United States Patent 11,459,587 (MATERIALS AND METHODS FOR TREATMENT OF PAIN RELATED DISORDERS) - sequence listing, part 3

SEQ ID NO: 22231 - DNA, 20 bp, Artificial Sequence
  Description of Artificial Sequence: Synthetic oligonucleotide
  Target: SCN9A; (-) strand; PAM type: NRG; PAM sequence: GAG
aacctgagggcttaaaacaa

SEQ ID NO: 22232 - DNA, 20 bp, Artificial Sequence
  Description of Artificial Sequence: Synthetic oligonucleotide
  Target: SCN9A; (-) strand; PAM type: NRG; PAM sequence: AAG
caaacctgagggcttaaaac

SEQ ID NO: 22233 - DNA, 20 bp, Artificial Sequence
  Description of Artificial Sequence: Synthetic oligonucleotide
  Target: SCN9A; (-) strand; PAM type: NRG; PAM sequence: GGG
acaggataatacaaacctga

SEQ ID NO: 22234 - DNA, 20 bp, Artificial Sequence
  Description of Artificial Sequence: Synthetic oligonucleotide
  Target: SCN9A; (-) strand; PAM type: NRG; PAM sequence: AGG
aacaggataatacaaacctg

SEQ ID NO: 22235 - DNA, 20 bp, Artificial Sequence
  Description of Artificial Sequence: Synthetic oligonucleotide
  Target: SCN9A; (-) strand; PAM type: NRG; PAM sequence: GAG
gaacaggataatacaaacct

SEQ ID NO: 22236 - DNA, 20 bp, Artificial Sequence
  Description of Artificial Sequence: Synthetic oligonucleotide
  Target: SCN9A; (-) strand; PAM type: NRG; PAM sequence: AGG
tttctttgacctacgagaac

SEQ ID NO: 22237 - DNA, 20 bp, Artificial Sequence
  Description of Artificial Sequence: Synthetic oligonucleotide
  Target: SCN9A; (-) strand; PAM type: NRG; PAM sequence: CAG
gtttctttgacctacgagaa

SEQ ID NO: 22238 - DNA, 20 bp, Artificial Sequence
  Description of Artificial Sequence: Synthetic oligonucleotide
  Target: SCN9A; (-) strand; PAM type: NRG; PAM sequence: GAG
tattagtttctttgacctac

SEQ ID NO: 22239 - DNA, 20 bp, Artificial Sequence
  Description of Artificial Sequence: Synthetic oligonucleotide
  Target: SCN9A; (-) strand; PAM type: NRG; PAM sequence: TAG
aatcttcacatcaactgtat

SEQ ID NO: 22240 - DNA, 20 bp, Artificial Sequence
  Description of Artificial Sequence: Synthetic oligonucleotide
  Target: SCN9A; (-) strand; PAM type: NRG; PAM sequence: GAG
cttgttgaatactgtaattt

SEQ ID NO: 22241 - DNA, 20 bp, Artificial Sequence
  Description of Artificial Sequence: Synthetic oligonucleotide
  Target: SCN9A; (-) strand; PAM type: NRG; PAM sequence: AAG
taacacaggtaatgaaaatt

SEQ ID NO: 22242 - DNA, 20 bp, Artificial Sequence
  Description of Artificial Sequence: Synthetic oligonucleotide
  Target: SCN9A; (-) strand; PAM type: NRG; PAM sequence: AGG
catagcagaataaataacac

SEQ ID NO: 22243 - DNA, 20 bp, Artificial Sequence
  Description of Artificial Sequence: Synthetic oligonucleotide
  Target: SCN9A; (-) strand; PAM type: NRG; PAM sequence: CAG
tcatagcagaataaataaca

SEQ ID NO: 22244 - DNA, 20 bp, Artificial Sequence
  Description of Artificial Sequence: Synthetic oligonucleotide
  Target: SCN9A; (-) strand; PAM type: NRG; PAM sequence: CAG
tcaaggagtttatgtcatag

SEQ ID NO: 22245 - DNA, 20 bp, Artificial Sequence
  Description of Artificial Sequence: Synthetic oligonucleotide
  Target: SCN9A; (-) strand; PAM type: NRG; PAM sequence: TAG
agctcaaggagtttatgtca

SEQ ID NO: 22246 - DNA, 20 bp, Artificial Sequence
  Description of Artificial Sequence: Synthetic oligonucleotide
  Target: SCN9A; (-) strand; PAM type: NRG; PAM sequence: GAG
atatggttcctgagctcaag

SEQ ID NO: 22247 - DNA, 20 bp, Artificial Sequence
  Description of Artificial Sequence: Synthetic oligonucleotide
  Target: SCN9A; (-) strand; PAM type: NRG; PAM sequence: AGG
agatatggttcctgagctca

SEQ ID NO: 22248 - DNA, 20 bp, Artificial Sequence
  Description of Artificial Sequence: Synthetic oligonucleotide
  Target: SCN9A; (-) strand; PAM type: NRG; PAM sequence: AAG
aagatatggttcctgagctc

SEQ ID NO: 22249 - DNA, 20 bp, Artificial Sequence
  Description of Artificial Sequence: Synthetic oligonucleotide
  Target: SCN9A; (-) strand; PAM type: NRG; PAM sequence: GAG
caacgtaagatatggttcct

SEQ ID NO: 22250 - DNA, 20 bp, Artificial Sequence
  Description of Artificial Sequence: Synthetic oligonucleotide
  Target: SCN9A; (-) strand; PAM type: NRG; PAM sequence: TGG
ggggagaccaacgtaagata

SEQ ID NO: 22251 - DNA, 20 bp, Artificial Sequence
  Description of Artificial Sequence: Synthetic oligonucleotide
  Target: SCN9A; (-) strand; PAM type: NRG; PAM sequence: AAG
gagcttggggagaccaacgt

SEQ ID NO: 22252 - DNA, 20 bp, Artificial Sequence
  Description of Artificial Sequence: Synthetic oligonucleotide
  Target: SCN9A; (-) strand; PAM type: NRG; PAM sequence: GAG
atattgggttggagcttggg

SEQ ID NO: 22253 - DNA, 20 bp, Artificial Sequence
  Description of Artificial Sequence: Synthetic oligonucleotide
  Target: SCN9A; (-) strand; PAM type: NRG; PAM sequence: GGG
atatattgggttggagcttg

SEQ ID NO: 22254 - DNA, 20 bp, Artificial Sequence
  Description of Artificial Sequence: Synthetic oligonucleotide
  Target: SCN9A; (-) strand; PAM type: NRG; PAM sequence: GGG
tatatattgggttggagctt

SEQ ID NO: 22255 - DNA, 20 bp, Artificial Sequence
  Description of Artificial Sequence: Synthetic oligonucleotide
  Target: SCN9A; (-) strand; PAM type: NRG; PAM sequence: TGG
atatatattgggttggagct

SEQ ID NO: 22256 - DNA, 20 bp, Artificial Sequence
  Description of Artificial Sequence: Synthetic oligonucleotide
  Target: SCN9A; (-) strand; PAM type: NRG; PAM sequence: GAG
gtgtaatatatattgggttg

SEQ ID NO: 22257 - DNA, 20 bp, Artificial Sequence
  Description of Artificial Sequence: Synthetic oligonucleotide
  Target: SCN9A; (-) strand; PAM type: NRG; PAM sequence: TGG
ttgtgtaatatatattgggt

SEQ ID NO: 22258 - DNA, 20 bp, Artificial Sequence
  Description of Artificial Sequence: Synthetic oligonucleotide
  Target: SCN9A; (-) strand; PAM type: NRG; PAM sequence: GGG
tattttgtgtaatatatatt

SEQ ID NO: 22259 - DNA, 20 bp, Artificial Sequence
  Description of Artificial Sequence: Synthetic oligonucleotide
  Target: SCN9A; (-) strand; PAM type: NRG; PAM sequence: TGG
ttattttgtgtaatatatat

SEQ ID NO: 22260 - DNA, 20 bp, Artificial Sequence
  Description of Artificial Sequence: Synthetic oligonucleotide
  Target: SCN9A; (-) strand; PAM type: NRG; PAM sequence: TAG
ttcaaaacacattttataag

SEQ ID NO: 22261 - DNA, 20 bp, Artificial Sequence
  Description of Artificial Sequence: Synthetic oligonucleotide
  Target: SCN9A; (-) strand; PAM type: NRG; PAM sequence: AAG
ttattcaaaacacattttat

SEQ ID NO: 22262 - DNA, 20 bp, Artificial Sequence
  Description of Artificial Sequence: Synthetic oligonucleotide
  Target: SCN9A; (-) strand; PAM type: NRG; PAM sequence: AAG
ctatagaggattgaataatt

SEQ ID NO: 22263 - DNA, 20 bp, Artificial Sequence
  Description of Artificial Sequence: Synthetic oligonucleotide
  Target: SCN9A; (-) strand; PAM type: NRG; PAM sequence: AGG
ttttccaatgtttcctatag

SEQ ID NO: 22264 - DNA, 20 bp, Artificial Sequence
  Description of Artificial Sequence: Synthetic oligonucleotide
  Target: SCN9A; (-) strand; PAM type: NRG; PAM sequence: GAG
tttttccaatgtttcctata

SEQ ID NO: 22265 - DNA, 20 bp, Artificial Sequence
  Description of Artificial Sequence: Synthetic oligonucleotide
  Target: SCN9A; (-) strand; PAM type: NRG; PAM sequence: TAG
gttttttccaatgtttccta

SEQ ID NO: 22266 - DNA, 20 bp, Artificial Sequence
  Description of Artificial Sequence: Synthetic oligonucleotide
  Target: SCN9A; (-) strand; PAM type: NRG; PAM sequence: GAG
aggttaaacccataggtttt

SEQ ID NO: 22267 - DNA, 20 bp, Artificial Sequence
  Description of Artificial Sequence: Synthetic oligonucleotide
  Target: SCN9A; (-) strand; PAM type: NRG; PAM sequence: AGG
atgatttaggttaaacccat

SEQ ID NO: 22268 - DNA, 20 bp, Artificial Sequence
  Description of Artificial Sequence: Synthetic oligonucleotide
  Target: SCN9A; (-) strand; PAM type: NRG; PAM sequence: TAG
tatgatttaggttaaaccca

SEQ ID NO: 22269 - DNA, 20 bp, Artificial Sequence
  Description of Artificial Sequence: Synthetic oligonucleotide
  Target: SCN9A; (-) strand; PAM type: NRG; PAM sequence: AGG
ttctggctaacttatgattt

SEQ ID NO: 22270 - DNA, 20 bp, Artificial Sequence
  Description of Artificial Sequence: Synthetic oligonucleotide
  Target: SCN9A; (-) strand; PAM type: NRG; PAM sequence: TAG
gttctggctaacttatgatt

SEQ ID NO: 22271 - DNA, 20 bp, Artificial Sequence
  Description of Artificial Sequence: Synthetic oligonucleotide
  Target: SCN9A; (-) strand; PAM type: NRG; PAM sequence: TGG
attttctaaataataggttc

SEQ ID NO: 22272 - DNA, 20 bp, Artificial Sequence
  Description of Artificial Sequence: Synthetic oligonucleotide
  Target: SCN9A; (-) strand; PAM type: NRG; PAM sequence: AGG
aaaacaattttctaaataat

SEQ ID NO: 22273 - DNA, 20 bp, Artificial Sequence
  Description of Artificial Sequence: Synthetic oligonucleotide
  Target: SCN9A; (-) strand; PAM type: NRG; PAM sequence: TAG
gaaaacaattttctaaataa

SEQ ID NO: 22274 - DNA, 20 bp, Artificial Sequence
  Description of Artificial Sequence: Synthetic oligonucleotide
  Target: SCN9A; (-) strand; PAM type: NRG; PAM sequence: CAG
taatcttattcatttttgca

SEQ ID NO: 22275 - DNA, 20 bp, Artificial Sequence
  Description of Artificial Sequence: Synthetic oligonucleotide
  Target: SCN9A; (-) strand; PAM type: NRG; PAM sequence: TAG
ttatttttcaaataattgac

SEQ ID NO: 22276 - DNA, 20 bp, Artificial Sequence
  Description of Artificial Sequence: Synthetic oligonucleotide
  Target: SCN9A; (-) strand; PAM type: NRG; PAM sequence: TAG
caattcatgattaattttat

SEQ ID NO: 22277 - DNA, 20 bp, Artificial Sequence
  Description of Artificial Sequence: Synthetic oligonucleotide
  Target: SCN9A; (-) strand; PAM type: NRG; PAM sequence: AAG
tttccaaaaaagataatgta

SEQ ID NO: 22278 - DNA, 20 bp, Artificial Sequence
  Description of Artificial Sequence: Synthetic oligonucleotide
  Target: SCN9A; (-) strand; PAM type: NRG; PAM sequence: AAG
tgaacaattattttccaaaa

SEQ ID NO: 22279 - DNA, 20 bp, Artificial Sequence
  Description of Artificial Sequence: Synthetic oligonucleotide
  Target: SCN9A; (-) strand; PAM type: NRG; PAM sequence: GGG
tatttttcattgtaatgaaa

SEQ ID NO: 22280 - DNA, 20 bp, Artificial Sequence
  Description of Artificial Sequence: Synthetic oligonucleotide
  Target: SCN9A; (-) strand; PAM type: NRG; PAM sequence: AGG
atatttttcattgtaatgaa

SEQ ID NO: 22281 - DNA, 20 bp, Artificial Sequence
  Description of Artificial Sequence: Synthetic oligonucleotide
  Target: SCN9A; (-) strand; PAM type: NRG; PAM sequence: AAG
aatatttttcattgtaatga

SEQ ID NO: 22282 - DNA, 20 bp, Artificial Sequence
  Description of Artificial Sequence: Synthetic oligonucleotide
  Target: SCN9A; (-) strand; PAM type: NRG; PAM sequence: AAG
aaccaacagaaaaagaagat

SEQ ID NO: 22283 - DNA, 20 bp, Artificial Sequence
  Description of Artificial Sequence: Synthetic oligonucleotide
  Target: SCN9A; (-) strand; PAM type: NRG; PAM sequence: AAG
atttcaaccaacagaaaaag

SEQ ID NO: 22284 - DNA, 20 bp, Artificial Sequence
  Description of Artificial Sequence: Synthetic oligonucleotide
  Target: SCN9A; (-) strand; PAM type: NRG; PAM sequence: AAG
ataatttcaaccaacagaaa

SEQ ID NO: 22285 - DNA, 20 bp, Artificial Sequence
  Description of Artificial Sequence: Synthetic oligonucleotide
  Target: SCN9A; (-) strand; PAM type: NRG; PAM sequence: CAG
tcatagataatttcaaccaa

SEQ ID NO: 22286 - DNA, 20 bp, Artificial Sequence
  Description of Artificial Sequence: Synthetic oligonucleotide
  Target: SCN9A; (-) strand; PAM type: NRG; PAM sequence: TAG
cttgttcattggtgtcatca

SEQ ID NO: 22287 - DNA, 20 bp, Artificial Sequence
  Description of Artificial Sequence: Synthetic oligonucleotide
  Target: SCN9A; (-) strand; PAM type: NRG; PAM sequence: TGG
ttcactttgaacttgttcat

SEQ ID NO: 22288 - DNA, 20 bp, Artificial Sequence
  Description of Artificial Sequence: Synthetic oligonucleotide
  Target: SCN9A; (-) strand; PAM type: NRG; PAM sequence: GGG
ttgtcgtctttatcatcttt

SEQ ID NO: 22289 - DNA, 20 bp, Artificial Sequence
  Description of Artificial Sequence: Synthetic oligonucleotide
  Target: SCN9A; (-) strand; PAM type: NRG; PAM sequence: TGG
tttgtcgtctttatcatctt

SEQ ID NO: 22290 - DNA, 20 bp, Artificial Sequence
  Description of Artificial Sequence: Synthetic oligonucleotide
  Target: SCN9A; (-) strand; PAM type: NRG; PAM sequence: TAG
aagcagcccaaatatgaata

SEQ ID NO: 22291 - DNA, 20 bp, Artificial Sequence
  Description of Artificial Sequence: Synthetic oligonucleotide
  Target: SCN9A; (-) strand; PAM type: NRG; PAM sequence: CAG
aaattttataggtagacaag

SEQ ID NO: 22292 - DNA, 20 bp, Artificial Sequence
  Description of Artificial Sequence: Synthetic oligonucleotide
  Target: SCN9A; (-) strand; PAM type: NRG; PAM sequence: AAG
tgtaaattttataggtagac

SEQ ID NO: 22293 - DNA, 20 bp, Artificial Sequence
  Description of Artificial Sequence: Synthetic oligonucleotide
  Target: SCN9A; (-) strand; PAM type: NRG; PAM sequence: TAG
acttttgtaaattttatagg

SEQ ID NO: 22294 - DNA, 20 bp, Artificial Sequence
  Description of Artificial Sequence: Synthetic oligonucleotide
  Target: SCN9A; (-) strand; PAM type: NRG; PAM sequence: AGG
ctaacttttgtaaattttat

SEQ ID NO: 22295 - DNA, 20 bp, Artificial Sequence
  Description of Artificial Sequence: Synthetic oligonucleotide
  Target: SCN9A; (-) strand; PAM type: NRG; PAM sequence: TAG
gctaacttttgtaaatttta

SEQ ID NO: 22296 - DNA, 20 bp, Artificial Sequence
  Description of Artificial Sequence: Synthetic oligonucleotide
  Target: SCN9A; (-) strand; PAM type: NRG; PAM sequence: AAG
cctggtcaaaccatgtgaaa

SEQ ID NO: 22297 - DNA, 20 bp, Artificial Sequence
  Description of Artificial Sequence: Synthetic oligonucleotide
  Target: SCN9A; (-) strand; PAM type: NRG; PAM sequence: TGG
atagcactgtttgaattacc

SEQ ID NO: 22298 - DNA, 20 bp, Artificial Sequence
  Description of Artificial Sequence: Synthetic oligonucleotide
  Target: SCN9A; (-) strand; PAM type: NRG; PAM sequence: TAG
aatcctatgtttacctagga

SEQ ID NO: 22299 - DNA, 20 bp, Artificial Sequence
  Description of Artificial Sequence: Synthetic oligonucleotide
  Target: SCN9A; (-) strand; PAM type: NRG; PAM sequence: AGG
cttaaatcctatgtttacct

SEQ ID NO: 22300 - DNA, 20 bp, Artificial Sequence
  Description of Artificial Sequence: Synthetic oligonucleotide
  Target: SCN9A; (-) strand; PAM type: NRG; PAM sequence: TAG
tcttaaatcctatgtttacc

SEQ ID NO: 22301 - DNA, 20 bp, Artificial Sequence
  Description of Artificial Sequence: Synthetic oligonucleotide
  Target: SCN9A; (-) strand; PAM type: NRG; PAM sequence: TGG
gttaaacctcaacaatgcta

SEQ ID NO: 22302 - DNA, 20 bp, Artificial Sequence
  Description of Artificial Sequence: Synthetic oligonucleotide
  Target: SCN9A; (-) strand; PAM type: NRG; PAM sequence: GAG
catgttgaataaattgttaa

SEQ ID NO: 22303 - DNA, 20 bp, Artificial Sequence
  Description of Artificial Sequence: Synthetic oligonucleotide
  Target: SCN9A; (-) strand; PAM type: NRG; PAM sequence: AAG
tacatgttgaataaattgtt

SEQ ID NO: 22304 - DNA, 20 bp, Artificial Sequence
  Description of Artificial Sequence: Synthetic oligonucleotide
  Target: SCN9A; (-) strand; PAM type: NRG; PAM sequence: AAG
tatgtaataaattaaataat

SEQ ID NO: 22305 - DNA, 20 bp, Artificial Sequence
  Description of Artificial Sequence: Synthetic oligonucleotide
  Target: SCN9A; (-) strand; PAM type: NRG; PAM sequence: AAG
gattatattatttattacat

SEQ ID NO: 22306 - DNA, 20 bp, Artificial Sequence
  Description of Artificial Sequence: Synthetic oligonucleotide
  Target: SCN9A; (-) strand; PAM type: NRG; PAM sequence: AAG
aagccctttgtagttatttg

SEQ ID NO: 22307 - DNA, 20 bp, Artificial Sequence
  Description of Artificial Sequence: Synthetic oligonucleotide
  Target: SCN9A; (-) strand; PAM type: NRG; PAM sequence: TAG
gcatatgattaagccctttg

SEQ ID NO: 22308 - DNA, 20 bp, Artificial Sequence
  Description of Artificial Sequence: Synthetic oligonucleotide
  Target: SCN9A; (-) strand; PAM type: NRG; PAM sequence: AAG
gcacaaatatgcatatgatt

SEQ ID NO: 22309 - DNA, 20 bp, Artificial Sequence
  Description of Artificial Sequence: Synthetic oligonucleotide
  Target: SCN9A; (-) strand; PAM type: NRG; PAM sequence: GAG
ttgaattttcctaccaatat

SEQ ID NO: 22310 - DNA, 20 bp, Artificial Sequence
  Description of Artificial Sequence: Synthetic oligonucleotide
  Target: SCN9A; (-) strand; PAM type: NRG; PAM sequence: TAG
catatacatagtatgtcact

SEQ ID NO: 22311 - DNA, 20 bp, Artificial Sequence
  Description of Artificial Sequence: Synthetic oligonucleotide
  Target: SCN9A; (-) strand; PAM type: NRG; PAM sequence: TAG
ttttggaaataacatataca

SEQ ID NO: 22312 - DNA, 20 bp, Artificial Sequence
  Description of Artificial Sequence: Synthetic oligonucleotide
  Target: SCN9A; (-) strand; PAM type: NRG; PAM sequence: TGG
tgtctcatttacagtacttt

SEQ ID NO: 22313 - DNA, 20 bp, Artificial Sequence
  Description of Artificial Sequence: Synthetic oligonucleotide
  Target: SCN9A; (-) strand; PAM type: NRG; PAM sequence: CAG
atatgataatgtctcattta

SEQ ID NO: 22314 - DNA, 20 bp, Artificial Sequence
  Description of Artificial Sequence: Synthetic oligonucleotide
  Target: SCN9A; (-) strand; PAM type: NRG; PAM sequence: TGG
cggaatcaaaagaaaataca

SEQ ID NO: 22315 - DNA, 20 bp, Artificial Sequence
  Description of Artificial Sequence: Synthetic oligonucleotide
  Target: SCN9A; (-) strand; PAM type: NRG; PAM sequence: AAG
aaagatgtattcggaatcaa

SEQ ID NO: 22316 - DNA, 20 bp, Artificial Sequence
  Description of Artificial Sequence: Synthetic oligonucleotide
  Target: SCN9A; (-) strand; PAM type: NRG; PAM sequence: CGG
aaatataataaagatgtatt

SEQ ID NO: 22317 - DNA, 20 bp, Artificial Sequence
  Description of Artificial Sequence: Synthetic oligonucleotide
  Target: SCN9A; (-) strand; PAM type: NRG; PAM sequence: AAG
tatttttacaaaatataata

SEQ ID NO: 22318 - DNA, 20 bp, Artificial Sequence
  Description of Artificial Sequence: Synthetic oligonucleotide
  Target: SCN9A; (-) strand; PAM type: NRG; PAM sequence: AGG
aactttaatgattactccct

SEQ ID NO: 22319 - DNA, 20 bp, Artificial Sequence
  Description of Artificial Sequence: Synthetic oligonucleotide
  Target: SCN9A; (-) strand; PAM type: NRG; PAM sequence: TAG
aaactttaatgattactccc

SEQ ID NO: 22320 - DNA, 20 bp, Artificial Sequence
  Description of Artificial Sequence: Synthetic oligonucleotide
  Target: SCN9A; (-) strand; PAM type: NRG; PAM sequence: AAG
tgtgaaataagttccatgct

SEQ ID NO: 22321 - DNA, 20 bp, Artificial Sequence
  Description of Artificial Sequence: Synthetic oligonucleotide
  Target: SCN9A; (-) strand; PAM type: NRG; PAM sequence: AAG
tggatgagtttatgtgaaat

SEQ ID NO: 22322 - DNA, 20 bp, Artificial Sequence
  Description of Artificial Sequence: Synthetic oligonucleotide
  Target: SCN9A; (-) strand; PAM type: NRG; PAM sequence: GAG
cagtttaaaacaccttggat

SEQ ID NO: 22323 - DNA, 20 bp, Artificial Sequence
  Description of Artificial Sequence: Synthetic oligonucleotide
  Target: SCN9A; (-) strand; PAM type: NRG; PAM sequence: TGG
ttttacagtttaaaacacct

SEQ ID NO: 22324 - DNA, 20 bp, Artificial Sequence
  Description of Artificial Sequence: Synthetic oligonucleotide
  Target: SCN9A; (-) strand; PAM type: NRG; PAM sequence: CAG
tatagcttttactgttttta

SEQ ID NO: 22325 - DNA, 20 bp, Artificial Sequence
  Description of Artificial Sequence: Synthetic oligonucleotide
  Target: SCN9A; (-) strand; PAM type: NRG; PAM sequence: TAG
aataaaataattttaatgta

SEQ ID NO: 22326 - DNA, 20 bp, Artificial Sequence
  Description of Artificial Sequence: Synthetic oligonucleotide
  Target: SCN9A; (-) strand; PAM type: NRG; PAM sequence: CAG
ggctggcattactaaatgct

SEQ ID NO: 22327 - DNA, 20 bp, Artificial Sequence
  Description of Artificial Sequence: Synthetic oligonucleotide
  Target: SCN9A; (-) strand; PAM type: NRG; PAM sequence: TGG
gcagggcacttagtgcaggc

SEQ ID NO: 22328 - DNA, 20 bp, Artificial Sequence
  Description of Artificial Sequence: Synthetic oligonucleotide
  Target: SCN9A; (-) strand; PAM type: NRG; PAM sequence: AGG
agaagcagggcacttagtgc

SEQ ID NO: 22329 - DNA, 20 bp, Artificial Sequence
  Description of Artificial Sequence: Synthetic oligonucleotide
  Target: SCN9A; (-) strand; PAM type: NRG; PAM sequence: CAG
tagaagcagggcacttagtg

SEQ ID NO: 22330 - DNA, 20 bp, Artificial Sequence
  Description of Artificial Sequence: Synthetic oligonucleotide
  Target: SCN9A; (-) strand; PAM type: NRG; PAM sequence: TAG
gaaaatagaagcagggcact

SEQ ID NO: 22331 - DNA, 20 bp, Artificial Sequence
  Description of Artificial Sequence: Synthetic oligonucleotide
  Target: SCN9A; (-) strand; PAM type: NRG; PAM sequence: GGG
ccaacaagaaaatagaagca

SEQ ID NO: 22332 - DNA, 20 bp, Artificial Sequence
  Description of Artificial Sequence: Synthetic oligonucleotide
  Target: SCN9A; (-) strand; PAM type: NRG; PAM sequence: AGG
cccaacaagaaaatagaagc

SEQ ID NO: 22333 - DNA, 20 bp, Artificial Sequence
  Description of Artificial Sequence: Synthetic oligonucleotide
  Target: SCN9A; (-) strand; PAM type: NRG; PAM sequence: CAG
acccaacaagaaaatagaag

SEQ ID NO: 22334 - DNA, 20 bp, Artificial Sequence
  Description of Artificial Sequence: Synthetic oligonucleotide
  Target: SCN9A; (-) strand; PAM type: NRG; PAM sequence: AAG
aggacccaacaagaaaatag

SEQ ID NO: 22335 - DNA, 20 bp, Artificial Sequence
  Description of Artificial Sequence: Synthetic oligonucleotide
  Target: SCN9A; (-) strand; PAM type: NRG; PAM sequence: TAG
gtgaggacccaacaagaaaa

SEQ ID NO: 22336 - DNA, 20 bp, Artificial Sequence
  Description of Artificial Sequence: Synthetic oligonucleotide
  Target: SCN9A; (-) strand; PAM type: NRG; PAM sequence: AAG
tagtgttgtgaggacccaac

SEQ ID NO: 22337 - DNA, 20 bp, Artificial Sequence
  Description of Artificial Sequence: Synthetic oligonucleotide
  Target: SCN9A; (-) strand; PAM type: NRG; PAM sequence: AGG
gcctactccatagtgttgtg

SEQ ID NO: 22338 - DNA, 20 bp, Artificial Sequence
  Description of Artificial Sequence: Synthetic oligonucleotide
  Target: SCN9A; (-) strand; PAM type: NRG; PAM sequence: GAG
tgcctactccatagtgttgt

SEQ ID NO: 22339 - DNA, 20 bp, Artificial Sequence
  Description of Artificial Sequence: Synthetic oligonucleotide
  Target: SCN9A; (-) strand; PAM type: NRG; PAM sequence: TAG
atcatccaatgcctactcca

SEQ ID NO: 22340 - DNA, 20 bp, Artificial Sequence
  Description of Artificial Sequence: Synthetic oligonucleotide
  Target: SCN9A; (-) strand; PAM type: NRG; PAM sequence: TAG
taccttaccttcttgagact

SEQ ID NO: 22341 - DNA, 20 bp, Artificial Sequence
  Description of Artificial Sequence: Synthetic oligonucleotide
  Target: SCN9A; (-) strand; PAM type: NRG; PAM sequence: GAG
gcaaattaccttaccttctt

SEQ ID NO: 22342 - DNA, 20 bp, Artificial Sequence
  Description of Artificial Sequence: Synthetic oligonucleotide
  Target: SCN9A; (-) strand; PAM type: NRG; PAM sequence: GGG
caagctctacaactgacttc

SEQ ID NO: 22343 - DNA, 20 bp, Artificial Sequence
  Description of Artificial Sequence: Synthetic oligonucleotide
  Target: SCN9A; (-) strand; PAM type: NRG; PAM sequence: CGG
ccaagctctacaactgactt

SEQ ID NO: 22344 - DNA, 20 bp, Artificial Sequence
  Description of Artificial Sequence: Synthetic oligonucleotide
  Target: SCN9A; (-) strand; PAM type: NRG; PAM sequence: AAG
ctagctgtaccatatcatcc

SEQ ID NO: 22345 - DNA, 20 bp, Artificial Sequence
  Description of Artificial Sequence: Synthetic oligonucleotide
  Target: SCN9A; (-) strand; PAM type: NRG; PAM sequence: TAG
atagagcctgattcaaattc

SEQ ID NO: 22346 - DNA, 20 bp, Artificial Sequence
  Description of Artificial Sequence: Synthetic oligonucleotide
  Target: SCN9A; (-) strand; PAM type: NRG; PAM sequence: GAG
gagtacagcagttggagata

SEQ ID NO: 22347 - DNA, 20 bp, Artificial Sequence
  Description of Artificial Sequence: Synthetic oligonucleotide
  Target: SCN9A; (-) strand; PAM type: NRG; PAM sequence: TAG
gtgagtacagcagttggaga

SEQ ID NO: 22348 - DNA, 20 bp, Artificial Sequence
  Description of Artificial Sequence: Synthetic oligonucleotide
  Target: SCN9A; (-) strand; PAM type: NRG; PAM sequence: GAG
ggttgtgagtacagcagttg

SEQ ID NO: 22349 - DNA, 20 bp, Artificial Sequence
  Description of Artificial Sequence: Synthetic oligonucleotide
  Target: SCN9A; (-) strand; PAM type: NRG; PAM sequence: TGG
gtggttgtgagtacagcagt

SEQ ID NO: 22350 - DNA, 20 bp, Artificial Sequence
  Description of Artificial Sequence: Synthetic oligonucleotide
  Target: SCN9A; (-) strand; PAM type: NRG; PAM sequence: CAG
cctagtggttgtgagtacag

SEQ ID NO: 22351 - DNA, 20 bp, Artificial Sequence
  Description of Artificial Sequence: Synthetic oligonucleotide
  Target: SCN9A; (-) strand; PAM type: NRG; PAM sequence: CAG
tagcctagtggttgtgagta

SEQ ID NO: 22352 - DNA, 20 bp, Artificial Sequence
  Description of Artificial Sequence: Synthetic oligonucleotide
  Target: SCN9A; (-) strand; PAM type: NRG; PAM sequence: GAG
gatagtagcctagtggttgt

SEQ ID NO: 22353 - DNA, 20 bp, Artificial Sequence
  Description of Artificial Sequence: Synthetic oligonucleotide
  Target: SCN9A; (-) strand; PAM type: NRG; PAM sequence: TGG
tccacctgatagtagcctag

SEQ ID NO: 22354 - DNA, 20 bp, Artificial Sequence
  Description of Artificial Sequence: Synthetic oligonucleotide
  Target: SCN9A; (-) strand; PAM type: NRG; PAM sequence: TAG
acatccacctgatagtagcc

SEQ ID NO: 22355 - DNA, 20 bp, Artificial Sequence
  Description of Artificial Sequence: Synthetic oligonucleotide
  Target: SCN9A; (-) strand; PAM type: NRG; PAM sequence: TAG
gaagaacatccacctgatag

SEQ ID NO: 22356 - DNA, 20 bp, Artificial Sequence
  Description of Artificial Sequence: Synthetic oligonucleotide
  Target: SCN9A; (-) strand; PAM type: NRG; PAM sequence: TAG
aatgaagaacatccacctga

SEQ ID NO: 22357 - DNA, 20 bp, Artificial Sequence
  Description of Artificial Sequence: Synthetic oligonucleotide
  Target: SCN9A; (-) strand; PAM type: NRG; PAM sequence: AAG
tgggactcacatagacaatg

SEQ ID NO: 22358 - DNA, 20 bp, Artificial Sequence
  Description of Artificial Sequence: Synthetic oligonucleotide
  Target: SCN9A; (-) strand; PAM type: NRG; PAM sequence: TAG
tgaagcccttgggactcaca

SEQ ID NO: 22359 - DNA, 20 bp, Artificial Sequence
  Description of Artificial Sequence: Synthetic oligonucleotide
  Target: SCN9A; (-) strand; PAM type: NRG; PAM sequence: GGG
tataacttcatgaagccctt

SEQ ID NO: 22360 - DNA, 20 bp, Artificial Sequence
  Description of Artificial Sequence: Synthetic oligonucleotide
  Target: SCN9A; (-) strand; PAM type: NRG; PAM sequence: TGG
ctataacttcatgaagccct

SEQ ID NO: 22361 - DNA, 20 bp, Artificial Sequence
  Description of Artificial Sequence: Synthetic oligonucleotide
  Target: SCN9A; (-) strand; PAM type: NRG; PAM sequence: AAG
ttccaaactataacttcatg

SEQ ID NO: 22362 - DNA, 20 bp, Artificial Sequence
  Description of Artificial Sequence: Synthetic oligonucleotide
  Target: SCN9A; (-) strand; PAM type: NRG; PAM sequence: CAG
aaaagcttcttagtttattt

SEQ ID NO: 22363 - DNA, 20 bp, Artificial Sequence
  Description of Artificial Sequence: Synthetic oligonucleotide
  Target: SCN9A; (-) strand; PAM type: NRG; PAM sequence: TAG
ctttatttttaaaagcttct

SEQ ID NO: 22364 - DNA, 20 bp, Artificial Sequence
  Description of Artificial Sequence: Synthetic oligonucleotide
  Target: SCN9A; (-) strand; PAM type: NRG; PAM sequence: AAG
gcactaaactttatttttaa

SEQ ID NO: 22365 - DNA, 20 bp, Artificial Sequence
  Description of Artificial Sequence: Synthetic oligonucleotide
  Target: SCN9A; (-) strand; PAM type: NRG; PAM sequence: TAG
aatgtaagtattgattatct

SEQ ID NO: 22366 - DNA, 20 bp, Artificial Sequence
  Description of Artificial Sequence: Synthetic oligonucleotide
  Target: SCN9A; (-) strand; PAM type: NRG; PAM sequence: AAG
gcagtggattctgttaatgt

SEQ ID NO: 22367 - DNA, 20 bp, Artificial Sequence
  Description of Artificial Sequence: Synthetic oligonucleotide
  Target: SCN9A; (-) strand; PAM type: NRG; PAM sequence: TGG
gattattatgtatgcagcag

SEQ ID NO: 22368 - DNA, 20 bp, Artificial Sequence
  Description of Artificial Sequence: Synthetic oligonucleotide
  Target: SCN9A; (-) strand; PAM type: NRG; PAM sequence: CAG
gacgattattatgtatgcag

SEQ ID NO: 22369 - DNA, 20 bp, Artificial Sequence
  Description of Artificial Sequence: Synthetic oligonucleotide
  Target: SCN9A; (-) strand; PAM type: NRG; PAM sequence: CAG
atggacgattattatgtatg

SEQ ID NO: 22370 - DNA, 20 bp, Artificial Sequence
  Description of Artificial Sequence: Synthetic oligonucleotide
  Target: SCN9A; (-) strand; PAM type: NRG; PAM sequence: TGG
taaaggcaacttttaaggga

SEQ ID NO: 22371 - DNA, 20 bp, Artificial Sequence
  Description of Artificial Sequence: Synthetic oligonucleotide
  Target: SCN9A; (-) strand; PAM type: NRG; PAM sequence: GGG
ttcttaaaggcaacttttaa

SEQ ID NO: 22372 - DNA, 20 bp, Artificial Sequence
  Description of Artificial Sequence: Synthetic oligonucleotide
  Target: SCN9A; (-) strand; PAM type: NRG; PAM sequence: AGG
attcttaaaggcaactttta

SEQ ID NO: 22373 - DNA, 20 bp, Artificial Sequence
  Description of Artificial Sequence: Synthetic oligonucleotide
  Target: SCN9A; (-) strand; PAM type: NRG; PAM sequence: AAG
tattcttaaaggcaactttt

SEQ ID NO: 22374 - DNA, 20 bp, Artificial Sequence
  Description of Artificial Sequence: Synthetic oligonucleotide
  Target: SCN9A; (-) strand; PAM type: NRG; PAM sequence: AGG
tctattaatgttattcttaa

SEQ ID NO: 22375 - DNA, 20 bp, Artificial Sequence
  Description of Artificial Sequence: Synthetic oligonucleotide
  Target: SCN9A; (-) strand; PAM type: NRG; PAM sequence: AAG
ttctattaatgttattctta

SEQ ID NO: 22376 - DNA, 20 bp, Artificial Sequence
  Description of Artificial Sequence: Synthetic oligonucleotide
  Target: SCN9A; (-) strand; PAM type: NRG; PAM sequence: GAG
ttatggctattttagaatat

SEQ ID NO: 22377 - DNA, 20 bp, Artificial Sequence
  Description of Artificial Sequence: Synthetic oligonucleotide
  Target: SCN9A; (-) strand; PAM type: NRG; PAM sequence: TAG
aactctgtttatggctattt

SEQ ID NO: 22378 - DNA, 20 bp, Artificial Sequence
  Description of Artificial Sequence: Synthetic oligonucleotide
  Target: SCN9A; (-) strand; PAM type: NRG; PAM sequence: TGG
aacagacaaaactctgttta

SEQ ID NO: 22379 - DNA, 20 bp, Artificial Sequence
  Description of Artificial Sequence: Synthetic oligonucleotide
  Target: SCN9A; (-) strand; PAM type: NRG; PAM sequence: CAG
ataattgtggtaacattaaa

SEQ ID NO: 22380 - DNA, 20 bp, Artificial Sequence
  Description of Artificial Sequence: Synthetic oligonucleotide
  Target: SCN9A; (-) strand; PAM type: NRG; PAM sequence: TGG
ctagtattacttaataattg

SEQ ID NO: 22381 - DNA, 20 bp, Artificial Sequence
  Description of Artificial Sequence: Synthetic oligonucleotide
  Target: SCN9A; (-) strand; PAM type: NRG; PAM sequence: TAG
ttgaatacagcaaaacttac

SEQ ID NO: 22382 - DNA, 20 bp, Artificial Sequence
  Description of Artificial Sequence: Synthetic oligonucleotide
  Target: SCN9A; (-) strand; PAM type: NRG; PAM sequence: CAG
ttaaatggacatgttgaata

SEQ ID NO: 22383 - DNA, 20 bp, Artificial Sequence
  Description of Artificial Sequence: Synthetic oligonucleotide
  Target: SCN9A; (-) strand; PAM type: NRG; PAM sequence: TGG
aaaaaaatctttacattaaa

SEQ ID NO: 22384 - DNA, 20 bp, Artificial Sequence
  Description of Artificial Sequence: Synthetic oligonucleotide
  Target: SCN9A; (-) strand; PAM type: NRG; PAM sequence: GGG
taagatttagaatgttactt

SEQ ID NO: 22385 - DNA, 20 bp, Artificial Sequence
  Description of Artificial Sequence: Synthetic oligonucleotide
  Target: SCN9A; (-) strand; PAM type: NRG; PAM sequence: TGG
ctaagatttagaatgttact

SEQ ID NO: 22386 - DNA, 20 bp, Artificial Sequence
  Description of Artificial Sequence: Synthetic oligonucleotide
  Target: SCN9A; (-) strand; PAM type: NRG; PAM sequence: TAG
aattaactgggactaagatt

SEQ ID NO: 22387 - DNA, 20 bp, Artificial Sequence
  Description of Artificial Sequence: Synthetic oligonucleotide
  Target: SCN9A; (-) strand; PAM type: NRG; PAM sequence: AAG
agaaataattaactgggact

SEQ ID NO: 22388 - DNA, 20 bp, Artificial Sequence
  Description of Artificial Sequence: Synthetic oligonucleotide
  Target: SCN9A; (-) strand; PAM type: NRG; PAM sequence: GGG
caatttagaaataattaact

SEQ ID NO: 22389 - DNA, 20 bp, Artificial Sequence
  Description of Artificial Sequence: Synthetic oligonucleotide
  Target: SCN9A; (-) strand; PAM type: NRG; PAM sequence: TGG
acaatttagaaataattaac

SEQ ID NO: 22390 - DNA, 20 bp, Artificial Sequence
  Description of Artificial Sequence: Synthetic oligonucleotide
  Target: SCN9A; (-) strand; PAM type: NRG; PAM sequence: TAG
cacaggcaactgtaacaatt

SEQ ID NO: 22391 - DNA, 20 bp, Artificial Sequence
  Description of Artificial Sequence: Synthetic oligonucleotide
  Target: SCN9A; (-) strand; PAM type: NRG; PAM sequence: AGG
aggttatgtgcgaaattcac

SEQ ID NO: 22392 - DNA, 20 bp, Artificial Sequence
  Description of Artificial Sequence: Synthetic oligonucleotide
  Target: SCN9A; (-) strand; PAM type: NRG; PAM sequence: CAG
aaggttatgtgcgaaattca

SEQ ID NO: 22393 - DNA, 20 bp, Artificial Sequence
  Description of Artificial Sequence: Synthetic oligonucleotide
  Target: SCN9A; (-) strand; PAM type: NRG; PAM sequence: AGG
cttcacctttaaaaaataaa

SEQ ID NO: 22394 - DNA, 20 bp, Artificial Sequence
  Description of Artificial Sequence: Synthetic oligonucleotide
  Target: SCN9A; (-) strand; PAM type: NRG; PAM sequence: AAG
ccttcacctttaaaaaataa

SEQ ID NO: 22395 - DNA, 20 bp, Artificial Sequence
  Description of Artificial Sequence: Synthetic oligonucleotide
  Target: SCN9A; (-) strand; PAM type: NRG; PAM sequence: AAG
accctttaaaaaatggagaa

SEQ ID NO: 22396 - DNA, 20 bp, Artificial Sequence
  Description of Artificial Sequence: Synthetic oligonucleotide
  Target: SCN9A; (-) strand; PAM type: NRG; PAM sequence: GAG
ggagaaccctttaaaaaatg

SEQ ID NO: 22397 - DNA, 20 bp, Artificial Sequence
  Description of Artificial Sequence: Synthetic oligonucleotide
  Target: SCN9A; (-) strand; PAM type: NRG; PAM sequence: TGG
atggagaaccctttaaaaaa

SEQ ID NO: 22398 - DNA, 20 bp, Artificial Sequence
  Description of Artificial Sequence: Synthetic oligonucleotide
  Target: SCN9A; (-) strand; PAM type: NRG; PAM sequence: GAG
aggaacttcccacaggcatg

SEQ ID NO: 22399 - DNA, 20 bp, Artificial Sequence
  Description of Artificial Sequence: Synthetic oligonucleotide
  Target: SCN9A; (-) strand; PAM type: NRG; PAM sequence: TGG
agaggaacttcccacaggca

SEQ ID NO: 22400 - DNA, 20 bp, Artificial Sequence
  Description of Artificial Sequence: Synthetic oligonucleotide
  Target: SCN9A; (-) strand; PAM type: NRG; PAM sequence: AGG
ggatgagaggaacttcccac

SEQ ID NO: 22401 - DNA, 20 bp, Artificial Sequence
  Description of Artificial Sequence: Synthetic oligonucleotide
  Target: SCN9A; (-) strand; PAM type: NRG; PAM sequence: CAG
gggatgagaggaacttccca

SEQ ID NO: 22402 - DNA, 20 bp, Artificial Sequence
  Description of Artificial Sequence: Synthetic oligonucleotide
  Target: SCN9A; (-) strand; PAM type: NRG; PAM sequence: AGG
tcacactatgaagggatgag

SEQ ID NO: 22403 - DNA, 20 bp, Artificial Sequence
  Description of Artificial Sequence: Synthetic oligonucleotide
  Target: SCN9A; (-) strand; PAM type: NRG; PAM sequence: GAG
ttcacactatgaagggatga

SEQ ID NO: 22404 - DNA, 20 bp, Artificial Sequence
  Description of Artificial Sequence: Synthetic oligonucleotide
  Target: SCN9A; (-) strand; PAM type: NRG; PAM sequence: GAG
gcttcacactatgaagggat

SEQ ID NO: 22405 - DNA, 20 bp, Artificial Sequence
  Description of Artificial Sequence: Synthetic oligonucleotide
  Target: SCN9A; (-) strand; PAM type: NRG; PAM sequence: GGG
ttcctgcttcacactatgaa

SEQ ID NO: 22406 - DNA, 20 bp, Artificial Sequence
  Description of Artificial Sequence: Synthetic oligonucleotide
  Target: SCN9A; (-) strand; PAM type: NRG; PAM sequence: AGG
cttcctgcttcacactatga

SEQ ID NO: 22407 - DNA, 20 bp, Artificial Sequence
  Description of Artificial Sequence: Synthetic oligonucleotide
  Target: SCN9A; (-) strand; PAM type: NRG; PAM sequence: AAG
acttcctgcttcacactatg

SEQ ID NO: 22408 - DNA, 20 bp, Artificial Sequence
  Description of Artificial Sequence: Synthetic oligonucleotide
  Target: SCN9A; (-) strand; PAM type: NRG; PAM sequence: TGG
attgactctttggtgtcatg

SEQ ID NO: 22409 - DNA, 20 bp, Artificial Sequence
  Description of Artificial Sequence: Synthetic oligonucleotide
  Target: SCN9A; (-) strand; PAM type: NRG; PAM sequence: TGG
ttaatttataattgactctt

SEQ ID NO: 22410 - DNA, 20 bp, Artificial Sequence
  Description of Artificial Sequence: Synthetic oligonucleotide
  Target: SCN9A; (-) strand; PAM type: NRG; PAM sequence: GAG
gcatgggttctgttgcattt

SEQ ID NO: 22411 - DNA, 20 bp, Artificial Sequence
  Description of Artificial Sequence: Synthetic oligonucleotide
  Target: SCN9A; (-) strand; PAM type: NRG; PAM sequence: GGG
cctacatgaataagaagcat

SEQ ID NO: 22412 - DNA, 20 bp, Artificial Sequence
  Description of Artificial Sequence: Synthetic oligonucleotide
  Target: SCN9A; (-) strand; PAM type: NRG; PAM sequence: TGG
tcctacatgaataagaagca

SEQ ID NO: 22413 - DNA, 20 bp, Artificial Sequence
  Description of Artificial Sequence: Synthetic oligonucleotide
  Target: SCN9A; (-) strand; PAM type: NRG; PAM sequence: AAG
catgttcctacatgaataag

SEQ ID NO: 22414 - DNA, 20 bp, Artificial Sequence
  Description of Artificial Sequence: Synthetic oligonucleotide
  Target: SCN9A; (-) strand; PAM type: NRG; PAM sequence: AAG
gaacatgttcctacatgaat

SEQ ID NO: 22415 - DNA, 20 bp, Artificial Sequence
  Description of Artificial Sequence: Synthetic oligonucleotide
  Target: SCN9A; (-) strand; PAM type: NRG; PAM sequence: TAG
aaaaaagtgttggtctttcc

SEQ ID NO: 22416 - DNA, 20 bp, Artificial Sequence
  Description of Artificial Sequence: Synthetic oligonucleotide
  Target: SCN9A; (-) strand; PAM type: NRG; PAM sequence: TGG
aaaaaaaaaaaaaaaagtgt

SEQ ID NO: 22417 - DNA, 20 bp, Artificial Sequence
  Description of Artificial Sequence: Synthetic oligonucleotide
  Target: SCN9A; (-) strand; PAM type: NRG; PAM sequence: AAG
aaaaaaaaaaaaaaaaaaaa

SEQ ID NO: 22418 - DNA, 20 bp, Artificial Sequence
  Description of Artificial Sequence: Synthetic oligonucleotide
  Target: SCN9A; (-) strand; PAM type: NRG; PAM sequence: GAG
tccagcctgggctacagagc

SEQ ID NO: 22419 - DNA, 20 bp, Artificial Sequence
  Description of Artificial Sequence: Synthetic oligonucleotide
  Target: SCN9A; (-) strand; PAM type: NRG; PAM sequence: GAG
gcactccagcctgggctaca

SEQ ID NO: 22420 - DNA, 20 bp, Artificial Sequence
  Description of Artificial Sequence: Synthetic oligonucleotide
  Target: SCN9A; (-) strand; PAM type: NRG; PAM sequence: CAG
ctgcactccagcctgggcta

SEQ ID NO: 22421 - DNA, 20 bp, Artificial Sequence
  Description of Artificial Sequence: Synthetic oligonucleotide
  Target: SCN9A; (-) strand; PAM type: NRG; PAM sequence: GGG
gtgccactgcactccagcct

SEQ ID NO: 22422 - DNA, 20 bp, Artificial Sequence
  Description of Artificial Sequence: Synthetic oligonucleotide
  Target: SCN9A; (-) strand; PAM type: NRG; PAM sequence: TGG
cgtgccactgcactccagcc

SEQ ID NO: 22423 - DNA, 20 bp, Artificial Sequence
  Description of Artificial Sequence: Synthetic oligonucleotide
  Target: SCN9A; (-) strand; PAM type: NRG; PAM sequence: CAG
aagatcgtgccactgcactc

SEQ ID NO: 22424 - DNA, 20 bp, Artificial Sequence
  Description of Artificial Sequence: Synthetic oligonucleotide
  Target: SCN9A; (-) strand; PAM type: NRG; PAM sequence: AAG
ggcggaggttgcagtgggcc

SEQ ID NO: 22425 - DNA, 20 bp, Artificial Sequence
  Description of Artificial Sequence: Synthetic oligonucleotide
  Target: SCN9A; (-) strand; PAM type: NRG; PAM sequence: GGG
tgggaggcggaggttgcagt

SEQ ID NO: 22426 - DNA, 20 bp, Artificial Sequence
  Description of Artificial Sequence: Synthetic oligonucleotide
  Target: SCN9A; (-) strand; PAM type: NRG; PAM sequence: TGG
ctgggaggcggaggttgcag

SEQ ID NO: 22427 - DNA, 20 bp, Artificial Sequence
  Description of Artificial Sequence: Synthetic oligonucleotide
  Target: SCN9A; (-) strand; PAM type: NRG; PAM sequence: CAG
aacctgggaggcggaggttg

SEQ ID NO: 22428 - DNA, 20 bp, Artificial Sequence
  Description of Artificial Sequence: Synthetic oligonucleotide
  Target: SCN9A; (-) strand; PAM type: NRG; PAM sequence: AGG
cacgtgaacctgggaggcgg

SEQ ID NO: 22429 - DNA, 20 bp, Artificial Sequence
  Description of Artificial Sequence: Synthetic oligonucleotide
  Target: SCN9A; (-) strand; PAM type: NRG; PAM sequence: GAG
tcacgtgaacctgggaggcg

SEQ ID NO: 22430 - DNA, 20 bp, Artificial Sequence
  Description of Artificial Sequence: Synthetic oligonucleotide
  Target: SCN9A; (-) strand; PAM type: NRG; PAM sequence: CGG
aatcacgtgaacctgggagg

SEQ ID NO: 22431 - DNA, 20 bp, Artificial Sequence
  Description of Artificial Sequence: Synthetic oligonucleotide
  Target: SCN9A; (-) strand; PAM type: NRG; PAM sequence: AGG
gagaatcacgtgaacctggg

SEQ ID NO: 22432 - DNA, 20 bp, Artificial Sequence
  Description of Artificial Sequence: Synthetic oligonucleotide
  Target: SCN9A; (-) strand; PAM type: NRG; PAM sequence: GAG
ggagaatcacgtgaacctgg

SEQ ID NO: 22433 - DNA, 20 bp, Artificial Sequence
  Description of Artificial Sequence: Synthetic oligonucleotide
  Target: SCN9A; (-) strand; PAM type: NRG; PAM sequence: GGG
caggagaatcacgtgaacct

SEQ ID NO: 22434 - DNA, 20 bp, Artificial Sequence
  Description of Artificial Sequence: Synthetic oligonucleotide
  Target: SCN9A; (-) strand; PAM type: NRG; PAM sequence: TGG
gcaggagaatcacgtgaacc

SEQ ID NO: 22435 - DNA, 20 bp, Artificial Sequence
  Description of Artificial Sequence: Synthetic oligonucleotide
  Target: SCN9A; (-) strand; PAM type: NRG; PAM sequence: GAG
tgcttgggaggctgaggcag

SEQ ID NO: 22436 - DNA, 20 bp, Artificial Sequence
  Description of Artificial Sequence: Synthetic oligonucleotide
  Target: SCN9A; (-) strand; PAM type: NRG; PAM sequence: AGG
gctgcttgggaggctgaggc

SEQ ID NO: 22437 - DNA, 20 bp, Artificial Sequence
  Description of Artificial Sequence: Synthetic oligonucleotide
  Target: SCN9A; (-) strand; PAM type: NRG; PAM sequence: CAG
agctgcttgggaggctgagg

SEQ ID NO: 22438 - DNA, 20 bp, Artificial Sequence
  Description of Artificial Sequence: Synthetic oligonucleotide
  Target: SCN9A; (-) strand; PAM type: NRG; PAM sequence: AGG
cctagctgcttgggaggctg

SEQ ID NO: 22439 - DNA, 20 bp, Artificial Sequence
  Description of Artificial Sequence: Synthetic oligonucleotide
  Target: SCN9A; (-) strand; PAM type: NRG; PAM sequence: GAG
tcctagctgcttgggaggct

SEQ ID NO: 22440 - DNA, 20 bp, Artificial Sequence
  Description of Artificial Sequence: Synthetic oligonucleotide
  Target: SCN9A; (-) strand; PAM type: NRG; PAM sequence: AGG
tgtaatcctagctgcttggg

SEQ ID NO: 22441 - DNA, 20 bp, Artificial Sequence
  Description of Artificial Sequence: Synthetic oligonucleotide
  Target: SCN9A; (-) strand; PAM type: NRG; PAM sequence: GAG
ctgtaatcctagctgcttgg

SEQ ID NO: 22442 - DNA, 20 bp, Artificial Sequence
  Description of Artificial Sequence: Synthetic oligonucleotide
  Target: SCN9A; (-) strand; PAM type: NRG; PAM sequence: GGG
gcctgtaatcctagctgctt

SEQ ID NO: 22443 - DNA, 20 bp, Artificial Sequence
  Description of Artificial Sequence: Synthetic oligonucleotide
  Target: SCN9A; (-) strand; PAM type: NRG; PAM sequence: TGG
cgcctgtaatcctagctgct

SEQ ID NO: 22444 - DNA, 20 bp, Artificial Sequence
  Description of Artificial Sequence: Synthetic oligonucleotide
  Target: SCN9A; (-) strand; PAM type: NRG; PAM sequence: TAG
gtggcaggcgcctgtaatcc

SEQ ID NO: 22445 - DNA, 20 bp, Artificial Sequence
  Description of Artificial Sequence: Synthetic oligonucleotide
  Target: SCN9A; (-) strand; PAM type: NRG; PAM sequence: AGG
aattagctgggtgtggtggc

SEQ ID NO: 22446 - DNA, 20 bp, Artificial Sequence
  Description of Artificial Sequence: Synthetic oligonucleotide
  Target: SCN9A; (-) strand; PAM type: NRG; PAM sequence: CAG
aaattagctgggtgtggtgg

SEQ ID NO: 22447 - DNA, 20 bp, Artificial Sequence
  Description of Artificial Sequence: Synthetic oligonucleotide
  Target: SCN9A; (-) strand; PAM type: NRG; PAM sequence: TGG
aaaaaattagctgggtgtgg

SEQ ID NO: 22448 - DNA, 20 bp, Artificial Sequence
  Description of Artificial Sequence: Synthetic oligonucleotide
  Target: SCN9A; (-) strand; PAM type: NRG; PAM sequence: TGG
acaaaaaaattagctgggtg

SEQ ID NO: 22449 - DNA, 20 bp, Artificial Sequence
  Description of Artificial Sequence: Synthetic oligonucleotide
  Target: SCN9A; (-) strand; PAM type: NRG; PAM sequence: GGG
aaaatacaaaaaaattagct

SEQ ID NO: 22450 - DNA, 20 bp, Artificial Sequence
  Description of Artificial Sequence: Synthetic oligonucleotide
  Target: SCN9A; (-) strand; PAM type: NRG; PAM sequence: TGG
aaaaatacaaaaaaattagc

SEQ ID NO: 22451 - DNA, 20 bp, Artificial Sequence
  Description of Artificial Sequence: Synthetic oligonucleotide
  Target: SCN9A; (-) strand; PAM type: NRG; PAM sequence: TAG
tactaaaaatacaaaaaaat

SEQ ID NO: 22452 - DNA, 20 bp, Artificial Sequence
  Description of Artificial Sequence: Synthetic oligonucleotide
  Target: SCN9A; (-) strand; PAM type: NRG; PAM sequence: TAG
cgagaccagtctggccaaca

SEQ ID NO: 22453 - DNA, 20 bp, Artificial Sequence
  Description of Artificial Sequence: Synthetic oligonucleotide
  Target: SCN9A; (-) strand; PAM type: NRG; PAM sequence: TGG
tcaggagttcgagaccagtc

SEQ ID NO: 22454 - DNA, 20 bp, Artificial Sequence
  Description of Artificial Sequence: Synthetic oligonucleotide
  Target: SCN9A; (-) strand; PAM type: NRG; PAM sequence: CAG
tgaggtcaggagttcgagac

SEQ ID NO: 22455 - DNA, 20 bp, Artificial Sequence
  Description of Artificial Sequence: Synthetic oligonucleotide
  Target: SCN9A; (-) strand; PAM type: NRG; PAM sequence: GAG
gatcatgaggtcaggagttc

SEQ ID NO: 22456 - DNA, 20 bp, Artificial Sequence
  Description of Artificial Sequence: Synthetic oligonucleotide
  Target: SCN9A; (-) strand; PAM type: NRG; PAM sequence: GAG
tgggcagatcatgaggtcag

SEQ ID NO: 22457 - DNA, 20 bp, Artificial Sequence
  Description of Artificial Sequence: Synthetic oligonucleotide
  Target: SCN9A; (-) strand; PAM type: NRG; PAM sequence: AGG
ggtgggcagatcatgaggtc

SEQ ID NO: 22458 - DNA, 20 bp, Artificial Sequence
  Description of Artificial Sequence: Synthetic oligonucleotide
  Target: SCN9A; (-) strand; PAM type: NRG; PAM sequence: CAG
aggtgggcagatcatgaggt

SEQ ID NO: 22459 - DNA, 20 bp, Artificial Sequence
  Description of Artificial Sequence: Synthetic oligonucleotide
  Target: SCN9A; (-) strand; PAM type: NRG; PAM sequence: AGG
gccaaggtgggcagatcatg

SEQ ID NO: 22460 - DNA, 20 bp, Artificial Sequence
  Description of Artificial Sequence: Synthetic oligonucleotide
  Target: SCN9A; (-) strand; PAM type: NRG; PAM sequence: GAG
ggccaaggtgggcagatcat

SEQ ID NO: 22461 - DNA, 20 bp, Artificial Sequence
  Description of Artificial Sequence: Synthetic oligonucleotide
  Target: SCN9A; (-) strand; PAM type: NRG; PAM sequence: CAG
ctttgggaggccaaggtggg

SEQ ID NO: 22462 - DNA, 20 bp, Artificial Sequence
  Description of Artificial Sequence: Synthetic oligonucleotide
  Target: SCN9A; (-) strand; PAM type: NRG; PAM sequence: GGG
tcactttgggaggccaaggt

SEQ ID NO: 22463 - DNA, 20 bp, Artificial Sequence
  Description of Artificial Sequence: Synthetic oligonucleotide
  Target: SCN9A; (-) strand; PAM type: NRG; PAM sequence: TGG
ttcactttgggaggccaagg

SEQ ID NO: 22464 - DNA, 20 bp, Artificial Sequence
  Description of Artificial Sequence: Synthetic oligonucleotide
  Target: SCN9A; (-) strand; PAM type: NRG; PAM sequence: AGG
ctcttcactttgggaggcca

SEQ ID NO: 22465 - DNA, 20 bp, Artificial Sequence
  Description of Artificial Sequence: Synthetic oligonucleotide
  Target: SCN9A; (-) strand; PAM type: NRG; PAM sequence: AAG
tctcttcactttgggaggcc

SEQ ID NO: 22466 - DNA, 20 bp, Artificial Sequence
  Description of Artificial Sequence: Synthetic oligonucleotide
  Target: SCN9A; (-) strand; PAM type: NRG; PAM sequence: AGG
tgtagtctcttcactttggg

SEQ ID NO: 22467 - DNA, 20 bp, Artificial Sequence
  Description of Artificial Sequence: Synthetic oligonucleotide
  Target: SCN9A; (-) strand; PAM type: NRG; PAM sequence: GAG
ctgtagtctcttcactttgg

SEQ ID NO: 22468 - DNA, 20 bp, Artificial Sequence
  Description of Artificial Sequence: Synthetic oligonucleotide
  Target: SCN9A; (-) strand; PAM type: NRG; PAM sequence: GGG
gcctgtagtctcttcacttt

SEQ ID NO: 22469 - DNA, 20 bp, Artificial Sequence
  Description of Artificial Sequence: Synthetic oligonucleotide
  Target: SCN9A; (-) strand; PAM type: NRG; PAM sequence: TGG
tgcctgtagtctcttcactt

SEQ ID NO: 22470 - DNA, 20 bp, Artificial Sequence
  Description of Artificial Sequence: Synthetic oligonucleotide
  Target: SCN9A; (-) strand; PAM type: NRG; PAM sequence: TAG
ggcgcagtggctcatgcctg

SEQ ID NO: 22471 - DNA, 20 bp, Artificial Sequence
  Description of Artificial Sequence: Synthetic oligonucleotide
  Target: SCN9A; (-) strand; PAM type: NRG; PAM sequence: TGG
ccagtcttggccgggcgcag

SEQ ID NO: 22472 - DNA, 20 bp, Artificial Sequence
  Description of Artificial Sequence: Synthetic oligonucleotide
  Target: SCN9A; (-) strand; PAM type: NRG; PAM sequence: CAG
gtgccagtcttggccgggcg

SEQ ID NO: 22473 - DNA, 20 bp, Artificial Sequence
  Description of Artificial Sequence: Synthetic oligonucleotide
  Target: SCN9A; (-) strand; PAM type: NRG; PAM sequence: GGG
aaacagtgccagtcttggcc

SEQ ID NO: 22474 - DNA, 20 bp, Artificial Sequence
  Description of Artificial Sequence: Synthetic oligonucleotide
  Target: SCN9A; (-) strand; PAM type: NRG; PAM sequence: CGG
aaaacagtgccagtcttggc

SEQ ID NO: 22475 - DNA, 20 bp, Artificial Sequence
  Description of Artificial Sequence: Synthetic oligonucleotide
  Target: SCN9A; (-) strand; PAM type: NRG; PAM sequence: TGG
ttttaaaacagtgccagtct

SEQ ID NO: 22476 - DNA, 20 bp, Artificial Sequence
  Description of Artificial Sequence: Synthetic oligonucleotide
  Target: SCN9A; (-) strand; PAM type: NRG; PAM sequence: CAG
tgtggtttttaaaacagtgc

SEQ ID NO: 22477 - DNA, 20 bp, Artificial Sequence
  Description of Artificial Sequence: Synthetic oligonucleotide
  Target: SCN9A; (-) strand; PAM type: NRG; PAM sequence: CAG
atactgtgtggtttttaaaa

SEQ ID NO: 22478 - DNA, 20 bp, Artificial Sequence
  Description of Artificial Sequence: Synthetic oligonucleotide
  Target: SCN9A; (-) strand; PAM type: NRG; PAM sequence: TGG
attgaagataaaatactgtg

SEQ ID NO: 22479 - DNA, 20 bp, Artificial Sequence
  Description of Artificial Sequence: Synthetic oligonucleotide
  Target: SCN9A; (-) strand; PAM type: NRG; PAM sequence: AAG
agtatattaattataaattg

SEQ ID NO: 22480 - DNA, 20 bp, Artificial Sequence
  Description of Artificial Sequence: Synthetic oligonucleotide
  Target: SCN9A; (-) strand; PAM type: NRG; PAM sequence: TAG
gatataagttattctttaaa

SEQ ID NO: 22481 - DNA, 20 bp, Artificial Sequence
  Description of Artificial Sequence: Synthetic oligonucleotide
  Target: SCN9A; (-) strand; PAM type: NRG; PAM sequence: AAG
agatattggacgaaggatat

SEQ ID NO: 22482 - DNA, 20 bp, Artificial Sequence
  Description of Artificial Sequence: Synthetic oligonucleotide
  Target: SCN9A; (-) strand; PAM type: NRG; PAM sequence: AGG
ttttaatagatattggacga

SEQ ID NO: 22483 - DNA, 20 bp, Artificial Sequence
  Description of Artificial Sequence: Synthetic oligonucleotide
  Target: SCN9A; (-) strand; PAM type: NRG; PAM sequence: AAG
attttaatagatattggacg

SEQ ID NO: 22484 - DNA, 20 bp, Artificial Sequence
  Description of Artificial Sequence: Synthetic oligonucleotide
  Target: SCN9A; (-) strand; PAM type: NRG; PAM sequence: TGG
cttggtattttaatagatat

SEQ ID NO: 22485 - DNA, 20 bp, Artificial Sequence
  Description of Artificial Sequence: Synthetic oligonucleotide
  Target: SCN9A; (-) strand; PAM type: NRG; PAM sequence: TAG
atgagtgcttggtattttaa

SEQ ID NO: 22486 - DNA, 20 bp, Artificial Sequence
  Description of Artificial Sequence: Synthetic oligonucleotide
  Target: SCN9A; (-) strand; PAM type: NRG; PAM sequence: TGG
tgtcccatttcatgagtgct

SEQ ID NO: 22487 - DNA, 20 bp, Artificial Sequence
  Description of Artificial Sequence: Synthetic oligonucleotide
  Target: SCN9A; (-) strand; PAM type: NRG; PAM sequence: GAG
ttgtaagtgtcccatttcat

SEQ ID NO: 22488 - DNA, 20 bp, Artificial Sequence
  Description of Artificial Sequence: Synthetic oligonucleotide
  Target: SCN9A; (-) strand; PAM type: NRG; PAM sequence: AAG
ctatctctgcttcaagttgt

SEQ ID NO: 22489 - DNA, 20 bp, Artificial Sequence
  Description of Artificial Sequence: Synthetic oligonucleotide
  Target: SCN9A; (-) strand; PAM type: NRG; PAM sequence: AAG
tggttacctatctctgcttc

SEQ ID NO: 22490 - DNA, 20 bp, Artificial Sequence
  Description of Artificial Sequence: Synthetic oligonucleotide
  Target: SCN9A; (-) strand; PAM type: NRG; PAM sequence: TGG
aactttgataatgtcggact

SEQ ID NO: 22491 - DNA, 20 bp, Artificial Sequence
  Description of Artificial Sequence: Synthetic oligonucleotide
  Target: SCN9A; (-) strand; PAM type: NRG; PAM sequence: CGG
aaagtgaactttgataatgt

SEQ ID NO: 22492 - DNA, 20 bp, Artificial Sequence
  Description of Artificial Sequence: Synthetic oligonucleotide
  Target: SCN9A; (-) strand; PAM type: NRG; PAM sequence: AAG
tgtgcgatggaaaaacctga

SEQ ID NO: 22493 - DNA, 20 bp, Artificial Sequence
  Description of Artificial Sequence: Synthetic oligonucleotide
  Target: SCN9A; (-) strand; PAM type: NRG; PAM sequence: TGG
atgttagtcaaaatgtgcga

SEQ ID NO: 22494 - DNA, 20 bp, Artificial Sequence
  Description of Artificial Sequence: Synthetic oligonucleotide
  Target: SCN9A; (-) strand; PAM type: NRG; PAM sequence: TAG
tgttttgcccttatgaatgt

SEQ ID NO: 22495 - DNA, 20 bp, Artificial Sequence
  Description of Artificial Sequence: Synthetic oligonucleotide
  Target: SCN9A; (-) strand; PAM type: NRG; PAM sequence: AAG
gtcacggtttcctgcaagtc

SEQ ID NO: 22496 - DNA, 20 bp, Artificial Sequence
  Description of Artificial Sequence: Synthetic oligonucleotide
  Target: SCN9A; (-) strand; PAM type: NRG; PAM sequence: AAG
gatgggtcacggtttcctgc

SEQ ID NO: 22497 - DNA, 20 bp, Artificial Sequence
  Description of Artificial Sequence: Synthetic oligonucleotide
  Target: SCN9A; (-) strand; PAM type: NRG; PAM sequence: CGG
ttaacaccacagatgggtca

SEQ ID NO: 22498 - DNA, 20 bp, Artificial Sequence
  Description of Artificial Sequence: Synthetic oligonucleotide
  Target: SCN9A; (-) strand; PAM type: NRG; PAM sequence: GGG
agtgtattaacaccacagat

SEQ ID NO: 22499 - DNA, 20 bp, Artificial Sequence
  Description of Artificial Sequence: Synthetic oligonucleotide
  Target: SCN9A; (-) strand; PAM type: NRG; PAM sequence: TGG
gagtgtattaacaccacaga

SEQ ID NO: 22500 - DNA, 20 bp, Artificial Sequence
  Description of Artificial Sequence: Synthetic oligonucleotide
  Target: SCN9A; (-) strand; PAM type: NRG; PAM sequence: CAG
ctatgagtgtattaacacca

SEQ ID NO: 22501 - DNA, 20 bp, Artificial Sequence
  Description of Artificial Sequence: Synthetic oligonucleotide
  Target: SCN9A; (-) strand; PAM type: NRG; PAM sequence: GAG
tgtttgctggcaagttctat

SEQ ID NO: 22502 - DNA, 20 bp, Artificial Sequence
  Description of Artificial Sequence: Synthetic oligonucleotide
  Target: SCN9A; (-) strand; PAM type: NRG; PAM sequence: AAG
gagtaaatttgtttgctggc

SEQ ID NO: 22503 - DNA, 20 bp, Artificial Sequence
  Description of Artificial Sequence: Synthetic oligonucleotide
  Target: SCN9A; (-) strand; PAM type: NRG; PAM sequence: TGG
atgggagtaaatttgtttgc

SEQ ID NO: 22504 - DNA, 20 bp, Artificial Sequence
  Description of Artificial Sequence: Synthetic oligonucleotide
  Target: SCN9A; (-) strand; PAM type: NRG; PAM sequence: GAG
gctgatattcagcatcatgg

SEQ ID NO: 22505 - DNA, 20 bp, Artificial Sequence
  Description of Artificial Sequence: Synthetic oligonucleotide
  Target: SCN9A; (-) strand; PAM type: NRG; PAM sequence: GGG
tggctgatattcagcatcat

SEQ ID NO: 22506 - DNA, 20 bp, Artificial Sequence
  Description of Artificial Sequence: Synthetic oligonucleotide
  Target: SCN9A; (-) strand; PAM type: NRG; PAM sequence: TGG
ctggctgatattcagcatca

SEQ ID NO: 22507 - DNA, 20 bp, Artificial Sequence
  Description of Artificial Sequence: Synthetic oligonucleotide
  Target: SCN9A; (-) strand; PAM type: NRG; PAM sequence: CAG
cttatattctggctgatatt

SEQ ID NO: 22508 - DNA, 20 bp, Artificial Sequence
  Description of Artificial Sequence: Synthetic oligonucleotide
  Target: SCN9A; (-) strand; PAM type: NRG; PAM sequence: TGG
tacttgtgtgtcttatattc

SEQ ID NO: 22509 - DNA, 20 bp, Artificial Sequence
  Description of Artificial Sequence: Synthetic oligonucleotide
  Target: SCN9A; (-) strand; PAM type: NRG; PAM sequence: GAG
cgttgtgaatgcactcatag

SEQ ID NO: 22510 - DNA, 20 bp, Artificial Sequence
  Description of Artificial Sequence: Synthetic oligonucleotide
  Target: SCN9A; (-) strand; PAM type: NRG; PAM sequence: AGG
gtcgttgtgaatgcactcat

SEQ ID NO: 22511 - DNA, 20 bp, Artificial Sequence
  Description of Artificial Sequence: Synthetic oligonucleotide
  Target: SCN9A; (-) strand; PAM type: NRG; PAM sequence: TAG
ggtcgttgtgaatgcactca

SEQ ID NO: 22512 - DNA, 20 bp, Artificial Sequence
  Description of Artificial Sequence: Synthetic oligonucleotide
  Target: SCN9A; (-) strand; PAM type: NRG; PAM sequence: AGG
ttttctttcttttgaatact

SEQ ID NO: 22513 - DNA, 20 bp, Artificial Sequence
  Description of Artificial Sequence: Synthetic oligonucleotide
  Target: SCN9A; (-) strand; PAM type: NRG; PAM sequence: TAG
cttttctttcttttgaatac

SEQ ID NO: 22514 - DNA, 20 bp, Artificial Sequence
  Description of Artificial Sequence: Synthetic oligonucleotide
  Target: SCN9A; (-) strand; PAM type: NRG; PAM sequence: TGG
ctaatttatttatgtctgca

SEQ ID NO: 22515 - DNA, 20 bp, Artificial Sequence
  Description of Artificial Sequence: Synthetic oligonucleotide
  Target: SCN9A; (-) strand; PAM type: NRG; PAM sequence: CGG
atgtcttagatatttaaggg

SEQ ID NO: 22516 - DNA, 20 bp, Artificial Sequence
  Description of Artificial Sequence: Synthetic oligonucleotide
  Target: SCN9A; (-) strand; PAM type: NRG; PAM sequence: GGG
ttgatgtcttagatatttaa

SEQ ID NO: 22517 - DNA, 20 bp, Artificial Sequence
  Description of Artificial Sequence: Synthetic oligonucleotide
  Target: SCN9A; (-) strand; PAM type: NRG; PAM sequence: AGG
tttgatgtcttagatattta

SEQ ID NO: 22518 - DNA, 20 bp, Artificial Sequence
  Description of Artificial Sequence: Synthetic oligonucleotide
  Target: SCN9A; (-) strand; PAM type: NRG; PAM sequence: AAG
gtttgatgtcttagatattt

SEQ ID NO: 22519 - DNA, 20 bp, Artificial Sequence
  Description of Artificial Sequence: Synthetic oligonucleotide
  Target: SCN9A; (-) strand; PAM type: NRG; PAM sequence: TAG
ggctggttggtttgatgtct

SEQ ID NO: 22520 - DNA, 20 bp, Artificial Sequence
  Description of Artificial Sequence: Synthetic oligonucleotide
  Target: SCN9A; (-) strand; PAM type: NRG; PAM sequence: TGG
ataaacatgagtcggctggt

SEQ ID NO: 22521 - DNA, 20 bp, Artificial Sequence
  Description of Artificial Sequence: Synthetic oligonucleotide
  Target: SCN9A; (-) strand; PAM type: NRG; PAM sequence: TGG
tttaataaacatgagtcggc

SEQ ID NO: 22522 - DNA, 20 bp, Artificial Sequence
  Description of Artificial Sequence: Synthetic oligonucleotide
  Target: SCN9A; (-) strand; PAM type: NRG; PAM sequence: CGG
ggcatttaataaacatgagt

SEQ ID NO: 22523 - DNA, 20 bp, Artificial Sequence
  Description of Artificial Sequence: Synthetic oligonucleotide
  Target: SCN9A; (-) strand; PAM type: NRG; PAM sequence: GAG
agtaggcatttaataaacat

SEQ ID NO: 22524 - DNA, 20 bp, Artificial Sequence
  Description of Artificial Sequence: Synthetic oligonucleotide
  Target: SCN9A; (-) strand; PAM type: NRG; PAM sequence: AGG
cacactgctgagtgtagagt

SEQ ID NO: 22525 - DNA, 20 bp, Artificial Sequence
  Description of Artificial Sequence: Synthetic oligonucleotide
  Target: SCN9A; (-) strand; PAM type: NRG; PAM sequence: TAG
gcacactgctgagtgtagag

SEQ ID NO: 22526 - DNA, 20 bp, Artificial Sequence
  Description of Artificial Sequence: Synthetic oligonucleotide
  Target: SCN9A; (-) strand; PAM type: NRG; PAM sequence: GAG
ttggcacactgctgagtgta

SEQ ID NO: 22527 - DNA, 20 bp, Artificial Sequence
  Description of Artificial Sequence: Synthetic oligonucleotide
  Target: SCN9A; (-) strand; PAM type: NRG; PAM sequence: TAG
gcttggcacactgctgagtg

SEQ ID NO: 22528 - DNA, 20 bp, Artificial Sequence
  Description of Artificial Sequence: Synthetic oligonucleotide
  Target: SCN9A; (-) strand; PAM type: NRG; PAM sequence: GAG
gtcttgcttggcacactgct

SEQ ID NO: 22529 - DNA, 20 bp, Artificial Sequence
  Description of Artificial Sequence: Synthetic oligonucleotide
  Target: SCN9A; (-) strand; PAM type: NRG; PAM sequence: TGG
atgtcttattttgtcttgct

SEQ ID NO: 22530 - DNA, 20 bp, Artificial Sequence
  Description of Artificial Sequence: Synthetic oligonucleotide
  Target: SCN9A; (-) strand; PAM type: NRG; PAM sequence: GAG
ttgtaagcctggtgatcaca

SEQ ID NO: 22531 - DNA, 20 bp, Artificial Sequence
  Description of Artificial Sequence: Synthetic oligonucleotide
  Target: SCN9A; (-) strand; PAM type: NRG; PAM sequence: CAG
atttgtaagcctggtgatca

SEQ ID NO: 22532 - DNA, 20 bp, Artificial Sequence
  Description of Artificial Sequence: Synthetic oligonucleotide
  Target: SCN9A; (-) strand; PAM type: NRG; PAM sequence: TGG
aatcatgtaatttgtaagcc

SEQ ID NO: 22533 - DNA, 20 bp, Artificial Sequence
  Description of Artificial Sequence: Synthetic oligonucleotide
  Target: SCN9A; (-) strand; PAM type: NRG; PAM sequence: AAG
gtgataatcatgtaatttgt

SEQ ID NO: 22534 - DNA, 20 bp, Artificial Sequence
  Description of Artificial Sequence: Synthetic oligonucleotide
  Target: SCN9A; (-) strand; PAM type: NRG; PAM sequence: TAG
tttaagctattatattatct

SEQ ID NO: 22535 - DNA, 20 bp, Artificial Sequence
  Description of Artificial Sequence: Synthetic oligonucleotide
  Target: SCN9A; (-) strand; PAM type: NRG; PAM sequence: AAG
tatttattttacatttattt

SEQ ID NO: 22536 - DNA, 20 bp, Artificial Sequence
  Description of Artificial Sequence: Synthetic oligonucleotide
  Target: SCN9A; (-) strand; PAM type: NRG; PAM sequence: TGG
accttatcaataacaggttt

SEQ ID NO: 22537 - DNA, 20 bp, Artificial Sequence
  Description of Artificial Sequence: Synthetic oligonucleotide
  Target: SCN9A; (-) strand; PAM type: NRG; PAM sequence: AGG
aagtttaccttatcaataac

SEQ ID NO: 22538 - DNA, 20 bp, Artificial Sequence
  Description of Artificial Sequence: Synthetic oligonucleotide
  Target: SCN9A; (-) strand; PAM type: NRG; PAM sequence: CAG
caagtttaccttatcaataa

SEQ ID NO: 22539 - DNA, 20 bp, Artificial Sequence
  Description of Artificial Sequence: Synthetic oligonucleotide
  Target: SCN9A; (-) strand; PAM type: NRG; PAM sequence: AAG
ccagagtgtacagattttac

SEQ ID NO: 22540 - DNA, 20 bp, Artificial Sequence
  Description of Artificial Sequence: Synthetic oligonucleotide
  Target: SCN9A; (-) strand; PAM type: NRG; PAM sequence: CAG
tcttttttttccagagtgta

SEQ ID NO: 22541 - DNA, 20 bp, Artificial Sequence
  Description of Artificial Sequence: Synthetic oligonucleotide
  Target: SCN9A; (-) strand; PAM type: NRG; PAM sequence: GAG
atacatttcttttttttcca

SEQ ID NO: 22542 - DNA, 20 bp, Artificial Sequence
  Description of Artificial Sequence: Synthetic oligonucleotide
  Target: SCN9A; (-) strand; PAM type: NRG; PAM sequence: CAG
ttatacatttcttttttttc

SEQ ID NO: 22543 - DNA, 20 bp, Artificial Sequence
  Description of Artificial Sequence: Synthetic oligonucleotide
  Target: SCN9A; (-) strand; PAM type: NRG; PAM sequence: AGG
tctttaatgctggtaataat

SEQ ID NO: 22544 - DNA, 20 bp, Artificial Sequence
  Description of Artificial Sequence: Synthetic oligonucleotide
  Target: SCN9A; (-) strand; PAM type: NRG; PAM sequence: TAG
atctttaatgctggtaataa

SEQ ID NO: 22545 - DNA, 20 bp, Artificial Sequence
  Description of Artificial Sequence: Synthetic oligonucleotide
  Target: SCN9A; (-) strand; PAM type: NRG; PAM sequence: TGG
tatgggggaatctttaatgc

SEQ ID NO: 22546 - DNA, 20 bp, Artificial Sequence
  Description of Artificial Sequence: Synthetic oligonucleotide
  Target: SCN9A; (-) strand; PAM type: NRG; PAM sequence: GGG
caccaatagtttctctatgg

SEQ ID NO: 22547 - DNA, 20 bp, Artificial Sequence
  Description of Artificial Sequence: Synthetic oligonucleotide
  Target: SCN9A; (-) strand; PAM type: NRG; PAM sequence: GGG
acaccaatagtttctctatg

SEQ ID NO: 22548 - DNA, 20 bp, Artificial Sequence
  Description of Artificial Sequence: Synthetic oligonucleotide
  Target: SCN9A; (-) strand; PAM type: NRG; PAM sequence: GGG
tacaccaatagtttctctat

SEQ ID NO: 22549 - DNA, 20 bp, Artificial Sequence
  Description of Artificial Sequence: Synthetic oligonucleotide
  Target: SCN9A; (-) strand; PAM type: NRG; PAM sequence: TGG
atacaccaatagtttctcta

SEQ ID NO: 22550 - DNA, 20 bp, Artificial Sequence
  Description of Artificial Sequence: Synthetic oligonucleotide
  Target: SCN9A; (-) strand; PAM type: NRG; PAM sequence: TAG
acctacctgatatacaccaa

SEQ ID NO: 22551 - DNA, 20 bp, Artificial Sequence
  Description of Artificial Sequence: Synthetic oligonucleotide
  Target: SCN9A; (-) strand; PAM type: NRG; PAM sequence: CAG
aattaaattaaaatgatgtc

SEQ ID NO: 22552 - DNA, 20 bp, Artificial Sequence
  Description of Artificial Sequence: Synthetic oligonucleotide
  Target: SCN9A; (-) strand; PAM type: NRG; PAM sequence: AAG
tcaaaaaaagagaataagaa

SEQ ID NO: 22553 - DNA, 20 bp, Artificial Sequence
  Description of Artificial Sequence: Synthetic oligonucleotide
  Target: SCN9A; (-) strand; PAM type: NRG; PAM sequence: AAG
atgtctcaaaaaaagagaat

SEQ ID NO: 22554 - DNA, 20 bp, Artificial Sequence
  Description of Artificial Sequence: Synthetic oligonucleotide
  Target: SCN9A; (-) strand; PAM type: NRG; PAM sequence: GAG
tggagaatgtctcaaaaaaa

SEQ ID NO: 22555 - DNA, 20 bp, Artificial Sequence
  Description of Artificial Sequence: Synthetic oligonucleotide
  Target: SCN9A; (-) strand; PAM type: NRG; PAM sequence: AAG
tgtggagaatgtctcaaaaa

SEQ ID NO: 22556 - DNA, 20 bp, Artificial Sequence
  Description of Artificial Sequence: Synthetic oligonucleotide
  Target: SCN9A; (-) strand; PAM type: NRG; PAM sequence: GAG
agattctcaatccttttgtg

SEQ ID NO: 22557 - DNA, 20 bp, Artificial Sequence
  Description of Artificial Sequence: Synthetic oligonucleotide
  Target: SCN9A; (-) strand; PAM type: NRG; PAM sequence: TGG
aaagattctcaatccttttg

SEQ ID NO: 22558 - DNA, 20 bp, Artificial Sequence
  Description of Artificial Sequence: Synthetic oligonucleotide
  Target: SCN9A; (-) strand; PAM type: NRG; PAM sequence: AAG
taaaggatttaaaccattta

SEQ ID NO: 22559 - DNA, 20 bp, Artificial Sequence
  Description of Artificial Sequence: Synthetic oligonucleotide
  Target: SCN9A; (-) strand; PAM type: NRG; PAM sequence: AGG
gtagaaccagccaaatctaa

SEQ ID NO: 22560 - DNA, 20 bp, Artificial Sequence
  Description of Artificial Sequence: Synthetic oligonucleotide
  Target: SCN9A; (-) strand; PAM type: NRG; PAM sequence: AAG
cgtagaaccagccaaatcta

SEQ ID NO: 22561 - DNA, 20 bp, Artificial Sequence
  Description of Artificial Sequence: Synthetic oligonucleotide
  Target: SCN9A; (-) strand; PAM type: NRG; PAM sequence: CAG
ttgctcttatttcgtagaac

SEQ ID NO: 22562 - DNA, 20 bp, Artificial Sequence
  Description of Artificial Sequence: Synthetic oligonucleotide
  Target: SCN9A; (-) strand; PAM type: NRG; PAM sequence: TAG
aaacgattgctcttatttcg

SEQ ID NO: 22563 - DNA, 20 bp, Artificial Sequence
  Description of Artificial Sequence: Synthetic oligonucleotide
  Target: SCN9A; (-) strand; PAM type: NRG; PAM sequence: GAG
gcttacatataaagtattta

SEQ ID NO: 22564 - DNA, 20 bp, Artificial Sequence
  Description of Artificial Sequence: Synthetic oligonucleotide
  Target: SCN9A; (-) strand; PAM type: NRG; PAM sequence: TAG
aggcttacatataaagtatt

SEQ ID NO: 22565 - DNA, 20 bp, Artificial Sequence
  Description of Artificial Sequence: Synthetic oligonucleotide
  Target: SCN9A; (-) strand; PAM type: NRG; PAM sequence: AAG
tagtcaaaggcttacatata

SEQ ID NO: 22566 - DNA, 20 bp, Artificial Sequence
  Description of Artificial Sequence: Synthetic oligonucleotide
  Target: SCN9A; (-) strand; PAM type: NRG; PAM sequence: AGG
cactatatatatttagtcaa

SEQ ID NO: 22567 - DNA, 20 bp, Artificial Sequence
  Description of Artificial Sequence: Synthetic oligonucleotide
  Target: SCN9A; (-) strand; PAM type: NRG; PAM sequence: AAG
gcactatatatatttagtca

SEQ ID NO: 22568 - DNA, 20 bp, Artificial Sequence
  Description of Artificial Sequence: Synthetic oligonucleotide
  Target: SCN9A; (-) strand; PAM type: NRG; PAM sequence: TAG
aggccagcactatatatatt

SEQ ID NO: 22569 - DNA, 20 bp, Artificial Sequence
  Description of Artificial Sequence: Synthetic oligonucleotide
  Target: SCN9A; (-) strand; PAM type: NRG; PAM sequence: CAG
atttttgtcttaactgaggc

SEQ ID NO: 22570 - DNA, 20 bp, Artificial Sequence
  Description of Artificial Sequence: Synthetic oligonucleotide
  Target: SCN9A; (-) strand; PAM type: NRG; PAM sequence: AGG
cctaatttttgtcttaactg

SEQ ID NO: 22571 - DNA, 20 bp, Artificial Sequence
  Description of Artificial Sequence: Synthetic oligonucleotide
  Target: SCN9A; (-) strand; PAM type: NRG; PAM sequence: GAG
tcctaatttttgtcttaact

SEQ ID NO: 22572 - DNA, 20 bp, Artificial Sequence
  Description of Artificial Sequence: Synthetic oligonucleotide
  Target: SCN9A; (-) strand; PAM type: NRG; PAM sequence: AAG
cagaaataaagaaaggatta

SEQ ID NO: 22573 - DNA, 20 bp, Artificial Sequence
  Description of Artificial Sequence: Synthetic oligonucleotide
  Target: SCN9A; (-) strand; PAM type: NRG; PAM sequence: AGG
tgaaaagcagaaataaagaa

SEQ ID NO: 22574 - DNA, 20 bp, Artificial Sequence
  Description of Artificial Sequence: Synthetic oligonucleotide
  Target: SCN9A; (-) strand; PAM type: NRG; PAM sequence: AAG
ctgaaaagcagaaataaaga

SEQ ID NO: 22575 - DNA, 20 bp, Artificial Sequence
  Description of Artificial Sequence: Synthetic oligonucleotide
  Target: SCN9A; (-) strand; PAM type: NRG; PAM sequence: AAG
aatgctgaaaagcagaaata

SEQ ID NO: 22576 - DNA, 20 bp, Artificial Sequence
  Description of Artificial Sequence: Synthetic oligonucleotide
  Target: SCN9A; (-) strand; PAM type: NRG; PAM sequence: CAG
gcagtacaaatgctgaaaag

SEQ ID NO: 22577 - DNA, 20 bp, Artificial Sequence
  Description of Artificial Sequence: Synthetic oligonucleotide
  Target: SCN9A; (-) strand; PAM type: NRG; PAM sequence: AAG
atagcagtacaaatgctgaa

SEQ ID NO: 22578 - DNA, 20 bp, Artificial Sequence
  Description of Artificial Sequence: Synthetic oligonucleotide
  Target: SCN9A; (-) strand; PAM type: NRG; PAM sequence: CAG
gacaaactggtgatcaatag

SEQ ID NO: 22579 - DNA, 20 bp, Artificial Sequence
  Description of Artificial Sequence: Synthetic oligonucleotide
  Target: SCN9A; (-) strand; PAM type: NRG; PAM sequence: TAG
aaagacaaactggtgatcaa

SEQ ID NO: 22580 - DNA, 20 bp, Artificial Sequence
  Description of Artificial Sequence: Synthetic oligonucleotide
  Target: SCN9A; (-) strand; PAM type: NRG; PAM sequence: TGG
ctggagtggcaaagacaaac

SEQ ID NO: 22581 - DNA, 20 bp, Artificial Sequence
  Description of Artificial Sequence: Synthetic oligonucleotide
  Target: SCN9A; (-) strand; PAM type: NRG; PAM sequence: AAG
ggatgaaaactggagtggca

SEQ ID NO: 22582 - DNA, 20 bp, Artificial Sequence
  Description of Artificial Sequence: Synthetic oligonucleotide
  Target: SCN9A; (-) strand; PAM type: NRG; PAM sequence: TGG
gccctggatgaaaactggag

SEQ ID NO: 22583 - DNA, 20 bp, Artificial Sequence
  Description of Artificial Sequence: Synthetic oligonucleotide
  Target: SCN9A; (-) strand; PAM type: NRG; PAM sequence: GAG
attgccctggatgaaaactg

SEQ ID NO: 22584 - DNA, 20 bp, Artificial Sequence
  Description of Artificial Sequence: Synthetic oligonucleotide
  Target: SCN9A; (-) strand; PAM type: NRG; PAM sequence: TGG
gaattgccctggatgaaaac

SEQ ID NO: 22585 - DNA, 20 bp, Artificial Sequence
  Description of Artificial Sequence: Synthetic oligonucleotide
  Target: SCN9A; (-) strand; PAM type: NRG; PAM sequence: TGG
aaatgccacaggaattgccc

SEQ ID NO: 22586 - DNA, 20 bp, Artificial Sequence
  Description of Artificial Sequence: Synthetic oligonucleotide
  Target: SCN9A; (-) strand; PAM type: NRG; PAM sequence: AGG
tggagagtgttaaatgccac

SEQ ID NO: 22587 - DNA, 20 bp, Artificial Sequence
  Description of Artificial Sequence: Synthetic oligonucleotide
  Target: SCN9A; (-) strand; PAM type: NRG; PAM sequence: CAG
ctggagagtgttaaatgcca

SEQ ID NO: 22588 - DNA, 20 bp, Artificial Sequence
  Description of Artificial Sequence: Synthetic oligonucleotide
  Target: SCN9A; (-) strand; PAM type: NRG; PAM sequence: GAG
agtaaataagaaaatctgga

SEQ ID NO: 22589 - DNA, 20 bp, Artificial Sequence
  Description of Artificial Sequence: Synthetic oligonucleotide
  Target: SCN9A; (-) strand; PAM type: NRG; PAM sequence: GAG
taagtaaataagaaaatctg

SEQ ID NO: 22590 - DNA, 20 bp, Artificial Sequence
  Description of Artificial Sequence: Synthetic oligonucleotide
  Target: SCN9A; (-) strand; PAM type: NRG; PAM sequence: TGG
attaagtaaataagaaaatc

SEQ ID NO: 22591 - DNA, 20 bp, Artificial Sequence
  Description of Artificial Sequence: Synthetic oligonucleotide
  Target: SCN9A; (-) strand; PAM type: NRG; PAM sequence: AAG
ttttgaaagattaagtaaat

SEQ ID NO: 22592 - DNA, 20 bp, Artificial Sequence
  Description of Artificial Sequence: Synthetic oligonucleotide
  Target: SCN9A; (-) strand; PAM type: NRG; PAM sequence: AAG
caggtaggttttgaaagatt

SEQ ID NO: 22593 - DNA, 20 bp, Artificial Sequence
  Description of Artificial Sequence: Synthetic oligonucleotide
  Target: SCN9A; (-) strand; PAM type: NRG; PAM sequence: AAG
agatgacaggtaggttttga

SEQ ID NO: 22594 - DNA, 20 bp, Artificial Sequence
  Description of Artificial Sequence: Synthetic oligonucleotide
  Target: SCN9A; (-) strand; PAM type: NRG; PAM sequence: AGG
tgaagtgtaagatgacaggt

SEQ ID NO: 22595 - DNA, 20 bp, Artificial Sequence
  Description of Artificial Sequence: Synthetic oligonucleotide
  Target: SCN9A; (-) strand; PAM type: NRG; PAM sequence: TAG
ctgaagtgtaagatgacagg

SEQ ID NO: 22596 - DNA, 20 bp, Artificial Sequence
  Description of Artificial Sequence: Synthetic oligonucleotide
  Target: SCN9A; (-) strand; PAM type: NRG; PAM sequence: AGG
aagctgaagtgtaagatgac

SEQ ID NO: 22597 - DNA, 20 bp, Artificial Sequence
  Description of Artificial Sequence: Synthetic oligonucleotide
  Target: SCN9A; (-) strand; PAM type: NRG; PAM sequence: CAG
caagctgaagtgtaagatga

SEQ ID NO: 22598 - DNA, 20 bp, Artificial Sequence
  Description of Artificial Sequence: Synthetic oligonucleotide
  Target: SCN9A; (-) strand; PAM type: NRG; PAM sequence: AAG
gggtgctcaagctgaagtgt

SEQ ID NO: 22599 - DNA, 20 bp, Artificial Sequence
  Description of Artificial Sequence: Synthetic oligonucleotide
  Target: SCN9A; (-) strand; PAM type: NRG; PAM sequence: AAG
ttgaatgggtgctcaagctg

SEQ ID NO: 22600 - DNA, 20 bp, Artificial Sequence
  Description of Artificial Sequence: Synthetic oligonucleotide
  Target: SCN9A; (-) strand; PAM type: NRG; PAM sequence: AAG
ttgtacttgaatgggtgctc

SEQ ID NO: 22601 - DNA, 20 bp, Artificial Sequence
  Description of Artificial Sequence: Synthetic oligonucleotide
  Target: SCN9A; (-) strand; PAM type: NRG; PAM sequence: GGG
taacacatttgtacttgaat

SEQ ID NO: 22602 - DNA, 20 bp, Artificial Sequence
  Description of Artificial Sequence: Synthetic oligonucleotide
  Target: SCN9A; (-) strand; PAM type: NRG; PAM sequence: TGG
ttaacacatttgtacttgaa

SEQ ID NO: 22603 - DNA, 20 bp, Artificial Sequence
  Description of Artificial Sequence: Synthetic oligonucleotide
  Target: SCN9A; (-) strand; PAM type: NRG; PAM sequence: AGG
cccagtgctccttccctaac

SEQ ID NO: 22604 - DNA, 20 bp, Artificial Sequence
  Description of Artificial Sequence: Synthetic oligonucleotide
  Target: SCN9A; (-) strand; PAM type: NRG; PAM sequence: CAG
tcccagtgctccttccctaa

SEQ ID NO: 22605 - DNA, 20 bp, Artificial Sequence
  Description of Artificial Sequence: Synthetic oligonucleotide
  Target: SCN9A; (-) strand; PAM type: NRG; PAM sequence: CAG
attgcagaaaagaaggatcc

SEQ ID NO: 22606 - DNA, 20 bp, Artificial Sequence
  Description of Artificial Sequence: Synthetic oligonucleotide
  Target: SCN9A; (-) strand; PAM type: NRG; PAM sequence: AGG
ttaatacattgcagaaaaga

SEQ ID NO: 22607 - DNA, 20 bp, Artificial Sequence
  Description of Artificial Sequence: Synthetic oligonucleotide
  Target: SCN9A; (-) strand; PAM type: NRG; PAM sequence: AAG
cttaatacattgcagaaaag

SEQ ID NO: 22608 - DNA, 20 bp, Artificial Sequence
  Description of Artificial Sequence: Synthetic oligonucleotide
  Target: SCN9A; (-) strand; PAM type: NRG; PAM sequence: AAG
ctgcttaatacattgcagaa

SEQ ID NO: 22609 - DNA, 20 bp, Artificial Sequence
  Description of Artificial Sequence: Synthetic oligonucleotide
  Target: SCN9A; (-) strand; PAM type: NRG; PAM sequence: CAG
agaacctgcttaatacattg

SEQ ID NO: 22610 - DNA, 20 bp, Artificial Sequence
  Description of Artificial Sequence: Synthetic oligonucleotide
  Target: SCN9A; (-) strand; PAM type: NRG; PAM sequence: GAG
tctctattttaaagcatctt

SEQ ID NO: 22611 - DNA, 20 bp, Artificial Sequence
  Description of Artificial Sequence: Synthetic oligonucleotide
  Target: SCN9A; (-) strand; PAM type: NRG; PAM sequence: AAG
cttagtatttctctatttta

SEQ ID NO: 22612 - DNA, 20 bp, Artificial Sequence
  Description of Artificial Sequence: Synthetic oligonucleotide
  Target: SCN9A; (-) strand; PAM type: NRG; PAM sequence: TAG
gattagtagtcagagatcct

SEQ ID NO: 22613 - DNA, 20 bp, Artificial Sequence
  Description of Artificial Sequence: Synthetic oligonucleotide
  Target: SCN9A; (-) strand; PAM type: NRG; PAM sequence: GAG
gatgatctgattagtagtca

SEQ ID NO: 22614 - DNA, 20 bp, Artificial Sequence
  Description of Artificial Sequence: Synthetic oligonucleotide
  Target: SCN9A; (-) strand; PAM type: NRG; PAM sequence: CAG
tagatgatctgattagtagt

SEQ ID NO: 22615 - DNA, 20 bp, Artificial Sequence
  Description of Artificial Sequence: Synthetic oligonucleotide
  Target: SCN9A; (-) strand; PAM type: NRG; PAM sequence: TAG
tccctagatgatctgattag

SEQ ID NO: 22616 - DNA, 20 bp, Artificial Sequence
  Description of Artificial Sequence: Synthetic oligonucleotide
  Target: SCN9A; (-) strand; PAM type: NRG; PAM sequence: TAG
ttctccctagatgatctgat

SEQ ID NO: 22617 - DNA, 20 bp, Artificial Sequence
  Description of Artificial Sequence: Synthetic oligonucleotide
  Target: SCN9A; (-) strand; PAM type: NRG; PAM sequence: TAG
atgtttgcaaaccttctccc

SEQ ID NO: 22618 - DNA, 20 bp, Artificial Sequence
  Description of Artificial Sequence: Synthetic oligonucleotide
  Target: SCN9A; (-) strand; PAM type: NRG; PAM sequence: AAG
caacggagatataacccaca

SEQ ID NO: 22619 - DNA, 20 bp, Artificial Sequence
  Description of Artificial Sequence: Synthetic oligonucleotide
  Target: SCN9A; (-) strand; PAM type: NRG; PAM sequence: GAG
agagttgaatagttgcaacg

SEQ ID NO: 22620 - DNA, 20 bp, Artificial Sequence
  Description of Artificial Sequence: Synthetic oligonucleotide
  Target: SCN9A; (-) strand; PAM type: NRG; PAM sequence: CGG
gcagagttgaatagttgcaa

SEQ ID NO: 22621 - DNA, 20 bp, Artificial Sequence
  Description of Artificial Sequence: Synthetic oligonucleotide
  Target: SCN9A; (-) strand; PAM type: NRG; PAM sequence: TAG
actaccatggcagagttgaa

SEQ ID NO: 22622 - DNA, 20 bp, Artificial Sequence
  Description of Artificial Sequence: Synthetic oligonucleotide
  Target: SCN9A; (-) strand; PAM type: NRG; PAM sequence: GAG
gacccatgactaccatggca

SEQ ID NO: 22623 - DNA, 20 bp, Artificial Sequence
  Description of Artificial Sequence: Synthetic oligonucleotide
  Target: SCN9A; (-) strand; PAM type: NRG; PAM sequence: CAG
atgacccatgactaccatgg

SEQ ID NO: 22624 - DNA, 20 bp, Artificial Sequence
  Description of Artificial Sequence: Synthetic oligonucleotide
  Target: SCN9A; (-) strand; PAM type: NRG; PAM sequence: TGG
tgtatgacccatgactacca

SEQ ID NO: 22625 - DNA, 20 bp, Artificial Sequence
  Description of Artificial Sequence: Synthetic oligonucleotide
  Target: SCN9A; (-) strand; PAM type: NRG; PAM sequence: CAG
ttcttggaacacagccatac

SEQ ID NO: 22626 - DNA, 20 bp, Artificial Sequence
  Description of Artificial Sequence: Synthetic oligonucleotide
  Target: SCN9A; (-) strand; PAM type: NRG; PAM sequence: CAG
gtaaaaatgttcttggaaca

SEQ ID NO: 22627 - DNA, 20 bp, Artificial Sequence
  Description of Artificial Sequence: Synthetic oligonucleotide
  Target: SCN9A; (-) strand; PAM type: NRG; PAM sequence: TGG
tgtttttgtaaaaatgttct

SEQ ID NO: 22628 - DNA, 20 bp, Artificial Sequence
  Description of Artificial Sequence: Synthetic oligonucleotide
  Target: SCN9A; (-) strand; PAM type: NRG; PAM sequence: CAG
gaccaaaggtcaacaaaccc

SEQ ID NO: 22629 - DNA, 20 bp, Artificial Sequence
  Description of Artificial Sequence: Synthetic oligonucleotide
  Target: SCN9A; (-) strand; PAM type: NRG; PAM sequence: AGG
taatcattgctctggaccaa

SEQ ID NO: 22630 - DNA, 20 bp, Artificial Sequence
  Description of Artificial Sequence: Synthetic oligonucleotide
  Target: SCN9A; (-) strand; PAM type: NRG; PAM sequence: AAG
ataatcattgctctggacca

SEQ ID NO: 22631 - DNA, 20 bp, Artificial Sequence
  Description of Artificial Sequence: Synthetic oligonucleotide
  Target: SCN9A; (-) strand; PAM type: NRG; PAM sequence: TGG
actccaaataatcattgctc

SEQ ID NO: 22632 - DNA, 20 bp, Artificial Sequence
  Description of Artificial Sequence: Synthetic oligonucleotide
  Target: SCN9A; (-) strand; PAM type: NRG; PAM sequence: AGG
tgcccccaggaaacctctac

SEQ ID NO: 22633 - DNA, 20 bp, Artificial Sequence
  Description of Artificial Sequence: Synthetic oligonucleotide
  Target: SCN9A; (-) strand; PAM type: NRG; PAM sequence: CAG
atgcccccaggaaacctcta

SEQ ID NO: 22634 - DNA, 20 bp, Artificial Sequence
  Description of Artificial Sequence: Synthetic oligonucleotide
  Target: SCN9A; (-) strand; PAM type: NRG; PAM sequence: AGG
ttatataatttcatgccccc

SEQ ID NO: 22635 - DNA, 20 bp, Artificial Sequence
  Description of Artificial Sequence: Synthetic oligonucleotide
  Target: SCN9A; (-) strand; PAM type: NRG; PAM sequence: CAG
gttatataatttcatgcccc

SEQ ID NO: 22636 - DNA, 20 bp, Artificial Sequence
  Description of Artificial Sequence: Synthetic oligonucleotide
  Target: SCN9A; (-) strand; PAM type: NRG; PAM sequence: CAG
gaattgtctttccggaaaga

SEQ ID NO: 22637 - DNA, 20 bp, Artificial Sequence
  Description of Artificial Sequence: Synthetic oligonucleotide
  Target: SCN9A; (-) strand; PAM type: NRG; PAM sequence: AAG
gttagaattgtctttccgga

SEQ ID NO: 22638 - DNA, 20 bp, Artificial Sequence
  Description of Artificial Sequence: Synthetic oligonucleotide
  Target: SCN9A; (-) strand; PAM type: NRG; PAM sequence: CGG
gaaagttagaattgtctttc

SEQ ID NO: 22639 - DNA, 20 bp, Artificial Sequence
  Description of Artificial Sequence: Synthetic oligonucleotide
  Target: SCN9A; (-) strand; PAM type: NRG; PAM sequence: TAG
tgtaagaatctgatgaaagt

SEQ ID NO: 22640 - DNA, 20 bp, Artificial Sequence
  Description of Artificial Sequence: Synthetic oligonucleotide
  Target: SCN9A; (-) strand; PAM type: NRG; PAM sequence: AAG
agactgtaagaatctgatga

SEQ ID NO: 22641 - DNA, 20 bp, Artificial Sequence
  Description of Artificial Sequence: Synthetic oligonucleotide
  Target: SCN9A; (-) strand; PAM type: NRG; PAM sequence: AAG
tttgaggtcacatagactgt

SEQ ID NO: 22642 - DNA, 20 bp, Artificial Sequence
  Description of Artificial Sequence: Synthetic oligonucleotide
  Target: SCN9A; (-) strand; PAM type: NRG; PAM sequence: TAG
taatcttttttgaggtcaca

SEQ ID NO: 22643 - DNA, 20 bp, Artificial Sequence
  Description of Artificial Sequence: Synthetic oligonucleotide
  Target: SCN9A; (-) strand; PAM type: NRG; PAM sequence: AGG
attcctcctaatcttttttg

SEQ ID NO: 22644 - DNA, 20 bp, Artificial Sequence
  Description of Artificial Sequence: Synthetic oligonucleotide
  Target: SCN9A; (-) strand; PAM type: NRG; PAM sequence: GAG
tattcctcctaatctttttt

SEQ ID NO: 22645 - DNA, 20 bp, Artificial Sequence
  Description of Artificial Sequence: Synthetic oligonucleotide
  Target: SCN9A; (-) strand; PAM type: NRG; PAM sequence: TGG
aggtaggctctattaagagc

SEQ ID NO: 22646 - DNA, 20 bp, Artificial Sequence
  Description of Artificial Sequence: Synthetic oligonucleotide
  Target: SCN9A; (-) strand; PAM type: NRG; PAM sequence: GAG
gaaaaggtaggctctattaa

SEQ ID NO: 22647 - DNA, 20 bp, Artificial Sequence
  Description of Artificial Sequence: Synthetic oligonucleotide
  Target: SCN9A; (-) strand; PAM type: NRG; PAM sequence: AAG
atgaaaaggtaggctctatt

SEQ ID NO: 22648 - DNA, 20 bp, Artificial Sequence
  Description of Artificial Sequence: Synthetic oligonucleotide
  Target: SCN9A; (-) strand; PAM type: NRG; PAM sequence: AGG
ggaaatgagcatgaaaaggt

SEQ ID NO: 22649 - DNA, 20 bp, Artificial Sequence
  Description of Artificial Sequence: Synthetic oligonucleotide
  Target: SCN9A; (-) strand; PAM type: NRG; PAM sequence: TAG
aggaaatgagcatgaaaagg

SEQ ID NO: 22650 - DNA, 20 bp, Artificial Sequence
  Description of Artificial Sequence: Synthetic oligonucleotide
  Target: SCN9A; (-) strand; PAM type: NRG; PAM sequence: AGG
agcaggaaatgagcatgaaa

SEQ ID NO: 22651 - DNA, 20 bp, Artificial Sequence
  Description of Artificial Sequence: Synthetic oligonucleotide
  Target: SCN9A; (-) strand; PAM type: NRG; PAM sequence: AAG
cagcaggaaatgagcatgaa

SEQ ID NO: 22652 - DNA, 20 bp, Artificial Sequence
  Description of Artificial Sequence: Synthetic oligonucleotide
  Target: SCN9A; (-) strand; PAM type: NRG; PAM sequence: GAG
tagggagggcagcaggaaat

SEQ ID NO: 22653 - DNA, 20 bp, Artificial Sequence
  Description of Artificial Sequence: Synthetic oligonucleotide
  Target: SCN9A; (-) strand; PAM type: NRG; PAM sequence: AGG
aacatagtagggagggcagc

SEQ ID NO: 22654 - DNA, 20 bp, Artificial Sequence
  Description of Artificial Sequence: Synthetic oligonucleotide
  Target: SCN9A; (-) strand; PAM type: NRG; PAM sequence: CAG
aaacatagtagggagggcag

SEQ ID NO: 22655 - DNA, 20 bp, Artificial Sequence
  Description of Artificial Sequence: Synthetic oligonucleotide
  Target: SCN9A; (-) strand; PAM type: NRG; PAM sequence: CAG
gataaacatagtagggaggg

SEQ ID NO: 22656 - DNA, 20 bp, Artificial Sequence
  Description of Artificial Sequence: Synthetic oligonucleotide
  Target: SCN9A; (-) strand; PAM type: NRG; PAM sequence: GGG
cgtgataaacatagtaggga

SEQ ID NO: 22657 - DNA, 20 bp, Artificial Sequence
  Description of Artificial Sequence: Synthetic oligonucleotide
  Target: SCN9A; (-) strand; PAM type: NRG; PAM sequence: AGG
acgtgataaacatagtaggg

SEQ ID NO: 22658 - DNA, 20 bp, Artificial Sequence
  Description of Artificial Sequence: Synthetic oligonucleotide
  Target: SCN9A; (-) strand; PAM type: NRG; PAM sequence: GAG
tacgtgataaacatagtagg

SEQ ID NO: 22659 - DNA, 20 bp, Artificial Sequence
  Description of Artificial Sequence: Synthetic oligonucleotide
  Target: SCN9A; (-) strand; PAM type: NRG; PAM sequence: GGG
cctacgtgataaacatagta

SEQ ID NO: 22660 - DNA, 20 bp, Artificial Sequence
  Description of Artificial Sequence: Synthetic oligonucleotide
  Target: SCN9A; (-) strand; PAM type: NRG; PAM sequence: AGG
gcctacgtgataaacatagt

SEQ ID NO: 22661 - DNA, 20 bp, Artificial Sequence
  Description of Artificial Sequence: Synthetic oligonucleotide
  Target: SCN9A; (-) strand; PAM type: NRG; PAM sequence: TAG
tgcctacgtgataaacatag

SEQ ID NO: 22662 - DNA, 20 bp, Artificial Sequence
  Description of Artificial Sequence: Synthetic oligonucleotide
  Target: SCN9A; (-) strand; PAM type: NRG; PAM sequence: TAG
gagtgcctacgtgataaaca

SEQ ID NO: 22663 - DNA, 20 bp, Artificial Sequence
  Description of Artificial Sequence: Synthetic oligonucleotide
  Target: SCN9A; (-) strand; PAM type: NRG; PAM sequence: GAG
gtcagtgactagatgtatca

SEQ ID NO: 22664 - DNA, 20 bp, Artificial Sequence
  Description of Artificial Sequence: Synthetic oligonucleotide
  Target: SCN9A; (-) strand; PAM type: NRG; PAM sequence: CAG
tggtcagtgactagatgtat

SEQ ID NO: 22665 - DNA, 20 bp, Artificial Sequence
  Description of Artificial Sequence: Synthetic oligonucleotide
  Target: SCN9A; (-) strand; PAM type: NRG; PAM sequence: TAG
aggtgtgcttggtcagtgac

SEQ ID NO: 22666 - DNA, 20 bp, Artificial Sequence
  Description of Artificial Sequence: Synthetic oligonucleotide
  Target: SCN9A; (-) strand; PAM type: NRG; PAM sequence: CAG
ttgtgcaaggtgtgcttggt

SEQ ID NO: 22667 - DNA, 20 bp, Artificial Sequence
  Description of Artificial Sequence: Synthetic oligonucleotide
  Target: SCN9A; (-) strand; PAM type: NRG; PAM sequence: TGG
tagattgtgcaaggtgtgct

SEQ ID NO: 22668 - DNA, 20 bp, Artificial Sequence
  Description of Artificial Sequence: Synthetic oligonucleotide
  Target: SCN9A; (-) strand; PAM type: NRG; PAM sequence: AGG
ggcacagaatagattgtgca

SEQ ID NO: 22669 - DNA, 20 bp, Artificial Sequence
  Description of Artificial Sequence: Synthetic oligonucleotide
  Target: SCN9A; (-) strand; PAM type: NRG; PAM sequence: AAG
aggcacagaatagattgtgc

SEQ ID NO: 22670 - DNA, 20 bp, Artificial Sequence
  Description of Artificial Sequence: Synthetic oligonucleotide
  Target: SCN9A; (-) strand; PAM type: NRG; PAM sequence: TAG
catggtagggaggcacagaa

SEQ ID NO: 22671 - DNA, 20 bp, Artificial Sequence
  Description of Artificial Sequence: Synthetic oligonucleotide
  Target: SCN9A; (-) strand; PAM type: NRG; PAM sequence: CAG
taccacatggtagggaggca

SEQ ID NO: 22672 - DNA, 20 bp, Artificial Sequence
  Description of Artificial Sequence: Synthetic oligonucleotide
  Target: SCN9A; (-) strand; PAM type: NRG; PAM sequence: AGG
agtgataccacatggtaggg

SEQ ID NO: 22673 - DNA, 20 bp, Artificial Sequence
  Description of Artificial Sequence: Synthetic oligonucleotide
  Target: SCN9A; (-) strand; PAM type: NRG; PAM sequence: GAG
cagtgataccacatggtagg

SEQ ID NO: 22674 - DNA, 20 bp, Artificial Sequence
  Description of Artificial Sequence: Synthetic oligonucleotide
  Target: SCN9A; (-) strand; PAM type: NRG; PAM sequence: GGG
ggcagtgataccacatggta

SEQ ID NO: 22675 - DNA, 20 bp, Artificial Sequence
  Description of Artificial Sequence: Synthetic oligonucleotide
  Target: SCN9A; (-) strand; PAM type: NRG; PAM sequence: AGG
aggcagtgataccacatggt

SEQ ID NO: 22676 - DNA, 20 bp, Artificial Sequence
  Description of Artificial Sequence: Synthetic oligonucleotide
  Target: SCN9A; (-) strand; PAM type: NRG; PAM sequence: TAG
aaggcagtgataccacatgg

SEQ ID NO: 22677 - DNA, 20 bp, Artificial Sequence
  Description of Artificial Sequence: Synthetic oligonucleotide
  Target: SCN9A; (-) strand; PAM type: NRG; PAM sequence: TGG
ttcaaggcagtgataccaca

SEQ ID NO: 22678 - DNA, 20 bp, Artificial Sequence
  Description of Artificial Sequence: Synthetic oligonucleotide
  Target: SCN9A; (-) strand; PAM type: NRG; PAM sequence: CAG
aggcagataggcattcaagg

SEQ ID NO: 22679 - DNA, 20 bp, Artificial Sequence
  Description of Artificial Sequence: Synthetic oligonucleotide
  Target: SCN9A; (-) strand; PAM type: NRG; PAM sequence: AGG
cataggcagataggcattca

SEQ ID NO: 22680 - DNA, 20 bp, Artificial Sequence
  Description of Artificial Sequence: Synthetic oligonucleotide
  Target: SCN9A; (-) strand; PAM type: NRG; PAM sequence: AAG
tcataggcagataggcattc

SEQ ID NO: 22681 - DNA, 20 bp, Artificial Sequence
  Description of Artificial Sequence: Synthetic oligonucleotide
  Target: SCN9A; (-) strand; PAM type: NRG; PAM sequence: AGG
gccccaaatcataggcagat

SEQ ID NO: 22682 - DNA, 20 bp, Artificial Sequence
  Description of Artificial Sequence: Synthetic oligonucleotide
  Target: SCN9A; (-) strand; PAM type: NRG; PAM sequence: TAG
agccccaaatcataggcaga

SEQ ID NO: 22683 - DNA, 20 bp, Artificial Sequence
  Description of Artificial Sequence: Synthetic oligonucleotide
  Target: SCN9A; (-) strand; PAM type: NRG; PAM sequence: CAG
agtaagccccaaatcatagg

SEQ ID NO: 22684 - DNA, 20 bp, Artificial Sequence
  Description of Artificial Sequence: Synthetic oligonucleotide
  Target: SCN9A; (-) strand; PAM type: NRG; PAM sequence: AGG
aagagtaagccccaaatcat

SEQ ID NO: 22685 - DNA, 20 bp, Artificial Sequence
  Description of Artificial Sequence: Synthetic oligonucleotide
  Target: SCN9A; (-) strand; PAM type: NRG; PAM sequence: TAG
gaagagtaagccccaaatca

SEQ ID NO: 22686 - DNA, 20 bp, Artificial Sequence
  Description of Artificial Sequence: Synthetic oligonucleotide
  Target: SCN9A; (-) strand; PAM type: NRG; PAM sequence: AAG
acatttcatgactgaagagt

SEQ ID NO: 22687 - DNA, 20 bp, Artificial Sequence
  Description of Artificial Sequence: Synthetic oligonucleotide
  Target: SCN9A; (-) strand; PAM type: NRG; PAM sequence: GAG
tcagacatttcatgactgaa

SEQ ID NO: 22688 - DNA, 20 bp, Artificial Sequence
  Description of Artificial Sequence: Synthetic oligonucleotide
  Target: SCN9A; (-) strand; PAM type: NRG; PAM sequence: AAG
tttcagacatttcatgactg

SEQ ID NO: 22689 - DNA, 20 bp, Artificial Sequence
  Description of Artificial Sequence: Synthetic oligonucleotide
  Target: SCN9A; (-) strand; PAM type: NRG; PAM sequence: CAG
atcacaaggaggtgacattt

SEQ ID NO: 22690 - DNA, 20 bp, Artificial Sequence
  Description of Artificial Sequence: Synthetic oligonucleotide
  Target: SCN9A; (-) strand; PAM type: NRG; PAM sequence: AGG
tctgggaagacatcacaagg

SEQ ID NO: 22691 - DNA, 20 bp, Artificial Sequence
  Description of Artificial Sequence: Synthetic oligonucleotide
  Target: SCN9A; (-) strand; PAM type: NRG; PAM sequence: GAG
gtctgggaagacatcacaag

SEQ ID NO: 22692 - DNA, 20 bp, Artificial Sequence
  Description of Artificial Sequence: Synthetic oligonucleotide
  Target: SCN9A; (-) strand; PAM type: NRG; PAM sequence: AGG
aagtctgggaagacatcaca

SEQ ID NO: 22693 - DNA, 20 bp, Artificial Sequence
  Description of Artificial Sequence: Synthetic oligonucleotide
  Target: SCN9A; (-) strand; PAM type: NRG; PAM sequence: AAG
gaagtctgggaagacatcac

SEQ ID NO: 22694 - DNA, 20 bp, Artificial Sequence
  Description of Artificial Sequence: Synthetic oligonucleotide
  Target: SCN9A; (-) strand; PAM type: NRG; PAM sequence: AAG
gctatccggggaagtctggg

SEQ ID NO: 22695 - DNA, 20 bp, Artificial Sequence
  Description of Artificial Sequence: Synthetic oligonucleotide
  Target: SCN9A; (-) strand; PAM type: NRG; PAM sequence: GGG
gtggctatccggggaagtct

SEQ ID NO: 22696 - DNA, 20 bp, Artificial Sequence
  Description of Artificial Sequence: Synthetic oligonucleotide
  Target: SCN9A; (-) strand; PAM type: NRG; PAM sequence: TGG
agtggctatccggggaagtc

SEQ ID NO: 22697 - DNA, 20 bp, Artificial Sequence
  Description of Artificial Sequence: Synthetic oligonucleotide
  Target: SCN9A; (-) strand; PAM type: NRG; PAM sequence: AAG
tagggagtggctatccgggg

SEQ ID NO: 22698 - DNA, 20 bp, Artificial Sequence
  Description of Artificial Sequence: Synthetic oligonucleotide
  Target: SCN9A; (-) strand; PAM type: NRG; PAM sequence: GGG
cagtagggagtggctatccg

SEQ ID NO: 22699 - DNA, 20 bp, Artificial Sequence
  Description of Artificial Sequence: Synthetic oligonucleotide
  Target: SCN9A; (-) strand; PAM type: NRG; PAM sequence: GGG
acagtagggagtggctatcc

SEQ ID NO: 22700 - DNA, 20 bp, Artificial Sequence
  Description of Artificial Sequence: Synthetic oligonucleotide
  Target: SCN9A; (-) strand; PAM type: NRG; PAM sequence: CGG
tacagtagggagtggctatc

SEQ ID NO: 22701 - DNA, 20 bp, Artificial Sequence
  Description of Artificial Sequence: Synthetic oligonucleotide
  Target: SCN9A; (-) strand; PAM type: NRG; PAM sequence: TGG
caggaatatacagtagggag

SEQ ID NO: 22702 - DNA, 20 bp, Artificial Sequence
  Description of Artificial Sequence: Synthetic oligonucleotide
  Target: SCN9A; (-) strand; PAM type: NRG; PAM sequence: GAG
atacaggaatatacagtagg

SEQ ID NO: 22703 - DNA, 20 bp, Artificial Sequence
  Description of Artificial Sequence: Synthetic oligonucleotide
  Target: SCN9A; (-) strand; PAM type: NRG; PAM sequence: GGG
tgatacaggaatatacagta

SEQ ID NO: 22704 - DNA, 20 bp, Artificial Sequence
  Description of Artificial Sequence: Synthetic oligonucleotide
  Target: SCN9A; (-) strand; PAM type: NRG; PAM sequence: AGG
atgatacaggaatatacagt

SEQ ID NO: 22705 - DNA, 20 bp, Artificial Sequence
  Description of Artificial Sequence: Synthetic oligonucleotide
  Target: SCN9A; (-) strand; PAM type: NRG; PAM sequence: TAG
aatgatacaggaatatacag

SEQ ID NO: 22706 - DNA, 20 bp, Artificial Sequence
  Description of Artificial Sequence: Synthetic oligonucleotide
  Target: SCN9A; (-) strand; PAM type: NRG; PAM sequence: CAG
cataatgatacaggaatata

SEQ ID NO: 22707 - DNA, 20 bp, Artificial Sequence
  Description of Artificial Sequence: Synthetic oligonucleotide
  Target: SCN9A; (-) strand; PAM type: NRG; PAM sequence: AGG
acaagggcacataatgatac

SEQ ID NO: 22708 - DNA, 20 bp, Artificial Sequence
  Description of Artificial Sequence: Synthetic oligonucleotide
  Target: SCN9A; (-) strand; PAM type: NRG; PAM sequence: CAG
gacaagggcacataatgata

SEQ ID NO: 22709 - DNA, 20 bp, Artificial Sequence
  Description of Artificial Sequence: Synthetic oligonucleotide
  Target: SCN9A; (-) strand; PAM type: NRG; PAM sequence: GGG
gttacaagagagacagacaa

SEQ ID NO: 22710 - DNA, 20 bp, Artificial Sequence
  Description of Artificial Sequence: Synthetic oligonucleotide
  Target: SCN9A; (-) strand; PAM type: NRG; PAM sequence: AGG
ggttacaagagagacagaca

SEQ ID NO: 22711 - DNA, 20 bp, Artificial Sequence
  Description of Artificial Sequence: Synthetic oligonucleotide
  Target: SCN9A; (-) strand; PAM type: NRG; PAM sequence: AAG
tggttacaagagagacagac

SEQ ID NO: 22712 - DNA, 20 bp, Artificial Sequence
  Description of Artificial Sequence: Synthetic oligonucleotide
  Target: SCN9A; (-) strand; PAM type: NRG; PAM sequence: CAG
gtcaatggttacaagagaga

SEQ ID NO: 22713 - DNA, 20 bp, Artificial Sequence
  Description of Artificial Sequence: Synthetic oligonucleotide
  Target: SCN9A; (-) strand; PAM type: NRG; PAM sequence: GAG
tagggtcaatggttacaaga

SEQ ID NO: 22714 - DNA, 20 bp, Artificial Sequence
  Description of Artificial Sequence: Synthetic oligonucleotide
  Target: SCN9A; (-) strand; PAM type: NRG; PAM sequence: GAG
agtagggtcaatggttacaa

SEQ ID NO: 22715 - DNA, 20 bp, Artificial Sequence
  Description of Artificial Sequence: Synthetic oligonucleotide
  Target: SCN9A; (-) strand; PAM type: NRG; PAM sequence: AAG
tgagtagggtcaatggttac

SEQ ID NO: 22716 - DNA, 20 bp, Artificial Sequence
  Description of Artificial Sequence: Synthetic oligonucleotide
  Target: SCN9A; (-) strand; PAM type: NRG; PAM sequence: TGG
caaagagtgagtagggtcaa

SEQ ID NO: 22717 - DNA, 20 bp, Artificial Sequence
  Description of Artificial Sequence: Synthetic oligonucleotide
  Target: SCN9A; (-) strand; PAM type: NRG; PAM sequence: GGG
cggtccccaaagagtgagta

SEQ ID NO: 22718 - DNA, 20 bp, Artificial Sequence
  Description of Artificial Sequence: Synthetic oligonucleotide
  Target: SCN9A; (-) strand; PAM type: NRG; PAM sequence: AGG
ccggtccccaaagagtgagt

SEQ ID NO: 22719 - DNA, 20 bp, Artificial Sequence
  Description of Artificial Sequence: Synthetic oligonucleotide
  Target: SCN9A; (-) strand; PAM type: NRG; PAM sequence: TAG
cccggtccccaaagagtgag

SEQ ID NO: 22720 - DNA, 20 bp, Artificial Sequence
  Description of Artificial Sequence: Synthetic oligonucleotide
  Target: SCN9A; (-) strand; PAM type: NRG; PAM sequence: GAG
gaccccggtccccaaagagt

SEQ ID NO: 22721 - DNA, 20 bp, Artificial Sequence
  Description of Artificial Sequence: Synthetic oligonucleotide
  Target: SCN9A; (-) strand; PAM type: NRG; PAM sequence: GAG
catagaccccggtccccaaa

SEQ ID NO: 22722 - DNA, 20 bp, Artificial Sequence
  Description of Artificial Sequence: Synthetic oligonucleotide
  Target: SCN9A; (-) strand; PAM type: NRG; PAM sequence: AAG
tacatagaccccggtcccca

SEQ ID NO: 22723 - DNA, 20 bp, Artificial Sequence
  Description of Artificial Sequence: Synthetic oligonucleotide
  Target: SCN9A; (-) strand; PAM type: NRG; PAM sequence: CGG
gtacagtggtacatagaccc

SEQ ID NO: 22724 - DNA, 20 bp, Artificial Sequence
  Description of Artificial Sequence: Synthetic oligonucleotide
  Target: SCN9A; (-) strand; PAM type: NRG; PAM sequence: TAG
acacagagtacagtggtaca

SEQ ID NO: 22725 - DNA, 20 bp, Artificial Sequence
  Description of Artificial Sequence: Synthetic oligonucleotide
  Target: SCN9A; (-) strand; PAM type: NRG; PAM sequence: TGG
ataaaaaacacagagtacag

SEQ ID NO: 22726 - DNA, 20 bp, Artificial Sequence
  Description of Artificial Sequence: Synthetic oligonucleotide
  Target: SCN9A; (-) strand; PAM type: NRG; PAM sequence: CAG
gatataaaaaacacagagta

SEQ ID NO: 22727 - DNA, 20 bp, Artificial Sequence
  Description of Artificial Sequence: Synthetic oligonucleotide
  Target: SCN9A; (-) strand; PAM type: NRG; PAM sequence: GAG
gttgtgatataaaaaacaca

SEQ ID NO: 22728 - DNA, 20 bp, Artificial Sequence
  Description of Artificial Sequence: Synthetic oligonucleotide
  Target: SCN9A; (-) strand; PAM type: NRG; PAM sequence: CAG
gtgttgtgatataaaaaaca

SEQ ID NO: 22729 - DNA, 20 bp, Artificial Sequence
  Description of Artificial Sequence: Synthetic oligonucleotide
  Target: SCN9A; (-) strand; PAM type: NRG; PAM sequence: AGG
ttaaacaccaactatgtgtc

SEQ ID NO: 22730 - DNA, 20 bp, Artificial Sequence
  Description of Artificial Sequence: Synthetic oligonucleotide
  Target: SCN9A; (-) strand; PAM type: NRG; PAM sequence: CAG
tttaaacaccaactatgtgt

SEQ ID NO: 22731 - DNA, 20 bp, Artificial Sequence
  Description of Artificial Sequence: Synthetic oligonucleotide
  Target: SCN9A; (-) strand; PAM type: NRG; PAM sequence: TAG
ccatcattactcacattttt

SEQ ID NO: 22732 - DNA, 20 bp, Artificial Sequence
  Description of Artificial Sequence: Synthetic oligonucleotide
  Target: SCN9A; (-) strand; PAM type: NRG; PAM sequence: GAG
ataggtgcctgtctttctca

SEQ ID NO: 22733 - DNA, 20 bp, Artificial Sequence
  Description of Artificial Sequence: Synthetic oligonucleotide
  Target: SCN9A; (-) strand; PAM type: NRG; PAM sequence: CAG
caataggtgcctgtctttct

SEQ ID NO: 22734 - DNA, 20 bp, Artificial Sequence
  Description of Artificial Sequence: Synthetic oligonucleotide
  Target: SCN9A; (-) strand; PAM type: NRG; PAM sequence: AGG
tggcttctcatcagaccaat

SEQ ID NO: 22735 - DNA, 20 bp, Artificial Sequence
  Description of Artificial Sequence: Synthetic oligonucleotide
  Target: SCN9A; (-) strand; PAM type: NRG; PAM sequence: TAG
ctggcttctcatcagaccaa

SEQ ID NO: 22736 - DNA, 20 bp, Artificial Sequence
  Description of Artificial Sequence: Synthetic oligonucleotide
  Target: SCN9A; (-) strand; PAM type: NRG; PAM sequence: CAG
tttcccaactggcttctcat

SEQ ID NO: 22737 - DNA, 20 bp, Artificial Sequence
  Description of Artificial Sequence: Synthetic oligonucleotide
  Target: SCN9A; (-) strand; PAM type: NRG; PAM sequence: TGG
ggctctttagctttcccaac

SEQ ID NO: 22738 - DNA, 20 bp, Artificial Sequence
  Description of Artificial Sequence: Synthetic oligonucleotide
  Target: SCN9A; (-) strand; PAM type: NRG; PAM sequence: TAG
gtttgagtccttaggctctt

SEQ ID NO: 22739 - DNA, 20 bp, Artificial Sequence
  Description of Artificial Sequence: Synthetic oligonucleotide
  Target: SCN9A; (-) strand; PAM type: NRG; PAM sequence: AGG
gtcagcttgtttgagtcctt

SEQ ID NO: 22740 - DNA, 20 bp, Artificial Sequence
  Description of Artificial Sequence: Synthetic oligonucleotide
  Target: SCN9A; (-) strand; PAM type: NRG; PAM sequence: TAG
agtcagcttgtttgagtcct

SEQ ID NO: 22741 - DNA, 20 bp, Artificial Sequence
  Description of Artificial Sequence: Synthetic oligonucleotide
  Target: SCN9A; (-) strand; PAM type: NRG; PAM sequence: GAG
atattgtagtcagcttgttt

SEQ ID NO: 22742 - DNA, 20 bp, Artificial Sequence
  Description of Artificial Sequence: Synthetic oligonucleotide
  Target: SCN9A; (-) strand; PAM type: NRG; PAM sequence: CAG
catttgaggcatattgtagt

SEQ ID NO: 22743 - DNA, 20 bp, Artificial Sequence
  Description of Artificial Sequence: Synthetic oligonucleotide
  Target: SCN9A; (-) strand; PAM type: NRG; PAM sequence: TAG
aatgcatttgaggcatattg

SEQ ID NO: 22744 - DNA, 20 bp, Artificial Sequence
  Description of Artificial Sequence: Synthetic oligonucleotide
  Target: SCN9A; (-) strand; PAM type: NRG; PAM sequence: AGG
ataatgaaataatgcatttg

SEQ ID NO: 22745 - DNA, 20 bp, Artificial Sequence
  Description of Artificial Sequence: Synthetic oligonucleotide
  Target: SCN9A; (-) strand; PAM type: NRG; PAM sequence: GAG
aataatgaaataatgcattt

SEQ ID NO: 22746 - DNA, 20 bp, Artificial Sequence
  Description of Artificial Sequence: Synthetic oligonucleotide
  Target: SCN9A; (-) strand; PAM type: NRG; PAM sequence: AGG
atgccgcagggctattttga

SEQ ID NO: 22747 - DNA, 20 bp, Artificial Sequence
  Description of Artificial Sequence: Synthetic oligonucleotide
  Target: SCN9A; (-) strand; PAM type: NRG; PAM sequence: AAG
catgccgcagggctattttg

SEQ ID NO: 22748 - DNA, 20 bp, Artificial Sequence
  Description of Artificial Sequence: Synthetic oligonucleotide
  Target: SCN9A; (-) strand; PAM type: NRG; PAM sequence: GGG
agacatttattcatgccgca

SEQ ID NO: 22749 - DNA, 20 bp, Artificial Sequence
  Description of Artificial Sequence: Synthetic oligonucleotide
  Target: SCN9A; (-) strand; PAM type: NRG; PAM sequence: AGG
gagacatttattcatgccgc

SEQ ID NO: 22750 - DNA, 20 bp, Artificial Sequence
  Description of Artificial Sequence: Synthetic oligonucleotide
  Target: SCN9A; (-) strand; PAM type: NRG; PAM sequence: CAG
agagacatttattcatgccg

SEQ ID NO: 22751 - DNA, 20 bp, Artificial Sequence
  Description of Artificial Sequence: Synthetic oligonucleotide
  Target: SCN9A; (-) strand; PAM type: NRG; PAM sequence: GAG
atttgttaaccatgcaaaaa

SEQ ID NO: 22752 - DNA, 20 bp, Artificial Sequence
  Description of Artificial Sequence: Synthetic oligonucleotide
  Target: SCN9A; (-) strand; PAM type: NRG; PAM sequence: AAG
acatttgttaaccatgcaaa

SEQ ID NO: 22753 - DNA, 20 bp, Artificial Sequence
  Description of Artificial Sequence: Synthetic oligonucleotide
  Target: SCN9A; (-) strand; PAM type: NRG; PAM sequence: TAG
ttgagaggcaaatgtctatt

SEQ ID NO: 22754 - DNA, 20 bp, Artificial Sequence
  Description of Artificial Sequence: Synthetic oligonucleotide
  Target: SCN9A; (-) strand; PAM type: NRG; PAM sequence: AGG
atagtttagtatattttgag

SEQ ID NO: 22755 - DNA, 20 bp, Artificial Sequence
  Description of Artificial Sequence: Synthetic oligonucleotide
  Target: SCN9A; (-) strand; PAM type: NRG; PAM sequence: GAG
aatagtttagtatattttga

SEQ ID NO: 22756 - DNA, 20 bp, Artificial Sequence
  Description of Artificial Sequence: Synthetic oligonucleotide
  Target: SCN9A; (-) strand; PAM type: NRG; PAM sequence: GAG
agaatagtttagtatatttt

SEQ ID NO: 22757 - DNA, 20 bp, Artificial Sequence
  Description of Artificial Sequence: Synthetic oligonucleotide
  Target: SCN9A; (-) strand; PAM type: NRG; PAM sequence: TAG
ttggatgcaggagaatagtt

SEQ ID NO: 22758 - DNA, 20 bp, Artificial Sequence
  Description of Artificial Sequence: Synthetic oligonucleotide
  Target: SCN9A; (-) strand; PAM type: NRG; PAM sequence: TAG
gtgaattggatgcaggagaa

SEQ ID NO: 22759 - DNA, 20 bp, Artificial Sequence
  Description of Artificial Sequence: Synthetic oligonucleotide
  Target: SCN9A; (-) strand; PAM type: NRG; PAM sequence: GAG
tacaggtgaattggatgcag

SEQ ID NO: 22760 - DNA, 20 bp, Artificial Sequence
  Description of Artificial Sequence: Synthetic oligonucleotide
  Target: SCN9A; (-) strand; PAM type: NRG; PAM sequence: AGG
attacaggtgaattggatgc

SEQ ID NO: 22761 - DNA, 20 bp, Artificial Sequence
  Description of Artificial Sequence: Synthetic oligonucleotide
  Target: SCN9A; (-) strand; PAM type: NRG; PAM sequence: CAG
tattacaggtgaattggatg

SEQ ID NO: 22762 - DNA, 20 bp, Artificial Sequence
  Description of Artificial Sequence: Synthetic oligonucleotide
  Target: SCN9A; (-) strand; PAM type: NRG; PAM sequence: TGG
tatctgtattacaggtgaat

SEQ ID NO: 22763 - DNA, 20 bp, Artificial Sequence
  Description of Artificial Sequence: Synthetic oligonucleotide
  Target: SCN9A; (-) strand; PAM type: NRG; PAM sequence: AGG
ttgttctttatctgtattac

SEQ ID NO: 22764 - DNA, 20 bp, Artificial Sequence
  Description of Artificial Sequence: Synthetic oligonucleotide
  Target: SCN9A; (-) strand; PAM type: NRG; PAM sequence: CAG
tttgttctttatctgtatta

SEQ ID NO: 22765 - DNA, 20 bp, Artificial Sequence
  Description of Artificial Sequence: Synthetic oligonucleotide
  Target: SCN9A; (-) strand; PAM type: NRG; PAM sequence: CAG
acttccttcagtgattaagc

SEQ ID NO: 22766 - DNA, 20 bp, Artificial Sequence
  Description of Artificial Sequence: Synthetic oligonucleotide
  Target: SCN9A; (-) strand; PAM type: NRG; PAM sequence: AAG
aaccacttccttcagtgatt

SEQ ID NO: 22767 - DNA, 20 bp, Artificial Sequence
  Description of Artificial Sequence: Synthetic oligonucleotide
  Target: SCN9A; (-) strand; PAM type: NRG; PAM sequence: CAG
ccctacaaaaccacttcctt

SEQ ID NO: 22768 - DNA, 20 bp, Artificial Sequence
  Description of Artificial Sequence: Synthetic oligonucleotide
  Target: SCN9A; (-) strand; PAM type: NRG; PAM sequence: TAG
cttaattttttgagcattaa

SEQ ID NO: 22769 - DNA, 20 bp, Artificial Sequence
  Description of Artificial Sequence: Synthetic oligonucleotide
  Target: SCN9A; (-) strand; PAM type: NRG; PAM sequence: GAG
tgacattaacttaatttttt

SEQ ID NO: 22770 - DNA, 20 bp, Artificial Sequence
  Description of Artificial Sequence: Synthetic oligonucleotide
  Target: SCN9A; (-) strand; PAM type: NRG; PAM sequence: TAG
tttgtgcagaaaggtggtat

SEQ ID NO: 22771 - DNA, 20 bp, Artificial Sequence
  Description of Artificial Sequence: Synthetic oligonucleotide
  Target: SCN9A; (-) strand; PAM type: NRG; PAM sequence: TGG
tttcattttgtgcagaaagg

SEQ ID NO: 22772 - DNA, 20 bp, Artificial Sequence
  Description of Artificial Sequence: Synthetic oligonucleotide
  Target: SCN9A; (-) strand; PAM type: NRG; PAM sequence: AGG
aagtttcattttgtgcagaa

SEQ ID NO: 22773 - DNA, 20 bp, Artificial Sequence
  Description of Artificial Sequence: Synthetic oligonucleotide
  Target: SCN9A; (-) strand; PAM type: NRG; PAM sequence: AAG
caagtttcattttgtgcaga

SEQ ID NO: 22774 - DNA, 20 bp, Artificial Sequence
  Description of Artificial Sequence: Synthetic oligonucleotide
  Target: SCN9A; (-) strand; PAM type: NRG; PAM sequence: CAG
attacaagtttcattttgtg

SEQ ID NO: 22775 - DNA, 20 bp, Artificial Sequence
  Description of Artificial Sequence: Synthetic oligonucleotide
  Target: SCN9A; (-) strand; PAM type: NRG; PAM sequence: AAG
atctacaagttgaaaattac

SEQ ID NO: 22776 - DNA, 20 bp, Artificial Sequence
  Description of Artificial Sequence: Synthetic oligonucleotide
  Target: SCN9A; (-) strand; PAM type: NRG; PAM sequence: AAG
ttcaaaaatattctatctac

SEQ ID NO: 22777 - DNA, 20 bp, Artificial Sequence
  Description of Artificial Sequence: Synthetic oligonucleotide
  Target: SCN9A; (-) strand; PAM type: NRG; PAM sequence: AAG
gattatacaaaaaagttcat

SEQ ID NO: 22778 - DNA, 20 bp, Artificial Sequence
  Description of Artificial Sequence: Synthetic oligonucleotide
  Target: SCN9A; (-) strand; PAM type: NRG; PAM sequence: AAG
aagatcatgattatacaaaa

SEQ ID NO: 22779 - DNA, 20 bp, Artificial Sequence
  Description of Artificial Sequence: Synthetic oligonucleotide
  Target: SCN9A; (-) strand; PAM type: NRG; PAM sequence: AAG
cggtttccaagtataaaaga

SEQ ID NO: 22780 - DNA, 20 bp, Artificial Sequence
  Description of Artificial Sequence: Synthetic oligonucleotide
  Target: SCN9A; (-) strand; PAM type: NRG; PAM sequence: AAG
ataacggtttccaagtataa

SEQ ID NO: 22781 - DNA, 20 bp, Artificial Sequence
  Description of Artificial Sequence: Synthetic oligonucleotide
  Target: SCN9A; (-) strand; PAM type: NRG; PAM sequence: AAG
tccagtgtataacggtttcc

SEQ ID NO: 22782 - DNA, 20 bp, Artificial Sequence
  Description of Artificial Sequence: Synthetic oligonucleotide
  Target: SCN9A; (-) strand; PAM type: NRG; PAM sequence: CGG
tttaattatccagtgtataa

SEQ ID NO: 22783 - DNA, 20 bp, Artificial Sequence
  Description of Artificial Sequence: Synthetic oligonucleotide
  Target: SCN9A; (-) strand; PAM type: NRG; PAM sequence: CAG
tctctgctattttaattatc

SEQ ID NO: 22784 - DNA, 20 bp, Artificial Sequence
  Description of Artificial Sequence: Synthetic oligonucleotide
  Target: SCN9A; (-) strand; PAM type: NRG; PAM sequence: CAG
agtgaacattagagatcttt

SEQ ID NO: 22785 - DNA, 20 bp, Artificial Sequence
  Description of Artificial Sequence: Synthetic oligonucleotide
  Target: SCN9A; (-) strand; PAM type: NRG; PAM sequence: GAG
ccagcctcaagtgaacatta

SEQ ID NO: 22786 - DNA, 20 bp, Artificial Sequence
  Description of Artificial Sequence: Synthetic oligonucleotide
  Target: SCN9A; (-) strand; PAM type: NRG; PAM sequence: TAG
aaccagcctcaagtgaacat

SEQ ID NO: 22787 - DNA, 20 bp, Artificial Sequence
  Description of Artificial Sequence: Synthetic oligonucleotide
  Target: SCN9A; (-) strand; PAM type: NRG; PAM sequence: AAG
cttgggttttaaccagcctc

SEQ ID NO: 22788 - DNA, 20 bp, Artificial Sequence
  Description of Artificial Sequence: Synthetic oligonucleotide
  Target: SCN9A; (-) strand; PAM type: NRG; PAM sequence: CAG
taagaaacttgggttttaac

SEQ ID NO: 22789 - DNA, 20 bp, Artificial Sequence
  Description of Artificial Sequence: Synthetic oligonucleotide
  Target: SCN9A; (-) strand; PAM type: NRG; PAM sequence: GGG
aggatggggataagaaactt

SEQ ID NO: 22790 - DNA, 20 bp, Artificial Sequence
  Description of Artificial Sequence: Synthetic oligonucleotide
  Target: SCN9A; (-) strand; PAM type: NRG; PAM sequence: TGG
caggatggggataagaaact

SEQ ID NO: 22791 - DNA, 20 bp, Artificial Sequence
  Description of Artificial Sequence: Synthetic oligonucleotide
  Target: SCN9A; (-) strand; PAM type: NRG; PAM sequence: AAG
agaaactccaggatggggat

SEQ ID NO: 22792 - DNA, 20 bp, Artificial Sequence
  Description of Artificial Sequence: Synthetic oligonucleotide
  Target: SCN9A; (-) strand; PAM type: NRG; PAM sequence: GGG
gagtcagaaactccaggatg

SEQ ID NO: 22793 - DNA, 20 bp, Artificial Sequence
  Description of Artificial Sequence: Synthetic oligonucleotide
  Target: SCN9A; (-) strand; PAM type: NRG; PAM sequence: GGG
tgagtcagaaactccaggat

SEQ ID NO: 22794 - DNA, 20 bp, Artificial Sequence
  Description of Artificial Sequence: Synthetic oligonucleotide
  Target: SCN9A; (-) strand; PAM type: NRG; PAM sequence: TGG
ctgagtcagaaactccagga

SEQ ID NO: 22795 - DNA, 20 bp, Artificial Sequence
  Description of Artificial Sequence: Synthetic oligonucleotide
  Target: SCN9A; (-) strand; PAM type: NRG; PAM sequence: AGG
cctactgagtcagaaactcc

SEQ ID NO: 22796 - DNA, 20 bp, Artificial Sequence
  Description of Artificial Sequence: Synthetic oligonucleotide
  Target: SCN9A; (-) strand; PAM type: NRG; PAM sequence: CAG
acctactgagtcagaaactc

SEQ ID NO: 22797 - DNA, 20 bp, Artificial Sequence
  Description of Artificial Sequence: Synthetic oligonucleotide
  Target: SCN9A; (-) strand; PAM type: NRG; PAM sequence: CAG
tcaccccagacctactgagt

SEQ ID NO: 22798 - DNA, 20 bp, Artificial Sequence
  Description of Artificial Sequence: Synthetic oligonucleotide
  Target: SCN9A; (-) strand; PAM type: NRG; PAM sequence: GAG
gatctcaccccagacctact

SEQ ID NO: 22799 - DNA, 20 bp, Artificial Sequence
  Description of Artificial Sequence: Synthetic oligonucleotide
  Target: SCN9A; (-) strand; PAM type: NRG; PAM sequence: CAG
caaattcttggatctcaccc

SEQ ID NO: 22800 - DNA, 20 bp, Artificial Sequence
  Description of Artificial Sequence: Synthetic oligonucleotide
  Target: SCN9A; (-) strand; PAM type: NRG; PAM sequence: TGG
aaaaaaaaaaagcaaattct

SEQ ID NO: 22801 - DNA, 20 bp, Artificial Sequence
  Description of Artificial Sequence: Synthetic oligonucleotide
  Target: SCN9A; (-) strand; PAM type: NRG; PAM sequence: AAG
caaaaaaaaaaaaaaaaaaa

SEQ ID NO: 22802 - DNA, 20 bp, Artificial Sequence
  Description of Artificial Sequence: Synthetic oligonucleotide
  Target: SCN9A; (-) strand; PAM type: NRG; PAM sequence: AAG
tccagcctggggaacagagc

SEQ ID NO: 22803 - DNA, 20 bp, Artificial Sequence
  Description of Artificial Sequence: Synthetic oligonucleotide
  Target: SCN9A; (-) strand; PAM type: NRG; PAM sequence: GAG
gcactccagcctggggaaca

SEQ ID NO: 22804 - DNA, 20 bp, Artificial Sequence
  Description of Artificial Sequence: Synthetic oligonucleotide
  Target: SCN9A; (-) strand; PAM type: NRG; PAM sequence: CAG
ctgcactccagcctggggaa

SEQ ID NO: 22805 - DNA, 20 bp, Artificial Sequence
  Description of Artificial Sequence: Synthetic oligonucleotide
  Target: SCN9A; (-) strand; PAM type: NRG; PAM sequence: GGG
tgcaactgcactccagcctg

SEQ ID NO: 22806 - DNA, 20 bp, Artificial Sequence
  Description of Artificial Sequence: Synthetic oligonucleotide
  Target: SCN9A; (-) strand; PAM type: NRG; PAM sequence: GGG
atgcaactgcactccagcct

SEQ ID NO: 22807 - DNA, 20 bp, Artificial Sequence
  Description of Artificial Sequence: Synthetic oligonucleotide
  Target: SCN9A; (-) strand; PAM type: NRG; PAM sequence: TGG
catgcaactgcactccagcc

SEQ ID NO: 22808 - DNA, 20 bp, Artificial Sequence
  Description of Artificial Sequence: Synthetic oligonucleotide
  Target: SCN9A; (-) strand; PAM type: NRG; PAM sequence: CAG
gagatcatgcaactgcactc

SEQ ID NO: 22809 - DNA, 20 bp, Artificial Sequence
  Description of Artificial Sequence: Synthetic oligonucleotide
  Target: SCN9A; (-) strand; PAM type: NRG; PAM sequence: GAG
ggcagaggttgcagtgagcc

SEQ ID NO: 22810 - DNA, 20 bp, Artificial Sequence
  Description of Artificial Sequence: Synthetic oligonucleotide
  Target: SCN9A; (-) strand; PAM type: NRG; PAM sequence: GAG
cgggaggcagaggttgcagt

SEQ ID NO: 22811 - DNA, 20 bp, Artificial Sequence
  Description of Artificial Sequence: Synthetic oligonucleotide
  Target: SCN9A; (-) strand; PAM type: NRG; PAM sequence: CAG
aacccgggaggcagaggttg

SEQ ID NO: 22812 - DNA, 20 bp, Artificial Sequence
  Description of Artificial Sequence: Synthetic oligonucleotide
  Target: SCN9A; (-) strand; PAM type: NRG; PAM sequence: AGG
cgcttgaacccgggaggcag

SEQ ID NO: 22813 - DNA, 20 bp, Artificial Sequence
  Description of Artificial Sequence: Synthetic oligonucleotide
  Target: SCN9A; (-) strand; PAM type: NRG; PAM sequence: GAG
tcgcttgaacccgggaggca

SEQ ID NO: 22814 - DNA, 20 bp, Artificial Sequence
  Description of Artificial Sequence: Synthetic oligonucleotide
  Target: SCN9A; (-) strand; PAM type: NRG; PAM sequence: CAG
aatcgcttgaacccgggagg

SEQ ID NO: 22815 - DNA, 20 bp, Artificial Sequence
  Description of Artificial Sequence: Synthetic oligonucleotide
  Target: SCN9A; (-) strand; PAM type: NRG; PAM sequence: AGG
aagaatcgcttgaacccggg

SEQ ID NO: 22816 - DNA, 20 bp, Artificial Sequence
  Description of Artificial Sequence: Synthetic oligonucleotide
  Target: SCN9A; (-) strand; PAM type: NRG; PAM sequence: GAG
gaagaatcgcttgaacccgg

SEQ ID NO: 22817 - DNA, 20 bp, Artificial Sequence
  Description of Artificial Sequence: Synthetic oligonucleotide
  Target: SCN9A; (-) strand; PAM type: NRG; PAM sequence: GGG
cagaagaatcgcttgaaccc

SEQ ID NO: 22818 - DNA, 20 bp, Artificial Sequence
  Description of Artificial Sequence: Synthetic oligonucleotide
  Target: SCN9A; (-) strand; PAM type: NRG; PAM sequence: CGG
gcagaagaatcgcttgaacc

SEQ ID NO: 22819 - DNA, 20 bp, Artificial Sequence
  Description of Artificial Sequence: Synthetic oligonucleotide
  Target: SCN9A; (-) strand; PAM type: NRG; PAM sequence: AAG
tactagggaggctgaggcag

SEQ ID NO: 22820 - DNA, 20 bp, Artificial Sequence
  Description of Artificial Sequence: Synthetic oligonucleotide
  Target: SCN9A; (-) strand; PAM type: NRG; PAM sequence: CAG
agctactagggaggctgagg

SEQ ID NO: 22821 - DNA, 20 bp, Artificial Sequence
  Description of Artificial Sequence: Synthetic oligonucleotide
  Target: SCN9A; (-) strand; PAM type: NRG; PAM sequence: AGG
ctcagctactagggaggctg

SEQ ID NO: 22822 - DNA, 20 bp, Artificial Sequence
  Description of Artificial Sequence: Synthetic oligonucleotide
  Target: SCN9A; (-) strand; PAM type: NRG; PAM sequence: GAG
tctcagctactagggaggct

SEQ ID NO: 22823 - DNA, 20 bp, Artificial Sequence
  Description of Artificial Sequence: Synthetic oligonucleotide
  Target: SCN9A; (-) strand; PAM type: NRG; PAM sequence: AGG
tgtagtctcagctactaggg

SEQ ID NO: 22824 - DNA, 20 bp, Artificial Sequence
  Description of Artificial Sequence: Synthetic oligonucleotide
  Target: SCN9A; (-) strand; PAM type: NRG; PAM sequence: GAG
ctgtagtctcagctactagg

SEQ ID NO: 22825 - DNA, 20 bp, Artificial Sequence
  Description of Artificial Sequence: Synthetic oligonucleotide
  Target: SCN9A; (-) strand; PAM type: NRG; PAM sequence: GGG
acctgtagtctcagctacta

SEQ ID NO: 22826 - DNA, 20 bp, Artificial Sequence
  Description of Artificial Sequence: Synthetic oligonucleotide
  Target: SCN9A; (-) strand; PAM type: NRG; PAM sequence: AGG
cacctgtagtctcagctact

SEQ ID NO: 22827 - DNA, 20 bp, Artificial Sequence
  Description of Artificial Sequence: Synthetic oligonucleotide
  Target: SCN9A; (-) strand; PAM type: NRG; PAM sequence: TAG
tcacctgtagtctcagctac

SEQ ID NO: 22828 - DNA, 20 bp, Artificial Sequence
  Description of Artificial Sequence: Synthetic oligonucleotide
  Target: SCN9A; (-) strand; PAM type: NRG; PAM sequence: CAG
gtggtgctcacctgtagtct

SEQ ID NO: 22829 - DNA, 20 bp, Artificial Sequence
  Description of Artificial Sequence: Synthetic oligonucleotide
  Target: SCN9A; (-) strand; PAM type: NRG; PAM sequence: TAG
ggcatagtggtgctcacctg

SEQ ID NO: 22830 - DNA, 20 bp, Artificial Sequence
  Description of Artificial Sequence: Synthetic oligonucleotide
  Target: SCN9A; (-) strand; PAM type: NRG; PAM sequence: TGG
aaaaaattacccgggcatag

SEQ ID NO: 22831 - DNA, 20 bp, Artificial Sequence
  Description of Artificial Sequence: Synthetic oligonucleotide
  Target: SCN9A; (-) strand; PAM type: NRG; PAM sequence: TAG
tgcaaaaaattacccgggca

SEQ ID NO: 22832 - DNA, 20 bp, Artificial Sequence
  Description of Artificial Sequence: Synthetic oligonucleotide
  Target: SCN9A; (-) strand; PAM type: NRG; PAM sequence: GGG
aaaaatgcaaaaaattaccc

SEQ ID NO: 22833 - DNA, 20 bp, Artificial Sequence
  Description of Artificial Sequence: Synthetic oligonucleotide
  Target: SCN9A; (-) strand; PAM type: NRG; PAM sequence: CGG
taaaaatgcaaaaaattacc

SEQ ID NO: 22834 - DNA, 20 bp, Artificial Sequence
  Description of Artificial Sequence: Synthetic oligonucleotide
  Target: SCN9A; (-) strand; PAM type: NRG; PAM sequence: TGG
cgagaccagcctggccaata

SEQ ID NO: 22835 - DNA, 20 bp, Artificial Sequence
  Description of Artificial Sequence: Synthetic oligonucleotide
  Target: SCN9A; (-) strand; PAM type: NRG; PAM sequence: TGG
tcaggagttcgagaccagcc

SEQ ID NO: 22836 - DNA, 20 bp, Artificial Sequence
  Description of Artificial Sequence: Synthetic oligonucleotide
  Target: SCN9A; (-) strand; PAM type: NRG; PAM sequence: CAG
tgaggtcaggagttcgagac

SEQ ID NO: 22837 - DNA, 20 bp, Artificial Sequence
  Description of Artificial Sequence: Synthetic oligonucleotide
  Target: SCN9A; (-) strand; PAM type: NRG; PAM sequence: GAG
gatcatgaggtcaggagttc

SEQ ID NO: 22838 - DNA, 20 bp, Artificial Sequence
  Description of Artificial Sequence: Synthetic oligonucleotide
  Target: SCN9A; (-) strand; PAM type: NRG; PAM sequence: GAG
cggacggatcatgaggtcag

SEQ ID NO: 22839 - DNA, 20 bp, Artificial Sequence
  Description of Artificial Sequence: Synthetic oligonucleotide
  Target: SCN9A; (-) strand; PAM type: NRG; PAM sequence: AGG
gacggacggatcatgaggtc

SEQ ID NO: 22840 - DNA, 20 bp, Artificial Sequence
  Description of Artificial Sequence: Synthetic oligonucleotide
  Target: SCN9A; (-) strand; PAM type: NRG; PAM sequence: CAG
agacggacggatcatgaggt

SEQ ID NO: 22841 - DNA, 20 bp, Artificial Sequence
  Description of Artificial Sequence: Synthetic oligonucleotide
  Target: SCN9A; (-) strand; PAM type: NRG; PAM sequence: AGG
aaaaagacggacggatcatg

SEQ ID NO: 22842 - DNA, 20 bp, Artificial Sequence
  Description of Artificial Sequence: Synthetic oligonucleotide
  Target: SCN9A; (-) strand; PAM type: NRG; PAM sequence: GAG
taaaaagacggacggatcat

SEQ ID NO: 22843 - DNA, 20 bp, Artificial Sequence
  Description of Artificial Sequence: Synthetic oligonucleotide
  Target: SCN9A; (-) strand; PAM type: NRG; PAM sequence: CGG
aaacttattaaaaagacgga

SEQ ID NO: 22844 - DNA, 20 bp, Artificial Sequence
  Description of Artificial Sequence: Synthetic oligonucleotide
  Target: SCN9A; (-) strand; PAM type: NRG; PAM sequence: CGG
ctacaaacttattaaaaaga

SEQ ID NO: 22845 - DNA, 20 bp, Artificial Sequence
  Description of Artificial Sequence: Synthetic oligonucleotide
  Target: SCN9A; (-) strand; PAM type: NRG; PAM sequence: AAG
ttatctacaaacttattaaa

SEQ ID NO: 22846 - DNA, 20 bp, Artificial Sequence
  Description of Artificial Sequence: Synthetic oligonucleotide
  Target: SCN9A; (-) strand; PAM type: NRG; PAM sequence: TAG
gtggtttactgaccagctat

SEQ ID NO: 22847 - DNA, 20 bp, Artificial Sequence
  Description of Artificial Sequence: Synthetic oligonucleotide
  Target: SCN9A; (-) strand; PAM type: NRG; PAM sequence: CAG
tttaagtgtggtttactgac

SEQ ID NO: 22848 - DNA, 20 bp, Artificial Sequence
  Description of Artificial Sequence: Synthetic oligonucleotide
  Target: SCN9A; (-) strand; PAM type: NRG; PAM sequence: TGG
gcttactgatactttaagtg

SEQ ID NO: 22849 - DNA, 20 bp, Artificial Sequence
  Description of Artificial Sequence: Synthetic oligonucleotide
  Target: SCN9A; (-) strand; PAM type: NRG; PAM sequence: AAG
gtccagcttactgatacttt

SEQ ID NO: 22850 - DNA, 20 bp, Artificial Sequence
  Description of Artificial Sequence: Synthetic oligonucleotide
  Target: SCN9A; (-) strand; PAM type: NRG; PAM sequence: CAG
atttaacacggagattagtc

SEQ ID NO: 22851 - DNA, 20 bp, Artificial Sequence
  Description of Artificial Sequence: Synthetic oligonucleotide
  Target: SCN9A; (-) strand; PAM type: NRG; PAM sequence: TAG
gagcaatttaacacggagat

SEQ ID NO: 22852 - DNA, 20 bp, Artificial Sequence
  Description of Artificial Sequence: Synthetic oligonucleotide
  Target: SCN9A; (-) strand; PAM type: NRG; PAM sequence: GAG
tctctgagcaatttaacacg

SEQ ID NO: 22853 - DNA, 20 bp, Artificial Sequence
  Description of Artificial Sequence: Synthetic oligonucleotide
  Target: SCN9A; (-) strand; PAM type: NRG; PAM sequence: CGG
cttctctgagcaatttaaca

SEQ ID NO: 22854 - DNA, 20 bp, Artificial Sequence
  Description of Artificial Sequence: Synthetic oligonucleotide
  Target: SCN9A; (-) strand; PAM type: NRG; PAM sequence: GAG
ctccctaccttaccttctct

SEQ ID NO: 22855 - DNA, 20 bp, Artificial Sequence
  Description of Artificial Sequence: Synthetic oligonucleotide
  Target: SCN9A; (-) strand; PAM type: NRG; PAM sequence: CAG
ctggatattctctctctgtt

SEQ ID NO: 22856 - DNA, 20 bp, Artificial Sequence
  Description of Artificial Sequence: Synthetic oligonucleotide
  Target: SCN9A; (-) strand; PAM type: NRG; PAM sequence: TGG
cgtccaccaggagacataac

SEQ ID NO: 22857 - DNA, 20 bp, Artificial Sequence
  Description of Artificial Sequence: Synthetic oligonucleotide
  Target: SCN9A; (-) strand; PAM type: NRG; PAM sequence: GAG
ttgccttgtccgtccaccag

SEQ ID NO: 22858 - DNA, 20 bp, Artificial Sequence
  Description of Artificial Sequence: Synthetic oligonucleotide
  Target: SCN9A; (-) strand; PAM type: NRG; PAM sequence: AGG
agttgccttgtccgtccacc

SEQ ID NO: 22859 - DNA, 20 bp, Artificial Sequence
  Description of Artificial Sequence: Synthetic oligonucleotide
  Target: SCN9A; (-) strand; PAM type: NRG; PAM sequence: CAG
aagttgccttgtccgtccac

SEQ ID NO: 22860 - DNA, 20 bp, Artificial Sequence
  Description of Artificial Sequence: Synthetic oligonucleotide
  Target: SCN9A; (-) strand; PAM type: NRG; PAM sequence: AAG
gtcctttaaggctcaattta

SEQ ID NO: 22861 - DNA, 20 bp, Artificial Sequence
  Description of Artificial Sequence: Synthetic oligonucleotide
  Target: SCN9A; (-) strand; PAM type: NRG; PAM sequence: AGG
aaacacctatctgtccttta

SEQ ID NO: 22862 - DNA, 20 bp, Artificial Sequence
  Description of Artificial Sequence: Synthetic oligonucleotide
  Target: SCN9A; (-) strand; PAM type: NRG; PAM sequence: AAG
caaacacctatctgtccttt

SEQ ID NO: 22863 - DNA, 20 bp, Artificial Sequence
  Description of Artificial Sequence: Synthetic oligonucleotide
  Target: SCN9A; (-) strand; PAM type: NRG; PAM sequence: CAG
accctaacccgtttgtatag

SEQ ID NO: 22864 - DNA, 20 bp, Artificial Sequence
  Description of Artificial Sequence: Synthetic oligonucleotide
  Target: SCN9A; (-) strand; PAM type: NRG; PAM sequence: TAG
ccgaccctaacccgtttgta

SEQ ID NO: 22865 - DNA, 20 bp, Artificial Sequence
  Description of Artificial Sequence: Synthetic oligonucleotide
  Target: SCN9A; (-) strand; PAM type: NRG; PAM sequence: TGG
gctattttatgcctctgttc

SEQ ID NO: 22866 - DNA, 20 bp, Artificial Sequence
  Description of Artificial Sequence: Synthetic oligonucleotide
  Target: SCN9A; (-) strand; PAM type: NRG; PAM sequence: CAG
ctcctctaaaatttcttctc

SEQ ID NO: 22867 - DNA, 20 bp, Artificial Sequence
  Description of Artificial Sequence: Synthetic oligonucleotide
  Target: SCN9A; (-) strand; PAM type: NRG; PAM sequence: TGG
tagtccatatcctcatgtgt

SEQ ID NO: 22868 - DNA, 20 bp, Artificial Sequence
  Description of Artificial Sequence: Synthetic oligonucleotide
  Target: SCN9A; (-) strand; PAM type: NRG; PAM sequence: TAG
acaactctattttctgtaat

SEQ ID NO: 22869 - DNA, 20 bp, Artificial Sequence
  Description of Artificial Sequence: Synthetic oligonucleotide
  Target: SCN9A; (-) strand; PAM type: NRG; PAM sequence: AGG
caactttgtaacacacatgg

SEQ ID NO: 22870 - DNA, 20 bp, Artificial Sequence
  Description of Artificial Sequence: Synthetic oligonucleotide
  Target: SCN9A; (-) strand; PAM type: NRG; PAM sequence: GAG
gcaactttgtaacacacatg

SEQ ID NO: 22871 - DNA, 20 bp, Artificial Sequence
  Description of Artificial Sequence: Synthetic oligonucleotide
  Target: SCN9A; (-) strand; PAM type: NRG; PAM sequence: TGG
cagcaactttgtaacacaca

SEQ ID NO: 22872 - DNA, 20 bp, Artificial Sequence
  Description of Artificial Sequence: Synthetic oligonucleotide
  Target: SCN9A; (-) strand; PAM type: NRG; PAM sequence: CAG
ctttaaggattgtattaaac

SEQ ID NO: 22873 - DNA, 20 bp, Artificial Sequence
  Description of Artificial Sequence: Synthetic oligonucleotide
  Target: SCN9A; (-) strand; PAM type: NRG; PAM sequence: AGG
actaccataacctagcttta

SEQ ID NO: 22874 - DNA, 20 bp, Artificial Sequence
  Description of Artificial Sequence: Synthetic oligonucleotide
  Target: SCN9A; (-) strand; PAM type: NRG; PAM sequence: AAG
aactaccataacctagcttt

SEQ ID NO: 22875 - DNA, 20 bp, Artificial Sequence
  Description of Artificial Sequence: Synthetic oligonucleotide
  Target: SCN9A; (-) strand; PAM type: NRG; PAM sequence: TAG
gaataacaactaccataacc

SEQ ID NO: 22876 - DNA, 20 bp, Artificial Sequence
  Description of Artificial Sequence: Synthetic oligonucleotide
  Target: SCN9A; (-) strand; PAM type: NRG; PAM sequence: AAG
ctcaattagcagagacaaac

SEQ ID NO: 22877 - DNA, 20 bp, Artificial Sequence
  Description of Artificial Sequence: Synthetic oligonucleotide
  Target: SCN9A; (-) strand; PAM type: NRG; PAM sequence: GAG
gaaaagatactcaattagca

SEQ ID NO: 22878 - DNA, 20 bp, Artificial Sequence
  Description of Artificial Sequence: Synthetic oligonucleotide
  Target: SCN9A; (-) strand; PAM type: NRG; PAM sequence: CAG
ctgaaaagatactcaattag

SEQ ID NO: 22879 - DNA, 20 bp, Artificial Sequence
  Description of Artificial Sequence: Synthetic oligonucleotide
  Target: SCN9A; (-) strand; PAM type: NRG; PAM sequence: TAG
tgcctgaaaagatactcaat

SEQ ID NO: 22880 - DNA, 20 bp, Artificial Sequence
  Description of Artificial Sequence: Synthetic oligonucleotide
  Target: SCN9A; (-) strand; PAM type: NRG; PAM sequence: AAG
taggctgcagagtgcctgaa

SEQ ID NO: 22881 - DNA, 20 bp, Artificial Sequence
  Description of Artificial Sequence: Synthetic oligonucleotide
  Target: SCN9A; (-) strand; PAM type: NRG; PAM sequence: GAG
taatttgcacttaggctgca

SEQ ID NO: 22882 - DNA, 20 bp, Artificial Sequence
  Description of Artificial Sequence: Synthetic oligonucleotide
  Target: SCN9A; (-) strand; PAM type: NRG; PAM sequence: CAG
cttaatttgcacttaggctg

SEQ ID NO: 22883 - DNA, 20 bp, Artificial Sequence
  Description of Artificial Sequence: Synthetic oligonucleotide
  Target: SCN9A; (-) strand; PAM type: NRG; PAM sequence: AGG
agtttacttaatttgcactt

SEQ ID NO: 22884 - DNA, 20 bp, Artificial Sequence
  Description of Artificial Sequence: Synthetic oligonucleotide
  Target: SCN9A; (-) strand; PAM type: NRG; PAM sequence: TAG
gagtttacttaatttgcact

SEQ ID NO: 22885 - DNA, 20 bp, Artificial Sequence
  Description of Artificial Sequence: Synthetic oligonucleotide
  Target: SCN9A; (-) strand; PAM type: NRG; PAM sequence: GAG
tgagaaaactaaagctcaga

SEQ ID NO: 22886 - DNA, 20 bp, Artificial Sequence
  Description of Artificial Sequence: Synthetic oligonucleotide
  Target: SCN9A; (-) strand; PAM type: NRG; PAM sequence: GAG
tttgagaaaactaaagctca

SEQ ID NO: 22887 - DNA, 20 bp, Artificial Sequence
  Description of Artificial Sequence: Synthetic oligonucleotide
  Target: SCN9A; (-) strand; PAM type: NRG; PAM sequence: CAG
tatttgagaaaactaaagct

SEQ ID NO: 22888 - DNA, 20 bp, Artificial Sequence
  Description of Artificial Sequence: Synthetic oligonucleotide
  Target: SCN9A; (-) strand; PAM type: NRG; PAM sequence: AAG
aattatatttgagaaaacta

SEQ ID NO: 22889 - DNA, 20 bp, Artificial Sequence
  Description of Artificial Sequence: Synthetic oligonucleotide
  Target: SCN9A; (-) strand; PAM type: NRG; PAM sequence: GAG
attataactaaattatattt

SEQ ID NO: 22890 - DNA, 20 bp, Artificial Sequence
  Description of Artificial Sequence: Synthetic oligonucleotide
  Target: SCN9A; (-) strand; PAM type: NRG; PAM sequence: TGG
aaataacattgcaaagtaag

SEQ ID NO: 22891 - DNA, 20 bp, Artificial Sequence
  Description of Artificial Sequence: Synthetic oligonucleotide
  Target: SCN9A; (-) strand; PAM type: NRG; PAM sequence: AAG
ttaaaataacattgcaaagt

SEQ ID NO: 22892 - DNA, 20 bp, Artificial Sequence
  Description of Artificial Sequence: Synthetic oligonucleotide
  Target: SCN9A; (-) strand; PAM type: NRG; PAM sequence: AAG
acctttaaaataacattgca

SEQ ID NO: 22893 - DNA, 20 bp, Artificial Sequence
  Description of Artificial Sequence: Synthetic oligonucleotide
  Target: SCN9A; (-) strand; PAM type: NRG; PAM sequence: CAG
ataggtaagtgagacagcat

SEQ ID NO: 22894 - DNA, 20 bp, Artificial Sequence
  Description of Artificial Sequence: Synthetic oligonucleotide
  Target: SCN9A; (-) strand; PAM type: NRG; PAM sequence: CAG
gaaaagataggtaagtgaga

SEQ ID NO: 22895 - DNA, 20 bp, Artificial Sequence
  Description of Artificial Sequence: Synthetic oligonucleotide
  Target: SCN9A; (-) strand; PAM type: NRG; PAM sequence: GAG
attagaaaagataggtaagt

SEQ ID NO: 22896 - DNA, 20 bp, Artificial Sequence
  Description of Artificial Sequence: Synthetic oligonucleotide
  Target: SCN9A; (-) strand; PAM type: NRG; PAM sequence: AAG
gagcattagaaaagataggt

SEQ ID NO: 22897 - DNA, 20 bp, Artificial Sequence
  Description of Artificial Sequence: Synthetic oligonucleotide
  Target: SCN9A; (-) strand; PAM type: NRG; PAM sequence: AGG
taaggagcattagaaaagat

SEQ ID NO: 22898 - DNA, 20 bp, Artificial Sequence
  Description of Artificial Sequence: Synthetic oligonucleotide
  Target: SCN9A; (-) strand; PAM type: NRG; PAM sequence: TAG
gtaaggagcattagaaaaga

SEQ ID NO: 22899 - DNA, 20 bp, Artificial Sequence
  Description of Artificial Sequence: Synthetic oligonucleotide
  Target: SCN9A; (-) strand; PAM type: NRG; PAM sequence: AAG
ctgggtaaggagcattagaa

SEQ ID NO: 22900 - DNA, 20 bp, Artificial Sequence
  Description of Artificial Sequence: Synthetic oligonucleotide
  Target: SCN9A; (-) strand; PAM type: NRG; PAM sequence: TAG
actacctgggtaaggagcat

SEQ ID NO: 22901 - DNA, 20 bp, Artificial Sequence
  Description of Artificial Sequence: Synthetic oligonucleotide
  Target: SCN9A; (-) strand; PAM type: NRG; PAM sequence: GAG
taagaaactacctgggtaag

SEQ ID NO: 22902 - DNA, 20 bp, Artificial Sequence
  Description of Artificial Sequence: Synthetic oligonucleotide
  Target: SCN9A; (-) strand; PAM type: NRG; PAM sequence: AGG
tttaagaaactacctgggta

SEQ ID NO: 22903 - DNA, 20 bp, Artificial Sequence
  Description of Artificial Sequence: Synthetic oligonucleotide
  Target: SCN9A; (-) strand; PAM type: NRG; PAM sequence: AAG
gtttaagaaactacctgggt

SEQ ID NO: 22904 - DNA, 20 bp, Artificial Sequence
  Description of Artificial Sequence: Synthetic oligonucleotide
  Target: SCN9A; (-) strand; PAM type: NRG; PAM sequence: GGG
atttgtttaagaaactacct

SEQ ID NO: 22905 - DNA, 20 bp, Artificial Sequence
  Description of Artificial Sequence: Synthetic oligonucleotide
  Target: SCN9A; (-) strand; PAM type: NRG; PAM sequence: TGG
tatttgtttaagaaactacc

SEQ ID NO: 22906 - DNA, 20 bp, Artificial Sequence
  Description of Artificial Sequence: Synthetic oligonucleotide
  Target: SCN9A; (-) strand; PAM type: NRG; PAM sequence: AAG
tgttcaaataatatttgttt

SEQ ID NO: 22907 - DNA, 20 bp, Artificial Sequence
  Description of Artificial Sequence: Synthetic oligonucleotide
  Target: SCN9A; (-) strand; PAM type: NRG; PAM sequence: AGG
atcaaggacctacttatatc

SEQ ID NO: 22908 - DNA, 20 bp, Artificial Sequence
  Description of Artificial Sequence: Synthetic oligonucleotide
  Target: SCN9A; (-) strand; PAM type: NRG; PAM sequence: CAG
aatcaaggacctacttatat

SEQ ID NO: 22909 - DNA, 20 bp, Artificial Sequence
  Description of Artificial Sequence: Synthetic oligonucleotide
  Target: SCN9A; (-) strand; PAM type: NRG; PAM sequence: AGG
ctctcatacataagtaatca

SEQ ID NO: 22910 - DNA, 20 bp, Artificial Sequence
  Description of Artificial Sequence: Synthetic oligonucleotide
  Target: SCN9A; (-) strand; PAM type: NRG; PAM sequence: AAG
tctctcatacataagtaatc

SEQ ID NO: 22911 - DNA, 20 bp, Artificial Sequence
  Description of Artificial Sequence: Synthetic oligonucleotide
  Target: SCN9A; (-) strand; PAM type: NRG; PAM sequence: AAG
taacatcatctctcatacat

SEQ ID NO: 22912 - DNA, 20 bp, Artificial Sequence
  Description of Artificial Sequence: Synthetic oligonucleotide
  Target: SCN9A; (-) strand; PAM type: NRG; PAM sequence: GGG
ctaggaagtccaagtgaaag

SEQ ID NO: 22913 - DNA, 20 bp, Artificial Sequence
  Description of Artificial Sequence: Synthetic oligonucleotide
  Target: SCN9A; (-) strand; PAM type: NRG; PAM sequence: GGG
gctaggaagtccaagtgaaa

SEQ ID NO: 22914 - DNA, 20 bp, Artificial Sequence
  Description of Artificial Sequence: Synthetic oligonucleotide
  Target: SCN9A; (-) strand; PAM type: NRG; PAM sequence: AGG
tgctaggaagtccaagtgaa

SEQ ID NO: 22915 - DNA, 20 bp, Artificial Sequence
  Description of Artificial Sequence: Synthetic oligonucleotide
  Target: SCN9A; (-) strand; PAM type: NRG; PAM sequence: AAG
gtgctaggaagtccaagtga

SEQ ID NO: 22916 - DNA, 20 bp, Artificial Sequence
  Description of Artificial Sequence: Synthetic oligonucleotide
  Target: SCN9A; (-) strand; PAM type: NRG; PAM sequence: AAG
ttccctgtgctaggaagtcc

SEQ ID NO: 22917 - DNA, 20 bp, Artificial Sequence
  Description of Artificial Sequence: Synthetic oligonucleotide
  Target: SCN9A; (-) strand; PAM type: NRG; PAM sequence: AAG
gaaatcttccctgtgctagg

SEQ ID NO: 22918 - DNA, 20 bp, Artificial Sequence
  Description of Artificial Sequence: Synthetic oligonucleotide
  Target: SCN9A; (-) strand; PAM type: NRG; PAM sequence: AGG
atggaaatcttccctgtgct

SEQ ID NO: 22919 - DNA, 20 bp, Artificial Sequence
  Description of Artificial Sequence: Synthetic oligonucleotide
  Target: SCN9A; (-) strand; PAM type: NRG; PAM sequence: TAG
aatggaaatcttccctgtgc

SEQ ID NO: 22920 - DNA, 20 bp, Artificial Sequence
  Description of Artificial Sequence: Synthetic oligonucleotide
  Target: SCN9A; (-) strand; PAM type: NRG; PAM sequence: TGG
gtgacttttttcatattaaa

SEQ ID NO: 22921 - DNA, 20 bp, Artificial Sequence
  Description of Artificial Sequence: Synthetic oligonucleotide
  Target: SCN9A; (-) strand; PAM type: NRG; PAM sequence: GAG
aacaatagaatgatccaaat

SEQ ID NO: 22922 - DNA, 20 bp, Artificial Sequence
  Description of Artificial Sequence: Synthetic oligonucleotide
  Target: SCN9A; (-) strand; PAM type: NRG; PAM sequence: TAG
tatctaatattgtcaaacaa

SEQ ID NO: 22923 - DNA, 20 bp, Artificial Sequence
  Description of Artificial Sequence: Synthetic oligonucleotide
  Target: SCN9A; (-) strand; PAM type: NRG; PAM sequence: CAG
acaagggaataagttaatca

SEQ ID NO: 22924 - DNA, 20 bp, Artificial Sequence
  Description of Artificial Sequence: Synthetic oligonucleotide
  Target: SCN9A; (-) strand; PAM type: NRG; PAM sequence: AAG
atattgtttaacaagggaat

SEQ ID NO: 22925 - DNA, 20 bp, Artificial Sequence
  Description of Artificial Sequence: Synthetic oligonucleotide
  Target: SCN9A; (-) strand; PAM type: NRG; PAM sequence: GGG
cagtgcatattgtttaacaa

SEQ ID NO: 22926 - DNA, 20 bp, Artificial Sequence
  Description of Artificial Sequence: Synthetic oligonucleotide
  Target: SCN9A; (-) strand; PAM type: NRG; PAM sequence: AGG
tcagtgcatattgtttaaca

SEQ ID NO: 22927 - DNA, 20 bp, Artificial Sequence
  Description of Artificial Sequence: Synthetic oligonucleotide
  Target: SCN9A; (-) strand; PAM type: NRG; PAM sequence: AAG
ttcagtgcatattgtttaac

SEQ ID NO: 22928 - DNA, 20 bp, Artificial Sequence
  Description of Artificial Sequence: Synthetic oligonucleotide
  Target: SCN9A; (-) strand; PAM type: NRG; PAM sequence: CAG
tatatacacacacagtattt

SEQ ID NO: 22929 - DNA, 20 bp, Artificial Sequence
  Description of Artificial Sequence: Synthetic oligonucleotide
  Target: SCN9A; (-) strand; PAM type: NRG; PAM sequence: CAG
tatatatatatatacacaca

SEQ ID NO: 22930 - DNA, 20 bp, Artificial Sequence
  Description of Artificial Sequence: Synthetic oligonucleotide
  Target: SCN9A; (-) strand; PAM type: NRG; PAM sequence: TAG
atttcatttactgtacatat

SEQ ID NO: 22931 - DNA, 20 bp, Artificial Sequence
  Description of Artificial Sequence: Synthetic oligonucleotide
  Target: SCN9A; (-) strand; PAM type: NRG; PAM sequence: TAG
taaaatatgcatatatagta

SEQ ID NO: 22932 - DNA, 20 bp, Artificial Sequence
  Description of Artificial Sequence: Synthetic oligonucleotide
  Target: SCN9A; (-) strand; PAM type: NRG; PAM sequence: TAG
atatataaaatatgcatata

SEQ ID NO: 22933 - DNA, 20 bp, Artificial Sequence
  Description of Artificial Sequence: Synthetic oligonucleotide
  Target: SCN9A; (-) strand; PAM type: NRG; PAM sequence: AAG
ttaatatatacagaatatga

SEQ ID NO: 22934 - DNA, 20 bp, Artificial Sequence
  Description of Artificial Sequence: Synthetic oligonucleotide
  Target: SCN9A; (-) strand; PAM type: NRG; PAM sequence: CAG
ctattatatattaatatata

SEQ ID NO: 22935 - DNA, 20 bp, Artificial Sequence
  Description of Artificial Sequence: Synthetic oligonucleotide
  Target: SCN9A; (-) strand; PAM type: NRG; PAM sequence: TAG
taaaaaagtataatactaat

SEQ ID NO: 22936 - DNA, 20 bp, Artificial Sequence
  Description of Artificial Sequence: Synthetic oligonucleotide
  Target: SCN9A; (-) strand; PAM type: NRG; PAM sequence: AAG
atactagtatattactaaaa

SEQ ID NO: 22937 - DNA, 20 bp, Artificial Sequence
  Description of Artificial Sequence: Synthetic oligonucleotide
  Target: SCN9A; (-) strand; PAM type: NRG; PAM sequence: TAG
taatactcattagtatatac

SEQ ID NO: 22938 - DNA, 20 bp, Artificial Sequence
  Description of Artificial Sequence: Synthetic oligonucleotide
  Target: SCN9A; (-) strand; PAM type: NRG; PAM sequence: TAG
aaaaatagtataatactcat

SEQ ID NO: 22939 - DNA, 20 bp, Artificial Sequence
  Description of Artificial Sequence: Synthetic oligonucleotide
  Target: SCN9A; (-) strand; PAM type: NRG; PAM sequence: TAG
aaatagtatattactaaaaa

SEQ ID NO: 22940 - DNA, 20 bp, Artificial Sequence
  Description of Artificial Sequence: Synthetic oligonucleotide
  Target: SCN9A; (-) strand; PAM type: NRG; PAM sequence: TAG
taattatagcattaattaaa

SEQ ID NO: 22941 - DNA, 20 bp, Artificial Sequence
  Description of Artificial Sequence: Synthetic oligonucleotide
  Target: SCN9A; (-) strand; PAM type: NRG; PAM sequence: TAG
taatatataaatactaatta

SEQ ID NO: 22942 - DNA, 20 bp, Artificial Sequence
  Description of Artificial Sequence: Synthetic oligonucleotide
  Target: SCN9A; (-) strand; PAM type: NRG; PAM sequence: TGG
atgcatattatatatactaa

SEQ ID NO: 22943 - DNA, 20 bp, Artificial Sequence
  Description of Artificial Sequence: Synthetic oligonucleotide
  Target: SCN9A; (-) strand; PAM type: NRG; PAM sequence: TAG
atgcatattacatatactaa

SEQ ID NO: 22944 - DNA, 20 bp, Artificial Sequence
  Description of Artificial Sequence: Synthetic oligonucleotide
  Target: SCN9A; (-) strand; PAM type: NRG; PAM sequence: TAG
atgcatattatatacactaa

SEQ ID NO: 22945 - DNA, 20 bp, Artificial Sequence
  Description of Artificial Sequence: Synthetic oligonucleotide
  Target: SCN9A; (-) strand; PAM type: NRG; PAM sequence: TGG
ctatatatagtatgcatata

SEQ ID NO: 22946 - DNA, 20 bp, Artificial Sequence
  Description of Artificial Sequence: Synthetic oligonucleotide
  Target: SCN9A; (-) strand; PAM type: NRG; PAM sequence: TAG
gtatgcatatatactatata

SEQ ID NO: 22947 - DNA, 20 bp, Artificial Sequence
  Description of Artificial Sequence: Synthetic oligonucleotide
  Target: SCN9A; (-) strand; PAM type: NRG; PAM sequence: CAG
atgcatttacatactatata

SEQ ID NO: 22948 - DNA, 20 bp, Artificial Sequence
  Description of Artificial Sequence: Synthetic oligonucleotide
  Target: SCN9A; (-) strand; PAM type: NRG; PAM sequence: TAG
atatgcatatgtatactata

SEQ ID NO: 22949 - DNA, 20 bp, Artificial Sequence
  Description of Artificial Sequence: Synthetic oligonucleotide
  Target: SCN9A; (-) strand; PAM type: NRG; PAM sequence: AGG
ttctgtttacataaatacat

SEQ ID NO: 22950 - DNA, 20 bp, Artificial Sequence
  Description of Artificial Sequence: Synthetic oligonucleotide
  Target: SCN9A; (-) strand; PAM type: NRG; PAM sequence: TAG
tttctgtttacataaataca

SEQ ID NO: 22951 - DNA, 20 bp, Artificial Sequence
  Description of Artificial Sequence: Synthetic oligonucleotide
  Target: SCN9A; (-) strand; PAM type: NRG; PAM sequence: GAG
aatgggtatgtagaaattat

SEQ ID NO: 22952 - DNA, 20 bp, Artificial Sequence
  Description of Artificial Sequence: Synthetic oligonucleotide
  Target: SCN9A; (-) strand; PAM type: NRG; PAM sequence: TAG
atataaaaacaatgggtatg

SEQ ID NO: 22953 - DNA, 20 bp, Artificial Sequence
  Description of Artificial Sequence: Synthetic oligonucleotide
  Target: SCN9A; (-) strand; PAM type: NRG; PAM sequence: GGG
gtttaaaatataaaaacaat

SEQ ID NO: 22954 - DNA, 20 bp, Artificial Sequence
  Description of Artificial Sequence: Synthetic oligonucleotide
  Target: SCN9A; (-) strand; PAM type: NRG; PAM sequence: TGG
ggtttaaaatataaaaacaa

SEQ ID NO: 22955 - DNA, 20 bp, Artificial Sequence
  Description of Artificial Sequence: Synthetic oligonucleotide
  Target: SCN9A; (-) strand; PAM type: NRG; PAM sequence: GGG
aatgttcttattttttaatg

SEQ ID NO: 22956 - DNA, 20 bp, Artificial Sequence
  Description of Artificial Sequence: Synthetic oligonucleotide
  Target: SCN9A; (-) strand; PAM type: NRG; PAM sequence: GGG
taatgttcttattttttaat

SEQ ID NO: 22957 - DNA, 20 bp, Artificial Sequence
  Description of Artificial Sequence: Synthetic oligonucleotide
  Target: SCN9A; (-) strand; PAM type: NRG; PAM sequence: TGG
ataatgttcttattttttaa

SEQ ID NO: 22958 - DNA, 20 bp, Artificial Sequence
  Description of Artificial Sequence: Synthetic oligonucleotide
  Target: SCN9A; (-) strand; PAM type: NRG; PAM sequence: AAG
agatttgaaggaatgagggt

SEQ ID NO: 22959 - DNA, 20 bp, Artificial Sequence
  Description of Artificial Sequence: Synthetic oligonucleotide
  Target: SCN9A; (-) strand; PAM type: NRG; PAM sequence: GGG
atctagatttgaaggaatga

SEQ ID NO: 22960 - DNA, 20 bp, Artificial Sequence
  Description of Artificial Sequence: Synthetic oligonucleotide
  Target: SCN9A; (-) strand; PAM type: NRG; PAM sequence: AGG
tatctagatttgaaggaatg

SEQ ID NO: 22961 - DNA, 20 bp, Artificial Sequence
  Description of Artificial Sequence: Synthetic oligonucleotide
  Target: SCN9A; (-) strand; PAM type: NRG; PAM sequence: GAG
ttatctagatttgaaggaat

SEQ ID NO: 22962 - DNA, 20 bp, Artificial Sequence
  Description of Artificial Sequence: Synthetic oligonucleotide
  Target: SCN9A; (-) strand; PAM type: NRG; PAM sequence: AGG
agagccttatctagatttga

SEQ ID NO: 22963 - DNA, 20 bp, Artificial Sequence
  Description of Artificial Sequence: Synthetic oligonucleotide
  Target: SCN9A; (-) strand; PAM type: NRG; PAM sequence: AAG
aagagccttatctagatttg

SEQ ID NO: 22964 - DNA, 20 bp, Artificial Sequence
  Description of Artificial Sequence: Synthetic oligonucleotide
  Target: SCN9A; (-) strand; PAM type: NRG; PAM sequence: TAG
agacctctaagagccttatc

SEQ ID NO: 22965 - DNA, 20 bp, Artificial Sequence
  Description of Artificial Sequence: Synthetic oligonucleotide
  Target: SCN9A; (-) strand; PAM type: NRG; PAM sequence: GAG
gagagctttaagacctctaa

SEQ ID NO: 22966 - DNA, 20 bp, Artificial Sequence
  Description of Artificial Sequence: Synthetic oligonucleotide
  Target: SCN9A; (-) strand; PAM type: NRG; PAM sequence: AAG
ctgagagctttaagacctct

SEQ ID NO: 22967 - DNA, 20 bp, Artificial Sequence
  Description of Artificial Sequence: Synthetic oligonucleotide
  Target: SCN9A; (-) strand; PAM type: NRG; PAM sequence: AAG
cttcggacactgagagcttt

SEQ ID NO: 22968 - DNA, 20 bp, Artificial Sequence
  Description of Artificial Sequence: Synthetic oligonucleotide
  Target: SCN9A; (-) strand; PAM type: NRG; PAM sequence: GAG
taaatcccttcggacactga

SEQ ID NO: 22969 - DNA, 20 bp, Artificial Sequence
  Description of Artificial Sequence: Synthetic oligonucleotide
  Target: SCN9A; (-) strand; PAM type: NRG; PAM sequence: GAG
attaaatcccttcggacact

SEQ ID NO: 22970 - DNA, 20 bp, Artificial Sequence
  Description of Artificial Sequence: Synthetic oligonucleotide
  Target: SCN9A; (-) strand; PAM type: NRG; PAM sequence: CGG
ttggccccattaaatccctt

SEQ ID NO: 22971 - DNA, 20 bp, Artificial Sequence
  Description of Artificial Sequence: Synthetic oligonucleotide
  Target: SCN9A; (-) strand; PAM type: NRG; PAM sequence: TGG
actcttggctactcagatct

SEQ ID NO: 22972 - DNA, 20 bp, Artificial Sequence
  Description of Artificial Sequence: Synthetic oligonucleotide
  Target: SCN9A; (-) strand; PAM type: NRG; PAM sequence: CAG
ggcaaacactcttggctact

SEQ ID NO: 22973 - DNA, 20 bp, Artificial Sequence
  Description of Artificial Sequence: Synthetic oligonucleotide
  Target: SCN9A; (-) strand; PAM type: NRG; PAM sequence: TGG
actttagtggcaaacactct

SEQ ID NO: 22974 - DNA, 20 bp, Artificial Sequence
  Description of Artificial Sequence: Synthetic oligonucleotide
  Target: SCN9A; (-) strand; PAM type: NRG; PAM sequence: TGG
ggtttctttggttactttag

SEQ ID NO: 22975 - DNA, 20 bp, Artificial Sequence
  Description of Artificial Sequence: Synthetic oligonucleotide
  Target: SCN9A; (-) strand; PAM type: NRG; PAM sequence: TAG
ataggtttctttggttactt

SEQ ID NO: 22976 - DNA, 20 bp, Artificial Sequence
  Description of Artificial Sequence: Synthetic oligonucleotide
  Target: SCN9A; (-) strand; PAM type: NRG; PAM sequence: TGG
gttatttttataggtttctt

SEQ ID NO: 22977 - DNA, 20 bp, Artificial Sequence
  Description of Artificial Sequence: Synthetic oligonucleotide
  Target: SCN9A; (-) strand; PAM type: NRG; PAM sequence: AGG
aatgaaaatgttatttttat

SEQ ID NO: 22978 - DNA, 20 bp, Artificial Sequence
  Description of Artificial Sequence: Synthetic oligonucleotide
  Target: SCN9A; (-) strand; PAM type: NRG; PAM sequence: TAG
taatgaaaatgttattttta

SEQ ID NO: 22979 - DNA, 20 bp, Artificial Sequence
  Description of Artificial Sequence: Synthetic oligonucleotide
  Target: SCN9A; (-) strand; PAM type: NRG; PAM sequence: CAG
gagttgcttttagtgagttt

SEQ ID NO: 22980 - DNA, 20 bp, Artificial Sequence
  Description of Artificial Sequence: Synthetic oligonucleotide
  Target: SCN9A; (-) strand; PAM type: NRG; PAM sequence: GAG
cctgttgagttgcttttagt

SEQ ID NO: 22981 - DNA, 20 bp, Artificial Sequence
  Description of Artificial Sequence: Synthetic oligonucleotide
  Target: SCN9A; (-) strand; PAM type: NRG; PAM sequence: TAG
tgttcctgttgagttgcttt

SEQ ID NO: 22982 - DNA, 20 bp, Artificial Sequence
  Description of Artificial Sequence: Synthetic oligonucleotide
  Target: SCN9A; (-) strand; PAM type: NRG; PAM sequence: GAG
accatcttattgttcctgtt

SEQ ID NO: 22983 - DNA, 20 bp, Artificial Sequence
  Description of Artificial Sequence: Synthetic oligonucleotide
  Target: SCN9A; (-) strand; PAM type: NRG; PAM sequence: AGG
atccatcttaccctattttt

SEQ ID NO: 22984 - DNA, 20 bp, Artificial Sequence
  Description of Artificial Sequence: Synthetic oligonucleotide
  Target: SCN9A; (-) strand; PAM type: NRG; PAM sequence: TAG
catccatcttaccctatttt

SEQ ID NO: 22985 - DNA, 20 bp, Artificial Sequence
  Description of Artificial Sequence: Synthetic oligonucleotide
  Target: SCN9A; (-) strand; PAM type: NRG; PAM sequence: CAG
cttttaaatctatttcctta

SEQ ID NO: 22986 - DNA, 20 bp, Artificial Sequence
  Description of Artificial Sequence: Synthetic oligonucleotide
  Target: SCN9A; (-) strand; PAM type: NRG; PAM sequence: TGG
tacattatttcttcttattt

SEQ ID NO: 22987 - DNA, 20 bp, Artificial Sequence
  Description of Artificial Sequence: Synthetic oligonucleotide
  Target: SCN9A; (-) strand; PAM type: NRG; PAM sequence: TAG
atgcatgatttctattcaaa

SEQ ID NO: 22988 - DNA, 20 bp, Artificial Sequence
  Description of Artificial Sequence: Synthetic oligonucleotide
  Target: SCN9A; (-) strand; PAM type: NRG; PAM sequence: AAG
attgattacaaaagtgtgaa

SEQ ID NO: 22989 - DNA, 20 bp, Artificial Sequence
  Description of Artificial Sequence: Synthetic oligonucleotide
  Target: SCN9A; (-) strand; PAM type: NRG; PAM sequence: AAG
tacaaagcaattgattacaa

SEQ ID NO: 22990 - DNA, 20 bp, Artificial Sequence
  Description of Artificial Sequence: Synthetic oligonucleotide
  Target: SCN9A; (-) strand; PAM type: NRG; PAM sequence: AAG
agatttaataaggaattaca

SEQ ID NO: 22991 - DNA, 20 bp, Artificial Sequence
  Description of Artificial Sequence: Synthetic oligonucleotide
  Target: SCN9A; (-) strand; PAM type: NRG; PAM sequence: AGG
ttaaatttttagatttaata

SEQ ID NO: 22992 - DNA, 20 bp, Artificial Sequence
  Description of Artificial Sequence: Synthetic oligonucleotide
  Target: SCN9A; (-) strand; PAM type: NRG; PAM sequence: AAG
attaaatttttagatttaat

SEQ ID NO: 22993 - DNA, 20 bp, Artificial Sequence
  Description of Artificial Sequence: Synthetic oligonucleotide
  Target: SCN9A; (-) strand; PAM type: NRG; PAM sequence: TAG
cattgttctaattaaatttt

SEQ ID NO: 22994 - DNA, 20 bp, Artificial Sequence
  Description of Artificial Sequence: Synthetic oligonucleotide
  Target: SCN9A; (-) strand; PAM type: NRG; PAM sequence: GAG
cacacacttcattttgacct

SEQ ID NO: 22995 - DNA, 20 bp, Artificial Sequence
  Description of Artificial Sequence: Synthetic oligonucleotide
  Target: SCN9A; (-) strand; PAM type: NRG; PAM sequence: CAG
acacttttagggcttagctt

SEQ ID NO: 22996 - DNA, 20 bp, Artificial Sequence
  Description of Artificial Sequence: Synthetic oligonucleotide
  Target: SCN9A; (-) strand; PAM type: NRG; PAM sequence: TAG
aataccacacttttagggct

SEQ ID NO: 22997 - DNA, 20 bp, Artificial Sequence
  Description of Artificial Sequence: Synthetic oligonucleotide
  Target: SCN9A; (-) strand; PAM type: NRG; PAM sequence: GGG
gagtgaataccacactttta

SEQ ID NO: 22998 - DNA, 20 bp, Artificial Sequence
  Description of Artificial Sequence: Synthetic oligonucleotide
  Target: SCN9A; (-) strand; PAM type: NRG; PAM sequence: AGG
tgagtgaataccacactttt

SEQ ID NO: 22999 - DNA, 20 bp, Artificial Sequence
  Description of Artificial Sequence: Synthetic oligonucleotide
  Target: SCN9A; (-) strand; PAM type: NRG; PAM sequence: TAG
ttgagtgaataccacacttt

SEQ ID NO: 23000 - DNA, 20 bp, Artificial Sequence
  Description of Artificial Sequence: Synthetic oligonucleotide
  Target: SCN9A; (-) strand; PAM type: NRG; PAM sequence: GAG
actaagacatagatttagtt

SEQ ID NO: 23001 - DNA, 20 bp, Artificial Sequence
  Description of Artificial Sequence: Synthetic oligonucleotide
  Target: SCN9A; (-) strand; PAM type: NRG; PAM sequence: TAG
tttatactaagacatagatt

SEQ ID NO: 23002 - DNA, 20 bp, Artificial Sequence
  Description of Artificial Sequence: Synthetic oligonucleotide
  Target: SCN9A; (-) strand; PAM type: NRG; PAM sequence: TAG
ataagatttatactaagaca

SEQ ID NO: 23003 - DNA, 20 bp, Artificial Sequence
  Description of Artificial Sequence: Synthetic oligonucleotide
  Target: SCN9A; (-) strand; PAM type: NRG; PAM sequence: AAG
tttttaataagatttatact

SEQ ID NO: 23004 - DNA, 20 bp, Artificial Sequence
  Description of Artificial Sequence: Synthetic oligonucleotide
  Target: SCN9A; (-) strand; PAM type: NRG; PAM sequence: AAG
tcttcaaaatgttttttaat

SEQ ID NO: 23005 - DNA, 20 bp, Artificial Sequence
  Description of Artificial Sequence: Synthetic oligonucleotide
  Target: SCN9A; (-) strand; PAM type: NRG; PAM sequence: GAG
ttgccccaactcaaaatcat

SEQ ID NO: 23006 - DNA, 20 bp, Artificial Sequence
  Description of Artificial Sequence: Synthetic oligonucleotide
  Target: SCN9A; (-) strand; PAM type: NRG; PAM sequence: GAG
agggcagaagcaatcttgtt

SEQ ID NO: 23007 - DNA, 20 bp, Artificial Sequence
  Description of Artificial Sequence: Synthetic oligonucleotide
  Target: SCN9A; (-) strand; PAM type: NRG; PAM sequence: AAG
ctttagaaattgtagggcag

SEQ ID NO: 23008 - DNA, 20 bp, Artificial Sequence
  Description of Artificial Sequence: Synthetic oligonucleotide
  Target: SCN9A; (-) strand; PAM type: NRG; PAM sequence: CAG
aatctttagaaattgtaggg

SEQ ID NO: 23009 - DNA, 20 bp, Artificial Sequence
  Description of Artificial Sequence: Synthetic oligonucleotide
  Target: SCN9A; (-) strand; PAM type: NRG; PAM sequence: GGG
gctaatctttagaaattgta

SEQ ID NO: 23010 - DNA, 20 bp, Artificial Sequence
  Description of Artificial Sequence: Synthetic oligonucleotide
  Target: SCN9A; (-) strand; PAM type: NRG; PAM sequence: AGG
tgctaatctttagaaattgt

SEQ ID NO: 23011 - DNA, 20 bp, Artificial Sequence
  Description of Artificial Sequence: Synthetic oligonucleotide
  Target: SCN9A; (-) strand; PAM type: NRG; PAM sequence: TAG
gtgctaatctttagaaattg

SEQ ID NO: 23012 - DNA, 20 bp, Artificial Sequence
  Description of Artificial Sequence: Synthetic oligonucleotide
  Target: SCN9A; (-) strand; PAM type: NRG; PAM sequence: TAG
agatctttggtgctaatctt

SEQ ID NO: 23013 - DNA, 20 bp, Artificial Sequence
  Description of Artificial Sequence: Synthetic oligonucleotide
  Target: SCN9A; (-) strand; PAM type: NRG; PAM sequence: TGG
aaaactatttggtagatctt

SEQ ID NO: 23014 - DNA, 20 bp, Artificial Sequence
  Description of Artificial Sequence: Synthetic oligonucleotide
  Target: SCN9A; (-) strand; PAM type: NRG; PAM sequence: TAG
tcccatgaaaaactatttgg

SEQ ID NO: 23015 - DNA, 20 bp, Artificial Sequence
  Description of Artificial Sequence: Synthetic oligonucleotide
  Target: SCN9A; (-) strand; PAM type: NRG; PAM sequence: TGG
ttctcccatgaaaaactatt

SEQ ID NO: 23016 - DNA, 20 bp, Artificial Sequence
  Description of Artificial Sequence: Synthetic oligonucleotide
  Target: SCN9A; (-) strand; PAM type: NRG; PAM sequence: CAG
agctactctcattctctctt

SEQ ID NO: 23017 - DNA, 20 bp, Artificial Sequence
  Description of Artificial Sequence: Synthetic oligonucleotide
  Target: SCN9A; (-) strand; PAM type: NRG; PAM sequence: CAG
gattgtgaagccaatgagat

SEQ ID NO: 23018 - DNA, 20 bp, Artificial Sequence
  Description of Artificial Sequence: Synthetic oligonucleotide
  Target: SCN9A; (-) strand; PAM type: NRG; PAM sequence: GAG
atattgattgtgaagccaat

SEQ ID NO: 23019 - DNA, 20 bp, Artificial Sequence
  Description of Artificial Sequence: Synthetic oligonucleotide
  Target: SCN9A; (-) strand; PAM type: NRG; PAM sequence: AAG
ttatatctatattgattgtg

SEQ ID NO: 23020 - DNA, 20 bp, Artificial Sequence
  Description of Artificial Sequence: Synthetic oligonucleotide
  Target: SCN9A; (-) strand; PAM type: NRG; PAM sequence: AAG
ctgatctatctaacatgatg

SEQ ID NO: 23021 - DNA, 20 bp, Artificial Sequence
  Description of Artificial Sequence: Synthetic oligonucleotide
  Target: SCN9A; (-) strand; PAM type: NRG; PAM sequence: TGG
gatactggttatggtaattg

SEQ ID NO: 23022 - DNA, 20 bp, Artificial Sequence
  Description of Artificial Sequence: Synthetic oligonucleotide
  Target: SCN9A; (-) strand; PAM type: NRG; PAM sequence: TGG
tttcttttggatactggtta

SEQ ID NO: 23023 - DNA, 20 bp, Artificial Sequence
  Description of Artificial Sequence: Synthetic oligonucleotide
  Target: SCN9A; (-) strand; PAM type: NRG; PAM sequence: TGG
ctcaaatttcttttggatac

SEQ ID NO: 23024 - DNA, 20 bp, Artificial Sequence
  Description of Artificial Sequence: Synthetic oligonucleotide
  Target: SCN9A; (-) strand; PAM type: NRG; PAM sequence: TGG
ataagaactcaaatttcttt

SEQ ID NO: 23025 - DNA, 20 bp, Artificial Sequence
  Description of Artificial Sequence: Synthetic oligonucleotide
  Target: SCN9A; (-) strand; PAM type: NRG; PAM sequence: AAG
ttcttaagataatttacgat

SEQ ID NO: 23026 - DNA, 20 bp, Artificial Sequence
  Description of Artificial Sequence: Synthetic oligonucleotide
  Target: SCN9A; (-) strand; PAM type: NRG; PAM sequence: AAG
tgctgttcatgttctttctt

SEQ ID NO: 23027 - DNA, 20 bp, Artificial Sequence
  Description of Artificial Sequence: Synthetic oligonucleotide
  Target: SCN9A; (-) strand; PAM type: NRG; PAM sequence: GAG
ccagatctaaggtcatggag

SEQ ID NO: 23028 - DNA, 20 bp, Artificial Sequence
  Description of Artificial Sequence: Synthetic oligonucleotide
  Target: SCN9A; (-) strand; PAM type: NRG; PAM sequence: AGG
atccagatctaaggtcatgg

SEQ ID NO: 23029 - DNA, 20 bp, Artificial Sequence
  Description of Artificial Sequence: Synthetic oligonucleotide
  Target: SCN9A; (-) strand; PAM type: NRG; PAM sequence: GAG
gatccagatctaaggtcatg

SEQ ID NO: 23030 - DNA, 20 bp, Artificial Sequence
  Description of Artificial Sequence: Synthetic oligonucleotide
  Target: SCN9A; (-) strand; PAM type: NRG; PAM sequence: TGG
tagatccagatctaaggtca

SEQ ID NO: 23031 - DNA, 20 bp, Artificial Sequence
  Description of Artificial Sequence: Synthetic oligonucleotide
  Target: SCN9A; (-) strand; PAM type: NRG; PAM sequence: AGG
tatttatagatccagatcta

SEQ ID NO: 23032 - DNA, 20 bp, Artificial Sequence
  Description of Artificial Sequence: Synthetic oligonucleotide
  Target: SCN9A; (-) strand; PAM type: NRG; PAM sequence: AAG
atatttatagatccagatct

SEQ ID NO: 23033 - DNA, 20 bp, Artificial Sequence
  Description of Artificial Sequence: Synthetic oligonucleotide
  Target: SCN9A; (-) strand; PAM type: NRG; PAM sequence: CAG
agtaaacatatttatagatc

SEQ ID NO: 23034 - DNA, 20 bp, Artificial Sequence
  Description of Artificial Sequence: Synthetic oligonucleotide
  Target: SCN9A; (-) strand; PAM type: NRG; PAM sequence: TAG
tcagagagtaaacatattta

SEQ ID NO: 23035 - DNA, 20 bp, Artificial Sequence
  Description of Artificial Sequence: Synthetic oligonucleotide
  Target: SCN9A; (-) strand; PAM type: NRG; PAM sequence: GAG
ttccatggaactaattcaga

SEQ ID NO: 23036 - DNA, 20 bp, Artificial Sequence
  Description of Artificial Sequence: Synthetic oligonucleotide
  Target: SCN9A; (-) strand; PAM type: NRG; PAM sequence: GAG
ttttccatggaactaattca

SEQ ID NO: 23037 - DNA, 20 bp, Artificial Sequence
  Description of Artificial Sequence: Synthetic oligonucleotide
  Target: SCN9A; (-) strand; PAM type: NRG; PAM sequence: CAG
tattttccatggaactaatt

SEQ ID NO: 23038 - DNA, 20 bp, Artificial Sequence
  Description of Artificial Sequence: Synthetic oligonucleotide
  Target: SCN9A; (-) strand; PAM type: NRG; PAM sequence: TGG
aggcaaatgaatattttcca

SEQ ID NO: 23039 - DNA, 20 bp, Artificial Sequence
  Description of Artificial Sequence: Synthetic oligonucleotide
  Target: SCN9A; (-) strand; PAM type: NRG; PAM sequence: AGG
ctcctgctacacaggatgtg

SEQ ID NO: 23040 - DNA, 20 bp, Artificial Sequence
  Description of Artificial Sequence: Synthetic oligonucleotide
  Target: SCN9A; (-) strand; PAM type: NRG; PAM sequence: GAG
tctcctgctacacaggatgt

SEQ ID NO: 23041 - DNA, 20 bp, Artificial Sequence
  Description of Artificial Sequence: Synthetic oligonucleotide
  Target: SCN9A; (-) strand; PAM type: NRG; PAM sequence: AGG
gacatcgtctcctgctacac

SEQ ID NO: 23042 - DNA, 20 bp, Artificial Sequence
  Description of Artificial Sequence: Synthetic oligonucleotide
  Target: SCN9A; (-) strand; PAM type: NRG; PAM sequence: CAG
agacatcgtctcctgctaca

SEQ ID NO: 23043 - DNA, 20 bp, Artificial Sequence
  Description of Artificial Sequence: Synthetic oligonucleotide
  Target: SCN9A; (-) strand; PAM type: NRG; PAM sequence: TAG
tgcattccagacatttttct

SEQ ID NO: 23044 - DNA, 20 bp, Artificial Sequence
  Description of Artificial Sequence: Synthetic oligonucleotide
  Target: SCN9A; (-) strand; PAM type: NRG; PAM sequence: CAG
cgtaatgaagaactgcattc

SEQ ID NO: 23045 - DNA, 20 bp, Artificial Sequence
  Description of Artificial Sequence: Synthetic oligonucleotide
  Target: SCN9A; (-) strand; PAM type: NRG; PAM sequence: AAG
tcactaacttattcgtaatg

SEQ ID NO: 23046 - DNA, 20 bp, Artificial Sequence
  Description of Artificial Sequence: Synthetic oligonucleotide
  Target: SCN9A; (-) strand; PAM type: NRG; PAM sequence: CAG
cctcgaaaaattgaatctct

SEQ ID NO: 23047 - DNA, 20 bp, Artificial Sequence
  Description of Artificial Sequence: Synthetic oligonucleotide
  Target: SCN9A; (-) strand; PAM type: NRG; PAM sequence: TGG
aatagataaatatataaagt

SEQ ID NO: 23048 - DNA, 20 bp, Artificial Sequence
  Description of Artificial Sequence: Synthetic oligonucleotide
  Target: SCN9A; (-) strand; PAM type: NRG; PAM sequence: AAG
ctgaaatagataaatatata

SEQ ID NO: 23049 - DNA, 20 bp, Artificial Sequence
  Description of Artificial Sequence: Synthetic oligonucleotide
  Target: SCN9A; (-) strand; PAM type: NRG; PAM sequence: TAG
gactttttctacgcctgaaa

SEQ ID NO: 23050 - DNA, 20 bp, Artificial Sequence
  Description of Artificial Sequence: Synthetic oligonucleotide
  Target: SCN9A; (-) strand; PAM type: NRG; PAM sequence: CAG
ttacctgtctctgatggtaa

SEQ ID NO: 23051 - DNA, 20 bp, Artificial Sequence
  Description of Artificial Sequence: Synthetic oligonucleotide
  Target: SCN9A; (-) strand; PAM type: NRG; PAM sequence: TGG
gtcagtttacctgtctctga

SEQ ID NO: 23052 - DNA, 20 bp, Artificial Sequence
  Description of Artificial Sequence: Synthetic oligonucleotide
  Target: SCN9A; (-) strand; PAM type: NRG; PAM sequence: CAG
acacttcccgcttcatcagt

SEQ ID NO: 23053 - DNA, 20 bp, Artificial Sequence
  Description of Artificial Sequence: Synthetic oligonucleotide
  Target: SCN9A; (-) strand; PAM type: NRG; PAM sequence: CAG
taaaacacttcccgcttcat

SEQ ID NO: 23054 - DNA, 20 bp, Artificial Sequence
  Description of Artificial Sequence: Synthetic oligonucleotide
  Target: SCN9A; (-) strand; PAM type: NRG; PAM sequence: GAG
tggaaatactacatgaggat

SEQ ID NO: 23055 - DNA, 20 bp, Artificial Sequence
  Description of Artificial Sequence: Synthetic oligonucleotide
  Target: SCN9A; (-) strand; PAM type: NRG; PAM sequence: AGG
acatctggaaatactacatg

SEQ ID NO: 23056 - DNA, 20 bp, Artificial Sequence
  Description of Artificial Sequence: Synthetic oligonucleotide
  Target: SCN9A; (-) strand; PAM type: NRG; PAM sequence: GAG
gacatctggaaatactacat

SEQ ID NO: 23057 - DNA, 20 bp, Artificial Sequence
  Description of Artificial Sequence: Synthetic oligonucleotide
  Target: SCN9A; (-) strand; PAM type: NRG; PAM sequence: TGG
gttacatttagtgagacatc

SEQ ID NO: 23058 - DNA, 20 bp, Artificial Sequence
  Description of Artificial Sequence: Synthetic oligonucleotide
  Target: SCN9A; (-) strand; PAM type: NRG; PAM sequence: GAG
aaagccatgttacatttagt

SEQ ID NO: 23059 - DNA, 20 bp, Artificial Sequence
  Description of Artificial Sequence: Synthetic oligonucleotide
  Target: SCN9A; (-) strand; PAM type: NRG; PAM sequence: TAG
aaaaaaagccatgttacatt

SEQ ID NO: 23060 - DNA, 20 bp, Artificial Sequence
  Description of Artificial Sequence: Synthetic oligonucleotide
  Target: SCN9A; (-) strand; PAM type: NRG; PAM sequence: AAG
ctttaggaatttaaaaaaaa

SEQ ID NO: 23061 - DNA, 20 bp, Artificial Sequence
  Description of Artificial Sequence: Synthetic oligonucleotide
  Target: SCN9A; (-) strand; PAM type: NRG; PAM sequence: AGG
tctgctaaatacgtagcttt

SEQ ID NO: 23062 - DNA, 20 bp, Artificial Sequence
  Description of Artificial Sequence: Synthetic oligonucleotide
  Target: SCN9A; (-) strand; PAM type: NRG; PAM sequence: TAG
ttctgctaaatacgtagctt

SEQ ID NO: 23063 - DNA, 20 bp, Artificial Sequence
  Description of Artificial Sequence: Synthetic oligonucleotide
  Target: SCN9A; (-) strand; PAM type: NRG; PAM sequence: TAG
aatttattctgctaaatacg

SEQ ID NO: 23064 - DNA, 20 bp, Artificial Sequence
  Description of Artificial Sequence: Synthetic oligonucleotide
  Target: SCN9A; (-) strand; PAM type: NRG; PAM sequence: GAG
aaatttaagagtggcatgag

SEQ ID NO: 23065 - DNA, 20 bp, Artificial Sequence
  Description of Artificial Sequence: Synthetic oligonucleotide
  Target: SCN9A; (-) strand; PAM type: NRG; PAM sequence: AGG
gcaaatttaagagtggcatg

SEQ ID NO: 23066 - DNA, 20 bp, Artificial Sequence
  Description of Artificial Sequence: Synthetic oligonucleotide
  Target: SCN9A; (-) strand; PAM type: NRG; PAM sequence: GAG
ggcaaatttaagagtggcat

SEQ ID NO: 23067 - DNA, 20 bp, Artificial Sequence
  Description of Artificial Sequence: Synthetic oligonucleotide
  Target: SCN9A; (-) strand; PAM type: NRG; PAM sequence: TGG
tgactgggcaaatttaagag

SEQ ID NO: 23068 - DNA, 20 bp, Artificial Sequence
  Description of Artificial Sequence: Synthetic oligonucleotide
  Target: SCN9A; (-) strand; PAM type: NRG; PAM sequence: GAG
gaatgactgggcaaatttaa

SEQ ID NO: 23069 - DNA, 20 bp, Artificial Sequence
  Description of Artificial Sequence: Synthetic oligonucleotide
  Target: SCN9A; (-) strand; PAM type: NRG; PAM sequence: AAG
gtgaatgactgggcaaattt

SEQ ID NO: 23070 - DNA, 20 bp, Artificial Sequence
  Description of Artificial Sequence: Synthetic oligonucleotide
  Target: SCN9A; (-) strand; PAM type: NRG; PAM sequence: GGG
aataatggatgtgaatgact

SEQ ID NO: 23071 - DNA, 20 bp, Artificial Sequence
  Description of Artificial Sequence: Synthetic oligonucleotide
  Target: SCN9A; (-) strand; PAM type: NRG; PAM sequence: TGG
aaataatggatgtgaatgac

SEQ ID NO: 23072 - DNA, 20 bp, Artificial Sequence
  Description of Artificial Sequence: Synthetic oligonucleotide
  Target: SCN9A; (-) strand; PAM type: NRG; PAM sequence: TGG
tgttcttaagtggaaaataa

SEQ ID NO: 23073 - DNA, 20 bp, Artificial Sequence
  Description of Artificial Sequence: Synthetic oligonucleotide
  Target: SCN9A; (-) strand; PAM type: NRG; PAM sequence: TGG
tattttcaagtgttcttaag

SEQ ID NO: 23074 - DNA, 20 bp, Artificial Sequence
  Description of Artificial Sequence: Synthetic oligonucleotide
  Target: SCN9A; (-) strand; PAM type: NRG; PAM sequence: AAG
acatattttcaagtgttctt

SEQ ID NO: 23075 - DNA, 20 bp, Artificial Sequence
  Description of Artificial Sequence: Synthetic oligonucleotide
  Target: SCN9A; (-) strand; PAM type: NRG; PAM sequence: AAG
gagggagcatacatattttc

SEQ ID NO: 23076 - DNA, 20 bp, Artificial Sequence
  Description of Artificial Sequence: Synthetic oligonucleotide
  Target: SCN9A; (-) strand; PAM type: NRG; PAM sequence: GAG
aaattttctgattaaagagg

SEQ ID NO: 23077 - DNA, 20 bp, Artificial Sequence
  Description of Artificial Sequence: Synthetic oligonucleotide
  Target: SCN9A; (-) strand; PAM type: NRG; PAM sequence: GGG
aaaaattttctgattaaaga

SEQ ID NO: 23078 - DNA, 20 bp, Artificial Sequence
  Description of Artificial Sequence: Synthetic oligonucleotide
  Target: SCN9A; (-) strand; PAM type: NRG; PAM sequence: AGG
aaaaaattttctgattaaag

SEQ ID NO: 23079 - DNA, 20 bp, Artificial Sequence
  Description of Artificial Sequence: Synthetic oligonucleotide
  Target: SCN9A; (-) strand; PAM type: NRG; PAM sequence: GAG
aaaaaaattttctgattaaa

SEQ ID NO: 23080 - DNA, 20 bp, Artificial Sequence
  Description of Artificial Sequence: Synthetic oligonucleotide
  Target: SCN9A; (-) strand; PAM type: NRG; PAM sequence: AAG
aaaaaaaaattttctgatta

SEQ ID NO: 23081 - DNA, 20 bp, Artificial Sequence
  Description of Artificial Sequence: Synthetic oligonucleotide
  Target: SCN9A; (-) strand; PAM type: NRG; PAM sequence: CAG
agggacaaacattcaaacca

SEQ ID NO: 23082 - DNA, 20 bp, Artificial Sequence
  Description of Artificial Sequence: Synthetic oligonucleotide
  Target: SCN9A; (-) strand; PAM type: NRG; PAM sequence: GGG
ttccaacatgagtttcaaaa

SEQ ID NO: 23083 - DNA, 20 bp, Artificial Sequence
  Description of Artificial Sequence: Synthetic oligonucleotide
  Target: SCN9A; (-) strand; PAM type: NRG; PAM sequence: AGG
gttccaacatgagtttcaaa

SEQ ID NO: 23084 - DNA, 20 bp, Artificial Sequence
  Description of Artificial Sequence: Synthetic oligonucleotide
  Target: SCN9A; (-) strand; PAM type: NRG; PAM sequence: AAG
agttccaacatgagtttcaa

SEQ ID NO: 23085 - DNA, 20 bp, Artificial Sequence
  Description of Artificial Sequence: Synthetic oligonucleotide
  Target: SCN9A; (-) strand; PAM type: NRG; PAM sequence: GAG
tgggaattaagttccaacat

SEQ ID NO: 23086 - DNA, 20 bp, Artificial Sequence
  Description of Artificial Sequence: Synthetic oligonucleotide
  Target: SCN9A; (-) strand; PAM type: NRG; PAM sequence: AAG
atactgttacattgggaatt

SEQ ID NO: 23087 - DNA, 20 bp, Artificial Sequence
  Description of Artificial Sequence: Synthetic oligonucleotide
  Target: SCN9A; (-) strand; PAM type: NRG; PAM sequence: GGG
cctcttaatactgttacatt

SEQ ID NO: 23088 - DNA, 20 bp, Artificial Sequence
  Description of Artificial Sequence: Synthetic oligonucleotide
  Target: SCN9A; (-) strand; PAM type: NRG; PAM sequence: TGG
gcctcttaatactgttacat

SEQ ID NO: 23089 - DNA, 20 bp, Artificial Sequence
  Description of Artificial Sequence: Synthetic oligonucleotide
  Target: SCN9A; (-) strand; PAM type: NRG; PAM sequence: AGG
atgacctcatcaccttttaa

SEQ ID NO: 23090 - DNA, 20 bp, Artificial Sequence
  Description of Artificial Sequence: Synthetic oligonucleotide
  Target: SCN9A; (-) strand; PAM type: NRG; PAM sequence: AAG
catgacctcatcacctttta

SEQ ID NO: 23091 - DNA, 20 bp, Artificial Sequence
  Description of Artificial Sequence: Synthetic oligonucleotide
  Target: SCN9A; (-) strand; PAM type: NRG; PAM sequence: CAG
ctatattccattcatgaagg

SEQ ID NO: 23092 - DNA, 20 bp, Artificial Sequence
  Description of Artificial Sequence: Synthetic oligonucleotide
  Target: SCN9A; (-) strand; PAM type: NRG; PAM sequence: AGG
actctatattccattcatga

SEQ ID NO: 23093 - DNA, 20 bp, Artificial Sequence
  Description of Artificial Sequence: Synthetic oligonucleotide
  Target: SCN9A; (-) strand; PAM type: NRG; PAM sequence: AAG
tactctatattccattcatg

SEQ ID NO: 23094 - DNA, 20 bp, Artificial Sequence
  Description of Artificial Sequence: Synthetic oligonucleotide
  Target: SCN9A; (-) strand; PAM type: NRG; PAM sequence: AAG
cactcccatgataacccatt

SEQ ID NO: 23095 - DNA, 20 bp, Artificial Sequence
  Description of Artificial Sequence: Synthetic oligonucleotide
  Target: SCN9A; (-) strand; PAM type: NRG; PAM sequence: GGG
tgttcactgagagccaaact

SEQ ID NO: 23096 - DNA, 20 bp, Artificial Sequence
  Description of Artificial Sequence: Synthetic oligonucleotide
  Target: SCN9A; (-) strand; PAM type: NRG; PAM sequence: TGG
gtgttcactgagagccaaac

SEQ ID NO: 23097 - DNA, 20 bp, Artificial Sequence
  Description of Artificial Sequence: Synthetic oligonucleotide
  Target: SCN9A; (-) strand; PAM type: NRG; PAM sequence: GAG
tggcgaggggtgttcactga

SEQ ID NO: 23098 - DNA, 20 bp, Artificial Sequence
  Description of Artificial Sequence: Synthetic oligonucleotide
  Target: SCN9A; (-) strand; PAM type: NRG; PAM sequence: GAG
catggcgaggggtgttcact

SEQ ID NO: 23099 - DNA, 20 bp, Artificial Sequence
  Description of Artificial Sequence: Synthetic oligonucleotide
  Target: SCN9A; (-) strand; PAM type: NRG; PAM sequence: GGG
tcatggcatcacatggcgag

SEQ ID NO: 23100 - DNA, 20 bp, Artificial Sequence
  Description of Artificial Sequence: Synthetic oligonucleotide
  Target: SCN9A; (-) strand; PAM type: NRG; PAM sequence: GGG
ctcatggcatcacatggcga

SEQ ID NO: 23101 - DNA, 20 bp, Artificial Sequence
  Description of Artificial Sequence: Synthetic oligonucleotide
  Target: SCN9A; (-) strand; PAM type: NRG; PAM sequence: AGG
gctcatggcatcacatggcg

SEQ ID NO: 23102 - DNA, 20 bp, Artificial Sequence
  Description of Artificial Sequence: Synthetic oligonucleotide
  Target: SCN9A; (-) strand; PAM type: NRG; PAM sequence: GAG
agctcatggcatcacatggc

SEQ ID NO: 23103 - DNA, 20 bp, Artificial Sequence
  Description of Artificial Sequence: Synthetic oligonucleotide
  Target: SCN9A; (-) strand; PAM type: NRG; PAM sequence: TGG
aggcagctcatggcatcaca

SEQ ID NO: 23104 - DNA, 20 bp, Artificial Sequence
  Description of Artificial Sequence: Synthetic oligonucleotide
  Target: SCN9A; (-) strand; PAM type: NRG; PAM sequence: TGG
gagagtcccaaggcagctca

SEQ ID NO: 23105 - DNA, 20 bp, Artificial Sequence
  Description of Artificial Sequence: Synthetic oligonucleotide
  Target: SCN9A; (-) strand; PAM type: NRG; PAM sequence: CAG
cacaccagagagtcccaagg

SEQ ID NO: 23106 - DNA, 20 bp, Artificial Sequence
  Description of Artificial Sequence: Synthetic oligonucleotide
  Target: SCN9A; (-) strand; PAM type: NRG; PAM sequence: AGG
gggcacaccagagagtccca

SEQ ID NO: 23107 - DNA, 20 bp, Artificial Sequence
  Description of Artificial Sequence: Synthetic oligonucleotide
  Target: SCN9A; (-) strand; PAM type: NRG; PAM sequence: AAG
tgggcacaccagagagtccc

SEQ ID NO: 23108 - DNA, 20 bp, Artificial Sequence
  Description of Artificial Sequence: Synthetic oligonucleotide
  Target: SCN9A; (-) strand; PAM type: NRG; PAM sequence: GAG
ttgctggtgggcacaccaga

SEQ ID NO: 23109 - DNA, 20 bp, Artificial Sequence
  Description of Artificial Sequence: Synthetic oligonucleotide
  Target: SCN9A; (-) strand; PAM type: NRG; PAM sequence: GAG
tcttgctggtgggcacacca

SEQ ID NO: 23110 - DNA, 20 bp, Artificial Sequence
  Description of Artificial Sequence: Synthetic oligonucleotide
  Target: SCN9A; (-) strand; PAM type: NRG; PAM sequence: CAG
tttcttgctggtgggcacac

SEQ ID NO: 23111 - DNA, 20 bp, Artificial Sequence
  Description of Artificial Sequence: Synthetic oligonucleotide
  Target: SCN9A; (-) strand; PAM type: NRG; PAM sequence: GGG
gtgggaactttcttgctggt

SEQ ID NO: 23112 - DNA, 20 bp, Artificial Sequence
  Description of Artificial Sequence: Synthetic oligonucleotide
  Target: SCN9A; (-) strand; PAM type: NRG; PAM sequence: TGG
ggtgggaactttcttgctgg

SEQ ID NO: 23113 - DNA, 20 bp, Artificial Sequence
  Description of Artificial Sequence: Synthetic oligonucleotide
  Target: SCN9A; (-) strand; PAM type: NRG; PAM sequence: TGG
tctggtgggaactttcttgc

SEQ ID NO: 23114 - DNA, 20 bp, Artificial Sequence
  Description of Artificial Sequence: Synthetic oligonucleotide
  Target: SCN9A; (-) strand; PAM type: NRG; PAM sequence: GGG
gtgaagggtccacatctggt

SEQ ID NO: 23115 - DNA, 20 bp, Artificial Sequence
  Description of Artificial Sequence: Synthetic oligonucleotide
  Target: SCN9A; (-) strand; PAM type: NRG; PAM sequence: TGG
ggtgaagggtccacatctgg

SEQ ID NO: 23116 - DNA, 20 bp, Artificial Sequence
  Description of Artificial Sequence: Synthetic oligonucleotide
  Target: SCN9A; (-) strand; PAM type: NRG; PAM sequence: TGG
taaggtgaagggtccacatc

SEQ ID NO: 23117 - DNA, 20 bp, Artificial Sequence
  Description of Artificial Sequence: Synthetic oligonucleotide
  Target: SCN9A; (-) strand; PAM type: NRG; PAM sequence: GGG
gctgggaagtctaaggtgaa

SEQ ID NO: 23118 - DNA, 20 bp, Artificial Sequence
  Description of Artificial Sequence: Synthetic oligonucleotide
  Target: SCN9A; (-) strand; PAM type: NRG; PAM sequence: AGG
agctgggaagtctaaggtga

SEQ ID NO: 23119 - DNA, 20 bp, Artificial Sequence
  Description of Artificial Sequence: Synthetic oligonucleotide
  Target: SCN9A; (-) strand; PAM type: NRG; PAM sequence: AAG
aagctgggaagtctaaggtg

SEQ ID NO: 23120 - DNA, 20 bp, Artificial Sequence
  Description of Artificial Sequence: Synthetic oligonucleotide
  Target: SCN9A; (-) strand; PAM type: NRG; PAM sequence: AGG
tctggaagctgggaagtcta

SEQ ID NO: 23121 - DNA, 20 bp, Artificial Sequence
  Description of Artificial Sequence: Synthetic oligonucleotide
  Target: SCN9A; (-) strand; PAM type: NRG; PAM sequence: AAG
ttctggaagctgggaagtct

SEQ ID NO: 23122 - DNA, 20 bp, Artificial Sequence
  Description of Artificial Sequence: Synthetic oligonucleotide
  Target: SCN9A; (-) strand; PAM type: NRG; PAM sequence: AAG
ttaaagttctggaagctggg

SEQ ID NO: 23123 - DNA, 20 bp, Artificial Sequence
  Description of Artificial Sequence: Synthetic oligonucleotide
  Target: SCN9A; (-) strand; PAM type: NRG; PAM sequence: GGG
ttcttaaagttctggaagct

SEQ ID NO: 23124 - DNA, 20 bp, Artificial Sequence
  Description of Artificial Sequence: Synthetic oligonucleotide
  Target: SCN9A; (-) strand; PAM type: NRG; PAM sequence: TGG
tttcttaaagttctggaagc

SEQ ID NO: 23125 - DNA, 20 bp, Artificial Sequence
  Description of Artificial Sequence: Synthetic oligonucleotide
  Target: SCN9A; (-) strand; PAM type: NRG; PAM sequence: AAG
tttatttcttaaagttctgg

SEQ ID NO: 23126 - DNA, 20 bp, Artificial Sequence
  Description of Artificial Sequence: Synthetic oligonucleotide
  Target: SCN9A; (-) strand; PAM type: NRG; PAM sequence: TGG
aaatttatttcttaaagttc

SEQ ID NO: 23127 - DNA, 20 bp, Artificial Sequence
  Description of Artificial Sequence: Synthetic oligonucleotide
  Target: SCN9A; (-) strand; PAM type: NRG; PAM sequence: AAG
ataaagaaatttatttctta

SEQ ID NO: 23128 - DNA, 20 bp, Artificial Sequence
  Description of Artificial Sequence: Synthetic oligonucleotide
  Target: SCN9A; (-) strand; PAM type: NRG; PAM sequence: AAG
actggttaaagtattcaata

SEQ ID NO: 23129 - DNA, 20 bp, Artificial Sequence
  Description of Artificial Sequence: Synthetic oligonucleotide
  Target: SCN9A; (-) strand; PAM type: NRG; PAM sequence: AAG
tgaatacctgagactggtta

SEQ ID NO: 23130 - DNA, 20 bp, Artificial Sequence
  Description of Artificial Sequence: Synthetic oligonucleotide
  Target: SCN9A; (-) strand; PAM type: NRG; PAM sequence: TGG
tgtaactgaatacctgagac

SEQ ID NO: 23131 - DNA, 20 bp, Artificial Sequence
  Description of Artificial Sequence: Synthetic oligonucleotide
  Target: SCN9A; (-) strand; PAM type: NRG; PAM sequence: GAG
attgctgtaactgaatacct

SEQ ID NO: 23132 - DNA, 20 bp, Artificial Sequence
  Description of Artificial Sequence: Synthetic oligonucleotide
  Target: SCN9A; (-) strand; PAM type: NRG; PAM sequence: TAG
caattataacagacatgtct

SEQ ID NO: 23133 - DNA, 20 bp, Artificial Sequence
  Description of Artificial Sequence: Synthetic oligonucleotide
  Target: SCN9A; (-) strand; PAM type: NRG; PAM sequence: CAG
aggggctgtatcaattataa

SEQ ID NO: 23134 - DNA, 20 bp, Artificial Sequence
  Description of Artificial Sequence: Synthetic oligonucleotide
  Target: SCN9A; (-) strand; PAM type: NRG; PAM sequence: GGG
cagacctattagtattttag

SEQ ID NO: 23135 - DNA, 20 bp, Artificial Sequence
  Description of Artificial Sequence: Synthetic oligonucleotide
  Target: SCN9A; (-) strand; PAM type: NRG; PAM sequence: GGG
acagacctattagtatttta

SEQ ID NO: 23136 - DNA, 20 bp, Artificial Sequence
  Description of Artificial Sequence: Synthetic oligonucleotide
  Target: SCN9A; (-) strand; PAM type: NRG; PAM sequence: AGG
aacagacctattagtatttt

SEQ ID NO: 23137 - DNA, 20 bp, Artificial Sequence
  Description of Artificial Sequence: Synthetic oligonucleotide
  Target: SCN9A; (-) strand; PAM type: NRG; PAM sequence: TAG
gaacagacctattagtattt

SEQ ID NO: 23138 - DNA, 20 bp, Artificial Sequence
  Description of Artificial Sequence: Synthetic oligonucleotide
  Target: SCN9A; (-) strand; PAM type: NRG; PAM sequence: TAG
ggcttggagaacagacctat

SEQ ID NO: 23139 - DNA, 20 bp, Artificial Sequence
  Description of Artificial Sequence: Synthetic oligonucleotide
  Target: SCN9A; (-) strand; PAM type: NRG; PAM sequence: CAG
cttaacagtggcttggagaa

SEQ ID NO: 23140 - DNA, 20 bp, Artificial Sequence
  Description of Artificial Sequence: Synthetic oligonucleotide
  Target: SCN9A; (-) strand; PAM type: NRG; PAM sequence: GAG
actcacttaacagtggcttg

SEQ ID NO: 23141 - DNA, 20 bp, Artificial Sequence
  Description of Artificial Sequence: Synthetic oligonucleotide
  Target: SCN9A; (-) strand; PAM type: NRG; PAM sequence: TGG
aaactcacttaacagtggct

SEQ ID NO: 23142 - DNA, 20 bp, Artificial Sequence
  Description of Artificial Sequence: Synthetic oligonucleotide
  Target: SCN9A; (-) strand; PAM type: NRG; PAM sequence: TGG
tcataaaactcacttaacag

SEQ ID NO: 23143 - DNA, 20 bp, Artificial Sequence
  Description of Artificial Sequence: Synthetic oligonucleotide
  Target: SCN9A; (-) strand; PAM type: NRG; PAM sequence: CAG
gtgtcataaaactcacttaa

SEQ ID NO: 23144 - DNA, 20 bp, Artificial Sequence
  Description of Artificial Sequence: Synthetic oligonucleotide
  Target: SCN9A; (-) strand; PAM type: NRG; PAM sequence: TAG
ctcagttacaaactatacca

SEQ ID NO: 23145 - DNA, 20 bp, Artificial Sequence
  Description of Artificial Sequence: Synthetic oligonucleotide
  Target: SCN9A; (-) strand; PAM type: NRG; PAM sequence: CAG
tatatatgcatatatattct

SEQ ID NO: 23146 - DNA, 20 bp, Artificial Sequence
  Description of Artificial Sequence: Synthetic oligonucleotide
  Target: SCN9A; (-) strand; PAM type: NRG; PAM sequence: AAG
tatacgtgtgtgtttataga

SEQ ID NO: 23147 - DNA, 20 bp, Artificial Sequence
  Description of Artificial Sequence: Synthetic oligonucleotide
  Target: SCN9A; (-) strand; PAM type: NRG; PAM sequence: TAG
tatatatacgtgtgtgttta

SEQ ID NO: 23148 - DNA, 20 bp, Artificial Sequence
  Description of Artificial Sequence: Synthetic oligonucleotide
  Target: SCN9A; (-) strand; PAM type: NRG; PAM sequence: AGG
taaacagtgttcttcagtac

SEQ ID NO: 23149 - DNA, 20 bp, Artificial Sequence
  Description of Artificial Sequence: Synthetic oligonucleotide
  Target: SCN9A; (-) strand; PAM type: NRG; PAM sequence: CAG
ttaaacagtgttcttcagta

SEQ ID NO: 23150 - DNA, 20 bp, Artificial Sequence
  Description of Artificial Sequence: Synthetic oligonucleotide
  Target: SCN9A; (-) strand; PAM type: NRG; PAM sequence: CAG
cttgattaaacagtgttctt

SEQ ID NO: 23151 - DNA, 20 bp, Artificial Sequence
  Description of Artificial Sequence: Synthetic oligonucleotide
  Target: SCN9A; (-) strand; PAM type: NRG; PAM sequence: CAG
ttgaaacttacttgattaaa

SEQ ID NO: 23152 - DNA, 20 bp, Artificial Sequence
  Description of Artificial Sequence: Synthetic oligonucleotide
  Target: SCN9A; (-) strand; PAM type: NRG; PAM sequence: GGG
tctgatttctgcaggcttct

SEQ ID NO: 23153 - DNA, 20 bp, Artificial Sequence
  Description of Artificial Sequence: Synthetic oligonucleotide
  Target: SCN9A; (-) strand; PAM type: NRG; PAM sequence: TGG
gtctgatttctgcaggcttc

SEQ ID NO: 23154 - DNA, 20 bp, Artificial Sequence
  Description of Artificial Sequence: Synthetic oligonucleotide
  Target: SCN9A; (-) strand; PAM type: NRG; PAM sequence: AGG
tggacttgtctgatttctgc

SEQ ID NO: 23155 - DNA, 20 bp, Artificial Sequence
  Description of Artificial Sequence: Synthetic oligonucleotide
  Target: SCN9A; (-) strand; PAM type: NRG; PAM sequence: CAG
atggacttgtctgatttctg

SEQ ID NO: 23156 - DNA, 20 bp, Artificial Sequence
  Description of Artificial Sequence: Synthetic oligonucleotide
  Target: SCN9A; (-) strand; PAM type: NRG; PAM sequence: TGG
attatttgctactcagagaa

SEQ ID NO: 23157 - DNA, 20 bp, Artificial Sequence
  Description of Artificial Sequence: Synthetic oligonucleotide
  Target: SCN9A; (-) strand; PAM type: NRG; PAM sequence: GAG
cttatattatttgctactca

SEQ ID NO: 23158 - DNA, 20 bp, Artificial Sequence
  Description of Artificial Sequence: Synthetic oligonucleotide
  Target: SCN9A; (-) strand; PAM type: NRG; PAM sequence: CAG
tacttatattatttgctact

SEQ ID NO: 23159 - DNA, 20 bp, Artificial Sequence
  Description of Artificial Sequence: Synthetic oligonucleotide
  Target: SCN9A; (-) strand; PAM type: NRG; PAM sequence: CAG
tctgttgtatattcagattt

SEQ ID NO: 23160 - DNA, 20 bp, Artificial Sequence
  Description of Artificial Sequence: Synthetic oligonucleotide
  Target: SCN9A; (-) strand; PAM type: NRG; PAM sequence: CAG
agatgattctgttgtatatt

SEQ ID NO: 23161 - DNA, 20 bp, Artificial Sequence
  Description of Artificial Sequence: Synthetic oligonucleotide
  Target: SCN9A; (-) strand; PAM type: NRG; PAM sequence: CAG
aatcattgtaacaagcccta

SEQ ID NO: 23162 - DNA, 20 bp, Artificial Sequence
  Description of Artificial Sequence: Synthetic oligonucleotide
  Target: SCN9A; (-) strand; PAM type: NRG; PAM sequence: AAG
atgtggcaaatcattgtaac

SEQ ID NO: 23163 - DNA, 20 bp, Artificial Sequence
  Description of Artificial Sequence: Synthetic oligonucleotide
  Target: SCN9A; (-) strand; PAM type: NRG; PAM sequence: TGG
agaaactctggggttggatg

SEQ ID NO: 23164 - DNA, 20 bp, Artificial Sequence
  Description of Artificial Sequence: Synthetic oligonucleotide
  Target: SCN9A; (-) strand; PAM type: NRG; PAM sequence: TGG
tgaatcagaaactctggggt

SEQ ID NO: 23165 - DNA, 20 bp, Artificial Sequence
  Description of Artificial Sequence: Synthetic oligonucleotide
  Target: SCN9A; (-) strand; PAM type: NRG; PAM sequence: GGG
atactgaatcagaaactctg

SEQ ID NO: 23166 - DNA, 20 bp, Artificial Sequence
  Description of Artificial Sequence: Synthetic oligonucleotide
  Target: SCN9A; (-) strand; PAM type: NRG; PAM sequence: GGG
catactgaatcagaaactct

SEQ ID NO: 23167 - DNA, 20 bp, Artificial Sequence
  Description of Artificial Sequence: Synthetic oligonucleotide
  Target: SCN9A; (-) strand; PAM type: NRG; PAM sequence: TGG
acatactgaatcagaaactc

SEQ ID NO: 23168 - DNA, 20 bp, Artificial Sequence
  Description of Artificial Sequence: Synthetic oligonucleotide
  Target: SCN9A; (-) strand; PAM type: NRG; PAM sequence: CAG
aaccccaagacatactgaat

SEQ ID NO: 23169 - DNA, 20 bp, Artificial Sequence
  Description of Artificial Sequence: Synthetic oligonucleotide
  Target: SCN9A; (-) strand; PAM type: NRG; PAM sequence: AAG
caaattctgcccccaacccc

SEQ ID NO: 23170 - DNA, 20 bp, Artificial Sequence
  Description of Artificial Sequence: Synthetic oligonucleotide
  Target: SCN9A; (-) strand; PAM type: NRG; PAM sequence: GAG
atgtaggtgagaactcataa

SEQ ID NO: 23171 - DNA, 20 bp, Artificial Sequence
  Description of Artificial Sequence: Synthetic oligonucleotide
  Target: SCN9A; (-) strand; PAM type: NRG; PAM sequence: AAG
acatgtaggtgagaactcat

SEQ ID NO: 23172 - DNA, 20 bp, Artificial Sequence
  Description of Artificial Sequence: Synthetic oligonucleotide
  Target: SCN9A; (-) strand; PAM type: NRG; PAM sequence: GAG
aaacgttggcacatgtaggt

SEQ ID NO: 23173 - DNA, 20 bp, Artificial Sequence
  Description of Artificial Sequence: Synthetic oligonucleotide
  Target: SCN9A; (-) strand; PAM type: NRG; PAM sequence: AGG
ctgaaaacgttggcacatgt

SEQ ID NO: 23174 - DNA, 20 bp, Artificial Sequence
  Description of Artificial Sequence: Synthetic oligonucleotide
  Target: SCN9A; (-) strand; PAM type: NRG; PAM sequence: TAG
actgaaaacgttggcacatg

SEQ ID NO: 23175 - DNA, 20 bp, Artificial Sequence
  Description of Artificial Sequence: Synthetic oligonucleotide
  Target: SCN9A; (-) strand; PAM type: NRG; PAM sequence: TGG
ggtctcaaaactgaaaacgt

SEQ ID NO: 23176 - DNA, 20 bp, Artificial Sequence
  Description of Artificial Sequence: Synthetic oligonucleotide
  Target: SCN9A; (-) strand; PAM type: NRG; PAM sequence: TGG
cagcagttgttcttgaagga

SEQ ID NO: 23177 - DNA, 20 bp, Artificial Sequence
  Description of Artificial Sequence: Synthetic oligonucleotide
  Target: SCN9A; (-) strand; PAM type: NRG; PAM sequence: AGG
tctacagcagttgttcttga

SEQ ID NO: 23178 - DNA, 20 bp, Artificial Sequence
  Description of Artificial Sequence: Synthetic oligonucleotide
  Target: SCN9A; (-) strand; PAM type: NRG; PAM sequence: AAG
atctacagcagttgttcttg

SEQ ID NO: 23179 - DNA, 20 bp, Artificial Sequence
  Description of Artificial Sequence: Synthetic oligonucleotide
  Target: SCN9A; (-) strand; PAM type: NRG; PAM sequence: CAG
gtatagaaacttatctacag

SEQ ID NO: 23180 - DNA, 20 bp, Artificial Sequence
  Description of Artificial Sequence: Synthetic oligonucleotide
  Target: SCN9A; (-) strand; PAM type: NRG; PAM sequence: CAG
aaagtatagaaacttatcta

SEQ ID NO: 23181 - DNA, 20 bp, Artificial Sequence
  Description of Artificial Sequence: Synthetic oligonucleotide
  Target: SCN9A; (-) strand; PAM type: NRG; PAM sequence: TAG
ttttttttttctgaaaagta

SEQ ID NO: 23182 - DNA, 20 bp, Artificial Sequence
  Description of Artificial Sequence: Synthetic oligonucleotide
  Target: SCN9A; (-) strand; PAM type: NRG; PAM sequence: AAG
tgattttttttttttctgaa

SEQ ID NO: 23183 - DNA, 20 bp, Artificial Sequence
  Description of Artificial Sequence: Synthetic oligonucleotide
  Target: SCN9A; (-) strand; PAM type: NRG; PAM sequence: TGG
gggacacagatttgggggag

SEQ ID NO: 23184 - DNA, 20 bp, Artificial Sequence
  Description of Artificial Sequence: Synthetic oligonucleotide
  Target: SCN9A; (-) strand; PAM type: NRG; PAM sequence: GAG
tttgggacacagatttgggg

SEQ ID NO: 23185 - DNA, 20 bp, Artificial Sequence
  Description of Artificial Sequence: Synthetic oligonucleotide
  Target: SCN9A; (-) strand; PAM type: NRG; PAM sequence: GGG
attttgggacacagatttgg

SEQ ID NO: 23186 - DNA, 20 bp, Artificial Sequence
  Description of Artificial Sequence: Synthetic oligonucleotide
  Target: SCN9A; (-) strand; PAM type: NRG; PAM sequence: GGG
aattttgggacacagatttg

SEQ ID NO: 23187 - DNA, 20 bp, Artificial Sequence
  Description of Artificial Sequence: Synthetic oligonucleotide
  Target: SCN9A; (-) strand; PAM type: NRG; PAM sequence: GGG
aaattttgggacacagattt

SEQ ID NO: 23188 - DNA, 20 bp, Artificial Sequence
  Description of Artificial Sequence: Synthetic oligonucleotide
  Target: SCN9A; (-) strand; PAM type: NRG; PAM sequence: TGG
caaattttgggacacagatt

SEQ ID NO: 23189 - DNA, 20 bp, Artificial Sequence
  Description of Artificial Sequence: Synthetic oligonucleotide
  Target: SCN9A; (-) strand; PAM type: NRG; PAM sequence: CAG
gagatgcaaattttgggaca

SEQ ID NO: 23190 - DNA, 20 bp, Artificial Sequence
  Description of Artificial Sequence: Synthetic oligonucleotide
  Target: SCN9A; (-) strand; PAM type: NRG; PAM sequence: GGG
ctgacagagatgcaaatttt

SEQ ID NO: 23191 - DNA, 20 bp, Artificial Sequence
  Description of Artificial Sequence: Synthetic oligonucleotide
  Target: SCN9A; (-) strand; PAM type: NRG; PAM sequence: TGG
gctgacagagatgcaaattt

SEQ ID NO: 23192 - DNA, 20 bp, Artificial Sequence
  Description of Artificial Sequence: Synthetic oligonucleotide
  Target: SCN9A; (-) strand; PAM type: NRG; PAM sequence: GAG
acacaatattcttgctgaca

SEQ ID NO: 23193 - DNA, 20 bp, Artificial Sequence
  Description of Artificial Sequence: Synthetic oligonucleotide
  Target: SCN9A; (-) strand; PAM type: NRG; PAM sequence: CAG
ccacacaatattcttgctga

SEQ ID NO: 23194 - DNA, 20 bp, Artificial Sequence
  Description of Artificial Sequence: Synthetic oligonucleotide
  Target: SCN9A; (-) strand; PAM type: NRG; PAM sequence: AAG
aatgcaaagcacagagagta

SEQ ID NO: 23195 - DNA, 20 bp, Artificial Sequence
  Description of Artificial Sequence: Synthetic oligonucleotide
  Target: SCN9A; (-) strand; PAM type: NRG; PAM sequence: GAG
aatataatgcaaagcacaga

SEQ ID NO: 23196 - DNA, 20 bp, Artificial Sequence
  Description of Artificial Sequence: Synthetic oligonucleotide
  Target: SCN9A; (-) strand; PAM type: NRG; PAM sequence: GAG
caaatataatgcaaagcaca

SEQ ID NO: 23197 - DNA, 20 bp, Artificial Sequence
  Description of Artificial Sequence: Synthetic oligonucleotide
  Target: SCN9A; (-) strand; PAM type: NRG; PAM sequence: CAG
aacaaatataatgcaaagca

SEQ ID NO: 23198 - DNA, 20 bp, Artificial Sequence
  Description of Artificial Sequence: Synthetic oligonucleotide
  Target: SCN9A; (-) strand; PAM type: NRG; PAM sequence: AAG
aaacgaacaaatataatgca

SEQ ID NO: 23199 - DNA, 20 bp, Artificial Sequence
  Description of Artificial Sequence: Synthetic oligonucleotide
  Target: SCN9A; (-) strand; PAM type: NRG; PAM sequence: TGG
tgaaatattatttaatattt

SEQ ID NO: 23200 - DNA, 20 bp, Artificial Sequence
  Description of Artificial Sequence: Synthetic oligonucleotide
  Target: SCN9A; (-) strand; PAM type: NRG; PAM sequence: GAG
tgtaatgtgcagaaatcagg

SEQ ID NO: 23201 - DNA, 20 bp, Artificial Sequence
  Description of Artificial Sequence: Synthetic oligonucleotide
  Target: SCN9A; (-) strand; PAM type: NRG; PAM sequence: GGG
tatgtaatgtgcagaaatca

SEQ ID NO: 23202 - DNA, 20 bp, Artificial Sequence
  Description of Artificial Sequence: Synthetic oligonucleotide
  Target: SCN9A; (-) strand; PAM type: NRG; PAM sequence: AGG
gtatgtaatgtgcagaaatc

SEQ ID NO: 23203 - DNA, 20 bp, Artificial Sequence
  Description of Artificial Sequence: Synthetic oligonucleotide
  Target: SCN9A; (-) strand; PAM type: NRG; PAM sequence: CAG
ggtatgtaatgtgcagaaat

SEQ ID NO: 23204 - DNA, 20 bp, Artificial Sequence
  Description of Artificial Sequence: Synthetic oligonucleotide
  Target: SCN9A; (-) strand; PAM type: NRG; PAM sequence: CAG
gttcaggggtatgtaatgtg

SEQ ID NO: 23205 - DNA, 20 bp, Artificial Sequence
  Description of Artificial Sequence: Synthetic oligonucleotide
  Target: SCN9A; (-) strand; PAM type: NRG; PAM sequence: GGG
gagtataacctcctgttcag

SEQ ID NO: 23206 - DNA, 20 bp, Artificial Sequence
  Description of Artificial Sequence: Synthetic oligonucleotide
  Target: SCN9A; (-) strand; PAM type: NRG; PAM sequence: GGG
tgagtataacctcctgttca

SEQ ID NO: 23207 - DNA, 20 bp, Artificial Sequence
  Description of Artificial Sequence: Synthetic oligonucleotide
  Target: SCN9A; (-) strand; PAM type: NRG; PAM sequence: AGG
gtgagtataacctcctgttc

SEQ ID NO: 23208 - DNA, 20 bp, Artificial Sequence
  Description of Artificial Sequence: Synthetic oligonucleotide
  Target: SCN9A; (-) strand; PAM type: NRG; PAM sequence: CAG
agtgagtataacctcctgtt

SEQ ID NO: 23209 - DNA, 20 bp, Artificial Sequence
  Description of Artificial Sequence: Synthetic oligonucleotide
  Target: SCN9A; (-) strand; PAM type: NRG; PAM sequence: GAG
ttaaagtgatgattctcagt

SEQ ID NO: 23210 - DNA, 20 bp, Artificial Sequence
  Description of Artificial Sequence: Synthetic oligonucleotide
  Target: SCN9A; (-) strand; PAM type: NRG; PAM sequence: CAG
aaatttaaagtgatgattct

SEQ ID NO: 23211 - DNA, 20 bp, Artificial Sequence
  Description of Artificial Sequence: Synthetic oligonucleotide
  Target: SCN9A; (-) strand; PAM type: NRG; PAM sequence: AAG
ttgttttatttgaaaattta

SEQ ID NO: 23212 - DNA, 20 bp, Artificial Sequence
  Description of Artificial Sequence: Synthetic oligonucleotide
  Target: SCN9A; (-) strand; PAM type: NRG; PAM sequence: TGG
gagatatggctgtttaataa

SEQ ID NO: 23213 - DNA, 20 bp, Artificial Sequence
  Description of Artificial Sequence: Synthetic oligonucleotide
  Target: SCN9A; (-) strand; PAM type: NRG; PAM sequence: TGG
ttattttaaattaagagata

SEQ ID NO: 23214 - DNA, 20 bp, Artificial Sequence
  Description of Artificial Sequence: Synthetic oligonucleotide
  Target: SCN9A; (-) strand; PAM type: NRG; PAM sequence: GAG
ttgaacttattttaaattaa

SEQ ID NO: 23215 - DNA, 20 bp, Artificial Sequence
  Description of Artificial Sequence: Synthetic oligonucleotide
  Target: SCN9A; (-) strand; PAM type: NRG; PAM sequence: AAG
aattgaacttattttaaatt

SEQ ID NO: 23216 - DNA, 20 bp, Artificial Sequence
  Description of Artificial Sequence: Synthetic oligonucleotide
  Target: SCN9A; (-) strand; PAM type: NRG; PAM sequence: AAG
tgtaagaaatgaaggtttac

SEQ ID NO: 23217 - DNA, 20 bp, Artificial Sequence
  Description of Artificial Sequence: Synthetic oligonucleotide
  Target: SCN9A; (-) strand; PAM type: NRG; PAM sequence: AGG
tcattcagtgtaagaaatga

SEQ ID NO: 23218 - DNA, 20 bp, Artificial Sequence
  Description of Artificial Sequence: Synthetic oligonucleotide
  Target: SCN9A; (-) strand; PAM type: NRG; PAM sequence: AAG
atcattcagtgtaagaaatg

SEQ ID NO: 23219 - DNA, 20 bp, Artificial Sequence
  Description of Artificial Sequence: Synthetic oligonucleotide
  Target: SCN9A; (-) strand; PAM type: NRG; PAM sequence: AAG
tcattttcatcattcagtgt

SEQ ID NO: 23220 - DNA, 20 bp, Artificial Sequence
  Description of Artificial Sequence: Synthetic oligonucleotide
  Target: SCN9A; (-) strand; PAM type: NRG; PAM sequence: CAG
atacactcattttcatcatt

SEQ ID NO: 23221 - DNA, 20 bp, Artificial Sequence
  Description of Artificial Sequence: Synthetic oligonucleotide
  Target: SCN9A; (-) strand; PAM type: NRG; PAM sequence: TAG
taaaaaattatacaatattt

SEQ ID NO: 23222 - DNA, 20 bp, Artificial Sequence
  Description of Artificial Sequence: Synthetic oligonucleotide
  Target: SCN9A; (-) strand; PAM type: NRG; PAM sequence: GGG
cttaaactgtaaatatgacg

SEQ ID NO: 23223 - DNA, 20 bp, Artificial Sequence
  Description of Artificial Sequence: Synthetic oligonucleotide
  Target: SCN9A; (-) strand; PAM type: NRG; PAM sequence: GGG
tcttaaactgtaaatatgac

SEQ ID NO: 23224 - DNA, 20 bp, Artificial Sequence
  Description of Artificial Sequence: Synthetic oligonucleotide
  Target: SCN9A; (-) strand; PAM type: NRG; PAM sequence: CGG
ctcttaaactgtaaatatga

SEQ ID NO: 23225 - DNA, 20 bp, Artificial Sequence
  Description of Artificial Sequence: Synthetic oligonucleotide
  Target: SCN9A; (-) strand; PAM type: NRG; PAM sequence: TAG
aagaaattatagaaggaatg

SEQ ID NO: 23226 - DNA, 20 bp, Artificial Sequence
  Description of Artificial Sequence: Synthetic oligonucleotide
  Target: SCN9A; (-) strand; PAM type: NRG; PAM sequence: AGG
aaataagaagaaattataga

SEQ ID NO: 23227 - DNA, 20 bp, Artificial Sequence
  Description of Artificial Sequence: Synthetic oligonucleotide
  Target: SCN9A; (-) strand; PAM type: NRG; PAM sequence: AAG
caaataagaagaaattatag

SEQ ID NO: 23228 - DNA, 20 bp, Artificial Sequence
  Description of Artificial Sequence: Synthetic oligonucleotide
  Target: SCN9A; (-) strand; PAM type: NRG; PAM sequence: TAG
ccccaaataagaagaaatta

SEQ ID NO: 23229 - DNA, 20 bp, Artificial Sequence
  Description of Artificial Sequence: Synthetic oligonucleotide
  Target: SCN9A; (-) strand; PAM type: NRG; PAM sequence: AAG
gaaaggctgccccaaataag

SEQ ID NO: 23230 - DNA, 20 bp, Artificial Sequence
  Description of Artificial Sequence: Synthetic oligonucleotide
  Target: SCN9A; (-) strand; PAM type: NRG; PAM sequence: AAG
gaagaaaggctgccccaaat

SEQ ID NO: 23231 - DNA, 20 bp, Artificial Sequence
  Description of Artificial Sequence: Synthetic oligonucleotide
  Target: SCN9A; (-) strand; PAM type: NRG; PAM sequence: AGG
aatatagtagttttgaagaa

SEQ ID NO: 23232 - DNA, 20 bp, Artificial Sequence
  Description of Artificial Sequence: Synthetic oligonucleotide
  Target: SCN9A; (-) strand; PAM type: NRG; PAM sequence: AAG
taatatagtagttttgaaga

SEQ ID NO: 23233 - DNA, 20 bp, Artificial Sequence
  Description of Artificial Sequence: Synthetic oligonucleotide
  Target: SCN9A; (-) strand; PAM type: NRG; PAM sequence: AAG
tttgtaatatagtagttttg

SEQ ID NO: 23234 - DNA, 20 bp, Artificial Sequence
  Description of Artificial Sequence: Synthetic oligonucleotide
  Target: SCN9A; (-) strand; PAM type: NRG; PAM sequence: TAG
tgggtatttttgtaatatag

SEQ ID NO: 23235 - DNA, 20 bp, Artificial Sequence
  Description of Artificial Sequence: Synthetic oligonucleotide
  Target: SCN9A; (-) strand; PAM type: NRG; PAM sequence: TAG
aaatgggtatttttgtaata

SEQ ID NO: 23236 - DNA, 20 bp, Artificial Sequence
  Description of Artificial Sequence: Synthetic oligonucleotide
  Target: SCN9A; (-) strand; PAM type: NRG; PAM sequence: GGG
aaaatgaaaaatgataaaat

SEQ ID NO: 23237 - DNA, 20 bp, Artificial Sequence
  Description of Artificial Sequence: Synthetic oligonucleotide
  Target: SCN9A; (-) strand; PAM type: NRG; PAM sequence: TGG
aaaaatgaaaaatgataaaa

SEQ ID NO: 23238 - DNA, 20 bp, Artificial Sequence
  Description of Artificial Sequence: Synthetic oligonucleotide
  Target: SCN9A; (-) strand; PAM type: NRG; PAM sequence: TAG
cattcatatatcaagttatc

SEQ ID NO: 23239 - DNA, 20 bp, Artificial Sequence
  Description of Artificial Sequence: Synthetic oligonucleotide
  Target: SCN9A; (-) strand; PAM type: NRG; PAM sequence: AAG
caattaatcattcatatatc

SEQ ID NO: 23240 - DNA, 20 bp, Artificial Sequence
  Description of Artificial Sequence: Synthetic oligonucleotide
  Target: SCN9A; (-) strand; PAM type: NRG; PAM sequence: TAG
gagaattctaacttcggata

SEQ ID NO: 23241 - DNA, 20 bp, Artificial Sequence
  Description of Artificial Sequence: Synthetic oligonucleotide
  Target: SCN9A; (-) strand; PAM type: NRG; PAM sequence: CGG
ctctatgagaattctaactt

SEQ ID NO: 23242 - DNA, 20 bp, Artificial Sequence
  Description of Artificial Sequence: Synthetic oligonucleotide
  Target: SCN9A; (-) strand; PAM type: NRG; PAM sequence: GAG
ttatcttaggtttcctctat

SEQ ID NO: 23243 - DNA, 20 bp, Artificial Sequence
  Description of Artificial Sequence: Synthetic oligonucleotide
  Target: SCN9A; (-) strand; PAM type: NRG; PAM sequence: AGG
caccttatatgtgttatctt

SEQ ID NO: 23244 - DNA, 20 bp, Artificial Sequence
  Description of Artificial Sequence: Synthetic oligonucleotide
  Target: SCN9A; (-) strand; PAM type: NRG; PAM sequence: TAG
acaccttatatgtgttatct

SEQ ID NO: 23245 - DNA, 20 bp, Artificial Sequence
  Description of Artificial Sequence: Synthetic oligonucleotide
  Target: SCN9A; (-) strand; PAM type: NRG; PAM sequence: TAG
atgtgaaaaaatttttaaca

SEQ ID NO: 23246 - DNA, 20 bp, Artificial Sequence
  Description of Artificial Sequence: Synthetic oligonucleotide
  Target: SCN9A; (-) strand; PAM type: NRG; PAM sequence: GAG
tccagcttgggcgacagggt

SEQ ID NO: 23247 - DNA, 20 bp, Artificial Sequence
  Description of Artificial Sequence: Synthetic oligonucleotide
  Target: SCN9A; (-) strand; PAM type: NRG; PAM sequence: GGG
gcactccagcttgggcgaca

SEQ ID NO: 23248 - DNA, 20 bp, Artificial Sequence
  Description of Artificial Sequence: Synthetic oligonucleotide
  Target: SCN9A; (-) strand; PAM type: NRG; PAM sequence: AGG
tgcactccagcttgggcgac

SEQ ID NO: 23249 - DNA, 20 bp, Artificial Sequence
  Description of Artificial Sequence: Synthetic oligonucleotide
  Target: SCN9A; (-) strand; PAM type: NRG; PAM sequence: CAG
ctgcactccagcttgggcga

SEQ ID NO: 23250 - DNA, 20 bp, Artificial Sequence
  Description of Artificial Sequence: Synthetic oligonucleotide
  Target: SCN9A; (-) strand; PAM type: NRG; PAM sequence: GGG
gtgccactgcactccagctt

SEQ ID NO: 23251 - DNA, 20 bp, Artificial Sequence
  Description of Artificial Sequence: Synthetic oligonucleotide
  Target: SCN9A; (-) strand; PAM type: NRG; PAM sequence: TGG
cgtgccactgcactccagct

SEQ ID NO: 23252 - DNA, 20 bp, Artificial Sequence
  Description of Artificial Sequence: Synthetic oligonucleotide
  Target: SCN9A; (-) strand; PAM type: NRG; PAM sequence: CAG
gagatcgtgccactgcactc

SEQ ID NO: 23253 - DNA, 20 bp, Artificial Sequence
  Description of Artificial Sequence: Synthetic oligonucleotide
  Target: SCN9A; (-) strand; PAM type: NRG; PAM sequence: GAG
ggcagaggtttcagtgagtc

SEQ ID NO: 23254 - DNA, 20 bp, Artificial Sequence
  Description of Artificial Sequence: Synthetic oligonucleotide
  Target: SCN9A; (-) strand; PAM type: NRG; PAM sequence: GAG
cggtaggcagaggtttcagt

SEQ ID NO: 23255 - DNA, 20 bp, Artificial Sequence
  Description of Artificial Sequence: Synthetic oligonucleotide
  Target: SCN9A; (-) strand; PAM type: NRG; PAM sequence: CAG
aacccggtaggcagaggttt

SEQ ID NO: 23256 - DNA, 20 bp, Artificial Sequence
  Description of Artificial Sequence: Synthetic oligonucleotide
  Target: SCN9A; (-) strand; PAM type: NRG; PAM sequence: AGG
cgcttgaacccggtaggcag

SEQ ID NO: 23257 - DNA, 20 bp, Artificial Sequence
  Description of Artificial Sequence: Synthetic oligonucleotide
  Target: SCN9A; (-) strand; PAM type: NRG; PAM sequence: GAG
tcgcttgaacccggtaggca

SEQ ID NO: 23258 - DNA, 20 bp, Artificial Sequence
  Description of Artificial Sequence: Synthetic oligonucleotide
  Target: SCN9A; (-) strand; PAM type: NRG; PAM sequence: CAG
aatcgcttgaacccggtagg

SEQ ID NO: 23259 - DNA, 20 bp, Artificial Sequence
  Description of Artificial Sequence: Synthetic oligonucleotide
  Target: SCN9A; (-) strand; PAM type: NRG; PAM sequence: AGG
aagaatcgcttgaacccggt

SEQ ID NO: 23260 - DNA, 20 bp, Artificial Sequence
  Description of Artificial Sequence: Synthetic oligonucleotide
  Target: SCN9A; (-) strand; PAM type: NRG; PAM sequence: TAG
gaagaatcgcttgaacccgg

SEQ ID NO: 23261 - DNA, 20 bp, Artificial Sequence
  Description of Artificial Sequence: Synthetic oligonucleotide
  Target: SCN9A; (-) strand; PAM type: NRG; PAM sequence: CGG
gcagaagaatcgcttgaacc

SEQ ID NO: 23262 - DNA, 20 bp, Artificial Sequence
  Description of Artificial Sequence: Synthetic oligonucleotide
  Target: SCN9A; (-) strand; PAM type: NRG; PAM sequence: AAG
tactcaggaggctgaggcag

SEQ ID NO: 23263 - DNA, 20 bp, Artificial Sequence
  Description of Artificial Sequence: Synthetic oligonucleotide
  Target: SCN9A; (-) strand; PAM type: NRG; PAM sequence: CAG
agctactcaggaggctgagg

SEQ ID NO: 23264 - DNA, 20 bp, Artificial Sequence
  Description of Artificial Sequence: Synthetic oligonucleotide
  Target: SCN9A; (-) strand; PAM type: NRG; PAM sequence: AGG
cccagctactcaggaggctg

SEQ ID NO: 23265 - DNA, 20 bp, Artificial Sequence
  Description of Artificial Sequence: Synthetic oligonucleotide
  Target: SCN9A; (-) strand; PAM type: NRG; PAM sequence: GAG
tcccagctactcaggaggct

SEQ ID NO: 23266 - DNA, 20 bp, Artificial Sequence
  Description of Artificial Sequence: Synthetic oligonucleotide
  Target: SCN9A; (-) strand; PAM type: NRG; PAM sequence: AGG
tgtaatcccagctactcagg

SEQ ID NO: 23267 - DNA, 20 bp, Artificial Sequence
  Description of Artificial Sequence: Synthetic oligonucleotide
  Target: SCN9A; (-) strand; PAM type: NRG; PAM sequence: GAG
ctgtaatcccagctactcag

SEQ ID NO: 23268 - DNA, 20 bp, Artificial Sequence
  Description of Artificial Sequence: Synthetic oligonucleotide
  Target: SCN9A; (-) strand; PAM type: NRG; PAM sequence: AGG
gcctgtaatcccagctactc

SEQ ID NO: 23269 - DNA, 20 bp, Artificial Sequence
  Description of Artificial Sequence: Synthetic oligonucleotide
  Target: SCN9A; (-) strand; PAM type: NRG; PAM sequence: CAG
tgcctgtaatcccagctact

SEQ ID NO: 23270 - DNA, 20 bp, Artificial Sequence
  Description of Artificial Sequence: Synthetic oligonucleotide
  Target: SCN9A; (-) strand; PAM type: NRG; PAM sequence: CAG
gtggcaggtgcctgtaatcc

SEQ ID NO: 23271 - DNA, 20 bp, Artificial Sequence
  Description of Artificial Sequence: Synthetic oligonucleotide
  Target: SCN9A; (-) strand; PAM type: NRG; PAM sequence: AGG
aattagccagacatggtggc

SEQ ID NO: 23272 - DNA, 20 bp, Artificial Sequence
  Description of Artificial Sequence: Synthetic oligonucleotide
  Target: SCN9A; (-) strand; PAM type: NRG; PAM sequence: CAG
aaattagccagacatggtgg

SEQ ID NO: 23273 - DNA, 20 bp, Artificial Sequence
  Description of Artificial Sequence: Synthetic oligonucleotide
  Target: SCN9A; (-) strand; PAM type: NRG; PAM sequence: TGG
aaaaaattagccagacatgg

SEQ ID NO: 23274 - DNA, 20 bp, Artificial Sequence
  Description of Artificial Sequence: Synthetic oligonucleotide
  Target: SCN9A; (-) strand; PAM type: NRG; PAM sequence: TGG
tacaaaaaattagccagaca

SEQ ID NO: 23275 - DNA, 20 bp, Artificial Sequence
  Description of Artificial Sequence: Synthetic oligonucleotide
  Target: SCN9A; (-) strand; PAM type: NRG; PAM sequence: CAG
aaaaaatacaaaaaattagc

SEQ ID NO: 23276 - DNA, 20 bp, Artificial Sequence
  Description of Artificial Sequence: Synthetic oligonucleotide
  Target: SCN9A; (-) strand; PAM type: NRG; PAM sequence: TAG
tactaaaaaatacaaaaaat

SEQ ID NO: 23277 - DNA, 20 bp, Artificial Sequence
  Description of Artificial Sequence: Synthetic oligonucleotide
  Target: SCN9A; (-) strand; PAM type: NRG; PAM sequence: TGG
tgagaccagcctggccaaca

SEQ ID NO: 23278 - DNA, 20 bp, Artificial Sequence
  Description of Artificial Sequence: Synthetic oligonucleotide
  Target: SCN9A; (-) strand; PAM type: NRG; PAM sequence: TGG
tcaggagtttgagaccagcc

SEQ ID NO: 23279 - DNA, 20 bp, Artificial Sequence
  Description of Artificial Sequence: Synthetic oligonucleotide
  Target: SCN9A; (-) strand; PAM type: NRG; PAM sequence: CAG
tgaggtcaggagtttgagac

SEQ ID NO: 23280 - DNA, 20 bp, Artificial Sequence
  Description of Artificial Sequence: Synthetic oligonucleotide
  Target: SCN9A; (-) strand; PAM type: NRG; PAM sequence: GAG
tcacctgaggtcaggagttt

SEQ ID NO: 23281 - DNA, 20 bp, Artificial Sequence
  Description of Artificial Sequence: Synthetic oligonucleotide
  Target: SCN9A; (-) strand; PAM type: NRG; PAM sequence: GAG
ggtggatcacctgaggtcag

SEQ ID NO: 23282 - DNA, 20 bp, Artificial Sequence
  Description of Artificial Sequence: Synthetic oligonucleotide
  Target: SCN9A; (-) strand; PAM type: NRG; PAM sequence: AGG
caggtggatcacctgaggtc

SEQ ID NO: 23283 - DNA, 20 bp, Artificial Sequence
  Description of Artificial Sequence: Synthetic oligonucleotide
  Target: SCN9A; (-) strand; PAM type: NRG; PAM sequence: CAG
gcaggtggatcacctgaggt

SEQ ID NO: 23284 - DNA, 20 bp, Artificial Sequence
  Description of Artificial Sequence: Synthetic oligonucleotide
  Target: SCN9A; (-) strand; PAM type: NRG; PAM sequence: AGG
cgaggcaggtggatcacctg

SEQ ID NO: 23285 - DNA, 20 bp, Artificial Sequence
  Description of Artificial Sequence: Synthetic oligonucleotide
  Target: SCN9A; (-) strand; PAM type: NRG; PAM sequence: GAG
ccgaggcaggtggatcacct

SEQ ID NO: 23286 - DNA, 20 bp, Artificial Sequence
  Description of Artificial Sequence: Synthetic oligonucleotide
  Target: SCN9A; (-) strand; PAM type: NRG; PAM sequence: TGG
ctttgagagtccgaggcagg

SEQ ID NO: 23287 - DNA, 20 bp, Artificial Sequence
  Description of Artificial Sequence: Synthetic oligonucleotide
  Target: SCN9A; (-) strand; PAM type: NRG; PAM sequence: AGG
gcactttgagagtccgaggc

SEQ ID NO: 23288 - DNA, 20 bp, Artificial Sequence
  Description of Artificial Sequence: Synthetic oligonucleotide
  Target: SCN9A; (-) strand; PAM type: NRG; PAM sequence: CAG
agcactttgagagtccgagg

SEQ ID NO: 23289 - DNA, 20 bp, Artificial Sequence
  Description of Artificial Sequence: Synthetic oligonucleotide
  Target: SCN9A; (-) strand; PAM type: NRG; PAM sequence: AGG
cccagcactttgagagtccg

SEQ ID NO: 23290 - DNA, 20 bp, Artificial Sequence
  Description of Artificial Sequence: Synthetic oligonucleotide
  Target: SCN9A; (-) strand; PAM type: NRG; PAM sequence: GAG
tcccagcactttgagagtcc

SEQ ID NO: 23291 - DNA, 20 bp, Artificial Sequence
  Description of Artificial Sequence: Synthetic oligonucleotide
  Target: SCN9A; (-) strand; PAM type: NRG; PAM sequence: GAG
ctgtaatcccagcactttga

SEQ ID NO: 23292 - DNA, 20 bp, Artificial Sequence
  Description of Artificial Sequence: Synthetic oligonucleotide
  Target: SCN9A; (-) strand; PAM type: NRG; PAM sequence: GAG
gcctgtaatcccagcacttt

SEQ ID NO: 23293 - DNA, 20 bp, Artificial Sequence
  Description of Artificial Sequence: Synthetic oligonucleotide
  Target: SCN9A; (-) strand; PAM type: NRG; PAM sequence: CAG
gtagctcacgcctgtaatcc

SEQ ID NO: 23294 - DNA, 20 bp, Artificial Sequence
  Description of Artificial Sequence: Synthetic oligonucleotide
  Target: SCN9A; (-) strand; PAM type: NRG; PAM sequence: TAG
tggcttctggccaggcgcgg

SEQ ID NO: 23295 - DNA, 20 bp, Artificial Sequence
  Description of Artificial Sequence: Synthetic oligonucleotide
  Target: SCN9A; (-) strand; PAM type: NRG; PAM sequence: CGG
ttttggcttctggccaggcg

SEQ ID NO: 23296 - DNA, 20 bp, Artificial Sequence
  Description of Artificial Sequence: Synthetic oligonucleotide
  Target: SCN9A; (-) strand; PAM type: NRG; PAM sequence: AGG
taaacttttggcttctggcc

SEQ ID NO: 23297 - DNA, 20 bp, Artificial Sequence
  Description of Artificial Sequence: Synthetic oligonucleotide
  Target: SCN9A; (-) strand; PAM type: NRG; PAM sequence: CAG
ataaacttttggcttctggc

SEQ ID NO: 23298 - DNA, 20 bp, Artificial Sequence
  Description of Artificial Sequence: Synthetic oligonucleotide
  Target: SCN9A; (-) strand; PAM type: NRG; PAM sequence: TGG
cttcataaacttttggcttc

SEQ ID NO: 23299 - DNA, 20 bp, Artificial Sequence
  Description of Artificial Sequence: Synthetic oligonucleotide
  Target: SCN9A; (-) strand; PAM type: NRG; PAM sequence: TGG
ttcaaagcttcataaacttt

SEQ ID NO: 23300 - DNA, 20 bp, Artificial Sequence
  Description of Artificial Sequence: Synthetic oligonucleotide
  Target: SCN9A; (-) strand; PAM type: NRG; PAM sequence: AAG
aatttctcaactgttattca

SEQ ID NO: 23301 - DNA, 20 bp, Artificial Sequence
  Description of Artificial Sequence: Synthetic oligonucleotide
  Target: SCN9A; (-) strand; PAM type: NRG; PAM sequence: AAG
aattagtcatatttactcaa

SEQ ID NO: 23302 - DNA, 20 bp, Artificial Sequence
  Description of Artificial Sequence: Synthetic oligonucleotide
  Target: SCN9A; (-) strand; PAM type: NRG; PAM sequence: TAG
actgcaaaatgttaccaaat

SEQ ID NO: 23303 - DNA, 20 bp, Artificial Sequence
  Description of Artificial Sequence: Synthetic oligonucleotide
  Target: SCN9A; (-) strand; PAM type: NRG; PAM sequence: TAG
caagtaagcatgatcataca

SEQ ID NO: 23304 - DNA, 20 bp, Artificial Sequence
  Description of Artificial Sequence: Synthetic oligonucleotide
  Target: SCN9A; (-) strand; PAM type: NRG; PAM sequence: AAG
tggattagaaaatcacaagt

SEQ ID NO: 23305 - DNA, 20 bp, Artificial Sequence
  Description of Artificial Sequence: Synthetic oligonucleotide
  Target: SCN9A; (-) strand; PAM type: NRG; PAM sequence: AAG
tatgtggattagaaaatcac

SEQ ID NO: 23306 - DNA, 20 bp, Artificial Sequence
  Description of Artificial Sequence: Synthetic oligonucleotide
  Target: SCN9A; (-) strand; PAM type: NRG; PAM sequence: TAG
atacagcatcatatgtggat

SEQ ID NO: 23307 - DNA, 20 bp, Artificial Sequence
  Description of Artificial Sequence: Synthetic oligonucleotide
  Target: SCN9A; (-) strand; PAM type: NRG; PAM sequence: TGG
aattcatacagcatcatatg

SEQ ID NO: 23308 - DNA, 20 bp, Artificial Sequence
  Description of Artificial Sequence: Synthetic oligonucleotide
  Target: SCN9A; (-) strand; PAM type: NRG; PAM sequence: CAG
taagaaaagttgaattcata

SEQ ID NO: 23309 - DNA, 20 bp, Artificial Sequence
  Description of Artificial Sequence: Synthetic oligonucleotide
  Target: SCN9A; (-) strand; PAM type: NRG; PAM sequence: AAG
cattatcgagcttttaagaa

SEQ ID NO: 23310 - DNA, 20 bp, Artificial Sequence
  Description of Artificial Sequence: Synthetic oligonucleotide
  Target: SCN9A; (-) strand; PAM type: NRG; PAM sequence: AAG
gtttgcattatcgagctttt

SEQ ID NO: 23311 - DNA, 20 bp, Artificial Sequence
  Description of Artificial Sequence: Synthetic oligonucleotide
  Target: SCN9A; (-) strand; PAM type: NRG; PAM sequence: GAG
aaccaagggtttgcattatc

SEQ ID NO: 23312 - DNA, 20 bp, Artificial Sequence
  Description of Artificial Sequence: Synthetic oligonucleotide
  Target: SCN9A; (-) strand; PAM type: NRG; PAM sequence: GGG
gtgctttaaaatttaaccaa

SEQ ID NO: 23313 - DNA, 20 bp, Artificial Sequence
  Description of Artificial Sequence: Synthetic oligonucleotide
  Target: SCN9A; (-) strand; PAM type: NRG; PAM sequence: AGG
agtgctttaaaatttaacca

SEQ ID NO: 23314 - DNA, 20 bp, Artificial Sequence
  Description of Artificial Sequence: Synthetic oligonucleotide
  Target: SCN9A; (-) strand; PAM type: NRG; PAM sequence: AAG
aagtgctttaaaatttaacc

SEQ ID NO: 23315 - DNA, 20 bp, Artificial Sequence
  Description of Artificial Sequence: Synthetic oligonucleotide
  Target: SCN9A; (-) strand; PAM type: NRG; PAM sequence: AAG
gcaaatttgtatatgccaat

SEQ ID NO: 23316 - DNA, 20 bp, Artificial Sequence
  Description of Artificial Sequence: Synthetic oligonucleotide
  Target: SCN9A; (-) strand; PAM type: NRG; PAM sequence: AGG
atgatgcctgacataattag

SEQ ID NO: 23317 - DNA, 20 bp, Artificial Sequence
  Description of Artificial Sequence: Synthetic oligonucleotide
  Target: SCN9A; (-) strand; PAM type: NRG; PAM sequence: GAG
tatgatgcctgacataatta

SEQ ID NO: 23318 - DNA, 20 bp, Artificial Sequence
  Description of Artificial Sequence: Synthetic oligonucleotide
  Target: SCN9A; (-) strand; PAM type: NRG; PAM sequence: TAG
catatgatgcctgacataat

SEQ ID NO: 23319 - DNA, 20 bp, Artificial Sequence
  Description of Artificial Sequence: Synthetic oligonucleotide
  Target: SCN9A; (-) strand; PAM type: NRG; PAM sequence: GAG
ataatcagtcatagttttta

SEQ ID NO: 23320 - DNA, 20 bp, Artificial Sequence
  Description of Artificial Sequence: Synthetic oligonucleotide
  Target: SCN9A; (-) strand; PAM type: NRG; PAM sequence: TAG
ctataatcagtcatagtttt

SEQ ID NO: 23321 - DNA, 20 bp, Artificial Sequence
  Description of Artificial Sequence: Synthetic oligonucleotide
  Target: SCN9A; (-) strand; PAM type: NRG; PAM sequence: TAG
aaacatcctataatcagtca

SEQ ID NO: 23322 - DNA, 20 bp, Artificial Sequence
  Description of Artificial Sequence: Synthetic oligonucleotide
  Target: SCN9A; (-) strand; PAM type: NRG; PAM sequence: CAG
gggaagaaacatcctataat

SEQ ID NO: 23323 - DNA, 20 bp, Artificial Sequence
  Description of Artificial Sequence: Synthetic oligonucleotide
  Target: SCN9A; (-) strand; PAM type: NRG; PAM sequence: AAG
cctaacctttgtgtttaggg

SEQ ID NO: 23324 - DNA, 20 bp, Artificial Sequence
  Description of Artificial Sequence: Synthetic oligonucleotide
  Target: SCN9A; (-) strand; PAM type: NRG; PAM sequence: GGG
aaacctaacctttgtgttta

SEQ ID NO: 23325 - DNA, 20 bp, Artificial Sequence
  Description of Artificial Sequence: Synthetic oligonucleotide
  Target: SCN9A; (-) strand; PAM type: NRG; PAM sequence: AGG
gaaacctaacctttgtgttt

SEQ ID NO: 23326 - DNA, 20 bp, Artificial Sequence
  Description of Artificial Sequence: Synthetic oligonucleotide
  Target: SCN9A; (-) strand; PAM type: NRG; PAM sequence: TAG
agaaacctaacctttgtgtt

SEQ ID NO: 23327 - DNA, 20 bp, Artificial Sequence
  Description of Artificial Sequence: Synthetic oligonucleotide
  Target: SCN9A; (-) strand; PAM type: NRG; PAM sequence: CAG
tactaattcttctagatttt

SEQ ID NO: 23328 - DNA, 20 bp, Artificial Sequence
  Description of Artificial Sequence: Synthetic oligonucleotide
  Target: SCN9A; (-) strand; PAM type: NRG; PAM sequence: TAG
ttatcttttactaattcttc

SEQ ID NO: 23329 - DNA, 20 bp, Artificial Sequence
  Description of Artificial Sequence: Synthetic oligonucleotide
  Target: SCN9A; (-) strand; PAM type: NRG; PAM sequence: CAG
tctcccagtcttatttttct

SEQ ID NO: 23330 - DNA, 20 bp, Artificial Sequence
  Description of Artificial Sequence: Synthetic oligonucleotide
  Target: SCN9A; (-) strand; PAM type: NRG; PAM sequence: CAG
attttataacctcaatctcc

SEQ ID NO: 23331 - DNA, 20 bp, Artificial Sequence
  Description of Artificial Sequence: Synthetic oligonucleotide
  Target: SCN9A; (-) strand; PAM type: NRG; PAM sequence: TGG
atattttgtattaattaaaa

SEQ ID NO: 23332 - DNA, 20 bp, Artificial Sequence
  Description of Artificial Sequence: Synthetic oligonucleotide
  Target: SCN9A; (-) strand; PAM type: NRG; PAM sequence: CGG
gactctcaaatagaaactaa

SEQ ID NO: 23333 - DNA, 20 bp, Artificial Sequence
  Description of Artificial Sequence: Synthetic oligonucleotide
  Target: SCN9A; (-) strand; PAM type: NRG; PAM sequence: TAG
tgagatcaaggactctcaaa

SEQ ID NO: 23334 - DNA, 20 bp, Artificial Sequence
  Description of Artificial Sequence: Synthetic oligonucleotide
  Target: SCN9A; (-) strand; PAM type: NRG; PAM sequence: AGG
taaaatagtcggtgagatca

SEQ ID NO: 23335 - DNA, 20 bp, Artificial Sequence
  Description of Artificial Sequence: Synthetic oligonucleotide
  Target: SCN9A; (-) strand; PAM type: NRG; PAM sequence: AAG
ttaaaatagtcggtgagatc

SEQ ID NO: 23336 - DNA, 20 bp, Artificial Sequence
  Description of Artificial Sequence: Synthetic oligonucleotide
  Target: SCN9A; (-) strand; PAM type: NRG; PAM sequence: GAG
gaaatcttaaaatagtcggt

SEQ ID NO: 23337 - DNA, 20 bp, Artificial Sequence
  Description of Artificial Sequence: Synthetic oligonucleotide
  Target: SCN9A; (-) strand; PAM type: NRG; PAM sequence: CGG
agaagaaatcttaaaatagt

SEQ ID NO: 23338 - DNA, 20 bp, Artificial Sequence
  Description of Artificial Sequence: Synthetic oligonucleotide
  Target: SCN9A; (-) strand; PAM type: NRG; PAM sequence: TAG
atagagaagaaatcttaaaa

SEQ ID NO: 23339 - DNA, 20 bp, Artificial Sequence
  Description of Artificial Sequence: Synthetic oligonucleotide
  Target: SCN9A; (-) strand; PAM type: NRG; PAM sequence: AAG
ggcttctgattgagatagag

SEQ ID NO: 23340 - DNA, 20 bp, Artificial Sequence
  Description of Artificial Sequence: Synthetic oligonucleotide
  Target: SCN9A; (-) strand; PAM type: NRG; PAM sequence: GAG
acaggcttctgattgagata

SEQ ID NO: 23341 - DNA, 20 bp, Artificial Sequence
  Description of Artificial Sequence: Synthetic oligonucleotide
  Target: SCN9A; (-) strand; PAM type: NRG; PAM sequence: TAG
ttacaggcttctgattgaga

SEQ ID NO: 23342 - DNA, 20 bp, Artificial Sequence
  Description of Artificial Sequence: Synthetic oligonucleotide
  Target: SCN9A; (-) strand; PAM type: NRG; PAM sequence: GAG
atttttacaggcttctgatt

SEQ ID NO: 23343 - DNA, 20 bp, Artificial Sequence
  Description of Artificial Sequence: Synthetic oligonucleotide
  Target: SCN9A; (-) strand; PAM type: NRG; PAM sequence: AGG
cgaagtagaaatatttttac

SEQ ID NO: 23344 - DNA, 20 bp, Artificial Sequence
  Description of Artificial Sequence: Synthetic oligonucleotide
  Target: SCN9A; (-) strand; PAM type: NRG; PAM sequence: CAG
acgaagtagaaatattttta

SEQ ID NO: 23345 - DNA, 20 bp, Artificial Sequence
  Description of Artificial Sequence: Synthetic oligonucleotide
  Target: SCN9A; (-) strand; PAM type: NRG; PAM sequence: TAG
tacatattattttaacgaag

SEQ ID NO: 23346 - DNA, 20 bp, Artificial Sequence
  Description of Artificial Sequence: Synthetic oligonucleotide
  Target: SCN9A; (-) strand; PAM type: NRG; PAM sequence: AAG
gtttacatattattttaacg

SEQ ID NO: 23347 - DNA, 20 bp, Artificial Sequence
  Description of Artificial Sequence: Synthetic oligonucleotide
  Target: SCN9A; (-) strand; PAM type: NRG; PAM sequence: TAG
gaaaatacataataattctt

SEQ ID NO: 23348 - DNA, 20 bp, Artificial Sequence
  Description of Artificial Sequence: Synthetic oligonucleotide
  Target: SCN9A; (-) strand; PAM type: NRG; PAM sequence: TGG
actgttgaatacttggatga

SEQ ID NO: 23349 - DNA, 20 bp, Artificial Sequence
  Description of Artificial Sequence: Synthetic oligonucleotide
  Target: SCN9A; (-) strand; PAM type: NRG; PAM sequence: TGG
tcaaagaactgttgaatact

SEQ ID NO: 23350 - DNA, 20 bp, Artificial Sequence
  Description of Artificial Sequence: Synthetic oligonucleotide
  Target: SCN9A; (-) strand; PAM type: NRG; PAM sequence: AAG
aattttagataataaattca

SEQ ID NO: 23351 - DNA, 20 bp, Artificial Sequence
  Description of Artificial Sequence: Synthetic oligonucleotide
  Target: SCN9A; (-) strand; PAM type: NRG; PAM sequence: TAG
tattattaatgtaataattt

SEQ ID NO: 23352 - DNA, 20 bp, Artificial Sequence
  Description of Artificial Sequence: Synthetic oligonucleotide
  Target: SCN9A; (-) strand; PAM type: NRG; PAM sequence: AGG
tggcagtggggcagaggagt

SEQ ID NO: 23353 - DNA, 20 bp, Artificial Sequence
  Description of Artificial Sequence: Synthetic oligonucleotide
  Target: SCN9A; (-) strand; PAM type: NRG; PAM sequence: TAG
atggcagtggggcagaggag

SEQ ID NO: 23354 - DNA, 20 bp, Artificial Sequence
  Description of Artificial Sequence: Synthetic oligonucleotide
  Target: SCN9A; (-) strand; PAM type: NRG; PAM sequence: GAG
agaatggcagtggggcagag

SEQ ID NO: 23355 - DNA, 20 bp, Artificial Sequence
  Description of Artificial Sequence: Synthetic oligonucleotide
  Target: SCN9A; (-) strand; PAM type: NRG; PAM sequence: AGG
ccagaatggcagtggggcag

SEQ ID NO: 23356 - DNA, 20 bp, Artificial Sequence
  Description of Artificial Sequence: Synthetic oligonucleotide
  Target: SCN9A; (-) strand; PAM type: NRG; PAM sequence: GAG
tccagaatggcagtggggca

SEQ ID NO: 23357 - DNA, 20 bp, Artificial Sequence
  Description of Artificial Sequence: Synthetic oligonucleotide
  Target: SCN9A; (-) strand; PAM type: NRG; PAM sequence: CAG
tctccagaatggcagtgggg

SEQ ID NO: 23358 - DNA, 20 bp, Artificial Sequence
  Description of Artificial Sequence: Synthetic oligonucleotide
  Target: SCN9A; (-) strand; PAM type: NRG; PAM sequence: GGG
tcatctccagaatggcagtg

SEQ ID NO: 23359 - DNA, 20 bp, Artificial Sequence
  Description of Artificial Sequence: Synthetic oligonucleotide
  Target: SCN9A; (-) strand; PAM type: NRG; PAM sequence: GGG
ttcatctccagaatggcagt

SEQ ID NO: 23360 - DNA, 20 bp, Artificial Sequence
  Description of Artificial Sequence: Synthetic oligonucleotide
  Target: SCN9A; (-) strand; PAM type: NRG; PAM sequence: TGG
cttcatctccagaatggcag

SEQ ID NO: 23361 - DNA, 20 bp, Artificial Sequence
  Description of Artificial Sequence: Synthetic oligonucleotide
  Target: SCN9A; (-) strand; PAM type: NRG; PAM sequence: CAG
gcccttcatctccagaatgg

SEQ ID NO: 23362 - DNA, 20 bp, Artificial Sequence
  Description of Artificial Sequence: Synthetic oligonucleotide
  Target: SCN9A; (-) strand; PAM type: NRG; PAM sequence: TGG
cttgcccttcatctccagaa

SEQ ID NO: 23363 - DNA, 20 bp, Artificial Sequence
  Description of Artificial Sequence: Synthetic oligonucleotide
  Target: SCN9A; (-) strand; PAM type: NRG; PAM sequence: CAG
tgcgacttgcccttcatctc

SEQ ID NO: 23364 - DNA, 20 bp, Artificial Sequence
  Description of Artificial Sequence: Synthetic oligonucleotide
  Target: SCN9A; (-) strand; PAM type: NRG; PAM sequence: GAG
attataggaaaaaccaaaat

SEQ ID NO: 23365 - DNA, 20 bp, Artificial Sequence
  Description of Artificial Sequence: Synthetic oligonucleotide
  Target: SCN9A; (-) strand; PAM type: NRG; PAM sequence: AGG
tctatctcagacccaattat

SEQ ID NO: 23366 - DNA, 20 bp, Artificial Sequence
  Description of Artificial Sequence: Synthetic oligonucleotide
  Target: SCN9A; (-) strand; PAM type: NRG; PAM sequence: TAG
atctatctcagacccaatta

SEQ ID NO: 23367 - DNA, 20 bp, Artificial Sequence
  Description of Artificial Sequence: Synthetic oligonucleotide
  Target: SCN9A; (-) strand; PAM type: NRG; PAM sequence: CAG
aaattttaaaatatctatct

SEQ ID NO: 23368 - DNA, 20 bp, Artificial Sequence
  Description of Artificial Sequence: Synthetic oligonucleotide
  Target: SCN9A; (-) strand; PAM type: NRG; PAM sequence: AAG
ctttgtatttggggagagag

SEQ ID NO: 23369 - DNA, 20 bp, Artificial Sequence
  Description of Artificial Sequence: Synthetic oligonucleotide
  Target: SCN9A; (-) strand; PAM type: NRG; PAM sequence: GAG
taactttgtatttggggaga

SEQ ID NO: 23370 - DNA, 20 bp, Artificial Sequence
  Description of Artificial Sequence: Synthetic oligonucleotide
  Target: SCN9A; (-) strand; PAM type: NRG; PAM sequence: GAG
gttaactttgtatttgggga

SEQ ID NO: 23371 - DNA, 20 bp, Artificial Sequence
  Description of Artificial Sequence: Synthetic oligonucleotide
  Target: SCN9A; (-) strand; PAM type: NRG; PAM sequence: GAG
aagttaactttgtatttggg

SEQ ID NO: 23372 - DNA, 20 bp, Artificial Sequence
  Description of Artificial Sequence: Synthetic oligonucleotide
  Target: SCN9A; (-) strand; PAM type: NRG; PAM sequence: GGG
caaagttaactttgtatttg

SEQ ID NO: 23373 - DNA, 20 bp, Artificial Sequence
  Description of Artificial Sequence: Synthetic oligonucleotide
  Target: SCN9A; (-) strand; PAM type: NRG; PAM sequence: GGG
acaaagttaactttgtattt

SEQ ID NO: 23374 - DNA, 20 bp, Artificial Sequence
  Description of Artificial Sequence: Synthetic oligonucleotide
  Target: SCN9A; (-) strand; PAM type: NRG; PAM sequence: TGG
tacaaagttaactttgtatt

SEQ ID NO: 23375 - DNA, 20 bp, Artificial Sequence
  Description of Artificial Sequence: Synthetic oligonucleotide
  Target: SCN9A; (-) strand; PAM type: NRG; PAM sequence: AAG
aaaatcattatacaaataca

SEQ ID NO: 23376 - DNA, 20 bp, Artificial Sequence
  Description of Artificial Sequence: Synthetic oligonucleotide
  Target: SCN9A; (-) strand; PAM type: NRG; PAM sequence: GAG
catcaagttggctgatatgt

SEQ ID NO: 23377 - DNA, 20 bp, Artificial Sequence
  Description of Artificial Sequence: Synthetic oligonucleotide
  Target: SCN9A; (-) strand; PAM type: NRG; PAM sequence: TGG
ggatgaggggcacatcaagt

SEQ ID NO: 23378 - DNA, 20 bp, Artificial Sequence
  Description of Artificial Sequence: Synthetic oligonucleotide
  Target: SCN9A; (-) strand; PAM type: NRG; PAM sequence: AAG
gagaggatgaggggcacatc

SEQ ID NO: 23379 - DNA, 20 bp, Artificial Sequence
  Description of Artificial Sequence: Synthetic oligonucleotide
  Target: SCN9A; (-) strand; PAM type: NRG; PAM sequence: GGG
ggaagataagagaggatgag

SEQ ID NO: 23380 - DNA, 20 bp, Artificial Sequence
  Description of Artificial Sequence: Synthetic oligonucleotide
  Target: SCN9A; (-) strand; PAM type: NRG; PAM sequence: GGG
tggaagataagagaggatga

SEQ ID NO: 23381 - DNA, 20 bp, Artificial Sequence
  Description of Artificial Sequence: Synthetic oligonucleotide
  Target: SCN9A; (-) strand; PAM type: NRG; PAM sequence: AGG
ttggaagataagagaggatg

SEQ ID NO: 23382 - DNA, 20 bp, Artificial Sequence
  Description of Artificial Sequence: Synthetic oligonucleotide
  Target: SCN9A; (-) strand; PAM type: NRG; PAM sequence: GAG
attggaagataagagaggat

SEQ ID NO: 23383 - DNA, 20 bp, Artificial Sequence
  Description of Artificial Sequence: Synthetic oligonucleotide
  Target: SCN9A; (-) strand; PAM type: NRG; PAM sequence: AGG
gtaaaattggaagataagag

SEQ ID NO: 23384 - DNA, 20 bp, Artificial Sequence
  Description of Artificial Sequence: Synthetic oligonucleotide
  Target: SCN9A; (-) strand; PAM type: NRG; PAM sequence: GAG
tgtaaaattggaagataaga

SEQ ID NO: 23385 - DNA, 20 bp, Artificial Sequence
  Description of Artificial Sequence: Synthetic oligonucleotide
  Target: SCN9A; (-) strand; PAM type: NRG; PAM sequence: GAG
aatgtaaaattggaagataa

SEQ ID NO: 23386 - DNA, 20 bp, Artificial Sequence
  Description of Artificial Sequence: Synthetic oligonucleotide
  Target: SCN9A; (-) strand; PAM type: NRG; PAM sequence: AAG
ataatgtaaaattggaagat

SEQ ID NO: 23387 - DNA, 20 bp, Artificial Sequence
  Description of Artificial Sequence: Synthetic oligonucleotide
  Target: SCN9A; (-) strand; PAM type: NRG; PAM sequence: AAG
tattcataatgtaaaattgg

SEQ ID NO: 23388 - DNA, 20 bp, Artificial Sequence
  Description of Artificial Sequence: Synthetic oligonucleotide
  Target: SCN9A; (-) strand; PAM type: NRG; PAM sequence: TGG
gattattcataatgtaaaat

SEQ ID NO: 23389 - DNA, 20 bp, Artificial Sequence
  Description of Artificial Sequence: Synthetic oligonucleotide
  Target: SCN9A; (-) strand; PAM type: NRG; PAM sequence: AGG
cagagacacagattaaagag

SEQ ID NO: 23390 - DNA, 20 bp, Artificial Sequence
  Description of Artificial Sequence: Synthetic oligonucleotide
  Target: SCN9A; (-) strand; PAM type: NRG; PAM sequence: GAG
gcagagacacagattaaaga

SEQ ID NO: 23391 - DNA, 20 bp, Artificial Sequence
  Description of Artificial Sequence: Synthetic oligonucleotide
  Target: SCN9A; (-) strand; PAM type: NRG; PAM sequence: GAG
gggcagagacacagattaaa

SEQ ID NO: 23392 - DNA, 20 bp, Artificial Sequence
  Description of Artificial Sequence: Synthetic oligonucleotide
  Target: SCN9A; (-) strand; PAM type: NRG; PAM sequence: AAG
aagggcagagacacagatta

SEQ ID NO: 23393 - DNA, 20 bp, Artificial Sequence
  Description of Artificial Sequence: Synthetic oligonucleotide
  Target: SCN9A; (-) strand; PAM type: NRG; PAM sequence: CAG
atgataaaagggcagagaca

SEQ ID NO: 23394 - DNA, 20 bp, Artificial Sequence
  Description of Artificial Sequence: Synthetic oligonucleotide
  Target: SCN9A; (-) strand; PAM type: NRG; PAM sequence: GAG
taggagatgataaaagggca

SEQ ID NO: 23395 - DNA, 20 bp, Artificial Sequence
  Description of Artificial Sequence: Synthetic oligonucleotide
  Target: SCN9A; (-) strand; PAM type: NRG; PAM sequence: CAG
agtaggagatgataaaaggg

SEQ ID NO: 23396 - DNA, 20 bp, Artificial Sequence
  Description of Artificial Sequence: Synthetic oligonucleotide
  Target: SCN9A; (-) strand; PAM type: NRG; PAM sequence: GGG
agaagtaggagatgataaaa

SEQ ID NO: 23397 - DNA, 20 bp, Artificial Sequence
  Description of Artificial Sequence: Synthetic oligonucleotide
  Target: SCN9A; (-) strand; PAM type: NRG; PAM sequence: AGG
tagaagtaggagatgataaa

SEQ ID NO: 23398 - DNA, 20 bp, Artificial Sequence
  Description of Artificial Sequence: Synthetic oligonucleotide
  Target: SCN9A; (-) strand; PAM type: NRG; PAM sequence: AAG
ttagaagtaggagatgataa

SEQ ID NO: 23399 - DNA, 20 bp, Artificial Sequence
  Description of Artificial Sequence: Synthetic oligonucleotide
  Target: SCN9A; (-) strand; PAM type: NRG; PAM sequence: GAG
aaaacaaaatttagaagtag

SEQ ID NO: 23400 - DNA, 20 bp, Artificial Sequence
  Description of Artificial Sequence: Synthetic oligonucleotide
  Target: SCN9A; (-) strand; PAM type: NRG; PAM sequence: AGG
ataaaacaaaatttagaagt

SEQ ID NO: 23401 - DNA, 20 bp, Artificial Sequence
  Description of Artificial Sequence: Synthetic oligonucleotide
  Target: SCN9A; (-) strand; PAM type: NRG; PAM sequence: TAG
aataaaacaaaatttagaag

SEQ ID NO: 23402 - DNA, 20 bp, Artificial Sequence
  Description of Artificial Sequence: Synthetic oligonucleotide
  Target: SCN9A; (-) strand; PAM type: NRG; PAM sequence: AAG
aagaataaaacaaaatttag

SEQ ID NO: 23403 - DNA, 20 bp, Artificial Sequence
  Description of Artificial Sequence: Synthetic oligonucleotide
  Target: SCN9A; (-) strand; PAM type: NRG; PAM sequence: TAG
gttaagaataaaacaaaatt

SEQ ID NO: 23404 - DNA, 20 bp, Artificial Sequence
  Description of Artificial Sequence: Synthetic oligonucleotide
  Target: SCN9A; (-) strand; PAM type: NRG; PAM sequence: AAG
atttgaatgtcattcttgtt

SEQ ID NO: 23405 - DNA, 20 bp, Artificial Sequence
  Description of Artificial Sequence: Synthetic oligonucleotide
  Target: SCN9A; (-) strand; PAM type: NRG; PAM sequence: GAG
tttttatgttttctgcaaag

SEQ ID NO: 23406 - DNA, 20 bp, Artificial Sequence
  Description of Artificial Sequence: Synthetic oligonucleotide
  Target: SCN9A; (-) strand; PAM type: NRG; PAM sequence: AGG
gttttttatgttttctgcaa

SEQ ID NO: 23407 - DNA, 20 bp, Artificial Sequence
  Description of Artificial Sequence: Synthetic oligonucleotide
  Target: SCN9A; (-) strand; PAM type: NRG; PAM sequence: AAG
agttttttatgttttctgca

SEQ ID NO: 23408 - DNA, 20 bp, Artificial Sequence
  Description of Artificial Sequence: Synthetic oligonucleotide
  Target: SCN9A; (-) strand; PAM type: NRG; PAM sequence: GAG
acattgtaacatttataatt

SEQ ID NO: 23409 - DNA, 20 bp, Artificial Sequence
  Description of Artificial Sequence: Synthetic oligonucleotide
  Target: SCN9A; (-) strand; PAM type: NRG; PAM sequence: CAG
atctgtgaggaatattagaa

SEQ ID NO: 23410 - DNA, 20 bp, Artificial Sequence
  Description of Artificial Sequence: Synthetic oligonucleotide
  Target: SCN9A; (-) strand; PAM type: NRG; PAM sequence: TAG
aatatatctgtgaggaatat

SEQ ID NO: 23411 - DNA, 20 bp, Artificial Sequence
  Description of Artificial Sequence: Synthetic oligonucleotide
  Target: SCN9A; (-) strand; PAM type: NRG; PAM sequence: AGG
ccagtggaaatatatctgtg

SEQ ID NO: 23412 - DNA, 20 bp, Artificial Sequence
  Description of Artificial Sequence: Synthetic oligonucleotide
  Target: SCN9A; (-) strand; PAM type: NRG; PAM sequence: GAG
gccagtggaaatatatctgt

SEQ ID NO: 23413 - DNA, 20 bp, Artificial Sequence
  Description of Artificial Sequence: Synthetic oligonucleotide
  Target: SCN9A; (-) strand; PAM type: NRG; PAM sequence: TGG
agaaatattaacacagccag

SEQ ID NO: 23414 - DNA, 20 bp, Artificial Sequence
  Description of Artificial Sequence: Synthetic oligonucleotide
  Target: SCN9A; (-) strand; PAM type: NRG; PAM sequence: CAG
tttagaaatattaacacagc

SEQ ID NO: 23415 - DNA, 20 bp, Artificial Sequence
  Description of Artificial Sequence: Synthetic oligonucleotide
  Target: SCN9A; (-) strand; PAM type: NRG; PAM sequence: CAG
ttcttttagaaatattaaca

SEQ ID NO: 23416 - DNA, 20 bp, Artificial Sequence
  Description of Artificial Sequence: Synthetic oligonucleotide
  Target: SCN9A; (-) strand; PAM type: NRG; PAM sequence: TAG
aggctataggtttattcttt

SEQ ID NO: 23417 - DNA, 20 bp, Artificial Sequence
  Description of Artificial Sequence: Synthetic oligonucleotide
  Target: SCN9A; (-) strand; PAM type: NRG; PAM sequence: AGG
ttcatatattttcaggctat

SEQ ID NO: 23418 - DNA, 20 bp, Artificial Sequence
  Description of Artificial Sequence: Synthetic oligonucleotide
  Target: SCN9A; (-) strand; PAM type: NRG; PAM sequence: TAG
cttcatatattttcaggcta

SEQ ID NO: 23419 - DNA, 20 bp, Artificial Sequence
  Description of Artificial Sequence: Synthetic oligonucleotide
  Target: SCN9A; (-) strand; PAM type: NRG; PAM sequence: AGG
gttaagcttcatatattttc

SEQ ID NO: 23420 - DNA, 20 bp, Artificial Sequence
  Description of Artificial Sequence: Synthetic oligonucleotide
  Target: SCN9A; (-) strand; PAM type: NRG; PAM sequence: CAG
tgttaagcttcatatatttt

SEQ ID NO: 23421 - DNA, 20 bp, Artificial Sequence
  Description of Artificial Sequence: Synthetic oligonucleotide
  Target: SCN9A; (-) strand; PAM type: NRG; PAM sequence: AAG
tatcatattttaattttgtt

SEQ ID NO: 23422 - DNA, 20 bp, Artificial Sequence
  Description of Artificial Sequence: Synthetic oligonucleotide
  Target: SCN9A; (-) strand; PAM type: NRG; PAM sequence: AGG
ttttgagtacattttaaaag

SEQ ID NO: 23423 - DNA, 20 bp, Artificial Sequence
  Description of Artificial Sequence: Synthetic oligonucleotide
  Target: SCN9A; (-) strand; PAM type: NRG; PAM sequence: GAG
cttttgagtacattttaaaa

SEQ ID NO: 23424 - DNA, 20 bp, Artificial Sequence
  Description of Artificial Sequence: Synthetic oligonucleotide
  Target: SCN9A; (-) strand; PAM type: NRG; PAM sequence: AAG
tacttttgagtacattttaa

SEQ ID NO: 23425 - DNA, 20 bp, Artificial Sequence
  Description of Artificial Sequence: Synthetic oligonucleotide
  Target: SCN9A; (-) strand; PAM type: NRG; PAM sequence: GAG
ttgttgatgtaggtactttt

SEQ ID NO: 23426 - DNA, 20 bp, Artificial Sequence
  Description of Artificial Sequence: Synthetic oligonucleotide
  Target: SCN9A; (-) strand; PAM type: NRG; PAM sequence: AGG
gatttcctaattgttgatgt

SEQ ID NO: 23427 - DNA, 20 bp, Artificial Sequence
  Description of Artificial Sequence: Synthetic oligonucleotide
  Target: SCN9A; (-) strand; PAM type: NRG; PAM sequence: TAG
ggatttcctaattgttgatg

SEQ ID NO: 23428 - DNA, 20 bp, Artificial Sequence
  Description of Artificial Sequence: Synthetic oligonucleotide
  Target: SCN9A; (-) strand; PAM type: NRG; PAM sequence: TGG
caccaatgcctggtgttggc

SEQ ID NO: 23429 - DNA, 20 bp, Artificial Sequence
  Description of Artificial Sequence: Synthetic oligonucleotide
  Target: SCN9A; (-) strand; PAM type: NRG; PAM sequence: TGG
atttcaccaatgcctggtgt

SEQ ID NO: 23430 - DNA, 20 bp, Artificial Sequence
  Description of Artificial Sequence: Synthetic oligonucleotide
  Target: SCN9A; (-) strand; PAM type: NRG; PAM sequence: TGG
aaacatatttcaccaatgcc

SEQ ID NO: 23431 - DNA, 20 bp, Artificial Sequence
  Description of Artificial Sequence: Synthetic oligonucleotide
  Target: SCN9A; (-) strand; PAM type: NRG; PAM sequence: TGG
cttctaaaatggatagcata

SEQ ID NO: 23432 - DNA, 20 bp, Artificial Sequence
  Description of Artificial Sequence: Synthetic oligonucleotide
  Target: SCN9A; (-) strand; PAM type: NRG; PAM sequence: TAG
ggaaatgcttctaaaatgga

SEQ ID NO: 23433 - DNA, 20 bp, Artificial Sequence
  Description of Artificial Sequence: Synthetic oligonucleotide
  Target: SCN9A; (-) strand; PAM type: NRG; PAM sequence: TGG
ttctggaaatgcttctaaaa

SEQ ID NO: 23434 - DNA, 20 bp, Artificial Sequence
  Description of Artificial Sequence: Synthetic oligonucleotide
  Target: SCN9A; (-) strand; PAM type: NRG; PAM sequence: TGG
cttcacttacatcttcattc

SEQ ID NO: 23435 - DNA, 20 bp, Artificial Sequence
  Description of Artificial Sequence: Synthetic oligonucleotide
  Target: SCN9A; (-) strand; PAM type: NRG; PAM sequence: AAG
ttatcctggagtatgcagac

SEQ ID NO: 23436 - DNA, 20 bp, Artificial Sequence
  Description of Artificial Sequence: Synthetic oligonucleotide
  Target: SCN9A; (-) strand; PAM type: NRG; PAM sequence: CAG
taagattatcctggagtatg

SEQ ID NO: 23437 - DNA, 20 bp, Artificial Sequence
  Description of Artificial Sequence: Synthetic oligonucleotide
  Target: SCN9A; (-) strand; PAM type: NRG; PAM sequence: GAG
agaccattaagattatcctg

SEQ ID NO: 23438 - DNA, 20 bp, Artificial Sequence
  Description of Artificial Sequence: Synthetic oligonucleotide
  Target: SCN9A; (-) strand; PAM type: NRG; PAM sequence: TGG
aaagaccattaagattatcc

SEQ ID NO: 23439 - DNA, 20 bp, Artificial Sequence
  Description of Artificial Sequence: Synthetic oligonucleotide
  Target: SCN9A; (-) strand; PAM type: NRG; PAM sequence: AAG
ttgaaaggaaaaagaccatt

SEQ ID NO: 23440 - DNA, 20 bp, Artificial Sequence
  Description of Artificial Sequence: Synthetic oligonucleotide
  Target: SCN9A; (-) strand; PAM type: NRG; PAM sequence: AAG
atatttatattgaaaggaaa

SEQ ID NO: 23441 - DNA, 20 bp, Artificial Sequence
  Description of Artificial Sequence: Synthetic oligonucleotide
  Target: SCN9A; (-) strand; PAM type: NRG; PAM sequence: AGG
ttgaagatatttatattgaa

SEQ ID NO: 23442 - DNA, 20 bp, Artificial Sequence
  Description of Artificial Sequence: Synthetic oligonucleotide
  Target: SCN9A; (-) strand; PAM type: NRG; PAM sequence: AAG
tttgaagatatttatattga

SEQ ID NO: 23443 - DNA, 20 bp, Artificial Sequence
  Description of Artificial Sequence: Synthetic oligonucleotide
  Target: SCN9A; (-) strand; PAM type: NRG; PAM sequence: AAG
attatttccacaggcttttg

SEQ ID NO: 23444 - DNA, 20 bp, Artificial Sequence
  Description of Artificial Sequence: Synthetic oligonucleotide
  Target: SCN9A; (-) strand; PAM type: NRG; PAM sequence: AGG
aacttgaatattatttccac

SEQ ID NO: 23445 - DNA, 20 bp, Artificial Sequence
  Description of Artificial Sequence: Synthetic oligonucleotide
  Target: SCN9A; (-) strand; PAM type: NRG; PAM sequence: CAG
aaacttgaatattatttcca

SEQ ID NO: 23446 - DNA, 20 bp, Artificial Sequence
  Description of Artificial Sequence: Synthetic oligonucleotide
  Target: SCN9A; (-) strand; PAM type: NRG; PAM sequence: AAG
ttaaatgaatcatgaagctt

SEQ ID NO: 23447 - DNA, 20 bp, Artificial Sequence
  Description of Artificial Sequence: Synthetic oligonucleotide
  Target: SCN9A; (-) strand; PAM type: NRG; PAM sequence: AAG
ttttttttaaatgaatcatg

SEQ ID NO: 23448 - DNA, 20 bp, Artificial Sequence
  Description of Artificial Sequence: Synthetic oligonucleotide
  Target: SCN9A; (-) strand; PAM type: NRG; PAM sequence: TAG
tgtttcagcagtcttagcat

SEQ ID NO: 23449 - DNA, 20 bp, Artificial Sequence
  Description of Artificial Sequence: Synthetic oligonucleotide
  Target: SCN9A; (-) strand; PAM type: NRG; PAM sequence: TAG
atattatgtttcagcagtct

SEQ ID NO: 23450 - DNA, 20 bp, Artificial Sequence
  Description of Artificial Sequence: Synthetic oligonucleotide
  Target: SCN9A; (-) strand; PAM type: NRG; PAM sequence: CAG
atgtcaatattatgtttcag

SEQ ID NO: 23451 - DNA, 20 bp, Artificial Sequence
  Description of Artificial Sequence: Synthetic oligonucleotide
  Target: SCN9A; (-) strand; PAM type: NRG; PAM sequence: CAG
cccatgtcaatattatgttt

SEQ ID NO: 23452 - DNA, 20 bp, Artificial Sequence
  Description of Artificial Sequence: Synthetic oligonucleotide
  Target: SCN9A; (-) strand; PAM type: NRG; PAM sequence: TGG
aaaccagaaaaaatgtcagc

SEQ ID NO: 23453 - DNA, 20 bp, Artificial Sequence
  Description of Artificial Sequence: Synthetic oligonucleotide
  Target: SCN9A; (-) strand; PAM type: NRG; PAM sequence: CAG
ctgtaaaccagaaaaaatgt

SEQ ID NO: 23454 - DNA, 20 bp, Artificial Sequence
  Description of Artificial Sequence: Synthetic oligonucleotide
  Target: SCN9A; (-) strand; PAM type: NRG; PAM sequence: CAG
gttatatgataactgtaaac

SEQ ID NO: 23455 - DNA, 20 bp, Artificial Sequence
  Description of Artificial Sequence: Synthetic oligonucleotide
  Target: SCN9A; (-) strand; PAM type: NRG; PAM sequence: TAG
agcagcactggtgagaaggc

SEQ ID NO: 23456 - DNA, 20 bp, Artificial Sequence
  Description of Artificial Sequence: Synthetic oligonucleotide
  Target: SCN9A; (-) strand; PAM type: NRG; PAM sequence: AGG
cagcagcagcactggtgaga

SEQ ID NO: 23457 - DNA, 20 bp, Artificial Sequence
  Description of Artificial Sequence: Synthetic oligonucleotide
  Target: SCN9A; (-) strand; PAM type: NRG; PAM sequence: AAG
ccagcagcagcactggtgag

SEQ ID NO: 23458 - DNA, 20 bp, Artificial Sequence
  Description of Artificial Sequence: Synthetic oligonucleotide
  Target: SCN9A; (-) strand; PAM type: NRG; PAM sequence: GAG
agaccagcagcagcactggt

SEQ ID NO: 23459 - DNA, 20 bp, Artificial Sequence
  Description of Artificial Sequence: Synthetic oligonucleotide
  Target: SCN9A; (-) strand; PAM type: NRG; PAM sequence: TGG
ctgaagaccagcagcagcac

SEQ ID NO: 23460 - DNA, 20 bp, Artificial Sequence
  Description of Artificial Sequence: Synthetic oligonucleotide
  Target: SCN9A; (-) strand; PAM type: NRG; PAM sequence: CAG
tgacctctgaagaccagcag

SEQ ID NO: 23461 - DNA, 20 bp, Artificial Sequence
  Description of Artificial Sequence: Synthetic oligonucleotide
  Target: SCN9A; (-) strand; PAM type: NRG; PAM sequence: CAG
tcttgacctctgaagaccag

SEQ ID NO: 23462 - DNA, 20 bp, Artificial Sequence
  Description of Artificial Sequence: Synthetic oligonucleotide
  Target: SCN9A; (-) strand; PAM type: NRG; PAM sequence: CAG
ttctcttgacctctgaagac

SEQ ID NO: 23463 - DNA, 20 bp, Artificial Sequence
  Description of Artificial Sequence: Synthetic oligonucleotide
  Target: SCN9A; (-) strand; PAM type: NRG; PAM sequence: AAG
gcactttctcttgacctctg

SEQ ID NO: 23464 - DNA, 20 bp, Artificial Sequence
  Description of Artificial Sequence: Synthetic oligonucleotide
  Target: SCN9A; (-) strand; PAM type: NRG; PAM sequence: AAG
tgagtctttttgtggattat

SEQ ID NO: 23465 - DNA, 20 bp, Artificial Sequence
  Description of Artificial Sequence: Synthetic oligonucleotide
  Target: SCN9A; (-) strand; PAM type: NRG; PAM sequence: TGG
agagatcatgagtctttttg

SEQ ID NO: 23466 - DNA, 20 bp, Artificial Sequence
  Description of Artificial Sequence: Synthetic oligonucleotide
  Target: SCN9A; (-) strand; PAM type: NRG; PAM sequence: GAG
gatcaggtgtcagagatcat

SEQ ID NO: 23467 - DNA, 20 bp, Artificial Sequence
  Description of Artificial Sequence: Synthetic oligonucleotide
  Target: SCN9A; (-) strand; PAM type: NRG; PAM sequence: GAG
gtggaaatgatcaggtgtca

SEQ ID NO: 23468 - DNA, 20 bp, Artificial Sequence
  Description of Artificial Sequence: Synthetic oligonucleotide
  Target: SCN9A; (-) strand; PAM type: NRG; PAM sequence: CAG
aggtggaaatgatcaggtgt

SEQ ID NO: 23469 - DNA, 20 bp, Artificial Sequence
  Description of Artificial Sequence: Synthetic oligonucleotide
  Target: SCN9A; (-) strand; PAM type: NRG; PAM sequence: AGG
agatggaggtggaaatgatc

SEQ ID NO: 23470 - DNA, 20 bp, Artificial Sequence
  Description of Artificial Sequence: Synthetic oligonucleotide
  Target: SCN9A; (-) strand; PAM type: NRG; PAM sequence: CAG
cagatggaggtggaaatgat

SEQ ID NO: 23471 - DNA, 20 bp, Artificial Sequence
  Description of Artificial Sequence: Synthetic oligonucleotide
  Target: SCN9A; (-) strand; PAM type: NRG; PAM sequence: TGG
gaggaggaatcagatggagg

SEQ ID NO: 23472 - DNA, 20 bp, Artificial Sequence
  Description of Artificial Sequence: Synthetic oligonucleotide
  Target: SCN9A; (-) strand; PAM type: NRG; PAM sequence: AGG
aaagaggaggaatcagatgg

SEQ ID NO: 23473 - DNA, 20 bp, Artificial Sequence
  Description of Artificial Sequence: Synthetic oligonucleotide
  Target: SCN9A; (-) strand; PAM type: NRG; PAM sequence: GAG
gaaagaggaggaatcagatg

SEQ ID NO: 23474 - DNA, 20 bp, Artificial Sequence
  Description of Artificial Sequence: Synthetic oligonucleotide
  Target: SCN9A; (-) strand; PAM type: NRG; PAM sequence: TGG
gagaaagaggaggaatcaga

SEQ ID NO: 23475 - DNA, 20 bp, Artificial Sequence
  Description of Artificial Sequence: Synthetic oligonucleotide
  Target: SCN9A; (-) strand; PAM type: NRG; PAM sequence: CAG
aatggagaaagaggaggaat

SEQ ID NO: 23476 - DNA, 20 bp, Artificial Sequence
  Description of Artificial Sequence: Synthetic oligonucleotide
  Target: SCN9A; (-) strand; PAM type: NRG; PAM sequence: AGG
aattttaatggagaaagagg

SEQ ID NO: 23477 - DNA, 20 bp, Artificial Sequence
  Description of Artificial Sequence: Synthetic oligonucleotide
  Target: SCN9A; (-) strand; PAM type: NRG; PAM sequence: GAG
caattttaatggagaaagag

SEQ ID NO: 23478 - DNA, 20 bp, Artificial Sequence
  Description of Artificial Sequence: Synthetic oligonucleotide
  Target: SCN9A; (-) strand; PAM type: NRG; PAM sequence: AGG
tccaattttaatggagaaag

SEQ ID NO: 23479 - DNA, 20 bp, Artificial Sequence
  Description of Artificial Sequence: Synthetic oligonucleotide
  Target: SCN9A; (-) strand; PAM type: NRG; PAM sequence: GAG
atccaattttaatggagaaa

SEQ ID NO: 23480 - DNA, 20 bp, Artificial Sequence
  Description of Artificial Sequence: Synthetic oligonucleotide
  Target: SCN9A; (-) strand; PAM type: NRG; PAM sequence: AAG
ttatccaattttaatggaga

SEQ ID NO: 23481 - DNA, 20 bp, Artificial Sequence
  Description of Artificial Sequence: Synthetic oligonucleotide
  Target: SCN9A; (-) strand; PAM type: NRG; PAM sequence: GAG
ggacttatccaattttaatg

SEQ ID NO: 23482 - DNA, 20 bp, Artificial Sequence
  Description of Artificial Sequence: Synthetic oligonucleotide
  Target: SCN9A; (-) strand; PAM type: NRG; PAM sequence: TGG
taggacttatccaattttaa

SEQ ID NO: 23483 - DNA, 20 bp, Artificial Sequence
  Description of Artificial Sequence: Synthetic oligonucleotide
  Target: SCN9A; (-) strand; PAM type: NRG; PAM sequence: AGG
ggatcatgtcttaaattgct

SEQ ID NO: 23484 - DNA, 20 bp, Artificial Sequence
  Description of Artificial Sequence: Synthetic oligonucleotide
  Target: SCN9A; (-) strand; PAM type: NRG; PAM sequence: TAG
gggatcatgtcttaaattgc

SEQ ID NO: 23485 - DNA, 20 bp, Artificial Sequence
  Description of Artificial Sequence: Synthetic oligonucleotide
  Target: SCN9A; (-) strand; PAM type: NRG; PAM sequence: GGG
ttataacagtggctggccat

SEQ ID NO: 23486 - DNA, 20 bp, Artificial Sequence
  Description of Artificial Sequence: Synthetic oligonucleotide
  Target: SCN9A; (-) strand; PAM type: NRG; PAM sequence: TGG
tttataacagtggctggcca

SEQ ID NO: 23487 - DNA, 20 bp, Artificial Sequence
  Description of Artificial Sequence: Synthetic oligonucleotide
  Target: SCN9A; (-) strand; PAM type: NRG; PAM sequence: TGG
gaaaagtttataacagtggc

SEQ ID NO: 23488 - DNA, 20 bp, Artificial Sequence
  Description of Artificial Sequence: Synthetic oligonucleotide
  Target: SCN9A; (-) strand; PAM type: NRG; PAM sequence: TGG
atgtgaaaagtttataacag

SEQ ID NO: 23489 - DNA, 20 bp, Artificial Sequence
  Description of Artificial Sequence: Synthetic oligonucleotide
  Target: SCN9A; (-) strand; PAM type: NRG; PAM sequence: CAG
aggatgtgaaaagtttataa

SEQ ID NO: 23490 - DNA, 20 bp, Artificial Sequence
  Description of Artificial Sequence: Synthetic oligonucleotide
  Target: SCN9A; (-) strand; PAM type: NRG; PAM sequence: AAG
aggggagtgtaggatgtgaa

SEQ ID NO: 23491 - DNA, 20 bp, Artificial Sequence
  Description of Artificial Sequence: Synthetic oligonucleotide
  Target: SCN9A; (-) strand; PAM type: NRG; PAM sequence: AGG
gtggggaaaaaggggagtgt

SEQ ID NO: 23492 - DNA, 20 bp, Artificial Sequence
  Description of Artificial Sequence: Synthetic oligonucleotide
  Target: SCN9A; (-) strand; PAM type: NRG; PAM sequence: TAG
ggtggggaaaaaggggagtg

SEQ ID NO: 23493 - DNA, 20 bp, Artificial Sequence
  Description of Artificial Sequence: Synthetic oligonucleotide
  Target: SCN9A; (-) strand; PAM type: NRG; PAM sequence: GAG
ctactggtggggaaaaaggg

SEQ ID NO: 23494 - DNA, 20 bp, Artificial Sequence
  Description of Artificial Sequence: Synthetic oligonucleotide
  Target: SCN9A; (-) strand; PAM type: NRG; PAM sequence: GGG
tcctactggtggggaaaaag

SEQ ID NO: 23495 - DNA, 20 bp, Artificial Sequence
  Description of Artificial Sequence: Synthetic oligonucleotide
  Target: SCN9A; (-) strand; PAM type: NRG; PAM sequence: GGG
atcctactggtggggaaaaa

SEQ ID NO: 23496 - DNA, 20 bp, Artificial Sequence
  Description of Artificial Sequence: Synthetic oligonucleotide
  Target: SCN9A; (-) strand; PAM type: NRG; PAM sequence: AGG
catcctactggtggggaaaa

SEQ ID NO: 23497 - DNA, 20 bp, Artificial Sequence
  Description of Artificial Sequence: Synthetic oligonucleotide
  Target: SCN9A; (-) strand; PAM type: NRG; PAM sequence: AAG
acatcctactggtggggaaa

SEQ ID NO: 23498 - DNA, 20 bp, Artificial Sequence
  Description of Artificial Sequence: Synthetic oligonucleotide
  Target: SCN9A; (-) strand; PAM type: NRG; PAM sequence: GGG
ggctccacatcctactggtg

SEQ ID NO: 23499 - DNA, 20 bp, Artificial Sequence
  Description of Artificial Sequence: Synthetic oligonucleotide
  Target: SCN9A; (-) strand; PAM type: NRG; PAM sequence: GGG
aggctccacatcctactggt

SEQ ID NO: 23500 - DNA, 20 bp, Artificial Sequence
  Description of Artificial Sequence: Synthetic oligonucleotide
  Target: SCN9A; (-) strand; PAM type: NRG; PAM sequence: TGG
caggctccacatcctactgg

SEQ ID NO: 23501 - DNA, 20 bp, Artificial Sequence
  Description of Artificial Sequence: Synthetic oligonucleotide
  Target: SCN9A; (-) strand; PAM type: NRG; PAM sequence: TGG
agacaggctccacatcctac

SEQ ID NO: 23502 - DNA, 20 bp, Artificial Sequence
  Description of Artificial Sequence: Synthetic oligonucleotide
  Target: SCN9A; (-) strand; PAM type: NRG; PAM sequence: AGG
gcatttgagagctgaaagac

SEQ ID NO: 23503 - DNA, 20 bp, Artificial Sequence
  Description of Artificial Sequence: Synthetic oligonucleotide
  Target: SCN9A; (-) strand; PAM type: NRG; PAM sequence: CAG
agcatttgagagctgaaaga

SEQ ID NO: 23504 - DNA, 20 bp, Artificial Sequence
  Description of Artificial Sequence: Synthetic oligonucleotide
  Target: SCN9A; (-) strand; PAM type: NRG; PAM sequence: AAG
cacaagcatttgagagctga

SEQ ID NO: 23505 - DNA, 20 bp, Artificial Sequence
  Description of Artificial Sequence: Synthetic oligonucleotide
  Target: SCN9A; (-) strand; PAM type: NRG; PAM sequence: GAG
tgggatgcacaagcatttga

SEQ ID NO: 23506 - DNA, 20 bp, Artificial Sequence
  Description of Artificial Sequence: Synthetic oligonucleotide
  Target: SCN9A; (-) strand; PAM type: NRG; PAM sequence: GAG
actgggatgcacaagcattt

SEQ ID NO: 23507 - DNA, 20 bp, Artificial Sequence
  Description of Artificial Sequence: Synthetic oligonucleotide
  Target: SCN9A; (-) strand; PAM type: NRG; PAM sequence: AAG
tactaggcactgggatgcac

SEQ ID NO: 23508 - DNA, 20 bp, Artificial Sequence
  Description of Artificial Sequence: Synthetic oligonucleotide
  Target: SCN9A; (-) strand; PAM type: NRG; PAM sequence: GGG
ttaacatggtactaggcact

SEQ ID NO: 23509 - DNA, 20 bp, Artificial Sequence
  Description of Artificial Sequence: Synthetic oligonucleotide
  Target: SCN9A; (-) strand; PAM type: NRG; PAM sequence: TGG
attaacatggtactaggcac

SEQ ID NO: 23510 - DNA, 20 bp, Artificial Sequence
  Description of Artificial Sequence: Synthetic oligonucleotide
  Target: SCN9A; (-) strand; PAM type: NRG; PAM sequence: AGG
gctgttattaacatggtact

SEQ ID NO: 23511 - DNA, 20 bp, Artificial Sequence
  Description of Artificial Sequence: Synthetic oligonucleotide
  Target: SCN9A; (-) strand; PAM type: NRG; PAM sequence: TAG
tgctgttattaacatggtac

SEQ ID NO: 23512 - DNA, 20 bp, Artificial Sequence
  Description of Artificial Sequence: Synthetic oligonucleotide
  Target: SCN9A; (-) strand; PAM type: NRG; PAM sequence: TGG
tcctgctgctgttattaaca

SEQ ID NO: 23513 - DNA, 20 bp, Artificial Sequence
  Description of Artificial Sequence: Synthetic oligonucleotide
  Target: SCN9A; (-) strand; PAM type: NRG; PAM sequence: TAG
agctactgcagtcattcatt

SEQ ID NO: 23514 - DNA, 20 bp, Artificial Sequence
  Description of Artificial Sequence: Synthetic oligonucleotide
  Target: SCN9A; (-) strand; PAM type: NRG; PAM sequence: CAG
ataggcctattaagctactg

SEQ ID NO: 23515 - DNA, 20 bp, Artificial Sequence
  Description of Artificial Sequence: Synthetic oligonucleotide
  Target: SCN9A; (-) strand; PAM type: NRG; PAM sequence: AAG
ctgtgttctataggcctatt

SEQ ID NO: 23516 - DNA, 20 bp, Artificial Sequence
  Description of Artificial Sequence: Synthetic oligonucleotide
  Target: SCN9A; (-) strand; PAM type: NRG; PAM sequence: AGG
aagcaccctctgtgttctat

SEQ ID NO: 23517 - DNA, 20 bp, Artificial Sequence
  Description of Artificial Sequence: Synthetic oligonucleotide
  Target: SCN9A; (-) strand; PAM type: NRG; PAM sequence: TAG
aaagcaccctctgtgttcta

SEQ ID NO: 23518 - DNA, 20 bp, Artificial Sequence
  Description of Artificial Sequence: Synthetic oligonucleotide
  Target: SCN9A; (-) strand; PAM type: NRG; PAM sequence: AAG
ggatgaatagtcaaaggaaa

SEQ ID NO: 23519 - DNA, 20 bp, Artificial Sequence
  Description of Artificial Sequence: Synthetic oligonucleotide
  Target: SCN9A; (-) strand; PAM type: NRG; PAM sequence: AGG
atatatggatgaatagtcaa

SEQ ID NO: 23520 - DNA, 20 bp, Artificial Sequence
  Description of Artificial Sequence: Synthetic oligonucleotide
  Target: SCN9A; (-) strand; PAM type: NRG; PAM sequence: AAG
aatatatggatgaatagtca

SEQ ID NO: 23521 - DNA, 20 bp, Artificial Sequence
  Description of Artificial Sequence: Synthetic oligonucleotide
  Target: SCN9A; (-) strand; PAM type: NRG; PAM sequence: TAG
aaggataatatatggatgaa

SEQ ID NO: 23522 - DNA, 20 bp, Artificial Sequence
  Description of Artificial Sequence: Synthetic oligonucleotide
  Target: SCN9A; (-) strand; PAM type: NRG; PAM sequence: TGG
aagctttgaaggataatata

SEQ ID NO: 23523 - DNA, 20 bp, Artificial Sequence
  Description of Artificial Sequence: Synthetic oligonucleotide
  Target: SCN9A; (-) strand; PAM type: NRG; PAM sequence: AGG
ttttagagctgaagctttga

SEQ ID NO: 23524 - DNA, 20 bp, Artificial Sequence
  Description of Artificial Sequence: Synthetic oligonucleotide
  Target: SCN9A; (-) strand; PAM type: NRG; PAM sequence: AAG
tttttagagctgaagctttg

SEQ ID NO: 23525 - DNA, 20 bp, Artificial Sequence
  Description of Artificial Sequence: Synthetic oligonucleotide
  Target: SCN9A; (-) strand; PAM type: NRG; PAM sequence: AAG
aacagtgatttttagagctg

SEQ ID NO: 23526 - DNA, 20 bp, Artificial Sequence
  Description of Artificial Sequence: Synthetic oligonucleotide
  Target: SCN9A; (-) strand; PAM type: NRG; PAM sequence: GAG
gaatagaacagtgattttta

SEQ ID NO: 23527 - DNA, 20 bp, Artificial Sequence
  Description of Artificial Sequence: Synthetic oligonucleotide
  Target: SCN9A; (-) strand; PAM type: NRG; PAM sequence: TAG
gagaatagaacagtgatttt

SEQ ID NO: 23528 - DNA, 20 bp, Artificial Sequence
  Description of Artificial Sequence: Synthetic oligonucleotide
  Target: SCN9A; (-) strand; PAM type: NRG; PAM sequence: CAG
cattaatggagagaatagaa

SEQ ID NO: 23529 - DNA, 20 bp, Artificial Sequence
  Description of Artificial Sequence: Synthetic oligonucleotide
  Target: SCN9A; (-) strand; PAM type: NRG; PAM sequence: TAG
caccgcattaatggagagaa

SEQ ID NO: 23530 - DNA, 20 bp, Artificial Sequence
  Description of Artificial Sequence: Synthetic oligonucleotide
  Target: SCN9A; (-) strand; PAM type: NRG; PAM sequence: GAG
ggaagcaccgcattaatgga

SEQ ID NO: 23531 - DNA, 20 bp, Artificial Sequence
  Description of Artificial Sequence: Synthetic oligonucleotide
  Target: SCN9A; (-) strand; PAM type: NRG; PAM sequence: GAG
taggaagcaccgcattaatg

SEQ ID NO: 23532 - DNA, 20 bp, Artificial Sequence
  Description of Artificial Sequence: Synthetic oligonucleotide
  Target: SCN9A; (-) strand; PAM type: NRG; PAM sequence: TGG
cataggaagcaccgcattaa

SEQ ID NO: 23533 - DNA, 20 bp, Artificial Sequence
  Description of Artificial Sequence: Synthetic oligonucleotide
  Target: SCN9A; (-) strand; PAM type: NRG; PAM sequence: AAG
aatttcttggaaagcatagg

SEQ ID NO: 23534 - DNA, 20 bp, Artificial Sequence
  Description of Artificial Sequence: Synthetic oligonucleotide
  Target: SCN9A; (-) strand; PAM type: NRG; PAM sequence: AGG
taaaatttcttggaaagcat

SEQ ID NO: 23535 - DNA, 20 bp, Artificial Sequence
  Description of Artificial Sequence: Synthetic oligonucleotide
  Target: SCN9A; (-) strand; PAM type: NRG; PAM sequence: TAG
ctaaaatttcttggaaagca

SEQ ID NO: 23536 - DNA, 20 bp, Artificial Sequence
  Description of Artificial Sequence: Synthetic oligonucleotide
  Target: SCN9A; (-) strand; PAM type: NRG; PAM sequence: AAG
acttactaaaatttcttgga

SEQ ID NO: 23537 - DNA, 20 bp, Artificial Sequence
  Description of Artificial Sequence: Synthetic oligonucleotide
  Target: SCN9A; (-) strand; PAM type: NRG; PAM sequence: TGG
tgtcacttactaaaatttct

SEQ ID NO: 23538 - DNA, 20 bp, Artificial Sequence
  Description of Artificial Sequence: Synthetic oligonucleotide
  Target: SCN9A; (-) strand; PAM type: NRG; PAM sequence: GAG
cgtaagccctacattagata

SEQ ID NO: 23539 - DNA, 20 bp, Artificial Sequence
  Description of Artificial Sequence: Synthetic oligonucleotide
  Target: SCN9A; (-) strand; PAM type: NRG; PAM sequence: TAG
agcgtaagccctacattaga

SEQ ID NO: 23540 - DNA, 20 bp, Artificial Sequence
  Description of Artificial Sequence: Synthetic oligonucleotide
  Target: SCN9A; (-) strand; PAM type: NRG; PAM sequence: TAG
gtaaagcgtaagccctacat

SEQ ID NO: 23541 - DNA, 20 bp, Artificial Sequence
  Description of Artificial Sequence: Synthetic oligonucleotide
  Target: SCN9A; (-) strand; PAM type: NRG; PAM sequence: AAG
aattagtaacagtaaagcgt

SEQ ID NO: 23542 - DNA, 20 bp, Artificial Sequence
  Description of Artificial Sequence: Synthetic oligonucleotide
  Target: SCN9A; (-) strand; PAM type: NRG; PAM sequence: AAG
aaccaaaattagtaacagta

SEQ ID NO: 23543 - DNA, 20 bp, Artificial Sequence
  Description of Artificial Sequence: Synthetic oligonucleotide
  Target: SCN9A; (-) strand; PAM type: NRG; PAM sequence: CAG
gtgataaccaaaattagtaa

SEQ ID NO: 23544 - DNA, 20 bp, Artificial Sequence
  Description of Artificial Sequence: Synthetic oligonucleotide
  Target: SCN9A; (-) strand; PAM type: NRG; PAM sequence: TAG
aaatgagtgataaccaaaat

SEQ ID NO: 23545 - DNA, 20 bp, Artificial Sequence
  Description of Artificial Sequence: Synthetic oligonucleotide
  Target: SCN9A; (-) strand; PAM type: NRG; PAM sequence: GAG
tacacaaaataggagtaaat

SEQ ID NO: 23546 - DNA, 20 bp, Artificial Sequence
  Description of Artificial Sequence: Synthetic oligonucleotide
  Target: SCN9A; (-) strand; PAM type: NRG; PAM sequence: GAG
gaagagcatacacaaaatag

SEQ ID NO: 23547 - DNA, 20 bp, Artificial Sequence
  Description of Artificial Sequence: Synthetic oligonucleotide
  Target: SCN9A; (-) strand; PAM type: NRG; PAM sequence: AGG
cagaagagcatacacaaaat

SEQ ID NO: 23548 - DNA, 20 bp, Artificial Sequence
  Description of Artificial Sequence: Synthetic oligonucleotide
  Target: SCN9A; (-) strand; PAM type: NRG; PAM sequence: TAG
acagaagagcatacacaaaa

SEQ ID NO: 23549 - DNA, 20 bp, Artificial Sequence
  Description of Artificial Sequence: Synthetic oligonucleotide
  Target: SCN9A; (-) strand; PAM type: NRG; PAM sequence: GAG
ttgtggctcctcagacagaa

SEQ ID NO: 23550 - DNA, 20 bp, Artificial Sequence
  Description of Artificial Sequence: Synthetic oligonucleotide
  Target: SCN9A; (-) strand; PAM type: NRG; PAM sequence: AAG
tgttgtggctcctcagacag

SEQ ID NO: 23551 - DNA, 20 bp, Artificial Sequence
  Description of Artificial Sequence: Synthetic oligonucleotide
  Target: SCN9A; (-) strand; PAM type: NRG; PAM sequence: CAG
ctgtgttgtggctcctcaga

SEQ ID NO: 23552 - DNA, 20 bp, Artificial Sequence
  Description of Artificial Sequence: Synthetic oligonucleotide
  Target: SCN9A; (-) strand; PAM type: NRG; PAM sequence: CAG
ttcactgtgttgtggctcct

SEQ ID NO: 23553 - DNA, 20 bp, Artificial Sequence
  Description of Artificial Sequence: Synthetic oligonucleotide
  Target: SCN9A; (-) strand; PAM type: NRG; PAM sequence: TGG
cctgtcctttcactgtgttg

SEQ ID NO: 23554 - DNA, 20 bp, Artificial Sequence
  Description of Artificial Sequence: Synthetic oligonucleotide
  Target: SCN9A; (-) strand; PAM type: NRG; PAM sequence: AAG
gtggctgaagtctaaagtca

SEQ ID NO: 23555 - DNA, 20 bp, Artificial Sequence
  Description of Artificial Sequence: Synthetic oligonucleotide
  Target: SCN9A; (-) strand; PAM type: NRG; PAM sequence: AAG
ggacatgtggctgaagtcta

SEQ ID NO: 23556 - DNA, 20 bp, Artificial Sequence
  Description of Artificial Sequence: Synthetic oligonucleotide
  Target: SCN9A; (-) strand; PAM type: NRG; PAM sequence: AAG
tgtcaagggacatgtggctg

SEQ ID NO: 23557 - DNA, 20 bp, Artificial Sequence
  Description of Artificial Sequence: Synthetic oligonucleotide
  Target: SCN9A; (-) strand; PAM type: NRG; PAM sequence: TGG
attctttgtcaagggacatg

SEQ ID NO: 23558 - DNA, 20 bp, Artificial Sequence
  Description of Artificial Sequence: Synthetic oligonucleotide
  Target: SCN9A; (-) strand; PAM type: NRG; PAM sequence: GGG
cctttcaaattctttgtcaa

SEQ ID NO: 23559 - DNA, 20 bp, Artificial Sequence
  Description of Artificial Sequence: Synthetic oligonucleotide
  Target: SCN9A; (-) strand; PAM type: NRG; PAM sequence: AGG
tcctttcaaattctttgtca

SEQ ID NO: 23560 - DNA, 20 bp, Artificial Sequence
  Description of Artificial Sequence: Synthetic oligonucleotide
  Target: SCN9A; (-) strand; PAM type: NRG; PAM sequence: AAG
gtcctttcaaattctttgtc

SEQ ID NO: 23561 - DNA, 20 bp, Artificial Sequence
  Description of Artificial Sequence: Synthetic oligonucleotide
  Target: SCN9A; (-) strand; PAM type: NRG; PAM sequence: CAG
caacaatgagcccaattttt

SEQ ID NO: 23562 - DNA, 20 bp, Artificial Sequence
  Description of Artificial Sequence: Synthetic oligonucleotide
  Target: SCN9A; (-) strand; PAM type: NRG; PAM sequence: GAG
tcttggctcactgcaacaat

SEQ ID NO: 23563 - DNA, 20 bp, Artificial Sequence
  Description of Artificial Sequence: Synthetic oligonucleotide
  Target: SCN9A; (-) strand; PAM type: NRG; PAM sequence: TGG
ggagtgcagtggcgtgatct

SEQ ID NO: 23564 - DNA, 20 bp, Artificial Sequence
  Description of Artificial Sequence: Synthetic oligonucleotide
  Target: SCN9A; (-) strand; PAM type: NRG; PAM sequence: TGG
ttgcccaggctggagtgcag

SEQ ID NO: 23565 - DNA, 20 bp, Artificial Sequence
  Description of Artificial Sequence: Synthetic oligonucleotide
  Target: SCN9A; (-) strand; PAM type: NRG; PAM sequence: CAG
ctgttgcccaggctggagtg

SEQ ID NO: 23566 - DNA, 20 bp, Artificial Sequence
  Description of Artificial Sequence: Synthetic oligonucleotide
  Target: SCN9A; (-) strand; PAM type: NRG; PAM sequence: GAG
ttgctctgttgcccaggctg

SEQ ID NO: 23567 - DNA, 20 bp, Artificial Sequence
  Description of Artificial Sequence: Synthetic oligonucleotide
  Target: SCN9A; (-) strand; PAM type: NRG; PAM sequence: TGG
tcttgctctgttgcccaggc

SEQ ID NO: 23568 - DNA, 20 bp, Artificial Sequence
  Description of Artificial Sequence: Synthetic oligonucleotide
  Target: SCN9A; (-) strand; PAM type: NRG; PAM sequence: AGG
agagtcttgctctgttgccc

SEQ ID NO: 23569 - DNA, 20 bp, Artificial Sequence
  Description of Artificial Sequence: Synthetic oligonucleotide
  Target: SCN9A; (-) strand; PAM type: NRG; PAM sequence: CAG
cagagtcttgctctgttgcc

SEQ ID NO: 23570 - DNA, 20 bp, Artificial Sequence
  Description of Artificial Sequence: Synthetic oligonucleotide
  Target: SCN9A; (-) strand; PAM type: NRG; PAM sequence: GAG
ttttttttttttttgagaca

SEQ ID NO: 23571 - DNA, 20 bp, Artificial Sequence
  Description of Artificial Sequence: Synthetic oligonucleotide
  Target: SCN9A; (-) strand; PAM type: NRG; PAM sequence: CAG
ttttttttttttttttgaga

SEQ ID NO: 23572 - DNA, 20 bp, Artificial Sequence
  Description of Artificial Sequence: Synthetic oligonucleotide
  Target: SCN9A; (-) strand; PAM type: NRG; PAM sequence: GAG
tttttttttttttttttttt

SEQ ID NO: 23573 - DNA, 20 bp, Artificial Sequence
  Description of Artificial Sequence: Synthetic oligonucleotide
  Target: SCN9A; (-) strand; PAM type: NRG; PAM sequence: GAG
atcattttcagtgtctcaat

SEQ ID NO: 23574 - DNA, 20 bp, Artificial Sequence
  Description of Artificial Sequence: Synthetic oligonucleotide
  Target: SCN9A; (-) strand; PAM type: NRG; PAM sequence: CAG
ttgagatcagcaatcatttt

SEQ ID NO: 23575 - DNA, 20 bp, Artificial Sequence
  Description of Artificial Sequence: Synthetic oligonucleotide
  Target: SCN9A; (-) strand; PAM type: NRG; PAM sequence: CAG
cactttagacctgttgagat

SEQ ID NO: 23576 - DNA, 20 bp, Artificial Sequence
  Description of Artificial Sequence: Synthetic oligonucleotide
  Target: SCN9A; (-) strand; PAM type: NRG; PAM sequence: GAG
tctaacactttagacctgtt

SEQ ID NO: 23577 - DNA, 20 bp, Artificial Sequence
  Description of Artificial Sequence: Synthetic oligonucleotide
  Target: SCN9A; (-) strand; PAM type: NRG; PAM sequence: TAG
aagagaaagttctaacactt

SEQ ID NO: 23578 - DNA, 20 bp, Artificial Sequence
  Description of Artificial Sequence: Synthetic oligonucleotide
  Target: SCN9A; (-) strand; PAM type: NRG; PAM sequence: AAG
gtgtttcgatctgaaagaga

SEQ ID NO: 23579 - DNA, 20 bp, Artificial Sequence
  Description of Artificial Sequence: Synthetic oligonucleotide
  Target: SCN9A; (-) strand; PAM type: NRG; PAM sequence: GAG
aatagtgtttcgatctgaaa

SEQ ID NO: 23580 - DNA, 20 bp, Artificial Sequence
  Description of Artificial Sequence: Synthetic oligonucleotide
  Target: SCN9A; (-) strand; PAM type: NRG; PAM sequence: AAG
ttaatagtgtttcgatctga

SEQ ID NO: 23581 - DNA, 20 bp, Artificial Sequence
  Description of Artificial Sequence: Synthetic oligonucleotide
  Target: SCN9A; (-) strand; PAM type: NRG; PAM sequence: TAG
attttatccaacagggttaa

SEQ ID NO: 23582 - DNA, 20 bp, Artificial Sequence
  Description of Artificial Sequence: Synthetic oligonucleotide
  Target: SCN9A; (-) strand; PAM type: NRG; PAM sequence: GGG
gactttcattttatccaaca

SEQ ID NO: 23583 - DNA, 20 bp, Artificial Sequence
  Description of Artificial Sequence: Synthetic oligonucleotide
  Target: SCN9A; (-) strand; PAM type: NRG; PAM sequence: AGG
tgactttcattttatccaac

SEQ ID NO: 23584 - DNA, 20 bp, Artificial Sequence
  Description of Artificial Sequence: Synthetic oligonucleotide
  Target: SCN9A; (-) strand; PAM type: NRG; PAM sequence: CAG
ttgactttcattttatccaa

SEQ ID NO: 23585 - DNA, 20 bp, Artificial Sequence
  Description of Artificial Sequence: Synthetic oligonucleotide
  Target: SCN9A; (-) strand; PAM type: NRG; PAM sequence: AGG
atattaaccacgaaggatac

SEQ ID NO: 23586 - DNA, 20 bp, Artificial Sequence
  Description of Artificial Sequence: Synthetic oligonucleotide
  Target: SCN9A; (-) strand; PAM type: NRG; PAM sequence: CAG
aatattaaccacgaaggata

SEQ ID NO: 23587 - DNA, 20 bp, Artificial Sequence
  Description of Artificial Sequence: Synthetic oligonucleotide
  Target: SCN9A; (-) strand; PAM type: NRG; PAM sequence: AGG
aaatataatattaaccacga

SEQ ID NO: 23588 - DNA, 20 bp, Artificial Sequence
  Description of Artificial Sequence: Synthetic oligonucleotide
  Target: SCN9A; (-) strand; PAM type: NRG; PAM sequence: AAG
taaatataatattaaccacg

SEQ ID NO: 23589 - DNA, 20 bp, Artificial Sequence
  Description of Artificial Sequence: Synthetic oligonucleotide
  Target: SCN9A; (-) strand; PAM type: NRG; PAM sequence: AGG
acaagttcatgactgtagac

SEQ ID NO: 23590 - DNA, 20 bp, Artificial Sequence
  Description of Artificial Sequence: Synthetic oligonucleotide
  Target: SCN9A; (-) strand; PAM type: NRG; PAM sequence: CAG
cacaagttcatgactgtaga

SEQ ID NO: 23591 - DNA, 20 bp, Artificial Sequence
  Description of Artificial Sequence: Synthetic oligonucleotide
  Target: SCN9A; (-) strand; PAM type: NRG; PAM sequence: TAG
atggcacaagttcatgactg

SEQ ID NO: 23592 - DNA, 20 bp, Artificial Sequence
  Description of Artificial Sequence: Synthetic oligonucleotide
  Target: SCN9A; (-) strand; PAM type: NRG; PAM sequence: AAG
aagaagaatctgaatggcac

SEQ ID NO: 23593 - DNA, 20 bp, Artificial Sequence
  Description of Artificial Sequence: Synthetic oligonucleotide
  Target: SCN9A; (-) strand; PAM type: NRG; PAM sequence: TGG
tagaataagaagaatctgaa

SEQ ID NO: 23594 - DNA, 20 bp, Artificial Sequence
  Description of Artificial Sequence: Synthetic oligonucleotide
  Target: SCN9A; (-) strand; PAM type: NRG; PAM sequence: AAG
aaagcagaacgtagaataag

SEQ ID NO: 23595 - DNA, 20 bp, Artificial Sequence
  Description of Artificial Sequence: Synthetic oligonucleotide
  Target: SCN9A; (-) strand; PAM type: NRG; PAM sequence: AAG
ttgaaagcagaacgtagaat

SEQ ID NO: 23596 - DNA, 20 bp, Artificial Sequence
  Description of Artificial Sequence: Synthetic oligonucleotide
  Target: SCN9A; (-) strand; PAM type: NRG; PAM sequence: TAG
agagtattgaaagcagaacg

SEQ ID NO: 23597 - DNA, 20 bp, Artificial Sequence
  Description of Artificial Sequence: Synthetic oligonucleotide
  Target: SCN9A; (-) strand; PAM type: NRG; PAM sequence: CAG
taattttagagtattgaaag

SEQ ID NO: 23598 - DNA, 20 bp, Artificial Sequence
  Description of Artificial Sequence: Synthetic oligonucleotide
  Target: SCN9A; (-) strand; PAM type: NRG; PAM sequence: AAG
ggataattttagagtattga

SEQ ID NO: 23599 - DNA, 20 bp, Artificial Sequence
  Description of Artificial Sequence: Synthetic oligonucleotide
  Target: SCN9A; (-) strand; PAM type: NRG; PAM sequence: GAG
aactgctaaggataatttta

SEQ ID NO: 23600 - DNA, 20 bp, Artificial Sequence
  Description of Artificial Sequence: Synthetic oligonucleotide
  Target: SCN9A; (-) strand; PAM type: NRG; PAM sequence: TAG
aaaactgctaaggataattt

SEQ ID NO: 23601 - DNA, 20 bp, Artificial Sequence
  Description of Artificial Sequence: Synthetic oligonucleotide
  Target: SCN9A; (-) strand; PAM type: NRG; PAM sequence: AGG
acagtttcccaaaactgcta

SEQ ID NO: 23602 - DNA, 20 bp, Artificial Sequence
  Description of Artificial Sequence: Synthetic oligonucleotide
  Target: SCN9A; (-) strand; PAM type: NRG; PAM sequence: AAG
aacagtttcccaaaactgct

SEQ ID NO: 23603 - DNA, 20 bp, Artificial Sequence
  Description of Artificial Sequence: Synthetic oligonucleotide
  Target: SCN9A; (-) strand; PAM type: NRG; PAM sequence: CAG
ttcttcaatattgataccaa

SEQ ID NO: 23604 - DNA, 20 bp, Artificial Sequence
  Description of Artificial Sequence: Synthetic oligonucleotide
  Target: SCN9A; (-) strand; PAM type: NRG; PAM sequence: CAG
tgcatcttagtaggtccatt

SEQ ID NO: 23605 - DNA, 20 bp, Artificial Sequence
  Description of Artificial Sequence: Synthetic oligonucleotide
  Target: SCN9A; (-) strand; PAM type: NRG; PAM sequence: AGG
ccttctttttgcatcttagt

SEQ ID NO: 23606 - DNA, 20 bp, Artificial Sequence
  Description of Artificial Sequence: Synthetic oligonucleotide
  Target: SCN9A; (-) strand; PAM type: NRG; PAM sequence: TAG
accttctttttgcatcttag

SEQ ID NO: 23607 - DNA, 20 bp, Artificial Sequence
  Description of Artificial Sequence: Synthetic oligonucleotide
  Target: SCN9A; (-) strand; PAM type: NRG; PAM sequence: TAG
gggaccttctttttgcatct

SEQ ID NO: 23608 - DNA, 20 bp, Artificial Sequence
  Description of Artificial Sequence: Synthetic oligonucleotide
  Target: SCN9A; (-) strand; PAM type: NRG; PAM sequence: GGG
cagaacctctgccaactgct

SEQ ID NO: 23609 - DNA, 20 bp, Artificial Sequence
  Description of Artificial Sequence: Synthetic oligonucleotide
  Target: SCN9A; (-) strand; PAM type: NRG; PAM sequence: TGG
tcagaacctctgccaactgc

SEQ ID NO: 23610 - DNA, 20 bp, Artificial Sequence
  Description of Artificial Sequence: Synthetic oligonucleotide
  Target: SCN9A; (-) strand; PAM type: NRG; PAM sequence: CAG
acttcaattccattgaattt

SEQ ID NO: 23611 - DNA, 20 bp, Artificial Sequence
  Description of Artificial Sequence: Synthetic oligonucleotide
  Target: SCN9A; (-) strand; PAM type: NRG; PAM sequence: AAG
aggaaaatcctgagggctag

SEQ ID NO: 23612 - DNA, 20 bp, Artificial Sequence
  Description of Artificial Sequence: Synthetic oligonucleotide
  Target: SCN9A; (-) strand; PAM type: NRG; PAM sequence: TAG
gggaggaaaatcctgagggc

SEQ ID NO: 23613 - DNA, 20 bp, Artificial Sequence
  Description of Artificial Sequence: Synthetic oligonucleotide
  Target: SCN9A; (-) strand; PAM type: NRG; PAM sequence: GGG
ggaggggaggaaaatcctga

SEQ ID NO: 23614 - DNA, 20 bp, Artificial Sequence
  Description of Artificial Sequence: Synthetic oligonucleotide
  Target: SCN9A; (-) strand; PAM type: NRG; PAM sequence: AGG
tggaggggaggaaaatcctg

SEQ ID NO: 23615 - DNA, 20 bp, Artificial Sequence
  Description of Artificial Sequence: Synthetic oligonucleotide
  Target: SCN9A; (-) strand; PAM type: NRG; PAM sequence: GAG
gtggaggggaggaaaatcct

SEQ ID NO: 23616 - DNA, 20 bp, Artificial Sequence
  Description of Artificial Sequence: Synthetic oligonucleotide
  Target: SCN9A; (-) strand; PAM type: NRG; PAM sequence: AGG
ttgggggtggagtggagggg

SEQ ID NO: 23617 - DNA, 20 bp, Artificial Sequence
  Description of Artificial Sequence: Synthetic oligonucleotide
  Target: SCN9A; (-) strand; PAM type: NRG; PAM sequence: GAG
tttgggggtggagtggaggg

SEQ ID NO: 23618 - DNA, 20 bp, Artificial Sequence
  Description of Artificial Sequence: Synthetic oligonucleotide
  Target: SCN9A; (-) strand; PAM type: NRG; PAM sequence: GGG
aatttgggggtggagtggag

SEQ ID NO: 23619 - DNA, 20 bp, Artificial Sequence
  Description of Artificial Sequence: Synthetic oligonucleotide
  Target: SCN9A; (-) strand; PAM type: NRG; PAM sequence: GGG
gaatttgggggtggagtgga

SEQ ID NO: 23620 - DNA, 20 bp, Artificial Sequence
  Description of Artificial Sequence: Synthetic oligonucleotide
  Target: SCN9A; (-) strand; PAM type: NRG; PAM sequence: AGG
agaatttgggggtggagtgg

SEQ ID NO: 23621 - DNA, 20 bp, Artificial Sequence
  Description of Artificial Sequence: Synthetic oligonucleotide
  Target: SCN9A; (-) strand; PAM type: NRG; PAM sequence: GAG
cagaatttgggggtggagtg

SEQ ID NO: 23622 - DNA, 20 bp, Artificial Sequence
  Description of Artificial Sequence: Synthetic oligonucleotide
  Target: SCN9A; (-) strand; PAM type: NRG; PAM sequence: TGG
tccagaatttgggggtggag

SEQ ID NO: 23623 - DNA, 20 bp, Artificial Sequence
  Description of Artificial Sequence: Synthetic oligonucleotide
  Target: SCN9A; (-) strand; PAM type: NRG; PAM sequence: GAG
tcctccagaatttgggggtg

SEQ ID NO: 23624 - DNA, 20 bp, Artificial Sequence
  Description of Artificial Sequence: Synthetic oligonucleotide
  Target: SCN9A; (-) strand; PAM type: NRG; PAM sequence: TGG
attcctccagaatttggggg

SEQ ID NO: 23625 - DNA, 20 bp, Artificial Sequence
  Description of Artificial Sequence: Synthetic oligonucleotide
  Target: SCN9A; (-) strand; PAM type: NRG; PAM sequence: GGG
ctgattcctccagaatttgg

SEQ ID NO: 23626 - DNA, 20 bp, Artificial Sequence
  Description of Artificial Sequence: Synthetic oligonucleotide
  Target: SCN9A; (-) strand; PAM type: NRG; PAM sequence: GGG
cctgattcctccagaatttg

SEQ ID NO: 23627 - DNA, 20 bp, Artificial Sequence
  Description of Artificial Sequence: Synthetic oligonucleotide
  Target: SCN9A; (-) strand; PAM type: NRG; PAM sequence: GGG
gcctgattcctccagaattt

SEQ ID NO: 23628 - DNA, 20 bp, Artificial Sequence
  Description of Artificial Sequence: Synthetic oligonucleotide
  Target: SCN9A; (-) strand; PAM type: NRG; PAM sequence: TGG
tgcctgattcctccagaatt

SEQ ID NO: 23629 - DNA, 20 bp, Artificial Sequence
  Description of Artificial Sequence: Synthetic oligonucleotide
  Target: SCN9A; (-) strand; PAM type: NRG; PAM sequence: CAG
gatggcttgcctgattcctc

SEQ ID NO: 23630 - DNA, 20 bp, Artificial Sequence
  Description of Artificial Sequence: Synthetic oligonucleotide
  Target: SCN9A; (-) strand; PAM type: NRG; PAM sequence: TGG
tgccatagtttcggtttaga

SEQ ID NO: 23631 - DNA, 20 bp, Artificial Sequence
  Description of Artificial Sequence: Synthetic oligonucleotide
  Target: SCN9A; (-) strand; PAM type: NRG; PAM sequence: TAG
tcattgccatagtttcggtt

SEQ ID NO: 23632 - DNA, 20 bp, Artificial Sequence
  Description of Artificial Sequence: Synthetic oligonucleotide
  Target: SCN9A; (-) strand; PAM type: NRG; PAM sequence: CGG
ctgagtcattgccatagttt

SEQ ID NO: 23633 - DNA, 20 bp, Artificial Sequence
  Description of Artificial Sequence: Synthetic oligonucleotide
  Target: SCN9A; (-) strand; PAM type: NRG; PAM sequence: TAG
caaggactgagtcattgcca

SEQ ID NO: 23634 - DNA, 20 bp, Artificial Sequence
  Description of Artificial Sequence: Synthetic oligonucleotide
  Target: SCN9A; (-) strand; PAM type: NRG; PAM sequence: GAG
gtctttgtatttcaaggact

SEQ ID NO: 23635 - DNA, 20 bp, Artificial Sequence
  Description of Artificial Sequence: Synthetic oligonucleotide
  Target: SCN9A; (-) strand; PAM type: NRG; PAM sequence: AGG
ttccttgtctttgtatttca

SEQ ID NO: 23636 - DNA, 20 bp, Artificial Sequence
  Description of Artificial Sequence: Synthetic oligonucleotide
  Target: SCN9A; (-) strand; PAM type: NRG; PAM sequence: AAG
cttccttgtctttgtatttc

SEQ ID NO: 23637 - DNA, 20 bp, Artificial Sequence
  Description of Artificial Sequence: Synthetic oligonucleotide
  Target: SCN9A; (-) strand; PAM type: NRG; PAM sequence: AAG
gcttcgttttccttgtgact

SEQ ID NO: 23638 - DNA, 20 bp, Artificial Sequence
  Description of Artificial Sequence: Synthetic oligonucleotide
  Target: SCN9A; (-) strand; PAM type: NRG; PAM sequence: AGG
tgtacaccagttctagaaac

SEQ ID NO: 23639 - DNA, 20 bp, Artificial Sequence
  Description of Artificial Sequence: Synthetic oligonucleotide
  Target: SCN9A; (-) strand; PAM type: NRG; PAM sequence: CAG
ctgtacaccagttctagaaa

SEQ ID NO: 23640 - DNA, 20 bp, Artificial Sequence
  Description of Artificial Sequence: Synthetic oligonucleotide
  Target: SCN9A; (-) strand; PAM type: NRG; PAM sequence: TAG
ctgaccctgtacaccagttc

SEQ ID NO: 23641 - DNA, 20 bp, Artificial Sequence
  Description of Artificial Sequence: Synthetic oligonucleotide
  Target: SCN9A; (-) strand; PAM type: NRG; PAM sequence: CAG
tctgctctgaccctgtacac

SEQ ID NO: 23642 - DNA, 20 bp, Artificial Sequence
  Description of Artificial Sequence: Synthetic oligonucleotide
  Target: SCN9A; (-) strand; PAM type: NRG; PAM sequence: CGG
ctcatcatcaagacttcctg

SEQ ID NO: 23643 - DNA, 20 bp, Artificial Sequence
  Description of Artificial Sequence: Synthetic oligonucleotide
  Target: SCN9A; (-) strand; PAM type: NRG; PAM sequence: AAG
agagagaggttctcatcatc

SEQ ID NO: 23644 - DNA, 20 bp, Artificial Sequence
  Description of Artificial Sequence: Synthetic oligonucleotide
  Target: SCN9A; (-) strand; PAM type: NRG; PAM sequence: AGG
ctctgggaccagtcagagag

SEQ ID NO: 23645 - DNA, 20 bp, Artificial Sequence
  Description of Artificial Sequence: Synthetic oligonucleotide
  Target: SCN9A; (-) strand; PAM type: NRG; PAM sequence: GAG
gctctgggaccagtcagaga

SEQ ID NO: 23646 - DNA, 20 bp, Artificial Sequence
  Description of Artificial Sequence: Synthetic oligonucleotide
  Target: SCN9A; (-) strand; PAM type: NRG; PAM sequence: GAG
ctgctctgggaccagtcaga

SEQ ID NO: 23647 - DNA, 20 bp, Artificial Sequence
  Description of Artificial Sequence: Synthetic oligonucleotide
  Target: SCN9A; (-) strand; PAM type: NRG; PAM sequence: GAG
tcctgctctgggaccagtca

SEQ ID NO: 23648 - DNA, 20 bp, Artificial Sequence
  Description of Artificial Sequence: Synthetic oligonucleotide
  Target: SCN9A; (-) strand; PAM type: NRG; PAM sequence: CAG
attcctgctctgggaccagt

SEQ ID NO: 23649 - DNA, 20 bp, Artificial Sequence
  Description of Artificial Sequence: Synthetic oligonucleotide
  Target: SCN9A; (-) strand; PAM type: NRG; PAM sequence: CAG
tctaattcctgctctgggac

SEQ ID NO: 23650 - DNA, 20 bp, Artificial Sequence
  Description of Artificial Sequence: Synthetic oligonucleotide
  Target: SCN9A; (-) strand; PAM type: NRG; PAM sequence: GGG
tgaattctaattcctgctct

SEQ ID NO: 23651 - DNA, 20 bp, Artificial Sequence
  Description of Artificial Sequence: Synthetic oligonucleotide
  Target: SCN9A; (-) strand; PAM type: NRG; PAM sequence: TGG
ctgaattctaattcctgctc

SEQ ID NO: 23652 - DNA, 20 bp, Artificial Sequence
  Description of Artificial Sequence: Synthetic oligonucleotide
  Target: SCN9A; (-) strand; PAM type: NRG; PAM sequence: GGG
ctggaagctagaacccctgt

SEQ ID NO: 23653 - DNA, 20 bp, Artificial Sequence
  Description of Artificial Sequence: Synthetic oligonucleotide
  Target: SCN9A; (-) strand; PAM type: NRG; PAM sequence: TGG
tctggaagctagaacccctg

SEQ ID NO: 23654 - DNA, 20 bp, Artificial Sequence
  Description of Artificial Sequence: Synthetic oligonucleotide
  Target: SCN9A; (-) strand; PAM type: NRG; PAM sequence: TAG
acaaaattggttctggaagc

SEQ ID NO: 23655 - DNA, 20 bp, Artificial Sequence
  Description of Artificial Sequence: Synthetic oligonucleotide
  Target: SCN9A; (-) strand; PAM type: NRG; PAM sequence: AAG
atccacaaaattggttctgg

SEQ ID NO: 23656 - DNA, 20 bp, Artificial Sequence
  Description of Artificial Sequence: Synthetic oligonucleotide
  Target: SCN9A; (-) strand; PAM type: NRG; PAM sequence: TGG
tacatccacaaaattggttc

SEQ ID NO: 23657 - DNA, 20 bp, Artificial Sequence
  Description of Artificial Sequence: Synthetic oligonucleotide
  Target: SCN9A; (-) strand; PAM type: NRG; PAM sequence: TGG
tgctcctacatccacaaaat

SEQ ID NO: 23658 - DNA, 20 bp, Artificial Sequence
  Description of Artificial Sequence: Synthetic oligonucleotide
  Target: SCN9A; (-) strand; PAM type: NRG; PAM sequence: AGG
aatcagatagagctcacata

SEQ ID NO: 23659 - DNA, 20 bp, Artificial Sequence
  Description of Artificial Sequence: Synthetic oligonucleotide
  Target: SCN9A; (-) strand; PAM type: NRG; PAM sequence: AAG
aaatcagatagagctcacat

SEQ ID NO: 23660 - DNA, 20 bp, Artificial Sequence
  Description of Artificial Sequence: Synthetic oligonucleotide
  Target: SCN9A; (-) strand; PAM type: NRG; PAM sequence: GAG
gttaagtcctaaatcagata

SEQ ID NO: 23661 - DNA, 20 bp, Artificial Sequence
  Description of Artificial Sequence: Synthetic oligonucleotide
  Target: SCN9A; (-) strand; PAM type: NRG; PAM sequence: TAG
gcgttaagtcctaaatcaga

SEQ ID NO: 23662 - DNA, 20 bp, Artificial Sequence
  Description of Artificial Sequence: Synthetic oligonucleotide
  Target: SCN9A; (-) strand; PAM type: NRG; PAM sequence: CAG
taaagcgttaagtcctaaat

SEQ ID NO: 23663 - DNA, 20 bp, Artificial Sequence
  Description of Artificial Sequence: Synthetic oligonucleotide
  Target: SCN9A; (-) strand; PAM type: NRG; PAM sequence: AAG
tttagtaacagtaaagcgtt

SEQ ID NO: 23664 - DNA, 20 bp, Artificial Sequence
  Description of Artificial Sequence: Synthetic oligonucleotide
  Target: SCN9A; (-) strand; PAM type: NRG; PAM sequence: AAG
aactgaatttagtaacagta

SEQ ID NO: 23665 - DNA, 20 bp, Artificial Sequence
  Description of Artificial Sequence: Synthetic oligonucleotide
  Target: SCN9A; (-) strand; PAM type: NRG; PAM sequence: CAG
gtggtaactgaatttagtaa

SEQ ID NO: 23666 - DNA, 20 bp, Artificial Sequence
  Description of Artificial Sequence: Synthetic oligonucleotide
  Target: SCN9A; (-) strand; PAM type: NRG; PAM sequence: TAG
aaatgagtggtaactgaatt

SEQ ID NO: 23667 - DNA, 20 bp, Artificial Sequence
  Description of Artificial Sequence: Synthetic oligonucleotide
  Target: SCN9A; (-) strand; PAM type: NRG; PAM sequence: TGG
acaaaacagaaataaatgag

SEQ ID NO: 23668 - DNA, 20 bp, Artificial Sequence
  Description of Artificial Sequence: Synthetic oligonucleotide
  Target: SCN9A; (-) strand; PAM type: NRG; PAM sequence: GAG
tacacaaaacagaaataaat

SEQ ID NO: 23669 - DNA, 20 bp, Artificial Sequence
  Description of Artificial Sequence: Synthetic oligonucleotide
  Target: SCN9A; (-) strand; PAM type: NRG; PAM sequence: CAG
aaagaagagtatacacaaaa

SEQ ID NO: 23670 - DNA, 20 bp, Artificial Sequence
  Description of Artificial Sequence: Synthetic oligonucleotide
  Target: SCN9A; (-) strand; PAM type: NRG; PAM sequence: GAG
ttgtggctcctcagaaagaa

SEQ ID NO: 23671 - DNA, 20 bp, Artificial Sequence
  Description of Artificial Sequence: Synthetic oligonucleotide
  Target: SCN9A; (-) strand; PAM type: NRG; PAM sequence: AAG
tgttgtggctcctcagaaag

SEQ ID NO: 23672 - DNA, 20 bp, Artificial Sequence
  Description of Artificial Sequence: Synthetic oligonucleotide
  Target: SCN9A; (-) strand; PAM type: NRG; PAM sequence: AAG
ctgtgttgtggctcctcaga

SEQ ID NO: 23673 - DNA, 20 bp, Artificial Sequence
  Description of Artificial Sequence: Synthetic oligonucleotide
  Target: SCN9A; (-) strand; PAM type: NRG; PAM sequence: CAG
ttcactgtgttgtggctcct

SEQ ID NO: 23674 - DNA, 20 bp, Artificial Sequence
  Description of Artificial Sequence: Synthetic oligonucleotide
  Target: SCN9A; (-) strand; PAM type: NRG; PAM sequence: TGG
catatcttttcactgtgttg

SEQ ID NO: 23675 - DNA, 20 bp, Artificial Sequence
  Description of Artificial Sequence: Synthetic oligonucleotide
  Target: SCN9A; (-) strand; PAM type: NRG; PAM sequence: AAG
tgaattgacatctaaaatca

SEQ ID NO: 23676 - DNA, 20 bp, Artificial Sequence
  Description of Artificial Sequence: Synthetic oligonucleotide
  Target: SCN9A; (-) strand; PAM type: NRG; PAM sequence: GAG
cccaaagctagtaaatgaca

SEQ ID NO: 23677 - DNA, 20 bp, Artificial Sequence
  Description of Artificial Sequence: Synthetic oligonucleotide
  Target: SCN9A; (-) strand; PAM type: NRG; PAM sequence: CAG
gtcccaaagctagtaaatga

SEQ ID NO: 23678 - DNA, 20 bp, Artificial Sequence
  Description of Artificial Sequence: Synthetic oligonucleotide
  Target: SCN9A; (-) strand; PAM type: NRG; PAM sequence: TAG
gttgcttaatgtcccaaagc

SEQ ID NO: 23679 - DNA, 20 bp, Artificial Sequence
  Description of Artificial Sequence: Synthetic oligonucleotide
  Target: SCN9A; (-) strand; PAM type: NRG; PAM sequence: AAG
aaaagttgcttaatgtccca

SEQ ID NO: 23680 - DNA, 20 bp, Artificial Sequence
  Description of Artificial Sequence: Synthetic oligonucleotide
  Target: SCN9A; (-) strand; PAM type: NRG; PAM sequence: AAG
gaagctgggtacagttttaa

SEQ ID NO: 23681 - DNA, 20 bp, Artificial Sequence
  Description of Artificial Sequence: Synthetic oligonucleotide
  Target: SCN9A; (-) strand; PAM type: NRG; PAM sequence: CAG
accaatgatgaagctgggta

SEQ ID NO: 23682 - DNA, 20 bp, Artificial Sequence
  Description of Artificial Sequence: Synthetic oligonucleotide
  Target: SCN9A; (-) strand; PAM type: NRG; PAM sequence: GGG
attttaccaatgatgaagct

SEQ ID NO: 23683 - DNA, 20 bp, Artificial Sequence
  Description of Artificial Sequence: Synthetic oligonucleotide
  Target: SCN9A; (-) strand; PAM type: NRG; PAM sequence: TGG
tattttaccaatgatgaagc

SEQ ID NO: 23684 - DNA, 20 bp, Artificial Sequence
  Description of Artificial Sequence: Synthetic oligonucleotide
  Target: SCN9A; (-) strand; PAM type: NRG; PAM sequence: AAG
tgcttattttaccaatgatg

SEQ ID NO: 23685 - DNA, 20 bp, Artificial Sequence
  Description of Artificial Sequence: Synthetic oligonucleotide
  Target: SCN9A; (-) strand; PAM type: NRG; PAM sequence: GAG
taattttcaaacaaccctgt

SEQ ID NO: 23686 - DNA, 20 bp, Artificial Sequence
  Description of Artificial Sequence: Synthetic oligonucleotide
  Target: SCN9A; (-) strand; PAM type: NRG; PAM sequence: TAG
tgtgtttcagaatcttcttt

SEQ ID NO: 23687 - DNA, 20 bp, Artificial Sequence
  Description of Artificial Sequence: Synthetic oligonucleotide
  Target: SCN9A; (-) strand; PAM type: NRG; PAM sequence: CAG
agcttatacttattgtgttt

SEQ ID NO: 23688 - DNA, 20 bp, Artificial Sequence
  Description of Artificial Sequence: Synthetic oligonucleotide
  Target: SCN9A; (-) strand; PAM type: NRG; PAM sequence: TAG
aagaagtaatagctctcatt

SEQ ID NO: 23689 - DNA, 20 bp, Artificial Sequence
  Description of Artificial Sequence: Synthetic oligonucleotide
  Target: SCN9A; (-) strand; PAM type: NRG; PAM sequence: TAG
taaaagttaaaaagaagtaa

SEQ ID NO: 23690 - DNA, 20 bp, Artificial Sequence
  Description of Artificial Sequence: Synthetic oligonucleotide
  Target: SCN9A; (-) strand; PAM type: NRG; PAM sequence: AAG
ctaaaataaaagttaaaaag

SEQ ID NO: 23691 - DNA, 20 bp, Artificial Sequence
  Description of Artificial Sequence: Synthetic oligonucleotide
  Target: SCN9A; (-) strand; PAM type: NRG; PAM sequence: AAG
aacctaaaataaaagttaaa

SEQ ID NO: 23692 - DNA, 20 bp, Artificial Sequence
  Description of Artificial Sequence: Synthetic oligonucleotide
  Target: SCN9A; (-) strand; PAM type: NRG; PAM sequence: AAG
taccctcaaacctaaaataa

SEQ ID NO: 23693 - DNA, 20 bp, Artificial Sequence
  Description of Artificial Sequence: Synthetic oligonucleotide
  Target: SCN9A; (-) strand; PAM type: NRG; PAM sequence: TAG
aactagattttttaaaagta

SEQ ID NO: 23694 - DNA, 20 bp, Artificial Sequence
  Description of Artificial Sequence: Synthetic oligonucleotide
  Target: SCN9A; (-) strand; PAM type: NRG; PAM sequence: AAG
aattaaactagattttttaa

SEQ ID NO: 23695 - DNA, 20 bp, Artificial Sequence
  Description of Artificial Sequence: Synthetic oligonucleotide
  Target: SCN9A; (-) strand; PAM type: NRG; PAM sequence: TAG
agacaggttgccaattaaac

SEQ ID NO: 23696 - DNA, 20 bp, Artificial Sequence
  Description of Artificial Sequence: Synthetic oligonucleotide
  Target: SCN9A; (-) strand; PAM type: NRG; PAM sequence: AGG
gctggtgtttgtacttagac

SEQ ID NO: 23697 - DNA, 20 bp, Artificial Sequence
  Description of Artificial Sequence: Synthetic oligonucleotide
  Target: SCN9A; (-) strand; PAM type: NRG; PAM sequence: CAG
agctggtgtttgtacttaga

SEQ ID NO: 23698 - DNA, 20 bp, Artificial Sequence
  Description of Artificial Sequence: Synthetic oligonucleotide
  Target: SCN9A; (-) strand; PAM type: NRG; PAM sequence: TAG
aagaagctggtgtttgtact

SEQ ID NO: 23699 - DNA, 20 bp, Artificial Sequence
  Description of Artificial Sequence: Synthetic oligonucleotide
  Target: SCN9A; (-) strand; PAM type: NRG; PAM sequence: TGG
ggaaagatatttcaagaagc

SEQ ID NO: 23700 - DNA, 20 bp, Artificial Sequence
  Description of Artificial Sequence: Synthetic oligonucleotide
  Target: SCN9A; (-) strand; PAM type: NRG; PAM sequence: AAG
aaagggaaagatatttcaag

SEQ ID NO: 23701 - DNA, 20 bp, Artificial Sequence
  Description of Artificial Sequence: Synthetic oligonucleotide
  Target: SCN9A; (-) strand; PAM type: NRG; PAM sequence: AAG
agaaaagggaaagatatttc

SEQ ID NO: 23702 - DNA, 20 bp, Artificial Sequence
  Description of Artificial Sequence: Synthetic oligonucleotide
  Target: SCN9A; (-) strand; PAM type: NRG; PAM sequence: AAG
catatgaggaagaaaaggga

SEQ ID NO: 23703 - DNA, 20 bp, Artificial Sequence
  Description of Artificial Sequence: Synthetic oligonucleotide
  Target: SCN9A; (-) strand; PAM type: NRG; PAM sequence: GGG
aaatcatatgaggaagaaaa

SEQ ID NO: 23704 - DNA, 20 bp, Artificial Sequence
  Description of Artificial Sequence: Synthetic oligonucleotide
  Target: SCN9A; (-) strand; PAM type: NRG; PAM sequence: AGG
taaatcatatgaggaagaaa

SEQ ID NO: 23705 - DNA, 20 bp, Artificial Sequence
  Description of Artificial Sequence: Synthetic oligonucleotide
  Target: SCN9A; (-) strand; PAM type: NRG; PAM sequence: AAG
ataaatcatatgaggaagaa

SEQ ID NO: 23706 - DNA, 20 bp, Artificial Sequence
  Description of Artificial Sequence: Synthetic oligonucleotide
  Target: SCN9A; (-) strand; PAM type: NRG; PAM sequence: AAG
tttaaataaatcatatgagg

SEQ ID NO: 23707 - DNA, 20 bp, Artificial Sequence
  Description of Artificial Sequence: Synthetic oligonucleotide
  Target: SCN9A; (-) strand; PAM type: NRG; PAM sequence: AGG
tattttaaataaatcatatg

SEQ ID NO: 23708 - DNA, 20 bp, Artificial Sequence
  Description of Artificial Sequence: Synthetic oligonucleotide
  Target: SCN9A; (-) strand; PAM type: NRG; PAM sequence: GAG
gtattttaaataaatcatat

SEQ ID NO: 23709 - DNA, 20 bp, Artificial Sequence
  Description of Artificial Sequence: Synthetic oligonucleotide
  Target: SCN9A; (-) strand; PAM type: NRG; PAM sequence: AAG
tttggggagggcattctcaa

SEQ ID NO: 23710 - DNA, 20 bp, Artificial Sequence
  Description of Artificial Sequence: Synthetic oligonucleotide
  Target: SCN9A; (-) strand; PAM type: NRG; PAM sequence: GGG
cagaggaagacatttgggga

SEQ ID NO: 23711 - DNA, 20 bp, Artificial Sequence
  Description of Artificial Sequence: Synthetic oligonucleotide
  Target: SCN9A; (-) strand; PAM type: NRG; PAM sequence: AGG
acagaggaagacatttgggg

SEQ ID NO: 23712 - DNA, 20 bp, Artificial Sequence
  Description of Artificial Sequence: Synthetic oligonucleotide
  Target: SCN9A; (-) strand; PAM type: NRG; PAM sequence: GAG
aacagaggaagacatttggg

SEQ ID NO: 23713 - DNA, 20 bp, Artificial Sequence
  Description of Artificial Sequence: Synthetic oligonucleotide
  Target: SCN9A; (-) strand; PAM type: NRG; PAM sequence: GGG
aaaacagaggaagacatttg

SEQ ID NO: 23714 - DNA, 20 bp, Artificial Sequence
  Description of Artificial Sequence: Synthetic oligonucleotide
  Target: SCN9A; (-) strand; PAM type: NRG; PAM sequence: GGG
taaaacagaggaagacattt

SEQ ID NO: 23715 - DNA, 20 bp, Artificial Sequence
  Description of Artificial Sequence: Synthetic oligonucleotide
  Target: SCN9A; (-) strand; PAM type: NRG; PAM sequence: TGG
ctaaaacagaggaagacatt

SEQ ID NO: 23716 - DNA, 20 bp, Artificial Sequence
  Description of Artificial Sequence: Synthetic oligonucleotide
  Target: SCN9A; (-) strand; PAM type: NRG; PAM sequence: AAG
caaaatgtctaaaacagagg

SEQ ID NO: 23717 - DNA, 20 bp, Artificial Sequence
  Description of Artificial Sequence: Synthetic oligonucleotide
  Target: SCN9A; (-) strand; PAM type: NRG; PAM sequence: AGG
gttcaaaatgtctaaaacag

SEQ ID NO: 23718 - DNA, 20 bp, Artificial Sequence
  Description of Artificial Sequence: Synthetic oligonucleotide
  Target: SCN9A; (-) strand; PAM type: NRG; PAM sequence: GAG
tgttcaaaatgtctaaaaca

SEQ ID NO: 23719 - DNA, 20 bp, Artificial Sequence
  Description of Artificial Sequence: Synthetic oligonucleotide
  Target: SCN9A; (-) strand; PAM type: NRG; PAM sequence: CAG
cttgttcaaaatgtctaaaa

SEQ ID NO: 23720 - DNA, 20 bp, Artificial Sequence
  Description of Artificial Sequence: Synthetic oligonucleotide
  Target: SCN9A; (-) strand; PAM type: NRG; PAM sequence: GAG
tacaaaaaaattaaagtttg

SEQ ID NO: 23721 - DNA, 20 bp, Artificial Sequence
  Description of Artificial Sequence: Synthetic oligonucleotide
  Target: SCN9A; (-) strand; PAM type: NRG; PAM sequence: TGG
attacaaaaaaattaaagtt

SEQ ID NO: 23722 - DNA, 20 bp, Artificial Sequence
  Description of Artificial Sequence: Synthetic oligonucleotide
  Target: SCN9A; (-) strand; PAM type: NRG; PAM sequence: AAG
aggagattacaaaaaaatta

SEQ ID NO: 23723 - DNA, 20 bp, Artificial Sequence
  Description of Artificial Sequence: Synthetic oligonucleotide
  Target: SCN9A; (-) strand; PAM type: NRG; PAM sequence: GAG
tgactgagaatttcagagag

SEQ ID NO: 23724 - DNA, 20 bp, Artificial Sequence
  Description of Artificial Sequence: Synthetic oligonucleotide
  Target: SCN9A; (-) strand; PAM type: NRG; PAM sequence: AGG
tgtgactgagaatttcagag

SEQ ID NO: 23725 - DNA, 20 bp, Artificial Sequence
  Description of Artificial Sequence: Synthetic oligonucleotide
  Target: SCN9A; (-) strand; PAM type: NRG; PAM sequence: GAG
atgtgactgagaatttcaga

SEQ ID NO: 23726 - DNA, 20 bp, Artificial Sequence
  Description of Artificial Sequence: Synthetic oligonucleotide
  Target: SCN9A; (-) strand; PAM type: NRG; PAM sequence: GAG
atatgtgactgagaatttca

SEQ ID NO: 23727 - DNA, 20 bp, Artificial Sequence
  Description of Artificial Sequence: Synthetic oligonucleotide
  Target: SCN9A; (-) strand; PAM type: NRG; PAM sequence: CAG
acatatgtgactgagaattt

SEQ ID NO: 23728 - DNA, 20 bp, Artificial Sequence
  Description of Artificial Sequence: Synthetic oligonucleotide
  Target: SCN9A; (-) strand; PAM type: NRG; PAM sequence: GAG
gctgactcacatatgtgact

SEQ ID NO: 23729 - DNA, 20 bp, Artificial Sequence
  Description of Artificial Sequence: Synthetic oligonucleotide
  Target: SCN9A; (-) strand; PAM type: NRG; PAM sequence: AGG
tgtattcctagtaactaagg

SEQ ID NO: 23730 - DNA, 20 bp, Artificial Sequence
  Description of Artificial Sequence: Synthetic oligonucleotide
  Target: SCN9A; (-) strand; PAM type: NRG; PAM sequence: GAG
atgtattcctagtaactaag

SEQ ID NO: 23731 - DNA, 20 bp, Artificial Sequence
  Description of Artificial Sequence: Synthetic oligonucleotide
  Target: SCN9A; (-) strand; PAM type: NRG; PAM sequence: AGG
caatgtattcctagtaacta

SEQ ID NO: 23732 - DNA, 20 bp, Artificial Sequence
  Description of Artificial Sequence: Synthetic oligonucleotide
  Target: SCN9A; (-) strand; PAM type: NRG; PAM sequence: AAG
gcaatgtattcctagtaact

SEQ ID NO: 23733 - DNA, 20 bp, Artificial Sequence
  Description of Artificial Sequence: Synthetic oligonucleotide
  Target: SCN9A; (-) strand; PAM type: NRG; PAM sequence: TAG
tctaccatgcaatgtattcc

SEQ ID NO: 23734 - DNA, 20 bp, Artificial Sequence
  Description of Artificial Sequence: Synthetic oligonucleotide
  Target: SCN9A; (-) strand; PAM type: NRG; PAM sequence: TAG
catccaagtagaaatcatga

SEQ ID NO: 23735 - DNA, 20 bp, Artificial Sequence
  Description of Artificial Sequence: Synthetic oligonucleotide
  Target: SCN9A; (-) strand; PAM type: NRG; PAM sequence: TAG
cttacctggagtcatccaag

SEQ ID NO: 23736 - DNA, 20 bp, Artificial Sequence
  Description of Artificial Sequence: Synthetic oligonucleotide
  Target: SCN9A; (-) strand; PAM type: NRG; PAM sequence: AAG
ttccttacctggagtcatcc

SEQ ID NO: 23737 - DNA, 20 bp, Artificial Sequence
  Description of Artificial Sequence: Synthetic oligonucleotide
  Target: SCN9A; (-) strand; PAM type: NRG; PAM sequence: GAG
agctctattttccttacctg

SEQ ID NO: 23738 - DNA, 20 bp, Artificial Sequence
  Description of Artificial Sequence: Synthetic oligonucleotide
  Target: SCN9A; (-) strand; PAM type: NRG; PAM sequence: TGG
aaagctctattttccttacc

SEQ ID NO: 23739 - DNA, 20 bp, Artificial Sequence
  Description of Artificial Sequence: Synthetic oligonucleotide
  Target: SCN9A; (-) strand; PAM type: NRG; PAM sequence: AAG
aacagaaaatgtgatcagaa

SEQ ID NO: 23740 - DNA, 20 bp, Artificial Sequence
  Description of Artificial Sequence: Synthetic oligonucleotide
  Target: SCN9A; (-) strand; PAM type: NRG; PAM sequence: CAG
tcagaaacagaaaatgtgat

SEQ ID NO: 23741 - DNA, 20 bp, Artificial Sequence
  Description of Artificial Sequence: Synthetic oligonucleotide
  Target: SCN9A; (-) strand; PAM type: NRG; PAM sequence: CAG
caagtctcaactctcagaaa

SEQ ID NO: 23742 - DNA, 20 bp, Artificial Sequence
  Description of Artificial Sequence: Synthetic oligonucleotide
  Target: SCN9A; (-) strand; PAM type: NRG; PAM sequence: CAG
tcctatcaagtctcaactct

SEQ ID NO: 23743 - DNA, 20 bp, Artificial Sequence
  Description of Artificial Sequence: Synthetic oligonucleotide
  Target: SCN9A; (-) strand; PAM type: NRG; PAM sequence: AAG
tgtggctttcctttcctatc

SEQ ID NO: 23744 - DNA, 20 bp, Artificial Sequence
  Description of Artificial Sequence: Synthetic oligonucleotide
  Target: SCN9A; (-) strand; PAM type: NRG; PAM sequence: TGG
caacctgcagggacccactg

SEQ ID NO: 23745 - DNA, 20 bp, Artificial Sequence
  Description of Artificial Sequence: Synthetic oligonucleotide
  Target: SCN9A; (-) strand; PAM type: NRG; PAM sequence: GGG
acactccccaacaacctgca

SEQ ID NO: 23746 - DNA, 20 bp, Artificial Sequence
  Description of Artificial Sequence: Synthetic oligonucleotide
  Target: SCN9A; (-) strand; PAM type: NRG; PAM sequence: AGG
cacactccccaacaacctgc

SEQ ID NO: 23747 - DNA, 20 bp, Artificial Sequence
  Description of Artificial Sequence: Synthetic oligonucleotide
  Target: SCN9A; (-) strand; PAM type: NRG; PAM sequence: CAG
gcacactccccaacaacctg

SEQ ID NO: 23748 - DNA, 20 bp, Artificial Sequence
  Description of Artificial Sequence: Synthetic oligonucleotide
  Target: SCN9A; (-) strand; PAM type: NRG; PAM sequence: TGG
caggcagagcctggcattct

SEQ ID NO: 23749 - DNA, 20 bp, Artificial Sequence
  Description of Artificial Sequence: Synthetic oligonucleotide
  Target: SCN9A; (-) strand; PAM type: NRG; PAM sequence: TGG
ggtaaggagcaggcagagcc

SEQ ID NO: 23750 - DNA, 20 bp, Artificial Sequence
  Description of Artificial Sequence: Synthetic oligonucleotide
  Target: SCN9A; (-) strand; PAM type: NRG; PAM sequence: GAG
tcctaggtaaggagcaggca

SEQ ID NO: 23751 - DNA, 20 bp, Artificial Sequence
  Description of Artificial Sequence: Synthetic oligonucleotide
  Target: SCN9A; (-) strand; PAM type: NRG; PAM sequence: CAG
tgtcctaggtaaggagcagg

SEQ ID NO: 23752 - DNA, 20 bp, Artificial Sequence
  Description of Artificial Sequence: Synthetic oligonucleotide
  Target: SCN9A; (-) strand; PAM type: NRG; PAM sequence: AGG
gaatgtcctaggtaaggagc

SEQ ID NO: 23753 - DNA, 20 bp, Artificial Sequence
  Description of Artificial Sequence: Synthetic oligonucleotide
  Target: SCN9A; (-) strand; PAM type: NRG; PAM sequence: CAG
ggaatgtcctaggtaaggag

SEQ ID NO: 23754 - DNA, 20 bp, Artificial Sequence
  Description of Artificial Sequence: Synthetic oligonucleotide
  Target: SCN9A; (-) strand; PAM type: NRG; PAM sequence: GAG
tgaggaatgtcctaggtaag

SEQ ID NO: 23755 - DNA, 20 bp, Artificial Sequence
  Description of Artificial Sequence: Synthetic oligonucleotide
  Target: SCN9A; (-) strand; PAM type: NRG; PAM sequence: AGG
cctgaggaatgtcctaggta

SEQ ID NO: 23756 - DNA, 20 bp, Artificial Sequence
  Description of Artificial Sequence: Synthetic oligonucleotide
  Target: SCN9A; (-) strand; PAM type: NRG; PAM sequence: AAG
ccctgaggaatgtcctaggt

SEQ ID NO: 23757 - DNA, 20 bp, Artificial Sequence
  Description of Artificial Sequence: Synthetic oligonucleotide
  Target: SCN9A; (-) strand; PAM type: NRG; PAM sequence: AGG
acaaccctgaggaatgtcct

SEQ ID NO: 23758 - DNA, 20 bp, Artificial Sequence
  Description of Artificial Sequence: Synthetic oligonucleotide
  Target: SCN9A; (-) strand; PAM type: NRG; PAM sequence: TAG
cacaaccctgaggaatgtcc

SEQ ID NO: 23759 - DNA, 20 bp, Artificial Sequence
  Description of Artificial Sequence: Synthetic oligonucleotide
  Target: SCN9A; (-) strand; PAM type: NRG; PAM sequence: AGG
tcactgcaaacacaaccctg

SEQ ID NO: 23760 - DNA, 20 bp, Artificial Sequence
  Description of Artificial Sequence: Synthetic oligonucleotide
  Target: SCN9A; (-) strand; PAM type: NRG; PAM sequence: GAG
ctcactgcaaacacaaccct

SEQ ID NO: 23761 - DNA, 20 bp, Artificial Sequence
  Description of Artificial Sequence: Synthetic oligonucleotide
  Target: SCN9A; (-) strand; PAM type: NRG; PAM sequence: AGG
agaccctacctcatgtctca

SEQ ID NO: 23762 - DNA, 20 bp, Artificial Sequence
  Description of Artificial Sequence: Synthetic oligonucleotide
  Target: SCN9A; (-) strand; PAM type: NRG; PAM sequence: AAG
gagaccctacctcatgtctc

SEQ ID NO: 23763 - DNA, 20 bp, Artificial Sequence
  Description of Artificial Sequence: Synthetic oligonucleotide
  Target: SCN9A; (-) strand; PAM type: NRG; PAM sequence: GAG
caaccctgctctttgtccca

SEQ ID NO: 23764 - DNA, 20 bp, Artificial Sequence
  Description of Artificial Sequence: Synthetic oligonucleotide
  Target: SCN9A; (-) strand; PAM type: NRG; PAM sequence: CAG
agcaaccctgctctttgtcc

SEQ ID NO: 23765 - DNA, 20 bp, Artificial Sequence
  Description of Artificial Sequence: Synthetic oligonucleotide
  Target: SCN9A; (-) strand; PAM type: NRG; PAM sequence: AAG
ccttttataccaagcaacat

SEQ ID NO: 23766 - DNA, 20 bp, Artificial Sequence
  Description of Artificial Sequence: Synthetic oligonucleotide
  Target: SCN9A; (-) strand; PAM type: NRG; PAM sequence: AAG
ggaatgcatccttttatacc

SEQ ID NO: 23767 - DNA, 20 bp, Artificial Sequence
  Description of Artificial Sequence: Synthetic oligonucleotide
  Target: SCN9A; (-) strand; PAM type: NRG; PAM sequence: GGG
gctgaggaacactgagctta

SEQ ID NO: 23768 - DNA, 20 bp, Artificial Sequence
  Description of Artificial Sequence: Synthetic oligonucleotide
  Target: SCN9A; (-) strand; PAM type: NRG; PAM sequence: AGG
agctgaggaacactgagctt

SEQ ID NO: 23769 - DNA, 20 bp, Artificial Sequence
  Description of Artificial Sequence: Synthetic oligonucleotide
  Target: SCN9A; (-) strand; PAM type: NRG; PAM sequence: TAG
cagctgaggaacactgagct

SEQ ID NO: 23770 - DNA, 20 bp, Artificial Sequence
  Description of Artificial Sequence: Synthetic oligonucleotide
  Target: SCN9A; (-) strand; PAM type: NRG; PAM sequence: GAG
tgtcacagctgaggaacact

SEQ ID NO: 23771 - DNA, 20 bp, Artificial Sequence
  Description of Artificial Sequence: Synthetic oligonucleotide
  Target: SCN9A; (-) strand; PAM type: NRG; PAM sequence: AGG
gtggattgatgtcacagctg

SEQ ID NO: 23772 - DNA, 20 bp, Artificial Sequence
  Description of Artificial Sequence: Synthetic oligonucleotide
  Target: SCN9A; (-) strand; PAM type: NRG; PAM sequence: GAG
agtggattgatgtcacagct

SEQ ID NO: 23773 - DNA, 20 bp, Artificial Sequence
  Description of Artificial Sequence: Synthetic oligonucleotide
  Target: SCN9A; (-) strand; PAM type: NRG; PAM sequence: CAG
catatagtggattgatgtca

SEQ ID NO: 23774 - DNA, 20 bp, Artificial Sequence
  Description of Artificial Sequence: Synthetic oligonucleotide
  Target: SCN9A; (-) strand; PAM type: NRG; PAM sequence: TGG
atgagtgtgtacacatatag

SEQ ID NO: 23775 - DNA, 20 bp, Artificial Sequence
  Description of Artificial Sequence: Synthetic oligonucleotide
  Target: SCN9A; (-) strand; PAM type: NRG; PAM sequence: TAG
tgaatgagtgtgtacacata

SEQ ID NO: 23776 - DNA, 20 bp, Artificial Sequence
  Description of Artificial Sequence: Synthetic oligonucleotide
  Target: SCN9A; (-) strand; PAM type: NRG; PAM sequence: GAG
ggcattatatgagcctgaat

SEQ ID NO: 23777 - DNA, 20 bp, Artificial Sequence
  Description of Artificial Sequence: Synthetic oligonucleotide
  Target: SCN9A; (-) strand; PAM type: NRG; PAM sequence: GAG
gtctcatgggggcattatat

SEQ ID NO: 23778 - DNA, 20 bp, Artificial Sequence
  Description of Artificial Sequence: Synthetic oligonucleotide
  Target: SCN9A; (-) strand; PAM type: NRG; PAM sequence: GGG
cctttacccaggtctcatgg

SEQ ID NO: 23779 - DNA, 20 bp, Artificial Sequence
  Description of Artificial Sequence: Synthetic oligonucleotide
  Target: SCN9A; (-) strand; PAM type: NRG; PAM sequence: GGG
ccctttacccaggtctcatg

SEQ ID NO: 23780 - DNA, 20 bp, Artificial Sequence
  Description of Artificial Sequence: Synthetic oligonucleotide
  Target: SCN9A; (-) strand; PAM type: NRG; PAM sequence: GGG
cccctttacccaggtctcat

SEQ ID NO: 23781 - DNA, 20 bp, Artificial Sequence
  Description of Artificial Sequence: Synthetic oligonucleotide
  Target: SCN9A; (-) strand; PAM type: NRG; PAM sequence: TGG
ccccctttacccaggtctca

SEQ ID NO: 23782 - DNA, 20 bp, Artificial Sequence
  Description of Artificial Sequence: Synthetic oligonucleotide
  Target: SCN9A; (-) strand; PAM type: NRG; PAM sequence: AGG
tgttggttccccctttaccc

SEQ ID NO: 23783 - DNA, 20 bp, Artificial Sequence
  Description of Artificial Sequence: Synthetic oligonucleotide
  Target: SCN9A; (-) strand; PAM type: NRG; PAM sequence: CAG
ctgttggttccccctttacc

SEQ ID NO: 23784 - DNA, 20 bp, Artificial Sequence
  Description of Artificial Sequence: Synthetic oligonucleotide
  Target: SCN9A; (-) strand; PAM type: NRG; PAM sequence: TGG
gagtttcaacatgtttctgt

SEQ ID NO: 23785 - DNA, 20 bp, Artificial Sequence
  Description of Artificial Sequence: Synthetic oligonucleotide
  Target: SCN9A; (-) strand; PAM type: NRG; PAM sequence: GAG
ttatgtgtggaaagtagcat

SEQ ID NO: 23786 - DNA, 20 bp, Artificial Sequence
  Description of Artificial Sequence: Synthetic oligonucleotide
  Target: SCN9A; (-) strand; PAM type: NRG; PAM sequence: TAG
tgttacttatgtgtggaaag

SEQ ID NO: 23787 - DNA, 20 bp, Artificial Sequence
  Description of Artificial Sequence: Synthetic oligonucleotide
  Target: SCN9A; (-) strand; PAM type: NRG; PAM sequence: AAG
ctttgttacttatgtgtgga

SEQ ID NO: 23788 - DNA, 20 bp, Artificial Sequence
  Description of Artificial Sequence: Synthetic oligonucleotide
  Target: SCN9A; (-) strand; PAM type: NRG; PAM sequence: TGG
aggactttgttacttatgtg

SEQ ID NO: 23789 - DNA, 20 bp, Artificial Sequence
  Description of Artificial Sequence: Synthetic oligonucleotide
  Target: SCN9A; (-) strand; PAM type: NRG; PAM sequence: AGG
ggtgcttgggtcagagataa

SEQ ID NO: 23790 - DNA, 20 bp, Artificial Sequence
  Description of Artificial Sequence: Synthetic oligonucleotide
  Target: SCN9A; (-) strand; PAM type: NRG; PAM sequence: AAG
aggtgcttgggtcagagata

SEQ ID NO: 23791 - DNA, 20 bp, Artificial Sequence
  Description of Artificial Sequence: Synthetic oligonucleotide
  Target: SCN9A; (-) strand; PAM type: NRG; PAM sequence: GAG
gatatgaggtgcttgggtca

SEQ ID NO: 23792 - DNA, 20 bp, Artificial Sequence
  Description of Artificial Sequence: Synthetic oligonucleotide
  Target: SCN9A; (-) strand; PAM type: NRG; PAM sequence: CAG
aagatatgaggtgcttgggt

SEQ ID NO: 23793 - DNA, 20 bp, Artificial Sequence
  Description of Artificial Sequence: Synthetic oligonucleotide
  Target: SCN9A; (-) strand; PAM type: NRG; PAM sequence: GGG
gcagaagatatgaggtgctt

SEQ ID NO: 23794 - DNA, 20 bp, Artificial Sequence
  Description of Artificial Sequence: Synthetic oligonucleotide
  Target: SCN9A; (-) strand; PAM type: NRG; PAM sequence: TGG
ggcagaagatatgaggtgct

SEQ ID NO: 23795 - DNA, 20 bp, Artificial Sequence
  Description of Artificial Sequence: Synthetic oligonucleotide
  Target: SCN9A; (-) strand; PAM type: NRG; PAM sequence: AGG
ggatgctggcagaagatatg

SEQ ID NO: 23796 - DNA, 20 bp, Artificial Sequence
  Description of Artificial Sequence: Synthetic oligonucleotide
  Target: SCN9A; (-) strand; PAM type: NRG; PAM sequence: GAG
tggatgctggcagaagatat

SEQ ID NO: 23797 - DNA, 20 bp, Artificial Sequence
  Description of Artificial Sequence: Synthetic oligonucleotide
  Target: SCN9A; (-) strand; PAM type: NRG; PAM sequence: AAG
tgtttcatggatgctggcag

SEQ ID NO: 23798 - DNA, 20 bp, Artificial Sequence
  Description of Artificial Sequence: Synthetic oligonucleotide
  Target: SCN9A; (-) strand; PAM type: NRG; PAM sequence: CAG
tactgtttcatggatgctgg

SEQ ID NO: 23799 - DNA, 20 bp, Artificial Sequence
  Description of Artificial Sequence: Synthetic oligonucleotide
  Target: SCN9A; (-) strand; PAM type: NRG; PAM sequence: TGG
tgatactgtttcatggatgc

SEQ ID NO: 23800 - DNA, 20 bp, Artificial Sequence
  Description of Artificial Sequence: Synthetic oligonucleotide
  Target: SCN9A; (-) strand; PAM type: NRG; PAM sequence: TGG
gttgatctgatactgtttca

SEQ ID NO: 23801 - DNA, 20 bp, Artificial Sequence
  Description of Artificial Sequence: Synthetic oligonucleotide
  Target: SCN9A; (-) strand; PAM type: NRG; PAM sequence: AGG
tactgtacttatatgctaat

SEQ ID NO: 23802 - DNA, 20 bp, Artificial Sequence
  Description of Artificial Sequence: Synthetic oligonucleotide
  Target: SCN9A; (-) strand; PAM type: NRG; PAM sequence: TAG
ttactgtacttatatgctaa

SEQ ID NO: 23803 - DNA, 20 bp, Artificial Sequence
  Description of Artificial Sequence: Synthetic oligonucleotide
  Target: SCN9A; (-) strand; PAM type: NRG; PAM sequence: TGG
atagacagtcttcatgagtt

SEQ ID NO: 23804 - DNA, 20 bp, Artificial Sequence
  Description of Artificial Sequence: Synthetic oligonucleotide
  Target: SCN9A; (-) strand; PAM type: NRG; PAM sequence: GAG
gcctcatagacagtcttcat

SEQ ID NO: 23805 - DNA, 20 bp, Artificial Sequence
  Description of Artificial Sequence: Synthetic oligonucleotide
  Target: SCN9A; (-) strand; PAM type: NRG; PAM sequence: CAG
tttgtaacttgcctcataga

SEQ ID NO: 23806 - DNA, 20 bp, Artificial Sequence
  Description of Artificial Sequence: Synthetic oligonucleotide
  Target: SCN9A; (-) strand; PAM type: NRG; PAM sequence: TAG
gaactttgtaacttgcctca

SEQ ID NO: 23807 - DNA, 20 bp, Artificial Sequence
  Description of Artificial Sequence: Synthetic oligonucleotide
  Target: SCN9A; (-) strand; PAM type: NRG; PAM sequence: AAG
atactaaaaatagaatactc

SEQ ID NO: 23808 - DNA, 20 bp, Artificial Sequence
  Description of Artificial Sequence: Synthetic oligonucleotide
  Target: SCN9A; (-) strand; PAM type: NRG; PAM sequence: TAG
aagtttcattatactaaaaa

SEQ ID NO: 23809 - DNA, 20 bp, Artificial Sequence
  Description of Artificial Sequence: Synthetic oligonucleotide
  Target: SCN9A; (-) strand; PAM type: NRG; PAM sequence: AAG
ctagctagatataccactgg

SEQ ID NO: 23810 - DNA, 20 bp, Artificial Sequence
  Description of Artificial Sequence: Synthetic oligonucleotide
  Target: SCN9A; (-) strand; PAM type: NRG; PAM sequence: TGG
gatctagctagatataccac

SEQ ID NO: 23811 - DNA, 20 bp, Artificial Sequence
  Description of Artificial Sequence: Synthetic oligonucleotide
  Target: SCN9A; (-) strand; PAM type: NRG; PAM sequence: TAG
attaggagcccagatctagc

SEQ ID NO: 23812 - DNA, 20 bp, Artificial Sequence
  Description of Artificial Sequence: Synthetic oligonucleotide
  Target: SCN9A; (-) strand; PAM type: NRG; PAM sequence: TAG
agccattaggagcccagatc

SEQ ID NO: 23813 - DNA, 20 bp, Artificial Sequence
  Description of Artificial Sequence: Synthetic oligonucleotide
  Target: SCN9A; (-) strand; PAM type: NRG; PAM sequence: CAG
attagaagccattaggagcc

SEQ ID NO: 23814 - DNA, 20 bp, Artificial Sequence
  Description of Artificial Sequence: Synthetic oligonucleotide
  Target: SCN9A; (-) strand; PAM type: NRG; PAM sequence: GAG
gagccattagaagccattag

SEQ ID NO: 23815 - DNA, 20 bp, Artificial Sequence
  Description of Artificial Sequence: Synthetic oligonucleotide
  Target: SCN9A; (-) strand; PAM type: NRG; PAM sequence: AGG
atgagccattagaagccatt

SEQ ID NO: 23816 - DNA, 20 bp, Artificial Sequence
  Description of Artificial Sequence: Synthetic oligonucleotide
  Target: SCN9A; (-) strand; PAM type: NRG; PAM sequence: TAG
gatgagccattagaagccat

SEQ ID NO: 23817 - DNA, 20 bp, Artificial Sequence
  Description of Artificial Sequence: Synthetic oligonucleotide
  Target: SCN9A; (-) strand; PAM type: NRG; PAM sequence: AAG
tgacagagatgagccattag

SEQ ID NO: 23818 - DNA, 20 bp, Artificial Sequence
  Description of Artificial Sequence: Synthetic oligonucleotide
  Target: SCN9A; (-) strand; PAM type: NRG; PAM sequence: TAG
cgctgacagagatgagccat

SEQ ID NO: 23819 - DNA, 20 bp, Artificial Sequence
  Description of Artificial Sequence: Synthetic oligonucleotide
  Target: SCN9A; (-) strand; PAM type: NRG; PAM sequence: GAG
ctgctgacgctgacagagat

SEQ ID NO: 23820 - DNA, 20 bp, Artificial Sequence
  Description of Artificial Sequence: Synthetic oligonucleotide
  Target: SCN9A; (-) strand; PAM type: NRG; PAM sequence: GAG
ttttcctgctgacgctgaca

SEQ ID NO: 23821 - DNA, 20 bp, Artificial Sequence
  Description of Artificial Sequence: Synthetic oligonucleotide
  Target: SCN9A; (-) strand; PAM type: NRG; PAM sequence: CAG
atttttcctgctgacgctga

SEQ ID NO: 23822 - DNA, 20 bp, Artificial Sequence
  Description of Artificial Sequence: Synthetic oligonucleotide
  Target: SCN9A; (-) strand; PAM type: NRG; PAM sequence: AAG
aagagatctagtagaattac

SEQ ID NO: 23823 - DNA, 20 bp, Artificial Sequence
  Description of Artificial Sequence: Synthetic oligonucleotide
  Target: SCN9A; (-) strand; PAM type: NRG; PAM sequence: TAG
gagagttgaaagagatctag

SEQ ID NO: 23824 - DNA, 20 bp, Artificial Sequence
  Description of Artificial Sequence: Synthetic oligonucleotide
  Target: SCN9A; (-) strand; PAM type: NRG; PAM sequence: TAG
catgagagttgaaagagatc

SEQ ID NO: 23825 - DNA, 20 bp, Artificial Sequence
  Description of Artificial Sequence: Synthetic oligonucleotide
  Target: SCN9A; (-) strand; PAM type: NRG; PAM sequence: GAG
agcttccatgagagttgaaa

SEQ ID NO: 23826 - DNA, 20 bp, Artificial Sequence
  Description of Artificial Sequence: Synthetic oligonucleotide
  Target: SCN9A; (-) strand; PAM type: NRG; PAM sequence: AAG
gcagcttccatgagagttga

SEQ ID NO: 23827 - DNA, 20 bp, Artificial Sequence
  Description of Artificial Sequence: Synthetic oligonucleotide
  Target: SCN9A; (-) strand; PAM type: NRG; PAM sequence: GAG
catacaagcagcttccatga

SEQ ID NO: 23828 - DNA, 20 bp, Artificial Sequence
  Description of Artificial Sequence: Synthetic oligonucleotide
  Target: SCN9A; (-) strand; PAM type: NRG; PAM sequence: GAG
cacatacaagcagcttccat

SEQ ID NO: 23829 - DNA, 20 bp, Artificial Sequence
  Description of Artificial Sequence: Synthetic oligonucleotide
  Target: SCN9A; (-) strand; PAM type: NRG; PAM sequence: CAG
cattcttgtacacatacaag

SEQ ID NO: 23830 - DNA, 20 bp, Artificial Sequence
  Description of Artificial Sequence: Synthetic oligonucleotide
  Target: SCN9A; (-) strand; PAM type: NRG; PAM sequence: AAG
tctcattcttgtacacatac

SEQ ID NO: 23831 - DNA, 20 bp, Artificial Sequence
  Description of Artificial Sequence: Synthetic oligonucleotide
  Target: SCN9A; (-) strand; PAM type: NRG; PAM sequence: AAG
ttttaggataaaagtaggac

SEQ ID NO: 23832 - DNA, 20 bp, Artificial Sequence
  Description of Artificial Sequence: Synthetic oligonucleotide
  Target: SCN9A; (-) strand; PAM type: NRG; PAM sequence: AGG
ggtagttttaggataaaagt

SEQ ID NO: 23833 - DNA, 20 bp, Artificial Sequence
  Description of Artificial Sequence: Synthetic oligonucleotide
  Target: SCN9A; (-) strand; PAM type: NRG; PAM sequence: TAG
tggtagttttaggataaaag

SEQ ID NO: 23834 - DNA, 20 bp, Artificial Sequence
  Description of Artificial Sequence: Synthetic oligonucleotide
  Target: SCN9A; (-) strand; PAM type: NRG; PAM sequence: AAG
agatggtagttttaggataa

SEQ ID NO: 23835 - DNA, 20 bp, Artificial Sequence
  Description of Artificial Sequence: Synthetic oligonucleotide
  Target: SCN9A; (-) strand; PAM type: NRG; PAM sequence: AGG
ggaaaacagatggtagtttt

SEQ ID NO: 23836 - DNA, 20 bp, Artificial Sequence
  Description of Artificial Sequence: Synthetic oligonucleotide
  Target: SCN9A; (-) strand; PAM type: NRG; PAM sequence: TAG
gggaaaacagatggtagttt

SEQ ID NO: 23837 - DNA, 20 bp, Artificial Sequence
  Description of Artificial Sequence: Synthetic oligonucleotide
  Target: SCN9A; (-) strand; PAM type: NRG; PAM sequence: TAG
taaaaagggaaaacagatgg

SEQ ID NO: 23838 - DNA, 20 bp, Artificial Sequence
  Description of Artificial Sequence: Synthetic oligonucleotide
  Target: SCN9A; (-) strand; PAM type: NRG; PAM sequence: TGG
ttataaaaagggaaaacaga

SEQ ID NO: 23839 - DNA, 20 bp, Artificial Sequence
  Description of Artificial Sequence: Synthetic oligonucleotide
  Target: SCN9A; (-) strand; PAM type: NRG; PAM sequence: CAG
tgtgttataaaaagggaaaa

SEQ ID NO: 23840 - DNA, 20 bp, Artificial Sequence
  Description of Artificial Sequence: Synthetic oligonucleotide
  Target: SCN9A; (-) strand; PAM type: NRG; PAM sequence: GGG
catcttgtgtgttataaaaa

SEQ ID NO: 23841 - DNA, 20 bp, Artificial Sequence
  Description of Artificial Sequence: Synthetic oligonucleotide
  Target: SCN9A; (-) strand; PAM type: NRG; PAM sequence: AGG
gcatcttgtgtgttataaaa

SEQ ID NO: 23842 - DNA, 20 bp, Artificial Sequence
  Description of Artificial Sequence: Synthetic oligonucleotide
  Target: SCN9A; (-) strand; PAM type: NRG; PAM sequence: AAG
agcatcttgtgtgttataaa

SEQ ID NO: 23843 - DNA, 20 bp, Artificial Sequence
  Description of Artificial Sequence: Synthetic oligonucleotide
  Target: SCN9A; (-) strand; PAM type: NRG; PAM sequence: AAG
gaaagcaaggtcagcttgtg

SEQ ID NO: 23844 - DNA, 20 bp, Artificial Sequence
  Description of Artificial Sequence: Synthetic oligonucleotide
  Target: SCN9A; (-) strand; PAM type: NRG; PAM sequence: CAG
atactatgagaaagcaaggt

SEQ ID NO: 23845 - DNA, 20 bp, Artificial Sequence
  Description of Artificial Sequence: Synthetic oligonucleotide
  Target: SCN9A; (-) strand; PAM type: NRG; PAM sequence: AGG
agagatactatgagaaagca

SEQ ID NO: 23846 - DNA, 20 bp, Artificial Sequence
  Description of Artificial Sequence: Synthetic oligonucleotide
  Target: SCN9A; (-) strand; PAM type: NRG; PAM sequence: AAG
cagagatactatgagaaagc

SEQ ID NO: 23847 - DNA, 20 bp, Artificial Sequence
  Description of Artificial Sequence: Synthetic oligonucleotide
  Target: SCN9A; (-) strand; PAM type: NRG; PAM sequence: AAG
tggccagagatactatgaga

SEQ ID NO: 23848 - DNA, 20 bp, Artificial Sequence
  Description of Artificial Sequence: Synthetic oligonucleotide
  Target: SCN9A; (-) strand; PAM type: NRG; PAM sequence: GAG
caggtggccagagatactat

SEQ ID NO: 23849 - DNA, 20 bp, Artificial Sequence
  Description of Artificial Sequence: Synthetic oligonucleotide
  Target: SCN9A; (-) strand; PAM type: NRG; PAM sequence: GAG
agaacaagtacaggtggcca

SEQ ID NO: 23850 - DNA, 20 bp, Artificial Sequence
  Description of Artificial Sequence: Synthetic oligonucleotide
  Target: SCN9A; (-) strand; PAM type: NRG; PAM sequence: CAG
gaagaacaagtacaggtggc

SEQ ID NO: 23851 - DNA, 20 bp, Artificial Sequence
  Description of Artificial Sequence: Synthetic oligonucleotide
  Target: SCN9A; (-) strand; PAM type: NRG; PAM sequence: TGG
ggaagaagaacaagtacagg

SEQ ID NO: 23852 - DNA, 20 bp, Artificial Sequence
  Description of Artificial Sequence: Synthetic oligonucleotide
  Target: SCN9A; (-) strand; PAM type: NRG; PAM sequence: AGG
gtgggaagaagaacaagtac

SEQ ID NO: 23853 - DNA, 20 bp, Artificial Sequence
  Description of Artificial Sequence: Synthetic oligonucleotide
  Target: SCN9A; (-) strand; PAM type: NRG; PAM sequence: CAG
ggtgggaagaagaacaagta

SEQ ID NO: 23854 - DNA, 20 bp, Artificial Sequence
  Description of Artificial Sequence: Synthetic oligonucleotide
  Target: SCN9A; (-) strand; PAM type: NRG; PAM sequence: AAG
agtgtggtgggaagaagaac

SEQ ID NO: 23855 - DNA, 20 bp, Artificial Sequence
  Description of Artificial Sequence: Synthetic oligonucleotide
  Target: SCN9A; (-) strand; PAM type: NRG; PAM sequence: AAG
actgcaagtgtggtgggaag

SEQ ID NO: 23856 - DNA, 20 bp, Artificial Sequence
  Description of Artificial Sequence: Synthetic oligonucleotide
  Target: SCN9A; (-) strand; PAM type: NRG; PAM sequence: AAG
tgaactgcaagtgtggtggg

SEQ ID NO: 23857 - DNA, 20 bp, Artificial Sequence
  Description of Artificial Sequence: Synthetic oligonucleotide
  Target: SCN9A; (-) strand; PAM type: NRG; PAM sequence: GGG
tgctgaactgcaagtgtggt

SEQ ID NO: 23858 - DNA, 20 bp, Artificial Sequence
  Description of Artificial Sequence: Synthetic oligonucleotide
  Target: SCN9A; (-) strand; PAM type: NRG; PAM sequence: TGG
ctgctgaactgcaagtgtgg

SEQ ID NO: 23859 - DNA, 20 bp, Artificial Sequence
  Description of Artificial Sequence: Synthetic oligonucleotide
  Target: SCN9A; (-) strand; PAM type: NRG; PAM sequence: TGG
aaactgctgaactgcaagtg

SEQ ID NO: 23860 - DNA, 20 bp, Artificial Sequence
  Description of Artificial Sequence: Synthetic oligonucleotide
  Target: SCN9A; (-) strand; PAM type: NRG; PAM sequence: AAG
attaaaaactgctgaactgc

SEQ ID NO: 23861 - DNA, 20 bp, Artificial Sequence
  Description of Artificial Sequence: Synthetic oligonucleotide
  Target: SCN9A; (-) strand; PAM type: NRG; PAM sequence: AGG
taaaacagcatcagatattc

SEQ ID NO: 23862 - DNA, 20 bp, Artificial Sequence
  Description of Artificial Sequence: Synthetic oligonucleotide
  Target: SCN9A; (-) strand; PAM type: NRG; PAM sequence: CAG
ataaaacagcatcagatatt

SEQ ID NO: 23863 - DNA, 20 bp, Artificial Sequence
  Description of Artificial Sequence: Synthetic oligonucleotide
  Target: SCN9A; (-) strand; PAM type: NRG; PAM sequence: CAG
aaggaggcataaaacagcat

SEQ ID NO: 23864 - DNA, 20 bp, Artificial Sequence
  Description of Artificial Sequence: Synthetic oligonucleotide
  Target: SCN9A; (-) strand; PAM type: NRG; PAM sequence: CAG
aatcgtaaggaggcataaaa

SEQ ID NO: 23865 - DNA, 20 bp, Artificial Sequence
  Description of Artificial Sequence: Synthetic oligonucleotide
  Target: SCN9A; (-) strand; PAM type: NRG; PAM sequence: AGG
acaagtatacaatcgtaagg

SEQ ID NO: 23866 - DNA, 20 bp, Artificial Sequence
  Description of Artificial Sequence: Synthetic oligonucleotide
  Target: SCN9A; (-) strand; PAM type: NRG; PAM sequence: GAG
aacaagtatacaatcgtaag

SEQ ID NO: 23867 - DNA, 20 bp, Artificial Sequence
  Description of Artificial Sequence: Synthetic oligonucleotide
  Target: SCN9A; (-) strand; PAM type: NRG; PAM sequence: AGG
ggaacaagtatacaatcgta

SEQ ID NO: 23868 - DNA, 20 bp, Artificial Sequence
  Description of Artificial Sequence: Synthetic oligonucleotide
  Target: SCN9A; (-) strand; PAM type: NRG; PAM sequence: AAG
gggaacaagtatacaatcgt

SEQ ID NO: 23869 - DNA, 20 bp, Artificial Sequence
  Description of Artificial Sequence: Synthetic oligonucleotide
  Target: SCN9A; (-) strand; PAM type: NRG; PAM sequence: AAG
caaggcaggctgaggggaac

SEQ ID NO: 23870 - DNA, 20 bp, Artificial Sequence
  Description of Artificial Sequence: Synthetic oligonucleotide
  Target: SCN9A; (-) strand; PAM type: NRG; PAM sequence: GGG
gttaggcaaggcaggctgag

SEQ ID NO: 23871 - DNA, 20 bp, Artificial Sequence
  Description of Artificial Sequence: Synthetic oligonucleotide
  Target: SCN9A; (-) strand; PAM type: NRG; PAM sequence: GGG
agttaggcaaggcaggctga

SEQ ID NO: 23872 - DNA, 20 bp, Artificial Sequence
  Description of Artificial Sequence: Synthetic oligonucleotide
  Target: SCN9A; (-) strand; PAM type: NRG; PAM sequence: AGG
tagttaggcaaggcaggctg

SEQ ID NO: 23873 - DNA, 20 bp, Artificial Sequence
  Description of Artificial Sequence: Synthetic oligonucleotide
  Target: SCN9A; (-) strand; PAM type: NRG; PAM sequence: GAG
ctagttaggcaaggcaggct

SEQ ID NO: 23874 - DNA, 20 bp, Artificial Sequence
  Description of Artificial Sequence: Synthetic oligonucleotide
  Target: SCN9A; (-) strand; PAM type: NRG; PAM sequence: AGG
attttctagttaggcaaggc

SEQ ID NO: 23875 - DNA, 20 bp, Artificial Sequence
  Description of Artificial Sequence: Synthetic oligonucleotide
  Target: SCN9A; (-) strand; PAM type: NRG; PAM sequence: CAG
aattttctagttaggcaagg

SEQ ID NO: 23876 - DNA, 20 bp, Artificial Sequence
  Description of Artificial Sequence: Synthetic oligonucleotide
  Target: SCN9A; (-) strand; PAM type: NRG; PAM sequence: AGG
aggaattttctagttaggca

SEQ ID NO: 23877 - DNA, 20 bp, Artificial Sequence
  Description of Artificial Sequence: Synthetic oligonucleotide
  Target: SCN9A; (-) strand; PAM type: NRG; PAM sequence: AAG
caggaattttctagttaggc

SEQ ID NO: 23878 - DNA, 20 bp, Artificial Sequence
  Description of Artificial Sequence: Synthetic oligonucleotide
  Target: SCN9A; (-) strand; PAM type: NRG; PAM sequence: AGG
cgaacaggaattttctagtt

SEQ ID NO: 23879 - DNA, 20 bp, Artificial Sequence
  Description of Artificial Sequence: Synthetic oligonucleotide
  Target: SCN9A; (-) strand; PAM type: NRG; PAM sequence: TAG
acgaacaggaattttctagt

SEQ ID NO: 23880 - DNA, 20 bp, Artificial Sequence
  Description of Artificial Sequence: Synthetic oligonucleotide
  Target: SCN9A; (-) strand; PAM type: NRG; PAM sequence: TAG
aaagacgaacaggaattttc

SEQ ID NO: 23881 - DNA, 20 bp, Artificial Sequence
  Description of Artificial Sequence: Synthetic oligonucleotide
  Target: SCN9A; (-) strand; PAM type: NRG; PAM sequence: AGG
cagggtctagaaagacgaac

SEQ ID NO: 23882 - DNA, 20 bp, Artificial Sequence
  Description of Artificial Sequence: Synthetic oligonucleotide
  Target: SCN9A; (-) strand; PAM type: NRG; PAM sequence: CAG
tcagggtctagaaagacgaa

SEQ ID NO: 23883 - DNA, 20 bp, Artificial Sequence
  Description of Artificial Sequence: Synthetic oligonucleotide
  Target: SCN9A; (-) strand; PAM type: NRG; PAM sequence: AAG
ggtgcttttcagggtctaga

SEQ ID NO: 23884 - DNA, 20 bp, Artificial Sequence
  Description of Artificial Sequence: Synthetic oligonucleotide
  Target: SCN9A; (-) strand; PAM type: NRG; PAM sequence: TAG
aaatggtgcttttcagggtc

SEQ ID NO: 23885 - DNA, 20 bp, Artificial Sequence
  Description of Artificial Sequence: Synthetic oligonucleotide
  Target: SCN9A; (-) strand; PAM type: NRG; PAM sequence: GGG
aacgtaaatggtgcttttca

SEQ ID NO: 23886 - DNA, 20 bp, Artificial Sequence
  Description of Artificial Sequence: Synthetic oligonucleotide
  Target: SCN9A; (-) strand; PAM type: NRG; PAM sequence: AGG
aaacgtaaatggtgcttttc

SEQ ID NO: 23887 - DNA, 20 bp, Artificial Sequence
  Description of Artificial Sequence: Synthetic oligonucleotide
  Target: SCN9A; (-) strand; PAM type: NRG; PAM sequence: CAG
gaaacgtaaatggtgctttt

SEQ ID NO: 23888 - DNA, 20 bp, Artificial Sequence
  Description of Artificial Sequence: Synthetic oligonucleotide
  Target: SCN9A; (-) strand; PAM type: NRG; PAM sequence: TGG
tgcaatttcagaaacgtaaa

SEQ ID NO: 23889 - DNA, 20 bp, Artificial Sequence
  Description of Artificial Sequence: Synthetic oligonucleotide
  Target: SCN9A; (-) strand; PAM type: NRG; PAM sequence: CAG
agaacaactgcttgcaattt

SEQ ID NO: 23890 - DNA, 20 bp, Artificial Sequence
  Description of Artificial Sequence: Synthetic oligonucleotide
  Target: SCN9A; (-) strand; PAM type: NRG; PAM sequence: GAG
tgacaaagttctgtagcaag

SEQ ID NO: 23891 - DNA, 20 bp, Artificial Sequence
  Description of Artificial Sequence: Synthetic oligonucleotide
  Target: SCN9A; (-) strand; PAM type: NRG; PAM sequence: AGG
tgtgacaaagttctgtagca

SEQ ID NO: 23892 - DNA, 20 bp, Artificial Sequence
  Description of Artificial Sequence: Synthetic oligonucleotide
  Target: SCN9A; (-) strand; PAM type: NRG; PAM sequence: AAG
atgtgacaaagttctgtagc

SEQ ID NO: 23893 - DNA, 20 bp, Artificial Sequence
  Description of Artificial Sequence: Synthetic oligonucleotide
  Target: SCN9A; (-) strand; PAM type: NRG; PAM sequence: TAG
gtaaatgtgacaaagttctg

SEQ ID NO: 23894 - DNA, 20 bp, Artificial Sequence
  Description of Artificial Sequence: Synthetic oligonucleotide
  Target: SCN9A; (-) strand; PAM type: NRG; PAM sequence: AAG
agcaaagtgtaaatgtgaca

SEQ ID NO: 23895 - DNA, 20 bp, Artificial Sequence
  Description of Artificial Sequence: Synthetic oligonucleotide
  Target: SCN9A; (-) strand; PAM type: NRG; PAM sequence: AAG
cttggatgtgtttgtaagca

SEQ ID NO: 23896 - DNA, 20 bp, Artificial Sequence
  Description of Artificial Sequence: Synthetic oligonucleotide
  Target: SCN9A; (-) strand; PAM type: NRG; PAM sequence: AAG
tagagcttggatgtgtttgt

SEQ ID NO: 23897 - DNA, 20 bp, Artificial Sequence
  Description of Artificial Sequence: Synthetic oligonucleotide
  Target: SCN9A; (-) strand; PAM type: NRG; PAM sequence: TGG
aaatgagtaactgtagagct

SEQ ID NO: 23898 - DNA, 20 bp, Artificial Sequence
  Description of Artificial Sequence: Synthetic oligonucleotide
  Target: SCN9A; (-) strand; PAM type: NRG; PAM sequence: GAG
aatacaaatgagtaactgta

SEQ ID NO: 23899 - DNA, 20 bp, Artificial Sequence
  Description of Artificial Sequence: Synthetic oligonucleotide
  Target: SCN9A; (-) strand; PAM type: NRG; PAM sequence: TAG
agaatacaaatgagtaactg

SEQ ID NO: 23900 - DNA, 20 bp, Artificial Sequence
  Description of Artificial Sequence: Synthetic oligonucleotide
  Target: SCN9A; (-) strand; PAM type: NRG; PAM sequence: GAG
gagaagagaagaatacaaat

SEQ ID NO: 23901 - DNA, 20 bp, Artificial Sequence
  Description of Artificial Sequence: Synthetic oligonucleotide
  Target: SCN9A; (-) strand; PAM type: NRG; PAM sequence: AAG
ctcagagcaatggagaagag

SEQ ID NO: 23902 - DNA, 20 bp, Artificial Sequence
  Description of Artificial Sequence: Synthetic oligonucleotide
  Target: SCN9A; (-) strand; PAM type: NRG; PAM sequence: GAG
gagctcagagcaatggagaa

SEQ ID NO: 23903 - DNA, 20 bp, Artificial Sequence
  Description of Artificial Sequence: Synthetic oligonucleotide
  Target: SCN9A; (-) strand; PAM type: NRG; PAM sequence: AAG
aggagctcagagcaatggag

SEQ ID NO: 23904 - DNA, 20 bp, Artificial Sequence
  Description of Artificial Sequence: Synthetic oligonucleotide
  Target: SCN9A; (-) strand; PAM type: NRG; PAM sequence: GAG
ttaaggagctcagagcaatg

SEQ ID NO: 23905 - DNA, 20 bp, Artificial Sequence
  Description of Artificial Sequence: Synthetic oligonucleotide
  Target: SCN9A; (-) strand; PAM type: NRG; PAM sequence: TGG
tcttaaggagctcagagcaa

SEQ ID NO: 23906 - DNA, 20 bp, Artificial Sequence
  Description of Artificial Sequence: Synthetic oligonucleotide
  Target: SCN9A; (-) strand; PAM type: NRG; PAM sequence: GAG
gtttattcttaaggagctca

SEQ ID NO: 23907 - DNA, 20 bp, Artificial Sequence
  Description of Artificial Sequence: Synthetic oligonucleotide
  Target: SCN9A; (-) strand; PAM type: NRG; PAM sequence: CAG
ctgtttattcttaaggagct

SEQ ID NO: 23908 - DNA, 20 bp, Artificial Sequence
  Description of Artificial Sequence: Synthetic oligonucleotide
  Target: SCN9A; (-) strand; PAM type: NRG; PAM sequence: GAG
aggtactgtttattcttaag

SEQ ID NO: 23909 - DNA, 20 bp, Artificial Sequence
  Description of Artificial Sequence: Synthetic oligonucleotide
  Target: SCN9A; (-) strand; PAM type: NRG; PAM sequence: AGG
ccaggtactgtttattctta

SEQ ID NO: 23910 - DNA, 20 bp, Artificial Sequence
  Description of Artificial Sequence: Synthetic oligonucleotide
  Target: SCN9A; (-) strand; PAM type: NRG; PAM sequence: AAG
tccaggtactgtttattctt

SEQ ID NO: 23911 - DNA, 20 bp, Artificial Sequence
  Description of Artificial Sequence: Synthetic oligonucleotide
  Target: SCN9A; (-) strand; PAM type: NRG; PAM sequence: AGG
tgcaaagataaataagatcc

SEQ ID NO: 23912 - DNA, 20 bp, Artificial Sequence
  Description of Artificial Sequence: Synthetic oligonucleotide
  Target: SCN9A; (-) strand; PAM type: NRG; PAM sequence: CAG
atgcaaagataaataagatc

SEQ ID NO: 23913 - DNA, 20 bp, Artificial Sequence
  Description of Artificial Sequence: Synthetic oligonucleotide
  Target: SCN9A; (-) strand; PAM type: NRG; PAM sequence: AAG
ttcacaatgcaaagataaat

SEQ ID NO: 23914 - DNA, 20 bp, Artificial Sequence
  Description of Artificial Sequence: Synthetic oligonucleotide
  Target: SCN9A; (-) strand; PAM type: NRG; PAM sequence: AAG
tgatcaactttcacaatgca

SEQ ID NO: 23915 - DNA, 20 bp, Artificial Sequence
  Description of Artificial Sequence: Synthetic oligonucleotide
  Target: SCN9A; (-) strand; PAM type: NRG; PAM sequence: AAG
gactgttagttgagtaggac

SEQ ID NO: 23916 - DNA, 20 bp, Artificial Sequence
  Description of Artificial Sequence: Synthetic oligonucleotide
  Target: SCN9A; (-) strand; PAM type: NRG; PAM sequence: AGG
tagttgactgttagttgagt

SEQ ID NO: 23917 - DNA, 20 bp, Artificial Sequence
  Description of Artificial Sequence: Synthetic oligonucleotide
  Target: SCN9A; (-) strand; PAM type: NRG; PAM sequence: TAG
ttagttgactgttagttgag

SEQ ID NO: 23918 - DNA, 20 bp, Artificial Sequence
  Description of Artificial Sequence: Synthetic oligonucleotide
  Target: SCN9A; (-) strand; PAM type: NRG; PAM sequence: GAG
ctcttagttgactgttagtt

SEQ ID NO: 23919 - DNA, 20 bp, Artificial Sequence
  Description of Artificial Sequence: Synthetic oligonucleotide
  Target: SCN9A; (-) strand; PAM type: NRG; PAM sequence: TAG
cttgactcttagttgactgt

SEQ ID NO: 23920 - DNA, 20 bp, Artificial Sequence
  Description of Artificial Sequence: Synthetic oligonucleotide
  Target: SCN9A; (-) strand; PAM type: NRG; PAM sequence: TAG
ccccctgccttcttgactct

SEQ ID NO: 23921 - DNA, 20 bp, Artificial Sequence
  Description of Artificial Sequence: Synthetic oligonucleotide
  Target: SCN9A; (-) strand; PAM type: NRG; PAM sequence: GAG
agtaatgttttgtaccctga

SEQ ID NO: 23922 - DNA, 20 bp, Artificial Sequence
  Description of Artificial Sequence: Synthetic oligonucleotide
  Target: SCN9A; (-) strand; PAM type: NRG; PAM sequence: GAG
ggagtaatgttttgtaccct

SEQ ID NO: 23923 - DNA, 20 bp, Artificial Sequence
  Description of Artificial Sequence: Synthetic oligonucleotide
  Target: SCN9A; (-) strand; PAM type: NRG; PAM sequence: GAG
gcagagaattataattcttg

SEQ ID NO: 23924 - DNA, 20 bp, Artificial Sequence
  Description of Artificial Sequence: Synthetic oligonucleotide
  Target: SCN9A; (-) strand; PAM type: NRG; PAM sequence: TGG
ttgcagagaattataattct

SEQ ID NO: 23925 - DNA, 20 bp, Artificial Sequence
  Description of Artificial Sequence: Synthetic oligonucleotide
  Target: SCN9A; (-) strand; PAM type: NRG; PAM sequence: GAG
cttcaacagtcagtcttgca

SEQ ID NO: 23926 - DNA, 20 bp, Artificial Sequence
  Description of Artificial Sequence: Synthetic oligonucleotide
  Target: SCN9A; (-) strand; PAM type: NRG; PAM sequence: CAG
agcttcaacagtcagtcttg

SEQ ID NO: 23927 - DNA, 20 bp, Artificial Sequence
  Description of Artificial Sequence: Synthetic oligonucleotide
  Target: SCN9A; (-) strand; PAM type: NRG; PAM sequence: CAG
caacaagcagcttcaacagt

SEQ ID NO: 23928 - DNA, 20 bp, Artificial Sequence
  Description of Artificial Sequence: Synthetic oligonucleotide
  Target: SCN9A; (-) strand; PAM type: NRG; PAM sequence: CAG
gttacaacaagcagcttcaa

SEQ ID NO: 23929 - DNA, 20 bp, Artificial Sequence
  Description of Artificial Sequence: Synthetic oligonucleotide
  Target: SCN9A; (-) strand; PAM type: NRG; PAM sequence: CAG
taatttcaagttacaacaag

SEQ ID NO: 23930 - DNA, 20 bp, Artificial Sequence
  Description of Artificial Sequence: Synthetic oligonucleotide
  Target: SCN9A; (-) strand; PAM type: NRG; PAM sequence: AAG
aactaatttcaagttacaac

SEQ ID NO: 23931 - DNA, 20 bp, Artificial Sequence
  Description of Artificial Sequence: Synthetic oligonucleotide
  Target: SCN9A; (-) strand; PAM type: NRG; PAM sequence: AAG
ctatagataaaactaatttc

SEQ ID NO: 23932 - DNA, 20 bp, Artificial Sequence
  Description of Artificial Sequence: Synthetic oligonucleotide
  Target: SCN9A; (-) strand; PAM type: NRG; PAM sequence: TAG
acaggtttcctcagaagcta

SEQ ID NO: 23933 - DNA, 20 bp, Artificial Sequence
  Description of Artificial Sequence: Synthetic oligonucleotide
  Target: SCN9A; (-) strand; PAM type: NRG; PAM sequence: AAG
agtgtaacaggtttcctcag

SEQ ID NO: 23934 - DNA, 20 bp, Artificial Sequence
  Description of Artificial Sequence: Synthetic oligonucleotide
  Target: SCN9A; (-) strand; PAM type: NRG; PAM sequence: CAG
tagagtgtaacaggtttcct

SEQ ID NO: 23935 - DNA, 20 bp, Artificial Sequence
  Description of Artificial Sequence: Synthetic oligonucleotide
  Target: SCN9A; (-) strand; PAM type: NRG; PAM sequence: AGG
aattagtcctagagtgtaac

SEQ ID NO: 23936 - DNA, 20 bp, Artificial Sequence
  Description of Artificial Sequence: Synthetic oligonucleotide
  Target: SCN9A; (-) strand; PAM type: NRG; PAM sequence: CAG
caattagtcctagagtgtaa

SEQ ID NO: 23937 - DNA, 20 bp, Artificial Sequence
  Description of Artificial Sequence: Synthetic oligonucleotide
  Target: SCN9A; (-) strand; PAM type: NRG; PAM sequence: GAG
cgttggcacaattagtccta

SEQ ID NO: 23938 - DNA, 20 bp, Artificial Sequence
  Description of Artificial Sequence: Synthetic oligonucleotide
  Target: SCN9A; (-) strand; PAM type: NRG; PAM sequence: TAG
gtcgttggcacaattagtcc

SEQ ID NO: 23939 - DNA, 20 bp, Artificial Sequence
  Description of Artificial Sequence: Synthetic oligonucleotide
  Target: SCN9A; (-) strand; PAM type: NRG; PAM sequence: TAG
gcaacagtcgttggcacaat

SEQ ID NO: 23940 - DNA, 20 bp, Artificial Sequence
  Description of Artificial Sequence: Synthetic oligonucleotide
  Target: SCN9A; (-) strand; PAM type: NRG; PAM sequence: TGG
aactggcgagcaacagtcgt

SEQ ID NO: 23941 - DNA, 20 bp, Artificial Sequence
  Description of Artificial Sequence: Synthetic oligonucleotide
  Target: SCN9A; (-) strand; PAM type: NRG; PAM sequence: CAG
aagctccaactggcgagcaa

SEQ ID NO: 23942 - DNA, 20 bp, Artificial Sequence
  Description of Artificial Sequence: Synthetic oligonucleotide
  Target: SCN9A; (-) strand; PAM type: NRG; PAM sequence: GAG
actggtaagctccaactggc

SEQ ID NO: 23943 - DNA, 20 bp, Artificial Sequence
  Description of Artificial Sequence: Synthetic oligonucleotide
  Target: SCN9A; (-) strand; PAM type: NRG; PAM sequence: TGG
gggaactggtaagctccaac

SEQ ID NO: 23944 - DNA, 20 bp, Artificial Sequence
  Description of Artificial Sequence: Synthetic oligonucleotide
  Target: SCN9A; (-) strand; PAM type: NRG; PAM sequence: AAG
taaggatctggggaactggt

SEQ ID NO: 23945 - DNA, 20 bp, Artificial Sequence
  Description of Artificial Sequence: Synthetic oligonucleotide
  Target: SCN9A; (-) strand; PAM type: NRG; PAM sequence: TGG
ctagtaaggatctggggaac

SEQ ID NO: 23946 - DNA, 20 bp, Artificial Sequence
  Description of Artificial Sequence: Synthetic oligonucleotide
  Target: SCN9A; (-) strand; PAM type: NRG; PAM sequence: GGG
ttggccctagtaaggatctg

SEQ ID NO: 23947 - DNA, 20 bp, Artificial Sequence
  Description of Artificial Sequence: Synthetic oligonucleotide
  Target: SCN9A; (-) strand; PAM type: NRG; PAM sequence: GGG
attggccctagtaaggatct

SEQ ID NO: 23948 - DNA, 20 bp, Artificial Sequence
  Description of Artificial Sequence: Synthetic oligonucleotide
  Target: SCN9A; (-) strand; PAM type: NRG; PAM sequence: TGG
cattggccctagtaaggatc

SEQ ID NO: 23949 - DNA, 20 bp, Artificial Sequence
  Description of Artificial Sequence: Synthetic oligonucleotide
  Target: SCN9A; (-) strand; PAM type: NRG; PAM sequence: AGG
aaagttcattggccctagta

SEQ ID NO: 23950 - DNA, 20 bp, Artificial Sequence
  Description of Artificial Sequence: Synthetic oligonucleotide
  Target: SCN9A; (-) strand; PAM type: NRG; PAM sequence: AAG
gaaagttcattggccctagt

SEQ ID NO: 23951 - DNA, 20 bp, Artificial Sequence
  Description of Artificial Sequence: Synthetic oligonucleotide
  Target: SCN9A; (-) strand; PAM type: NRG; PAM sequence: TAG
ttgagaaagttcattggccc

SEQ ID NO: 23952 - DNA, 20 bp, Artificial Sequence
  Description of Artificial Sequence: Synthetic oligonucleotide
  Target: SCN9A; (-) strand; PAM type: NRG; PAM sequence: TGG
tgctctttgagaaagttcat

SEQ ID NO: 23953 - DNA, 20 bp, Artificial Sequence
  Description of Artificial Sequence: Synthetic oligonucleotide
  Target: SCN9A; (-) strand; PAM type: NRG; PAM sequence: AAG
ttatatattgctctttgaga

SEQ ID NO: 23954 - DNA, 20 bp, Artificial Sequence
  Description of Artificial Sequence: Synthetic oligonucleotide
  Target: SCN9A; (-) strand; PAM type: NRG; PAM sequence: GAG
aatgttatatattgctcttt

SEQ ID NO: 23955 - DNA, 20 bp, Artificial Sequence
  Description of Artificial Sequence: Synthetic oligonucleotide
  Target: SCN9A; (-) strand; PAM type: NRG; PAM sequence: GGG
gttagaggttttattaaaat

SEQ ID NO: 23956 - DNA, 20 bp, Artificial Sequence
  Description of Artificial Sequence: Synthetic oligonucleotide
  Target: SCN9A; (-) strand; PAM type: NRG; PAM sequence: TGG
ggttagaggttttattaaaa

SEQ ID NO: 23957 - DNA, 20 bp, Artificial Sequence
  Description of Artificial Sequence: Synthetic oligonucleotide
  Target: SCN9A; (-) strand; PAM type: NRG; PAM sequence: AGG
gaacaaagagagaaggttag

SEQ ID NO: 23958 - DNA, 20 bp, Artificial Sequence
  Description of Artificial Sequence: Synthetic oligonucleotide
  Target: SCN9A; (-) strand; PAM type: NRG; PAM sequence: GAG
agaacaaagagagaaggtta

SEQ ID NO: 23959 - DNA, 20 bp, Artificial Sequence
  Description of Artificial Sequence: Synthetic oligonucleotide
  Target: SCN9A; (-) strand; PAM type: NRG; PAM sequence: TAG
gtagaacaaagagagaaggt

SEQ ID NO: 23960 - DNA, 20 bp, Artificial Sequence
  Description of Artificial Sequence: Synthetic oligonucleotide
  Target: SCN9A; (-) strand; PAM type: NRG; PAM sequence: AGG
ccctgtagaacaaagagaga

SEQ ID NO: 23961 - DNA, 20 bp, Artificial Sequence
  Description of Artificial Sequence: Synthetic oligonucleotide
  Target: SCN9A; (-) strand; PAM type: NRG; PAM sequence: AAG
tccctgtagaacaaagagag

SEQ ID NO: 23962 - DNA, 20 bp, Artificial Sequence
  Description of Artificial Sequence: Synthetic oligonucleotide
  Target: SCN9A; (-) strand; PAM type: NRG; PAM sequence: GAG
ctttccctgtagaacaaaga

SEQ ID NO: 23963 - DNA, 20 bp, Artificial Sequence
  Description of Artificial Sequence: Synthetic oligonucleotide
  Target: SCN9A; (-) strand; PAM type: NRG; PAM sequence: GAG
cactttccctgtagaacaaa

SEQ ID NO: 23964 - DNA, 20 bp, Artificial Sequence
  Description of Artificial Sequence: Synthetic oligonucleotide
  Target: SCN9A; (-) strand; PAM type: NRG; PAM sequence: AAG
agcactttccctgtagaaca

SEQ ID NO: 23965 - DNA, 20 bp, Artificial Sequence
  Description of Artificial Sequence: Synthetic oligonucleotide
  Target: SCN9A; (-) strand; PAM type: NRG; PAM sequence: TAG
aactgaaagcactttccctg

SEQ ID NO: 23966 - DNA, 20 bp, Artificial Sequence
  Description of Artificial Sequence: Synthetic oligonucleotide
  Target: SCN9A; (-) strand; PAM type: NRG; PAM sequence: AAG
gagtctgtggcataaactga

SEQ ID NO: 23967 - DNA, 20 bp, Artificial Sequence
  Description of Artificial Sequence: Synthetic oligonucleotide
  Target: SCN9A; (-) strand; PAM type: NRG; PAM sequence: TGG
caaaacagggagagagtctg

SEQ ID NO: 23968 - DNA, 20 bp, Artificial Sequence
  Description of Artificial Sequence: Synthetic oligonucleotide
  Target: SCN9A; (-) strand; PAM type: NRG; PAM sequence: GAG
cagtttgcaaaacagggaga

SEQ ID NO: 23969 - DNA, 20 bp, Artificial Sequence
  Description of Artificial Sequence: Synthetic oligonucleotide
  Target: SCN9A; (-) strand; PAM type: NRG; PAM sequence: GAG
atcagtttgcaaaacaggga

SEQ ID NO: 23970 - DNA, 20 bp, Artificial Sequence
  Description of Artificial Sequence: Synthetic oligonucleotide
  Target: SCN9A; (-) strand; PAM type: NRG; PAM sequence: GAG
atatcagtttgcaaaacagg

SEQ ID NO: 23971 - DNA, 20 bp, Artificial Sequence
  Description of Artificial Sequence: Synthetic oligonucleotide
  Target: SCN9A; (-) strand; PAM type: NRG; PAM sequence: GGG
caatatcagtttgcaaaaca

SEQ ID NO: 23972 - DNA, 20 bp, Artificial Sequence
  Description of Artificial Sequence: Synthetic oligonucleotide
  Target: SCN9A; (-) strand; PAM type: NRG; PAM sequence: AGG
gcaatatcagtttgcaaaac

SEQ ID NO: 23973 - DNA, 20 bp, Artificial Sequence
  Description of Artificial Sequence: Synthetic oligonucleotide
  Target: SCN9A; (-) strand; PAM type: NRG; PAM sequence: CAG
ggcaatatcagtttgcaaaa

SEQ ID NO: 23974 - DNA, 20 bp, Artificial Sequence
  Description of Artificial Sequence: Synthetic oligonucleotide
  Target: SCN9A; (-) strand; PAM type: NRG; PAM sequence: CAG
gagaattttactggcaatat

SEQ ID NO: 23975 - DNA, 20 bp, Artificial Sequence
  Description of Artificial Sequence: Synthetic oligonucleotide
  Target: SCN9A; (-) strand; PAM type: NRG; PAM sequence: TGG
aatagaaaagagaattttac

SEQ ID NO: 23976 - DNA, 20 bp, Artificial Sequence
  Description of Artificial Sequence: Synthetic oligonucleotide
  Target: SCN9A; (-) strand; PAM type: NRG; PAM sequence: GAG
cagatggctataatagaaaa

SEQ ID NO: 23977 - DNA, 20 bp, Artificial Sequence
  Description of Artificial Sequence: Synthetic oligonucleotide
  Target: SCN9A; (-) strand; PAM type: NRG; PAM sequence: AAG
cccagatggctataatagaa

SEQ ID NO: 23978 - DNA, 20 bp, Artificial Sequence
  Description of Artificial Sequence: Synthetic oligonucleotide
  Target: SCN9A; (-) strand; PAM type: NRG; PAM sequence: TAG
gaccacccagatggctataa

SEQ ID NO: 23979 - DNA, 20 bp, Artificial Sequence
  Description of Artificial Sequence: Synthetic oligonucleotide
  Target: SCN9A; (-) strand; PAM type: NRG; PAM sequence: TGG
tgtccaaaggaccacccaga

SEQ ID NO: 23980 - DNA, 20 bp, Artificial Sequence
  Description of Artificial Sequence: Synthetic oligonucleotide
  Target: SCN9A; (-) strand; PAM type: NRG; PAM sequence: CAG
ctgttgtccaaaggaccacc

SEQ ID NO: 23981 - DNA, 20 bp, Artificial Sequence
  Description of Artificial Sequence: Synthetic oligonucleotide
  Target: SCN9A; (-) strand; PAM type: NRG; PAM sequence: AGG
ccctgaatgctgttgtccaa

SEQ ID NO: 23982 - DNA, 20 bp, Artificial Sequence
  Description of Artificial Sequence: Synthetic oligonucleotide
  Target: SCN9A; (-) strand; PAM type: NRG; PAM sequence: AAG
gccctgaatgctgttgtcca

SEQ ID NO: 23983 - DNA, 20 bp, Artificial Sequence
  Description of Artificial Sequence: Synthetic oligonucleotide
  Target: SCN9A; (-) strand; PAM type: NRG; PAM sequence: AGG
actgagcactcctacatgcc

SEQ ID NO: 23984 - DNA, 20 bp, Artificial Sequence
  Description of Artificial Sequence: Synthetic oligonucleotide
  Target: SCN9A; (-) strand; PAM type: NRG; PAM sequence: CAG
tactgagcactcctacatgc

SEQ ID NO: 23985 - DNA, 20 bp, Artificial Sequence
  Description of Artificial Sequence: Synthetic oligonucleotide
  Target: SCN9A; (-) strand; PAM type: NRG; PAM sequence: GAG
gagctcagtaaatagttact

SEQ ID NO: 23986 - DNA, 20 bp, Artificial Sequence
  Description of Artificial Sequence: Synthetic oligonucleotide
  Target: SCN9A; (-) strand; PAM type: NRG; PAM sequence: TAG
ttttacttgagctcagtaaa

SEQ ID NO: 23987 - DNA, 20 bp, Artificial Sequence
  Description of Artificial Sequence: Synthetic oligonucleotide
  Target: SCN9A; (-) strand; PAM type: NRG; PAM sequence: CAG
gacaaaattttacttgagct

SEQ ID NO: 23988 - DNA, 20 bp, Artificial Sequence
  Description of Artificial Sequence: Synthetic oligonucleotide
  Target: SCN9A; (-) strand; PAM type: NRG; PAM sequence: GAG
ccaatgacaaaattttactt

SEQ ID NO: 23989 - DNA, 20 bp, Artificial Sequence
  Description of Artificial Sequence: Synthetic oligonucleotide
  Target: SCN9A; (-) strand; PAM type: NRG; PAM sequence: TAG
ctagaattaatccctatgat

SEQ ID NO: 23990 - DNA, 20 bp, Artificial Sequence
  Description of Artificial Sequence: Synthetic oligonucleotide
  Target: SCN9A; (-) strand; PAM type: NRG; PAM sequence: TAG
tcatggcaagttgttttacc

SEQ ID NO: 23991 - DNA, 20 bp, Artificial Sequence
  Description of Artificial Sequence: Synthetic oligonucleotide
  Target: SCN9A; (-) strand; PAM type: NRG; PAM sequence: AAG
aaagataaaaatatcatggc

SEQ ID NO: 23992 - DNA, 20 bp, Artificial Sequence
  Description of Artificial Sequence: Synthetic oligonucleotide
  Target: SCN9A; (-) strand; PAM type: NRG; PAM sequence: TGG
gctaaaagataaaaatatca

SEQ ID NO: 23993 - DNA, 20 bp, Artificial Sequence
  Description of Artificial Sequence: Synthetic oligonucleotide
  Target: SCN9A; (-) strand; PAM type: NRG; PAM sequence: AAG
tattctttaaaatgagctaa

SEQ ID NO: 23994 - DNA, 20 bp, Artificial Sequence
  Description of Artificial Sequence: Synthetic oligonucleotide
  Target: SCN9A; (-) strand; PAM type: NRG; PAM sequence: GAG
aagtcaatattctttaaaat

SEQ ID NO: 23995 - DNA, 20 bp, Artificial Sequence
  Description of Artificial Sequence: Synthetic oligonucleotide
  Target: SCN9A; (-) strand; PAM type: NRG; PAM sequence: AAG
cctaagtcaatatattgatt

SEQ ID NO: 23996 - DNA, 20 bp, Artificial Sequence
  Description of Artificial Sequence: Synthetic oligonucleotide
  Target: SCN9A; (-) strand; PAM type: NRG; PAM sequence: AAG
tggtaaatgatctgacacct

SEQ ID NO: 23997 - DNA, 20 bp, Artificial Sequence
  Description of Artificial Sequence: Synthetic oligonucleotide
  Target: SCN9A; (-) strand; PAM type: NRG; PAM sequence: TGG
cctgctcagcagtggtgccc

SEQ ID NO: 23998 - DNA, 20 bp, Artificial Sequence
  Description of Artificial Sequence: Synthetic oligonucleotide
  Target: SCN9A; (-) strand; PAM type: NRG; PAM sequence: TGG
ctcatgatcctgctcagcag

SEQ ID NO: 23999 - DNA, 20 bp, Artificial Sequence
  Description of Artificial Sequence: Synthetic oligonucleotide
  Target: SCN9A; (-) strand; PAM type: NRG; PAM sequence: CAG
gtcctcatgatcctgctcag

SEQ ID NO: 24000 - DNA, 20 bp, Artificial Sequence
  Description of Artificial Sequence: Synthetic oligonucleotide
  Target: SCN9A; (-) strand; PAM type: NRG; PAM sequence: CAG
attgtcctcatgatcctgct

SEQ ID NO: 24001 - DNA, 20 bp, Artificial Sequence
  Description of Artificial Sequence: Synthetic oligonucleotide
  Target: SCN9A; (-) strand; PAM type: NRG; PAM sequence: AAG
gttgaacacagttggtttga

SEQ ID NO: 24002 - DNA, 20 bp, Artificial Sequence
  Description of Artificial Sequence: Synthetic oligonucleotide
  Target: SCN9A; (-) strand; PAM type: NRG; PAM sequence: TGG
acaagattgttgaacacagt

SEQ ID NO: 24003 - DNA, 20 bp, Artificial Sequence
  Description of Artificial Sequence: Synthetic oligonucleotide
  Target: SCN9A; (-) strand; PAM type: NRG; PAM sequence: CAG
tgctacaagattgttgaaca

SEQ ID NO: 24004 - DNA, 20 bp, Artificial Sequence
  Description of Artificial Sequence: Synthetic oligonucleotide
  Target: SCN9A; (-) strand; PAM type: NRG; PAM sequence: AAG
acatcaggaaaacctgctac

SEQ ID NO: 24005 - DNA, 20 bp, Artificial Sequence
  Description of Artificial Sequence: Synthetic oligonucleotide
  Target: SCN9A; (-) strand; PAM type: NRG; PAM sequence: AGG
gaaaaatctggtggaacatc

SEQ ID NO: 24006 - DNA, 20 bp, Artificial Sequence
  Description of Artificial Sequence: Synthetic oligonucleotide
  Target: SCN9A; (-) strand; PAM type: NRG; PAM sequence: CAG
ggaaaaatctggtggaacat

SEQ ID NO: 24007 - DNA, 20 bp, Artificial Sequence
  Description of Artificial Sequence: Synthetic oligonucleotide
  Target: SCN9A; (-) strand; PAM type: NRG; PAM sequence: TGG
cagggaaaggaaaaatctgg

SEQ ID NO: 24008 - DNA, 20 bp, Artificial Sequence
  Description of Artificial Sequence: Synthetic oligonucleotide
  Target: SCN9A; (-) strand; PAM type: NRG; PAM sequence: TGG
agtcagggaaaggaaaaatc

SEQ ID NO: 24009 - DNA, 20 bp, Artificial Sequence
  Description of Artificial Sequence: Synthetic oligonucleotide
  Target: SCN9A; (-) strand; PAM type: NRG; PAM sequence: AGG
gttaacatagagtcagggaa

SEQ ID NO: 24010 - DNA, 20 bp, Artificial Sequence
  Description of Artificial Sequence: Synthetic oligonucleotide
  Target: SCN9A; (-) strand; PAM type: NRG; PAM sequence: AAG
agttaacatagagtcaggga

SEQ ID NO: 24011 - DNA, 20 bp, Artificial Sequence
  Description of Artificial Sequence: Synthetic oligonucleotide
  Target: SCN9A; (-) strand; PAM type: NRG; PAM sequence: GGG
gccaagttaacatagagtca

SEQ ID NO: 24012 - DNA, 20 bp, Artificial Sequence
  Description of Artificial Sequence: Synthetic oligonucleotide
  Target: SCN9A; (-) strand; PAM type: NRG; PAM sequence: AGG
tgccaagttaacatagagtc

SEQ ID NO: 24013 - DNA, 20 bp, Artificial Sequence
  Description of Artificial Sequence: Synthetic oligonucleotide
  Target: SCN9A; (-) strand; PAM type: NRG; PAM sequence: CAG
ctgccaagttaacatagagt

SEQ ID NO: 24014 - DNA, 20 bp, Artificial Sequence
  Description of Artificial Sequence: Synthetic oligonucleotide
  Target: SCN9A; (-) strand; PAM type: NRG; PAM sequence: GAG
catgctgccaagttaacata

SEQ ID NO: 24015 - DNA, 20 bp, Artificial Sequence
  Description of Artificial Sequence: Synthetic oligonucleotide
  Target: SCN9A; (-) strand; PAM type: NRG; PAM sequence: TAG
ctcatgctgccaagttaaca

SEQ ID NO: 24016 - DNA, 20 bp, Artificial Sequence
  Description of Artificial Sequence: Synthetic oligonucleotide
  Target: SCN9A; (-) strand; PAM type: NRG; PAM sequence: AAG
atggaggttctcatgctgcc

SEQ ID NO: 24017 - DNA, 20 bp, Artificial Sequence
  Description of Artificial Sequence: Synthetic oligonucleotide
  Target: SCN9A; (-) strand; PAM type: NRG; PAM sequence: AGG
tcttgtcaggttgtgtatgg

SEQ ID NO: 24018 - DNA, 20 bp, Artificial Sequence
  Description of Artificial Sequence: Synthetic oligonucleotide
  Target: SCN9A; (-) strand; PAM type: NRG; PAM sequence: GAG
ttcttgtcaggttgtgtatg

SEQ ID NO: 24019 - DNA, 20 bp, Artificial Sequence
  Description of Artificial Sequence: Synthetic oligonucleotide
  Target: SCN9A; (-) strand; PAM type: NRG; PAM sequence: TGG
ctttcttgtcaggttgtgta

SEQ ID NO: 24020 - DNA, 20 bp, Artificial Sequence
  Description of Artificial Sequence: Synthetic oligonucleotide
  Target: SCN9A; (-) strand; PAM type: NRG; PAM sequence: AGG
acatgcatgtctttcttgtc

SEQ ID NO: 24021 - DNA, 20 bp, Artificial Sequence
  Description of Artificial Sequence: Synthetic oligonucleotide
  Target: SCN9A; (-) strand; PAM type: NRG; PAM sequence: CAG
aacatgcatgtctttcttgt

SEQ ID NO: 24022 - DNA, 20 bp, Artificial Sequence
  Description of Artificial Sequence: Synthetic oligonucleotide
  Target: SCN9A; (-) strand; PAM type: NRG; PAM sequence: AAG
ttttatttattctgaatatc

SEQ ID NO: 24023 - DNA, 20 bp, Artificial Sequence
  Description of Artificial Sequence: Synthetic oligonucleotide
  Target: SCN9A; (-) strand; PAM type: NRG; PAM sequence: CAG
tgagggagtatcacagaaag

SEQ ID NO: 24024 - DNA, 20 bp, Artificial Sequence
  Description of Artificial Sequence: Synthetic oligonucleotide
  Target: SCN9A; (-) strand; PAM type: NRG; PAM sequence: AAG
ggttgagggagtatcacaga

SEQ ID NO: 24025 - DNA, 20 bp, Artificial Sequence
  Description of Artificial Sequence: Synthetic oligonucleotide
  Target: SCN9A; (-) strand; PAM type: NRG; PAM sequence: CAG
atttggttgagggagtatca

SEQ ID NO: 24026 - DNA, 20 bp, Artificial Sequence
  Description of Artificial Sequence: Synthetic oligonucleotide
  Target: SCN9A; (-) strand; PAM type: NRG; PAM sequence: GAG
ttgaaattatttggttgagg

SEQ ID NO: 24027 - DNA, 20 bp, Artificial Sequence
  Description of Artificial Sequence: Synthetic oligonucleotide
  Target: SCN9A; (-) strand; PAM type: NRG; PAM sequence: GGG
tgttgaaattatttggttga

SEQ ID NO: 24028 - DNA, 20 bp, Artificial Sequence
  Description of Artificial Sequence: Synthetic oligonucleotide
  Target: SCN9A; (-) strand; PAM type: NRG; PAM sequence: AGG
gtgttgaaattatttggttg

SEQ ID NO: 24029 - DNA, 20 bp, Artificial Sequence
  Description of Artificial Sequence: Synthetic oligonucleotide
  Target: SCN9A; (-) strand; PAM type: NRG; PAM sequence: GAG
ggtgttgaaattatttggtt

SEQ ID NO: 24030 - DNA, 20 bp, Artificial Sequence
  Description of Artificial Sequence: Synthetic oligonucleotide
  Target: SCN9A; (-) strand; PAM type: NRG; PAM sequence: TGG
gtataggtgttgaaattatt

SEQ ID NO: 24031 - DNA, 20 bp, Artificial Sequence
  Description of Artificial Sequence: Synthetic oligonucleotide
  Target: SCN9A; (-) strand; PAM type: NRG; PAM sequence: AGG
ctatctgaaattgcaagtat

SEQ ID NO: 24032 - DNA, 20 bp, Artificial Sequence
  Description of Artificial Sequence: Synthetic oligonucleotide
  Target: SCN9A; (-) strand; PAM type: NRG; PAM sequence: TAG
tctatctgaaattgcaagta

SEQ ID NO: 24033 - DNA, 20 bp, Artificial Sequence
  Description of Artificial Sequence: Synthetic oligonucleotide
  Target: SCN9A; (-) strand; PAM type: NRG; PAM sequence: AAG
ttaaatctatctgaaattgc

SEQ ID NO: 24034 - DNA, 20 bp, Artificial Sequence
  Description of Artificial Sequence: Synthetic oligonucleotide
  Target: SCN9A; (-) strand; PAM type: NRG; PAM sequence: CAG
agttagaagatgaaggaagg

SEQ ID NO: 24035 - DNA, 20 bp, Artificial Sequence
  Description of Artificial Sequence: Synthetic oligonucleotide
  Target: SCN9A; (-) strand; PAM type: NRG; PAM sequence: AGG
caaagttagaagatgaagga

SEQ ID NO: 24036 - DNA, 20 bp, Artificial Sequence
  Description of Artificial Sequence: Synthetic oligonucleotide
  Target: SCN9A; (-) strand; PAM type: NRG; PAM sequence: AAG
gcaaagttagaagatgaagg

SEQ ID NO: 24037 - DNA, 20 bp, Artificial Sequence
  Description of Artificial Sequence: Synthetic oligonucleotide
  Target: SCN9A; (-) strand; PAM type: NRG; PAM sequence: AGG
catgcaaagttagaagatga

SEQ ID NO: 24038 - DNA, 20 bp, Artificial Sequence
  Description of Artificial Sequence: Synthetic oligonucleotide
  Target: SCN9A; (-) strand; PAM type: NRG; PAM sequence: AAG
tcatgcaaagttagaagatg

SEQ ID NO: 24039 - DNA, 20 bp, Artificial Sequence
  Description of Artificial Sequence: Synthetic oligonucleotide
  Target: SCN9A; (-) strand; PAM type: NRG; PAM sequence: AAG
aaaacatcatgcaaagttag

SEQ ID NO: 24040 - DNA, 20 bp, Artificial Sequence
  Description of Artificial Sequence: Synthetic oligonucleotide
  Target: SCN9A; (-) strand; PAM type: NRG; PAM sequence: TAG
tagaaaacatcatgcaaagt

SEQ ID NO: 24041 - DNA, 20 bp, Artificial Sequence
  Description of Artificial Sequence: Synthetic oligonucleotide
  Target: SCN9A; (-) strand; PAM type: NRG; PAM sequence: AAG
tatttagaaaacatcatgca

SEQ ID NO: 24042 - DNA, 20 bp, Artificial Sequence
  Description of Artificial Sequence: Synthetic oligonucleotide
  Target: SCN9A; (-) strand; PAM type: NRG; PAM sequence: TAG
aaaactaactaacaactatt

SEQ ID NO: 24043 - DNA, 20 bp, Artificial Sequence
  Description of Artificial Sequence: Synthetic oligonucleotide
  Target: SCN9A; (-) strand; PAM type: NRG; PAM sequence: AAG
agaagacaagaatacattgt

SEQ ID NO: 24044 - DNA, 20 bp, Artificial Sequence
  Description of Artificial Sequence: Synthetic oligonucleotide
  Target: SCN9A; (-) strand; PAM type: NRG; PAM sequence: AAG
aattggggattacagaagac

SEQ ID NO: 24045 - DNA, 20 bp, Artificial Sequence
  Description of Artificial Sequence: Synthetic oligonucleotide
  Target: SCN9A; (-) strand; PAM type: NRG; PAM sequence: AAG
agagaaattggggattacag

SEQ ID NO: 24046 - DNA, 20 bp, Artificial Sequence
  Description of Artificial Sequence: Synthetic oligonucleotide
  Target: SCN9A; (-) strand; PAM type: NRG; PAM sequence: CAG
tgaagagaaattggggatta

SEQ ID NO: 24047 - DNA, 20 bp, Artificial Sequence
  Description of Artificial Sequence: Synthetic oligonucleotide
  Target: SCN9A; (-) strand; PAM type: NRG; PAM sequence: GGG
aggagactgaagagaaattg

SEQ ID NO: 24048 - DNA, 20 bp, Artificial Sequence
  Description of Artificial Sequence: Synthetic oligonucleotide
  Target: SCN9A; (-) strand; PAM type: NRG; PAM sequence: GGG
gaggagactgaagagaaatt

SEQ ID NO: 24049 - DNA, 20 bp, Artificial Sequence
  Description of Artificial Sequence: Synthetic oligonucleotide
  Target: SCN9A; (-) strand; PAM type: NRG; PAM sequence: TGG
ggaggagactgaagagaaat

SEQ ID NO: 24050 - DNA, 20 bp, Artificial Sequence
  Description of Artificial Sequence: Synthetic oligonucleotide
  Target: SCN9A; (-) strand; PAM type: NRG; PAM sequence: GAG
agactgtggaggagactgaa

SEQ ID NO: 24051 - DNA, 20 bp, Artificial Sequence
  Description of Artificial Sequence: Synthetic oligonucleotide
  Target: SCN9A; (-) strand; PAM type: NRG; PAM sequence: AAG
aaagactgtggaggagactg

SEQ ID NO: 24052 - DNA, 20 bp, Artificial Sequence
  Description of Artificial Sequence: Synthetic oligonucleotide
  Target: SCN9A; (-) strand; PAM type: NRG; PAM sequence: GAG
gtggtttaaagactgtggag

SEQ ID NO: 24053 - DNA, 20 bp, Artificial Sequence
  Description of Artificial Sequence: Synthetic oligonucleotide
  Target: SCN9A; (-) strand; PAM type: NRG; PAM sequence: AGG
aagtggtttaaagactgtgg

SEQ ID NO: 24054 - DNA, 20 bp, Artificial Sequence
  Description of Artificial Sequence: Synthetic oligonucleotide
  Target: SCN9A; (-) strand; PAM type: NRG; PAM sequence: GAG
aaagtggtttaaagactgtg

SEQ ID NO: 24055 - DNA, 20 bp, Artificial Sequence
  Description of Artificial Sequence: Synthetic oligonucleotide
  Target: SCN9A; (-) strand; PAM type: NRG; PAM sequence: TGG
tgaaagtggtttaaagactg

SEQ ID NO: 24056 - DNA, 20 bp, Artificial Sequence
  Description of Artificial Sequence: Synthetic oligonucleotide
  Target: SCN9A; (-) strand; PAM type: NRG; PAM sequence: AAG
cataaaatgaaagtggttta

SEQ ID NO: 24057 - DNA, 20 bp, Artificial Sequence
  Description of Artificial Sequence: Synthetic oligonucleotide
  Target: SCN9A; (-) strand; PAM type: NRG; PAM sequence: TGG
attcacacataaaatgaaag

SEQ ID NO: 24058 - DNA, 20 bp, Artificial Sequence
  Description of Artificial Sequence: Synthetic oligonucleotide
  Target: SCN9A; (-) strand; PAM type: NRG; PAM sequence: AAG
ttcattcacacataaaatga

SEQ ID NO: 24059 - DNA, 20 bp, Artificial Sequence
  Description of Artificial Sequence: Synthetic oligonucleotide
  Target: SCN9A; (-) strand; PAM type: NRG; PAM sequence: TAG
ttcatgtcgtcttcagattt

SEQ ID NO: 24060 - DNA, 20 bp, Artificial Sequence
  Description of Artificial Sequence: Synthetic oligonucleotide
  Target: SCN9A; (-) strand; PAM type: NRG; PAM sequence: CAG
cctaaaattcatgtcgtctt

SEQ ID NO: 24061 - DNA, 20 bp, Artificial Sequence
  Description of Artificial Sequence: Synthetic oligonucleotide
  Target: SCN9A; (-) strand; PAM type: NRG; PAM sequence: AAG
aaatttatctgtcagaaaag

SEQ ID NO: 24062 - DNA, 20 bp, Artificial Sequence
  Description of Artificial Sequence: Synthetic oligonucleotide
  Target: SCN9A; (-) strand; PAM type: NRG; PAM sequence: AAG
gaaaaatttatctgtcagaa

SEQ ID NO: 24063 - DNA, 20 bp, Artificial Sequence
  Description of Artificial Sequence: Synthetic oligonucleotide
  Target: SCN9A; (-) strand; PAM type: NRG; PAM sequence: CAG
gactagaaaaatttatctgt

SEQ ID NO: 24064 - DNA, 20 bp, Artificial Sequence
  Description of Artificial Sequence: Synthetic oligonucleotide
  Target: SCN9A; (-) strand; PAM type: NRG; PAM sequence: TAG
aagtatctaaaattatagac

SEQ ID NO: 24065 - DNA, 20 bp, Artificial Sequence
  Description of Artificial Sequence: Synthetic oligonucleotide
  Target: SCN9A; (-) strand; PAM type: NRG; PAM sequence: TAG
agtggaagtatctaaaatta

SEQ ID NO: 24066 - DNA, 20 bp, Artificial Sequence
  Description of Artificial Sequence: Synthetic oligonucleotide
  Target: SCN9A; (-) strand; PAM type: NRG; PAM sequence: AAG
tttttaccatagaggagtgg

SEQ ID NO: 24067 - DNA, 20 bp, Artificial Sequence
  Description of Artificial Sequence: Synthetic oligonucleotide
  Target: SCN9A; (-) strand; PAM type: NRG; PAM sequence: TGG
gggtttttaccatagaggag

SEQ ID NO: 24068 - DNA, 20 bp, Artificial Sequence
  Description of Artificial Sequence: Synthetic oligonucleotide
  Target: SCN9A; (-) strand; PAM type: NRG; PAM sequence: GAG
agagggtttttaccatagag

SEQ ID NO: 24069 - DNA, 20 bp, Artificial Sequence
  Description of Artificial Sequence: Synthetic oligonucleotide
  Target: SCN9A; (-) strand; PAM type: NRG; PAM sequence: AGG
tcagagggtttttaccatag

SEQ ID NO: 24070 - DNA, 20 bp, Artificial Sequence
  Description of Artificial Sequence: Synthetic oligonucleotide
  Target: SCN9A; (-) strand; PAM type: NRG; PAM sequence: GAG
ttcagagggtttttaccata

SEQ ID NO: 24071 - DNA, 20 bp, Artificial Sequence
  Description of Artificial Sequence: Synthetic oligonucleotide
  Target: SCN9A; (-) strand; PAM type: NRG; PAM sequence: TAG
atttcagagggtttttacca

SEQ ID NO: 24072 - DNA, 20 bp, Artificial Sequence
  Description of Artificial Sequence: Synthetic oligonucleotide
  Target: SCN9A; (-) strand; PAM type: NRG; PAM sequence: GGG
ttagaaaggtgtatttcaga

SEQ ID NO: 24073 - DNA, 20 bp, Artificial Sequence
  Description of Artificial Sequence: Synthetic oligonucleotide
  Target: SCN9A; (-) strand; PAM type: NRG; PAM sequence: AGG
tttagaaaggtgtatttcag

SEQ ID NO: 24074 - DNA, 20 bp, Artificial Sequence
  Description of Artificial Sequence: Synthetic oligonucleotide
  Target: SCN9A; (-) strand; PAM type: NRG; PAM sequence: GAG
gtttagaaaggtgtatttca

SEQ ID NO: 24075 - DNA, 20 bp, Artificial Sequence
  Description of Artificial Sequence: Synthetic oligonucleotide
  Target: SCN9A; (-) strand; PAM type: NRG; PAM sequence: CAG
ttgtttagaaaggtgtattt

SEQ ID NO: 24076 - DNA, 20 bp, Artificial Sequence
  Description of Artificial Sequence: Synthetic oligonucleotide
  Target: SCN9A; (-) strand; PAM type: NRG; PAM sequence: AGG
tttctcaatattgtttagaa

SEQ ID NO: 24077 - DNA, 20 bp, Artificial Sequence
  Description of Artificial Sequence: Synthetic oligonucleotide
  Target: SCN9A; (-) strand; PAM type: NRG; PAM sequence: AAG
ttttctcaatattgtttaga

SEQ ID NO: 24078 - DNA, 20 bp, Artificial Sequence
  Description of Artificial Sequence: Synthetic oligonucleotide
  Target: SCN9A; (-) strand; PAM type: NRG; PAM sequence: TAG
ctaattttctcaatattgtt

SEQ ID NO: 24079 - DNA, 20 bp, Artificial Sequence
  Description of Artificial Sequence: Synthetic oligonucleotide
  Target: SCN9A; (-) strand; PAM type: NRG; PAM sequence: GAG
tcttttgaacttaatttcag

SEQ ID NO: 24080 - DNA, 20 bp, Artificial Sequence
  Description of Artificial Sequence: Synthetic oligonucleotide
  Target: SCN9A; (-) strand; PAM type: NRG; PAM sequence: AGG
tttcttttgaacttaatttc

SEQ ID NO: 24081 - DNA, 20 bp, Artificial Sequence
  Description of Artificial Sequence: Synthetic oligonucleotide
  Target: SCN9A; (-) strand; PAM type: NRG; PAM sequence: CAG
gtttcttttgaacttaattt

SEQ ID NO: 24082 - DNA, 20 bp, Artificial Sequence
  Description of Artificial Sequence: Synthetic oligonucleotide
  Target: SCN9A; (-) strand; PAM type: NRG; PAM sequence: GAG
ctggatcttctaatcaagat

SEQ ID NO: 24083 - DNA, 20 bp, Artificial Sequence
  Description of Artificial Sequence: Synthetic oligonucleotide
  Target: SCN9A; (-) strand; PAM type: NRG; PAM sequence: AAG
ttcatctggatcttctaatc

SEQ ID NO: 24084 - DNA, 20 bp, Artificial Sequence
  Description of Artificial Sequence: Synthetic oligonucleotide
  Target: SCN9A; (-) strand; PAM type: NRG; PAM sequence: TGG
atacttgaaacagtttcatc

SEQ ID NO: 24085 - DNA, 20 bp, Artificial Sequence
  Description of Artificial Sequence: Synthetic oligonucleotide
  Target: SCN9A; (-) strand; PAM type: NRG; PAM sequence: CAG
ttaacttagaatacttgaaa

SEQ ID NO: 24086 - DNA, 20 bp, Artificial Sequence
  Description of Artificial Sequence: Synthetic oligonucleotide
  Target: SCN9A; (-) strand; PAM type: NRG; PAM sequence: TAG
agtcacatttgtttttaact

SEQ ID NO: 24087 - DNA, 20 bp, Artificial Sequence
  Description of Artificial Sequence: Synthetic oligonucleotide
  Target: SCN9A; (-) strand; PAM type: NRG; PAM sequence: AAG
attttgtacataaaaattta

SEQ ID NO: 24088 - DNA, 20 bp, Artificial Sequence
  Description of Artificial Sequence: Synthetic oligonucleotide
  Target: SCN9A; (-) strand; PAM type: NRG; PAM sequence: CAG
caattttcaattttttgtag

SEQ ID NO: 24089 - DNA, 20 bp, Artificial Sequence
  Description of Artificial Sequence: Synthetic oligonucleotide
  Target: SCN9A; (-) strand; PAM type: NRG; PAM sequence: TAG
gtacaattttcaattttttg

SEQ ID NO: 24090 - DNA, 20 bp, Artificial Sequence
  Description of Artificial Sequence: Synthetic oligonucleotide
  Target: SCN9A; (-) strand; PAM type: NRG; PAM sequence: AAG
gaataaacctaaccattttt

SEQ ID NO: 24091 - DNA, 20 bp, Artificial Sequence
  Description of Artificial Sequence: Synthetic oligonucleotide
  Target: SCN9A; (-) strand; PAM type: NRG; PAM sequence: AAG
aacaagggtttgatggacaa

SEQ ID NO: 24092 - DNA, 20 bp, Artificial Sequence
  Description of Artificial Sequence: Synthetic oligonucleotide
  Target: SCN9A; (-) strand; PAM type: NRG; PAM sequence: TGG
gatacgtaacaagggtttga

SEQ ID NO: 24093 - DNA, 20 bp, Artificial Sequence
  Description of Artificial Sequence: Synthetic oligonucleotide
  Target: SCN9A; (-) strand; PAM type: NRG; PAM sequence: GGG
acataaaagatacgtaacaa

SEQ ID NO: 24094 - DNA, 20 bp, Artificial Sequence
  Description of Artificial Sequence: Synthetic oligonucleotide
  Target: SCN9A; (-) strand; PAM type: NRG; PAM sequence: AGG
tacataaaagatacgtaaca

SEQ ID NO: 24095 - DNA, 20 bp, Artificial Sequence
  Description of Artificial Sequence: Synthetic oligonucleotide
  Target: SCN9A; (-) strand; PAM type: NRG; PAM sequence: AAG
atacataaaagatacgtaac

SEQ ID NO: 24096 - DNA, 20 bp, Artificial Sequence
  Description of Artificial Sequence: Synthetic oligonucleotide
  Target: SCN9A; (-) strand; PAM type: NRG; PAM sequence: AAG
gtacagaggtgaatacataa

SEQ ID NO: 24097 - DNA, 20 bp, Artificial Sequence
  Description of Artificial Sequence: Synthetic oligonucleotide
  Target: SCN9A; (-) strand; PAM type: NRG; PAM sequence: AGG
ggaaaggaaatcatgtacag

SEQ ID NO: 24098 - DNA, 20 bp, Artificial Sequence
  Description of Artificial Sequence: Synthetic oligonucleotide
  Target: SCN9A; (-) strand; PAM type: NRG; PAM sequence: GAG
aggaaaggaaatcatgtaca

SEQ ID NO: 24099 - DNA, 20 bp, Artificial Sequence
  Description of Artificial Sequence: Synthetic oligonucleotide
  Target: SCN9A; (-) strand; PAM type: NRG; PAM sequence: CAG
tgaggaaaggaaatcatgta

SEQ ID NO: 24100 - DNA, 20 bp, Artificial Sequence
  Description of Artificial Sequence: Synthetic oligonucleotide
  Target: SCN9A; (-) strand; PAM type: NRG; PAM sequence: AGG
aacataaattcactgaggaa

SEQ ID NO: 24101 - DNA, 20 bp, Artificial Sequence
  Description of Artificial Sequence: Synthetic oligonucleotide
  Target: SCN9A; (-) strand; PAM type: NRG; PAM sequence: AAG
taacataaattcactgagga

SEQ ID NO: 24102 - DNA, 20 bp, Artificial Sequence
  Description of Artificial Sequence: Synthetic oligonucleotide
  Target: SCN9A; (-) strand; PAM type: NRG; PAM sequence: AGG
aacctaacataaattcactg

SEQ ID NO: 24103 - DNA, 20 bp, Artificial Sequence
  Description of Artificial Sequence: Synthetic oligonucleotide
  Target: SCN9A; (-) strand; PAM type: NRG; PAM sequence: GAG
aaacctaacataaattcact

SEQ ID NO: 24104 - DNA, 20 bp, Artificial Sequence
  Description of Artificial Sequence: Synthetic oligonucleotide
  Target: SCN9A; (-) strand; PAM type: NRG; PAM sequence: TAG
ttagttgccatatctagtta

SEQ ID NO: 24105 - DNA, 20 bp, Artificial Sequence
  Description of Artificial Sequence: Synthetic oligonucleotide
  Target: SCN9A; (-) strand; PAM type: NRG; PAM sequence: TAG
gtcactttagttgccatatc

SEQ ID NO: 24106 - DNA, 20 bp, Artificial Sequence
  Description of Artificial Sequence: Synthetic oligonucleotide
  Target: SCN9A; (-) strand; PAM type: NRG; PAM sequence: TAG
accctgactatctgtcactt

SEQ ID NO: 24107 - DNA, 20 bp, Artificial Sequence
  Description of Artificial Sequence: Synthetic oligonucleotide
  Target: SCN9A; (-) strand; PAM type: NRG; PAM sequence: GAG
tctcaagaaataagccaggt

SEQ ID NO: 24108 - DNA, 20 bp, Artificial Sequence
  Description of Artificial Sequence: Synthetic oligonucleotide
  Target: SCN9A; (-) strand; PAM type: NRG; PAM sequence: AGG
tctttctcaagaaataagcc

SEQ ID NO: 24109 - DNA, 20 bp, Artificial Sequence
  Description of Artificial Sequence: Synthetic oligonucleotide
  Target: SCN9A; (-) strand; PAM type: NRG; PAM sequence: CAG
ctctttctcaagaaataagc

SEQ ID NO: 24110 - DNA, 20 bp, Artificial Sequence
  Description of Artificial Sequence: Synthetic oligonucleotide
  Target: SCN9A; (-) strand; PAM type: NRG; PAM sequence: AAG
atctctctttctcaagaaat

SEQ ID NO: 24111 - DNA, 20 bp, Artificial Sequence
  Description of Artificial Sequence: Synthetic oligonucleotide
  Target: SCN9A; (-) strand; PAM type: NRG; PAM sequence: AAG
tctactgatctctctttctc

SEQ ID NO: 24112 - DNA, 20 bp, Artificial Sequence
  Description of Artificial Sequence: Synthetic oligonucleotide
  Target: SCN9A; (-) strand; PAM type: NRG; PAM sequence: AAG
caggctccatctcttctagg

SEQ ID NO: 24113 - DNA, 20 bp, Artificial Sequence
  Description of Artificial Sequence: Synthetic oligonucleotide
  Target: SCN9A; (-) strand; PAM type: NRG; PAM sequence: AGG
acccaggctccatctcttct

SEQ ID NO: 24114 - DNA, 20 bp, Artificial Sequence
  Description of Artificial Sequence: Synthetic oligonucleotide
  Target: SCN9A; (-) strand; PAM type: NRG; PAM sequence: TAG
aacccaggctccatctcttc

SEQ ID NO: 24115 - DNA, 20 bp, Artificial Sequence
  Description of Artificial Sequence: Synthetic oligonucleotide
  Target: SCN9A; (-) strand; PAM type: NRG; PAM sequence: AGG
ctgatattttgattcaaccc

SEQ ID NO: 24116 - DNA, 20 bp, Artificial Sequence
  Description of Artificial Sequence: Synthetic oligonucleotide
  Target: SCN9A; (-) strand; PAM type: NRG; PAM sequence: CAG
actgatattttgattcaacc

SEQ ID NO: 24117 - DNA, 20 bp, Artificial Sequence
  Description of Artificial Sequence: Synthetic oligonucleotide
  Target: SCN9A; (-) strand; PAM type: NRG; PAM sequence: TGG
gcataacaatttttgctgcc

SEQ ID NO: 24118 - DNA, 20 bp, Artificial Sequence
  Description of Artificial Sequence: Synthetic oligonucleotide
  Target: SCN9A; (-) strand; PAM type: NRG; PAM sequence: TGG
cttgcatcacaattctaaac

SEQ ID NO: 24119 - DNA, 20 bp, Artificial Sequence
  Description of Artificial Sequence: Synthetic oligonucleotide
  Target: SCN9A; (-) strand; PAM type: NRG; PAM sequence: AAG
ataatctgaccaatttttct

SEQ ID NO: 24120 - DNA, 20 bp, Artificial Sequence
  Description of Artificial Sequence: Synthetic oligonucleotide
  Target: SCN9A; (-) strand; PAM type: NRG; PAM sequence: AGG
agccaaactccttaaggtaa

SEQ ID NO: 24121 - DNA, 20 bp, Artificial Sequence
  Description of Artificial Sequence: Synthetic oligonucleotide
  Target: SCN9A; (-) strand; PAM type: NRG; PAM sequence: AAG
aagccaaactccttaaggta

SEQ ID NO: 24122 - DNA, 20 bp, Artificial Sequence
  Description of Artificial Sequence: Synthetic oligonucleotide
  Target: SCN9A; (-) strand; PAM type: NRG; PAM sequence: AGG
gatataagccaaactcctta

SEQ ID NO: 24123 - DNA, 20 bp, Artificial Sequence
  Description of Artificial Sequence: Synthetic oligonucleotide
  Target: SCN9A; (-) strand; PAM type: NRG; PAM sequence: AAG
ggatataagccaaactcctt

SEQ ID NO: 24124 - DNA, 20 bp, Artificial Sequence
  Description of Artificial Sequence: Synthetic oligonucleotide
  Target: SCN9A; (-) strand; PAM type: NRG; PAM sequence: AAG
cctcaacctcaataggatat

SEQ ID NO: 24125 - DNA, 20 bp, Artificial Sequence
  Description of Artificial Sequence: Synthetic oligonucleotide
  Target: SCN9A; (-) strand; PAM type: NRG; PAM sequence: AGG
acttactcctcaacctcaat

SEQ ID NO: 24126 - DNA, 20 bp, Artificial Sequence
  Description of Artificial Sequence: Synthetic oligonucleotide
  Target: SCN9A; (-) strand; PAM type: NRG; PAM sequence: TAG
tacttactcctcaacctcaa

SEQ ID NO: 24127 - DNA, 20 bp, Artificial Sequence
  Description of Artificial Sequence: Synthetic oligonucleotide
  Target: SCN9A; (-) strand; PAM type: NRG; PAM sequence: GAG
cttatcctccatgtaccgtg

SEQ ID NO: 24128 - DNA, 20 bp, Artificial Sequence
  Description of Artificial Sequence: Synthetic oligonucleotide
  Target: SCN9A; (-) strand; PAM type: NRG; PAM sequence: TGG
aacttatcctccatgtaccg

SEQ ID NO: 24129 - DNA, 20 bp, Artificial Sequence
  Description of Artificial Sequence: Synthetic oligonucleotide
  Target: SCN9A; (-) strand; PAM type: NRG; PAM sequence: GGG
cagaatccaaatggttttct

SEQ ID NO: 24130 - DNA, 20 bp, Artificial Sequence
  Description of Artificial Sequence: Synthetic oligonucleotide
  Target: SCN9A; (-) strand; PAM type: NRG; PAM sequence: TGG
ccagaatccaaatggttttc

SEQ ID NO: 24131 - DNA, 20 bp, Artificial Sequence
  Description of Artificial Sequence: Synthetic oligonucleotide
  Target: SCN9A; (-) strand; PAM type: NRG; PAM sequence: TGG
atactggaccagaatccaaa

SEQ ID NO: 24132 - DNA, 20 bp, Artificial Sequence
  Description of Artificial Sequence: Synthetic oligonucleotide
  Target: SCN9A; (-) strand; PAM type: NRG; PAM sequence: CAG
ctccagacaggatactggac

SEQ ID NO: 24133 - DNA, 20 bp, Artificial Sequence
  Description of Artificial Sequence: Synthetic oligonucleotide
  Target: SCN9A; (-) strand; PAM type: NRG; PAM sequence: TGG
tttccctccagacaggatac

SEQ ID NO: 24134 - DNA, 20 bp, Artificial Sequence
  Description of Artificial Sequence: Synthetic oligonucleotide
  Target: SCN9A; (-) strand; PAM type: NRG; PAM sequence: AGG
actaatctttccctccagac

SEQ ID NO: 24135 - DNA, 20 bp, Artificial Sequence
  Description of Artificial Sequence: Synthetic oligonucleotide
  Target: SCN9A; (-) strand; PAM type: NRG; PAM sequence: CAG
aactaatctttccctccaga

SEQ ID NO: 24136 - DNA, 20 bp, Artificial Sequence
  Description of Artificial Sequence: Synthetic oligonucleotide
  Target: SCN9A; (-) strand; PAM type: NRG; PAM sequence: CAG
tcctaactaatctttccctc

SEQ ID NO: 24137 - DNA, 20 bp, Artificial Sequence
  Description of Artificial Sequence: Synthetic oligonucleotide
  Target: SCN9A; (-) strand; PAM type: NRG; PAM sequence: TAG
tcttgaatctgttacaactc

SEQ ID NO: 24138 - DNA, 20 bp, Artificial Sequence
  Description of Artificial Sequence: Synthetic oligonucleotide
  Target: SCN9A; (-) strand; PAM type: NRG; PAM sequence: GGG
aacatccacctggtagtcct

SEQ ID NO: 24139 - DNA, 20 bp, Artificial Sequence
  Description of Artificial Sequence: Synthetic oligonucleotide
  Target: SCN9A; (-) strand; PAM type: NRG; PAM sequence: TGG
taacatccacctggtagtcc

SEQ ID NO: 24140 - DNA, 20 bp, Artificial Sequence
  Description of Artificial Sequence: Synthetic oligonucleotide
  Target: SCN9A; (-) strand; PAM type: NRG; PAM sequence: TAG
cactgctaacatccacctgg

SEQ ID NO: 24141 - DNA, 20 bp, Artificial Sequence
  Description of Artificial Sequence: Synthetic oligonucleotide
  Target: SCN9A; (-) strand; PAM type: NRG; PAM sequence: TGG
attcactgctaacatccacc

SEQ ID NO: 24142 - DNA, 20 bp, Artificial Sequence
  Description of Artificial Sequence: Synthetic oligonucleotide
  Target: SCN9A; (-) strand; PAM type: NRG; PAM sequence: TGG
cgagtcagctcctcctcctg

SEQ ID NO: 24143 - DNA, 20 bp, Artificial Sequence
  Description of Artificial Sequence: Synthetic oligonucleotide
  Target: SCN9A; (-) strand; PAM type: NRG; PAM sequence: CAG
aaaatcattacctgccgagt

SEQ ID NO: 24144 - DNA, 20 bp, Artificial Sequence
  Description of Artificial Sequence: Synthetic oligonucleotide
  Target: SCN9A; (-) strand; PAM type: NRG; PAM sequence: GAG
tctcaaaatcattacctgcc

SEQ ID NO: 24145 - DNA, 20 bp, Artificial Sequence
  Description of Artificial Sequence: Synthetic oligonucleotide
  Target: SCN9A; (-) strand; PAM type: NRG; PAM sequence: AGG
tctgtatttaaacaattcac

SEQ ID NO: 24146 - DNA, 20 bp, Artificial Sequence
  Description of Artificial Sequence: Synthetic oligonucleotide
  Target: SCN9A; (-) strand; PAM type: NRG; PAM sequence: CAG
atctgtatttaaacaattca

SEQ ID NO: 24147 - DNA, 20 bp, Artificial Sequence
  Description of Artificial Sequence: Synthetic oligonucleotide
  Target: SCN9A; (-) strand; PAM type: NRG; PAM sequence: AGG
cccccatttttaaaatctat

SEQ ID NO: 24148 - DNA, 20 bp, Artificial Sequence
  Description of Artificial Sequence: Synthetic oligonucleotide
  Target: SCN9A; (-) strand; PAM type: NRG; PAM sequence: TAG
acccccatttttaaaatcta

SEQ ID NO: 24149 - DNA, 20 bp, Artificial Sequence
  Description of Artificial Sequence: Synthetic oligonucleotide
  Target: SCN9A; (-) strand; PAM type: NRG; PAM sequence: AGG
agacaggtttttcccgtttc

SEQ ID NO: 24150 - DNA, 20 bp, Artificial Sequence
  Description of Artificial Sequence: Synthetic oligonucleotide
  Target: SCN9A; (-) strand; PAM type: NRG; PAM sequence: CAG
tagacaggtttttcccgttt

SEQ ID NO: 24151 - DNA, 20 bp, Artificial Sequence
  Description of Artificial Sequence: Synthetic oligonucleotide
  Target: SCN9A; (-) strand; PAM type: NRG; PAM sequence: AGG
ctaagaattcttttctagac

SEQ ID NO: 24152 - DNA, 20 bp, Artificial Sequence
  Description of Artificial Sequence: Synthetic oligonucleotide
  Target: SCN9A; (-) strand; PAM type: NRG; PAM sequence: CAG
actaagaattcttttctaga

SEQ ID NO: 24153 - DNA, 20 bp, Artificial Sequence
  Description of Artificial Sequence: Synthetic oligonucleotide
  Target: SCN9A; (-) strand; PAM type: NRG; PAM sequence: TAG
tattactaagaattcttttc

SEQ ID NO: 24154 - DNA, 20 bp, Artificial Sequence
  Description of Artificial Sequence: Synthetic oligonucleotide
  Target: SCN9A; (-) strand; PAM type: NRG; PAM sequence: AAG
catgtatgctaattattact

SEQ ID NO: 24155 - DNA, 20 bp, Artificial Sequence
  Description of Artificial Sequence: Synthetic oligonucleotide
  Target: SCN9A; (-) strand; PAM type: NRG; PAM sequence: CAG
aaaaactgttctgacttcag

SEQ ID NO: 24156 - DNA, 20 bp, Artificial Sequence
  Description of Artificial Sequence: Synthetic oligonucleotide
  Target: SCN9A; (-) strand; PAM type: NRG; PAM sequence: CAG
ctcaaaaactgttctgactt

SEQ ID NO: 24157 - DNA, 20 bp, Artificial Sequence
  Description of Artificial Sequence: Synthetic oligonucleotide
  Target: SCN9A; (-) strand; PAM type: NRG; PAM sequence: TGG
gtttcagaatgtttcggagt

SEQ ID NO: 24158 - DNA, 20 bp, Artificial Sequence
  Description of Artificial Sequence: Synthetic oligonucleotide
  Target: SCN9A; (-) strand; PAM type: NRG; PAM sequence: GAG
tgttgtttcagaatgtttcg

SEQ ID NO: 24159 - DNA, 20 bp, Artificial Sequence
  Description of Artificial Sequence: Synthetic oligonucleotide
  Target: SCN9A; (-) strand; PAM type: NRG; PAM sequence: CGG
attgttgtttcagaatgttt

SEQ ID NO: 24160 - DNA, 20 bp, Artificial Sequence
  Description of Artificial Sequence: Synthetic oligonucleotide
  Target: SCN9A; (-) strand; PAM type: NRG; PAM sequence: CAG
ctcccttaatattgttgttt

SEQ ID NO: 24161 - DNA, 20 bp, Artificial Sequence
  Description of Artificial Sequence: Synthetic oligonucleotide
  Target: SCN9A; (-) strand; PAM type: NRG; PAM sequence: CAG
gaattggtatggtctgcttt

SEQ ID NO: 24162 - DNA, 20 bp, Artificial Sequence
  Description of Artificial Sequence: Synthetic oligonucleotide
  Target: SCN9A; (-) strand; PAM type: NRG; PAM sequence: TGG
tttaacaacaagaattggta

SEQ ID NO: 24163 - DNA, 20 bp, Artificial Sequence
  Description of Artificial Sequence: Synthetic oligonucleotide
  Target: SCN9A; (-) strand; PAM type: NRG; PAM sequence: TGG
gacagtttaacaacaagaat

SEQ ID NO: 24164 - DNA, 20 bp, Artificial Sequence
  Description of Artificial Sequence: Synthetic oligonucleotide
  Target: SCN9A; (-) strand; PAM type: NRG; PAM sequence: AAG
atttctgacagtttaacaac

SEQ ID NO: 24165 - DNA, 20 bp, Artificial Sequence
  Description of Artificial Sequence: Synthetic oligonucleotide
  Target: SCN9A; (-) strand; PAM type: NRG; PAM sequence: CAG
agacaagcaggaatttctga

SEQ ID NO: 24166 - DNA, 20 bp, Artificial Sequence
  Description of Artificial Sequence: Synthetic oligonucleotide
  Target: SCN9A; (-) strand; PAM type: NRG; PAM sequence: AGG
gcttttaacaacagacaagc

SEQ ID NO: 24167 - DNA, 20 bp, Artificial Sequence
  Description of Artificial Sequence: Synthetic oligonucleotide
  Target: SCN9A; (-) strand; PAM type: NRG; PAM sequence: CAG
tgcttttaacaacagacaag

SEQ ID NO: 24168 - DNA, 20 bp, Artificial Sequence
  Description of Artificial Sequence: Synthetic oligonucleotide
  Target: SCN9A; (-) strand; PAM type: NRG; PAM sequence: AAG
ggctgcttttaacaacagac

SEQ ID NO: 24169 - DNA, 20 bp, Artificial Sequence
  Description of Artificial Sequence: Synthetic oligonucleotide
  Target: SCN9A; (-) strand; PAM type: NRG; PAM sequence: CAG
ataatggctgcttttaacaa

SEQ ID NO: 24170 - DNA, 20 bp, Artificial Sequence
  Description of Artificial Sequence: Synthetic oligonucleotide
  Target: SCN9A; (-) strand; PAM type: NRG; PAM sequence: TGG
tatagtcaaatatttaataa

SEQ ID NO: 24171 - DNA, 20 bp, Artificial Sequence
  Description of Artificial Sequence: Synthetic oligonucleotide
  Target: SCN9A; (-) strand; PAM type: NRG; PAM sequence: TAG
tatagaattctaagtttata

SEQ ID NO: 24172 - DNA, 20 bp, Artificial Sequence
  Description of Artificial Sequence: Synthetic oligonucleotide
  Target: SCN9A; (-) strand; PAM type: NRG; PAM sequence: AAG
aaggtaagttatagaattct

SEQ ID NO: 24173 - DNA, 20 bp, Artificial Sequence
  Description of Artificial Sequence: Synthetic oligonucleotide
  Target: SCN9A; (-) strand; PAM type: NRG; PAM sequence: TAG
cctttccttaaggtaagtta

SEQ ID NO: 24174 - DNA, 20 bp, Artificial Sequence
  Description of Artificial Sequence: Synthetic oligonucleotide
  Target: SCN9A; (-) strand; PAM type: NRG; PAM sequence: AAG
ttattacctttccttaaggt

SEQ ID NO: 24175 - DNA, 20 bp, Artificial Sequence
  Description of Artificial Sequence: Synthetic oligonucleotide
  Target: SCN9A; (-) strand; PAM type: NRG; PAM sequence: AGG
gtatttattacctttcctta

SEQ ID NO: 24176 - DNA, 20 bp, Artificial Sequence
  Description of Artificial Sequence: Synthetic oligonucleotide
  Target: SCN9A; (-) strand; PAM type: NRG; PAM sequence: AAG
agtatttattacctttcctt

SEQ ID NO: 24177 - DNA, 20 bp, Artificial Sequence
  Description of Artificial Sequence: Synthetic oligonucleotide
  Target: SCN9A; (-) strand; PAM type: NRG; PAM sequence: TAG
aattaggaagtgatatgtct

SEQ ID NO: 24178 - DNA, 20 bp, Artificial Sequence
  Description of Artificial Sequence: Synthetic oligonucleotide
  Target: SCN9A; (-) strand; PAM type: NRG; PAM sequence: AAG
aatacagtaaaataattagg

SEQ ID NO: 24179 - DNA, 20 bp, Artificial Sequence
  Description of Artificial Sequence: Synthetic oligonucleotide
  Target: SCN9A; (-) strand; PAM type: NRG; PAM sequence: AGG
taaaatacagtaaaataatt

SEQ ID NO: 24180 - DNA, 20 bp, Artificial Sequence
  Description of Artificial Sequence: Synthetic oligonucleotide
  Target: SCN9A; (-) strand; PAM type: NRG; PAM sequence: TAG
ataaaatacagtaaaataat

SEQ ID NO: 24181 - DNA, 20 bp, Artificial Sequence
  Description of Artificial Sequence: Synthetic oligonucleotide
  Target: SCN9A; (-) strand; PAM type: NRG; PAM sequence: CAG
cggaatagacaaataaaata

SEQ ID NO: 24182 - DNA, 20 bp, Artificial Sequence
  Description of Artificial Sequence: Synthetic oligonucleotide
  Target: SCN9A; (-) strand; PAM type: NRG; PAM sequence: TAG
cttctgctattcaaacggaa

SEQ ID NO: 24183 - DNA, 20 bp, Artificial Sequence
  Description of Artificial Sequence: Synthetic oligonucleotide
  Target: SCN9A; (-) strand; PAM type: NRG; PAM sequence: CGG
ccatacttctgctattcaaa

SEQ ID NO: 24184 - DNA, 20 bp, Artificial Sequence
  Description of Artificial Sequence: Synthetic oligonucleotide
  Target: SCN9A; (-) strand; PAM type: NRG; PAM sequence: CAG
agagatgcacaatagcccga

SEQ ID NO: 24185 - DNA, 20 bp, Artificial Sequence
  Description of Artificial Sequence: Synthetic oligonucleotide
  Target: SCN9A; (-) strand; PAM type: NRG; PAM sequence: TAG
cagaaagaagagatgcacaa

SEQ ID NO: 24186 - DNA, 20 bp, Artificial Sequence
  Description of Artificial Sequence: Synthetic oligonucleotide
  Target: SCN9A; (-) strand; PAM type: NRG; PAM sequence: GAG
agaccaccgtccagaaagaa

SEQ ID NO: 24187 - DNA, 20 bp, Artificial Sequence
  Description of Artificial Sequence: Synthetic oligonucleotide
  Target: SCN9A; (-) strand; PAM type: NRG; PAM sequence: AAG
atagaccaccgtccagaaag

SEQ ID NO: 24188 - DNA, 20 bp, Artificial Sequence
  Description of Artificial Sequence: Synthetic oligonucleotide
  Target: SCN9A; (-) strand; PAM type: NRG; PAM sequence: AAG
agaatagaccaccgtccaga

SEQ ID NO: 24189 - DNA, 20 bp, Artificial Sequence
  Description of Artificial Sequence: Synthetic oligonucleotide
  Target: SCN9A; (-) strand; PAM type: NRG; PAM sequence: CAG
agagagaatagaccaccgtc

SEQ ID NO: 24190 - DNA, 20 bp, Artificial Sequence
  Description of Artificial Sequence: Synthetic oligonucleotide
  Target: SCN9A; (-) strand; PAM type: NRG; PAM sequence: TAG
agagaataatccagagagaa

SEQ ID NO: 24191 - DNA, 20 bp, Artificial Sequence
  Description of Artificial Sequence: Synthetic oligonucleotide
  Target: SCN9A; (-) strand; PAM type: NRG; PAM sequence: GAG
tccagagagaataatccaga

SEQ ID NO: 24192 - DNA, 20 bp, Artificial Sequence
  Description of Artificial Sequence: Synthetic oligonucleotide
  Target: SCN9A; (-) strand; PAM type: NRG; PAM sequence: GAG
tgtccagagagaataatcca

SEQ ID NO: 24193 - DNA, 20 bp, Artificial Sequence
  Description of Artificial Sequence: Synthetic oligonucleotide
  Target: SCN9A; (-) strand; PAM type: NRG; PAM sequence: CAG
actgtccagagagaataatc

SEQ ID NO: 24194 - DNA, 20 bp, Artificial Sequence
  Description of Artificial Sequence: Synthetic oligonucleotide
  Target: SCN9A; (-) strand; PAM type: NRG; PAM sequence: GAG
gcatattactactgtccaga

SEQ ID NO: 24195 - DNA, 20 bp, Artificial Sequence
  Description of Artificial Sequence: Synthetic oligonucleotide
  Target: SCN9A; (-) strand; PAM type: NRG; PAM sequence: GAG
tagcatattactactgtcca

SEQ ID NO: 24196 - DNA, 20 bp, Artificial Sequence
  Description of Artificial Sequence: Synthetic oligonucleotide
  Target: SCN9A; (-) strand; PAM type: NRG; PAM sequence: CAG
tatagcatattactactgtc

SEQ ID NO: 24197 - DNA, 20 bp, Artificial Sequence
  Description of Artificial Sequence: Synthetic oligonucleotide
  Target: SCN9A; (-) strand; PAM type: NRG; PAM sequence: TAG
tgcacagtagcccaatagta

SEQ ID NO: 24198 - DNA, 20 bp, Artificial Sequence
  Description of Artificial Sequence: Synthetic oligonucleotide
  Target: SCN9A; (-) strand; PAM type: NRG; PAM sequence: TAG
agagttgcacagtagcccaa

SEQ ID NO: 24199 - DNA, 20 bp, Artificial Sequence
  Description of Artificial Sequence: Synthetic oligonucleotide
  Target: SCN9A; (-) strand; PAM type: NRG; PAM sequence: TAG
cagaaagaagagttgcacag

SEQ ID NO: 24200 - DNA, 20 bp, Artificial Sequence
  Description of Artificial Sequence: Synthetic oligonucleotide
  Target: SCN9A; (-) strand; PAM type: NRG; PAM sequence: CAG
atccagaaagaagagttgca

SEQ ID NO: 24201 - DNA, 20 bp, Artificial Sequence
  Description of Artificial Sequence: Synthetic oligonucleotide
  Target: SCN9A; (-) strand; PAM type: NRG; PAM sequence: GAG
agaccagcatccagaaagaa

SEQ ID NO: 24202 - DNA, 20 bp, Artificial Sequence
  Description of Artificial Sequence: Synthetic oligonucleotide
  Target: SCN9A; (-) strand; PAM type: NRG; PAM sequence: AAG
atagaccagcatccagaaag

SEQ ID NO: 24203 - DNA, 20 bp, Artificial Sequence
  Description of Artificial Sequence: Synthetic oligonucleotide
  Target: SCN9A; (-) strand; PAM type: NRG; PAM sequence: AAG
agaatagaccagcatccaga

SEQ ID NO: 24204 - DNA, 20 bp, Artificial Sequence
  Description of Artificial Sequence: Synthetic oligonucleotide
  Target: SCN9A; (-) strand; PAM type: NRG; PAM sequence: CAG
agatagaatagaccagcatc

SEQ ID NO: 24205 - DNA, 20 bp, Artificial Sequence
  Description of Artificial Sequence: Synthetic oligonucleotide
  Target: SCN9A; (-) strand; PAM type: NRG; PAM sequence: CAG
ataggccagatagaatagac

SEQ ID NO: 24206 - DNA, 20 bp, Artificial Sequence
  Description of Artificial Sequence: Synthetic oligonucleotide
  Target: SCN9A; (-) strand; PAM type: NRG; PAM sequence: TAG
atagaataggccagatagaa

SEQ ID NO: 24207 - DNA, 20 bp, Artificial Sequence
  Description of Artificial Sequence: Synthetic oligonucleotide
  Target: SCN9A; (-) strand; PAM type: NRG; PAM sequence: TAG
tccagatagaataggccaga

SEQ ID NO: 24208 - DNA, 20 bp, Artificial Sequence
  Description of Artificial Sequence: Synthetic oligonucleotide
  Target: SCN9A; (-) strand; PAM type: NRG; PAM sequence: CAG
accatccagatagaataggc

SEQ ID NO: 24209 - DNA, 20 bp, Artificial Sequence
  Description of Artificial Sequence: Synthetic oligonucleotide
  Target: SCN9A; (-) strand; PAM type: NRG; PAM sequence: AGG
ttccaccatccagatagaat

SEQ ID NO: 24210 - DNA, 20 bp, Artificial Sequence
  Description of Artificial Sequence: Synthetic oligonucleotide
  Target: SCN9A; (-) strand; PAM type: NRG; PAM sequence: TAG
cttccaccatccagatagaa

SEQ ID NO: 24211 - DNA, 20 bp, Artificial Sequence
  Description of Artificial Sequence: Synthetic oligonucleotide
  Target: SCN9A; (-) strand; PAM type: NRG; PAM sequence: TAG
acatacttccaccatccaga

SEQ ID NO: 24212 - DNA, 20 bp, Artificial Sequence
  Description of Artificial Sequence: Synthetic oligonucleotide
  Target: SCN9A; (-) strand; PAM type: NRG; PAM sequence: CAG
tgtgacatacttccaccatc

SEQ ID NO: 24213 - DNA, 20 bp, Artificial Sequence
  Description of Artificial Sequence: Synthetic oligonucleotide
  Target: SCN9A; (-) strand; PAM type: NRG; PAM sequence: CAG
agagattcacagtagctcaa

SEQ ID NO: 24214 - DNA, 20 bp, Artificial Sequence
  Description of Artificial Sequence: Synthetic oligonucleotide
  Target: SCN9A; (-) strand; PAM type: NRG; PAM sequence: TAG
agttaagaagagattcacag

SEQ ID NO: 24215 - DNA, 20 bp, Artificial Sequence
  Description of Artificial Sequence: Synthetic oligonucleotide
  Target: SCN9A; (-) strand; PAM type: NRG; PAM sequence: CAG
cagagttaagaagagattca

SEQ ID NO: 24216 - DNA, 20 bp, Artificial Sequence
  Description of Artificial Sequence: Synthetic oligonucleotide
  Target: SCN9A; (-) strand; PAM type: NRG; PAM sequence: GAG
gctaaatgcagagttaagaa

SEQ ID NO: 24217 - DNA, 20 bp, Artificial Sequence
  Description of Artificial Sequence: Synthetic oligonucleotide
  Target: SCN9A; (-) strand; PAM type: NRG; PAM sequence: AAG
ttgctaaatgcagagttaag

SEQ ID NO: 24218 - DNA, 20 bp, Artificial Sequence
  Description of Artificial Sequence: Synthetic oligonucleotide
  Target: SCN9A; (-) strand; PAM type: NRG; PAM sequence: AAG
aaattgctaaatgcagagtt

SEQ ID NO: 24219 - DNA, 20 bp, Artificial Sequence
  Description of Artificial Sequence: Synthetic oligonucleotide
  Target: SCN9A; (-) strand; PAM type: NRG; PAM sequence: GAG
atgtgaaattgctaaatgca

SEQ ID NO: 24220 - DNA, 20 bp, Artificial Sequence
  Description of Artificial Sequence: Synthetic oligonucleotide
  Target: SCN9A; (-) strand; PAM type: NRG; PAM sequence: CAG
tgatgtgaaattgctaaatg

SEQ ID NO: 24221 - DNA, 20 bp, Artificial Sequence
  Description of Artificial Sequence: Synthetic oligonucleotide
  Target: SCN9A; (-) strand; PAM type: NRG; PAM sequence: AAG
ttggagatttttgtaatgta

SEQ ID NO: 24222 - DNA, 20 bp, Artificial Sequence
  Description of Artificial Sequence: Synthetic oligonucleotide
  Target: SCN9A; (-) strand; PAM type: NRG; PAM sequence: GAG
gctctcatttgtagtgcttg

SEQ ID NO: 24223 - DNA, 20 bp, Artificial Sequence
  Description of Artificial Sequence: Synthetic oligonucleotide
  Target: SCN9A; (-) strand; PAM type: NRG; PAM sequence: TGG
aagctctcatttgtagtgct

SEQ ID NO: 24224 - DNA, 20 bp, Artificial Sequence
  Description of Artificial Sequence: Synthetic oligonucleotide
  Target: SCN9A; (-) strand; PAM type: NRG; PAM sequence: TAG
aatcaagaagctctcatttg

SEQ ID NO: 24225 - DNA, 20 bp, Artificial Sequence
  Description of Artificial Sequence: Synthetic oligonucleotide
  Target: SCN9A; (-) strand; PAM type: NRG; PAM sequence: AAG
ttctactctagaaaatcaag

SEQ ID NO: 24226 - DNA, 20 bp, Artificial Sequence
  Description of Artificial Sequence: Synthetic oligonucleotide
  Target: SCN9A; (-) strand; PAM type: NRG; PAM sequence: AAG
taattctactctagaaaatc

SEQ ID NO: 24227 - DNA, 20 bp, Artificial Sequence
  Description of Artificial Sequence: Synthetic oligonucleotide
  Target: SCN9A; (-) strand; PAM type: NRG; PAM sequence: TAG
tcaccttcttaattctactc

SEQ ID NO: 24228 - DNA, 20 bp, Artificial Sequence
  Description of Artificial Sequence: Synthetic oligonucleotide
  Target: SCN9A; (-) strand; PAM type: NRG; PAM sequence: TGG
tgactgtttatctgttttat

SEQ ID NO: 24229 - DNA, 20 bp, Artificial Sequence
  Description of Artificial Sequence: Synthetic oligonucleotide
  Target: SCN9A; (-) strand; PAM type: NRG; PAM sequence: TGG
ttttgtgctattcagagtaa

SEQ ID NO: 24230 - DNA, 20 bp, Artificial Sequence
  Description of Artificial Sequence: Synthetic oligonucleotide
  Target: SCN9A; (-) strand; PAM type: NRG; PAM sequence: GAG
tttaatttttgtgctattca

SEQ ID NO: 24231 - DNA, 20 bp, Artificial Sequence
  Description of Artificial Sequence: Synthetic oligonucleotide
  Target: SCN9A; (-) strand; PAM type: NRG; PAM sequence: CAG
tttttaatttttgtgctatt

SEQ ID NO: 24232 - DNA, 20 bp, Artificial Sequence
  Description of Artificial Sequence: Synthetic oligonucleotide
  Target: SCN9A; (-) strand; PAM type: NRG; PAM sequence: AGG
aacagaatttcaataatgaa

SEQ ID NO: 24233 - DNA, 20 bp, Artificial Sequence
  Description of Artificial Sequence: Synthetic oligonucleotide
  Target: SCN9A; (-) strand; PAM type: NRG; PAM sequence: AAG
aaacagaatttcaataatga

SEQ ID NO: 24234 - DNA, 20 bp, Artificial Sequence
  Description of Artificial Sequence: Synthetic oligonucleotide
  Target: SCN9A; (-) strand; PAM type: NRG; PAM sequence: CAG
attatttgcaaatcaaaaaa

SEQ ID NO: 24235 - DNA, 20 bp, Artificial Sequence
  Description of Artificial Sequence: Synthetic oligonucleotide
  Target: SCN9A; (-) strand; PAM type: NRG; PAM sequence: AAG
tactcattcatcagtgatgt

SEQ ID NO: 24236 - DNA, 20 bp, Artificial Sequence
  Description of Artificial Sequence: Synthetic oligonucleotide
  Target: SCN9A; (-) strand; PAM type: NRG; PAM sequence: CAG
tcagaactttactcattcat

SEQ ID NO: 24237 - DNA, 20 bp, Artificial Sequence
  Description of Artificial Sequence: Synthetic oligonucleotide
  Target: SCN9A; (-) strand; PAM type: NRG; PAM sequence: CAG
gaaatgaagaagctatatgt

SEQ ID NO: 24238 - DNA, 20 bp, Artificial Sequence
  Description of Artificial Sequence: Synthetic oligonucleotide
  Target: SCN9A; (-) strand; PAM type: NRG; PAM sequence: AAG
gaaataaaaaagaaatgaag

SEQ ID NO: 24239 - DNA, 20 bp, Artificial Sequence
  Description of Artificial Sequence: Synthetic oligonucleotide
  Target: SCN9A; (-) strand; PAM type: NRG; PAM sequence: AAG
agtgaaataaaaaagaaatg

SEQ ID NO: 24240 - DNA, 20 bp, Artificial Sequence
  Description of Artificial Sequence: Synthetic oligonucleotide
  Target: SCN9A; (-) strand; PAM type: NRG; PAM sequence: AAG
tgttagtcagtgaaataaaa

SEQ ID NO: 24241 - DNA, 20 bp, Artificial Sequence
  Description of Artificial Sequence: Synthetic oligonucleotide
  Target: SCN9A; (-) strand; PAM type: NRG; PAM sequence: CAG
tgcttgatatttatgttagt

SEQ ID NO: 24242 - DNA, 20 bp, Artificial Sequence
  Description of Artificial Sequence: Synthetic oligonucleotide
  Target: SCN9A; (-) strand; PAM type: NRG; PAM sequence: TAG
agactgcttgatatttatgt

SEQ ID NO: 24243 - DNA, 20 bp, Artificial Sequence
  Description of Artificial Sequence: Synthetic oligonucleotide
  Target: SCN9A; (-) strand; PAM type: NRG; PAM sequence: AAG
acaagtatagttttagcatg

SEQ ID NO: 24244 - DNA, 20 bp, Artificial Sequence
  Description of Artificial Sequence: Synthetic oligonucleotide
  Target: SCN9A; (-) strand; PAM type: NRG; PAM sequence: TAG
ctaataaacaagtatagttt

SEQ ID NO: 24245 - DNA, 20 bp, Artificial Sequence
  Description of Artificial Sequence: Synthetic oligonucleotide
  Target: SCN9A; (-) strand; PAM type: NRG; PAM sequence: TAG
ttgcagctaataaacaagta

SEQ ID NO: 24246 - DNA, 20 bp, Artificial Sequence
  Description of Artificial Sequence: Synthetic oligonucleotide
  Target: SCN9A; (-) strand; PAM type: NRG; PAM sequence: AAG
tatttttgcagctaataaac

SEQ ID NO: 24247 - DNA, 20 bp, Artificial Sequence
  Description of Artificial Sequence: Synthetic oligonucleotide
  Target: SCN9A; (-) strand; PAM type: NRG; PAM sequence: CAG
gtataggcaacctatttttg

SEQ ID NO: 24248 - DNA, 20 bp, Artificial Sequence
  Description of Artificial Sequence: Synthetic oligonucleotide
  Target: SCN9A; (-) strand; PAM type: NRG; PAM sequence: AGG
tgccaaacttttgcatgtat

SEQ ID NO: 24249 - DNA, 20 bp, Artificial Sequence
  Description of Artificial Sequence: Synthetic oligonucleotide
  Target: SCN9A; (-) strand; PAM type: NRG; PAM sequence: TAG
ttgccaaacttttgcatgta

SEQ ID NO: 24250 - DNA, 20 bp, Artificial Sequence
  Description of Artificial Sequence: Synthetic oligonucleotide
  Target: SCN9A; (-) strand; PAM type: NRG; PAM sequence: AAG
gtatatcaaattgtttctca

SEQ ID NO: 24251 - DNA, 20 bp, Artificial Sequence
  Description of Artificial Sequence: Synthetic oligonucleotide
  Target: SCN9A; (-) strand; PAM type: NRG; PAM sequence: AGG
ctataaattttactgatatt

SEQ ID NO: 24252 - DNA, 20 bp, Artificial Sequence
  Description of Artificial Sequence: Synthetic oligonucleotide
  Target: SCN9A; (-) strand; PAM type: NRG; PAM sequence: TAG
actataaattttactgatat

SEQ ID NO: 24253 - DNA, 20 bp, Artificial Sequence
  Description of Artificial Sequence: Synthetic oligonucleotide
  Target: SCN9A; (-) strand; PAM type: NRG; PAM sequence: AGG
ttttataaactggttctcca

SEQ ID NO: 24254 - DNA, 20 bp, Artificial Sequence
  Description of Artificial Sequence: Synthetic oligonucleotide
  Target: SCN9A; (-) strand; PAM type: NRG; PAM sequence: AAG
tttttataaactggttctcc

SEQ ID NO: 24255 - DNA, 20 bp, Artificial Sequence
  Description of Artificial Sequence: Synthetic oligonucleotide
  Target: SCN9A; (-) strand; PAM type: NRG; PAM sequence: TGG
aggtaaatatttttataaac

SEQ ID NO: 24256 - DNA, 20 bp, Artificial Sequence
  Description of Artificial Sequence: Synthetic oligonucleotide
  Target: SCN9A; (-) strand; PAM type: NRG; PAM sequence: AGG
tacctgtcctagtgatgtgt

SEQ ID NO: 24257 - DNA, 20 bp, Artificial Sequence
  Description of Artificial Sequence: Synthetic oligonucleotide
  Target: SCN9A; (-) strand; PAM type: NRG; PAM sequence: TAG
ctacctgtcctagtgatgtg

SEQ ID NO: 24258 - DNA, 20 bp, Artificial Sequence
  Description of Artificial Sequence: Synthetic oligonucleotide
  Target: SCN9A; (-) strand; PAM type: NRG; PAM sequence: TAG
gttttctcctctacctgtcc

SEQ ID NO: 24259 - DNA, 20 bp, Artificial Sequence
  Description of Artificial Sequence: Synthetic oligonucleotide
  Target: SCN9A; (-) strand; PAM type: NRG; PAM sequence: AAG
ctctcatttcatctacttca

SEQ ID NO: 24260 - DNA, 20 bp, Artificial Sequence
  Description of Artificial Sequence: Synthetic oligonucleotide
  Target: SCN9A; (-) strand; PAM type: NRG; PAM sequence: TGG
tctcttttactgcaccctct

SEQ ID NO: 24261 - DNA, 20 bp, Artificial Sequence
  Description of Artificial Sequence: Synthetic oligonucleotide
  Target: SCN9A; (-) strand; PAM type: NRG; PAM sequence: TGG
ttataaaactttttactctt

SEQ ID NO: 24262 - DNA, 20 bp, Artificial Sequence
  Description of Artificial Sequence: Synthetic oligonucleotide
  Target: SCN9A; (-) strand; PAM type: NRG; PAM sequence: TAG
ttctgggcctcttatgttca

SEQ ID NO: 24263 - DNA, 20 bp, Artificial Sequence
  Description of Artificial Sequence: Synthetic oligonucleotide
  Target: SCN9A; (-) strand; PAM type: NRG; PAM sequence: GGG
gtttcaatcattctctttct

SEQ ID NO: 24264 - DNA, 20 bp, Artificial Sequence
  Description of Artificial Sequence: Synthetic oligonucleotide
  Target: SCN9A; (-) strand; PAM type: NRG; PAM sequence: TGG
tgtttcaatcattctctttc

SEQ ID NO: 24265 - DNA, 20 bp, Artificial Sequence
  Description of Artificial Sequence: Synthetic oligonucleotide
  Target: SCN9A; (-) strand; PAM type: NRG; PAM sequence: TAG
tcttttcttcagagtaattc

SEQ ID NO: 24266 - DNA, 20 bp, Artificial Sequence
  Description of Artificial Sequence: Synthetic oligonucleotide
  Target: SCN9A; (-) strand; PAM type: NRG; PAM sequence: GAG
aagagtctctcttttcttca

SEQ ID NO: 24267 - DNA, 20 bp, Artificial Sequence
  Description of Artificial Sequence: Synthetic oligonucleotide
  Target: SCN9A; (-) strand; PAM type: NRG; PAM sequence: CAG
taaagagtctctcttttctt

SEQ ID NO: 24268 - DNA, 20 bp, Artificial Sequence
  Description of Artificial Sequence: Synthetic oligonucleotide
  Target: SCN9A; (-) strand; PAM type: NRG; PAM sequence: GAG
cactgtagttactttttaaa

SEQ ID NO: 24269 - DNA, 20 bp, Artificial Sequence
  Description of Artificial Sequence: Synthetic oligonucleotide
  Target: SCN9A; (-) strand; PAM type: NRG; PAM sequence: AAG
ttcactgtagttacttttta

SEQ ID NO: 24270 - DNA, 20 bp, Artificial Sequence
  Description of Artificial Sequence: Synthetic oligonucleotide
  Target: SCN9A; (-) strand; PAM type: NRG; PAM sequence: TAG
ttatgaggaagaattcactg

SEQ ID NO: 24271 - DNA, 20 bp, Artificial Sequence
  Description of Artificial Sequence: Synthetic oligonucleotide
  Target: SCN9A; (-) strand; PAM type: NRG; PAM sequence: AAG
tcatctaaaattttatgagg

SEQ ID NO: 24272 - DNA, 20 bp, Artificial Sequence
  Description of Artificial Sequence: Synthetic oligonucleotide
  Target: SCN9A; (-) strand; PAM type: NRG; PAM sequence: AGG
ttttcatctaaaattttatg

SEQ ID NO: 24273 - DNA, 20 bp, Artificial Sequence
  Description of Artificial Sequence: Synthetic oligonucleotide
  Target: SCN9A; (-) strand; PAM type: NRG; PAM sequence: GAG
tttttcatctaaaattttat

SEQ ID NO: 24274 - DNA, 20 bp, Artificial Sequence
  Description of Artificial Sequence: Synthetic oligonucleotide
  Target: SCN9A; (-) strand; PAM type: NRG; PAM sequence: AGG
tcctgccttcatctaaaatg

SEQ ID NO: 24275 - DNA, 20 bp, Artificial Sequence
  Description of Artificial Sequence: Synthetic oligonucleotide
  Target: SCN9A; (-) strand; PAM type: NRG; PAM sequence: GAG
ctcctgccttcatctaaaat

SEQ ID NO: 24276 - DNA, 20 bp, Artificial Sequence
  Description of Artificial Sequence: Synthetic oligonucleotide
  Target: SCN9A; (-) strand; PAM type: NRG; PAM sequence: AAG
ttctgaaacaggtatcaaaa

SEQ ID NO: 24277 - DNA, 20 bp, Artificial Sequence
  Description of Artificial Sequence: Synthetic oligonucleotide
  Target: SCN9A; (-) strand; PAM type: NRG; PAM sequence: AGG
aaaattcaaacttctgaaac

SEQ ID NO: 24278 - DNA, 20 bp, Artificial Sequence
  Description of Artificial Sequence: Synthetic oligonucleotide
  Target: SCN9A; (-) strand; PAM type: NRG; PAM sequence: CAG
taaaattcaaacttctgaaa

SEQ ID NO: 24279 - DNA, 20 bp, Artificial Sequence
  Description of Artificial Sequence: Synthetic oligonucleotide
  Target: SCN9A; (-) strand; PAM type: NRG; PAM sequence: TAG
agaaaaggagatcaatcttt

SEQ ID NO: 24280 - DNA, 20 bp, Artificial Sequence
  Description of Artificial Sequence: Synthetic oligonucleotide
  Target: SCN9A; (-) strand; PAM type: NRG; PAM sequence: GAG
tatattgttttacagaaaag

SEQ ID NO: 24281 - DNA, 20 bp, Artificial Sequence
  Description of Artificial Sequence: Synthetic oligonucleotide
  Target: SCN9A; (-) strand; PAM type: NRG; PAM sequence: AGG
attatattgttttacagaaa

SEQ ID NO: 24282 - DNA, 20 bp, Artificial Sequence
  Description of Artificial Sequence: Synthetic oligonucleotide
  Target: SCN9A; (-) strand; PAM type: NRG; PAM sequence: AAG
aattatattgttttacagaa

SEQ ID NO: 24283 - DNA, 20 bp, Artificial Sequence
  Description of Artificial Sequence: Synthetic oligonucleotide
  Target: SCN9A; (-) strand; PAM type: NRG; PAM sequence: CAG
taatgaattatattgtttta

SEQ ID NO: 24284 - DNA, 20 bp, Artificial Sequence
  Description of Artificial Sequence: Synthetic oligonucleotide
  Target: SCN9A; (-) strand; PAM type: NRG; PAM sequence: AAG
atacaacttatgattatctg

SEQ ID NO: 24285 - DNA, 20 bp, Artificial Sequence
  Description of Artificial Sequence: Synthetic oligonucleotide
  Target: SCN9A; (-) strand; PAM type: NRG; PAM sequence: TAG
ggattctagttttgttgttt

SEQ ID NO: 24286 - DNA, 20 bp, Artificial Sequence
  Description of Artificial Sequence: Synthetic oligonucleotide
  Target: SCN9A; (-) strand; PAM type: NRG; PAM sequence: TAG
gcatcttgtcaagaggattc

SEQ ID NO: 24287 - DNA, 20 bp, Artificial Sequence
  Description of Artificial Sequence: Synthetic oligonucleotide
  Target: SCN9A; (-) strand; PAM type: NRG; PAM sequence: AGG
accaggtgcatcttgtcaag

SEQ ID NO: 24288 - DNA, 20 bp, Artificial Sequence
  Description of Artificial Sequence: Synthetic oligonucleotide
  Target: SCN9A; (-) strand; PAM type: NRG; PAM sequence: GAG
taccaggtgcatcttgtcaa

SEQ ID NO: 24289 - DNA, 20 bp, Artificial Sequence
  Description of Artificial Sequence: Synthetic oligonucleotide
  Target: SCN9A; (-) strand; PAM type: NRG; PAM sequence: AAG
tctaccaggtgcatcttgtc

SEQ ID NO: 24290 - DNA, 20 bp, Artificial Sequence
  Description of Artificial Sequence: Synthetic oligonucleotide
  Target: SCN9A; (-) strand; PAM type: NRG; PAM sequence: AGG
attacaaaacattttctacc

SEQ ID NO: 24291 - DNA, 20 bp, Artificial Sequence
  Description of Artificial Sequence: Synthetic oligonucleotide
  Target: SCN9A; (-) strand; PAM type: NRG; PAM sequence: CAG
cattacaaaacattttctac

SEQ ID NO: 24292 - DNA, 20 bp, Artificial Sequence
  Description of Artificial Sequence: Synthetic oligonucleotide
  Target: SCN9A; (-) strand; PAM type: NRG; PAM sequence: AAG
ttagacttcagaaacatgaa

SEQ ID NO: 24293 - DNA, 20 bp, Artificial Sequence
  Description of Artificial Sequence: Synthetic oligonucleotide
  Target: SCN9A; (-) strand; PAM type: NRG; PAM sequence: CAG
tcaatgcactaattagactt

SEQ ID NO: 24294 - DNA, 20 bp, Artificial Sequence
  Description of Artificial Sequence: Synthetic oligonucleotide
  Target: SCN9A; (-) strand; PAM type: NRG; PAM sequence: TAG
aactggatcaatgcactaat

SEQ ID NO: 24295 - DNA, 20 bp, Artificial Sequence
  Description of Artificial Sequence: Synthetic oligonucleotide
  Target: SCN9A; (-) strand; PAM type: NRG; PAM sequence: TGG
gaaaataaccttatatcaac

SEQ ID NO: 24296 - DNA, 20 bp, Artificial Sequence
  Description of Artificial Sequence: Synthetic oligonucleotide
  Target: SCN9A; (-) strand; PAM type: NRG; PAM sequence: TAG
agagctggaaattaaagtgc

SEQ ID NO: 24297 - DNA, 20 bp, Artificial Sequence
  Description of Artificial Sequence: Synthetic oligonucleotide
  Target: SCN9A; (-) strand; PAM type: NRG; PAM sequence: AAG
ttctatagagctggaaatta

SEQ ID NO: 24298 - DNA, 20 bp, Artificial Sequence
  Description of Artificial Sequence: Synthetic oligonucleotide
  Target: SCN9A; (-) strand; PAM type: NRG; PAM sequence: TGG
ttgctgtatttctatagagc

SEQ ID NO: 24299 - DNA, 20 bp, Artificial Sequence
  Description of Artificial Sequence: Synthetic oligonucleotide
  Target: SCN9A; (-) strand; PAM type: NRG; PAM sequence: GAG
ttgtttgctgtatttctata

SEQ ID NO: 24300 - DNA, 20 bp, Artificial Sequence
  Description of Artificial Sequence: Synthetic oligonucleotide
  Target: SCN9A; (-) strand; PAM type: NRG; PAM sequence: TAG
ccttgtttgctgtatttcta

SEQ ID NO: 24301 - DNA, 20 bp, Artificial Sequence
  Description of Artificial Sequence: Synthetic oligonucleotide
  Target: SCN9A; (-) strand; PAM type: NRG; PAM sequence: GGG
accagagacatagggggaga

SEQ ID NO: 24302 - DNA, 20 bp, Artificial Sequence
  Description of Artificial Sequence: Synthetic oligonucleotide
  Target: SCN9A; (-) strand; PAM type: NRG; PAM sequence: AGG
caccagagacatagggggag

SEQ ID NO: 24303 - DNA, 20 bp, Artificial Sequence
  Description of Artificial Sequence: Synthetic oligonucleotide
  Target: SCN9A; (-) strand; PAM type: NRG; PAM sequence: GAG
acaccagagacataggggga

SEQ ID NO: 24304 - DNA, 20 bp, Artificial Sequence
  Description of Artificial Sequence: Synthetic oligonucleotide
  Target: SCN9A; (-) strand; PAM type: NRG; PAM sequence: GAG
aaacaccagagacatagggg

SEQ ID NO: 24305 - DNA, 20 bp, Artificial Sequence
  Description of Artificial Sequence: Synthetic oligonucleotide
  Target: SCN9A; (-) strand; PAM type: NRG; PAM sequence: GGG
aaaaacaccagagacatagg

SEQ ID NO: 24306 - DNA, 20 bp, Artificial Sequence
  Description of Artificial Sequence: Synthetic oligonucleotide
  Target: SCN9A; (-) strand; PAM type: NRG; PAM sequence: GGG
caaaaacaccagagacatag

SEQ ID NO: 24307 - DNA, 20 bp, Artificial Sequence
  Description of Artificial Sequence: Synthetic oligonucleotide
  Target: SCN9A; (-) strand; PAM type: NRG; PAM sequence: GGG
acaaaaacaccagagacata

SEQ ID NO: 24308 - DNA, 20 bp, Artificial Sequence
  Description of Artificial Sequence: Synthetic oligonucleotide
  Target: SCN9A; (-) strand; PAM type: NRG; PAM sequence: AGG
aacaaaaacaccagagacat

SEQ ID NO: 24309 - DNA, 20 bp, Artificial Sequence
  Description of Artificial Sequence: Synthetic oligonucleotide
  Target: SCN9A; (-) strand; PAM type: NRG; PAM sequence: TAG
taacaaaaacaccagagaca

SEQ ID NO: 24310 - DNA, 20 bp, Artificial Sequence
  Description of Artificial Sequence: Synthetic oligonucleotide
  Target: SCN9A; (-) strand; PAM type: NRG; PAM sequence: GAG
acatgataacaaaaacacca

SEQ ID NO: 24311 - DNA, 20 bp, Artificial Sequence
  Description of Artificial Sequence: Synthetic oligonucleotide
  Target: SCN9A; (-) strand; PAM type: NRG; PAM sequence: CAG
atacatgataacaaaaacac

SEQ ID NO: 24312 - DNA, 20 bp, Artificial Sequence
  Description of Artificial Sequence: Synthetic oligonucleotide
  Target: SCN9A; (-) strand; PAM type: NRG; PAM sequence: AGG
aacttccagagagaaaaaac

SEQ ID NO: 24313 - DNA, 20 bp, Artificial Sequence
  Description of Artificial Sequence: Synthetic oligonucleotide
  Target: SCN9A; (-) strand; PAM type: NRG; PAM sequence: CAG
aaacttccagagagaaaaaa

SEQ ID NO: 24314 - DNA, 20 bp, Artificial Sequence
  Description of Artificial Sequence: Synthetic oligonucleotide
  Target: SCN9A; (-) strand; PAM type: NRG; PAM sequence: GAG
ggaacttagaaacttccaga

SEQ ID NO: 24315 - DNA, 20 bp, Artificial Sequence
  Description of Artificial Sequence: Synthetic oligonucleotide
  Target: SCN9A; (-) strand; PAM type: NRG; PAM sequence: GAG
tgggaacttagaaacttcca

SEQ ID NO: 24316 - DNA, 20 bp, Artificial Sequence
  Description of Artificial Sequence: Synthetic oligonucleotide
  Target: SCN9A; (-) strand; PAM type: NRG; PAM sequence: CAG
tctgggaacttagaaacttc

SEQ ID NO: 24317 - DNA, 20 bp, Artificial Sequence
  Description of Artificial Sequence: Synthetic oligonucleotide
  Target: SCN9A; (-) strand; PAM type: NRG; PAM sequence: TAG
gtttgagtcttctgggaact

SEQ ID NO: 24318 - DNA, 20 bp, Artificial Sequence
  Description of Artificial Sequence: Synthetic oligonucleotide
  Target: SCN9A; (-) strand; PAM type: NRG; PAM sequence: GGG
agactcagtttgagtcttct

SEQ ID NO: 24319 - DNA, 20 bp, Artificial Sequence
  Description of Artificial Sequence: Synthetic oligonucleotide
  Target: SCN9A; (-) strand; PAM type: NRG; PAM sequence: TGG
cagactcagtttgagtcttc

SEQ ID NO: 24320 - DNA, 20 bp, Artificial Sequence
  Description of Artificial Sequence: Synthetic oligonucleotide
  Target: SCN9A; (-) strand; PAM type: NRG; PAM sequence: GAG
aagcattacagactcagttt

SEQ ID NO: 24321 - DNA, 20 bp, Artificial Sequence
  Description of Artificial Sequence: Synthetic oligonucleotide
  Target: SCN9A; (-) strand; PAM type: NRG; PAM sequence: CAG
aagagcaagcattacagact

SEQ ID NO: 24322 - DNA, 20 bp, Artificial Sequence
  Description of Artificial Sequence: Synthetic oligonucleotide
  Target: SCN9A; (-) strand; PAM type: NRG; PAM sequence: CAG
agcacaaagagcaagcatta

SEQ ID NO: 24323 - DNA, 20 bp, Artificial Sequence
  Description of Artificial Sequence: Synthetic oligonucleotide
  Target: SCN9A; (-) strand; PAM type: NRG; PAM sequence: AAG
gtactataagcacaaagagc

SEQ ID NO: 24324 - DNA, 20 bp, Artificial Sequence
  Description of Artificial Sequence: Synthetic oligonucleotide
  Target: SCN9A; (-) strand; PAM type: NRG; PAM sequence: GAG
atgagtactataagcacaaa

SEQ ID NO: 24325 - DNA, 20 bp, Artificial Sequence
  Description of Artificial Sequence: Synthetic oligonucleotide
  Target: SCN9A; (-) strand; PAM type: NRG; PAM sequence: AAG
tgatgagtactataagcaca

SEQ ID NO: 24326 - DNA, 20 bp, Artificial Sequence
  Description of Artificial Sequence: Synthetic oligonucleotide
  Target: SCN9A; (-) strand; PAM type: NRG; PAM sequence: AAG
aggactatgatgagtactat

SEQ ID NO: 24327 - DNA, 20 bp, Artificial Sequence
  Description of Artificial Sequence: Synthetic oligonucleotide
  Target: SCN9A; (-) strand; PAM type: NRG; PAM sequence: GAG
gccaagtagaggactatgat

SEQ ID NO: 24328 - DNA, 20 bp, Artificial Sequence
  Description of Artificial Sequence: Synthetic oligonucleotide
  Target: SCN9A; (-) strand; PAM type: NRG; PAM sequence: AGG
tgacctattaagccaagtag

SEQ ID NO: 24329 - DNA, 20 bp, Artificial Sequence
  Description of Artificial Sequence: Synthetic oligonucleotide
  Target: SCN9A; (-) strand; PAM type: NRG; PAM sequence: GAG
atgacctattaagccaagta

SEQ ID NO: 24330 - DNA, 20 bp, Artificial Sequence
  Description of Artificial Sequence: Synthetic oligonucleotide
  Target: SCN9A; (-) strand; PAM type: NRG; PAM sequence: TAG
aaatgacctattaagccaag

SEQ ID NO: 24331 - DNA, 20 bp, Artificial Sequence
  Description of Artificial Sequence: Synthetic oligonucleotide
  Target: SCN9A; (-) strand; PAM type: NRG; PAM sequence: AAG
tataaatgacctattaagcc

SEQ ID NO: 24332 - DNA, 20 bp, Artificial Sequence
  Description of Artificial Sequence: Synthetic oligonucleotide
  Target: SCN9A; (-) strand; PAM type: NRG; PAM sequence: AAG
tcaactataaatgacctatt

SEQ ID NO: 24333 - DNA, 20 bp, Artificial Sequence
  Description of Artificial Sequence: Synthetic oligonucleotide
  Target: SCN9A; (-) strand; PAM type: NRG; PAM sequence: AAG
ataactctttttggggaatc

SEQ ID NO: 24334 - DNA, 20 bp, Artificial Sequence
  Description of Artificial Sequence: Synthetic oligonucleotide
  Target: SCN9A; (-) strand; PAM type: NRG; PAM sequence: GGG
agattatataactctttttg

SEQ ID NO: 24335 - DNA, 20 bp, Artificial Sequence
  Description of Artificial Sequence: Synthetic oligonucleotide
  Target: SCN9A; (-) strand; PAM type: NRG; PAM sequence: GGG
aagattatataactcttttt

SEQ ID NO: 24336 - DNA, 20 bp, Artificial Sequence
  Description of Artificial Sequence: Synthetic oligonucleotide
  Target: SCN9A; (-) strand; PAM type: NRG; PAM sequence: TGG
gaagattatataactctttt

SEQ ID NO: 24337 - DNA, 20 bp, Artificial Sequence
  Description of Artificial Sequence: Synthetic oligonucleotide
  Target: SCN9A; (-) strand; PAM type: NRG; PAM sequence: AAG
aattatgactaactgcttag

SEQ ID NO: 24338 - DNA, 20 bp, Artificial Sequence
  Description of Artificial Sequence: Synthetic oligonucleotide
  Target: SCN9A; (-) strand; PAM type: NRG; PAM sequence: TAG
tcaaattatgactaactgct

SEQ ID NO: 24339 - DNA, 20 bp, Artificial Sequence
  Description of Artificial Sequence: Synthetic oligonucleotide
  Target: SCN9A; (-) strand; PAM type: NRG; PAM sequence: GAG
tgtaaagtatagaattcaca

SEQ ID NO: 24340 - DNA, 20 bp, Artificial Sequence
  Description of Artificial Sequence: Synthetic oligonucleotide
  Target: SCN9A; (-) strand; PAM type: NRG; PAM sequence: CAG
tatgtaaagtatagaattca

SEQ ID NO: 24341 - DNA, 20 bp, Artificial Sequence
  Description of Artificial Sequence: Synthetic oligonucleotide
  Target: SCN9A; (-) strand; PAM type: NRG; PAM sequence: TAG
tccaatgtttatgtaaagta

SEQ ID NO: 24342 - DNA, 20 bp, Artificial Sequence
  Description of Artificial Sequence: Synthetic oligonucleotide
  Target: SCN9A; (-) strand; PAM type: NRG; PAM sequence: AAG
tttcatccaatgtttatgta

SEQ ID NO: 24343 - DNA, 20 bp, Artificial Sequence
  Description of Artificial Sequence: Synthetic oligonucleotide
  Target: SCN9A; (-) strand; PAM type: NRG; PAM sequence: TAG
tgtataaatgaagctatgtg

SEQ ID NO: 24344 - DNA, 20 bp, Artificial Sequence
  Description of Artificial Sequence: Synthetic oligonucleotide
  Target: SCN9A; (-) strand; PAM type: NRG; PAM sequence: AAG
taattaacattgtataaatg

SEQ ID NO: 24345 - DNA, 20 bp, Artificial Sequence
  Description of Artificial Sequence: Synthetic oligonucleotide
  Target: SCN9A; (-) strand; PAM type: NRG; PAM sequence: GAG
tgatacataatttcagatct

SEQ ID NO: 24346 - DNA, 20 bp, Artificial Sequence
  Description of Artificial Sequence: Synthetic oligonucleotide
  Target: SCN9A; (-) strand; PAM type: NRG; PAM sequence: CAG
tataggatgatacataattt

SEQ ID NO: 24347 - DNA, 20 bp, Artificial Sequence
  Description of Artificial Sequence: Synthetic oligonucleotide
  Target: SCN9A; (-) strand; PAM type: NRG; PAM sequence: AGG
gataataattatttaagtat

SEQ ID NO: 24348 - DNA, 20 bp, Artificial Sequence
  Description of Artificial Sequence: Synthetic oligonucleotide
  Target: SCN9A; (-) strand; PAM type: NRG; PAM sequence: TAG
agataataattatttaagta

SEQ ID NO: 24349 - DNA, 20 bp, Artificial Sequence
  Description of Artificial Sequence: Synthetic oligonucleotide
  Target: SCN9A; (-) strand; PAM type: NRG; PAM sequence: AAG
catgtagataataattattt

SEQ ID NO: 24350 - DNA, 20 bp, Artificial Sequence
  Description of Artificial Sequence: Synthetic oligonucleotide
  Target: SCN9A; (-) strand; PAM type: NRG; PAM sequence: TAG
ctctcttaactaaatgcatg

SEQ ID NO: 24351 - DNA, 20 bp, Artificial Sequence
  Description of Artificial Sequence: Synthetic oligonucleotide
  Target: SCN9A; (-) strand; PAM type: NRG; PAM sequence: GAG
ccctgaaaaagattaactta

SEQ ID NO: 24352 - DNA, 20 bp, Artificial Sequence
  Description of Artificial Sequence: Synthetic oligonucleotide
  Target: SCN9A; (-) strand; PAM type: NRG; PAM sequence: TAG
ttccctgaaaaagattaact

SEQ ID NO: 24353 - DNA, 20 bp, Artificial Sequence
  Description of Artificial Sequence: Synthetic oligonucleotide
  Target: SCN9A; (-) strand; PAM type: NRG; PAM sequence: AAG
tatttttattttccctgaaa

SEQ ID NO: 24354 - DNA, 20 bp, Artificial Sequence
  Description of Artificial Sequence: Synthetic oligonucleotide
  Target: SCN9A; (-) strand; PAM type: NRG; PAM sequence: TGG
ctcatttttttcgctctctc

SEQ ID NO: 24355 - DNA, 20 bp, Artificial Sequence
  Description of Artificial Sequence: Synthetic oligonucleotide
  Target: SCN9A; (-) strand; PAM type: NRG; PAM sequence: AAG
aagacaaattctaaagcact

SEQ ID NO: 24356 - DNA, 20 bp, Artificial Sequence
  Description of Artificial Sequence: Synthetic oligonucleotide
  Target: SCN9A; (-) strand; PAM type: NRG; PAM sequence: AAG
taagtttaagacaaattcta

SEQ ID NO: 24357 - DNA, 20 bp, Artificial Sequence
  Description of Artificial Sequence: Synthetic oligonucleotide
  Target: SCN9A; (-) strand; PAM type: NRG; PAM sequence: AAG
tgatcattgtttttaagttt

SEQ ID NO: 24358 - DNA, 20 bp, Artificial Sequence
  Description of Artificial Sequence: Synthetic oligonucleotide
  Target: SCN9A; (-) strand; PAM type: NRG; PAM sequence: AAG
tatatgtgatcattgttttt

SEQ ID NO: 24359 - DNA, 20 bp, Artificial Sequence
  Description of Artificial Sequence: Synthetic oligonucleotide
  Target: SCN9A; (-) strand; PAM type: NRG; PAM sequence: AAG
ccaataatttgcccctgaga

SEQ ID NO: 24360 - DNA, 20 bp, Artificial Sequence
  Description of Artificial Sequence: Synthetic oligonucleotide
  Target: SCN9A; (-) strand; PAM type: NRG; PAM sequence: GAG
ttatccaataatttgcccct

SEQ ID NO: 24361 - DNA, 20 bp, Artificial Sequence
  Description of Artificial Sequence: Synthetic oligonucleotide
  Target: SCN9A; (-) strand; PAM type: NRG; PAM sequence: GGG
gcaaaatcttcttaaccaaa

SEQ ID NO: 24362 - DNA, 20 bp, Artificial Sequence
  Description of Artificial Sequence: Synthetic oligonucleotide
  Target: SCN9A; (-) strand; PAM type: NRG; PAM sequence: AGG
agcaaaatcttcttaaccaa

SEQ ID NO: 24363 - DNA, 20 bp, Artificial Sequence
  Description of Artificial Sequence: Synthetic oligonucleotide
  Target: SCN9A; (-) strand; PAM type: NRG; PAM sequence: AAG
gagcaaaatcttcttaacca

SEQ ID NO: 24364 - DNA, 20 bp, Artificial Sequence
  Description of Artificial Sequence: Synthetic oligonucleotide
  Target: SCN9A; (-) strand; PAM type: NRG; PAM sequence: GAG
tgacaaaagtaaatcccaga

SEQ ID NO: 24365 - DNA, 20 bp, Artificial Sequence
  Description of Artificial Sequence: Synthetic oligonucleotide
  Target: SCN9A; (-) strand; PAM type: NRG; PAM sequence: GAG
attgacaaaagtaaatccca

SEQ ID NO: 24366 - DNA, 20 bp, Artificial Sequence
  Description of Artificial Sequence: Synthetic oligonucleotide
  Target: SCN9A; (-) strand; PAM type: NRG; PAM sequence: CAG
agattgacaaaagtaaatcc

SEQ ID NO: 24367 - DNA, 20 bp, Artificial Sequence
  Description of Artificial Sequence: Synthetic oligonucleotide
  Target: SCN9A; (-) strand; PAM type: NRG; PAM sequence: AAG
ttcaattttaagattgacaa

SEQ ID NO: 24368 - DNA, 20 bp, Artificial Sequence
  Description of Artificial Sequence: Synthetic oligonucleotide
  Target: SCN9A; (-) strand; PAM type: NRG; PAM sequence: AAG
taatgtttcccttcaatttt

SEQ ID NO: 24369 - DNA, 20 bp, Artificial Sequence
  Description of Artificial Sequence: Synthetic oligonucleotide
  Target: SCN9A; (-) strand; PAM type: NRG; PAM sequence: AAG
gtttttatttcctcaatcat

SEQ ID NO: 24370 - DNA, 20 bp, Artificial Sequence
  Description of Artificial Sequence: Synthetic oligonucleotide
  Target: SCN9A; (-) strand; PAM type: NRG; PAM sequence: TAG
acttttctaattaggatttt

SEQ ID NO: 24371 - DNA, 20 bp, Artificial Sequence
  Description of Artificial Sequence: Synthetic oligonucleotide
  Target: SCN9A; (-) strand; PAM type: NRG; PAM sequence: AGG
gtttactaacttttctaatt

SEQ ID NO: 24372 - DNA, 20 bp, Artificial Sequence
  Description of Artificial Sequence: Synthetic oligonucleotide
  Target: SCN9A; (-) strand; PAM type: NRG; PAM sequence: TAG
agtttactaacttttctaat

SEQ ID NO: 24373 - DNA, 20 bp, Artificial Sequence
  Description of Artificial Sequence: Synthetic oligonucleotide
  Target: SCN9A; (-) strand; PAM type: NRG; PAM sequence: AAG
gaaacttcatttcagattga

SEQ ID NO: 24374 - DNA, 20 bp, Artificial Sequence
  Description of Artificial Sequence: Synthetic oligonucleotide
  Target: SCN9A; (-) strand; PAM type: NRG; PAM sequence: CAG
atatttatgaaacttcattt

SEQ ID NO: 24375 - DNA, 20 bp, Artificial Sequence
  Description of Artificial Sequence: Synthetic oligonucleotide
  Target: SCN9A; (-) strand; PAM type: NRG; PAM sequence: GGG
tgaggtgtaataaaccctga

SEQ ID NO: 24376 - DNA, 20 bp, Artificial Sequence
  Description of Artificial Sequence: Synthetic oligonucleotide
  Target: SCN9A; (-) strand; PAM type: NRG; PAM sequence: AGG
ctgaggtgtaataaaccctg

SEQ ID NO: 24377 - DNA, 20 bp, Artificial Sequence
  Description of Artificial Sequence: Synthetic oligonucleotide
  Target: SCN9A; (-) strand; PAM type: NRG; PAM sequence: GAG
tctgaggtgtaataaaccct

SEQ ID NO: 24378 - DNA, 20 bp, Artificial Sequence
  Description of Artificial Sequence: Synthetic oligonucleotide
  Target: SCN9A; (-) strand; PAM type: NRG; PAM sequence: AGG
taagagaaagaaactctctg

SEQ ID NO: 24379 - DNA, 20 bp, Artificial Sequence
  Description of Artificial Sequence: Synthetic oligonucleotide
  Target: SCN9A; (-) strand; PAM type: NRG; PAM sequence: GAG
ataagagaaagaaactctct

SEQ ID NO: 24380 - DNA, 20 bp, Artificial Sequence
  Description of Artificial Sequence: Synthetic oligonucleotide
  Target: SCN9A; (-) strand; PAM type: NRG; PAM sequence: AAG
tcttgcctcaaaataagaga

SEQ ID NO: 24381 - DNA, 20 bp, Artificial Sequence
  Description of Artificial Sequence: Synthetic oligonucleotide
  Target: SCN9A; (-) strand; PAM type: NRG; PAM sequence: GAG
tcactcttgcctcaaaataa

SEQ ID NO: 24382 - DNA, 20 bp, Artificial Sequence
  Description of Artificial Sequence: Synthetic oligonucleotide
  Target: SCN9A; (-) strand; PAM type: NRG; PAM sequence: AAG
catcactcttgcctcaaaat

SEQ ID NO: 24383 - DNA, 20 bp, Artificial Sequence
  Description of Artificial Sequence: Synthetic oligonucleotide
  Target: SCN9A; (-) strand; PAM type: NRG; PAM sequence: AGG
cctttgcacaaaaaccagac

SEQ ID NO: 24384 - DNA, 20 bp, Artificial Sequence
  Description of Artificial Sequence: Synthetic oligonucleotide
  Target: SCN9A; (-) strand; PAM type: NRG; PAM sequence: CAG
acctttgcacaaaaaccaga

SEQ ID NO: 24385 - DNA, 20 bp, Artificial Sequence
  Description of Artificial Sequence: Synthetic oligonucleotide
  Target: SCN9A; (-) strand; PAM type: NRG; PAM sequence: CAG
atatacctttgcacaaaaac

SEQ ID NO: 24386 - DNA, 20 bp, Artificial Sequence
  Description of Artificial Sequence: Synthetic oligonucleotide
  Target: SCN9A; (-) strand; PAM type: NRG; PAM sequence: GGG
agcttagttggaaatctctt

SEQ ID NO: 24387 - DNA, 20 bp, Artificial Sequence
  Description of Artificial Sequence: Synthetic oligonucleotide
  Target: SCN9A; (-) strand; PAM type: NRG; PAM sequence: TGG
cagcttagttggaaatctct

SEQ ID NO: 24388 - DNA, 20 bp, Artificial Sequence
  Description of Artificial Sequence: Synthetic oligonucleotide
  Target: SCN9A; (-) strand; PAM type: NRG; PAM sequence: TGG
acattgctaaccagcttagt

SEQ ID NO: 24389 - DNA, 20 bp, Artificial Sequence
  Description of Artificial Sequence: Synthetic oligonucleotide
  Target: SCN9A; (-) strand; PAM type: NRG; PAM sequence: TAG
gataacattgctaaccagct

SEQ ID NO: 24390 - DNA, 20 bp, Artificial Sequence
  Description of Artificial Sequence: Synthetic oligonucleotide
  Target: SCN9A; (-) strand; PAM type: NRG; PAM sequence: CAG
ggtatgataacattgctaac

SEQ ID NO: 24391 - DNA, 20 bp, Artificial Sequence
  Description of Artificial Sequence: Synthetic oligonucleotide
  Target: SCN9A; (-) strand; PAM type: NRG; PAM sequence: AGG
taatagtccttttaaagaga

SEQ ID NO: 24392 - DNA, 20 bp, Artificial Sequence
  Description of Artificial Sequence: Synthetic oligonucleotide
  Target: SCN9A; (-) strand; PAM type: NRG; PAM sequence: AAG
ttaatagtccttttaaagag

SEQ ID NO: 24393 - DNA, 20 bp, Artificial Sequence
  Description of Artificial Sequence: Synthetic oligonucleotide
  Target: SCN9A; (-) strand; PAM type: NRG; PAM sequence: GAG
caattaatagtccttttaaa

SEQ ID NO: 24394 - DNA, 20 bp, Artificial Sequence
  Description of Artificial Sequence: Synthetic oligonucleotide
  Target: SCN9A; (-) strand; PAM type: NRG; PAM sequence: AAG
ttcaattaatagtcctttta

SEQ ID NO: 24395 - DNA, 20 bp, Artificial Sequence
  Description of Artificial Sequence: Synthetic oligonucleotide
  Target: SCN9A; (-) strand; PAM type: NRG; PAM sequence: TAG
ttatgtttacattcaattaa

SEQ ID NO: 24396 - DNA, 20 bp, Artificial Sequence
  Description of Artificial Sequence: Synthetic oligonucleotide
  Target: SCN9A; (-) strand; PAM type: NRG; PAM sequence: GAG
ggacccattaaaatgtttga

SEQ ID NO: 24397 - DNA, 20 bp, Artificial Sequence
  Description of Artificial Sequence: Synthetic oligonucleotide
  Target: SCN9A; (-) strand; PAM type: NRG; PAM sequence: GAG
tgggacccattaaaatgttt

SEQ ID NO: 24398 - DNA, 20 bp, Artificial Sequence
  Description of Artificial Sequence: Synthetic oligonucleotide
  Target: SCN9A; (-) strand; PAM type: NRG; PAM sequence: GGG
agaaatagcatttactcact

SEQ ID NO: 24399 - DNA, 20 bp, Artificial Sequence
  Description of Artificial Sequence: Synthetic oligonucleotide
  Target: SCN9A; (-) strand; PAM type: NRG; PAM sequence: TGG
aagaaatagcatttactcac

SEQ ID NO: 24400 - DNA, 20 bp, Artificial Sequence
  Description of Artificial Sequence: Synthetic oligonucleotide
  Target: SCN9A; (-) strand; PAM type: NRG; PAM sequence: TAG
gtgaaaccacccaaaagaaa

SEQ ID NO: 24401 - DNA, 20 bp, Artificial Sequence
  Description of Artificial Sequence: Synthetic oligonucleotide
  Target: SCN9A; (-) strand; PAM type: NRG; PAM sequence: AAG
acattagtgaaaccacccaa

SEQ ID NO: 24402 - DNA, 20 bp, Artificial Sequence
  Description of Artificial Sequence: Synthetic oligonucleotide
  Target: SCN9A; (-) strand; PAM type: NRG; PAM sequence: TAG
aatgcaccatgagagcacat

SEQ ID NO: 24403 - DNA, 20 bp, Artificial Sequence
  Description of Artificial Sequence: Synthetic oligonucleotide
  Target: SCN9A; (-) strand; PAM type: NRG; PAM sequence: GAG
ctttatgtaatgcaccatga

SEQ ID NO: 24404 - DNA, 20 bp, Artificial Sequence
  Description of Artificial Sequence: Synthetic oligonucleotide
  Target: SCN9A; (-) strand; PAM type: NRG; PAM sequence: GAG
gactttatgtaatgcaccat

SEQ ID NO: 24405 - DNA, 20 bp, Artificial Sequence
  Description of Artificial Sequence: Synthetic oligonucleotide
  Target: SCN9A; (-) strand; PAM type: NRG; PAM sequence: TAG
taacatgatgaaactcagca

SEQ ID NO: 24406 - DNA, 20 bp, Artificial Sequence
  Description of Artificial Sequence: Synthetic oligonucleotide
  Target: SCN9A; (-) strand; PAM type: NRG; PAM sequence: CAG
tggtttaacatgatgaaact

SEQ ID NO: 24407 - DNA, 20 bp, Artificial Sequence
  Description of Artificial Sequence: Synthetic oligonucleotide
  Target: SCN9A; (-) strand; PAM type: NRG; PAM sequence: TGG
ttttttttttttgagagctt

SEQ ID NO: 24408 - DNA, 20 bp, Artificial Sequence
  Description of Artificial Sequence: Synthetic oligonucleotide
  Target: SCN9A; (-) strand; PAM type: NRG; PAM sequence: GAG
ttttttttttttttttttga

SEQ ID NO: 24409 - DNA, 20 bp, Artificial Sequence
  Description of Artificial Sequence: Synthetic oligonucleotide
  Target: SCN9A; (-) strand; PAM type: NRG; PAM sequence: GAG
tttttttttttttttttttt

SEQ ID NO: 24410 - DNA, 20 bp, Artificial Sequence
  Description of Artificial Sequence: Synthetic oligonucleotide
  Target: SCN9A; (-) strand; PAM type: NRG; PAM sequence: TGG
ctgtcttttgaagtggtcag

SEQ ID NO: 24411 - DNA, 20 bp, Artificial Sequence
  Description of Artificial Sequence: Synthetic oligonucleotide
  Target: SCN9A; (-) strand; PAM type: NRG; PAM sequence: CAG
agtctgtcttttgaagtggt

SEQ ID NO: 24412 - DNA, 20 bp, Artificial Sequence
  Description of Artificial Sequence: Synthetic oligonucleotide
  Target: SCN9A; (-) strand; PAM type: NRG; PAM sequence: TGG
gaatagtctgtcttttgaag

SEQ ID NO: 24413 - DNA, 20 bp, Artificial Sequence
  Description of Artificial Sequence: Synthetic oligonucleotide
  Target: SCN9A; (-) strand; PAM type: NRG; PAM sequence: AAG
aatgaatagtctgtcttttg

SEQ ID NO: 24414 - DNA, 20 bp, Artificial Sequence
  Description of Artificial Sequence: Synthetic oligonucleotide
  Target: SCN9A; (-) strand; PAM type: NRG; PAM sequence: TAG
ctgttatggtttttaatgaa

SEQ ID NO: 24415 - DNA, 20 bp, Artificial Sequence
  Description of Artificial Sequence: Synthetic oligonucleotide
  Target: SCN9A; (-) strand; PAM type: NRG; PAM sequence: TGG
ttatattgatcatgctgtta

SEQ ID NO: 24416 - DNA, 20 bp, Artificial Sequence
  Description of Artificial Sequence: Synthetic oligonucleotide
  Target: SCN9A; (-) strand; PAM type: NRG; PAM sequence: AAG
atgttaagaaatggtgaaaa

SEQ ID NO: 24417 - DNA, 20 bp, Artificial Sequence
  Description of Artificial Sequence: Synthetic oligonucleotide
  Target: SCN9A; (-) strand; PAM type: NRG; PAM sequence: TGG
ttatatttgatgttaagaaa

SEQ ID NO: 24418 - DNA, 20 bp, Artificial Sequence
  Description of Artificial Sequence: Synthetic oligonucleotide
  Target: SCN9A; (-) strand; PAM type: NRG; PAM sequence: AAG
ttttagttatatttgatgtt

SEQ ID NO: 24419 - DNA, 20 bp, Artificial Sequence
  Description of Artificial Sequence: Synthetic oligonucleotide
  Target: SCN9A; (-) strand; PAM type: NRG; PAM sequence: TAG
atgttaacaaatatttgttt

SEQ ID NO: 24420 - DNA, 20 bp, Artificial Sequence
  Description of Artificial Sequence: Synthetic oligonucleotide
  Target: SCN9A; (-) strand; PAM type: NRG; PAM sequence: AAG
tattttttctttcttttgga

SEQ ID NO: 24421 - DNA, 20 bp, Artificial Sequence
  Description of Artificial Sequence: Synthetic oligonucleotide
  Target: SCN9A; (-) strand; PAM type: NRG; PAM sequence: TGG
cttttattttttctttcttt

SEQ ID NO: 24422 - DNA, 20 bp, Artificial Sequence
  Description of Artificial Sequence: Synthetic oligonucleotide
  Target: SCN9A; (-) strand; PAM type: NRG; PAM sequence: TAG
ctaataattaattctaactt

SEQ ID NO: 24423 - DNA, 20 bp, Artificial Sequence
  Description of Artificial Sequence: Synthetic oligonucleotide
  Target: SCN9A; (-) strand; PAM type: NRG; PAM sequence: AAG
ttctgttaacttggtaggag

SEQ ID NO: 24424 - DNA, 20 bp, Artificial Sequence
  Description of Artificial Sequence: Synthetic oligonucleotide
  Target: SCN9A; (-) strand; PAM type: NRG; PAM sequence: GAG
tttttctgttaacttggtag

SEQ ID NO: 24425 - DNA, 20 bp, Artificial Sequence
  Description of Artificial Sequence: Synthetic oligonucleotide
  Target: SCN9A; (-) strand; PAM type: NRG; PAM sequence: AGG
tatttttctgttaacttggt

SEQ ID NO: 24426 - DNA, 20 bp, Artificial Sequence
  Description of Artificial Sequence: Synthetic oligonucleotide
  Target: SCN9A; (-) strand; PAM type: NRG; PAM sequence: TAG
gtatttttctgttaacttgg

SEQ ID NO: 24427 - DNA, 20 bp, Artificial Sequence
  Description of Artificial Sequence: Synthetic oligonucleotide
  Target: SCN9A; (-) strand; PAM type: NRG; PAM sequence: TGG
aatgtatttttctgttaact

SEQ ID NO: 24428 - DNA, 20 bp, Artificial Sequence
  Description of Artificial Sequence: Synthetic oligonucleotide
  Target: SCN9A; (-) strand; PAM type: NRG; PAM sequence: TAG
aaaaataataatggtaataa

SEQ ID NO: 24429 - DNA, 20 bp, Artificial Sequence
  Description of Artificial Sequence: Synthetic oligonucleotide
  Target: SCN9A; (-) strand; PAM type: NRG; PAM sequence: TGG
tctgtctcaaaaaataataa

SEQ ID NO: 24430 - DNA, 20 bp, Artificial Sequence
  Description of Artificial Sequence: Synthetic oligonucleotide
  Target: SCN9A; (-) strand; PAM type: NRG; PAM sequence: GAG
ctccagcctggcaacaaagt

SEQ ID NO: 24431 - DNA, 20 bp, Artificial Sequence
  Description of Artificial Sequence: Synthetic oligonucleotide
  Target: SCN9A; (-) strand; PAM type: NRG; PAM sequence: AAG
tgcactccagcctggcaaca

SEQ ID NO: 24432 - DNA, 20 bp, Artificial Sequence
  Description of Artificial Sequence: Synthetic oligonucleotide
  Target: SCN9A; (-) strand; PAM type: NRG; PAM sequence: TGG
cctgctactgcactccagcc

SEQ ID NO: 24433 - DNA, 20 bp, Artificial Sequence
  Description of Artificial Sequence: Synthetic oligonucleotide
  Target: SCN9A; (-) strand; PAM type: NRG; PAM sequence: CAG
gagatcctgctactgcactc

SEQ ID NO: 24434 - DNA, 20 bp, Artificial Sequence
  Description of Artificial Sequence: Synthetic oligonucleotide
  Target: SCN9A; (-) strand; PAM type: NRG; PAM sequence: GAG
ggcagaggttgcagtgagct

SEQ ID NO: 24435 - DNA, 20 bp, Artificial Sequence
  Description of Artificial Sequence: Synthetic oligonucleotide
  Target: SCN9A; (-) strand; PAM type: NRG; PAM sequence: GAG
caggaggcagaggttgcagt

SEQ ID NO: 24436 - DNA, 20 bp, Artificial Sequence
  Description of Artificial Sequence: Synthetic oligonucleotide
  Target: SCN9A; (-) strand; PAM type: NRG; PAM sequence: CAG
aacccaggaggcagaggttg

SEQ ID NO: 24437 - DNA, 20 bp, Artificial Sequence
  Description of Artificial Sequence: Synthetic oligonucleotide
  Target: SCN9A; (-) strand; PAM type: NRG; PAM sequence: AGG
cgcttgaacccaggaggcag

SEQ ID NO: 24438 - DNA, 20 bp, Artificial Sequence
  Description of Artificial Sequence: Synthetic oligonucleotide
  Target: SCN9A; (-) strand; PAM type: NRG; PAM sequence: GAG
tcgcttgaacccaggaggca

SEQ ID NO: 24439 - DNA, 20 bp, Artificial Sequence
  Description of Artificial Sequence: Synthetic oligonucleotide
  Target: SCN9A; (-) strand; PAM type: NRG; PAM sequence: CAG
aatcgcttgaacccaggagg

SEQ ID NO: 24440 - DNA, 20 bp, Artificial Sequence
  Description of Artificial Sequence: Synthetic oligonucleotide
  Target: SCN9A; (-) strand; PAM type: NRG; PAM sequence: AGG
gagaatcgcttgaacccagg

SEQ ID NO: 24441 - DNA, 20 bp, Artificial Sequence
  Description of Artificial Sequence: Synthetic oligonucleotide
  Target: SCN9A; (-) strand; PAM type: NRG; PAM sequence: GAG
ggagaatcgcttgaacccag

SEQ ID NO: 24442 - DNA, 20 bp, Artificial Sequence
  Description of Artificial Sequence: Synthetic oligonucleotide
  Target: SCN9A; (-) strand; PAM type: NRG; PAM sequence: AGG
caggagaatcgcttgaaccc

SEQ ID NO: 24443 - DNA, 20 bp, Artificial Sequence
  Description of Artificial Sequence: Synthetic oligonucleotide
  Target: SCN9A; (-) strand; PAM type: NRG; PAM sequence: CAG
gcaggagaatcgcttgaacc

SEQ ID NO: 24444 - DNA, 20 bp, Artificial Sequence
  Description of Artificial Sequence: Synthetic oligonucleotide
  Target: SCN9A; (-) strand; PAM type: NRG; PAM sequence: GAG
tactcaagaggctgaggcag

SEQ ID NO: 24445 - DNA, 20 bp, Artificial Sequence
  Description of Artificial Sequence: Synthetic oligonucleotide
  Target: SCN9A; (-) strand; PAM type: NRG; PAM sequence: AGG
gctactcaagaggctgaggc

SEQ ID NO: 24446 - DNA, 20 bp, Artificial Sequence
  Description of Artificial Sequence: Synthetic oligonucleotide
  Target: SCN9A; (-) strand; PAM type: NRG; PAM sequence: CAG
agctactcaagaggctgagg

SEQ ID NO: 24447 - DNA, 20 bp, Artificial Sequence
  Description of Artificial Sequence: Synthetic oligonucleotide
  Target: SCN9A; (-) strand; PAM type: NRG; PAM sequence: AGG
cccagctactcaagaggctg

SEQ ID NO: 24448 - DNA, 20 bp, Artificial Sequence
  Description of Artificial Sequence: Synthetic oligonucleotide
  Target: SCN9A; (-) strand; PAM type: NRG; PAM sequence: GAG
tcccagctactcaagaggct

SEQ ID NO: 24449 - DNA, 20 bp, Artificial Sequence
  Description of Artificial Sequence: Synthetic oligonucleotide
  Target: SCN9A; (-) strand; PAM type: NRG; PAM sequence: AGG
tgtagtcccagctactcaag

SEQ ID NO: 24450 - DNA, 20 bp, Artificial Sequence
  Description of Artificial Sequence: Synthetic oligonucleotide
  Target: SCN9A; (-) strand; PAM type: NRG; PAM sequence: GAG
ctgtagtcccagctactcaa

SEQ ID NO: 24451 - DNA, 20 bp, Artificial Sequence
  Description of Artificial Sequence: Synthetic oligonucleotide
  Target: SCN9A; (-) strand; PAM type: NRG; PAM sequence: AAG
gcctgtagtcccagctactc

SEQ ID NO: 24452 - DNA, 20 bp, Artificial Sequence
  Description of Artificial Sequence: Synthetic oligonucleotide
  Target: SCN9A; (-) strand; PAM type: NRG; PAM sequence: CAG
gtggtgagcgcctgtagtcc

SEQ ID NO: 24453 - DNA, 20 bp, Artificial Sequence
  Description of Artificial Sequence: Synthetic oligonucleotide
  Target: SCN9A; (-) strand; PAM type: NRG; PAM sequence: TAG
agcctggtggtgagcgcctg

SEQ ID NO: 24454 - DNA, 20 bp, Artificial Sequence
  Description of Artificial Sequence: Synthetic oligonucleotide
  Target: SCN9A; (-) strand; PAM type: NRG; PAM sequence: GAG
aattagctgagcctggtggt

SEQ ID NO: 24455 - DNA, 20 bp, Artificial Sequence
  Description of Artificial Sequence: Synthetic oligonucleotide
  Target: SCN9A; (-) strand; PAM type: NRG; PAM sequence: TGG
caaaaattagctgagcctgg

SEQ ID NO: 24456 - DNA, 20 bp, Artificial Sequence
  Description of Artificial Sequence: Synthetic oligonucleotide
  Target: SCN9A; (-) strand; PAM type: NRG; PAM sequence: TGG
atacaaaaattagctgagcc

SEQ ID NO: 24457 - DNA, 20 bp, Artificial Sequence
  Description of Artificial Sequence: Synthetic oligonucleotide
  Target: SCN9A; (-) strand; PAM type: NRG; PAM sequence: GAG
taaaaatacaaaaattagct

SEQ ID NO: 24458 - DNA, 20 bp, Artificial Sequence
  Description of Artificial Sequence: Synthetic oligonucleotide
  Target: SCN9A; (-) strand; PAM type: NRG; PAM sequence: TAG
tctactaaaaatacaaaaat

SEQ ID NO: 24459 - DNA, 20 bp, Artificial Sequence
  Description of Artificial Sequence: Synthetic oligonucleotide
  Target: SCN9A; (-) strand; PAM type: NRG; PAM sequence: TGG
cgagaccatcctggctaaca

SEQ ID NO: 24460 - DNA, 20 bp, Artificial Sequence
  Description of Artificial Sequence: Synthetic oligonucleotide
  Target: SCN9A; (-) strand; PAM type: NRG; PAM sequence: TGG
tcaagagatcgagaccatcc

SEQ ID NO: 24461 - DNA, 20 bp, Artificial Sequence
  Description of Artificial Sequence: Synthetic oligonucleotide
  Target: SCN9A; (-) strand; PAM type: NRG; PAM sequence: GAG
tttcacaaggtcaagagatc

SEQ ID NO: 24462 - DNA, 20 bp, Artificial Sequence
  Description of Artificial Sequence: Synthetic oligonucleotide
  Target: SCN9A; (-) strand; PAM type: NRG; PAM sequence: GAG
aacctttttcacaaggtcaa

SEQ ID NO: 24463 - DNA, 20 bp, Artificial Sequence
  Description of Artificial Sequence: Synthetic oligonucleotide
  Target: SCN9A; (-) strand; PAM type: NRG; PAM sequence: AAG
ataacctttttcacaaggtc

SEQ ID NO: 24464 - DNA, 20 bp, Artificial Sequence
  Description of Artificial Sequence: Synthetic oligonucleotide
  Target: SCN9A; (-) strand; PAM type: NRG; PAM sequence: AGG
gaaaaataacctttttcaca

SEQ ID NO: 24465 - DNA, 20 bp, Artificial Sequence
  Description of Artificial Sequence: Synthetic oligonucleotide
  Target: SCN9A; (-) strand; PAM type: NRG; PAM sequence: AAG
cgaaaaataacctttttcac

SEQ ID NO: 24466 - DNA, 20 bp, Artificial Sequence
  Description of Artificial Sequence: Synthetic oligonucleotide
  Target: SCN9A; (-) strand; PAM type: NRG; PAM sequence: TAG
tacataatcaggattagagt

SEQ ID NO: 24467 - DNA, 20 bp, Artificial Sequence
  Description of Artificial Sequence: Synthetic oligonucleotide
  Target: SCN9A; (-) strand; PAM type: NRG; PAM sequence: GAG
aaattacataatcaggatta

SEQ ID NO: 24468 - DNA, 20 bp, Artificial Sequence
  Description of Artificial Sequence: Synthetic oligonucleotide
  Target: SCN9A; (-) strand; PAM type: NRG; PAM sequence: TAG
gtaaattacataatcaggat

SEQ ID NO: 24469 - DNA, 20 bp, Artificial Sequence
  Description of Artificial Sequence: Synthetic oligonucleotide
  Target: SCN9A; (-) strand; PAM type: NRG; PAM sequence: AGG
aattagtaaattacataatc

SEQ ID NO: 24470 - DNA, 20 bp, Artificial Sequence
  Description of Artificial Sequence: Synthetic oligonucleotide
  Target: SCN9A; (-) strand; PAM type: NRG; PAM sequence: CAG
aaattagtaaattacataat

SEQ ID NO: 24471 - DNA, 20 bp, Artificial Sequence
  Description of Artificial Sequence: Synthetic oligonucleotide
  Target: SCN9A; (-) strand; PAM type: NRG; PAM sequence: TAG
ctgcttttagattatcaaat

SEQ ID NO: 24472 - DNA, 20 bp, Artificial Sequence
  Description of Artificial Sequence: Synthetic oligonucleotide
  Target: SCN9A; (-) strand; PAM type: NRG; PAM sequence: TAG
gttttatattgtgctgcttt

SEQ ID NO: 24473 - DNA, 20 bp, Artificial Sequence
  Description of Artificial Sequence: Synthetic oligonucleotide
  Target: SCN9A; (-) strand; PAM type: NRG; PAM sequence: TGG
catgactctttgggtctatg

SEQ ID NO: 24474 - DNA, 20 bp, Artificial Sequence
  Description of Artificial Sequence: Synthetic oligonucleotide
  Target: SCN9A; (-) strand; PAM type: NRG; PAM sequence: GGG
tgaacatgacatgactcttt

SEQ ID NO: 24475 - DNA, 20 bp, Artificial Sequence
  Description of Artificial Sequence: Synthetic oligonucleotide
  Target: SCN9A; (-) strand; PAM type: NRG; PAM sequence: TGG
atgaacatgacatgactctt

SEQ ID NO: 24476 - DNA, 20 bp, Artificial Sequence
  Description of Artificial Sequence: Synthetic oligonucleotide
  Target: SCN9A; (-) strand; PAM type: NRG; PAM sequence: TGG
atccttagttctacatgact

SEQ ID NO: 24477 - DNA, 20 bp, Artificial Sequence
  Description of Artificial Sequence: Synthetic oligonucleotide
  Target: SCN9A; (-) strand; PAM type: NRG; PAM sequence: TAG
gccctgttctttactatcct

SEQ ID NO: 24478 - DNA, 20 bp, Artificial Sequence
  Description of Artificial Sequence: Synthetic oligonucleotide
  Target: SCN9A; (-) strand; PAM type: NRG; PAM sequence: CAG
tactttgtatttgaagactt

SEQ ID NO: 24479 - DNA, 20 bp, Artificial Sequence
  Description of Artificial Sequence: Synthetic oligonucleotide
  Target: SCN9A; (-) strand; PAM type: NRG; PAM sequence: AAG
tgtctattactttgtatttg

SEQ ID NO: 24480 - DNA, 20 bp, Artificial Sequence
  Description of Artificial Sequence: Synthetic oligonucleotide
  Target: SCN9A; (-) strand; PAM type: NRG; PAM sequence: TAG
tcttatgcaaggttgttcct

SEQ ID NO: 24481 - DNA, 20 bp, Artificial Sequence
  Description of Artificial Sequence: Synthetic oligonucleotide
  Target: SCN9A; (-) strand; PAM type: NRG; PAM sequence: AGG
ttttctctccctcttatgca

SEQ ID NO: 24482 - DNA, 20 bp, Artificial Sequence
  Description of Artificial Sequence: Synthetic oligonucleotide
  Target: SCN9A; (-) strand; PAM type: NRG; PAM sequence: AAG
cttttctctccctcttatgc

SEQ ID NO: 24483 - DNA, 20 bp, Artificial Sequence
  Description of Artificial Sequence: Synthetic oligonucleotide
  Target: SCN9A; (-) strand; PAM type: NRG; PAM sequence: TGG
tgtatttcattgattgcatc

SEQ ID NO: 24484 - DNA, 20 bp, Artificial Sequence
  Description of Artificial Sequence: Synthetic oligonucleotide
  Target: SCN9A; (-) strand; PAM type: NRG; PAM sequence: CAG
tcacatttgttgattcattt

SEQ ID NO: 24485 - DNA, 20 bp, Artificial Sequence
  Description of Artificial Sequence: Synthetic oligonucleotide
  Target: SCN9A; (-) strand; PAM type: NRG; PAM sequence: TAG
taaaacgattttgttgttca

SEQ ID NO: 24486 - DNA, 20 bp, Artificial Sequence
  Description of Artificial Sequence: Synthetic oligonucleotide
  Target: SCN9A; (-) strand; PAM type: NRG; PAM sequence: AAG
caagtagcatgtttttactg

SEQ ID NO: 24487 - DNA, 20 bp, Artificial Sequence
  Description of Artificial Sequence: Synthetic oligonucleotide
  Target: SCN9A; (-) strand; PAM type: NRG; PAM sequence: TAG
gaaaaagaattaaatccaag

SEQ ID NO: 24488 - DNA, 20 bp, Artificial Sequence
  Description of Artificial Sequence: Synthetic oligonucleotide
  Target: SCN9A; (-) strand; PAM type: NRG; PAM sequence: AAG
tatgaaaaagaattaaatcc

SEQ ID NO: 24489 - DNA, 20 bp, Artificial Sequence
  Description of Artificial Sequence: Synthetic oligonucleotide
  Target: SCN9A; (-) strand; PAM type: NRG; PAM sequence: AAG
aaattaaatgaagtatgaaa

SEQ ID NO: 24490 - DNA, 20 bp, Artificial Sequence
  Description of Artificial Sequence: Synthetic oligonucleotide
  Target: SCN9A; (-) strand; PAM type: NRG; PAM sequence: AAG
gtaacagaaaaaattaaatg

SEQ ID NO: 24491 - DNA, 20 bp, Artificial Sequence
  Description of Artificial Sequence: Synthetic oligonucleotide
  Target: SCN9A; (-) strand; PAM type: NRG; PAM sequence: CAG
ctctgctacctgaaaggtaa

SEQ ID NO: 24492 - DNA, 20 bp, Artificial Sequence
  Description of Artificial Sequence: Synthetic oligonucleotide
  Target: SCN9A; (-) strand; PAM type: NRG; PAM sequence: AGG
agagatctctgctacctgaa

SEQ ID NO: 24493 - DNA, 20 bp, Artificial Sequence
  Description of Artificial Sequence: Synthetic oligonucleotide
  Target: SCN9A; (-) strand; PAM type: NRG; PAM sequence: AAG
cagagatctctgctacctga

SEQ ID NO: 24494 - DNA, 20 bp, Artificial Sequence
  Description of Artificial Sequence: Synthetic oligonucleotide
  Target: SCN9A; (-) strand; PAM type: NRG; PAM sequence: GAG
agagcaatgtttcacctcca

SEQ ID NO: 24495 - DNA, 20 bp, Artificial Sequence
  Description of Artificial Sequence: Synthetic oligonucleotide
  Target: SCN9A; (-) strand; PAM type: NRG; PAM sequence: CAG
tcagagcaatgtttcacctc

SEQ ID NO: 24496 - DNA, 20 bp, Artificial Sequence
  Description of Artificial Sequence: Synthetic oligonucleotide
  Target: SCN9A; (-) strand; PAM type: NRG; PAM sequence: GAG
ctagaatcaatgccagttca

SEQ ID NO: 24497 - DNA, 20 bp, Artificial Sequence
  Description of Artificial Sequence: Synthetic oligonucleotide
  Target: SCN9A; (-) strand; PAM type: NRG; PAM sequence: CAG
ggctagaatcaatgccagtt

SEQ ID NO: 24498 - DNA, 20 bp, Artificial Sequence
  Description of Artificial Sequence: Synthetic oligonucleotide
  Target: SCN9A; (-) strand; PAM type: NRG; PAM sequence: CAG
agctgggctagaatcaatgc

SEQ ID NO: 24499 - DNA, 20 bp, Artificial Sequence
  Description of Artificial Sequence: Synthetic oligonucleotide
  Target: SCN9A; (-) strand; PAM type: NRG; PAM sequence: TAG
ttggtctacaagagctgggc

SEQ ID NO: 24500 - DNA, 20 bp, Artificial Sequence
  Description of Artificial Sequence: Synthetic oligonucleotide
  Target: SCN9A; (-) strand; PAM type: NRG; PAM sequence: GGG
gtaattggtctacaagagct

SEQ ID NO: 24501 - DNA, 20 bp, Artificial Sequence
  Description of Artificial Sequence: Synthetic oligonucleotide
  Target: SCN9A; (-) strand; PAM type: NRG; PAM sequence: TGG
ggtaattggtctacaagagc

SEQ ID NO: 24502 - DNA, 20 bp, Artificial Sequence
  Description of Artificial Sequence: Synthetic oligonucleotide
  Target: SCN9A; (-) strand; PAM type: NRG; PAM sequence: GAG
agttggtaattggtctacaa

SEQ ID NO: 24503 - DNA, 20 bp, Artificial Sequence
  Description of Artificial Sequence: Synthetic oligonucleotide
  Target: SCN9A; (-) strand; PAM type: NRG; PAM sequence: AAG
caagttggtaattggtctac

SEQ ID NO: 24504 - DNA, 20 bp, Artificial Sequence
  Description of Artificial Sequence: Synthetic oligonucleotide
  Target: SCN9A; (-) strand; PAM type: NRG; PAM sequence: TGG
tttacttacaagttggtaat

SEQ ID NO: 24505 - DNA, 20 bp, Artificial Sequence
  Description of Artificial Sequence: Synthetic oligonucleotide
  Target: SCN9A; (-) strand; PAM type: NRG; PAM sequence: TGG
gaacatgtttacttacaagt

SEQ ID NO: 24506 - DNA, 20 bp, Artificial Sequence
  Description of Artificial Sequence: Synthetic oligonucleotide
  Target: SCN9A; (-) strand; PAM type: NRG; PAM sequence: AAG
tcatgaacatgtttacttac

SEQ ID NO: 24507 - DNA, 20 bp, Artificial Sequence
  Description of Artificial Sequence: Synthetic oligonucleotide
  Target: SCN9A; (-) strand; PAM type: NRG; PAM sequence: AAG
agcatgggcttgtcagaatg

SEQ ID NO: 24508 - DNA, 20 bp, Artificial Sequence
  Description of Artificial Sequence: Synthetic oligonucleotide
  Target: SCN9A; (-) strand; PAM type: NRG; PAM sequence: CAG
actgagaagcatgggcttgt

SEQ ID NO: 24509 - DNA, 20 bp, Artificial Sequence
  Description of Artificial Sequence: Synthetic oligonucleotide
  Target: SCN9A; (-) strand; PAM type: NRG; PAM sequence: GGG
acatgaagactgagaagcat

SEQ ID NO: 24510 - DNA, 20 bp, Artificial Sequence
  Description of Artificial Sequence: Synthetic oligonucleotide
  Target: SCN9A; (-) strand; PAM type: NRG; PAM sequence: TGG
cacatgaagactgagaagca

SEQ ID NO: 24511 - DNA, 20 bp, Artificial Sequence
  Description of Artificial Sequence: Synthetic oligonucleotide
  Target: SCN9A; (-) strand; PAM type: NRG; PAM sequence: AAG
gtttccacatgaagactgag

SEQ ID NO: 24512 - DNA, 20 bp, Artificial Sequence
  Description of Artificial Sequence: Synthetic oligonucleotide
  Target: SCN9A; (-) strand; PAM type: NRG; PAM sequence: GAG
atagtttccacatgaagact

SEQ ID NO: 24513 - DNA, 20 bp, Artificial Sequence
  Description of Artificial Sequence: Synthetic oligonucleotide
  Target: SCN9A; (-) strand; PAM type: NRG; PAM sequence: AAG
aaatgcatagtttccacatg

SEQ ID NO: 24514 - DNA, 20 bp, Artificial Sequence
  Description of Artificial Sequence: Synthetic oligonucleotide
  Target: SCN9A; (-) strand; PAM type: NRG; PAM sequence: TAG
gcttaaaaactggaaatgca

SEQ ID NO: 24515 - DNA, 20 bp, Artificial Sequence
  Description of Artificial Sequence: Synthetic oligonucleotide
  Target: SCN9A; (-) strand; PAM type: NRG; PAM sequence: TGG
aacattgggtgcttaaaaac

SEQ ID NO: 24516 - DNA, 20 bp, Artificial Sequence
  Description of Artificial Sequence: Synthetic oligonucleotide
  Target: SCN9A; (-) strand; PAM type: NRG; PAM sequence: GGG
ttgttgatggattgaacatt

SEQ ID NO: 24517 - DNA, 20 bp, Artificial Sequence
  Description of Artificial Sequence: Synthetic oligonucleotide
  Target: SCN9A; (-) strand; PAM type: NRG; PAM sequence: TGG
tttgttgatggattgaacat

SEQ ID NO: 24518 - DNA, 20 bp, Artificial Sequence
  Description of Artificial Sequence: Synthetic oligonucleotide
  Target: SCN9A; (-) strand; PAM type: NRG; PAM sequence: TGG
gagctgaagggatttgttga

SEQ ID NO: 24519 - DNA, 20 bp, Artificial Sequence
  Description of Artificial Sequence: Synthetic oligonucleotide
  Target: SCN9A; (-) strand; PAM type: NRG; PAM sequence: GGG
attttgaagttagagctgaa

SEQ ID NO: 24520 - DNA, 20 bp, Artificial Sequence
  Description of Artificial Sequence: Synthetic oligonucleotide
  Target: SCN9A; (-) strand; PAM type: NRG; PAM sequence: AGG
tattttgaagttagagctga

SEQ ID NO: 24521 - DNA, 20 bp, Artificial Sequence
  Description of Artificial Sequence: Synthetic oligonucleotide
  Target: SCN9A; (-) strand; PAM type: NRG; PAM sequence: AAG
atattttgaagttagagctg

SEQ ID NO: 24522 - DNA, 20 bp, Artificial Sequence
  Description of Artificial Sequence: Synthetic oligonucleotide
  Target: SCN9A; (-) strand; PAM type: NRG; PAM sequence: GAG
ctgagtatattttgaagtta

SEQ ID NO: 24523 - DNA, 20 bp, Artificial Sequence
  Description of Artificial Sequence: Synthetic oligonucleotide
  Target: SCN9A; (-) strand; PAM type: NRG; PAM sequence: TAG
tgctgagtatattttgaagt

SEQ ID NO: 24524 - DNA, 20 bp, Artificial Sequence
  Description of Artificial Sequence: Synthetic oligonucleotide
  Target: SCN9A; (-) strand; PAM type: NRG; PAM sequence: AAG
gacatgctgagtatattttg

SEQ ID NO: 24525 - DNA, 20 bp, Artificial Sequence
  Description of Artificial Sequence: Synthetic oligonucleotide
  Target: SCN9A; (-) strand; PAM type: NRG; PAM sequence: GAG
tagtgagggtgtgacatgct

SEQ ID NO: 24526 - DNA, 20 bp, Artificial Sequence
  Description of Artificial Sequence: Synthetic oligonucleotide
  Target: SCN9A; (-) strand; PAM type: NRG; PAM sequence: GGG
ggtagagttttgtatagtga

SEQ ID NO: 24527 - DNA, 20 bp, Artificial Sequence
  Description of Artificial Sequence: Synthetic oligonucleotide
  Target: SCN9A; (-) strand; PAM type: NRG; PAM sequence: AGG
tggtagagttttgtatagtg

SEQ ID NO: 24528 - DNA, 20 bp, Artificial Sequence
  Description of Artificial Sequence: Synthetic oligonucleotide
  Target: SCN9A; (-) strand; PAM type: NRG; PAM sequence: GAG
atggtagagttttgtatagt

SEQ ID NO: 24529 - DNA, 20 bp, Artificial Sequence
  Description of Artificial Sequence: Synthetic oligonucleotide
  Target: SCN9A; (-) strand; PAM type: NRG; PAM sequence: TAG
tagtatggtagagttttgta

SEQ ID NO: 24530 - DNA, 20 bp, Artificial Sequence
  Description of Artificial Sequence: Synthetic oligonucleotide
  Target: SCN9A; (-) strand; PAM type: NRG; PAM sequence: GAG
gagcttagactagtatggta

SEQ ID NO: 24531 - DNA, 20 bp, Artificial Sequence
  Description of Artificial Sequence: Synthetic oligonucleotide
  Target: SCN9A; (-) strand; PAM type: NRG; PAM sequence: TAG
gggagcttagactagtatgg

SEQ ID NO: 24532 - DNA, 20 bp, Artificial Sequence
  Description of Artificial Sequence: Synthetic oligonucleotide
  Target: SCN9A; (-) strand; PAM type: NRG; PAM sequence: TGG
gatgggagcttagactagta

SEQ ID NO: 24533 - DNA, 20 bp, Artificial Sequence
  Description of Artificial Sequence: Synthetic oligonucleotide
  Target: SCN9A; (-) strand; PAM type: NRG; PAM sequence: TAG
gaggtgatgggagcttagac

SEQ ID NO: 24534 - DNA, 20 bp, Artificial Sequence
  Description of Artificial Sequence: Synthetic oligonucleotide
  Target: SCN9A; (-) strand; PAM type: NRG; PAM sequence: TAG
ggtgagaggtgatgggagct

SEQ ID NO: 24535 - DNA, 20 bp, Artificial Sequence
  Description of Artificial Sequence: Synthetic oligonucleotide
  Target: SCN9A; (-) strand; PAM type: NRG; PAM sequence: GAG
atccaggtgagaggtgatgg

SEQ ID NO: 24536 - DNA, 20 bp, Artificial Sequence
  Description of Artificial Sequence: Synthetic oligonucleotide
  Target: SCN9A; (-) strand; PAM type: NRG; PAM sequence: GGG
aaatccaggtgagaggtgat

SEQ ID NO: 24537 - DNA, 20 bp, Artificial Sequence
  Description of Artificial Sequence: Synthetic oligonucleotide
  Target: SCN9A; (-) strand; PAM type: NRG; PAM sequence: TGG
taaatccaggtgagaggtga

SEQ ID NO: 24538 - DNA, 20 bp, Artificial Sequence
  Description of Artificial Sequence: Synthetic oligonucleotide
  Target: SCN9A; (-) strand; PAM type: NRG; PAM sequence: AGG
tctgcataaatccaggtgag

SEQ ID NO: 24539 - DNA, 20 bp, Artificial Sequence
  Description of Artificial Sequence: Synthetic oligonucleotide
  Target: SCN9A; (-) strand; PAM type: NRG; PAM sequence: GAG
ttctgcataaatccaggtga

SEQ ID NO: 24540 - DNA, 20 bp, Artificial Sequence
  Description of Artificial Sequence: Synthetic oligonucleotide
  Target: SCN9A; (-) strand; PAM type: NRG; PAM sequence: GAG
gtttctgcataaatccaggt

SEQ ID NO: 24541 - DNA, 20 bp, Artificial Sequence
  Description of Artificial Sequence: Synthetic oligonucleotide
  Target: SCN9A; (-) strand; PAM type: NRG; PAM sequence: AGG
tggagtttctgcataaatcc

SEQ ID NO: 24542 - DNA, 20 bp, Artificial Sequence
  Description of Artificial Sequence: Synthetic oligonucleotide
  Target: SCN9A; (-) strand; PAM type: NRG; PAM sequence: CAG
ttggagtttctgcataaatc

SEQ ID NO: 24543 - DNA, 20 bp, Artificial Sequence
  Description of Artificial Sequence: Synthetic oligonucleotide
  Target: SCN9A; (-) strand; PAM type: NRG; PAM sequence: GAG
agaagctggaagatttcttg

SEQ ID NO: 24544 - DNA, 20 bp, Artificial Sequence
  Description of Artificial Sequence: Synthetic oligonucleotide
  Target: SCN9A; (-) strand; PAM type: NRG; PAM sequence: TGG
gcagaagctggaagatttct

SEQ ID NO: 24545 - DNA, 20 bp, Artificial Sequence
  Description of Artificial Sequence: Synthetic oligonucleotide
  Target: SCN9A; (-) strand; PAM type: NRG; PAM sequence: AAG
atagcaatggcagaagctgg

SEQ ID NO: 24546 - DNA, 20 bp, Artificial Sequence
  Description of Artificial Sequence: Synthetic oligonucleotide
  Target: SCN9A; (-) strand; PAM type: NRG; PAM sequence: TGG
cgaatagcaatggcagaagc

SEQ ID NO: 24547 - DNA, 20 bp, Artificial Sequence
  Description of Artificial Sequence: Synthetic oligonucleotide
  Target: SCN9A; (-) strand; PAM type: NRG; PAM sequence: AAG
agggcgaatagcaatggcag

SEQ ID NO: 24548 - DNA, 20 bp, Artificial Sequence
  Description of Artificial Sequence: Synthetic oligonucleotide
  Target: SCN9A; (-) strand; PAM type: NRG; PAM sequence: CAG
ggaagggcgaatagcaatgg

SEQ ID NO: 24549 - DNA, 20 bp, Artificial Sequence
  Description of Artificial Sequence: Synthetic oligonucleotide
  Target: SCN9A; (-) strand; PAM type: NRG; PAM sequence: TGG
agtggaagggcgaatagcaa

SEQ ID NO: 24550 - DNA, 20 bp, Artificial Sequence
  Description of Artificial Sequence: Synthetic oligonucleotide
  Target: SCN9A; (-) strand; PAM type: NRG; PAM sequence: TAG
cttaagagtggaagggcgaa

SEQ ID NO: 24551 - DNA, 20 bp, Artificial Sequence
  Description of Artificial Sequence: Synthetic oligonucleotide
  Target: SCN9A; (-) strand; PAM type: NRG; PAM sequence: GGG
gtgcaatcttaagagtggaa

SEQ ID NO: 24552 - DNA, 20 bp, Artificial Sequence
  Description of Artificial Sequence: Synthetic oligonucleotide
  Target: SCN9A; (-) strand; PAM type: NRG; PAM sequence: AGG
tgtgcaatcttaagagtgga

SEQ ID NO: 24553 - DNA, 20 bp, Artificial Sequence
  Description of Artificial Sequence: Synthetic oligonucleotide
  Target: SCN9A; (-) strand; PAM type: NRG; PAM sequence: AAG
atgtgcaatcttaagagtgg

SEQ ID NO: 24554 - DNA, 20 bp, Artificial Sequence
  Description of Artificial Sequence: Synthetic oligonucleotide
  Target: SCN9A; (-) strand; PAM type: NRG; PAM sequence: TGG
acaatgtgcaatcttaagag

SEQ ID NO: 24555 - DNA, 20 bp, Artificial Sequence
  Description of Artificial Sequence: Synthetic oligonucleotide
  Target: SCN9A; (-) strand; PAM type: NRG; PAM sequence: GAG
ctcacaatgtgcaatcttaa

SEQ ID NO: 24556 - DNA, 20 bp, Artificial Sequence
  Description of Artificial Sequence: Synthetic oligonucleotide
  Target: SCN9A; (-) strand; PAM type: NRG; PAM sequence: AAG
atctcacaatgtgcaatctt

SEQ ID NO: 24557 - DNA, 20 bp, Artificial Sequence
  Description of Artificial Sequence: Synthetic oligonucleotide
  Target: SCN9A; (-) strand; PAM type: NRG; PAM sequence: AGG
gacatttgaagaacattata

SEQ ID NO: 24558 - DNA, 20 bp, Artificial Sequence
  Description of Artificial Sequence: Synthetic oligonucleotide
  Target: SCN9A; (-) strand; PAM type: NRG; PAM sequence: AAG
agacatttgaagaacattat

SEQ ID NO: 24559 - DNA, 20 bp, Artificial Sequence
  Description of Artificial Sequence: Synthetic oligonucleotide
  Target: SCN9A; (-) strand; PAM type: NRG; PAM sequence: AAG
gccagattataagacatttg

SEQ ID NO: 24560 - DNA, 20 bp, Artificial Sequence
  Description of Artificial Sequence: Synthetic oligonucleotide
  Target: SCN9A; (-) strand; PAM type: NRG; PAM sequence: AAG
tgtagtagaggccagattat

SEQ ID NO: 24561 - DNA, 20 bp, Artificial Sequence
  Description of Artificial Sequence: Synthetic oligonucleotide
  Target: SCN9A; (-) strand; PAM type: NRG; PAM sequence: CAG
atcagagatgtagtagaggc

SEQ ID NO: 24562 - DNA, 20 bp, Artificial Sequence
  Description of Artificial Sequence: Synthetic oligonucleotide
  Target: SCN9A; (-) strand; PAM type: NRG; PAM sequence: AGG
gtagatcagagatgtagtag

SEQ ID NO: 24563 - DNA, 20 bp, Artificial Sequence
  Description of Artificial Sequence: Synthetic oligonucleotide
  Target: SCN9A; (-) strand; PAM type: NRG; PAM sequence: GAG
tgtagatcagagatgtagta

SEQ ID NO: 24564 - DNA, 20 bp, Artificial Sequence
  Description of Artificial Sequence: Synthetic oligonucleotide
  Target: SCN9A; (-) strand; PAM type: NRG; PAM sequence: TAG
agtgtagatcagagatgtag

SEQ ID NO: 24565 - DNA, 20 bp, Artificial Sequence
  Description of Artificial Sequence: Synthetic oligonucleotide
  Target: SCN9A; (-) strand; PAM type: NRG; PAM sequence: TAG
aaaagtgtagatcagagatg

SEQ ID NO: 24566 - DNA, 20 bp, Artificial Sequence
  Description of Artificial Sequence: Synthetic oligonucleotide
  Target: SCN9A; (-) strand; PAM type: NRG; PAM sequence: GAG
tttttaaaaagtgtagatca

SEQ ID NO: 24567 - DNA, 20 bp, Artificial Sequence
  Description of Artificial Sequence: Synthetic oligonucleotide
  Target: SCN9A; (-) strand; PAM type: NRG; PAM sequence: CAG
tatttttaaaaagtgtagat

SEQ ID NO: 24568 - DNA, 20 bp, Artificial Sequence
  Description of Artificial Sequence: Synthetic oligonucleotide
  Target: SCN9A; (-) strand; PAM type: NRG; PAM sequence: TAG
gacattatttttaaaaagtg

SEQ ID NO: 24569 - DNA, 20 bp, Artificial Sequence
  Description of Artificial Sequence: Synthetic oligonucleotide
  Target: SCN9A; (-) strand; PAM type: NRG; PAM sequence: AAG
caaatgacattatttttaaa

SEQ ID NO: 24570 - DNA, 20 bp, Artificial Sequence
  Description of Artificial Sequence: Synthetic oligonucleotide
  Target: SCN9A; (-) strand; PAM type: NRG; PAM sequence: AAG
tccagcctggacgacagagg

SEQ ID NO: 24571 - DNA, 20 bp, Artificial Sequence
  Description of Artificial Sequence: Synthetic oligonucleotide
  Target: SCN9A; (-) strand; PAM type: NRG; PAM sequence: AGG
cactccagcctggacgacag

SEQ ID NO: 24572 - DNA, 20 bp, Artificial Sequence
  Description of Artificial Sequence: Synthetic oligonucleotide
  Target: SCN9A; (-) strand; PAM type: NRG; PAM sequence: GAG
gcactccagcctggacgaca

SEQ ID NO: 24573 - DNA, 20 bp, Artificial Sequence
  Description of Artificial Sequence: Synthetic oligonucleotide
  Target: SCN9A; (-) strand; PAM type: NRG; PAM sequence: CAG
ctgcactccagcctggacga

SEQ ID NO: 24574 - DNA, 20 bp, Artificial Sequence
  Description of Artificial Sequence: Synthetic oligonucleotide
  Target: SCN9A; (-) strand; PAM type: NRG; PAM sequence: TGG
tgtgccactgcactccagcc

SEQ ID NO: 24575 - DNA, 20 bp, Artificial Sequence
  Description of Artificial Sequence: Synthetic oligonucleotide
  Target: SCN9A; (-) strand; PAM type: NRG; PAM sequence: CAG
aagattgtgccactgcactc

SEQ ID NO: 24576 - DNA, 20 bp, Artificial Sequence
  Description of Artificial Sequence: Synthetic oligonucleotide
  Target: SCN9A; (-) strand; PAM type: NRG; PAM sequence: AAG
ggcagaggttgcagtgagcc

SEQ ID NO: 24577 - DNA, 20 bp, Artificial Sequence
  Description of Artificial Sequence: Synthetic oligonucleotide
  Target: SCN9A; (-) strand; PAM type: NRG; PAM sequence: GAG
caggaggcagaggttgcagt

SEQ ID NO: 24578 - DNA, 20 bp, Artificial Sequence
  Description of Artificial Sequence: Synthetic oligonucleotide
  Target: SCN9A; (-) strand; PAM type: NRG; PAM sequence: CAG
aatccaggaggcagaggttg

SEQ ID NO: 24579 - DNA, 20 bp, Artificial Sequence
  Description of Artificial Sequence: Synthetic oligonucleotide
  Target: SCN9A; (-) strand; PAM type: NRG; PAM sequence: AGG
tacttgaatccaggaggcag

SEQ ID NO: 24580 - DNA, 20 bp, Artificial Sequence
  Description of Artificial Sequence: Synthetic oligonucleotide
  Target: SCN9A; (-) strand; PAM type: NRG; PAM sequence: GAG
ttacttgaatccaggaggca

SEQ ID NO: 24581 - DNA, 20 bp, Artificial Sequence
  Description of Artificial Sequence: Synthetic oligonucleotide
  Target: SCN9A; (-) strand; PAM type: NRG; PAM sequence: CAG
aattacttgaatccaggagg

SEQ ID NO: 24582 - DNA, 20 bp, Artificial Sequence
  Description of Artificial Sequence: Synthetic oligonucleotide
  Target: SCN9A; (-) strand; PAM type: NRG; PAM sequence: AGG
gagaattacttgaatccagg

SEQ ID NO: 24583 - DNA, 20 bp, Artificial Sequence
  Description of Artificial Sequence: Synthetic oligonucleotide
  Target: SCN9A; (-) strand; PAM type: NRG; PAM sequence: GAG
cgagaattacttgaatccag

SEQ ID NO: 24584 - DNA, 20 bp, Artificial Sequence
  Description of Artificial Sequence: Synthetic oligonucleotide
  Target: SCN9A; (-) strand; PAM type: NRG; PAM sequence: AGG
cacgagaattacttgaatcc

SEQ ID NO: 24585 - DNA, 20 bp, Artificial Sequence
  Description of Artificial Sequence: Synthetic oligonucleotide
  Target: SCN9A; (-) strand; PAM type: NRG; PAM sequence: CAG
gcacgagaattacttgaatc

SEQ ID NO: 24586 - DNA, 20 bp, Artificial Sequence
  Description of Artificial Sequence: Synthetic oligonucleotide
  Target: SCN9A; (-) strand; PAM type: NRG; PAM sequence: GAG
tacttgtgaggctgaggcac

SEQ ID NO: 24587 - DNA, 20 bp, Artificial Sequence
  Description of Artificial Sequence: Synthetic oligonucleotide
  Target: SCN9A; (-) strand; PAM type: NRG; PAM sequence: AGG
cccagctacttgtgaggctg

SEQ ID NO: 24588 - DNA, 20 bp, Artificial Sequence
  Description of Artificial Sequence: Synthetic oligonucleotide
  Target: SCN9A; (-) strand; PAM type: NRG; PAM sequence: GAG
tcccagctacttgtgaggct

SEQ ID NO: 24589 - DNA, 20 bp, Artificial Sequence
  Description of Artificial Sequence: Synthetic oligonucleotide
  Target: SCN9A; (-) strand; PAM type: NRG; PAM sequence: AGG
tataatcccagctacttgtg

SEQ ID NO: 24590 - DNA, 20 bp, Artificial Sequence
  Description of Artificial Sequence: Synthetic oligonucleotide
  Target: SCN9A; (-) strand; PAM type: NRG; PAM sequence: GAG
ctataatcccagctacttgt

SEQ ID NO: 24591 - DNA, 20 bp, Artificial Sequence
  Description of Artificial Sequence: Synthetic oligonucleotide
  Target: SCN9A; (-) strand; PAM type: NRG; PAM sequence: CAG
gtgatacatgcctataatcc

SEQ ID NO: 24592 - DNA, 20 bp, Artificial Sequence
  Description of Artificial Sequence: Synthetic oligonucleotide
  Target: SCN9A; (-) strand; PAM type: NRG; PAM sequence: TGG
aaaaaaaaattaattgatct

SEQ ID NO: 24593 - DNA, 20 bp, Artificial Sequence
  Description of Artificial Sequence: Synthetic oligonucleotide
  Target: SCN9A; (-) strand; PAM type: NRG; PAM sequence: TAG
caagaccagcctggccaacg

SEQ ID NO: 24594 - DNA, 20 bp, Artificial Sequence
  Description of Artificial Sequence: Synthetic oligonucleotide
  Target: SCN9A; (-) strand; PAM type: NRG; PAM sequence: TGG
ccaggagttcaagaccagcc

SEQ ID NO: 24595 - DNA, 20 bp, Artificial Sequence
  Description of Artificial Sequence: Synthetic oligonucleotide
  Target: SCN9A; (-) strand; PAM type: NRG; PAM sequence: CAG
tgaggccaggagttcaagac

SEQ ID NO: 24596 - DNA, 20 bp, Artificial Sequence
  Description of Artificial Sequence: Synthetic oligonucleotide
  Target: SCN9A; (-) strand; PAM type: NRG; PAM sequence: AAG
tcacttgaggccaggagttc

SEQ ID NO: 24597 - DNA, 20 bp, Artificial Sequence
  Description of Artificial Sequence: Synthetic oligonucleotide
  Target: SCN9A; (-) strand; PAM type: NRG; PAM sequence: GAG
gggcgatcacttgaggccag

SEQ ID NO: 24598 - DNA, 20 bp, Artificial Sequence
  Description of Artificial Sequence: Synthetic oligonucleotide
  Target: SCN9A; (-) strand; PAM type: NRG; PAM sequence: AGG
gtgggcgatcacttgaggcc

SEQ ID NO: 24599 - DNA, 20 bp, Artificial Sequence
  Description of Artificial Sequence: Synthetic oligonucleotide
  Target: SCN9A; (-) strand; PAM type: NRG; PAM sequence: CAG
ggtgggcgatcacttgaggc

SEQ ID NO: 24600 - DNA, 20 bp, Artificial Sequence
  Description of Artificial Sequence: Synthetic oligonucleotide
  Target: SCN9A; (-) strand; PAM type: NRG; PAM sequence: AGG
ccgaggtgggcgatcacttg

SEQ ID NO: 24601 - DNA, 20 bp, Artificial Sequence
  Description of Artificial Sequence: Synthetic oligonucleotide
  Target: SCN9A; (-) strand; PAM type: NRG; PAM sequence: GAG
gccgaggtgggcgatcactt

SEQ ID NO: 24602 - DNA, 20 bp, Artificial Sequence
  Description of Artificial Sequence: Synthetic oligonucleotide
  Target: SCN9A; (-) strand; PAM type: NRG; PAM sequence: GGG
gtactttgggaggccgaggt

SEQ ID NO: 24603 - DNA, 20 bp, Artificial Sequence
  Description of Artificial Sequence: Synthetic oligonucleotide
  Target: SCN9A; (-) strand; PAM type: NRG; PAM sequence: TGG
agtactttgggaggccgagg

SEQ ID NO: 24604 - DNA, 20 bp, Artificial Sequence
  Description of Artificial Sequence: Synthetic oligonucleotide
  Target: SCN9A; (-) strand; PAM type: NRG; PAM sequence: AGG
tccagtactttgggaggccg

SEQ ID NO: 24605 - DNA, 20 bp, Artificial Sequence
  Description of Artificial Sequence: Synthetic oligonucleotide
  Target: SCN9A; (-) strand; PAM type: NRG; PAM sequence: GAG
ttccagtactttgggaggcc

SEQ ID NO: 24606 - DNA, 20 bp, Artificial Sequence
  Description of Artificial Sequence: Synthetic oligonucleotide
  Target: SCN9A; (-) strand; PAM type: NRG; PAM sequence: AGG
tataattccagtactttggg

SEQ ID NO: 24607 - DNA, 20 bp, Artificial Sequence
  Description of Artificial Sequence: Synthetic oligonucleotide
  Target: SCN9A; (-) strand; PAM type: NRG; PAM sequence: GAG
ctataattccagtactttgg

SEQ ID NO: 24608 - DNA, 20 bp, Artificial Sequence
  Description of Artificial Sequence: Synthetic oligonucleotide
  Target: SCN9A; (-) strand; PAM type: NRG; PAM sequence: GGG
acctataattccagtacttt

SEQ ID NO: 24609 - DNA, 20 bp, Artificial Sequence
  Description of Artificial Sequence: Synthetic oligonucleotide
  Target: SCN9A; (-) strand; PAM type: NRG; PAM sequence: TGG
cacctataattccagtactt

SEQ ID NO: 24610 - DNA, 20 bp, Artificial Sequence
  Description of Artificial Sequence: Synthetic oligonucleotide
  Target: SCN9A; (-) strand; PAM type: NRG; PAM sequence: CAG
gtggctcacacctataattc

SEQ ID NO: 24611 - DNA, 20 bp, Artificial Sequence
  Description of Artificial Sequence: Synthetic oligonucleotide
  Target: SCN9A; (-) strand; PAM type: NRG; PAM sequence: TGG
aggtcagaggctgggtgaag

SEQ ID NO: 24612 - DNA, 20 bp, Artificial Sequence
  Description of Artificial Sequence: Synthetic oligonucleotide
  Target: SCN9A; (-) strand; PAM type: NRG; PAM sequence: AAG
ttaaggtcagaggctgggtg

SEQ ID NO: 24613 - DNA, 20 bp, Artificial Sequence
  Description of Artificial Sequence: Synthetic oligonucleotide
  Target: SCN9A; (-) strand; PAM type: NRG; PAM sequence: GGG
aaaagttaaggtcagaggct

SEQ ID NO: 24614 - DNA, 20 bp, Artificial Sequence
  Description of Artificial Sequence: Synthetic oligonucleotide
  Target: SCN9A; (-) strand; PAM type: NRG; PAM sequence: TGG
taaaagttaaggtcagaggc

SEQ ID NO: 24615 - DNA, 20 bp, Artificial Sequence
  Description of Artificial Sequence: Synthetic oligonucleotide
  Target: SCN9A; (-) strand; PAM type: NRG; PAM sequence: AGG
ggattaaaagttaaggtcag

SEQ ID NO: 24616 - DNA, 20 bp, Artificial Sequence
  Description of Artificial Sequence: Synthetic oligonucleotide
  Target: SCN9A; (-) strand; PAM type: NRG; PAM sequence: GAG
aggattaaaagttaaggtca

SEQ ID NO: 24617 - DNA, 20 bp, Artificial Sequence
  Description of Artificial Sequence: Synthetic oligonucleotide
  Target: SCN9A; (-) strand; PAM type: NRG; PAM sequence: CAG
agaggattaaaagttaaggt

SEQ ID NO: 24618 - DNA, 20 bp, Artificial Sequence
  Description of Artificial Sequence: Synthetic oligonucleotide
  Target: SCN9A; (-) strand; PAM type: NRG; PAM sequence: AGG
gggaagaggattaaaagtta

SEQ ID NO: 24619 - DNA, 20 bp, Artificial Sequence
  Description of Artificial Sequence: Synthetic oligonucleotide
  Target: SCN9A; (-) strand; PAM type: NRG; PAM sequence: AAG
tgggaagaggattaaaagtt

SEQ ID NO: 24620 - DNA, 20 bp, Artificial Sequence
  Description of Artificial Sequence: Synthetic oligonucleotide
  Target: SCN9A; (-) strand; PAM type: NRG; PAM sequence: AAG
aaagatgggaagaggattaa

SEQ ID NO: 24621 - DNA, 20 bp, Artificial Sequence
  Description of Artificial Sequence: Synthetic oligonucleotide
  Target: SCN9A; (-) strand; PAM type: NRG; PAM sequence: AGG
gaataatgaaagatgggaag

SEQ ID NO: 24622 - DNA, 20 bp, Artificial Sequence
  Description of Artificial Sequence: Synthetic oligonucleotide
  Target: SCN9A; (-) strand; PAM type: NRG; PAM sequence: GAG
agaataatgaaagatgggaa

SEQ ID NO: 24623 - DNA, 20 bp, Artificial Sequence
  Description of Artificial Sequence: Synthetic oligonucleotide
  Target: SCN9A; (-) strand; PAM type: NRG; PAM sequence: AAG
ggagaataatgaaagatggg

SEQ ID NO: 24624 - DNA, 20 bp, Artificial Sequence
  Description of Artificial Sequence: Synthetic oligonucleotide
  Target: SCN9A; (-) strand; PAM type: NRG; PAM sequence: GGG
gatggagaataatgaaagat

SEQ ID NO: 24625 - DNA, 20 bp, Artificial Sequence
  Description of Artificial Sequence: Synthetic oligonucleotide
  Target: SCN9A; (-) strand; PAM type: NRG; PAM sequence: TGG
agatggagaataatgaaaga

SEQ ID NO: 24626 - DNA, 20 bp, Artificial Sequence
  Description of Artificial Sequence: Synthetic oligonucleotide
  Target: SCN9A; (-) strand; PAM type: NRG; PAM sequence: AAG
aaatagatggagaataatga

SEQ ID NO: 24627 - DNA, 20 bp, Artificial Sequence
  Description of Artificial Sequence: Synthetic oligonucleotide
  Target: SCN9A; (-) strand; PAM type: NRG; PAM sequence: GAG
ccaagaggccaaaatagatg

SEQ ID NO: 24628 - DNA, 20 bp, Artificial Sequence
  Description of Artificial Sequence: Synthetic oligonucleotide
  Target: SCN9A; (-) strand; PAM type: NRG; PAM sequence: TGG
aaccaagaggccaaaataga

SEQ ID NO: 24629 - DNA, 20 bp, Artificial Sequence
  Description of Artificial Sequence: Synthetic oligonucleotide
  Target: SCN9A; (-) strand; PAM type: NRG; PAM sequence: TAG
gaaaaaccaagaggccaaaa

SEQ ID NO: 24630 - DNA, 20 bp, Artificial Sequence
  Description of Artificial Sequence: Synthetic oligonucleotide
  Target: SCN9A; (-) strand; PAM type: NRG; PAM sequence: AGG
aacatttgggaaaaaccaag

SEQ ID NO: 24631 - DNA, 20 bp, Artificial Sequence
  Description of Artificial Sequence: Synthetic oligonucleotide
  Target: SCN9A; (-) strand; PAM type: NRG; PAM sequence: GAG
taacatttgggaaaaaccaa

SEQ ID NO: 24632 - DNA, 20 bp, Artificial Sequence
  Description of Artificial Sequence: Synthetic oligonucleotide
  Target: SCN9A; (-) strand; PAM type: NRG; PAM sequence: AAG
cataacatttgggaaaaacc

SEQ ID NO: 24633 - DNA, 20 bp, Artificial Sequence
  Description of Artificial Sequence: Synthetic oligonucleotide
  Target: SCN9A; (-) strand; PAM type: NRG; PAM sequence: GGG
tgaggatatgcataacattt

SEQ ID NO: 24634 - DNA, 20 bp, Artificial Sequence
  Description of Artificial Sequence: Synthetic oligonucleotide
  Target: SCN9A; (-) strand; PAM type: NRG; PAM sequence: TGG
gtgaggatatgcataacatt

SEQ ID NO: 24635 - DNA, 20 bp, Artificial Sequence
  Description of Artificial Sequence: Synthetic oligonucleotide
  Target: SCN9A; (-) strand; PAM type: NRG; PAM sequence: AGG
aaggcacatgccccaaggtg

SEQ ID NO: 24636 - DNA, 20 bp, Artificial Sequence
  Description of Artificial Sequence: Synthetic oligonucleotide
  Target: SCN9A; (-) strand; PAM type: NRG; PAM sequence: GAG
gaaggcacatgccccaaggt

SEQ ID NO: 24637 - DNA, 20 bp, Artificial Sequence
  Description of Artificial Sequence: Synthetic oligonucleotide
  Target: SCN9A; (-) strand; PAM type: NRG; PAM sequence: AGG
taatgaaggcacatgcccca

SEQ ID NO: 24638 - DNA, 20 bp, Artificial Sequence
  Description of Artificial Sequence: Synthetic oligonucleotide
  Target: SCN9A; (-) strand; PAM type: NRG; PAM sequence: AAG
gtaatgaaggcacatgcccc

SEQ ID NO: 24639 - DNA, 20 bp, Artificial Sequence
  Description of Artificial Sequence: Synthetic oligonucleotide
  Target: SCN9A; (-) strand; PAM type: NRG; PAM sequence: AGG
tattttaggcagagtaatga

SEQ ID NO: 24640 - DNA, 20 bp, Artificial Sequence
  Description of Artificial Sequence: Synthetic oligonucleotide
  Target: SCN9A; (-) strand; PAM type: NRG; PAM sequence: AAG
gtattttaggcagagtaatg

SEQ ID NO: 24641 - DNA, 20 bp, Artificial Sequence
  Description of Artificial Sequence: Synthetic oligonucleotide
  Target: SCN9A; (-) strand; PAM type: NRG; PAM sequence: GAG
gagggaaagtattttaggca

SEQ ID NO: 24642 - DNA, 20 bp, Artificial Sequence
  Description of Artificial Sequence: Synthetic oligonucleotide
  Target: SCN9A; (-) strand; PAM type: NRG; PAM sequence: CAG
tggagggaaagtattttagg

SEQ ID NO: 24643 - DNA, 20 bp, Artificial Sequence
  Description of Artificial Sequence: Synthetic oligonucleotide
  Target: SCN9A; (-) strand; PAM type: NRG; PAM sequence: AGG
atatggagggaaagtatttt

SEQ ID NO: 24644 - DNA, 20 bp, Artificial Sequence
  Description of Artificial Sequence: Synthetic oligonucleotide
  Target: SCN9A; (-) strand; PAM type: NRG; PAM sequence: TAG
tatatggagggaaagtattt

SEQ ID NO: 24645 - DNA, 20 bp, Artificial Sequence
  Description of Artificial Sequence: Synthetic oligonucleotide
  Target: SCN9A; (-) strand; PAM type: NRG; PAM sequence: AAG
cgtgcaaatatatggaggga

SEQ ID NO: 24646 - DNA, 20 bp, Artificial Sequence
  Description of Artificial Sequence: Synthetic oligonucleotide
  Target: SCN9A; (-) strand; PAM type: NRG; PAM sequence: GGG
gggccgtgcaaatatatgga

SEQ ID NO: 24647 - DNA, 20 bp, Artificial Sequence
  Description of Artificial Sequence: Synthetic oligonucleotide
  Target: SCN9A; (-) strand; PAM type: NRG; PAM sequence: AGG
ggggccgtgcaaatatatgg

SEQ ID NO: 24648 - DNA, 20 bp, Artificial Sequence
  Description of Artificial Sequence: Synthetic oligonucleotide
  Target: SCN9A; (-) strand; PAM type: NRG; PAM sequence: GAG
gggggccgtgcaaatatatg

SEQ ID NO: 24649 - DNA, 20 bp, Artificial Sequence
  Description of Artificial Sequence: Synthetic oligonucleotide
  Target: SCN9A; (-) strand; PAM type: NRG; PAM sequence: TGG
aagggggccgtgcaaatata

SEQ ID NO: 24650 - DNA, 20 bp, Artificial Sequence
  Description of Artificial Sequence: Synthetic oligonucleotide
  Target: SCN9A; (-) strand; PAM type: NRG; PAM sequence: GGG
gatgtaaagaaaattgaagg

SEQ ID NO: 24651 - DNA, 20 bp, Artificial Sequence
  Description of Artificial Sequence: Synthetic oligonucleotide
  Target: SCN9A; (-) strand; PAM type: NRG; PAM sequence: GGG
tgatgtaaagaaaattgaag

SEQ ID NO: 24652 - DNA, 20 bp, Artificial Sequence
  Description of Artificial Sequence: Synthetic oligonucleotide
  Target: SCN9A; (-) strand; PAM type: NRG; PAM sequence: GGG
gtgatgtaaagaaaattgaa

SEQ ID NO: 24653 - DNA, 20 bp, Artificial Sequence
  Description of Artificial Sequence: Synthetic oligonucleotide
  Target: SCN9A; (-) strand; PAM type: NRG; PAM sequence: AGG
cgtgatgtaaagaaaattga

SEQ ID NO: 24654 - DNA, 20 bp, Artificial Sequence
  Description of Artificial Sequence: Synthetic oligonucleotide
  Target: SCN9A; (-) strand; PAM type: NRG; PAM sequence: AAG
ccgtgatgtaaagaaaattg

SEQ ID NO: 24655 - DNA, 20 bp, Artificial Sequence
  Description of Artificial Sequence: Synthetic oligonucleotide
  Target: SCN9A; (-) strand; PAM type: NRG; PAM sequence: AAG
ggcgtttcttccgtgatgta

SEQ ID NO: 24656 - DNA, 20 bp, Artificial Sequence
  Description of Artificial Sequence: Synthetic oligonucleotide
  Target: SCN9A; (-) strand; PAM type: NRG; PAM sequence: TGG
agaaagcctgcctataaagg

SEQ ID NO: 24657 - DNA, 20 bp, Artificial Sequence
  Description of Artificial Sequence: Synthetic oligonucleotide
  Target: SCN9A; (-) strand; PAM type: NRG; PAM sequence: AGG
cagagaaagcctgcctataa

SEQ ID NO: 24658 - DNA, 20 bp, Artificial Sequence
  Description of Artificial Sequence: Synthetic oligonucleotide
  Target: SCN9A; (-) strand; PAM type: NRG; PAM sequence: AAG
tcagagaaagcctgcctata

SEQ ID NO: 24659 - DNA, 20 bp, Artificial Sequence
  Description of Artificial Sequence: Synthetic oligonucleotide
  Target: SCN9A; (-) strand; PAM type: NRG; PAM sequence: AAG
aatgaatgattggtcagaga

SEQ ID NO: 24660 - DNA, 20 bp, Artificial Sequence
  Description of Artificial Sequence: Synthetic oligonucleotide
  Target: SCN9A; (-) strand; PAM type: NRG; PAM sequence: GAG
tatcaatgaatgattggtca

SEQ ID NO: 24661 - DNA, 20 bp, Artificial Sequence
  Description of Artificial Sequence: Synthetic oligonucleotide
  Target: SCN9A; (-) strand; PAM type: NRG; PAM sequence: CAG
gctatcaatgaatgattggt

SEQ ID NO: 24662 - DNA, 20 bp, Artificial Sequence
  Description of Artificial Sequence: Synthetic oligonucleotide
  Target: SCN9A; (-) strand; PAM type: NRG; PAM sequence: TGG
atatgctatcaatgaatgat

SEQ ID NO: 24663 - DNA, 20 bp, Artificial Sequence
  Description of Artificial Sequence: Synthetic oligonucleotide
  Target: SCN9A; (-) strand; PAM type: NRG; PAM sequence: TAG
agtgagggggaagaacttac

SEQ ID NO: 24664 - DNA, 20 bp, Artificial Sequence
  Description of Artificial Sequence: Synthetic oligonucleotide
  Target: SCN9A; (-) strand; PAM type: NRG; PAM sequence: AAG
gaataccaagagtgaggggg

SEQ ID NO: 24665 - DNA, 20 bp, Artificial Sequence
  Description of Artificial Sequence: Synthetic oligonucleotide
  Target: SCN9A; (-) strand; PAM type: NRG; PAM sequence: GGG
gaggaataccaagagtgagg

SEQ ID NO: 24666 - DNA, 20 bp, Artificial Sequence
  Description of Artificial Sequence: Synthetic oligonucleotide
  Target: SCN9A; (-) strand; PAM type: NRG; PAM sequence: GGG
agaggaataccaagagtgag

SEQ ID NO: 24667 - DNA, 20 bp, Artificial Sequence
  Description of Artificial Sequence: Synthetic oligonucleotide
  Target: SCN9A; (-) strand; PAM type: NRG; PAM sequence: GGG
aagaggaataccaagagtga

SEQ ID NO: 24668 - DNA, 20 bp, Artificial Sequence
  Description of Artificial Sequence: Synthetic oligonucleotide
  Target: SCN9A; (-) strand; PAM type: NRG; PAM sequence: AGG
aaagaggaataccaagagtg

SEQ ID NO: 24669 - DNA, 20 bp, Artificial Sequence
  Description of Artificial Sequence: Synthetic oligonucleotide
  Target: SCN9A; (-) strand; PAM type: NRG; PAM sequence: GAG
aaaagaggaataccaagagt

SEQ ID NO: 24670 - DNA, 20 bp, Artificial Sequence
  Description of Artificial Sequence: Synthetic oligonucleotide
  Target: SCN9A; (-) strand; PAM type: NRG; PAM sequence: GAG
atggaaaagaggaataccaa

SEQ ID NO: 24671 - DNA, 20 bp, Artificial Sequence
  Description of Artificial Sequence: Synthetic oligonucleotide
  Target: SCN9A; (-) strand; PAM type: NRG; PAM sequence: AAG
atatggaaaagaggaatacc

SEQ ID NO: 24672 - DNA, 20 bp, Artificial Sequence
  Description of Artificial Sequence: Synthetic oligonucleotide
  Target: SCN9A; (-) strand; PAM type: NRG; PAM sequence: AGG
ggagaaggtatatggaaaag

SEQ ID NO: 24673 - DNA, 20 bp, Artificial Sequence
  Description of Artificial Sequence: Synthetic oligonucleotide
  Target: SCN9A; (-) strand; PAM type: NRG; PAM sequence: GAG
tggagaaggtatatggaaaa

SEQ ID NO: 24674 - DNA, 20 bp, Artificial Sequence
  Description of Artificial Sequence: Synthetic oligonucleotide
  Target: SCN9A; (-) strand; PAM type: NRG; PAM sequence: AAG
tatggagaaggtatatggaa

SEQ ID NO: 24675 - DNA, 20 bp, Artificial Sequence
  Description of Artificial Sequence: Synthetic oligonucleotide
  Target: SCN9A; (-) strand; PAM type: NRG; PAM sequence: TGG
agtgctatggagaaggtata

SEQ ID NO: 24676 - DNA, 20 bp, Artificial Sequence
  Description of Artificial Sequence: Synthetic oligonucleotide
  Target: SCN9A; (-) strand; PAM type: NRG; PAM sequence: AGG
agtgaaaagtgctatggaga

SEQ ID NO: 24677 - DNA, 20 bp, Artificial Sequence
  Description of Artificial Sequence: Synthetic oligonucleotide
  Target: SCN9A; (-) strand; PAM type: NRG; PAM sequence: AAG
aagtgaaaagtgctatggag

SEQ ID NO: 24678 - DNA, 20 bp, Artificial Sequence
  Description of Artificial Sequence: Synthetic oligonucleotide
  Target: SCN9A; (-) strand; PAM type: NRG; PAM sequence: GAG
gataagtgaaaagtgctatg

SEQ ID NO: 24679 - DNA, 20 bp, Artificial Sequence
  Description of Artificial Sequence: Synthetic oligonucleotide
  Target: SCN9A; (-) strand; PAM type: NRG; PAM sequence: TGG
cagataagtgaaaagtgcta

SEQ ID NO: 24680 - DNA, 20 bp, Artificial Sequence
  Description of Artificial Sequence: Synthetic oligonucleotide
  Target: SCN9A; (-) strand; PAM type: NRG; PAM sequence: AAG
tagcaggtcagataagtgaa

SEQ ID NO: 24681 - DNA, 20 bp, Artificial Sequence
  Description of Artificial Sequence: Synthetic oligonucleotide
  Target: SCN9A; (-) strand; PAM type: NRG; PAM sequence: AAG
caagatgtagcaggtcagat

SEQ ID NO: 24682 - DNA, 20 bp, Artificial Sequence
  Description of Artificial Sequence: Synthetic oligonucleotide
  Target: SCN9A; (-) strand; PAM type: NRG; PAM sequence: CAG
catatcaagatgtagcaggt

SEQ ID NO: 24683 - DNA, 20 bp, Artificial Sequence
  Description of Artificial Sequence: Synthetic oligonucleotide
  Target: SCN9A; (-) strand; PAM type: NRG; PAM sequence: AGG
gaaacatatcaagatgtagc

SEQ ID NO: 24684 - DNA, 20 bp, Artificial Sequence
  Description of Artificial Sequence: Synthetic oligonucleotide
  Target: SCN9A; (-) strand; PAM type: NRG; PAM sequence: CAG
agaaacatatcaagatgtag

SEQ ID NO: 24685 - DNA, 20 bp, Artificial Sequence
  Description of Artificial Sequence: Synthetic oligonucleotide
  Target: SCN9A; (-) strand; PAM type: NRG; PAM sequence: TAG
tgaagaaacatatcaagatg

SEQ ID NO: 24686 - DNA, 20 bp, Artificial Sequence
  Description of Artificial Sequence: Synthetic oligonucleotide
  Target: SCN9A; (-) strand; PAM type: NRG; PAM sequence: AAG
ccttgctgaagaaacatatc

SEQ ID NO: 24687 - DNA, 20 bp, Artificial Sequence
  Description of Artificial Sequence: Synthetic oligonucleotide
  Target: SCN9A; (-) strand; PAM type: NRG; PAM sequence: AAG
caaaacaataccccttgctg

SEQ ID NO: 24688 - DNA, 20 bp, Artificial Sequence
  Description of Artificial Sequence: Synthetic oligonucleotide
  Target: SCN9A; (-) strand; PAM type: NRG; PAM sequence: GAG
ccaggcactggagggagatg

SEQ ID NO: 24689 - DNA, 20 bp, Artificial Sequence
  Description of Artificial Sequence: Synthetic oligonucleotide
  Target: SCN9A; (-) strand; PAM type: NRG; PAM sequence: TGG
ttccaggcactggagggaga

SEQ ID NO: 24690 - DNA, 20 bp, Artificial Sequence
  Description of Artificial Sequence: Synthetic oligonucleotide
  Target: SCN9A; (-) strand; PAM type: NRG; PAM sequence: GAG
ccagttccaggcactggagg

SEQ ID NO: 24691 - DNA, 20 bp, Artificial Sequence
  Description of Artificial Sequence: Synthetic oligonucleotide
  Target: SCN9A; (-) strand; PAM type: NRG; PAM sequence: GGG
gtccagttccaggcactgga

SEQ ID NO: 24692 - DNA, 20 bp, Artificial Sequence
  Description of Artificial Sequence: Synthetic oligonucleotide
  Target: SCN9A; (-) strand; PAM type: NRG; PAM sequence: AGG
ggtccagttccaggcactgg

SEQ ID NO: 24693 - DNA, 20 bp, Artificial Sequence
  Description of Artificial Sequence: Synthetic oligonucleotide
  Target: SCN9A; (-) strand; PAM type: NRG; PAM sequence: GAG
aggtccagttccaggcactg

SEQ ID NO: 24694 - DNA, 20 bp, Artificial Sequence
  Description of Artificial Sequence: Synthetic oligonucleotide
  Target: SCN9A; (-) strand; PAM type: NRG; PAM sequence: TGG
ccaggtccagttccaggcac

SEQ ID NO: 24695 - DNA, 20 bp, Artificial Sequence
  Description of Artificial Sequence: Synthetic oligonucleotide
  Target: SCN9A; (-) strand; PAM type: NRG; PAM sequence: AGG
tgtgtgccaggtccagttcc

SEQ ID NO: 24696 - DNA, 20 bp, Artificial Sequence
  Description of Artificial Sequence: Synthetic oligonucleotide
  Target: SCN9A; (-) strand; PAM type: NRG; PAM sequence: CAG
ctgtgtgccaggtccagttc

SEQ ID NO: 24697 - DNA, 20 bp, Artificial Sequence
  Description of Artificial Sequence: Synthetic oligonucleotide
  Target: SCN9A; (-) strand; PAM type: NRG; PAM sequence: CAG
aaatacctgtgtgccaggtc

SEQ ID NO: 24698 - DNA, 20 bp, Artificial Sequence
  Description of Artificial Sequence: Synthetic oligonucleotide
  Target: SCN9A; (-) strand; PAM type: NRG; PAM sequence: AGG
ttattaaatacctgtgtgcc

SEQ ID NO: 24699 - DNA, 20 bp, Artificial Sequence
  Description of Artificial Sequence: Synthetic oligonucleotide
  Target: SCN9A; (-) strand; PAM type: NRG; PAM sequence: CAG
attattaaatacctgtgtgc

SEQ ID NO: 24700 - DNA, 20 bp, Artificial Sequence
  Description of Artificial Sequence: Synthetic oligonucleotide
  Target: SCN9A; (-) strand; PAM type: NRG; PAM sequence: CAG
cacataatcattctttattc

SEQ ID NO: 24701 - DNA, 20 bp, Artificial Sequence
  Description of Artificial Sequence: Synthetic oligonucleotide
  Target: SCN9A; (-) strand; PAM type: NRG; PAM sequence: TAG
agtgaagcagccaatttgct

SEQ ID NO: 24702 - DNA, 20 bp, Artificial Sequence
  Description of Artificial Sequence: Synthetic oligonucleotide
  Target: SCN9A; (-) strand; PAM type: NRG; PAM sequence: CAG
gcctaataaattcagtgaag

SEQ ID NO: 24703 - DNA, 20 bp, Artificial Sequence
  Description of Artificial Sequence: Synthetic oligonucleotide
  Target: SCN9A; (-) strand; PAM type: NRG; PAM sequence: AAG
gtagcctaataaattcagtg

SEQ ID NO: 24704 - DNA, 20 bp, Artificial Sequence
  Description of Artificial Sequence: Synthetic oligonucleotide
  Target: SCN9A; (-) strand; PAM type: NRG; PAM sequence: CAG
gatctgtagcctaataaatt

SEQ ID NO: 24705 - DNA, 20 bp, Artificial Sequence
  Description of Artificial Sequence: Synthetic oligonucleotide
  Target: SCN9A; (-) strand; PAM type: NRG; PAM sequence: TAG
tcatacagtctctggatctg

SEQ ID NO: 24706 - DNA, 20 bp, Artificial Sequence
  Description of Artificial Sequence: Synthetic oligonucleotide
  Target: SCN9A; (-) strand; PAM type: NRG; PAM sequence: TGG
cagagacttcatacagtctc

SEQ ID NO: 24707 - DNA, 20 bp, Artificial Sequence
  Description of Artificial Sequence: Synthetic oligonucleotide
  Target: SCN9A; (-) strand; PAM type: NRG; PAM sequence: CAG
gctccagcagagacttcata

SEQ ID NO: 24708 - DNA, 20 bp, Artificial Sequence
  Description of Artificial Sequence: Synthetic oligonucleotide
  Target: SCN9A; (-) strand; PAM type: NRG; PAM sequence: GAG
cccttttatgtgctccagca

SEQ ID NO: 24709 - DNA, 20 bp, Artificial Sequence
  Description of Artificial Sequence: Synthetic oligonucleotide
  Target: SCN9A; (-) strand; PAM type: NRG; PAM sequence: CAG
atcccttttatgtgctccag

SEQ ID NO: 24710 - DNA, 20 bp, Artificial Sequence
  Description of Artificial Sequence: Synthetic oligonucleotide
  Target: SCN9A; (-) strand; PAM type: NRG; PAM sequence: CAG
cacatcccttttatgtgctc

SEQ ID NO: 24711 - DNA, 20 bp, Artificial Sequence
  Description of Artificial Sequence: Synthetic oligonucleotide
  Target: SCN9A; (-) strand; PAM type: NRG; PAM sequence: GAG
ctgagggagcatatatctct

SEQ ID NO: 24712 - DNA, 20 bp, Artificial Sequence
  Description of Artificial Sequence: Synthetic oligonucleotide
  Target: SCN9A; (-) strand; PAM type: NRG; PAM sequence: GAG
accattgaaatttactgagg

SEQ ID NO: 24713 - DNA, 20 bp, Artificial Sequence
  Description of Artificial Sequence: Synthetic oligonucleotide
  Target: SCN9A; (-) strand; PAM type: NRG; PAM sequence: GGG
ggaccattgaaatttactga

SEQ ID NO: 24714 - DNA, 20 bp, Artificial Sequence
  Description of Artificial Sequence: Synthetic oligonucleotide
  Target: SCN9A; (-) strand; PAM type: NRG; PAM sequence: AGG
tggaccattgaaatttactg

SEQ ID NO: 24715 - DNA, 20 bp, Artificial Sequence
  Description of Artificial Sequence: Synthetic oligonucleotide
  Target: SCN9A; (-) strand; PAM type: NRG; PAM sequence: GAG
ttggaccattgaaatttact

SEQ ID NO: 24716 - DNA, 20 bp, Artificial Sequence
  Description of Artificial Sequence: Synthetic oligonucleotide
  Target: SCN9A; (-) strand; PAM type: NRG; PAM sequence: TGG
ttttccaatgaacctgggct

SEQ ID NO: 24717 - DNA, 20 bp, Artificial Sequence
  Description of Artificial Sequence: Synthetic oligonucleotide
  Target: SCN9A; (-) strand; PAM type: NRG; PAM sequence: GGG
acacattttccaatgaacct

SEQ ID NO: 24718 - DNA, 20 bp, Artificial Sequence
  Description of Artificial Sequence: Synthetic oligonucleotide
  Target: SCN9A; (-) strand; PAM type: NRG; PAM sequence: TGG
aacacattttccaatgaacc

SEQ ID NO: 24719 - DNA, 20 bp, Artificial Sequence
  Description of Artificial Sequence: Synthetic oligonucleotide
  Target: SCN9A; (-) strand; PAM type: NRG; PAM sequence: TGG
ccagtatagaagaaatatta

SEQ ID NO: 24720 - DNA, 20 bp, Artificial Sequence
  Description of Artificial Sequence: Synthetic oligonucleotide
  Target: SCN9A; (-) strand; PAM type: NRG; PAM sequence: AAG
ccaaactgaggccagtatag

SEQ ID NO: 24721 - DNA, 20 bp, Artificial Sequence
  Description of Artificial Sequence: Synthetic oligonucleotide
  Target: SCN9A; (-) strand; PAM type: NRG; PAM sequence: TAG
cttccaaactgaggccagta

SEQ ID NO: 24722 - DNA, 20 bp, Artificial Sequence
  Description of Artificial Sequence: Synthetic oligonucleotide
  Target: SCN9A; (-) strand; PAM type: NRG; PAM sequence: CAG
cattgcttccaaactgaggc

SEQ ID NO: 24723 - DNA, 20 bp, Artificial Sequence
  Description of Artificial Sequence: Synthetic oligonucleotide
  Target: SCN9A; (-) strand; PAM type: NRG; PAM sequence: AGG
tattcattgcttccaaactg

SEQ ID NO: 24724 - DNA, 20 bp, Artificial Sequence
  Description of Artificial Sequence: Synthetic oligonucleotide
  Target: SCN9A; (-) strand; PAM type: NRG; PAM sequence: GAG
ttattcattgcttccaaact

SEQ ID NO: 24725 - DNA, 20 bp, Artificial Sequence
  Description of Artificial Sequence: Synthetic oligonucleotide
  Target: SCN9A; (-) strand; PAM type: NRG; PAM sequence: GAG
aatacttttgtgaatactct

SEQ ID NO: 24726 - DNA, 20 bp, Artificial Sequence
  Description of Artificial Sequence: Synthetic oligonucleotide
  Target: SCN9A; (-) strand; PAM type: NRG; PAM sequence: AAG
ttataataagatataataca

SEQ ID NO: 24727 - DNA, 20 bp, Artificial Sequence
  Description of Artificial Sequence: Synthetic oligonucleotide
  Target: SCN9A; (-) strand; PAM type: NRG; PAM sequence: AAG
actgtaggtgctgttataat

SEQ ID NO: 24728 - DNA, 20 bp, Artificial Sequence
  Description of Artificial Sequence: Synthetic oligonucleotide
  Target: SCN9A; (-) strand; PAM type: NRG; PAM sequence: AGG
actatgctatttcagactgt

SEQ ID NO: 24729 - DNA, 20 bp, Artificial Sequence
  Description of Artificial Sequence: Synthetic oligonucleotide
  Target: SCN9A; (-) strand; PAM type: NRG; PAM sequence: TAG
tactatgctatttcagactg

SEQ ID NO: 24730 - DNA, 20 bp, Artificial Sequence
  Description of Artificial Sequence: Synthetic oligonucleotide
  Target: SCN9A; (-) strand; PAM type: NRG; PAM sequence: CAG
gtattaatactatgctattt

SEQ ID NO: 24731 - DNA, 20 bp, Artificial Sequence
  Description of Artificial Sequence: Synthetic oligonucleotide
  Target: SCN9A; (-) strand; PAM type: NRG; PAM sequence: AAG
aaaacttaaactcttacaga

SEQ ID NO: 24732 - DNA, 20 bp, Artificial Sequence
  Description of Artificial Sequence: Synthetic oligonucleotide
  Target: SCN9A; (-) strand; PAM type: NRG; PAM sequence: CAG
tcaaaaaacttaaactctta

SEQ ID NO: 24733 - DNA, 20 bp, Artificial Sequence
  Description of Artificial Sequence: Synthetic oligonucleotide
  Target: SCN9A; (-) strand; PAM type: NRG; PAM sequence: AAG
tgggcttatcaatcaactta

SEQ ID NO: 24734 - DNA, 20 bp, Artificial Sequence
  Description of Artificial Sequence: Synthetic oligonucleotide
  Target: SCN9A; (-) strand; PAM type: NRG; PAM sequence: GGG
aggataactagaaagaagtt

SEQ ID NO: 24735 - DNA, 20 bp, Artificial Sequence
  Description of Artificial Sequence: Synthetic oligonucleotide
  Target: SCN9A; (-) strand; PAM type: NRG; PAM sequence: TGG
taggataactagaaagaagt

SEQ ID NO: 24736 - DNA, 20 bp, Artificial Sequence
  Description of Artificial Sequence: Synthetic oligonucleotide
  Target: SCN9A; (-) strand; PAM type: NRG; PAM sequence: AAG
attctaggataactagaaag

SEQ ID NO: 24737 - DNA, 20 bp, Artificial Sequence
  Description of Artificial Sequence: Synthetic oligonucleotide
  Target: SCN9A; (-) strand; PAM type: NRG; PAM sequence: AAG
aaaattctaggataactaga

SEQ ID NO: 24738 - DNA, 20 bp, Artificial Sequence
  Description of Artificial Sequence: Synthetic oligonucleotide
  Target: SCN9A; (-) strand; PAM type: NRG; PAM sequence: TAG
acttaaaattctaggataac

SEQ ID NO: 24739 - DNA, 20 bp, Artificial Sequence
  Description of Artificial Sequence: Synthetic oligonucleotide
  Target: SCN9A; (-) strand; PAM type: NRG; PAM sequence: AGG
tgatcatgacttaaaattct

SEQ ID NO: 24740 - DNA, 20 bp, Artificial Sequence
  Description of Artificial Sequence: Synthetic oligonucleotide
  Target: SCN9A; (-) strand; PAM type: NRG; PAM sequence: TAG
atgatcatgacttaaaattc

SEQ ID NO: 24741 - DNA, 20 bp, Artificial Sequence
  Description of Artificial Sequence: Synthetic oligonucleotide
  Target: SCN9A; (-) strand; PAM type: NRG; PAM sequence: AAG
aaatttgtattgatgctacc

SEQ ID NO: 24742 - DNA, 20 bp, Artificial Sequence
  Description of Artificial Sequence: Synthetic oligonucleotide
  Target: SCN9A; (-) strand; PAM type: NRG; PAM sequence: TAG
agaaatttattagcagtata

SEQ ID NO: 24743 - DNA, 20 bp, Artificial Sequence
  Description of Artificial Sequence: Synthetic oligonucleotide
  Target: SCN9A; (-) strand; PAM type: NRG; PAM sequence: CAG
ctcctcaagaaatttattag

SEQ ID NO: 24744 - DNA, 20 bp, Artificial Sequence
  Description of Artificial Sequence: Synthetic oligonucleotide
  Target: SCN9A; (-) strand; PAM type: NRG; PAM sequence: TAG
ctgctcctcaagaaatttat

SEQ ID NO: 24745 - DNA, 20 bp, Artificial Sequence
  Description of Artificial Sequence: Synthetic oligonucleotide
  Target: SCN9A; (-) strand; PAM type: NRG; PAM sequence: AAG
acatgtatggcctgctcctc

SEQ ID NO: 24746 - DNA, 20 bp, Artificial Sequence
  Description of Artificial Sequence: Synthetic oligonucleotide
  Target: SCN9A; (-) strand; PAM type: NRG; PAM sequence: TGG
aagaatttcatcaacatgta

SEQ ID NO: 24747 - DNA, 20 bp, Artificial Sequence
  Description of Artificial Sequence: Synthetic oligonucleotide
  Target: SCN9A; (-) strand; PAM type: NRG; PAM sequence: AAG
tgtccatgttacagagattt

SEQ ID NO: 24748 - DNA, 20 bp, Artificial Sequence
  Description of Artificial Sequence: Synthetic oligonucleotide
  Target: SCN9A; (-) strand; PAM type: NRG; PAM sequence: GAG
ttaaaagtgtccatgttaca

SEQ ID NO: 24749 - DNA, 20 bp, Artificial Sequence
  Description of Artificial Sequence: Synthetic oligonucleotide
  Target: SCN9A; (-) strand; PAM type: NRG; PAM sequence: CAG
ctttaaaagtgtccatgtta

SEQ ID NO: 24750 - DNA, 20 bp, Artificial Sequence
  Description of Artificial Sequence: Synthetic oligonucleotide
  Target: SCN9A; (-) strand; PAM type: NRG; PAM sequence: AAG
aaatgcacagtttcctttaa

SEQ ID NO: 24751 - DNA, 20 bp, Artificial Sequence
  Description of Artificial Sequence: Synthetic oligonucleotide
  Target: SCN9A; (-) strand; PAM type: NRG; PAM sequence: CAG
tagtgctataagcaaatgca

SEQ ID NO: 24752 - DNA, 20 bp, Artificial Sequence
  Description of Artificial Sequence: Synthetic oligonucleotide
  Target: SCN9A; (-) strand; PAM type: NRG; PAM sequence: AAG
cttgctgaaattagtgctat

SEQ ID NO: 24753 - DNA, 20 bp, Artificial Sequence
  Description of Artificial Sequence: Synthetic oligonucleotide
  Target: SCN9A; (-) strand; PAM type: NRG; PAM sequence: TAG
aattttgtgcttgctgaaat

SEQ ID NO: 24754 - DNA, 20 bp, Artificial Sequence
  Description of Artificial Sequence: Synthetic oligonucleotide
  Target: SCN9A; (-) strand; PAM type: NRG; PAM sequence: CAG
aagcaaaggtgtacgacatc

SEQ ID NO: 24755 - DNA, 20 bp, Artificial Sequence
  Description of Artificial Sequence: Synthetic oligonucleotide
  Target: SCN9A; (-) strand; PAM type: NRG; PAM sequence: AGG
tcattttatgtaagaagcaa

SEQ ID NO: 24756 - DNA, 20 bp, Artificial Sequence
  Description of Artificial Sequence: Synthetic oligonucleotide
  Target: SCN9A; (-) strand; PAM type: NRG; PAM sequence: AAG
atcattttatgtaagaagca

SEQ ID NO: 24757 - DNA, 20 bp, Artificial Sequence
  Description of Artificial Sequence: Synthetic oligonucleotide
  Target: SCN9A; (-) strand; PAM type: NRG; PAM sequence: AAG
caaatatcattttatgtaag

SEQ ID NO: 24758 - DNA, 20 bp, Artificial Sequence
  Description of Artificial Sequence: Synthetic oligonucleotide
  Target: SCN9A; (-) strand; PAM type: NRG; PAM sequence: AAG
caccaaatatcattttatgt

SEQ ID NO: 24759 - DNA, 20 bp, Artificial Sequence
  Description of Artificial Sequence: Synthetic oligonucleotide
  Target: SCN9A; (-) strand; PAM type: NRG; PAM sequence: TGG
agcaaactacaaagagtgca

SEQ ID NO: 24760 - DNA, 20 bp, Artificial Sequence
  Description of Artificial Sequence: Synthetic oligonucleotide
  Target: SCN9A; (-) strand; PAM type: NRG; PAM sequence: GAG
agacatcagcaaactacaaa

SEQ ID NO: 24761 - DNA, 20 bp, Artificial Sequence
  Description of Artificial Sequence: Synthetic oligonucleotide
  Target: SCN9A; (-) strand; PAM type: NRG; PAM sequence: AAG
aaagacatcagcaaactaca

SEQ ID NO: 24762 - DNA, 20 bp, Artificial Sequence
  Description of Artificial Sequence: Synthetic oligonucleotide
  Target: SCN9A; (-) strand; PAM type: NRG; PAM sequence: CAG
tgattggaaaataaagacat

SEQ ID NO: 24763 - DNA, 20 bp, Artificial Sequence
  Description of Artificial Sequence: Synthetic oligonucleotide
  Target: SCN9A; (-) strand; PAM type: NRG; PAM sequence: AAG
agcaaaatgattggaaaata

SEQ ID NO: 24764 - DNA, 20 bp, Artificial Sequence
  Description of Artificial Sequence: Synthetic oligonucleotide
  Target: SCN9A; (-) strand; PAM type: NRG; PAM sequence: TGG
catgggttaagcaaaatgat

SEQ ID NO: 24765 - DNA, 20 bp, Artificial Sequence
  Description of Artificial Sequence: Synthetic oligonucleotide
  Target: SCN9A; (-) strand; PAM type: NRG; PAM sequence: AAG
tcttataacattcatgggtt

SEQ ID NO: 24766 - DNA, 20 bp, Artificial Sequence
  Description of Artificial Sequence: Synthetic oligonucleotide
  Target: SCN9A; (-) strand; PAM type: NRG; PAM sequence: GGG
tggtttcttataacattcat

SEQ ID NO: 24767 - DNA, 20 bp, Artificial Sequence
  Description of Artificial Sequence: Synthetic oligonucleotide
  Target: SCN9A; (-) strand; PAM type: NRG; PAM sequence: TGG
ctggtttcttataacattca

SEQ ID NO: 24768 - DNA, 20 bp, Artificial Sequence
  Description of Artificial Sequence: Synthetic oligonucleotide
  Target: SCN9A; (-) strand; PAM type: NRG; PAM sequence: TGG
gtgtccaagattttctcaac

SEQ ID NO: 24769 - DNA, 20 bp, Artificial Sequence
  Description of Artificial Sequence: Synthetic oligonucleotide
  Target: SCN9A; (-) strand; PAM type: NRG; PAM sequence: AAG
tcgacttgctttcagtgtcc

SEQ ID NO: 24770 - DNA, 20 bp, Artificial Sequence
  Description of Artificial Sequence: Synthetic oligonucleotide
  Target: SCN9A; (-) strand; PAM type: NRG; PAM sequence: CAG
aaaaatcatcgacttgcttt

SEQ ID NO: 24771 - DNA, 20 bp, Artificial Sequence
  Description of Artificial Sequence: Synthetic oligonucleotide
  Target: SCN9A; (-) strand; PAM type: NRG; PAM sequence: TAG
catgggcttaccctcagcat

SEQ ID NO: 24772 - DNA, 20 bp, Artificial Sequence
  Description of Artificial Sequence: Synthetic oligonucleotide
  Target: SCN9A; (-) strand; PAM type: NRG; PAM sequence: CAG
tctagtcatgggcttaccct

SEQ ID NO: 24773 - DNA, 20 bp, Artificial Sequence
  Description of Artificial Sequence: Synthetic oligonucleotide
  Target: SCN9A; (-) strand; PAM type: NRG; PAM sequence: GGG
ctaatgacttatctagtcat

SEQ ID NO: 24774 - DNA, 20 bp, Artificial Sequence
  Description of Artificial Sequence: Synthetic oligonucleotide
  Target: SCN9A; (-) strand; PAM type: NRG; PAM sequence: TGG
gctaatgacttatctagtca

SEQ ID NO: 24775 - DNA, 20 bp, Artificial Sequence
  Description of Artificial Sequence: Synthetic oligonucleotide
  Target: SCN9A; (-) strand; PAM type: NRG; PAM sequence: TAG
acagatgctaatgacttatc

SEQ ID NO: 24776 - DNA, 20 bp, Artificial Sequence
  Description of Artificial Sequence: Synthetic oligonucleotide
  Target: SCN9A; (-) strand; PAM type: NRG; PAM sequence: CAG
atacagaagttatgatagca

SEQ ID NO: 24777 - DNA, 20 bp, Artificial Sequence
  Description of Artificial Sequence: Synthetic oligonucleotide
  Target: SCN9A; (-) strand; PAM type: NRG; PAM sequence: TAG
atcttatacagaagttatga

SEQ ID NO: 24778 - DNA, 20 bp, Artificial Sequence
  Description of Artificial Sequence: Synthetic oligonucleotide
  Target: SCN9A; (-) strand; PAM type: NRG; PAM sequence: AAG
ctgttaacaatcttatacag

SEQ ID NO: 24779 - DNA, 20 bp, Artificial Sequence
  Description of Artificial Sequence: Synthetic oligonucleotide
  Target: SCN9A; (-) strand; PAM type: NRG; PAM sequence: CAG
attctgttaacaatcttata

SEQ ID NO: 24780 - DNA, 20 bp, Artificial Sequence
  Description of Artificial Sequence: Synthetic oligonucleotide
  Target: SCN9A; (-) strand; PAM type: NRG; PAM sequence: AGG
tctacttttcttattcttca

SEQ ID NO: 24781 - DNA, 20 bp, Artificial Sequence
  Description of Artificial Sequence: Synthetic oligonucleotide
  Target: SCN9A; (-) strand; PAM type: NRG; PAM sequence: AAG
ttctacttttcttattcttc

SEQ ID NO: 24782 - DNA, 20 bp, Artificial Sequence
  Description of Artificial Sequence: Synthetic oligonucleotide
  Target: SCN9A; (-) strand; PAM type: NRG; PAM sequence: CAG
tgattataaacttactagca

SEQ ID NO: 24783 - DNA, 20 bp, Artificial Sequence
  Description of Artificial Sequence: Synthetic oligonucleotide
  Target: SCN9A; (-) strand; PAM type: NRG; PAM sequence: TAG
gataatgattataaacttac

SEQ ID NO: 24784 - DNA, 20 bp, Artificial Sequence
  Description of Artificial Sequence: Synthetic oligonucleotide
  Target: SCN9A; (-) strand; PAM type: NRG; PAM sequence: AAG
cgatgctaagaggatcaaat

SEQ ID NO: 24785 - DNA, 20 bp, Artificial Sequence
  Description of Artificial Sequence: Synthetic oligonucleotide
  Target: SCN9A; (-) strand; PAM type: NRG; PAM sequence: AGG
cacatcacagcgatgctaag

SEQ ID NO: 24786 - DNA, 20 bp, Artificial Sequence
  Description of Artificial Sequence: Synthetic oligonucleotide
  Target: SCN9A; (-) strand; PAM type: NRG; PAM sequence: GAG
ccacatcacagcgatgctaa

SEQ ID NO: 24787 - DNA, 20 bp, Artificial Sequence
  Description of Artificial Sequence: Synthetic oligonucleotide
  Target: SCN9A; (-) strand; PAM type: NRG; PAM sequence: AAG
atccacatcacagcgatgct

SEQ ID NO: 24788 - DNA, 20 bp, Artificial Sequence
  Description of Artificial Sequence: Synthetic oligonucleotide
  Target: SCN9A; (-) strand; PAM type: NRG; PAM sequence: CAG
ggatatcagcatccacatca

SEQ ID NO: 24789 - DNA, 20 bp, Artificial Sequence
  Description of Artificial Sequence: Synthetic oligonucleotide
  Target: SCN9A; (-) strand; PAM type: NRG; PAM sequence: CAG
catctgtaaaatggggatat

SEQ ID NO: 24790 - DNA, 20 bp, Artificial Sequence
  Description of Artificial Sequence: Synthetic oligonucleotide
  Target: SCN9A; (-) strand; PAM type: NRG; PAM sequence: GGG
gatatctcatctgtaaaatg

SEQ ID NO: 24791 - DNA, 20 bp, Artificial Sequence
  Description of Artificial Sequence: Synthetic oligonucleotide
  Target: SCN9A; (-) strand; PAM type: NRG; PAM sequence: GGG
agatatctcatctgtaaaat

SEQ ID NO: 24792 - DNA, 20 bp, Artificial Sequence
  Description of Artificial Sequence: Synthetic oligonucleotide
  Target: SCN9A; (-) strand; PAM type: NRG; PAM sequence: TGG
cagatatctcatctgtaaaa

SEQ ID NO: 24793 - DNA, 20 bp, Artificial Sequence
  Description of Artificial Sequence: Synthetic oligonucleotide
  Target: SCN9A; (-) strand; PAM type: NRG; PAM sequence: CAG
caatttaaaatcttgttctt

SEQ ID NO: 24794 - DNA, 20 bp, Artificial Sequence
  Description of Artificial Sequence: Synthetic oligonucleotide
  Target: SCN9A; (-) strand; PAM type: NRG; PAM sequence: GAG
ttgccgacttatctgcctgt

SEQ ID NO: 24795 - DNA, 20 bp, Artificial Sequence
  Description of Artificial Sequence: Synthetic oligonucleotide
  Target: SCN9A; (-) strand; PAM type: NRG; PAM sequence: GAG
aatacaaagttcaaactttg

SEQ ID NO: 24796 - DNA, 20 bp, Artificial Sequence
  Description of Artificial Sequence: Synthetic oligonucleotide
  Target: SCN9A; (-) strand; PAM type: NRG; PAM sequence: TGG
gtaatacaaagttcaaactt

SEQ ID NO: 24797 - DNA, 20 bp, Artificial Sequence
  Description of Artificial Sequence: Synthetic oligonucleotide
  Target: SCN9A; (-) strand; PAM type: NRG; PAM sequence: AAG
caatgtaatacagtaataca

SEQ ID NO: 24798 - DNA, 20 bp, Artificial Sequence
  Description of Artificial Sequence: Synthetic oligonucleotide
  Target: SCN9A; (-) strand; PAM type: NRG; PAM sequence: CAG
agtagggctgcaatgtaata

SEQ ID NO: 24799 - DNA, 20 bp, Artificial Sequence
  Description of Artificial Sequence: Synthetic oligonucleotide
  Target: SCN9A; (-) strand; PAM type: NRG; PAM sequence: GGG
aaaaatacaagcccagagta

SEQ ID NO: 24800 - DNA, 20 bp, Artificial Sequence
  Description of Artificial Sequence: Synthetic oligonucleotide
  Target: SCN9A; (-) strand; PAM type: NRG; PAM sequence: AGG
taaaaatacaagcccagagt

SEQ ID NO: 24801 - DNA, 20 bp, Artificial Sequence
  Description of Artificial Sequence: Synthetic oligonucleotide
  Target: SCN9A; (-) strand; PAM type: NRG; PAM sequence: TAG
gtaaaaatacaagcccagag

SEQ ID NO: 24802 - DNA, 20 bp, Artificial Sequence
  Description of Artificial Sequence: Synthetic oligonucleotide
  Target: SCN9A; (-) strand; PAM type: NRG; PAM sequence: GAG
taggtaaaaatacaagccca

SEQ ID NO: 24803 - DNA, 20 bp, Artificial Sequence
  Description of Artificial Sequence: Synthetic oligonucleotide
  Target: SCN9A; (-) strand; PAM type: NRG; PAM sequence: CAG
tctaggtaaaaatacaagcc

SEQ ID NO: 24804 - DNA, 20 bp, Artificial Sequence
  Description of Artificial Sequence: Synthetic oligonucleotide
  Target: SCN9A; (-) strand; PAM type: NRG; PAM sequence: AAG
tatcatctaggtaaaaatac

SEQ ID NO: 24805 - DNA, 20 bp, Artificial Sequence
  Description of Artificial Sequence: Synthetic oligonucleotide
  Target: SCN9A; (-) strand; PAM type: NRG; PAM sequence: AGG
gaacaagtattgtatcatct

SEQ ID NO: 24806 - DNA, 20 bp, Artificial Sequence
  Description of Artificial Sequence: Synthetic oligonucleotide
  Target: SCN9A; (-) strand; PAM type: NRG; PAM sequence: TAG
tgaacaagtattgtatcatc

SEQ ID NO: 24807 - DNA, 20 bp, Artificial Sequence
  Description of Artificial Sequence: Synthetic oligonucleotide
  Target: SCN9A; (-) strand; PAM type: NRG; PAM sequence: AAG
taatgcagtattgtctgaac

SEQ ID NO: 24808 - DNA, 20 bp, Artificial Sequence
  Description of Artificial Sequence: Synthetic oligonucleotide
  Target: SCN9A; (-) strand; PAM type: NRG; PAM sequence: CAG
ggaatttgtcagggataatg

SEQ ID NO: 24809 - DNA, 20 bp, Artificial Sequence
  Description of Artificial Sequence: Synthetic oligonucleotide
  Target: SCN9A; (-) strand; PAM type: NRG; PAM sequence: GGG
actacttctggaatttgtca

SEQ ID NO: 24810 - DNA, 20 bp, Artificial Sequence
  Description of Artificial Sequence: Synthetic oligonucleotide
  Target: SCN9A; (-) strand; PAM type: NRG; PAM sequence: AGG
tactacttctggaatttgtc

SEQ ID NO: 24811 - DNA, 20 bp, Artificial Sequence
  Description of Artificial Sequence: Synthetic oligonucleotide
  Target: SCN9A; (-) strand; PAM type: NRG; PAM sequence: CAG
ttactacttctggaatttgt

SEQ ID NO: 24812 - DNA, 20 bp, Artificial Sequence
  Description of Artificial Sequence: Synthetic oligonucleotide
  Target: SCN9A; (-) strand; PAM type: NRG; PAM sequence: TGG
gctgaatttcttactacttc

SEQ ID NO: 24813 - DNA, 20 bp, Artificial Sequence
  Description of Artificial Sequence: Synthetic oligonucleotide
  Target: SCN9A; (-) strand; PAM type: NRG; PAM sequence: CAG
cttagtctcttgttttgtaa

SEQ ID NO: 24814 - DNA, 20 bp, Artificial Sequence
  Description of Artificial Sequence: Synthetic oligonucleotide
  Target: SCN9A; (-) strand; PAM type: NRG; PAM sequence: TAG
aagttctttacatttggcct

SEQ ID NO: 24815 - DNA, 20 bp, Artificial Sequence
  Description of Artificial Sequence: Synthetic oligonucleotide
  Target: SCN9A; (-) strand; PAM type: NRG; PAM sequence: TGG
catgtaaagttctttacatt

SEQ ID NO: 24816 - DNA, 20 bp, Artificial Sequence
  Description of Artificial Sequence: Synthetic oligonucleotide
  Target: SCN9A; (-) strand; PAM type: NRG; PAM sequence: AAG
agtccttaacttgacatgta

SEQ ID NO: 24817 - DNA, 20 bp, Artificial Sequence
  Description of Artificial Sequence: Synthetic oligonucleotide
  Target: SCN9A; (-) strand; PAM type: NRG; PAM sequence: AAG
ggcctctagggtaaagtctg

SEQ ID NO: 24818 - DNA, 20 bp, Artificial Sequence
  Description of Artificial Sequence: Synthetic oligonucleotide
  Target: SCN9A; (-) strand; PAM type: NRG; PAM sequence: AAG
aatccttggcctctagggta

SEQ ID NO: 24819 - DNA, 20 bp, Artificial Sequence
  Description of Artificial Sequence: Synthetic oligonucleotide
  Target: SCN9A; (-) strand; PAM type: NRG; PAM sequence: GGG
gtgagaatccttggcctcta

SEQ ID NO: 24820 - DNA, 20 bp, Artificial Sequence
  Description of Artificial Sequence: Synthetic oligonucleotide
  Target: SCN9A; (-) strand; PAM type: NRG; PAM sequence: AGG
tgtgagaatccttggcctct

SEQ ID NO: 24821 - DNA, 20 bp, Artificial Sequence
  Description of Artificial Sequence: Synthetic oligonucleotide
  Target: SCN9A; (-) strand; PAM type: NRG; PAM sequence: TAG
atgtgagaatccttggcctc

SEQ ID NO: 24822 - DNA, 20 bp, Artificial Sequence
  Description of Artificial Sequence: Synthetic oligonucleotide
  Target: SCN9A; (-) strand; PAM type: NRG; PAM sequence: TGG
cactaaaatgtgagaatcct

SEQ ID NO: 24823 - DNA, 20 bp, Artificial Sequence
  Description of Artificial Sequence: Synthetic oligonucleotide
  Target: SCN9A; (-) strand; PAM type: NRG; PAM sequence: GAG
ttgcatgcacactaaaatgt

SEQ ID NO: 24824 - DNA, 20 bp, Artificial Sequence
  Description of Artificial Sequence: Synthetic oligonucleotide
  Target: SCN9A; (-) strand; PAM type: NRG; PAM sequence: AGG
atagggcccaagcccttaag

SEQ ID NO: 24825 - DNA, 20 bp, Artificial Sequence
  Description of Artificial Sequence: Synthetic oligonucleotide
  Target: SCN9A; (-) strand; PAM type: NRG; PAM sequence: GAG
gatagggcccaagcccttaa

SEQ ID NO: 24826 - DNA, 20 bp, Artificial Sequence
  Description of Artificial Sequence: Synthetic oligonucleotide
  Target: SCN9A; (-) strand; PAM type: NRG; PAM sequence: AAG
gagatagggcccaagccctt

SEQ ID NO: 24827 - DNA, 20 bp, Artificial Sequence
  Description of Artificial Sequence: Synthetic oligonucleotide
  Target: SCN9A; (-) strand; PAM type: NRG; PAM sequence: AAG
gaactctggagatagggccc

SEQ ID NO: 24828 - DNA, 20 bp, Artificial Sequence
  Description of Artificial Sequence: Synthetic oligonucleotide
  Target: SCN9A; (-) strand; PAM type: NRG; PAM sequence: GGG
catcaggaactctggagata

SEQ ID NO: 24829 - DNA, 20 bp, Artificial Sequence
  Description of Artificial Sequence: Synthetic oligonucleotide
  Target: SCN9A; (-) strand; PAM type: NRG; PAM sequence: AGG
tcatcaggaactctggagat

SEQ ID NO: 24830 - DNA, 20 bp, Artificial Sequence
  Description of Artificial Sequence: Synthetic oligonucleotide
  Target: SCN9A; (-) strand; PAM type: NRG; PAM sequence: TAG
ttcatcaggaactctggaga

SEQ ID NO: 24831 - DNA, 20 bp, Artificial Sequence
  Description of Artificial Sequence: Synthetic oligonucleotide
  Target: SCN9A; (-) strand; PAM type: NRG; PAM sequence: GAG
caagttcatcaggaactctg

SEQ ID NO: 24832 - DNA, 20 bp, Artificial Sequence
  Description of Artificial Sequence: Synthetic oligonucleotide
  Target: SCN9A; (-) strand; PAM type: NRG; PAM sequence: TGG
cacaagttcatcaggaactc

SEQ ID NO: 24833 - DNA, 20 bp, Artificial Sequence
  Description of Artificial Sequence: Synthetic oligonucleotide
  Target: SCN9A; (-) strand; PAM type: NRG; PAM sequence: AGG
ttgctagtcacaagttcatc

SEQ ID NO: 24834 - DNA, 20 bp, Artificial Sequence
  Description of Artificial Sequence: Synthetic oligonucleotide
  Target: SCN9A; (-) strand; PAM type: NRG; PAM sequence: CAG
cttgctagtcacaagttcat

SEQ ID NO: 24835 - DNA, 20 bp, Artificial Sequence
  Description of Artificial Sequence: Synthetic oligonucleotide
  Target: SCN9A; (-) strand; PAM type: NRG; PAM sequence: AAG
aagttttccttgctagtcac

SEQ ID NO: 24836 - DNA, 20 bp, Artificial Sequence
  Description of Artificial Sequence: Synthetic oligonucleotide
  Target: SCN9A; (-) strand; PAM type: NRG; PAM sequence: TAG
acccttaaagttttccttgc

SEQ ID NO: 24837 - DNA, 20 bp, Artificial Sequence
  Description of Artificial Sequence: Synthetic oligonucleotide
  Target: SCN9A; (-) strand; PAM type: NRG; PAM sequence: AAG
aagactttgagagaccctta

SEQ ID NO: 24838 - DNA, 20 bp, Artificial Sequence
  Description of Artificial Sequence: Synthetic oligonucleotide
  Target: SCN9A; (-) strand; PAM type: NRG; PAM sequence: GAG
cctcaagctaaagactttga

SEQ ID NO: 24839 - DNA, 20 bp, Artificial Sequence
  Description of Artificial Sequence: Synthetic oligonucleotide
  Target: SCN9A; (-) strand; PAM type: NRG; PAM sequence: GAG
accctcaagctaaagacttt

SEQ ID NO: 24840 - DNA, 20 bp, Artificial Sequence
  Description of Artificial Sequence: Synthetic oligonucleotide
  Target: SCN9A; (-) strand; PAM type: NRG; PAM sequence: AAG
tctaccttaccctcaagcta

SEQ ID NO: 24841 - DNA, 20 bp, Artificial Sequence
  Description of Artificial Sequence: Synthetic oligonucleotide
  Target: SCN9A; (-) strand; PAM type: NRG; PAM sequence: AAG
tcatgatctaccttaccctc

SEQ ID NO: 24842 - DNA, 20 bp, Artificial Sequence
  Description of Artificial Sequence: Synthetic oligonucleotide
  Target: SCN9A; (-) strand; PAM type: NRG; PAM sequence: TAG
cagcttcctccagtctttat

SEQ ID NO: 24843 - DNA, 20 bp, Artificial Sequence
  Description of Artificial Sequence: Synthetic oligonucleotide
  Target: SCN9A; (-) strand; PAM type: NRG; PAM sequence: CAG
gtatggtttacagcttcctc

SEQ ID NO: 24844 - DNA, 20 bp, Artificial Sequence
  Description of Artificial Sequence: Synthetic oligonucleotide
  Target: SCN9A; (-) strand; PAM type: NRG; PAM sequence: CAG
caaaactttagtatggttta

SEQ ID NO: 24845 - DNA, 20 bp, Artificial Sequence
  Description of Artificial Sequence: Synthetic oligonucleotide
  Target: SCN9A; (-) strand; PAM type: NRG; PAM sequence: TGG
acaaaaacaaaactttagta

SEQ ID NO: 24846 - DNA, 20 bp, Artificial Sequence
  Description of Artificial Sequence: Synthetic oligonucleotide
  Target: SCN9A; (-) strand; PAM type: NRG; PAM sequence: TAG
caaaaacaaaaacaaaactt

SEQ ID NO: 24847 - DNA, 20 bp, Artificial Sequence
  Description of Artificial Sequence: Synthetic oligonucleotide
  Target: SCN9A; (-) strand; PAM type: NRG; PAM sequence: AAG
taagtttttttttttttgaa

SEQ ID NO: 24848 - DNA, 20 bp, Artificial Sequence
  Description of Artificial Sequence: Synthetic oligonucleotide
  Target: SCN9A; (-) strand; PAM type: NRG; PAM sequence: AAG
taaaacattccaagtttaat

SEQ ID NO: 24849 - DNA, 20 bp, Artificial Sequence
  Description of Artificial Sequence: Synthetic oligonucleotide
  Target: SCN9A; (-) strand; PAM type: NRG; PAM sequence: AAG
tgttgtttgtaaaacattcc

SEQ ID NO: 24850 - DNA, 20 bp, Artificial Sequence
  Description of Artificial Sequence: Synthetic oligonucleotide
  Target: SCN9A; (-) strand; PAM type: NRG; PAM sequence: TGG
atctgcttacaattccccat

SEQ ID NO: 24851 - DNA, 20 bp, Artificial Sequence
  Description of Artificial Sequence: Synthetic oligonucleotide
  Target: SCN9A; (-) strand; PAM type: NRG; PAM sequence: CAG
ctaacctcactcttgagtcc

SEQ ID NO: 24852 - DNA, 20 bp, Artificial Sequence
  Description of Artificial Sequence: Synthetic oligonucleotide
  Target: SCN9A; (-) strand; PAM type: NRG; PAM sequence: GAG
ttacctctaacctcactctt

SEQ ID NO: 24853 - DNA, 20 bp, Artificial Sequence
  Description of Artificial Sequence: Synthetic oligonucleotide
  Target: SCN9A; (-) strand; PAM type: NRG; PAM sequence: AAG
atgcatgcctgtggcttgaa

SEQ ID NO: 24854 - DNA, 20 bp, Artificial Sequence
  Description of Artificial Sequence: Synthetic oligonucleotide
  Target: SCN9A; (-) strand; PAM type: NRG; PAM sequence: TGG
aggtgtttcatgcatgcctg

SEQ ID NO: 24855 - DNA, 20 bp, Artificial Sequence
  Description of Artificial Sequence: Synthetic oligonucleotide
  Target: SCN9A; (-) strand; PAM type: NRG; PAM sequence: AGG
tttcttattctgaagctctg

SEQ ID NO: 24856 - DNA, 20 bp, Artificial Sequence
  Description of Artificial Sequence: Synthetic oligonucleotide
  Target: SCN9A; (-) strand; PAM type: NRG; PAM sequence: GAG
ttttcttattctgaagctct

SEQ ID NO: 24857 - DNA, 20 bp, Artificial Sequence
  Description of Artificial Sequence: Synthetic oligonucleotide
  Target: SCN9A; (-) strand; PAM type: NRG; PAM sequence: AAG
agttatcttttcttattctg

SEQ ID NO: 24858 - DNA, 20 bp, Artificial Sequence
  Description of Artificial Sequence: Synthetic oligonucleotide
  Target: SCN9A; (-) strand; PAM type: NRG; PAM sequence: CAG
ctccccacatgttcaatctt

SEQ ID NO: 24859 - DNA, 20 bp, Artificial Sequence
  Description of Artificial Sequence: Synthetic oligonucleotide
  Target: SCN9A; (-) strand; PAM type: NRG; PAM sequence: GAG
cctctctctatttctttaat

SEQ ID NO: 24860 - DNA, 20 bp, Artificial Sequence
  Description of Artificial Sequence: Synthetic oligonucleotide
  Target: SCN9A; (-) strand; PAM type: NRG; PAM sequence: GAG
tttatttgtcttagagttct

SEQ ID NO: 24861 - DNA, 20 bp, Artificial Sequence
  Description of Artificial Sequence: Synthetic oligonucleotide
  Target: SCN9A; (-) strand; PAM type: NRG; PAM sequence: GAG
ttggtcttttatttgtctta

SEQ ID NO: 24862 - DNA, 20 bp, Artificial Sequence
  Description of Artificial Sequence: Synthetic oligonucleotide
  Target: SCN9A; (-) strand; PAM type: NRG; PAM sequence: TAG
ctttggtcttttatttgtct

SEQ ID NO: 24863 - DNA, 20 bp, Artificial Sequence
  Description of Artificial Sequence: Synthetic oligonucleotide
  Target: SCN9A; (-) strand; PAM type: NRG; PAM sequence: TGG
cagaggccatagtctacctt

SEQ ID NO: 24864 - DNA, 20 bp, Artificial Sequence
  Description of Artificial Sequence: Synthetic oligonucleotide
  Target: SCN9A; (-) strand; PAM type: NRG; PAM sequence: TAG
ttccttagtttcagaggcca

SEQ ID NO: 24865 - DNA, 20 bp, Artificial Sequence
  Description of Artificial Sequence: Synthetic oligonucleotide
  Target: SCN9A; (-) strand; PAM type: NRG; PAM sequence: AGG
cttcctttccttagtttcag

SEQ ID NO: 24866 - DNA, 20 bp, Artificial Sequence
  Description of Artificial Sequence: Synthetic oligonucleotide
  Target: SCN9A; (-) strand; PAM type: NRG; PAM sequence: GAG
tcttcctttccttagtttca

SEQ ID NO: 24867 - DNA, 20 bp, Artificial Sequence
  Description of Artificial Sequence: Synthetic oligonucleotide
  Target: SCN9A; (-) strand; PAM type: NRG; PAM sequence: CAG
attcttcctttccttagttt

SEQ ID NO: 24868 - DNA, 20 bp, Artificial Sequence
  Description of Artificial Sequence: Synthetic oligonucleotide
  Target: SCN9A; (-) strand; PAM type: NRG; PAM sequence: TAG
ctcaaaattcttcctttcct

SEQ ID NO: 24869 - DNA, 20 bp, Artificial Sequence
  Description of Artificial Sequence: Synthetic oligonucleotide
  Target: SCN9A; (-) strand; PAM type: NRG; PAM sequence: CAG
ctgtttgatactgttgacta

SEQ ID NO: 24870 - DNA, 20 bp, Artificial Sequence
  Description of Artificial Sequence: Synthetic oligonucleotide
  Target: SCN9A; (-) strand; PAM type: NRG; PAM sequence: CAG
ggaatctactcactaactct

SEQ ID NO: 24871 - DNA, 20 bp, Artificial Sequence
  Description of Artificial Sequence: Synthetic oligonucleotide
  Target: SCN9A; (-) strand; PAM type: NRG; PAM sequence: TGG
ctggtccttttaatcaaaaa

SEQ ID NO: 24872 - DNA, 20 bp, Artificial Sequence
  Description of Artificial Sequence: Synthetic oligonucleotide
  Target: SCN9A; (-) strand; PAM type: NRG; PAM sequence: TGG
taatgaaagagtctgtactc

SEQ ID NO: 24873 - DNA, 20 bp, Artificial Sequence
  Description of Artificial Sequence: Synthetic oligonucleotide
  Target: SCN9A; (-) strand; PAM type: NRG; PAM sequence: GAG
cagaatacaagttaatgaaa

SEQ ID NO: 24874 - DNA, 20 bp, Artificial Sequence
  Description of Artificial Sequence: Synthetic oligonucleotide
  Target: SCN9A; (-) strand; PAM type: NRG; PAM sequence: AAG
accagaatacaagttaatga

SEQ ID NO: 24875 - DNA, 20 bp, Artificial Sequence
  Description of Artificial Sequence: Synthetic oligonucleotide
  Target: SCN9A; (-) strand; PAM type: NRG; PAM sequence: AAG
caatggaaccaccagaatac

SEQ ID NO: 24876 - DNA, 20 bp, Artificial Sequence
  Description of Artificial Sequence: Synthetic oligonucleotide
  Target: SCN9A; (-) strand; PAM type: NRG; PAM sequence: CAG
tcccagatcaatggaaccac

SEQ ID NO: 24877 - DNA, 20 bp, Artificial Sequence
  Description of Artificial Sequence: Synthetic oligonucleotide
  Target: SCN9A; (-) strand; PAM type: NRG; PAM sequence: TGG
aattcgtattcccagatcaa

SEQ ID NO: 24878 - DNA, 20 bp, Artificial Sequence
  Description of Artificial Sequence: Synthetic oligonucleotide
  Target: SCN9A; (-) strand; PAM type: NRG; PAM sequence: CAG
agagccttaattcgtattcc

SEQ ID NO: 24879 - DNA, 20 bp, Artificial Sequence
  Description of Artificial Sequence: Synthetic oligonucleotide
  Target: SCN9A; (-) strand; PAM type: NRG; PAM sequence: GAG
tgctactacttcttatttta

SEQ ID NO: 24880 - DNA, 20 bp, Artificial Sequence
  Description of Artificial Sequence: Synthetic oligonucleotide
  Target: SCN9A; (-) strand; PAM type: NRG; PAM sequence: TAG
catgctactacttcttattt

SEQ ID NO: 24881 - DNA, 20 bp, Artificial Sequence
  Description of Artificial Sequence: Synthetic oligonucleotide
  Target: SCN9A; (-) strand; PAM type: NRG; PAM sequence: AAG
atcactgtatgttagactgt

SEQ ID NO: 24882 - DNA, 20 bp, Artificial Sequence
  Description of Artificial Sequence: Synthetic oligonucleotide
  Target: SCN9A; (-) strand; PAM type: NRG; PAM sequence: TAG
aatttcctatcactgtatgt

SEQ ID NO: 24883 - DNA, 20 bp, Artificial Sequence
  Description of Artificial Sequence: Synthetic oligonucleotide
  Target: SCN9A; (-) strand; PAM type: NRG; PAM sequence: CAG
catctatggcacttgactaa

SEQ ID NO: 24884 - DNA, 20 bp, Artificial Sequence
  Description of Artificial Sequence: Synthetic oligonucleotide
  Target: SCN9A; (-) strand; PAM type: NRG; PAM sequence: TGG
agcttgagtttccacatcta

SEQ ID NO: 24885 - DNA, 20 bp, Artificial Sequence
  Description of Artificial Sequence: Synthetic oligonucleotide
  Target: SCN9A; (-) strand; PAM type: NRG; PAM sequence: GAG
cactagagctctctaagctt

SEQ ID NO: 24886 - DNA, 20 bp, Artificial Sequence
  Description of Artificial Sequence: Synthetic oligonucleotide
  Target: SCN9A; (-) strand; PAM type: NRG; PAM sequence: AAG
gcaagtcactagagctctct

SEQ ID NO: 24887 - DNA, 20 bp, Artificial Sequence
  Description of Artificial Sequence: Synthetic oligonucleotide
  Target: SCN9A; (-) strand; PAM type: NRG; PAM sequence: GAG
tgattaagggcaagtcacta

SEQ ID NO: 24888 - DNA, 20 bp, Artificial Sequence
  Description of Artificial Sequence: Synthetic oligonucleotide
  Target: SCN9A; (-) strand; PAM type: NRG; PAM sequence: TAG
gatgattaagggcaagtcac

SEQ ID NO: 24889 - DNA, 20 bp, Artificial Sequence
  Description of Artificial Sequence: Synthetic oligonucleotide
  Target: SCN9A; (-) strand; PAM type: NRG; PAM sequence: AAG
gctgtatgatgattaagggc

SEQ ID NO: 24890 - DNA, 20 bp, Artificial Sequence
  Description of Artificial Sequence: Synthetic oligonucleotide
  Target: SCN9A; (-) strand; PAM type: NRG; PAM sequence: GGG
tatagctgtatgatgattaa

SEQ ID NO: 24891 - DNA, 20 bp, Artificial Sequence
  Description of Artificial Sequence: Synthetic oligonucleotide
  Target: SCN9A; (-) strand; PAM type: NRG; PAM sequence: AGG
ctatagctgtatgatgatta

SEQ ID NO: 24892 - DNA, 20 bp, Artificial Sequence
  Description of Artificial Sequence: Synthetic oligonucleotide
  Target: SCN9A; (-) strand; PAM type: NRG; PAM sequence: AAG
gctatagctgtatgatgatt

SEQ ID NO: 24893 - DNA, 20 bp, Artificial Sequence
  Description of Artificial Sequence: Synthetic oligonucleotide
  Target: SCN9A; (-) strand; PAM type: NRG; PAM sequence: TAG
attccatgctgattcagcta

SEQ ID NO: 24894 - DNA, 20 bp, Artificial Sequence
  Description of Artificial Sequence: Synthetic oligonucleotide
  Target: SCN9A; (-) strand; PAM type: NRG; PAM sequence: CAG
gactccattccatgctgatt

SEQ ID NO: 24895 - DNA, 20 bp, Artificial Sequence
  Description of Artificial Sequence: Synthetic oligonucleotide
  Target: SCN9A; (-) strand; PAM type: NRG; PAM sequence: AAG
agaggttgtcggtaagtcag

SEQ ID NO: 24896 - DNA, 20 bp, Artificial Sequence
  Description of Artificial Sequence: Synthetic oligonucleotide
  Target: SCN9A; (-) strand; PAM type: NRG; PAM sequence: CAG
accagaggttgtcggtaagt

SEQ ID NO: 24897 - DNA, 20 bp, Artificial Sequence
  Description of Artificial Sequence: Synthetic oligonucleotide
  Target: SCN9A; (-) strand; PAM type: NRG; PAM sequence: AAG
acttaccagaggttgtcggt

SEQ ID NO: 24898 - DNA, 20 bp, Artificial Sequence
  Description of Artificial Sequence: Synthetic oligonucleotide
  Target: SCN9A; (-) strand; PAM type: NRG; PAM sequence: CGG
taatacttaccagaggttgt

SEQ ID NO: 24899 - DNA, 20 bp, Artificial Sequence
  Description of Artificial Sequence: Synthetic oligonucleotide
  Target: SCN9A; (-) strand; PAM type: NRG; PAM sequence: AGG
taacgcctaatacttaccag

SEQ ID NO: 24900 - DNA, 20 bp, Artificial Sequence
  Description of Artificial Sequence: Synthetic oligonucleotide
  Target: SCN9A; (-) strand; PAM type: NRG; PAM sequence: GAG
ttaacgcctaatacttacca

SEQ ID NO: 24901 - DNA, 20 bp, Artificial Sequence
  Description of Artificial Sequence: Synthetic oligonucleotide
  Target: SCN9A; (-) strand; PAM type: NRG; PAM sequence: CAG
tcttaacgcctaatacttac

SEQ ID NO: 24902 - DNA, 20 bp, Artificial Sequence
  Description of Artificial Sequence: Synthetic oligonucleotide
  Target: SCN9A; (-) strand; PAM type: NRG; PAM sequence: GGG
attccttaattagtgttctg

SEQ ID NO: 24903 - DNA, 20 bp, Artificial Sequence
  Description of Artificial Sequence: Synthetic oligonucleotide
  Target: SCN9A; (-) strand; PAM type: NRG; PAM sequence: GGG
cattccttaattagtgttct

SEQ ID NO: 24904 - DNA, 20 bp, Artificial Sequence
  Description of Artificial Sequence: Synthetic oligonucleotide
  Target: SCN9A; (-) strand; PAM type: NRG; PAM sequence: TGG
gcattccttaattagtgttc

SEQ ID NO: 24905 - DNA, 20 bp, Artificial Sequence
  Description of Artificial Sequence: Synthetic oligonucleotide
  Target: SCN9A; (-) strand; PAM type: NRG; PAM sequence: TAG
cttggttagcattccttaat

SEQ ID NO: 24906 - DNA, 20 bp, Artificial Sequence
  Description of Artificial Sequence: Synthetic oligonucleotide
  Target: SCN9A; (-) strand; PAM type: NRG; PAM sequence: TAG
acaaaaattgagaccttggt

SEQ ID NO: 24907 - DNA, 20 bp, Artificial Sequence
  Description of Artificial Sequence: Synthetic oligonucleotide
  Target: SCN9A; (-) strand; PAM type: NRG; PAM sequence: TGG
taagacaaaaattgagacct

SEQ ID NO: 24908 - DNA, 20 bp, Artificial Sequence
  Description of Artificial Sequence: Synthetic oligonucleotide
  Target: SCN9A; (-) strand; PAM type: NRG; PAM sequence: GAG
cagatggtaagacaaaaatt

SEQ ID NO: 24909 - DNA, 20 bp, Artificial Sequence
  Description of Artificial Sequence: Synthetic oligonucleotide
  Target: SCN9A; (-) strand; PAM type: NRG; PAM sequence: AAG
aggcctgtttcacagatggt

SEQ ID NO: 24910 - DNA, 20 bp, Artificial Sequence
  Description of Artificial Sequence: Synthetic oligonucleotide
  Target: SCN9A; (-) strand; PAM type: NRG; PAM sequence: TGG
ccagaggcctgtttcacaga

SEQ ID NO: 24911 - DNA, 20 bp, Artificial Sequence
  Description of Artificial Sequence: Synthetic oligonucleotide
  Target: SCN9A; (-) strand; PAM type: NRG; PAM sequence: CAG
tgagccagaggcctgtttca

SEQ ID NO: 24912 - DNA, 20 bp, Artificial Sequence
  Description of Artificial Sequence: Synthetic oligonucleotide
  Target: SCN9A; (-) strand; PAM type: NRG; PAM sequence: AGG
tatgaattccgatgagccag

SEQ ID NO: 24913 - DNA, 20 bp, Artificial Sequence
  Description of Artificial Sequence: Synthetic oligonucleotide
  Target: SCN9A; (-) strand; PAM type: NRG; PAM sequence: GAG
ctatgaattccgatgagcca

SEQ ID NO: 24914 - DNA, 20 bp, Artificial Sequence
  Description of Artificial Sequence: Synthetic oligonucleotide
  Target: SCN9A; (-) strand; PAM type: NRG; PAM sequence: CAG
acctatgaattccgatgagc

SEQ ID NO: 24915 - DNA, 20 bp, Artificial Sequence
  Description of Artificial Sequence: Synthetic oligonucleotide
  Target: SCN9A; (-) strand; PAM type: NRG; PAM sequence: GAG
ctgaacctatgaattccgat

SEQ ID NO: 24916 - DNA, 20 bp, Artificial Sequence
  Description of Artificial Sequence: Synthetic oligonucleotide
  Target: SCN9A; (-) strand; PAM type: NRG; PAM sequence: AGG
tggagaaggagaagaagcag

SEQ ID NO: 24917 - DNA, 20 bp, Artificial Sequence
  Description of Artificial Sequence: Synthetic oligonucleotide
  Target: SCN9A; (-) strand; PAM type: NRG; PAM sequence: GAG
ctggagaaggagaagaagca

SEQ ID NO: 24918 - DNA, 20 bp, Artificial Sequence
  Description of Artificial Sequence: Synthetic oligonucleotide
  Target: SCN9A; (-) strand; PAM type: NRG; PAM sequence: CAG
gcctggagaaggagaagaag

SEQ ID NO: 24919 - DNA, 20 bp, Artificial Sequence
  Description of Artificial Sequence: Synthetic oligonucleotide
  Target: SCN9A; (-) strand; PAM type: NRG; PAM sequence: AAG
tttgcctggagaaggagaag

SEQ ID NO: 24920 - DNA, 20 bp, Artificial Sequence
  Description of Artificial Sequence: Synthetic oligonucleotide
  Target: SCN9A; (-) strand; PAM type: NRG; PAM sequence: AAG
ccctttgcctggagaaggag

SEQ ID NO: 24921 - DNA, 20 bp, Artificial Sequence
  Description of Artificial Sequence: Synthetic oligonucleotide
  Target: SCN9A; (-) strand; PAM type: NRG; PAM sequence: GAG
taaccctttgcctggagaag

SEQ ID NO: 24922 - DNA, 20 bp, Artificial Sequence
  Description of Artificial Sequence: Synthetic oligonucleotide
  Target: SCN9A; (-) strand; PAM type: NRG; PAM sequence: AGG
gataaccctttgcctggaga

SEQ ID NO: 24923 - DNA, 20 bp, Artificial Sequence
  Description of Artificial Sequence: Synthetic oligonucleotide
  Target: SCN9A; (-) strand; PAM type: NRG; PAM sequence: AAG
tgataaccctttgcctggag

SEQ ID NO: 24924 - DNA, 20 bp, Artificial Sequence
  Description of Artificial Sequence: Synthetic oligonucleotide
  Target: SCN9A; (-) strand; PAM type: NRG; PAM sequence: GAG
agttgataaccctttgcctg

SEQ ID NO: 24925 - DNA, 20 bp, Artificial Sequence
  Description of Artificial Sequence: Synthetic oligonucleotide
  Target: SCN9A; (-) strand; PAM type: NRG; PAM sequence: TGG
acagttgataaccctttgcc

SEQ ID NO: 24926 - DNA, 20 bp, Artificial Sequence
  Description of Artificial Sequence: Synthetic oligonucleotide
  Target: SCN9A; (-) strand; PAM type: NRG; PAM sequence: CAG
aagctcctcagagtgcagca

SEQ ID NO: 24927 - DNA, 20 bp, Artificial Sequence
  Description of Artificial Sequence: Synthetic oligonucleotide
  Target: SCN9A; (-) strand; PAM type: NRG; PAM sequence: CAG
cggtcaagctcctcagagtg

SEQ ID NO: 24928 - DNA, 20 bp, Artificial Sequence
  Description of Artificial Sequence: Synthetic oligonucleotide
  Target: SCN9A; (-) strand; PAM type: NRG; PAM sequence: GAG
taaaccggtcaagctcctca

SEQ ID NO: 24929 - DNA, 20 bp, Artificial Sequence
  Description of Artificial Sequence: Synthetic oligonucleotide
  Target: SCN9A; (-) strand; PAM type: NRG; PAM sequence: CAG
attaaaccggtcaagctcct

SEQ ID NO: 24930 - DNA, 20 bp, Artificial Sequence
  Description of Artificial Sequence: Synthetic oligonucleotide
  Target: SCN9A; (-) strand; PAM type: NRG; PAM sequence: AAG
ttctagagattaaaccggtc

SEQ ID NO: 24931 - DNA, 20 bp, Artificial Sequence
  Description of Artificial Sequence: Synthetic oligonucleotide
  Target: SCN9A; (-) strand; PAM type: NRG; PAM sequence: CGG
ttcctttctagagattaaac

SEQ ID NO: 24932 - DNA, 20 bp, Artificial Sequence
  Description of Artificial Sequence: Synthetic oligonucleotide
  Target: SCN9A; (-) strand; PAM type: NRG; PAM sequence: GAG
gggtggtgaattcctttcta

SEQ ID NO: 24933 - DNA, 20 bp, Artificial Sequence
  Description of Artificial Sequence: Synthetic oligonucleotide
  Target: SCN9A; (-) strand; PAM type: NRG; PAM sequence: TAG
tggggtggtgaattcctttc

SEQ ID NO: 24934 - DNA, 20 bp, Artificial Sequence
  Description of Artificial Sequence: Synthetic oligonucleotide
  Target: SCN9A; (-) strand; PAM type: NRG; PAM sequence: TGG
aaatgaactacctggtgggg

SEQ ID NO: 24935 - DNA, 20 bp, Artificial Sequence
  Description of Artificial Sequence: Synthetic oligonucleotide
  Target: SCN9A; (-) strand; PAM type: NRG; PAM sequence: GGG
tctaaatgaactacctggtg

SEQ ID NO: 24936 - DNA, 20 bp, Artificial Sequence
  Description of Artificial Sequence: Synthetic oligonucleotide
  Target: SCN9A; (-) strand; PAM type: NRG; PAM sequence: GGG
ctctaaatgaactacctggt

SEQ ID NO: 24937 - DNA, 20 bp, Artificial Sequence
  Description of Artificial Sequence: Synthetic oligonucleotide
  Target: SCN9A; (-) strand; PAM type: NRG; PAM sequence: TGG
actctaaatgaactacctgg

SEQ ID NO: 24938 - DNA, 20 bp, Artificial Sequence
  Description of Artificial Sequence: Synthetic oligonucleotide
  Target: SCN9A; (-) strand; PAM type: NRG; PAM sequence: TGG
tgaactctaaatgaactacc

SEQ ID NO: 24939 - DNA, 20 bp, Artificial Sequence
  Description of Artificial Sequence: Synthetic oligonucleotide
  Target: SCN9A; (-) strand; PAM type: NRG; PAM sequence: AGG
atgagtctgattattaaata

SEQ ID NO: 24940 - DNA, 20 bp, Artificial Sequence
  Description of Artificial Sequence: Synthetic oligonucleotide
  Target: SCN9A; (-) strand; PAM type: NRG; PAM sequence: AAG
catgagtctgattattaaat

SEQ ID NO: 24941 - DNA, 20 bp, Artificial Sequence
  Description of Artificial Sequence: Synthetic oligonucleotide
  Target: SCN9A; (-) strand; PAM type: NRG; PAM sequence: GAG
tttttcataatactttgcat

SEQ ID NO: 24942 - DNA, 20 bp, Artificial Sequence
  Description of Artificial Sequence: Synthetic oligonucleotide
  Target: SCN9A; (-) strand; PAM type: NRG; PAM sequence: TGG
atgtgtttatacatttttta

SEQ ID NO: 24943 - DNA, 20 bp, Artificial Sequence
  Description of Artificial Sequence: Synthetic oligonucleotide
  Target: SCN9A; (-) strand; PAM type: NRG; PAM sequence: AGG
atcaagtatagatacattta

SEQ ID NO: 24944 - DNA, 20 bp, Artificial Sequence
  Description of Artificial Sequence: Synthetic oligonucleotide
  Target: SCN9A; (-) strand; PAM type: NRG; PAM sequence: AAG
gatcaagtatagatacattt

SEQ ID NO: 24945 - DNA, 20 bp, Artificial Sequence
  Description of Artificial Sequence: Synthetic oligonucleotide
  Target: SCN9A; (-) strand; PAM type: NRG; PAM sequence: TAG
gtagatagaaagatcaagta

SEQ ID NO: 24946 - DNA, 20 bp, Artificial Sequence
  Description of Artificial Sequence: Synthetic oligonucleotide
  Target: SCN9A; (-) strand; PAM type: NRG; PAM sequence: AAG
atggtgtagatagaaagatc

SEQ ID NO: 24947 - DNA, 20 bp, Artificial Sequence
  Description of Artificial Sequence: Synthetic oligonucleotide
  Target: SCN9A; (-) strand; PAM type: NRG; PAM sequence: AAG
tacaggatggtgtagataga

SEQ ID NO: 24948 - DNA, 20 bp, Artificial Sequence
  Description of Artificial Sequence: Synthetic oligonucleotide
  Target: SCN9A; (-) strand; PAM type: NRG; PAM sequence: TAG
attttacaggatggtgtaga

SEQ ID NO: 24949 - DNA, 20 bp, Artificial Sequence
  Description of Artificial Sequence: Synthetic oligonucleotide
  Target: SCN9A; (-) strand; PAM type: NRG; PAM sequence: TAG
tattattttacaggatggtg

SEQ ID NO: 24950 - DNA, 20 bp, Artificial Sequence
  Description of Artificial Sequence: Synthetic oligonucleotide
  Target: SCN9A; (-) strand; PAM type: NRG; PAM sequence: TGG
aagtttattattttacagga

SEQ ID NO: 24951 - DNA, 20 bp, Artificial Sequence
  Description of Artificial Sequence: Synthetic oligonucleotide
  Target: SCN9A; (-) strand; PAM type: NRG; PAM sequence: AGG
aataaagtttattattttac

SEQ ID NO: 24952 - DNA, 20 bp, Artificial Sequence
  Description of Artificial Sequence: Synthetic oligonucleotide
  Target: SCN9A; (-) strand; PAM type: NRG; PAM sequence: CAG
taataaagtttattatttta

SEQ ID NO: 24953 - DNA, 20 bp, Artificial Sequence
  Description of Artificial Sequence: Synthetic oligonucleotide
  Target: SCN9A; (-) strand; PAM type: NRG; PAM sequence: AAG
ttagtataataaacataata

SEQ ID NO: 24954 - DNA, 20 bp, Artificial Sequence
  Description of Artificial Sequence: Synthetic oligonucleotide
  Target: SCN9A; (-) strand; PAM type: NRG; PAM sequence: TAG
aattttggccacgtacttgt

SEQ ID NO: 24955 - DNA, 20 bp, Artificial Sequence
  Description of Artificial Sequence: Synthetic oligonucleotide
  Target: SCN9A; (-) strand; PAM type: NRG; PAM sequence: TGG
tatattaccttatctaattt

SEQ ID NO: 24956 - DNA, 20 bp, Artificial Sequence
  Description of Artificial Sequence: Synthetic oligonucleotide
  Target: SCN9A; (-) strand; PAM type: NRG; PAM sequence: TAG
tcaatactttccaaaagtga

SEQ ID NO: 24957 - DNA, 20 bp, Artificial Sequence
  Description of Artificial Sequence: Synthetic oligonucleotide
  Target: SCN9A; (-) strand; PAM type: NRG; PAM sequence: AAG
atgtggtcaatactttccaa

SEQ ID NO: 24958 - DNA, 20 bp, Artificial Sequence
  Description of Artificial Sequence: Synthetic oligonucleotide
  Target: SCN9A; (-) strand; PAM type: NRG; PAM sequence: TGG
aaaatttaaaaaataagatg

SEQ ID NO: 24959 - DNA, 20 bp, Artificial Sequence
  Description of Artificial Sequence: Synthetic oligonucleotide
  Target: SCN9A; (-) strand; PAM type: NRG; PAM sequence: AAG
atattaaaaatttaaaaaat

SEQ ID NO: 24960 - DNA, 20 bp, Artificial Sequence
  Description of Artificial Sequence: Synthetic oligonucleotide
  Target: SCN9A; (-) strand; PAM type: NRG; PAM sequence: CAG
tgtcctcaaataatgattgt

SEQ ID NO: 24961 - DNA, 20 bp, Artificial Sequence
  Description of Artificial Sequence: Synthetic oligonucleotide
  Target: SCN9A; (-) strand; PAM type: NRG; PAM sequence: AGG
ttatattgcaaatagggtat

SEQ ID NO: 24962 - DNA, 20 bp, Artificial Sequence
  Description of Artificial Sequence: Synthetic oligonucleotide
  Target: SCN9A; (-) strand; PAM type: NRG; PAM sequence: TAG
attatattgcaaatagggta

SEQ ID NO: 24963 - DNA, 20 bp, Artificial Sequence
  Description of Artificial Sequence: Synthetic oligonucleotide
  Target: SCN9A; (-) strand; PAM type: NRG; PAM sequence: GGG
cttgtattatattgcaaata

SEQ ID NO: 24964 - DNA, 20 bp, Artificial Sequence
  Description of Artificial Sequence: Synthetic oligonucleotide
  Target: SCN9A; (-) strand; PAM type: NRG; PAM sequence: AGG
acttgtattatattgcaaat

SEQ ID NO: 24965 - DNA, 20 bp, Artificial Sequence
  Description of Artificial Sequence: Synthetic oligonucleotide
  Target: SCN9A; (-) strand; PAM type: NRG; PAM sequence: TAG
cacttgtattatattgcaaa

SEQ ID NO: 24966 - DNA, 20 bp, Artificial Sequence
  Description of Artificial Sequence: Synthetic oligonucleotide
  Target: SCN9A; (-) strand; PAM type: NRG; PAM sequence: TAG
agctttcaatgatcaggcat

SEQ ID NO: 24967 - DNA, 20 bp, Artificial Sequence
  Description of Artificial Sequence: Synthetic oligonucleotide
  Target: SCN9A; (-) strand; PAM type: NRG; PAM sequence: AGG
gatctgagctttcaatgatc

SEQ ID NO: 24968 - DNA, 20 bp, Artificial Sequence
  Description of Artificial Sequence: Synthetic oligonucleotide
  Target: SCN9A; (-) strand; PAM type: NRG; PAM sequence: CAG
tgatctgagctttcaatgat

SEQ ID NO: 24969 - DNA, 20 bp, Artificial Sequence
  Description of Artificial Sequence: Synthetic oligonucleotide
  Target: SCN9A; (-) strand; PAM type: NRG; PAM sequence: GAG
ttttgccaactatttgatct

SEQ ID NO: 24970 - DNA, 20 bp, Artificial Sequence
  Description of Artificial Sequence: Synthetic oligonucleotide
  Target: SCN9A; (-) strand; PAM type: NRG; PAM sequence: AAG
aaaaaattttaactatcaat

SEQ ID NO: 24971 - DNA, 20 bp, Artificial Sequence
  Description of Artificial Sequence: Synthetic oligonucleotide
  Target: SCN9A; (-) strand; PAM type: NRG; PAM sequence: TGG
gagataataaaaaatacatt

SEQ ID NO: 24972 - DNA, 20 bp, Artificial Sequence
  Description of Artificial Sequence: Synthetic oligonucleotide
  Target: SCN9A; (-) strand; PAM type: NRG; PAM sequence: GAG
ctacatatatttaaattcaa

SEQ ID NO: 24973 - DNA, 20 bp, Artificial Sequence
  Description of Artificial Sequence: Synthetic oligonucleotide
  Target: SCN9A; (-) strand; PAM type: NRG; PAM sequence: AAG
tgctacatatatttaaattc

SEQ ID NO: 24974 - DNA, 20 bp, Artificial Sequence
  Description of Artificial Sequence: Synthetic oligonucleotide
  Target: SCN9A; (-) strand; PAM type: NRG; PAM sequence: AAG
tgattttgtggtcttgatca

SEQ ID NO: 24975 - DNA, 20 bp, Artificial Sequence
  Description of Artificial Sequence: Synthetic oligonucleotide
  Target: SCN9A; (-) strand; PAM type: NRG; PAM sequence: TGG
caaaaccgtatttgattttg

SEQ ID NO: 24976 - DNA, 20 bp, Artificial Sequence
  Description of Artificial Sequence: Synthetic oligonucleotide
  Target: SCN9A; (-) strand; PAM type: NRG; PAM sequence: TGG
ggtggtgttggtatggtcat

SEQ ID NO: 24977 - DNA, 20 bp, Artificial Sequence
  Description of Artificial Sequence: Synthetic oligonucleotide
  Target: SCN9A; (-) strand; PAM type: NRG; PAM sequence: TGG
caaaatgggtggtgttggta

SEQ ID NO: 24978 - DNA, 20 bp, Artificial Sequence
  Description of Artificial Sequence: Synthetic oligonucleotide
  Target: SCN9A; (-) strand; PAM type: NRG; PAM sequence: TGG
atatacaaaatgggtggtgt

SEQ ID NO: 24979 - DNA, 20 bp, Artificial Sequence
  Description of Artificial Sequence: Synthetic oligonucleotide
  Target: SCN9A; (-) strand; PAM type: NRG; PAM sequence: TGG
aatgttatatacaaaatggg

SEQ ID NO: 24980 - DNA, 20 bp, Artificial Sequence
  Description of Artificial Sequence: Synthetic oligonucleotide
  Target: SCN9A; (-) strand; PAM type: NRG; PAM sequence: GGG
taaaatgttatatacaaaat

SEQ ID NO: 24981 - DNA, 20 bp, Artificial Sequence
  Description of Artificial Sequence: Synthetic oligonucleotide
  Target: SCN9A; (-) strand; PAM type: NRG; PAM sequence: TGG
ctaaaatgttatatacaaaa

SEQ ID NO: 24982 - DNA, 20 bp, Artificial Sequence
  Description of Artificial Sequence: Synthetic oligonucleotide
  Target: SCN9A; (-) strand; PAM type: NRG; PAM sequence: TAG
gcatgtggtgcttactttag

SEQ ID NO: 24983 - DNA, 20 bp, Artificial Sequence
  Description of Artificial Sequence: Synthetic oligonucleotide
  Target: SCN9A; (-) strand; PAM type: NRG; PAM sequence: TAG
tttgcatgtggtgcttactt

SEQ ID NO: 24984 - DNA, 20 bp, Artificial Sequence
  Description of Artificial Sequence: Synthetic oligonucleotide
  Target: SCN9A; (-) strand; PAM type: NRG; PAM sequence: TGG
tttgtttcagagtttgcatg

SEQ ID NO: 24985 - DNA, 20 bp, Artificial Sequence
  Description of Artificial Sequence: Synthetic oligonucleotide
  Target: SCN9A; (-) strand; PAM type: NRG; PAM sequence: GAG
tttcttcgatctttgtttca

SEQ ID NO: 24986 - DNA, 20 bp, Artificial Sequence
  Description of Artificial Sequence: Synthetic oligonucleotide
  Target: SCN9A; (-) strand; PAM type: NRG; PAM sequence: CAG
attttcttcgatctttgttt

SEQ ID NO: 24987 - DNA, 20 bp, Artificial Sequence
  Description of Artificial Sequence: Synthetic oligonucleotide
  Target: SCN9A; (-) strand; PAM type: NRG; PAM sequence: AAG
gaattcattattccatgtgt

SEQ ID NO: 24988 - DNA, 20 bp, Artificial Sequence
  Description of Artificial Sequence: Synthetic oligonucleotide
  Target: SCN9A; (-) strand; PAM type: NRG; PAM sequence: GAG
ttactcataaagctctgggt

SEQ ID NO: 24989 - DNA, 20 bp, Artificial Sequence
  Description of Artificial Sequence: Synthetic oligonucleotide
  Target: SCN9A; (-) strand; PAM type: NRG; PAM sequence: GGG
atggttactcataaagctct

SEQ ID NO: 24990 - DNA, 20 bp, Artificial Sequence
  Description of Artificial Sequence: Synthetic oligonucleotide
  Target: SCN9A; (-) strand; PAM type: NRG; PAM sequence: TGG
catggttactcataaagctc

SEQ ID NO: 24991 - DNA, 20 bp, Artificial Sequence
  Description of Artificial Sequence: Synthetic oligonucleotide
  Target: SCN9A; (-) strand; PAM type: NRG; PAM sequence: AAG
aaacatcatggttactcata

SEQ ID NO: 24992 - DNA, 20 bp, Artificial Sequence
  Description of Artificial Sequence: Synthetic oligonucleotide
  Target: SCN9A; (-) strand; PAM type: NRG; PAM sequence: TGG
gtgtgtatgtgtaaacatca

SEQ ID NO: 24993 - DNA, 20 bp, Artificial Sequence
  Description of Artificial Sequence: Synthetic oligonucleotide
  Target: SCN9A; (-) strand; PAM type: NRG; PAM sequence: AAG
tgctgtatgtattttttgta

SEQ ID NO: 24994 - DNA, 20 bp, Artificial Sequence
  Description of Artificial Sequence: Synthetic oligonucleotide
  Target: SCN9A; (-) strand; PAM type: NRG; PAM sequence: CAG
aatttgacagagttttgcta

SEQ ID NO: 24995 - DNA, 20 bp, Artificial Sequence
  Description of Artificial Sequence: Synthetic oligonucleotide
  Target: SCN9A; (-) strand; PAM type: NRG; PAM sequence: GAG
aatatttgggaaatttgaca

SEQ ID NO: 24996 - DNA, 20 bp, Artificial Sequence
  Description of Artificial Sequence: Synthetic oligonucleotide
  Target: SCN9A; (-) strand; PAM type: NRG; PAM sequence: CAG
acaatatttgggaaatttga

SEQ ID NO: 24997 - DNA, 20 bp, Artificial Sequence
  Description of Artificial Sequence: Synthetic oligonucleotide
  Target: SCN9A; (-) strand; PAM type: NRG; PAM sequence: GGG
tcctttataaaacaatattt

SEQ ID NO: 24998 - DNA, 20 bp, Artificial Sequence
  Description of Artificial Sequence: Synthetic oligonucleotide
  Target: SCN9A; (-) strand; PAM type: NRG; PAM sequence: TGG
ctcctttataaaacaatatt

SEQ ID NO: 24999 - DNA, 20 bp, Artificial Sequence
  Description of Artificial Sequence: Synthetic oligonucleotide
  Target: SCN9A; (-) strand; PAM type: NRG; PAM sequence: GAG
tcacatgtcatttagcaaat

SEQ ID NO: 25000 - DNA, 20 bp, Artificial Sequence
  Description of Artificial Sequence: Synthetic oligonucleotide
  Target: SCN9A; (-) strand; PAM type: NRG; PAM sequence: TAG
ttcaatattcacatgtcatt

SEQ ID NO: 25001 - DNA, 20 bp, Artificial Sequence
  Description of Artificial Sequence: Synthetic oligonucleotide
  Target: SCN9A; (-) strand; PAM type: NRG; PAM sequence: TAG
aattgtgttgtagtaactag

SEQ ID NO: 25002 - DNA, 20 bp, Artificial Sequence
  Description of Artificial Sequence: Synthetic oligonucleotide
  Target: SCN9A; (-) strand; PAM type: NRG; PAM sequence: TAG
gagaattgtgttgtagtaac

SEQ ID NO: 25003 - DNA, 20 bp, Artificial Sequence
  Description of Artificial Sequence: Synthetic oligonucleotide
  Target: SCN9A; (-) strand; PAM type: NRG; PAM sequence: TAG
ttaataagagaattgtgttg

SEQ ID NO: 25004 - DNA, 20 bp, Artificial Sequence
  Description of Artificial Sequence: Synthetic oligonucleotide
  Target: SCN9A; (-) strand; PAM type: NRG; PAM sequence: GAG
ataaagttgtaacttaataa

SEQ ID NO: 25005 - DNA, 20 bp, Artificial Sequence
  Description of Artificial Sequence: Synthetic oligonucleotide
  Target: SCN9A; (-) strand; PAM type: NRG; PAM sequence: AAG
agataaagttgtaacttaat

SEQ ID NO: 25006 - DNA, 20 bp, Artificial Sequence
  Description of Artificial Sequence: Synthetic oligonucleotide
  Target: SCN9A; (-) strand; PAM type: NRG; PAM sequence: AAG
gaactactctaaaaaagata

SEQ ID NO: 25007 - DNA, 20 bp, Artificial Sequence
  Description of Artificial Sequence: Synthetic oligonucleotide
  Target: SCN9A; (-) strand; PAM type: NRG; PAM sequence: AAG
ttgcttgaactactctaaaa

SEQ ID NO: 25008 - DNA, 20 bp, Artificial Sequence
  Description of Artificial Sequence: Synthetic oligonucleotide
  Target: SCN9A; (-) strand; PAM type: NRG; PAM sequence: TAG
aataagtattttattatttt

SEQ ID NO: 25009 - DNA, 20 bp, Artificial Sequence
  Description of Artificial Sequence: Synthetic oligonucleotide
  Target: SCN9A; (-) strand; PAM type: NRG; PAM sequence: AAG
agaatcaatttatctgaaat

SEQ ID NO: 25010 - DNA, 20 bp, Artificial Sequence
  Description of Artificial Sequence: Synthetic oligonucleotide
  Target: SCN9A; (-) strand; PAM type: NRG; PAM sequence: GAG
ttaatacaaattcatagatt

SEQ ID NO: 25011 - DNA, 20 bp, Artificial Sequence
  Description of Artificial Sequence: Synthetic oligonucleotide
  Target: SCN9A; (-) strand; PAM type: NRG; PAM sequence: TAG
atcatattaatacaaattca

SEQ ID NO: 25012 - DNA, 20 bp, Artificial Sequence
  Description of Artificial Sequence: Synthetic oligonucleotide
  Target: SCN9A; (-) strand; PAM type: NRG; PAM sequence: GGG
aaaagtcaaacctttagatt

SEQ ID NO: 25013 - DNA, 20 bp, Artificial Sequence
  Description of Artificial Sequence: Synthetic oligonucleotide
  Target: SCN9A; (-) strand; PAM type: NRG; PAM sequence: TGG
taaaagtcaaacctttagat

SEQ ID NO: 25014 - DNA, 20 bp, Artificial Sequence
  Description of Artificial Sequence: Synthetic oligonucleotide
  Target: SCN9A; (-) strand; PAM type: NRG; PAM sequence: TAG
atctctaaaagtcaaacctt

SEQ ID NO: 25015 - DNA, 20 bp, Artificial Sequence
  Description of Artificial Sequence: Synthetic oligonucleotide
  Target: SCN9A; (-) strand; PAM type: NRG; PAM sequence: AAG
gcttccaagtcaatctctaa

SEQ ID NO: 25016 - DNA, 20 bp, Artificial Sequence
  Description of Artificial Sequence: Synthetic oligonucleotide
  Target: SCN9A; (-) strand; PAM type: NRG; PAM sequence: AAG
caagaatacttctagcttcc

SEQ ID NO: 25017 - DNA, 20 bp, Artificial Sequence
  Description of Artificial Sequence: Synthetic oligonucleotide
  Target: SCN9A; (-) strand; PAM type: NRG; PAM sequence: TAG
gtacccatcaagaatacttc

SEQ ID NO: 25018 - DNA, 20 bp, Artificial Sequence
  Description of Artificial Sequence: Synthetic oligonucleotide
  Target: SCN9A; (-) strand; PAM type: NRG; PAM sequence: AAG
aatttaatgtggtacccatc

SEQ ID NO: 25019 - DNA, 20 bp, Artificial Sequence
  Description of Artificial Sequence: Synthetic oligonucleotide
  Target: SCN9A; (-) strand; PAM type: NRG; PAM sequence: TGG
atagcattgagaatttaatg

SEQ ID NO: 25020 - DNA, 20 bp, Artificial Sequence
  Description of Artificial Sequence: Synthetic oligonucleotide
  Target: SCN9A; (-) strand; PAM type: NRG; PAM sequence: GAG
taggtgataataatagcatt

SEQ ID NO: 25021 - DNA, 20 bp, Artificial Sequence
  Description of Artificial Sequence: Synthetic oligonucleotide
  Target: SCN9A; (-) strand; PAM type: NRG; PAM sequence: TAG
tgtatactaggtgataataa

SEQ ID NO: 25022 - DNA, 20 bp, Artificial Sequence
  Description of Artificial Sequence: Synthetic oligonucleotide
  Target: SCN9A; (-) strand; PAM type: NRG; PAM sequence: AGG
tttttatgatgttgtatact

SEQ ID NO: 25023 - DNA, 20 bp, Artificial Sequence
  Description of Artificial Sequence: Synthetic oligonucleotide
  Target: SCN9A; (-) strand; PAM type: NRG; PAM sequence: TAG
atttttatgatgttgtatac

SEQ ID NO: 25024 - DNA, 20 bp, Artificial Sequence
  Description of Artificial Sequence: Synthetic oligonucleotide
  Target: SCN9A; (-) strand; PAM type: NRG; PAM sequence: AAG
tatttactccagttataaga

SEQ ID NO: 25025 - DNA, 20 bp, Artificial Sequence
  Description of Artificial Sequence: Synthetic oligonucleotide
  Target: SCN9A; (-) strand; PAM type: NRG; PAM sequence: AAG
taattatttactccagttat

SEQ ID NO: 25026 - DNA, 20 bp, Artificial Sequence
  Description of Artificial Sequence: Synthetic oligonucleotide
  Target: SCN9A; (-) strand; PAM type: NRG; PAM sequence: CAG
ttgttcataattatttactc

SEQ ID NO: 25027 - DNA, 20 bp, Artificial Sequence
  Description of Artificial Sequence: Synthetic oligonucleotide
  Target: SCN9A; (-) strand; PAM type: NRG; PAM sequence: AGG
attggaggagttctcttaat

SEQ ID NO: 25028 - DNA, 20 bp, Artificial Sequence
  Description of Artificial Sequence: Synthetic oligonucleotide
  Target: SCN9A; (-) strand; PAM type: NRG; PAM sequence: TAG
gattggaggagttctcttaa

SEQ ID NO: 25029 - DNA, 20 bp, Artificial Sequence
  Description of Artificial Sequence: Synthetic oligonucleotide
  Target: SCN9A; (-) strand; PAM type: NRG; PAM sequence: GAG
taggccaacatagattggag

SEQ ID NO: 25030 - DNA, 20 bp, Artificial Sequence
  Description of Artificial Sequence: Synthetic oligonucleotide
  Target: SCN9A; (-) strand; PAM type: NRG; PAM sequence: AGG
tctaggccaacatagattgg

SEQ ID NO: 25031 - DNA, 20 bp, Artificial Sequence
  Description of Artificial Sequence: Synthetic oligonucleotide
  Target: SCN9A; (-) strand; PAM type: NRG; PAM sequence: GAG
ctctaggccaacatagattg

SEQ ID NO: 25032 - DNA, 20 bp, Artificial Sequence
  Description of Artificial Sequence: Synthetic oligonucleotide
  Target: SCN9A; (-) strand; PAM type: NRG; PAM sequence: TGG
gcctctaggccaacatagat

SEQ ID NO: 25033 - DNA, 20 bp, Artificial Sequence
  Description of Artificial Sequence: Synthetic oligonucleotide
  Target: SCN9A; (-) strand; PAM type: NRG; PAM sequence: TAG
ataatgcctctaggccaaca

SEQ ID NO: 25034 - DNA, 20 bp, Artificial Sequence
  Description of Artificial Sequence: Synthetic oligonucleotide
  Target: SCN9A; (-) strand; PAM type: NRG; PAM sequence: AGG
ctggtgggaataatgcctct

SEQ ID NO: 25035 - DNA, 20 bp, Artificial Sequence
  Description of Artificial Sequence: Synthetic oligonucleotide
  Target: SCN9A; (-) strand; PAM type: NRG; PAM sequence: TAG
cctggtgggaataatgcctc

SEQ ID NO: 25036 - DNA, 20 bp, Artificial Sequence
  Description of Artificial Sequence: Synthetic oligonucleotide
  Target: SCN9A; (-) strand; PAM type: NRG; PAM sequence: GGG
atcaaactcctggacctggt

SEQ ID NO: 25037 - DNA, 20 bp, Artificial Sequence
  Description of Artificial Sequence: Synthetic oligonucleotide
  Target: SCN9A; (-) strand; PAM type: NRG; PAM sequence: TGG
tatcaaactcctggacctgg

SEQ ID NO: 25038 - DNA, 20 bp, Artificial Sequence
  Description of Artificial Sequence: Synthetic oligonucleotide
  Target: SCN9A; (-) strand; PAM type: NRG; PAM sequence: TGG
tgttatcaaactcctggacc

SEQ ID NO: 25039 - DNA, 20 bp, Artificial Sequence
  Description of Artificial Sequence: Synthetic oligonucleotide
  Target: SCN9A; (-) strand; PAM type: NRG; PAM sequence: TGG
tgaaactgttatcaaactcc

SEQ ID NO: 25040 - DNA, 20 bp, Artificial Sequence
  Description of Artificial Sequence: Synthetic oligonucleotide
  Target: SCN9A; (-) strand; PAM type: NRG; PAM sequence: GAG
agtttaaataacatgttttt

SEQ ID NO: 25041 - DNA, 20 bp, Artificial Sequence
  Description of Artificial Sequence: Synthetic oligonucleotide
  Target: SCN9A; (-) strand; PAM type: NRG; PAM sequence: CAG
ctaatttagatgaattcaat

SEQ ID NO: 25042 - DNA, 20 bp, Artificial Sequence
  Description of Artificial Sequence: Synthetic oligonucleotide
  Target: SCN9A; (-) strand; PAM type: NRG; PAM sequence: TAG
tattttaaattaaactaatt

SEQ ID NO: 25043 - DNA, 20 bp, Artificial Sequence
  Description of Artificial Sequence: Synthetic oligonucleotide
  Target: SCN9A; (-) strand; PAM type: NRG; PAM sequence: CAG
ctatagttttatagaatatt

SEQ ID NO: 25044 - DNA, 20 bp, Artificial Sequence
  Description of Artificial Sequence: Synthetic oligonucleotide
  Target: SCN9A; (-) strand; PAM type: NRG; PAM sequence: TAG
aagcctattctatagtttta

SEQ ID NO: 25045 - DNA, 20 bp, Artificial Sequence
  Description of Artificial Sequence: Synthetic oligonucleotide
  Target: SCN9A; (-) strand; PAM type: NRG; PAM sequence: TAG
atactttaaagcctattcta

SEQ ID NO: 25046 - DNA, 20 bp, Artificial Sequence
  Description of Artificial Sequence: Synthetic oligonucleotide
  Target: SCN9A; (-) strand; PAM type: NRG; PAM sequence: AAG
attctatagtttatacttta

SEQ ID NO: 25047 - DNA, 20 bp, Artificial Sequence
  Description of Artificial Sequence: Synthetic oligonucleotide
  Target: SCN9A; (-) strand; PAM type: NRG; PAM sequence: TAG
atattttaaaactcattcta

SEQ ID NO: 25048 - DNA, 20 bp, Artificial Sequence
  Description of Artificial Sequence: Synthetic oligonucleotide
  Target: SCN9A; (-) strand; PAM type: NRG; PAM sequence: TGG
gtttatccaacatcgtttcc

SEQ ID NO: 25049 - DNA, 20 bp, Artificial Sequence
  Description of Artificial Sequence: Synthetic oligonucleotide
  Target: SCN9A; (-) strand; PAM type: NRG; PAM sequence: AAG
aaatacatattagtaattat

SEQ ID NO: 25050 - DNA, 20 bp, Artificial Sequence
  Description of Artificial Sequence: Synthetic oligonucleotide
  Target: SCN9A; (-) strand; PAM type: NRG; PAM sequence: TAG
aattggcacaaaatacatat

SEQ ID NO: 25051 - DNA, 20 bp, Artificial Sequence
  Description of Artificial Sequence: Synthetic oligonucleotide
  Target: SCN9A; (-) strand; PAM type: NRG; PAM sequence: TGG
actttggattttgtggcaat

SEQ ID NO: 25052 - DNA, 20 bp, Artificial Sequence
  Description of Artificial Sequence: Synthetic oligonucleotide
  Target: SCN9A; (-) strand; PAM type: NRG; PAM sequence: TGG
atatggtactttggattttg

SEQ ID NO: 25053 - DNA, 20 bp, Artificial Sequence
  Description of Artificial Sequence: Synthetic oligonucleotide
  Target: SCN9A; (-) strand; PAM type: NRG; PAM sequence: TGG
gtcttctaaatatggtactt

SEQ ID NO: 25054 - DNA, 20 bp, Artificial Sequence
  Description of Artificial Sequence: Synthetic oligonucleotide
  Target: SCN9A; (-) strand; PAM type: NRG; PAM sequence: TGG
aaactgtagtcttctaaata

SEQ ID NO: 25055 - DNA, 20 bp, Artificial Sequence
  Description of Artificial Sequence: Synthetic oligonucleotide
  Target: SCN9A; (-) strand; PAM type: NRG; PAM sequence: TAG
aattgaagccattaaaactg

SEQ ID NO: 25056 - DNA, 20 bp, Artificial Sequence
  Description of Artificial Sequence: Synthetic oligonucleotide
  Target: SCN9A; (-) strand; PAM type: NRG; PAM sequence: AAG
agccgagaggtcaggaattg

SEQ ID NO: 25057 - DNA, 20 bp, Artificial Sequence
  Description of Artificial Sequence: Synthetic oligonucleotide
  Target: SCN9A; (-) strand; PAM type: NRG; PAM sequence: AGG
tcacgtgcagccgagaggtc

SEQ ID NO: 25058 - DNA, 20 bp, Artificial Sequence
  Description of Artificial Sequence: Synthetic oligonucleotide
  Target: SCN9A; (-) strand; PAM type: NRG; PAM sequence: CAG
ttcacgtgcagccgagaggt

SEQ ID NO: 25059 - DNA, 20 bp, Artificial Sequence
  Description of Artificial Sequence: Synthetic oligonucleotide
  Target: SCN9A; (-) strand; PAM type: NRG; PAM sequence: AGG
atagttcacgtgcagccgag

SEQ ID NO: 25060 - DNA, 20 bp, Artificial Sequence
  Description of Artificial Sequence: Synthetic oligonucleotide
  Target: SCN9A; (-) strand; PAM type: NRG; PAM sequence: GAG
gatagttcacgtgcagccga

SEQ ID NO: 25061 - DNA, 20 bp, Artificial Sequence
  Description of Artificial Sequence: Synthetic oligonucleotide
  Target: SCN9A; (-) strand; PAM type: NRG; PAM sequence: GAG
gtgatagttcacgtgcagcc

SEQ ID NO: 25062 - DNA, 20 bp, Artificial Sequence
  Description of Artificial Sequence: Synthetic oligonucleotide
  Target: SCN9A; (-) strand; PAM type: NRG; PAM sequence: CAG
ctctggtgatagttcacgtg

SEQ ID NO: 25063 - DNA, 20 bp, Artificial Sequence
  Description of Artificial Sequence: Synthetic oligonucleotide
  Target: SCN9A; (-) strand; PAM type: NRG; PAM sequence: TAG
gtctttcacttctctggtga

SEQ ID NO: 25064 - DNA, 20 bp, Artificial Sequence
  Description of Artificial Sequence: Synthetic oligonucleotide
  Target: SCN9A; (-) strand; PAM type: NRG; PAM sequence: TGG
ggccttgtctttcacttctc

SEQ ID NO: 25065 - DNA, 20 bp, Artificial Sequence
  Description of Artificial Sequence: Synthetic oligonucleotide
  Target: SCN9A; (-) strand; PAM type: NRG; PAM sequence: GGG
cttaacttcacagaataata

SEQ ID NO: 25066 - DNA, 20 bp, Artificial Sequence
  Description of Artificial Sequence: Synthetic oligonucleotide
  Target: SCN9A; (-) strand; PAM type: NRG; PAM sequence: AGG
tcttaacttcacagaataat

SEQ ID NO: 25067 - DNA, 20 bp, Artificial Sequence
  Description of Artificial Sequence: Synthetic oligonucleotide
  Target: SCN9A; (-) strand; PAM type: NRG; PAM sequence: TAG
gtcttaacttcacagaataa

SEQ ID NO: 25068 - DNA, 20 bp, Artificial Sequence
  Description of Artificial Sequence: Synthetic oligonucleotide
  Target: SCN9A; (-) strand; PAM type: NRG; PAM sequence: CAG
agggcctggtcttaacttca

SEQ ID NO: 25069 - DNA, 20 bp, Artificial Sequence
  Description of Artificial Sequence: Synthetic oligonucleotide
  Target: SCN9A; (-) strand; PAM type: NRG; PAM sequence: TGG
tttttcagaaatgaagggcc

SEQ ID NO: 25070 - DNA, 20 bp, Artificial Sequence
  Description of Artificial Sequence: Synthetic oligonucleotide
  Target: SCN9A; (-) strand; PAM type: NRG; PAM sequence: GGG
attcttttttcagaaatgaa

SEQ ID NO: 25071 - DNA, 20 bp, Artificial Sequence
  Description of Artificial Sequence: Synthetic oligonucleotide
  Target: SCN9A; (-) strand; PAM type: NRG; PAM sequence: AGG
aattcttttttcagaaatga

SEQ ID NO: 25072 - DNA, 20 bp, Artificial Sequence
  Description of Artificial Sequence: Synthetic oligonucleotide
  Target: SCN9A; (-) strand; PAM type: NRG; PAM sequence: AAG
taattcttttttcagaaatg

SEQ ID NO: 25073 - DNA, 20 bp, Artificial Sequence
  Description of Artificial Sequence: Synthetic oligonucleotide
  Target: SCN9A; (-) strand; PAM type: NRG; PAM sequence: CAG
caggccaataattctttttt

SEQ ID NO: 25074 - DNA, 20 bp, Artificial Sequence
  Description of Artificial Sequence: Synthetic oligonucleotide
  Target: SCN9A; (-) strand; PAM type: NRG; PAM sequence: AGG
actgctttacctcaaaaccc

SEQ ID NO: 25075 - DNA, 20 bp, Artificial Sequence
  Description of Artificial Sequence: Synthetic oligonucleotide
  Target: SCN9A; (-) strand; PAM type: NRG; PAM sequence: CAG
cactgctttacctcaaaacc

SEQ ID NO: 25076 - DNA, 20 bp, Artificial Sequence
  Description of Artificial Sequence: Synthetic oligonucleotide
  Target: SCN9A; (-) strand; PAM type: NRG; PAM sequence: CAG
gtgctttgtattctttctat

SEQ ID NO: 25077 - DNA, 20 bp, Artificial Sequence
  Description of Artificial Sequence: Synthetic oligonucleotide
  Target: SCN9A; (-) strand; PAM type: NRG; PAM sequence: GGG
tattgtgtctaatagcaggg

SEQ ID NO: 25078 - DNA, 20 bp, Artificial Sequence
  Description of Artificial Sequence: Synthetic oligonucleotide
  Target: SCN9A; (-) strand; PAM type: NRG; PAM sequence: GGG
atattgtgtctaatagcagg

SEQ ID NO: 25079 - DNA, 20 bp, Artificial Sequence
  Description of Artificial Sequence: Synthetic oligonucleotide
  Target: SCN9A; (-) strand; PAM type: NRG; PAM sequence: GGG
aatattgtgtctaatagcag

SEQ ID NO: 25080 - DNA, 20 bp, Artificial Sequence
  Description of Artificial Sequence: Synthetic oligonucleotide
  Target: SCN9A; (-) strand; PAM type: NRG; PAM sequence: GGG
taatattgtgtctaatagca

SEQ ID NO: 25081 - DNA, 20 bp, Artificial Sequence
  Description of Artificial Sequence: Synthetic oligonucleotide
  Target: SCN9A; (-) strand; PAM type: NRG; PAM sequence: AGG
ttaatattgtgtctaatagc

SEQ ID NO: 25082 - DNA, 20 bp, Artificial Sequence
  Description of Artificial Sequence: Synthetic oligonucleotide
  Target: SCN9A; (-) strand; PAM type: NRG; PAM sequence: CAG
gttaatattgtgtctaatag

SEQ ID NO: 25083 - DNA, 20 bp, Artificial Sequence
  Description of Artificial Sequence: Synthetic oligonucleotide
  Target: SCN9A; (-) strand; PAM type: NRG; PAM sequence: TAG
attgttaatattgtgtctaa

SEQ ID NO: 25084 - DNA, 20 bp, Artificial Sequence
  Description of Artificial Sequence: Synthetic oligonucleotide
  Target: SCN9A; (-) strand; PAM type: NRG; PAM sequence: GAG
taaaagttgttaccagctca

SEQ ID NO: 25085 - DNA, 20 bp, Artificial Sequence
  Description of Artificial Sequence: Synthetic oligonucleotide
  Target: SCN9A; (-) strand; PAM type: NRG; PAM sequence: CAG
tttaaaagttgttaccagct

SEQ ID NO: 25086 - DNA, 20 bp, Artificial Sequence
  Description of Artificial Sequence: Synthetic oligonucleotide
  Target: SCN9A; (-) strand; PAM type: NRG; PAM sequence: CAG
ttttatttaaaagttgttac

SEQ ID NO: 25087 - DNA, 20 bp, Artificial Sequence
  Description of Artificial Sequence: Synthetic oligonucleotide
  Target: SCN9A; (-) strand; PAM type: NRG; PAM sequence: AAG
ataagaatcattttatttaa

SEQ ID NO: 25088 - DNA, 20 bp, Artificial Sequence
  Description of Artificial Sequence: Synthetic oligonucleotide
  Target: SCN9A; (-) strand; PAM type: NRG; PAM sequence: AAG
aaagtcagaattctgcaaat

SEQ ID NO: 25089 - DNA, 20 bp, Artificial Sequence
  Description of Artificial Sequence: Synthetic oligonucleotide
  Target: SCN9A; (-) strand; PAM type: NRG; PAM sequence: CAG
ttcatgaatttagctaaagt

SEQ ID NO: 25090 - DNA, 20 bp, Artificial Sequence
  Description of Artificial Sequence: Synthetic oligonucleotide
  Target: SCN9A; (-) strand; PAM type: NRG; PAM sequence: AAG
tgctttcatgaatttagcta

SEQ ID NO: 25091 - DNA, 20 bp, Artificial Sequence
  Description of Artificial Sequence: Synthetic oligonucleotide
  Target: SCN9A; (-) strand; PAM type: NRG; PAM sequence: TAG
tgaagatgctttcatgaatt

SEQ ID NO: 25092 - DNA, 20 bp, Artificial Sequence
  Description of Artificial Sequence: Synthetic oligonucleotide
  Target: SCN9A; (-) strand; PAM type: NRG; PAM sequence: AAG
aaaccaattattgatgtttg

SEQ ID NO: 25093 - DNA, 20 bp, Artificial Sequence
  Description of Artificial Sequence: Synthetic oligonucleotide
  Target: SCN9A; (-) strand; PAM type: NRG; PAM sequence: GAG
ttaatgctctcttaaacagt

SEQ ID NO: 25094 - DNA, 20 bp, Artificial Sequence
  Description of Artificial Sequence: Synthetic oligonucleotide
  Target: SCN9A; (-) strand; PAM type: NRG; PAM sequence: CAG
tttgttaatgctctcttaaa

SEQ ID NO: 25095 - DNA, 20 bp, Artificial Sequence
  Description of Artificial Sequence: Synthetic oligonucleotide
  Target: SCN9A; (-) strand; PAM type: NRG; PAM sequence: TGG
tacttgctcataatctaatt

SEQ ID NO: 25096 - DNA, 20 bp, Artificial Sequence
  Description of Artificial Sequence: Synthetic oligonucleotide
  Target: SCN9A; (-) strand; PAM type: NRG; PAM sequence: AAG
tgaaaaaaagtttcaacaac

SEQ ID NO: 25097 - DNA, 20 bp, Artificial Sequence
  Description of Artificial Sequence: Synthetic oligonucleotide
  Target: SCN9A; (-) strand; PAM type: NRG; PAM sequence: AAG
taaaacctgcatatgaaaaa

SEQ ID NO: 25098 - DNA, 20 bp, Artificial Sequence
  Description of Artificial Sequence: Synthetic oligonucleotide
  Target: SCN9A; (-) strand; PAM type: NRG; PAM sequence: AAG
atgatgtaaaattctgtgcc

SEQ ID NO: 25099 - DNA, 20 bp, Artificial Sequence
  Description of Artificial Sequence: Synthetic oligonucleotide
  Target: SCN9A; (-) strand; PAM type: NRG; PAM sequence: TAG
aaatacaaattaattaataa

SEQ ID NO: 25100 - DNA, 20 bp, Artificial Sequence
  Description of Artificial Sequence: Synthetic oligonucleotide
  Target: SCN9A; (-) strand; PAM type: NRG; PAM sequence: TAG
ttgaatgtctaagaatctat

SEQ ID NO: 25101 - DNA, 20 bp, Artificial Sequence
  Description of Artificial Sequence: Synthetic oligonucleotide
  Target: SCN9A; (-) strand; PAM type: NRG; PAM sequence: AAG
caagaaaacattgaatgtct

SEQ ID NO: 25102 - DNA, 20 bp, Artificial Sequence
  Description of Artificial Sequence: Synthetic oligonucleotide
  Target: SCN9A; (-) strand; PAM type: NRG; PAM sequence: AAG
tgaatacttaatgcattccc

SEQ ID NO: 25103 - DNA, 20 bp, Artificial Sequence
  Description of Artificial Sequence: Synthetic oligonucleotide
  Target: SCN9A; (-) strand; PAM type: NRG; PAM sequence: TAG
ttttatatacagtatggaaa

SEQ ID NO: 25104 - DNA, 20 bp, Artificial Sequence
  Description of Artificial Sequence: Synthetic oligonucleotide
  Target: SCN9A; (-) strand; PAM type: NRG; PAM sequence: TGG
atttaattttatatacagta

SEQ ID NO: 25105 - DNA, 20 bp, Artificial Sequence
  Description of Artificial Sequence: Synthetic oligonucleotide
  Target: SCN9A; (-) strand; PAM type: NRG; PAM sequence: CAG
taaacatttaattttatata

SEQ ID NO: 25106 - DNA, 20 bp, Artificial Sequence
  Description of Artificial Sequence: Synthetic oligonucleotide
  Target: SCN9A; (-) strand; PAM type: NRG; PAM sequence: AAG
tagaactgtctatattgcta

SEQ ID NO: 25107 - DNA, 20 bp, Artificial Sequence
  Description of Artificial Sequence: Synthetic oligonucleotide
  Target: SCN9A; (-) strand; PAM type: NRG; PAM sequence: TAG
atttcaaaggctgaattgac

SEQ ID NO: 25108 - DNA, 20 bp, Artificial Sequence
  Description of Artificial Sequence: Synthetic oligonucleotide
  Target: SCN9A; (-) strand; PAM type: NRG; PAM sequence: AGG
gtagcaagtatagatttcaa

SEQ ID NO: 25109 - DNA, 20 bp, Artificial Sequence
  Description of Artificial Sequence: Synthetic oligonucleotide
  Target: SCN9A; (-) strand; PAM type: NRG; PAM sequence: AAG
tgtagcaagtatagatttca

SEQ ID NO: 25110 - DNA, 20 bp, Artificial Sequence
  Description of Artificial Sequence: Synthetic oligonucleotide
  Target: SCN9A; (-) strand; PAM type: NRG; PAM sequence: TAG
agcttatactgtagcaagta

SEQ ID NO: 25111 - DNA, 20 bp, Artificial Sequence
  Description of Artificial Sequence: Synthetic oligonucleotide
  Target: SCN9A; (-) strand; PAM type: NRG; PAM sequence: AAG
aaagaagcttatactgtagc

SEQ ID NO: 25112 - DNA, 20 bp, Artificial Sequence
  Description of Artificial Sequence: Synthetic oligonucleotide
  Target: SCN9A; (-) strand; PAM type: NRG; PAM sequence: TAG
tgctaaagaagcttatactg

SEQ ID NO: 25113 - DNA, 20 bp, Artificial Sequence
  Description of Artificial Sequence: Synthetic oligonucleotide
  Target: SCN9A; (-) strand; PAM type: NRG; PAM sequence: AAG
ctcttagaaatctgctaaag

SEQ ID NO: 25114 - DNA, 20 bp, Artificial Sequence
  Description of Artificial Sequence: Synthetic oligonucleotide
  Target: SCN9A; (-) strand; PAM type: NRG; PAM sequence: AAG
attctcttagaaatctgcta

SEQ ID NO: 25115 - DNA, 20 bp, Artificial Sequence
  Description of Artificial Sequence: Synthetic oligonucleotide
  Target: SCN9A; (-) strand; PAM type: NRG; PAM sequence: TAG
tctatataaaggtattctct

SEQ ID NO: 25116 - DNA, 20 bp, Artificial Sequence
  Description of Artificial Sequence: Synthetic oligonucleotide
  Target: SCN9A; (-) strand; PAM type: NRG; PAM sequence: AGG
atatcagcctttctatataa

SEQ ID NO: 25117 - DNA, 20 bp, Artificial Sequence
  Description of Artificial Sequence: Synthetic oligonucleotide
  Target: SCN9A; (-) strand; PAM type: NRG; PAM sequence: AAG
tatatcagcctttctatata

SEQ ID NO: 25118 - DNA, 20 bp, Artificial Sequence
  Description of Artificial Sequence: Synthetic oligonucleotide
  Target: SCN9A; (-) strand; PAM type: NRG; PAM sequence: CAG
aaaaactttattatatatat

SEQ ID NO: 25119 - DNA, 20 bp, Artificial Sequence
  Description of Artificial Sequence: Synthetic oligonucleotide
  Target: SCN9A; (-) strand; PAM type: NRG; PAM sequence: AGG
aattcaatatatttcaccgc

SEQ ID NO: 25120 - DNA, 20 bp, Artificial Sequence
  Description of Artificial Sequence: Synthetic oligonucleotide
  Target: SCN9A; (-) strand; PAM type: NRG; PAM sequence: CAG
gaattcaatatatttcaccg

SEQ ID NO: 25121 - DNA, 20 bp, Artificial Sequence
  Description of Artificial Sequence: Synthetic oligonucleotide
  Target: SCN9A; (-) strand; PAM type: NRG; PAM sequence: GAG
aatatggtgatgcctactgt

SEQ ID NO: 25122 - DNA, 20 bp, Artificial Sequence
  Description of Artificial Sequence: Synthetic oligonucleotide
  Target: SCN9A; (-) strand; PAM type: NRG; PAM sequence: TGG
atattcaaagtacttaaata

SEQ ID NO: 25123 - DNA, 20 bp, Artificial Sequence
  Description of Artificial Sequence: Synthetic oligonucleotide
  Target: SCN9A; (-) strand; PAM type: NRG; PAM sequence: AAG
tagtaaaaaacatatattca

SEQ ID NO: 25124 - DNA, 20 bp, Artificial Sequence
  Description of Artificial Sequence: Synthetic oligonucleotide
  Target: SCN9A; (-) strand; PAM type: NRG; PAM sequence: TAG
ttgatatgatcttccttgta

SEQ ID NO: 25125 - DNA, 20 bp, Artificial Sequence
  Description of Artificial Sequence: Synthetic oligonucleotide
  Target: SCN9A; (-) strand; PAM type: NRG; PAM sequence: TAG
ttaaagaaatgaagataata

SEQ ID NO: 25126 - DNA, 20 bp, Artificial Sequence
  Description of Artificial Sequence: Synthetic oligonucleotide
  Target: SCN9A; (-) strand; PAM type: NRG; PAM sequence: AAG
tgattgagtttaaagaaatg

SEQ ID NO: 25127 - DNA, 20 bp, Artificial Sequence
  Description of Artificial Sequence: Synthetic oligonucleotide
  Target: SCN9A; (-) strand; PAM type: NRG; PAM sequence: AAG
acaacagatgattgagttta

SEQ ID NO: 25128 - DNA, 20 bp, Artificial Sequence
  Description of Artificial Sequence: Synthetic oligonucleotide
  Target: SCN9A; (-) strand; PAM type: NRG; PAM sequence: GAG
aaactaaacaacagatgatt

SEQ ID NO: 25129 - DNA, 20 bp, Artificial Sequence
  Description of Artificial Sequence: Synthetic oligonucleotide
  Target: SCN9A; (-) strand; PAM type: NRG; PAM sequence: CAG
ttacatggaaaactaaacaa

SEQ ID NO: 25130 - DNA, 20 bp, Artificial Sequence
  Description of Artificial Sequence: Synthetic oligonucleotide
  Target: SCN9A; (-) strand; PAM type: NRG; PAM sequence: TGG
ctttcatttccaaaattaca

SEQ ID NO: 25131 - DNA, 20 bp, Artificial Sequence
  Description of Artificial Sequence: Synthetic oligonucleotide
  Target: SCN9A; (-) strand; PAM type: NRG; PAM sequence: TAG
tttatttcacttctctaata

SEQ ID NO: 25132 - DNA, 20 bp, Artificial Sequence
  Description of Artificial Sequence: Synthetic oligonucleotide
  Target: SCN9A; (-) strand; PAM type: NRG; PAM sequence: AAG
aagaaatttctttcatacta

SEQ ID NO: 25133 - DNA, 20 bp, Artificial Sequence
  Description of Artificial Sequence: Synthetic oligonucleotide
  Target: SCN9A; (-) strand; PAM type: NRG; PAM sequence: AAG
ggtcctatttataatagcaa

SEQ ID NO: 25134 - DNA, 20 bp, Artificial Sequence
  Description of Artificial Sequence: Synthetic oligonucleotide
  Target: SCN9A; (-) strand; PAM type: NRG; PAM sequence: TAG
acagaaggtcctatttataa

SEQ ID NO: 25135 - DNA, 20 bp, Artificial Sequence
  Description of Artificial Sequence: Synthetic oligonucleotide
  Target: SCN9A; (-) strand; PAM type: NRG; PAM sequence: AGG
atccatgtgaaaattacaga

SEQ ID NO: 25136 - DNA, 20 bp, Artificial Sequence
  Description of Artificial Sequence: Synthetic oligonucleotide
  Target: SCN9A; (-) strand; PAM type: NRG; PAM sequence: AAG
aatccatgtgaaaattacag

SEQ ID NO: 25137 - DNA, 20 bp, Artificial Sequence
  Description of Artificial Sequence: Synthetic oligonucleotide
  Target: SCN9A; (-) strand; PAM type: NRG; PAM sequence: CAG
tcaaatccatgtgaaaatta

SEQ ID NO: 25138 - DNA, 20 bp, Artificial Sequence
  Description of Artificial Sequence: Synthetic oligonucleotide
  Target: SCN9A; (-) strand; PAM type: NRG; PAM sequence: TAG
aattgatacttcccttttat

SEQ ID NO: 25139 - DNA, 20 bp, Artificial Sequence
  Description of Artificial Sequence: Synthetic oligonucleotide
  Target: SCN9A; (-) strand; PAM type: NRG; PAM sequence: TAG
atatttactttatttataac

SEQ ID NO: 25140 - DNA, 20 bp, Artificial Sequence
  Description of Artificial Sequence: Synthetic oligonucleotide
  Target: SCN9A; (-) strand; PAM type: NRG; PAM sequence: GAG
ttctgattcctaatactagt

SEQ ID NO: 25141 - DNA, 20 bp, Artificial Sequence
  Description of Artificial Sequence: Synthetic oligonucleotide
  Target: SCN9A; (-) strand; PAM type: NRG; PAM sequence: TAG
acacttctgattcctaatac

SEQ ID NO: 25142 - DNA, 20 bp, Artificial Sequence
  Description of Artificial Sequence: Synthetic oligonucleotide
  Target: SCN9A; (-) strand; PAM type: NRG; PAM sequence: TGG
aaaggcaggaatgctaatta

SEQ ID NO: 25143 - DNA, 20 bp, Artificial Sequence
  Description of Artificial Sequence: Synthetic oligonucleotide
  Target: SCN9A; (-) strand; PAM type: NRG; PAM sequence: AGG
atattattcaataaaaaggc

SEQ ID NO: 25144 - DNA, 20 bp, Artificial Sequence
  Description of Artificial Sequence: Synthetic oligonucleotide
  Target: SCN9A; (-) strand; PAM type: NRG; PAM sequence: CAG
catattattcaataaaaagg

SEQ ID NO: 25145 - DNA, 20 bp, Artificial Sequence
  Description of Artificial Sequence: Synthetic oligonucleotide
  Target: SCN9A; (-) strand; PAM type: NRG; PAM sequence: AGG
tatcatattattcaataaaa

SEQ ID NO: 25146 - DNA, 20 bp, Artificial Sequence
  Description of Artificial Sequence: Synthetic oligonucleotide
  Target: SCN9A; (-) strand; PAM type: NRG; PAM sequence: AAG
atatcatattattcaataaa

SEQ ID NO: 25147 - DNA, 20 bp, Artificial Sequence
  Description of Artificial Sequence: Synthetic oligonucleotide
  Target: SCN9A; (-) strand; PAM type: NRG; PAM sequence: CAG
taaaacacttttagaaggca

SEQ ID NO: 25148 - DNA, 20 bp, Artificial Sequence
  Description of Artificial Sequence: Synthetic oligonucleotide
  Target: SCN9A; (-) strand; PAM type: NRG; PAM sequence: AGG
atttttaaaacacttttaga

SEQ ID NO: 25149 - DNA, 20 bp, Artificial Sequence
  Description of Artificial Sequence: Synthetic oligonucleotide
  Target: SCN9A; (-) strand; PAM type: NRG; PAM sequence: AAG
tatttttaaaacacttttag

SEQ ID NO: 25150 - DNA, 20 bp, Artificial Sequence
  Description of Artificial Sequence: Synthetic oligonucleotide
  Target: SCN9A; (-) strand; PAM type: NRG; PAM sequence: TAG
tcatatttttaaaacacttt

SEQ ID NO: 25151 - DNA, 20 bp, Artificial Sequence
  Description of Artificial Sequence: Synthetic oligonucleotide
  Target: SCN9A; (-) strand; PAM type: NRG; PAM sequence: GAG
attatacatttaaaatgttt

SEQ ID NO: 25152 - DNA, 20 bp, Artificial Sequence
  Description of Artificial Sequence: Synthetic oligonucleotide
  Target: SCN9A; (-) strand; PAM type: NRG; PAM sequence: GGG
tgaatcaaggagatagtgga

SEQ ID NO: 25153 - DNA, 20 bp, Artificial Sequence
  Description of Artificial Sequence: Synthetic oligonucleotide
  Target: SCN9A; (-) strand; PAM type: NRG; PAM sequence: AGG
ttgaatcaaggagatagtgg

SEQ ID NO: 25154 - DNA, 20 bp, Artificial Sequence
  Description of Artificial Sequence: Synthetic oligonucleotide
  Target: SCN9A; (-) strand; PAM type: NRG; PAM sequence: GAG
gttgaatcaaggagatagtg

SEQ ID NO: 25155 - DNA, 20 bp, Artificial Sequence
  Description of Artificial Sequence: Synthetic oligonucleotide
  Target: SCN9A; (-) strand; PAM type: NRG; PAM sequence: TGG
gggttgaatcaaggagatag

SEQ ID NO: 25156 - DNA, 20 bp, Artificial Sequence
  Description of Artificial Sequence: Synthetic oligonucleotide
  Target: SCN9A; (-) strand; PAM type: NRG; PAM sequence: TAG
agggggttgaatcaaggaga

SEQ ID NO: 25157 - DNA, 20 bp, Artificial Sequence
  Description of Artificial Sequence: Synthetic oligonucleotide
  Target: SCN9A; (-) strand; PAM type: NRG; PAM sequence: GAG
ctcaagggggttgaatcaag

SEQ ID NO: 25158 - DNA, 20 bp, Artificial Sequence
  Description of Artificial Sequence: Synthetic oligonucleotide
  Target: SCN9A; (-) strand; PAM type: NRG; PAM sequence: AGG
acctcaagggggttgaatca

SEQ ID NO: 25159 - DNA, 20 bp, Artificial Sequence
  Description of Artificial Sequence: Synthetic oligonucleotide
  Target: SCN9A; (-) strand; PAM type: NRG; PAM sequence: AAG
tacctcaagggggttgaatc

SEQ ID NO: 25160 - DNA, 20 bp, Artificial Sequence
  Description of Artificial Sequence: Synthetic oligonucleotide
  Target: SCN9A; (-) strand; PAM type: NRG; PAM sequence: GGG
ctctctcgattacctcaagg

SEQ ID NO: 25161 - DNA, 20 bp, Artificial Sequence
  Description of Artificial Sequence: Synthetic oligonucleotide
  Target: SCN9A; (-) strand; PAM type: NRG; PAM sequence: GGG
tctctctcgattacctcaag

SEQ ID NO: 25162 - DNA, 20 bp, Artificial Sequence
  Description of Artificial Sequence: Synthetic oligonucleotide
  Target: SCN9A; (-) strand; PAM type: NRG; PAM sequence: GGG
ctctctctcgattacctcaa

SEQ ID NO: 25163 - DNA, 20 bp, Artificial Sequence
  Description of Artificial Sequence: Synthetic oligonucleotide
  Target: SCN9A; (-) strand; PAM type: NRG; PAM sequence: AGG
tctctctctcgattacctca

SEQ ID NO: 25164 - DNA, 20 bp, Artificial Sequence
  Description of Artificial Sequence: Synthetic oligonucleotide
  Target: SCN9A; (-) strand; PAM type: NRG; PAM sequence: AAG
ttctctctctcgattacctc

SEQ ID NO: 25165 - DNA, 20 bp, Artificial Sequence
  Description of Artificial Sequence: Synthetic oligonucleotide
  Target: SCN9A; (-) strand; PAM type: NRG; PAM sequence: AAG
tgcacactgaaaaatatgga

SEQ ID NO: 25166 - DNA, 20 bp, Artificial Sequence
  Description of Artificial Sequence: Synthetic oligonucleotide
  Target: SCN9A; (-) strand; PAM type: NRG; PAM sequence: TGG
tggatgcacactgaaaaata

SEQ ID NO: 25167 - DNA, 20 bp, Artificial Sequence
  Description of Artificial Sequence: Synthetic oligonucleotide
  Target: SCN9A; (-) strand; PAM type: NRG; PAM sequence: TGG
ttcacagctatagtgttgta

SEQ ID NO: 25168 - DNA, 20 bp, Artificial Sequence
  Description of Artificial Sequence: Synthetic oligonucleotide
  Target: SCN9A; (-) strand; PAM type: NRG; PAM sequence: TAG
taaggattgtttcacagcta

SEQ ID NO: 25169 - DNA, 20 bp, Artificial Sequence
  Description of Artificial Sequence: Synthetic oligonucleotide
  Target: SCN9A; (-) strand; PAM type: NRG; PAM sequence: CAG
tcaagataaggattgtttca

SEQ ID NO: 25170 - DNA, 20 bp, Artificial Sequence
  Description of Artificial Sequence: Synthetic oligonucleotide
  Target: SCN9A; (-) strand; PAM type: NRG; PAM sequence: AGG
ataagtttacaatcaagata

SEQ ID NO: 25171 - DNA, 20 bp, Artificial Sequence
  Description of Artificial Sequence: Synthetic oligonucleotide
  Target: SCN9A; (-) strand; PAM type: NRG; PAM sequence: AAG
cataagtttacaatcaagat

SEQ ID NO: 25172 - DNA, 20 bp, Artificial Sequence
  Description of Artificial Sequence: Synthetic oligonucleotide
  Target: SCN9A; (-) strand; PAM type: NRG; PAM sequence: AAG
agctacataagtttacaatc

SEQ ID NO: 25173 - DNA, 20 bp, Artificial Sequence
  Description of Artificial Sequence: Synthetic oligonucleotide
  Target: SCN9A; (-) strand; PAM type: NRG; PAM sequence: AAG
agcatcttaaatagctacat

SEQ ID NO: 25174 - DNA, 20 bp, Artificial Sequence
  Description of Artificial Sequence: Synthetic oligonucleotide
  Target: SCN9A; (-) strand; PAM type: NRG; PAM sequence: TAG
ttgaaaaggagcatcttaaa

SEQ ID NO: 25175 - DNA, 20 bp, Artificial Sequence
  Description of Artificial Sequence: Synthetic oligonucleotide
  Target: SCN9A; (-) strand; PAM type: NRG; PAM sequence: GAG
tattttcagtaattgaaaag

SEQ ID NO: 25176 - DNA, 20 bp, Artificial Sequence
  Description of Artificial Sequence: Synthetic oligonucleotide
  Target: SCN9A; (-) strand; PAM type: NRG; PAM sequence: AGG
catattttcagtaattgaaa

SEQ ID NO: 25177 - DNA, 20 bp, Artificial Sequence
  Description of Artificial Sequence: Synthetic oligonucleotide
  Target: SCN9A; (-) strand; PAM type: NRG; PAM sequence: AAG
acatattttcagtaattgaa

SEQ ID NO: 25178 - DNA, 20 bp, Artificial Sequence
  Description of Artificial Sequence: Synthetic oligonucleotide
  Target: SCN9A; (-) strand; PAM type: NRG; PAM sequence: CAG
ttttaatttggacatatttt

SEQ ID NO: 25179 - DNA, 20 bp, Artificial Sequence
  Description of Artificial Sequence: Synthetic oligonucleotide
  Target: SCN9A; (-) strand; PAM type: NRG; PAM sequence: TGG
gaataataaagcttttaatt

SEQ ID NO: 25180 - DNA, 20 bp, Artificial Sequence
  Description of Artificial Sequence: Synthetic oligonucleotide
  Target: SCN9A; (-) strand; PAM type: NRG; PAM sequence: AAG
gaaaaccatgaagaataata

SEQ ID NO: 25181 - DNA, 20 bp, Artificial Sequence
  Description of Artificial Sequence: Synthetic oligonucleotide
  Target: SCN9A; (-) strand; PAM type: NRG; PAM sequence: AAG
caatcaaagggaaaaccatg

SEQ ID NO: 25182 - DNA, 20 bp, Artificial Sequence
  Description of Artificial Sequence: Synthetic oligonucleotide
  Target: SCN9A; (-) strand; PAM type: NRG; PAM sequence: GGG
acagcttcaaggcaatcaaa

SEQ ID NO: 25183 - DNA, 20 bp, Artificial Sequence
  Description of Artificial Sequence: Synthetic oligonucleotide
  Target: SCN9A; (-) strand; PAM type: NRG; PAM sequence: AGG
cacagcttcaaggcaatcaa

SEQ ID NO: 25184 - DNA, 20 bp, Artificial Sequence
  Description of Artificial Sequence: Synthetic oligonucleotide
  Target: SCN9A; (-) strand; PAM type: NRG; PAM sequence: AAG
acacagcttcaaggcaatca

SEQ ID NO: 25185 - DNA, 20 bp, Artificial Sequence
  Description of Artificial Sequence: Synthetic oligonucleotide
  Target: SCN9A; (-) strand; PAM type: NRG; PAM sequence: AGG
tagtagaaaacacagcttca

SEQ ID NO: 25186 - DNA, 20 bp, Artificial Sequence
  Description of Artificial Sequence: Synthetic oligonucleotide
  Target: SCN9A; (-) strand; PAM type: NRG; PAM sequence: AAG
atagtagaaaacacagcttc

SEQ ID NO: 25187 - DNA, 20 bp, Artificial Sequence
  Description of Artificial Sequence: Synthetic oligonucleotide
  Target: SCN9A; (-) strand; PAM type: NRG; PAM sequence: CAG
aagcagtatagtagaaaaca

SEQ ID NO: 25188 - DNA, 20 bp, Artificial Sequence
  Description of Artificial Sequence: Synthetic oligonucleotide
  Target: SCN9A; (-) strand; PAM type: NRG; PAM sequence: TAG
tttctactcaagcagtatag

SEQ ID NO: 25189 - DNA, 20 bp, Artificial Sequence
  Description of Artificial Sequence: Synthetic oligonucleotide
  Target: SCN9A; (-) strand; PAM type: NRG; PAM sequence: TAG
caatttctactcaagcagta

SEQ ID NO: 25190 - DNA, 20 bp, Artificial Sequence
  Description of Artificial Sequence: Synthetic oligonucleotide
  Target: SCN9A; (-) strand; PAM type: NRG; PAM sequence: CAG
taacacaatttctactcaag

SEQ ID NO: 25191 - DNA, 20 bp, Artificial Sequence
  Description of Artificial Sequence: Synthetic oligonucleotide
  Target: SCN9A; (-) strand; PAM type: NRG; PAM sequence: AAG
atttaacacaatttctactc

SEQ ID NO: 25192 - DNA, 20 bp, Artificial Sequence
  Description of Artificial Sequence: Synthetic oligonucleotide
  Target: SCN9A; (-) strand; PAM type: NRG; PAM sequence: AGG
aatttgtaagtgaacaactt

SEQ ID NO: 25193 - DNA, 20 bp, Artificial Sequence
  Description of Artificial Sequence: Synthetic oligonucleotide
  Target: SCN9A; (-) strand; PAM type: NRG; PAM sequence: TAG
aaatttgtaagtgaacaact

SEQ ID NO: 25194 - DNA, 20 bp, Artificial Sequence
  Description of Artificial Sequence: Synthetic oligonucleotide
  Target: SCN9A; (-) strand; PAM type: NRG; PAM sequence: AAG
aatgccagtgataaatttgt

SEQ ID NO: 25195 - DNA, 20 bp, Artificial Sequence
  Description of Artificial Sequence: Synthetic oligonucleotide
  Target: SCN9A; (-) strand; PAM type: NRG; PAM sequence: CAG
atgtttatcttaggaaatgc

SEQ ID NO: 25196 - DNA, 20 bp, Artificial Sequence
  Description of Artificial Sequence: Synthetic oligonucleotide
  Target: SCN9A; (-) strand; PAM type: NRG; PAM sequence: AGG
acatcgttaatgtttatctt

SEQ ID NO: 25197 - DNA, 20 bp, Artificial Sequence
  Description of Artificial Sequence: Synthetic oligonucleotide
  Target: SCN9A; (-) strand; PAM type: NRG; PAM sequence: TAG
tacatcgttaatgtttatct

SEQ ID NO: 25198 - DNA, 20 bp, Artificial Sequence
  Description of Artificial Sequence: Synthetic oligonucleotide
  Target: SCN9A; (-) strand; PAM type: NRG; PAM sequence: AGG
catccatgatagcatgaaat

SEQ ID NO: 25199 - DNA, 20 bp, Artificial Sequence
  Description of Artificial Sequence: Synthetic oligonucleotide
  Target: SCN9A; (-) strand; PAM type: NRG; PAM sequence: TAG
tcatccatgatagcatgaaa

SEQ ID NO: 25200 - DNA, 20 bp, Artificial Sequence
  Description of Artificial Sequence: Synthetic oligonucleotide
  Target: SCN9A; (-) strand; PAM type: NRG; PAM sequence: TAG
gcattaaccatcatccatga

SEQ ID NO: 25201 - DNA, 20 bp, Artificial Sequence
  Description of Artificial Sequence: Synthetic oligonucleotide
  Target: SCN9A; (-) strand; PAM type: NRG; PAM sequence: TAG
ctcttggaacaataaataac

SEQ ID NO: 25202 - DNA, 20 bp, Artificial Sequence
  Description of Artificial Sequence: Synthetic oligonucleotide
  Target: SCN9A; (-) strand; PAM type: NRG; PAM sequence: TGG
cactcctacctcacacctct

SEQ ID NO: 25203 - DNA, 20 bp, Artificial Sequence
  Description of Artificial Sequence: Synthetic oligonucleotide
  Target: SCN9A; (-) strand; PAM type: NRG; PAM sequence: TAG
gcgttagattatcaagtcat

SEQ ID NO: 25204 - DNA, 20 bp, Artificial Sequence
  Description of Artificial Sequence: Synthetic oligonucleotide
  Target: SCN9A; (-) strand; PAM type: NRG; PAM sequence: AAG
cttttgagcgttagattatc

SEQ ID NO: 25205 - DNA, 20 bp, Artificial Sequence
  Description of Artificial Sequence: Synthetic oligonucleotide
  Target: SCN9A; (-) strand; PAM type: NRG; PAM sequence: TAG
tagtttcttcttttgagcgt

SEQ ID NO: 25206 - DNA, 20 bp, Artificial Sequence
  Description of Artificial Sequence: Synthetic oligonucleotide
  Target: SCN9A; (-) strand; PAM type: NRG; PAM sequence: GAG
gtttgatagtttcttctttt

SEQ ID NO: 25207 - DNA, 20 bp, Artificial Sequence
  Description of Artificial Sequence: Synthetic oligonucleotide
  Target: SCN9A; (-) strand; PAM type: NRG; PAM sequence: TAG
tacagtgctgctgtgtttga

SEQ ID NO: 25208 - DNA, 20 bp, Artificial Sequence
  Description of Artificial Sequence: Synthetic oligonucleotide
  Target: SCN9A; (-) strand; PAM type: NRG; PAM sequence: CAG
gttgagttctgtgttttgta

SEQ ID NO: 25209 - DNA, 20 bp, Artificial Sequence
  Description of Artificial Sequence: Synthetic oligonucleotide
  Target: SCN9A; (-) strand; PAM type: NRG; PAM sequence: GAG
ctttgagtaaggtttttgtt

SEQ ID NO: 25210 - DNA, 20 bp, Artificial Sequence
  Description of Artificial Sequence: Synthetic oligonucleotide
  Target: SCN9A; (-) strand; PAM type: NRG; PAM sequence: AGG
tcaatcattctctttgagta

SEQ ID NO: 25211 - DNA, 20 bp, Artificial Sequence
  Description of Artificial Sequence: Synthetic oligonucleotide
  Target: SCN9A; (-) strand; PAM type: NRG; PAM sequence: AAG
atcaatcattctctttgagt

SEQ ID NO: 25212 - DNA, 20 bp, Artificial Sequence
  Description of Artificial Sequence: Synthetic oligonucleotide
  Target: SCN9A; (-) strand; PAM type: NRG; PAM sequence: GAG
cagcatcaatcattctcttt

SEQ ID NO: 25213 - DNA, 20 bp, Artificial Sequence
  Description of Artificial Sequence: Synthetic oligonucleotide
  Target: SCN9A; (-) strand; PAM type: NRG; PAM sequence: CAG
taacatttttcagttctttt

SEQ ID NO: 25214 - DNA, 20 bp, Artificial Sequence
  Description of Artificial Sequence: Synthetic oligonucleotide
  Target: SCN9A; (-) strand; PAM type: NRG; PAM sequence: CAG
acttgaaatgtaacattttt

SEQ ID NO: 25215 - DNA, 20 bp, Artificial Sequence
  Description of Artificial Sequence: Synthetic oligonucleotide
  Target: SCN9A; (-) strand; PAM type: NRG; PAM sequence: TAG
tgtgtgaagcaaacagttta

SEQ ID NO: 25216 - DNA, 20 bp, Artificial Sequence
  Description of Artificial Sequence: Synthetic oligonucleotide
  Target: SCN9A; (-) strand; PAM type: NRG; PAM sequence: CAG
tttttgttgtgtgaagcaaa

SEQ ID NO: 25217 - DNA, 20 bp, Artificial Sequence
  Description of Artificial Sequence: Synthetic oligonucleotide
  Target: SCN9A; (-) strand; PAM type: NRG; PAM sequence: AAG
atctttttttttgttgtgtg

SEQ ID NO: 25218 - DNA, 20 bp, Artificial Sequence
  Description of Artificial Sequence: Synthetic oligonucleotide
  Target: SCN9A; (-) strand; PAM type: NRG; PAM sequence: AAG
attctaggctctgctcctta

SEQ ID NO: 25219 - DNA, 20 bp, Artificial Sequence
  Description of Artificial Sequence: Synthetic oligonucleotide
  Target: SCN9A; (-) strand; PAM type: NRG; PAM sequence: AGG
tcaggtgaaataaccattct

SEQ ID NO: 25220 - DNA, 20 bp, Artificial Sequence
  Description of Artificial Sequence: Synthetic oligonucleotide
  Target: SCN9A; (-) strand; PAM type: NRG; PAM sequence: TAG
ctcaggtgaaataaccattc

SEQ ID NO: 25221 - DNA, 20 bp, Artificial Sequence
  Description of Artificial Sequence: Synthetic oligonucleotide
  Target: SCN9A; (-) strand; PAM type: NRG; PAM sequence: AGG
ttgtgagtattttaaggctc

SEQ ID NO: 25222 - DNA, 20 bp, Artificial Sequence
  Description of Artificial Sequence: Synthetic oligonucleotide
  Target: SCN9A; (-) strand; PAM type: NRG; PAM sequence: CAG
tttgtgagtattttaaggct

SEQ ID NO: 25223 - DNA, 20 bp, Artificial Sequence
  Description of Artificial Sequence: Synthetic oligonucleotide
  Target: SCN9A; (-) strand; PAM type: NRG; PAM sequence: AGG
tgtcttttgtgagtatttta

SEQ ID NO: 25224 - DNA, 20 bp, Artificial Sequence
  Description of Artificial Sequence: Synthetic oligonucleotide
  Target: SCN9A; (-) strand; PAM type: NRG; PAM sequence: AAG
ctgtcttttgtgagtatttt

SEQ ID NO: 25225 - DNA, 20 bp, Artificial Sequence
  Description of Artificial Sequence: Synthetic oligonucleotide
  Target: SCN9A; (-) strand; PAM type: NRG; PAM sequence: GAG
actttcttactgtcttttgt

SEQ ID NO: 25226 - DNA, 20 bp, Artificial Sequence
  Description of Artificial Sequence: Synthetic oligonucleotide
  Target: SCN9A; (-) strand; PAM type: NRG; PAM sequence: TAG
tattaacagataatggagct

SEQ ID NO: 25227 - DNA, 20 bp, Artificial Sequence
  Description of Artificial Sequence: Synthetic oligonucleotide
  Target: SCN9A; (-) strand; PAM type: NRG; PAM sequence: GAG
ttgcttattaacagataatg

SEQ ID NO: 25228 - DNA, 20 bp, Artificial Sequence
  Description of Artificial Sequence: Synthetic oligonucleotide
  Target: SCN9A; (-) strand; PAM type: NRG; PAM sequence: TGG
tcttgcttattaacagataa

SEQ ID NO: 25229 - DNA, 20 bp, Artificial Sequence
  Description of Artificial Sequence: Synthetic oligonucleotide
  Target: SCN9A; (-) strand; PAM type: NRG; PAM sequence: CAG
atgtctttcttgcttattaa

SEQ ID NO: 25230 - DNA, 20 bp, Artificial Sequence
  Description of Artificial Sequence: Synthetic oligonucleotide
  Target: SCN9A; (-) strand; PAM type: NRG; PAM sequence: TAG
ttaaattaaaagatggataa

SEQ ID NO: 25231 - DNA, 20 bp, Artificial Sequence
  Description of Artificial Sequence: Synthetic oligonucleotide
  Target: SCN9A; (-) strand; PAM type: NRG; PAM sequence: TGG
tacacaattaaattaaaaga

SEQ ID NO: 25232 - DNA, 20 bp, Artificial Sequence
  Description of Artificial Sequence: Synthetic oligonucleotide
  Target: SCN9A; (-) strand; PAM type: NRG; PAM sequence: AAG
aaactacacaattaaattaa

SEQ ID NO: 25233 - DNA, 20 bp, Artificial Sequence
  Description of Artificial Sequence: Synthetic oligonucleotide
  Target: SCN9A; (-) strand; PAM type: NRG; PAM sequence: TAG
atgattcaagaacacaatta

SEQ ID NO: 25234 - DNA, 20 bp, Artificial Sequence
  Description of Artificial Sequence: Synthetic oligonucleotide
  Target: SCN9A; (-) strand; PAM type: NRG; PAM sequence: AAG
attttactccttaatgattc

SEQ ID NO: 25235 - DNA, 20 bp, Artificial Sequence
  Description of Artificial Sequence: Synthetic oligonucleotide
  Target: SCN9A; (-) strand; PAM type: NRG; PAM sequence: AGG
atgtgtggatttcttctcaa

SEQ ID NO: 25236 - DNA, 20 bp, Artificial Sequence
  Description of Artificial Sequence: Synthetic oligonucleotide
  Target: SCN9A; (-) strand; PAM type: NRG; PAM sequence: AAG
tatgtgtggatttcttctca

SEQ ID NO: 25237 - DNA, 20 bp, Artificial Sequence
  Description of Artificial Sequence: Synthetic oligonucleotide
  Target: SCN9A; (-) strand; PAM type: NRG; PAM sequence: TGG
tgccacatagtaactatgtg

SEQ ID NO: 25238 - DNA, 20 bp, Artificial Sequence
  Description of Artificial Sequence: Synthetic oligonucleotide
  Target: SCN9A; (-) strand; PAM type: NRG; PAM sequence: TAG
tattggactcttatgccaca

SEQ ID NO: 25239 - DNA, 20 bp, Artificial Sequence
  Description of Artificial Sequence: Synthetic oligonucleotide
  Target: SCN9A; (-) strand; PAM type: NRG; PAM sequence: TGG
atgggaaacttggaaaatat

SEQ ID NO: 25240 - DNA, 20 bp, Artificial Sequence
  Description of Artificial Sequence: Synthetic oligonucleotide
  Target: SCN9A; (-) strand; PAM type: NRG; PAM sequence: TGG
ctgtaacataatgggaaact

SEQ ID NO: 25241 - DNA, 20 bp, Artificial Sequence
  Description of Artificial Sequence: Synthetic oligonucleotide
  Target: SCN9A; (-) strand; PAM type: NRG; PAM sequence: GGG
tagttgtcctgtaacataat

SEQ ID NO: 25242 - DNA, 20 bp, Artificial Sequence
  Description of Artificial Sequence: Synthetic oligonucleotide
  Target: SCN9A; (-) strand; PAM type: NRG; PAM sequence: TGG
ctagttgtcctgtaacataa

SEQ ID NO: 25243 - DNA, 20 bp, Artificial Sequence
  Description of Artificial Sequence: Synthetic oligonucleotide
  Target: SCN9A; (-) strand; PAM type: NRG; PAM sequence: TAG
gaagagagtatttaaacatc

SEQ ID NO: 25244 - DNA, 20 bp, Artificial Sequence
  Description of Artificial Sequence: Synthetic oligonucleotide
  Target: SCN9A; (-) strand; PAM type: NRG; PAM sequence: GAG
ttttgttctacaccagaaga

SEQ ID NO: 25245 - DNA, 20 bp, Artificial Sequence
  Description of Artificial Sequence: Synthetic oligonucleotide
  Target: SCN9A; (-) strand; PAM type: NRG; PAM sequence: GAG
atttttgttctacaccagaa

SEQ ID NO: 25246 - DNA, 20 bp, Artificial Sequence
  Description of Artificial Sequence: Synthetic oligonucleotide
  Target: SCN9A; (-) strand; PAM type: NRG; PAM sequence: AAG
ttatttttgttctacaccag

SEQ ID NO: 25247 - DNA, 20 bp, Artificial Sequence
  Description of Artificial Sequence: Synthetic oligonucleotide
  Target: SCN9A; (-) strand; PAM type: NRG; PAM sequence: CAG
aggttatttttgttctacac

SEQ ID NO: 25248 - DNA, 20 bp, Artificial Sequence
  Description of Artificial Sequence: Synthetic oligonucleotide
  Target: SCN9A; (-) strand; PAM type: NRG; PAM sequence: AGG
atgattgcaagagagaagaa

SEQ ID NO: 25249 - DNA, 20 bp, Artificial Sequence
  Description of Artificial Sequence: Synthetic oligonucleotide
  Target: SCN9A; (-) strand; PAM type: NRG; PAM sequence: AAG
aatgattgcaagagagaaga

SEQ ID NO: 25250 - DNA, 20 bp, Artificial Sequence
  Description of Artificial Sequence: Synthetic oligonucleotide
  Target: SCN9A; (-) strand; PAM type: NRG; PAM sequence: AAG
cctgaatgattgcaagagag

SEQ ID NO: 25251 - DNA, 20 bp, Artificial Sequence
  Description of Artificial Sequence: Synthetic oligonucleotide
  Target: SCN9A; (-) strand; PAM type: NRG; PAM sequence: GAG
ggccctgaatgattgcaaga

SEQ ID NO: 25252 - DNA, 20 bp, Artificial Sequence
  Description of Artificial Sequence: Synthetic oligonucleotide
  Target: SCN9A; (-) strand; PAM type: NRG; PAM sequence: GAG
aaggccctgaatgattgcaa

SEQ ID NO: 25253 - DNA, 20 bp, Artificial Sequence
  Description of Artificial Sequence: Synthetic oligonucleotide
  Target: SCN9A; (-) strand; PAM type: NRG; PAM sequence: AAG
taaaggccctgaatgattgc

SEQ ID NO: 25254 - DNA, 20 bp, Artificial Sequence
  Description of Artificial Sequence: Synthetic oligonucleotide
  Target: SCN9A; (-) strand; PAM type: NRG; PAM sequence: AGG
ctccagaaggaaaaaaataa

SEQ ID NO: 25255 - DNA, 20 bp, Artificial Sequence
  Description of Artificial Sequence: Synthetic oligonucleotide
  Target: SCN9A; (-) strand; PAM type: NRG; PAM sequence: AAG
tctccagaaggaaaaaaata

SEQ ID NO: 25256 - DNA, 20 bp, Artificial Sequence
  Description of Artificial Sequence: Synthetic oligonucleotide
  Target: SCN9A; (-) strand; PAM type: NRG; PAM sequence: AGG
aatgttcacatttctccaga

SEQ ID NO: 25257 - DNA, 20 bp, Artificial Sequence
  Description of Artificial Sequence: Synthetic oligonucleotide
  Target: SCN9A; (-) strand; PAM type: NRG; PAM sequence: AAG
taatgttcacatttctccag

SEQ ID NO: 25258 - DNA, 20 bp, Artificial Sequence
  Description of Artificial Sequence: Synthetic oligonucleotide
  Target: SCN9A; (-) strand; PAM type: NRG; PAM sequence: CAG
ggataatgttcacatttctc

SEQ ID NO: 25259 - DNA, 20 bp, Artificial Sequence
  Description of Artificial Sequence: Synthetic oligonucleotide
  Target: SCN9A; (-) strand; PAM type: NRG; PAM sequence: AGG
aattttaaaaactctataag

SEQ ID NO: 25260 - DNA, 20 bp, Artificial Sequence
  Description of Artificial Sequence: Synthetic oligonucleotide
  Target: SCN9A; (-) strand; PAM type: NRG; PAM sequence: GAG
caattttaaaaactctataa

SEQ ID NO: 25261 - DNA, 20 bp, Artificial Sequence
  Description of Artificial Sequence: Synthetic oligonucleotide
  Target: SCN9A; (-) strand; PAM type: NRG; PAM sequence: AAG
tccaattttaaaaactctat

SEQ ID NO: 25262 - DNA, 20 bp, Artificial Sequence
  Description of Artificial Sequence: Synthetic oligonucleotide
  Target: SCN9A; (-) strand; PAM type: NRG; PAM sequence: TAG
ctcaagatgaaaagcactaa

SEQ ID NO: 25263 - DNA, 20 bp, Artificial Sequence
  Description of Artificial Sequence: Synthetic oligonucleotide
  Target: SCN9A; (-) strand; PAM type: NRG; PAM sequence: AAG
gtgattacactcaagatgaa

SEQ ID NO: 25264 - DNA, 20 bp, Artificial Sequence
  Description of Artificial Sequence: Synthetic oligonucleotide
  Target: SCN9A; (-) strand; PAM type: NRG; PAM sequence: AAG
taagaaatgtgattacactc

SEQ ID NO: 25265 - DNA, 20 bp, Artificial Sequence
  Description of Artificial Sequence: Synthetic oligonucleotide
  Target: SCN9A; (-) strand; PAM type: NRG; PAM sequence: AAG
ccagaaatctaaatcatgtt

SEQ ID NO: 25266 - DNA, 20 bp, Artificial Sequence
  Description of Artificial Sequence: Synthetic oligonucleotide
  Target: SCN9A; (-) strand; PAM type: NRG; PAM sequence: CAG
tgtagagacctcaaggggcc

SEQ ID NO: 25267 - DNA, 20 bp, Artificial Sequence
  Description of Artificial Sequence: Synthetic oligonucleotide
  Target: SCN9A; (-) strand; PAM type: NRG; PAM sequence: GGG
aagattgtagagacctcaag

SEQ ID NO: 25268 - DNA, 20 bp, Artificial Sequence
  Description of Artificial Sequence: Synthetic oligonucleotide
  Target: SCN9A; (-) strand; PAM type: NRG; PAM sequence: GGG
aaagattgtagagacctcaa

SEQ ID NO: 25269 - DNA, 20 bp, Artificial Sequence
  Description of Artificial Sequence: Synthetic oligonucleotide
  Target: SCN9A; (-) strand; PAM type: NRG; PAM sequence: AGG
aaaagattgtagagacctca

SEQ ID NO: 25270 - DNA, 20 bp, Artificial Sequence
  Description of Artificial Sequence: Synthetic oligonucleotide
  Target: SCN9A; (-) strand; PAM type: NRG; PAM sequence: AAG
aaaaagattgtagagacctc

SEQ ID NO: 25271 - DNA, 20 bp, Artificial Sequence
  Description of Artificial Sequence: Synthetic oligonucleotide
  Target: SCN9A; (-) strand; PAM type: NRG; PAM sequence: GAG
atcaaaaaaaaaagattgta

SEQ ID NO: 25272 - DNA, 20 bp, Artificial Sequence
  Description of Artificial Sequence: Synthetic oligonucleotide
  Target: SCN9A; (-) strand; PAM type: NRG; PAM sequence: TAG
atatcaaaaaaaaaagattg

SEQ ID NO: 25273 - DNA, 20 bp, Artificial Sequence
  Description of Artificial Sequence: Synthetic oligonucleotide
  Target: SCN9A; (-) strand; PAM type: NRG; PAM sequence: AAG
aaatttcatatcaaaaaaaa

SEQ ID NO: 25274 - DNA, 20 bp, Artificial Sequence
  Description of Artificial Sequence: Synthetic oligonucleotide
  Target: SCN9A; (-) strand; PAM type: NRG; PAM sequence: GAG
taccttttaaaaagaatctt

SEQ ID NO: 25275 - DNA, 20 bp, Artificial Sequence
  Description of Artificial Sequence: Synthetic oligonucleotide
  Target: SCN9A; (-) strand; PAM type: NRG; PAM sequence: AAG
ttgaggcattaccttttaaa

SEQ ID NO: 25276 - DNA, 20 bp, Artificial Sequence
  Description of Artificial Sequence: Synthetic oligonucleotide
  Target: SCN9A; (-) strand; PAM type: NRG; PAM sequence: AGG
ttcagtgattttttaacttg

SEQ ID NO: 25277 - DNA, 20 bp, Artificial Sequence
  Description of Artificial Sequence: Synthetic oligonucleotide
  Target: SCN9A; (-) strand; PAM type: NRG; PAM sequence: GAG
cttcagtgattttttaactt

SEQ ID NO: 25278 - DNA, 20 bp, Artificial Sequence
  Description of Artificial Sequence: Synthetic oligonucleotide
  Target: SCN9A; (-) strand; PAM type: NRG; PAM sequence: CAG
ttcctgaaattcctgagctt

SEQ ID NO: 25279 - DNA, 20 bp, Artificial Sequence
  Description of Artificial Sequence: Synthetic oligonucleotide
  Target: SCN9A; (-) strand; PAM type: NRG; PAM sequence: GAG
atttttttcctgaaattcct

SEQ ID NO: 25280 - DNA, 20 bp, Artificial Sequence
  Description of Artificial Sequence: Synthetic oligonucleotide
  Target: SCN9A; (-) strand; PAM type: NRG; PAM sequence: GAG
ccactgatcaataatatctg

SEQ ID NO: 25281 - DNA, 20 bp, Artificial Sequence
  Description of Artificial Sequence: Synthetic oligonucleotide
  Target: SCN9A; (-) strand; PAM type: NRG; PAM sequence: TGG
ttccactgatcaataatatc

SEQ ID NO: 25282 - DNA, 20 bp, Artificial Sequence
  Description of Artificial Sequence: Synthetic oligonucleotide
  Target: SCN9A; (-) strand; PAM type: NRG; PAM sequence: GAG
caacagaagaaaatacagtt

SEQ ID NO: 25283 - DNA, 20 bp, Artificial Sequence
  Description of Artificial Sequence: Synthetic oligonucleotide
  Target: SCN9A; (-) strand; PAM type: NRG; PAM sequence: CAG
ttagacaacagaagaaaata

SEQ ID NO: 25284 - DNA, 20 bp, Artificial Sequence
  Description of Artificial Sequence: Synthetic oligonucleotide
  Target: SCN9A; (-) strand; PAM type: NRG; PAM sequence: AAG
cattaaaacttagacaacag

SEQ ID NO: 25285 - DNA, 20 bp, Artificial Sequence
  Description of Artificial Sequence: Synthetic oligonucleotide
  Target: SCN9A; (-) strand; PAM type: NRG; PAM sequence: CAG
taacattaaaacttagacaa

SEQ ID NO: 25286 - DNA, 20 bp, Artificial Sequence
  Description of Artificial Sequence: Synthetic oligonucleotide
  Target: SCN9A; (-) strand; PAM type: NRG; PAM sequence: TAG
gtggaagtaacattaaaact

SEQ ID NO: 25287 - DNA, 20 bp, Artificial Sequence
  Description of Artificial Sequence: Synthetic oligonucleotide
  Target: SCN9A; (-) strand; PAM type: NRG; PAM sequence: AAG
attttctgctaaattagtgg

SEQ ID NO: 25288 - DNA, 20 bp, Artificial Sequence
  Description of Artificial Sequence: Synthetic oligonucleotide
  Target: SCN9A; (-) strand; PAM type: NRG; PAM sequence: TGG
acaattttctgctaaattag

SEQ ID NO: 25289 - DNA, 20 bp, Artificial Sequence
  Description of Artificial Sequence: Synthetic oligonucleotide
  Target: SCN9A; (-) strand; PAM type: NRG; PAM sequence: TAG
ctgacaattttctgctaaat

SEQ ID NO: 25290 - DNA, 20 bp, Artificial Sequence
  Description of Artificial Sequence: Synthetic oligonucleotide
  Target: SCN9A; (-) strand; PAM type: NRG; PAM sequence: TAG
agcccagaatttattgcaac

SEQ ID NO: 25291 - DNA, 20 bp, Artificial Sequence
  Description of Artificial Sequence: Synthetic oligonucleotide
  Target: SCN9A; (-) strand; PAM type: NRG; PAM sequence: CAG
ccataattagaatgtgagcc

SEQ ID NO: 25292 - DNA, 20 bp, Artificial Sequence
  Description of Artificial Sequence: Synthetic oligonucleotide
  Target: SCN9A; (-) strand; PAM type: NRG; PAM sequence: GAG
gttgcccataattagaatgt

SEQ ID NO: 25293 - DNA, 20 bp, Artificial Sequence
  Description of Artificial Sequence: Synthetic oligonucleotide
  Target: SCN9A; (-) strand; PAM type: NRG; PAM sequence: TAG
aagttttagttgcccataat

SEQ ID NO: 25294 - DNA, 20 bp, Artificial Sequence
  Description of Artificial Sequence: Synthetic oligonucleotide
  Target: SCN9A; (-) strand; PAM type: NRG; PAM sequence: TAG
taaaaaaagagctaaagttt

SEQ ID NO: 25295 - DNA, 20 bp, Artificial Sequence
  Description of Artificial Sequence: Synthetic oligonucleotide
  Target: SCN9A; (-) strand; PAM type: NRG; PAM sequence: AAG
tttttttaaaaaaagagcta

SEQ ID NO: 25296 - DNA, 20 bp, Artificial Sequence
  Description of Artificial Sequence: Synthetic oligonucleotide
  Target: SCN9A; (-) strand; PAM type: NRG; PAM sequence: GAG
ttgccctttttttaaaaaaa

SEQ ID NO: 25297 - DNA, 20 bp, Artificial Sequence
  Description of Artificial Sequence: Synthetic oligonucleotide
  Target: SCN9A; (-) strand; PAM type: NRG; PAM sequence: AAG
tcttgccctttttttaaaaa

SEQ ID NO: 25298 - DNA, 20 bp, Artificial Sequence
  Description of Artificial Sequence: Synthetic oligonucleotide
  Target: SCN9A; (-) strand; PAM type: NRG; PAM sequence: TGG
aataggaaaggaaaaaaaat

SEQ ID NO: 25299 - DNA, 20 bp, Artificial Sequence
  Description of Artificial Sequence: Synthetic oligonucleotide
  Target: SCN9A; (-) strand; PAM type: NRG; PAM sequence: AGG
tagacaaagaaaaataggaa

SEQ ID NO: 25300 - DNA, 20 bp, Artificial Sequence
  Description of Artificial Sequence: Synthetic oligonucleotide
  Target: SCN9A; (-) strand; PAM type: NRG; PAM sequence: AAG
atagacaaagaaaaatagga

SEQ ID NO: 25301 - DNA, 20 bp, Artificial Sequence
  Description of Artificial Sequence: Synthetic oligonucleotide
  Target: SCN9A; (-) strand; PAM type: NRG; PAM sequence: AGG
agcaatagacaaagaaaaat

SEQ ID NO: 25302 - DNA, 20 bp, Artificial Sequence
  Description of Artificial Sequence: Synthetic oligonucleotide
  Target: SCN9A; (-) strand; PAM type: NRG; PAM sequence: TAG
tagcaatagacaaagaaaaa

SEQ ID NO: 25303 - DNA, 20 bp, Artificial Sequence
  Description of Artificial Sequence: Synthetic oligonucleotide
  Target: SCN9A; (-) strand; PAM type: NRG; PAM sequence: AAG
ttctctgctagcaatagaca

SEQ ID NO: 25304 - DNA, 20 bp, Artificial Sequence
  Description of Artificial Sequence: Synthetic oligonucleotide
  Target: SCN9A; (-) strand; PAM type: NRG; PAM sequence: TAG
caatatttctctgctagcaa

SEQ ID NO: 25305 - DNA, 20 bp, Artificial Sequence
  Description of Artificial Sequence: Synthetic oligonucleotide
  Target: SCN9A; (-) strand; PAM type: NRG; PAM sequence: TAG
cctacacaatatttctctgc

SEQ ID NO: 25306 - DNA, 20 bp, Artificial Sequence
  Description of Artificial Sequence: Synthetic oligonucleotide
  Target: SCN9A; (-) strand; PAM type: NRG; PAM sequence: GAG
ataagtagctattcctccca

SEQ ID NO: 25307 - DNA, 20 bp, Artificial Sequence
  Description of Artificial Sequence: Synthetic oligonucleotide
  Target: SCN9A; (-) strand; PAM type: NRG; PAM sequence: CAG
gaataagtagctattcctcc

SEQ ID NO: 25308 - DNA, 20 bp, Artificial Sequence
  Description of Artificial Sequence: Synthetic oligonucleotide
  Target: SCN9A; (-) strand; PAM type: NRG; PAM sequence: TAG
tgtgtttcacgctgaataag

SEQ ID NO: 25309 - DNA, 20 bp, Artificial Sequence
  Description of Artificial Sequence: Synthetic oligonucleotide
  Target: SCN9A; (-) strand; PAM type: NRG; PAM sequence: AAG
ctgtgtgtttcacgctgaat

SEQ ID NO: 25310 - DNA, 20 bp, Artificial Sequence
  Description of Artificial Sequence: Synthetic oligonucleotide
  Target: SCN9A; (-) strand; PAM type: NRG; PAM sequence: TGG
atatcatgttgaccttgtga

SEQ ID NO: 25311 - DNA, 20 bp, Artificial Sequence
  Description of Artificial Sequence: Synthetic oligonucleotide
  Target: SCN9A; (-) strand; PAM type: NRG; PAM sequence: CAG
tgacctcattatttcaccaa

SEQ ID NO: 25312 - DNA, 20 bp, Artificial Sequence
  Description of Artificial Sequence: Synthetic oligonucleotide
  Target: SCN9A; (-) strand; PAM type: NRG; PAM sequence: GAG
gaatttctctggtggtggct

SEQ ID NO: 25313 - DNA, 20 bp, Artificial Sequence
  Description of Artificial Sequence: Synthetic oligonucleotide
  Target: SCN9A; (-) strand; PAM type: NRG; PAM sequence: TGG
attctgaatttctctggtgg

SEQ ID NO: 25314 - DNA, 20 bp, Artificial Sequence
  Description of Artificial Sequence: Synthetic oligonucleotide
  Target: SCN9A; (-) strand; PAM type: NRG; PAM sequence: TGG
tttattctgaatttctctgg

SEQ ID NO: 25315 - DNA, 20 bp, Artificial Sequence
  Description of Artificial Sequence: Synthetic oligonucleotide
  Target: SCN9A; (-) strand; PAM type: NRG; PAM sequence: TGG
ggttttattctgaatttctc

SEQ ID NO: 25316 - DNA, 20 bp, Artificial Sequence
  Description of Artificial Sequence: Synthetic oligonucleotide
  Target: SCN9A; (-) strand; PAM type: NRG; PAM sequence: TGG
agaggtctccgtgaaatcac

SEQ ID NO: 25317 - DNA, 20 bp, Artificial Sequence
  Description of Artificial Sequence: Synthetic oligonucleotide
  Target: SCN9A; (-) strand; PAM type: NRG; PAM sequence: AGG
aagattctgagaaaaagaag

SEQ ID NO: 25318 - DNA, 20 bp, Artificial Sequence
  Description of Artificial Sequence: Synthetic oligonucleotide
  Target: SCN9A; (-) strand; PAM type: NRG; PAM sequence: GAG
gaagattctgagaaaaagaa

SEQ ID NO: 25319 - DNA, 20 bp, Artificial Sequence
  Description of Artificial Sequence: Synthetic oligonucleotide
  Target: SCN9A; (-) strand; PAM type: NRG; PAM sequence: AAG
tagaagattctgagaaaaag

SEQ ID NO: 25320 - DNA, 20 bp, Artificial Sequence
  Description of Artificial Sequence: Synthetic oligonucleotide
  Target: SCN9A; (-) strand; PAM type: NRG; PAM sequence: AAG
aggtagaagattctgagaaa

SEQ ID NO: 25321 - DNA, 20 bp, Artificial Sequence
  Description of Artificial Sequence: Synthetic oligonucleotide
  Target: SCN9A; (-) strand; PAM type: NRG; PAM sequence: GAG
tgccctaggtagaagattct

SEQ ID NO: 25322 - DNA, 20 bp, Artificial Sequence
  Description of Artificial Sequence: Synthetic oligonucleotide
  Target: SCN9A; (-) strand; PAM type: NRG; PAM sequence: AAG
atagaaagtgccctaggtag

SEQ ID NO: 25323 - DNA, 20 bp, Artificial Sequence
  Description of Artificial Sequence: Synthetic oligonucleotide
  Target: SCN9A; (-) strand; PAM type: NRG; PAM sequence: TAG
tggatagaaagtgccctagg

SEQ ID NO: 25324 - DNA, 20 bp, Artificial Sequence
  Description of Artificial Sequence: Synthetic oligonucleotide
  Target: SCN9A; (-) strand; PAM type: NRG; PAM sequence: AGG
tattggatagaaagtgccct

SEQ ID NO: 25325 - DNA, 20 bp, Artificial Sequence
  Description of Artificial Sequence: Synthetic oligonucleotide
  Target: SCN9A; (-) strand; PAM type: NRG; PAM sequence: TAG
ttattggatagaaagtgccc

SEQ ID NO: 25326 - DNA, 20 bp, Artificial Sequence
  Description of Artificial Sequence: Synthetic oligonucleotide
  Target: SCN9A; (-) strand; PAM type: NRG; PAM sequence: AAG
ttttcatgttattggataga

SEQ ID NO: 25327 - DNA, 20 bp, Artificial Sequence
  Description of Artificial Sequence: Synthetic oligonucleotide
  Target: SCN9A; (-) strand; PAM type: NRG; PAM sequence: TAG
taagttttcatgttattgga

SEQ ID NO: 25328 - DNA, 20 bp, Artificial Sequence
  Description of Artificial Sequence: Synthetic oligonucleotide
  Target: SCN9A; (-) strand; PAM type: NRG; PAM sequence: TGG
cacgtaagttttcatgttat

SEQ ID NO: 25329 - DNA, 20 bp, Artificial Sequence
  Description of Artificial Sequence: Synthetic oligonucleotide
  Target: SCN9A; (-) strand; PAM type: NRG; PAM sequence: AAG
atcttatcatttagtcacgt

SEQ ID NO: 25330 - DNA, 20 bp, Artificial Sequence
  Description of Artificial Sequence: Synthetic oligonucleotide
  Target: SCN9A; (-) strand; PAM type: NRG; PAM sequence: TAG
tatattcatatcttatcatt

SEQ ID NO: 25331 - DNA, 20 bp, Artificial Sequence
  Description of Artificial Sequence: Synthetic oligonucleotide
  Target: SCN9A; (-) strand; PAM type: NRG; PAM sequence: TGG
gccagtctagccttcttaca

SEQ ID NO: 25332 - DNA, 20 bp, Artificial Sequence
  Description of Artificial Sequence: Synthetic oligonucleotide
  Target: SCN9A; (-) strand; PAM type: NRG; PAM sequence: TAG
tgagaaatctgtagccagtc

SEQ ID NO: 25333 - DNA, 20 bp, Artificial Sequence
  Description of Artificial Sequence: Synthetic oligonucleotide
  Target: SCN9A; (-) strand; PAM type: NRG; PAM sequence: CAG
ctggctgagaaatctgtagc

SEQ ID NO: 25334 - DNA, 20 bp, Artificial Sequence
  Description of Artificial Sequence: Synthetic oligonucleotide
  Target: SCN9A; (-) strand; PAM type: NRG; PAM sequence: TAG
ggacctggctgagaaatctg

SEQ ID NO: 25335 - DNA, 20 bp, Artificial Sequence
  Description of Artificial Sequence: Synthetic oligonucleotide
  Target: SCN9A; (-) strand; PAM type: NRG; PAM sequence: GAG
tgatactataggacctggct

SEQ ID NO: 25336 - DNA, 20 bp, Artificial Sequence
  Description of Artificial Sequence: Synthetic oligonucleotide
  Target: SCN9A; (-) strand; PAM type: NRG; PAM sequence: TGG
caagatgatactataggacc

SEQ ID NO: 25337 - DNA, 20 bp, Artificial Sequence
  Description of Artificial Sequence: Synthetic oligonucleotide
  Target: SCN9A; (-) strand; PAM type: NRG; PAM sequence: AGG
atgcttcaagatgatactat

SEQ ID NO: 25338 - DNA, 20 bp, Artificial Sequence
  Description of Artificial Sequence: Synthetic oligonucleotide
  Target: SCN9A; (-) strand; PAM type: NRG; PAM sequence: TAG
gatgcttcaagatgatacta

SEQ ID NO: 25339 - DNA, 20 bp, Artificial Sequence
  Description of Artificial Sequence: Synthetic oligonucleotide
  Target: SCN9A; (-) strand; PAM type: NRG; PAM sequence: AAG
tttcattagaaagatgcttc

SEQ ID NO: 25340 - DNA, 20 bp, Artificial Sequence
  Description of Artificial Sequence: Synthetic oligonucleotide
  Target: SCN9A; (-) strand; PAM type: NRG; PAM sequence: AAG
cttctcttcttttcattaga

SEQ ID NO: 25341 - DNA, 20 bp, Artificial Sequence
  Description of Artificial Sequence: Synthetic oligonucleotide
  Target: SCN9A; (-) strand; PAM type: NRG; PAM sequence: TAG
tttgcttctcttcttttcat

SEQ ID NO: 25342 - DNA, 20 bp, Artificial Sequence
  Description of Artificial Sequence: Synthetic oligonucleotide
  Target: SCN9A; (-) strand; PAM type: NRG; PAM sequence: TAG
caatggccactttacactcc

SEQ ID NO: 25343 - DNA, 20 bp, Artificial Sequence
  Description of Artificial Sequence: Synthetic oligonucleotide
  Target: SCN9A; (-) strand; PAM type: NRG; PAM sequence: TGG
agagagcccttgaatatcaa

SEQ ID NO: 25344 - DNA, 20 bp, Artificial Sequence
  Description of Artificial Sequence: Synthetic oligonucleotide
  Target: SCN9A; (-) strand; PAM type: NRG; PAM sequence: GAG
tctgtgacagagcacagaga

SEQ ID NO: 25345 - DNA, 20 bp, Artificial Sequence
  Description of Artificial Sequence: Synthetic oligonucleotide
  Target: SCN9A; (-) strand; PAM type: NRG; PAM sequence: GAG
gttctgtgacagagcacaga

SEQ ID NO: 25346 - DNA, 20 bp, Artificial Sequence
  Description of Artificial Sequence: Synthetic oligonucleotide
  Target: SCN9A; (-) strand; PAM type: NRG; PAM sequence: GAG
cagttctgtgacagagcaca

SEQ ID NO: 25347 - DNA, 20 bp, Artificial Sequence
  Description of Artificial Sequence: Synthetic oligonucleotide
  Target: SCN9A; (-) strand; PAM type: NRG; PAM sequence: CAG
agcagttctgtgacagagca

SEQ ID NO: 25348 - DNA, 20 bp, Artificial Sequence
  Description of Artificial Sequence: Synthetic oligonucleotide
  Target: SCN9A; (-) strand; PAM type: NRG; PAM sequence: GAG
agtgtagcagttctgtgaca

SEQ ID NO: 25349 - DNA, 20 bp, Artificial Sequence
  Description of Artificial Sequence: Synthetic oligonucleotide
  Target: SCN9A; (-) strand; PAM type: NRG; PAM sequence: CAG
acagtgtagcagttctgtga

SEQ ID NO: 25350 - DNA, 20 bp, Artificial Sequence
  Description of Artificial Sequence: Synthetic oligonucleotide
  Target: SCN9A; (-) strand; PAM type: NRG; PAM sequence: CAG
tttctctgcaaacagtgtag

SEQ ID NO: 25351 - DNA, 20 bp, Artificial Sequence
  Description of Artificial Sequence: Synthetic oligonucleotide
  Target: SCN9A; (-) strand; PAM type: NRG; PAM sequence: TAG
tgctttctctgcaaacagtg

SEQ ID NO: 25352 - DNA, 20 bp, Artificial Sequence
  Description of Artificial Sequence: Synthetic oligonucleotide
  Target: SCN9A; (-) strand; PAM type: NRG; PAM sequence: CAG
ccagctgctttctctgcaaa

SEQ ID NO: 25353 - DNA, 20 bp, Artificial Sequence
  Description of Artificial Sequence: Synthetic oligonucleotide
  Target: SCN9A; (-) strand; PAM type: NRG; PAM sequence: CAG
tgacttgacccactgtattc

SEQ ID NO: 25354 - DNA, 20 bp, Artificial Sequence
  Description of Artificial Sequence: Synthetic oligonucleotide
  Target: SCN9A; (-) strand; PAM type: NRG; PAM sequence: AAG
tgtttgcttctaaagacttt

SEQ ID NO: 25355 - DNA, 20 bp, Artificial Sequence
  Description of Artificial Sequence: Synthetic oligonucleotide
  Target: SCN9A; (-) strand; PAM type: NRG; PAM sequence: AAG
tgtttaaatgtttgcttcta

SEQ ID NO: 25356 - DNA, 20 bp, Artificial Sequence
  Description of Artificial Sequence: Synthetic oligonucleotide
  Target: SCN9A; (-) strand; PAM type: NRG; PAM sequence: TAG
tttttttaagctggcataaa

SEQ ID NO: 25357 - DNA, 20 bp, Artificial Sequence
  Description of Artificial Sequence: Synthetic oligonucleotide
  Target: SCN9A; (-) strand; PAM type: NRG; PAM sequence: TGG
cttgttgcatttttttaagc

SEQ ID NO: 25358 - DNA, 20 bp, Artificial Sequence
  Description of Artificial Sequence: Synthetic oligonucleotide
  Target: SCN9A; (-) strand; PAM type: NRG; PAM sequence: AAG
cctacttgttgcattttttt

SEQ ID NO: 25359 - DNA, 20 bp, Artificial Sequence
  Description of Artificial Sequence: Synthetic oligonucleotide
  Target: SCN9A; (-) strand; PAM type: NRG; PAM sequence: AGG
ctttgcctttatgtttgcta

SEQ ID NO: 25360 - DNA, 20 bp, Artificial Sequence
  Description of Artificial Sequence: Synthetic oligonucleotide
  Target: SCN9A; (-) strand; PAM type: NRG; PAM sequence: AAG
actttgcctttatgtttgct

SEQ ID NO: 25361 - DNA, 20 bp, Artificial Sequence
  Description of Artificial Sequence: Synthetic oligonucleotide
  Target: SCN9A; (-) strand; PAM type: NRG; PAM sequence: GAG
agataatatttacgaagctt

SEQ ID NO: 25362 - DNA, 20 bp, Artificial Sequence
  Description of Artificial Sequence: Synthetic oligonucleotide
  Target: SCN9A; (-) strand; PAM type: NRG; PAM sequence: AAG
aattatagataatatttacg

SEQ ID NO: 25363 - DNA, 20 bp, Artificial Sequence
  Description of Artificial Sequence: Synthetic oligonucleotide
  Target: SCN9A; (-) strand; PAM type: NRG; PAM sequence: TAG
tcttgtttgtttcaaaatta

SEQ ID NO: 25364 - DNA, 20 bp, Artificial Sequence
  Description of Artificial Sequence: Synthetic oligonucleotide
  Target: SCN9A; (-) strand; PAM type: NRG; PAM sequence: TAG
aaatgattcagatatctagg

SEQ ID NO: 25365 - DNA, 20 bp, Artificial Sequence
  Description of Artificial Sequence: Synthetic oligonucleotide
  Target: SCN9A; (-) strand; PAM type: NRG; PAM sequence: AGG
cagaaatgattcagatatct

SEQ ID NO: 25366 - DNA, 20 bp, Artificial Sequence
  Description of Artificial Sequence: Synthetic oligonucleotide
  Target: SCN9A; (-) strand; PAM type: NRG; PAM sequence: TAG
acagaaatgattcagatatc

SEQ ID NO: 25367 - DNA, 20 bp, Artificial Sequence
  Description of Artificial Sequence: Synthetic oligonucleotide
  Target: SCN9A; (-) strand; PAM type: NRG; PAM sequence: CAG
agtagttaacagaaatgatt

SEQ ID NO: 25368 - DNA, 20 bp, Artificial Sequence
  Description of Artificial Sequence: Synthetic oligonucleotide
  Target: SCN9A; (-) strand; PAM type: NRG; PAM sequence: CAG
tgggtagtattagtagttaa

SEQ ID NO: 25369 - DNA, 20 bp, Artificial Sequence
  Description of Artificial Sequence: Synthetic oligonucleotide
  Target: SCN9A; (-) strand; PAM type: NRG; PAM sequence: TAG
ttcattgtgggtagtattag

SEQ ID NO: 25370 - DNA, 20 bp, Artificial Sequence
  Description of Artificial Sequence: Synthetic oligonucleotide
  Target: SCN9A; (-) strand; PAM type: NRG; PAM sequence: TAG
tccttcattgtgggtagtat

SEQ ID NO: 25371 - DNA, 20 bp, Artificial Sequence
  Description of Artificial Sequence: Synthetic oligonucleotide
  Target: SCN9A; (-) strand; PAM type: NRG; PAM sequence: TAG
ttgccctccttcattgtggg

SEQ ID NO: 25372 - DNA, 20 bp, Artificial Sequence
  Description of Artificial Sequence: Synthetic oligonucleotide
  Target: SCN9A; (-) strand; PAM type: NRG; PAM sequence: GGG
tccttgccctccttcattgt

SEQ ID NO: 25373 - DNA, 20 bp, Artificial Sequence
  Description of Artificial Sequence: Synthetic oligonucleotide
  Target: SCN9A; (-) strand; PAM type: NRG; PAM sequence: TGG
ttccttgccctccttcattg

SEQ ID NO: 25374 - DNA, 20 bp, Artificial Sequence
  Description of Artificial Sequence: Synthetic oligonucleotide
  Target: SCN9A; (-) strand; PAM type: NRG; PAM sequence: TAG
aatccacatgtttaaaaagc

SEQ ID NO: 25375 - DNA, 20 bp, Artificial Sequence
  Description of Artificial Sequence: Synthetic oligonucleotide
  Target: SCN9A; (-) strand; PAM type: NRG; PAM sequence: AAG
tagaaatccacatgtttaaa

SEQ ID NO: 25376 - DNA, 20 bp, Artificial Sequence
  Description of Artificial Sequence: Synthetic oligonucleotide
  Target: SCN9A; (-) strand; PAM type: NRG; PAM sequence: TAG
tctatttatattttcaatat

SEQ ID NO: 25377 - DNA, 20 bp, Artificial Sequence
  Description of Artificial Sequence: Synthetic oligonucleotide
  Target: SCN9A; (-) strand; PAM type: NRG; PAM sequence: TAG
agctgcctacataaaggata

SEQ ID NO: 25378 - DNA, 20 bp, Artificial Sequence
  Description of Artificial Sequence: Synthetic oligonucleotide
  Target: SCN9A; (-) strand; PAM type: NRG; PAM sequence: AGG
agcaaaagctgcctacataa

SEQ ID NO: 25379 - DNA, 20 bp, Artificial Sequence
  Description of Artificial Sequence: Synthetic oligonucleotide
  Target: SCN9A; (-) strand; PAM type: NRG; PAM sequence: AAG
tagcaaaagctgcctacata

SEQ ID NO: 25380 - DNA, 20 bp, Artificial Sequence
  Description of Artificial Sequence: Synthetic oligonucleotide
  Target: SCN9A; (-) strand; PAM type: NRG; PAM sequence: AAG
gaaatatggcactttagcaa

SEQ ID NO: 25381 - DNA, 20 bp, Artificial Sequence
  Description of Artificial Sequence: Synthetic oligonucleotide
  Target: SCN9A; (-) strand; PAM type: NRG; PAM sequence: TAG
tgacttgaaatatggcactt

SEQ ID NO: 25382 - DNA, 20 bp, Artificial Sequence
  Description of Artificial Sequence: Synthetic oligonucleotide
  Target: SCN9A; (-) strand; PAM type: NRG; PAM sequence: TGG
gttaagaatgacttgaaata

SEQ ID NO: 25383 - DNA, 20 bp, Artificial Sequence
  Description of Artificial Sequence: Synthetic oligonucleotide
  Target: SCN9A; (-) strand; PAM type: NRG; PAM sequence: AAG
aaaaaactgaatattcagtt

SEQ ID NO: 25384 - DNA, 20 bp, Artificial Sequence
  Description of Artificial Sequence: Synthetic oligonucleotide
  Target: SCN9A; (-) strand; PAM type: NRG; PAM sequence: CAG
taagaaaaaaactgaatatt

SEQ ID NO: 25385 - DNA, 20 bp, Artificial Sequence
  Description of Artificial Sequence: Synthetic oligonucleotide
  Target: SCN9A; (-) strand; PAM type: NRG; PAM sequence: AAG
taatgaatggtcatcctctt

SEQ ID NO: 25386 - DNA, 20 bp, Artificial Sequence
  Description of Artificial Sequence: Synthetic oligonucleotide
  Target: SCN9A; (-) strand; PAM type: NRG; PAM sequence: TGG
atgaggtacatgttaatgaa

SEQ ID NO: 25387 - DNA, 20 bp, Artificial Sequence
  Description of Artificial Sequence: Synthetic oligonucleotide
  Target: SCN9A; (-) strand; PAM type: NRG; PAM sequence: AGG
ccaagctgttagaaaagatg

SEQ ID NO: 25388 - DNA, 20 bp, Artificial Sequence
  Description of Artificial Sequence: Synthetic oligonucleotide
  Target: SCN9A; (-) strand; PAM type: NRG; PAM sequence: GAG
accaagctgttagaaaagat

SEQ ID NO: 25389 - DNA, 20 bp, Artificial Sequence
  Description of Artificial Sequence: Synthetic oligonucleotide
  Target: SCN9A; (-) strand; PAM type: NRG; PAM sequence: AAG
tttttaccaagctgttagaa

SEQ ID NO: 25390 - DNA, 20 bp, Artificial Sequence
  Description of Artificial Sequence: Synthetic oligonucleotide
  Target: SCN9A; (-) strand; PAM type: NRG; PAM sequence: TAG
ttacttttttaccaagctgt

SEQ ID NO: 25391 - DNA, 20 bp, Artificial Sequence
  Description of Artificial Sequence: Synthetic oligonucleotide
  Target: SCN9A; (-) strand; PAM type: NRG; PAM sequence: AAG
attcttattacttttttacc

SEQ ID NO: 25392 - DNA, 20 bp, Artificial Sequence
  Description of Artificial Sequence: Synthetic oligonucleotide
  Target: SCN9A; (-) strand; PAM type: NRG; PAM sequence: TAG
tagaaatatatatacatgca

SEQ ID NO: 25393 - DNA, 20 bp, Artificial Sequence
  Description of Artificial Sequence: Synthetic oligonucleotide
  Target: SCN9A; (-) strand; PAM type: NRG; PAM sequence: TAG
atttttgagaaagctatttc

SEQ ID NO: 25394 - DNA, 20 bp, Artificial Sequence
  Description of Artificial Sequence: Synthetic oligonucleotide
  Target: SCN9A; (-) strand; PAM type: NRG; PAM sequence: AAG
aaaacatataatttttgaga

SEQ ID NO: 25395 - DNA, 20 bp, Artificial Sequence
  Description of Artificial Sequence: Synthetic oligonucleotide
  Target: SCN9A; (-) strand; PAM type: NRG; PAM sequence: GAG
agataaaacatataattttt

SEQ ID NO: 25396 - DNA, 20 bp, Artificial Sequence
  Description of Artificial Sequence: Synthetic oligonucleotide
  Target: SCN9A; (-) strand; PAM type: NRG; PAM sequence: TAG
caatattatctatataggta

SEQ ID NO: 25397 - DNA, 20 bp, Artificial Sequence
  Description of Artificial Sequence: Synthetic oligonucleotide
  Target: SCN9A; (-) strand; PAM type: NRG; PAM sequence: AGG
acacccaatattatctatat

SEQ ID NO: 25398 - DNA, 20 bp, Artificial Sequence
  Description of Artificial Sequence: Synthetic oligonucleotide
  Target: SCN9A; (-) strand; PAM type: NRG; PAM sequence: TAG
tacacccaatattatctata

SEQ ID NO: 25399 - DNA, 20 bp, Artificial Sequence
  Description of Artificial Sequence: Synthetic oligonucleotide
  Target: SCN9A; (-) strand; PAM type: NRG; PAM sequence: AGG
cttcaactagagcctaaata

SEQ ID NO: 25400 - DNA, 20 bp, Artificial Sequence
  Description of Artificial Sequence: Synthetic oligonucleotide
  Target: SCN9A; (-) strand; PAM type: NRG; PAM sequence: AAG
tcttcaactagagcctaaat

SEQ ID NO: 25401 - DNA, 20 bp, Artificial Sequence
  Description of Artificial Sequence: Synthetic oligonucleotide
  Target: SCN9A; (-) strand; PAM type: NRG; PAM sequence: GAG
tggtgaattttcttcaacta

SEQ ID NO: 25402 - DNA, 20 bp, Artificial Sequence
  Description of Artificial Sequence: Synthetic oligonucleotide
  Target: SCN9A; (-) strand; PAM type: NRG; PAM sequence: TAG
tatggtgaattttcttcaac

SEQ ID NO: 25403 - DNA, 20 bp, Artificial Sequence
  Description of Artificial Sequence: Synthetic oligonucleotide
  Target: SCN9A; (-) strand; PAM type: NRG; PAM sequence: TGG
aactattttattccagaata

SEQ ID NO: 25404 - DNA, 20 bp, Artificial Sequence
  Description of Artificial Sequence: Synthetic oligonucleotide
  Target: SCN9A; (-) strand; PAM type: NRG; PAM sequence: CAG
catagaaaactattttattc

SEQ ID NO: 25405 - DNA, 20 bp, Artificial Sequence
  Description of Artificial Sequence: Synthetic oligonucleotide
  Target: SCN9A; (-) strand; PAM type: NRG; PAM sequence: TAG
atttagaggcaatattctca

SEQ ID NO: 25406 - DNA, 20 bp, Artificial Sequence
  Description of Artificial Sequence: Synthetic oligonucleotide
  Target: SCN9A; (-) strand; PAM type: NRG; PAM sequence: AGG
caaatttggtggggatttag

SEQ ID NO: 25407 - DNA, 20 bp, Artificial Sequence
  Description of Artificial Sequence: Synthetic oligonucleotide
  Target: SCN9A; (-) strand; PAM type: NRG; PAM sequence: GAG
tcaaatttggtggggattta

SEQ ID NO: 25408 - DNA, 20 bp, Artificial Sequence
  Description of Artificial Sequence: Synthetic oligonucleotide
  Target: SCN9A; (-) strand; PAM type: NRG; PAM sequence: TAG
tttcaaatttggtggggatt

SEQ ID NO: 25409 - DNA, 20 bp, Artificial Sequence
  Description of Artificial Sequence: Synthetic oligonucleotide
  Target: SCN9A; (-) strand; PAM type: NRG; PAM sequence: GGG
tttctatttcaaatttggtg

SEQ ID NO: 25410 - DNA, 20 bp, Artificial Sequence
  Description of Artificial Sequence: Synthetic oligonucleotide
  Target: SCN9A; (-) strand; PAM type: NRG; PAM sequence: GGG
ttttctatttcaaatttggt

SEQ ID NO: 25411 - DNA, 20 bp, Artificial Sequence
  Description of Artificial Sequence: Synthetic oligonucleotide
  Target: SCN9A; (-) strand; PAM type: NRG; PAM sequence: TGG
tttttctatttcaaatttgg

SEQ ID NO: 25412 - DNA, 20 bp, Artificial Sequence
  Description of Artificial Sequence: Synthetic oligonucleotide
  Target: SCN9A; (-) strand; PAM type: NRG; PAM sequence: TGG
atatttttctatttcaaatt

SEQ ID NO: 25413 - DNA, 20 bp, Artificial Sequence
  Description of Artificial Sequence: Synthetic oligonucleotide
  Target: SCN9A; (-) strand; PAM type: NRG; PAM sequence: AAG
tttaaaggtggcctaagtaa

SEQ ID NO: 25414 - DNA, 20 bp, Artificial Sequence
  Description of Artificial Sequence: Synthetic oligonucleotide
  Target: SCN9A; (-) strand; PAM type: NRG; PAM sequence: AAG
gataattttaaaggtggcct

SEQ ID NO: 25415 - DNA, 20 bp, Artificial Sequence
  Description of Artificial Sequence: Synthetic oligonucleotide
  Target: SCN9A; (-) strand; PAM type: NRG; PAM sequence: TGG
tttgaagataattttaaagg

SEQ ID NO: 25416 - DNA, 20 bp, Artificial Sequence
  Description of Artificial Sequence: Synthetic oligonucleotide
  Target: SCN9A; (-) strand; PAM type: NRG; PAM sequence: AGG
ttatttgaagataattttaa

SEQ ID NO: 25417 - DNA, 20 bp, Artificial Sequence
  Description of Artificial Sequence: Synthetic oligonucleotide
  Target: SCN9A; (-) strand; PAM type: NRG; PAM sequence: AAG
tttatttgaagataatttta

SEQ ID NO: 25418 - DNA, 20 bp, Artificial Sequence
  Description of Artificial Sequence: Synthetic oligonucleotide
  Target: SCN9A; (-) strand; PAM type: NRG; PAM sequence: AAG
ttagtgttccagtttatttg

SEQ ID NO: 25419 - DNA, 20 bp, Artificial Sequence
  Description of Artificial Sequence: Synthetic oligonucleotide
  Target: SCN9A; (-) strand; PAM type: NRG; PAM sequence: CAG
aattagttattttagtgttc

SEQ ID NO: 25420 - DNA, 20 bp, Artificial Sequence
  Description of Artificial Sequence: Synthetic oligonucleotide
  Target: SCN9A; (-) strand; PAM type: NRG; PAM sequence: TAG
aaatgaaaaattagttattt

SEQ ID NO: 25421 - DNA, 20 bp, Artificial Sequence
  Description of Artificial Sequence: Synthetic oligonucleotide
  Target: SCN9A; (-) strand; PAM type: NRG; PAM sequence: TAG
aacagtttcaaatgaaaaat

SEQ ID NO: 25422 - DNA, 20 bp, Artificial Sequence
  Description of Artificial Sequence: Synthetic oligonucleotide
  Target: SCN9A; (-) strand; PAM type: NRG; PAM sequence: CAG
cttagagataatattgctaa

SEQ ID NO: 25423 - DNA, 20 bp, Artificial Sequence
  Description of Artificial Sequence: Synthetic oligonucleotide
  Target: SCN9A; (-) strand; PAM type: NRG; PAM sequence: GAG
cctgaaattgacacacctta

SEQ ID NO: 25424 - DNA, 20 bp, Artificial Sequence
  Description of Artificial Sequence: Synthetic oligonucleotide
  Target: SCN9A; (-) strand; PAM type: NRG; PAM sequence: TAG
atcctgaaattgacacacct

SEQ ID NO: 25425 - DNA, 20 bp, Artificial Sequence
  Description of Artificial Sequence: Synthetic oligonucleotide
  Target: SCN9A; (-) strand; PAM type: NRG; PAM sequence: AAG
tatctattgtgcaatgatga

SEQ ID NO: 25426 - DNA, 20 bp, Artificial Sequence
  Description of Artificial Sequence: Synthetic oligonucleotide
  Target: SCN9A; (-) strand; PAM type: NRG; PAM sequence: GAG
tgaatttctctgtcattgtt

SEQ ID NO: 25427 - DNA, 20 bp, Artificial Sequence
  Description of Artificial Sequence: Synthetic oligonucleotide
  Target: SCN9A; (-) strand; PAM type: NRG; PAM sequence: TAG
cttgactcctttttataatc

SEQ ID NO: 25428 - DNA, 20 bp, Artificial Sequence
  Description of Artificial Sequence: Synthetic oligonucleotide
  Target: SCN9A; (-) strand; PAM type: NRG; PAM sequence: AAG
gggcaggaatctctgccaat

SEQ ID NO: 25429 - DNA, 20 bp, Artificial Sequence
  Description of Artificial Sequence: Synthetic oligonucleotide
  Target: SCN9A; (-) strand; PAM type: NRG; PAM sequence: AGG
aatagttctaggatgggggc

SEQ ID NO: 25430 - DNA, 20 bp, Artificial Sequence
  Description of Artificial Sequence: Synthetic oligonucleotide
  Target: SCN9A; (-) strand; PAM type: NRG; PAM sequence: CAG
taatagttctaggatggggg

SEQ ID NO: 25431 - DNA, 20 bp, Artificial Sequence
  Description of Artificial Sequence: Synthetic oligonucleotide
  Target: SCN9A; (-) strand; PAM type: NRG; PAM sequence: GGG
ctttaatagttctaggatgg

SEQ ID NO: 25432 - DNA, 20 bp, Artificial Sequence
  Description of Artificial Sequence: Synthetic oligonucleotide
  Target: SCN9A; (-) strand; PAM type: NRG; PAM sequence: GGG
actttaatagttctaggatg

SEQ ID NO: 25433 - DNA, 20 bp, Artificial Sequence
  Description of Artificial Sequence: Synthetic oligonucleotide
  Target: SCN9A; (-) strand; PAM type: NRG; PAM sequence: GGG
aactttaatagttctaggat

SEQ ID NO: 25434 - DNA, 20 bp, Artificial Sequence
  Description of Artificial Sequence: Synthetic oligonucleotide
  Target: SCN9A; (-) strand; PAM type: NRG; PAM sequence: TGG
gaactttaatagttctagga

SEQ ID NO: 25435 - DNA, 20 bp, Artificial Sequence
  Description of Artificial Sequence: Synthetic oligonucleotide
  Target: SCN9A; (-) strand; PAM type: NRG; PAM sequence: AGG
gactgaactttaatagttct

SEQ ID NO: 25436 - DNA, 20 bp, Artificial Sequence
  Description of Artificial Sequence: Synthetic oligonucleotide
  Target: SCN9A; (-) strand; PAM type: NRG; PAM sequence: TAG
tgactgaactttaatagttc

SEQ ID NO: 25437 - DNA, 20 bp, Artificial Sequence
  Description of Artificial Sequence: Synthetic oligonucleotide
  Target: SCN9A; (-) strand; PAM type: NRG; PAM sequence: TAG
gttgaatgactgaactttaa

SEQ ID NO: 25438 - DNA, 20 bp, Artificial Sequence
  Description of Artificial Sequence: Synthetic oligonucleotide
  Target: SCN9A; (-) strand; PAM type: NRG; PAM sequence: TAG
actaagatatattttaattt

SEQ ID NO: 25439 - DNA, 20 bp, Artificial Sequence
  Description of Artificial Sequence: Synthetic oligonucleotide
  Target: SCN9A; (-) strand; PAM type: NRG; PAM sequence: AAG
aatgtattaaaatacatact

SEQ ID NO: 25440 - DNA, 20 bp, Artificial Sequence
  Description of Artificial Sequence: Synthetic oligonucleotide
  Target: SCN9A; (-) strand; PAM type: NRG; PAM sequence: CAG
acttttactgaaattagata

SEQ ID NO: 25441 - DNA, 20 bp, Artificial Sequence
  Description of Artificial Sequence: Synthetic oligonucleotide
  Target: SCN9A; (-) strand; PAM type: NRG; PAM sequence: TAG
tagaacacttttactgaaat

SEQ ID NO: 25442 - DNA, 20 bp, Artificial Sequence
  Description of Artificial Sequence: Synthetic oligonucleotide
  Target: SCN9A; (-) strand; PAM type: NRG; PAM sequence: TAG
tcctatctatcaataacaca

SEQ ID NO: 25443 - DNA, 20 bp, Artificial Sequence
  Description of Artificial Sequence: Synthetic oligonucleotide
  Target: SCN9A; (-) strand; PAM type: NRG; PAM sequence: GAG
gaaactaagaggtttagata

SEQ ID NO: 25444 - DNA, 20 bp, Artificial Sequence
  Description of Artificial Sequence: Synthetic oligonucleotide
  Target: SCN9A; (-) strand; PAM type: NRG; PAM sequence: TAG
tagaaactaagaggtttaga

SEQ ID NO: 25445 - DNA, 20 bp, Artificial Sequence
  Description of Artificial Sequence: Synthetic oligonucleotide
  Target: SCN9A; (-) strand; PAM type: NRG; PAM sequence: TAG
tctctagaaactaagaggtt

SEQ ID NO: 25446 - DNA, 20 bp, Artificial Sequence
  Description of Artificial Sequence: Synthetic oligonucleotide
  Target: SCN9A; (-) strand; PAM type: NRG; PAM sequence: AGG
atcagtctctagaaactaag

SEQ ID NO: 25447 - DNA, 20 bp, Artificial Sequence
  Description of Artificial Sequence: Synthetic oligonucleotide
  Target: SCN9A; (-) strand; PAM type: NRG; PAM sequence: GAG
gatcagtctctagaaactaa

SEQ ID NO: 25448 - DNA, 20 bp, Artificial Sequence
  Description of Artificial Sequence: Synthetic oligonucleotide
  Target: SCN9A; (-) strand; PAM type: NRG; PAM sequence: AAG
cagatcagtctctagaaact

SEQ ID NO: 25449 - DNA, 20 bp, Artificial Sequence
  Description of Artificial Sequence: Synthetic oligonucleotide
  Target: SCN9A; (-) strand; PAM type: NRG; PAM sequence: TAG
tacataatcagatcagtctc

SEQ ID NO: 25450 - DNA, 20 bp, Artificial Sequence
  Description of Artificial Sequence: Synthetic oligonucleotide
  Target: SCN9A; (-) strand; PAM type: NRG; PAM sequence: CAG
gattatatacataatcagat

SEQ ID NO: 25451 - DNA, 20 bp, Artificial Sequence
  Description of Artificial Sequence: Synthetic oligonucleotide
  Target: SCN9A; (-) strand; PAM type: NRG; PAM sequence: CAG
tttctgattatatacataat

SEQ ID NO: 25452 - DNA, 20 bp, Artificial Sequence
  Description of Artificial Sequence: Synthetic oligonucleotide
  Target: SCN9A; (-) strand; PAM type: NRG; PAM sequence: AAG
tattactcattgataagaat

SEQ ID NO: 25453 - DNA, 20 bp, Artificial Sequence
  Description of Artificial Sequence: Synthetic oligonucleotide
  Target: SCN9A; (-) strand; PAM type: NRG; PAM sequence: AAG
aagtaatattactcattgat

SEQ ID NO: 25454 - DNA, 20 bp, Artificial Sequence
  Description of Artificial Sequence: Synthetic oligonucleotide
  Target: SCN9A; (-) strand; PAM type: NRG; PAM sequence: AAG
aatgtttaattttattccag

SEQ ID NO: 25455 - DNA, 20 bp, Artificial Sequence
  Description of Artificial Sequence: Synthetic oligonucleotide
  Target: SCN9A; (-) strand; PAM type: NRG; PAM sequence: CAG
caaaatgtttaattttattc

SEQ ID NO: 25456 - DNA, 20 bp, Artificial Sequence
  Description of Artificial Sequence: Synthetic oligonucleotide
  Target: SCN9A; (-) strand; PAM type: NRG; PAM sequence: AAG
cctatgaatgaataagtgat

SEQ ID NO: 25457 - DNA, 20 bp, Artificial Sequence
  Description of Artificial Sequence: Synthetic oligonucleotide
  Target: SCN9A; (-) strand; PAM type: NRG; PAM sequence: AAG
ggccttgcctatgaatgaat

SEQ ID NO: 25458 - DNA, 20 bp, Artificial Sequence
  Description of Artificial Sequence: Synthetic oligonucleotide
  Target: SCN9A; (-) strand; PAM type: NRG; PAM sequence: AGG
tgcatcagttaaaagttgat

SEQ ID NO: 25459 - DNA, 20 bp, Artificial Sequence
  Description of Artificial Sequence: Synthetic oligonucleotide
  Target: SCN9A; (-) strand; PAM type: NRG; PAM sequence: TAG
atgcatcagttaaaagttga

SEQ ID NO: 25460 - DNA, 20 bp, Artificial Sequence
  Description of Artificial Sequence: Synthetic oligonucleotide
  Target: SCN9A; (-) strand; PAM type: NRG; PAM sequence: AAG
atataaaatgcatcagttaa

SEQ ID NO: 25461 - DNA, 20 bp, Artificial Sequence
  Description of Artificial Sequence: Synthetic oligonucleotide
  Target: SCN9A; (-) strand; PAM type: NRG; PAM sequence: CAG
tgctcctatataaaatgcat

SEQ ID NO: 25462 - DNA, 20 bp, Artificial Sequence
  Description of Artificial Sequence: Synthetic oligonucleotide
  Target: SCN9A; (-) strand; PAM type: NRG; PAM sequence: CAG
tttatttttttaaatcaact

SEQ ID NO: 25463 - DNA, 20 bp, Artificial Sequence
  Description of Artificial Sequence: Synthetic oligonucleotide
  Target: SCN9A; (-) strand; PAM type: NRG; PAM sequence: GGG
ttttatgcactgttagttat

SEQ ID NO: 25464 - DNA, 20 bp, Artificial Sequence
  Description of Artificial Sequence: Synthetic oligonucleotide
  Target: SCN9A; (-) strand; PAM type: NRG; PAM sequence: TGG
gttttatgcactgttagtta

SEQ ID NO: 25465 - DNA, 20 bp, Artificial Sequence
  Description of Artificial Sequence: Synthetic oligonucleotide
  Target: SCN9A; (-) strand; PAM type: NRG; PAM sequence: TAG
gaaatggttttatgcactgt

SEQ ID NO: 25466 - DNA, 20 bp, Artificial Sequence
  Description of Artificial Sequence: Synthetic oligonucleotide
  Target: SCN9A; (-) strand; PAM type: NRG; PAM sequence: TGG
actttgaatacattttgaaa

SEQ ID NO: 25467 - DNA, 20 bp, Artificial Sequence
  Description of Artificial Sequence: Synthetic oligonucleotide
  Target: SCN9A; (-) strand; PAM type: NRG; PAM sequence: TAG
aagccaaagtaccctgcttc

SEQ ID NO: 25468 - DNA, 20 bp, Artificial Sequence
  Description of Artificial Sequence: Synthetic oligonucleotide
  Target: SCN9A; (-) strand; PAM type: NRG; PAM sequence: AAG
gaaagttggggtcaaagcca

SEQ ID NO: 25469 - DNA, 20 bp, Artificial Sequence
  Description of Artificial Sequence: Synthetic oligonucleotide
  Target: SCN9A; (-) strand; PAM type: NRG; PAM sequence: AAG
catctagaaagttggggtca

SEQ ID NO: 25470 - DNA, 20 bp, Artificial Sequence
  Description of Artificial Sequence: Synthetic oligonucleotide
  Target: SCN9A; (-) strand; PAM type: NRG; PAM sequence: GGG
agtacacatctagaaagttg

SEQ ID NO: 25471 - DNA, 20 bp, Artificial Sequence
  Description of Artificial Sequence: Synthetic oligonucleotide
  Target: SCN9A; (-) strand; PAM type: NRG; PAM sequence: GGG
tagtacacatctagaaagtt

SEQ ID NO: 25472 - DNA, 20 bp, Artificial Sequence
  Description of Artificial Sequence: Synthetic oligonucleotide
  Target: SCN9A; (-) strand; PAM type: NRG; PAM sequence: TGG
ttagtacacatctagaaagt

SEQ ID NO: 25473 - DNA, 20 bp, Artificial Sequence
  Description of Artificial Sequence: Synthetic oligonucleotide
  Target: SCN9A; (-) strand; PAM type: NRG; PAM sequence: AAG
tttcttagtacacatctaga

SEQ ID NO: 25474 - DNA, 20 bp, Artificial Sequence
  Description of Artificial Sequence: Synthetic oligonucleotide
  Target: SCN9A; (-) strand; PAM type: NRG; PAM sequence: TAG
atgctttcttagtacacatc

SEQ ID NO: 25475 - DNA, 20 bp, Artificial Sequence
  Description of Artificial Sequence: Synthetic oligonucleotide
  Target: SCN9A; (-) strand; PAM type: NRG; PAM sequence: TAG
aattgagactcatgctttct

SEQ ID NO: 25476 - DNA, 20 bp, Artificial Sequence
  Description of Artificial Sequence: Synthetic oligonucleotide
  Target: SCN9A; (-) strand; PAM type: NRG; PAM sequence: GAG
tatttatggataagcaaatt

SEQ ID NO: 25477 - DNA, 20 bp, Artificial Sequence
  Description of Artificial Sequence: Synthetic oligonucleotide
  Target: SCN9A; (-) strand; PAM type: NRG; PAM sequence: AAG
ctggttatgtatttatggat

SEQ ID NO: 25478 - DNA, 20 bp, Artificial Sequence
  Description of Artificial Sequence: Synthetic oligonucleotide
  Target: SCN9A; (-) strand; PAM type: NRG; PAM sequence: TGG
taattctggttatgtattta

SEQ ID NO: 25479 - DNA, 20 bp, Artificial Sequence
  Description of Artificial Sequence: Synthetic oligonucleotide
  Target: SCN9A; (-) strand; PAM type: NRG; PAM sequence: TGG
agctttgtatttaataattc

SEQ ID NO: 25480 - DNA, 20 bp, Artificial Sequence
  Description of Artificial Sequence: Synthetic oligonucleotide
  Target: SCN9A; (-) strand; PAM type: NRG; PAM sequence: TAG
ggaaaagatcattgtaattc

SEQ ID NO: 25481 - DNA, 20 bp, Artificial Sequence
  Description of Artificial Sequence: Synthetic oligonucleotide
  Target: SCN9A; (-) strand; PAM type: NRG; PAM sequence: AAG
ataaaatctcagagcaggaa

SEQ ID NO: 25482 - DNA, 20 bp, Artificial Sequence
  Description of Artificial Sequence: Synthetic oligonucleotide
  Target: SCN9A; (-) strand; PAM type: NRG; PAM sequence: AGG
taaatataaaatctcagagc

SEQ ID NO: 25483 - DNA, 20 bp, Artificial Sequence
  Description of Artificial Sequence: Synthetic oligonucleotide
  Target: SCN9A; (-) strand; PAM type: NRG; PAM sequence: CAG
ataaatataaaatctcagag

SEQ ID NO: 25484 - DNA, 20 bp, Artificial Sequence
  Description of Artificial Sequence: Synthetic oligonucleotide
  Target: SCN9A; (-) strand; PAM type: NRG; PAM sequence: GAG
ggcataaatataaaatctca

SEQ ID NO: 25485 - DNA, 20 bp, Artificial Sequence
  Description of Artificial Sequence: Synthetic oligonucleotide
  Target: SCN9A; (-) strand; PAM type: NRG; PAM sequence: CAG
ctggcataaatataaaatct

SEQ ID NO: 25486 - DNA, 20 bp, Artificial Sequence
  Description of Artificial Sequence: Synthetic oligonucleotide
  Target: SCN9A; (-) strand; PAM type: NRG; PAM sequence: TGG
aattgtggaagaagtgtttc

SEQ ID NO: 25487 - DNA, 20 bp, Artificial Sequence
  Description of Artificial Sequence: Synthetic oligonucleotide
  Target: SCN9A; (-) strand; PAM type: NRG; PAM sequence: AAG
actctaaaaaattgtggaag

SEQ ID NO: 25488 - DNA, 20 bp, Artificial Sequence
  Description of Artificial Sequence: Synthetic oligonucleotide
  Target: SCN9A; (-) strand; PAM type: NRG; PAM sequence: AAG
aaaactctaaaaaattgtgg

SEQ ID NO: 25489 - DNA, 20 bp, Artificial Sequence
  Description of Artificial Sequence: Synthetic oligonucleotide
  Target: SCN9A; (-) strand; PAM type: NRG; PAM sequence: TGG
atcaaaactctaaaaaattg

SEQ ID NO: 25490 - DNA, 20 bp, Artificial Sequence
  Description of Artificial Sequence: Synthetic oligonucleotide
  Target: SCN9A; (-) strand; PAM type: NRG; PAM sequence: TAG
attgtcacatttaaattaag

SEQ ID NO: 25491 - DNA, 20 bp, Artificial Sequence
  Description of Artificial Sequence: Synthetic oligonucleotide
  Target: SCN9A; (-) strand; PAM type: NRG; PAM sequence: AAG
taaattgtcacatttaaatt

SEQ ID NO: 25492 - DNA, 20 bp, Artificial Sequence
  Description of Artificial Sequence: Synthetic oligonucleotide
  Target: SCN9A; (-) strand; PAM type: NRG; PAM sequence: GAG
aatctacataaaaatatgga

SEQ ID NO: 25493 - DNA, 20 bp, Artificial Sequence
  Description of Artificial Sequence: Synthetic oligonucleotide
  Target: SCN9A; (-) strand; PAM type: NRG; PAM sequence: GAG
ttaatctacataaaaatatg

SEQ ID NO: 25494 - DNA, 20 bp, Artificial Sequence
  Description of Artificial Sequence: Synthetic oligonucleotide
  Target: SCN9A; (-) strand; PAM type: NRG; PAM sequence: TGG
atttaatctacataaaaata

SEQ ID NO: 25495 - DNA, 20 bp, Artificial Sequence
  Description of Artificial Sequence: Synthetic oligonucleotide
  Target: SCN9A; (-) strand; PAM type: NRG; PAM sequence: AAG
gaatgtaacagtagccattg

SEQ ID NO: 25496 - DNA, 20 bp, Artificial Sequence
  Description of Artificial Sequence: Synthetic oligonucleotide
  Target: SCN9A; (-) strand; PAM type: NRG; PAM sequence: TAG
taaaatgcagaatgtaacag

SEQ ID NO: 25497 - DNA, 20 bp, Artificial Sequence
  Description of Artificial Sequence: Synthetic oligonucleotide
  Target: SCN9A; (-) strand; PAM type: NRG; PAM sequence: CAG
aagtaaaatgcagaatgtaa

SEQ ID NO: 25498 - DNA, 20 bp, Artificial Sequence
  Description of Artificial Sequence: Synthetic oligonucleotide
  Target: SCN9A; (-) strand; PAM type: NRG; PAM sequence: CAG
ttgattataaaagtaaaatg

SEQ ID NO: 25499 - DNA, 20 bp, Artificial Sequence
  Description of Artificial Sequence: Synthetic oligonucleotide
  Target: SCN9A; (-) strand; PAM type: NRG; PAM sequence: AAG
ttttattgaattgattataa

SEQ ID NO: 25500 - DNA, 20 bp, Artificial Sequence
  Description of Artificial Sequence: Synthetic oligonucleotide
  Target: SCN9A; (-) strand; PAM type: NRG; PAM sequence: TAG
gatttcaagtgcatgatctg

SEQ ID NO: 25501 - DNA, 20 bp, Artificial Sequence
  Description of Artificial Sequence: Synthetic oligonucleotide
  Target: SCN9A; (-) strand; PAM type: NRG; PAM sequence: AAG
tcatgtgcttaagtgatttc

SEQ ID NO: 25502 - DNA, 20 bp, Artificial Sequence
  Description of Artificial Sequence: Synthetic oligonucleotide
  Target: SCN9A; (-) strand; PAM type: NRG; PAM sequence: AAG
gatgtaaccttcatgtgctt

SEQ ID NO: 25503 - DNA, 20 bp, Artificial Sequence
  Description of Artificial Sequence: Synthetic oligonucleotide
  Target: SCN9A; (-) strand; PAM type: NRG; PAM sequence: GGG
gacatcacagcatgtcacca

SEQ ID NO: 25504 - DNA, 20 bp, Artificial Sequence
  Description of Artificial Sequence: Synthetic oligonucleotide
  Target: SCN9A; (-) strand; PAM type: NRG; PAM sequence: AGG
tgacatcacagcatgtcacc

SEQ ID NO: 25505 - DNA, 20 bp, Artificial Sequence
  Description of Artificial Sequence: Synthetic oligonucleotide
  Target: SCN9A; (-) strand; PAM type: NRG; PAM sequence: CAG
gtgacatcacagcatgtcac

SEQ ID NO: 25506 - DNA, 20 bp, Artificial Sequence
  Description of Artificial Sequence: Synthetic oligonucleotide
  Target: SCN9A; (-) strand; PAM type: NRG; PAM sequence: CAG
caatagataaagtgacatca

SEQ ID NO: 25507 - DNA, 20 bp, Artificial Sequence
  Description of Artificial Sequence: Synthetic oligonucleotide
  Target: SCN9A; (-) strand; PAM type: NRG; PAM sequence: AAG
atacagttgttcaatagata

SEQ ID NO: 25508 - DNA, 20 bp, Artificial Sequence
  Description of Artificial Sequence: Synthetic oligonucleotide
  Target: SCN9A; (-) strand; PAM type: NRG; PAM sequence: TAG
aaacatatacagttgttcaa

SEQ ID NO: 25509 - DNA, 20 bp, Artificial Sequence
  Description of Artificial Sequence: Synthetic oligonucleotide
  Target: SCN9A; (-) strand; PAM type: NRG; PAM sequence: CAG
caagaaagtagaaacatata

SEQ ID NO: 25510 - DNA, 20 bp, Artificial Sequence
  Description of Artificial Sequence: Synthetic oligonucleotide
  Target: SCN9A; (-) strand; PAM type: NRG; PAM sequence: TAG
cctgacccactgcaagaaag

SEQ ID NO: 25511 - DNA, 20 bp, Artificial Sequence
  Description of Artificial Sequence: Synthetic oligonucleotide
  Target: SCN9A; (-) strand; PAM type: NRG; PAM sequence: AAG
ctgcctgacccactgcaaga

SEQ ID NO: 25512 - DNA, 20 bp, Artificial Sequence
  Description of Artificial Sequence: Synthetic oligonucleotide
  Target: SCN9A; (-) strand; PAM type: NRG; PAM sequence: AAG
ctttctgcctgacccactgc

SEQ ID NO: 25513 - DNA, 20 bp, Artificial Sequence
  Description of Artificial Sequence: Synthetic oligonucleotide
  Target: SCN9A; (-) strand; PAM type: NRG; PAM sequence: CAG
tcaatgtcttgcatgctgtt

SEQ ID NO: 25514 - DNA, 20 bp, Artificial Sequence
  Description of Artificial Sequence: Synthetic oligonucleotide
  Target: SCN9A; (-) strand; PAM type: NRG; PAM sequence: AGG
atatgtcaccacttttacac

SEQ ID NO: 25515 - DNA, 20 bp, Artificial Sequence
  Description of Artificial Sequence: Synthetic oligonucleotide
  Target: SCN9A; (-) strand; PAM type: NRG; PAM sequence: CAG
catatgtcaccacttttaca

SEQ ID NO: 25516 - DNA, 20 bp, Artificial Sequence
  Description of Artificial Sequence: Synthetic oligonucleotide
  Target: SCN9A; (-) strand; PAM type: NRG; PAM sequence: GAG
tctgtgcttttaaccaggca

SEQ ID NO: 25517 - DNA, 20 bp, Artificial Sequence
  Description of Artificial Sequence: Synthetic oligonucleotide
  Target: SCN9A; (-) strand; PAM type: NRG; PAM sequence: CAG
gctctgtgcttttaaccagg

SEQ ID NO: 25518 - DNA, 20 bp, Artificial Sequence
  Description of Artificial Sequence: Synthetic oligonucleotide
  Target: SCN9A; (-) strand; PAM type: NRG; PAM sequence: AGG
gcagctctgtgcttttaacc

SEQ ID NO: 25519 - DNA, 20 bp, Artificial Sequence
  Description of Artificial Sequence: Synthetic oligonucleotide
  Target: SCN9A; (-) strand; PAM type: NRG; PAM sequence: CAG
tgcagctctgtgcttttaac

SEQ ID NO: 25520 - DNA, 20 bp, Artificial Sequence
  Description of Artificial Sequence: Synthetic oligonucleotide
  Target: SCN9A; (-) strand; PAM type: NRG; PAM sequence: CAG
aactggatcagtcaaggatg

SEQ ID NO: 25521 - DNA, 20 bp, Artificial Sequence
  Description of Artificial Sequence: Synthetic oligonucleotide
  Target: SCN9A; (-) strand; PAM type: NRG; PAM sequence: AGG
atatcaaactggatcagtca

SEQ ID NO: 25522 - DNA, 20 bp, Artificial Sequence
  Description of Artificial Sequence: Synthetic oligonucleotide
  Target: SCN9A; (-) strand; PAM type: NRG; PAM sequence: AAG
aatatcaaactggatcagtc

SEQ ID NO: 25523 - DNA, 20 bp, Artificial Sequence
  Description of Artificial Sequence: Synthetic oligonucleotide
  Target: SCN9A; (-) strand; PAM type: NRG; PAM sequence: CAG
ggggtaatatcaaactggat

SEQ ID NO: 25524 - DNA, 20 bp, Artificial Sequence
  Description of Artificial Sequence: Synthetic oligonucleotide
  Target: SCN9A; (-) strand; PAM type: NRG; PAM sequence: TGG
tcacaggggtaatatcaaac

SEQ ID NO: 25525 - DNA, 20 bp, Artificial Sequence
  Description of Artificial Sequence: Synthetic oligonucleotide
  Target: SCN9A; (-) strand; PAM type: NRG; PAM sequence: GGG
acctaaccttcttctcacag

SEQ ID NO: 25526 - DNA, 20 bp, Artificial Sequence
  Description of Artificial Sequence: Synthetic oligonucleotide
  Target: SCN9A; (-) strand; PAM type: NRG; PAM sequence: GGG
tacctaaccttcttctcaca

SEQ ID NO: 25527 - DNA, 20 bp, Artificial Sequence
  Description of Artificial Sequence: Synthetic oligonucleotide
  Target: SCN9A; (-) strand; PAM type: NRG; PAM sequence: AGG
gtacctaaccttcttctcac

SEQ ID NO: 25528 - DNA, 20 bp, Artificial Sequence
  Description of Artificial Sequence: Synthetic oligonucleotide
  Target: SCN9A; (-) strand; PAM type: NRG; PAM sequence: CAG
agtacctaaccttcttctca

SEQ ID NO: 25529 - DNA, 20 bp, Artificial Sequence
  Description of Artificial Sequence: Synthetic oligonucleotide
  Target: SCN9A; (-) strand; PAM type: NRG; PAM sequence: CAG
catgctgcatttctaaaatt

SEQ ID NO: 25530 - DNA, 20 bp, Artificial Sequence
  Description of Artificial Sequence: Synthetic oligonucleotide
  Target: SCN9A; (-) strand; PAM type: NRG; PAM sequence: CAG
actttaaacattttaaaaca

SEQ ID NO: 25531 - DNA, 20 bp, Artificial Sequence
  Description of Artificial Sequence: Synthetic oligonucleotide
  Target: SCN9A; (-) strand; PAM type: NRG; PAM sequence: AGG
tgtaactaatttctacttac

SEQ ID NO: 25532 - DNA, 20 bp, Artificial Sequence
  Description of Artificial Sequence: Synthetic oligonucleotide
  Target: SCN9A; (-) strand; PAM type: NRG; PAM sequence: CAG
atgtaactaatttctactta

SEQ ID NO: 25533 - DNA, 20 bp, Artificial Sequence
  Description of Artificial Sequence: Synthetic oligonucleotide
  Target: SCN9A; (-) strand; PAM type: NRG; PAM sequence: TAG
attgcttaacgttgagtata

SEQ ID NO: 25534 - DNA, 20 bp, Artificial Sequence
  Description of Artificial Sequence: Synthetic oligonucleotide
  Target: SCN9A; (-) strand; PAM type: NRG; PAM sequence: GAG
caaatatattgcttaacgtt

SEQ ID NO: 25535 - DNA, 20 bp, Artificial Sequence
  Description of Artificial Sequence: Synthetic oligonucleotide
  Target: SCN9A; (-) strand; PAM type: NRG; PAM sequence: TAG
tgttgaatgacatttaatct

SEQ ID NO: 25536 - DNA, 20 bp, Artificial Sequence
  Description of Artificial Sequence: Synthetic oligonucleotide
  Target: SCN9A; (-) strand; PAM type: NRG; PAM sequence: AAG
ctgtttaattgattgttttt

SEQ ID NO: 25537 - DNA, 20 bp, Artificial Sequence
  Description of Artificial Sequence: Synthetic oligonucleotide
  Target: SCN9A; (-) strand; PAM type: NRG; PAM sequence: TAG
tcaatttttaaatagtagag

SEQ ID NO: 25538 - DNA, 20 bp, Artificial Sequence
  Description of Artificial Sequence: Synthetic oligonucleotide
  Target: SCN9A; (-) strand; PAM type: NRG; PAM sequence: GAG
aattcaatttttaaatagta

SEQ ID NO: 25539 - DNA, 20 bp, Artificial Sequence
  Description of Artificial Sequence: Synthetic oligonucleotide
  Target: SCN9A; (-) strand; PAM type: NRG; PAM sequence: TAG
taaattcaatttttaaatag

SEQ ID NO: 25540 - DNA, 20 bp, Artificial Sequence
  Description of Artificial Sequence: Synthetic oligonucleotide
  Target: SCN9A; (-) strand; PAM type: NRG; PAM sequence: TAG
atttaaattcaatttttaaa

SEQ ID NO: 25541 - DNA, 20 bp, Artificial Sequence
  Description of Artificial Sequence: Synthetic oligonucleotide
  Target: SCN9A; (-) strand; PAM type: NRG; PAM sequence: TAG
aacattgcattagcacatta

SEQ ID NO: 25542 - DNA, 20 bp, Artificial Sequence
  Description of Artificial Sequence: Synthetic oligonucleotide
  Target: SCN9A; (-) strand; PAM type: NRG; PAM sequence: TAG
tagaatgcaaaacattgcat

SEQ ID NO: 25543 - DNA, 20 bp, Artificial Sequence
  Description of Artificial Sequence: Synthetic oligonucleotide
  Target: SCN9A; (-) strand; PAM type: NRG; PAM sequence: TAG
tgcttgcatttaaggaaaaa

SEQ ID NO: 25544 - DNA, 20 bp, Artificial Sequence
  Description of Artificial Sequence: Synthetic oligonucleotide
  Target: SCN9A; (-) strand; PAM type: NRG; PAM sequence: AGG
ttaaatgttgcttgcattta

SEQ ID NO: 25545 - DNA, 20 bp, Artificial Sequence
  Description of Artificial Sequence: Synthetic oligonucleotide
  Target: SCN9A; (-) strand; PAM type: NRG; PAM sequence: AAG
tttaaatgttgcttgcattt

SEQ ID NO: 25546 - DNA, 20 bp, Artificial Sequence
  Description of Artificial Sequence: Synthetic oligonucleotide
  Target: SCN9A; (-) strand; PAM type: NRG; PAM sequence: GAG
gccacctcaccccctatact

SEQ ID NO: 25547 - DNA, 20 bp, Artificial Sequence
  Description of Artificial Sequence: Synthetic oligonucleotide
  Target: SCN9A; (-) strand; PAM type: NRG; PAM sequence: AAG
attttagaatatgcttttta

SEQ ID NO: 25548 - DNA, 20 bp, Artificial Sequence
  Description of Artificial Sequence: Synthetic oligonucleotide
  Target: SCN9A; (-) strand; PAM type: NRG; PAM sequence: TAG
caatcaagaaatgctaattt

SEQ ID NO: 25549 - DNA, 20 bp, Artificial Sequence
  Description of Artificial Sequence: Synthetic oligonucleotide
  Target: SCN9A; (-) strand; PAM type: NRG; PAM sequence: AAG
taaataaaaataagtcaatc

SEQ ID NO: 25550 - DNA, 20 bp, Artificial Sequence
  Description of Artificial Sequence: Synthetic oligonucleotide
  Target: SCN9A; (-) strand; PAM type: NRG; PAM sequence: AAG
aaaattaattaaataaaaat

SEQ ID NO: 25551 - DNA, 20 bp, Artificial Sequence
  Description of Artificial Sequence: Synthetic oligonucleotide
  Target: SCN9A; (-) strand; PAM type: NRG; PAM sequence: TGG
tctttatattttgataaatt

SEQ ID NO: 25552 - DNA, 20 bp, Artificial Sequence
  Description of Artificial Sequence: Synthetic oligonucleotide
  Target: SCN9A; (-) strand; PAM type: NRG; PAM sequence: TGG
aaaaatctttccatcttcat

SEQ ID NO: 25553 - DNA, 20 bp, Artificial Sequence
  Description of Artificial Sequence: Synthetic oligonucleotide
  Target: SCN9A; (-) strand; PAM type: NRG; PAM sequence: AAG
tttttttcaggttgtttcca

SEQ ID NO: 25554 - DNA, 20 bp, Artificial Sequence
  Description of Artificial Sequence: Synthetic oligonucleotide
  Target: SCN9A; (-) strand; PAM type: NRG; PAM sequence: AGG
ttagaccatttgtttttttc

SEQ ID NO: 25555 - DNA, 20 bp, Artificial Sequence
  Description of Artificial Sequence: Synthetic oligonucleotide
  Target: SCN9A; (-) strand; PAM type: NRG; PAM sequence: CAG
cttagaccatttgttttttt

SEQ ID NO: 25556 - DNA, 20 bp, Artificial Sequence
  Description of Artificial Sequence: Synthetic oligonucleotide
  Target: SCN9A; (-) strand; PAM type: NRG; PAM sequence: TAG
ctcttctgtagaattgcact

SEQ ID NO: 25557 - DNA, 20 bp, Artificial Sequence
  Description of Artificial Sequence: Synthetic oligonucleotide
  Target: SCN9A; (-) strand; PAM type: NRG; PAM sequence: TAG
tttttaaaagcactcttctg

SEQ ID NO: 25558 - DNA, 20 bp, Artificial Sequence
  Description of Artificial Sequence: Synthetic oligonucleotide
  Target: SCN9A; (-) strand; PAM type: NRG; PAM sequence: AAG
tatgcatagattttttttaa

SEQ ID NO: 25559 - DNA, 20 bp, Artificial Sequence
  Description of Artificial Sequence: Synthetic oligonucleotide
  Target: SCN9A; (-) strand; PAM type: NRG; PAM sequence: TAG
ttgattctatattttatgca

SEQ ID NO: 25560 - DNA, 20 bp, Artificial Sequence
  Description of Artificial Sequence: Synthetic oligonucleotide
  Target: SCN9A; (-) strand; PAM type: NRG; PAM sequence: TGG
gttatgctgtttcgtaaaat

SEQ ID NO: 25561 - DNA, 20 bp, Artificial Sequence
  Description of Artificial Sequence: Synthetic oligonucleotide
  Target: SCN9A; (-) strand; PAM type: NRG; PAM sequence: CAG
aaagatttagggattagtta

SEQ ID NO: 25562 - DNA, 20 bp, Artificial Sequence
  Description of Artificial Sequence: Synthetic oligonucleotide
  Target: SCN9A; (-) strand; PAM type: NRG; PAM sequence: TAG
actttgaaagatttagggat

SEQ ID NO: 25563 - DNA, 20 bp, Artificial Sequence
  Description of Artificial Sequence: Synthetic oligonucleotide
  Target: SCN9A; (-) strand; PAM type: NRG; PAM sequence: GGG
atttgactttgaaagattta

SEQ ID NO: 25564 - DNA, 20 bp, Artificial Sequence
  Description of Artificial Sequence: Synthetic oligonucleotide
  Target: SCN9A; (-) strand; PAM type: NRG; PAM sequence: AGG
catttgactttgaaagattt

SEQ ID NO: 25565 - DNA, 20 bp, Artificial Sequence
  Description of Artificial Sequence: Synthetic oligonucleotide
  Target: SCN9A; (-) strand; PAM type: NRG; PAM sequence: TAG
gcatttgactttgaaagatt

SEQ ID NO: 25566 - DNA, 20 bp, Artificial Sequence
  Description of Artificial Sequence: Synthetic oligonucleotide
  Target: SCN9A; (-) strand; PAM type: NRG; PAM sequence: AAG
aaaaatgcatttgactttga

SEQ ID NO: 25567 - DNA, 20 bp, Artificial Sequence
  Description of Artificial Sequence: Synthetic oligonucleotide
  Target: SCN9A; (-) strand; PAM type: NRG; PAM sequence: TAG
ttctgcttattactacactt

SEQ ID NO: 25568 - DNA, 20 bp, Artificial Sequence
  Description of Artificial Sequence: Synthetic oligonucleotide
  Target: SCN9A; (-) strand; PAM type: NRG; PAM sequence: TAG
tagatttttaatcaaagttt

SEQ ID NO: 25569 - DNA, 20 bp, Artificial Sequence
  Description of Artificial Sequence: Synthetic oligonucleotide
  Target: SCN9A; (-) strand; PAM type: NRG; PAM sequence: AAG
tctctttagatttttaatca

SEQ ID NO: 25570 - DNA, 20 bp, Artificial Sequence
  Description of Artificial Sequence: Synthetic oligonucleotide
  Target: SCN9A; (-) strand; PAM type: NRG; PAM sequence: TAG
ttatcaagactttctctctt

SEQ ID NO: 25571 - DNA, 20 bp, Artificial Sequence
  Description of Artificial Sequence: Synthetic oligonucleotide
  Target: SCN9A; (-) strand; PAM type: NRG; PAM sequence: AAG
gttttaattacactgttatc

SEQ ID NO: 25572 - DNA, 20 bp, Artificial Sequence
  Description of Artificial Sequence: Synthetic oligonucleotide
  Target: SCN9A; (-) strand; PAM type: NRG; PAM sequence: TGG
aatgtccttttactatgtgg

SEQ ID NO: 25573 - DNA, 20 bp, Artificial Sequence
  Description of Artificial Sequence: Synthetic oligonucleotide
  Target: SCN9A; (-) strand; PAM type: NRG; PAM sequence: TGG
tttaatgtccttttactatg

SEQ ID NO: 25574 - DNA, 20 bp, Artificial Sequence
  Description of Artificial Sequence: Synthetic oligonucleotide
  Target: SCN9A; (-) strand; PAM type: NRG; PAM sequence: CAG
aaaagttgtttcaatatttg

SEQ ID NO: 25575 - DNA, 20 bp, Artificial Sequence
  Description of Artificial Sequence: Synthetic oligonucleotide
  Target: SCN9A; (-) strand; PAM type: NRG; PAM sequence: AAG
cattttgttgacctgataaa

SEQ ID NO: 25576 - DNA, 20 bp, Artificial Sequence
  Description of Artificial Sequence: Synthetic oligonucleotide
  Target: SCN9A; (-) strand; PAM type: NRG; PAM sequence: TAG
atgcttattattatgaaatg

SEQ ID NO: 25577 - DNA, 20 bp, Artificial Sequence
  Description of Artificial Sequence: Synthetic oligonucleotide
  Target: SCN9A; (-) strand; PAM type: NRG; PAM sequence: GAG
ttacaaagtcattatctttg

SEQ ID NO: 25578 - DNA, 20 bp, Artificial Sequence
  Description of Artificial Sequence: Synthetic oligonucleotide
  Target: SCN9A; (-) strand; PAM type: NRG; PAM sequence: TGG
gtttacaaagtcattatctt

SEQ ID NO: 25579 - DNA, 20 bp, Artificial Sequence
  Description of Artificial Sequence: Synthetic oligonucleotide
  Target: SCN9A; (-) strand; PAM type: NRG; PAM sequence: AAG
tattcagtgttcagtttaca

SEQ ID NO: 25580 - DNA, 20 bp, Artificial Sequence
  Description of Artificial Sequence: Synthetic oligonucleotide
  Target: SCN9A; (-) strand; PAM type: NRG; PAM sequence: CAG
ccattcatctattcagtgtt

SEQ ID NO: 25581 - DNA, 20 bp, Artificial Sequence
  Description of Artificial Sequence: Synthetic oligonucleotide
  Target: SCN9A; (-) strand; PAM type: NRG; PAM sequence: CAG
tatccacccattcatctatt

SEQ ID NO: 25582 - DNA, 20 bp, Artificial Sequence
  Description of Artificial Sequence: Synthetic oligonucleotide
  Target: SCN9A; (-) strand; PAM type: NRG; PAM sequence: AAG
gaaatctcaggcagaggaac

SEQ ID NO: 25583 - DNA, 20 bp, Artificial Sequence
  Description of Artificial Sequence: Synthetic oligonucleotide
  Target: SCN9A; (-) strand; PAM type: NRG; PAM sequence: AGG
cagaaggaaatctcaggcag

SEQ ID NO: 25584 - DNA, 20 bp, Artificial Sequence
  Description of Artificial Sequence: Synthetic oligonucleotide
  Target: SCN9A; (-) strand; PAM type: NRG; PAM sequence: GAG
acagaaggaaatctcaggca

SEQ ID NO: 25585 - DNA, 20 bp, Artificial Sequence
  Description of Artificial Sequence: Synthetic oligonucleotide
  Target: SCN9A; (-) strand; PAM type: NRG; PAM sequence: CAG
gtacagaaggaaatctcagg

SEQ ID NO: 25586 - DNA, 20 bp, Artificial Sequence
  Description of Artificial Sequence: Synthetic oligonucleotide
  Target: SCN9A; (-) strand; PAM type: NRG; PAM sequence: AGG
gtggtacagaaggaaatctc

SEQ ID NO: 25587 - DNA, 20 bp, Artificial Sequence
  Description of Artificial Sequence: Synthetic oligonucleotide
  Target: SCN9A; (-) strand; PAM type: NRG; PAM sequence: CAG
tgtggtacagaaggaaatct

SEQ ID NO: 25588 - DNA, 20 bp, Artificial Sequence
  Description of Artificial Sequence: Synthetic oligonucleotide
  Target: SCN9A; (-) strand; PAM type: NRG; PAM sequence: AGG
ctgggcagatgtggtacaga

SEQ ID NO: 25589 - DNA, 20 bp, Artificial Sequence
  Description of Artificial Sequence: Synthetic oligonucleotide
  Target: SCN9A; (-) strand; PAM type: NRG; PAM sequence: AAG
actgggcagatgtggtacag

SEQ ID NO: 25590 - DNA, 20 bp, Artificial Sequence
  Description of Artificial Sequence: Synthetic oligonucleotide
  Target: SCN9A; (-) strand; PAM type: NRG; PAM sequence: CAG
ttcactgggcagatgtggta

SEQ ID NO: 25591 - DNA, 20 bp, Artificial Sequence
  Description of Artificial Sequence: Synthetic oligonucleotide
  Target: SCN9A; (-) strand; PAM type: NRG; PAM sequence: TGG
aaaatttcactgggcagatg

SEQ ID NO: 25592 - DNA, 20 bp, Artificial Sequence
  Description of Artificial Sequence: Synthetic oligonucleotide
  Target: SCN9A; (-) strand; PAM type: NRG; PAM sequence: CAG
atggagaaaatttcactggg

SEQ ID NO: 25593 - DNA, 20 bp, Artificial Sequence
  Description of Artificial Sequence: Synthetic oligonucleotide
  Target: SCN9A; (-) strand; PAM type: NRG; PAM sequence: GGG
agtatggagaaaatttcact

SEQ ID NO: 25594 - DNA, 20 bp, Artificial Sequence
  Description of Artificial Sequence: Synthetic oligonucleotide
  Target: SCN9A; (-) strand; PAM type: NRG; PAM sequence: TGG
cagtatggagaaaatttcac

SEQ ID NO: 25595 - DNA, 20 bp, Artificial Sequence
  Description of Artificial Sequence: Synthetic oligonucleotide
  Target: SCN9A; (-) strand; PAM type: NRG; PAM sequence: GAG
agaccagaccttacagtatg

SEQ ID NO: 25596 - DNA, 20 bp, Artificial Sequence
  Description of Artificial Sequence: Synthetic oligonucleotide
  Target: SCN9A; (-) strand; PAM type: NRG; PAM sequence: TGG
ttagaccagaccttacagta

SEQ ID NO: 25597 - DNA, 20 bp, Artificial Sequence
  Description of Artificial Sequence: Synthetic oligonucleotide
  Target: SCN9A; (-) strand; PAM type: NRG; PAM sequence: CAG
ggcacttagaccagacctta

SEQ ID NO: 25598 - DNA, 20 bp, Artificial Sequence
  Description of Artificial Sequence: Synthetic oligonucleotide
  Target: SCN9A; (-) strand; PAM type: NRG; PAM sequence: CAG
aaaggaggtggcacttagac

SEQ ID NO: 25599 - DNA, 20 bp, Artificial Sequence
  Description of Artificial Sequence: Synthetic oligonucleotide
  Target: SCN9A; (-) strand; PAM type: NRG; PAM sequence: TAG
acatgaaaggaggtggcact

SEQ ID NO: 25600 - DNA, 20 bp, Artificial Sequence
  Description of Artificial Sequence: Synthetic oligonucleotide
  Target: SCN9A; (-) strand; PAM type: NRG; PAM sequence: TGG
tgacttcacatgaaaggagg

SEQ ID NO: 25601 - DNA, 20 bp, Artificial Sequence
  Description of Artificial Sequence: Synthetic oligonucleotide
  Target: SCN9A; (-) strand; PAM type: NRG; PAM sequence: AGG
ggctgacttcacatgaaagg

SEQ ID NO: 25602 - DNA, 20 bp, Artificial Sequence
  Description of Artificial Sequence: Synthetic oligonucleotide
  Target: SCN9A; (-) strand; PAM type: NRG; PAM sequence: GAG
tggctgacttcacatgaaag

SEQ ID NO: 25603 - DNA, 20 bp, Artificial Sequence
  Description of Artificial Sequence: Synthetic oligonucleotide
  Target: SCN9A; (-) strand; PAM type: NRG; PAM sequence: AGG
tctggctgacttcacatgaa

SEQ ID NO: 25604 - DNA, 20 bp, Artificial Sequence
  Description of Artificial Sequence: Synthetic oligonucleotide
  Target: SCN9A; (-) strand; PAM type: NRG; PAM sequence: AAG
atctggctgacttcacatga

SEQ ID NO: 25605 - DNA, 20 bp, Artificial Sequence
  Description of Artificial Sequence: Synthetic oligonucleotide
  Target: SCN9A; (-) strand; PAM type: NRG; PAM sequence: TGG
attgagtaaggggctgtatc

SEQ ID NO: 25606 - DNA, 20 bp, Artificial Sequence
  Description of Artificial Sequence: Synthetic oligonucleotide
  Target: SCN9A; (-) strand; PAM type: NRG; PAM sequence: GGG
ttgaggatgcattgagtaag

SEQ ID NO: 25607 - DNA, 20 bp, Artificial Sequence
  Description of Artificial Sequence: Synthetic oligonucleotide
  Target: SCN9A; (-) strand; PAM type: NRG; PAM sequence: GGG
attgaggatgcattgagtaa

SEQ ID NO: 25608 - DNA, 20 bp, Artificial Sequence
  Description of Artificial Sequence: Synthetic oligonucleotide
  Target: SCN9A; (-) strand; PAM type: NRG; PAM sequence: AGG
cattgaggatgcattgagta

SEQ ID NO: 25609 - DNA, 20 bp, Artificial Sequence
  Description of Artificial Sequence: Synthetic oligonucleotide
  Target: SCN9A; (-) strand; PAM type: NRG; PAM sequence: AAG
ccattgaggatgcattgagt

SEQ ID NO: 25610 - DNA, 20 bp, Artificial Sequence
  Description of Artificial Sequence: Synthetic oligonucleotide
  Target: SCN9A; (-) strand; PAM type: NRG; PAM sequence: GAG
tagtccattgaggatgcatt

SEQ ID NO: 25611 - DNA, 20 bp, Artificial Sequence
  Description of Artificial Sequence: Synthetic oligonucleotide
  Target: SCN9A; (-) strand; PAM type: NRG; PAM sequence: AGG
gacactaaactagtccattg

SEQ ID NO: 25612 - DNA, 20 bp, Artificial Sequence
  Description of Artificial Sequence: Synthetic oligonucleotide
  Target: SCN9A; (-) strand; PAM type: NRG; PAM sequence: GAG
ggacactaaactagtccatt

SEQ ID NO: 25613 - DNA, 20 bp, Artificial Sequence
  Description of Artificial Sequence: Synthetic oligonucleotide
  Target: SCN9A; (-) strand; PAM type: NRG; PAM sequence: TAG
tccgtaacaggacactaaac

SEQ ID NO: 25614 - DNA, 20 bp, Artificial Sequence
  Description of Artificial Sequence: Synthetic oligonucleotide
  Target: SCN9A; (-) strand; PAM type: NRG; PAM sequence: AGG
agcaaagcacaatccgtaac

SEQ ID NO: 25615 - DNA, 20 bp, Artificial Sequence
  Description of Artificial Sequence: Synthetic oligonucleotide
  Target: SCN9A; (-) strand; PAM type: NRG; PAM sequence: CAG
aagcaaagcacaatccgtaa

SEQ ID NO: 25616 - DNA, 20 bp, Artificial Sequence
  Description of Artificial Sequence: Synthetic oligonucleotide
  Target: SCN9A; (-) strand; PAM type: NRG; PAM sequence: AAG
ttataacacagaacaaagca

SEQ ID NO: 25617 - DNA, 20 bp, Artificial Sequence
  Description of Artificial Sequence: Synthetic oligonucleotide
  Target: SCN9A; (-) strand; PAM type: NRG; PAM sequence: AAG
aaaaattataacacagaaca

SEQ ID NO: 25618 - DNA, 20 bp, Artificial Sequence
  Description of Artificial Sequence: Synthetic oligonucleotide
  Target: SCN9A; (-) strand; PAM type: NRG; PAM sequence: CAG
atatacaaaaaattataaca

SEQ ID NO: 25619 - DNA, 20 bp, Artificial Sequence
  Description of Artificial Sequence: Synthetic oligonucleotide
  Target: SCN9A; (-) strand; PAM type: NRG; PAM sequence: AGG
actctaatagcttgcacctt

SEQ ID NO: 25620 - DNA, 20 bp, Artificial Sequence
  Description of Artificial Sequence: Synthetic oligonucleotide
  Target: SCN9A; (-) strand; PAM type: NRG; PAM sequence: TAG
cactctaatagcttgcacct

SEQ ID NO: 25621 - DNA, 20 bp, Artificial Sequence
  Description of Artificial Sequence: Synthetic oligonucleotide
  Target: SCN9A; (-) strand; PAM type: NRG; PAM sequence: TAG
acaaaaagtatacactctaa

SEQ ID NO: 25622 - DNA, 20 bp, Artificial Sequence
  Description of Artificial Sequence: Synthetic oligonucleotide
  Target: SCN9A; (-) strand; PAM type: NRG; PAM sequence: AAG
gattgatcattgacaacaaa

SEQ ID NO: 25623 - DNA, 20 bp, Artificial Sequence
  Description of Artificial Sequence: Synthetic oligonucleotide
  Target: SCN9A; (-) strand; PAM type: NRG; PAM sequence: GGG
tcatgtacttcaaaggtaaa

SEQ ID NO: 25624 - DNA, 20 bp, Artificial Sequence
  Description of Artificial Sequence: Synthetic oligonucleotide
  Target: SCN9A; (-) strand; PAM type: NRG; PAM sequence: AGG
ttcatgtacttcaaaggtaa

SEQ ID NO: 25625 - DNA, 20 bp, Artificial Sequence
  Description of Artificial Sequence: Synthetic oligonucleotide
  Target: SCN9A; (-) strand; PAM type: NRG; PAM sequence: AAG
cttcatgtacttcaaaggta

SEQ ID NO: 25626 - DNA, 20 bp, Artificial Sequence
  Description of Artificial Sequence: Synthetic oligonucleotide
  Target: SCN9A; (-) strand; PAM type: NRG; PAM sequence: AGG
aaaaacttcatgtacttcaa

SEQ ID NO: 25627 - DNA, 20 bp, Artificial Sequence
  Description of Artificial Sequence: Synthetic oligonucleotide
  Target: SCN9A; (-) strand; PAM type: NRG; PAM sequence: AAG
taaaaacttcatgtacttca

SEQ ID NO: 25628 - DNA, 20 bp, Artificial Sequence
  Description of Artificial Sequence: Synthetic oligonucleotide
  Target: SCN9A; (-) strand; PAM type: NRG; PAM sequence: GAG
tttggccccctataaatatt

SEQ ID NO: 25629 - DNA, 20 bp, Artificial Sequence
  Description of Artificial Sequence: Synthetic oligonucleotide
  Target: SCN9A; (-) strand; PAM type: NRG; PAM sequence: TGG
ttacactcatgaaatatttt

SEQ ID NO: 25630 - DNA, 20 bp, Artificial Sequence
  Description of Artificial Sequence: Synthetic oligonucleotide
  Target: SCN9A; (-) strand; PAM type: NRG; PAM sequence: GAG
ccagaattataataggcata

SEQ ID NO: 25631 - DNA, 20 bp, Artificial Sequence
  Description of Artificial Sequence: Synthetic oligonucleotide
  Target: SCN9A; (-) strand; PAM type: NRG; PAM sequence: TAG
gcccagaattataataggca

SEQ ID NO: 25632 - DNA, 20 bp, Artificial Sequence
  Description of Artificial Sequence: Synthetic oligonucleotide
  Target: SCN9A; (-) strand; PAM type: NRG; PAM sequence: AGG
tctctgcccagaattataat

SEQ ID NO: 25633 - DNA, 20 bp, Artificial Sequence
  Description of Artificial Sequence: Synthetic oligonucleotide
  Target: SCN9A; (-) strand; PAM type: NRG; PAM sequence: TAG
ctctctgcccagaattataa

SEQ ID NO: 25634 - DNA, 20 bp, Artificial Sequence
  Description of Artificial Sequence: Synthetic oligonucleotide
  Target: SCN9A; (-) strand; PAM type: NRG; PAM sequence: CAG
attttctatgactctctgcc

SEQ ID NO: 25635 - DNA, 20 bp, Artificial Sequence
  Description of Artificial Sequence: Synthetic oligonucleotide
  Target: SCN9A; (-) strand; PAM type: NRG; PAM sequence: GAG
tcttttatttgtgcatagta

SEQ ID NO: 25636 - DNA, 20 bp, Artificial Sequence
  Description of Artificial Sequence: Synthetic oligonucleotide
  Target: SCN9A; (-) strand; PAM type: NRG; PAM sequence: TAG
tttcttttatttgtgcatag

SEQ ID NO: 25637 - DNA, 20 bp, Artificial Sequence
  Description of Artificial Sequence: Synthetic oligonucleotide
  Target: SCN9A; (-) strand; PAM type: NRG; PAM sequence: TAG
tcatttcttttatttgtgca

SEQ ID NO: 25638 - DNA, 20 bp, Artificial Sequence
  Description of Artificial Sequence: Synthetic oligonucleotide
  Target: SCN9A; (-) strand; PAM type: NRG; PAM sequence: CAG
aaatattatgttactgaaca

SEQ ID NO: 25639 - DNA, 20 bp, Artificial Sequence
  Description of Artificial Sequence: Synthetic oligonucleotide
  Target: SCN9A; (-) strand; PAM type: NRG; PAM sequence: AAG
tcaacataatacaaaggcat

SEQ ID NO: 25640 - DNA, 20 bp, Artificial Sequence
  Description of Artificial Sequence: Synthetic oligonucleotide
  Target: SCN9A; (-) strand; PAM type: NRG; PAM sequence: AGG
tgtggctcaacataatacaa

SEQ ID NO: 25641 - DNA, 20 bp, Artificial Sequence
  Description of Artificial Sequence: Synthetic oligonucleotide
  Target: SCN9A; (-) strand; PAM type: NRG; PAM sequence: AAG
atgtggctcaacataataca

SEQ ID NO: 25642 - DNA, 20 bp, Artificial Sequence
  Description of Artificial Sequence: Synthetic oligonucleotide
  Target: SCN9A; (-) strand; PAM type: NRG; PAM sequence: TGG
caaaaactagaaatttcatg

SEQ ID NO: 25643 - DNA, 20 bp, Artificial Sequence
  Description of Artificial Sequence: Synthetic oligonucleotide
  Target: SCN9A; (-) strand; PAM type: NRG; PAM sequence: TAG
catttttaatctgcaaaaac

SEQ ID NO: 25644 - DNA, 20 bp, Artificial Sequence
  Description of Artificial Sequence: Synthetic oligonucleotide
  Target: SCN9A; (-) strand; PAM type: NRG; PAM sequence: AAG
tatgaaaataagaatatttt

SEQ ID NO: 25645 - DNA, 20 bp, Artificial Sequence
  Description of Artificial Sequence: Synthetic oligonucleotide
  Target: SCN9A; (-) strand; PAM type: NRG; PAM sequence: AAG
tagaaaatatatatgaaaat

SEQ ID NO: 25646 - DNA, 20 bp, Artificial Sequence
  Description of Artificial Sequence: Synthetic oligonucleotide
  Target: SCN9A; (-) strand; PAM type: NRG; PAM sequence: TAG
ttaatttttacttattgaat

SEQ ID NO: 25647 - DNA, 20 bp, Artificial Sequence
  Description of Artificial Sequence: Synthetic oligonucleotide
  Target: SCN9A; (-) strand; PAM type: NRG; PAM sequence: AAG
ataaaattaccaaaaaacaa

SEQ ID NO: 25648 - DNA, 20 bp, Artificial Sequence
  Description of Artificial Sequence: Synthetic oligonucleotide
  Target: SCN9A; (-) strand; PAM type: NRG; PAM sequence: TGG
tgcagttactaggcataatt

SEQ ID NO: 25649 - DNA, 20 bp, Artificial Sequence
  Description of Artificial Sequence: Synthetic oligonucleotide
  Target: SCN9A; (-) strand; PAM type: NRG; PAM sequence: AGG
ttttaagagatgcagttact

SEQ ID NO: 25650 - DNA, 20 bp, Artificial Sequence
  Description of Artificial Sequence: Synthetic oligonucleotide
  Target: SCN9A; (-) strand; PAM type: NRG; PAM sequence: TAG
attttaagagatgcagttac

SEQ ID NO: 25651 - DNA, 20 bp, Artificial Sequence
  Description of Artificial Sequence: Synthetic oligonucleotide
  Target: SCN9A; (-) strand; PAM type: NRG; PAM sequence: CAG
attttctattttaagagatg

SEQ ID NO: 25652 - DNA, 20 bp, Artificial Sequence
  Description of Artificial Sequence: Synthetic oligonucleotide
  Target: SCN9A; (-) strand; PAM type: NRG; PAM sequence: GAG
atggtaattttctattttaa

SEQ ID NO: 25653 - DNA, 20 bp, Artificial Sequence
  Description of Artificial Sequence: Synthetic oligonucleotide
  Target: SCN9A; (-) strand; PAM type: NRG; PAM sequence: AAG
ggatggtaattttctatttt

SEQ ID NO: 25654 - DNA, 20 bp, Artificial Sequence
  Description of Artificial Sequence: Synthetic oligonucleotide
  Target: SCN9A; (-) strand; PAM type: NRG; PAM sequence: TGG
atgtcaaaagaattgaagga

SEQ ID NO: 25655 - DNA, 20 bp, Artificial Sequence
  Description of Artificial Sequence: Synthetic oligonucleotide
  Target: SCN9A; (-) strand; PAM type: NRG; PAM sequence: AGG
gaaaatgtcaaaagaattga

SEQ ID NO: 25656 - DNA, 20 bp, Artificial Sequence
  Description of Artificial Sequence: Synthetic oligonucleotide
  Target: SCN9A; (-) strand; PAM type: NRG; PAM sequence: AAG
tgaaaatgtcaaaagaattg

SEQ ID NO: 25657 - DNA, 20 bp, Artificial Sequence
  Description of Artificial Sequence: Synthetic oligonucleotide
  Target: SCN9A; (-) strand; PAM type: NRG; PAM sequence: AAG
ttcctttatgaaaatgtcaa

SEQ ID NO: 25658 - DNA, 20 bp, Artificial Sequence
  Description of Artificial Sequence: Synthetic oligonucleotide
  Target: SCN9A; (-) strand; PAM type: NRG; PAM sequence: AGG
tggaaggtattaacaaggtc

SEQ ID NO: 25659 - DNA, 20 bp, Artificial Sequence
  Description of Artificial Sequence: Synthetic oligonucleotide
  Target: SCN9A; (-) strand; PAM type: NRG; PAM sequence: CAG
ttggaaggtattaacaaggt

SEQ ID NO: 25660 - DNA, 20 bp, Artificial Sequence
  Description of Artificial Sequence: Synthetic oligonucleotide
  Target: SCN9A; (-) strand; PAM type: NRG; PAM sequence: AGG
taccttggaaggtattaaca

SEQ ID NO: 25661 - DNA, 20 bp, Artificial Sequence
  Description of Artificial Sequence: Synthetic oligonucleotide
  Target: SCN9A; (-) strand; PAM type: NRG; PAM sequence: AAG
ataccttggaaggtattaac

SEQ ID NO: 25662 - DNA, 20 bp, Artificial Sequence
  Description of Artificial Sequence: Synthetic oligonucleotide
  Target: SCN9A; (-) strand; PAM type: NRG; PAM sequence: AGG
tcttggtaagataccttgga

SEQ ID NO: 25663 - DNA, 20 bp, Artificial Sequence
  Description of Artificial Sequence: Synthetic oligonucleotide
  Target: SCN9A; (-) strand; PAM type: NRG; PAM sequence: AAG
ctcttggtaagataccttgg

SEQ ID NO: 25664 - DNA, 20 bp, Artificial Sequence
  Description of Artificial Sequence: Synthetic oligonucleotide
  Target: SCN9A; (-) strand; PAM type: NRG; PAM sequence: TGG
attctcttggtaagatacct

SEQ ID NO: 25665 - DNA, 20 bp, Artificial Sequence
  Description of Artificial Sequence: Synthetic oligonucleotide
  Target: SCN9A; (-) strand; PAM type: NRG; PAM sequence: AAG
aaaatctggattctcttggt

SEQ ID NO: 25666 - DNA, 20 bp, Artificial Sequence
  Description of Artificial Sequence: Synthetic oligonucleotide
  Target: SCN9A; (-) strand; PAM type: NRG; PAM sequence: TGG
gaataaaatctggattctct

SEQ ID NO: 25667 - DNA, 20 bp, Artificial Sequence
  Description of Artificial Sequence: Synthetic oligonucleotide
  Target: SCN9A; (-) strand; PAM type: NRG; PAM sequence: TGG
ttgctaccctgaataaaatc

SEQ ID NO: 25668 - DNA, 20 bp, Artificial Sequence
  Description of Artificial Sequence: Synthetic oligonucleotide
  Target: SCN9A; (-) strand; PAM type: NRG; PAM sequence: GGG
ctgaggcaggacatttatct

SEQ ID NO: 25669 - DNA, 20 bp, Artificial Sequence
  Description of Artificial Sequence: Synthetic oligonucleotide
  Target: SCN9A; (-) strand; PAM type: NRG; PAM sequence: TGG
gctgaggcaggacatttatc

SEQ ID NO: 25670 - DNA, 20 bp, Artificial Sequence
  Description of Artificial Sequence: Synthetic oligonucleotide
  Target: SCN9A; (-) strand; PAM type: NRG; PAM sequence: AGG
caaggtagcctggctgaggc

SEQ ID NO: 25671 - DNA, 20 bp, Artificial Sequence
  Description of Artificial Sequence: Synthetic oligonucleotide
  Target: SCN9A; (-) strand; PAM type: NRG; PAM sequence: CAG
acaaggtagcctggctgagg

SEQ ID NO: 25672 - DNA, 20 bp, Artificial Sequence
  Description of Artificial Sequence: Synthetic oligonucleotide
  Target: SCN9A; (-) strand; PAM type: NRG; PAM sequence: AGG
acaacaaggtagcctggctg

SEQ ID NO: 25673 - DNA, 20 bp, Artificial Sequence
  Description of Artificial Sequence: Synthetic oligonucleotide
  Target: SCN9A; (-) strand; PAM type: NRG; PAM sequence: GAG
aacaacaaggtagcctggct

SEQ ID NO: 25674 - DNA, 20 bp, Artificial Sequence
  Description of Artificial Sequence: Synthetic oligonucleotide
  Target: SCN9A; (-) strand; PAM type: NRG; PAM sequence: TGG
cccctaacaacaaggtagcc

SEQ ID NO: 25675 - DNA, 20 bp, Artificial Sequence
  Description of Artificial Sequence: Synthetic oligonucleotide
  Target: SCN9A; (-) strand; PAM type: NRG; PAM sequence: TAG
ggccacccctaacaacaagg

SEQ ID NO: 25676 - DNA, 20 bp, Artificial Sequence
  Description of Artificial Sequence: Synthetic oligonucleotide
  Target: SCN9A; (-) strand; PAM type: NRG; PAM sequence: AGG
catggccacccctaacaaca

SEQ ID NO: 25677 - DNA, 20 bp, Artificial Sequence
  Description of Artificial Sequence: Synthetic oligonucleotide
  Target: SCN9A; (-) strand; PAM type: NRG; PAM sequence: AAG
acatggccacccctaacaac

SEQ ID NO: 25678 - DNA, 20 bp, Artificial Sequence
  Description of Artificial Sequence: Synthetic oligonucleotide
  Target: SCN9A; (-) strand; PAM type: NRG; PAM sequence: TGG
ttggcaagaacagtgtgaca

SEQ ID NO: 25679 - DNA, 20 bp, Artificial Sequence
  Description of Artificial Sequence: Synthetic oligonucleotide
  Target: SCN9A; (-) strand; PAM type: NRG; PAM sequence: CAG
ttatgtcttattggcaagaa

SEQ ID NO: 25680 - DNA, 20 bp, Artificial Sequence
  Description of Artificial Sequence: Synthetic oligonucleotide
  Target: SCN9A; (-) strand; PAM type: NRG; PAM sequence: AAG
ttggcttatgtcttattggc

SEQ ID NO: 25681 - DNA, 20 bp, Artificial Sequence
  Description of Artificial Sequence: Synthetic oligonucleotide
  Target: SCN9A; (-) strand; PAM type: NRG; PAM sequence: TGG
aactttggcttatgtcttat

SEQ ID NO: 25682 - DNA, 20 bp, Artificial Sequence
  Description of Artificial Sequence: Synthetic oligonucleotide
  Target: SCN9A; (-) strand; PAM type: NRG; PAM sequence: TGG
cagagatccttatccaactt

SEQ ID NO: 25683 - DNA, 20 bp, Artificial Sequence
  Description of Artificial Sequence: Synthetic oligonucleotide
  Target: SCN9A; (-) strand; PAM type: NRG; PAM sequence: GAG
ggaagggcaaaactttccca

SEQ ID NO: 25684 - DNA, 20 bp, Artificial Sequence
  Description of Artificial Sequence: Synthetic oligonucleotide
  Target: SCN9A; (-) strand; PAM type: NRG; PAM sequence: CAG
gaggaagggcaaaactttcc

SEQ ID NO: 25685 - DNA, 20 bp, Artificial Sequence
  Description of Artificial Sequence: Synthetic oligonucleotide
  Target: SCN9A; (-) strand; PAM type: NRG; PAM sequence: GGG
tatcccacttgcctgaggaa

SEQ ID NO: 25686 - DNA, 20 bp, Artificial Sequence
  Description of Artificial Sequence: Synthetic oligonucleotide
  Target: SCN9A; (-) strand; PAM type: NRG; PAM sequence: AGG
ctatcccacttgcctgagga

SEQ ID NO: 25687 - DNA, 20 bp, Artificial Sequence
  Description of Artificial Sequence: Synthetic oligonucleotide
  Target: SCN9A; (-) strand; PAM type: NRG; PAM sequence: AAG
actatcccacttgcctgagg

SEQ ID NO: 25688 - DNA, 20 bp, Artificial Sequence
  Description of Artificial Sequence: Synthetic oligonucleotide
  Target: SCN9A; (-) strand; PAM type: NRG; PAM sequence: AGG
atgactatcccacttgcctg

SEQ ID NO: 25689 - DNA, 20 bp, Artificial Sequence
  Description of Artificial Sequence: Synthetic oligonucleotide
  Target: SCN9A; (-) strand; PAM type: NRG; PAM sequence: GAG
aatgactatcccacttgcct

SEQ ID NO: 25690 - DNA, 20 bp, Artificial Sequence
  Description of Artificial Sequence: Synthetic oligonucleotide
  Target: SCN9A; (-) strand; PAM type: NRG; PAM sequence: AAG
aaagaaatagaacgaagcag

SEQ ID NO: 25691 - DNA, 20 bp, Artificial Sequence
  Description of Artificial Sequence: Synthetic oligonucleotide
  Target: SCN9A; (-) strand; PAM type: NRG; PAM sequence: CAG
gagaaagaaatagaacgaag

SEQ ID NO: 25692 - DNA, 20 bp, Artificial Sequence
  Description of Artificial Sequence: Synthetic oligonucleotide
  Target: SCN9A; (-) strand; PAM type: NRG; PAM sequence: AAG
gtagagaaagaaatagaacg

SEQ ID NO: 25693 - DNA, 20 bp, Artificial Sequence
  Description of Artificial Sequence: Synthetic oligonucleotide
  Target: SCN9A; (-) strand; PAM type: NRG; PAM sequence: TAG
tacccaggtagagaaagaaa

SEQ ID NO: 25694 - DNA, 20 bp, Artificial Sequence
  Description of Artificial Sequence: Synthetic oligonucleotide
  Target: SCN9A; (-) strand; PAM type: NRG; PAM sequence: AAG
atccaatacccaggtagaga

SEQ ID NO: 25695 - DNA, 20 bp, Artificial Sequence
  Description of Artificial Sequence: Synthetic oligonucleotide
  Target: SCN9A; (-) strand; PAM type: NRG; PAM sequence: GAG
ttatatccaatacccaggta

SEQ ID NO: 25696 - DNA, 20 bp, Artificial Sequence
  Description of Artificial Sequence: Synthetic oligonucleotide
  Target: SCN9A; (-) strand; PAM type: NRG; PAM sequence: TAG
ctttatatccaatacccagg

SEQ ID NO: 25697 - DNA, 20 bp, Artificial Sequence
  Description of Artificial Sequence: Synthetic oligonucleotide
  Target: SCN9A; (-) strand; PAM type: NRG; PAM sequence: AGG
cagctttatatccaataccc

SEQ ID NO: 25698 - DNA, 20 bp, Artificial Sequence
  Description of Artificial Sequence: Synthetic oligonucleotide
  Target: SCN9A; (-) strand; PAM type: NRG; PAM sequence: CAG
acagctttatatccaatacc

SEQ ID NO: 25699 - DNA, 20 bp, Artificial Sequence
  Description of Artificial Sequence: Synthetic oligonucleotide
  Target: SCN9A; (-) strand; PAM type: NRG; PAM sequence: CAG
agaggtgactgttccaccta

SEQ ID NO: 25700 - DNA, 20 bp, Artificial Sequence
  Description of Artificial Sequence: Synthetic oligonucleotide
  Target: SCN9A; (-) strand; PAM type: NRG; PAM sequence: AGG
atattaatgcctatgattag

SEQ ID NO: 25701 - DNA, 20 bp, Artificial Sequence
  Description of Artificial Sequence: Synthetic oligonucleotide
  Target: SCN9A; (-) strand; PAM type: NRG; PAM sequence: GAG
tatattaatgcctatgatta

SEQ ID NO: 25702 - DNA, 20 bp, Artificial Sequence
  Description of Artificial Sequence: Synthetic oligonucleotide
  Target: SCN9A; (-) strand; PAM type: NRG; PAM sequence: TAG
tctatattaatgcctatgat

SEQ ID NO: 25703 - DNA, 20 bp, Artificial Sequence
  Description of Artificial Sequence: Synthetic oligonucleotide
  Target: SCN9A; (-) strand; PAM type: NRG; PAM sequence: AGG
ccacgtggcctccatgtcct

SEQ ID NO: 25704 - DNA, 20 bp, Artificial Sequence
  Description of Artificial Sequence: Synthetic oligonucleotide
  Target: SCN9A; (-) strand; PAM type: NRG; PAM sequence: TAG
tccacgtggcctccatgtcc

SEQ ID NO: 25705 - DNA, 20 bp, Artificial Sequence
  Description of Artificial Sequence: Synthetic oligonucleotide
  Target: SCN9A; (-) strand; PAM type: NRG; PAM sequence: TGG
ccacagatcagcagtccacg

SEQ ID NO: 25706 - DNA, 20 bp, Artificial Sequence
  Description of Artificial Sequence: Synthetic oligonucleotide
  Target: SCN9A; (-) strand; PAM type: NRG; PAM sequence: CAG
ttaaaacatccacagatcag

SEQ ID NO: 25707 - DNA, 20 bp, Artificial Sequence
  Description of Artificial Sequence: Synthetic oligonucleotide
  Target: SCN9A; (-) strand; PAM type: NRG; PAM sequence: CAG
attttaaaacatccacagat

SEQ ID NO: 25708 - DNA, 20 bp, Artificial Sequence
  Description of Artificial Sequence: Synthetic oligonucleotide
  Target: SCN9A; (-) strand; PAM type: NRG; PAM sequence: CAG
ttcatattttaaaacatcca

SEQ ID NO: 25709 - DNA, 20 bp, Artificial Sequence
  Description of Artificial Sequence: Synthetic oligonucleotide
  Target: SCN9A; (-) strand; PAM type: NRG; PAM sequence: TAG
actacattggcataactgga

SEQ ID NO: 25710 - DNA, 20 bp, Artificial Sequence
  Description of Artificial Sequence: Synthetic oligonucleotide
  Target: SCN9A; (-) strand; PAM type: NRG; PAM sequence: TGG
cttaactacattggcataac

SEQ ID NO: 25711 - DNA, 20 bp, Artificial Sequence
  Description of Artificial Sequence: Synthetic oligonucleotide
  Target: SCN9A; (-) strand; PAM type: NRG; PAM sequence: TGG
caacagagacttaactacat

SEQ ID NO: 25712 - DNA, 20 bp, Artificial Sequence
  Description of Artificial Sequence: Synthetic oligonucleotide
  Target: SCN9A; (-) strand; PAM type: NRG; PAM sequence: GAG
ctgtttaactgcatgcaaca

SEQ ID NO: 25713 - DNA, 20 bp, Artificial Sequence
  Description of Artificial Sequence: Synthetic oligonucleotide
  Target: SCN9A; (-) strand; PAM type: NRG; PAM sequence: CAG
ctctgtttaactgcatgcaa

SEQ ID NO: 25714 - DNA, 20 bp, Artificial Sequence
  Description of Artificial Sequence: Synthetic oligonucleotide
  Target: SCN9A; (-) strand; PAM type: NRG; PAM sequence: AGG
tttttggctatttctgagtc

SEQ ID NO: 25715 - DNA, 20 bp, Artificial Sequence
  Description of Artificial Sequence: Synthetic oligonucleotide
  Target: SCN9A; (-) strand; PAM type: NRG; PAM sequence: CAG
atttttggctatttctgagt

SEQ ID NO: 25716 - DNA, 20 bp, Artificial Sequence
  Description of Artificial Sequence: Synthetic oligonucleotide
  Target: SCN9A; (-) strand; PAM type: NRG; PAM sequence: GAG
tgttatttttggctatttct

SEQ ID NO: 25717 - DNA, 20 bp, Artificial Sequence
  Description of Artificial Sequence: Synthetic oligonucleotide
  Target: SCN9A; (-) strand; PAM type: NRG; PAM sequence: TGG
tgtgtgtgttttgttatttt

SEQ ID NO: 25718 - DNA, 20 bp, Artificial Sequence
  Description of Artificial Sequence: Synthetic oligonucleotide
  Target: SCN9A; (-) strand; PAM type: NRG; PAM sequence: GGG
tattttacttaagggtacat

SEQ ID NO: 25719 - DNA, 20 bp, Artificial Sequence
  Description of Artificial Sequence: Synthetic oligonucleotide
  Target: SCN9A; (-) strand; PAM type: NRG; PAM sequence: TGG
ctattttacttaagggtaca

SEQ ID NO: 25720 - DNA, 20 bp, Artificial Sequence
  Description of Artificial Sequence: Synthetic oligonucleotide
  Target: SCN9A; (-) strand; PAM type: NRG; PAM sequence: GGG
aataaacctattttacttaa

SEQ ID NO: 25721 - DNA, 20 bp, Artificial Sequence
  Description of Artificial Sequence: Synthetic oligonucleotide
  Target: SCN9A; (-) strand; PAM type: NRG; PAM sequence: AGG
gaataaacctattttactta

SEQ ID NO: 25722 - DNA, 20 bp, Artificial Sequence
  Description of Artificial Sequence: Synthetic oligonucleotide
  Target: SCN9A; (-) strand; PAM type: NRG; PAM sequence: AAG
tgaataaacctattttactt

SEQ ID NO: 25723 - DNA, 20 bp, Artificial Sequence
  Description of Artificial Sequence: Synthetic oligonucleotide
  Target: SCN9A; (-) strand; PAM type: NRG; PAM sequence: AAG
cacaccaaggtacacatgtt

SEQ ID NO: 25724 - DNA, 20 bp, Artificial Sequence
  Description of Artificial Sequence: Synthetic oligonucleotide
  Target: SCN9A; (-) strand; PAM type: NRG; PAM sequence: AGG
gtacacttactgccacacca

SEQ ID NO: 25725 - DNA, 20 bp, Artificial Sequence
  Description of Artificial Sequence: Synthetic oligonucleotide
  Target: SCN9A; (-) strand; PAM type: NRG; PAM sequence: AAG
agtacacttactgccacacc

SEQ ID NO: 25726 - DNA, 20 bp, Artificial Sequence
  Description of Artificial Sequence: Synthetic oligonucleotide
  Target: SCN9A; (-) strand; PAM type: NRG; PAM sequence: GAG
aggctatattaggggctagg

SEQ ID NO: 25727 - DNA, 20 bp, Artificial Sequence
  Description of Artificial Sequence: Synthetic oligonucleotide
  Target: SCN9A; (-) strand; PAM type: NRG; PAM sequence: GGG
taaggctatattaggggcta

SEQ ID NO: 25728 - DNA, 20 bp, Artificial Sequence
  Description of Artificial Sequence: Synthetic oligonucleotide
  Target: SCN9A; (-) strand; PAM type: NRG; PAM sequence: AGG
ttaaggctatattaggggct

SEQ ID NO: 25729 - DNA, 20 bp, Artificial Sequence
  Description of Artificial Sequence: Synthetic oligonucleotide
  Target: SCN9A; (-) strand; PAM type: NRG; PAM sequence: TAG
attaaggctatattaggggc

SEQ ID NO: 25730 - DNA, 20 bp, Artificial Sequence
  Description of Artificial Sequence: Synthetic oligonucleotide
  Target: SCN9A; (-) strand; PAM type: NRG; PAM sequence: GGG
tcacattaaggctatattag

SEQ ID NO: 25731 - DNA, 20 bp, Artificial Sequence
  Description of Artificial Sequence: Synthetic oligonucleotide
  Target: SCN9A; (-) strand; PAM type: NRG; PAM sequence: GGG
ttcacattaaggctatatta

SEQ ID NO: 25732 - DNA, 20 bp, Artificial Sequence
  Description of Artificial Sequence: Synthetic oligonucleotide
  Target: SCN9A; (-) strand; PAM type: NRG; PAM sequence: AGG
tttcacattaaggctatatt

SEQ ID NO: 25733 - DNA, 20 bp, Artificial Sequence
  Description of Artificial Sequence: Synthetic oligonucleotide
  Target: SCN9A; (-) strand; PAM type: NRG; PAM sequence: TAG
ctttcacattaaggctatat

SEQ ID NO: 25734 - DNA, 20 bp, Artificial Sequence
  Description of Artificial Sequence: Synthetic oligonucleotide
  Target: SCN9A; (-) strand; PAM type: NRG; PAM sequence: AGG
ttatattatctttcacatta

SEQ ID NO: 25735 - DNA, 20 bp, Artificial Sequence
  Description of Artificial Sequence: Synthetic oligonucleotide
  Target: SCN9A; (-) strand; PAM type: NRG; PAM sequence: AAG
attatattatctttcacatt

SEQ ID NO: 25736 - DNA, 20 bp, Artificial Sequence
  Description of Artificial Sequence: Synthetic oligonucleotide
  Target: SCN9A; (-) strand; PAM type: NRG; PAM sequence: TAG
tctcaggacaatgtattaag

SEQ ID NO: 25737 - DNA, 20 bp, Artificial Sequence
  Description of Artificial Sequence: Synthetic oligonucleotide
  Target: SCN9A; (-) strand; PAM type: NRG; PAM sequence: AAG
ttctctcaggacaatgtatt

SEQ ID NO: 25738 - DNA, 20 bp, Artificial Sequence
  Description of Artificial Sequence: Synthetic oligonucleotide
  Target: SCN9A; (-) strand; PAM type: NRG; PAM sequence: AGG
ttgaacctttgtgttctctc

SEQ ID NO: 25739 - DNA, 20 bp, Artificial Sequence
  Description of Artificial Sequence: Synthetic oligonucleotide
  Target: SCN9A; (-) strand; PAM type: NRG; PAM sequence: CAG
tttgaacctttgtgttctct

SEQ ID NO: 25740 - DNA, 20 bp, Artificial Sequence
  Description of Artificial Sequence: Synthetic oligonucleotide
  Target: SCN9A; (-) strand; PAM type: NRG; PAM sequence: TGG
agaaaagtattaaatcaatt

SEQ ID NO: 25741 - DNA, 20 bp, Artificial Sequence
  Description of Artificial Sequence: Synthetic oligonucleotide
  Target: SCN9A; (-) strand; PAM type: NRG; PAM sequence: AAG
cttattatgttattacagaa

SEQ ID NO: 25742 - DNA, 20 bp, Artificial Sequence
  Description of Artificial Sequence: Synthetic oligonucleotide
  Target: SCN9A; (-) strand; PAM type: NRG; PAM sequence: CAG
catgacttattatgttatta

SEQ ID NO: 25743 - DNA, 20 bp, Artificial Sequence
  Description of Artificial Sequence: Synthetic oligonucleotide
  Target: SCN9A; (-) strand; PAM type: NRG; PAM sequence: AAG
agtccagatcattgccttta

SEQ ID NO: 25744 - DNA, 20 bp, Artificial Sequence
  Description of Artificial Sequence: Synthetic oligonucleotide
  Target: SCN9A; (-) strand; PAM type: NRG; PAM sequence: CAG
tcagaaatatcactaaagtc

SEQ ID NO: 25745 - DNA, 20 bp, Artificial Sequence
  Description of Artificial Sequence: Synthetic oligonucleotide
  Target: SCN9A; (-) strand; PAM type: NRG; PAM sequence: AAG
gtgactcagaaatatcacta

SEQ ID NO: 25746 - DNA, 20 bp, Artificial Sequence
  Description of Artificial Sequence: Synthetic oligonucleotide
  Target: SCN9A; (-) strand; PAM type: NRG; PAM sequence: CAG
gatgaaattggcaagtgact

SEQ ID NO: 25747 - DNA, 20 bp, Artificial Sequence
  Description of Artificial Sequence: Synthetic oligonucleotide
  Target: SCN9A; (-) strand; PAM type: NRG; PAM sequence: AAG
ggcttgttgatgaaattggc

SEQ ID NO: 25748 - DNA, 20 bp, Artificial Sequence
  Description of Artificial Sequence: Synthetic oligonucleotide
  Target: SCN9A; (-) strand; PAM type: NRG; PAM sequence: TGG
ccctggcttgttgatgaaat

SEQ ID NO: 25749 - DNA, 20 bp, Artificial Sequence
  Description of Artificial Sequence: Synthetic oligonucleotide
  Target: SCN9A; (-) strand; PAM type: NRG; PAM sequence: TGG
aagacttatccagctctccc

SEQ ID NO: 25750 - DNA, 20 bp, Artificial Sequence
  Description of Artificial Sequence: Synthetic oligonucleotide
  Target: SCN9A; (-) strand; PAM type: NRG; PAM sequence: CAG
tagtgctactaagacttatc

SEQ ID NO: 25751 - DNA, 20 bp, Artificial Sequence
  Description of Artificial Sequence: Synthetic oligonucleotide
  Target: SCN9A; (-) strand; PAM type: NRG; PAM sequence: AAG
atgaggttcttagtgctact

SEQ ID NO: 25752 - DNA, 20 bp, Artificial Sequence
  Description of Artificial Sequence: Synthetic oligonucleotide
  Target: SCN9A; (-) strand; PAM type: NRG; PAM sequence: TAG
tgaggtaactatgaggttct

SEQ ID NO: 25753 - DNA, 20 bp, Artificial Sequence
  Description of Artificial Sequence: Synthetic oligonucleotide
  Target: SCN9A; (-) strand; PAM type: NRG; PAM sequence: AGG
accttgctgaggtaactatg

SEQ ID NO: 25754 - DNA, 20 bp, Artificial Sequence
  Description of Artificial Sequence: Synthetic oligonucleotide
  Target: SCN9A; (-) strand; PAM type: NRG; PAM sequence: GAG
aaccttgctgaggtaactat

SEQ ID NO: 25755 - DNA, 20 bp, Artificial Sequence
  Description of Artificial Sequence: Synthetic oligonucleotide
  Target: SCN9A; (-) strand; PAM type: NRG; PAM sequence: AGG
tctaggtgaaaaccttgctg

SEQ ID NO: 25756 - DNA, 20 bp, Artificial Sequence
  Description of Artificial Sequence: Synthetic oligonucleotide
  Target: SCN9A; (-) strand; PAM type: NRG; PAM sequence: GAG
ctctaggtgaaaaccttgct

SEQ ID NO: 25757 - DNA, 20 bp, Artificial Sequence
  Description of Artificial Sequence: Synthetic oligonucleotide
  Target: SCN9A; (-) strand; PAM type: NRG; PAM sequence: AGG
tgatacattcattcttctct

SEQ ID NO: 25758 - DNA, 20 bp, Artificial Sequence
  Description of Artificial Sequence: Synthetic oligonucleotide
  Target: SCN9A; (-) strand; PAM type: NRG; PAM sequence: TAG
ctgatacattcattcttctc

SEQ ID NO: 25759 - DNA, 20 bp, Artificial Sequence
  Description of Artificial Sequence: Synthetic oligonucleotide
  Target: SCN9A; (-) strand; PAM type: NRG; PAM sequence: TAG
agaccaaattcaagttcttg

SEQ ID NO: 25760 - DNA, 20 bp, Artificial Sequence
  Description of Artificial Sequence: Synthetic oligonucleotide
  Target: SCN9A; (-) strand; PAM type: NRG; PAM sequence: AAG
aactcatctagaccaaattc

SEQ ID NO: 25761 - DNA, 20 bp, Artificial Sequence
  Description of Artificial Sequence: Synthetic oligonucleotide
  Target: SCN9A; (-) strand; PAM type: NRG; PAM sequence: TAG
ataaatatgacaaactcatc

SEQ ID NO: 25762 - DNA, 20 bp, Artificial Sequence
  Description of Artificial Sequence: Synthetic oligonucleotide
  Target: SCN9A; (-) strand; PAM type: NRG; PAM sequence: TGG
aatgcatattttatacatta

SEQ ID NO: 25763 - DNA, 20 bp, Artificial Sequence
  Description of Artificial Sequence: Synthetic oligonucleotide
  Target: SCN9A; (-) strand; PAM type: NRG; PAM sequence: CAG
ccctttcctttccatttatt

SEQ ID NO: 25764 - DNA, 20 bp, Artificial Sequence
  Description of Artificial Sequence: Synthetic oligonucleotide
  Target: SCN9A; (-) strand; PAM type: NRG; PAM sequence: AAG
ctagaatatatttctttctc

SEQ ID NO: 25765 - DNA, 20 bp, Artificial Sequence
  Description of Artificial Sequence: Synthetic oligonucleotide
  Target: SCN9A; (-) strand; PAM type: NRG; PAM sequence: TAG
agtaaaactgattttacttc

SEQ ID NO: 25766 - DNA, 20 bp, Artificial Sequence
  Description of Artificial Sequence: Synthetic oligonucleotide
  Target: SCN9A; (-) strand; PAM type: NRG; PAM sequence: AAG
ttattcccttctttattgaa

SEQ ID NO: 25767 - DNA, 20 bp, Artificial Sequence
  Description of Artificial Sequence: Synthetic oligonucleotide
  Target: SCN9A; (-) strand; PAM type: NRG; PAM sequence: AGG
atgtgtgatttttatatttt

SEQ ID NO: 25768 - DNA, 20 bp, Artificial Sequence
  Description of Artificial Sequence: Synthetic oligonucleotide
  Target: SCN9A; (-) strand; PAM type: NRG; PAM sequence: TAG
aatgtgtgatttttatattt

SEQ ID NO: 25769 - DNA, 20 bp, Artificial Sequence
  Description of Artificial Sequence: Synthetic oligonucleotide
  Target: SCN9A; (-) strand; PAM type: NRG; PAM sequence: TGG
gattaggttatagtctacct

SEQ ID NO: 25770 - DNA, 20 bp, Artificial Sequence
  Description of Artificial Sequence: Synthetic oligonucleotide
  Target: SCN9A; (-) strand; PAM type: NRG; PAM sequence: TAG
aatgctgactgattaggtta

SEQ ID NO: 25771 - DNA, 20 bp, Artificial Sequence
  Description of Artificial Sequence: Synthetic oligonucleotide
  Target: SCN9A; (-) strand; PAM type: NRG; PAM sequence: AGG
caccttaatgctgactgatt

SEQ ID NO: 25772 - DNA, 20 bp, Artificial Sequence
  Description of Artificial Sequence: Synthetic oligonucleotide
  Target: SCN9A; (-) strand; PAM type: NRG; PAM sequence: TAG
ccaccttaatgctgactgat

SEQ ID NO: 25773 - DNA, 20 bp, Artificial Sequence
  Description of Artificial Sequence: Synthetic oligonucleotide
  Target: SCN9A; (-) strand; PAM type: NRG; PAM sequence: GGG
tgtacatttgctgattcatt

SEQ ID NO: 25774 - DNA, 20 bp, Artificial Sequence
  Description of Artificial Sequence: Synthetic oligonucleotide
  Target: SCN9A; (-) strand; PAM type: NRG; PAM sequence: TGG
ttgtacatttgctgattcat

SEQ ID NO: 25775 - DNA, 20 bp, Artificial Sequence
  Description of Artificial Sequence: Synthetic oligonucleotide
  Target: SCN9A; (-) strand; PAM type: NRG; PAM sequence: TGG
ggtgaaattttctgttgtaa

SEQ ID NO: 25776 - DNA, 20 bp, Artificial Sequence
  Description of Artificial Sequence: Synthetic oligonucleotide
  Target: SCN9A; (-) strand; PAM type: NRG; PAM sequence: GGG
ctctgtaatggtgtaattca

SEQ ID NO: 25777 - DNA, 20 bp, Artificial Sequence
  Description of Artificial Sequence: Synthetic oligonucleotide
  Target: SCN9A; (-) strand; PAM type: NRG; PAM sequence: AGG
cctctgtaatggtgtaattc

SEQ ID NO: 25778 - DNA, 20 bp, Artificial Sequence
  Description of Artificial Sequence: Synthetic oligonucleotide
  Target: SCN9A; (-) strand; PAM type: NRG; PAM sequence: CAG
acctctgtaatggtgtaatt

SEQ ID NO: 25779 - DNA, 20 bp, Artificial Sequence
  Description of Artificial Sequence: Synthetic oligonucleotide
  Target: SCN9A; (-) strand; PAM type: NRG; PAM sequence: TGG
tttctgctatacctctgtaa

SEQ ID NO: 25780 - DNA, 20 bp, Artificial Sequence
  Description of Artificial Sequence: Synthetic oligonucleotide
  Target: SCN9A; (-) strand; PAM type: NRG; PAM sequence: TAG
aaaggcaagaaaatgagtag

SEQ ID NO: 25781 - DNA, 20 bp, Artificial Sequence
  Description of Artificial Sequence: Synthetic oligonucleotide
  Target: SCN9A; (-) strand; PAM type: NRG; PAM sequence: TAG
tagaaaggcaagaaaatgag

SEQ ID NO: 25782 - DNA, 20 bp, Artificial Sequence
  Description of Artificial Sequence: Synthetic oligonucleotide
  Target: SCN9A; (-) strand; PAM type: NRG; PAM sequence: GAG
ccatagaaaggcaagaaaat

SEQ ID NO: 25783 - DNA, 20 bp, Artificial Sequence
  Description of Artificial Sequence: Synthetic oligonucleotide
  Target: SCN9A; (-) strand; PAM type: NRG; PAM sequence: AAG
actacatgccatagaaaggc

SEQ ID NO: 25784 - DNA, 20 bp, Artificial Sequence
  Description of Artificial Sequence: Synthetic oligonucleotide
  Target: SCN9A; (-) strand; PAM type: NRG; PAM sequence: AGG
ttatactacatgccatagaa

SEQ ID NO: 25785 - DNA, 20 bp, Artificial Sequence
  Description of Artificial Sequence: Synthetic oligonucleotide
  Target: SCN9A; (-) strand; PAM type: NRG; PAM sequence: AAG
attatactacatgccataga

SEQ ID NO: 25786 - DNA, 20 bp, Artificial Sequence
  Description of Artificial Sequence: Synthetic oligonucleotide
  Target: SCN9A; (-) strand; PAM type: NRG; PAM sequence: TAG
aatcattatactacatgcca

SEQ ID NO: 25787 - DNA, 20 bp, Artificial Sequence
  Description of Artificial Sequence: Synthetic oligonucleotide
  Target: SCN9A; (-) strand; PAM type: NRG; PAM sequence: AAG
tctttttaaatttaaacccc

SEQ ID NO: 25788 - DNA, 20 bp, Artificial Sequence
  Description of Artificial Sequence: Synthetic oligonucleotide
  Target: SCN9A; (-) strand; PAM type: NRG; PAM sequence: GGG
ttagtcatggacgtatctgg

SEQ ID NO: 25789 - DNA, 20 bp, Artificial Sequence
  Description of Artificial Sequence: Synthetic oligonucleotide
  Target: SCN9A; (-) strand; PAM type: NRG; PAM sequence: GGG
gttagtcatggacgtatctg

SEQ ID NO: 25790 - DNA, 20 bp, Artificial Sequence
  Description of Artificial Sequence: Synthetic oligonucleotide
  Target: SCN9A; (-) strand; PAM type: NRG; PAM sequence: GGG
ggttagtcatggacgtatct

SEQ ID NO: 25791 - DNA, 20 bp, Artificial Sequence
  Description of Artificial Sequence: Synthetic oligonucleotide
  Target: SCN9A; (-) strand; PAM type: NRG; PAM sequence: TGG
tggttagtcatggacgtatc

SEQ ID NO: 25792 - DNA, 20 bp, Artificial Sequence
  Description of Artificial Sequence: Synthetic oligonucleotide
  Target: SCN9A; (-) strand; PAM type: NRG; PAM sequence: TGG
agaaaagatttggttagtca

SEQ ID NO: 25793 - DNA, 20 bp, Artificial Sequence
  Description of Artificial Sequence: Synthetic oligonucleotide
  Target: SCN9A; (-) strand; PAM type: NRG; PAM sequence: TAG
agattaagaaaagatttggt

SEQ ID NO: 25794 - DNA, 20 bp, Artificial Sequence
  Description of Artificial Sequence: Synthetic oligonucleotide
  Target: SCN9A; (-) strand; PAM type: NRG; PAM sequence: TGG
taaaagattaagaaaagatt

SEQ ID NO: 25795 - DNA, 20 bp, Artificial Sequence
  Description of Artificial Sequence: Synthetic oligonucleotide
  Target: SCN9A; (-) strand; PAM type: NRG; PAM sequence: AAG
cgattctaaaagattaagaa

SEQ ID NO: 25796 - DNA, 20 bp, Artificial Sequence
  Description of Artificial Sequence: Synthetic oligonucleotide
  Target: SCN9A; (-) strand; PAM type: NRG; PAM sequence: AAG
gactgcgattctaaaagatt

SEQ ID NO: 25797 - DNA, 20 bp, Artificial Sequence
  Description of Artificial Sequence: Synthetic oligonucleotide
  Target: SCN9A; (-) strand; PAM type: NRG; PAM sequence: AAG
gcagatgactgcgattctaa

SEQ ID NO: 25798 - DNA, 20 bp, Artificial Sequence
  Description of Artificial Sequence: Synthetic oligonucleotide
  Target: SCN9A; (-) strand; PAM type: NRG; PAM sequence: CAG
atataatgcatctatatttg

SEQ ID NO: 25799 - DNA, 20 bp, Artificial Sequence
  Description of Artificial Sequence: Synthetic oligonucleotide
  Target: SCN9A; (-) strand; PAM type: NRG; PAM sequence: AAG
gtctttgtgacctccttagg

SEQ ID NO: 25800 - DNA, 20 bp, Artificial Sequence
  Description of Artificial Sequence: Synthetic oligonucleotide
  Target: SCN9A; (-) strand; PAM type: NRG; PAM sequence: AGG
ttcgtctttgtgacctcctt

SEQ ID NO: 25801 - DNA, 20 bp, Artificial Sequence
  Description of Artificial Sequence: Synthetic oligonucleotide
  Target: SCN9A; (-) strand; PAM type: NRG; PAM sequence: TAG
tttcgtctttgtgacctcct

SEQ ID NO: 25802 - DNA, 20 bp, Artificial Sequence
  Description of Artificial Sequence: Synthetic oligonucleotide
  Target: SCN9A; (-) strand; PAM type: NRG; PAM sequence: TAG
cacggataaaatgtatacag

SEQ ID NO: 25803 - DNA, 20 bp, Artificial Sequence
  Description of Artificial Sequence: Synthetic oligonucleotide
  Target: SCN9A; (-) strand; PAM type: NRG; PAM sequence: CAG
acacacggataaaatgtata

SEQ ID NO: 25804 - DNA, 20 bp, Artificial Sequence
  Description of Artificial Sequence: Synthetic oligonucleotide
  Target: SCN9A; (-) strand; PAM type: NRG; PAM sequence: CGG
agaaagcacgcacacacaca

SEQ ID NO: 25805 - DNA, 20 bp, Artificial Sequence
  Description of Artificial Sequence: Synthetic oligonucleotide
  Target: SCN9A; (-) strand; PAM type: NRG; PAM sequence: AAG
gaggtggatgcaaaagaaga

SEQ ID NO: 25806 - DNA, 20 bp, Artificial Sequence
  Description of Artificial Sequence: Synthetic oligonucleotide
  Target: SCN9A; (-) strand; PAM type: NRG; PAM sequence: AAG
ttgagaggtggatgcaaaag

SEQ ID NO: 25807 - DNA, 20 bp, Artificial Sequence
  Description of Artificial Sequence: Synthetic oligonucleotide
  Target: SCN9A; (-) strand; PAM type: NRG; PAM sequence: AAG
catttgagaggtggatgcaa

SEQ ID NO: 25808 - DNA, 20 bp, Artificial Sequence
  Description of Artificial Sequence: Synthetic oligonucleotide
  Target: SCN9A; (-) strand; PAM type: NRG; PAM sequence: TGG
gatcaaacacatttgagagg

SEQ ID NO: 25809 - DNA, 20 bp, Artificial Sequence
  Description of Artificial Sequence: Synthetic oligonucleotide
  Target: SCN9A; (-) strand; PAM type: NRG; PAM sequence: AGG
gcggatcaaacacatttgag

SEQ ID NO: 25810 - DNA, 20 bp, Artificial Sequence
  Description of Artificial Sequence: Synthetic oligonucleotide
  Target: SCN9A; (-) strand; PAM type: NRG; PAM sequence: GAG
agcggatcaaacacatttga

SEQ ID NO: 25811 - DNA, 20 bp, Artificial Sequence
  Description of Artificial Sequence: Synthetic oligonucleotide
  Target: SCN9A; (-) strand; PAM type: NRG; PAM sequence: GAG
acagcggatcaaacacattt

SEQ ID NO: 25812 - DNA, 20 bp, Artificial Sequence
  Description of Artificial Sequence: Synthetic oligonucleotide
  Target: SCN9A; (-) strand; PAM type: NRG; PAM sequence: CGG
cagacagcagctgagaacag

SEQ ID NO: 25813 - DNA, 20 bp, Artificial Sequence
  Description of Artificial Sequence: Synthetic oligonucleotide
  Target: SCN9A; (-) strand; PAM type: NRG; PAM sequence: CAG
ccacagacagcagctgagaa

SEQ ID NO: 25814 - DNA, 20 bp, Artificial Sequence
  Description of Artificial Sequence: Synthetic oligonucleotide
  Target: SCN9A; (-) strand; PAM type: NRG; PAM sequence: GAG
cagaaccacagacagcagct

SEQ ID NO: 25815 - DNA, 20 bp, Artificial Sequence
  Description of Artificial Sequence: Synthetic oligonucleotide
  Target: SCN9A; (-) strand; PAM type: NRG; PAM sequence: CAG
catgacagaaccacagacag

SEQ ID NO: 25816 - DNA, 20 bp, Artificial Sequence
  Description of Artificial Sequence: Synthetic oligonucleotide
  Target: SCN9A; (-) strand; PAM type: NRG; PAM sequence: CAG
cttcatgacagaaccacaga

SEQ ID NO: 25817 - DNA, 20 bp, Artificial Sequence
  Description of Artificial Sequence: Synthetic oligonucleotide
  Target: SCN9A; (-) strand; PAM type: NRG; PAM sequence: CAG
tctacttcatgacagaacca

SEQ ID NO: 25818 - DNA, 20 bp, Artificial Sequence
  Description of Artificial Sequence: Synthetic oligonucleotide
  Target: SCN9A; (-) strand; PAM type: NRG; PAM sequence: CAG
ttagagcatctacttcatga

SEQ ID NO: 25819 - DNA, 20 bp, Artificial Sequence
  Description of Artificial Sequence: Synthetic oligonucleotide
  Target: SCN9A; (-) strand; PAM type: NRG; PAM sequence: GAG
aggatgtggacagtgcctta

SEQ ID NO: 25820 - DNA, 20 bp, Artificial Sequence
  Description of Artificial Sequence: Synthetic oligonucleotide
  Target: SCN9A; (-) strand; PAM type: NRG; PAM sequence: TAG
gcaggatgtggacagtgcct

SEQ ID NO: 25821 - DNA, 20 bp, Artificial Sequence
  Description of Artificial Sequence: Synthetic oligonucleotide
  Target: SCN9A; (-) strand; PAM type: NRG; PAM sequence: CAG
gctggaaagcaggatgtgga

SEQ ID NO: 25822 - DNA, 20 bp, Artificial Sequence
  Description of Artificial Sequence: Synthetic oligonucleotide
  Target: SCN9A; (-) strand; PAM type: NRG; PAM sequence: TGG
gcttgctggaaagcaggatg

SEQ ID NO: 25823 - DNA, 20 bp, Artificial Sequence
  Description of Artificial Sequence: Synthetic oligonucleotide
  Target: SCN9A; (-) strand; PAM type: NRG; PAM sequence: AGG
tgagcagcttgctggaaagc

SEQ ID NO: 25824 - DNA, 20 bp, Artificial Sequence
  Description of Artificial Sequence: Synthetic oligonucleotide
  Target: SCN9A; (-) strand; PAM type: NRG; PAM sequence: CAG
atgagcagcttgctggaaag

SEQ ID NO: 25825 - DNA, 20 bp, Artificial Sequence
  Description of Artificial Sequence: Synthetic oligonucleotide
  Target: SCN9A; (-) strand; PAM type: NRG; PAM sequence: AAG
ggaatgagcagcttgctgga

SEQ ID NO: 25826 - DNA, 20 bp, Artificial Sequence
  Description of Artificial Sequence: Synthetic oligonucleotide
  Target: SCN9A; (-) strand; PAM type: NRG; PAM sequence: TGG
tgggggaatgagcagcttgc

SEQ ID NO: 25827 - DNA, 20 bp, Artificial Sequence
  Description of Artificial Sequence: Synthetic oligonucleotide
  Target: SCN9A; (-) strand; PAM type: NRG; PAM sequence: CAG
ttggcagctgggggaatgag

SEQ ID NO: 25828 - DNA, 20 bp, Artificial Sequence
  Description of Artificial Sequence: Synthetic oligonucleotide
  Target: SCN9A; (-) strand; PAM type: NRG; PAM sequence: GAG
cttttggcagctgggggaat

SEQ ID NO: 25829 - DNA, 20 bp, Artificial Sequence
  Description of Artificial Sequence: Synthetic oligonucleotide
  Target: SCN9A; (-) strand; PAM type: NRG; PAM sequence: GGG
ccaacacttttggcagctgg

SEQ ID NO: 25830 - DNA, 20 bp, Artificial Sequence
  Description of Artificial Sequence: Synthetic oligonucleotide
  Target: SCN9A; (-) strand; PAM type: NRG; PAM sequence: GGG
tccaacacttttggcagctg

SEQ ID NO: 25831 - DNA, 20 bp, Artificial Sequence
  Description of Artificial Sequence: Synthetic oligonucleotide
  Target: SCN9A; (-) strand; PAM type: NRG; PAM sequence: GGG
atccaacacttttggcagct

SEQ ID NO: 25832 - DNA, 20 bp, Artificial Sequence
  Description of Artificial Sequence: Synthetic oligonucleotide
  Target: SCN9A; (-) strand; PAM type: NRG; PAM sequence: TGG
catccaacacttttggcagc

SEQ ID NO: 25833 - DNA, 20 bp, Artificial Sequence
  Description of Artificial Sequence: Synthetic oligonucleotide
  Target: SCN9A; (-) strand; PAM type: NRG; PAM sequence: CAG
tcagcatccaacacttttgg

SEQ ID NO: 25834 - DNA, 20 bp, Artificial Sequence
  Description of Artificial Sequence: Synthetic oligonucleotide
  Target: SCN9A; (-) strand; PAM type: NRG; PAM sequence: TGG
ccttcagcatccaacacttt

SEQ ID NO: 25835 - DNA, 20 bp, Artificial Sequence
  Description of Artificial Sequence: Synthetic oligonucleotide
  Target: SCN9A; (-) strand; PAM type: NRG; PAM sequence: CAG
gggattcagatgtgagcctt

SEQ ID NO: 25836 - DNA, 20 bp, Artificial Sequence
  Description of Artificial Sequence: Synthetic oligonucleotide
  Target: SCN9A; (-) strand; PAM type: NRG; PAM sequence: GAG
ccaaagagggattcagatgt

SEQ ID NO: 25837 - DNA, 20 bp, Artificial Sequence
  Description of Artificial Sequence: Synthetic oligonucleotide
  Target: SCN9A; (-) strand; PAM type: NRG; PAM sequence: CAG
ataaggcccaaagagggatt

SEQ ID NO: 25838 - DNA, 20 bp, Artificial Sequence
  Description of Artificial Sequence: Synthetic oligonucleotide
  Target: SCN9A; (-) strand; PAM type: NRG; PAM sequence: GGG
gccacgataaggcccaaaga

SEQ ID NO: 25839 - DNA, 20 bp, Artificial Sequence
  Description of Artificial Sequence: Synthetic oligonucleotide
  Target: SCN9A; (-) strand; PAM type: NRG; PAM sequence: AGG
tgccacgataaggcccaaag

SEQ ID NO: 25840 - DNA, 20 bp, Artificial Sequence
  Description of Artificial Sequence: Synthetic oligonucleotide
  Target: SCN9A; (-) strand; PAM type: NRG; PAM sequence: GAG
ctgccacgataaggcccaaa

SEQ ID NO: 25841 - DNA, 20 bp, Artificial Sequence
  Description of Artificial Sequence: Synthetic oligonucleotide
  Target: SCN9A; (-) strand; PAM type: NRG; PAM sequence: AAG
ttctgccacgataaggccca

SEQ ID NO: 25842 - DNA, 20 bp, Artificial Sequence
  Description of Artificial Sequence: Synthetic oligonucleotide
  Target: SCN9A; (-) strand; PAM type: NRG; PAM sequence: AGG
acctcccttctgccacgata

SEQ ID NO: 25843 - DNA, 20 bp, Artificial Sequence
  Description of Artificial Sequence: Synthetic oligonucleotide
  Target: SCN9A; (-) strand; PAM type: NRG; PAM sequence: AAG
cacctcccttctgccacgat

SEQ ID NO: 25844 - DNA, 20 bp, Artificial Sequence
  Description of Artificial Sequence: Synthetic oligonucleotide
  Target: SCN9A; (-) strand; PAM type: NRG; PAM sequence: AAG
gaagggtataaccttggggg

SEQ ID NO: 25845 - DNA, 20 bp, Artificial Sequence
  Description of Artificial Sequence: Synthetic oligonucleotide
  Target: SCN9A; (-) strand; PAM type: NRG; PAM sequence: GGG
ggagaagggtataaccttgg

SEQ ID NO: 25846 - DNA, 20 bp, Artificial Sequence
  Description of Artificial Sequence: Synthetic oligonucleotide
  Target: SCN9A; (-) strand; PAM type: NRG; PAM sequence: GGG
gggagaagggtataaccttg

SEQ ID NO: 25847 - DNA, 20 bp, Artificial Sequence
  Description of Artificial Sequence: Synthetic oligonucleotide
  Target: SCN9A; (-) strand; PAM type: NRG; PAM sequence: GGG
ggggagaagggtataacctt

SEQ ID NO: 25848 - DNA, 20 bp, Artificial Sequence
  Description of Artificial Sequence: Synthetic oligonucleotide
  Target: SCN9A; (-) strand; PAM type: NRG; PAM sequence: TGG
aggggagaagggtataacct

SEQ ID NO: 25849 - DNA, 20 bp, Artificial Sequence
  Description of Artificial Sequence: Synthetic oligonucleotide
  Target: SCN9A; (-) strand; PAM type: NRG; PAM sequence: GGG
tttacctttccaggggagaa

SEQ ID NO: 25850 - DNA, 20 bp, Artificial Sequence
  Description of Artificial Sequence: Synthetic oligonucleotide
  Target: SCN9A; (-) strand; PAM type: NRG; PAM sequence: AGG
ctttacctttccaggggaga

SEQ ID NO: 25851 - DNA, 20 bp, Artificial Sequence
  Description of Artificial Sequence: Synthetic oligonucleotide
  Target: SCN9A; (-) strand; PAM type: NRG; PAM sequence: AAG
cctttacctttccaggggag

SEQ ID NO: 25852 - DNA, 20 bp, Artificial Sequence
  Description of Artificial Sequence: Synthetic oligonucleotide
  Target: SCN9A; (-) strand; PAM type: NRG; PAM sequence: GAG
ctccctttacctttccaggg

SEQ ID NO: 25853 - DNA, 20 bp, Artificial Sequence
  Description of Artificial Sequence: Synthetic oligonucleotide
  Target: SCN9A; (-) strand; PAM type: NRG; PAM sequence: GGG
ctctccctttacctttccag

SEQ ID NO: 25854 - DNA, 20 bp, Artificial Sequence
  Description of Artificial Sequence: Synthetic oligonucleotide
  Target: SCN9A; (-) strand; PAM type: NRG; PAM sequence: GGG
gctctccctttacctttcca

SEQ ID NO: 25855 - DNA, 20 bp, Artificial Sequence
  Description of Artificial Sequence: Synthetic oligonucleotide
  Target: SCN9A; (-) strand; PAM type: NRG; PAM sequence: AGG
ggctctccctttacctttcc

SEQ ID NO: 25856 - DNA, 20 bp, Artificial Sequence
  Description of Artificial Sequence: Synthetic oligonucleotide
  Target: SCN9A; (-) strand; PAM type: NRG; PAM sequence: CAG
aggctctccctttacctttc

SEQ ID NO: 25857 - DNA, 20 bp, Artificial Sequence
  Description of Artificial Sequence: Synthetic oligonucleotide
  Target: SCN9A; (-) strand; PAM type: NRG; PAM sequence: AGG
ccacaccattcattggatgc

SEQ ID NO: 25858 - DNA, 20 bp, Artificial Sequence
  Description of Artificial Sequence: Synthetic oligonucleotide
  Target: SCN9A; (-) strand; PAM type: NRG; PAM sequence: CAG
tccacaccattcattggatg

SEQ ID NO: 25859 - DNA, 20 bp, Artificial Sequence
  Description of Artificial Sequence: Synthetic oligonucleotide
  Target: SCN9A; (-) strand; PAM type: NRG; PAM sequence: TGG
ttcttctccacaccattcat

SEQ ID NO: 25860 - DNA, 20 bp, Artificial Sequence
  Description of Artificial Sequence: Synthetic oligonucleotide
  Target: SCN9A; (-) strand; PAM type: NRG; PAM sequence: AGG
caaaacaaagcaagagggtc

SEQ ID NO: 25861 - DNA, 20 bp, Artificial Sequence
  Description of Artificial Sequence: Synthetic oligonucleotide
  Target: SCN9A; (-) strand; PAM type: NRG; PAM sequence: CAG
ccaaaacaaagcaagagggt

SEQ ID NO: 25862 - DNA, 20 bp, Artificial Sequence
  Description of Artificial Sequence: Synthetic oligonucleotide
  Target: SCN9A; (-) strand; PAM type: NRG; PAM sequence: GGG
agttccaaaacaaagcaaga

SEQ ID NO: 25863 - DNA, 20 bp, Artificial Sequence
  Description of Artificial Sequence: Synthetic oligonucleotide
  Target: SCN9A; (-) strand; PAM type: NRG; PAM sequence: AGG
tagttccaaaacaaagcaag

SEQ ID NO: 25864 - DNA, 20 bp, Artificial Sequence
  Description of Artificial Sequence: Synthetic oligonucleotide
  Target: SCN9A; (-) strand; PAM type: NRG; PAM sequence: GAG
gtagttccaaaacaaagcaa

SEQ ID NO: 25865 - DNA, 20 bp, Artificial Sequence
  Description of Artificial Sequence: Synthetic oligonucleotide
  Target: SCN9A; (-) strand; PAM type: NRG; PAM sequence: AAG
gagtagttccaaaacaaagc

SEQ ID NO: 25866 - DNA, 20 bp, Artificial Sequence
  Description of Artificial Sequence: Synthetic oligonucleotide
  Target: SCN9A; (-) strand; PAM type: NRG; PAM sequence: AAG
tctggagtagttccaaaaca

SEQ ID NO: 25867 - DNA, 20 bp, Artificial Sequence
  Description of Artificial Sequence: Synthetic oligonucleotide
  Target: SCN9A; (-) strand; PAM type: NRG; PAM sequence: TAG
gctgtgacaaccctctggag

SEQ ID NO: 25868 - DNA, 20 bp, Artificial Sequence
  Description of Artificial Sequence: Synthetic oligonucleotide
  Target: SCN9A; (-) strand; PAM type: NRG; PAM sequence: GAG
gatgctgtgacaaccctctg

SEQ ID NO: 25869 - DNA, 20 bp, Artificial Sequence
  Description of Artificial Sequence: Synthetic oligonucleotide
  Target: SCN9A; (-) strand; PAM type: NRG; PAM sequence: TGG
ctgatgctgtgacaaccctc

SEQ ID NO: 25870 - DNA, 20 bp, Artificial Sequence
  Description of Artificial Sequence: Synthetic oligonucleotide
  Target: SCN9A; (-) strand; PAM type: NRG; PAM sequence: TGG
gagatttcggctgatcctat

SEQ ID NO: 25871 - DNA, 20 bp, Artificial Sequence
  Description of Artificial Sequence: Synthetic oligonucleotide
  Target: SCN9A; (-) strand; PAM type: NRG; PAM sequence: CGG
taaaattgcaacagagattt

SEQ ID NO: 25872 - DNA, 20 bp, Artificial Sequence
  Description of Artificial Sequence: Synthetic oligonucleotide
  Target: SCN9A; (-) strand; PAM type: NRG; PAM sequence: GAG
gaactgttaaaattgcaaca

SEQ ID NO: 25873 - DNA, 20 bp, Artificial Sequence
  Description of Artificial Sequence: Synthetic oligonucleotide
  Target: SCN9A; (-) strand; PAM type: NRG; PAM sequence: CAG
ttgaactgttaaaattgcaa

SEQ ID NO: 25874 - DNA, 20 bp, Artificial Sequence
  Description of Artificial Sequence: Synthetic oligonucleotide
  Target: SCN9A; (-) strand; PAM type: NRG; PAM sequence: AAG
aaattattgggcagagagag

SEQ ID NO: 25875 - DNA, 20 bp, Artificial Sequence
  Description of Artificial Sequence: Synthetic oligonucleotide
  Target: SCN9A; (-) strand; PAM type: NRG; PAM sequence: GAG
gcaaaattattgggcagaga

SEQ ID NO: 25876 - DNA, 20 bp, Artificial Sequence
  Description of Artificial Sequence: Synthetic oligonucleotide
  Target: SCN9A; (-) strand; PAM type: NRG; PAM sequence: GAG
atgcaaaattattgggcaga

SEQ ID NO: 25877 - DNA, 20 bp, Artificial Sequence
  Description of Artificial Sequence: Synthetic oligonucleotide
  Target: SCN9A; (-) strand; PAM type: NRG; PAM sequence: GAG
gcatgcaaaattattgggca

SEQ ID NO: 25878 - DNA, 20 bp, Artificial Sequence
  Description of Artificial Sequence: Synthetic oligonucleotide
  Target: SCN9A; (-) strand; PAM type: NRG; PAM sequence: CAG
aggcatgcaaaattattggg

SEQ ID NO: 25879 - DNA, 20 bp, Artificial Sequence
  Description of Artificial Sequence: Synthetic oligonucleotide
  Target: SCN9A; (-) strand; PAM type: NRG; PAM sequence: GGG
gtgaggcatgcaaaattatt

SEQ ID NO: 25880 - DNA, 20 bp, Artificial Sequence
  Description of Artificial Sequence: Synthetic oligonucleotide
  Target: SCN9A; (-) strand; PAM type: NRG; PAM sequence: TGG
agtgaggcatgcaaaattat

SEQ ID NO: 25881 - DNA, 20 bp, Artificial Sequence
  Description of Artificial Sequence: Synthetic oligonucleotide
  Target: SCN9A; (-) strand; PAM type: NRG; PAM sequence: AGG
cgtaacatctgtaaaaagtg

SEQ ID NO: 25882 - DNA, 20 bp, Artificial Sequence
  Description of Artificial Sequence: Synthetic oligonucleotide
  Target: SCN9A; (-) strand; PAM type: NRG; PAM sequence: GAG
acgtaacatctgtaaaaagt

SEQ ID NO: 25883 - DNA, 20 bp, Artificial Sequence
  Description of Artificial Sequence: Synthetic oligonucleotide
  Target: SCN9A; (-) strand; PAM type: NRG; PAM sequence: AAG
cgaaacgtaacatctgtaaa

SEQ ID NO: 25884 - DNA, 20 bp, Artificial Sequence
  Description of Artificial Sequence: Synthetic oligonucleotide
  Target: SCN9A; (-) strand; PAM type: NRG; PAM sequence: AGG
atttactgagaagtgttttc

SEQ ID NO: 25885 - DNA, 20 bp, Artificial Sequence
  Description of Artificial Sequence: Synthetic oligonucleotide
  Target: SCN9A; (-) strand; PAM type: NRG; PAM sequence: CAG
gatttactgagaagtgtttt

SEQ ID NO: 25886 - DNA, 20 bp, Artificial Sequence
  Description of Artificial Sequence: Synthetic oligonucleotide
  Target: SCN9A; (-) strand; PAM type: NRG; PAM sequence: AAG
gaaatctgagatttactgag

SEQ ID NO: 25887 - DNA, 20 bp, Artificial Sequence
  Description of Artificial Sequence: Synthetic oligonucleotide
  Target: SCN9A; (-) strand; PAM type: NRG; PAM sequence: GAG
agagaaatctgagatttact

SEQ ID NO: 25888 - DNA, 20 bp, Artificial Sequence
  Description of Artificial Sequence: Synthetic oligonucleotide
  Target: SCN9A; (-) strand; PAM type: NRG; PAM sequence: GAG
caatcctgagagagaaatct

SEQ ID NO: 25889 - DNA, 20 bp, Artificial Sequence
  Description of Artificial Sequence: Synthetic oligonucleotide
  Target: SCN9A; (-) strand; PAM type: NRG; PAM sequence: GAG
ctgggaaaccaatcctgaga

SEQ ID NO: 25890 - DNA, 20 bp, Artificial Sequence
  Description of Artificial Sequence: Synthetic oligonucleotide
  Target: SCN9A; (-) strand; PAM type: NRG; PAM sequence: GAG
ccctgggaaaccaatcctga

SEQ ID NO: 25891 - DNA, 20 bp, Artificial Sequence
  Description of Artificial Sequence: Synthetic oligonucleotide
  Target: SCN9A; (-) strand; PAM type: NRG; PAM sequence: GAG
ttccctgggaaaccaatcct

SEQ ID NO: 25892 - DNA, 20 bp, Artificial Sequence
  Description of Artificial Sequence: Synthetic oligonucleotide
  Target: SCN9A; (-) strand; PAM type: NRG; PAM sequence: GGG
tgtgtaggggtcagttccct

SEQ ID NO: 25893 - DNA, 20 bp, Artificial Sequence
  Description of Artificial Sequence: Synthetic oligonucleotide
  Target: SCN9A; (-) strand; PAM type: NRG; PAM sequence: TGG
ttgtgtaggggtcagttccc

SEQ ID NO: 25894 - DNA, 20 bp, Artificial Sequence
  Description of Artificial Sequence: Synthetic oligonucleotide
  Target: SCN9A; (-) strand; PAM type: NRG; PAM sequence: CAG
tcacgggattgtgtaggggt

SEQ ID NO: 25895 - DNA, 20 bp, Artificial Sequence
  Description of Artificial Sequence: Synthetic oligonucleotide
  Target: SCN9A; (-) strand; PAM type: NRG; PAM sequence: GGG
ttaatcacgggattgtgtag

SEQ ID NO: 25896 - DNA, 20 bp, Artificial Sequence
  Description of Artificial Sequence: Synthetic oligonucleotide
  Target: SCN9A; (-) strand; PAM type: NRG; PAM sequence: GGG
attaatcacgggattgtgta

SEQ ID NO: 25897 - DNA, 20 bp, Artificial Sequence
  Description of Artificial Sequence: Synthetic oligonucleotide
  Target: SCN9A; (-) strand; PAM type: NRG; PAM sequence: AGG
cattaatcacgggattgtgt

SEQ ID NO: 25898 - DNA, 20 bp, Artificial Sequence
  Description of Artificial Sequence: Synthetic oligonucleotide
  Target: SCN9A; (-) strand; PAM type: NRG; PAM sequence: TAG
tcattaatcacgggattgtg

SEQ ID NO: 25899 - DNA, 20 bp, Artificial Sequence
  Description of Artificial Sequence: Synthetic oligonucleotide
  Target: SCN9A; (-) strand; PAM type: NRG; PAM sequence: GGG
tgctaactttcattaatcac

SEQ ID NO: 25900 - DNA, 20 bp, Artificial Sequence
  Description of Artificial Sequence: Synthetic oligonucleotide
  Target: SCN9A; (-) strand; PAM type: NRG; PAM sequence: CGG
atgctaactttcattaatca

SEQ ID NO: 25901 - DNA, 20 bp, Artificial Sequence
  Description of Artificial Sequence: Synthetic oligonucleotide
  Target: SCN9A; (-) strand; PAM type: NRG; PAM sequence: GGG
gtcagagttgtagataggtt

SEQ ID NO: 25902 - DNA, 20 bp, Artificial Sequence
  Description of Artificial Sequence: Synthetic oligonucleotide
  Target: SCN9A; (-) strand; PAM type: NRG; PAM sequence: TGG
agtcagagttgtagataggt

SEQ ID NO: 25903 - DNA, 20 bp, Artificial Sequence
  Description of Artificial Sequence: Synthetic oligonucleotide
  Target: SCN9A; (-) strand; PAM type: NRG; PAM sequence: AGG
gaaaagtcagagttgtagat

SEQ ID NO: 25904 - DNA, 20 bp, Artificial Sequence
  Description of Artificial Sequence: Synthetic oligonucleotide
  Target: SCN9A; (-) strand; PAM type: NRG; PAM sequence: TAG
agaaaagtcagagttgtaga

SEQ ID NO: 25905 - DNA, 20 bp, Artificial Sequence
  Description of Artificial Sequence: Synthetic oligonucleotide
  Target: SCN9A; (-) strand; PAM type: NRG; PAM sequence: TAG
aagaagaaaagtcagagttg

SEQ ID NO: 25906 - DNA, 20 bp, Artificial Sequence
  Description of Artificial Sequence: Synthetic oligonucleotide
  Target: SCN9A; (-) strand; PAM type: NRG; PAM sequence: GAG
taaggaaagaagaaaagtca

SEQ ID NO: 25907 - DNA, 20 bp, Artificial Sequence
  Description of Artificial Sequence: Synthetic oligonucleotide
  Target: SCN9A; (-) strand; PAM type: NRG; PAM sequence: CAG
cttaaggaaagaagaaaagt

SEQ ID NO: 25908 - DNA, 20 bp, Artificial Sequence
  Description of Artificial Sequence: Synthetic oligonucleotide
  Target: SCN9A; (-) strand; PAM type: NRG; PAM sequence: AAG
aaatcttaaggaaagaagaa

SEQ ID NO: 25909 - DNA, 20 bp, Artificial Sequence
  Description of Artificial Sequence: Synthetic oligonucleotide
  Target: SCN9A; (-) strand; PAM type: NRG; PAM sequence: AAG
aagataaatcttaaggaaag

SEQ ID NO: 25910 - DNA, 20 bp, Artificial Sequence
  Description of Artificial Sequence: Synthetic oligonucleotide
  Target: SCN9A; (-) strand; PAM type: NRG; PAM sequence: AAG
ggaaagataaatcttaagga

SEQ ID NO: 25911 - DNA, 20 bp, Artificial Sequence
  Description of Artificial Sequence: Synthetic oligonucleotide
  Target: SCN9A; (-) strand; PAM type: NRG; PAM sequence: AGG
atatggaaagataaatctta

SEQ ID NO: 25912 - DNA, 20 bp, Artificial Sequence
  Description of Artificial Sequence: Synthetic oligonucleotide
  Target: SCN9A; (-) strand; PAM type: NRG; PAM sequence: AAG
tatatggaaagataaatctt

SEQ ID NO: 25913 - DNA, 20 bp, Artificial Sequence
  Description of Artificial Sequence: Synthetic oligonucleotide
  Target: SCN9A; (-) strand; PAM type: NRG; PAM sequence: AAG
ctgaacaggaggtatatgga

SEQ ID NO: 25914 - DNA, 20 bp, Artificial Sequence
  Description of Artificial Sequence: Synthetic oligonucleotide
  Target: SCN9A; (-) strand; PAM type: NRG; PAM sequence: TGG
gaacctgaacaggaggtata

SEQ ID NO: 25915 - DNA, 20 bp, Artificial Sequence
  Description of Artificial Sequence: Synthetic oligonucleotide
  Target: SCN9A; (-) strand; PAM type: NRG; PAM sequence: AGG
aggcagtgaacctgaacagg

SEQ ID NO: 25916 - DNA, 20 bp, Artificial Sequence
  Description of Artificial Sequence: Synthetic oligonucleotide
  Target: SCN9A; (-) strand; PAM type: NRG; PAM sequence: GAG
caggcagtgaacctgaacag

SEQ ID NO: 25917 - DNA, 20 bp, Artificial Sequence
  Description of Artificial Sequence: Synthetic oligonucleotide
  Target: SCN9A; (-) strand; PAM type: NRG; PAM sequence: AGG
tacaggcagtgaacctgaac

SEQ ID NO: 25918 - DNA, 20 bp, Artificial Sequence
  Description of Artificial Sequence: Synthetic oligonucleotide
  Target: SCN9A; (-) strand; PAM type: NRG; PAM sequence: CAG
gtacaggcagtgaacctgaa

SEQ ID NO: 25919 - DNA, 20 bp, Artificial Sequence
  Description of Artificial Sequence: Synthetic oligonucleotide
  Target: SCN9A; (-) strand; PAM type: NRG; PAM sequence: CAG
tgaactacttgcagtacagg

SEQ ID NO: 25920 - DNA, 20 bp, Artificial Sequence
  Description of Artificial Sequence: Synthetic oligonucleotide
  Target: SCN9A; (-) strand; PAM type: NRG; PAM sequence: AGG
atttgaactacttgcagtac

SEQ ID NO: 25921 - DNA, 20 bp, Artificial Sequence
  Description of Artificial Sequence: Synthetic oligonucleotide
  Target: SCN9A; (-) strand; PAM type: NRG; PAM sequence: CAG
aatttgaactacttgcagta

SEQ ID NO: 25922 - DNA, 20 bp, Artificial Sequence
  Description of Artificial Sequence: Synthetic oligonucleotide
  Target: SCN9A; (-) strand; PAM type: NRG; PAM sequence: CAG
tcataaatttgaactacttg

SEQ ID NO: 25923 - DNA, 20 bp, Artificial Sequence
  Description of Artificial Sequence: Synthetic oligonucleotide
  Target: SCN9A; (-) strand; PAM type: NRG; PAM sequence: TGG
aaatacagagtttaatttgg

SEQ ID NO: 25924 - DNA, 20 bp, Artificial Sequence
  Description of Artificial Sequence: Synthetic oligonucleotide
  Target: SCN9A; (-) strand; PAM type: NRG; PAM sequence: TGG
gggaaatacagagtttaatt

SEQ ID NO: 25925 - DNA, 20 bp, Artificial Sequence
  Description of Artificial Sequence: Synthetic oligonucleotide
  Target: SCN9A; (-) strand; PAM type: NRG; PAM sequence: GAG
gaggaggtaggggaaataca

SEQ ID NO: 25926 - DNA, 20 bp, Artificial Sequence
  Description of Artificial Sequence: Synthetic oligonucleotide
  Target: SCN9A; (-) strand; PAM type: NRG; PAM sequence: CAG
ttgaggaggtaggggaaata

SEQ ID NO: 25927 - DNA, 20 bp, Artificial Sequence
  Description of Artificial Sequence: Synthetic oligonucleotide
  Target: SCN9A; (-) strand; PAM type: NRG; PAM sequence: GGG
ggagaaaattgaggaggtag

SEQ ID NO: 25928 - DNA, 20 bp, Artificial Sequence
  Description of Artificial Sequence: Synthetic oligonucleotide
  Target: SCN9A; (-) strand; PAM type: NRG; PAM sequence: GGG
aggagaaaattgaggaggta

SEQ ID NO: 25929 - DNA, 20 bp, Artificial Sequence
  Description of Artificial Sequence: Synthetic oligonucleotide
  Target: SCN9A; (-) strand; PAM type: NRG; PAM sequence: AGG
gaggagaaaattgaggaggt

SEQ ID NO: 25930 - DNA, 20 bp, Artificial Sequence
  Description of Artificial Sequence: Synthetic oligonucleotide
  Target: SCN9A; (-) strand; PAM type: NRG; PAM sequence: TAG
ggaggagaaaattgaggagg

SEQ ID NO: 25931 - DNA, 20 bp, Artificial Sequence
  Description of Artificial Sequence: Synthetic oligonucleotide
  Target: SCN9A; (-) strand; PAM type: NRG; PAM sequence: AGG
gatggaggagaaaattgagg

SEQ ID NO: 25932 - DNA, 20 bp, Artificial Sequence
  Description of Artificial Sequence: Synthetic oligonucleotide
  Target: SCN9A; (-) strand; PAM type: NRG; PAM sequence: GAG
tgatggaggagaaaattgag

SEQ ID NO: 25933 - DNA, 20 bp, Artificial Sequence
  Description of Artificial Sequence: Synthetic oligonucleotide
  Target: SCN9A; (-) strand; PAM type: NRG; PAM sequence: AGG
actgatggaggagaaaattg

SEQ ID NO: 25934 - DNA, 20 bp, Artificial Sequence
  Description of Artificial Sequence: Synthetic oligonucleotide
  Target: SCN9A; (-) strand; PAM type: NRG; PAM sequence: GAG
cactgatggaggagaaaatt

SEQ ID NO: 25935 - DNA, 20 bp, Artificial Sequence
  Description of Artificial Sequence: Synthetic oligonucleotide
  Target: SCN9A; (-) strand; PAM type: NRG; PAM sequence: GAG
ttaagaatacactgatggag

SEQ ID NO: 25936 - DNA, 20 bp, Artificial Sequence
  Description of Artificial Sequence: Synthetic oligonucleotide
  Target: SCN9A; (-) strand; PAM type: NRG; PAM sequence: AGG
aattaagaatacactgatgg

SEQ ID NO: 25937 - DNA, 20 bp, Artificial Sequence
  Description of Artificial Sequence: Synthetic oligonucleotide
  Target: SCN9A; (-) strand; PAM type: NRG; PAM sequence: GAG
caattaagaatacactgatg

SEQ ID NO: 25938 - DNA, 20 bp, Artificial Sequence
  Description of Artificial Sequence: Synthetic oligonucleotide
  Target: SCN9A; (-) strand; PAM type: NRG; PAM sequence: TGG
tacaattaagaatacactga

SEQ ID NO: 25939 - DNA, 20 bp, Artificial Sequence
  Description of Artificial Sequence: Synthetic oligonucleotide
  Target: SCN9A; (-) strand; PAM type: NRG; PAM sequence: AAG
agatggttattgatacaatt

SEQ ID NO: 25940 - DNA, 20 bp, Artificial Sequence
  Description of Artificial Sequence: Synthetic oligonucleotide
  Target: SCN9A; (-) strand; PAM type: NRG; PAM sequence: TGG
ttttgacttagaagactaga

SEQ ID NO: 25941 - DNA, 20 bp, Artificial Sequence
  Description of Artificial Sequence: Synthetic oligonucleotide
  Target: SCN9A; (-) strand; PAM type: NRG; PAM sequence: TAG
agaattttgacttagaagac

SEQ ID NO: 25942 - DNA, 20 bp, Artificial Sequence
  Description of Artificial Sequence: Synthetic oligonucleotide
  Target: SCN9A; (-) strand; PAM type: NRG; PAM sequence: AAG
aacaaagaattttgacttag

SEQ ID NO: 25943 - DNA, 20 bp, Artificial Sequence
  Description of Artificial Sequence: Synthetic oligonucleotide
  Target: SCN9A; (-) strand; PAM type: NRG; PAM sequence: TAG
cacaacaaagaattttgact

SEQ ID NO: 25944 - DNA, 20 bp, Artificial Sequence
  Description of Artificial Sequence: Synthetic oligonucleotide
  Target: SCN9A; (-) strand; PAM type: NRG; PAM sequence: AAG
ttacaattcaacccacaaca

SEQ ID NO: 25945 - DNA, 20 bp, Artificial Sequence
  Description of Artificial Sequence: Synthetic oligonucleotide
  Target: SCN9A; (-) strand; PAM type: NRG; PAM sequence: AGG
gacttcaacataacttttgg

SEQ ID NO: 25946 - DNA, 20 bp, Artificial Sequence
  Description of Artificial Sequence: Synthetic oligonucleotide
  Target: SCN9A; (-) strand; PAM type: NRG; PAM sequence: GAG
ggacttcaacataacttttg

SEQ ID NO: 25947 - DNA, 20 bp, Artificial Sequence
  Description of Artificial Sequence: Synthetic oligonucleotide
  Target: SCN9A; (-) strand; PAM type: NRG; PAM sequence: TGG
taggacttcaacataacttt

SEQ ID NO: 25948 - DNA, 20 bp, Artificial Sequence
  Description of Artificial Sequence: Synthetic oligonucleotide
  Target: SCN9A; (-) strand; PAM type: NRG; PAM sequence: AGG
cactcaaacatgccagggtt

SEQ ID NO: 25949 - DNA, 20 bp, Artificial Sequence
  Description of Artificial Sequence: Synthetic oligonucleotide
  Target: SCN9A; (-) strand; PAM type: NRG; PAM sequence: TAG
acactcaaacatgccagggt

SEQ ID NO: 25950 - DNA, 20 bp, Artificial Sequence
  Description of Artificial Sequence: Synthetic oligonucleotide
  Target: SCN9A; (-) strand; PAM type: NRG; PAM sequence: GGG
gatcacactcaaacatgcca

SEQ ID NO: 25951 - DNA, 20 bp, Artificial Sequence
  Description of Artificial Sequence: Synthetic oligonucleotide
  Target: SCN9A; (-) strand; PAM type: NRG; PAM sequence: AGG
agatcacactcaaacatgcc

SEQ ID NO: 25952 - DNA, 20 bp, Artificial Sequence
  Description of Artificial Sequence: Synthetic oligonucleotide
  Target: SCN9A; (-) strand; PAM type: NRG; PAM sequence: CAG
aagatcacactcaaacatgc

SEQ ID NO: 25953 - DNA, 20 bp, Artificial Sequence
  Description of Artificial Sequence: Synthetic oligonucleotide
  Target: SCN9A; (-) strand; PAM type: NRG; PAM sequence: AAG
caaagaccatatttccaaat

SEQ ID NO: 25954 - DNA, 20 bp, Artificial Sequence
  Description of Artificial Sequence: Synthetic oligonucleotide
  Target: SCN9A; (-) strand; PAM type: NRG; PAM sequence: AAG
tcatcttcattgtgtctgca

SEQ ID NO: 25955 - DNA, 20 bp, Artificial Sequence
  Description of Artificial Sequence: Synthetic oligonucleotide
  Target: SCN9A; (-) strand; PAM type: NRG; PAM sequence: TGG
gaccccagttatattggatt

SEQ ID NO: 25956 - DNA, 20 bp, Artificial Sequence
  Description of Artificial Sequence: Synthetic oligonucleotide
  Target: SCN9A; (-) strand; PAM type: NRG; PAM sequence: TGG
tataaggaccccagttatat

SEQ ID NO: 25957 - DNA, 20 bp, Artificial Sequence
  Description of Artificial Sequence: Synthetic oligonucleotide
  Target: SCN9A; (-) strand; PAM type: NRG; PAM sequence: CAG
ttttcttcttataaggaccc

SEQ ID NO: 25958 - DNA, 20 bp, Artificial Sequence
  Description of Artificial Sequence: Synthetic oligonucleotide
  Target: SCN9A; (-) strand; PAM type: NRG; PAM sequence: AGG
ctcggtcttttcttcttata

SEQ ID NO: 25959 - DNA, 20 bp, Artificial Sequence
  Description of Artificial Sequence: Synthetic oligonucleotide
  Target: SCN9A; (-) strand; PAM type: NRG; PAM sequence: AAG
tctcggtcttttcttcttat

SEQ ID NO: 25960 - DNA, 20 bp, Artificial Sequence
  Description of Artificial Sequence: Synthetic oligonucleotide
  Target: SCN9A; (-) strand; PAM type: NRG; PAM sequence: CGG
agttttctccctgtgtgtct

SEQ ID NO: 25961 - DNA, 20 bp, Artificial Sequence
  Description of Artificial Sequence: Synthetic oligonucleotide
  Target: SCN9A; (-) strand; PAM type: NRG; PAM sequence: TAG
tctctggcccggtactcacg

SEQ ID NO: 25962 - DNA, 20 bp, Artificial Sequence
  Description of Artificial Sequence: Synthetic oligonucleotide
  Target: SCN9A; (-) strand; PAM type: NRG; PAM sequence: CGG
catcatcccaatctctggcc

SEQ ID NO: 25963 - DNA, 20 bp, Artificial Sequence
  Description of Artificial Sequence: Synthetic oligonucleotide
  Target: SCN9A; (-) strand; PAM type: NRG; PAM sequence: TGG
agctgcatcatcccaatctc

SEQ ID NO: 25964 - DNA, 20 bp, Artificial Sequence
  Description of Artificial Sequence: Synthetic oligonucleotide
  Target: SCN9A; (-) strand; PAM type: NRG; PAM sequence: CAG
ttggcaatccttgcagcttg

SEQ ID NO: 25965 - DNA, 20 bp, Artificial Sequence
  Description of Artificial Sequence: Synthetic oligonucleotide
  Target: SCN9A; (-) strand; PAM type: NRG; PAM sequence: CAG
gaggttgttggcaatccttg

SEQ ID NO: 25966 - DNA, 20 bp, Artificial Sequence
  Description of Artificial Sequence: Synthetic oligonucleotide
  Target: SCN9A; (-) strand; PAM type: NRG; PAM sequence: TGG
tttctaactttggaggttgt

SEQ ID NO: 25967 - DNA, 20 bp, Artificial Sequence
  Description of Artificial Sequence: Synthetic oligonucleotide
  Target: SCN9A; (-) strand; PAM type: NRG; PAM sequence: AGG
ttgctgctttctaactttgg

SEQ ID NO: 25968 - DNA, 20 bp, Artificial Sequence
  Description of Artificial Sequence: Synthetic oligonucleotide
  Target: SCN9A; (-) strand; PAM type: NRG; PAM sequence: GAG
cttgctgctttctaactttg

SEQ ID NO: 25969 - DNA, 20 bp, Artificial Sequence
  Description of Artificial Sequence: Synthetic oligonucleotide
  Target: SCN9A; (-) strand; PAM type: NRG; PAM sequence: TGG
gccttgctgctttctaactt

SEQ ID NO: 25970 - DNA, 20 bp, Artificial Sequence
  Description of Artificial Sequence: Synthetic oligonucleotide
  Target: SCN9A; (-) strand; PAM type: NRG; PAM sequence: AAG
atttctctaaaggctctagt

SEQ ID NO: 25971 - DNA, 20 bp, Artificial Sequence
  Description of Artificial Sequence: Synthetic oligonucleotide
  Target: SCN9A; (-) strand; PAM type: NRG; PAM sequence: TAG
catgatttctctaaaggctc

SEQ ID NO: 25972 - DNA, 20 bp, Artificial Sequence
  Description of Artificial Sequence: Synthetic oligonucleotide
  Target: SCN9A; (-) strand; PAM type: NRG; PAM sequence: AGG
caaggccatgatttctctaa

SEQ ID NO: 25973 - DNA, 20 bp, Artificial Sequence
  Description of Artificial Sequence: Synthetic oligonucleotide
  Target: SCN9A; (-) strand; PAM type: NRG; PAM sequence: AAG
gcaaggccatgatttctcta

SEQ ID NO: 25974 - DNA, 20 bp, Artificial Sequence
  Description of Artificial Sequence: Synthetic oligonucleotide
  Target: SCN9A; (-) strand; PAM type: NRG; PAM sequence: AGG
ctgaaatcaaggtctgagca

SEQ ID NO: 25975 - DNA, 20 bp, Artificial Sequence
  Description of Artificial Sequence: Synthetic oligonucleotide
  Target: SCN9A; (-) strand; PAM type: NRG; PAM sequence: AAG
tctgaaatcaaggtctgagc

SEQ ID NO: 25976 - DNA, 20 bp, Artificial Sequence
  Description of Artificial Sequence: Synthetic oligonucleotide
  Target: SCN9A; (-) strand; PAM type: NRG; PAM sequence: GAG
gaagtctgaaatcaaggtct

SEQ ID NO: 25977 - DNA, 20 bp, Artificial Sequence
  Description of Artificial Sequence: Synthetic oligonucleotide
  Target: SCN9A; (-) strand; PAM type: NRG; PAM sequence: AGG
aggctagaagtctgaaatca

SEQ ID NO: 25978 - DNA, 20 bp, Artificial Sequence
  Description of Artificial Sequence: Synthetic oligonucleotide
  Target: SCN9A; (-) strand; PAM type: NRG; PAM sequence: AAG
gaggctagaagtctgaaatc

SEQ ID NO: 25979 - DNA, 20 bp, Artificial Sequence
  Description of Artificial Sequence: Synthetic oligonucleotide
  Target: SCN9A; (-) strand; PAM type: NRG; PAM sequence: AAG
ttgccagttctggaggctag

SEQ ID NO: 25980 - DNA, 20 bp, Artificial Sequence
  Description of Artificial Sequence: Synthetic oligonucleotide
  Target: SCN9A; (-) strand; PAM type: NRG; PAM sequence: TAG
cttttgccagttctggaggc

SEQ ID NO: 25981 - DNA, 20 bp, Artificial Sequence
  Description of Artificial Sequence: Synthetic oligonucleotide
  Target: SCN9A; (-) strand; PAM type: NRG; PAM sequence: AGG
tattcttttgccagttctgg

SEQ ID NO: 25982 - DNA, 20 bp, Artificial Sequence
  Description of Artificial Sequence: Synthetic oligonucleotide
  Target: SCN9A; (-) strand; PAM type: NRG; PAM sequence: GAG
ttattcttttgccagttctg

SEQ ID NO: 25983 - DNA, 20 bp, Artificial Sequence
  Description of Artificial Sequence: Synthetic oligonucleotide
  Target: SCN9A; (-) strand; PAM type: NRG; PAM sequence: TGG
atttattcttttgccagttc

SEQ ID NO: 25984 - DNA, 20 bp, Artificial Sequence
  Description of Artificial Sequence: Synthetic oligonucleotide
  Target: SCN9A; (-) strand; PAM type: NRG; PAM sequence: CAG
acagaaatttattcttttgc

SEQ ID NO: 25985 - DNA, 20 bp, Artificial Sequence
  Description of Artificial Sequence: Synthetic oligonucleotide
  Target: SCN9A; (-) strand; PAM type: NRG; PAM sequence: CAG
aactcagtggcttacaacaa

SEQ ID NO: 25986 - DNA, 20 bp, Artificial Sequence
  Description of Artificial Sequence: Synthetic oligonucleotide
  Target: SCN9A; (-) strand; PAM type: NRG; PAM sequence: TGG
aacaaattagcaaaactcag

SEQ ID NO: 25987 - DNA, 20 bp, Artificial Sequence
  Description of Artificial Sequence: Synthetic oligonucleotide
  Target: SCN9A; (-) strand; PAM type: NRG; PAM sequence: CAG
tgtaacaaattagcaaaact

SEQ ID NO: 25988 - DNA, 20 bp, Artificial Sequence
  Description of Artificial Sequence: Synthetic oligonucleotide
  Target: SCN9A; (-) strand; PAM type: NRG; PAM sequence: TAG
ttacggctgttgtaacaaat

SEQ ID NO: 25989 - DNA, 20 bp, Artificial Sequence
  Description of Artificial Sequence: Synthetic oligonucleotide
  Target: SCN9A; (-) strand; PAM type: NRG; PAM sequence: CGG
aaggatgtattagtttctta

SEQ ID NO: 25990 - DNA, 20 bp, Artificial Sequence
  Description of Artificial Sequence: Synthetic oligonucleotide
  Target: SCN9A; (-) strand; PAM type: NRG; PAM sequence: TAG
gagctgatccaaggatgtat

SEQ ID NO: 25991 - DNA, 20 bp, Artificial Sequence
  Description of Artificial Sequence: Synthetic oligonucleotide
  Target: SCN9A; (-) strand; PAM type: NRG; PAM sequence: AGG
taagattgtgagctgatcca

SEQ ID NO: 25992 - DNA, 20 bp, Artificial Sequence
  Description of Artificial Sequence: Synthetic oligonucleotide
  Target: SCN9A; (-) strand; PAM type: NRG; PAM sequence: AAG
ataagattgtgagctgatcc

SEQ ID NO: 25993 - DNA, 20 bp, Artificial Sequence
  Description of Artificial Sequence: Synthetic oligonucleotide
  Target: SCN9A; (-) strand; PAM type: NRG; PAM sequence: GAG
gtctagatatataagattgt

SEQ ID NO: 25994 - DNA, 20 bp, Artificial Sequence
  Description of Artificial Sequence: Synthetic oligonucleotide
  Target: SCN9A; (-) strand; PAM type: NRG; PAM sequence: AAG
ggctcagggtctagatatat

SEQ ID NO: 25995 - DNA, 20 bp, Artificial Sequence
  Description of Artificial Sequence: Synthetic oligonucleotide
  Target: SCN9A; (-) strand; PAM type: NRG; PAM sequence: TAG
aaatataagggctcagggtc

SEQ ID NO: 25996 - DNA, 20 bp, Artificial Sequence
  Description of Artificial Sequence: Synthetic oligonucleotide
  Target: SCN9A; (-) strand; PAM type: NRG; PAM sequence: GGG
agttaaaatataagggctca

SEQ ID NO: 25997 - DNA, 20 bp, Artificial Sequence
  Description of Artificial Sequence: Synthetic oligonucleotide
  Target: SCN9A; (-) strand; PAM type: NRG; PAM sequence: AGG
aagttaaaatataagggctc

SEQ ID NO: 25998 - DNA, 20 bp, Artificial Sequence
  Description of Artificial Sequence: Synthetic oligonucleotide
  Target: SCN9A; (-) strand; PAM type: NRG; PAM sequence: CAG
aaagttaaaatataagggct

SEQ ID NO: 25999 - DNA, 20 bp, Artificial Sequence
  Description of Artificial Sequence: Synthetic oligonucleotide
  Target: SCN9A; (-) strand; PAM type: NRG; PAM sequence: GGG
acttgaaagttaaaatataa

SEQ ID NO: 26000 - DNA, 20 bp, Artificial Sequence
  Description of Artificial Sequence: Synthetic oligonucleotide
  Target: SCN9A; (-) strand; PAM type: NRG; PAM sequence: AGG
aacttgaaagttaaaatata

SEQ ID NO: 26001 - DNA, 20 bp, Artificial Sequence
  Description of Artificial Sequence: Synthetic oligonucleotide
  Target: SCN9A; (-) strand; PAM type: NRG; PAM sequence: AAG
taacttgaaagttaaaatat

SEQ ID NO: 26002 - DNA, 20 bp, Artificial Sequence
  Description of Artificial Sequence: Synthetic oligonucleotide
  Target: SCN9A; (-) strand; PAM type: NRG; PAM sequence: AAG
taatatcgggattaacttga

SEQ ID NO: 26003 - DNA, 20 bp, Artificial Sequence
  Description of Artificial Sequence: Synthetic oligonucleotide
  Target: SCN9A; (-) strand; PAM type: NRG; PAM sequence: GGG
agctgcaacaatttaatatc

SEQ ID NO: 26004 - DNA, 20 bp, Artificial Sequence
  Description of Artificial Sequence: Synthetic oligonucleotide
  Target: SCN9A; (-) strand; PAM type: NRG; PAM sequence: CGG
cagctgcaacaatttaatat

SEQ ID NO: 26005 - DNA, 20 bp, Artificial Sequence
  Description of Artificial Sequence: Synthetic oligonucleotide
  Target: SCN9A; (-) strand; PAM type: NRG; PAM sequence: CAG
aaaaagatcatgttctcaca

SEQ ID NO: 26006 - DNA, 20 bp, Artificial Sequence
  Description of Artificial Sequence: Synthetic oligonucleotide
  Target: SCN9A; (-) strand; PAM type: NRG; PAM sequence: AAG
taagaattgctgagggaaaa

SEQ ID NO: 26007 - DNA, 20 bp, Artificial Sequence
  Description of Artificial Sequence: Synthetic oligonucleotide
  Target: SCN9A; (-) strand; PAM type: NRG; PAM sequence: GGG
actgtgctaagaattgctga

SEQ ID NO: 26008 - DNA, 20 bp, Artificial Sequence
  Description of Artificial Sequence: Synthetic oligonucleotide
  Target: SCN9A; (-) strand; PAM type: NRG; PAM sequence: AGG
cactgtgctaagaattgctg

SEQ ID NO: 26009 - DNA, 20 bp, Artificial Sequence
  Description of Artificial Sequence: Synthetic oligonucleotide
  Target: SCN9A; (-) strand; PAM type: NRG; PAM sequence: GAG
gcactgtgctaagaattgct

SEQ ID NO: 26010 - DNA, 20 bp, Artificial Sequence
  Description of Artificial Sequence: Synthetic oligonucleotide
  Target: SCN9A; (-) strand; PAM type: NRG; PAM sequence: AAG
tatgctctaagcactgtgct

SEQ ID NO: 26011 - DNA, 20 bp, Artificial Sequence
  Description of Artificial Sequence: Synthetic oligonucleotide
  Target: SCN9A; (-) strand; PAM type: NRG; PAM sequence: AAG
attacaccttactatgctct

SEQ ID NO: 26012 - DNA, 20 bp, Artificial Sequence
  Description of Artificial Sequence: Synthetic oligonucleotide
  Target: SCN9A; (-) strand; PAM type: NRG; PAM sequence: AAG
ctcattagaagccttaaagg

SEQ ID NO: 26013 - DNA, 20 bp, Artificial Sequence
  Description of Artificial Sequence: Synthetic oligonucleotide
  Target: SCN9A; (-) strand; PAM type: NRG; PAM sequence: AGG
ttcctcattagaagccttaa

SEQ ID NO: 26014 - DNA, 20 bp, Artificial Sequence
  Description of Artificial Sequence: Synthetic oligonucleotide
  Target: SCN9A; (-) strand; PAM type: NRG; PAM sequence: AAG
cttcctcattagaagcctta

SEQ ID NO: 26015 - DNA, 20 bp, Artificial Sequence
  Description of Artificial Sequence: Synthetic oligonucleotide
  Target: SCN9A; (-) strand; PAM type: NRG; PAM sequence: AAG
gtgaagtgcttcctcattag

SEQ ID NO: 26016 - DNA, 20 bp, Artificial Sequence
  Description of Artificial Sequence: Synthetic oligonucleotide
  Target: SCN9A; (-) strand; PAM type: NRG; PAM sequence: TAG
gcagtgaagtgcttcctcat

SEQ ID NO: 26017 - DNA, 20 bp, Artificial Sequence
  Description of Artificial Sequence: Synthetic oligonucleotide
  Target: SCN9A; (-) strand; PAM type: NRG; PAM sequence: AAG
cttttttaccactggcagtg

SEQ ID NO: 26018 - DNA, 20 bp, Artificial Sequence
  Description of Artificial Sequence: Synthetic oligonucleotide
  Target: SCN9A; (-) strand; PAM type: NRG; PAM sequence: CAG
acaggcttttttaccactgg

SEQ ID NO: 26019 - DNA, 20 bp, Artificial Sequence
  Description of Artificial Sequence: Synthetic oligonucleotide
  Target: SCN9A; (-) strand; PAM type: NRG; PAM sequence: TGG
tacacaggcttttttaccac

SEQ ID NO: 26020 - DNA, 20 bp, Artificial Sequence
  Description of Artificial Sequence: Synthetic oligonucleotide
  Target: SCN9A; (-) strand; PAM type: NRG; PAM sequence: AGG
acattaacaacacactacac

SEQ ID NO: 26021 - DNA, 20 bp, Artificial Sequence
  Description of Artificial Sequence: Synthetic oligonucleotide
  Target: SCN9A; (-) strand; PAM type: NRG; PAM sequence: CAG
aacattaacaacacactaca

SEQ ID NO: 26022 - DNA, 20 bp, Artificial Sequence
  Description of Artificial Sequence: Synthetic oligonucleotide
  Target: SCN9A; (-) strand; PAM type: NRG; PAM sequence: AAG
gaagtgcaatgaagccctcc

SEQ ID NO: 26023 - DNA, 20 bp, Artificial Sequence
  Description of Artificial Sequence: Synthetic oligonucleotide
  Target: SCN9A; (-) strand; PAM type: NRG; PAM sequence: AAG
ccttctcctgaagtgcaatg

SEQ ID NO: 26024 - DNA, 20 bp, Artificial Sequence
  Description of Artificial Sequence: Synthetic oligonucleotide
  Target: SCN9A; (-) strand; PAM type: NRG; PAM sequence: AAG
tcagagtcagccttctcctg

SEQ ID NO: 26025 - DNA, 20 bp, Artificial Sequence
  Description of Artificial Sequence: Synthetic oligonucleotide
  Target: SCN9A; (-) strand; PAM type: NRG; PAM sequence: CAG
ctgatggctcttctcagagt

SEQ ID NO: 26026 - DNA, 20 bp, Artificial Sequence
  Description of Artificial Sequence: Synthetic oligonucleotide
  Target: SCN9A; (-) strand; PAM type: NRG; PAM sequence: GAG
tgaactgatggctcttctca

SEQ ID NO: 26027 - DNA, 20 bp, Artificial Sequence
  Description of Artificial Sequence: Synthetic oligonucleotide
  Target: SCN9A; (-) strand; PAM type: NRG; PAM sequence: CAG
actgaactgatggctcttct

SEQ ID NO: 26028 - DNA, 20 bp, Artificial Sequence
  Description of Artificial Sequence: Synthetic oligonucleotide
  Target: SCN9A; (-) strand; PAM type: NRG; PAM sequence: TGG
gaatgcaggcactgaactga

SEQ ID NO: 26029 - DNA, 20 bp, Artificial Sequence
  Description of Artificial Sequence: Synthetic oligonucleotide
  Target: SCN9A; (-) strand; PAM type: NRG; PAM sequence: AGG
ttcactgtttctaagaatgc

SEQ ID NO: 26030 - DNA, 20 bp, Artificial Sequence
  Description of Artificial Sequence: Synthetic oligonucleotide
  Target: SCN9A; (-) strand; PAM type: NRG; PAM sequence: CAG
tttcactgtttctaagaatg

SEQ ID NO: 26031 - DNA, 20 bp, Artificial Sequence
  Description of Artificial Sequence: Synthetic oligonucleotide
  Target: SCN9A; (-) strand; PAM type: NRG; PAM sequence: AAG
atactcttttcactgtttct

SEQ ID NO: 26032 - DNA, 20 bp, Artificial Sequence
  Description of Artificial Sequence: Synthetic oligonucleotide
  Target: SCN9A; (-) strand; PAM type: NRG; PAM sequence: GAG
gttatctcaaaggtacccat

SEQ ID NO: 26033 - DNA, 20 bp, Artificial Sequence
  Description of Artificial Sequence: Synthetic oligonucleotide
  Target: SCN9A; (-) strand; PAM type: NRG; PAM sequence: AGG
aagacatgctgttatctcaa

SEQ ID NO: 26034 - DNA, 20 bp, Artificial Sequence
  Description of Artificial Sequence: Synthetic oligonucleotide
  Target: SCN9A; (-) strand; PAM type: NRG; PAM sequence: AAG
aaagacatgctgttatctca

SEQ ID NO: 26035 - DNA, 20 bp, Artificial Sequence
  Description of Artificial Sequence: Synthetic oligonucleotide
  Target: SCN9A; (-) strand; PAM type: NRG; PAM sequence: AAG
agtcagtgtcagaatcaaga

SEQ ID NO: 26036 - DNA, 20 bp, Artificial Sequence
  Description of Artificial Sequence: Synthetic oligonucleotide
  Target: SCN9A; (-) strand; PAM type: NRG; PAM sequence: AAG
agatagtcagtgtcagaatc

SEQ ID NO: 26037 - DNA, 20 bp, Artificial Sequence
  Description of Artificial Sequence: Synthetic oligonucleotide
  Target: SCN9A; (-) strand; PAM type: NRG; PAM sequence: CAG
tctgaagagatagtcagtgt

SEQ ID NO: 26038 - DNA, 20 bp, Artificial Sequence
  Description of Artificial Sequence: Synthetic oligonucleotide
  Target: SCN9A; (-) strand; PAM type: NRG; PAM sequence: CAG
cacttctctgaagagatagt

SEQ ID NO: 26039 - DNA, 20 bp, Artificial Sequence
  Description of Artificial Sequence: Synthetic oligonucleotide
  Target: SCN9A; (-) strand; PAM type: NRG; PAM sequence: TAG
atagcacttctctgaagaga

SEQ ID NO: 26040 - DNA, 20 bp, Artificial Sequence
  Description of Artificial Sequence: Synthetic oligonucleotide
  Target: SCN9A; (-) strand; PAM type: NRG; PAM sequence: GAG
aacaatagcacttctctgaa

SEQ ID NO: 26041 - DNA, 20 bp, Artificial Sequence
  Description of Artificial Sequence: Synthetic oligonucleotide
  Target: SCN9A; (-) strand; PAM type: NRG; PAM sequence: AAG
agaacaatagcacttctctg

SEQ ID NO: 26042 - DNA, 20 bp, Artificial Sequence
  Description of Artificial Sequence: Synthetic oligonucleotide
  Target: SCN9A; (-) strand; PAM type: NRG; PAM sequence: TAG
aacaaatggaaatagaacaa

SEQ ID NO: 26043 - DNA, 20 bp, Artificial Sequence
  Description of Artificial Sequence: Synthetic oligonucleotide
  Target: SCN9A; (-) strand; PAM type: NRG; PAM sequence: TAG
tctgaggaaacaaatggaaa

SEQ ID NO: 26044 - DNA, 20 bp, Artificial Sequence
  Description of Artificial Sequence: Synthetic oligonucleotide
  Target: SCN9A; (-) strand; PAM type: NRG; PAM sequence: TGG
aacagttctgaggaaacaaa

SEQ ID NO: 26045 - DNA, 20 bp, Artificial Sequence
  Description of Artificial Sequence: Synthetic oligonucleotide
  Target: SCN9A; (-) strand; PAM type: NRG; PAM sequence: AGG
aaatatcttaaacagttctg

SEQ ID NO: 26046 - DNA, 20 bp, Artificial Sequence
  Description of Artificial Sequence: Synthetic oligonucleotide
  Target: SCN9A; (-) strand; PAM type: NRG; PAM sequence: GAG
caaatatcttaaacagttct

SEQ ID NO: 26047 - DNA, 20 bp, Artificial Sequence
  Description of Artificial Sequence: Synthetic oligonucleotide
  Target: SCN9A; (-) strand; PAM type: NRG; PAM sequence: CAG
gtttagtcaaatatcttaaa

SEQ ID NO: 26048 - DNA, 20 bp, Artificial Sequence
  Description of Artificial Sequence: Synthetic oligonucleotide
  Target: SCN9A; (-) strand; PAM type: NRG; PAM sequence: TAG
atgagttaaaacaaacggtt

SEQ ID NO: 26049 - DNA, 20 bp, Artificial Sequence
  Description of Artificial Sequence: Synthetic oligonucleotide
  Target: SCN9A; (-) strand; PAM type: NRG; PAM sequence: CGG
aagagatgagttaaaacaaa

SEQ ID NO: 26050 - DNA, 20 bp, Artificial Sequence
  Description of Artificial Sequence: Synthetic oligonucleotide
  Target: SCN9A; (-) strand; PAM type: NRG; PAM sequence: GAG
cagaaaataaccaaagagat

SEQ ID NO: 26051 - DNA, 20 bp, Artificial Sequence
  Description of Artificial Sequence: Synthetic oligonucleotide
  Target: SCN9A; (-) strand; PAM type: NRG; PAM sequence: GAG
cttatcagaaaataaccaaa

SEQ ID NO: 26052 - DNA, 20 bp, Artificial Sequence
  Description of Artificial Sequence: Synthetic oligonucleotide
  Target: SCN9A; (-) strand; PAM type: NRG; PAM sequence: AAG
ctcttatcagaaaataacca

SEQ ID NO: 26053 - DNA, 20 bp, Artificial Sequence
  Description of Artificial Sequence: Synthetic oligonucleotide
  Target: SCN9A; (-) strand; PAM type: NRG; PAM sequence: CAG
tttacagtaaaacctcttat

SEQ ID NO: 26054 - DNA, 20 bp, Artificial Sequence
  Description of Artificial Sequence: Synthetic oligonucleotide
  Target: SCN9A; (-) strand; PAM type: NRG; PAM sequence: CAG
aatcaaatcaaaatatttta

SEQ ID NO: 26055 - DNA, 20 bp, Artificial Sequence
  Description of Artificial Sequence: Synthetic oligonucleotide
  Target: SCN9A; (-) strand; PAM type: NRG; PAM sequence: CAG
agacagttaaaaatacactc

SEQ ID NO: 26056 - DNA, 20 bp, Artificial Sequence
  Description of Artificial Sequence: Synthetic oligonucleotide
  Target: SCN9A; (-) strand; PAM type: NRG; PAM sequence: CAG
gatttcctcaacctgataga

SEQ ID NO: 26057 - DNA, 20 bp, Artificial Sequence
  Description of Artificial Sequence: Synthetic oligonucleotide
  Target: SCN9A; (-) strand; PAM type: NRG; PAM sequence: TAG
gacagatttcctcaacctga

SEQ ID NO: 26058 - DNA, 20 bp, Artificial Sequence
  Description of Artificial Sequence: Synthetic oligonucleotide
  Target: SCN9A; (-) strand; PAM type: NRG; PAM sequence: CAG
agtataagttttcaggttga

SEQ ID NO: 26059 - DNA, 20 bp, Artificial Sequence
  Description of Artificial Sequence: Synthetic oligonucleotide
  Target: SCN9A; (-) strand; PAM type: NRG; PAM sequence: AGG
ctctcctagtataagttttc

SEQ ID NO: 26060 - DNA, 20 bp, Artificial Sequence
  Description of Artificial Sequence: Synthetic oligonucleotide
  Target: SCN9A; (-) strand; PAM type: NRG; PAM sequence: CAG
gctctcctagtataagtttt

SEQ ID NO: 26061 - DNA, 20 bp, Artificial Sequence
  Description of Artificial Sequence: Synthetic oligonucleotide
  Target: SCN9A; (-) strand; PAM type: NRG; PAM sequence: AAG
tttcagtgctctcctagtat

SEQ ID NO: 26062 - DNA, 20 bp, Artificial Sequence
  Description of Artificial Sequence: Synthetic oligonucleotide
  Target: SCN9A; (-) strand; PAM type: NRG; PAM sequence: TAG
gagaattttcagtgctctcc

SEQ ID NO: 26063 - DNA, 20 bp, Artificial Sequence
  Description of Artificial Sequence: Synthetic oligonucleotide
  Target: SCN9A; (-) strand; PAM type: NRG; PAM sequence: CAG
cagagtttatggagaatttt

SEQ ID NO: 26064 - DNA, 20 bp, Artificial Sequence
  Description of Artificial Sequence: Synthetic oligonucleotide
  Target: SCN9A; (-) strand; PAM type: NRG; PAM sequence: GAG
gtttctcaacagagtttatg

SEQ ID NO: 26065 - DNA, 20 bp, Artificial Sequence
  Description of Artificial Sequence: Synthetic oligonucleotide
  Target: SCN9A; (-) strand; PAM type: NRG; PAM sequence: TGG
tggtttctcaacagagttta

SEQ ID NO: 26066 - DNA, 20 bp, Artificial Sequence
  Description of Artificial Sequence: Synthetic oligonucleotide
  Target: SCN9A; (-) strand; PAM type: NRG; PAM sequence: GAG
agcatcctggtttctcaaca

SEQ ID NO: 26067 - DNA, 20 bp, Artificial Sequence
  Description of Artificial Sequence: Synthetic oligonucleotide
  Target: SCN9A; (-) strand; PAM type: NRG; PAM sequence: CAG
ctagcatcctggtttctcaa

SEQ ID NO: 26068 - DNA, 20 bp, Artificial Sequence
  Description of Artificial Sequence: Synthetic oligonucleotide
  Target: SCN9A; (-) strand; PAM type: NRG; PAM sequence: TGG
tcttttatgacctagcatcc

SEQ ID NO: 26069 - DNA, 20 bp, Artificial Sequence
  Description of Artificial Sequence: Synthetic oligonucleotide
  Target: SCN9A; (-) strand; PAM type: NRG; PAM sequence: TAG
aaaccctctcttttatgacc

SEQ ID NO: 26070 - DNA, 20 bp, Artificial Sequence
  Description of Artificial Sequence: Synthetic oligonucleotide
  Target: SCN9A; (-) strand; PAM type: NRG; PAM sequence: GGG
gaacctgcattttgagcaag

SEQ ID NO: 26071 - DNA, 20 bp, Artificial Sequence
  Description of Artificial Sequence: Synthetic oligonucleotide
  Target: SCN9A; (-) strand; PAM type: NRG; PAM sequence: GGG
agaacctgcattttgagcaa

SEQ ID NO: 26072 - DNA, 20 bp, Artificial Sequence
  Description of Artificial Sequence: Synthetic oligonucleotide
  Target: SCN9A; (-) strand; PAM type: NRG; PAM sequence: AGG
aagaacctgcattttgagca

SEQ ID NO: 26073 - DNA, 20 bp, Artificial Sequence
  Description of Artificial Sequence: Synthetic oligonucleotide
  Target: SCN9A; (-) strand; PAM type: NRG; PAM sequence: AAG
taagaacctgcattttgagc

SEQ ID NO: 26074 - DNA, 20 bp, Artificial Sequence
  Description of Artificial Sequence: Synthetic oligonucleotide
  Target: SCN9A; (-) strand; PAM type: NRG; PAM sequence: GAG
tgtttaagaacctgcatttt

SEQ ID NO: 26075 - DNA, 20 bp, Artificial Sequence
  Description of Artificial Sequence: Synthetic oligonucleotide
  Target: SCN9A; (-) strand; PAM type: NRG; PAM sequence: AAG
atttccccttttgcttgttt

SEQ ID NO: 26076 - DNA, 20 bp, Artificial Sequence
  Description of Artificial Sequence: Synthetic oligonucleotide
  Target: SCN9A; (-) strand; PAM type: NRG; PAM sequence: GGG
tttctttattcaggggctat

SEQ ID NO: 26077 - DNA, 20 bp, Artificial Sequence
  Description of Artificial Sequence: Synthetic oligonucleotide
  Target: SCN9A; (-) strand; PAM type: NRG; PAM sequence: TGG
ttttctttattcaggggcta

SEQ ID NO: 26078 - DNA, 20 bp, Artificial Sequence
  Description of Artificial Sequence: Synthetic oligonucleotide
  Target: SCN9A; (-) strand; PAM type: NRG; PAM sequence: GGG
atattattttctttattcag

SEQ ID NO: 26079 - DNA, 20 bp, Artificial Sequence
  Description of Artificial Sequence: Synthetic oligonucleotide
  Target: SCN9A; (-) strand; PAM type: NRG; PAM sequence: GGG
gatattattttctttattca

SEQ ID NO: 26080 - DNA, 20 bp, Artificial Sequence
  Description of Artificial Sequence: Synthetic oligonucleotide
  Target: SCN9A; (-) strand; PAM type: NRG; PAM sequence: AGG
agatattattttctttattc

SEQ ID NO: 26081 - DNA, 20 bp, Artificial Sequence
  Description of Artificial Sequence: Synthetic oligonucleotide
  Target: SCN9A; (-) strand; PAM type: NRG; PAM sequence: CAG
gagatattattttctttatt

SEQ ID NO: 26082 - DNA, 20 bp, Artificial Sequence
  Description of Artificial Sequence: Synthetic oligonucleotide
  Target: SCN9A; (-) strand; PAM type: NRG; PAM sequence: GAG
ttacttggattcaggtttct

SEQ ID NO: 26083 - DNA, 20 bp, Artificial Sequence
  Description of Artificial Sequence: Synthetic oligonucleotide
  Target: SCN9A; (-) strand; PAM type: NRG; PAM sequence: AGG
tccctagcttacttggattc

SEQ ID NO: 26084 - DNA, 20 bp, Artificial Sequence
  Description of Artificial Sequence: Synthetic oligonucleotide
  Target: SCN9A; (-) strand; PAM type: NRG; PAM sequence: CAG
atccctagcttacttggatt

SEQ ID NO: 26085 - DNA, 20 bp, Artificial Sequence
  Description of Artificial Sequence: Synthetic oligonucleotide
  Target: SCN9A; (-) strand; PAM type: NRG; PAM sequence: TGG
aacttaatccctagcttact

SEQ ID NO: 26086 - DNA, 20 bp, Artificial Sequence
  Description of Artificial Sequence: Synthetic oligonucleotide
  Target: SCN9A; (-) strand; PAM type: NRG; PAM sequence: TAG
aatgatgccaacttaatccc

SEQ ID NO: 26087 - DNA, 20 bp, Artificial Sequence
  Description of Artificial Sequence: Synthetic oligonucleotide
  Target: SCN9A; (-) strand; PAM type: NRG; PAM sequence: TAG
gttcaaagctatggatctgc

SEQ ID NO: 26088 - DNA, 20 bp, Artificial Sequence
  Description of Artificial Sequence: Synthetic oligonucleotide
  Target: SCN9A; (-) strand; PAM type: NRG; PAM sequence: TGG
atggtaaatgttcaaagcta

SEQ ID NO: 26089 - DNA, 20 bp, Artificial Sequence
  Description of Artificial Sequence: Synthetic oligonucleotide
  Target: SCN9A; (-) strand; PAM type: NRG; PAM sequence: AAG
aaagaaatggtaaatgttca

SEQ ID NO: 26090 - DNA, 20 bp, Artificial Sequence
  Description of Artificial Sequence: Synthetic oligonucleotide
  Target: SCN9A; (-) strand; PAM type: NRG; PAM sequence: TGG
atggtctcctcacaaagaaa

SEQ ID NO: 26091 - DNA, 20 bp, Artificial Sequence
  Description of Artificial Sequence: Synthetic oligonucleotide
  Target: SCN9A; (-) strand; PAM type: NRG; PAM sequence: AAG
ttttaaatggtctcctcaca

SEQ ID NO: 26092 - DNA, 20 bp, Artificial Sequence
  Description of Artificial Sequence: Synthetic oligonucleotide
  Target: SCN9A; (-) strand; PAM type: NRG; PAM sequence: TGG
aatagctagaagtttttaaa

SEQ ID NO: 26093 - DNA, 20 bp, Artificial Sequence
  Description of Artificial Sequence: Synthetic oligonucleotide
  Target: SCN9A; (-) strand; PAM type: NRG; PAM sequence: AAG
gtatatttcaaaatagctag

SEQ ID NO: 26094 - DNA, 20 bp, Artificial Sequence
  Description of Artificial Sequence: Synthetic oligonucleotide
  Target: SCN9A; (-) strand; PAM type: NRG; PAM sequence: TAG
gttgtatatttcaaaatagc

SEQ ID NO: 26095 - DNA, 20 bp, Artificial Sequence
  Description of Artificial Sequence: Synthetic oligonucleotide
  Target: SCN9A; (-) strand; PAM type: NRG; PAM sequence: TAG
atgtgttgtatatttcaaaa

SEQ ID NO: 26096 - DNA, 20 bp, Artificial Sequence
  Description of Artificial Sequence: Synthetic oligonucleotide
  Target: SCN9A; (-) strand; PAM type: NRG; PAM sequence: GAG
attgaatcgttggatgacta

SEQ ID NO: 26097 - DNA, 20 bp, Artificial Sequence
  Description of Artificial Sequence: Synthetic oligonucleotide
  Target: SCN9A; (-) strand; PAM type: NRG; PAM sequence: TAG
ctattgaatcgttggatgac

SEQ ID NO: 26098 - DNA, 20 bp, Artificial Sequence
  Description of Artificial Sequence: Synthetic oligonucleotide
  Target: SCN9A; (-) strand; PAM type: NRG; PAM sequence: TGG
ctggtgttctattgaatcgt

SEQ ID NO: 26099 - DNA, 20 bp, Artificial Sequence
  Description of Artificial Sequence: Synthetic oligonucleotide
  Target: SCN9A; (-) strand; PAM type: NRG; PAM sequence: TGG
gagatagaaagaataagttc

SEQ ID NO: 26100 - DNA, 20 bp, Artificial Sequence
  Description of Artificial Sequence: Synthetic oligonucleotide
  Target: SCN9A; (-) strand; PAM type: NRG; PAM sequence: AAG
tacagtgagatagaaagaat

SEQ ID NO: 26101 - DNA, 20 bp, Artificial Sequence
  Description of Artificial Sequence: Synthetic oligonucleotide
  Target: SCN9A; (-) strand; PAM type: NRG; PAM sequence: AAG
caaagctacagtgagataga

SEQ ID NO: 26102 - DNA, 20 bp, Artificial Sequence
  Description of Artificial Sequence: Synthetic oligonucleotide
  Target: SCN9A; (-) strand; PAM type: NRG; PAM sequence: TAG
ggtacaaagctacagtgaga

SEQ ID NO: 26103 - DNA, 20 bp, Artificial Sequence
  Description of Artificial Sequence: Synthetic oligonucleotide
  Target: SCN9A; (-) strand; PAM type: NRG; PAM sequence: GAG
aacaggtacaaagctacagt

SEQ ID NO: 26104 - DNA, 20 bp, Artificial Sequence
  Description of Artificial Sequence: Synthetic oligonucleotide
  Target: SCN9A; (-) strand; PAM type: NRG; PAM sequence: CAG
ggtcaacaggtacaaagcta

SEQ ID NO: 26105 - DNA, 20 bp, Artificial Sequence
  Description of Artificial Sequence: Synthetic oligonucleotide
  Target: SCN9A; (-) strand; PAM type: NRG; PAM sequence: AAG
aagattggtcaacaggtaca

SEQ ID NO: 26106 - DNA, 20 bp, Artificial Sequence
  Description of Artificial Sequence: Synthetic oligonucleotide
  Target: SCN9A; (-) strand; PAM type: NRG; PAM sequence: AGG
gtggggaaagattggtcaac

SEQ ID NO: 26107 - DNA, 20 bp, Artificial Sequence
  Description of Artificial Sequence: Synthetic oligonucleotide
  Target: SCN9A; (-) strand; PAM type: NRG; PAM sequence: CAG
tgtggggaaagattggtcaa

SEQ ID NO: 26108 - DNA, 20 bp, Artificial Sequence
  Description of Artificial Sequence: Synthetic oligonucleotide
  Target: SCN9A; (-) strand; PAM type: NRG; PAM sequence: TGG
agcgaggtgtggggaaagat

SEQ ID NO: 26109 - DNA, 20 bp, Artificial Sequence
  Description of Artificial Sequence: Synthetic oligonucleotide
  Target: SCN9A; (-) strand; PAM type: NRG; PAM sequence: AAG
ggaggagcgaggtgtgggga

SEQ ID NO: 26110 - DNA, 20 bp, Artificial Sequence
  Description of Artificial Sequence: Synthetic oligonucleotide
  Target: SCN9A; (-) strand; PAM type: NRG; PAM sequence: GGG
gcttggaggagcgaggtgtg

SEQ ID NO: 26111 - DNA, 20 bp, Artificial Sequence
  Description of Artificial Sequence: Synthetic oligonucleotide
  Target: SCN9A; (-) strand; PAM type: NRG; PAM sequence: GGG
ggcttggaggagcgaggtgt

SEQ ID NO: 26112 - DNA, 20 bp, Artificial Sequence
  Description of Artificial Sequence: Synthetic oligonucleotide
  Target: SCN9A; (-) strand; PAM type: NRG; PAM sequence: TGG
aggcttggaggagcgaggtg

SEQ ID NO: 26113 - DNA, 20 bp, Artificial Sequence
  Description of Artificial Sequence: Synthetic oligonucleotide
  Target: SCN9A; (-) strand; PAM type: NRG; PAM sequence: AGG
atgggaggcttggaggagcg

SEQ ID NO: 26114 - DNA, 20 bp, Artificial Sequence
  Description of Artificial Sequence: Synthetic oligonucleotide
  Target: SCN9A; (-) strand; PAM type: NRG; PAM sequence: GAG
gatgggaggcttggaggagc

SEQ ID NO: 26115 - DNA, 20 bp, Artificial Sequence
  Description of Artificial Sequence: Synthetic oligonucleotide
  Target: SCN9A; (-) strand; PAM type: NRG; PAM sequence: GAG
ggaggatgggaggcttggag

SEQ ID NO: 26116 - DNA, 20 bp, Artificial Sequence
  Description of Artificial Sequence: Synthetic oligonucleotide
  Target: SCN9A; (-) strand; PAM type: NRG; PAM sequence: AGG
tcggaggatgggaggcttgg

SEQ ID NO: 26117 - DNA, 20 bp, Artificial Sequence
  Description of Artificial Sequence: Synthetic oligonucleotide
  Target: SCN9A; (-) strand; PAM type: NRG; PAM sequence: GAG
atcggaggatgggaggcttg

SEQ ID NO: 26118 - DNA, 20 bp, Artificial Sequence
  Description of Artificial Sequence: Synthetic oligonucleotide
  Target: SCN9A; (-) strand; PAM type: NRG; PAM sequence: TGG
ttatcggaggatgggaggct

SEQ ID NO: 26119 - DNA, 20 bp, Artificial Sequence
  Description of Artificial Sequence: Synthetic oligonucleotide
  Target: SCN9A; (-) strand; PAM type: NRG; PAM sequence: AGG
agtggttatcggaggatggg

SEQ ID NO: 26120 - DNA, 20 bp, Artificial Sequence
  Description of Artificial Sequence: Synthetic oligonucleotide
  Target: SCN9A; (-) strand; PAM type: NRG; PAM sequence: GAG
tagtggttatcggaggatgg

SEQ ID NO: 26121 - DNA, 20 bp, Artificial Sequence
  Description of Artificial Sequence: Synthetic oligonucleotide
  Target: SCN9A; (-) strand; PAM type: NRG; PAM sequence: GGG
aatagtggttatcggaggat

SEQ ID NO: 26122 - DNA, 20 bp, Artificial Sequence
  Description of Artificial Sequence: Synthetic oligonucleotide
  Target: SCN9A; (-) strand; PAM type: NRG; PAM sequence: TGG
gaatagtggttatcggagga

SEQ ID NO: 26123 - DNA, 20 bp, Artificial Sequence
  Description of Artificial Sequence: Synthetic oligonucleotide
  Target: SCN9A; (-) strand; PAM type: NRG; PAM sequence: AGG
agtagaatagtggttatcgg

SEQ ID NO: 26124 - DNA, 20 bp, Artificial Sequence
  Description of Artificial Sequence: Synthetic oligonucleotide
  Target: SCN9A; (-) strand; PAM type: NRG; PAM sequence: GAG
tagtagaatagtggttatcg

SEQ ID NO: 26125 - DNA, 20 bp, Artificial Sequence
  Description of Artificial Sequence: Synthetic oligonucleotide
  Target: SCN9A; (-) strand; PAM type: NRG; PAM sequence: CGG
gatagtagaatagtggttat

SEQ ID NO: 26126 - DNA, 20 bp, Artificial Sequence
  Description of Artificial Sequence: Synthetic oligonucleotide
  Target: SCN9A; (-) strand; PAM type: NRG; PAM sequence: TGG
agaagtagatagtagaatag

SEQ ID NO: 26127 - DNA, 20 bp, Artificial Sequence
  Description of Artificial Sequence: Synthetic oligonucleotide
  Target: SCN9A; (-) strand; PAM type: NRG; PAM sequence: TAG
catagaagtagatagtagaa

SEQ ID NO: 26128 - DNA, 20 bp, Artificial Sequence
  Description of Artificial Sequence: Synthetic oligonucleotide
  Target: SCN9A; (-) strand; PAM type: NRG; PAM sequence: TAG
gttgtcatagaagtagatag

SEQ ID NO: 26129 - DNA, 20 bp, Artificial Sequence
  Description of Artificial Sequence: Synthetic oligonucleotide
  Target: SCN9A; (-) strand; PAM type: NRG; PAM sequence: TAG
agggttgtcatagaagtaga

SEQ ID NO: 26130 - DNA, 20 bp, Artificial Sequence
  Description of Artificial Sequence: Synthetic oligonucleotide
  Target: SCN9A; (-) strand; PAM type: NRG; PAM sequence: TAG
ctaaagggttgtcatagaag

SEQ ID NO: 26131 - DNA, 20 bp, Artificial Sequence
  Description of Artificial Sequence: Synthetic oligonucleotide
  Target: SCN9A; (-) strand; PAM type: NRG; PAM sequence: AAG
aatctaaagggttgtcatag

SEQ ID NO: 26132 - DNA, 20 bp, Artificial Sequence
  Description of Artificial Sequence: Synthetic oligonucleotide
  Target: SCN9A; (-) strand; PAM type: NRG; PAM sequence: TAG
tggaatctaaagggttgtca

SEQ ID NO: 26133 - DNA, 20 bp, Artificial Sequence
  Description of Artificial Sequence: Synthetic oligonucleotide
  Target: SCN9A; (-) strand; PAM type: NRG; PAM sequence: GGG
acacatatgtggaatctaaa

SEQ ID NO: 26134 - DNA, 20 bp, Artificial Sequence
  Description of Artificial Sequence: Synthetic oligonucleotide
  Target: SCN9A; (-) strand; PAM type: NRG; PAM sequence: AGG
cacacatatgtggaatctaa

SEQ ID NO: 26135 - DNA, 20 bp, Artificial Sequence
  Description of Artificial Sequence: Synthetic oligonucleotide
  Target: SCN9A; (-) strand; PAM type: NRG; PAM sequence: AAG
tcacacatatgtggaatcta

SEQ ID NO: 26136 - DNA, 20 bp, Artificial Sequence
  Description of Artificial Sequence: Synthetic oligonucleotide
  Target: SCN9A; (-) strand; PAM type: NRG; PAM sequence: TGG
tcaaatatctcacacatatg

SEQ ID NO: 26137 - DNA, 20 bp, Artificial Sequence
  Description of Artificial Sequence: Synthetic oligonucleotide
  Target: SCN9A; (-) strand; PAM type: NRG; PAM sequence: AAG
tgaaatcagccaggcacaga

SEQ ID NO: 26138 - DNA, 20 bp, Artificial Sequence
  Description of Artificial Sequence: Synthetic oligonucleotide
  Target: SCN9A; (-) strand; PAM type: NRG; PAM sequence: CAG
taagtgaaatcagccaggca

SEQ ID NO: 26139 - DNA, 20 bp, Artificial Sequence
  Description of Artificial Sequence: Synthetic oligonucleotide
  Target: SCN9A; (-) strand; PAM type: NRG; PAM sequence: AGG
tatgttaagtgaaatcagcc

SEQ ID NO: 26140 - DNA, 20 bp, Artificial Sequence
  Description of Artificial Sequence: Synthetic oligonucleotide
  Target: SCN9A; (-) strand; PAM type: NRG; PAM sequence: CAG
ttatgttaagtgaaatcagc

SEQ ID NO: 26141 - DNA, 20 bp, Artificial Sequence
  Description of Artificial Sequence: Synthetic oligonucleotide
  Target: SCN9A; (-) strand; PAM type: NRG; PAM sequence: CAG
gacattatgttaagtgaaat

SEQ ID NO: 26142 - DNA, 20 bp, Artificial Sequence
  Description of Artificial Sequence: Synthetic oligonucleotide
  Target: SCN9A; (-) strand; PAM type: NRG; PAM sequence: AAG
aacctggaggacattatgtt

SEQ ID NO: 26143 - DNA, 20 bp, Artificial Sequence
  Description of Artificial Sequence: Synthetic oligonucleotide
  Target: SCN9A; (-) strand; PAM type: NRG; PAM sequence: AGG
ggcaacatgaatgaacctgg

SEQ ID NO: 26144 - DNA, 20 bp, Artificial Sequence
  Description of Artificial Sequence: Synthetic oligonucleotide
  Target: SCN9A; (-) strand; PAM type: NRG; PAM sequence: GAG
tggcaacatgaatgaacctg

SEQ ID NO: 26145 - DNA, 20 bp, Artificial Sequence
  Description of Artificial Sequence: Synthetic oligonucleotide
  Target: SCN9A; (-) strand; PAM type: NRG; PAM sequence: TGG
tgtggcaacatgaatgaacc

SEQ ID NO: 26146 - DNA, 20 bp, Artificial Sequence
  Description of Artificial Sequence: Synthetic oligonucleotide
  Target: SCN9A; (-) strand; PAM type: NRG; PAM sequence: TGG
taatgaaatcctgttatttg

SEQ ID NO: 26147 - DNA, 20 bp, Artificial Sequence
  Description of Artificial Sequence: Synthetic oligonucleotide
  Target: SCN9A; (-) strand; PAM type: NRG; PAM sequence: AAG
attgaacgccattcagccat

SEQ ID NO: 26148 - DNA, 20 bp, Artificial Sequence
  Description of Artificial Sequence: Synthetic oligonucleotide
  Target: SCN9A; (-) strand; PAM type: NRG; PAM sequence: CAG
aagaaaaattgaacgccatt

SEQ ID NO: 26149 - DNA, 20 bp, Artificial Sequence
  Description of Artificial Sequence: Synthetic oligonucleotide
  Target: SCN9A; (-) strand; PAM type: NRG; PAM sequence: AAG
tgcataaagaaaatgtacat

SEQ ID NO: 26150 - DNA, 20 bp, Artificial Sequence
  Description of Artificial Sequence: Synthetic oligonucleotide
  Target: SCN9A; (-) strand; PAM type: NRG; PAM sequence: AAG
cgtaaataaataaatgcata

SEQ ID NO: 26151 - DNA, 20 bp, Artificial Sequence
  Description of Artificial Sequence: Synthetic oligonucleotide
  Target: SCN9A; (-) strand; PAM type: NRG; PAM sequence: AAG
ctgcactgttcacaatagcc

SEQ ID NO: 26152 - DNA, 20 bp, Artificial Sequence
  Description of Artificial Sequence: Synthetic oligonucleotide
  Target: SCN9A; (-) strand; PAM type: NRG; PAM sequence: TAG
tattgctgcactgttcacaa

SEQ ID NO: 26153 - DNA, 20 bp, Artificial Sequence
  Description of Artificial Sequence: Synthetic oligonucleotide
  Target: SCN9A; (-) strand; PAM type: NRG; PAM sequence: TAG
ttgaagagatacagtaaaca

SEQ ID NO: 26154 - DNA, 20 bp, Artificial Sequence
  Description of Artificial Sequence: Synthetic oligonucleotide
  Target: SCN9A; (-) strand; PAM type: NRG; PAM sequence: CAG
atcagtatgttgaagagata

SEQ ID NO: 26155 - DNA, 20 bp, Artificial Sequence
  Description of Artificial Sequence: Synthetic oligonucleotide
  Target: SCN9A; (-) strand; PAM type: NRG; PAM sequence: GAG
aatgaaatcagtatgttgaa

SEQ ID NO: 26156 - DNA, 20 bp, Artificial Sequence
  Description of Artificial Sequence: Synthetic oligonucleotide
  Target: SCN9A; (-) strand; PAM type: NRG; PAM sequence: AAG
gaaatgaaatcagtatgttg

SEQ ID NO: 26157 - DNA, 20 bp, Artificial Sequence
  Description of Artificial Sequence: Synthetic oligonucleotide
  Target: SCN9A; (-) strand; PAM type: NRG; PAM sequence: CAG
atatccagatgaaatgaaat

SEQ ID NO: 26158 - DNA, 20 bp, Artificial Sequence
  Description of Artificial Sequence: Synthetic oligonucleotide
  Target: SCN9A; (-) strand; PAM type: NRG; PAM sequence: CAG
cccaatactaagtaaatatc

SEQ ID NO: 26159 - DNA, 20 bp, Artificial Sequence
  Description of Artificial Sequence: Synthetic oligonucleotide
  Target: SCN9A; (-) strand; PAM type: NRG; PAM sequence: AAG
gatccagcagtcccaatact

SEQ ID NO: 26160 - DNA, 20 bp, Artificial Sequence
  Description of Artificial Sequence: Synthetic oligonucleotide
  Target: SCN9A; (-) strand; PAM type: NRG; PAM sequence: CAG
agaattttcatatgatccag

SEQ ID NO: 26161 - DNA, 20 bp, Artificial Sequence
  Description of Artificial Sequence: Synthetic oligonucleotide
  Target: SCN9A; (-) strand; PAM type: NRG; PAM sequence: CAG
aatagaattttcatatgatc

SEQ ID NO: 26162 - DNA, 20 bp, Artificial Sequence
  Description of Artificial Sequence: Synthetic oligonucleotide
  Target: SCN9A; (-) strand; PAM type: NRG; PAM sequence: TAG
gttctttaaaaaattaaaaa

SEQ ID NO: 26163 - DNA, 20 bp, Artificial Sequence
  Description of Artificial Sequence: Synthetic oligonucleotide
  Target: SCN9A; (-) strand; PAM type: NRG; PAM sequence: GGG
cattatggaaagtaatatgg

SEQ ID NO: 26164 - DNA, 20 bp, Artificial Sequence
  Description of Artificial Sequence: Synthetic oligonucleotide
  Target: SCN9A; (-) strand; PAM type: NRG; PAM sequence: GGG
ccattatggaaagtaatatg

SEQ ID NO: 26165 - DNA, 20 bp, Artificial Sequence
  Description of Artificial Sequence: Synthetic oligonucleotide
  Target: SCN9A; (-) strand; PAM type: NRG; PAM sequence: GGG
accattatggaaagtaatat

SEQ ID NO: 26166 - DNA, 20 bp, Artificial Sequence
  Description of Artificial Sequence: Synthetic oligonucleotide
  Target: SCN9A; (-) strand; PAM type: NRG; PAM sequence: TGG
caccattatggaaagtaata

SEQ ID NO: 26167 - DNA, 20 bp, Artificial Sequence
  Description of Artificial Sequence: Synthetic oligonucleotide
  Target: SCN9A; (-) strand; PAM type: NRG; PAM sequence: AAG
attagtaccaccattatgga

SEQ ID NO: 26168 - DNA, 20 bp, Artificial Sequence
  Description of Artificial Sequence: Synthetic oligonucleotide
  Target: SCN9A; (-) strand; PAM type: NRG; PAM sequence: TGG
gtaaattagtaccaccatta

SEQ ID NO: 26169 - DNA, 20 bp, Artificial Sequence
  Description of Artificial Sequence: Synthetic oligonucleotide
  Target: SCN9A; (-) strand; PAM type: NRG; PAM sequence: TAG
ctgattgtgagaatgtaaat

SEQ ID NO: 26170 - DNA, 20 bp, Artificial Sequence
  Description of Artificial Sequence: Synthetic oligonucleotide
  Target: SCN9A; (-) strand; PAM type: NRG; PAM sequence: GAG
aatccttacacactgattgt

SEQ ID NO: 26171 - DNA, 20 bp, Artificial Sequence
  Description of Artificial Sequence: Synthetic oligonucleotide
  Target: SCN9A; (-) strand; PAM type: NRG; PAM sequence: GGG
tttaaaggatatggagaaaa

SEQ ID NO: 26172 - DNA, 20 bp, Artificial Sequence
  Description of Artificial Sequence: Synthetic oligonucleotide
  Target: SCN9A; (-) strand; PAM type: NRG; PAM sequence: AGG
gtttaaaggatatggagaaa

SEQ ID NO: 26173 - DNA, 20 bp, Artificial Sequence
  Description of Artificial Sequence: Synthetic oligonucleotide
  Target: SCN9A; (-) strand; PAM type: NRG; PAM sequence: AAG
tgtttaaaggatatggagaa

SEQ ID NO: 26174 - DNA, 20 bp, Artificial Sequence
  Description of Artificial Sequence: Synthetic oligonucleotide
  Target: SCN9A; (-) strand; PAM type: NRG; PAM sequence: GAG
ataagtgtttaaaggatatg

SEQ ID NO: 26175 - DNA, 20 bp, Artificial Sequence
  Description of Artificial Sequence: Synthetic oligonucleotide
  Target: SCN9A; (-) strand; PAM type: NRG; PAM sequence: TGG
atataagtgtttaaaggata

SEQ ID NO: 26176 - DNA, 20 bp, Artificial Sequence
  Description of Artificial Sequence: Synthetic oligonucleotide
  Target: SCN9A; (-) strand; PAM type: NRG; PAM sequence: AGG
caaaagatataagtgtttaa

SEQ ID NO: 26177 - DNA, 20 bp, Artificial Sequence
  Description of Artificial Sequence: Synthetic oligonucleotide
  Target: SCN9A; (-) strand; PAM type: NRG; PAM sequence: AAG
tcaaaagatataagtgttta

SEQ ID NO: 26178 - DNA, 20 bp, Artificial Sequence
  Description of Artificial Sequence: Synthetic oligonucleotide
  Target: SCN9A; (-) strand; PAM type: NRG; PAM sequence: AAG
atcaaaaaatcaaaagatat

SEQ ID NO: 26179 - DNA, 20 bp, Artificial Sequence
  Description of Artificial Sequence: Synthetic oligonucleotide
  Target: SCN9A; (-) strand; PAM type: NRG; PAM sequence: AAG
ggctaccatcaaaaaatcaa

SEQ ID NO: 26180 - DNA, 20 bp, Artificial Sequence
  Description of Artificial Sequence: Synthetic oligonucleotide
  Target: SCN9A; (-) strand; PAM type: NRG; PAM sequence: TGG
tctcctcaccctagttaaaa

SEQ ID NO: 26181 - DNA, 20 bp, Artificial Sequence
  Description of Artificial Sequence: Synthetic oligonucleotide
  Target: SCN9A; (-) strand; PAM type: NRG; PAM sequence: TAG
cttgaggtatctcctcaccc

SEQ ID NO: 26182 - DNA, 20 bp, Artificial Sequence
  Description of Artificial Sequence: Synthetic oligonucleotide
  Target: SCN9A; (-) strand; PAM type: NRG; PAM sequence: AGG
tgcaaatcaaacctatcttg

SEQ ID NO: 26183 - DNA, 20 bp, Artificial Sequence
  Description of Artificial Sequence: Synthetic oligonucleotide
  Target: SCN9A; (-) strand; PAM type: NRG; PAM sequence: GAG
atgcaaatcaaacctatctt

SEQ ID NO: 26184 - DNA, 20 bp, Artificial Sequence
  Description of Artificial Sequence: Synthetic oligonucleotide
  Target: SCN9A; (-) strand; PAM type: NRG; PAM sequence: GGG
ctcaacatcactaatcacca

SEQ ID NO: 26185 - DNA, 20 bp, Artificial Sequence
  Description of Artificial Sequence: Synthetic oligonucleotide
  Target: SCN9A; (-) strand; PAM type: NRG; PAM sequence: AGG
gctcaacatcactaatcacc

SEQ ID NO: 26186 - DNA, 20 bp, Artificial Sequence
  Description of Artificial Sequence: Synthetic oligonucleotide
  Target: SCN9A; (-) strand; PAM type: NRG; PAM sequence: CAG
tgctcaacatcactaatcac

SEQ ID NO: 26187 - DNA, 20 bp, Artificial Sequence
  Description of Artificial Sequence: Synthetic oligonucleotide
  Target: SCN9A; (-) strand; PAM type: NRG; PAM sequence: CAG
agaagacaaagaaatgccaa

SEQ ID NO: 26188 - DNA, 20 bp, Artificial Sequence
  Description of Artificial Sequence: Synthetic oligonucleotide
  Target: SCN9A; (-) strand; PAM type: NRG; PAM sequence: AAG
atatttctcaaaagaagaca

SEQ ID NO: 26189 - DNA, 20 bp, Artificial Sequence
  Description of Artificial Sequence: Synthetic oligonucleotide
  Target: SCN9A; (-) strand; PAM type: NRG; PAM sequence: AAG
gaatagatatttctcaaaag

SEQ ID NO: 26190 - DNA, 20 bp, Artificial Sequence
  Description of Artificial Sequence: Synthetic oligonucleotide
  Target: SCN9A; (-) strand; PAM type: NRG; PAM sequence: AAG
cctgaatagatatttctcaa

SEQ ID NO: 26191 - DNA, 20 bp, Artificial Sequence
  Description of Artificial Sequence: Synthetic oligonucleotide
  Target: SCN9A; (-) strand; PAM type: NRG; PAM sequence: TAG
aaatggacaaaagacctgaa

SEQ ID NO: 26192 - DNA, 20 bp, Artificial Sequence
  Description of Artificial Sequence: Synthetic oligonucleotide
  Target: SCN9A; (-) strand; PAM type: NRG; PAM sequence: AAG
aataattcaaaaatggacaa

SEQ ID NO: 26193 - DNA, 20 bp, Artificial Sequence
  Description of Artificial Sequence: Synthetic oligonucleotide
  Target: SCN9A; (-) strand; PAM type: NRG; PAM sequence: TGG
aaaaacaaataattcaaaaa

SEQ ID NO: 26194 - DNA, 20 bp, Artificial Sequence
  Description of Artificial Sequence: Synthetic oligonucleotide
  Target: SCN9A; (-) strand; PAM type: NRG; PAM sequence: AGG
gttaatatctaaaacataca

SEQ ID NO: 26195 - DNA, 20 bp, Artificial Sequence
  Description of Artificial Sequence: Synthetic oligonucleotide
  Target: SCN9A; (-) strand; PAM type: NRG; PAM sequence: AAG
ggttaatatctaaaacatac

SEQ ID NO: 26196 - DNA, 20 bp, Artificial Sequence
  Description of Artificial Sequence: Synthetic oligonucleotide
  Target: SCN9A; (-) strand; PAM type: NRG; PAM sequence: GGG
taaactatgcatctgataat

SEQ ID NO: 26197 - DNA, 20 bp, Artificial Sequence
  Description of Artificial Sequence: Synthetic oligonucleotide
  Target: SCN9A; (-) strand; PAM type: NRG; PAM sequence: TGG
gtaaactatgcatctgataa

SEQ ID NO: 26198 - DNA, 20 bp, Artificial Sequence
  Description of Artificial Sequence: Synthetic oligonucleotide
  Target: SCN9A; (-) strand; PAM type: NRG; PAM sequence: GGG
gaagagataacctacagaat

SEQ ID NO: 26199 - DNA, 20 bp, Artificial Sequence
  Description of Artificial Sequence: Synthetic oligonucleotide
  Target: SCN9A; (-) strand; PAM type: NRG; PAM sequence: TGG
tgaagagataacctacagaa

SEQ ID NO: 26200 - DNA, 20 bp, Artificial Sequence
  Description of Artificial Sequence: Synthetic oligonucleotide
  Target: SCN9A; (-) strand; PAM type: NRG; PAM sequence: CAG
tagagtgaagagataaccta

SEQ ID NO: 26201 - DNA, 20 bp, Artificial Sequence
  Description of Artificial Sequence: Synthetic oligonucleotide
  Target: SCN9A; (-) strand; PAM type: NRG; PAM sequence: GAG
caaacaatcaatagagtgaa

SEQ ID NO: 26202 - DNA, 20 bp, Artificial Sequence
  Description of Artificial Sequence: Synthetic oligonucleotide
  Target: SCN9A; (-) strand; PAM type: NRG; PAM sequence: AAG
ggcaaacaatcaatagagtg

SEQ ID NO: 26203 - DNA, 20 bp, Artificial Sequence
  Description of Artificial Sequence: Synthetic oligonucleotide
  Target: SCN9A; (-) strand; PAM type: NRG; PAM sequence: GAG
agcaaggcaaacaatcaata

SEQ ID NO: 26204 - DNA, 20 bp, Artificial Sequence
  Description of Artificial Sequence: Synthetic oligonucleotide
  Target: SCN9A; (-) strand; PAM type: NRG; PAM sequence: TAG
acagcaaggcaaacaatcaa

SEQ ID NO: 26205 - DNA, 20 bp, Artificial Sequence
  Description of Artificial Sequence: Synthetic oligonucleotide
  Target: SCN9A; (-) strand; PAM type: NRG; PAM sequence: AGG
taaaaagcttctgcacagca

SEQ ID NO: 26206 - DNA, 20 bp, Artificial Sequence
  Description of Artificial Sequence: Synthetic oligonucleotide
  Target: SCN9A; (-) strand; PAM type: NRG; PAM sequence: AAG
ctaaaaagcttctgcacagc

SEQ ID NO: 26207 - DNA, 20 bp, Artificial Sequence
  Description of Artificial Sequence: Synthetic oligonucleotide
  Target: SCN9A; (-) strand; PAM type: NRG; PAM sequence: CAG
taaactaaaaagcttctgca

SEQ ID NO: 26208 - DNA, 20 bp, Artificial Sequence
  Description of Artificial Sequence: Synthetic oligonucleotide
  Target: SCN9A; (-) strand; PAM type: NRG; PAM sequence: AAG
ttggattatattaaactaaa

SEQ ID NO: 26209 - DNA, 20 bp, Artificial Sequence
  Description of Artificial Sequence: Synthetic oligonucleotide
  Target: SCN9A; (-) strand; PAM type: NRG; PAM sequence: TGG
aaaagcaaatatagacaaat

SEQ ID NO: 26210 - DNA, 20 bp, Artificial Sequence
  Description of Artificial Sequence: Synthetic oligonucleotide
  Target: SCN9A; (-) strand; PAM type: NRG; PAM sequence: TAG
acaggcaacaaaagcaaata

SEQ ID NO: 26211 - DNA, 20 bp, Artificial Sequence
  Description of Artificial Sequence: Synthetic oligonucleotide
  Target: SCN9A; (-) strand; PAM type: NRG; PAM sequence: AAG
ctaaaaagcacaggcaacaa

SEQ ID NO: 26212 - DNA, 20 bp, Artificial Sequence
  Description of Artificial Sequence: Synthetic oligonucleotide
  Target: SCN9A; (-) strand; PAM type: NRG; PAM sequence: AGG
ggataaaacctaaaaagcac

SEQ ID NO: 26213 - DNA, 20 bp, Artificial Sequence
  Description of Artificial Sequence: Synthetic oligonucleotide
  Target: SCN9A; (-) strand; PAM type: NRG; PAM sequence: CAG
tggataaaacctaaaaagca

SEQ ID NO: 26214 - DNA, 20 bp, Artificial Sequence
  Description of Artificial Sequence: Synthetic oligonucleotide
  Target: SCN9A; (-) strand; PAM type: NRG; PAM sequence: AAG
ttttttggataaaacctaaa

SEQ ID NO: 26215 - DNA, 20 bp, Artificial Sequence
  Description of Artificial Sequence: Synthetic oligonucleotide
  Target: SCN9A; (-) strand; PAM type: NRG; PAM sequence: TGG
gttctaggcaaggatttttt

SEQ ID NO: 26216 - DNA, 20 bp, Artificial Sequence
  Description of Artificial Sequence: Synthetic oligonucleotide
  Target: SCN9A; (-) strand; PAM type: NRG; PAM sequence: AGG
tcatgatgttgttctaggca

SEQ ID NO: 26217 - DNA, 20 bp, Artificial Sequence
  Description of Artificial Sequence: Synthetic oligonucleotide
  Target: SCN9A; (-) strand; PAM type: NRG; PAM sequence: AAG
ttcatgatgttgttctaggc

SEQ ID NO: 26218 - DNA, 20 bp, Artificial Sequence
  Description of Artificial Sequence: Synthetic oligonucleotide
  Target: SCN9A; (-) strand; PAM type: NRG; PAM sequence: AGG
aagcttcatgatgttgttct

SEQ ID NO: 26219 - DNA, 20 bp, Artificial Sequence
  Description of Artificial Sequence: Synthetic oligonucleotide
  Target: SCN9A; (-) strand; PAM type: NRG; PAM sequence: TAG
aaagcttcatgatgttgttc

SEQ ID NO: 26220 - DNA, 20 bp, Artificial Sequence
  Description of Artificial Sequence: Synthetic oligonucleotide
  Target: SCN9A; (-) strand; PAM type: NRG; PAM sequence: AAG
gaagaaaaaaaacaggggga

SEQ ID NO: 26221 - DNA, 20 bp, Artificial Sequence
  Description of Artificial Sequence: Synthetic oligonucleotide
  Target: SCN9A; (-) strand; PAM type: NRG; PAM sequence: GGG
tagagaagaaaaaaaacagg

SEQ ID NO: 26222 - DNA, 20 bp, Artificial Sequence
  Description of Artificial Sequence: Synthetic oligonucleotide
  Target: SCN9A; (-) strand; PAM type: NRG; PAM sequence: GGG
ttagagaagaaaaaaaacag

SEQ ID NO: 26223 - DNA, 20 bp, Artificial Sequence
  Description of Artificial Sequence: Synthetic oligonucleotide
  Target: SCN9A; (-) strand; PAM type: NRG; PAM sequence: GGG
attagagaagaaaaaaaaca

SEQ ID NO: 26224 - DNA, 20 bp, Artificial Sequence
  Description of Artificial Sequence: Synthetic oligonucleotide
  Target: SCN9A; (-) strand; PAM type: NRG; PAM sequence: AGG
tattagagaagaaaaaaaac

SEQ ID NO: 26225 - DNA, 20 bp, Artificial Sequence
  Description of Artificial Sequence: Synthetic oligonucleotide
  Target: SCN9A; (-) strand; PAM type: NRG; PAM sequence: CAG
ctattagagaagaaaaaaaa

SEQ ID NO: 26226 - DNA, 20 bp, Artificial Sequence
  Description of Artificial Sequence: Synthetic oligonucleotide
  Target: SCN9A; (-) strand; PAM type: NRG; PAM sequence: AAG
aaactacacaactattagag

SEQ ID NO: 26227 - DNA, 20 bp, Artificial Sequence
  Description of Artificial Sequence: Synthetic oligonucleotide
  Target: SCN9A; (-) strand; PAM type: NRG; PAM sequence: GAG
tgaaaactacacaactatta

SEQ ID NO: 26228 - DNA, 20 bp, Artificial Sequence
  Description of Artificial Sequence: Synthetic oligonucleotide
  Target: SCN9A; (-) strand; PAM type: NRG; PAM sequence: TAG
actgaaaactacacaactat

SEQ ID NO: 26229 - DNA, 20 bp, Artificial Sequence
  Description of Artificial Sequence: Synthetic oligonucleotide
  Target: SCN9A; (-) strand; PAM type: NRG; PAM sequence: AAG
aaaatagactacttaaatgt

SEQ ID NO: 26230 - DNA, 20 bp, Artificial Sequence
  Description of Artificial Sequence: Synthetic oligonucleotide
  Target: SCN9A; (-) strand; PAM type: NRG; PAM sequence: TAG
atacacaagtcaactcaaaa

SEQ ID NO: 26231 - DNA, 20 bp, Artificial Sequence
  Description of Artificial Sequence: Synthetic oligonucleotide
  Target: SCN9A; (-) strand; PAM type: NRG; PAM sequence: AAG
ttatctcttactttatacac

SEQ ID NO: 26232 - DNA, 20 bp, Artificial Sequence
  Description of Artificial Sequence: Synthetic oligonucleotide
  Target: SCN9A; (-) strand; PAM type: NRG; PAM sequence: TAG
cacatgcaaaagaatgaaat

SEQ ID NO: 26233 - DNA, 20 bp, Artificial Sequence
  Description of Artificial Sequence: Synthetic oligonucleotide
  Target: SCN9A; (-) strand; PAM type: NRG; PAM sequence: AAG
aactgaatagccacatgcaa

SEQ ID NO: 26234 - DNA, 20 bp, Artificial Sequence
  Description of Artificial Sequence: Synthetic oligonucleotide
  Target: SCN9A; (-) strand; PAM type: NRG; PAM sequence: TAG
atggttctgggcaaactgaa

SEQ ID NO: 26235 - DNA, 20 bp, Artificial Sequence
  Description of Artificial Sequence: Synthetic oligonucleotide
  Target: SCN9A; (-) strand; PAM type: NRG; PAM sequence: GGG
cctctttagtaaatggttct

SEQ ID NO: 26236 - DNA, 20 bp, Artificial Sequence
  Description of Artificial Sequence: Synthetic oligonucleotide
  Target: SCN9A; (-) strand; PAM type: NRG; PAM sequence: TGG
gcctctttagtaaatggttc

SEQ ID NO: 26237 - DNA, 20 bp, Artificial Sequence
  Description of Artificial Sequence: Synthetic oligonucleotide
  Target: SCN9A; (-) strand; PAM type: NRG; PAM sequence: TGG
aggacagcctctttagtaaa

SEQ ID NO: 26238 - DNA, 20 bp, Artificial Sequence
  Description of Artificial Sequence: Synthetic oligonucleotide
  Target: SCN9A; (-) strand; PAM type: NRG; PAM sequence: TAG
tagagaaaggacagcctctt

SEQ ID NO: 26239 - DNA, 20 bp, Artificial Sequence
  Description of Artificial Sequence: Synthetic oligonucleotide
  Target: SCN9A; (-) strand; PAM type: NRG; PAM sequence: CAG
tacctataatagagaaagga

SEQ ID NO: 26240 - DNA, 20 bp, Artificial Sequence
  Description of Artificial Sequence: Synthetic oligonucleotide
  Target: SCN9A; (-) strand; PAM type: NRG; PAM sequence: AGG
caagtacctataatagagaa

SEQ ID NO: 26241 - DNA, 20 bp, Artificial Sequence
  Description of Artificial Sequence: Synthetic oligonucleotide
  Target: SCN9A; (-) strand; PAM type: NRG; PAM sequence: AAG
ccaagtacctataatagaga

SEQ ID NO: 26242 - DNA, 20 bp, Artificial Sequence
  Description of Artificial Sequence: Synthetic oligonucleotide
  Target: SCN9A; (-) strand; PAM type: NRG; PAM sequence: GAG
ggttccaagtacctataata

SEQ ID NO: 26243 - DNA, 20 bp, Artificial Sequence
  Description of Artificial Sequence: Synthetic oligonucleotide
  Target: SCN9A; (-) strand; PAM type: NRG; PAM sequence: TAG
aaggttccaagtacctataa

SEQ ID NO: 26244 - DNA, 20 bp, Artificial Sequence
  Description of Artificial Sequence: Synthetic oligonucleotide
  Target: SCN9A; (-) strand; PAM type: NRG; PAM sequence: AAG
ctgagttttgacaaggttcc

SEQ ID NO: 26245 - DNA, 20 bp, Artificial Sequence
  Description of Artificial Sequence: Synthetic oligonucleotide
  Target: SCN9A; (-) strand; PAM type: NRG; PAM sequence: AGG
cagtcaactgagttttgaca

SEQ ID NO: 26246 - DNA, 20 bp, Artificial Sequence
  Description of Artificial Sequence: Synthetic oligonucleotide
  Target: SCN9A; (-) strand; PAM type: NRG; PAM sequence: AAG
acagtcaactgagttttgac

SEQ ID NO: 26247 - DNA, 20 bp, Artificial Sequence
  Description of Artificial Sequence: Synthetic oligonucleotide
  Target: SCN9A; (-) strand; PAM type: NRG; PAM sequence: GAG
ctacacatatacagtcaact

SEQ ID NO: 26248 - DNA, 20 bp, Artificial Sequence
  Description of Artificial Sequence: Synthetic oligonucleotide
  Target: SCN9A; (-) strand; PAM type: NRG; PAM sequence: CAG
gaaataaatctacacatata

SEQ ID NO: 26249 - DNA, 20 bp, Artificial Sequence
  Description of Artificial Sequence: Synthetic oligonucleotide
  Target: SCN9A; (-) strand; PAM type: NRG; PAM sequence: CAG
atacataagaatagagagcc

SEQ ID NO: 26250 - DNA, 20 bp, Artificial Sequence
  Description of Artificial Sequence: Synthetic oligonucleotide
  Target: SCN9A; (-) strand; PAM type: NRG; PAM sequence: GAG
gagcaatacataagaataga

SEQ ID NO: 26251 - DNA, 20 bp, Artificial Sequence
  Description of Artificial Sequence: Synthetic oligonucleotide
  Target: SCN9A; (-) strand; PAM type: NRG; PAM sequence: GAG
cagagcaatacataagaata

SEQ ID NO: 26252 - DNA, 20 bp, Artificial Sequence
  Description of Artificial Sequence: Synthetic oligonucleotide
  Target: SCN9A; (-) strand; PAM type: NRG; PAM sequence: TAG
cacagagcaatacataagaa

SEQ ID NO: 26253 - DNA, 20 bp, Artificial Sequence
  Description of Artificial Sequence: Synthetic oligonucleotide
  Target: SCN9A; (-) strand; PAM type: NRG; PAM sequence: AAG
agacacacagagcaatacat

SEQ ID NO: 26254 - DNA, 20 bp, Artificial Sequence
  Description of Artificial Sequence: Synthetic oligonucleotide
  Target: SCN9A; (-) strand; PAM type: NRG; PAM sequence: GAG
tgacataaaacagacacaca

SEQ ID NO: 26255 - DNA, 20 bp, Artificial Sequence
  Description of Artificial Sequence: Synthetic oligonucleotide
  Target: SCN9A; (-) strand; PAM type: NRG; PAM sequence: CAG
actgacataaaacagacaca

SEQ ID NO: 26256 - DNA, 20 bp, Artificial Sequence
  Description of Artificial Sequence: Synthetic oligonucleotide
  Target: SCN9A; (-) strand; PAM type: NRG; PAM sequence: CAG
agaatgatactgacataaaa

SEQ ID NO: 26257 - DNA, 20 bp, Artificial Sequence
  Description of Artificial Sequence: Synthetic oligonucleotide
  Target: SCN9A; (-) strand; PAM type: NRG; PAM sequence: CAG
ataaagctatagtaaccaaa

SEQ ID NO: 26258 - DNA, 20 bp, Artificial Sequence
  Description of Artificial Sequence: Synthetic oligonucleotide
  Target: SCN9A; (-) strand; PAM type: NRG; PAM sequence: TAG
caaaacatactataaagcta

SEQ ID NO: 26259 - DNA, 20 bp, Artificial Sequence
  Description of Artificial Sequence: Synthetic oligonucleotide
  Target: SCN9A; (-) strand; PAM type: NRG; PAM sequence: AAG
tgacttcaaaacatactata

SEQ ID NO: 26260 - DNA, 20 bp, Artificial Sequence
  Description of Artificial Sequence: Synthetic oligonucleotide
  Target: SCN9A; (-) strand; PAM type: NRG; PAM sequence: TGG
aacaaaaagaacaaagctga

SEQ ID NO: 26261 - DNA, 20 bp, Artificial Sequence
  Description of Artificial Sequence: Synthetic oligonucleotide
  Target: SCN9A; (-) strand; PAM type: NRG; PAM sequence: AAG
aacctggaacaaaaagaaca

SEQ ID NO: 26262 - DNA, 20 bp, Artificial Sequence
  Description of Artificial Sequence: Synthetic oligonucleotide
  Target: SCN9A; (-) strand; PAM type: NRG; PAM sequence: AAG
cccaagtaacctggaacaaa

SEQ ID NO: 26263 - DNA, 20 bp, Artificial Sequence
  Description of Artificial Sequence: Synthetic oligonucleotide
  Target: SCN9A; (-) strand; PAM type: NRG; PAM sequence: TGG
cctaaatagcccaagtaacc

SEQ ID NO: 26264 - DNA, 20 bp, Artificial Sequence
  Description of Artificial Sequence: Synthetic oligonucleotide
  Target: SCN9A; (-) strand; PAM type: NRG; PAM sequence: AAG
caaaagaccctaaatagccc

SEQ ID NO: 26265 - DNA, 20 bp, Artificial Sequence
  Description of Artificial Sequence: Synthetic oligonucleotide
  Target: SCN9A; (-) strand; PAM type: NRG; PAM sequence: TAG
aaaccacaaaagaccctaaa

SEQ ID NO: 26266 - DNA, 20 bp, Artificial Sequence
  Description of Artificial Sequence: Synthetic oligonucleotide
  Target: SCN9A; (-) strand; PAM type: NRG; PAM sequence: AAG
acatttgtatgaaaccacaa

SEQ ID NO: 26267 - DNA, 20 bp, Artificial Sequence
  Description of Artificial Sequence: Synthetic oligonucleotide
  Target: SCN9A; (-) strand; PAM type: NRG; PAM sequence: AAG
tttacagaaaaaaaaaaaaa

SEQ ID NO: 26268 - DNA, 20 bp, Artificial Sequence
  Description of Artificial Sequence: Synthetic oligonucleotide
  Target: SCN9A; (-) strand; PAM type: NRG; PAM sequence: CAG
aataccagtgacattcttta

SEQ ID NO: 26269 - DNA, 20 bp, Artificial Sequence
  Description of Artificial Sequence: Synthetic oligonucleotide
  Target: SCN9A; (-) strand; PAM type: NRG; PAM sequence: CAG
tgcaatccctatcaaaatac

SEQ ID NO: 26270 - DNA, 20 bp, Artificial Sequence
  Description of Artificial Sequence: Synthetic oligonucleotide
  Target: SCN9A; (-) strand; PAM type: NRG; PAM sequence: AGG
tattacccaaagcaatctac

SEQ ID NO: 26271 - DNA, 20 bp, Artificial Sequence
  Description of Artificial Sequence: Synthetic oligonucleotide
  Target: SCN9A; (-) strand; PAM type: NRG; PAM sequence: CAG
atattacccaaagcaatcta

SEQ ID NO: 26272 - DNA, 20 bp, Artificial Sequence
  Description of Artificial Sequence: Synthetic oligonucleotide
  Target: SCN9A; (-) strand; PAM type: NRG; PAM sequence: AAG
taaaatgtccatattaccca

SEQ ID NO: 26273 - DNA, 20 bp, Artificial Sequence
  Description of Artificial Sequence: Synthetic oligonucleotide
  Target: SCN9A; (-) strand; PAM type: NRG; PAM sequence: TAG
gatattccatgttcatggat

SEQ ID NO: 26274 - DNA, 20 bp, Artificial Sequence
  Description of Artificial Sequence: Synthetic oligonucleotide
  Target: SCN9A; (-) strand; PAM type: NRG; PAM sequence: TGG
ggaaagatattccatgttca

SEQ ID NO: 26275 - DNA, 20 bp, Artificial Sequence
  Description of Artificial Sequence: Synthetic oligonucleotide
  Target: SCN9A; (-) strand; PAM type: NRG; PAM sequence: AAG
gaagaggacacaaaaaggga

SEQ ID NO: 26276 - DNA, 20 bp, Artificial Sequence
  Description of Artificial Sequence: Synthetic oligonucleotide
  Target: SCN9A; (-) strand; PAM type: NRG; PAM sequence: GGG
aattgaagaggacacaaaaa

SEQ ID NO: 26277 - DNA, 20 bp, Artificial Sequence
  Description of Artificial Sequence: Synthetic oligonucleotide
  Target: SCN9A; (-) strand; PAM type: NRG; PAM sequence: AGG
aaattgaagaggacacaaaa

SEQ ID NO: 26278 - DNA, 20 bp, Artificial Sequence
  Description of Artificial Sequence: Synthetic oligonucleotide
  Target: SCN9A; (-) strand; PAM type: NRG; PAM sequence: AAG
gaaattgaagaggacacaaa

SEQ ID NO: 26279 - DNA, 20 bp, Artificial Sequence
  Description of Artificial Sequence: Synthetic oligonucleotide
  Target: SCN9A; (-) strand; PAM type: NRG; PAM sequence: AGG
attggtgagagaaattgaag

SEQ ID NO: 26280 - DNA, 20 bp, Artificial Sequence
  Description of Artificial Sequence: Synthetic oligonucleotide
  Target: SCN9A; (-) strand; PAM type: NRG; PAM sequence: GAG
tattggtgagagaaattgaa

SEQ ID NO: 26281 - DNA, 20 bp, Artificial Sequence
  Description of Artificial Sequence: Synthetic oligonucleotide
  Target: SCN9A; (-) strand; PAM type: NRG; PAM sequence: AAG
aatattggtgagagaaattg

SEQ ID NO: 26282 - DNA, 20 bp, Artificial Sequence
  Description of Artificial Sequence: Synthetic oligonucleotide
  Target: SCN9A; (-) strand; PAM type: NRG; PAM sequence: GAG
aaactataaaatattggtga

SEQ ID NO: 26283 - DNA, 20 bp, Artificial Sequence
  Description of Artificial Sequence: Synthetic oligonucleotide
  Target: SCN9A; (-) strand; PAM type: NRG; PAM sequence: GAG
gaaaactataaaatattggt

SEQ ID NO: 26284 - DNA, 20 bp, Artificial Sequence
  Description of Artificial Sequence: Synthetic oligonucleotide
  Target: SCN9A; (-) strand; PAM type: NRG; PAM sequence: TGG
caatgaaaactataaaatat

SEQ ID NO: 26285 - DNA, 20 bp, Artificial Sequence
  Description of Artificial Sequence: Synthetic oligonucleotide
  Target: SCN9A; (-) strand; PAM type: NRG; PAM sequence: AGG
agaaataaatttaaacaagg

SEQ ID NO: 26286 - DNA, 20 bp, Artificial Sequence
  Description of Artificial Sequence: Synthetic oligonucleotide
  Target: SCN9A; (-) strand; PAM type: NRG; PAM sequence: GAG
tagaaataaatttaaacaag

SEQ ID NO: 26287 - DNA, 20 bp, Artificial Sequence
  Description of Artificial Sequence: Synthetic oligonucleotide
  Target: SCN9A; (-) strand; PAM type: NRG; PAM sequence: AGG
cctagaaataaatttaaaca

SEQ ID NO: 26288 - DNA, 20 bp, Artificial Sequence
  Description of Artificial Sequence: Synthetic oligonucleotide
  Target: SCN9A; (-) strand; PAM type: NRG; PAM sequence: AAG
acctagaaataaatttaaac

SEQ ID NO: 26289 - DNA, 20 bp, Artificial Sequence
  Description of Artificial Sequence: Synthetic oligonucleotide
  Target: SCN9A; (-) strand; PAM type: NRG; PAM sequence: TAG
gctacaaaaaataaaatacc

SEQ ID NO: 26290 - DNA, 20 bp, Artificial Sequence
  Description of Artificial Sequence: Synthetic oligonucleotide
  Target: SCN9A; (-) strand; PAM type: NRG; PAM sequence: TAG
gaaagcaatcccatttacaa

SEQ ID NO: 26291 - DNA, 20 bp, Artificial Sequence
  Description of Artificial Sequence: Synthetic oligonucleotide
  Target: SCN9A; (-) strand; PAM type: NRG; PAM sequence: AAG
caaataatctgaaaataaga

SEQ ID NO: 26292 - DNA, 20 bp, Artificial Sequence
  Description of Artificial Sequence: Synthetic oligonucleotide
  Target: SCN9A; (-) strand; PAM type: NRG; PAM sequence: AAG
acaacaaataatctgaaaat

SEQ ID NO: 26293 - DNA, 20 bp, Artificial Sequence
  Description of Artificial Sequence: Synthetic oligonucleotide
  Target: SCN9A; (-) strand; PAM type: NRG; PAM sequence: AGG
aatgaattcagtaatgttgg

SEQ ID NO: 26294 - DNA, 20 bp, Artificial Sequence
  Description of Artificial Sequence: Synthetic oligonucleotide
  Target: SCN9A; (-) strand; PAM type: NRG; PAM sequence: GAG
aaatgaattcagtaatgttg

SEQ ID NO: 26295 - DNA, 20 bp, Artificial Sequence
  Description of Artificial Sequence: Synthetic oligonucleotide
  Target: SCN9A; (-) strand; PAM type: NRG; PAM sequence: TGG
ataaatgaattcagtaatgt

SEQ ID NO: 26296 - DNA, 20 bp, Artificial Sequence
  Description of Artificial Sequence: Synthetic oligonucleotide
  Target: SCN9A; (-) strand; PAM type: NRG; PAM sequence: CAG
gtagatttcataaatgaatt

SEQ ID NO: 26297 - DNA, 20 bp, Artificial Sequence
  Description of Artificial Sequence: Synthetic oligonucleotide
  Target: SCN9A; (-) strand; PAM type: NRG; PAM sequence: TAG
gaccccatgaaaaaaagtag

SEQ ID NO: 26298 - DNA, 20 bp, Artificial Sequence
  Description of Artificial Sequence: Synthetic oligonucleotide
  Target: SCN9A; (-) strand; PAM type: NRG; PAM sequence: TAG
aatgaccccatgaaaaaaag

SEQ ID NO: 26299 - DNA, 20 bp, Artificial Sequence
  Description of Artificial Sequence: Synthetic oligonucleotide
  Target: SCN9A; (-) strand; PAM type: NRG; PAM sequence: AAG
tctaatgaccccatgaaaaa

SEQ ID NO: 26300 - DNA, 20 bp, Artificial Sequence
  Description of Artificial Sequence: Synthetic oligonucleotide
  Target: SCN9A; (-) strand; PAM type: NRG; PAM sequence: GAG
gatctgatcttagatataga

SEQ ID NO: 26301 - DNA, 20 bp, Artificial Sequence
  Description of Artificial Sequence: Synthetic oligonucleotide
  Target: SCN9A; (-) strand; PAM type: NRG; PAM sequence: GAG
atgatctgatcttagatata

SEQ ID NO: 26302 - DNA, 20 bp, Artificial Sequence
  Description of Artificial Sequence: Synthetic oligonucleotide
  Target: SCN9A; (-) strand; PAM type: NRG; PAM sequence: TAG
atatgatctgatcttagata

SEQ ID NO: 26303 - DNA, 20 bp, Artificial Sequence
  Description of Artificial Sequence: Synthetic oligonucleotide
  Target: SCN9A; (-) strand; PAM type: NRG; PAM sequence: TAG
gtttttatatgatctgatct

SEQ ID NO: 26304 - DNA, 20 bp, Artificial Sequence
  Description of Artificial Sequence: Synthetic oligonucleotide
  Target: SCN9A; (-) strand; PAM type: NRG; PAM sequence: AAG
catttaaattggaaagaagg

SEQ ID NO: 26305 - DNA, 20 bp, Artificial Sequence
  Description of Artificial Sequence: Synthetic oligonucleotide
  Target: SCN9A; (-) strand; PAM type: NRG; PAM sequence: AGG
ggacatttaaattggaaaga

SEQ ID NO: 26306 - DNA, 20 bp, Artificial Sequence
  Description of Artificial Sequence: Synthetic oligonucleotide
  Target: SCN9A; (-) strand; PAM type: NRG; PAM sequence: AAG
aggacatttaaattggaaag

SEQ ID NO: 26307 - DNA, 20 bp, Artificial Sequence
  Description of Artificial Sequence: Synthetic oligonucleotide
  Target: SCN9A; (-) strand; PAM type: NRG; PAM sequence: AAG
taaaggacatttaaattgga

SEQ ID NO: 26308 - DNA, 20 bp, Artificial Sequence
  Description of Artificial Sequence: Synthetic oligonucleotide
  Target: SCN9A; (-) strand; PAM type: NRG; PAM sequence: TGG
gaaataaaggacatttaaat

SEQ ID NO: 26309 - DNA, 20 bp, Artificial Sequence
  Description of Artificial Sequence: Synthetic oligonucleotide
  Target: SCN9A; (-) strand; PAM type: NRG; PAM sequence: AGG
caggcaagagaaagaaataa

SEQ ID NO: 26310 - DNA, 20 bp, Artificial Sequence
  Description of Artificial Sequence: Synthetic oligonucleotide
  Target: SCN9A; (-) strand; PAM type: NRG; PAM sequence: AAG
tcaggcaagagaaagaaata

SEQ ID NO: 26311 - DNA, 20 bp, Artificial Sequence
  Description of Artificial Sequence: Synthetic oligonucleotide
  Target: SCN9A; (-) strand; PAM type: NRG; PAM sequence: AAG
cagagcaatcaggcaagaga

SEQ ID NO: 26312 - DNA, 20 bp, Artificial Sequence
  Description of Artificial Sequence: Synthetic oligonucleotide
  Target: SCN9A; (-) strand; PAM type: NRG; PAM sequence: GAG
tagccagagcaatcaggcaa

SEQ ID NO: 26313 - DNA, 20 bp, Artificial Sequence
  Description of Artificial Sequence: Synthetic oligonucleotide
  Target: SCN9A; (-) strand; PAM type: NRG; PAM sequence: AAG
tctagccagagcaatcaggc

SEQ ID NO: 26314 - DNA, 20 bp, Artificial Sequence
  Description of Artificial Sequence: Synthetic oligonucleotide
  Target: SCN9A; (-) strand; PAM type: NRG; PAM sequence: AGG
aagttctagccagagcaatc

SEQ ID NO: 26315 - DNA, 20 bp, Artificial Sequence
  Description of Artificial Sequence: Synthetic oligonucleotide
  Target: SCN9A; (-) strand; PAM type: NRG; PAM sequence: CAG
gaagttctagccagagcaat

SEQ ID NO: 26316 - DNA, 20 bp, Artificial Sequence
  Description of Artificial Sequence: Synthetic oligonucleotide
  Target: SCN9A; (-) strand; PAM type: NRG; PAM sequence: GAG
tagtaatgaagttctagcca

SEQ ID NO: 26317 - DNA, 20 bp, Artificial Sequence
  Description of Artificial Sequence: Synthetic oligonucleotide
  Target: SCN9A; (-) strand; PAM type: NRG; PAM sequence: CAG
catagtaatgaagttctagc

SEQ ID NO: 26318 - DNA, 20 bp, Artificial Sequence
  Description of Artificial Sequence: Synthetic oligonucleotide
  Target: SCN9A; (-) strand; PAM type: NRG; PAM sequence: TAG
tcaacatagtaatgaagttc

SEQ ID NO: 26319 - DNA, 20 bp, Artificial Sequence
  Description of Artificial Sequence: Synthetic oligonucleotide
  Target: SCN9A; (-) strand; PAM type: NRG; PAM sequence: AAG
ttttattcaacatagtaatg

SEQ ID NO: 26320 - DNA, 20 bp, Artificial Sequence
  Description of Artificial Sequence: Synthetic oligonucleotide
  Target: SCN9A; (-) strand; PAM type: NRG; PAM sequence: TAG
ttcactacttttattcaaca

SEQ ID NO: 26321 - DNA, 20 bp, Artificial Sequence
  Description of Artificial Sequence: Synthetic oligonucleotide
  Target: SCN9A; (-) strand; PAM type: NRG; PAM sequence: AGG
ccaagatctggaacaagata

SEQ ID NO: 26322 - DNA, 20 bp, Artificial Sequence
  Description of Artificial Sequence: Synthetic oligonucleotide
  Target: SCN9A; (-) strand; PAM type: NRG; PAM sequence: AAG
tccaagatctggaacaagat

SEQ ID NO: 26323 - DNA, 20 bp, Artificial Sequence
  Description of Artificial Sequence: Synthetic oligonucleotide
  Target: SCN9A; (-) strand; PAM type: NRG; PAM sequence: AAG
ttctctccaagatctggaac

SEQ ID NO: 26324 - DNA, 20 bp, Artificial Sequence
  Description of Artificial Sequence: Synthetic oligonucleotide
  Target: SCN9A; (-) strand; PAM type: NRG; PAM sequence: TGG
aaagctttctctccaagatc

SEQ ID NO: 26325 - DNA, 20 bp, Artificial Sequence
  Description of Artificial Sequence: Synthetic oligonucleotide
  Target: SCN9A; (-) strand; PAM type: NRG; PAM sequence: AAG
gagctgaaagctttctctcc

SEQ ID NO: 26326 - DNA, 20 bp, Artificial Sequence
  Description of Artificial Sequence: Synthetic oligonucleotide
  Target: SCN9A; (-) strand; PAM type: NRG; PAM sequence: AAG
actaaccagggaagagctga

SEQ ID NO: 26327 - DNA, 20 bp, Artificial Sequence
  Description of Artificial Sequence: Synthetic oligonucleotide
  Target: SCN9A; (-) strand; PAM type: NRG; PAM sequence: GAG
acatgatactaaccagggaa

SEQ ID NO: 26328 - DNA, 20 bp, Artificial Sequence
  Description of Artificial Sequence: Synthetic oligonucleotide
  Target: SCN9A; (-) strand; PAM type: NRG; PAM sequence: AAG
taacatgatactaaccaggg

SEQ ID NO: 26329 - DNA, 20 bp, Artificial Sequence
  Description of Artificial Sequence: Synthetic oligonucleotide
  Target: SCN9A; (-) strand; PAM type: NRG; PAM sequence: GGG
agctaacatgatactaacca

SEQ ID NO: 26330 - DNA, 20 bp, Artificial Sequence
  Description of Artificial Sequence: Synthetic oligonucleotide
  Target: SCN9A; (-) strand; PAM type: NRG; PAM sequence: AGG
cagctaacatgatactaacc

SEQ ID NO: 26331 - DNA, 20 bp, Artificial Sequence
  Description of Artificial Sequence: Synthetic oligonucleotide
  Target: SCN9A; (-) strand; PAM type: NRG; PAM sequence: CAG
acagctaacatgatactaac

SEQ ID NO: 26332 - DNA, 20 bp, Artificial Sequence
  Description of Artificial Sequence: Synthetic oligonucleotide
  Target: SCN9A; (-) strand; PAM type: NRG; PAM sequence: CAG
ggccatatgtaacaaaccca

SEQ ID NO: 26333 - DNA, 20 bp, Artificial Sequence
  Description of Artificial Sequence: Synthetic oligonucleotide
  Target: SCN9A; (-) strand; PAM type: NRG; PAM sequence: AGG
aacataccttaatgtaatga

SEQ ID NO: 26334 - DNA, 20 bp, Artificial Sequence
  Description of Artificial Sequence: Synthetic oligonucleotide
  Target: SCN9A; (-) strand; PAM type: NRG; PAM sequence: AAG
aaacataccttaatgtaatg

SEQ ID NO: 26335 - DNA, 20 bp, Artificial Sequence
  Description of Artificial Sequence: Synthetic oligonucleotide
  Target: SCN9A; (-) strand; PAM type: NRG; PAM sequence: AAG
tatcaacaaattaagtatag

SEQ ID NO: 26336 - DNA, 20 bp, Artificial Sequence
  Description of Artificial Sequence: Synthetic oligonucleotide
  Target: SCN9A; (-) strand; PAM type: NRG; PAM sequence: TAG
aattatcaacaaattaagta

SEQ ID NO: 26337 - DNA, 20 bp, Artificial Sequence
  Description of Artificial Sequence: Synthetic oligonucleotide
  Target: SCN9A; (-) strand; PAM type: NRG; PAM sequence: AAG
ataaaaattatcaacaaatt

SEQ ID NO: 26338 - DNA, 20 bp, Artificial Sequence
  Description of Artificial Sequence: Synthetic oligonucleotide
  Target: SCN9A; (-) strand; PAM type: NRG; PAM sequence: CAG
aaaaagcattttataaaatc

SEQ ID NO: 26339 - DNA, 20 bp, Artificial Sequence
  Description of Artificial Sequence: Synthetic oligonucleotide
  Target: SCN9A; (-) strand; PAM type: NRG; PAM sequence: AAG
catctcaatagacagagaaa

SEQ ID NO: 26340 - DNA, 20 bp, Artificial Sequence
  Description of Artificial Sequence: Synthetic oligonucleotide
  Target: SCN9A; (-) strand; PAM type: NRG; PAM sequence: GAG
tataatcatctcaatagaca

SEQ ID NO: 26341 - DNA, 20 bp, Artificial Sequence
  Description of Artificial Sequence: Synthetic oligonucleotide
  Target: SCN9A; (-) strand; PAM type: NRG; PAM sequence: CAG
catataatcatctcaataga

SEQ ID NO: 26342 - DNA, 20 bp, Artificial Sequence
  Description of Artificial Sequence: Synthetic oligonucleotide
  Target: SCN9A; (-) strand; PAM type: NRG; PAM sequence: TAG
aaaccatataatcatctcaa

SEQ ID NO: 26343 - DNA, 20 bp, Artificial Sequence
  Description of Artificial Sequence: Synthetic oligonucleotide
  Target: SCN9A; (-) strand; PAM type: NRG; PAM sequence: CAG
aactttctatattatatcaa

SEQ ID NO: 26344 - DNA, 20 bp, Artificial Sequence
  Description of Artificial Sequence: Synthetic oligonucleotide
  Target: SCN9A; (-) strand; PAM type: NRG; PAM sequence: CAG
caaagatgtttcaacatttg

SEQ ID NO: 26345 - DNA, 20 bp, Artificial Sequence
  Description of Artificial Sequence: Synthetic oligonucleotide
  Target: SCN9A; (-) strand; PAM type: NRG; PAM sequence: AAG
gaaatcgtcccagggatgca

SEQ ID NO: 26346 - DNA, 20 bp, Artificial Sequence
  Description of Artificial Sequence: Synthetic oligonucleotide
  Target: SCN9A; (-) strand; PAM type: NRG; PAM sequence: GGG
ctcaactggaaatcgtccca

SEQ ID NO: 26347 - DNA, 20 bp, Artificial Sequence
  Description of Artificial Sequence: Synthetic oligonucleotide
  Target: SCN9A; (-) strand; PAM type: NRG; PAM sequence: AGG
gctcaactggaaatcgtccc

SEQ ID NO: 26348 - DNA, 20 bp, Artificial Sequence
  Description of Artificial Sequence: Synthetic oligonucleotide
  Target: SCN9A; (-) strand; PAM type: NRG; PAM sequence: CAG
tgctcaactggaaatcgtcc

SEQ ID NO: 26349 - DNA, 20 bp, Artificial Sequence
  Description of Artificial Sequence: Synthetic oligonucleotide
  Target: SCN9A; (-) strand; PAM type: NRG; PAM sequence: TGG
gattattcaccatgctcaac

SEQ ID NO: 26350 - DNA, 20 bp, Artificial Sequence
  Description of Artificial Sequence: Synthetic oligonucleotide
  Target: SCN9A; (-) strand; PAM type: NRG; PAM sequence: AAG
aaatccaacagcctatcaaa

SEQ ID NO: 26351 - DNA, 20 bp, Artificial Sequence
  Description of Artificial Sequence: Synthetic oligonucleotide
  Target: SCN9A; (-) strand; PAM type: NRG; PAM sequence: CAG
tactagcaactcaaatccaa

SEQ ID NO: 26352 - DNA, 20 bp, Artificial Sequence
  Description of Artificial Sequence: Synthetic oligonucleotide
  Target: SCN9A; (-) strand; PAM type: NRG; PAM sequence: TAG
aaaatgccccaacaaaatac

SEQ ID NO: 26353 - DNA, 20 bp, Artificial Sequence
  Description of Artificial Sequence: Synthetic oligonucleotide
  Target: SCN9A; (-) strand; PAM type: NRG; PAM sequence: CAG
gccactatccctgatgaaca

SEQ ID NO: 26354 - DNA, 20 bp, Artificial Sequence
  Description of Artificial Sequence: Synthetic oligonucleotide
  Target: SCN9A; (-) strand; PAM type: NRG; PAM sequence: AGG
acacacgaaaagaaagctga

SEQ ID NO: 26355 - DNA, 20 bp, Artificial Sequence
  Description of Artificial Sequence: Synthetic oligonucleotide
  Target: SCN9A; (-) strand; PAM type: NRG; PAM sequence: AAG
cacacacgaaaagaaagctg

SEQ ID NO: 26356 - DNA, 20 bp, Artificial Sequence
  Description of Artificial Sequence: Synthetic oligonucleotide
  Target: SCN9A; (-) strand; PAM type: NRG; PAM sequence: AAG
gacacacacacacgaaaaga

SEQ ID NO: 26357 - DNA, 20 bp, Artificial Sequence
  Description of Artificial Sequence: Synthetic oligonucleotide
  Target: SCN9A; (-) strand; PAM type: NRG; PAM sequence: AAG
cagggacacacacacacgaa

SEQ ID NO: 26358 - DNA, 20 bp, Artificial Sequence
  Description of Artificial Sequence: Synthetic oligonucleotide
  Target: SCN9A; (-) strand; PAM type: NRG; PAM sequence: GGG
cccaataccagaacaagaca

SEQ ID NO: 26359 - DNA, 20 bp, Artificial Sequence
  Description of Artificial Sequence: Synthetic oligonucleotide
  Target: SCN9A; (-) strand; PAM type: NRG; PAM sequence: AGG
ccccaataccagaacaagac

SEQ ID NO: 26360 - DNA, 20 bp, Artificial Sequence
  Description of Artificial Sequence: Synthetic oligonucleotide
  Target: SCN9A; (-) strand; PAM type: NRG; PAM sequence: CAG
accccaataccagaacaaga

SEQ ID NO: 26361 - DNA, 20 bp, Artificial Sequence
  Description of Artificial Sequence: Synthetic oligonucleotide
  Target: SCN9A; (-) strand; PAM type: NRG; PAM sequence: AAG
tattaccccaataccagaac

SEQ ID NO: 26362 - DNA, 20 bp, Artificial Sequence
  Description of Artificial Sequence: Synthetic oligonucleotide
  Target: SCN9A; (-) strand; PAM type: NRG; PAM sequence: CAG
ggccaatattaccccaatac

SEQ ID NO: 26363 - DNA, 20 bp, Artificial Sequence
  Description of Artificial Sequence: Synthetic oligonucleotide
  Target: SCN9A; (-) strand; PAM type: NRG; PAM sequence: AGG
tcttctaaattcattctaca

SEQ ID NO: 26364 - DNA, 20 bp, Artificial Sequence
  Description of Artificial Sequence: Synthetic oligonucleotide
  Target: SCN9A; (-) strand; PAM type: NRG; PAM sequence: AAG
ttcttctaaattcattctac

SEQ ID NO: 26365 - DNA, 20 bp, Artificial Sequence
  Description of Artificial Sequence: Synthetic oligonucleotide
  Target: SCN9A; (-) strand; PAM type: NRG; PAM sequence: AGG
tccaaaaaaatcaaaaggaa

SEQ ID NO: 26366 - DNA, 20 bp, Artificial Sequence
  Description of Artificial Sequence: Synthetic oligonucleotide
  Target: SCN9A; (-) strand; PAM type: NRG; PAM sequence: AAG
ttccaaaaaaatcaaaagga

SEQ ID NO: 26367 - DNA, 20 bp, Artificial Sequence
  Description of Artificial Sequence: Synthetic oligonucleotide
  Target: SCN9A; (-) strand; PAM type: NRG; PAM sequence: AGG
attattccaaaaaaatcaaa

SEQ ID NO: 26368 - DNA, 20 bp, Artificial Sequence
  Description of Artificial Sequence: Synthetic oligonucleotide
  Target: SCN9A; (-) strand; PAM type: NRG; PAM sequence: AAG
aattattccaaaaaaatcaa

SEQ ID NO: 26369 - DNA, 20 bp, Artificial Sequence
  Description of Artificial Sequence: Synthetic oligonucleotide
  Target: SCN9A; (-) strand; PAM type: NRG; PAM sequence: AAG
attctaccaaacatttaaag

SEQ ID NO: 26370 - DNA, 20 bp, Artificial Sequence
  Description of Artificial Sequence: Synthetic oligonucleotide
  Target: SCN9A; (-) strand; PAM type: NRG; PAM sequence: AAG
tgaattctaccaaacattta

SEQ ID NO: 26371 - DNA, 20 bp, Artificial Sequence
  Description of Artificial Sequence: Synthetic oligonucleotide
  Target: SCN9A; (-) strand; PAM type: NRG; PAM sequence: TGG
aagaaaagtccaggaccaca

SEQ ID NO: 26372 - DNA, 20 bp, Artificial Sequence
  Description of Artificial Sequence: Synthetic oligonucleotide
  Target: SCN9A; (-) strand; PAM type: NRG; PAM sequence: AGG
ctcctagcaaagaaaagtcc

SEQ ID NO: 26373 - DNA, 20 bp, Artificial Sequence
  Description of Artificial Sequence: Synthetic oligonucleotide
  Target: SCN9A; (-) strand; PAM type: NRG; PAM sequence: CAG
tctcctagcaaagaaaagtc

SEQ ID NO: 26374 - DNA, 20 bp, Artificial Sequence
  Description of Artificial Sequence: Synthetic oligonucleotide
  Target: SCN9A; (-) strand; PAM type: NRG; PAM sequence: AAG
aaatctctcctagcaaagaa

SEQ ID NO: 26375 - DNA, 20 bp, Artificial Sequence
  Description of Artificial Sequence: Synthetic oligonucleotide
  Target: SCN9A; (-) strand; PAM type: NRG; PAM sequence: AAG
taataaaatctctcctagca

SEQ ID NO: 26376 - DNA, 20 bp, Artificial Sequence
  Description of Artificial Sequence: Synthetic oligonucleotide
  Target: SCN9A; (-) strand; PAM type: NRG; PAM sequence: TAG
atcagtaataaaatctctcc

SEQ ID NO: 26377 - DNA, 20 bp, Artificial Sequence
  Description of Artificial Sequence: Synthetic oligonucleotide
  Target: SCN9A; (-) strand; PAM type: NRG; PAM sequence: CAG
aatgagtaacaagattgaat

SEQ ID NO: 26378 - DNA, 20 bp, Artificial Sequence
  Description of Artificial Sequence: Synthetic oligonucleotide
  Target: SCN9A; (-) strand; PAM type: NRG; PAM sequence: AAG
acagaccaataatgagtaac

SEQ ID NO: 26379 - DNA, 20 bp, Artificial Sequence
  Description of Artificial Sequence: Synthetic oligonucleotide
  Target: SCN9A; (-) strand; PAM type: NRG; PAM sequence: GAG
aactcaaacagaccaataat

SEQ ID NO: 26380 - DNA, 20 bp, Artificial Sequence
  Description of Artificial Sequence: Synthetic oligonucleotide
  Target: SCN9A; (-) strand; PAM type: NRG; PAM sequence: CAG
gaagaaatggaaaactcaaa

SEQ ID NO: 26381 - DNA, 20 bp, Artificial Sequence
  Description of Artificial Sequence: Synthetic oligonucleotide
  Target: SCN9A; (-) strand; PAM type: NRG; PAM sequence: TGG
aagactgtatcatgaagaaa

SEQ ID NO: 26382 - DNA, 20 bp, Artificial Sequence
  Description of Artificial Sequence: Synthetic oligonucleotide
  Target: SCN9A; (-) strand; PAM type: NRG; PAM sequence: AAG
cttgccaagactgtatcatg

SEQ ID NO: 26383 - DNA, 20 bp, Artificial Sequence
  Description of Artificial Sequence: Synthetic oligonucleotide
  Target: SCN9A; (-) strand; PAM type: NRG; PAM sequence: AAG
ctcaacacatacaacttgcc

SEQ ID NO: 26384 - DNA, 20 bp, Artificial Sequence
  Description of Artificial Sequence: Synthetic oligonucleotide
  Target: SCN9A; (-) strand; PAM type: NRG; PAM sequence: TGG
caacaaattggaaaacctaa

SEQ ID NO: 26385 - DNA, 20 bp, Artificial Sequence
  Description of Artificial Sequence: Synthetic oligonucleotide
  Target: SCN9A; (-) strand; PAM type: NRG; PAM sequence: TGG
acaatcatactccaacaaat

SEQ ID NO: 26386 - DNA, 20 bp, Artificial Sequence
  Description of Artificial Sequence: Synthetic oligonucleotide
  Target: SCN9A; (-) strand; PAM type: NRG; PAM sequence: GAG
gcagcagctactgatcaata

SEQ ID NO: 26387 - DNA, 20 bp, Artificial Sequence
  Description of Artificial Sequence: Synthetic oligonucleotide
  Target: SCN9A; (-) strand; PAM type: NRG; PAM sequence: TAG
ttgcagcagctactgatcaa

SEQ ID NO: 26388 - DNA, 20 bp, Artificial Sequence
  Description of Artificial Sequence: Synthetic oligonucleotide
  Target: SCN9A; (-) strand; PAM type: NRG; PAM sequence: CAG
atcattaacaacgtttgcag

SEQ ID NO: 26389 - DNA, 20 bp, Artificial Sequence
  Description of Artificial Sequence: Synthetic oligonucleotide
  Target: SCN9A; (-) strand; PAM type: NRG; PAM sequence: CAG
agaatcattaacaacgtttg

SEQ ID NO: 26390 - DNA, 20 bp, Artificial Sequence
  Description of Artificial Sequence: Synthetic oligonucleotide
  Target: SCN9A; (-) strand; PAM type: NRG; PAM sequence: CAG
cctaaatttggatgcaactt

SEQ ID NO: 26391 - DNA, 20 bp, Artificial Sequence
  Description of Artificial Sequence: Synthetic oligonucleotide
  Target: SCN9A; (-) strand; PAM type: NRG; PAM sequence: TGG
ttgaattgtttgcctaaatt

SEQ ID NO: 26392 - DNA, 20 bp, Artificial Sequence
  Description of Artificial Sequence: Synthetic oligonucleotide
  Target: SCN9A; (-) strand; PAM type: NRG; PAM sequence: TGG
tttattacaaatgcctgttc

SEQ ID NO: 26393 - DNA, 20 bp, Artificial Sequence
  Description of Artificial Sequence: Synthetic oligonucleotide
  Target: SCN9A; (-) strand; PAM type: NRG; PAM sequence: GGG
gtgtgtgaaagacatacttg

SEQ ID NO: 26394 - DNA, 20 bp, Artificial Sequence
  Description of Artificial Sequence: Synthetic oligonucleotide
  Target: SCN9A; (-) strand; PAM type: NRG; PAM sequence: GGG
agtgtgtgaaagacatactt

SEQ ID NO: 26395 - DNA, 20 bp, Artificial Sequence
  Description of Artificial Sequence: Synthetic oligonucleotide
  Target: SCN9A; (-) strand; PAM type: NRG; PAM sequence: TGG
tagtgtgtgaaagacatact

SEQ ID NO: 26396 - DNA, 20 bp, Artificial Sequence
  Description of Artificial Sequence: Synthetic oligonucleotide
  Target: SCN9A; (-) strand; PAM type: NRG; PAM sequence: AAG
ttcagaattttagtgtgtga

SEQ ID NO: 26397 - DNA, 20 bp, Artificial Sequence
  Description of Artificial Sequence: Synthetic oligonucleotide
  Target: SCN9A; (-) strand; PAM type: NRG; PAM sequence: TAG
agatcagtgcttcagaattt

SEQ ID NO: 26398 - DNA, 20 bp, Artificial Sequence
  Description of Artificial Sequence: Synthetic oligonucleotide
  Target: SCN9A; (-) strand; PAM type: NRG; PAM sequence: CAG
cgtgatgaagatcagtgctt

SEQ ID NO: 26399 - DNA, 20 bp, Artificial Sequence
  Description of Artificial Sequence: Synthetic oligonucleotide
  Target: SCN9A; (-) strand; PAM type: NRG; PAM sequence: CAG
agagatagcgtgatgaagat

SEQ ID NO: 26400 - DNA, 20 bp, Artificial Sequence
  Description of Artificial Sequence: Synthetic oligonucleotide
  Target: SCN9A; (-) strand; PAM type: NRG; PAM sequence: AAG
ttaaaagagatagcgtgatg

SEQ ID NO: 26401 - DNA, 20 bp, Artificial Sequence
  Description of Artificial Sequence: Synthetic oligonucleotide
  Target: SCN9A; (-) strand; PAM type: NRG; PAM sequence: TAG
cagattgaatttaaaagaga

SEQ ID NO: 26402 - DNA, 20 bp, Artificial Sequence
  Description of Artificial Sequence: Synthetic oligonucleotide
  Target: SCN9A; (-) strand; PAM type: NRG; PAM sequence: GAG
gttacagattgaatttaaaa

SEQ ID NO: 26403 - DNA, 20 bp, Artificial Sequence
  Description of Artificial Sequence: Synthetic oligonucleotide
  Target: SCN9A; (-) strand; PAM type: NRG; PAM sequence: AAG
tggttacagattgaatttaa

SEQ ID NO: 26404 - DNA, 20 bp, Artificial Sequence
  Description of Artificial Sequence: Synthetic oligonucleotide
  Target: SCN9A; (-) strand; PAM type: NRG; PAM sequence: CAG
ctgtaagtagctattggtta

SEQ ID NO: 26405 - DNA, 20 bp, Artificial Sequence
  Description of Artificial Sequence: Synthetic oligonucleotide
  Target: SCN9A; (-) strand; PAM type: NRG; PAM sequence: TGG
tacacactgtaagtagctat

SEQ ID NO: 26406 - DNA, 20 bp, Artificial Sequence
  Description of Artificial Sequence: Synthetic oligonucleotide
  Target: SCN9A; (-) strand; PAM type: NRG; PAM sequence: TAG
gcttatatacacactgtaag

SEQ ID NO: 26407 - DNA, 20 bp, Artificial Sequence
  Description of Artificial Sequence: Synthetic oligonucleotide
  Target: SCN9A; (-) strand; PAM type: NRG; PAM sequence: AAG
agtgcttatatacacactgt

SEQ ID NO: 26408 - DNA, 20 bp, Artificial Sequence
  Description of Artificial Sequence: Synthetic oligonucleotide
  Target: SCN9A; (-) strand; PAM type: NRG; PAM sequence: GAG
attattataagtatggaatt

SEQ ID NO: 26409 - DNA, 20 bp, Artificial Sequence
  Description of Artificial Sequence: Synthetic oligonucleotide
  Target: SCN9A; (-) strand; PAM type: NRG; PAM sequence: TGG
atgtacaattattataagta

SEQ ID NO: 26410 - DNA, 20 bp, Artificial Sequence
  Description of Artificial Sequence: Synthetic oligonucleotide
  Target: SCN9A; (-) strand; PAM type: NRG; PAM sequence: AAG
gctcaatgtacaattattat

SEQ ID NO: 26411 - DNA, 20 bp, Artificial Sequence
  Description of Artificial Sequence: Synthetic oligonucleotide
  Target: SCN9A; (-) strand; PAM type: NRG; PAM sequence: AAG
ttagacaaatgcttattgaa

SEQ ID NO: 26412 - DNA, 20 bp, Artificial Sequence
  Description of Artificial Sequence: Synthetic oligonucleotide
  Target: SCN9A; (-) strand; PAM type: NRG; PAM sequence: TAG
atatgattctcataaataat

SEQ ID NO: 26413 - DNA, 20 bp, Artificial Sequence
  Description of Artificial Sequence: Synthetic oligonucleotide
  Target: SCN9A; (-) strand; PAM type: NRG; PAM sequence: AAG
gtgtaaaatagattgtaata

SEQ ID NO: 26414 - DNA, 20 bp, Artificial Sequence
  Description of Artificial Sequence: Synthetic oligonucleotide
  Target: SCN9A; (-) strand; PAM type: NRG; PAM sequence: TAG
cagtttatttatgtgtaaaa

SEQ ID NO: 26415 - DNA, 20 bp, Artificial Sequence
  Description of Artificial Sequence: Synthetic oligonucleotide
  Target: SCN9A; (-) strand; PAM type: NRG; PAM sequence: CAG
atttacaaaaacattttttt

SEQ ID NO: 26416 - DNA, 20 bp, Artificial Sequence
  Description of Artificial Sequence: Synthetic oligonucleotide
  Target: SCN9A; (-) strand; PAM type: NRG; PAM sequence: GAG
ttagcttttgataagacctt

SEQ ID NO: 26417 - DNA, 20 bp, Artificial Sequence
  Description of Artificial Sequence: Synthetic oligonucleotide
  Target: SCN9A; (-) strand; PAM type: NRG; PAM sequence: AAG
ctcaaatcttagcttttgat

SEQ ID NO: 26418 - DNA, 20 bp, Artificial Sequence
  Description of Artificial Sequence: Synthetic oligonucleotide
  Target: SCN9A; (-) strand; PAM type: NRG; PAM sequence: TAG
agaatatttgcctcaaatct

SEQ ID NO: 26419 - DNA, 20 bp, Artificial Sequence
  Description of Artificial Sequence: Synthetic oligonucleotide
  Target: SCN9A; (-) strand; PAM type: NRG; PAM sequence: TAG
aagaatgccactttttaaga

SEQ ID NO: 26420 - DNA, 20 bp, Artificial Sequence
  Description of Artificial Sequence: Synthetic oligonucleotide
  Target: SCN9A; (-) strand; PAM type: NRG; PAM sequence: AAG
agttaagaatgccacttttt

SEQ ID NO: 26421 - DNA, 20 bp, Artificial Sequence
  Description of Artificial Sequence: Synthetic oligonucleotide
  Target: SCN9A; (-) strand; PAM type: NRG; PAM sequence: AAG
cactaccttgggatatagtt

SEQ ID NO: 26422 - DNA, 20 bp, Artificial Sequence
  Description of Artificial Sequence: Synthetic oligonucleotide
  Target: SCN9A; (-) strand; PAM type: NRG; PAM sequence: TAG
ttagccactaccttgggata

SEQ ID NO: 26423 - DNA, 20 bp, Artificial Sequence
  Description of Artificial Sequence: Synthetic oligonucleotide
  Target: SCN9A; (-) strand; PAM type: NRG; PAM sequence: GGG
taagtcttagccactacctt

SEQ ID NO: 26424 - DNA, 20 bp, Artificial Sequence
  Description of Artificial Sequence: Synthetic oligonucleotide
  Target: SCN9A; (-) strand; PAM type: NRG; PAM sequence: TGG
ttaagtcttagccactacct

SEQ ID NO: 26425 - DNA, 20 bp, Artificial Sequence
  Description of Artificial Sequence: Synthetic oligonucleotide
  Target: SCN9A; (-) strand; PAM type: NRG; PAM sequence: TAG
atatttatgtcattaagtct

SEQ ID NO: 26426 - DNA, 20 bp, Artificial Sequence
  Description of Artificial Sequence: Synthetic oligonucleotide
  Target: SCN9A; (-) strand; PAM type: NRG; PAM sequence: AAG
atttatatatttatgtcatt

SEQ ID NO: 26427 - DNA, 20 bp, Artificial Sequence
  Description of Artificial Sequence: Synthetic oligonucleotide
  Target: SCN9A; (-) strand; PAM type: NRG; PAM sequence: AAG
aaattgaattacccaataga

SEQ ID NO: 26428 - DNA, 20 bp, Artificial Sequence
  Description of Artificial Sequence: Synthetic oligonucleotide
  Target: SCN9A; (-) strand; PAM type: NRG; PAM sequence: TAG
aggcaaattgaattacccaa

SEQ ID NO: 26429 - DNA, 20 bp, Artificial Sequence
  Description of Artificial Sequence: Synthetic oligonucleotide
  Target: SCN9A; (-) strand; PAM type: NRG; PAM sequence: AGG
tgagcctggatgagccaaag

SEQ ID NO: 26430 - DNA, 20 bp, Artificial Sequence
  Description of Artificial Sequence: Synthetic oligonucleotide
  Target: SCN9A; (-) strand; PAM type: NRG; PAM sequence: GAG
atgagcctggatgagccaaa

SEQ ID NO: 26431 - DNA, 20 bp, Artificial Sequence
  Description of Artificial Sequence: Synthetic oligonucleotide
  Target: SCN9A; (-) strand; PAM type: NRG; PAM sequence: AAG
tgatgagcctggatgagcca

SEQ ID NO: 26432 - DNA, 20 bp, Artificial Sequence
  Description of Artificial Sequence: Synthetic oligonucleotide
  Target: SCN9A; (-) strand; PAM type: NRG; PAM sequence: GAG
tgtttgtgatgagcctggat

SEQ ID NO: 26433 - DNA, 20 bp, Artificial Sequence
  Description of Artificial Sequence: Synthetic oligonucleotide
  Target: SCN9A; (-) strand; PAM type: NRG; PAM sequence: TGG
ggttgtgtttgtgatgagcc

SEQ ID NO: 26434 - DNA, 20 bp, Artificial Sequence
  Description of Artificial Sequence: Synthetic oligonucleotide
  Target: SCN9A; (-) strand; PAM type: NRG; PAM sequence: GAG
gtgatggttgtgtttgtgat

SEQ ID NO: 26435 - DNA, 20 bp, Artificial Sequence
  Description of Artificial Sequence: Synthetic oligonucleotide
  Target: SCN9A; (-) strand; PAM type: NRG; PAM sequence: TGG
agatgcctttgaaatagtga

SEQ ID NO: 26436 - DNA, 20 bp, Artificial Sequence
  Description of Artificial Sequence: Synthetic oligonucleotide
  Target: SCN9A; (-) strand; PAM type: NRG; PAM sequence: TAG
tatctgagatgcctttgaaa

SEQ ID NO: 26437 - DNA, 20 bp, Artificial Sequence
  Description of Artificial Sequence: Synthetic oligonucleotide
  Target: SCN9A; (-) strand; PAM type: NRG; PAM sequence: GAG
cttttatttttttcgtatct

SEQ ID NO: 26438 - DNA, 20 bp, Artificial Sequence
  Description of Artificial Sequence: Synthetic oligonucleotide
  Target: SCN9A; (-) strand; PAM type: NRG; PAM sequence: GAG
atctcccacttgagttccca

SEQ ID NO: 26439 - DNA, 20 bp, Artificial Sequence
  Description of Artificial Sequence: Synthetic oligonucleotide
  Target: SCN9A; (-) strand; PAM type: NRG; PAM sequence: CAG
tcatctcccacttgagttcc

SEQ ID NO: 26440 - DNA, 20 bp, Artificial Sequence
  Description of Artificial Sequence: Synthetic oligonucleotide
  Target: SCN9A; (-) strand; PAM type: NRG; PAM sequence: GAG
ataatcttcatctcccactt

SEQ ID NO: 26441 - DNA, 20 bp, Artificial Sequence
  Description of Artificial Sequence: Synthetic oligonucleotide
  Target: SCN9A; (-) strand; PAM type: NRG; PAM sequence: TAG
tcccattcagatcactaaaa

SEQ ID NO: 26442 - DNA, 20 bp, Artificial Sequence
  Description of Artificial Sequence: Synthetic oligonucleotide
  Target: SCN9A; (-) strand; PAM type: NRG; PAM sequence: CAG
ttttgttttgttttcccatt

SEQ ID NO: 26443 - DNA, 20 bp, Artificial Sequence
  Description of Artificial Sequence: Synthetic oligonucleotide
  Target: SCN9A; (-) strand; PAM type: NRG; PAM sequence: CAG
tcttcagattaaaatgtttc

SEQ ID NO: 26444 - DNA, 20 bp, Artificial Sequence
  Description of Artificial Sequence: Synthetic oligonucleotide
  Target: SCN9A; (-) strand; PAM type: NRG; PAM sequence: CAG
gtctttctttccagcctctt

SEQ ID NO: 26445 - DNA, 20 bp, Artificial Sequence
  Description of Artificial Sequence: Synthetic oligonucleotide
  Target: SCN9A; (-) strand; PAM type: NRG; PAM sequence: CAG
acatctaaggtctttctttc

SEQ ID NO: 26446 - DNA, 20 bp, Artificial Sequence
  Description of Artificial Sequence: Synthetic oligonucleotide
  Target: SCN9A; (-) strand; PAM type: NRG; PAM sequence: AGG
ctataaaaaccttacatcta

SEQ ID NO: 26447 - DNA, 20 bp, Artificial Sequence
  Description of Artificial Sequence: Synthetic oligonucleotide
  Target: SCN9A; (-) strand; PAM type: NRG; PAM sequence: AAG
actataaaaaccttacatct

SEQ ID NO: 26448 - DNA, 20 bp, Artificial Sequence
  Description of Artificial Sequence: Synthetic oligonucleotide
  Target: SCN9A; (-) strand; PAM type: NRG; PAM sequence: TGG
tttgataagatattaagctg

SEQ ID NO: 26449 - DNA, 20 bp, Artificial Sequence
  Description of Artificial Sequence: Synthetic oligonucleotide
  Target: SCN9A; (-) strand; PAM type: NRG; PAM sequence: AAG
aatttgtttgataagatatt

SEQ ID NO: 26450 - DNA, 20 bp, Artificial Sequence
  Description of Artificial Sequence: Synthetic oligonucleotide
  Target: SCN9A; (-) strand; PAM type: NRG; PAM sequence: AAG
ctagaggaaatttgtttgat

SEQ ID NO: 26451 - DNA, 20 bp, Artificial Sequence
  Description of Artificial Sequence: Synthetic oligonucleotide
  Target: SCN9A; (-) strand; PAM type: NRG; PAM sequence: AGG
aatgaaggttcaagatctag

SEQ ID NO: 26452 - DNA, 20 bp, Artificial Sequence
  Description of Artificial Sequence: Synthetic oligonucleotide
  Target: SCN9A; (-) strand; PAM type: NRG; PAM sequence: GAG
taatgaaggttcaagatcta

SEQ ID NO: 26453 - DNA, 20 bp, Artificial Sequence
  Description of Artificial Sequence: Synthetic oligonucleotide
  Target: SCN9A; (-) strand; PAM type: NRG; PAM sequence: TAG
aataatgaaggttcaagatc

SEQ ID NO: 26454 - DNA, 20 bp, Artificial Sequence
  Description of Artificial Sequence: Synthetic oligonucleotide
  Target: SCN9A; (-) strand; PAM type: NRG; PAM sequence: AAG
ttgagaaataatgaaggttc

SEQ ID NO: 26455 - DNA, 20 bp, Artificial Sequence
  Description of Artificial Sequence: Synthetic oligonucleotide
  Target: SCN9A; (-) strand; PAM type: NRG; PAM sequence: AGG
taagaattgagaaataatga

SEQ ID NO: 26456 - DNA, 20 bp, Artificial Sequence
  Description of Artificial Sequence: Synthetic oligonucleotide
  Target: SCN9A; (-) strand; PAM type: NRG; PAM sequence: AAG
ataagaattgagaaataatg

SEQ ID NO: 26457 - DNA, 20 bp, Artificial Sequence
  Description of Artificial Sequence: Synthetic oligonucleotide
  Target: SCN9A; (-) strand; PAM type: NRG; PAM sequence: GAG
tacctgaaaatataagaatt

SEQ ID NO: 26458 - DNA, 20 bp, Artificial Sequence
  Description of Artificial Sequence: Synthetic oligonucleotide
  Target: SCN9A; (-) strand; PAM type: NRG; PAM sequence: AAG
acaaacctacctgaaaatat

SEQ ID NO: 26459 - DNA, 20 bp, Artificial Sequence
  Description of Artificial Sequence: Synthetic oligonucleotide
  Target: SCN9A; (-) strand; PAM type: NRG; PAM sequence: TAG
aaagtatgtcatattaagta

SEQ ID NO: 26460 - DNA, 20 bp, Artificial Sequence
  Description of Artificial Sequence: Synthetic oligonucleotide
  Target: SCN9A; (-) strand; PAM type: NRG; PAM sequence: AAG
atctcaaagtatgtcatatt

SEQ ID NO: 26461 - DNA, 20 bp, Artificial Sequence
  Description of Artificial Sequence: Synthetic oligonucleotide
  Target: SCN9A; (-) strand; PAM type: NRG; PAM sequence: AAG
attttccatgacgtatctca

SEQ ID NO: 26462 - DNA, 20 bp, Artificial Sequence
  Description of Artificial Sequence: Synthetic oligonucleotide
  Target: SCN9A; (-) strand; PAM type: NRG; PAM sequence: AAG
cttctaattatgaactttga

SEQ ID NO: 26463 - DNA, 20 bp, Artificial Sequence
  Description of Artificial Sequence: Synthetic oligonucleotide
  Target: SCN9A; (-) strand; PAM type: NRG; PAM sequence: TAG
tacttaagaactcaggttct

SEQ ID NO: 26464 - DNA, 20 bp, Artificial Sequence
  Description of Artificial Sequence: Synthetic oligonucleotide
  Target: SCN9A; (-) strand; PAM type: NRG; PAM sequence: AGG
ttattattacttaagaactc

SEQ ID NO: 26465 - DNA, 20 bp, Artificial Sequence
  Description of Artificial Sequence: Synthetic oligonucleotide
  Target: SCN9A; (-) strand; PAM type: NRG; PAM sequence: CAG
attattattacttaagaact

SEQ ID NO: 26466 - DNA, 20 bp, Artificial Sequence
  Description of Artificial Sequence: Synthetic oligonucleotide
  Target: SCN9A; (-) strand; PAM type: NRG; PAM sequence: AAG
ctgcatcattattattactt

SEQ ID NO: 26467 - DNA, 20 bp, Artificial Sequence
  Description of Artificial Sequence: Synthetic oligonucleotide
  Target: SCN9A; (-) strand; PAM type: NRG; PAM sequence: AAG
ttagcaagccattttaaaaa

SEQ ID NO: 26468 - DNA, 20 bp, Artificial Sequence
  Description of Artificial Sequence: Synthetic oligonucleotide
  Target: SCN9A; (-) strand; PAM type: NRG; PAM sequence: AAG
agcatagtgtttgaattagc

SEQ ID NO: 26469 - DNA, 20 bp, Artificial Sequence
  Description of Artificial Sequence: Synthetic oligonucleotide
  Target: SCN9A; (-) strand; PAM type: NRG; PAM sequence: TAG
atgtagcatagtgtttgaat

SEQ ID NO: 26470 - DNA, 20 bp, Artificial Sequence
  Description of Artificial Sequence: Synthetic oligonucleotide
  Target: SCN9A; (-) strand; PAM type: NRG; PAM sequence: TAG
tatttttaagtcatgtagca

SEQ ID NO: 26471 - DNA, 20 bp, Artificial Sequence
  Description of Artificial Sequence: Synthetic oligonucleotide
  Target: SCN9A; (-) strand; PAM type: NRG; PAM sequence: TAG
gctagtatttttaagtcatg

SEQ ID NO: 26472 - DNA, 20 bp, Artificial Sequence
  Description of Artificial Sequence: Synthetic oligonucleotide
  Target: SCN9A; (-) strand; PAM type: NRG; PAM sequence: AAG
atacacaagctagtattttt

SEQ ID NO: 26473 - DNA, 20 bp, Artificial Sequence
  Description of Artificial Sequence: Synthetic oligonucleotide
  Target: SCN9A; (-) strand; PAM type: NRG; PAM sequence: TAG
gtagtaacagatacacaagc

SEQ ID NO: 26474 - DNA, 20 bp, Artificial Sequence
  Description of Artificial Sequence: Synthetic oligonucleotide
  Target: SCN9A; (-) strand; PAM type: NRG; PAM sequence: AAG
ggttgtagtaacagatacac

SEQ ID NO: 26475 - DNA, 20 bp, Artificial Sequence
  Description of Artificial Sequence: Synthetic oligonucleotide
  Target: SCN9A; (-) strand; PAM type: NRG; PAM sequence: CAG
taccttagaggttgtagtaa

SEQ ID NO: 26476 - DNA, 20 bp, Artificial Sequence
  Description of Artificial Sequence: Synthetic oligonucleotide
  Target: SCN9A; (-) strand; PAM type: NRG; PAM sequence: TAG
tgtggctaccttagaggttg

SEQ ID NO: 26477 - DNA, 20 bp, Artificial Sequence
  Description of Artificial Sequence: Synthetic oligonucleotide
  Target: SCN9A; (-) strand; PAM type: NRG; PAM sequence: AGG
ggagtttgtggctaccttag

SEQ ID NO: 26478 - DNA, 20 bp, Artificial Sequence
  Description of Artificial Sequence: Synthetic oligonucleotide
  Target: SCN9A; (-) strand; PAM type: NRG; PAM sequence: GAG
aggagtttgtggctacctta

SEQ ID NO: 26479 - DNA, 20 bp, Artificial Sequence
  Description of Artificial Sequence: Synthetic oligonucleotide
  Target: SCN9A; (-) strand; PAM type: NRG; PAM sequence: TAG
acaggagtttgtggctacct

SEQ ID NO: 26480 - DNA, 20 bp, Artificial Sequence
  Description of Artificial Sequence: Synthetic oligonucleotide
  Target: SCN9A; (-) strand; PAM type: NRG; PAM sequence: TGG
attaaatatacaggagtttg

SEQ ID NO: 26481 - DNA, 20 bp, Artificial Sequence
  Description of Artificial Sequence: Synthetic oligonucleotide
  Target: SCN9A; (-) strand; PAM type: NRG; PAM sequence: GAG
atgcacaattaaatatacag

SEQ ID NO: 26482 - DNA, 20 bp, Artificial Sequence
  Description of Artificial Sequence: Synthetic oligonucleotide
  Target: SCN9A; (-) strand; PAM type: NRG; PAM sequence: AGG
gtatgcacaattaaatatac

SEQ ID NO: 26483 - DNA, 20 bp, Artificial Sequence
  Description of Artificial Sequence: Synthetic oligonucleotide
  Target: SCN9A; (-) strand; PAM type: NRG; PAM sequence: CAG
ggtatgcacaattaaatata

SEQ ID NO: 26484 - DNA, 20 bp, Artificial Sequence
  Description of Artificial Sequence: Synthetic oligonucleotide
  Target: SCN9A; (-) strand; PAM type: NRG; PAM sequence: TGG
cttactctattacatttcca

SEQ ID NO: 26485 - DNA, 20 bp, Artificial Sequence
  Description of Artificial Sequence: Synthetic oligonucleotide
  Target: SCN9A; (-) strand; PAM type: NRG; PAM sequence: GAG
gttatatctatatgataaaa

SEQ ID NO: 26486 - DNA, 20 bp, Artificial Sequence
  Description of Artificial Sequence: Synthetic oligonucleotide
  Target: SCN9A; (-) strand; PAM type: NRG; PAM sequence: AAG
tggttatatctatatgataa

SEQ ID NO: 26487 - DNA, 20 bp, Artificial Sequence
  Description of Artificial Sequence: Synthetic oligonucleotide
  Target: SCN9A; (-) strand; PAM type: NRG; PAM sequence: TGG
atttttttctcattacataa

SEQ ID NO: 26488 - DNA, 20 bp, Artificial Sequence
  Description of Artificial Sequence: Synthetic oligonucleotide
  Target: SCN9A; (-) strand; PAM type: NRG; PAM sequence: GAG
aatctagtgccctataaact

SEQ ID NO: 26489 - DNA, 20 bp, Artificial Sequence
  Description of Artificial Sequence: Synthetic oligonucleotide
  Target: SCN9A; (-) strand; PAM type: NRG; PAM sequence: TAG
ttccgaaagcgtatgaaatc

SEQ ID NO: 26490 - DNA, 20 bp, Artificial Sequence
  Description of Artificial Sequence: Synthetic oligonucleotide
  Target: SCN9A; (-) strand; PAM type: NRG; PAM sequence: AAG
tattccatgagcccttccga

SEQ ID NO: 26491 - DNA, 20 bp, Artificial Sequence
  Description of Artificial Sequence: Synthetic oligonucleotide
  Target: SCN9A; (-) strand; PAM type: NRG; PAM sequence: GAG
tactctgtcacttattccat

SEQ ID NO: 26492 - DNA, 20 bp, Artificial Sequence
  Description of Artificial Sequence: Synthetic oligonucleotide
  Target: SCN9A; (-) strand; PAM type: NRG; PAM sequence: TAG
tttgtattttataactgaaa

SEQ ID NO: 26493 - DNA, 20 bp, Artificial Sequence
  Description of Artificial Sequence: Synthetic oligonucleotide
  Target: SCN9A; (-) strand; PAM type: NRG; PAM sequence: TAG
ggttagctatcttttataac

SEQ ID NO: 26494 - DNA, 20 bp, Artificial Sequence
  Description of Artificial Sequence: Synthetic oligonucleotide
  Target: SCN9A; (-) strand; PAM type: NRG; PAM sequence: TAG
aggtgtgttgtcataatggt

SEQ ID NO: 26495 - DNA, 20 bp, Artificial Sequence
  Description of Artificial Sequence: Synthetic oligonucleotide
  Target: SCN9A; (-) strand; PAM type: NRG; PAM sequence: TGG
atgaaggtgtgttgtcataa

SEQ ID NO: 26496 - DNA, 20 bp, Artificial Sequence
  Description of Artificial Sequence: Synthetic oligonucleotide
  Target: SCN9A; (-) strand; PAM type: NRG; PAM sequence: AGG
tatctgtggcatgcagatga

SEQ ID NO: 26497 - DNA, 20 bp, Artificial Sequence
  Description of Artificial Sequence: Synthetic oligonucleotide
  Target: SCN9A; (-) strand; PAM type: NRG; PAM sequence: AAG
atatctgtggcatgcagatg

SEQ ID NO: 26498 - DNA, 20 bp, Artificial Sequence
  Description of Artificial Sequence: Synthetic oligonucleotide
  Target: SCN9A; (-) strand; PAM type: NRG; PAM sequence: CAG
atttatatatctgtggcatg

SEQ ID NO: 26499 - DNA, 20 bp, Artificial Sequence
  Description of Artificial Sequence: Synthetic oligonucleotide
  Target: SCN9A; (-) strand; PAM type: NRG; PAM sequence: TGG
ctatagaatttatatatctg

SEQ ID NO: 26500 - DNA, 20 bp, Artificial Sequence
  Description of Artificial Sequence: Synthetic oligonucleotide
  Target: SCN9A; (-) strand; PAM type: NRG; PAM sequence: TAG
ggtataaagccatgcagcta

SEQ ID NO: 26501 - DNA, 20 bp, Artificial Sequence
  Description of Artificial Sequence: Synthetic oligonucleotide
  Target: SCN9A; (-) strand; PAM type: NRG; PAM sequence: CAG
ccctggggtataaagccatg

SEQ ID NO: 26502 - DNA, 20 bp, Artificial Sequence
  Description of Artificial Sequence: Synthetic oligonucleotide
  Target: SCN9A; (-) strand; PAM type: NRG; PAM sequence: AAG
tttgtctcccctggggtata

SEQ ID NO: 26503 - DNA, 20 bp, Artificial Sequence
  Description of Artificial Sequence: Synthetic oligonucleotide
  Target: SCN9A; (-) strand; PAM type: NRG; PAM sequence: GGG
ttaataatttgtctcccctg

SEQ ID NO: 26504 - DNA, 20 bp, Artificial Sequence
  Description of Artificial Sequence: Synthetic oligonucleotide
  Target: SCN9A; (-) strand; PAM type: NRG; PAM sequence: GGG
cttaataatttgtctcccct

SEQ ID NO: 26505 - DNA, 20 bp, Artificial Sequence
  Description of Artificial Sequence: Synthetic oligonucleotide
  Target: SCN9A; (-) strand; PAM type: NRG; PAM sequence: TGG
acttaataatttgtctcccc

SEQ ID NO: 26506 - DNA, 20 bp, Artificial Sequence
  Description of Artificial Sequence: Synthetic oligonucleotide
  Target: SCN9A; (-) strand; PAM type: NRG; PAM sequence: TGG
cacaaaacaaacattcctat

SEQ ID NO: 26507 - DNA, 20 bp, Artificial Sequence
  Description of Artificial Sequence: Synthetic oligonucleotide
  Target: SCN9A; (-) strand; PAM type: NRG; PAM sequence: TGG
gcttgtgacttatagctcaa

SEQ ID NO: 26508 - DNA, 20 bp, Artificial Sequence
  Description of Artificial Sequence: Synthetic oligonucleotide
  Target: SCN9A; (-) strand; PAM type: NRG; PAM sequence: TAG
agtcctaggcttgtgactta

SEQ ID NO: 26509 - DNA, 20 bp, Artificial Sequence
  Description of Artificial Sequence: Synthetic oligonucleotide
  Target: SCN9A; (-) strand; PAM type: NRG; PAM sequence: AGG
agagccatgtcaagagtcct

SEQ ID NO: 26510 - DNA, 20 bp, Artificial Sequence
  Description of Artificial Sequence: Synthetic oligonucleotide
  Target: SCN9A; (-) strand; PAM type: NRG; PAM sequence: TAG
cagagccatgtcaagagtcc

SEQ ID NO: 26511 - DNA, 20 bp, Artificial Sequence
  Description of Artificial Sequence: Synthetic oligonucleotide
  Target: SCN9A; (-) strand; PAM type: NRG; PAM sequence: GAG
taaaggcagagccatgtcaa

SEQ ID NO: 26512 - DNA, 20 bp, Artificial Sequence
  Description of Artificial Sequence: Synthetic oligonucleotide
  Target: SCN9A; (-) strand; PAM type: NRG; PAM sequence: AAG
tataaaggcagagccatgtc

SEQ ID NO: 26513 - DNA, 20 bp, Artificial Sequence
  Description of Artificial Sequence: Synthetic oligonucleotide
  Target: SCN9A; (-) strand; PAM type: NRG; PAM sequence: GAG
gttatacagttataaaggca

SEQ ID NO: 26514 - DNA, 20 bp, Artificial Sequence
  Description of Artificial Sequence: Synthetic oligonucleotide
  Target: SCN9A; (-) strand; PAM type: NRG; PAM sequence: CAG
gagttatacagttataaagg

SEQ ID NO: 26515 - DNA, 20 bp, Artificial Sequence
  Description of Artificial Sequence: Synthetic oligonucleotide
  Target: SCN9A; (-) strand; PAM type: NRG; PAM sequence: AGG
atagagttatacagttataa

SEQ ID NO: 26516 - DNA, 20 bp, Artificial Sequence
  Description of Artificial Sequence: Synthetic oligonucleotide
  Target: SCN9A; (-) strand; PAM type: NRG; PAM sequence: AAG
tatagagttatacagttata

SEQ ID NO: 26517 - DNA, 20 bp, Artificial Sequence
  Description of Artificial Sequence: Synthetic oligonucleotide
  Target: SCN9A; (-) strand; PAM type: NRG; PAM sequence: CAG
tctagagttatagagttata

SEQ ID NO: 26518 - DNA, 20 bp, Artificial Sequence
  Description of Artificial Sequence: Synthetic oligonucleotide
  Target: SCN9A; (-) strand; PAM type: NRG; PAM sequence: GAG
gttataaatctagagttata

SEQ ID NO: 26519 - DNA, 20 bp, Artificial Sequence
  Description of Artificial Sequence: Synthetic oligonucleotide
  Target: SCN9A; (-) strand; PAM type: NRG; PAM sequence: TAG
cagttataaatctagagtta

SEQ ID NO: 26520 - DNA, 20 bp, Artificial Sequence
  Description of Artificial Sequence: Synthetic oligonucleotide
  Target: SCN9A; (-) strand; PAM type: NRG; PAM sequence: GAG
gttatacagttataaatcta

SEQ ID NO: 26521 - DNA, 20 bp, Artificial Sequence
  Description of Artificial Sequence: Synthetic oligonucleotide
  Target: SCN9A; (-) strand; PAM type: NRG; PAM sequence: TAG
gagttatacagttataaatc

SEQ ID NO: 26522 - DNA, 20 bp, Artificial Sequence
  Description of Artificial Sequence: Synthetic oligonucleotide
  Target: SCN9A; (-) strand; PAM type: NRG; PAM sequence: CAG
gttataaagctagagttata

SEQ ID NO: 26523 - DNA, 20 bp, Artificial Sequence
  Description of Artificial Sequence: Synthetic oligonucleotide
  Target: SCN9A; (-) strand; PAM type: NRG; PAM sequence: GAG
tattcacagttataaagcta

SEQ ID NO: 26524 - DNA, 20 bp, Artificial Sequence
  Description of Artificial Sequence: Synthetic oligonucleotide
  Target: SCN9A; (-) strand; PAM type: NRG; PAM sequence: TAG
tttattcacagttataaagc

SEQ ID NO: 26525 - DNA, 20 bp, Artificial Sequence
  Description of Artificial Sequence: Synthetic oligonucleotide
  Target: SCN9A; (-) strand; PAM type: NRG; PAM sequence: AAG
tgattttattcacagttata

SEQ ID NO: 26526 - DNA, 20 bp, Artificial Sequence
  Description of Artificial Sequence: Synthetic oligonucleotide
  Target: SCN9A; (-) strand; PAM type: NRG; PAM sequence: CAG
aaaggaagtgattttattca

SEQ ID NO: 26527 - DNA, 20 bp, Artificial Sequence
  Description of Artificial Sequence: Synthetic oligonucleotide
  Target: SCN9A; (-) strand; PAM type: NRG; PAM sequence: AAG
aaagcagactcattaaaagg

SEQ ID NO: 26528 - DNA, 20 bp, Artificial Sequence
  Description of Artificial Sequence: Synthetic oligonucleotide
  Target: SCN9A; (-) strand; PAM type: NRG; PAM sequence: AGG
gaaaaagcagactcattaaa

SEQ ID NO: 26529 - DNA, 20 bp, Artificial Sequence
  Description of Artificial Sequence: Synthetic oligonucleotide
  Target: SCN9A; (-) strand; PAM type: NRG; PAM sequence: AAG
tgaaaaagcagactcattaa

SEQ ID NO: 26530 - DNA, 20 bp, Artificial Sequence
  Description of Artificial Sequence: Synthetic oligonucleotide
  Target: SCN9A; (-) strand; PAM type: NRG; PAM sequence: CAG
tcattttctaactgaaaaag

SEQ ID NO: 26531 - DNA, 20 bp, Artificial Sequence
  Description of Artificial Sequence: Synthetic oligonucleotide
  Target: SCN9A; (-) strand; PAM type: NRG; PAM sequence: AAG
acttcattttctaactgaaa

SEQ ID NO: 26532 - DNA, 20 bp, Artificial Sequence
  Description of Artificial Sequence: Synthetic oligonucleotide
  Target: SCN9A; (-) strand; PAM type: NRG; PAM sequence: TAG
accttatagaactttccatt

SEQ ID NO: 26533 - DNA, 20 bp, Artificial Sequence
  Description of Artificial Sequence: Synthetic oligonucleotide
  Target: SCN9A; (-) strand; PAM type: NRG; PAM sequence: TAG
acatttttaagggaacctta

SEQ ID NO: 26534 - DNA, 20 bp, Artificial Sequence
  Description of Artificial Sequence: Synthetic oligonucleotide
  Target: SCN9A; (-) strand; PAM type: NRG; PAM sequence: GGG
ttgagttgcaacatttttaa

SEQ ID NO: 26535 - DNA, 20 bp, Artificial Sequence
  Description of Artificial Sequence: Synthetic oligonucleotide
  Target: SCN9A; (-) strand; PAM type: NRG; PAM sequence: AGG
gttgagttgcaacattttta

SEQ ID NO: 26536 - DNA, 20 bp, Artificial Sequence
  Description of Artificial Sequence: Synthetic oligonucleotide
  Target: SCN9A; (-) strand; PAM type: NRG; PAM sequence: AAG
tgttgagttgcaacattttt

SEQ ID NO: 26537 - DNA, 20 bp, Artificial Sequence
  Description of Artificial Sequence: Synthetic oligonucleotide
  Target: SCN9A; (-) strand; PAM type: NRG; PAM sequence: GAG
attcttattcttagtatgtt

SEQ ID NO: 26538 - DNA, 20 bp, Artificial Sequence
  Description of Artificial Sequence: Synthetic oligonucleotide
  Target: SCN9A; (-) strand; PAM type: NRG; PAM sequence: TAG
gctgacaaaattcttattct

SEQ ID NO: 26539 - DNA, 20 bp, Artificial Sequence
  Description of Artificial Sequence: Synthetic oligonucleotide
  Target: SCN9A; (-) strand; PAM type: NRG; PAM sequence: TAG
tgacctttcatggatctcct

SEQ ID NO: 26540 - DNA, 20 bp, Artificial Sequence
  Description of Artificial Sequence: Synthetic oligonucleotide
  Target: SCN9A; (-) strand; PAM type: NRG; PAM sequence: TGG
agtcaatggctgacctttca

SEQ ID NO: 26541 - DNA, 20 bp, Artificial Sequence
  Description of Artificial Sequence: Synthetic oligonucleotide
  Target: SCN9A; (-) strand; PAM type: NRG; PAM sequence: TGG
tttctttcatttaaagtcaa

SEQ ID NO: 26542 - DNA, 20 bp, Artificial Sequence
  Description of Artificial Sequence: Synthetic oligonucleotide
  Target: SCN9A; (-) strand; PAM type: NRG; PAM sequence: AAG
gttcatttttctttcattta

SEQ ID NO: 26543 - DNA, 20 bp, Artificial Sequence
  Description of Artificial Sequence: Synthetic oligonucleotide
  Target: SCN9A; (-) strand; PAM type: NRG; PAM sequence: AGG
attatttcttaacatttatg

SEQ ID NO: 26544 - DNA, 20 bp, Artificial Sequence
  Description of Artificial Sequence: Synthetic oligonucleotide
  Target: SCN9A; (-) strand; PAM type: NRG; PAM sequence: GAG
aattatttcttaacatttat

SEQ ID NO: 26545 - DNA, 20 bp, Artificial Sequence
  Description of Artificial Sequence: Synthetic oligonucleotide
  Target: SCN9A; (-) strand; PAM type: NRG; PAM sequence: AAG
gagctggggaaagtcaacca

SEQ ID NO: 26546 - DNA, 20 bp, Artificial Sequence
  Description of Artificial Sequence: Synthetic oligonucleotide
  Target: SCN9A; (-) strand; PAM type: NRG; PAM sequence: AAG
agcacttcaggagctgggga

SEQ ID NO: 26547 - DNA, 20 bp, Artificial Sequence
  Description of Artificial Sequence: Synthetic oligonucleotide
  Target: SCN9A; (-) strand; PAM type: NRG; PAM sequence: GGG
ttaaagcacttcaggagctg

SEQ ID NO: 26548 - DNA, 20 bp, Artificial Sequence
  Description of Artificial Sequence: Synthetic oligonucleotide
  Target: SCN9A; (-) strand; PAM type: NRG; PAM sequence: GGG
gttaaagcacttcaggagct

SEQ ID NO: 26549 - DNA, 20 bp, Artificial Sequence
  Description of Artificial Sequence: Synthetic oligonucleotide
  Target: SCN9A; (-) strand; PAM type: NRG; PAM sequence: TGG
tgttaaagcacttcaggagc

SEQ ID NO: 26550 - DNA, 20 bp, Artificial Sequence
  Description of Artificial Sequence: Synthetic oligonucleotide
  Target: SCN9A; (-) strand; PAM type: NRG; PAM sequence: GAG
taggtgttaaagcacttcag

SEQ ID NO: 26551 - DNA, 20 bp, Artificial Sequence
  Description of Artificial Sequence: Synthetic oligonucleotide
  Target: SCN9A; (-) strand; PAM type: NRG; PAM sequence: AGG
tctaggtgttaaagcacttc

SEQ ID NO: 26552 - DNA, 20 bp, Artificial Sequence
  Description of Artificial Sequence: Synthetic oligonucleotide
  Target: SCN9A; (-) strand; PAM type: NRG; PAM sequence: CAG
ttctaggtgttaaagcactt

SEQ ID NO: 26553 - DNA, 20 bp, Artificial Sequence
  Description of Artificial Sequence: Synthetic oligonucleotide
  Target: SCN9A; (-) strand; PAM type: NRG; PAM sequence: AAG
aacttggattctaggtgtta

SEQ ID NO: 26554 - DNA, 20 bp, Artificial Sequence
  Description of Artificial Sequence: Synthetic oligonucleotide
  Target: SCN9A; (-) strand; PAM type: NRG; PAM sequence: AGG
cagaataaaacttggattct

SEQ ID NO: 26555 - DNA, 20 bp, Artificial Sequence
  Description of Artificial Sequence: Synthetic oligonucleotide
  Target: SCN9A; (-) strand; PAM type: NRG; PAM sequence: TAG
tcagaataaaacttggattc

SEQ ID NO: 26556 - DNA, 20 bp, Artificial Sequence
  Description of Artificial Sequence: Synthetic oligonucleotide
  Target: SCN9A; (-) strand; PAM type: NRG; PAM sequence: TGG
gttgctctcagaataaaact

SEQ ID NO: 26557 - DNA, 20 bp, Artificial Sequence
  Description of Artificial Sequence: Synthetic oligonucleotide
  Target: SCN9A; (-) strand; PAM type: NRG; PAM sequence: CAG
gcctggcagacagttgctct

SEQ ID NO: 26558 - DNA, 20 bp, Artificial Sequence
  Description of Artificial Sequence: Synthetic oligonucleotide
  Target: SCN9A; (-) strand; PAM type: NRG; PAM sequence: CAG
aactccaattgcctggcaga

SEQ ID NO: 26559 - DNA, 20 bp, Artificial Sequence
  Description of Artificial Sequence: Synthetic oligonucleotide
  Target: SCN9A; (-) strand; PAM type: NRG; PAM sequence: CAG
tataaactccaattgcctgg

SEQ ID NO: 26560 - DNA, 20 bp, Artificial Sequence
  Description of Artificial Sequence: Synthetic oligonucleotide
  Target: SCN9A; (-) strand; PAM type: NRG; PAM sequence: TGG
aattataaactccaattgcc

SEQ ID NO: 26561 - DNA, 20 bp, Artificial Sequence
  Description of Artificial Sequence: Synthetic oligonucleotide
  Target: SCN9A; (-) strand; PAM type: NRG; PAM sequence: AAG
actctgtcacccatttaaag

SEQ ID NO: 26562 - DNA, 20 bp, Artificial Sequence
  Description of Artificial Sequence: Synthetic oligonucleotide
  Target: SCN9A; (-) strand; PAM type: NRG; PAM sequence: AAG
ctaactctgtcacccattta

SEQ ID NO: 26563 - DNA, 20 bp, Artificial Sequence
  Description of Artificial Sequence: Synthetic oligonucleotide
  Target: SCN9A; (-) strand; PAM type: NRG; PAM sequence: CAG
tatggaaagggaaactaact

SEQ ID NO: 26564 - DNA, 20 bp, Artificial Sequence
  Description of Artificial Sequence: Synthetic oligonucleotide
  Target: SCN9A; (-) strand; PAM type: NRG; PAM sequence: GGG
ggtttagtatcatatggaaa

SEQ ID NO: 26565 - DNA, 20 bp, Artificial Sequence
  Description of Artificial Sequence: Synthetic oligonucleotide
  Target: SCN9A; (-) strand; PAM type: NRG; PAM sequence: AGG
aggtttagtatcatatggaa

SEQ ID NO: 26566 - DNA, 20 bp, Artificial Sequence
  Description of Artificial Sequence: Synthetic oligonucleotide
  Target: SCN9A; (-) strand; PAM type: NRG; PAM sequence: AAG
taggtttagtatcatatgga

SEQ ID NO: 26567 - DNA, 20 bp, Artificial Sequence
  Description of Artificial Sequence: Synthetic oligonucleotide
  Target: SCN9A; (-) strand; PAM type: NRG; PAM sequence: TGG
catctaggtttagtatcata

SEQ ID NO: 26568 - DNA, 20 bp, Artificial Sequence
  Description of Artificial Sequence: Synthetic oligonucleotide
  Target: SCN9A; (-) strand; PAM type: NRG; PAM sequence: TAG
aaggagcaggcatctaggtt

SEQ ID NO: 26569 - DNA, 20 bp, Artificial Sequence
  Description of Artificial Sequence: Synthetic oligonucleotide
  Target: SCN9A; (-) strand; PAM type: NRG; PAM sequence: AGG
cttttaaggagcaggcatct

SEQ ID NO: 26570 - DNA, 20 bp, Artificial Sequence
  Description of Artificial Sequence: Synthetic oligonucleotide
  Target: SCN9A; (-) strand; PAM type: NRG; PAM sequence: TAG
ccttttaaggagcaggcatc

SEQ ID NO: 26571 - DNA, 20 bp, Artificial Sequence
  Description of Artificial Sequence: Synthetic oligonucleotide
  Target: SCN9A; (-) strand; PAM type: NRG; PAM sequence: AGG
acgtatgccttttaaggagc

SEQ ID NO: 26572 - DNA, 20 bp, Artificial Sequence
  Description of Artificial Sequence: Synthetic oligonucleotide
  Target: SCN9A; (-) strand; PAM type: NRG; PAM sequence: CAG
cacgtatgccttttaaggag

SEQ ID NO: 26573 - DNA, 20 bp, Artificial Sequence
  Description of Artificial Sequence: Synthetic oligonucleotide
  Target: SCN9A; (-) strand; PAM type: NRG; PAM sequence: GAG
ttccacgtatgccttttaag

SEQ ID NO: 26574 - DNA, 20 bp, Artificial Sequence
  Description of Artificial Sequence: Synthetic oligonucleotide
  Target: SCN9A; (-) strand; PAM type: NRG; PAM sequence: AGG
gattccacgtatgcctttta

SEQ ID NO: 26575 - DNA, 20 bp, Artificial Sequence
  Description of Artificial Sequence: Synthetic oligonucleotide
  Target: SCN9A; (-) strand; PAM type: NRG; PAM sequence: AAG
agattccacgtatgcctttt

SEQ ID NO: 26576 - DNA, 20 bp, Artificial Sequence
  Description of Artificial Sequence: Synthetic oligonucleotide
  Target: SCN9A; (-) strand; PAM type: NRG; PAM sequence: CAG
tcagcttaaagttagaaaat

SEQ ID NO: 26577 - DNA, 20 bp, Artificial Sequence
  Description of Artificial Sequence: Synthetic oligonucleotide
  Target: SCN9A; (-) strand; PAM type: NRG; PAM sequence: TAG
tgttcatttcagcttaaagt

SEQ ID NO: 26578 - DNA, 20 bp, Artificial Sequence
  Description of Artificial Sequence: Synthetic oligonucleotide
  Target: SCN9A; (-) strand; PAM type: NRG; PAM sequence: AAG
accgtgttcatttcagctta

SEQ ID NO: 26579 - DNA, 20 bp, Artificial Sequence
  Description of Artificial Sequence: Synthetic oligonucleotide
  Target: SCN9A; (-) strand; PAM type: NRG; PAM sequence: CAG
ttttaaaaccgtgttcattt

SEQ ID NO: 26580 - DNA, 20 bp, Artificial Sequence
  Description of Artificial Sequence: Synthetic oligonucleotide
  Target: SCN9A; (-) strand; PAM type: NRG; PAM sequence: AAG
taaaatgttctacatggaag

SEQ ID NO: 26581 - DNA, 20 bp, Artificial Sequence
  Description of Artificial Sequence: Synthetic oligonucleotide
  Target: SCN9A; (-) strand; PAM type: NRG; PAM sequence: AAG
ttttaaaatgttctacatgg

SEQ ID NO: 26582 - DNA, 20 bp, Artificial Sequence
  Description of Artificial Sequence: Synthetic oligonucleotide
  Target: SCN9A; (-) strand; PAM type: NRG; PAM sequence: TGG
atattttaaaatgttctaca

SEQ ID NO: 26583 - DNA, 20 bp, Artificial Sequence
  Description of Artificial Sequence: Synthetic oligonucleotide
  Target: SCN9A; (-) strand; PAM type: NRG; PAM sequence: CAG
gacccagggatacagaaggc

SEQ ID NO: 26584 - DNA, 20 bp, Artificial Sequence
  Description of Artificial Sequence: Synthetic oligonucleotide
  Target: SCN9A; (-) strand; PAM type: NRG; PAM sequence: AGG
gtgggacccagggatacaga

SEQ ID NO: 26585 - DNA, 20 bp, Artificial Sequence
  Description of Artificial Sequence: Synthetic oligonucleotide
  Target: SCN9A; (-) strand; PAM type: NRG; PAM sequence: AAG
tgtgggacccagggatacag

SEQ ID NO: 26586 - DNA, 20 bp, Artificial Sequence
  Description of Artificial Sequence: Synthetic oligonucleotide
  Target: SCN9A; (-) strand; PAM type: NRG; PAM sequence: CAG
agatgtgggacccagggata

SEQ ID NO: 26587 - DNA, 20 bp, Artificial Sequence
  Description of Artificial Sequence: Synthetic oligonucleotide
  Target: SCN9A; (-) strand; PAM type: NRG; PAM sequence: GGG
ctctacagatgtgggaccca

SEQ ID NO: 26588 - DNA, 20 bp, Artificial Sequence
  Description of Artificial Sequence: Synthetic oligonucleotide
  Target: SCN9A; (-) strand; PAM type: NRG; PAM sequence: AGG
actctacagatgtgggaccc

SEQ ID NO: 26589 - DNA, 20 bp, Artificial Sequence
  Description of Artificial Sequence: Synthetic oligonucleotide
  Target: SCN9A; (-) strand; PAM type: NRG; PAM sequence: CAG
gactctacagatgtgggacc

SEQ ID NO: 26590 - DNA, 20 bp, Artificial Sequence
  Description of Artificial Sequence: Synthetic oligonucleotide
  Target: SCN9A; (-) strand; PAM type: NRG; PAM sequence: GGG
ttggttgactctacagatgt

SEQ ID NO: 26591 - DNA, 20 bp, Artificial Sequence
  Description of Artificial Sequence: Synthetic oligonucleotide
  Target: SCN9A; (-) strand; PAM type: NRG; PAM sequence: TGG
gttggttgactctacagatg

SEQ ID NO: 26592 - DNA, 20 bp, Artificial Sequence
  Description of Artificial Sequence: Synthetic oligonucleotide
  Target: SCN9A; (-) strand; PAM type: NRG; PAM sequence: CAG
tctgtagttggttgactcta

SEQ ID NO: 26593 - DNA, 20 bp, Artificial Sequence
  Description of Artificial Sequence: Synthetic oligonucleotide
  Target: SCN9A; (-) strand; PAM type: NRG; PAM sequence: TGG
aattattttccatctgtagt

SEQ ID NO: 26594 - DNA, 20 bp, Artificial Sequence
  Description of Artificial Sequence: Synthetic oligonucleotide
  Target: SCN9A; (-) strand; PAM type: NRG; PAM sequence: TAG
ttccaattattttccatctg

SEQ ID NO: 26595 - DNA, 20 bp, Artificial Sequence
  Description of Artificial Sequence: Synthetic oligonucleotide
  Target: SCN9A; (-) strand; PAM type: NRG; PAM sequence: AAG
tcagattacttataatgtaa

SEQ ID NO: 26596 - DNA, 20 bp, Artificial Sequence
  Description of Artificial Sequence: Synthetic oligonucleotide
  Target: SCN9A; (-) strand; PAM type: NRG; PAM sequence: CAG
tgtacactttaaattatctt

SEQ ID NO: 26597 - DNA, 20 bp, Artificial Sequence
  Description of Artificial Sequence: Synthetic oligonucleotide
  Target: SCN9A; (-) strand; PAM type: NRG; PAM sequence: TGG
ctcaattcctttatataaaa

SEQ ID NO: 26598 - DNA, 20 bp, Artificial Sequence
  Description of Artificial Sequence: Synthetic oligonucleotide
  Target: SCN9A; (-) strand; PAM type: NRG; PAM sequence: CAG
cccacagagactaaaatctg

SEQ ID NO: 26599 - DNA, 20 bp, Artificial Sequence
  Description of Artificial Sequence: Synthetic oligonucleotide
  Target: SCN9A; (-) strand; PAM type: NRG; PAM sequence: GAG
tagtttgaaggccccccaca

SEQ ID NO: 26600 - DNA, 20 bp, Artificial Sequence
  Description of Artificial Sequence: Synthetic oligonucleotide
  Target: SCN9A; (-) strand; PAM type: NRG; PAM sequence: CAG
agtagtttgaaggcccccca

SEQ ID NO: 26601 - DNA, 20 bp, Artificial Sequence
  Description of Artificial Sequence: Synthetic oligonucleotide
  Target: SCN9A; (-) strand; PAM type: NRG; PAM sequence: AGG
tctatgggcgagtagtttga

SEQ ID NO: 26602 - DNA, 20 bp, Artificial Sequence
  Description of Artificial Sequence: Synthetic oligonucleotide
  Target: SCN9A; (-) strand; PAM type: NRG; PAM sequence: AAG
atctatgggcgagtagtttg

SEQ ID NO: 26603 - DNA, 20 bp, Artificial Sequence
  Description of Artificial Sequence: Synthetic oligonucleotide
  Target: SCN9A; (-) strand; PAM type: NRG; PAM sequence: TAG
cctcgatatctatgggcgag

SEQ ID NO: 26604 - DNA, 20 bp, Artificial Sequence
  Description of Artificial Sequence: Synthetic oligonucleotide
  Target: SCN9A; (-) strand; PAM type: NRG; PAM sequence: GAG
atccctcgatatctatgggc

SEQ ID NO: 26605 - DNA, 20 bp, Artificial Sequence
  Description of Artificial Sequence: Synthetic oligonucleotide
  Target: SCN9A; (-) strand; PAM type: NRG; PAM sequence: GGG
agtcatccctcgatatctat

SEQ ID NO: 26606 - DNA, 20 bp, Artificial Sequence
  Description of Artificial Sequence: Synthetic oligonucleotide
  Target: SCN9A; (-) strand; PAM type: NRG; PAM sequence: TGG
tagtcatccctcgatatcta

SEQ ID NO: 26607 - DNA, 20 bp, Artificial Sequence
  Description of Artificial Sequence: Synthetic oligonucleotide
  Target: SCN9A; (-) strand; PAM type: NRG; PAM sequence: TAG
gtaaagtaaggaatcaaatc

SEQ ID NO: 26608 - DNA, 20 bp, Artificial Sequence
  Description of Artificial Sequence: Synthetic oligonucleotide
  Target: SCN9A; (-) strand; PAM type: NRG; PAM sequence: AGG
ttttccaagacggtaaagta

SEQ ID NO: 26609 - DNA, 20 bp, Artificial Sequence
  Description of Artificial Sequence: Synthetic oligonucleotide
  Target: SCN9A; (-) strand; PAM type: NRG; PAM sequence: AAG
tttttccaagacggtaaagt

SEQ ID NO: 26610 - DNA, 20 bp, Artificial Sequence
  Description of Artificial Sequence: Synthetic oligonucleotide
  Target: SCN9A; (-) strand; PAM type: NRG; PAM sequence: AAG
acattttttccaagacggta

SEQ ID NO: 26611 - DNA, 20 bp, Artificial Sequence
  Description of Artificial Sequence: Synthetic oligonucleotide
  Target: SCN9A; (-) strand; PAM type: NRG; PAM sequence: CGG
caaggacattttttccaaga

SEQ ID NO: 26612 - DNA, 20 bp, Artificial Sequence
  Description of Artificial Sequence: Synthetic oligonucleotide
  Target: SCN9A; (-) strand; PAM type: NRG; PAM sequence: AAG
tagccaaggacattttttcc

SEQ ID NO: 26613 - DNA, 20 bp, Artificial Sequence
  Description of Artificial Sequence: Synthetic oligonucleotide
  Target: SCN9A; (-) strand; PAM type: NRG; PAM sequence: AGG
tatatgtttctatgtagcca

SEQ ID NO: 26614 - DNA, 20 bp, Artificial Sequence
  Description of Artificial Sequence: Synthetic oligonucleotide
  Target: SCN9A; (-) strand; PAM type: NRG; PAM sequence: AAG
atatatgtttctatgtagcc

SEQ ID NO: 26615 - DNA, 20 bp, Artificial Sequence
  Description of Artificial Sequence: Synthetic oligonucleotide
  Target: SCN9A; (-) strand; PAM type: NRG; PAM sequence: TAG
tcatgatatatgtttctatg

SEQ ID NO: 26616 - DNA, 20 bp, Artificial Sequence
  Description of Artificial Sequence: Synthetic oligonucleotide
  Target: SCN9A; (-) strand; PAM type: NRG; PAM sequence: GAG
aaaatgctctatatttaatt

SEQ ID NO: 26617 - DNA, 20 bp, Artificial Sequence
  Description of Artificial Sequence: Synthetic oligonucleotide
  Target: SCN9A; (-) strand; PAM type: NRG; PAM sequence: AAG
taagattaaattaaatacat

SEQ ID NO: 26618 - DNA, 20 bp, Artificial Sequence
  Description of Artificial Sequence: Synthetic oligonucleotide
  Target: SCN9A; (-) strand; PAM type: NRG; PAM sequence: AAG
ctcaaaaaaaatcaatacat

SEQ ID NO: 26619 - DNA, 20 bp, Artificial Sequence
  Description of Artificial Sequence: Synthetic oligonucleotide
  Target: SCN9A; (-) strand; PAM type: NRG; PAM sequence: GAG
tccagcttggactacagagt

SEQ ID NO: 26620 - DNA, 20 bp, Artificial Sequence
  Description of Artificial Sequence: Synthetic oligonucleotide
  Target: SCN9A; (-) strand; PAM type: NRG; PAM sequence: GAG
gcactccagcttggactaca

SEQ ID NO: 26621 - DNA, 20 bp, Artificial Sequence
  Description of Artificial Sequence: Synthetic oligonucleotide
  Target: SCN9A; (-) strand; PAM type: NRG; PAM sequence: CAG
ctgcactccagcttggacta

SEQ ID NO: 26622 - DNA, 20 bp, Artificial Sequence
  Description of Artificial Sequence: Synthetic oligonucleotide
  Target: SCN9A; (-) strand; PAM type: NRG; PAM sequence: TGG
cgcaccgctgcactccagct

SEQ ID NO: 26623 - DNA, 20 bp, Artificial Sequence
  Description of Artificial Sequence: Synthetic oligonucleotide
  Target: SCN9A; (-) strand; PAM type: NRG; PAM sequence: CAG
aagatcgcaccgctgcactc

SEQ ID NO: 26624 - DNA, 20 bp, Artificial Sequence
  Description of Artificial Sequence: Synthetic oligonucleotide
  Target: SCN9A; (-) strand; PAM type: NRG; PAM sequence: AAG
ggcggaggttgcagtaagcc

SEQ ID NO: 26625 - DNA, 20 bp, Artificial Sequence
  Description of Artificial Sequence: Synthetic oligonucleotide
  Target: SCN9A; (-) strand; PAM type: NRG; PAM sequence: AAG
ccagaggcggaggttgcagt

SEQ ID NO: 26626 - DNA, 20 bp, Artificial Sequence
  Description of Artificial Sequence: Synthetic oligonucleotide
  Target: SCN9A; (-) strand; PAM type: NRG; PAM sequence: CAG
agctccagaggcggaggttg

SEQ ID NO: 26627 - DNA, 20 bp, Artificial Sequence
  Description of Artificial Sequence: Synthetic oligonucleotide
  Target: SCN9A; (-) strand; PAM type: NRG; PAM sequence: AGG
cacttgagctccagaggcgg

SEQ ID NO: 26628 - DNA, 20 bp, Artificial Sequence
  Description of Artificial Sequence: Synthetic oligonucleotide
  Target: SCN9A; (-) strand; PAM type: NRG; PAM sequence: GAG
tcacttgagctccagaggcg

SEQ ID NO: 26629 - DNA, 20 bp, Artificial Sequence
  Description of Artificial Sequence: Synthetic oligonucleotide
  Target: SCN9A; (-) strand; PAM type: NRG; PAM sequence: CGG
aatcacttgagctccagagg

SEQ ID NO: 26630 - DNA, 20 bp, Artificial Sequence
  Description of Artificial Sequence: Synthetic oligonucleotide
  Target: SCN9A; (-) strand; PAM type: NRG; PAM sequence: AGG
gagaatcacttgagctccag

SEQ ID NO: 26631 - DNA, 20 bp, Artificial Sequence
  Description of Artificial Sequence: Synthetic oligonucleotide
  Target: SCN9A; (-) strand; PAM type: NRG; PAM sequence: GAG
tgagaatcacttgagctcca

SEQ ID NO: 26632 - DNA, 20 bp, Artificial Sequence
  Description of Artificial Sequence: Synthetic oligonucleotide
  Target: SCN9A; (-) strand; PAM type: NRG; PAM sequence: CAG
catgagaatcacttgagctc

SEQ ID NO: 26633 - DNA, 20 bp, Artificial Sequence
  Description of Artificial Sequence: Synthetic oligonucleotide
  Target: SCN9A; (-) strand; PAM type: NRG; PAM sequence: GAG
ctgaggcatgagaatcactt

SEQ ID NO: 26634 - DNA, 20 bp, Artificial Sequence
  Description of Artificial Sequence: Synthetic oligonucleotide
  Target: SCN9A; (-) strand; PAM type: NRG; PAM sequence: GAG
tgctcaggaggctgaggcat

SEQ ID NO: 26635 - DNA, 20 bp, Artificial Sequence
  Description of Artificial Sequence: Synthetic oligonucleotide
  Target: SCN9A; (-) strand; PAM type: NRG; PAM sequence: AGG
gtaaaatgctcaggaggctg

SEQ ID NO: 26636 - DNA, 20 bp, Artificial Sequence
  Description of Artificial Sequence: Synthetic oligonucleotide
  Target: SCN9A; (-) strand; PAM type: NRG; PAM sequence: GAG
agtaaaatgctcaggaggct

SEQ ID NO: 26637 - DNA, 20 bp, Artificial Sequence
  Description of Artificial Sequence: Synthetic oligonucleotide
  Target: SCN9A; (-) strand; PAM type: NRG; PAM sequence: AGG
atatcagtaaaatgctcagg

SEQ ID NO: 26638 - DNA, 20 bp, Artificial Sequence
  Description of Artificial Sequence: Synthetic oligonucleotide
  Target: SCN9A; (-) strand; PAM type: NRG; PAM sequence: GAG
tatatcagtaaaatgctcag

SEQ ID NO: 26639 - DNA, 20 bp, Artificial Sequence
  Description of Artificial Sequence: Synthetic oligonucleotide
  Target: SCN9A; (-) strand; PAM type: NRG; PAM sequence: AGG
tatatatcagtaaaatgctc

SEQ ID NO: 26640 - DNA, 20 bp, Artificial Sequence
  Description of Artificial Sequence: Synthetic oligonucleotide
  Target: SCN9A; (-) strand; PAM type: NRG; PAM sequence: CAG
atatatatcagtaaaatgct

SEQ ID NO: 26641 - DNA, 20 bp, Artificial Sequence
  Description of Artificial Sequence: Synthetic oligonucleotide
  Target: SCN9A; (-) strand; PAM type: NRG; PAM sequence: CAG
atatatatatatatatatat

SEQ ID NO: 26642 - DNA, 20 bp, Artificial Sequence
  Description of Artificial Sequence: Synthetic oligonucleotide
  Target: SCN9A; (-) strand; PAM type: NRG; PAM sequence: TGG
acttggaaaacgagattata

SEQ ID NO: 26643 - DNA, 20 bp, Artificial Sequence
  Description of Artificial Sequence: Synthetic oligonucleotide
  Target: SCN9A; (-) strand; PAM type: NRG; PAM sequence: GAG
ttatagtggacttggaaaac

SEQ ID NO: 26644 - DNA, 20 bp, Artificial Sequence
  Description of Artificial Sequence: Synthetic oligonucleotide
  Target: SCN9A; (-) strand; PAM type: NRG; PAM sequence: TGG
ccatgaatttatagtggact

SEQ ID NO: 26645 - DNA, 20 bp, Artificial Sequence
  Description of Artificial Sequence: Synthetic oligonucleotide
  Target: SCN9A; (-) strand; PAM type: NRG; PAM sequence: TGG
caccctccatgaatttatag

SEQ ID NO: 26646 - DNA, 20 bp, Artificial Sequence
  Description of Artificial Sequence: Synthetic oligonucleotide
  Target: SCN9A; (-) strand; PAM type: NRG; PAM sequence: TAG
ctccaccctccatgaattta

SEQ ID NO: 26647 - DNA, 20 bp, Artificial Sequence
  Description of Artificial Sequence: Synthetic oligonucleotide
  Target: SCN9A; (-) strand; PAM type: NRG; PAM sequence: AAG
ttctatctccttaacttact

SEQ ID NO: 26648 - DNA, 20 bp, Artificial Sequence
  Description of Artificial Sequence: Synthetic oligonucleotide
  Target: SCN9A; (-) strand; PAM type: NRG; PAM sequence: CAG
tcatgttagaaagtatttga

SEQ ID NO: 26649 - DNA, 20 bp, Artificial Sequence
  Description of Artificial Sequence: Synthetic oligonucleotide
  Target: SCN9A; (-) strand; PAM type: NRG; PAM sequence: AAG
tttctctagctcatgttaga

SEQ ID NO: 26650 - DNA, 20 bp, Artificial Sequence
  Description of Artificial Sequence: Synthetic oligonucleotide
  Target: SCN9A; (-) strand; PAM type: NRG; PAM sequence: TAG
ttgttttctctagctcatgt

SEQ ID NO: 26651 - DNA, 20 bp, Artificial Sequence
  Description of Artificial Sequence: Synthetic oligonucleotide
  Target: SCN9A; (-) strand; PAM type: NRG; PAM sequence: TAG
aaataatcttttgttttctc

SEQ ID NO: 26652 - DNA, 20 bp, Artificial Sequence
  Description of Artificial Sequence: Synthetic oligonucleotide
  Target: SCN9A; (-) strand; PAM type: NRG; PAM sequence: AGG
gagattgctttcaagtctta

SEQ ID NO: 26653 - DNA, 20 bp, Artificial Sequence
  Description of Artificial Sequence: Synthetic oligonucleotide
  Target: SCN9A; (-) strand; PAM type: NRG; PAM sequence: AAG
tgagattgctttcaagtctt

SEQ ID NO: 26654 - DNA, 20 bp, Artificial Sequence
  Description of Artificial Sequence: Synthetic oligonucleotide
  Target: SCN9A; (-) strand; PAM type: NRG; PAM sequence: AAG
acttttatgagattgctttc

SEQ ID NO: 26655 - DNA, 20 bp, Artificial Sequence
  Description of Artificial Sequence: Synthetic oligonucleotide
  Target: SCN9A; (-) strand; PAM type: NRG; PAM sequence: GAG
gtattacaaattacttttat

SEQ ID NO: 26656 - DNA, 20 bp, Artificial Sequence
  Description of Artificial Sequence: Synthetic oligonucleotide
  Target: SCN9A; (-) strand; PAM type: NRG; PAM sequence: GAG
agtgagtcaaggtatgtatt

SEQ ID NO: 26657 - DNA, 20 bp, Artificial Sequence
  Description of Artificial Sequence: Synthetic oligonucleotide
  Target: SCN9A; (-) strand; PAM type: NRG; PAM sequence: AGG
tgcatatttctagtgagtca

SEQ ID NO: 26658 - DNA, 20 bp, Artificial Sequence
  Description of Artificial Sequence: Synthetic oligonucleotide
  Target: SCN9A; (-) strand; PAM type: NRG; PAM sequence: AAG
ctgcatatttctagtgagtc

SEQ ID NO: 26659 - DNA, 20 bp, Artificial Sequence
  Description of Artificial Sequence: Synthetic oligonucleotide
  Target: SCN9A; (-) strand; PAM type: NRG; PAM sequence: GAG
cttacctgcatatttctagt

SEQ ID NO: 26660 - DNA, 20 bp, Artificial Sequence
  Description of Artificial Sequence: Synthetic oligonucleotide
  Target: SCN9A; (-) strand; PAM type: NRG; PAM sequence: TAG
cacccttacctgcatatttc

SEQ ID NO: 26661 - DNA, 20 bp, Artificial Sequence
  Description of Artificial Sequence: Synthetic oligonucleotide
  Target: SCN9A; (-) strand; PAM type: NRG; PAM sequence: AGG
actgtaaattcattgagaac

SEQ ID NO: 26662 - DNA, 20 bp, Artificial Sequence
  Description of Artificial Sequence: Synthetic oligonucleotide
  Target: SCN9A; (-) strand; PAM type: NRG; PAM sequence: CAG
tactgtaaattcattgagaa

SEQ ID NO: 26663 - DNA, 20 bp, Artificial Sequence
  Description of Artificial Sequence: Synthetic oligonucleotide
  Target: SCN9A; (-) strand; PAM type: NRG; PAM sequence: GAG
aatagtactgtaaattcatt

SEQ ID NO: 26664 - DNA, 20 bp, Artificial Sequence
  Description of Artificial Sequence: Synthetic oligonucleotide
  Target: SCN9A; (-) strand; PAM type: NRG; PAM sequence: TAG
aaattatggtatgcatcaaa

SEQ ID NO: 26665 - DNA, 20 bp, Artificial Sequence
  Description of Artificial Sequence: Synthetic oligonucleotide
  Target: SCN9A; (-) strand; PAM type: NRG; PAM sequence: TGG
tttaattttttgagaaatta

SEQ ID NO: 26666 - DNA, 20 bp, Artificial Sequence
  Description of Artificial Sequence: Synthetic oligonucleotide
  Target: SCN9A; (-) strand; PAM type: NRG; PAM sequence: GAG
atcttaaattttaatttttt

SEQ ID NO: 26667 - DNA, 20 bp, Artificial Sequence
  Description of Artificial Sequence: Synthetic oligonucleotide
  Target: SCN9A; (-) strand; PAM type: NRG; PAM sequence: CAG
tttatacttcttcctggatt

SEQ ID NO: 26668 - DNA, 20 bp, Artificial Sequence
  Description of Artificial Sequence: Synthetic oligonucleotide
  Target: SCN9A; (-) strand; PAM type: NRG; PAM sequence: TGG
aacaattttatacttcttcc

SEQ ID NO: 26669 - DNA, 20 bp, Artificial Sequence
  Description of Artificial Sequence: Synthetic oligonucleotide
  Target: SCN9A; (-) strand; PAM type: NRG; PAM sequence: TAG
aatttctccccaaatggatg

SEQ ID NO: 26670 - DNA, 20 bp, Artificial Sequence
  Description of Artificial Sequence: Synthetic oligonucleotide
  Target: SCN9A; (-) strand; PAM type: NRG; PAM sequence: TGG
cctcctaatttctccccaaa

SEQ ID NO: 26671 - DNA, 20 bp, Artificial Sequence
  Description of Artificial Sequence: Synthetic oligonucleotide
  Target: SCN9A; (-) strand; PAM type: NRG; PAM sequence: TAG
gttaatacatgtaaaatgtt

SEQ ID NO: 26672 - DNA, 20 bp, Artificial Sequence
  Description of Artificial Sequence: Synthetic oligonucleotide
  Target: SCN9A; (-) strand; PAM type: NRG; PAM sequence: GGG
cttaaatcgcagttgggtca

SEQ ID NO: 26673 - DNA, 20 bp, Artificial Sequence
  Description of Artificial Sequence: Synthetic oligonucleotide
  Target: SCN9A; (-) strand; PAM type: NRG; PAM sequence: AGG
acttaaatcgcagttgggtc

SEQ ID NO: 26674 - DNA, 20 bp, Artificial Sequence
  Description of Artificial Sequence: Synthetic oligonucleotide
  Target: SCN9A; (-) strand; PAM type: NRG; PAM sequence: CAG
tacttaaatcgcagttgggt

SEQ ID NO: 26675 - DNA, 20 bp, Artificial Sequence
  Description of Artificial Sequence: Synthetic oligonucleotide
  Target: SCN9A; (-) strand; PAM type: NRG; PAM sequence: GGG
ttaatacttaaatcgcagtt

SEQ ID NO: 26676 - DNA, 20 bp, Artificial Sequence
  Description of Artificial Sequence: Synthetic oligonucleotide
  Target: SCN9A; (-) strand; PAM type: NRG; PAM sequence: TGG
gttaatacttaaatcgcagt

SEQ ID NO: 26677 - DNA, 20 bp, Artificial Sequence
  Description of Artificial Sequence: Synthetic oligonucleotide
  Target: SCN9A; (-) strand; PAM type: NRG; PAM sequence: CAG
aattgttaatacttaaatcg

SEQ ID NO: 26678 - DNA, 20 bp, Artificial Sequence
  Description of Artificial Sequence: Synthetic oligonucleotide
  Target: SCN9A; (-) strand; PAM type: NRG; PAM sequence: AGG
tctccagtcaaaatccttca

SEQ ID NO: 26679 - DNA, 20 bp, Artificial Sequence
  Description of Artificial Sequence: Synthetic oligonucleotide
  Target: SCN9A; (-) strand; PAM type: NRG; PAM sequence: AAG
ttctccagtcaaaatccttc

SEQ ID NO: 26680 - DNA, 20 bp, Artificial Sequence
  Description of Artificial Sequence: Synthetic oligonucleotide
  Target: SCN9A; (-) strand; PAM type: NRG; PAM sequence: CAG
ttgcttgggatttccttctc

SEQ ID NO: 26681 - DNA, 20 bp, Artificial Sequence
  Description of Artificial Sequence: Synthetic oligonucleotide
  Target: SCN9A; (-) strand; PAM type: NRG; PAM sequence: GGG
acactctccacactttgctt

SEQ ID NO: 26682 - DNA, 20 bp, Artificial Sequence
  Description of Artificial Sequence: Synthetic oligonucleotide
  Target: SCN9A; (-) strand; PAM type: NRG; PAM sequence: TGG
aacactctccacactttgct

SEQ ID NO: 26683 - DNA, 20 bp, Artificial Sequence
  Description of Artificial Sequence: Synthetic oligonucleotide
  Target: SCN9A; (-) strand; PAM type: NRG; PAM sequence: AGG
taccaaaccaatttcctttt

SEQ ID NO: 26684 - DNA, 20 bp, Artificial Sequence
  Description of Artificial Sequence: Synthetic oligonucleotide
  Target: SCN9A; (-) strand; PAM type: NRG; PAM sequence: TAG
gtaccaaaccaatttccttt

SEQ ID NO: 26685 - DNA, 20 bp, Artificial Sequence
  Description of Artificial Sequence: Synthetic oligonucleotide
  Target: SCN9A; (-) strand; PAM type: NRG; PAM sequence: TAG
tatctcctagtgctcaccca

SEQ ID NO: 26686 - DNA, 20 bp, Artificial Sequence
  Description of Artificial Sequence: Synthetic oligonucleotide
  Target: SCN9A; (-) strand; PAM type: NRG; PAM sequence: TAG
ctttgaccagctctatctcc

SEQ ID NO: 26687 - DNA, 20 bp, Artificial Sequence
  Description of Artificial Sequence: Synthetic oligonucleotide
  Target: SCN9A; (-) strand; PAM type: NRG; PAM sequence: CAG
tggccctaaccagctttgac

SEQ ID NO: 26688 - DNA, 20 bp, Artificial Sequence
  Description of Artificial Sequence: Synthetic oligonucleotide
  Target: SCN9A; (-) strand; PAM type: NRG; PAM sequence: CAG
cttcacactatggccctaac

SEQ ID NO: 26689 - DNA, 20 bp, Artificial Sequence
  Description of Artificial Sequence: Synthetic oligonucleotide
  Target: SCN9A; (-) strand; PAM type: NRG; PAM sequence: TGG
tgcacaaagccttcacacta

SEQ ID NO: 26690 - DNA, 20 bp, Artificial Sequence
  Description of Artificial Sequence: Synthetic oligonucleotide
  Target: SCN9A; (-) strand; PAM type: NRG; PAM sequence: AAG
cgaattatgtactgtgcaca

SEQ ID NO: 26691 - DNA, 20 bp, Artificial Sequence
  Description of Artificial Sequence: Synthetic oligonucleotide
  Target: SCN9A; (-) strand; PAM type: NRG; PAM sequence: AAG
accacgcctggccatcccca

SEQ ID NO: 26692 - DNA, 20 bp, Artificial Sequence
  Description of Artificial Sequence: Synthetic oligonucleotide
  Target: SCN9A; (-) strand; PAM type: NRG; PAM sequence: TGG
caggagtgagccaccacgcc

SEQ ID NO: 26693 - DNA, 20 bp, Artificial Sequence
  Description of Artificial Sequence: Synthetic oligonucleotide
  Target: SCN9A; (-) strand; PAM type: NRG; PAM sequence: GAG
gttgctgagattacaggagt

SEQ ID NO: 26694 - DNA, 20 bp, Artificial Sequence
  Description of Artificial Sequence: Synthetic oligonucleotide
  Target: SCN9A; (-) strand; PAM type: NRG; PAM sequence: GAG
cccagttgctgagattacag

SEQ ID NO: 26695 - DNA, 20 bp, Artificial Sequence
  Description of Artificial Sequence: Synthetic oligonucleotide
  Target: SCN9A; (-) strand; PAM type: NRG; PAM sequence: AGG
tccccagttgctgagattac

SEQ ID NO: 26696 - DNA, 20 bp, Artificial Sequence
  Description of Artificial Sequence: Synthetic oligonucleotide
  Target: SCN9A; (-) strand; PAM type: NRG; PAM sequence: CAG
ttccccagttgctgagatta

SEQ ID NO: 26697 - DNA, 20 bp, Artificial Sequence
  Description of Artificial Sequence: Synthetic oligonucleotide
  Target: SCN9A; (-) strand; PAM type: NRG; PAM sequence: GAG
aaactttttccccagttgct

SEQ ID NO: 26698 - DNA, 20 bp, Artificial Sequence
  Description of Artificial Sequence: Synthetic oligonucleotide
  Target: SCN9A; (-) strand; PAM type: NRG; PAM sequence: CAG
aattcttcaaactttttccc

SEQ ID NO: 26699 - DNA, 20 bp, Artificial Sequence
  Description of Artificial Sequence: Synthetic oligonucleotide
  Target: SCN9A; (-) strand; PAM type: NRG; PAM sequence: AGG
ggtctcaaactactggactc

SEQ ID NO: 26700 - DNA, 20 bp, Artificial Sequence
  Description of Artificial Sequence: Synthetic oligonucleotide
  Target: SCN9A; (-) strand; PAM type: NRG; PAM sequence: CAG
tggtctcaaactactggact

SEQ ID NO: 26701 - DNA, 20 bp, Artificial Sequence
  Description of Artificial Sequence: Synthetic oligonucleotide
  Target: SCN9A; (-) strand; PAM type: NRG; PAM sequence: TGG
ccaggctggtctcaaactac

SEQ ID NO: 26702 - DNA, 20 bp, Artificial Sequence
  Description of Artificial Sequence: Synthetic oligonucleotide
  Target: SCN9A; (-) strand; PAM type: NRG; PAM sequence: TGG
tttcactatgtttcccaggc

SEQ ID NO: 26703 - DNA, 20 bp, Artificial Sequence
  Description of Artificial Sequence: Synthetic oligonucleotide
  Target: SCN9A; (-) strand; PAM type: NRG; PAM sequence: AGG
aaggtttcactatgtttccc

SEQ ID NO: 26704 - DNA, 20 bp, Artificial Sequence
  Description of Artificial Sequence: Synthetic oligonucleotide
  Target: SCN9A; (-) strand; PAM type: NRG; PAM sequence: CAG
caaggtttcactatgtttcc

SEQ ID NO: 26705 - DNA, 20 bp, Artificial Sequence
  Description of Artificial Sequence: Synthetic oligonucleotide
  Target: SCN9A; (-) strand; PAM type: NRG; PAM sequence: AGG
taaaaaagtttgtagagaca

SEQ ID NO: 26706 - DNA, 20 bp, Artificial Sequence
  Description of Artificial Sequence: Synthetic oligonucleotide
  Target: SCN9A; (-) strand; PAM type: NRG; PAM sequence: AAG
ttaaaaaagtttgtagagac

SEQ ID NO: 26707 - DNA, 20 bp, Artificial Sequence
  Description of Artificial Sequence: Synthetic oligonucleotide
  Target: SCN9A; (-) strand; PAM type: NRG; PAM sequence: GAG
tttttttaaaaaagtttgta

SEQ ID NO: 26708 - DNA, 20 bp, Artificial Sequence
  Description of Artificial Sequence: Synthetic oligonucleotide
  Target: SCN9A; (-) strand; PAM type: NRG; PAM sequence: TAG
aatttttttaaaaaagtttg

SEQ ID NO: 26709 - DNA, 20 bp, Artificial Sequence
  Description of Artificial Sequence: Synthetic oligonucleotide
  Target: SCN9A; (-) strand; PAM type: NRG; PAM sequence: AAG
cccagctaatttttttaaaa

SEQ ID NO: 26710 - DNA, 20 bp, Artificial Sequence
  Description of Artificial Sequence: Synthetic oligonucleotide
  Target: SCN9A; (-) strand; PAM type: NRG; PAM sequence: CAG
cacacccatgccacaacacc

SEQ ID NO: 26711 - DNA, 20 bp, Artificial Sequence
  Description of Artificial Sequence: Synthetic oligonucleotide
  Target: SCN9A; (-) strand; PAM type: NRG; PAM sequence: GGG
cctccacctcctgagttgct

SEQ ID NO: 26712 - DNA, 20 bp, Artificial Sequence
  Description of Artificial Sequence: Synthetic oligonucleotide
  Target: SCN9A; (-) strand; PAM type: NRG; PAM sequence: TGG
gcctccacctcctgagttgc

SEQ ID NO: 26713 - DNA, 20 bp, Artificial Sequence
  Description of Artificial Sequence: Synthetic oligonucleotide
  Target: SCN9A; (-) strand; PAM type: NRG; PAM sequence: GAG
tcctcctgcctccacctcct

SEQ ID NO: 26714 - DNA, 20 bp, Artificial Sequence
  Description of Artificial Sequence: Synthetic oligonucleotide
  Target: SCN9A; (-) strand; PAM type: NRG; PAM sequence: AAG
aaccttgaactcctgggctc

SEQ ID NO: 26715 - DNA, 20 bp, Artificial Sequence
  Description of Artificial Sequence: Synthetic oligonucleotide
  Target: SCN9A; (-) strand; PAM type: NRG; PAM sequence: GGG
tactgcaaccttgaactcct

SEQ ID NO: 26716 - DNA, 20 bp, Artificial Sequence
  Description of Artificial Sequence: Synthetic oligonucleotide
  Target: SCN9A; (-) strand; PAM type: NRG; PAM sequence: TGG
ttactgcaaccttgaactcc

SEQ ID NO: 26717 - DNA, 20 bp, Artificial Sequence
  Description of Artificial Sequence: Synthetic oligonucleotide
  Target: SCN9A; (-) strand; PAM type: NRG; PAM sequence: TAG
ggagtacagtggtgctatca

SEQ ID NO: 26718 - DNA, 20 bp, Artificial Sequence
  Description of Artificial Sequence: Synthetic oligonucleotide
  Target: SCN9A; (-) strand; PAM type: NRG; PAM sequence: TGG
ttgcccagtctggagtacag

SEQ ID NO: 26719 - DNA, 20 bp, Artificial Sequence
  Description of Artificial Sequence: Synthetic oligonucleotide
  Target: SCN9A; (-) strand; PAM type: NRG; PAM sequence: CAG
ctgttgcccagtctggagta

SEQ ID NO: 26720 - DNA, 20 bp, Artificial Sequence
  Description of Artificial Sequence: Synthetic oligonucleotide
  Target: SCN9A; (-) strand; PAM type: NRG; PAM sequence: GAG
tcactctgttgcccagtctg

SEQ ID NO: 26721 - DNA, 20 bp, Artificial Sequence
  Description of Artificial Sequence: Synthetic oligonucleotide
  Target: SCN9A; (-) strand; PAM type: NRG; PAM sequence: TGG
tctcactctgttgcccagtc

SEQ ID NO: 26722 - DNA, 20 bp, Artificial Sequence
  Description of Artificial Sequence: Synthetic oligonucleotide
  Target: SCN9A; (-) strand; PAM type: NRG; PAM sequence: CAG
acaggtctcactctgttgcc

SEQ ID NO: 26723 - DNA, 20 bp, Artificial Sequence
  Description of Artificial Sequence: Synthetic oligonucleotide
  Target: SCN9A; (-) strand; PAM type: NRG; PAM sequence: AGG
tttttttaaaaaacggagac

SEQ ID NO: 26724 - DNA, 20 bp, Artificial Sequence
  Description of Artificial Sequence: Synthetic oligonucleotide
  Target: SCN9A; (-) strand; PAM type: NRG; PAM sequence: CAG
ttttttttaaaaaacggaga

SEQ ID NO: 26725 - DNA, 20 bp, Artificial Sequence
  Description of Artificial Sequence: Synthetic oligonucleotide
  Target: SCN9A; (-) strand; PAM type: NRG; PAM sequence: GAG
cttcttttttttaaaaaacg

SEQ ID NO: 26726 - DNA, 20 bp, Artificial Sequence
  Description of Artificial Sequence: Synthetic oligonucleotide
  Target: SCN9A; (-) strand; PAM type: NRG; PAM sequence: CGG
ctcttcttttttttaaaaaa

SEQ ID NO: 26727 - DNA, 20 bp, Artificial Sequence
  Description of Artificial Sequence: Synthetic oligonucleotide
  Target: SCN9A; (-) strand; PAM type: NRG; PAM sequence: AAG
tgatgtatccatgatccgca

SEQ ID NO: 26728 - DNA, 20 bp, Artificial Sequence
  Description of Artificial Sequence: Synthetic oligonucleotide
  Target: SCN9A; (-) strand; PAM type: NRG; PAM sequence: CAG
tattttcgctcatgcagatt

SEQ ID NO: 26729 - DNA, 20 bp, Artificial Sequence
  Description of Artificial Sequence: Synthetic oligonucleotide
  Target: SCN9A; (-) strand; PAM type: NRG; PAM sequence: CAG
tttgattattttcgctcatg

SEQ ID NO: 26730 - DNA, 20 bp, Artificial Sequence
  Description of Artificial Sequence: Synthetic oligonucleotide
  Target: SCN9A; (-) strand; PAM type: NRG; PAM sequence: TAG
cttccattttgcatttactc

SEQ ID NO: 26731 - DNA, 20 bp, Artificial Sequence
  Description of Artificial Sequence: Synthetic oligonucleotide
  Target: SCN9A; (-) strand; PAM type: NRG; PAM sequence: GAG
tgcctaaaccatttcaagca

SEQ ID NO: 26732 - DNA, 20 bp, Artificial Sequence
  Description of Artificial Sequence: Synthetic oligonucleotide
  Target: SCN9A; (-) strand; PAM type: NRG; PAM sequence: CAG
tttgcctaaaccatttcaag

SEQ ID NO: 26733 - DNA, 20 bp, Artificial Sequence
  Description of Artificial Sequence: Synthetic oligonucleotide
  Target: SCN9A; (-) strand; PAM type: NRG; PAM sequence: AAG
ctttttgcctaaaccatttc

SEQ ID NO: 26734 - DNA, 20 bp, Artificial Sequence
  Description of Artificial Sequence: Synthetic oligonucleotide
  Target: SCN9A; (-) strand; PAM type: NRG; PAM sequence: CAG
agttacacagtctccctcca

SEQ ID NO: 26735 - DNA, 20 bp, Artificial Sequence
  Description of Artificial Sequence: Synthetic oligonucleotide
  Target: SCN9A; (-) strand; PAM type: NRG; PAM sequence: CAG
ctgtcagttgaaaagttaca

SEQ ID NO: 26736 - DNA, 20 bp, Artificial Sequence
  Description of Artificial Sequence: Synthetic oligonucleotide
  Target: SCN9A; (-) strand; PAM type: NRG; PAM sequence: AAG
catgtttcctgtcagttgaa

SEQ ID NO: 26737 - DNA, 20 bp, Artificial Sequence
  Description of Artificial Sequence: Synthetic oligonucleotide
  Target: SCN9A; (-) strand; PAM type: NRG; PAM sequence: CAG
cttcatcccatgtttcctgt

SEQ ID NO: 26738 - DNA, 20 bp, Artificial Sequence
  Description of Artificial Sequence: Synthetic oligonucleotide
  Target: SCN9A; (-) strand; PAM type: NRG; PAM sequence: GAG
gaaagctcaaaggtatcttt

SEQ ID NO: 26739 - DNA, 20 bp, Artificial Sequence
  Description of Artificial Sequence: Synthetic oligonucleotide
  Target: SCN9A; (-) strand; PAM type: NRG; PAM sequence: AGG
agctgtatgagaaagctcaa

SEQ ID NO: 26740 - DNA, 20 bp, Artificial Sequence
  Description of Artificial Sequence: Synthetic oligonucleotide
  Target: SCN9A; (-) strand; PAM type: NRG; PAM sequence: AAG
tagctgtatgagaaagctca

SEQ ID NO: 26741 - DNA, 20 bp, Artificial Sequence
  Description of Artificial Sequence: Synthetic oligonucleotide
  Target: SCN9A; (-) strand; PAM type: NRG; PAM sequence: AAG
tcttacttagctgtatgaga

SEQ ID NO: 26742 - DNA, 20 bp, Artificial Sequence
  Description of Artificial Sequence: Synthetic oligonucleotide
  Target: SCN9A; (-) strand; PAM type: NRG; PAM sequence: GAG
ttaatcttacttagctgtat

SEQ ID NO: 26743 - DNA, 20 bp, Artificial Sequence
  Description of Artificial Sequence: Synthetic oligonucleotide
  Target: SCN9A; (-) strand; PAM type: NRG; PAM sequence: TAG
ataattgatttaatcttact

SEQ ID NO: 26744 - DNA, 20 bp, Artificial Sequence
  Description of Artificial Sequence: Synthetic oligonucleotide
  Target: SCN9A; (-) strand; PAM type: NRG; PAM sequence: TAG
atctggtaaagttttcttac

SEQ ID NO: 26745 - DNA, 20 bp, Artificial Sequence
  Description of Artificial Sequence: Synthetic oligonucleotide
  Target: SCN9A; (-) strand; PAM type: NRG; PAM sequence: AAG
tcctgaagattcatctggta

SEQ ID NO: 26746 - DNA, 20 bp, Artificial Sequence
  Description of Artificial Sequence: Synthetic oligonucleotide
  Target: SCN9A; (-) strand; PAM type: NRG; PAM sequence: TGG
cagcttcctgaagattcatc

SEQ ID NO: 26747 - DNA, 20 bp, Artificial Sequence
  Description of Artificial Sequence: Synthetic oligonucleotide
  Target: SCN9A; (-) strand; PAM type: NRG; PAM sequence: AAG
ctttacacaacagcttcctg

SEQ ID NO: 26748 - DNA, 20 bp, Artificial Sequence
  Description of Artificial Sequence: Synthetic oligonucleotide
  Target: SCN9A; (-) strand; PAM type: NRG; PAM sequence: CAG
ttgtgcgtgactttacacaa

SEQ ID NO: 26749 - DNA, 20 bp, Artificial Sequence
  Description of Artificial Sequence: Synthetic oligonucleotide
  Target: SCN9A; (-) strand; PAM type: NRG; PAM sequence: TAG
acattgcatgtagtgatgga

SEQ ID NO: 26750 - DNA, 20 bp, Artificial Sequence
  Description of Artificial Sequence: Synthetic oligonucleotide
  Target: SCN9A; (-) strand; PAM type: NRG; PAM sequence: TGG
cttaacattgcatgtagtga

SEQ ID NO: 26751 - DNA, 20 bp, Artificial Sequence
  Description of Artificial Sequence: Synthetic oligonucleotide
  Target: SCN9A; (-) strand; PAM type: NRG; PAM sequence: TAG
gttcttcttaacattgcatg

SEQ ID NO: 26752 - DNA, 20 bp, Artificial Sequence
  Description of Artificial Sequence: Synthetic oligonucleotide
  Target: SCN9A; (-) strand; PAM type: NRG; PAM sequence: AAG
tttcatatttctattgtcat

SEQ ID NO: 26753 - DNA, 20 bp, Artificial Sequence
  Description of Artificial Sequence: Synthetic oligonucleotide
  Target: SCN9A; (-) strand; PAM type: NRG; PAM sequence: TAG
ttgtgtttcatattaacaat

SEQ ID NO: 26754 - DNA, 20 bp, Artificial Sequence
  Description of Artificial Sequence: Synthetic oligonucleotide
  Target: SCN9A; (-) strand; PAM type: NRG; PAM sequence: AAG
agtgaatacagcaaagtggt

SEQ ID NO: 26755 - DNA, 20 bp, Artificial Sequence
  Description of Artificial Sequence: Synthetic oligonucleotide
  Target: SCN9A; (-) strand; PAM type: NRG; PAM sequence: TGG
ggatagtgaatacagcaaag

SEQ ID NO: 26756 - DNA, 20 bp, Artificial Sequence
  Description of Artificial Sequence: Synthetic oligonucleotide
  Target: SCN9A; (-) strand; PAM type: NRG; PAM sequence: AAG
ttcggatagtgaatacagca

SEQ ID NO: 26757 - DNA, 20 bp, Artificial Sequence
  Description of Artificial Sequence: Synthetic oligonucleotide
  Target: SCN9A; (-) strand; PAM type: NRG; PAM sequence: CAG
agtgattcggatagtgaata

SEQ ID NO: 26758 - DNA, 20 bp, Artificial Sequence
  Description of Artificial Sequence: Synthetic oligonucleotide
  Target: SCN9A; (-) strand; PAM type: NRG; PAM sequence: TAG
gaacttagcagtgattcgga

SEQ ID NO: 26759 - DNA, 20 bp, Artificial Sequence
  Description of Artificial Sequence: Synthetic oligonucleotide
  Target: SCN9A; (-) strand; PAM type: NRG; PAM sequence: CGG
tgaggaacttagcagtgatt

SEQ ID NO: 26760 - DNA, 20 bp, Artificial Sequence
  Description of Artificial Sequence: Synthetic oligonucleotide
  Target: SCN9A; (-) strand; PAM type: NRG; PAM sequence: CAG
atgaatgctgaggaacttag

SEQ ID NO: 26761 - DNA, 20 bp, Artificial Sequence
  Description of Artificial Sequence: Synthetic oligonucleotide
  Target: SCN9A; (-) strand; PAM type: NRG; PAM sequence: TAG
aatatgaatgctgaggaact

SEQ ID NO: 26762 - DNA, 20 bp, Artificial Sequence
  Description of Artificial Sequence: Synthetic oligonucleotide
  Target: SCN9A; (-) strand; PAM type: NRG; PAM sequence: AGG
tttggaaaatatgaatgctg

SEQ ID NO: 26763 - DNA, 20 bp, Artificial Sequence
  Description of Artificial Sequence: Synthetic oligonucleotide
  Target: SCN9A; (-) strand; PAM type: NRG; PAM sequence: GAG
atttggaaaatatgaatgct

SEQ ID NO: 26764 - DNA, 20 bp, Artificial Sequence
  Description of Artificial Sequence: Synthetic oligonucleotide
  Target: SCN9A; (-) strand; PAM type: NRG; PAM sequence: TGG
tgcacctggggaatccgatt

SEQ ID NO: 26765 - DNA, 20 bp, Artificial Sequence
  Description of Artificial Sequence: Synthetic oligonucleotide
  Target: SCN9A; (-) strand; PAM type: NRG; PAM sequence: GGG
gacagtgccaattgcacctg

SEQ ID NO: 26766 - DNA, 20 bp, Artificial Sequence
  Description of Artificial Sequence: Synthetic oligonucleotide
  Target: SCN9A; (-) strand; PAM type: NRG; PAM sequence: GGG
tgacagtgccaattgcacct

SEQ ID NO: 26767 - DNA, 20 bp, Artificial Sequence
  Description of Artificial Sequence: Synthetic oligonucleotide
  Target: SCN9A; (-) strand; PAM type: NRG; PAM sequence: TGG
gtgacagtgccaattgcacc

SEQ ID NO: 26768 - DNA, 20 bp, Artificial Sequence
  Description of Artificial Sequence: Synthetic oligonucleotide
  Target: SCN9A; (-) strand; PAM type: NRG; PAM sequence: CAG
caatcccagcctcacagtga

SEQ ID NO: 26769 - DNA, 20 bp, Artificial Sequence
  Description of Artificial Sequence: Synthetic oligonucleotide
  Target: SCN9A; (-) strand; PAM type: NRG; PAM sequence: CAG
tattcacaatcccagcctca

SEQ ID NO: 26770 - DNA, 20 bp, Artificial Sequence
  Description of Artificial Sequence: Synthetic oligonucleotide
  Target: SCN9A; (-) strand; PAM type: NRG; PAM sequence: CAG
caatcatttattcacaatcc

SEQ ID NO: 26771 - DNA, 20 bp, Artificial Sequence
  Description of Artificial Sequence: Synthetic oligonucleotide
  Target: SCN9A; (-) strand; PAM type: NRG; PAM sequence: TGG
cacttgatggaagacagtga

SEQ ID NO: 26772 - DNA, 20 bp, Artificial Sequence
  Description of Artificial Sequence: Synthetic oligonucleotide
  Target: SCN9A; (-) strand; PAM type: NRG; PAM sequence: CAG
gacaaacacttgatggaaga

SEQ ID NO: 26773 - DNA, 20 bp, Artificial Sequence
  Description of Artificial Sequence: Synthetic oligonucleotide
  Target: SCN9A; (-) strand; PAM type: NRG; PAM sequence: AAG
cgtggacaaacacttgatgg

SEQ ID NO: 26774 - DNA, 20 bp, Artificial Sequence
  Description of Artificial Sequence: Synthetic oligonucleotide
  Target: SCN9A; (-) strand; PAM type: NRG; PAM sequence: TGG
cagcgtggacaaacacttga

SEQ ID NO: 26775 - DNA, 20 bp, Artificial Sequence
  Description of Artificial Sequence: Synthetic oligonucleotide
  Target: SCN9A; (-) strand; PAM type: NRG; PAM sequence: TGG
cagtggttttggaagcagcg

SEQ ID NO: 26776 - DNA, 20 bp, Artificial Sequence
  Description of Artificial Sequence: Synthetic oligonucleotide
  Target: SCN9A; (-) strand; PAM type: NRG; PAM sequence: CAG
aaaatcagtggttttggaag

SEQ ID NO: 26777 - DNA, 20 bp, Artificial Sequence
  Description of Artificial Sequence: Synthetic oligonucleotide
  Target: SCN9A; (-) strand; PAM type: NRG; PAM sequence: AAG
gataaaatcagtggttttgg

SEQ ID NO: 26778 - DNA, 20 bp, Artificial Sequence
  Description of Artificial Sequence: Synthetic oligonucleotide
  Target: SCN9A; (-) strand; PAM type: NRG; PAM sequence: TGG
aaagataaaatcagtggttt

SEQ ID NO: 26779 - DNA, 20 bp, Artificial Sequence
  Description of Artificial Sequence: Synthetic oligonucleotide
  Target: SCN9A; (-) strand; PAM type: NRG; PAM sequence: TGG
aaggaaaaagataaaatcag

SEQ ID NO: 26780 - DNA, 20 bp, Artificial Sequence
  Description of Artificial Sequence: Synthetic oligonucleotide
  Target: SCN9A; (-) strand; PAM type: NRG; PAM sequence: CAG
ctcaaggaaaaagataaaat

SEQ ID NO: 26781 - DNA, 20 bp, Artificial Sequence
  Description of Artificial Sequence: Synthetic oligonucleotide
  Target: SCN9A; (-) strand; PAM type: NRG; PAM sequence: AAG
tcacaatttcctcaaggaaa

SEQ ID NO: 26782 - DNA, 20 bp, Artificial Sequence
  Description of Artificial Sequence: Synthetic oligonucleotide
  Target: SCN9A; (-) strand; PAM type: NRG; PAM sequence: AGG
caaaggtcacaatttcctca

SEQ ID NO: 26783 - DNA, 20 bp, Artificial Sequence
  Description of Artificial Sequence: Synthetic oligonucleotide
  Target: SCN9A; (-) strand; PAM type: NRG; PAM sequence: AAG
gcaaaggtcacaatttcctc

SEQ ID NO: 26784 - DNA, 20 bp, Artificial Sequence
  Description of Artificial Sequence: Synthetic oligonucleotide
  Target: SCN9A; (-) strand; PAM type: NRG; PAM sequence: AGG
acacttgctgaaatgagcaa

SEQ ID NO: 26785 - DNA, 20 bp, Artificial Sequence
  Description of Artificial Sequence: Synthetic oligonucleotide
  Target: SCN9A; (-) strand; PAM type: NRG; PAM sequence: AAG
tacacttgctgaaatgagca

SEQ ID NO: 26786 - DNA, 20 bp, Artificial Sequence
  Description of Artificial Sequence: Synthetic oligonucleotide
  Target: SCN9A; (-) strand; PAM type: NRG; PAM sequence: GAG
aaccatacacttgctgaaat

SEQ ID NO: 26787 - DNA, 20 bp, Artificial Sequence
  Description of Artificial Sequence: Synthetic oligonucleotide
  Target: SCN9A; (-) strand; PAM type: NRG; PAM sequence: AGG
agaagatctgaatactaaga

SEQ ID NO: 26788 - DNA, 20 bp, Artificial Sequence
  Description of Artificial Sequence: Synthetic oligonucleotide
  Target: SCN9A; (-) strand; PAM type: NRG; PAM sequence: AAG
cagaagatctgaatactaag

SEQ ID NO: 26789 - DNA, 20 bp, Artificial Sequence
  Description of Artificial Sequence: Synthetic oligonucleotide
  Target: SCN9A; (-) strand; PAM type: NRG; PAM sequence: AAG
aagcagaagatctgaatact

SEQ ID NO: 26790 - DNA, 20 bp, Artificial Sequence
  Description of Artificial Sequence: Synthetic oligonucleotide
  Target: SCN9A; (-) strand; PAM type: NRG; PAM sequence: AAG
cagggagataagacaagcag

SEQ ID NO: 26791 - DNA, 20 bp, Artificial Sequence
  Description of Artificial Sequence: Synthetic oligonucleotide
  Target: SCN9A; (-) strand; PAM type: NRG; PAM sequence: CAG
ttccagggagataagacaag

SEQ ID NO: 26792 - DNA, 20 bp, Artificial Sequence
  Description of Artificial Sequence: Synthetic oligonucleotide
  Target: SCN9A; (-) strand; PAM type: NRG; PAM sequence: AAG
gatttccagggagataagac

SEQ ID NO: 26793 - DNA, 20 bp, Artificial Sequence
  Description of Artificial Sequence: Synthetic oligonucleotide
  Target: SCN9A; (-) strand; PAM type: NRG; PAM sequence: AAG
ccaaagatttccagggagat

SEQ ID NO: 26794 - DNA, 20 bp, Artificial Sequence
  Description of Artificial Sequence: Synthetic oligonucleotide
  Target: SCN9A; (-) strand; PAM type: NRG; PAM sequence: GAG
aaaagccaaagatttccagg

SEQ ID NO: 26795 - DNA, 20 bp, Artificial Sequence
  Description of Artificial Sequence: Synthetic oligonucleotide
  Target: SCN9A; (-) strand; PAM type: NRG; PAM sequence: GGG
caaaaagccaaagatttcca

SEQ ID NO: 26796 - DNA, 20 bp, Artificial Sequence
  Description of Artificial Sequence: Synthetic oligonucleotide
  Target: SCN9A; (-) strand; PAM type: NRG; PAM sequence: AGG
ccaaaaagccaaagatttcc

SEQ ID NO: 26797 - DNA, 20 bp, Artificial Sequence
  Description of Artificial Sequence: Synthetic oligonucleotide
  Target: SCN9A; (-) strand; PAM type: NRG; PAM sequence: CAG
tccaaaaagccaaagatttc

SEQ ID NO: 26798 - DNA, 20 bp, Artificial Sequence
  Description of Artificial Sequence: Synthetic oligonucleotide
  Target: SCN9A; (-) strand; PAM type: NRG; PAM sequence: AAG
aagcattttccaaaaagcca

SEQ ID NO: 26799 - DNA, 20 bp, Artificial Sequence
  Description of Artificial Sequence: Synthetic oligonucleotide
  Target: SCN9A; (-) strand; PAM type: NRG; PAM sequence: AAG
ttctaaaagcattttccaaa

SEQ ID NO: 26800 - DNA, 20 bp, Artificial Sequence
  Description of Artificial Sequence: Synthetic oligonucleotide
  Target: SCN9A; (-) strand; PAM type: NRG; PAM sequence: AAG
cttacgtgaatttattctaa

SEQ ID NO: 26801 - DNA, 20 bp, Artificial Sequence
  Description of Artificial Sequence: Synthetic oligonucleotide
  Target: SCN9A; (-) strand; PAM type: NRG; PAM sequence: GGG
gcagtgactagaattaaaaa

SEQ ID NO: 26802 - DNA, 20 bp, Artificial Sequence
  Description of Artificial Sequence: Synthetic oligonucleotide
  Target: SCN9A; (-) strand; PAM type: NRG; PAM sequence: AGG
tgcagtgactagaattaaaa

SEQ ID NO: 26803 - DNA, 20 bp, Artificial Sequence
  Description of Artificial Sequence: Synthetic oligonucleotide
  Target: SCN9A; (-) strand; PAM type: NRG; PAM sequence: AAG
ttgcagtgactagaattaaa

SEQ ID NO: 26804 - DNA, 20 bp, Artificial Sequence
  Description of Artificial Sequence: Synthetic oligonucleotide
  Target: SCN9A; (-) strand; PAM type: NRG; PAM sequence: TAG
aacctccagattgcagtgac

SEQ ID NO: 26805 - DNA, 20 bp, Artificial Sequence
  Description of Artificial Sequence: Synthetic oligonucleotide
  Target: SCN9A; (-) strand; PAM type: NRG; PAM sequence: CAG
tgcaaacaacctccagattg

SEQ ID NO: 26806 - DNA, 20 bp, Artificial Sequence
  Description of Artificial Sequence: Synthetic oligonucleotide
  Target: SCN9A; (-) strand; PAM type: NRG; PAM sequence: CAG
accctgatgcaaacaacctc

SEQ ID NO: 26807 - DNA, 20 bp, Artificial Sequence
  Description of Artificial Sequence: Synthetic oligonucleotide
  Target: SCN9A; (-) strand; PAM type: NRG; PAM sequence: AAG
caatcttacagcaattgaag

SEQ ID NO: 26808 - DNA, 20 bp, Artificial Sequence
  Description of Artificial Sequence: Synthetic oligonucleotide
  Target: SCN9A; (-) strand; PAM type: NRG; PAM sequence: AAG
agacaatcttacagcaattg

SEQ ID NO: 26809 - DNA, 20 bp, Artificial Sequence
  Description of Artificial Sequence: Synthetic oligonucleotide
  Target: SCN9A; (-) strand; PAM type: NRG; PAM sequence: CAG
atttagttcagacaatctta

SEQ ID NO: 26810 - DNA, 20 bp, Artificial Sequence
  Description of Artificial Sequence: Synthetic oligonucleotide
  Target: SCN9A; (-) strand; PAM type: NRG; PAM sequence: CAG
attattgagctcatttagtt

SEQ ID NO: 26811 - DNA, 20 bp, Artificial Sequence
  Description of Artificial Sequence: Synthetic oligonucleotide
  Target: SCN9A; (-) strand; PAM type: NRG; PAM sequence: TAG
gccttattattgagctcatt

SEQ ID NO: 26812 - DNA, 20 bp, Artificial Sequence
  Description of Artificial Sequence: Synthetic oligonucleotide
  Target: SCN9A; (-) strand; PAM type: NRG; PAM sequence: GAG
ctatttctggccttattatt

SEQ ID NO: 26813 - DNA, 20 bp, Artificial Sequence
  Description of Artificial Sequence: Synthetic oligonucleotide
  Target: SCN9A; (-) strand; PAM type: NRG; PAM sequence: TGG
ataggtcctaaacctatttc

SEQ ID NO: 26814 - DNA, 20 bp, Artificial Sequence
  Description of Artificial Sequence: Synthetic oligonucleotide
  Target: SCN9A; (-) strand; PAM type: NRG; PAM sequence: AGG
ccctctccccaccctgatat

SEQ ID NO: 26815 - DNA, 20 bp, Artificial Sequence
  Description of Artificial Sequence: Synthetic oligonucleotide
  Target: SCN9A; (-) strand; PAM type: NRG; PAM sequence: TAG
cccctctccccaccctgata

SEQ ID NO: 26816 - DNA, 20 bp, Artificial Sequence
  Description of Artificial Sequence: Synthetic oligonucleotide
  Target: SCN9A; (-) strand; PAM type: NRG; PAM sequence: AAG
attgtggcctatattcggaa

SEQ ID NO: 26817 - DNA, 20 bp, Artificial Sequence
  Description of Artificial Sequence: Synthetic oligonucleotide
  Target: SCN9A; (-) strand; PAM type: NRG; PAM sequence: CGG
tttgtattgtggcctatatt

SEQ ID NO: 26818 - DNA, 20 bp, Artificial Sequence
  Description of Artificial Sequence: Synthetic oligonucleotide
  Target: SCN9A; (-) strand; PAM type: NRG; PAM sequence: TGG
ttcgttgctggtttgtattg

SEQ ID NO: 26819 - DNA, 20 bp, Artificial Sequence
  Description of Artificial Sequence: Synthetic oligonucleotide
  Target: SCN9A; (-) strand; PAM type: NRG; PAM sequence: TGG
ggtgcagaaatcttcgttgc

SEQ ID NO: 26820 - DNA, 20 bp, Artificial Sequence
  Description of Artificial Sequence: Synthetic oligonucleotide
  Target: SCN9A; (-) strand; PAM type: NRG; PAM sequence: CAG
tatccgtgtgtgaaaaggtg

SEQ ID NO: 26821 - DNA, 20 bp, Artificial Sequence
  Description of Artificial Sequence: Synthetic oligonucleotide
  Target: SCN9A; (-) strand; PAM type: NRG; PAM sequence: AGG
ggtcttatccgtgtgtgaaa

SEQ ID NO: 26822 - DNA, 20 bp, Artificial Sequence
  Description of Artificial Sequence: Synthetic oligonucleotide
  Target: SCN9A; (-) strand; PAM type: NRG; PAM sequence: AAG
tggtcttatccgtgtgtgaa

SEQ ID NO: 26823 - DNA, 20 bp, Artificial Sequence
  Description of Artificial Sequence: Synthetic oligonucleotide
  Target: SCN9A; (-) strand; PAM type: NRG; PAM sequence: TGG
tcgcctctgtctctctcatg

SEQ ID NO: 26824 - DNA, 20 bp, Artificial Sequence
  Description of Artificial Sequence: Synthetic oligonucleotide
  Target: SCN9A; (-) strand; PAM type: NRG; PAM sequence: GAG
tctagggatacagtgatgag

SEQ ID NO: 26825 - DNA, 20 bp, Artificial Sequence
  Description of Artificial Sequence: Synthetic oligonucleotide
  Target: SCN9A; (-) strand; PAM type: NRG; PAM sequence: AGG
agtctagggatacagtgatg

SEQ ID NO: 26826 - DNA, 20 bp, Artificial Sequence
  Description of Artificial Sequence: Synthetic oligonucleotide
  Target: SCN9A; (-) strand; PAM type: NRG; PAM sequence: GAG
tagtctagggatacagtgat

SEQ ID NO: 26827 - DNA, 20 bp, Artificial Sequence
  Description of Artificial Sequence: Synthetic oligonucleotide
  Target: SCN9A; (-) strand; PAM type: NRG; PAM sequence: CAG
caggggctagtctagggata

SEQ ID NO: 26828 - DNA, 20 bp, Artificial Sequence
  Description of Artificial Sequence: Synthetic oligonucleotide
  Target: SCN9A; (-) strand; PAM type: NRG; PAM sequence: GGG
agtctgcaggggctagtcta

SEQ ID NO: 26829 - DNA, 20 bp, Artificial Sequence
  Description of Artificial Sequence: Synthetic oligonucleotide
  Target: SCN9A; (-) strand; PAM type: NRG; PAM sequence: AGG
gagtctgcaggggctagtct

SEQ ID NO: 26830 - DNA, 20 bp, Artificial Sequence
  Description of Artificial Sequence: Synthetic oligonucleotide
  Target: SCN9A; (-) strand; PAM type: NRG; PAM sequence: TAG
tgagtctgcaggggctagtc

SEQ ID NO: 26831 - DNA, 20 bp, Artificial Sequence
  Description of Artificial Sequence: Synthetic oligonucleotide
  Target: SCN9A; (-) strand; PAM type: NRG; PAM sequence: TAG
gctgctgagtctgcaggggc

SEQ ID NO: 26832 - DNA, 20 bp, Artificial Sequence
  Description of Artificial Sequence: Synthetic oligonucleotide
  Target: SCN9A; (-) strand; PAM type: NRG; PAM sequence: GGG
ctctgctgctgagtctgcag

SEQ ID NO: 26833 - DNA, 20 bp, Artificial Sequence
  Description of Artificial Sequence: Synthetic oligonucleotide
  Target: SCN9A; (-) strand; PAM type: NRG; PAM sequence: GGG
cctctgctgctgagtctgca

SEQ ID NO: 26834 - DNA, 20 bp, Artificial Sequence
  Description of Artificial Sequence: Synthetic oligonucleotide
  Target: SCN9A; (-) strand; PAM type: NRG; PAM sequence: AGG
ccctctgctgctgagtctgc

SEQ ID NO: 26835 - DNA, 20 bp, Artificial Sequence
  Description of Artificial Sequence: Synthetic oligonucleotide
  Target: SCN9A; (-) strand; PAM type: NRG; PAM sequence: CAG
accctctgctgctgagtctg

SEQ ID NO: 26836 - DNA, 20 bp, Artificial Sequence
  Description of Artificial Sequence: Synthetic oligonucleotide
  Target: SCN9A; (-) strand; PAM type: NRG; PAM sequence: GAG
atggctgaccctctgctgct

SEQ ID NO: 26837 - DNA, 20 bp, Artificial Sequence
  Description of Artificial Sequence: Synthetic oligonucleotide
  Target: SCN9A; (-) strand; PAM type: NRG; PAM sequence: TGG
atggtaattcttcctgggta

SEQ ID NO: 26838 - DNA, 20 bp, Artificial Sequence
  Description of Artificial Sequence: Synthetic oligonucleotide
  Target: SCN9A; (-) strand; PAM type: NRG; PAM sequence: GGG
tccccatggtaattcttcct

SEQ ID NO: 26839 - DNA, 20 bp, Artificial Sequence
  Description of Artificial Sequence: Synthetic oligonucleotide
  Target: SCN9A; (-) strand; PAM type: NRG; PAM sequence: TGG
ctccccatggtaattcttcc

SEQ ID NO: 26840 - DNA, 20 bp, Artificial Sequence
  Description of Artificial Sequence: Synthetic oligonucleotide
  Target: SCN9A; (-) strand; PAM type: NRG; PAM sequence: TGG
atcattctctctgctcccca

SEQ ID NO: 26841 - DNA, 20 bp, Artificial Sequence
  Description of Artificial Sequence: Synthetic oligonucleotide
  Target: SCN9A; (-) strand; PAM type: NRG; PAM sequence: GGG
tgatgtaatgataatggtga

SEQ ID NO: 26842 - DNA, 20 bp, Artificial Sequence
  Description of Artificial Sequence: Synthetic oligonucleotide
  Target: SCN9A; (-) strand; PAM type: NRG; PAM sequence: AGG
atgatgtaatgataatggtg

SEQ ID NO: 26843 - DNA, 20 bp, Artificial Sequence
  Description of Artificial Sequence: Synthetic oligonucleotide
  Target: SCN9A; (-) strand; PAM type: NRG; PAM sequence: GAG
aatgatgtaatgataatggt

SEQ ID NO: 26844 - DNA, 20 bp, Artificial Sequence
  Description of Artificial Sequence: Synthetic oligonucleotide
  Target: SCN9A; (-) strand; PAM type: NRG; PAM sequence: TGG
tagaaatgatgtaatgataa

SEQ ID NO: 26845 - DNA, 20 bp, Artificial Sequence
  Description of Artificial Sequence: Synthetic oligonucleotide
  Target: SCN9A; (-) strand; PAM type: NRG; PAM sequence: TAG
tactgctacagaaatgaact

SEQ ID NO: 26846 - DNA, 20 bp, Artificial Sequence
  Description of Artificial Sequence: Synthetic oligonucleotide
  Target: SCN9A; (-) strand; PAM type: NRG; PAM sequence: CAG
tgattaaggcactactgcta

SEQ ID NO: 26847 - DNA, 20 bp, Artificial Sequence
  Description of Artificial Sequence: Synthetic oligonucleotide
  Target: SCN9A; (-) strand; PAM type: NRG; PAM sequence: AGG
cataaaagagaacttgatta

SEQ ID NO: 26848 - DNA, 20 bp, Artificial Sequence
  Description of Artificial Sequence: Synthetic oligonucleotide
  Target: SCN9A; (-) strand; PAM type: NRG; PAM sequence: AAG
tcataaaagagaacttgatt

SEQ ID NO: 26849 - DNA, 20 bp, Artificial Sequence
  Description of Artificial Sequence: Synthetic oligonucleotide
  Target: SCN9A; (-) strand; PAM type: NRG; PAM sequence: GAG
agttttttgggttcataaaa

SEQ ID NO: 26850 - DNA, 20 bp, Artificial Sequence
  Description of Artificial Sequence: Synthetic oligonucleotide
  Target: SCN9A; (-) strand; PAM type: NRG; PAM sequence: AAG
agagttttttgggttcataa

SEQ ID NO: 26851 - DNA, 20 bp, Artificial Sequence
  Description of Artificial Sequence: Synthetic oligonucleotide
  Target: SCN9A; (-) strand; PAM type: NRG; PAM sequence: GGG
gaatgctaggagagtttttt

SEQ ID NO: 26852 - DNA, 20 bp, Artificial Sequence
  Description of Artificial Sequence: Synthetic oligonucleotide
  Target: SCN9A; (-) strand; PAM type: NRG; PAM sequence: TGG
tgaatgctaggagagttttt

SEQ ID NO: 26853 - DNA, 20 bp, Artificial Sequence
  Description of Artificial Sequence: Synthetic oligonucleotide
  Target: SCN9A; (-) strand; PAM type: NRG; PAM sequence: GAG
atgatagatgaatgctagga

SEQ ID NO: 26854 - DNA, 20 bp, Artificial Sequence
  Description of Artificial Sequence: Synthetic oligonucleotide
  Target: SCN9A; (-) strand; PAM type: NRG; PAM sequence: GAG
taatgatagatgaatgctag

SEQ ID NO: 26855 - DNA, 20 bp, Artificial Sequence
  Description of Artificial Sequence: Synthetic oligonucleotide
  Target: SCN9A; (-) strand; PAM type: NRG; PAM sequence: AGG
agtaatgatagatgaatgct

SEQ ID NO: 26856 - DNA, 20 bp, Artificial Sequence
  Description of Artificial Sequence: Synthetic oligonucleotide
  Target: SCN9A; (-) strand; PAM type: NRG; PAM sequence: TAG
gagtaatgatagatgaatgc

SEQ ID NO: 26857 - DNA, 20 bp, Artificial Sequence
  Description of Artificial Sequence: Synthetic oligonucleotide
  Target: SCN9A; (-) strand; PAM type: NRG; PAM sequence: TAG
caggtaataaagagtaatga

SEQ ID NO: 26858 - DNA, 20 bp, Artificial Sequence
  Description of Artificial Sequence: Synthetic oligonucleotide
  Target: SCN9A; (-) strand; PAM type: NRG; PAM sequence: GAG
tgtttctcacaggtaataaa

SEQ ID NO: 26859 - DNA, 20 bp, Artificial Sequence
  Description of Artificial Sequence: Synthetic oligonucleotide
  Target: SCN9A; (-) strand; PAM type: NRG; PAM sequence: AAG
cctgtttctcacaggtaata

SEQ ID NO: 26860 - DNA, 20 bp, Artificial Sequence
  Description of Artificial Sequence: Synthetic oligonucleotide
  Target: SCN9A; (-) strand; PAM type: NRG; PAM sequence: AGG
ttgttctacctgtttctcac

SEQ ID NO: 26861 - DNA, 20 bp, Artificial Sequence
  Description of Artificial Sequence: Synthetic oligonucleotide
  Target: SCN9A; (-) strand; PAM type: NRG; PAM sequence: CAG
tttgttctacctgtttctca

SEQ ID NO: 26862 - DNA, 20 bp, Artificial Sequence
  Description of Artificial Sequence: Synthetic oligonucleotide
  Target: SCN9A; (-) strand; PAM type: NRG; PAM sequence: TAG
atctttagcacaatagaaaa

SEQ ID NO: 26863 - DNA, 20 bp, Artificial Sequence
  Description of Artificial Sequence: Synthetic oligonucleotide
  Target: SCN9A; (-) strand; PAM type: NRG; PAM sequence: TAG
aacaaagatctttagcacaa

SEQ ID NO: 26864 - DNA, 20 bp, Artificial Sequence
  Description of Artificial Sequence: Synthetic oligonucleotide
  Target: SCN9A; (-) strand; PAM type: NRG; PAM sequence: TAG
gtaaagtgaacaaagatctt

SEQ ID NO: 26865 - DNA, 20 bp, Artificial Sequence
  Description of Artificial Sequence: Synthetic oligonucleotide
  Target: SCN9A; (-) strand; PAM type: NRG; PAM sequence: AAG
atcttctggtaaagtgaaca

SEQ ID NO: 26866 - DNA, 20 bp, Artificial Sequence
  Description of Artificial Sequence: Synthetic oligonucleotide
  Target: SCN9A; (-) strand; PAM type: NRG; PAM sequence: AAG
gtgacatttatcttctggta

SEQ ID NO: 26867 - DNA, 20 bp, Artificial Sequence
  Description of Artificial Sequence: Synthetic oligonucleotide
  Target: SCN9A; (-) strand; PAM type: NRG; PAM sequence: TGG
aacaagtgacatttatcttc

SEQ ID NO: 26868 - DNA, 20 bp, Artificial Sequence
  Description of Artificial Sequence: Synthetic oligonucleotide
  Target: SCN9A; (-) strand; PAM type: NRG; PAM sequence: AAG
tgtgttccatttgttagaac

SEQ ID NO: 26869 - DNA, 20 bp, Artificial Sequence
  Description of Artificial Sequence: Synthetic oligonucleotide
  Target: SCN9A; (-) strand; PAM type: NRG; PAM sequence: TAG
gtattatgtgttccatttgt

SEQ ID NO: 26870 - DNA, 20 bp, Artificial Sequence
  Description of Artificial Sequence: Synthetic oligonucleotide
  Target: SCN9A; (-) strand; PAM type: NRG; PAM sequence: AAG
ttttattacaggaactttgt

SEQ ID NO: 26871 - DNA, 20 bp, Artificial Sequence
  Description of Artificial Sequence: Synthetic oligonucleotide
  Target: SCN9A; (-) strand; PAM type: NRG; PAM sequence: AGG
tggacagaatattttattac

SEQ ID NO: 26872 - DNA, 20 bp, Artificial Sequence
  Description of Artificial Sequence: Synthetic oligonucleotide
  Target: SCN9A; (-) strand; PAM type: NRG; PAM sequence: CAG
ttggacagaatattttatta

SEQ ID NO: 26873 - DNA, 20 bp, Artificial Sequence
  Description of Artificial Sequence: Synthetic oligonucleotide
  Target: SCN9A; (-) strand; PAM type: NRG; PAM sequence: CAG
attctagcacgcttcttgga

SEQ ID NO: 26874 - DNA, 20 bp, Artificial Sequence
  Description of Artificial Sequence: Synthetic oligonucleotide
  Target: SCN9A; (-) strand; PAM type: NRG; PAM sequence: TGG
cagtattctagcacgcttct

SEQ ID NO: 26875 - DNA, 20 bp, Artificial Sequence
  Description of Artificial Sequence: Synthetic oligonucleotide
  Target: SCN9A; (-) strand; PAM type: NRG; PAM sequence: TAG
agtcacattaagcagtattc

SEQ ID NO: 26876 - DNA, 20 bp, Artificial Sequence
  Description of Artificial Sequence: Synthetic oligonucleotide
  Target: SCN9A; (-) strand; PAM type: NRG; PAM sequence: CAG
gctttaaaagtcacattaag

SEQ ID NO: 26877 - DNA, 20 bp, Artificial Sequence
  Description of Artificial Sequence: Synthetic oligonucleotide
  Target: SCN9A; (-) strand; PAM type: NRG; PAM sequence: AAG
tgtgctttaaaagtcacatt

SEQ ID NO: 26878 - DNA, 20 bp, Artificial Sequence
  Description of Artificial Sequence: Synthetic oligonucleotide
  Target: SCN9A; (-) strand; PAM type: NRG; PAM sequence: AAG
ggtccttttctgtgctttaa

SEQ ID NO: 26879 - DNA, 20 bp, Artificial Sequence
  Description of Artificial Sequence: Synthetic oligonucleotide
  Target: SCN9A; (-) strand; PAM type: NRG; PAM sequence: AGG
gtgaatcaggttcaaggggc

SEQ ID NO: 26880 - DNA, 20 bp, Artificial Sequence
  Description of Artificial Sequence: Synthetic oligonucleotide
  Target: SCN9A; (-) strand; PAM type: NRG; PAM sequence: CAG
tgtgaatcaggttcaagggg

SEQ ID NO: 26881 - DNA, 20 bp, Artificial Sequence
  Description of Artificial Sequence: Synthetic oligonucleotide
  Target: SCN9A; (-) strand; PAM type: NRG; PAM sequence: GGG
gcatgtgaatcaggttcaag

SEQ ID NO: 26882 - DNA, 20 bp, Artificial Sequence
  Description of Artificial Sequence: Synthetic oligonucleotide
  Target: SCN9A; (-) strand; PAM type: NRG; PAM sequence: GGG
tgcatgtgaatcaggttcaa

SEQ ID NO: 26883 - DNA, 20 bp, Artificial Sequence
  Description of Artificial Sequence: Synthetic oligonucleotide
  Target: SCN9A; (-) strand; PAM type: NRG; PAM sequence: AGG
ttgcatgtgaatcaggttca

SEQ ID NO: 26884 - DNA, 20 bp, Artificial Sequence
  Description of Artificial Sequence: Synthetic oligonucleotide
  Target: SCN9A; (-) strand; PAM type: NRG; PAM sequence: AAG
attgcatgtgaatcaggttc

SEQ ID NO: 26885 - DNA, 20 bp, Artificial Sequence
  Description of Artificial Sequence: Synthetic oligonucleotide
  Target: SCN9A; (-) strand; PAM type: NRG; PAM sequence: AGG
gccattattgcatgtgaatc

SEQ ID NO: 26886 - DNA, 20 bp, Artificial Sequence
  Description of Artificial Sequence: Synthetic oligonucleotide
  Target: SCN9A; (-) strand; PAM type: NRG; PAM sequence: CAG
tgccattattgcatgtgaat

SEQ ID NO: 26887 - DNA, 20 bp, Artificial Sequence
  Description of Artificial Sequence: Synthetic oligonucleotide
  Target: SCN9A; (-) strand; PAM type: NRG; PAM sequence: CAG
aacataataggcaatgaagc

SEQ ID NO: 26888 - DNA, 20 bp, Artificial Sequence
  Description of Artificial Sequence: Synthetic oligonucleotide
  Target: SCN9A; (-) strand; PAM type: NRG; PAM sequence: AAG
ggcaaacataataggcaatg

SEQ ID NO: 26889 - DNA, 20 bp, Artificial Sequence
  Description of Artificial Sequence: Synthetic oligonucleotide
  Target: SCN9A; (-) strand; PAM type: NRG; PAM sequence: AGG
tcttctagggcaaacataat

SEQ ID NO: 26890 - DNA, 20 bp, Artificial Sequence
  Description of Artificial Sequence: Synthetic oligonucleotide
  Target: SCN9A; (-) strand; PAM type: NRG; PAM sequence: TAG
ctcttctagggcaaacataa

SEQ ID NO: 26891 - DNA, 20 bp, Artificial Sequence
  Description of Artificial Sequence: Synthetic oligonucleotide
  Target: SCN9A; (-) strand; PAM type: NRG; PAM sequence: GGG
cttttttgtaatctcttcta

SEQ ID NO: 26892 - DNA, 20 bp, Artificial Sequence
  Description of Artificial Sequence: Synthetic oligonucleotide
  Target: SCN9A; (-) strand; PAM type: NRG; PAM sequence: AGG
ccttttttgtaatctcttct

SEQ ID NO: 26893 - DNA, 20 bp, Artificial Sequence
  Description of Artificial Sequence: Synthetic oligonucleotide
  Target: SCN9A; (-) strand; PAM type: NRG; PAM sequence: TAG
accttttttgtaatctcttc

SEQ ID NO: 26894 - DNA, 20 bp, Artificial Sequence
  Description of Artificial Sequence: Synthetic oligonucleotide
  Target: SCN9A; (-) strand; PAM type: NRG; PAM sequence: TAG
aaaactttgcttcaagagaa

SEQ ID NO: 26895 - DNA, 20 bp, Artificial Sequence
  Description of Artificial Sequence: Synthetic oligonucleotide
  Target: SCN9A; (-) strand; PAM type: NRG; PAM sequence: GAG
gaaataaaactttgcttcaa

SEQ ID NO: 26896 - DNA, 20 bp, Artificial Sequence
  Description of Artificial Sequence: Synthetic oligonucleotide
  Target: SCN9A; (-) strand; PAM type: NRG; PAM sequence: AAG
cagaaataaaactttgcttc

SEQ ID NO: 26897 - DNA, 20 bp, Artificial Sequence
  Description of Artificial Sequence: Synthetic oligonucleotide
  Target: SCN9A; (-) strand; PAM type: NRG; PAM sequence: CAG
agaaaaaaaaataattaact

SEQ ID NO: 26898 - DNA, 20 bp, Artificial Sequence
  Description of Artificial Sequence: Synthetic oligonucleotide
  Target: SCN9A; (-) strand; PAM type: NRG; PAM sequence: GAG
acctgcacttctacttcagt

SEQ ID NO: 26899 - DNA, 20 bp, Artificial Sequence
  Description of Artificial Sequence: Synthetic oligonucleotide
  Target: SCN9A; (-) strand; PAM type: NRG; PAM sequence: CAG
gttgacctgcacttctactt

SEQ ID NO: 26900 - DNA, 20 bp, Artificial Sequence
  Description of Artificial Sequence: Synthetic oligonucleotide
  Target: SCN9A; (-) strand; PAM type: NRG; PAM sequence: GAG
ttttttttttttacaatgtg

SEQ ID NO: 26901 - DNA, 20 bp, Artificial Sequence
  Description of Artificial Sequence: Synthetic oligonucleotide
  Target: SCN9A; (-) strand; PAM type: NRG; PAM sequence: TGG
cattttttttttttacaatg

SEQ ID NO: 26902 - DNA, 20 bp, Artificial Sequence
  Description of Artificial Sequence: Synthetic oligonucleotide
  Target: SCN9A; (-) strand; PAM type: NRG; PAM sequence: TGG
caatttccttttttgtttcc

SEQ ID NO: 26903 - DNA, 20 bp, Artificial Sequence
  Description of Artificial Sequence: Synthetic oligonucleotide
  Target: SCN9A; (-) strand; PAM type: NRG; PAM sequence: AAG
tagatgatttgggccatgaa

SEQ ID NO: 26904 - DNA, 20 bp, Artificial Sequence
  Description of Artificial Sequence: Synthetic oligonucleotide
  Target: SCN9A; (-) strand; PAM type: NRG; PAM sequence: GGG
aaacatgaggtagatgattt

SEQ ID NO: 26905 - DNA, 20 bp, Artificial Sequence
  Description of Artificial Sequence: Synthetic oligonucleotide
  Target: SCN9A; (-) strand; PAM type: NRG; PAM sequence: TGG
aaaacatgaggtagatgatt

SEQ ID NO: 26906 - DNA, 20 bp, Artificial Sequence
  Description of Artificial Sequence: Synthetic oligonucleotide
  Target: SCN9A; (-) strand; PAM type: NRG; PAM sequence: TAG
tcgatttttaaaacatgagg

SEQ ID NO: 26907 - DNA, 20 bp, Artificial Sequence
  Description of Artificial Sequence: Synthetic oligonucleotide
  Target: SCN9A; (-) strand; PAM type: NRG; PAM sequence: AGG
acttcgatttttaaaacatg

SEQ ID NO: 26908 - DNA, 20 bp, Artificial Sequence
  Description of Artificial Sequence: Synthetic oligonucleotide
  Target: SCN9A; (-) strand; PAM type: NRG; PAM sequence: GAG
tacttcgatttttaaaacat

SEQ ID NO: 26909 - DNA, 20 bp, Artificial Sequence
  Description of Artificial Sequence: Synthetic oligonucleotide
  Target: SCN9A; (-) strand; PAM type: NRG; PAM sequence: AGG
tgagtaccttctcttcagtt

SEQ ID NO: 26910 - DNA, 20 bp, Artificial Sequence
  Description of Artificial Sequence: Synthetic oligonucleotide
  Target: SCN9A; (-) strand; PAM type: NRG; PAM sequence: TAG
atgagtaccttctcttcagt

SEQ ID NO: 26911 - DNA, 20 bp, Artificial Sequence
  Description of Artificial Sequence: Synthetic oligonucleotide
  Target: SCN9A; (-) strand; PAM type: NRG; PAM sequence: CAG
agggatgagtaccttctctt

SEQ ID NO: 26912 - DNA, 20 bp, Artificial Sequence
  Description of Artificial Sequence: Synthetic oligonucleotide
  Target: SCN9A; (-) strand; PAM type: NRG; PAM sequence: GAG
gtatgaccaaaatgagggat

SEQ ID NO: 26913 - DNA, 20 bp, Artificial Sequence
  Description of Artificial Sequence: Synthetic oligonucleotide
  Target: SCN9A; (-) strand; PAM type: NRG; PAM sequence: GGG
tttaggtatgaccaaaatga

SEQ ID NO: 26914 - DNA, 20 bp, Artificial Sequence
  Description of Artificial Sequence: Synthetic oligonucleotide
  Target: SCN9A; (-) strand; PAM type: NRG; PAM sequence: AGG
ttttaggtatgaccaaaatg

SEQ ID NO: 26915 - DNA, 20 bp, Artificial Sequence
  Description of Artificial Sequence: Synthetic oligonucleotide
  Target: SCN9A; (-) strand; PAM type: NRG; PAM sequence: GAG
gttttaggtatgaccaaaat

SEQ ID NO: 26916 - DNA, 20 bp, Artificial Sequence
  Description of Artificial Sequence: Synthetic oligonucleotide
  Target: SCN9A; (-) strand; PAM type: NRG; PAM sequence: AGG
catctcagagaaattgtttt

SEQ ID NO: 26917 - DNA, 20 bp, Artificial Sequence
  Description of Artificial Sequence: Synthetic oligonucleotide
  Target: SCN9A; (-) strand; PAM type: NRG; PAM sequence: TAG
acatctcagagaaattgttt

SEQ ID NO: 26918 - DNA, 20 bp, Artificial Sequence
  Description of Artificial Sequence: Synthetic oligonucleotide
  Target: SCN9A; (-) strand; PAM type: NRG; PAM sequence: GAG
ctgtctttacttacatctca

SEQ ID NO: 26919 - DNA, 20 bp, Artificial Sequence
  Description of Artificial Sequence: Synthetic oligonucleotide
  Target: SCN9A; (-) strand; PAM type: NRG; PAM sequence: CAG
tgctgtctttacttacatct

SEQ ID NO: 26920 - DNA, 20 bp, Artificial Sequence
  Description of Artificial Sequence: Synthetic oligonucleotide
  Target: SCN9A; (-) strand; PAM type: NRG; PAM sequence: TAG
cttattgagacacacaattt

SEQ ID NO: 26921 - DNA, 20 bp, Artificial Sequence
  Description of Artificial Sequence: Synthetic oligonucleotide
  Target: SCN9A; (-) strand; PAM type: NRG; PAM sequence: GAG
tctcctaaatcagacttatt

SEQ ID NO: 26922 - DNA, 20 bp, Artificial Sequence
  Description of Artificial Sequence: Synthetic oligonucleotide
  Target: SCN9A; (-) strand; PAM type: NRG; PAM sequence: CAG
tccagaattttctcctaaat

SEQ ID NO: 26923 - DNA, 20 bp, Artificial Sequence
  Description of Artificial Sequence: Synthetic oligonucleotide
  Target: SCN9A; (-) strand; PAM type: NRG; PAM sequence: CAG
attcccagacctccgacctc

SEQ ID NO: 26924 - DNA, 20 bp, Artificial Sequence
  Description of Artificial Sequence: Synthetic oligonucleotide
  Target: SCN9A; (-) strand; PAM type: NRG; PAM sequence: CAG
aaattgttcactatgattcc

SEQ ID NO: 26925 - DNA, 20 bp, Artificial Sequence
  Description of Artificial Sequence: Synthetic oligonucleotide
  Target: SCN9A; (-) strand; PAM type: NRG; PAM sequence: TAG
taaaccatttcagggatttt

SEQ ID NO: 26926 - DNA, 20 bp, Artificial Sequence
  Description of Artificial Sequence: Synthetic oligonucleotide
  Target: SCN9A; (-) strand; PAM type: NRG; PAM sequence: GGG
acaactattaaaccatttca

SEQ ID NO: 26927 - DNA, 20 bp, Artificial Sequence
  Description of Artificial Sequence: Synthetic oligonucleotide
  Target: SCN9A; (-) strand; PAM type: NRG; PAM sequence: AGG
gacaactattaaaccatttc

SEQ ID NO: 26928 - DNA, 20 bp, Artificial Sequence
  Description of Artificial Sequence: Synthetic oligonucleotide
  Target: SCN9A; (-) strand; PAM type: NRG; PAM sequence: CAG
tgacaactattaaaccattt

SEQ ID NO: 26929 - DNA, 20 bp, Artificial Sequence
  Description of Artificial Sequence: Synthetic oligonucleotide
  Target: SCN9A; (-) strand; PAM type: NRG; PAM sequence: TAG
atacacaaacatgtatttca

SEQ ID NO: 26930 - DNA, 20 bp, Artificial Sequence
  Description of Artificial Sequence: Synthetic oligonucleotide
  Target: SCN9A; (-) strand; PAM type: NRG; PAM sequence: CAG
aaagcagtaaaatggaccct

SEQ ID NO: 26931 - DNA, 20 bp, Artificial Sequence
  Description of Artificial Sequence: Synthetic oligonucleotide
  Target: SCN9A; (-) strand; PAM type: NRG; PAM sequence: TGG
aggagactaaagcagtaaaa

SEQ ID NO: 26932 - DNA, 20 bp, Artificial Sequence
  Description of Artificial Sequence: Synthetic oligonucleotide
  Target: SCN9A; (-) strand; PAM type: NRG; PAM sequence: CAG
acagattaaggagactaaag

SEQ ID NO: 26933 - DNA, 20 bp, Artificial Sequence
  Description of Artificial Sequence: Synthetic oligonucleotide
  Target: SCN9A; (-) strand; PAM type: NRG; PAM sequence: AAG
tgaacagattaaggagacta

SEQ ID NO: 26934 - DNA, 20 bp, Artificial Sequence
  Description of Artificial Sequence: Synthetic oligonucleotide
  Target: SCN9A; (-) strand; PAM type: NRG; PAM sequence: GAG
taacgcttgaacagattaag

SEQ ID NO: 26935 - DNA, 20 bp, Artificial Sequence
  Description of Artificial Sequence: Synthetic oligonucleotide
  Target: SCN9A; (-) strand; PAM type: NRG; PAM sequence: AGG
tttaacgcttgaacagatta

SEQ ID NO: 26936 - DNA, 20 bp, Artificial Sequence
  Description of Artificial Sequence: Synthetic oligonucleotide
  Target: SCN9A; (-) strand; PAM type: NRG; PAM sequence: AAG
gtttaacgcttgaacagatt

SEQ ID NO: 26937 - DNA, 20 bp, Artificial Sequence
  Description of Artificial Sequence: Synthetic oligonucleotide
  Target: SCN9A; (-) strand; PAM type: NRG; PAM sequence: CAG
aaaatggtttaacgcttgaa

SEQ ID NO: 26938 - DNA, 20 bp, Artificial Sequence
  Description of Artificial Sequence: Synthetic oligonucleotide
  Target: SCN9A; (-) strand; PAM type: NRG; PAM sequence: TGG
gccactgcaccctgttaaaa

SEQ ID NO: 26939 - DNA, 20 bp, Artificial Sequence
  Description of Artificial Sequence: Synthetic oligonucleotide
  Target: SCN9A; (-) strand; PAM type: NRG; PAM sequence: GAG
caacgaagtgagaaccgcat

SEQ ID NO: 26940 - DNA, 20 bp, Artificial Sequence
  Description of Artificial Sequence: Synthetic oligonucleotide
  Target: SCN9A; (-) strand; PAM type: NRG; PAM sequence: GAG
gcagctgttctcaacgaagt

SEQ ID NO: 26941 - DNA, 20 bp, Artificial Sequence
  Description of Artificial Sequence: Synthetic oligonucleotide
  Target: SCN9A; (-) strand; PAM type: NRG; PAM sequence: AAG
cacagcagctgttctcaacg

SEQ ID NO: 26942 - DNA, 20 bp, Artificial Sequence
  Description of Artificial Sequence: Synthetic oligonucleotide
  Target: SCN9A; (-) strand; PAM type: NRG; PAM sequence: CAG
aggaaagaaagttgtcacag

SEQ ID NO: 26943 - DNA, 20 bp, Artificial Sequence
  Description of Artificial Sequence: Synthetic oligonucleotide
  Target: SCN9A; (-) strand; PAM type: NRG; PAM sequence: CAG
tgaaggaaagaaagttgtca

SEQ ID NO: 26944 - DNA, 20 bp, Artificial Sequence
  Description of Artificial Sequence: Synthetic oligonucleotide
  Target: SCN9A; (-) strand; PAM type: NRG; PAM sequence: AAG
tatgatttttgaaggaaaga

SEQ ID NO: 26945 - DNA, 20 bp, Artificial Sequence
  Description of Artificial Sequence: Synthetic oligonucleotide
  Target: SCN9A; (-) strand; PAM type: NRG; PAM sequence: AAG
gacttatgatttttgaagga

SEQ ID NO: 26946 - DNA, 20 bp, Artificial Sequence
  Description of Artificial Sequence: Synthetic oligonucleotide
  Target: SCN9A; (-) strand; PAM type: NRG; PAM sequence: AGG
tagagacttatgatttttga

SEQ ID NO: 26947 - DNA, 20 bp, Artificial Sequence
  Description of Artificial Sequence: Synthetic oligonucleotide
  Target: SCN9A; (-) strand; PAM type: NRG; PAM sequence: AAG
ttagagacttatgatttttg

SEQ ID NO: 26948 - DNA, 20 bp, Artificial Sequence
  Description of Artificial Sequence: Synthetic oligonucleotide
  Target: SCN9A; (-) strand; PAM type: NRG; PAM sequence: GAG
actaggttatagaaatatta

SEQ ID NO: 26949 - DNA, 20 bp, Artificial Sequence
  Description of Artificial Sequence: Synthetic oligonucleotide
  Target: SCN9A; (-) strand; PAM type: NRG; PAM sequence: TAG
ccactaggttatagaaatat

SEQ ID NO: 26950 - DNA, 20 bp, Artificial Sequence
  Description of Artificial Sequence: Synthetic oligonucleotide
  Target: SCN9A; (-) strand; PAM type: NRG; PAM sequence: TAG
ttgtgatacccactaggtta

SEQ ID NO: 26951 - DNA, 20 bp, Artificial Sequence
  Description of Artificial Sequence: Synthetic oligonucleotide
  Target: SCN9A; (-) strand; PAM type: NRG; PAM sequence: AGG
tttgatttgtgatacccact

SEQ ID NO: 26952 - DNA, 20 bp, Artificial Sequence
  Description of Artificial Sequence: Synthetic oligonucleotide
  Target: SCN9A; (-) strand; PAM type: NRG; PAM sequence: TAG
ttttgatttgtgatacccac

SEQ ID NO: 26953 - DNA, 20 bp, Artificial Sequence
  Description of Artificial Sequence: Synthetic oligonucleotide
  Target: SCN9A; (-) strand; PAM type: NRG; PAM sequence: TGG
taatacaaagatgatacaaa

SEQ ID NO: 26954 - DNA, 20 bp, Artificial Sequence
  Description of Artificial Sequence: Synthetic oligonucleotide
  Target: SCN9A; (-) strand; PAM type: NRG; PAM sequence: AAG
ttgtttaacatgataataca

SEQ ID NO: 26955 - DNA, 20 bp, Artificial Sequence
  Description of Artificial Sequence: Synthetic oligonucleotide
  Target: SCN9A; (-) strand; PAM type: NRG; PAM sequence: AAG
tcaaaatgagactttgaatc

SEQ ID NO: 26956 - DNA, 20 bp, Artificial Sequence
  Description of Artificial Sequence: Synthetic oligonucleotide
  Target: SCN9A; (-) strand; PAM type: NRG; PAM sequence: GAG
cgaagaccattaatcaaaat

SEQ ID NO: 26957 - DNA, 20 bp, Artificial Sequence
  Description of Artificial Sequence: Synthetic oligonucleotide
  Target: SCN9A; (-) strand; PAM type: NRG; PAM sequence: AAG
tctatatcaggaaacttgcg

SEQ ID NO: 26958 - DNA, 20 bp, Artificial Sequence
  Description of Artificial Sequence: Synthetic oligonucleotide
  Target: SCN9A; (-) strand; PAM type: NRG; PAM sequence: AGG
agtcagctcgggtctatatc

SEQ ID NO: 26959 - DNA, 20 bp, Artificial Sequence
  Description of Artificial Sequence: Synthetic oligonucleotide
  Target: SCN9A; (-) strand; PAM type: NRG; PAM sequence: CAG
tagtcagctcgggtctatat

SEQ ID NO: 26960 - DNA, 20 bp, Artificial Sequence
  Description of Artificial Sequence: Synthetic oligonucleotide
  Target: SCN9A; (-) strand; PAM type: NRG; PAM sequence: GGG
aaataagttttagtcagctc

SEQ ID NO: 26961 - DNA, 20 bp, Artificial Sequence
  Description of Artificial Sequence: Synthetic oligonucleotide
  Target: SCN9A; (-) strand; PAM type: NRG; PAM sequence: CGG
aaaataagttttagtcagct

SEQ ID NO: 26962 - DNA, 20 bp, Artificial Sequence
  Description of Artificial Sequence: Synthetic oligonucleotide
  Target: SCN9A; (-) strand; PAM type: NRG; PAM sequence: CAG
ttggaaaaataagttttagt

SEQ ID NO: 26963 - DNA, 20 bp, Artificial Sequence
  Description of Artificial Sequence: Synthetic oligonucleotide
  Target: SCN9A; (-) strand; PAM type: NRG; PAM sequence: TAG
acatttggaaaaataagttt

SEQ ID NO: 26964 - DNA, 20 bp, Artificial Sequence
  Description of Artificial Sequence: Synthetic oligonucleotide
  Target: SCN9A; (-) strand; PAM type: NRG; PAM sequence: AAG
aggaaaacatttggaaaaat

SEQ ID NO: 26965 - DNA, 20 bp, Artificial Sequence
  Description of Artificial Sequence: Synthetic oligonucleotide
  Target: SCN9A; (-) strand; PAM type: NRG; PAM sequence: TGG
cataggtttaggaaaacatt

SEQ ID NO: 26966 - DNA, 20 bp, Artificial Sequence
  Description of Artificial Sequence: Synthetic oligonucleotide
  Target: SCN9A; (-) strand; PAM type: NRG; PAM sequence: AGG
tggttaaggaccataggttt

SEQ ID NO: 26967 - DNA, 20 bp, Artificial Sequence
  Description of Artificial Sequence: Synthetic oligonucleotide
  Target: SCN9A; (-) strand; PAM type: NRG; PAM sequence: TAG
atggttaaggaccataggtt

SEQ ID NO: 26968 - DNA, 20 bp, Artificial Sequence
  Description of Artificial Sequence: Synthetic oligonucleotide
  Target: SCN9A; (-) strand; PAM type: NRG; PAM sequence: AGG
ttgaaatggttaaggaccat

SEQ ID NO: 26969 - DNA, 20 bp, Artificial Sequence
  Description of Artificial Sequence: Synthetic oligonucleotide
  Target: SCN9A; (-) strand; PAM type: NRG; PAM sequence: TAG
attgaaatggttaaggacca

SEQ ID NO: 26970 - DNA, 20 bp, Artificial Sequence
  Description of Artificial Sequence: Synthetic oligonucleotide
  Target: SCN9A; (-) strand; PAM type: NRG; PAM sequence: AGG
ccagttaattgaaatggtta

SEQ ID NO: 26971 - DNA, 20 bp, Artificial Sequence
  Description of Artificial Sequence: Synthetic oligonucleotide
  Target: SCN9A; (-) strand; PAM type: NRG; PAM sequence: AAG
gccagttaattgaaatggtt

SEQ ID NO: 26972 - DNA, 20 bp, Artificial Sequence
  Description of Artificial Sequence: Synthetic oligonucleotide
  Target: SCN9A; (-) strand; PAM type: NRG; PAM sequence: TGG
ttattgccagttaattgaaa

SEQ ID NO: 26973 - DNA, 20 bp, Artificial Sequence
  Description of Artificial Sequence: Synthetic oligonucleotide
  Target: SCN9A; (-) strand; PAM type: NRG; PAM sequence: CAG
tcttttgatcattttattgc

SEQ ID NO: 26974 - DNA, 20 bp, Artificial Sequence
  Description of Artificial Sequence: Synthetic oligonucleotide
  Target: SCN9A; (-) strand; PAM type: NRG; PAM sequence: TGG
attagagttatatgctaaac

SEQ ID NO: 26975 - DNA, 20 bp, Artificial Sequence
  Description of Artificial Sequence: Synthetic oligonucleotide
  Target: SCN9A; (-) strand; PAM type: NRG; PAM sequence: GAG
tgatatagccttccacatta

SEQ ID NO: 26976 - DNA, 20 bp, Artificial Sequence
  Description of Artificial Sequence: Synthetic oligonucleotide
  Target: SCN9A; (-) strand; PAM type: NRG; PAM sequence: TAG
cctgatatagccttccacat

SEQ ID NO: 26977 - DNA, 20 bp, Artificial Sequence
  Description of Artificial Sequence: Synthetic oligonucleotide
  Target: SCN9A; (-) strand; PAM type: NRG; PAM sequence: TAG
aaaaaaatatattcctgata

SEQ ID NO: 26978 - DNA, 20 bp, Artificial Sequence
  Description of Artificial Sequence: Synthetic oligonucleotide
  Target: SCN9A; (-) strand; PAM type: NRG; PAM sequence: AGG
tatcatagaattaaaattta

SEQ ID NO: 26979 - DNA, 20 bp, Artificial Sequence
  Description of Artificial Sequence: Synthetic oligonucleotide
  Target: SCN9A; (-) strand; PAM type: NRG; PAM sequence: AAG
atatcatagaattaaaattt

SEQ ID NO: 26980 - DNA, 20 bp, Artificial Sequence
  Description of Artificial Sequence: Synthetic oligonucleotide
  Target: SCN9A; (-) strand; PAM type: NRG; PAM sequence: TAG
tggaggaactaccaatatca

SEQ ID NO: 26981 - DNA, 20 bp, Artificial Sequence
  Description of Artificial Sequence: Synthetic oligonucleotide
  Target: SCN9A; (-) strand; PAM type: NRG; PAM sequence: AGG
aaccaactcttgactaatgg

SEQ ID NO: 26982 - DNA, 20 bp, Artificial Sequence
  Description of Artificial Sequence: Synthetic oligonucleotide
  Target: SCN9A; (-) strand; PAM type: NRG; PAM sequence: GAG
taaccaactcttgactaatg

SEQ ID NO: 26983 - DNA, 20 bp, Artificial Sequence
  Description of Artificial Sequence: Synthetic oligonucleotide
  Target: SCN9A; (-) strand; PAM type: NRG; PAM sequence: TGG
gataaccaactcttgactaa

SEQ ID NO: 26984 - DNA, 20 bp, Artificial Sequence
  Description of Artificial Sequence: Synthetic oligonucleotide
  Target: SCN9A; (-) strand; PAM type: NRG; PAM sequence: AAG
tatacagaagaaaattcata

SEQ ID NO: 26985 - DNA, 20 bp, Artificial Sequence
  Description of Artificial Sequence: Synthetic oligonucleotide
  Target: SCN9A; (-) strand; PAM type: NRG; PAM sequence: AAG
ttggcaaagaaagtatacag

SEQ ID NO: 26986 - DNA, 20 bp, Artificial Sequence
  Description of Artificial Sequence: Synthetic oligonucleotide
  Target: SCN9A; (-) strand; PAM type: NRG; PAM sequence: CAG
ttcttggcaaagaaagtata

SEQ ID NO: 26987 - DNA, 20 bp, Artificial Sequence
  Description of Artificial Sequence: Synthetic oligonucleotide
  Target: SCN9A; (-) strand; PAM type: NRG; PAM sequence: AAG
ttattaattcttggcaaaga

SEQ ID NO: 26988 - DNA, 20 bp, Artificial Sequence
  Description of Artificial Sequence: Synthetic oligonucleotide
  Target: SCN9A; (-) strand; PAM type: NRG; PAM sequence: AAG
ttaattattaattcttggca

SEQ ID NO: 26989 - DNA, 20 bp, Artificial Sequence
  Description of Artificial Sequence: Synthetic oligonucleotide
  Target: SCN9A; (-) strand; PAM type: NRG; PAM sequence: TGG
attctttaattattaattct

SEQ ID NO: 26990 - DNA, 20 bp, Artificial Sequence
  Description of Artificial Sequence: Synthetic oligonucleotide
  Target: SCN9A; (-) strand; PAM type: NRG; PAM sequence: TAG
gtgtttcattcgtgtagaat

SEQ ID NO: 26991 - DNA, 20 bp, Artificial Sequence
  Description of Artificial Sequence: Synthetic oligonucleotide
  Target: SCN9A; (-) strand; PAM type: NRG; PAM sequence: TAG
tggtgagtgtttcattcgtg

SEQ ID NO: 26992 - DNA, 20 bp, Artificial Sequence
  Description of Artificial Sequence: Synthetic oligonucleotide
  Target: SCN9A; (-) strand; PAM type: NRG; PAM sequence: GAG
aacagaggggatatattggt

SEQ ID NO: 26993 - DNA, 20 bp, Artificial Sequence
  Description of Artificial Sequence: Synthetic oligonucleotide
  Target: SCN9A; (-) strand; PAM type: NRG; PAM sequence: TGG
aaaaaacagaggggatatat

SEQ ID NO: 26994 - DNA, 20 bp, Artificial Sequence
  Description of Artificial Sequence: Synthetic oligonucleotide
  Target: SCN9A; (-) strand; PAM type: NRG; PAM sequence: GGG
atttatagtaaaaaacagag

SEQ ID NO: 26995 - DNA, 20 bp, Artificial Sequence
  Description of Artificial Sequence: Synthetic oligonucleotide
  Target: SCN9A; (-) strand; PAM type: NRG; PAM sequence: GGG
gatttatagtaaaaaacaga

SEQ ID NO: 26996 - DNA, 20 bp, Artificial Sequence
  Description of Artificial Sequence: Synthetic oligonucleotide
  Target: SCN9A; (-) strand; PAM type: NRG; PAM sequence: AGG
agatttatagtaaaaaacag

SEQ ID NO: 26997 - DNA, 20 bp, Artificial Sequence
  Description of Artificial Sequence: Synthetic oligonucleotide
  Target: SCN9A; (-) strand; PAM type: NRG; PAM sequence: GAG
tagatttatagtaaaaaaca

SEQ ID NO: 26998 - DNA, 20 bp, Artificial Sequence
  Description of Artificial Sequence: Synthetic oligonucleotide
  Target: SCN9A; (-) strand; PAM type: NRG; PAM sequence: CAG
tatagatttatagtaaaaaa

SEQ ID NO: 26999 - DNA, 20 bp, Artificial Sequence
  Description of Artificial Sequence: Synthetic oligonucleotide
  Target: SCN9A; (-) strand; PAM type: NRG; PAM sequence: TAG
tgaaaggcaatatagattta

SEQ ID NO: 27000 - DNA, 20 bp, Artificial Sequence
  Description of Artificial Sequence: Synthetic oligonucleotide
  Target: SCN9A; (-) strand; PAM type: NRG; PAM sequence: TAG
ttttcctttgaaaggcaata

SEQ ID NO: 27001 - DNA, 20 bp, Artificial Sequence
  Description of Artificial Sequence: Synthetic oligonucleotide
  Target: SCN9A; (-) strand; PAM type: NRG; PAM sequence: AGG
gagttatgttttcctttgaa

SEQ ID NO: 27002 - DNA, 20 bp, Artificial Sequence
  Description of Artificial Sequence: Synthetic oligonucleotide
  Target: SCN9A; (-) strand; PAM type: NRG; PAM sequence: AAG
agagttatgttttcctttga

SEQ ID NO: 27003 - DNA, 20 bp, Artificial Sequence
  Description of Artificial Sequence: Synthetic oligonucleotide
  Target: SCN9A; (-) strand; PAM type: NRG; PAM sequence: GAG
gatcatggacactggtgtga

SEQ ID NO: 27004 - DNA, 20 bp, Artificial Sequence
  Description of Artificial Sequence: Synthetic oligonucleotide
  Target: SCN9A; (-) strand; PAM type: NRG; PAM sequence: GAG
ttgatcatggacactggtgt

SEQ ID NO: 27005 - DNA, 20 bp, Artificial Sequence
  Description of Artificial Sequence: Synthetic oligonucleotide
  Target: SCN9A; (-) strand; PAM type: NRG; PAM sequence: TGG
taatatttgatcatggacac

SEQ ID NO: 27006 - DNA, 20 bp, Artificial Sequence
  Description of Artificial Sequence: Synthetic oligonucleotide
  Target: SCN9A; (-) strand; PAM type: NRG; PAM sequence: TGG
gataatataatatttgatca

SEQ ID NO: 27007 - DNA, 20 bp, Artificial Sequence
  Description of Artificial Sequence: Synthetic oligonucleotide
  Target: SCN9A; (-) strand; PAM type: NRG; PAM sequence: TGG
tgaagtgggcctttgaacaa

SEQ ID NO: 27008 - DNA, 20 bp, Artificial Sequence
  Description of Artificial Sequence: Synthetic oligonucleotide
  Target: SCN9A; (-) strand; PAM type: NRG; PAM sequence: GGG
ttaagggaggtttttgaagt

SEQ ID NO: 27009 - DNA, 20 bp, Artificial Sequence
  Description of Artificial Sequence: Synthetic oligonucleotide
  Target: SCN9A; (-) strand; PAM type: NRG; PAM sequence: TGG
cttaagggaggtttttgaag

SEQ ID NO: 27010 - DNA, 20 bp, Artificial Sequence
  Description of Artificial Sequence: Synthetic oligonucleotide
  Target: SCN9A; (-) strand; PAM type: NRG; PAM sequence: AAG
agacttaagggaggtttttg

SEQ ID NO: 27011 - DNA, 20 bp, Artificial Sequence
  Description of Artificial Sequence: Synthetic oligonucleotide
  Target: SCN9A; (-) strand; PAM type: NRG; PAM sequence: AGG
tctagattgagacttaaggg

SEQ ID NO: 27012 - DNA, 20 bp, Artificial Sequence
  Description of Artificial Sequence: Synthetic oligonucleotide
  Target: SCN9A; (-) strand; PAM type: NRG; PAM sequence: GAG
ttctagattgagacttaagg

SEQ ID NO: 27013 - DNA, 20 bp, Artificial Sequence
  Description of Artificial Sequence: Synthetic oligonucleotide
  Target: SCN9A; (-) strand; PAM type: NRG; PAM sequence: GGG
agttctagattgagacttaa

SEQ ID NO: 27014 - DNA, 20 bp, Artificial Sequence
  Description of Artificial Sequence: Synthetic oligonucleotide
  Target: SCN9A; (-) strand; PAM type: NRG; PAM sequence: AGG
gagttctagattgagactta

SEQ ID NO: 27015 - DNA, 20 bp, Artificial Sequence
  Description of Artificial Sequence: Synthetic oligonucleotide
  Target: SCN9A; (-) strand; PAM type: NRG; PAM sequence: AAG
agagttctagattgagactt

SEQ ID NO: 27016 - DNA, 20 bp, Artificial Sequence
  Description of Artificial Sequence: Synthetic oligonucleotide
  Target: SCN9A; (-) strand; PAM type: NRG; PAM sequence: GAG
taaagaaagagttctagatt

SEQ ID NO: 27017 - DNA, 20 bp, Artificial Sequence
  Description of Artificial Sequence: Synthetic oligonucleotide
  Target: SCN9A; (-) strand; PAM type: NRG; PAM sequence: TAG
gacacttaaagaaagagttc

SEQ ID NO: 27018 - DNA, 20 bp, Artificial Sequence
  Description of Artificial Sequence: Synthetic oligonucleotide
  Target: SCN9A; (-) strand; PAM type: NRG; PAM sequence: GAG
gcttctgacacttaaagaaa

SEQ ID NO: 27019 - DNA, 20 bp, Artificial Sequence
  Description of Artificial Sequence: Synthetic oligonucleotide
  Target: SCN9A; (-) strand; PAM type: NRG; PAM sequence: AAG
atgcttctgacacttaaaga

SEQ ID NO: 27020 - DNA, 20 bp, Artificial Sequence
  Description of Artificial Sequence: Synthetic oligonucleotide
  Target: SCN9A; (-) strand; PAM type: NRG; PAM sequence: AAG
taaaatgcttctgacactta

SEQ ID NO: 27021 - DNA, 20 bp, Artificial Sequence
  Description of Artificial Sequence: Synthetic oligonucleotide
  Target: SCN9A; (-) strand; PAM type: NRG; PAM sequence: AGG
agtgatgagttctaccaata

SEQ ID NO: 27022 - DNA, 20 bp, Artificial Sequence
  Description of Artificial Sequence: Synthetic oligonucleotide
  Target: SCN9A; (-) strand; PAM type: NRG; PAM sequence: AAG
aagtgatgagttctaccaat

SEQ ID NO: 27023 - DNA, 20 bp, Artificial Sequence
  Description of Artificial Sequence: Synthetic oligonucleotide
  Target: SCN9A; (-) strand; PAM type: NRG; PAM sequence: GAG
tcagacaaggaagaagtgat

SEQ ID NO: 27024 - DNA, 20 bp, Artificial Sequence
  Description of Artificial Sequence: Synthetic oligonucleotide
  Target: SCN9A; (-) strand; PAM type: NRG; PAM sequence: AAG
aaagttatcagacaaggaag

SEQ ID NO: 27025 - DNA, 20 bp, Artificial Sequence
  Description of Artificial Sequence: Synthetic oligonucleotide
  Target: SCN9A; (-) strand; PAM type: NRG; PAM sequence: AAG
acaaaagttatcagacaagg

SEQ ID NO: 27026 - DNA, 20 bp, Artificial Sequence
  Description of Artificial Sequence: Synthetic oligonucleotide
  Target: SCN9A; (-) strand; PAM type: NRG; PAM sequence: AGG
aacacaaaagttatcagaca

SEQ ID NO: 27027 - DNA, 20 bp, Artificial Sequence
  Description of Artificial Sequence: Synthetic oligonucleotide
  Target: SCN9A; (-) strand; PAM type: NRG; PAM sequence: AAG
gaacacaaaagttatcagac

SEQ ID NO: 27028 - DNA, 20 bp, Artificial Sequence
  Description of Artificial Sequence: Synthetic oligonucleotide
  Target: SCN9A; (-) strand; PAM type: NRG; PAM sequence: CAG
aagtggaacacaaaagttat

SEQ ID NO: 27029 - DNA, 20 bp, Artificial Sequence
  Description of Artificial Sequence: Synthetic oligonucleotide
  Target: SCN9A; (-) strand; PAM type: NRG; PAM sequence: AAG
cacagaaaagtggaacacaa

SEQ ID NO: 27030 - DNA, 20 bp, Artificial Sequence
  Description of Artificial Sequence: Synthetic oligonucleotide
  Target: SCN9A; (-) strand; PAM type: NRG; PAM sequence: TGG
cttattagggcacagaaaag

SEQ ID NO: 27031 - DNA, 20 bp, Artificial Sequence
  Description of Artificial Sequence: Synthetic oligonucleotide
  Target: SCN9A; (-) strand; PAM type: NRG; PAM sequence: AAG
atgcttattagggcacagaa

SEQ ID NO: 27032 - DNA, 20 bp, Artificial Sequence
  Description of Artificial Sequence: Synthetic oligonucleotide
  Target: SCN9A; (-) strand; PAM type: NRG; PAM sequence: CAG
ttaagatgcttattagggca

SEQ ID NO: 27033 - DNA, 20 bp, Artificial Sequence
  Description of Artificial Sequence: Synthetic oligonucleotide
  Target: SCN9A; (-) strand; PAM type: NRG; PAM sequence: GGG
tgtttttaagatgcttatta

SEQ ID NO: 27034 - DNA, 20 bp, Artificial Sequence
  Description of Artificial Sequence: Synthetic oligonucleotide
  Target: SCN9A; (-) strand; PAM type: NRG; PAM sequence: AGG
ttgtttttaagatgcttatt

SEQ ID NO: 27035 - DNA, 20 bp, Artificial Sequence
  Description of Artificial Sequence: Synthetic oligonucleotide
  Target: SCN9A; (-) strand; PAM type: NRG; PAM sequence: TAG
cttgtttttaagatgcttat

SEQ ID NO: 27036 - DNA, 20 bp, Artificial Sequence
  Description of Artificial Sequence: Synthetic oligonucleotide
  Target: SCN9A; (-) strand; PAM type: NRG; PAM sequence: AAG
atggtctaatccttgttttt

SEQ ID NO: 27037 - DNA, 20 bp, Artificial Sequence
  Description of Artificial Sequence: Synthetic oligonucleotide
  Target: SCN9A; (-) strand; PAM type: NRG; PAM sequence: TGG
agaccaaaaccaattaccca

SEQ ID NO: 27038 - DNA, 20 bp, Artificial Sequence
  Description of Artificial Sequence: Synthetic oligonucleotide
  Target: SCN9A; (-) strand; PAM type: NRG; PAM sequence: AAG
ttaggtattatttagggtgg

SEQ ID NO: 27039 - DNA, 20 bp, Artificial Sequence
  Description of Artificial Sequence: Synthetic oligonucleotide
  Target: SCN9A; (-) strand; PAM type: NRG; PAM sequence: TGG
tgtttaggtattatttaggg

SEQ ID NO: 27040 - DNA, 20 bp, Artificial Sequence
  Description of Artificial Sequence: Synthetic oligonucleotide
  Target: SCN9A; (-) strand; PAM type: NRG; PAM sequence: GGG
cattgtttaggtattattta

SEQ ID NO: 27041 - DNA, 20 bp, Artificial Sequence
  Description of Artificial Sequence: Synthetic oligonucleotide
  Target: SCN9A; (-) strand; PAM type: NRG; PAM sequence: AGG
gcattgtttaggtattattt

SEQ ID NO: 27042 - DNA, 20 bp, Artificial Sequence
  Description of Artificial Sequence: Synthetic oligonucleotide
  Target: SCN9A; (-) strand; PAM type: NRG; PAM sequence: TAG
ggcattgtttaggtattatt

SEQ ID NO: 27043 - DNA, 20 bp, Artificial Sequence
  Description of Artificial Sequence: Synthetic oligonucleotide
  Target: SCN9A; (-) strand; PAM type: NRG; PAM sequence: AGG
tagataggaaggcattgttt

SEQ ID NO: 27044 - DNA, 20 bp, Artificial Sequence
  Description of Artificial Sequence: Synthetic oligonucleotide
  Target: SCN9A; (-) strand; PAM type: NRG; PAM sequence: TAG
ttagataggaaggcattgtt

SEQ ID NO: 27045 - DNA, 20 bp, Artificial Sequence
  Description of Artificial Sequence: Synthetic oligonucleotide
  Target: SCN9A; (-) strand; PAM type: NRG; PAM sequence: AGG
taggtattgtttagatagga

SEQ ID NO: 27046 - DNA, 20 bp, Artificial Sequence
  Description of Artificial Sequence: Synthetic oligonucleotide
  Target: SCN9A; (-) strand; PAM type: NRG; PAM sequence: AAG
ttaggtattgtttagatagg

SEQ ID NO: 27047 - DNA, 20 bp, Artificial Sequence
  Description of Artificial Sequence: Synthetic oligonucleotide
  Target: SCN9A; (-) strand; PAM type: NRG; PAM sequence: AGG
tatttaggtattgtttagat

SEQ ID NO: 27048 - DNA, 20 bp, Artificial Sequence
  Description of Artificial Sequence: Synthetic oligonucleotide
  Target: SCN9A; (-) strand; PAM type: NRG; PAM sequence: TAG
gtatttaggtattgtttaga

SEQ ID NO: 27049 - DNA, 20 bp, Artificial Sequence
  Description of Artificial Sequence: Synthetic oligonucleotide
  Target: SCN9A; (-) strand; PAM type: NRG; PAM sequence: TAG
aaaggtatttaggtattgtt

SEQ ID NO: 27050 - DNA, 20 bp, Artificial Sequence
  Description of Artificial Sequence: Synthetic oligonucleotide
  Target: SCN9A; (-) strand; PAM type: NRG; PAM sequence: AGG
ctgtgaaaagaaaggtattt

SEQ ID NO: 27051 - DNA, 20 bp, Artificial Sequence
  Description of Artificial Sequence: Synthetic oligonucleotide
  Target: SCN9A; (-) strand; PAM type: NRG; PAM sequence: TAG
tctgtgaaaagaaaggtatt

SEQ ID NO: 27052 - DNA, 20 bp, Artificial Sequence
  Description of Artificial Sequence: Synthetic oligonucleotide
  Target: SCN9A; (-) strand; PAM type: NRG; PAM sequence: AGG
tatcttctctgtgaaaagaa

SEQ ID NO: 27053 - DNA, 20 bp, Artificial Sequence
  Description of Artificial Sequence: Synthetic oligonucleotide
  Target: SCN9A; (-) strand; PAM type: NRG; PAM sequence: AAG
gtatcttctctgtgaaaaga

SEQ ID NO: 27054 - DNA, 20 bp, Artificial Sequence
  Description of Artificial Sequence: Synthetic oligonucleotide
  Target: SCN9A; (-) strand; PAM type: NRG; PAM sequence: AAG
tttagtatcttctctgtgaa

SEQ ID NO: 27055 - DNA, 20 bp, Artificial Sequence
  Description of Artificial Sequence: Synthetic oligonucleotide
  Target: SCN9A; (-) strand; PAM type: NRG; PAM sequence: TAG
attttccactcaatattttt

SEQ ID NO: 27056 - DNA, 20 bp, Artificial Sequence
  Description of Artificial Sequence: Synthetic oligonucleotide
  Target: SCN9A; (-) strand; PAM type: NRG; PAM sequence: TGG
caaagggaaaggcattccct

SEQ ID NO: 27057 - DNA, 20 bp, Artificial Sequence
  Description of Artificial Sequence: Synthetic oligonucleotide
  Target: SCN9A; (-) strand; PAM type: NRG; PAM sequence: AGG
tcaggcaaattcaaagggaa

SEQ ID NO: 27058 - DNA, 20 bp, Artificial Sequence
  Description of Artificial Sequence: Synthetic oligonucleotide
  Target: SCN9A; (-) strand; PAM type: NRG; PAM sequence: AAG
ttcaggcaaattcaaaggga

SEQ ID NO: 27059 - DNA, 20 bp, Artificial Sequence
  Description of Artificial Sequence: Synthetic oligonucleotide
  Target: SCN9A; (-) strand; PAM type: NRG; PAM sequence: GGG
tttattcaggcaaattcaaa

SEQ ID NO: 27060 - DNA, 20 bp, Artificial Sequence
  Description of Artificial Sequence: Synthetic oligonucleotide
  Target: SCN9A; (-) strand; PAM type: NRG; PAM sequence: AGG
atttattcaggcaaattcaa

SEQ ID NO: 27061 - DNA, 20 bp, Artificial Sequence
  Description of Artificial Sequence: Synthetic oligonucleotide
  Target: SCN9A; (-) strand; PAM type: NRG; PAM sequence: AAG
tatttattcaggcaaattca

SEQ ID NO: 27062 - DNA, 20 bp, Artificial Sequence
  Description of Artificial Sequence: Synthetic oligonucleotide
  Target: SCN9A; (-) strand; PAM type: NRG; PAM sequence: AGG
taaatgtttattatttattc

SEQ ID NO: 27063 - DNA, 20 bp, Artificial Sequence
  Description of Artificial Sequence: Synthetic oligonucleotide
  Target: SCN9A; (-) strand; PAM type: NRG; PAM sequence: CAG
ttaaatgtttattatttatt

SEQ ID NO: 27064 - DNA, 20 bp, Artificial Sequence
  Description of Artificial Sequence: Synthetic oligonucleotide
  Target: SCN9A; (-) strand; PAM type: NRG; PAM sequence: AAG
tgtgaaaacatgccacatca

SEQ ID NO: 27065 - DNA, 20 bp, Artificial Sequence
  Description of Artificial Sequence: Synthetic oligonucleotide
  Target: SCN9A; (-) strand; PAM type: NRG; PAM sequence: AGG
taaaatcgtgaaattgggaa

SEQ ID NO: 27066 - DNA, 20 bp, Artificial Sequence
  Description of Artificial Sequence: Synthetic oligonucleotide
  Target: SCN9A; (-) strand; PAM type: NRG; PAM sequence: AAG
ataaaatcgtgaaattggga

SEQ ID NO: 27067 - DNA, 20 bp, Artificial Sequence
  Description of Artificial Sequence: Synthetic oligonucleotide
  Target: SCN9A; (-) strand; PAM type: NRG; PAM sequence: GGG
tgacataaaatcgtgaaatt

SEQ ID NO: 27068 - DNA, 20 bp, Artificial Sequence
  Description of Artificial Sequence: Synthetic oligonucleotide
  Target: SCN9A; (-) strand; PAM type: NRG; PAM sequence: TGG
ttgacataaaatcgtgaaat

SEQ ID NO: 27069 - DNA, 20 bp, Artificial Sequence
  Description of Artificial Sequence: Synthetic oligonucleotide
  Target: SCN9A; (-) strand; PAM type: NRG; PAM sequence: CAG
caggcgtgagctactgcgcc

SEQ ID NO: 27070 - DNA, 20 bp, Artificial Sequence
  Description of Artificial Sequence: Synthetic oligonucleotide
  Target: SCN9A; (-) strand; PAM type: NRG; PAM sequence: GAG
agtgctagaattacaggcgt

SEQ ID NO: 27071 - DNA, 20 bp, Artificial Sequence
  Description of Artificial Sequence: Synthetic oligonucleotide
  Target: SCN9A; (-) strand; PAM type: NRG; PAM sequence: AGG
tcccaaagtgctagaattac

SEQ ID NO: 27072 - DNA, 20 bp, Artificial Sequence
  Description of Artificial Sequence: Synthetic oligonucleotide
  Target: SCN9A; (-) strand; PAM type: NRG; PAM sequence: CAG
ctcccaaagtgctagaatta

SEQ ID NO: 27073 - DNA, 20 bp, Artificial Sequence
  Description of Artificial Sequence: Synthetic oligonucleotide
  Target: SCN9A; (-) strand; PAM type: NRG; PAM sequence: TAG
tccgtcgcctcccaaagtgc

SEQ ID NO: 27074 - DNA, 20 bp, Artificial Sequence
  Description of Artificial Sequence: Synthetic oligonucleotide
  Target: SCN9A; (-) strand; PAM type: NRG; PAM sequence: AAG
ccagcctccgtcgcctccca

SEQ ID NO: 27075 - DNA, 20 bp, Artificial Sequence
  Description of Artificial Sequence: Synthetic oligonucleotide
  Target: SCN9A; (-) strand; PAM type: NRG; PAM sequence: CAG
actcctgacctcaggtgatc

SEQ ID NO: 27076 - DNA, 20 bp, Artificial Sequence
  Description of Artificial Sequence: Synthetic oligonucleotide
  Target: SCN9A; (-) strand; PAM type: NRG; PAM sequence: AGG
ggtctcgaactcctgacctc

SEQ ID NO: 27077 - DNA, 20 bp, Artificial Sequence
  Description of Artificial Sequence: Synthetic oligonucleotide
  Target: SCN9A; (-) strand; PAM type: NRG; PAM sequence: CAG
tggtctcgaactcctgacct

SEQ ID NO: 27078 - DNA, 20 bp, Artificial Sequence
  Description of Artificial Sequence: Synthetic oligonucleotide
  Target: SCN9A; (-) strand; PAM type: NRG; PAM sequence: TGG
tttcgtcatgttggccaggc

SEQ ID NO: 27079 - DNA, 20 bp, Artificial Sequence
  Description of Artificial Sequence: Synthetic oligonucleotide
  Target: SCN9A; (-) strand; PAM type: NRG; PAM sequence: AGG
aggttttcgtcatgttggcc

SEQ ID NO: 27080 - DNA, 20 bp, Artificial Sequence
  Description of Artificial Sequence: Synthetic oligonucleotide
  Target: SCN9A; (-) strand; PAM type: NRG; PAM sequence: CAG
caggttttcgtcatgttggc

SEQ ID NO: 27081 - DNA, 20 bp, Artificial Sequence
  Description of Artificial Sequence: Synthetic oligonucleotide
  Target: SCN9A; (-) strand; PAM type: NRG; PAM sequence: TGG
gagacaggttttcgtcatgt

SEQ ID NO: 27082 - DNA, 20 bp, Artificial Sequence
  Description of Artificial Sequence: Synthetic oligonucleotide
  Target: SCN9A; (-) strand; PAM type: NRG; PAM sequence: AGG
tttgtatttttagtagagac

SEQ ID NO: 27083 - DNA, 20 bp, Artificial Sequence
  Description of Artificial Sequence: Synthetic oligonucleotide
  Target: SCN9A; (-) strand; PAM type: NRG; PAM sequence: CAG
ttttgtatttttagtagaga

SEQ ID NO: 27084 - DNA, 20 bp, Artificial Sequence
  Description of Artificial Sequence: Synthetic oligonucleotide
  Target: SCN9A; (-) strand; PAM type: NRG; PAM sequence: GAG
taatttttgtatttttagta

SEQ ID NO: 27085 - DNA, 20 bp, Artificial Sequence
  Description of Artificial Sequence: Synthetic oligonucleotide
  Target: SCN9A; (-) strand; PAM type: NRG; PAM sequence: TAG
gctaatttttgtatttttag

SEQ ID NO: 27086 - DNA, 20 bp, Artificial Sequence
  Description of Artificial Sequence: Synthetic oligonucleotide
  Target: SCN9A; (-) strand; PAM type: NRG; PAM sequence: TAG
ccagctaatttttgtatttt

SEQ ID NO: 27087 - DNA, 20 bp, Artificial Sequence
  Description of Artificial Sequence: Synthetic oligonucleotide
  Target: SCN9A; (-) strand; PAM type: NRG; PAM sequence: CAG
acaggtgcatgctaccgtgc

SEQ ID NO: 27088 - DNA, 20 bp, Artificial Sequence
  Description of Artificial Sequence: Synthetic oligonucleotide
  Target: SCN9A; (-) strand; PAM type: NRG; PAM sequence: AGG
tcctgagtagctgagattac

SEQ ID NO: 27089 - DNA, 20 bp, Artificial Sequence
  Description of Artificial Sequence: Synthetic oligonucleotide
  Target: SCN9A; (-) strand; PAM type: NRG; PAM sequence: CAG
ctcctgagtagctgagatta

SEQ ID NO: 27090 - DNA, 20 bp, Artificial Sequence
  Description of Artificial Sequence: Synthetic oligonucleotide
  Target: SCN9A; (-) strand; PAM type: NRG; PAM sequence: GAG
cctcagcctcctgagtagct

SEQ ID NO: 27091 - DNA, 20 bp, Artificial Sequence
  Description of Artificial Sequence: Synthetic oligonucleotide
  Target: SCN9A; (-) strand; PAM type: NRG; PAM sequence: TAG
ttctgcctcagcctcctgag

SEQ ID NO: 27092 - DNA, 20 bp, Artificial Sequence
  Description of Artificial Sequence: Synthetic oligonucleotide
  Target: SCN9A; (-) strand; PAM type: NRG; PAM sequence: GAG
ttcttctgcctcagcctcct

SEQ ID NO: 27093 - DNA, 20 bp, Artificial Sequence
  Description of Artificial Sequence: Synthetic oligonucleotide
  Target: SCN9A; (-) strand; PAM type: NRG; PAM sequence: CAG
ttcaagcaattcttctgcct

SEQ ID NO: 27094 - DNA, 20 bp, Artificial Sequence
  Description of Artificial Sequence: Synthetic oligonucleotide
  Target: SCN9A; (-) strand; PAM type: NRG; PAM sequence: AAG
aacctccacctcccaggttc

SEQ ID NO: 27095 - DNA, 20 bp, Artificial Sequence
  Description of Artificial Sequence: Synthetic oligonucleotide
  Target: SCN9A; (-) strand; PAM type: NRG; PAM sequence: AGG
caccccaacctccacctccc

SEQ ID NO: 27096 - DNA, 20 bp, Artificial Sequence
  Description of Artificial Sequence: Synthetic oligonucleotide
  Target: SCN9A; (-) strand; PAM type: NRG; PAM sequence: CAG
tcaccccaacctccacctcc

SEQ ID NO: 27097 - DNA, 20 bp, Artificial Sequence
  Description of Artificial Sequence: Synthetic oligonucleotide
  Target: SCN9A; (-) strand; PAM type: NRG; PAM sequence: CGG
ggagtgcaatgatgtgatct

SEQ ID NO: 27098 - DNA, 20 bp, Artificial Sequence
  Description of Artificial Sequence: Synthetic oligonucleotide
  Target: SCN9A; (-) strand; PAM type: NRG; PAM sequence: GAG
tcgctttgttgcccaggctg

SEQ ID NO: 27099 - DNA, 20 bp, Artificial Sequence
  Description of Artificial Sequence: Synthetic oligonucleotide
  Target: SCN9A; (-) strand; PAM type: NRG; PAM sequence: TGG
tctcgctttgttgcccaggc

SEQ ID NO: 27100 - DNA, 20 bp, Artificial Sequence
  Description of Artificial Sequence: Synthetic oligonucleotide
  Target: SCN9A; (-) strand; PAM type: NRG; PAM sequence: AGG
ggaatctcgctttgttgccc

SEQ ID NO: 27101 - DNA, 20 bp, Artificial Sequence
  Description of Artificial Sequence: Synthetic oligonucleotide
  Target: SCN9A; (-) strand; PAM type: NRG; PAM sequence: CAG
tggaatctcgctttgttgcc

SEQ ID NO: 27102 - DNA, 20 bp, Artificial Sequence
  Description of Artificial Sequence: Synthetic oligonucleotide
  Target: SCN9A; (-) strand; PAM type: NRG; PAM sequence: TGG
tattttttttttttttgaga

SEQ ID NO: 27103 - DNA, 20 bp, Artificial Sequence
  Description of Artificial Sequence: Synthetic oligonucleotide
  Target: SCN9A; (-) strand; PAM type: NRG; PAM sequence: GAG
tgtgtatttttttttttttt

SEQ ID NO: 27104 - DNA, 20 bp, Artificial Sequence
  Description of Artificial Sequence: Synthetic oligonucleotide
  Target: SCN9A; (-) strand; PAM type: NRG; PAM sequence: AGG
tatttataagctcctatagc

SEQ ID NO: 27105 - DNA, 20 bp, Artificial Sequence
  Description of Artificial Sequence: Synthetic oligonucleotide
  Target: SCN9A; (-) strand; PAM type: NRG; PAM sequence: CAG
gtatttataagctcctatag

SEQ ID NO: 27106 - DNA, 20 bp, Artificial Sequence
  Description of Artificial Sequence: Synthetic oligonucleotide
  Target: SCN9A; (-) strand; PAM type: NRG; PAM sequence: TAG
tttgtatttataagctccta

SEQ ID NO: 27107 - DNA, 20 bp, Artificial Sequence
  Description of Artificial Sequence: Synthetic oligonucleotide
  Target: SCN9A; (-) strand; PAM type: NRG; PAM sequence: AAG
cttctctgttttgtatttat

SEQ ID NO: 27108 - DNA, 20 bp, Artificial Sequence
  Description of Artificial Sequence: Synthetic oligonucleotide
  Target: SCN9A; (-) strand; PAM type: NRG; PAM sequence: TGG
cttacaaattccttccaata

SEQ ID NO: 27109 - DNA, 20 bp, Artificial Sequence
  Description of Artificial Sequence: Synthetic oligonucleotide
  Target: SCN9A; (-) strand; PAM type: NRG; PAM sequence: TAG
ataagcttcctagttttata

SEQ ID NO: 27110 - DNA, 20 bp, Artificial Sequence
  Description of Artificial Sequence: Synthetic oligonucleotide
  Target: SCN9A; (-) strand; PAM type: NRG; PAM sequence: TAG
gtagtaataaataagcttcc

SEQ ID NO: 27111 - DNA, 20 bp, Artificial Sequence
  Description of Artificial Sequence: Synthetic oligonucleotide
  Target: SCN9A; (-) strand; PAM type: NRG; PAM sequence: AAG
ctcaagttgtagtaataaat

SEQ ID NO: 27112 - DNA, 20 bp, Artificial Sequence
  Description of Artificial Sequence: Synthetic oligonucleotide
  Target: SCN9A; (-) strand; PAM type: NRG; PAM sequence: TAG
tgttgatcaccctcaagttg

SEQ ID NO: 27113 - DNA, 20 bp, Artificial Sequence
  Description of Artificial Sequence: Synthetic oligonucleotide
  Target: SCN9A; (-) strand; PAM type: NRG; PAM sequence: AAG
tataattgttgatcaccctc

SEQ ID NO: 27114 - DNA, 20 bp, Artificial Sequence
  Description of Artificial Sequence: Synthetic oligonucleotide
  Target: SCN9A; (-) strand; PAM type: NRG; PAM sequence: TGG
tgcacaaaaaatatacatcc

SEQ ID NO: 27115 - DNA, 20 bp, Artificial Sequence
  Description of Artificial Sequence: Synthetic oligonucleotide
  Target: SCN9A; (-) strand; PAM type: NRG; PAM sequence: TAG
catttatgcagcacaaattc

SEQ ID NO: 27116 - DNA, 20 bp, Artificial Sequence
  Description of Artificial Sequence: Synthetic oligonucleotide
  Target: SCN9A; (-) strand; PAM type: NRG; PAM sequence: CAG
catacacaaaggcatttatg

SEQ ID NO: 27117 - DNA, 20 bp, Artificial Sequence
  Description of Artificial Sequence: Synthetic oligonucleotide
  Target: SCN9A; (-) strand; PAM type: NRG; PAM sequence: AGG
actgtgccagacatacacaa

SEQ ID NO: 27118 - DNA, 20 bp, Artificial Sequence
  Description of Artificial Sequence: Synthetic oligonucleotide
  Target: SCN9A; (-) strand; PAM type: NRG; PAM sequence: AAG
tactgtgccagacatacaca

SEQ ID NO: 27119 - DNA, 20 bp, Artificial Sequence
  Description of Artificial Sequence: Synthetic oligonucleotide
  Target: SCN9A; (-) strand; PAM type: NRG; PAM sequence: CAG
cacactaaatgatactgtgc

SEQ ID NO: 27120 - DNA, 20 bp, Artificial Sequence
  Description of Artificial Sequence: Synthetic oligonucleotide
  Target: SCN9A; (-) strand; PAM type: NRG; PAM sequence: CAG
gacagaaacttacattcatc

SEQ ID NO: 27121 - DNA, 20 bp, Artificial Sequence
  Description of Artificial Sequence: Synthetic oligonucleotide
  Target: SCN9A; (-) strand; PAM type: NRG; PAM sequence: CAG
agaggattcagaagtcagga

SEQ ID NO: 27122 - DNA, 20 bp, Artificial Sequence
  Description of Artificial Sequence: Synthetic oligonucleotide
  Target: SCN9A; (-) strand; PAM type: NRG; PAM sequence: AGG
aaaaagaggattcagaagtc

SEQ ID NO: 27123 - DNA, 20 bp, Artificial Sequence
  Description of Artificial Sequence: Synthetic oligonucleotide
  Target: SCN9A; (-) strand; PAM type: NRG; PAM sequence: CAG
taaaaagaggattcagaagt

SEQ ID NO: 27124 - DNA, 20 bp, Artificial Sequence
  Description of Artificial Sequence: Synthetic oligonucleotide
  Target: SCN9A; (-) strand; PAM type: NRG; PAM sequence: AAG
accataaaaagaggattcag

SEQ ID NO: 27125 - DNA, 20 bp, Artificial Sequence
  Description of Artificial Sequence: Synthetic oligonucleotide
  Target: SCN9A; (-) strand; PAM type: NRG; PAM sequence: CAG
accaccataaaaagaggatt

SEQ ID NO: 27126 - DNA, 20 bp, Artificial Sequence
  Description of Artificial Sequence: Synthetic oligonucleotide
  Target: SCN9A; (-) strand; PAM type: NRG; PAM sequence: AGG
cttgtaaccaccataaaaag

SEQ ID NO: 27127 - DNA, 20 bp, Artificial Sequence
  Description of Artificial Sequence: Synthetic oligonucleotide
  Target: SCN9A; (-) strand; PAM type: NRG; PAM sequence: GAG
ccttgtaaccaccataaaaa

SEQ ID NO: 27128 - DNA, 20 bp, Artificial Sequence
  Description of Artificial Sequence: Synthetic oligonucleotide
  Target: SCN9A; (-) strand; PAM type: NRG; PAM sequence: AAG
gtccttgtaaccaccataaa

SEQ ID NO: 27129 - DNA, 20 bp, Artificial Sequence
  Description of Artificial Sequence: Synthetic oligonucleotide
  Target: SCN9A; (-) strand; PAM type: NRG; PAM sequence: GAG
aagtgccttcacttcccact

SEQ ID NO: 27130 - DNA, 20 bp, Artificial Sequence
  Description of Artificial Sequence: Synthetic oligonucleotide
  Target: SCN9A; (-) strand; PAM type: NRG; PAM sequence: AAG
tatggtaacagccatatggt

SEQ ID NO: 27131 - DNA, 20 bp, Artificial Sequence
  Description of Artificial Sequence: Synthetic oligonucleotide
  Target: SCN9A; (-) strand; PAM type: NRG; PAM sequence: TGG
gggatatggtaacagccata

SEQ ID NO: 27132 - DNA, 20 bp, Artificial Sequence
  Description of Artificial Sequence: Synthetic oligonucleotide
  Target: SCN9A; (-) strand; PAM type: NRG; PAM sequence: CAG
cagaaggtgggatatggtaa

SEQ ID NO: 27133 - DNA, 20 bp, Artificial Sequence
  Description of Artificial Sequence: Synthetic oligonucleotide
  Target: SCN9A; (-) strand; PAM type: NRG; PAM sequence: TGG
ggtatccagaaggtgggata

SEQ ID NO: 27134 - DNA, 20 bp, Artificial Sequence
  Description of Artificial Sequence: Synthetic oligonucleotide
  Target: SCN9A; (-) strand; PAM type: NRG; PAM sequence: GGG
tcatcaggtatccagaaggt

SEQ ID NO: 27135 - DNA, 20 bp, Artificial Sequence
  Description of Artificial Sequence: Synthetic oligonucleotide
  Target: SCN9A; (-) strand; PAM type: NRG; PAM sequence: TGG
ctcatcaggtatccagaagg

SEQ ID NO: 27136 - DNA, 20 bp, Artificial Sequence
  Description of Artificial Sequence: Synthetic oligonucleotide
  Target: SCN9A; (-) strand; PAM type: NRG; PAM sequence: AGG
tctctcatcaggtatccaga

SEQ ID NO: 27137 - DNA, 20 bp, Artificial Sequence
  Description of Artificial Sequence: Synthetic oligonucleotide
  Target: SCN9A; (-) strand; PAM type: NRG; PAM sequence: AAG
atctctcatcaggtatccag

SEQ ID NO: 27138 - DNA, 20 bp, Artificial Sequence
  Description of Artificial Sequence: Synthetic oligonucleotide
  Target: SCN9A; (-) strand; PAM type: NRG; PAM sequence: CAG
caaatctctcatcaggtatc

SEQ ID NO: 27139 - DNA, 20 bp, Artificial Sequence
  Description of Artificial Sequence: Synthetic oligonucleotide
  Target: SCN9A; (-) strand; PAM type: NRG; PAM sequence: AGG
ttgacatcaaatctctcatc

SEQ ID NO: 27140 - DNA, 20 bp, Artificial Sequence
  Description of Artificial Sequence: Synthetic oligonucleotide
  Target: SCN9A; (-) strand; PAM type: NRG; PAM sequence: CAG
cttgacatcaaatctctcat

SEQ ID NO: 27141 - DNA, 20 bp, Artificial Sequence
  Description of Artificial Sequence: Synthetic oligonucleotide
  Target: SCN9A; (-) strand; PAM type: NRG; PAM sequence: CAG
gttgacttgtcacagttggt

SEQ ID NO: 27142 - DNA, 20 bp, Artificial Sequence
  Description of Artificial Sequence: Synthetic oligonucleotide
  Target: SCN9A; (-) strand; PAM type: NRG; PAM sequence: TGG
ccacgttgacttgtcacagt

SEQ ID NO: 27143 - DNA, 20 bp, Artificial Sequence
  Description of Artificial Sequence: Synthetic oligonucleotide
  Target: SCN9A; (-) strand; PAM type: NRG; PAM sequence: CAG
tctgccacgttgacttgtca

SEQ ID NO: 27144 - DNA, 20 bp, Artificial Sequence
  Description of Artificial Sequence: Synthetic oligonucleotide
  Target: SCN9A; (-) strand; PAM type: NRG; PAM sequence: GAG
gggataaaatgctcttctat

SEQ ID NO: 27145 - DNA, 20 bp, Artificial Sequence
  Description of Artificial Sequence: Synthetic oligonucleotide
  Target: SCN9A; (-) strand; PAM type: NRG; PAM sequence: GGG
cttacaagcaggagaaaatt

SEQ ID NO: 27146 - DNA, 20 bp, Artificial Sequence
  Description of Artificial Sequence: Synthetic oligonucleotide
  Target: SCN9A; (-) strand; PAM type: NRG; PAM sequence: TGG
gcttacaagcaggagaaaat

SEQ ID NO: 27147 - DNA, 20 bp, Artificial Sequence
  Description of Artificial Sequence: Synthetic oligonucleotide
  Target: SCN9A; (-) strand; PAM type: NRG; PAM sequence: GAG
actttcaagcttacaagcag

SEQ ID NO: 27148 - DNA, 20 bp, Artificial Sequence
  Description of Artificial Sequence: Synthetic oligonucleotide
  Target: SCN9A; (-) strand; PAM type: NRG; PAM sequence: AGG
aaactttcaagcttacaagc

SEQ ID NO: 27149 - DNA, 20 bp, Artificial Sequence
  Description of Artificial Sequence: Synthetic oligonucleotide
  Target: SCN9A; (-) strand; PAM type: NRG; PAM sequence: CAG
aaaactttcaagcttacaag

SEQ ID NO: 27150 - DNA, 20 bp, Artificial Sequence
  Description of Artificial Sequence: Synthetic oligonucleotide
  Target: SCN9A; (-) strand; PAM type: NRG; PAM sequence: AAG
gtgaaaactttcaagcttac

SEQ ID NO: 27151 - DNA, 20 bp, Artificial Sequence
  Description of Artificial Sequence: Synthetic oligonucleotide
  Target: SCN9A; (-) strand; PAM type: NRG; PAM sequence: AAG
actgattagtgaaaactttc

SEQ ID NO: 27152 - DNA, 20 bp, Artificial Sequence
  Description of Artificial Sequence: Synthetic oligonucleotide
  Target: SCN9A; (-) strand; PAM type: NRG; PAM sequence: TAG
tttttcttccttatactgat

SEQ ID NO: 27153 - DNA, 20 bp, Artificial Sequence
  Description of Artificial Sequence: Synthetic oligonucleotide
  Target: SCN9A; (-) strand; PAM type: NRG; PAM sequence: TGG
tttttgaattagtgttttct

SEQ ID NO: 27154 - DNA, 20 bp, Artificial Sequence
  Description of Artificial Sequence: Synthetic oligonucleotide
  Target: SCN9A; (-) strand; PAM type: NRG; PAM sequence: TAG
aatctgcctactttttgaat

SEQ ID NO: 27155 - DNA, 20 bp, Artificial Sequence
  Description of Artificial Sequence: Synthetic oligonucleotide
  Target: SCN9A; (-) strand; PAM type: NRG; PAM sequence: TAG
cctatagcatcgcgtggaca

SEQ ID NO: 27156 - DNA, 20 bp, Artificial Sequence
  Description of Artificial Sequence: Synthetic oligonucleotide
  Target: SCN9A; (-) strand; PAM type: NRG; PAM sequence: TGG
cactggcctatagcatcgcg

SEQ ID NO: 27157 - DNA, 20 bp, Artificial Sequence
  Description of Artificial Sequence: Synthetic oligonucleotide
  Target: SCN9A; (-) strand; PAM type: NRG; PAM sequence: TAG
gttttccagccactggccta

SEQ ID NO: 27158 - DNA, 20 bp, Artificial Sequence
  Description of Artificial Sequence: Synthetic oligonucleotide
  Target: SCN9A; (-) strand; PAM type: NRG; PAM sequence: TGG
cgaaaaagttttccagccac

SEQ ID NO: 27159 - DNA, 20 bp, Artificial Sequence
  Description of Artificial Sequence: Synthetic oligonucleotide
  Target: SCN9A; (-) strand; PAM type: NRG; PAM sequence: CAG
ccctttacgaaaaagttttc

SEQ ID NO: 27160 - DNA, 20 bp, Artificial Sequence
  Description of Artificial Sequence: Synthetic oligonucleotide
  Target: SCN9A; (-) strand; PAM type: NRG; PAM sequence: AAG
tcatttggccctttacgaaa

SEQ ID NO: 27161 - DNA, 20 bp, Artificial Sequence
  Description of Artificial Sequence: Synthetic oligonucleotide
  Target: SCN9A; (-) strand; PAM type: NRG; PAM sequence: TGG
agtctaaaatatttatcatt

SEQ ID NO: 27162 - DNA, 20 bp, Artificial Sequence
  Description of Artificial Sequence: Synthetic oligonucleotide
  Target: SCN9A; (-) strand; PAM type: NRG; PAM sequence: AAG
tagaaatcgtatgcccaata

SEQ ID NO: 27163 - DNA, 20 bp, Artificial Sequence
  Description of Artificial Sequence: Synthetic oligonucleotide
  Target: SCN9A; (-) strand; PAM type: NRG; PAM sequence: TAG
gcagaggtgaatagctgcca

SEQ ID NO: 27164 - DNA, 20 bp, Artificial Sequence
  Description of Artificial Sequence: Synthetic oligonucleotide
  Target: SCN9A; (-) strand; PAM type: NRG; PAM sequence: TAG
attacagtggcagaggtgaa

SEQ ID NO: 27165 - DNA, 20 bp, Artificial Sequence
  Description of Artificial Sequence: Synthetic oligonucleotide
  Target: SCN9A; (-) strand; PAM type: NRG; PAM sequence: AGG
cttttacattacagtggcag

SEQ ID NO: 27166 - DNA, 20 bp, Artificial Sequence
  Description of Artificial Sequence: Synthetic oligonucleotide
  Target: SCN9A; (-) strand; PAM type: NRG; PAM sequence: GAG
gcttttacattacagtggca

SEQ ID NO: 27167 - DNA, 20 bp, Artificial Sequence
  Description of Artificial Sequence: Synthetic oligonucleotide
  Target: SCN9A; (-) strand; PAM type: NRG; PAM sequence: CAG
ctgcttttacattacagtgg

SEQ ID NO: 27168 - DNA, 20 bp, Artificial Sequence
  Description of Artificial Sequence: Synthetic oligonucleotide
  Target: SCN9A; (-) strand; PAM type: NRG; PAM sequence: TGG
tgactgcttttacattacag

SEQ ID NO: 27169 - DNA, 20 bp, Artificial Sequence
  Description of Artificial Sequence: Synthetic oligonucleotide
  Target: SCN9A; (-) strand; PAM type: NRG; PAM sequence: CAG
ctatgactgcttttacatta

SEQ ID NO: 27170 - DNA, 20 bp, Artificial Sequence
  Description of Artificial Sequence: Synthetic oligonucleotide
  Target: SCN9A; (-) strand; PAM type: NRG; PAM sequence: AGG
cataaactttattcaaacat

SEQ ID NO: 27171 - DNA, 20 bp, Artificial Sequence
  Description of Artificial Sequence: Synthetic oligonucleotide
  Target: SCN9A; (-) strand; PAM type: NRG; PAM sequence: TAG
tcataaactttattcaaaca

SEQ ID NO: 27172 - DNA, 20 bp, Artificial Sequence
  Description of Artificial Sequence: Synthetic oligonucleotide
  Target: SCN9A; (-) strand; PAM type: NRG; PAM sequence: TAG
attatatgaaatgcaaattt

SEQ ID NO: 27173 - DNA, 20 bp, Artificial Sequence
  Description of Artificial Sequence: Synthetic oligonucleotide
  Target: SCN9A; (-) strand; PAM type: NRG; PAM sequence: AAG
gtggttaaaataatcaaaag

SEQ ID NO: 27174 - DNA, 20 bp, Artificial Sequence
  Description of Artificial Sequence: Synthetic oligonucleotide
  Target: SCN9A; (-) strand; PAM type: NRG; PAM sequence: AAG
taagtggttaaaataatcaa

SEQ ID NO: 27175 - DNA, 20 bp, Artificial Sequence
  Description of Artificial Sequence: Synthetic oligonucleotide
  Target: SCN9A; (-) strand; PAM type: NRG; PAM sequence: TGG
atgatttttacatttttaag

SEQ ID NO: 27176 - DNA, 20 bp, Artificial Sequence
  Description of Artificial Sequence: Synthetic oligonucleotide
  Target: SCN9A; (-) strand; PAM type: NRG; PAM sequence: AAG
agaatgatttttacattttt

SEQ ID NO: 27177 - DNA, 20 bp, Artificial Sequence
  Description of Artificial Sequence: Synthetic oligonucleotide
  Target: SCN9A; (-) strand; PAM type: NRG; PAM sequence: AAG
attgtgtggccctgggagct

SEQ ID NO: 27178 - DNA, 20 bp, Artificial Sequence
  Description of Artificial Sequence: Synthetic oligonucleotide
  Target: SCN9A; (-) strand; PAM type: NRG; PAM sequence: GAG
ctgttattgtgtggccctgg

SEQ ID NO: 27179 - DNA, 20 bp, Artificial Sequence
  Description of Artificial Sequence: Synthetic oligonucleotide
  Target: SCN9A; (-) strand; PAM type: NRG; PAM sequence: GGG
gcctgttattgtgtggccct

SEQ ID NO: 27180 - DNA, 20 bp, Artificial Sequence
  Description of Artificial Sequence: Synthetic oligonucleotide
  Target: SCN9A; (-) strand; PAM type: NRG; PAM sequence: TGG
tgcctgttattgtgtggccc

SEQ ID NO: 27181 - DNA, 20 bp, Artificial Sequence
  Description of Artificial Sequence: Synthetic oligonucleotide
  Target: SCN9A; (-) strand; PAM type: NRG; PAM sequence: TGG
gtccaatgcctgttattgtg

SEQ ID NO: 27182 - DNA, 20 bp, Artificial Sequence
  Description of Artificial Sequence: Synthetic oligonucleotide
  Target: SCN9A; (-) strand; PAM type: NRG; PAM sequence: CAG
tatgccccacagaccaaagc

SEQ ID NO: 27183 - DNA, 20 bp, Artificial Sequence
  Description of Artificial Sequence: Synthetic oligonucleotide
  Target: SCN9A; (-) strand; PAM type: NRG; PAM sequence: AAG
cacctatgccccacagacca

SEQ ID NO: 27184 - DNA, 20 bp, Artificial Sequence
  Description of Artificial Sequence: Synthetic oligonucleotide
  Target: SCN9A; (-) strand; PAM type: NRG; PAM sequence: CAG
ggatcagcacctatgcccca

SEQ ID NO: 27185 - DNA, 20 bp, Artificial Sequence
  Description of Artificial Sequence: Synthetic oligonucleotide
  Target: SCN9A; (-) strand; PAM type: NRG; PAM sequence: CAG
ctagcctctatagcaaggat

SEQ ID NO: 27186 - DNA, 20 bp, Artificial Sequence
  Description of Artificial Sequence: Synthetic oligonucleotide
  Target: SCN9A; (-) strand; PAM type: NRG; PAM sequence: AGG
taagactagcctctatagca

SEQ ID NO: 27187 - DNA, 20 bp, Artificial Sequence
  Description of Artificial Sequence: Synthetic oligonucleotide
  Target: SCN9A; (-) strand; PAM type: NRG; PAM sequence: AAG
gtaagactagcctctatagc

SEQ ID NO: 27188 - DNA, 20 bp, Artificial Sequence
  Description of Artificial Sequence: Synthetic oligonucleotide
  Target: SCN9A; (-) strand; PAM type: NRG; PAM sequence: TAG
atgtgtaagactagcctcta

SEQ ID NO: 27189 - DNA, 20 bp, Artificial Sequence
  Description of Artificial Sequence: Synthetic oligonucleotide
  Target: SCN9A; (-) strand; PAM type: NRG; PAM sequence: TAG
cttatagccatgtgtaagac

SEQ ID NO: 27190 - DNA, 20 bp, Artificial Sequence
  Description of Artificial Sequence: Synthetic oligonucleotide
  Target: SCN9A; (-) strand; PAM type: NRG; PAM sequence: AAG
cgcaccttatagccatgtgt

SEQ ID NO: 27191 - DNA, 20 bp, Artificial Sequence
  Description of Artificial Sequence: Synthetic oligonucleotide
  Target: SCN9A; (-) strand; PAM type: NRG; PAM sequence: TAG
aggactggtcccgcacctta

SEQ ID NO: 27192 - DNA, 20 bp, Artificial Sequence
  Description of Artificial Sequence: Synthetic oligonucleotide
  Target: SCN9A; (-) strand; PAM type: NRG; PAM sequence: TGG
accaaggcaaatgaaaggac

SEQ ID NO: 27193 - DNA, 20 bp, Artificial Sequence
  Description of Artificial Sequence: Synthetic oligonucleotide
  Target: SCN9A; (-) strand; PAM type: NRG; PAM sequence: AGG
aatggaccaaggcaaatgaa

SEQ ID NO: 27194 - DNA, 20 bp, Artificial Sequence
  Description of Artificial Sequence: Synthetic oligonucleotide
  Target: SCN9A; (-) strand; PAM type: NRG; PAM sequence: AAG
taatggaccaaggcaaatga

SEQ ID NO: 27195 - DNA, 20 bp, Artificial Sequence
  Description of Artificial Sequence: Synthetic oligonucleotide
  Target: SCN9A; (-) strand; PAM type: NRG; PAM sequence: AGG
atgaagttaataatggacca

SEQ ID NO: 27196 - DNA, 20 bp, Artificial Sequence
  Description of Artificial Sequence: Synthetic oligonucleotide
  Target: SCN9A; (-) strand; PAM type: NRG; PAM sequence: AAG
aatgaagttaataatggacc

SEQ ID NO: 27197 - DNA, 20 bp, Artificial Sequence
  Description of Artificial Sequence: Synthetic oligonucleotide
  Target: SCN9A; (-) strand; PAM type: NRG; PAM sequence: TGG
aacaaaaatgaagttaataa

SEQ ID NO: 27198 - DNA, 20 bp, Artificial Sequence
  Description of Artificial Sequence: Synthetic oligonucleotide
  Target: SCN9A; (-) strand; PAM type: NRG; PAM sequence: AAG
agttaataataacaaaaatg

SEQ ID NO: 27199 - DNA, 20 bp, Artificial Sequence
  Description of Artificial Sequence: Synthetic oligonucleotide
  Target: SCN9A; (-) strand; PAM type: NRG; PAM sequence: AAG
ctagtaaataaaatataatt

SEQ ID NO: 27200 - DNA, 20 bp, Artificial Sequence
  Description of Artificial Sequence: Synthetic oligonucleotide
  Target: SCN9A; (-) strand; PAM type: NRG; PAM sequence: TAG
atgctctcttgaagctatac

SEQ ID NO: 27201 - DNA, 20 bp, Artificial Sequence
  Description of Artificial Sequence: Synthetic oligonucleotide
  Target: SCN9A; (-) strand; PAM type: NRG; PAM sequence: AAG
tgatggcatatgctctcttg

SEQ ID NO: 27202 - DNA, 20 bp, Artificial Sequence
  Description of Artificial Sequence: Synthetic oligonucleotide
  Target: SCN9A; (-) strand; PAM type: NRG; PAM sequence: TGG
ttctctaattttgaaagtga

SEQ ID NO: 27203 - DNA, 20 bp, Artificial Sequence
  Description of Artificial Sequence: Synthetic oligonucleotide
  Target: SCN9A; (-) strand; PAM type: NRG; PAM sequence: AAG
atctttttctctaattttga

SEQ ID NO: 27204 - DNA, 20 bp, Artificial Sequence
  Description of Artificial Sequence: Synthetic oligonucleotide
  Target: SCN9A; (-) strand; PAM type: NRG; PAM sequence: AGG
gcctattcattttaaggcaa

SEQ ID NO: 27205 - DNA, 20 bp, Artificial Sequence
  Description of Artificial Sequence: Synthetic oligonucleotide
  Target: SCN9A; (-) strand; PAM type: NRG; PAM sequence: AAG
tgcctattcattttaaggca

SEQ ID NO: 27206 - DNA, 20 bp, Artificial Sequence
  Description of Artificial Sequence: Synthetic oligonucleotide
  Target: SCN9A; (-) strand; PAM type: NRG; PAM sequence: AGG
atcactgcctattcatttta

SEQ ID NO: 27207 - DNA, 20 bp, Artificial Sequence
  Description of Artificial Sequence: Synthetic oligonucleotide
  Target: SCN9A; (-) strand; PAM type: NRG; PAM sequence: AAG
aatcactgcctattcatttt

SEQ ID NO: 27208 - DNA, 20 bp, Artificial Sequence
  Description of Artificial Sequence: Synthetic oligonucleotide
  Target: SCN9A; (-) strand; PAM type: NRG; PAM sequence: TAG
aaattttgtattagttttcc

SEQ ID NO: 27209 - DNA, 20 bp, Artificial Sequence
  Description of Artificial Sequence: Synthetic oligonucleotide
  Target: SCN9A; (-) strand; PAM type: NRG; PAM sequence: TAG
aagagaacgaaattttgtat

SEQ ID NO: 27210 - DNA, 20 bp, Artificial Sequence
  Description of Artificial Sequence: Synthetic oligonucleotide
  Target: SCN9A; (-) strand; PAM type: NRG; PAM sequence: GAG
atacaagaaagaacaggaaa

SEQ ID NO: 27211 - DNA, 20 bp, Artificial Sequence
  Description of Artificial Sequence: Synthetic oligonucleotide
  Target: SCN9A; (-) strand; PAM type: NRG; PAM sequence: AAG
taatacaagaaagaacagga

SEQ ID NO: 27212 - DNA, 20 bp, Artificial Sequence
  Description of Artificial Sequence: Synthetic oligonucleotide
  Target: SCN9A; (-) strand; PAM type: NRG; PAM sequence: AGG
attttaatacaagaaagaac

SEQ ID NO: 27213 - DNA, 20 bp, Artificial Sequence
  Description of Artificial Sequence: Synthetic oligonucleotide
  Target: SCN9A; (-) strand; PAM type: NRG; PAM sequence: CAG
aattttaatacaagaaagaa

SEQ ID NO: 27214 - DNA, 20 bp, Artificial Sequence
  Description of Artificial Sequence: Synthetic oligonucleotide
  Target: SCN9A; (-) strand; PAM type: NRG; PAM sequence: AAG
gtgataattttaatacaaga

SEQ ID NO: 27215 - DNA, 20 bp, Artificial Sequence
  Description of Artificial Sequence: Synthetic oligonucleotide
  Target: SCN9A; (-) strand; PAM type: NRG; PAM sequence: AAG
aatagtgataattttaatac

SEQ ID NO: 27216 - DNA, 20 bp, Artificial Sequence
  Description of Artificial Sequence: Synthetic oligonucleotide
  Target: SCN9A; (-) strand; PAM type: NRG; PAM sequence: TAG
aattattaattgcaaaagaa

SEQ ID NO: 27217 - DNA, 20 bp, Artificial Sequence
  Description of Artificial Sequence: Synthetic oligonucleotide
  Target: SCN9A; (-) strand; PAM type: NRG; PAM sequence: AAG
tctacaattattaattgcaa

SEQ ID NO: 27218 - DNA, 20 bp, Artificial Sequence
  Description of Artificial Sequence: Synthetic oligonucleotide
  Target: SCN9A; (-) strand; PAM type: NRG; PAM sequence: TGG
catgcattttaatttctctg

SEQ ID NO: 27219 - DNA, 20 bp, Artificial Sequence
  Description of Artificial Sequence: Synthetic oligonucleotide
  Target: SCN9A; (-) strand; PAM type: NRG; PAM sequence: CAG
gaaacctggtggtatgtaac

SEQ ID NO: 27220 - DNA, 20 bp, Artificial Sequence
  Description of Artificial Sequence: Synthetic oligonucleotide
  Target: SCN9A; (-) strand; PAM type: NRG; PAM sequence: TGG
catggtcattggaaacctgg

SEQ ID NO: 27221 - DNA, 20 bp, Artificial Sequence
  Description of Artificial Sequence: Synthetic oligonucleotide
  Target: SCN9A; (-) strand; PAM type: NRG; PAM sequence: TGG
ggtcatggtcattggaaacc

SEQ ID NO: 27222 - DNA, 20 bp, Artificial Sequence
  Description of Artificial Sequence: Synthetic oligonucleotide
  Target: SCN9A; (-) strand; PAM type: NRG; PAM sequence: TGG
tacatgatggtcatggtcat

SEQ ID NO: 27223 - DNA, 20 bp, Artificial Sequence
  Description of Artificial Sequence: Synthetic oligonucleotide
  Target: SCN9A; (-) strand; PAM type: NRG; PAM sequence: TGG
tattgtttacatgatggtca

SEQ ID NO: 27224 - DNA, 20 bp, Artificial Sequence
  Description of Artificial Sequence: Synthetic oligonucleotide
  Target: SCN9A; (-) strand; PAM type: NRG; PAM sequence: TGG
gtgccttattgtttacatga

SEQ ID NO: 27225 - DNA, 20 bp, Artificial Sequence
  Description of Artificial Sequence: Synthetic oligonucleotide
  Target: SCN9A; (-) strand; PAM type: NRG; PAM sequence: AAG
ctgtatggaggtcgctggtc

SEQ ID NO: 27226 - DNA, 20 bp, Artificial Sequence
  Description of Artificial Sequence: Synthetic oligonucleotide
  Target: SCN9A; (-) strand; PAM type: NRG; PAM sequence: TGG
tgggactgtatggaggtcgc

SEQ ID NO: 27227 - DNA, 20 bp, Artificial Sequence
  Description of Artificial Sequence: Synthetic oligonucleotide
  Target: SCN9A; (-) strand; PAM type: NRG; PAM sequence: AGG
gaccatgtgggactgtatgg

SEQ ID NO: 27228 - DNA, 20 bp, Artificial Sequence
  Description of Artificial Sequence: Synthetic oligonucleotide
  Target: SCN9A; (-) strand; PAM type: NRG; PAM sequence: GAG
agaccatgtgggactgtatg

SEQ ID NO: 27229 - DNA, 20 bp, Artificial Sequence
  Description of Artificial Sequence: Synthetic oligonucleotide
  Target: SCN9A; (-) strand; PAM type: NRG; PAM sequence: TGG
agagaccatgtgggactgta

SEQ ID NO: 27230 - DNA, 20 bp, Artificial Sequence
  Description of Artificial Sequence: Synthetic oligonucleotide
  Target: SCN9A; (-) strand; PAM type: NRG; PAM sequence: GGG
agagtggatagagaccatgt

SEQ ID NO: 27231 - DNA, 20 bp, Artificial Sequence
  Description of Artificial Sequence: Synthetic oligonucleotide
  Target: SCN9A; (-) strand; PAM type: NRG; PAM sequence: TGG
gagagtggatagagaccatg

SEQ ID NO: 27232 - DNA, 20 bp, Artificial Sequence
  Description of Artificial Sequence: Synthetic oligonucleotide
  Target: SCN9A; (-) strand; PAM type: NRG; PAM sequence: GAG
tgctgtgtggagagtggata

SEQ ID NO: 27233 - DNA, 20 bp, Artificial Sequence
  Description of Artificial Sequence: Synthetic oligonucleotide
  Target: SCN9A; (-) strand; PAM type: NRG; PAM sequence: TAG
cgtgctgtgtggagagtgga

SEQ ID NO: 27234 - DNA, 20 bp, Artificial Sequence
  Description of Artificial Sequence: Synthetic oligonucleotide
  Target: SCN9A; (-) strand; PAM type: NRG; PAM sequence: TGG
tccgcgtgctgtgtggagag

SEQ ID NO: 27235 - DNA, 20 bp, Artificial Sequence
  Description of Artificial Sequence: Synthetic oligonucleotide
  Target: SCN9A; (-) strand; PAM type: NRG; PAM sequence: GAG
tgttccgcgtgctgtgtgga

SEQ ID NO: 27236 - DNA, 20 bp, Artificial Sequence
  Description of Artificial Sequence: Synthetic oligonucleotide
  Target: SCN9A; (-) strand; PAM type: NRG; PAM sequence: GAG
tgtgttccgcgtgctgtgtg

SEQ ID NO: 27237 - DNA, 20 bp, Artificial Sequence
  Description of Artificial Sequence: Synthetic oligonucleotide
  Target: SCN9A; (-) strand; PAM type: NRG; PAM sequence: TGG
attgtgttccgcgtgctgtg

SEQ ID NO: 27238 - DNA, 20 bp, Artificial Sequence
  Description of Artificial Sequence: Synthetic oligonucleotide
  Target: SCN9A; (-) strand; PAM type: NRG; PAM sequence: TGG
atgactgtacgctcccacgg

SEQ ID NO: 27239 - DNA, 20 bp, Artificial Sequence
  Description of Artificial Sequence: Synthetic oligonucleotide
  Target: SCN9A; (-) strand; PAM type: NRG; PAM sequence: CGG
atgatgactgtacgctccca

SEQ ID NO: 27240 - DNA, 20 bp, Artificial Sequence
  Description of Artificial Sequence: Synthetic oligonucleotide
  Target: SCN9A; (-) strand; PAM type: NRG; PAM sequence: AAG
gctacaaagaatgtgtctgc

SEQ ID NO: 27241 - DNA, 20 bp, Artificial Sequence
  Description of Artificial Sequence: Synthetic oligonucleotide
  Target: SCN9A; (-) strand; PAM type: NRG; PAM sequence: AAG
gctctttggtaagagctaca

SEQ ID NO: 27242 - DNA, 20 bp, Artificial Sequence
  Description of Artificial Sequence: Synthetic oligonucleotide
  Target: SCN9A; (-) strand; PAM type: NRG; PAM sequence: GAG
ggcatgcagctctttggtaa

SEQ ID NO: 27243 - DNA, 20 bp, Artificial Sequence
  Description of Artificial Sequence: Synthetic oligonucleotide
  Target: SCN9A; (-) strand; PAM type: NRG; PAM sequence: AAG
tcggcatgcagctctttggt

SEQ ID NO: 27244 - DNA, 20 bp, Artificial Sequence
  Description of Artificial Sequence: Synthetic oligonucleotide
  Target: SCN9A; (-) strand; PAM type: NRG; PAM sequence: TGG
gtggtcggcatgcagctctt

SEQ ID NO: 27245 - DNA, 20 bp, Artificial Sequence
  Description of Artificial Sequence: Synthetic oligonucleotide
  Target: SCN9A; (-) strand; PAM type: NRG; PAM sequence: CAG
tttttgctgtggtcggcatg

SEQ ID NO: 27246 - DNA, 20 bp, Artificial Sequence
  Description of Artificial Sequence: Synthetic oligonucleotide
  Target: SCN9A; (-) strand; PAM type: NRG; PAM sequence: CGG
gtcttcatttttgctgtggt

SEQ ID NO: 27247 - DNA, 20 bp, Artificial Sequence
  Description of Artificial Sequence: Synthetic oligonucleotide
  Target: SCN9A; (-) strand; PAM type: NRG; PAM sequence: TGG
catcgtcttcatttttgctg

SEQ ID NO: 27248 - DNA, 20 bp, Artificial Sequence
  Description of Artificial Sequence: Synthetic oligonucleotide
  Target: SCN9A; (-) strand; PAM type: NRG; PAM sequence: TGG
aggtaacctcaccttagtgt

SEQ ID NO: 27249 - DNA, 20 bp, Artificial Sequence
  Description of Artificial Sequence: Synthetic oligonucleotide
  Target: SCN9A; (-) strand; PAM type: NRG; PAM sequence: TAG
ggctctaggtaacctcacct

SEQ ID NO: 27250 - DNA, 20 bp, Artificial Sequence
  Description of Artificial Sequence: Synthetic oligonucleotide
  Target: SCN9A; (-) strand; PAM type: NRG; PAM sequence: AGG
ggtaactcagtaggggctct

SEQ ID NO: 27251 - DNA, 20 bp, Artificial Sequence
  Description of Artificial Sequence: Synthetic oligonucleotide
  Target: SCN9A; (-) strand; PAM type: NRG; PAM sequence: TAG
tggtaactcagtaggggctc

SEQ ID NO: 27252 - DNA, 20 bp, Artificial Sequence
  Description of Artificial Sequence: Synthetic oligonucleotide
  Target: SCN9A; (-) strand; PAM type: NRG; PAM sequence: GGG
gatcattggtaactcagtag

SEQ ID NO: 27253 - DNA, 20 bp, Artificial Sequence
  Description of Artificial Sequence: Synthetic oligonucleotide
  Target: SCN9A; (-) strand; PAM type: NRG; PAM sequence: GGG
agatcattggtaactcagta

SEQ ID NO: 27254 - DNA, 20 bp, Artificial Sequence
  Description of Artificial Sequence: Synthetic oligonucleotide
  Target: SCN9A; (-) strand; PAM type: NRG; PAM sequence: AGG
aagatcattggtaactcagt

SEQ ID NO: 27255 - DNA, 20 bp, Artificial Sequence
  Description of Artificial Sequence: Synthetic oligonucleotide
  Target: SCN9A; (-) strand; PAM type: NRG; PAM sequence: TAG
taagatcattggtaactcag

SEQ ID NO: 27256 - DNA, 20 bp, Artificial Sequence
  Description of Artificial Sequence: Synthetic oligonucleotide
  Target: SCN9A; (-) strand; PAM type: NRG; PAM sequence: CAG
gattaagatcattggtaact

SEQ ID NO: 27257 - DNA, 20 bp, Artificial Sequence
  Description of Artificial Sequence: Synthetic oligonucleotide
  Target: SCN9A; (-) strand; PAM type: NRG; PAM sequence: TGG
aacatgctgattaagatcat

SEQ ID NO: 27258 - DNA, 20 bp, Artificial Sequence
  Description of Artificial Sequence: Synthetic oligonucleotide
  Target: SCN9A; (-) strand; PAM type: NRG; PAM sequence: AAG
caacattgaacatgctgatt

SEQ ID NO: 27259 - DNA, 20 bp, Artificial Sequence
  Description of Artificial Sequence: Synthetic oligonucleotide
  Target: SCN9A; (-) strand; PAM type: NRG; PAM sequence: TGG
tcttcaagttggcaaaatcc

SEQ ID NO: 27260 - DNA, 20 bp, Artificial Sequence
  Description of Artificial Sequence: Synthetic oligonucleotide
  Target: SCN9A; (-) strand; PAM type: NRG; PAM sequence: TGG
ttagctccgagtcttcaagt

SEQ ID NO: 27261 - DNA, 20 bp, Artificial Sequence
  Description of Artificial Sequence: Synthetic oligonucleotide
  Target: SCN9A; (-) strand; PAM type: NRG; PAM sequence: AAG
gcttttagctccgagtcttc

SEQ ID NO: 27262 - DNA, 20 bp, Artificial Sequence
  Description of Artificial Sequence: Synthetic oligonucleotide
  Target: SCN9A; (-) strand; PAM type: NRG; PAM sequence: GAG
ttatatttgcttttagctcc

SEQ ID NO: 27263 - DNA, 20 bp, Artificial Sequence
  Description of Artificial Sequence: Synthetic oligonucleotide
  Target: SCN9A; (-) strand; PAM type: NRG; PAM sequence: TAG
ttaaactttatatttgcttt

SEQ ID NO: 27264 - DNA, 20 bp, Artificial Sequence
  Description of Artificial Sequence: Synthetic oligonucleotide
  Target: SCN9A; (-) strand; PAM type: NRG; PAM sequence: TAG
aaacattgaaaagattttca

SEQ ID NO: 27265 - DNA, 20 bp, Artificial Sequence
  Description of Artificial Sequence: Synthetic oligonucleotide
  Target: SCN9A; (-) strand; PAM type: NRG; PAM sequence: AAG
tcaagattggaaacattgaa

SEQ ID NO: 27266 - DNA, 20 bp, Artificial Sequence
  Description of Artificial Sequence: Synthetic oligonucleotide
  Target: SCN9A; (-) strand; PAM type: NRG; PAM sequence: TGG
ctttgaacaaaaatcaagat

SEQ ID NO: 27267 - DNA, 20 bp, Artificial Sequence
  Description of Artificial Sequence: Synthetic oligonucleotide
  Target: SCN9A; (-) strand; PAM type: NRG; PAM sequence: AAG
ttaccctttgaacaaaaatc

SEQ ID NO: 27268 - DNA, 20 bp, Artificial Sequence
  Description of Artificial Sequence: Synthetic oligonucleotide
  Target: SCN9A; (-) strand; PAM type: NRG; PAM sequence: AAG
tgacaatattataggactta

SEQ ID NO: 27269 - DNA, 20 bp, Artificial Sequence
  Description of Artificial Sequence: Synthetic oligonucleotide
  Target: SCN9A; (-) strand; PAM type: NRG; PAM sequence: AGG
gataataatgacaatattat

SEQ ID NO: 27270 - DNA, 20 bp, Artificial Sequence
  Description of Artificial Sequence: Synthetic oligonucleotide
  Target: SCN9A; (-) strand; PAM type: NRG; PAM sequence: TAG
ggataataatgacaatatta

SEQ ID NO: 27271 - DNA, 20 bp, Artificial Sequence
  Description of Artificial Sequence: Synthetic oligonucleotide
  Target: SCN9A; (-) strand; PAM type: NRG; PAM sequence: TGG
aaaaataagaatattttagc

SEQ ID NO: 27272 - DNA, 20 bp, Artificial Sequence
  Description of Artificial Sequence: Synthetic oligonucleotide
  Target: SCN9A; (-) strand; PAM type: NRG; PAM sequence: TAG
aatgaaaaataagaatattt

SEQ ID NO: 27273 - DNA, 20 bp, Artificial Sequence
  Description of Artificial Sequence: Synthetic oligonucleotide
  Target: SCN9A; (-) strand; PAM type: NRG; PAM sequence: AAG
aattgatgaaaatgaaaaat

SEQ ID NO: 27274 - DNA, 20 bp, Artificial Sequence
  Description of Artificial Sequence: Synthetic oligonucleotide
  Target: SCN9A; (-) strand; PAM type: NRG; PAM sequence: GAG
gcaagtggaacaaaataaca

SEQ ID NO: 27275 - DNA, 20 bp, Artificial Sequence
  Description of Artificial Sequence: Synthetic oligonucleotide
  Target: SCN9A; (-) strand; PAM type: NRG; PAM sequence: CAG
tggcaagtggaacaaaataa

SEQ ID NO: 27276 - DNA, 20 bp, Artificial Sequence
  Description of Artificial Sequence: Synthetic oligonucleotide
  Target: SCN9A; (-) strand; PAM type: NRG; PAM sequence: TGG
ttgtaattttttgtggcaag

SEQ ID NO: 27277 - DNA, 20 bp, Artificial Sequence
  Description of Artificial Sequence: Synthetic oligonucleotide
  Target: SCN9A; (-) strand; PAM type: NRG; PAM sequence: AAG
gtgttgtaattttttgtggc

SEQ ID NO: 27278 - DNA, 20 bp, Artificial Sequence
  Description of Artificial Sequence: Synthetic oligonucleotide
  Target: SCN9A; (-) strand; PAM type: NRG; PAM sequence: TGG
atatgtgttgtaattttttg

SEQ ID NO: 27279 - DNA, 20 bp, Artificial Sequence
  Description of Artificial Sequence: Synthetic oligonucleotide
  Target: SCN9A; (-) strand; PAM type: NRG; PAM sequence: TAG
aatcctgaactaaaagtaca

SEQ ID NO: 27280 - DNA, 20 bp, Artificial Sequence
  Description of Artificial Sequence: Synthetic oligonucleotide
  Target: SCN9A; (-) strand; PAM type: NRG; PAM sequence: AAG
ctatagcaatcctgaactaa

SEQ ID NO: 27281 - DNA, 20 bp, Artificial Sequence
  Description of Artificial Sequence: Synthetic oligonucleotide
  Target: SCN9A; (-) strand; PAM type: NRG; PAM sequence: TAG
attatgataagaggtttcta

SEQ ID NO: 27282 - DNA, 20 bp, Artificial Sequence
  Description of Artificial Sequence: Synthetic oligonucleotide
  Target: SCN9A; (-) strand; PAM type: NRG; PAM sequence: AGG
atatcacaaattatgataag

SEQ ID NO: 27283 - DNA, 20 bp, Artificial Sequence
  Description of Artificial Sequence: Synthetic oligonucleotide
  Target: SCN9A; (-) strand; PAM type: NRG; PAM sequence: GAG
aatatcacaaattatgataa

SEQ ID NO: 27284 - DNA, 20 bp, Artificial Sequence
  Description of Artificial Sequence: Synthetic oligonucleotide
  Target: SCN9A; (-) strand; PAM type: NRG; PAM sequence: AAG
aaaatatcacaaattatgat

SEQ ID NO: 27285 - DNA, 20 bp, Artificial Sequence
  Description of Artificial Sequence: Synthetic oligonucleotide
  Target: SCN9A; (-) strand; PAM type: NRG; PAM sequence: AAG
ggataaattatcaattctaa

SEQ ID NO: 27286 - DNA, 20 bp, Artificial Sequence
  Description of Artificial Sequence: Synthetic oligonucleotide
  Target: SCN9A; (-) strand; PAM type: NRG; PAM sequence: AGG
agtattagaaagtagaatta

SEQ ID NO: 27287 - DNA, 20 bp, Artificial Sequence
  Description of Artificial Sequence: Synthetic oligonucleotide
  Target: SCN9A; (-) strand; PAM type: NRG; PAM sequence: AAG
aagtattagaaagtagaatt

SEQ ID NO: 27288 - DNA, 20 bp, Artificial Sequence
  Description of Artificial Sequence: Synthetic oligonucleotide
  Target: SCN9A; (-) strand; PAM type: NRG; PAM sequence: TAG
tgtatgaaagtattagaaag

SEQ ID NO: 27289 - DNA, 20 bp, Artificial Sequence
  Description of Artificial Sequence: Synthetic oligonucleotide
  Target: SCN9A; (-) strand; PAM type: NRG; PAM sequence: AAG
aaatgtatgaaagtattaga

SEQ ID NO: 27290 - DNA, 20 bp, Artificial Sequence
  Description of Artificial Sequence: Synthetic oligonucleotide
  Target: SCN9A; (-) strand; PAM type: NRG; PAM sequence: TAG
gagaaaatgtatgaaagtat

SEQ ID NO: 27291 - DNA, 20 bp, Artificial Sequence
  Description of Artificial Sequence: Synthetic oligonucleotide
  Target: SCN9A; (-) strand; PAM type: NRG; PAM sequence: AAG
cggcatgagaaaatgtatga

SEQ ID NO: 27292 - DNA, 20 bp, Artificial Sequence
  Description of Artificial Sequence: Synthetic oligonucleotide
  Target: SCN9A; (-) strand; PAM type: NRG; PAM sequence: GAG
ttttatctaagtgtcggcat

SEQ ID NO: 27293 - DNA, 20 bp, Artificial Sequence
  Description of Artificial Sequence: Synthetic oligonucleotide
  Target: SCN9A; (-) strand; PAM type: NRG; PAM sequence: CGG
gctagattttatctaagtgt

SEQ ID NO: 27294 - DNA, 20 bp, Artificial Sequence
  Description of Artificial Sequence: Synthetic oligonucleotide
  Target: SCN9A; (-) strand; PAM type: NRG; PAM sequence: AAG
taatatgctagattttatct

SEQ ID NO: 27295 - DNA, 20 bp, Artificial Sequence
  Description of Artificial Sequence: Synthetic oligonucleotide
  Target: SCN9A; (-) strand; PAM type: NRG; PAM sequence: TAG
agcacattcctctaatatgc

SEQ ID NO: 27296 - DNA, 20 bp, Artificial Sequence
  Description of Artificial Sequence: Synthetic oligonucleotide
  Target: SCN9A; (-) strand; PAM type: NRG; PAM sequence: AAG
aaacaaataaagacttttta

SEQ ID NO: 27297 - DNA, 20 bp, Artificial Sequence
  Description of Artificial Sequence: Synthetic oligonucleotide
  Target: SCN9A; (-) strand; PAM type: NRG; PAM sequence: AAG
taacaatataaaaacaaata

SEQ ID NO: 27298 - DNA, 20 bp, Artificial Sequence
  Description of Artificial Sequence: Synthetic oligonucleotide
  Target: SCN9A; (-) strand; PAM type: NRG; PAM sequence: AAG
ctttatgaatttggtaatta

SEQ ID NO: 27299 - DNA, 20 bp, Artificial Sequence
  Description of Artificial Sequence: Synthetic oligonucleotide
  Target: SCN9A; (-) strand; PAM type: NRG; PAM sequence: TGG
tgttcataactttatgaatt

SEQ ID NO: 27300 - DNA, 20 bp, Artificial Sequence
  Description of Artificial Sequence: Synthetic oligonucleotide
  Target: SCN9A; (-) strand; PAM type: NRG; PAM sequence: CAG
agtaagaagcttgtggctta

SEQ ID NO: 27301 - DNA, 20 bp, Artificial Sequence
  Description of Artificial Sequence: Synthetic oligonucleotide
  Target: SCN9A; (-) strand; PAM type: NRG; PAM sequence: TGG
atttcagagtaagaagcttg

SEQ ID NO: 27302 - DNA, 20 bp, Artificial Sequence
  Description of Artificial Sequence: Synthetic oligonucleotide
  Target: SCN9A; (-) strand; PAM type: NRG; PAM sequence: AAG
ataatttatttcagagtaag

SEQ ID NO: 27303 - DNA, 20 bp, Artificial Sequence
  Description of Artificial Sequence: Synthetic oligonucleotide
  Target: SCN9A; (-) strand; PAM type: NRG; PAM sequence: AAG
acaataatttatttcagagt

SEQ ID NO: 27304 - DNA, 20 bp, Artificial Sequence
  Description of Artificial Sequence: Synthetic oligonucleotide
  Target: SCN9A; (-) strand; PAM type: NRG; PAM sequence: GAG
tagtacaataatttatttca

SEQ ID NO: 27305 - DNA, 20 bp, Artificial Sequence
  Description of Artificial Sequence: Synthetic oligonucleotide
  Target: SCN9A; (-) strand; PAM type: NRG; PAM sequence: CAG
tatagtacaataatttattt

SEQ ID NO: 27306 - DNA, 20 bp, Artificial Sequence
  Description of Artificial Sequence: Synthetic oligonucleotide
  Target: SCN9A; (-) strand; PAM type: NRG; PAM sequence: TAG
ataaatattttctattaata

SEQ ID NO: 27307 - DNA, 20 bp, Artificial Sequence
  Description of Artificial Sequence: Synthetic oligonucleotide
  Target: SCN9A; (-) strand; PAM type: NRG; PAM sequence: AAG
acatgctcaattctaatttg

SEQ ID NO: 27308 - DNA, 20 bp, Artificial Sequence
  Description of Artificial Sequence: Synthetic oligonucleotide
  Target: SCN9A; (-) strand; PAM type: NRG; PAM sequence: AAG
gaatatttttacaatttttg

SEQ ID NO: 27309 - DNA, 20 bp, Artificial Sequence
  Description of Artificial Sequence: Synthetic oligonucleotide
  Target: SCN9A; (-) strand; PAM type: NRG; PAM sequence: AAG
ttcattgacaaatgcactta

SEQ ID NO: 27310 - DNA, 20 bp, Artificial Sequence
  Description of Artificial Sequence: Synthetic oligonucleotide
  Target: SCN9A; (-) strand; PAM type: NRG; PAM sequence: TAG
caagattatatcttgatatc

SEQ ID NO: 27311 - DNA, 20 bp, Artificial Sequence
  Description of Artificial Sequence: Synthetic oligonucleotide
  Target: SCN9A; (-) strand; PAM type: NRG; PAM sequence: AAG
gggaatttgaatcaaaaggc

SEQ ID NO: 27312 - DNA, 20 bp, Artificial Sequence
  Description of Artificial Sequence: Synthetic oligonucleotide
  Target: SCN9A; (-) strand; PAM type: NRG; PAM sequence: AGG
ttttgggaatttgaatcaaa

SEQ ID NO: 27313 - DNA, 20 bp, Artificial Sequence
  Description of Artificial Sequence: Synthetic oligonucleotide
  Target: SCN9A; (-) strand; PAM type: NRG; PAM sequence: AAG
cttttgggaatttgaatcaa

SEQ ID NO: 27314 - DNA, 20 bp, Artificial Sequence
  Description of Artificial Sequence: Synthetic oligonucleotide
  Target: SCN9A; (-) strand; PAM type: NRG; PAM sequence: GGG
cattatttttaaaaactttt

SEQ ID NO: 27315 - DNA, 20 bp, Artificial Sequence
  Description of Artificial Sequence: Synthetic oligonucleotide
  Target: SCN9A; (-) strand; PAM type: NRG; PAM sequence: TGG
gcattatttttaaaaacttt

SEQ ID NO: 27316 - DNA, 20 bp, Artificial Sequence
  Description of Artificial Sequence: Synthetic oligonucleotide
  Target: SCN9A; (-) strand; PAM type: NRG; PAM sequence: TGG
ataataaaggggtatttctt

SEQ ID NO: 27317 - DNA, 20 bp, Artificial Sequence
  Description of Artificial Sequence: Synthetic oligonucleotide
  Target: SCN9A; (-) strand; PAM type: NRG; PAM sequence: GGG
cattatattctataataaag

SEQ ID NO: 27318 - DNA, 20 bp, Artificial Sequence
  Description of Artificial Sequence: Synthetic oligonucleotide
  Target: SCN9A; (-) strand; PAM type: NRG; PAM sequence: GGG
ccattatattctataataaa

SEQ ID NO: 27319 - DNA, 20 bp, Artificial Sequence
  Description of Artificial Sequence: Synthetic oligonucleotide
  Target: SCN9A; (-) strand; PAM type: NRG; PAM sequence: AGG
gccattatattctataataa

SEQ ID NO: 27320 - DNA, 20 bp, Artificial Sequence
  Description of Artificial Sequence: Synthetic oligonucleotide
  Target: SCN9A; (-) strand; PAM type: NRG; PAM sequence: AAG
tgccattatattctataata

SEQ ID NO: 27321 - DNA, 20 bp, Artificial Sequence
  Description of Artificial Sequence: Synthetic oligonucleotide
  Target: SCN9A; (-) strand; PAM type: NRG; PAM sequence: AGG
agactggtaaacataaacta

SEQ ID NO: 27322 - DNA, 20 bp, Artificial Sequence
  Description of Artificial Sequence: Synthetic oligonucleotide
  Target: SCN9A; (-) strand; PAM type: NRG; PAM sequence: AAG
cagactggtaaacataaact

SEQ ID NO: 27323 - DNA, 20 bp, Artificial Sequence
  Description of Artificial Sequence: Synthetic oligonucleotide
  Target: SCN9A; (-) strand; PAM type: NRG; PAM sequence: TGG
agttctgcgatcattcagac

SEQ ID NO: 27324 - DNA, 20 bp, Artificial Sequence
  Description of Artificial Sequence: Synthetic oligonucleotide
  Target: SCN9A; (-) strand; PAM type: NRG; PAM sequence: CAG
ttgtcagttctgcgatcatt

SEQ ID NO: 27325 - DNA, 20 bp, Artificial Sequence
  Description of Artificial Sequence: Synthetic oligonucleotide
  Target: SCN9A; (-) strand; PAM type: NRG; PAM sequence: CAG
agcagatgtggaaggattgt

SEQ ID NO: 27326 - DNA, 20 bp, Artificial Sequence
  Description of Artificial Sequence: Synthetic oligonucleotide
  Target: SCN9A; (-) strand; PAM type: NRG; PAM sequence: AGG
ctctttctagcagatgtgga

SEQ ID NO: 27327 - DNA, 20 bp, Artificial Sequence
  Description of Artificial Sequence: Synthetic oligonucleotide
  Target: SCN9A; (-) strand; PAM type: NRG; PAM sequence: AAG
gctctttctagcagatgtgg

SEQ ID NO: 27328 - DNA, 20 bp, Artificial Sequence
  Description of Artificial Sequence: Synthetic oligonucleotide
  Target: SCN9A; (-) strand; PAM type: NRG; PAM sequence: TGG
ggagctctttctagcagatg

SEQ ID NO: 27329 - DNA, 20 bp, Artificial Sequence
  Description of Artificial Sequence: Synthetic oligonucleotide
  Target: SCN9A; (-) strand; PAM type: NRG; PAM sequence: CAG
tttagtggagctctttctag

SEQ ID NO: 27330 - DNA, 20 bp, Artificial Sequence
  Description of Artificial Sequence: Synthetic oligonucleotide
  Target: SCN9A; (-) strand; PAM type: NRG; PAM sequence: TAG
aagtttagtggagctctttc

SEQ ID NO: 27331 - DNA, 20 bp, Artificial Sequence
  Description of Artificial Sequence: Synthetic oligonucleotide
  Target: SCN9A; (-) strand; PAM type: NRG; PAM sequence: GAG
ttgtgactttaagtttagtg

SEQ ID NO: 27332 - DNA, 20 bp, Artificial Sequence
  Description of Artificial Sequence: Synthetic oligonucleotide
  Target: SCN9A; (-) strand; PAM type: NRG; PAM sequence: TGG
tattgtgactttaagtttag

SEQ ID NO: 27333 - DNA, 20 bp, Artificial Sequence
  Description of Artificial Sequence: Synthetic oligonucleotide
  Target: SCN9A; (-) strand; PAM type: NRG; PAM sequence: TAG
ccttattgtgactttaagtt

SEQ ID NO: 27334 - DNA, 20 bp, Artificial Sequence
  Description of Artificial Sequence: Synthetic oligonucleotide
  Target: SCN9A; (-) strand; PAM type: NRG; PAM sequence: AAG
gacagccttattgtgacttt

SEQ ID NO: 27335 - DNA, 20 bp, Artificial Sequence
  Description of Artificial Sequence: Synthetic oligonucleotide
  Target: SCN9A; (-) strand; PAM type: NRG; PAM sequence: CAG
gtaggctggaatatttttga

SEQ ID NO: 27336 - DNA, 20 bp, Artificial Sequence
  Description of Artificial Sequence: Synthetic oligonucleotide
  Target: SCN9A; (-) strand; PAM type: NRG; PAM sequence: TGG
atgagtatttccaagtaggc

SEQ ID NO: 27337 - DNA, 20 bp, Artificial Sequence
  Description of Artificial Sequence: Synthetic oligonucleotide
  Target: SCN9A; (-) strand; PAM type: NRG; PAM sequence: AGG
ccatatgagtatttccaagt

SEQ ID NO: 27338 - DNA, 20 bp, Artificial Sequence
  Description of Artificial Sequence: Synthetic oligonucleotide
  Target: SCN9A; (-) strand; PAM type: NRG; PAM sequence: TAG
tccatatgagtatttccaag

SEQ ID NO: 27339 - DNA, 20 bp, Artificial Sequence
  Description of Artificial Sequence: Synthetic oligonucleotide
  Target: SCN9A; (-) strand; PAM type: NRG; PAM sequence: AAG
ggatccatatgagtatttcc

SEQ ID NO: 27340 - DNA, 20 bp, Artificial Sequence
  Description of Artificial Sequence: Synthetic oligonucleotide
  Target: SCN9A; (-) strand; PAM type: NRG; PAM sequence: GAG
tgattgccatggatccatat

SEQ ID NO: 27341 - DNA, 20 bp, Artificial Sequence
  Description of Artificial Sequence: Synthetic oligonucleotide
  Target: SCN9A; (-) strand; PAM type: NRG; PAM sequence: TGG
ggtattaaaactgattgcca

SEQ ID NO: 27342 - DNA, 20 bp, Artificial Sequence
  Description of Artificial Sequence: Synthetic oligonucleotide
  Target: SCN9A; (-) strand; PAM type: NRG; PAM sequence: TGG
tggaatctttgcagctgaaa

SEQ ID NO: 27343 - DNA, 20 bp, Artificial Sequence
  Description of Artificial Sequence: Synthetic oligonucleotide
  Target: SCN9A; (-) strand; PAM type: NRG; PAM sequence: CAG
ggtctttactggaatctttg

SEQ ID NO: 27344 - DNA, 20 bp, Artificial Sequence
  Description of Artificial Sequence: Synthetic oligonucleotide
  Target: SCN9A; (-) strand; PAM type: NRG; PAM sequence: TGG
tttctcacttaggtctttac

SEQ ID NO: 27345 - DNA, 20 bp, Artificial Sequence
  Description of Artificial Sequence: Synthetic oligonucleotide
  Target: SCN9A; (-) strand; PAM type: NRG; PAM sequence: AGG
aaacattatttttctcactt

SEQ ID NO: 27346 - DNA, 20 bp, Artificial Sequence
  Description of Artificial Sequence: Synthetic oligonucleotide
  Target: SCN9A; (-) strand; PAM type: NRG; PAM sequence: TAG
aaaacattatttttctcact

SEQ ID NO: 27347 - DNA, 20 bp, Artificial Sequence
  Description of Artificial Sequence: Synthetic oligonucleotide
  Target: SCN9A; (-) strand; PAM type: NRG; PAM sequence: CAG
ttcctgttttctaatattaa

SEQ ID NO: 27348 - DNA, 20 bp, Artificial Sequence
  Description of Artificial Sequence: Synthetic oligonucleotide
  Target: SCN9A; (-) strand; PAM type: NRG; PAM sequence: CAG
cacagtaaatgctaagcaaa

SEQ ID NO: 27349 - DNA, 20 bp, Artificial Sequence
  Description of Artificial Sequence: Synthetic oligonucleotide
  Target: SCN9A; (-) strand; PAM type: NRG; PAM sequence: AAG
tctggaacacagtaaatgct

SEQ ID NO: 27350 - DNA, 20 bp, Artificial Sequence
  Description of Artificial Sequence: Synthetic oligonucleotide
  Target: SCN9A; (-) strand; PAM type: NRG; PAM sequence: CAG
ttagcaaactgtctggaaca

SEQ ID NO: 27351 - DNA, 20 bp, Artificial Sequence
  Description of Artificial Sequence: Synthetic oligonucleotide
  Target: SCN9A; (-) strand; PAM type: NRG; PAM sequence: TGG
aaagtatttagcaaactgtc

SEQ ID NO: 27352 - DNA, 20 bp, Artificial Sequence
  Description of Artificial Sequence: Synthetic oligonucleotide
  Target: SCN9A; (-) strand; PAM type: NRG; PAM sequence: TAG
atatccatttataaagtatt

SEQ ID NO: 27353 - DNA, 20 bp, Artificial Sequence
  Description of Artificial Sequence: Synthetic oligonucleotide
  Target: SCN9A; (-) strand; PAM type: NRG; PAM sequence: AAG
gataagaatatccatttata

SEQ ID NO: 27354 - DNA, 20 bp, Artificial Sequence
  Description of Artificial Sequence: Synthetic oligonucleotide
  Target: SCN9A; (-) strand; PAM type: NRG; PAM sequence: AAG
tttacaggactaagttagat

SEQ ID NO: 27355 - DNA, 20 bp, Artificial Sequence
  Description of Artificial Sequence: Synthetic oligonucleotide
  Target: SCN9A; (-) strand; PAM type: NRG; PAM sequence: TAG
cctaatttacaggactaagt

SEQ ID NO: 27356 - DNA, 20 bp, Artificial Sequence
  Description of Artificial Sequence: Synthetic oligonucleotide
  Target: SCN9A; (-) strand; PAM type: NRG; PAM sequence: AAG
aatacctaatttacaggact

SEQ ID NO: 27357 - DNA, 20 bp, Artificial Sequence
  Description of Artificial Sequence: Synthetic oligonucleotide
  Target: SCN9A; (-) strand; PAM type: NRG; PAM sequence: AGG
aagagcaatacctaatttac

SEQ ID NO: 27358 - DNA, 20 bp, Artificial Sequence
  Description of Artificial Sequence: Synthetic oligonucleotide
  Target: SCN9A; (-) strand; PAM type: NRG; PAM sequence: CAG
gaagagcaatacctaattta

SEQ ID NO: 27359 - DNA, 20 bp, Artificial Sequence
  Description of Artificial Sequence: Synthetic oligonucleotide
  Target: SCN9A; (-) strand; PAM type: NRG; PAM sequence: GAG
ctgatatgggagccagggaa

SEQ ID NO: 27360 - DNA, 20 bp, Artificial Sequence
  Description of Artificial Sequence: Synthetic oligonucleotide
  Target: SCN9A; (-) strand; PAM type: NRG; PAM sequence: AAG
tgctgatatgggagccaggg

SEQ ID NO: 27361 - DNA, 20 bp, Artificial Sequence
  Description of Artificial Sequence: Synthetic oligonucleotide
  Target: SCN9A; (-) strand; PAM type: NRG; PAM sequence: GGG
tgatgctgatatgggagcca

SEQ ID NO: 27362 - DNA, 20 bp, Artificial Sequence
  Description of Artificial Sequence: Synthetic oligonucleotide
  Target: SCN9A; (-) strand; PAM type: NRG; PAM sequence: AGG
ttgatgctgatatgggagcc

SEQ ID NO: 27363 - DNA, 20 bp, Artificial Sequence
  Description of Artificial Sequence: Synthetic oligonucleotide
  Target: SCN9A; (-) strand; PAM type: NRG; PAM sequence: CAG
tttgatgctgatatgggagc

SEQ ID NO: 27364 - DNA, 20 bp, Artificial Sequence
  Description of Artificial Sequence: Synthetic oligonucleotide
  Target: SCN9A; (-) strand; PAM type: NRG; PAM sequence: GAG
accttttgatgctgatatgg

SEQ ID NO: 27365 - DNA, 20 bp, Artificial Sequence
  Description of Artificial Sequence: Synthetic oligonucleotide
  Target: SCN9A; (-) strand; PAM type: NRG; PAM sequence: GGG
caaccttttgatgctgatat

SEQ ID NO: 27366 - DNA, 20 bp, Artificial Sequence
  Description of Artificial Sequence: Synthetic oligonucleotide
  Target: SCN9A; (-) strand; PAM type: NRG; PAM sequence: TGG
tcaaccttttgatgctgata

SEQ ID NO: 27367 - DNA, 20 bp, Artificial Sequence
  Description of Artificial Sequence: Synthetic oligonucleotide
  Target: SCN9A; (-) strand; PAM type: NRG; PAM sequence: GAG
gagcactgacaggacagtta

SEQ ID NO: 27368 - DNA, 20 bp, Artificial Sequence
  Description of Artificial Sequence: Synthetic oligonucleotide
  Target: SCN9A; (-) strand; PAM type: NRG; PAM sequence: TAG
atgagcactgacaggacagt

SEQ ID NO: 27369 - DNA, 20 bp, Artificial Sequence
  Description of Artificial Sequence: Synthetic oligonucleotide
  Target: SCN9A; (-) strand; PAM type: NRG; PAM sequence: CAG
aatgatgagcactgacagga

SEQ ID NO: 27370 - DNA, 20 bp, Artificial Sequence
  Description of Artificial Sequence: Synthetic oligonucleotide
  Target: SCN9A; (-) strand; PAM type: NRG; PAM sequence: AGG
taaaaatgatgagcactgac

SEQ ID NO: 27371 - DNA, 20 bp, Artificial Sequence
  Description of Artificial Sequence: Synthetic oligonucleotide
  Target: SCN9A; (-) strand; PAM type: NRG; PAM sequence: CAG
ctaaaaatgatgagcactga

SEQ ID NO: 27372 - DNA, 20 bp, Artificial Sequence
  Description of Artificial Sequence: Synthetic oligonucleotide
  Target: SCN9A; (-) strand; PAM type: NRG; PAM sequence: GAG
aaatgctgtctaaaaatgat

SEQ ID NO: 27373 - DNA, 20 bp, Artificial Sequence
  Description of Artificial Sequence: Synthetic oligonucleotide
  Target: SCN9A; (-) strand; PAM type: NRG; PAM sequence: TAG
ccacataaattctttgaaaa

SEQ ID NO: 27374 - DNA, 20 bp, Artificial Sequence
  Description of Artificial Sequence: Synthetic oligonucleotide
  Target: SCN9A; (-) strand; PAM type: NRG; PAM sequence: CAG
gttttctttttatcttcttc

SEQ ID NO: 27375 - DNA, 20 bp, Artificial Sequence
  Description of Artificial Sequence: Synthetic oligonucleotide
  Target: SCN9A; (-) strand; PAM type: NRG; PAM sequence: CAG
aaaagactggctcaaaattt

SEQ ID NO: 27376 - DNA, 20 bp, Artificial Sequence
  Description of Artificial Sequence: Synthetic oligonucleotide
  Target: SCN9A; (-) strand; PAM type: NRG; PAM sequence: TGG
cagatcagaaaaaaaaagac

SEQ ID NO: 27377 - DNA, 20 bp, Artificial Sequence
  Description of Artificial Sequence: Synthetic oligonucleotide
  Target: SCN9A; (-) strand; PAM type: NRG; PAM sequence: AAG
gtagtcagatcagaaaaaaa

SEQ ID NO: 27378 - DNA, 20 bp, Artificial Sequence
  Description of Artificial Sequence: Synthetic oligonucleotide
  Target: SCN9A; (-) strand; PAM type: NRG; PAM sequence: CAG
tactctaacagtagtcagat

SEQ ID NO: 27379 - DNA, 20 bp, Artificial Sequence
  Description of Artificial Sequence: Synthetic oligonucleotide
  Target: SCN9A; (-) strand; PAM type: NRG; PAM sequence: CAG
tttattactctaacagtagt

SEQ ID NO: 27380 - DNA, 20 bp, Artificial Sequence
  Description of Artificial Sequence: Synthetic oligonucleotide
  Target: SCN9A; (-) strand; PAM type: NRG; PAM sequence: TAG
gttctttattactctaacag

SEQ ID NO: 27381 - DNA, 20 bp, Artificial Sequence
  Description of Artificial Sequence: Synthetic oligonucleotide
  Target: SCN9A; (-) strand; PAM type: NRG; PAM sequence: CAG
catgttctttattactctaa

SEQ ID NO: 27382 - DNA, 20 bp, Artificial Sequence
  Description of Artificial Sequence: Synthetic oligonucleotide
  Target: SCN9A; (-) strand; PAM type: NRG; PAM sequence: GAG
ctgataaatctttaaagagt

SEQ ID NO: 27383 - DNA, 20 bp, Artificial Sequence
  Description of Artificial Sequence: Synthetic oligonucleotide
  Target: SCN9A; (-) strand; PAM type: NRG; PAM sequence: GAG
tctgctgataaatctttaaa

SEQ ID NO: 27384 - DNA, 20 bp, Artificial Sequence
  Description of Artificial Sequence: Synthetic oligonucleotide
  Target: SCN9A; (-) strand; PAM type: NRG; PAM sequence: AAG
cttctgctgataaatcttta

SEQ ID NO: 27385 - DNA, 20 bp, Artificial Sequence
  Description of Artificial Sequence: Synthetic oligonucleotide
  Target: SCN9A; (-) strand; PAM type: NRG; PAM sequence: TAG
aagctttagaagtattactt

SEQ ID NO: 27386 - DNA, 20 bp, Artificial Sequence
  Description of Artificial Sequence: Synthetic oligonucleotide
  Target: SCN9A; (-) strand; PAM type: NRG; PAM sequence: AAG
cttttgtgtcaaagctttag

SEQ ID NO: 27387 - DNA, 20 bp, Artificial Sequence
  Description of Artificial Sequence: Synthetic oligonucleotide
  Target: SCN9A; (-) strand; PAM type: NRG; PAM sequence: TAG
gcacttttgtgtcaaagctt

SEQ ID NO: 27388 - DNA, 20 bp, Artificial Sequence
  Description of Artificial Sequence: Synthetic oligonucleotide
  Target: SCN9A; (-) strand; PAM type: NRG; PAM sequence: AAG
tgcaatgcacttttgtgtca

SEQ ID NO: 27389 - DNA, 20 bp, Artificial Sequence
  Description of Artificial Sequence: Synthetic oligonucleotide
  Target: SCN9A; (-) strand; PAM type: NRG; PAM sequence: CAG
ttaagtgagtcctttgatac

SEQ ID NO: 27390 - DNA, 20 bp, Artificial Sequence
  Description of Artificial Sequence: Synthetic oligonucleotide
  Target: SCN9A; (-) strand; PAM type: NRG; PAM sequence: GAG
tcggtgttgcctttttaagt

SEQ ID NO: 27391 - DNA, 20 bp, Artificial Sequence
  Description of Artificial Sequence: Synthetic oligonucleotide
  Target: SCN9A; (-) strand; PAM type: NRG; PAM sequence: AAG
catttcggtgttgccttttt

SEQ ID NO: 27392 - DNA, 20 bp, Artificial Sequence
  Description of Artificial Sequence: Synthetic oligonucleotide
  Target: SCN9A; (-) strand; PAM type: NRG; PAM sequence: CGG
tgtacccaaaggattcattt

SEQ ID NO: 27393 - DNA, 20 bp, Artificial Sequence
  Description of Artificial Sequence: Synthetic oligonucleotide
  Target: SCN9A; (-) strand; PAM type: NRG; PAM sequence: AGG
ttgagtcaaagtgtacccaa

SEQ ID NO: 27394 - DNA, 20 bp, Artificial Sequence
  Description of Artificial Sequence: Synthetic oligonucleotide
  Target: SCN9A; (-) strand; PAM type: NRG; PAM sequence: AAG
cttgagtcaaagtgtaccca

SEQ ID NO: 27395 - DNA, 20 bp, Artificial Sequence
  Description of Artificial Sequence: Synthetic oligonucleotide
  Target: SCN9A; (-) strand; PAM type: NRG; PAM sequence: AAG
tggtcagattccttgagtca

SEQ ID NO: 27396 - DNA, 20 bp, Artificial Sequence
  Description of Artificial Sequence: Synthetic oligonucleotide
  Target: SCN9A; (-) strand; PAM type: NRG; PAM sequence: GAG
cttctttggtcagattcctt

SEQ ID NO: 27397 - DNA, 20 bp, Artificial Sequence
  Description of Artificial Sequence: Synthetic oligonucleotide
  Target: SCN9A; (-) strand; PAM type: NRG; PAM sequence: CAG
cccttagaatcttctttggt

SEQ ID NO: 27398 - DNA, 20 bp, Artificial Sequence
  Description of Artificial Sequence: Synthetic oligonucleotide
  Target: SCN9A; (-) strand; PAM type: NRG; PAM sequence: TGG
atttcccttagaatcttctt

SEQ ID NO: 27399 - DNA, 20 bp, Artificial Sequence
  Description of Artificial Sequence: Synthetic oligonucleotide
  Target: SCN9A; (-) strand; PAM type: NRG; PAM sequence: TAG
atagacctaaacatttccct

SEQ ID NO: 27400 - DNA, 20 bp, Artificial Sequence
  Description of Artificial Sequence: Synthetic oligonucleotide
  Target: SCN9A; (-) strand; PAM type: NRG; PAM sequence: TAG
aaaattgactcctgcagtta

SEQ ID NO: 27401 - DNA, 20 bp, Artificial Sequence
  Description of Artificial Sequence: Synthetic oligonucleotide
  Target: SCN9A; (-) strand; PAM type: NRG; PAM sequence: CAG
tatttgaaaattgactcctg

SEQ ID NO: 27402 - DNA, 20 bp, Artificial Sequence
  Description of Artificial Sequence: Synthetic oligonucleotide
  Target: SCN9A; (-) strand; PAM type: NRG; PAM sequence: CAG
tattaccacaacctcaagtc

SEQ ID NO: 27403 - DNA, 20 bp, Artificial Sequence
  Description of Artificial Sequence: Synthetic oligonucleotide
  Target: SCN9A; (-) strand; PAM type: NRG; PAM sequence: AAG
acagctattaccacaacctc

SEQ ID NO: 27404 - DNA, 20 bp, Artificial Sequence
  Description of Artificial Sequence: Synthetic oligonucleotide
  Target: SCN9A; (-) strand; PAM type: NRG; PAM sequence: CAG
agaaaggatttacctggtca

SEQ ID NO: 27405 - DNA, 20 bp, Artificial Sequence
  Description of Artificial Sequence: Synthetic oligonucleotide
  Target: SCN9A; (-) strand; PAM type: NRG; PAM sequence: TGG
gaactcagaaaggatttacc

SEQ ID NO: 27406 - DNA, 20 bp, Artificial Sequence
  Description of Artificial Sequence: Synthetic oligonucleotide
  Target: SCN9A; (-) strand; PAM type: NRG; PAM sequence: AGG
gcatccctgtgaactcagaa

SEQ ID NO: 27407 - DNA, 20 bp, Artificial Sequence
  Description of Artificial Sequence: Synthetic oligonucleotide
  Target: SCN9A; (-) strand; PAM type: NRG; PAM sequence: AAG
tgcatccctgtgaactcaga

SEQ ID NO: 27408 - DNA, 20 bp, Artificial Sequence
  Description of Artificial Sequence: Synthetic oligonucleotide
  Target: SCN9A; (-) strand; PAM type: NRG; PAM sequence: CAG
cgactgcatccctgtgaact

SEQ ID NO: 27409 - DNA, 20 bp, Artificial Sequence
  Description of Artificial Sequence: Synthetic oligonucleotide
  Target: SCN9A; (-) strand; PAM type: NRG; PAM sequence: GAG
caaataagtaccttctcact

SEQ ID NO: 27410 - DNA, 20 bp, Artificial Sequence
  Description of Artificial Sequence: Synthetic oligonucleotide
  Target: SCN9A; (-) strand; PAM type: NRG; PAM sequence: AAG
gagatccggatcttgcaaat

SEQ ID NO: 27411 - DNA, 20 bp, Artificial Sequence
  Description of Artificial Sequence: Synthetic oligonucleotide
  Target: SCN9A; (-) strand; PAM type: NRG; PAM sequence: CGG
tctaattgttggtggagatc

SEQ ID NO: 27412 - DNA, 20 bp, Artificial Sequence
  Description of Artificial Sequence: Synthetic oligonucleotide
  Target: SCN9A; (-) strand; PAM type: NRG; PAM sequence: GAG
ctagtttctaattgttggtg

SEQ ID NO: 27413 - DNA, 20 bp, Artificial Sequence
  Description of Artificial Sequence: Synthetic oligonucleotide
  Target: SCN9A; (-) strand; PAM type: NRG; PAM sequence: TGG
atctagtttctaattgttgg

SEQ ID NO: 27414 - DNA, 20 bp, Artificial Sequence
  Description of Artificial Sequence: Synthetic oligonucleotide
  Target: SCN9A; (-) strand; PAM type: NRG; PAM sequence: TGG
aatatctagtttctaattgt

SEQ ID NO: 27415 - DNA, 20 bp, Artificial Sequence
  Description of Artificial Sequence: Synthetic oligonucleotide
  Target: SCN9A; (-) strand; PAM type: NRG; PAM sequence: TAG
tggaaaaaggcaggaatatc

SEQ ID NO: 27416 - DNA, 20 bp, Artificial Sequence
  Description of Artificial Sequence: Synthetic oligonucleotide
  Target: SCN9A; (-) strand; PAM type: NRG; PAM sequence: AGG
atttatctttggaaaaaggc

SEQ ID NO: 27417 - DNA, 20 bp, Artificial Sequence
  Description of Artificial Sequence: Synthetic oligonucleotide
  Target: SCN9A; (-) strand; PAM type: NRG; PAM sequence: CAG
tatttatctttggaaaaagg

SEQ ID NO: 27418 - DNA, 20 bp, Artificial Sequence
  Description of Artificial Sequence: Synthetic oligonucleotide
  Target: SCN9A; (-) strand; PAM type: NRG; PAM sequence: AGG
ttctatttatctttggaaaa

SEQ ID NO: 27419 - DNA, 20 bp, Artificial Sequence
  Description of Artificial Sequence: Synthetic oligonucleotide
  Target: SCN9A; (-) strand; PAM type: NRG; PAM sequence: AAG
cttctatttatctttggaaa

SEQ ID NO: 27420 - DNA, 20 bp, Artificial Sequence
  Description of Artificial Sequence: Synthetic oligonucleotide
  Target: SCN9A; (-) strand; PAM type: NRG; PAM sequence: TGG
tcttcccttctatttatctt

SEQ ID NO: 27421 - DNA, 20 bp, Artificial Sequence
  Description of Artificial Sequence: Synthetic oligonucleotide
  Target: SCN9A; (-) strand; PAM type: NRG; PAM sequence: TAG
tccccatgtgctcgctgagt

SEQ ID NO: 27422 - DNA, 20 bp, Artificial Sequence
  Description of Artificial Sequence: Synthetic oligonucleotide
  Target: SCN9A; (-) strand; PAM type: NRG; PAM sequence: GAG
tttttccccatgtgctcgct

SEQ ID NO: 27423 - DNA, 20 bp, Artificial Sequence
  Description of Artificial Sequence: Synthetic oligonucleotide
  Target: SCN9A; (-) strand; PAM type: NRG; PAM sequence: GAG
aagaccagaagttcttttct

SEQ ID NO: 27424 - DNA, 20 bp, Artificial Sequence
  Description of Artificial Sequence: Synthetic oligonucleotide
  Target: SCN9A; (-) strand; PAM type: NRG; PAM sequence: AAG
aattgacatttgaagaccag

SEQ ID NO: 27425 - DNA, 20 bp, Artificial Sequence
  Description of Artificial Sequence: Synthetic oligonucleotide
  Target: SCN9A; (-) strand; PAM type: NRG; PAM sequence: CAG
acaaattgacatttgaagac

SEQ ID NO: 27426 - DNA, 20 bp, Artificial Sequence
  Description of Artificial Sequence: Synthetic oligonucleotide
  Target: SCN9A; (-) strand; PAM type: NRG; PAM sequence: AAG
cccaaacaaattgacatttg

SEQ ID NO: 27427 - DNA, 20 bp, Artificial Sequence
  Description of Artificial Sequence: Synthetic oligonucleotide
  Target: SCN9A; (-) strand; PAM type: NRG; PAM sequence: TGG
agataattttgcttttgctg

SEQ ID NO: 27428 - DNA, 20 bp, Artificial Sequence
  Description of Artificial Sequence: Synthetic oligonucleotide
  Target: SCN9A; (-) strand; PAM type: NRG; PAM sequence: AAG
atctttgtcaatgtctatat

SEQ ID NO: 27429 - DNA, 20 bp, Artificial Sequence
  Description of Artificial Sequence: Synthetic oligonucleotide
  Target: SCN9A; (-) strand; PAM type: NRG; PAM sequence: GGG
cataaaccatgaataacttt

SEQ ID NO: 27430 - DNA, 20 bp, Artificial Sequence
  Description of Artificial Sequence: Synthetic oligonucleotide
  Target: SCN9A; (-) strand; PAM type: NRG; PAM sequence: TGG
tcataaaccatgaataactt

SEQ ID NO: 27431 - DNA, 20 bp, Artificial Sequence
  Description of Artificial Sequence: Synthetic oligonucleotide
  Target: SCN9A; (-) strand; PAM type: NRG; PAM sequence: CAG
tttttagggccagagaatct

SEQ ID NO: 27432 - DNA, 20 bp, Artificial Sequence
  Description of Artificial Sequence: Synthetic oligonucleotide
  Target: SCN9A; (-) strand; PAM type: NRG; PAM sequence: GAG
ccagttcatttttagggcca

SEQ ID NO: 27433 - DNA, 20 bp, Artificial Sequence
  Description of Artificial Sequence: Synthetic oligonucleotide
  Target: SCN9A; (-) strand; PAM type: NRG; PAM sequence: CAG
caccagttcatttttagggc

SEQ ID NO: 27434 - DNA, 20 bp, Artificial Sequence
  Description of Artificial Sequence: Synthetic oligonucleotide
  Target: SCN9A; (-) strand; PAM type: NRG; PAM sequence: GGG
caggcaccagttcattttta

SEQ ID NO: 27435 - DNA, 20 bp, Artificial Sequence
  Description of Artificial Sequence: Synthetic oligonucleotide
  Target: SCN9A; (-) strand; PAM type: NRG; PAM sequence: AGG
gcaggcaccagttcattttt

SEQ ID NO: 27436 - DNA, 20 bp, Artificial Sequence
  Description of Artificial Sequence: Synthetic oligonucleotide
  Target: SCN9A; (-) strand; PAM type: NRG; PAM sequence: TAG
ggcaggcaccagttcatttt

SEQ ID NO: 27437 - DNA, 20 bp, Artificial Sequence
  Description of Artificial Sequence: Synthetic oligonucleotide
  Target: SCN9A; (-) strand; PAM type: NRG; PAM sequence: CAG
tatggatgtgaggcaggcac

SEQ ID NO: 27438 - DNA, 20 bp, Artificial Sequence
  Description of Artificial Sequence: Synthetic oligonucleotide
  Target: SCN9A; (-) strand; PAM type: NRG; PAM sequence: AGG
tttgactatggatgtgaggc

SEQ ID NO: 27439 - DNA, 20 bp, Artificial Sequence
  Description of Artificial Sequence: Synthetic oligonucleotide
  Target: SCN9A; (-) strand; PAM type: NRG; PAM sequence: CAG
ttttgactatggatgtgagg

SEQ ID NO: 27440 - DNA, 20 bp, Artificial Sequence
  Description of Artificial Sequence: Synthetic oligonucleotide
  Target: SCN9A; (-) strand; PAM type: NRG; PAM sequence: AGG
agtttttgactatggatgtg

SEQ ID NO: 27441 - DNA, 20 bp, Artificial Sequence
  Description of Artificial Sequence: Synthetic oligonucleotide
  Target: SCN9A; (-) strand; PAM type: NRG; PAM sequence: GAG
cagtttttgactatggatgt

SEQ ID NO: 27442 - DNA, 20 bp, Artificial Sequence
  Description of Artificial Sequence: Synthetic oligonucleotide
  Target: SCN9A; (-) strand; PAM type: NRG; PAM sequence: TGG
aaaatgccagtttttgacta

SEQ ID NO: 27443 - DNA, 20 bp, Artificial Sequence
  Description of Artificial Sequence: Synthetic oligonucleotide
  Target: SCN9A; (-) strand; PAM type: NRG; PAM sequence: CAG
actcagggtaaacaaaatgc

SEQ ID NO: 27444 - DNA, 20 bp, Artificial Sequence
  Description of Artificial Sequence: Synthetic oligonucleotide
  Target: SCN9A; (-) strand; PAM type: NRG; PAM sequence: GGG
gtgctggtcacactaactca

SEQ ID NO: 27445 - DNA, 20 bp, Artificial Sequence
  Description of Artificial Sequence: Synthetic oligonucleotide
  Target: SCN9A; (-) strand; PAM type: NRG; PAM sequence: AGG
agtgctggtcacactaactc

SEQ ID NO: 27446 - DNA, 20 bp, Artificial Sequence
  Description of Artificial Sequence: Synthetic oligonucleotide
  Target: SCN9A; (-) strand; PAM type: NRG; PAM sequence: CAG
cagtgctggtcacactaact

SEQ ID NO: 27447 - DNA, 20 bp, Artificial Sequence
  Description of Artificial Sequence: Synthetic oligonucleotide
  Target: SCN9A; (-) strand; PAM type: NRG; PAM sequence: TGG
atctctaaaatgtacagtgc

SEQ ID NO: 27448 - DNA, 20 bp, Artificial Sequence
  Description of Artificial Sequence: Synthetic oligonucleotide
  Target: SCN9A; (-) strand; PAM type: NRG; PAM sequence: CAG
agagtgatctctaaaatgta

SEQ ID NO: 27449 - DNA, 20 bp, Artificial Sequence
  Description of Artificial Sequence: Synthetic oligonucleotide
  Target: SCN9A; (-) strand; PAM type: NRG; PAM sequence: GAG
aattagtaaaattgatgcca

SEQ ID NO: 27450 - DNA, 20 bp, Artificial Sequence
  Description of Artificial Sequence: Synthetic oligonucleotide
  Target: SCN9A; (-) strand; PAM type: NRG; PAM sequence: CAG
ccaattagtaaaattgatgc

SEQ ID NO: 27451 - DNA, 20 bp, Artificial Sequence
  Description of Artificial Sequence: Synthetic oligonucleotide
  Target: SCN9A; (-) strand; PAM type: NRG; PAM sequence: TAG
tggaagatataagatccaat

SEQ ID NO: 27452 - DNA, 20 bp, Artificial Sequence
  Description of Artificial Sequence: Synthetic oligonucleotide
  Target: SCN9A; (-) strand; PAM type: NRG; PAM sequence: AAG
aacagacttctggaagatat

SEQ ID NO: 27453 - DNA, 20 bp, Artificial Sequence
  Description of Artificial Sequence: Synthetic oligonucleotide
  Target: SCN9A; (-) strand; PAM type: NRG; PAM sequence: AAG
ggtgatcaacagacttctgg

SEQ ID NO: 27454 - DNA, 20 bp, Artificial Sequence
  Description of Artificial Sequence: Synthetic oligonucleotide
  Target: SCN9A; (-) strand; PAM type: NRG; PAM sequence: TGG
gaaggtgatcaacagacttc

SEQ ID NO: 27455 - DNA, 20 bp, Artificial Sequence
  Description of Artificial Sequence: Synthetic oligonucleotide
  Target: SCN9A; (-) strand; PAM type: NRG; PAM sequence: CAG
ataggcaagaaggtgatcaa

SEQ ID NO: 27456 - DNA, 20 bp, Artificial Sequence
  Description of Artificial Sequence: Synthetic oligonucleotide
  Target: SCN9A; (-) strand; PAM type: NRG; PAM sequence: AGG
agactcaaggataggcaaga

SEQ ID NO: 27457 - DNA, 20 bp, Artificial Sequence
  Description of Artificial Sequence: Synthetic oligonucleotide
  Target: SCN9A; (-) strand; PAM type: NRG; PAM sequence: AAG
aagactcaaggataggcaag

SEQ ID NO: 27458 - DNA, 20 bp, Artificial Sequence
  Description of Artificial Sequence: Synthetic oligonucleotide
  Target: SCN9A; (-) strand; PAM type: NRG; PAM sequence: AAG
tagaagactcaaggataggc

SEQ ID NO: 27459 - DNA, 20 bp, Artificial Sequence
  Description of Artificial Sequence: Synthetic oligonucleotide
  Target: SCN9A; (-) strand; PAM type: NRG; PAM sequence: AGG
gacatagaagactcaaggat

SEQ ID NO: 27460 - DNA, 20 bp, Artificial Sequence
  Description of Artificial Sequence: Synthetic oligonucleotide
  Target: SCN9A; (-) strand; PAM type: NRG; PAM sequence: TAG
ggacatagaagactcaagga

SEQ ID NO: 27461 - DNA, 20 bp, Artificial Sequence
  Description of Artificial Sequence: Synthetic oligonucleotide
  Target: SCN9A; (-) strand; PAM type: NRG; PAM sequence: AGG
aactggacatagaagactca

SEQ ID NO: 27462 - DNA, 20 bp, Artificial Sequence
  Description of Artificial Sequence: Synthetic oligonucleotide
  Target: SCN9A; (-) strand; PAM type: NRG; PAM sequence: AAG
gaactggacatagaagactc

SEQ ID NO: 27463 - DNA, 20 bp, Artificial Sequence
  Description of Artificial Sequence: Synthetic oligonucleotide
  Target: SCN9A; (-) strand; PAM type: NRG; PAM sequence: AAG
aatggttgaactggacatag

SEQ ID NO: 27464 - DNA, 20 bp, Artificial Sequence
  Description of Artificial Sequence: Synthetic oligonucleotide
  Target: SCN9A; (-) strand; PAM type: NRG; PAM sequence: TAG
caaaatggttgaactggaca

SEQ ID NO: 27465 - DNA, 20 bp, Artificial Sequence
  Description of Artificial Sequence: Synthetic oligonucleotide
  Target: SCN9A; (-) strand; PAM type: NRG; PAM sequence: TGG
agaaaccaaaatggttgaac

SEQ ID NO: 27466 - DNA, 20 bp, Artificial Sequence
  Description of Artificial Sequence: Synthetic oligonucleotide
  Target: SCN9A; (-) strand; PAM type: NRG; PAM sequence: TGG
actattttgagaaaccaaaa

SEQ ID NO: 27467 - DNA, 20 bp, Artificial Sequence
  Description of Artificial Sequence: Synthetic oligonucleotide
  Target: SCN9A; (-) strand; PAM type: NRG; PAM sequence: GAG
gctttaaaaacaactatttt

SEQ ID NO: 27468 - DNA, 20 bp, Artificial Sequence
  Description of Artificial Sequence: Synthetic oligonucleotide
  Target: SCN9A; (-) strand; PAM type: NRG; PAM sequence: AAG
cttcaaagacttaatgaaac

SEQ ID NO: 27469 - DNA, 20 bp, Artificial Sequence
  Description of Artificial Sequence: Synthetic oligonucleotide
  Target: SCN9A; (-) strand; PAM type: NRG; PAM sequence: AAG
tcattgtcatcaaaacttca

SEQ ID NO: 27470 - DNA, 20 bp, Artificial Sequence
  Description of Artificial Sequence: Synthetic oligonucleotide
  Target: SCN9A; (-) strand; PAM type: NRG; PAM sequence: AAG
agtaaatacacaataaatta

SEQ ID NO: 27471 - DNA, 20 bp, Artificial Sequence
  Description of Artificial Sequence: Synthetic oligonucleotide
  Target: SCN9A; (-) strand; PAM type: NRG; PAM sequence: TAG
ctgcttattagcctggcata

SEQ ID NO: 27472 - DNA, 20 bp, Artificial Sequence
  Description of Artificial Sequence: Synthetic oligonucleotide
  Target: SCN9A; (-) strand; PAM type: NRG; PAM sequence: TGG
atgctttctgcttattagcc

SEQ ID NO: 27473 - DNA, 20 bp, Artificial Sequence
  Description of Artificial Sequence: Synthetic oligonucleotide
  Target: SCN9A; (-) strand; PAM type: NRG; PAM sequence: TAG
attaaatgctttctgcttat

SEQ ID NO: 27474 - DNA, 20 bp, Artificial Sequence
  Description of Artificial Sequence: Synthetic oligonucleotide
  Target: SCN9A; (-) strand; PAM type: NRG; PAM sequence: AGG
tcatttatcatattcttggg

SEQ ID NO: 27475 - DNA, 20 bp, Artificial Sequence
  Description of Artificial Sequence: Synthetic oligonucleotide
  Target: SCN9A; (-) strand; PAM type: NRG; PAM sequence: GAG
ttcatttatcatattcttgg

SEQ ID NO: 27476 - DNA, 20 bp, Artificial Sequence
  Description of Artificial Sequence: Synthetic oligonucleotide
  Target: SCN9A; (-) strand; PAM type: NRG; PAM sequence: GGG
atttcatttatcatattctt

SEQ ID NO: 27477 - DNA, 20 bp, Artificial Sequence
  Description of Artificial Sequence: Synthetic oligonucleotide
  Target: SCN9A; (-) strand; PAM type: NRG; PAM sequence: TGG
tatttcatttatcatattct

SEQ ID NO: 27478 - DNA, 20 bp, Artificial Sequence
  Description of Artificial Sequence: Synthetic oligonucleotide
  Target: SCN9A; (-) strand; PAM type: NRG; PAM sequence: TAG
ggacaaatattttaactctg

SEQ ID NO: 27479 - DNA, 20 bp, Artificial Sequence
  Description of Artificial Sequence: Synthetic oligonucleotide
  Target: SCN9A; (-) strand; PAM type: NRG; PAM sequence: TGG
ttatatgagtgatatgccct

SEQ ID NO: 27480 - DNA, 20 bp, Artificial Sequence
  Description of Artificial Sequence: Synthetic oligonucleotide
  Target: SCN9A; (-) strand; PAM type: NRG; PAM sequence: GAG
atgctgattctgcattatat

SEQ ID NO: 27481 - DNA, 20 bp, Artificial Sequence
  Description of Artificial Sequence: Synthetic oligonucleotide
  Target: SCN9A; (-) strand; PAM type: NRG; PAM sequence: GGG
cctcagagtcccaaagtcct

SEQ ID NO: 27482 - DNA, 20 bp, Artificial Sequence
  Description of Artificial Sequence: Synthetic oligonucleotide
  Target: SCN9A; (-) strand; PAM type: NRG; PAM sequence: TGG
tcctcagagtcccaaagtcc

SEQ ID NO: 27483 - DNA, 20 bp, Artificial Sequence
  Description of Artificial Sequence: Synthetic oligonucleotide
  Target: SCN9A; (-) strand; PAM type: NRG; PAM sequence: AAG
tttgggtcctcagagtccca

SEQ ID NO: 27484 - DNA, 20 bp, Artificial Sequence
  Description of Artificial Sequence: Synthetic oligonucleotide
  Target: SCN9A; (-) strand; PAM type: NRG; PAM sequence: GAG
gtgaagtgtttgggtcctca

SEQ ID NO: 27485 - DNA, 20 bp, Artificial Sequence
  Description of Artificial Sequence: Synthetic oligonucleotide
  Target: SCN9A; (-) strand; PAM type: NRG; PAM sequence: CAG
tagtgaagtgtttgggtcct

SEQ ID NO: 27486 - DNA, 20 bp, Artificial Sequence
  Description of Artificial Sequence: Synthetic oligonucleotide
  Target: SCN9A; (-) strand; PAM type: NRG; PAM sequence: GGG
ataatagtagtgaagtgttt

SEQ ID NO: 27487 - DNA, 20 bp, Artificial Sequence
  Description of Artificial Sequence: Synthetic oligonucleotide
  Target: SCN9A; (-) strand; PAM type: NRG; PAM sequence: TGG
cataatagtagtgaagtgtt

SEQ ID NO: 27488 - DNA, 20 bp, Artificial Sequence
  Description of Artificial Sequence: Synthetic oligonucleotide
  Target: SCN9A; (-) strand; PAM type: NRG; PAM sequence: AAG
gctttgacataatagtagtg

SEQ ID NO: 27489 - DNA, 20 bp, Artificial Sequence
  Description of Artificial Sequence: Synthetic oligonucleotide
  Target: SCN9A; (-) strand; PAM type: NRG; PAM sequence: TAG
gtattgctttgacataatag

SEQ ID NO: 27490 - DNA, 20 bp, Artificial Sequence
  Description of Artificial Sequence: Synthetic oligonucleotide
  Target: SCN9A; (-) strand; PAM type: NRG; PAM sequence: TAG
gatgtattgctttgacataa

SEQ ID NO: 27491 - DNA, 20 bp, Artificial Sequence
  Description of Artificial Sequence: Synthetic oligonucleotide
  Target: SCN9A; (-) strand; PAM type: NRG; PAM sequence: TGG
acatattttcagaaaaccta

SEQ ID NO: 27492 - DNA, 20 bp, Artificial Sequence
  Description of Artificial Sequence: Synthetic oligonucleotide
  Target: SCN9A; (-) strand; PAM type: NRG; PAM sequence: CAG
gtacacacctcacatatttt

SEQ ID NO: 27493 - DNA, 20 bp, Artificial Sequence
  Description of Artificial Sequence: Synthetic oligonucleotide
  Target: SCN9A; (-) strand; PAM type: NRG; PAM sequence: AAG
ttacattgctgctttcttgt

SEQ ID NO: 27494 - DNA, 20 bp, Artificial Sequence
  Description of Artificial Sequence: Synthetic oligonucleotide
  Target: SCN9A; (-) strand; PAM type: NRG; PAM sequence: TGG
ggagcaacacttaacatttt

SEQ ID NO: 27495 - DNA, 20 bp, Artificial Sequence
  Description of Artificial Sequence: Synthetic oligonucleotide
  Target: SCN9A; (-) strand; PAM type: NRG; PAM sequence: GAG
tctgccagcatatttcttgg

SEQ ID NO: 27496 - DNA, 20 bp, Artificial Sequence
  Description of Artificial Sequence: Synthetic oligonucleotide
  Target: SCN9A; (-) strand; PAM type: NRG; PAM sequence: GGG
tttctgccagcatatttctt

SEQ ID NO: 27497 - DNA, 20 bp, Artificial Sequence
  Description of Artificial Sequence: Synthetic oligonucleotide
  Target: SCN9A; (-) strand; PAM type: NRG; PAM sequence: TGG
ttttctgccagcatatttct

SEQ ID NO: 27498 - DNA, 20 bp, Artificial Sequence
  Description of Artificial Sequence: Synthetic oligonucleotide
  Target: SCN9A; (-) strand; PAM type: NRG; PAM sequence: CAG
ttgataatgattttttctgc

SEQ ID NO: 27499 - DNA, 20 bp, Artificial Sequence
  Description of Artificial Sequence: Synthetic oligonucleotide
  Target: SCN9A; (-) strand; PAM type: NRG; PAM sequence: GAG
ataaaaggttaccatcttgg

SEQ ID NO: 27500 - DNA, 20 bp, Artificial Sequence
  Description of Artificial Sequence: Synthetic oligonucleotide
  Target: SCN9A; (-) strand; PAM type: NRG; PAM sequence: GGG
ctataaaaggttaccatctt

SEQ ID NO: 27501 - DNA, 20 bp, Artificial Sequence
  Description of Artificial Sequence: Synthetic oligonucleotide
  Target: SCN9A; (-) strand; PAM type: NRG; PAM sequence: TGG
tctataaaaggttaccatct

SEQ ID NO: 27502 - DNA, 20 bp, Artificial Sequence
  Description of Artificial Sequence: Synthetic oligonucleotide
  Target: SCN9A; (-) strand; PAM type: NRG; PAM sequence: AGG
aacaatactatttctataaa

SEQ ID NO: 27503 - DNA, 20 bp, Artificial Sequence
  Description of Artificial Sequence: Synthetic oligonucleotide
  Target: SCN9A; (-) strand; PAM type: NRG; PAM sequence: AAG
taacaatactatttctataa

SEQ ID NO: 27504 - DNA, 20 bp, Artificial Sequence
  Description of Artificial Sequence: Synthetic oligonucleotide
  Target: SCN9A; (-) strand; PAM type: NRG; PAM sequence: AGG
ataattgtgcagtactgttg

SEQ ID NO: 27505 - DNA, 20 bp, Artificial Sequence
  Description of Artificial Sequence: Synthetic oligonucleotide
  Target: SCN9A; (-) strand; PAM type: NRG; PAM sequence: GAG
aataattgtgcagtactgtt

SEQ ID NO: 27506 - DNA, 20 bp, Artificial Sequence
  Description of Artificial Sequence: Synthetic oligonucleotide
  Target: SCN9A; (-) strand; PAM type: NRG; PAM sequence: CAG
tgtcttttaaaataattgtg

SEQ ID NO: 27507 - DNA, 20 bp, Artificial Sequence
  Description of Artificial Sequence: Synthetic oligonucleotide
  Target: SCN9A; (-) strand; PAM type: NRG; PAM sequence: TGG
gatgtgtagagtcaagtttc

SEQ ID NO: 27508 - DNA, 20 bp, Artificial Sequence
  Description of Artificial Sequence: Synthetic oligonucleotide
  Target: SCN9A; (-) strand; PAM type: NRG; PAM sequence: AAG
atgaatggatgtgtagagtc

SEQ ID NO: 27509 - DNA, 20 bp, Artificial Sequence
  Description of Artificial Sequence: Synthetic oligonucleotide
  Target: SCN9A; (-) strand; PAM type: NRG; PAM sequence: GAG
tccatatgaatggatgtgta

SEQ ID NO: 27510 - DNA, 20 bp, Artificial Sequence
  Description of Artificial Sequence: Synthetic oligonucleotide
  Target: SCN9A; (-) strand; PAM type: NRG; PAM sequence: TAG
tttccatatgaatggatgtg

SEQ ID NO: 27511 - DNA, 20 bp, Artificial Sequence
  Description of Artificial Sequence: Synthetic oligonucleotide
  Target: SCN9A; (-) strand; PAM type: NRG; PAM sequence: TGG
tccagaactttccatatgaa

SEQ ID NO: 27512 - DNA, 20 bp, Artificial Sequence
  Description of Artificial Sequence: Synthetic oligonucleotide
  Target: SCN9A; (-) strand; PAM type: NRG; PAM sequence: CAG
gcctcagaattatgcatatc

SEQ ID NO: 27513 - DNA, 20 bp, Artificial Sequence
  Description of Artificial Sequence: Synthetic oligonucleotide
  Target: SCN9A; (-) strand; PAM type: NRG; PAM sequence: CAG
gtcagatgaatctgcagcct

SEQ ID NO: 27514 - DNA, 20 bp, Artificial Sequence
  Description of Artificial Sequence: Synthetic oligonucleotide
  Target: SCN9A; (-) strand; PAM type: NRG; PAM sequence: CAG
ttttatgtcagatgaatctg

SEQ ID NO: 27515 - DNA, 20 bp, Artificial Sequence
  Description of Artificial Sequence: Synthetic oligonucleotide
  Target: SCN9A; (-) strand; PAM type: NRG; PAM sequence: CAG
tcatttcatattttttatgt

SEQ ID NO: 27516 - DNA, 20 bp, Artificial Sequence
  Description of Artificial Sequence: Synthetic oligonucleotide
  Target: SCN9A; (-) strand; PAM type: NRG; PAM sequence: TAG
gtactcatagtttctctttt

SEQ ID NO: 27517 - DNA, 20 bp, Artificial Sequence
  Description of Artificial Sequence: Synthetic oligonucleotide
  Target: SCN9A; (-) strand; PAM type: NRG; PAM sequence: TAG
tattgtgtgttatgtactca

SEQ ID NO: 27518 - DNA, 20 bp, Artificial Sequence
  Description of Artificial Sequence: Synthetic oligonucleotide
  Target: SCN9A; (-) strand; PAM type: NRG; PAM sequence: AAG
cttgctataggaaatttggt

SEQ ID NO: 27519 - DNA, 20 bp, Artificial Sequence
  Description of Artificial Sequence: Synthetic oligonucleotide
  Target: SCN9A; (-) strand; PAM type: NRG; PAM sequence: TGG
tgtacttgctataggaaatt

SEQ ID NO: 27520 - DNA, 20 bp, Artificial Sequence
  Description of Artificial Sequence: Synthetic oligonucleotide
  Target: SCN9A; (-) strand; PAM type: NRG; PAM sequence: AGG
ttcaaaaatgtacttgctat

SEQ ID NO: 27521 - DNA, 20 bp, Artificial Sequence
  Description of Artificial Sequence: Synthetic oligonucleotide
  Target: SCN9A; (-) strand; PAM type: NRG; PAM sequence: TAG
attcaaaaatgtacttgcta

SEQ ID NO: 27522 - DNA, 20 bp, Artificial Sequence
  Description of Artificial Sequence: Synthetic oligonucleotide
  Target: SCN9A; (-) strand; PAM type: NRG; PAM sequence: AGG
ggaacaccacccaatgactg

SEQ ID NO: 27523 - DNA, 20 bp, Artificial Sequence
  Description of Artificial Sequence: Synthetic oligonucleotide
  Target: SCN9A; (-) strand; PAM type: NRG; PAM sequence: GAG
tggaacaccacccaatgact

SEQ ID NO: 27524 - DNA, 20 bp, Artificial Sequence
  Description of Artificial Sequence: Synthetic oligonucleotide
  Target: SCN9A; (-) strand; PAM type: NRG; PAM sequence: TGG
aaacacattatttatggcta

SEQ ID NO: 27525 - DNA, 20 bp, Artificial Sequence
  Description of Artificial Sequence: Synthetic oligonucleotide
  Target: SCN9A; (-) strand; PAM type: NRG; PAM sequence: TGG
agttttaaacacattattta

SEQ ID NO: 27526 - DNA, 20 bp, Artificial Sequence
  Description of Artificial Sequence: Synthetic oligonucleotide
  Target: SCN9A; (-) strand; PAM type: NRG; PAM sequence: TAG
tcttgcaattaccatttgca

SEQ ID NO: 27527 - DNA, 20 bp, Artificial Sequence
  Description of Artificial Sequence: Synthetic oligonucleotide
  Target: SCN9A; (-) strand; PAM type: NRG; PAM sequence: TAG
tattgtaatggatccttttg

SEQ ID NO: 27528 - DNA, 20 bp, Artificial Sequence
  Description of Artificial Sequence: Synthetic oligonucleotide
  Target: SCN9A; (-) strand; PAM type: NRG; PAM sequence: TGG
gtgtatctattttattgtaa

SEQ ID NO: 27529 - DNA, 20 bp, Artificial Sequence
  Description of Artificial Sequence: Synthetic oligonucleotide
  Target: SCN9A; (-) strand; PAM type: NRG; PAM sequence: AAG
catattggataaaattcaaa

SEQ ID NO: 27530 - DNA, 20 bp, Artificial Sequence
  Description of Artificial Sequence: Synthetic oligonucleotide
  Target: SCN9A; (-) strand; PAM type: NRG; PAM sequence: TGG
tctggaattgctctccatat

SEQ ID NO: 27531 - DNA, 20 bp, Artificial Sequence
  Description of Artificial Sequence: Synthetic oligonucleotide
  Target: SCN9A; (-) strand; PAM type: NRG; PAM sequence: TGG
ttgcacacaaattcttgatc

SEQ ID NO: 27532 - DNA, 20 bp, Artificial Sequence
  Description of Artificial Sequence: Synthetic oligonucleotide
  Target: SCN9A; (-) strand; PAM type: NRG; PAM sequence: CAG
aaatgtccaccttggtggta

SEQ ID NO: 27533 - DNA, 20 bp, Artificial Sequence
  Description of Artificial Sequence: Synthetic oligonucleotide
  Target: SCN9A; (-) strand; PAM type: NRG; PAM sequence: TGG
gacaaaaatgtccaccttgg

SEQ ID NO: 27534 - DNA, 20 bp, Artificial Sequence
  Description of Artificial Sequence: Synthetic oligonucleotide
  Target: SCN9A; (-) strand; PAM type: NRG; PAM sequence: TGG
ccagacaaaaatgtccacct

SEQ ID NO: 27535 - DNA, 20 bp, Artificial Sequence
  Description of Artificial Sequence: Synthetic oligonucleotide
  Target: SCN9A; (-) strand; PAM type: NRG; PAM sequence: CAG
ctcccagaacttgaagagtc

SEQ ID NO: 27536 - DNA, 20 bp, Artificial Sequence
  Description of Artificial Sequence: Synthetic oligonucleotide
  Target: SCN9A; (-) strand; PAM type: NRG; PAM sequence: GAG
tttttctcccagaacttgaa

SEQ ID NO: 27537 - DNA, 20 bp, Artificial Sequence
  Description of Artificial Sequence: Synthetic oligonucleotide
  Target: SCN9A; (-) strand; PAM type: NRG; PAM sequence: AAG
cttttttctcccagaacttg

SEQ ID NO: 27538 - DNA, 20 bp, Artificial Sequence
  Description of Artificial Sequence: Synthetic oligonucleotide
  Target: SCN9A; (-) strand; PAM type: NRG; PAM sequence: CAG
tgttctctgcttttttctcc

SEQ ID NO: 27539 - DNA, 20 bp, Artificial Sequence
  Description of Artificial Sequence: Synthetic oligonucleotide
  Target: SCN9A; (-) strand; PAM type: NRG; PAM sequence: TGG
ttaggagtgaaacagacaaa

SEQ ID NO: 27540 - DNA, 20 bp, Artificial Sequence
  Description of Artificial Sequence: Synthetic oligonucleotide
  Target: SCN9A; (-) strand; PAM type: NRG; PAM sequence: CAG
gtatctggttaggagtgaaa

SEQ ID NO: 27541 - DNA, 20 bp, Artificial Sequence
  Description of Artificial Sequence: Synthetic oligonucleotide
  Target: SCN9A; (-) strand; PAM type: NRG; PAM sequence: GAG
actgatttgtatctggttag

SEQ ID NO: 27542 - DNA, 20 bp, Artificial Sequence
  Description of Artificial Sequence: Synthetic oligonucleotide
  Target: SCN9A; (-) strand; PAM type: NRG; PAM sequence: AGG
tgactgatttgtatctggtt

SEQ ID NO: 27543 - DNA, 20 bp, Artificial Sequence
  Description of Artificial Sequence: Synthetic oligonucleotide
  Target: SCN9A; (-) strand; PAM type: NRG; PAM sequence: TAG
ctgactgatttgtatctggt

SEQ ID NO: 27544 - DNA, 20 bp, Artificial Sequence
  Description of Artificial Sequence: Synthetic oligonucleotide
  Target: SCN9A; (-) strand; PAM type: NRG; PAM sequence: TGG
atgcctgactgatttgtatc

SEQ ID NO: 27545 - DNA, 20 bp, Artificial Sequence
  Description of Artificial Sequence: Synthetic oligonucleotide
  Target: SCN9A; (-) strand; PAM type: NRG; PAM sequence: TAG
tataaaccttgtttcaatat

SEQ ID NO: 27546 - DNA, 20 bp, Artificial Sequence
  Description of Artificial Sequence: Synthetic oligonucleotide
  Target: SCN9A; (-) strand; PAM type: NRG; PAM sequence: TAG
aggctatgctttcattgaaa

SEQ ID NO: 27547 - DNA, 20 bp, Artificial Sequence
  Description of Artificial Sequence: Synthetic oligonucleotide
  Target: SCN9A; (-) strand; PAM type: NRG; PAM sequence: AGG
tcataatagacttacataag

SEQ ID NO: 27548 - DNA, 20 bp, Artificial Sequence
  Description of Artificial Sequence: Synthetic oligonucleotide
  Target: SCN9A; (-) strand; PAM type: NRG; PAM sequence: GAG
gtcataatagacttacataa

SEQ ID NO: 27549 - DNA, 20 bp, Artificial Sequence
  Description of Artificial Sequence: Synthetic oligonucleotide
  Target: SCN9A; (-) strand; PAM type: NRG; PAM sequence: AAG
atgtcataatagacttacat

SEQ ID NO: 27550 - DNA, 20 bp, Artificial Sequence
  Description of Artificial Sequence: Synthetic oligonucleotide
  Target: SCN9A; (-) strand; PAM type: NRG; PAM sequence: TAG
aggcaacgaacatgtcataa

SEQ ID NO: 27551 - DNA, 20 bp, Artificial Sequence
  Description of Artificial Sequence: Synthetic oligonucleotide
  Target: SCN9A; (-) strand; PAM type: NRG; PAM sequence: AGG
ccctctcttatgcttcatct

SEQ ID NO: 27552 - DNA, 20 bp, Artificial Sequence
  Description of Artificial Sequence: Synthetic oligonucleotide
  Target: SCN9A; (-) strand; PAM type: NRG; PAM sequence: TAG
accctctcttatgcttcatc

SEQ ID NO: 27553 - DNA, 20 bp, Artificial Sequence
  Description of Artificial Sequence: Synthetic oligonucleotide
  Target: SCN9A; (-) strand; PAM type: NRG; PAM sequence: CAG
gatgcccacatatgtgcttg

SEQ ID NO: 27554 - DNA, 20 bp, Artificial Sequence
  Description of Artificial Sequence: Synthetic oligonucleotide
  Target: SCN9A; (-) strand; PAM type: NRG; PAM sequence: AAG
ttaggtgcatttttctctga

SEQ ID NO: 27555 - DNA, 20 bp, Artificial Sequence
  Description of Artificial Sequence: Synthetic oligonucleotide
  Target: SCN9A; (-) strand; PAM type: NRG; PAM sequence: AGG
cctgtttaccatcacatgtt

SEQ ID NO: 27556 - DNA, 20 bp, Artificial Sequence
  Description of Artificial Sequence: Synthetic oligonucleotide
  Target: SCN9A; (-) strand; PAM type: NRG; PAM sequence: TAG
tcctgtttaccatcacatgt

SEQ ID NO: 27557 - DNA, 20 bp, Artificial Sequence
  Description of Artificial Sequence: Synthetic oligonucleotide
  Target: SCN9A; (-) strand; PAM type: NRG; PAM sequence: TAG
atttctctgttaaggaaaca

SEQ ID NO: 27558 - DNA, 20 bp, Artificial Sequence
  Description of Artificial Sequence: Synthetic oligonucleotide
  Target: SCN9A; (-) strand; PAM type: NRG; PAM sequence: AGG
aaacatacatttctctgtta

SEQ ID NO: 27559 - DNA, 20 bp, Artificial Sequence
  Description of Artificial Sequence: Synthetic oligonucleotide
  Target: SCN9A; (-) strand; PAM type: NRG; PAM sequence: AAG
aaaacatacatttctctgtt

SEQ ID NO: 27560 - DNA, 20 bp, Artificial Sequence
  Description of Artificial Sequence: Synthetic oligonucleotide
  Target: SCN9A; (-) strand; PAM type: NRG; PAM sequence: TGG
gtgaaaaatatgcatattgg

SEQ ID NO: 27561 - DNA, 20 bp, Artificial Sequence
  Description of Artificial Sequence: Synthetic oligonucleotide
  Target: SCN9A; (-) strand; PAM type: NRG; PAM sequence: TGG
caggtgaaaaatatgcatat

SEQ ID NO: 27562 - DNA, 20 bp, Artificial Sequence
  Description of Artificial Sequence: Synthetic oligonucleotide
  Target: SCN9A; (-) strand; PAM type: NRG; PAM sequence: AGG
tgtcatgggactaaaaacac

SEQ ID NO: 27563 - DNA, 20 bp, Artificial Sequence
  Description of Artificial Sequence: Synthetic oligonucleotide
  Target: SCN9A; (-) strand; PAM type: NRG; PAM sequence: CAG
ttgtcatgggactaaaaaca

SEQ ID NO: 27564 - DNA, 20 bp, Artificial Sequence
  Description of Artificial Sequence: Synthetic oligonucleotide
  Target: SCN9A; (-) strand; PAM type: NRG; PAM sequence: GGG
tctcatcttattgttgtcat

SEQ ID NO: 27565 - DNA, 20 bp, Artificial Sequence
  Description of Artificial Sequence: Synthetic oligonucleotide
  Target: SCN9A; (-) strand; PAM type: NRG; PAM sequence: TGG
gtctcatcttattgttgtca

SEQ ID NO: 27566 - DNA, 20 bp, Artificial Sequence
  Description of Artificial Sequence: Synthetic oligonucleotide
  Target: SCN9A; (-) strand; PAM type: NRG; PAM sequence: TAG
agagttttttctggacagaa

SEQ ID NO: 27567 - DNA, 20 bp, Artificial Sequence
  Description of Artificial Sequence: Synthetic oligonucleotide
  Target: SCN9A; (-) strand; PAM type: NRG; PAM sequence: CAG
cagcaagagttttttctgga

SEQ ID NO: 27568 - DNA, 20 bp, Artificial Sequence
  Description of Artificial Sequence: Synthetic oligonucleotide
  Target: SCN9A; (-) strand; PAM type: NRG; PAM sequence: TGG
attacagcaagagttttttc

SEQ ID NO: 27569 - DNA, 20 bp, Artificial Sequence
  Description of Artificial Sequence: Synthetic oligonucleotide
  Target: SCN9A; (-) strand; PAM type: NRG; PAM sequence: GAG
cctgtgaactattacagcaa

SEQ ID NO: 27570 - DNA, 20 bp, Artificial Sequence
  Description of Artificial Sequence: Synthetic oligonucleotide
  Target: SCN9A; (-) strand; PAM type: NRG; PAM sequence: AAG
cacctgtgaactattacagc

SEQ ID NO: 27571 - DNA, 20 bp, Artificial Sequence
  Description of Artificial Sequence: Synthetic oligonucleotide
  Target: SCN9A; (-) strand; PAM type: NRG; PAM sequence: CAG
ttttcacctgtgaactatta

SEQ ID NO: 27572 - DNA, 20 bp, Artificial Sequence
  Description of Artificial Sequence: Synthetic oligonucleotide
  Target: SCN9A; (-) strand; PAM type: NRG; PAM sequence: AGG
atttctagttgcttggttct

SEQ ID NO: 27573 - DNA, 20 bp, Artificial Sequence
  Description of Artificial Sequence: Synthetic oligonucleotide
  Target: SCN9A; (-) strand; PAM type: NRG; PAM sequence: TAG
tatttctagttgcttggttc

SEQ ID NO: 27574 - DNA, 20 bp, Artificial Sequence
  Description of Artificial Sequence: Synthetic oligonucleotide
  Target: SCN9A; (-) strand; PAM type: NRG; PAM sequence: TGG
ataaattatttctagttgct

SEQ ID NO: 27575 - DNA, 20 bp, Artificial Sequence
  Description of Artificial Sequence: Synthetic oligonucleotide
  Target: SCN9A; (-) strand; PAM type: NRG; PAM sequence: TAG
agtcctccataaattatttc

SEQ ID NO: 27576 - DNA, 20 bp, Artificial Sequence
  Description of Artificial Sequence: Synthetic oligonucleotide
  Target: SCN9A; (-) strand; PAM type: NRG; PAM sequence: GAG
gtgtgaaatgtctatttcat

SEQ ID NO: 27577 - DNA, 20 bp, Artificial Sequence
  Description of Artificial Sequence: Synthetic oligonucleotide
  Target: SCN9A; (-) strand; PAM type: NRG; PAM sequence: TGG
gtgagaagtaaatgggctaa

SEQ ID NO: 27578 - DNA, 20 bp, Artificial Sequence
  Description of Artificial Sequence: Synthetic oligonucleotide
  Target: SCN9A; (-) strand; PAM type: NRG; PAM sequence: GGG
ataaatggtgagaagtaaat

SEQ ID NO: 27579 - DNA, 20 bp, Artificial Sequence
  Description of Artificial Sequence: Synthetic oligonucleotide
  Target: SCN9A; (-) strand; PAM type: NRG; PAM sequence: TGG
aataaatggtgagaagtaaa

SEQ ID NO: 27580 - DNA, 20 bp, Artificial Sequence
  Description of Artificial Sequence: Synthetic oligonucleotide
  Target: SCN9A; (-) strand; PAM type: NRG; PAM sequence: AAG
tctcctaaataaatggtgag

SEQ ID NO: 27581 - DNA, 20 bp, Artificial Sequence
  Description of Artificial Sequence: Synthetic oligonucleotide
  Target: SCN9A; (-) strand; PAM type: NRG; PAM sequence: GAG
tcatctcctaaataaatggt

SEQ ID NO: 27582 - DNA, 20 bp, Artificial Sequence
  Description of Artificial Sequence: Synthetic oligonucleotide
  Target: SCN9A; (-) strand; PAM type: NRG; PAM sequence: TGG
ctactcatctcctaaataaa

SEQ ID NO: 27583 - DNA, 20 bp, Artificial Sequence
  Description of Artificial Sequence: Synthetic oligonucleotide
  Target: SCN9A; (-) strand; PAM type: NRG; PAM sequence: AAG
acattcccattgtgggggca

SEQ ID NO: 27584 - DNA, 20 bp, Artificial Sequence
  Description of Artificial Sequence: Synthetic oligonucleotide
  Target: SCN9A; (-) strand; PAM type: NRG; PAM sequence: GGG
cccccacattcccattgtgg

SEQ ID NO: 27585 - DNA, 20 bp, Artificial Sequence
  Description of Artificial Sequence: Synthetic oligonucleotide
  Target: SCN9A; (-) strand; PAM type: NRG; PAM sequence: GGG
ccccccacattcccattgtg

SEQ ID NO: 27586 - DNA, 20 bp, Artificial Sequence
  Description of Artificial Sequence: Synthetic oligonucleotide
  Target: SCN9A; (-) strand; PAM type: NRG; PAM sequence: GGG
accccccacattcccattgt

SEQ ID NO: 27587 - DNA, 20 bp, Artificial Sequence
  Description of Artificial Sequence: Synthetic oligonucleotide
  Target: SCN9A; (-) strand; PAM type: NRG; PAM sequence: TGG
caccccccacattcccattg

SEQ ID NO: 27588 - DNA, 20 bp, Artificial Sequence
  Description of Artificial Sequence: Synthetic oligonucleotide
  Target: SCN9A; (-) strand; PAM type: NRG; PAM sequence: GGG
ccaggtcccacctggtccct

SEQ ID NO: 27589 - DNA, 20 bp, Artificial Sequence
  Description of Artificial Sequence: Synthetic oligonucleotide
  Target: SCN9A; (-) strand; PAM type: NRG; PAM sequence: TGG
cccaggtcccacctggtccc

SEQ ID NO: 27590 - DNA, 20 bp, Artificial Sequence
  Description of Artificial Sequence: Synthetic oligonucleotide
  Target: SCN9A; (-) strand; PAM type: NRG; PAM sequence: TGG
aatatgccccaggtcccacc

SEQ ID NO: 27591 - DNA, 20 bp, Artificial Sequence
  Description of Artificial Sequence: Synthetic oligonucleotide
  Target: SCN9A; (-) strand; PAM type: NRG; PAM sequence: AGG
ctcccctgacaatatgcccc

SEQ ID NO: 27592 - DNA, 20 bp, Artificial Sequence
  Description of Artificial Sequence: Synthetic oligonucleotide
  Target: SCN9A; (-) strand; PAM type: NRG; PAM sequence: CAG
tctcccctgacaatatgccc

SEQ ID NO: 27593 - DNA, 20 bp, Artificial Sequence
  Description of Artificial Sequence: Synthetic oligonucleotide
  Target: SCN9A; (-) strand; PAM type: NRG; PAM sequence: TGG
gacaactttacaaactgtgc

SEQ ID NO: 27594 - DNA, 20 bp, Artificial Sequence
  Description of Artificial Sequence: Synthetic oligonucleotide
  Target: SCN9A; (-) strand; PAM type: NRG; PAM sequence: GGG
aataagcaaagatagtcaaa

SEQ ID NO: 27595 - DNA, 20 bp, Artificial Sequence
  Description of Artificial Sequence: Synthetic oligonucleotide
  Target: SCN9A; (-) strand; PAM type: NRG; PAM sequence: AGG
taataagcaaagatagtcaa

SEQ ID NO: 27596 - DNA, 20 bp, Artificial Sequence
  Description of Artificial Sequence: Synthetic oligonucleotide
  Target: SCN9A; (-) strand; PAM type: NRG; PAM sequence: AAG
ctaataagcaaagatagtca

SEQ ID NO: 27597 - DNA, 20 bp, Artificial Sequence
  Description of Artificial Sequence: Synthetic oligonucleotide
  Target: SCN9A; (-) strand; PAM type: NRG; PAM sequence: TAG
tctcttctaataagcaaaga

SEQ ID NO: 27598 - DNA, 20 bp, Artificial Sequence
  Description of Artificial Sequence: Synthetic oligonucleotide
  Target: SCN9A; (-) strand; PAM type: NRG; PAM sequence: AAG
attgtctcttctaataagca

SEQ ID NO: 27599 - DNA, 20 bp, Artificial Sequence
  Description of Artificial Sequence: Synthetic oligonucleotide
  Target: SCN9A; (-) strand; PAM type: NRG; PAM sequence: AAG
caaaaattgtctcttctaat

SEQ ID NO: 27600 - DNA, 20 bp, Artificial Sequence
  Description of Artificial Sequence: Synthetic oligonucleotide
  Target: SCN9A; (-) strand; PAM type: NRG; PAM sequence: GAG
cagaaaacaaggttaaccca

SEQ ID NO: 27601 - DNA, 20 bp, Artificial Sequence
  Description of Artificial Sequence: Synthetic oligonucleotide
  Target: SCN9A; (-) strand; PAM type: NRG; PAM sequence: CAG
tgcagaaaacaaggttaacc

SEQ ID NO: 27602 - DNA, 20 bp, Artificial Sequence
  Description of Artificial Sequence: Synthetic oligonucleotide
  Target: SCN9A; (-) strand; PAM type: NRG; PAM sequence: AGG
agtaattgatgcagaaaaca

SEQ ID NO: 27603 - DNA, 20 bp, Artificial Sequence
  Description of Artificial Sequence: Synthetic oligonucleotide
  Target: SCN9A; (-) strand; PAM type: NRG; PAM sequence: AAG
tagtaattgatgcagaaaac

SEQ ID NO: 27604 - DNA, 20 bp, Artificial Sequence
  Description of Artificial Sequence: Synthetic oligonucleotide
  Target: SCN9A; (-) strand; PAM type: NRG; PAM sequence: CAG
tgatttaatagtaattgatg

SEQ ID NO: 27605 - DNA, 20 bp, Artificial Sequence
  Description of Artificial Sequence: Synthetic oligonucleotide
  Target: SCN9A; (-) strand; PAM type: NRG; PAM sequence: TAG
ttcaaagataagtgatttaa

SEQ ID NO: 27606 - DNA, 20 bp, Artificial Sequence
  Description of Artificial Sequence: Synthetic oligonucleotide
  Target: SCN9A; (-) strand; PAM type: NRG; PAM sequence: AAG
tgatctgacctttcaaagat

SEQ ID NO: 27607 - DNA, 20 bp, Artificial Sequence
  Description of Artificial Sequence: Synthetic oligonucleotide
  Target: SCN9A; (-) strand; PAM type: NRG; PAM sequence: AAG
ttgggtgatctgacctttca

SEQ ID NO: 27608 - DNA, 20 bp, Artificial Sequence
  Description of Artificial Sequence: Synthetic oligonucleotide
  Target: SCN9A; (-) strand; PAM type: NRG; PAM sequence: GGG
aacccacaaagacagatgtt

SEQ ID NO: 27609 - DNA, 20 bp, Artificial Sequence
  Description of Artificial Sequence: Synthetic oligonucleotide
  Target: SCN9A; (-) strand; PAM type: NRG; PAM sequence: TGG
aaacccacaaagacagatgt

SEQ ID NO: 27610 - DNA, 20 bp, Artificial Sequence
  Description of Artificial Sequence: Synthetic oligonucleotide
  Target: SCN9A; (-) strand; PAM type: NRG; PAM sequence: CAG
aaaaagaaaacccacaaaga

SEQ ID NO: 27611 - DNA, 20 bp, Artificial Sequence
  Description of Artificial Sequence: Synthetic oligonucleotide
  Target: SCN9A; (-) strand; PAM type: NRG; PAM sequence: AAG
tgaaaaaaagaaaacccaca

SEQ ID NO: 27612 - DNA, 20 bp, Artificial Sequence
  Description of Artificial Sequence: Synthetic oligonucleotide
  Target: SCN9A; (-) strand; PAM type: NRG; PAM sequence: AAG
tgactttgcaaaatgaaaaa

SEQ ID NO: 27613 - DNA, 20 bp, Artificial Sequence
  Description of Artificial Sequence: Synthetic oligonucleotide
  Target: SCN9A; (-) strand; PAM type: NRG; PAM sequence: TGG
aaacacagacattgataaca

SEQ ID NO: 27614 - DNA, 20 bp, Artificial Sequence
  Description of Artificial Sequence: Synthetic oligonucleotide
  Target: SCN9A; (-) strand; PAM type: NRG; PAM sequence: CAG
aaattatttgctattaaaca

SEQ ID NO: 27615 - DNA, 20 bp, Artificial Sequence
  Description of Artificial Sequence: Synthetic oligonucleotide
  Target: SCN9A; (-) strand; PAM type: NRG; PAM sequence: TGG
tgtttttatgtgcttaaaaa

SEQ ID NO: 27616 - DNA, 20 bp, Artificial Sequence
  Description of Artificial Sequence: Synthetic oligonucleotide
  Target: SCN9A; (-) strand; PAM type: NRG; PAM sequence: TGG
agataaccaatggatactga

SEQ ID NO: 27617 - DNA, 20 bp, Artificial Sequence
  Description of Artificial Sequence: Synthetic oligonucleotide
  Target: SCN9A; (-) strand; PAM type: NRG; PAM sequence: TGG
atgatggtaaagataaccaa

SEQ ID NO: 27618 - DNA, 20 bp, Artificial Sequence
  Description of Artificial Sequence: Synthetic oligonucleotide
  Target: SCN9A; (-) strand; PAM type: NRG; PAM sequence: AAG
aatggttttaaatgatggta

SEQ ID NO: 27619 - DNA, 20 bp, Artificial Sequence
  Description of Artificial Sequence: Synthetic oligonucleotide
  Target: SCN9A; (-) strand; PAM type: NRG; PAM sequence: TGG
cataaaatggttttaaatga

SEQ ID NO: 27620 - DNA, 20 bp, Artificial Sequence
  Description of Artificial Sequence: Synthetic oligonucleotide
  Target: SCN9A; (-) strand; PAM type: NRG; PAM sequence: TGG
agaattcagagaccataaaa

SEQ ID NO: 27621 - DNA, 20 bp, Artificial Sequence
  Description of Artificial Sequence: Synthetic oligonucleotide
  Target: SCN9A; (-) strand; PAM type: NRG; PAM sequence: GAG
aaattcttaggaagaattca

SEQ ID NO: 27622 - DNA, 20 bp, Artificial Sequence
  Description of Artificial Sequence: Synthetic oligonucleotide
  Target: SCN9A; (-) strand; PAM type: NRG; PAM sequence: CAG
tgaaattcttaggaagaatt

SEQ ID NO: 27623 - DNA, 20 bp, Artificial Sequence
  Description of Artificial Sequence: Synthetic oligonucleotide
  Target: SCN9A; (-) strand; PAM type: NRG; PAM sequence: AAG
aggcacatgaaattcttagg

SEQ ID NO: 27624 - DNA, 20 bp, Artificial Sequence
  Description of Artificial Sequence: Synthetic oligonucleotide
  Target: SCN9A; (-) strand; PAM type: NRG; PAM sequence: AGG
aataggcacatgaaattctt

SEQ ID NO: 27625 - DNA, 20 bp, Artificial Sequence
  Description of Artificial Sequence: Synthetic oligonucleotide
  Target: SCN9A; (-) strand; PAM type: NRG; PAM sequence: TAG
aaataggcacatgaaattct

SEQ ID NO: 27626 - DNA, 20 bp, Artificial Sequence
  Description of Artificial Sequence: Synthetic oligonucleotide
  Target: SCN9A; (-) strand; PAM type: NRG; PAM sequence: AGG
aaatctggtcaaccttaaat

SEQ ID NO: 27627 - DNA, 20 bp, Artificial Sequence
  Description of Artificial Sequence: Synthetic oligonucleotide
  Target: SCN9A; (-) strand; PAM type: NRG; PAM sequence: TAG
taaatctggtcaaccttaaa

SEQ ID NO: 27628 - DNA, 20 bp, Artificial Sequence
  Description of Artificial Sequence: Synthetic oligonucleotide
  Target: SCN9A; (-) strand; PAM type: NRG; PAM sequence: TGG
aaataaaattaacataaatc

SEQ ID NO: 27629 - DNA, 20 bp, Artificial Sequence
  Description of Artificial Sequence: Synthetic oligonucleotide
  Target: SCN9A; (-) strand; PAM type: NRG; PAM sequence: CAG
aataatcttcttttactgta

SEQ ID NO: 27630 - DNA, 20 bp, Artificial Sequence
  Description of Artificial Sequence: Synthetic oligonucleotide
  Target: SCN9A; (-) strand; PAM type: NRG; PAM sequence: AGG
atattaacaaacactgtgga

SEQ ID NO: 27631 - DNA, 20 bp, Artificial Sequence
  Description of Artificial Sequence: Synthetic oligonucleotide
  Target: SCN9A; (-) strand; PAM type: NRG; PAM sequence: AAG
catattaacaaacactgtgg

SEQ ID NO: 27632 - DNA, 20 bp, Artificial Sequence
  Description of Artificial Sequence: Synthetic oligonucleotide
  Target: SCN9A; (-) strand; PAM type: NRG; PAM sequence: TGG
aagcatattaacaaacactg

SEQ ID NO: 27633 - DNA, 20 bp, Artificial Sequence
  Description of Artificial Sequence: Synthetic oligonucleotide
  Target: SCN9A; (-) strand; PAM type: NRG; PAM sequence: AAG
cagagagcaatgagtagagc

SEQ ID NO: 27634 - DNA, 20 bp, Artificial Sequence
  Description of Artificial Sequence: Synthetic oligonucleotide
  Target: SCN9A; (-) strand; PAM type: NRG; PAM sequence: GAG
cagacagagagcaatgagta

SEQ ID NO: 27635 - DNA, 20 bp, Artificial Sequence
  Description of Artificial Sequence: Synthetic oligonucleotide
  Target: SCN9A; (-) strand; PAM type: NRG; PAM sequence: TAG
ctcagacagagagcaatgag

SEQ ID NO: 27636 - DNA, 20 bp, Artificial Sequence
  Description of Artificial Sequence: Synthetic oligonucleotide
  Target: SCN9A; (-) strand; PAM type: NRG; PAM sequence: GAG
aacctcagacagagagcaat

SEQ ID NO: 27637 - DNA, 20 bp, Artificial Sequence
  Description of Artificial Sequence: Synthetic oligonucleotide
  Target: SCN9A; (-) strand; PAM type: NRG; PAM sequence: GAG
tgatcccaacctcagacaga

SEQ ID NO: 27638 - DNA, 20 bp, Artificial Sequence
  Description of Artificial Sequence: Synthetic oligonucleotide
  Target: SCN9A; (-) strand; PAM type: NRG; PAM sequence: GAG
aatgatcccaacctcagaca

SEQ ID NO: 27639 - DNA, 20 bp, Artificial Sequence
  Description of Artificial Sequence: Synthetic oligonucleotide
  Target: SCN9A; (-) strand; PAM type: NRG; PAM sequence: CAG
tgaatgatcccaacctcaga

SEQ ID NO: 27640 - DNA, 20 bp, Artificial Sequence
  Description of Artificial Sequence: Synthetic oligonucleotide
  Target: SCN9A; (-) strand; PAM type: NRG; PAM sequence: CAG
atgctgaatgatcccaacct

SEQ ID NO: 27641 - DNA, 20 bp, Artificial Sequence
  Description of Artificial Sequence: Synthetic oligonucleotide
  Target: SCN9A; (-) strand; PAM type: NRG; PAM sequence: AGG
tagttcctatctcctttcag

SEQ ID NO: 27642 - DNA, 20 bp, Artificial Sequence
  Description of Artificial Sequence: Synthetic oligonucleotide
  Target: SCN9A; (-) strand; PAM type: NRG; PAM sequence: GAG
gtagttcctatctcctttca

SEQ ID NO: 27643 - DNA, 20 bp, Artificial Sequence
  Description of Artificial Sequence: Synthetic oligonucleotide
  Target: SCN9A; (-) strand; PAM type: NRG; PAM sequence: CAG
ttgtagttcctatctccttt

SEQ ID NO: 27644 - DNA, 20 bp, Artificial Sequence
  Description of Artificial Sequence: Synthetic oligonucleotide
  Target: SCN9A; (-) strand; PAM type: NRG; PAM sequence: TAG
atacacaagaaaaggcgttg

SEQ ID NO: 27645 - DNA, 20 bp, Artificial Sequence
  Description of Artificial Sequence: Synthetic oligonucleotide
  Target: SCN9A; (-) strand; PAM type: NRG; PAM sequence: AGG
ccaatcaaatacacaagaaa

SEQ ID NO: 27646 - DNA, 20 bp, Artificial Sequence
  Description of Artificial Sequence: Synthetic oligonucleotide
  Target: SCN9A; (-) strand; PAM type: NRG; PAM sequence: AAG
accaatcaaatacacaagaa

SEQ ID NO: 27647 - DNA, 20 bp, Artificial Sequence
  Description of Artificial Sequence: Synthetic oligonucleotide
  Target: SCN9A; (-) strand; PAM type: NRG; PAM sequence: AAG
gcacgaccaatcaaatacac

SEQ ID NO: 27648 - DNA, 20 bp, Artificial Sequence
  Description of Artificial Sequence: Synthetic oligonucleotide
  Target: SCN9A; (-) strand; PAM type: NRG; PAM sequence: GGG
attaattgatttttttttta

SEQ ID NO: 27649 - DNA, 20 bp, Artificial Sequence
  Description of Artificial Sequence: Synthetic oligonucleotide
  Target: SCN9A; (-) strand; PAM type: NRG; PAM sequence: AGG
cattaattgatttttttttt

SEQ ID NO: 27650 - DNA, 20 bp, Artificial Sequence
  Description of Artificial Sequence: Synthetic oligonucleotide
  Target: SCN9A; (-) strand; PAM type: NRG; PAM sequence: TAG
acattaattgattttttttt

SEQ ID NO: 27651 - DNA, 20 bp, Artificial Sequence
  Description of Artificial Sequence: Synthetic oligonucleotide
  Target: SCN9A; (-) strand; PAM type: NRG; PAM sequence: AAG
tttattaggattctgttctt

SEQ ID NO: 27652 - DNA, 20 bp, Artificial Sequence
  Description of Artificial Sequence: Synthetic oligonucleotide
  Target: SCN9A; (-) strand; PAM type: NRG; PAM sequence: AGG
tcttatacctacaatttatt

SEQ ID NO: 27653 - DNA, 20 bp, Artificial Sequence
  Description of Artificial Sequence: Synthetic oligonucleotide
  Target: SCN9A; (-) strand; PAM type: NRG; PAM sequence: TAG
atcttatacctacaatttat

SEQ ID NO: 27654 - DNA, 20 bp, Artificial Sequence
  Description of Artificial Sequence: Synthetic oligonucleotide
  Target: SCN9A; (-) strand; PAM type: NRG; PAM sequence: AAG
ctcactacagctatataagc

SEQ ID NO: 27655 - DNA, 20 bp, Artificial Sequence
  Description of Artificial Sequence: Synthetic oligonucleotide
  Target: SCN9A; (-) strand; PAM type: NRG; PAM sequence: AAG
attactcactacagctatat

SEQ ID NO: 27656 - DNA, 20 bp, Artificial Sequence
  Description of Artificial Sequence: Synthetic oligonucleotide
  Target: SCN9A; (-) strand; PAM type: NRG; PAM sequence: CAG
ctacttttaattactcacta

SEQ ID NO: 27657 - DNA, 20 bp, Artificial Sequence
  Description of Artificial Sequence: Synthetic oligonucleotide
  Target: SCN9A; (-) strand; PAM type: NRG; PAM sequence: AGG
taatttgaacccagcaatct

SEQ ID NO: 27658 - DNA, 20 bp, Artificial Sequence
  Description of Artificial Sequence: Synthetic oligonucleotide
  Target: SCN9A; (-) strand; PAM type: NRG; PAM sequence: TAG
ataatttgaacccagcaatc

SEQ ID NO: 27659 - DNA, 20 bp, Artificial Sequence
  Description of Artificial Sequence: Synthetic oligonucleotide
  Target: SCN9A; (-) strand; PAM type: NRG; PAM sequence: CAG
gcagagccataatttgaacc

SEQ ID NO: 27660 - DNA, 20 bp, Artificial Sequence
  Description of Artificial Sequence: Synthetic oligonucleotide
  Target: SCN9A; (-) strand; PAM type: NRG; PAM sequence: GAG
tatacagccagtaagtagca

SEQ ID NO: 27661 - DNA, 20 bp, Artificial Sequence
  Description of Artificial Sequence: Synthetic oligonucleotide
  Target: SCN9A; (-) strand; PAM type: NRG; PAM sequence: CAG
gatatacagccagtaagtag

SEQ ID NO: 27662 - DNA, 20 bp, Artificial Sequence
  Description of Artificial Sequence: Synthetic oligonucleotide
  Target: SCN9A; (-) strand; PAM type: NRG; PAM sequence: TAG
tatgatatacagccagtaag

SEQ ID NO: 27663 - DNA, 20 bp, Artificial Sequence
  Description of Artificial Sequence: Synthetic oligonucleotide
  Target: SCN9A; (-) strand; PAM type: NRG; PAM sequence: AAG
tcctatgatatacagccagt

SEQ ID NO: 27664 - DNA, 20 bp, Artificial Sequence
  Description of Artificial Sequence: Synthetic oligonucleotide
  Target: SCN9A; (-) strand; PAM type: NRG; PAM sequence: CAG
gctctcctatgatatacagc

SEQ ID NO: 27665 - DNA, 20 bp, Artificial Sequence
  Description of Artificial Sequence: Synthetic oligonucleotide
  Target: SCN9A; (-) strand; PAM type: NRG; PAM sequence: CAG
agtagctctcctatgatata

SEQ ID NO: 27666 - DNA, 20 bp, Artificial Sequence
  Description of Artificial Sequence: Synthetic oligonucleotide
  Target: SCN9A; (-) strand; PAM type: NRG; PAM sequence: TAG
ataaaactgagacagttaag

SEQ ID NO: 27667 - DNA, 20 bp, Artificial Sequence
  Description of Artificial Sequence: Synthetic oligonucleotide
  Target: SCN9A; (-) strand; PAM type: NRG; PAM sequence: AAG
aatataaaactgagacagtt

SEQ ID NO: 27668 - DNA, 20 bp, Artificial Sequence
  Description of Artificial Sequence: Synthetic oligonucleotide
  Target: SCN9A; (-) strand; PAM type: NRG; PAM sequence: CAG
ttaccaatataaaactgaga

SEQ ID NO: 27669 - DNA, 20 bp, Artificial Sequence
  Description of Artificial Sequence: Synthetic oligonucleotide
  Target: SCN9A; (-) strand; PAM type: NRG; PAM sequence: GAG
cattttaccaatataaaact

SEQ ID NO: 27670 - DNA, 20 bp, Artificial Sequence
  Description of Artificial Sequence: Synthetic oligonucleotide
  Target: SCN9A; (-) strand; PAM type: NRG; PAM sequence: AAG
tcctcacaagaatatgaagc

SEQ ID NO: 27671 - DNA, 20 bp, Artificial Sequence
  Description of Artificial Sequence: Synthetic oligonucleotide
  Target: SCN9A; (-) strand; PAM type: NRG; PAM sequence: AAG
ttaatcctcacaagaatatg

SEQ ID NO: 27672 - DNA, 20 bp, Artificial Sequence
  Description of Artificial Sequence: Synthetic oligonucleotide
  Target: SCN9A; (-) strand; PAM type: NRG; PAM sequence: AAG
ttaattcctttaatcctcac

SEQ ID NO: 27673 - DNA, 20 bp, Artificial Sequence
  Description of Artificial Sequence: Synthetic oligonucleotide
  Target: SCN9A; (-) strand; PAM type: NRG; PAM sequence: TAG
tgatataacaaaaaagcagc

SEQ ID NO: 27674 - DNA, 20 bp, Artificial Sequence
  Description of Artificial Sequence: Synthetic oligonucleotide
  Target: SCN9A; (-) strand; PAM type: NRG; PAM sequence: CAG
gtgatgatataacaaaaaag

SEQ ID NO: 27675 - DNA, 20 bp, Artificial Sequence
  Description of Artificial Sequence: Synthetic oligonucleotide
  Target: SCN9A; (-) strand; PAM type: NRG; PAM sequence: AAG
atagtgatgatataacaaaa

SEQ ID NO: 27676 - DNA, 20 bp, Artificial Sequence
  Description of Artificial Sequence: Synthetic oligonucleotide
  Target: SCN9A; (-) strand; PAM type: NRG; PAM sequence: TAG
gaaaggcagagaggtgatga

SEQ ID NO: 27677 - DNA, 20 bp, Artificial Sequence
  Description of Artificial Sequence: Synthetic oligonucleotide
  Target: SCN9A; (-) strand; PAM type: NRG; PAM sequence: AGG
gaacactcagaaaggcagag

SEQ ID NO: 27678 - DNA, 20 bp, Artificial Sequence
  Description of Artificial Sequence: Synthetic oligonucleotide
  Target: SCN9A; (-) strand; PAM type: NRG; PAM sequence: GAG
tgaacactcagaaaggcaga

SEQ ID NO: 27679 - DNA, 20 bp, Artificial Sequence
  Description of Artificial Sequence: Synthetic oligonucleotide
  Target: SCN9A; (-) strand; PAM type: NRG; PAM sequence: GAG
attgaacactcagaaaggca

SEQ ID NO: 27680 - DNA, 20 bp, Artificial Sequence
  Description of Artificial Sequence: Synthetic oligonucleotide
  Target: SCN9A; (-) strand; PAM type: NRG; PAM sequence: CAG
aaattgaacactcagaaagg

SEQ ID NO: 27681 - DNA, 20 bp, Artificial Sequence
  Description of Artificial Sequence: Synthetic oligonucleotide
  Target: SCN9A; (-) strand; PAM type: NRG; PAM sequence: AGG
aataaattgaacactcagaa

SEQ ID NO: 27682 - DNA, 20 bp, Artificial Sequence
  Description of Artificial Sequence: Synthetic oligonucleotide
  Target: SCN9A; (-) strand; PAM type: NRG; PAM sequence: AAG
gaataaattgaacactcaga

SEQ ID NO: 27683 - DNA, 20 bp, Artificial Sequence
  Description of Artificial Sequence: Synthetic oligonucleotide
  Target: SCN9A; (-) strand; PAM type: NRG; PAM sequence: CAG
atctgaataaattgaacact

SEQ ID NO: 27684 - DNA, 20 bp, Artificial Sequence
  Description of Artificial Sequence: Synthetic oligonucleotide
  Target: SCN9A; (-) strand; PAM type: NRG; PAM sequence: AGG
cactttcactgttttcatgt

SEQ ID NO: 27685 - DNA, 20 bp, Artificial Sequence
  Description of Artificial Sequence: Synthetic oligonucleotide
  Target: SCN9A; (-) strand; PAM type: NRG; PAM sequence: TAG
gcactttcactgttttcatg

SEQ ID NO: 27686 - DNA, 20 bp, Artificial Sequence
  Description of Artificial Sequence: Synthetic oligonucleotide
  Target: SCN9A; (-) strand; PAM type: NRG; PAM sequence: CAG
cctttagatacacagcacta

SEQ ID NO: 27687 - DNA, 20 bp, Artificial Sequence
  Description of Artificial Sequence: Synthetic oligonucleotide
  Target: SCN9A; (-) strand; PAM type: NRG; PAM sequence: CAG
attctacccctttagataca

SEQ ID NO: 27688 - DNA, 20 bp, Artificial Sequence
  Description of Artificial Sequence: Synthetic oligonucleotide
  Target: SCN9A; (-) strand; PAM type: NRG; PAM sequence: TAG
atactgagattctacccctt

SEQ ID NO: 27689 - DNA, 20 bp, Artificial Sequence
  Description of Artificial Sequence: Synthetic oligonucleotide
  Target: SCN9A; (-) strand; PAM type: NRG; PAM sequence: GAG
gaaatttatcagagaatact

SEQ ID NO: 27690 - DNA, 20 bp, Artificial Sequence
  Description of Artificial Sequence: Synthetic oligonucleotide
  Target: SCN9A; (-) strand; PAM type: NRG; PAM sequence: GAG
gtaattccagaaatttatca

SEQ ID NO: 27691 - DNA, 20 bp, Artificial Sequence
  Description of Artificial Sequence: Synthetic oligonucleotide
  Target: SCN9A; (-) strand; PAM type: NRG; PAM sequence: CAG
aagtaattccagaaatttat

SEQ ID NO: 27692 - DNA, 20 bp, Artificial Sequence
  Description of Artificial Sequence: Synthetic oligonucleotide
  Target: SCN9A; (-) strand; PAM type: NRG; PAM sequence: CAG
ccctcaataaaaagtaattc

SEQ ID NO: 27693 - DNA, 20 bp, Artificial Sequence
  Description of Artificial Sequence: Synthetic oligonucleotide
  Target: SCN9A; (-) strand; PAM type: NRG; PAM sequence: AAG
aatgttgttccctcaataaa

SEQ ID NO: 27694 - DNA, 20 bp, Artificial Sequence
  Description of Artificial Sequence: Synthetic oligonucleotide
  Target: SCN9A; (-) strand; PAM type: NRG; PAM sequence: GAG
gtaagagacaaccattacag

SEQ ID NO: 27695 - DNA, 20 bp, Artificial Sequence
  Description of Artificial Sequence: Synthetic oligonucleotide
  Target: SCN9A; (-) strand; PAM type: NRG; PAM sequence: AGG
cagtaagagacaaccattac

SEQ ID NO: 27696 - DNA, 20 bp, Artificial Sequence
  Description of Artificial Sequence: Synthetic oligonucleotide
  Target: SCN9A; (-) strand; PAM type: NRG; PAM sequence: CAG
gcagtaagagacaaccatta

SEQ ID NO: 27697 - DNA, 20 bp, Artificial Sequence
  Description of Artificial Sequence: Synthetic oligonucleotide
  Target: SCN9A; (-) strand; PAM type: NRG; PAM sequence: GAG
gaggtcttccttggcagtaa

SEQ ID NO: 27698 - DNA, 20 bp, Artificial Sequence
  Description of Artificial Sequence: Synthetic oligonucleotide
  Target: SCN9A; (-) strand; PAM type: NRG; PAM sequence: AAG
atgaggtcttccttggcagt

SEQ ID NO: 27699 - DNA, 20 bp, Artificial Sequence
  Description of Artificial Sequence: Synthetic oligonucleotide
  Target: SCN9A; (-) strand; PAM type: NRG; PAM sequence: CAG
gttcatgaggtcttccttgg

SEQ ID NO: 27700 - DNA, 20 bp, Artificial Sequence
  Description of Artificial Sequence: Synthetic oligonucleotide
  Target: SCN9A; (-) strand; PAM type: NRG; PAM sequence: TGG
tcagttcatgaggtcttcct

SEQ ID NO: 27701 - DNA, 20 bp, Artificial Sequence
  Description of Artificial Sequence: Synthetic oligonucleotide
  Target: SCN9A; (-) strand; PAM type: NRG; PAM sequence: AGG
tatgctctgctcagttcatg

SEQ ID NO: 27702 - DNA, 20 bp, Artificial Sequence
  Description of Artificial Sequence: Synthetic oligonucleotide
  Target: SCN9A; (-) strand; PAM type: NRG; PAM sequence: GAG
atatgctctgctcagttcat

SEQ ID NO: 27703 - DNA, 20 bp, Artificial Sequence
  Description of Artificial Sequence: Synthetic oligonucleotide
  Target: SCN9A; (-) strand; PAM type: NRG; PAM sequence: CAG
ttatcatcatatgctctgct

SEQ ID NO: 27704 - DNA, 20 bp, Artificial Sequence
  Description of Artificial Sequence: Synthetic oligonucleotide
  Target: SCN9A; (-) strand; PAM type: NRG; PAM sequence: GAG
ctaattgttcctttcaaact

SEQ ID NO: 27705 - DNA, 20 bp, Artificial Sequence
  Description of Artificial Sequence: Synthetic oligonucleotide
  Target: SCN9A; (-) strand; PAM type: NRG; PAM sequence: TAG
gaggtcacctctttcagatg

SEQ ID NO: 27706 - DNA, 20 bp, Artificial Sequence
  Description of Artificial Sequence: Synthetic oligonucleotide
  Target: SCN9A; (-) strand; PAM type: NRG; PAM sequence: CAG
tgaagagaggtcacctcttt

SEQ ID NO: 27707 - DNA, 20 bp, Artificial Sequence
  Description of Artificial Sequence: Synthetic oligonucleotide
  Target: SCN9A; (-) strand; PAM type: NRG; PAM sequence: AGG
caatttctagagctgaagag

SEQ ID NO: 27708 - DNA, 20 bp, Artificial Sequence
  Description of Artificial Sequence: Synthetic oligonucleotide
  Target: SCN9A; (-) strand; PAM type: NRG; PAM sequence: GAG
acaatttctagagctgaaga

SEQ ID NO: 27709 - DNA, 20 bp, Artificial Sequence
  Description of Artificial Sequence: Synthetic oligonucleotide
  Target: SCN9A; (-) strand; PAM type: NRG; PAM sequence: GAG
caacaatttctagagctgaa

SEQ ID NO: 27710 - DNA, 20 bp, Artificial Sequence
  Description of Artificial Sequence: Synthetic oligonucleotide
  Target: SCN9A; (-) strand; PAM type: NRG; PAM sequence: AAG
ggcaacaatttctagagctg

SEQ ID NO: 27711 - DNA, 20 bp, Artificial Sequence
  Description of Artificial Sequence: Synthetic oligonucleotide
  Target: SCN9A; (-) strand; PAM type: NRG; PAM sequence: GAG
ttgcatggcaacaatttcta

SEQ ID NO: 27712 - DNA, 20 bp, Artificial Sequence
  Description of Artificial Sequence: Synthetic oligonucleotide
  Target: SCN9A; (-) strand; PAM type: NRG; PAM sequence: TAG
ttttgcatggcaacaatttc

SEQ ID NO: 27713 - DNA, 20 bp, Artificial Sequence
  Description of Artificial Sequence: Synthetic oligonucleotide
  Target: SCN9A; (-) strand; PAM type: NRG; PAM sequence: TGG
catgagttcatgtttttgca

SEQ ID NO: 27714 - DNA, 20 bp, Artificial Sequence
  Description of Artificial Sequence: Synthetic oligonucleotide
  Target: SCN9A; (-) strand; PAM type: NRG; PAM sequence: GAG
taaatacacttgttatgcat

SEQ ID NO: 27715 - DNA, 20 bp, Artificial Sequence
  Description of Artificial Sequence: Synthetic oligonucleotide
  Target: SCN9A; (-) strand; PAM type: NRG; PAM sequence: AAG
agtttccaagttttaaaaat

SEQ ID NO: 27716 - DNA, 20 bp, Artificial Sequence
  Description of Artificial Sequence: Synthetic oligonucleotide
  Target: SCN9A; (-) strand; PAM type: NRG; PAM sequence: AAG
ttaaatttgaattagtttcc

SEQ ID NO: 27717 - DNA, 20 bp, Artificial Sequence
  Description of Artificial Sequence: Synthetic oligonucleotide
  Target: SCN9A; (-) strand; PAM type: NRG; PAM sequence: TAG
atagtgttttaaatttgaat

SEQ ID NO: 27718 - DNA, 20 bp, Artificial Sequence
  Description of Artificial Sequence: Synthetic oligonucleotide
  Target: SCN9A; (-) strand; PAM type: NRG; PAM sequence: TAG
tggcctgcatggaaccaaca

SEQ ID NO: 27719 - DNA, 20 bp, Artificial Sequence
  Description of Artificial Sequence: Synthetic oligonucleotide
  Target: SCN9A; (-) strand; PAM type: NRG; PAM sequence: TGG
gtgtgtatttctggcctgca

SEQ ID NO: 27720 - DNA, 20 bp, Artificial Sequence
  Description of Artificial Sequence: Synthetic oligonucleotide
  Target: SCN9A; (-) strand; PAM type: NRG; PAM sequence: TGG
tgagtgtgtgtgtgtatttc

SEQ ID NO: 27721 - DNA, 20 bp, Artificial Sequence
  Description of Artificial Sequence: Synthetic oligonucleotide
  Target: SCN9A; (-) strand; PAM type: NRG; PAM sequence: GAG
ttgtgtatatatgtgtgtgt

SEQ ID NO: 27722 - DNA, 20 bp, Artificial Sequence
  Description of Artificial Sequence: Synthetic oligonucleotide
  Target: SCN9A; (-) strand; PAM type: NRG; PAM sequence: TAG
atgatagatctagagttgta

SEQ ID NO: 27723 - DNA, 20 bp, Artificial Sequence
  Description of Artificial Sequence: Synthetic oligonucleotide
  Target: SCN9A; (-) strand; PAM type: NRG; PAM sequence: GAG
agacaaacatgatagatcta

SEQ ID NO: 27724 - DNA, 20 bp, Artificial Sequence
  Description of Artificial Sequence: Synthetic oligonucleotide
  Target: SCN9A; (-) strand; PAM type: NRG; PAM sequence: TAG
gcagacaaacatgatagatc

SEQ ID NO: 27725 - DNA, 20 bp, Artificial Sequence
  Description of Artificial Sequence: Synthetic oligonucleotide
  Target: SCN9A; (-) strand; PAM type: NRG; PAM sequence: TAG
acacaagcagacaaacatga

SEQ ID NO: 27726 - DNA, 20 bp, Artificial Sequence
  Description of Artificial Sequence: Synthetic oligonucleotide
  Target: SCN9A; (-) strand; PAM type: NRG; PAM sequence: CAG
taccacataccacacacaag

SEQ ID NO: 27727 - DNA, 20 bp, Artificial Sequence
  Description of Artificial Sequence: Synthetic oligonucleotide
  Target: SCN9A; (-) strand; PAM type: NRG; PAM sequence: AAG
atataccacataccacacac

SEQ ID NO: 27728 - DNA, 20 bp, Artificial Sequence
  Description of Artificial Sequence: Synthetic oligonucleotide
  Target: SCN9A; (-) strand; PAM type: NRG; PAM sequence: TAG
actatacaactttacaaatc

SEQ ID NO: 27729 - DNA, 20 bp, Artificial Sequence
  Description of Artificial Sequence: Synthetic oligonucleotide
  Target: SCN9A; (-) strand; PAM type: NRG; PAM sequence: TAG
tgtgtctgttcacatacaca

SEQ ID NO: 27730 - DNA, 20 bp, Artificial Sequence
  Description of Artificial Sequence: Synthetic oligonucleotide
  Target: SCN9A; (-) strand; PAM type: NRG; PAM sequence: GGG
tttacagagatctctcaaat

SEQ ID NO: 27731 - DNA, 20 bp, Artificial Sequence
  Description of Artificial Sequence: Synthetic oligonucleotide
  Target: SCN9A; (-) strand; PAM type: NRG; PAM sequence: TGG
ttttacagagatctctcaaa

SEQ ID NO: 27732 - DNA, 20 bp, Artificial Sequence
  Description of Artificial Sequence: Synthetic oligonucleotide
  Target: SCN9A; (-) strand; PAM type: NRG; PAM sequence: GAG
caaaaagttgactttttaca

SEQ ID NO: 27733 - DNA, 20 bp, Artificial Sequence
  Description of Artificial Sequence: Synthetic oligonucleotide
  Target: SCN9A; (-) strand; PAM type: NRG; PAM sequence: CAG
ttcaaaaagttgacttttta

SEQ ID NO: 27734 - DNA, 20 bp, Artificial Sequence
  Description of Artificial Sequence: Synthetic oligonucleotide
  Target: SCN9A; (-) strand; PAM type: NRG; PAM sequence: AAG
ggttttcgagacttttcaaa

SEQ ID NO: 27735 - DNA, 20 bp, Artificial Sequence
  Description of Artificial Sequence: Synthetic oligonucleotide
  Target: SCN9A; (-) strand; PAM type: NRG; PAM sequence: GAG
gcacagaaaacctggttttc

SEQ ID NO: 27736 - DNA, 20 bp, Artificial Sequence
  Description of Artificial Sequence: Synthetic oligonucleotide
  Target: SCN9A; (-) strand; PAM type: NRG; PAM sequence: TGG
agactatagcacagaaaacc

SEQ ID NO: 27737 - DNA, 20 bp, Artificial Sequence
  Description of Artificial Sequence: Synthetic oligonucleotide
  Target: SCN9A; (-) strand; PAM type: NRG; PAM sequence: CAG
ttgtttgacagactatagca

SEQ ID NO: 27738 - DNA, 20 bp, Artificial Sequence
  Description of Artificial Sequence: Synthetic oligonucleotide
  Target: SCN9A; (-) strand; PAM type: NRG; PAM sequence: TAG
aattcttgtttgacagacta

SEQ ID NO: 27739 - DNA, 20 bp, Artificial Sequence
  Description of Artificial Sequence: Synthetic oligonucleotide
  Target: SCN9A; (-) strand; PAM type: NRG; PAM sequence: CAG
tctgacaaattcttgtttga

SEQ ID NO: 27740 - DNA, 20 bp, Artificial Sequence
  Description of Artificial Sequence: Synthetic oligonucleotide
  Target: SCN9A; (-) strand; PAM type: NRG; PAM sequence: TGG
atacctgaaacatgtctaca

SEQ ID NO: 27741 - DNA, 20 bp, Artificial Sequence
  Description of Artificial Sequence: Synthetic oligonucleotide
  Target: SCN9A; (-) strand; PAM type: NRG; PAM sequence: TGG
taaaattgtggcacaatata

SEQ ID NO: 27742 - DNA, 20 bp, Artificial Sequence
  Description of Artificial Sequence: Synthetic oligonucleotide
  Target: SCN9A; (-) strand; PAM type: NRG; PAM sequence: TGG
atacagtaaacataaaattg

SEQ ID NO: 27743 - DNA, 20 bp, Artificial Sequence
  Description of Artificial Sequence: Synthetic oligonucleotide
  Target: SCN9A; (-) strand; PAM type: NRG; PAM sequence: CAG
tataagatacaatggaaata

SEQ ID NO: 27744 - DNA, 20 bp, Artificial Sequence
  Description of Artificial Sequence: Synthetic oligonucleotide
  Target: SCN9A; (-) strand; PAM type: NRG; PAM sequence: TGG
tggatacttataagatacaa

SEQ ID NO: 27745 - DNA, 20 bp, Artificial Sequence
  Description of Artificial Sequence: Synthetic oligonucleotide
  Target: SCN9A; (-) strand; PAM type: NRG; PAM sequence: AAG
aggaattagtggatacttat

SEQ ID NO: 27746 - DNA, 20 bp, Artificial Sequence
  Description of Artificial Sequence: Synthetic oligonucleotide
  Target: SCN9A; (-) strand; PAM type: NRG; PAM sequence: TGG
tacaaaactagaggaattag

SEQ ID NO: 27747 - DNA, 20 bp, Artificial Sequence
  Description of Artificial Sequence: Synthetic oligonucleotide
  Target: SCN9A; (-) strand; PAM type: NRG; PAM sequence: TAG
aactacaaaactagaggaat

SEQ ID NO: 27748 - DNA, 20 bp, Artificial Sequence
  Description of Artificial Sequence: Synthetic oligonucleotide
  Target: SCN9A; (-) strand; PAM type: NRG; PAM sequence: AGG
agtgaaaactacaaaactag

SEQ ID NO: 27749 - DNA, 20 bp, Artificial Sequence
  Description of Artificial Sequence: Synthetic oligonucleotide
  Target: SCN9A; (-) strand; PAM type: NRG; PAM sequence: GAG
aagtgaaaactacaaaacta

SEQ ID NO: 27750 - DNA, 20 bp, Artificial Sequence
  Description of Artificial Sequence: Synthetic oligonucleotide
  Target: SCN9A; (-) strand; PAM type: NRG; PAM sequence: TAG
taaagtgaaaactacaaaac

SEQ ID NO: 27751 - DNA, 20 bp, Artificial Sequence
  Description of Artificial Sequence: Synthetic oligonucleotide
  Target: SCN9A; (-) strand; PAM type: NRG; PAM sequence: AAG
cagtatcacaataaatccta

SEQ ID NO: 27752 - DNA, 20 bp, Artificial Sequence
  Description of Artificial Sequence: Synthetic oligonucleotide
  Target: SCN9A; (-) strand; PAM type: NRG; PAM sequence: CAG
ttttttcaccatagaaaaat

SEQ ID NO: 27753 - DNA, 20 bp, Artificial Sequence
  Description of Artificial Sequence: Synthetic oligonucleotide
  Target: SCN9A; (-) strand; PAM type: NRG; PAM sequence: TAG
atttaagagttttttcacca

SEQ ID NO: 27754 - DNA, 20 bp, Artificial Sequence
  Description of Artificial Sequence: Synthetic oligonucleotide
  Target: SCN9A; (-) strand; PAM type: NRG; PAM sequence: GAG
aatgaagtttcttcatttaa

SEQ ID NO: 27755 - DNA, 20 bp, Artificial Sequence
  Description of Artificial Sequence: Synthetic oligonucleotide
  Target: SCN9A; (-) strand; PAM type: NRG; PAM sequence: AAG
ttaatgaagtttcttcattt

SEQ ID NO: 27756 - DNA, 20 bp, Artificial Sequence
  Description of Artificial Sequence: Synthetic oligonucleotide
  Target: SCN9A; (-) strand; PAM type: NRG; PAM sequence: AAG
attatttcatatttttaatg

SEQ ID NO: 27757 - DNA, 20 bp, Artificial Sequence
  Description of Artificial Sequence: Synthetic oligonucleotide
  Target: SCN9A; (-) strand; PAM type: NRG; PAM sequence: GAG
tataatttatatcagattag

SEQ ID NO: 27758 - DNA, 20 bp, Artificial Sequence
  Description of Artificial Sequence: Synthetic oligonucleotide
  Target: SCN9A; (-) strand; PAM type: NRG; PAM sequence: AGG
tatataatttatatcagatt

SEQ ID NO: 27759 - DNA, 20 bp, Artificial Sequence
  Description of Artificial Sequence: Synthetic oligonucleotide
  Target: SCN9A; (-) strand; PAM type: NRG; PAM sequence: TAG
ctatataatttatatcagat

SEQ ID NO: 27760 - DNA, 20 bp, Artificial Sequence
  Description of Artificial Sequence: Synthetic oligonucleotide
  Target: SCN9A; (-) strand; PAM type: NRG; PAM sequence: CAG
aaatactatataatttatat

SEQ ID NO: 27761 - DNA, 20 bp, Artificial Sequence
  Description of Artificial Sequence: Synthetic oligonucleotide
  Target: SCN9A; (-) strand; PAM type: NRG; PAM sequence: TGG
atgagcatgttaaatttctg

SEQ ID NO: 27762 - DNA, 20 bp, Artificial Sequence
  Description of Artificial Sequence: Synthetic oligonucleotide
  Target: SCN9A; (-) strand; PAM type: NRG; PAM sequence: GAG
ggtatttttcattattgaat

SEQ ID NO: 27763 - DNA, 20 bp, Artificial Sequence
  Description of Artificial Sequence: Synthetic oligonucleotide
  Target: SCN9A; (-) strand; PAM type: NRG; PAM sequence: AGG
acagcttaagcccttctgca

SEQ ID NO: 27764 - DNA, 20 bp, Artificial Sequence
  Description of Artificial Sequence: Synthetic oligonucleotide
  Target: SCN9A; (-) strand; PAM type: NRG; PAM sequence: AAG
tacagcttaagcccttctgc

SEQ ID NO: 27765 - DNA, 20 bp, Artificial Sequence
  Description of Artificial Sequence: Synthetic oligonucleotide
  Target: SCN9A; (-) strand; PAM type: NRG; PAM sequence: AAG
atgtgtgcatgatacagctt

SEQ ID NO: 27766 - DNA, 20 bp, Artificial Sequence
  Description of Artificial Sequence: Synthetic oligonucleotide
  Target: SCN9A; (-) strand; PAM type: NRG; PAM sequence: CAG
acctctatgtgtgcatgata

SEQ ID NO: 27767 - DNA, 20 bp, Artificial Sequence
  Description of Artificial Sequence: Synthetic oligonucleotide
  Target: SCN9A; (-) strand; PAM type: NRG; PAM sequence: AGG
gaataaatgcatgtgctttt

SEQ ID NO: 27768 - DNA, 20 bp, Artificial Sequence
  Description of Artificial Sequence: Synthetic oligonucleotide
  Target: SCN9A; (-) strand; PAM type: NRG; PAM sequence: TAG
tgaataaatgcatgtgcttt

SEQ ID NO: 27769 - DNA, 20 bp, Artificial Sequence
  Description of Artificial Sequence: Synthetic oligonucleotide
  Target: SCN9A; (-) strand; PAM type: NRG; PAM sequence: TGG
gtaaagttccatcaaatcca

SEQ ID NO: 27770 - DNA, 20 bp, Artificial Sequence
  Description of Artificial Sequence: Synthetic oligonucleotide
  Target: SCN9A; (-) strand; PAM type: NRG; PAM sequence: AAG
tagtatttcaagtgagagta

SEQ ID NO: 27771 - DNA, 20 bp, Artificial Sequence
  Description of Artificial Sequence: Synthetic oligonucleotide
  Target: SCN9A; (-) strand; PAM type: NRG; PAM sequence: GAG
caatgtagtatttcaagtga

SEQ ID NO: 27772 - DNA, 20 bp, Artificial Sequence
  Description of Artificial Sequence: Synthetic oligonucleotide
  Target: SCN9A; (-) strand; PAM type: NRG; PAM sequence: GAG
gacaatgtagtatttcaagt

SEQ ID NO: 27773 - DNA, 20 bp, Artificial Sequence
  Description of Artificial Sequence: Synthetic oligonucleotide
  Target: SCN9A; (-) strand; PAM type: NRG; PAM sequence: AAG
tgcagacaatgtagtatttc

SEQ ID NO: 27774 - DNA, 20 bp, Artificial Sequence
  Description of Artificial Sequence: Synthetic oligonucleotide
  Target: SCN9A; (-) strand; PAM type: NRG; PAM sequence: TAG
atttatatttgcagacaatg

SEQ ID NO: 27775 - DNA, 20 bp, Artificial Sequence
  Description of Artificial Sequence: Synthetic oligonucleotide
  Target: SCN9A; (-) strand; PAM type: NRG; PAM sequence: CAG
tgcttatatatttatatttg

SEQ ID NO: 27776 - DNA, 20 bp, Artificial Sequence
  Description of Artificial Sequence: Synthetic oligonucleotide
  Target: SCN9A; (-) strand; PAM type: NRG; PAM sequence: AAG
agggctttgactaacccaat

SEQ ID NO: 27777 - DNA, 20 bp, Artificial Sequence
  Description of Artificial Sequence: Synthetic oligonucleotide
  Target: SCN9A; (-) strand; PAM type: NRG; PAM sequence: GGG
tgcattaccaatatcagcaa

SEQ ID NO: 27778 - DNA, 20 bp, Artificial Sequence
  Description of Artificial Sequence: Synthetic oligonucleotide
  Target: SCN9A; (-) strand; PAM type: NRG; PAM sequence: AGG
ctgcattaccaatatcagca

SEQ ID NO: 27779 - DNA, 20 bp, Artificial Sequence
  Description of Artificial Sequence: Synthetic oligonucleotide
  Target: SCN9A; (-) strand; PAM type: NRG; PAM sequence: AAG
gctgcattaccaatatcagc

SEQ ID NO: 27780 - DNA, 20 bp, Artificial Sequence
  Description of Artificial Sequence: Synthetic oligonucleotide
  Target: SCN9A; (-) strand; PAM type: NRG; PAM sequence: CAG
ctatgctgcattaccaatat

SEQ ID NO: 27781 - DNA, 20 bp, Artificial Sequence
  Description of Artificial Sequence: Synthetic oligonucleotide
  Target: SCN9A; (-) strand; PAM type: NRG; PAM sequence: TAG
gagtttccaggatatctctt

SEQ ID NO: 27782 - DNA, 20 bp, Artificial Sequence
  Description of Artificial Sequence: Synthetic oligonucleotide
  Target: SCN9A; (-) strand; PAM type: NRG; PAM sequence: AGG
ttctcattcctggagtttcc

SEQ ID NO: 27783 - DNA, 20 bp, Artificial Sequence
  Description of Artificial Sequence: Synthetic oligonucleotide
  Target: SCN9A; (-) strand; PAM type: NRG; PAM sequence: CAG
tttctcattcctggagtttc

SEQ ID NO: 27784 - DNA, 20 bp, Artificial Sequence
  Description of Artificial Sequence: Synthetic oligonucleotide
  Target: SCN9A; (-) strand; PAM type: NRG; PAM sequence: GAG
tgagatctttctcattcctg

SEQ ID NO: 27785 - DNA, 20 bp, Artificial Sequence
  Description of Artificial Sequence: Synthetic oligonucleotide
  Target: SCN9A; (-) strand; PAM type: NRG; PAM sequence: TGG
agtgagatctttctcattcc

SEQ ID NO: 27786 - DNA, 20 bp, Artificial Sequence
  Description of Artificial Sequence: Synthetic oligonucleotide
  Target: SCN9A; (-) strand; PAM type: NRG; PAM sequence: GAG
gtctgattaggcttgaaagt

SEQ ID NO: 27787 - DNA, 20 bp, Artificial Sequence
  Description of Artificial Sequence: Synthetic oligonucleotide
  Target: SCN9A; (-) strand; PAM type: NRG; PAM sequence: AAG
aggtgtctgattaggcttga

SEQ ID NO: 27788 - DNA, 20 bp, Artificial Sequence
  Description of Artificial Sequence: Synthetic oligonucleotide
  Target: SCN9A; (-) strand; PAM type: NRG; PAM sequence: AGG
ttagagaaaggtgtctgatt

SEQ ID NO: 27789 - DNA, 20 bp, Artificial Sequence
  Description of Artificial Sequence: Synthetic oligonucleotide
  Target: SCN9A; (-) strand; PAM type: NRG; PAM sequence: TAG
gttagagaaaggtgtctgat

SEQ ID NO: 27790 - DNA, 20 bp, Artificial Sequence
  Description of Artificial Sequence: Synthetic oligonucleotide
  Target: SCN9A; (-) strand; PAM type: NRG; PAM sequence: AGG
gtcactaagtggttagagaa

SEQ ID NO: 27791 - DNA, 20 bp, Artificial Sequence
  Description of Artificial Sequence: Synthetic oligonucleotide
  Target: SCN9A; (-) strand; PAM type: NRG; PAM sequence: AAG
agtcactaagtggttagaga

SEQ ID NO: 27792 - DNA, 20 bp, Artificial Sequence
  Description of Artificial Sequence: Synthetic oligonucleotide
  Target: SCN9A; (-) strand; PAM type: NRG; PAM sequence: GAG
tacgagtcactaagtggtta

SEQ ID NO: 27793 - DNA, 20 bp, Artificial Sequence
  Description of Artificial Sequence: Synthetic oligonucleotide
  Target: SCN9A; (-) strand; PAM type: NRG; PAM sequence: TAG
tctacgagtcactaagtggt

SEQ ID NO: 27794 - DNA, 20 bp, Artificial Sequence
  Description of Artificial Sequence: Synthetic oligonucleotide
  Target: SCN9A; (-) strand; PAM type: NRG; PAM sequence: TGG
aaggtctacgagtcactaag

SEQ ID NO: 27795 - DNA, 20 bp, Artificial Sequence
  Description of Artificial Sequence: Synthetic oligonucleotide
  Target: SCN9A; (-) strand; PAM type: NRG; PAM sequence: AAG
ccaaaggtctacgagtcact

SEQ ID NO: 27796 - DNA, 20 bp, Artificial Sequence
  Description of Artificial Sequence: Synthetic oligonucleotide
  Target: SCN9A; (-) strand; PAM type: NRG; PAM sequence: GAG
cagcagttccaaaggtctac

SEQ ID NO: 27797 - DNA, 20 bp, Artificial Sequence
  Description of Artificial Sequence: Synthetic oligonucleotide
  Target: SCN9A; (-) strand; PAM type: NRG; PAM sequence: AGG
tcattttacagcagttccaa

SEQ ID NO: 27798 - DNA, 20 bp, Artificial Sequence
  Description of Artificial Sequence: Synthetic oligonucleotide
  Target: SCN9A; (-) strand; PAM type: NRG; PAM sequence: AAG
atcattttacagcagttcca

SEQ ID NO: 27799 - DNA, 20 bp, Artificial Sequence
  Description of Artificial Sequence: Synthetic oligonucleotide
  Target: SCN9A; (-) strand; PAM type: NRG; PAM sequence: CAG
gcaaaacaatcattttacag

SEQ ID NO: 27800 - DNA, 20 bp, Artificial Sequence
  Description of Artificial Sequence: Synthetic oligonucleotide
  Target: SCN9A; (-) strand; PAM type: NRG; PAM sequence: CAG
aaagcaaaacaatcatttta

SEQ ID NO: 27801 - DNA, 20 bp, Artificial Sequence
  Description of Artificial Sequence: Synthetic oligonucleotide
  Target: SCN9A; (-) strand; PAM type: NRG; PAM sequence: AAG
attgacacaaacaaacataa

SEQ ID NO: 27802 - DNA, 20 bp, Artificial Sequence
  Description of Artificial Sequence: Synthetic oligonucleotide
  Target: SCN9A; (-) strand; PAM type: NRG; PAM sequence: AAG
aaacaaaatatctgaaatgc

SEQ ID NO: 27803 - DNA, 20 bp, Artificial Sequence
  Description of Artificial Sequence: Synthetic oligonucleotide
  Target: SCN9A; (-) strand; PAM type: NRG; PAM sequence: GAG
tttaaaaaatatttcatctg

SEQ ID NO: 27804 - DNA, 20 bp, Artificial Sequence
  Description of Artificial Sequence: Synthetic oligonucleotide
  Target: SCN9A; (-) strand; PAM type: NRG; PAM sequence: TGG
tttttaaaaaatatttcatc

SEQ ID NO: 27805 - DNA, 20 bp, Artificial Sequence
  Description of Artificial Sequence: Synthetic oligonucleotide
  Target: SCN9A; (-) strand; PAM type: NRG; PAM sequence: AGG
atttagaatggctatgtatt

SEQ ID NO: 27806 - DNA, 20 bp, Artificial Sequence
  Description of Artificial Sequence: Synthetic oligonucleotide
  Target: SCN9A; (-) strand; PAM type: NRG; PAM sequence: TAG
aatttagaatggctatgtat

SEQ ID NO: 27807 - DNA, 20 bp, Artificial Sequence
  Description of Artificial Sequence: Synthetic oligonucleotide
  Target: SCN9A; (-) strand; PAM type: NRG; PAM sequence: TGG
tatcttgaaaaaatttagaa

SEQ ID NO: 27808 - DNA, 20 bp, Artificial Sequence
  Description of Artificial Sequence: Synthetic oligonucleotide
  Target: SCN9A; (-) strand; PAM type: NRG; PAM sequence: TAG
cttcttatcttgaaaaaatt

SEQ ID NO: 27809 - DNA, 20 bp, Artificial Sequence
  Description of Artificial Sequence: Synthetic oligonucleotide
  Target: SCN9A; (-) strand; PAM type: NRG; PAM sequence: AGG
ctatctctccaatgtgcagt

SEQ ID NO: 27810 - DNA, 20 bp, Artificial Sequence
  Description of Artificial Sequence: Synthetic oligonucleotide
  Target: SCN9A; (-) strand; PAM type: NRG; PAM sequence: TAG
gctatctctccaatgtgcag

SEQ ID NO: 27811 - DNA, 20 bp, Artificial Sequence
  Description of Artificial Sequence: Synthetic oligonucleotide
  Target: SCN9A; (-) strand; PAM type: NRG; PAM sequence: CAG
tctgctatctctccaatgtg

SEQ ID NO: 27812 - DNA, 20 bp, Artificial Sequence
  Description of Artificial Sequence: Synthetic oligonucleotide
  Target: SCN9A; (-) strand; PAM type: NRG; PAM sequence: CAG
gaaacggaggctgtctgttt

SEQ ID NO: 27813 - DNA, 20 bp, Artificial Sequence
  Description of Artificial Sequence: Synthetic oligonucleotide
  Target: SCN9A; (-) strand; PAM type: NRG; PAM sequence: AGG
tagctcctaagttgaaacgg

SEQ ID NO: 27814 - DNA, 20 bp, Artificial Sequence
  Description of Artificial Sequence: Synthetic oligonucleotide
  Target: SCN9A; (-) strand; PAM type: NRG; PAM sequence: GAG
gtagctcctaagttgaaacg

SEQ ID NO: 27815 - DNA, 20 bp, Artificial Sequence
  Description of Artificial Sequence: Synthetic oligonucleotide
  Target: SCN9A; (-) strand; PAM type: NRG; PAM sequence: CGG
tggtagctcctaagttgaaa

SEQ ID NO: 27816 - DNA, 20 bp, Artificial Sequence
  Description of Artificial Sequence: Synthetic oligonucleotide
  Target: SCN9A; (-) strand; PAM type: NRG; PAM sequence: AAG
gctaataaatggtagctcct

SEQ ID NO: 27817 - DNA, 20 bp, Artificial Sequence
  Description of Artificial Sequence: Synthetic oligonucleotide
  Target: SCN9A; (-) strand; PAM type: NRG; PAM sequence: TAG
tttactcagctaataaatgg

SEQ ID NO: 27818 - DNA, 20 bp, Artificial Sequence
  Description of Artificial Sequence: Synthetic oligonucleotide
  Target: SCN9A; (-) strand; PAM type: NRG; PAM sequence: TGG
caatttactcagctaataaa

SEQ ID NO: 27819 - DNA, 20 bp, Artificial Sequence
  Description of Artificial Sequence: Synthetic oligonucleotide
  Target: SCN9A; (-) strand; PAM type: NRG; PAM sequence: CAG
gcaacttgccccaatttact

SEQ ID NO: 27820 - DNA, 20 bp, Artificial Sequence
  Description of Artificial Sequence: Synthetic oligonucleotide
  Target: SCN9A; (-) strand; PAM type: NRG; PAM sequence: AAG
aattgaggcatggggaaatg

SEQ ID NO: 27821 - DNA, 20 bp, Artificial Sequence
  Description of Artificial Sequence: Synthetic oligonucleotide
  Target: SCN9A; (-) strand; PAM type: NRG; PAM sequence: GGG
aatgggaaaattgaggcatg

SEQ ID NO: 27822 - DNA, 20 bp, Artificial Sequence
  Description of Artificial Sequence: Synthetic oligonucleotide
  Target: SCN9A; (-) strand; PAM type: NRG; PAM sequence: GGG
aaatgggaaaattgaggcat

SEQ ID NO: 27823 - DNA, 20 bp, Artificial Sequence
  Description of Artificial Sequence: Synthetic oligonucleotide
  Target: SCN9A; (-) strand; PAM type: NRG; PAM sequence: TGG
caaatgggaaaattgaggca

SEQ ID NO: 27824 - DNA, 20 bp, Artificial Sequence
  Description of Artificial Sequence: Synthetic oligonucleotide
  Target: SCN9A; (-) strand; PAM type: NRG; PAM sequence: AGG
ttttacaaatgggaaaattg

SEQ ID NO: 27825 - DNA, 20 bp, Artificial Sequence
  Description of Artificial Sequence: Synthetic oligonucleotide
  Target: SCN9A; (-) strand; PAM type: NRG; PAM sequence: GAG
gttttacaaatgggaaaatt

SEQ ID NO: 27826 - DNA, 20 bp, Artificial Sequence
  Description of Artificial Sequence: Synthetic oligonucleotide
  Target: SCN9A; (-) strand; PAM type: NRG; PAM sequence: GGG
attatctctgttttacaaat

SEQ ID NO: 27827 - DNA, 20 bp, Artificial Sequence
  Description of Artificial Sequence: Synthetic oligonucleotide
  Target: SCN9A; (-) strand; PAM type: NRG; PAM sequence: TGG
tattatctctgttttacaaa

SEQ ID NO: 27828 - DNA, 20 bp, Artificial Sequence
  Description of Artificial Sequence: Synthetic oligonucleotide
  Target: SCN9A; (-) strand; PAM type: NRG; PAM sequence: GAG
agtatttatgacaaccccat

SEQ ID NO: 27829 - DNA, 20 bp, Artificial Sequence
  Description of Artificial Sequence: Synthetic oligonucleotide
  Target: SCN9A; (-) strand; PAM type: NRG; PAM sequence: TAG
aataacagcaaacacatatt

SEQ ID NO: 27830 - DNA, 20 bp, Artificial Sequence
  Description of Artificial Sequence: Synthetic oligonucleotide
  Target: SCN9A; (-) strand; PAM type: NRG; PAM sequence: CAG
cttatttgagttgttaataa

SEQ ID NO: 27831 - DNA, 20 bp, Artificial Sequence
  Description of Artificial Sequence: Synthetic oligonucleotide
  Target: SCN9A; (-) strand; PAM type: NRG; PAM sequence: GAG
tattccaaggaatcttattt

SEQ ID NO: 27832 - DNA, 20 bp, Artificial Sequence
  Description of Artificial Sequence: Synthetic oligonucleotide
  Target: SCN9A; (-) strand; PAM type: NRG; PAM sequence: AGG
cttaatatgtacctattcca

SEQ ID NO: 27833 - DNA, 20 bp, Artificial Sequence
  Description of Artificial Sequence: Synthetic oligonucleotide
  Target: SCN9A; (-) strand; PAM type: NRG; PAM sequence: AAG
gcttaatatgtacctattcc

SEQ ID NO: 27834 - DNA, 20 bp, Artificial Sequence
  Description of Artificial Sequence: Synthetic oligonucleotide
  Target: SCN9A; (-) strand; PAM type: NRG; PAM sequence: CAG
ctgctatctttttcaggtca

SEQ ID NO: 27835 - DNA, 20 bp, Artificial Sequence
  Description of Artificial Sequence: Synthetic oligonucleotide
  Target: SCN9A; (-) strand; PAM type: NRG; PAM sequence: AGG
cagctactgctatctttttc

SEQ ID NO: 27836 - DNA, 20 bp, Artificial Sequence
  Description of Artificial Sequence: Synthetic oligonucleotide
  Target: SCN9A; (-) strand; PAM type: NRG; PAM sequence: CAG
ccagctactgctatcttttt

SEQ ID NO: 27837 - DNA, 20 bp, Artificial Sequence
  Description of Artificial Sequence: Synthetic oligonucleotide
  Target: SCN9A; (-) strand; PAM type: NRG; PAM sequence: CAG
aagaaatttggattacttgc

SEQ ID NO: 27838 - DNA, 20 bp, Artificial Sequence
  Description of Artificial Sequence: Synthetic oligonucleotide
  Target: SCN9A; (-) strand; PAM type: NRG; PAM sequence: TGG
cccatttctatgaagaaatt

SEQ ID NO: 27839 - DNA, 20 bp, Artificial Sequence
  Description of Artificial Sequence: Synthetic oligonucleotide
  Target: SCN9A; (-) strand; PAM type: NRG; PAM sequence: AAG
taatagatcccatttctatg

SEQ ID NO: 27840 - DNA, 20 bp, Artificial Sequence
  Description of Artificial Sequence: Synthetic oligonucleotide
  Target: SCN9A; (-) strand; PAM type: NRG; PAM sequence: TAG
atgctgatattagttaataa

SEQ ID NO: 27841 - DNA, 20 bp, Artificial Sequence
  Description of Artificial Sequence: Synthetic oligonucleotide
  Target: SCN9A; (-) strand; PAM type: NRG; PAM sequence: TAG
tgcaaggataatgctgatat

SEQ ID NO: 27842 - DNA, 20 bp, Artificial Sequence
  Description of Artificial Sequence: Synthetic oligonucleotide
  Target: SCN9A; (-) strand; PAM type: NRG; PAM sequence: AGG
atatcagtacagaaaatgca

SEQ ID NO: 27843 - DNA, 20 bp, Artificial Sequence
  Description of Artificial Sequence: Synthetic oligonucleotide
  Target: SCN9A; (-) strand; PAM type: NRG; PAM sequence: AAG
gatatcagtacagaaaatgc

SEQ ID NO: 27844 - DNA, 20 bp, Artificial Sequence
  Description of Artificial Sequence: Synthetic oligonucleotide
  Target: SCN9A; (-) strand; PAM type: NRG; PAM sequence: CAG
tatatagatagatatcagta

SEQ ID NO: 27845 - DNA, 20 bp, Artificial Sequence
  Description of Artificial Sequence: Synthetic oligonucleotide
  Target: SCN9A; (-) strand; PAM type: NRG; PAM sequence: CAG
atacatatatagatagatat

SEQ ID NO: 27846 - DNA, 20 bp, Artificial Sequence
  Description of Artificial Sequence: Synthetic oligonucleotide
  Target: SCN9A; (-) strand; PAM type: NRG; PAM sequence: TAG
atgacggatacatatataga

SEQ ID NO: 27847 - DNA, 20 bp, Artificial Sequence
  Description of Artificial Sequence: Synthetic oligonucleotide
  Target: SCN9A; (-) strand; PAM type: NRG; PAM sequence: TAG
atttatgacggatacatata

SEQ ID NO: 27848 - DNA, 20 bp, Artificial Sequence
  Description of Artificial Sequence: Synthetic oligonucleotide
  Target: SCN9A; (-) strand; PAM type: NRG; PAM sequence: CGG
ctttagagaacaatttatga

SEQ ID NO: 27849 - DNA, 20 bp, Artificial Sequence
  Description of Artificial Sequence: Synthetic oligonucleotide
  Target: SCN9A; (-) strand; PAM type: NRG; PAM sequence: GAG
gattataaataatctcttta

SEQ ID NO: 27850 - DNA, 20 bp, Artificial Sequence
  Description of Artificial Sequence: Synthetic oligonucleotide
  Target: SCN9A; (-) strand; PAM type: NRG; PAM sequence: TAG
aagattataaataatctctt

SEQ ID NO: 27851 - DNA, 20 bp, Artificial Sequence
  Description of Artificial Sequence: Synthetic oligonucleotide
  Target: SCN9A; (-) strand; PAM type: NRG; PAM sequence: AAG
gtctattaattttataattg

SEQ ID NO: 27852 - DNA, 20 bp, Artificial Sequence
  Description of Artificial Sequence: Synthetic oligonucleotide
  Target: SCN9A; (-) strand; PAM type: NRG; PAM sequence: AGG
aaaatcccatttttgtaaaa

SEQ ID NO: 27853 - DNA, 20 bp, Artificial Sequence
  Description of Artificial Sequence: Synthetic oligonucleotide
  Target: SCN9A; (-) strand; PAM type: NRG; PAM sequence: AAG
taaaatcccatttttgtaaa

SEQ ID NO: 27854 - DNA, 20 bp, Artificial Sequence
  Description of Artificial Sequence: Synthetic oligonucleotide
  Target: SCN9A; (-) strand; PAM type: NRG; PAM sequence: AAG
tgttgtaggcatctaactca

SEQ ID NO: 27855 - DNA, 20 bp, Artificial Sequence
  Description of Artificial Sequence: Synthetic oligonucleotide
  Target: SCN9A; (-) strand; PAM type: NRG; PAM sequence: AGG
atcctcattctatgtgttgt

SEQ ID NO: 27856 - DNA, 20 bp, Artificial Sequence
  Description of Artificial Sequence: Synthetic oligonucleotide
  Target: SCN9A; (-) strand; PAM type: NRG; PAM sequence: TAG
aatcctcattctatgtgttg

SEQ ID NO: 27857 - DNA, 20 bp, Artificial Sequence
  Description of Artificial Sequence: Synthetic oligonucleotide
  Target: SCN9A; (-) strand; PAM type: NRG; PAM sequence: TAG
ggaacacacctttgattcat

SEQ ID NO: 27858 - DNA, 20 bp, Artificial Sequence
  Description of Artificial Sequence: Synthetic oligonucleotide
  Target: SCN9A; (-) strand; PAM type: NRG; PAM sequence: AGG
ttttgcaatactttttctat

SEQ ID NO: 27859 - DNA, 20 bp, Artificial Sequence
  Description of Artificial Sequence: Synthetic oligonucleotide
  Target: SCN9A; (-) strand; PAM type: NRG; PAM sequence: TAG
attttgcaatactttttcta

SEQ ID NO: 27860 - DNA, 20 bp, Artificial Sequence
  Description of Artificial Sequence: Synthetic oligonucleotide
  Target: SCN9A; (-) strand; PAM type: NRG; PAM sequence: TGG
gccttctctggtcttgtgaa

SEQ ID NO: 27861 - DNA, 20 bp, Artificial Sequence
  Description of Artificial Sequence: Synthetic oligonucleotide
  Target: SCN9A; (-) strand; PAM type: NRG; PAM sequence: TGG
ctctgctgaagggccttctc

SEQ ID NO: 27862 - DNA, 20 bp, Artificial Sequence
  Description of Artificial Sequence: Synthetic oligonucleotide
  Target: SCN9A; (-) strand; PAM type: NRG; PAM sequence: GGG
cagtcagtctctctgctgaa

SEQ ID NO: 27863 - DNA, 20 bp, Artificial Sequence
  Description of Artificial Sequence: Synthetic oligonucleotide
  Target: SCN9A; (-) strand; PAM type: NRG; PAM sequence: AGG
tcagtcagtctctctgctga

SEQ ID NO: 27864 - DNA, 20 bp, Artificial Sequence
  Description of Artificial Sequence: Synthetic oligonucleotide
  Target: SCN9A; (-) strand; PAM type: NRG; PAM sequence: AAG
atcagtcagtctctctgctg

SEQ ID NO: 27865 - DNA, 20 bp, Artificial Sequence
  Description of Artificial Sequence: Synthetic oligonucleotide
  Target: SCN9A; (-) strand; PAM type: NRG; PAM sequence: CAG
gcccttgttcctgcatcagt

SEQ ID NO: 27866 - DNA, 20 bp, Artificial Sequence
  Description of Artificial Sequence: Synthetic oligonucleotide
  Target: SCN9A; (-) strand; PAM type: NRG; PAM sequence: CAG
ctgggcccttgttcctgcat

SEQ ID NO: 27867 - DNA, 20 bp, Artificial Sequence
  Description of Artificial Sequence: Synthetic oligonucleotide
  Target: SCN9A; (-) strand; PAM type: NRG; PAM sequence: GGG
tacatagctcaggcatggct

SEQ ID NO: 27868 - DNA, 20 bp, Artificial Sequence
  Description of Artificial Sequence: Synthetic oligonucleotide
  Target: SCN9A; (-) strand; PAM type: NRG; PAM sequence: TGG
ttacatagctcaggcatggc

SEQ ID NO: 27869 - DNA, 20 bp, Artificial Sequence
  Description of Artificial Sequence: Synthetic oligonucleotide
  Target: SCN9A; (-) strand; PAM type: NRG; PAM sequence: TGG
cgttttacatagctcaggca

SEQ ID NO: 27870 - DNA, 20 bp, Artificial Sequence
  Description of Artificial Sequence: Synthetic oligonucleotide
  Target: SCN9A; (-) strand; PAM type: NRG; PAM sequence: AGG
aaggacgttttacatagctc

SEQ ID NO: 27871 - DNA, 20 bp, Artificial Sequence
  Description of Artificial Sequence: Synthetic oligonucleotide
  Target: SCN9A; (-) strand; PAM type: NRG; PAM sequence: CAG
taaggacgttttacatagct

SEQ ID NO: 27872 - DNA, 20 bp, Artificial Sequence
  Description of Artificial Sequence: Synthetic oligonucleotide
  Target: SCN9A; (-) strand; PAM type: NRG; PAM sequence: TAG
cagcgtaaggacgttttaca

SEQ ID NO: 27873 - DNA, 20 bp, Artificial Sequence
  Description of Artificial Sequence: Synthetic oligonucleotide
  Target: SCN9A; (-) strand; PAM type: NRG; PAM sequence: AGG
caacttctgatgacagcgta

SEQ ID NO: 27874 - DNA, 20 bp, Artificial Sequence
  Description of Artificial Sequence: Synthetic oligonucleotide
  Target: SCN9A; (-) strand; PAM type: NRG; PAM sequence: AAG
gcaacttctgatgacagcgt

SEQ ID NO: 27875 - DNA, 20 bp, Artificial Sequence
  Description of Artificial Sequence: Synthetic oligonucleotide
  Target: SCN9A; (-) strand; PAM type: NRG; PAM sequence: CAG
gataaggcaacttctgatga

SEQ ID NO: 27876 - DNA, 20 bp, Artificial Sequence
  Description of Artificial Sequence: Synthetic oligonucleotide
  Target: SCN9A; (-) strand; PAM type: NRG; PAM sequence: AGG
gccagaggtgataatagata

SEQ ID NO: 27877 - DNA, 20 bp, Artificial Sequence
  Description of Artificial Sequence: Synthetic oligonucleotide
  Target: SCN9A; (-) strand; PAM type: NRG; PAM sequence: AAG
tgccagaggtgataatagat

SEQ ID NO: 27878 - DNA, 20 bp, Artificial Sequence
  Description of Artificial Sequence: Synthetic oligonucleotide
  Target: SCN9A; (-) strand; PAM type: NRG; PAM sequence: TAG
gcttctgccagaggtgataa

SEQ ID NO: 27879 - DNA, 20 bp, Artificial Sequence
  Description of Artificial Sequence: Synthetic oligonucleotide
  Target: SCN9A; (-) strand; PAM type: NRG; PAM sequence: AGG
caatggacagcttctgccag

SEQ ID NO: 27880 - DNA, 20 bp, Artificial Sequence
  Description of Artificial Sequence: Synthetic oligonucleotide
  Target: SCN9A; (-) strand; PAM type: NRG; PAM sequence: GAG
ccaatggacagcttctgcca

SEQ ID NO: 27881 - DNA, 20 bp, Artificial Sequence
  Description of Artificial Sequence: Synthetic oligonucleotide
  Target: SCN9A; (-) strand; PAM type: NRG; PAM sequence: CAG
ccccaatggacagcttctgc

SEQ ID NO: 27882 - DNA, 20 bp, Artificial Sequence
  Description of Artificial Sequence: Synthetic oligonucleotide
  Target: SCN9A; (-) strand; PAM type: NRG; PAM sequence: CAG
ccctcatgctccccaatgga

SEQ ID NO: 27883 - DNA, 20 bp, Artificial Sequence
  Description of Artificial Sequence: Synthetic oligonucleotide
  Target: SCN9A; (-) strand; PAM type: NRG; PAM sequence: TGG
tcagccctcatgctccccaa

SEQ ID NO: 27884 - DNA, 20 bp, Artificial Sequence
  Description of Artificial Sequence: Synthetic oligonucleotide
  Target: SCN9A; (-) strand; PAM type: NRG; PAM sequence: CAG
ctccctggttgatggacgct

SEQ ID NO: 27885 - DNA, 20 bp, Artificial Sequence
  Description of Artificial Sequence: Synthetic oligonucleotide
  Target: SCN9A; (-) strand; PAM type: NRG; PAM sequence: TGG
ggtgtggtctccctggttga

SEQ ID NO: 27886 - DNA, 20 bp, Artificial Sequence
  Description of Artificial Sequence: Synthetic oligonucleotide
  Target: SCN9A; (-) strand; PAM type: NRG; PAM sequence: TGG
ctgcaacggtgtggtctccc

SEQ ID NO: 27887 - DNA, 20 bp, Artificial Sequence
  Description of Artificial Sequence: Synthetic oligonucleotide
  Target: SCN9A; (-) strand; PAM type: NRG; PAM sequence: TGG
tgctgtggactgcaacggtg

SEQ ID NO: 27888 - DNA, 20 bp, Artificial Sequence
  Description of Artificial Sequence: Synthetic oligonucleotide
  Target: SCN9A; (-) strand; PAM type: NRG; PAM sequence: CGG
cacagtgctgtggactgcaa

SEQ ID NO: 27889 - DNA, 20 bp, Artificial Sequence
  Description of Artificial Sequence: Synthetic oligonucleotide
  Target: SCN9A; (-) strand; PAM type: NRG; PAM sequence: TGG
cgggaaaatgcacagtgctg

SEQ ID NO: 27890 - DNA, 20 bp, Artificial Sequence
  Description of Artificial Sequence: Synthetic oligonucleotide
  Target: SCN9A; (-) strand; PAM type: NRG; PAM sequence: CAG
ccggtgaacgggaaaatgca

SEQ ID NO: 27891 - DNA, 20 bp, Artificial Sequence
  Description of Artificial Sequence: Synthetic oligonucleotide
  Target: SCN9A; (-) strand; PAM type: NRG; PAM sequence: GGG
caccaatgctgccggtgaac

SEQ ID NO: 27892 - DNA, 20 bp, Artificial Sequence
  Description of Artificial Sequence: Synthetic oligonucleotide
  Target: SCN9A; (-) strand; PAM type: NRG; PAM sequence: CGG
ccaccaatgctgccggtgaa

SEQ ID NO: 27893 - DNA, 20 bp, Artificial Sequence
  Description of Artificial Sequence: Synthetic oligonucleotide
  Target: SCN9A; (-) strand; PAM type: NRG; PAM sequence: CGG
taggtccccaccaatgctgc

SEQ ID NO: 27894 - DNA, 20 bp, Artificial Sequence
  Description of Artificial Sequence: Synthetic oligonucleotide
  Target: SCN9A; (-) strand; PAM type: NRG; PAM sequence: AGG
gtaacatcagccaagccagt

SEQ ID NO: 27895 - DNA, 20 bp, Artificial Sequence
  Description of Artificial Sequence: Synthetic oligonucleotide
  Target: SCN9A; (-) strand; PAM type: NRG; PAM sequence: TAG
agtaacatcagccaagccag

SEQ ID NO: 27896 - DNA, 20 bp, Artificial Sequence
  Description of Artificial Sequence: Synthetic oligonucleotide
  Target: SCN9A; (-) strand; PAM type: NRG; PAM sequence: CAG
agcagtaacatcagccaagc

SEQ ID NO: 27897 - DNA, 20 bp, Artificial Sequence
  Description of Artificial Sequence: Synthetic oligonucleotide
  Target: SCN9A; (-) strand; PAM type: NRG; PAM sequence: AAG
acgcagcagtaacatcagcc

SEQ ID NO: 27898 - DNA, 20 bp, Artificial Sequence
  Description of Artificial Sequence: Synthetic oligonucleotide
  Target: SCN9A; (-) strand; PAM type: NRG; PAM sequence: CAG
gagcgacgcagcagtaacat

SEQ ID NO: 27899 - DNA, 20 bp, Artificial Sequence
  Description of Artificial Sequence: Synthetic oligonucleotide
  Target: SCN9A; (-) strand; PAM type: NRG; PAM sequence: CAG
agaccccaggagcgacgcag

SEQ ID NO: 27900 - DNA, 20 bp, Artificial Sequence
  Description of Artificial Sequence: Synthetic oligonucleotide
  Target: SCN9A; (-) strand; PAM type: NRG; PAM sequence: CAG
cacagaccccaggagcgacg

SEQ ID NO: 27901 - DNA, 20 bp, Artificial Sequence
  Description of Artificial Sequence: Synthetic oligonucleotide
  Target: SCN9A; (-) strand; PAM type: NRG; PAM sequence: GAG
ttgtgccccacagaccccag

SEQ ID NO: 27902 - DNA, 20 bp, Artificial Sequence
  Description of Artificial Sequence: Synthetic oligonucleotide
  Target: SCN9A; (-) strand; PAM type: NRG; PAM sequence: AGG
gtttgtgccccacagacccc

SEQ ID NO: 27903 - DNA, 20 bp, Artificial Sequence
  Description of Artificial Sequence: Synthetic oligonucleotide
  Target: SCN9A; (-) strand; PAM type: NRG; PAM sequence: CAG
tgtttgtgccccacagaccc

SEQ ID NO: 27904 - DNA, 20 bp, Artificial Sequence
  Description of Artificial Sequence: Synthetic oligonucleotide
  Target: SCN9A; (-) strand; PAM type: NRG; PAM sequence: CAG
ggctcactgtttgtgcccca

SEQ ID NO: 27905 - DNA, 20 bp, Artificial Sequence
  Description of Artificial Sequence: Synthetic oligonucleotide
  Target: SCN9A; (-) strand; PAM type: NRG; PAM sequence: GGG
ggagacaatgagagcagaag

SEQ ID NO: 27906 - DNA, 20 bp, Artificial Sequence
  Description of Artificial Sequence: Synthetic oligonucleotide
  Target: SCN9A; (-) strand; PAM type: NRG; PAM sequence: GGG
tggagacaatgagagcagaa

SEQ ID NO: 27907 - DNA, 20 bp, Artificial Sequence
  Description of Artificial Sequence: Synthetic oligonucleotide
  Target: SCN9A; (-) strand; PAM type: NRG; PAM sequence: AGG
ttggagacaatgagagcaga

SEQ ID NO: 27908 - DNA, 20 bp, Artificial Sequence
  Description of Artificial Sequence: Synthetic oligonucleotide
  Target: SCN9A; (-) strand; PAM type: NRG; PAM sequence: AAG
tttggagacaatgagagcag

SEQ ID NO: 27909 - DNA, 20 bp, Artificial Sequence
  Description of Artificial Sequence: Synthetic oligonucleotide
  Target: SCN9A; (-) strand; PAM type: NRG; PAM sequence: CAG
atttttggagacaatgagag

SEQ ID NO: 27910 - DNA, 20 bp, Artificial Sequence
  Description of Artificial Sequence: Synthetic oligonucleotide
  Target: SCN9A; (-) strand; PAM type: NRG; PAM sequence: GAG
agcatttttggagacaatga

SEQ ID NO: 27911 - DNA, 20 bp, Artificial Sequence
  Description of Artificial Sequence: Synthetic oligonucleotide
  Target: SCN9A; (-) strand; PAM type: NRG; PAM sequence: GAG
acagcatttttggagacaat

SEQ ID NO: 27912 - DNA, 20 bp, Artificial Sequence
  Description of Artificial Sequence: Synthetic oligonucleotide
  Target: SCN9A; (-) strand; PAM type: NRG; PAM sequence: GAG
tgatgagcacagcatttttg

SEQ ID NO: 27913 - DNA, 20 bp, Artificial Sequence
  Description of Artificial Sequence: Synthetic oligonucleotide
  Target: SCN9A; (-) strand; PAM type: NRG; PAM sequence: TGG
gatgatgagcacagcatttt

SEQ ID NO: 27914 - DNA, 20 bp, Artificial Sequence
  Description of Artificial Sequence: Synthetic oligonucleotide
  Target: SCN9A; (-) strand; PAM type: NRG; PAM sequence: CAG
gaatttgccgatgatgagca

SEQ ID NO: 27915 - DNA, 20 bp, Artificial Sequence
  Description of Artificial Sequence: Synthetic oligonucleotide
  Target: SCN9A; (-) strand; PAM type: NRG; PAM sequence: GAG
agactgaatttgccgatgat

SEQ ID NO: 27916 - DNA, 20 bp, Artificial Sequence
  Description of Artificial Sequence: Synthetic oligonucleotide
  Target: SCN9A; (-) strand; PAM type: NRG; PAM sequence: GAG
gaggaagagatataggatct

SEQ ID NO: 27917 - DNA, 20 bp, Artificial Sequence
  Description of Artificial Sequence: Synthetic oligonucleotide
  Target: SCN9A; (-) strand; PAM type: NRG; PAM sequence: AGG
aaaggcagaggaagagatat

SEQ ID NO: 27918 - DNA, 20 bp, Artificial Sequence
  Description of Artificial Sequence: Synthetic oligonucleotide
  Target: SCN9A; (-) strand; PAM type: NRG; PAM sequence: TAG
caaaggcagaggaagagata

SEQ ID NO: 27919 - DNA, 20 bp, Artificial Sequence
  Description of Artificial Sequence: Synthetic oligonucleotide
  Target: SCN9A; (-) strand; PAM type: NRG; PAM sequence: GAG
tagtttcaaaggcagaggaa

SEQ ID NO: 27920 - DNA, 20 bp, Artificial Sequence
  Description of Artificial Sequence: Synthetic oligonucleotide
  Target: SCN9A; (-) strand; PAM type: NRG; PAM sequence: AAG
tttagtttcaaaggcagagg

SEQ ID NO: 27921 - DNA, 20 bp, Artificial Sequence
  Description of Artificial Sequence: Synthetic oligonucleotide
  Target: SCN9A; (-) strand; PAM type: NRG; PAM sequence: AGG
ctttttagtttcaaaggcag

SEQ ID NO: 27922 - DNA, 20 bp, Artificial Sequence
  Description of Artificial Sequence: Synthetic oligonucleotide
  Target: SCN9A; (-) strand; PAM type: NRG; PAM sequence: GAG
tctttttagtttcaaaggca

SEQ ID NO: 27923 - DNA, 20 bp, Artificial Sequence
  Description of Artificial Sequence: Synthetic oligonucleotide
  Target: SCN9A; (-) strand; PAM type: NRG; PAM sequence: CAG
agtctttttagtttcaaagg

SEQ ID NO: 27924 - DNA, 20 bp, Artificial Sequence
  Description of Artificial Sequence: Synthetic oligonucleotide
  Target: SCN9A; (-) strand; PAM type: NRG; PAM sequence: AGG
acaagtctttttagtttcaa

SEQ ID NO: 27925 - DNA, 20 bp, Artificial Sequence
  Description of Artificial Sequence: Synthetic oligonucleotide
  Target: SCN9A; (-) strand; PAM type: NRG; PAM sequence: AAG
aacaagtctttttagtttca

SEQ ID NO: 27926 - DNA, 20 bp, Artificial Sequence
  Description of Artificial Sequence: Synthetic oligonucleotide
  Target: SCN9A; (-) strand; PAM type: NRG; PAM sequence: TAG
agcagcagaacaagtctttt

SEQ ID NO: 27927 - DNA, 20 bp, Artificial Sequence
  Description of Artificial Sequence: Synthetic oligonucleotide
  Target: SCN9A; (-) strand; PAM type: NRG; PAM sequence: AAG
gcaaggcgaagcagcagaac

SEQ ID NO: 27928 - DNA, 20 bp, Artificial Sequence
  Description of Artificial Sequence: Synthetic oligonucleotide
  Target: SCN9A; (-) strand; PAM type: NRG; PAM sequence: CAG
ttttctgcaaggcgaagcag

SEQ ID NO: 27929 - DNA, 20 bp, Artificial Sequence
  Description of Artificial Sequence: Synthetic oligonucleotide
  Target: SCN9A; (-) strand; PAM type: NRG; PAM sequence: CAG
ttgttttctgcaaggcgaag

SEQ ID NO: 27930 - DNA, 20 bp, Artificial Sequence
  Description of Artificial Sequence: Synthetic oligonucleotide
  Target: SCN9A; (-) strand; PAM type: NRG; PAM sequence: AAG
tccttgttttctgcaaggcg

SEQ ID NO: 27931 - DNA, 20 bp, Artificial Sequence
  Description of Artificial Sequence: Synthetic oligonucleotide
  Target: SCN9A; (-) strand; PAM type: NRG; PAM sequence: AGG
gtggctccttgttttctgca

SEQ ID NO: 27932 - DNA, 20 bp, Artificial Sequence
  Description of Artificial Sequence: Synthetic oligonucleotide
  Target: SCN9A; (-) strand; PAM type: NRG; PAM sequence: AAG
cgtggctccttgttttctgc

SEQ ID NO: 27933 - DNA, 20 bp, Artificial Sequence
  Description of Artificial Sequence: Synthetic oligonucleotide
  Target: SCN9A; (-) strand; PAM type: NRG; PAM sequence: TGG
cagtcaccactcagcattcg

SEQ ID NO: 27934 - DNA, 20 bp, Artificial Sequence
  Description of Artificial Sequence: Synthetic oligonucleotide
  Target: SCN9A; (-) strand; PAM type: NRG; PAM sequence: CAG
atttttctgcagtcaccact

SEQ ID NO: 27935 - DNA, 20 bp, Artificial Sequence
  Description of Artificial Sequence: Synthetic oligonucleotide
  Target: SCN9A; (-) strand; PAM type: NRG; PAM sequence: CAG
cgttttttttaatttttctg

SEQ ID NO: 27936 - DNA, 20 bp, Artificial Sequence
  Description of Artificial Sequence: Synthetic oligonucleotide
  Target: SCN9A; (-) strand; PAM type: NRG; PAM sequence: CAG
acttctatcagtaggtgctt

SEQ ID NO: 27937 - DNA, 20 bp, Artificial Sequence
  Description of Artificial Sequence: Synthetic oligonucleotide
  Target: SCN9A; (-) strand; PAM type: NRG; PAM sequence: AGG
tgaagtgtacttctatcagt

SEQ ID NO: 27938 - DNA, 20 bp, Artificial Sequence
  Description of Artificial Sequence: Synthetic oligonucleotide
  Target: SCN9A; (-) strand; PAM type: NRG; PAM sequence: TAG
atgaagtgtacttctatcag

SEQ ID NO: 27939 - DNA, 20 bp, Artificial Sequence
  Description of Artificial Sequence: Synthetic oligonucleotide
  Target: SCN9A; (-) strand; PAM type: NRG; PAM sequence: CAG
tatatgaagtgtacttctat

SEQ ID NO: 27940 - DNA, 20 bp, Artificial Sequence
  Description of Artificial Sequence: Synthetic oligonucleotide
  Target: SCN9A; (-) strand; PAM type: NRG; PAM sequence: AAG
ggttcagtggtatttatatg

SEQ ID NO: 27941 - DNA, 20 bp, Artificial Sequence
  Description of Artificial Sequence: Synthetic oligonucleotide
  Target: SCN9A; (-) strand; PAM type: NRG; PAM sequence: TGG
cctcaggccagtgggttcag

SEQ ID NO: 27942 - DNA, 20 bp, Artificial Sequence
  Description of Artificial Sequence: Synthetic oligonucleotide
  Target: SCN9A; (-) strand; PAM type: NRG; PAM sequence: CAG
tgccctcaggccagtgggtt

SEQ ID NO: 27943 - DNA, 20 bp, Artificial Sequence
  Description of Artificial Sequence: Synthetic oligonucleotide
  Target: SCN9A; (-) strand; PAM type: NRG; PAM sequence: GGG
ccacctgccctcaggccagt

SEQ ID NO: 27944 - DNA, 20 bp, Artificial Sequence
  Description of Artificial Sequence: Synthetic oligonucleotide
  Target: SCN9A; (-) strand; PAM type: NRG; PAM sequence: TGG
gccacctgccctcaggccag

SEQ ID NO: 27945 - DNA, 20 bp, Artificial Sequence
  Description of Artificial Sequence: Synthetic oligonucleotide
  Target: SCN9A; (-) strand; PAM type: NRG; PAM sequence: CAG
agagccacctgccctcaggc

SEQ ID NO: 27946 - DNA, 20 bp, Artificial Sequence
  Description of Artificial Sequence: Synthetic oligonucleotide
  Target: SCN9A; (-) strand; PAM type: NRG; PAM sequence: AGG
gtacagagccacctgccctc

SEQ ID NO: 27947 - DNA, 20 bp, Artificial Sequence
  Description of Artificial Sequence: Synthetic oligonucleotide
  Target: SCN9A; (-) strand; PAM type: NRG; PAM sequence: CAG
agtacagagccacctgccct

SEQ ID NO: 27948 - DNA, 20 bp, Artificial Sequence
  Description of Artificial Sequence: Synthetic oligonucleotide
  Target: SCN9A; (-) strand; PAM type: NRG; PAM sequence: GAG
gtttcttttaagtcagtaca

SEQ ID NO: 27949 - DNA, 20 bp, Artificial Sequence
  Description of Artificial Sequence: Synthetic oligonucleotide
  Target: SCN9A; (-) strand; PAM type: NRG; PAM sequence: CAG
atgtttcttttaagtcagta

SEQ ID NO: 27950 - DNA, 20 bp, Artificial Sequence
  Description of Artificial Sequence: Synthetic oligonucleotide
  Target: SCN9A; (-) strand; PAM type: NRG; PAM sequence: CAG
taagtatgtttcttttaagt

SEQ ID NO: 27951 - DNA, 20 bp, Artificial Sequence
  Description of Artificial Sequence: Synthetic oligonucleotide
  Target: SCN9A; (-) strand; PAM type: NRG; PAM sequence: AAG
tttttaagtatgtttctttt

SEQ ID NO: 27952 - DNA, 20 bp, Artificial Sequence
  Description of Artificial Sequence: Synthetic oligonucleotide
  Target: SCN9A; (-) strand; PAM type: NRG; PAM sequence: AAG
cactgaattgcttcgttttt

SEQ ID NO: 27953 - DNA, 20 bp, Artificial Sequence
  Description of Artificial Sequence: Synthetic oligonucleotide
  Target: SCN9A; (-) strand; PAM type: NRG; PAM sequence: AAG
tttcatcccttaagtggaag

SEQ ID NO: 27954 - DNA, 20 bp, Artificial Sequence
  Description of Artificial Sequence: Synthetic oligonucleotide
  Target: SCN9A; (-) strand; PAM type: NRG; PAM sequence: AAG
ttgtttcatcccttaagtgg

SEQ ID NO: 27955 - DNA, 20 bp, Artificial Sequence
  Description of Artificial Sequence: Synthetic oligonucleotide
  Target: SCN9A; (-) strand; PAM type: NRG; PAM sequence: TGG
aaattgtttcatcccttaag

SEQ ID NO: 27956 - DNA, 20 bp, Artificial Sequence
  Description of Artificial Sequence: Synthetic oligonucleotide
  Target: SCN9A; (-) strand; PAM type: NRG; PAM sequence: AAG
tacaaattgtttcatccctt

SEQ ID NO: 27957 - DNA, 20 bp, Artificial Sequence
  Description of Artificial Sequence: Synthetic oligonucleotide
  Target: SCN9A; (-) strand; PAM type: NRG; PAM sequence: AGG
ataatttacctggtcctgaa

SEQ ID NO: 27958 - DNA, 20 bp, Artificial Sequence
  Description of Artificial Sequence: Synthetic oligonucleotide
  Target: SCN9A; (-) strand; PAM type: NRG; PAM sequence: AAG
aataatttacctggtcctga

SEQ ID NO: 27959 - DNA, 20 bp, Artificial Sequence
  Description of Artificial Sequence: Synthetic oligonucleotide
  Target: SCN9A; (-) strand; PAM type: NRG; PAM sequence: TGG
atagcaacaaataatttacc

SEQ ID NO: 27960 - DNA, 20 bp, Artificial Sequence
  Description of Artificial Sequence: Synthetic oligonucleotide
  Target: SCN9A; (-) strand; PAM type: NRG; PAM sequence: TAG
cagaatattagagagctgta

SEQ ID NO: 27961 - DNA, 20 bp, Artificial Sequence
  Description of Artificial Sequence: Synthetic oligonucleotide
  Target: SCN9A; (-) strand; PAM type: NRG; PAM sequence: GAG
ctctaggccagaatattaga

SEQ ID NO: 27962 - DNA, 20 bp, Artificial Sequence
  Description of Artificial Sequence: Synthetic oligonucleotide
  Target: SCN9A; (-) strand; PAM type: NRG; PAM sequence: GAG
aactctaggccagaatatta

SEQ ID NO: 27963 - DNA, 20 bp, Artificial Sequence
  Description of Artificial Sequence: Synthetic oligonucleotide
  Target: SCN9A; (-) strand; PAM type: NRG; PAM sequence: TAG
gtaactctaggccagaatat

SEQ ID NO: 27964 - DNA, 20 bp, Artificial Sequence
  Description of Artificial Sequence: Synthetic oligonucleotide
  Target: SCN9A; (-) strand; PAM type: NRG; PAM sequence: CAG
atggagcagtaactctaggc

SEQ ID NO: 27965 - DNA, 20 bp, Artificial Sequence
  Description of Artificial Sequence: Synthetic oligonucleotide
  Target: SCN9A; (-) strand; PAM type: NRG; PAM sequence: AGG
aagaatggagcagtaactct

SEQ ID NO: 27966 - DNA, 20 bp, Artificial Sequence
  Description of Artificial Sequence: Synthetic oligonucleotide
  Target: SCN9A; (-) strand; PAM type: NRG; PAM sequence: TAG
aaagaatggagcagtaactc

SEQ ID NO: 27967 - DNA, 20 bp, Artificial Sequence
  Description of Artificial Sequence: Synthetic oligonucleotide
  Target: SCN9A; (-) strand; PAM type: NRG; PAM sequence: CAG
atggcattaaaagaatggag

SEQ ID NO: 27968 - DNA, 20 bp, Artificial Sequence
  Description of Artificial Sequence: Synthetic oligonucleotide
  Target: SCN9A; (-) strand; PAM type: NRG; PAM sequence: GAG
tgaatggcattaaaagaatg

SEQ ID NO: 27969 - DNA, 20 bp, Artificial Sequence
  Description of Artificial Sequence: Synthetic oligonucleotide
  Target: SCN9A; (-) strand; PAM type: NRG; PAM sequence: TGG
aatgaatggcattaaaagaa

SEQ ID NO: 27970 - DNA, 20 bp, Artificial Sequence
  Description of Artificial Sequence: Synthetic oligonucleotide
  Target: SCN9A; (-) strand; PAM type: NRG; PAM sequence: AAG
agcaaaatgaatggcattaa

SEQ ID NO: 27971 - DNA, 20 bp, Artificial Sequence
  Description of Artificial Sequence: Synthetic oligonucleotide
  Target: SCN9A; (-) strand; PAM type: NRG; PAM sequence: TGG
gttctgtgcagcaaaatgaa

SEQ ID NO: 27972 - DNA, 20 bp, Artificial Sequence
  Description of Artificial Sequence: Synthetic oligonucleotide
  Target: SCN9A; (-) strand; PAM type: NRG; PAM sequence: CAG
tttaagttataagttctgtg

SEQ ID NO: 27973 - DNA, 20 bp, Artificial Sequence
  Description of Artificial Sequence: Synthetic oligonucleotide
  Target: SCN9A; (-) strand; PAM type: NRG; PAM sequence: AAG
aagttctttttttaagttat

SEQ ID NO: 27974 - DNA, 20 bp, Artificial Sequence
  Description of Artificial Sequence: Synthetic oligonucleotide
  Target: SCN9A; (-) strand; PAM type: NRG; PAM sequence: AAG
caatactaagttcttttttt

SEQ ID NO: 27975 - DNA, 20 bp, Artificial Sequence
  Description of Artificial Sequence: Synthetic oligonucleotide
  Target: SCN9A; (-) strand; PAM type: NRG; PAM sequence: AAG
gaatgaccagtagcaatact

SEQ ID NO: 27976 - DNA, 20 bp, Artificial Sequence
  Description of Artificial Sequence: Synthetic oligonucleotide
  Target: SCN9A; (-) strand; PAM type: NRG; PAM sequence: TAG
ataaaaagttgaatgaccag

SEQ ID NO: 27977 - DNA, 20 bp, Artificial Sequence
  Description of Artificial Sequence: Synthetic oligonucleotide
  Target: SCN9A; (-) strand; PAM type: NRG; PAM sequence: CAG
tatataaaaagttgaatgac

SEQ ID NO: 27978 - DNA, 20 bp, Artificial Sequence
  Description of Artificial Sequence: Synthetic oligonucleotide
  Target: SCN9A; (-) strand; PAM type: NRG; PAM sequence: AAG
cctggggattgatatataaa

SEQ ID NO: 27979 - DNA, 20 bp, Artificial Sequence
  Description of Artificial Sequence: Synthetic oligonucleotide
  Target: SCN9A; (-) strand; PAM type: NRG; PAM sequence: GGG
caatttttttgtgaagcctg

SEQ ID NO: 27980 - DNA, 20 bp, Artificial Sequence
  Description of Artificial Sequence: Synthetic oligonucleotide
  Target: SCN9A; (-) strand; PAM type: NRG; PAM sequence: GGG
ccaatttttttgtgaagcct

SEQ ID NO: 27981 - DNA, 20 bp, Artificial Sequence
  Description of Artificial Sequence: Synthetic oligonucleotide
  Target: SCN9A; (-) strand; PAM type: NRG; PAM sequence: TGG
tccaatttttttgtgaagcc

SEQ ID NO: 27982 - DNA, 20 bp, Artificial Sequence
  Description of Artificial Sequence: Synthetic oligonucleotide
  Target: SCN9A; (-) strand; PAM type: NRG; PAM sequence: AAG
tgatttccaatttttttgtg

SEQ ID NO: 27983 - DNA, 20 bp, Artificial Sequence
  Description of Artificial Sequence: Synthetic oligonucleotide
  Target: SCN9A; (-) strand; PAM type: NRG; PAM sequence: CAG
tttcaatgcaaagaaccata

SEQ ID NO: 27984 - DNA, 20 bp, Artificial Sequence
  Description of Artificial Sequence: Synthetic oligonucleotide
  Target: SCN9A; (-) strand; PAM type: NRG; PAM sequence: AAG
taaggtggattttcaatgca

SEQ ID NO: 27985 - DNA, 20 bp, Artificial Sequence
  Description of Artificial Sequence: Synthetic oligonucleotide
  Target: SCN9A; (-) strand; PAM type: NRG; PAM sequence: TGG
tgagctcttagtatgtaagg

SEQ ID NO: 27986 - DNA, 20 bp, Artificial Sequence
  Description of Artificial Sequence: Synthetic oligonucleotide
  Target: SCN9A; (-) strand; PAM type: NRG; PAM sequence: AGG
aactgagctcttagtatgta

SEQ ID NO: 27987 - DNA, 20 bp, Artificial Sequence
  Description of Artificial Sequence: Synthetic oligonucleotide
  Target: SCN9A; (-) strand; PAM type: NRG; PAM sequence: AAG
taactgagctcttagtatgt

SEQ ID NO: 27988 - DNA, 20 bp, Artificial Sequence
  Description of Artificial Sequence: Synthetic oligonucleotide
  Target: SCN9A; (-) strand; PAM type: NRG; PAM sequence: TAG
atacactttaactgagctct

SEQ ID NO: 27989 - DNA, 20 bp, Artificial Sequence
  Description of Artificial Sequence: Synthetic oligonucleotide
  Target: SCN9A; (-) strand; PAM type: NRG; PAM sequence: GAG
tctttaaatacactttaact

SEQ ID NO: 27990 - DNA, 20 bp, Artificial Sequence
  Description of Artificial Sequence: Synthetic oligonucleotide
  Target: SCN9A; (-) strand; PAM type: NRG; PAM sequence: AAG
tataaattaactggtgctaa

SEQ ID NO: 27991 - DNA, 20 bp, Artificial Sequence
  Description of Artificial Sequence: Synthetic oligonucleotide
  Target: SCN9A; (-) strand; PAM type: NRG; PAM sequence: TGG
taatgactttataaattaac

SEQ ID NO: 27992 - DNA, 20 bp, Artificial Sequence
  Description of Artificial Sequence: Synthetic oligonucleotide
  Target: SCN9A; (-) strand; PAM type: NRG; PAM sequence: GGG
ttttcctcctctttggtatt

SEQ ID NO: 27993 - DNA, 20 bp, Artificial Sequence
  Description of Artificial Sequence: Synthetic oligonucleotide
  Target: SCN9A; (-) strand; PAM type: NRG; PAM sequence: TGG
tttttcctcctctttggtat

SEQ ID NO: 27994 - DNA, 20 bp, Artificial Sequence
  Description of Artificial Sequence: Synthetic oligonucleotide
  Target: SCN9A; (-) strand; PAM type: NRG; PAM sequence: TGG
attgaatttttcctcctctt

SEQ ID NO: 27995 - DNA, 20 bp, Artificial Sequence
  Description of Artificial Sequence: Synthetic oligonucleotide
  Target: SCN9A; (-) strand; PAM type: NRG; PAM sequence: AAG
accctggacatgagtcatat

SEQ ID NO: 27996 - DNA, 20 bp, Artificial Sequence
  Description of Artificial Sequence: Synthetic oligonucleotide
  Target: SCN9A; (-) strand; PAM type: NRG; PAM sequence: GAG
aggatttacaccctggacat

SEQ ID NO: 27997 - DNA, 20 bp, Artificial Sequence
  Description of Artificial Sequence: Synthetic oligonucleotide
  Target: SCN9A; (-) strand; PAM type: NRG; PAM sequence: TGG
cttccaaaggatttacaccc

SEQ ID NO: 27998 - DNA, 20 bp, Artificial Sequence
  Description of Artificial Sequence: Synthetic oligonucleotide
  Target: SCN9A; (-) strand; PAM type: NRG; PAM sequence: AGG
attgaactagatccttccaa

SEQ ID NO: 27999 - DNA, 20 bp, Artificial Sequence
  Description of Artificial Sequence: Synthetic oligonucleotide
  Target: SCN9A; (-) strand; PAM type: NRG; PAM sequence: AAG
tattgaactagatccttcca

SEQ ID NO: 28000 - DNA, 20 bp, Artificial Sequence
  Description of Artificial Sequence: Synthetic oligonucleotide
  Target: SCN9A; (-) strand; PAM type: NRG; PAM sequence: TAG
agcactaatgtctattgaac

SEQ ID NO: 28001 - DNA, 20 bp, Artificial Sequence
  Description of Artificial Sequence: Synthetic oligonucleotide
  Target: SCN9A; (-) strand; PAM type: NRG; PAM sequence: AAG
cactttgttctttacatagt

SEQ ID NO: 28002 - DNA, 20 bp, Artificial Sequence
  Description of Artificial Sequence: Synthetic oligonucleotide
  Target: SCN9A; (-) strand; PAM type: NRG; PAM sequence: TAG
ttgccactttgttctttaca

SEQ ID NO: 28003 - DNA, 20 bp, Artificial Sequence
  Description of Artificial Sequence: Synthetic oligonucleotide
  Target: SCN9A; (-) strand; PAM type: NRG; PAM sequence: TAG
actttttccattgttcacaa

SEQ ID NO: 28004 - DNA, 20 bp, Artificial Sequence
  Description of Artificial Sequence: Synthetic oligonucleotide
  Target: SCN9A; (-) strand; PAM type: NRG; PAM sequence: AAG
tccaagctggttttgaggca

SEQ ID NO: 28005 - DNA, 20 bp, Artificial Sequence
  Description of Artificial Sequence: Synthetic oligonucleotide
  Target: SCN9A; (-) strand; PAM type: NRG; PAM sequence: AGG
agcagtccaagctggttttg

SEQ ID NO: 28006 - DNA, 20 bp, Artificial Sequence
  Description of Artificial Sequence: Synthetic oligonucleotide
  Target: SCN9A; (-) strand; PAM type: NRG; PAM sequence: GAG
gagcagtccaagctggtttt

SEQ ID NO: 28007 - DNA, 20 bp, Artificial Sequence
  Description of Artificial Sequence: Synthetic oligonucleotide
  Target: SCN9A; (-) strand; PAM type: NRG; PAM sequence: TGG
atgacaggagcagtccaagc

SEQ ID NO: 28008 - DNA, 20 bp, Artificial Sequence
  Description of Artificial Sequence: Synthetic oligonucleotide
  Target: SCN9A; (-) strand; PAM type: NRG; PAM sequence: AAG
aaatatgacaggagcagtcc

SEQ ID NO: 28009 - DNA, 20 bp, Artificial Sequence
  Description of Artificial Sequence: Synthetic oligonucleotide
  Target: SCN9A; (-) strand; PAM type: NRG; PAM sequence: CAG
aaaaataaatatgacaggag

SEQ ID NO: 28010 - DNA, 20 bp, Artificial Sequence
  Description of Artificial Sequence: Synthetic oligonucleotide
  Target: SCN9A; (-) strand; PAM type: NRG; PAM sequence: GAG
aataaaaataaatatgacag

SEQ ID NO: 28011 - DNA, 20 bp, Artificial Sequence
  Description of Artificial Sequence: Synthetic oligonucleotide
  Target: SCN9A; (-) strand; PAM type: NRG; PAM sequence: AGG
tcaataaaaataaatatgac

SEQ ID NO: 28012 - DNA, 20 bp, Artificial Sequence
  Description of Artificial Sequence: Synthetic oligonucleotide
  Target: SCN9A; (-) strand; PAM type: NRG; PAM sequence: CAG
atcaataaaaataaatatga

SEQ ID NO: 28013 - DNA, 20 bp, Artificial Sequence
  Description of Artificial Sequence: Synthetic oligonucleotide
  Target: SCN9A; (-) strand; PAM type: NRG; PAM sequence: TGG
ctaggtgatgatacagaact

SEQ ID NO: 28014 - DNA, 20 bp, Artificial Sequence
  Description of Artificial Sequence: Synthetic oligonucleotide
  Target: SCN9A; (-) strand; PAM type: NRG; PAM sequence: CAG
cttgaacctaggtgatgata

SEQ ID NO: 28015 - DNA, 20 bp, Artificial Sequence
  Description of Artificial Sequence: Synthetic oligonucleotide
  Target: SCN9A; (-) strand; PAM type: NRG; PAM sequence: AGG
tcaaaatttcacttgaacct

SEQ ID NO: 28016 - DNA, 20 bp, Artificial Sequence
  Description of Artificial Sequence: Synthetic oligonucleotide
  Target: SCN9A; (-) strand; PAM type: NRG; PAM sequence: TAG
ttcaaaatttcacttgaacc

SEQ ID NO: 28017 - DNA, 20 bp, Artificial Sequence
  Description of Artificial Sequence: Synthetic oligonucleotide
  Target: SCN9A; (-) strand; PAM type: NRG; PAM sequence: GAG
atacacagtaaaaaaagata

SEQ ID NO: 28018 - DNA, 20 bp, Artificial Sequence
  Description of Artificial Sequence: Synthetic oligonucleotide
  Target: SCN9A; (-) strand; PAM type: NRG; PAM sequence: TAG
atatacacagtaaaaaaaga

SEQ ID NO: 28019 - DNA, 20 bp, Artificial Sequence
  Description of Artificial Sequence: Synthetic oligonucleotide
  Target: SCN9A; (-) strand; PAM type: NRG; PAM sequence: AAG
cctgatatacacagtaaaaa

SEQ ID NO: 28020 - DNA, 20 bp, Artificial Sequence
  Description of Artificial Sequence: Synthetic oligonucleotide
  Target: SCN9A; (-) strand; PAM type: NRG; PAM sequence: CAG
caagattctcctgatataca

SEQ ID NO: 28021 - DNA, 20 bp, Artificial Sequence
  Description of Artificial Sequence: Synthetic oligonucleotide
  Target: SCN9A; (-) strand; PAM type: NRG; PAM sequence: AAG
aaatctagttaaaaatctac

SEQ ID NO: 28022 - DNA, 20 bp, Artificial Sequence
  Description of Artificial Sequence: Synthetic oligonucleotide
  Target: SCN9A; (-) strand; PAM type: NRG; PAM sequence: TAG
acttttctaaactaaaaatc

SEQ ID NO: 28023 - DNA, 20 bp, Artificial Sequence
  Description of Artificial Sequence: Synthetic oligonucleotide
  Target: SCN9A; (-) strand; PAM type: NRG; PAM sequence: AGG
ccattgcttctgttttcctt

SEQ ID NO: 28024 - DNA, 20 bp, Artificial Sequence
  Description of Artificial Sequence: Synthetic oligonucleotide
  Target: SCN9A; (-) strand; PAM type: NRG; PAM sequence: TAG
accattgcttctgttttcct

SEQ ID NO: 28025 - DNA, 20 bp, Artificial Sequence
  Description of Artificial Sequence: Synthetic oligonucleotide
  Target: SCN9A; (-) strand; PAM type: NRG; PAM sequence: AAG
ataattctgcacaaatcccc

SEQ ID NO: 28026 - DNA, 20 bp, Artificial Sequence
  Description of Artificial Sequence: Synthetic oligonucleotide
  Target: SCN9A; (-) strand; PAM type: NRG; PAM sequence: AGG
cactgaaaccttcatctctc

SEQ ID NO: 28027 - DNA, 20 bp, Artificial Sequence
  Description of Artificial Sequence: Synthetic oligonucleotide
  Target: SCN9A; (-) strand; PAM type: NRG; PAM sequence: CAG
tcactgaaaccttcatctct

SEQ ID NO: 28028 - DNA, 20 bp, Artificial Sequence
  Description of Artificial Sequence: Synthetic oligonucleotide
  Target: SCN9A; (-) strand; PAM type: NRG; PAM sequence: AAG
tgttaattctgtttatgtgg

SEQ ID NO: 28029 - DNA, 20 bp, Artificial Sequence
  Description of Artificial Sequence: Synthetic oligonucleotide
  Target: SCN9A; (-) strand; PAM type: NRG; PAM sequence: TGG
gtctgttaattctgtttatg

SEQ ID NO: 28030 - DNA, 20 bp, Artificial Sequence
  Description of Artificial Sequence: Synthetic oligonucleotide
  Target: SCN9A; (-) strand; PAM type: NRG; PAM sequence: TAG
actactaatatgtagtgcca

SEQ ID NO: 28031 - DNA, 20 bp, Artificial Sequence
  Description of Artificial Sequence: Synthetic oligonucleotide
  Target: SCN9A; (-) strand; PAM type: NRG; PAM sequence: TAG
ccacatcaactactaatatg

SEQ ID NO: 28032 - DNA, 20 bp, Artificial Sequence
  Description of Artificial Sequence: Synthetic oligonucleotide
  Target: SCN9A; (-) strand; PAM type: NRG; PAM sequence: AAG
acccatttggaactttggag

SEQ ID NO: 28033 - DNA, 20 bp, Artificial Sequence
  Description of Artificial Sequence: Synthetic oligonucleotide
  Target: SCN9A; (-) strand; PAM type: NRG; PAM sequence: GAG
ctcacccatttggaactttg

SEQ ID NO: 28034 - DNA, 20 bp, Artificial Sequence
  Description of Artificial Sequence: Synthetic oligonucleotide
  Target: SCN9A; (-) strand; PAM type: NRG; PAM sequence: TGG
cactcacccatttggaactt

SEQ ID NO: 28035 - DNA, 20 bp, Artificial Sequence
  Description of Artificial Sequence: Synthetic oligonucleotide
  Target: SCN9A; (-) strand; PAM type: NRG; PAM sequence: TGG
aatagtatcactcacccatt

SEQ ID NO: 28036 - DNA, 20 bp, Artificial Sequence
  Description of Artificial Sequence: Synthetic oligonucleotide
  Target: SCN9A; (-) strand; PAM type: NRG; PAM sequence: TAG
ttcttaaacagtataggtaa

SEQ ID NO: 28037 - DNA, 20 bp, Artificial Sequence
  Description of Artificial Sequence: Synthetic oligonucleotide
  Target: SCN9A; (-) strand; PAM type: NRG; PAM sequence: AGG
tcttctttcttaaacagtat

SEQ ID NO: 28038 - DNA, 20 bp, Artificial Sequence
  Description of Artificial Sequence: Synthetic oligonucleotide
  Target: SCN9A; (-) strand; PAM type: NRG; PAM sequence: TAG
ctcttctttcttaaacagta

SEQ ID NO: 28039 - DNA, 20 bp, Artificial Sequence
  Description of Artificial Sequence: Synthetic oligonucleotide
  Target: SCN9A; (-) strand; PAM type: NRG; PAM sequence: CAG
agtttctcttctttcttaaa

SEQ ID NO: 28040 - DNA, 20 bp, Artificial Sequence
  Description of Artificial Sequence: Synthetic oligonucleotide
  Target: SCN9A; (-) strand; PAM type: NRG; PAM sequence: TAG
gttaaaaactaatcttagac

SEQ ID NO: 28041 - DNA, 20 bp, Artificial Sequence
  Description of Artificial Sequence: Synthetic oligonucleotide
  Target: SCN9A; (-) strand; PAM type: NRG; PAM sequence: TAG
cattggttaaaaactaatct

SEQ ID NO: 28042 - DNA, 20 bp, Artificial Sequence
  Description of Artificial Sequence: Synthetic oligonucleotide
  Target: SCN9A; (-) strand; PAM type: NRG; PAM sequence: TGG
tgtgttttgtaatgcttcat

SEQ ID NO: 28043 - DNA, 20 bp, Artificial Sequence
  Description of Artificial Sequence: Synthetic oligonucleotide
  Target: SCN9A; (-) strand; PAM type: NRG; PAM sequence: TAG
ataacttttatatttgtatt

SEQ ID NO: 28044 - DNA, 20 bp, Artificial Sequence
  Description of Artificial Sequence: Synthetic oligonucleotide
  Target: SCN9A; (-) strand; PAM type: NRG; PAM sequence: TAG
taaagagaccattcacacta

SEQ ID NO: 28045 - DNA, 20 bp, Artificial Sequence
  Description of Artificial Sequence: Synthetic oligonucleotide
  Target: SCN9A; (-) strand; PAM type: NRG; PAM sequence: GAG
agaaccattgtagaaataaa

SEQ ID NO: 28046 - DNA, 20 bp, Artificial Sequence
  Description of Artificial Sequence: Synthetic oligonucleotide
  Target: SCN9A; (-) strand; PAM type: NRG; PAM sequence: AAG
tgagaaccattgtagaaata

SEQ ID NO: 28047 - DNA, 20 bp, Artificial Sequence
  Description of Artificial Sequence: Synthetic oligonucleotide
  Target: SCN9A; (-) strand; PAM type: NRG; PAM sequence: TAG
aatgttcctgagaaccattg

SEQ ID NO: 28048 - DNA, 20 bp, Artificial Sequence
  Description of Artificial Sequence: Synthetic oligonucleotide
  Target: SCN9A; (-) strand; PAM type: NRG; PAM sequence: GAG
ttcagaagcaaaatgttcct

SEQ ID NO: 28049 - DNA, 20 bp, Artificial Sequence
  Description of Artificial Sequence: Synthetic oligonucleotide
  Target: SCN9A; (-) strand; PAM type: NRG; PAM sequence: AAG
tctaataaactaattttcag

SEQ ID NO: 28050 - DNA, 20 bp, Artificial Sequence
  Description of Artificial Sequence: Synthetic oligonucleotide
  Target: SCN9A; (-) strand; PAM type: NRG; PAM sequence: CAG
ttctctaataaactaatttt

SEQ ID NO: 28051 - DNA, 20 bp, Artificial Sequence
  Description of Artificial Sequence: Synthetic oligonucleotide
  Target: SCN9A; (-) strand; PAM type: NRG; PAM sequence: CAG
tttgaaagaccttatagttt

SEQ ID NO: 28052 - DNA, 20 bp, Artificial Sequence
  Description of Artificial Sequence: Synthetic oligonucleotide
  Target: SCN9A; (-) strand; PAM type: NRG; PAM sequence: TAG
atcatttttgaaagacctta

SEQ ID NO: 28053 - DNA, 20 bp, Artificial Sequence
  Description of Artificial Sequence: Synthetic oligonucleotide
  Target: SCN9A; (-) strand; PAM type: NRG; PAM sequence: AAG
ttgggttcaatcatttttga

SEQ ID NO: 28054 - DNA, 20 bp, Artificial Sequence
  Description of Artificial Sequence: Synthetic oligonucleotide
  Target: SCN9A; (-) strand; PAM type: NRG; PAM sequence: GGG
atgtacacaggtttccattt

SEQ ID NO: 28055 - DNA, 20 bp, Artificial Sequence
  Description of Artificial Sequence: Synthetic oligonucleotide
  Target: SCN9A; (-) strand; PAM type: NRG; PAM sequence: TGG
gatgtacacaggtttccatt

SEQ ID NO: 28056 - DNA, 20 bp, Artificial Sequence
  Description of Artificial Sequence: Synthetic oligonucleotide
  Target: SCN9A; (-) strand; PAM type: NRG; PAM sequence: AGG
atttatggaaagatgtacac

SEQ ID NO: 28057 - DNA, 20 bp, Artificial Sequence
  Description of Artificial Sequence: Synthetic oligonucleotide
  Target: SCN9A; (-) strand; PAM type: NRG; PAM sequence: CAG
catttatggaaagatgtaca

SEQ ID NO: 28058 - DNA, 20 bp, Artificial Sequence
  Description of Artificial Sequence: Synthetic oligonucleotide
  Target: SCN9A; (-) strand; PAM type: NRG; PAM sequence: AAG
tatcgctaggcatttatgga

SEQ ID NO: 28059 - DNA, 20 bp, Artificial Sequence
  Description of Artificial Sequence: Synthetic oligonucleotide
  Target: SCN9A; (-) strand; PAM type: NRG; PAM sequence: TGG
ctagtatcgctaggcattta

SEQ ID NO: 28060 - DNA, 20 bp, Artificial Sequence
  Description of Artificial Sequence: Synthetic oligonucleotide
  Target: SCN9A; (-) strand; PAM type: NRG; PAM sequence: AGG
ggtaaaaacctagtatcgct

SEQ ID NO: 28061 - DNA, 20 bp, Artificial Sequence
  Description of Artificial Sequence: Synthetic oligonucleotide
  Target: SCN9A; (-) strand; PAM type: NRG; PAM sequence: TAG
aggtaaaaacctagtatcgc

SEQ ID NO: 28062 - DNA, 20 bp, Artificial Sequence
  Description of Artificial Sequence: Synthetic oligonucleotide
  Target: SCN9A; (-) strand; PAM type: NRG; PAM sequence: TAG
tatgattttaggtaaaaacc

SEQ ID NO: 28063 - DNA, 20 bp, Artificial Sequence
  Description of Artificial Sequence: Synthetic oligonucleotide
  Target: SCN9A; (-) strand; PAM type: NRG; PAM sequence: AGG
gatttcattggtatgatttt

SEQ ID NO: 28064 - DNA, 20 bp, Artificial Sequence
  Description of Artificial Sequence: Synthetic oligonucleotide
  Target: SCN9A; (-) strand; PAM type: NRG; PAM sequence: TAG
tgatttcattggtatgattt

SEQ ID NO: 28065 - DNA, 20 bp, Artificial Sequence
  Description of Artificial Sequence: Synthetic oligonucleotide
  Target: SCN9A; (-) strand; PAM type: NRG; PAM sequence: TGG
aggatagtgagtgatttcat

SEQ ID NO: 28066 - DNA, 20 bp, Artificial Sequence
  Description of Artificial Sequence: Synthetic oligonucleotide
  Target: SCN9A; (-) strand; PAM type: NRG; PAM sequence: GAG
agaactcgggagaggatagt

SEQ ID NO: 28067 - DNA, 20 bp, Artificial Sequence
  Description of Artificial Sequence: Synthetic oligonucleotide
  Target: SCN9A; (-) strand; PAM type: NRG; PAM sequence: TAG
taagagaactcgggagagga

SEQ ID NO: 28068 - DNA, 20 bp, Artificial Sequence
  Description of Artificial Sequence: Synthetic oligonucleotide
  Target: SCN9A; (-) strand; PAM type: NRG; PAM sequence: AGG
agggtaagagaactcgggag

SEQ ID NO: 28069 - DNA, 20 bp, Artificial Sequence
  Description of Artificial Sequence: Synthetic oligonucleotide
  Target: SCN9A; (-) strand; PAM type: NRG; PAM sequence: GAG
tagggtaagagaactcggga

SEQ ID NO: 28070 - DNA, 20 bp, Artificial Sequence
  Description of Artificial Sequence: Synthetic oligonucleotide
  Target: SCN9A; (-) strand; PAM type: NRG; PAM sequence: GAG
tttagggtaagagaactcgg

SEQ ID NO: 28071 - DNA, 20 bp, Artificial Sequence
  Description of Artificial Sequence: Synthetic oligonucleotide
  Target: SCN9A; (-) strand; PAM type: NRG; PAM sequence: GGG
attttagggtaagagaactc

SEQ ID NO: 28072 - DNA, 20 bp, Artificial Sequence
  Description of Artificial Sequence: Synthetic oligonucleotide
  Target: SCN9A; (-) strand; PAM type: NRG; PAM sequence: CGG
tattttagggtaagagaact

SEQ ID NO: 28073 - DNA, 20 bp, Artificial Sequence
  Description of Artificial Sequence: Synthetic oligonucleotide
  Target: SCN9A; (-) strand; PAM type: NRG; PAM sequence: GAG
aatgtcttattttagggtaa

SEQ ID NO: 28074 - DNA, 20 bp, Artificial Sequence
  Description of Artificial Sequence: Synthetic oligonucleotide
  Target: SCN9A; (-) strand; PAM type: NRG; PAM sequence: AAG
aaaatgtcttattttagggt

SEQ ID NO: 28075 - DNA, 20 bp, Artificial Sequence
  Description of Artificial Sequence: Synthetic oligonucleotide
  Target: SCN9A; (-) strand; PAM type: NRG; PAM sequence: GGG
gagaaaaatgtcttatttta

SEQ ID NO: 28076 - DNA, 20 bp, Artificial Sequence
  Description of Artificial Sequence: Synthetic oligonucleotide
  Target: SCN9A; (-) strand; PAM type: NRG; PAM sequence: AGG
agagaaaaatgtcttatttt

SEQ ID NO: 28077 - DNA, 20 bp, Artificial Sequence
  Description of Artificial Sequence: Synthetic oligonucleotide
  Target: SCN9A; (-) strand; PAM type: NRG; PAM sequence: TAG
tagagaaaaatgtcttattt

SEQ ID NO: 28078 - DNA, 20 bp, Artificial Sequence
  Description of Artificial Sequence: Synthetic oligonucleotide
  Target: SCN9A; (-) strand; PAM type: NRG; PAM sequence: GAG
tcacccgaggcagaatgcta

SEQ ID NO: 28079 - DNA, 20 bp, Artificial Sequence
  Description of Artificial Sequence: Synthetic oligonucleotide
  Target: SCN9A; (-) strand; PAM type: NRG; PAM sequence: TAG
tatcacccgaggcagaatgc

SEQ ID NO: 28080 - DNA, 20 bp, Artificial Sequence
  Description of Artificial Sequence: Synthetic oligonucleotide
  Target: SCN9A; (-) strand; PAM type: NRG; PAM sequence: CAG
taaatgtgtatcacccgagg

SEQ ID NO: 28081 - DNA, 20 bp, Artificial Sequence
  Description of Artificial Sequence: Synthetic oligonucleotide
  Target: SCN9A; (-) strand; PAM type: NRG; PAM sequence: AGG
tgctaaatgtgtatcacccg

SEQ ID NO: 28082 - DNA, 20 bp, Artificial Sequence
  Description of Artificial Sequence: Synthetic oligonucleotide
  Target: SCN9A; (-) strand; PAM type: NRG; PAM sequence: GAG
ttgctaaatgtgtatcaccc

SEQ ID NO: 28083 - DNA, 20 bp, Artificial Sequence
  Description of Artificial Sequence: Synthetic oligonucleotide
  Target: SCN9A; (-) strand; PAM type: NRG; PAM sequence: AGG
gaggttgtctacccccaatc

SEQ ID NO: 28084 - DNA, 20 bp, Artificial Sequence
  Description of Artificial Sequence: Synthetic oligonucleotide
  Target: SCN9A; (-) strand; PAM type: NRG; PAM sequence: CAG
agaggttgtctacccccaat

SEQ ID NO: 28085 - DNA, 20 bp, Artificial Sequence
  Description of Artificial Sequence: Synthetic oligonucleotide
  Target: SCN9A; (-) strand; PAM type: NRG; PAM sequence: AGG
ataggcgagcacatgaaaag

SEQ ID NO: 28086 - DNA, 20 bp, Artificial Sequence
  Description of Artificial Sequence: Synthetic oligonucleotide
  Target: SCN9A; (-) strand; PAM type: NRG; PAM sequence: GAG
cataggcgagcacatgaaaa

SEQ ID NO: 28087 - DNA, 20 bp, Artificial Sequence
  Description of Artificial Sequence: Synthetic oligonucleotide
  Target: SCN9A; (-) strand; PAM type: NRG; PAM sequence: AAG
ggcataggcgagcacatgaa

SEQ ID NO: 28088 - DNA, 20 bp, Artificial Sequence
  Description of Artificial Sequence: Synthetic oligonucleotide
  Target: SCN9A; (-) strand; PAM type: NRG; PAM sequence: GAG
tggtgtcgaagggcataggc

SEQ ID NO: 28089 - DNA, 20 bp, Artificial Sequence
  Description of Artificial Sequence: Synthetic oligonucleotide
  Target: SCN9A; (-) strand; PAM type: NRG; PAM sequence: AGG
accttggtgtcgaagggcat

SEQ ID NO: 28090 - DNA, 20 bp, Artificial Sequence
  Description of Artificial Sequence: Synthetic oligonucleotide
  Target: SCN9A; (-) strand; PAM type: NRG; PAM sequence: TAG
caccttggtgtcgaagggca

SEQ ID NO: 28091 - DNA, 20 bp, Artificial Sequence
  Description of Artificial Sequence: Synthetic oligonucleotide
  Target: SCN9A; (-) strand; PAM type: NRG; PAM sequence: GGG
gtttccaccttggtgtcgaa

SEQ ID NO: 28092 - DNA, 20 bp, Artificial Sequence
  Description of Artificial Sequence: Synthetic oligonucleotide
  Target: SCN9A; (-) strand; PAM type: NRG; PAM sequence: AGG
agtttccaccttggtgtcga

SEQ ID NO: 28093 - DNA, 20 bp, Artificial Sequence
  Description of Artificial Sequence: Synthetic oligonucleotide
  Target: SCN9A; (-) strand; PAM type: NRG; PAM sequence: AAG
aagtttccaccttggtgtcg

SEQ ID NO: 28094 - DNA, 20 bp, Artificial Sequence
  Description of Artificial Sequence: Synthetic oligonucleotide
  Target: SCN9A; (-) strand; PAM type: NRG; PAM sequence: TGG
agaagaaaaagtttccacct

SEQ ID NO: 28095 - DNA, 20 bp, Artificial Sequence
  Description of Artificial Sequence: Synthetic oligonucleotide
  Target: SCN9A; (-) strand; PAM type: NRG; PAM sequence: AAG
gaggacagcatcagaagaaa

SEQ ID NO: 28096 - DNA, 20 bp, Artificial Sequence
  Description of Artificial Sequence: Synthetic oligonucleotide
  Target: SCN9A; (-) strand; PAM type: NRG; PAM sequence: AAG
gaatcagaggacagcatcag

SEQ ID NO: 28097 - DNA, 20 bp, Artificial Sequence
  Description of Artificial Sequence: Synthetic oligonucleotide
  Target: SCN9A; (-) strand; PAM type: NRG; PAM sequence: CAG
tcagaatcagaggacagcat

SEQ ID NO: 28098 - DNA, 20 bp, Artificial Sequence
  Description of Artificial Sequence: Synthetic oligonucleotide
  Target: SCN9A; (-) strand; PAM type: NRG; PAM sequence: CAG
tcgaaatcagaatcagagga

SEQ ID NO: 28099 - DNA, 20 bp, Artificial Sequence
  Description of Artificial Sequence: Synthetic oligonucleotide
  Target: SCN9A; (-) strand; PAM type: NRG; PAM sequence: AGG
attgtcgaaatcagaatcag

SEQ ID NO: 28100 - DNA, 20 bp, Artificial Sequence
  Description of Artificial Sequence: Synthetic oligonucleotide
  Target: SCN9A; (-) strand; PAM type: NRG; PAM sequence: GAG
aattgtcgaaatcagaatca

SEQ ID NO: 28101 - DNA, 20 bp, Artificial Sequence
  Description of Artificial Sequence: Synthetic oligonucleotide
  Target: SCN9A; (-) strand; PAM type: NRG; PAM sequence: CAG
gaaattgtcgaaatcagaat

SEQ ID NO: 28102 - DNA, 20 bp, Artificial Sequence
  Description of Artificial Sequence: Synthetic oligonucleotide
  Target: SCN9A; (-) strand; PAM type: NRG; PAM sequence: CAG
tgctgagaaattgtcgaaat

SEQ ID NO: 28103 - DNA, 20 bp, Artificial Sequence
  Description of Artificial Sequence: Synthetic oligonucleotide
  Target: SCN9A; (-) strand; PAM type: NRG; PAM sequence: GAG
gagaggaaaagggagatgct

SEQ ID NO: 28104 - DNA, 20 bp, Artificial Sequence
  Description of Artificial Sequence: Synthetic oligonucleotide
  Target: SCN9A; (-) strand; PAM type: NRG; PAM sequence: GAG
ctccagtggagaggaaaagg

SEQ ID NO: 28105 - DNA, 20 bp, Artificial Sequence
  Description of Artificial Sequence: Synthetic oligonucleotide
  Target: SCN9A; (-) strand; PAM type: NRG; PAM sequence: GGG
ctctccagtggagaggaaaa

SEQ ID NO: 28106 - DNA, 20 bp, Artificial Sequence
  Description of Artificial Sequence: Synthetic oligonucleotide
  Target: SCN9A; (-) strand; PAM type: NRG; PAM sequence: AGG
gctctccagtggagaggaaa

SEQ ID NO: 28107 - DNA, 20 bp, Artificial Sequence
  Description of Artificial Sequence: Synthetic oligonucleotide
  Target: SCN9A; (-) strand; PAM type: NRG; PAM sequence: AAG
agctctccagtggagaggaa

SEQ ID NO: 28108 - DNA, 20 bp, Artificial Sequence
  Description of Artificial Sequence: Synthetic oligonucleotide
  Target: SCN9A; (-) strand; PAM type: NRG; PAM sequence: AGG
aaagaagctctccagtggag

SEQ ID NO: 28109 - DNA, 20 bp, Artificial Sequence
  Description of Artificial Sequence: Synthetic oligonucleotide
  Target: SCN9A; (-) strand; PAM type: NRG; PAM sequence: GAG
aaaagaagctctccagtgga

SEQ ID NO: 28110 - DNA, 20 bp, Artificial Sequence
  Description of Artificial Sequence: Synthetic oligonucleotide
  Target: SCN9A; (-) strand; PAM type: NRG; PAM sequence: GAG
tcaaaagaagctctccagtg

SEQ ID NO: 28111 - DNA, 20 bp, Artificial Sequence
  Description of Artificial Sequence: Synthetic oligonucleotide
  Target: SCN9A; (-) strand; PAM type: NRG; PAM sequence: TGG
aatcaaaagaagctctccag

SEQ ID NO: 28112 - DNA, 20 bp, Artificial Sequence
  Description of Artificial Sequence: Synthetic oligonucleotide
  Target: SCN9A; (-) strand; PAM type: NRG; PAM sequence: CAG
aagaatcaaaagaagctctc

SEQ ID NO: 28113 - DNA, 20 bp, Artificial Sequence
  Description of Artificial Sequence: Synthetic oligonucleotide
  Target: SCN9A; (-) strand; PAM type: NRG; PAM sequence: AAG
gaaagaaaaagaatcaaaag

SEQ ID NO: 28114 - DNA, 20 bp, Artificial Sequence
  Description of Artificial Sequence: Synthetic oligonucleotide
  Target: SCN9A; (-) strand; PAM type: NRG; PAM sequence: AAG
gaagaaagaaaaagaatcaa

SEQ ID NO: 28115 - DNA, 20 bp, Artificial Sequence
  Description of Artificial Sequence: Synthetic oligonucleotide
  Target: SCN9A; (-) strand; PAM type: NRG; PAM sequence: AAG
gaagaaacagaagaaagaaa

SEQ ID NO: 28116 - DNA, 20 bp, Artificial Sequence
  Description of Artificial Sequence: Synthetic oligonucleotide
  Target: SCN9A; (-) strand; PAM type: NRG; PAM sequence: AAG
aagaaagaagaaacagaaga

SEQ ID NO: 28117 - DNA, 20 bp, Artificial Sequence
  Description of Artificial Sequence: Synthetic oligonucleotide
  Target: SCN9A; (-) strand; PAM type: NRG; PAM sequence: AAG
gctaaagaaagaagaaacag

SEQ ID NO: 28118 - DNA, 20 bp, Artificial Sequence
  Description of Artificial Sequence: Synthetic oligonucleotide
  Target: SCN9A; (-) strand; PAM type: NRG; PAM sequence: CAG
agtgctaaagaaagaagaaa

SEQ ID NO: 28119 - DNA, 20 bp, Artificial Sequence
  Description of Artificial Sequence: Synthetic oligonucleotide
  Target: SCN9A; (-) strand; PAM type: NRG; PAM sequence: AAG
tctaaaagtgctaaagaaag

SEQ ID NO: 28120 - DNA, 20 bp, Artificial Sequence
  Description of Artificial Sequence: Synthetic oligonucleotide
  Target: SCN9A; (-) strand; PAM type: NRG; PAM sequence: AAG
agctctaaaagtgctaaaga

SEQ ID NO: 28121 - DNA, 20 bp, Artificial Sequence
  Description of Artificial Sequence: Synthetic oligonucleotide
  Target: SCN9A; (-) strand; PAM type: NRG; PAM sequence: AAG
actgagctctaaaagtgcta

SEQ ID NO: 28122 - DNA, 20 bp, Artificial Sequence
  Description of Artificial Sequence: Synthetic oligonucleotide
  Target: SCN9A; (-) strand; PAM type: NRG; PAM sequence: AAG
acatccaaactgagctctaa

SEQ ID NO: 28123 - DNA, 20 bp, Artificial Sequence
  Description of Artificial Sequence: Synthetic oligonucleotide
  Target: SCN9A; (-) strand; PAM type: NRG; PAM sequence: GAG
tcttctgaaacatccaaact

SEQ ID NO: 28124 - DNA, 20 bp, Artificial Sequence
  Description of Artificial Sequence: Synthetic oligonucleotide
  Target: SCN9A; (-) strand; PAM type: NRG; PAM sequence: GAG
agaattatgggcctctcaga

SEQ ID NO: 28125 - DNA, 20 bp, Artificial Sequence
  Description of Artificial Sequence: Synthetic oligonucleotide
  Target: SCN9A; (-) strand; PAM type: NRG; PAM sequence: GAG
gcagaattatgggcctctca

SEQ ID NO: 28126 - DNA, 20 bp, Artificial Sequence
  Description of Artificial Sequence: Synthetic oligonucleotide
  Target: SCN9A; (-) strand; PAM type: NRG; PAM sequence: CAG
aagcagaattatgggcctct

SEQ ID NO: 28127 - DNA, 20 bp, Artificial Sequence
  Description of Artificial Sequence: Synthetic oligonucleotide
  Target: SCN9A; (-) strand; PAM type: NRG; PAM sequence: GGG
attaggagaagcagaattat

SEQ ID NO: 28128 - DNA, 20 bp, Artificial Sequence
  Description of Artificial Sequence: Synthetic oligonucleotide
  Target: SCN9A; (-) strand; PAM type: NRG; PAM sequence: TGG
tattaggagaagcagaatta

SEQ ID NO: 28129 - DNA, 20 bp, Artificial Sequence
  Description of Artificial Sequence: Synthetic oligonucleotide
  Target: SCN9A; (-) strand; PAM type: NRG; PAM sequence: CAG
tatacaagtattaggagaag

SEQ ID NO: 28130 - DNA, 20 bp, Artificial Sequence
  Description of Artificial Sequence: Synthetic oligonucleotide
  Target: SCN9A; (-) strand; PAM type: NRG; PAM sequence: AAG
gaatatacaagtattaggag

SEQ ID NO: 28131 - DNA, 20 bp, Artificial Sequence
  Description of Artificial Sequence: Synthetic oligonucleotide
  Target: SCN9A; (-) strand; PAM type: NRG; PAM sequence: GAG
gctgaatatacaagtattag

SEQ ID NO: 28132 - DNA, 20 bp, Artificial Sequence
  Description of Artificial Sequence: Synthetic oligonucleotide
  Target: SCN9A; (-) strand; PAM type: NRG; PAM sequence: AGG
cggctgaatatacaagtatt

SEQ ID NO: 28133 - DNA, 20 bp, Artificial Sequence
  Description of Artificial Sequence: Synthetic oligonucleotide
  Target: SCN9A; (-) strand; PAM type: NRG; PAM sequence: TAG
gcggctgaatatacaagtat

SEQ ID NO: 28134 - DNA, 20 bp, Artificial Sequence
  Description of Artificial Sequence: Synthetic oligonucleotide
  Target: SCN9A; (-) strand; PAM type: NRG; PAM sequence: AAG
gcggcagcggctgaatatac

SEQ ID NO: 28135 - DNA, 20 bp, Artificial Sequence
  Description of Artificial Sequence: Synthetic oligonucleotide
  Target: SCN9A; (-) strand; PAM type: NRG; PAM sequence: CGG
ccaggcaattgcagcggcag

SEQ ID NO: 28136 - DNA, 20 bp, Artificial Sequence
  Description of Artificial Sequence: Synthetic oligonucleotide
  Target: SCN9A; (-) strand; PAM type: NRG; PAM sequence: CAG
caaccaggcaattgcagcgg

SEQ ID NO: 28137 - DNA, 20 bp, Artificial Sequence
  Description of Artificial Sequence: Synthetic oligonucleotide
  Target: SCN9A; (-) strand; PAM type: NRG; PAM sequence: CGG
gcccaaccaggcaattgcag

SEQ ID NO: 28138 - DNA, 20 bp, Artificial Sequence
  Description of Artificial Sequence: Synthetic oligonucleotide
  Target: SCN9A; (-) strand; PAM type: NRG; PAM sequence: CAG
ttggcccaaccaggcaattg

SEQ ID NO: 28139 - DNA, 20 bp, Artificial Sequence
  Description of Artificial Sequence: Synthetic oligonucleotide
  Target: SCN9A; (-) strand; PAM type: NRG; PAM sequence: AGG
gttaacgtcttggcccaacc

SEQ ID NO: 28140 - DNA, 20 bp, Artificial Sequence
  Description of Artificial Sequence: Synthetic oligonucleotide
  Target: SCN9A; (-) strand; PAM type: NRG; PAM sequence: CAG
tgttaacgtcttggcccaac

SEQ ID NO: 28141 - DNA, 20 bp, Artificial Sequence
  Description of Artificial Sequence: Synthetic oligonucleotide
  Target: SCN9A; (-) strand; PAM type: NRG; PAM sequence: TGG
tcatttaagtgttaacgtct

SEQ ID NO: 28142 - DNA, 20 bp, Artificial Sequence
  Description of Artificial Sequence: Synthetic oligonucleotide
  Target: SCN9A; (-) strand; PAM type: NRG; PAM sequence: AAG
gatttggaaatgactcattt

SEQ ID NO: 28143 - DNA, 20 bp, Artificial Sequence
  Description of Artificial Sequence: Synthetic oligonucleotide
  Target: SCN9A; (-) strand; PAM type: NRG; PAM sequence: TGG
tcctagggtttcctaggatt

SEQ ID NO: 28144 - DNA, 20 bp, Artificial Sequence
  Description of Artificial Sequence: Synthetic oligonucleotide
  Target: SCN9A; (-) strand; PAM type: NRG; PAM sequence: AGG
gtcctgtcctagggtttcct

SEQ ID NO: 28145 - DNA, 20 bp, Artificial Sequence
  Description of Artificial Sequence: Synthetic oligonucleotide
  Target: SCN9A; (-) strand; PAM type: NRG; PAM sequence: TAG
tgtcctgtcctagggtttcc

SEQ ID NO: 28146 - DNA, 20 bp, Artificial Sequence
  Description of Artificial Sequence: Synthetic oligonucleotide
  Target: SCN9A; (-) strand; PAM type: NRG; PAM sequence: GGG
gtgaaagatgtcctgtccta

SEQ ID NO: 28147 - DNA, 20 bp, Artificial Sequence
  Description of Artificial Sequence: Synthetic oligonucleotide
  Target: SCN9A; (-) strand; PAM type: NRG; PAM sequence: AGG
ggtgaaagatgtcctgtcct

SEQ ID NO: 28148 - DNA, 20 bp, Artificial Sequence
  Description of Artificial Sequence: Synthetic oligonucleotide
  Target: SCN9A; (-) strand; PAM type: NRG; PAM sequence: TAG
aggtgaaagatgtcctgtcc

SEQ ID NO: 28149 - DNA, 20 bp, Artificial Sequence
  Description of Artificial Sequence: Synthetic oligonucleotide
  Target: SCN9A; (-) strand; PAM type: NRG; PAM sequence: AAG
gttgttatgctaataggtga

SEQ ID NO: 28150 - DNA, 20 bp, Artificial Sequence
  Description of Artificial Sequence: Synthetic oligonucleotide
  Target: SCN9A; (-) strand; PAM type: NRG; PAM sequence: AGG
caccatgttgttatgctaat

SEQ ID NO: 28151 - DNA, 20 bp, Artificial Sequence
  Description of Artificial Sequence: Synthetic oligonucleotide
  Target: SCN9A; (-) strand; PAM type: NRG; PAM sequence: TAG
gcaccatgttgttatgctaa

SEQ ID NO: 28152 - DNA, 20 bp, Artificial Sequence
  Description of Artificial Sequence: Synthetic oligonucleotide
  Target: SCN9A; (-) strand; PAM type: NRG; PAM sequence: AGG
aacgatcatttcatgtttaa

SEQ ID NO: 28153 - DNA, 20 bp, Artificial Sequence
  Description of Artificial Sequence: Synthetic oligonucleotide
  Target: SCN9A; (-) strand; PAM type: NRG; PAM sequence: AAG
aaacgatcatttcatgttta

SEQ ID NO: 28154 - DNA, 20 bp, Artificial Sequence
  Description of Artificial Sequence: Synthetic oligonucleotide
  Target: SCN9A; (-) strand; PAM type: NRG; PAM sequence: AAG
agcattctgatcattgtgta

SEQ ID NO: 28155 - DNA, 20 bp, Artificial Sequence
  Description of Artificial Sequence: Synthetic oligonucleotide
  Target: SCN9A; (-) strand; PAM type: NRG; PAM sequence: AAG
aaaccaaatatatactttgt

SEQ ID NO: 28156 - DNA, 20 bp, Artificial Sequence
  Description of Artificial Sequence: Synthetic oligonucleotide
  Target: SCN9A; (-) strand; PAM type: NRG; PAM sequence: GAG
atagagctttatttcaacct

SEQ ID NO: 28157 - DNA, 20 bp, Artificial Sequence
  Description of Artificial Sequence: Synthetic oligonucleotide
  Target: SCN9A; (-) strand; PAM type: NRG; PAM sequence: GAG
tttaattctaaaatacaata

SEQ ID NO: 28158 - DNA, 20 bp, Artificial Sequence
  Description of Artificial Sequence: Synthetic oligonucleotide
  Target: SCN9A; (-) strand; PAM type: NRG; PAM sequence: TAG
agtttaattctaaaatacaa

SEQ ID NO: 28159 - DNA, 20 bp, Artificial Sequence
  Description of Artificial Sequence: Synthetic oligonucleotide
  Target: SCN9A; (-) strand; PAM type: NRG; PAM sequence: TAG
agcaaattaataacatgtaa

SEQ ID NO: 28160 - DNA, 20 bp, Artificial Sequence
  Description of Artificial Sequence: Synthetic oligonucleotide
  Target: SCN9A; (-) strand; PAM type: NRG; PAM sequence: AAG
atttaatttgtctttactgt

SEQ ID NO: 28161 - DNA, 20 bp, Artificial Sequence
  Description of Artificial Sequence: Synthetic oligonucleotide
  Target: SCN9A; (-) strand; PAM type: NRG; PAM sequence: GAG
tcttattgcatggtttatgc

SEQ ID NO: 28162 - DNA, 20 bp, Artificial Sequence
  Description of Artificial Sequence: Synthetic oligonucleotide
  Target: SCN9A; (-) strand; PAM type: NRG; PAM sequence: TGG
aaattgtctgtcttattgca

SEQ ID NO: 28163 - DNA, 20 bp, Artificial Sequence
  Description of Artificial Sequence: Synthetic oligonucleotide
  Target: SCN9A; (-) strand; PAM type: NRG; PAM sequence: GAG
ctgattctattgatgatatg

SEQ ID NO: 28164 - DNA, 20 bp, Artificial Sequence
  Description of Artificial Sequence: Synthetic oligonucleotide
  Target: SCN9A; (-) strand; PAM type: NRG; PAM sequence: TGG
gcctgattctattgatgata

SEQ ID NO: 28165 - DNA, 20 bp, Artificial Sequence
  Description of Artificial Sequence: Synthetic oligonucleotide
  Target: SCN9A; (-) strand; PAM type: NRG; PAM sequence: GAG
tcaatctttattaaaccata

SEQ ID NO: 28166 - DNA, 20 bp, Artificial Sequence
  Description of Artificial Sequence: Synthetic oligonucleotide
  Target: SCN9A; (-) strand; PAM type: NRG; PAM sequence: TAG
actcaatctttattaaacca

SEQ ID NO: 28167 - DNA, 20 bp, Artificial Sequence
  Description of Artificial Sequence: Synthetic oligonucleotide
  Target: SCN9A; (-) strand; PAM type: NRG; PAM sequence: TAG
agaagtttcatttaggccaa

SEQ ID NO: 28168 - DNA, 20 bp, Artificial Sequence
  Description of Artificial Sequence: Synthetic oligonucleotide
  Target: SCN9A; (-) strand; PAM type: NRG; PAM sequence: AGG
aattcccagaagtttcattt

SEQ ID NO: 28169 - DNA, 20 bp, Artificial Sequence
  Description of Artificial Sequence: Synthetic oligonucleotide
  Target: SCN9A; (-) strand; PAM type: NRG; PAM sequence: TAG
gaattcccagaagtttcatt

SEQ ID NO: 28170 - DNA, 20 bp, Artificial Sequence
  Description of Artificial Sequence: Synthetic oligonucleotide
  Target: SCN9A; (-) strand; PAM type: NRG; PAM sequence: AAG
actacctagggaattcccag

SEQ ID NO: 28171 - DNA, 20 bp, Artificial Sequence
  Description of Artificial Sequence: Synthetic oligonucleotide
  Target: SCN9A; (-) strand; PAM type: NRG; PAM sequence: CAG
ggtactacctagggaattcc

SEQ ID NO: 28172 - DNA, 20 bp, Artificial Sequence
  Description of Artificial Sequence: Synthetic oligonucleotide
  Target: SCN9A; (-) strand; PAM type: NRG; PAM sequence: GGG
gttatcccaggtactaccta

SEQ ID NO: 28173 - DNA, 20 bp, Artificial Sequence
  Description of Artificial Sequence: Synthetic oligonucleotide
  Target: SCN9A; (-) strand; PAM type: NRG; PAM sequence: AGG
ggttatcccaggtactacct

SEQ ID NO: 28174 - DNA, 20 bp, Artificial Sequence
  Description of Artificial Sequence: Synthetic oligonucleotide
  Target: SCN9A; (-) strand; PAM type: NRG; PAM sequence: TAG
aggttatcccaggtactacc

SEQ ID NO: 28175 - DNA, 20 bp, Artificial Sequence
  Description of Artificial Sequence: Synthetic oligonucleotide
  Target: SCN9A; (-) strand; PAM type: NRG; PAM sequence: AGG
ggatagtactaggttatccc

SEQ ID NO: 28176 - DNA, 20 bp, Artificial Sequence
  Description of Artificial Sequence: Synthetic oligonucleotide
  Target: SCN9A; (-) strand; PAM type: NRG; PAM sequence: CAG
gggatagtactaggttatcc

SEQ ID NO: 28177 - DNA, 20 bp, Artificial Sequence
  Description of Artificial Sequence: Synthetic oligonucleotide
  Target: SCN9A; (-) strand; PAM type: NRG; PAM sequence: AGG
ttttgtaaagggatagtact

SEQ ID NO: 28178 - DNA, 20 bp, Artificial Sequence
  Description of Artificial Sequence: Synthetic oligonucleotide
  Target: SCN9A; (-) strand; PAM type: NRG; PAM sequence: TAG
attttgtaaagggatagtac

SEQ ID NO: 28179 - DNA, 20 bp, Artificial Sequence
  Description of Artificial Sequence: Synthetic oligonucleotide
  Target: SCN9A; (-) strand; PAM type: NRG; PAM sequence: TAG
caaaacattttgtaaaggga

SEQ ID NO: 28180 - DNA, 20 bp, Artificial Sequence
  Description of Artificial Sequence: Synthetic oligonucleotide
  Target: SCN9A; (-) strand; PAM type: NRG; PAM sequence: GGG
taaacaaaacattttgtaaa

SEQ ID NO: 28181 - DNA, 20 bp, Artificial Sequence
  Description of Artificial Sequence: Synthetic oligonucleotide
  Target: SCN9A; (-) strand; PAM type: NRG; PAM sequence: AGG
ataaacaaaacattttgtaa

SEQ ID NO: 28182 - DNA, 20 bp, Artificial Sequence
  Description of Artificial Sequence: Synthetic oligonucleotide
  Target: SCN9A; (-) strand; PAM type: NRG; PAM sequence: AAG
tataaacaaaacattttgta

SEQ ID NO: 28183 - DNA, 20 bp, Artificial Sequence
  Description of Artificial Sequence: Synthetic oligonucleotide
  Target: SCN9A; (-) strand; PAM type: NRG; PAM sequence: TAG
atgtttttacaagaattttt

SEQ ID NO: 28184 - DNA, 20 bp, Artificial Sequence
  Description of Artificial Sequence: Synthetic oligonucleotide
  Target: SCN9A; (-) strand; PAM type: NRG; PAM sequence: AAG
tttatttcccatgtttttac

SEQ ID NO: 28185 - DNA, 20 bp, Artificial Sequence
  Description of Artificial Sequence: Synthetic oligonucleotide
  Target: SCN9A; (-) strand; PAM type: NRG; PAM sequence: AAG
accaattatttctgggaggt

SEQ ID NO: 28186 - DNA, 20 bp, Artificial Sequence
  Description of Artificial Sequence: Synthetic oligonucleotide
  Target: SCN9A; (-) strand; PAM type: NRG; PAM sequence: AGG
tagcaccaattatttctggg

SEQ ID NO: 28187 - DNA, 20 bp, Artificial Sequence
  Description of Artificial Sequence: Synthetic oligonucleotide
  Target: SCN9A; (-) strand; PAM type: NRG; PAM sequence: GAG
ttagcaccaattatttctgg

SEQ ID NO: 28188 - DNA, 20 bp, Artificial Sequence
  Description of Artificial Sequence: Synthetic oligonucleotide
  Target: SCN9A; (-) strand; PAM type: NRG; PAM sequence: GGG
tattagcaccaattatttct

SEQ ID NO: 28189 - DNA, 20 bp, Artificial Sequence
  Description of Artificial Sequence: Synthetic oligonucleotide
  Target: SCN9A; (-) strand; PAM type: NRG; PAM sequence: TGG
atattagcaccaattatttc

SEQ ID NO: 28190 - DNA, 20 bp, Artificial Sequence
  Description of Artificial Sequence: Synthetic oligonucleotide
  Target: SCN9A; (-) strand; PAM type: NRG; PAM sequence: TAG
aaaaagaatggaagaaatat

SEQ ID NO: 28191 - DNA, 20 bp, Artificial Sequence
  Description of Artificial Sequence: Synthetic oligonucleotide
  Target: SCN9A; (-) strand; PAM type: NRG; PAM sequence: AAG
catacatataaaaagaatgg

SEQ ID NO: 28192 - DNA, 20 bp, Artificial Sequence
  Description of Artificial Sequence: Synthetic oligonucleotide
  Target: SCN9A; (-) strand; PAM type: NRG; PAM sequence: TGG
atacatacatataaaaagaa

SEQ ID NO: 28193 - DNA, 20 bp, Artificial Sequence
  Description of Artificial Sequence: Synthetic oligonucleotide
  Target: SCN9A; (-) strand; PAM type: NRG; PAM sequence: AAG
aaattatacatacatataaa

SEQ ID NO: 28194 - DNA, 20 bp, Artificial Sequence
  Description of Artificial Sequence: Synthetic oligonucleotide
  Target: SCN9A; (-) strand; PAM type: NRG; PAM sequence: TAG
taatgatggattaaataata

SEQ ID NO: 28195 - DNA, 20 bp, Artificial Sequence
  Description of Artificial Sequence: Synthetic oligonucleotide
  Target: SCN9A; (-) strand; PAM type: NRG; PAM sequence: TGG
aaaatcttttagaataatga

SEQ ID NO: 28196 - DNA, 20 bp, Artificial Sequence
  Description of Artificial Sequence: Synthetic oligonucleotide
  Target: SCN9A; (-) strand; PAM type: NRG; PAM sequence: TAG
tatcatgaggaaaaatcttt

SEQ ID NO: 28197 - DNA, 20 bp, Artificial Sequence
  Description of Artificial Sequence: Synthetic oligonucleotide
  Target: SCN9A; (-) strand; PAM type: NRG; PAM sequence: AGG
tttaaaattattttatcatg

SEQ ID NO: 28198 - DNA, 20 bp, Artificial Sequence
  Description of Artificial Sequence: Synthetic oligonucleotide
  Target: SCN9A; (-) strand; PAM type: NRG; PAM sequence: GAG
ttttaaaattattttatcat

SEQ ID NO: 28199 - DNA, 20 bp, Artificial Sequence
  Description of Artificial Sequence: Synthetic oligonucleotide
  Target: SCN9A; (-) strand; PAM type: NRG; PAM sequence: TAG
cttaaagtattattttgcca

SEQ ID NO: 28200 - DNA, 20 bp, Artificial Sequence
  Description of Artificial Sequence: Synthetic oligonucleotide
  Target: SCN9A; (-) strand; PAM type: NRG; PAM sequence: AAG
tatgaaaattgtatatctta

SEQ ID NO: 28201 - DNA, 20 bp, Artificial Sequence
  Description of Artificial Sequence: Synthetic oligonucleotide
  Target: SCN9A; (-) strand; PAM type: NRG; PAM sequence: AAG
tggaaaattagaaaataact

SEQ ID NO: 28202 - DNA, 20 bp, Artificial Sequence
  Description of Artificial Sequence: Synthetic oligonucleotide
  Target: SCN9A; (-) strand; PAM type: NRG; PAM sequence: TAG
aaatttaaattttggaaaat

SEQ ID NO: 28203 - DNA, 20 bp, Artificial Sequence
  Description of Artificial Sequence: Synthetic oligonucleotide
  Target: SCN9A; (-) strand; PAM type: NRG; PAM sequence: TGG
atcagaaaaaatttaaattt

SEQ ID NO: 28204 - DNA, 20 bp, Artificial Sequence
  Description of Artificial Sequence: Synthetic oligonucleotide
  Target: SCN9A; (-) strand; PAM type: NRG; PAM sequence: CAG
attttaataatggtaaaaat

SEQ ID NO: 28205 - DNA, 20 bp, Artificial Sequence
  Description of Artificial Sequence: Synthetic oligonucleotide
  Target: SCN9A; (-) strand; PAM type: NRG; PAM sequence: TGG
tcagtgcagcattttaataa

SEQ ID NO: 28206 - DNA, 20 bp, Artificial Sequence
  Description of Artificial Sequence: Synthetic oligonucleotide
  Target: SCN9A; (-) strand; PAM type: NRG; PAM sequence: CAG
tgatgcacaaatattcagtg

SEQ ID NO: 28207 - DNA, 20 bp, Artificial Sequence
  Description of Artificial Sequence: Synthetic oligonucleotide
  Target: SCN9A; (-) strand; PAM type: NRG; PAM sequence: CAG
aattctgatgcacaaatatt

SEQ ID NO: 28208 - DNA, 20 bp, Artificial Sequence
  Description of Artificial Sequence: Synthetic oligonucleotide
  Target: SCN9A; (-) strand; PAM type: NRG; PAM sequence: CAG
gagggcaatcatctgcaatg

SEQ ID NO: 28209 - DNA, 20 bp, Artificial Sequence
  Description of Artificial Sequence: Synthetic oligonucleotide
  Target: SCN9A; (-) strand; PAM type: NRG; PAM sequence: GGG
gagtctaatgtattagggga

SEQ ID NO: 28210 - DNA, 20 bp, Artificial Sequence
  Description of Artificial Sequence: Synthetic oligonucleotide
  Target: SCN9A; (-) strand; PAM type: NRG; PAM sequence: AGG
ggagtctaatgtattagggg

SEQ ID NO: 28211 - DNA, 20 bp, Artificial Sequence
  Description of Artificial Sequence: Synthetic oligonucleotide
  Target: SCN9A; (-) strand; PAM type: NRG; PAM sequence: GAG
aggagtctaatgtattaggg

SEQ ID NO: 28212 - DNA, 20 bp, Artificial Sequence
  Description of Artificial Sequence: Synthetic oligonucleotide
  Target: SCN9A; (-) strand; PAM type: NRG; PAM sequence: GGG
caaggagtctaatgtattag

SEQ ID NO: 28213 - DNA, 20 bp, Artificial Sequence
  Description of Artificial Sequence: Synthetic oligonucleotide
  Target: SCN9A; (-) strand; PAM type: NRG; PAM sequence: GGG
tcaaggagtctaatgtatta

SEQ ID NO: 28214 - DNA, 20 bp, Artificial Sequence
  Description of Artificial Sequence: Synthetic oligonucleotide
  Target: SCN9A; (-) strand; PAM type: NRG; PAM sequence: AGG
ttcaaggagtctaatgtatt

SEQ ID NO: 28215 - DNA, 20 bp, Artificial Sequence
  Description of Artificial Sequence: Synthetic oligonucleotide
  Target: SCN9A; (-) strand; PAM type: NRG; PAM sequence: TAG
cttcaaggagtctaatgtat

SEQ ID NO: 28216 - DNA, 20 bp, Artificial Sequence
  Description of Artificial Sequence: Synthetic oligonucleotide
  Target: SCN9A; (-) strand; PAM type: NRG; PAM sequence: GAG
cctagttaaatctcttcaag

SEQ ID NO: 28217 - DNA, 20 bp, Artificial Sequence
  Description of Artificial Sequence: Synthetic oligonucleotide
  Target: SCN9A; (-) strand; PAM type: NRG; PAM sequence: AGG
cacctagttaaatctcttca

SEQ ID NO: 28218 - DNA, 20 bp, Artificial Sequence
  Description of Artificial Sequence: Synthetic oligonucleotide
  Target: SCN9A; (-) strand; PAM type: NRG; PAM sequence: AAG
tcacctagttaaatctcttc

SEQ ID NO: 28219 - DNA, 20 bp, Artificial Sequence
  Description of Artificial Sequence: Synthetic oligonucleotide
  Target: SCN9A; (-) strand; PAM type: NRG; PAM sequence: TAG
atttgtctgaaggtttcacc

SEQ ID NO: 28220 - DNA, 20 bp, Artificial Sequence
  Description of Artificial Sequence: Synthetic oligonucleotide
  Target: SCN9A; (-) strand; PAM type: NRG; PAM sequence: AGG
ttgccttaacatttgtctga

SEQ ID NO: 28221 - DNA, 20 bp, Artificial Sequence
  Description of Artificial Sequence: Synthetic oligonucleotide
  Target: SCN9A; (-) strand; PAM type: NRG; PAM sequence: AAG
gttgccttaacatttgtctg

SEQ ID NO: 28222 - DNA, 20 bp, Artificial Sequence
  Description of Artificial Sequence: Synthetic oligonucleotide
  Target: SCN9A; (-) strand; PAM type: NRG; PAM sequence: CAG
acataatttcaaatgtactg

SEQ ID NO: 28223 - DNA, 20 bp, Artificial Sequence
  Description of Artificial Sequence: Synthetic oligonucleotide
  Target: SCN9A; (-) strand; PAM type: NRG; PAM sequence: GAG
tttgagaaggcttgtactaa

SEQ ID NO: 28224 - DNA, 20 bp, Artificial Sequence
  Description of Artificial Sequence: Synthetic oligonucleotide
  Target: SCN9A; (-) strand; PAM type: NRG; PAM sequence: AAG
tgtttgagaaggcttgtact

SEQ ID NO: 28225 - DNA, 20 bp, Artificial Sequence
  Description of Artificial Sequence: Synthetic oligonucleotide
  Target: SCN9A; (-) strand; PAM type: NRG; PAM sequence: AGG
ttcagtgtaaatgtttgaga

SEQ ID NO: 28226 - DNA, 20 bp, Artificial Sequence
  Description of Artificial Sequence: Synthetic oligonucleotide
  Target: SCN9A; (-) strand; PAM type: NRG; PAM sequence: AAG
cttcagtgtaaatgtttgag

SEQ ID NO: 28227 - DNA, 20 bp, Artificial Sequence
  Description of Artificial Sequence: Synthetic oligonucleotide
  Target: SCN9A; (-) strand; PAM type: NRG; PAM sequence: GAG
attcttcagtgtaaatgttt

SEQ ID NO: 28228 - DNA, 20 bp, Artificial Sequence
  Description of Artificial Sequence: Synthetic oligonucleotide
  Target: SCN9A; (-) strand; PAM type: NRG; PAM sequence: CAG
ctctttccagagagattctt

SEQ ID NO: 28229 - DNA, 20 bp, Artificial Sequence
  Description of Artificial Sequence: Synthetic oligonucleotide
  Target: SCN9A; (-) strand; PAM type: NRG; PAM sequence: GAG
tccttaatcctctttccaga

SEQ ID NO: 28230 - DNA, 20 bp, Artificial Sequence
  Description of Artificial Sequence: Synthetic oligonucleotide
  Target: SCN9A; (-) strand; PAM type: NRG; PAM sequence: GAG
cctccttaatcctctttcca

SEQ ID NO: 28231 - DNA, 20 bp, Artificial Sequence
  Description of Artificial Sequence: Synthetic oligonucleotide
  Target: SCN9A; (-) strand; PAM type: NRG; PAM sequence: CAG
ttcctccttaatcctctttc

SEQ ID NO: 28232 - DNA, 20 bp, Artificial Sequence
  Description of Artificial Sequence: Synthetic oligonucleotide
  Target: SCN9A; (-) strand; PAM type: NRG; PAM sequence: AAG
aggttgtcatagattctcga

SEQ ID NO: 28233 - DNA, 20 bp, Artificial Sequence
  Description of Artificial Sequence: Synthetic oligonucleotide
  Target: SCN9A; (-) strand; PAM type: NRG; PAM sequence: TAG
gtggctaatttaggttgtca

SEQ ID NO: 28234 - DNA, 20 bp, Artificial Sequence
  Description of Artificial Sequence: Synthetic oligonucleotide
  Target: SCN9A; (-) strand; PAM type: NRG; PAM sequence: AGG
aattttggtgtggctaattt

SEQ ID NO: 28235 - DNA, 20 bp, Artificial Sequence
  Description of Artificial Sequence: Synthetic oligonucleotide
  Target: SCN9A; (-) strand; PAM type: NRG; PAM sequence: TAG
taattttggtgtggctaatt

SEQ ID NO: 28236 - DNA, 20 bp, Artificial Sequence
  Description of Artificial Sequence: Synthetic oligonucleotide
  Target: SCN9A; (-) strand; PAM type: NRG; PAM sequence: TGG
ttaagaaaataattttggtg

SEQ ID NO: 28237 - DNA, 20 bp, Artificial Sequence
  Description of Artificial Sequence: Synthetic oligonucleotide
  Target: SCN9A; (-) strand; PAM type: NRG; PAM sequence: TGG
agatattaagaaaataattt

SEQ ID NO: 28238 - DNA, 20 bp, Artificial Sequence
  Description of Artificial Sequence: Synthetic oligonucleotide
  Target: SCN9A; (-) strand; PAM type: NRG; PAM sequence: AAG
aagataaaacatgagatatt

SEQ ID NO: 28239 - DNA, 20 bp, Artificial Sequence
  Description of Artificial Sequence: Synthetic oligonucleotide
  Target: SCN9A; (-) strand; PAM type: NRG; PAM sequence: GAG
ggatttttaagataaaacat

SEQ ID NO: 28240 - DNA, 20 bp, Artificial Sequence
  Description of Artificial Sequence: Synthetic oligonucleotide
  Target: SCN9A; (-) strand; PAM type: NRG; PAM sequence: AAG
ttaatgtcacaaggattttt

SEQ ID NO: 28241 - DNA, 20 bp, Artificial Sequence
  Description of Artificial Sequence: Synthetic oligonucleotide
  Target: SCN9A; (-) strand; PAM type: NRG; PAM sequence: AGG
catgttttgttaatgtcaca

SEQ ID NO: 28242 - DNA, 20 bp, Artificial Sequence
  Description of Artificial Sequence: Synthetic oligonucleotide
  Target: SCN9A; (-) strand; PAM type: NRG; PAM sequence: AAG
tcatgttttgttaatgtcac

SEQ ID NO: 28243 - DNA, 20 bp, Artificial Sequence
  Description of Artificial Sequence: Synthetic oligonucleotide
  Target: SCN9A; (-) strand; PAM type: NRG; PAM sequence: CAG
tctatggggtatgactaaaa

SEQ ID NO: 28244 - DNA, 20 bp, Artificial Sequence
  Description of Artificial Sequence: Synthetic oligonucleotide
  Target: SCN9A; (-) strand; PAM type: NRG; PAM sequence: GGG
ttaacagatactcttctatg

SEQ ID NO: 28245 - DNA, 20 bp, Artificial Sequence
  Description of Artificial Sequence: Synthetic oligonucleotide
  Target: SCN9A; (-) strand; PAM type: NRG; PAM sequence: GGG
attaacagatactcttctat

SEQ ID NO: 28246 - DNA, 20 bp, Artificial Sequence
  Description of Artificial Sequence: Synthetic oligonucleotide
  Target: SCN9A; (-) strand; PAM type: NRG; PAM sequence: TGG
aattaacagatactcttcta

SEQ ID NO: 28247 - DNA, 20 bp, Artificial Sequence
  Description of Artificial Sequence: Synthetic oligonucleotide
  Target: SCN9A; (-) strand; PAM type: NRG; PAM sequence: CAG
tattttaacgttaaaattaa

SEQ ID NO: 28248 - DNA, 20 bp, Artificial Sequence
  Description of Artificial Sequence: Synthetic oligonucleotide
  Target: SCN9A; (-) strand; PAM type: NRG; PAM sequence: TGG
agagtaccaattgtatacag

SEQ ID NO: 28249 - DNA, 20 bp, Artificial Sequence
  Description of Artificial Sequence: Synthetic oligonucleotide
  Target: SCN9A; (-) strand; PAM type: NRG; PAM sequence: CAG
cccagagtaccaattgtata

SEQ ID NO: 28250 - DNA, 20 bp, Artificial Sequence
  Description of Artificial Sequence: Synthetic oligonucleotide
  Target: SCN9A; (-) strand; PAM type: NRG; PAM sequence: GAG
acacacaatggatttcccca

SEQ ID NO: 28251 - DNA, 20 bp, Artificial Sequence
  Description of Artificial Sequence: Synthetic oligonucleotide
  Target: SCN9A; (-) strand; PAM type: NRG; PAM sequence: CAG
atacacacaatggatttccc

SEQ ID NO: 28252 - DNA, 20 bp, Artificial Sequence
  Description of Artificial Sequence: Synthetic oligonucleotide
  Target: SCN9A; (-) strand; PAM type: NRG; PAM sequence: TGG
atatacacacatacacacaa

SEQ ID NO: 28253 - DNA, 20 bp, Artificial Sequence
  Description of Artificial Sequence: Synthetic oligonucleotide
  Target: SCN9A; (-) strand; PAM type: NRG; PAM sequence: CAG
aattgattaaataatatagt

SEQ ID NO: 28254 - DNA, 20 bp, Artificial Sequence
  Description of Artificial Sequence: Synthetic oligonucleotide
  Target: SCN9A; (-) strand; PAM type: NRG; PAM sequence: TAG
gaataattgattaaataata

SEQ ID NO: 28255 - DNA, 20 bp, Artificial Sequence
  Description of Artificial Sequence: Synthetic oligonucleotide
  Target: SCN9A; (-) strand; PAM type: NRG; PAM sequence: TAG
tatcatgaggaaaaatcttt

SEQ ID NO: 28256 - DNA, 20 bp, Artificial Sequence
  Description of Artificial Sequence: Synthetic oligonucleotide
  Target: SCN9A; (-) strand; PAM type: NRG; PAM sequence: AGG
ttttaaattattatatcatg

SEQ ID NO: 28257 - DNA, 20 bp, Artificial Sequence
  Description of Artificial Sequence: Synthetic oligonucleotide
  Target: SCN9A; (-) strand; PAM type: NRG; PAM sequence: GAG
tttttaaattattatatcat

SEQ ID NO: 28258 - DNA, 20 bp, Artificial Sequence
  Description of Artificial Sequence: Synthetic oligonucleotide
  Target: SCN9A; (-) strand; PAM type: NRG; PAM sequence: TGG
tatatatatatataaacaca

SEQ ID NO: 28259 - DNA, 20 bp, Artificial Sequence
  Description of Artificial Sequence: Synthetic oligonucleotide
  Target: SCN9A; (-) strand; PAM type: NRG; PAM sequence: TAG
accttttacctacaatgact

SEQ ID NO: 28260 - DNA, 20 bp, Artificial Sequence
  Description of Artificial Sequence: Synthetic oligonucleotide
  Target: SCN9A; (-) strand; PAM type: NRG; PAM sequence: AGG
actgcatgaaaagtgatcta

SEQ ID NO: 28261 - DNA, 20 bp, Artificial Sequence
  Description of Artificial Sequence: Synthetic oligonucleotide
  Target: SCN9A; (-) strand; PAM type: NRG; PAM sequence: AAG
cactgcatgaaaagtgatct

SEQ ID NO: 28262 - DNA, 20 bp, Artificial Sequence
  Description of Artificial Sequence: Synthetic oligonucleotide
  Target: SCN9A; (-) strand; PAM type: NRG; PAM sequence: AAG
taatcatctcactgcatgaa

SEQ ID NO: 28263 - DNA, 20 bp, Artificial Sequence
  Description of Artificial Sequence: Synthetic oligonucleotide
  Target: SCN9A; (-) strand; PAM type: NRG; PAM sequence: TAG
gaaccaattctgggctgagc

SEQ ID NO: 28264 - DNA, 20 bp, Artificial Sequence
  Description of Artificial Sequence: Synthetic oligonucleotide
  Target: SCN9A; (-) strand; PAM type: NRG; PAM sequence: GAG
aaaggaaccaattctgggct

SEQ ID NO: 28265 - DNA, 20 bp, Artificial Sequence
  Description of Artificial Sequence: Synthetic oligonucleotide
  Target: SCN9A; (-) strand; PAM type: NRG; PAM sequence: GGG
tggaaaaaggaaccaattct

SEQ ID NO: 28266 - DNA, 20 bp, Artificial Sequence
  Description of Artificial Sequence: Synthetic oligonucleotide
  Target: SCN9A; (-) strand; PAM type: NRG; PAM sequence: TGG
gtggaaaaaggaaccaattc

SEQ ID NO: 28267 - DNA, 20 bp, Artificial Sequence
  Description of Artificial Sequence: Synthetic oligonucleotide
  Target: SCN9A; (-) strand; PAM type: NRG; PAM sequence: AGG
ctcatttctggtgtggaaaa

SEQ ID NO: 28268 - DNA, 20 bp, Artificial Sequence
  Description of Artificial Sequence: Synthetic oligonucleotide
  Target: SCN9A; (-) strand; PAM type: NRG; PAM sequence: AAG
cctcatttctggtgtggaaa

SEQ ID NO: 28269 - DNA, 20 bp, Artificial Sequence
  Description of Artificial Sequence: Synthetic oligonucleotide
  Target: SCN9A; (-) strand; PAM type: NRG; PAM sequence: TGG
ctgtatcctcatttctggtg

SEQ ID NO: 28270 - DNA, 20 bp, Artificial Sequence
  Description of Artificial Sequence: Synthetic oligonucleotide
  Target: SCN9A; (-) strand; PAM type: NRG; PAM sequence: TGG
ataaactgtatcctcatttc

SEQ ID NO: 28271 - DNA, 20 bp, Artificial Sequence
  Description of Artificial Sequence: Synthetic oligonucleotide
  Target: SCN9A; (-) strand; PAM type: NRG; PAM sequence: TAG
tatgcttggccttctccagc

SEQ ID NO: 28272 - DNA, 20 bp, Artificial Sequence
  Description of Artificial Sequence: Synthetic oligonucleotide
  Target: SCN9A; (-) strand; PAM type: NRG; PAM sequence: CAG
ggtatatgcttggccttctc

SEQ ID NO: 28273 - DNA, 20 bp, Artificial Sequence
  Description of Artificial Sequence: Synthetic oligonucleotide
  Target: SCN9A; (-) strand; PAM type: NRG; PAM sequence: TGG
gaggctctgcggtatatgct

SEQ ID NO: 28274 - DNA, 20 bp, Artificial Sequence
  Description of Artificial Sequence: Synthetic oligonucleotide
  Target: SCN9A; (-) strand; PAM type: NRG; PAM sequence: CGG
cggttacaacagaggctctg

SEQ ID NO: 28275 - DNA, 20 bp, Artificial Sequence
  Description of Artificial Sequence: Synthetic oligonucleotide
  Target: SCN9A; (-) strand; PAM type: NRG; PAM sequence: AGG
aatgcaaacggttacaacag

SEQ ID NO: 28276 - DNA, 20 bp, Artificial Sequence
  Description of Artificial Sequence: Synthetic oligonucleotide
  Target: SCN9A; (-) strand; PAM type: NRG; PAM sequence: GAG
aaatgcaaacggttacaaca

SEQ ID NO: 28277 - DNA, 20 bp, Artificial Sequence
  Description of Artificial Sequence: Synthetic oligonucleotide
  Target: SCN9A; (-) strand; PAM type: NRG; PAM sequence: CAG
agaaatgcaaacggttacaa

SEQ ID NO: 28278 - DNA, 20 bp, Artificial Sequence
  Description of Artificial Sequence: Synthetic oligonucleotide
  Target: SCN9A; (-) strand; PAM type: NRG; PAM sequence: CGG
cctagaggtagaaatgcaaa

SEQ ID NO: 28279 - DNA, 20 bp, Artificial Sequence
  Description of Artificial Sequence: Synthetic oligonucleotide
  Target: SCN9A; (-) strand; PAM type: NRG; PAM sequence: TAG
tttaaaattcttcctagagg

SEQ ID NO: 28280 - DNA, 20 bp, Artificial Sequence
  Description of Artificial Sequence: Synthetic oligonucleotide
  Target: SCN9A; (-) strand; PAM type: NRG; PAM sequence: AGG
tgatttaaaattcttcctag

SEQ ID NO: 28281 - DNA, 20 bp, Artificial Sequence
  Description of Artificial Sequence: Synthetic oligonucleotide
  Target: SCN9A; (-) strand; PAM type: NRG; PAM sequence: GAG
ttgatttaaaattcttccta

SEQ ID NO: 28282 - DNA, 20 bp, Artificial Sequence
  Description of Artificial Sequence: Synthetic oligonucleotide
  Target: SCN9A; (-) strand; PAM type: NRG; PAM sequence: TAG
atttgatttaaaattcttcc

SEQ ID NO: 28283 - DNA, 20 bp, Artificial Sequence
  Description of Artificial Sequence: Synthetic oligonucleotide
  Target: SCN9A; (-) strand; PAM type: NRG; PAM sequence: AGG
aaaagagcaagaagaagctg

SEQ ID NO: 28284 - DNA, 20 bp, Artificial Sequence
  Description of Artificial Sequence: Synthetic oligonucleotide
  Target: SCN9A; (-) strand; PAM type: NRG; PAM sequence: GAG
aaaaagagcaagaagaagct

SEQ ID NO: 28285 - DNA, 20 bp, Artificial Sequence
  Description of Artificial Sequence: Synthetic oligonucleotide
  Target: SCN9A; (-) strand; PAM type: NRG; PAM sequence: AAG
tcttaaaaaagagcaagaag

SEQ ID NO: 28286 - DNA, 20 bp, Artificial Sequence
  Description of Artificial Sequence: Synthetic oligonucleotide
  Target: SCN9A; (-) strand; PAM type: NRG; PAM sequence: AAG
ccgtcttaaaaaagagcaag

SEQ ID NO: 28287 - DNA, 20 bp, Artificial Sequence
  Description of Artificial Sequence: Synthetic oligonucleotide
  Target: SCN9A; (-) strand; PAM type: NRG; PAM sequence: AAG
agaccgtcttaaaaaagagc

SEQ ID NO: 28288 - DNA, 20 bp, Artificial Sequence
  Description of Artificial Sequence: Synthetic oligonucleotide
  Target: SCN9A; (-) strand; PAM type: NRG; PAM sequence: GAG
tgttagaccgtcttaaaaaa

SEQ ID NO: 28289 - DNA, 20 bp, Artificial Sequence
  Description of Artificial Sequence: Synthetic oligonucleotide
  Target: SCN9A; (-) strand; PAM type: NRG; PAM sequence: AAG
gatgttagaccgtcttaaaa

SEQ ID NO: 28290 - DNA, 20 bp, Artificial Sequence
  Description of Artificial Sequence: Synthetic oligonucleotide
  Target: SCN9A; (-) strand; PAM type: NRG; PAM sequence: TAG
attagaatttcaacagatgt

SEQ ID NO: 28291 - DNA, 20 bp, Artificial Sequence
  Description of Artificial Sequence: Synthetic oligonucleotide
  Target: SCN9A; (-) strand; PAM type: NRG; PAM sequence: CAG
agaaagaattagaatttcaa

SEQ ID NO: 28292 - DNA, 20 bp, Artificial Sequence
  Description of Artificial Sequence: Synthetic oligonucleotide
  Target: SCN9A; (-) strand; PAM type: NRG; PAM sequence: TAG
agaagctaaacagaaagaat

SEQ ID NO: 28293 - DNA, 20 bp, Artificial Sequence
  Description of Artificial Sequence: Synthetic oligonucleotide
  Target: SCN9A; (-) strand; PAM type: NRG; PAM sequence: AAG
cattgaagaagctaaacaga

SEQ ID NO: 28294 - DNA, 20 bp, Artificial Sequence
  Description of Artificial Sequence: Synthetic oligonucleotide
  Target: SCN9A; (-) strand; PAM type: NRG; PAM sequence: CAG
caaacattgaagaagctaaa

SEQ ID NO: 28295 - DNA, 20 bp, Artificial Sequence
  Description of Artificial Sequence: Synthetic oligonucleotide
  Target: SCN9A; (-) strand; PAM type: NRG; PAM sequence: AAG
gaaccaggcaaacattgaag

SEQ ID NO: 28296 - DNA, 20 bp, Artificial Sequence
  Description of Artificial Sequence: Synthetic oligonucleotide
  Target: SCN9A; (-) strand; PAM type: NRG; PAM sequence: AAG
acagaaccaggcaaacattg

SEQ ID NO: 28297 - DNA, 20 bp, Artificial Sequence
  Description of Artificial Sequence: Synthetic oligonucleotide
  Target: SCN9A; (-) strand; PAM type: NRG; PAM sequence: AGG
ggcatatgaagaacagaacc

SEQ ID NO: 28298 - DNA, 20 bp, Artificial Sequence
  Description of Artificial Sequence: Synthetic oligonucleotide
  Target: SCN9A; (-) strand; PAM type: NRG; PAM sequence: CAG
tggcatatgaagaacagaac

SEQ ID NO: 28299 - DNA, 20 bp, Artificial Sequence
  Description of Artificial Sequence: Synthetic oligonucleotide
  Target: SCN9A; (-) strand; PAM type: NRG; PAM sequence: CAG
ttgccatggcatatgaagaa

SEQ ID NO: 28300 - DNA, 20 bp, Artificial Sequence
  Description of Artificial Sequence: Synthetic oligonucleotide
  Target: SCN9A; (-) strand; PAM type: NRG; PAM sequence: AAG
tgtggttgccatggcatatg

SEQ ID NO: 28301 - DNA, 20 bp, Artificial Sequence
  Description of Artificial Sequence: Synthetic oligonucleotide
  Target: SCN9A; (-) strand; PAM type: NRG; PAM sequence: TGG
gatcctggctgtggttgcca

SEQ ID NO: 28302 - DNA, 20 bp, Artificial Sequence
  Description of Artificial Sequence: Synthetic oligonucleotide
  Target: SCN9A; (-) strand; PAM type: NRG; PAM sequence: TGG
aataaacttgatcctggctg

SEQ ID NO: 28303 - DNA, 20 bp, Artificial Sequence
  Description of Artificial Sequence: Synthetic oligonucleotide
  Target: SCN9A; (-) strand; PAM type: NRG; PAM sequence: TGG
ttatctaataaacttgatcc

SEQ ID NO: 28304 - DNA, 20 bp, Artificial Sequence
  Description of Artificial Sequence: Synthetic oligonucleotide
  Target: SCN9A; (-) strand; PAM type: NRG; PAM sequence: GGG
tttgtcgtagtgattttcct

SEQ ID NO: 28305 - DNA, 20 bp, Artificial Sequence
  Description of Artificial Sequence: Synthetic oligonucleotide
  Target: SCN9A; (-) strand; PAM type: NRG; PAM sequence: TGG
ctttgtcgtagtgattttcc

SEQ ID NO: 28306 - DNA, 20 bp, Artificial Sequence
  Description of Artificial Sequence: Synthetic oligonucleotide
  Target: SCN9A; (-) strand; PAM type: NRG; PAM sequence: TAG
ctacatgatcttctttgtcg

SEQ ID NO: 28307 - DNA, 20 bp, Artificial Sequence
  Description of Artificial Sequence: Synthetic oligonucleotide
  Target: SCN9A; (-) strand; PAM type: NRG; PAM sequence: TGG
ccctagacgctgcgtgctgc

SEQ ID NO: 28308 - DNA, 20 bp, Artificial Sequence
  Description of Artificial Sequence: Synthetic oligonucleotide
  Target: SCN9A; (-) strand; PAM type: NRG; PAM sequence: TAG
tgacaatttccatttttccc

SEQ ID NO: 28309 - DNA, 20 bp, Artificial Sequence
  Description of Artificial Sequence: Synthetic oligonucleotide
  Target: SCN9A; (-) strand; PAM type: NRG; PAM sequence: CAG
atgagattataccaaactgt

SEQ ID NO: 28310 - DNA, 20 bp, Artificial Sequence
  Description of Artificial Sequence: Synthetic oligonucleotide
  Target: SCN9A; (-) strand; PAM type: NRG; PAM sequence: GAG
ctttatatttttgataacat

SEQ ID NO: 28311 - DNA, 20 bp, Artificial Sequence
  Description of Artificial Sequence: Synthetic oligonucleotide
  Target: SCN9A; (-) strand; PAM type: NRG; PAM sequence: AAG
tttaatatttgttttccatg

SEQ ID NO: 28312 - DNA, 20 bp, Artificial Sequence
  Description of Artificial Sequence: Synthetic oligonucleotide
  Target: SCN9A; (-) strand; PAM type: NRG; PAM sequence: AAG
atcttacatgactttagtac

SEQ ID NO: 28313 - DNA, 20 bp, Artificial Sequence
  Description of Artificial Sequence: Synthetic oligonucleotide
  Target: SCN9A; (-) strand; PAM type: NRG; PAM sequence: TAG
tcaagaatcttacatgactt

SEQ ID NO: 28314 - DNA, 20 bp, Artificial Sequence
  Description of Artificial Sequence: Synthetic oligonucleotide
  Target: SCN9A; (-) strand; PAM type: NRG; PAM sequence: AAG
tactactacacttaataatc

SEQ ID NO: 28315 - DNA, 20 bp, Artificial Sequence
  Description of Artificial Sequence: Synthetic oligonucleotide
  Target: SCN9A; (-) strand; PAM type: NRG; PAM sequence: AGG
atgagtaattttcagactgt

SEQ ID NO: 28316 - DNA, 20 bp, Artificial Sequence
  Description of Artificial Sequence: Synthetic oligonucleotide
  Target: SCN9A; (-) strand; PAM type: NRG; PAM sequence: TAG
tatgagtaattttcagactg

SEQ ID NO: 28317 - DNA, 20 bp, Artificial Sequence
  Description of Artificial Sequence: Synthetic oligonucleotide
  Target: SCN9A; (-) strand; PAM type: NRG; PAM sequence: CAG
ttaattttatgagtaatttt

SEQ ID NO: 28318 - DNA, 20 bp, Artificial Sequence
  Description of Artificial Sequence: Synthetic oligonucleotide
  Target: SCN9A; (-) strand; PAM type: NRG; PAM sequence: GAG
agcaaaggatttaattttat

SEQ ID NO: 28319 - DNA, 20 bp, Artificial Sequence
  Description of Artificial Sequence: Synthetic oligonucleotide
  Target: SCN9A; (-) strand; PAM type: NRG; PAM sequence: AGG
taaaatttgaaagtgagcaa

SEQ ID NO: 28320 - DNA, 20 bp, Artificial Sequence
  Description of Artificial Sequence: Synthetic oligonucleotide
  Target: SCN9A; (-) strand; PAM type: NRG; PAM sequence: AAG
ctaaaatttgaaagtgagca

SEQ ID NO: 28321 - DNA, 20 bp, Artificial Sequence
  Description of Artificial Sequence: Synthetic oligonucleotide
  Target: SCN9A; (-) strand; PAM type: NRG; PAM sequence: GAG
tgttcctaaaatttgaaagt

SEQ ID NO: 28322 - DNA, 20 bp, Artificial Sequence
  Description of Artificial Sequence: Synthetic oligonucleotide
  Target: SCN9A; (-) strand; PAM type: NRG; PAM sequence: AAG
cacctgttcctaaaatttga

SEQ ID NO: 28323 - DNA, 20 bp, Artificial Sequence
  Description of Artificial Sequence: Synthetic oligonucleotide
  Target: SCN9A; (-) strand; PAM type: NRG; PAM sequence: TGG
tttaacagtaaaagggacta

SEQ ID NO: 28324 - DNA, 20 bp, Artificial Sequence
  Description of Artificial Sequence: Synthetic oligonucleotide
  Target: SCN9A; (-) strand; PAM type: NRG; PAM sequence: GGG
atagaattttaacagtaaaa

SEQ ID NO: 28325 - DNA, 20 bp, Artificial Sequence
  Description of Artificial Sequence: Synthetic oligonucleotide
  Target: SCN9A; (-) strand; PAM type: NRG; PAM sequence: AGG
gatagaattttaacagtaaa

SEQ ID NO: 28326 - DNA, 20 bp, Artificial Sequence
  Description of Artificial Sequence: Synthetic oligonucleotide
  Target: SCN9A; (-) strand; PAM type: NRG; PAM sequence: AAG
agatagaattttaacagtaa

SEQ ID NO: 28327 - DNA, 20 bp, Artificial Sequence
  Description of Artificial Sequence: Synthetic oligonucleotide
  Target: SCN9A; (-) strand; PAM type: NRG; PAM sequence: CAG
aagaaaagatagaattttaa

SEQ ID NO: 28328 - DNA, 20 bp, Artificial Sequence
  Description of Artificial Sequence: Synthetic oligonucleotide
  Target: SCN9A; (-) strand; PAM type: NRG; PAM sequence: TAG
gatgataaagaaagaaaaga

SEQ ID NO: 28329 - DNA, 20 bp, Artificial Sequence
  Description of Artificial Sequence: Synthetic oligonucleotide
  Target: SCN9A; (-) strand; PAM type: NRG; PAM sequence: AAG
atttgatgataaagaaagaa

SEQ ID NO: 28330 - DNA, 20 bp, Artificial Sequence
  Description of Artificial Sequence: Synthetic oligonucleotide
  Target: SCN9A; (-) strand; PAM type: NRG; PAM sequence: AAG
ttaatatttgatgataaaga

SEQ ID NO: 28331 - DNA, 20 bp, Artificial Sequence
  Description of Artificial Sequence: Synthetic oligonucleotide
  Target: SCN9A; (-) strand; PAM type: NRG; PAM sequence: AAG
attattaatatttgatgata

SEQ ID NO: 28332 - DNA, 20 bp, Artificial Sequence
  Description of Artificial Sequence: Synthetic oligonucleotide
  Target: SCN9A; (-) strand; PAM type: NRG; PAM sequence: TAG
attaaataagaccatctgcc

SEQ ID NO: 28333 - DNA, 20 bp, Artificial Sequence
  Description of Artificial Sequence: Synthetic oligonucleotide
  Target: SCN9A; (-) strand; PAM type: NRG; PAM sequence: AAG
gatgaataaagtaattaaat

SEQ ID NO: 28334 - DNA, 20 bp, Artificial Sequence
  Description of Artificial Sequence: Synthetic oligonucleotide
  Target: SCN9A; (-) strand; PAM type: NRG; PAM sequence: AAG
aaatacctatgagatgaata

SEQ ID NO: 28335 - DNA, 20 bp, Artificial Sequence
  Description of Artificial Sequence: Synthetic oligonucleotide
  Target: SCN9A; (-) strand; PAM type: NRG; PAM sequence: GAG
agttaattgaaaatacctat

SEQ ID NO: 28336 - DNA, 20 bp, Artificial Sequence
  Description of Artificial Sequence: Synthetic oligonucleotide
  Target: SCN9A; (-) strand; PAM type: NRG; PAM sequence: AAG
agcaaagaaagcgaaaaaaa

SEQ ID NO: 28337 - DNA, 20 bp, Artificial Sequence
  Description of Artificial Sequence: Synthetic oligonucleotide
  Target: SCN9A; (-) strand; PAM type: NRG; PAM sequence: AAG
tctattttaaaaagcaaaga

SEQ ID NO: 28338 - DNA, 20 bp, Artificial Sequence
  Description of Artificial Sequence: Synthetic oligonucleotide
  Target: SCN9A; (-) strand; PAM type: NRG; PAM sequence: AAG
aaattctattttaaaaagca

SEQ ID NO: 28339 - DNA, 20 bp, Artificial Sequence
  Description of Artificial Sequence: Synthetic oligonucleotide
  Target: SCN9A; (-) strand; PAM type: NRG; PAM sequence: AAG
aaaaaaaattctattttaaa

SEQ ID NO: 28340 - DNA, 20 bp, Artificial Sequence
  Description of Artificial Sequence: Synthetic oligonucleotide
  Target: SCN9A; (-) strand; PAM type: NRG; PAM sequence: CAG
aaaaaaaatctctgtacctt

SEQ ID NO: 28341 - DNA, 20 bp, Artificial Sequence
  Description of Artificial Sequence: Synthetic oligonucleotide
  Target: SCN9A; (-) strand; PAM type: NRG; PAM sequence: AAG
tatgccaaaaaaaagaaaaa

SEQ ID NO: 28342 - DNA, 20 bp, Artificial Sequence
  Description of Artificial Sequence: Synthetic oligonucleotide
  Target: SCN9A; (-) strand; PAM type: NRG; PAM sequence: AAG
ctgcacgttatgccaaaaaa

SEQ ID NO: 28343 - DNA, 20 bp, Artificial Sequence
  Description of Artificial Sequence: Synthetic oligonucleotide
  Target: SCN9A; (-) strand; PAM type: NRG; PAM sequence: TGG
atgggtgcagcaaaccacca

SEQ ID NO: 28344 - DNA, 20 bp, Artificial Sequence
  Description of Artificial Sequence: Synthetic oligonucleotide
  Target: SCN9A; (-) strand; PAM type: NRG; PAM sequence: CAG
aggtaacaggttgatgggtg

SEQ ID NO: 28345 - DNA, 20 bp, Artificial Sequence
  Description of Artificial Sequence: Synthetic oligonucleotide
  Target: SCN9A; (-) strand; PAM type: NRG; PAM sequence: GGG
aatgtaggtaacaggttgat

SEQ ID NO: 28346 - DNA, 20 bp, Artificial Sequence
  Description of Artificial Sequence: Synthetic oligonucleotide
  Target: SCN9A; (-) strand; PAM type: NRG; PAM sequence: TGG
taatgtaggtaacaggttga

SEQ ID NO: 28347 - DNA, 20 bp, Artificial Sequence
  Description of Artificial Sequence: Synthetic oligonucleotide
  Target: SCN9A; (-) strand; PAM type: NRG; PAM sequence: AGG
acatacctaatgtaggtaac

SEQ ID NO: 28348 - DNA, 20 bp, Artificial Sequence
  Description of Artificial Sequence: Synthetic oligonucleotide
  Target: SCN9A; (-) strand; PAM type: NRG; PAM sequence: CAG
gacatacctaatgtaggtaa

SEQ ID NO: 28349 - DNA, 20 bp, Artificial Sequence
  Description of Artificial Sequence: Synthetic oligonucleotide
  Target: SCN9A; (-) strand; PAM type: NRG; PAM sequence: AGG
ttaggagacatacctaatgt

SEQ ID NO: 28350 - DNA, 20 bp, Artificial Sequence
  Description of Artificial Sequence: Synthetic oligonucleotide
  Target: SCN9A; (-) strand; PAM type: NRG; PAM sequence: TAG
attaggagacatacctaatg

SEQ ID NO: 28351 - DNA, 20 bp, Artificial Sequence
  Description of Artificial Sequence: Synthetic oligonucleotide
  Target: SCN9A; (-) strand; PAM type: NRG; PAM sequence: GAG
aaagggaggaatagcattag

SEQ ID NO: 28352 - DNA, 20 bp, Artificial Sequence
  Description of Artificial Sequence: Synthetic oligonucleotide
  Target: SCN9A; (-) strand; PAM type: NRG; PAM sequence: AGG
gcaaagggaggaatagcatt

SEQ ID NO: 28353 - DNA, 20 bp, Artificial Sequence
  Description of Artificial Sequence: Synthetic oligonucleotide
  Target: SCN9A; (-) strand; PAM type: NRG; PAM sequence: TAG
ggcaaagggaggaatagcat

SEQ ID NO: 28354 - DNA, 20 bp, Artificial Sequence
  Description of Artificial Sequence: Synthetic oligonucleotide
  Target: SCN9A; (-) strand; PAM type: NRG; PAM sequence: TAG
gtggggggcaaagggaggaa

SEQ ID NO: 28355 - DNA, 20 bp, Artificial Sequence
  Description of Artificial Sequence: Synthetic oligonucleotide
  Target: SCN9A; (-) strand; PAM type: NRG; PAM sequence: AGG
cggtggtggggggcaaaggg

SEQ ID NO: 28356 - DNA, 20 bp, Artificial Sequence
  Description of Artificial Sequence: Synthetic oligonucleotide
  Target: SCN9A; (-) strand; PAM type: NRG; PAM sequence: GAG
tcggtggtggggggcaaagg

SEQ ID NO: 28357 - DNA, 20 bp, Artificial Sequence
  Description of Artificial Sequence: Synthetic oligonucleotide
  Target: SCN9A; (-) strand; PAM type: NRG; PAM sequence: GGG
tgtcggtggtggggggcaaa

SEQ ID NO: 28358 - DNA, 20 bp, Artificial Sequence
  Description of Artificial Sequence: Synthetic oligonucleotide
  Target: SCN9A; (-) strand; PAM type: NRG; PAM sequence: AGG
ctgtcggtggtggggggcaa

SEQ ID NO: 28359 - DNA, 20 bp, Artificial Sequence
  Description of Artificial Sequence: Synthetic oligonucleotide
  Target: SCN9A; (-) strand; PAM type: NRG; PAM sequence: AAG
cctgtcggtggtggggggca

SEQ ID NO: 28360 - DNA, 20 bp, Artificial Sequence
  Description of Artificial Sequence: Synthetic oligonucleotide
  Target: SCN9A; (-) strand; PAM type: NRG; PAM sequence: GGG
tggggcctgtcggtggtggg

SEQ ID NO: 28361 - DNA, 20 bp, Artificial Sequence
  Description of Artificial Sequence: Synthetic oligonucleotide
  Target: SCN9A; (-) strand; PAM type: NRG; PAM sequence: GGG
ctggggcctgtcggtggtgg

SEQ ID NO: 28362 - DNA, 20 bp, Artificial Sequence
  Description of Artificial Sequence: Synthetic oligonucleotide
  Target: SCN9A; (-) strand; PAM type: NRG; PAM sequence: GGG
actggggcctgtcggtggtg

SEQ ID NO: 28363 - DNA, 20 bp, Artificial Sequence
  Description of Artificial Sequence: Synthetic oligonucleotide
  Target: SCN9A; (-) strand; PAM type: NRG; PAM sequence: GGG
cactggggcctgtcggtggt

SEQ ID NO: 28364 - DNA, 20 bp, Artificial Sequence
  Description of Artificial Sequence: Synthetic oligonucleotide
  Target: SCN9A; (-) strand; PAM type: NRG; PAM sequence: TGG
acactggggcctgtcggtgg

SEQ ID NO: 28365 - DNA, 20 bp, Artificial Sequence
  Description of Artificial Sequence: Synthetic oligonucleotide
  Target: SCN9A; (-) strand; PAM type: NRG; PAM sequence: TGG
cacacactggggcctgtcgg

SEQ ID NO: 28366 - DNA, 20 bp, Artificial Sequence
  Description of Artificial Sequence: Synthetic oligonucleotide
  Target: SCN9A; (-) strand; PAM type: NRG; PAM sequence: CGG
catcacacactggggcctgt

SEQ ID NO: 28367 - DNA, 20 bp, Artificial Sequence
  Description of Artificial Sequence: Synthetic oligonucleotide
  Target: SCN9A; (-) strand; PAM type: NRG; PAM sequence: GGG
gagaagatcatcacacactg

SEQ ID NO: 28368 - DNA, 20 bp, Artificial Sequence
  Description of Artificial Sequence: Synthetic oligonucleotide
  Target: SCN9A; (-) strand; PAM type: NRG; PAM sequence: GGG
tgagaagatcatcacacact

SEQ ID NO: 28369 - DNA, 20 bp, Artificial Sequence
  Description of Artificial Sequence: Synthetic oligonucleotide
  Target: SCN9A; (-) strand; PAM type: NRG; PAM sequence: TGG
atgagaagatcatcacacac

SEQ ID NO: 28370 - DNA, 20 bp, Artificial Sequence
  Description of Artificial Sequence: Synthetic oligonucleotide
  Target: SCN9A; (-) strand; PAM type: NRG; PAM sequence: AAG
gagaacacatgggcaatgag

SEQ ID NO: 28371 - DNA, 20 bp, Artificial Sequence
  Description of Artificial Sequence: Synthetic oligonucleotide
  Target: SCN9A; (-) strand; PAM type: NRG; PAM sequence: GAG
aatgagaacacatgggcaat

SEQ ID NO: 28372 - DNA, 20 bp, Artificial Sequence
  Description of Artificial Sequence: Synthetic oligonucleotide
  Target: SCN9A; (-) strand; PAM type: NRG; PAM sequence: GGG
ggtgggcaatgagaacacat

SEQ ID NO: 28373 - DNA, 20 bp, Artificial Sequence
  Description of Artificial Sequence: Synthetic oligonucleotide
  Target: SCN9A; (-) strand; PAM type: NRG; PAM sequence: TGG
aggtgggcaatgagaacaca

SEQ ID NO: 28374 - DNA, 20 bp, Artificial Sequence
  Description of Artificial Sequence: Synthetic oligonucleotide
  Target: SCN9A; (-) strand; PAM type: NRG; PAM sequence: GAG
atgagtgagaggtgggcaat

SEQ ID NO: 28375 - DNA, 20 bp, Artificial Sequence
  Description of Artificial Sequence: Synthetic oligonucleotide
  Target: SCN9A; (-) strand; PAM type: NRG; PAM sequence: GGG
ctcactcatgagtgagaggt

SEQ ID NO: 28376 - DNA, 20 bp, Artificial Sequence
  Description of Artificial Sequence: Synthetic oligonucleotide
  Target: SCN9A; (-) strand; PAM type: NRG; PAM sequence: TGG
tctcactcatgagtgagagg

SEQ ID NO: 28377 - DNA, 20 bp, Artificial Sequence
  Description of Artificial Sequence: Synthetic oligonucleotide
  Target: SCN9A; (-) strand; PAM type: NRG; PAM sequence: AGG
tgttctcactcatgagtgag

SEQ ID NO: 28378 - DNA, 20 bp, Artificial Sequence
  Description of Artificial Sequence: Synthetic oligonucleotide
  Target: SCN9A; (-) strand; PAM type: NRG; PAM sequence: GAG
atgttctcactcatgagtga

SEQ ID NO: 28379 - DNA, 20 bp, Artificial Sequence
  Description of Artificial Sequence: Synthetic oligonucleotide
  Target: SCN9A; (-) strand; PAM type: NRG; PAM sequence: GAG
gcatgttctcactcatgagt

SEQ ID NO: 28380 - DNA, 20 bp, Artificial Sequence
  Description of Artificial Sequence: Synthetic oligonucleotide
  Target: SCN9A; (-) strand; PAM type: NRG; PAM sequence: GAG
caacgcatgttctcactcat

SEQ ID NO: 28381 - DNA, 20 bp, Artificial Sequence
  Description of Artificial Sequence: Synthetic oligonucleotide
  Target: SCN9A; (-) strand; PAM type: NRG; PAM sequence: CAG
tcagcaaactaaaacaggaa

SEQ ID NO: 28382 - DNA, 20 bp, Artificial Sequence
  Description of Artificial Sequence: Synthetic oligonucleotide
  Target: SCN9A; (-) strand; PAM type: NRG; PAM sequence: AGG
cattctcagcaaactaaaac

SEQ ID NO: 28383 - DNA, 20 bp, Artificial Sequence
  Description of Artificial Sequence: Synthetic oligonucleotide
  Target: SCN9A; (-) strand; PAM type: NRG; PAM sequence: CAG
tcattctcagcaaactaaaa

SEQ ID NO: 28384 - DNA, 20 bp, Artificial Sequence
  Description of Artificial Sequence: Synthetic oligonucleotide
  Target: SCN9A; (-) strand; PAM type: NRG; PAM sequence: CAG
aagctagaaaccatcattct

SEQ ID NO: 28385 - DNA, 20 bp, Artificial Sequence
  Description of Artificial Sequence: Synthetic oligonucleotide
  Target: SCN9A; (-) strand; PAM type: NRG; PAM sequence: TAG
tgcagggacatggatgaagc

SEQ ID NO: 28386 - DNA, 20 bp, Artificial Sequence
  Description of Artificial Sequence: Synthetic oligonucleotide
  Target: SCN9A; (-) strand; PAM type: NRG; PAM sequence: AAG
cctttgcagggacatggatg

SEQ ID NO: 28387 - DNA, 20 bp, Artificial Sequence
  Description of Artificial Sequence: Synthetic oligonucleotide
  Target: SCN9A; (-) strand; PAM type: NRG; PAM sequence: TGG
tcatgtcctttgcagggaca

SEQ ID NO: 28388 - DNA, 20 bp, Artificial Sequence
  Description of Artificial Sequence: Synthetic oligonucleotide
  Target: SCN9A; (-) strand; PAM type: NRG; PAM sequence: GGG
ataagttcatgtcctttgca

SEQ ID NO: 28389 - DNA, 20 bp, Artificial Sequence
  Description of Artificial Sequence: Synthetic oligonucleotide
  Target: SCN9A; (-) strand; PAM type: NRG; PAM sequence: AGG
aataagttcatgtcctttgc

SEQ ID NO: 28390 - DNA, 20 bp, Artificial Sequence
  Description of Artificial Sequence: Synthetic oligonucleotide
  Target: SCN9A; (-) strand; PAM type: NRG; PAM sequence: CAG
gaataagttcatgtcctttg

SEQ ID NO: 28391 - DNA, 20 bp, Artificial Sequence
  Description of Artificial Sequence: Synthetic oligonucleotide
  Target: SCN9A; (-) strand; PAM type: NRG; PAM sequence: AAG
atgcagccataaaaaagaat

SEQ ID NO: 28392 - DNA, 20 bp, Artificial Sequence
  Description of Artificial Sequence: Synthetic oligonucleotide
  Target: SCN9A; (-) strand; PAM type: NRG; PAM sequence: AAG
aatactatgcagccataaaa

SEQ ID NO: 28393 - DNA, 20 bp, Artificial Sequence
  Description of Artificial Sequence: Synthetic oligonucleotide
  Target: SCN9A; (-) strand; PAM type: NRG; PAM sequence: CAG
atacaccatggaatactatg

SEQ ID NO: 28394 - DNA, 20 bp, Artificial Sequence
  Description of Artificial Sequence: Synthetic oligonucleotide
  Target: SCN9A; (-) strand; PAM type: NRG; PAM sequence: TGG
aatgtggcacatatacacca

SEQ ID NO: 28395 - DNA, 20 bp, Artificial Sequence
  Description of Artificial Sequence: Synthetic oligonucleotide
  Target: SCN9A; (-) strand; PAM type: NRG; PAM sequence: TGG
tagactggataaagaaaatg

SEQ ID NO: 28396 - DNA, 20 bp, Artificial Sequence
  Description of Artificial Sequence: Synthetic oligonucleotide
  Target: SCN9A; (-) strand; PAM type: NRG; PAM sequence: AAG
catcaatgatagactggata

SEQ ID NO: 28397 - DNA, 20 bp, Artificial Sequence
  Description of Artificial Sequence: Synthetic oligonucleotide
  Target: SCN9A; (-) strand; PAM type: NRG; PAM sequence: TGG
aatgcccatcaatgatagac

SEQ ID NO: 28398 - DNA, 20 bp, Artificial Sequence
  Description of Artificial Sequence: Synthetic oligonucleotide
  Target: SCN9A; (-) strand; PAM type: NRG; PAM sequence: TAG
acccaaatgcccatcaatga

SEQ ID NO: 28399 - DNA, 20 bp, Artificial Sequence
  Description of Artificial Sequence: Synthetic oligonucleotide
  Target: SCN9A; (-) strand; PAM type: NRG; PAM sequence: GGG
tattcacaatagcaaagact

SEQ ID NO: 28400 - DNA, 20 bp, Artificial Sequence
  Description of Artificial Sequence: Synthetic oligonucleotide
  Target: SCN9A; (-) strand; PAM type: NRG; PAM sequence: TGG
ctattcacaatagcaaagac

SEQ ID NO: 28401 - DNA, 20 bp, Artificial Sequence
  Description of Artificial Sequence: Synthetic oligonucleotide
  Target: SCN9A; (-) strand; PAM type: NRG; PAM sequence: AAG
tggcactattcacaatagca

SEQ ID NO: 28402 - DNA, 20 bp, Artificial Sequence
  Description of Artificial Sequence: Synthetic oligonucleotide
  Target: SCN9A; (-) strand; PAM type: NRG; PAM sequence: TAG
tattgtggcactattcacaa

SEQ ID NO: 28403 - DNA, 20 bp, Artificial Sequence
  Description of Artificial Sequence: Synthetic oligonucleotide
  Target: SCN9A; (-) strand; PAM type: NRG; PAM sequence: TGG
atgcacacatatgtttattg

SEQ ID NO: 28404 - DNA, 20 bp, Artificial Sequence
  Description of Artificial Sequence: Synthetic oligonucleotide
  Target: SCN9A; (-) strand; PAM type: NRG; PAM sequence: AAG
ttacatatcattctatggta

SEQ ID NO: 28405 - DNA, 20 bp, Artificial Sequence
  Description of Artificial Sequence: Synthetic oligonucleotide
  Target: SCN9A; (-) strand; PAM type: NRG; PAM sequence: TGG
aaagattacatatcattcta

SEQ ID NO: 28406 - DNA, 20 bp, Artificial Sequence
  Description of Artificial Sequence: Synthetic oligonucleotide
  Target: SCN9A; (-) strand; PAM type: NRG; PAM sequence: AAG
attactgggtatatacccaa

SEQ ID NO: 28407 - DNA, 20 bp, Artificial Sequence
  Description of Artificial Sequence: Synthetic oligonucleotide
  Target: SCN9A; (-) strand; PAM type: NRG; PAM sequence: GGG
gacccagcaatcccattact

SEQ ID NO: 28408 - DNA, 20 bp, Artificial Sequence
  Description of Artificial Sequence: Synthetic oligonucleotide
  Target: SCN9A; (-) strand; PAM type: NRG; PAM sequence: TGG
tgacccagcaatcccattac

SEQ ID NO: 28409 - DNA, 20 bp, Artificial Sequence
  Description of Artificial Sequence: Synthetic oligonucleotide
  Target: SCN9A; (-) strand; PAM type: NRG; PAM sequence: CAG
cagtgtggaagacagtgacc

SEQ ID NO: 28410 - DNA, 20 bp, Artificial Sequence
  Description of Artificial Sequence: Synthetic oligonucleotide
  Target: SCN9A; (-) strand; PAM type: NRG; PAM sequence: CAG
agttcaaccagtgtggaaga

SEQ ID NO: 28411 - DNA, 20 bp, Artificial Sequence
  Description of Artificial Sequence: Synthetic oligonucleotide
  Target: SCN9A; (-) strand; PAM type: NRG; PAM sequence: AAG
aattagttcaaccagtgtgg

SEQ ID NO: 28412 - DNA, 20 bp, Artificial Sequence
  Description of Artificial Sequence: Synthetic oligonucleotide
  Target: SCN9A; (-) strand; PAM type: NRG; PAM sequence: TGG
gtaaattagttcaaccagtg

SEQ ID NO: 28413 - DNA, 20 bp, Artificial Sequence
  Description of Artificial Sequence: Synthetic oligonucleotide
  Target: SCN9A; (-) strand; PAM type: NRG; PAM sequence: CAG
ggagtgtaaattagttcaac

SEQ ID NO: 28414 - DNA, 20 bp, Artificial Sequence
  Description of Artificial Sequence: Synthetic oligonucleotide
  Target: SCN9A; (-) strand; PAM type: NRG; PAM sequence: TAG
ctgttggtaggagtgtaaat

SEQ ID NO: 28415 - DNA, 20 bp, Artificial Sequence
  Description of Artificial Sequence: Synthetic oligonucleotide
  Target: SCN9A; (-) strand; PAM type: NRG; PAM sequence: GAG
tgcttttaaactgttggtag

SEQ ID NO: 28416 - DNA, 20 bp, Artificial Sequence
  Description of Artificial Sequence: Synthetic oligonucleotide
  Target: SCN9A; (-) strand; PAM type: NRG; PAM sequence: AGG
aatgcttttaaactgttggt

SEQ ID NO: 28417 - DNA, 20 bp, Artificial Sequence
  Description of Artificial Sequence: Synthetic oligonucleotide
  Target: SCN9A; (-) strand; PAM type: NRG; PAM sequence: TAG
gaatgcttttaaactgttgg

SEQ ID NO: 28418 - DNA, 20 bp, Artificial Sequence
  Description of Artificial Sequence: Synthetic oligonucleotide
  Target: SCN9A; (-) strand; PAM type: NRG; PAM sequence: TGG
taggaatgcttttaaactgt

SEQ ID NO: 28419 - DNA, 20 bp, Artificial Sequence
  Description of Artificial Sequence: Synthetic oligonucleotide
  Target: SCN9A; (-) strand; PAM type: NRG; PAM sequence: AGG
tggagaaaatgtggagaaat

SEQ ID NO: 28420 - DNA, 20 bp, Artificial Sequence
  Description of Artificial Sequence: Synthetic oligonucleotide
  Target: SCN9A; (-) strand; PAM type: NRG; PAM sequence: TAG
ctggagaaaatgtggagaaa

SEQ ID NO: 28421 - DNA, 20 bp, Artificial Sequence
  Description of Artificial Sequence: Synthetic oligonucleotide
  Target: SCN9A; (-) strand; PAM type: NRG; PAM sequence: GAG
cagatgctggagaaaatgtg

SEQ ID NO: 28422 - DNA, 20 bp, Artificial Sequence
  Description of Artificial Sequence: Synthetic oligonucleotide
  Target: SCN9A; (-) strand; PAM type: NRG; PAM sequence: TGG
aacagatgctggagaaaatg

SEQ ID NO: 28423 - DNA, 20 bp, Artificial Sequence
  Description of Artificial Sequence: Synthetic oligonucleotide
  Target: SCN9A; (-) strand; PAM type: NRG; PAM sequence: GAG
tcagaaaataacagatgctg

SEQ ID NO: 28424 - DNA, 20 bp, Artificial Sequence
  Description of Artificial Sequence: Synthetic oligonucleotide
  Target: SCN9A; (-) strand; PAM type: NRG; PAM sequence: TGG
agtcagaaaataacagatgc

SEQ ID NO: 28425 - DNA, 20 bp, Artificial Sequence
  Description of Artificial Sequence: Synthetic oligonucleotide
  Target: SCN9A; (-) strand; PAM type: NRG; PAM sequence: CAG
attaaaaagtcagaaaataa

SEQ ID NO: 28426 - DNA, 20 bp, Artificial Sequence
  Description of Artificial Sequence: Synthetic oligonucleotide
  Target: SCN9A; (-) strand; PAM type: NRG; PAM sequence: CAG
aatggtgataattaaaaagt

SEQ ID NO: 28427 - DNA, 20 bp, Artificial Sequence
  Description of Artificial Sequence: Synthetic oligonucleotide
  Target: SCN9A; (-) strand; PAM type: NRG; PAM sequence: AAG
ttagaatggtgataattaaa

SEQ ID NO: 28428 - DNA, 20 bp, Artificial Sequence
  Description of Artificial Sequence: Synthetic oligonucleotide
  Target: SCN9A; (-) strand; PAM type: NRG; PAM sequence: TGG
ccatctcatgccagttagaa

SEQ ID NO: 28429 - DNA, 20 bp, Artificial Sequence
  Description of Artificial Sequence: Synthetic oligonucleotide
  Target: SCN9A; (-) strand; PAM type: NRG; PAM sequence: TAG
agataccatctcatgccagt

SEQ ID NO: 28430 - DNA, 20 bp, Artificial Sequence
  Description of Artificial Sequence: Synthetic oligonucleotide
  Target: SCN9A; (-) strand; PAM type: NRG; PAM sequence: CAG
aatgagataccatctcatgc

SEQ ID NO: 28431 - DNA, 20 bp, Artificial Sequence
  Description of Artificial Sequence: Synthetic oligonucleotide
  Target: SCN9A; (-) strand; PAM type: NRG; PAM sequence: GAG
atgcaattcaaaaccacaat

SEQ ID NO: 28432 - DNA, 20 bp, Artificial Sequence
  Description of Artificial Sequence: Synthetic oligonucleotide
  Target: SCN9A; (-) strand; PAM type: NRG; PAM sequence: GAG
ctcatcatcactggccatta

SEQ ID NO: 28433 - DNA, 20 bp, Artificial Sequence
  Description of Artificial Sequence: Synthetic oligonucleotide
  Target: SCN9A; (-) strand; PAM type: NRG; PAM sequence: TAG
agctcatcatcactggccat

SEQ ID NO: 28434 - DNA, 20 bp, Artificial Sequence
  Description of Artificial Sequence: Synthetic oligonucleotide
  Target: SCN9A; (-) strand; PAM type: NRG; PAM sequence: TGG
gaaaaaaagctcatcatcac

SEQ ID NO: 28435 - DNA, 20 bp, Artificial Sequence
  Description of Artificial Sequence: Synthetic oligonucleotide
  Target: SCN9A; (-) strand; PAM type: NRG; PAM sequence: AAG
taacttaaacatatgaaaaa

SEQ ID NO: 28436 - DNA, 20 bp, Artificial Sequence
  Description of Artificial Sequence: Synthetic oligonucleotide
  Target: SCN9A; (-) strand; PAM type: NRG; PAM sequence: TAG
ataggtggagcaaaccacca

SEQ ID NO: 28437 - DNA, 20 bp, Artificial Sequence
  Description of Artificial Sequence: Synthetic oligonucleotide
  Target: SCN9A; (-) strand; PAM type: NRG; PAM sequence: GAG
agataatgggttgataggtg

SEQ ID NO: 28438 - DNA, 20 bp, Artificial Sequence
  Description of Artificial Sequence: Synthetic oligonucleotide
  Target: SCN9A; (-) strand; PAM type: NRG; PAM sequence: TGG
ctagataatgggttgatagg

SEQ ID NO: 28439 - DNA, 20 bp, Artificial Sequence
  Description of Artificial Sequence: Synthetic oligonucleotide
  Target: SCN9A; (-) strand; PAM type: NRG; PAM sequence: AGG
aacctagataatgggttgat

SEQ ID NO: 28440 - DNA, 20 bp, Artificial Sequence
  Description of Artificial Sequence: Synthetic oligonucleotide
  Target: SCN9A; (-) strand; PAM type: NRG; PAM sequence: TAG
aaacctagataatgggttga

SEQ ID NO: 28441 - DNA, 20 bp, Artificial Sequence
  Description of Artificial Sequence: Synthetic oligonucleotide
  Target: SCN9A; (-) strand; PAM type: NRG; PAM sequence: GGG
ggtcttaaaacctagataat

SEQ ID NO: 28442 - DNA, 20 bp, Artificial Sequence
  Description of Artificial Sequence: Synthetic oligonucleotide
  Target: SCN9A; (-) strand; PAM type: NRG; PAM sequence: TGG
aggtcttaaaacctagataa

SEQ ID NO: 28443 - DNA, 20 bp, Artificial Sequence
  Description of Artificial Sequence: Synthetic oligonucleotide
  Target: SCN9A; (-) strand; PAM type: NRG; PAM sequence: TAG
tgcatgcaggtcttaaaacc

SEQ ID NO: 28444 - DNA, 20 bp, Artificial Sequence
  Description of Artificial Sequence: Synthetic oligonucleotide
  Target: SCN9A; (-) strand; PAM type: NRG; PAM sequence: AGG
gacaactacctaatgcatgc

SEQ ID NO: 28445 - DNA, 20 bp, Artificial Sequence
  Description of Artificial Sequence: Synthetic oligonucleotide
  Target: SCN9A; (-) strand; PAM type: NRG; PAM sequence: CAG
ggacaactacctaatgcatg

SEQ ID NO: 28446 - DNA, 20 bp, Artificial Sequence
  Description of Artificial Sequence: Synthetic oligonucleotide
  Target: SCN9A; (-) strand; PAM type: NRG; PAM sequence: AGG
gcaaggggagggagaacgtt

SEQ ID NO: 28447 - DNA, 20 bp, Artificial Sequence
  Description of Artificial Sequence: Synthetic oligonucleotide
  Target: SCN9A; (-) strand; PAM type: NRG; PAM sequence: TAG
ggcaaggggagggagaacgt

SEQ ID NO: 28448 - DNA, 20 bp, Artificial Sequence
  Description of Artificial Sequence: Synthetic oligonucleotide
  Target: SCN9A; (-) strand; PAM type: NRG; PAM sequence: GAG
gggtgggaggcaaggggagg

SEQ ID NO: 28449 - DNA, 20 bp, Artificial Sequence
  Description of Artificial Sequence: Synthetic oligonucleotide
  Target: SCN9A; (-) strand; PAM type: NRG; PAM sequence: GGG
gggggtgggaggcaagggga

SEQ ID NO: 28450 - DNA, 20 bp, Artificial Sequence
  Description of Artificial Sequence: Synthetic oligonucleotide
  Target: SCN9A; (-) strand; PAM type: NRG; PAM sequence: AGG
ggggggtgggaggcaagggg

SEQ ID NO: 28451 - DNA, 20 bp, Artificial Sequence
  Description of Artificial Sequence: Synthetic oligonucleotide
  Target: SCN9A; (-) strand; PAM type: NRG; PAM sequence: GAG
tggggggtgggaggcaaggg

SEQ ID NO: 28452 - DNA, 20 bp, Artificial Sequence
  Description of Artificial Sequence: Synthetic oligonucleotide
  Target: SCN9A; (-) strand; PAM type: NRG; PAM sequence: GGG
gttggggggtgggaggcaag

SEQ ID NO: 28453 - DNA, 20 bp, Artificial Sequence
  Description of Artificial Sequence: Synthetic oligonucleotide
  Target: SCN9A; (-) strand; PAM type: NRG; PAM sequence: GGG
tgttggggggtgggaggcaa

SEQ ID NO: 28454 - DNA, 20 bp, Artificial Sequence
  Description of Artificial Sequence: Synthetic oligonucleotide
  Target: SCN9A; (-) strand; PAM type: NRG; PAM sequence: AGG
ctgttggggggtgggaggca

SEQ ID NO: 28455 - DNA, 20 bp, Artificial Sequence
  Description of Artificial Sequence: Synthetic oligonucleotide
  Target: SCN9A; (-) strand; PAM type: NRG; PAM sequence: AAG
cctgttggggggtgggaggc

SEQ ID NO: 28456 - DNA, 20 bp, Artificial Sequence
  Description of Artificial Sequence: Synthetic oligonucleotide
  Target: SCN9A; (-) strand; PAM type: NRG; PAM sequence: AGG
ggggcctgttggggggtggg

SEQ ID NO: 28457 - DNA, 20 bp, Artificial Sequence
  Description of Artificial Sequence: Synthetic oligonucleotide
  Target: SCN9A; (-) strand; PAM type: NRG; PAM sequence: GAG
cggggcctgttggggggtgg

SEQ ID NO: 28458 - DNA, 20 bp, Artificial Sequence
  Description of Artificial Sequence: Synthetic oligonucleotide
  Target: SCN9A; (-) strand; PAM type: NRG; PAM sequence: GGG
accggggcctgttggggggt

SEQ ID NO: 28459 - DNA, 20 bp, Artificial Sequence
  Description of Artificial Sequence: Synthetic oligonucleotide
  Target: SCN9A; (-) strand; PAM type: NRG; PAM sequence: TGG
caccggggcctgttgggggg

SEQ ID NO: 28460 - DNA, 20 bp, Artificial Sequence
  Description of Artificial Sequence: Synthetic oligonucleotide
  Target: SCN9A; (-) strand; PAM type: NRG; PAM sequence: GGG
acacaccggggcctgttggg

SEQ ID NO: 28461 - DNA, 20 bp, Artificial Sequence
  Description of Artificial Sequence: Synthetic oligonucleotide
  Target: SCN9A; (-) strand; PAM type: NRG; PAM sequence: GGG
cacacaccggggcctgttgg

SEQ ID NO: 28462 - DNA, 20 bp, Artificial Sequence
  Description of Artificial Sequence: Synthetic oligonucleotide
  Target: SCN9A; (-) strand; PAM type: NRG; PAM sequence: GGG
acacacaccggggcctgttg

SEQ ID NO: 28463 - DNA, 20 bp, Artificial Sequence
  Description of Artificial Sequence: Synthetic oligonucleotide
  Target: SCN9A; (-) strand; PAM type: NRG; PAM sequence: GGG
aacacacaccggggcctgtt

SEQ ID NO: 28464 - DNA, 20 bp, Artificial Sequence
  Description of Artificial Sequence: Synthetic oligonucleotide
  Target: SCN9A; (-) strand; PAM type: NRG; PAM sequence: TGG
caacacacaccggggcctgt

SEQ ID NO: 28465 - DNA, 20 bp, Artificial Sequence
  Description of Artificial Sequence: Synthetic oligonucleotide
  Target: SCN9A; (-) strand; PAM type: NRG; PAM sequence: GGG
gaggggaacaacacacaccg

SEQ ID NO: 28466 - DNA, 20 bp, Artificial Sequence
  Description of Artificial Sequence: Synthetic oligonucleotide
  Target: SCN9A; (-) strand; PAM type: NRG; PAM sequence: GGG
ggaggggaacaacacacacc

SEQ ID NO: 28467 - DNA, 20 bp, Artificial Sequence
  Description of Artificial Sequence: Synthetic oligonucleotide
  Target: SCN9A; (-) strand; PAM type: NRG; PAM sequence: CGG
gggaggggaacaacacacac

SEQ ID NO: 28468 - DNA, 20 bp, Artificial Sequence
  Description of Artificial Sequence: Synthetic oligonucleotide
  Target: SCN9A; (-) strand; PAM type: NRG; PAM sequence: GGG
gaacacatggacacagggag

SEQ ID NO: 28469 - DNA, 20 bp, Artificial Sequence
  Description of Artificial Sequence: Synthetic oligonucleotide
  Target: SCN9A; (-) strand; PAM type: NRG; PAM sequence: GGG
tgaacacatggacacaggga

SEQ ID NO: 28470 - DNA, 20 bp, Artificial Sequence
  Description of Artificial Sequence: Synthetic oligonucleotide
  Target: SCN9A; (-) strand; PAM type: NRG; PAM sequence: AGG
ttgaacacatggacacaggg

SEQ ID NO: 28471 - DNA, 20 bp, Artificial Sequence
  Description of Artificial Sequence: Synthetic oligonucleotide
  Target: SCN9A; (-) strand; PAM type: NRG; PAM sequence: GAG
tttgaacacatggacacagg

SEQ ID NO: 28472 - DNA, 20 bp, Artificial Sequence
  Description of Artificial Sequence: Synthetic oligonucleotide
  Target: SCN9A; (-) strand; PAM type: NRG; PAM sequence: GGG
aatttgaacacatggacaca

SEQ ID NO: 28473 - DNA, 20 bp, Artificial Sequence
  Description of Artificial Sequence: Synthetic oligonucleotide
  Target: SCN9A; (-) strand; PAM type: NRG; PAM sequence: AGG
caatttgaacacatggacac

SEQ ID NO: 28474 - DNA, 20 bp, Artificial Sequence
  Description of Artificial Sequence: Synthetic oligonucleotide
  Target: SCN9A; (-) strand; PAM type: NRG; PAM sequence: CAG
acaatttgaacacatggaca

SEQ ID NO: 28475 - DNA, 20 bp, Artificial Sequence
  Description of Artificial Sequence: Synthetic oligonucleotide
  Target: SCN9A; (-) strand; PAM type: NRG; PAM sequence: TGG
agttgaacaatttgaacaca

SEQ ID NO: 28476 - DNA, 20 bp, Artificial Sequence
  Description of Artificial Sequence: Synthetic oligonucleotide
  Target: SCN9A; (-) strand; PAM type: NRG; PAM sequence: GAG
atgttctcactcataagtgg

SEQ ID NO: 28477 - DNA, 20 bp, Artificial Sequence
  Description of Artificial Sequence: Synthetic oligonucleotide
  Target: SCN9A; (-) strand; PAM type: NRG; PAM sequence: GGG
gcatgttctcactcataagt

SEQ ID NO: 28478 - DNA, 20 bp, Artificial Sequence
  Description of Artificial Sequence: Synthetic oligonucleotide
  Target: SCN9A; (-) strand; PAM type: NRG; PAM sequence: TGG
tgcatgttctcactcataag

SEQ ID NO: 28479 - DNA, 20 bp, Artificial Sequence
  Description of Artificial Sequence: Synthetic oligonucleotide
  Target: SCN9A; (-) strand; PAM type: NRG; PAM sequence: AAG
cactgcatgttctcactcat

SEQ ID NO: 28480 - DNA, 20 bp, Artificial Sequence
  Description of Artificial Sequence: Synthetic oligonucleotide
  Target: SCN9A; (-) strand; PAM type: NRG; PAM sequence: GAG
tcagcaaactaatacaggaa

SEQ ID NO: 28481 - DNA, 20 bp, Artificial Sequence
  Description of Artificial Sequence: Synthetic oligonucleotide
  Target: SCN9A; (-) strand; PAM type: NRG; PAM sequence: AAG
cctcagcaaactaatacagg

SEQ ID NO: 28482 - DNA, 20 bp, Artificial Sequence
  Description of Artificial Sequence: Synthetic oligonucleotide
  Target: SCN9A; (-) strand; PAM type: NRG; PAM sequence: AGG
catcctcagcaaactaatac

SEQ ID NO: 28483 - DNA, 20 bp, Artificial Sequence
  Description of Artificial Sequence: Synthetic oligonucleotide
  Target: SCN9A; (-) strand; PAM type: NRG; PAM sequence: CAG
tcatcctcagcaaactaata

SEQ ID NO: 28484 - DNA, 20 bp, Artificial Sequence
  Description of Artificial Sequence: Synthetic oligonucleotide
  Target: SCN9A; (-) strand; PAM type: NRG; PAM sequence: CAG
aagctggaagccatcatcct

SEQ ID NO: 28485 - DNA, 20 bp, Artificial Sequence
  Description of Artificial Sequence: Synthetic oligonucleotide
  Target: SCN9A; (-) strand; PAM type: NRG; PAM sequence: AAG
agggacatggatgaagctgg

SEQ ID NO: 28486 - DNA, 20 bp, Artificial Sequence
  Description of Artificial Sequence: Synthetic oligonucleotide
  Target: SCN9A; (-) strand; PAM type: NRG; PAM sequence: TGG
tacagggacatggatgaagc

SEQ ID NO: 28487 - DNA, 20 bp, Artificial Sequence
  Description of Artificial Sequence: Synthetic oligonucleotide
  Target: SCN9A; (-) strand; PAM type: NRG; PAM sequence: AAG
cctttacagggacatggatg

SEQ ID NO: 28488 - DNA, 20 bp, Artificial Sequence
  Description of Artificial Sequence: Synthetic oligonucleotide
  Target: SCN9A; (-) strand; PAM type: NRG; PAM sequence: TGG
tcatgtcctttacagggaca

SEQ ID NO: 28489 - DNA, 20 bp, Artificial Sequence
  Description of Artificial Sequence: Synthetic oligonucleotide
  Target: SCN9A; (-) strand; PAM type: NRG; PAM sequence: GGG
atgagatcatgtcctttaca

SEQ ID NO: 28490 - DNA, 20 bp, Artificial Sequence
  Description of Artificial Sequence: Synthetic oligonucleotide
  Target: SCN9A; (-) strand; PAM type: NRG; PAM sequence: AGG
aatgagatcatgtcctttac

SEQ ID NO: 28491 - DNA, 20 bp, Artificial Sequence
  Description of Artificial Sequence: Synthetic oligonucleotide
  Target: SCN9A; (-) strand; PAM type: NRG; PAM sequence: CAG
gaatgagatcatgtccttta

SEQ ID NO: 28492 - DNA, 20 bp, Artificial Sequence
  Description of Artificial Sequence: Synthetic oligonucleotide
  Target: SCN9A; (-) strand; PAM type: NRG; PAM sequence: GAG
tgcagccattaaaaaagaat

SEQ ID NO: 28493 - DNA, 20 bp, Artificial Sequence
  Description of Artificial Sequence: Synthetic oligonucleotide
  Target: SCN9A; (-) strand; PAM type: NRG; PAM sequence: AAG
atactatgcagccattaaaa

SEQ ID NO: 28494 - DNA, 20 bp, Artificial Sequence
  Description of Artificial Sequence: Synthetic oligonucleotide
  Target: SCN9A; (-) strand; PAM type: NRG; PAM sequence: CAG
atacaccatggaatactatg

SEQ ID NO: 28495 - DNA, 20 bp, Artificial Sequence
  Description of Artificial Sequence: Synthetic oligonucleotide
  Target: SCN9A; (-) strand; PAM type: NRG; PAM sequence: TGG
aatgtggtacatatacacca

SEQ ID NO: 28496 - DNA, 20 bp, Artificial Sequence
  Description of Artificial Sequence: Synthetic oligonucleotide
  Target: SCN9A; (-) strand; PAM type: NRG; PAM sequence: TGG
taaattgtataaagaaaatg

SEQ ID NO: 28497 - DNA, 20 bp, Artificial Sequence
  Description of Artificial Sequence: Synthetic oligonucleotide
  Target: SCN9A; (-) strand; PAM type: NRG; PAM sequence: AAG
catcaatgttaaattgtata

SEQ ID NO: 28498 - DNA, 20 bp, Artificial Sequence
  Description of Artificial Sequence: Synthetic oligonucleotide
  Target: SCN9A; (-) strand; PAM type: NRG; PAM sequence: TGG
tatttacaatagcaaagaga

SEQ ID NO: 28499 - DNA, 20 bp, Artificial Sequence
  Description of Artificial Sequence: Synthetic oligonucleotide
  Target: SCN9A; (-) strand; PAM type: NRG; PAM sequence: GAG
gtactatttacaatagcaaa

SEQ ID NO: 28500 - DNA, 20 bp, Artificial Sequence
  Description of Artificial Sequence: Synthetic oligonucleotide
  Target: SCN9A; (-) strand; PAM type: NRG; PAM sequence: AAG
cagtactatttacaatagca

SEQ ID NO: 28501 - DNA, 20 bp, Artificial Sequence
  Description of Artificial Sequence: Synthetic oligonucleotide
  Target: SCN9A; (-) strand; PAM type: NRG; PAM sequence: TAG
tattgcagtactatttacaa

SEQ ID NO: 28502 - DNA, 20 bp, Artificial Sequence
  Description of Artificial Sequence: Synthetic oligonucleotide
  Target: SCN9A; (-) strand; PAM type: NRG; PAM sequence: CAG
atgcacacatatgtttattg

SEQ ID NO: 28503 - DNA, 20 bp, Artificial Sequence
  Description of Artificial Sequence: Synthetic oligonucleotide
  Target: SCN9A; (-) strand; PAM type: NRG; PAM sequence: AAG
atataaatcattctactaca

SEQ ID NO: 28504 - DNA, 20 bp, Artificial Sequence
  Description of Artificial Sequence: Synthetic oligonucleotide
  Target: SCN9A; (-) strand; PAM type: NRG; PAM sequence: GGG
gacctagcaatcccattact

SEQ ID NO: 28505 - DNA, 20 bp, Artificial Sequence
  Description of Artificial Sequence: Synthetic oligonucleotide
  Target: SCN9A; (-) strand; PAM type: NRG; PAM sequence: TGG
tgacctagcaatcccattac

SEQ ID NO: 28506 - DNA, 20 bp, Artificial Sequence
  Description of Artificial Sequence: Synthetic oligonucleotide
  Target: SCN9A; (-) strand; PAM type: NRG; PAM sequence: TAG
accagaaataccatttgacc

SEQ ID NO: 28507 - DNA, 20 bp, Artificial Sequence
  Description of Artificial Sequence: Synthetic oligonucleotide
  Target: SCN9A; (-) strand; PAM type: NRG; PAM sequence: CAG
attccttaaggacctagaac

SEQ ID NO: 28508 - DNA, 20 bp, Artificial Sequence
  Description of Artificial Sequence: Synthetic oligonucleotide
  Target: SCN9A; (-) strand; PAM type: NRG; PAM sequence: TAG
gaggcaattccttaaggacc

SEQ ID NO: 28509 - DNA, 20 bp, Artificial Sequence
  Description of Artificial Sequence: Synthetic oligonucleotide
  Target: SCN9A; (-) strand; PAM type: NRG; PAM sequence: AGG
gacagtgaggcaattcctta

SEQ ID NO: 28510 - DNA, 20 bp, Artificial Sequence
  Description of Artificial Sequence: Synthetic oligonucleotide
  Target: SCN9A; (-) strand; PAM type: NRG; PAM sequence: AAG
agacagtgaggcaattcctt

SEQ ID NO: 28511 - DNA, 20 bp, Artificial Sequence
  Description of Artificial Sequence: Synthetic oligonucleotide
  Target: SCN9A; (-) strand; PAM type: NRG; PAM sequence: AGG
caacaattttgaagacagtg

SEQ ID NO: 28512 - DNA, 20 bp, Artificial Sequence
  Description of Artificial Sequence: Synthetic oligonucleotide
  Target: SCN9A; (-) strand; PAM type: NRG; PAM sequence: GAG
tcaacaattttgaagacagt

SEQ ID NO: 28513 - DNA, 20 bp, Artificial Sequence
  Description of Artificial Sequence: Synthetic oligonucleotide
  Target: SCN9A; (-) strand; PAM type: NRG; PAM sequence: CAG
tagttcaacaattttgaaga

SEQ ID NO: 28514 - DNA, 20 bp, Artificial Sequence
  Description of Artificial Sequence: Synthetic oligonucleotide
  Target: SCN9A; (-) strand; PAM type: NRG; PAM sequence: AAG
aaattagttcaacaattttg

SEQ ID NO: 28515 - DNA, 20 bp, Artificial Sequence
  Description of Artificial Sequence: Synthetic oligonucleotide
  Target: SCN9A; (-) strand; PAM type: NRG; PAM sequence: TAG
ctgttggtgggagtgtaaat

SEQ ID NO: 28516 - DNA, 20 bp, Artificial Sequence
  Description of Artificial Sequence: Synthetic oligonucleotide
  Target: SCN9A; (-) strand; PAM type: NRG; PAM sequence: GAG
cacttttacactgttggtgg

SEQ ID NO: 28517 - DNA, 20 bp, Artificial Sequence
  Description of Artificial Sequence: Synthetic oligonucleotide
  Target: SCN9A; (-) strand; PAM type: NRG; PAM sequence: GGG
agcacttttacactgttggt

SEQ ID NO: 28518 - DNA, 20 bp, Artificial Sequence
  Description of Artificial Sequence: Synthetic oligonucleotide
  Target: SCN9A; (-) strand; PAM type: NRG; PAM sequence: TGG
tagcacttttacactgttgg

SEQ ID NO: 28519 - DNA, 20 bp, Artificial Sequence
  Description of Artificial Sequence: Synthetic oligonucleotide
  Target: SCN9A; (-) strand; PAM type: NRG; PAM sequence: TGG
tagtagcacttttacactgt

SEQ ID NO: 28520 - DNA, 20 bp, Artificial Sequence
  Description of Artificial Sequence: Synthetic oligonucleotide
  Target: SCN9A; (-) strand; PAM type: NRG; PAM sequence: TAG
gtgaggctatgaagaaatag

SEQ ID NO: 28521 - DNA, 20 bp, Artificial Sequence
  Description of Artificial Sequence: Synthetic oligonucleotide
  Target: SCN9A; (-) strand; PAM type: NRG; PAM sequence: TAG
ctggtgaggctatgaagaaa

SEQ ID NO: 28522 - DNA, 20 bp, Artificial Sequence
  Description of Artificial Sequence: Synthetic oligonucleotide
  Target: SCN9A; (-) strand; PAM type: NRG; PAM sequence: AAG
tagattctggtgaggctatg

SEQ ID NO: 28523 - DNA, 20 bp, Artificial Sequence
  Description of Artificial Sequence: Synthetic oligonucleotide
  Target: SCN9A; (-) strand; PAM type: NRG; PAM sequence: AGG
agaaacaatagattctggtg

SEQ ID NO: 28524 - DNA, 20 bp, Artificial Sequence
  Description of Artificial Sequence: Synthetic oligonucleotide
  Target: SCN9A; (-) strand; PAM type: NRG; PAM sequence: GAG
gagaaacaatagattctggt

SEQ ID NO: 28525 - DNA, 20 bp, Artificial Sequence
  Description of Artificial Sequence: Synthetic oligonucleotide
  Target: SCN9A; (-) strand; PAM type: NRG; PAM sequence: TGG
agttgagaaacaatagattc

SEQ ID NO: 28526 - DNA, 20 bp, Artificial Sequence
  Description of Artificial Sequence: Synthetic oligonucleotide
  Target: SCN9A; (-) strand; PAM type: NRG; PAM sequence: TAG
attaaaaagttgagaaacaa

SEQ ID NO: 28527 - DNA, 20 bp, Artificial Sequence
  Description of Artificial Sequence: Synthetic oligonucleotide
  Target: SCN9A; (-) strand; PAM type: NRG; PAM sequence: GAG
atggtgattattaaaaagtt

SEQ ID NO: 28528 - DNA, 20 bp, Artificial Sequence
  Description of Artificial Sequence: Synthetic oligonucleotide
  Target: SCN9A; (-) strand; PAM type: NRG; PAM sequence: AAG
tcagaatggtgattattaaa

SEQ ID NO: 28529 - DNA, 20 bp, Artificial Sequence
  Description of Artificial Sequence: Synthetic oligonucleotide
  Target: SCN9A; (-) strand; PAM type: NRG; PAM sequence: TGG
ccatctcaagtcagtcagaa

SEQ ID NO: 28530 - DNA, 20 bp, Artificial Sequence
  Description of Artificial Sequence: Synthetic oligonucleotide
  Target: SCN9A; (-) strand; PAM type: NRG; PAM sequence: CAG
agataccatctcaagtcagt

SEQ ID NO: 28531 - DNA, 20 bp, Artificial Sequence
  Description of Artificial Sequence: Synthetic oligonucleotide
  Target: SCN9A; (-) strand; PAM type: NRG; PAM sequence: CAG
aatgagataccatctcaagt

SEQ ID NO: 28532 - DNA, 20 bp, Artificial Sequence
  Description of Artificial Sequence: Synthetic oligonucleotide
  Target: SCN9A; (-) strand; PAM type: NRG; PAM sequence: AAG
ccacaatgagataccatctc

SEQ ID NO: 28533 - DNA, 20 bp, Artificial Sequence
  Description of Artificial Sequence: Synthetic oligonucleotide
  Target: SCN9A; (-) strand; PAM type: NRG; PAM sequence: GAG
acgcaaatcaaaaccacaat

SEQ ID NO: 28534 - DNA, 20 bp, Artificial Sequence
  Description of Artificial Sequence: Synthetic oligonucleotide
  Target: SCN9A; (-) strand; PAM type: NRG; PAM sequence: AAG
gctcaacatcagtgatcatt

SEQ ID NO: 28535 - DNA, 20 bp, Artificial Sequence
  Description of Artificial Sequence: Synthetic oligonucleotide
  Target: SCN9A; (-) strand; PAM type: NRG; PAM sequence: CAG
catgaaaaaaagctcaacat

SEQ ID NO: 28536 - DNA, 20 bp, Artificial Sequence
  Description of Artificial Sequence: Synthetic oligonucleotide
  Target: SCN9A; (-) strand; PAM type: NRG; PAM sequence: AAG
cggccaaaaaacatgaaaaa

SEQ ID NO: 28537 - DNA, 20 bp, Artificial Sequence
  Description of Artificial Sequence: Synthetic oligonucleotide
  Target: SCN9A; (-) strand; PAM type: NRG; PAM sequence: CGG
ctcaaaagaagacatttatg

SEQ ID NO: 28538 - DNA, 20 bp, Artificial Sequence
  Description of Artificial Sequence: Synthetic oligonucleotide
  Target: SCN9A; (-) strand; PAM type: NRG; PAM sequence: AAG
gaacagagacttctcaaaag

SEQ ID NO: 28539 - DNA, 20 bp, Artificial Sequence
  Description of Artificial Sequence: Synthetic oligonucleotide
  Target: SCN9A; (-) strand; PAM type: NRG; PAM sequence: AAG
tatgaacagagacttctcaa

SEQ ID NO: 28540 - DNA, 20 bp, Artificial Sequence
  Description of Artificial Sequence: Synthetic oligonucleotide
  Target: SCN9A; (-) strand; PAM type: NRG; PAM sequence: GAG
gtgggcaaaggatatgaaca

SEQ ID NO: 28541 - DNA, 20 bp, Artificial Sequence
  Description of Artificial Sequence: Synthetic oligonucleotide
  Target: SCN9A; (-) strand; PAM type: NRG; PAM sequence: CAG
aagtgggcaaaggatatgaa

SEQ ID NO: 28542 - DNA, 20 bp, Artificial Sequence
  Description of Artificial Sequence: Synthetic oligonucleotide
  Target: SCN9A; (-) strand; PAM type: NRG; PAM sequence: AGG
tcccatcaaaaagtgggcaa

SEQ ID NO: 28543 - DNA, 20 bp, Artificial Sequence
  Description of Artificial Sequence: Synthetic oligonucleotide
  Target: SCN9A; (-) strand; PAM type: NRG; PAM sequence: AAG
atcccatcaaaaagtgggca

SEQ ID NO: 28544 - DNA, 20 bp, Artificial Sequence
  Description of Artificial Sequence: Synthetic oligonucleotide
  Target: SCN9A; (-) strand; PAM type: NRG; PAM sequence: GGG
cttgcatcccatcaaaaagt

SEQ ID NO: 28545 - DNA, 20 bp, Artificial Sequence
  Description of Artificial Sequence: Synthetic oligonucleotide
  Target: SCN9A; (-) strand; PAM type: NRG; PAM sequence: TGG
ccttgcatcccatcaaaaag

SEQ ID NO: 28546 - DNA, 20 bp, Artificial Sequence
  Description of Artificial Sequence: Synthetic oligonucleotide
  Target: SCN9A; (-) strand; PAM type: NRG; PAM sequence: AAG
cagccttgcatcccatcaaa

SEQ ID NO: 28547 - DNA, 20 bp, Artificial Sequence
  Description of Artificial Sequence: Synthetic oligonucleotide
  Target: SCN9A; (-) strand; PAM type: NRG; PAM sequence: CAG
ttgatttgcatatattgaac

SEQ ID NO: 28548 - DNA, 20 bp, Artificial Sequence
  Description of Artificial Sequence: Synthetic oligonucleotide
  Target: SCN9A; (-) strand; PAM type: NRG; PAM sequence: TGG
cattggttctgtttatgtga

SEQ ID NO: 28549 - DNA, 20 bp, Artificial Sequence
  Description of Artificial Sequence: Synthetic oligonucleotide
  Target: SCN9A; (-) strand; PAM type: NRG; PAM sequence: TGG
aatcatgtggtttttgtcat

SEQ ID NO: 28550 - DNA, 20 bp, Artificial Sequence
  Description of Artificial Sequence: Synthetic oligonucleotide
  Target: SCN9A; (-) strand; PAM type: NRG; PAM sequence: TGG
catctattgagataatcatg

SEQ ID NO: 28551 - DNA, 20 bp, Artificial Sequence
  Description of Artificial Sequence: Synthetic oligonucleotide
  Target: SCN9A; (-) strand; PAM type: NRG; PAM sequence: GAG
agaccttctctgcatctatt

SEQ ID NO: 28552 - DNA, 20 bp, Artificial Sequence
  Description of Artificial Sequence: Synthetic oligonucleotide
  Target: SCN9A; (-) strand; PAM type: NRG; PAM sequence: AAG
atggatgttgcattttattg

SEQ ID NO: 28553 - DNA, 20 bp, Artificial Sequence
  Description of Artificial Sequence: Synthetic oligonucleotide
  Target: SCN9A; (-) strand; PAM type: NRG; PAM sequence: TGG
ttgatagtttttaacatgaa

SEQ ID NO: 28554 - DNA, 20 bp, Artificial Sequence
  Description of Artificial Sequence: Synthetic oligonucleotide
  Target: SCN9A; (-) strand; PAM type: NRG; PAM sequence: TAG
atcaatacctagtttattga

SEQ ID NO: 28555 - DNA, 20 bp, Artificial Sequence
  Description of Artificial Sequence: Synthetic oligonucleotide
  Target: SCN9A; (-) strand; PAM type: NRG; PAM sequence: TAG
agatatgttccatcaatacc

SEQ ID NO: 28556 - DNA, 20 bp, Artificial Sequence
  Description of Artificial Sequence: Synthetic oligonucleotide
  Target: SCN9A; (-) strand; PAM type: NRG; PAM sequence: GAG
taaatagctcttattatttt

SEQ ID NO: 28557 - DNA, 20 bp, Artificial Sequence
  Description of Artificial Sequence: Synthetic oligonucleotide
  Target: SCN9A; (-) strand; PAM type: NRG; PAM sequence: TAG
ggctatggagttttcataaa

SEQ ID NO: 28558 - DNA, 20 bp, Artificial Sequence
  Description of Artificial Sequence: Synthetic oligonucleotide
  Target: SCN9A; (-) strand; PAM type: NRG; PAM sequence: GAG
tcagtatgatattggctatg

SEQ ID NO: 28559 - DNA, 20 bp, Artificial Sequence
  Description of Artificial Sequence: Synthetic oligonucleotide
  Target: SCN9A; (-) strand; PAM type: NRG; PAM sequence: TGG
attcagtatgatattggcta

SEQ ID NO: 28560 - DNA, 20 bp, Artificial Sequence
  Description of Artificial Sequence: Synthetic oligonucleotide
  Target: SCN9A; (-) strand; PAM type: NRG; PAM sequence: TGG
tttcccattcagtatgatat

SEQ ID NO: 28561 - DNA, 20 bp, Artificial Sequence
  Description of Artificial Sequence: Synthetic oligonucleotide
  Target: SCN9A; (-) strand; PAM type: NRG; PAM sequence: CAG
gcttccagctttttcccatt

SEQ ID NO: 28562 - DNA, 20 bp, Artificial Sequence
  Description of Artificial Sequence: Synthetic oligonucleotide
  Target: SCN9A; (-) strand; PAM type: NRG; PAM sequence: CAG
gtttttaaagggaatgcttc

SEQ ID NO: 28563 - DNA, 20 bp, Artificial Sequence
  Description of Artificial Sequence: Synthetic oligonucleotide
  Target: SCN9A; (-) strand; PAM type: NRG; PAM sequence: GGG
gtcttgtgccagtttttaaa

SEQ ID NO: 28564 - DNA, 20 bp, Artificial Sequence
  Description of Artificial Sequence: Synthetic oligonucleotide
  Target: SCN9A; (-) strand; PAM type: NRG; PAM sequence: AGG
tgtcttgtgccagtttttaa

SEQ ID NO: 28565 - DNA, 20 bp, Artificial Sequence
  Description of Artificial Sequence: Synthetic oligonucleotide
  Target: SCN9A; (-) strand; PAM type: NRG; PAM sequence: AAG
ttgtcttgtgccagttttta

SEQ ID NO: 28566 - DNA, 20 bp, Artificial Sequence
  Description of Artificial Sequence: Synthetic oligonucleotide
  Target: SCN9A; (-) strand; PAM type: NRG; PAM sequence: CAG
agggcatccttgtcttgtgc

SEQ ID NO: 28567 - DNA, 20 bp, Artificial Sequence
  Description of Artificial Sequence: Synthetic oligonucleotide
  Target: SCN9A; (-) strand; PAM type: NRG; PAM sequence: GGG
tgaatagcagtggtgagaga

SEQ ID NO: 28568 - DNA, 20 bp, Artificial Sequence
  Description of Artificial Sequence: Synthetic oligonucleotide
  Target: SCN9A; (-) strand; PAM type: NRG; PAM sequence: AGG
ttgaatagcagtggtgagag

SEQ ID NO: 28569 - DNA, 20 bp, Artificial Sequence
  Description of Artificial Sequence: Synthetic oligonucleotide
  Target: SCN9A; (-) strand; PAM type: NRG; PAM sequence: GAG
attgaatagcagtggtgaga

SEQ ID NO: 28570 - DNA, 20 bp, Artificial Sequence
  Description of Artificial Sequence: Synthetic oligonucleotide
  Target: SCN9A; (-) strand; PAM type: NRG; PAM sequence: GAG
atattgaatagcagtggtga

SEQ ID NO: 28571 - DNA, 20 bp, Artificial Sequence
  Description of Artificial Sequence: Synthetic oligonucleotide
  Target: SCN9A; (-) strand; PAM type: NRG; PAM sequence: GAG
ctatattgaatagcagtggt

SEQ ID NO: 28572 - DNA, 20 bp, Artificial Sequence
  Description of Artificial Sequence: Synthetic oligonucleotide
  Target: SCN9A; (-) strand; PAM type: NRG; PAM sequence: TGG
aacactatattgaatagcag

SEQ ID NO: 28573 - DNA, 20 bp, Artificial Sequence
  Description of Artificial Sequence: Synthetic oligonucleotide
  Target: SCN9A; (-) strand; PAM type: NRG; PAM sequence: CAG
tccaacactatattgaatag

SEQ ID NO: 28574 - DNA, 20 bp, Artificial Sequence
  Description of Artificial Sequence: Synthetic oligonucleotide
  Target: SCN9A; (-) strand; PAM type: NRG; PAM sequence: TAG
aattccaacactatattgaa

SEQ ID NO: 28575 - DNA, 20 bp, Artificial Sequence
  Description of Artificial Sequence: Synthetic oligonucleotide
  Target: SCN9A; (-) strand; PAM type: NRG; PAM sequence: CAG
tcttgtctgattgccctggc

SEQ ID NO: 28576 - DNA, 20 bp, Artificial Sequence
  Description of Artificial Sequence: Synthetic oligonucleotide
  Target: SCN9A; (-) strand; PAM type: NRG; PAM sequence: TGG
tttctcttgtctgattgccc

SEQ ID NO: 28577 - DNA, 20 bp, Artificial Sequence
  Description of Artificial Sequence: Synthetic oligonucleotide
  Target: SCN9A; (-) strand; PAM type: NRG; PAM sequence: CGG
tgcagagacaatttgacttc

SEQ ID NO: 28578 - DNA, 20 bp, Artificial Sequence
  Description of Artificial Sequence: Synthetic oligonucleotide
  Target: SCN9A; (-) strand; PAM type: NRG; PAM sequence: GAG
atagaatcatgtcatttgca

SEQ ID NO: 28579 - DNA, 20 bp, Artificial Sequence
  Description of Artificial Sequence: Synthetic oligonucleotide
  Target: SCN9A; (-) strand; PAM type: NRG; PAM sequence: CAG
atatagaatcatgtcatttg

SEQ ID NO: 28580 - DNA, 20 bp, Artificial Sequence
  Description of Artificial Sequence: Synthetic oligonucleotide
  Target: SCN9A; (-) strand; PAM type: NRG; PAM sequence: TAG
atgatcgggttttctaaata

SEQ ID NO: 28581 - DNA, 20 bp, Artificial Sequence
  Description of Artificial Sequence: Synthetic oligonucleotide
  Target: SCN9A; (-) strand; PAM type: NRG; PAM sequence: GGG
gttttggggctgagatgatc

SEQ ID NO: 28582 - DNA, 20 bp, Artificial Sequence
  Description of Artificial Sequence: Synthetic oligonucleotide
  Target: SCN9A; (-) strand; PAM type: NRG; PAM sequence: CGG
agttttggggctgagatgat

SEQ ID NO: 28583 - DNA, 20 bp, Artificial Sequence
  Description of Artificial Sequence: Synthetic oligonucleotide
  Target: SCN9A; (-) strand; PAM type: NRG; PAM sequence: GAG
gtttaaagagttttggggct

SEQ ID NO: 28584 - DNA, 20 bp, Artificial Sequence
  Description of Artificial Sequence: Synthetic oligonucleotide
  Target: SCN9A; (-) strand; PAM type: NRG; PAM sequence: GGG
tatcagtttaaagagttttg

SEQ ID NO: 28585 - DNA, 20 bp, Artificial Sequence
  Description of Artificial Sequence: Synthetic oligonucleotide
  Target: SCN9A; (-) strand; PAM type: NRG; PAM sequence: GGG
ttatcagtttaaagagtttt

SEQ ID NO: 28586 - DNA, 20 bp, Artificial Sequence
  Description of Artificial Sequence: Synthetic oligonucleotide
  Target: SCN9A; (-) strand; PAM type: NRG; PAM sequence: TGG
cttatcagtttaaagagttt

SEQ ID NO: 28587 - DNA, 20 bp, Artificial Sequence
  Description of Artificial Sequence: Synthetic oligonucleotide
  Target: SCN9A; (-) strand; PAM type: NRG; PAM sequence: GAG
aagttgcttatcagtttaaa

SEQ ID NO: 28588 - DNA, 20 bp, Artificial Sequence
  Description of Artificial Sequence: Synthetic oligonucleotide
  Target: SCN9A; (-) strand; PAM type: NRG; PAM sequence: AAG
tgaagttgcttatcagttta

SEQ ID NO: 28589 - DNA, 20 bp, Artificial Sequence
  Description of Artificial Sequence: Synthetic oligonucleotide
  Target: SCN9A; (-) strand; PAM type: NRG; PAM sequence: CAG
accttgctgaagttgcttat

SEQ ID NO: 28590 - DNA, 20 bp, Artificial Sequence
  Description of Artificial Sequence: Synthetic oligonucleotide
  Target: SCN9A; (-) strand; PAM type: NRG; PAM sequence: AAG
tgtatcctgataccttgctg

SEQ ID NO: 28591 - DNA, 20 bp, Artificial Sequence
  Description of Artificial Sequence: Synthetic oligonucleotide
  Target: SCN9A; (-) strand; PAM type: NRG; PAM sequence: AGG
cttgtctattgttggtgtat

SEQ ID NO: 28592 - DNA, 20 bp, Artificial Sequence
  Description of Artificial Sequence: Synthetic oligonucleotide
  Target: SCN9A; (-) strand; PAM type: NRG; PAM sequence: TAG
gcttgtctattgttggtgta

SEQ ID NO: 28593 - DNA, 20 bp, Artificial Sequence
  Description of Artificial Sequence: Synthetic oligonucleotide
  Target: SCN9A; (-) strand; PAM type: NRG; PAM sequence: TGG
gctctctgcttgtctattgt

SEQ ID NO: 28594 - DNA, 20 bp, Artificial Sequence
  Description of Artificial Sequence: Synthetic oligonucleotide
  Target: SCN9A; (-) strand; PAM type: NRG; PAM sequence: TGG
atgggagtttattcatgatt

SEQ ID NO: 28595 - DNA, 20 bp, Artificial Sequence
  Description of Artificial Sequence: Synthetic oligonucleotide
  Target: SCN9A; (-) strand; PAM type: NRG; PAM sequence: GAG
tttatagcaattgcaaatgg

SEQ ID NO: 28596 - DNA, 20 bp, Artificial Sequence
  Description of Artificial Sequence: Synthetic oligonucleotide
  Target: SCN9A; (-) strand; PAM type: NRG; PAM sequence: GGG
tctttatagcaattgcaaat

SEQ ID NO: 28597 - DNA, 20 bp, Artificial Sequence
  Description of Artificial Sequence: Synthetic oligonucleotide
  Target: SCN9A; (-) strand; PAM type: NRG; PAM sequence: TGG
ctctttatagcaattgcaaa

SEQ ID NO: 28598 - DNA, 20 bp, Artificial Sequence
  Description of Artificial Sequence: Synthetic oligonucleotide
  Target: SCN9A; (-) strand; PAM type: NRG; PAM sequence: TAG
taggtattttattctcttta

SEQ ID NO: 28599 - DNA, 20 bp, Artificial Sequence
  Description of Artificial Sequence: Synthetic oligonucleotide
  Target: SCN9A; (-) strand; PAM type: NRG; PAM sequence: AGG
cctttgtaagctgtattcct

SEQ ID NO: 28600 - DNA, 20 bp, Artificial Sequence
  Description of Artificial Sequence: Synthetic oligonucleotide
  Target: SCN9A; (-) strand; PAM type: NRG; PAM sequence: TAG
tcctttgtaagctgtattcc

SEQ ID NO: 28601 - DNA, 20 bp, Artificial Sequence
  Description of Artificial Sequence: Synthetic oligonucleotide
  Target: SCN9A; (-) strand; PAM type: NRG; PAM sequence: AAG
aggtctttcatatcctttgt

SEQ ID NO: 28602 - DNA, 20 bp, Artificial Sequence
  Description of Artificial Sequence: Synthetic oligonucleotide
  Target: SCN9A; (-) strand; PAM type: NRG; PAM sequence: AGG
gtggcttgtagttcttgaag

SEQ ID NO: 28603 - DNA, 20 bp, Artificial Sequence
  Description of Artificial Sequence: Synthetic oligonucleotide
  Target: SCN9A; (-) strand; PAM type: NRG; PAM sequence: GAG
agtggcttgtagttcttgaa

SEQ ID NO: 28604 - DNA, 20 bp, Artificial Sequence
  Description of Artificial Sequence: Synthetic oligonucleotide
  Target: SCN9A; (-) strand; PAM type: NRG; PAM sequence: AAG
gtagtggcttgtagttcttg

SEQ ID NO: 28605 - DNA, 20 bp, Artificial Sequence
  Description of Artificial Sequence: Synthetic oligonucleotide
  Target: SCN9A; (-) strand; PAM type: NRG; PAM sequence: TAG
tttccttgagtagtggcttg

SEQ ID NO: 28606 - DNA, 20 bp, Artificial Sequence
  Description of Artificial Sequence: Synthetic oligonucleotide
  Target: SCN9A; (-) strand; PAM type: NRG; PAM sequence: TGG
tctcttgtttccttgagtag

SEQ ID NO: 28607 - DNA, 20 bp, Artificial Sequence
  Description of Artificial Sequence: Synthetic oligonucleotide
  Target: SCN9A; (-) strand; PAM type: NRG; PAM sequence: TAG
tcctctcttgtttccttgag

SEQ ID NO: 28608 - DNA, 20 bp, Artificial Sequence
  Description of Artificial Sequence: Synthetic oligonucleotide
  Target: SCN9A; (-) strand; PAM type: NRG; PAM sequence: GAG
gtgtcctctcttgtttcctt

SEQ ID NO: 28609 - DNA, 20 bp, Artificial Sequence
  Description of Artificial Sequence: Synthetic oligonucleotide
  Target: SCN9A; (-) strand; PAM type: NRG; PAM sequence: TGG
attcttcctatccatgagta

SEQ ID NO: 28610 - DNA, 20 bp, Artificial Sequence
  Description of Artificial Sequence: Synthetic oligonucleotide
  Target: SCN9A; (-) strand; PAM type: NRG; PAM sequence: GAG
cattgattcttcctatccat

SEQ ID NO: 28611 - DNA, 20 bp, Artificial Sequence
  Description of Artificial Sequence: Synthetic oligonucleotide
  Target: SCN9A; (-) strand; PAM type: NRG; PAM sequence: TGG
ataaattactttcggcagta

SEQ ID NO: 28612 - DNA, 20 bp, Artificial Sequence
  Description of Artificial Sequence: Synthetic oligonucleotide
  Target: SCN9A; (-) strand; PAM type: NRG; PAM sequence: CAG
aatctataaattactttcgg

SEQ ID NO: 28613 - DNA, 20 bp, Artificial Sequence
  Description of Artificial Sequence: Synthetic oligonucleotide
  Target: SCN9A; (-) strand; PAM type: NRG; PAM sequence: CGG
ttgaatctataaattacttt

SEQ ID NO: 28614 - DNA, 20 bp, Artificial Sequence
  Description of Artificial Sequence: Synthetic oligonucleotide
  Target: SCN9A; (-) strand; PAM type: NRG; PAM sequence: TAG
caatggtaatttgatgggac

SEQ ID NO: 28615 - DNA, 20 bp, Artificial Sequence
  Description of Artificial Sequence: Synthetic oligonucleotide
  Target: SCN9A; (-) strand; PAM type: NRG; PAM sequence: GGG
gatgtcaatggtaatttgat

SEQ ID NO: 28616 - DNA, 20 bp, Artificial Sequence
  Description of Artificial Sequence: Synthetic oligonucleotide
  Target: SCN9A; (-) strand; PAM type: NRG; PAM sequence: TGG
agatgtcaatggtaatttga

SEQ ID NO: 28617 - DNA, 20 bp, Artificial Sequence
  Description of Artificial Sequence: Synthetic oligonucleotide
  Target: SCN9A; (-) strand; PAM type: NRG; PAM sequence: TGG
taattctgtgaagatgtcaa

SEQ ID NO: 28618 - DNA, 20 bp, Artificial Sequence
  Description of Artificial Sequence: Synthetic oligonucleotide
  Target: SCN9A; (-) strand; PAM type: NRG; PAM sequence: AAG
agtagttttctaattctgtg

SEQ ID NO: 28619 - DNA, 20 bp, Artificial Sequence
  Description of Artificial Sequence: Synthetic oligonucleotide
  Target: SCN9A; (-) strand; PAM type: NRG; PAM sequence: TAG
gtttcatatgaaatttaaag

SEQ ID NO: 28620 - DNA, 20 bp, Artificial Sequence
  Description of Artificial Sequence: Synthetic oligonucleotide
  Target: SCN9A; (-) strand; PAM type: NRG; PAM sequence: AAG
ctggtttcatatgaaattta

SEQ ID NO: 28621 - DNA, 20 bp, Artificial Sequence
  Description of Artificial Sequence: Synthetic oligonucleotide
  Target: SCN9A; (-) strand; PAM type: NRG; PAM sequence: TGG
ttgctatatgtgctctttcc

SEQ ID NO: 28622 - DNA, 20 bp, Artificial Sequence
  Description of Artificial Sequence: Synthetic oligonucleotide
  Target: SCN9A; (-) strand; PAM type: NRG; PAM sequence: TAG
ccagctttgttctttttgct

SEQ ID NO: 28623 - DNA, 20 bp, Artificial Sequence
  Description of Artificial Sequence: Synthetic oligonucleotide
  Target: SCN9A; (-) strand; PAM type: NRG; PAM sequence: CAG
gtcaggtaggctgatgcctc

SEQ ID NO: 28624 - DNA, 20 bp, Artificial Sequence
  Description of Artificial Sequence: Synthetic oligonucleotide
  Target: SCN9A; (-) strand; PAM type: NRG; PAM sequence: AGG
agtatagtttgaagtcaggt

SEQ ID NO: 28625 - DNA, 20 bp, Artificial Sequence
  Description of Artificial Sequence: Synthetic oligonucleotide
  Target: SCN9A; (-) strand; PAM type: NRG; PAM sequence: TAG
tagtatagtttgaagtcagg

SEQ ID NO: 28626 - DNA, 20 bp, Artificial Sequence
  Description of Artificial Sequence: Synthetic oligonucleotide
  Target: SCN9A; (-) strand; PAM type: NRG; PAM sequence: AGG
tcatagtatagtttgaagtc

SEQ ID NO: 28627 - DNA, 20 bp, Artificial Sequence
  Description of Artificial Sequence: Synthetic oligonucleotide
  Target: SCN9A; (-) strand; PAM type: NRG; PAM sequence: CAG
ctcatagtatagtttgaagt

SEQ ID NO: 28628 - DNA, 20 bp, Artificial Sequence
  Description of Artificial Sequence: Synthetic oligonucleotide
  Target: SCN9A; (-) strand; PAM type: NRG; PAM sequence: AAG
taacctcatagtatagtttg

SEQ ID NO: 28629 - DNA, 20 bp, Artificial Sequence
  Description of Artificial Sequence: Synthetic oligonucleotide
  Target: SCN9A; (-) strand; PAM type: NRG; PAM sequence: TAG
gttactgtaacctcatagta

SEQ ID NO: 28630 - DNA, 20 bp, Artificial Sequence
  Description of Artificial Sequence: Synthetic oligonucleotide
  Target: SCN9A; (-) strand; PAM type: NRG; PAM sequence: TAG
ttttggttactgtaacctca

SEQ ID NO: 28631 - DNA, 20 bp, Artificial Sequence
  Description of Artificial Sequence: Synthetic oligonucleotide
  Target: SCN9A; (-) strand; PAM type: NRG; PAM sequence: TGG
gtaccactaccatgctgttt

SEQ ID NO: 28632 - DNA, 20 bp, Artificial Sequence
  Description of Artificial Sequence: Synthetic oligonucleotide
  Target: SCN9A; (-) strand; PAM type: NRG; PAM sequence: GGG
attggcctatatgtctgttt

SEQ ID NO: 28633 - DNA, 20 bp, Artificial Sequence
  Description of Artificial Sequence: Synthetic oligonucleotide
  Target: SCN9A; (-) strand; PAM type: NRG; PAM sequence: TGG
cattggcctatatgtctgtt

SEQ ID NO: 28634 - DNA, 20 bp, Artificial Sequence
  Description of Artificial Sequence: Synthetic oligonucleotide
  Target: SCN9A; (-) strand; PAM type: NRG; PAM sequence: TGG
aggtctctattctattccat

SEQ ID NO: 28635 - DNA, 20 bp, Artificial Sequence
  Description of Artificial Sequence: Synthetic oligonucleotide
  Target: SCN9A; (-) strand; PAM type: NRG; PAM sequence: AGG
gaagtgtggtgttatttctg

SEQ ID NO: 28636 - DNA, 20 bp, Artificial Sequence
  Description of Artificial Sequence: Synthetic oligonucleotide
  Target: SCN9A; (-) strand; PAM type: NRG; PAM sequence: GAG
agaagtgtggtgttatttct

SEQ ID NO: 28637 - DNA, 20 bp, Artificial Sequence
  Description of Artificial Sequence: Synthetic oligonucleotide
  Target: SCN9A; (-) strand; PAM type: NRG; PAM sequence: TGG
atcagatgcttgtagaagtg

SEQ ID NO: 28638 - DNA, 20 bp, Artificial Sequence
  Description of Artificial Sequence: Synthetic oligonucleotide
  Target: SCN9A; (-) strand; PAM type: NRG; PAM sequence: AAG
cgaagatcagatgcttgtag

SEQ ID NO: 28639 - DNA, 20 bp, Artificial Sequence
  Description of Artificial Sequence: Synthetic oligonucleotide
  Target: SCN9A; (-) strand; PAM type: NRG; PAM sequence: TAG
tgtcgaagatcagatgcttg

SEQ ID NO: 28640 - DNA, 20 bp, Artificial Sequence
  Description of Artificial Sequence: Synthetic oligonucleotide
  Target: SCN9A; (-) strand; PAM type: NRG; PAM sequence: CAG
ttgtcaggtttgtcgaagat

SEQ ID NO: 28641 - DNA, 20 bp, Artificial Sequence
  Description of Artificial Sequence: Synthetic oligonucleotide
  Target: SCN9A; (-) strand; PAM type: NRG; PAM sequence: AAG
tgtttttgtcaggtttgtcg

SEQ ID NO: 28642 - DNA, 20 bp, Artificial Sequence
  Description of Artificial Sequence: Synthetic oligonucleotide
  Target: SCN9A; (-) strand; PAM type: NRG; PAM sequence: AGG
ccacattgcttgtttttgtc

SEQ ID NO: 28643 - DNA, 20 bp, Artificial Sequence
  Description of Artificial Sequence: Synthetic oligonucleotide
  Target: SCN9A; (-) strand; PAM type: NRG; PAM sequence: CAG
tccacattgcttgtttttgt

SEQ ID NO: 28644 - DNA, 20 bp, Artificial Sequence
  Description of Artificial Sequence: Synthetic oligonucleotide
  Target: SCN9A; (-) strand; PAM type: NRG; PAM sequence: GGG
ccagcaccatttattatata

SEQ ID NO: 28645 - DNA, 20 bp, Artificial Sequence
  Description of Artificial Sequence: Synthetic oligonucleotide
  Target: SCN9A; (-) strand; PAM type: NRG; PAM sequence: AGG
cccagcaccatttattatat

SEQ ID NO: 28646 - DNA, 20 bp, Artificial Sequence
  Description of Artificial Sequence: Synthetic oligonucleotide
  Target: SCN9A; (-) strand; PAM type: NRG; PAM sequence: TAG
ccccagcaccatttattata

SEQ ID NO: 28647 - DNA, 20 bp, Artificial Sequence
  Description of Artificial Sequence: Synthetic oligonucleotide
  Target: SCN9A; (-) strand; PAM type: NRG; PAM sequence: CAG
atatggctagccagcttccc

SEQ ID NO: 28648 - DNA, 20 bp, Artificial Sequence
  Description of Artificial Sequence: Synthetic oligonucleotide
  Target: SCN9A; (-) strand; PAM type: NRG; PAM sequence: CAG
gttttctgcatatggctagc

SEQ ID NO: 28649 - DNA, 20 bp, Artificial Sequence
  Description of Artificial Sequence: Synthetic oligonucleotide
  Target: SCN9A; (-) strand; PAM type: NRG; PAM sequence: TAG
ttcagttttctgcatatggc

SEQ ID NO: 28650 - DNA, 20 bp, Artificial Sequence
  Description of Artificial Sequence: Synthetic oligonucleotide
  Target: SCN9A; (-) strand; PAM type: NRG; PAM sequence: TGG
cagtttcagttttctgcata

SEQ ID NO: 28651 - DNA, 20 bp, Artificial Sequence
  Description of Artificial Sequence: Synthetic oligonucleotide
  Target: SCN9A; (-) strand; PAM type: NRG; PAM sequence: CAG
gtaaggaaggagcccagttt

SEQ ID NO: 28652 - DNA, 20 bp, Artificial Sequence
  Description of Artificial Sequence: Synthetic oligonucleotide
  Target: SCN9A; (-) strand; PAM type: NRG; PAM sequence: CAG
taaggtgtaaggaaggagcc

SEQ ID NO: 28653 - DNA, 20 bp, Artificial Sequence
  Description of Artificial Sequence: Synthetic oligonucleotide
  Target: SCN9A; (-) strand; PAM type: NRG; PAM sequence: GAG
ttgtataaggtgtaaggaag

SEQ ID NO: 28654 - DNA, 20 bp, Artificial Sequence
  Description of Artificial Sequence: Synthetic oligonucleotide
  Target: SCN9A; (-) strand; PAM type: NRG; PAM sequence: AGG
ttttgtataaggtgtaagga

SEQ ID NO: 28655 - DNA, 20 bp, Artificial Sequence
  Description of Artificial Sequence: Synthetic oligonucleotide
  Target: SCN9A; (-) strand; PAM type: NRG; PAM sequence: AAG
tttttgtataaggtgtaagg

SEQ ID NO: 28656 - DNA, 20 bp, Artificial Sequence
  Description of Artificial Sequence: Synthetic oligonucleotide
  Target: SCN9A; (-) strand; PAM type: NRG; PAM sequence: AGG
taatttttgtataaggtgta

SEQ ID NO: 28657 - DNA, 20 bp, Artificial Sequence
  Description of Artificial Sequence: Synthetic oligonucleotide
  Target: SCN9A; (-) strand; PAM type: NRG; PAM sequence: AAG
ttaatttttgtataaggtgt

SEQ ID NO: 28658 - DNA, 20 bp, Artificial Sequence
  Description of Artificial Sequence: Synthetic oligonucleotide
  Target: SCN9A; (-) strand; PAM type: NRG; PAM sequence: AGG
cttgagttaatttttgtata

SEQ ID NO: 28659 - DNA, 20 bp, Artificial Sequence
  Description of Artificial Sequence: Synthetic oligonucleotide
  Target: SCN9A; (-) strand; PAM type: NRG; PAM sequence: AAG
tcttgagttaatttttgtat

SEQ ID NO: 28660 - DNA, 20 bp, Artificial Sequence
  Description of Artificial Sequence: Synthetic oligonucleotide
  Target: SCN9A; (-) strand; PAM type: NRG; PAM sequence: GAG
ttaagtctttaatccatctt

SEQ ID NO: 28661 - DNA, 20 bp, Artificial Sequence
  Description of Artificial Sequence: Synthetic oligonucleotide
  Target: SCN9A; (-) strand; PAM type: NRG; PAM sequence: AAG
atggtttggggttttacatt

SEQ ID NO: 28662 - DNA, 20 bp, Artificial Sequence
  Description of Artificial Sequence: Synthetic oligonucleotide
  Target: SCN9A; (-) strand; PAM type: NRG; PAM sequence: GGG
tctagggttttcatggtttg

SEQ ID NO: 28663 - DNA, 20 bp, Artificial Sequence
  Description of Artificial Sequence: Synthetic oligonucleotide
  Target: SCN9A; (-) strand; PAM type: NRG; PAM sequence: GGG
ttctagggttttcatggttt

SEQ ID NO: 28664 - DNA, 20 bp, Artificial Sequence
  Description of Artificial Sequence: Synthetic oligonucleotide
  Target: SCN9A; (-) strand; PAM type: NRG; PAM sequence: TGG
cttctagggttttcatggtt

SEQ ID NO: 28665 - DNA, 20 bp, Artificial Sequence
  Description of Artificial Sequence: Synthetic oligonucleotide
  Target: SCN9A; (-) strand; PAM type: NRG; PAM sequence: TGG
gttttcttctagggttttca

SEQ ID NO: 28666 - DNA, 20 bp, Artificial Sequence
  Description of Artificial Sequence: Synthetic oligonucleotide
  Target: SCN9A; (-) strand; PAM type: NRG; PAM sequence: GGG
gttgcctaggttttcttcta

SEQ ID NO: 28667 - DNA, 20 bp, Artificial Sequence
  Description of Artificial Sequence: Synthetic oligonucleotide
  Target: SCN9A; (-) strand; PAM type: NRG; PAM sequence: AGG
tgttgcctaggttttcttct

SEQ ID NO: 28668 - DNA, 20 bp, Artificial Sequence
  Description of Artificial Sequence: Synthetic oligonucleotide
  Target: SCN9A; (-) strand; PAM type: NRG; PAM sequence: TAG
gtgttgcctaggttttcttc

SEQ ID NO: 28669 - DNA, 20 bp, Artificial Sequence
  Description of Artificial Sequence: Synthetic oligonucleotide
  Target: SCN9A; (-) strand; PAM type: NRG; PAM sequence: AGG
tttcctgaatggtgttgcct

SEQ ID NO: 28670 - DNA, 20 bp, Artificial Sequence
  Description of Artificial Sequence: Synthetic oligonucleotide
  Target: SCN9A; (-) strand; PAM type: NRG; PAM sequence: TAG
atttcctgaatggtgttgcc

SEQ ID NO: 28671 - DNA, 20 bp, Artificial Sequence
  Description of Artificial Sequence: Synthetic oligonucleotide
  Target: SCN9A; (-) strand; PAM type: NRG; PAM sequence: TGG
gcccatgcctatttcctgaa

SEQ ID NO: 28672 - DNA, 20 bp, Artificial Sequence
  Description of Artificial Sequence: Synthetic oligonucleotide
  Target: SCN9A; (-) strand; PAM type: NRG; PAM sequence: AAG
cttttggtatttttgtcatg

SEQ ID NO: 28673 - DNA, 20 bp, Artificial Sequence
  Description of Artificial Sequence: Synthetic oligonucleotide
  Target: SCN9A; (-) strand; PAM type: NRG; PAM sequence: TGG
gctttggttgcaattgcttt

SEQ ID NO: 28674 - DNA, 20 bp, Artificial Sequence
  Description of Artificial Sequence: Synthetic oligonucleotide
  Target: SCN9A; (-) strand; PAM type: NRG; PAM sequence: TGG
ccatttgtcaattttggctt

SEQ ID NO: 28675 - DNA, 20 bp, Artificial Sequence
  Description of Artificial Sequence: Synthetic oligonucleotide
  Target: SCN9A; (-) strand; PAM type: NRG; PAM sequence: TGG
tatatcccatttgtcaattt

SEQ ID NO: 28676 - DNA, 20 bp, Artificial Sequence
  Description of Artificial Sequence: Synthetic oligonucleotide
  Target: SCN9A; (-) strand; PAM type: NRG; PAM sequence: TAG
tgtgcagaagctctttagtt

SEQ ID NO: 28677 - DNA, 20 bp, Artificial Sequence
  Description of Artificial Sequence: Synthetic oligonucleotide
  Target: SCN9A; (-) strand; PAM type: NRG; PAM sequence: TAG
tttgctgtgcagaagctctt

SEQ ID NO: 28678 - DNA, 20 bp, Artificial Sequence
  Description of Artificial Sequence: Synthetic oligonucleotide
  Target: SCN9A; (-) strand; PAM type: NRG; PAM sequence: AAG
tagtttcttttgctgtgcag

SEQ ID NO: 28679 - DNA, 20 bp, Artificial Sequence
  Description of Artificial Sequence: Synthetic oligonucleotide
  Target: SCN9A; (-) strand; PAM type: NRG; PAM sequence: CAG
tgttagtttcttttgctgtg

SEQ ID NO: 28680 - DNA, 20 bp, Artificial Sequence
  Description of Artificial Sequence: Synthetic oligonucleotide
  Target: SCN9A; (-) strand; PAM type: NRG; PAM sequence: TAG
ttgcctgttcactctgatgt

SEQ ID NO: 28681 - DNA, 20 bp, Artificial Sequence
  Description of Artificial Sequence: Synthetic oligonucleotide
  Target: SCN9A; (-) strand; PAM type: NRG; PAM sequence: TAG
caaatttttctcccattcta

SEQ ID NO: 28682 - DNA, 20 bp, Artificial Sequence
  Description of Artificial Sequence: Synthetic oligonucleotide
  Target: SCN9A; (-) strand; PAM type: NRG; PAM sequence: TAG
ttagacctttgtcagatggg

SEQ ID NO: 28683 - DNA, 20 bp, Artificial Sequence
  Description of Artificial Sequence: Synthetic oligonucleotide
  Target: SCN9A; (-) strand; PAM type: NRG; PAM sequence: GGG
atattagacctttgtcagat

SEQ ID NO: 28684 - DNA, 20 bp, Artificial Sequence
  Description of Artificial Sequence: Synthetic oligonucleotide
  Target: SCN9A; (-) strand; PAM type: NRG; PAM sequence: TGG
aatattagacctttgtcaga

SEQ ID NO: 28685 - DNA, 20 bp, Artificial Sequence
  Description of Artificial Sequence: Synthetic oligonucleotide
  Target: SCN9A; (-) strand; PAM type: NRG; PAM sequence: CAG
tcttaatattagacctttgt

SEQ ID NO: 28686 - DNA, 20 bp, Artificial Sequence
  Description of Artificial Sequence: Synthetic oligonucleotide
  Target: SCN9A; (-) strand; PAM type: NRG; PAM sequence: TAG
tacttgtagattcttaatat

SEQ ID NO: 28687 - DNA, 20 bp, Artificial Sequence
  Description of Artificial Sequence: Synthetic oligonucleotide
  Target: SCN9A; (-) strand; PAM type: NRG; PAM sequence: TAG
aaatttgtttaagttacttg

SEQ ID NO: 28688 - DNA, 20 bp, Artificial Sequence
  Description of Artificial Sequence: Synthetic oligonucleotide
  Target: SCN9A; (-) strand; PAM type: NRG; PAM sequence: AAG
attatcttataaatttgttt

SEQ ID NO: 28689 - DNA, 20 bp, Artificial Sequence
  Description of Artificial Sequence: Synthetic oligonucleotide
  Target: SCN9A; (-) strand; PAM type: NRG; PAM sequence: TAG
ttacattatacaattattaa

SEQ ID NO: 28690 - DNA, 20 bp, Artificial Sequence
  Description of Artificial Sequence: Synthetic oligonucleotide
  Target: SCN9A; (-) strand; PAM type: NRG; PAM sequence: AAG
taaaatgctttgtatgataa

SEQ ID NO: 28691 - DNA, 20 bp, Artificial Sequence
  Description of Artificial Sequence: Synthetic oligonucleotide
  Target: SCN9A; (-) strand; PAM type: NRG; PAM sequence: CAG
acttatttttcatttaatat

SEQ ID NO: 28692 - DNA, 20 bp, Artificial Sequence
  Description of Artificial Sequence: Synthetic oligonucleotide
  Target: SCN9A; (-) strand; PAM type: NRG; PAM sequence: AAG
aataatttttcatcagaggt

SEQ ID NO: 28693 - DNA, 20 bp, Artificial Sequence
  Description of Artificial Sequence: Synthetic oligonucleotide
  Target: SCN9A; (-) strand; PAM type: NRG; PAM sequence: AGG
ttaaaataatttttcatcag

SEQ ID NO: 28694 - DNA, 20 bp, Artificial Sequence
  Description of Artificial Sequence: Synthetic oligonucleotide
  Target: SCN9A; (-) strand; PAM type: NRG; PAM sequence: GAG
attaaaataatttttcatca

SEQ ID NO: 28695 - DNA, 20 bp, Artificial Sequence
  Description of Artificial Sequence: Synthetic oligonucleotide
  Target: SCN9A; (-) strand; PAM type: NRG; PAM sequence: CAG
aaattaaaataatttttcat

SEQ ID NO: 28696 - DNA, 20 bp, Artificial Sequence
  Description of Artificial Sequence: Synthetic oligonucleotide
  Target: SCN9A; (-) strand; PAM type: NRG; PAM sequence: AAG
gtcacctttactcaaaatta

SEQ ID NO: 28697 - DNA, 20 bp, Artificial Sequence
  Description of Artificial Sequence: Synthetic oligonucleotide
  Target: SCN9A; (-) strand; PAM type: NRG; PAM sequence: TGG
ttttttaaatatgcaagaag

SEQ ID NO: 28698 - DNA, 20 bp, Artificial Sequence
  Description of Artificial Sequence: Synthetic oligonucleotide
  Target: SCN9A; (-) strand; PAM type: NRG; PAM sequence: AAG
atattttttaaatatgcaag

SEQ ID NO: 28699 - DNA, 20 bp, Artificial Sequence
  Description of Artificial Sequence: Synthetic oligonucleotide
  Target: SCN9A; (-) strand; PAM type: NRG; PAM sequence: AAG
caaatattttttaaatatgc

SEQ ID NO: 28700 - DNA, 20 bp, Artificial Sequence
  Description of Artificial Sequence: Synthetic oligonucleotide
  Target: SCN9A; (-) strand; PAM type: NRG; PAM sequence: GGG
atgcactttacagcaaaaat

SEQ ID NO: 28701 - DNA, 20 bp, Artificial Sequence
  Description of Artificial Sequence: Synthetic oligonucleotide
  Target: SCN9A; (-) strand; PAM type: NRG; PAM sequence: TGG
gatgcactttacagcaaaaa

SEQ ID NO: 28702 - DNA, 20 bp, Artificial Sequence
  Description of Artificial Sequence: Synthetic oligonucleotide
  Target: SCN9A; (-) strand; PAM type: NRG; PAM sequence: CAG
attatgtaagatgcacttta

SEQ ID NO: 28703 - DNA, 20 bp, Artificial Sequence
  Description of Artificial Sequence: Synthetic oligonucleotide
  Target: SCN9A; (-) strand; PAM type: NRG; PAM sequence: AAG
aatgaattcggaaattatgt

SEQ ID NO: 28704 - DNA, 20 bp, Artificial Sequence
  Description of Artificial Sequence: Synthetic oligonucleotide
  Target: SCN9A; (-) strand; PAM type: NRG; PAM sequence: CGG
gagaatattataaatgaatt

SEQ ID NO: 28705 - DNA, 20 bp, Artificial Sequence
  Description of Artificial Sequence: Synthetic oligonucleotide
  Target: SCN9A; (-) strand; PAM type: NRG; PAM sequence: GAG
tttatatttactttatttcc

SEQ ID NO: 28706 - DNA, 20 bp, Artificial Sequence
  Description of Artificial Sequence: Synthetic oligonucleotide
  Target: SCN9A; (-) strand; PAM type: NRG; PAM sequence: TGG
atctgtttttttttcttttt

SEQ ID NO: 28707 - DNA, 20 bp, Artificial Sequence
  Description of Artificial Sequence: Synthetic oligonucleotide
  Target: SCN9A; (-) strand; PAM type: NRG; PAM sequence: CAG
cacttttctcagaatagctg

SEQ ID NO: 28708 - DNA, 20 bp, Artificial Sequence
  Description of Artificial Sequence: Synthetic oligonucleotide
  Target: SCN9A; (-) strand; PAM type: NRG; PAM sequence: TAG
atgattcacttttctcagaa

SEQ ID NO: 28709 - DNA, 20 bp, Artificial Sequence
  Description of Artificial Sequence: Synthetic oligonucleotide
  Target: SCN9A; (-) strand; PAM type: NRG; PAM sequence: CAG
taacaatgattcacttttct

SEQ ID NO: 28710 - DNA, 20 bp, Artificial Sequence
  Description of Artificial Sequence: Synthetic oligonucleotide
  Target: SCN9A; (-) strand; PAM type: NRG; PAM sequence: TAG
agaccaaaatgattattcta

SEQ ID NO: 28711 - DNA, 20 bp, Artificial Sequence
  Description of Artificial Sequence: Synthetic oligonucleotide
  Target: SCN9A; (-) strand; PAM type: NRG; PAM sequence: GAG
gcagccaagccaaaaggaag

SEQ ID NO: 28712 - DNA, 20 bp, Artificial Sequence
  Description of Artificial Sequence: Synthetic oligonucleotide
  Target: SCN9A; (-) strand; PAM type: NRG; PAM sequence: AGG
cagcagccaagccaaaagga

SEQ ID NO: 28713 - DNA, 20 bp, Artificial Sequence
  Description of Artificial Sequence: Synthetic oligonucleotide
  Target: SCN9A; (-) strand; PAM type: NRG; PAM sequence: AAG
tcagcagccaagccaaaagg

SEQ ID NO: 28714 - DNA, 20 bp, Artificial Sequence
  Description of Artificial Sequence: Synthetic oligonucleotide
  Target: SCN9A; (-) strand; PAM type: NRG; PAM sequence: AGG
gtctcagcagccaagccaaa

SEQ ID NO: 28715 - DNA, 20 bp, Artificial Sequence
  Description of Artificial Sequence: Synthetic oligonucleotide
  Target: SCN9A; (-) strand; PAM type: NRG; PAM sequence: AAG
agtctcagcagccaagccaa

SEQ ID NO: 28716 - DNA, 20 bp, Artificial Sequence
  Description of Artificial Sequence: Synthetic oligonucleotide
  Target: SCN9A; (-) strand; PAM type: NRG; PAM sequence: AAG
cttgtatagtctcagcagcc

SEQ ID NO: 28717 - DNA, 20 bp, Artificial Sequence
  Description of Artificial Sequence: Synthetic oligonucleotide
  Target: SCN9A; (-) strand; PAM type: NRG; PAM sequence: CAG
atttacttgtatagtctcag

SEQ ID NO: 28718 - DNA, 20 bp, Artificial Sequence
  Description of Artificial Sequence: Synthetic oligonucleotide
  Target: SCN9A; (-) strand; PAM type: NRG; PAM sequence: CAG
tccatttacttgtatagtct

SEQ ID NO: 28719 - DNA, 20 bp, Artificial Sequence
  Description of Artificial Sequence: Synthetic oligonucleotide
  Target: SCN9A; (-) strand; PAM type: NRG; PAM sequence: TAG
gtggtctccatttacttgta

SEQ ID NO: 28720 - DNA, 20 bp, Artificial Sequence
  Description of Artificial Sequence: Synthetic oligonucleotide
  Target: SCN9A; (-) strand; PAM type: NRG; PAM sequence: TGG
atgtgaacctcttggggctg

SEQ ID NO: 28721 - DNA, 20 bp, Artificial Sequence
  Description of Artificial Sequence: Synthetic oligonucleotide
  Target: SCN9A; (-) strand; PAM type: NRG; PAM sequence: GGG
acttgaatgtgaacctcttg

SEQ ID NO: 28722 - DNA, 20 bp, Artificial Sequence
  Description of Artificial Sequence: Synthetic oligonucleotide
  Target: SCN9A; (-) strand; PAM type: NRG; PAM sequence: GGG
aacttgaatgtgaacctctt

SEQ ID NO: 28723 - DNA, 20 bp, Artificial Sequence
  Description of Artificial Sequence: Synthetic oligonucleotide
  Target: SCN9A; (-) strand; PAM type: NRG; PAM sequence: TGG
taacttgaatgtgaacctct

SEQ ID NO: 28724 - DNA, 20 bp, Artificial Sequence
  Description of Artificial Sequence: Synthetic oligonucleotide
  Target: SCN9A; (-) strand; PAM type: NRG; PAM sequence: TGG
attgcaagtggtaattcatg

SEQ ID NO: 28725 - DNA, 20 bp, Artificial Sequence
  Description of Artificial Sequence: Synthetic oligonucleotide
  Target: SCN9A; (-) strand; PAM type: NRG; PAM sequence: TGG
ttgatctcttgtattgcaag

SEQ ID NO: 28726 - DNA, 20 bp, Artificial Sequence
  Description of Artificial Sequence: Synthetic oligonucleotide
  Target: SCN9A; (-) strand; PAM type: NRG; PAM sequence: AAG
tcattgatctcttgtattgc

SEQ ID NO: 28727 - DNA, 20 bp, Artificial Sequence
  Description of Artificial Sequence: Synthetic oligonucleotide
  Target: SCN9A; (-) strand; PAM type: NRG; PAM sequence: TAG
aaatcaattgctcccaactg

SEQ ID NO: 28728 - DNA, 20 bp, Artificial Sequence
  Description of Artificial Sequence: Synthetic oligonucleotide
  Target: SCN9A; (-) strand; PAM type: NRG; PAM sequence: AAG
aagatgcaattcatttctct

SEQ ID NO: 28729 - DNA, 20 bp, Artificial Sequence
  Description of Artificial Sequence: Synthetic oligonucleotide
  Target: SCN9A; (-) strand; PAM type: NRG; PAM sequence: AAG
tgaactcctatttaaagtta

SEQ ID NO: 28730 - DNA, 20 bp, Artificial Sequence
  Description of Artificial Sequence: Synthetic oligonucleotide
  Target: SCN9A; (-) strand; PAM type: NRG; PAM sequence: AAG
tatttttgaactcctattta

SEQ ID NO: 28731 - DNA, 20 bp, Artificial Sequence
  Description of Artificial Sequence: Synthetic oligonucleotide
  Target: SCN9A; (-) strand; PAM type: NRG; PAM sequence: AGG
tgggatggcctgaagagaag

SEQ ID NO: 28732 - DNA, 20 bp, Artificial Sequence
  Description of Artificial Sequence: Synthetic oligonucleotide
  Target: SCN9A; (-) strand; PAM type: NRG; PAM sequence: GAG
ttgggatggcctgaagagaa

SEQ ID NO: 28733 - DNA, 20 bp, Artificial Sequence
  Description of Artificial Sequence: Synthetic oligonucleotide
  Target: SCN9A; (-) strand; PAM type: NRG; PAM sequence: AAG
gcttgggatggcctgaagag

SEQ ID NO: 28734 - DNA, 20 bp, Artificial Sequence
  Description of Artificial Sequence: Synthetic oligonucleotide
  Target: SCN9A; (-) strand; PAM type: NRG; PAM sequence: GAG
cgtgcttgggatggcctgaa

SEQ ID NO: 28735 - DNA, 20 bp, Artificial Sequence
  Description of Artificial Sequence: Synthetic oligonucleotide
  Target: SCN9A; (-) strand; PAM type: NRG; PAM sequence: AAG
tgcgtgcttgggatggcctg

SEQ ID NO: 28736 - DNA, 20 bp, Artificial Sequence
  Description of Artificial Sequence: Synthetic oligonucleotide
  Target: SCN9A; (-) strand; PAM type: NRG; PAM sequence: TGG
ttttccatgcgtgcttggga

SEQ ID NO: 28737 - DNA, 20 bp, Artificial Sequence
  Description of Artificial Sequence: Synthetic oligonucleotide
  Target: SCN9A; (-) strand; PAM type: NRG; PAM sequence: GGG
actgttttccatgcgtgctt

SEQ ID NO: 28738 - DNA, 20 bp, Artificial Sequence
  Description of Artificial Sequence: Synthetic oligonucleotide
  Target: SCN9A; (-) strand; PAM type: NRG; PAM sequence: TGG
gactgttttccatgcgtgct

SEQ ID NO: 28739 - DNA, 20 bp, Artificial Sequence
  Description of Artificial Sequence: Synthetic oligonucleotide
  Target: SCN9A; (-) strand; PAM type: NRG; PAM sequence: TGG
tctcaagctgctcctgcaca

SEQ ID NO: 28740 - DNA, 20 bp, Artificial Sequence
  Description of Artificial Sequence: Synthetic oligonucleotide
  Target: SCN9A; (-) strand; PAM type: NRG; PAM sequence: AAG
acatactgtaatgttttctc

SEQ ID NO: 28741 - DNA, 20 bp, Artificial Sequence
  Description of Artificial Sequence: Synthetic oligonucleotide
  Target: SCN9A; (-) strand; PAM type: NRG; PAM sequence: AGG
tggggtcctagttaagtacc

SEQ ID NO: 28742 - DNA, 20 bp, Artificial Sequence
  Description of Artificial Sequence: Synthetic oligonucleotide
  Target: SCN9A; (-) strand; PAM type: NRG; PAM sequence: CAG
atggggtcctagttaagtac

SEQ ID NO: 28743 - DNA, 20 bp, Artificial Sequence
  Description of Artificial Sequence: Synthetic oligonucleotide
  Target: SCN9A; (-) strand; PAM type: NRG; PAM sequence: AAG
catcccatggggtcctagtt

SEQ ID NO: 28744 - DNA, 20 bp, Artificial Sequence
  Description of Artificial Sequence: Synthetic oligonucleotide
  Target: SCN9A; (-) strand; PAM type: NRG; PAM sequence: TAG
tatatcatcccatggggtcc

SEQ ID NO: 28745 - DNA, 20 bp, Artificial Sequence
  Description of Artificial Sequence: Synthetic oligonucleotide
  Target: SCN9A; (-) strand; PAM type: NRG; PAM sequence: GGG
cctgagtatatcatcccatg

SEQ ID NO: 28746 - DNA, 20 bp, Artificial Sequence
  Description of Artificial Sequence: Synthetic oligonucleotide
  Target: SCN9A; (-) strand; PAM type: NRG; PAM sequence: GGG
tcctgagtatatcatcccat

SEQ ID NO: 28747 - DNA, 20 bp, Artificial Sequence
  Description of Artificial Sequence: Synthetic oligonucleotide
  Target: SCN9A; (-) strand; PAM type: NRG; PAM sequence: TGG
ttcctgagtatatcatccca

SEQ ID NO: 28748 - DNA, 20 bp, Artificial Sequence
  Description of Artificial Sequence: Synthetic oligonucleotide
  Target: SCN9A; (-) strand; PAM type: NRG; PAM sequence: GAG
tctagatctctcgccttcct

SEQ ID NO: 28749 - DNA, 20 bp, Artificial Sequence
  Description of Artificial Sequence: Synthetic oligonucleotide
  Target: SCN9A; (-) strand; PAM type: NRG; PAM sequence: TAG
ttctgggcatatttaatctc

SEQ ID NO: 28750 - DNA, 20 bp, Artificial Sequence
  Description of Artificial Sequence: Synthetic oligonucleotide
  Target: SCN9A; (-) strand; PAM type: NRG; PAM sequence: GGG
ataattttcttatcttttct

SEQ ID NO: 28751 - DNA, 20 bp, Artificial Sequence
  Description of Artificial Sequence: Synthetic oligonucleotide
  Target: SCN9A; (-) strand; PAM type: NRG; PAM sequence: TGG
aataattttcttatcttttc

SEQ ID NO: 28752 - DNA, 20 bp, Artificial Sequence
  Description of Artificial Sequence: Synthetic oligonucleotide
  Target: SCN9A; (-) strand; PAM type: NRG; PAM sequence: TAG
cccatcactaataatatggg

SEQ ID NO: 28753 - DNA, 20 bp, Artificial Sequence
  Description of Artificial Sequence: Synthetic oligonucleotide
  Target: SCN9A; (-) strand; PAM type: NRG; PAM sequence: GGG
actcccatcactaataatat

SEQ ID NO: 28754 - DNA, 20 bp, Artificial Sequence
  Description of Artificial Sequence: Synthetic oligonucleotide
  Target: SCN9A; (-) strand; PAM type: NRG; PAM sequence: TGG
tactcccatcactaataata

SEQ ID NO: 28755 - DNA, 20 bp, Artificial Sequence
  Description of Artificial Sequence: Synthetic oligonucleotide
  Target: SCN9A; (-) strand; PAM type: NRG; PAM sequence: AAG
tatcttattaccaaaattat

SEQ ID NO: 28756 - DNA, 20 bp, Artificial Sequence
  Description of Artificial Sequence: Synthetic oligonucleotide
  Target: SCN9A; (-) strand; PAM type: NRG; PAM sequence: AGG
ttttatttatttgagaatgg

SEQ ID NO: 28757 - DNA, 20 bp, Artificial Sequence
  Description of Artificial Sequence: Synthetic oligonucleotide
  Target: SCN9A; (-) strand; PAM type: NRG; PAM sequence: GAG
tttttatttatttgagaatg

SEQ ID NO: 28758 - DNA, 20 bp, Artificial Sequence
  Description of Artificial Sequence: Synthetic oligonucleotide
  Target: SCN9A; (-) strand; PAM type: NRG; PAM sequence: TGG
gttttttatttatttgagaa

SEQ ID NO: 28759 - DNA, 20 bp, Artificial Sequence
  Description of Artificial Sequence: Synthetic oligonucleotide
  Target: SCN9A; (-) strand; PAM type: NRG; PAM sequence: GAG
aggaggttttttatttattt

SEQ ID NO: 28760 - DNA, 20 bp, Artificial Sequence
  Description of Artificial Sequence: Synthetic oligonucleotide
  Target: SCN9A; (-) strand; PAM type: NRG; PAM sequence: AGG
tgttaagagcctgtattagg

SEQ ID NO: 28761 - DNA, 20 bp, Artificial Sequence
  Description of Artificial Sequence: Synthetic oligonucleotide
  Target: SCN9A; (-) strand; PAM type: NRG; PAM sequence: GAG
atgttaagagcctgtattag

SEQ ID NO: 28762 - DNA, 20 bp, Artificial Sequence
  Description of Artificial Sequence: Synthetic oligonucleotide
  Target: SCN9A; (-) strand; PAM type: NRG; PAM sequence: AGG
gtatgttaagagcctgtatt

SEQ ID NO: 28763 - DNA, 20 bp, Artificial Sequence
  Description of Artificial Sequence: Synthetic oligonucleotide
  Target: SCN9A; (-) strand; PAM type: NRG; PAM sequence: TAG
tgtatgttaagagcctgtat

SEQ ID NO: 28764 - DNA, 20 bp, Artificial Sequence
  Description of Artificial Sequence: Synthetic oligonucleotide
  Target: SCN9A; (-) strand; PAM type: NRG; PAM sequence: GAG
atgtacctggtgtatgttaa

SEQ ID NO: 28765 - DNA, 20 bp, Artificial Sequence
  Description of Artificial Sequence: Synthetic oligonucleotide
  Target: SCN9A; (-) strand; PAM type: NRG; PAM sequence: AAG
atatgtacctggtgtatgtt

SEQ ID NO: 28766 - DNA, 20 bp, Artificial Sequence
  Description of Artificial Sequence: Synthetic oligonucleotide
  Target: SCN9A; (-) strand; PAM type: NRG; PAM sequence: TGG
ttttgaatggcatatgtacc

SEQ ID NO: 28767 - DNA, 20 bp, Artificial Sequence
  Description of Artificial Sequence: Synthetic oligonucleotide
  Target: SCN9A; (-) strand; PAM type: NRG; PAM sequence: TGG
acatgcattgtatttttgaa

SEQ ID NO: 28768 - DNA, 20 bp, Artificial Sequence
  Description of Artificial Sequence: Synthetic oligonucleotide
  Target: SCN9A; (-) strand; PAM type: NRG; PAM sequence: GAG
taccaacaggtgagtaccaa

SEQ ID NO: 28769 - DNA, 20 bp, Artificial Sequence
  Description of Artificial Sequence: Synthetic oligonucleotide
  Target: SCN9A; (-) strand; PAM type: NRG; PAM sequence: AAG
tttaccaacaggtgagtacc

SEQ ID NO: 28770 - DNA, 20 bp, Artificial Sequence
  Description of Artificial Sequence: Synthetic oligonucleotide
  Target: SCN9A; (-) strand; PAM type: NRG; PAM sequence: GAG
gaaaacctttaccaacaggt

SEQ ID NO: 28771 - DNA, 20 bp, Artificial Sequence
  Description of Artificial Sequence: Synthetic oligonucleotide
  Target: SCN9A; (-) strand; PAM type: NRG; PAM sequence: AGG
ctgggaaaacctttaccaac

SEQ ID NO: 28772 - DNA, 20 bp, Artificial Sequence
  Description of Artificial Sequence: Synthetic oligonucleotide
  Target: SCN9A; (-) strand; PAM type: NRG; PAM sequence: CAG
actgggaaaacctttaccaa

SEQ ID NO: 28773 - DNA, 20 bp, Artificial Sequence
  Description of Artificial Sequence: Synthetic oligonucleotide
  Target: SCN9A; (-) strand; PAM type: NRG; PAM sequence: GGG
gctaatgacccaagattact

SEQ ID NO: 28774 - DNA, 20 bp, Artificial Sequence
  Description of Artificial Sequence: Synthetic oligonucleotide
  Target: SCN9A; (-) strand; PAM type: NRG; PAM sequence: TGG
ggctaatgacccaagattac

SEQ ID NO: 28775 - DNA, 20 bp, Artificial Sequence
  Description of Artificial Sequence: Synthetic oligonucleotide
  Target: SCN9A; (-) strand; PAM type: NRG; PAM sequence: AAG
cttgtttaggctaatgaccc

SEQ ID NO: 28776 - DNA, 20 bp, Artificial Sequence
  Description of Artificial Sequence: Synthetic oligonucleotide
  Target: SCN9A; (-) strand; PAM type: NRG; PAM sequence: AGG
gggccttcttagccttgttt

SEQ ID NO: 28777 - DNA, 20 bp, Artificial Sequence
  Description of Artificial Sequence: Synthetic oligonucleotide
  Target: SCN9A; (-) strand; PAM type: NRG; PAM sequence: TAG
tgggccttcttagccttgtt

SEQ ID NO: 28778 - DNA, 20 bp, Artificial Sequence
  Description of Artificial Sequence: Synthetic oligonucleotide
  Target: SCN9A; (-) strand; PAM type: NRG; PAM sequence: TAG
cactttcagctgggccttct

SEQ ID NO: 28779 - DNA, 20 bp, Artificial Sequence
  Description of Artificial Sequence: Synthetic oligonucleotide
  Target: SCN9A; (-) strand; PAM type: NRG; PAM sequence: GGG
gagctttgacactttcagct

SEQ ID NO: 28780 - DNA, 20 bp, Artificial Sequence
  Description of Artificial Sequence: Synthetic oligonucleotide
  Target: SCN9A; (-) strand; PAM type: NRG; PAM sequence: TGG
cgagctttgacactttcagc

SEQ ID NO: 28781 - DNA, 20 bp, Artificial Sequence
  Description of Artificial Sequence: Synthetic oligonucleotide
  Target: SCN9A; (-) strand; PAM type: NRG; PAM sequence: CAG
tacacgagctttgacacttt

SEQ ID NO: 28782 - DNA, 20 bp, Artificial Sequence
  Description of Artificial Sequence: Synthetic oligonucleotide
  Target: SCN9A; (-) strand; PAM type: NRG; PAM sequence: GAG
aaccctgattatggctacac

SEQ ID NO: 28783 - DNA, 20 bp, Artificial Sequence
  Description of Artificial Sequence: Synthetic oligonucleotide
  Target: SCN9A; (-) strand; PAM type: NRG; PAM sequence: TGG
attggcagaaaccctgatta

SEQ ID NO: 28784 - DNA, 20 bp, Artificial Sequence
  Description of Artificial Sequence: Synthetic oligonucleotide
  Target: SCN9A; (-) strand; PAM type: NRG; PAM sequence: CAG
tacacctgtgtgaaaattgg

SEQ ID NO: 28785 - DNA, 20 bp, Artificial Sequence
  Description of Artificial Sequence: Synthetic oligonucleotide
  Target: SCN9A; (-) strand; PAM type: NRG; PAM sequence: TGG
gggtacacctgtgtgaaaat

SEQ ID NO: 28786 - DNA, 20 bp, Artificial Sequence
  Description of Artificial Sequence: Synthetic oligonucleotide
  Target: SCN9A; (-) strand; PAM type: NRG; PAM sequence: GGG
tgtgtagtcagtgtccagag

SEQ ID NO: 28787 - DNA, 20 bp, Artificial Sequence
  Description of Artificial Sequence: Synthetic oligonucleotide
  Target: SCN9A; (-) strand; PAM type: NRG; PAM sequence: GGG
gtgtgtagtcagtgtccaga

SEQ ID NO: 28788 - DNA, 20 bp, Artificial Sequence
  Description of Artificial Sequence: Synthetic oligonucleotide
  Target: SCN9A; (-) strand; PAM type: NRG; PAM sequence: AGG
cgtgtgtagtcagtgtccag

SEQ ID NO: 28789 - DNA, 20 bp, Artificial Sequence
  Description of Artificial Sequence: Synthetic oligonucleotide
  Target: SCN9A; (-) strand; PAM type: NRG; PAM sequence: GAG
tcgtgtgtagtcagtgtcca

SEQ ID NO: 28790 - DNA, 20 bp, Artificial Sequence
  Description of Artificial Sequence: Synthetic oligonucleotide
  Target: SCN9A; (-) strand; PAM type: NRG; PAM sequence: CAG
tctcgtgtgtagtcagtgtc

SEQ ID NO: 28791 - DNA, 20 bp, Artificial Sequence
  Description of Artificial Sequence: Synthetic oligonucleotide
  Target: SCN9A; (-) strand; PAM type: NRG; PAM sequence: CAG
tgttctttctcgtgtgtagt

SEQ ID NO: 28792 - DNA, 20 bp, Artificial Sequence
  Description of Artificial Sequence: Synthetic oligonucleotide
  Target: SCN9A; (-) strand; PAM type: NRG; PAM sequence: TAG
ataatgttctttctcgtgtg

SEQ ID NO: 28793 - DNA, 20 bp, Artificial Sequence
  Description of Artificial Sequence: Synthetic oligonucleotide
  Target: SCN9A; (-) strand; PAM type: NRG; PAM sequence: AAG
gctatttagcttgtgtcctg

SEQ ID NO: 28794 - DNA, 20 bp, Artificial Sequence
  Description of Artificial Sequence: Synthetic oligonucleotide
  Target: SCN9A; (-) strand; PAM type: NRG; PAM sequence: TAG
aacttttcagtaaggctatt

SEQ ID NO: 28795 - DNA, 20 bp, Artificial Sequence
  Description of Artificial Sequence: Synthetic oligonucleotide
  Target: SCN9A; (-) strand; PAM type: NRG; PAM sequence: AGG
gagtttgtaacttttcagta

SEQ ID NO: 28796 - DNA, 20 bp, Artificial Sequence
  Description of Artificial Sequence: Synthetic oligonucleotide
  Target: SCN9A; (-) strand; PAM type: NRG; PAM sequence: AAG
tgagtttgtaacttttcagt

SEQ ID NO: 28797 - DNA, 20 bp, Artificial Sequence
  Description of Artificial Sequence: Synthetic oligonucleotide
  Target: SCN9A; (-) strand; PAM type: NRG; PAM sequence: CAG
accttgagtttgtaactttt

SEQ ID NO: 28798 - DNA, 20 bp, Artificial Sequence
  Description of Artificial Sequence: Synthetic oligonucleotide
  Target: SCN9A; (-) strand; PAM type: NRG; PAM sequence: GAG
ccccctatagaagaaacctt

SEQ ID NO: 28799 - DNA, 20 bp, Artificial Sequence
  Description of Artificial Sequence: Synthetic oligonucleotide
  Target: SCN9A; (-) strand; PAM type: NRG; PAM sequence: AAG
tcaatattgtccccctatag

SEQ ID NO: 28800 - DNA, 20 bp, Artificial Sequence
  Description of Artificial Sequence: Synthetic oligonucleotide
  Target: SCN9A; (-) strand; PAM type: NRG; PAM sequence: TAG
tattcaatattgtcccccta

SEQ ID NO: 28801 - DNA, 20 bp, Artificial Sequence
  Description of Artificial Sequence: Synthetic oligonucleotide
  Target: SCN9A; (-) strand; PAM type: NRG; PAM sequence: TAG
taaagtcactaagtagtcag

SEQ ID NO: 28802 - DNA, 20 bp, Artificial Sequence
  Description of Artificial Sequence: Synthetic oligonucleotide
  Target: SCN9A; (-) strand; PAM type: NRG; PAM sequence: CAG
tggtaaagtcactaagtagt

SEQ ID NO: 28803 - DNA, 20 bp, Artificial Sequence
  Description of Artificial Sequence: Synthetic oligonucleotide
  Target: SCN9A; (-) strand; PAM type: NRG; PAM sequence: TAG
aatttggtaaagtcactaag

SEQ ID NO: 28804 - DNA, 20 bp, Artificial Sequence
  Description of Artificial Sequence: Synthetic oligonucleotide
  Target: SCN9A; (-) strand; PAM type: NRG; PAM sequence: AAG
aagaatttggtaaagtcact

SEQ ID NO: 28805 - DNA, 20 bp, Artificial Sequence
  Description of Artificial Sequence: Synthetic oligonucleotide
  Target: SCN9A; (-) strand; PAM type: NRG; PAM sequence: AAG
atgccttgaagaatttggta

SEQ ID NO: 28806 - DNA, 20 bp, Artificial Sequence
  Description of Artificial Sequence: Synthetic oligonucleotide
  Target: SCN9A; (-) strand; PAM type: NRG; PAM sequence: TGG
gacttatgccttgaagaatt

SEQ ID NO: 28807 - DNA, 20 bp, Artificial Sequence
  Description of Artificial Sequence: Synthetic oligonucleotide
  Target: SCN9A; (-) strand; PAM type: NRG; PAM sequence: AAG
acagacagacttatgccttg

SEQ ID NO: 28808 - DNA, 20 bp, Artificial Sequence
  Description of Artificial Sequence: Synthetic oligonucleotide
  Target: SCN9A; (-) strand; PAM type: NRG; PAM sequence: CAG
tattatcctattttcacaga

SEQ ID NO: 28809 - DNA, 20 bp, Artificial Sequence
  Description of Artificial Sequence: Synthetic oligonucleotide
  Target: SCN9A; (-) strand; PAM type: NRG; PAM sequence: CAG
atgttattatcctattttca

SEQ ID NO: 28810 - DNA, 20 bp, Artificial Sequence
  Description of Artificial Sequence: Synthetic oligonucleotide
  Target: SCN9A; (-) strand; PAM type: NRG; PAM sequence: TAG
caagtcttattttcttgagg

SEQ ID NO: 28811 - DNA, 20 bp, Artificial Sequence
  Description of Artificial Sequence: Synthetic oligonucleotide
  Target: SCN9A; (-) strand; PAM type: NRG; PAM sequence: AGG
ttacaagtcttattttcttg

SEQ ID NO: 28812 - DNA, 20 bp, Artificial Sequence
  Description of Artificial Sequence: Synthetic oligonucleotide
  Target: SCN9A; (-) strand; PAM type: NRG; PAM sequence: GAG
attacaagtcttattttctt

SEQ ID NO: 28813 - DNA, 20 bp, Artificial Sequence
  Description of Artificial Sequence: Synthetic oligonucleotide
  Target: SCN9A; (-) strand; PAM type: NRG; PAM sequence: AAG
atcttatttaaacttattac

SEQ ID NO: 28814 - DNA, 20 bp, Artificial Sequence
  Description of Artificial Sequence: Synthetic oligonucleotide
  Target: SCN9A; (-) strand; PAM type: NRG; PAM sequence: AAG
ctatgtgcaggatgtaagct

SEQ ID NO: 28815 - DNA, 20 bp, Artificial Sequence
  Description of Artificial Sequence: Synthetic oligonucleotide
  Target: SCN9A; (-) strand; PAM type: NRG; PAM sequence: AAG
actttctatgtgcaggatgt

SEQ ID NO: 28816 - DNA, 20 bp, Artificial Sequence
  Description of Artificial Sequence: Synthetic oligonucleotide
  Target: SCN9A; (-) strand; PAM type: NRG; PAM sequence: AGG
attaaacactttctatgtgc

SEQ ID NO: 28817 - DNA, 20 bp, Artificial Sequence
  Description of Artificial Sequence: Synthetic oligonucleotide
  Target: SCN9A; (-) strand; PAM type: NRG; PAM sequence: CAG
tattaaacactttctatgtg

SEQ ID NO: 28818 - DNA, 20 bp, Artificial Sequence
  Description of Artificial Sequence: Synthetic oligonucleotide
  Target: SCN9A; (-) strand; PAM type: NRG; PAM sequence: CAG
aatgatgatgatgctaatgg

SEQ ID NO: 28819 - DNA, 20 bp, Artificial Sequence
  Description of Artificial Sequence: Synthetic oligonucleotide
  Target: SCN9A; (-) strand; PAM type: NRG; PAM sequence: TGG
tttaatgatgatgatgctaa

SEQ ID NO: 28820 - DNA, 20 bp, Artificial Sequence
  Description of Artificial Sequence: Synthetic oligonucleotide
  Target: SCN9A; (-) strand; PAM type: NRG; PAM sequence: AAG
atatcaatatttactgaacc

SEQ ID NO: 28821 - DNA, 20 bp, Artificial Sequence
  Description of Artificial Sequence: Synthetic oligonucleotide
  Target: SCN9A; (-) strand; PAM type: NRG; PAM sequence: CAG
gacagaaagagctttggtaa

SEQ ID NO: 28822 - DNA, 20 bp, Artificial Sequence
  Description of Artificial Sequence: Synthetic oligonucleotide
  Target: SCN9A; (-) strand; PAM type: NRG; PAM sequence: TGG
tatacagacagaaagagctt

SEQ ID NO: 28823 - DNA, 20 bp, Artificial Sequence
  Description of Artificial Sequence: Synthetic oligonucleotide
  Target: SCN9A; (-) strand; PAM type: NRG; PAM sequence: GAG
aagaattatacagacagaaa

SEQ ID NO: 28824 - DNA, 20 bp, Artificial Sequence
  Description of Artificial Sequence: Synthetic oligonucleotide
  Target: SCN9A; (-) strand; PAM type: NRG; PAM sequence: AAG
ccaagaattatacagacaga

SEQ ID NO: 28825 - DNA, 20 bp, Artificial Sequence
  Description of Artificial Sequence: Synthetic oligonucleotide
  Target: SCN9A; (-) strand; PAM type: NRG; PAM sequence: CAG
tattccaagaattatacaga

SEQ ID NO: 28826 - DNA, 20 bp, Artificial Sequence
  Description of Artificial Sequence: Synthetic oligonucleotide
  Target: SCN9A; (-) strand; PAM type: NRG; PAM sequence: CAG
aatctattccaagaattata

SEQ ID NO: 28827 - DNA, 20 bp, Artificial Sequence
  Description of Artificial Sequence: Synthetic oligonucleotide
  Target: SCN9A; (-) strand; PAM type: NRG; PAM sequence: AAG
tattgactctaatctattcc

SEQ ID NO: 28828 - DNA, 20 bp, Artificial Sequence
  Description of Artificial Sequence: Synthetic oligonucleotide
  Target: SCN9A; (-) strand; PAM type: NRG; PAM sequence: TAG
gctgcacatttttatgaact

SEQ ID NO: 28829 - DNA, 20 bp, Artificial Sequence
  Description of Artificial Sequence: Synthetic oligonucleotide
  Target: SCN9A; (-) strand; PAM type: NRG; PAM sequence: AAG
ttagaaagaaaaaagtctta

SEQ ID NO: 28830 - DNA, 20 bp, Artificial Sequence
  Description of Artificial Sequence: Synthetic oligonucleotide
  Target: SCN9A; (-) strand; PAM type: NRG; PAM sequence: AAG
caccaattttagaaagaaaa

SEQ ID NO: 28831 - DNA, 20 bp, Artificial Sequence
  Description of Artificial Sequence: Synthetic oligonucleotide
  Target: SCN9A; (-) strand; PAM type: NRG; PAM sequence: AAG
accagtccaccaattttaga

SEQ ID NO: 28832 - DNA, 20 bp, Artificial Sequence
  Description of Artificial Sequence: Synthetic oligonucleotide
  Target: SCN9A; (-) strand; PAM type: NRG; PAM sequence: TAG
aaaaaccagtccaccaattt

SEQ ID NO: 28833 - DNA, 20 bp, Artificial Sequence
  Description of Artificial Sequence: Synthetic oligonucleotide
  Target: SCN9A; (-) strand; PAM type: NRG; PAM sequence: CAG
ttaatggcatcaggaaaaac

SEQ ID NO: 28834 - DNA, 20 bp, Artificial Sequence
  Description of Artificial Sequence: Synthetic oligonucleotide
  Target: SCN9A; (-) strand; PAM type: NRG; PAM sequence: AGG
tgtatttatttaatggcatc

SEQ ID NO: 28835 - DNA, 20 bp, Artificial Sequence
  Description of Artificial Sequence: Synthetic oligonucleotide
  Target: SCN9A; (-) strand; PAM type: NRG; PAM sequence: CAG
ttgtatttatttaatggcat

SEQ ID NO: 28836 - DNA, 20 bp, Artificial Sequence
  Description of Artificial Sequence: Synthetic oligonucleotide
  Target: SCN9A; (-) strand; PAM type: NRG; PAM sequence: TGG
agaatattgtatttatttaa

SEQ ID NO: 28837 - DNA, 20 bp, Artificial Sequence
  Description of Artificial Sequence: Synthetic oligonucleotide
  Target: SCN9A; (-) strand; PAM type: NRG; PAM sequence: CAG
tgctgttcccagaagaatct

SEQ ID NO: 28838 - DNA, 20 bp, Artificial Sequence
  Description of Artificial Sequence: Synthetic oligonucleotide
  Target: SCN9A; (-) strand; PAM type: NRG; PAM sequence: AAG
gataaggttgctgttcccag

SEQ ID NO: 28839 - DNA, 20 bp, Artificial Sequence
  Description of Artificial Sequence: Synthetic oligonucleotide
  Target: SCN9A; (-) strand; PAM type: NRG; PAM sequence: CAG
ctggataaggttgctgttcc

SEQ ID NO: 28840 - DNA, 20 bp, Artificial Sequence
  Description of Artificial Sequence: Synthetic oligonucleotide
  Target: SCN9A; (-) strand; PAM type: NRG; PAM sequence: AGG
acataggaataaactggata

SEQ ID NO: 28841 - DNA, 20 bp, Artificial Sequence
  Description of Artificial Sequence: Synthetic oligonucleotide
  Target: SCN9A; (-) strand; PAM type: NRG; PAM sequence: AAG
aacataggaataaactggat

SEQ ID NO: 28842 - DNA, 20 bp, Artificial Sequence
  Description of Artificial Sequence: Synthetic oligonucleotide
  Target: SCN9A; (-) strand; PAM type: NRG; PAM sequence: TGG
ctggcaacataggaataaac

SEQ ID NO: 28843 - DNA, 20 bp, Artificial Sequence
  Description of Artificial Sequence: Synthetic oligonucleotide
  Target: SCN9A; (-) strand; PAM type: NRG; PAM sequence: AGG
tctgtgtacactggcaacat

SEQ ID NO: 28844 - DNA, 20 bp, Artificial Sequence
  Description of Artificial Sequence: Synthetic oligonucleotide
  Target: SCN9A; (-) strand; PAM type: NRG; PAM sequence: TAG
ctctgtgtacactggcaaca

SEQ ID NO: 28845 - DNA, 20 bp, Artificial Sequence
  Description of Artificial Sequence: Synthetic oligonucleotide
  Target: SCN9A; (-) strand; PAM type: NRG; PAM sequence: TGG
tcatcaggctctgtgtacac

SEQ ID NO: 28846 - DNA, 20 bp, Artificial Sequence
  Description of Artificial Sequence: Synthetic oligonucleotide
  Target: SCN9A; (-) strand; PAM type: NRG; PAM sequence: AGG
tatgcagacatctattcatc

SEQ ID NO: 28847 - DNA, 20 bp, Artificial Sequence
  Description of Artificial Sequence: Synthetic oligonucleotide
  Target: SCN9A; (-) strand; PAM type: NRG; PAM sequence: CAG
ctatgcagacatctattcat

SEQ ID NO: 28848 - DNA, 20 bp, Artificial Sequence
  Description of Artificial Sequence: Synthetic oligonucleotide
  Target: SCN9A; (-) strand; PAM type: NRG; PAM sequence: CAG
ctcttgcttttccccctatg

SEQ ID NO: 28849 - DNA, 20 bp, Artificial Sequence
  Description of Artificial Sequence: Synthetic oligonucleotide
  Target: SCN9A; (-) strand; PAM type: NRG; PAM sequence: AAG
ttttgtagcatcagctgcat

SEQ ID NO: 28850 - DNA, 20 bp, Artificial Sequence
  Description of Artificial Sequence: Synthetic oligonucleotide
  Target: SCN9A; (-) strand; PAM type: NRG; PAM sequence: CAG
ccaacttcattttgtagcat

SEQ ID NO: 28851 - DNA, 20 bp, Artificial Sequence
  Description of Artificial Sequence: Synthetic oligonucleotide
  Target: SCN9A; (-) strand; PAM type: NRG; PAM sequence: TAG
cttacaccaacttcattttg

SEQ ID NO: 28852 - DNA, 20 bp, Artificial Sequence
  Description of Artificial Sequence: Synthetic oligonucleotide
  Target: SCN9A; (-) strand; PAM type: NRG; PAM sequence: AAG
tttaagaatattgtatatat

SEQ ID NO: 28853 - DNA, 20 bp, Artificial Sequence
  Description of Artificial Sequence: Synthetic oligonucleotide
  Target: SCN9A; (-) strand; PAM type: NRG; PAM sequence: AAG
gacttgggtacacatatttt

SEQ ID NO: 28854 - DNA, 20 bp, Artificial Sequence
  Description of Artificial Sequence: Synthetic oligonucleotide
  Target: SCN9A; (-) strand; PAM type: NRG; PAM sequence: GGG
caaagggattccttggactt

SEQ ID NO: 28855 - DNA, 20 bp, Artificial Sequence
  Description of Artificial Sequence: Synthetic oligonucleotide
  Target: SCN9A; (-) strand; PAM type: NRG; PAM sequence: TGG
gcaaagggattccttggact

SEQ ID NO: 28856 - DNA, 20 bp, Artificial Sequence
  Description of Artificial Sequence: Synthetic oligonucleotide
  Target: SCN9A; (-) strand; PAM type: NRG; PAM sequence: TGG
ctctaagcaaagggattcct

SEQ ID NO: 28857 - DNA, 20 bp, Artificial Sequence
  Description of Artificial Sequence: Synthetic oligonucleotide
  Target: SCN9A; (-) strand; PAM type: NRG; PAM sequence: GGG
ttttggccactctaagcaaa

SEQ ID NO: 28858 - DNA, 20 bp, Artificial Sequence
  Description of Artificial Sequence: Synthetic oligonucleotide
  Target: SCN9A; (-) strand; PAM type: NRG; PAM sequence: AGG
gttttggccactctaagcaa

SEQ ID NO: 28859 - DNA, 20 bp, Artificial Sequence
  Description of Artificial Sequence: Synthetic oligonucleotide
  Target: SCN9A; (-) strand; PAM type: NRG; PAM sequence: AAG
tgttttggccactctaagca

SEQ ID NO: 28860 - DNA, 20 bp, Artificial Sequence
  Description of Artificial Sequence: Synthetic oligonucleotide
  Target: SCN9A; (-) strand; PAM type: NRG; PAM sequence: AAG
tgtcatgttttggccactct

SEQ ID NO: 28861 - DNA, 20 bp, Artificial Sequence
  Description of Artificial Sequence: Synthetic oligonucleotide
  Target: SCN9A; (-) strand; PAM type: NRG; PAM sequence: TGG
ggtgactgaatgtcatgttt

SEQ ID NO: 28862 - DNA, 20 bp, Artificial Sequence
  Description of Artificial Sequence: Synthetic oligonucleotide
  Target: SCN9A; (-) strand; PAM type: NRG; PAM sequence: AGG
tccaattaaatgtgactcat

SEQ ID NO: 28863 - DNA, 20 bp, Artificial Sequence
  Description of Artificial Sequence: Synthetic oligonucleotide
  Target: SCN9A; (-) strand; PAM type: NRG; PAM sequence: TAG
ctccaattaaatgtgactca

SEQ ID NO: 28864 - DNA, 20 bp, Artificial Sequence
  Description of Artificial Sequence: Synthetic oligonucleotide
  Target: SCN9A; (-) strand; PAM type: NRG; PAM sequence: AAG
ctatttttctttctactccc

SEQ ID NO: 28865 - DNA, 20 bp, Artificial Sequence
  Description of Artificial Sequence: Synthetic oligonucleotide
  Target: SCN9A; (-) strand; PAM type: NRG; PAM sequence: AAG
ctggaaaacgaagagtcaca

SEQ ID NO: 28866 - DNA, 20 bp, Artificial Sequence
  Description of Artificial Sequence: Synthetic oligonucleotide
  Target: SCN9A; (-) strand; PAM type: NRG; PAM sequence: GAG
tcttctttctggaaaacgaa

SEQ ID NO: 28867 - DNA, 20 bp, Artificial Sequence
  Description of Artificial Sequence: Synthetic oligonucleotide
  Target: SCN9A; (-) strand; PAM type: NRG; PAM sequence: AAG
ggtcttctttctggaaaacg

SEQ ID NO: 28868 - DNA, 20 bp, Artificial Sequence
  Description of Artificial Sequence: Synthetic oligonucleotide
  Target: SCN9A; (-) strand; PAM type: NRG; PAM sequence: TGG
ataatttcaggtcttctttc

SEQ ID NO: 28869 - DNA, 20 bp, Artificial Sequence
  Description of Artificial Sequence: Synthetic oligonucleotide
  Target: SCN9A; (-) strand; PAM type: NRG; PAM sequence: AGG
aaagttggttggataatttc

SEQ ID NO: 28870 - DNA, 20 bp, Artificial Sequence
  Description of Artificial Sequence: Synthetic oligonucleotide
  Target: SCN9A; (-) strand; PAM type: NRG; PAM sequence: CAG
aaaagttggttggataattt

SEQ ID NO: 28871 - DNA, 20 bp, Artificial Sequence
  Description of Artificial Sequence: Synthetic oligonucleotide
  Target: SCN9A; (-) strand; PAM type: NRG; PAM sequence: TGG
aaactccaccaaaagttggt

SEQ ID NO: 28872 - DNA, 20 bp, Artificial Sequence
  Description of Artificial Sequence: Synthetic oligonucleotide
  Target: SCN9A; (-) strand; PAM type: NRG; PAM sequence: TGG
tagaaaactccaccaaaagt

SEQ ID NO: 28873 - DNA, 20 bp, Artificial Sequence
  Description of Artificial Sequence: Synthetic oligonucleotide
  Target: SCN9A; (-) strand; PAM type: NRG; PAM sequence: AAG
cttctagaaaactccaccaa

SEQ ID NO: 28874 - DNA, 20 bp, Artificial Sequence
  Description of Artificial Sequence: Synthetic oligonucleotide
  Target: SCN9A; (-) strand; PAM type: NRG; PAM sequence: TAG
aaggtagaaaatgttacttc

SEQ ID NO: 28875 - DNA, 20 bp, Artificial Sequence
  Description of Artificial Sequence: Synthetic oligonucleotide
  Target: SCN9A; (-) strand; PAM type: NRG; PAM sequence: TAG
tcatataaatcttaagaagg

SEQ ID NO: 28876 - DNA, 20 bp, Artificial Sequence
  Description of Artificial Sequence: Synthetic oligonucleotide
  Target: SCN9A; (-) strand; PAM type: NRG; PAM sequence: AGG
aagtcatataaatcttaaga

SEQ ID NO: 28877 - DNA, 20 bp, Artificial Sequence
  Description of Artificial Sequence: Synthetic oligonucleotide
  Target: SCN9A; (-) strand; PAM type: NRG; PAM sequence: AAG
gaagtcatataaatcttaag

SEQ ID NO: 28878 - DNA, 20 bp, Artificial Sequence
  Description of Artificial Sequence: Synthetic oligonucleotide
  Target: SCN9A; (-) strand; PAM type: NRG; PAM sequence: AAG
acagaagtcatataaatctt

SEQ ID NO: 28879 - DNA, 20 bp, Artificial Sequence
  Description of Artificial Sequence: Synthetic oligonucleotide
  Target: SCN9A; (-) strand; PAM type: NRG; PAM sequence: AAG
ctcgaattaacacaagacag

SEQ ID NO: 28880 - DNA, 20 bp, Artificial Sequence
  Description of Artificial Sequence: Synthetic oligonucleotide
  Target: SCN9A; (-) strand; PAM type: NRG; PAM sequence: CAG
gtgctcgaattaacacaaga

SEQ ID NO: 28881 - DNA, 20 bp, Artificial Sequence
  Description of Artificial Sequence: Synthetic oligonucleotide
  Target: SCN9A; (-) strand; PAM type: NRG; PAM sequence: AAG
gacagtgctcgaattaacac

SEQ ID NO: 28882 - DNA, 20 bp, Artificial Sequence
  Description of Artificial Sequence: Synthetic oligonucleotide
  Target: SCN9A; (-) strand; PAM type: NRG; PAM sequence: CAG
ttgaaagcaagactttgaga

SEQ ID NO: 28883 - DNA, 20 bp, Artificial Sequence
  Description of Artificial Sequence: Synthetic oligonucleotide
  Target: SCN9A; (-) strand; PAM type: NRG; PAM sequence: GAG
actcttgaaagcaagacttt

SEQ ID NO: 28884 - DNA, 20 bp, Artificial Sequence
  Description of Artificial Sequence: Synthetic oligonucleotide
  Target: SCN9A; (-) strand; PAM type: NRG; PAM sequence: AAG
taatgcatactcttgaaagc

SEQ ID NO: 28885 - DNA, 20 bp, Artificial Sequence
  Description of Artificial Sequence: Synthetic oligonucleotide
  Target: SCN9A; (-) strand; PAM type: NRG; PAM sequence: AAG
cagttaatgcatactcttga

SEQ ID NO: 28886 - DNA, 20 bp, Artificial Sequence
  Description of Artificial Sequence: Synthetic oligonucleotide
  Target: SCN9A; (-) strand; PAM type: NRG; PAM sequence: CAG
tccagtctttaaaatgttca

SEQ ID NO: 28887 - DNA, 20 bp, Artificial Sequence
  Description of Artificial Sequence: Synthetic oligonucleotide
  Target: SCN9A; (-) strand; PAM type: NRG; PAM sequence: CAG
attctgtcccacagcaaatc

SEQ ID NO: 28888 - DNA, 20 bp, Artificial Sequence
  Description of Artificial Sequence: Synthetic oligonucleotide
  Target: SCN9A; (-) strand; PAM type: NRG; PAM sequence: CAG
atttgactcattctgtccca

SEQ ID NO: 28889 - DNA, 20 bp, Artificial Sequence
  Description of Artificial Sequence: Synthetic oligonucleotide
  Target: SCN9A; (-) strand; PAM type: NRG; PAM sequence: TGG
attgctttttatatatttca

SEQ ID NO: 28890 - DNA, 20 bp, Artificial Sequence
  Description of Artificial Sequence: Synthetic oligonucleotide
  Target: SCN9A; (-) strand; PAM type: NRG; PAM sequence: TAG
tgttcagtcagtttgcaaat

SEQ ID NO: 28891 - DNA, 20 bp, Artificial Sequence
  Description of Artificial Sequence: Synthetic oligonucleotide
  Target: SCN9A; (-) strand; PAM type: NRG; PAM sequence: CAG
gaaggaaaagaatgttcagt

SEQ ID NO: 28892 - DNA, 20 bp, Artificial Sequence
  Description of Artificial Sequence: Synthetic oligonucleotide
  Target: SCN9A; (-) strand; PAM type: NRG; PAM sequence: CAG
aagagaaggaaaagaatgtt

SEQ ID NO: 28893 - DNA, 20 bp, Artificial Sequence
  Description of Artificial Sequence: Synthetic oligonucleotide
  Target: SCN9A; (-) strand; PAM type: NRG; PAM sequence: AAG
aaaggctgaaagagaaggaa

SEQ ID NO: 28894 - DNA, 20 bp, Artificial Sequence
  Description of Artificial Sequence: Synthetic oligonucleotide
  Target: SCN9A; (-) strand; PAM type: NRG; PAM sequence: AGG
agtctaaaggctgaaagaga

SEQ ID NO: 28895 - DNA, 20 bp, Artificial Sequence
  Description of Artificial Sequence: Synthetic oligonucleotide
  Target: SCN9A; (-) strand; PAM type: NRG; PAM sequence: AAG
tagtctaaaggctgaaagag

SEQ ID NO: 28896 - DNA, 20 bp, Artificial Sequence
  Description of Artificial Sequence: Synthetic oligonucleotide
  Target: SCN9A; (-) strand; PAM type: NRG; PAM sequence: GAG
ttttagtctaaaggctgaaa

SEQ ID NO: 28897 - DNA, 20 bp, Artificial Sequence
  Description of Artificial Sequence: Synthetic oligonucleotide
  Target: SCN9A; (-) strand; PAM type: NRG; PAM sequence: AAG
ctttttagtctaaaggctga

SEQ ID NO: 28898 - DNA, 20 bp, Artificial Sequence
  Description of Artificial Sequence: Synthetic oligonucleotide
  Target: SCN9A; (-) strand; PAM type: NRG; PAM sequence: AGG
ttgttttctttttagtctaa

SEQ ID NO: 28899 - DNA, 20 bp, Artificial Sequence
  Description of Artificial Sequence: Synthetic oligonucleotide
  Target: SCN9A; (-) strand; PAM type: NRG; PAM sequence: AAG
tttgttttctttttagtcta

SEQ ID NO: 28900 - DNA, 20 bp, Artificial Sequence
  Description of Artificial Sequence: Synthetic oligonucleotide
  Target: SCN9A; (-) strand; PAM type: NRG; PAM sequence: TAG
tgtaatatttgttttctttt

SEQ ID NO: 28901 - DNA, 20 bp, Artificial Sequence
  Description of Artificial Sequence: Synthetic oligonucleotide
  Target: SCN9A; (-) strand; PAM type: NRG; PAM sequence: GGG
gtggtttcagcacagattca

SEQ ID NO: 28902 - DNA, 20 bp, Artificial Sequence
  Description of Artificial Sequence: Synthetic oligonucleotide
  Target: SCN9A; (-) strand; PAM type: NRG; PAM sequence: AGG
tgtggtttcagcacagattc

SEQ ID NO: 28903 - DNA, 20 bp, Artificial Sequence
  Description of Artificial Sequence: Synthetic oligonucleotide
  Target: SCN9A; (-) strand; PAM type: NRG; PAM sequence: CAG
ttgtggtttcagcacagatt

SEQ ID NO: 28904 - DNA, 20 bp, Artificial Sequence
  Description of Artificial Sequence: Synthetic oligonucleotide
  Target: SCN9A; (-) strand; PAM type: NRG; PAM sequence: CAG
tctcctttgtggtttcagca

SEQ ID NO: 28905 - DNA, 20 bp, Artificial Sequence
  Description of Artificial Sequence: Synthetic oligonucleotide
  Target: SCN9A; (-) strand; PAM type: NRG; PAM sequence: CAG
gatgctctcctttgtggttt

SEQ ID NO: 28906 - DNA, 20 bp, Artificial Sequence
  Description of Artificial Sequence: Synthetic oligonucleotide
  Target: SCN9A; (-) strand; PAM type: NRG; PAM sequence: TGG
tccaaagatgctctcctttg

SEQ ID NO: 28907 - DNA, 20 bp, Artificial Sequence
  Description of Artificial Sequence: Synthetic oligonucleotide
  Target: SCN9A; (-) strand; PAM type: NRG; PAM sequence: AAG
ttattacttggaaggatcca

SEQ ID NO: 28908 - DNA, 20 bp, Artificial Sequence
  Description of Artificial Sequence: Synthetic oligonucleotide
  Target: SCN9A; (-) strand; PAM type: NRG; PAM sequence: AGG
gaatatttttattacttgga

SEQ ID NO: 28909 - DNA, 20 bp, Artificial Sequence
  Description of Artificial Sequence: Synthetic oligonucleotide
  Target: SCN9A; (-) strand; PAM type: NRG; PAM sequence: AAG
agaatatttttattacttgg

SEQ ID NO: 28910 - DNA, 20 bp, Artificial Sequence
  Description of Artificial Sequence: Synthetic oligonucleotide
  Target: SCN9A; (-) strand; PAM type: NRG; PAM sequence: TGG
aacagaatatttttattact

SEQ ID NO: 28911 - DNA, 20 bp, Artificial Sequence
  Description of Artificial Sequence: Synthetic oligonucleotide
  Target: SCN9A; (-) strand; PAM type: NRG; PAM sequence: CAG
ctgttcaaattcttcttcaa

SEQ ID NO: 28912 - DNA, 20 bp, Artificial Sequence
  Description of Artificial Sequence: Synthetic oligonucleotide
  Target: SCN9A; (-) strand; PAM type: NRG; PAM sequence: AAG
tttatcacaatcacagatta

SEQ ID NO: 28913 - DNA, 20 bp, Artificial Sequence
  Description of Artificial Sequence: Synthetic oligonucleotide
  Target: SCN9A; (-) strand; PAM type: NRG; PAM sequence: CAG
tacctcctttatcacaatca

SEQ ID NO: 28914 - DNA, 20 bp, Artificial Sequence
  Description of Artificial Sequence: Synthetic oligonucleotide
  Target: SCN9A; (-) strand; PAM type: NRG; PAM sequence: TAG
tgggaccaggcctgaatttg

SEQ ID NO: 28915 - DNA, 20 bp, Artificial Sequence
  Description of Artificial Sequence: Synthetic oligonucleotide
  Target: SCN9A; (-) strand; PAM type: NRG; PAM sequence: AGG
gatgcatattgcctgggacc

SEQ ID NO: 28916 - DNA, 20 bp, Artificial Sequence
  Description of Artificial Sequence: Synthetic oligonucleotide
  Target: SCN9A; (-) strand; PAM type: NRG; PAM sequence: CAG
ggatgcatattgcctgggac

SEQ ID NO: 28917 - DNA, 20 bp, Artificial Sequence
  Description of Artificial Sequence: Synthetic oligonucleotide
  Target: SCN9A; (-) strand; PAM type: NRG; PAM sequence: GGG
taaatggatgcatattgcct

SEQ ID NO: 28918 - DNA, 20 bp, Artificial Sequence
  Description of Artificial Sequence: Synthetic oligonucleotide
  Target: SCN9A; (-) strand; PAM type: NRG; PAM sequence: TGG
ataaatggatgcatattgcc

SEQ ID NO: 28919 - DNA, 20 bp, Artificial Sequence
  Description of Artificial Sequence: Synthetic oligonucleotide
  Target: SCN9A; (-) strand; PAM type: NRG; PAM sequence: TGG
atgagaaaatagtaaataaa

SEQ ID NO: 28920 - DNA, 20 bp, Artificial Sequence
  Description of Artificial Sequence: Synthetic oligonucleotide
  Target: SCN9A; (-) strand; PAM type: NRG; PAM sequence: TAG
agggagaatatatgagaaaa

SEQ ID NO: 28921 - DNA, 20 bp, Artificial Sequence
  Description of Artificial Sequence: Synthetic oligonucleotide
  Target: SCN9A; (-) strand; PAM type: NRG; PAM sequence: GAG
atatttgagggagaatatat

SEQ ID NO: 28922 - DNA, 20 bp, Artificial Sequence
  Description of Artificial Sequence: Synthetic oligonucleotide
  Target: SCN9A; (-) strand; PAM type: NRG; PAM sequence: GAG
ttatcaataaatatttgagg

SEQ ID NO: 28923 - DNA, 20 bp, Artificial Sequence
  Description of Artificial Sequence: Synthetic oligonucleotide
  Target: SCN9A; (-) strand; PAM type: NRG; PAM sequence: GGG
gattatcaataaatatttga

SEQ ID NO: 28924 - DNA, 20 bp, Artificial Sequence
  Description of Artificial Sequence: Synthetic oligonucleotide
  Target: SCN9A; (-) strand; PAM type: NRG; PAM sequence: AGG
agattatcaataaatatttg

SEQ ID NO: 28925 - DNA, 20 bp, Artificial Sequence
  Description of Artificial Sequence: Synthetic oligonucleotide
  Target: SCN9A; (-) strand; PAM type: NRG; PAM sequence: GAG
gagattatcaataaatattt

SEQ ID NO: 28926 - DNA, 20 bp, Artificial Sequence
  Description of Artificial Sequence: Synthetic oligonucleotide
  Target: SCN9A; (-) strand; PAM type: NRG; PAM sequence: GAG
gtttattgcctagcctctaa

SEQ ID NO: 28927 - DNA, 20 bp, Artificial Sequence
  Description of Artificial Sequence: Synthetic oligonucleotide
  Target: SCN9A; (-) strand; PAM type: NRG; PAM sequence: AAG
atgtttattgcctagcctct

SEQ ID NO: 28928 - DNA, 20 bp, Artificial Sequence
  Description of Artificial Sequence: Synthetic oligonucleotide
  Target: SCN9A; (-) strand; PAM type: NRG; PAM sequence: TAG
ttattgtcatgtttattgcc

SEQ ID NO: 28929 - DNA, 20 bp, Artificial Sequence
  Description of Artificial Sequence: Synthetic oligonucleotide
  Target: SCN9A; (-) strand; PAM type: NRG; PAM sequence: AGG
ccctcacctaaacataaagg

SEQ ID NO: 28930 - DNA, 20 bp, Artificial Sequence
  Description of Artificial Sequence: Synthetic oligonucleotide
  Target: SCN9A; (-) strand; PAM type: NRG; PAM sequence: GAG
accctcacctaaacataaag

SEQ ID NO: 28931 - DNA, 20 bp, Artificial Sequence
  Description of Artificial Sequence: Synthetic oligonucleotide
  Target: SCN9A; (-) strand; PAM type: NRG; PAM sequence: AGG
ccaccctcacctaaacataa

SEQ ID NO: 28932 - DNA, 20 bp, Artificial Sequence
  Description of Artificial Sequence: Synthetic oligonucleotide
  Target: SCN9A; (-) strand; PAM type: NRG; PAM sequence: AAG
tccaccctcacctaaacata

SEQ ID NO: 28933 - DNA, 20 bp, Artificial Sequence
  Description of Artificial Sequence: Synthetic oligonucleotide
  Target: SCN9A; (-) strand; PAM type: NRG; PAM sequence: TAG
ttgccttaatttattttctt

SEQ ID NO: 28934 - DNA, 20 bp, Artificial Sequence
  Description of Artificial Sequence: Synthetic oligonucleotide
  Target: SCN9A; (-) strand; PAM type: NRG; PAM sequence: CAG
agaaagaccgtccctgactg

SEQ ID NO: 28935 - DNA, 20 bp, Artificial Sequence
  Description of Artificial Sequence: Synthetic oligonucleotide
  Target: SCN9A; (-) strand; PAM type: NRG; PAM sequence: AAG
ttaaatatcatctccttaga

SEQ ID NO: 28936 - DNA, 20 bp, Artificial Sequence
  Description of Artificial Sequence: Synthetic oligonucleotide
  Target: SCN9A; (-) strand; PAM type: NRG; PAM sequence: TAG
tagtttaaatatcatctcct

SEQ ID NO: 28937 - DNA, 20 bp, Artificial Sequence
  Description of Artificial Sequence: Synthetic oligonucleotide
  Target: SCN9A; (-) strand; PAM type: NRG; PAM sequence: TAG
tctttgtcacacttaggtct

SEQ ID NO: 28938 - DNA, 20 bp, Artificial Sequence
  Description of Artificial Sequence: Synthetic oligonucleotide
  Target: SCN9A; (-) strand; PAM type: NRG; PAM sequence: AGG
ctgtcttctttgtcacactt

SEQ ID NO: 28939 - DNA, 20 bp, Artificial Sequence
  Description of Artificial Sequence: Synthetic oligonucleotide
  Target: SCN9A; (-) strand; PAM type: NRG; PAM sequence: TAG
gctgtcttctttgtcacact

SEQ ID NO: 28940 - DNA, 20 bp, Artificial Sequence
  Description of Artificial Sequence: Synthetic oligonucleotide
  Target: SCN9A; (-) strand; PAM type: NRG; PAM sequence: TGG
tctcttcaccagtattttca

SEQ ID NO: 28941 - DNA, 20 bp, Artificial Sequence
  Description of Artificial Sequence: Synthetic oligonucleotide
  Target: SCN9A; (-) strand; PAM type: NRG; PAM sequence: CAG
cagcccaaatatctcttcac

SEQ ID NO: 28942 - DNA, 20 bp, Artificial Sequence
  Description of Artificial Sequence: Synthetic oligonucleotide
  Target: SCN9A; (-) strand; PAM type: NRG; PAM sequence: CAG
tttagttctttctcttcccc

SEQ ID NO: 28943 - DNA, 20 bp, Artificial Sequence
  Description of Artificial Sequence: Synthetic oligonucleotide
  Target: SCN9A; (-) strand; PAM type: NRG; PAM sequence: TAG
tcatctctgccttagggctt

SEQ ID NO: 28944 - DNA, 20 bp, Artificial Sequence
  Description of Artificial Sequence: Synthetic oligonucleotide
  Target: SCN9A; (-) strand; PAM type: NRG; PAM sequence: GGG
ccaacttcatctctgcctta

SEQ ID NO: 28945 - DNA, 20 bp, Artificial Sequence
  Description of Artificial Sequence: Synthetic oligonucleotide
  Target: SCN9A; (-) strand; PAM type: NRG; PAM sequence: AGG
accaacttcatctctgcctt

SEQ ID NO: 28946 - DNA, 20 bp, Artificial Sequence
  Description of Artificial Sequence: Synthetic oligonucleotide
  Target: SCN9A; (-) strand; PAM type: NRG; PAM sequence: TAG
caccaacttcatctctgcct

SEQ ID NO: 28947 - DNA, 20 bp, Artificial Sequence
  Description of Artificial Sequence: Synthetic oligonucleotide
  Target: SCN9A; (-) strand; PAM type: NRG; PAM sequence: TGG
agccacactggccatcttgc

SEQ ID NO: 28948 - DNA, 20 bp, Artificial Sequence
  Description of Artificial Sequence: Synthetic oligonucleotide
  Target: SCN9A; (-) strand; PAM type: NRG; PAM sequence: TGG
tcaccacactgtagccacac

SEQ ID NO: 28949 - DNA, 20 bp, Artificial Sequence
  Description of Artificial Sequence: Synthetic oligonucleotide
  Target: SCN9A; (-) strand; PAM type: NRG; PAM sequence: TAG
tcctccctctcaccacactg

SEQ ID NO: 28950 - DNA, 20 bp, Artificial Sequence
  Description of Artificial Sequence: Synthetic oligonucleotide
  Target: SCN9A; (-) strand; PAM type: NRG; PAM sequence: CGG
atgcaaattccgacatgatc

SEQ ID NO: 28951 - DNA, 20 bp, Artificial Sequence
  Description of Artificial Sequence: Synthetic oligonucleotide
  Target: SCN9A; (-) strand; PAM type: NRG; PAM sequence: AAG
cagaatgtatcacagtcatt

SEQ ID NO: 28952 - DNA, 20 bp, Artificial Sequence
  Description of Artificial Sequence: Synthetic oligonucleotide
  Target: SCN9A; (-) strand; PAM type: NRG; PAM sequence: CAG
gcatttctcagaatgtatca

SEQ ID NO: 28953 - DNA, 20 bp, Artificial Sequence
  Description of Artificial Sequence: Synthetic oligonucleotide
  Target: SCN9A; (-) strand; PAM type: NRG; PAM sequence: CAG
cgtcctaatgatgcatttct

SEQ ID NO: 28954 - DNA, 20 bp, Artificial Sequence
  Description of Artificial Sequence: Synthetic oligonucleotide
  Target: SCN9A; (-) strand; PAM type: NRG; PAM sequence: AGG
caccctaggatgtttgcaca

SEQ ID NO: 28955 - DNA, 20 bp, Artificial Sequence
  Description of Artificial Sequence: Synthetic oligonucleotide
  Target: SCN9A; (-) strand; PAM type: NRG; PAM sequence: AAG
gcaccctaggatgtttgcac

SEQ ID NO: 28956 - DNA, 20 bp, Artificial Sequence
  Description of Artificial Sequence: Synthetic oligonucleotide
  Target: SCN9A; (-) strand; PAM type: NRG; PAM sequence: AGG
ggtttgtataagtgcaccct

SEQ ID NO: 28957 - DNA, 20 bp, Artificial Sequence
  Description of Artificial Sequence: Synthetic oligonucleotide
  Target: SCN9A; (-) strand; PAM type: NRG; PAM sequence: TAG
aggtttgtataagtgcaccc

SEQ ID NO: 28958 - DNA, 20 bp, Artificial Sequence
  Description of Artificial Sequence: Synthetic oligonucleotide
  Target: SCN9A; (-) strand; PAM type: NRG; PAM sequence: AAG
tataccatctaggtttgtat

SEQ ID NO: 28959 - DNA, 20 bp, Artificial Sequence
  Description of Artificial Sequence: Synthetic oligonucleotide
  Target: SCN9A; (-) strand; PAM type: NRG; PAM sequence: AGG
tatggtagcctataccatct

SEQ ID NO: 28960 - DNA, 20 bp, Artificial Sequence
  Description of Artificial Sequence: Synthetic oligonucleotide
  Target: SCN9A; (-) strand; PAM type: NRG; PAM sequence: TAG
gtatggtagcctataccatc

SEQ ID NO: 28961 - DNA, 20 bp, Artificial Sequence
  Description of Artificial Sequence: Synthetic oligonucleotide
  Target: SCN9A; (-) strand; PAM type: NRG; PAM sequence: TAG
cacatagcctaggtgtatgg

SEQ ID NO: 28962 - DNA, 20 bp, Artificial Sequence
  Description of Artificial Sequence: Synthetic oligonucleotide
  Target: SCN9A; (-) strand; PAM type: NRG; PAM sequence: TGG
taccacatagcctaggtgta

SEQ ID NO: 28963 - DNA, 20 bp, Artificial Sequence
  Description of Artificial Sequence: Synthetic oligonucleotide
  Target: SCN9A; (-) strand; PAM type: NRG; PAM sequence: AGG
taggctataccacatagcct

SEQ ID NO: 28964 - DNA, 20 bp, Artificial Sequence
  Description of Artificial Sequence: Synthetic oligonucleotide
  Target: SCN9A; (-) strand; PAM type: NRG; PAM sequence: TAG
ataggctataccacatagcc

SEQ ID NO: 28965 - DNA, 20 bp, Artificial Sequence
  Description of Artificial Sequence: Synthetic oligonucleotide
  Target: SCN9A; (-) strand; PAM type: NRG; PAM sequence: TAG
gagcaataggctataccaca

SEQ ID NO: 28966 - DNA, 20 bp, Artificial Sequence
  Description of Artificial Sequence: Synthetic oligonucleotide
  Target: SCN9A; (-) strand; PAM type: NRG; PAM sequence: AGG
gtttgcagcccaggagcaat

SEQ ID NO: 28967 - DNA, 20 bp, Artificial Sequence
  Description of Artificial Sequence: Synthetic oligonucleotide
  Target: SCN9A; (-) strand; PAM type: NRG; PAM sequence: TAG
ggtttgcagcccaggagcaa

SEQ ID NO: 28968 - DNA, 20 bp, Artificial Sequence
  Description of Artificial Sequence: Synthetic oligonucleotide
  Target: SCN9A; (-) strand; PAM type: NRG; PAM sequence: GAG
tctacaggtttgcagcccag

SEQ ID NO: 28969 - DNA, 20 bp, Artificial Sequence
  Description of Artificial Sequence: Synthetic oligonucleotide
  Target: SCN9A; (-) strand; PAM type: NRG; PAM sequence: AGG
actctacaggtttgcagccc

SEQ ID NO: 28970 - DNA, 20 bp, Artificial Sequence
  Description of Artificial Sequence: Synthetic oligonucleotide
  Target: SCN9A; (-) strand; PAM type: NRG; PAM sequence: CAG
cactctacaggtttgcagcc

SEQ ID NO: 28971 - DNA, 20 bp, Artificial Sequence
  Description of Artificial Sequence: Synthetic oligonucleotide
  Target: SCN9A; (-) strand; PAM type: NRG; PAM sequence: CAG
tagcccactctacaggtttg

SEQ ID NO: 28972 - DNA, 20 bp, Artificial Sequence
  Description of Artificial Sequence: Synthetic oligonucleotide
  Target: SCN9A; (-) strand; PAM type: NRG; PAM sequence: AGG
agtacagtagcccactctac

SEQ ID NO: 28973 - DNA, 20 bp, Artificial Sequence
  Description of Artificial Sequence: Synthetic oligonucleotide
  Target: SCN9A; (-) strand; PAM type: NRG; PAM sequence: CAG
gagtacagtagcccactcta

SEQ ID NO: 28974 - DNA, 20 bp, Artificial Sequence
  Description of Artificial Sequence: Synthetic oligonucleotide
  Target: SCN9A; (-) strand; PAM type: NRG; PAM sequence: TAG
gcctacaatattgagtacag

SEQ ID NO: 28975 - DNA, 20 bp, Artificial Sequence
  Description of Artificial Sequence: Synthetic oligonucleotide
  Target: SCN9A; (-) strand; PAM type: NRG; PAM sequence: CAG
gttgcctacaatattgagta

SEQ ID NO: 28976 - DNA, 20 bp, Artificial Sequence
  Description of Artificial Sequence: Synthetic oligonucleotide
  Target: SCN9A; (-) strand; PAM type: NRG; PAM sequence: GAG
taacagttgcctacaatatt

SEQ ID NO: 28977 - DNA, 20 bp, Artificial Sequence
  Description of Artificial Sequence: Synthetic oligonucleotide
  Target: SCN9A; (-) strand; PAM type: NRG; PAM sequence: CAG
acacactttccattgtataa

SEQ ID NO: 28978 - DNA, 20 bp, Artificial Sequence
  Description of Artificial Sequence: Synthetic oligonucleotide
  Target: SCN9A; (-) strand; PAM type: NRG; PAM sequence: TAG
tactgtaccttttctgtctt

SEQ ID NO: 28979 - DNA, 20 bp, Artificial Sequence
  Description of Artificial Sequence: Synthetic oligonucleotide
  Target: SCN9A; (-) strand; PAM type: NRG; PAM sequence: AAG
atatataatggtgatctcat

SEQ ID NO: 28980 - DNA, 20 bp, Artificial Sequence
  Description of Artificial Sequence: Synthetic oligonucleotide
  Target: SCN9A; (-) strand; PAM type: NRG; PAM sequence: TGG
atagcggaccatatatataa

SEQ ID NO: 28981 - DNA, 20 bp, Artificial Sequence
  Description of Artificial Sequence: Synthetic oligonucleotide
  Target: SCN9A; (-) strand; PAM type: NRG; PAM sequence: CGG
aaggatgttttagtcaatag

SEQ ID NO: 28982 - DNA, 20 bp, Artificial Sequence
  Description of Artificial Sequence: Synthetic oligonucleotide
  Target: SCN9A; (-) strand; PAM type: NRG; PAM sequence: TAG
cataaggatgttttagtcaa

SEQ ID NO: 28983 - DNA, 20 bp, Artificial Sequence
  Description of Artificial Sequence: Synthetic oligonucleotide
  Target: SCN9A; (-) strand; PAM type: NRG; PAM sequence: TAG
tgtaccacataaggatgttt

SEQ ID NO: 28984 - DNA, 20 bp, Artificial Sequence
  Description of Artificial Sequence: Synthetic oligonucleotide
  Target: SCN9A; (-) strand; PAM type: NRG; PAM sequence: AGG
ccggagtattgtaccacata

SEQ ID NO: 28985 - DNA, 20 bp, Artificial Sequence
  Description of Artificial Sequence: Synthetic oligonucleotide
  Target: SCN9A; (-) strand; PAM type: NRG; PAM sequence: AAG
tccggagtattgtaccacat

SEQ ID NO: 28986 - DNA, 20 bp, Artificial Sequence
  Description of Artificial Sequence: Synthetic oligonucleotide
  Target: SCN9A; (-) strand; PAM type: NRG; PAM sequence: GAG
tactgagtctgcctcttccg

SEQ ID NO: 28987 - DNA, 20 bp, Artificial Sequence
  Description of Artificial Sequence: Synthetic oligonucleotide
  Target: SCN9A; (-) strand; PAM type: NRG; PAM sequence: CGG
cttactgagtctgcctcttc

SEQ ID NO: 28988 - DNA, 20 bp, Artificial Sequence
  Description of Artificial Sequence: Synthetic oligonucleotide
  Target: SCN9A; (-) strand; PAM type: NRG; PAM sequence: GAG
acttatgttactgccttact

SEQ ID NO: 28989 - DNA, 20 bp, Artificial Sequence
  Description of Artificial Sequence: Synthetic oligonucleotide
  Target: SCN9A; (-) strand; PAM type: NRG; PAM sequence: TAG
aatgaaaagtaagataattt

SEQ ID NO: 28990 - DNA, 20 bp, Artificial Sequence
  Description of Artificial Sequence: Synthetic oligonucleotide
  Target: SCN9A; (-) strand; PAM type: NRG; PAM sequence: AAG
tggactggtgaatgaaaagt

SEQ ID NO: 28991 - DNA, 20 bp, Artificial Sequence
  Description of Artificial Sequence: Synthetic oligonucleotide
  Target: SCN9A; (-) strand; PAM type: NRG; PAM sequence: AAG
agtatggactggtgaatgaa

SEQ ID NO: 28992 - DNA, 20 bp, Artificial Sequence
  Description of Artificial Sequence: Synthetic oligonucleotide
  Target: SCN9A; (-) strand; PAM type: NRG; PAM sequence: TGG
ggtcctaagtaagtatggac

SEQ ID NO: 28993 - DNA, 20 bp, Artificial Sequence
  Description of Artificial Sequence: Synthetic oligonucleotide
  Target: SCN9A; (-) strand; PAM type: NRG; PAM sequence: TGG
tagtaggtcctaagtaagta

SEQ ID NO: 28994 - DNA, 20 bp, Artificial Sequence
  Description of Artificial Sequence: Synthetic oligonucleotide
  Target: SCN9A; (-) strand; PAM type: NRG; PAM sequence: AAG
agaattagtaggtcctaagt

SEQ ID NO: 28995 - DNA, 20 bp, Artificial Sequence
  Description of Artificial Sequence: Synthetic oligonucleotide
  Target: SCN9A; (-) strand; PAM type: NRG; PAM sequence: AAG
acctagaattagtaggtcct

SEQ ID NO: 28996 - DNA, 20 bp, Artificial Sequence
  Description of Artificial Sequence: Synthetic oligonucleotide
  Target: SCN9A; (-) strand; PAM type: NRG; PAM sequence: AGG
cctcaacacctagaattagt

SEQ ID NO: 28997 - DNA, 20 bp, Artificial Sequence
  Description of Artificial Sequence: Synthetic oligonucleotide
  Target: SCN9A; (-) strand; PAM type: NRG; PAM sequence: TAG
tcctcaacacctagaattag

SEQ ID NO: 28998 - DNA, 20 bp, Artificial Sequence
  Description of Artificial Sequence: Synthetic oligonucleotide
  Target: SCN9A; (-) strand; PAM type: NRG; PAM sequence: TAG
atctcctcaacacctagaat

SEQ ID NO: 28999 - DNA, 20 bp, Artificial Sequence
  Description of Artificial Sequence: Synthetic oligonucleotide
  Target: SCN9A; (-) strand; PAM type: NRG; PAM sequence: TAG
attgtcatctcctcaacacc

SEQ ID NO: 29000 - DNA, 20 bp, Artificial Sequence
  Description of Artificial Sequence: Synthetic oligonucleotide
  Target: SCN9A; (-) strand; PAM type: NRG; PAM sequence: TGG
ataccatgaaaggtgaaaca

SEQ ID NO: 29001 - DNA, 20 bp, Artificial Sequence
  Description of Artificial Sequence: Synthetic oligonucleotide
  Target: SCN9A; (-) strand; PAM type: NRG; PAM sequence: AGG
agcacaaagaataccatgaa

SEQ ID NO: 29002 - DNA, 20 bp, Artificial Sequence
  Description of Artificial Sequence: Synthetic oligonucleotide
  Target: SCN9A; (-) strand; PAM type: NRG; PAM sequence: AAG
tagcacaaagaataccatga

SEQ ID NO: 29003 - DNA, 20 bp, Artificial Sequence
  Description of Artificial Sequence: Synthetic oligonucleotide
  Target: SCN9A; (-) strand; PAM type: NRG; PAM sequence: AAG
tactactaaaaattagcaca

SEQ ID NO: 29004 - DNA, 20 bp, Artificial Sequence
  Description of Artificial Sequence: Synthetic oligonucleotide
  Target: SCN9A; (-) strand; PAM type: NRG; PAM sequence: TAG
gaacttttactactaaaaat

SEQ ID NO: 29005 - DNA, 20 bp, Artificial Sequence
  Description of Artificial Sequence: Synthetic oligonucleotide
  Target: SCN9A; (-) strand; PAM type: NRG; PAM sequence: GAG
caaatgacagaagagttgat

SEQ ID NO: 29006 - DNA, 20 bp, Artificial Sequence
  Description of Artificial Sequence: Synthetic oligonucleotide
  Target: SCN9A; (-) strand; PAM type: NRG; PAM sequence: GAG
cttaacagcaaatgacagaa

SEQ ID NO: 29007 - DNA, 20 bp, Artificial Sequence
  Description of Artificial Sequence: Synthetic oligonucleotide
  Target: SCN9A; (-) strand; PAM type: NRG; PAM sequence: AAG
gccttaacagcaaatgacag

SEQ ID NO: 29008 - DNA, 20 bp, Artificial Sequence
  Description of Artificial Sequence: Synthetic oligonucleotide
  Target: SCN9A; (-) strand; PAM type: NRG; PAM sequence: CAG
caagccttaacagcaaatga

SEQ ID NO: 29009 - DNA, 20 bp, Artificial Sequence
  Description of Artificial Sequence: Synthetic oligonucleotide
  Target: SCN9A; (-) strand; PAM type: NRG; PAM sequence: CAG
gtcttaggaacaagccttaa

SEQ ID NO: 29010 - DNA, 20 bp, Artificial Sequence
  Description of Artificial Sequence: Synthetic oligonucleotide
  Target: SCN9A; (-) strand; PAM type: NRG; PAM sequence: AAG
ctgcccccagtcttaggaac

SEQ ID NO: 29011 - DNA, 20 bp, Artificial Sequence
  Description of Artificial Sequence: Synthetic oligonucleotide
  Target: SCN9A; (-) strand; PAM type: NRG; PAM sequence: AGG
atagatctgcccccagtctt

SEQ ID NO: 29012 - DNA, 20 bp, Artificial Sequence
  Description of Artificial Sequence: Synthetic oligonucleotide
  Target: SCN9A; (-) strand; PAM type: NRG; PAM sequence: TAG
gatagatctgcccccagtct

SEQ ID NO: 29013 - DNA, 20 bp, Artificial Sequence
  Description of Artificial Sequence: Synthetic oligonucleotide
  Target: SCN9A; (-) strand; PAM type: NRG; PAM sequence: CAG
tacaaggatagatctgcccc

SEQ ID NO: 29014 - DNA, 20 bp, Artificial Sequence
  Description of Artificial Sequence: Synthetic oligonucleotide
  Target: SCN9A; (-) strand; PAM type: NRG; PAM sequence: TAG
aaacatttactatacaagga

SEQ ID NO: 29015 - DNA, 20 bp, Artificial Sequence
  Description of Artificial Sequence: Synthetic oligonucleotide
  Target: SCN9A; (-) strand; PAM type: NRG; PAM sequence: AGG
atttaaacatttactataca

SEQ ID NO: 29016 - DNA, 20 bp, Artificial Sequence
  Description of Artificial Sequence: Synthetic oligonucleotide
  Target: SCN9A; (-) strand; PAM type: NRG; PAM sequence: AAG
catttaaacatttactatac

SEQ ID NO: 29017 - DNA, 20 bp, Artificial Sequence
  Description of Artificial Sequence: Synthetic oligonucleotide
  Target: SCN9A; (-) strand; PAM type: NRG; PAM sequence: TAG
agagatgacaaaaggttttt

SEQ ID NO: 29018 - DNA, 20 bp, Artificial Sequence
  Description of Artificial Sequence: Synthetic oligonucleotide
  Target: SCN9A; (-) strand; PAM type: NRG; PAM sequence: AGG
tatttaagagagatgacaaa

SEQ ID NO: 29019 - DNA, 20 bp, Artificial Sequence
  Description of Artificial Sequence: Synthetic oligonucleotide
  Target: SCN9A; (-) strand; PAM type: NRG; PAM sequence: AAG
atatttaagagagatgacaa

SEQ ID NO: 29020 - DNA, 20 bp, Artificial Sequence
  Description of Artificial Sequence: Synthetic oligonucleotide
  Target: SCN9A; (-) strand; PAM type: NRG; PAM sequence: GAG
agtagaatagatatttaaga

SEQ ID NO: 29021 - DNA, 20 bp, Artificial Sequence
  Description of Artificial Sequence: Synthetic oligonucleotide
  Target: SCN9A; (-) strand; PAM type: NRG; PAM sequence: GAG
atagtagaatagatatttaa

SEQ ID NO: 29022 - DNA, 20 bp, Artificial Sequence
  Description of Artificial Sequence: Synthetic oligonucleotide
  Target: SCN9A; (-) strand; PAM type: NRG; PAM sequence: AAG
ttatagtagaatagatattt

SEQ ID NO: 29023 - DNA, 20 bp, Artificial Sequence
  Description of Artificial Sequence: Synthetic oligonucleotide
  Target: SCN9A; (-) strand; PAM type: NRG; PAM sequence: TAG
gtcaggttcttatagtagaa

SEQ ID NO: 29024 - DNA, 20 bp, Artificial Sequence
  Description of Artificial Sequence: Synthetic oligonucleotide
  Target: SCN9A; (-) strand; PAM type: NRG; PAM sequence: TAG
aggaagtcaggttcttatag

SEQ ID NO: 29025 - DNA, 20 bp, Artificial Sequence
  Description of Artificial Sequence: Synthetic oligonucleotide
  Target: SCN9A; (-) strand; PAM type: NRG; PAM sequence: TAG
aataggaagtcaggttctta

SEQ ID NO: 29026 - DNA, 20 bp, Artificial Sequence
  Description of Artificial Sequence: Synthetic oligonucleotide
  Target: SCN9A; (-) strand; PAM type: NRG; PAM sequence: AGG
cctgagtaaaataggaagtc

SEQ ID NO: 29027 - DNA, 20 bp, Artificial Sequence
  Description of Artificial Sequence: Synthetic oligonucleotide
  Target: SCN9A; (-) strand; PAM type: NRG; PAM sequence: CAG
acctgagtaaaataggaagt

SEQ ID NO: 29028 - DNA, 20 bp, Artificial Sequence
  Description of Artificial Sequence: Synthetic oligonucleotide
  Target: SCN9A; (-) strand; PAM type: NRG; PAM sequence: AAG
tttgacctgagtaaaatagg

SEQ ID NO: 29029 - DNA, 20 bp, Artificial Sequence
  Description of Artificial Sequence: Synthetic oligonucleotide
  Target: SCN9A; (-) strand; PAM type: NRG; PAM sequence: AGG
taatttgacctgagtaaaat

SEQ ID NO: 29030 - DNA, 20 bp, Artificial Sequence
  Description of Artificial Sequence: Synthetic oligonucleotide
  Target: SCN9A; (-) strand; PAM type: NRG; PAM sequence: TAG
ttaatttgacctgagtaaaa

SEQ ID NO: 29031 - DNA, 20 bp, Artificial Sequence
  Description of Artificial Sequence: Synthetic oligonucleotide
  Target: SCN9A; (-) strand; PAM type: NRG; PAM sequence: GAG
cagattttttaatttgacct

SEQ ID NO: 29032 - DNA, 20 bp, Artificial Sequence
  Description of Artificial Sequence: Synthetic oligonucleotide
  Target: SCN9A; (-) strand; PAM type: NRG; PAM sequence: CAG
tccaaaagtctcccaataat

SEQ ID NO: 29033 - DNA, 20 bp, Artificial Sequence
  Description of Artificial Sequence: Synthetic oligonucleotide
  Target: SCN9A; (-) strand; PAM type: NRG; PAM sequence: AAG
ttcttccatgattactccaa

SEQ ID NO: 29034 - DNA, 20 bp, Artificial Sequence
  Description of Artificial Sequence: Synthetic oligonucleotide
  Target: SCN9A; (-) strand; PAM type: NRG; PAM sequence: TAG
tccaagaatatctgatttca

SEQ ID NO: 29035 - DNA, 20 bp, Artificial Sequence
  Description of Artificial Sequence: Synthetic oligonucleotide
  Target: SCN9A; (-) strand; PAM type: NRG; PAM sequence: AAG
tagaagcaacattcaaatcc

SEQ ID NO: 29036 - DNA, 20 bp, Artificial Sequence
  Description of Artificial Sequence: Synthetic oligonucleotide
  Target: SCN9A; (-) strand; PAM type: NRG; PAM sequence: AAG
acttacttaagaagggatag

SEQ ID NO: 29037 - DNA, 20 bp, Artificial Sequence
  Description of Artificial Sequence: Synthetic oligonucleotide
  Target: SCN9A; (-) strand; PAM type: NRG; PAM sequence: TAG
ttcacttacttaagaaggga

SEQ ID NO: 29038 - DNA, 20 bp, Artificial Sequence
  Description of Artificial Sequence: Synthetic oligonucleotide
  Target: SCN9A; (-) strand; PAM type: NRG; PAM sequence: GGG
ataattcacttacttaagaa

SEQ ID NO: 29039 - DNA, 20 bp, Artificial Sequence
  Description of Artificial Sequence: Synthetic oligonucleotide
  Target: SCN9A; (-) strand; PAM type: NRG; PAM sequence: AGG
gataattcacttacttaaga

SEQ ID NO: 29040 - DNA, 20 bp, Artificial Sequence
  Description of Artificial Sequence: Synthetic oligonucleotide
  Target: SCN9A; (-) strand; PAM type: NRG; PAM sequence: AAG
agataattcacttacttaag

SEQ ID NO: 29041 - DNA, 20 bp, Artificial Sequence
  Description of Artificial Sequence: Synthetic oligonucleotide
  Target: SCN9A; (-) strand; PAM type: NRG; PAM sequence: AAG
taaagataattcacttactt

SEQ ID NO: 29042 - DNA, 20 bp, Artificial Sequence
  Description of Artificial Sequence: Synthetic oligonucleotide
  Target: SCN9A; (-) strand; PAM type: NRG; PAM sequence: AAG
agctaaggcttaatggctta

SEQ ID NO: 29043 - DNA, 20 bp, Artificial Sequence
  Description of Artificial Sequence: Synthetic oligonucleotide
  Target: SCN9A; (-) strand; PAM type: NRG; PAM sequence: TGG
atgcagcagctaaggcttaa

SEQ ID NO: 29044 - DNA, 20 bp, Artificial Sequence
  Description of Artificial Sequence: Synthetic oligonucleotide
  Target: SCN9A; (-) strand; PAM type: NRG; PAM sequence: AGG
ttttacagatgcagcagcta

SEQ ID NO: 29045 - DNA, 20 bp, Artificial Sequence
  Description of Artificial Sequence: Synthetic oligonucleotide
  Target: SCN9A; (-) strand; PAM type: NRG; PAM sequence: AAG
attttacagatgcagcagct

SEQ ID NO: 29046 - DNA, 20 bp, Artificial Sequence
  Description of Artificial Sequence: Synthetic oligonucleotide
  Target: SCN9A; (-) strand; PAM type: NRG; PAM sequence: CAG
tacgtattttacagatgcag

SEQ ID NO: 29047 - DNA, 20 bp, Artificial Sequence
  Description of Artificial Sequence: Synthetic oligonucleotide
  Target: SCN9A; (-) strand; PAM type: NRG; PAM sequence: CAG
ttatacgtattttacagatg

SEQ ID NO: 29048 - DNA, 20 bp, Artificial Sequence
  Description of Artificial Sequence: Synthetic oligonucleotide
  Target: SCN9A; (-) strand; PAM type: NRG; PAM sequence: CAG
gtattcttatacgtatttta

SEQ ID NO: 29049 - DNA, 20 bp, Artificial Sequence
  Description of Artificial Sequence: Synthetic oligonucleotide
  Target: SCN9A; (-) strand; PAM type: NRG; PAM sequence: AGG
atttaacaactttataaagt

SEQ ID NO: 29050 - DNA, 20 bp, Artificial Sequence
  Description of Artificial Sequence: Synthetic oligonucleotide
  Target: SCN9A; (-) strand; PAM type: NRG; PAM sequence: TAG
tatttaacaactttataaag

SEQ ID NO: 29051 - DNA, 20 bp, Artificial Sequence
  Description of Artificial Sequence: Synthetic oligonucleotide
  Target: SCN9A; (-) strand; PAM type: NRG; PAM sequence: AAG
tactatttaacaactttata

SEQ ID NO: 29052 - DNA, 20 bp, Artificial Sequence
  Description of Artificial Sequence: Synthetic oligonucleotide
  Target: SCN9A; (-) strand; PAM type: NRG; PAM sequence: TGG
gtgtggatcacagtatcaag

SEQ ID NO: 29053 - DNA, 20 bp, Artificial Sequence
  Description of Artificial Sequence: Synthetic oligonucleotide
  Target: SCN9A; (-) strand; PAM type: NRG; PAM sequence: AAG
aatgtgtggatcacagtatc

SEQ ID NO: 29054 - DNA, 20 bp, Artificial Sequence
  Description of Artificial Sequence: Synthetic oligonucleotide
  Target: SCN9A; (-) strand; PAM type: NRG; PAM sequence: CAG
agtacagaatgtgtggatca

SEQ ID NO: 29055 - DNA, 20 bp, Artificial Sequence
  Description of Artificial Sequence: Synthetic oligonucleotide
  Target: SCN9A; (-) strand; PAM type: NRG; PAM sequence: TGG
agcagctagtacagaatgtg

SEQ ID NO: 29056 - DNA, 20 bp, Artificial Sequence
  Description of Artificial Sequence: Synthetic oligonucleotide
  Target: SCN9A; (-) strand; PAM type: NRG; PAM sequence: CAG
ctgtttttgagcagctagta

SEQ ID NO: 29057 - DNA, 20 bp, Artificial Sequence
  Description of Artificial Sequence: Synthetic oligonucleotide
  Target: SCN9A; (-) strand; PAM type: NRG; PAM sequence: TAG
aactcctgtttttgagcagc

SEQ ID NO: 29058 - DNA, 20 bp, Artificial Sequence
  Description of Artificial Sequence: Synthetic oligonucleotide
  Target: SCN9A; (-) strand; PAM type: NRG; PAM sequence: CAG
taataactcctgtttttgag

SEQ ID NO: 29059 - DNA, 20 bp, Artificial Sequence
  Description of Artificial Sequence: Synthetic oligonucleotide
  Target: SCN9A; (-) strand; PAM type: NRG; PAM sequence: GAG
ttataataactcctgttttt

SEQ ID NO: 29060 - DNA, 20 bp, Artificial Sequence
  Description of Artificial Sequence: Synthetic oligonucleotide
  Target: SCN9A; (-) strand; PAM type: NRG; PAM sequence: TAG
ttttatctcaaattgtataa

SEQ ID NO: 29061 - DNA, 20 bp, Artificial Sequence
  Description of Artificial Sequence: Synthetic oligonucleotide
  Target: SCN9A; (-) strand; PAM type: NRG; PAM sequence: TAG
atgatgtgtaattcaatcaa

SEQ ID NO: 29062 - DNA, 20 bp, Artificial Sequence
  Description of Artificial Sequence: Synthetic oligonucleotide
  Target: SCN9A; (-) strand; PAM type: NRG; PAM sequence: AAG
tttatctgtgtcttctaagt

SEQ ID NO: 29063 - DNA, 20 bp, Artificial Sequence
  Description of Artificial Sequence: Synthetic oligonucleotide
  Target: SCN9A; (-) strand; PAM type: NRG; PAM sequence: AAG
ttgttttatctgtgtcttct

SEQ ID NO: 29064 - DNA, 20 bp, Artificial Sequence
  Description of Artificial Sequence: Synthetic oligonucleotide
  Target: SCN9A; (-) strand; PAM type: NRG; PAM sequence: AGG
catttgcacctcaaactgca

SEQ ID NO: 29065 - DNA, 20 bp, Artificial Sequence
  Description of Artificial Sequence: Synthetic oligonucleotide
  Target: SCN9A; (-) strand; PAM type: NRG; PAM sequence: AAG
acatttgcacctcaaactgc

SEQ ID NO: 29066 - DNA, 20 bp, Artificial Sequence
  Description of Artificial Sequence: Synthetic oligonucleotide
  Target: SCN9A; (-) strand; PAM type: NRG; PAM sequence: AAG
gttcaggagtgttttcagga

SEQ ID NO: 29067 - DNA, 20 bp, Artificial Sequence
  Description of Artificial Sequence: Synthetic oligonucleotide
  Target: SCN9A; (-) strand; PAM type: NRG; PAM sequence: AGG
cgaggttcaggagtgttttc

SEQ ID NO: 29068 - DNA, 20 bp, Artificial Sequence
  Description of Artificial Sequence: Synthetic oligonucleotide
  Target: SCN9A; (-) strand; PAM type: NRG; PAM sequence: CAG
ccgaggttcaggagtgtttt

SEQ ID NO: 29069 - DNA, 20 bp, Artificial Sequence
  Description of Artificial Sequence: Synthetic oligonucleotide
  Target: SCN9A; (-) strand; PAM type: NRG; PAM sequence: GAG
ccatccttcccgaggttcag

SEQ ID NO: 29070 - DNA, 20 bp, Artificial Sequence
  Description of Artificial Sequence: Synthetic oligonucleotide
  Target: SCN9A; (-) strand; PAM type: NRG; PAM sequence: AGG
gcccatccttcccgaggttc

SEQ ID NO: 29071 - DNA, 20 bp, Artificial Sequence
  Description of Artificial Sequence: Synthetic oligonucleotide
  Target: SCN9A; (-) strand; PAM type: NRG; PAM sequence: CAG
ggcccatccttcccgaggtt

SEQ ID NO: 29072 - DNA, 20 bp, Artificial Sequence
  Description of Artificial Sequence: Synthetic oligonucleotide
  Target: SCN9A; (-) strand; PAM type: NRG; PAM sequence: AGG
taccaggcccatccttcccg

SEQ ID NO: 29073 - DNA, 20 bp, Artificial Sequence
  Description of Artificial Sequence: Synthetic oligonucleotide
  Target: SCN9A; (-) strand; PAM type: NRG; PAM sequence: GAG
ctaccaggcccatccttccc

SEQ ID NO: 29074 - DNA, 20 bp, Artificial Sequence
  Description of Artificial Sequence: Synthetic oligonucleotide
  Target: SCN9A; (-) strand; PAM type: NRG; PAM sequence: AGG
tctcccatactcactctacc

SEQ ID NO: 29075 - DNA, 20 bp, Artificial Sequence
  Description of Artificial Sequence: Synthetic oligonucleotide
  Target: SCN9A; (-) strand; PAM type: NRG; PAM sequence: CAG
ctctcccatactcactctac

SEQ ID NO: 29076 - DNA, 20 bp, Artificial Sequence
  Description of Artificial Sequence: Synthetic oligonucleotide
  Target: SCN9A; (-) strand; PAM type: NRG; PAM sequence: TGG
ccatccttattaaaatattt

SEQ ID NO: 29077 - DNA, 20 bp, Artificial Sequence
  Description of Artificial Sequence: Synthetic oligonucleotide
  Target: SCN9A; (-) strand; PAM type: NRG; PAM sequence: AAG
tagtttaaaggataattcta

SEQ ID NO: 29078 - DNA, 20 bp, Artificial Sequence
  Description of Artificial Sequence: Synthetic oligonucleotide
  Target: SCN9A; (-) strand; PAM type: NRG; PAM sequence: AGG
gtgaaccagcattagtttaa

SEQ ID NO: 29079 - DNA, 20 bp, Artificial Sequence
  Description of Artificial Sequence: Synthetic oligonucleotide
  Target: SCN9A; (-) strand; PAM type: NRG; PAM sequence: AAG
tgtgaaccagcattagttta

SEQ ID NO: 29080 - DNA, 20 bp, Artificial Sequence
  Description of Artificial Sequence: Synthetic oligonucleotide
  Target: SCN9A; (-) strand; PAM type: NRG; PAM sequence: TAG
tgataaatgtgaaccagcat

SEQ ID NO: 29081 - DNA, 20 bp, Artificial Sequence
  Description of Artificial Sequence: Synthetic oligonucleotide
  Target: SCN9A; (-) strand; PAM type: NRG; PAM sequence: CAG
agtggttgataaatgtgaac

SEQ ID NO: 29082 - DNA, 20 bp, Artificial Sequence
  Description of Artificial Sequence: Synthetic oligonucleotide
  Target: SCN9A; (-) strand; PAM type: NRG; PAM sequence: TGG
catataattcagctcctcag

SEQ ID NO: 29083 - DNA, 20 bp, Artificial Sequence
  Description of Artificial Sequence: Synthetic oligonucleotide
  Target: SCN9A; (-) strand; PAM type: NRG; PAM sequence: CAG
attcatataattcagctcct

SEQ ID NO: 29084 - DNA, 20 bp, Artificial Sequence
  Description of Artificial Sequence: Synthetic oligonucleotide
  Target: SCN9A; (-) strand; PAM type: NRG; PAM sequence: CAG
cagagcccattcatataatt

SEQ ID NO: 29085 - DNA, 20 bp, Artificial Sequence
  Description of Artificial Sequence: Synthetic oligonucleotide
  Target: SCN9A; (-) strand; PAM type: NRG; PAM sequence: GAG
tgtgctaatagacagctcca

SEQ ID NO: 29086 - DNA, 20 bp, Artificial Sequence
  Description of Artificial Sequence: Synthetic oligonucleotide
  Target: SCN9A; (-) strand; PAM type: NRG; PAM sequence: CAG
agtgtgctaatagacagctc

SEQ ID NO: 29087 - DNA, 20 bp, Artificial Sequence
  Description of Artificial Sequence: Synthetic oligonucleotide
  Target: SCN9A; (-) strand; PAM type: NRG; PAM sequence: CAG
tatagcagtgtgctaataga

SEQ ID NO: 29088 - DNA, 20 bp, Artificial Sequence
  Description of Artificial Sequence: Synthetic oligonucleotide
  Target: SCN9A; (-) strand; PAM type: NRG; PAM sequence: TAG
gtagtatagcagtgtgctaa

SEQ ID NO: 29089 - DNA, 20 bp, Artificial Sequence
  Description of Artificial Sequence: Synthetic oligonucleotide
  Target: SCN9A; (-) strand; PAM type: NRG; PAM sequence: CAG
tgttaaatacagtagtatag

SEQ ID NO: 29090 - DNA, 20 bp, Artificial Sequence
  Description of Artificial Sequence: Synthetic oligonucleotide
  Target: SCN9A; (-) strand; PAM type: NRG; PAM sequence: TAG
ctgtgttaaatacagtagta

SEQ ID NO: 29091 - DNA, 20 bp, Artificial Sequence
  Description of Artificial Sequence: Synthetic oligonucleotide
  Target: SCN9A; (-) strand; PAM type: NRG; PAM sequence: TAG
ttatactgtgttaaatacag

SEQ ID NO: 29092 - DNA, 20 bp, Artificial Sequence
  Description of Artificial Sequence: Synthetic oligonucleotide
  Target: SCN9A; (-) strand; PAM type: NRG; PAM sequence: CAG
ttcttatactgtgttaaata

SEQ ID NO: 29093 - DNA, 20 bp, Artificial Sequence
  Description of Artificial Sequence: Synthetic oligonucleotide
  Target: SCN9A; (-) strand; PAM type: NRG; PAM sequence: GAG
gttttctacaaacctagagt

SEQ ID NO: 29094 - DNA, 20 bp, Artificial Sequence
  Description of Artificial Sequence: Synthetic oligonucleotide
  Target: SCN9A; (-) strand; PAM type: NRG; PAM sequence: GAG
taaagttttctacaaaccta

SEQ ID NO: 29095 - DNA, 20 bp, Artificial Sequence
  Description of Artificial Sequence: Synthetic oligonucleotide
  Target: SCN9A; (-) strand; PAM type: NRG; PAM sequence: TAG
tgtaaagttttctacaaacc

SEQ ID NO: 29096 - DNA, 20 bp, Artificial Sequence
  Description of Artificial Sequence: Synthetic oligonucleotide
  Target: SCN9A; (-) strand; PAM type: NRG; PAM sequence: AAG
gttgtttagaaattattgta

SEQ ID NO: 29097 - DNA, 20 bp, Artificial Sequence
  Description of Artificial Sequence: Synthetic oligonucleotide
  Target: SCN9A; (-) strand; PAM type: NRG; PAM sequence: TAG
taatttaatgtctagttgtt

SEQ ID NO: 29098 - DNA, 20 bp, Artificial Sequence
  Description of Artificial Sequence: Synthetic oligonucleotide
  Target: SCN9A; (-) strand; PAM type: NRG; PAM sequence: TAG
catcttaataatttaatgtc

SEQ ID NO: 29099 - DNA, 20 bp, Artificial Sequence
  Description of Artificial Sequence: Synthetic oligonucleotide
  Target: SCN9A; (-) strand; PAM type: NRG; PAM sequence: AAG
gttaaccttaaatcttcttg

SEQ ID NO: 29100 - DNA, 20 bp, Artificial Sequence
  Description of Artificial Sequence: Synthetic oligonucleotide
  Target: SCN9A; (-) strand; PAM type: NRG; PAM sequence: AAG
tcaattttttcccattttta

SEQ ID NO: 29101 - DNA, 20 bp, Artificial Sequence
  Description of Artificial Sequence: Synthetic oligonucleotide
  Target: SCN9A; (-) strand; PAM type: NRG; PAM sequence: AAG
tcccacttttgaatatgcac

SEQ ID NO: 29102 - DNA, 20 bp, Artificial Sequence
  Description of Artificial Sequence: Synthetic oligonucleotide
  Target: SCN9A; (-) strand; PAM type: NRG; PAM sequence: CAG
gtgattcattctttatcttt

SEQ ID NO: 29103 - DNA, 20 bp, Artificial Sequence
  Description of Artificial Sequence: Synthetic oligonucleotide
  Target: SCN9A; (-) strand; PAM type: NRG; PAM sequence: CGG
caggcgtgagccactgcgcc

SEQ ID NO: 29104 - DNA, 20 bp, Artificial Sequence
  Description of Artificial Sequence: Synthetic oligonucleotide
  Target: SCN9A; (-) strand; PAM type: NRG; PAM sequence: GAG
agtgctggcattacaggcgt

SEQ ID NO: 29105 - DNA, 20 bp, Artificial Sequence
  Description of Artificial Sequence: Synthetic oligonucleotide
  Target: SCN9A; (-) strand; PAM type: NRG; PAM sequence: AGG
tcccaaagtgctggcattac

SEQ ID NO: 29106 - DNA, 20 bp, Artificial Sequence
  Description of Artificial Sequence: Synthetic oligonucleotide
  Target: SCN9A; (-) strand; PAM type: NRG; PAM sequence: CAG
ctcccaaagtgctggcatta

SEQ ID NO: 29107 - DNA, 20 bp, Artificial Sequence
  Description of Artificial Sequence: Synthetic oligonucleotide
  Target: SCN9A; (-) strand; PAM type: NRG; PAM sequence: TGG
gcctcgacctcccaaagtgc

SEQ ID NO: 29108 - DNA, 20 bp, Artificial Sequence
  Description of Artificial Sequence: Synthetic oligonucleotide
  Target: SCN9A; (-) strand; PAM type: NRG; PAM sequence: AAG
ctgcccgcctcgacctccca

SEQ ID NO: 29109 - DNA, 20 bp, Artificial Sequence
  Description of Artificial Sequence: Synthetic oligonucleotide
  Target: SCN9A; (-) strand; PAM type: NRG; PAM sequence: TGG
tttcattgtgttagccagga

SEQ ID NO: 29110 - DNA, 20 bp, Artificial Sequence
  Description of Artificial Sequence: Synthetic oligonucleotide
  Target: SCN9A; (-) strand; PAM type: NRG; PAM sequence: AGG
ggggtttcattgtgttagcc

SEQ ID NO: 29111 - DNA, 20 bp, Artificial Sequence
  Description of Artificial Sequence: Synthetic oligonucleotide
  Target: SCN9A; (-) strand; PAM type: NRG; PAM sequence: CAG
cggggtttcattgtgttagc

SEQ ID NO: 29112 - DNA, 20 bp, Artificial Sequence
  Description of Artificial Sequence: Synthetic oligonucleotide
  Target: SCN9A; (-) strand; PAM type: NRG; PAM sequence: TAG
gagacggggtttcattgtgt

SEQ ID NO: 29113 - DNA, 20 bp, Artificial Sequence
  Description of Artificial Sequence: Synthetic oligonucleotide
  Target: SCN9A; (-) strand; PAM type: NRG; PAM sequence: GGG
ttgtatttttagtagagacg

SEQ ID NO: 29114 - DNA, 20 bp, Artificial Sequence
  Description of Artificial Sequence: Synthetic oligonucleotide
  Target: SCN9A; (-) strand; PAM type: NRG; PAM sequence: GGG
tttgtatttttagtagagac

SEQ ID NO: 29115 - DNA, 20 bp, Artificial Sequence
  Description of Artificial Sequence: Synthetic oligonucleotide
  Target: SCN9A; (-) strand; PAM type: NRG; PAM sequence: CGG
ttttgtatttttagtagaga

SEQ ID NO: 29116 - DNA, 20 bp, Artificial Sequence
  Description of Artificial Sequence: Synthetic oligonucleotide
  Target: SCN9A; (-) strand; PAM type: NRG; PAM sequence: GAG
atttttttgtatttttagta

SEQ ID NO: 29117 - DNA, 20 bp, Artificial Sequence
  Description of Artificial Sequence: Synthetic oligonucleotide
  Target: SCN9A; (-) strand; PAM type: NRG; PAM sequence: TAG
ctatttttttgtatttttag

SEQ ID NO: 29118 - DNA, 20 bp, Artificial Sequence
  Description of Artificial Sequence: Synthetic oligonucleotide
  Target: SCN9A; (-) strand; PAM type: NRG; PAM sequence: TAG
cagctatttttttgtatttt

SEQ ID NO: 29119 - DNA, 20 bp, Artificial Sequence
  Description of Artificial Sequence: Synthetic oligonucleotide
  Target: SCN9A; (-) strand; PAM type: NRG; PAM sequence: CAG
caggtgcccgccaccacgcc

SEQ ID NO: 29120 - DNA, 20 bp, Artificial Sequence
  Description of Artificial Sequence: Synthetic oligonucleotide
  Target: SCN9A; (-) strand; PAM type: NRG; PAM sequence: AGG
tgccaagtagctgggactac

SEQ ID NO: 29121 - DNA, 20 bp, Artificial Sequence
  Description of Artificial Sequence: Synthetic oligonucleotide
  Target: SCN9A; (-) strand; PAM type: NRG; PAM sequence: CAG
ctgccaagtagctgggacta

SEQ ID NO: 29122 - DNA, 20 bp, Artificial Sequence
  Description of Artificial Sequence: Synthetic oligonucleotide
  Target: SCN9A; (-) strand; PAM type: NRG; PAM sequence: GGG
cctcagcctgccaagtagct

SEQ ID NO: 29123 - DNA, 20 bp, Artificial Sequence
  Description of Artificial Sequence: Synthetic oligonucleotide
  Target: SCN9A; (-) strand; PAM type: NRG; PAM sequence: TGG
gcctcagcctgccaagtagc

SEQ ID NO: 29124 - DNA, 20 bp, Artificial Sequence
  Description of Artificial Sequence: Synthetic oligonucleotide
  Target: SCN9A; (-) strand; PAM type: NRG; PAM sequence: TAG
tcctgcctcagcctgccaag

SEQ ID NO: 29125 - DNA, 20 bp, Artificial Sequence
  Description of Artificial Sequence: Synthetic oligonucleotide
  Target: SCN9A; (-) strand; PAM type: NRG; PAM sequence: AAG
ttctcctgcctcagcctgcc

SEQ ID NO: 29126 - DNA, 20 bp, Artificial Sequence
  Description of Artificial Sequence: Synthetic oligonucleotide
  Target: SCN9A; (-) strand; PAM type: NRG; PAM sequence: CAG
ttcacaccattctcctgcct

SEQ ID NO: 29127 - DNA, 20 bp, Artificial Sequence
  Description of Artificial Sequence: Synthetic oligonucleotide
  Target: SCN9A; (-) strand; PAM type: NRG; PAM sequence: GGG
cactgtaagctccgcctccc

SEQ ID NO: 29128 - DNA, 20 bp, Artificial Sequence
  Description of Artificial Sequence: Synthetic oligonucleotide
  Target: SCN9A; (-) strand; PAM type: NRG; PAM sequence: CGG
tcactgtaagctccgcctcc

SEQ ID NO: 29129 - DNA, 20 bp, Artificial Sequence
  Description of Artificial Sequence: Synthetic oligonucleotide
  Target: SCN9A; (-) strand; PAM type: NRG; PAM sequence: AAG
tcgctatctcggctcactgt

SEQ ID NO: 29130 - DNA, 20 bp, Artificial Sequence
  Description of Artificial Sequence: Synthetic oligonucleotide
  Target: SCN9A; (-) strand; PAM type: NRG; PAM sequence: CGG
ggaatgcagtgtcgctatct

SEQ ID NO: 29131 - DNA, 20 bp, Artificial Sequence
  Description of Artificial Sequence: Synthetic oligonucleotide
  Target: SCN9A; (-) strand; PAM type: NRG; PAM sequence: CAG
ctgtcgcctaggctggaatg

SEQ ID NO: 29132 - DNA, 20 bp, Artificial Sequence
  Description of Artificial Sequence: Synthetic oligonucleotide
  Target: SCN9A; (-) strand; PAM type: NRG; PAM sequence: TGG
tctcactctgtcgcctaggc

SEQ ID NO: 29133 - DNA, 20 bp, Artificial Sequence
  Description of Artificial Sequence: Synthetic oligonucleotide
  Target: SCN9A; (-) strand; PAM type: NRG; PAM sequence: AGG
ggagtctcactctgtcgcct

SEQ ID NO: 29134 - DNA, 20 bp, Artificial Sequence
  Description of Artificial Sequence: Synthetic oligonucleotide
  Target: SCN9A; (-) strand; PAM type: NRG; PAM sequence: TAG
tggagtctcactctgtcgcc

SEQ ID NO: 29135 - DNA, 20 bp, Artificial Sequence
  Description of Artificial Sequence: Synthetic oligonucleotide
  Target: SCN9A; (-) strand; PAM type: NRG; PAM sequence: GAG
ttttttttttttttgagatg

SEQ ID NO: 29136 - DNA, 20 bp, Artificial Sequence
  Description of Artificial Sequence: Synthetic oligonucleotide
  Target: SCN9A; (-) strand; PAM type: NRG; PAM sequence: TGG
ttttttttttttttttgaga

SEQ ID NO: 29137 - DNA, 20 bp, Artificial Sequence
  Description of Artificial Sequence: Synthetic oligonucleotide
  Target: SCN9A; (-) strand; PAM type: NRG; PAM sequence: GAG
tttttttttttttttttttt

SEQ ID NO: 29138 - DNA, 20 bp, Artificial Sequence
  Description of Artificial Sequence: Synthetic oligonucleotide
  Target: SCN9A; (-) strand; PAM type: NRG; PAM sequence: TGG
gtagtgggattactgagtca

SEQ ID NO: 29139 - DNA, 20 bp, Artificial Sequence
  Description of Artificial Sequence: Synthetic oligonucleotide
  Target: SCN9A; (-) strand; PAM type: NRG; PAM sequence: GAG
tacctagtagtgggattact

SEQ ID NO: 29140 - DNA, 20 bp, Artificial Sequence
  Description of Artificial Sequence: Synthetic oligonucleotide
  Target: SCN9A; (-) strand; PAM type: NRG; PAM sequence: GGG
ctcagtatatacctagtagt

SEQ ID NO: 29141 - DNA, 20 bp, Artificial Sequence
  Description of Artificial Sequence: Synthetic oligonucleotide
  Target: SCN9A; (-) strand; PAM type: NRG; PAM sequence: TGG
tctcagtatatacctagtag

SEQ ID NO: 29142 - DNA, 20 bp, Artificial Sequence
  Description of Artificial Sequence: Synthetic oligonucleotide
  Target: SCN9A; (-) strand; PAM type: NRG; PAM sequence: TAG
agttctcagtatatacctag

SEQ ID NO: 29143 - DNA, 20 bp, Artificial Sequence
  Description of Artificial Sequence: Synthetic oligonucleotide
  Target: SCN9A; (-) strand; PAM type: NRG; PAM sequence: TAG
ttcagttctcagtatatacc

SEQ ID NO: 29144 - DNA, 20 bp, Artificial Sequence
  Description of Artificial Sequence: Synthetic oligonucleotide
  Target: SCN9A; (-) strand; PAM type: NRG; PAM sequence: CAG
cattttcaattttcagttct

SEQ ID NO: 29145 - DNA, 20 bp, Artificial Sequence
  Description of Artificial Sequence: Synthetic oligonucleotide
  Target: SCN9A; (-) strand; PAM type: NRG; PAM sequence: CAG
ggaaatacattttcaatttt

SEQ ID NO: 29146 - DNA, 20 bp, Artificial Sequence
  Description of Artificial Sequence: Synthetic oligonucleotide
  Target: SCN9A; (-) strand; PAM type: NRG; PAM sequence: TGG
cattcatgtacaagtttttg

SEQ ID NO: 29147 - DNA, 20 bp, Artificial Sequence
  Description of Artificial Sequence: Synthetic oligonucleotide
  Target: SCN9A; (-) strand; PAM type: NRG; PAM sequence: AAG
tgctgtaaacattcatgtac

SEQ ID NO: 29148 - DNA, 20 bp, Artificial Sequence
  Description of Artificial Sequence: Synthetic oligonucleotide
  Target: SCN9A; (-) strand; PAM type: NRG; PAM sequence: TGG
tttgggttatttccgtcttt

SEQ ID NO: 29149 - DNA, 20 bp, Artificial Sequence
  Description of Artificial Sequence: Synthetic oligonucleotide
  Target: SCN9A; (-) strand; PAM type: NRG; PAM sequence: GGG
tcatcagttgatggacattt

SEQ ID NO: 29150 - DNA, 20 bp, Artificial Sequence
  Description of Artificial Sequence: Synthetic oligonucleotide
  Target: SCN9A; (-) strand; PAM type: NRG; PAM sequence: TGG
ttcatcagttgatggacatt

SEQ ID NO: 29151 - DNA, 20 bp, Artificial Sequence
  Description of Artificial Sequence: Synthetic oligonucleotide
  Target: SCN9A; (-) strand; PAM type: NRG; PAM sequence: TGG
tttatacattcatcagttga

SEQ ID NO: 29152 - DNA, 20 bp, Artificial Sequence
  Description of Artificial Sequence: Synthetic oligonucleotide
  Target: SCN9A; (-) strand; PAM type: NRG; PAM sequence: CAG
tattttgtttatacattcat

SEQ ID NO: 29153 - DNA, 20 bp, Artificial Sequence
  Description of Artificial Sequence: Synthetic oligonucleotide
  Target: SCN9A; (-) strand; PAM type: NRG; PAM sequence: TAG
ttcaaaatttatccatggta

SEQ ID NO: 29154 - DNA, 20 bp, Artificial Sequence
  Description of Artificial Sequence: Synthetic oligonucleotide
  Target: SCN9A; (-) strand; PAM type: NRG; PAM sequence: TGG
atgttttcaaaatttatcca

SEQ ID NO: 29155 - DNA, 20 bp, Artificial Sequence
  Description of Artificial Sequence: Synthetic oligonucleotide
  Target: SCN9A; (-) strand; PAM type: NRG; PAM sequence: TAG
tgtatctggcttcttacacc

SEQ ID NO: 29156 - DNA, 20 bp, Artificial Sequence
  Description of Artificial Sequence: Synthetic oligonucleotide
  Target: SCN9A; (-) strand; PAM type: NRG; PAM sequence: TGG
aatatatggctttttgtatc

SEQ ID NO: 29157 - DNA, 20 bp, Artificial Sequence
  Description of Artificial Sequence: Synthetic oligonucleotide
  Target: SCN9A; (-) strand; PAM type: NRG; PAM sequence: TGG
acatggaagcatataatata

SEQ ID NO: 29158 - DNA, 20 bp, Artificial Sequence
  Description of Artificial Sequence: Synthetic oligonucleotide
  Target: SCN9A; (-) strand; PAM type: NRG; PAM sequence: AAG
tgtagatttaatatacatgg

SEQ ID NO: 29159 - DNA, 20 bp, Artificial Sequence
  Description of Artificial Sequence: Synthetic oligonucleotide
  Target: SCN9A; (-) strand; PAM type: NRG; PAM sequence: TGG
ctctgtagatttaatataca

SEQ ID NO: 29160 - DNA, 20 bp, Artificial Sequence
  Description of Artificial Sequence: Synthetic oligonucleotide
  Target: SCN9A; (-) strand; PAM type: NRG; PAM sequence: TAG
ctagggatttacccactctg

SEQ ID NO: 29161 - DNA, 20 bp, Artificial Sequence
  Description of Artificial Sequence: Synthetic oligonucleotide
  Target: SCN9A; (-) strand; PAM type: NRG; PAM sequence: GGG
taatctactttctgtcccta

SEQ ID NO: 29162 - DNA, 20 bp, Artificial Sequence
  Description of Artificial Sequence: Synthetic oligonucleotide
  Target: SCN9A; (-) strand; PAM type: NRG; PAM sequence: AGG
ctaatctactttctgtccct

SEQ ID NO: 29163 - DNA, 20 bp, Artificial Sequence
  Description of Artificial Sequence: Synthetic oligonucleotide
  Target: SCN9A; (-) strand; PAM type: NRG; PAM sequence: TAG
actaatctactttctgtccc

SEQ ID NO: 29164 - DNA, 20 bp, Artificial Sequence
  Description of Artificial Sequence: Synthetic oligonucleotide
  Target: SCN9A; (-) strand; PAM type: NRG; PAM sequence: TGG
ttcccttttctcccagcccc

SEQ ID NO: 29165 - DNA, 20 bp, Artificial Sequence
  Description of Artificial Sequence: Synthetic oligonucleotide
  Target: SCN9A; (-) strand; PAM type: NRG; PAM sequence: CAG
tccccatttcccttttctcc

SEQ ID NO: 29166 - DNA, 20 bp, Artificial Sequence
  Description of Artificial Sequence: Synthetic oligonucleotide
  Target: SCN9A; (-) strand; PAM type: NRG; PAM sequence: TAG
agaaacccagggcccgttag

SEQ ID NO: 29167 - DNA, 20 bp, Artificial Sequence
  Description of Artificial Sequence: Synthetic oligonucleotide
  Target: SCN9A; (-) strand; PAM type: NRG; PAM sequence: TAG
ccaagaaacccagggcccgt

SEQ ID NO: 29168 - DNA, 20 bp, Artificial Sequence
  Description of Artificial Sequence: Synthetic oligonucleotide
  Target: SCN9A; (-) strand; PAM type: NRG; PAM sequence: GGG
ctttcccaccaagaaaccca

SEQ ID NO: 29169 - DNA, 20 bp, Artificial Sequence
  Description of Artificial Sequence: Synthetic oligonucleotide
  Target: SCN9A; (-) strand; PAM type: NRG; PAM sequence: AGG
tctttcccaccaagaaaccc

SEQ ID NO: 29170 - DNA, 20 bp, Artificial Sequence
  Description of Artificial Sequence: Synthetic oligonucleotide
  Target: SCN9A; (-) strand; PAM type: NRG; PAM sequence: CAG
atctttcccaccaagaaacc

SEQ ID NO: 29171 - DNA, 20 bp, Artificial Sequence
  Description of Artificial Sequence: Synthetic oligonucleotide
  Target: SCN9A; (-) strand; PAM type: NRG; PAM sequence: AAG
atattttcatctttcccacc

SEQ ID NO: 29172 - DNA, 20 bp, Artificial Sequence
  Description of Artificial Sequence: Synthetic oligonucleotide
  Target: SCN9A; (-) strand; PAM type: NRG; PAM sequence: GAG
cattttttaaactatactca

SEQ ID NO: 29173 - DNA, 20 bp, Artificial Sequence
  Description of Artificial Sequence: Synthetic oligonucleotide
  Target: SCN9A; (-) strand; PAM type: NRG; PAM sequence: CAG
ctcattttttaaactatact

SEQ ID NO: 29174 - DNA, 20 bp, Artificial Sequence
  Description of Artificial Sequence: Synthetic oligonucleotide
  Target: SCN9A; (-) strand; PAM type: NRG; PAM sequence: AGG
ttttaaaaataggtttattg

SEQ ID NO: 29175 - DNA, 20 bp, Artificial Sequence
  Description of Artificial Sequence: Synthetic oligonucleotide
  Target: SCN9A; (-) strand; PAM type: NRG; PAM sequence: GAG
cttttaaaaataggtttatt

SEQ ID NO: 29176 - DNA, 20 bp, Artificial Sequence
  Description of Artificial Sequence: Synthetic oligonucleotide
  Target: SCN9A; (-) strand; PAM type: NRG; PAM sequence: AGG
ctgcattcccttttaaaaat

SEQ ID NO: 29177 - DNA, 20 bp, Artificial Sequence
  Description of Artificial Sequence: Synthetic oligonucleotide
  Target: SCN9A; (-) strand; PAM type: NRG; PAM sequence: TAG
gctgcattcccttttaaaaa

SEQ ID NO: 29178 - DNA, 20 bp, Artificial Sequence
  Description of Artificial Sequence: Synthetic oligonucleotide
  Target: SCN9A; (-) strand; PAM type: NRG; PAM sequence: TGG
tacgtattttagtgataagt

SEQ ID NO: 29179 - DNA, 20 bp, Artificial Sequence
  Description of Artificial Sequence: Synthetic oligonucleotide
  Target: SCN9A; (-) strand; PAM type: NRG; PAM sequence: AAG
cccatacgtattttagtgat

SEQ ID NO: 29180 - DNA, 20 bp, Artificial Sequence
  Description of Artificial Sequence: Synthetic oligonucleotide
  Target: SCN9A; (-) strand; PAM type: NRG; PAM sequence: TAG
cattttccccatacgtattt

SEQ ID NO: 29181 - DNA, 20 bp, Artificial Sequence
  Description of Artificial Sequence: Synthetic oligonucleotide
  Target: SCN9A; (-) strand; PAM type: NRG; PAM sequence: TAG
acttcacccagaatcttcat

SEQ ID NO: 29182 - DNA, 20 bp, Artificial Sequence
  Description of Artificial Sequence: Synthetic oligonucleotide
  Target: SCN9A; (-) strand; PAM type: NRG; PAM sequence: CAG
attaatttaaaaacttcacc

SEQ ID NO: 29183 - DNA, 20 bp, Artificial Sequence
  Description of Artificial Sequence: Synthetic oligonucleotide
  Target: SCN9A; (-) strand; PAM type: NRG; PAM sequence: CAG
gttgtctttctgagcaaggg

SEQ ID NO: 29184 - DNA, 20 bp, Artificial Sequence
  Description of Artificial Sequence: Synthetic oligonucleotide
  Target: SCN9A; (-) strand; PAM type: NRG; PAM sequence: GGG
taagttgtctttctgagcaa

SEQ ID NO: 29185 - DNA, 20 bp, Artificial Sequence
  Description of Artificial Sequence: Synthetic oligonucleotide
  Target: SCN9A; (-) strand; PAM type: NRG; PAM sequence: AGG
ataagttgtctttctgagca

SEQ ID NO: 29186 - DNA, 20 bp, Artificial Sequence
  Description of Artificial Sequence: Synthetic oligonucleotide
  Target: SCN9A; (-) strand; PAM type: NRG; PAM sequence: AAG
cataagttgtctttctgagc

SEQ ID NO: 29187 - DNA, 20 bp, Artificial Sequence
  Description of Artificial Sequence: Synthetic oligonucleotide
  Target: SCN9A; (-) strand; PAM type: NRG; PAM sequence: GAG
ttgtcataagttgtctttct

SEQ ID NO: 29188 - DNA, 20 bp, Artificial Sequence
  Description of Artificial Sequence: Synthetic oligonucleotide
  Target: SCN9A; (-) strand; PAM type: NRG; PAM sequence: AAG
aagccatacacaattgtcat

SEQ ID NO: 29189 - DNA, 20 bp, Artificial Sequence
  Description of Artificial Sequence: Synthetic oligonucleotide
  Target: SCN9A; (-) strand; PAM type: NRG; PAM sequence: AAG
ctcttcacttccataggccc

SEQ ID NO: 29190 - DNA, 20 bp, Artificial Sequence
  Description of Artificial Sequence: Synthetic oligonucleotide
  Target: SCN9A; (-) strand; PAM type: NRG; PAM sequence: AGG
gatatactcttcacttccat

SEQ ID NO: 29191 - DNA, 20 bp, Artificial Sequence
  Description of Artificial Sequence: Synthetic oligonucleotide
  Target: SCN9A; (-) strand; PAM type: NRG; PAM sequence: TAG
ggatatactcttcacttcca

SEQ ID NO: 29192 - DNA, 20 bp, Artificial Sequence
  Description of Artificial Sequence: Synthetic oligonucleotide
  Target: SCN9A; (-) strand; PAM type: NRG; PAM sequence: GGG
gcattatttgcccttcgttg

SEQ ID NO: 29193 - DNA, 20 bp, Artificial Sequence
  Description of Artificial Sequence: Synthetic oligonucleotide
  Target: SCN9A; (-) strand; PAM type: NRG; PAM sequence: GGG
tgcattatttgcccttcgtt

SEQ ID NO: 29194 - DNA, 20 bp, Artificial Sequence
  Description of Artificial Sequence: Synthetic oligonucleotide
  Target: SCN9A; (-) strand; PAM type: NRG; PAM sequence: TGG
ttgcattatttgcccttcgt

SEQ ID NO: 29195 - DNA, 20 bp, Artificial Sequence
  Description of Artificial Sequence: Synthetic oligonucleotide
  Target: SCN9A; (-) strand; PAM type: NRG; PAM sequence: GAG
cccctgcactagttttctca

SEQ ID NO: 29196 - DNA, 20 bp, Artificial Sequence
  Description of Artificial Sequence: Synthetic oligonucleotide
  Target: SCN9A; (-) strand; PAM type: NRG; PAM sequence: CAG
atcccctgcactagttttct

SEQ ID NO: 29197 - DNA, 20 bp, Artificial Sequence
  Description of Artificial Sequence: Synthetic oligonucleotide
  Target: SCN9A; (-) strand; PAM type: NRG; PAM sequence: TAG
ccagtcctgatcccctgcac

SEQ ID NO: 29198 - DNA, 20 bp, Artificial Sequence
  Description of Artificial Sequence: Synthetic oligonucleotide
  Target: SCN9A; (-) strand; PAM type: NRG; PAM sequence: CAG
tcatgtgcaggccctctgcc

SEQ ID NO: 29199 - DNA, 20 bp, Artificial Sequence
  Description of Artificial Sequence: Synthetic oligonucleotide
  Target: SCN9A; (-) strand; PAM type: NRG; PAM sequence: AGG
gagtgtagagtatcatgtgc

SEQ ID NO: 29200 - DNA, 20 bp, Artificial Sequence
  Description of Artificial Sequence: Synthetic oligonucleotide
  Target: SCN9A; (-) strand; PAM type: NRG; PAM sequence: CAG
agagtgtagagtatcatgtg

SEQ ID NO: 29201 - DNA, 20 bp, Artificial Sequence
  Description of Artificial Sequence: Synthetic oligonucleotide
  Target: SCN9A; (-) strand; PAM type: NRG; PAM sequence: GAG
actacatttgccagagtgta

SEQ ID NO: 29202 - DNA, 20 bp, Artificial Sequence
  Description of Artificial Sequence: Synthetic oligonucleotide
  Target: SCN9A; (-) strand; PAM type: NRG; PAM sequence: TAG
gaactacatttgccagagtg

SEQ ID NO: 29203 - DNA, 20 bp, Artificial Sequence
  Description of Artificial Sequence: Synthetic oligonucleotide
  Target: SCN9A; (-) strand; PAM type: NRG; PAM sequence: GAG
tgtgagaactacatttgcca

SEQ ID NO: 29204 - DNA, 20 bp, Artificial Sequence
  Description of Artificial Sequence: Synthetic oligonucleotide
  Target: SCN9A; (-) strand; PAM type: NRG; PAM sequence: CAG
cttgtgagaactacatttgc

SEQ ID NO: 29205 - DNA, 20 bp, Artificial Sequence
  Description of Artificial Sequence: Synthetic oligonucleotide
  Target: SCN9A; (-) strand; PAM type: NRG; PAM sequence: GAG
atctacagctgttttcttgt

SEQ ID NO: 29206 - DNA, 20 bp, Artificial Sequence
  Description of Artificial Sequence: Synthetic oligonucleotide
  Target: SCN9A; (-) strand; PAM type: NRG; PAM sequence: CAG
tttcctatctccttcatcta

SEQ ID NO: 29207 - DNA, 20 bp, Artificial Sequence
  Description of Artificial Sequence: Synthetic oligonucleotide
  Target: SCN9A; (-) strand; PAM type: NRG; PAM sequence: AGG
tattggccttcactactaac

SEQ ID NO: 29208 - DNA, 20 bp, Artificial Sequence
  Description of Artificial Sequence: Synthetic oligonucleotide
  Target: SCN9A; (-) strand; PAM type: NRG; PAM sequence: CAG
atattggccttcactactaa

SEQ ID NO: 29209 - DNA, 20 bp, Artificial Sequence
  Description of Artificial Sequence: Synthetic oligonucleotide
  Target: SCN9A; (-) strand; PAM type: NRG; PAM sequence: TGG
ttttgaaaaaaccgcaatat

SEQ ID NO: 29210 - DNA, 20 bp, Artificial Sequence
  Description of Artificial Sequence: Synthetic oligonucleotide
  Target: SCN9A; (-) strand; PAM type: NRG; PAM sequence: AAG
tatttgacatttaatagaga

SEQ ID NO: 29211 - DNA, 20 bp, Artificial Sequence
  Description of Artificial Sequence: Synthetic oligonucleotide
  Target: SCN9A; (-) strand; PAM type: NRG; PAM sequence: GAG
ctaatatttgacatttaata

SEQ ID NO: 29212 - DNA, 20 bp, Artificial Sequence
  Description of Artificial Sequence: Synthetic oligonucleotide
  Target: SCN9A; (-) strand; PAM type: NRG; PAM sequence: TAG
ttctaatatttgacatttaa

SEQ ID NO: 29213 - DNA, 20 bp, Artificial Sequence
  Description of Artificial Sequence: Synthetic oligonucleotide
  Target: SCN9A; (-) strand; PAM type: NRG; PAM sequence: AGG
tggttatattgggctaaaac

SEQ ID NO: 29214 - DNA, 20 bp, Artificial Sequence
  Description of Artificial Sequence: Synthetic oligonucleotide
  Target: SCN9A; (-) strand; PAM type: NRG; PAM sequence: CAG
gtggttatattgggctaaaa

SEQ ID NO: 29215 - DNA, 20 bp, Artificial Sequence
  Description of Artificial Sequence: Synthetic oligonucleotide
  Target: SCN9A; (-) strand; PAM type: NRG; PAM sequence: GGG
aaatatactgtggttatatt

SEQ ID NO: 29216 - DNA, 20 bp, Artificial Sequence
  Description of Artificial Sequence: Synthetic oligonucleotide
  Target: SCN9A; (-) strand; PAM type: NRG; PAM sequence: TGG
gaaatatactgtggttatat

SEQ ID NO: 29217 - DNA, 20 bp, Artificial Sequence
  Description of Artificial Sequence: Synthetic oligonucleotide
  Target: SCN9A; (-) strand; PAM type: NRG; PAM sequence: TGG
tattatggagaaatatactg

SEQ ID NO: 29218 - DNA, 20 bp, Artificial Sequence
  Description of Artificial Sequence: Synthetic oligonucleotide
  Target: SCN9A; (-) strand; PAM type: NRG; PAM sequence: GAG
gctaaatgtgcagtattatg

SEQ ID NO: 29219 - DNA, 20 bp, Artificial Sequence
  Description of Artificial Sequence: Synthetic oligonucleotide
  Target: SCN9A; (-) strand; PAM type: NRG; PAM sequence: TGG
tagctaaatgtgcagtatta

SEQ ID NO: 29220 - DNA, 20 bp, Artificial Sequence
  Description of Artificial Sequence: Synthetic oligonucleotide
  Target: SCN9A; (-) strand; PAM type: NRG; PAM sequence: CAG
acagtgtgtagctaaatgtg

SEQ ID NO: 29221 - DNA, 20 bp, Artificial Sequence
  Description of Artificial Sequence: Synthetic oligonucleotide
  Target: SCN9A; (-) strand; PAM type: NRG; PAM sequence: TAG
gggttcatgtgcacagtgtg

SEQ ID NO: 29222 - DNA, 20 bp, Artificial Sequence
  Description of Artificial Sequence: Synthetic oligonucleotide
  Target: SCN9A; (-) strand; PAM type: NRG; PAM sequence: CAG
gaaagtggggttcatgtgca

SEQ ID NO: 29223 - DNA, 20 bp, Artificial Sequence
  Description of Artificial Sequence: Synthetic oligonucleotide
  Target: SCN9A; (-) strand; PAM type: NRG; PAM sequence: GGG
tgctgctacagatgaaagtg

SEQ ID NO: 29224 - DNA, 20 bp, Artificial Sequence
  Description of Artificial Sequence: Synthetic oligonucleotide
  Target: SCN9A; (-) strand; PAM type: NRG; PAM sequence: GGG
atgctgctacagatgaaagt

SEQ ID NO: 29225 - DNA, 20 bp, Artificial Sequence
  Description of Artificial Sequence: Synthetic oligonucleotide
  Target: SCN9A; (-) strand; PAM type: NRG; PAM sequence: TGG
tatgctgctacagatgaaag

SEQ ID NO: 29226 - DNA, 20 bp, Artificial Sequence
  Description of Artificial Sequence: Synthetic oligonucleotide
  Target: SCN9A; (-) strand; PAM type: NRG; PAM sequence: AAG
ttttatgctgctacagatga

SEQ ID NO: 29227 - DNA, 20 bp, Artificial Sequence
  Description of Artificial Sequence: Synthetic oligonucleotide
  Target: SCN9A; (-) strand; PAM type: NRG; PAM sequence: CAG
aacacttttttatgctgcta

SEQ ID NO: 29228 - DNA, 20 bp, Artificial Sequence
  Description of Artificial Sequence: Synthetic oligonucleotide
  Target: SCN9A; (-) strand; PAM type: NRG; PAM sequence: TGG
tacaatttgtagatttcctt

SEQ ID NO: 29229 - DNA, 20 bp, Artificial Sequence
  Description of Artificial Sequence: Synthetic oligonucleotide
  Target: SCN9A; (-) strand; PAM type: NRG; PAM sequence: TAG
gctgaaaaacatacaatttg

SEQ ID NO: 29230 - DNA, 20 bp, Artificial Sequence
  Description of Artificial Sequence: Synthetic oligonucleotide
  Target: SCN9A; (-) strand; PAM type: NRG; PAM sequence: AAG
attttctggtgcctatagca

SEQ ID NO: 29231 - DNA, 20 bp, Artificial Sequence
  Description of Artificial Sequence: Synthetic oligonucleotide
  Target: SCN9A; (-) strand; PAM type: NRG; PAM sequence: TAG
aaagcattttctggtgccta

SEQ ID NO: 29232 - DNA, 20 bp, Artificial Sequence
  Description of Artificial Sequence: Synthetic oligonucleotide
  Target: SCN9A; (-) strand; PAM type: NRG; PAM sequence: TGG
cataatctaaaagcattttc

SEQ ID NO: 29233 - DNA, 20 bp, Artificial Sequence
  Description of Artificial Sequence: Synthetic oligonucleotide
  Target: SCN9A; (-) strand; PAM type: NRG; PAM sequence: AAG
agaacctgagcataatctaa

SEQ ID NO: 29234 - DNA, 20 bp, Artificial Sequence
  Description of Artificial Sequence: Synthetic oligonucleotide
  Target: SCN9A; (-) strand; PAM type: NRG; PAM sequence: GAG
gcaatctacacagagaacct

SEQ ID NO: 29235 - DNA, 20 bp, Artificial Sequence
  Description of Artificial Sequence: Synthetic oligonucleotide
  Target: SCN9A; (-) strand; PAM type: NRG; PAM sequence: GAG
tggtaaaggcaatctacaca

SEQ ID NO: 29236 - DNA, 20 bp, Artificial Sequence
  Description of Artificial Sequence: Synthetic oligonucleotide
  Target: SCN9A; (-) strand; PAM type: NRG; PAM sequence: CAG
aatggtaaaggcaatctaca

SEQ ID NO: 29237 - DNA, 20 bp, Artificial Sequence
  Description of Artificial Sequence: Synthetic oligonucleotide
  Target: SCN9A; (-) strand; PAM type: NRG; PAM sequence: AGG
tcaaggaattataatggtaa

SEQ ID NO: 29238 - DNA, 20 bp, Artificial Sequence
  Description of Artificial Sequence: Synthetic oligonucleotide
  Target: SCN9A; (-) strand; PAM type: NRG; PAM sequence: AAG
atcaaggaattataatggta

SEQ ID NO: 29239 - DNA, 20 bp, Artificial Sequence
  Description of Artificial Sequence: Synthetic oligonucleotide
  Target: SCN9A; (-) strand; PAM type: NRG; PAM sequence: TGG
aaaagatcaaggaattataa

SEQ ID NO: 29240 - DNA, 20 bp, Artificial Sequence
  Description of Artificial Sequence: Synthetic oligonucleotide
  Target: SCN9A; (-) strand; PAM type: NRG; PAM sequence: AGG
tggcaatatttaaaagatca

SEQ ID NO: 29241 - DNA, 20 bp, Artificial Sequence
  Description of Artificial Sequence: Synthetic oligonucleotide
  Target: SCN9A; (-) strand; PAM type: NRG; PAM sequence: AAG
ttggcaatatttaaaagatc

SEQ ID NO: 29242 - DNA, 20 bp, Artificial Sequence
  Description of Artificial Sequence: Synthetic oligonucleotide
  Target: SCN9A; (-) strand; PAM type: NRG; PAM sequence: AAG
aatgaattggcaatatttaa

SEQ ID NO: 29243 - DNA, 20 bp, Artificial Sequence
  Description of Artificial Sequence: Synthetic oligonucleotide
  Target: SCN9A; (-) strand; PAM type: NRG; PAM sequence: TGG
aagtgctaaggcaaatgaat

SEQ ID NO: 29244 - DNA, 20 bp, Artificial Sequence
  Description of Artificial Sequence: Synthetic oligonucleotide
  Target: SCN9A; (-) strand; PAM type: NRG; PAM sequence: AGG
tagatcatgagaaagtgcta

SEQ ID NO: 29245 - DNA, 20 bp, Artificial Sequence
  Description of Artificial Sequence: Synthetic oligonucleotide
  Target: SCN9A; (-) strand; PAM type: NRG; PAM sequence: AAG
atagatcatgagaaagtgct

SEQ ID NO: 29246 - DNA, 20 bp, Artificial Sequence
  Description of Artificial Sequence: Synthetic oligonucleotide
  Target: SCN9A; (-) strand; PAM type: NRG; PAM sequence: AAG
ttggttgatagatcatgaga

SEQ ID NO: 29247 - DNA, 20 bp, Artificial Sequence
  Description of Artificial Sequence: Synthetic oligonucleotide
  Target: SCN9A; (-) strand; PAM type: NRG; PAM sequence: GAG
gaacttggttgatagatcat

SEQ ID NO: 29248 - DNA, 20 bp, Artificial Sequence
  Description of Artificial Sequence: Synthetic oligonucleotide
  Target: SCN9A; (-) strand; PAM type: NRG; PAM sequence: TAG
agtgacaagaacttggttga

SEQ ID NO: 29249 - DNA, 20 bp, Artificial Sequence
  Description of Artificial Sequence: Synthetic oligonucleotide
  Target: SCN9A; (-) strand; PAM type: NRG; PAM sequence: TGG
tacaaagagtgacaagaact

SEQ ID NO: 29250 - DNA, 20 bp, Artificial Sequence
  Description of Artificial Sequence: Synthetic oligonucleotide
  Target: SCN9A; (-) strand; PAM type: NRG; PAM sequence: AAG
taagctgtacaaagagtgac

SEQ ID NO: 29251 - DNA, 20 bp, Artificial Sequence
  Description of Artificial Sequence: Synthetic oligonucleotide
  Target: SCN9A; (-) strand; PAM type: NRG; PAM sequence: GAG
atggatttaagctgtacaaa

SEQ ID NO: 29252 - DNA, 20 bp, Artificial Sequence
  Description of Artificial Sequence: Synthetic oligonucleotide
  Target: SCN9A; (-) strand; PAM type: NRG; PAM sequence: AAG
ccatggatttaagctgtaca

SEQ ID NO: 29253 - DNA, 20 bp, Artificial Sequence
  Description of Artificial Sequence: Synthetic oligonucleotide
  Target: SCN9A; (-) strand; PAM type: NRG; PAM sequence: AAG
taatgaatgcccatggattt

SEQ ID NO: 29254 - DNA, 20 bp, Artificial Sequence
  Description of Artificial Sequence: Synthetic oligonucleotide
  Target: SCN9A; (-) strand; PAM type: NRG; PAM sequence: TGG
ctgatgataatgaatgccca

SEQ ID NO: 29255 - DNA, 20 bp, Artificial Sequence
  Description of Artificial Sequence: Synthetic oligonucleotide
  Target: SCN9A; (-) strand; PAM type: NRG; PAM sequence: AGG
gactgtggttctgccaggtt

SEQ ID NO: 29256 - DNA, 20 bp, Artificial Sequence
  Description of Artificial Sequence: Synthetic oligonucleotide
  Target: SCN9A; (-) strand; PAM type: NRG; PAM sequence: TAG
agactgtggttctgccaggt

SEQ ID NO: 29257 - DNA, 20 bp, Artificial Sequence
  Description of Artificial Sequence: Synthetic oligonucleotide
  Target: SCN9A; (-) strand; PAM type: NRG; PAM sequence: AGG
gtgtagactgtggttctgcc

SEQ ID NO: 29258 - DNA, 20 bp, Artificial Sequence
  Description of Artificial Sequence: Synthetic oligonucleotide
  Target: SCN9A; (-) strand; PAM type: NRG; PAM sequence: CAG
tgtgtagactgtggttctgc

SEQ ID NO: 29259 - DNA, 20 bp, Artificial Sequence
  Description of Artificial Sequence: Synthetic oligonucleotide
  Target: SCN9A; (-) strand; PAM type: NRG; PAM sequence: TGG
gccagattatgtgtagactg

SEQ ID NO: 29260 - DNA, 20 bp, Artificial Sequence
  Description of Artificial Sequence: Synthetic oligonucleotide
  Target: SCN9A; (-) strand; PAM type: NRG; PAM sequence: TAG
gacagatgccagattatgtg

SEQ ID NO: 29261 - DNA, 20 bp, Artificial Sequence
  Description of Artificial Sequence: Synthetic oligonucleotide
  Target: SCN9A; (-) strand; PAM type: NRG; PAM sequence: CAG
agcatggaaaagacagatgc

SEQ ID NO: 29262 - DNA, 20 bp, Artificial Sequence
  Description of Artificial Sequence: Synthetic oligonucleotide
  Target: SCN9A; (-) strand; PAM type: NRG; PAM sequence: CAG
ggtagccagcatggaaaaga

SEQ ID NO: 29263 - DNA, 20 bp, Artificial Sequence
  Description of Artificial Sequence: Synthetic oligonucleotide
  Target: SCN9A; (-) strand; PAM type: NRG; PAM sequence: AAG
atttggtagccagcatggaa

SEQ ID NO: 29264 - DNA, 20 bp, Artificial Sequence
  Description of Artificial Sequence: Synthetic oligonucleotide
  Target: SCN9A; (-) strand; PAM type: NRG; PAM sequence: TGG
cagccatttggtagccagca

SEQ ID NO: 29265 - DNA, 20 bp, Artificial Sequence
  Description of Artificial Sequence: Synthetic oligonucleotide
  Target: SCN9A; (-) strand; PAM type: NRG; PAM sequence: CAG
acattcagccatttggtagc

SEQ ID NO: 29266 - DNA, 20 bp, Artificial Sequence
  Description of Artificial Sequence: Synthetic oligonucleotide
  Target: SCN9A; (-) strand; PAM type: NRG; PAM sequence: TAG
accaacattcagccatttgg

SEQ ID NO: 29267 - DNA, 20 bp, Artificial Sequence
  Description of Artificial Sequence: Synthetic oligonucleotide
  Target: SCN9A; (-) strand; PAM type: NRG; PAM sequence: TGG
tccaccaacattcagccatt

SEQ ID NO: 29268 - DNA, 20 bp, Artificial Sequence
  Description of Artificial Sequence: Synthetic oligonucleotide
  Target: SCN9A; (-) strand; PAM type: NRG; PAM sequence: CAG
agagtttctccaccaacatt

SEQ ID NO: 29269 - DNA, 20 bp, Artificial Sequence
  Description of Artificial Sequence: Synthetic oligonucleotide
  Target: SCN9A; (-) strand; PAM type: NRG; PAM sequence: GAG
aaccattcacttggttgtga

SEQ ID NO: 29270 - DNA, 20 bp, Artificial Sequence
  Description of Artificial Sequence: Synthetic oligonucleotide
  Target: SCN9A; (-) strand; PAM type: NRG; PAM sequence: GAG
ataaccattcacttggttgt

SEQ ID NO: 29271 - DNA, 20 bp, Artificial Sequence
  Description of Artificial Sequence: Synthetic oligonucleotide
  Target: SCN9A; (-) strand; PAM type: NRG; PAM sequence: TGG
ttaaaatataaccattcact

SEQ ID NO: 29272 - DNA, 20 bp, Artificial Sequence
  Description of Artificial Sequence: Synthetic oligonucleotide
  Target: SCN9A; (-) strand; PAM type: NRG; PAM sequence: GAG
tgagtgcaaatttgatgttg

SEQ ID NO: 29273 - DNA, 20 bp, Artificial Sequence
  Description of Artificial Sequence: Synthetic oligonucleotide
  Target: SCN9A; (-) strand; PAM type: NRG; PAM sequence: TGG
tttgagtgcaaatttgatgt

SEQ ID NO: 29274 - DNA, 20 bp, Artificial Sequence
  Description of Artificial Sequence: Synthetic oligonucleotide
  Target: SCN9A; (-) strand; PAM type: NRG; PAM sequence: GAG
tgagaaatttagtgtatttt

SEQ ID NO: 29275 - DNA, 20 bp, Artificial Sequence
  Description of Artificial Sequence: Synthetic oligonucleotide
  Target: SCN9A; (-) strand; PAM type: NRG; PAM sequence: TAG
atatcagggcatgagaaatt

SEQ ID NO: 29276 - DNA, 20 bp, Artificial Sequence
  Description of Artificial Sequence: Synthetic oligonucleotide
  Target: SCN9A; (-) strand; PAM type: NRG; PAM sequence: GAG
atatggtcatatcagggcat

SEQ ID NO: 29277 - DNA, 20 bp, Artificial Sequence
  Description of Artificial Sequence: Synthetic oligonucleotide
  Target: SCN9A; (-) strand; PAM type: NRG; PAM sequence: GGG
ttatatatatggtcatatca

SEQ ID NO: 29278 - DNA, 20 bp, Artificial Sequence
  Description of Artificial Sequence: Synthetic oligonucleotide
  Target: SCN9A; (-) strand; PAM type: NRG; PAM sequence: AGG
attatatatatggtcatatc

SEQ ID NO: 29279 - DNA, 20 bp, Artificial Sequence
  Description of Artificial Sequence: Synthetic oligonucleotide
  Target: SCN9A; (-) strand; PAM type: NRG; PAM sequence: CAG
cattatatatatggtcatat

SEQ ID NO: 29280 - DNA, 20 bp, Artificial Sequence
  Description of Artificial Sequence: Synthetic oligonucleotide
  Target: SCN9A; (-) strand; PAM type: NRG; PAM sequence: TGG
atgagaatgcattatatata

SEQ ID NO: 29281 - DNA, 20 bp, Artificial Sequence
  Description of Artificial Sequence: Synthetic oligonucleotide
  Target: SCN9A; (-) strand; PAM type: NRG; PAM sequence: GAG
aattctacagatgatttgat

SEQ ID NO: 29282 - DNA, 20 bp, Artificial Sequence
  Description of Artificial Sequence: Synthetic oligonucleotide
  Target: SCN9A; (-) strand; PAM type: NRG; PAM sequence: CAG
atgaggaagagaaaattcta

SEQ ID NO: 29283 - DNA, 20 bp, Artificial Sequence
  Description of Artificial Sequence: Synthetic oligonucleotide
  Target: SCN9A; (-) strand; PAM type: NRG; PAM sequence: GAG
ctgagagtgcaaatgaggaa

SEQ ID NO: 29284 - DNA, 20 bp, Artificial Sequence
  Description of Artificial Sequence: Synthetic oligonucleotide
  Target: SCN9A; (-) strand; PAM type: NRG; PAM sequence: AAG
gcctgagagtgcaaatgagg

SEQ ID NO: 29285 - DNA, 20 bp, Artificial Sequence
  Description of Artificial Sequence: Synthetic oligonucleotide
  Target: SCN9A; (-) strand; PAM type: NRG; PAM sequence: AGG
attgcctgagagtgcaaatg

SEQ ID NO: 29286 - DNA, 20 bp, Artificial Sequence
  Description of Artificial Sequence: Synthetic oligonucleotide
  Target: SCN9A; (-) strand; PAM type: NRG; PAM sequence: GAG
cattgcctgagagtgcaaat

SEQ ID NO: 29287 - DNA, 20 bp, Artificial Sequence
  Description of Artificial Sequence: Synthetic oligonucleotide
  Target: SCN9A; (-) strand; PAM type: NRG; PAM sequence: GAG
aagatgggatcattgcctga

SEQ ID NO: 29288 - DNA, 20 bp, Artificial Sequence
  Description of Artificial Sequence: Synthetic oligonucleotide
  Target: SCN9A; (-) strand; PAM type: NRG; PAM sequence: GAG
ataagatgggatcattgcct

SEQ ID NO: 29289 - DNA, 20 bp, Artificial Sequence
  Description of Artificial Sequence: Synthetic oligonucleotide
  Target: SCN9A; (-) strand; PAM type: NRG; PAM sequence: GGG
atttcctcaaagtataagat

SEQ ID NO: 29290 - DNA, 20 bp, Artificial Sequence
  Description of Artificial Sequence: Synthetic oligonucleotide
  Target: SCN9A; (-) strand; PAM type: NRG; PAM sequence: TGG
tatttcctcaaagtataaga

SEQ ID NO: 29291 - DNA, 20 bp, Artificial Sequence
  Description of Artificial Sequence: Synthetic oligonucleotide
  Target: SCN9A; (-) strand; PAM type: NRG; PAM sequence: AAG
tttttatttcctcaaagtat

SEQ ID NO: 29292 - DNA, 20 bp, Artificial Sequence
  Description of Artificial Sequence: Synthetic oligonucleotide
  Target: SCN9A; (-) strand; PAM type: NRG; PAM sequence: AAG
caatggtttttatttcctca

SEQ ID NO: 29293 - DNA, 20 bp, Artificial Sequence
  Description of Artificial Sequence: Synthetic oligonucleotide
  Target: SCN9A; (-) strand; PAM type: NRG; PAM sequence: TGG
atgattgagttcaaacccaa

SEQ ID NO: 29294 - DNA, 20 bp, Artificial Sequence
  Description of Artificial Sequence: Synthetic oligonucleotide
  Target: SCN9A; (-) strand; PAM type: NRG; PAM sequence: GAG
agagttatcaaaagatgatt

SEQ ID NO: 29295 - DNA, 20 bp, Artificial Sequence
  Description of Artificial Sequence: Synthetic oligonucleotide
  Target: SCN9A; (-) strand; PAM type: NRG; PAM sequence: AAG
gaagactgcagagttatcaa

SEQ ID NO: 29296 - DNA, 20 bp, Artificial Sequence
  Description of Artificial Sequence: Synthetic oligonucleotide
  Target: SCN9A; (-) strand; PAM type: NRG; PAM sequence: GAG
agatagaagagaagactgca

SEQ ID NO: 29297 - DNA, 20 bp, Artificial Sequence
  Description of Artificial Sequence: Synthetic oligonucleotide
  Target: SCN9A; (-) strand; PAM type: NRG; PAM sequence: CAG
aaagatagaagagaagactg

SEQ ID NO: 29298 - DNA, 20 bp, Artificial Sequence
  Description of Artificial Sequence: Synthetic oligonucleotide
  Target: SCN9A; (-) strand; PAM type: NRG; PAM sequence: AAG
caggaggaaagatagaagag

SEQ ID NO: 29299 - DNA, 20 bp, Artificial Sequence
  Description of Artificial Sequence: Synthetic oligonucleotide
  Target: SCN9A; (-) strand; PAM type: NRG; PAM sequence: GAG
aaacaggaggaaagatagaa

SEQ ID NO: 29300 - DNA, 20 bp, Artificial Sequence
  Description of Artificial Sequence: Synthetic oligonucleotide
  Target: SCN9A; (-) strand; PAM type: NRG; PAM sequence: AAG
cgaaacaggaggaaagatag

SEQ ID NO: 29301 - DNA, 20 bp, Artificial Sequence
  Description of Artificial Sequence: Synthetic oligonucleotide
  Target: SCN9A; (-) strand; PAM type: NRG; PAM sequence: TAG
caccgaaacaggaggaaaga

SEQ ID NO: 29302 - DNA, 20 bp, Artificial Sequence
  Description of Artificial Sequence: Synthetic oligonucleotide
  Target: SCN9A; (-) strand; PAM type: NRG; PAM sequence: AAG
gctccaccgaaacaggagga

SEQ ID NO: 29303 - DNA, 20 bp, Artificial Sequence
  Description of Artificial Sequence: Synthetic oligonucleotide
  Target: SCN9A; (-) strand; PAM type: NRG; PAM sequence: AGG
gacagctccaccgaaacagg

SEQ ID NO: 29304 - DNA, 20 bp, Artificial Sequence
  Description of Artificial Sequence: Synthetic oligonucleotide
  Target: SCN9A; (-) strand; PAM type: NRG; PAM sequence: GAG
cgacagctccaccgaaacag

SEQ ID NO: 29305 - DNA, 20 bp, Artificial Sequence
  Description of Artificial Sequence: Synthetic oligonucleotide
  Target: SCN9A; (-) strand; PAM type: NRG; PAM sequence: AGG
agcgacagctccaccgaaac

SEQ ID NO: 29306 - DNA, 20 bp, Artificial Sequence
  Description of Artificial Sequence: Synthetic oligonucleotide
  Target: SCN9A; (-) strand; PAM type: NRG; PAM sequence: CAG
gagcgacagctccaccgaaa

SEQ ID NO: 29307 - DNA, 20 bp, Artificial Sequence
  Description of Artificial Sequence: Synthetic oligonucleotide
  Target: SCN9A; (-) strand; PAM type: NRG; PAM sequence: CAG
gaaagagtaaaggggagcga

SEQ ID NO: 29308 - DNA, 20 bp, Artificial Sequence
  Description of Artificial Sequence: Synthetic oligonucleotide
  Target: SCN9A; (-) strand; PAM type: NRG; PAM sequence: GAG
gaaagtgaaagagtaaaggg

SEQ ID NO: 29309 - DNA, 20 bp, Artificial Sequence
  Description of Artificial Sequence: Synthetic oligonucleotide
  Target: SCN9A; (-) strand; PAM type: NRG; PAM sequence: GGG
gtgaaagtgaaagagtaaag

SEQ ID NO: 29310 - DNA, 20 bp, Artificial Sequence
  Description of Artificial Sequence: Synthetic oligonucleotide
  Target: SCN9A; (-) strand; PAM type: NRG; PAM sequence: GGG
cgtgaaagtgaaagagtaaa

SEQ ID NO: 29311 - DNA, 20 bp, Artificial Sequence
  Description of Artificial Sequence: Synthetic oligonucleotide
  Target: SCN9A; (-) strand; PAM type: NRG; PAM sequence: AGG
tcgtgaaagtgaaagagtaa

SEQ ID NO: 29312 - DNA, 20 bp, Artificial Sequence
  Description of Artificial Sequence: Synthetic oligonucleotide
  Target: SCN9A; (-) strand; PAM type: NRG; PAM sequence: AAG
ctcgtgaaagtgaaagagta

SEQ ID NO: 29313 - DNA, 20 bp, Artificial Sequence
  Description of Artificial Sequence: Synthetic oligonucleotide
  Target: SCN9A; (-) strand; PAM type: NRG; PAM sequence: GAG
aagtcctcgtgaaagtgaaa

SEQ ID NO: 29314 - DNA, 20 bp, Artificial Sequence
  Description of Artificial Sequence: Synthetic oligonucleotide
  Target: SCN9A; (-) strand; PAM type: NRG; PAM sequence: AAG
tcaagtcctcgtgaaagtga

SEQ ID NO: 29315 - DNA, 20 bp, Artificial Sequence
  Description of Artificial Sequence: Synthetic oligonucleotide
  Target: SCN9A; (-) strand; PAM type: NRG; PAM sequence: AAG
gagaagtcaagtcctcgtga

SEQ ID NO: 29316 - DNA, 20 bp, Artificial Sequence
  Description of Artificial Sequence: Synthetic oligonucleotide
  Target: SCN9A; (-) strand; PAM type: NRG; PAM sequence: AAG
aggagagagagggagaagtc

SEQ ID NO: 29317 - DNA, 20 bp, Artificial Sequence
  Description of Artificial Sequence: Synthetic oligonucleotide
  Target: SCN9A; (-) strand; PAM type: NRG; PAM sequence: AAG
aattcaggagagagagggag

SEQ ID NO: 29318 - DNA, 20 bp, Artificial Sequence
  Description of Artificial Sequence: Synthetic oligonucleotide
  Target: SCN9A; (-) strand; PAM type: NRG; PAM sequence: GAG
atcaattcaggagagagagg

SEQ ID NO: 29319 - DNA, 20 bp, Artificial Sequence
  Description of Artificial Sequence: Synthetic oligonucleotide
  Target: SCN9A; (-) strand; PAM type: NRG; PAM sequence: GGG
gaatcaattcaggagagaga

SEQ ID NO: 29320 - DNA, 20 bp, Artificial Sequence
  Description of Artificial Sequence: Synthetic oligonucleotide
  Target: SCN9A; (-) strand; PAM type: NRG; PAM sequence: AGG
tgaatcaattcaggagagag

SEQ ID NO: 29321 - DNA, 20 bp, Artificial Sequence
  Description of Artificial Sequence: Synthetic oligonucleotide
  Target: SCN9A; (-) strand; PAM type: NRG; PAM sequence: GAG
atgaatcaattcaggagaga

SEQ ID NO: 29322 - DNA, 20 bp, Artificial Sequence
  Description of Artificial Sequence: Synthetic oligonucleotide
  Target: SCN9A; (-) strand; PAM type: NRG; PAM sequence: GAG
atatgaatcaattcaggaga

SEQ ID NO: 29323 - DNA, 20 bp, Artificial Sequence
  Description of Artificial Sequence: Synthetic oligonucleotide
  Target: SCN9A; (-) strand; PAM type: NRG; PAM sequence: GAG
atatatgaatcaattcagga

SEQ ID NO: 29324 - DNA, 20 bp, Artificial Sequence
  Description of Artificial Sequence: Synthetic oligonucleotide
  Target: SCN9A; (-) strand; PAM type: NRG; PAM sequence: GAG
ttatatatgaatcaattcag

SEQ ID NO: 29325 - DNA, 20 bp, Artificial Sequence
  Description of Artificial Sequence: Synthetic oligonucleotide
  Target: SCN9A; (-) strand; PAM type: NRG; PAM sequence: AGG
agttatatatgaatcaattc

SEQ ID NO: 29326 - DNA, 20 bp, Artificial Sequence
  Description of Artificial Sequence: Synthetic oligonucleotide
  Target: SCN9A; (-) strand; PAM type: NRG; PAM sequence: CAG
tagttatatatgaatcaatt

SEQ ID NO: 29327 - DNA, 20 bp, Artificial Sequence
  Description of Artificial Sequence: Synthetic oligonucleotide
  Target: SCN9A; (-) strand; PAM type: NRG; PAM sequence: TAG
tgctagtgataatgaatgag

SEQ ID NO: 29328 - DNA, 20 bp, Artificial Sequence
  Description of Artificial Sequence: Synthetic oligonucleotide
  Target: SCN9A; (-) strand; PAM type: NRG; PAM sequence: GAG
ttttgctagtgataatgaat

SEQ ID NO: 29329 - DNA, 20 bp, Artificial Sequence
  Description of Artificial Sequence: Synthetic oligonucleotide
  Target: SCN9A; (-) strand; PAM type: NRG; PAM sequence: TAG
tttttgtatggatgttttgc

SEQ ID NO: 29330 - DNA, 20 bp, Artificial Sequence
  Description of Artificial Sequence: Synthetic oligonucleotide
  Target: SCN9A; (-) strand; PAM type: NRG; PAM sequence: TGG
aaaatatatgggtttttgta

SEQ ID NO: 29331 - DNA, 20 bp, Artificial Sequence
  Description of Artificial Sequence: Synthetic oligonucleotide
  Target: SCN9A; (-) strand; PAM type: NRG; PAM sequence: GGG
tggcatttaaaaaaatatat

SEQ ID NO: 29332 - DNA, 20 bp, Artificial Sequence
  Description of Artificial Sequence: Synthetic oligonucleotide
  Target: SCN9A; (-) strand; PAM type: NRG; PAM sequence: TGG
ctggcatttaaaaaaatata

SEQ ID NO: 29333 - DNA, 20 bp, Artificial Sequence
  Description of Artificial Sequence: Synthetic oligonucleotide
  Target: SCN9A; (-) strand; PAM type: NRG; PAM sequence: TGG
agaataatggggcaaatggc

SEQ ID NO: 29334 - DNA, 20 bp, Artificial Sequence
  Description of Artificial Sequence: Synthetic oligonucleotide
  Target: SCN9A; (-) strand; PAM type: NRG; PAM sequence: TGG
aagcagaataatggggcaaa

SEQ ID NO: 29335 - DNA, 20 bp, Artificial Sequence
  Description of Artificial Sequence: Synthetic oligonucleotide
  Target: SCN9A; (-) strand; PAM type: NRG; PAM sequence: GGG
taaagggaagcagaataatg

SEQ ID NO: 29336 - DNA, 20 bp, Artificial Sequence
  Description of Artificial Sequence: Synthetic oligonucleotide
  Target: SCN9A; (-) strand; PAM type: NRG; PAM sequence: GGG
ataaagggaagcagaataat

SEQ ID NO: 29337 - DNA, 20 bp, Artificial Sequence
  Description of Artificial Sequence: Synthetic oligonucleotide
  Target: SCN9A; (-) strand; PAM type: NRG; PAM sequence: TGG
tataaagggaagcagaataa

SEQ ID NO: 29338 - DNA, 20 bp, Artificial Sequence
  Description of Artificial Sequence: Synthetic oligonucleotide
  Target: SCN9A; (-) strand; PAM type: NRG; PAM sequence: CAG
aatttggctataaagggaag

SEQ ID NO: 29339 - DNA, 20 bp, Artificial Sequence
  Description of Artificial Sequence: Synthetic oligonucleotide
  Target: SCN9A; (-) strand; PAM type: NRG; PAM sequence: AAG
agaaatttggctataaaggg

SEQ ID NO: 29340 - DNA, 20 bp, Artificial Sequence
  Description of Artificial Sequence: Synthetic oligonucleotide
  Target: SCN9A; (-) strand; PAM type: NRG; PAM sequence: GGG
ccaagaaatttggctataaa

SEQ ID NO: 29341 - DNA, 20 bp, Artificial Sequence
  Description of Artificial Sequence: Synthetic oligonucleotide
  Target: SCN9A; (-) strand; PAM type: NRG; PAM sequence: AGG
cccaagaaatttggctataa

SEQ ID NO: 29342 - DNA, 20 bp, Artificial Sequence
  Description of Artificial Sequence: Synthetic oligonucleotide
  Target: SCN9A; (-) strand; PAM type: NRG; PAM sequence: AAG
tcccaagaaatttggctata

SEQ ID NO: 29343 - DNA, 20 bp, Artificial Sequence
  Description of Artificial Sequence: Synthetic oligonucleotide
  Target: SCN9A; (-) strand; PAM type: NRG; PAM sequence: TGG
gacaattctcccaagaaatt

SEQ ID NO: 29344 - DNA, 20 bp, Artificial Sequence
  Description of Artificial Sequence: Synthetic oligonucleotide
  Target: SCN9A; (-) strand; PAM type: NRG; PAM sequence: AAG
tatgtgtagacaattctccc

SEQ ID NO: 29345 - DNA, 20 bp, Artificial Sequence
  Description of Artificial Sequence: Synthetic oligonucleotide
  Target: SCN9A; (-) strand; PAM type: NRG; PAM sequence: TAG
cagaaagaaggtaatatgtg

SEQ ID NO: 29346 - DNA, 20 bp, Artificial Sequence
  Description of Artificial Sequence: Synthetic oligonucleotide
  Target: SCN9A; (-) strand; PAM type: NRG; PAM sequence: AGG
aaaagaagaggtcagaaaga

SEQ ID NO: 29347 - DNA, 20 bp, Artificial Sequence
  Description of Artificial Sequence: Synthetic oligonucleotide
  Target: SCN9A; (-) strand; PAM type: NRG; PAM sequence: AAG
gaaaagaagaggtcagaaag

SEQ ID NO: 29348 - DNA, 20 bp, Artificial Sequence
  Description of Artificial Sequence: Synthetic oligonucleotide
  Target: SCN9A; (-) strand; PAM type: NRG; PAM sequence: AAG
ggtgaaaagaagaggtcaga

SEQ ID NO: 29349 - DNA, 20 bp, Artificial Sequence
  Description of Artificial Sequence: Synthetic oligonucleotide
  Target: SCN9A; (-) strand; PAM type: NRG; PAM sequence: CAG
caggggtgaaaagaagaggt

SEQ ID NO: 29350 - DNA, 20 bp, Artificial Sequence
  Description of Artificial Sequence: Synthetic oligonucleotide
  Target: SCN9A; (-) strand; PAM type: NRG; PAM sequence: AGG
catacaggggtgaaaagaag

SEQ ID NO: 29351 - DNA, 20 bp, Artificial Sequence
  Description of Artificial Sequence: Synthetic oligonucleotide
  Target: SCN9A; (-) strand; PAM type: NRG; PAM sequence: GAG
gcatacaggggtgaaaagaa

SEQ ID NO: 29352 - DNA, 20 bp, Artificial Sequence
  Description of Artificial Sequence: Synthetic oligonucleotide
  Target: SCN9A; (-) strand; PAM type: NRG; PAM sequence: AAG
gtgcatacaggggtgaaaag

SEQ ID NO: 29353 - DNA, 20 bp, Artificial Sequence
  Description of Artificial Sequence: Synthetic oligonucleotide
  Target: SCN9A; (-) strand; PAM type: NRG; PAM sequence: AAG
aaggtgcatacaggggtgaa

SEQ ID NO: 29354 - DNA, 20 bp, Artificial Sequence
  Description of Artificial Sequence: Synthetic oligonucleotide
  Target: SCN9A; (-) strand; PAM type: NRG; PAM sequence: GGG
taagaataaggtgcatacag

SEQ ID NO: 29355 - DNA, 20 bp, Artificial Sequence
  Description of Artificial Sequence: Synthetic oligonucleotide
  Target: SCN9A; (-) strand; PAM type: NRG; PAM sequence: GGG
gtaagaataaggtgcataca

SEQ ID NO: 29356 - DNA, 20 bp, Artificial Sequence
  Description of Artificial Sequence: Synthetic oligonucleotide
  Target: SCN9A; (-) strand; PAM type: NRG; PAM sequence: AGG
ggtaagaataaggtgcatac

SEQ ID NO: 29357 - DNA, 20 bp, Artificial Sequence
  Description of Artificial Sequence: Synthetic oligonucleotide
  Target: SCN9A; (-) strand; PAM type: NRG; PAM sequence: CAG
aggtaagaataaggtgcata

SEQ ID NO: 29358 - DNA, 20 bp, Artificial Sequence
  Description of Artificial Sequence: Synthetic oligonucleotide
  Target: SCN9A; (-) strand; PAM type: NRG; PAM sequence: AGG
tagggttcaaggtaagaata

SEQ ID NO: 29359 - DNA, 20 bp, Artificial Sequence
  Description of Artificial Sequence: Synthetic oligonucleotide
  Target: SCN9A; (-) strand; PAM type: NRG; PAM sequence: AAG
gtagggttcaaggtaagaat

SEQ ID NO: 29360 - DNA, 20 bp, Artificial Sequence
  Description of Artificial Sequence: Synthetic oligonucleotide
  Target: SCN9A; (-) strand; PAM type: NRG; PAM sequence: AAG
taagtggtagggttcaaggt

SEQ ID NO: 29361 - DNA, 20 bp, Artificial Sequence
  Description of Artificial Sequence: Synthetic oligonucleotide
  Target: SCN9A; (-) strand; PAM type: NRG; PAM sequence: AGG
tgggtaagtggtagggttca

SEQ ID NO: 29362 - DNA, 20 bp, Artificial Sequence
  Description of Artificial Sequence: Synthetic oligonucleotide
  Target: SCN9A; (-) strand; PAM type: NRG; PAM sequence: AAG
ttgggtaagtggtagggttc

SEQ ID NO: 29363 - DNA, 20 bp, Artificial Sequence
  Description of Artificial Sequence: Synthetic oligonucleotide
  Target: SCN9A; (-) strand; PAM type: NRG; PAM sequence: GGG
gaaaatttgggtaagtggta

SEQ ID NO: 29364 - DNA, 20 bp, Artificial Sequence
  Description of Artificial Sequence: Synthetic oligonucleotide
  Target: SCN9A; (-) strand; PAM type: NRG; PAM sequence: AGG
agaaaatttgggtaagtggt

SEQ ID NO: 29365 - DNA, 20 bp, Artificial Sequence
  Description of Artificial Sequence: Synthetic oligonucleotide
  Target: SCN9A; (-) strand; PAM type: NRG; PAM sequence: TAG
gagaaaatttgggtaagtgg

SEQ ID NO: 29366 - DNA, 20 bp, Artificial Sequence
  Description of Artificial Sequence: Synthetic oligonucleotide
  Target: SCN9A; (-) strand; PAM type: NRG; PAM sequence: TGG
cttgagaaaatttgggtaag

SEQ ID NO: 29367 - DNA, 20 bp, Artificial Sequence
  Description of Artificial Sequence: Synthetic oligonucleotide
  Target: SCN9A; (-) strand; PAM type: NRG; PAM sequence: AAG
tttcttgagaaaatttgggt

SEQ ID NO: 29368 - DNA, 20 bp, Artificial Sequence
  Description of Artificial Sequence: Synthetic oligonucleotide
  Target: SCN9A; (-) strand; PAM type: NRG; PAM sequence: GGG
agaatttcttgagaaaattt

SEQ ID NO: 29369 - DNA, 20 bp, Artificial Sequence
  Description of Artificial Sequence: Synthetic oligonucleotide
  Target: SCN9A; (-) strand; PAM type: NRG; PAM sequence: TGG
gagaatttcttgagaaaatt

SEQ ID NO: 29370 - DNA, 20 bp, Artificial Sequence
  Description of Artificial Sequence: Synthetic oligonucleotide
  Target: SCN9A; (-) strand; PAM type: NRG; PAM sequence: GAG
aagtcatcagagaatttctt

SEQ ID NO: 29371 - DNA, 20 bp, Artificial Sequence
  Description of Artificial Sequence: Synthetic oligonucleotide
  Target: SCN9A; (-) strand; PAM type: NRG; PAM sequence: GAG
aagtaacagggaagtcatca

SEQ ID NO: 29372 - DNA, 20 bp, Artificial Sequence
  Description of Artificial Sequence: Synthetic oligonucleotide
  Target: SCN9A; (-) strand; PAM type: NRG; PAM sequence: CAG
ttaagtaacagggaagtcat

SEQ ID NO: 29373 - DNA, 20 bp, Artificial Sequence
  Description of Artificial Sequence: Synthetic oligonucleotide
  Target: SCN9A; (-) strand; PAM type: NRG; PAM sequence: AAG
cattaggttaagtaacaggg

SEQ ID NO: 29374 - DNA, 20 bp, Artificial Sequence
  Description of Artificial Sequence: Synthetic oligonucleotide
  Target: SCN9A; (-) strand; PAM type: NRG; PAM sequence: GGG
atgcattaggttaagtaaca

SEQ ID NO: 29375 - DNA, 20 bp, Artificial Sequence
  Description of Artificial Sequence: Synthetic oligonucleotide
  Target: SCN9A; (-) strand; PAM type: NRG; PAM sequence: AGG
tatgcattaggttaagtaac

SEQ ID NO: 29376 - DNA, 20 bp, Artificial Sequence
  Description of Artificial Sequence: Synthetic oligonucleotide
  Target: SCN9A; (-) strand; PAM type: NRG; PAM sequence: CAG
atatgcattaggttaagtaa

SEQ ID NO: 29377 - DNA, 20 bp, Artificial Sequence
  Description of Artificial Sequence: Synthetic oligonucleotide
  Target: SCN9A; (-) strand; PAM type: NRG; PAM sequence: AAG
aaagaaatatgcattaggtt

SEQ ID NO: 29378 - DNA, 20 bp, Artificial Sequence
  Description of Artificial Sequence: Synthetic oligonucleotide
  Target: SCN9A; (-) strand; PAM type: NRG; PAM sequence: AGG
tgaagaaagaaatatgcatt

SEQ ID NO: 29379 - DNA, 20 bp, Artificial Sequence
  Description of Artificial Sequence: Synthetic oligonucleotide
  Target: SCN9A; (-) strand; PAM type: NRG; PAM sequence: TAG
atgaagaaagaaatatgcat

SEQ ID NO: 29380 - DNA, 20 bp, Artificial Sequence
  Description of Artificial Sequence: Synthetic oligonucleotide
  Target: SCN9A; (-) strand; PAM type: NRG; PAM sequence: AAG
aggagtaaggatgatgaaga

SEQ ID NO: 29381 - DNA, 20 bp, Artificial Sequence
  Description of Artificial Sequence: Synthetic oligonucleotide
  Target: SCN9A; (-) strand; PAM type: NRG; PAM sequence: AAG
atcaaggagtaaggatgatg

SEQ ID NO: 29382 - DNA, 20 bp, Artificial Sequence
  Description of Artificial Sequence: Synthetic oligonucleotide
  Target: SCN9A; (-) strand; PAM type: NRG; PAM sequence: AGG
tgctgcaagatcaaggagta

SEQ ID NO: 29383 - DNA, 20 bp, Artificial Sequence
  Description of Artificial Sequence: Synthetic oligonucleotide
  Target: SCN9A; (-) strand; PAM type: NRG; PAM sequence: AAG
atgctgcaagatcaaggagt

SEQ ID NO: 29384 - DNA, 20 bp, Artificial Sequence
  Description of Artificial Sequence: Synthetic oligonucleotide
  Target: SCN9A; (-) strand; PAM type: NRG; PAM sequence: GAG
aatcatgctgcaagatcaag

SEQ ID NO: 29385 - DNA, 20 bp, Artificial Sequence
  Description of Artificial Sequence: Synthetic oligonucleotide
  Target: SCN9A; (-) strand; PAM type: NRG; PAM sequence: AGG
agaatcatgctgcaagatca

SEQ ID NO: 29386 - DNA, 20 bp, Artificial Sequence
  Description of Artificial Sequence: Synthetic oligonucleotide
  Target: SCN9A; (-) strand; PAM type: NRG; PAM sequence: AAG
tagaatcatgctgcaagatc

SEQ ID NO: 29387 - DNA, 20 bp, Artificial Sequence
  Description of Artificial Sequence: Synthetic oligonucleotide
  Target: SCN9A; (-) strand; PAM type: NRG; PAM sequence: AAG
cttgtgtagaatcatgctgc

SEQ ID NO: 29388 - DNA, 20 bp, Artificial Sequence
  Description of Artificial Sequence: Synthetic oligonucleotide
  Target: SCN9A; (-) strand; PAM type: NRG; PAM sequence: TAG
tagaaacagatgtgcttgtg

SEQ ID NO: 29389 - DNA, 20 bp, Artificial Sequence
  Description of Artificial Sequence: Synthetic oligonucleotide
  Target: SCN9A; (-) strand; PAM type: NRG; PAM sequence: CAG
aagaaaacatattgtagaaa

SEQ ID NO: 29390 - DNA, 20 bp, Artificial Sequence
  Description of Artificial Sequence: Synthetic oligonucleotide
  Target: SCN9A; (-) strand; PAM type: NRG; PAM sequence: TAG
caagagaagaaaacatattg

SEQ ID NO: 29391 - DNA, 20 bp, Artificial Sequence
  Description of Artificial Sequence: Synthetic oligonucleotide
  Target: SCN9A; (-) strand; PAM type: NRG; PAM sequence: AAG
ataaataatgaagccaagag

SEQ ID NO: 29392 - DNA, 20 bp, Artificial Sequence
  Description of Artificial Sequence: Synthetic oligonucleotide
  Target: SCN9A; (-) strand; PAM type: NRG; PAM sequence: GAG
gatataaataatgaagccaa

SEQ ID NO: 29393 - DNA, 20 bp, Artificial Sequence
  Description of Artificial Sequence: Synthetic oligonucleotide
  Target: SCN9A; (-) strand; PAM type: NRG; PAM sequence: AAG
aagatataaataatgaagcc

SEQ ID NO: 29394 - DNA, 20 bp, Artificial Sequence
  Description of Artificial Sequence: Synthetic oligonucleotide
  Target: SCN9A; (-) strand; PAM type: NRG; PAM sequence: AAG
aagcaaagatataaataatg

SEQ ID NO: 29395 - DNA, 20 bp, Artificial Sequence
  Description of Artificial Sequence: Synthetic oligonucleotide
  Target: SCN9A; (-) strand; PAM type: NRG; PAM sequence: AAG
cgccaataaagtaagaagca

SEQ ID NO: 29396 - DNA, 20 bp, Artificial Sequence
  Description of Artificial Sequence: Synthetic oligonucleotide
  Target: SCN9A; (-) strand; PAM type: NRG; PAM sequence: AAG
agagccgccaataaagtaag

SEQ ID NO: 29397 - DNA, 20 bp, Artificial Sequence
  Description of Artificial Sequence: Synthetic oligonucleotide
  Target: SCN9A; (-) strand; PAM type: NRG; PAM sequence: AAG
gaaagagccgccaataaagt

SEQ ID NO: 29398 - DNA, 20 bp, Artificial Sequence
  Description of Artificial Sequence: Synthetic oligonucleotide
  Target: SCN9A; (-) strand; PAM type: NRG; PAM sequence: AAG
cagagaaagagccgccaata

SEQ ID NO: 29399 - DNA, 20 bp, Artificial Sequence
  Description of Artificial Sequence: Synthetic oligonucleotide
  Target: SCN9A; (-) strand; PAM type: NRG; PAM sequence: GAG
cagaaaagaacacagagaaa

SEQ ID NO: 29400 - DNA, 20 bp, Artificial Sequence
  Description of Artificial Sequence: Synthetic oligonucleotide
  Target: SCN9A; (-) strand; PAM type: NRG; PAM sequence: AAG
cccagaaaagaacacagaga

SEQ ID NO: 29401 - DNA, 20 bp, Artificial Sequence
  Description of Artificial Sequence: Synthetic oligonucleotide
  Target: SCN9A; (-) strand; PAM type: NRG; PAM sequence: GAG
aggacccagaaaagaacaca

SEQ ID NO: 29402 - DNA, 20 bp, Artificial Sequence
  Description of Artificial Sequence: Synthetic oligonucleotide
  Target: SCN9A; (-) strand; PAM type: NRG; PAM sequence: CAG
agaggacccagaaaagaaca

SEQ ID NO: 29403 - DNA, 20 bp, Artificial Sequence
  Description of Artificial Sequence: Synthetic oligonucleotide
  Target: SCN9A; (-) strand; PAM type: NRG; PAM sequence: AAG
gtagaaaagaggacccagaa

SEQ ID NO: 29404 - DNA, 20 bp, Artificial Sequence
  Description of Artificial Sequence: Synthetic oligonucleotide
  Target: SCN9A; (-) strand; PAM type: NRG; PAM sequence: CAG
ttcaggtagaaaagaggacc

SEQ ID NO: 29405 - DNA, 20 bp, Artificial Sequence
  Description of Artificial Sequence: Synthetic oligonucleotide
  Target: SCN9A; (-) strand; PAM type: NRG; PAM sequence: AGG
ttagaattcaggtagaaaag

SEQ ID NO: 29406 - DNA, 20 bp, Artificial Sequence
  Description of Artificial Sequence: Synthetic oligonucleotide
  Target: SCN9A; (-) strand; PAM type: NRG; PAM sequence: GAG
tttagaattcaggtagaaaa

SEQ ID NO: 29407 - DNA, 20 bp, Artificial Sequence
  Description of Artificial Sequence: Synthetic oligonucleotide
  Target: SCN9A; (-) strand; PAM type: NRG; PAM sequence: AAG
catttagaattcaggtagaa

SEQ ID NO: 29408 - DNA, 20 bp, Artificial Sequence
  Description of Artificial Sequence: Synthetic oligonucleotide
  Target: SCN9A; (-) strand; PAM type: NRG; PAM sequence: TAG
tctgacatttagaattcagg

SEQ ID NO: 29409 - DNA, 20 bp, Artificial Sequence
  Description of Artificial Sequence: Synthetic oligonucleotide
  Target: SCN9A; (-) strand; PAM type: NRG; PAM sequence: AGG
aactctgacatttagaattc

SEQ ID NO: 29410 - DNA, 20 bp, Artificial Sequence
  Description of Artificial Sequence: Synthetic oligonucleotide
  Target: SCN9A; (-) strand; PAM type: NRG; PAM sequence: CAG
caactctgacatttagaatt

SEQ ID NO: 29411 - DNA, 20 bp, Artificial Sequence
  Description of Artificial Sequence: Synthetic oligonucleotide
  Target: SCN9A; (-) strand; PAM type: NRG; PAM sequence: TAG
agatctacaactctgacatt

SEQ ID NO: 29412 - DNA, 20 bp, Artificial Sequence
  Description of Artificial Sequence: Synthetic oligonucleotide
  Target: SCN9A; (-) strand; PAM type: NRG; PAM sequence: AAG
atttaaagcaatctggtacc

SEQ ID NO: 29413 - DNA, 20 bp, Artificial Sequence
  Description of Artificial Sequence: Synthetic oligonucleotide
  Target: SCN9A; (-) strand; PAM type: NRG; PAM sequence: TGG
acctggtatttaaagcaatc

SEQ ID NO: 29414 - DNA, 20 bp, Artificial Sequence
  Description of Artificial Sequence: Synthetic oligonucleotide
  Target: SCN9A; (-) strand; PAM type: NRG; PAM sequence: AAG
aatgggaaacctggtattta

SEQ ID NO: 29415 - DNA, 20 bp, Artificial Sequence
  Description of Artificial Sequence: Synthetic oligonucleotide
  Target: SCN9A; (-) strand; PAM type: NRG; PAM sequence: TGG
tagatagagaatgggaaacc

SEQ ID NO: 29416 - DNA, 20 bp, Artificial Sequence
  Description of Artificial Sequence: Synthetic oligonucleotide
  Target: SCN9A; (-) strand; PAM type: NRG; PAM sequence: GGG
tttttaagtagatagagaat

SEQ ID NO: 29417 - DNA, 20 bp, Artificial Sequence
  Description of Artificial Sequence: Synthetic oligonucleotide
  Target: SCN9A; (-) strand; PAM type: NRG; PAM sequence: TGG
atttttaagtagatagagaa

SEQ ID NO: 29418 - DNA, 20 bp, Artificial Sequence
  Description of Artificial Sequence: Synthetic oligonucleotide
  Target: SCN9A; (-) strand; PAM type: NRG; PAM sequence: GAG
ctgatatttttaagtagata

SEQ ID NO: 29419 - DNA, 20 bp, Artificial Sequence
  Description of Artificial Sequence: Synthetic oligonucleotide
  Target: SCN9A; (-) strand; PAM type: NRG; PAM sequence: TAG
ccctgatatttttaagtaga

SEQ ID NO: 29420 - DNA, 20 bp, Artificial Sequence
  Description of Artificial Sequence: Synthetic oligonucleotide
  Target: SCN9A; (-) strand; PAM type: NRG; PAM sequence: TAG
acatccctgatatttttaag

SEQ ID NO: 29421 - DNA, 20 bp, Artificial Sequence
  Description of Artificial Sequence: Synthetic oligonucleotide
  Target: SCN9A; (-) strand; PAM type: NRG; PAM sequence: AAG
tgaacatccctgatattttt

SEQ ID NO: 29422 - DNA, 20 bp, Artificial Sequence
  Description of Artificial Sequence: Synthetic oligonucleotide
  Target: SCN9A; (-) strand; PAM type: NRG; PAM sequence: AGG
agagcaatcagcaaaaagaa

SEQ ID NO: 29423 - DNA, 20 bp, Artificial Sequence
  Description of Artificial Sequence: Synthetic oligonucleotide
  Target: SCN9A; (-) strand; PAM type: NRG; PAM sequence: AAG
cagagcaatcagcaaaaaga

SEQ ID NO: 29424 - DNA, 20 bp, Artificial Sequence
  Description of Artificial Sequence: Synthetic oligonucleotide
  Target: SCN9A; (-) strand; PAM type: NRG; PAM sequence: AAG
attccagagcaatcagcaaa

SEQ ID NO: 29425 - DNA, 20 bp, Artificial Sequence
  Description of Artificial Sequence: Synthetic oligonucleotide
  Target: SCN9A; (-) strand; PAM type: NRG; PAM sequence: CAG
gagataaattccagagcaat

SEQ ID NO: 29426 - DNA, 20 bp, Artificial Sequence
  Description of Artificial Sequence: Synthetic oligonucleotide
  Target: SCN9A; (-) strand; PAM type: NRG; PAM sequence: GAG
gagtttggagataaattcca

SEQ ID NO: 29427 - DNA, 20 bp, Artificial Sequence
  Description of Artificial Sequence: Synthetic oligonucleotide
  Target: SCN9A; (-) strand; PAM type: NRG; PAM sequence: CAG
ctgagtttggagataaattc

SEQ ID NO: 29428 - DNA, 20 bp, Artificial Sequence
  Description of Artificial Sequence: Synthetic oligonucleotide
  Target: SCN9A; (-) strand; PAM type: NRG; PAM sequence: GAG
cagagggcctgctgagtttg

SEQ ID NO: 29429 - DNA, 20 bp, Artificial Sequence
  Description of Artificial Sequence: Synthetic oligonucleotide
  Target: SCN9A; (-) strand; PAM type: NRG; PAM sequence: TGG
atcagagggcctgctgagtt

SEQ ID NO: 29430 - DNA, 20 bp, Artificial Sequence
  Description of Artificial Sequence: Synthetic oligonucleotide
  Target: SCN9A; (-) strand; PAM type: NRG; PAM sequence: GAG
tagaaatcagagggcctgct

SEQ ID NO: 29431 - DNA, 20 bp, Artificial Sequence
  Description of Artificial Sequence: Synthetic oligonucleotide
  Target: SCN9A; (-) strand; PAM type: NRG; PAM sequence: GGG
atttaagtatagaaatcaga

SEQ ID NO: 29432 - DNA, 20 bp, Artificial Sequence
  Description of Artificial Sequence: Synthetic oligonucleotide
  Target: SCN9A; (-) strand; PAM type: NRG; PAM sequence: AGG
gatttaagtatagaaatcag

SEQ ID NO: 29433 - DNA, 20 bp, Artificial Sequence
  Description of Artificial Sequence: Synthetic oligonucleotide
  Target: SCN9A; (-) strand; PAM type: NRG; PAM sequence: GAG
agatttaagtatagaaatca

SEQ ID NO: 29434 - DNA, 20 bp, Artificial Sequence
  Description of Artificial Sequence: Synthetic oligonucleotide
  Target: SCN9A; (-) strand; PAM type: NRG; PAM sequence: CAG
ggagatttaagtatagaaat

SEQ ID NO: 29435 - DNA, 20 bp, Artificial Sequence
  Description of Artificial Sequence: Synthetic oligonucleotide
  Target: SCN9A; (-) strand; PAM type: NRG; PAM sequence: TAG
gagaattggagatttaagta

SEQ ID NO: 29436 - DNA, 20 bp, Artificial Sequence
  Description of Artificial Sequence: Synthetic oligonucleotide
  Target: SCN9A; (-) strand; PAM type: NRG; PAM sequence: AAG
atatagagaattggagattt

SEQ ID NO: 29437 - DNA, 20 bp, Artificial Sequence
  Description of Artificial Sequence: Synthetic oligonucleotide
  Target: SCN9A; (-) strand; PAM type: NRG; PAM sequence: GAG
atatataatatagagaattg

SEQ ID NO: 29438 - DNA, 20 bp, Artificial Sequence
  Description of Artificial Sequence: Synthetic oligonucleotide
  Target: SCN9A; (-) strand; PAM type: NRG; PAM sequence: TGG
ggatatataatatagagaat

SEQ ID NO: 29439 - DNA, 20 bp, Artificial Sequence
  Description of Artificial Sequence: Synthetic oligonucleotide
  Target: SCN9A; (-) strand; PAM type: NRG; PAM sequence: GAG
ccaggtggatatataatata

SEQ ID NO: 29440 - DNA, 20 bp, Artificial Sequence
  Description of Artificial Sequence: Synthetic oligonucleotide
  Target: SCN9A; (-) strand; PAM type: NRG; PAM sequence: TAG
gtccaggtggatatataata

SEQ ID NO: 29441 - DNA, 20 bp, Artificial Sequence
  Description of Artificial Sequence: Synthetic oligonucleotide
  Target: SCN9A; (-) strand; PAM type: NRG; PAM sequence: TGG
atgcctttgagatgtccagg

SEQ ID NO: 29442 - DNA, 20 bp, Artificial Sequence
  Description of Artificial Sequence: Synthetic oligonucleotide
  Target: SCN9A; (-) strand; PAM type: NRG; PAM sequence: AGG
gagatgcctttgagatgtcc

SEQ ID NO: 29443 - DNA, 20 bp, Artificial Sequence
  Description of Artificial Sequence: Synthetic oligonucleotide
  Target: SCN9A; (-) strand; PAM type: NRG; PAM sequence: CAG
tgagatgcctttgagatgtc

SEQ ID NO: 29444 - DNA, 20 bp, Artificial Sequence
  Description of Artificial Sequence: Synthetic oligonucleotide
  Target: SCN9A; (-) strand; PAM type: NRG; PAM sequence: GAG
aattaaaatgagatgccttt

SEQ ID NO: 29445 - DNA, 20 bp, Artificial Sequence
  Description of Artificial Sequence: Synthetic oligonucleotide
  Target: SCN9A; (-) strand; PAM type: NRG; PAM sequence: GAG
tagctagctaaaattaaaat

SEQ ID NO: 29446 - DNA, 20 bp, Artificial Sequence
  Description of Artificial Sequence: Synthetic oligonucleotide
  Target: SCN9A; (-) strand; PAM type: NRG; PAM sequence: TAG
agaggaaggtcactattagc

SEQ ID NO: 29447 - DNA, 20 bp, Artificial Sequence
  Description of Artificial Sequence: Synthetic oligonucleotide
  Target: SCN9A; (-) strand; PAM type: NRG; PAM sequence: TAG
ttgtagaggaaggtcactat

SEQ ID NO: 29448 - DNA, 20 bp, Artificial Sequence
  Description of Artificial Sequence: Synthetic oligonucleotide
  Target: SCN9A; (-) strand; PAM type: NRG; PAM sequence: AGG
gtggacacatttgtagagga

SEQ ID NO: 29449 - DNA, 20 bp, Artificial Sequence
  Description of Artificial Sequence: Synthetic oligonucleotide
  Target: SCN9A; (-) strand; PAM type: NRG; PAM sequence: AAG
ggtggacacatttgtagagg

SEQ ID NO: 29450 - DNA, 20 bp, Artificial Sequence
  Description of Artificial Sequence: Synthetic oligonucleotide
  Target: SCN9A; (-) strand; PAM type: NRG; PAM sequence: AGG
aatggtggacacatttgtag

SEQ ID NO: 29451 - DNA, 20 bp, Artificial Sequence
  Description of Artificial Sequence: Synthetic oligonucleotide
  Target: SCN9A; (-) strand; PAM type: NRG; PAM sequence: GAG
aaatggtggacacatttgta

SEQ ID NO: 29452 - DNA, 20 bp, Artificial Sequence
  Description of Artificial Sequence: Synthetic oligonucleotide
  Target: SCN9A; (-) strand; PAM type: NRG; PAM sequence: TAG
ggaaatggtggacacatttg

SEQ ID NO: 29453 - DNA, 20 bp, Artificial Sequence
  Description of Artificial Sequence: Synthetic oligonucleotide
  Target: SCN9A; (-) strand; PAM type: NRG; PAM sequence: TGG
gatggttaatgaggaaatgg

SEQ ID NO: 29454 - DNA, 20 bp, Artificial Sequence
  Description of Artificial Sequence: Synthetic oligonucleotide
  Target: SCN9A; (-) strand; PAM type: NRG; PAM sequence: TGG
ggtgatggttaatgaggaaa

SEQ ID NO: 29455 - DNA, 20 bp, Artificial Sequence
  Description of Artificial Sequence: Synthetic oligonucleotide
  Target: SCN9A; (-) strand; PAM type: NRG; PAM sequence: AGG
atgggtggtgatggttaatg

SEQ ID NO: 29456 - DNA, 20 bp, Artificial Sequence
  Description of Artificial Sequence: Synthetic oligonucleotide
  Target: SCN9A; (-) strand; PAM type: NRG; PAM sequence: GAG
gatgggtggtgatggttaat

SEQ ID NO: 29457 - DNA, 20 bp, Artificial Sequence
  Description of Artificial Sequence: Synthetic oligonucleotide
  Target: SCN9A; (-) strand; PAM type: NRG; PAM sequence: TGG
aataactggatgggtggtga

SEQ ID NO: 29458 - DNA, 20 bp, Artificial Sequence
  Description of Artificial Sequence: Synthetic oligonucleotide
  Target: SCN9A; (-) strand; PAM type: NRG; PAM sequence: TGG
ggctgcaataactggatggg

SEQ ID NO: 29459 - DNA, 20 bp, Artificial Sequence
  Description of Artificial Sequence: Synthetic oligonucleotide
  Target: SCN9A; (-) strand; PAM type: NRG; PAM sequence: GGG
tctggctgcaataactggat

SEQ ID NO: 29460 - DNA, 20 bp, Artificial Sequence
  Description of Artificial Sequence: Synthetic oligonucleotide
  Target: SCN9A; (-) strand; PAM type: NRG; PAM sequence: TGG
ttctggctgcaataactgga

SEQ ID NO: 29461 - DNA, 20 bp, Artificial Sequence
  Description of Artificial Sequence: Synthetic oligonucleotide
  Target: SCN9A; (-) strand; PAM type: NRG; PAM sequence: TGG
cagtttctggctgcaataac

SEQ ID NO: 29462 - DNA, 20 bp, Artificial Sequence
  Description of Artificial Sequence: Synthetic oligonucleotide
  Target: SCN9A; (-) strand; PAM type: NRG; PAM sequence: TGG
gaggatgacttctcagtttc

SEQ ID NO: 29463 - DNA, 20 bp, Artificial Sequence
  Description of Artificial Sequence: Synthetic oligonucleotide
  Target: SCN9A; (-) strand; PAM type: NRG; PAM sequence: CAG
aagcattgaggatgacttct

SEQ ID NO: 29464 - DNA, 20 bp, Artificial Sequence
  Description of Artificial Sequence: Synthetic oligonucleotide
  Target: SCN9A; (-) strand; PAM type: NRG; PAM sequence: AGG
aaagaagacaggaagcattg

SEQ ID NO: 29465 - DNA, 20 bp, Artificial Sequence
  Description of Artificial Sequence: Synthetic oligonucleotide
  Target: SCN9A; (-) strand; PAM type: NRG; PAM sequence: GAG
taaagaagacaggaagcatt

SEQ ID NO: 29466 - DNA, 20 bp, Artificial Sequence
  Description of Artificial Sequence: Synthetic oligonucleotide
  Target: SCN9A; (-) strand; PAM type: NRG; PAM sequence: AAG
gatggattaaagaagacagg

SEQ ID NO: 29467 - DNA, 20 bp, Artificial Sequence
  Description of Artificial Sequence: Synthetic oligonucleotide
  Target: SCN9A; (-) strand; PAM type: NRG; PAM sequence: AGG
gctgatggattaaagaagac

SEQ ID NO: 29468 - DNA, 20 bp, Artificial Sequence
  Description of Artificial Sequence: Synthetic oligonucleotide
  Target: SCN9A; (-) strand; PAM type: NRG; PAM sequence: CAG
tgctgatggattaaagaaga

SEQ ID NO: 29469 - DNA, 20 bp, Artificial Sequence
  Description of Artificial Sequence: Synthetic oligonucleotide
  Target: SCN9A; (-) strand; PAM type: NRG; PAM sequence: AAG
agcttgctgatggattaaag

SEQ ID NO: 29470 - DNA, 20 bp, Artificial Sequence
  Description of Artificial Sequence: Synthetic oligonucleotide
  Target: SCN9A; (-) strand; PAM type: NRG; PAM sequence: AAG
tagagcttgctgatggatta

SEQ ID NO: 29471 - DNA, 20 bp, Artificial Sequence
  Description of Artificial Sequence: Synthetic oligonucleotide
  Target: SCN9A; (-) strand; PAM type: NRG; PAM sequence: TGG
aagtctgtagagcttgctga

SEQ ID NO: 29472 - DNA, 20 bp, Artificial Sequence
  Description of Artificial Sequence: Synthetic oligonucleotide
  Target: SCN9A; (-) strand; PAM type: NRG; PAM sequence: GAG
ctcaacatacaaagtctgta

SEQ ID NO: 29473 - DNA, 20 bp, Artificial Sequence
  Description of Artificial Sequence: Synthetic oligonucleotide
  Target: SCN9A; (-) strand; PAM type: NRG; PAM sequence: TAG
agctcaacatacaaagtctg

SEQ ID NO: 29474 - DNA, 20 bp, Artificial Sequence
  Description of Artificial Sequence: Synthetic oligonucleotide
  Target: SCN9A; (-) strand; PAM type: NRG; PAM sequence: AAG
aaagatgagctcaacataca

SEQ ID NO: 29475 - DNA, 20 bp, Artificial Sequence
  Description of Artificial Sequence: Synthetic oligonucleotide
  Target: SCN9A; (-) strand; PAM type: NRG; PAM sequence: GAG
gaaatgaagagaaaaaagat

SEQ ID NO: 29476 - DNA, 20 bp, Artificial Sequence
  Description of Artificial Sequence: Synthetic oligonucleotide
  Target: SCN9A; (-) strand; PAM type: NRG; PAM sequence: AAG
gcagagaaatgaagagaaaa

SEQ ID NO: 29477 - DNA, 20 bp, Artificial Sequence
  Description of Artificial Sequence: Synthetic oligonucleotide
  Target: SCN9A; (-) strand; PAM type: NRG; PAM sequence: GAG
agtgatggcagagaaatgaa

SEQ ID NO: 29478 - DNA, 20 bp, Artificial Sequence
  Description of Artificial Sequence: Synthetic oligonucleotide
  Target: SCN9A; (-) strand; PAM type: NRG; PAM sequence: AAG
agagtgatggcagagaaatg

SEQ ID NO: 29479 - DNA, 20 bp, Artificial Sequence
  Description of Artificial Sequence: Synthetic oligonucleotide
  Target: SCN9A; (-) strand; PAM type: NRG; PAM sequence: GAG
tttcatctagagtgatggca

SEQ ID NO: 29480 - DNA, 20 bp, Artificial Sequence
  Description of Artificial Sequence: Synthetic oligonucleotide
  Target: SCN9A; (-) strand; PAM type: NRG; PAM sequence: CAG
ggtttcatctagagtgatgg

SEQ ID NO: 29481 - DNA, 20 bp, Artificial Sequence
  Description of Artificial Sequence: Synthetic oligonucleotide
  Target: SCN9A; (-) strand; PAM type: NRG; PAM sequence: TGG
aaaggtttcatctagagtga

SEQ ID NO: 29482 - DNA, 20 bp, Artificial Sequence
  Description of Artificial Sequence: Synthetic oligonucleotide
  Target: SCN9A; (-) strand; PAM type: NRG; PAM sequence: GAG
gaaaataaaggtttcatcta

SEQ ID NO: 29483 - DNA, 20 bp, Artificial Sequence
  Description of Artificial Sequence: Synthetic oligonucleotide
  Target: SCN9A; (-) strand; PAM type: NRG; PAM sequence: TAG
gagaaaataaaggtttcatc

SEQ ID NO: 29484 - DNA, 20 bp, Artificial Sequence
  Description of Artificial Sequence: Synthetic oligonucleotide
  Target: SCN9A; (-) strand; PAM type: NRG; PAM sequence: AGG
atctaggcaagagaaaataa

SEQ ID NO: 29485 - DNA, 20 bp, Artificial Sequence
  Description of Artificial Sequence: Synthetic oligonucleotide
  Target: SCN9A; (-) strand; PAM type: NRG; PAM sequence: AAG
catctaggcaagagaaaata

SEQ ID NO: 29486 - DNA, 20 bp, Artificial Sequence
  Description of Artificial Sequence: Synthetic oligonucleotide
  Target: SCN9A; (-) strand; PAM type: NRG; PAM sequence: GAG
tgcttctctcatctaggcaa

SEQ ID NO: 29487 - DNA, 20 bp, Artificial Sequence
  Description of Artificial Sequence: Synthetic oligonucleotide
  Target: SCN9A; (-) strand; PAM type: NRG; PAM sequence: AAG
gttgcttctctcatctaggc

SEQ ID NO: 29488 - DNA, 20 bp, Artificial Sequence
  Description of Artificial Sequence: Synthetic oligonucleotide
  Target: SCN9A; (-) strand; PAM type: NRG; PAM sequence: AGG
gaaggttgcttctctcatct

SEQ ID NO: 29489 - DNA, 20 bp, Artificial Sequence
  Description of Artificial Sequence: Synthetic oligonucleotide
  Target: SCN9A; (-) strand; PAM type: NRG; PAM sequence: TAG
tgaaggttgcttctctcatc

SEQ ID NO: 29490 - DNA, 20 bp, Artificial Sequence
  Description of Artificial Sequence: Synthetic oligonucleotide
  Target: SCN9A; (-) strand; PAM type: NRG; PAM sequence: AGG
gaataagaaaggtaagttga

SEQ ID NO: 29491 - DNA, 20 bp, Artificial Sequence
  Description of Artificial Sequence: Synthetic oligonucleotide
  Target: SCN9A; (-) strand; PAM type: NRG; PAM sequence: AAG
ggaataagaaaggtaagttg

SEQ ID NO: 29492 - DNA, 20 bp, Artificial Sequence
  Description of Artificial Sequence: Synthetic oligonucleotide
  Target: SCN9A; (-) strand; PAM type: NRG; PAM sequence: AAG
tagatgggaataagaaaggt

SEQ ID NO: 29493 - DNA, 20 bp, Artificial Sequence
  Description of Artificial Sequence: Synthetic oligonucleotide
  Target: SCN9A; (-) strand; PAM type: NRG; PAM sequence: AGG
atggtagatgggaataagaa

SEQ ID NO: 29494 - DNA, 20 bp, Artificial Sequence
  Description of Artificial Sequence: Synthetic oligonucleotide
  Target: SCN9A; (-) strand; PAM type: NRG; PAM sequence: AAG
gatggtagatgggaataaga

SEQ ID NO: 29495 - DNA, 20 bp, Artificial Sequence
  Description of Artificial Sequence: Synthetic oligonucleotide
  Target: SCN9A; (-) strand; PAM type: NRG; PAM sequence: AAG
ggtagatggtagatgggaat

SEQ ID NO: 29496 - DNA, 20 bp, Artificial Sequence
  Description of Artificial Sequence: Synthetic oligonucleotide
  Target: SCN9A; (-) strand; PAM type: NRG; PAM sequence: GGG
agcaagggtagatggtagat

SEQ ID NO: 29497 - DNA, 20 bp, Artificial Sequence
  Description of Artificial Sequence: Synthetic oligonucleotide
  Target: SCN9A; (-) strand; PAM type: NRG; PAM sequence: TGG
gagcaagggtagatggtaga

SEQ ID NO: 29498 - DNA, 20 bp, Artificial Sequence
  Description of Artificial Sequence: Synthetic oligonucleotide
  Target: SCN9A; (-) strand; PAM type: NRG; PAM sequence: TAG
gattgagcaagggtagatgg

SEQ ID NO: 29499 - DNA, 20 bp, Artificial Sequence
  Description of Artificial Sequence: Synthetic oligonucleotide
  Target: SCN9A; (-) strand; PAM type: NRG; PAM sequence: TGG
actgattgagcaagggtaga

SEQ ID NO: 29500 - DNA, 20 bp, Artificial Sequence
  Description of Artificial Sequence: Synthetic oligonucleotide
  Target: SCN9A; (-) strand; PAM type: NRG; PAM sequence: TAG
cacaactgattgagcaaggg

SEQ ID NO: 29501 - DNA, 20 bp, Artificial Sequence
  Description of Artificial Sequence: Synthetic oligonucleotide
  Target: SCN9A; (-) strand; PAM type: NRG; PAM sequence: GGG
gtgcacaactgattgagcaa

SEQ ID NO: 29502 - DNA, 20 bp, Artificial Sequence
  Description of Artificial Sequence: Synthetic oligonucleotide
  Target: SCN9A; (-) strand; PAM type: NRG; PAM sequence: AGG
tgtgcacaactgattgagca

SEQ ID NO: 29503 - DNA, 20 bp, Artificial Sequence
  Description of Artificial Sequence: Synthetic oligonucleotide
  Target: SCN9A; (-) strand; PAM type: NRG; PAM sequence: AAG
ttgtgcacaactgattgagc

SEQ ID NO: 29504 - DNA, 20 bp, Artificial Sequence
  Description of Artificial Sequence: Synthetic oligonucleotide
  Target: SCN9A; (-) strand; PAM type: NRG; PAM sequence: GAG
tgtcttgtgcacaactgatt

SEQ ID NO: 29505 - DNA, 20 bp, Artificial Sequence
  Description of Artificial Sequence: Synthetic oligonucleotide
  Target: SCN9A; (-) strand; PAM type: NRG; PAM sequence: CAG
tttgtattttattttaaatg

SEQ ID NO: 29506 - DNA, 20 bp, Artificial Sequence
  Description of Artificial Sequence: Synthetic oligonucleotide
  Target: SCN9A; (-) strand; PAM type: NRG; PAM sequence: GAG
acatttcagcccatgggaag

SEQ ID NO: 29507 - DNA, 20 bp, Artificial Sequence
  Description of Artificial Sequence: Synthetic oligonucleotide
  Target: SCN9A; (-) strand; PAM type: NRG; PAM sequence: AGG
ggacatttcagcccatggga

SEQ ID NO: 29508 - DNA, 20 bp, Artificial Sequence
  Description of Artificial Sequence: Synthetic oligonucleotide
  Target: SCN9A; (-) strand; PAM type: NRG; PAM sequence: AAG
aggacatttcagcccatggg

SEQ ID NO: 29509 - DNA, 20 bp, Artificial Sequence
  Description of Artificial Sequence: Synthetic oligonucleotide
  Target: SCN9A; (-) strand; PAM type: NRG; PAM sequence: GGG
tgcaggacatttcagcccat

SEQ ID NO: 29510 - DNA, 20 bp, Artificial Sequence
  Description of Artificial Sequence: Synthetic oligonucleotide
  Target: SCN9A; (-) strand; PAM type: NRG; PAM sequence: TGG
atgcaggacatttcagccca

SEQ ID NO: 29511 - DNA, 20 bp, Artificial Sequence
  Description of Artificial Sequence: Synthetic oligonucleotide
  Target: SCN9A; (-) strand; PAM type: NRG; PAM sequence: CAG
tcatatcatgcaggacattt

SEQ ID NO: 29512 - DNA, 20 bp, Artificial Sequence
  Description of Artificial Sequence: Synthetic oligonucleotide
  Target: SCN9A; (-) strand; PAM type: NRG; PAM sequence: AGG
aaataggggtcatatcatgc

SEQ ID NO: 29513 - DNA, 20 bp, Artificial Sequence
  Description of Artificial Sequence: Synthetic oligonucleotide
  Target: SCN9A; (-) strand; PAM type: NRG; PAM sequence: CAG
aaaataggggtcatatcatg

SEQ ID NO: 29514 - DNA, 20 bp, Artificial Sequence
  Description of Artificial Sequence: Synthetic oligonucleotide
  Target: SCN9A; (-) strand; PAM type: NRG; PAM sequence: GGG
gaaagtagcagaaaaaatag

SEQ ID NO: 29515 - DNA, 20 bp, Artificial Sequence
  Description of Artificial Sequence: Synthetic oligonucleotide
  Target: SCN9A; (-) strand; PAM type: NRG; PAM sequence: GGG
agaaagtagcagaaaaaata

SEQ ID NO: 29516 - DNA, 20 bp, Artificial Sequence
  Description of Artificial Sequence: Synthetic oligonucleotide
  Target: SCN9A; (-) strand; PAM type: NRG; PAM sequence: AGG
gagaaagtagcagaaaaaat

SEQ ID NO: 29517 - DNA, 20 bp, Artificial Sequence
  Description of Artificial Sequence: Synthetic oligonucleotide
  Target: SCN9A; (-) strand; PAM type: NRG; PAM sequence: TAG
agagaaagtagcagaaaaaa

SEQ ID NO: 29518 - DNA, 20 bp, Artificial Sequence
  Description of Artificial Sequence: Synthetic oligonucleotide
  Target: SCN9A; (-) strand; PAM type: NRG; PAM sequence: CAG
aatggcaacagagaaagtag

SEQ ID NO: 29519 - DNA, 20 bp, Artificial Sequence
  Description of Artificial Sequence: Synthetic oligonucleotide
  Target: SCN9A; (-) strand; PAM type: NRG; PAM sequence: TAG
aagaatggcaacagagaaag

SEQ ID NO: 29520 - DNA, 20 bp, Artificial Sequence
  Description of Artificial Sequence: Synthetic oligonucleotide
  Target: SCN9A; (-) strand; PAM type: NRG; PAM sequence: AAG
aggaagaatggcaacagaga

SEQ ID NO: 29521 - DNA, 20 bp, Artificial Sequence
  Description of Artificial Sequence: Synthetic oligonucleotide
  Target: SCN9A; (-) strand; PAM type: NRG; PAM sequence: GAG
agaaaggaagaatggcaaca

SEQ ID NO: 29522 - DNA, 20 bp, Artificial Sequence
  Description of Artificial Sequence: Synthetic oligonucleotide
  Target: SCN9A; (-) strand; PAM type: NRG; PAM sequence: CAG
agagaaaggaagaatggcaa

SEQ ID NO: 29523 - DNA, 20 bp, Artificial Sequence
  Description of Artificial Sequence: Synthetic oligonucleotide
  Target: SCN9A; (-) strand; PAM type: NRG; PAM sequence: TGG
ttggtaagagaaaggaagaa

SEQ ID NO: 29524 - DNA, 20 bp, Artificial Sequence
  Description of Artificial Sequence: Synthetic oligonucleotide
  Target: SCN9A; (-) strand; PAM type: NRG; PAM sequence: AAG
gtggtttggtaagagaaagg

SEQ ID NO: 29525 - DNA, 20 bp, Artificial Sequence
  Description of Artificial Sequence: Synthetic oligonucleotide
  Target: SCN9A; (-) strand; PAM type: NRG; PAM sequence: AGG
agcgtggtttggtaagagaa

SEQ ID NO: 29526 - DNA, 20 bp, Artificial Sequence
  Description of Artificial Sequence: Synthetic oligonucleotide
  Target: SCN9A; (-) strand; PAM type: NRG; PAM sequence: AAG
cagcgtggtttggtaagaga

SEQ ID NO: 29527 - DNA, 20 bp, Artificial Sequence
  Description of Artificial Sequence: Synthetic oligonucleotide
  Target: SCN9A; (-) strand; PAM type: NRG; PAM sequence: GAG
acagcagcgtggtttggtaa

SEQ ID NO: 29528 - DNA, 20 bp, Artificial Sequence
  Description of Artificial Sequence: Synthetic oligonucleotide
  Target: SCN9A; (-) strand; PAM type: NRG; PAM sequence: AAG
aaacagcagcgtggtttggt

SEQ ID NO: 29529 - DNA, 20 bp, Artificial Sequence
  Description of Artificial Sequence: Synthetic oligonucleotide
  Target: SCN9A; (-) strand; PAM type: NRG; PAM sequence: TGG
ggaaaaacagcagcgtggtt

SEQ ID NO: 29530 - DNA, 20 bp, Artificial Sequence
  Description of Artificial Sequence: Synthetic oligonucleotide
  Target: SCN9A; (-) strand; PAM type: NRG; PAM sequence: TGG
agaatggaaaaacagcagcg

SEQ ID NO: 29531 - DNA, 20 bp, Artificial Sequence
  Description of Artificial Sequence: Synthetic oligonucleotide
  Target: SCN9A; (-) strand; PAM type: NRG; PAM sequence: CAG
tttaaagaatggaaaaacag

SEQ ID NO: 29532 - DNA, 20 bp, Artificial Sequence
  Description of Artificial Sequence: Synthetic oligonucleotide
  Target: SCN9A; (-) strand; PAM type: NRG; PAM sequence: CAG
gggtttaaagaatggaaaaa

SEQ ID NO: 29533 - DNA, 20 bp, Artificial Sequence
  Description of Artificial Sequence: Synthetic oligonucleotide
  Target: SCN9A; (-) strand; PAM type: NRG; PAM sequence: TGG
gagggtatgggtttaaagaa

SEQ ID NO: 29534 - DNA, 20 bp, Artificial Sequence
  Description of Artificial Sequence: Synthetic oligonucleotide
  Target: SCN9A; (-) strand; PAM type: NRG; PAM sequence: AAG
aaagggagggtatgggttta

SEQ ID NO: 29535 - DNA, 20 bp, Artificial Sequence
  Description of Artificial Sequence: Synthetic oligonucleotide
  Target: SCN9A; (-) strand; PAM type: NRG; PAM sequence: GGG
cctgaataaagggagggtat

SEQ ID NO: 29536 - DNA, 20 bp, Artificial Sequence
  Description of Artificial Sequence: Synthetic oligonucleotide
  Target: SCN9A; (-) strand; PAM type: NRG; PAM sequence: TGG
tcctgaataaagggagggta

SEQ ID NO: 29537 - DNA, 20 bp, Artificial Sequence
  Description of Artificial Sequence: Synthetic oligonucleotide
  Target: SCN9A; (-) strand; PAM type: NRG; PAM sequence: GGG
aaaggtcctgaataaaggga

SEQ ID NO: 29538 - DNA, 20 bp, Artificial Sequence
  Description of Artificial Sequence: Synthetic oligonucleotide
  Target: SCN9A; (-) strand; PAM type: NRG; PAM sequence: AGG
caaaggtcctgaataaaggg

SEQ ID NO: 29539 - DNA, 20 bp, Artificial Sequence
  Description of Artificial Sequence: Synthetic oligonucleotide
  Target: SCN9A; (-) strand; PAM type: NRG; PAM sequence: GAG
gcaaaggtcctgaataaagg

SEQ ID NO: 29540 - DNA, 20 bp, Artificial Sequence
  Description of Artificial Sequence: Synthetic oligonucleotide
  Target: SCN9A; (-) strand; PAM type: NRG; PAM sequence: GGG
gggcaaaggtcctgaataaa

SEQ ID NO: 29541 - DNA, 20 bp, Artificial Sequence
  Description of Artificial Sequence: Synthetic oligonucleotide
  Target: SCN9A; (-) strand; PAM type: NRG; PAM sequence: AGG
tgggcaaaggtcctgaataa

SEQ ID NO: 29542 - DNA, 20 bp, Artificial Sequence
  Description of Artificial Sequence: Synthetic oligonucleotide
  Target: SCN9A; (-) strand; PAM type: NRG; PAM sequence: AAG
atgggcaaaggtcctgaata

SEQ ID NO: 29543 - DNA, 20 bp, Artificial Sequence
  Description of Artificial Sequence: Synthetic oligonucleotide
  Target: SCN9A; (-) strand; PAM type: NRG; PAM sequence: AGG
aggagaaatagcatgggcaa

SEQ ID NO: 29544 - DNA, 20 bp, Artificial Sequence
  Description of Artificial Sequence: Synthetic oligonucleotide
  Target: SCN9A; (-) strand; PAM type: NRG; PAM sequence: AAG
taggagaaatagcatgggca

SEQ ID NO: 29545 - DNA, 20 bp, Artificial Sequence
  Description of Artificial Sequence: Synthetic oligonucleotide
  Target: SCN9A; (-) strand; PAM type: NRG; PAM sequence: GGG
tcaattaggagaaatagcat

SEQ ID NO: 29546 - DNA, 20 bp, Artificial Sequence
  Description of Artificial Sequence: Synthetic oligonucleotide
  Target: SCN9A; (-) strand; PAM type: NRG; PAM sequence: TGG
ttcaattaggagaaatagca

SEQ ID NO: 29547 - DNA, 20 bp, Artificial Sequence
  Description of Artificial Sequence: Synthetic oligonucleotide
  Target: SCN9A; (-) strand; PAM type: NRG; PAM sequence: TAG
gctgcttcaattaggagaaa

SEQ ID NO: 29548 - DNA, 20 bp, Artificial Sequence
  Description of Artificial Sequence: Synthetic oligonucleotide
  Target: SCN9A; (-) strand; PAM type: NRG; PAM sequence: GAG
gggggtgctgcttcaattag

SEQ ID NO: 29549 - DNA, 20 bp, Artificial Sequence
  Description of Artificial Sequence: Synthetic oligonucleotide
  Target: SCN9A; (-) strand; PAM type: NRG; PAM sequence: AGG
tggggggtgctgcttcaatt

SEQ ID NO: 29550 - DNA, 20 bp, Artificial Sequence
  Description of Artificial Sequence: Synthetic oligonucleotide
  Target: SCN9A; (-) strand; PAM type: NRG; PAM sequence: TAG
gtggggggtgctgcttcaat

SEQ ID NO: 29551 - DNA, 20 bp, Artificial Sequence
  Description of Artificial Sequence: Synthetic oligonucleotide
  Target: SCN9A; (-) strand; PAM type: NRG; PAM sequence: GGG
ggtgtgagtctatgtgtggg

SEQ ID NO: 29552 - DNA, 20 bp, Artificial Sequence
  Description of Artificial Sequence: Synthetic oligonucleotide
  Target: SCN9A; (-) strand; PAM type: NRG; PAM sequence: GGG
gggtgtgagtctatgtgtgg

SEQ ID NO: 29553 - DNA, 20 bp, Artificial Sequence
  Description of Artificial Sequence: Synthetic oligonucleotide
  Target: SCN9A; (-) strand; PAM type: NRG; PAM sequence: GGG
tgggtgtgagtctatgtgtg

SEQ ID NO: 29554 - DNA, 20 bp, Artificial Sequence
  Description of Artificial Sequence: Synthetic oligonucleotide
  Target: SCN9A; (-) strand; PAM type: NRG; PAM sequence: GGG
gtgggtgtgagtctatgtgt

SEQ ID NO: 29555 - DNA, 20 bp, Artificial Sequence
  Description of Artificial Sequence: Synthetic oligonucleotide
  Target: SCN9A; (-) strand; PAM type: NRG; PAM sequence: TGG
tgtgggtgtgagtctatgtg

SEQ ID NO: 29556 - DNA, 20 bp, Artificial Sequence
  Description of Artificial Sequence: Synthetic oligonucleotide
  Target: SCN9A; (-) strand; PAM type: NRG; PAM sequence: GAG
aatagtttaagtgtgggtgt

SEQ ID NO: 29557 - DNA, 20 bp, Artificial Sequence
  Description of Artificial Sequence: Synthetic oligonucleotide
  Target: SCN9A; (-) strand; PAM type: NRG; PAM sequence: GGG
ccataaaatagtttaagtgt

SEQ ID NO: 29558 - DNA, 20 bp, Artificial Sequence
  Description of Artificial Sequence: Synthetic oligonucleotide
  Target: SCN9A; (-) strand; PAM type: NRG; PAM sequence: TGG
gccataaaatagtttaagtg

SEQ ID NO: 29559 - DNA, 20 bp, Artificial Sequence
  Description of Artificial Sequence: Synthetic oligonucleotide
  Target: SCN9A; (-) strand; PAM type: NRG; PAM sequence: AAG
aagaagccataaaatagttt

SEQ ID NO: 29560 - DNA, 20 bp, Artificial Sequence
  Description of Artificial Sequence: Synthetic oligonucleotide
  Target: SCN9A; (-) strand; PAM type: NRG; PAM sequence: TAG
gatagtaagaagccataaaa

SEQ ID NO: 29561 - DNA, 20 bp, Artificial Sequence
  Description of Artificial Sequence: Synthetic oligonucleotide
  Target: SCN9A; (-) strand; PAM type: NRG; PAM sequence: AAG
gagatctaaaagatagtaag

SEQ ID NO: 29562 - DNA, 20 bp, Artificial Sequence
  Description of Artificial Sequence: Synthetic oligonucleotide
  Target: SCN9A; (-) strand; PAM type: NRG; PAM sequence: AAG
gctgagatctaaaagatagt

SEQ ID NO: 29563 - DNA, 20 bp, Artificial Sequence
  Description of Artificial Sequence: Synthetic oligonucleotide
  Target: SCN9A; (-) strand; PAM type: NRG; PAM sequence: TAG
ttaagctgagatctaaaaga

SEQ ID NO: 29564 - DNA, 20 bp, Artificial Sequence
  Description of Artificial Sequence: Synthetic oligonucleotide
  Target: SCN9A; (-) strand; PAM type: NRG; PAM sequence: AAG
gcatttaagctgagatctaa

SEQ ID NO: 29565 - DNA, 20 bp, Artificial Sequence
  Description of Artificial Sequence: Synthetic oligonucleotide
  Target: SCN9A; (-) strand; PAM type: NRG; PAM sequence: GAG
gaggtgatggcatttaagct

SEQ ID NO: 29566 - DNA, 20 bp, Artificial Sequence
  Description of Artificial Sequence: Synthetic oligonucleotide
  Target: SCN9A; (-) strand; PAM type: NRG; PAM sequence: AAG
tctctgaggtgatggcattt

SEQ ID NO: 29567 - DNA, 20 bp, Artificial Sequence
  Description of Artificial Sequence: Synthetic oligonucleotide
  Target: SCN9A; (-) strand; PAM type: NRG; PAM sequence: TGG
agaagacatctctgaggtga

SEQ ID NO: 29568 - DNA, 20 bp, Artificial Sequence
  Description of Artificial Sequence: Synthetic oligonucleotide
  Target: SCN9A; (-) strand; PAM type: NRG; PAM sequence: AGG
tagatgagaagacatctctg

SEQ ID NO: 29569 - DNA, 20 bp, Artificial Sequence
  Description of Artificial Sequence: Synthetic oligonucleotide
  Target: SCN9A; (-) strand; PAM type: NRG; PAM sequence: GAG
ctagatgagaagacatctct

SEQ ID NO: 29570 - DNA, 20 bp, Artificial Sequence
  Description of Artificial Sequence: Synthetic oligonucleotide
  Target: SCN9A; (-) strand; PAM type: NRG; PAM sequence: AAG
tgagatatcaactagatgag

SEQ ID NO: 29571 - DNA, 20 bp, Artificial Sequence
  Description of Artificial Sequence: Synthetic oligonucleotide
  Target: SCN9A; (-) strand; PAM type: NRG; PAM sequence: GAG
tgctgagatatcaactagat

SEQ ID NO: 29572 - DNA, 20 bp, Artificial Sequence
  Description of Artificial Sequence: Synthetic oligonucleotide
  Target: SCN9A; (-) strand; PAM type: NRG; PAM sequence: TAG
tcaggtgctgagatatcaac

SEQ ID NO: 29573 - DNA, 20 bp, Artificial Sequence
  Description of Artificial Sequence: Synthetic oligonucleotide
  Target: SCN9A; (-) strand; PAM type: NRG; PAM sequence: GAG
ggaagtgagtctcaggtgct

SEQ ID NO: 29574 - DNA, 20 bp, Artificial Sequence
  Description of Artificial Sequence: Synthetic oligonucleotide
  Target: SCN9A; (-) strand; PAM type: NRG; PAM sequence: AGG
atgcaaaggaagtgagtctc

SEQ ID NO: 29575 - DNA, 20 bp, Artificial Sequence
  Description of Artificial Sequence: Synthetic oligonucleotide
  Target: SCN9A; (-) strand; PAM type: NRG; PAM sequence: CAG
catgcaaaggaagtgagtct

SEQ ID NO: 29576 - DNA, 20 bp, Artificial Sequence
  Description of Artificial Sequence: Synthetic oligonucleotide
  Target: SCN9A; (-) strand; PAM type: NRG; PAM sequence: GAG
aaatgccatgcaaaggaagt

SEQ ID NO: 29577 - DNA, 20 bp, Artificial Sequence
  Description of Artificial Sequence: Synthetic oligonucleotide
  Target: SCN9A; (-) strand; PAM type: NRG; PAM sequence: AAG
taataaatgccatgcaaagg

SEQ ID NO: 29578 - DNA, 20 bp, Artificial Sequence
  Description of Artificial Sequence: Synthetic oligonucleotide
  Target: SCN9A; (-) strand; PAM type: NRG; PAM sequence: AGG
ttataataaatgccatgcaa

SEQ ID NO: 29579 - DNA, 20 bp, Artificial Sequence
  Description of Artificial Sequence: Synthetic oligonucleotide
  Target: SCN9A; (-) strand; PAM type: NRG; PAM sequence: AAG
gttataataaatgccatgca

SEQ ID NO: 29580 - DNA, 20 bp, Artificial Sequence
  Description of Artificial Sequence: Synthetic oligonucleotide
  Target: SCN9A; (-) strand; PAM type: NRG; PAM sequence: AAG
aaataaattaaaaatatctc

SEQ ID NO: 29581 - DNA, 20 bp, Artificial Sequence
  Description of Artificial Sequence: Synthetic oligonucleotide
  Target: SCN9A; (-) strand; PAM type: NRG; PAM sequence: CAG
aaaaaatgtttaagggggaa

SEQ ID NO: 29582 - DNA, 20 bp, Artificial Sequence
  Description of Artificial Sequence: Synthetic oligonucleotide
  Target: SCN9A; (-) strand; PAM type: NRG; PAM sequence: GGG
atgaaaaaaaatgtttaagg

SEQ ID NO: 29583 - DNA, 20 bp, Artificial Sequence
  Description of Artificial Sequence: Synthetic oligonucleotide
  Target: SCN9A; (-) strand; PAM type: NRG; PAM sequence: GGG
aatgaaaaaaaatgtttaag

SEQ ID NO: 29584 - DNA, 20 bp, Artificial Sequence
  Description of Artificial Sequence: Synthetic oligonucleotide
  Target: SCN9A; (-) strand; PAM type: NRG; PAM sequence: GGG
gaatgaaaaaaaatgtttaa

SEQ ID NO: 29585 - DNA, 20 bp, Artificial Sequence
  Description of Artificial Sequence: Synthetic oligonucleotide
  Target: SCN9A; (-) strand; PAM type: NRG; PAM sequence: AGG
ggaatgaaaaaaaatgttta

SEQ ID NO: 29586 - DNA, 20 bp, Artificial Sequence
  Description of Artificial Sequence: Synthetic oligonucleotide
  Target: SCN9A; (-) strand; PAM type: NRG; PAM sequence: AAG
gggaatgaaaaaaaatgttt

SEQ ID NO: 29587 - DNA, 20 bp, Artificial Sequence
  Description of Artificial Sequence: Synthetic oligonucleotide
  Target: SCN9A; (-) strand; PAM type: NRG; PAM sequence: GGG
cacagagcttatcatctagt

SEQ ID NO: 29588 - DNA, 20 bp, Artificial Sequence
  Description of Artificial Sequence: Synthetic oligonucleotide
  Target: SCN9A; (-) strand; PAM type: NRG; PAM sequence: TGG
tcacagagcttatcatctag

SEQ ID NO: 29589 - DNA, 20 bp, Artificial Sequence
  Description of Artificial Sequence: Synthetic oligonucleotide
  Target: SCN9A; (-) strand; PAM type: NRG; PAM sequence: TAG
ctttcacagagcttatcatc

SEQ ID NO: 29590 - DNA, 20 bp, Artificial Sequence
  Description of Artificial Sequence: Synthetic oligonucleotide
  Target: SCN9A; (-) strand; PAM type: NRG; PAM sequence: GAG
cctcagcccttgctttcaca

SEQ ID NO: 29591 - DNA, 20 bp, Artificial Sequence
  Description of Artificial Sequence: Synthetic oligonucleotide
  Target: SCN9A; (-) strand; PAM type: NRG; PAM sequence: CAG
agcctcagcccttgctttca

SEQ ID NO: 29592 - DNA, 20 bp, Artificial Sequence
  Description of Artificial Sequence: Synthetic oligonucleotide
  Target: SCN9A; (-) strand; PAM type: NRG; PAM sequence: CAG
atagcaataaatgatagcct

SEQ ID NO: 29593 - DNA, 20 bp, Artificial Sequence
  Description of Artificial Sequence: Synthetic oligonucleotide
  Target: SCN9A; (-) strand; PAM type: NRG; PAM sequence: TAG
tgagctatagcaataaatga

SEQ ID NO: 29594 - DNA, 20 bp, Artificial Sequence
  Description of Artificial Sequence: Synthetic oligonucleotide
  Target: SCN9A; (-) strand; PAM type: NRG; PAM sequence: TAG
tacatggtttccctgagcta

SEQ ID NO: 29595 - DNA, 20 bp, Artificial Sequence
  Description of Artificial Sequence: Synthetic oligonucleotide
  Target: SCN9A; (-) strand; PAM type: NRG; PAM sequence: GAG
gtttattacatggtttccct

SEQ ID NO: 29596 - DNA, 20 bp, Artificial Sequence
  Description of Artificial Sequence: Synthetic oligonucleotide
  Target: SCN9A; (-) strand; PAM type: NRG; PAM sequence: TGG
ttattggtgcgtttattaca

SEQ ID NO: 29597 - DNA, 20 bp, Artificial Sequence
  Description of Artificial Sequence: Synthetic oligonucleotide
  Target: SCN9A; (-) strand; PAM type: NRG; PAM sequence: TGG
tgattcaaactttcatttat

SEQ ID NO: 29598 - DNA, 20 bp, Artificial Sequence
  Description of Artificial Sequence: Synthetic oligonucleotide
  Target: SCN9A; (-) strand; PAM type: NRG; PAM sequence: AAG
ttctgtttcctatgtcatag

SEQ ID NO: 29599 - DNA, 20 bp, Artificial Sequence
  Description of Artificial Sequence: Synthetic oligonucleotide
  Target: SCN9A; (-) strand; PAM type: NRG; PAM sequence: TAG
tgcttctgtttcctatgtca

SEQ ID NO: 29600 - DNA, 20 bp, Artificial Sequence
  Description of Artificial Sequence: Synthetic oligonucleotide
  Target: SCN9A; (-) strand; PAM type: NRG; PAM sequence: AAG
agtgaagaggtgtttaaatc

SEQ ID NO: 29601 - DNA, 20 bp, Artificial Sequence
  Description of Artificial Sequence: Synthetic oligonucleotide
  Target: SCN9A; (-) strand; PAM type: NRG; PAM sequence: AGG
gaaatgtagttttagtgaag

SEQ ID NO: 29602 - DNA, 20 bp, Artificial Sequence
  Description of Artificial Sequence: Synthetic oligonucleotide
  Target: SCN9A; (-) strand; PAM type: NRG; PAM sequence: GAG
tgaaatgtagttttagtgaa

SEQ ID NO: 29603 - DNA, 20 bp, Artificial Sequence
  Description of Artificial Sequence: Synthetic oligonucleotide
  Target: SCN9A; (-) strand; PAM type: NRG; PAM sequence: AAG
tctgaaatgtagttttagtg

SEQ ID NO: 29604 - DNA, 20 bp, Artificial Sequence
  Description of Artificial Sequence: Synthetic oligonucleotide
  Target: SCN9A; (-) strand; PAM type: NRG; PAM sequence: TAG
tttcttctgaaatgtagttt

SEQ ID NO: 29605 - DNA, 20 bp, Artificial Sequence
  Description of Artificial Sequence: Synthetic oligonucleotide
  Target: SCN9A; (-) strand; PAM type: NRG; PAM sequence: TAG
ctttattttcttctgaaatg

SEQ ID NO: 29606 - DNA, 20 bp, Artificial Sequence
  Description of Artificial Sequence: Synthetic oligonucleotide
  Target: SCN9A; (-) strand; PAM type: NRG; PAM sequence: TAG
aaacatgaatgcatgacaat

SEQ ID NO: 29607 - DNA, 20 bp, Artificial Sequence
  Description of Artificial Sequence: Synthetic oligonucleotide
  Target: SCN9A; (-) strand; PAM type: NRG; PAM sequence: GAG
ataataataatagagccctt

SEQ ID NO: 29608 - DNA, 20 bp, Artificial Sequence
  Description of Artificial Sequence: Synthetic oligonucleotide
  Target: SCN9A; (-) strand; PAM type: NRG; PAM sequence: GAG
ataaattaataataataata

SEQ ID NO: 29609 - DNA, 20 bp, Artificial Sequence
  Description of Artificial Sequence: Synthetic oligonucleotide
  Target: SCN9A; (-) strand; PAM type: NRG; PAM sequence: TAG
taataaattaataataataa

SEQ ID NO: 29610 - DNA, 20 bp, Artificial Sequence
  Description of Artificial Sequence: Synthetic oligonucleotide
  Target: SCN9A; (-) strand; PAM type: NRG; PAM sequence: GAG
cactccagcctgggcaacaa

SEQ ID NO: 29611 - DNA, 20 bp, Artificial Sequence
  Description of Artificial Sequence: Synthetic oligonucleotide
  Target: SCN9A; (-) strand; PAM type: NRG; PAM sequence: AAG
tgcactccagcctgggcaac

SEQ ID NO: 29612 - DNA, 20 bp, Artificial Sequence
  Description of Artificial Sequence: Synthetic oligonucleotide
  Target: SCN9A; (-) strand; PAM type: NRG; PAM sequence: GGG
gtgccattgcactccagcct

SEQ ID NO: 29613 - DNA, 20 bp, Artificial Sequence
  Description of Artificial Sequence: Synthetic oligonucleotide
  Target: SCN9A; (-) strand; PAM type: NRG; PAM sequence: TGG
cgtgccattgcactccagcc

SEQ ID NO: 29614 - DNA, 20 bp, Artificial Sequence
  Description of Artificial Sequence: Synthetic oligonucleotide
  Target: SCN9A; (-) strand; PAM type: NRG; PAM sequence: CAG
gagatcgtgccattgcactc

SEQ ID NO: 29615 - DNA, 20 bp, Artificial Sequence
  Description of Artificial Sequence: Synthetic oligonucleotide
  Target: SCN9A; (-) strand; PAM type: NRG; PAM sequence: GAG
ggcagaggttgcggtgagcc

SEQ ID NO: 29616 - DNA, 20 bp, Artificial Sequence
  Description of Artificial Sequence: Synthetic oligonucleotide
  Target: SCN9A; (-) strand; PAM type: NRG; PAM sequence: GAG
cgggaggcagaggttgcggt

SEQ ID NO: 29617 - DNA, 20 bp, Artificial Sequence
  Description of Artificial Sequence: Synthetic oligonucleotide
  Target: SCN9A; (-) strand; PAM type: NRG; PAM sequence: CGG
aactcgggaggcagaggttg

SEQ ID NO: 29618 - DNA, 20 bp, Artificial Sequence
  Description of Artificial Sequence: Synthetic oligonucleotide
  Target: SCN9A; (-) strand; PAM type: NRG; PAM sequence: AGG
cgcttgaactcgggaggcag

SEQ ID NO: 29619 - DNA, 20 bp, Artificial Sequence
  Description of Artificial Sequence: Synthetic oligonucleotide
  Target: SCN9A; (-) strand; PAM type: NRG; PAM sequence: GAG
tcgcttgaactcgggaggca

SEQ ID NO: 29620 - DNA, 20 bp, Artificial Sequence
  Description of Artificial Sequence: Synthetic oligonucleotide
  Target: SCN9A; (-) strand; PAM type: NRG; PAM sequence: CAG
aatcgcttgaactcgggagg

SEQ ID NO: 29621 - DNA, 20 bp, Artificial Sequence
  Description of Artificial Sequence: Synthetic oligonucleotide
  Target: SCN9A; (-) strand; PAM type: NRG; PAM sequence: AGG
gagaatcgcttgaactcggg

SEQ ID NO: 29622 - DNA, 20 bp, Artificial Sequence
  Description of Artificial Sequence: Synthetic oligonucleotide
  Target: SCN9A; (-) strand; PAM type: NRG; PAM sequence: GAG
ggagaatcgcttgaactcgg

SEQ ID NO: 29623 - DNA, 20 bp, Artificial Sequence
  Description of Artificial Sequence: Synthetic oligonucleotide
  Target: SCN9A; (-) strand; PAM type: NRG; PAM sequence: GGG
caggagaatcgcttgaactc

SEQ ID NO: 29624 - DNA, 20 bp, Artificial Sequence
  Description of Artificial Sequence: Synthetic oligonucleotide
  Target: SCN9A; (-) strand; PAM type: NRG; PAM sequence: CGG
gcaggagaatcgcttgaact

SEQ ID NO: 29625 - DNA, 20 bp, Artificial Sequence
  Description of Artificial Sequence: Synthetic oligonucleotide
  Target: SCN9A; (-) strand; PAM type: NRG; PAM sequence: GAG
tactcaggaggctgaggcag

SEQ ID NO: 29626 - DNA, 20 bp, Artificial Sequence
  Description of Artificial Sequence: Synthetic oligonucleotide
  Target: SCN9A; (-) strand; PAM type: NRG; PAM sequence: AGG
gctactcaggaggctgaggc

SEQ ID NO: 29627 - DNA, 20 bp, Artificial Sequence
  Description of Artificial Sequence: Synthetic oligonucleotide
  Target: SCN9A; (-) strand; PAM type: NRG; PAM sequence: CAG
agctactcaggaggctgagg

SEQ ID NO: 29628 - DNA, 20 bp, Artificial Sequence
  Description of Artificial Sequence: Synthetic oligonucleotide
  Target: SCN9A; (-) strand; PAM type: NRG; PAM sequence: AGG
tccagctactcaggaggctg

SEQ ID NO: 29629 - DNA, 20 bp, Artificial Sequence
  Description of Artificial Sequence: Synthetic oligonucleotide
  Target: SCN9A; (-) strand; PAM type: NRG; PAM sequence: GAG
ttccagctactcaggaggct

SEQ ID NO: 29630 - DNA, 20 bp, Artificial Sequence
  Description of Artificial Sequence: Synthetic oligonucleotide
  Target: SCN9A; (-) strand; PAM type: NRG; PAM sequence: AGG
tgtaattccagctactcagg

SEQ ID NO: 29631 - DNA, 20 bp, Artificial Sequence
  Description of Artificial Sequence: Synthetic oligonucleotide
  Target: SCN9A; (-) strand; PAM type: NRG; PAM sequence: GAG
ctgtaattccagctactcag

SEQ ID NO: 29632 - DNA, 20 bp, Artificial Sequence
  Description of Artificial Sequence: Synthetic oligonucleotide
  Target: SCN9A; (-) strand; PAM type: NRG; PAM sequence: AGG
gcctgtaattccagctactc

SEQ ID NO: 29633 - DNA, 20 bp, Artificial Sequence
  Description of Artificial Sequence: Synthetic oligonucleotide
  Target: SCN9A; (-) strand; PAM type: NRG; PAM sequence: CAG
cgcctgtaattccagctact

SEQ ID NO: 29634 - DNA, 20 bp, Artificial Sequence
  Description of Artificial Sequence: Synthetic oligonucleotide
  Target: SCN9A; (-) strand; PAM type: NRG; PAM sequence: CAG
gtggtgggcgcctgtaattc

SEQ ID NO: 29635 - DNA, 20 bp, Artificial Sequence
  Description of Artificial Sequence: Synthetic oligonucleotide
  Target: SCN9A; (-) strand; PAM type: NRG; PAM sequence: GGG
aattagccgggcatggtggt

SEQ ID NO: 29636 - DNA, 20 bp, Artificial Sequence
  Description of Artificial Sequence: Synthetic oligonucleotide
  Target: SCN9A; (-) strand; PAM type: NRG; PAM sequence: TGG
aaattagccgggcatggtgg

SEQ ID NO: 29637 - DNA, 20 bp, Artificial Sequence
  Description of Artificial Sequence: Synthetic oligonucleotide
  Target: SCN9A; (-) strand; PAM type: NRG; PAM sequence: TGG
aaaaaattagccgggcatgg

SEQ ID NO: 29638 - DNA, 20 bp, Artificial Sequence
  Description of Artificial Sequence: Synthetic oligonucleotide
  Target: SCN9A; (-) strand; PAM type: NRG; PAM sequence: TGG
tacaaaaaattagccgggca

SEQ ID NO: 29639 - DNA, 20 bp, Artificial Sequence
  Description of Artificial Sequence: Synthetic oligonucleotide
  Target: SCN9A; (-) strand; PAM type: NRG; PAM sequence: GGG
aaaaatacaaaaaattagcc

SEQ ID NO: 29640 - DNA, 20 bp, Artificial Sequence
  Description of Artificial Sequence: Synthetic oligonucleotide
  Target: SCN9A; (-) strand; PAM type: NRG; PAM sequence: CGG
taaaaatacaaaaaattagc

SEQ ID NO: 29641 - DNA, 20 bp, Artificial Sequence
  Description of Artificial Sequence: Synthetic oligonucleotide
  Target: SCN9A; (-) strand; PAM type: NRG; PAM sequence: TAG
ctactaaaaatacaaaaaat

SEQ ID NO: 29642 - DNA, 20 bp, Artificial Sequence
  Description of Artificial Sequence: Synthetic oligonucleotide
  Target: SCN9A; (-) strand; PAM type: NRG; PAM sequence: AAG
acaaaaaaagaagaaaaaaa

SEQ ID NO: 29643 - DNA, 20 bp, Artificial Sequence
  Description of Artificial Sequence: Synthetic oligonucleotide
  Target: SCN9A; (-) strand; PAM type: NRG; PAM sequence: AAG
aaaaaataatacaaaaaaag

SEQ ID NO: 29644 - DNA, 20 bp, Artificial Sequence
  Description of Artificial Sequence: Synthetic oligonucleotide
  Target: SCN9A; (-) strand; PAM type: NRG; PAM sequence: AAG
gctaaaaaataatacaaaaa

SEQ ID NO: 29645 - DNA, 20 bp, Artificial Sequence
  Description of Artificial Sequence: Synthetic oligonucleotide
  Target: SCN9A; (-) strand; PAM type: NRG; PAM sequence: TGG
taatttaattcatcgctttc

SEQ ID NO: 29646 - DNA, 20 bp, Artificial Sequence
  Description of Artificial Sequence: Synthetic oligonucleotide
  Target: SCN9A; (-) strand; PAM type: NRG; PAM sequence: CAG
caattctctatgtacacaga

SEQ ID NO: 29647 - DNA, 20 bp, Artificial Sequence
  Description of Artificial Sequence: Synthetic oligonucleotide
  Target: SCN9A; (-) strand; PAM type: NRG; PAM sequence: CAG
attgcaattctctatgtaca

SEQ ID NO: 29648 - DNA, 20 bp, Artificial Sequence
  Description of Artificial Sequence: Synthetic oligonucleotide
  Target: SCN9A; (-) strand; PAM type: NRG; PAM sequence: TAG
aatttgtttacatatgaagt

SEQ ID NO: 29649 - DNA, 20 bp, Artificial Sequence
  Description of Artificial Sequence: Synthetic oligonucleotide
  Target: SCN9A; (-) strand; PAM type: NRG; PAM sequence: AAG
atgcaatttgtttacatatg

SEQ ID NO: 29650 - DNA, 20 bp, Artificial Sequence
  Description of Artificial Sequence: Synthetic oligonucleotide
  Target: SCN9A; (-) strand; PAM type: NRG; PAM sequence: TAG
acaagaatatactaatagat

SEQ ID NO: 29651 - DNA, 20 bp, Artificial Sequence
  Description of Artificial Sequence: Synthetic oligonucleotide
  Target: SCN9A; (-) strand; PAM type: NRG; PAM sequence: TAG
ttgttacaagaatatactaa

SEQ ID NO: 29652 - DNA, 20 bp, Artificial Sequence
  Description of Artificial Sequence: Synthetic oligonucleotide
  Target: SCN9A; (-) strand; PAM type: NRG; PAM sequence: AAG
ctgagacagctacttgttac

SEQ ID NO: 29653 - DNA, 20 bp, Artificial Sequence
  Description of Artificial Sequence: Synthetic oligonucleotide
  Target: SCN9A; (-) strand; PAM type: NRG; PAM sequence: CAG
gctgctgtgattggctgaga

SEQ ID NO: 29654 - DNA, 20 bp, Artificial Sequence
  Description of Artificial Sequence: Synthetic oligonucleotide
  Target: SCN9A; (-) strand; PAM type: NRG; PAM sequence: GAG
ctcagctgctgtgattggct

SEQ ID NO: 29655 - DNA, 20 bp, Artificial Sequence
  Description of Artificial Sequence: Synthetic oligonucleotide
  Target: SCN9A; (-) strand; PAM type: NRG; PAM sequence: TGG
tgaagctcagctgctgtgat

SEQ ID NO: 29656 - DNA, 20 bp, Artificial Sequence
  Description of Artificial Sequence: Synthetic oligonucleotide
  Target: SCN9A; (-) strand; PAM type: NRG; PAM sequence: CAG
ggctgtggttggctgaagct

SEQ ID NO: 29657 - DNA, 20 bp, Artificial Sequence
  Description of Artificial Sequence: Synthetic oligonucleotide
  Target: SCN9A; (-) strand; PAM type: NRG; PAM sequence: AAG
cagcaggctgtggttggctg

SEQ ID NO: 29658 - DNA, 20 bp, Artificial Sequence
  Description of Artificial Sequence: Synthetic oligonucleotide
  Target: SCN9A; (-) strand; PAM type: NRG; PAM sequence: TGG
ataaatcagcaggctgtggt

SEQ ID NO: 29659 - DNA, 20 bp, Artificial Sequence
  Description of Artificial Sequence: Synthetic oligonucleotide
  Target: SCN9A; (-) strand; PAM type: NRG; PAM sequence: TGG
tctgataaatcagcaggctg

SEQ ID NO: 29660 - DNA, 20 bp, Artificial Sequence
  Description of Artificial Sequence: Synthetic oligonucleotide
  Target: SCN9A; (-) strand; PAM type: NRG; PAM sequence: AGG
acattgtctgataaatcagc

SEQ ID NO: 29661 - DNA, 20 bp, Artificial Sequence
  Description of Artificial Sequence: Synthetic oligonucleotide
  Target: SCN9A; (-) strand; PAM type: NRG; PAM sequence: CAG
gacattgtctgataaatcag

SEQ ID NO: 29662 - DNA, 20 bp, Artificial Sequence
  Description of Artificial Sequence: Synthetic oligonucleotide
  Target: SCN9A; (-) strand; PAM type: NRG; PAM sequence: CAG
gtggacattgtctgataaat

SEQ ID NO: 29663 - DNA, 20 bp, Artificial Sequence
  Description of Artificial Sequence: Synthetic oligonucleotide
  Target: SCN9A; (-) strand; PAM type: NRG; PAM sequence: TGG
agcttgacatttgccttatg

SEQ ID NO: 29664 - DNA, 20 bp, Artificial Sequence
  Description of Artificial Sequence: Synthetic oligonucleotide
  Target: SCN9A; (-) strand; PAM type: NRG; PAM sequence: TAG
aaaaacagcttgattgctta

SEQ ID NO: 29665 - DNA, 20 bp, Artificial Sequence
  Description of Artificial Sequence: Synthetic oligonucleotide
  Target: SCN9A; (-) strand; PAM type: NRG; PAM sequence: CAG
aagggagtgacgcacaaaaa

SEQ ID NO: 29666 - DNA, 20 bp, Artificial Sequence
  Description of Artificial Sequence: Synthetic oligonucleotide
  Target: SCN9A; (-) strand; PAM type: NRG; PAM sequence: GAG
tatttatagacagaaaaagg

SEQ ID NO: 29667 - DNA, 20 bp, Artificial Sequence
  Description of Artificial Sequence: Synthetic oligonucleotide
  Target: SCN9A; (-) strand; PAM type: NRG; PAM sequence: GGG
agtatttatagacagaaaaa

SEQ ID NO: 29668 - DNA, 20 bp, Artificial Sequence
  Description of Artificial Sequence: Synthetic oligonucleotide
  Target: SCN9A; (-) strand; PAM type: NRG; PAM sequence: AGG
gagtatttatagacagaaaa

SEQ ID NO: 29669 - DNA, 20 bp, Artificial Sequence
  Description of Artificial Sequence: Synthetic oligonucleotide
  Target: SCN9A; (-) strand; PAM type: NRG; PAM sequence: AAG
ggagtatttatagacagaaa

SEQ ID NO: 29670 - DNA, 20 bp, Artificial Sequence
  Description of Artificial Sequence: Synthetic oligonucleotide
  Target: SCN9A; (-) strand; PAM type: NRG; PAM sequence: CAG
tgagcaggagtatttataga

SEQ ID NO: 29671 - DNA, 20 bp, Artificial Sequence
  Description of Artificial Sequence: Synthetic oligonucleotide
  Target: SCN9A; (-) strand; PAM type: NRG; PAM sequence: TAG
aacatgagcaggagtattta

SEQ ID NO: 29672 - DNA, 20 bp, Artificial Sequence
  Description of Artificial Sequence: Synthetic oligonucleotide
  Target: SCN9A; (-) strand; PAM type: NRG; PAM sequence: GAG
caactcagcaacatgagcag

SEQ ID NO: 29673 - DNA, 20 bp, Artificial Sequence
  Description of Artificial Sequence: Synthetic oligonucleotide
  Target: SCN9A; (-) strand; PAM type: NRG; PAM sequence: AGG
ctcaactcagcaacatgagc

SEQ ID NO: 29674 - DNA, 20 bp, Artificial Sequence
  Description of Artificial Sequence: Synthetic oligonucleotide
  Target: SCN9A; (-) strand; PAM type: NRG; PAM sequence: CAG
gctcaactcagcaacatgag

SEQ ID NO: 29675 - DNA, 20 bp, Artificial Sequence
  Description of Artificial Sequence: Synthetic oligonucleotide
  Target: SCN9A; (-) strand; PAM type: NRG; PAM sequence: GAG
agagctcaactcagcaacat

SEQ ID NO: 29676 - DNA, 20 bp, Artificial Sequence
  Description of Artificial Sequence: Synthetic oligonucleotide
  Target: SCN9A; (-) strand; PAM type: NRG; PAM sequence: CAG
gaagttcggagagctcaact

SEQ ID NO: 29677 - DNA, 20 bp, Artificial Sequence
  Description of Artificial Sequence: Synthetic oligonucleotide
  Target: SCN9A; (-) strand; PAM type: NRG; PAM sequence: GAG
agaaccaagagaagttcgga

SEQ ID NO: 29678 - DNA, 20 bp, Artificial Sequence
  Description of Artificial Sequence: Synthetic oligonucleotide
  Target: SCN9A; (-) strand; PAM type: NRG; PAM sequence: GAG
tcagaaccaagagaagttcg

SEQ ID NO: 29679 - DNA, 20 bp, Artificial Sequence
  Description of Artificial Sequence: Synthetic oligonucleotide
  Target: SCN9A; (-) strand; PAM type: NRG; PAM sequence: CGG
actcagaaccaagagaagtt

SEQ ID NO: 29680 - DNA, 20 bp, Artificial Sequence
  Description of Artificial Sequence: Synthetic oligonucleotide
  Target: SCN9A; (-) strand; PAM type: NRG; PAM sequence: AAG
gcagcactcagaaccaagag

SEQ ID NO: 29681 - DNA, 20 bp, Artificial Sequence
  Description of Artificial Sequence: Synthetic oligonucleotide
  Target: SCN9A; (-) strand; PAM type: NRG; PAM sequence: GAG
taggcagcactcagaaccaa

SEQ ID NO: 29682 - DNA, 20 bp, Artificial Sequence
  Description of Artificial Sequence: Synthetic oligonucleotide
  Target: SCN9A; (-) strand; PAM type: NRG; PAM sequence: AAG
tttaggcagcactcagaacc

SEQ ID NO: 29683 - DNA, 20 bp, Artificial Sequence
  Description of Artificial Sequence: Synthetic oligonucleotide
  Target: SCN9A; (-) strand; PAM type: NRG; PAM sequence: CAG
ataatgatttaggcagcact

SEQ ID NO: 29684 - DNA, 20 bp, Artificial Sequence
  Description of Artificial Sequence: Synthetic oligonucleotide
  Target: SCN9A; (-) strand; PAM type: NRG; PAM sequence: CAG
aataataataatgatttagg

SEQ ID NO: 29685 - DNA, 20 bp, Artificial Sequence
  Description of Artificial Sequence: Synthetic oligonucleotide
  Target: SCN9A; (-) strand; PAM type: NRG; PAM sequence: AGG
gataataataataatgattt

SEQ ID NO: 29686 - DNA, 20 bp, Artificial Sequence
  Description of Artificial Sequence: Synthetic oligonucleotide
  Target: SCN9A; (-) strand; PAM type: NRG; PAM sequence: TAG
agataataataataatgatt

SEQ ID NO: 29687 - DNA, 20 bp, Artificial Sequence
  Description of Artificial Sequence: Synthetic oligonucleotide
  Target: SCN9A; (-) strand; PAM type: NRG; PAM sequence: AAG
atagtatttattgctgaaat

SEQ ID NO: 29688 - DNA, 20 bp, Artificial Sequence
  Description of Artificial Sequence: Synthetic oligonucleotide
  Target: SCN9A; (-) strand; PAM type: NRG; PAM sequence: TAG
agcttatttcagcaatgaaa

SEQ ID NO: 29689 - DNA, 20 bp, Artificial Sequence
  Description of Artificial Sequence: Synthetic oligonucleotide
  Target: SCN9A; (-) strand; PAM type: NRG; PAM sequence: CAG
ttaaatttagcagcttattt

SEQ ID NO: 29690 - DNA, 20 bp, Artificial Sequence
  Description of Artificial Sequence: Synthetic oligonucleotide
  Target: SCN9A; (-) strand; PAM type: NRG; PAM sequence: CAG
tttcaacaaattaaatttag

SEQ ID NO: 29691 - DNA, 20 bp, Artificial Sequence
  Description of Artificial Sequence: Synthetic oligonucleotide
  Target: SCN9A; (-) strand; PAM type: NRG; PAM sequence: TAG
aattttcaacaaattaaatt

SEQ ID NO: 29692 - DNA, 20 bp, Artificial Sequence
  Description of Artificial Sequence: Synthetic oligonucleotide
  Target: SCN9A; (-) strand; PAM type: NRG; PAM sequence: AAG
gttttcttaacctttgttaa

SEQ ID NO: 29693 - DNA, 20 bp, Artificial Sequence
  Description of Artificial Sequence: Synthetic oligonucleotide
  Target: SCN9A; (-) strand; PAM type: NRG; PAM sequence: TGG
ttctgagtttatactgtgaa

SEQ ID NO: 29694 - DNA, 20 bp, Artificial Sequence
  Description of Artificial Sequence: Synthetic oligonucleotide
  Target: SCN9A; (-) strand; PAM type: NRG; PAM sequence: GAG
tgagtcttgctcctatttct

SEQ ID NO: 29695 - DNA, 20 bp, Artificial Sequence
  Description of Artificial Sequence: Synthetic oligonucleotide
  Target: SCN9A; (-) strand; PAM type: NRG; PAM sequence: GAG
gggatctgtccttttattct

SEQ ID NO: 29696 - DNA, 20 bp, Artificial Sequence
  Description of Artificial Sequence: Synthetic oligonucleotide
  Target: SCN9A; (-) strand; PAM type: NRG; PAM sequence: GGG
taaacttaagttttctcact

SEQ ID NO: 29697 - DNA, 20 bp, Artificial Sequence
  Description of Artificial Sequence: Synthetic oligonucleotide
  Target: SCN9A; (-) strand; PAM type: NRG; PAM sequence: TGG
ttaaacttaagttttctcac

SEQ ID NO: 29698 - DNA, 20 bp, Artificial Sequence
  Description of Artificial Sequence: Synthetic oligonucleotide
  Target: SCN9A; (-) strand; PAM type: NRG; PAM sequence: AAG
taccacacttatttaaactt

SEQ ID NO: 29699 - DNA, 20 bp, Artificial Sequence
  Description of Artificial Sequence: Synthetic oligonucleotide
  Target: SCN9A; (-) strand; PAM type: NRG; PAM sequence: TAG
gtaacttacatttaatattg

SEQ ID NO: 29700 - DNA, 20 bp, Artificial Sequence
  Description of Artificial Sequence: Synthetic oligonucleotide
  Target: SCN9A; (-) strand; PAM type: NRG; PAM sequence: GAG
gtaaaattaatatatctgat

SEQ ID NO: 29701 - DNA, 20 bp, Artificial Sequence
  Description of Artificial Sequence: Synthetic oligonucleotide
  Target: SCN9A; (-) strand; PAM type: NRG; PAM sequence: GAG
aaacttatttccaatggatg

SEQ ID NO: 29702 - DNA, 20 bp, Artificial Sequence
  Description of Artificial Sequence: Synthetic oligonucleotide
  Target: SCN9A; (-) strand; PAM type: NRG; PAM sequence: TGG
tgaaacttatttccaatgga

SEQ ID NO: 29703 - DNA, 20 bp, Artificial Sequence
  Description of Artificial Sequence: Synthetic oligonucleotide
  Target: SCN9A; (-) strand; PAM type: NRG; PAM sequence: TGG
gatttgaaacttatttccaa

SEQ ID NO: 29704 - DNA, 20 bp, Artificial Sequence
  Description of Artificial Sequence: Synthetic oligonucleotide
  Target: SCN9A; (-) strand; PAM type: NRG; PAM sequence: CAG
tttatatttaccctcttttc

SEQ ID NO: 29705 - DNA, 20 bp, Artificial Sequence
  Description of Artificial Sequence: Synthetic oligonucleotide
  Target: SCN9A; (-) strand; PAM type: NRG; PAM sequence: TAG
ccaccatttgatgaggaatt

SEQ ID NO: 29706 - DNA, 20 bp, Artificial Sequence
  Description of Artificial Sequence: Synthetic oligonucleotide
  Target: SCN9A; (-) strand; PAM type: NRG; PAM sequence: AGG
tttactaccaccatttgatg

SEQ ID NO: 29707 - DNA, 20 bp, Artificial Sequence
  Description of Artificial Sequence: Synthetic oligonucleotide
  Target: SCN9A; (-) strand; PAM type: NRG; PAM sequence: GAG
ttttactaccaccatttgat

SEQ ID NO: 29708 - DNA, 20 bp, Artificial Sequence
  Description of Artificial Sequence: Synthetic oligonucleotide
  Target: SCN9A; (-) strand; PAM type: NRG; PAM sequence: TAG
aagttttgaagtaaaatgtt

SEQ ID NO: 29709 - DNA, 20 bp, Artificial Sequence
  Description of Artificial Sequence: Synthetic oligonucleotide
  Target: SCN9A; (-) strand; PAM type: NRG; PAM sequence: AAG
caagaaaactgaaagttttg

SEQ ID NO: 29710 - DNA, 20 bp, Artificial Sequence
  Description of Artificial Sequence: Synthetic oligonucleotide
  Target: SCN9A; (-) strand; PAM type: NRG; PAM sequence: AAG
agccttaacaagaaaactga

SEQ ID NO: 29711 - DNA, 20 bp, Artificial Sequence
  Description of Artificial Sequence: Synthetic oligonucleotide
  Target: SCN9A; (-) strand; PAM type: NRG; PAM sequence: AAG
aaaaaaatagaagccttaac

SEQ ID NO: 29712 - DNA, 20 bp, Artificial Sequence
  Description of Artificial Sequence: Synthetic oligonucleotide
  Target: SCN9A; (-) strand; PAM type: NRG; PAM sequence: AAG
aaaatgacagaaaaaaatag

SEQ ID NO: 29713 - DNA, 20 bp, Artificial Sequence
  Description of Artificial Sequence: Synthetic oligonucleotide
  Target: SCN9A; (-) strand; PAM type: NRG; PAM sequence: TAG
aataaaatgacagaaaaaaa

SEQ ID NO: 29714 - DNA, 20 bp, Artificial Sequence
  Description of Artificial Sequence: Synthetic oligonucleotide
  Target: SCN9A; (-) strand; PAM type: NRG; PAM sequence: CAG
aaagactataaataaaatga

SEQ ID NO: 29715 - DNA, 20 bp, Artificial Sequence
  Description of Artificial Sequence: Synthetic oligonucleotide
  Target: SCN9A; (-) strand; PAM type: NRG; PAM sequence: AAG
acacctagcccacatggtaa

SEQ ID NO: 29716 - DNA, 20 bp, Artificial Sequence
  Description of Artificial Sequence: Synthetic oligonucleotide
  Target: SCN9A; (-) strand; PAM type: NRG; PAM sequence: TGG
caaataacacctagcccaca

SEQ ID NO: 29717 - DNA, 20 bp, Artificial Sequence
  Description of Artificial Sequence: Synthetic oligonucleotide
  Target: SCN9A; (-) strand; PAM type: NRG; PAM sequence: TAG
aaataaaatcaaataacacc

SEQ ID NO: 29718 - DNA, 20 bp, Artificial Sequence
  Description of Artificial Sequence: Synthetic oligonucleotide
  Target: SCN9A; (-) strand; PAM type: NRG; PAM sequence: AAG
gattctccttagataataaa

SEQ ID NO: 29719 - DNA, 20 bp, Artificial Sequence
  Description of Artificial Sequence: Synthetic oligonucleotide
  Target: SCN9A; (-) strand; PAM type: NRG; PAM sequence: TAG
ggaaaggtcaggattctcct

SEQ ID NO: 29720 - DNA, 20 bp, Artificial Sequence
  Description of Artificial Sequence: Synthetic oligonucleotide
  Target: SCN9A; (-) strand; PAM type: NRG; PAM sequence: AGG
gaaatgagggaggaaaggtc

SEQ ID NO: 29721 - DNA, 20 bp, Artificial Sequence
  Description of Artificial Sequence: Synthetic oligonucleotide
  Target: SCN9A; (-) strand; PAM type: NRG; PAM sequence: CAG
ggaaatgagggaggaaaggt

SEQ ID NO: 29722 - DNA, 20 bp, Artificial Sequence
  Description of Artificial Sequence: Synthetic oligonucleotide
  Target: SCN9A; (-) strand; PAM type: NRG; PAM sequence: AGG
aaaaggaaatgagggaggaa

SEQ ID NO: 29723 - DNA, 20 bp, Artificial Sequence
  Description of Artificial Sequence: Synthetic oligonucleotide
  Target: SCN9A; (-) strand; PAM type: NRG; PAM sequence: AAG
caaaaggaaatgagggagga

SEQ ID NO: 29724 - DNA, 20 bp, Artificial Sequence
  Description of Artificial Sequence: Synthetic oligonucleotide
  Target: SCN9A; (-) strand; PAM type: NRG; PAM sequence: AGG
ttgccaaaaggaaatgaggg

SEQ ID NO: 29725 - DNA, 20 bp, Artificial Sequence
  Description of Artificial Sequence: Synthetic oligonucleotide
  Target: SCN9A; (-) strand; PAM type: NRG; PAM sequence: GAG
gttgccaaaaggaaatgagg

SEQ ID NO: 29726 - DNA, 20 bp, Artificial Sequence
  Description of Artificial Sequence: Synthetic oligonucleotide
  Target: SCN9A; (-) strand; PAM type: NRG; PAM sequence: GGG
ctgttgccaaaaggaaatga

SEQ ID NO: 29727 - DNA, 20 bp, Artificial Sequence
  Description of Artificial Sequence: Synthetic oligonucleotide
  Target: SCN9A; (-) strand; PAM type: NRG; PAM sequence: AGG
gctgttgccaaaaggaaatg

SEQ ID NO: 29728 - DNA, 20 bp, Artificial Sequence
  Description of Artificial Sequence: Synthetic oligonucleotide
  Target: SCN9A; (-) strand; PAM type: NRG; PAM sequence: GAG
tgctgttgccaaaaggaaat

SEQ ID NO: 29729 - DNA, 20 bp, Artificial Sequence
  Description of Artificial Sequence: Synthetic oligonucleotide
  Target: SCN9A; (-) strand; PAM type: NRG; PAM sequence: AGG
atatatgtgctgttgccaaa

SEQ ID NO: 29730 - DNA, 20 bp, Artificial Sequence
  Description of Artificial Sequence: Synthetic oligonucleotide
  Target: SCN9A; (-) strand; PAM type: NRG; PAM sequence: AAG
aatatatgtgctgttgccaa

SEQ ID NO: 29731 - DNA, 20 bp, Artificial Sequence
  Description of Artificial Sequence: Synthetic oligonucleotide
  Target: SCN9A; (-) strand; PAM type: NRG; PAM sequence: AAG
ttgacccaggtgtggtatgg

SEQ ID NO: 29732 - DNA, 20 bp, Artificial Sequence
  Description of Artificial Sequence: Synthetic oligonucleotide
  Target: SCN9A; (-) strand; PAM type: NRG; PAM sequence: TGG
aatttgacccaggtgtggta

SEQ ID NO: 29733 - DNA, 20 bp, Artificial Sequence
  Description of Artificial Sequence: Synthetic oligonucleotide
  Target: SCN9A; (-) strand; PAM type: NRG; PAM sequence: TGG
tagataatttgacccaggtg

SEQ ID NO: 29734 - DNA, 20 bp, Artificial Sequence
  Description of Artificial Sequence: Synthetic oligonucleotide
  Target: SCN9A; (-) strand; PAM type: NRG; PAM sequence: AGG
cttaatagataatttgaccc

SEQ ID NO: 29735 - DNA, 20 bp, Artificial Sequence
  Description of Artificial Sequence: Synthetic oligonucleotide
  Target: SCN9A; (-) strand; PAM type: NRG; PAM sequence: CAG
tcttaatagataatttgacc

SEQ ID NO: 29736 - DNA, 20 bp, Artificial Sequence
  Description of Artificial Sequence: Synthetic oligonucleotide
  Target: SCN9A; (-) strand; PAM type: NRG; PAM sequence: TAG
cgtgaatacataaatcttaa

SEQ ID NO: 29737 - DNA, 20 bp, Artificial Sequence
  Description of Artificial Sequence: Synthetic oligonucleotide
  Target: SCN9A; (-) strand; PAM type: NRG; PAM sequence: TGG
cctggaatgtatctatctga

SEQ ID NO: 29738 - DNA, 20 bp, Artificial Sequence
  Description of Artificial Sequence: Synthetic oligonucleotide
  Target: SCN9A; (-) strand; PAM type: NRG; PAM sequence: TGG
tgtactttctgtctgacacc

SEQ ID NO: 29739 - DNA, 20 bp, Artificial Sequence
  Description of Artificial Sequence: Synthetic oligonucleotide
  Target: SCN9A; (-) strand; PAM type: NRG; PAM sequence: AAG
tattggatgaagatatgatc

SEQ ID NO: 29740 - DNA, 20 bp, Artificial Sequence
  Description of Artificial Sequence: Synthetic oligonucleotide
  Target: SCN9A; (-) strand; PAM type: NRG; PAM sequence: AAG
cggttgatgaatattggatg

SEQ ID NO: 29741 - DNA, 20 bp, Artificial Sequence
  Description of Artificial Sequence: Synthetic oligonucleotide
  Target: SCN9A; (-) strand; PAM type: NRG; PAM sequence: TGG
ctggaacggttgatgaatat

SEQ ID NO: 29742 - DNA, 20 bp, Artificial Sequence
  Description of Artificial Sequence: Synthetic oligonucleotide
  Target: SCN9A; (-) strand; PAM type: NRG; PAM sequence: CGG
catggtgtctctcactggaa

SEQ ID NO: 29743 - DNA, 20 bp, Artificial Sequence
  Description of Artificial Sequence: Synthetic oligonucleotide
  Target: SCN9A; (-) strand; PAM type: NRG; PAM sequence: TGG
cctagcatggtgtctctcac

SEQ ID NO: 29744 - DNA, 20 bp, Artificial Sequence
  Description of Artificial Sequence: Synthetic oligonucleotide
  Target: SCN9A; (-) strand; PAM type: NRG; PAM sequence: TGG
taaacaattatcccctagca

SEQ ID NO: 29745 - DNA, 20 bp, Artificial Sequence
  Description of Artificial Sequence: Synthetic oligonucleotide
  Target: SCN9A; (-) strand; PAM type: NRG; PAM sequence: TAG
ttctctaaacaattatcccc

SEQ ID NO: 29746 - DNA, 20 bp, Artificial Sequence
  Description of Artificial Sequence: Synthetic oligonucleotide
  Target: SCN9A; (-) strand; PAM type: NRG; PAM sequence: AAG
caattagagtttcttacata

SEQ ID NO: 29747 - DNA, 20 bp, Artificial Sequence
  Description of Artificial Sequence: Synthetic oligonucleotide
  Target: SCN9A; (-) strand; PAM type: NRG; PAM sequence: GAG
taattcagaagtatcaatta

SEQ ID NO: 29748 - DNA, 20 bp, Artificial Sequence
  Description of Artificial Sequence: Synthetic oligonucleotide
  Target: SCN9A; (-) strand; PAM type: NRG; PAM sequence: TAG
cttaattcagaagtatcaat

SEQ ID NO: 29749 - DNA, 20 bp, Artificial Sequence
  Description of Artificial Sequence: Synthetic oligonucleotide
  Target: SCN9A; (-) strand; PAM type: NRG; PAM sequence: AAG
cagaagtctgcttaattcag

SEQ ID NO: 29750 - DNA, 20 bp, Artificial Sequence
  Description of Artificial Sequence: Synthetic oligonucleotide
  Target: SCN9A; (-) strand; PAM type: NRG; PAM sequence: CAG
tctcagaagtctgcttaatt

SEQ ID NO: 29751 - DNA, 20 bp, Artificial Sequence
  Description of Artificial Sequence: Synthetic oligonucleotide
  Target: SCN9A; (-) strand; PAM type: NRG; PAM sequence: AAG
tcatctgtatgcactctcag

SEQ ID NO: 29752 - DNA, 20 bp, Artificial Sequence
  Description of Artificial Sequence: Synthetic oligonucleotide
  Target: SCN9A; (-) strand; PAM type: NRG; PAM sequence: CAG
agatcatctgtatgcactct

SEQ ID NO: 29753 - DNA, 20 bp, Artificial Sequence
  Description of Artificial Sequence: Synthetic oligonucleotide
  Target: SCN9A; (-) strand; PAM type: NRG; PAM sequence: GAG
tatttctgtaggtaccacat

SEQ ID NO: 29754 - DNA, 20 bp, Artificial Sequence
  Description of Artificial Sequence: Synthetic oligonucleotide
  Target: SCN9A; (-) strand; PAM type: NRG; PAM sequence: AGG
ttcagtagaattatttctgt

SEQ ID NO: 29755 - DNA, 20 bp, Artificial Sequence
  Description of Artificial Sequence: Synthetic oligonucleotide
  Target: SCN9A; (-) strand; PAM type: NRG; PAM sequence: TAG
gttcagtagaattatttctg

SEQ ID NO: 29756 - DNA, 20 bp, Artificial Sequence
  Description of Artificial Sequence: Synthetic oligonucleotide
  Target: SCN9A; (-) strand; PAM type: NRG; PAM sequence: TAG
gatatcaaagtttagttcag

SEQ ID NO: 29757 - DNA, 20 bp, Artificial Sequence
  Description of Artificial Sequence: Synthetic oligonucleotide
  Target: SCN9A; (-) strand; PAM type: NRG; PAM sequence: CAG
caagatatcaaagtttagtt

SEQ ID NO: 29758 - DNA, 20 bp, Artificial Sequence
  Description of Artificial Sequence: Synthetic oligonucleotide
  Target: SCN9A; (-) strand; PAM type: NRG; PAM sequence: TAG
gatggcaagatatcaaagtt

SEQ ID NO: 29759 - DNA, 20 bp, Artificial Sequence
  Description of Artificial Sequence: Synthetic oligonucleotide
  Target: SCN9A; (-) strand; PAM type: NRG; PAM sequence: AAG
aggctgatggcaagatatca

SEQ ID NO: 29760 - DNA, 20 bp, Artificial Sequence
  Description of Artificial Sequence: Synthetic oligonucleotide
  Target: SCN9A; (-) strand; PAM type: NRG; PAM sequence: AAG
cttcaatataggctgatggc

SEQ ID NO: 29761 - DNA, 20 bp, Artificial Sequence
  Description of Artificial Sequence: Synthetic oligonucleotide
  Target: SCN9A; (-) strand; PAM type: NRG; PAM sequence: TGG
cttccttcaatataggctga

SEQ ID NO: 29762 - DNA, 20 bp, Artificial Sequence
  Description of Artificial Sequence: Synthetic oligonucleotide
  Target: SCN9A; (-) strand; PAM type: NRG; PAM sequence: AGG
ttaatggcttccttcaatat

SEQ ID NO: 29763 - DNA, 20 bp, Artificial Sequence
  Description of Artificial Sequence: Synthetic oligonucleotide
  Target: SCN9A; (-) strand; PAM type: NRG; PAM sequence: TAG
tttaatggcttccttcaata

SEQ ID NO: 29764 - DNA, 20 bp, Artificial Sequence
  Description of Artificial Sequence: Synthetic oligonucleotide
  Target: SCN9A; (-) strand; PAM type: NRG; PAM sequence: TGG
agtttcatagctgtttttaa

SEQ ID NO: 29765 - DNA, 20 bp, Artificial Sequence
  Description of Artificial Sequence: Synthetic oligonucleotide
  Target: SCN9A; (-) strand; PAM type: NRG; PAM sequence: TAG
gtaaccaatgacgagtttca

SEQ ID NO: 29766 - DNA, 20 bp, Artificial Sequence
  Description of Artificial Sequence: Synthetic oligonucleotide
  Target: SCN9A; (-) strand; PAM type: NRG; PAM sequence: GAG
tccactttgtaaccaatgac

SEQ ID NO: 29767 - DNA, 20 bp, Artificial Sequence
  Description of Artificial Sequence: Synthetic oligonucleotide
  Target: SCN9A; (-) strand; PAM type: NRG; PAM sequence: CAG
acaaagcaaaatcatttgct

SEQ ID NO: 29768 - DNA, 20 bp, Artificial Sequence
  Description of Artificial Sequence: Synthetic oligonucleotide
  Target: SCN9A; (-) strand; PAM type: NRG; PAM sequence: AAG
tattcctaaagatttgtaca

SEQ ID NO: 29769 - DNA, 20 bp, Artificial Sequence
  Description of Artificial Sequence: Synthetic oligonucleotide
  Target: SCN9A; (-) strand; PAM type: NRG; PAM sequence: AAG
gtatcttgatagtattccta

SEQ ID NO: 29770 - DNA, 20 bp, Artificial Sequence
  Description of Artificial Sequence: Synthetic oligonucleotide
  Target: SCN9A; (-) strand; PAM type: NRG; PAM sequence: TAG
agatagtatctgtatcttga

SEQ ID NO: 29771 - DNA, 20 bp, Artificial Sequence
  Description of Artificial Sequence: Synthetic oligonucleotide
  Target: SCN9A; (-) strand; PAM type: NRG; PAM sequence: TAG
ttaattatcaaatataaaga

SEQ ID NO: 29772 - DNA, 20 bp, Artificial Sequence
  Description of Artificial Sequence: Synthetic oligonucleotide
  Target: SCN9A; (-) strand; PAM type: NRG; PAM sequence: AAG
aatattaattatcaaatata

SEQ ID NO: 29773 - DNA, 20 bp, Artificial Sequence
  Description of Artificial Sequence: Synthetic oligonucleotide
  Target: SCN9A; (-) strand; PAM type: NRG; PAM sequence: AAG
ctcataactataacatctta

SEQ ID NO: 29774 - DNA, 20 bp, Artificial Sequence
  Description of Artificial Sequence: Synthetic oligonucleotide
  Target: SCN9A; (-) strand; PAM type: NRG; PAM sequence: TAG
tgatagatttttatacttaa

SEQ ID NO: 29775 - DNA, 20 bp, Artificial Sequence
  Description of Artificial Sequence: Synthetic oligonucleotide
  Target: SCN9A; (-) strand; PAM type: NRG; PAM sequence: TAG
atgtgacatatttattatga

SEQ ID NO: 29776 - DNA, 20 bp, Artificial Sequence
  Description of Artificial Sequence: Synthetic oligonucleotide
  Target: SCN9A; (-) strand; PAM type: NRG; PAM sequence: TAG
ttttatataattttattata

SEQ ID NO: 29777 - DNA, 20 bp, Artificial Sequence
  Description of Artificial Sequence: Synthetic oligonucleotide
  Target: SCN9A; (-) strand; PAM type: NRG; PAM sequence: TAG
cattacatttaacaatataa

SEQ ID NO: 29778 - DNA, 20 bp, Artificial Sequence
  Description of Artificial Sequence: Synthetic oligonucleotide
  Target: SCN9A; (-) strand; PAM type: NRG; PAM sequence: TAG
tttctctagagaaataaatg

SEQ ID NO: 29779 - DNA, 20 bp, Artificial Sequence
  Description of Artificial Sequence: Synthetic oligonucleotide
  Target: SCN9A; (-) strand; PAM type: NRG; PAM sequence: GAG
aaaaagaattattttctcta

SEQ ID NO: 29780 - DNA, 20 bp, Artificial Sequence
  Description of Artificial Sequence: Synthetic oligonucleotide
  Target: SCN9A; (-) strand; PAM type: NRG; PAM sequence: TAG
taaaaaagaattattttctc

SEQ ID NO: 29781 - DNA, 20 bp, Artificial Sequence
  Description of Artificial Sequence: Synthetic oligonucleotide
  Target: SCN9A; (-) strand; PAM type: NRG; PAM sequence: AAG
ctaatttctatatcataaaa

SEQ ID NO: 29782 - DNA, 20 bp, Artificial Sequence
  Description of Artificial Sequence: Synthetic oligonucleotide
  Target: SCN9A; (-) strand; PAM type: NRG; PAM sequence: TAG
ctggcaaaaggaacacagga

SEQ ID NO: 29783 - DNA, 20 bp, Artificial Sequence
  Description of Artificial Sequence: Synthetic oligonucleotide
  Target: SCN9A; (-) strand; PAM type: NRG; PAM sequence: AGG
agtactggcaaaaggaacac

SEQ ID NO: 29784 - DNA, 20 bp, Artificial Sequence
  Description of Artificial Sequence: Synthetic oligonucleotide
  Target: SCN9A; (-) strand; PAM type: NRG; PAM sequence: CAG
cagtactggcaaaaggaaca

SEQ ID NO: 29785 - DNA, 20 bp, Artificial Sequence
  Description of Artificial Sequence: Synthetic oligonucleotide
  Target: SCN9A; (-) strand; PAM type: NRG; PAM sequence: AGG
tatctagcagtactggcaaa

SEQ ID NO: 29786 - DNA, 20 bp, Artificial Sequence
  Description of Artificial Sequence: Synthetic oligonucleotide
  Target: SCN9A; (-) strand; PAM type: NRG; PAM sequence: AAG
ctatctagcagtactggcaa

SEQ ID NO: 29787 - DNA, 20 bp, Artificial Sequence
  Description of Artificial Sequence: Synthetic oligonucleotide
  Target: SCN9A; (-) strand; PAM type: NRG; PAM sequence: TGG
tctaagctatctagcagtac

SEQ ID NO: 29788 - DNA, 20 bp, Artificial Sequence
  Description of Artificial Sequence: Synthetic oligonucleotide
  Target: SCN9A; (-) strand; PAM type: NRG; PAM sequence: CAG
cctggttctaagctatctag

SEQ ID NO: 29789 - DNA, 20 bp, Artificial Sequence
  Description of Artificial Sequence: Synthetic oligonucleotide
  Target: SCN9A; (-) strand; PAM type: NRG; PAM sequence: TAG
catcctggttctaagctatc

SEQ ID NO: 29790 - DNA, 20 bp, Artificial Sequence
  Description of Artificial Sequence: Synthetic oligonucleotide
  Target: SCN9A; (-) strand; PAM type: NRG; PAM sequence: AAG
tcataaatcatcctggttct

SEQ ID NO: 29791 - DNA, 20 bp, Artificial Sequence
  Description of Artificial Sequence: Synthetic oligonucleotide
  Target: SCN9A; (-) strand; PAM type: NRG; PAM sequence: TGG
atgattttcataaatcatcc

SEQ ID NO: 29792 - DNA, 20 bp, Artificial Sequence
  Description of Artificial Sequence: Synthetic oligonucleotide
  Target: SCN9A; (-) strand; PAM type: NRG; PAM sequence: GGG
agctgctacagtgtgaattt

SEQ ID NO: 29793 - DNA, 20 bp, Artificial Sequence
  Description of Artificial Sequence: Synthetic oligonucleotide
  Target: SCN9A; (-) strand; PAM type: NRG; PAM sequence: TGG
aagctgctacagtgtgaatt

SEQ ID NO: 29794 - DNA, 20 bp, Artificial Sequence
  Description of Artificial Sequence: Synthetic oligonucleotide
  Target: SCN9A; (-) strand; PAM type: NRG; PAM sequence: CAG
aaatatatagaaagctgcta

SEQ ID NO: 29795 - DNA, 20 bp, Artificial Sequence
  Description of Artificial Sequence: Synthetic oligonucleotide
  Target: SCN9A; (-) strand; PAM type: NRG; PAM sequence: AAG
aagctattcaaatatataga

SEQ ID NO: 29796 - DNA, 20 bp, Artificial Sequence
  Description of Artificial Sequence: Synthetic oligonucleotide
  Target: SCN9A; (-) strand; PAM type: NRG; PAM sequence: TAG
ttcaaagctattcaaatata

SEQ ID NO: 29797 - DNA, 20 bp, Artificial Sequence
  Description of Artificial Sequence: Synthetic oligonucleotide
  Target: SCN9A; (-) strand; PAM type: NRG; PAM sequence: AAG
ctttcattttaatcatttca

SEQ ID NO: 29798 - DNA, 20 bp, Artificial Sequence
  Description of Artificial Sequence: Synthetic oligonucleotide
  Target: SCN9A; (-) strand; PAM type: NRG; PAM sequence: AGG
atgtccttgcatttgttatt

SEQ ID NO: 29799 - DNA, 20 bp, Artificial Sequence
  Description of Artificial Sequence: Synthetic oligonucleotide
  Target: SCN9A; (-) strand; PAM type: NRG; PAM sequence: TAG
aatgtccttgcatttgttat

SEQ ID NO: 29800 - DNA, 20 bp, Artificial Sequence
  Description of Artificial Sequence: Synthetic oligonucleotide
  Target: SCN9A; (-) strand; PAM type: NRG; PAM sequence: AAG
gtgaagaagactttagaagt

SEQ ID NO: 29801 - DNA, 20 bp, Artificial Sequence
  Description of Artificial Sequence: Synthetic oligonucleotide
  Target: SCN9A; (-) strand; PAM type: NRG; PAM sequence: AAG
gagagtgaagaagactttag

SEQ ID NO: 29802 - DNA, 20 bp, Artificial Sequence
  Description of Artificial Sequence: Synthetic oligonucleotide
  Target: SCN9A; (-) strand; PAM type: NRG; PAM sequence: TAG
ctagagagtgaagaagactt

SEQ ID NO: 29803 - DNA, 20 bp, Artificial Sequence
  Description of Artificial Sequence: Synthetic oligonucleotide
  Target: SCN9A; (-) strand; PAM type: NRG; PAM sequence: AAG
gaataccctagagagtgaag

SEQ ID NO: 29804 - DNA, 20 bp, Artificial Sequence
  Description of Artificial Sequence: Synthetic oligonucleotide
  Target: SCN9A; (-) strand; PAM type: NRG; PAM sequence: AAG
aatgaataccctagagagtg

SEQ ID NO: 29805 - DNA, 20 bp, Artificial Sequence
  Description of Artificial Sequence: Synthetic oligonucleotide
  Target: SCN9A; (-) strand; PAM type: NRG; PAM sequence: GAG
agcataatgaataccctaga

SEQ ID NO: 29806 - DNA, 20 bp, Artificial Sequence
  Description of Artificial Sequence: Synthetic oligonucleotide
  Target: SCN9A; (-) strand; PAM type: NRG; PAM sequence: GAG
aaagcataatgaatacccta

SEQ ID NO: 29807 - DNA, 20 bp, Artificial Sequence
  Description of Artificial Sequence: Synthetic oligonucleotide
  Target: SCN9A; (-) strand; PAM type: NRG; PAM sequence: TAG
agaaagcataatgaataccc

SEQ ID NO: 29808 - DNA, 20 bp, Artificial Sequence
  Description of Artificial Sequence: Synthetic oligonucleotide
  Target: SCN9A; (-) strand; PAM type: NRG; PAM sequence: AAG
gaaaataatgaaacattaga

SEQ ID NO: 29809 - DNA, 20 bp, Artificial Sequence
  Description of Artificial Sequence: Synthetic oligonucleotide
  Target: SCN9A; (-) strand; PAM type: NRG; PAM sequence: TAG
acttgaaaataatgaaacat

SEQ ID NO: 29810 - DNA, 20 bp, Artificial Sequence
  Description of Artificial Sequence: Synthetic oligonucleotide
  Target: SCN9A; (-) strand; PAM type: NRG; PAM sequence: AAG
agctgttcatgggaaacctg

SEQ ID NO: 29811 - DNA, 20 bp, Artificial Sequence
  Description of Artificial Sequence: Synthetic oligonucleotide
  Target: SCN9A; (-) strand; PAM type: NRG; PAM sequence: GGG
attggactacagctgttcat

SEQ ID NO: 29812 - DNA, 20 bp, Artificial Sequence
  Description of Artificial Sequence: Synthetic oligonucleotide
  Target: SCN9A; (-) strand; PAM type: NRG; PAM sequence: TGG
aattggactacagctgttca

SEQ ID NO: 29813 - DNA, 20 bp, Artificial Sequence
  Description of Artificial Sequence: Synthetic oligonucleotide
  Target: SCN9A; (-) strand; PAM type: NRG; PAM sequence: CAG
tgtttgcactaattggacta

SEQ ID NO: 29814 - DNA, 20 bp, Artificial Sequence
  Description of Artificial Sequence: Synthetic oligonucleotide
  Target: SCN9A; (-) strand; PAM type: NRG; PAM sequence: TGG
ctgagtgtgtttgcactaat

SEQ ID NO: 29815 - DNA, 20 bp, Artificial Sequence
  Description of Artificial Sequence: Synthetic oligonucleotide
  Target: SCN9A; (-) strand; PAM type: NRG; PAM sequence: GAG
atcctgactgtgttctgtct

SEQ ID NO: 29816 - DNA, 20 bp, Artificial Sequence
  Description of Artificial Sequence: Synthetic oligonucleotide
  Target: SCN9A; (-) strand; PAM type: NRG; PAM sequence: AAG
ctttgatccagtcagtgaag

SEQ ID NO: 29817 - DNA, 20 bp, Artificial Sequence
  Description of Artificial Sequence: Synthetic oligonucleotide
  Target: SCN9A; (-) strand; PAM type: NRG; PAM sequence: AAG
gggctttgatccagtcagtg

SEQ ID NO: 29818 - DNA, 20 bp, Artificial Sequence
  Description of Artificial Sequence: Synthetic oligonucleotide
  Target: SCN9A; (-) strand; PAM type: NRG; PAM sequence: CAG
tgtaggggctttgatccagt

SEQ ID NO: 29819 - DNA, 20 bp, Artificial Sequence
  Description of Artificial Sequence: Synthetic oligonucleotide
  Target: SCN9A; (-) strand; PAM type: NRG; PAM sequence: CAG
caattgtaggggctttgatc

SEQ ID NO: 29820 - DNA, 20 bp, Artificial Sequence
  Description of Artificial Sequence: Synthetic oligonucleotide
  Target: SCN9A; (-) strand; PAM type: NRG; PAM sequence: GGG
aggcctgaagacaattgtag

SEQ ID NO: 29821 - DNA, 20 bp, Artificial Sequence
  Description of Artificial Sequence: Synthetic oligonucleotide
  Target: SCN9A; (-) strand; PAM type: NRG; PAM sequence: GGG
caggcctgaagacaattgta

SEQ ID NO: 29822 - DNA, 20 bp, Artificial Sequence
  Description of Artificial Sequence: Synthetic oligonucleotide
  Target: SCN9A; (-) strand; PAM type: NRG; PAM sequence: AGG
tcaggcctgaagacaattgt

SEQ ID NO: 29823 - DNA, 20 bp, Artificial Sequence
  Description of Artificial Sequence: Synthetic oligonucleotide
  Target: SCN9A; (-) strand; PAM type: NRG; PAM sequence: TAG
ttcaggcctgaagacaattg

SEQ ID NO: 29824 - DNA, 20 bp, Artificial Sequence
  Description of Artificial Sequence: Synthetic oligonucleotide
  Target: SCN9A; (-) strand; PAM type: NRG; PAM sequence: AAG
ttctcccattttcaggcctg

SEQ ID NO: 29825 - DNA, 20 bp, Artificial Sequence
  Description of Artificial Sequence: Synthetic oligonucleotide
  Target: SCN9A; (-) strand; PAM type: NRG; PAM sequence: AGG
cacttttttctcccattttc

SEQ ID NO: 29826 - DNA, 20 bp, Artificial Sequence
  Description of Artificial Sequence: Synthetic oligonucleotide
  Target: SCN9A; (-) strand; PAM type: NRG; PAM sequence: CAG
acacttttttctcccatttt

SEQ ID NO: 29827 - DNA, 20 bp, Artificial Sequence
  Description of Artificial Sequence: Synthetic oligonucleotide
  Target: SCN9A; (-) strand; PAM type: NRG; PAM sequence: AGG
tgttttttgtttcgattcag

SEQ ID NO: 29828 - DNA, 20 bp, Artificial Sequence
  Description of Artificial Sequence: Synthetic oligonucleotide
  Target: SCN9A; (-) strand; PAM type: NRG; PAM sequence: GAG
gtgttttttgtttcgattca

SEQ ID NO: 29829 - DNA, 20 bp, Artificial Sequence
  Description of Artificial Sequence: Synthetic oligonucleotide
  Target: SCN9A; (-) strand; PAM type: NRG; PAM sequence: CAG
ttgtgttttttgtttcgatt

SEQ ID NO: 29830 - DNA, 20 bp, Artificial Sequence
  Description of Artificial Sequence: Synthetic oligonucleotide
  Target: SCN9A; (-) strand; PAM type: NRG; PAM sequence: AAG
taatgcatgactttctagga

SEQ ID NO: 29831 - DNA, 20 bp, Artificial Sequence
  Description of Artificial Sequence: Synthetic oligonucleotide
  Target: SCN9A; (-) strand; PAM type: NRG; PAM sequence: AGG
gatataatgcatgactttct

SEQ ID NO: 29832 - DNA, 20 bp, Artificial Sequence
  Description of Artificial Sequence: Synthetic oligonucleotide
  Target: SCN9A; (-) strand; PAM type: NRG; PAM sequence: TAG
tgatataatgcatgactttc

SEQ ID NO: 29833 - DNA, 20 bp, Artificial Sequence
  Description of Artificial Sequence: Synthetic oligonucleotide
  Target: SCN9A; (-) strand; PAM type: NRG; PAM sequence: AGG
tttttgaattaggttactta

SEQ ID NO: 29834 - DNA, 20 bp, Artificial Sequence
  Description of Artificial Sequence: Synthetic oligonucleotide
  Target: SCN9A; (-) strand; PAM type: NRG; PAM sequence: AAG
ttttttgaattaggttactt

SEQ ID NO: 29835 - DNA, 20 bp, Artificial Sequence
  Description of Artificial Sequence: Synthetic oligonucleotide
  Target: SCN9A; (-) strand; PAM type: NRG; PAM sequence: AGG
cagaaggctttttttgaatt

SEQ ID NO: 29836 - DNA, 20 bp, Artificial Sequence
  Description of Artificial Sequence: Synthetic oligonucleotide
  Target: SCN9A; (-) strand; PAM type: NRG; PAM sequence: TAG
ccagaaggctttttttgaat

SEQ ID NO: 29837 - DNA, 20 bp, Artificial Sequence
  Description of Artificial Sequence: Synthetic oligonucleotide
  Target: SCN9A; (-) strand; PAM type: NRG; PAM sequence: AGG
tataaaatagcaaacccaga

SEQ ID NO: 29838 - DNA, 20 bp, Artificial Sequence
  Description of Artificial Sequence: Synthetic oligonucleotide
  Target: SCN9A; (-) strand; PAM type: NRG; PAM sequence: AAG
atataaaatagcaaacccag

SEQ ID NO: 29839 - DNA, 20 bp, Artificial Sequence
  Description of Artificial Sequence: Synthetic oligonucleotide
  Target: SCN9A; (-) strand; PAM type: NRG; PAM sequence: CAG
tatatataaaatagcaaacc

SEQ ID NO: 29840 - DNA, 20 bp, Artificial Sequence
  Description of Artificial Sequence: Synthetic oligonucleotide
  Target: SCN9A; (-) strand; PAM type: NRG; PAM sequence: TAG
aaaacaaagtatatataaaa

SEQ ID NO: 29841 - DNA, 20 bp, Artificial Sequence
  Description of Artificial Sequence: Synthetic oligonucleotide
  Target: SCN9A; (-) strand; PAM type: NRG; PAM sequence: AAG
tgctgtaatatataaaaaca

SEQ ID NO: 29842 - DNA, 20 bp, Artificial Sequence
  Description of Artificial Sequence: Synthetic oligonucleotide
  Target: SCN9A; (-) strand; PAM type: NRG; PAM sequence: GAG
tgacaacctaggtattcttt

SEQ ID NO: 29843 - DNA, 20 bp, Artificial Sequence
  Description of Artificial Sequence: Synthetic oligonucleotide
  Target: SCN9A; (-) strand; PAM type: NRG; PAM sequence: AGG
attgttcattttgacaacct

SEQ ID NO: 29844 - DNA, 20 bp, Artificial Sequence
  Description of Artificial Sequence: Synthetic oligonucleotide
  Target: SCN9A; (-) strand; PAM type: NRG; PAM sequence: TAG
aattgttcattttgacaacc

SEQ ID NO: 29845 - DNA, 20 bp, Artificial Sequence
  Description of Artificial Sequence: Synthetic oligonucleotide
  Target: SCN9A; (-) strand; PAM type: NRG; PAM sequence: TAG
tatttttaaagtggtttgaa

SEQ ID NO: 29846 - DNA, 20 bp, Artificial Sequence
  Description of Artificial Sequence: Synthetic oligonucleotide
  Target: SCN9A; (-) strand; PAM type: NRG; PAM sequence: TGG
tacaaaaattatttttaaag

SEQ ID NO: 29847 - DNA, 20 bp, Artificial Sequence
  Description of Artificial Sequence: Synthetic oligonucleotide
  Target: SCN9A; (-) strand; PAM type: NRG; PAM sequence: AAG
acttacaaaaattattttta

SEQ ID NO: 29848 - DNA, 20 bp, Artificial Sequence
  Description of Artificial Sequence: Synthetic oligonucleotide
  Target: SCN9A; (-) strand; PAM type: NRG; PAM sequence: TAG
gtggtttgtttgacaaacat

SEQ ID NO: 29849 - DNA, 20 bp, Artificial Sequence
  Description of Artificial Sequence: Synthetic oligonucleotide
  Target: SCN9A; (-) strand; PAM type: NRG; PAM sequence: TGG
tggtgccatttatagagaag

SEQ ID NO: 29850 - DNA, 20 bp, Artificial Sequence
  Description of Artificial Sequence: Synthetic oligonucleotide
  Target: SCN9A; (-) strand; PAM type: NRG; PAM sequence: AAG
ttttggtgccatttatagag

SEQ ID NO: 29851 - DNA, 20 bp, Artificial Sequence
  Description of Artificial Sequence: Synthetic oligonucleotide
  Target: SCN9A; (-) strand; PAM type: NRG; PAM sequence: GAG
ttgttttggtgccatttata

SEQ ID NO: 29852 - DNA, 20 bp, Artificial Sequence
  Description of Artificial Sequence: Synthetic oligonucleotide
  Target: SCN9A; (-) strand; PAM type: NRG; PAM sequence: TAG
atttgttttggtgccattta

SEQ ID NO: 29853 - DNA, 20 bp, Artificial Sequence
  Description of Artificial Sequence: Synthetic oligonucleotide
  Target: SCN9A; (-) strand; PAM type: NRG; PAM sequence: TGG
ctatatgctgtaatttgttt

SEQ ID NO: 29854 - DNA, 20 bp, Artificial Sequence
  Description of Artificial Sequence: Synthetic oligonucleotide
  Target: SCN9A; (-) strand; PAM type: NRG; PAM sequence: AGG
ctttattgaaaattattaca

SEQ ID NO: 29855 - DNA, 20 bp, Artificial Sequence
  Description of Artificial Sequence: Synthetic oligonucleotide
  Target: SCN9A; (-) strand; PAM type: NRG; PAM sequence: AAG
tctttattgaaaattattac

SEQ ID NO: 29856 - DNA, 20 bp, Artificial Sequence
  Description of Artificial Sequence: Synthetic oligonucleotide
  Target: SCN9A; (-) strand; PAM type: NRG; PAM sequence: CAG
cattgttttttattttttct

SEQ ID NO: 29857 - DNA, 20 bp, Artificial Sequence
  Description of Artificial Sequence: Synthetic oligonucleotide
  Target: SCN9A; (-) strand; PAM type: NRG; PAM sequence: GGG
agatcataaatatcagcatg

SEQ ID NO: 29858 - DNA, 20 bp, Artificial Sequence
  Description of Artificial Sequence: Synthetic oligonucleotide
  Target: SCN9A; (-) strand; PAM type: NRG; PAM sequence: GGG
gagatcataaatatcagcat

SEQ ID NO: 29859 - DNA, 20 bp, Artificial Sequence
  Description of Artificial Sequence: Synthetic oligonucleotide
  Target: SCN9A; (-) strand; PAM type: NRG; PAM sequence: TGG
agagatcataaatatcagca

SEQ ID NO: 29860 - DNA, 20 bp, Artificial Sequence
  Description of Artificial Sequence: Synthetic oligonucleotide
  Target: SCN9A; (-) strand; PAM type: NRG; PAM sequence: CAG
aggaaagagatcataaatat

SEQ ID NO: 29861 - DNA, 20 bp, Artificial Sequence
  Description of Artificial Sequence: Synthetic oligonucleotide
  Target: SCN9A; (-) strand; PAM type: NRG; PAM sequence: GAG
attttaaaatacttaggaaa

SEQ ID NO: 29862 - DNA, 20 bp, Artificial Sequence
  Description of Artificial Sequence: Synthetic oligonucleotide
  Target: SCN9A; (-) strand; PAM type: NRG; PAM sequence: AAG
tgattttaaaatacttagga

SEQ ID NO: 29863 - DNA, 20 bp, Artificial Sequence
  Description of Artificial Sequence: Synthetic oligonucleotide
  Target: SCN9A; (-) strand; PAM type: NRG; PAM sequence: AGG
taattgattttaaaatactt

SEQ ID NO: 29864 - DNA, 20 bp, Artificial Sequence
  Description of Artificial Sequence: Synthetic oligonucleotide
  Target: SCN9A; (-) strand; PAM type: NRG; PAM sequence: TAG
ttaattgattttaaaatact

SEQ ID NO: 29865 - DNA, 20 bp, Artificial Sequence
  Description of Artificial Sequence: Synthetic oligonucleotide
  Target: SCN9A; (-) strand; PAM type: NRG; PAM sequence: AGG
ttccatttgcttatacagga

SEQ ID NO: 29866 - DNA, 20 bp, Artificial Sequence
  Description of Artificial Sequence: Synthetic oligonucleotide
  Target: SCN9A; (-) strand; PAM type: NRG; PAM sequence: AAG
tttccatttgcttatacagg

SEQ ID NO: 29867 - DNA, 20 bp, Artificial Sequence
  Description of Artificial Sequence: Synthetic oligonucleotide
  Target: SCN9A; (-) strand; PAM type: NRG; PAM sequence: AGG
gtttttccatttgcttatac

SEQ ID NO: 29868 - DNA, 20 bp, Artificial Sequence
  Description of Artificial Sequence: Synthetic oligonucleotide
  Target: SCN9A; (-) strand; PAM type: NRG; PAM sequence: CAG
tgtttttccatttgcttata

SEQ ID NO: 29869 - DNA, 20 bp, Artificial Sequence
  Description of Artificial Sequence: Synthetic oligonucleotide
  Target: SCN9A; (-) strand; PAM type: NRG; PAM sequence: GGG
aaatcttccctcctgtctga

SEQ ID NO: 29870 - DNA, 20 bp, Artificial Sequence
  Description of Artificial Sequence: Synthetic oligonucleotide
  Target: SCN9A; (-) strand; PAM type: NRG; PAM sequence: AGG
gaaatcttccctcctgtctg

SEQ ID NO: 29871 - DNA, 20 bp, Artificial Sequence
  Description of Artificial Sequence: Synthetic oligonucleotide
  Target: SCN9A; (-) strand; PAM type: NRG; PAM sequence: GAG
tgaaatcttccctcctgtct

SEQ ID NO: 29872 - DNA, 20 bp, Artificial Sequence
  Description of Artificial Sequence: Synthetic oligonucleotide
  Target: SCN9A; (-) strand; PAM type: NRG; PAM sequence: TGG
ttaggatgaggatgactact

SEQ ID NO: 29873 - DNA, 20 bp, Artificial Sequence
  Description of Artificial Sequence: Synthetic oligonucleotide
  Target: SCN9A; (-) strand; PAM type: NRG; PAM sequence: AGG
ttgcatgggtctttaggatg

SEQ ID NO: 29874 - DNA, 20 bp, Artificial Sequence
  Description of Artificial Sequence: Synthetic oligonucleotide
  Target: SCN9A; (-) strand; PAM type: NRG; PAM sequence: GAG
attgcatgggtctttaggat

SEQ ID NO: 29875 - DNA, 20 bp, Artificial Sequence
  Description of Artificial Sequence: Synthetic oligonucleotide
  Target: SCN9A; (-) strand; PAM type: NRG; PAM sequence: AGG
aatcaattgcatgggtcttt

SEQ ID NO: 29876 - DNA, 20 bp, Artificial Sequence
  Description of Artificial Sequence: Synthetic oligonucleotide
  Target: SCN9A; (-) strand; PAM type: NRG; PAM sequence: TAG
taatcaattgcatgggtctt

SEQ ID NO: 29877 - DNA, 20 bp, Artificial Sequence
  Description of Artificial Sequence: Synthetic oligonucleotide
  Target: SCN9A; (-) strand; PAM type: NRG; PAM sequence: GGG
ttgagtttaatcaattgcat

SEQ ID NO: 29878 - DNA, 20 bp, Artificial Sequence
  Description of Artificial Sequence: Synthetic oligonucleotide
  Target: SCN9A; (-) strand; PAM type: NRG; PAM sequence: TGG
tttgagtttaatcaattgca

SEQ ID NO: 29879 - DNA, 20 bp, Artificial Sequence
  Description of Artificial Sequence: Synthetic oligonucleotide
  Target: SCN9A; (-) strand; PAM type: NRG; PAM sequence: GAG
attatcaaaagtcaaccttt

SEQ ID NO: 29880 - DNA, 20 bp, Artificial Sequence
  Description of Artificial Sequence: Synthetic oligonucleotide
  Target: SCN9A; (-) strand; PAM type: NRG; PAM sequence: AAG
ttttccacaatcattatcaa

SEQ ID NO: 29881 - DNA, 20 bp, Artificial Sequence
  Description of Artificial Sequence: Synthetic oligonucleotide
  Target: SCN9A; (-) strand; PAM type: NRG; PAM sequence: AAG
gactttgatcttttgaaaga

SEQ ID NO: 29882 - DNA, 20 bp, Artificial Sequence
  Description of Artificial Sequence: Synthetic oligonucleotide
  Target: SCN9A; (-) strand; PAM type: NRG; PAM sequence: AAG
ggctgactttgatcttttga

SEQ ID NO: 29883 - DNA, 20 bp, Artificial Sequence
  Description of Artificial Sequence: Synthetic oligonucleotide
  Target: SCN9A; (-) strand; PAM type: NRG; PAM sequence: GGG
gagagtggggttaaacacca

SEQ ID NO: 29884 - DNA, 20 bp, Artificial Sequence
  Description of Artificial Sequence: Synthetic oligonucleotide
  Target: SCN9A; (-) strand; PAM type: NRG; PAM sequence: AGG
tgagagtggggttaaacacc

SEQ ID NO: 29885 - DNA, 20 bp, Artificial Sequence
  Description of Artificial Sequence: Synthetic oligonucleotide
  Target: SCN9A; (-) strand; PAM type: NRG; PAM sequence: CAG
gtgagagtggggttaaacac

SEQ ID NO: 29886 - DNA, 20 bp, Artificial Sequence
  Description of Artificial Sequence: Synthetic oligonucleotide
  Target: SCN9A; (-) strand; PAM type: NRG; PAM sequence: GGG
agtcattccaggtgagagtg

SEQ ID NO: 29887 - DNA, 20 bp, Artificial Sequence
  Description of Artificial Sequence: Synthetic oligonucleotide
  Target: SCN9A; (-) strand; PAM type: NRG; PAM sequence: GGG
cagtcattccaggtgagagt

SEQ ID NO: 29888 - DNA, 20 bp, Artificial Sequence
  Description of Artificial Sequence: Synthetic oligonucleotide
  Target: SCN9A; (-) strand; PAM type: NRG; PAM sequence: TGG
tcagtcattccaggtgagag

SEQ ID NO: 29889 - DNA, 20 bp, Artificial Sequence
  Description of Artificial Sequence: Synthetic oligonucleotide
  Target: SCN9A; (-) strand; PAM type: NRG; PAM sequence: GAG
atttcagtcattccaggtga

SEQ ID NO: 29890 - DNA, 20 bp, Artificial Sequence
  Description of Artificial Sequence: Synthetic oligonucleotide
  Target: SCN9A; (-) strand; PAM type: NRG; PAM sequence: GAG
caatttcagtcattccaggt

SEQ ID NO: 29891 - DNA, 20 bp, Artificial Sequence
  Description of Artificial Sequence: Synthetic oligonucleotide
  Target: SCN9A; (-) strand; PAM type: NRG; PAM sequence: AGG
aaaacaatttcagtcattcc

SEQ ID NO: 29892 - DNA, 20 bp, Artificial Sequence
  Description of Artificial Sequence: Synthetic oligonucleotide
  Target: SCN9A; (-) strand; PAM type: NRG; PAM sequence: CAG
gaaaacaatttcagtcattc

SEQ ID NO: 29893 - DNA, 20 bp, Artificial Sequence
  Description of Artificial Sequence: Synthetic oligonucleotide
  Target: SCN9A; (-) strand; PAM type: NRG; PAM sequence: CAG
ccgagcattgaaaacaattt

SEQ ID NO: 29894 - DNA, 20 bp, Artificial Sequence
  Description of Artificial Sequence: Synthetic oligonucleotide
  Target: SCN9A; (-) strand; PAM type: NRG; PAM sequence: GAG
gagaacattcagagttctcc

SEQ ID NO: 29895 - DNA, 20 bp, Artificial Sequence
  Description of Artificial Sequence: Synthetic oligonucleotide
  Target: SCN9A; (-) strand; PAM type: NRG; PAM sequence: GAG
ctcagcattgagaacattca

SEQ ID NO: 29896 - DNA, 20 bp, Artificial Sequence
  Description of Artificial Sequence: Synthetic oligonucleotide
  Target: SCN9A; (-) strand; PAM type: NRG; PAM sequence: CAG
gtctcagcattgagaacatt

SEQ ID NO: 29897 - DNA, 20 bp, Artificial Sequence
  Description of Artificial Sequence: Synthetic oligonucleotide
  Target: SCN9A; (-) strand; PAM type: NRG; PAM sequence: GAG
ctgggcaatgtctcagcatt

SEQ ID NO: 29898 - DNA, 20 bp, Artificial Sequence
  Description of Artificial Sequence: Synthetic oligonucleotide
  Target: SCN9A; (-) strand; PAM type: NRG; PAM sequence: CAG
tgtggacctgggcaatgtct

SEQ ID NO: 29899 - DNA, 20 bp, Artificial Sequence
  Description of Artificial Sequence: Synthetic oligonucleotide
  Target: SCN9A; (-) strand; PAM type: NRG; PAM sequence: GGG
gtgacagagtttgtggacct

SEQ ID NO: 29900 - DNA, 20 bp, Artificial Sequence
  Description of Artificial Sequence: Synthetic oligonucleotide
  Target: SCN9A; (-) strand; PAM type: NRG; PAM sequence: TGG
tgtgacagagtttgtggacc

SEQ ID NO: 29901 - DNA, 20 bp, Artificial Sequence
  Description of Artificial Sequence: Synthetic oligonucleotide
  Target: SCN9A; (-) strand; PAM type: NRG; PAM sequence: TGG
cagatatgtgacagagtttg

SEQ ID NO: 29902 - DNA, 20 bp, Artificial Sequence
  Description of Artificial Sequence: Synthetic oligonucleotide
  Target: SCN9A; (-) strand; PAM type: NRG; PAM sequence: GAG
cctattacagatatgtgaca

SEQ ID NO: 29903 - DNA, 20 bp, Artificial Sequence
  Description of Artificial Sequence: Synthetic oligonucleotide
  Target: SCN9A; (-) strand; PAM type: NRG; PAM sequence: CAG
cccctattacagatatgtga

SEQ ID NO: 29904 - DNA, 20 bp, Artificial Sequence
  Description of Artificial Sequence: Synthetic oligonucleotide
  Target: SCN9A; (-) strand; PAM type: NRG; PAM sequence: CAG
gtgtataaactcccctatta

SEQ ID NO: 29905 - DNA, 20 bp, Artificial Sequence
  Description of Artificial Sequence: Synthetic oligonucleotide
  Target: SCN9A; (-) strand; PAM type: NRG; PAM sequence: GAG
tcataactccaactatttgg

SEQ ID NO: 29906 - DNA, 20 bp, Artificial Sequence
  Description of Artificial Sequence: Synthetic oligonucleotide
  Target: SCN9A; (-) strand; PAM type: NRG; PAM sequence: GGG
actcataactccaactattt

SEQ ID NO: 29907 - DNA, 20 bp, Artificial Sequence
  Description of Artificial Sequence: Synthetic oligonucleotide
  Target: SCN9A; (-) strand; PAM type: NRG; PAM sequence: TGG
cactcataactccaactatt

SEQ ID NO: 29908 - DNA, 20 bp, Artificial Sequence
  Description of Artificial Sequence: Synthetic oligonucleotide
  Target: SCN9A; (-) strand; PAM type: NRG; PAM sequence: AGG
agtaattggtgtgaagcatt

SEQ ID NO: 29909 - DNA, 20 bp, Artificial Sequence
  Description of Artificial Sequence: Synthetic oligonucleotide
  Target: SCN9A; (-) strand; PAM type: NRG; PAM sequence: TAG
aagtaattggtgtgaagcat

SEQ ID NO: 29910 - DNA, 20 bp, Artificial Sequence
  Description of Artificial Sequence: Synthetic oligonucleotide
  Target: SCN9A; (-) strand; PAM type: NRG; PAM sequence: AAG
ggtaagaagtaattggtgtg

SEQ ID NO: 29911 - DNA, 20 bp, Artificial Sequence
  Description of Artificial Sequence: Synthetic oligonucleotide
  Target: SCN9A; (-) strand; PAM type: NRG; PAM sequence: TGG
aatcccaggtaagaagtaat

SEQ ID NO: 29912 - DNA, 20 bp, Artificial Sequence
  Description of Artificial Sequence: Synthetic oligonucleotide
  Target: SCN9A; (-) strand; PAM type: NRG; PAM sequence: AAG
tttctgtaatcccaggtaag

SEQ ID NO: 29913 - DNA, 20 bp, Artificial Sequence
  Description of Artificial Sequence: Synthetic oligonucleotide
  Target: SCN9A; (-) strand; PAM type: NRG; PAM sequence: AAG
ctatttctgtaatcccaggt

SEQ ID NO: 29914 - DNA, 20 bp, Artificial Sequence
  Description of Artificial Sequence: Synthetic oligonucleotide
  Target: SCN9A; (-) strand; PAM type: NRG; PAM sequence: AGG
aaaactatttctgtaatccc

SEQ ID NO: 29915 - DNA, 20 bp, Artificial Sequence
  Description of Artificial Sequence: Synthetic oligonucleotide
  Target: SCN9A; (-) strand; PAM type: NRG; PAM sequence: CAG
gaaaactatttctgtaatcc

SEQ ID NO: 29916 - DNA, 20 bp, Artificial Sequence
  Description of Artificial Sequence: Synthetic oligonucleotide
  Target: SCN9A; (-) strand; PAM type: NRG; PAM sequence: GAG
tcgaactttcagagtattga

SEQ ID NO: 29917 - DNA, 20 bp, Artificial Sequence
  Description of Artificial Sequence: Synthetic oligonucleotide
  Target: SCN9A; (-) strand; PAM type: NRG; PAM sequence: GAG
cttcgaactttcagagtatt

SEQ ID NO: 29918 - DNA, 20 bp, Artificial Sequence
  Description of Artificial Sequence: Synthetic oligonucleotide
  Target: SCN9A; (-) strand; PAM type: NRG; PAM sequence: GAG
ttcagctcttcgaactttca

SEQ ID NO: 29919 - DNA, 20 bp, Artificial Sequence
  Description of Artificial Sequence: Synthetic oligonucleotide
  Target: SCN9A; (-) strand; PAM type: NRG; PAM sequence: CAG
gtttcagctcttcgaacttt

SEQ ID NO: 29920 - DNA, 20 bp, Artificial Sequence
  Description of Artificial Sequence: Synthetic oligonucleotide
  Target: SCN9A; (-) strand; PAM type: NRG; PAM sequence: CAG
tgtaaacctaggcaatgttt

SEQ ID NO: 29921 - DNA, 20 bp, Artificial Sequence
  Description of Artificial Sequence: Synthetic oligonucleotide
  Target: SCN9A; (-) strand; PAM type: NRG; PAM sequence: AGG
ttaacagaatttgtaaacct

SEQ ID NO: 29922 - DNA, 20 bp, Artificial Sequence
  Description of Artificial Sequence: Synthetic oligonucleotide
  Target: SCN9A; (-) strand; PAM type: NRG; PAM sequence: TAG
tttaacagaatttgtaaacc

SEQ ID NO: 29923 - DNA, 20 bp, Artificial Sequence
  Description of Artificial Sequence: Synthetic oligonucleotide
  Target: SCN9A; (-) strand; PAM type: NRG; PAM sequence: CAG
ttaattctacaggtatttaa

SEQ ID NO: 29924 - DNA, 20 bp, Artificial Sequence
  Description of Artificial Sequence: Synthetic oligonucleotide
  Target: SCN9A; (-) strand; PAM type: NRG; PAM sequence: AGG
taattctgatttaattctac

SEQ ID NO: 29925 - DNA, 20 bp, Artificial Sequence
  Description of Artificial Sequence: Synthetic oligonucleotide
  Target: SCN9A; (-) strand; PAM type: NRG; PAM sequence: CAG
ataattctgatttaattcta

SEQ ID NO: 29926 - DNA, 20 bp, Artificial Sequence
  Description of Artificial Sequence: Synthetic oligonucleotide
  Target: SCN9A; (-) strand; PAM type: NRG; PAM sequence: TAG
aaaggctcaggtaagtatca

SEQ ID NO: 29927 - DNA, 20 bp, Artificial Sequence
  Description of Artificial Sequence: Synthetic oligonucleotide
  Target: SCN9A; (-) strand; PAM type: NRG; PAM sequence: AAG
ccttgactaaaggctcaggt

SEQ ID NO: 29928 - DNA, 20 bp, Artificial Sequence
  Description of Artificial Sequence: Synthetic oligonucleotide
  Target: SCN9A; (-) strand; PAM type: NRG; PAM sequence: AGG
aataccttgactaaaggctc

SEQ ID NO: 29929 - DNA, 20 bp, Artificial Sequence
  Description of Artificial Sequence: Synthetic oligonucleotide
  Target: SCN9A; (-) strand; PAM type: NRG; PAM sequence: CAG
aaataccttgactaaaggct

SEQ ID NO: 29930 - DNA, 20 bp, Artificial Sequence
  Description of Artificial Sequence: Synthetic oligonucleotide
  Target: SCN9A; (-) strand; PAM type: NRG; PAM sequence: AGG
gtagaaaataccttgactaa

SEQ ID NO: 29931 - DNA, 20 bp, Artificial Sequence
  Description of Artificial Sequence: Synthetic oligonucleotide
  Target: SCN9A; (-) strand; PAM type: NRG; PAM sequence: AAG
cgtagaaaataccttgacta

SEQ ID NO: 29932 - DNA, 20 bp, Artificial Sequence
  Description of Artificial Sequence: Synthetic oligonucleotide
  Target: SCN9A; (-) strand; PAM type: NRG; PAM sequence: TAG
taaaatagaagccccaaacg

SEQ ID NO: 29933 - DNA, 20 bp, Artificial Sequence
  Description of Artificial Sequence: Synthetic oligonucleotide
  Target: SCN9A; (-) strand; PAM type: NRG; PAM sequence: AAG
gaactatacatttaaaatag

SEQ ID NO: 29934 - DNA, 20 bp, Artificial Sequence
  Description of Artificial Sequence: Synthetic oligonucleotide
  Target: SCN9A; (-) strand; PAM type: NRG; PAM sequence: TAG
gcagaactatacatttaaaa

SEQ ID NO: 29935 - DNA, 20 bp, Artificial Sequence
  Description of Artificial Sequence: Synthetic oligonucleotide
  Target: SCN9A; (-) strand; PAM type: NRG; PAM sequence: CAG
atgatagcaaaaaagacttg

SEQ ID NO: 29936 - DNA, 20 bp, Artificial Sequence
  Description of Artificial Sequence: Synthetic oligonucleotide
  Target: SCN9A; (-) strand; PAM type: NRG; PAM sequence: AAG
agttagttatgatagcaaaa

SEQ ID NO: 29937 - DNA, 20 bp, Artificial Sequence
  Description of Artificial Sequence: Synthetic oligonucleotide
  Target: SCN9A; (-) strand; PAM type: NRG; PAM sequence: TAG
ttaaattaagttagttatga

SEQ ID NO: 29938 - DNA, 20 bp, Artificial Sequence
  Description of Artificial Sequence: Synthetic oligonucleotide
  Target: SCN9A; (-) strand; PAM type: NRG; PAM sequence: TAG
caatgctaattaaattaagt

SEQ ID NO: 29939 - DNA, 20 bp, Artificial Sequence
  Description of Artificial Sequence: Synthetic oligonucleotide
  Target: SCN9A; (-) strand; PAM type: NRG; PAM sequence: AAG
aaatcaatgctaattaaatt

SEQ ID NO: 29940 - DNA, 20 bp, Artificial Sequence
  Description of Artificial Sequence: Synthetic oligonucleotide
  Target: SCN9A; (-) strand; PAM type: NRG; PAM sequence: GAG
gtattttgtttgcatcaaat

SEQ ID NO: 29941 - DNA, 20 bp, Artificial Sequence
  Description of Artificial Sequence: Synthetic oligonucleotide
  Target: SCN9A; (-) strand; PAM type: NRG; PAM sequence: AAG
atttagttgtttacgcattt

SEQ ID NO: 29942 - DNA, 20 bp, Artificial Sequence
  Description of Artificial Sequence: Synthetic oligonucleotide
  Target: SCN9A; (-) strand; PAM type: NRG; PAM sequence: TAG
ggtccaacaattgaaacatt

SEQ ID NO: 29943 - DNA, 20 bp, Artificial Sequence
  Description of Artificial Sequence: Synthetic oligonucleotide
  Target: SCN9A; (-) strand; PAM type: NRG; PAM sequence: GGG
ctaaattaccataatgttaa

SEQ ID NO: 29944 - DNA, 20 bp, Artificial Sequence
  Description of Artificial Sequence: Synthetic oligonucleotide
  Target: SCN9A; (-) strand; PAM type: NRG; PAM sequence: AGG
tctaaattaccataatgtta

SEQ ID NO: 29945 - DNA, 20 bp, Artificial Sequence
  Description of Artificial Sequence: Synthetic oligonucleotide
  Target: SCN9A; (-) strand; PAM type: NRG; PAM sequence: AAG
gtctaaattaccataatgtt

SEQ ID NO: 29946 - DNA, 20 bp, Artificial Sequence
  Description of Artificial Sequence: Synthetic oligonucleotide
  Target: SCN9A; (-) strand; PAM type: NRG; PAM sequence: AAG
aatgttttataaaaaattaa

SEQ ID NO: 29947 - DNA, 20 bp, Artificial Sequence
  Description of Artificial Sequence: Synthetic oligonucleotide
  Target: SCN9A; (-) strand; PAM type: NRG; PAM sequence: TAG
agccttttgtgtctgacact

SEQ ID NO: 29948 - DNA, 20 bp, Artificial Sequence
  Description of Artificial Sequence: Synthetic oligonucleotide
  Target: SCN9A; (-) strand; PAM type: NRG; PAM sequence: CAG
tggaaatatcaaacagtatg

SEQ ID NO: 29949 - DNA, 20 bp, Artificial Sequence
  Description of Artificial Sequence: Synthetic oligonucleotide
  Target: SCN9A; (-) strand; PAM type: NRG; PAM sequence: CAG
ttatgaatggaaatatcaaa

SEQ ID NO: 29950 - DNA, 20 bp, Artificial Sequence
  Description of Artificial Sequence: Synthetic oligonucleotide
  Target: SCN9A; (-) strand; PAM type: NRG; PAM sequence: TGG
tatttggatttttttatgaa

SEQ ID NO: 29951 - DNA, 20 bp, Artificial Sequence
  Description of Artificial Sequence: Synthetic oligonucleotide
  Target: SCN9A; (-) strand; PAM type: NRG; PAM sequence: TGG
tctctatggatttgtctatt

SEQ ID NO: 29952 - DNA, 20 bp, Artificial Sequence
  Description of Artificial Sequence: Synthetic oligonucleotide
  Target: SCN9A; (-) strand; PAM type: NRG; PAM sequence: TGG
tcatctatgttttatctcta

SEQ ID NO: 29953 - DNA, 20 bp, Artificial Sequence
  Description of Artificial Sequence: Synthetic oligonucleotide
  Target: SCN9A; (-) strand; PAM type: NRG; PAM sequence: TGG
tccttctctccctggcccct

SEQ ID NO: 29954 - DNA, 20 bp, Artificial Sequence
  Description of Artificial Sequence: Synthetic oligonucleotide
  Target: SCN9A; (-) strand; PAM type: NRG; PAM sequence: TGG
cttcaatttccttctctccc

SEQ ID NO: 29955 - DNA, 20 bp, Artificial Sequence
  Description of Artificial Sequence: Synthetic oligonucleotide
  Target: SCN9A; (-) strand; PAM type: NRG; PAM sequence: CAG
agaaactctgtactcattag

SEQ ID NO: 29956 - DNA, 20 bp, Artificial Sequence
  Description of Artificial Sequence: Synthetic oligonucleotide
  Target: SCN9A; (-) strand; PAM type: NRG; PAM sequence: TAG
aatagaaactctgtactcat

SEQ ID NO: 29957 - DNA, 20 bp, Artificial Sequence
  Description of Artificial Sequence: Synthetic oligonucleotide
  Target: SCN9A; (-) strand; PAM type: NRG; PAM sequence: TAG
agaagtttaacaaccccaaa

SEQ ID NO: 29958 - DNA, 20 bp, Artificial Sequence
  Description of Artificial Sequence: Synthetic oligonucleotide
  Target: SCN9A; (-) strand; PAM type: NRG; PAM sequence: AAG
tcaccactacctaattagag

SEQ ID NO: 29959 - DNA, 20 bp, Artificial Sequence
  Description of Artificial Sequence: Synthetic oligonucleotide
  Target: SCN9A; (-) strand; PAM type: NRG; PAM sequence: GAG
acatcaccactacctaatta

SEQ ID NO: 29960 - DNA, 20 bp, Artificial Sequence
  Description of Artificial Sequence: Synthetic oligonucleotide
  Target: SCN9A; (-) strand; PAM type: NRG; PAM sequence: TAG
caacatcaccactacctaat

SEQ ID NO: 29961 - DNA, 20 bp, Artificial Sequence
  Description of Artificial Sequence: Synthetic oligonucleotide
  Target: SCN9A; (-) strand; PAM type: NRG; PAM sequence: CAG
gtatacaattcagtgttttt

SEQ ID NO: 29962 - DNA, 20 bp, Artificial Sequence
  Description of Artificial Sequence: Synthetic oligonucleotide
  Target: SCN9A; (-) strand; PAM type: NRG; PAM sequence: CAG
caattttaaagtatacaatt

SEQ ID NO: 29963 - DNA, 20 bp, Artificial Sequence
  Description of Artificial Sequence: Synthetic oligonucleotide
  Target: SCN9A; (-) strand; PAM type: NRG; PAM sequence: AAG
ctacaaaattcacaatttta

SEQ ID NO: 29964 - DNA, 20 bp, Artificial Sequence
  Description of Artificial Sequence: Synthetic oligonucleotide
  Target: SCN9A; (-) strand; PAM type: NRG; PAM sequence: TGG
aggtctcctttttttcctat

SEQ ID NO: 29965 - DNA, 20 bp, Artificial Sequence
  Description of Artificial Sequence: Synthetic oligonucleotide
  Target: SCN9A; (-) strand; PAM type: NRG; PAM sequence: AGG
agaagactgcctcttctcat

SEQ ID NO: 29966 - DNA, 20 bp, Artificial Sequence
  Description of Artificial Sequence: Synthetic oligonucleotide
  Target: SCN9A; (-) strand; PAM type: NRG; PAM sequence: TAG
aagaagactgcctcttctca

SEQ ID NO: 29967 - DNA, 20 bp, Artificial Sequence
  Description of Artificial Sequence: Synthetic oligonucleotide
  Target: SCN9A; (-) strand; PAM type: NRG; PAM sequence: AAG
taagaaaacattgtgcaaag

SEQ ID NO: 29968 - DNA, 20 bp, Artificial Sequence
  Description of Artificial Sequence: Synthetic oligonucleotide
  Target: SCN9A; (-) strand; PAM type: NRG; PAM sequence: AAG
tgctaagaaaacattgtgca

SEQ ID NO: 29969 - DNA, 20 bp, Artificial Sequence
  Description of Artificial Sequence: Synthetic oligonucleotide
  Target: SCN9A; (-) strand; PAM type: NRG; PAM sequence: AAG
tccatctgctacctgctgct

SEQ ID NO: 29970 - DNA, 20 bp, Artificial Sequence
  Description of Artificial Sequence: Synthetic oligonucleotide
  Target: SCN9A; (-) strand; PAM type: NRG; PAM sequence: CAG
tgaggtcacatatgatgggg

SEQ ID NO: 29971 - DNA, 20 bp, Artificial Sequence
  Description of Artificial Sequence: Synthetic oligonucleotide
  Target: SCN9A; (-) strand; PAM type: NRG; PAM sequence: GGG
ttttgaggtcacatatgatg

SEQ ID NO: 29972 - DNA, 20 bp, Artificial Sequence
  Description of Artificial Sequence: Synthetic oligonucleotide
  Target: SCN9A; (-) strand; PAM type: NRG; PAM sequence: GGG
cttttgaggtcacatatgat

SEQ ID NO: 29973 - DNA, 20 bp, Artificial Sequence
  Description of Artificial Sequence: Synthetic oligonucleotide
  Target: SCN9A; (-) strand; PAM type: NRG; PAM sequence: TGG
ccttttgaggtcacatatga

SEQ ID NO: 29974 - DNA, 20 bp, Artificial Sequence
  Description of Artificial Sequence: Synthetic oligonucleotide
  Target: SCN9A; (-) strand; PAM type: NRG; PAM sequence: AGG
catcaggctccctccttttg

SEQ ID NO: 29975 - DNA, 20 bp, Artificial Sequence
  Description of Artificial Sequence: Synthetic oligonucleotide
  Target: SCN9A; (-) strand; PAM type: NRG; PAM sequence: GAG
ccatcaggctccctcctttt

SEQ ID NO: 29976 - DNA, 20 bp, Artificial Sequence
  Description of Artificial Sequence: Synthetic oligonucleotide
  Target: SCN9A; (-) strand; PAM type: NRG; PAM sequence: AGG
tgcctaacctcttttccatc

SEQ ID NO: 29977 - DNA, 20 bp, Artificial Sequence
  Description of Artificial Sequence: Synthetic oligonucleotide
  Target: SCN9A; (-) strand; PAM type: NRG; PAM sequence: CAG
ctgcctaacctcttttccat

SEQ ID NO: 29978 - DNA, 20 bp, Artificial Sequence
  Description of Artificial Sequence: Synthetic oligonucleotide
  Target: SCN9A; (-) strand; PAM type: NRG; PAM sequence: AAG
agacaatacagaagggtctt

SEQ ID NO: 29979 - DNA, 20 bp, Artificial Sequence
  Description of Artificial Sequence: Synthetic oligonucleotide
  Target: SCN9A; (-) strand; PAM type: NRG; PAM sequence: GGG
gccacctagacaatacagaa

SEQ ID NO: 29980 - DNA, 20 bp, Artificial Sequence
  Description of Artificial Sequence: Synthetic oligonucleotide
  Target: SCN9A; (-) strand; PAM type: NRG; PAM sequence: AGG
agccacctagacaatacaga

SEQ ID NO: 29981 - DNA, 20 bp, Artificial Sequence
  Description of Artificial Sequence: Synthetic oligonucleotide
  Target: SCN9A; (-) strand; PAM type: NRG; PAM sequence: AAG
gagccacctagacaatacag

SEQ ID NO: 29982 - DNA, 20 bp, Artificial Sequence
  Description of Artificial Sequence: Synthetic oligonucleotide
  Target: SCN9A; (-) strand; PAM type: NRG; PAM sequence: CAG
ctggagccacctagacaata

SEQ ID NO: 29983 - DNA, 20 bp, Artificial Sequence
  Description of Artificial Sequence: Synthetic oligonucleotide
  Target: SCN9A; (-) strand; PAM type: NRG; PAM sequence: TAG
ccaggttcactggagccacc

SEQ ID NO: 29984 - DNA, 20 bp, Artificial Sequence
  Description of Artificial Sequence: Synthetic oligonucleotide
  Target: SCN9A; (-) strand; PAM type: NRG; PAM sequence: GAG
aaagtaatccaggttcactg

SEQ ID NO: 29985 - DNA, 20 bp, Artificial Sequence
  Description of Artificial Sequence: Synthetic oligonucleotide
  Target: SCN9A; (-) strand; PAM type: NRG; PAM sequence: TGG
tcaaagtaatccaggttcac

SEQ ID NO: 29986 - DNA, 20 bp, Artificial Sequence
  Description of Artificial Sequence: Synthetic oligonucleotide
  Target: SCN9A; (-) strand; PAM type: NRG; PAM sequence: AGG
ttgaattatcaaagtaatcc

SEQ ID NO: 29987 - DNA, 20 bp, Artificial Sequence
  Description of Artificial Sequence: Synthetic oligonucleotide
  Target: SCN9A; (-) strand; PAM type: NRG; PAM sequence: CAG
tttgaattatcaaagtaatc

SEQ ID NO: 29988 - DNA, 20 bp, Artificial Sequence
  Description of Artificial Sequence: Synthetic oligonucleotide
  Target: SCN9A; (-) strand; PAM type: NRG; PAM sequence: AAG
ttaatgactttgaattatca

SEQ ID NO: 29989 - DNA, 20 bp, Artificial Sequence
  Description of Artificial Sequence: Synthetic oligonucleotide
  Target: SCN9A; (-) strand; PAM type: NRG; PAM sequence: TAG
gatttttacaatctcatatc

SEQ ID NO: 29990 - DNA, 20 bp, Artificial Sequence
  Description of Artificial Sequence: Synthetic oligonucleotide
  Target: SCN9A; (-) strand; PAM type: NRG; PAM sequence: TGG
aaatgtatttatcagaaaaa

SEQ ID NO: 29991 - DNA, 20 bp, Artificial Sequence
  Description of Artificial Sequence: Synthetic oligonucleotide
  Target: SCN9A; (-) strand; PAM type: NRG; PAM sequence: CAG
cttttcccaaatgtatttat

SEQ ID NO: 29992 - DNA, 20 bp, Artificial Sequence
  Description of Artificial Sequence: Synthetic oligonucleotide
  Target: SCN9A; (-) strand; PAM type: NRG; PAM sequence: CAG
tcaaggaaaatattacatta

SEQ ID NO: 29993 - DNA, 20 bp, Artificial Sequence
  Description of Artificial Sequence: Synthetic oligonucleotide
  Target: SCN9A; (-) strand; PAM type: NRG; PAM sequence: AGG
atacactcagtttattttca

SEQ ID NO: 29994 - DNA, 20 bp, Artificial Sequence
  Description of Artificial Sequence: Synthetic oligonucleotide
  Target: SCN9A; (-) strand; PAM type: NRG; PAM sequence: AAG
tatacactcagtttattttc

SEQ ID NO: 29995 - DNA, 20 bp, Artificial Sequence
  Description of Artificial Sequence: Synthetic oligonucleotide
  Target: SCN9A; (-) strand; PAM type: NRG; PAM sequence: CAG
atacacattatatatacact

SEQ ID NO: 29996 - DNA, 20 bp, Artificial Sequence
  Description of Artificial Sequence: Synthetic oligonucleotide
  Target: SCN9A; (-) strand; PAM type: NRG; PAM sequence: AAG
tgtcactgcttactaagcct

SEQ ID NO: 29997 - DNA, 20 bp, Artificial Sequence
  Description of Artificial Sequence: Synthetic oligonucleotide
  Target: SCN9A; (-) strand; PAM type: NRG; PAM sequence: AAG
aagagctgtcactgcttact

SEQ ID NO: 29998 - DNA, 20 bp, Artificial Sequence
  Description of Artificial Sequence: Synthetic oligonucleotide
  Target: SCN9A; (-) strand; PAM type: NRG; PAM sequence: GAG
aaaagtatatatttgtaaaa

SEQ ID NO: 29999 - DNA, 20 bp, Artificial Sequence
  Description of Artificial Sequence: Synthetic oligonucleotide
  Target: SCN9A; (-) strand; PAM type: NRG; PAM sequence: AAG
ataaaagtatatatttgtaa

SEQ ID NO: 30000 - DNA, 20 bp, Artificial Sequence
  Description of Artificial Sequence: Synthetic oligonucleotide
  Target: SCN9A; (-) strand; PAM type: NRG; PAM sequence: AAG
atttttgtattaaaatataa

SEQ ID NO: 30001 - DNA, 20 bp, Artificial Sequence
  Description of Artificial Sequence: Synthetic oligonucleotide
  Target: SCN9A; (-) strand; PAM type: NRG; PAM sequence: CAG
caggcctttaaatacaagta

SEQ ID NO: 30002 - DNA, 20 bp, Artificial Sequence
  Description of Artificial Sequence: Synthetic oligonucleotide
  Target: SCN9A; (-) strand; PAM type: NRG; PAM sequence: AAG
aaactcaggcctttaaatac

SEQ ID NO: 30003 - DNA, 20 bp, Artificial Sequence
  Description of Artificial Sequence: Synthetic oligonucleotide
  Target: SCN9A; (-) strand; PAM type: NRG; PAM sequence: AGG
aagaagcacacaaaaaactc

SEQ ID NO: 30004 - DNA, 20 bp, Artificial Sequence
  Description of Artificial Sequence: Synthetic oligonucleotide
  Target: SCN9A; (-) strand; PAM type: NRG; PAM sequence: CAG
taagaagcacacaaaaaact

SEQ ID NO: 30005 - DNA, 20 bp, Artificial Sequence
  Description of Artificial Sequence: Synthetic oligonucleotide
  Target: SCN9A; (-) strand; PAM type: NRG; PAM sequence: AAG
aaatgaataaaacctataag

SEQ ID NO: 30006 - DNA, 20 bp, Artificial Sequence
  Description of Artificial Sequence: Synthetic oligonucleotide
  Target: SCN9A; (-) strand; PAM type: NRG; PAM sequence: AAG
taaaaatgaataaaacctat

SEQ ID NO: 30007 - DNA, 20 bp, Artificial Sequence
  Description of Artificial Sequence: Synthetic oligonucleotide
  Target: SCN9A; (-) strand; PAM type: NRG; PAM sequence: AAG
attaggtttacactttttcc

SEQ ID NO: 30008 - DNA, 20 bp, Artificial Sequence
  Description of Artificial Sequence: Synthetic oligonucleotide
  Target: SCN9A; (-) strand; PAM type: NRG; PAM sequence: AGG
tagtctatgcagtgccaatt

SEQ ID NO: 30009 - DNA, 20 bp, Artificial Sequence
  Description of Artificial Sequence: Synthetic oligonucleotide
  Target: SCN9A; (-) strand; PAM type: NRG; PAM sequence: TAG
atagtctatgcagtgccaat

SEQ ID NO: 30010 - DNA, 20 bp, Artificial Sequence
  Description of Artificial Sequence: Synthetic oligonucleotide
  Target: SCN9A; (-) strand; PAM type: NRG; PAM sequence: CAG
acttggatggatagtctatg

SEQ ID NO: 30011 - DNA, 20 bp, Artificial Sequence
  Description of Artificial Sequence: Synthetic oligonucleotide
  Target: SCN9A; (-) strand; PAM type: NRG; PAM sequence: TAG
atgctcagcacttggatgga

SEQ ID NO: 30012 - DNA, 20 bp, Artificial Sequence
  Description of Artificial Sequence: Synthetic oligonucleotide
  Target: SCN9A; (-) strand; PAM type: NRG; PAM sequence: TGG
ctccatgctcagcacttgga

SEQ ID NO: 30013 - DNA, 20 bp, Artificial Sequence
  Description of Artificial Sequence: Synthetic oligonucleotide
  Target: SCN9A; (-) strand; PAM type: NRG; PAM sequence: TGG
cttcctccatgctcagcact

SEQ ID NO: 30014 - DNA, 20 bp, Artificial Sequence
  Description of Artificial Sequence: Synthetic oligonucleotide
  Target: SCN9A; (-) strand; PAM type: NRG; PAM sequence: CAG
tgatcatcttcctccatgct

SEQ ID NO: 30015 - DNA, 20 bp, Artificial Sequence
  Description of Artificial Sequence: Synthetic oligonucleotide
  Target: SCN9A; (-) strand; PAM type: NRG; PAM sequence: GAG
cagaggtatgtgacatcatt

SEQ ID NO: 30016 - DNA, 20 bp, Artificial Sequence
  Description of Artificial Sequence: Synthetic oligonucleotide
  Target: SCN9A; (-) strand; PAM type: NRG; PAM sequence: AGG
aaagactatctcccactcag

SEQ ID NO: 30017 - DNA, 20 bp, Artificial Sequence
  Description of Artificial Sequence: Synthetic oligonucleotide
  Target: SCN9A; (-) strand; PAM type: NRG; PAM sequence: GAG
aaaagactatctcccactca

SEQ ID NO: 30018 - DNA, 20 bp, Artificial Sequence
  Description of Artificial Sequence: Synthetic oligonucleotide
  Target: SCN9A; (-) strand; PAM type: NRG; PAM sequence: CAG
caaaaagactatctcccact

SEQ ID NO: 30019 - DNA, 20 bp, Artificial Sequence
  Description of Artificial Sequence: Synthetic oligonucleotide
  Target: SCN9A; (-) strand; PAM type: NRG; PAM sequence: AAG
caaatactaaatttttcaaa

SEQ ID NO: 30020 - DNA, 20 bp, Artificial Sequence
  Description of Artificial Sequence: Synthetic oligonucleotide
  Target: SCN9A; (-) strand; PAM type: NRG; PAM sequence: AGG
tatgaaagctagtcattgat

SEQ ID NO: 30021 - DNA, 20 bp, Artificial Sequence
  Description of Artificial Sequence: Synthetic oligonucleotide
  Target: SCN9A; (-) strand; PAM type: NRG; PAM sequence: TAG
atatgaaagctagtcattga

SEQ ID NO: 30022 - DNA, 20 bp, Artificial Sequence
  Description of Artificial Sequence: Synthetic oligonucleotide
  Target: SCN9A; (-) strand; PAM type: NRG; PAM sequence: TAG
aatggaagctatatgaaagc

SEQ ID NO: 30023 - DNA, 20 bp, Artificial Sequence
  Description of Artificial Sequence: Synthetic oligonucleotide
  Target: SCN9A; (-) strand; PAM type: NRG; PAM sequence: AAG
ggaaaatggaagctatatga

SEQ ID NO: 30024 - DNA, 20 bp, Artificial Sequence
  Description of Artificial Sequence: Synthetic oligonucleotide
  Target: SCN9A; (-) strand; PAM type: NRG; PAM sequence: AAG
ctgtatttaaaggaaaatgg

SEQ ID NO: 30025 - DNA, 20 bp, Artificial Sequence
  Description of Artificial Sequence: Synthetic oligonucleotide
  Target: SCN9A; (-) strand; PAM type: NRG; PAM sequence: TGG
tgtctgtatttaaaggaaaa

SEQ ID NO: 30026 - DNA, 20 bp, Artificial Sequence
  Description of Artificial Sequence: Synthetic oligonucleotide
  Target: SCN9A; (-) strand; PAM type: NRG; PAM sequence: AGG
catggaatgtctgtatttaa

SEQ ID NO: 30027 - DNA, 20 bp, Artificial Sequence
  Description of Artificial Sequence: Synthetic oligonucleotide
  Target: SCN9A; (-) strand; PAM type: NRG; PAM sequence: AAG
gcatggaatgtctgtattta

SEQ ID NO: 30028 - DNA, 20 bp, Artificial Sequence
  Description of Artificial Sequence: Synthetic oligonucleotide
  Target: SCN9A; (-) strand; PAM type: NRG; PAM sequence: TGG
ggggtctgatttttccagca

SEQ ID NO: 30029 - DNA, 20 bp, Artificial Sequence
  Description of Artificial Sequence: Synthetic oligonucleotide
  Target: SCN9A; (-) strand; PAM type: NRG; PAM sequence: CAG
cctctggggtctgatttttc

SEQ ID NO: 30030 - DNA, 20 bp, Artificial Sequence
  Description of Artificial Sequence: Synthetic oligonucleotide
  Target: SCN9A; (-) strand; PAM type: NRG; PAM sequence: GGG
ccaataacagcaaacctctg

SEQ ID NO: 30031 - DNA, 20 bp, Artificial Sequence
  Description of Artificial Sequence: Synthetic oligonucleotide
  Target: SCN9A; (-) strand; PAM type: NRG; PAM sequence: GGG
tccaataacagcaaacctct

SEQ ID NO: 30032 - DNA, 20 bp, Artificial Sequence
  Description of Artificial Sequence: Synthetic oligonucleotide
  Target: SCN9A; (-) strand; PAM type: NRG; PAM sequence: TGG
ttccaataacagcaaacctc

SEQ ID NO: 30033 - DNA, 20 bp, Artificial Sequence
  Description of Artificial Sequence: Synthetic oligonucleotide
  Target: SCN9A; (-) strand; PAM type: NRG; PAM sequence: CAG
gcagcacagtgttccaataa

SEQ ID NO: 30034 - DNA, 20 bp, Artificial Sequence
  Description of Artificial Sequence: Synthetic oligonucleotide
  Target: SCN9A; (-) strand; PAM type: NRG; PAM sequence: CAG
tatgaaaatctcaggcagca

SEQ ID NO: 30035 - DNA, 20 bp, Artificial Sequence
  Description of Artificial Sequence: Synthetic oligonucleotide
  Target: SCN9A; (-) strand; PAM type: NRG; PAM sequence: CAG
aaatttatgaaaatctcagg

SEQ ID NO: 30036 - DNA, 20 bp, Artificial Sequence
  Description of Artificial Sequence: Synthetic oligonucleotide
  Target: SCN9A; (-) strand; PAM type: NRG; PAM sequence: AGG
ggcaaatttatgaaaatctc

SEQ ID NO: 30037 - DNA, 20 bp, Artificial Sequence
  Description of Artificial Sequence: Synthetic oligonucleotide
  Target: SCN9A; (-) strand; PAM type: NRG; PAM sequence: CAG
cggcaaatttatgaaaatct

SEQ ID NO: 30038 - DNA, 20 bp, Artificial Sequence
  Description of Artificial Sequence: Synthetic oligonucleotide
  Target: SCN9A; (-) strand; PAM type: NRG; PAM sequence: CGG
gtactttcagctttttgaaa

SEQ ID NO: 30039 - DNA, 20 bp, Artificial Sequence
  Description of Artificial Sequence: Synthetic oligonucleotide
  Target: SCN9A; (-) strand; PAM type: NRG; PAM sequence: CAG
tgtttttgcgtaagtacttt

SEQ ID NO: 30040 - DNA, 20 bp, Artificial Sequence
  Description of Artificial Sequence: Synthetic oligonucleotide
  Target: SCN9A; (-) strand; PAM type: NRG; PAM sequence: AAG
tgtcgtcattgtttttgcgt

SEQ ID NO: 30041 - DNA, 20 bp, Artificial Sequence
  Description of Artificial Sequence: Synthetic oligonucleotide
  Target: SCN9A; (-) strand; PAM type: NRG; PAM sequence: TGG
tcgtgacccgtggaactggc

SEQ ID NO: 30042 - DNA, 20 bp, Artificial Sequence
  Description of Artificial Sequence: Synthetic oligonucleotide
  Target: SCN9A; (-) strand; PAM type: NRG; PAM sequence: TGG
ttcttcgtgacccgtggaac

SEQ ID NO: 30043 - DNA, 20 bp, Artificial Sequence
  Description of Artificial Sequence: Synthetic oligonucleotide
  Target: SCN9A; (-) strand; PAM type: NRG; PAM sequence: TGG
tcacttttcttcgtgacccg

SEQ ID NO: 30044 - DNA, 20 bp, Artificial Sequence
  Description of Artificial Sequence: Synthetic oligonucleotide
  Target: SCN9A; (-) strand; PAM type: NRG; PAM sequence: GAG
tgcaagaggcttctgtgtag

SEQ ID NO: 30045 - DNA, 20 bp, Artificial Sequence
  Description of Artificial Sequence: Synthetic oligonucleotide
  Target: SCN9A; (-) strand; PAM type: NRG; PAM sequence: AGG
cttgcaagaggcttctgtgt

SEQ ID NO: 30046 - DNA, 20 bp, Artificial Sequence
  Description of Artificial Sequence: Synthetic oligonucleotide
  Target: SCN9A; (-) strand; PAM type: NRG; PAM sequence: TAG
ccttgcaagaggcttctgtg

SEQ ID NO: 30047 - DNA, 20 bp, Artificial Sequence
  Description of Artificial Sequence: Synthetic oligonucleotide
  Target: SCN9A; (-) strand; PAM type: NRG; PAM sequence: AGG
cttgtaaaaatccttgcaag

SEQ ID NO: 30048 - DNA, 20 bp, Artificial Sequence
  Description of Artificial Sequence: Synthetic oligonucleotide
  Target: SCN9A; (-) strand; PAM type: NRG; PAM sequence: GAG
acttgtaaaaatccttgcaa

SEQ ID NO: 30049 - DNA, 20 bp, Artificial Sequence
  Description of Artificial Sequence: Synthetic oligonucleotide
  Target: SCN9A; (-) strand; PAM type: NRG; PAM sequence: AAG
tcacttgtaaaaatccttgc

SEQ ID NO: 30050 - DNA, 20 bp, Artificial Sequence
  Description of Artificial Sequence: Synthetic oligonucleotide
  Target: SCN9A; (-) strand; PAM type: NRG; PAM sequence: TGG
gtgtttaggtacacttttac

SEQ ID NO: 30051 - DNA, 20 bp, Artificial Sequence
  Description of Artificial Sequence: Synthetic oligonucleotide
  Target: SCN9A; (-) strand; PAM type: NRG; PAM sequence: AGG
cccaatggaatcttgtgttt

SEQ ID NO: 30052 - DNA, 20 bp, Artificial Sequence
  Description of Artificial Sequence: Synthetic oligonucleotide
  Target: SCN9A; (-) strand; PAM type: NRG; PAM sequence: TAG
tcccaatggaatcttgtgtt

SEQ ID NO: 30053 - DNA, 20 bp, Artificial Sequence
  Description of Artificial Sequence: Synthetic oligonucleotide
  Target: SCN9A; (-) strand; PAM type: NRG; PAM sequence: TGG
tttcacatctagtatcccaa

SEQ ID NO: 30054 - DNA, 20 bp, Artificial Sequence
  Description of Artificial Sequence: Synthetic oligonucleotide
  Target: SCN9A; (-) strand; PAM type: NRG; PAM sequence: TAG
ggttgtattcttttcacatc

SEQ ID NO: 30055 - DNA, 20 bp, Artificial Sequence
  Description of Artificial Sequence: Synthetic oligonucleotide
  Target: SCN9A; (-) strand; PAM type: NRG; PAM sequence: TGG
agttataaagatttacatgg

SEQ ID NO: 30056 - DNA, 20 bp, Artificial Sequence
  Description of Artificial Sequence: Synthetic oligonucleotide
  Target: SCN9A; (-) strand; PAM type: NRG; PAM sequence: TGG
ataagttataaagatttaca

SEQ ID NO: 30057 - DNA, 20 bp, Artificial Sequence
  Description of Artificial Sequence: Synthetic oligonucleotide
  Target: SCN9A; (-) strand; PAM type: NRG; PAM sequence: AAG
attagagaaaataagttata

SEQ ID NO: 30058 - DNA, 20 bp, Artificial Sequence
  Description of Artificial Sequence: Synthetic oligonucleotide
  Target: SCN9A; (-) strand; PAM type: NRG; PAM sequence: AAG
agtggttaattagagaaaat

SEQ ID NO: 30059 - DNA, 20 bp, Artificial Sequence
  Description of Artificial Sequence: Synthetic oligonucleotide
  Target: SCN9A; (-) strand; PAM type: NRG; PAM sequence: GAG
tgtcttccagtggttaatta

SEQ ID NO: 30060 - DNA, 20 bp, Artificial Sequence
  Description of Artificial Sequence: Synthetic oligonucleotide
  Target: SCN9A; (-) strand; PAM type: NRG; PAM sequence: TAG
tatgtcttccagtggttaat

SEQ ID NO: 30061 - DNA, 20 bp, Artificial Sequence
  Description of Artificial Sequence: Synthetic oligonucleotide
  Target: SCN9A; (-) strand; PAM type: NRG; PAM sequence: TGG
ctccaatatatgtcttccag

SEQ ID NO: 30062 - DNA, 20 bp, Artificial Sequence
  Description of Artificial Sequence: Synthetic oligonucleotide
  Target: SCN9A; (-) strand; PAM type: NRG; PAM sequence: CAG
atcctccaatatatgtcttc

SEQ ID NO: 30063 - DNA, 20 bp, Artificial Sequence
  Description of Artificial Sequence: Synthetic oligonucleotide
  Target: SCN9A; (-) strand; PAM type: NRG; PAM sequence: CAG
agggtgtgtccataacccaa

SEQ ID NO: 30064 - DNA, 20 bp, Artificial Sequence
  Description of Artificial Sequence: Synthetic oligonucleotide
  Target: SCN9A; (-) strand; PAM type: NRG; PAM sequence: GGG
agacctattgtagtttaata

SEQ ID NO: 30065 - DNA, 20 bp, Artificial Sequence
  Description of Artificial Sequence: Synthetic oligonucleotide
  Target: SCN9A; (-) strand; PAM type: NRG; PAM sequence: AGG
tagacctattgtagtttaat

SEQ ID NO: 30066 - DNA, 20 bp, Artificial Sequence
  Description of Artificial Sequence: Synthetic oligonucleotide
  Target: SCN9A; (-) strand; PAM type: NRG; PAM sequence: TAG
atagacctattgtagtttaa

SEQ ID NO: 30067 - DNA, 20 bp, Artificial Sequence
  Description of Artificial Sequence: Synthetic oligonucleotide
  Target: SCN9A; (-) strand; PAM type: NRG; PAM sequence: TAG
ttttctggatagacctattg

SEQ ID NO: 30068 - DNA, 20 bp, Artificial Sequence
  Description of Artificial Sequence: Synthetic oligonucleotide
  Target: SCN9A; (-) strand; PAM type: NRG; PAM sequence: TAG
acattttaatattttctgga

SEQ ID NO: 30069 - DNA, 20 bp, Artificial Sequence
  Description of Artificial Sequence: Synthetic oligonucleotide
  Target: SCN9A; (-) strand; PAM type: NRG; PAM sequence: TGG
attgacattttaatattttc

SEQ ID NO: 30070 - DNA, 20 bp, Artificial Sequence
  Description of Artificial Sequence: Synthetic oligonucleotide
  Target: SCN9A; (-) strand; PAM type: NRG; PAM sequence: GAG
caagtacctctgctttctgg

SEQ ID NO: 30071 - DNA, 20 bp, Artificial Sequence
  Description of Artificial Sequence: Synthetic oligonucleotide
  Target: SCN9A; (-) strand; PAM type: NRG; PAM sequence: GGG
ttcaagtacctctgctttct

SEQ ID NO: 30072 - DNA, 20 bp, Artificial Sequence
  Description of Artificial Sequence: Synthetic oligonucleotide
  Target: SCN9A; (-) strand; PAM type: NRG; PAM sequence: TGG
tttcaagtacctctgctttc

SEQ ID NO: 30073 - DNA, 20 bp, Artificial Sequence
  Description of Artificial Sequence: Synthetic oligonucleotide
  Target: SCN9A; (-) strand; PAM type: NRG; PAM sequence: AAG
cctatattcttagttatttc

SEQ ID NO: 30074 - DNA, 20 bp, Artificial Sequence
  Description of Artificial Sequence: Synthetic oligonucleotide
  Target: SCN9A; (-) strand; PAM type: NRG; PAM sequence: TAG
agatctgagacctatattct

SEQ ID NO: 30075 - DNA, 20 bp, Artificial Sequence
  Description of Artificial Sequence: Synthetic oligonucleotide
  Target: SCN9A; (-) strand; PAM type: NRG; PAM sequence: GAG
ggaaatttttaggcagatct

SEQ ID NO: 30076 - DNA, 20 bp, Artificial Sequence
  Description of Artificial Sequence: Synthetic oligonucleotide
  Target: SCN9A; (-) strand; PAM type: NRG; PAM sequence: CAG
caatgtaggaaatttttagg

SEQ ID NO: 30077 - DNA, 20 bp, Artificial Sequence
  Description of Artificial Sequence: Synthetic oligonucleotide
  Target: SCN9A; (-) strand; PAM type: NRG; PAM sequence: AGG
aagcaatgtaggaaattttt

SEQ ID NO: 30078 - DNA, 20 bp, Artificial Sequence
  Description of Artificial Sequence: Synthetic oligonucleotide
  Target: SCN9A; (-) strand; PAM type: NRG; PAM sequence: TAG
gaagcaatgtaggaaatttt

SEQ ID NO: 30079 - DNA, 20 bp, Artificial Sequence
  Description of Artificial Sequence: Synthetic oligonucleotide
  Target: SCN9A; (-) strand; PAM type: NRG; PAM sequence: AGG
atttttgatagaagcaatgt

SEQ ID NO: 30080 - DNA, 20 bp, Artificial Sequence
  Description of Artificial Sequence: Synthetic oligonucleotide
  Target: SCN9A; (-) strand; PAM type: NRG; PAM sequence: TAG
aatttttgatagaagcaatg

SEQ ID NO: 30081 - DNA, 20 bp, Artificial Sequence
  Description of Artificial Sequence: Synthetic oligonucleotide
  Target: SCN9A; (-) strand; PAM type: NRG; PAM sequence: AAG
attgggtgaatttttgatag

SEQ ID NO: 30082 - DNA, 20 bp, Artificial Sequence
  Description of Artificial Sequence: Synthetic oligonucleotide
  Target: SCN9A; (-) strand; PAM type: NRG; PAM sequence: TAG
atgattgggtgaatttttga

SEQ ID NO: 30083 - DNA, 20 bp, Artificial Sequence
  Description of Artificial Sequence: Synthetic oligonucleotide
  Target: SCN9A; (-) strand; PAM type: NRG; PAM sequence: GGG
gggtgtatttttaaatgatt

SEQ ID NO: 30084 - DNA, 20 bp, Artificial Sequence
  Description of Artificial Sequence: Synthetic oligonucleotide
  Target: SCN9A; (-) strand; PAM type: NRG; PAM sequence: TGG
tgggtgtatttttaaatgat

SEQ ID NO: 30085 - DNA, 20 bp, Artificial Sequence
  Description of Artificial Sequence: Synthetic oligonucleotide
  Target: SCN9A; (-) strand; PAM type: NRG; PAM sequence: GGG
tgtatgttttataattatat

SEQ ID NO: 30086 - DNA, 20 bp, Artificial Sequence
  Description of Artificial Sequence: Synthetic oligonucleotide
  Target: SCN9A; (-) strand; PAM type: NRG; PAM sequence: TGG
gtgtatgttttataattata

SEQ ID NO: 30087 - DNA, 20 bp, Artificial Sequence
  Description of Artificial Sequence: Synthetic oligonucleotide
  Target: SCN9A; (-) strand; PAM type: NRG; PAM sequence: GGG
gttacacatattttattctt

SEQ ID NO: 30088 - DNA, 20 bp, Artificial Sequence
  Description of Artificial Sequence: Synthetic oligonucleotide
  Target: SCN9A; (-) strand; PAM type: NRG; PAM sequence: TGG
tgttacacatattttattct

SEQ ID NO: 30089 - DNA, 20 bp, Artificial Sequence
  Description of Artificial Sequence: Synthetic oligonucleotide
  Target: SCN9A; (-) strand; PAM type: NRG; PAM sequence: TAG
cagatgctccatcctgttct

SEQ ID NO: 30090 - DNA, 20 bp, Artificial Sequence
  Description of Artificial Sequence: Synthetic oligonucleotide
  Target: SCN9A; (-) strand; PAM type: NRG; PAM sequence: CAG
ttctcaaagaatgaacttgt

SEQ ID NO: 30091 - DNA, 20 bp, Artificial Sequence
  Description of Artificial Sequence: Synthetic oligonucleotide
  Target: SCN9A; (-) strand; PAM type: NRG; PAM sequence: AAG
gatgctacagtgttttctca

SEQ ID NO: 30092 - DNA, 20 bp, Artificial Sequence
  Description of Artificial Sequence: Synthetic oligonucleotide
  Target: SCN9A; (-) strand; PAM type: NRG; PAM sequence: CAG
attagaaaaattagatgcta

SEQ ID NO: 30093 - DNA, 20 bp, Artificial Sequence
  Description of Artificial Sequence: Synthetic oligonucleotide
  Target: SCN9A; (-) strand; PAM type: NRG; PAM sequence: TAG
acctgctagattagaaaaat

SEQ ID NO: 30094 - DNA, 20 bp, Artificial Sequence
  Description of Artificial Sequence: Synthetic oligonucleotide
  Target: SCN9A; (-) strand; PAM type: NRG; PAM sequence: TAG
atgatattaacctgctagat

SEQ ID NO: 30095 - DNA, 20 bp, Artificial Sequence
  Description of Artificial Sequence: Synthetic oligonucleotide
  Target: SCN9A; (-) strand; PAM type: NRG; PAM sequence: TAG
cctctatgatattaacctgc

SEQ ID NO: 30096 - DNA, 20 bp, Artificial Sequence
  Description of Artificial Sequence: Synthetic oligonucleotide
  Target: SCN9A; (-) strand; PAM type: NRG; PAM sequence: GGG
ttactgcatttatgaagatg

SEQ ID NO: 30097 - DNA, 20 bp, Artificial Sequence
  Description of Artificial Sequence: Synthetic oligonucleotide
  Target: SCN9A; (-) strand; PAM type: NRG; PAM sequence: GGG
gttactgcatttatgaagat

SEQ ID NO: 30098 - DNA, 20 bp, Artificial Sequence
  Description of Artificial Sequence: Synthetic oligonucleotide
  Target: SCN9A; (-) strand; PAM type: NRG; PAM sequence: TGG
agttactgcatttatgaaga

SEQ ID NO: 30099 - DNA, 20 bp, Artificial Sequence
  Description of Artificial Sequence: Synthetic oligonucleotide
  Target: SCN9A; (-) strand; PAM type: NRG; PAM sequence: AAG
aggaagttactgcatttatg

SEQ ID NO: 30100 - DNA, 20 bp, Artificial Sequence
  Description of Artificial Sequence: Synthetic oligonucleotide
  Target: SCN9A; (-) strand; PAM type: NRG; PAM sequence: AAG
cctttccttttcctgccagg

SEQ ID NO: 30101 - DNA, 20 bp, Artificial Sequence
  Description of Artificial Sequence: Synthetic oligonucleotide
  Target: SCN9A; (-) strand; PAM type: NRG; PAM sequence: AGG
catcctttccttttcctgcc

SEQ ID NO: 30102 - DNA, 20 bp, Artificial Sequence
  Description of Artificial Sequence: Synthetic oligonucleotide
  Target: SCN9A; (-) strand; PAM type: NRG; PAM sequence: CAG
tcatcctttccttttcctgc

SEQ ID NO: 30103 - DNA, 20 bp, Artificial Sequence
  Description of Artificial Sequence: Synthetic oligonucleotide
  Target: SCN9A; (-) strand; PAM type: NRG; PAM sequence: TGG
agtacattttaatatagttt

SEQ ID NO: 30104 - DNA, 20 bp, Artificial Sequence
  Description of Artificial Sequence: Synthetic oligonucleotide
  Target: SCN9A; (-) strand; PAM type: NRG; PAM sequence: TAG
ggtataagtacattttaata

SEQ ID NO: 30105 - DNA, 20 bp, Artificial Sequence
  Description of Artificial Sequence: Synthetic oligonucleotide
  Target: SCN9A; (-) strand; PAM type: NRG; PAM sequence: AAG
aatgtcgagtaagtgggtat

SEQ ID NO: 30106 - DNA, 20 bp, Artificial Sequence
  Description of Artificial Sequence: Synthetic oligonucleotide
  Target: SCN9A; (-) strand; PAM type: NRG; PAM sequence: GGG
accaaaaatgtcgagtaagt

SEQ ID NO: 30107 - DNA, 20 bp, Artificial Sequence
  Description of Artificial Sequence: Synthetic oligonucleotide
  Target: SCN9A; (-) strand; PAM type: NRG; PAM sequence: TGG
gaccaaaaatgtcgagtaag

SEQ ID NO: 30108 - DNA, 20 bp, Artificial Sequence
  Description of Artificial Sequence: Synthetic oligonucleotide
  Target: SCN9A; (-) strand; PAM type: NRG; PAM sequence: AAG
ctggaccaaaaatgtcgagt

SEQ ID NO: 30109 - DNA, 20 bp, Artificial Sequence
  Description of Artificial Sequence: Synthetic oligonucleotide
  Target: SCN9A; (-) strand; PAM type: NRG; PAM sequence: GAG
cggactggaccaaaaatgtc

SEQ ID NO: 30110 - DNA, 20 bp, Artificial Sequence
  Description of Artificial Sequence: Synthetic oligonucleotide
  Target: SCN9A; (-) strand; PAM type: NRG; PAM sequence: TGG
ccatgaataacccaccggac

SEQ ID NO: 30111 - DNA, 20 bp, Artificial Sequence
  Description of Artificial Sequence: Synthetic oligonucleotide
  Target: SCN9A; (-) strand; PAM type: NRG; PAM sequence: CGG
tatgaccatgaataacccac

SEQ ID NO: 30112 - DNA, 20 bp, Artificial Sequence
  Description of Artificial Sequence: Synthetic oligonucleotide
  Target: SCN9A; (-) strand; PAM type: NRG; PAM sequence: CAG
tgattctaagctaccttatt

SEQ ID NO: 30113 - DNA, 20 bp, Artificial Sequence
  Description of Artificial Sequence: Synthetic oligonucleotide
  Target: SCN9A; (-) strand; PAM type: NRG; PAM sequence: AAG
ctcttttgttccttgattct

SEQ ID NO: 30114 - DNA, 20 bp, Artificial Sequence
  Description of Artificial Sequence: Synthetic oligonucleotide
  Target: SCN9A; (-) strand; PAM type: NRG; PAM sequence: AAG
aaagttgtaagcatttcaac

SEQ ID NO: 30115 - DNA, 20 bp, Artificial Sequence
  Description of Artificial Sequence: Synthetic oligonucleotide
  Target: SCN9A; (-) strand; PAM type: NRG; PAM sequence: AAG
tttttcttaggaaaagttgt

SEQ ID NO: 30116 - DNA, 20 bp, Artificial Sequence
  Description of Artificial Sequence: Synthetic oligonucleotide
  Target: SCN9A; (-) strand; PAM type: NRG; PAM sequence: AAG
tagaatttttttcttaggaa

SEQ ID NO: 30117 - DNA, 20 bp, Artificial Sequence
  Description of Artificial Sequence: Synthetic oligonucleotide
  Target: SCN9A; (-) strand; PAM type: NRG; PAM sequence: AGG
tcatttagaatttttttctt

SEQ ID NO: 30118 - DNA, 20 bp, Artificial Sequence
  Description of Artificial Sequence: Synthetic oligonucleotide
  Target: SCN9A; (-) strand; PAM type: NRG; PAM sequence: TAG
ctcatttagaatttttttct

SEQ ID NO: 30119 - DNA, 20 bp, Artificial Sequence
  Description of Artificial Sequence: Synthetic oligonucleotide
  Target: SCN9A; (-) strand; PAM type: NRG; PAM sequence: TAG
aaatagtctacaagctcatt

SEQ ID NO: 30120 - DNA, 20 bp, Artificial Sequence
  Description of Artificial Sequence: Synthetic oligonucleotide
  Target: SCN9A; (-) strand; PAM type: NRG; PAM sequence: AAG
aaagagacaaaatagtctac

SEQ ID NO: 30121 - DNA, 20 bp, Artificial Sequence
  Description of Artificial Sequence: Synthetic oligonucleotide
  Target: SCN9A; (-) strand; PAM type: NRG; PAM sequence: TAG
tcttgttcaaagagacaaaa

SEQ ID NO: 30122 - DNA, 20 bp, Artificial Sequence
  Description of Artificial Sequence: Synthetic oligonucleotide
  Target: SCN9A; (-) strand; PAM type: NRG; PAM sequence: GAG
ttattactctcttgttcaaa

SEQ ID NO: 30123 - DNA, 20 bp, Artificial Sequence
  Description of Artificial Sequence: Synthetic oligonucleotide
  Target: SCN9A; (-) strand; PAM type: NRG; PAM sequence: AAG
atttattactctcttgttca

SEQ ID NO: 30124 - DNA, 20 bp, Artificial Sequence
  Description of Artificial Sequence: Synthetic oligonucleotide
  Target: SCN9A; (-) strand; PAM type: NRG; PAM sequence: AGG
agtggcaatattaagatttt

SEQ ID NO: 30125 - DNA, 20 bp, Artificial Sequence
  Description of Artificial Sequence: Synthetic oligonucleotide
  Target: SCN9A; (-) strand; PAM type: NRG; PAM sequence: TAG
gagtggcaatattaagattt

SEQ ID NO: 30126 - DNA, 20 bp, Artificial Sequence
  Description of Artificial Sequence: Synthetic oligonucleotide
  Target: SCN9A; (-) strand; PAM type: NRG; PAM sequence: AAG
actgggagagtggcaatatt

SEQ ID NO: 30127 - DNA, 20 bp, Artificial Sequence
  Description of Artificial Sequence: Synthetic oligonucleotide
  Target: SCN9A; (-) strand; PAM type: NRG; PAM sequence: TGG
ctcagagaagactgggagag

SEQ ID NO: 30128 - DNA, 20 bp, Artificial Sequence
  Description of Artificial Sequence: Synthetic oligonucleotide
  Target: SCN9A; (-) strand; PAM type: NRG; PAM sequence: GAG
ggtctcagagaagactggga

SEQ ID NO: 30129 - DNA, 20 bp, Artificial Sequence
  Description of Artificial Sequence: Synthetic oligonucleotide
  Target: SCN9A; (-) strand; PAM type: NRG; PAM sequence: GAG
tgggtctcagagaagactgg

SEQ ID NO: 30130 - DNA, 20 bp, Artificial Sequence
  Description of Artificial Sequence: Synthetic oligonucleotide
  Target: SCN9A; (-) strand; PAM type: NRG; PAM sequence: GGG
catgggtctcagagaagact

SEQ ID NO: 30131 - DNA, 20 bp, Artificial Sequence
  Description of Artificial Sequence: Synthetic oligonucleotide
  Target: SCN9A; (-) strand; PAM type: NRG; PAM sequence: TGG
tcatgggtctcagagaagac

SEQ ID NO: 30132 - DNA, 20 bp, Artificial Sequence
  Description of Artificial Sequence: Synthetic oligonucleotide
  Target: SCN9A; (-) strand; PAM type: NRG; PAM sequence: AAG
atttgtcatgggtctcagag

SEQ ID NO: 30133 - DNA, 20 bp, Artificial Sequence
  Description of Artificial Sequence: Synthetic oligonucleotide
  Target: SCN9A; (-) strand; PAM type: NRG; PAM sequence: GAG
ataatttgtcatgggtctca

SEQ ID NO: 30134 - DNA, 20 bp, Artificial Sequence
  Description of Artificial Sequence: Synthetic oligonucleotide
  Target: SCN9A; (-) strand; PAM type: NRG; PAM sequence: CAG
atataatttgtcatgggtct

SEQ ID NO: 30135 - DNA, 20 bp, Artificial Sequence
  Description of Artificial Sequence: Synthetic oligonucleotide
  Target: SCN9A; (-) strand; PAM type: NRG; PAM sequence: GGG
ttattaatataatttgtcat

SEQ ID NO: 30136 - DNA, 20 bp, Artificial Sequence
  Description of Artificial Sequence: Synthetic oligonucleotide
  Target: SCN9A; (-) strand; PAM type: NRG; PAM sequence: TGG
attattaatataatttgtca

SEQ ID NO: 30137 - DNA, 20 bp, Artificial Sequence
  Description of Artificial Sequence: Synthetic oligonucleotide
  Target: SCN9A; (-) strand; PAM type: NRG; PAM sequence: CAG
tggttttagtttattaattt

SEQ ID NO: 30138 - DNA, 20 bp, Artificial Sequence
  Description of Artificial Sequence: Synthetic oligonucleotide
  Target: SCN9A; (-) strand; PAM type: NRG; PAM sequence: TAG
accttgaaagactctggttt

SEQ ID NO: 30139 - DNA, 20 bp, Artificial Sequence
  Description of Artificial Sequence: Synthetic oligonucleotide
  Target: SCN9A; (-) strand; PAM type: NRG; PAM sequence: TGG
ttttgcaccttgaaagactc

SEQ ID NO: 30140 - DNA, 20 bp, Artificial Sequence
  Description of Artificial Sequence: Synthetic oligonucleotide
  Target: SCN9A; (-) strand; PAM type: NRG; PAM sequence: AAG
ttataccttttgcaccttga

SEQ ID NO: 30141 - DNA, 20 bp, Artificial Sequence
  Description of Artificial Sequence: Synthetic oligonucleotide
  Target: SCN9A; (-) strand; PAM type: NRG; PAM sequence: TAG
tttgctattttattcaaata

SEQ ID NO: 30142 - DNA, 20 bp, Artificial Sequence
  Description of Artificial Sequence: Synthetic oligonucleotide
  Target: SCN9A; (-) strand; PAM type: NRG; PAM sequence: TGG
ttacatccagtggcacttta

SEQ ID NO: 30143 - DNA, 20 bp, Artificial Sequence
  Description of Artificial Sequence: Synthetic oligonucleotide
  Target: SCN9A; (-) strand; PAM type: NRG; PAM sequence: TGG
ttaaaaatgattacatccag

SEQ ID NO: 30144 - DNA, 20 bp, Artificial Sequence
  Description of Artificial Sequence: Synthetic oligonucleotide
  Target: SCN9A; (-) strand; PAM type: NRG; PAM sequence: CAG
cttttaaaaatgattacatc

SEQ ID NO: 30145 - DNA, 20 bp, Artificial Sequence
  Description of Artificial Sequence: Synthetic oligonucleotide
  Target: SCN9A; (-) strand; PAM type: NRG; PAM sequence: TAG
aagaatatctattaagattt

SEQ ID NO: 30146 - DNA, 20 bp, Artificial Sequence
  Description of Artificial Sequence: Synthetic oligonucleotide
  Target: SCN9A; (-) strand; PAM type: NRG; PAM sequence: AAG
ctctaagaagaatatctatt

SEQ ID NO: 30147 - DNA, 20 bp, Artificial Sequence
  Description of Artificial Sequence: Synthetic oligonucleotide
  Target: SCN9A; (-) strand; PAM type: NRG; PAM sequence: AAG
tctcctttcagtcctctaag

SEQ ID NO: 30148 - DNA, 20 bp, Artificial Sequence
  Description of Artificial Sequence: Synthetic oligonucleotide
  Target: SCN9A; (-) strand; PAM type: NRG; PAM sequence: AAG
ctttctcctttcagtcctct

SEQ ID NO: 30149 - DNA, 20 bp, Artificial Sequence
  Description of Artificial Sequence: Synthetic oligonucleotide
  Target: SCN9A; (-) strand; PAM type: NRG; PAM sequence: CAG
ttatatatgctttctccttt

SEQ ID NO: 30150 - DNA, 20 bp, Artificial Sequence
  Description of Artificial Sequence: Synthetic oligonucleotide
  Target: SCN9A; (-) strand; PAM type: NRG; PAM sequence: GGG
ctttcatagtattgaacaaa

SEQ ID NO: 30151 - DNA, 20 bp, Artificial Sequence
  Description of Artificial Sequence: Synthetic oligonucleotide
  Target: SCN9A; (-) strand; PAM type: NRG; PAM sequence: AGG
actttcatagtattgaacaa

SEQ ID NO: 30152 - DNA, 20 bp, Artificial Sequence
  Description of Artificial Sequence: Synthetic oligonucleotide
  Target: SCN9A; (-) strand; PAM type: NRG; PAM sequence: AAG
gactttcatagtattgaaca

SEQ ID NO: 30153 - DNA, 20 bp, Artificial Sequence
  Description of Artificial Sequence: Synthetic oligonucleotide
  Target: SCN9A; (-) strand; PAM type: NRG; PAM sequence: TAG
tttcctcctgcagactttca

SEQ ID NO: 30154 - DNA, 20 bp, Artificial Sequence
  Description of Artificial Sequence: Synthetic oligonucleotide
  Target: SCN9A; (-) strand; PAM type: NRG; PAM sequence: CAG
atcctttctttttcctcctg

SEQ ID NO: 30155 - DNA, 20 bp, Artificial Sequence
  Description of Artificial Sequence: Synthetic oligonucleotide
  Target: SCN9A; (-) strand; PAM type: NRG; PAM sequence: TGG
gatgtgaaaaattgatattt

SEQ ID NO: 30156 - DNA, 20 bp, Artificial Sequence
  Description of Artificial Sequence: Synthetic oligonucleotide
  Target: SCN9A; (-) strand; PAM type: NRG; PAM sequence: AGG
tataacactgccatgtagaa

SEQ ID NO: 30157 - DNA, 20 bp, Artificial Sequence
  Description of Artificial Sequence: Synthetic oligonucleotide
  Target: SCN9A; (-) strand; PAM type: NRG; PAM sequence: AAG
atataacactgccatgtaga

SEQ ID NO: 30158 - DNA, 20 bp, Artificial Sequence
  Description of Artificial Sequence: Synthetic oligonucleotide
  Target: SCN9A; (-) strand; PAM type: NRG; PAM sequence: TAG
ttcaatataacactgccatg

SEQ ID NO: 30159 - DNA, 20 bp, Artificial Sequence
  Description of Artificial Sequence: Synthetic oligonucleotide
  Target: SCN9A; (-) strand; PAM type: NRG; PAM sequence: CAG
acattgctggagtctgatgg

SEQ ID NO: 30160 - DNA, 20 bp, Artificial Sequence
  Description of Artificial Sequence: Synthetic oligonucleotide
  Target: SCN9A; (-) strand; PAM type: NRG; PAM sequence: TGG
accacattgctggagtctga

SEQ ID NO: 30161 - DNA, 20 bp, Artificial Sequence
  Description of Artificial Sequence: Synthetic oligonucleotide
  Target: SCN9A; (-) strand; PAM type: NRG; PAM sequence: GAG
acattggaaccacattgctg

SEQ ID NO: 30162 - DNA, 20 bp, Artificial Sequence
  Description of Artificial Sequence: Synthetic oligonucleotide
  Target: SCN9A; (-) strand; PAM type: NRG; PAM sequence: TGG
tgacattggaaccacattgc

SEQ ID NO: 30163 - DNA, 20 bp, Artificial Sequence
  Description of Artificial Sequence: Synthetic oligonucleotide
  Target: SCN9A; (-) strand; PAM type: NRG; PAM sequence: TGG
gatagatgcgttgatgacat

SEQ ID NO: 30164 - DNA, 20 bp, Artificial Sequence
  Description of Artificial Sequence: Synthetic oligonucleotide
  Target: SCN9A; (-) strand; PAM type: NRG; PAM sequence: TAG
attggccaaggtgacattga

SEQ ID NO: 30165 - DNA, 20 bp, Artificial Sequence
  Description of Artificial Sequence: Synthetic oligonucleotide
  Target: SCN9A; (-) strand; PAM type: NRG; PAM sequence: AGG
gacttggagttcattggcca

SEQ ID NO: 30166 - DNA, 20 bp, Artificial Sequence
  Description of Artificial Sequence: Synthetic oligonucleotide
  Target: SCN9A; (-) strand; PAM type: NRG; PAM sequence: AAG
ggacttggagttcattggcc

SEQ ID NO: 30167 - DNA, 20 bp, Artificial Sequence
  Description of Artificial Sequence: Synthetic oligonucleotide
  Target: SCN9A; (-) strand; PAM type: NRG; PAM sequence: TGG
gaagtggacttggagttcat

SEQ ID NO: 30168 - DNA, 20 bp, Artificial Sequence
  Description of Artificial Sequence: Synthetic oligonucleotide
  Target: SCN9A; (-) strand; PAM type: NRG; PAM sequence: GAG
actatgaagaagtggacttg

SEQ ID NO: 30169 - DNA, 20 bp, Artificial Sequence
  Description of Artificial Sequence: Synthetic oligonucleotide
  Target: SCN9A; (-) strand; PAM type: NRG; PAM sequence: TGG
ttactatgaagaagtggact

SEQ ID NO: 30170 - DNA, 20 bp, Artificial Sequence
  Description of Artificial Sequence: Synthetic oligonucleotide
  Target: SCN9A; (-) strand; PAM type: NRG; PAM sequence: TGG
ttaaagttactatgaagaag

SEQ ID NO: 30171 - DNA, 20 bp, Artificial Sequence
  Description of Artificial Sequence: Synthetic oligonucleotide
  Target: SCN9A; (-) strand; PAM type: NRG; PAM sequence: AAG
tttttaaagttactatgaag

SEQ ID NO: 30172 - DNA, 20 bp, Artificial Sequence
  Description of Artificial Sequence: Synthetic oligonucleotide
  Target: SCN9A; (-) strand; PAM type: NRG; PAM sequence: AAG
caatttttaaagttactatg

SEQ ID NO: 30173 - DNA, 20 bp, Artificial Sequence
  Description of Artificial Sequence: Synthetic oligonucleotide
  Target: SCN9A; (-) strand; PAM type: NRG; PAM sequence: AAG
aacaaatagctcaattttta

SEQ ID NO: 30174 - DNA, 20 bp, Artificial Sequence
  Description of Artificial Sequence: Synthetic oligonucleotide
  Target: SCN9A; (-) strand; PAM type: NRG; PAM sequence: TAG
aagcaatacatgctaacaaa

SEQ ID NO: 30175 - DNA, 20 bp, Artificial Sequence
  Description of Artificial Sequence: Synthetic oligonucleotide
  Target: SCN9A; (-) strand; PAM type: NRG; PAM sequence: AAG
tacagtattttgaaagctct

SEQ ID NO: 30176 - DNA, 20 bp, Artificial Sequence
  Description of Artificial Sequence: Synthetic oligonucleotide
  Target: SCN9A; (-) strand; PAM type: NRG; PAM sequence: AAG
tatgaaatacagtattttga

SEQ ID NO: 30177 - DNA, 20 bp, Artificial Sequence
  Description of Artificial Sequence: Synthetic oligonucleotide
  Target: SCN9A; (-) strand; PAM type: NRG; PAM sequence: CAG
aaaatgaaaaatatgaaata

SEQ ID NO: 30178 - DNA, 20 bp, Artificial Sequence
  Description of Artificial Sequence: Synthetic oligonucleotide
  Target: SCN9A; (-) strand; PAM type: NRG; PAM sequence: AAG
acagttattgttactggtga

SEQ ID NO: 30179 - DNA, 20 bp, Artificial Sequence
  Description of Artificial Sequence: Synthetic oligonucleotide
  Target: SCN9A; (-) strand; PAM type: NRG; PAM sequence: TGG
ttaaccacagttattgttac

SEQ ID NO: 30180 - DNA, 20 bp, Artificial Sequence
  Description of Artificial Sequence: Synthetic oligonucleotide
  Target: SCN9A; (-) strand; PAM type: NRG; PAM sequence: CAG
actttaaaataacttaacca

SEQ ID NO: 30181 - DNA, 20 bp, Artificial Sequence
  Description of Artificial Sequence: Synthetic oligonucleotide
  Target: SCN9A; (-) strand; PAM type: NRG; PAM sequence: AAG
cagtgtaatggaagggaaag

SEQ ID NO: 30182 - DNA, 20 bp, Artificial Sequence
  Description of Artificial Sequence: Synthetic oligonucleotide
  Target: SCN9A; (-) strand; PAM type: NRG; PAM sequence: AAG
atgcagtgtaatggaaggga

SEQ ID NO: 30183 - DNA, 20 bp, Artificial Sequence
  Description of Artificial Sequence: Synthetic oligonucleotide
  Target: SCN9A; (-) strand; PAM type: NRG; PAM sequence: GGG
taaaatgcagtgtaatggaa

SEQ ID NO: 30184 - DNA, 20 bp, Artificial Sequence
  Description of Artificial Sequence: Synthetic oligonucleotide
  Target: SCN9A; (-) strand; PAM type: NRG; PAM sequence: AGG
ttaaaatgcagtgtaatgga

SEQ ID NO: 30185 - DNA, 20 bp, Artificial Sequence
  Description of Artificial Sequence: Synthetic oligonucleotide
  Target: SCN9A; (-) strand; PAM type: NRG; PAM sequence: AAG
cttaaaatgcagtgtaatgg

SEQ ID NO: 30186 - DNA, 20 bp, Artificial Sequence
  Description of Artificial Sequence: Synthetic oligonucleotide
  Target: SCN9A; (-) strand; PAM type: NRG; PAM sequence: TGG
tttcttaaaatgcagtgtaa

SEQ ID NO: 30187 - DNA, 20 bp, Artificial Sequence
  Description of Artificial Sequence: Synthetic oligonucleotide
  Target: SCN9A; (-) strand; PAM type: NRG; PAM sequence: CAG
tatttggctttcttaaaatg

SEQ ID NO: 30188 - DNA, 20 bp, Artificial Sequence
  Description of Artificial Sequence: Synthetic oligonucleotide
  Target: SCN9A; (-) strand; PAM type: NRG; PAM sequence: TGG
agagatagctagtttctatt

SEQ ID NO: 30189 - DNA, 20 bp, Artificial Sequence
  Description of Artificial Sequence: Synthetic oligonucleotide
  Target: SCN9A; (-) strand; PAM type: NRG; PAM sequence: TAG
ataaaaatattagagatagc

SEQ ID NO: 30190 - DNA, 20 bp, Artificial Sequence
  Description of Artificial Sequence: Synthetic oligonucleotide
  Target: SCN9A; (-) strand; PAM type: NRG; PAM sequence: TAG
tatgataaaaatattagaga

SEQ ID NO: 30191 - DNA, 20 bp, Artificial Sequence
  Description of Artificial Sequence: Synthetic oligonucleotide
  Target: SCN9A; (-) strand; PAM type: NRG; PAM sequence: GAG
gttttatgataaaaatatta

SEQ ID NO: 30192 - DNA, 20 bp, Artificial Sequence
  Description of Artificial Sequence: Synthetic oligonucleotide
  Target: SCN9A; (-) strand; PAM type: NRG; PAM sequence: TAG
aggttttatgataaaaatat

SEQ ID NO: 30193 - DNA, 20 bp, Artificial Sequence
  Description of Artificial Sequence: Synthetic oligonucleotide
  Target: SCN9A; (-) strand; PAM type: NRG; PAM sequence: AGG
agcaagtattaaaattctca

SEQ ID NO: 30194 - DNA, 20 bp, Artificial Sequence
  Description of Artificial Sequence: Synthetic oligonucleotide
  Target: SCN9A; (-) strand; PAM type: NRG; PAM sequence: AAG
cagcaagtattaaaattctc

SEQ ID NO: 30195 - DNA, 20 bp, Artificial Sequence
  Description of Artificial Sequence: Synthetic oligonucleotide
  Target: SCN9A; (-) strand; PAM type: NRG; PAM sequence: AAG
taaccataacaattgccagc

SEQ ID NO: 30196 - DNA, 20 bp, Artificial Sequence
  Description of Artificial Sequence: Synthetic oligonucleotide
  Target: SCN9A; (-) strand; PAM type: NRG; PAM sequence: CAG
ctgctaaccataacaattgc

SEQ ID NO: 30197 - DNA, 20 bp, Artificial Sequence
  Description of Artificial Sequence: Synthetic oligonucleotide
  Target: SCN9A; (-) strand; PAM type: NRG; PAM sequence: TGG
ttttgaaataactcatattt

SEQ ID NO: 30198 - DNA, 20 bp, Artificial Sequence
  Description of Artificial Sequence: Synthetic oligonucleotide
  Target: SCN9A; (-) strand; PAM type: NRG; PAM sequence: AGG
ctctgacgttccttcaactt

SEQ ID NO: 30199 - DNA, 20 bp, Artificial Sequence
  Description of Artificial Sequence: Synthetic oligonucleotide
  Target: SCN9A; (-) strand; PAM type: NRG; PAM sequence: TAG
actctgacgttccttcaact

SEQ ID NO: 30200 - DNA, 20 bp, Artificial Sequence
  Description of Artificial Sequence: Synthetic oligonucleotide
  Target: SCN9A; (-) strand; PAM type: NRG; PAM sequence: AGG
aattgaactcagtgattgga

SEQ ID NO: 30201 - DNA, 20 bp, Artificial Sequence
  Description of Artificial Sequence: Synthetic oligonucleotide
  Target: SCN9A; (-) strand; PAM type: NRG; PAM sequence: AAG
aaattgaactcagtgattgg

SEQ ID NO: 30202 - DNA, 20 bp, Artificial Sequence
  Description of Artificial Sequence: Synthetic oligonucleotide
  Target: SCN9A; (-) strand; PAM type: NRG; PAM sequence: TGG
aagaaattgaactcagtgat

SEQ ID NO: 30203 - DNA, 20 bp, Artificial Sequence
  Description of Artificial Sequence: Synthetic oligonucleotide
  Target: SCN9A; (-) strand; PAM type: NRG; PAM sequence: CAG
taaaataaagaaattgaact

SEQ ID NO: 30204 - DNA, 20 bp, Artificial Sequence
  Description of Artificial Sequence: Synthetic oligonucleotide
  Target: SCN9A; (-) strand; PAM type: NRG; PAM sequence: AAG
ttagtattataactaaaata

SEQ ID NO: 30205 - DNA, 20 bp, Artificial Sequence
  Description of Artificial Sequence: Synthetic oligonucleotide
  Target: SCN9A; (-) strand; PAM type: NRG; PAM sequence: TAG
tcccttttaaaagctaatat

SEQ ID NO: 30206 - DNA, 20 bp, Artificial Sequence
  Description of Artificial Sequence: Synthetic oligonucleotide
  Target: SCN9A; (-) strand; PAM type: NRG; PAM sequence: AAG
ttaatttaagtcccttttaa

SEQ ID NO: 30207 - DNA, 20 bp, Artificial Sequence
  Description of Artificial Sequence: Synthetic oligonucleotide
  Target: SCN9A; (-) strand; PAM type: NRG; PAM sequence: AAG
gtgaggaatcctcttaattt

SEQ ID NO: 30208 - DNA, 20 bp, Artificial Sequence
  Description of Artificial Sequence: Synthetic oligonucleotide
  Target: SCN9A; (-) strand; PAM type: NRG; PAM sequence: AGG
attaccgtggttagtaagtg

SEQ ID NO: 30209 - DNA, 20 bp, Artificial Sequence
  Description of Artificial Sequence: Synthetic oligonucleotide
  Target: SCN9A; (-) strand; PAM type: NRG; PAM sequence: GAG
aattaccgtggttagtaagt

SEQ ID NO: 30210 - DNA, 20 bp, Artificial Sequence
  Description of Artificial Sequence: Synthetic oligonucleotide
  Target: SCN9A; (-) strand; PAM type: NRG; PAM sequence: AAG
tttaaattaccgtggttagt

SEQ ID NO: 30211 - DNA, 20 bp, Artificial Sequence
  Description of Artificial Sequence: Synthetic oligonucleotide
  Target: SCN9A; (-) strand; PAM type: NRG; PAM sequence: TAG
gttttttaaattaccgtggt

SEQ ID NO: 30212 - DNA, 20 bp, Artificial Sequence
  Description of Artificial Sequence: Synthetic oligonucleotide
  Target: SCN9A; (-) strand; PAM type: NRG; PAM sequence: TGG
tatcgttttttaaattaccg

SEQ ID NO: 30213 - DNA, 20 bp, Artificial Sequence
  Description of Artificial Sequence: Synthetic oligonucleotide
  Target: SCN9A; (-) strand; PAM type: NRG; PAM sequence: AAG
aatggctacaataacatttc

SEQ ID NO: 30214 - DNA, 20 bp, Artificial Sequence
  Description of Artificial Sequence: Synthetic oligonucleotide
  Target: SCN9A; (-) strand; PAM type: NRG; PAM sequence: TGG
ggaaaaggacacttatggaa

SEQ ID NO: 30215 - DNA, 20 bp, Artificial Sequence
  Description of Artificial Sequence: Synthetic oligonucleotide
  Target: SCN9A; (-) strand; PAM type: NRG; PAM sequence: TGG
gctatggaaaaggacactta

SEQ ID NO: 30216 - DNA, 20 bp, Artificial Sequence
  Description of Artificial Sequence: Synthetic oligonucleotide
  Target: SCN9A; (-) strand; PAM type: NRG; PAM sequence: AGG
gaatactaaagctatggaaa

SEQ ID NO: 30217 - DNA, 20 bp, Artificial Sequence
  Description of Artificial Sequence: Synthetic oligonucleotide
  Target: SCN9A; (-) strand; PAM type: NRG; PAM sequence: AAG
tgaatactaaagctatggaa

SEQ ID NO: 30218 - DNA, 20 bp, Artificial Sequence
  Description of Artificial Sequence: Synthetic oligonucleotide
  Target: SCN9A; (-) strand; PAM type: NRG; PAM sequence: TGG
ttaactgaatactaaagcta

SEQ ID NO: 30219 - DNA, 20 bp, Artificial Sequence
  Description of Artificial Sequence: Synthetic oligonucleotide
  Target: SCN9A; (-) strand; PAM type: NRG; PAM sequence: AAG
tatttcttaactgaatacta

SEQ ID NO: 30220 - DNA, 20 bp, Artificial Sequence
  Description of Artificial Sequence: Synthetic oligonucleotide
  Target: SCN9A; (-) strand; PAM type: NRG; PAM sequence: TGG
taatattttgttgttactgc

SEQ ID NO: 30221 - DNA, 20 bp, Artificial Sequence
  Description of Artificial Sequence: Synthetic oligonucleotide
  Target: SCN9A; (-) strand; PAM type: NRG; PAM sequence: AGG
gatttctaagccaatgcttt

SEQ ID NO: 30222 - DNA, 20 bp, Artificial Sequence
  Description of Artificial Sequence: Synthetic oligonucleotide
  Target: SCN9A; (-) strand; PAM type: NRG; PAM sequence: TAG
tgatttctaagccaatgctt

SEQ ID NO: 30223 - DNA, 20 bp, Artificial Sequence
  Description of Artificial Sequence: Synthetic oligonucleotide
  Target: SCN9A; (-) strand; PAM type: NRG; PAM sequence: AAG
actttgtctttctgatttct

SEQ ID NO: 30224 - DNA, 20 bp, Artificial Sequence
  Description of Artificial Sequence: Synthetic oligonucleotide
  Target: SCN9A; (-) strand; PAM type: NRG; PAM sequence: GGG
aaccggagaaaaataaggct

SEQ ID NO: 30225 - DNA, 20 bp, Artificial Sequence
  Description of Artificial Sequence: Synthetic oligonucleotide
  Target: SCN9A; (-) strand; PAM type: NRG; PAM sequence: TGG
caaccggagaaaaataaggc

SEQ ID NO: 30226 - DNA, 20 bp, Artificial Sequence
  Description of Artificial Sequence: Synthetic oligonucleotide
  Target: SCN9A; (-) strand; PAM type: NRG; PAM sequence: AGG
ctgccaaccggagaaaaata

SEQ ID NO: 30227 - DNA, 20 bp, Artificial Sequence
  Description of Artificial Sequence: Synthetic oligonucleotide
  Target: SCN9A; (-) strand; PAM type: NRG; PAM sequence: AAG
cctgccaaccggagaaaaat

SEQ ID NO: 30228 - DNA, 20 bp, Artificial Sequence
  Description of Artificial Sequence: Synthetic oligonucleotide
  Target: SCN9A; (-) strand; PAM type: NRG; PAM sequence: GAG
agtcatcttcctgccaaccg

SEQ ID NO: 30229 - DNA, 20 bp, Artificial Sequence
  Description of Artificial Sequence: Synthetic oligonucleotide
  Target: SCN9A; (-) strand; PAM type: NRG; PAM sequence: CGG
caagtcatcttcctgccaac

SEQ ID NO: 30230 - DNA, 20 bp, Artificial Sequence
  Description of Artificial Sequence: Synthetic oligonucleotide
  Target: SCN9A; (-) strand; PAM type: NRG; PAM sequence: AAG
cagtgtctttcagctaacac

SEQ ID NO: 30231 - DNA, 20 bp, Artificial Sequence
  Description of Artificial Sequence: Synthetic oligonucleotide
  Target: SCN9A; (-) strand; PAM type: NRG; PAM sequence: CAG
tttagaaagtcagtgtcttt

SEQ ID NO: 30232 - DNA, 20 bp, Artificial Sequence
  Description of Artificial Sequence: Synthetic oligonucleotide
  Target: SCN9A; (-) strand; PAM type: NRG; PAM sequence: CAG
ctatataaaatttagaaagt

SEQ ID NO: 30233 - DNA, 20 bp, Artificial Sequence
  Description of Artificial Sequence: Synthetic oligonucleotide
  Target: SCN9A; (-) strand; PAM type: NRG; PAM sequence: AAG
aaccctatataaaatttaga

SEQ ID NO: 30234 - DNA, 20 bp, Artificial Sequence
  Description of Artificial Sequence: Synthetic oligonucleotide
  Target: SCN9A; (-) strand; PAM type: NRG; PAM sequence: TAG
tgataaccctatataaaatt

SEQ ID NO: 30235 - DNA, 20 bp, Artificial Sequence
  Description of Artificial Sequence: Synthetic oligonucleotide
  Target: SCN9A; (-) strand; PAM type: NRG; PAM sequence: CAG
cggtgagaaatgcttattgc

SEQ ID NO: 30236 - DNA, 20 bp, Artificial Sequence
  Description of Artificial Sequence: Synthetic oligonucleotide
  Target: SCN9A; (-) strand; PAM type: NRG; PAM sequence: GAG
acttacctcctgaatacggt

SEQ ID NO: 30237 - DNA, 20 bp, Artificial Sequence
  Description of Artificial Sequence: Synthetic oligonucleotide
  Target: SCN9A; (-) strand; PAM type: NRG; PAM sequence: CGG
acagacttacctcctgaata

SEQ ID NO: 30238 - DNA, 20 bp, Artificial Sequence
  Description of Artificial Sequence: Synthetic oligonucleotide
  Target: SCN9A; (-) strand; PAM type: NRG; PAM sequence: CAG
caaataaaaagcctgactca

SEQ ID NO: 30239 - DNA, 20 bp, Artificial Sequence
  Description of Artificial Sequence: Synthetic oligonucleotide
  Target: SCN9A; (-) strand; PAM type: NRG; PAM sequence: AAG
cgctgccgcatacaaataaa

SEQ ID NO: 30240 - DNA, 20 bp, Artificial Sequence
  Description of Artificial Sequence: Synthetic oligonucleotide
  Target: SCN9A; (-) strand; PAM type: NRG; PAM sequence: GGG
actctgatttgttttcttga

SEQ ID NO: 30241 - DNA, 20 bp, Artificial Sequence
  Description of Artificial Sequence: Synthetic oligonucleotide
  Target: SCN9A; (-) strand; PAM type: NRG; PAM sequence: AGG
gactctgatttgttttcttg

SEQ ID NO: 30242 - DNA, 20 bp, Artificial Sequence
  Description of Artificial Sequence: Synthetic oligonucleotide
  Target: SCN9A; (-) strand; PAM type: NRG; PAM sequence: GAG
agactctgatttgttttctt

SEQ ID NO: 30243 - DNA, 20 bp, Artificial Sequence
  Description of Artificial Sequence: Synthetic oligonucleotide
  Target: SCN9A; (-) strand; PAM type: NRG; PAM sequence: TAG
aaaaggacacctgaaaacaa

SEQ ID NO: 30244 - DNA, 20 bp, Artificial Sequence
  Description of Artificial Sequence: Synthetic oligonucleotide
  Target: SCN9A; (-) strand; PAM type: NRG; PAM sequence: AGG
aaagggagcaggaaaataaa

SEQ ID NO: 30245 - DNA, 20 bp, Artificial Sequence
  Description of Artificial Sequence: Synthetic oligonucleotide
  Target: SCN9A; (-) strand; PAM type: NRG; PAM sequence: AAG
gaaagggagcaggaaaataa

SEQ ID NO: 30246 - DNA, 20 bp, Artificial Sequence
  Description of Artificial Sequence: Synthetic oligonucleotide
  Target: SCN9A; (-) strand; PAM type: NRG; PAM sequence: AGG
ctgatacagtgaaagggagc

SEQ ID NO: 30247 - DNA, 20 bp, Artificial Sequence
  Description of Artificial Sequence: Synthetic oligonucleotide
  Target: SCN9A; (-) strand; PAM type: NRG; PAM sequence: CAG
actgatacagtgaaagggag

SEQ ID NO: 30248 - DNA, 20 bp, Artificial Sequence
  Description of Artificial Sequence: Synthetic oligonucleotide
  Target: SCN9A; (-) strand; PAM type: NRG; PAM sequence: GAG
agaactgatacagtgaaagg

SEQ ID NO: 30249 - DNA, 20 bp, Artificial Sequence
  Description of Artificial Sequence: Synthetic oligonucleotide
  Target: SCN9A; (-) strand; PAM type: NRG; PAM sequence: GGG
atagaactgatacagtgaaa

SEQ ID NO: 30250 - DNA, 20 bp, Artificial Sequence
  Description of Artificial Sequence: Synthetic oligonucleotide
  Target: SCN9A; (-) strand; PAM type: NRG; PAM sequence: AGG
gatagaactgatacagtgaa

SEQ ID NO: 30251 - DNA, 20 bp, Artificial Sequence
  Description of Artificial Sequence: Synthetic oligonucleotide
  Target: SCN9A; (-) strand; PAM type: NRG; PAM sequence: AAG
agatagaactgatacagtga

SEQ ID NO: 30252 - DNA, 20 bp, Artificial Sequence
  Description of Artificial Sequence: Synthetic oligonucleotide
  Target: SCN9A; (-) strand; PAM type: NRG; PAM sequence: CAG
gtatttagatagaactgata

SEQ ID NO: 30253 - DNA, 20 bp, Artificial Sequence
  Description of Artificial Sequence: Synthetic oligonucleotide
  Target: SCN9A; (-) strand; PAM type: NRG; PAM sequence: TAG
tacattaaattgtatttaga

SEQ ID NO: 30254 - DNA, 20 bp, Artificial Sequence
  Description of Artificial Sequence: Synthetic oligonucleotide
  Target: SCN9A; (-) strand; PAM type: NRG; PAM sequence: TAG
attttacattaaattgtatt

SEQ ID NO: 30255 - DNA, 20 bp, Artificial Sequence
  Description of Artificial Sequence: Synthetic oligonucleotide
  Target: SCN9A; (-) strand; PAM type: NRG; PAM sequence: AAG
taaaataattttccatgtaa

SEQ ID NO: 30256 - DNA, 20 bp, Artificial Sequence
  Description of Artificial Sequence: Synthetic oligonucleotide
  Target: SCN9A; (-) strand; PAM type: NRG; PAM sequence: AGG
aaggattgtacttgaggact

SEQ ID NO: 30257 - DNA, 20 bp, Artificial Sequence
  Description of Artificial Sequence: Synthetic oligonucleotide
  Target: SCN9A; (-) strand; PAM type: NRG; PAM sequence: TAG
aaaggattgtacttgaggac

SEQ ID NO: 30258 - DNA, 20 bp, Artificial Sequence
  Description of Artificial Sequence: Synthetic oligonucleotide
  Target: SCN9A; (-) strand; PAM type: NRG; PAM sequence: AGG
gacaaaaaggattgtacttg

SEQ ID NO: 30259 - DNA, 20 bp, Artificial Sequence
  Description of Artificial Sequence: Synthetic oligonucleotide
  Target: SCN9A; (-) strand; PAM type: NRG; PAM sequence: GAG
agacaaaaaggattgtactt

SEQ ID NO: 30260 - DNA, 20 bp, Artificial Sequence
  Description of Artificial Sequence: Synthetic oligonucleotide
  Target: SCN9A; (-) strand; PAM type: NRG; PAM sequence: AGG
tactgagatttaagacaaaa

SEQ ID NO: 30261 - DNA, 20 bp, Artificial Sequence
  Description of Artificial Sequence: Synthetic oligonucleotide
  Target: SCN9A; (-) strand; PAM type: NRG; PAM sequence: AAG
ctactgagatttaagacaaa

SEQ ID NO: 30262 - DNA, 20 bp, Artificial Sequence
  Description of Artificial Sequence: Synthetic oligonucleotide
  Target: SCN9A; (-) strand; PAM type: NRG; PAM sequence: AAG
aatacagtctactgagattt

SEQ ID NO: 30263 - DNA, 20 bp, Artificial Sequence
  Description of Artificial Sequence: Synthetic oligonucleotide
  Target: SCN9A; (-) strand; PAM type: NRG; PAM sequence: GAG
ttttaaaaatacagtctact

SEQ ID NO: 30264 - DNA, 20 bp, Artificial Sequence
  Description of Artificial Sequence: Synthetic oligonucleotide
  Target: SCN9A; (-) strand; PAM type: NRG; PAM sequence: CAG
tgaataattttttaaaaata

SEQ ID NO: 30265 - DNA, 20 bp, Artificial Sequence
  Description of Artificial Sequence: Synthetic oligonucleotide
  Target: SCN9A; (-) strand; PAM type: NRG; PAM sequence: TGG
caatacaattgcagaaagaa

SEQ ID NO: 30266 - DNA, 20 bp, Artificial Sequence
  Description of Artificial Sequence: Synthetic oligonucleotide
  Target: SCN9A; (-) strand; PAM type: NRG; PAM sequence: AAG
catgtcaatacaattgcaga

SEQ ID NO: 30267 - DNA, 20 bp, Artificial Sequence
  Description of Artificial Sequence: Synthetic oligonucleotide
  Target: SCN9A; (-) strand; PAM type: NRG; PAM sequence: CAG
aaaccatgtcaatacaattg

SEQ ID NO: 30268 - DNA, 20 bp, Artificial Sequence
  Description of Artificial Sequence: Synthetic oligonucleotide
  Target: SCN9A; (-) strand; PAM type: NRG; PAM sequence: GAG
gagatttgggcggggacaca

SEQ ID NO: 30269 - DNA, 20 bp, Artificial Sequence
  Description of Artificial Sequence: Synthetic oligonucleotide
  Target: SCN9A; (-) strand; PAM type: NRG; PAM sequence: CAG
atgagatttgggcggggaca

SEQ ID NO: 30270 - DNA, 20 bp, Artificial Sequence
  Description of Artificial Sequence: Synthetic oligonucleotide
  Target: SCN9A; (-) strand; PAM type: NRG; PAM sequence: GGG
ttcaaaatgagatttgggcg

SEQ ID NO: 30271 - DNA, 20 bp, Artificial Sequence
  Description of Artificial Sequence: Synthetic oligonucleotide
  Target: SCN9A; (-) strand; PAM type: NRG; PAM sequence: GGG
attcaaaatgagatttgggc

SEQ ID NO: 30272 - DNA, 20 bp, Artificial Sequence
  Description of Artificial Sequence: Synthetic oligonucleotide
  Target: SCN9A; (-) strand; PAM type: NRG; PAM sequence: CGG
aattcaaaatgagatttggg

SEQ ID NO: 30273 - DNA, 20 bp, Artificial Sequence
  Description of Artificial Sequence: Synthetic oligonucleotide
  Target: SCN9A; (-) strand; PAM type: NRG; PAM sequence: GGG
tacaattcaaaatgagattt

SEQ ID NO: 30274 - DNA, 20 bp, Artificial Sequence
  Description of Artificial Sequence: Synthetic oligonucleotide
  Target: SCN9A; (-) strand; PAM type: NRG; PAM sequence: TGG
ttacaattcaaaatgagatt

SEQ ID NO: 30275 - DNA, 20 bp, Artificial Sequence
  Description of Artificial Sequence: Synthetic oligonucleotide
  Target: SCN9A; (-) strand; PAM type: NRG; PAM sequence: GAG
tggggattacaattcaaaat

SEQ ID NO: 30276 - DNA, 20 bp, Artificial Sequence
  Description of Artificial Sequence: Synthetic oligonucleotide
  Target: SCN9A; (-) strand; PAM type: NRG; PAM sequence: GGG
ggtccctcccctgagacgtg

SEQ ID NO: 30277 - DNA, 20 bp, Artificial Sequence
  Description of Artificial Sequence: Synthetic oligonucleotide
  Target: SCN9A; (-) strand; PAM type: NRG; PAM sequence: GGG
aggtccctcccctgagacgt

SEQ ID NO: 30278 - DNA, 20 bp, Artificial Sequence
  Description of Artificial Sequence: Synthetic oligonucleotide
  Target: SCN9A; (-) strand; PAM type: NRG; PAM sequence: TGG
caggtccctcccctgagacg

SEQ ID NO: 30279 - DNA, 20 bp, Artificial Sequence
  Description of Artificial Sequence: Synthetic oligonucleotide
  Target: SCN9A; (-) strand; PAM type: NRG; PAM sequence: GAG
taccaccaggtccctcccct

SEQ ID NO: 30280 - DNA, 20 bp, Artificial Sequence
  Description of Artificial Sequence: Synthetic oligonucleotide
  Target: SCN9A; (-) strand; PAM type: NRG; PAM sequence: AGG
tgatccaatcacttaccacc

SEQ ID NO: 30281 - DNA, 20 bp, Artificial Sequence
  Description of Artificial Sequence: Synthetic oligonucleotide
  Target: SCN9A; (-) strand; PAM type: NRG; PAM sequence: CAG
atgatccaatcacttaccac

SEQ ID NO: 30282 - DNA, 20 bp, Artificial Sequence
  Description of Artificial Sequence: Synthetic oligonucleotide
  Target: SCN9A; (-) strand; PAM type: NRG; PAM sequence: GGG
ctatcatgagaacagcactg

SEQ ID NO: 30283 - DNA, 20 bp, Artificial Sequence
  Description of Artificial Sequence: Synthetic oligonucleotide
  Target: SCN9A; (-) strand; PAM type: NRG; PAM sequence: GGG
actatcatgagaacagcact

SEQ ID NO: 30284 - DNA, 20 bp, Artificial Sequence
  Description of Artificial Sequence: Synthetic oligonucleotide
  Target: SCN9A; (-) strand; PAM type: NRG; PAM sequence: TGG
cactatcatgagaacagcac

SEQ ID NO: 30285 - DNA, 20 bp, Artificial Sequence
  Description of Artificial Sequence: Synthetic oligonucleotide
  Target: SCN9A; (-) strand; PAM type: NRG; PAM sequence: CAG
ctcactcactatcatgagaa

SEQ ID NO: 30286 - DNA, 20 bp, Artificial Sequence
  Description of Artificial Sequence: Synthetic oligonucleotide
  Target: SCN9A; (-) strand; PAM type: NRG; PAM sequence: GAG
actcactcactcactatcat

SEQ ID NO: 30287 - DNA, 20 bp, Artificial Sequence
  Description of Artificial Sequence: Synthetic oligonucleotide
  Target: SCN9A; (-) strand; PAM type: NRG; PAM sequence: GAG
ttaaacccatcagatctcat

SEQ ID NO: 30288 - DNA, 20 bp, Artificial Sequence
  Description of Artificial Sequence: Synthetic oligonucleotide
  Target: SCN9A; (-) strand; PAM type: NRG; PAM sequence: CAG
tgccgcacttttaaacccat

SEQ ID NO: 30289 - DNA, 20 bp, Artificial Sequence
  Description of Artificial Sequence: Synthetic oligonucleotide
  Target: SCN9A; (-) strand; PAM type: NRG; PAM sequence: GGG
caggagagggagaaagagga

SEQ ID NO: 30290 - DNA, 20 bp, Artificial Sequence
  Description of Artificial Sequence: Synthetic oligonucleotide
  Target: SCN9A; (-) strand; PAM type: NRG; PAM sequence: AGG
gcaggagagggagaaagagg

SEQ ID NO: 30291 - DNA, 20 bp, Artificial Sequence
  Description of Artificial Sequence: Synthetic oligonucleotide
  Target: SCN9A; (-) strand; PAM type: NRG; PAM sequence: GAG
tgcaggagagggagaaagag

SEQ ID NO: 30292 - DNA, 20 bp, Artificial Sequence
  Description of Artificial Sequence: Synthetic oligonucleotide
  Target: SCN9A; (-) strand; PAM type: NRG; PAM sequence: AGG
ggtgcaggagagggagaaag

SEQ ID NO: 30293 - DNA, 20 bp, Artificial Sequence
  Description of Artificial Sequence: Synthetic oligonucleotide
  Target: SCN9A; (-) strand; PAM type: NRG; PAM sequence: GAG
tggtgcaggagagggagaaa

SEQ ID NO: 30294 - DNA, 20 bp, Artificial Sequence
  Description of Artificial Sequence: Synthetic oligonucleotide
  Target: SCN9A; (-) strand; PAM type: NRG; PAM sequence: AAG
catggtgcaggagagggaga

SEQ ID NO: 30295 - DNA, 20 bp, Artificial Sequence
  Description of Artificial Sequence: Synthetic oligonucleotide
  Target: SCN9A; (-) strand; PAM type: NRG; PAM sequence: GAG
ttaacatggtgcaggagagg

SEQ ID NO: 30296 - DNA, 20 bp, Artificial Sequence
  Description of Artificial Sequence: Synthetic oligonucleotide
  Target: SCN9A; (-) strand; PAM type: NRG; PAM sequence: GGG
tcttaacatggtgcaggaga

SEQ ID NO: 30297 - DNA, 20 bp, Artificial Sequence
  Description of Artificial Sequence: Synthetic oligonucleotide
  Target: SCN9A; (-) strand; PAM type: NRG; PAM sequence: AGG
atcttaacatggtgcaggag

SEQ ID NO: 30298 - DNA, 20 bp, Artificial Sequence
  Description of Artificial Sequence: Synthetic oligonucleotide
  Target: SCN9A; (-) strand; PAM type: NRG; PAM sequence: GAG
catcttaacatggtgcagga

SEQ ID NO: 30299 - DNA, 20 bp, Artificial Sequence
  Description of Artificial Sequence: Synthetic oligonucleotide
  Target: SCN9A; (-) strand; PAM type: NRG; PAM sequence: GAG
cacatcttaacatggtgcag

SEQ ID NO: 30300 - DNA, 20 bp, Artificial Sequence
  Description of Artificial Sequence: Synthetic oligonucleotide
  Target: SCN9A; (-) strand; PAM type: NRG; PAM sequence: AGG
ggcacatcttaacatggtgc

SEQ ID NO: 30301 - DNA, 20 bp, Artificial Sequence
  Description of Artificial Sequence: Synthetic oligonucleotide
  Target: SCN9A; (-) strand; PAM type: NRG; PAM sequence: CAG
aggcacatcttaacatggtg

SEQ ID NO: 30302 - DNA, 20 bp, Artificial Sequence
  Description of Artificial Sequence: Synthetic oligonucleotide
  Target: SCN9A; (-) strand; PAM type: NRG; PAM sequence: TGG
aagcaaggcacatcttaaca

SEQ ID NO: 30303 - DNA, 20 bp, Artificial Sequence
  Description of Artificial Sequence: Synthetic oligonucleotide
  Target: SCN9A; (-) strand; PAM type: NRG; PAM sequence: AGG
tcgaaggcaaaggggaagca

SEQ ID NO: 30304 - DNA, 20 bp, Artificial Sequence
  Description of Artificial Sequence: Synthetic oligonucleotide
  Target: SCN9A; (-) strand; PAM type: NRG; PAM sequence: AAG
gtcgaaggcaaaggggaagc

SEQ ID NO: 30305 - DNA, 20 bp, Artificial Sequence
  Description of Artificial Sequence: Synthetic oligonucleotide
  Target: SCN9A; (-) strand; PAM type: NRG; PAM sequence: AAG
catggtcgaaggcaaagggg

SEQ ID NO: 30306 - DNA, 20 bp, Artificial Sequence
  Description of Artificial Sequence: Synthetic oligonucleotide
  Target: SCN9A; (-) strand; PAM type: NRG; PAM sequence: GGG
aatcatggtcgaaggcaaag

SEQ ID NO: 30307 - DNA, 20 bp, Artificial Sequence
  Description of Artificial Sequence: Synthetic oligonucleotide
  Target: SCN9A; (-) strand; PAM type: NRG; PAM sequence: GGG
caatcatggtcgaaggcaaa

SEQ ID NO: 30308 - DNA, 20 bp, Artificial Sequence
  Description of Artificial Sequence: Synthetic oligonucleotide
  Target: SCN9A; (-) strand; PAM type: NRG; PAM sequence: AGG
acaatcatggtcgaaggcaa

SEQ ID NO: 30309 - DNA, 20 bp, Artificial Sequence
  Description of Artificial Sequence: Synthetic oligonucleotide
  Target: SCN9A; (-) strand; PAM type: NRG; PAM sequence: AAG
tacaatcatggtcgaaggca

SEQ ID NO: 30310 - DNA, 20 bp, Artificial Sequence
  Description of Artificial Sequence: Synthetic oligonucleotide
  Target: SCN9A; (-) strand; PAM type: NRG; PAM sequence: AGG
aaacttacaatcatggtcga

SEQ ID NO: 30311 - DNA, 20 bp, Artificial Sequence
  Description of Artificial Sequence: Synthetic oligonucleotide
  Target: SCN9A; (-) strand; PAM type: NRG; PAM sequence: AAG
aaaacttacaatcatggtcg

SEQ ID NO: 30312 - DNA, 20 bp, Artificial Sequence
  Description of Artificial Sequence: Synthetic oligonucleotide
  Target: SCN9A; (-) strand; PAM type: NRG; PAM sequence: TGG
cctcagaaaacttacaatca

SEQ ID NO: 30313 - DNA, 20 bp, Artificial Sequence
  Description of Artificial Sequence: Synthetic oligonucleotide
  Target: SCN9A; (-) strand; PAM type: NRG; PAM sequence: CAG
ctgaatggcaggggaggcct

SEQ ID NO: 30314 - DNA, 20 bp, Artificial Sequence
  Description of Artificial Sequence: Synthetic oligonucleotide
  Target: SCN9A; (-) strand; PAM type: NRG; PAM sequence: AGG
actgttctgaatggcagggg

SEQ ID NO: 30315 - DNA, 20 bp, Artificial Sequence
  Description of Artificial Sequence: Synthetic oligonucleotide
  Target: SCN9A; (-) strand; PAM type: NRG; PAM sequence: GAG
cactgttctgaatggcaggg

SEQ ID NO: 30316 - DNA, 20 bp, Artificial Sequence
  Description of Artificial Sequence: Synthetic oligonucleotide
  Target: SCN9A; (-) strand; PAM type: NRG; PAM sequence: GGG
ctcactgttctgaatggcag

SEQ ID NO: 30317 - DNA, 20 bp, Artificial Sequence
  Description of Artificial Sequence: Synthetic oligonucleotide
  Target: SCN9A; (-) strand; PAM type: NRG; PAM sequence: GGG
actcactgttctgaatggca

SEQ ID NO: 30318 - DNA, 20 bp, Artificial Sequence
  Description of Artificial Sequence: Synthetic oligonucleotide
  Target: SCN9A; (-) strand; PAM type: NRG; PAM sequence: AGG
tactcactgttctgaatggc

SEQ ID NO: 30319 - DNA, 20 bp, Artificial Sequence
  Description of Artificial Sequence: Synthetic oligonucleotide
  Target: SCN9A; (-) strand; PAM type: NRG; PAM sequence: CAG
ttactcactgttctgaatgg

SEQ ID NO: 30320 - DNA, 20 bp, Artificial Sequence
  Description of Artificial Sequence: Synthetic oligonucleotide
  Target: SCN9A; (-) strand; PAM type: NRG; PAM sequence: TGG
aatttactcactgttctgaa

SEQ ID NO: 30321 - DNA, 20 bp, Artificial Sequence
  Description of Artificial Sequence: Synthetic oligonucleotide
  Target: SCN9A; (-) strand; PAM type: NRG; PAM sequence: GAG
tgggtaatttataaagaaaa

SEQ ID NO: 30322 - DNA, 20 bp, Artificial Sequence
  Description of Artificial Sequence: Synthetic oligonucleotide
  Target: SCN9A; (-) strand; PAM type: NRG; PAM sequence: AAG
actgggtaatttataaagaa

SEQ ID NO: 30323 - DNA, 20 bp, Artificial Sequence
  Description of Artificial Sequence: Synthetic oligonucleotide
  Target: SCN9A; (-) strand; PAM type: NRG; PAM sequence: AAG
ctgagactgggtaatttata

SEQ ID NO: 30324 - DNA, 20 bp, Artificial Sequence
  Description of Artificial Sequence: Synthetic oligonucleotide
  Target: SCN9A; (-) strand; PAM type: NRG; PAM sequence: GGG
ataaagaactacctgagact

SEQ ID NO: 30325 - DNA, 20 bp, Artificial Sequence
  Description of Artificial Sequence: Synthetic oligonucleotide
  Target: SCN9A; (-) strand; PAM type: NRG; PAM sequence: TGG
tataaagaactacctgagac

SEQ ID NO: 30326 - DNA, 20 bp, Artificial Sequence
  Description of Artificial Sequence: Synthetic oligonucleotide
  Target: SCN9A; (-) strand; PAM type: NRG; PAM sequence: GAG
actgctataaagaactacct

SEQ ID NO: 30327 - DNA, 20 bp, Artificial Sequence
  Description of Artificial Sequence: Synthetic oligonucleotide
  Target: SCN9A; (-) strand; PAM type: NRG; PAM sequence: AAG
tccatttttacactgctata

SEQ ID NO: 30328 - DNA, 20 bp, Artificial Sequence
  Description of Artificial Sequence: Synthetic oligonucleotide
  Target: SCN9A; (-) strand; PAM type: NRG; PAM sequence: TAG
gccaccacgcccggccgtat

SEQ ID NO: 30329 - DNA, 20 bp, Artificial Sequence
  Description of Artificial Sequence: Synthetic oligonucleotide
  Target: SCN9A; (-) strand; PAM type: NRG; PAM sequence: CGG
caggcgtgagccaccacgcc

SEQ ID NO: 30330 - DNA, 20 bp, Artificial Sequence
  Description of Artificial Sequence: Synthetic oligonucleotide
  Target: SCN9A; (-) strand; PAM type: NRG; PAM sequence: GAG
agtgctgggaacacaggcgt

SEQ ID NO: 30331 - DNA, 20 bp, Artificial Sequence
  Description of Artificial Sequence: Synthetic oligonucleotide
  Target: SCN9A; (-) strand; PAM type: NRG; PAM sequence: AGG
tcccaaagtgctgggaacac

SEQ ID NO: 30332 - DNA, 20 bp, Artificial Sequence
  Description of Artificial Sequence: Synthetic oligonucleotide
  Target: SCN9A; (-) strand; PAM type: NRG; PAM sequence: CAG
ctcccaaagtgctgggaaca

SEQ ID NO: 30333 - DNA, 20 bp, Artificial Sequence
  Description of Artificial Sequence: Synthetic oligonucleotide
  Target: SCN9A; (-) strand; PAM type: NRG; PAM sequence: GGG
ccttggcctcccaaagtgct

SEQ ID NO: 30334 - DNA, 20 bp, Artificial Sequence
  Description of Artificial Sequence: Synthetic oligonucleotide
  Target: SCN9A; (-) strand; PAM type: NRG; PAM sequence: TGG
accttggcctcccaaagtgc

SEQ ID NO: 30335 - DNA, 20 bp, Artificial Sequence
  Description of Artificial Sequence: Synthetic oligonucleotide
  Target: SCN9A; (-) strand; PAM type: NRG; PAM sequence: AAG
ctgcccaccttggcctccca

SEQ ID NO: 30336 - DNA, 20 bp, Artificial Sequence
  Description of Artificial Sequence: Synthetic oligonucleotide
  Target: SCN9A; (-) strand; PAM type: NRG; PAM sequence: TGG
acgttgtgttctgcccacct

SEQ ID NO: 30337 - DNA, 20 bp, Artificial Sequence
  Description of Artificial Sequence: Synthetic oligonucleotide
  Target: SCN9A; (-) strand; PAM type: NRG; PAM sequence: TGG
attcaccgtgttagccagga

SEQ ID NO: 30338 - DNA, 20 bp, Artificial Sequence
  Description of Artificial Sequence: Synthetic oligonucleotide
  Target: SCN9A; (-) strand; PAM type: NRG; PAM sequence: AGG
ggggattcaccgtgttagcc

SEQ ID NO: 30339 - DNA, 20 bp, Artificial Sequence
  Description of Artificial Sequence: Synthetic oligonucleotide
  Target: SCN9A; (-) strand; PAM type: NRG; PAM sequence: CAG
cggggattcaccgtgttagc

SEQ ID NO: 30340 - DNA, 20 bp, Artificial Sequence
  Description of Artificial Sequence: Synthetic oligonucleotide
  Target: SCN9A; (-) strand; PAM type: NRG; PAM sequence: TAG
gagacggggattcaccgtgt

SEQ ID NO: 30341 - DNA, 20 bp, Artificial Sequence
  Description of Artificial Sequence: Synthetic oligonucleotide
  Target: SCN9A; (-) strand; PAM type: NRG; PAM sequence: GGG
ttgtatttttagtagagacg

SEQ ID NO: 30342 - DNA, 20 bp, Artificial Sequence
  Description of Artificial Sequence: Synthetic oligonucleotide
  Target: SCN9A; (-) strand; PAM type: NRG; PAM sequence: GGG
tttgtatttttagtagagac

SEQ ID NO: 30343 - DNA, 20 bp, Artificial Sequence
  Description of Artificial Sequence: Synthetic oligonucleotide
  Target: SCN9A; (-) strand; PAM type: NRG; PAM sequence: CGG
ttttgtatttttagtagaga

SEQ ID NO: 30344 - DNA, 20 bp, Artificial Sequence
  Description of Artificial Sequence: Synthetic oligonucleotide
  Target: SCN9A; (-) strand; PAM type: NRG; PAM sequence: GAG
ttgtttttgtatttttagta

SEQ ID NO: 30345 - DNA, 20 bp, Artificial Sequence
  Description of Artificial Sequence: Synthetic oligonucleotide
  Target: SCN9A; (-) strand; PAM type: NRG; PAM sequence: TAG
ttttgtttttgtatttttag

SEQ ID NO: 30346 - DNA, 20 bp, Artificial Sequence
  Description of Artificial Sequence: Synthetic oligonucleotide
  Target: SCN9A; (-) strand; PAM type: NRG; PAM sequence: TAG
taattttgtttttgtatttt

SEQ ID NO: 30347 - DNA, 20 bp, Artificial Sequence
  Description of Artificial Sequence: Synthetic oligonucleotide
  Target: SCN9A; (-) strand; PAM type: NRG; PAM sequence: TGG
caggtacccgccaccacacc

SEQ ID NO: 30348 - DNA, 20 bp, Artificial Sequence
  Description of Artificial Sequence: Synthetic oligonucleotide
  Target: SCN9A; (-) strand; PAM type: NRG; PAM sequence: AGG
tccagggtagctgggactac

SEQ ID NO: 30349 - DNA, 20 bp, Artificial Sequence
  Description of Artificial Sequence: Synthetic oligonucleotide
  Target: SCN9A; (-) strand; PAM type: NRG; PAM sequence: CAG
ctccagggtagctgggacta

SEQ ID NO: 30350 - DNA, 20 bp, Artificial Sequence
  Description of Artificial Sequence: Synthetic oligonucleotide
  Target: SCN9A; (-) strand; PAM type: NRG; PAM sequence: GGG
cctcagcctccagggtagct

SEQ ID NO: 30351 - DNA, 20 bp, Artificial Sequence
  Description of Artificial Sequence: Synthetic oligonucleotide
  Target: SCN9A; (-) strand; PAM type: NRG; PAM sequence: TGG
acctcagcctccagggtagc

SEQ ID NO: 30352 - DNA, 20 bp, Artificial Sequence
  Description of Artificial Sequence: Synthetic oligonucleotide
  Target: SCN9A; (-) strand; PAM type: NRG; PAM sequence: TAG
tcccacctcagcctccaggg

SEQ ID NO: 30353 - DNA, 20 bp, Artificial Sequence
  Description of Artificial Sequence: Synthetic oligonucleotide
  Target: SCN9A; (-) strand; PAM type: NRG; PAM sequence: GGG
ttctcccacctcagcctcca

SEQ ID NO: 30354 - DNA, 20 bp, Artificial Sequence
  Description of Artificial Sequence: Synthetic oligonucleotide
  Target: SCN9A; (-) strand; PAM type: NRG; PAM sequence: AGG
attctcccacctcagcctcc

SEQ ID NO: 30355 - DNA, 20 bp, Artificial Sequence
  Description of Artificial Sequence: Synthetic oligonucleotide
  Target: SCN9A; (-) strand; PAM type: NRG; PAM sequence: CAG
cattctcccacctcagcctc

SEQ ID NO: 30356 - DNA, 20 bp, Artificial Sequence
  Description of Artificial Sequence: Synthetic oligonucleotide
  Target: SCN9A; (-) strand; PAM type: NRG; PAM sequence: CAG
ttcacgccattctcccacct

SEQ ID NO: 30357 - DNA, 20 bp, Artificial Sequence
  Description of Artificial Sequence: Synthetic oligonucleotide
  Target: SCN9A; (-) strand; PAM type: NRG; PAM sequence: GGG
cactgcaagctccgcctccc

SEQ ID NO: 30358 - DNA, 20 bp, Artificial Sequence
  Description of Artificial Sequence: Synthetic oligonucleotide
  Target: SCN9A; (-) strand; PAM type: NRG; PAM sequence: CGG
tcactgcaagctccgcctcc

SEQ ID NO: 30359 - DNA, 20 bp, Artificial Sequence
  Description of Artificial Sequence: Synthetic oligonucleotide
  Target: SCN9A; (-) strand; PAM type: NRG; PAM sequence: AAG
gcgcgattttggctcactgc

SEQ ID NO: 30360 - DNA, 20 bp, Artificial Sequence
  Description of Artificial Sequence: Synthetic oligonucleotide
  Target: SCN9A; (-) strand; PAM type: NRG; PAM sequence: TGG
ggagtgccgtggcgcgattt

SEQ ID NO: 30361 - DNA, 20 bp, Artificial Sequence
  Description of Artificial Sequence: Synthetic oligonucleotide
  Target: SCN9A; (-) strand; PAM type: NRG; PAM sequence: TGG
ttgcccaggctggagtgccg

SEQ ID NO: 30362 - DNA, 20 bp, Artificial Sequence
  Description of Artificial Sequence: Synthetic oligonucleotide
  Target: SCN9A; (-) strand; PAM type: NRG; PAM sequence: GAG
tccctctgttgcccaggctg

SEQ ID NO: 30363 - DNA, 20 bp, Artificial Sequence
  Description of Artificial Sequence: Synthetic oligonucleotide
  Target: SCN9A; (-) strand; PAM type: NRG; PAM sequence: TGG
tctccctctgttgcccaggc

SEQ ID NO: 30364 - DNA, 20 bp, Artificial Sequence
  Description of Artificial Sequence: Synthetic oligonucleotide
  Target: SCN9A; (-) strand; PAM type: NRG; PAM sequence: AGG
agagtctccctctgttgccc

SEQ ID NO: 30365 - DNA, 20 bp, Artificial Sequence
  Description of Artificial Sequence: Synthetic oligonucleotide
  Target: SCN9A; (-) strand; PAM type: NRG; PAM sequence: CAG
cagagtctccctctgttgcc

SEQ ID NO: 30366 - DNA, 20 bp, Artificial Sequence
  Description of Artificial Sequence: Synthetic oligonucleotide
  Target: SCN9A; (-) strand; PAM type: NRG; PAM sequence: GAG
ttttttttttttttgagaca

SEQ ID NO: 30367 - DNA, 20 bp, Artificial Sequence
  Description of Artificial Sequence: Synthetic oligonucleotide
  Target: SCN9A; (-) strand; PAM type: NRG; PAM sequence: CAG
ttttttttttttttttgaga

SEQ ID NO: 30368 - DNA, 20 bp, Artificial Sequence
  Description of Artificial Sequence: Synthetic oligonucleotide
  Target: SCN9A; (-) strand; PAM type: NRG; PAM sequence: GAG
tttttttttttttttttttt

SEQ ID NO: 30369 - DNA, 20 bp, Artificial Sequence
  Description of Artificial Sequence: Synthetic oligonucleotide
  Target: SCN9A; (-) strand; PAM type: NRG; PAM sequence: TAG
gtttctgactatacatgtat

SEQ ID NO: 30370 - DNA, 20 bp, Artificial Sequence
  Description of Artificial Sequence: Synthetic oligonucleotide
  Target: SCN9A; (-) strand; PAM type: NRG; PAM sequence: TAG
tttcattacctgttatgata

SEQ ID NO: 30371 - DNA, 20 bp, Artificial Sequence
  Description of Artificial Sequence: Synthetic oligonucleotide
  Target: SCN9A; (-) strand; PAM type: NRG; PAM sequence: AAG
cttcttttcatttttctagg

SEQ ID NO: 30372 - DNA, 20 bp, Artificial Sequence
  Description of Artificial Sequence: Synthetic oligonucleotide
  Target: SCN9A; (-) strand; PAM type: NRG; PAM sequence: AGG
tttcttcttttcatttttct

SEQ ID NO: 30373 - DNA, 20 bp, Artificial Sequence
  Description of Artificial Sequence: Synthetic oligonucleotide
  Target: SCN9A; (-) strand; PAM type: NRG; PAM sequence: TAG
ctttcttcttttcatttttc

SEQ ID NO: 30374 - DNA, 20 bp, Artificial Sequence
  Description of Artificial Sequence: Synthetic oligonucleotide
  Target: SCN9A; (-) strand; PAM type: NRG; PAM sequence: TAG
tgtcacatcttgccttatat

SEQ ID NO: 30375 - DNA, 20 bp, Artificial Sequence
  Description of Artificial Sequence: Synthetic oligonucleotide
  Target: SCN9A; (-) strand; PAM type: NRG; PAM sequence: CAG
agtctccctgataattttga

SEQ ID NO: 30376 - DNA, 20 bp, Artificial Sequence
  Description of Artificial Sequence: Synthetic oligonucleotide
  Target: SCN9A; (-) strand; PAM type: NRG; PAM sequence: AAG
cagatgacctccggtttata

SEQ ID NO: 30377 - DNA, 20 bp, Artificial Sequence
  Description of Artificial Sequence: Synthetic oligonucleotide
  Target: SCN9A; (-) strand; PAM type: NRG; PAM sequence: CGG
atgttagctcagatgacctc

SEQ ID NO: 30378 - DNA, 20 bp, Artificial Sequence
  Description of Artificial Sequence: Synthetic oligonucleotide
  Target: SCN9A; (-) strand; PAM type: NRG; PAM sequence: CAG
tgtgatttttcatgttagct

SEQ ID NO: 30379 - DNA, 20 bp, Artificial Sequence
  Description of Artificial Sequence: Synthetic oligonucleotide
  Target: SCN9A; (-) strand; PAM type: NRG; PAM sequence: TAG
tatgttgtgatttttcatgt

SEQ ID NO: 30380 - DNA, 20 bp, Artificial Sequence
  Description of Artificial Sequence: Synthetic oligonucleotide
  Target: SCN9A; (-) strand; PAM type: NRG; PAM sequence: TAG
ttgatcttgccaatactatg

SEQ ID NO: 30381 - DNA, 20 bp, Artificial Sequence
  Description of Artificial Sequence: Synthetic oligonucleotide
  Target: SCN9A; (-) strand; PAM type: NRG; PAM sequence: AGG
ttattaaaatttcaagtata

SEQ ID NO: 30382 - DNA, 20 bp, Artificial Sequence
  Description of Artificial Sequence: Synthetic oligonucleotide
  Target: SCN9A; (-) strand; PAM type: NRG; PAM sequence: AAG
tttattaaaatttcaagtat

SEQ ID NO: 30383 - DNA, 20 bp, Artificial Sequence
  Description of Artificial Sequence: Synthetic oligonucleotide
  Target: SCN9A; (-) strand; PAM type: NRG; PAM sequence: AAG
attctttttattaaaatttc

SEQ ID NO: 30384 - DNA, 20 bp, Artificial Sequence
  Description of Artificial Sequence: Synthetic oligonucleotide
  Target: SCN9A; (-) strand; PAM type: NRG; PAM sequence: GAG
atcacttaaaagtttttaat

SEQ ID NO: 30385 - DNA, 20 bp, Artificial Sequence
  Description of Artificial Sequence: Synthetic oligonucleotide
  Target: SCN9A; (-) strand; PAM type: NRG; PAM sequence: AAG
cagacccaaaaatcacttaa

SEQ ID NO: 30386 - DNA, 20 bp, Artificial Sequence
  Description of Artificial Sequence: Synthetic oligonucleotide
  Target: SCN9A; (-) strand; PAM type: NRG; PAM sequence: CAG
aattaactctcatgtgtatg

SEQ ID NO: 30387 - DNA, 20 bp, Artificial Sequence
  Description of Artificial Sequence: Synthetic oligonucleotide
  Target: SCN9A; (-) strand; PAM type: NRG; PAM sequence: CAG
taacatttttggacatgaca

SEQ ID NO: 30388 - DNA, 20 bp, Artificial Sequence
  Description of Artificial Sequence: Synthetic oligonucleotide
  Target: SCN9A; (-) strand; PAM type: NRG; PAM sequence: TGG
attgtttagcataacatttt

SEQ ID NO: 30389 - DNA, 20 bp, Artificial Sequence
  Description of Artificial Sequence: Synthetic oligonucleotide
  Target: SCN9A; (-) strand; PAM type: NRG; PAM sequence: TAG
cattgtttagtataattgtt

SEQ ID NO: 30390 - DNA, 20 bp, Artificial Sequence
  Description of Artificial Sequence: Synthetic oligonucleotide
  Target: SCN9A; (-) strand; PAM type: NRG; PAM sequence: TAG
ataacatagtatacattgtt

SEQ ID NO: 30391 - DNA, 20 bp, Artificial Sequence
  Description of Artificial Sequence: Synthetic oligonucleotide
  Target: SCN9A; (-) strand; PAM type: NRG; PAM sequence: TAG
gtataatgtttagtataaca

SEQ ID NO: 30392 - DNA, 20 bp, Artificial Sequence
  Description of Artificial Sequence: Synthetic oligonucleotide
  Target: SCN9A; (-) strand; PAM type: NRG; PAM sequence: TAG
gtgaaatttagtataatgtt

SEQ ID NO: 30393 - DNA, 20 bp, Artificial Sequence
  Description of Artificial Sequence: Synthetic oligonucleotide
  Target: SCN9A; (-) strand; PAM type: NRG; PAM sequence: TAG
tttgaagcaattgtgaaatt

SEQ ID NO: 30394 - DNA, 20 bp, Artificial Sequence
  Description of Artificial Sequence: Synthetic oligonucleotide
  Target: SCN9A; (-) strand; PAM type: NRG; PAM sequence: AAG
taggtattttattctctttg

SEQ ID NO: 30395 - DNA, 20 bp, Artificial Sequence
  Description of Artificial Sequence: Synthetic oligonucleotide
  Target: SCN9A; (-) strand; PAM type: NRG; PAM sequence: AGG
cccttgtaagttggattcct

SEQ ID NO: 30396 - DNA, 20 bp, Artificial Sequence
  Description of Artificial Sequence: Synthetic oligonucleotide
  Target: SCN9A; (-) strand; PAM type: NRG; PAM sequence: TAG
tcccttgtaagttggattcc

SEQ ID NO: 30397 - DNA, 20 bp, Artificial Sequence
  Description of Artificial Sequence: Synthetic oligonucleotide
  Target: SCN9A; (-) strand; PAM type: NRG; PAM sequence: TGG
ccttcacatcccttgtaagt

SEQ ID NO: 30398 - DNA, 20 bp, Artificial Sequence
  Description of Artificial Sequence: Synthetic oligonucleotide
  Target: SCN9A; (-) strand; PAM type: NRG; PAM sequence: AAG
aggtccttcacatcccttgt

SEQ ID NO: 30399 - DNA, 20 bp, Artificial Sequence
  Description of Artificial Sequence: Synthetic oligonucleotide
  Target: SCN9A; (-) strand; PAM type: NRG; PAM sequence: AGG
gtttgtagttctcctcgaag

SEQ ID NO: 30400 - DNA, 20 bp, Artificial Sequence
  Description of Artificial Sequence: Synthetic oligonucleotide
  Target: SCN9A; (-) strand; PAM type: NRG; PAM sequence: GAG
ggtttgtagttctcctcgaa

SEQ ID NO: 30401 - DNA, 20 bp, Artificial Sequence
  Description of Artificial Sequence: Synthetic oligonucleotide
  Target: SCN9A; (-) strand; PAM type: NRG; PAM sequence: AAG
gtggtttgtagttctcctcg

SEQ ID NO: 30402 - DNA, 20 bp, Artificial Sequence
  Description of Artificial Sequence: Synthetic oligonucleotide
  Target: SCN9A; (-) strand; PAM type: NRG; PAM sequence: TAG
tttccttgagcagtggtttg

SEQ ID NO: 30403 - DNA, 20 bp, Artificial Sequence
  Description of Artificial Sequence: Synthetic oligonucleotide
  Target: SCN9A; (-) strand; PAM type: NRG; PAM sequence: TGG
tcttttatttccttgagcag

SEQ ID NO: 30404 - DNA, 20 bp, Artificial Sequence
  Description of Artificial Sequence: Synthetic oligonucleotide
  Target: SCN9A; (-) strand; PAM type: NRG; PAM sequence: CAG
tcctcttttatttccttgag

SEQ ID NO: 30405 - DNA, 20 bp, Artificial Sequence
  Description of Artificial Sequence: Synthetic oligonucleotide
  Target: SCN9A; (-) strand; PAM type: NRG; PAM sequence: GAG
gtatcctcttttatttcctt

SEQ ID NO: 30406 - DNA, 20 bp, Artificial Sequence
  Description of Artificial Sequence: Synthetic oligonucleotide
  Target: SCN9A; (-) strand; PAM type: NRG; PAM sequence: TGG
attcttcctacacatgagca

SEQ ID NO: 30407 - DNA, 20 bp, Artificial Sequence
  Description of Artificial Sequence: Synthetic oligonucleotide
  Target: SCN9A; (-) strand; PAM type: NRG; PAM sequence: GAG
tattgattcttcctacacat

SEQ ID NO: 30408 - DNA, 20 bp, Artificial Sequence
  Description of Artificial Sequence: Synthetic oligonucleotide
  Target: SCN9A; (-) strand; PAM type: NRG; PAM sequence: TGG
gtaaattaccttgggcagta

SEQ ID NO: 30409 - DNA, 20 bp, Artificial Sequence
  Description of Artificial Sequence: Synthetic oligonucleotide
  Target: SCN9A; (-) strand; PAM type: NRG; PAM sequence: CAG
aatctgtaaattaccttggg

SEQ ID NO: 30410 - DNA, 20 bp, Artificial Sequence
  Description of Artificial Sequence: Synthetic oligonucleotide
  Target: SCN9A; (-) strand; PAM type: NRG; PAM sequence: GGG
ttgaatctgtaaattacctt

SEQ ID NO: 30411 - DNA, 20 bp, Artificial Sequence
  Description of Artificial Sequence: Synthetic oligonucleotide
  Target: SCN9A; (-) strand; PAM type: NRG; PAM sequence: TGG
attgaatctgtaaattacct

SEQ ID NO: 30412 - DNA, 20 bp, Artificial Sequence
  Description of Artificial Sequence: Synthetic oligonucleotide
  Target: SCN9A; (-) strand; PAM type: NRG; PAM sequence: TGG
cattggtagcttgatgggga

SEQ ID NO: 30413 - DNA, 20 bp, Artificial Sequence
  Description of Artificial Sequence: Synthetic oligonucleotide
  Target: SCN9A; (-) strand; PAM type: NRG; PAM sequence: GGG
aagtcattggtagcttgatg

SEQ ID NO: 30414 - DNA, 20 bp, Artificial Sequence
  Description of Artificial Sequence: Synthetic oligonucleotide
  Target: SCN9A; (-) strand; PAM type: NRG; PAM sequence: GGG
aaagtcattggtagcttgat

SEQ ID NO: 30415 - DNA, 20 bp, Artificial Sequence
  Description of Artificial Sequence: Synthetic oligonucleotide
  Target: SCN9A; (-) strand; PAM type: NRG; PAM sequence: TGG
gaaagtcattggtagcttga

SEQ ID NO: 30416 - DNA, 20 bp, Artificial Sequence
  Description of Artificial Sequence: Synthetic oligonucleotide
  Target: SCN9A; (-) strand; PAM type: NRG; PAM sequence: TAG
tctgtgaagaaagtcattgg

SEQ ID NO: 30417 - DNA, 20 bp, Artificial Sequence
  Description of Artificial Sequence: Synthetic oligonucleotide
  Target: SCN9A; (-) strand; PAM type: NRG; PAM sequence: TGG
agttctgtgaagaaagtcat

SEQ ID NO: 30418 - DNA, 20 bp, Artificial Sequence
  Description of Artificial Sequence: Synthetic oligonucleotide
  Target: SCN9A; (-) strand; PAM type: NRG; PAM sequence: AAG
tttttccagttctgtgaaga

SEQ ID NO: 30419 - DNA, 20 bp, Artificial Sequence
  Description of Artificial Sequence: Synthetic oligonucleotide
  Target: SCN9A; (-) strand; PAM type: NRG; PAM sequence: AAG
tagttttttccagttctgtg

SEQ ID NO: 30420 - DNA, 20 bp, Artificial Sequence
  Description of Artificial Sequence: Synthetic oligonucleotide
  Target: SCN9A; (-) strand; PAM type: NRG; PAM sequence: CAG
aactttaaagtagttttttc

SEQ ID NO: 30421 - DNA, 20 bp, Artificial Sequence
  Description of Artificial Sequence: Synthetic oligonucleotide
  Target: SCN9A; (-) strand; PAM type: NRG; PAM sequence: TAG
gttccatatgaactttaaag

SEQ ID NO: 30422 - DNA, 20 bp, Artificial Sequence
  Description of Artificial Sequence: Synthetic oligonucleotide
  Target: SCN9A; (-) strand; PAM type: NRG; PAM sequence: AAG
ttggttccatatgaacttta

SEQ ID NO: 30423 - DNA, 20 bp, Artificial Sequence
  Description of Artificial Sequence: Synthetic oligonucleotide
  Target: SCN9A; (-) strand; PAM type: NRG; PAM sequence: TGG
tggcgatgcgggctcttttt

SEQ ID NO: 30424 - DNA, 20 bp, Artificial Sequence
  Description of Artificial Sequence: Synthetic oligonucleotide
  Target: SCN9A; (-) strand; PAM type: NRG; PAM sequence: GGG
taggattgacttggcgatgc

SEQ ID NO: 30425 - DNA, 20 bp, Artificial Sequence
  Description of Artificial Sequence: Synthetic oligonucleotide
  Target: SCN9A; (-) strand; PAM type: NRG; PAM sequence: CGG
ttaggattgacttggcgatg

SEQ ID NO: 30426 - DNA, 20 bp, Artificial Sequence
  Description of Artificial Sequence: Synthetic oligonucleotide
  Target: SCN9A; (-) strand; PAM type: NRG; PAM sequence: TGG
cttttggcttaggattgact

SEQ ID NO: 30427 - DNA, 20 bp, Artificial Sequence
  Description of Artificial Sequence: Synthetic oligonucleotide
  Target: SCN9A; (-) strand; PAM type: NRG; PAM sequence: AGG
cagctttgttcttttggctt

SEQ ID NO: 30428 - DNA, 20 bp, Artificial Sequence
  Description of Artificial Sequence: Synthetic oligonucleotide
  Target: SCN9A; (-) strand; PAM type: NRG; PAM sequence: TAG
ccagctttgttcttttggct

SEQ ID NO: 30429 - DNA, 20 bp, Artificial Sequence
  Description of Artificial Sequence: Synthetic oligonucleotide
  Target: SCN9A; (-) strand; PAM type: NRG; PAM sequence: TGG
tgcctccagctttgttcttt

SEQ ID NO: 30430 - DNA, 20 bp, Artificial Sequence
  Description of Artificial Sequence: Synthetic oligonucleotide
  Target: SCN9A; (-) strand; PAM type: NRG; PAM sequence: CAG
gtcaggtagcgtgatgcctc

SEQ ID NO: 30431 - DNA, 20 bp, Artificial Sequence
  Description of Artificial Sequence: Synthetic oligonucleotide
  Target: SCN9A; (-) strand; PAM type: NRG; PAM sequence: TAG
tagtgtagtttgaagtcagg

SEQ ID NO: 30432 - DNA, 20 bp, Artificial Sequence
  Description of Artificial Sequence: Synthetic oligonucleotide
  Target: SCN9A; (-) strand; PAM type: NRG; PAM sequence: AGG
ttgtagtgtagtttgaagtc

SEQ ID NO: 30433 - DNA, 20 bp, Artificial Sequence
  Description of Artificial Sequence: Synthetic oligonucleotide
  Target: SCN9A; (-) strand; PAM type: NRG; PAM sequence: CAG
cttgtagtgtagtttgaagt

SEQ ID NO: 30434 - DNA, 20 bp, Artificial Sequence
  Description of Artificial Sequence: Synthetic oligonucleotide
  Target: SCN9A; (-) strand; PAM type: NRG; PAM sequence: AAG
tagccttgtagtgtagtttg

SEQ ID NO: 30435 - DNA, 20 bp, Artificial Sequence
  Description of Artificial Sequence: Synthetic oligonucleotide
  Target: SCN9A; (-) strand; PAM type: NRG; PAM sequence: TAG
gttactgtagccttgtagtg

SEQ ID NO: 30436 - DNA, 20 bp, Artificial Sequence
  Description of Artificial Sequence: Synthetic oligonucleotide
  Target: SCN9A; (-) strand; PAM type: NRG; PAM sequence: TAG
tttgggttactgtagccttg

SEQ ID NO: 30437 - DNA, 20 bp, Artificial Sequence
  Description of Artificial Sequence: Synthetic oligonucleotide
  Target: SCN9A; (-) strand; PAM type: NRG; PAM sequence: TAG
ccatgctgtttgggttactg

SEQ ID NO: 30438 - DNA, 20 bp, Artificial Sequence
  Description of Artificial Sequence: Synthetic oligonucleotide
  Target: SCN9A; (-) strand; PAM type: NRG; PAM sequence: GGG
gtaccagtaccatgctgttt

SEQ ID NO: 30439 - DNA, 20 bp, Artificial Sequence
  Description of Artificial Sequence: Synthetic oligonucleotide
  Target: SCN9A; (-) strand; PAM type: NRG; PAM sequence: TGG
ggtaccagtaccatgctgtt

SEQ ID NO: 30440 - DNA, 20 bp, Artificial Sequence
  Description of Artificial Sequence: Synthetic oligonucleotide
  Target: SCN9A; (-) strand; PAM type: NRG; PAM sequence: CAG
ctatatctctgttttggtac

SEQ ID NO: 30441 - DNA, 20 bp, Artificial Sequence
  Description of Artificial Sequence: Synthetic oligonucleotide
  Target: SCN9A; (-) strand; PAM type: NRG; PAM sequence: TGG
attgatctatatctctgttt

SEQ ID NO: 30442 - DNA, 20 bp, Artificial Sequence
  Description of Artificial Sequence: Synthetic oligonucleotide
  Target: SCN9A; (-) strand; PAM type: NRG; PAM sequence: GGG
atatgtggcgttatttctga

SEQ ID NO: 30443 - DNA, 20 bp, Artificial Sequence
  Description of Artificial Sequence: Synthetic oligonucleotide
  Target: SCN9A; (-) strand; PAM type: NRG; PAM sequence: AGG
gatatgtggcgttatttctg

SEQ ID NO: 30444 - DNA, 20 bp, Artificial Sequence
  Description of Artificial Sequence: Synthetic oligonucleotide
  Target: SCN9A; (-) strand; PAM type: NRG; PAM sequence: GAG
agatatgtggcgttatttct

SEQ ID NO: 30445 - DNA, 20 bp, Artificial Sequence
  Description of Artificial Sequence: Synthetic oligonucleotide
  Target: SCN9A; (-) strand; PAM type: NRG; PAM sequence: TGG
atcagatagttgtagatatg

SEQ ID NO: 30446 - DNA, 20 bp, Artificial Sequence
  Description of Artificial Sequence: Synthetic oligonucleotide
  Target: SCN9A; (-) strand; PAM type: NRG; PAM sequence: TAG
tgtcaaagatcagatagttg

SEQ ID NO: 30447 - DNA, 20 bp, Artificial Sequence
  Description of Artificial Sequence: Synthetic oligonucleotide
  Target: SCN9A; (-) strand; PAM type: NRG; PAM sequence: TAG
caggtttgtcaaagatcaga

SEQ ID NO: 30448 - DNA, 20 bp, Artificial Sequence
  Description of Artificial Sequence: Synthetic oligonucleotide
  Target: SCN9A; (-) strand; PAM type: NRG; PAM sequence: CAG
ttctcaggtttgtcaaagat

SEQ ID NO: 30449 - DNA, 20 bp, Artificial Sequence
  Description of Artificial Sequence: Synthetic oligonucleotide
  Target: SCN9A; (-) strand; PAM type: NRG; PAM sequence: AAG
tgtttttctcaggtttgtca

SEQ ID NO: 30450 - DNA, 20 bp, Artificial Sequence
  Description of Artificial Sequence: Synthetic oligonucleotide
  Target: SCN9A; (-) strand; PAM type: NRG; PAM sequence: AGG
ccccattgcttgtttttctc

SEQ ID NO: 30451 - DNA, 20 bp, Artificial Sequence
  Description of Artificial Sequence: Synthetic oligonucleotide
  Target: SCN9A; (-) strand; PAM type: NRG; PAM sequence: CAG
tccccattgcttgtttttct

SEQ ID NO: 30452 - DNA, 20 bp, Artificial Sequence
  Description of Artificial Sequence: Synthetic oligonucleotide
  Target: SCN9A; (-) strand; PAM type: NRG; PAM sequence: GGG
ccagcaccatttgttaaata

SEQ ID NO: 30453 - DNA, 20 bp, Artificial Sequence
  Description of Artificial Sequence: Synthetic oligonucleotide
  Target: SCN9A; (-) strand; PAM type: NRG; PAM sequence: AGG
cccagcaccatttgttaaat

SEQ ID NO: 30454 - DNA, 20 bp, Artificial Sequence
  Description of Artificial Sequence: Synthetic oligonucleotide
  Target: SCN9A; (-) strand; PAM type: NRG; PAM sequence: TAG
tcccagcaccatttgttaaa

SEQ ID NO: 30455 - DNA, 20 bp, Artificial Sequence
  Description of Artificial Sequence: Synthetic oligonucleotide
  Target: SCN9A; (-) strand; PAM type: NRG; PAM sequence: CAG
atatggctagccagttttcc

SEQ ID NO: 30456 - DNA, 20 bp, Artificial Sequence
  Description of Artificial Sequence: Synthetic oligonucleotide
  Target: SCN9A; (-) strand; PAM type: NRG; PAM sequence: CAG
gctttctacatatggctagc

SEQ ID NO: 30457 - DNA, 20 bp, Artificial Sequence
  Description of Artificial Sequence: Synthetic oligonucleotide
  Target: SCN9A; (-) strand; PAM type: NRG; PAM sequence: TAG
ttcagctttctacatatggc

SEQ ID NO: 30458 - DNA, 20 bp, Artificial Sequence
  Description of Artificial Sequence: Synthetic oligonucleotide
  Target: SCN9A; (-) strand; PAM type: NRG; PAM sequence: TGG
cagtttcagctttctacata

SEQ ID NO: 30459 - DNA, 20 bp, Artificial Sequence
  Description of Artificial Sequence: Synthetic oligonucleotide
  Target: SCN9A; (-) strand; PAM type: NRG; PAM sequence: CAG
gtaaggaagggatccagttt

SEQ ID NO: 30460 - DNA, 20 bp, Artificial Sequence
  Description of Artificial Sequence: Synthetic oligonucleotide
  Target: SCN9A; (-) strand; PAM type: NRG; PAM sequence: CAG
taaggtgtaaggaagggatc

SEQ ID NO: 30461 - DNA, 20 bp, Artificial Sequence
  Description of Artificial Sequence: Synthetic oligonucleotide
  Target: SCN9A; (-) strand; PAM type: NRG; PAM sequence: GGG
tttgtataaggtgtaaggaa

SEQ ID NO: 30462 - DNA, 20 bp, Artificial Sequence
  Description of Artificial Sequence: Synthetic oligonucleotide
  Target: SCN9A; (-) strand; PAM type: NRG; PAM sequence: AGG
ttttgtataaggtgtaagga

SEQ ID NO: 30463 - DNA, 20 bp, Artificial Sequence
  Description of Artificial Sequence: Synthetic oligonucleotide
  Target: SCN9A; (-) strand; PAM type: NRG; PAM sequence: AAG
tttttgtataaggtgtaagg

SEQ ID NO: 30464 - DNA, 20 bp, Artificial Sequence
  Description of Artificial Sequence: Synthetic oligonucleotide
  Target: SCN9A; (-) strand; PAM type: NRG; PAM sequence: AGG
tgatttttgtataaggtgta

SEQ ID NO: 30465 - DNA, 20 bp, Artificial Sequence
  Description of Artificial Sequence: Synthetic oligonucleotide
  Target: SCN9A; (-) strand; PAM type: NRG; PAM sequence: AAG
ttgatttttgtataaggtgt

SEQ ID NO: 30466 - DNA, 20 bp, Artificial Sequence
  Description of Artificial Sequence: Synthetic oligonucleotide
  Target: SCN9A; (-) strand; PAM type: NRG; PAM sequence: AGG
cttgaattgatttttgtata

SEQ ID NO: 30467 - DNA, 20 bp, Artificial Sequence
  Description of Artificial Sequence: Synthetic oligonucleotide
  Target: SCN9A; (-) strand; PAM type: NRG; PAM sequence: AAG
tcttgaattgatttttgtat

SEQ ID NO: 30468 - DNA, 20 bp, Artificial Sequence
  Description of Artificial Sequence: Synthetic oligonucleotide
  Target: SCN9A; (-) strand; PAM type: NRG; PAM sequence: AAG
tggttttaggtctaatgttt

SEQ ID NO: 30469 - DNA, 20 bp, Artificial Sequence
  Description of Artificial Sequence: Synthetic oligonucleotide
  Target: SCN9A; (-) strand; PAM type: NRG; PAM sequence: AGG
tctagggtttttatggtttt

SEQ ID NO: 30470 - DNA, 20 bp, Artificial Sequence
  Description of Artificial Sequence: Synthetic oligonucleotide
  Target: SCN9A; (-) strand; PAM type: NRG; PAM sequence: TAG
ttctagggtttttatggttt

SEQ ID NO: 30471 - DNA, 20 bp, Artificial Sequence
  Description of Artificial Sequence: Synthetic oligonucleotide
  Target: SCN9A; (-) strand; PAM type: NRG; PAM sequence: TGG
gttttcttctagggttttta

SEQ ID NO: 30472 - DNA, 20 bp, Artificial Sequence
  Description of Artificial Sequence: Synthetic oligonucleotide
  Target: SCN9A; (-) strand; PAM type: NRG; PAM sequence: GGG
aatgcctgggttttcttcta

SEQ ID NO: 30473 - DNA, 20 bp, Artificial Sequence
  Description of Artificial Sequence: Synthetic oligonucleotide
  Target: SCN9A; (-) strand; PAM type: NRG; PAM sequence: AGG
taatgcctgggttttcttct

SEQ ID NO: 30474 - DNA, 20 bp, Artificial Sequence
  Description of Artificial Sequence: Synthetic oligonucleotide
  Target: SCN9A; (-) strand; PAM type: NRG; PAM sequence: TAG
gtaatgcctgggttttcttc

SEQ ID NO: 30475 - DNA, 20 bp, Artificial Sequence
  Description of Artificial Sequence: Synthetic oligonucleotide
  Target: SCN9A; (-) strand; PAM type: NRG; PAM sequence: GGG
tgtcctgaatggtaatgcct

SEQ ID NO: 30476 - DNA, 20 bp, Artificial Sequence
  Description of Artificial Sequence: Synthetic oligonucleotide
  Target: SCN9A; (-) strand; PAM type: NRG; PAM sequence: TGG
atgtcctgaatggtaatgcc

SEQ ID NO: 30477 - DNA, 20 bp, Artificial Sequence
  Description of Artificial Sequence: Synthetic oligonucleotide
  Target: SCN9A; (-) strand; PAM type: NRG; PAM sequence: TGG
gcccatgcctatgtcctgaa

SEQ ID NO: 30478 - DNA, 20 bp, Artificial Sequence
  Description of Artificial Sequence: Synthetic oligonucleotide
  Target: SCN9A; (-) strand; PAM type: NRG; PAM sequence: AAG
cttttggtgttttagacatg

SEQ ID NO: 30479 - DNA, 20 bp, Artificial Sequence
  Description of Artificial Sequence: Synthetic oligonucleotide
  Target: SCN9A; (-) strand; PAM type: NRG; PAM sequence: TAG
tgccattgcttttggtgttt

SEQ ID NO: 30480 - DNA, 20 bp, Artificial Sequence
  Description of Artificial Sequence: Synthetic oligonucleotide
  Target: SCN9A; (-) strand; PAM type: NRG; PAM sequence: TGG
tcttttgttgccattgcttt

SEQ ID NO: 30481 - DNA, 20 bp, Artificial Sequence
  Description of Artificial Sequence: Synthetic oligonucleotide
  Target: SCN9A; (-) strand; PAM type: NRG; PAM sequence: TAG
cagaagctctttagtttaat

SEQ ID NO: 30482 - DNA, 20 bp, Artificial Sequence
  Description of Artificial Sequence: Synthetic oligonucleotide
  Target: SCN9A; (-) strand; PAM type: NRG; PAM sequence: TAG
tttgctgtgcagaagctctt

SEQ ID NO: 30483 - DNA, 20 bp, Artificial Sequence
  Description of Artificial Sequence: Synthetic oligonucleotide
  Target: SCN9A; (-) strand; PAM type: NRG; PAM sequence: AAG
tagtttattttgctgtgcag

SEQ ID NO: 30484 - DNA, 20 bp, Artificial Sequence
  Description of Artificial Sequence: Synthetic oligonucleotide
  Target: SCN9A; (-) strand; PAM type: NRG; PAM sequence: CAG
tggtagtttattttgctgtg

SEQ ID NO: 30485 - DNA, 20 bp, Artificial Sequence
  Description of Artificial Sequence: Synthetic oligonucleotide
  Target: SCN9A; (-) strand; PAM type: NRG; PAM sequence: TAG
ttgcatgttcactctgatgg

SEQ ID NO: 30486 - DNA, 20 bp, Artificial Sequence
  Description of Artificial Sequence: Synthetic oligonucleotide
  Target: SCN9A; (-) strand; PAM type: NRG; PAM sequence: TGG
aggttgcatgttcactctga

SEQ ID NO: 30487 - DNA, 20 bp, Artificial Sequence
  Description of Artificial Sequence: Synthetic oligonucleotide
  Target: SCN9A; (-) strand; PAM type: NRG; PAM sequence: AGG
aaaattgtctcccattttgt

SEQ ID NO: 30488 - DNA, 20 bp, Artificial Sequence
  Description of Artificial Sequence: Synthetic oligonucleotide
  Target: SCN9A; (-) strand; PAM type: NRG; PAM sequence: TAG
gaaaattgtctcccattttg

SEQ ID NO: 30489 - DNA, 20 bp, Artificial Sequence
  Description of Artificial Sequence: Synthetic oligonucleotide
  Target: SCN9A; (-) strand; PAM type: NRG; PAM sequence: AGG
tagccttttgtcagatgagt

SEQ ID NO: 30490 - DNA, 20 bp, Artificial Sequence
  Description of Artificial Sequence: Synthetic oligonucleotide
  Target: SCN9A; (-) strand; PAM type: NRG; PAM sequence: TAG
ttagccttttgtcagatgag

SEQ ID NO: 30491 - DNA, 20 bp, Artificial Sequence
  Description of Artificial Sequence: Synthetic oligonucleotide
  Target: SCN9A; (-) strand; PAM type: NRG; PAM sequence: GAG
atattagccttttgtcagat

SEQ ID NO: 30492 - DNA, 20 bp, Artificial Sequence
  Description of Artificial Sequence: Synthetic oligonucleotide
  Target: SCN9A; (-) strand; PAM type: NRG; PAM sequence: CAG
tctggatattagccttttgt

SEQ ID NO: 30493 - DNA, 20 bp, Artificial Sequence
  Description of Artificial Sequence: Synthetic oligonucleotide
  Target: SCN9A; (-) strand; PAM type: NRG; PAM sequence: TAG
tcattgtagattctggatat

SEQ ID NO: 30494 - DNA, 20 bp, Artificial Sequence
  Description of Artificial Sequence: Synthetic oligonucleotide
  Target: SCN9A; (-) strand; PAM type: NRG; PAM sequence: TGG
tttgagttcattgtagattc

SEQ ID NO: 30495 - DNA, 20 bp, Artificial Sequence
  Description of Artificial Sequence: Synthetic oligonucleotide
  Target: SCN9A; (-) strand; PAM type: NRG; PAM sequence: TAG
aaatttgtttgagttcattg

SEQ ID NO: 30496 - DNA, 20 bp, Artificial Sequence
  Description of Artificial Sequence: Synthetic oligonucleotide
  Target: SCN9A; (-) strand; PAM type: NRG; PAM sequence: GAG
tttttcttgtaaatttgttt

SEQ ID NO: 30497 - DNA, 20 bp, Artificial Sequence
  Description of Artificial Sequence: Synthetic oligonucleotide
  Target: SCN9A; (-) strand; PAM type: NRG; PAM sequence: GGG
cctttgcccactttttgatg

SEQ ID NO: 30498 - DNA, 20 bp, Artificial Sequence
  Description of Artificial Sequence: Synthetic oligonucleotide
  Target: SCN9A; (-) strand; PAM type: NRG; PAM sequence: GGG
tcctttgcccactttttgat

SEQ ID NO: 30499 - DNA, 20 bp, Artificial Sequence
  Description of Artificial Sequence: Synthetic oligonucleotide
  Target: SCN9A; (-) strand; PAM type: NRG; PAM sequence: TGG
gtcctttgcccactttttga

SEQ ID NO: 30500 - DNA, 20 bp, Artificial Sequence
  Description of Artificial Sequence: Synthetic oligonucleotide
  Target: SCN9A; (-) strand; PAM type: NRG; PAM sequence: AAG
cataaatgtcttcttttgag

SEQ ID NO: 30501 - DNA, 20 bp, Artificial Sequence
  Description of Artificial Sequence: Synthetic oligonucleotide
  Target: SCN9A; (-) strand; PAM type: NRG; PAM sequence: GAG
ctgcataaatgtcttctttt

SEQ ID NO: 30502 - DNA, 20 bp, Artificial Sequence
  Description of Artificial Sequence: Synthetic oligonucleotide
  Target: SCN9A; (-) strand; PAM type: NRG; PAM sequence: TGG
gcattttttcatgtgttttt

SEQ ID NO: 30503 - DNA, 20 bp, Artificial Sequence
  Description of Artificial Sequence: Synthetic oligonucleotide
  Target: SCN9A; (-) strand; PAM type: NRG; PAM sequence: GAG
ctctgatggccagtgatgat

SEQ ID NO: 30504 - DNA, 20 bp, Artificial Sequence
  Description of Artificial Sequence: Synthetic oligonucleotide
  Target: SCN9A; (-) strand; PAM type: NRG; PAM sequence: CAG
atttgcatttctctgatggc

SEQ ID NO: 30505 - DNA, 20 bp, Artificial Sequence
  Description of Artificial Sequence: Synthetic oligonucleotide
  Target: SCN9A; (-) strand; PAM type: NRG; PAM sequence: TGG
tttgatttgcatttctctga

SEQ ID NO: 30506 - DNA, 20 bp, Artificial Sequence
  Description of Artificial Sequence: Synthetic oligonucleotide
  Target: SCN9A; (-) strand; PAM type: NRG; PAM sequence: TGG
tgtgagatggtatctcattg

SEQ ID NO: 30507 - DNA, 20 bp, Artificial Sequence
  Description of Artificial Sequence: Synthetic oligonucleotide
  Target: SCN9A; (-) strand; PAM type: NRG; PAM sequence: TGG
ccattctaactggtgtgaga

SEQ ID NO: 30508 - DNA, 20 bp, Artificial Sequence
  Description of Artificial Sequence: Synthetic oligonucleotide
  Target: SCN9A; (-) strand; PAM type: NRG; PAM sequence: GAG
attgccattctaactggtgt

SEQ ID NO: 30509 - DNA, 20 bp, Artificial Sequence
  Description of Artificial Sequence: Synthetic oligonucleotide
  Target: SCN9A; (-) strand; PAM type: NRG; PAM sequence: TGG
ttaatgattgccattctaac

SEQ ID NO: 30510 - DNA, 20 bp, Artificial Sequence
  Description of Artificial Sequence: Synthetic oligonucleotide
  Target: SCN9A; (-) strand; PAM type: NRG; PAM sequence: CAG
ctatttctccacatcctctc

SEQ ID NO: 30511 - DNA, 20 bp, Artificial Sequence
  Description of Artificial Sequence: Synthetic oligonucleotide
  Target: SCN9A; (-) strand; PAM type: NRG; PAM sequence: AAG
gtttaccaccaacagtgtaa

SEQ ID NO: 30512 - DNA, 20 bp, Artificial Sequence
  Description of Artificial Sequence: Synthetic oligonucleotide
  Target: SCN9A; (-) strand; PAM type: NRG; PAM sequence: CAG
ttgaactagtttaccaccaa

SEQ ID NO: 30513 - DNA, 20 bp, Artificial Sequence
  Description of Artificial Sequence: Synthetic oligonucleotide
  Target: SCN9A; (-) strand; PAM type: NRG; PAM sequence: TAG
gacttccacaatggttgaac

SEQ ID NO: 30514 - DNA, 20 bp, Artificial Sequence
  Description of Artificial Sequence: Synthetic oligonucleotide
  Target: SCN9A; (-) strand; PAM type: NRG; PAM sequence: TGG
cgccacactgacttccacaa

SEQ ID NO: 30515 - DNA, 20 bp, Artificial Sequence
  Description of Artificial Sequence: Synthetic oligonucleotide
  Target: SCN9A; (-) strand; PAM type: NRG; PAM sequence: AGG
tttctagttctagatccctg

SEQ ID NO: 30516 - DNA, 20 bp, Artificial Sequence
  Description of Artificial Sequence: Synthetic oligonucleotide
  Target: SCN9A; (-) strand; PAM type: NRG; PAM sequence: GAG
atttctagttctagatccct

SEQ ID NO: 30517 - DNA, 20 bp, Artificial Sequence
  Description of Artificial Sequence: Synthetic oligonucleotide
  Target: SCN9A; (-) strand; PAM type: NRG; PAM sequence: TAG
tcaaatggtatttctagttc

SEQ ID NO: 30518 - DNA, 20 bp, Artificial Sequence
  Description of Artificial Sequence: Synthetic oligonucleotide
  Target: SCN9A; (-) strand; PAM type: NRG; PAM sequence: TAG
gctgggtcaaatggtatttc

SEQ ID NO: 30519 - DNA, 20 bp, Artificial Sequence
  Description of Artificial Sequence: Synthetic oligonucleotide
  Target: SCN9A; (-) strand; PAM type: NRG; PAM sequence: TGG
aatgggatggctgggtcaaa

SEQ ID NO: 30520 - DNA, 20 bp, Artificial Sequence
  Description of Artificial Sequence: Synthetic oligonucleotide
  Target: SCN9A; (-) strand; PAM type: NRG; PAM sequence: GGG
tacccagtaatgggatggct

SEQ ID NO: 30521 - DNA, 20 bp, Artificial Sequence
  Description of Artificial Sequence: Synthetic oligonucleotide
  Target: SCN9A; (-) strand; PAM type: NRG; PAM sequence: TGG
atacccagtaatgggatggc

SEQ ID NO: 30522 - DNA, 20 bp, Artificial Sequence
  Description of Artificial Sequence: Synthetic oligonucleotide
  Target: SCN9A; (-) strand; PAM type: NRG; PAM sequence: TGG
gtatatacccagtaatggga

SEQ ID NO: 30523 - DNA, 20 bp, Artificial Sequence
  Description of Artificial Sequence: Synthetic oligonucleotide
  Target: SCN9A; (-) strand; PAM type: NRG; PAM sequence: GGG
ttgggtatatacccagtaat

SEQ ID NO: 30524 - DNA, 20 bp, Artificial Sequence
  Description of Artificial Sequence: Synthetic oligonucleotide
  Target: SCN9A; (-) strand; PAM type: NRG; PAM sequence: TGG
tttgggtatatacccagtaa

SEQ ID NO: 30525 - DNA, 20 bp, Artificial Sequence
  Description of Artificial Sequence: Synthetic oligonucleotide
  Target: SCN9A; (-) strand; PAM type: NRG; PAM sequence: CAG
tagtcctttgggtatatacc

SEQ ID NO: 30526 - DNA, 20 bp, Artificial Sequence
  Description of Artificial Sequence: Synthetic oligonucleotide
  Target: SCN9A; (-) strand; PAM type: NRG; PAM sequence: GGG
agcatgatttatagtccttt

SEQ ID NO: 30527 - DNA, 20 bp, Artificial Sequence
  Description of Artificial Sequence: Synthetic oligonucleotide
  Target: SCN9A; (-) strand; PAM type: NRG; PAM sequence: TGG
cagcatgatttatagtcctt

SEQ ID NO: 30528 - DNA, 20 bp, Artificial Sequence
  Description of Artificial Sequence: Synthetic oligonucleotide
  Target: SCN9A; (-) strand; PAM type: NRG; PAM sequence: TAG
ctttatagcagcatgattta

SEQ ID NO: 30529 - DNA, 20 bp, Artificial Sequence
  Description of Artificial Sequence: Synthetic oligonucleotide
  Target: SCN9A; (-) strand; PAM type: NRG; PAM sequence: CAG
gtgtgcatgtgtctttatag

SEQ ID NO: 30530 - DNA, 20 bp, Artificial Sequence
  Description of Artificial Sequence: Synthetic oligonucleotide
  Target: SCN9A; (-) strand; PAM type: NRG; PAM sequence: TAG
tatgtgtgcatgtgtcttta

SEQ ID NO: 30531 - DNA, 20 bp, Artificial Sequence
  Description of Artificial Sequence: Synthetic oligonucleotide
  Target: SCN9A; (-) strand; PAM type: NRG; PAM sequence: AAG
tggacatttgggttggttcc

SEQ ID NO: 30532 - DNA, 20 bp, Artificial Sequence
  Description of Artificial Sequence: Synthetic oligonucleotide
  Target: SCN9A; (-) strand; PAM type: NRG; PAM sequence: TGG
tcattgttggacatttgggt

SEQ ID NO: 30533 - DNA, 20 bp, Artificial Sequence
  Description of Artificial Sequence: Synthetic oligonucleotide
  Target: SCN9A; (-) strand; PAM type: NRG; PAM sequence: GGG
tctatcattgttggacattt

SEQ ID NO: 30534 - DNA, 20 bp, Artificial Sequence
  Description of Artificial Sequence: Synthetic oligonucleotide
  Target: SCN9A; (-) strand; PAM type: NRG; PAM sequence: TGG
gtctatcattgttggacatt

SEQ ID NO: 30535 - DNA, 20 bp, Artificial Sequence
  Description of Artificial Sequence: Synthetic oligonucleotide
  Target: SCN9A; (-) strand; PAM type: NRG; PAM sequence: TGG
ttaatccagtctatcattgt

SEQ ID NO: 30536 - DNA, 20 bp, Artificial Sequence
  Description of Artificial Sequence: Synthetic oligonucleotide
  Target: SCN9A; (-) strand; PAM type: NRG; PAM sequence: CAG
tgagccacattttcttaatc

SEQ ID NO: 30537 - DNA, 20 bp, Artificial Sequence
  Description of Artificial Sequence: Synthetic oligonucleotide
  Target: SCN9A; (-) strand; PAM type: NRG; PAM sequence: GAG
tagtattccatggtgtatat

SEQ ID NO: 30538 - DNA, 20 bp, Artificial Sequence
  Description of Artificial Sequence: Synthetic oligonucleotide
  Target: SCN9A; (-) strand; PAM type: NRG; PAM sequence: TGG
tatggctgcatagtattcca

SEQ ID NO: 30539 - DNA, 20 bp, Artificial Sequence
  Description of Artificial Sequence: Synthetic oligonucleotide
  Target: SCN9A; (-) strand; PAM type: NRG; PAM sequence: TAG
catcattttttatggctgca

SEQ ID NO: 30540 - DNA, 20 bp, Artificial Sequence
  Description of Artificial Sequence: Synthetic oligonucleotide
  Target: SCN9A; (-) strand; PAM type: NRG; PAM sequence: TGG
cgtgaactcatcatttttta

SEQ ID NO: 30541 - DNA, 20 bp, Artificial Sequence
  Description of Artificial Sequence: Synthetic oligonucleotide
  Target: SCN9A; (-) strand; PAM type: NRG; PAM sequence: AGG
ttgcatccatgtccctacaa

SEQ ID NO: 30542 - DNA, 20 bp, Artificial Sequence
  Description of Artificial Sequence: Synthetic oligonucleotide
  Target: SCN9A; (-) strand; PAM type: NRG; PAM sequence: AAG
attgcatccatgtccctaca

SEQ ID NO: 30543 - DNA, 20 bp, Artificial Sequence
  Description of Artificial Sequence: Synthetic oligonucleotide
  Target: SCN9A; (-) strand; PAM type: NRG; PAM sequence: GAG
tattcttgtgatagtttact

SEQ ID NO: 30544 - DNA, 20 bp, Artificial Sequence
  Description of Artificial Sequence: Synthetic oligonucleotide
  Target: SCN9A; (-) strand; PAM type: NRG; PAM sequence: TAG
ttggttttttattcttgtga

SEQ ID NO: 30545 - DNA, 20 bp, Artificial Sequence
  Description of Artificial Sequence: Synthetic oligonucleotide
  Target: SCN9A; (-) strand; PAM type: NRG; PAM sequence: TGG
gagtgagaatatgcggtgtt

SEQ ID NO: 30546 - DNA, 20 bp, Artificial Sequence
  Description of Artificial Sequence: Synthetic oligonucleotide
  Target: SCN9A; (-) strand; PAM type: NRG; PAM sequence: CGG
cacctatgagtgagaatatg

SEQ ID NO: 30547 - DNA, 20 bp, Artificial Sequence
  Description of Artificial Sequence: Synthetic oligonucleotide
  Target: SCN9A; (-) strand; PAM type: NRG; PAM sequence: GAG
ttcaattcccacctatgagt

SEQ ID NO: 30548 - DNA, 20 bp, Artificial Sequence
  Description of Artificial Sequence: Synthetic oligonucleotide
  Target: SCN9A; (-) strand; PAM type: NRG; PAM sequence: GAG
attgttcaattcccacctat

SEQ ID NO: 30549 - DNA, 20 bp, Artificial Sequence
  Description of Artificial Sequence: Synthetic oligonucleotide
  Target: SCN9A; (-) strand; PAM type: NRG; PAM sequence: GAG
ccaccccaccacagtcccta

SEQ ID NO: 30550 - DNA, 20 bp, Artificial Sequence
  Description of Artificial Sequence: Synthetic oligonucleotide
  Target: SCN9A; (-) strand; PAM type: NRG; PAM sequence: TAG
ccccaccccaccacagtccc

SEQ ID NO: 30551 - DNA, 20 bp, Artificial Sequence
  Description of Artificial Sequence: Synthetic oligonucleotide
  Target: SCN9A; (-) strand; PAM type: NRG; PAM sequence: CAG
cccctccccccaccccacca

SEQ ID NO: 30552 - DNA, 20 bp, Artificial Sequence
  Description of Artificial Sequence: Synthetic oligonucleotide
  Target: SCN9A; (-) strand; PAM type: NRG; PAM sequence: AGG
ctaactggtcatctagcatt

SEQ ID NO: 30553 - DNA, 20 bp, Artificial Sequence
  Description of Artificial Sequence: Synthetic oligonucleotide
  Target: SCN9A; (-) strand; PAM type: NRG; PAM sequence: TAG
actaactggtcatctagcat

SEQ ID NO: 30554 - DNA, 20 bp, Artificial Sequence
  Description of Artificial Sequence: Synthetic oligonucleotide
  Target: SCN9A; (-) strand; PAM type: NRG; PAM sequence: TAG
gcacccactaactggtcatc

SEQ ID NO: 30555 - DNA, 20 bp, Artificial Sequence
  Description of Artificial Sequence: Synthetic oligonucleotide
  Target: SCN9A; (-) strand; PAM type: NRG; PAM sequence: TGG
ggtgcgctgcacccactaac

SEQ ID NO: 30556 - DNA, 20 bp, Artificial Sequence
  Description of Artificial Sequence: Synthetic oligonucleotide
  Target: SCN9A; (-) strand; PAM type: NRG; PAM sequence: TGG
tatgtatacatgtgccatgc

SEQ ID NO: 30557 - DNA, 20 bp, Artificial Sequence
  Description of Artificial Sequence: Synthetic oligonucleotide
  Target: SCN9A; (-) strand; PAM type: NRG; PAM sequence: TAG
catgtgcacattgtgcaggt

SEQ ID NO: 30558 - DNA, 20 bp, Artificial Sequence
  Description of Artificial Sequence: Synthetic oligonucleotide
  Target: SCN9A; (-) strand; PAM type: NRG; PAM sequence: AGG
ggtacatgtgcacattgtgc

SEQ ID NO: 30559 - DNA, 20 bp, Artificial Sequence
  Description of Artificial Sequence: Synthetic oligonucleotide
  Target: SCN9A; (-) strand; PAM type: NRG; PAM sequence: CAG
gggtacatgtgcacattgtg

SEQ ID NO: 30560 - DNA, 20 bp, Artificial Sequence
  Description of Artificial Sequence: Synthetic oligonucleotide
  Target: SCN9A; (-) strand; PAM type: NRG; PAM sequence: GGG
taattatactttaagtttta

SEQ ID NO: 30561 - DNA, 20 bp, Artificial Sequence
  Description of Artificial Sequence: Synthetic oligonucleotide
  Target: SCN9A; (-) strand; PAM type: NRG; PAM sequence: AGG
ttaattatactttaagtttt

SEQ ID NO: 30562 - DNA, 20 bp, Artificial Sequence
  Description of Artificial Sequence: Synthetic oligonucleotide
  Target: SCN9A; (-) strand; PAM type: NRG; PAM sequence: TAG
tttaattatactttaagttt

SEQ ID NO: 30563 - DNA, 20 bp, Artificial Sequence
  Description of Artificial Sequence: Synthetic oligonucleotide
  Target: SCN9A; (-) strand; PAM type: NRG; PAM sequence: AAG
tttttttttaattatacttt

SEQ ID NO: 30564 - DNA, 20 bp, Artificial Sequence
  Description of Artificial Sequence: Synthetic oligonucleotide
  Target: SCN9A; (-) strand; PAM type: NRG; PAM sequence: TGG
attgaaattggctctggcat

SEQ ID NO: 30565 - DNA, 20 bp, Artificial Sequence
  Description of Artificial Sequence: Synthetic oligonucleotide
  Target: SCN9A; (-) strand; PAM type: NRG; PAM sequence: TGG
tttttcattgaaattggctc

SEQ ID NO: 30566 - DNA, 20 bp, Artificial Sequence
  Description of Artificial Sequence: Synthetic oligonucleotide
  Target: SCN9A; (-) strand; PAM type: NRG; PAM sequence: TGG
ttcaaatttttcattgaaat

SEQ ID NO: 30567 - DNA, 20 bp, Artificial Sequence
  Description of Artificial Sequence: Synthetic oligonucleotide
  Target: SCN9A; (-) strand; PAM type: NRG; PAM sequence: CAG
atatatatatataggatatt

SEQ ID NO: 30568 - DNA, 20 bp, Artificial Sequence
  Description of Artificial Sequence: Synthetic oligonucleotide
  Target: SCN9A; (-) strand; PAM type: NRG; PAM sequence: AGG
atatatatatatatatatat

SEQ ID NO: 30569 - DNA, 20 bp, Artificial Sequence
  Description of Artificial Sequence: Synthetic oligonucleotide
  Target: SCN9A; (-) strand; PAM type: NRG; PAM sequence: TAG
tatatatatatatatatata

SEQ ID NO: 30570 - DNA, 20 bp, Artificial Sequence
  Description of Artificial Sequence: Synthetic oligonucleotide
  Target: SCN9A; (-) strand; PAM type: NRG; PAM sequence: CAG
gtgaataaccatatcatgac

SEQ ID NO: 30571 - DNA, 20 bp, Artificial Sequence
  Description of Artificial Sequence: Synthetic oligonucleotide
  Target: SCN9A; (-) strand; PAM type: NRG; PAM sequence: TAG
aaattgagattagtgaaatt

SEQ ID NO: 30572 - DNA, 20 bp, Artificial Sequence
  Description of Artificial Sequence: Synthetic oligonucleotide
  Target: SCN9A; (-) strand; PAM type: NRG; PAM sequence: TAG
aaattattttaaattgagat

SEQ ID NO: 30573 - DNA, 20 bp, Artificial Sequence
  Description of Artificial Sequence: Synthetic oligonucleotide
  Target: SCN9A; (-) strand; PAM type: NRG; PAM sequence: GAG
tataaaaattattttaaatt

SEQ ID NO: 30574 - DNA, 20 bp, Artificial Sequence
  Description of Artificial Sequence: Synthetic oligonucleotide
  Target: SCN9A; (-) strand; PAM type: NRG; PAM sequence: TGG
cttcagtggtcagtttctgt

SEQ ID NO: 30575 - DNA, 20 bp, Artificial Sequence
  Description of Artificial Sequence: Synthetic oligonucleotide
  Target: SCN9A; (-) strand; PAM type: NRG; PAM sequence: CAG
tttattttgacttcagtggt

SEQ ID NO: 30576 - DNA, 20 bp, Artificial Sequence
  Description of Artificial Sequence: Synthetic oligonucleotide
  Target: SCN9A; (-) strand; PAM type: NRG; PAM sequence: TGG
tgagtttattttgacttcag

SEQ ID NO: 30577 - DNA, 20 bp, Artificial Sequence
  Description of Artificial Sequence: Synthetic oligonucleotide
  Target: SCN9A; (-) strand; PAM type: NRG; PAM sequence: CAG
aggtgagtttattttgactt

SEQ ID NO: 30578 - DNA, 20 bp, Artificial Sequence
  Description of Artificial Sequence: Synthetic oligonucleotide
  Target: SCN9A; (-) strand; PAM type: NRG; PAM sequence: GAG
tactatgcagacaaaaaggt

SEQ ID NO: 30579 - DNA, 20 bp, Artificial Sequence
  Description of Artificial Sequence: Synthetic oligonucleotide
  Target: SCN9A; (-) strand; PAM type: NRG; PAM sequence: AGG
cccctactatgcagacaaaa

SEQ ID NO: 30580 - DNA, 20 bp, Artificial Sequence
  Description of Artificial Sequence: Synthetic oligonucleotide
  Target: SCN9A; (-) strand; PAM type: NRG; PAM sequence: AAG
acccctactatgcagacaaa

SEQ ID NO: 30581 - DNA, 20 bp, Artificial Sequence
  Description of Artificial Sequence: Synthetic oligonucleotide
  Target: SCN9A; (-) strand; PAM type: NRG; PAM sequence: CAG
ggacttggacccctactatg

SEQ ID NO: 30582 - DNA, 20 bp, Artificial Sequence
  Description of Artificial Sequence: Synthetic oligonucleotide
  Target: SCN9A; (-) strand; PAM type: NRG; PAM sequence: TGG
gtcagagcccctggaggact

SEQ ID NO: 30583 - DNA, 20 bp, Artificial Sequence
  Description of Artificial Sequence: Synthetic oligonucleotide
  Target: SCN9A; (-) strand; PAM type: NRG; PAM sequence: AGG
catggtgtcagagcccctgg

SEQ ID NO: 30584 - DNA, 20 bp, Artificial Sequence
  Description of Artificial Sequence: Synthetic oligonucleotide
  Target: SCN9A; (-) strand; PAM type: NRG; PAM sequence: GAG
gcatggtgtcagagcccctg

SEQ ID NO: 30585 - DNA, 20 bp, Artificial Sequence
  Description of Artificial Sequence: Synthetic oligonucleotide
  Target: SCN9A; (-) strand; PAM type: NRG; PAM sequence: TGG
cggcatggtgtcagagcccc

SEQ ID NO: 30586 - DNA, 20 bp, Artificial Sequence
  Description of Artificial Sequence: Synthetic oligonucleotide
  Target: SCN9A; (-) strand; PAM type: NRG; PAM sequence: GAG
ttcctcccggcatggtgtca

SEQ ID NO: 30587 - DNA, 20 bp, Artificial Sequence
  Description of Artificial Sequence: Synthetic oligonucleotide
  Target: SCN9A; (-) strand; PAM type: NRG; PAM sequence: CAG
cattcctcccggcatggtgt

SEQ ID NO: 30588 - DNA, 20 bp, Artificial Sequence
  Description of Artificial Sequence: Synthetic oligonucleotide
  Target: SCN9A; (-) strand; PAM type: NRG; PAM sequence: TGG
tggggacattcctcccggca

SEQ ID NO: 30589 - DNA, 20 bp, Artificial Sequence
  Description of Artificial Sequence: Synthetic oligonucleotide
  Target: SCN9A; (-) strand; PAM type: NRG; PAM sequence: CGG
atctatggggacattcctcc

SEQ ID NO: 30590 - DNA, 20 bp, Artificial Sequence
  Description of Artificial Sequence: Synthetic oligonucleotide
  Target: SCN9A; (-) strand; PAM type: NRG; PAM sequence: GGG
acagctgcccttcatctatg

SEQ ID NO: 30591 - DNA, 20 bp, Artificial Sequence
  Description of Artificial Sequence: Synthetic oligonucleotide
  Target: SCN9A; (-) strand; PAM type: NRG; PAM sequence: GGG
aacagctgcccttcatctat

SEQ ID NO: 30592 - DNA, 20 bp, Artificial Sequence
  Description of Artificial Sequence: Synthetic oligonucleotide
  Target: SCN9A; (-) strand; PAM type: NRG; PAM sequence: TGG
aaacagctgcccttcatcta

SEQ ID NO: 30593 - DNA, 20 bp, Artificial Sequence
  Description of Artificial Sequence: Synthetic oligonucleotide
  Target: SCN9A; (-) strand; PAM type: NRG; PAM sequence: CAG
gtgacttggaagctggcaaa

SEQ ID NO: 30594 - DNA, 20 bp, Artificial Sequence
  Description of Artificial Sequence: Synthetic oligonucleotide
  Target: SCN9A; (-) strand; PAM type: NRG; PAM sequence: TGG
ccaagcagtgacttggaagc

SEQ ID NO: 30595 - DNA, 20 bp, Artificial Sequence
  Description of Artificial Sequence: Synthetic oligonucleotide
  Target: SCN9A; (-) strand; PAM type: NRG; PAM sequence: AAG
aaagccaagcagtgacttgg

SEQ ID NO: 30596 - DNA, 20 bp, Artificial Sequence
  Description of Artificial Sequence: Synthetic oligonucleotide
  Target: SCN9A; (-) strand; PAM type: NRG; PAM sequence: TGG
cccaaagccaagcagtgact

SEQ ID NO: 30597 - DNA, 20 bp, Artificial Sequence
  Description of Artificial Sequence: Synthetic oligonucleotide
  Target: SCN9A; (-) strand; PAM type: NRG; PAM sequence: CAG
gaagaagccccaaagccaag

SEQ ID NO: 30598 - DNA, 20 bp, Artificial Sequence
  Description of Artificial Sequence: Synthetic oligonucleotide
  Target: SCN9A; (-) strand; PAM type: NRG; PAM sequence: AAG
gatgaagaagccccaaagcc

SEQ ID NO: 30599 - DNA, 20 bp, Artificial Sequence
  Description of Artificial Sequence: Synthetic oligonucleotide
  Target: SCN9A; (-) strand; PAM type: NRG; PAM sequence: AAG
atgatgatgaagaagcccca

SEQ ID NO: 30600 - DNA, 20 bp, Artificial Sequence
  Description of Artificial Sequence: Synthetic oligonucleotide
  Target: SCN9A; (-) strand; PAM type: NRG; PAM sequence: AAG
aaagaaagatgatgatgaag

SEQ ID NO: 30601 - DNA, 20 bp, Artificial Sequence
  Description of Artificial Sequence: Synthetic oligonucleotide
  Target: SCN9A; (-) strand; PAM type: NRG; PAM sequence: AAG
agaaaagaaagatgatgatg

SEQ ID NO: 30602 - DNA, 20 bp, Artificial Sequence
  Description of Artificial Sequence: Synthetic oligonucleotide
  Target: SCN9A; (-) strand; PAM type: NRG; PAM sequence: AAG
ggaacccaaagaagaaaaga

SEQ ID NO: 30603 - DNA, 20 bp, Artificial Sequence
  Description of Artificial Sequence: Synthetic oligonucleotide
  Target: SCN9A; (-) strand; PAM type: NRG; PAM sequence: AAG
caaaggaacccaaagaagaa

SEQ ID NO: 30604 - DNA, 20 bp, Artificial Sequence
  Description of Artificial Sequence: Synthetic oligonucleotide
  Target: SCN9A; (-) strand; PAM type: NRG; PAM sequence: AAG
aaaatcaaaggaacccaaag

SEQ ID NO: 30605 - DNA, 20 bp, Artificial Sequence
  Description of Artificial Sequence: Synthetic oligonucleotide
  Target: SCN9A; (-) strand; PAM type: NRG; PAM sequence: AAG
aagaaaatcaaaggaaccca

SEQ ID NO: 30606 - DNA, 20 bp, Artificial Sequence
  Description of Artificial Sequence: Synthetic oligonucleotide
  Target: SCN9A; (-) strand; PAM type: NRG; PAM sequence: AGG
cattgctgaaagaaaatcaa

SEQ ID NO: 30607 - DNA, 20 bp, Artificial Sequence
  Description of Artificial Sequence: Synthetic oligonucleotide
  Target: SCN9A; (-) strand; PAM type: NRG; PAM sequence: AAG
gcattgctgaaagaaaatca

SEQ ID NO: 30608 - DNA, 20 bp, Artificial Sequence
  Description of Artificial Sequence: Synthetic oligonucleotide
  Target: SCN9A; (-) strand; PAM type: NRG; PAM sequence: AAG
attgaacaacgcattgctga

SEQ ID NO: 30609 - DNA, 20 bp, Artificial Sequence
  Description of Artificial Sequence: Synthetic oligonucleotide
  Target: SCN9A; (-) strand; PAM type: NRG; PAM sequence: CAG
gctttgtccatttcacaaaa

SEQ ID NO: 30610 - DNA, 20 bp, Artificial Sequence
  Description of Artificial Sequence: Synthetic oligonucleotide
  Target: SCN9A; (-) strand; PAM type: NRG; PAM sequence: GAG
ttgcctcccccaggacctca

SEQ ID NO: 30611 - DNA, 20 bp, Artificial Sequence
  Description of Artificial Sequence: Synthetic oligonucleotide
  Target: SCN9A; (-) strand; PAM type: NRG; PAM sequence: CAG
tgttgcctcccccaggacct

SEQ ID NO: 30612 - DNA, 20 bp, Artificial Sequence
  Description of Artificial Sequence: Synthetic oligonucleotide
  Target: SCN9A; (-) strand; PAM type: NRG; PAM sequence: AGG
atggcaatgttgcctccccc

SEQ ID NO: 30613 - DNA, 20 bp, Artificial Sequence
  Description of Artificial Sequence: Synthetic oligonucleotide
  Target: SCN9A; (-) strand; PAM type: NRG; PAM sequence: CAG
gatggcaatgttgcctcccc

SEQ ID NO: 30614 - DNA, 20 bp, Artificial Sequence
  Description of Artificial Sequence: Synthetic oligonucleotide
  Target: SCN9A; (-) strand; PAM type: NRG; PAM sequence: TGG
aaatatacaggatgaaaaga

SEQ ID NO: 30615 - DNA, 20 bp, Artificial Sequence
  Description of Artificial Sequence: Synthetic oligonucleotide
  Target: SCN9A; (-) strand; PAM type: NRG; PAM sequence: AAG
attaaaatatacaggatgaa

SEQ ID NO: 30616 - DNA, 20 bp, Artificial Sequence
  Description of Artificial Sequence: Synthetic oligonucleotide
  Target: SCN9A; (-) strand; PAM type: NRG; PAM sequence: AGG
gaagaggaattaaaatatac

SEQ ID NO: 30617 - DNA, 20 bp, Artificial Sequence
  Description of Artificial Sequence: Synthetic oligonucleotide
  Target: SCN9A; (-) strand; PAM type: NRG; PAM sequence: CAG
tgaagaggaattaaaatata

SEQ ID NO: 30618 - DNA, 20 bp, Artificial Sequence
  Description of Artificial Sequence: Synthetic oligonucleotide
  Target: SCN9A; (-) strand; PAM type: NRG; PAM sequence: AGG
tcttatgtgaggagctgaag

SEQ ID NO: 30619 - DNA, 20 bp, Artificial Sequence
  Description of Artificial Sequence: Synthetic oligonucleotide
  Target: SCN9A; (-) strand; PAM type: NRG; PAM sequence: GAG
ctcttatgtgaggagctgaa

SEQ ID NO: 30620 - DNA, 20 bp, Artificial Sequence
  Description of Artificial Sequence: Synthetic oligonucleotide
  Target: SCN9A; (-) strand; PAM type: NRG; PAM sequence: AAG
gcctcttatgtgaggagctg

SEQ ID NO: 30621 - DNA, 20 bp, Artificial Sequence
  Description of Artificial Sequence: Synthetic oligonucleotide
  Target: SCN9A; (-) strand; PAM type: NRG; PAM sequence: GAG
atccaggcctcttatgtgag

SEQ ID NO: 30622 - DNA, 20 bp, Artificial Sequence
  Description of Artificial Sequence: Synthetic oligonucleotide
  Target: SCN9A; (-) strand; PAM type: NRG; PAM sequence: AGG
ccatccaggcctcttatgtg

SEQ ID NO: 30623 - DNA, 20 bp, Artificial Sequence
  Description of Artificial Sequence: Synthetic oligonucleotide
  Target: SCN9A; (-) strand; PAM type: NRG; PAM sequence: GAG
tccatccaggcctcttatgt

SEQ ID NO: 30624 - DNA, 20 bp, Artificial Sequence
  Description of Artificial Sequence: Synthetic oligonucleotide
  Target: SCN9A; (-) strand; PAM type: NRG; PAM sequence: AGG
ttatttctttgtttccatcc

SEQ ID NO: 30625 - DNA, 20 bp, Artificial Sequence
  Description of Artificial Sequence: Synthetic oligonucleotide
  Target: SCN9A; (-) strand; PAM type: NRG; PAM sequence: CAG
tttatttctttgtttccatc

SEQ ID NO: 30626 - DNA, 20 bp, Artificial Sequence
  Description of Artificial Sequence: Synthetic oligonucleotide
  Target: SCN9A; (-) strand; PAM type: NRG; PAM sequence: AAG
ttcttggcaggcaaatagtt

SEQ ID NO: 30627 - DNA, 20 bp, Artificial Sequence
  Description of Artificial Sequence: Synthetic oligonucleotide
  Target: SCN9A; (-) strand; PAM type: NRG; PAM sequence: TAG
ggcctttcttggcaggcaaa

SEQ ID NO: 30628 - DNA, 20 bp, Artificial Sequence
  Description of Artificial Sequence: Synthetic oligonucleotide
  Target: SCN9A; (-) strand; PAM type: NRG; PAM sequence: AGG
tttaatgggcctttcttggc

SEQ ID NO: 30629 - DNA, 20 bp, Artificial Sequence
  Description of Artificial Sequence: Synthetic oligonucleotide
  Target: SCN9A; (-) strand; PAM type: NRG; PAM sequence: CAG
ttttaatgggcctttcttgg

SEQ ID NO: 30630 - DNA, 20 bp, Artificial Sequence
  Description of Artificial Sequence: Synthetic oligonucleotide
  Target: SCN9A; (-) strand; PAM type: NRG; PAM sequence: TGG
agtttttaatgggcctttct

SEQ ID NO: 30631 - DNA, 20 bp, Artificial Sequence
  Description of Artificial Sequence: Synthetic oligonucleotide
  Target: SCN9A; (-) strand; PAM type: NRG; PAM sequence: GGG
tgttattattagtttttaat

SEQ ID NO: 30632 - DNA, 20 bp, Artificial Sequence
  Description of Artificial Sequence: Synthetic oligonucleotide
  Target: SCN9A; (-) strand; PAM type: NRG; PAM sequence: TGG
ttgttattattagtttttaa

SEQ ID NO: 30633 - DNA, 20 bp, Artificial Sequence
  Description of Artificial Sequence: Synthetic oligonucleotide
  Target: SCN9A; (-) strand; PAM type: NRG; PAM sequence: TAG
tctgtttatgttgttattat

SEQ ID NO: 30634 - DNA, 20 bp, Artificial Sequence
  Description of Artificial Sequence: Synthetic oligonucleotide
  Target: SCN9A; (-) strand; PAM type: NRG; PAM sequence: TAG
ctagaacatgttaccttttg

SEQ ID NO: 30635 - DNA, 20 bp, Artificial Sequence
  Description of Artificial Sequence: Synthetic oligonucleotide
  Target: SCN9A; (-) strand; PAM type: NRG; PAM sequence: TAG
ccttaacaagctgataattc

SEQ ID NO: 30636 - DNA, 20 bp, Artificial Sequence
  Description of Artificial Sequence: Synthetic oligonucleotide
  Target: SCN9A; (-) strand; PAM type: NRG; PAM sequence: AAG
acacatagtaatcccttaac

SEQ ID NO: 30637 - DNA, 20 bp, Artificial Sequence
  Description of Artificial Sequence: Synthetic oligonucleotide
  Target: SCN9A; (-) strand; PAM type: NRG; PAM sequence: TAG
cccgcccattgcctgacaca

SEQ ID NO: 30638 - DNA, 20 bp, Artificial Sequence
  Description of Artificial Sequence: Synthetic oligonucleotide
  Target: SCN9A; (-) strand; PAM type: NRG; PAM sequence: AAG
ggttagaaggcacgaaagat

SEQ ID NO: 30639 - DNA, 20 bp, Artificial Sequence
  Description of Artificial Sequence: Synthetic oligonucleotide
  Target: SCN9A; (-) strand; PAM type: NRG; PAM sequence: AAG
aagatggttagaaggcacga

SEQ ID NO: 30640 - DNA, 20 bp, Artificial Sequence
  Description of Artificial Sequence: Synthetic oligonucleotide
  Target: SCN9A; (-) strand; PAM type: NRG; PAM sequence: AGG
tgagtataaagatggttaga

SEQ ID NO: 30641 - DNA, 20 bp, Artificial Sequence
  Description of Artificial Sequence: Synthetic oligonucleotide
  Target: SCN9A; (-) strand; PAM type: NRG; PAM sequence: AAG
ctgagtataaagatggttag

SEQ ID NO: 30642 - DNA, 20 bp, Artificial Sequence
  Description of Artificial Sequence: Synthetic oligonucleotide
  Target: SCN9A; (-) strand; PAM type: NRG; PAM sequence: TAG
tttctgagtataaagatggt

SEQ ID NO: 30643 - DNA, 20 bp, Artificial Sequence
  Description of Artificial Sequence: Synthetic oligonucleotide
  Target: SCN9A; (-) strand; PAM type: NRG; PAM sequence: TGG
caaatttctgagtataaaga

SEQ ID NO: 30644 - DNA, 20 bp, Artificial Sequence
  Description of Artificial Sequence: Synthetic oligonucleotide
  Target: SCN9A; (-) strand; PAM type: NRG; PAM sequence: AAG
acttcaaatttctgagtata

SEQ ID NO: 30645 - DNA, 20 bp, Artificial Sequence
  Description of Artificial Sequence: Synthetic oligonucleotide
  Target: SCN9A; (-) strand; PAM type: NRG; PAM sequence: GAG
agcgtaaacttcaaatttct

SEQ ID NO: 30646 - DNA, 20 bp, Artificial Sequence
  Description of Artificial Sequence: Synthetic oligonucleotide
  Target: SCN9A; (-) strand; PAM type: NRG; PAM sequence: AAG
ttttttactttaaagctatg

SEQ ID NO: 30647 - DNA, 20 bp, Artificial Sequence
  Description of Artificial Sequence: Synthetic oligonucleotide
  Target: SCN9A; (-) strand; PAM type: NRG; PAM sequence: AAG
aattgtcattttttacttta

SEQ ID NO: 30648 - DNA, 20 bp, Artificial Sequence
  Description of Artificial Sequence: Synthetic oligonucleotide
  Target: SCN9A; (-) strand; PAM type: NRG; PAM sequence: CAG
ggaatttaggaaaatttact

SEQ ID NO: 30649 - DNA, 20 bp, Artificial Sequence
  Description of Artificial Sequence: Synthetic oligonucleotide
  Target: SCN9A; (-) strand; PAM type: NRG; PAM sequence: AGG
gacgaaaagaaggggaattt

SEQ ID NO: 30650 - DNA, 20 bp, Artificial Sequence
  Description of Artificial Sequence: Synthetic oligonucleotide
  Target: SCN9A; (-) strand; PAM type: NRG; PAM sequence: TAG
agacgaaaagaaggggaatt

SEQ ID NO: 30651 - DNA, 20 bp, Artificial Sequence
  Description of Artificial Sequence: Synthetic oligonucleotide
  Target: SCN9A; (-) strand; PAM type: NRG; PAM sequence: GGG
taaatatagacgaaaagaag

SEQ ID NO: 30652 - DNA, 20 bp, Artificial Sequence
  Description of Artificial Sequence: Synthetic oligonucleotide
  Target: SCN9A; (-) strand; PAM type: NRG; PAM sequence: GGG
gtaaatatagacgaaaagaa

SEQ ID NO: 30653 - DNA, 20 bp, Artificial Sequence
  Description of Artificial Sequence: Synthetic oligonucleotide
  Target: SCN9A; (-) strand; PAM type: NRG; PAM sequence: AGG
ggtaaatatagacgaaaaga

SEQ ID NO: 30654 - DNA, 20 bp, Artificial Sequence
  Description of Artificial Sequence: Synthetic oligonucleotide
  Target: SCN9A; (-) strand; PAM type: NRG; PAM sequence: AAG
aggtaaatatagacgaaaag

SEQ ID NO: 30655 - DNA, 20 bp, Artificial Sequence
  Description of Artificial Sequence: Synthetic oligonucleotide
  Target: SCN9A; (-) strand; PAM type: NRG; PAM sequence: AAG
caaaggtaaatatagacgaa

SEQ ID NO: 30656 - DNA, 20 bp, Artificial Sequence
  Description of Artificial Sequence: Synthetic oligonucleotide
  Target: SCN9A; (-) strand; PAM type: NRG; PAM sequence: TAG
aattgcaccaaaggtaaata

SEQ ID NO: 30657 - DNA, 20 bp, Artificial Sequence
  Description of Artificial Sequence: Synthetic oligonucleotide
  Target: SCN9A; (-) strand; PAM type: NRG; PAM sequence: AGG
gttgagttgaattgcaccaa

SEQ ID NO: 30658 - DNA, 20 bp, Artificial Sequence
  Description of Artificial Sequence: Synthetic oligonucleotide
  Target: SCN9A; (-) strand; PAM type: NRG; PAM sequence: AAG
agttgagttgaattgcacca

SEQ ID NO: 30659 - DNA, 20 bp, Artificial Sequence
  Description of Artificial Sequence: Synthetic oligonucleotide
  Target: SCN9A; (-) strand; PAM type: NRG; PAM sequence: GAG
acttttaaaagaggaaagtt

SEQ ID NO: 30660 - DNA, 20 bp, Artificial Sequence
  Description of Artificial Sequence: Synthetic oligonucleotide
  Target: SCN9A; (-) strand; PAM type: NRG; PAM sequence: AAG
taaagacttttaaaagagga

SEQ ID NO: 30661 - DNA, 20 bp, Artificial Sequence
  Description of Artificial Sequence: Synthetic oligonucleotide
  Target: SCN9A; (-) strand; PAM type: NRG; PAM sequence: AGG
atcataaagacttttaaaag

SEQ ID NO: 30662 - DNA, 20 bp, Artificial Sequence
  Description of Artificial Sequence: Synthetic oligonucleotide
  Target: SCN9A; (-) strand; PAM type: NRG; PAM sequence: GAG
tatcataaagacttttaaaa

SEQ ID NO: 30663 - DNA, 20 bp, Artificial Sequence
  Description of Artificial Sequence: Synthetic oligonucleotide
  Target: SCN9A; (-) strand; PAM type: NRG; PAM sequence: AAG
attatcataaagacttttaa

SEQ ID NO: 30664 - DNA, 20 bp, Artificial Sequence
  Description of Artificial Sequence: Synthetic oligonucleotide
  Target: SCN9A; (-) strand; PAM type: NRG; PAM sequence: AAG
ctaccaaaggcattatcata

SEQ ID NO: 30665 - DNA, 20 bp, Artificial Sequence
  Description of Artificial Sequence: Synthetic oligonucleotide
  Target: SCN9A; (-) strand; PAM type: NRG; PAM sequence: AGG
ctggagagtggtgctaccaa

SEQ ID NO: 30666 - DNA, 20 bp, Artificial Sequence
  Description of Artificial Sequence: Synthetic oligonucleotide
  Target: SCN9A; (-) strand; PAM type: NRG; PAM sequence: AAG
gctggagagtggtgctacca

SEQ ID NO: 30667 - DNA, 20 bp, Artificial Sequence
  Description of Artificial Sequence: Synthetic oligonucleotide
  Target: SCN9A; (-) strand; PAM type: NRG; PAM sequence: TGG
aacagcatcaggctggagag

SEQ ID NO: 30668 - DNA, 20 bp, Artificial Sequence
  Description of Artificial Sequence: Synthetic oligonucleotide
  Target: SCN9A; (-) strand; PAM type: NRG; PAM sequence: GAG
taaaacagcatcaggctgga

SEQ ID NO: 30669 - DNA, 20 bp, Artificial Sequence
  Description of Artificial Sequence: Synthetic oligonucleotide
  Target: SCN9A; (-) strand; PAM type: NRG; PAM sequence: GAG
ggtaaaacagcatcaggctg

SEQ ID NO: 30670 - DNA, 20 bp, Artificial Sequence
  Description of Artificial Sequence: Synthetic oligonucleotide
  Target: SCN9A; (-) strand; PAM type: NRG; PAM sequence: TGG
ttggtaaaacagcatcaggc

SEQ ID NO: 30671 - DNA, 20 bp, Artificial Sequence
  Description of Artificial Sequence: Synthetic oligonucleotide
  Target: SCN9A; (-) strand; PAM type: NRG; PAM sequence: AGG
ttagttggtaaaacagcatc

SEQ ID NO: 30672 - DNA, 20 bp, Artificial Sequence
  Description of Artificial Sequence: Synthetic oligonucleotide
  Target: SCN9A; (-) strand; PAM type: NRG; PAM sequence: CAG
tttagttggtaaaacagcat

SEQ ID NO: 30673 - DNA, 20 bp, Artificial Sequence
  Description of Artificial Sequence: Synthetic oligonucleotide
  Target: SCN9A; (-) strand; PAM type: NRG; PAM sequence: CAG
cataagtttagttggtaaaa

SEQ ID NO: 30674 - DNA, 20 bp, Artificial Sequence
  Description of Artificial Sequence: Synthetic oligonucleotide
  Target: SCN9A; (-) strand; PAM type: NRG; PAM sequence: TGG
gaatattacataagtttagt

SEQ ID NO: 30675 - DNA, 20 bp, Artificial Sequence
  Description of Artificial Sequence: Synthetic oligonucleotide
  Target: SCN9A; (-) strand; PAM type: NRG; PAM sequence: TAG
tttagaatattacataagtt

SEQ ID NO: 30676 - DNA, 20 bp, Artificial Sequence
  Description of Artificial Sequence: Synthetic oligonucleotide
  Target: SCN9A; (-) strand; PAM type: NRG; PAM sequence: AAG
gaggatttagaatattacat

SEQ ID NO: 30677 - DNA, 20 bp, Artificial Sequence
  Description of Artificial Sequence: Synthetic oligonucleotide
  Target: SCN9A; (-) strand; PAM type: NRG; PAM sequence: TAG
tgaagtgacagcagaggatt

SEQ ID NO: 30678 - DNA, 20 bp, Artificial Sequence
  Description of Artificial Sequence: Synthetic oligonucleotide
  Target: SCN9A; (-) strand; PAM type: NRG; PAM sequence: AGG
cattgttgaagtgacagcag

SEQ ID NO: 30679 - DNA, 20 bp, Artificial Sequence
  Description of Artificial Sequence: Synthetic oligonucleotide
  Target: SCN9A; (-) strand; PAM type: NRG; PAM sequence: GAG
acattgttgaagtgacagca

SEQ ID NO: 30680 - DNA, 20 bp, Artificial Sequence
  Description of Artificial Sequence: Synthetic oligonucleotide
  Target: SCN9A; (-) strand; PAM type: NRG; PAM sequence: CAG
gaacattgttgaagtgacag

SEQ ID NO: 30681 - DNA, 20 bp, Artificial Sequence
  Description of Artificial Sequence: Synthetic oligonucleotide
  Target: SCN9A; (-) strand; PAM type: NRG; PAM sequence: CAG
tatgaacattgttgaagtga

SEQ ID NO: 30682 - DNA, 20 bp, Artificial Sequence
  Description of Artificial Sequence: Synthetic oligonucleotide
  Target: SCN9A; (-) strand; PAM type: NRG; PAM sequence: AAG
agatgttatgaacattgttg

SEQ ID NO: 30683 - DNA, 20 bp, Artificial Sequence
  Description of Artificial Sequence: Synthetic oligonucleotide
  Target: SCN9A; (-) strand; PAM type: NRG; PAM sequence: AAG
gatggaatcttctcctggtc

SEQ ID NO: 30684 - DNA, 20 bp, Artificial Sequence
  Description of Artificial Sequence: Synthetic oligonucleotide
  Target: SCN9A; (-) strand; PAM type: NRG; PAM sequence: TGG
cgtgagatggaatcttctcc

SEQ ID NO: 30685 - DNA, 20 bp, Artificial Sequence
  Description of Artificial Sequence: Synthetic oligonucleotide
  Target: SCN9A; (-) strand; PAM type: NRG; PAM sequence: TGG
aagaaagtggtttcgtgaga

SEQ ID NO: 30686 - DNA, 20 bp, Artificial Sequence
  Description of Artificial Sequence: Synthetic oligonucleotide
  Target: SCN9A; (-) strand; PAM type: NRG; PAM sequence: GAG
agcaaagaaagtggtttcgt

SEQ ID NO: 30687 - DNA, 20 bp, Artificial Sequence
  Description of Artificial Sequence: Synthetic oligonucleotide
  Target: SCN9A; (-) strand; PAM type: NRG; PAM sequence: TGG
tgattgataagcaaagaaag

SEQ ID NO: 30688 - DNA, 20 bp, Artificial Sequence
  Description of Artificial Sequence: Synthetic oligonucleotide
  Target: SCN9A; (-) strand; PAM type: NRG; PAM sequence: AAG
ttctgattgataagcaaaga

SEQ ID NO: 30689 - DNA, 20 bp, Artificial Sequence
  Description of Artificial Sequence: Synthetic oligonucleotide
  Target: SCN9A; (-) strand; PAM type: NRG; PAM sequence: AAG
ttgcttctgattgataagca

SEQ ID NO: 30690 - DNA, 20 bp, Artificial Sequence
  Description of Artificial Sequence: Synthetic oligonucleotide
  Target: SCN9A; (-) strand; PAM type: NRG; PAM sequence: AAG
aggagttgcttctgattgat

SEQ ID NO: 30691 - DNA, 20 bp, Artificial Sequence
  Description of Artificial Sequence: Synthetic oligonucleotide
  Target: SCN9A; (-) strand; PAM type: NRG; PAM sequence: GAG
cggtaacttgaatggatgag

SEQ ID NO: 30692 - DNA, 20 bp, Artificial Sequence
  Description of Artificial Sequence: Synthetic oligonucleotide
  Target: SCN9A; (-) strand; PAM type: NRG; PAM sequence: AGG
cgcggtaacttgaatggatg

SEQ ID NO: 30693 - DNA, 20 bp, Artificial Sequence
  Description of Artificial Sequence: Synthetic oligonucleotide
  Target: SCN9A; (-) strand; PAM type: NRG; PAM sequence: GAG
tcgcggtaacttgaatggat

SEQ ID NO: 30694 - DNA, 20 bp, Artificial Sequence
  Description of Artificial Sequence: Synthetic oligonucleotide
  Target: SCN9A; (-) strand; PAM type: NRG; PAM sequence: TGG
ccatctcgcggtaacttgaa

SEQ ID NO: 30695 - DNA, 20 bp, Artificial Sequence
  Description of Artificial Sequence: Synthetic oligonucleotide
  Target: SCN9A; (-) strand; PAM type: NRG; PAM sequence: CGG
actgaattgctgccatctcg

SEQ ID NO: 30696 - DNA, 20 bp, Artificial Sequence
  Description of Artificial Sequence: Synthetic oligonucleotide
  Target: SCN9A; (-) strand; PAM type: NRG; PAM sequence: GAG
agaattagaattaagagatg

SEQ ID NO: 30697 - DNA, 20 bp, Artificial Sequence
  Description of Artificial Sequence: Synthetic oligonucleotide
  Target: SCN9A; (-) strand; PAM type: NRG; PAM sequence: TGG
agagaattagaattaagaga

SEQ ID NO: 30698 - DNA, 20 bp, Artificial Sequence
  Description of Artificial Sequence: Synthetic oligonucleotide
  Target: SCN9A; (-) strand; PAM type: NRG; PAM sequence: GAG
agcaagagaattagaattaa

SEQ ID NO: 30699 - DNA, 20 bp, Artificial Sequence
  Description of Artificial Sequence: Synthetic oligonucleotide
  Target: SCN9A; (-) strand; PAM type: NRG; PAM sequence: AAG
atagcaagagaattagaatt

SEQ ID NO: 30700 - DNA, 20 bp, Artificial Sequence
  Description of Artificial Sequence: Synthetic oligonucleotide
  Target: SCN9A; (-) strand; PAM type: NRG; PAM sequence: TAG
ggtggaaatagcaagagaat

SEQ ID NO: 30701 - DNA, 20 bp, Artificial Sequence
  Description of Artificial Sequence: Synthetic oligonucleotide
  Target: SCN9A; (-) strand; PAM type: NRG; PAM sequence: GAG
agatgtggtggaaatagcaa

SEQ ID NO: 30702 - DNA, 20 bp, Artificial Sequence
  Description of Artificial Sequence: Synthetic oligonucleotide
  Target: SCN9A; (-) strand; PAM type: NRG; PAM sequence: AAG
gcagatgtggtggaaatagc

SEQ ID NO: 30703 - DNA, 20 bp, Artificial Sequence
  Description of Artificial Sequence: Synthetic oligonucleotide
  Target: SCN9A; (-) strand; PAM type: NRG; PAM sequence: TAG
aactgcagatgtggtggaaa

SEQ ID NO: 30704 - DNA, 20 bp, Artificial Sequence
  Description of Artificial Sequence: Synthetic oligonucleotide
  Target: SCN9A; (-) strand; PAM type: NRG; PAM sequence: TGG
ggaaagaactgcagatgtgg

SEQ ID NO: 30705 - DNA, 20 bp, Artificial Sequence
  Description of Artificial Sequence: Synthetic oligonucleotide
  Target: SCN9A; (-) strand; PAM type: NRG; PAM sequence: TGG
gatggaaagaactgcagatg

SEQ ID NO: 30706 - DNA, 20 bp, Artificial Sequence
  Description of Artificial Sequence: Synthetic oligonucleotide
  Target: SCN9A; (-) strand; PAM type: NRG; PAM sequence: CAG
ttcagtgatggaaagaactg

SEQ ID NO: 30707 - DNA, 20 bp, Artificial Sequence
  Description of Artificial Sequence: Synthetic oligonucleotide
  Target: SCN9A; (-) strand; PAM type: NRG; PAM sequence: AAG
tttaagacttcagtgatgga

SEQ ID NO: 30708 - DNA, 20 bp, Artificial Sequence
  Description of Artificial Sequence: Synthetic oligonucleotide
  Target: SCN9A; (-) strand; PAM type: NRG; PAM sequence: TGG
gaggtttaagacttcagtga

SEQ ID NO: 30709 - DNA, 20 bp, Artificial Sequence
  Description of Artificial Sequence: Synthetic oligonucleotide
  Target: SCN9A; (-) strand; PAM type: NRG; PAM sequence: CAG
ctatgagaggtttaagactt

SEQ ID NO: 30710 - DNA, 20 bp, Artificial Sequence
  Description of Artificial Sequence: Synthetic oligonucleotide
  Target: SCN9A; (-) strand; PAM type: NRG; PAM sequence: AAG
tggatgactatgagaggttt

SEQ ID NO: 30711 - DNA, 20 bp, Artificial Sequence
  Description of Artificial Sequence: Synthetic oligonucleotide
  Target: SCN9A; (-) strand; PAM type: NRG; PAM sequence: AGG
ctctcatggatgactatgag

SEQ ID NO: 30712 - DNA, 20 bp, Artificial Sequence
  Description of Artificial Sequence: Synthetic oligonucleotide
  Target: SCN9A; (-) strand; PAM type: NRG; PAM sequence: GAG
actctcatggatgactatga

SEQ ID NO: 30713 - DNA, 20 bp, Artificial Sequence
  Description of Artificial Sequence: Synthetic oligonucleotide
  Target: SCN9A; (-) strand; PAM type: NRG; PAM sequence: GAG
caactctcatggatgactat

SEQ ID NO: 30714 - DNA, 20 bp, Artificial Sequence
  Description of Artificial Sequence: Synthetic oligonucleotide
  Target: SCN9A; (-) strand; PAM type: NRG; PAM sequence: TGG
tgagttgattccaactctca

SEQ ID NO: 30715 - DNA, 20 bp, Artificial Sequence
  Description of Artificial Sequence: Synthetic oligonucleotide
  Target: SCN9A; (-) strand; PAM type: NRG; PAM sequence: GAG
cattaataggaaattggaat

SEQ ID NO: 30716 - DNA, 20 bp, Artificial Sequence
  Description of Artificial Sequence: Synthetic oligonucleotide
  Target: SCN9A; (-) strand; PAM type: NRG; PAM sequence: TGG
tacaaacattaataggaaat

SEQ ID NO: 30717 - DNA, 20 bp, Artificial Sequence
  Description of Artificial Sequence: Synthetic oligonucleotide
  Target: SCN9A; (-) strand; PAM type: NRG; PAM sequence: AGG
ggcaatatacaaacattaat

SEQ ID NO: 30718 - DNA, 20 bp, Artificial Sequence
  Description of Artificial Sequence: Synthetic oligonucleotide
  Target: SCN9A; (-) strand; PAM type: NRG; PAM sequence: TAG
gggcaatatacaaacattaa

SEQ ID NO: 30719 - DNA, 20 bp, Artificial Sequence
  Description of Artificial Sequence: Synthetic oligonucleotide
  Target: SCN9A; (-) strand; PAM type: NRG; PAM sequence: GGG
attaatgatttgtgggagga

SEQ ID NO: 30720 - DNA, 20 bp, Artificial Sequence
  Description of Artificial Sequence: Synthetic oligonucleotide
  Target: SCN9A; (-) strand; PAM type: NRG; PAM sequence: AGG
cattaatgatttgtgggagg

SEQ ID NO: 30721 - DNA, 20 bp, Artificial Sequence
  Description of Artificial Sequence: Synthetic oligonucleotide
  Target: SCN9A; (-) strand; PAM type: NRG; PAM sequence: GAG
acattaatgatttgtgggag

SEQ ID NO: 30722 - DNA, 20 bp, Artificial Sequence
  Description of Artificial Sequence: Synthetic oligonucleotide
  Target: SCN9A; (-) strand; PAM type: NRG; PAM sequence: AGG
gaacattaatgatttgtggg

SEQ ID NO: 30723 - DNA, 20 bp, Artificial Sequence
  Description of Artificial Sequence: Synthetic oligonucleotide
  Target: SCN9A; (-) strand; PAM type: NRG; PAM sequence: GAG
agaacattaatgatttgtgg

SEQ ID NO: 30724 - DNA, 20 bp, Artificial Sequence
  Description of Artificial Sequence: Synthetic oligonucleotide
  Target: SCN9A; (-) strand; PAM type: NRG; PAM sequence: GGG
ttagaacattaatgatttgt

SEQ ID NO: 30725 - DNA, 20 bp, Artificial Sequence
  Description of Artificial Sequence: Synthetic oligonucleotide
  Target: SCN9A; (-) strand; PAM type: NRG; PAM sequence: TGG
attagaacattaatgatttg

SEQ ID NO: 30726 - DNA, 20 bp, Artificial Sequence
  Description of Artificial Sequence: Synthetic oligonucleotide
  Target: SCN9A; (-) strand; PAM type: NRG; PAM sequence: TAG
ttcaccattctagatgttat

SEQ ID NO: 30727 - DNA, 20 bp, Artificial Sequence
  Description of Artificial Sequence: Synthetic oligonucleotide
  Target: SCN9A; (-) strand; PAM type: NRG; PAM sequence: TAG
ctggaaaggattcaccattc

SEQ ID NO: 30728 - DNA, 20 bp, Artificial Sequence
  Description of Artificial Sequence: Synthetic oligonucleotide
  Target: SCN9A; (-) strand; PAM type: NRG; PAM sequence: AGG
aaattgaaaatcttctggaa

SEQ ID NO: 30729 - DNA, 20 bp, Artificial Sequence
  Description of Artificial Sequence: Synthetic oligonucleotide
  Target: SCN9A; (-) strand; PAM type: NRG; PAM sequence: AAG
taaattgaaaatcttctgga

SEQ ID NO: 30730 - DNA, 20 bp, Artificial Sequence
  Description of Artificial Sequence: Synthetic oligonucleotide
  Target: SCN9A; (-) strand; PAM type: NRG; PAM sequence: TGG
aaagtaaattgaaaatcttc

SEQ ID NO: 30731 - DNA, 20 bp, Artificial Sequence
  Description of Artificial Sequence: Synthetic oligonucleotide
  Target: SCN9A; (-) strand; PAM type: NRG; PAM sequence: AAG
tcctctgatgggtctgggaa

SEQ ID NO: 30732 - DNA, 20 bp, Artificial Sequence
  Description of Artificial Sequence: Synthetic oligonucleotide
  Target: SCN9A; (-) strand; PAM type: NRG; PAM sequence: GGG
gtgattcctctgatgggtct

SEQ ID NO: 30733 - DNA, 20 bp, Artificial Sequence
  Description of Artificial Sequence: Synthetic oligonucleotide
  Target: SCN9A; (-) strand; PAM type: NRG; PAM sequence: TGG
agtgattcctctgatgggtc

SEQ ID NO: 30734 - DNA, 20 bp, Artificial Sequence
  Description of Artificial Sequence: Synthetic oligonucleotide
  Target: SCN9A; (-) strand; PAM type: NRG; PAM sequence: GGG
tagatagtgattcctctgat

SEQ ID NO: 30735 - DNA, 20 bp, Artificial Sequence
  Description of Artificial Sequence: Synthetic oligonucleotide
  Target: SCN9A; (-) strand; PAM type: NRG; PAM sequence: TGG
atagatagtgattcctctga

SEQ ID NO: 30736 - DNA, 20 bp, Artificial Sequence
  Description of Artificial Sequence: Synthetic oligonucleotide
  Target: SCN9A; (-) strand; PAM type: NRG; PAM sequence: TAG
aagactatagctgccataga

SEQ ID NO: 30737 - DNA, 20 bp, Artificial Sequence
  Description of Artificial Sequence: Synthetic oligonucleotide
  Target: SCN9A; (-) strand; PAM type: NRG; PAM sequence: TAG
ttataagactatagctgcca

SEQ ID NO: 30738 - DNA, 20 bp, Artificial Sequence
  Description of Artificial Sequence: Synthetic oligonucleotide
  Target: SCN9A; (-) strand; PAM type: NRG; PAM sequence: TAG
aaatacattttataagacta

SEQ ID NO: 30739 - DNA, 20 bp, Artificial Sequence
  Description of Artificial Sequence: Synthetic oligonucleotide
  Target: SCN9A; (-) strand; PAM type: NRG; PAM sequence: AAG
ttttaataaatacattttat

SEQ ID NO: 30740 - DNA, 20 bp, Artificial Sequence
  Description of Artificial Sequence: Synthetic oligonucleotide
  Target: SCN9A; (-) strand; PAM type: NRG; PAM sequence: AAG
aaagagtaatttcaactttt

SEQ ID NO: 30741 - DNA, 20 bp, Artificial Sequence
  Description of Artificial Sequence: Synthetic oligonucleotide
  Target: SCN9A; (-) strand; PAM type: NRG; PAM sequence: GAG
tctgtagcctatgggccaaa

SEQ ID NO: 30742 - DNA, 20 bp, Artificial Sequence
  Description of Artificial Sequence: Synthetic oligonucleotide
  Target: SCN9A; (-) strand; PAM type: NRG; PAM sequence: AAG
attctgtagcctatgggcca

SEQ ID NO: 30743 - DNA, 20 bp, Artificial Sequence
  Description of Artificial Sequence: Synthetic oligonucleotide
  Target: SCN9A; (-) strand; PAM type: NRG; PAM sequence: GGG
ctatccattctgtagcctat

SEQ ID NO: 30744 - DNA, 20 bp, Artificial Sequence
  Description of Artificial Sequence: Synthetic oligonucleotide
  Target: SCN9A; (-) strand; PAM type: NRG; PAM sequence: TGG
gctatccattctgtagccta

SEQ ID NO: 30745 - DNA, 20 bp, Artificial Sequence
  Description of Artificial Sequence: Synthetic oligonucleotide
  Target: SCN9A; (-) strand; PAM type: NRG; PAM sequence: TAG
tgctaacgctatccattctg

SEQ ID NO: 30746 - DNA, 20 bp, Artificial Sequence
  Description of Artificial Sequence: Synthetic oligonucleotide
  Target: SCN9A; (-) strand; PAM type: NRG; PAM sequence: GGG
gctctaacggagaggtacaa

SEQ ID NO: 30747 - DNA, 20 bp, Artificial Sequence
  Description of Artificial Sequence: Synthetic oligonucleotide
  Target: SCN9A; (-) strand; PAM type: NRG; PAM sequence: AGG
agctctaacggagaggtaca

SEQ ID NO: 30748 - DNA, 20 bp, Artificial Sequence
  Description of Artificial Sequence: Synthetic oligonucleotide
  Target: SCN9A; (-) strand; PAM type: NRG; PAM sequence: AAG
gagctctaacggagaggtac

SEQ ID NO: 30749 - DNA, 20 bp, Artificial Sequence
  Description of Artificial Sequence: Synthetic oligonucleotide
  Target: SCN9A; (-) strand; PAM type: NRG; PAM sequence: AGG
actcaagagctctaacggag

SEQ ID NO: 30750 - DNA, 20 bp, Artificial Sequence
  Description of Artificial Sequence: Synthetic oligonucleotide
  Target: SCN9A; (-) strand; PAM type: NRG; PAM sequence: GAG
cactcaagagctctaacgga

SEQ ID NO: 30751 - DNA, 20 bp, Artificial Sequence
  Description of Artificial Sequence: Synthetic oligonucleotide
  Target: SCN9A; (-) strand; PAM type: NRG; PAM sequence: GAG
gtcactcaagagctctaacg

SEQ ID NO: 30752 - DNA, 20 bp, Artificial Sequence
  Description of Artificial Sequence: Synthetic oligonucleotide
  Target: SCN9A; (-) strand; PAM type: NRG; PAM sequence: CGG
tggtcactcaagagctctaa

SEQ ID NO: 30753 - DNA, 20 bp, Artificial Sequence
  Description of Artificial Sequence: Synthetic oligonucleotide
  Target: SCN9A; (-) strand; PAM type: NRG; PAM sequence: GAG
caatgtgcctggtcactcaa

SEQ ID NO: 30754 - DNA, 20 bp, Artificial Sequence
  Description of Artificial Sequence: Synthetic oligonucleotide
  Target: SCN9A; (-) strand; PAM type: NRG; PAM sequence: AAG
gacaatgtgcctggtcactc

SEQ ID NO: 30755 - DNA, 20 bp, Artificial Sequence
  Description of Artificial Sequence: Synthetic oligonucleotide
  Target: SCN9A; (-) strand; PAM type: NRG; PAM sequence: TGG
ctgcctattgacaatgtgcc

SEQ ID NO: 30756 - DNA, 20 bp, Artificial Sequence
  Description of Artificial Sequence: Synthetic oligonucleotide
  Target: SCN9A; (-) strand; PAM type: NRG; PAM sequence: AAG
atagctcaggaaaaaaaaaa

SEQ ID NO: 30757 - DNA, 20 bp, Artificial Sequence
  Description of Artificial Sequence: Synthetic oligonucleotide
  Target: SCN9A; (-) strand; PAM type: NRG; PAM sequence: AGG
agtgttgatacttatagctc

SEQ ID NO: 30758 - DNA, 20 bp, Artificial Sequence
  Description of Artificial Sequence: Synthetic oligonucleotide
  Target: SCN9A; (-) strand; PAM type: NRG; PAM sequence: CAG
cagtgttgatacttatagct

SEQ ID NO: 30759 - DNA, 20 bp, Artificial Sequence
  Description of Artificial Sequence: Synthetic oligonucleotide
  Target: SCN9A; (-) strand; PAM type: NRG; PAM sequence: TAG
aggcccagtgttgatactta

SEQ ID NO: 30760 - DNA, 20 bp, Artificial Sequence
  Description of Artificial Sequence: Synthetic oligonucleotide
  Target: SCN9A; (-) strand; PAM type: NRG; PAM sequence: CAG
ttcactaaatattttaggcc

SEQ ID NO: 30761 - DNA, 20 bp, Artificial Sequence
  Description of Artificial Sequence: Synthetic oligonucleotide
  Target: SCN9A; (-) strand; PAM type: NRG; PAM sequence: AGG
catggttcactaaatatttt

SEQ ID NO: 30762 - DNA, 20 bp, Artificial Sequence
  Description of Artificial Sequence: Synthetic oligonucleotide
  Target: SCN9A; (-) strand; PAM type: NRG; PAM sequence: TAG
gcatggttcactaaatattt

SEQ ID NO: 30763 - DNA, 20 bp, Artificial Sequence
  Description of Artificial Sequence: Synthetic oligonucleotide
  Target: SCN9A; (-) strand; PAM type: NRG; PAM sequence: TGG
cagcacgtctgtttacagca

SEQ ID NO: 30764 - DNA, 20 bp, Artificial Sequence
  Description of Artificial Sequence: Synthetic oligonucleotide
  Target: SCN9A; (-) strand; PAM type: NRG; PAM sequence: CAG
gatgacagcacgtctgttta

SEQ ID NO: 30765 - DNA, 20 bp, Artificial Sequence
  Description of Artificial Sequence: Synthetic oligonucleotide
  Target: SCN9A; (-) strand; PAM type: NRG; PAM sequence: CAG
gaacaacaaagcctggatga

SEQ ID NO: 30766 - DNA, 20 bp, Artificial Sequence
  Description of Artificial Sequence: Synthetic oligonucleotide
  Target: SCN9A; (-) strand; PAM type: NRG; PAM sequence: TGG
ataaatagaacaacaaagcc

SEQ ID NO: 30767 - DNA, 20 bp, Artificial Sequence
  Description of Artificial Sequence: Synthetic oligonucleotide
  Target: SCN9A; (-) strand; PAM type: NRG; PAM sequence: AAG
gctctataaatagaacaaca

SEQ ID NO: 30768 - DNA, 20 bp, Artificial Sequence
  Description of Artificial Sequence: Synthetic oligonucleotide
  Target: SCN9A; (-) strand; PAM type: NRG; PAM sequence: TAG
ctctgcctgtgctctataaa

SEQ ID NO: 30769 - DNA, 20 bp, Artificial Sequence
  Description of Artificial Sequence: Synthetic oligonucleotide
  Target: SCN9A; (-) strand; PAM type: NRG; PAM sequence: AAG
aatcattcagaaaatctctt

SEQ ID NO: 30770 - DNA, 20 bp, Artificial Sequence
  Description of Artificial Sequence: Synthetic oligonucleotide
  Target: SCN9A; (-) strand; PAM type: NRG; PAM sequence: CAG
aattatattatttaatcatt

SEQ ID NO: 30771 - DNA, 20 bp, Artificial Sequence
  Description of Artificial Sequence: Synthetic oligonucleotide
  Target: SCN9A; (-) strand; PAM type: NRG; PAM sequence: CAG
aactatattatttaattatt

SEQ ID NO: 30772 - DNA, 20 bp, Artificial Sequence
  Description of Artificial Sequence: Synthetic oligonucleotide
  Target: SCN9A; (-) strand; PAM type: NRG; PAM sequence: CAG
taattatattctttactatt

SEQ ID NO: 30773 - DNA, 20 bp, Artificial Sequence
  Description of Artificial Sequence: Synthetic oligonucleotide
  Target: SCN9A; (-) strand; PAM type: NRG; PAM sequence: CAG
taattatattatttactatt

SEQ ID NO: 30774 - DNA, 20 bp, Artificial Sequence
  Description of Artificial Sequence: Synthetic oligonucleotide
  Target: SCN9A; (-) strand; PAM type: NRG; PAM sequence: CAG
taattatattatttactatt

SEQ ID NO: 30775 - DNA, 20 bp, Artificial Sequence
  Description of Artificial Sequence: Synthetic oligonucleotide
  Target: SCN9A; (-) strand; PAM type: NRG; PAM sequence: CAG
attaataattatttactatt

SEQ ID NO: 30776 - DNA, 20 bp, Artificial Sequence
  Description of Artificial Sequence: Synthetic oligonucleotide
  Target: SCN9A; (-) strand; PAM type: NRG; PAM sequence: CAG
aattatattatttaattatt

SEQ ID NO: 30777 - DNA, 20 bp, Artificial Sequence
  Description of Artificial Sequence: Synthetic oligonucleotide
  Target: SCN9A; (-) strand; PAM type: NRG; PAM sequence: TAG
atttatcgttcagaaaatct

SEQ ID NO: 30778 - DNA, 20 bp, Artificial Sequence
  Description of Artificial Sequence: Synthetic oligonucleotide
  Target: SCN9A; (-) strand; PAM type: NRG; PAM sequence: CAG
gcaaatgctaatttatcgtt

SEQ ID NO: 30779 - DNA, 20 bp, Artificial Sequence
  Description of Artificial Sequence: Synthetic oligonucleotide
  Target: SCN9A; (-) strand; PAM type: NRG; PAM sequence: AAG
cagctggtgactttaaattg

SEQ ID NO: 30780 - DNA, 20 bp, Artificial Sequence
  Description of Artificial Sequence: Synthetic oligonucleotide
  Target: SCN9A; (-) strand; PAM type: NRG; PAM sequence: TGG
ttgttaggggataatgcagc

SEQ ID NO: 30781 - DNA, 20 bp, Artificial Sequence
  Description of Artificial Sequence: Synthetic oligonucleotide
  Target: SCN9A; (-) strand; PAM type: NRG; PAM sequence: CAG
tctcttgttaggggataatg

SEQ ID NO: 30782 - DNA, 20 bp, Artificial Sequence
  Description of Artificial Sequence: Synthetic oligonucleotide
  Target: SCN9A; (-) strand; PAM type: NRG; PAM sequence: GGG
caggctgactctcttgttag

SEQ ID NO: 30783 - DNA, 20 bp, Artificial Sequence
  Description of Artificial Sequence: Synthetic oligonucleotide
  Target: SCN9A; (-) strand; PAM type: NRG; PAM sequence: GGG
acaggctgactctcttgtta

SEQ ID NO: 30784 - DNA, 20 bp, Artificial Sequence
  Description of Artificial Sequence: Synthetic oligonucleotide
  Target: SCN9A; (-) strand; PAM type: NRG; PAM sequence: AGG
aacaggctgactctcttgtt

SEQ ID NO: 30785 - DNA, 20 bp, Artificial Sequence
  Description of Artificial Sequence: Synthetic oligonucleotide
  Target: SCN9A; (-) strand; PAM type: NRG; PAM sequence: TAG
gaacaggctgactctcttgt

SEQ ID NO: 30786 - DNA, 20 bp, Artificial Sequence
  Description of Artificial Sequence: Synthetic oligonucleotide
  Target: SCN9A; (-) strand; PAM type: NRG; PAM sequence: AGG
gcttcaaagcttcaacgaac

SEQ ID NO: 30787 - DNA, 20 bp, Artificial Sequence
  Description of Artificial Sequence: Synthetic oligonucleotide
  Target: SCN9A; (-) strand; PAM type: NRG; PAM sequence: CAG
ggcttcaaagcttcaacgaa

SEQ ID NO: 30788 - DNA, 20 bp, Artificial Sequence
  Description of Artificial Sequence: Synthetic oligonucleotide
  Target: SCN9A; (-) strand; PAM type: NRG; PAM sequence: AAG
gaagtcaatgtctggcttca

SEQ ID NO: 30789 - DNA, 20 bp, Artificial Sequence
  Description of Artificial Sequence: Synthetic oligonucleotide
  Target: SCN9A; (-) strand; PAM type: NRG; PAM sequence: TGG
agaaaggagaagtcaatgtc

SEQ ID NO: 30790 - DNA, 20 bp, Artificial Sequence
  Description of Artificial Sequence: Synthetic oligonucleotide
  Target: SCN9A; (-) strand; PAM type: NRG; PAM sequence: AAG
atattatagctagaaaggag

SEQ ID NO: 30791 - DNA, 20 bp, Artificial Sequence
  Description of Artificial Sequence: Synthetic oligonucleotide
  Target: SCN9A; (-) strand; PAM type: NRG; PAM sequence: GAG
aatatattatagctagaaag

SEQ ID NO: 30792 - DNA, 20 bp, Artificial Sequence
  Description of Artificial Sequence: Synthetic oligonucleotide
  Target: SCN9A; (-) strand; PAM type: NRG; PAM sequence: AGG
agaatatattatagctagaa

SEQ ID NO: 30793 - DNA, 20 bp, Artificial Sequence
  Description of Artificial Sequence: Synthetic oligonucleotide
  Target: SCN9A; (-) strand; PAM type: NRG; PAM sequence: AAG
aagaatatattatagctaga

SEQ ID NO: 30794 - DNA, 20 bp, Artificial Sequence
  Description of Artificial Sequence: Synthetic oligonucleotide
  Target: SCN9A; (-) strand; PAM type: NRG; PAM sequence: TAG
ctagaagaatatattatagc

SEQ ID NO: 30795 - DNA, 20 bp, Artificial Sequence
  Description of Artificial Sequence: Synthetic oligonucleotide
  Target: SCN9A; (-) strand; PAM type: NRG; PAM sequence: TAG
tctactagaagaatatatta

SEQ ID NO: 30796 - DNA, 20 bp, Artificial Sequence
  Description of Artificial Sequence: Synthetic oligonucleotide
  Target: SCN9A; (-) strand; PAM type: NRG; PAM sequence: AAG
gtctaacagccttctactag

SEQ ID NO: 30797 - DNA, 20 bp, Artificial Sequence
  Description of Artificial Sequence: Synthetic oligonucleotide
  Target: SCN9A; (-) strand; PAM type: NRG; PAM sequence: TAG
aaggtctaacagccttctac

SEQ ID NO: 30798 - DNA, 20 bp, Artificial Sequence
  Description of Artificial Sequence: Synthetic oligonucleotide
  Target: SCN9A; (-) strand; PAM type: NRG; PAM sequence: CAG
gatttgcaatgaaggtctaa

SEQ ID NO: 30799 - DNA, 20 bp, Artificial Sequence
  Description of Artificial Sequence: Synthetic oligonucleotide
  Target: SCN9A; (-) strand; PAM type: NRG; PAM sequence: AGG
aaacaacagatttgcaatga

SEQ ID NO: 30800 - DNA, 20 bp, Artificial Sequence
  Description of Artificial Sequence: Synthetic oligonucleotide
  Target: SCN9A; (-) strand; PAM type: NRG; PAM sequence: AAG
taaacaacagatttgcaatg

SEQ ID NO: 30801 - DNA, 20 bp, Artificial Sequence
  Description of Artificial Sequence: Synthetic oligonucleotide
  Target: SCN9A; (-) strand; PAM type: NRG; PAM sequence: CAG
agagtggttacattaaacaa

SEQ ID NO: 30802 - DNA, 20 bp, Artificial Sequence
  Description of Artificial Sequence: Synthetic oligonucleotide
  Target: SCN9A; (-) strand; PAM type: NRG; PAM sequence: TGG
gctaagatcattgataagag

SEQ ID NO: 30803 - DNA, 20 bp, Artificial Sequence
  Description of Artificial Sequence: Synthetic oligonucleotide
  Target: SCN9A; (-) strand; PAM type: NRG; PAM sequence: GAG
ctagctaagatcattgataa

SEQ ID NO: 30804 - DNA, 20 bp, Artificial Sequence
  Description of Artificial Sequence: Synthetic oligonucleotide
  Target: SCN9A; (-) strand; PAM type: NRG; PAM sequence: AAG
atctagctaagatcattgat

SEQ ID NO: 30805 - DNA, 20 bp, Artificial Sequence
  Description of Artificial Sequence: Synthetic oligonucleotide
  Target: SCN9A; (-) strand; PAM type: NRG; PAM sequence: AAG
gttattcagaagatctagct

SEQ ID NO: 30806 - DNA, 20 bp, Artificial Sequence
  Description of Artificial Sequence: Synthetic oligonucleotide
  Target: SCN9A; (-) strand; PAM type: NRG; PAM sequence: TAG
agcaagttattcagaagatc

SEQ ID NO: 30807 - DNA, 20 bp, Artificial Sequence
  Description of Artificial Sequence: Synthetic oligonucleotide
  Target: SCN9A; (-) strand; PAM type: NRG; PAM sequence: AAG
agatgcagcaagttattcag

SEQ ID NO: 30808 - DNA, 20 bp, Artificial Sequence
  Description of Artificial Sequence: Synthetic oligonucleotide
  Target: SCN9A; (-) strand; PAM type: NRG; PAM sequence: CAG
agaagatgcagcaagttatt

SEQ ID NO: 30809 - DNA, 20 bp, Artificial Sequence
  Description of Artificial Sequence: Synthetic oligonucleotide
  Target: SCN9A; (-) strand; PAM type: NRG; PAM sequence: AAG
gccaatggagaagatgcagc

SEQ ID NO: 30810 - DNA, 20 bp, Artificial Sequence
  Description of Artificial Sequence: Synthetic oligonucleotide
  Target: SCN9A; (-) strand; PAM type: NRG; PAM sequence: CAG
aagtgccaatggagaagatg

SEQ ID NO: 30811 - DNA, 20 bp, Artificial Sequence
  Description of Artificial Sequence: Synthetic oligonucleotide
  Target: SCN9A; (-) strand; PAM type: NRG; PAM sequence: AAG
aacagcaagtgccaatggag

SEQ ID NO: 30812 - DNA, 20 bp, Artificial Sequence
  Description of Artificial Sequence: Synthetic oligonucleotide
  Target: SCN9A; (-) strand; PAM type: NRG; PAM sequence: GAG
tgaaacagcaagtgccaatg

SEQ ID NO: 30813 - DNA, 20 bp, Artificial Sequence
  Description of Artificial Sequence: Synthetic oligonucleotide
  Target: SCN9A; (-) strand; PAM type: NRG; PAM sequence: TGG
ggtgaaacagcaagtgccaa

SEQ ID NO: 30814 - DNA, 20 bp, Artificial Sequence
  Description of Artificial Sequence: Synthetic oligonucleotide
  Target: SCN9A; (-) strand; PAM type: NRG; PAM sequence: AAG
aaaatgcaaggtgaaacagc

SEQ ID NO: 30815 - DNA, 20 bp, Artificial Sequence
  Description of Artificial Sequence: Synthetic oligonucleotide
  Target: SCN9A; (-) strand; PAM type: NRG; PAM sequence: CAG
cataaaaatgcaaggtgaaa

SEQ ID NO: 30816 - DNA, 20 bp, Artificial Sequence
  Description of Artificial Sequence: Synthetic oligonucleotide
  Target: SCN9A; (-) strand; PAM type: NRG; PAM sequence: AGG
tgccataacataaaaatgca

SEQ ID NO: 30817 - DNA, 20 bp, Artificial Sequence
  Description of Artificial Sequence: Synthetic oligonucleotide
  Target: SCN9A; (-) strand; PAM type: NRG; PAM sequence: AAG
ctgccataacataaaaatgc

SEQ ID NO: 30818 - DNA, 20 bp, Artificial Sequence
  Description of Artificial Sequence: Synthetic oligonucleotide
  Target: SCN9A; (-) strand; PAM type: NRG; PAM sequence: AAG
cccatgagattgaaggaaag

SEQ ID NO: 30819 - DNA, 20 bp, Artificial Sequence
  Description of Artificial Sequence: Synthetic oligonucleotide
  Target: SCN9A; (-) strand; PAM type: NRG; PAM sequence: AAG
taccccatgagattgaagga

SEQ ID NO: 30820 - DNA, 20 bp, Artificial Sequence
  Description of Artificial Sequence: Synthetic oligonucleotide
  Target: SCN9A; (-) strand; PAM type: NRG; PAM sequence: AGG
acggtaccccatgagattga

SEQ ID NO: 30821 - DNA, 20 bp, Artificial Sequence
  Description of Artificial Sequence: Synthetic oligonucleotide
  Target: SCN9A; (-) strand; PAM type: NRG; PAM sequence: AAG
gacggtaccccatgagattg

SEQ ID NO: 30822 - DNA, 20 bp, Artificial Sequence
  Description of Artificial Sequence: Synthetic oligonucleotide
  Target: SCN9A; (-) strand; PAM type: NRG; PAM sequence: GAG
gctggcagacggtaccccat

SEQ ID NO: 30823 - DNA, 20 bp, Artificial Sequence
  Description of Artificial Sequence: Synthetic oligonucleotide
  Target: SCN9A; (-) strand; PAM type: NRG; PAM sequence: CGG
aaaggtttgaagctggcaga

SEQ ID NO: 30824 - DNA, 20 bp, Artificial Sequence
  Description of Artificial Sequence: Synthetic oligonucleotide
  Target: SCN9A; (-) strand; PAM type: NRG; PAM sequence: CAG
aaaaaaaggtttgaagctgg

SEQ ID NO: 30825 - DNA, 20 bp, Artificial Sequence
  Description of Artificial Sequence: Synthetic oligonucleotide
  Target: SCN9A; (-) strand; PAM type: NRG; PAM sequence: TGG
ggaaaaaaaaggtttgaagc

SEQ ID NO: 30826 - DNA, 20 bp, Artificial Sequence
  Description of Artificial Sequence: Synthetic oligonucleotide
  Target: SCN9A; (-) strand; PAM type: NRG; PAM sequence: AAG
agctggaaaaaaaaggtttg

SEQ ID NO: 30827 - DNA, 20 bp, Artificial Sequence
  Description of Artificial Sequence: Synthetic oligonucleotide
  Target: SCN9A; (-) strand; PAM type: NRG; PAM sequence: AGG
gtgaagaagctggaaaaaaa

SEQ ID NO: 30828 - DNA, 20 bp, Artificial Sequence
  Description of Artificial Sequence: Synthetic oligonucleotide
  Target: SCN9A; (-) strand; PAM type: NRG; PAM sequence: AAG
ggtgaagaagctggaaaaaa

SEQ ID NO: 30829 - DNA, 20 bp, Artificial Sequence
  Description of Artificial Sequence: Synthetic oligonucleotide
  Target: SCN9A; (-) strand; PAM type: NRG; PAM sequence: TGG
aggctgagaggtgaagaagc

SEQ ID NO: 30830 - DNA, 20 bp, Artificial Sequence
  Description of Artificial Sequence: Synthetic oligonucleotide
  Target: SCN9A; (-) strand; PAM type: NRG; PAM sequence: AAG
atgaaggctgagaggtgaag

SEQ ID NO: 30831 - DNA, 20 bp, Artificial Sequence
  Description of Artificial Sequence: Synthetic oligonucleotide
  Target: SCN9A; (-) strand; PAM type: NRG; PAM sequence: AAG
tgtatgaaggctgagaggtg

SEQ ID NO: 30832 - DNA, 20 bp, Artificial Sequence
  Description of Artificial Sequence: Synthetic oligonucleotide
  Target: SCN9A; (-) strand; PAM type: NRG; PAM sequence: AGG
ccaattgtatgaaggctgag

SEQ ID NO: 30833 - DNA, 20 bp, Artificial Sequence
  Description of Artificial Sequence: Synthetic oligonucleotide
  Target: SCN9A; (-) strand; PAM type: NRG; PAM sequence: GAG
tccaattgtatgaaggctga

SEQ ID NO: 30834 - DNA, 20 bp, Artificial Sequence
  Description of Artificial Sequence: Synthetic oligonucleotide
  Target: SCN9A; (-) strand; PAM type: NRG; PAM sequence: GAG
actccaattgtatgaaggct

SEQ ID NO: 30835 - DNA, 20 bp, Artificial Sequence
  Description of Artificial Sequence: Synthetic oligonucleotide
  Target: SCN9A; (-) strand; PAM type: NRG; PAM sequence: AGG
ccataactccaattgtatga

SEQ ID NO: 30836 - DNA, 20 bp, Artificial Sequence
  Description of Artificial Sequence: Synthetic oligonucleotide
  Target: SCN9A; (-) strand; PAM type: NRG; PAM sequence: AAG
gccataactccaattgtatg

SEQ ID NO: 30837 - DNA, 20 bp, Artificial Sequence
  Description of Artificial Sequence: Synthetic oligonucleotide
  Target: SCN9A; (-) strand; PAM type: NRG; PAM sequence: AGG
ccaaagcctaatccacagca

SEQ ID NO: 30838 - DNA, 20 bp, Artificial Sequence
  Description of Artificial Sequence: Synthetic oligonucleotide
  Target: SCN9A; (-) strand; PAM type: NRG; PAM sequence: AAG
gccaaagcctaatccacagc

SEQ ID NO: 30839 - DNA, 20 bp, Artificial Sequence
  Description of Artificial Sequence: Synthetic oligonucleotide
  Target: SCN9A; (-) strand; PAM type: NRG; PAM sequence: CAG
ttaagccaaagcctaatcca

SEQ ID NO: 30840 - DNA, 20 bp, Artificial Sequence
  Description of Artificial Sequence: Synthetic oligonucleotide
  Target: SCN9A; (-) strand; PAM type: NRG; PAM sequence: AAG
cacaacatttccttaagcca

SEQ ID NO: 30841 - DNA, 20 bp, Artificial Sequence
  Description of Artificial Sequence: Synthetic oligonucleotide
  Target: SCN9A; (-) strand; PAM type: NRG; PAM sequence: AAG
accagccacaacatttcctt

SEQ ID NO: 30842 - DNA, 20 bp, Artificial Sequence
  Description of Artificial Sequence: Synthetic oligonucleotide
  Target: SCN9A; (-) strand; PAM type: NRG; PAM sequence: CAG
gatctagatagaagatcaac

SEQ ID NO: 30843 - DNA, 20 bp, Artificial Sequence
  Description of Artificial Sequence: Synthetic oligonucleotide
  Target: SCN9A; (-) strand; PAM type: NRG; PAM sequence: AAG
agttttagtgatctagatag

SEQ ID NO: 30844 - DNA, 20 bp, Artificial Sequence
  Description of Artificial Sequence: Synthetic oligonucleotide
  Target: SCN9A; (-) strand; PAM type: NRG; PAM sequence: TAG
gaaagttttagtgatctaga

SEQ ID NO: 30845 - DNA, 20 bp, Artificial Sequence
  Description of Artificial Sequence: Synthetic oligonucleotide
  Target: SCN9A; (-) strand; PAM type: NRG; PAM sequence: TAG
tagagaaagttttagtgatc

SEQ ID NO: 30846 - DNA, 20 bp, Artificial Sequence
  Description of Artificial Sequence: Synthetic oligonucleotide
  Target: SCN9A; (-) strand; PAM type: NRG; PAM sequence: TAG
tgcaaatatagagaaagttt

SEQ ID NO: 30847 - DNA, 20 bp, Artificial Sequence
  Description of Artificial Sequence: Synthetic oligonucleotide
  Target: SCN9A; (-) strand; PAM type: NRG; PAM sequence: AAG
ccttattgcaaatatagaga

SEQ ID NO: 30848 - DNA, 20 bp, Artificial Sequence
  Description of Artificial Sequence: Synthetic oligonucleotide
  Target: SCN9A; (-) strand; PAM type: NRG; PAM sequence: GAG
acagccttattgcaaatata

SEQ ID NO: 30849 - DNA, 20 bp, Artificial Sequence
  Description of Artificial Sequence: Synthetic oligonucleotide
  Target: SCN9A; (-) strand; PAM type: NRG; PAM sequence: TAG
aaacagccttattgcaaata

SEQ ID NO: 30850 - DNA, 20 bp, Artificial Sequence
  Description of Artificial Sequence: Synthetic oligonucleotide
  Target: SCN9A; (-) strand; PAM type: NRG; PAM sequence: CAG
tgaatgataagaaaacaaaa

SEQ ID NO: 30851 - DNA, 20 bp, Artificial Sequence
  Description of Artificial Sequence: Synthetic oligonucleotide
  Target: SCN9A; (-) strand; PAM type: NRG; PAM sequence: AAG
ccagtgaacacatgaatgat

SEQ ID NO: 30852 - DNA, 20 bp, Artificial Sequence
  Description of Artificial Sequence: Synthetic oligonucleotide
  Target: SCN9A; (-) strand; PAM type: NRG; PAM sequence: CAG
ggaaatcaaatgtgctactc

SEQ ID NO: 30853 - DNA, 20 bp, Artificial Sequence
  Description of Artificial Sequence: Synthetic oligonucleotide
  Target: SCN9A; (-) strand; PAM type: NRG; PAM sequence: AGG
tgcaaaggaaacattcttga

SEQ ID NO: 30854 - DNA, 20 bp, Artificial Sequence
  Description of Artificial Sequence: Synthetic oligonucleotide
  Target: SCN9A; (-) strand; PAM type: NRG; PAM sequence: AAG
atgcaaaggaaacattcttg

SEQ ID NO: 30855 - DNA, 20 bp, Artificial Sequence
  Description of Artificial Sequence: Synthetic oligonucleotide
  Target: SCN9A; (-) strand; PAM type: NRG; PAM sequence: AGG
tagccaagttgtgaatgcaa

SEQ ID NO: 30856 - DNA, 20 bp, Artificial Sequence
  Description of Artificial Sequence: Synthetic oligonucleotide
  Target: SCN9A; (-) strand; PAM type: NRG; PAM sequence: AAG
ttagccaagttgtgaatgca

SEQ ID NO: 30857 - DNA, 20 bp, Artificial Sequence
  Description of Artificial Sequence: Synthetic oligonucleotide
  Target: SCN9A; (-) strand; PAM type: NRG; PAM sequence: AAG
cttgcactaagtacttagcc

SEQ ID NO: 30858 - DNA, 20 bp, Artificial Sequence
  Description of Artificial Sequence: Synthetic oligonucleotide
  Target: SCN9A; (-) strand; PAM type: NRG; PAM sequence: TAG
ggcctcttgcactaagtact

SEQ ID NO: 30859 - DNA, 20 bp, Artificial Sequence
  Description of Artificial Sequence: Synthetic oligonucleotide
  Target: SCN9A; (-) strand; PAM type: NRG; PAM sequence: AAG
aaatctaggcctcttgcact

SEQ ID NO: 30860 - DNA, 20 bp, Artificial Sequence
  Description of Artificial Sequence: Synthetic oligonucleotide
  Target: SCN9A; (-) strand; PAM type: NRG; PAM sequence: AGG
gccaagataggccaaaatct

SEQ ID NO: 30861 - DNA, 20 bp, Artificial Sequence
  Description of Artificial Sequence: Synthetic oligonucleotide
  Target: SCN9A; (-) strand; PAM type: NRG; PAM sequence: TAG
agccaagataggccaaaatc

SEQ ID NO: 30862 - DNA, 20 bp, Artificial Sequence
  Description of Artificial Sequence: Synthetic oligonucleotide
  Target: SCN9A; (-) strand; PAM type: NRG; PAM sequence: AGG
ggcatgttgaaagccaagat

SEQ ID NO: 30863 - DNA, 20 bp, Artificial Sequence
  Description of Artificial Sequence: Synthetic oligonucleotide
  Target: SCN9A; (-) strand; PAM type: NRG; PAM sequence: TAG
aggcatgttgaaagccaaga

SEQ ID NO: 30864 - DNA, 20 bp, Artificial Sequence
  Description of Artificial Sequence: Synthetic oligonucleotide
  Target: SCN9A; (-) strand; PAM type: NRG; PAM sequence: AAG
aggaaggcatgttgaaagcc

SEQ ID NO: 30865 - DNA, 20 bp, Artificial Sequence
  Description of Artificial Sequence: Synthetic oligonucleotide
  Target: SCN9A; (-) strand; PAM type: NRG; PAM sequence: AAG
tagtgaggaaggcatgttga

SEQ ID NO: 30866 - DNA, 20 bp, Artificial Sequence
  Description of Artificial Sequence: Synthetic oligonucleotide
  Target: SCN9A; (-) strand; PAM type: NRG; PAM sequence: AGG
atgattaagcttagtgagga

SEQ ID NO: 30867 - DNA, 20 bp, Artificial Sequence
  Description of Artificial Sequence: Synthetic oligonucleotide
  Target: SCN9A; (-) strand; PAM type: NRG; PAM sequence: AAG
aatgattaagcttagtgagg

SEQ ID NO: 30868 - DNA, 20 bp, Artificial Sequence
  Description of Artificial Sequence: Synthetic oligonucleotide
  Target: SCN9A; (-) strand; PAM type: NRG; PAM sequence: AGG
agaaatgattaagcttagtg

SEQ ID NO: 30869 - DNA, 20 bp, Artificial Sequence
  Description of Artificial Sequence: Synthetic oligonucleotide
  Target: SCN9A; (-) strand; PAM type: NRG; PAM sequence: GAG
tagaaatgattaagcttagt

SEQ ID NO: 30870 - DNA, 20 bp, Artificial Sequence
  Description of Artificial Sequence: Synthetic oligonucleotide
  Target: SCN9A; (-) strand; PAM type: NRG; PAM sequence: TAG
aagctagaaatgattaagct

SEQ ID NO: 30871 - DNA, 20 bp, Artificial Sequence
  Description of Artificial Sequence: Synthetic oligonucleotide
  Target: SCN9A; (-) strand; PAM type: NRG; PAM sequence: AAG
atcagaagctagaaatgatt

SEQ ID NO: 30872 - DNA, 20 bp, Artificial Sequence
  Description of Artificial Sequence: Synthetic oligonucleotide
  Target: SCN9A; (-) strand; PAM type: NRG; PAM sequence: TAG
tctcactttaaatcagaagc

SEQ ID NO: 30873 - DNA, 20 bp, Artificial Sequence
  Description of Artificial Sequence: Synthetic oligonucleotide
  Target: SCN9A; (-) strand; PAM type: NRG; PAM sequence: AAG
catttctcactttaaatcag

SEQ ID NO: 30874 - DNA, 20 bp, Artificial Sequence
  Description of Artificial Sequence: Synthetic oligonucleotide
  Target: SCN9A; (-) strand; PAM type: NRG; PAM sequence: CAG
gcgcatttctcactttaaat

SEQ ID NO: 30875 - DNA, 20 bp, Artificial Sequence
  Description of Artificial Sequence: Synthetic oligonucleotide
  Target: SCN9A; (-) strand; PAM type: NRG; PAM sequence: AAG
ccctaatgttcaagtaaagg

SEQ ID NO: 30876 - DNA, 20 bp, Artificial Sequence
  Description of Artificial Sequence: Synthetic oligonucleotide
  Target: SCN9A; (-) strand; PAM type: NRG; PAM sequence: AGG
cacccctaatgttcaagtaa

SEQ ID NO: 30877 - DNA, 20 bp, Artificial Sequence
  Description of Artificial Sequence: Synthetic oligonucleotide
  Target: SCN9A; (-) strand; PAM type: NRG; PAM sequence: AAG
ccacccctaatgttcaagta

SEQ ID NO: 30878 - DNA, 20 bp, Artificial Sequence
  Description of Artificial Sequence: Synthetic oligonucleotide
  Target: SCN9A; (-) strand; PAM type: NRG; PAM sequence: AAG
cattcccacccctaatgttc

SEQ ID NO: 30879 - DNA, 20 bp, Artificial Sequence
  Description of Artificial Sequence: Synthetic oligonucleotide
  Target: SCN9A; (-) strand; PAM type: NRG; PAM sequence: TAG
gatgttaaaattaggccaat

SEQ ID NO: 30880 - DNA, 20 bp, Artificial Sequence
  Description of Artificial Sequence: Synthetic oligonucleotide
  Target: SCN9A; (-) strand; PAM type: NRG; PAM sequence: AGG
cacacaacgatgttaaaatt

SEQ ID NO: 30881 - DNA, 20 bp, Artificial Sequence
  Description of Artificial Sequence: Synthetic oligonucleotide
  Target: SCN9A; (-) strand; PAM type: NRG; PAM sequence: TAG
acacacaacgatgttaaaat

SEQ ID NO: 30882 - DNA, 20 bp, Artificial Sequence
  Description of Artificial Sequence: Synthetic oligonucleotide
  Target: SCN9A; (-) strand; PAM type: NRG; PAM sequence: AGG
ctatctctctccctttcctc

SEQ ID NO: 30883 - DNA, 20 bp, Artificial Sequence
  Description of Artificial Sequence: Synthetic oligonucleotide
  Target: SCN9A; (-) strand; PAM type: NRG; PAM sequence: CAG
cctatctctctccctttcct

SEQ ID NO: 30884 - DNA, 20 bp, Artificial Sequence
  Description of Artificial Sequence: Synthetic oligonucleotide
  Target: SCN9A; (-) strand; PAM type: NRG; PAM sequence: CAG
aaatgtgacgtgttctgttt

SEQ ID NO: 30885 - DNA, 20 bp, Artificial Sequence
  Description of Artificial Sequence: Synthetic oligonucleotide
  Target: SCN9A; (-) strand; PAM type: NRG; PAM sequence: CAG
tgaaccacatccacataaga

SEQ ID NO: 30886 - DNA, 20 bp, Artificial Sequence
  Description of Artificial Sequence: Synthetic oligonucleotide
  Target: SCN9A; (-) strand; PAM type: NRG; PAM sequence: AAG
gctatgaaccacatccacat

SEQ ID NO: 30887 - DNA, 20 bp, Artificial Sequence
  Description of Artificial Sequence: Synthetic oligonucleotide
  Target: SCN9A; (-) strand; PAM type: NRG; PAM sequence: GGG
ttactgtggtaattgttttg

SEQ ID NO: 30888 - DNA, 20 bp, Artificial Sequence
  Description of Artificial Sequence: Synthetic oligonucleotide
  Target: SCN9A; (-) strand; PAM type: NRG; PAM sequence: GGG
gttactgtggtaattgtttt

SEQ ID NO: 30889 - DNA, 20 bp, Artificial Sequence
  Description of Artificial Sequence: Synthetic oligonucleotide
  Target: SCN9A; (-) strand; PAM type: NRG; PAM sequence: TGG
tgttactgtggtaattgttt

SEQ ID NO: 30890 - DNA, 20 bp, Artificial Sequence
  Description of Artificial Sequence: Synthetic oligonucleotide
  Target: SCN9A; (-) strand; PAM type: NRG; PAM sequence: TGG
agtgatctttgttgttactg

SEQ ID NO: 30891 - DNA, 20 bp, Artificial Sequence
  Description of Artificial Sequence: Synthetic oligonucleotide
  Target: SCN9A; (-) strand; PAM type: NRG; PAM sequence: CAG
gtgttatggtgatctatgat

SEQ ID NO: 30892 - DNA, 20 bp, Artificial Sequence
  Description of Artificial Sequence: Synthetic oligonucleotide
  Target: SCN9A; (-) strand; PAM type: NRG; PAM sequence: TGG
aattattactgtatgtgtta

SEQ ID NO: 30893 - DNA, 20 bp, Artificial Sequence
  Description of Artificial Sequence: Synthetic oligonucleotide
  Target: SCN9A; (-) strand; PAM type: NRG; PAM sequence: TGG
catgcatctgtgtcacactt

SEQ ID NO: 30894 - DNA, 20 bp, Artificial Sequence
  Description of Artificial Sequence: Synthetic oligonucleotide
  Target: SCN9A; (-) strand; PAM type: NRG; PAM sequence: CAG
tgtcagcgtaattttttcaa

SEQ ID NO: 30895 - DNA, 20 bp, Artificial Sequence
  Description of Artificial Sequence: Synthetic oligonucleotide
  Target: SCN9A; (-) strand; PAM type: NRG; PAM sequence: CAG
cctgcattaagcaagtctgt

SEQ ID NO: 30896 - DNA, 20 bp, Artificial Sequence
  Description of Artificial Sequence: Synthetic oligonucleotide
  Target: SCN9A; (-) strand; PAM type: NRG; PAM sequence: AAG
gtggcaaccctgcattaagc

SEQ ID NO: 30897 - DNA, 20 bp, Artificial Sequence
  Description of Artificial Sequence: Synthetic oligonucleotide
  Target: SCN9A; (-) strand; PAM type: NRG; PAM sequence: AAG
gtttgtggcaaccctgcatt

SEQ ID NO: 30898 - DNA, 20 bp, Artificial Sequence
  Description of Artificial Sequence: Synthetic oligonucleotide
  Target: SCN9A; (-) strand; PAM type: NRG; PAM sequence: TGG
ctttacaagttgaaggtttg

SEQ ID NO: 30899 - DNA, 20 bp, Artificial Sequence
  Description of Artificial Sequence: Synthetic oligonucleotide
  Target: SCN9A; (-) strand; PAM type: NRG; PAM sequence: AGG
ctgcattctttacaagttga

SEQ ID NO: 30900 - DNA, 20 bp, Artificial Sequence
  Description of Artificial Sequence: Synthetic oligonucleotide
  Target: SCN9A; (-) strand; PAM type: NRG; PAM sequence: AAG
actgcattctttacaagttg

SEQ ID NO: 30901 - DNA, 20 bp, Artificial Sequence
  Description of Artificial Sequence: Synthetic oligonucleotide
  Target: SCN9A; (-) strand; PAM type: NRG; PAM sequence: AAG
caagatactgcattctttac

SEQ ID NO: 30902 - DNA, 20 bp, Artificial Sequence
  Description of Artificial Sequence: Synthetic oligonucleotide
  Target: SCN9A; (-) strand; PAM type: NRG; PAM sequence: AAG
gctttactttattgcacttc

SEQ ID NO: 30903 - DNA, 20 bp, Artificial Sequence
  Description of Artificial Sequence: Synthetic oligonucleotide
  Target: SCN9A; (-) strand; PAM type: NRG; PAM sequence: GGG
caggcatacttcattttatg

SEQ ID NO: 30904 - DNA, 20 bp, Artificial Sequence
  Description of Artificial Sequence: Synthetic oligonucleotide
  Target: SCN9A; (-) strand; PAM type: NRG; PAM sequence: GGG
acaggcatacttcattttat

SEQ ID NO: 30905 - DNA, 20 bp, Artificial Sequence
  Description of Artificial Sequence: Synthetic oligonucleotide
  Target: SCN9A; (-) strand; PAM type: NRG; PAM sequence: TGG
tacaggcatacttcatttta

SEQ ID NO: 30906 - DNA, 20 bp, Artificial Sequence
  Description of Artificial Sequence: Synthetic oligonucleotide
  Target: SCN9A; (-) strand; PAM type: NRG; PAM sequence: AGG
tttggtttccatcaaaatac

SEQ ID NO: 30907 - DNA, 20 bp, Artificial Sequence
  Description of Artificial Sequence: Synthetic oligonucleotide
  Target: SCN9A; (-) strand; PAM type: NRG; PAM sequence: CAG
ctttggtttccatcaaaata

SEQ ID NO: 30908 - DNA, 20 bp, Artificial Sequence
  Description of Artificial Sequence: Synthetic oligonucleotide
  Target: SCN9A; (-) strand; PAM type: NRG; PAM sequence: TGG
aaaaacctttatcctaactt

SEQ ID NO: 30909 - DNA, 20 bp, Artificial Sequence
  Description of Artificial Sequence: Synthetic oligonucleotide
  Target: SCN9A; (-) strand; PAM type: NRG; PAM sequence: CAG
ataacttactctttaccttt

SEQ ID NO: 30910 - DNA, 20 bp, Artificial Sequence
  Description of Artificial Sequence: Synthetic oligonucleotide
  Target: SCN9A; (-) strand; PAM type: NRG; PAM sequence: GAG
taccaagtagtggaattgcc

SEQ ID NO: 30911 - DNA, 20 bp, Artificial Sequence
  Description of Artificial Sequence: Synthetic oligonucleotide
  Target: SCN9A; (-) strand; PAM type: NRG; PAM sequence: TGG
cttgagtctgtaccaagtag

SEQ ID NO: 30912 - DNA, 20 bp, Artificial Sequence
  Description of Artificial Sequence: Synthetic oligonucleotide
  Target: SCN9A; (-) strand; PAM type: NRG; PAM sequence: TAG
tcccttgagtctgtaccaag

SEQ ID NO: 30913 - DNA, 20 bp, Artificial Sequence
  Description of Artificial Sequence: Synthetic oligonucleotide
  Target: SCN9A; (-) strand; PAM type: NRG; PAM sequence: AAG
aattcccttgagtctgtacc

SEQ ID NO: 30914 - DNA, 20 bp, Artificial Sequence
  Description of Artificial Sequence: Synthetic oligonucleotide
  Target: SCN9A; (-) strand; PAM type: NRG; PAM sequence: GAG
catatgttttaaattccctt

SEQ ID NO: 30915 - DNA, 20 bp, Artificial Sequence
  Description of Artificial Sequence: Synthetic oligonucleotide
  Target: SCN9A; (-) strand; PAM type: NRG; PAM sequence: TGG
ttcatgtaaacgttcttgtg

SEQ ID NO: 30916 - DNA, 20 bp, Artificial Sequence
  Description of Artificial Sequence: Synthetic oligonucleotide
  Target: SCN9A; (-) strand; PAM type: NRG; PAM sequence: TAG
ggttgtgtttactttttggc

SEQ ID NO: 30917 - DNA, 20 bp, Artificial Sequence
  Description of Artificial Sequence: Synthetic oligonucleotide
  Target: SCN9A; (-) strand; PAM type: NRG; PAM sequence: TGG
atgaggttgtgtttactttt

SEQ ID NO: 30918 - DNA, 20 bp, Artificial Sequence
  Description of Artificial Sequence: Synthetic oligonucleotide
  Target: SCN9A; (-) strand; PAM type: NRG; PAM sequence: AGG
ttattcattggtgagtaatg

SEQ ID NO: 30919 - DNA, 20 bp, Artificial Sequence
  Description of Artificial Sequence: Synthetic oligonucleotide
  Target: SCN9A; (-) strand; PAM type: NRG; PAM sequence: GAG
tttattcattggtgagtaat

SEQ ID NO: 30920 - DNA, 20 bp, Artificial Sequence
  Description of Artificial Sequence: Synthetic oligonucleotide
  Target: SCN9A; (-) strand; PAM type: NRG; PAM sequence: GAG
ttatccatttattcattggt

SEQ ID NO: 30921 - DNA, 20 bp, Artificial Sequence
  Description of Artificial Sequence: Synthetic oligonucleotide
  Target: SCN9A; (-) strand; PAM type: NRG; PAM sequence: TGG
tcctttatccatttattcat

SEQ ID NO: 30922 - DNA, 20 bp, Artificial Sequence
  Description of Artificial Sequence: Synthetic oligonucleotide
  Target: SCN9A; (-) strand; PAM type: NRG; PAM sequence: CAG
tttattgctaaatactaatt

SEQ ID NO: 30923 - DNA, 20 bp, Artificial Sequence
  Description of Artificial Sequence: Synthetic oligonucleotide
  Target: SCN9A; (-) strand; PAM type: NRG; PAM sequence: GGG
tggctctgtgttctttcacg

SEQ ID NO: 30924 - DNA, 20 bp, Artificial Sequence
  Description of Artificial Sequence: Synthetic oligonucleotide
  Target: SCN9A; (-) strand; PAM type: NRG; PAM sequence: GGG
ttggctctgtgttctttcac

SEQ ID NO: 30925 - DNA, 20 bp, Artificial Sequence
  Description of Artificial Sequence: Synthetic oligonucleotide
  Target: SCN9A; (-) strand; PAM type: NRG; PAM sequence: CGG
tttggctctgtgttctttca

SEQ ID NO: 30926 - DNA, 20 bp, Artificial Sequence
  Description of Artificial Sequence: Synthetic oligonucleotide
  Target: SCN9A; (-) strand; PAM type: NRG; PAM sequence: TGG
tcatatcgtatgtggccttt

SEQ ID NO: 30927 - DNA, 20 bp, Artificial Sequence
  Description of Artificial Sequence: Synthetic oligonucleotide
  Target: SCN9A; (-) strand; PAM type: NRG; PAM sequence: TGG
agatggaatcatatcgtatg

SEQ ID NO: 30928 - DNA, 20 bp, Artificial Sequence
  Description of Artificial Sequence: Synthetic oligonucleotide
  Target: SCN9A; (-) strand; PAM type: NRG; PAM sequence: TGG
attctggacatttcataaga

SEQ ID NO: 30929 - DNA, 20 bp, Artificial Sequence
  Description of Artificial Sequence: Synthetic oligonucleotide
  Target: SCN9A; (-) strand; PAM type: NRG; PAM sequence: AAG
gcctattctggacatttcat

SEQ ID NO: 30930 - DNA, 20 bp, Artificial Sequence
  Description of Artificial Sequence: Synthetic oligonucleotide
  Target: SCN9A; (-) strand; PAM type: NRG; PAM sequence: TGG
ttctggggatttgcctattc

SEQ ID NO: 30931 - DNA, 20 bp, Artificial Sequence
  Description of Artificial Sequence: Synthetic oligonucleotide
  Target: SCN9A; (-) strand; PAM type: NRG; PAM sequence: GGG
tactctacattttgtttctg

SEQ ID NO: 30932 - DNA, 20 bp, Artificial Sequence
  Description of Artificial Sequence: Synthetic oligonucleotide
  Target: SCN9A; (-) strand; PAM type: NRG; PAM sequence: GGG
atactctacattttgtttct

SEQ ID NO: 30933 - DNA, 20 bp, Artificial Sequence
  Description of Artificial Sequence: Synthetic oligonucleotide
  Target: SCN9A; (-) strand; PAM type: NRG; PAM sequence: TGG
aatactctacattttgtttc

SEQ ID NO: 30934 - DNA, 20 bp, Artificial Sequence
  Description of Artificial Sequence: Synthetic oligonucleotide
  Target: SCN9A; (-) strand; PAM type: NRG; PAM sequence: CAG
taatcacttcctattacacc

SEQ ID NO: 30935 - DNA, 20 bp, Artificial Sequence
  Description of Artificial Sequence: Synthetic oligonucleotide
  Target: SCN9A; (-) strand; PAM type: NRG; PAM sequence: AAG
tatttttatcaccccaaaag

SEQ ID NO: 30936 - DNA, 20 bp, Artificial Sequence
  Description of Artificial Sequence: Synthetic oligonucleotide
  Target: SCN9A; (-) strand; PAM type: NRG; PAM sequence: AAG
gaatatttttatcaccccaa

SEQ ID NO: 30937 - DNA, 20 bp, Artificial Sequence
  Description of Artificial Sequence: Synthetic oligonucleotide
  Target: SCN9A; (-) strand; PAM type: NRG; PAM sequence: TAG
caatcatcattatgtagttt

SEQ ID NO: 30938 - DNA, 20 bp, Artificial Sequence
  Description of Artificial Sequence: Synthetic oligonucleotide
  Target: SCN9A; (-) strand; PAM type: NRG; PAM sequence: TAG
atgcaacaatcatcattatg

SEQ ID NO: 30939 - DNA, 20 bp, Artificial Sequence
  Description of Artificial Sequence: Synthetic oligonucleotide
  Target: SCN9A; (-) strand; PAM type: NRG; PAM sequence: AGG
ggtttttagtatgttcacaa

SEQ ID NO: 30940 - DNA, 20 bp, Artificial Sequence
  Description of Artificial Sequence: Synthetic oligonucleotide
  Target: SCN9A; (-) strand; PAM type: NRG; PAM sequence: AAG
tggtttttagtatgttcaca

SEQ ID NO: 30941 - DNA, 20 bp, Artificial Sequence
  Description of Artificial Sequence: Synthetic oligonucleotide
  Target: SCN9A; (-) strand; PAM type: NRG; PAM sequence: TAG
gtgtatcactcagtggtttt

SEQ ID NO: 30942 - DNA, 20 bp, Artificial Sequence
  Description of Artificial Sequence: Synthetic oligonucleotide
  Target: SCN9A; (-) strand; PAM type: NRG; PAM sequence: TGG
ttttaaagtgtatcactcag

SEQ ID NO: 30943 - DNA, 20 bp, Artificial Sequence
  Description of Artificial Sequence: Synthetic oligonucleotide
  Target: SCN9A; (-) strand; PAM type: NRG; PAM sequence: CAG
ccattttaaagtgtatcact

SEQ ID NO: 30944 - DNA, 20 bp, Artificial Sequence
  Description of Artificial Sequence: Synthetic oligonucleotide
  Target: SCN9A; (-) strand; PAM type: NRG; PAM sequence: AAG
cataaaaaatcaccatttta

SEQ ID NO: 30945 - DNA, 20 bp, Artificial Sequence
  Description of Artificial Sequence: Synthetic oligonucleotide
  Target: SCN9A; (-) strand; PAM type: NRG; PAM sequence: AAG
atattcatagtagttttatt

SEQ ID NO: 30946 - DNA, 20 bp, Artificial Sequence
  Description of Artificial Sequence: Synthetic oligonucleotide
  Target: SCN9A; (-) strand; PAM type: NRG; PAM sequence: TAG
ttcttaatgcatattcatag

SEQ ID NO: 30947 - DNA, 20 bp, Artificial Sequence
  Description of Artificial Sequence: Synthetic oligonucleotide
  Target: SCN9A; (-) strand; PAM type: NRG; PAM sequence: TAG
aaattcttaatgcatattca

SEQ ID NO: 30948 - DNA, 20 bp, Artificial Sequence
  Description of Artificial Sequence: Synthetic oligonucleotide
  Target: SCN9A; (-) strand; PAM type: NRG; PAM sequence: AGG
ggacaattttcacatatttt

SEQ ID NO: 30949 - DNA, 20 bp, Artificial Sequence
  Description of Artificial Sequence: Synthetic oligonucleotide
  Target: SCN9A; (-) strand; PAM type: NRG; PAM sequence: TAG
aggacaattttcacatattt

SEQ ID NO: 30950 - DNA, 20 bp, Artificial Sequence
  Description of Artificial Sequence: Synthetic oligonucleotide
  Target: SCN9A; (-) strand; PAM type: NRG; PAM sequence: AGG
ctaaatctcttcctattctg

SEQ ID NO: 30951 - DNA, 20 bp, Artificial Sequence
  Description of Artificial Sequence: Synthetic oligonucleotide
  Target: SCN9A; (-) strand; PAM type: NRG; PAM sequence: GAG
actaaatctcttcctattct

SEQ ID NO: 30952 - DNA, 20 bp, Artificial Sequence
  Description of Artificial Sequence: Synthetic oligonucleotide
  Target: SCN9A; (-) strand; PAM type: NRG; PAM sequence: TGG
aggaatctccaaagcacaag

SEQ ID NO: 30953 - DNA, 20 bp, Artificial Sequence
  Description of Artificial Sequence: Synthetic oligonucleotide
  Target: SCN9A; (-) strand; PAM type: NRG; PAM sequence: AAG
ttgaggaatctccaaagcac

SEQ ID NO: 30954 - DNA, 20 bp, Artificial Sequence
  Description of Artificial Sequence: Synthetic oligonucleotide
  Target: SCN9A; (-) strand; PAM type: NRG; PAM sequence: AAG
aaagtgttgaggaatctcca

SEQ ID NO: 30955 - DNA, 20 bp, Artificial Sequence
  Description of Artificial Sequence: Synthetic oligonucleotide
  Target: SCN9A; (-) strand; PAM type: NRG; PAM sequence: AGG
tatgatttccaaaagtgttg

SEQ ID NO: 30956 - DNA, 20 bp, Artificial Sequence
  Description of Artificial Sequence: Synthetic oligonucleotide
  Target: SCN9A; (-) strand; PAM type: NRG; PAM sequence: GAG
ttatgatttccaaaagtgtt

SEQ ID NO: 30957 - DNA, 20 bp, Artificial Sequence
  Description of Artificial Sequence: Synthetic oligonucleotide
  Target: SCN9A; (-) strand; PAM type: NRG; PAM sequence: AAG
ctcacctttatgatttccaa

SEQ ID NO: 30958 - DNA, 20 bp, Artificial Sequence
  Description of Artificial Sequence: Synthetic oligonucleotide
  Target: SCN9A; (-) strand; PAM type: NRG; PAM sequence: AAG
cactgaaagtctagtgaggc

SEQ ID NO: 30959 - DNA, 20 bp, Artificial Sequence
  Description of Artificial Sequence: Synthetic oligonucleotide
  Target: SCN9A; (-) strand; PAM type: NRG; PAM sequence: AGG
tctacactgaaagtctagtg

SEQ ID NO: 30960 - DNA, 20 bp, Artificial Sequence
  Description of Artificial Sequence: Synthetic oligonucleotide
  Target: SCN9A; (-) strand; PAM type: NRG; PAM sequence: GAG
gtctacactgaaagtctagt

SEQ ID NO: 30961 - DNA, 20 bp, Artificial Sequence
  Description of Artificial Sequence: Synthetic oligonucleotide
  Target: SCN9A; (-) strand; PAM type: NRG; PAM sequence: TAG
gtatgtctacactgaaagtc

SEQ ID NO: 30962 - DNA, 20 bp, Artificial Sequence
  Description of Artificial Sequence: Synthetic oligonucleotide
  Target: SCN9A; (-) strand; PAM type: NRG; PAM sequence: AAG
ccacagtatgtctacactga

SEQ ID NO: 30963 - DNA, 20 bp, Artificial Sequence
  Description of Artificial Sequence: Synthetic oligonucleotide
  Target: SCN9A; (-) strand; PAM type: NRG; PAM sequence: CAG
caacttttcttcaagagcca

SEQ ID NO: 30964 - DNA, 20 bp, Artificial Sequence
  Description of Artificial Sequence: Synthetic oligonucleotide
  Target: SCN9A; (-) strand; PAM type: NRG; PAM sequence: GAG
tcaagccaacttttcttcaa

SEQ ID NO: 30965 - DNA, 20 bp, Artificial Sequence
  Description of Artificial Sequence: Synthetic oligonucleotide
  Target: SCN9A; (-) strand; PAM type: NRG; PAM sequence: AAG
attcaagccaacttttcttc

SEQ ID NO: 30966 - DNA, 20 bp, Artificial Sequence
  Description of Artificial Sequence: Synthetic oligonucleotide
  Target: SCN9A; (-) strand; PAM type: NRG; PAM sequence: AAG
tacaaaaacaccagttattc

SEQ ID NO: 30967 - DNA, 20 bp, Artificial Sequence
  Description of Artificial Sequence: Synthetic oligonucleotide
  Target: SCN9A; (-) strand; PAM type: NRG; PAM sequence: CAG
tgtagaatctacaaaaacac

SEQ ID NO: 30968 - DNA, 20 bp, Artificial Sequence
  Description of Artificial Sequence: Synthetic oligonucleotide
  Target: SCN9A; (-) strand; PAM type: NRG; PAM sequence: TAG
tggtaccctccagttgaatg

SEQ ID NO: 30969 - DNA, 20 bp, Artificial Sequence
  Description of Artificial Sequence: Synthetic oligonucleotide
  Target: SCN9A; (-) strand; PAM type: NRG; PAM sequence: CAG
ttgaaagagatggtaccctc

SEQ ID NO: 30970 - DNA, 20 bp, Artificial Sequence
  Description of Artificial Sequence: Synthetic oligonucleotide
  Target: SCN9A; (-) strand; PAM type: NRG; PAM sequence: TGG
caaataattcttgaaagaga

SEQ ID NO: 30971 - DNA, 20 bp, Artificial Sequence
  Description of Artificial Sequence: Synthetic oligonucleotide
  Target: SCN9A; (-) strand; PAM type: NRG; PAM sequence: GAG
ctgtcaaataattcttgaaa

SEQ ID NO: 30972 - DNA, 20 bp, Artificial Sequence
  Description of Artificial Sequence: Synthetic oligonucleotide
  Target: SCN9A; (-) strand; PAM type: NRG; PAM sequence: AAG
ttctgtcaaataattcttga

SEQ ID NO: 30973 - DNA, 20 bp, Artificial Sequence
  Description of Artificial Sequence: Synthetic oligonucleotide
  Target: SCN9A; (-) strand; PAM type: NRG; PAM sequence: TAG
gttcacaacatctttgtacc

SEQ ID NO: 30974 - DNA, 20 bp, Artificial Sequence
  Description of Artificial Sequence: Synthetic oligonucleotide
  Target: SCN9A; (-) strand; PAM type: NRG; PAM sequence: GAG
caaactggtaatggacatct

SEQ ID NO: 30975 - DNA, 20 bp, Artificial Sequence
  Description of Artificial Sequence: Synthetic oligonucleotide
  Target: SCN9A; (-) strand; PAM type: NRG; PAM sequence: TGG
tggaagaatcaaactggtaa

SEQ ID NO: 30976 - DNA, 20 bp, Artificial Sequence
  Description of Artificial Sequence: Synthetic oligonucleotide
  Target: SCN9A; (-) strand; PAM type: NRG; PAM sequence: TGG
gaatattggaagaatcaaac

SEQ ID NO: 30977 - DNA, 20 bp, Artificial Sequence
  Description of Artificial Sequence: Synthetic oligonucleotide
  Target: SCN9A; (-) strand; PAM type: NRG; PAM sequence: AAG
gaggagaataggaatattgg

SEQ ID NO: 30978 - DNA, 20 bp, Artificial Sequence
  Description of Artificial Sequence: Synthetic oligonucleotide
  Target: SCN9A; (-) strand; PAM type: NRG; PAM sequence: TGG
acagaggagaataggaatat

SEQ ID NO: 30979 - DNA, 20 bp, Artificial Sequence
  Description of Artificial Sequence: Synthetic oligonucleotide
  Target: SCN9A; (-) strand; PAM type: NRG; PAM sequence: AGG
agacagagacagaggagaat

SEQ ID NO: 30980 - DNA, 20 bp, Artificial Sequence
  Description of Artificial Sequence: Synthetic oligonucleotide
  Target: SCN9A; (-) strand; PAM type: NRG; PAM sequence: TAG
gagacagagacagaggagaa

SEQ ID NO: 30981 - DNA, 20 bp, Artificial Sequence
  Description of Artificial Sequence: Synthetic oligonucleotide
  Target: SCN9A; (-) strand; PAM type: NRG; PAM sequence: GAG
tgggggagacagagacagag

SEQ ID NO: 30982 - DNA, 20 bp, Artificial Sequence
  Description of Artificial Sequence: Synthetic oligonucleotide
  Target: SCN9A; (-) strand; PAM type: NRG; PAM sequence: AGG
gttgggggagacagagacag

SEQ ID NO: 30983 - DNA, 20 bp, Artificial Sequence
  Description of Artificial Sequence: Synthetic oligonucleotide
  Target: SCN9A; (-) strand; PAM type: NRG; PAM sequence: GAG
ggttgggggagacagagaca

SEQ ID NO: 30984 - DNA, 20 bp, Artificial Sequence
  Description of Artificial Sequence: Synthetic oligonucleotide
  Target: SCN9A; (-) strand; PAM type: NRG; PAM sequence: CAG
ggggttgggggagacagaga

SEQ ID NO: 30985 - DNA, 20 bp, Artificial Sequence
  Description of Artificial Sequence: Synthetic oligonucleotide
  Target: SCN9A; (-) strand; PAM type: NRG; PAM sequence: GAG
catgggggttgggggagaca

SEQ ID NO: 30986 - DNA, 20 bp, Artificial Sequence
  Description of Artificial Sequence: Synthetic oligonucleotide
  Target: SCN9A; (-) strand; PAM type: NRG; PAM sequence: CAG
tgcatgggggttgggggaga

SEQ ID NO: 30987 - DNA, 20 bp, Artificial Sequence
  Description of Artificial Sequence: Synthetic oligonucleotide
  Target: SCN9A; (-) strand; PAM type: NRG; PAM sequence: GAG
catgtgcatgggggttgggg

SEQ ID NO: 30988 - DNA, 20 bp, Artificial Sequence
  Description of Artificial Sequence: Synthetic oligonucleotide
  Target: SCN9A; (-) strand; PAM type: NRG; PAM sequence: GGG
agcatgtgcatgggggttgg

SEQ ID NO: 30989 - DNA, 20 bp, Artificial Sequence
  Description of Artificial Sequence: Synthetic oligonucleotide
  Target: SCN9A; (-) strand; PAM type: NRG; PAM sequence: GGG
gagcatgtgcatgggggttg

SEQ ID NO: 30990 - DNA, 20 bp, Artificial Sequence
  Description of Artificial Sequence: Synthetic oligonucleotide
  Target: SCN9A; (-) strand; PAM type: NRG; PAM sequence: GGG
tgagcatgtgcatgggggtt

SEQ ID NO: 30991 - DNA, 20 bp, Artificial Sequence
  Description of Artificial Sequence: Synthetic oligonucleotide
  Target: SCN9A; (-) strand; PAM type: NRG; PAM sequence: TGG
ttgagcatgtgcatgggggt

SEQ ID NO: 30992 - DNA, 20 bp, Artificial Sequence
  Description of Artificial Sequence: Synthetic oligonucleotide
  Target: SCN9A; (-) strand; PAM type: NRG; PAM sequence: GGG
tgtgttgagcatgtgcatgg

SEQ ID NO: 30993 - DNA, 20 bp, Artificial Sequence
  Description of Artificial Sequence: Synthetic oligonucleotide
  Target: SCN9A; (-) strand; PAM type: NRG; PAM sequence: GGG
ctgtgttgagcatgtgcatg

SEQ ID NO: 30994 - DNA, 20 bp, Artificial Sequence
  Description of Artificial Sequence: Synthetic oligonucleotide
  Target: SCN9A; (-) strand; PAM type: NRG; PAM sequence: GGG
gctgtgttgagcatgtgcat

SEQ ID NO: 30995 - DNA, 20 bp, Artificial Sequence
  Description of Artificial Sequence: Synthetic oligonucleotide
  Target: SCN9A; (-) strand; PAM type: NRG; PAM sequence: TGG
agctgtgttgagcatgtgca

SEQ ID NO: 30996 - DNA, 20 bp, Artificial Sequence
  Description of Artificial Sequence: Synthetic oligonucleotide
  Target: SCN9A; (-) strand; PAM type: NRG; PAM sequence: GAG
agtcattctggagctgtgtt

SEQ ID NO: 30997 - DNA, 20 bp, Artificial Sequence
  Description of Artificial Sequence: Synthetic oligonucleotide
  Target: SCN9A; (-) strand; PAM type: NRG; PAM sequence: GAG
catatactttagtcattctg

SEQ ID NO: 30998 - DNA, 20 bp, Artificial Sequence
  Description of Artificial Sequence: Synthetic oligonucleotide
  Target: SCN9A; (-) strand; PAM type: NRG; PAM sequence: TGG
ttcatatactttagtcattc

SEQ ID NO: 30999 - DNA, 20 bp, Artificial Sequence
  Description of Artificial Sequence: Synthetic oligonucleotide
  Target: SCN9A; (-) strand; PAM type: NRG; PAM sequence: TAG
tctgcttttttcatatactt

SEQ ID NO: 31000 - DNA, 20 bp, Artificial Sequence
  Description of Artificial Sequence: Synthetic oligonucleotide
  Target: SCN9A; (-) strand; PAM type: NRG; PAM sequence: TAG
ttgcccatgcatggtaccac

SEQ ID NO: 31001 - DNA, 20 bp, Artificial Sequence
  Description of Artificial Sequence: Synthetic oligonucleotide
  Target: SCN9A; (-) strand; PAM type: NRG; PAM sequence: TGG
agggaaatattgcccatgca

SEQ ID NO: 31002 - DNA, 20 bp, Artificial Sequence
  Description of Artificial Sequence: Synthetic oligonucleotide
  Target: SCN9A; (-) strand; PAM type: NRG; PAM sequence: GGG
cctttaatttagcttgatca

SEQ ID NO: 31003 - DNA, 20 bp, Artificial Sequence
  Description of Artificial Sequence: Synthetic oligonucleotide
  Target: SCN9A; (-) strand; PAM type: NRG; PAM sequence: AGG
tcctttaatttagcttgatc

SEQ ID NO: 31004 - DNA, 20 bp, Artificial Sequence
  Description of Artificial Sequence: Synthetic oligonucleotide
  Target: SCN9A; (-) strand; PAM type: NRG; PAM sequence: CAG
ttcctttaatttagcttgat

SEQ ID NO: 31005 - DNA, 20 bp, Artificial Sequence
  Description of Artificial Sequence: Synthetic oligonucleotide
  Target: SCN9A; (-) strand; PAM type: NRG; PAM sequence: TAG
cttagtgtcttcctttaatt

SEQ ID NO: 31006 - DNA, 20 bp, Artificial Sequence
  Description of Artificial Sequence: Synthetic oligonucleotide
  Target: SCN9A; (-) strand; PAM type: NRG; PAM sequence: TAG
catgatgttaagcaggtgct

SEQ ID NO: 31007 - DNA, 20 bp, Artificial Sequence
  Description of Artificial Sequence: Synthetic oligonucleotide
  Target: SCN9A; (-) strand; PAM type: NRG; PAM sequence: AGG
cacagatcatgatgttaagc

SEQ ID NO: 31008 - DNA, 20 bp, Artificial Sequence
  Description of Artificial Sequence: Synthetic oligonucleotide
  Target: SCN9A; (-) strand; PAM type: NRG; PAM sequence: CAG
tcacagatcatgatgttaag

SEQ ID NO: 31009 - DNA, 20 bp, Artificial Sequence
  Description of Artificial Sequence: Synthetic oligonucleotide
  Target: SCN9A; (-) strand; PAM type: NRG; PAM sequence: AAG
atttcacagatcatgatgtt

SEQ ID NO: 31010 - DNA, 20 bp, Artificial Sequence
  Description of Artificial Sequence: Synthetic oligonucleotide
  Target: SCN9A; (-) strand; PAM type: NRG; PAM sequence: CAG
tctcttcaacttccatttca

SEQ ID NO: 31011 - DNA, 20 bp, Artificial Sequence
  Description of Artificial Sequence: Synthetic oligonucleotide
  Target: SCN9A; (-) strand; PAM type: NRG; PAM sequence: AGG
atgatgatgaaatctgatca

SEQ ID NO: 31012 - DNA, 20 bp, Artificial Sequence
  Description of Artificial Sequence: Synthetic oligonucleotide
  Target: SCN9A; (-) strand; PAM type: NRG; PAM sequence: AAG
gatgatgatgaaatctgatc

SEQ ID NO: 31013 - DNA, 20 bp, Artificial Sequence
  Description of Artificial Sequence: Synthetic oligonucleotide
  Target: SCN9A; (-) strand; PAM type: NRG; PAM sequence: AGG
gtttcacctctccaaactag

SEQ ID NO: 31014 - DNA, 20 bp, Artificial Sequence
  Description of Artificial Sequence: Synthetic oligonucleotide
  Target: SCN9A; (-) strand; PAM type: NRG; PAM sequence: GAG
agtttcacctctccaaacta

SEQ ID NO: 31015 - DNA, 20 bp, Artificial Sequence
  Description of Artificial Sequence: Synthetic oligonucleotide
  Target: SCN9A; (-) strand; PAM type: NRG; PAM sequence: TAG
gaagtttcacctctccaaac

SEQ ID NO: 31016 - DNA, 20 bp, Artificial Sequence
  Description of Artificial Sequence: Synthetic oligonucleotide
  Target: SCN9A; (-) strand; PAM type: NRG; PAM sequence: AAG
aaaattagtaaaatgaaagg

SEQ ID NO: 31017 - DNA, 20 bp, Artificial Sequence
  Description of Artificial Sequence: Synthetic oligonucleotide
  Target: SCN9A; (-) strand; PAM type: NRG; PAM sequence: AGG
tataaaattagtaaaatgaa

SEQ ID NO: 31018 - DNA, 20 bp, Artificial Sequence
  Description of Artificial Sequence: Synthetic oligonucleotide
  Target: SCN9A; (-) strand; PAM type: NRG; PAM sequence: AAG
ctataaaattagtaaaatga

SEQ ID NO: 31019 - DNA, 20 bp, Artificial Sequence
  Description of Artificial Sequence: Synthetic oligonucleotide
  Target: SCN9A; (-) strand; PAM type: NRG; PAM sequence: TAG
cttcttcaaagctataaaat

SEQ ID NO: 31020 - DNA, 20 bp, Artificial Sequence
  Description of Artificial Sequence: Synthetic oligonucleotide
  Target: SCN9A; (-) strand; PAM type: NRG; PAM sequence: AAG
actaaagctgctcttcttca

SEQ ID NO: 31021 - DNA, 20 bp, Artificial Sequence
  Description of Artificial Sequence: Synthetic oligonucleotide
  Target: SCN9A; (-) strand; PAM type: NRG; PAM sequence: AAG
gcaaactcagatgccaacta

SEQ ID NO: 31022 - DNA, 20 bp, Artificial Sequence
  Description of Artificial Sequence: Synthetic oligonucleotide
  Target: SCN9A; (-) strand; PAM type: NRG; PAM sequence: CAG
caataacttccaagcaaact

SEQ ID NO: 31023 - DNA, 20 bp, Artificial Sequence
  Description of Artificial Sequence: Synthetic oligonucleotide
  Target: SCN9A; (-) strand; PAM type: NRG; PAM sequence: AAG
ggcctggtacaataacttcc

SEQ ID NO: 31024 - DNA, 20 bp, Artificial Sequence
  Description of Artificial Sequence: Synthetic oligonucleotide
  Target: SCN9A; (-) strand; PAM type: NRG; PAM sequence: TGG
atcttgccaccccactggcc

SEQ ID NO: 31025 - DNA, 20 bp, Artificial Sequence
  Description of Artificial Sequence: Synthetic oligonucleotide
  Target: SCN9A; (-) strand; PAM type: NRG; PAM sequence: TGG
ctatcatcttgccaccccac

SEQ ID NO: 31026 - DNA, 20 bp, Artificial Sequence
  Description of Artificial Sequence: Synthetic oligonucleotide
  Target: SCN9A; (-) strand; PAM type: NRG; PAM sequence: CAG
gttgccctctgtaaccctgt

SEQ ID NO: 31027 - DNA, 20 bp, Artificial Sequence
  Description of Artificial Sequence: Synthetic oligonucleotide
  Target: SCN9A; (-) strand; PAM type: NRG; PAM sequence: AGG
gtgtgtgttggtgaagtgtg

SEQ ID NO: 31028 - DNA, 20 bp, Artificial Sequence
  Description of Artificial Sequence: Synthetic oligonucleotide
  Target: SCN9A; (-) strand; PAM type: NRG; PAM sequence: GAG
tgtgtgtgttggtgaagtgt

SEQ ID NO: 31029 - DNA, 20 bp, Artificial Sequence
  Description of Artificial Sequence: Synthetic oligonucleotide
  Target: SCN9A; (-) strand; PAM type: NRG; PAM sequence: AAG
cttctttgtgtgtgttggtg

SEQ ID NO: 31030 - DNA, 20 bp, Artificial Sequence
  Description of Artificial Sequence: Synthetic oligonucleotide
  Target: SCN9A; (-) strand; PAM type: NRG; PAM sequence: TGG
tgcatcttctttgtgtgtgt

SEQ ID NO: 31031 - DNA, 20 bp, Artificial Sequence
  Description of Artificial Sequence: Synthetic oligonucleotide
  Target: SCN9A; (-) strand; PAM type: NRG; PAM sequence: AGG
aagaagttgtagtcacacat

SEQ ID NO: 31032 - DNA, 20 bp, Artificial Sequence
  Description of Artificial Sequence: Synthetic oligonucleotide
  Target: SCN9A; (-) strand; PAM type: NRG; PAM sequence: TAG
aaagaagttgtagtcacaca

SEQ ID NO: 31033 - DNA, 20 bp, Artificial Sequence
  Description of Artificial Sequence: Synthetic oligonucleotide
  Target: SCN9A; (-) strand; PAM type: NRG; PAM sequence: TAG
agggaagaggaaagaagttg

SEQ ID NO: 31034 - DNA, 20 bp, Artificial Sequence
  Description of Artificial Sequence: Synthetic oligonucleotide
  Target: SCN9A; (-) strand; PAM type: NRG; PAM sequence: AAG
agactaagggaagaggaaag

SEQ ID NO: 31035 - DNA, 20 bp, Artificial Sequence
  Description of Artificial Sequence: Synthetic oligonucleotide
  Target: SCN9A; (-) strand; PAM type: NRG; PAM sequence: AAG
agaagactaagggaagagga

SEQ ID NO: 31036 - DNA, 20 bp, Artificial Sequence
  Description of Artificial Sequence: Synthetic oligonucleotide
  Target: SCN9A; (-) strand; PAM type: NRG; PAM sequence: AGG
atccagaagactaagggaag

SEQ ID NO: 31037 - DNA, 20 bp, Artificial Sequence
  Description of Artificial Sequence: Synthetic oligonucleotide
  Target: SCN9A; (-) strand; PAM type: NRG; PAM sequence: GAG
tatccagaagactaagggaa

SEQ ID NO: 31038 - DNA, 20 bp, Artificial Sequence
  Description of Artificial Sequence: Synthetic oligonucleotide
  Target: SCN9A; (-) strand; PAM type: NRG; PAM sequence: AAG
tttatccagaagactaaggg

SEQ ID NO: 31039 - DNA, 20 bp, Artificial Sequence
  Description of Artificial Sequence: Synthetic oligonucleotide
  Target: SCN9A; (-) strand; PAM type: NRG; PAM sequence: GGG
ctgtttatccagaagactaa

SEQ ID NO: 31040 - DNA, 20 bp, Artificial Sequence
  Description of Artificial Sequence: Synthetic oligonucleotide
  Target: SCN9A; (-) strand; PAM type: NRG; PAM sequence: AGG
cctgtttatccagaagacta

SEQ ID NO: 31041 - DNA, 20 bp, Artificial Sequence
  Description of Artificial Sequence: Synthetic oligonucleotide
  Target: SCN9A; (-) strand; PAM type: NRG; PAM sequence: AAG
gcctgtttatccagaagact

SEQ ID NO: 31042 - DNA, 20 bp, Artificial Sequence
  Description of Artificial Sequence: Synthetic oligonucleotide
  Target: SCN9A; (-) strand; PAM type: NRG; PAM sequence: AAG
cctgtggcctgtttatccag

SEQ ID NO: 31043 - DNA, 20 bp, Artificial Sequence
  Description of Artificial Sequence: Synthetic oligonucleotide
  Target: SCN9A; (-) strand; PAM type: NRG; PAM sequence: CAG
actcctgtggcctgtttatc

SEQ ID NO: 31044 - DNA, 20 bp, Artificial Sequence
  Description of Artificial Sequence: Synthetic oligonucleotide
  Target: SCN9A; (-) strand; PAM type: NRG; PAM sequence: TGG
ctgactaatgaaaactcctg

SEQ ID NO: 31045 - DNA, 20 bp, Artificial Sequence
  Description of Artificial Sequence: Synthetic oligonucleotide
  Target: SCN9A; (-) strand; PAM type: NRG; PAM sequence: CAG
catttaaatatttactccac

SEQ ID NO: 31046 - DNA, 20 bp, Artificial Sequence
  Description of Artificial Sequence: Synthetic oligonucleotide
  Target: SCN9A; (-) strand; PAM type: NRG; PAM sequence: GAG
tcacttttattagaatgttt

SEQ ID NO: 31047 - DNA, 20 bp, Artificial Sequence
  Description of Artificial Sequence: Synthetic oligonucleotide
  Target: SCN9A; (-) strand; PAM type: NRG; PAM sequence: TAG
gtattcattttcacttttat

SEQ ID NO: 31048 - DNA, 20 bp, Artificial Sequence
  Description of Artificial Sequence: Synthetic oligonucleotide
  Target: SCN9A; (-) strand; PAM type: NRG; PAM sequence: AAG
tctctactctcacattaaat

SEQ ID NO: 31049 - DNA, 20 bp, Artificial Sequence
  Description of Artificial Sequence: Synthetic oligonucleotide
  Target: SCN9A; (-) strand; PAM type: NRG; PAM sequence: AAG
cctttggtgtaatgctttac

SEQ ID NO: 31050 - DNA, 20 bp, Artificial Sequence
  Description of Artificial Sequence: Synthetic oligonucleotide
  Target: SCN9A; (-) strand; PAM type: NRG; PAM sequence: TGG
atctttttcgattttgcctt

SEQ ID NO: 31051 - DNA, 20 bp, Artificial Sequence
  Description of Artificial Sequence: Synthetic oligonucleotide
  Target: SCN9A; (-) strand; PAM type: NRG; PAM sequence: TAG
cattgttatgagattaaatc

SEQ ID NO: 31052 - DNA, 20 bp, Artificial Sequence
  Description of Artificial Sequence: Synthetic oligonucleotide
  Target: SCN9A; (-) strand; PAM type: NRG; PAM sequence: GAG
ttaaaaaccttcattgttat

SEQ ID NO: 31053 - DNA, 20 bp, Artificial Sequence
  Description of Artificial Sequence: Synthetic oligonucleotide
  Target: SCN9A; (-) strand; PAM type: NRG; PAM sequence: TGG
attgtactttttttattttg

SEQ ID NO: 31054 - DNA, 20 bp, Artificial Sequence
  Description of Artificial Sequence: Synthetic oligonucleotide
  Target: SCN9A; (-) strand; PAM type: NRG; PAM sequence: AAG
atctttattcattaaaggaa

SEQ ID NO: 31055 - DNA, 20 bp, Artificial Sequence
  Description of Artificial Sequence: Synthetic oligonucleotide
  Target: SCN9A; (-) strand; PAM type: NRG; PAM sequence: AGG
ttaatatctttattcattaa

SEQ ID NO: 31056 - DNA, 20 bp, Artificial Sequence
  Description of Artificial Sequence: Synthetic oligonucleotide
  Target: SCN9A; (-) strand; PAM type: NRG; PAM sequence: AAG
attaatatctttattcatta

SEQ ID NO: 31057 - DNA, 20 bp, Artificial Sequence
  Description of Artificial Sequence: Synthetic oligonucleotide
  Target: SCN9A; (-) strand; PAM type: NRG; PAM sequence: GAG
tgttttttactaaattttat

SEQ ID NO: 31058 - DNA, 20 bp, Artificial Sequence
  Description of Artificial Sequence: Synthetic oligonucleotide
  Target: SCN9A; (-) strand; PAM type: NRG; PAM sequence: TAG
ttattaaccatttgtatttt

SEQ ID NO: 31059 - DNA, 20 bp, Artificial Sequence
  Description of Artificial Sequence: Synthetic oligonucleotide
  Target: SCN9A; (-) strand; PAM type: NRG; PAM sequence: AAG
gtgaggtttgacatggttac

SEQ ID NO: 31060 - DNA, 20 bp, Artificial Sequence
  Description of Artificial Sequence: Synthetic oligonucleotide
  Target: SCN9A; (-) strand; PAM type: NRG; PAM sequence: TGG
attactagtgaggtttgaca

SEQ ID NO: 31061 - DNA, 20 bp, Artificial Sequence
  Description of Artificial Sequence: Synthetic oligonucleotide
  Target: SCN9A; (-) strand; PAM type: NRG; PAM sequence: AGG
tgtttctttgattactagtg

SEQ ID NO: 31062 - DNA, 20 bp, Artificial Sequence
  Description of Artificial Sequence: Synthetic oligonucleotide
  Target: SCN9A; (-) strand; PAM type: NRG; PAM sequence: GAG
ttgtttctttgattactagt

SEQ ID NO: 31063 - DNA, 20 bp, Artificial Sequence
  Description of Artificial Sequence: Synthetic oligonucleotide
  Target: SCN9A; (-) strand; PAM type: NRG; PAM sequence: TAG
atatttgtttctttgattac

SEQ ID NO: 31064 - DNA, 20 bp, Artificial Sequence
  Description of Artificial Sequence: Synthetic oligonucleotide
  Target: SCN9A; (-) strand; PAM type: NRG; PAM sequence: TGG
aatgattaataggccaaatt

SEQ ID NO: 31065 - DNA, 20 bp, Artificial Sequence
  Description of Artificial Sequence: Synthetic oligonucleotide
  Target: SCN9A; (-) strand; PAM type: NRG; PAM sequence: AGG
aatctttgctaatgattaat

SEQ ID NO: 31066 - DNA, 20 bp, Artificial Sequence
  Description of Artificial Sequence: Synthetic oligonucleotide
  Target: SCN9A; (-) strand; PAM type: NRG; PAM sequence: TAG
aaatctttgctaatgattaa

SEQ ID NO: 31067 - DNA, 20 bp, Artificial Sequence
  Description of Artificial Sequence: Synthetic oligonucleotide
  Target: SCN9A; (-) strand; PAM type: NRG; PAM sequence: AGG
tttattactttcatccagac

SEQ ID NO: 31068 - DNA, 20 bp, Artificial Sequence
  Description of Artificial Sequence: Synthetic oligonucleotide
  Target: SCN9A; (-) strand; PAM type: NRG; PAM sequence: CAG
atttattactttcatccaga

SEQ ID NO: 31069 - DNA, 20 bp, Artificial Sequence
  Description of Artificial Sequence: Synthetic oligonucleotide
  Target: SCN9A; (-) strand; PAM type: NRG; PAM sequence: CAG
cattatttattactttcatc

SEQ ID NO: 31070 - DNA, 20 bp, Artificial Sequence
  Description of Artificial Sequence: Synthetic oligonucleotide
  Target: SCN9A; (-) strand; PAM type: NRG; PAM sequence: CAG
cgtgagccaccgcacccaga

SEQ ID NO: 31071 - DNA, 20 bp, Artificial Sequence
  Description of Artificial Sequence: Synthetic oligonucleotide
  Target: SCN9A; (-) strand; PAM type: NRG; PAM sequence: CAG
taggcgtgagccaccgcacc

SEQ ID NO: 31072 - DNA, 20 bp, Artificial Sequence
  Description of Artificial Sequence: Synthetic oligonucleotide
  Target: SCN9A; (-) strand; PAM type: NRG; PAM sequence: GAG
agttctgggattataggcgt

SEQ ID NO: 31073 - DNA, 20 bp, Artificial Sequence
  Description of Artificial Sequence: Synthetic oligonucleotide
  Target: SCN9A; (-) strand; PAM type: NRG; PAM sequence: AGG
tcccaaagttctgggattat

SEQ ID NO: 31074 - DNA, 20 bp, Artificial Sequence
  Description of Artificial Sequence: Synthetic oligonucleotide
  Target: SCN9A; (-) strand; PAM type: NRG; PAM sequence: TAG
ctcccaaagttctgggatta

SEQ ID NO: 31075 - DNA, 20 bp, Artificial Sequence
  Description of Artificial Sequence: Synthetic oligonucleotide
  Target: SCN9A; (-) strand; PAM type: NRG; PAM sequence: GGG
cctgggcctcccaaagttct

SEQ ID NO: 31076 - DNA, 20 bp, Artificial Sequence
  Description of Artificial Sequence: Synthetic oligonucleotide
  Target: SCN9A; (-) strand; PAM type: NRG; PAM sequence: TGG
gcctgggcctcccaaagttc

SEQ ID NO: 31077 - DNA, 20 bp, Artificial Sequence
  Description of Artificial Sequence: Synthetic oligonucleotide
  Target: SCN9A; (-) strand; PAM type: NRG; PAM sequence: AAG
ctgcctgcctgggcctccca

SEQ ID NO: 31078 - DNA, 20 bp, Artificial Sequence
  Description of Artificial Sequence: Synthetic oligonucleotide
  Target: SCN9A; (-) strand; PAM type: NRG; PAM sequence: GGG
acctcatgatctgcctgcct

SEQ ID NO: 31079 - DNA, 20 bp, Artificial Sequence
  Description of Artificial Sequence: Synthetic oligonucleotide
  Target: SCN9A; (-) strand; PAM type: NRG; PAM sequence: TGG
gacctcatgatctgcctgcc

SEQ ID NO: 31080 - DNA, 20 bp, Artificial Sequence
  Description of Artificial Sequence: Synthetic oligonucleotide
  Target: SCN9A; (-) strand; PAM type: NRG; PAM sequence: TGG
tttcacagtgttcgccaggt

SEQ ID NO: 31081 - DNA, 20 bp, Artificial Sequence
  Description of Artificial Sequence: Synthetic oligonucleotide
  Target: SCN9A; (-) strand; PAM type: NRG; PAM sequence: AGG
agggtttcacagtgttcgcc

SEQ ID NO: 31082 - DNA, 20 bp, Artificial Sequence
  Description of Artificial Sequence: Synthetic oligonucleotide
  Target: SCN9A; (-) strand; PAM type: NRG; PAM sequence: CAG
cagggtttcacagtgttcgc

SEQ ID NO: 31083 - DNA, 20 bp, Artificial Sequence
  Description of Artificial Sequence: Synthetic oligonucleotide
  Target: SCN9A; (-) strand; PAM type: NRG; PAM sequence: CAG
ttagtagagacagggtttca

SEQ ID NO: 31084 - DNA, 20 bp, Artificial Sequence
  Description of Artificial Sequence: Synthetic oligonucleotide
  Target: SCN9A; (-) strand; PAM type: NRG; PAM sequence: GGG
ttgtacttttagtagagaca

SEQ ID NO: 31085 - DNA, 20 bp, Artificial Sequence
  Description of Artificial Sequence: Synthetic oligonucleotide
  Target: SCN9A; (-) strand; PAM type: NRG; PAM sequence: AGG
tttgtacttttagtagagac

SEQ ID NO: 31086 - DNA, 20 bp, Artificial Sequence
  Description of Artificial Sequence: Synthetic oligonucleotide
  Target: SCN9A; (-) strand; PAM type: NRG; PAM sequence: CAG
ttttgtacttttagtagaga

SEQ ID NO: 31087 - DNA, 20 bp, Artificial Sequence
  Description of Artificial Sequence: Synthetic oligonucleotide
  Target: SCN9A; (-) strand; PAM type: NRG; PAM sequence: GAG
atttttttgtacttttagta

SEQ ID NO: 31088 - DNA, 20 bp, Artificial Sequence
  Description of Artificial Sequence: Synthetic oligonucleotide
  Target: SCN9A; (-) strand; PAM type: NRG; PAM sequence: TAG
taatttttttgtacttttag

SEQ ID NO: 31089 - DNA, 20 bp, Artificial Sequence
  Description of Artificial Sequence: Synthetic oligonucleotide
  Target: SCN9A; (-) strand; PAM type: NRG; PAM sequence: TAG
ggctaatttttttgtacttt

SEQ ID NO: 31090 - DNA, 20 bp, Artificial Sequence
  Description of Artificial Sequence: Synthetic oligonucleotide
  Target: SCN9A; (-) strand; PAM type: NRG; PAM sequence: TGG
taggcgcctgccaacatgcc

SEQ ID NO: 31091 - DNA, 20 bp, Artificial Sequence
  Description of Artificial Sequence: Synthetic oligonucleotide
  Target: SCN9A; (-) strand; PAM type: NRG; PAM sequence: AGG
tcccgagcagctgggactat

SEQ ID NO: 31092 - DNA, 20 bp, Artificial Sequence
  Description of Artificial Sequence: Synthetic oligonucleotide
  Target: SCN9A; (-) strand; PAM type: NRG; PAM sequence: TAG
ctcccgagcagctgggacta

SEQ ID NO: 31093 - DNA, 20 bp, Artificial Sequence
  Description of Artificial Sequence: Synthetic oligonucleotide
  Target: SCN9A; (-) strand; PAM type: NRG; PAM sequence: GGG
cctcagcctcccgagcagct

SEQ ID NO: 31094 - DNA, 20 bp, Artificial Sequence
  Description of Artificial Sequence: Synthetic oligonucleotide
  Target: SCN9A; (-) strand; PAM type: NRG; PAM sequence: TGG
gcctcagcctcccgagcagc

SEQ ID NO: 31095 - DNA, 20 bp, Artificial Sequence
  Description of Artificial Sequence: Synthetic oligonucleotide
  Target: SCN9A; (-) strand; PAM type: NRG; PAM sequence: CAG
ctctgcctcagcctcccgag

SEQ ID NO: 31096 - DNA, 20 bp, Artificial Sequence
  Description of Artificial Sequence: Synthetic oligonucleotide
  Target: SCN9A; (-) strand; PAM type: NRG; PAM sequence: GAG
attctctgcctcagcctccc

SEQ ID NO: 31097 - DNA, 20 bp, Artificial Sequence
  Description of Artificial Sequence: Synthetic oligonucleotide
  Target: SCN9A; (-) strand; PAM type: NRG; PAM sequence: CAG
gttcacgccattctctgcct

SEQ ID NO: 31098 - DNA, 20 bp, Artificial Sequence
  Description of Artificial Sequence: Synthetic oligonucleotide
  Target: SCN9A; (-) strand; PAM type: NRG; PAM sequence: GGG
cactgcaagctccgcctcct

SEQ ID NO: 31099 - DNA, 20 bp, Artificial Sequence
  Description of Artificial Sequence: Synthetic oligonucleotide
  Target: SCN9A; (-) strand; PAM type: NRG; PAM sequence: TGG
tcactgcaagctccgcctcc

SEQ ID NO: 31100 - DNA, 20 bp, Artificial Sequence
  Description of Artificial Sequence: Synthetic oligonucleotide
  Target: SCN9A; (-) strand; PAM type: NRG; PAM sequence: AAG
gcacgatcttggctcactgc

SEQ ID NO: 31101 - DNA, 20 bp, Artificial Sequence
  Description of Artificial Sequence: Synthetic oligonucleotide
  Target: SCN9A; (-) strand; PAM type: NRG; PAM sequence: TGG
ggagtgcagtggcacgatct

SEQ ID NO: 31102 - DNA, 20 bp, Artificial Sequence
  Description of Artificial Sequence: Synthetic oligonucleotide
  Target: SCN9A; (-) strand; PAM type: NRG; PAM sequence: TGG
ttgcccaggctggagtgcag

SEQ ID NO: 31103 - DNA, 20 bp, Artificial Sequence
  Description of Artificial Sequence: Synthetic oligonucleotide
  Target: SCN9A; (-) strand; PAM type: NRG; PAM sequence: CAG
ctattgcccaggctggagtg

SEQ ID NO: 31104 - DNA, 20 bp, Artificial Sequence
  Description of Artificial Sequence: Synthetic oligonucleotide
  Target: SCN9A; (-) strand; PAM type: NRG; PAM sequence: GAG
tcgctctattgcccaggctg

SEQ ID NO: 31105 - DNA, 20 bp, Artificial Sequence
  Description of Artificial Sequence: Synthetic oligonucleotide
  Target: SCN9A; (-) strand; PAM type: NRG; PAM sequence: TGG
tctcgctctattgcccaggc

SEQ ID NO: 31106 - DNA, 20 bp, Artificial Sequence
  Description of Artificial Sequence: Synthetic oligonucleotide
  Target: SCN9A; (-) strand; PAM type: NRG; PAM sequence: AGG
ggagtctcgctctattgccc

SEQ ID NO: 31107 - DNA, 20 bp, Artificial Sequence
  Description of Artificial Sequence: Synthetic oligonucleotide
  Target: SCN9A; (-) strand; PAM type: NRG; PAM sequence: CAG
cggagtctcgctctattgcc

SEQ ID NO: 31108 - DNA, 20 bp, Artificial Sequence
  Description of Artificial Sequence: Synthetic oligonucleotide
  Target: SCN9A; (-) strand; PAM type: NRG; PAM sequence: GAG
ttatttatttatttgagacg

SEQ ID NO: 31109 - DNA, 20 bp, Artificial Sequence
  Description of Artificial Sequence: Synthetic oligonucleotide
  Target: SCN9A; (-) strand; PAM type: NRG; PAM sequence: CGG
ctttatttatttatttgaga

SEQ ID NO: 31110 - DNA, 20 bp, Artificial Sequence
  Description of Artificial Sequence: Synthetic oligonucleotide
  Target: SCN9A; (-) strand; PAM type: NRG; PAM sequence: GAG
tacactttatttatttattt

SEQ ID NO: 31111 - DNA, 20 bp, Artificial Sequence
  Description of Artificial Sequence: Synthetic oligonucleotide
  Target: SCN9A; (-) strand; PAM type: NRG; PAM sequence: AAG
attacaaaattaccctcaaa

SEQ ID NO: 31112 - DNA, 20 bp, Artificial Sequence
  Description of Artificial Sequence: Synthetic oligonucleotide
  Target: SCN9A; (-) strand; PAM type: NRG; PAM sequence: TAG
cacgtgtttaaggcttttga

SEQ ID NO: 31113 - DNA, 20 bp, Artificial Sequence
  Description of Artificial Sequence: Synthetic oligonucleotide
  Target: SCN9A; (-) strand; PAM type: NRG; PAM sequence: AGG
taaacgaattcacgtgttta

SEQ ID NO: 31114 - DNA, 20 bp, Artificial Sequence
  Description of Artificial Sequence: Synthetic oligonucleotide
  Target: SCN9A; (-) strand; PAM type: NRG; PAM sequence: AAG
ataaacgaattcacgtgttt

SEQ ID NO: 31115 - DNA, 20 bp, Artificial Sequence
  Description of Artificial Sequence: Synthetic oligonucleotide
  Target: SCN9A; (-) strand; PAM type: NRG; PAM sequence: TGG
ttcctagaaggaaaattatt

SEQ ID NO: 31116 - DNA, 20 bp, Artificial Sequence
  Description of Artificial Sequence: Synthetic oligonucleotide
  Target: SCN9A; (-) strand; PAM type: NRG; PAM sequence: AGG
tctttgaataaattcctaga

SEQ ID NO: 31117 - DNA, 20 bp, Artificial Sequence
  Description of Artificial Sequence: Synthetic oligonucleotide
  Target: SCN9A; (-) strand; PAM type: NRG; PAM sequence: AAG
gtctttgaataaattcctag

SEQ ID NO: 31118 - DNA, 20 bp, Artificial Sequence
  Description of Artificial Sequence: Synthetic oligonucleotide
  Target: SCN9A; (-) strand; PAM type: NRG; PAM sequence: TAG
actgtctttgaataaattcc

SEQ ID NO: 31119 - DNA, 20 bp, Artificial Sequence
  Description of Artificial Sequence: Synthetic oligonucleotide
  Target: SCN9A; (-) strand; PAM type: NRG; PAM sequence: GAG
atacatgttagaggacacct

SEQ ID NO: 31120 - DNA, 20 bp, Artificial Sequence
  Description of Artificial Sequence: Synthetic oligonucleotide
  Target: SCN9A; (-) strand; PAM type: NRG; PAM sequence: AGG
aatatatttatacatgttag

SEQ ID NO: 31121 - DNA, 20 bp, Artificial Sequence
  Description of Artificial Sequence: Synthetic oligonucleotide
  Target: SCN9A; (-) strand; PAM type: NRG; PAM sequence: GAG
aaatatatttatacatgtta

SEQ ID NO: 31122 - DNA, 20 bp, Artificial Sequence
  Description of Artificial Sequence: Synthetic oligonucleotide
  Target: SCN9A; (-) strand; PAM type: NRG; PAM sequence: TAG
gtaaatatatttatacatgt

SEQ ID NO: 31123 - DNA, 20 bp, Artificial Sequence
  Description of Artificial Sequence: Synthetic oligonucleotide
  Target: SCN9A; (-) strand; PAM type: NRG; PAM sequence: TAG
tcaatattataaaaatattg

SEQ ID NO: 31124 - DNA, 20 bp, Artificial Sequence
  Description of Artificial Sequence: Synthetic oligonucleotide
  Target: SCN9A; (-) strand; PAM type: NRG; PAM sequence: TGG
aacccttactgttaggattt

SEQ ID NO: 31125 - DNA, 20 bp, Artificial Sequence
  Description of Artificial Sequence: Synthetic oligonucleotide
  Target: SCN9A; (-) strand; PAM type: NRG; PAM sequence: AGG
ttagtgtaacccttactgtt

SEQ ID NO: 31126 - DNA, 20 bp, Artificial Sequence
  Description of Artificial Sequence: Synthetic oligonucleotide
  Target: SCN9A; (-) strand; PAM type: NRG; PAM sequence: TAG
tttagtgtaacccttactgt

SEQ ID NO: 31127 - DNA, 20 bp, Artificial Sequence
  Description of Artificial Sequence: Synthetic oligonucleotide
  Target: SCN9A; (-) strand; PAM type: NRG; PAM sequence: TAG
tatacattcattacttcatt

SEQ ID NO: 31128 - DNA, 20 bp, Artificial Sequence
  Description of Artificial Sequence: Synthetic oligonucleotide
  Target: SCN9A; (-) strand; PAM type: NRG; PAM sequence: AAG
tctttgaacgctctctttca

SEQ ID NO: 31129 - DNA, 20 bp, Artificial Sequence
  Description of Artificial Sequence: Synthetic oligonucleotide
  Target: SCN9A; (-) strand; PAM type: NRG; PAM sequence: TAG
aattcatttaattcattaaa

SEQ ID NO: 31130 - DNA, 20 bp, Artificial Sequence
  Description of Artificial Sequence: Synthetic oligonucleotide
  Target: SCN9A; (-) strand; PAM type: NRG; PAM sequence: TGG
atctatctgtgtgtataacc

SEQ ID NO: 31131 - DNA, 20 bp, Artificial Sequence
  Description of Artificial Sequence: Synthetic oligonucleotide
  Target: SCN9A; (-) strand; PAM type: NRG; PAM sequence: GGG
aatccataatctcttaacta

SEQ ID NO: 31132 - DNA, 20 bp, Artificial Sequence
  Description of Artificial Sequence: Synthetic oligonucleotide
  Target: SCN9A; (-) strand; PAM type: NRG; PAM sequence: AGG
taatccataatctcttaact

SEQ ID NO: 31133 - DNA, 20 bp, Artificial Sequence
  Description of Artificial Sequence: Synthetic oligonucleotide
  Target: SCN9A; (-) strand; PAM type: NRG; PAM sequence: TAG
ataatccataatctcttaac

SEQ ID NO: 31134 - DNA, 20 bp, Artificial Sequence
  Description of Artificial Sequence: Synthetic oligonucleotide
  Target: SCN9A; (-) strand; PAM type: NRG; PAM sequence: AAG
aatttgaaaagtaaagtata

SEQ ID NO: 31135 - DNA, 20 bp, Artificial Sequence
  Description of Artificial Sequence: Synthetic oligonucleotide
  Target: SCN9A; (-) strand; PAM type: NRG; PAM sequence: AAG
ttgtacaaatttgaaaagta

SEQ ID NO: 31136 - DNA, 20 bp, Artificial Sequence
  Description of Artificial Sequence: Synthetic oligonucleotide
  Target: SCN9A; (-) strand; PAM type: NRG; PAM sequence: AAG
tttcgttgtacaaatttgaa

SEQ ID NO: 31137 - DNA, 20 bp, Artificial Sequence
  Description of Artificial Sequence: Synthetic oligonucleotide
  Target: SCN9A; (-) strand; PAM type: NRG; PAM sequence: TAG
tatattttctttcttctgga

SEQ ID NO: 31138 - DNA, 20 bp, Artificial Sequence
  Description of Artificial Sequence: Synthetic oligonucleotide
  Target: SCN9A; (-) strand; PAM type: NRG; PAM sequence: TGG
aaagtatattttctttcttc

SEQ ID NO: 31139 - DNA, 20 bp, Artificial Sequence
  Description of Artificial Sequence: Synthetic oligonucleotide
  Target: SCN9A; (-) strand; PAM type: NRG; PAM sequence: AAG
attttaaatgatttttttca

SEQ ID NO: 31140 - DNA, 20 bp, Artificial Sequence
  Description of Artificial Sequence: Synthetic oligonucleotide
  Target: SCN9A; (-) strand; PAM type: NRG; PAM sequence: AGG
ttcattgactatataaaatt

SEQ ID NO: 31141 - DNA, 20 bp, Artificial Sequence
  Description of Artificial Sequence: Synthetic oligonucleotide
  Target: SCN9A; (-) strand; PAM type: NRG; PAM sequence: TAG
tttcattgactatataaaat

SEQ ID NO: 31142 - DNA, 20 bp, Artificial Sequence
  Description of Artificial Sequence: Synthetic oligonucleotide
  Target: SCN9A; (-) strand; PAM type: NRG; PAM sequence: AAG
aattgtaaattaaacatgac

SEQ ID NO: 31143 - DNA, 20 bp, Artificial Sequence
  Description of Artificial Sequence: Synthetic oligonucleotide
  Target: SCN9A; (-) strand; PAM type: NRG; PAM sequence: TAG
tgttaataaaagtggaaatg

SEQ ID NO: 31144 - DNA, 20 bp, Artificial Sequence
  Description of Artificial Sequence: Synthetic oligonucleotide
  Target: SCN9A; (-) strand; PAM type: NRG; PAM sequence: TGG
catagtaatgttaataaaag

SEQ ID NO: 31145 - DNA, 20 bp, Artificial Sequence
  Description of Artificial Sequence: Synthetic oligonucleotide
  Target: SCN9A; (-) strand; PAM type: NRG; PAM sequence: AAG
aatcatagtaatgttaataa

SEQ ID NO: 31146 - DNA, 20 bp, Artificial Sequence
  Description of Artificial Sequence: Synthetic oligonucleotide
  Target: SCN9A; (-) strand; PAM type: NRG; PAM sequence: TAG
ttctaaagaagatacaatca

SEQ ID NO: 31147 - DNA, 20 bp, Artificial Sequence
  Description of Artificial Sequence: Synthetic oligonucleotide
  Target: SCN9A; (-) strand; PAM type: NRG; PAM sequence: AAG
attgggatttcattctaaag

SEQ ID NO: 31148 - DNA, 20 bp, Artificial Sequence
  Description of Artificial Sequence: Synthetic oligonucleotide
  Target: SCN9A; (-) strand; PAM type: NRG; PAM sequence: AAG
aacattgggatttcattcta

SEQ ID NO: 31149 - DNA, 20 bp, Artificial Sequence
  Description of Artificial Sequence: Synthetic oligonucleotide
  Target: SCN9A; (-) strand; PAM type: NRG; PAM sequence: GGG
ctgcctttatatgcaacatt

SEQ ID NO: 31150 - DNA, 20 bp, Artificial Sequence
  Description of Artificial Sequence: Synthetic oligonucleotide
  Target: SCN9A; (-) strand; PAM type: NRG; PAM sequence: TGG
actgcctttatatgcaacat

SEQ ID NO: 31151 - DNA, 20 bp, Artificial Sequence
  Description of Artificial Sequence: Synthetic oligonucleotide
  Target: SCN9A; (-) strand; PAM type: NRG; PAM sequence: AAG
agatagtaatgagaaaacaa

SEQ ID NO: 31152 - DNA, 20 bp, Artificial Sequence
  Description of Artificial Sequence: Synthetic oligonucleotide
  Target: SCN9A; (-) strand; PAM type: NRG; PAM sequence: GAG
tgagtgggtaagatagtaat

SEQ ID NO: 31153 - DNA, 20 bp, Artificial Sequence
  Description of Artificial Sequence: Synthetic oligonucleotide
  Target: SCN9A; (-) strand; PAM type: NRG; PAM sequence: TAG
ttaatggtgagtgggtaaga

SEQ ID NO: 31154 - DNA, 20 bp, Artificial Sequence
  Description of Artificial Sequence: Synthetic oligonucleotide
  Target: SCN9A; (-) strand; PAM type: NRG; PAM sequence: AAG
gagattaatggtgagtgggt

SEQ ID NO: 31155 - DNA, 20 bp, Artificial Sequence
  Description of Artificial Sequence: Synthetic oligonucleotide
  Target: SCN9A; (-) strand; PAM type: NRG; PAM sequence: GGG
atatgagattaatggtgagt

SEQ ID NO: 31156 - DNA, 20 bp, Artificial Sequence
  Description of Artificial Sequence: Synthetic oligonucleotide
  Target: SCN9A; (-) strand; PAM type: NRG; PAM sequence: TGG
aatatgagattaatggtgag

SEQ ID NO: 31157 - DNA, 20 bp, Artificial Sequence
  Description of Artificial Sequence: Synthetic oligonucleotide
  Target: SCN9A; (-) strand; PAM type: NRG; PAM sequence: GAG
tctaatatgagattaatggt

SEQ ID NO: 31158 - DNA, 20 bp, Artificial Sequence
  Description of Artificial Sequence: Synthetic oligonucleotide
  Target: SCN9A; (-) strand; PAM type: NRG; PAM sequence: TGG
attctctaatatgagattaa

SEQ ID NO: 31159 - DNA, 20 bp, Artificial Sequence
  Description of Artificial Sequence: Synthetic oligonucleotide
  Target: SCN9A; (-) strand; PAM type: NRG; PAM sequence: GAG
gcctaagtattctctaatat

SEQ ID NO: 31160 - DNA, 20 bp, Artificial Sequence
  Description of Artificial Sequence: Synthetic oligonucleotide
  Target: SCN9A; (-) strand; PAM type: NRG; PAM sequence: AAG
tttaattttagtagttgcct

SEQ ID NO: 31161 - DNA, 20 bp, Artificial Sequence
  Description of Artificial Sequence: Synthetic oligonucleotide
  Target: SCN9A; (-) strand; PAM type: NRG; PAM sequence: TAG
cattcattttttaattttag

SEQ ID NO: 31162 - DNA, 20 bp, Artificial Sequence
  Description of Artificial Sequence: Synthetic oligonucleotide
  Target: SCN9A; (-) strand; PAM type: NRG; PAM sequence: TAG
acacattcattttttaattt

SEQ ID NO: 31163 - DNA, 20 bp, Artificial Sequence
  Description of Artificial Sequence: Synthetic oligonucleotide
  Target: SCN9A; (-) strand; PAM type: NRG; PAM sequence: AAG
ctataggaaatcttagatac

SEQ ID NO: 31164 - DNA, 20 bp, Artificial Sequence
  Description of Artificial Sequence: Synthetic oligonucleotide
  Target: SCN9A; (-) strand; PAM type: NRG; PAM sequence: TAG
attttaactataggaaatct

SEQ ID NO: 31165 - DNA, 20 bp, Artificial Sequence
  Description of Artificial Sequence: Synthetic oligonucleotide
  Target: SCN9A; (-) strand; PAM type: NRG; PAM sequence: AGG
tccatattgattttaactat

SEQ ID NO: 31166 - DNA, 20 bp, Artificial Sequence
  Description of Artificial Sequence: Synthetic oligonucleotide
  Target: SCN9A; (-) strand; PAM type: NRG; PAM sequence: TAG
ttccatattgattttaacta

SEQ ID NO: 31167 - DNA, 20 bp, Artificial Sequence
  Description of Artificial Sequence: Synthetic oligonucleotide
  Target: SCN9A; (-) strand; PAM type: NRG; PAM sequence: CAG
atagaaaataagaaagagtt

SEQ ID NO: 31168 - DNA, 20 bp, Artificial Sequence
  Description of Artificial Sequence: Synthetic oligonucleotide
  Target: SCN9A; (-) strand; PAM type: NRG; PAM sequence: GAG
catacatagaaaataagaaa

SEQ ID NO: 31169 - DNA, 20 bp, Artificial Sequence
  Description of Artificial Sequence: Synthetic oligonucleotide
  Target: SCN9A; (-) strand; PAM type: NRG; PAM sequence: AAG
tgcatacatagaaaataaga

SEQ ID NO: 31170 - DNA, 20 bp, Artificial Sequence
  Description of Artificial Sequence: Synthetic oligonucleotide
  Target: SCN9A; (-) strand; PAM type: NRG; PAM sequence: AAG
tgtctgcatacatagaaaat

SEQ ID NO: 31171 - DNA, 20 bp, Artificial Sequence
  Description of Artificial Sequence: Synthetic oligonucleotide
  Target: SCN9A; (-) strand; PAM type: NRG; PAM sequence: TAG
tatgtgtgtgtctgcataca

SEQ ID NO: 31172 - DNA, 20 bp, Artificial Sequence
  Description of Artificial Sequence: Synthetic oligonucleotide
  Target: SCN9A; (-) strand; PAM type: NRG; PAM sequence: TAG
gatccatagatggataagca

SEQ ID NO: 31173 - DNA, 20 bp, Artificial Sequence
  Description of Artificial Sequence: Synthetic oligonucleotide
  Target: SCN9A; (-) strand; PAM type: NRG; PAM sequence: AAG
acatagatccatagatggat

SEQ ID NO: 31174 - DNA, 20 bp, Artificial Sequence
  Description of Artificial Sequence: Synthetic oligonucleotide
  Target: SCN9A; (-) strand; PAM type: NRG; PAM sequence: TGG
gacagacatagatccataga

SEQ ID NO: 31175 - DNA, 20 bp, Artificial Sequence
  Description of Artificial Sequence: Synthetic oligonucleotide
  Target: SCN9A; (-) strand; PAM type: NRG; PAM sequence: TAG
tttggacagacatagatcca

SEQ ID NO: 31176 - DNA, 20 bp, Artificial Sequence
  Description of Artificial Sequence: Synthetic oligonucleotide
  Target: SCN9A; (-) strand; PAM type: NRG; PAM sequence: TAG
atatgatatttggacagaca

SEQ ID NO: 31177 - DNA, 20 bp, Artificial Sequence
  Description of Artificial Sequence: Synthetic oligonucleotide
  Target: SCN9A; (-) strand; PAM type: NRG; PAM sequence: CAG
tacatgatatgatatttgga

SEQ ID NO: 31178 - DNA, 20 bp, Artificial Sequence
  Description of Artificial Sequence: Synthetic oligonucleotide
  Target: SCN9A; (-) strand; PAM type: NRG; PAM sequence: TGG
caaatacatgatatgatatt

SEQ ID NO: 31179 - DNA, 20 bp, Artificial Sequence
  Description of Artificial Sequence: Synthetic oligonucleotide
  Target: SCN9A; (-) strand; PAM type: NRG; PAM sequence: TAG
gaagaaaaatagatgctaga

SEQ ID NO: 31180 - DNA, 20 bp, Artificial Sequence
  Description of Artificial Sequence: Synthetic oligonucleotide
  Target: SCN9A; (-) strand; PAM type: NRG; PAM sequence: TAG
gtgtgaagaaaaatagatgc

SEQ ID NO: 31181 - DNA, 20 bp, Artificial Sequence
  Description of Artificial Sequence: Synthetic oligonucleotide
  Target: SCN9A; (-) strand; PAM type: NRG; PAM sequence: TAG
gaaagatgtgtgaagaaaaa

SEQ ID NO: 31182 - DNA, 20 bp, Artificial Sequence
  Description of Artificial Sequence: Synthetic oligonucleotide
  Target: SCN9A; (-) strand; PAM type: NRG; PAM sequence: AAG
tttgactggaaagatgtgtg

SEQ ID NO: 31183 - DNA, 20 bp, Artificial Sequence
  Description of Artificial Sequence: Synthetic oligonucleotide
  Target: SCN9A; (-) strand; PAM type: NRG; PAM sequence: AAG
ctgacattgctttgactgga

SEQ ID NO: 31184 - DNA, 20 bp, Artificial Sequence
  Description of Artificial Sequence: Synthetic oligonucleotide
  Target: SCN9A; (-) strand; PAM type: NRG; PAM sequence: TGG
ggagctgacattgctttgac

SEQ ID NO: 31185 - DNA, 20 bp, Artificial Sequence
  Description of Artificial Sequence: Synthetic oligonucleotide
  Target: SCN9A; (-) strand; PAM type: NRG; PAM sequence: GAG
agaccattttcatgaactgg

SEQ ID NO: 31186 - DNA, 20 bp, Artificial Sequence
  Description of Artificial Sequence: Synthetic oligonucleotide
  Target: SCN9A; (-) strand; PAM type: NRG; PAM sequence: GGG
taagaccattttcatgaact

SEQ ID NO: 31187 - DNA, 20 bp, Artificial Sequence
  Description of Artificial Sequence: Synthetic oligonucleotide
  Target: SCN9A; (-) strand; PAM type: NRG; PAM sequence: TGG
ataagaccattttcatgaac

SEQ ID NO: 31188 - DNA, 20 bp, Artificial Sequence
  Description of Artificial Sequence: Synthetic oligonucleotide
  Target: SCN9A; (-) strand; PAM type: NRG; PAM sequence: AAG
gtgtgataaacacatgggat

SEQ ID NO: 31189 - DNA, 20 bp, Artificial Sequence
  Description of Artificial Sequence: Synthetic oligonucleotide
  Target: SCN9A; (-) strand; PAM type: NRG; PAM sequence: GGG
agagagtgtgataaacacat

SEQ ID NO: 31190 - DNA, 20 bp, Artificial Sequence
  Description of Artificial Sequence: Synthetic oligonucleotide
  Target: SCN9A; (-) strand; PAM type: NRG; PAM sequence: TGG
cagagagtgtgataaacaca

SEQ ID NO: 31191 - DNA, 20 bp, Artificial Sequence
  Description of Artificial Sequence: Synthetic oligonucleotide
  Target: SCN9A; (-) strand; PAM type: NRG; PAM sequence: GAG
atggaaatttgaaggccaga

SEQ ID NO: 31192 - DNA, 20 bp, Artificial Sequence
  Description of Artificial Sequence: Synthetic oligonucleotide
  Target: SCN9A; (-) strand; PAM type: NRG; PAM sequence: GAG
caatggaaatttgaaggcca

SEQ ID NO: 31193 - DNA, 20 bp, Artificial Sequence
  Description of Artificial Sequence: Synthetic oligonucleotide
  Target: SCN9A; (-) strand; PAM type: NRG; PAM sequence: CAG
tgcaatggaaatttgaaggc

SEQ ID NO: 31194 - DNA, 20 bp, Artificial Sequence
  Description of Artificial Sequence: Synthetic oligonucleotide
  Target: SCN9A; (-) strand; PAM type: NRG; PAM sequence: AGG
ttactgcaatggaaatttga

SEQ ID NO: 31195 - DNA, 20 bp, Artificial Sequence
  Description of Artificial Sequence: Synthetic oligonucleotide
  Target: SCN9A; (-) strand; PAM type: NRG; PAM sequence: AAG
tttactgcaatggaaatttg

SEQ ID NO: 31196 - DNA, 20 bp, Artificial Sequence
  Description of Artificial Sequence: Synthetic oligonucleotide
  Target: SCN9A; (-) strand; PAM type: NRG; PAM sequence: TGG
catctttgtttttactgcaa

SEQ ID NO: 31197 - DNA, 20 bp, Artificial Sequence
  Description of Artificial Sequence: Synthetic oligonucleotide
  Target: SCN9A; (-) strand; PAM type: NRG; PAM sequence: TAG
ttttgtcttcctctggtttt

SEQ ID NO: 31198 - DNA, 20 bp, Artificial Sequence
  Description of Artificial Sequence: Synthetic oligonucleotide
  Target: SCN9A; (-) strand; PAM type: NRG; PAM sequence: TGG
taactttttttgtcttcctc

SEQ ID NO: 31199 - DNA, 20 bp, Artificial Sequence
  Description of Artificial Sequence: Synthetic oligonucleotide
  Target: SCN9A; (-) strand; PAM type: NRG; PAM sequence: GGG
ctgctttgatctcctcacta

SEQ ID NO: 31200 - DNA, 20 bp, Artificial Sequence
  Description of Artificial Sequence: Synthetic oligonucleotide
  Target: SCN9A; (-) strand; PAM type: NRG; PAM sequence: AGG
tctgctttgatctcctcact

SEQ ID NO: 31201 - DNA, 20 bp, Artificial Sequence
  Description of Artificial Sequence: Synthetic oligonucleotide
  Target: SCN9A; (-) strand; PAM type: NRG; PAM sequence: TAG
ttctgctttgatctcctcac

SEQ ID NO: 31202 - DNA, 20 bp, Artificial Sequence
  Description of Artificial Sequence: Synthetic oligonucleotide
  Target: SCN9A; (-) strand; PAM type: NRG; PAM sequence: TAG
cagatgagtgttctagactg

SEQ ID NO: 31203 - DNA, 20 bp, Artificial Sequence
  Description of Artificial Sequence: Synthetic oligonucleotide
  Target: SCN9A; (-) strand; PAM type: NRG; PAM sequence: TAG
acattctcagatgagtgttc

SEQ ID NO: 31204 - DNA, 20 bp, Artificial Sequence
  Description of Artificial Sequence: Synthetic oligonucleotide
  Target: SCN9A; (-) strand; PAM type: NRG; PAM sequence: GAG
aaattctaacattctcagat

SEQ ID NO: 31205 - DNA, 20 bp, Artificial Sequence
  Description of Artificial Sequence: Synthetic oligonucleotide
  Target: SCN9A; (-) strand; PAM type: NRG; PAM sequence: CAG
gaaagaaattctaacattct

SEQ ID NO: 31206 - DNA, 20 bp, Artificial Sequence
  Description of Artificial Sequence: Synthetic oligonucleotide
  Target: SCN9A; (-) strand; PAM type: NRG; PAM sequence: AAG
tctgtgacttctctgctaga

SEQ ID NO: 31207 - DNA, 20 bp, Artificial Sequence
  Description of Artificial Sequence: Synthetic oligonucleotide
  Target: SCN9A; (-) strand; PAM type: NRG; PAM sequence: TAG
gaaatctgtgacttctctgc

SEQ ID NO: 31208 - DNA, 20 bp, Artificial Sequence
  Description of Artificial Sequence: Synthetic oligonucleotide
  Target: SCN9A; (-) strand; PAM type: NRG; PAM sequence: TAG
tctacatcacatatttgcca

SEQ ID NO: 31209 - DNA, 20 bp, Artificial Sequence
  Description of Artificial Sequence: Synthetic oligonucleotide
  Target: SCN9A; (-) strand; PAM type: NRG; PAM sequence: TGG
attattgaataaataatcca

SEQ ID NO: 31210 - DNA, 20 bp, Artificial Sequence
  Description of Artificial Sequence: Synthetic oligonucleotide
  Target: SCN9A; (-) strand; PAM type: NRG; PAM sequence: GGG
tttaacatagagagggaagt

SEQ ID NO: 31211 - DNA, 20 bp, Artificial Sequence
  Description of Artificial Sequence: Synthetic oligonucleotide
  Target: SCN9A; (-) strand; PAM type: NRG; PAM sequence: TGG
atttaacatagagagggaag

SEQ ID NO: 31212 - DNA, 20 bp, Artificial Sequence
  Description of Artificial Sequence: Synthetic oligonucleotide
  Target: SCN9A; (-) strand; PAM type: NRG; PAM sequence: AAG
catatttaacatagagaggg

SEQ ID NO: 31213 - DNA, 20 bp, Artificial Sequence
  Description of Artificial Sequence: Synthetic oligonucleotide
  Target: SCN9A; (-) strand; PAM type: NRG; PAM sequence: GGG
ctacatatttaacatagaga

SEQ ID NO: 31214 - DNA, 20 bp, Artificial Sequence
  Description of Artificial Sequence: Synthetic oligonucleotide
  Target: SCN9A; (-) strand; PAM type: NRG; PAM sequence: AGG
gctacatatttaacatagag

SEQ ID NO: 31215 - DNA, 20 bp, Artificial Sequence
  Description of Artificial Sequence: Synthetic oligonucleotide
  Target: SCN9A; (-) strand; PAM type: NRG; PAM sequence: GAG
tgctacatatttaacataga

SEQ ID NO: 31216 - DNA, 20 bp, Artificial Sequence
  Description of Artificial Sequence: Synthetic oligonucleotide
  Target: SCN9A; (-) strand; PAM type: NRG; PAM sequence: GAG
tctgctacatatttaacata

SEQ ID NO: 31217 - DNA, 20 bp, Artificial Sequence
  Description of Artificial Sequence: Synthetic oligonucleotide
  Target: SCN9A; (-) strand; PAM type: NRG; PAM sequence: TAG
actctgctacatatttaaca

SEQ ID NO: 31218 - DNA, 20 bp, Artificial Sequence
  Description of Artificial Sequence: Synthetic oligonucleotide
  Target: SCN9A; (-) strand; PAM type: NRG; PAM sequence: GAG
atccttttggtgatagcttg

SEQ ID NO: 31219 - DNA, 20 bp, Artificial Sequence
  Description of Artificial Sequence: Synthetic oligonucleotide
  Target: SCN9A; (-) strand; PAM type: NRG; PAM sequence: TGG
ttatccttttggtgatagct

SEQ ID NO: 31220 - DNA, 20 bp, Artificial Sequence
  Description of Artificial Sequence: Synthetic oligonucleotide
  Target: SCN9A; (-) strand; PAM type: NRG; PAM sequence: TAG
agatattatccttttggtga

SEQ ID NO: 31221 - DNA, 20 bp, Artificial Sequence
  Description of Artificial Sequence: Synthetic oligonucleotide
  Target: SCN9A; (-) strand; PAM type: NRG; PAM sequence: TGG
taatgcagatattatccttt

SEQ ID NO: 31222 - DNA, 20 bp, Artificial Sequence
  Description of Artificial Sequence: Synthetic oligonucleotide
  Target: SCN9A; (-) strand; PAM type: NRG; PAM sequence: CAG
gagtcctaccttaattaatg

SEQ ID NO: 31223 - DNA, 20 bp, Artificial Sequence
  Description of Artificial Sequence: Synthetic oligonucleotide
  Target: SCN9A; (-) strand; PAM type: NRG; PAM sequence: GAG
aatggacatggataccctag

SEQ ID NO: 31224 - DNA, 20 bp, Artificial Sequence
  Description of Artificial Sequence: Synthetic oligonucleotide
  Target: SCN9A; (-) strand; PAM type: NRG; PAM sequence: AGG
aaaatggacatggataccct

SEQ ID NO: 31225 - DNA, 20 bp, Artificial Sequence
  Description of Artificial Sequence: Synthetic oligonucleotide
  Target: SCN9A; (-) strand; PAM type: NRG; PAM sequence: TAG
taaaatggacatggataccc

SEQ ID NO: 31226 - DNA, 20 bp, Artificial Sequence
  Description of Artificial Sequence: Synthetic oligonucleotide
  Target: SCN9A; (-) strand; PAM type: NRG; PAM sequence: TGG
ggttctagctaaaatggaca

SEQ ID NO: 31227 - DNA, 20 bp, Artificial Sequence
  Description of Artificial Sequence: Synthetic oligonucleotide
  Target: SCN9A; (-) strand; PAM type: NRG; PAM sequence: TGG
caccctggttctagctaaaa

SEQ ID NO: 31228 - DNA, 20 bp, Artificial Sequence
  Description of Artificial Sequence: Synthetic oligonucleotide
  Target: SCN9A; (-) strand; PAM type: NRG; PAM sequence: TAG
cctcgactccaccctggttc

SEQ ID NO: 31229 - DNA, 20 bp, Artificial Sequence
  Description of Artificial Sequence: Synthetic oligonucleotide
  Target: SCN9A; (-) strand; PAM type: NRG; PAM sequence: TGG
cctttccctcgactccaccc

SEQ ID NO: 31230 - DNA, 20 bp, Artificial Sequence
  Description of Artificial Sequence: Synthetic oligonucleotide
  Target: SCN9A; (-) strand; PAM type: NRG; PAM sequence: GAG
tggatgaggagtagataagg

SEQ ID NO: 31231 - DNA, 20 bp, Artificial Sequence
  Description of Artificial Sequence: Synthetic oligonucleotide
  Target: SCN9A; (-) strand; PAM type: NRG; PAM sequence: GGG
tatggatgaggagtagataa

SEQ ID NO: 31232 - DNA, 20 bp, Artificial Sequence
  Description of Artificial Sequence: Synthetic oligonucleotide
  Target: SCN9A; (-) strand; PAM type: NRG; PAM sequence: AGG
gtatggatgaggagtagata

SEQ ID NO: 31233 - DNA, 20 bp, Artificial Sequence
  Description of Artificial Sequence: Synthetic oligonucleotide
  Target: SCN9A; (-) strand; PAM type: NRG; PAM sequence: AAG
tgtatggatgaggagtagat

SEQ ID NO: 31234 - DNA, 20 bp, Artificial Sequence
  Description of Artificial Sequence: Synthetic oligonucleotide
  Target: SCN9A; (-) strand; PAM type: NRG; PAM sequence: TAG
taggatgtatggatgaggag

SEQ ID NO: 31235 - DNA, 20 bp, Artificial Sequence
  Description of Artificial Sequence: Synthetic oligonucleotide
  Target: SCN9A; (-) strand; PAM type: NRG; PAM sequence: GAG
ttttaggatgtatggatgag

SEQ ID NO: 31236 - DNA, 20 bp, Artificial Sequence
  Description of Artificial Sequence: Synthetic oligonucleotide
  Target: SCN9A; (-) strand; PAM type: NRG; PAM sequence: AGG
cattttaggatgtatggatg

SEQ ID NO: 31237 - DNA, 20 bp, Artificial Sequence
  Description of Artificial Sequence: Synthetic oligonucleotide
  Target: SCN9A; (-) strand; PAM type: NRG; PAM sequence: GAG
acattttaggatgtatggat

SEQ ID NO: 31238 - DNA, 20 bp, Artificial Sequence
  Description of Artificial Sequence: Synthetic oligonucleotide
  Target: SCN9A; (-) strand; PAM type: NRG; PAM sequence: TGG
aggctacattttaggatgta

SEQ ID NO: 31239 - DNA, 20 bp, Artificial Sequence
  Description of Artificial Sequence: Synthetic oligonucleotide
  Target: SCN9A; (-) strand; PAM type: NRG; PAM sequence: AGG
tgacaggcaggctacatttt

SEQ ID NO: 31240 - DNA, 20 bp, Artificial Sequence
  Description of Artificial Sequence: Synthetic oligonucleotide
  Target: SCN9A; (-) strand; PAM type: NRG; PAM sequence: TAG
ctgacaggcaggctacattt

SEQ ID NO: 31241 - DNA, 20 bp, Artificial Sequence
  Description of Artificial Sequence: Synthetic oligonucleotide
  Target: SCN9A; (-) strand; PAM type: NRG; PAM sequence: AGG
tgtatggtgtactgacaggc

SEQ ID NO: 31242 - DNA, 20 bp, Artificial Sequence
  Description of Artificial Sequence: Synthetic oligonucleotide
  Target: SCN9A; (-) strand; PAM type: NRG; PAM sequence: CAG
atgtatggtgtactgacagg

SEQ ID NO: 31243 - DNA, 20 bp, Artificial Sequence
  Description of Artificial Sequence: Synthetic oligonucleotide
  Target: SCN9A; (-) strand; PAM type: NRG; PAM sequence: AGG
tacatgtatggtgtactgac

SEQ ID NO: 31244 - DNA, 20 bp, Artificial Sequence
  Description of Artificial Sequence: Synthetic oligonucleotide
  Target: SCN9A; (-) strand; PAM type: NRG; PAM sequence: CAG
atacatgtatggtgtactga

SEQ ID NO: 31245 - DNA, 20 bp, Artificial Sequence
  Description of Artificial Sequence: Synthetic oligonucleotide
  Target: SCN9A; (-) strand; PAM type: NRG; PAM sequence: TGG
ggtctgtgtatatacatgta

SEQ ID NO: 31246 - DNA, 20 bp, Artificial Sequence
  Description of Artificial Sequence: Synthetic oligonucleotide
  Target: SCN9A; (-) strand; PAM type: NRG; PAM sequence: AGG
gaaagagagggatgactgaa

SEQ ID NO: 31247 - DNA, 20 bp, Artificial Sequence
  Description of Artificial Sequence: Synthetic oligonucleotide
  Target: SCN9A; (-) strand; PAM type: NRG; PAM sequence: AAG
tgaaagagagggatgactga

SEQ ID NO: 31248 - DNA, 20 bp, Artificial Sequence
  Description of Artificial Sequence: Synthetic oligonucleotide
  Target: SCN9A; (-) strand; PAM type: NRG; PAM sequence: GGG
aaatcctctcttgaaagaga

SEQ ID NO: 31249 - DNA, 20 bp, Artificial Sequence
  Description of Artificial Sequence: Synthetic oligonucleotide
  Target: SCN9A; (-) strand; PAM type: NRG; PAM sequence: AGG
caaatcctctcttgaaagag

SEQ ID NO: 31250 - DNA, 20 bp, Artificial Sequence
  Description of Artificial Sequence: Synthetic oligonucleotide
  Target: SCN9A; (-) strand; PAM type: NRG; PAM sequence: GAG
acaaatcctctcttgaaaga

SEQ ID NO: 31251 - DNA, 20 bp, Artificial Sequence
  Description of Artificial Sequence: Synthetic oligonucleotide
  Target: SCN9A; (-) strand; PAM type: NRG; PAM sequence: GAG
agacaaatcctctcttgaaa

SEQ ID NO: 31252 - DNA, 20 bp, Artificial Sequence
  Description of Artificial Sequence: Synthetic oligonucleotide
  Target: SCN9A; (-) strand; PAM type: NRG; PAM sequence: AAG
ccagacaaatcctctcttga

SEQ ID NO: 31253 - DNA, 20 bp, Artificial Sequence
  Description of Artificial Sequence: Synthetic oligonucleotide
  Target: SCN9A; (-) strand; PAM type: NRG; PAM sequence: CAG
ctttatacaggtctgtttcc

SEQ ID NO: 31254 - DNA, 20 bp, Artificial Sequence
  Description of Artificial Sequence: Synthetic oligonucleotide
  Target: SCN9A; (-) strand; PAM type: NRG; PAM sequence: AGG
gtttgcatctgtctttatac

SEQ ID NO: 31255 - DNA, 20 bp, Artificial Sequence
  Description of Artificial Sequence: Synthetic oligonucleotide
  Target: SCN9A; (-) strand; PAM type: NRG; PAM sequence: CAG
ggtttgcatctgtctttata

SEQ ID NO: 31256 - DNA, 20 bp, Artificial Sequence
  Description of Artificial Sequence: Synthetic oligonucleotide
  Target: SCN9A; (-) strand; PAM type: NRG; PAM sequence: AGG
aggccaggttggtgttggcc

SEQ ID NO: 31257 - DNA, 20 bp, Artificial Sequence
  Description of Artificial Sequence: Synthetic oligonucleotide
  Target: SCN9A; (-) strand; PAM type: NRG; PAM sequence: CAG
aaggccaggttggtgttggc

SEQ ID NO: 31258 - DNA, 20 bp, Artificial Sequence
  Description of Artificial Sequence: Synthetic oligonucleotide
  Target: SCN9A; (-) strand; PAM type: NRG; PAM sequence: TGG
aagaaaggccaggttggtgt

SEQ ID NO: 31259 - DNA, 20 bp, Artificial Sequence
  Description of Artificial Sequence: Synthetic oligonucleotide
  Target: SCN9A; (-) strand; PAM type: NRG; PAM sequence: TGG
ttatggaagaaaggccaggt

SEQ ID NO: 31260 - DNA, 20 bp, Artificial Sequence
  Description of Artificial Sequence: Synthetic oligonucleotide
  Target: SCN9A; (-) strand; PAM type: NRG; PAM sequence: AGG
atatttatggaagaaaggcc

SEQ ID NO: 31261 - DNA, 20 bp, Artificial Sequence
  Description of Artificial Sequence: Synthetic oligonucleotide
  Target: SCN9A; (-) strand; PAM type: NRG; PAM sequence: CAG
aatatttatggaagaaaggc

SEQ ID NO: 31262 - DNA, 20 bp, Artificial Sequence
  Description of Artificial Sequence: Synthetic oligonucleotide
  Target: SCN9A; (-) strand; PAM type: NRG; PAM sequence: AGG
tattaatatttatggaagaa

SEQ ID NO: 31263 - DNA, 20 bp, Artificial Sequence
  Description of Artificial Sequence: Synthetic oligonucleotide
  Target: SCN9A; (-) strand; PAM type: NRG; PAM sequence: AAG
ctattaatatttatggaaga

SEQ ID NO: 31264 - DNA, 20 bp, Artificial Sequence
  Description of Artificial Sequence: Synthetic oligonucleotide
  Target: SCN9A; (-) strand; PAM type: NRG; PAM sequence: AAG
taatctattaatatttatgg

SEQ ID NO: 31265 - DNA, 20 bp, Artificial Sequence
  Description of Artificial Sequence: Synthetic oligonucleotide
  Target: SCN9A; (-) strand; PAM type: NRG; PAM sequence: TGG
tgataatctattaatattta

SEQ ID NO: 31266 - DNA, 20 bp, Artificial Sequence
  Description of Artificial Sequence: Synthetic oligonucleotide
  Target: SCN9A; (-) strand; PAM type: NRG; PAM sequence: TAG
tctttcaattttatgtttgg

SEQ ID NO: 31267 - DNA, 20 bp, Artificial Sequence
  Description of Artificial Sequence: Synthetic oligonucleotide
  Target: SCN9A; (-) strand; PAM type: NRG; PAM sequence: TGG
tagtctttcaattttatgtt

SEQ ID NO: 31268 - DNA, 20 bp, Artificial Sequence
  Description of Artificial Sequence: Synthetic oligonucleotide
  Target: SCN9A; (-) strand; PAM type: NRG; PAM sequence: TAG
aaagtttggtctgttcatct

SEQ ID NO: 31269 - DNA, 20 bp, Artificial Sequence
  Description of Artificial Sequence: Synthetic oligonucleotide
  Target: SCN9A; (-) strand; PAM type: NRG; PAM sequence: TGG
tttttctaaagttaaaagtt

SEQ ID NO: 31270 - DNA, 20 bp, Artificial Sequence
  Description of Artificial Sequence: Synthetic oligonucleotide
  Target: SCN9A; (-) strand; PAM type: NRG; PAM sequence: AAG
ttttttttttctaaagttaa

SEQ ID NO: 31271 - DNA, 20 bp, Artificial Sequence
  Description of Artificial Sequence: Synthetic oligonucleotide
  Target: SCN9A; (-) strand; PAM type: NRG; PAM sequence: AAG
tgtttgcttttttttttcta

SEQ ID NO: 31272 - DNA, 20 bp, Artificial Sequence
  Description of Artificial Sequence: Synthetic oligonucleotide
  Target: SCN9A; (-) strand; PAM type: NRG; PAM sequence: AGG
ctgtctcctcaaatttctct

SEQ ID NO: 31273 - DNA, 20 bp, Artificial Sequence
  Description of Artificial Sequence: Synthetic oligonucleotide
  Target: SCN9A; (-) strand; PAM type: NRG; PAM sequence: TAG
tctgtctcctcaaatttctc

SEQ ID NO: 31274 - DNA, 20 bp, Artificial Sequence
  Description of Artificial Sequence: Synthetic oligonucleotide
  Target: SCN9A; (-) strand; PAM type: NRG; PAM sequence: AAG
ctattttttttttttaataa

SEQ ID NO: 31275 - DNA, 20 bp, Artificial Sequence
  Description of Artificial Sequence: Synthetic oligonucleotide
  Target: SCN9A; (-) strand; PAM type: NRG; PAM sequence: TAG
attgatgttgttgtttttgg

SEQ ID NO: 31276 - DNA, 20 bp, Artificial Sequence
  Description of Artificial Sequence: Synthetic oligonucleotide
  Target: SCN9A; (-) strand; PAM type: NRG; PAM sequence: TGG
agaattgatgttgttgtttt

SEQ ID NO: 31277 - DNA, 20 bp, Artificial Sequence
  Description of Artificial Sequence: Synthetic oligonucleotide
  Target: SCN9A; (-) strand; PAM type: NRG; PAM sequence: CAG
cacaaagcatgacctttacc

SEQ ID NO: 31278 - DNA, 20 bp, Artificial Sequence
  Description of Artificial Sequence: Synthetic oligonucleotide
  Target: SCN9A; (-) strand; PAM type: NRG; PAM sequence: AAG
ctgaaattttttgtttcaca

SEQ ID NO: 31279 - DNA, 20 bp, Artificial Sequence
  Description of Artificial Sequence: Synthetic oligonucleotide
  Target: SCN9A; (-) strand; PAM type: NRG; PAM sequence: AAG
tatgacttctccttttcagc

SEQ ID NO: 31280 - DNA, 20 bp, Artificial Sequence
  Description of Artificial Sequence: Synthetic oligonucleotide
  Target: SCN9A; (-) strand; PAM type: NRG; PAM sequence: CAG
caattatgacttctcctttt

SEQ ID NO: 31281 - DNA, 20 bp, Artificial Sequence
  Description of Artificial Sequence: Synthetic oligonucleotide
  Target: SCN9A; (-) strand; PAM type: NRG; PAM sequence: AGG
ccccttttgggtaaagtaaa

SEQ ID NO: 31282 - DNA, 20 bp, Artificial Sequence
  Description of Artificial Sequence: Synthetic oligonucleotide
  Target: SCN9A; (-) strand; PAM type: NRG; PAM sequence: AAG
gccccttttgggtaaagtaa

SEQ ID NO: 31283 - DNA, 20 bp, Artificial Sequence
  Description of Artificial Sequence: Synthetic oligonucleotide
  Target: SCN9A; (-) strand; PAM type: NRG; PAM sequence: AAG
taaagtgccccttttgggta

SEQ ID NO: 31284 - DNA, 20 bp, Artificial Sequence
  Description of Artificial Sequence: Synthetic oligonucleotide
  Target: SCN9A; (-) strand; PAM type: NRG; PAM sequence: GGG
tctggtaaagtgcccctttt

SEQ ID NO: 31285 - DNA, 20 bp, Artificial Sequence
  Description of Artificial Sequence: Synthetic oligonucleotide
  Target: SCN9A; (-) strand; PAM type: NRG; PAM sequence: TGG
ttctggtaaagtgccccttt

SEQ ID NO: 31286 - DNA, 20 bp, Artificial Sequence
  Description of Artificial Sequence: Synthetic oligonucleotide
  Target: SCN9A; (-) strand; PAM type: NRG; PAM sequence: AAG
actggtgccccattctggta

SEQ ID NO: 31287 - DNA, 20 bp, Artificial Sequence
  Description of Artificial Sequence: Synthetic oligonucleotide
  Target: SCN9A; (-) strand; PAM type: NRG; PAM sequence: TGG
tgctcactggtgccccattc

SEQ ID NO: 31288 - DNA, 20 bp, Artificial Sequence
  Description of Artificial Sequence: Synthetic oligonucleotide
  Target: SCN9A; (-) strand; PAM type: NRG; PAM sequence: TGG
tagcacctgagaatgctcac

SEQ ID NO: 31289 - DNA, 20 bp, Artificial Sequence
  Description of Artificial Sequence: Synthetic oligonucleotide
  Target: SCN9A; (-) strand; PAM type: NRG; PAM sequence: GAG
atagaacgtttctagcacct

SEQ ID NO: 31290 - DNA, 20 bp, Artificial Sequence
  Description of Artificial Sequence: Synthetic oligonucleotide
  Target: SCN9A; (-) strand; PAM type: NRG; PAM sequence: TAG
atcaaggtatagaacgtttc

SEQ ID NO: 31291 - DNA, 20 bp, Artificial Sequence
  Description of Artificial Sequence: Synthetic oligonucleotide
  Target: SCN9A; (-) strand; PAM type: NRG; PAM sequence: TAG
ccatcacatagatcaaggta

SEQ ID NO: 31292 - DNA, 20 bp, Artificial Sequence
  Description of Artificial Sequence: Synthetic oligonucleotide
  Target: SCN9A; (-) strand; PAM type: NRG; PAM sequence: AGG
tgtaaccatcacatagatca

SEQ ID NO: 31293 - DNA, 20 bp, Artificial Sequence
  Description of Artificial Sequence: Synthetic oligonucleotide
  Target: SCN9A; (-) strand; PAM type: NRG; PAM sequence: AAG
atgtaaccatcacatagatc

SEQ ID NO: 31294 - DNA, 20 bp, Artificial Sequence
  Description of Artificial Sequence: Synthetic oligonucleotide
  Target: SCN9A; (-) strand; PAM type: NRG; PAM sequence: TAG
tttcccatgtaaccatcaca

SEQ ID NO: 31295 - DNA, 20 bp, Artificial Sequence
  Description of Artificial Sequence: Synthetic oligonucleotide
  Target: SCN9A; (-) strand; PAM type: NRG; PAM sequence: TAG
atatagaaaaatctaagata

SEQ ID NO: 31296 - DNA, 20 bp, Artificial Sequence
  Description of Artificial Sequence: Synthetic oligonucleotide
  Target: SCN9A; (-) strand; PAM type: NRG; PAM sequence: AAG
taaaatatatagaaaaatct

SEQ ID NO: 31297 - DNA, 20 bp, Artificial Sequence
  Description of Artificial Sequence: Synthetic oligonucleotide
  Target: SCN9A; (-) strand; PAM type: NRG; PAM sequence: TAG
taaaattctcctaaaatata

SEQ ID NO: 31298 - DNA, 20 bp, Artificial Sequence
  Description of Artificial Sequence: Synthetic oligonucleotide
  Target: SCN9A; (-) strand; PAM type: NRG; PAM sequence: AAG
tggattattctgtatcttct

SEQ ID NO: 31299 - DNA, 20 bp, Artificial Sequence
  Description of Artificial Sequence: Synthetic oligonucleotide
  Target: SCN9A; (-) strand; PAM type: NRG; PAM sequence: TGG
gagactaatgtcgaacaaca

SEQ ID NO: 31300 - DNA, 20 bp, Artificial Sequence
  Description of Artificial Sequence: Synthetic oligonucleotide
  Target: SCN9A; (-) strand; PAM type: NRG; PAM sequence: GAG
ctactatttgctgctctctt

SEQ ID NO: 31301 - DNA, 20 bp, Artificial Sequence
  Description of Artificial Sequence: Synthetic oligonucleotide
  Target: SCN9A; (-) strand; PAM type: NRG; PAM sequence: TGG
acttttagcttgatgactct

SEQ ID NO: 31302 - DNA, 20 bp, Artificial Sequence
  Description of Artificial Sequence: Synthetic oligonucleotide
  Target: SCN9A; (-) strand; PAM type: NRG; PAM sequence: TAG
ttgatcttcttttgtacttt

SEQ ID NO: 31303 - DNA, 20 bp, Artificial Sequence
  Description of Artificial Sequence: Synthetic oligonucleotide
  Target: SCN9A; (-) strand; PAM type: NRG; PAM sequence: TGG
gctctaaactttcacaagaa

SEQ ID NO: 31304 - DNA, 20 bp, Artificial Sequence
  Description of Artificial Sequence: Synthetic oligonucleotide
  Target: SCN9A; (-) strand; PAM type: NRG; PAM sequence: AAG
ttaatgctctaaactttcac

SEQ ID NO: 31305 - DNA, 20 bp, Artificial Sequence
  Description of Artificial Sequence: Synthetic oligonucleotide
  Target: SCN9A; (-) strand; PAM type: NRG; PAM sequence: AAG
gttagttatcttatttttgg

SEQ ID NO: 31306 - DNA, 20 bp, Artificial Sequence
  Description of Artificial Sequence: Synthetic oligonucleotide
  Target: SCN9A; (-) strand; PAM type: NRG; PAM sequence: TGG
ttagttagttatcttatttt

SEQ ID NO: 31307 - DNA, 20 bp, Artificial Sequence
  Description of Artificial Sequence: Synthetic oligonucleotide
  Target: SCN9A; (-) strand; PAM type: NRG; PAM sequence: TAG
taattttcattctttttagt

SEQ ID NO: 31308 - DNA, 20 bp, Artificial Sequence
  Description of Artificial Sequence: Synthetic oligonucleotide
  Target: SCN9A; (-) strand; PAM type: NRG; PAM sequence: TAG
aatctaattttcattctttt

SEQ ID NO: 31309 - DNA, 20 bp, Artificial Sequence
  Description of Artificial Sequence: Synthetic oligonucleotide
  Target: SCN9A; (-) strand; PAM type: NRG; PAM sequence: TGG
tatggctaaggaaattttaa

SEQ ID NO: 31310 - DNA, 20 bp, Artificial Sequence
  Description of Artificial Sequence: Synthetic oligonucleotide
  Target: SCN9A; (-) strand; PAM type: NRG; PAM sequence: AGG
tctagtgtcaattatggcta

SEQ ID NO: 31311 - DNA, 20 bp, Artificial Sequence
  Description of Artificial Sequence: Synthetic oligonucleotide
  Target: SCN9A; (-) strand; PAM type: NRG; PAM sequence: AAG
ttctagtgtcaattatggct

SEQ ID NO: 31312 - DNA, 20 bp, Artificial Sequence
  Description of Artificial Sequence: Synthetic oligonucleotide
  Target: SCN9A; (-) strand; PAM type: NRG; PAM sequence: TGG
ttgtgttctagtgtcaatta

SEQ ID NO: 31313 - DNA, 20 bp, Artificial Sequence
  Description of Artificial Sequence: Synthetic oligonucleotide
  Target: SCN9A; (-) strand; PAM type: NRG; PAM sequence: TAG
tgaaagcattgattgtgttc

SEQ ID NO: 31314 - DNA, 20 bp, Artificial Sequence
  Description of Artificial Sequence: Synthetic oligonucleotide
  Target: SCN9A; (-) strand; PAM type: NRG; PAM sequence: AAG
attttctctcatcacactga

SEQ ID NO: 31315 - DNA, 20 bp, Artificial Sequence
  Description of Artificial Sequence: Synthetic oligonucleotide
  Target: SCN9A; (-) strand; PAM type: NRG; PAM sequence: TAG
gataataggttgtctgataa

SEQ ID NO: 31316 - DNA, 20 bp, Artificial Sequence
  Description of Artificial Sequence: Synthetic oligonucleotide
  Target: SCN9A; (-) strand; PAM type: NRG; PAM sequence: AGG
ttgccatcacacttgataat

SEQ ID NO: 31317 - DNA, 20 bp, Artificial Sequence
  Description of Artificial Sequence: Synthetic oligonucleotide
  Target: SCN9A; (-) strand; PAM type: NRG; PAM sequence: TAG
tttgccatcacacttgataa

SEQ ID NO: 31318 - DNA, 20 bp, Artificial Sequence
  Description of Artificial Sequence: Synthetic oligonucleotide
  Target: SCN9A; (-) strand; PAM type: NRG; PAM sequence: TAG
attttgaattttcttatacc

SEQ ID NO: 31319 - DNA, 20 bp, Artificial Sequence
  Description of Artificial Sequence: Synthetic oligonucleotide
  Target: SCN9A; (-) strand; PAM type: NRG; PAM sequence: GAG
taaaaaaaaaagataaaaag

SEQ ID NO: 31320 - DNA, 20 bp, Artificial Sequence
  Description of Artificial Sequence: Synthetic oligonucleotide
  Target: SCN9A; (-) strand; PAM type: NRG; PAM sequence: AGG
cttaaaaaaaaaagataaaa

SEQ ID NO: 31321 - DNA, 20 bp, Artificial Sequence
  Description of Artificial Sequence: Synthetic oligonucleotide
  Target: SCN9A; (-) strand; PAM type: NRG; PAM sequence: AAG
acttaaaaaaaaaagataaa

SEQ ID NO: 31322 - DNA, 20 bp, Artificial Sequence
  Description of Artificial Sequence: Synthetic oligonucleotide
  Target: SCN9A; (-) strand; PAM type: NRG; PAM sequence: AAG
ccaaagtaacttaaaaaaaa

SEQ ID NO: 31323 - DNA, 20 bp, Artificial Sequence
  Description of Artificial Sequence: Synthetic oligonucleotide
  Target: SCN9A; (-) strand; PAM type: NRG; PAM sequence: AAG
ttttgctctaccttaatcca

SEQ ID NO: 31324 - DNA, 20 bp, Artificial Sequence
  Description of Artificial Sequence: Synthetic oligonucleotide
  Target: SCN9A; (-) strand; PAM type: NRG; PAM sequence: AAG
ttgtattctatgtgttttag

SEQ ID NO: 31325 - DNA, 20 bp, Artificial Sequence
  Description of Artificial Sequence: Synthetic oligonucleotide
  Target: SCN9A; (-) strand; PAM type: NRG; PAM sequence: TAG
atcttgtattctatgtgttt

SEQ ID NO: 31326 - DNA, 20 bp, Artificial Sequence
  Description of Artificial Sequence: Synthetic oligonucleotide
  Target: SCN9A; (-) strand; PAM type: NRG; PAM sequence: AAG
atggctatttacacgttcta

SEQ ID NO: 31327 - DNA, 20 bp, Artificial Sequence
  Description of Artificial Sequence: Synthetic oligonucleotide
  Target: SCN9A; (-) strand; PAM type: NRG; PAM sequence: TGG
tgattcctatttggacaata

SEQ ID NO: 31328 - DNA, 20 bp, Artificial Sequence
  Description of Artificial Sequence: Synthetic oligonucleotide
  Target: SCN9A; (-) strand; PAM type: NRG; PAM sequence: TGG
attttgaattgattcctatt

SEQ ID NO: 31329 - DNA, 20 bp, Artificial Sequence
  Description of Artificial Sequence: Synthetic oligonucleotide
  Target: SCN9A; (-) strand; PAM type: NRG; PAM sequence: AAG
ttcaattctaccagttgttc

SEQ ID NO: 31330 - DNA, 20 bp, Artificial Sequence
  Description of Artificial Sequence: Synthetic oligonucleotide
  Target: SCN9A; (-) strand; PAM type: NRG; PAM sequence: CAG
cctctctgcttcaattctac

SEQ ID NO: 31331 - DNA, 20 bp, Artificial Sequence
  Description of Artificial Sequence: Synthetic oligonucleotide
  Target: SCN9A; (-) strand; PAM type: NRG; PAM sequence: TGG
aagaacacatcaaactcaag

SEQ ID NO: 31332 - DNA, 20 bp, Artificial Sequence
  Description of Artificial Sequence: Synthetic oligonucleotide
  Target: SCN9A; (-) strand; PAM type: NRG; PAM sequence: AAG
ttgaagaacacatcaaactc

SEQ ID NO: 31333 - DNA, 20 bp, Artificial Sequence
  Description of Artificial Sequence: Synthetic oligonucleotide
  Target: SCN9A; (-) strand; PAM type: NRG; PAM sequence: AAG
cattcaaactctgctacttg

SEQ ID NO: 31334 - DNA, 20 bp, Artificial Sequence
  Description of Artificial Sequence: Synthetic oligonucleotide
  Target: SCN9A; (-) strand; PAM type: NRG; PAM sequence: AGG
aacatggtttgatctagagg

SEQ ID NO: 31335 - DNA, 20 bp, Artificial Sequence
  Description of Artificial Sequence: Synthetic oligonucleotide
  Target: SCN9A; (-) strand; PAM type: NRG; PAM sequence: GAG
taacatggtttgatctagag

SEQ ID NO: 31336 - DNA, 20 bp, Artificial Sequence
  Description of Artificial Sequence: Synthetic oligonucleotide
  Target: SCN9A; (-) strand; PAM type: NRG; PAM sequence: AGG
agtaacatggtttgatctag

SEQ ID NO: 31337 - DNA, 20 bp, Artificial Sequence
  Description of Artificial Sequence: Synthetic oligonucleotide
  Target: SCN9A; (-) strand; PAM type: NRG; PAM sequence: GAG
aagtaacatggtttgatcta

SEQ ID NO: 31338 - DNA, 20 bp, Artificial Sequence
  Description of Artificial Sequence: Synthetic oligonucleotide
  Target: SCN9A; (-) strand; PAM type: NRG; PAM sequence: TAG
acaagtaacatggtttgatc

SEQ ID NO: 31339 - DNA, 20 bp, Artificial Sequence
  Description of Artificial Sequence: Synthetic oligonucleotide
  Target: SCN9A; (-) strand; PAM type: NRG; PAM sequence: TGG
tcattttaaaacaagtaaca

SEQ ID NO: 31340 - DNA, 20 bp, Artificial Sequence
  Description of Artificial Sequence: Synthetic oligonucleotide
  Target: SCN9A; (-) strand; PAM type: NRG; PAM sequence: AAG
tgtatttttcattttaaaac

SEQ ID NO: 31341 - DNA, 20 bp, Artificial Sequence
  Description of Artificial Sequence: Synthetic oligonucleotide
  Target: SCN9A; (-) strand; PAM type: NRG; PAM sequence: GAG
ttggtaattggcacatttgt

SEQ ID NO: 31342 - DNA, 20 bp, Artificial Sequence
  Description of Artificial Sequence: Synthetic oligonucleotide
  Target: SCN9A; (-) strand; PAM type: NRG; PAM sequence: TGG
tttatatatgctttggtaat

SEQ ID NO: 31343 - DNA, 20 bp, Artificial Sequence
  Description of Artificial Sequence: Synthetic oligonucleotide
  Target: SCN9A; (-) strand; PAM type: NRG; PAM sequence: TGG
cttacattttatatatgctt

SEQ ID NO: 31344 - DNA, 20 bp, Artificial Sequence
  Description of Artificial Sequence: Synthetic oligonucleotide
  Target: SCN9A; (-) strand; PAM type: NRG; PAM sequence: AAG
atcttgtctttgtgtaaata

SEQ ID NO: 31345 - DNA, 20 bp, Artificial Sequence
  Description of Artificial Sequence: Synthetic oligonucleotide
  Target: SCN9A; (-) strand; PAM type: NRG; PAM sequence: AAG
ctctacctctcaatttttgt

SEQ ID NO: 31346 - DNA, 20 bp, Artificial Sequence
  Description of Artificial Sequence: Synthetic oligonucleotide
  Target: SCN9A; (-) strand; PAM type: NRG; PAM sequence: CAG
ttcaatgtaagataaggggt

SEQ ID NO: 31347 - DNA, 20 bp, Artificial Sequence
  Description of Artificial Sequence: Synthetic oligonucleotide
  Target: SCN9A; (-) strand; PAM type: NRG; PAM sequence: GGG
tgccttcaatgtaagataag

SEQ ID NO: 31348 - DNA, 20 bp, Artificial Sequence
  Description of Artificial Sequence: Synthetic oligonucleotide
  Target: SCN9A; (-) strand; PAM type: NRG; PAM sequence: GGG
ctgccttcaatgtaagataa

SEQ ID NO: 31349 - DNA, 20 bp, Artificial Sequence
  Description of Artificial Sequence: Synthetic oligonucleotide
  Target: SCN9A; (-) strand; PAM type: NRG; PAM sequence: AGG
actgccttcaatgtaagata

SEQ ID NO: 31350 - DNA, 20 bp, Artificial Sequence
  Description of Artificial Sequence: Synthetic oligonucleotide
  Target: SCN9A; (-) strand; PAM type: NRG; PAM sequence: AAG
aactgccttcaatgtaagat

SEQ ID NO: 31351 - DNA, 20 bp, Artificial Sequence
  Description of Artificial Sequence: Synthetic oligonucleotide
  Target: SCN9A; (-) strand; PAM type: NRG; PAM sequence: AAG
gcactaactgccttcaatgt

SEQ ID NO: 31352 - DNA, 20 bp, Artificial Sequence
  Description of Artificial Sequence: Synthetic oligonucleotide
  Target: SCN9A; (-) strand; PAM type: NRG; PAM sequence: AGG
ttgttacttaaactttagcc

SEQ ID NO: 31353 - DNA, 20 bp, Artificial Sequence
  Description of Artificial Sequence: Synthetic oligonucleotide
  Target: SCN9A; (-) strand; PAM type: NRG; PAM sequence: CAG
cttgttacttaaactttagc

SEQ ID NO: 31354 - DNA, 20 bp, Artificial Sequence
  Description of Artificial Sequence: Synthetic oligonucleotide
  Target: SCN9A; (-) strand; PAM type: NRG; PAM sequence: TAG
atttcttgttacttaaactt

SEQ ID NO: 31355 - DNA, 20 bp, Artificial Sequence
  Description of Artificial Sequence: Synthetic oligonucleotide
  Target: SCN9A; (-) strand; PAM type: NRG; PAM sequence: TGG
gttggatttatacctttaaa

SEQ ID NO: 31356 - DNA, 20 bp, Artificial Sequence
  Description of Artificial Sequence: Synthetic oligonucleotide
  Target: SCN9A; (-) strand; PAM type: NRG; PAM sequence: TGG
ttctaagtaattctatgggt

SEQ ID NO: 31357 - DNA, 20 bp, Artificial Sequence
  Description of Artificial Sequence: Synthetic oligonucleotide
  Target: SCN9A; (-) strand; PAM type: NRG; PAM sequence: GGG
tcatttctaagtaattctat

SEQ ID NO: 31358 - DNA, 20 bp, Artificial Sequence
  Description of Artificial Sequence: Synthetic oligonucleotide
  Target: SCN9A; (-) strand; PAM type: NRG; PAM sequence: TGG
ttcatttctaagtaattcta

SEQ ID NO: 31359 - DNA, 20 bp, Artificial Sequence
  Description of Artificial Sequence: Synthetic oligonucleotide
  Target: SCN9A; (-) strand; PAM type: NRG; PAM sequence: AAG
gcagttatgttttcatttct

SEQ ID NO: 31360 - DNA, 20 bp, Artificial Sequence
  Description of Artificial Sequence: Synthetic oligonucleotide
  Target: SCN9A; (-) strand; PAM type: NRG; PAM sequence: CAG
ccccattctcaaattccaag

SEQ ID NO: 31361 - DNA, 20 bp, Artificial Sequence
  Description of Artificial Sequence: Synthetic oligonucleotide
  Target: SCN9A; (-) strand; PAM type: NRG; PAM sequence: AAG
ctgccccattctcaaattcc

SEQ ID NO: 31362 - DNA, 20 bp, Artificial Sequence
  Description of Artificial Sequence: Synthetic oligonucleotide
  Target: SCN9A; (-) strand; PAM type: NRG; PAM sequence: AGG
aactttctaatttgaaaatg

SEQ ID NO: 31363 - DNA, 20 bp, Artificial Sequence
  Description of Artificial Sequence: Synthetic oligonucleotide
  Target: SCN9A; (-) strand; PAM type: NRG; PAM sequence: GAG
taactttctaatttgaaaat

SEQ ID NO: 31364 - DNA, 20 bp, Artificial Sequence
  Description of Artificial Sequence: Synthetic oligonucleotide
  Target: SCN9A; (-) strand; PAM type: NRG; PAM sequence: AAG
cttcccgcttttttaaaaaa

SEQ ID NO: 31365 - DNA, 20 bp, Artificial Sequence
  Description of Artificial Sequence: Synthetic oligonucleotide
  Target: SCN9A; (-) strand; PAM type: NRG; PAM sequence: GGG
ccctttaaagccattatcta

SEQ ID NO: 31366 - DNA, 20 bp, Artificial Sequence
  Description of Artificial Sequence: Synthetic oligonucleotide
  Target: SCN9A; (-) strand; PAM type: NRG; PAM sequence: AGG
tccctttaaagccattatct

SEQ ID NO: 31367 - DNA, 20 bp, Artificial Sequence
  Description of Artificial Sequence: Synthetic oligonucleotide
  Target: SCN9A; (-) strand; PAM type: NRG; PAM sequence: TAG
atccctttaaagccattatc

SEQ ID NO: 31368 - DNA, 20 bp, Artificial Sequence
  Description of Artificial Sequence: Synthetic oligonucleotide
  Target: SCN9A; (-) strand; PAM type: NRG; PAM sequence: AAG
atttttgctttatcccttta

SEQ ID NO: 31369 - DNA, 20 bp, Artificial Sequence
  Description of Artificial Sequence: Synthetic oligonucleotide
  Target: SCN9A; (-) strand; PAM type: NRG; PAM sequence: TGG
ataaaattaacaaatgcaca

SEQ ID NO: 31370 - DNA, 20 bp, Artificial Sequence
  Description of Artificial Sequence: Synthetic oligonucleotide
  Target: SCN9A; (-) strand; PAM type: NRG; PAM sequence: CAG
taatatcttcttttatttta

SEQ ID NO: 31371 - DNA, 20 bp, Artificial Sequence
  Description of Artificial Sequence: Synthetic oligonucleotide
  Target: SCN9A; (-) strand; PAM type: NRG; PAM sequence: AGG
gtttctttggctcaagagag

SEQ ID NO: 31372 - DNA, 20 bp, Artificial Sequence
  Description of Artificial Sequence: Synthetic oligonucleotide
  Target: SCN9A; (-) strand; PAM type: NRG; PAM sequence: GAG
ggtttctttggctcaagaga

SEQ ID NO: 31373 - DNA, 20 bp, Artificial Sequence
  Description of Artificial Sequence: Synthetic oligonucleotide
  Target: SCN9A; (-) strand; PAM type: NRG; PAM sequence: GAG
ttggtttctttggctcaaga

SEQ ID NO: 31374 - DNA, 20 bp, Artificial Sequence
  Description of Artificial Sequence: Synthetic oligonucleotide
  Target: SCN9A; (-) strand; PAM type: NRG; PAM sequence: GAG
tgttggtttctttggctcaa

SEQ ID NO: 31375 - DNA, 20 bp, Artificial Sequence
  Description of Artificial Sequence: Synthetic oligonucleotide
  Target: SCN9A; (-) strand; PAM type: NRG; PAM sequence: AAG
tttgttggtttctttggctc

SEQ ID NO: 31376 - DNA, 20 bp, Artificial Sequence
  Description of Artificial Sequence: Synthetic oligonucleotide
  Target: SCN9A; (-) strand; PAM type: NRG; PAM sequence: TGG
cagctgtttgttggtttctt

SEQ ID NO: 31377 - DNA, 20 bp, Artificial Sequence
  Description of Artificial Sequence: Synthetic oligonucleotide
  Target: SCN9A; (-) strand; PAM type: NRG; PAM sequence: TGG
ctacttaagcagctgtttgt

SEQ ID NO: 31378 - DNA, 20 bp, Artificial Sequence
  Description of Artificial Sequence: Synthetic oligonucleotide
  Target: SCN9A; (-) strand; PAM type: NRG; PAM sequence: CAG
cagaacagtttctacttaag

SEQ ID NO: 31379 - DNA, 20 bp, Artificial Sequence
  Description of Artificial Sequence: Synthetic oligonucleotide
  Target: SCN9A; (-) strand; PAM type: NRG; PAM sequence: AAG
taacagaacagtttctactt

SEQ ID NO: 31380 - DNA, 20 bp, Artificial Sequence
  Description of Artificial Sequence: Synthetic oligonucleotide
  Target: SCN9A; (-) strand; PAM type: NRG; PAM sequence: CAG
gcccagtgaaggtaacagaa

SEQ ID NO: 31381 - DNA, 20 bp, Artificial Sequence
  Description of Artificial Sequence: Synthetic oligonucleotide
  Target: SCN9A; (-) strand; PAM type: NRG; PAM sequence: CAG
ttcaagcccagtgaaggtaa

SEQ ID NO: 31382 - DNA, 20 bp, Artificial Sequence
  Description of Artificial Sequence: Synthetic oligonucleotide
  Target: SCN9A; (-) strand; PAM type: NRG; PAM sequence: AGG
atatttttcaagcccagtga

SEQ ID NO: 31383 - DNA, 20 bp, Artificial Sequence
  Description of Artificial Sequence: Synthetic oligonucleotide
  Target: SCN9A; (-) strand; PAM type: NRG; PAM sequence: AAG
catatttttcaagcccagtg

SEQ ID NO: 31384 - DNA, 20 bp, Artificial Sequence
  Description of Artificial Sequence: Synthetic oligonucleotide
  Target: SCN9A; (-) strand; PAM type: NRG; PAM sequence: CAG
cagtccatatttttcaagcc

SEQ ID NO: 31385 - DNA, 20 bp, Artificial Sequence
  Description of Artificial Sequence: Synthetic oligonucleotide
  Target: SCN9A; (-) strand; PAM type: NRG; PAM sequence: AAG
agagtcagtccatatttttc

SEQ ID NO: 31386 - DNA, 20 bp, Artificial Sequence
  Description of Artificial Sequence: Synthetic oligonucleotide
  Target: SCN9A; (-) strand; PAM type: NRG; PAM sequence: CAG
gtgtttgaaaggtgtagagt

SEQ ID NO: 31387 - DNA, 20 bp, Artificial Sequence
  Description of Artificial Sequence: Synthetic oligonucleotide
  Target: SCN9A; (-) strand; PAM type: NRG; PAM sequence: GAG
tatggtgtttgaaaggtgta

SEQ ID NO: 31388 - DNA, 20 bp, Artificial Sequence
  Description of Artificial Sequence: Synthetic oligonucleotide
  Target: SCN9A; (-) strand; PAM type: NRG; PAM sequence: TAG
tatatggtgtttgaaaggtg

SEQ ID NO: 31389 - DNA, 20 bp, Artificial Sequence
  Description of Artificial Sequence: Synthetic oligonucleotide
  Target: SCN9A; (-) strand; PAM type: NRG; PAM sequence: AGG
ctaaatatatggtgtttgaa

SEQ ID NO: 31390 - DNA, 20 bp, Artificial Sequence
  Description of Artificial Sequence: Synthetic oligonucleotide
  Target: SCN9A; (-) strand; PAM type: NRG; PAM sequence: AAG
tctaaatatatggtgtttga

SEQ ID NO: 31391 - DNA, 20 bp, Artificial Sequence
  Description of Artificial Sequence: Synthetic oligonucleotide
  Target: SCN9A; (-) strand; PAM type: NRG; PAM sequence: TGG
aaataatgtatctaaatata

SEQ ID NO: 31392 - DNA, 20 bp, Artificial Sequence
  Description of Artificial Sequence: Synthetic oligonucleotide
  Target: SCN9A; (-) strand; PAM type: NRG; PAM sequence: GAG
tgtctccaatttacctgaaa

SEQ ID NO: 31393 - DNA, 20 bp, Artificial Sequence
  Description of Artificial Sequence: Synthetic oligonucleotide
  Target: SCN9A; (-) strand; PAM type: NRG; PAM sequence: AAG
attgtctccaatttacctga

SEQ ID NO: 31394 - DNA, 20 bp, Artificial Sequence
  Description of Artificial Sequence: Synthetic oligonucleotide
  Target: SCN9A; (-) strand; PAM type: NRG; PAM sequence: AAG
tgtcagatggtcccttgaag

SEQ ID NO: 31395 - DNA, 20 bp, Artificial Sequence
  Description of Artificial Sequence: Synthetic oligonucleotide
  Target: SCN9A; (-) strand; PAM type: NRG; PAM sequence: AAG
gtgtgtcagatggtcccttg

SEQ ID NO: 31396 - DNA, 20 bp, Artificial Sequence
  Description of Artificial Sequence: Synthetic oligonucleotide
  Target: SCN9A; (-) strand; PAM type: NRG; PAM sequence: TGG
agtgtttgcagtgtgtcaga

SEQ ID NO: 31397 - DNA, 20 bp, Artificial Sequence
  Description of Artificial Sequence: Synthetic oligonucleotide
  Target: SCN9A; (-) strand; PAM type: NRG; PAM sequence: CAG
tttgagtgtttgcagtgtgt

SEQ ID NO: 31398 - DNA, 20 bp, Artificial Sequence
  Description of Artificial Sequence: Synthetic oligonucleotide
  Target: SCN9A; (-) strand; PAM type: NRG; PAM sequence: CAG
actgtaactttgagtgtttg

SEQ ID NO: 31399 - DNA, 20 bp, Artificial Sequence
  Description of Artificial Sequence: Synthetic oligonucleotide
  Target: SCN9A; (-) strand; PAM type: NRG; PAM sequence: GAG
acaatctttactgtaacttt

SEQ ID NO: 31400 - DNA, 20 bp, Artificial Sequence
  Description of Artificial Sequence: Synthetic oligonucleotide
  Target: SCN9A; (-) strand; PAM type: NRG; PAM sequence: AAG
catctaagcagagaaagtag

SEQ ID NO: 31401 - DNA, 20 bp, Artificial Sequence
  Description of Artificial Sequence: Synthetic oligonucleotide
  Target: SCN9A; (-) strand; PAM type: NRG; PAM sequence: TAG
attcatctaagcagagaaag

SEQ ID NO: 31402 - DNA, 20 bp, Artificial Sequence
  Description of Artificial Sequence: Synthetic oligonucleotide
  Target: SCN9A; (-) strand; PAM type: NRG; PAM sequence: AAG
agtattcatctaagcagaga

SEQ ID NO: 31403 - DNA, 20 bp, Artificial Sequence
  Description of Artificial Sequence: Synthetic oligonucleotide
  Target: SCN9A; (-) strand; PAM type: NRG; PAM sequence: GAG
gttcagtattcatctaagca

SEQ ID NO: 31404 - DNA, 20 bp, Artificial Sequence
  Description of Artificial Sequence: Synthetic oligonucleotide
  Target: SCN9A; (-) strand; PAM type: NRG; PAM sequence: CAG
gtgttcagtattcatctaag

SEQ ID NO: 31405 - DNA, 20 bp, Artificial Sequence
  Description of Artificial Sequence: Synthetic oligonucleotide
  Target: SCN9A; (-) strand; PAM type: NRG; PAM sequence: AAG
gaagtgttcagtattcatct

SEQ ID NO: 31406 - DNA, 20 bp, Artificial Sequence
  Description of Artificial Sequence: Synthetic oligonucleotide
  Target: SCN9A; (-) strand; PAM type: NRG; PAM sequence: CAG
gtagcacccaatgaagtgtt

SEQ ID NO: 31407 - DNA, 20 bp, Artificial Sequence
  Description of Artificial Sequence: Synthetic oligonucleotide
  Target: SCN9A; (-) strand; PAM type: NRG; PAM sequence: AAG
gccattggtagcacccaatg

SEQ ID NO: 31408 - DNA, 20 bp, Artificial Sequence
  Description of Artificial Sequence: Synthetic oligonucleotide
  Target: SCN9A; (-) strand; PAM type: NRG; PAM sequence: TAG
ttcagcaagccagccattgg

SEQ ID NO: 31409 - DNA, 20 bp, Artificial Sequence
  Description of Artificial Sequence: Synthetic oligonucleotide
  Target: SCN9A; (-) strand; PAM type: NRG; PAM sequence: TGG
gcattcagcaagccagccat

SEQ ID NO: 31410 - DNA, 20 bp, Artificial Sequence
  Description of Artificial Sequence: Synthetic oligonucleotide
  Target: SCN9A; (-) strand; PAM type: NRG; PAM sequence: CAG
aaaccatgcattcagcaagc

SEQ ID NO: 31411 - DNA, 20 bp, Artificial Sequence
  Description of Artificial Sequence: Synthetic oligonucleotide
  Target: SCN9A; (-) strand; PAM type: NRG; PAM sequence: AAG
ttgaaaaccatgcattcagc

SEQ ID NO: 31412 - DNA, 20 bp, Artificial Sequence
  Description of Artificial Sequence: Synthetic oligonucleotide
  Target: SCN9A; (-) strand; PAM type: NRG; PAM sequence: CAG
attgttgaaaaccatgcatt

SEQ ID NO: 31413 - DNA, 20 bp, Artificial Sequence
  Description of Artificial Sequence: Synthetic oligonucleotide
  Target: SCN9A; (-) strand; PAM type: NRG; PAM sequence: AAG
aattggtgtcagataatagg

SEQ ID NO: 31414 - DNA, 20 bp, Artificial Sequence
  Description of Artificial Sequence: Synthetic oligonucleotide
  Target: SCN9A; (-) strand; PAM type: NRG; PAM sequence: AGG
aagaattggtgtcagataat

SEQ ID NO: 31415 - DNA, 20 bp, Artificial Sequence
  Description of Artificial Sequence: Synthetic oligonucleotide
  Target: SCN9A; (-) strand; PAM type: NRG; PAM sequence: TAG
gaagaattggtgtcagataa

SEQ ID NO: 31416 - DNA, 20 bp, Artificial Sequence
  Description of Artificial Sequence: Synthetic oligonucleotide
  Target: SCN9A; (-) strand; PAM type: NRG; PAM sequence: CAG
cactatggaagaattggtgt

SEQ ID NO: 31417 - DNA, 20 bp, Artificial Sequence
  Description of Artificial Sequence: Synthetic oligonucleotide
  Target: SCN9A; (-) strand; PAM type: NRG; PAM sequence: TGG
aaagctcactatggaagaat

SEQ ID NO: 31418 - DNA, 20 bp, Artificial Sequence
  Description of Artificial Sequence: Synthetic oligonucleotide
  Target: SCN9A; (-) strand; PAM type: NRG; PAM sequence: AAG
catctcaaagctcactatgg

SEQ ID NO: 31419 - DNA, 20 bp, Artificial Sequence
  Description of Artificial Sequence: Synthetic oligonucleotide
  Target: SCN9A; (-) strand; PAM type: NRG; PAM sequence: TGG
ccacatctcaaagctcacta

SEQ ID NO: 31420 - DNA, 20 bp, Artificial Sequence
  Description of Artificial Sequence: Synthetic oligonucleotide
  Target: SCN9A; (-) strand; PAM type: NRG; PAM sequence: AAG
catgtaatgcccacatctca

SEQ ID NO: 31421 - DNA, 20 bp, Artificial Sequence
  Description of Artificial Sequence: Synthetic oligonucleotide
  Target: SCN9A; (-) strand; PAM type: NRG; PAM sequence: AAG
tgttgtgggttattggtatt

SEQ ID NO: 31422 - DNA, 20 bp, Artificial Sequence
  Description of Artificial Sequence: Synthetic oligonucleotide
  Target: SCN9A; (-) strand; PAM type: NRG; PAM sequence: TGG
aattttgtgttgtgggttat

SEQ ID NO: 31423 - DNA, 20 bp, Artificial Sequence
  Description of Artificial Sequence: Synthetic oligonucleotide
  Target: SCN9A; (-) strand; PAM type: NRG; PAM sequence: GGG
aaacattaattttgtgttgt

SEQ ID NO: 31424 - DNA, 20 bp, Artificial Sequence
  Description of Artificial Sequence: Synthetic oligonucleotide
  Target: SCN9A; (-) strand; PAM type: NRG; PAM sequence: TGG
aaaacattaattttgtgttg

SEQ ID NO: 31425 - DNA, 20 bp, Artificial Sequence
  Description of Artificial Sequence: Synthetic oligonucleotide
  Target: SCN9A; (-) strand; PAM type: NRG; PAM sequence: CAG
agtagtattttggaaaacag

SEQ ID NO: 31426 - DNA, 20 bp, Artificial Sequence
  Description of Artificial Sequence: Synthetic oligonucleotide
  Target: SCN9A; (-) strand; PAM type: NRG; PAM sequence: CAG
aacagtagtattttggaaaa

SEQ ID NO: 31427 - DNA, 20 bp, Artificial Sequence
  Description of Artificial Sequence: Synthetic oligonucleotide
  Target: SCN9A; (-) strand; PAM type: NRG; PAM sequence: TGG
attttaaaacagtagtattt

SEQ ID NO: 31428 - DNA, 20 bp, Artificial Sequence
  Description of Artificial Sequence: Synthetic oligonucleotide
  Target: SCN9A; (-) strand; PAM type: NRG; PAM sequence: TAG
tgaaagggattttaaaacag

SEQ ID NO: 31429 - DNA, 20 bp, Artificial Sequence
  Description of Artificial Sequence: Synthetic oligonucleotide
  Target: SCN9A; (-) strand; PAM type: NRG; PAM sequence: CAG
aagtgaaagggattttaaaa

SEQ ID NO: 31430 - DNA, 20 bp, Artificial Sequence
  Description of Artificial Sequence: Synthetic oligonucleotide
  Target: SCN9A; (-) strand; PAM type: NRG; PAM sequence: GGG
attacctaacataagtgaaa

SEQ ID NO: 31431 - DNA, 20 bp, Artificial Sequence
  Description of Artificial Sequence: Synthetic oligonucleotide
  Target: SCN9A; (-) strand; PAM type: NRG; PAM sequence: AGG
cattacctaacataagtgaa

SEQ ID NO: 31432 - DNA, 20 bp, Artificial Sequence
  Description of Artificial Sequence: Synthetic oligonucleotide
  Target: SCN9A; (-) strand; PAM type: NRG; PAM sequence: AAG
acattacctaacataagtga

SEQ ID NO: 31433 - DNA, 20 bp, Artificial Sequence
  Description of Artificial Sequence: Synthetic oligonucleotide
  Target: SCN9A; (-) strand; PAM type: NRG; PAM sequence: AAG
tttttaacattacctaacat

SEQ ID NO: 31434 - DNA, 20 bp, Artificial Sequence
  Description of Artificial Sequence: Synthetic oligonucleotide
  Target: SCN9A; (-) strand; PAM type: NRG; PAM sequence: TAG
ccatagagacaaatgatact

SEQ ID NO: 31435 - DNA, 20 bp, Artificial Sequence
  Description of Artificial Sequence: Synthetic oligonucleotide
  Target: SCN9A; (-) strand; PAM type: NRG; PAM sequence: GAG
atacactcttgacaaccata

SEQ ID NO: 31436 - DNA, 20 bp, Artificial Sequence
  Description of Artificial Sequence: Synthetic oligonucleotide
  Target: SCN9A; (-) strand; PAM type: NRG; PAM sequence: TAG
atatacactcttgacaacca

SEQ ID NO: 31437 - DNA, 20 bp, Artificial Sequence
  Description of Artificial Sequence: Synthetic oligonucleotide
  Target: SCN9A; (-) strand; PAM type: NRG; PAM sequence: GAG
cctggtcaatagccacagtg

SEQ ID NO: 31438 - DNA, 20 bp, Artificial Sequence
  Description of Artificial Sequence: Synthetic oligonucleotide
  Target: SCN9A; (-) strand; PAM type: NRG; PAM sequence: TGG
accctggtcaatagccacag

SEQ ID NO: 31439 - DNA, 20 bp, Artificial Sequence
  Description of Artificial Sequence: Synthetic oligonucleotide
  Target: SCN9A; (-) strand; PAM type: NRG; PAM sequence: CAG
tataccctggtcaatagcca

SEQ ID NO: 31440 - DNA, 20 bp, Artificial Sequence
  Description of Artificial Sequence: Synthetic oligonucleotide
  Target: SCN9A; (-) strand; PAM type: NRG; PAM sequence: TAG
tttttgtataccctggtcaa

SEQ ID NO: 31441 - DNA, 20 bp, Artificial Sequence
  Description of Artificial Sequence: Synthetic oligonucleotide
  Target: SCN9A; (-) strand; PAM type: NRG; PAM sequence: TGG
gatgatttttttgtataccc

SEQ ID NO: 31442 - DNA, 20 bp, Artificial Sequence
  Description of Artificial Sequence: Synthetic oligonucleotide
  Target: SCN9A; (-) strand; PAM type: NRG; PAM sequence: CAG
ctgtatttttttaggttaca

SEQ ID NO: 31443 - DNA, 20 bp, Artificial Sequence
  Description of Artificial Sequence: Synthetic oligonucleotide
  Target: SCN9A; (-) strand; PAM type: NRG; PAM sequence: AGG
cctggcatctgtattttttt

SEQ ID NO: 31444 - DNA, 20 bp, Artificial Sequence
  Description of Artificial Sequence: Synthetic oligonucleotide
  Target: SCN9A; (-) strand; PAM type: NRG; PAM sequence: TAG
ccctggcatctgtatttttt

SEQ ID NO: 31445 - DNA, 20 bp, Artificial Sequence
  Description of Artificial Sequence: Synthetic oligonucleotide
  Target: SCN9A; (-) strand; PAM type: NRG; PAM sequence: TGG
agcattacttagataagccc

SEQ ID NO: 31446 - DNA, 20 bp, Artificial Sequence
  Description of Artificial Sequence: Synthetic oligonucleotide
  Target: SCN9A; (-) strand; PAM type: NRG; PAM sequence: AAG
tatttcagcattacttagat

SEQ ID NO: 31447 - DNA, 20 bp, Artificial Sequence
  Description of Artificial Sequence: Synthetic oligonucleotide
  Target: SCN9A; (-) strand; PAM type: NRG; PAM sequence: TAG
acttttatttcagcattact

SEQ ID NO: 31448 - DNA, 20 bp, Artificial Sequence
  Description of Artificial Sequence: Synthetic oligonucleotide
  Target: SCN9A; (-) strand; PAM type: NRG; PAM sequence: CAG
cttccctaaaacttttattt

SEQ ID NO: 31449 - DNA, 20 bp, Artificial Sequence
  Description of Artificial Sequence: Synthetic oligonucleotide
  Target: SCN9A; (-) strand; PAM type: NRG; PAM sequence: TAG
tattttatgctttttaaaag

SEQ ID NO: 31450 - DNA, 20 bp, Artificial Sequence
  Description of Artificial Sequence: Synthetic oligonucleotide
  Target: SCN9A; (-) strand; PAM type: NRG; PAM sequence: AAG
tagtattttatgctttttaa

SEQ ID NO: 31451 - DNA, 20 bp, Artificial Sequence
  Description of Artificial Sequence: Synthetic oligonucleotide
  Target: SCN9A; (-) strand; PAM type: NRG; PAM sequence: TAG
atcaaatggagggttcacgt

SEQ ID NO: 31452 - DNA, 20 bp, Artificial Sequence
  Description of Artificial Sequence: Synthetic oligonucleotide
  Target: SCN9A; (-) strand; PAM type: NRG; PAM sequence: GGG
atttaacaaaatcaaatgga

SEQ ID NO: 31453 - DNA, 20 bp, Artificial Sequence
  Description of Artificial Sequence: Synthetic oligonucleotide
  Target: SCN9A; (-) strand; PAM type: NRG; PAM sequence: AGG
gatttaacaaaatcaaatgg

SEQ ID NO: 31454 - DNA, 20 bp, Artificial Sequence
  Description of Artificial Sequence: Synthetic oligonucleotide
  Target: SCN9A; (-) strand; PAM type: NRG; PAM sequence: GAG
tgatttaacaaaatcaaatg

SEQ ID NO: 31455 - DNA, 20 bp, Artificial Sequence
  Description of Artificial Sequence: Synthetic oligonucleotide
  Target: SCN9A; (-) strand; PAM type: NRG; PAM sequence: TGG
tttgatttaacaaaatcaaa

SEQ ID NO: 31456 - DNA, 20 bp, Artificial Sequence
  Description of Artificial Sequence: Synthetic oligonucleotide
  Target: SCN9A; (-) strand; PAM type: NRG; PAM sequence: TGG
tccttttgaataataaaacc

SEQ ID NO: 31457 - DNA, 20 bp, Artificial Sequence
  Description of Artificial Sequence: Synthetic oligonucleotide
  Target: SCN9A; (-) strand; PAM type: NRG; PAM sequence: AAG
ttttaaaatagttaacttta

SEQ ID NO: 31458 - DNA, 20 bp, Artificial Sequence
  Description of Artificial Sequence: Synthetic oligonucleotide
  Target: SCN9A; (-) strand; PAM type: NRG; PAM sequence: TAG
tatcctttccaattttaaaa

SEQ ID NO: 31459 - DNA, 20 bp, Artificial Sequence
  Description of Artificial Sequence: Synthetic oligonucleotide
  Target: SCN9A; (-) strand; PAM type: NRG; PAM sequence: TGG
actgtgcctggtctattgaa

SEQ ID NO: 31460 - DNA, 20 bp, Artificial Sequence
  Description of Artificial Sequence: Synthetic oligonucleotide
  Target: SCN9A; (-) strand; PAM type: NRG; PAM sequence: TGG
caggcacgagccactgtgcc

SEQ ID NO: 31461 - DNA, 20 bp, Artificial Sequence
  Description of Artificial Sequence: Synthetic oligonucleotide
  Target: SCN9A; (-) strand; PAM type: NRG; PAM sequence: GAG
aatgttggaattacaggcac

SEQ ID NO: 31462 - DNA, 20 bp, Artificial Sequence
  Description of Artificial Sequence: Synthetic oligonucleotide
  Target: SCN9A; (-) strand; PAM type: NRG; PAM sequence: AGG
tccgaaaatgttggaattac

SEQ ID NO: 31463 - DNA, 20 bp, Artificial Sequence
  Description of Artificial Sequence: Synthetic oligonucleotide
  Target: SCN9A; (-) strand; PAM type: NRG; PAM sequence: CAG
ctccgaaaatgttggaatta

SEQ ID NO: 31464 - DNA, 20 bp, Artificial Sequence
  Description of Artificial Sequence: Synthetic oligonucleotide
  Target: SCN9A; (-) strand; PAM type: NRG; PAM sequence: TGG
gccttggcctccgaaaatgt

SEQ ID NO: 31465 - DNA, 20 bp, Artificial Sequence
  Description of Artificial Sequence: Synthetic oligonucleotide
  Target: SCN9A; (-) strand; PAM type: NRG; PAM sequence: TGG
ctcaagtgattcacccgcct

SEQ ID NO: 31466 - DNA, 20 bp, Artificial Sequence
  Description of Artificial Sequence: Synthetic oligonucleotide
  Target: SCN9A; (-) strand; PAM type: NRG; PAM sequence: AAG
gttcttgaactcctgccctc

SEQ ID NO: 31467 - DNA, 20 bp, Artificial Sequence
  Description of Artificial Sequence: Synthetic oligonucleotide
  Target: SCN9A; (-) strand; PAM type: NRG; PAM sequence: GGG
ttgtacttttcctagagaca

SEQ ID NO: 31468 - DNA, 20 bp, Artificial Sequence
  Description of Artificial Sequence: Synthetic oligonucleotide
  Target: SCN9A; (-) strand; PAM type: NRG; PAM sequence: AGG
tttgtacttttcctagagac

SEQ ID NO: 31469 - DNA, 20 bp, Artificial Sequence
  Description of Artificial Sequence: Synthetic oligonucleotide
  Target: SCN9A; (-) strand; PAM type: NRG; PAM sequence: CAG
ttttgtacttttcctagaga

SEQ ID NO: 31470 - DNA, 20 bp, Artificial Sequence
  Description of Artificial Sequence: Synthetic oligonucleotide
  Target: SCN9A; (-) strand; PAM type: NRG; PAM sequence: GAG
taatttttgtacttttccta

SEQ ID NO: 31471 - DNA, 20 bp, Artificial Sequence
  Description of Artificial Sequence: Synthetic oligonucleotide
  Target: SCN9A; (-) strand; PAM type: NRG; PAM sequence: TAG
gctaatttttgtacttttcc

SEQ ID NO: 31472 - DNA, 20 bp, Artificial Sequence
  Description of Artificial Sequence: Synthetic oligonucleotide
  Target: SCN9A; (-) strand; PAM type: NRG; PAM sequence: TGG
caggtgcacagctccatgcc

SEQ ID NO: 31473 - DNA, 20 bp, Artificial Sequence
  Description of Artificial Sequence: Synthetic oligonucleotide
  Target: SCN9A; (-) strand; PAM type: NRG; PAM sequence: CAG
cagctgagactacaggtgca

SEQ ID NO: 31474 - DNA, 20 bp, Artificial Sequence
  Description of Artificial Sequence: Synthetic oligonucleotide
  Target: SCN9A; (-) strand; PAM type: NRG; PAM sequence: AGG
tctcaagcagctgagactac

SEQ ID NO: 31475 - DNA, 20 bp, Artificial Sequence
  Description of Artificial Sequence: Synthetic oligonucleotide
  Target: SCN9A; (-) strand; PAM type: NRG; PAM sequence: CAG
ctctcaagcagctgagacta

SEQ ID NO: 31476 - DNA, 20 bp, Artificial Sequence
  Description of Artificial Sequence: Synthetic oligonucleotide
  Target: SCN9A; (-) strand; PAM type: NRG; PAM sequence: GAG
ttagctactctcaagcagct

SEQ ID NO: 31477 - DNA, 20 bp, Artificial Sequence
  Description of Artificial Sequence: Synthetic oligonucleotide
  Target: SCN9A; (-) strand; PAM type: NRG; PAM sequence: CAG
ccaccttagctactctcaag

SEQ ID NO: 31478 - DNA, 20 bp, Artificial Sequence
  Description of Artificial Sequence: Synthetic oligonucleotide
  Target: SCN9A; (-) strand; PAM type: NRG; PAM sequence: AAG
ctcccaccttagctactctc

SEQ ID NO: 31479 - DNA, 20 bp, Artificial Sequence
  Description of Artificial Sequence: Synthetic oligonucleotide
  Target: SCN9A; (-) strand; PAM type: NRG; PAM sequence: TAG
ctcaggtgatcctcccacct

SEQ ID NO: 31480 - DNA, 20 bp, Artificial Sequence
  Description of Artificial Sequence: Synthetic oligonucleotide
  Target: SCN9A; (-) strand; PAM type: NRG; PAM sequence: AGG
gactcaacctccccaggctc

SEQ ID NO: 31481 - DNA, 20 bp, Artificial Sequence
  Description of Artificial Sequence: Synthetic oligonucleotide
  Target: SCN9A; (-) strand; PAM type: NRG; PAM sequence: CAG
agactcaacctccccaggct

SEQ ID NO: 31482 - DNA, 20 bp, Artificial Sequence
  Description of Artificial Sequence: Synthetic oligonucleotide
  Target: SCN9A; (-) strand; PAM type: NRG; PAM sequence: AGG
actgcagactcaacctcccc

SEQ ID NO: 31483 - DNA, 20 bp, Artificial Sequence
  Description of Artificial Sequence: Synthetic oligonucleotide
  Target: SCN9A; (-) strand; PAM type: NRG; PAM sequence: CAG
cactgcagactcaacctccc

SEQ ID NO: 31484 - DNA, 20 bp, Artificial Sequence
  Description of Artificial Sequence: Synthetic oligonucleotide
  Target: SCN9A; (-) strand; PAM type: NRG; PAM sequence: CAG
ggtgtgatcatggctcactg

SEQ ID NO: 31485 - DNA, 20 bp, Artificial Sequence
  Description of Artificial Sequence: Synthetic oligonucleotide
  Target: SCN9A; (-) strand; PAM type: NRG; PAM sequence: TGG
ggaccgcagtggtgtgatca

SEQ ID NO: 31486 - DNA, 20 bp, Artificial Sequence
  Description of Artificial Sequence: Synthetic oligonucleotide
  Target: SCN9A; (-) strand; PAM type: NRG; PAM sequence: TGG
tcatccaagctggaccgcag

SEQ ID NO: 31487 - DNA, 20 bp, Artificial Sequence
  Description of Artificial Sequence: Synthetic oligonucleotide
  Target: SCN9A; (-) strand; PAM type: NRG; PAM sequence: CAG
ctgtcatccaagctggaccg

SEQ ID NO: 31488 - DNA, 20 bp, Artificial Sequence
  Description of Artificial Sequence: Synthetic oligonucleotide
  Target: SCN9A; (-) strand; PAM type: NRG; PAM sequence: TGG
tctctgtctgtcatccaagc

SEQ ID NO: 31489 - DNA, 20 bp, Artificial Sequence
  Description of Artificial Sequence: Synthetic oligonucleotide
  Target: SCN9A; (-) strand; PAM type: NRG; PAM sequence: AAG
agggtctctgtctgtcatcc

SEQ ID NO: 31490 - DNA, 20 bp, Artificial Sequence
  Description of Artificial Sequence: Synthetic oligonucleotide
  Target: SCN9A; (-) strand; PAM type: NRG; PAM sequence: GGG
ttttttttttttttgagaca

SEQ ID NO: 31491 - DNA, 20 bp, Artificial Sequence
  Description of Artificial Sequence: Synthetic oligonucleotide
  Target: SCN9A; (-) strand; PAM type: NRG; PAM sequence: AGG
tttttttttttttttgagac

SEQ ID NO: 31492 - DNA, 20 bp, Artificial Sequence
  Description of Artificial Sequence: Synthetic oligonucleotide
  Target: SCN9A; (-) strand; PAM type: NRG; PAM sequence: CAG
ttttttttttttttttgaga

SEQ ID NO: 31493 - DNA, 20 bp, Artificial Sequence
  Description of Artificial Sequence: Synthetic oligonucleotide
  Target: SCN9A; (-) strand; PAM type: NRG; PAM sequence: GAG
tagatttttttttttttttt

SEQ ID NO: 31494 - DNA, 20 bp, Artificial Sequence
  Description of Artificial Sequence: Synthetic oligonucleotide
  Target: SCN9A; (-) strand; PAM type: NRG; PAM sequence: TAG
tgttgtttctattgaattga

SEQ ID NO: 31495 - DNA, 20 bp, Artificial Sequence
  Description of Artificial Sequence: Synthetic oligonucleotide
  Target: SCN9A; (-) strand; PAM type: NRG; PAM sequence: GAG
ttgaacataatagagactcg

SEQ ID NO: 31496 - DNA, 20 bp, Artificial Sequence
  Description of Artificial Sequence: Synthetic oligonucleotide
  Target: SCN9A; (-) strand; PAM type: NRG; PAM sequence: CGG
aattgaacataatagagact

SEQ ID NO: 31497 - DNA, 20 bp, Artificial Sequence
  Description of Artificial Sequence: Synthetic oligonucleotide
  Target: SCN9A; (-) strand; PAM type: NRG; PAM sequence: GAG
ttctttaattgaacataata

SEQ ID NO: 31498 - DNA, 20 bp, Artificial Sequence
  Description of Artificial Sequence: Synthetic oligonucleotide
  Target: SCN9A; (-) strand; PAM type: NRG; PAM sequence: TAG
ctttctttaattgaacataa

SEQ ID NO: 31499 - DNA, 20 bp, Artificial Sequence
  Description of Artificial Sequence: Synthetic oligonucleotide
  Target: SCN9A; (-) strand; PAM type: NRG; PAM sequence: CAG
caacttccatttttttcatt

SEQ ID NO: 31500 - DNA, 20 bp, Artificial Sequence
  Description of Artificial Sequence: Synthetic oligonucleotide
  Target: SCN9A; (-) strand; PAM type: NRG; PAM sequence: TGG
aaacttttttttaccctttt

SEQ ID NO: 31501 - DNA, 20 bp, Artificial Sequence
  Description of Artificial Sequence: Synthetic oligonucleotide
  Target: SCN9A; (-) strand; PAM type: NRG; PAM sequence: AAG
ttaaaatgttgagaattaaa

SEQ ID NO: 31502 - DNA, 20 bp, Artificial Sequence
  Description of Artificial Sequence: Synthetic oligonucleotide
  Target: SCN9A; (-) strand; PAM type: NRG; PAM sequence: GAG
tgaatgatgcttaaaatgtt

SEQ ID NO: 31503 - DNA, 20 bp, Artificial Sequence
  Description of Artificial Sequence: Synthetic oligonucleotide
  Target: SCN9A; (-) strand; PAM type: NRG; PAM sequence: AAG
taattggaatgaagtgatat

SEQ ID NO: 31504 - DNA, 20 bp, Artificial Sequence
  Description of Artificial Sequence: Synthetic oligonucleotide
  Target: SCN9A; (-) strand; PAM type: NRG; PAM sequence: AAG
gccaggctataattggaatg

SEQ ID NO: 31505 - DNA, 20 bp, Artificial Sequence
  Description of Artificial Sequence: Synthetic oligonucleotide
  Target: SCN9A; (-) strand; PAM type: NRG; PAM sequence: TGG
agattttgccaggctataat

SEQ ID NO: 31506 - DNA, 20 bp, Artificial Sequence
  Description of Artificial Sequence: Synthetic oligonucleotide
  Target: SCN9A; (-) strand; PAM type: NRG; PAM sequence: AGG
aaaaaaaaaaagattttgcc

SEQ ID NO: 31507 - DNA, 20 bp, Artificial Sequence
  Description of Artificial Sequence: Synthetic oligonucleotide
  Target: SCN9A; (-) strand; PAM type: NRG; PAM sequence: CAG
aaaaaaaaaaaagattttgc

SEQ ID NO: 31508 - DNA, 20 bp, Artificial Sequence
  Description of Artificial Sequence: Synthetic oligonucleotide
  Target: SCN9A; (-) strand; PAM type: NRG; PAM sequence: AAG
accaaaaaaaaaaaaaaaaa

SEQ ID NO: 31509 - DNA, 20 bp, Artificial Sequence
  Description of Artificial Sequence: Synthetic oligonucleotide
  Target: SCN9A; (-) strand; PAM type: NRG; PAM sequence: GAG
aaagaacttggagagaataa

SEQ ID NO: 31510 - DNA, 20 bp, Artificial Sequence
  Description of Artificial Sequence: Synthetic oligonucleotide
  Target: SCN9A; (-) strand; PAM type: NRG; PAM sequence: AAG
caaaagaacttggagagaat

SEQ ID NO: 31511 - DNA, 20 bp, Artificial Sequence
  Description of Artificial Sequence: Synthetic oligonucleotide
  Target: SCN9A; (-) strand; PAM type: NRG; PAM sequence: GAG
atgcctcaaaagaacttgga

SEQ ID NO: 31512 - DNA, 20 bp, Artificial Sequence
  Description of Artificial Sequence: Synthetic oligonucleotide
  Target: SCN9A; (-) strand; PAM type: NRG; PAM sequence: GAG
gcatgcctcaaaagaacttg

SEQ ID NO: 31513 - DNA, 20 bp, Artificial Sequence
  Description of Artificial Sequence: Synthetic oligonucleotide
  Target: SCN9A; (-) strand; PAM type: NRG; PAM sequence: TGG
ctgcatgcctcaaaagaact

SEQ ID NO: 31514 - DNA, 20 bp, Artificial Sequence
  Description of Artificial Sequence: Synthetic oligonucleotide
  Target: SCN9A; (-) strand; PAM type: NRG; PAM sequence: AAG
aggagcactgcatgcctcaa

SEQ ID NO: 31515 - DNA, 20 bp, Artificial Sequence
  Description of Artificial Sequence: Synthetic oligonucleotide
  Target: SCN9A; (-) strand; PAM type: NRG; PAM sequence: GAG
atgagcaaaactctgaggag

SEQ ID NO: 31516 - DNA, 20 bp, Artificial Sequence
  Description of Artificial Sequence: Synthetic oligonucleotide
  Target: SCN9A; (-) strand; PAM type: NRG; PAM sequence: AGG
gtatgagcaaaactctgagg

SEQ ID NO: 31517 - DNA, 20 bp, Artificial Sequence
  Description of Artificial Sequence: Synthetic oligonucleotide
  Target: SCN9A; (-) strand; PAM type: NRG; PAM sequence: GAG
agtatgagcaaaactctgag

SEQ ID NO: 31518 - DNA, 20 bp, Artificial Sequence
  Description of Artificial Sequence: Synthetic oligonucleotide
  Target: SCN9A; (-) strand; PAM type: NRG; PAM sequence: AGG
tgagtatgagcaaaactctg

SEQ ID NO: 31519 - DNA, 20 bp, Artificial Sequence
  Description of Artificial Sequence: Synthetic oligonucleotide
  Target: SCN9A; (-) strand; PAM type: NRG; PAM sequence: GAG
gtgagtatgagcaaaactct

SEQ ID NO: 31520 - DNA, 20 bp, Artificial Sequence
  Description of Artificial Sequence: Synthetic oligonucleotide
  Target: SCN9A; (-) strand; PAM type: NRG; PAM sequence: GAG
gatgagggatgagtgagtat

SEQ ID NO: 31521 - DNA, 20 bp, Artificial Sequence
  Description of Artificial Sequence: Synthetic oligonucleotide
  Target: SCN9A; (-) strand; PAM type: NRG; PAM sequence: GAG
ttggaggatgagggatgagt

SEQ ID NO: 31522 - DNA, 20 bp, Artificial Sequence
  Description of Artificial Sequence: Synthetic oligonucleotide
  Target: SCN9A; (-) strand; PAM type: NRG; PAM sequence: GAG
aggtttggaggatgagggat

SEQ ID NO: 31523 - DNA, 20 bp, Artificial Sequence
  Description of Artificial Sequence: Synthetic oligonucleotide
  Target: SCN9A; (-) strand; PAM type: NRG; PAM sequence: GGG
ctgacaggtttggaggatga

SEQ ID NO: 31524 - DNA, 20 bp, Artificial Sequence
  Description of Artificial Sequence: Synthetic oligonucleotide
  Target: SCN9A; (-) strand; PAM type: NRG; PAM sequence: AGG
gctgacaggtttggaggatg

SEQ ID NO: 31525 - DNA, 20 bp, Artificial Sequence
  Description of Artificial Sequence: Synthetic oligonucleotide
  Target: SCN9A; (-) strand; PAM type: NRG; PAM sequence: GAG
agctgacaggtttggaggat

SEQ ID NO: 31526 - DNA, 20 bp, Artificial Sequence
  Description of Artificial Sequence: Synthetic oligonucleotide
  Target: SCN9A; (-) strand; PAM type: NRG; PAM sequence: AGG
tttagagctgacaggtttgg

SEQ ID NO: 31527 - DNA, 20 bp, Artificial Sequence
  Description of Artificial Sequence: Synthetic oligonucleotide
  Target: SCN9A; (-) strand; PAM type: NRG; PAM sequence: GAG
ctttagagctgacaggtttg

SEQ ID NO: 31528 - DNA, 20 bp, Artificial Sequence
  Description of Artificial Sequence: Synthetic oligonucleotide
  Target: SCN9A; (-) strand; PAM type: NRG; PAM sequence: TGG
tgctttagagctgacaggtt

SEQ ID NO: 31529 - DNA, 20 bp, Artificial Sequence
  Description of Artificial Sequence: Synthetic oligonucleotide
  Target: SCN9A; (-) strand; PAM type: NRG; PAM sequence: AGG
gaggatgctttagagctgac

SEQ ID NO: 31530 - DNA, 20 bp, Artificial Sequence
  Description of Artificial Sequence: Synthetic oligonucleotide
  Target: SCN9A; (-) strand; PAM type: NRG; PAM sequence: CAG
tgaggatgctttagagctga

SEQ ID NO: 31531 - DNA, 20 bp, Artificial Sequence
  Description of Artificial Sequence: Synthetic oligonucleotide
  Target: SCN9A; (-) strand; PAM type: NRG; PAM sequence: GAG
gattgactgaggatgcttta

SEQ ID NO: 31532 - DNA, 20 bp, Artificial Sequence
  Description of Artificial Sequence: Synthetic oligonucleotide
  Target: SCN9A; (-) strand; PAM type: NRG; PAM sequence: TAG
cagattgactgaggatgctt

SEQ ID NO: 31533 - DNA, 20 bp, Artificial Sequence
  Description of Artificial Sequence: Synthetic oligonucleotide
  Target: SCN9A; (-) strand; PAM type: NRG; PAM sequence: AGG
gcttgacaacagattgactg

SEQ ID NO: 31534 - DNA, 20 bp, Artificial Sequence
  Description of Artificial Sequence: Synthetic oligonucleotide
  Target: SCN9A; (-) strand; PAM type: NRG; PAM sequence: GAG
tgcttgacaacagattgact

SEQ ID NO: 31535 - DNA, 20 bp, Artificial Sequence
  Description of Artificial Sequence: Synthetic oligonucleotide
  Target: SCN9A; (-) strand; PAM type: NRG; PAM sequence: CAG
tcttgcttattgcttgacaa

SEQ ID NO: 31536 - DNA, 20 bp, Artificial Sequence
  Description of Artificial Sequence: Synthetic oligonucleotide
  Target: SCN9A; (-) strand; PAM type: NRG; PAM sequence: GAG
tgattattttacagcatcaa

SEQ ID NO: 31537 - DNA, 20 bp, Artificial Sequence
  Description of Artificial Sequence: Synthetic oligonucleotide
  Target: SCN9A; (-) strand; PAM type: NRG; PAM sequence: AAG
cttgattattttacagcatc

SEQ ID NO: 31538 - DNA, 20 bp, Artificial Sequence
  Description of Artificial Sequence: Synthetic oligonucleotide
  Target: SCN9A; (-) strand; PAM type: NRG; PAM sequence: CAG
tgtaactcttgattatttta

SEQ ID NO: 31539 - DNA, 20 bp, Artificial Sequence
  Description of Artificial Sequence: Synthetic oligonucleotide
  Target: SCN9A; (-) strand; PAM type: NRG; PAM sequence: AAG
ttttaaaataaatgctagga

SEQ ID NO: 31540 - DNA, 20 bp, Artificial Sequence
  Description of Artificial Sequence: Synthetic oligonucleotide
  Target: SCN9A; (-) strand; PAM type: NRG; PAM sequence: AGG
agcgttttaaaataaatgct

SEQ ID NO: 31541 - DNA, 20 bp, Artificial Sequence
  Description of Artificial Sequence: Synthetic oligonucleotide
  Target: SCN9A; (-) strand; PAM type: NRG; PAM sequence: TAG
cagcgttttaaaataaatgc

SEQ ID NO: 31542 - DNA, 20 bp, Artificial Sequence
  Description of Artificial Sequence: Synthetic oligonucleotide
  Target: SCN9A; (-) strand; PAM type: NRG; PAM sequence: CAG
attcctgaaagttggaagat

SEQ ID NO: 31543 - DNA, 20 bp, Artificial Sequence
  Description of Artificial Sequence: Synthetic oligonucleotide
  Target: SCN9A; (-) strand; PAM type: NRG; PAM sequence: AAG
tacacattcctgaaagttgg

SEQ ID NO: 31544 - DNA, 20 bp, Artificial Sequence
  Description of Artificial Sequence: Synthetic oligonucleotide
  Target: SCN9A; (-) strand; PAM type: NRG; PAM sequence: TGG
tgttacacattcctgaaagt

SEQ ID NO: 31545 - DNA, 20 bp, Artificial Sequence
  Description of Artificial Sequence: Synthetic oligonucleotide
  Target: SCN9A; (-) strand; PAM type: NRG; PAM sequence: AAG
atgttgttacacattcctga

SEQ ID NO: 31546 - DNA, 20 bp, Artificial Sequence
  Description of Artificial Sequence: Synthetic oligonucleotide
  Target: SCN9A; (-) strand; PAM type: NRG; PAM sequence: TAG
taaaataaatctatttcttt

SEQ ID NO: 31547 - DNA, 20 bp, Artificial Sequence
  Description of Artificial Sequence: Synthetic oligonucleotide
  Target: SCN9A; (-) strand; PAM type: NRG; PAM sequence: AGG
aatacaaatttttagttatt

SEQ ID NO: 31548 - DNA, 20 bp, Artificial Sequence
  Description of Artificial Sequence: Synthetic oligonucleotide
  Target: SCN9A; (-) strand; PAM type: NRG; PAM sequence: TAG
taatacaaatttttagttat

SEQ ID NO: 31549 - DNA, 20 bp, Artificial Sequence
  Description of Artificial Sequence: Synthetic oligonucleotide
  Target: SCN9A; (-) strand; PAM type: NRG; PAM sequence: TAG
cataaagtaatacaaatttt

SEQ ID NO: 31550 - DNA, 20 bp, Artificial Sequence
  Description of Artificial Sequence: Synthetic oligonucleotide
  Target: SCN9A; (-) strand; PAM type: NRG; PAM sequence: AAG
tttctaagtagtgtttcata

SEQ ID NO: 31551 - DNA, 20 bp, Artificial Sequence
  Description of Artificial Sequence: Synthetic oligonucleotide
  Target: SCN9A; (-) strand; PAM type: NRG; PAM sequence: TAG
ttaaaaaagtgttttctaag

SEQ ID NO: 31552 - DNA, 20 bp, Artificial Sequence
  Description of Artificial Sequence: Synthetic oligonucleotide
  Target: SCN9A; (-) strand; PAM type: NRG; PAM sequence: AAG
tttttaaaaaagtgttttct

SEQ ID NO: 31553 - DNA, 20 bp, Artificial Sequence
  Description of Artificial Sequence: Synthetic oligonucleotide
  Target: SCN9A; (-) strand; PAM type: NRG; PAM sequence: AAG
aaatgaaattttttttaaaa

SEQ ID NO: 31554 - DNA, 20 bp, Artificial Sequence
  Description of Artificial Sequence: Synthetic oligonucleotide
  Target: SCN9A; (-) strand; PAM type: NRG; PAM sequence: TAG
tccaaattaagaagaaacta

SEQ ID NO: 31555 - DNA, 20 bp, Artificial Sequence
  Description of Artificial Sequence: Synthetic oligonucleotide
  Target: SCN9A; (-) strand; PAM type: NRG; PAM sequence: AAG
tacaaaagctccaaattaag

SEQ ID NO: 31556 - DNA, 20 bp, Artificial Sequence
  Description of Artificial Sequence: Synthetic oligonucleotide
  Target: SCN9A; (-) strand; PAM type: NRG; PAM sequence: AAG
ttttacaaaagctccaaatt

SEQ ID NO: 31557 - DNA, 20 bp, Artificial Sequence
  Description of Artificial Sequence: Synthetic oligonucleotide
  Target: SCN9A; (-) strand; PAM type: NRG; PAM sequence: AAG
gtatattaaagattttacaa

SEQ ID NO: 31558 - DNA, 20 bp, Artificial Sequence
  Description of Artificial Sequence: Synthetic oligonucleotide
  Target: SCN9A; (-) strand; PAM type: NRG; PAM sequence: AAG
ggaaatcgagctgtatatta

SEQ ID NO: 31559 - DNA, 20 bp, Artificial Sequence
  Description of Artificial Sequence: Synthetic oligonucleotide
  Target: SCN9A; (-) strand; PAM type: NRG; PAM sequence: GAG
cattggatcaaatggaaatc

SEQ ID NO: 31560 - DNA, 20 bp, Artificial Sequence
  Description of Artificial Sequence: Synthetic oligonucleotide
  Target: SCN9A; (-) strand; PAM type: NRG; PAM sequence: TGG
tcattttacattggatcaaa

SEQ ID NO: 31561 - DNA, 20 bp, Artificial Sequence
  Description of Artificial Sequence: Synthetic oligonucleotide
  Target: SCN9A; (-) strand; PAM type: NRG; PAM sequence: TGG
ggattttattcattttacat

SEQ ID NO: 31562 - DNA, 20 bp, Artificial Sequence
  Description of Artificial Sequence: Synthetic oligonucleotide
  Target: SCN9A; (-) strand; PAM type: NRG; PAM sequence: AGG
tatattgtaactgttgctga

SEQ ID NO: 31563 - DNA, 20 bp, Artificial Sequence
  Description of Artificial Sequence: Synthetic oligonucleotide
  Target: SCN9A; (-) strand; PAM type: NRG; PAM sequence: AAG
atatattgtaactgttgctg

SEQ ID NO: 31564 - DNA, 20 bp, Artificial Sequence
  Description of Artificial Sequence: Synthetic oligonucleotide
  Target: SCN9A; (-) strand; PAM type: NRG; PAM sequence: AAG
aattgttctgtatggaatag

SEQ ID NO: 31565 - DNA, 20 bp, Artificial Sequence
  Description of Artificial Sequence: Synthetic oligonucleotide
  Target: SCN9A; (-) strand; PAM type: NRG; PAM sequence: TAG
gtgaattgttctgtatggaa

SEQ ID NO: 31566 - DNA, 20 bp, Artificial Sequence
  Description of Artificial Sequence: Synthetic oligonucleotide
  Target: SCN9A; (-) strand; PAM type: NRG; PAM sequence: TGG
ccagtgtgaattgttctgta

SEQ ID NO: 31567 - DNA, 20 bp, Artificial Sequence
  Description of Artificial Sequence: Synthetic oligonucleotide
  Target: SCN9A; (-) strand; PAM type: NRG; PAM sequence: CAG
gacctgtgagccactgaaac

SEQ ID NO: 31568 - DNA, 20 bp, Artificial Sequence
  Description of Artificial Sequence: Synthetic oligonucleotide
  Target: SCN9A; (-) strand; PAM type: NRG; PAM sequence: GAG
caagatgattattgacctgt

SEQ ID NO: 31569 - DNA, 20 bp, Artificial Sequence
  Description of Artificial Sequence: Synthetic oligonucleotide
  Target: SCN9A; (-) strand; PAM type: NRG; PAM sequence: AAG
aaattgtaatgggaaaggcc

SEQ ID NO: 31570 - DNA, 20 bp, Artificial Sequence
  Description of Artificial Sequence: Synthetic oligonucleotide
  Target: SCN9A; (-) strand; PAM type: NRG; PAM sequence: AGG
agcacaaattgtaatgggaa

SEQ ID NO: 31571 - DNA, 20 bp, Artificial Sequence
  Description of Artificial Sequence: Synthetic oligonucleotide
  Target: SCN9A; (-) strand; PAM type: NRG; PAM sequence: AAG
gagcacaaattgtaatggga

SEQ ID NO: 31572 - DNA, 20 bp, Artificial Sequence
  Description of Artificial Sequence: Synthetic oligonucleotide
  Target: SCN9A; (-) strand; PAM type: NRG; PAM sequence: GGG
tgtggagcacaaattgtaat

SEQ ID NO: 31573 - DNA, 20 bp, Artificial Sequence
  Description of Artificial Sequence: Synthetic oligonucleotide
  Target: SCN9A; (-) strand; PAM type: NRG; PAM sequence: TGG
atgtggagcacaaattgtaa

SEQ ID NO: 31574 - DNA, 20 bp, Artificial Sequence
  Description of Artificial Sequence: Synthetic oligonucleotide
  Target: SCN9A; (-) strand; PAM type: NRG; PAM sequence: GAG
gtcaacagctctaaaatgtg

SEQ ID NO: 31575 - DNA, 20 bp, Artificial Sequence
  Description of Artificial Sequence: Synthetic oligonucleotide
  Target: SCN9A; (-) strand; PAM type: NRG; PAM sequence: TGG
gggtcaacagctctaaaatg

SEQ ID NO: 31576 - DNA, 20 bp, Artificial Sequence
  Description of Artificial Sequence: Synthetic oligonucleotide
  Target: SCN9A; (-) strand; PAM type: NRG; PAM sequence: CAG
tgtcatctccacagggtcaa

SEQ ID NO: 31577 - DNA, 20 bp, Artificial Sequence
  Description of Artificial Sequence: Synthetic oligonucleotide
  Target: SCN9A; (-) strand; PAM type: NRG; PAM sequence: GGG
gaggttatgtcatctccaca

SEQ ID NO: 31578 - DNA, 20 bp, Artificial Sequence
  Description of Artificial Sequence: Synthetic oligonucleotide
  Target: SCN9A; (-) strand; PAM type: NRG; PAM sequence: AGG
agaggttatgtcatctccac

SEQ ID NO: 31579 - DNA, 20 bp, Artificial Sequence
  Description of Artificial Sequence: Synthetic oligonucleotide
  Target: SCN9A; (-) strand; PAM type: NRG; PAM sequence: CAG
gagaggttatgtcatctcca

SEQ ID NO: 31580 - DNA, 20 bp, Artificial Sequence
  Description of Artificial Sequence: Synthetic oligonucleotide
  Target: SCN9A; (-) strand; PAM type: NRG; PAM sequence: AGG
taggaatcttaggctcagag

SEQ ID NO: 31581 - DNA, 20 bp, Artificial Sequence
  Description of Artificial Sequence: Synthetic oligonucleotide
  Target: SCN9A; (-) strand; PAM type: NRG; PAM sequence: GAG
ctaggaatcttaggctcaga

SEQ ID NO: 31582 - DNA, 20 bp, Artificial Sequence
  Description of Artificial Sequence: Synthetic oligonucleotide
  Target: SCN9A; (-) strand; PAM type: NRG; PAM sequence: GAG
aactaggaatcttaggctca

SEQ ID NO: 31583 - DNA, 20 bp, Artificial Sequence
  Description of Artificial Sequence: Synthetic oligonucleotide
  Target: SCN9A; (-) strand; PAM type: NRG; PAM sequence: CAG
caaactaggaatcttaggct

SEQ ID NO: 31584 - DNA, 20 bp, Artificial Sequence
  Description of Artificial Sequence: Synthetic oligonucleotide
  Target: SCN9A; (-) strand; PAM type: NRG; PAM sequence: AGG
tttttcaaactaggaatctt

SEQ ID NO: 31585 - DNA, 20 bp, Artificial Sequence
  Description of Artificial Sequence: Synthetic oligonucleotide
  Target: SCN9A; (-) strand; PAM type: NRG; PAM sequence: TAG
atttttcaaactaggaatct

SEQ ID NO: 31586 - DNA, 20 bp, Artificial Sequence
  Description of Artificial Sequence: Synthetic oligonucleotide
  Target: SCN9A; (-) strand; PAM type: NRG; PAM sequence: AGG
ttaactcaatttttcaaact

SEQ ID NO: 31587 - DNA, 20 bp, Artificial Sequence
  Description of Artificial Sequence: Synthetic oligonucleotide
  Target: SCN9A; (-) strand; PAM type: NRG; PAM sequence: TAG
attaactcaatttttcaaac

SEQ ID NO: 31588 - DNA, 20 bp, Artificial Sequence
  Description of Artificial Sequence: Synthetic oligonucleotide
  Target: SCN9A; (-) strand; PAM type: NRG; PAM sequence: GAG
acaatctaaaccactcttcg

SEQ ID NO: 31589 - DNA, 20 bp, Artificial Sequence
  Description of Artificial Sequence: Synthetic oligonucleotide
  Target: SCN9A; (-) strand; PAM type: NRG; PAM sequence: CGG
tcacaatctaaaccactctt

SEQ ID NO: 31590 - DNA, 20 bp, Artificial Sequence
  Description of Artificial Sequence: Synthetic oligonucleotide
  Target: SCN9A; (-) strand; PAM type: NRG; PAM sequence: CAG
cctgttaagcactttatata

SEQ ID NO: 31591 - DNA, 20 bp, Artificial Sequence
  Description of Artificial Sequence: Synthetic oligonucleotide
  Target: SCN9A; (-) strand; PAM type: NRG; PAM sequence: AAG
tgtgcaaaactcttcctgtt

SEQ ID NO: 31592 - DNA, 20 bp, Artificial Sequence
  Description of Artificial Sequence: Synthetic oligonucleotide
  Target: SCN9A; (-) strand; PAM type: NRG; PAM sequence: GAG
agacaagttaataatcttat

SEQ ID NO: 31593 - DNA, 20 bp, Artificial Sequence
  Description of Artificial Sequence: Synthetic oligonucleotide
  Target: SCN9A; (-) strand; PAM type: NRG; PAM sequence: AAG
ttaaaatagaaggatgagac

SEQ ID NO: 31594 - DNA, 20 bp, Artificial Sequence
  Description of Artificial Sequence: Synthetic oligonucleotide
  Target: SCN9A; (-) strand; PAM type: NRG; PAM sequence: GAG
aggaattaaaatagaaggat

SEQ ID NO: 31595 - DNA, 20 bp, Artificial Sequence
  Description of Artificial Sequence: Synthetic oligonucleotide
  Target: SCN9A; (-) strand; PAM type: NRG; PAM sequence: AGG
aagcaaggaattaaaataga

SEQ ID NO: 31596 - DNA, 20 bp, Artificial Sequence
  Description of Artificial Sequence: Synthetic oligonucleotide
  Target: SCN9A; (-) strand; PAM type: NRG; PAM sequence: AAG
aaagcaaggaattaaaatag

SEQ ID NO: 31597 - DNA, 20 bp, Artificial Sequence
  Description of Artificial Sequence: Synthetic oligonucleotide
  Target: SCN9A; (-) strand; PAM type: NRG; PAM sequence: TAG
tccaaagcaaggaattaaaa

SEQ ID NO: 31598 - DNA, 20 bp, Artificial Sequence
  Description of Artificial Sequence: Synthetic oligonucleotide
  Target: SCN9A; (-) strand; PAM type: NRG; PAM sequence: AGG
tgataaaattatccaaagca

SEQ ID NO: 31599 - DNA, 20 bp, Artificial Sequence
  Description of Artificial Sequence: Synthetic oligonucleotide
  Target: SCN9A; (-) strand; PAM type: NRG; PAM sequence: AAG
atgataaaattatccaaagc

SEQ ID NO: 31600 - DNA, 20 bp, Artificial Sequence
  Description of Artificial Sequence: Synthetic oligonucleotide
  Target: SCN9A; (-) strand; PAM type: NRG; PAM sequence: AAG
aagcatgataaaattatcca

SEQ ID NO: 31601 - DNA, 20 bp, Artificial Sequence
  Description of Artificial Sequence: Synthetic oligonucleotide
  Target: SCN9A; (-) strand; PAM type: NRG; PAM sequence: AAG
ttaatatattttaattatgg

SEQ ID NO: 31602 - DNA, 20 bp, Artificial Sequence
  Description of Artificial Sequence: Synthetic oligonucleotide
  Target: SCN9A; (-) strand; PAM type: NRG; PAM sequence: TGG
taattaatatattttaatta

SEQ ID NO: 31603 - DNA, 20 bp, Artificial Sequence
  Description of Artificial Sequence: Synthetic oligonucleotide
  Target: SCN9A; (-) strand; PAM type: NRG; PAM sequence: TGG
ggccaatacattcccataaa

SEQ ID NO: 31604 - DNA, 20 bp, Artificial Sequence
  Description of Artificial Sequence: Synthetic oligonucleotide
  Target: SCN9A; (-) strand; PAM type: NRG; PAM sequence: AGG
tgaaatgtttcatgtttaaa

SEQ ID NO: 31605 - DNA, 20 bp, Artificial Sequence
  Description of Artificial Sequence: Synthetic oligonucleotide
  Target: SCN9A; (-) strand; PAM type: NRG; PAM sequence: AAG
atgaaatgtttcatgtttaa

SEQ ID NO: 31606 - DNA, 20 bp, Artificial Sequence
  Description of Artificial Sequence: Synthetic oligonucleotide
  Target: SCN9A; (-) strand; PAM type: NRG; PAM sequence: TAG
tctagctcctgaacttgtcc

SEQ ID NO: 31607 - DNA, 20 bp, Artificial Sequence
  Description of Artificial Sequence: Synthetic oligonucleotide
  Target: SCN9A; (-) strand; PAM type: NRG; PAM sequence: TAG
tattcaaaacccaggctttc

SEQ ID NO: 31608 - DNA, 20 bp, Artificial Sequence
  Description of Artificial Sequence: Synthetic oligonucleotide
  Target: SCN9A; (-) strand; PAM type: NRG; PAM sequence: AGG
gaatccagtattcaaaaccc

SEQ ID NO: 31609 - DNA, 20 bp, Artificial Sequence
  Description of Artificial Sequence: Synthetic oligonucleotide
  Target: SCN9A; (-) strand; PAM type: NRG; PAM sequence: CAG
tgaatccagtattcaaaacc

SEQ ID NO: 31610 - DNA, 20 bp, Artificial Sequence
  Description of Artificial Sequence: Synthetic oligonucleotide
  Target: SCN9A; (-) strand; PAM type: NRG; PAM sequence: CAG
tagctagtaagtagtgaatc

SEQ ID NO: 31611 - DNA, 20 bp, Artificial Sequence
  Description of Artificial Sequence: Synthetic oligonucleotide
  Target: SCN9A; (-) strand; PAM type: NRG; PAM sequence: TAG
aagatcatttagctagtaag

SEQ ID NO: 31612 - DNA, 20 bp, Artificial Sequence
  Description of Artificial Sequence: Synthetic oligonucleotide
  Target: SCN9A; (-) strand; PAM type: NRG; PAM sequence: AAG
tccaagatcatttagctagt

SEQ ID NO: 31613 - DNA, 20 bp, Artificial Sequence
  Description of Artificial Sequence: Synthetic oligonucleotide
  Target: SCN9A; (-) strand; PAM type: NRG; PAM sequence: TAG
gatgtccaagatcatttagc

SEQ ID NO: 31614 - DNA, 20 bp, Artificial Sequence
  Description of Artificial Sequence: Synthetic oligonucleotide
  Target: SCN9A; (-) strand; PAM type: NRG; PAM sequence: TAG
ctgggatgtccaagatcatt

SEQ ID NO: 31615 - DNA, 20 bp, Artificial Sequence
  Description of Artificial Sequence: Synthetic oligonucleotide
  Target: SCN9A; (-) strand; PAM type: NRG; PAM sequence: AAG
gttgcttaactgggatgtcc

SEQ ID NO: 31616 - DNA, 20 bp, Artificial Sequence
  Description of Artificial Sequence: Synthetic oligonucleotide
  Target: SCN9A; (-) strand; PAM type: NRG; PAM sequence: GGG
atcagaaaagttgcttaact

SEQ ID NO: 31617 - DNA, 20 bp, Artificial Sequence
  Description of Artificial Sequence: Synthetic oligonucleotide
  Target: SCN9A; (-) strand; PAM type: NRG; PAM sequence: TGG
aatcagaaaagttgcttaac

SEQ ID NO: 31618 - DNA, 20 bp, Artificial Sequence
  Description of Artificial Sequence: Synthetic oligonucleotide
  Target: SCN9A; (-) strand; PAM type: NRG; PAM sequence: AAG
caacatttttagaatcagaa

SEQ ID NO: 31619 - DNA, 20 bp, Artificial Sequence
  Description of Artificial Sequence: Synthetic oligonucleotide
  Target: SCN9A; (-) strand; PAM type: NRG; PAM sequence: CAG
tgcctcaacatttttagaat

SEQ ID NO: 31620 - DNA, 20 bp, Artificial Sequence
  Description of Artificial Sequence: Synthetic oligonucleotide
  Target: SCN9A; (-) strand; PAM type: NRG; PAM sequence: TAG
cctaaatgcctcaacatttt

SEQ ID NO: 31621 - DNA, 20 bp, Artificial Sequence
  Description of Artificial Sequence: Synthetic oligonucleotide
  Target: SCN9A; (-) strand; PAM type: NRG; PAM sequence: GGG
agcaatcaacagtcattcta

SEQ ID NO: 31622 - DNA, 20 bp, Artificial Sequence
  Description of Artificial Sequence: Synthetic oligonucleotide
  Target: SCN9A; (-) strand; PAM type: NRG; PAM sequence: AGG
gagcaatcaacagtcattct

SEQ ID NO: 31623 - DNA, 20 bp, Artificial Sequence
  Description of Artificial Sequence: Synthetic oligonucleotide
  Target: SCN9A; (-) strand; PAM type: NRG; PAM sequence: TAG
tgagcaatcaacagtcattc

SEQ ID NO: 31624 - DNA, 20 bp, Artificial Sequence
  Description of Artificial Sequence: Synthetic oligonucleotide
  Target: SCN9A; (-) strand; PAM type: NRG; PAM sequence: CAG
ccaatcctttgagcaatcaa

SEQ ID NO: 31625 - DNA, 20 bp, Artificial Sequence
  Description of Artificial Sequence: Synthetic oligonucleotide
  Target: SCN9A; (-) strand; PAM type: NRG; PAM sequence: GAG
ctgcagtgacccaatccttt

SEQ ID NO: 31626 - DNA, 20 bp, Artificial Sequence
  Description of Artificial Sequence: Synthetic oligonucleotide
  Target: SCN9A; (-) strand; PAM type: NRG; PAM sequence: CAG
tcttaagaaaggaaattctg

SEQ ID NO: 31627 - DNA, 20 bp, Artificial Sequence
  Description of Artificial Sequence: Synthetic oligonucleotide
  Target: SCN9A; (-) strand; PAM type: NRG; PAM sequence: AGG
gatgggaattttcttaagaa

SEQ ID NO: 31628 - DNA, 20 bp, Artificial Sequence
  Description of Artificial Sequence: Synthetic oligonucleotide
  Target: SCN9A; (-) strand; PAM type: NRG; PAM sequence: AAG
tgatgggaattttcttaaga

SEQ ID NO: 31629 - DNA, 20 bp, Artificial Sequence
  Description of Artificial Sequence: Synthetic oligonucleotide
  Target: SCN9A; (-) strand; PAM type: NRG; PAM sequence: AAG
gaaatgatgggaattttctt

SEQ ID NO: 31630 - DNA, 20 bp, Artificial Sequence
  Description of Artificial Sequence: Synthetic oligonucleotide
  Target: SCN9A; (-) strand; PAM type: NRG; PAM sequence: GGG
aacaacaaaggtgaaatgat

SEQ ID NO: 31631 - DNA, 20 bp, Artificial Sequence
  Description of Artificial Sequence: Synthetic oligonucleotide
  Target: SCN9A; (-) strand; PAM type: NRG; PAM sequence: TGG
aaacaacaaaggtgaaatga

SEQ ID NO: 31632 - DNA, 20 bp, Artificial Sequence
  Description of Artificial Sequence: Synthetic oligonucleotide
  Target: SCN9A; (-) strand; PAM type: NRG; PAM sequence: AGG
tataaagttcaaaacaacaa

SEQ ID NO: 31633 - DNA, 20 bp, Artificial Sequence
  Description of Artificial Sequence: Synthetic oligonucleotide
  Target: SCN9A; (-) strand; PAM type: NRG; PAM sequence: AAG
atataaagttcaaaacaaca

SEQ ID NO: 31634 - DNA, 20 bp, Artificial Sequence
  Description of Artificial Sequence: Synthetic oligonucleotide
  Target: SCN9A; (-) strand; PAM type: NRG; PAM sequence: AAG
attttgcaagtcttcatata

SEQ ID NO: 31635 - DNA, 20 bp, Artificial Sequence
  Description of Artificial Sequence: Synthetic oligonucleotide
  Target: SCN9A; (-) strand; PAM type: NRG; PAM sequence: AAG
ctaattaaaaaatattttgc

SEQ ID NO: 31636 - DNA, 20 bp, Artificial Sequence
  Description of Artificial Sequence: Synthetic oligonucleotide
  Target: SCN9A; (-) strand; PAM type: NRG; PAM sequence: GAG
aagtcttaatgatagttctt

SEQ ID NO: 31637 - DNA, 20 bp, Artificial Sequence
  Description of Artificial Sequence: Synthetic oligonucleotide
  Target: SCN9A; (-) strand; PAM type: NRG; PAM sequence: TAG
aaagaaaaaagtcttaatga

SEQ ID NO: 31638 - DNA, 20 bp, Artificial Sequence
  Description of Artificial Sequence: Synthetic oligonucleotide
  Target: SCN9A; (-) strand; PAM type: NRG; PAM sequence: AAG
tcaatgaataaaaaagaaaa

SEQ ID NO: 31639 - DNA, 20 bp, Artificial Sequence
  Description of Artificial Sequence: Synthetic oligonucleotide
  Target: SCN9A; (-) strand; PAM type: NRG; PAM sequence: AAG
gcaatattcaatgaataaaa

SEQ ID NO: 31640 - DNA, 20 bp, Artificial Sequence
  Description of Artificial Sequence: Synthetic oligonucleotide
  Target: SCN9A; (-) strand; PAM type: NRG; PAM sequence: CAG
tatttgcttttgaccctgtt

SEQ ID NO: 31641 - DNA, 20 bp, Artificial Sequence
  Description of Artificial Sequence: Synthetic oligonucleotide
  Target: SCN9A; (-) strand; PAM type: NRG; PAM sequence: TGG
tcagaagataaaccaagtgt

SEQ ID NO: 31642 - DNA, 20 bp, Artificial Sequence
  Description of Artificial Sequence: Synthetic oligonucleotide
  Target: SCN9A; (-) strand; PAM type: NRG; PAM sequence: AAG
tgtttctcagaagataaacc

SEQ ID NO: 31643 - DNA, 20 bp, Artificial Sequence
  Description of Artificial Sequence: Synthetic oligonucleotide
  Target: SCN9A; (-) strand; PAM type: NRG; PAM sequence: AAG
gatatttaaatgtttctcag

SEQ ID NO: 31644 - DNA, 20 bp, Artificial Sequence
  Description of Artificial Sequence: Synthetic oligonucleotide
  Target: SCN9A; (-) strand; PAM type: NRG; PAM sequence: CAG
aatgatatttaaatgtttct

SEQ ID NO: 31645 - DNA, 20 bp, Artificial Sequence
  Description of Artificial Sequence: Synthetic oligonucleotide
  Target: SCN9A; (-) strand; PAM type: NRG; PAM sequence: GAG
tcattcttgtattctgttca

SEQ ID NO: 31646 - DNA, 20 bp, Artificial Sequence
  Description of Artificial Sequence: Synthetic oligonucleotide
  Target: SCN9A; (-) strand; PAM type: NRG; PAM sequence: CAG
gatcattcttgtattctgtt

SEQ ID NO: 31647 - DNA, 20 bp, Artificial Sequence
  Description of Artificial Sequence: Synthetic oligonucleotide
  Target: SCN9A; (-) strand; PAM type: NRG; PAM sequence: GGG
tatttctttgcttgaaggaa

SEQ ID NO: 31648 - DNA, 20 bp, Artificial Sequence
  Description of Artificial Sequence: Synthetic oligonucleotide
  Target: SCN9A; (-) strand; PAM type: NRG; PAM sequence: AGG
atatttctttgcttgaagga

SEQ ID NO: 31649 - DNA, 20 bp, Artificial Sequence
  Description of Artificial Sequence: Synthetic oligonucleotide
  Target: SCN9A; (-) strand; PAM type: NRG; PAM sequence: AAG
aatatttctttgcttgaagg

SEQ ID NO: 31650 - DNA, 20 bp, Artificial Sequence
  Description of Artificial Sequence: Synthetic oligonucleotide
  Target: SCN9A; (-) strand; PAM type: NRG; PAM sequence: AGG
tgtaatatttctttgcttga

SEQ ID NO: 31651 - DNA, 20 bp, Artificial Sequence
  Description of Artificial Sequence: Synthetic oligonucleotide
  Target: SCN9A; (-) strand; PAM type: NRG; PAM sequence: AAG
ctgtaatatttctttgcttg

SEQ ID NO: 31652 - DNA, 20 bp, Artificial Sequence
  Description of Artificial Sequence: Synthetic oligonucleotide
  Target: SCN9A; (-) strand; PAM type: NRG; PAM sequence: GAG
agagtctctaaaactctgga

SEQ ID NO: 31653 - DNA, 20 bp, Artificial Sequence
  Description of Artificial Sequence: Synthetic oligonucleotide
  Target: SCN9A; (-) strand; PAM type: NRG; PAM sequence: GAG
acagagtctctaaaactctg

SEQ ID NO: 31654 - DNA, 20 bp, Artificial Sequence
  Description of Artificial Sequence: Synthetic oligonucleotide
  Target: SCN9A; (-) strand; PAM type: NRG; PAM sequence: TGG
acacagagtctctaaaactc

SEQ ID NO: 31655 - DNA, 20 bp, Artificial Sequence
  Description of Artificial Sequence: Synthetic oligonucleotide
  Target: SCN9A; (-) strand; PAM type: NRG; PAM sequence: GAG
agagccataccaggcacaca

SEQ ID NO: 31656 - DNA, 20 bp, Artificial Sequence
  Description of Artificial Sequence: Synthetic oligonucleotide
  Target: SCN9A; (-) strand; PAM type: NRG; PAM sequence: CAG
tcagagccataccaggcaca

SEQ ID NO: 31657 - DNA, 20 bp, Artificial Sequence
  Description of Artificial Sequence: Synthetic oligonucleotide
  Target: SCN9A; (-) strand; PAM type: NRG; PAM sequence: AGG
agtatgttcagagccatacc

SEQ ID NO: 31658 - DNA, 20 bp, Artificial Sequence
  Description of Artificial Sequence: Synthetic oligonucleotide
  Target: SCN9A; (-) strand; PAM type: NRG; PAM sequence: CAG
tagtatgttcagagccatac

SEQ ID NO: 31659 - DNA, 20 bp, Artificial Sequence
  Description of Artificial Sequence: Synthetic oligonucleotide
  Target: SCN9A; (-) strand; PAM type: NRG; PAM sequence: GAG
ttttccaaatagtatgttca

SEQ ID NO: 31660 - DNA, 20 bp, Artificial Sequence
  Description of Artificial Sequence: Synthetic oligonucleotide
  Target: SCN9A; (-) strand; PAM type: NRG; PAM sequence: CAG
cgttttccaaatagtatgtt

SEQ ID NO: 31661 - DNA, 20 bp, Artificial Sequence
  Description of Artificial Sequence: Synthetic oligonucleotide
  Target: SCN9A; (-) strand; PAM type: NRG; PAM sequence: TAG
caagaataccgttttccaaa

SEQ ID NO: 31662 - DNA, 20 bp, Artificial Sequence
  Description of Artificial Sequence: Synthetic oligonucleotide
  Target: SCN9A; (-) strand; PAM type: NRG; PAM sequence: AAG
tgcttccaatatttgacttc

SEQ ID NO: 31663 - DNA, 20 bp, Artificial Sequence
  Description of Artificial Sequence: Synthetic oligonucleotide
  Target: SCN9A; (-) strand; PAM type: NRG; PAM sequence: AAG
agtaccttggggatgaaagg

SEQ ID NO: 31664 - DNA, 20 bp, Artificial Sequence
  Description of Artificial Sequence: Synthetic oligonucleotide
  Target: SCN9A; (-) strand; PAM type: NRG; PAM sequence: AGG
catagtaccttggggatgaa

SEQ ID NO: 31665 - DNA, 20 bp, Artificial Sequence
  Description of Artificial Sequence: Synthetic oligonucleotide
  Target: SCN9A; (-) strand; PAM type: NRG; PAM sequence: AAG
tcatagtaccttggggatga

SEQ ID NO: 31666 - DNA, 20 bp, Artificial Sequence
  Description of Artificial Sequence: Synthetic oligonucleotide
  Target: SCN9A; (-) strand; PAM type: NRG; PAM sequence: GGG
agggttttcatagtaccttg

SEQ ID NO: 31667 - DNA, 20 bp, Artificial Sequence
  Description of Artificial Sequence: Synthetic oligonucleotide
  Target: SCN9A; (-) strand; PAM type: NRG; PAM sequence: GGG
aagggttttcatagtacctt

SEQ ID NO: 31668 - DNA, 20 bp, Artificial Sequence
  Description of Artificial Sequence: Synthetic oligonucleotide
  Target: SCN9A; (-) strand; PAM type: NRG; PAM sequence: TGG
gaagggttttcatagtacct

SEQ ID NO: 31669 - DNA, 20 bp, Artificial Sequence
  Description of Artificial Sequence: Synthetic oligonucleotide
  Target: SCN9A; (-) strand; PAM type: NRG; PAM sequence: TAG
ccctatgtgaagggttttca

SEQ ID NO: 31670 - DNA, 20 bp, Artificial Sequence
  Description of Artificial Sequence: Synthetic oligonucleotide
  Target: SCN9A; (-) strand; PAM type: NRG; PAM sequence: GGG
atagattttccctatgtgaa

SEQ ID NO: 31671 - DNA, 20 bp, Artificial Sequence
  Description of Artificial Sequence: Synthetic oligonucleotide
  Target: SCN9A; (-) strand; PAM type: NRG; PAM sequence: AGG
tatagattttccctatgtga

SEQ ID NO: 31672 - DNA, 20 bp, Artificial Sequence
  Description of Artificial Sequence: Synthetic oligonucleotide
  Target: SCN9A; (-) strand; PAM type: NRG; PAM sequence: AAG
ctatagattttccctatgtg

SEQ ID NO: 31673 - DNA, 20 bp, Artificial Sequence
  Description of Artificial Sequence: Synthetic oligonucleotide
  Target: SCN9A; (-) strand; PAM type: NRG; PAM sequence: TAG
ccacttcccacctcatccta

SEQ ID NO: 31674 - DNA, 20 bp, Artificial Sequence
  Description of Artificial Sequence: Synthetic oligonucleotide
  Target: SCN9A; (-) strand; PAM type: NRG; PAM sequence: GGG
atttttactgtgaacactta

SEQ ID NO: 31675 - DNA, 20 bp, Artificial Sequence
  Description of Artificial Sequence: Synthetic oligonucleotide
  Target: SCN9A; (-) strand; PAM type: NRG; PAM sequence: AGG
aatttttactgtgaacactt

SEQ ID NO: 31676 - DNA, 20 bp, Artificial Sequence
  Description of Artificial Sequence: Synthetic oligonucleotide
  Target: SCN9A; (-) strand; PAM type: NRG; PAM sequence: TAG
caatttttactgtgaacact

SEQ ID NO: 31677 - DNA, 20 bp, Artificial Sequence
  Description of Artificial Sequence: Synthetic oligonucleotide
  Target: SCN9A; (-) strand; PAM type: NRG; PAM sequence: AGG
ttacttcagtgattttttag

SEQ ID NO: 31678 - DNA, 20 bp, Artificial Sequence
  Description of Artificial Sequence: Synthetic oligonucleotide
  Target: SCN9A; (-) strand; PAM type: NRG; PAM sequence: GAG
tttacttcagtgatttttta

SEQ ID NO: 31679 - DNA, 20 bp, Artificial Sequence
  Description of Artificial Sequence: Synthetic oligonucleotide
  Target: SCN9A; (-) strand; PAM type: NRG; PAM sequence: TAG
tgtttacttcagtgattttt

SEQ ID NO: 31680 - DNA, 20 bp, Artificial Sequence
  Description of Artificial Sequence: Synthetic oligonucleotide
  Target: SCN9A; (-) strand; PAM type: NRG; PAM sequence: CAG
attagtgttggtgtttactt

SEQ ID NO: 31681 - DNA, 20 bp, Artificial Sequence
  Description of Artificial Sequence: Synthetic oligonucleotide
  Target: SCN9A; (-) strand; PAM type: NRG; PAM sequence: TGG
tattaggtaaaaattagtgt

SEQ ID NO: 31682 - DNA, 20 bp, Artificial Sequence
  Description of Artificial Sequence: Synthetic oligonucleotide
  Target: SCN9A; (-) strand; PAM type: NRG; PAM sequence: TAG
tttagttattaggtaaaaat

SEQ ID NO: 31683 - DNA, 20 bp, Artificial Sequence
  Description of Artificial Sequence: Synthetic oligonucleotide
  Target: SCN9A; (-) strand; PAM type: NRG; PAM sequence: AGG
attttttccttttagttatt

SEQ ID NO: 31684 - DNA, 20 bp, Artificial Sequence
  Description of Artificial Sequence: Synthetic oligonucleotide
  Target: SCN9A; (-) strand; PAM type: NRG; PAM sequence: TAG
cattttttccttttagttat

SEQ ID NO: 31685 - DNA, 20 bp, Artificial Sequence
  Description of Artificial Sequence: Synthetic oligonucleotide
  Target: SCN9A; (-) strand; PAM type: NRG; PAM sequence: TAG
caactcacattttttccttt

SEQ ID NO: 31686 - DNA, 20 bp, Artificial Sequence
  Description of Artificial Sequence: Synthetic oligonucleotide
  Target: SCN9A; (-) strand; PAM type: NRG; PAM sequence: GGG
cttttccagtctaatataat

SEQ ID NO: 31687 - DNA, 20 bp, Artificial Sequence
  Description of Artificial Sequence: Synthetic oligonucleotide
  Target: SCN9A; (-) strand; PAM type: NRG; PAM sequence: TGG
ccttttccagtctaatataa

SEQ ID NO: 31688 - DNA, 20 bp, Artificial Sequence
  Description of Artificial Sequence: Synthetic oligonucleotide
  Target: SCN9A; (-) strand; PAM type: NRG; PAM sequence: CAG
gaggccactgagaccttttc

SEQ ID NO: 31689 - DNA, 20 bp, Artificial Sequence
  Description of Artificial Sequence: Synthetic oligonucleotide
  Target: SCN9A; (-) strand; PAM type: NRG; PAM sequence: GAG
agaaggtaatagaggccact

SEQ ID NO: 31690 - DNA, 20 bp, Artificial Sequence
  Description of Artificial Sequence: Synthetic oligonucleotide
  Target: SCN9A; (-) strand; PAM type: NRG; PAM sequence: AGG
tgtggccaagaaggtaatag

SEQ ID NO: 31691 - DNA, 20 bp, Artificial Sequence
  Description of Artificial Sequence: Synthetic oligonucleotide
  Target: SCN9A; (-) strand; PAM type: NRG; PAM sequence: GAG
atgtggccaagaaggtaata

SEQ ID NO: 31692 - DNA, 20 bp, Artificial Sequence
  Description of Artificial Sequence: Synthetic oligonucleotide
  Target: SCN9A; (-) strand; PAM type: NRG; PAM sequence: TAG
ttatgtggccaagaaggtaa

SEQ ID NO: 31693 - DNA, 20 bp, Artificial Sequence
  Description of Artificial Sequence: Synthetic oligonucleotide
  Target: SCN9A; (-) strand; PAM type: NRG; PAM sequence: AGG
tacctgttatgtggccaaga

SEQ ID NO: 31694 - DNA, 20 bp, Artificial Sequence
  Description of Artificial Sequence: Synthetic oligonucleotide
  Target: SCN9A; (-) strand; PAM type: NRG; PAM sequence: AAG
gtacctgttatgtggccaag

SEQ ID NO: 31695 - DNA, 20 bp, Artificial Sequence
  Description of Artificial Sequence: Synthetic oligonucleotide
  Target: SCN9A; (-) strand; PAM type: NRG; PAM sequence: AAG
ttagtacctgttatgtggcc

SEQ ID NO: 31696 - DNA, 20 bp, Artificial Sequence
  Description of Artificial Sequence: Synthetic oligonucleotide
  Target: SCN9A; (-) strand; PAM type: NRG; PAM sequence: TGG
agtatttagtacctgttatg

SEQ ID NO: 31697 - DNA, 20 bp, Artificial Sequence
  Description of Artificial Sequence: Synthetic oligonucleotide
  Target: SCN9A; (-) strand; PAM type: NRG; PAM sequence: TAG
gaactgcagtttggagtatt

SEQ ID NO: 31698 - DNA, 20 bp, Artificial Sequence
  Description of Artificial Sequence: Synthetic oligonucleotide
  Target: SCN9A; (-) strand; PAM type: NRG; PAM sequence: GAG
catttgggaactgcagtttg

SEQ ID NO: 31699 - DNA, 20 bp, Artificial Sequence
  Description of Artificial Sequence: Synthetic oligonucleotide
  Target: SCN9A; (-) strand; PAM type: NRG; PAM sequence: TGG
atcatttgggaactgcagtt

SEQ ID NO: 31700 - DNA, 20 bp, Artificial Sequence
  Description of Artificial Sequence: Synthetic oligonucleotide
  Target: SCN9A; (-) strand; PAM type: NRG; PAM sequence: CAG
aataaatcatttgggaactg

SEQ ID NO: 31701 - DNA, 20 bp, Artificial Sequence
  Description of Artificial Sequence: Synthetic oligonucleotide
  Target: SCN9A; (-) strand; PAM type: NRG; PAM sequence: GGG
ctgacactaataaatcattt

SEQ ID NO: 31702 - DNA, 20 bp, Artificial Sequence
  Description of Artificial Sequence: Synthetic oligonucleotide
  Target: SCN9A; (-) strand; PAM type: NRG; PAM sequence: TGG
cctgacactaataaatcatt

SEQ ID NO: 31703 - DNA, 20 bp, Artificial Sequence
  Description of Artificial Sequence: Synthetic oligonucleotide
  Target: SCN9A; (-) strand; PAM type: NRG; PAM sequence: TGG
taactgagccacaatagaat

SEQ ID NO: 31704 - DNA, 20 bp, Artificial Sequence
  Description of Artificial Sequence: Synthetic oligonucleotide
  Target: SCN9A; (-) strand; PAM type: NRG; PAM sequence: TAG
atactctaactgagccacaa

SEQ ID NO: 31705 - DNA, 20 bp, Artificial Sequence
  Description of Artificial Sequence: Synthetic oligonucleotide
  Target: SCN9A; (-) strand; PAM type: NRG; PAM sequence: GAG
aatatgcacatactctaact

SEQ ID NO: 31706 - DNA, 20 bp, Artificial Sequence
  Description of Artificial Sequence: Synthetic oligonucleotide
  Target: SCN9A; (-) strand; PAM type: NRG; PAM sequence: TGG
caacatattacaaaattata

SEQ ID NO: 31707 - DNA, 20 bp, Artificial Sequence
  Description of Artificial Sequence: Synthetic oligonucleotide
  Target: SCN9A; (-) strand; PAM type: NRG; PAM sequence: AAG
ataaacattaattattacaa

SEQ ID NO: 31708 - DNA, 20 bp, Artificial Sequence
  Description of Artificial Sequence: Synthetic oligonucleotide
  Target: SCN9A; (-) strand; PAM type: NRG; PAM sequence: AAG
taaatatagctttcatatat

SEQ ID NO: 31709 - DNA, 20 bp, Artificial Sequence
  Description of Artificial Sequence: Synthetic oligonucleotide
  Target: SCN9A; (-) strand; PAM type: NRG; PAM sequence: TAG
cttattctcttaaataaata

SEQ ID NO: 31710 - DNA, 20 bp, Artificial Sequence
  Description of Artificial Sequence: Synthetic oligonucleotide
  Target: SCN9A; (-) strand; PAM type: NRG; PAM sequence: GAG
tatctgggagatatttttaa

SEQ ID NO: 31711 - DNA, 20 bp, Artificial Sequence
  Description of Artificial Sequence: Synthetic oligonucleotide
  Target: SCN9A; (-) strand; PAM type: NRG; PAM sequence: AAG
attatctgggagatattttt

SEQ ID NO: 31712 - DNA, 20 bp, Artificial Sequence
  Description of Artificial Sequence: Synthetic oligonucleotide
  Target: SCN9A; (-) strand; PAM type: NRG; PAM sequence: GAG
tgtttaaaggaattatctgg

SEQ ID NO: 31713 - DNA, 20 bp, Artificial Sequence
  Description of Artificial Sequence: Synthetic oligonucleotide
  Target: SCN9A; (-) strand; PAM type: NRG; PAM sequence: GGG
actgtttaaaggaattatct

SEQ ID NO: 31714 - DNA, 20 bp, Artificial Sequence
  Description of Artificial Sequence: Synthetic oligonucleotide
  Target: SCN9A; (-) strand; PAM type: NRG; PAM sequence: TGG
tactgtttaaaggaattatc

SEQ ID NO: 31715 - DNA, 20 bp, Artificial Sequence
  Description of Artificial Sequence: Synthetic oligonucleotide
  Target: SCN9A; (-) strand; PAM type: NRG; PAM sequence: AGG
aaaggaaacatactgtttaa

SEQ ID NO: 31716 - DNA, 20 bp, Artificial Sequence
  Description of Artificial Sequence: Synthetic oligonucleotide
  Target: SCN9A; (-) strand; PAM type: NRG; PAM sequence: AAG
caaaggaaacatactgttta

SEQ ID NO: 31717 - DNA, 20 bp, Artificial Sequence
  Description of Artificial Sequence: Synthetic oligonucleotide
  Target: SCN9A; (-) strand; PAM type: NRG; PAM sequence: AGG
gagatgtcaaaagttatcaa

SEQ ID NO: 31718 - DNA, 20 bp, Artificial Sequence
  Description of Artificial Sequence: Synthetic oligonucleotide
  Target: SCN9A; (-) strand; PAM type: NRG; PAM sequence: AAG
agagatgtcaaaagttatca

SEQ ID NO: 31719 - DNA, 20 bp, Artificial Sequence
  Description of Artificial Sequence: Synthetic oligonucleotide
  Target: SCN9A; (-) strand; PAM type: NRG; PAM sequence: AAG
ctttctacaagagatgtcaa

SEQ ID NO: 31720 - DNA, 20 bp, Artificial Sequence
  Description of Artificial Sequence: Synthetic oligonucleotide
  Target: SCN9A; (-) strand; PAM type: NRG; PAM sequence: GAG
acactacttgctttctacaa

SEQ ID NO: 31721 - DNA, 20 bp, Artificial Sequence
  Description of Artificial Sequence: Synthetic oligonucleotide
  Target: SCN9A; (-) strand; PAM type: NRG; PAM sequence: AAG
aaacactacttgctttctac

SEQ ID NO: 31722 - DNA, 20 bp, Artificial Sequence
  Description of Artificial Sequence: Synthetic oligonucleotide
  Target: SCN9A; (-) strand; PAM type: NRG; PAM sequence: AAG
tcaagattaaagaaacaaac

SEQ ID NO: 31723 - DNA, 20 bp, Artificial Sequence
  Description of Artificial Sequence: Synthetic oligonucleotide
  Target: SCN9A; (-) strand; PAM type: NRG; PAM sequence: AAG
agtccctctaatcaagatta

SEQ ID NO: 31724 - DNA, 20 bp, Artificial Sequence
  Description of Artificial Sequence: Synthetic oligonucleotide
  Target: SCN9A; (-) strand; PAM type: NRG; PAM sequence: AAG
atatcatagtccctctaatc

SEQ ID NO: 31725 - DNA, 20 bp, Artificial Sequence
  Description of Artificial Sequence: Synthetic oligonucleotide
  Target: SCN9A; (-) strand; PAM type: NRG; PAM sequence: TAG
aataagaaaatgtcatatca

SEQ ID NO: 31726 - DNA, 20 bp, Artificial Sequence
  Description of Artificial Sequence: Synthetic oligonucleotide
  Target: SCN9A; (-) strand; PAM type: NRG; PAM sequence: AAG
attttcctgctccttgaaat

SEQ ID NO: 31727 - DNA, 20 bp, Artificial Sequence
  Description of Artificial Sequence: Synthetic oligonucleotide
  Target: SCN9A; (-) strand; PAM type: NRG; PAM sequence: TAG
aatatagagttgtgagcgtg

SEQ ID NO: 31728 - DNA, 20 bp, Artificial Sequence
  Description of Artificial Sequence: Synthetic oligonucleotide
  Target: SCN9A; (-) strand; PAM type: NRG; PAM sequence: GAG
ataagaaaatatagagttgt

SEQ ID NO: 31729 - DNA, 20 bp, Artificial Sequence
  Description of Artificial Sequence: Synthetic oligonucleotide
  Target: SCN9A; (-) strand; PAM type: NRG; PAM sequence: GAG
ccttgaaataagaaaatata

SEQ ID NO: 31730 - DNA, 20 bp, Artificial Sequence
  Description of Artificial Sequence: Synthetic oligonucleotide
  Target: SCN9A; (-) strand; PAM type: NRG; PAM sequence: TAG
ctccttgaaataagaaaata

SEQ ID NO: 31731 - DNA, 20 bp, Artificial Sequence
  Description of Artificial Sequence: Synthetic oligonucleotide
  Target: SCN9A; (-) strand; PAM type: NRG; PAM sequence: AAG
attttcctgctccttgaaat

SEQ ID NO: 31732 - DNA, 20 bp, Artificial Sequence
  Description of Artificial Sequence: Synthetic oligonucleotide
  Target: SCN9A; (-) strand; PAM type: NRG; PAM sequence: TAG
attatagagttgtgagcatg

SEQ ID NO: 31733 - DNA, 20 bp, Artificial Sequence
  Description of Artificial Sequence: Synthetic oligonucleotide
  Target: SCN9A; (-) strand; PAM type: NRG; PAM sequence: GAG
tgaaattattatagagttgt

SEQ ID NO: 31734 - DNA, 20 bp, Artificial Sequence
  Description of Artificial Sequence: Synthetic oligonucleotide
  Target: SCN9A; (-) strand; PAM type: NRG; PAM sequence: GAG
aacagcctgaaattattata

SEQ ID NO: 31735 - DNA, 20 bp, Artificial Sequence
  Description of Artificial Sequence: Synthetic oligonucleotide
  Target: SCN9A; (-) strand; PAM type: NRG; PAM sequence: TAG
aaaacagcctgaaattatta

SEQ ID NO: 31736 - DNA, 20 bp, Artificial Sequence
  Description of Artificial Sequence: Synthetic oligonucleotide
  Target: SCN9A; (-) strand; PAM type: NRG; PAM sequence: CAG
ctcagtgatggaatgcaaaa

SEQ ID NO: 31737 - DNA, 20 bp, Artificial Sequence
  Description of Artificial Sequence: Synthetic oligonucleotide
  Target: SCN9A; (-) strand; PAM type: NRG; PAM sequence: TGG
acaggtaagaggctcagtga

SEQ ID NO: 31738 - DNA, 20 bp, Artificial Sequence
  Description of Artificial Sequence: Synthetic oligonucleotide
  Target: SCN9A; (-) strand; PAM type: NRG; PAM sequence: CAG
ttatttacaggtaagaggct

SEQ ID NO: 31739 - DNA, 20 bp, Artificial Sequence
  Description of Artificial Sequence: Synthetic oligonucleotide
  Target: SCN9A; (-) strand; PAM type: NRG; PAM sequence: AGG
ttaagttatttacaggtaag

SEQ ID NO: 31740 - DNA, 20 bp, Artificial Sequence
  Description of Artificial Sequence: Synthetic oligonucleotide
  Target: SCN9A; (-) strand; PAM type: NRG; PAM sequence: GAG
attaagttatttacaggtaa

SEQ ID NO: 31741 - DNA, 20 bp, Artificial Sequence
  Description of Artificial Sequence: Synthetic oligonucleotide
  Target: SCN9A; (-) strand; PAM type: NRG; PAM sequence: AAG
agattaagttatttacaggt

SEQ ID NO: 31742 - DNA, 20 bp, Artificial Sequence
  Description of Artificial Sequence: Synthetic oligonucleotide
  Target: SCN9A; (-) strand; PAM type: NRG; PAM sequence: AGG
aataagattaagttatttac

SEQ ID NO: 31743 - DNA, 20 bp, Artificial Sequence
  Description of Artificial Sequence: Synthetic oligonucleotide
  Target: SCN9A; (-) strand; PAM type: NRG; PAM sequence: CAG
aaataagattaagttattta

SEQ ID NO: 31744 - DNA, 20 bp, Artificial Sequence
  Description of Artificial Sequence: Synthetic oligonucleotide
  Target: SCN9A; (-) strand; PAM type: NRG; PAM sequence: AAG
aattttatcgaaataagatt

SEQ ID NO: 31745 - DNA, 20 bp, Artificial Sequence
  Description of Artificial Sequence: Synthetic oligonucleotide
  Target: SCN9A; (-) strand; PAM type: NRG; PAM sequence: AAG
tgttgtaattttatcgaaat

SEQ ID NO: 31746 - DNA, 20 bp, Artificial Sequence
  Description of Artificial Sequence: Synthetic oligonucleotide
  Target: SCN9A; (-) strand; PAM type: NRG; PAM sequence: TGG
gcaggcgcccacaccacacc

SEQ ID NO: 31747 - DNA, 20 bp, Artificial Sequence
  Description of Artificial Sequence: Synthetic oligonucleotide
  Target: SCN9A; (-) strand; PAM type: NRG; PAM sequence: AGG
tcctgagtagctgagattgc

SEQ ID NO: 31748 - DNA, 20 bp, Artificial Sequence
  Description of Artificial Sequence: Synthetic oligonucleotide
  Target: SCN9A; (-) strand; PAM type: NRG; PAM sequence: CAG
ctcctgagtagctgagattg

SEQ ID NO: 31749 - DNA, 20 bp, Artificial Sequence
  Description of Artificial Sequence: Synthetic oligonucleotide
  Target: SCN9A; (-) strand; PAM type: NRG; PAM sequence: GAG
cctcagcctcctgagtagct

SEQ ID NO: 31750 - DNA, 20 bp, Artificial Sequence
  Description of Artificial Sequence: Synthetic oligonucleotide
  Target: SCN9A; (-) strand; PAM type: NRG; PAM sequence: TAG
tcctgcctcagcctcctgag

SEQ ID NO: 31751 - DNA, 20 bp, Artificial Sequence
  Description of Artificial Sequence: Synthetic oligonucleotide
  Target: SCN9A; (-) strand; PAM type: NRG; PAM sequence: GAG
ttctcctgcctcagcctcct

SEQ ID NO: 31752 - DNA, 20 bp, Artificial Sequence
  Description of Artificial Sequence: Synthetic oligonucleotide
  Target: SCN9A; (-) strand; PAM type: NRG; PAM sequence: CAG
ttcaagtaattctcctgcct

SEQ ID NO: 31753 - DNA, 20 bp, Artificial Sequence
  Description of Artificial Sequence: Synthetic oligonucleotide
  Target: SCN9A; (-) strand; PAM type: NRG; PAM sequence: AAG
aacctctgcctgctgggttc

SEQ ID NO: 31754 - DNA, 20 bp, Artificial Sequence
  Description of Artificial Sequence: Synthetic oligonucleotide
  Target: SCN9A; (-) strand; PAM type: NRG; PAM sequence: GGG
cactgcaacctctgcctgct

SEQ ID NO: 31755 - DNA, 20 bp, Artificial Sequence
  Description of Artificial Sequence: Synthetic oligonucleotide
  Target: SCN9A; (-) strand; PAM type: NRG; PAM sequence: TGG
tcactgcaacctctgcctgc

SEQ ID NO: 31756 - DNA, 20 bp, Artificial Sequence
  Description of Artificial Sequence: Synthetic oligonucleotide
  Target: SCN9A; (-) strand; PAM type: NRG; PAM sequence: CGG
ggagtgcagtggcgcgatct

SEQ ID NO: 31757 - DNA, 20 bp, Artificial Sequence
  Description of Artificial Sequence: Synthetic oligonucleotide
  Target: SCN9A; (-) strand; PAM type: NRG; PAM sequence: TGG
tggttcaggctggagtgcag

SEQ ID NO: 31758 - DNA, 20 bp, Artificial Sequence
  Description of Artificial Sequence: Synthetic oligonucleotide
  Target: SCN9A; (-) strand; PAM type: NRG; PAM sequence: CAG
ctctggttcaggctggagtg

SEQ ID NO: 31759 - DNA, 20 bp, Artificial Sequence
  Description of Artificial Sequence: Synthetic oligonucleotide
  Target: SCN9A; (-) strand; PAM type: NRG; PAM sequence: GAG
ccgctctctggttcaggctg

SEQ ID NO: 31760 - DNA, 20 bp, Artificial Sequence
  Description of Artificial Sequence: Synthetic oligonucleotide
  Target: SCN9A; (-) strand; PAM type: NRG; PAM sequence: TGG
tcccgctctctggttcaggc

SEQ ID NO: 31761 - DNA, 20 bp, Artificial Sequence
  Description of Artificial Sequence: Synthetic oligonucleotide
  Target: SCN9A; (-) strand; PAM type: NRG; PAM sequence: AGG
ggagtcccgctctctggttc

SEQ ID NO: 31762 - DNA, 20 bp, Artificial Sequence
  Description of Artificial Sequence: Synthetic oligonucleotide
  Target: SCN9A; (-) strand; PAM type: NRG; PAM sequence: CAG
tggagtcccgctctctggtt

SEQ ID NO: 31763 - DNA, 20 bp, Artificial Sequence
  Description of Artificial Sequence: Synthetic oligonucleotide
  Target: SCN9A; (-) strand; PAM type: NRG; PAM sequence: TGG
tgagatggagtcccgctctc

SEQ ID NO: 31764 - DNA, 20 bp, Artificial Sequence
  Description of Artificial Sequence: Synthetic oligonucleotide
  Target: SCN9A; (-) strand; PAM type: NRG; PAM sequence: GAG
ttatttatttatttgagatg

SEQ ID NO: 31765 - DNA, 20 bp, Artificial Sequence
  Description of Artificial Sequence: Synthetic oligonucleotide
  Target: SCN9A; (-) strand; PAM type: NRG; PAM sequence: TGG
atttatttatttatttgaga

SEQ ID NO: 31766 - DNA, 20 bp, Artificial Sequence
  Description of Artificial Sequence: Synthetic oligonucleotide
  Target: SCN9A; (-) strand; PAM type: NRG; PAM sequence: GAG
ataaatttatttatttattt

SEQ ID NO: 31767 - DNA, 20 bp, Artificial Sequence
  Description of Artificial Sequence: Synthetic oligonucleotide
  Target: SCN9A; (-) strand; PAM type: NRG; PAM sequence: TGG
agatcttccaaatgattaat

SEQ ID NO: 31768 - DNA, 20 bp, Artificial Sequence
  Description of Artificial Sequence: Synthetic oligonucleotide
  Target: SCN9A; (-) strand; PAM type: NRG; PAM sequence: CAG
caatctcattcagattttgg

SEQ ID NO: 31769 - DNA, 20 bp, Artificial Sequence
  Description of Artificial Sequence: Synthetic oligonucleotide
  Target: SCN9A; (-) strand; PAM type: NRG; PAM sequence: TGG
actcaatctcattcagattt

SEQ ID NO: 31770 - DNA, 20 bp, Artificial Sequence
  Description of Artificial Sequence: Synthetic oligonucleotide
  Target: SCN9A; (-) strand; PAM type: NRG; PAM sequence: CAG
tatactgactcaatctcatt

SEQ ID NO: 31771 - DNA, 20 bp, Artificial Sequence
  Description of Artificial Sequence: Synthetic oligonucleotide
  Target: SCN9A; (-) strand; PAM type: NRG; PAM sequence: TAG
gtatttcattttacaacagt

SEQ ID NO: 31772 - DNA, 20 bp, Artificial Sequence
  Description of Artificial Sequence: Synthetic oligonucleotide
  Target: SCN9A; (-) strand; PAM type: NRG; PAM sequence: CAG
agcagtatttcattttacaa

SEQ ID NO: 31773 - DNA, 20 bp, Artificial Sequence
  Description of Artificial Sequence: Synthetic oligonucleotide
  Target: SCN9A; (-) strand; PAM type: NRG; PAM sequence: CAG
gagaagtgacattttcaaag

SEQ ID NO: 31774 - DNA, 20 bp, Artificial Sequence
  Description of Artificial Sequence: Synthetic oligonucleotide
  Target: SCN9A; (-) strand; PAM type: NRG; PAM sequence: AAG
ctagagaagtgacattttca

SEQ ID NO: 31775 - DNA, 20 bp, Artificial Sequence
  Description of Artificial Sequence: Synthetic oligonucleotide
  Target: SCN9A; (-) strand; PAM type: NRG; PAM sequence: AAG
atcactatgtgtttctagag

SEQ ID NO: 31776 - DNA, 20 bp, Artificial Sequence
  Description of Artificial Sequence: Synthetic oligonucleotide
  Target: SCN9A; (-) strand; PAM type: NRG; PAM sequence: GAG
aaaatcactatgtgtttcta

SEQ ID NO: 31777 - DNA, 20 bp, Artificial Sequence
  Description of Artificial Sequence: Synthetic oligonucleotide
  Target: SCN9A; (-) strand; PAM type: NRG; PAM sequence: TAG
aaaaaatcactatgtgtttc

SEQ ID NO: 31778 - DNA, 20 bp, Artificial Sequence
  Description of Artificial Sequence: Synthetic oligonucleotide
  Target: SCN9A; (-) strand; PAM type: NRG; PAM sequence: AGG
tcagtcaagattttacctgc

SEQ ID NO: 31779 - DNA, 20 bp, Artificial Sequence
  Description of Artificial Sequence: Synthetic oligonucleotide
  Target: SCN9A; (-) strand; PAM type: NRG; PAM sequence: CAG
ttcagtcaagattttacctg

SEQ ID NO: 31780 - DNA, 20 bp, Artificial Sequence
  Description of Artificial Sequence: Synthetic oligonucleotide
  Target: SCN9A; (-) strand; PAM type: NRG; PAM sequence: AAG
aaattaatggtacttcagtc

SEQ ID NO: 31781 - DNA, 20 bp, Artificial Sequence
  Description of Artificial Sequence: Synthetic oligonucleotide
  Target: SCN9A; (-) strand; PAM type: NRG; PAM sequence: CAG
tttaaaaattaatggtactt

SEQ ID NO: 31782 - DNA, 20 bp, Artificial Sequence
  Description of Artificial Sequence: Synthetic oligonucleotide
  Target: SCN9A; (-) strand; PAM type: NRG; PAM sequence: TGG
gagaatgctttaaaaattaa

SEQ ID NO: 31783 - DNA, 20 bp, Artificial Sequence
  Description of Artificial Sequence: Synthetic oligonucleotide
  Target: SCN9A; (-) strand; PAM type: NRG; PAM sequence: GAG
ttctgattctatggtgcctt

SEQ ID NO: 31784 - DNA, 20 bp, Artificial Sequence
  Description of Artificial Sequence: Synthetic oligonucleotide
  Target: SCN9A; (-) strand; PAM type: NRG; PAM sequence: TGG
gttctcatgttctgattcta

SEQ ID NO: 31785 - DNA, 20 bp, Artificial Sequence
  Description of Artificial Sequence: Synthetic oligonucleotide
  Target: SCN9A; (-) strand; PAM type: NRG; PAM sequence: AGG
atgatttaaataaacttttt

SEQ ID NO: 31786 - DNA, 20 bp, Artificial Sequence
  Description of Artificial Sequence: Synthetic oligonucleotide
  Target: SCN9A; (-) strand; PAM type: NRG; PAM sequence: TAG
tatgatttaaataaactttt

SEQ ID NO: 31787 - DNA, 20 bp, Artificial Sequence
  Description of Artificial Sequence: Synthetic oligonucleotide
  Target: SCN9A; (-) strand; PAM type: NRG; PAM sequence: GAG
caatggtacacattgtcaat

SEQ ID NO: 31788 - DNA, 20 bp, Artificial Sequence
  Description of Artificial Sequence: Synthetic oligonucleotide
  Target: SCN9A; (-) strand; PAM type: NRG; PAM sequence: TGG
ttctcatcacatagtatcaa

SEQ ID NO: 31789 - DNA, 20 bp, Artificial Sequence
  Description of Artificial Sequence: Synthetic oligonucleotide
  Target: SCN9A; (-) strand; PAM type: NRG; PAM sequence: TAG
aaaaggccattctcatcaca

SEQ ID NO: 31790 - DNA, 20 bp, Artificial Sequence
  Description of Artificial Sequence: Synthetic oligonucleotide
  Target: SCN9A; (-) strand; PAM type: NRG; PAM sequence: AGG
aggaagatcacatatgtaaa

SEQ ID NO: 31791 - DNA, 20 bp, Artificial Sequence
  Description of Artificial Sequence: Synthetic oligonucleotide
  Target: SCN9A; (-) strand; PAM type: NRG; PAM sequence: AAG
aaggaagatcacatatgtaa

SEQ ID NO: 31792 - DNA, 20 bp, Artificial Sequence
  Description of Artificial Sequence: Synthetic oligonucleotide
  Target: SCN9A; (-) strand; PAM type: NRG; PAM sequence: AAG
ggctataagttttgggaagg

SEQ ID NO: 31793 - DNA, 20 bp, Artificial Sequence
  Description of Artificial Sequence: Synthetic oligonucleotide
  Target: SCN9A; (-) strand; PAM type: NRG; PAM sequence: AGG
taaggctataagttttggga

SEQ ID NO: 31794 - DNA, 20 bp, Artificial Sequence
  Description of Artificial Sequence: Synthetic oligonucleotide
  Target: SCN9A; (-) strand; PAM type: NRG; PAM sequence: AAG
ttaaggctataagttttggg

SEQ ID NO: 31795 - DNA, 20 bp, Artificial Sequence
  Description of Artificial Sequence: Synthetic oligonucleotide
  Target: SCN9A; (-) strand; PAM type: NRG; PAM sequence: GGG
agattaaggctataagtttt

SEQ ID NO: 31796 - DNA, 20 bp, Artificial Sequence
  Description of Artificial Sequence: Synthetic oligonucleotide
  Target: SCN9A; (-) strand; PAM type: NRG; PAM sequence: TGG
tagattaaggctataagttt

SEQ ID NO: 31797 - DNA, 20 bp, Artificial Sequence
  Description of Artificial Sequence: Synthetic oligonucleotide
  Target: SCN9A; (-) strand; PAM type: NRG; PAM sequence: AAG
catggttagattaaggctat

SEQ ID NO: 31798 - DNA, 20 bp, Artificial Sequence
  Description of Artificial Sequence: Synthetic oligonucleotide
  Target: SCN9A; (-) strand; PAM type: NRG; PAM sequence: AGG
tttttctcatggttagatta

SEQ ID NO: 31799 - DNA, 20 bp, Artificial Sequence
  Description of Artificial Sequence: Synthetic oligonucleotide
  Target: SCN9A; (-) strand; PAM type: NRG; PAM sequence: AAG
atttttctcatggttagatt

SEQ ID NO: 31800 - DNA, 20 bp, Artificial Sequence
  Description of Artificial Sequence: Synthetic oligonucleotide
  Target: SCN9A; (-) strand; PAM type: NRG; PAM sequence: TAG
tctgatatttttctcatggt

SEQ ID NO: 31801 - DNA, 20 bp, Artificial Sequence
  Description of Artificial Sequence: Synthetic oligonucleotide
  Target: SCN9A; (-) strand; PAM type: NRG; PAM sequence: TGG
tttgtctgatatttttctca

SEQ ID NO: 31802 - DNA, 20 bp, Artificial Sequence
  Description of Artificial Sequence: Synthetic oligonucleotide
  Target: SCN9A; (-) strand; PAM type: NRG; PAM sequence: TGG
tttgtagaatgttcctgaat

SEQ ID NO: 31803 - DNA, 20 bp, Artificial Sequence
  Description of Artificial Sequence: Synthetic oligonucleotide
  Target: SCN9A; (-) strand; PAM type: NRG; PAM sequence: TAG
agtataggttaggtattttg

SEQ ID NO: 31804 - DNA, 20 bp, Artificial Sequence
  Description of Artificial Sequence: Synthetic oligonucleotide
  Target: SCN9A; (-) strand; PAM type: NRG; PAM sequence: AGG
actttgagtgagtataggtt

SEQ ID NO: 31805 - DNA, 20 bp, Artificial Sequence
  Description of Artificial Sequence: Synthetic oligonucleotide
  Target: SCN9A; (-) strand; PAM type: NRG; PAM sequence: TAG
tactttgagtgagtataggt

SEQ ID NO: 31806 - DNA, 20 bp, Artificial Sequence
  Description of Artificial Sequence: Synthetic oligonucleotide
  Target: SCN9A; (-) strand; PAM type: NRG; PAM sequence: AGG
ttgatactttgagtgagtat

SEQ ID NO: 31807 - DNA, 20 bp, Artificial Sequence
  Description of Artificial Sequence: Synthetic oligonucleotide
  Target: SCN9A; (-) strand; PAM type: NRG; PAM sequence: TAG
gttgatactttgagtgagta

SEQ ID NO: 31808 - DNA, 20 bp, Artificial Sequence
  Description of Artificial Sequence: Synthetic oligonucleotide
  Target: SCN9A; (-) strand; PAM type: NRG; PAM sequence: GAG
atgatgttgatactttgagt

SEQ ID NO: 31809 - DNA, 20 bp, Artificial Sequence
  Description of Artificial Sequence: Synthetic oligonucleotide
  Target: SCN9A; (-) strand; PAM type: NRG; PAM sequence: GAG
tttgatgatgttgatacttt

SEQ ID NO: 31810 - DNA, 20 bp, Artificial Sequence
  Description of Artificial Sequence: Synthetic oligonucleotide
  Target: SCN9A; (-) strand; PAM type: NRG; PAM sequence: AGG
ctaggctgtcgcaatttctc

SEQ ID NO: 31811 - DNA, 20 bp, Artificial Sequence
  Description of Artificial Sequence: Synthetic oligonucleotide
  Target: SCN9A; (-) strand; PAM type: NRG; PAM sequence: CAG
tctaggctgtcgcaatttct

SEQ ID NO: 31812 - DNA, 20 bp, Artificial Sequence
  Description of Artificial Sequence: Synthetic oligonucleotide
  Target: SCN9A; (-) strand; PAM type: NRG; PAM sequence: AGG
atatcaccttaagcatctct

SEQ ID NO: 31813 - DNA, 20 bp, Artificial Sequence
  Description of Artificial Sequence: Synthetic oligonucleotide
  Target: SCN9A; (-) strand; PAM type: NRG; PAM sequence: TAG
catatcaccttaagcatctc

SEQ ID NO: 31814 - DNA, 20 bp, Artificial Sequence
  Description of Artificial Sequence: Synthetic oligonucleotide
  Target: SCN9A; (-) strand; PAM type: NRG; PAM sequence: AAG
tcataccatcatatcacctt

SEQ ID NO: 31815 - DNA, 20 bp, Artificial Sequence
  Description of Artificial Sequence: Synthetic oligonucleotide
  Target: SCN9A; (-) strand; PAM type: NRG; PAM sequence: AGG
tctctttcaagatctcaccc

SEQ ID NO: 31816 - DNA, 20 bp, Artificial Sequence
  Description of Artificial Sequence: Synthetic oligonucleotide
  Target: SCN9A; (-) strand; PAM type: NRG; PAM sequence: CAG
ttctctttcaagatctcacc

SEQ ID NO: 31817 - DNA, 20 bp, Artificial Sequence
  Description of Artificial Sequence: Synthetic oligonucleotide
  Target: SCN9A; (-) strand; PAM type: NRG; PAM sequence: AAG
taatttcctttttctctttc

SEQ ID NO: 31818 - DNA, 20 bp, Artificial Sequence
  Description of Artificial Sequence: Synthetic oligonucleotide
  Target: SCN9A; (-) strand; PAM type: NRG; PAM sequence: TAG
ttaccctattcagagttcct

SEQ ID NO: 31819 - DNA, 20 bp, Artificial Sequence
  Description of Artificial Sequence: Synthetic oligonucleotide
  Target: SCN9A; (-) strand; PAM type: NRG; PAM sequence: GAG
aaatgcccttaccctattca

SEQ ID NO: 31820 - DNA, 20 bp, Artificial Sequence
  Description of Artificial Sequence: Synthetic oligonucleotide
  Target: SCN9A; (-) strand; PAM type: NRG; PAM sequence: CAG
acaaatgcccttaccctatt

SEQ ID NO: 31821 - DNA, 20 bp, Artificial Sequence
  Description of Artificial Sequence: Synthetic oligonucleotide
  Target: SCN9A; (-) strand; PAM type: NRG; PAM sequence: TGG
attaacagtttatattagta

SEQ ID NO: 31822 - DNA, 20 bp, Artificial Sequence
  Description of Artificial Sequence: Synthetic oligonucleotide
  Target: SCN9A; (-) strand; PAM type: NRG; PAM sequence: TAG
ctgttattaacagtttatat

SEQ ID NO: 31823 - DNA, 20 bp, Artificial Sequence
  Description of Artificial Sequence: Synthetic oligonucleotide
  Target: SCN9A; (-) strand; PAM type: NRG; PAM sequence: CAG
ccagtttcccctgttattaa

SEQ ID NO: 31824 - DNA, 20 bp, Artificial Sequence
  Description of Artificial Sequence: Synthetic oligonucleotide
  Target: SCN9A; (-) strand; PAM type: NRG; PAM sequence: CAG
gtttcaatataccccacatc

SEQ ID NO: 31825 - DNA, 20 bp, Artificial Sequence
  Description of Artificial Sequence: Synthetic oligonucleotide
  Target: SCN9A; (-) strand; PAM type: NRG; PAM sequence: CAG
aatggtgcagatagtaagga

SEQ ID NO: 31826 - DNA, 20 bp, Artificial Sequence
  Description of Artificial Sequence: Synthetic oligonucleotide
  Target: SCN9A; (-) strand; PAM type: NRG; PAM sequence: AGG
gaaaaatggtgcagatagta

SEQ ID NO: 31827 - DNA, 20 bp, Artificial Sequence
  Description of Artificial Sequence: Synthetic oligonucleotide
  Target: SCN9A; (-) strand; PAM type: NRG; PAM sequence: AAG
ggaaaaatggtgcagatagt

SEQ ID NO: 31828 - DNA, 20 bp, Artificial Sequence
  Description of Artificial Sequence: Synthetic oligonucleotide
  Target: SCN9A; (-) strand; PAM type: NRG; PAM sequence: TAG
ttatggaaaaatggtgcaga

SEQ ID NO: 31829 - DNA, 20 bp, Artificial Sequence
  Description of Artificial Sequence: Synthetic oligonucleotide
  Target: SCN9A; (-) strand; PAM type: NRG; PAM sequence: CAG
agatttatggaaaaatggtg

SEQ ID NO: 31830 - DNA, 20 bp, Artificial Sequence
  Description of Artificial Sequence: Synthetic oligonucleotide
  Target: SCN9A; (-) strand; PAM type: NRG; PAM sequence: TGG
ggaatagatttatggaaaaa

SEQ ID NO: 31831 - DNA, 20 bp, Artificial Sequence
  Description of Artificial Sequence: Synthetic oligonucleotide
  Target: SCN9A; (-) strand; PAM type: NRG; PAM sequence: TGG
tttgtcttggaatagattta

SEQ ID NO: 31832 - DNA, 20 bp, Artificial Sequence
  Description of Artificial Sequence: Synthetic oligonucleotide
  Target: SCN9A; (-) strand; PAM type: NRG; PAM sequence: TAG
cttaaacttttgtcttggaa

SEQ ID NO: 31833 - DNA, 20 bp, Artificial Sequence
  Description of Artificial Sequence: Synthetic oligonucleotide
  Target: SCN9A; (-) strand; PAM type: NRG; PAM sequence: TGG
ttttgcttaaacttttgtct

SEQ ID NO: 31834 - DNA, 20 bp, Artificial Sequence
  Description of Artificial Sequence: Synthetic oligonucleotide
  Target: SCN9A; (-) strand; PAM type: NRG; PAM sequence: TAG
ttattacctttatttaatat

SEQ ID NO: 31835 - DNA, 20 bp, Artificial Sequence
  Description of Artificial Sequence: Synthetic oligonucleotide
  Target: SCN9A; (-) strand; PAM type: NRG; PAM sequence: GAG
ctgataaattcaaattcact

SEQ ID NO: 31836 - DNA, 20 bp, Artificial Sequence
  Description of Artificial Sequence: Synthetic oligonucleotide
  Target: SCN9A; (-) strand; PAM type: NRG; PAM sequence: TGG
attatagataatatagataa

SEQ ID NO: 31837 - DNA, 20 bp, Artificial Sequence
  Description of Artificial Sequence: Synthetic oligonucleotide
  Target: SCN9A; (-) strand; PAM type: NRG; PAM sequence: TAG
taggtatattatagataata

SEQ ID NO: 31838 - DNA, 20 bp, Artificial Sequence
  Description of Artificial Sequence: Synthetic oligonucleotide
  Target: SCN9A; (-) strand; PAM type: NRG; PAM sequence: TAG
attatcacttaggtatatta

SEQ ID NO: 31839 - DNA, 20 bp, Artificial Sequence
  Description of Artificial Sequence: Synthetic oligonucleotide
  Target: SCN9A; (-) strand; PAM type: NRG; PAM sequence: AGG
atttatgtctattatcactt

SEQ ID NO: 31840 - DNA, 20 bp, Artificial Sequence
  Description of Artificial Sequence: Synthetic oligonucleotide
  Target: SCN9A; (-) strand; PAM type: NRG; PAM sequence: TAG
aatttatgtctattatcact

SEQ ID NO: 31841 - DNA, 20 bp, Artificial Sequence
  Description of Artificial Sequence: Synthetic oligonucleotide
  Target: SCN9A; (-) strand; PAM type: NRG; PAM sequence: TGG
taattcattttaattaaaag

SEQ ID NO: 31842 - DNA, 20 bp, Artificial Sequence
  Description of Artificial Sequence: Synthetic oligonucleotide
  Target: SCN9A; (-) strand; PAM type: NRG; PAM sequence: AAG
ttgtaattcattttaattaa

SEQ ID NO: 31843 - DNA, 20 bp, Artificial Sequence
  Description of Artificial Sequence: Synthetic oligonucleotide
  Target: SCN9A; (-) strand; PAM type: NRG; PAM sequence: AAG
aatggatctcctattgatca

SEQ ID NO: 31844 - DNA, 20 bp, Artificial Sequence
  Description of Artificial Sequence: Synthetic oligonucleotide
  Target: SCN9A; (-) strand; PAM type: NRG; PAM sequence: TGG
aaactgatcagcatttctaa

SEQ ID NO: 31845 - DNA, 20 bp, Artificial Sequence
  Description of Artificial Sequence: Synthetic oligonucleotide
  Target: SCN9A; (-) strand; PAM type: NRG; PAM sequence: CAG
attactttaagaaaactgat

SEQ ID NO: 31846 - DNA, 20 bp, Artificial Sequence
  Description of Artificial Sequence: Synthetic oligonucleotide
  Target: SCN9A; (-) strand; PAM type: NRG; PAM sequence: AAG
ctcccaggcatgattacttt

SEQ ID NO: 31847 - DNA, 20 bp, Artificial Sequence
  Description of Artificial Sequence: Synthetic oligonucleotide
  Target: SCN9A; (-) strand; PAM type: NRG; PAM sequence: AGG
ttatagaaaattatcctccc

SEQ ID NO: 31848 - DNA, 20 bp, Artificial Sequence
  Description of Artificial Sequence: Synthetic oligonucleotide
  Target: SCN9A; (-) strand; PAM type: NRG; PAM sequence: CAG
tttatagaaaattatcctcc

SEQ ID NO: 31849 - DNA, 20 bp, Artificial Sequence
  Description of Artificial Sequence: Synthetic oligonucleotide
  Target: SCN9A; (-) strand; PAM type: NRG; PAM sequence: TAG
gacccaggagagtgcattta

SEQ ID NO: 31850 - DNA, 20 bp, Artificial Sequence
  Description of Artificial Sequence: Synthetic oligonucleotide
  Target: SCN9A; (-) strand; PAM type: NRG; PAM sequence: GAG
agctcattcctgacccagga

SEQ ID NO: 31851 - DNA, 20 bp, Artificial Sequence
  Description of Artificial Sequence: Synthetic oligonucleotide
  Target: SCN9A; (-) strand; PAM type: NRG; PAM sequence: GAG
taagctcattcctgacccag

SEQ ID NO: 31852 - DNA, 20 bp, Artificial Sequence
  Description of Artificial Sequence: Synthetic oligonucleotide
  Target: SCN9A; (-) strand; PAM type: NRG; PAM sequence: AGG
cataagctcattcctgaccc

SEQ ID NO: 31853 - DNA, 20 bp, Artificial Sequence
  Description of Artificial Sequence: Synthetic oligonucleotide
  Target: SCN9A; (-) strand; PAM type: NRG; PAM sequence: CAG
tcataagctcattcctgacc

SEQ ID NO: 31854 - DNA, 20 bp, Artificial Sequence
  Description of Artificial Sequence: Synthetic oligonucleotide
  Target: SCN9A; (-) strand; PAM type: NRG; PAM sequence: AAG
gttctatgtttataagtcat

SEQ ID NO: 31855 - DNA, 20 bp, Artificial Sequence
  Description of Artificial Sequence: Synthetic oligonucleotide
  Target: SCN9A; (-) strand; PAM type: NRG; PAM sequence: AAG
cagtttagttctatgtttat

SEQ ID NO: 31856 - DNA, 20 bp, Artificial Sequence
  Description of Artificial Sequence: Synthetic oligonucleotide
  Target: SCN9A; (-) strand; PAM type: NRG; PAM sequence: TAG
cagacattgtgactccagtt

SEQ ID NO: 31857 - DNA, 20 bp, Artificial Sequence
  Description of Artificial Sequence: Synthetic oligonucleotide
  Target: SCN9A; (-) strand; PAM type: NRG; PAM sequence: CAG
ggactcagacattgtgactc

SEQ ID NO: 31858 - DNA, 20 bp, Artificial Sequence
  Description of Artificial Sequence: Synthetic oligonucleotide
  Target: SCN9A; (-) strand; PAM type: NRG; PAM sequence: CAG
tctcaagtataattaggact

SEQ ID NO: 31859 - DNA, 20 bp, Artificial Sequence
  Description of Artificial Sequence: Synthetic oligonucleotide
  Target: SCN9A; (-) strand; PAM type: NRG; PAM sequence: AGG
aatgactctcaagtataatt

SEQ ID NO: 31860 - DNA, 20 bp, Artificial Sequence
  Description of Artificial Sequence: Synthetic oligonucleotide
  Target: SCN9A; (-) strand; PAM type: NRG; PAM sequence: TAG
taatgactctcaagtataat

SEQ ID NO: 31861 - DNA, 20 bp, Artificial Sequence
  Description of Artificial Sequence: Synthetic oligonucleotide
  Target: SCN9A; (-) strand; PAM type: NRG; PAM sequence: AAG
aataagacataatgactctc

SEQ ID NO: 31862 - DNA, 20 bp, Artificial Sequence
  Description of Artificial Sequence: Synthetic oligonucleotide
  Target: SCN9A; (-) strand; PAM type: NRG; PAM sequence: AAG
tttttttagcctattataat

SEQ ID NO: 31863 - DNA, 20 bp, Artificial Sequence
  Description of Artificial Sequence: Synthetic oligonucleotide
  Target: SCN9A; (-) strand; PAM type: NRG; PAM sequence: TAG
ccctcataagtgtatttttt

SEQ ID NO: 31864 - DNA, 20 bp, Artificial Sequence
  Description of Artificial Sequence: Synthetic oligonucleotide
  Target: SCN9A; (-) strand; PAM type: NRG; PAM sequence: AAG
atacacacagattccctcat

SEQ ID NO: 31865 - DNA, 20 bp, Artificial Sequence
  Description of Artificial Sequence: Synthetic oligonucleotide
  Target: SCN9A; (-) strand; PAM type: NRG; PAM sequence: CAG
attctaaaagaaaatacaca

SEQ ID NO: 31866 - DNA, 20 bp, Artificial Sequence
  Description of Artificial Sequence: Synthetic oligonucleotide
  Target: SCN9A; (-) strand; PAM type: NRG; PAM sequence: AAG
ttaaattgtacttattctaa

SEQ ID NO: 31867 - DNA, 20 bp, Artificial Sequence
  Description of Artificial Sequence: Synthetic oligonucleotide
  Target: SCN9A; (-) strand; PAM type: NRG; PAM sequence: GAG
tatgcttaccatggttgagg

SEQ ID NO: 31868 - DNA, 20 bp, Artificial Sequence
  Description of Artificial Sequence: Synthetic oligonucleotide
  Target: SCN9A; (-) strand; PAM type: NRG; PAM sequence: GGG
agtatgcttaccatggttga

SEQ ID NO: 31869 - DNA, 20 bp, Artificial Sequence
  Description of Artificial Sequence: Synthetic oligonucleotide
  Target: SCN9A; (-) strand; PAM type: NRG; PAM sequence: AGG
tagtatgcttaccatggttg

SEQ ID NO: 31870 - DNA, 20 bp, Artificial Sequence
  Description of Artificial Sequence: Synthetic oligonucleotide
  Target: SCN9A; (-) strand; PAM type: NRG; PAM sequence: GAG
ttagtatgcttaccatggtt

SEQ ID NO: 31871 - DNA, 20 bp, Artificial Sequence
  Description of Artificial Sequence: Synthetic oligonucleotide
  Target: SCN9A; (-) strand; PAM type: NRG; PAM sequence: TGG
gatatttagtatgcttacca

SEQ ID NO: 31872 - DNA, 20 bp, Artificial Sequence
  Description of Artificial Sequence: Synthetic oligonucleotide
  Target: SCN9A; (-) strand; PAM type: NRG; PAM sequence: TAG
ttaacaacttaaaagatatt

SEQ ID NO: 31873 - DNA, 20 bp, Artificial Sequence
  Description of Artificial Sequence: Synthetic oligonucleotide
  Target: SCN9A; (-) strand; PAM type: NRG; PAM sequence: AAG
gcttcaatttaacaacttaa

SEQ ID NO: 31874 - DNA, 20 bp, Artificial Sequence
  Description of Artificial Sequence: Synthetic oligonucleotide
  Target: SCN9A; (-) strand; PAM type: NRG; PAM sequence: AAG
attaagatggatatgtaata

SEQ ID NO: 31875 - DNA, 20 bp, Artificial Sequence
  Description of Artificial Sequence: Synthetic oligonucleotide
  Target: SCN9A; (-) strand; PAM type: NRG; PAM sequence: TGG
ccttaacggcatcattaaga

SEQ ID NO: 31876 - DNA, 20 bp, Artificial Sequence
  Description of Artificial Sequence: Synthetic oligonucleotide
  Target: SCN9A; (-) strand; PAM type: NRG; PAM sequence: AAG
tgtaccttaacggcatcatt

SEQ ID NO: 31877 - DNA, 20 bp, Artificial Sequence
  Description of Artificial Sequence: Synthetic oligonucleotide
  Target: SCN9A; (-) strand; PAM type: NRG; PAM sequence: CGG
gtcagccttttgtaccttaa

SEQ ID NO: 31878 - DNA, 20 bp, Artificial Sequence
  Description of Artificial Sequence: Synthetic oligonucleotide
  Target: SCN9A; (-) strand; PAM type: NRG; PAM sequence: CAG
gtaacacagaaatcaaaagt

SEQ ID NO: 31879 - DNA, 20 bp, Artificial Sequence
  Description of Artificial Sequence: Synthetic oligonucleotide
  Target: SCN9A; (-) strand; PAM type: NRG; PAM sequence: AAG
taaagtaacacagaaatcaa

SEQ ID NO: 31880 - DNA, 20 bp, Artificial Sequence
  Description of Artificial Sequence: Synthetic oligonucleotide
  Target: SCN9A; (-) strand; PAM type: NRG; PAM sequence: CAG
tcacagttcctaaagtaaca

SEQ ID NO: 31881 - DNA, 20 bp, Artificial Sequence
  Description of Artificial Sequence: Synthetic oligonucleotide
  Target: SCN9A; (-) strand; PAM type: NRG; PAM sequence: AAG
atgttacctcacagttccta

SEQ ID NO: 31882 - DNA, 20 bp, Artificial Sequence
  Description of Artificial Sequence: Synthetic oligonucleotide
  Target: SCN9A; (-) strand; PAM type: NRG; PAM sequence: CAG
tttatctctatgttacctca

SEQ ID NO: 31883 - DNA, 20 bp, Artificial Sequence
  Description of Artificial Sequence: Synthetic oligonucleotide
  Target: SCN9A; (-) strand; PAM type: NRG; PAM sequence: GAG
tcagtaaaatgagaatctca

SEQ ID NO: 31884 - DNA, 20 bp, Artificial Sequence
  Description of Artificial Sequence: Synthetic oligonucleotide
  Target: SCN9A; (-) strand; PAM type: NRG; PAM sequence: CAG
gctcagtaaaatgagaatct

SEQ ID NO: 31885 - DNA, 20 bp, Artificial Sequence
  Description of Artificial Sequence: Synthetic oligonucleotide
  Target: SCN9A; (-) strand; PAM type: NRG; PAM sequence: GAG
tgttcagagctcagtaaaat

SEQ ID NO: 31886 - DNA, 20 bp, Artificial Sequence
  Description of Artificial Sequence: Synthetic oligonucleotide
  Target: SCN9A; (-) strand; PAM type: NRG; PAM sequence: CAG
gttatcaggtgttcagagct

SEQ ID NO: 31887 - DNA, 20 bp, Artificial Sequence
  Description of Artificial Sequence: Synthetic oligonucleotide
  Target: SCN9A; (-) strand; PAM type: NRG; PAM sequence: GAG
atgatgttatcaggtgttca

SEQ ID NO: 31888 - DNA, 20 bp, Artificial Sequence
  Description of Artificial Sequence: Synthetic oligonucleotide
  Target: SCN9A; (-) strand; PAM type: NRG; PAM sequence: CAG
tgatgatgttatcaggtgtt

SEQ ID NO: 31889 - DNA, 20 bp, Artificial Sequence
  Description of Artificial Sequence: Synthetic oligonucleotide
  Target: SCN9A; (-) strand; PAM type: NRG; PAM sequence: AGG
cttgctctgatgatgttatc

SEQ ID NO: 31890 - DNA, 20 bp, Artificial Sequence
  Description of Artificial Sequence: Synthetic oligonucleotide
  Target: SCN9A; (-) strand; PAM type: NRG; PAM sequence: CAG
tcttgctctgatgatgttat

SEQ ID NO: 31891 - DNA, 20 bp, Artificial Sequence
  Description of Artificial Sequence: Synthetic oligonucleotide
  Target: SCN9A; (-) strand; PAM type: NRG; PAM sequence: GAG
tatccttgtcagccagagtg

SEQ ID NO: 31892 - DNA, 20 bp, Artificial Sequence
  Description of Artificial Sequence: Synthetic oligonucleotide
  Target: SCN9A; (-) strand; PAM type: NRG; PAM sequence: TGG
cgtatccttgtcagccagag

SEQ ID NO: 31893 - DNA, 20 bp, Artificial Sequence
  Description of Artificial Sequence: Synthetic oligonucleotide
  Target: SCN9A; (-) strand; PAM type: NRG; PAM sequence: GAG
aagcgtatccttgtcagcca

SEQ ID NO: 31894 - DNA, 20 bp, Artificial Sequence
  Description of Artificial Sequence: Synthetic oligonucleotide
  Target: SCN9A; (-) strand; PAM type: NRG; PAM sequence: CAG
ttaagcgtatccttgtcagc

SEQ ID NO: 31895 - DNA, 20 bp, Artificial Sequence
  Description of Artificial Sequence: Synthetic oligonucleotide
  Target: SCN9A; (-) strand; PAM type: NRG; PAM sequence: CAG
agggttaagcgtatccttgt

SEQ ID NO: 31896 - DNA, 20 bp, Artificial Sequence
  Description of Artificial Sequence: Synthetic oligonucleotide
  Target: SCN9A; (-) strand; PAM type: NRG; PAM sequence: AAG
tgtagttataaaccagggtt

SEQ ID NO: 31897 - DNA, 20 bp, Artificial Sequence
  Description of Artificial Sequence: Synthetic oligonucleotide
  Target: SCN9A; (-) strand; PAM type: NRG; PAM sequence: GGG
gcttttgtagttataaacca

SEQ ID NO: 31898 - DNA, 20 bp, Artificial Sequence
  Description of Artificial Sequence: Synthetic oligonucleotide
  Target: SCN9A; (-) strand; PAM type: NRG; PAM sequence: AGG
ggcttttgtagttataaacc

SEQ ID NO: 31899 - DNA, 20 bp, Artificial Sequence
  Description of Artificial Sequence: Synthetic oligonucleotide
  Target: SCN9A; (-) strand; PAM type: NRG; PAM sequence: CAG
gggcttttgtagttataaac

SEQ ID NO: 31900 - DNA, 20 bp, Artificial Sequence
  Description of Artificial Sequence: Synthetic oligonucleotide
  Target: SCN9A; (-) strand; PAM type: NRG; PAM sequence: TAG
attgacaaaaggggcttttg

SEQ ID NO: 31901 - DNA, 20 bp, Artificial Sequence
  Description of Artificial Sequence: Synthetic oligonucleotide
  Target: SCN9A; (-) strand; PAM type: NRG; PAM sequence: GGG
taaaatattattgacaaaag

SEQ ID NO: 31902 - DNA, 20 bp, Artificial Sequence
  Description of Artificial Sequence: Synthetic oligonucleotide
  Target: SCN9A; (-) strand; PAM type: NRG; PAM sequence: GGG
ttaaaatattattgacaaaa

SEQ ID NO: 31903 - DNA, 20 bp, Artificial Sequence
  Description of Artificial Sequence: Synthetic oligonucleotide
  Target: SCN9A; (-) strand; PAM type: NRG; PAM sequence: AGG
tttaaaatattattgacaaa

SEQ ID NO: 31904 - DNA, 20 bp, Artificial Sequence
  Description of Artificial Sequence: Synthetic oligonucleotide
  Target: SCN9A; (-) strand; PAM type: NRG; PAM sequence: AAG
atttaaaatattattgacaa

SEQ ID NO: 31905 - DNA, 20 bp, Artificial Sequence
  Description of Artificial Sequence: Synthetic oligonucleotide
  Target: SCN9A; (-) strand; PAM type: NRG; PAM sequence: GAG
tgatgttatcgaacatagga

SEQ ID NO: 31906 - DNA, 20 bp, Artificial Sequence
  Description of Artificial Sequence: Synthetic oligonucleotide
  Target: SCN9A; (-) strand; PAM type: NRG; PAM sequence: GAG
ggtgatgttatcgaacatag

SEQ ID NO: 31907 - DNA, 20 bp, Artificial Sequence
  Description of Artificial Sequence: Synthetic oligonucleotide
  Target: SCN9A; (-) strand; PAM type: NRG; PAM sequence: AGG
aaggtgatgttatcgaacat

SEQ ID NO: 31908 - DNA, 20 bp, Artificial Sequence
  Description of Artificial Sequence: Synthetic oligonucleotide
  Target: SCN9A; (-) strand; PAM type: NRG; PAM sequence: TAG
gaaggtgatgttatcgaaca

SEQ ID NO: 31909 - DNA, 20 bp, Artificial Sequence
  Description of Artificial Sequence: Synthetic oligonucleotide
  Target: SCN9A; (-) strand; PAM type: NRG; PAM sequence: AGG
tatgagtagataagttatga

SEQ ID NO: 31910 - DNA, 20 bp, Artificial Sequence
  Description of Artificial Sequence: Synthetic oligonucleotide
  Target: SCN9A; (-) strand; PAM type: NRG; PAM sequence: AAG
ttatgagtagataagttatg

SEQ ID NO: 31911 - DNA, 20 bp, Artificial Sequence
  Description of Artificial Sequence: Synthetic oligonucleotide
  Target: SCN9A; (-) strand; PAM type: NRG; PAM sequence: AAG
gtcttatgttatgagtagat

SEQ ID NO: 31912 - DNA, 20 bp, Artificial Sequence
  Description of Artificial Sequence: Synthetic oligonucleotide
  Target: SCN9A; (-) strand; PAM type: NRG; PAM sequence: TAG
gggaagtcttatgttatgag

SEQ ID NO: 31913 - DNA, 20 bp, Artificial Sequence
  Description of Artificial Sequence: Synthetic oligonucleotide
  Target: SCN9A; (-) strand; PAM type: NRG; PAM sequence: GAG
catgggaagtcttatgttat

SEQ ID NO: 31914 - DNA, 20 bp, Artificial Sequence
  Description of Artificial Sequence: Synthetic oligonucleotide
  Target: SCN9A; (-) strand; PAM type: NRG; PAM sequence: AAG
tatttctcttttatcatggg

SEQ ID NO: 31915 - DNA, 20 bp, Artificial Sequence
  Description of Artificial Sequence: Synthetic oligonucleotide
  Target: SCN9A; (-) strand; PAM type: NRG; PAM sequence: GGG
acatatttctcttttatcat

SEQ ID NO: 31916 - DNA, 20 bp, Artificial Sequence
  Description of Artificial Sequence: Synthetic oligonucleotide
  Target: SCN9A; (-) strand; PAM type: NRG; PAM sequence: TGG
gacatatttctcttttatca

SEQ ID NO: 31917 - DNA, 20 bp, Artificial Sequence
  Description of Artificial Sequence: Synthetic oligonucleotide
  Target: SCN9A; (-) strand; PAM type: NRG; PAM sequence: AGG
ctataagagttcatactgga

SEQ ID NO: 31918 - DNA, 20 bp, Artificial Sequence
  Description of Artificial Sequence: Synthetic oligonucleotide
  Target: SCN9A; (-) strand; PAM type: NRG; PAM sequence: AAG
cctataagagttcatactgg

SEQ ID NO: 31919 - DNA, 20 bp, Artificial Sequence
  Description of Artificial Sequence: Synthetic oligonucleotide
  Target: SCN9A; (-) strand; PAM type: NRG; PAM sequence: TGG
aggcctataagagttcatac

SEQ ID NO: 31920 - DNA, 20 bp, Artificial Sequence
  Description of Artificial Sequence: Synthetic oligonucleotide
  Target: SCN9A; (-) strand; PAM type: NRG; PAM sequence: GAG
tcatgggagaaggcctataa

SEQ ID NO: 31921 - DNA, 20 bp, Artificial Sequence
  Description of Artificial Sequence: Synthetic oligonucleotide
  Target: SCN9A; (-) strand; PAM type: NRG; PAM sequence: AAG
tttcatgggagaaggcctat

SEQ ID NO: 31922 - DNA, 20 bp, Artificial Sequence
  Description of Artificial Sequence: Synthetic oligonucleotide
  Target: SCN9A; (-) strand; PAM type: NRG; PAM sequence: AGG
ttttctgttttcatgggaga

SEQ ID NO: 31923 - DNA, 20 bp, Artificial Sequence
  Description of Artificial Sequence: Synthetic oligonucleotide
  Target: SCN9A; (-) strand; PAM type: NRG; PAM sequence: AAG
tttttctgttttcatgggag

SEQ ID NO: 31924 - DNA, 20 bp, Artificial Sequence
  Description of Artificial Sequence: Synthetic oligonucleotide
  Target: SCN9A; (-) strand; PAM type: NRG; PAM sequence: GAG
aaatttttctgttttcatgg

SEQ ID NO: 31925 - DNA, 20 bp, Artificial Sequence
  Description of Artificial Sequence: Synthetic oligonucleotide
  Target: SCN9A; (-) strand; PAM type: NRG; PAM sequence: GGG
ggaaatttttctgttttcat

SEQ ID NO: 31926 - DNA, 20 bp, Artificial Sequence
  Description of Artificial Sequence: Synthetic oligonucleotide
  Target: SCN9A; (-) strand; PAM type: NRG; PAM sequence: TGG
tggaaatttttctgttttca

SEQ ID NO: 31927 - DNA, 20 bp, Artificial Sequence
  Description of Artificial Sequence: Synthetic oligonucleotide
  Target: SCN9A; (-) strand; PAM type: NRG; PAM sequence: TGG
acagagttttcagatccatc

SEQ ID NO: 31928 - DNA, 20 bp, Artificial Sequence
  Description of Artificial Sequence: Synthetic oligonucleotide
  Target: SCN9A; (-) strand; PAM type: NRG; PAM sequence: CAG
aagacatagaacagagtttt

SEQ ID NO: 31929 - DNA, 20 bp, Artificial Sequence
  Description of Artificial Sequence: Synthetic oligonucleotide
  Target: SCN9A; (-) strand; PAM type: NRG; PAM sequence: GAG
tggtgccaagacatagaaca

SEQ ID NO: 31930 - DNA, 20 bp, Artificial Sequence
  Description of Artificial Sequence: Synthetic oligonucleotide
  Target: SCN9A; (-) strand; PAM type: NRG; PAM sequence: CAG
cttggtgccaagacatagaa

SEQ ID NO: 31931 - DNA, 20 bp, Artificial Sequence
  Description of Artificial Sequence: Synthetic oligonucleotide
  Target: SCN9A; (-) strand; PAM type: NRG; PAM sequence: TAG
attttcttggtgccaagaca

SEQ ID NO: 31932 - DNA, 20 bp, Artificial Sequence
  Description of Artificial Sequence: Synthetic oligonucleotide
  Target: SCN9A; (-) strand; PAM type: NRG; PAM sequence: AAG
tccaatattttcttggtgcc

SEQ ID NO: 31933 - DNA, 20 bp, Artificial Sequence
  Description of Artificial Sequence: Synthetic oligonucleotide
  Target: SCN9A; (-) strand; PAM type: NRG; PAM sequence: TGG
gaaggactccaatattttct

SEQ ID NO: 31934 - DNA, 20 bp, Artificial Sequence
  Description of Artificial Sequence: Synthetic oligonucleotide
  Target: SCN9A; (-) strand; PAM type: NRG; PAM sequence: AGG
atcggaggccaggtgtagga

SEQ ID NO: 31935 - DNA, 20 bp, Artificial Sequence
  Description of Artificial Sequence: Synthetic oligonucleotide
  Target: SCN9A; (-) strand; PAM type: NRG; PAM sequence: AAG
aatcggaggccaggtgtagg

SEQ ID NO: 31936 - DNA, 20 bp, Artificial Sequence
  Description of Artificial Sequence: Synthetic oligonucleotide
  Target: SCN9A; (-) strand; PAM type: NRG; PAM sequence: AGG
ttcaatcggaggccaggtgt

SEQ ID NO: 31937 - DNA, 20 bp, Artificial Sequence
  Description of Artificial Sequence: Synthetic oligonucleotide
  Target: SCN9A; (-) strand; PAM type: NRG; PAM sequence: TAG
attcaatcggaggccaggtg

SEQ ID NO: 31938 - DNA, 20 bp, Artificial Sequence
  Description of Artificial Sequence: Synthetic oligonucleotide
  Target: SCN9A; (-) strand; PAM type: NRG; PAM sequence: AGG
cacttattcaatcggaggcc

SEQ ID NO: 31939 - DNA, 20 bp, Artificial Sequence
  Description of Artificial Sequence: Synthetic oligonucleotide
  Target: SCN9A; (-) strand; PAM type: NRG; PAM sequence: CAG
tcacttattcaatcggaggc

SEQ ID NO: 31940 - DNA, 20 bp, Artificial Sequence
  Description of Artificial Sequence: Synthetic oligonucleotide
  Target: SCN9A; (-) strand; PAM type: NRG; PAM sequence: AGG
tatttcacttattcaatcgg

SEQ ID NO: 31941 - DNA, 20 bp, Artificial Sequence
  Description of Artificial Sequence: Synthetic oligonucleotide
  Target: SCN9A; (-) strand; PAM type: NRG; PAM sequence: GAG
atatttcacttattcaatcg

SEQ ID NO: 31942 - DNA, 20 bp, Artificial Sequence
  Description of Artificial Sequence: Synthetic oligonucleotide
  Target: SCN9A; (-) strand; PAM type: NRG; PAM sequence: CGG
tgatatttcacttattcaat

SEQ ID NO: 31943 - DNA, 20 bp, Artificial Sequence
  Description of Artificial Sequence: Synthetic oligonucleotide
  Target: SCN9A; (-) strand; PAM type: NRG; PAM sequence: TAG
tttatcttgttattgacata

SEQ ID NO: 31944 - DNA, 20 bp, Artificial Sequence
  Description of Artificial Sequence: Synthetic oligonucleotide
  Target: SCN9A; (-) strand; PAM type: NRG; PAM sequence: CAG
cttattgtctttgaatgttt

SEQ ID NO: 31945 - DNA, 20 bp, Artificial Sequence
  Description of Artificial Sequence: Synthetic oligonucleotide
  Target: SCN9A; (-) strand; PAM type: NRG; PAM sequence: GAG
actttcttatctaaactgta

SEQ ID NO: 31946 - DNA, 20 bp, Artificial Sequence
  Description of Artificial Sequence: Synthetic oligonucleotide
  Target: SCN9A; (-) strand; PAM type: NRG; PAM sequence: TAG
tgactttcttatctaaactg

SEQ ID NO: 31947 - DNA, 20 bp, Artificial Sequence
  Description of Artificial Sequence: Synthetic oligonucleotide
  Target: SCN9A; (-) strand; PAM type: NRG; PAM sequence: CAG
tatttttcccctgtattctc

SEQ ID NO: 31948 - DNA, 20 bp, Artificial Sequence
  Description of Artificial Sequence: Synthetic oligonucleotide
  Target: SCN9A; (-) strand; PAM type: NRG; PAM sequence: AAG
aatggatatagacttggttt

SEQ ID NO: 31949 - DNA, 20 bp, Artificial Sequence
  Description of Artificial Sequence: Synthetic oligonucleotide
  Target: SCN9A; (-) strand; PAM type: NRG; PAM sequence: TGG
cataggaatggatatagact

SEQ ID NO: 31950 - DNA, 20 bp, Artificial Sequence
  Description of Artificial Sequence: Synthetic oligonucleotide
  Target: SCN9A; (-) strand; PAM type: NRG; PAM sequence: TAG
ggagcacataggaatggata

SEQ ID NO: 31951 - DNA, 20 bp, Artificial Sequence
  Description of Artificial Sequence: Synthetic oligonucleotide
  Target: SCN9A; (-) strand; PAM type: NRG; PAM sequence: TGG
attcaaggagcacataggaa

SEQ ID NO: 31952 - DNA, 20 bp, Artificial Sequence
  Description of Artificial Sequence: Synthetic oligonucleotide
  Target: SCN9A; (-) strand; PAM type: NRG; PAM sequence: AGG
ttataattcaaggagcacat

SEQ ID NO: 31953 - DNA, 20 bp, Artificial Sequence
  Description of Artificial Sequence: Synthetic oligonucleotide
  Target: SCN9A; (-) strand; PAM type: NRG; PAM sequence: TAG
cttataattcaaggagcaca

SEQ ID NO: 31954 - DNA, 20 bp, Artificial Sequence
  Description of Artificial Sequence: Synthetic oligonucleotide
  Target: SCN9A; (-) strand; PAM type: NRG; PAM sequence: GAG
agatacccttataattcaag

SEQ ID NO: 31955 - DNA, 20 bp, Artificial Sequence
  Description of Artificial Sequence: Synthetic oligonucleotide
  Target: SCN9A; (-) strand; PAM type: NRG; PAM sequence: AGG
tgagatacccttataattca

SEQ ID NO: 31956 - DNA, 20 bp, Artificial Sequence
  Description of Artificial Sequence: Synthetic oligonucleotide
  Target: SCN9A; (-) strand; PAM type: NRG; PAM sequence: AAG
ctgagatacccttataattc

SEQ ID NO: 31957 - DNA, 20 bp, Artificial Sequence
  Description of Artificial Sequence: Synthetic oligonucleotide
  Target: SCN9A; (-) strand; PAM type: NRG; PAM sequence: GAG
ttagtaaaatgagaaatact

SEQ ID NO: 31958 - DNA, 20 bp, Artificial Sequence
  Description of Artificial Sequence: Synthetic oligonucleotide
  Target: SCN9A; (-) strand; PAM type: NRG; PAM sequence: GAG
ggtatttagattagtaaaat

SEQ ID NO: 31959 - DNA, 20 bp, Artificial Sequence
  Description of Artificial Sequence: Synthetic oligonucleotide
  Target: SCN9A; (-) strand; PAM type: NRG; PAM sequence: TAG
atgttatcaggtatttagat

SEQ ID NO: 31960 - DNA, 20 bp, Artificial Sequence
  Description of Artificial Sequence: Synthetic oligonucleotide
  Target: SCN9A; (-) strand; PAM type: NRG; PAM sequence: TAG
caaagatgttatcaggtatt

SEQ ID NO: 31961 - DNA, 20 bp, Artificial Sequence
  Description of Artificial Sequence: Synthetic oligonucleotide
  Target: SCN9A; (-) strand; PAM type: NRG; PAM sequence: AGG
cttcctccaaagatgttatc

SEQ ID NO: 31962 - DNA, 20 bp, Artificial Sequence
  Description of Artificial Sequence: Synthetic oligonucleotide
  Target: SCN9A; (-) strand; PAM type: NRG; PAM sequence: CAG
ccttcctccaaagatgttat

SEQ ID NO: 31963 - DNA, 20 bp, Artificial Sequence
  Description of Artificial Sequence: Synthetic oligonucleotide
  Target: SCN9A; (-) strand; PAM type: NRG; PAM sequence: AAG
ctgtctatttccttcctcca

SEQ ID NO: 31964 - DNA, 20 bp, Artificial Sequence
  Description of Artificial Sequence: Synthetic oligonucleotide
  Target: SCN9A; (-) strand; PAM type: NRG; PAM sequence: GAG
taaccctgacagctagggta

SEQ ID NO: 31965 - DNA, 20 bp, Artificial Sequence
  Description of Artificial Sequence: Synthetic oligonucleotide
  Target: SCN9A; (-) strand; PAM type: NRG; PAM sequence: TAG
tgtaaccctgacagctaggg

SEQ ID NO: 31966 - DNA, 20 bp, Artificial Sequence
  Description of Artificial Sequence: Synthetic oligonucleotide
  Target: SCN9A; (-) strand; PAM type: NRG; PAM sequence: GGG
aagtgtaaccctgacagcta

SEQ ID NO: 31967 - DNA, 20 bp, Artificial Sequence
  Description of Artificial Sequence: Synthetic oligonucleotide
  Target: SCN9A; (-) strand; PAM type: NRG; PAM sequence: AGG
taagtgtaaccctgacagct

SEQ ID NO: 31968 - DNA, 20 bp, Artificial Sequence
  Description of Artificial Sequence: Synthetic oligonucleotide
  Target: SCN9A; (-) strand; PAM type: NRG; PAM sequence: TAG
ataagtgtaaccctgacagc

SEQ ID NO: 31969 - DNA, 20 bp, Artificial Sequence
  Description of Artificial Sequence: Synthetic oligonucleotide
  Target: SCN9A; (-) strand; PAM type: NRG; PAM sequence: CAG
atttataagtgtaaccctga

SEQ ID NO: 31970 - DNA, 20 bp, Artificial Sequence
  Description of Artificial Sequence: Synthetic oligonucleotide
  Target: SCN9A; (-) strand; PAM type: NRG; PAM sequence: AAG
aaggattgaatcaaatttat

SEQ ID NO: 31971 - DNA, 20 bp, Artificial Sequence
  Description of Artificial Sequence: Synthetic oligonucleotide
  Target: SCN9A; (-) strand; PAM type: NRG; PAM sequence: AGG
atgctgtagacatcctgcca

SEQ ID NO: 31972 - DNA, 20 bp, Artificial Sequence
  Description of Artificial Sequence: Synthetic oligonucleotide
  Target: SCN9A; (-) strand; PAM type: NRG; PAM sequence: AAG
aatgctgtagacatcctgcc

SEQ ID NO: 31973 - DNA, 20 bp, Artificial Sequence
  Description of Artificial Sequence: Synthetic oligonucleotide
  Target: SCN9A; (-) strand; PAM type: NRG; PAM sequence: TAG
ggcttggaacataaatgctg

SEQ ID NO: 31974 - DNA, 20 bp, Artificial Sequence
  Description of Artificial Sequence: Synthetic oligonucleotide
  Target: SCN9A; (-) strand; PAM type: NRG; PAM sequence: TGG
cttgacacaaaatcctggct

SEQ ID NO: 31975 - DNA, 20 bp, Artificial Sequence
  Description of Artificial Sequence: Synthetic oligonucleotide
  Target: SCN9A; (-) strand; PAM type: NRG; PAM sequence: TGG
ttattcttgacacaaaatcc

SEQ ID NO: 31976 - DNA, 20 bp, Artificial Sequence
  Description of Artificial Sequence: Synthetic oligonucleotide
  Target: SCN9A; (-) strand; PAM type: NRG; PAM sequence: TAG
ttggtattttctgtgttgtg

SEQ ID NO: 31977 - DNA, 20 bp, Artificial Sequence
  Description of Artificial Sequence: Synthetic oligonucleotide
  Target: SCN9A; (-) strand; PAM type: NRG; PAM sequence: TGG
caaggtcattcctgctgtct

SEQ ID NO: 31978 - DNA, 20 bp, Artificial Sequence
  Description of Artificial Sequence: Synthetic oligonucleotide
  Target: SCN9A; (-) strand; PAM type: NRG; PAM sequence: AGG
agcttgcctagaacagtcca

SEQ ID NO: 31979 - DNA, 20 bp, Artificial Sequence
  Description of Artificial Sequence: Synthetic oligonucleotide
  Target: SCN9A; (-) strand; PAM type: NRG; PAM sequence: AAG
aagcttgcctagaacagtcc

SEQ ID NO: 31980 - DNA, 20 bp, Artificial Sequence
  Description of Artificial Sequence: Synthetic oligonucleotide
  Target: SCN9A; (-) strand; PAM type: NRG; PAM sequence: CAG
atatctaagcttgcctagaa

SEQ ID NO: 31981 - DNA, 20 bp, Artificial Sequence
  Description of Artificial Sequence: Synthetic oligonucleotide
  Target: SCN9A; (-) strand; PAM type: NRG; PAM sequence: TAG
atcatatatctaagcttgcc

SEQ ID NO: 31982 - DNA, 20 bp, Artificial Sequence
  Description of Artificial Sequence: Synthetic oligonucleotide
  Target: SCN9A; (-) strand; PAM type: NRG; PAM sequence: AAG
ggtaagatcatcatatatct

SEQ ID NO: 31983 - DNA, 20 bp, Artificial Sequence
  Description of Artificial Sequence: Synthetic oligonucleotide
  Target: SCN9A; (-) strand; PAM type: NRG; PAM sequence: AAG
tccaaggatctctcaatggt

SEQ ID NO: 31984 - DNA, 20 bp, Artificial Sequence
  Description of Artificial Sequence: Synthetic oligonucleotide
  Target: SCN9A; (-) strand; PAM type: NRG; PAM sequence: TGG
tttctccaaggatctctcaa

SEQ ID NO: 31985 - DNA, 20 bp, Artificial Sequence
  Description of Artificial Sequence: Synthetic oligonucleotide
  Target: SCN9A; (-) strand; PAM type: NRG; PAM sequence: AGG
cctatttggctatttctcca

SEQ ID NO: 31986 - DNA, 20 bp, Artificial Sequence
  Description of Artificial Sequence: Synthetic oligonucleotide
  Target: SCN9A; (-) strand; PAM type: NRG; PAM sequence: AAG
tcctatttggctatttctcc

SEQ ID NO: 31987 - DNA, 20 bp, Artificial Sequence
  Description of Artificial Sequence: Synthetic oligonucleotide
  Target: SCN9A; (-) strand; PAM type: NRG; PAM sequence: TGG
ccaggaccttgggtcctatt

SEQ ID NO: 31988 - DNA, 20 bp, Artificial Sequence
  Description of Artificial Sequence: Synthetic oligonucleotide
  Target: SCN9A; (-) strand; PAM type: NRG; PAM sequence: GGG
tgaggtggtgccaggacctt

SEQ ID NO: 31989 - DNA, 20 bp, Artificial Sequence
  Description of Artificial Sequence: Synthetic oligonucleotide
  Target: SCN9A; (-) strand; PAM type: NRG; PAM sequence: TGG
atgaggtggtgccaggacct

SEQ ID NO: 31990 - DNA, 20 bp, Artificial Sequence
  Description of Artificial Sequence: Synthetic oligonucleotide
  Target: SCN9A; (-) strand; PAM type: NRG; PAM sequence: AGG
aagtattatgaggtggtgcc

SEQ ID NO: 31991 - DNA, 20 bp, Artificial Sequence
  Description of Artificial Sequence: Synthetic oligonucleotide
  Target: SCN9A; (-) strand; PAM type: NRG; PAM sequence: CAG
aaagtattatgaggtggtgc

SEQ ID NO: 31992 - DNA, 20 bp, Artificial Sequence
  Description of Artificial Sequence: Synthetic oligonucleotide
  Target: SCN9A; (-) strand; PAM type: NRG; PAM sequence: TGG
aaaagaaaagtattatgagg

SEQ ID NO: 31993 - DNA, 20 bp, Artificial Sequence
  Description of Artificial Sequence: Synthetic oligonucleotide
  Target: SCN9A; (-) strand; PAM type: NRG; PAM sequence: AGG
aaaaaaagaaaagtattatg

SEQ ID NO: 31994 - DNA, 20 bp, Artificial Sequence
  Description of Artificial Sequence: Synthetic oligonucleotide
  Target: SCN9A; (-) strand; PAM type: NRG; PAM sequence: GAG
taaaaaaagaaaagtattat

SEQ ID NO: 31995 - DNA, 20 bp, Artificial Sequence
  Description of Artificial Sequence: Synthetic oligonucleotide
  Target: SCN9A; (-) strand; PAM type: NRG; PAM sequence: AAG
atgctctcataaaaaaagaa

SEQ ID NO: 31996 - DNA, 20 bp, Artificial Sequence
  Description of Artificial Sequence: Synthetic oligonucleotide
  Target: SCN9A; (-) strand; PAM type: NRG; PAM sequence: AAG
ctaatatgctctcataaaaa

SEQ ID NO: 31997 - DNA, 20 bp, Artificial Sequence
  Description of Artificial Sequence: Synthetic oligonucleotide
  Target: SCN9A; (-) strand; PAM type: NRG; PAM sequence: TAG
agaatagtcagtaggatggt

SEQ ID NO: 31998 - DNA, 20 bp, Artificial Sequence
  Description of Artificial Sequence: Synthetic oligonucleotide
  Target: SCN9A; (-) strand; PAM type: NRG; PAM sequence: TGG
ataaagaatagtcagtagga

SEQ ID NO: 31999 - DNA, 20 bp, Artificial Sequence
  Description of Artificial Sequence: Synthetic oligonucleotide
  Target: SCN9A; (-) strand; PAM type: NRG; PAM sequence: AGG
tttgataaagaatagtcagt

SEQ ID NO: 32000 - DNA, 20 bp, Artificial Sequence
  Description of Artificial Sequence: Synthetic oligonucleotide
  Target: SCN9A; (-) strand; PAM type: NRG; PAM sequence: TAG
ctttgataaagaatagtcag

SEQ ID NO: 32001 - DNA, 20 bp, Artificial Sequence
  Description of Artificial Sequence: Synthetic oligonucleotide
  Target: SCN9A; (-) strand; PAM type: NRG; PAM sequence: CAG
ttactttgataaagaatagt

SEQ ID NO: 32002 - DNA, 20 bp, Artificial Sequence
  Description of Artificial Sequence: Synthetic oligonucleotide
  Target: SCN9A; (-) strand; PAM type: NRG; PAM sequence: TAG
tggcttactttgataaagaa

SEQ ID NO: 32003 - DNA, 20 bp, Artificial Sequence
  Description of Artificial Sequence: Synthetic oligonucleotide
  Target: SCN9A; (-) strand; PAM type: NRG; PAM sequence: AAG
aactatggcttactttgata

SEQ ID NO: 32004 - DNA, 20 bp, Artificial Sequence
  Description of Artificial Sequence: Synthetic oligonucleotide
  Target: SCN9A; (-) strand; PAM type: NRG; PAM sequence: TGG
agaaaagttcacaataacta

SEQ ID NO: 32005 - DNA, 20 bp, Artificial Sequence
  Description of Artificial Sequence: Synthetic oligonucleotide
  Target: SCN9A; (-) strand; PAM type: NRG; PAM sequence: AAG
agccacaaaatctttcagaa

SEQ ID NO: 32006 - DNA, 20 bp, Artificial Sequence
  Description of Artificial Sequence: Synthetic oligonucleotide
  Target: SCN9A; (-) strand; PAM type: NRG; PAM sequence: CAG
tgtgcagccacaaaatcttt

SEQ ID NO: 32007 - DNA, 20 bp, Artificial Sequence
  Description of Artificial Sequence: Synthetic oligonucleotide
  Target: SCN9A; (-) strand; PAM type: NRG; PAM sequence: CAG
cttactacagcactgttgtg

SEQ ID NO: 32008 - DNA, 20 bp, Artificial Sequence
  Description of Artificial Sequence: Synthetic oligonucleotide
  Target: SCN9A; (-) strand; PAM type: NRG; PAM sequence: CAG
tatatgacatctgcttacta

SEQ ID NO: 32009 - DNA, 20 bp, Artificial Sequence
  Description of Artificial Sequence: Synthetic oligonucleotide
  Target: SCN9A; (-) strand; PAM type: NRG; PAM sequence: TAG
agtgcaggatttccaaacac

SEQ ID NO: 32010 - DNA, 20 bp, Artificial Sequence
  Description of Artificial Sequence: Synthetic oligonucleotide
  Target: SCN9A; (-) strand; PAM type: NRG; PAM sequence: AGG
atgttatttaagcaaagtgc

SEQ ID NO: 32011 - DNA, 20 bp, Artificial Sequence
  Description of Artificial Sequence: Synthetic oligonucleotide
  Target: SCN9A; (-) strand; PAM type: NRG; PAM sequence: CAG
gatgttatttaagcaaagtg

SEQ ID NO: 32012 - DNA, 20 bp, Artificial Sequence
  Description of Artificial Sequence: Synthetic oligonucleotide
  Target: SCN9A; (-) strand; PAM type: NRG; PAM sequence: AAG
cctaggatgttatttaagca

SEQ ID NO: 32013 - DNA, 20 bp, Artificial Sequence
  Description of Artificial Sequence: Synthetic oligonucleotide
  Target: SCN9A; (-) strand; PAM type: NRG; PAM sequence: AAG
gactccctaggatgttattt

SEQ ID NO: 32014 - DNA, 20 bp, Artificial Sequence
  Description of Artificial Sequence: Synthetic oligonucleotide
  Target: SCN9A; (-) strand; PAM type: NRG; PAM sequence: AGG
ctcaagctccaagactccct

SEQ ID NO: 32015 - DNA, 20 bp, Artificial Sequence
  Description of Artificial Sequence: Synthetic oligonucleotide
  Target: SCN9A; (-) strand; PAM type: NRG; PAM sequence: TAG
tctcaagctccaagactccc

SEQ ID NO: 32016 - DNA, 20 bp, Artificial Sequence
  Description of Artificial Sequence: Synthetic oligonucleotide
  Target: SCN9A; (-) strand; PAM type: NRG; PAM sequence: AAG
tctgaatgttctcaagctcc

SEQ ID NO: 32017 - DNA, 20 bp, Artificial Sequence
  Description of Artificial Sequence: Synthetic oligonucleotide
  Target: SCN9A; (-) strand; PAM type: NRG; PAM sequence: AAG
ttagttatctgaatgttctc

SEQ ID NO: 32018 - DNA, 20 bp, Artificial Sequence
  Description of Artificial Sequence: Synthetic oligonucleotide
  Target: SCN9A; (-) strand; PAM type: NRG; PAM sequence: TAG
agcctgaagtcaagaacctt

SEQ ID NO: 32019 - DNA, 20 bp, Artificial Sequence
  Description of Artificial Sequence: Synthetic oligonucleotide
  Target: SCN9A; (-) strand; PAM type: NRG; PAM sequence: AAG
ccagtcttcagcctgaagtc

SEQ ID NO: 32020 - DNA, 20 bp, Artificial Sequence
  Description of Artificial Sequence: Synthetic oligonucleotide
  Target: SCN9A; (-) strand; PAM type: NRG; PAM sequence: AAG
tggtcccagtcttcagcctg

SEQ ID NO: 32021 - DNA, 20 bp, Artificial Sequence
  Description of Artificial Sequence: Synthetic oligonucleotide
  Target: SCN9A; (-) strand; PAM type: NRG; PAM sequence: CAG
cccatagtggtcccagtctt

SEQ ID NO: 32022 - DNA, 20 bp, Artificial Sequence
  Description of Artificial Sequence: Synthetic oligonucleotide
  Target: SCN9A; (-) strand; PAM type: NRG; PAM sequence: CAG
aagataacccatagtggtcc

SEQ ID NO: 32023 - DNA, 20 bp, Artificial Sequence
  Description of Artificial Sequence: Synthetic oligonucleotide
  Target: SCN9A; (-) strand; PAM type: NRG; PAM sequence: TGG
tatttgaagataacccatag

SEQ ID NO: 32024 - DNA, 20 bp, Artificial Sequence
  Description of Artificial Sequence: Synthetic oligonucleotide
  Target: SCN9A; (-) strand; PAM type: NRG; PAM sequence: TAG
caatatttgaagataaccca

SEQ ID NO: 32025 - DNA, 20 bp, Artificial Sequence
  Description of Artificial Sequence: Synthetic oligonucleotide
  Target: SCN9A; (-) strand; PAM type: NRG; PAM sequence: AAG
gcaatgctaaacaatatttg

SEQ ID NO: 32026 - DNA, 20 bp, Artificial Sequence
  Description of Artificial Sequence: Synthetic oligonucleotide
  Target: SCN9A; (-) strand; PAM type: NRG; PAM sequence: CAG
agttttgtcaaggggtttca

SEQ ID NO: 32027 - DNA, 20 bp, Artificial Sequence
  Description of Artificial Sequence: Synthetic oligonucleotide
  Target: SCN9A; (-) strand; PAM type: NRG; PAM sequence: GGG
aaatgaaaagttttgtcaag

SEQ ID NO: 32028 - DNA, 20 bp, Artificial Sequence
  Description of Artificial Sequence: Synthetic oligonucleotide
  Target: SCN9A; (-) strand; PAM type: NRG; PAM sequence: GGG
aaaatgaaaagttttgtcaa

SEQ ID NO: 32029 - DNA, 20 bp, Artificial Sequence
  Description of Artificial Sequence: Synthetic oligonucleotide
  Target: SCN9A; (-) strand; PAM type: NRG; PAM sequence: AGG
gaaaatgaaaagttttgtca

SEQ ID NO: 32030 - DNA, 20 bp, Artificial Sequence
  Description of Artificial Sequence: Synthetic oligonucleotide
  Target: SCN9A; (-) strand; PAM type: NRG; PAM sequence: AAG
agaaaatgaaaagttttgtc

SEQ ID NO: 32031 - DNA, 20 bp, Artificial Sequence
  Description of Artificial Sequence: Synthetic oligonucleotide
  Target: SCN9A; (-) strand; PAM type: NRG; PAM sequence: AAG
ttctcaagacagaaaatgaa

SEQ ID NO: 32032 - DNA, 20 bp, Artificial Sequence
  Description of Artificial Sequence: Synthetic oligonucleotide
  Target: SCN9A; (-) strand; PAM type: NRG; PAM sequence: CAG
taagacagaaattctcaaga

SEQ ID NO: 32033 - DNA, 20 bp, Artificial Sequence
  Description of Artificial Sequence: Synthetic oligonucleotide
  Target: SCN9A; (-) strand; PAM type: NRG; PAM sequence: AAG
aaaataagacagaaattctc

SEQ ID NO: 32034 - DNA, 20 bp, Artificial Sequence
  Description of Artificial Sequence: Synthetic oligonucleotide
  Target: SCN9A; (-) strand; PAM type: NRG; PAM sequence: CAG
ttatttttatcaaaataaga

SEQ ID NO: 32035 - DNA, 20 bp, Artificial Sequence
  Description of Artificial Sequence: Synthetic oligonucleotide
  Target: SCN9A; (-) strand; PAM type: NRG; PAM sequence: AAG
gtgtttatttttatcaaaat

SEQ ID NO: 32036 - DNA, 20 bp, Artificial Sequence
  Description of Artificial Sequence: Synthetic oligonucleotide
  Target: SCN9A; (-) strand; PAM type: NRG; PAM sequence: TGG
attacagctgcctccttctg

SEQ ID NO: 32037 - DNA, 20 bp, Artificial Sequence
  Description of Artificial Sequence: Synthetic oligonucleotide
  Target: SCN9A; (-) strand; PAM type: NRG; PAM sequence: CAG
catactttctgcccatatta

SEQ ID NO: 32038 - DNA, 20 bp, Artificial Sequence
  Description of Artificial Sequence: Synthetic oligonucleotide
  Target: SCN9A; (-) strand; PAM type: NRG; PAM sequence: AAG
gagtgagaccttgtgtttat

SEQ ID NO: 32039 - DNA, 20 bp, Artificial Sequence
  Description of Artificial Sequence: Synthetic oligonucleotide
  Target: SCN9A; (-) strand; PAM type: NRG; PAM sequence: GAG
acctgggcaacagagtgagt

SEQ ID NO: 32040 - DNA, 20 bp, Artificial Sequence
  Description of Artificial Sequence: Synthetic oligonucleotide
  Target: SCN9A; (-) strand; PAM type: NRG; PAM sequence: GAG
tgcaacctgggcaacagagt

SEQ ID NO: 32041 - DNA, 20 bp, Artificial Sequence
  Description of Artificial Sequence: Synthetic oligonucleotide
  Target: SCN9A; (-) strand; PAM type: NRG; PAM sequence: GAG
gcactgcaacctgggcaaca

SEQ ID NO: 32042 - DNA, 20 bp, Artificial Sequence
  Description of Artificial Sequence: Synthetic oligonucleotide
  Target: SCN9A; (-) strand; PAM type: NRG; PAM sequence: CAG
ttgcactgcaacctgggcaa

SEQ ID NO: 32043 - DNA, 20 bp, Artificial Sequence
  Description of Artificial Sequence: Synthetic oligonucleotide
  Target: SCN9A; (-) strand; PAM type: NRG; PAM sequence: GGG
acagtattgcactgcaacct

SEQ ID NO: 32044 - DNA, 20 bp, Artificial Sequence
  Description of Artificial Sequence: Synthetic oligonucleotide
  Target: SCN9A; (-) strand; PAM type: NRG; PAM sequence: TGG
cacagtattgcactgcaacc

SEQ ID NO: 32045 - DNA, 20 bp, Artificial Sequence
  Description of Artificial Sequence: Synthetic oligonucleotide
  Target: SCN9A; (-) strand; PAM type: NRG; PAM sequence: CAG
gctccagtgagccgtgatca

SEQ ID NO: 32046 - DNA, 20 bp, Artificial Sequence
  Description of Artificial Sequence: Synthetic oligonucleotide
  Target: SCN9A; (-) strand; PAM type: NRG; PAM sequence: GAG
cacgaggatgatgctccagt

SEQ ID NO: 32047 - DNA, 20 bp, Artificial Sequence
  Description of Artificial Sequence: Synthetic oligonucleotide
  Target: SCN9A; (-) strand; PAM type: NRG; PAM sequence: CAG
agtgcacgaggatgatgctc

SEQ ID NO: 32048 - DNA, 20 bp, Artificial Sequence
  Description of Artificial Sequence: Synthetic oligonucleotide
  Target: SCN9A; (-) strand; PAM type: NRG; PAM sequence: AGG
ggaggtcgcttgagtgcacg

SEQ ID NO: 32049 - DNA, 20 bp, Artificial Sequence
  Description of Artificial Sequence: Synthetic oligonucleotide
  Target: SCN9A; (-) strand; PAM type: NRG; PAM sequence: GAG
gggaggtcgcttgagtgcac

SEQ ID NO: 32050 - DNA, 20 bp, Artificial Sequence
  Description of Artificial Sequence: Synthetic oligonucleotide
  Target: SCN9A; (-) strand; PAM type: NRG; PAM sequence: GAG
gggaaggtgggaggtcgctt

SEQ ID NO: 32051 - DNA, 20 bp, Artificial Sequence
  Description of Artificial Sequence: Synthetic oligonucleotide
  Target: SCN9A; (-) strand; PAM type: NRG; PAM sequence: AGG
cagctacttgggaaggtggg

SEQ ID NO: 32052 - DNA, 20 bp, Artificial Sequence
  Description of Artificial Sequence: Synthetic oligonucleotide
  Target: SCN9A; (-) strand; PAM type: NRG; PAM sequence: GAG
ccagctacttgggaaggtgg

SEQ ID NO: 32053 - DNA, 20 bp, Artificial Sequence
  Description of Artificial Sequence: Synthetic oligonucleotide
  Target: SCN9A; (-) strand; PAM type: NRG; PAM sequence: GGG
tcccagctacttgggaaggt

SEQ ID NO: 32054 - DNA, 20 bp, Artificial Sequence
  Description of Artificial Sequence: Synthetic oligonucleotide
  Target: SCN9A; (-) strand; PAM type: NRG; PAM sequence: TGG
gtcccagctacttgggaagg

SEQ ID NO: 32055 - DNA, 20 bp, Artificial Sequence
  Description of Artificial Sequence: Synthetic oligonucleotide
  Target: SCN9A; (-) strand; PAM type: NRG; PAM sequence: AGG
gtggtcccagctacttggga

SEQ ID NO: 32056 - DNA, 20 bp, Artificial Sequence
  Description of Artificial Sequence: Synthetic oligonucleotide
  Target: SCN9A; (-) strand; PAM type: NRG; PAM sequence: AAG
tgtggtcccagctacttggg

SEQ ID NO: 32057 - DNA, 20 bp, Artificial Sequence
  Description of Artificial Sequence: Synthetic oligonucleotide
  Target: SCN9A; (-) strand; PAM type: NRG; PAM sequence: GGG
acctgtggtcccagctactt

SEQ ID NO: 32058 - DNA, 20 bp, Artificial Sequence
  Description of Artificial Sequence: Synthetic oligonucleotide
  Target: SCN9A; (-) strand; PAM type: NRG; PAM sequence: TGG
cacctgtggtcccagctact

SEQ ID NO: 32059 - DNA, 20 bp, Artificial Sequence
  Description of Artificial Sequence: Synthetic oligonucleotide
  Target: SCN9A; (-) strand; PAM type: NRG; PAM sequence: CAG
gtggcacgcacctgtggtcc

SEQ ID NO: 32060 - DNA, 20 bp, Artificial Sequence
  Description of Artificial Sequence: Synthetic oligonucleotide
  Target: SCN9A; (-) strand; PAM type: NRG; PAM sequence: TGG
agcatggtggcacgcacctg

SEQ ID NO: 32061 - DNA, 20 bp, Artificial Sequence
  Description of Artificial Sequence: Synthetic oligonucleotide
  Target: SCN9A; (-) strand; PAM type: NRG; PAM sequence: TGG
aaaaaattagcccagcatgg

SEQ ID NO: 32062 - DNA, 20 bp, Artificial Sequence
  Description of Artificial Sequence: Synthetic oligonucleotide
  Target: SCN9A; (-) strand; PAM type: NRG; PAM sequence: TGG
tttaaaaaattagcccagca

SEQ ID NO: 32063 - DNA, 20 bp, Artificial Sequence
  Description of Artificial Sequence: Synthetic oligonucleotide
  Target: SCN9A; (-) strand; PAM type: NRG; PAM sequence: CAG
aatgctttaaaaaattagcc

SEQ ID NO: 32064 - DNA, 20 bp, Artificial Sequence
  Description of Artificial Sequence: Synthetic oligonucleotide
  Target: SCN9A; (-) strand; PAM type: NRG; PAM sequence: TAG
caaaaaatgctttaaaaaat

SEQ ID NO: 32065 - DNA, 20 bp, Artificial Sequence
  Description of Artificial Sequence: Synthetic oligonucleotide
  Target: SCN9A; (-) strand; PAM type: NRG; PAM sequence: GAG
acgagcctgggcaacatggt

SEQ ID NO: 32066 - DNA, 20 bp, Artificial Sequence
  Description of Artificial Sequence: Synthetic oligonucleotide
  Target: SCN9A; (-) strand; PAM type: NRG; PAM sequence: TGG
caagacgagcctgggcaaca

SEQ ID NO: 32067 - DNA, 20 bp, Artificial Sequence
  Description of Artificial Sequence: Synthetic oligonucleotide
  Target: SCN9A; (-) strand; PAM type: NRG; PAM sequence: GGG
caggagttcaagacgagcct

SEQ ID NO: 32068 - DNA, 20 bp, Artificial Sequence
  Description of Artificial Sequence: Synthetic oligonucleotide
  Target: SCN9A; (-) strand; PAM type: NRG; PAM sequence: TGG
ccaggagttcaagacgagcc

SEQ ID NO: 32069 - DNA, 20 bp, Artificial Sequence
  Description of Artificial Sequence: Synthetic oligonucleotide
  Target: SCN9A; (-) strand; PAM type: NRG; PAM sequence: GAG
tgagcccaggagttcaagac

SEQ ID NO: 32070 - DNA, 20 bp, Artificial Sequence
  Description of Artificial Sequence: Synthetic oligonucleotide
  Target: SCN9A; (-) strand; PAM type: NRG; PAM sequence: AAG
tcacttgagcccaggagttc

SEQ ID NO: 32071 - DNA, 20 bp, Artificial Sequence
  Description of Artificial Sequence: Synthetic oligonucleotide
  Target: SCN9A; (-) strand; PAM type: NRG; PAM sequence: GAG
ggcagatcacttgagcccag

SEQ ID NO: 32072 - DNA, 20 bp, Artificial Sequence
  Description of Artificial Sequence: Synthetic oligonucleotide
  Target: SCN9A; (-) strand; PAM type: NRG; PAM sequence: AGG
agggcagatcacttgagccc

SEQ ID NO: 32073 - DNA, 20 bp, Artificial Sequence
  Description of Artificial Sequence: Synthetic oligonucleotide
  Target: SCN9A; (-) strand; PAM type: NRG; PAM sequence: CAG
gagggcagatcacttgagcc

SEQ ID NO: 32074 - DNA, 20 bp, Artificial Sequence
  Description of Artificial Sequence: Synthetic oligonucleotide
  Target: SCN9A; (-) strand; PAM type: NRG; PAM sequence: GAG
ccaaggagggcagatcactt

SEQ ID NO: 32075 - DNA, 20 bp, Artificial Sequence
  Description of Artificial Sequence: Synthetic oligonucleotide
  Target: SCN9A; (-) strand; PAM type: NRG; PAM sequence: CAG
ctttgggaggccaaggaggg

SEQ ID NO: 32076 - DNA, 20 bp, Artificial Sequence
  Description of Artificial Sequence: Synthetic oligonucleotide
  Target: SCN9A; (-) strand; PAM type: NRG; PAM sequence: GGG
gcactttgggaggccaagga

SEQ ID NO: 32077 - DNA, 20 bp, Artificial Sequence
  Description of Artificial Sequence: Synthetic oligonucleotide
  Target: SCN9A; (-) strand; PAM type: NRG; PAM sequence: AGG
agcactttgggaggccaagg

SEQ ID NO: 32078 - DNA, 20 bp, Artificial Sequence
  Description of Artificial Sequence: Synthetic oligonucleotide
  Target: SCN9A; (-) strand; PAM type: NRG; PAM sequence: GAG
cagcactttgggaggccaag

SEQ ID NO: 32079 - DNA, 20 bp, Artificial Sequence
  Description of Artificial Sequence: Synthetic oligonucleotide
  Target: SCN9A; (-) strand; PAM type: NRG; PAM sequence: AGG
cccagcactttgggaggcca

SEQ ID NO: 32080 - DNA, 20 bp, Artificial Sequence
  Description of Artificial Sequence: Synthetic oligonucleotide
  Target: SCN9A; (-) strand; PAM type: NRG; PAM sequence: AAG
ccccagcactttgggaggcc

SEQ ID NO: 32081 - DNA, 20 bp, Artificial Sequence
  Description of Artificial Sequence: Synthetic oligonucleotide
  Target: SCN9A; (-) strand; PAM type: NRG; PAM sequence: AGG
tgtaaccccagcactttggg

SEQ ID NO: 32082 - DNA, 20 bp, Artificial Sequence
  Description of Artificial Sequence: Synthetic oligonucleotide
  Target: SCN9A; (-) strand; PAM type: NRG; PAM sequence: GAG
ctgtaaccccagcactttgg

SEQ ID NO: 32083 - DNA, 20 bp, Artificial Sequence
  Description of Artificial Sequence: Synthetic oligonucleotide
  Target: SCN9A; (-) strand; PAM type: NRG; PAM sequence: GGG
gcctgtaaccccagcacttt

SEQ ID NO: 32084 - DNA, 20 bp, Artificial Sequence
  Description of Artificial Sequence: Synthetic oligonucleotide
  Target: SCN9A; (-) strand; PAM type: NRG; PAM sequence: TGG
tgcctgtaaccccagcactt

SEQ ID NO: 32085 - DNA, 20 bp, Artificial Sequence
  Description of Artificial Sequence: Synthetic oligonucleotide
  Target: SCN9A; (-) strand; PAM type: NRG; PAM sequence: CAG
gtggttgatgcctgtaaccc

SEQ ID NO: 32086 - DNA, 20 bp, Artificial Sequence
  Description of Artificial Sequence: Synthetic oligonucleotide
  Target: SCN9A; (-) strand; PAM type: NRG; PAM sequence: TGG
aaaaattgtgccaggctcag

SEQ ID NO: 32087 - DNA, 20 bp, Artificial Sequence
  Description of Artificial Sequence: Synthetic oligonucleotide
  Target: SCN9A; (-) strand; PAM type: NRG; PAM sequence: CAG
ttaaaaaattgtgccaggct

SEQ ID NO: 32088 - DNA, 20 bp, Artificial Sequence
  Description of Artificial Sequence: Synthetic oligonucleotide
  Target: SCN9A; (-) strand; PAM type: NRG; PAM sequence: AGG
gcaatttaaaaaattgtgcc

SEQ ID NO: 32089 - DNA, 20 bp, Artificial Sequence
  Description of Artificial Sequence: Synthetic oligonucleotide
  Target: SCN9A; (-) strand; PAM type: NRG; PAM sequence: CAG
ggcaatttaaaaaattgtgc

SEQ ID NO: 32090 - DNA, 20 bp, Artificial Sequence
  Description of Artificial Sequence: Synthetic oligonucleotide
  Target: SCN9A; (-) strand; PAM type: NRG; PAM sequence: TGG
aaacaagataagtagaatgt

SEQ ID NO: 32091 - DNA, 20 bp, Artificial Sequence
  Description of Artificial Sequence: Synthetic oligonucleotide
  Target: SCN9A; (-) strand; PAM type: NRG; PAM sequence: TAG
gtaagataaaacaagataag

SEQ ID NO: 32092 - DNA, 20 bp, Artificial Sequence
  Description of Artificial Sequence: Synthetic oligonucleotide
  Target: SCN9A; (-) strand; PAM type: NRG; PAM sequence: AAG
agagtaagataaaacaagat

SEQ ID NO: 32093 - DNA, 20 bp, Artificial Sequence
  Description of Artificial Sequence: Synthetic oligonucleotide
  Target: SCN9A; (-) strand; PAM type: NRG; PAM sequence: AAG
ggggaagagtaagataaaac

SEQ ID NO: 32094 - DNA, 20 bp, Artificial Sequence
  Description of Artificial Sequence: Synthetic oligonucleotide
  Target: SCN9A; (-) strand; PAM type: NRG; PAM sequence: AAG
atctagactaggggaagagt

SEQ ID NO: 32095 - DNA, 20 bp, Artificial Sequence
  Description of Artificial Sequence: Synthetic oligonucleotide
  Target: SCN9A; (-) strand; PAM type: NRG; PAM sequence: GAG
ctgaatctagactaggggaa

SEQ ID NO: 32096 - DNA, 20 bp, Artificial Sequence
  Description of Artificial Sequence: Synthetic oligonucleotide
  Target: SCN9A; (-) strand; PAM type: NRG; PAM sequence: AAG
tactgaatctagactagggg

SEQ ID NO: 32097 - DNA, 20 bp, Artificial Sequence
  Description of Artificial Sequence: Synthetic oligonucleotide
  Target: SCN9A; (-) strand; PAM type: NRG; PAM sequence: GGG
ttttactgaatctagactag

SEQ ID NO: 32098 - DNA, 20 bp, Artificial Sequence
  Description of Artificial Sequence: Synthetic oligonucleotide
  Target: SCN9A; (-) strand; PAM type: NRG; PAM sequence: GGG
tttttactgaatctagacta

SEQ ID NO: 32099 - DNA, 20 bp, Artificial Sequence
  Description of Artificial Sequence: Synthetic oligonucleotide
  Target: SCN9A; (-) strand; PAM type: NRG; PAM sequence: AGG
gtttttactgaatctagact

SEQ ID NO: 32100 - DNA, 20 bp, Artificial Sequence
  Description of Artificial Sequence: Synthetic oligonucleotide
  Target: SCN9A; (-) strand; PAM type: NRG; PAM sequence: TAG
tgtttttactgaatctagac

SEQ ID NO: 32101 - DNA, 20 bp, Artificial Sequence
  Description of Artificial Sequence: Synthetic oligonucleotide
  Target: SCN9A; (-) strand; PAM type: NRG; PAM sequence: TAG
accattgtttttactgaatc

SEQ ID NO: 32102 - DNA, 20 bp, Artificial Sequence
  Description of Artificial Sequence: Synthetic oligonucleotide
  Target: SCN9A; (-) strand; PAM type: NRG; PAM sequence: TGG
atttcaggtaacaaataata

SEQ ID NO: 32103 - DNA, 20 bp, Artificial Sequence
  Description of Artificial Sequence: Synthetic oligonucleotide
  Target: SCN9A; (-) strand; PAM type: NRG; PAM sequence: AGG
tggttaatttttaaaatttc

SEQ ID NO: 32104 - DNA, 20 bp, Artificial Sequence
  Description of Artificial Sequence: Synthetic oligonucleotide
  Target: SCN9A; (-) strand; PAM type: NRG; PAM sequence: CAG
ttggttaatttttaaaattt

SEQ ID NO: 32105 - DNA, 20 bp, Artificial Sequence
  Description of Artificial Sequence: Synthetic oligonucleotide
  Target: SCN9A; (-) strand; PAM type: NRG; PAM sequence: TGG
tctacttaagtgtatagatt

SEQ ID NO: 32106 - DNA, 20 bp, Artificial Sequence
  Description of Artificial Sequence: Synthetic oligonucleotide
  Target: SCN9A; (-) strand; PAM type: NRG; PAM sequence: TAG
ttttactctacttaagtgta

SEQ ID NO: 32107 - DNA, 20 bp, Artificial Sequence
  Description of Artificial Sequence: Synthetic oligonucleotide
  Target: SCN9A; (-) strand; PAM type: NRG; PAM sequence: AAG
ccagtgtttttactctactt

SEQ ID NO: 32108 - DNA, 20 bp, Artificial Sequence
  Description of Artificial Sequence: Synthetic oligonucleotide
  Target: SCN9A; (-) strand; PAM type: NRG; PAM sequence: CAG
cataatggctggctcaattc

SEQ ID NO: 32109 - DNA, 20 bp, Artificial Sequence
  Description of Artificial Sequence: Synthetic oligonucleotide
  Target: SCN9A; (-) strand; PAM type: NRG; PAM sequence: TGG
ttgtatagattcataatggc

SEQ ID NO: 32110 - DNA, 20 bp, Artificial Sequence
  Description of Artificial Sequence: Synthetic oligonucleotide
  Target: SCN9A; (-) strand; PAM type: NRG; PAM sequence: TGG
aggattgtatagattcataa

SEQ ID NO: 32111 - DNA, 20 bp, Artificial Sequence
  Description of Artificial Sequence: Synthetic oligonucleotide
  Target: SCN9A; (-) strand; PAM type: NRG; PAM sequence: TAG
agtgaggaaagaggattgta

SEQ ID NO: 32112 - DNA, 20 bp, Artificial Sequence
  Description of Artificial Sequence: Synthetic oligonucleotide
  Target: SCN9A; (-) strand; PAM type: NRG; PAM sequence: AGG
aggtgttgtagtgaggaaag

SEQ ID NO: 32113 - DNA, 20 bp, Artificial Sequence
  Description of Artificial Sequence: Synthetic oligonucleotide
  Target: SCN9A; (-) strand; PAM type: NRG; PAM sequence: GAG
gaggtgttgtagtgaggaaa

SEQ ID NO: 32114 - DNA, 20 bp, Artificial Sequence
  Description of Artificial Sequence: Synthetic oligonucleotide
  Target: SCN9A; (-) strand; PAM type: NRG; PAM sequence: AAG
ttgaggtgttgtagtgagga

SEQ ID NO: 32115 - DNA, 20 bp, Artificial Sequence
  Description of Artificial Sequence: Synthetic oligonucleotide
  Target: SCN9A; (-) strand; PAM type: NRG; PAM sequence: AGG
caaattgaggtgttgtagtg

SEQ ID NO: 32116 - DNA, 20 bp, Artificial Sequence
  Description of Artificial Sequence: Synthetic oligonucleotide
  Target: SCN9A; (-) strand; PAM type: NRG; PAM sequence: GAG
gcaaattgaggtgttgtagt

SEQ ID NO: 32117 - DNA, 20 bp, Artificial Sequence
  Description of Artificial Sequence: Synthetic oligonucleotide
  Target: SCN9A; (-) strand; PAM type: NRG; PAM sequence: TAG
aaaagcaaattgaggtgttg

SEQ ID NO: 32118 - DNA, 20 bp, Artificial Sequence
  Description of Artificial Sequence: Synthetic oligonucleotide
  Target: SCN9A; (-) strand; PAM type: NRG; PAM sequence: AGG
ataaagttaaaagcaaattg

SEQ ID NO: 32119 - DNA, 20 bp, Artificial Sequence
  Description of Artificial Sequence: Synthetic oligonucleotide
  Target: SCN9A; (-) strand; PAM type: NRG; PAM sequence: GAG
tataaagttaaaagcaaatt

SEQ ID NO: 32120 - DNA, 20 bp, Artificial Sequence
  Description of Artificial Sequence: Synthetic oligonucleotide
  Target: SCN9A; (-) strand; PAM type: NRG; PAM sequence: AAG
taaaaagattataaagttaa

SEQ ID NO: 32121 - DNA, 20 bp, Artificial Sequence
  Description of Artificial Sequence: Synthetic oligonucleotide
  Target: SCN9A; (-) strand; PAM type: NRG; PAM sequence: AAG
aagattataaaaagattata

SEQ ID NO: 32122 - DNA, 20 bp, Artificial Sequence
  Description of Artificial Sequence: Synthetic oligonucleotide
  Target: SCN9A; (-) strand; PAM type: NRG; PAM sequence: AAG
atttctaataagattataaa

SEQ ID NO: 32123 - DNA, 20 bp, Artificial Sequence
  Description of Artificial Sequence: Synthetic oligonucleotide
  Target: SCN9A; (-) strand; PAM type: NRG; PAM sequence: AAG
tttgactgtttatttctaat

SEQ ID NO: 32124 - DNA, 20 bp, Artificial Sequence
  Description of Artificial Sequence: Synthetic oligonucleotide
  Target: SCN9A; (-) strand; PAM type: NRG; PAM sequence: AAG
aagatgggcagtcaattgat

SEQ ID NO: 32125 - DNA, 20 bp, Artificial Sequence
  Description of Artificial Sequence: Synthetic oligonucleotide
  Target: SCN9A; (-) strand; PAM type: NRG; PAM sequence: CAG
aaattcatagtgaagatggg

SEQ ID NO: 32126 - DNA, 20 bp, Artificial Sequence
  Description of Artificial Sequence: Synthetic oligonucleotide
  Target: SCN9A; (-) strand; PAM type: NRG; PAM sequence: GGG
gacaaattcatagtgaagat

SEQ ID NO: 32127 - DNA, 20 bp, Artificial Sequence
  Description of Artificial Sequence: Synthetic oligonucleotide
  Target: SCN9A; (-) strand; PAM type: NRG; PAM sequence: TGG
ggacaaattcatagtgaaga

SEQ ID NO: 32128 - DNA, 20 bp, Artificial Sequence
  Description of Artificial Sequence: Synthetic oligonucleotide
  Target: SCN9A; (-) strand; PAM type: NRG; PAM sequence: AAG
gcctggacaaattcatagtg

SEQ ID NO: 32129 - DNA, 20 bp, Artificial Sequence
  Description of Artificial Sequence: Synthetic oligonucleotide
  Target: SCN9A; (-) strand; PAM type: NRG; PAM sequence: TAG
aaatggcctggacaaattca

SEQ ID NO: 32130 - DNA, 20 bp, Artificial Sequence
  Description of Artificial Sequence: Synthetic oligonucleotide
  Target: SCN9A; (-) strand; PAM type: NRG; PAM sequence: TGG
agtcttttagtgaaatggcc

SEQ ID NO: 32131 - DNA, 20 bp, Artificial Sequence
  Description of Artificial Sequence: Synthetic oligonucleotide
  Target: SCN9A; (-) strand; PAM type: NRG; PAM sequence: TGG
atgctagtcttttagtgaaa

SEQ ID NO: 32132 - DNA, 20 bp, Artificial Sequence
  Description of Artificial Sequence: Synthetic oligonucleotide
  Target: SCN9A; (-) strand; PAM type: NRG; PAM sequence: TAG
cctggctcatgctagtcttt

SEQ ID NO: 32133 - DNA, 20 bp, Artificial Sequence
  Description of Artificial Sequence: Synthetic oligonucleotide
  Target: SCN9A; (-) strand; PAM type: NRG; PAM sequence: TAG
agagttatcctggctcatgc

SEQ ID NO: 32134 - DNA, 20 bp, Artificial Sequence
  Description of Artificial Sequence: Synthetic oligonucleotide
  Target: SCN9A; (-) strand; PAM type: NRG; PAM sequence: TGG
aggtctggggagagttatcc

SEQ ID NO: 32135 - DNA, 20 bp, Artificial Sequence
  Description of Artificial Sequence: Synthetic oligonucleotide
  Target: SCN9A; (-) strand; PAM type: NRG; PAM sequence: GAG
cagggctagaggtctgggga

SEQ ID NO: 32136 - DNA, 20 bp, Artificial Sequence
  Description of Artificial Sequence: Synthetic oligonucleotide
  Target: SCN9A; (-) strand; PAM type: NRG; PAM sequence: GAG
atcagggctagaggtctggg

SEQ ID NO: 32137 - DNA, 20 bp, Artificial Sequence
  Description of Artificial Sequence: Synthetic oligonucleotide
  Target: SCN9A; (-) strand; PAM type: NRG; PAM sequence: GGG
ttatcagggctagaggtctg

SEQ ID NO: 32138 - DNA, 20 bp, Artificial Sequence
  Description of Artificial Sequence: Synthetic oligonucleotide
  Target: SCN9A; (-) strand; PAM type: NRG; PAM sequence: GGG
gttatcagggctagaggtct

SEQ ID NO: 32139 - DNA, 20 bp, Artificial Sequence
  Description of Artificial Sequence: Synthetic oligonucleotide
  Target: SCN9A; (-) strand; PAM type: NRG; PAM sequence: TGG
agttatcagggctagaggtc

SEQ ID NO: 32140 - DNA, 20 bp, Artificial Sequence
  Description of Artificial Sequence: Synthetic oligonucleotide
  Target: SCN9A; (-) strand; PAM type: NRG; PAM sequence: AGG
ctaagagttatcagggctag

SEQ ID NO: 32141 - DNA, 20 bp, Artificial Sequence
  Description of Artificial Sequence: Synthetic oligonucleotide
  Target: SCN9A; (-) strand; PAM type: NRG; PAM sequence: GAG
tctaagagttatcagggcta

SEQ ID NO: 32142 - DNA, 20 bp, Artificial Sequence
  Description of Artificial Sequence: Synthetic oligonucleotide
  Target: SCN9A; (-) strand; PAM type: NRG; PAM sequence: TAG
catctaagagttatcagggc

SEQ ID NO: 32143 - DNA, 20 bp, Artificial Sequence
  Description of Artificial Sequence: Synthetic oligonucleotide
  Target: SCN9A; (-) strand; PAM type: NRG; PAM sequence: GGG
aggacatctaagagttatca

SEQ ID NO: 32144 - DNA, 20 bp, Artificial Sequence
  Description of Artificial Sequence: Synthetic oligonucleotide
  Target: SCN9A; (-) strand; PAM type: NRG; PAM sequence: AGG
aaggacatctaagagttatc

SEQ ID NO: 32145 - DNA, 20 bp, Artificial Sequence
  Description of Artificial Sequence: Synthetic oligonucleotide
  Target: SCN9A; (-) strand; PAM type: NRG; PAM sequence: CAG
gaaggacatctaagagttat

SEQ ID NO: 32146 - DNA, 20 bp, Artificial Sequence
  Description of Artificial Sequence: Synthetic oligonucleotide
  Target: SCN9A; (-) strand; PAM type: NRG; PAM sequence: GAG
gagatgtgaaggacatctaa

SEQ ID NO: 32147 - DNA, 20 bp, Artificial Sequence
  Description of Artificial Sequence: Synthetic oligonucleotide
  Target: SCN9A; (-) strand; PAM type: NRG; PAM sequence: AAG
atgagatgtgaaggacatct

SEQ ID NO: 32148 - DNA, 20 bp, Artificial Sequence
  Description of Artificial Sequence: Synthetic oligonucleotide
  Target: SCN9A; (-) strand; PAM type: NRG; PAM sequence: AGG
ttagtatcaatgagatgtga

SEQ ID NO: 32149 - DNA, 20 bp, Artificial Sequence
  Description of Artificial Sequence: Synthetic oligonucleotide
  Target: SCN9A; (-) strand; PAM type: NRG; PAM sequence: AAG
cttagtatcaatgagatgtg

SEQ ID NO: 32150 - DNA, 20 bp, Artificial Sequence
  Description of Artificial Sequence: Synthetic oligonucleotide
  Target: SCN9A; (-) strand; PAM type: NRG; PAM sequence: GAG
gaaagctccttagtatcaat

SEQ ID NO: 32151 - DNA, 20 bp, Artificial Sequence
  Description of Artificial Sequence: Synthetic oligonucleotide
  Target: SCN9A; (-) strand; PAM type: NRG; PAM sequence: TAG
ccttgttagagaaagctcct

SEQ ID NO: 32152 - DNA, 20 bp, Artificial Sequence
  Description of Artificial Sequence: Synthetic oligonucleotide
  Target: SCN9A; (-) strand; PAM type: NRG; PAM sequence: AAG
acctagcaccttgttagaga

SEQ ID NO: 32153 - DNA, 20 bp, Artificial Sequence
  Description of Artificial Sequence: Synthetic oligonucleotide
  Target: SCN9A; (-) strand; PAM type: NRG; PAM sequence: GAG
gtgtacctagcaccttgtta

SEQ ID NO: 32154 - DNA, 20 bp, Artificial Sequence
  Description of Artificial Sequence: Synthetic oligonucleotide
  Target: SCN9A; (-) strand; PAM type: NRG; PAM sequence: TAG
gagtgtacctagcaccttgt

SEQ ID NO: 32155 - DNA, 20 bp, Artificial Sequence
  Description of Artificial Sequence: Synthetic oligonucleotide
  Target: SCN9A; (-) strand; PAM type: NRG; PAM sequence: TAG
gtgacacagatgagtgtacc

SEQ ID NO: 32156 - DNA, 20 bp, Artificial Sequence
  Description of Artificial Sequence: Synthetic oligonucleotide
  Target: SCN9A; (-) strand; PAM type: NRG; PAM sequence: GAG
agttaaattgtgacacagat

SEQ ID NO: 32157 - DNA, 20 bp, Artificial Sequence
  Description of Artificial Sequence: Synthetic oligonucleotide
  Target: SCN9A; (-) strand; PAM type: NRG; PAM sequence: CAG
acaatagttaaattgtgaca

SEQ ID NO: 32158 - DNA, 20 bp, Artificial Sequence
  Description of Artificial Sequence: Synthetic oligonucleotide
  Target: SCN9A; (-) strand; PAM type: NRG; PAM sequence: TAG
agctgtgtattcatggacaa

SEQ ID NO: 32159 - DNA, 20 bp, Artificial Sequence
  Description of Artificial Sequence: Synthetic oligonucleotide
  Target: SCN9A; (-) strand; PAM type: NRG; PAM sequence: TGG
taaatgaagctgtgtattca

SEQ ID NO: 32160 - DNA, 20 bp, Artificial Sequence
  Description of Artificial Sequence: Synthetic oligonucleotide
  Target: SCN9A; (-) strand; PAM type: NRG; PAM sequence: AAG
ttctactaattagttaaatg

SEQ ID NO: 32161 - DNA, 20 bp, Artificial Sequence
  Description of Artificial Sequence: Synthetic oligonucleotide
  Target: SCN9A; (-) strand; PAM type: NRG; PAM sequence: TAG
gtacataaaattctactaat

SEQ ID NO: 32162 - DNA, 20 bp, Artificial Sequence
  Description of Artificial Sequence: Synthetic oligonucleotide
  Target: SCN9A; (-) strand; PAM type: NRG; PAM sequence: AGG
tcatactcttaaaagttccc

SEQ ID NO: 32163 - DNA, 20 bp, Artificial Sequence
  Description of Artificial Sequence: Synthetic oligonucleotide
  Target: SCN9A; (-) strand; PAM type: NRG; PAM sequence: CAG
ttcatactcttaaaagttcc

SEQ ID NO: 32164 - DNA, 20 bp, Artificial Sequence
  Description of Artificial Sequence: Synthetic oligonucleotide
  Target: SCN9A; (-) strand; PAM type: NRG; PAM sequence: AAG
gtaggatttcatactcttaa

SEQ ID NO: 32165 - DNA, 20 bp, Artificial Sequence
  Description of Artificial Sequence: Synthetic oligonucleotide
  Target: SCN9A; (-) strand; PAM type: NRG; PAM sequence: AGG
gctaaagatacactgcttgt

SEQ ID NO: 32166 - DNA, 20 bp, Artificial Sequence
  Description of Artificial Sequence: Synthetic oligonucleotide
  Target: SCN9A; (-) strand; PAM type: NRG; PAM sequence: TAG
ggctaaagatacactgcttg

SEQ ID NO: 32167 - DNA, 20 bp, Artificial Sequence
  Description of Artificial Sequence: Synthetic oligonucleotide
  Target: SCN9A; (-) strand; PAM type: NRG; PAM sequence: AAG
ccaagcaatgttacaggcta

SEQ ID NO: 32168 - DNA, 20 bp, Artificial Sequence
  Description of Artificial Sequence: Synthetic oligonucleotide
  Target: SCN9A; (-) strand; PAM type: NRG; PAM sequence: AGG
tttgttccaagcaatgttac

SEQ ID NO: 32169 - DNA, 20 bp, Artificial Sequence
  Description of Artificial Sequence: Synthetic oligonucleotide
  Target: SCN9A; (-) strand; PAM type: NRG; PAM sequence: CAG
ctttgttccaagcaatgtta

SEQ ID NO: 32170 - DNA, 20 bp, Artificial Sequence
  Description of Artificial Sequence: Synthetic oligonucleotide
  Target: SCN9A; (-) strand; PAM type: NRG; PAM sequence: AAG
tgacaggtctgctttgttcc

SEQ ID NO: 32171 - DNA, 20 bp, Artificial Sequence
  Description of Artificial Sequence: Synthetic oligonucleotide
  Target: SCN9A; (-) strand; PAM type: NRG; PAM sequence: AGG
aggctacaaaaccaaatgac

SEQ ID NO: 32172 - DNA, 20 bp, Artificial Sequence
  Description of Artificial Sequence: Synthetic oligonucleotide
  Target: SCN9A; (-) strand; PAM type: NRG; PAM sequence: CAG
aaggctacaaaaccaaatga

SEQ ID NO: 32173 - DNA, 20 bp, Artificial Sequence
  Description of Artificial Sequence: Synthetic oligonucleotide
  Target: SCN9A; (-) strand; PAM type: NRG; PAM sequence: AGG
cagagtgtcagggactacaa

SEQ ID NO: 32174 - DNA, 20 bp, Artificial Sequence
  Description of Artificial Sequence: Synthetic oligonucleotide
  Target: SCN9A; (-) strand; PAM type: NRG; PAM sequence: AAG
ccagagtgtcagggactaca

SEQ ID NO: 32175 - DNA, 20 bp, Artificial Sequence
  Description of Artificial Sequence: Synthetic oligonucleotide
  Target: SCN9A; (-) strand; PAM type: NRG; PAM sequence: GGG
tctaatgttccagagtgtca

SEQ ID NO: 32176 - DNA, 20 bp, Artificial Sequence
  Description of Artificial Sequence: Synthetic oligonucleotide
  Target: SCN9A; (-) strand; PAM type: NRG; PAM sequence: AGG
ctctaatgttccagagtgtc

SEQ ID NO: 32177 - DNA, 20 bp, Artificial Sequence
  Description of Artificial Sequence: Synthetic oligonucleotide
  Target: SCN9A; (-) strand; PAM type: NRG; PAM sequence: CAG
tctctaatgttccagagtgt

SEQ ID NO: 32178 - DNA, 20 bp, Artificial Sequence
  Description of Artificial Sequence: Synthetic oligonucleotide
  Target: SCN9A; (-) strand; PAM type: NRG; PAM sequence: GAG
tcactctctctaatgttcca

SEQ ID NO: 32179 - DNA, 20 bp, Artificial Sequence
  Description of Artificial Sequence: Synthetic oligonucleotide
  Target: SCN9A; (-) strand; PAM type: NRG; PAM sequence: CAG
tttcactctctctaatgttc

SEQ ID NO: 32180 - DNA, 20 bp, Artificial Sequence
  Description of Artificial Sequence: Synthetic oligonucleotide
  Target: SCN9A; (-) strand; PAM type: NRG; PAM sequence: TAG
aacacagaattccttcactc

SEQ ID NO: 32181 - DNA, 20 bp, Artificial Sequence
  Description of Artificial Sequence: Synthetic oligonucleotide
  Target: SCN9A; (-) strand; PAM type: NRG; PAM sequence: CAG
ccaatactgggatgaaaaca

SEQ ID NO: 32182 - DNA, 20 bp, Artificial Sequence
  Description of Artificial Sequence: Synthetic oligonucleotide
  Target: SCN9A; (-) strand; PAM type: NRG; PAM sequence: GGG
caaaccatgtaaccaatact

SEQ ID NO: 32183 - DNA, 20 bp, Artificial Sequence
  Description of Artificial Sequence: Synthetic oligonucleotide
  Target: SCN9A; (-) strand; PAM type: NRG; PAM sequence: TGG
acaaaccatgtaaccaatac

SEQ ID NO: 32184 - DNA, 20 bp, Artificial Sequence
  Description of Artificial Sequence: Synthetic oligonucleotide
  Target: SCN9A; (-) strand; PAM type: NRG; PAM sequence: TAG
atgcatatatcctaaaaata

SEQ ID NO: 32185 - DNA, 20 bp, Artificial Sequence
  Description of Artificial Sequence: Synthetic oligonucleotide
  Target: SCN9A; (-) strand; PAM type: NRG; PAM sequence: AAG
tactcctgaacttaaaataa

SEQ ID NO: 32186 - DNA, 20 bp, Artificial Sequence
  Description of Artificial Sequence: Synthetic oligonucleotide
  Target: SCN9A; (-) strand; PAM type: NRG; PAM sequence: TGG
gtttacctatgtaacaaacc

SEQ ID NO: 32187 - DNA, 20 bp, Artificial Sequence
  Description of Artificial Sequence: Synthetic oligonucleotide
  Target: SCN9A; (-) strand; PAM type: NRG; PAM sequence: AAG
aaaacaaacccccatgacac

SEQ ID NO: 32188 - DNA, 20 bp, Artificial Sequence
  Description of Artificial Sequence: Synthetic oligonucleotide
  Target: SCN9A; (-) strand; PAM type: NRG; PAM sequence: AAG
taatacctgggtgatgaaat

SEQ ID NO: 32189 - DNA, 20 bp, Artificial Sequence
  Description of Artificial Sequence: Synthetic oligonucleotide
  Target: SCN9A; (-) strand; PAM type: NRG; PAM sequence: GGG
gagtactaggtctaatacct

SEQ ID NO: 32190 - DNA, 20 bp, Artificial Sequence
  Description of Artificial Sequence: Synthetic oligonucleotide
  Target: SCN9A; (-) strand; PAM type: NRG; PAM sequence: TGG
tgagtactaggtctaatacc

SEQ ID NO: 32191 - DNA, 20 bp, Artificial Sequence
  Description of Artificial Sequence: Synthetic oligonucleotide
  Target: SCN9A; (-) strand; PAM type: NRG; PAM sequence: AGG
aaaaataaccaatgagtact

SEQ ID NO: 32192 - DNA, 20 bp, Artificial Sequence
  Description of Artificial Sequence: Synthetic oligonucleotide
  Target: SCN9A; (-) strand; PAM type: NRG; PAM sequence: TAG
gaaaaataaccaatgagtac

SEQ ID NO: 32193 - DNA, 20 bp, Artificial Sequence
  Description of Artificial Sequence: Synthetic oligonucleotide
  Target: SCN9A; (-) strand; PAM type: NRG; PAM sequence: GAG
gatcaggaaaaataaccaat

SEQ ID NO: 32194 - DNA, 20 bp, Artificial Sequence
  Description of Artificial Sequence: Synthetic oligonucleotide
  Target: SCN9A; (-) strand; PAM type: NRG; PAM sequence: AGG
gtgggaggaggcagaagatc

SEQ ID NO: 32195 - DNA, 20 bp, Artificial Sequence
  Description of Artificial Sequence: Synthetic oligonucleotide
  Target: SCN9A; (-) strand; PAM type: NRG; PAM sequence: CAG
ggtgggaggaggcagaagat

SEQ ID NO: 32196 - DNA, 20 bp, Artificial Sequence
  Description of Artificial Sequence: Synthetic oligonucleotide
  Target: SCN9A; (-) strand; PAM type: NRG; PAM sequence: AAG
tagagggtgggaggaggcag

SEQ ID NO: 32197 - DNA, 20 bp, Artificial Sequence
  Description of Artificial Sequence: Synthetic oligonucleotide
  Target: SCN9A; (-) strand; PAM type: NRG; PAM sequence: CAG
cagtagagggtgggaggagg

SEQ ID NO: 32198 - DNA, 20 bp, Artificial Sequence
  Description of Artificial Sequence: Synthetic oligonucleotide
  Target: SCN9A; (-) strand; PAM type: NRG; PAM sequence: AGG
atacagtagagggtgggagg

SEQ ID NO: 32199 - DNA, 20 bp, Artificial Sequence
  Description of Artificial Sequence: Synthetic oligonucleotide
  Target: SCN9A; (-) strand; PAM type: NRG; PAM sequence: GAG
aatacagtagagggtgggag

SEQ ID NO: 32200 - DNA, 20 bp, Artificial Sequence
  Description of Artificial Sequence: Synthetic oligonucleotide
  Target: SCN9A; (-) strand; PAM type: NRG; PAM sequence: AGG
caaatacagtagagggtggg

SEQ ID NO: 32201 - DNA, 20 bp, Artificial Sequence
  Description of Artificial Sequence: Synthetic oligonucleotide
  Target: SCN9A; (-) strand; PAM type: NRG; PAM sequence: GAG
tcaaatacagtagagggtgg

SEQ ID NO: 32202 - DNA, 20 bp, Artificial Sequence
  Description of Artificial Sequence: Synthetic oligonucleotide
  Target: SCN9A; (-) strand; PAM type: NRG; PAM sequence: GGG
tttcaaatacagtagagggt

SEQ ID NO: 32203 - DNA, 20 bp, Artificial Sequence
  Description of Artificial Sequence: Synthetic oligonucleotide
  Target: SCN9A; (-) strand; PAM type: NRG; PAM sequence: TGG
ctttcaaatacagtagaggg

SEQ ID NO: 32204 - DNA, 20 bp, Artificial Sequence
  Description of Artificial Sequence: Synthetic oligonucleotide
  Target: SCN9A; (-) strand; PAM type: NRG; PAM sequence: GGG
aacctttcaaatacagtaga

SEQ ID NO: 32205 - DNA, 20 bp, Artificial Sequence
  Description of Artificial Sequence: Synthetic oligonucleotide
  Target: SCN9A; (-) strand; PAM type: NRG; PAM sequence: AGG
gaacctttcaaatacagtag

SEQ ID NO: 32206 - DNA, 20 bp, Artificial Sequence
  Description of Artificial Sequence: Synthetic oligonucleotide
  Target: SCN9A; (-) strand; PAM type: NRG; PAM sequence: GAG
ggaacctttcaaatacagta

SEQ ID NO: 32207 - DNA, 20 bp, Artificial Sequence
  Description of Artificial Sequence: Synthetic oligonucleotide
  Target: SCN9A; (-) strand; PAM type: NRG; PAM sequence: TAG
ctggaacctttcaaatacag

SEQ ID NO: 32208 - DNA, 20 bp, Artificial Sequence
  Description of Artificial Sequence: Synthetic oligonucleotide
  Target: SCN9A; (-) strand; PAM type: NRG; PAM sequence: CAG
acactggaacctttcaaata

SEQ ID NO: 32209 - DNA, 20 bp, Artificial Sequence
  Description of Artificial Sequence: Synthetic oligonucleotide
  Target: SCN9A; (-) strand; PAM type: NRG; PAM sequence: TGG
tagaggggaaaaacacacac

SEQ ID NO: 32210 - DNA, 20 bp, Artificial Sequence
  Description of Artificial Sequence: Synthetic oligonucleotide
  Target: SCN9A; (-) strand; PAM type: NRG; PAM sequence: GGG
tataagtgagacacatagag

SEQ ID NO: 32211 - DNA, 20 bp, Artificial Sequence
  Description of Artificial Sequence: Synthetic oligonucleotide
  Target: SCN9A; (-) strand; PAM type: NRG; PAM sequence: GGG
ttataagtgagacacataga

SEQ ID NO: 32212 - DNA, 20 bp, Artificial Sequence
  Description of Artificial Sequence: Synthetic oligonucleotide
  Target: SCN9A; (-) strand; PAM type: NRG; PAM sequence: AGG
cttataagtgagacacatag

SEQ ID NO: 32213 - DNA, 20 bp, Artificial Sequence
  Description of Artificial Sequence: Synthetic oligonucleotide
  Target: SCN9A; (-) strand; PAM type: NRG; PAM sequence: GAG
gcttataagtgagacacata

SEQ ID NO: 32214 - DNA, 20 bp, Artificial Sequence
  Description of Artificial Sequence: Synthetic oligonucleotide
  Target: SCN9A; (-) strand; PAM type: NRG; PAM sequence: TAG
tcgcttataagtgagacaca

SEQ ID NO: 32215 - DNA, 20 bp, Artificial Sequence
  Description of Artificial Sequence: Synthetic oligonucleotide
  Target: SCN9A; (-) strand; PAM type: NRG; PAM sequence: GAG
tcatgttctcgcttataagt

SEQ ID NO: 32216 - DNA, 20 bp, Artificial Sequence
  Description of Artificial Sequence: Synthetic oligonucleotide
  Target: SCN9A; (-) strand; PAM type: NRG; PAM sequence: AAG
tatatcatgttctcgcttat

SEQ ID NO: 32217 - DNA, 20 bp, Artificial Sequence
  Description of Artificial Sequence: Synthetic oligonucleotide
  Target: SCN9A; (-) strand; PAM type: NRG; PAM sequence: AAG
catctttttaacttttcatt

SEQ ID NO: 32218 - DNA, 20 bp, Artificial Sequence
  Description of Artificial Sequence: Synthetic oligonucleotide
  Target: SCN9A; (-) strand; PAM type: NRG; PAM sequence: AAG
acttgagttttcagaaaaag

SEQ ID NO: 32219 - DNA, 20 bp, Artificial Sequence
  Description of Artificial Sequence: Synthetic oligonucleotide
  Target: SCN9A; (-) strand; PAM type: NRG; PAM sequence: AAG
tcaacttgagttttcagaaa

SEQ ID NO: 32220 - DNA, 20 bp, Artificial Sequence
  Description of Artificial Sequence: Synthetic oligonucleotide
  Target: SCN9A; (-) strand; PAM type: NRG; PAM sequence: CAG
attctctcaacttgagtttt

SEQ ID NO: 32221 - DNA, 20 bp, Artificial Sequence
  Description of Artificial Sequence: Synthetic oligonucleotide
  Target: SCN9A; (-) strand; PAM type: NRG; PAM sequence: GAG
atgattaattctctcaactt

SEQ ID NO: 32222 - DNA, 20 bp, Artificial Sequence
  Description of Artificial Sequence: Synthetic oligonucleotide
  Target: SCN9A; (-) strand; PAM type: NRG; PAM sequence: TAG
acttcctttagtgtatattt

SEQ ID NO: 32223 - DNA, 20 bp, Artificial Sequence
  Description of Artificial Sequence: Synthetic oligonucleotide
  Target: SCN9A; (-) strand; PAM type: NRG; PAM sequence: TAG
tctgcctaaagtacttcctt

SEQ ID NO: 32224 - DNA, 20 bp, Artificial Sequence
  Description of Artificial Sequence: Synthetic oligonucleotide
  Target: SCN9A; (-) strand; PAM type: NRG; PAM sequence: AAG
agatcttttccttctgccta

SEQ ID NO: 32225 - DNA, 20 bp, Artificial Sequence
  Description of Artificial Sequence: Synthetic oligonucleotide
  Target: SCN9A; (-) strand; PAM type: NRG; PAM sequence: AAG
tgtttccattctttttgtct

SEQ ID NO: 32226 - DNA, 20 bp, Artificial Sequence
  Description of Artificial Sequence: Synthetic oligonucleotide
  Target: SCN9A; (-) strand; PAM type: NRG; PAM sequence: AGG
atttttccttacatgtaaac

SEQ ID NO: 32227 - DNA, 20 bp, Artificial Sequence
  Description of Artificial Sequence: Synthetic oligonucleotide
  Target: SCN9A; (-) strand; PAM type: NRG; PAM sequence: CAG
catttttccttacatgtaaa

SEQ ID NO: 32228 - DNA, 20 bp, Artificial Sequence
  Description of Artificial Sequence: Synthetic oligonucleotide
  Target: SCN9A; (-) strand; PAM type: NRG; PAM sequence: GAG
agtcatttttcacctttgta

SEQ ID NO: 32229 - DNA, 20 bp, Artificial Sequence
  Description of Artificial Sequence: Synthetic oligonucleotide
  Target: SCN9A; (-) strand; PAM type: NRG; PAM sequence: TAG
gtagtcatttttcacctttg

SEQ ID NO: 32230 - DNA, 20 bp, Artificial Sequence
  Description of Artificial Sequence: Synthetic oligonucleotide
  Target: SCN9A; (-) strand; PAM type: NRG; PAM sequence: TAG
ataaaccttattgctttgtg

SEQ ID NO: 32231 - DNA, 20 bp, Artificial Sequence
  Description of Artificial Sequence: Synthetic oligonucleotide
  Target: SCN9A; (-) strand; PAM type: NRG; PAM sequence: TAG
ttaatgcattttaacctata

SEQ ID NO: 32232 - DNA, 20 bp, Artificial Sequence
  Description of Artificial Sequence: Synthetic oligonucleotide
  Target: SCN9A; (-) strand; PAM type: NRG; PAM sequence: TGG
ggattcaagaaaataaaaat

SEQ ID NO: 32233 - DNA, 20 bp, Artificial Sequence
  Description of Artificial Sequence: Synthetic oligonucleotide
  Target: SCN9A; (-) strand; PAM type: NRG; PAM sequence: AAG
caaataatggtaagggattc

SEQ ID NO: 32234 - DNA, 20 bp, Artificial Sequence
  Description of Artificial Sequence: Synthetic oligonucleotide
  Target: SCN9A; (-) strand; PAM type: NRG; PAM sequence: GGG
tcatatacaaataatggtaa

SEQ ID NO: 32235 - DNA, 20 bp, Artificial Sequence
  Description of Artificial Sequence: Synthetic oligonucleotide
  Target: SCN9A; (-) strand; PAM type: NRG; PAM sequence: AGG
ttcatatacaaataatggta

SEQ ID NO: 32236 - DNA, 20 bp, Artificial Sequence
  Description of Artificial Sequence: Synthetic oligonucleotide
  Target: SCN9A; (-) strand; PAM type: NRG; PAM sequence: AAG
tttcatatacaaataatggt

SEQ ID NO: 32237 - DNA, 20 bp, Artificial Sequence
  Description of Artificial Sequence: Synthetic oligonucleotide
  Target: SCN9A; (-) strand; PAM type: NRG; PAM sequence: TGG
cagttttcatatacaaataa

SEQ ID NO: 32238 - DNA, 20 bp, Artificial Sequence
  Description of Artificial Sequence: Synthetic oligonucleotide
  Target: SCN9A; (-) strand; PAM type: NRG; PAM sequence: CAG
aaaataagattaaagaaaat

SEQ ID NO: 32239 - DNA, 20 bp, Artificial Sequence
  Description of Artificial Sequence: Synthetic oligonucleotide
  Target: SCN9A; (-) strand; PAM type: NRG; PAM sequence: AAG
tgaaagtcaaaataagatta

SEQ ID NO: 32240 - DNA, 20 bp, Artificial Sequence
  Description of Artificial Sequence: Synthetic oligonucleotide
  Target: SCN9A; (-) strand; PAM type: NRG; PAM sequence: AAG
aaataattgaaagtcaaaat

SEQ ID NO: 32241 - DNA, 20 bp, Artificial Sequence
  Description of Artificial Sequence: Synthetic oligonucleotide
  Target: SCN9A; (-) strand; PAM type: NRG; PAM sequence: AAG
ttgtagactaaaataattga

SEQ ID NO: 32242 - DNA, 20 bp, Artificial Sequence
  Description of Artificial Sequence: Synthetic oligonucleotide
  Target: SCN9A; (-) strand; PAM type: NRG; PAM sequence: TAG
attaaatcactcaaatgttg

SEQ ID NO: 32243 - DNA, 20 bp, Artificial Sequence
  Description of Artificial Sequence: Synthetic oligonucleotide
  Target: SCN9A; (-) strand; PAM type: NRG; PAM sequence: GAG
aaaattttatgtaaacctga

SEQ ID NO: 32244 - DNA, 20 bp, Artificial Sequence
  Description of Artificial Sequence: Synthetic oligonucleotide
  Target: SCN9A; (-) strand; PAM type: NRG; PAM sequence: GAG
aaaaaattttatgtaaacct

SEQ ID NO: 32245 - DNA, 20 bp, Artificial Sequence
  Description of Artificial Sequence: Synthetic oligonucleotide
  Target: SCN9A; (-) strand; PAM type: NRG; PAM sequence: GAG
atggtgttttctacacaaca

SEQ ID NO: 32246 - DNA, 20 bp, Artificial Sequence
  Description of Artificial Sequence: Synthetic oligonucleotide
  Target: SCN9A; (-) strand; PAM type: NRG; PAM sequence: CAG
ggatggtgttttctacacaa

SEQ ID NO: 32247 - DNA, 20 bp, Artificial Sequence
  Description of Artificial Sequence: Synthetic oligonucleotide
  Target: SCN9A; (-) strand; PAM type: NRG; PAM sequence: TGG
acattaagggaattcatgga

SEQ ID NO: 32248 - DNA, 20 bp, Artificial Sequence
  Description of Artificial Sequence: Synthetic oligonucleotide
  Target: SCN9A; (-) strand; PAM type: NRG; PAM sequence: TGG
ttgtacattaagggaattca

SEQ ID NO: 32249 - DNA, 20 bp, Artificial Sequence
  Description of Artificial Sequence: Synthetic oligonucleotide
  Target: SCN9A; (-) strand; PAM type: NRG; PAM sequence: GGG
tatactatattgtacattaa

SEQ ID NO: 32250 - DNA, 20 bp, Artificial Sequence
  Description of Artificial Sequence: Synthetic oligonucleotide
  Target: SCN9A; (-) strand; PAM type: NRG; PAM sequence: AGG
ttatactatattgtacatta

SEQ ID NO: 32251 - DNA, 20 bp, Artificial Sequence
  Description of Artificial Sequence: Synthetic oligonucleotide
  Target: SCN9A; (-) strand; PAM type: NRG; PAM sequence: AAG
tttatactatattgtacatt

SEQ ID NO: 32252 - DNA, 20 bp, Artificial Sequence
  Description of Artificial Sequence: Synthetic oligonucleotide
  Target: SCN9A; (-) strand; PAM type: NRG; PAM sequence: AGG
ttaaaaggtctttcaaaata

SEQ ID NO: 32253 - DNA, 20 bp, Artificial Sequence
  Description of Artificial Sequence: Synthetic oligonucleotide
  Target: SCN9A; (-) strand; PAM type: NRG; PAM sequence: AAG
attaaaaggtctttcaaaat

SEQ ID NO: 32254 - DNA, 20 bp, Artificial Sequence
  Description of Artificial Sequence: Synthetic oligonucleotide
  Target: SCN9A; (-) strand; PAM type: NRG; PAM sequence: AGG
tctaattttcagttattaaa

SEQ ID NO: 32255 - DNA, 20 bp, Artificial Sequence
  Description of Artificial Sequence: Synthetic oligonucleotide
  Target: SCN9A; (-) strand; PAM type: NRG; PAM sequence: AAG
ttctaattttcagttattaa

SEQ ID NO: 32256 - DNA, 20 bp, Artificial Sequence
  Description of Artificial Sequence: Synthetic oligonucleotide
  Target: SCN9A; (-) strand; PAM type: NRG; PAM sequence: CAG
taagatcgctttctaatttt

SEQ ID NO: 32257 - DNA, 20 bp, Artificial Sequence
  Description of Artificial Sequence: Synthetic oligonucleotide
  Target: SCN9A; (-) strand; PAM type: NRG; PAM sequence: AAG
taattgatggctggtcactt

SEQ ID NO: 32258 - DNA, 20 bp, Artificial Sequence
  Description of Artificial Sequence: Synthetic oligonucleotide
  Target: SCN9A; (-) strand; PAM type: NRG; PAM sequence: TGG
taatcaatttaattgatggc

SEQ ID NO: 32259 - DNA, 20 bp, Artificial Sequence
  Description of Artificial Sequence: Synthetic oligonucleotide
  Target: SCN9A; (-) strand; PAM type: NRG; PAM sequence: TGG
cagataatcaatttaattga

SEQ ID NO: 32260 - DNA, 20 bp, Artificial Sequence
  Description of Artificial Sequence: Synthetic oligonucleotide
  Target: SCN9A; (-) strand; PAM type: NRG; PAM sequence: CAG
taatgcaaataataatgatg

SEQ ID NO: 32261 - DNA, 20 bp, Artificial Sequence
  Description of Artificial Sequence: Synthetic oligonucleotide
  Target: SCN9A; (-) strand; PAM type: NRG; PAM sequence: TGG
gtgctagcaagttattatga

SEQ ID NO: 32262 - DNA, 20 bp, Artificial Sequence
  Description of Artificial Sequence: Synthetic oligonucleotide
  Target: SCN9A; (-) strand; PAM type: NRG; PAM sequence: AAG
attctgttaattgtgctagc

SEQ ID NO: 32263 - DNA, 20 bp, Artificial Sequence
  Description of Artificial Sequence: Synthetic oligonucleotide
  Target: SCN9A; (-) strand; PAM type: NRG; PAM sequence: TAG
ctacattctgttaattgtgc

SEQ ID NO: 32264 - DNA, 20 bp, Artificial Sequence
  Description of Artificial Sequence: Synthetic oligonucleotide
  Target: SCN9A; (-) strand; PAM type: NRG; PAM sequence: AAG
taatcttttgtagtttaata

SEQ ID NO: 32265 - DNA, 20 bp, Artificial Sequence
  Description of Artificial Sequence: Synthetic oligonucleotide
  Target: SCN9A; (-) strand; PAM type: NRG; PAM sequence: TAG
ttttttactttaatcttttg

SEQ ID NO: 32266 - DNA, 20 bp, Artificial Sequence
  Description of Artificial Sequence: Synthetic oligonucleotide
  Target: SCN9A; (-) strand; PAM type: NRG; PAM sequence: AGG
gtaaggaaccgataatattt

SEQ ID NO: 32267 - DNA, 20 bp, Artificial Sequence
  Description of Artificial Sequence: Synthetic oligonucleotide
  Target: SCN9A; (-) strand; PAM type: NRG; PAM sequence: TAG
agtaaggaaccgataatatt

SEQ ID NO: 32268 - DNA, 20 bp, Artificial Sequence
  Description of Artificial Sequence: Synthetic oligonucleotide
  Target: SCN9A; (-) strand; PAM type: NRG; PAM sequence: AGG
ttttggtaatttgaaaagta

SEQ ID NO: 32269 - DNA, 20 bp, Artificial Sequence
  Description of Artificial Sequence: Synthetic oligonucleotide
  Target: SCN9A; (-) strand; PAM type: NRG; PAM sequence: AAG
gttttggtaatttgaaaagt

SEQ ID NO: 32270 - DNA, 20 bp, Artificial Sequence
  Description of Artificial Sequence: Synthetic oligonucleotide
  Target: SCN9A; (-) strand; PAM type: NRG; PAM sequence: AAG
ttttgttttggtaatttgaa

SEQ ID NO: 32271 - DNA, 20 bp, Artificial Sequence
  Description of Artificial Sequence: Synthetic oligonucleotide
  Target: SCN9A; (-) strand; PAM type: NRG; PAM sequence: TGG
agactaccttcattttgttt

SEQ ID NO: 32272 - DNA, 20 bp, Artificial Sequence
  Description of Artificial Sequence: Synthetic oligonucleotide
  Target: SCN9A; (-) strand; PAM type: NRG; PAM sequence: AAG
cgggggtaaaccttaaaatc

SEQ ID NO: 32273 - DNA, 20 bp, Artificial Sequence
  Description of Artificial Sequence: Synthetic oligonucleotide
  Target: SCN9A; (-) strand; PAM type: NRG; PAM sequence: GGG
attttcataacttgctgcgg

SEQ ID NO: 32274 - DNA, 20 bp, Artificial Sequence
  Description of Artificial Sequence: Synthetic oligonucleotide
  Target: SCN9A; (-) strand; PAM type: NRG; PAM sequence: GGG
tattttcataacttgctgcg

SEQ ID NO: 32275 - DNA, 20 bp, Artificial Sequence
  Description of Artificial Sequence: Synthetic oligonucleotide
  Target: SCN9A; (-) strand; PAM type: NRG; PAM sequence: GGG
ttattttcataacttgctgc

SEQ ID NO: 32276 - DNA, 20 bp, Artificial Sequence
  Description of Artificial Sequence: Synthetic oligonucleotide
  Target: SCN9A; (-) strand; PAM type: NRG; PAM sequence: CGG
attattttcataacttgctg

SEQ ID NO: 32277 - DNA, 20 bp, Artificial Sequence
  Description of Artificial Sequence: Synthetic oligonucleotide
  Target: SCN9A; (-) strand; PAM type: NRG; PAM sequence: CAG
tgaacctattaaaggaatat

SEQ ID NO: 32278 - DNA, 20 bp, Artificial Sequence
  Description of Artificial Sequence: Synthetic oligonucleotide
  Target: SCN9A; (-) strand; PAM type: NRG; PAM sequence: AGG
aaatgaaatgaacctattaa

SEQ ID NO: 32279 - DNA, 20 bp, Artificial Sequence
  Description of Artificial Sequence: Synthetic oligonucleotide
  Target: SCN9A; (-) strand; PAM type: NRG; PAM sequence: AAG
aaaatgaaatgaacctatta

SEQ ID NO: 32280 - DNA, 20 bp, Artificial Sequence
  Description of Artificial Sequence: Synthetic oligonucleotide
  Target: SCN9A; (-) strand; PAM type: NRG; PAM sequence: AAG
taaaatatctgttgaagagt

SEQ ID NO: 32281 - DNA, 20 bp, Artificial Sequence
  Description of Artificial Sequence: Synthetic oligonucleotide
  Target: SCN9A; (-) strand; PAM type: NRG; PAM sequence: GAG
attttaaaatatctgttgaa

SEQ ID NO: 32282 - DNA, 20 bp, Artificial Sequence
  Description of Artificial Sequence: Synthetic oligonucleotide
  Target: SCN9A; (-) strand; PAM type: NRG; PAM sequence: AAG
gtattttaaaatatctgttg

SEQ ID NO: 32283 - DNA, 20 bp, Artificial Sequence
  Description of Artificial Sequence: Synthetic oligonucleotide
  Target: SCN9A; (-) strand; PAM type: NRG; PAM sequence: AAG
taccttaaatatacacaata

SEQ ID NO: 32284 - DNA, 20 bp, Artificial Sequence
  Description of Artificial Sequence: Synthetic oligonucleotide
  Target: SCN9A; (-) strand; PAM type: NRG; PAM sequence: TAG
tactatctacatgtatccaa

SEQ ID NO: 32285 - DNA, 20 bp, Artificial Sequence
  Description of Artificial Sequence: Synthetic oligonucleotide
  Target: SCN9A; (-) strand; PAM type: NRG; PAM sequence: TGG
tatgttaatttcctttacta

SEQ ID NO: 32286 - DNA, 20 bp, Artificial Sequence
  Description of Artificial Sequence: Synthetic oligonucleotide
  Target: SCN9A; (-) strand; PAM type: NRG; PAM sequence: TAG
tgggtaacaactagagatgg

SEQ ID NO: 32287 - DNA, 20 bp, Artificial Sequence
  Description of Artificial Sequence: Synthetic oligonucleotide
  Target: SCN9A; (-) strand; PAM type: NRG; PAM sequence: TGG
aaatgggtaacaactagaga

SEQ ID NO: 32288 - DNA, 20 bp, Artificial Sequence
  Description of Artificial Sequence: Synthetic oligonucleotide
  Target: SCN9A; (-) strand; PAM type: NRG; PAM sequence: GAG
acaaaaatgggtaacaacta

SEQ ID NO: 32289 - DNA, 20 bp, Artificial Sequence
  Description of Artificial Sequence: Synthetic oligonucleotide
  Target: SCN9A; (-) strand; PAM type: NRG; PAM sequence: TAG
caacaaaaatgggtaacaac

SEQ ID NO: 32290 - DNA, 20 bp, Artificial Sequence
  Description of Artificial Sequence: Synthetic oligonucleotide
  Target: SCN9A; (-) strand; PAM type: NRG; PAM sequence: GGG
caataacaaacaacaaaaat

SEQ ID NO: 32291 - DNA, 20 bp, Artificial Sequence
  Description of Artificial Sequence: Synthetic oligonucleotide
  Target: SCN9A; (-) strand; PAM type: NRG; PAM sequence: TGG
acaataacaaacaacaaaaa

SEQ ID NO: 32292 - DNA, 20 bp, Artificial Sequence
  Description of Artificial Sequence: Synthetic oligonucleotide
  Target: SCN9A; (-) strand; PAM type: NRG; PAM sequence: TGG
agtattgtgtcccaggcacc

SEQ ID NO: 32293 - DNA, 20 bp, Artificial Sequence
  Description of Artificial Sequence: Synthetic oligonucleotide
  Target: SCN9A; (-) strand; PAM type: NRG; PAM sequence: AGG
cctagttagtattgtgtccc

SEQ ID NO: 32294 - DNA, 20 bp, Artificial Sequence
  Description of Artificial Sequence: Synthetic oligonucleotide
  Target: SCN9A; (-) strand; PAM type: NRG; PAM sequence: CAG
acctagttagtattgtgtcc

SEQ ID NO: 32295 - DNA, 20 bp, Artificial Sequence
  Description of Artificial Sequence: Synthetic oligonucleotide
  Target: SCN9A; (-) strand; PAM type: NRG; PAM sequence: TAG
aaggatcaaggccacctagt

SEQ ID NO: 32296 - DNA, 20 bp, Artificial Sequence
  Description of Artificial Sequence: Synthetic oligonucleotide
  Target: SCN9A; (-) strand; PAM type: NRG; PAM sequence: TAG
ggacaaggatcaaggccacc

SEQ ID NO: 32297 - DNA, 20 bp, Artificial Sequence
  Description of Artificial Sequence: Synthetic oligonucleotide
  Target: SCN9A; (-) strand; PAM type: NRG; PAM sequence: AGG
gccctagaggacaaggatca

SEQ ID NO: 32298 - DNA, 20 bp, Artificial Sequence
  Description of Artificial Sequence: Synthetic oligonucleotide
  Target: SCN9A; (-) strand; PAM type: NRG; PAM sequence: AAG
agccctagaggacaaggatc

SEQ ID NO: 32299 - DNA, 20 bp, Artificial Sequence
  Description of Artificial Sequence: Synthetic oligonucleotide
  Target: SCN9A; (-) strand; PAM type: NRG; PAM sequence: AGG
actgtaagccctagaggaca

SEQ ID NO: 32300 - DNA, 20 bp, Artificial Sequence
  Description of Artificial Sequence: Synthetic oligonucleotide
  Target: SCN9A; (-) strand; PAM type: NRG; PAM sequence: AAG
gactgtaagccctagaggac

SEQ ID NO: 32301 - DNA, 20 bp, Artificial Sequence
  Description of Artificial Sequence: Synthetic oligonucleotide
  Target: SCN9A; (-) strand; PAM type: NRG; PAM sequence: AGG
caacagactgtaagccctag

SEQ ID NO: 32302 - DNA, 20 bp, Artificial Sequence
  Description of Artificial Sequence: Synthetic oligonucleotide
  Target: SCN9A; (-) strand; PAM type: NRG; PAM sequence: GAG
ccaacagactgtaagcccta

SEQ ID NO: 32303 - DNA, 20 bp, Artificial Sequence
  Description of Artificial Sequence: Synthetic oligonucleotide
  Target: SCN9A; (-) strand; PAM type: NRG; PAM sequence: TAG
ccccaacagactgtaagccc

SEQ ID NO: 32304 - DNA, 20 bp, Artificial Sequence
  Description of Artificial Sequence: Synthetic oligonucleotide
  Target: SCN9A; (-) strand; PAM type: NRG; PAM sequence: AAG
ggttttccccaacagactgt

SEQ ID NO: 32305 - DNA, 20 bp, Artificial Sequence
  Description of Artificial Sequence: Synthetic oligonucleotide
  Target: SCN9A; (-) strand; PAM type: NRG; PAM sequence: CAG
tacctgctggttttccccaa

SEQ ID NO: 32306 - DNA, 20 bp, Artificial Sequence
  Description of Artificial Sequence: Synthetic oligonucleotide
  Target: SCN9A; (-) strand; PAM type: NRG; PAM sequence: TGG
tgttgtaattgtttacctgc

SEQ ID NO: 32307 - DNA, 20 bp, Artificial Sequence
  Description of Artificial Sequence: Synthetic oligonucleotide
  Target: SCN9A; (-) strand; PAM type: NRG; PAM sequence: AGG
tctcattgctctcatatagt

SEQ ID NO: 32308 - DNA, 20 bp, Artificial Sequence
  Description of Artificial Sequence: Synthetic oligonucleotide
  Target: SCN9A; (-) strand; PAM type: NRG; PAM sequence: TAG
ttctcattgctctcatatag

SEQ ID NO: 32309 - DNA, 20 bp, Artificial Sequence
  Description of Artificial Sequence: Synthetic oligonucleotide
  Target: SCN9A; (-) strand; PAM type: NRG; PAM sequence: TAG
gtgttctcattgctctcata

SEQ ID NO: 32310 - DNA, 20 bp, Artificial Sequence
  Description of Artificial Sequence: Synthetic oligonucleotide
  Target: SCN9A; (-) strand; PAM type: NRG; PAM sequence: AGG
tttcttcctaagtccaagtt

SEQ ID NO: 32311 - DNA, 20 bp, Artificial Sequence
  Description of Artificial Sequence: Synthetic oligonucleotide
  Target: SCN9A; (-) strand; PAM type: NRG; PAM sequence: TAG
ctttcttcctaagtccaagt

SEQ ID NO: 32312 - DNA, 20 bp, Artificial Sequence
  Description of Artificial Sequence: Synthetic oligonucleotide
  Target: SCN9A; (-) strand; PAM type: NRG; PAM sequence: AAG
aaatctttcttcctaagtcc

SEQ ID NO: 32313 - DNA, 20 bp, Artificial Sequence
  Description of Artificial Sequence: Synthetic oligonucleotide
  Target: SCN9A; (-) strand; PAM type: NRG; PAM sequence: AAG
tgaccaaaatctttcttcct

SEQ ID NO: 32314 - DNA, 20 bp, Artificial Sequence
  Description of Artificial Sequence: Synthetic oligonucleotide
  Target: SCN9A; (-) strand; PAM type: NRG; PAM sequence: CAG
atacctgtcatagtacagac

SEQ ID NO: 32315 - DNA, 20 bp, Artificial Sequence
  Description of Artificial Sequence: Synthetic oligonucleotide
  Target: SCN9A; (-) strand; PAM type: NRG; PAM sequence: CAG
aggagatacctgtcatagta

SEQ ID NO: 32316 - DNA, 20 bp, Artificial Sequence
  Description of Artificial Sequence: Synthetic oligonucleotide
  Target: SCN9A; (-) strand; PAM type: NRG; PAM sequence: TAG
attgtaggagatacctgtca

SEQ ID NO: 32317 - DNA, 20 bp, Artificial Sequence
  Description of Artificial Sequence: Synthetic oligonucleotide
  Target: SCN9A; (-) strand; PAM type: NRG; PAM sequence: GAG
acaagagggaggaattgtag

SEQ ID NO: 32318 - DNA, 20 bp, Artificial Sequence
  Description of Artificial Sequence: Synthetic oligonucleotide
  Target: SCN9A; (-) strand; PAM type: NRG; PAM sequence: AGG
acacaagagggaggaattgt

SEQ ID NO: 32319 - DNA, 20 bp, Artificial Sequence
  Description of Artificial Sequence: Synthetic oligonucleotide
  Target: SCN9A; (-) strand; PAM type: NRG; PAM sequence: TAG
aacacaagagggaggaattg

SEQ ID NO: 32320 - DNA, 20 bp, Artificial Sequence
  Description of Artificial Sequence: Synthetic oligonucleotide
  Target: SCN9A; (-) strand; PAM type: NRG; PAM sequence: AGG
aaactgttaacacaagaggg

SEQ ID NO: 32321 - DNA, 20 bp, Artificial Sequence
  Description of Artificial Sequence: Synthetic oligonucleotide
  Target: SCN9A; (-) strand; PAM type: NRG; PAM sequence: GAG
caaactgttaacacaagagg

SEQ ID NO: 32322 - DNA, 20 bp, Artificial Sequence
  Description of Artificial Sequence: Synthetic oligonucleotide
  Target: SCN9A; (-) strand; PAM type: NRG; PAM sequence: GGG
agcaaactgttaacacaaga

SEQ ID NO: 32323 - DNA, 20 bp, Artificial Sequence
  Description of Artificial Sequence: Synthetic oligonucleotide
  Target: SCN9A; (-) strand; PAM type: NRG; PAM sequence: AGG
tagcaaactgttaacacaag

SEQ ID NO: 32324 - DNA, 20 bp, Artificial Sequence
  Description of Artificial Sequence: Synthetic oligonucleotide
  Target: SCN9A; (-) strand; PAM type: NRG; PAM sequence: GAG
atagcaaactgttaacacaa

SEQ ID NO: 32325 - DNA, 20 bp, Artificial Sequence
  Description of Artificial Sequence: Synthetic oligonucleotide
  Target: SCN9A; (-) strand; PAM type: NRG; PAM sequence: AAG
tcatagcaaactgttaacac

SEQ ID NO: 32326 - DNA, 20 bp, Artificial Sequence
  Description of Artificial Sequence: Synthetic oligonucleotide
  Target: SCN9A; (-) strand; PAM type: NRG; PAM sequence: TAG
aggagacagctcctggatca

SEQ ID NO: 32327 - DNA, 20 bp, Artificial Sequence
  Description of Artificial Sequence: Synthetic oligonucleotide
  Target: SCN9A; (-) strand; PAM type: NRG; PAM sequence: TGG
aaaatgaaggagacagctcc

SEQ ID NO: 32328 - DNA, 20 bp, Artificial Sequence
  Description of Artificial Sequence: Synthetic oligonucleotide
  Target: SCN9A; (-) strand; PAM type: NRG; PAM sequence: CAG
aaagccaaaaatgaaggaga

SEQ ID NO: 32329 - DNA, 20 bp, Artificial Sequence
  Description of Artificial Sequence: Synthetic oligonucleotide
  Target: SCN9A; (-) strand; PAM type: NRG; PAM sequence: GAG
tgacaaagccaaaaatgaag

SEQ ID NO: 32330 - DNA, 20 bp, Artificial Sequence
  Description of Artificial Sequence: Synthetic oligonucleotide
  Target: SCN9A; (-) strand; PAM type: NRG; PAM sequence: AGG
gatgacaaagccaaaaatga

SEQ ID NO: 32331 - DNA, 20 bp, Artificial Sequence
  Description of Artificial Sequence: Synthetic oligonucleotide
  Target: SCN9A; (-) strand; PAM type: NRG; PAM sequence: AAG
tgatgacaaagccaaaaatg

SEQ ID NO: 32332 - DNA, 20 bp, Artificial Sequence
  Description of Artificial Sequence: Synthetic oligonucleotide
  Target: SCN9A; (-) strand; PAM type: NRG; PAM sequence: AAG
gacaatcagacttgatgaca

SEQ ID NO: 32333 - DNA, 20 bp, Artificial Sequence
  Description of Artificial Sequence: Synthetic oligonucleotide
  Target: SCN9A; (-) strand; PAM type: NRG; PAM sequence: CAG
tgagagtaagtaaggacaat

SEQ ID NO: 32334 - DNA, 20 bp, Artificial Sequence
  Description of Artificial Sequence: Synthetic oligonucleotide
  Target: SCN9A; (-) strand; PAM type: NRG; PAM sequence: AGG
ggaaaagttgagagtaagta

SEQ ID NO: 32335 - DNA, 20 bp, Artificial Sequence
  Description of Artificial Sequence: Synthetic oligonucleotide
  Target: SCN9A; (-) strand; PAM type: NRG; PAM sequence: AAG
tggaaaagttgagagtaagt

SEQ ID NO: 32336 - DNA, 20 bp, Artificial Sequence
  Description of Artificial Sequence: Synthetic oligonucleotide
  Target: SCN9A; (-) strand; PAM type: NRG; PAM sequence: AAG
tgtttggaaaagttgagagt

SEQ ID NO: 32337 - DNA, 20 bp, Artificial Sequence
  Description of Artificial Sequence: Synthetic oligonucleotide
  Target: SCN9A; (-) strand; PAM type: NRG; PAM sequence: GAG
ttcttgtttggaaaagttga

SEQ ID NO: 32338 - DNA, 20 bp, Artificial Sequence
  Description of Artificial Sequence: Synthetic oligonucleotide
  Target: SCN9A; (-) strand; PAM type: NRG; PAM sequence: GAG
ttttcttgtttggaaaagtt

SEQ ID NO: 32339 - DNA, 20 bp, Artificial Sequence
  Description of Artificial Sequence: Synthetic oligonucleotide
  Target: SCN9A; (-) strand; PAM type: NRG; PAM sequence: AAG
attttttttcttgtttggaa

SEQ ID NO: 32340 - DNA, 20 bp, Artificial Sequence
  Description of Artificial Sequence: Synthetic oligonucleotide
  Target: SCN9A; (-) strand; PAM type: NRG; PAM sequence: TGG
agatgattttttttcttgtt

SEQ ID NO: 32341 - DNA, 20 bp, Artificial Sequence
  Description of Artificial Sequence: Synthetic oligonucleotide
  Target: SCN9A; (-) strand; PAM type: NRG; PAM sequence: AAG
tccatcgaaggacaaagcca

SEQ ID NO: 32342 - DNA, 20 bp, Artificial Sequence
  Description of Artificial Sequence: Synthetic oligonucleotide
  Target: SCN9A; (-) strand; PAM type: NRG; PAM sequence: AAG
tcaaattccatcgaaggaca

SEQ ID NO: 32343 - DNA, 20 bp, Artificial Sequence
  Description of Artificial Sequence: Synthetic oligonucleotide
  Target: SCN9A; (-) strand; PAM type: NRG; PAM sequence: AGG
tatatttcaaattccatcga

SEQ ID NO: 32344 - DNA, 20 bp, Artificial Sequence
  Description of Artificial Sequence: Synthetic oligonucleotide
  Target: SCN9A; (-) strand; PAM type: NRG; PAM sequence: AAG
atatatttcaaattccatcg

SEQ ID NO: 32345 - DNA, 20 bp, Artificial Sequence
  Description of Artificial Sequence: Synthetic oligonucleotide
  Target: SCN9A; (-) strand; PAM type: NRG; PAM sequence: AAG
gaaaatctagagagtttatg

SEQ ID NO: 32346 - DNA, 20 bp, Artificial Sequence
  Description of Artificial Sequence: Synthetic oligonucleotide
  Target: SCN9A; (-) strand; PAM type: NRG; PAM sequence: GAG
acaggaatagaaaatctaga

SEQ ID NO: 32347 - DNA, 20 bp, Artificial Sequence
  Description of Artificial Sequence: Synthetic oligonucleotide
  Target: SCN9A; (-) strand; PAM type: NRG; PAM sequence: GAG
gtacaggaatagaaaatcta

SEQ ID NO: 32348 - DNA, 20 bp, Artificial Sequence
  Description of Artificial Sequence: Synthetic oligonucleotide
  Target: SCN9A; (-) strand; PAM type: NRG; PAM sequence: TAG
aagtacaggaatagaaaatc

SEQ ID NO: 32349 - DNA, 20 bp, Artificial Sequence
  Description of Artificial Sequence: Synthetic oligonucleotide
  Target: SCN9A; (-) strand; PAM type: NRG; PAM sequence: TAG
agactagacaagtacaggaa

SEQ ID NO: 32350 - DNA, 20 bp, Artificial Sequence
  Description of Artificial Sequence: Synthetic oligonucleotide
  Target: SCN9A; (-) strand; PAM type: NRG; PAM sequence: AGG
tttgaagactagacaagtac

SEQ ID NO: 32351 - DNA, 20 bp, Artificial Sequence
  Description of Artificial Sequence: Synthetic oligonucleotide
  Target: SCN9A; (-) strand; PAM type: NRG; PAM sequence: CAG
gtttgaagactagacaagta

SEQ ID NO: 32352 - DNA, 20 bp, Artificial Sequence
  Description of Artificial Sequence: Synthetic oligonucleotide
  Target: SCN9A; (-) strand; PAM type: NRG; PAM sequence: AAG
gaatagtttgaagactagac

SEQ ID NO: 32353 - DNA, 20 bp, Artificial Sequence
  Description of Artificial Sequence: Synthetic oligonucleotide
  Target: SCN9A; (-) strand; PAM type: NRG; PAM sequence: TAG
aattagaatagtttgaagac

SEQ ID NO: 32354 - DNA, 20 bp, Artificial Sequence
  Description of Artificial Sequence: Synthetic oligonucleotide
  Target: SCN9A; (-) strand; PAM type: NRG; PAM sequence: AAG
tttttaattagaatagtttg

SEQ ID NO: 32355 - DNA, 20 bp, Artificial Sequence
  Description of Artificial Sequence: Synthetic oligonucleotide
  Target: SCN9A; (-) strand; PAM type: NRG; PAM sequence: TAG
tttaaaatttttaattagaa

SEQ ID NO: 32356 - DNA, 20 bp, Artificial Sequence
  Description of Artificial Sequence: Synthetic oligonucleotide
  Target: SCN9A; (-) strand; PAM type: NRG; PAM sequence: TAG
catcctttaaaatttttaat

SEQ ID NO: 32357 - DNA, 20 bp, Artificial Sequence
  Description of Artificial Sequence: Synthetic oligonucleotide
  Target: SCN9A; (-) strand; PAM type: NRG; PAM sequence: AAG
ttaacctttagaaggaaaat

SEQ ID NO: 32358 - DNA, 20 bp, Artificial Sequence
  Description of Artificial Sequence: Synthetic oligonucleotide
  Target: SCN9A; (-) strand; PAM type: NRG; PAM sequence: AGG
gttatgatttaacctttaga

SEQ ID NO: 32359 - DNA, 20 bp, Artificial Sequence
  Description of Artificial Sequence: Synthetic oligonucleotide
  Target: SCN9A; (-) strand; PAM type: NRG; PAM sequence: AAG
agttatgatttaacctttag

SEQ ID NO: 32360 - DNA, 20 bp, Artificial Sequence
  Description of Artificial Sequence: Synthetic oligonucleotide
  Target: SCN9A; (-) strand; PAM type: NRG; PAM sequence: TAG
gtaagttatgatttaacctt

SEQ ID NO: 32361 - DNA, 20 bp, Artificial Sequence
  Description of Artificial Sequence: Synthetic oligonucleotide
  Target: SCN9A; (-) strand; PAM type: NRG; PAM sequence: AAG
atattatccacaatacaagt

SEQ ID NO: 32362 - DNA, 20 bp, Artificial Sequence
  Description of Artificial Sequence: Synthetic oligonucleotide
  Target: SCN9A; (-) strand; PAM type: NRG; PAM sequence: AAG
gttgatattatccacaatac

SEQ ID NO: 32363 - DNA, 20 bp, Artificial Sequence
  Description of Artificial Sequence: Synthetic oligonucleotide
  Target: SCN9A; (-) strand; PAM type: NRG; PAM sequence: TGG
tctgtagaatgcaggaactt

SEQ ID NO: 32364 - DNA, 20 bp, Artificial Sequence
  Description of Artificial Sequence: Synthetic oligonucleotide
  Target: SCN9A; (-) strand; PAM type: NRG; PAM sequence: AGG
taaaaaaatctgtagaatgc

SEQ ID NO: 32365 - DNA, 20 bp, Artificial Sequence
  Description of Artificial Sequence: Synthetic oligonucleotide
  Target: SCN9A; (-) strand; PAM type: NRG; PAM sequence: CAG
ttaaaaaaatctgtagaatg

SEQ ID NO: 32366 - DNA, 20 bp, Artificial Sequence
  Description of Artificial Sequence: Synthetic oligonucleotide
  Target: SCN9A; (-) strand; PAM type: NRG; PAM sequence: TAG
cttgaggttaaaaaaatctg

SEQ ID NO: 32367 - DNA, 20 bp, Artificial Sequence
  Description of Artificial Sequence: Synthetic oligonucleotide
  Target: SCN9A; (-) strand; PAM type: NRG; PAM sequence: AGG
ggaatttaacctggaacttg

SEQ ID NO: 32368 - DNA, 20 bp, Artificial Sequence
  Description of Artificial Sequence: Synthetic oligonucleotide
  Target: SCN9A; (-) strand; PAM type: NRG; PAM sequence: GAG
gggaatttaacctggaactt

SEQ ID NO: 32369 - DNA, 20 bp, Artificial Sequence
  Description of Artificial Sequence: Synthetic oligonucleotide
  Target: SCN9A; (-) strand; PAM type: NRG; PAM sequence: TGG
cacaaactgggaatttaacc

SEQ ID NO: 32370 - DNA, 20 bp, Artificial Sequence
  Description of Artificial Sequence: Synthetic oligonucleotide
  Target: SCN9A; (-) strand; PAM type: NRG; PAM sequence: GGG
ataacaattggccacaaact

SEQ ID NO: 32371 - DNA, 20 bp, Artificial Sequence
  Description of Artificial Sequence: Synthetic oligonucleotide
  Target: SCN9A; (-) strand; PAM type: NRG; PAM sequence: TGG
gataacaattggccacaaac

SEQ ID NO: 32372 - DNA, 20 bp, Artificial Sequence
  Description of Artificial Sequence: Synthetic oligonucleotide
  Target: SCN9A; (-) strand; PAM type: NRG; PAM sequence: TGG
gcatggccaatgataacaat

SEQ ID NO: 32373 - DNA, 20 bp, Artificial Sequence
  Description of Artificial Sequence: Synthetic oligonucleotide
  Target: SCN9A; (-) strand; PAM type: NRG; PAM sequence: TGG
taataaaaggaggctttgca

SEQ ID NO: 32374 - DNA, 20 bp, Artificial Sequence
  Description of Artificial Sequence: Synthetic oligonucleotide
  Target: SCN9A; (-) strand; PAM type: NRG; PAM sequence: AGG
gaaaaaatattaataaaagg

SEQ ID NO: 32375 - DNA, 20 bp, Artificial Sequence
  Description of Artificial Sequence: Synthetic oligonucleotide
  Target: SCN9A; (-) strand; PAM type: NRG; PAM sequence: GAG
agaaaaaatattaataaaag

SEQ ID NO: 32376 - DNA, 20 bp, Artificial Sequence
  Description of Artificial Sequence: Synthetic oligonucleotide
  Target: SCN9A; (-) strand; PAM type: NRG; PAM sequence: AGG
ggagaaaaaatattaataaa

SEQ ID NO: 32377 - DNA, 20 bp, Artificial Sequence
  Description of Artificial Sequence: Synthetic oligonucleotide
  Target: SCN9A; (-) strand; PAM type: NRG; PAM sequence: AAG
tggagaaaaaatattaataa

SEQ ID NO: 32378 - DNA, 20 bp, Artificial Sequence
  Description of Artificial Sequence: Synthetic oligonucleotide
  Target: SCN9A; (-) strand; PAM type: NRG; PAM sequence: GAG
aatgggatatgggggcaatg

SEQ ID NO: 32379 - DNA, 20 bp, Artificial Sequence
  Description of Artificial Sequence: Synthetic oligonucleotide
  Target: SCN9A; (-) strand; PAM type: NRG; PAM sequence: TGG
agaatgggatatgggggcaa

SEQ ID NO: 32380 - DNA, 20 bp, Artificial Sequence
  Description of Artificial Sequence: Synthetic oligonucleotide
  Target: SCN9A; (-) strand; PAM type: NRG; PAM sequence: GGG
tggcagagaatgggatatgg

SEQ ID NO: 32381 - DNA, 20 bp, Artificial Sequence
  Description of Artificial Sequence: Synthetic oligonucleotide
  Target: SCN9A; (-) strand; PAM type: NRG; PAM sequence: GGG
gtggcagagaatgggatatg

SEQ ID NO: 32382 - DNA, 20 bp, Artificial Sequence
  Description of Artificial Sequence: Synthetic oligonucleotide
  Target: SCN9A; (-) strand; PAM type: NRG; PAM sequence: GGG
agtggcagagaatgggatat

SEQ ID NO: 32383 - DNA, 20 bp, Artificial Sequence
  Description of Artificial Sequence: Synthetic oligonucleotide
  Target: SCN9A; (-) strand; PAM type: NRG; PAM sequence: TGG
gagtggcagagaatgggata

SEQ ID NO: 32384 - DNA, 20 bp, Artificial Sequence
  Description of Artificial Sequence: Synthetic oligonucleotide
  Target: SCN9A; (-) strand; PAM type: NRG; PAM sequence: GGG
caggtagagtggcagagaat

SEQ ID NO: 32385 - DNA, 20 bp, Artificial Sequence
  Description of Artificial Sequence: Synthetic oligonucleotide
  Target: SCN9A; (-) strand; PAM type: NRG; PAM sequence: TGG
acaggtagagtggcagagaa

SEQ ID NO: 32386 - DNA, 20 bp, Artificial Sequence
  Description of Artificial Sequence: Synthetic oligonucleotide
  Target: SCN9A; (-) strand; PAM type: NRG; PAM sequence: GAG
gaaaaacaggtagagtggca

SEQ ID NO: 32387 - DNA, 20 bp, Artificial Sequence
  Description of Artificial Sequence: Synthetic oligonucleotide
  Target: SCN9A; (-) strand; PAM type: NRG; PAM sequence: CAG
atgaaaaacaggtagagtgg

SEQ ID NO: 32388 - DNA, 20 bp, Artificial Sequence
  Description of Artificial Sequence: Synthetic oligonucleotide
  Target: SCN9A; (-) strand; PAM type: NRG; PAM sequence: TGG
ggaatgaaaaacaggtagag

SEQ ID NO: 32389 - DNA, 20 bp, Artificial Sequence
  Description of Artificial Sequence: Synthetic oligonucleotide
  Target: SCN9A; (-) strand; PAM type: NRG; PAM sequence: GAG
atgggaatgaaaaacaggta

SEQ ID NO: 32390 - DNA, 20 bp, Artificial Sequence
  Description of Artificial Sequence: Synthetic oligonucleotide
  Target: SCN9A; (-) strand; PAM type: NRG; PAM sequence: TAG
gcatgggaatgaaaaacagg

SEQ ID NO: 32391 - DNA, 20 bp, Artificial Sequence
  Description of Artificial Sequence: Synthetic oligonucleotide
  Target: SCN9A; (-) strand; PAM type: NRG; PAM sequence: AGG
taagcatgggaatgaaaaac

SEQ ID NO: 32392 - DNA, 20 bp, Artificial Sequence
  Description of Artificial Sequence: Synthetic oligonucleotide
  Target: SCN9A; (-) strand; PAM type: NRG; PAM sequence: CAG
ctaagcatgggaatgaaaaa

SEQ ID NO: 32393 - DNA, 20 bp, Artificial Sequence
  Description of Artificial Sequence: Synthetic oligonucleotide
  Target: SCN9A; (-) strand; PAM type: NRG; PAM sequence: GGG
ttataatggttgctaagcat

SEQ ID NO: 32394 - DNA, 20 bp, Artificial Sequence
  Description of Artificial Sequence: Synthetic oligonucleotide
  Target: SCN9A; (-) strand; PAM type: NRG; PAM sequence: TGG
attataatggttgctaagca

SEQ ID NO: 32395 - DNA, 20 bp, Artificial Sequence
  Description of Artificial Sequence: Synthetic oligonucleotide
  Target: SCN9A; (-) strand; PAM type: NRG; PAM sequence: AAG
aacacattataatggttgct

SEQ ID NO: 32396 - DNA, 20 bp, Artificial Sequence
  Description of Artificial Sequence: Synthetic oligonucleotide
  Target: SCN9A; (-) strand; PAM type: NRG; PAM sequence: TGG
tgttcataaacacattataa

SEQ ID NO: 32397 - DNA, 20 bp, Artificial Sequence
  Description of Artificial Sequence: Synthetic oligonucleotide
  Target: SCN9A; (-) strand; PAM type: NRG; PAM sequence: AAG
tcaattttcaagaaaacaga

SEQ ID NO: 32398 - DNA, 20 bp, Artificial Sequence
  Description of Artificial Sequence: Synthetic oligonucleotide
  Target: SCN9A; (-) strand; PAM type: NRG; PAM sequence: CAG
atattcaattttcaagaaaa

SEQ ID NO: 32399 - DNA, 20 bp, Artificial Sequence
  Description of Artificial Sequence: Synthetic oligonucleotide
  Target: SCN9A; (-) strand; PAM type: NRG; PAM sequence: AAG
gtgtacaatattcaattttc

SEQ ID NO: 32400 - DNA, 20 bp, Artificial Sequence
  Description of Artificial Sequence: Synthetic oligonucleotide
  Target: SCN9A; (-) strand; PAM type: NRG; PAM sequence: GAG
gagaaaatgtatgtaaatta

SEQ ID NO: 32401 - DNA, 20 bp, Artificial Sequence
  Description of Artificial Sequence: Synthetic oligonucleotide
  Target: SCN9A; (-) strand; PAM type: NRG; PAM sequence: TAG
atgagaaaatgtatgtaaat

SEQ ID NO: 32402 - DNA, 20 bp, Artificial Sequence
  Description of Artificial Sequence: Synthetic oligonucleotide
  Target: SCN9A; (-) strand; PAM type: NRG; PAM sequence: GAG
agtaaataaaaacaaacaat

SEQ ID NO: 32403 - DNA, 20 bp, Artificial Sequence
  Description of Artificial Sequence: Synthetic oligonucleotide
  Target: SCN9A; (-) strand; PAM type: NRG; PAM sequence: TAG
gtactttaaatcatagtgct

SEQ ID NO: 32404 - DNA, 20 bp, Artificial Sequence
  Description of Artificial Sequence: Synthetic oligonucleotide
  Target: SCN9A; (-) strand; PAM type: NRG; PAM sequence: TAG
atgctaagtactttaaatca

SEQ ID NO: 32405 - DNA, 20 bp, Artificial Sequence
  Description of Artificial Sequence: Synthetic oligonucleotide
  Target: SCN9A; (-) strand; PAM type: NRG; PAM sequence: AAG
tttacaacaacatgaatgct

SEQ ID NO: 32406 - DNA, 20 bp, Artificial Sequence
  Description of Artificial Sequence: Synthetic oligonucleotide
  Target: SCN9A; (-) strand; PAM type: NRG; PAM sequence: TAG
cagtagttagaagtgcagat

SEQ ID NO: 32407 - DNA, 20 bp, Artificial Sequence
  Description of Artificial Sequence: Synthetic oligonucleotide
  Target: SCN9A; (-) strand; PAM type: NRG; PAM sequence: CAG
ttatgcagtagttagaagtg

SEQ ID NO: 32408 - DNA, 20 bp, Artificial Sequence
  Description of Artificial Sequence: Synthetic oligonucleotide
  Target: SCN9A; (-) strand; PAM type: NRG; PAM sequence: AAG
gaatattatgcagtagttag

SEQ ID NO: 32409 - DNA, 20 bp, Artificial Sequence
  Description of Artificial Sequence: Synthetic oligonucleotide
  Target: SCN9A; (-) strand; PAM type: NRG; PAM sequence: TAG
ctggaatattatgcagtagt

SEQ ID NO: 32410 - DNA, 20 bp, Artificial Sequence
  Description of Artificial Sequence: Synthetic oligonucleotide
  Target: SCN9A; (-) strand; PAM type: NRG; PAM sequence: TAG
tacactggaatattatgcag

SEQ ID NO: 32411 - DNA, 20 bp, Artificial Sequence
  Description of Artificial Sequence: Synthetic oligonucleotide
  Target: SCN9A; (-) strand; PAM type: NRG; PAM sequence: CAG
atatacactggaatattatg

SEQ ID NO: 32412 - DNA, 20 bp, Artificial Sequence
  Description of Artificial Sequence: Synthetic oligonucleotide
  Target: SCN9A; (-) strand; PAM type: NRG; PAM sequence: TGG
aaatgtctggtaatatacac

SEQ ID NO: 32413 - DNA, 20 bp, Artificial Sequence
  Description of Artificial Sequence: Synthetic oligonucleotide
  Target: SCN9A; (-) strand; PAM type: NRG; PAM sequence: TGG
gagcaaataggtaaaatgtc

SEQ ID NO: 32414 - DNA, 20 bp, Artificial Sequence
  Description of Artificial Sequence: Synthetic oligonucleotide
  Target: SCN9A; (-) strand; PAM type: NRG; PAM sequence: AGG
ttatcactaagagagcaaat

SEQ ID NO: 32415 - DNA, 20 bp, Artificial Sequence
  Description of Artificial Sequence: Synthetic oligonucleotide
  Target: SCN9A; (-) strand; PAM type: NRG; PAM sequence: TAG
gttatcactaagagagcaaa

SEQ ID NO: 32416 - DNA, 20 bp, Artificial Sequence
  Description of Artificial Sequence: Synthetic oligonucleotide
  Target: SCN9A; (-) strand; PAM type: NRG; PAM sequence: GAG
gccaggtgttatcactaaga

SEQ ID NO: 32417 - DNA, 20 bp, Artificial Sequence
  Description of Artificial Sequence: Synthetic oligonucleotide
  Target: SCN9A; (-) strand; PAM type: NRG; PAM sequence: GAG
ttgccaggtgttatcactaa

SEQ ID NO: 32418 - DNA, 20 bp, Artificial Sequence
  Description of Artificial Sequence: Synthetic oligonucleotide
  Target: SCN9A; (-) strand; PAM type: NRG; PAM sequence: AAG
gattgccaggtgttatcact

SEQ ID NO: 32419 - DNA, 20 bp, Artificial Sequence
  Description of Artificial Sequence: Synthetic oligonucleotide
  Target: SCN9A; (-) strand; PAM type: NRG; PAM sequence: AGG
ttggggactgctggattgcc

SEQ ID NO: 32420 - DNA, 20 bp, Artificial Sequence
  Description of Artificial Sequence: Synthetic oligonucleotide
  Target: SCN9A; (-) strand; PAM type: NRG; PAM sequence: CAG
gttggggactgctggattgc

SEQ ID NO: 32421 - DNA, 20 bp, Artificial Sequence
  Description of Artificial Sequence: Synthetic oligonucleotide
  Target: SCN9A; (-) strand; PAM type: NRG; PAM sequence: TGG
ccaagaaggttggggactgc

SEQ ID NO: 32422 - DNA, 20 bp, Artificial Sequence
  Description of Artificial Sequence: Synthetic oligonucleotide
  Target: SCN9A; (-) strand; PAM type: NRG; PAM sequence: GGG
ccttggttccaagaaggttg

SEQ ID NO: 32423 - DNA, 20 bp, Artificial Sequence
  Description of Artificial Sequence: Synthetic oligonucleotide
  Target: SCN9A; (-) strand; PAM type: NRG; PAM sequence: GGG
tccttggttccaagaaggtt

SEQ ID NO: 32424 - DNA, 20 bp, Artificial Sequence
  Description of Artificial Sequence: Synthetic oligonucleotide
  Target: SCN9A; (-) strand; PAM type: NRG; PAM sequence: TGG
gtccttggttccaagaaggt

SEQ ID NO: 32425 - DNA, 20 bp, Artificial Sequence
  Description of Artificial Sequence: Synthetic oligonucleotide
  Target: SCN9A; (-) strand; PAM type: NRG; PAM sequence: AGG
accagtccttggttccaaga

SEQ ID NO: 32426 - DNA, 20 bp, Artificial Sequence
  Description of Artificial Sequence: Synthetic oligonucleotide
  Target: SCN9A; (-) strand; PAM type: NRG; PAM sequence: AAG
aaccagtccttggttccaag

SEQ ID NO: 32427 - DNA, 20 bp, Artificial Sequence
  Description of Artificial Sequence: Synthetic oligonucleotide
  Target: SCN9A; (-) strand; PAM type: NRG; PAM sequence: AAG
tgaaaccagtccttggttcc

SEQ ID NO: 32428 - DNA, 20 bp, Artificial Sequence
  Description of Artificial Sequence: Synthetic oligonucleotide
  Target: SCN9A; (-) strand; PAM type: NRG; PAM sequence: TGG
tcttccatgaaaccagtcct

SEQ ID NO: 32429 - DNA, 20 bp, Artificial Sequence
  Description of Artificial Sequence: Synthetic oligonucleotide
  Target: SCN9A; (-) strand; PAM type: NRG; PAM sequence: CAG
aaaattgtcttccatgaaac

SEQ ID NO: 32430 - DNA, 20 bp, Artificial Sequence
  Description of Artificial Sequence: Synthetic oligonucleotide
  Target: SCN9A; (-) strand; PAM type: NRG; PAM sequence: TAG
cctgatcatctgaagtggaa

SEQ ID NO: 32431 - DNA, 20 bp, Artificial Sequence
  Description of Artificial Sequence: Synthetic oligonucleotide
  Target: SCN9A; (-) strand; PAM type: NRG; PAM sequence: TGG
taatgcctgatcatctgaag

SEQ ID NO: 32432 - DNA, 20 bp, Artificial Sequence
  Description of Artificial Sequence: Synthetic oligonucleotide
  Target: SCN9A; (-) strand; PAM type: NRG; PAM sequence: AAG
aactaatgcctgatcatctg

SEQ ID NO: 32433 - DNA, 20 bp, Artificial Sequence
  Description of Artificial Sequence: Synthetic oligonucleotide
  Target: SCN9A; (-) strand; PAM type: NRG; PAM sequence: GAG
ctaagttgcacactccttat

SEQ ID NO: 32434 - DNA, 20 bp, Artificial Sequence
  Description of Artificial Sequence: Synthetic oligonucleotide
  Target: SCN9A; (-) strand; PAM type: NRG; PAM sequence: AAG
actgcacatacgagggatct

SEQ ID NO: 32435 - DNA, 20 bp, Artificial Sequence
  Description of Artificial Sequence: Synthetic oligonucleotide
  Target: SCN9A; (-) strand; PAM type: NRG; PAM sequence: GGG
attgtgaactgcacatacga

SEQ ID NO: 32436 - DNA, 20 bp, Artificial Sequence
  Description of Artificial Sequence: Synthetic oligonucleotide
  Target: SCN9A; (-) strand; PAM type: NRG; PAM sequence: AGG
tattgtgaactgcacatacg

SEQ ID NO: 32437 - DNA, 20 bp, Artificial Sequence
  Description of Artificial Sequence: Synthetic oligonucleotide
  Target: SCN9A; (-) strand; PAM type: NRG; PAM sequence: GAG
ttattgtgaactgcacatac

SEQ ID NO: 32438 - DNA, 20 bp, Artificial Sequence
  Description of Artificial Sequence: Synthetic oligonucleotide
  Target: SCN9A; (-) strand; PAM type: NRG; PAM sequence: AAG
ttagactctcagagaagtgc

SEQ ID NO: 32439 - DNA, 20 bp, Artificial Sequence
  Description of Artificial Sequence: Synthetic oligonucleotide
  Target: SCN9A; (-) strand; PAM type: NRG; PAM sequence: AAG
ttggcattagactctcagag

SEQ ID NO: 32440 - DNA, 20 bp, Artificial Sequence
  Description of Artificial Sequence: Synthetic oligonucleotide
  Target: SCN9A; (-) strand; PAM type: NRG; PAM sequence: GAG
gccttggcattagactctca

SEQ ID NO: 32441 - DNA, 20 bp, Artificial Sequence
  Description of Artificial Sequence: Synthetic oligonucleotide
  Target: SCN9A; (-) strand; PAM type: NRG; PAM sequence: CAG
cagccttggcattagactct

SEQ ID NO: 32442 - DNA, 20 bp, Artificial Sequence
  Description of Artificial Sequence: Synthetic oligonucleotide
  Target: SCN9A; (-) strand; PAM type: NRG; PAM sequence: TAG
tgttagatcagccttggcat

SEQ ID NO: 32443 - DNA, 20 bp, Artificial Sequence
  Description of Artificial Sequence: Synthetic oligonucleotide
  Target: SCN9A; (-) strand; PAM type: NRG; PAM sequence: TGG
tcctcctgttagatcagcct

SEQ ID NO: 32444 - DNA, 20 bp, Artificial Sequence
  Description of Artificial Sequence: Synthetic oligonucleotide
  Target: SCN9A; (-) strand; PAM type: NRG; PAM sequence: CAG
agttcttcctcctgttagat

SEQ ID NO: 32445 - DNA, 20 bp, Artificial Sequence
  Description of Artificial Sequence: Synthetic oligonucleotide
  Target: SCN9A; (-) strand; PAM type: NRG; PAM sequence: TAG
acctgagttcttcctcctgt

SEQ ID NO: 32446 - DNA, 20 bp, Artificial Sequence
  Description of Artificial Sequence: Synthetic oligonucleotide
  Target: SCN9A; (-) strand; PAM type: NRG; PAM sequence: GAG
cccagtgaacattaccacct

SEQ ID NO: 32447 - DNA, 20 bp, Artificial Sequence
  Description of Artificial Sequence: Synthetic oligonucleotide
  Target: SCN9A; (-) strand; PAM type: NRG; PAM sequence: CAG
gcaggaggtgagcagcagcc

SEQ ID NO: 32448 - DNA, 20 bp, Artificial Sequence
  Description of Artificial Sequence: Synthetic oligonucleotide
  Target: SCN9A; (-) strand; PAM type: NRG; PAM sequence: CAG
gcacagcaggaggtgagcag

SEQ ID NO: 32449 - DNA, 20 bp, Artificial Sequence
  Description of Artificial Sequence: Synthetic oligonucleotide
  Target: SCN9A; (-) strand; PAM type: NRG; PAM sequence: CAG
gctgcacagcaggaggtgag

SEQ ID NO: 32450 - DNA, 20 bp, Artificial Sequence
  Description of Artificial Sequence: Synthetic oligonucleotide
  Target: SCN9A; (-) strand; PAM type: NRG; PAM sequence: GAG
caggctgcacagcaggaggt

SEQ ID NO: 32451 - DNA, 20 bp, Artificial Sequence
  Description of Artificial Sequence: Synthetic oligonucleotide
  Target: SCN9A; (-) strand; PAM type: NRG; PAM sequence: AGG
gaaccaggctgcacagcagg

SEQ ID NO: 32452 - DNA, 20 bp, Artificial Sequence
  Description of Artificial Sequence: Synthetic oligonucleotide
  Target: SCN9A; (-) strand; PAM type: NRG; PAM sequence: GAG
ggaaccaggctgcacagcag

SEQ ID NO: 32453 - DNA, 20 bp, Artificial Sequence
  Description of Artificial Sequence: Synthetic oligonucleotide
  Target: SCN9A; (-) strand; PAM type: NRG; PAM sequence: AGG
taggaaccaggctgcacagc

SEQ ID NO: 32454 - DNA, 20 bp, Artificial Sequence
  Description of Artificial Sequence: Synthetic oligonucleotide
  Target: SCN9A; (-) strand; PAM type: NRG; PAM sequence: CAG
ttaggaaccaggctgcacag

SEQ ID NO: 32455 - DNA, 20 bp, Artificial Sequence
  Description of Artificial Sequence: Synthetic oligonucleotide
  Target: SCN9A; (-) strand; PAM type: NRG; PAM sequence: CAG
ctgttaggaaccaggctgca

SEQ ID NO: 32456 - DNA, 20 bp, Artificial Sequence
  Description of Artificial Sequence: Synthetic oligonucleotide
  Target: SCN9A; (-) strand; PAM type: NRG; PAM sequence: AGG
tccatggcctgttaggaacc

SEQ ID NO: 32457 - DNA, 20 bp, Artificial Sequence
  Description of Artificial Sequence: Synthetic oligonucleotide
  Target: SCN9A; (-) strand; PAM type: NRG; PAM sequence: CAG
gtccatggcctgttaggaac

SEQ ID NO: 32458 - DNA, 20 bp, Artificial Sequence
  Description of Artificial Sequence: Synthetic oligonucleotide
  Target: SCN9A; (-) strand; PAM type: NRG; PAM sequence: AGG
atactggtccatggcctgtt

SEQ ID NO: 32459 - DNA, 20 bp, Artificial Sequence
  Description of Artificial Sequence: Synthetic oligonucleotide
  Target: SCN9A; (-) strand; PAM type: NRG; PAM sequence: TAG
gatactggtccatggcctgt

SEQ ID NO: 32460 - DNA, 20 bp, Artificial Sequence
  Description of Artificial Sequence: Synthetic oligonucleotide
  Target: SCN9A; (-) strand; PAM type: NRG; PAM sequence: TGG
cagtgacagatactggtcca

SEQ ID NO: 32461 - DNA, 20 bp, Artificial Sequence
  Description of Artificial Sequence: Synthetic oligonucleotide
  Target: SCN9A; (-) strand; PAM type: NRG; PAM sequence: TGG
cctgggccagtgacagatac

SEQ ID NO: 32462 - DNA, 20 bp, Artificial Sequence
  Description of Artificial Sequence: Synthetic oligonucleotide
  Target: SCN9A; (-) strand; PAM type: NRG; PAM sequence: CAG
tccatcccctgggccagtga

SEQ ID NO: 32463 - DNA, 20 bp, Artificial Sequence
  Description of Artificial Sequence: Synthetic oligonucleotide
  Target: SCN9A; (-) strand; PAM type: NRG; PAM sequence: CAG
ggggtttccatcccctgggc

SEQ ID NO: 32464 - DNA, 20 bp, Artificial Sequence
  Description of Artificial Sequence: Synthetic oligonucleotide
  Target: SCN9A; (-) strand; PAM type: NRG; PAM sequence: GGG
atcaggggtttccatcccct

SEQ ID NO: 32465 - DNA, 20 bp, Artificial Sequence
  Description of Artificial Sequence: Synthetic oligonucleotide
  Target: SCN9A; (-) strand; PAM type: NRG; PAM sequence: TGG
gatcaggggtttccatcccc

SEQ ID NO: 32466 - DNA, 20 bp, Artificial Sequence
  Description of Artificial Sequence: Synthetic oligonucleotide
  Target: SCN9A; (-) strand; PAM type: NRG; PAM sequence: GGG
gccacagtgggttagatcag

SEQ ID NO: 32467 - DNA, 20 bp, Artificial Sequence
  Description of Artificial Sequence: Synthetic oligonucleotide
  Target: SCN9A; (-) strand; PAM type: NRG; PAM sequence: GGG
ggccacagtgggttagatca

SEQ ID NO: 32468 - DNA, 20 bp, Artificial Sequence
  Description of Artificial Sequence: Synthetic oligonucleotide
  Target: SCN9A; (-) strand; PAM type: NRG; PAM sequence: AGG
aggccacagtgggttagatc

SEQ ID NO: 32469 - DNA, 20 bp, Artificial Sequence
  Description of Artificial Sequence: Synthetic oligonucleotide
  Target: SCN9A; (-) strand; PAM type: NRG; PAM sequence: CAG
taggccacagtgggttagat

SEQ ID NO: 32470 - DNA, 20 bp, Artificial Sequence
  Description of Artificial Sequence: Synthetic oligonucleotide
  Target: SCN9A; (-) strand; PAM type: NRG; PAM sequence: TAG
gtttataggccacagtgggt

SEQ ID NO: 32471 - DNA, 20 bp, Artificial Sequence
  Description of Artificial Sequence: Synthetic oligonucleotide
  Target: SCN9A; (-) strand; PAM type: NRG; PAM sequence: GGG
atctgtttataggccacagt

SEQ ID NO: 32472 - DNA, 20 bp, Artificial Sequence
  Description of Artificial Sequence: Synthetic oligonucleotide
  Target: SCN9A; (-) strand; PAM type: NRG; PAM sequence: TGG
gatctgtttataggccacag

SEQ ID NO: 32473 - DNA, 20 bp, Artificial Sequence
  Description of Artificial Sequence: Synthetic oligonucleotide
  Target: SCN9A; (-) strand; PAM type: NRG; PAM sequence: CAG
ctggatctgtttataggcca

SEQ ID NO: 32474 - DNA, 20 bp, Artificial Sequence
  Description of Artificial Sequence: Synthetic oligonucleotide
  Target: SCN9A; (-) strand; PAM type: NRG; PAM sequence: AGG
taaaacctggatctgtttat

SEQ ID NO: 32475 - DNA, 20 bp, Artificial Sequence
  Description of Artificial Sequence: Synthetic oligonucleotide
  Target: SCN9A; (-) strand; PAM type: NRG; PAM sequence: TAG
ataaaacctggatctgttta

SEQ ID NO: 32476 - DNA, 20 bp, Artificial Sequence
  Description of Artificial Sequence: Synthetic oligonucleotide
  Target: SCN9A; (-) strand; PAM type: NRG; PAM sequence: TGG
agccacagatccataaaacc

SEQ ID NO: 32477 - DNA, 20 bp, Artificial Sequence
  Description of Artificial Sequence: Synthetic oligonucleotide
  Target: SCN9A; (-) strand; PAM type: NRG; PAM sequence: CAG
tcccccagttgtataagcca

SEQ ID NO: 32478 - DNA, 20 bp, Artificial Sequence
  Description of Artificial Sequence: Synthetic oligonucleotide
  Target: SCN9A; (-) strand; PAM type: NRG; PAM sequence: AAG
acctcctcccccagttgtat

SEQ ID NO: 32479 - DNA, 20 bp, Artificial Sequence
  Description of Artificial Sequence: Synthetic oligonucleotide
  Target: SCN9A; (-) strand; PAM type: NRG; PAM sequence: CAG
tttttctcaacctcctcccc

SEQ ID NO: 32480 - DNA, 20 bp, Artificial Sequence
  Description of Artificial Sequence: Synthetic oligonucleotide
  Target: SCN9A; (-) strand; PAM type: NRG; PAM sequence: GAG
ggttaattatttttaataca

SEQ ID NO: 32481 - DNA, 20 bp, Artificial Sequence
  Description of Artificial Sequence: Synthetic oligonucleotide
  Target: SCN9A; (-) strand; PAM type: NRG; PAM sequence: CAG
ttggttaattatttttaata

SEQ ID NO: 32482 - DNA, 20 bp, Artificial Sequence
  Description of Artificial Sequence: Synthetic oligonucleotide
  Target: SCN9A; (-) strand; PAM type: NRG; PAM sequence: TGG
aattttggaatttatggtat

SEQ ID NO: 32483 - DNA, 20 bp, Artificial Sequence
  Description of Artificial Sequence: Synthetic oligonucleotide
  Target: SCN9A; (-) strand; PAM type: NRG; PAM sequence: TGG
taataaaattttggaattta

SEQ ID NO: 32484 - DNA, 20 bp, Artificial Sequence
  Description of Artificial Sequence: Synthetic oligonucleotide
  Target: SCN9A; (-) strand; PAM type: NRG; PAM sequence: TGG
ggagtaaattaataaaattt

SEQ ID NO: 32485 - DNA, 20 bp, Artificial Sequence
  Description of Artificial Sequence: Synthetic oligonucleotide
  Target: SCN9A; (-) strand; PAM type: NRG; PAM sequence: GAG
tcctaaagaaatgtgttaag

SEQ ID NO: 32486 - DNA, 20 bp, Artificial Sequence
  Description of Artificial Sequence: Synthetic oligonucleotide
  Target: SCN9A; (-) strand; PAM type: NRG; PAM sequence: AGG
agtcctaaagaaatgtgtta

SEQ ID NO: 32487 - DNA, 20 bp, Artificial Sequence
  Description of Artificial Sequence: Synthetic oligonucleotide
  Target: SCN9A; (-) strand; PAM type: NRG; PAM sequence: AAG
aagtcctaaagaaatgtgtt

SEQ ID NO: 32488 - DNA, 20 bp, Artificial Sequence
  Description of Artificial Sequence: Synthetic oligonucleotide
  Target: SCN9A; (-) strand; PAM type: NRG; PAM sequence: AAG
aaaaatgaagggaagtccta

SEQ ID NO: 32489 - DNA, 20 bp, Artificial Sequence
  Description of Artificial Sequence: Synthetic oligonucleotide
  Target: SCN9A; (-) strand; PAM type: NRG; PAM sequence: AAG
atgaagccaaaaatgaaggg

SEQ ID NO: 32490 - DNA, 20 bp, Artificial Sequence
  Description of Artificial Sequence: Synthetic oligonucleotide
  Target: SCN9A; (-) strand; PAM type: NRG; PAM sequence: GGG
agaatgaagccaaaaatgaa

SEQ ID NO: 32491 - DNA, 20 bp, Artificial Sequence
  Description of Artificial Sequence: Synthetic oligonucleotide
  Target: SCN9A; (-) strand; PAM type: NRG; PAM sequence: AGG
gagaatgaagccaaaaatga

SEQ ID NO: 32492 - DNA, 20 bp, Artificial Sequence
  Description of Artificial Sequence: Synthetic oligonucleotide
  Target: SCN9A; (-) strand; PAM type: NRG; PAM sequence: AAG
agagaatgaagccaaaaatg

SEQ ID NO: 32493 - DNA, 20 bp, Artificial Sequence
  Description of Artificial Sequence: Synthetic oligonucleotide
  Target: SCN9A; (-) strand; PAM type: NRG; PAM sequence: AAG
agggaagatcaaagagaatg

SEQ ID NO: 32494 - DNA, 20 bp, Artificial Sequence
  Description of Artificial Sequence: Synthetic oligonucleotide
  Target: SCN9A; (-) strand; PAM type: NRG; PAM sequence: GAG
aaagtaaagggaagatcaaa

SEQ ID NO: 32495 - DNA, 20 bp, Artificial Sequence
  Description of Artificial Sequence: Synthetic oligonucleotide
  Target: SCN9A; (-) strand; PAM type: NRG; PAM sequence: AAG
acaaagtaaagggaagatca

SEQ ID NO: 32496 - DNA, 20 bp, Artificial Sequence
  Description of Artificial Sequence: Synthetic oligonucleotide
  Target: SCN9A; (-) strand; PAM type: NRG; PAM sequence: AAG
aattgatacaaagtaaaggg

SEQ ID NO: 32497 - DNA, 20 bp, Artificial Sequence
  Description of Artificial Sequence: Synthetic oligonucleotide
  Target: SCN9A; (-) strand; PAM type: NRG; PAM sequence: GGG
caaaattgatacaaagtaaa

SEQ ID NO: 32498 - DNA, 20 bp, Artificial Sequence
  Description of Artificial Sequence: Synthetic oligonucleotide
  Target: SCN9A; (-) strand; PAM type: NRG; PAM sequence: AGG
acaaaattgatacaaagtaa

SEQ ID NO: 32499 - DNA, 20 bp, Artificial Sequence
  Description of Artificial Sequence: Synthetic oligonucleotide
  Target: SCN9A; (-) strand; PAM type: NRG; PAM sequence: AAG
tacaaaattgatacaaagta

SEQ ID NO: 32500 - DNA, 20 bp, Artificial Sequence
  Description of Artificial Sequence: Synthetic oligonucleotide
  Target: SCN9A; (-) strand; PAM type: NRG; PAM sequence: AAG
tccattacaaaattgataca

SEQ ID NO: 32501 - DNA, 20 bp, Artificial Sequence
  Description of Artificial Sequence: Synthetic oligonucleotide
  Target: SCN9A; (-) strand; PAM type: NRG; PAM sequence: AAG
tactcagttgtggtaaaaga

SEQ ID NO: 32502 - DNA, 20 bp, Artificial Sequence
  Description of Artificial Sequence: Synthetic oligonucleotide
  Target: SCN9A; (-) strand; PAM type: NRG; PAM sequence: AAG
actatactcagttgtggtaa

SEQ ID NO: 32503 - DNA, 20 bp, Artificial Sequence
  Description of Artificial Sequence: Synthetic oligonucleotide
  Target: SCN9A; (-) strand; PAM type: NRG; PAM sequence: TGG
acacacactatactcagttg

SEQ ID NO: 32504 - DNA, 20 bp, Artificial Sequence
  Description of Artificial Sequence: Synthetic oligonucleotide
  Target: SCN9A; (-) strand; PAM type: NRG; PAM sequence: CAG
gaacatacacacactatact

SEQ ID NO: 32505 - DNA, 20 bp, Artificial Sequence
  Description of Artificial Sequence: Synthetic oligonucleotide
  Target: SCN9A; (-) strand; PAM type: NRG; PAM sequence: CAG
agagaaatttgctcaactat

SEQ ID NO: 32506 - DNA, 20 bp, Artificial Sequence
  Description of Artificial Sequence: Synthetic oligonucleotide
  Target: SCN9A; (-) strand; PAM type: NRG; PAM sequence: GAG
aaaacaagttgtaaaactca

SEQ ID NO: 32507 - DNA, 20 bp, Artificial Sequence
  Description of Artificial Sequence: Synthetic oligonucleotide
  Target: SCN9A; (-) strand; PAM type: NRG; PAM sequence: CAG
caaaaacaagttgtaaaact

SEQ ID NO: 32508 - DNA, 20 bp, Artificial Sequence
  Description of Artificial Sequence: Synthetic oligonucleotide
  Target: SCN9A; (-) strand; PAM type: NRG; PAM sequence: AAG
ttcatgccattaccaaaaac

SEQ ID NO: 32509 - DNA, 20 bp, Artificial Sequence
  Description of Artificial Sequence: Synthetic oligonucleotide
  Target: SCN9A; (-) strand; PAM type: NRG; PAM sequence: CAG
ggaggtgttcccaaatttga

SEQ ID NO: 32510 - DNA, 20 bp, Artificial Sequence
  Description of Artificial Sequence: Synthetic oligonucleotide
  Target: SCN9A; (-) strand; PAM type: NRG; PAM sequence: AGG
atgtgaaagaaacttgatgg

SEQ ID NO: 32511 - DNA, 20 bp, Artificial Sequence
  Description of Artificial Sequence: Synthetic oligonucleotide
  Target: SCN9A; (-) strand; PAM type: NRG; PAM sequence: GAG
tatgtgaaagaaacttgatg

SEQ ID NO: 32512 - DNA, 20 bp, Artificial Sequence
  Description of Artificial Sequence: Synthetic oligonucleotide
  Target: SCN9A; (-) strand; PAM type: NRG; PAM sequence: TGG
catatgtgaaagaaacttga

SEQ ID NO: 32513 - DNA, 20 bp, Artificial Sequence
  Description of Artificial Sequence: Synthetic oligonucleotide
  Target: SCN9A; (-) strand; PAM type: NRG; PAM sequence: AAG
atcttacaactcatatgtga

SEQ ID NO: 32514 - DNA, 20 bp, Artificial Sequence
  Description of Artificial Sequence: Synthetic oligonucleotide
  Target: SCN9A; (-) strand; PAM type: NRG; PAM sequence: AGG
tctgaataaggacactgtac

SEQ ID NO: 32515 - DNA, 20 bp, Artificial Sequence
  Description of Artificial Sequence: Synthetic oligonucleotide
  Target: SCN9A; (-) strand; PAM type: NRG; PAM sequence: CAG
ttctgaataaggacactgta

SEQ ID NO: 32516 - DNA, 20 bp, Artificial Sequence
  Description of Artificial Sequence: Synthetic oligonucleotide
  Target: SCN9A; (-) strand; PAM type: NRG; PAM sequence: AGG
ataagattagcttctgaata

SEQ ID NO: 32517 - DNA, 20 bp, Artificial Sequence
  Description of Artificial Sequence: Synthetic oligonucleotide
  Target: SCN9A; (-) strand; PAM type: NRG; PAM sequence: AAG
tataagattagcttctgaat

SEQ ID NO: 32518 - DNA, 20 bp, Artificial Sequence
  Description of Artificial Sequence: Synthetic oligonucleotide
  Target: SCN9A; (-) strand; PAM type: NRG; PAM sequence: TAG
cgatttagagtatataagat

SEQ ID NO: 32519 - DNA, 20 bp, Artificial Sequence
  Description of Artificial Sequence: Synthetic oligonucleotide
  Target: SCN9A; (-) strand; PAM type: NRG; PAM sequence: AAG
gttgtcgatttagagtatat

SEQ ID NO: 32520 - DNA, 20 bp, Artificial Sequence
  Description of Artificial Sequence: Synthetic oligonucleotide
  Target: SCN9A; (-) strand; PAM type: NRG; PAM sequence: GAG
ggttgggtgttgtcgattta

SEQ ID NO: 32521 - DNA, 20 bp, Artificial Sequence
  Description of Artificial Sequence: Synthetic oligonucleotide
  Target: SCN9A; (-) strand; PAM type: NRG; PAM sequence: TAG
gtggttgggtgttgtcgatt

SEQ ID NO: 32522 - DNA, 20 bp, Artificial Sequence
  Description of Artificial Sequence: Synthetic oligonucleotide
  Target: SCN9A; (-) strand; PAM type: NRG; PAM sequence: GGG
atattgataacagagtggtt

SEQ ID NO: 32523 - DNA, 20 bp, Artificial Sequence
  Description of Artificial Sequence: Synthetic oligonucleotide
  Target: SCN9A; (-) strand; PAM type: NRG; PAM sequence: TGG
gatattgataacagagtggt

SEQ ID NO: 32524 - DNA, 20 bp, Artificial Sequence
  Description of Artificial Sequence: Synthetic oligonucleotide
  Target: SCN9A; (-) strand; PAM type: NRG; PAM sequence: TGG
tgaggatattgataacagag

SEQ ID NO: 32525 - DNA, 20 bp, Artificial Sequence
  Description of Artificial Sequence: Synthetic oligonucleotide
  Target: SCN9A; (-) strand; PAM type: NRG; PAM sequence: GAG
cattgaggatattgataaca

SEQ ID NO: 32526 - DNA, 20 bp, Artificial Sequence
  Description of Artificial Sequence: Synthetic oligonucleotide
  Target: SCN9A; (-) strand; PAM type: NRG; PAM sequence: CAG
tacattgaggatattgataa

SEQ ID NO: 32527 - DNA, 20 bp, Artificial Sequence
  Description of Artificial Sequence: Synthetic oligonucleotide
  Target: SCN9A; (-) strand; PAM type: NRG; PAM sequence: AGG
cttcatacatcactacattg

SEQ ID NO: 32528 - DNA, 20 bp, Artificial Sequence
  Description of Artificial Sequence: Synthetic oligonucleotide
  Target: SCN9A; (-) strand; PAM type: NRG; PAM sequence: GAG
tcttcatacatcactacatt

SEQ ID NO: 32529 - DNA, 20 bp, Artificial Sequence
  Description of Artificial Sequence: Synthetic oligonucleotide
  Target: SCN9A; (-) strand; PAM type: NRG; PAM sequence: GAG
ataaaatggccaaacatgtt

SEQ ID NO: 32530 - DNA, 20 bp, Artificial Sequence
  Description of Artificial Sequence: Synthetic oligonucleotide
  Target: SCN9A; (-) strand; PAM type: NRG; PAM sequence: TGG
cttgctcatttgccataaaa

SEQ ID NO: 32531 - DNA, 20 bp, Artificial Sequence
  Description of Artificial Sequence: Synthetic oligonucleotide
  Target: SCN9A; (-) strand; PAM type: NRG; PAM sequence: AGG
atatgttgaggaaaaatatt

SEQ ID NO: 32532 - DNA, 20 bp, Artificial Sequence
  Description of Artificial Sequence: Synthetic oligonucleotide
  Target: SCN9A; (-) strand; PAM type: NRG; PAM sequence: TAG
aatatgttgaggaaaaatat

SEQ ID NO: 32533 - DNA, 20 bp, Artificial Sequence
  Description of Artificial Sequence: Synthetic oligonucleotide
  Target: SCN9A; (-) strand; PAM type: NRG; PAM sequence: AGG
tgaatcatatgaatatgttg

SEQ ID NO: 32534 - DNA, 20 bp, Artificial Sequence
  Description of Artificial Sequence: Synthetic oligonucleotide
  Target: SCN9A; (-) strand; PAM type: NRG; PAM sequence: GAG
gtgaatcatatgaatatgtt

SEQ ID NO: 32535 - DNA, 20 bp, Artificial Sequence
  Description of Artificial Sequence: Synthetic oligonucleotide
  Target: SCN9A; (-) strand; PAM type: NRG; PAM sequence: GAG
ataatccagtttataaagaa

SEQ ID NO: 32536 - DNA, 20 bp, Artificial Sequence
  Description of Artificial Sequence: Synthetic oligonucleotide
  Target: SCN9A; (-) strand; PAM type: NRG; PAM sequence: AAG
taataatccagtttataaag

SEQ ID NO: 32537 - DNA, 20 bp, Artificial Sequence
  Description of Artificial Sequence: Synthetic oligonucleotide
  Target: SCN9A; (-) strand; PAM type: NRG; PAM sequence: AAG
gtgtaataatccagtttata

SEQ ID NO: 32538 - DNA, 20 bp, Artificial Sequence
  Description of Artificial Sequence: Synthetic oligonucleotide
  Target: SCN9A; (-) strand; PAM type: NRG; PAM sequence: CAG
tcttggattgtgtaataatc

SEQ ID NO: 32539 - DNA, 20 bp, Artificial Sequence
  Description of Artificial Sequence: Synthetic oligonucleotide
  Target: SCN9A; (-) strand; PAM type: NRG; PAM sequence: TGG
agcactattaaataaattct

SEQ ID NO: 32540 - DNA, 20 bp, Artificial Sequence
  Description of Artificial Sequence: Synthetic oligonucleotide
  Target: SCN9A; (-) strand; PAM type: NRG; PAM sequence: TAG
aagaagacactcatctctta

SEQ ID NO: 32541 - DNA, 20 bp, Artificial Sequence
  Description of Artificial Sequence: Synthetic oligonucleotide
  Target: SCN9A; (-) strand; PAM type: NRG; PAM sequence: AAG
agtattatttctcaaagaag

SEQ ID NO: 32542 - DNA, 20 bp, Artificial Sequence
  Description of Artificial Sequence: Synthetic oligonucleotide
  Target: SCN9A; (-) strand; PAM type: NRG; PAM sequence: AAG
aaaagtattatttctcaaag

SEQ ID NO: 32543 - DNA, 20 bp, Artificial Sequence
  Description of Artificial Sequence: Synthetic oligonucleotide
  Target: SCN9A; (-) strand; PAM type: NRG; PAM sequence: AAG
gtaaaaagtattatttctca

SEQ ID NO: 32544 - DNA, 20 bp, Artificial Sequence
  Description of Artificial Sequence: Synthetic oligonucleotide
  Target: SCN9A; (-) strand; PAM type: NRG; PAM sequence: AAG
ataccagaagcaaaagtaaa

SEQ ID NO: 32545 - DNA, 20 bp, Artificial Sequence
  Description of Artificial Sequence: Synthetic oligonucleotide
  Target: SCN9A; (-) strand; PAM type: NRG; PAM sequence: AAG
ttttgtcataccagaagcaa

SEQ ID NO: 32546 - DNA, 20 bp, Artificial Sequence
  Description of Artificial Sequence: Synthetic oligonucleotide
  Target: SCN9A; (-) strand; PAM type: NRG; PAM sequence: AAG
acaaagttttgtcataccag

SEQ ID NO: 32547 - DNA, 20 bp, Artificial Sequence
  Description of Artificial Sequence: Synthetic oligonucleotide
  Target: SCN9A; (-) strand; PAM type: NRG; PAM sequence: CAG
ataacaaagttttgtcatac

SEQ ID NO: 32548 - DNA, 20 bp, Artificial Sequence
  Description of Artificial Sequence: Synthetic oligonucleotide
  Target: SCN9A; (-) strand; PAM type: NRG; PAM sequence: AAG
ttgagcaatgaactataaca

SEQ ID NO: 32549 - DNA, 20 bp, Artificial Sequence
  Description of Artificial Sequence: Synthetic oligonucleotide
  Target: SCN9A; (-) strand; PAM type: NRG; PAM sequence: GAG
acagaaattatattaacatt

SEQ ID NO: 32550 - DNA, 20 bp, Artificial Sequence
  Description of Artificial Sequence: Synthetic oligonucleotide
  Target: SCN9A; (-) strand; PAM type: NRG; PAM sequence: CAG
aggatgagcaataaaataaa

SEQ ID NO: 32551 - DNA, 20 bp, Artificial Sequence
  Description of Artificial Sequence: Synthetic oligonucleotide
  Target: SCN9A; (-) strand; PAM type: NRG; PAM sequence: GAG
gaaacaaaagttacaaggat

SEQ ID NO: 32552 - DNA, 20 bp, Artificial Sequence
  Description of Artificial Sequence: Synthetic oligonucleotide
  Target: SCN9A; (-) strand; PAM type: NRG; PAM sequence: AGG
aatatgaaacaaaagttaca

SEQ ID NO: 32553 - DNA, 20 bp, Artificial Sequence
  Description of Artificial Sequence: Synthetic oligonucleotide
  Target: SCN9A; (-) strand; PAM type: NRG; PAM sequence: AAG
gaatatgaaacaaaagttac

SEQ ID NO: 32554 - DNA, 20 bp, Artificial Sequence
  Description of Artificial Sequence: Synthetic oligonucleotide
  Target: SCN9A; (-) strand; PAM type: NRG; PAM sequence: AAG
gttagtggaatatgaaacaa

SEQ ID NO: 32555 - DNA, 20 bp, Artificial Sequence
  Description of Artificial Sequence: Synthetic oligonucleotide
  Target: SCN9A; (-) strand; PAM type: NRG; PAM sequence: TGG
aagtagtgatggaaagttag

SEQ ID NO: 32556 - DNA, 20 bp, Artificial Sequence
  Description of Artificial Sequence: Synthetic oligonucleotide
  Target: SCN9A; (-) strand; PAM type: NRG; PAM sequence: TAG
ttaaagtagtgatggaaagt

SEQ ID NO: 32557 - DNA, 20 bp, Artificial Sequence
  Description of Artificial Sequence: Synthetic oligonucleotide
  Target: SCN9A; (-) strand; PAM type: NRG; PAM sequence: AAG
tatattaaagtagtgatgga

SEQ ID NO: 32558 - DNA, 20 bp, Artificial Sequence
  Description of Artificial Sequence: Synthetic oligonucleotide
  Target: SCN9A; (-) strand; PAM type: NRG; PAM sequence: TGG
tttttatattaaagtagtga

SEQ ID NO: 32559 - DNA, 20 bp, Artificial Sequence
  Description of Artificial Sequence: Synthetic oligonucleotide
  Target: SCN9A; (-) strand; PAM type: NRG; PAM sequence: TAG
tttgactttttatattaaag

SEQ ID NO: 32560 - DNA, 20 bp, Artificial Sequence
  Description of Artificial Sequence: Synthetic oligonucleotide
  Target: SCN9A; (-) strand; PAM type: NRG; PAM sequence: AAG
atttttgactttttatatta

SEQ ID NO: 32561 - DNA, 20 bp, Artificial Sequence
  Description of Artificial Sequence: Synthetic oligonucleotide
  Target: SCN9A; (-) strand; PAM type: NRG; PAM sequence: AGG
aaaaaagtagacatataatt

SEQ ID NO: 32562 - DNA, 20 bp, Artificial Sequence
  Description of Artificial Sequence: Synthetic oligonucleotide
  Target: SCN9A; (-) strand; PAM type: NRG; PAM sequence: TAG
aaaaaaagtagacatataat

SEQ ID NO: 32563 - DNA, 20 bp, Artificial Sequence
  Description of Artificial Sequence: Synthetic oligonucleotide
  Target: SCN9A; (-) strand; PAM type: NRG; PAM sequence: TAG
atattggatagaaaaaaaag

SEQ ID NO: 32564 - DNA, 20 bp, Artificial Sequence
  Description of Artificial Sequence: Synthetic oligonucleotide
  Target: SCN9A; (-) strand; PAM type: NRG; PAM sequence: AAG
tggatattggatagaaaaaa

SEQ ID NO: 32565 - DNA, 20 bp, Artificial Sequence
  Description of Artificial Sequence: Synthetic oligonucleotide
  Target: SCN9A; (-) strand; PAM type: NRG; PAM sequence: TAG
aaggaagattggatattgga

SEQ ID NO: 32566 - DNA, 20 bp, Artificial Sequence
  Description of Artificial Sequence: Synthetic oligonucleotide
  Target: SCN9A; (-) strand; PAM type: NRG; PAM sequence: TGG
taagaaggaagattggatat

SEQ ID NO: 32567 - DNA, 20 bp, Artificial Sequence
  Description of Artificial Sequence: Synthetic oligonucleotide
  Target: SCN9A; (-) strand; PAM type: NRG; PAM sequence: TGG
ttctagataagaaggaagat

SEQ ID NO: 32568 - DNA, 20 bp, Artificial Sequence
  Description of Artificial Sequence: Synthetic oligonucleotide
  Target: SCN9A; (-) strand; PAM type: NRG; PAM sequence: AAG
gttcattctagataagaagg

SEQ ID NO: 32569 - DNA, 20 bp, Artificial Sequence
  Description of Artificial Sequence: Synthetic oligonucleotide
  Target: SCN9A; (-) strand; PAM type: NRG; PAM sequence: AGG
cctgttcattctagataaga

SEQ ID NO: 32570 - DNA, 20 bp, Artificial Sequence
  Description of Artificial Sequence: Synthetic oligonucleotide
  Target: SCN9A; (-) strand; PAM type: NRG; PAM sequence: AAG
acctgttcattctagataag

SEQ ID NO: 32571 - DNA, 20 bp, Artificial Sequence
  Description of Artificial Sequence: Synthetic oligonucleotide
  Target: SCN9A; (-) strand; PAM type: NRG; PAM sequence: AAG
aatacctgttcattctagat

SEQ ID NO: 32572 - DNA, 20 bp, Artificial Sequence
  Description of Artificial Sequence: Synthetic oligonucleotide
  Target: SCN9A; (-) strand; PAM type: NRG; PAM sequence: TAG
tgggaaatacctgttcattc

SEQ ID NO: 32573 - DNA, 20 bp, Artificial Sequence
  Description of Artificial Sequence: Synthetic oligonucleotide
  Target: SCN9A; (-) strand; PAM type: NRG; PAM sequence: GGG
ccatcaccactacacacaat

SEQ ID NO: 32574 - DNA, 20 bp, Artificial Sequence
  Description of Artificial Sequence: Synthetic oligonucleotide
  Target: SCN9A; (-) strand; PAM type: NRG; PAM sequence: TGG
tccatcaccactacacacaa

SEQ ID NO: 32575 - DNA, 20 bp, Artificial Sequence
  Description of Artificial Sequence: Synthetic oligonucleotide
  Target: SCN9A; (-) strand; PAM type: NRG; PAM sequence: AGG
gctttccacggcaggtgtca

SEQ ID NO: 32576 - DNA, 20 bp, Artificial Sequence
  Description of Artificial Sequence: Synthetic oligonucleotide
  Target: SCN9A; (-) strand; PAM type: NRG; PAM sequence: AAG
agctttccacggcaggtgtc

SEQ ID NO: 32577 - DNA, 20 bp, Artificial Sequence
  Description of Artificial Sequence: Synthetic oligonucleotide
  Target: SCN9A; (-) strand; PAM type: NRG; PAM sequence: AGG
tcactttagctttccacggc

SEQ ID NO: 32578 - DNA, 20 bp, Artificial Sequence
  Description of Artificial Sequence: Synthetic oligonucleotide
  Target: SCN9A; (-) strand; PAM type: NRG; PAM sequence: CAG
gtcactttagctttccacgg

SEQ ID NO: 32579 - DNA, 20 bp, Artificial Sequence
  Description of Artificial Sequence: Synthetic oligonucleotide
  Target: SCN9A; (-) strand; PAM type: NRG; PAM sequence: CGG
ttagtcactttagctttcca

SEQ ID NO: 32580 - DNA, 20 bp, Artificial Sequence
  Description of Artificial Sequence: Synthetic oligonucleotide
  Target: SCN9A; (-) strand; PAM type: NRG; PAM sequence: TAG
tatagtcactttagtcactt

SEQ ID NO: 32581 - DNA, 20 bp, Artificial Sequence
  Description of Artificial Sequence: Synthetic oligonucleotide
  Target: SCN9A; (-) strand; PAM type: NRG; PAM sequence: TAG
gaatggaaatatagtcactt

SEQ ID NO: 32582 - DNA, 20 bp, Artificial Sequence
  Description of Artificial Sequence: Synthetic oligonucleotide
  Target: SCN9A; (-) strand; PAM type: NRG; PAM sequence: TAG
acaggagtggaatggaaata

SEQ ID NO: 32583 - DNA, 20 bp, Artificial Sequence
  Description of Artificial Sequence: Synthetic oligonucleotide
  Target: SCN9A; (-) strand; PAM type: NRG; PAM sequence: TGG
ttaaaataacaggagtggaa

SEQ ID NO: 32584 - DNA, 20 bp, Artificial Sequence
  Description of Artificial Sequence: Synthetic oligonucleotide
  Target: SCN9A; (-) strand; PAM type: NRG; PAM sequence: TGG
accacttaaaataacaggag

SEQ ID NO: 32585 - DNA, 20 bp, Artificial Sequence
  Description of Artificial Sequence: Synthetic oligonucleotide
  Target: SCN9A; (-) strand; PAM type: NRG; PAM sequence: GAG
ctcaccacttaaaataacag

SEQ ID NO: 32586 - DNA, 20 bp, Artificial Sequence
  Description of Artificial Sequence: Synthetic oligonucleotide
  Target: SCN9A; (-) strand; PAM type: NRG; PAM sequence: AGG
gcctcaccacttaaaataac

SEQ ID NO: 32587 - DNA, 20 bp, Artificial Sequence
  Description of Artificial Sequence: Synthetic oligonucleotide
  Target: SCN9A; (-) strand; PAM type: NRG; PAM sequence: CAG
ggcctcaccacttaaaataa

SEQ ID NO: 32588 - DNA, 20 bp, Artificial Sequence
  Description of Artificial Sequence: Synthetic oligonucleotide
  Target: SCN9A; (-) strand; PAM type: NRG; PAM sequence: TGG
tgaataagcttaggagatga

SEQ ID NO: 32589 - DNA, 20 bp, Artificial Sequence
  Description of Artificial Sequence: Synthetic oligonucleotide
  Target: SCN9A; (-) strand; PAM type: NRG; PAM sequence: GAG
atccatttgaataagcttag

SEQ ID NO: 32590 - DNA, 20 bp, Artificial Sequence
  Description of Artificial Sequence: Synthetic oligonucleotide
  Target: SCN9A; (-) strand; PAM type: NRG; PAM sequence: AGG
gaatccatttgaataagctt

SEQ ID NO: 32591 - DNA, 20 bp, Artificial Sequence
  Description of Artificial Sequence: Synthetic oligonucleotide
  Target: SCN9A; (-) strand; PAM type: NRG; PAM sequence: TAG
agaatccatttgaataagct

SEQ ID NO: 32592 - DNA, 20 bp, Artificial Sequence
  Description of Artificial Sequence: Synthetic oligonucleotide
  Target: SCN9A; (-) strand; PAM type: NRG; PAM sequence: AAG
gcaacagaatccatttgaat

SEQ ID NO: 32593 - DNA, 20 bp, Artificial Sequence
  Description of Artificial Sequence: Synthetic oligonucleotide
  Target: SCN9A; (-) strand; PAM type: NRG; PAM sequence: CAG
aagttcaaagtaaagggcaa

SEQ ID NO: 32594 - DNA, 20 bp, Artificial Sequence
  Description of Artificial Sequence: Synthetic oligonucleotide
  Target: SCN9A; (-) strand; PAM type: NRG; PAM sequence: GGG
ttcaccaagttcaaagtaaa

SEQ ID NO: 32595 - DNA, 20 bp, Artificial Sequence
  Description of Artificial Sequence: Synthetic oligonucleotide
  Target: SCN9A; (-) strand; PAM type: NRG; PAM sequence: AGG
attcaccaagttcaaagtaa

SEQ ID NO: 32596 - DNA, 20 bp, Artificial Sequence
  Description of Artificial Sequence: Synthetic oligonucleotide
  Target: SCN9A; (-) strand; PAM type: NRG; PAM sequence: AAG
cattcaccaagttcaaagta

SEQ ID NO: 32597 - DNA, 20 bp, Artificial Sequence
  Description of Artificial Sequence: Synthetic oligonucleotide
  Target: SCN9A; (-) strand; PAM type: NRG; PAM sequence: AAG
ggcttcattcaccaagttca

SEQ ID NO: 32598 - DNA, 20 bp, Artificial Sequence
  Description of Artificial Sequence: Synthetic oligonucleotide
  Target: SCN9A; (-) strand; PAM type: NRG; PAM sequence: AAG
tttatttggcttcattcacc

SEQ ID NO: 32599 - DNA, 20 bp, Artificial Sequence
  Description of Artificial Sequence: Synthetic oligonucleotide
  Target: SCN9A; (-) strand; PAM type: NRG; PAM sequence: TGG
caataaaatcttcctttatt

SEQ ID NO: 32600 - DNA, 20 bp, Artificial Sequence
  Description of Artificial Sequence: Synthetic oligonucleotide
  Target: SCN9A; (-) strand; PAM type: NRG; PAM sequence: GGG
tgtacatagacccagcacaa

SEQ ID NO: 32601 - DNA, 20 bp, Artificial Sequence
  Description of Artificial Sequence: Synthetic oligonucleotide
  Target: SCN9A; (-) strand; PAM type: NRG; PAM sequence: AGG
ctgtacatagacccagcaca

SEQ ID NO: 32602 - DNA, 20 bp, Artificial Sequence
  Description of Artificial Sequence: Synthetic oligonucleotide
  Target: SCN9A; (-) strand; PAM type: NRG; PAM sequence: AAG
gctgtacatagacccagcac

SEQ ID NO: 32603 - DNA, 20 bp, Artificial Sequence
  Description of Artificial Sequence: Synthetic oligonucleotide
  Target: SCN9A; (-) strand; PAM type: NRG; PAM sequence: CAG
actatagctgtacatagacc

SEQ ID NO: 32604 - DNA, 20 bp, Artificial Sequence
  Description of Artificial Sequence: Synthetic oligonucleotide
  Target: SCN9A; (-) strand; PAM type: NRG; PAM sequence: TAG
gattctactatagctgtaca

SEQ ID NO: 32605 - DNA, 20 bp, Artificial Sequence
  Description of Artificial Sequence: Synthetic oligonucleotide
  Target: SCN9A; (-) strand; PAM type: NRG; PAM sequence: TAG
tgccacacaggattctacta

SEQ ID NO: 32606 - DNA, 20 bp, Artificial Sequence
  Description of Artificial Sequence: Synthetic oligonucleotide
  Target: SCN9A; (-) strand; PAM type: NRG; PAM sequence: AGG
actggtcactgctgccacac

SEQ ID NO: 32607 - DNA, 20 bp, Artificial Sequence
  Description of Artificial Sequence: Synthetic oligonucleotide
  Target: SCN9A; (-) strand; PAM type: NRG; PAM sequence: CAG
tactggtcactgctgccaca

SEQ ID NO: 32608 - DNA, 20 bp, Artificial Sequence
  Description of Artificial Sequence: Synthetic oligonucleotide
  Target: SCN9A; (-) strand; PAM type: NRG; PAM sequence: TGG
gacccagctggctagactac

SEQ ID NO: 32609 - DNA, 20 bp, Artificial Sequence
  Description of Artificial Sequence: Synthetic oligonucleotide
  Target: SCN9A; (-) strand; PAM type: NRG; PAM sequence: TAG
gtttggcagacccagctggc

SEQ ID NO: 32610 - DNA, 20 bp, Artificial Sequence
  Description of Artificial Sequence: Synthetic oligonucleotide
  Target: SCN9A; (-) strand; PAM type: NRG; PAM sequence: TGG
ggctgtttggcagacccagc

SEQ ID NO: 32611 - DNA, 20 bp, Artificial Sequence
  Description of Artificial Sequence: Synthetic oligonucleotide
  Target: SCN9A; (-) strand; PAM type: NRG; PAM sequence: CAG
tagaggctgtttggcagacc

SEQ ID NO: 32612 - DNA, 20 bp, Artificial Sequence
  Description of Artificial Sequence: Synthetic oligonucleotide
  Target: SCN9A; (-) strand; PAM type: NRG; PAM sequence: CAG
gaaatctagaggctgtttgg

SEQ ID NO: 32613 - DNA, 20 bp, Artificial Sequence
  Description of Artificial Sequence: Synthetic oligonucleotide
  Target: SCN9A; (-) strand; PAM type: NRG; PAM sequence: TGG
agggaaatctagaggctgtt

SEQ ID NO: 32614 - DNA, 20 bp, Artificial Sequence
  Description of Artificial Sequence: Synthetic oligonucleotide
  Target: SCN9A; (-) strand; PAM type: NRG; PAM sequence: AGG
ctgacaaaagggaaatctag

SEQ ID NO: 32615 - DNA, 20 bp, Artificial Sequence
  Description of Artificial Sequence: Synthetic oligonucleotide
  Target: SCN9A; (-) strand; PAM type: NRG; PAM sequence: GAG
gctgacaaaagggaaatcta

SEQ ID NO: 32616 - DNA, 20 bp, Artificial Sequence
  Description of Artificial Sequence: Synthetic oligonucleotide
  Target: SCN9A; (-) strand; PAM type: NRG; PAM sequence: TAG
gagctgacaaaagggaaatc

SEQ ID NO: 32617 - DNA, 20 bp, Artificial Sequence
  Description of Artificial Sequence: Synthetic oligonucleotide
  Target: SCN9A; (-) strand; PAM type: NRG; PAM sequence: GGG
aggaaaatgagctgacaaaa

SEQ ID NO: 32618 - DNA, 20 bp, Artificial Sequence
  Description of Artificial Sequence: Synthetic oligonucleotide
  Target: SCN9A; (-) strand; PAM type: NRG; PAM sequence: AGG
taggaaaatgagctgacaaa

SEQ ID NO: 32619 - DNA, 20 bp, Artificial Sequence
  Description of Artificial Sequence: Synthetic oligonucleotide
  Target: SCN9A; (-) strand; PAM type: NRG; PAM sequence: AAG
ataggaaaatgagctgacaa

SEQ ID NO: 32620 - DNA, 20 bp, Artificial Sequence
  Description of Artificial Sequence: Synthetic oligonucleotide
  Target: SCN9A; (-) strand; PAM type: NRG; PAM sequence: GAG
gagcagctgtataggaaaat

SEQ ID NO: 32621 - DNA, 20 bp, Artificial Sequence
  Description of Artificial Sequence: Synthetic oligonucleotide
  Target: SCN9A; (-) strand; PAM type: NRG; PAM sequence: AGG
ggaaactagagcagctgtat

SEQ ID NO: 32622 - DNA, 20 bp, Artificial Sequence
  Description of Artificial Sequence: Synthetic oligonucleotide
  Target: SCN9A; (-) strand; PAM type: NRG; PAM sequence: TAG
gggaaactagagcagctgta

SEQ ID NO: 32623 - DNA, 20 bp, Artificial Sequence
  Description of Artificial Sequence: Synthetic oligonucleotide
  Target: SCN9A; (-) strand; PAM type: NRG; PAM sequence: CAG
aaggctttgggaaactagag

SEQ ID NO: 32624 - DNA, 20 bp, Artificial Sequence
  Description of Artificial Sequence: Synthetic oligonucleotide
  Target: SCN9A; (-) strand; PAM type: NRG; PAM sequence: GAG
tggaaggctttgggaaacta

SEQ ID NO: 32625 - DNA, 20 bp, Artificial Sequence
  Description of Artificial Sequence: Synthetic oligonucleotide
  Target: SCN9A; (-) strand; PAM type: NRG; PAM sequence: TAG
attggaaggctttgggaaac

SEQ ID NO: 32626 - DNA, 20 bp, Artificial Sequence
  Description of Artificial Sequence: Synthetic oligonucleotide
  Target: SCN9A; (-) strand; PAM type: NRG; PAM sequence: GGG
tgcattcattggaaggcttt

SEQ ID NO: 32627 - DNA, 20 bp, Artificial Sequence
  Description of Artificial Sequence: Synthetic oligonucleotide
  Target: SCN9A; (-) strand; PAM type: NRG; PAM sequence: TGG
atgcattcattggaaggctt

SEQ ID NO: 32628 - DNA, 20 bp, Artificial Sequence
  Description of Artificial Sequence: Synthetic oligonucleotide
  Target: SCN9A; (-) strand; PAM type: NRG; PAM sequence: AGG
gtactcatgcattcattgga

SEQ ID NO: 32629 - DNA, 20 bp, Artificial Sequence
  Description of Artificial Sequence: Synthetic oligonucleotide
  Target: SCN9A; (-) strand; PAM type: NRG; PAM sequence: AAG
ggtactcatgcattcattgg

SEQ ID NO: 32630 - DNA, 20 bp, Artificial Sequence
  Description of Artificial Sequence: Synthetic oligonucleotide
  Target: SCN9A; (-) strand; PAM type: NRG; PAM sequence: TGG
ttgggtactcatgcattcat

SEQ ID NO: 32631 - DNA, 20 bp, Artificial Sequence
  Description of Artificial Sequence: Synthetic oligonucleotide
  Target: SCN9A; (-) strand; PAM type: NRG; PAM sequence: GGG
gagatttattggaagttgtt

SEQ ID NO: 32632 - DNA, 20 bp, Artificial Sequence
  Description of Artificial Sequence: Synthetic oligonucleotide
  Target: SCN9A; (-) strand; PAM type: NRG; PAM sequence: TGG
ggagatttattggaagttgt

SEQ ID NO: 32633 - DNA, 20 bp, Artificial Sequence
  Description of Artificial Sequence: Synthetic oligonucleotide
  Target: SCN9A; (-) strand; PAM type: NRG; PAM sequence: AAG
gccaaatggagatttattgg

SEQ ID NO: 32634 - DNA, 20 bp, Artificial Sequence
  Description of Artificial Sequence: Synthetic oligonucleotide
  Target: SCN9A; (-) strand; PAM type: NRG; PAM sequence: TGG
caagccaaatggagatttat

SEQ ID NO: 32635 - DNA, 20 bp, Artificial Sequence
  Description of Artificial Sequence: Synthetic oligonucleotide
  Target: SCN9A; (-) strand; PAM type: NRG; PAM sequence: GAG
tggctgtcccaagccaaatg

SEQ ID NO: 32636 - DNA, 20 bp, Artificial Sequence
  Description of Artificial Sequence: Synthetic oligonucleotide
  Target: SCN9A; (-) strand; PAM type: NRG; PAM sequence: TGG
actggctgtcccaagccaaa

SEQ ID NO: 32637 - DNA, 20 bp, Artificial Sequence
  Description of Artificial Sequence: Synthetic oligonucleotide
  Target: SCN9A; (-) strand; PAM type: NRG; PAM sequence: AAG
aaacaaacactggctgtccc

SEQ ID NO: 32638 - DNA, 20 bp, Artificial Sequence
  Description of Artificial Sequence: Synthetic oligonucleotide
  Target: SCN9A; (-) strand; PAM type: NRG; PAM sequence: TGG
caagcaagagaaacaaacac

SEQ ID NO: 32639 - DNA, 20 bp, Artificial Sequence
  Description of Artificial Sequence: Synthetic oligonucleotide
  Target: SCN9A; (-) strand; PAM type: NRG; PAM sequence: GAG
aagatattgattacaagcaa

SEQ ID NO: 32640 - DNA, 20 bp, Artificial Sequence
  Description of Artificial Sequence: Synthetic oligonucleotide
  Target: SCN9A; (-) strand; PAM type: NRG; PAM sequence: AAG
caaagatattgattacaagc

SEQ ID NO: 32641 - DNA, 20 bp, Artificial Sequence
  Description of Artificial Sequence: Synthetic oligonucleotide
  Target: SCN9A; (-) strand; PAM type: NRG; PAM sequence: AAG
taagcaaagatattgattac

SEQ ID NO: 32642 - DNA, 20 bp, Artificial Sequence
  Description of Artificial Sequence: Synthetic oligonucleotide
  Target: SCN9A; (-) strand; PAM type: NRG; PAM sequence: AAG
gtaatttctcatattaagca

SEQ ID NO: 32643 - DNA, 20 bp, Artificial Sequence
  Description of Artificial Sequence: Synthetic oligonucleotide
  Target: SCN9A; (-) strand; PAM type: NRG; PAM sequence: AAG
caaaagtaatttctcatatt

SEQ ID NO: 32644 - DNA, 20 bp, Artificial Sequence
  Description of Artificial Sequence: Synthetic oligonucleotide
  Target: SCN9A; (-) strand; PAM type: NRG; PAM sequence: AAG
gttcccacaaagtgagccaa

SEQ ID NO: 32645 - DNA, 20 bp, Artificial Sequence
  Description of Artificial Sequence: Synthetic oligonucleotide
  Target: SCN9A; (-) strand; PAM type: NRG; PAM sequence: GAG
taacctagttcccacaaagt

SEQ ID NO: 32646 - DNA, 20 bp, Artificial Sequence
  Description of Artificial Sequence: Synthetic oligonucleotide
  Target: SCN9A; (-) strand; PAM type: NRG; PAM sequence: AAG
gtcataacctagttcccaca

SEQ ID NO: 32647 - DNA, 20 bp, Artificial Sequence
  Description of Artificial Sequence: Synthetic oligonucleotide
  Target: SCN9A; (-) strand; PAM type: NRG; PAM sequence: TAG
agcttgttttggtcataacc

SEQ ID NO: 32648 - DNA, 20 bp, Artificial Sequence
  Description of Artificial Sequence: Synthetic oligonucleotide
  Target: SCN9A; (-) strand; PAM type: NRG; PAM sequence: TGG
tagccaaaaggagcttgttt

SEQ ID NO: 32649 - DNA, 20 bp, Artificial Sequence
  Description of Artificial Sequence: Synthetic oligonucleotide
  Target: SCN9A; (-) strand; PAM type: NRG; PAM sequence: GAG
aaaactgtcatagccaaaag

SEQ ID NO: 32650 - DNA, 20 bp, Artificial Sequence
  Description of Artificial Sequence: Synthetic oligonucleotide
  Target: SCN9A; (-) strand; PAM type: NRG; PAM sequence: AGG
gcaaaactgtcatagccaaa

SEQ ID NO: 32651 - DNA, 20 bp, Artificial Sequence
  Description of Artificial Sequence: Synthetic oligonucleotide
  Target: SCN9A; (-) strand; PAM type: NRG; PAM sequence: AAG
agcaaaactgtcatagccaa

SEQ ID NO: 32652 - DNA, 20 bp, Artificial Sequence
  Description of Artificial Sequence: Synthetic oligonucleotide
  Target: SCN9A; (-) strand; PAM type: NRG; PAM sequence: TAG
atcacttagcaaaactgtca

SEQ ID NO: 32653 - DNA, 20 bp, Artificial Sequence
  Description of Artificial Sequence: Synthetic oligonucleotide
  Target: SCN9A; (-) strand; PAM type: NRG; PAM sequence: TAG
gaagaaatgctttaatcact

SEQ ID NO: 32654 - DNA, 20 bp, Artificial Sequence
  Description of Artificial Sequence: Synthetic oligonucleotide
  Target: SCN9A; (-) strand; PAM type: NRG; PAM sequence: AAG
ttaattttcaagtgattcag

SEQ ID NO: 32655 - DNA, 20 bp, Artificial Sequence
  Description of Artificial Sequence: Synthetic oligonucleotide
  Target: SCN9A; (-) strand; PAM type: NRG; PAM sequence: CAG
tgattaattttcaagtgatt

SEQ ID NO: 32656 - DNA, 20 bp, Artificial Sequence
  Description of Artificial Sequence: Synthetic oligonucleotide
  Target: SCN9A; (-) strand; PAM type: NRG; PAM sequence: AAG
aggtcaagtgattaattttc

SEQ ID NO: 32657 - DNA, 20 bp, Artificial Sequence
  Description of Artificial Sequence: Synthetic oligonucleotide
  Target: SCN9A; (-) strand; PAM type: NRG; PAM sequence: AAG
aaatcactacttctgaggtc

SEQ ID NO: 32658 - DNA, 20 bp, Artificial Sequence
  Description of Artificial Sequence: Synthetic oligonucleotide
  Target: SCN9A; (-) strand; PAM type: NRG; PAM sequence: AGG
cttttaaatcactacttctg

SEQ ID NO: 32659 - DNA, 20 bp, Artificial Sequence
  Description of Artificial Sequence: Synthetic oligonucleotide
  Target: SCN9A; (-) strand; PAM type: NRG; PAM sequence: GAG
tcttttaaatcactacttct

SEQ ID NO: 32660 - DNA, 20 bp, Artificial Sequence
  Description of Artificial Sequence: Synthetic oligonucleotide
  Target: SCN9A; (-) strand; PAM type: NRG; PAM sequence: CAG
tgaaatggattctgcattta

SEQ ID NO: 32661 - DNA, 20 bp, Artificial Sequence
  Description of Artificial Sequence: Synthetic oligonucleotide
  Target: SCN9A; (-) strand; PAM type: NRG; PAM sequence: TGG
tgataggaacaatattgaaa

SEQ ID NO: 32662 - DNA, 20 bp, Artificial Sequence
  Description of Artificial Sequence: Synthetic oligonucleotide
  Target: SCN9A; (-) strand; PAM type: NRG; PAM sequence: AGG
agtataagaagtaatatgat

SEQ ID NO: 32663 - DNA, 20 bp, Artificial Sequence
  Description of Artificial Sequence: Synthetic oligonucleotide
  Target: SCN9A; (-) strand; PAM type: NRG; PAM sequence: TAG
tagtataagaagtaatatga

SEQ ID NO: 32664 - DNA, 20 bp, Artificial Sequence
  Description of Artificial Sequence: Synthetic oligonucleotide
  Target: SCN9A; (-) strand; PAM type: NRG; PAM sequence: AAG
tatctattttatagtataag

SEQ ID NO: 32665 - DNA, 20 bp, Artificial Sequence
  Description of Artificial Sequence: Synthetic oligonucleotide
  Target: SCN9A; (-) strand; PAM type: NRG; PAM sequence: AAG
tcatatctattttatagtat

SEQ ID NO: 32666 - DNA, 20 bp, Artificial Sequence
  Description of Artificial Sequence: Synthetic oligonucleotide
  Target: SCN9A; (-) strand; PAM type: NRG; PAM sequence: TAG
aaatcatcatatctatttta

SEQ ID NO: 32667 - DNA, 20 bp, Artificial Sequence
  Description of Artificial Sequence: Synthetic oligonucleotide
  Target: SCN9A; (-) strand; PAM type: NRG; PAM sequence: GAG
atattattaataaagataat

SEQ ID NO: 32668 - DNA, 20 bp, Artificial Sequence
  Description of Artificial Sequence: Synthetic oligonucleotide
  Target: SCN9A; (-) strand; PAM type: NRG; PAM sequence: AAG
ttgcagaaatattattaata

SEQ ID NO: 32669 - DNA, 20 bp, Artificial Sequence
  Description of Artificial Sequence: Synthetic oligonucleotide
  Target: SCN9A; (-) strand; PAM type: NRG; PAM sequence: CAG
gttttggactgtggatattg

SEQ ID NO: 32670 - DNA, 20 bp, Artificial Sequence
  Description of Artificial Sequence: Synthetic oligonucleotide
  Target: SCN9A; (-) strand; PAM type: NRG; PAM sequence: TGG
aaaataaaagttttggactg

SEQ ID NO: 32671 - DNA, 20 bp, Artificial Sequence
  Description of Artificial Sequence: Synthetic oligonucleotide
  Target: SCN9A; (-) strand; PAM type: NRG; PAM sequence: TGG
ttagtccaaaataaaagttt

SEQ ID NO: 32672 - DNA, 20 bp, Artificial Sequence
  Description of Artificial Sequence: Synthetic oligonucleotide
  Target: SCN9A; (-) strand; PAM type: NRG; PAM sequence: AAG
acggacttagtccaaaataa

SEQ ID NO: 32673 - DNA, 20 bp, Artificial Sequence
  Description of Artificial Sequence: Synthetic oligonucleotide
  Target: SCN9A; (-) strand; PAM type: NRG; PAM sequence: TAG
gtgaattttaaggacggact

SEQ ID NO: 32674 - DNA, 20 bp, Artificial Sequence
  Description of Artificial Sequence: Synthetic oligonucleotide
  Target: SCN9A; (-) strand; PAM type: NRG; PAM sequence: CGG
tttaaagtgaattttaagga

SEQ ID NO: 32675 - DNA, 20 bp, Artificial Sequence
  Description of Artificial Sequence: Synthetic oligonucleotide
  Target: SCN9A; (-) strand; PAM type: NRG; PAM sequence: AGG
tatatttaaagtgaatttta

SEQ ID NO: 32676 - DNA, 20 bp, Artificial Sequence
  Description of Artificial Sequence: Synthetic oligonucleotide
  Target: SCN9A; (-) strand; PAM type: NRG; PAM sequence: AAG
gtatatttaaagtgaatttt

SEQ ID NO: 32677 - DNA, 20 bp, Artificial Sequence
  Description of Artificial Sequence: Synthetic oligonucleotide
  Target: SCN9A; (-) strand; PAM type: NRG; PAM sequence: AAG
aaaagcagtgtgtatattta

SEQ ID NO: 32678 - DNA, 20 bp, Artificial Sequence
  Description of Artificial Sequence: Synthetic oligonucleotide
  Target: SCN9A; (-) strand; PAM type: NRG; PAM sequence: CAG
tagtgtagaagatataaaag

SEQ ID NO: 32679 - DNA, 20 bp, Artificial Sequence
  Description of Artificial Sequence: Synthetic oligonucleotide
  Target: SCN9A; (-) strand; PAM type: NRG; PAM sequence: AAG
taatagtgtagaagatataa

SEQ ID NO: 32680 - DNA, 20 bp, Artificial Sequence
  Description of Artificial Sequence: Synthetic oligonucleotide
  Target: SCN9A; (-) strand; PAM type: NRG; PAM sequence: AAG
aactaagaataatagtgtag

SEQ ID NO: 32681 - DNA, 20 bp, Artificial Sequence
  Description of Artificial Sequence: Synthetic oligonucleotide
  Target: SCN9A; (-) strand; PAM type: NRG; PAM sequence: TAG
aaaaactaagaataatagtg

SEQ ID NO: 32682 - DNA, 20 bp, Artificial Sequence
  Description of Artificial Sequence: Synthetic oligonucleotide
  Target: SCN9A; (-) strand; PAM type: NRG; PAM sequence: TAG
tttttaaaaactaagaataa

SEQ ID NO: 32683 - DNA, 20 bp, Artificial Sequence
  Description of Artificial Sequence: Synthetic oligonucleotide
  Target: SCN9A; (-) strand; PAM type: NRG; PAM sequence: AAG
tgatttcatttttaaaaact

SEQ ID NO: 32684 - DNA, 20 bp, Artificial Sequence
  Description of Artificial Sequence: Synthetic oligonucleotide
  Target: SCN9A; (-) strand; PAM type: NRG; PAM sequence: TGG
tgcaagattaaataatggct

SEQ ID NO: 32685 - DNA, 20 bp, Artificial Sequence
  Description of Artificial Sequence: Synthetic oligonucleotide
  Target: SCN9A; (-) strand; PAM type: NRG; PAM sequence: TGG
ggtcctgcaagattaaataa

SEQ ID NO: 32686 - DNA, 20 bp, Artificial Sequence
  Description of Artificial Sequence: Synthetic oligonucleotide
  Target: SCN9A; (-) strand; PAM type: NRG; PAM sequence: AAG
tggaaggcttatggtcctgc

SEQ ID NO: 32687 - DNA, 20 bp, Artificial Sequence
  Description of Artificial Sequence: Synthetic oligonucleotide
  Target: SCN9A; (-) strand; PAM type: NRG; PAM sequence: TGG
ggttgcttatggaaggctta

SEQ ID NO: 32688 - DNA, 20 bp, Artificial Sequence
  Description of Artificial Sequence: Synthetic oligonucleotide
  Target: SCN9A; (-) strand; PAM type: NRG; PAM sequence: AGG
atcatcaggttgcttatgga

SEQ ID NO: 32689 - DNA, 20 bp, Artificial Sequence
  Description of Artificial Sequence: Synthetic oligonucleotide
  Target: SCN9A; (-) strand; PAM type: NRG; PAM sequence: AAG
catcatcaggttgcttatgg

SEQ ID NO: 32690 - DNA, 20 bp, Artificial Sequence
  Description of Artificial Sequence: Synthetic oligonucleotide
  Target: SCN9A; (-) strand; PAM type: NRG; PAM sequence: TGG
tagcatcatcaggttgctta

SEQ ID NO: 32691 - DNA, 20 bp, Artificial Sequence
  Description of Artificial Sequence: Synthetic oligonucleotide
  Target: SCN9A; (-) strand; PAM type: NRG; PAM sequence: AGG
tgtagtaagttagcatcatc

SEQ ID NO: 32692 - DNA, 20 bp, Artificial Sequence
  Description of Artificial Sequence: Synthetic oligonucleotide
  Target: SCN9A; (-) strand; PAM type: NRG; PAM sequence: CAG
ttgtagtaagttagcatcat

SEQ ID NO: 32693 - DNA, 20 bp, Artificial Sequence
  Description of Artificial Sequence: Synthetic oligonucleotide
  Target: SCN9A; (-) strand; PAM type: NRG; PAM sequence: TAG
tttgttttattgtagtaagt

SEQ ID NO: 32694 - DNA, 20 bp, Artificial Sequence
  Description of Artificial Sequence: Synthetic oligonucleotide
  Target: SCN9A; (-) strand; PAM type: NRG; PAM sequence: AAG
aaagtttgttttattgtagt

SEQ ID NO: 32695 - DNA, 20 bp, Artificial Sequence
  Description of Artificial Sequence: Synthetic oligonucleotide
  Target: SCN9A; (-) strand; PAM type: NRG; PAM sequence: TAG
attgaaagtttgttttattg

SEQ ID NO: 32696 - DNA, 20 bp, Artificial Sequence
  Description of Artificial Sequence: Synthetic oligonucleotide
  Target: SCN9A; (-) strand; PAM type: NRG; PAM sequence: AAG
aaaatattttagagtattga

SEQ ID NO: 32697 - DNA, 20 bp, Artificial Sequence
  Description of Artificial Sequence: Synthetic oligonucleotide
  Target: SCN9A; (-) strand; PAM type: NRG; PAM sequence: GAG
tttaattttaaaatatttta

SEQ ID NO: 32698 - DNA, 20 bp, Artificial Sequence
  Description of Artificial Sequence: Synthetic oligonucleotide
  Target: SCN9A; (-) strand; PAM type: NRG; PAM sequence: TAG
aatttaattttaaaatattt

SEQ ID NO: 32699 - DNA, 20 bp, Artificial Sequence
  Description of Artificial Sequence: Synthetic oligonucleotide
  Target: SCN9A; (-) strand; PAM type: NRG; PAM sequence: AAG
ataataaaatataattttaa

SEQ ID NO: 32700 - DNA, 20 bp, Artificial Sequence
  Description of Artificial Sequence: Synthetic oligonucleotide
  Target: SCN9A; (-) strand; PAM type: NRG; PAM sequence: AGG
ggatttgccatattttcttg

SEQ ID NO: 32701 - DNA, 20 bp, Artificial Sequence
  Description of Artificial Sequence: Synthetic oligonucleotide
  Target: SCN9A; (-) strand; PAM type: NRG; PAM sequence: GAG
tggatttgccatattttctt

SEQ ID NO: 32702 - DNA, 20 bp, Artificial Sequence
  Description of Artificial Sequence: Synthetic oligonucleotide
  Target: SCN9A; (-) strand; PAM type: NRG; PAM sequence: TGG
tcttaaaataaatatattct

SEQ ID NO: 32703 - DNA, 20 bp, Artificial Sequence
  Description of Artificial Sequence: Synthetic oligonucleotide
  Target: SCN9A; (-) strand; PAM type: NRG; PAM sequence: TAG
tagaccaagataaaatatta

SEQ ID NO: 32704 - DNA, 20 bp, Artificial Sequence
  Description of Artificial Sequence: Synthetic oligonucleotide
  Target: SCN9A; (-) strand; PAM type: NRG; PAM sequence: AAG
gaggaccactggtttagacc

SEQ ID NO: 32705 - DNA, 20 bp, Artificial Sequence
  Description of Artificial Sequence: Synthetic oligonucleotide
  Target: SCN9A; (-) strand; PAM type: NRG; PAM sequence: TAG
cctgttgaggaccactggtt

SEQ ID NO: 32706 - DNA, 20 bp, Artificial Sequence
  Description of Artificial Sequence: Synthetic oligonucleotide
  Target: SCN9A; (-) strand; PAM type: NRG; PAM sequence: TGG
attatcctgttgaggaccac

SEQ ID NO: 32707 - DNA, 20 bp, Artificial Sequence
  Description of Artificial Sequence: Synthetic oligonucleotide
  Target: SCN9A; (-) strand; PAM type: NRG; PAM sequence: AGG
agggaagaattatcctgttg

SEQ ID NO: 32708 - DNA, 20 bp, Artificial Sequence
  Description of Artificial Sequence: Synthetic oligonucleotide
  Target: SCN9A; (-) strand; PAM type: NRG; PAM sequence: GAG
tagggaagaattatcctgtt

SEQ ID NO: 32709 - DNA, 20 bp, Artificial Sequence
  Description of Artificial Sequence: Synthetic oligonucleotide
  Target: SCN9A; (-) strand; PAM type: NRG; PAM sequence: AAG
aactccacctggaggtaggg

SEQ ID NO: 32710 - DNA, 20 bp, Artificial Sequence
  Description of Artificial Sequence: Synthetic oligonucleotide
  Target: SCN9A; (-) strand; PAM type: NRG; PAM sequence: GGG
ggtaactccacctggaggta

SEQ ID NO: 32711 - DNA, 20 bp, Artificial Sequence
  Description of Artificial Sequence: Synthetic oligonucleotide
  Target: SCN9A; (-) strand; PAM type: NRG; PAM sequence: AGG
tggtaactccacctggaggt

SEQ ID NO: 32712 - DNA, 20 bp, Artificial Sequence
  Description of Artificial Sequence: Synthetic oligonucleotide
  Target: SCN9A; (-) strand; PAM type: NRG; PAM sequence: TAG
ctggtaactccacctggagg

SEQ ID NO: 32713 - DNA, 20 bp, Artificial Sequence
  Description of Artificial Sequence: Synthetic oligonucleotide
  Target: SCN9A; (-) strand; PAM type: NRG; PAM sequence: AGG
actctggtaactccacctgg

SEQ ID NO: 32714 - DNA, 20 bp, Artificial Sequence
  Description of Artificial Sequence: Synthetic oligonucleotide
  Target: SCN9A; (-) strand; PAM type: NRG; PAM sequence: GAG
aactctggtaactccacctg

SEQ ID NO: 32715 - DNA, 20 bp, Artificial Sequence
  Description of Artificial Sequence: Synthetic oligonucleotide
  Target: SCN9A; (-) strand; PAM type: NRG; PAM sequence: TGG
ctaactctggtaactccacc

SEQ ID NO: 32716 - DNA, 20 bp, Artificial Sequence
  Description of Artificial Sequence: Synthetic oligonucleotide
  Target: SCN9A; (-) strand; PAM type: NRG; PAM sequence: TGG
tgtattctttttgctaactc

SEQ ID NO: 32717 - DNA, 20 bp, Artificial Sequence
  Description of Artificial Sequence: Synthetic oligonucleotide
  Target: SCN9A; (-) strand; PAM type: NRG; PAM sequence: CAG
aaaacatttccatttatggt

SEQ ID NO: 32718 - DNA, 20 bp, Artificial Sequence
  Description of Artificial Sequence: Synthetic oligonucleotide
  Target: SCN9A; (-) strand; PAM type: NRG; PAM sequence: TGG
tgtaaaaacatttccattta

SEQ ID NO: 32719 - DNA, 20 bp, Artificial Sequence
  Description of Artificial Sequence: Synthetic oligonucleotide
  Target: SCN9A; (-) strand; PAM type: NRG; PAM sequence: AAG
aattagtaaattttaagatt

SEQ ID NO: 32720 - DNA, 20 bp, Artificial Sequence
  Description of Artificial Sequence: Synthetic oligonucleotide
  Target: SCN9A; (-) strand; PAM type: NRG; PAM sequence: AAG
ataaacaattagtaaatttt

SEQ ID NO: 32721 - DNA, 20 bp, Artificial Sequence
  Description of Artificial Sequence: Synthetic oligonucleotide
  Target: SCN9A; (-) strand; PAM type: NRG; PAM sequence: TAG
atttattttagataaacaat

SEQ ID NO: 32722 - DNA, 20 bp, Artificial Sequence
  Description of Artificial Sequence: Synthetic oligonucleotide
  Target: SCN9A; (-) strand; PAM type: NRG; PAM sequence: TAG
tacatactgatcatttattt

SEQ ID NO: 32723 - DNA, 20 bp, Artificial Sequence
  Description of Artificial Sequence: Synthetic oligonucleotide
  Target: SCN9A; (-) strand; PAM type: NRG; PAM sequence: AAG
catcgaggaaattttcagaa

SEQ ID NO: 32724 - DNA, 20 bp, Artificial Sequence
  Description of Artificial Sequence: Synthetic oligonucleotide
  Target: SCN9A; (-) strand; PAM type: NRG; PAM sequence: CAG
ccaatcatcgaggaaatttt

SEQ ID NO: 32725 - DNA, 20 bp, Artificial Sequence
  Description of Artificial Sequence: Synthetic oligonucleotide
  Target: SCN9A; (-) strand; PAM type: NRG; PAM sequence: AGG
ttaatgaaagccaatcatcg

SEQ ID NO: 32726 - DNA, 20 bp, Artificial Sequence
  Description of Artificial Sequence: Synthetic oligonucleotide
  Target: SCN9A; (-) strand; PAM type: NRG; PAM sequence: GAG
gttaatgaaagccaatcatc

SEQ ID NO: 32727 - DNA, 20 bp, Artificial Sequence
  Description of Artificial Sequence: Synthetic oligonucleotide
  Target: SCN9A; (-) strand; PAM type: NRG; PAM sequence: AAG
aaacaaggagctgttaatga

SEQ ID NO: 32728 - DNA, 20 bp, Artificial Sequence
  Description of Artificial Sequence: Synthetic oligonucleotide
  Target: SCN9A; (-) strand; PAM type: NRG; PAM sequence: GAG
agtcaactctgcaaaacaag

SEQ ID NO: 32729 - DNA, 20 bp, Artificial Sequence
  Description of Artificial Sequence: Synthetic oligonucleotide
  Target: SCN9A; (-) strand; PAM type: NRG; PAM sequence: AGG
taagtcaactctgcaaaaca

SEQ ID NO: 32730 - DNA, 20 bp, Artificial Sequence
  Description of Artificial Sequence: Synthetic oligonucleotide
  Target: SCN9A; (-) strand; PAM type: NRG; PAM sequence: AAG
ataagtcaactctgcaaaac

SEQ ID NO: 32731 - DNA, 20 bp, Artificial Sequence
  Description of Artificial Sequence: Synthetic oligonucleotide
  Target: SCN9A; (-) strand; PAM type: NRG; PAM sequence: AAG
ttaactataaggaattttat

SEQ ID NO: 32732 - DNA, 20 bp, Artificial Sequence
  Description of Artificial Sequence: Synthetic oligonucleotide
  Target: SCN9A; (-) strand; PAM type: NRG; PAM sequence: AGG
gaacataggctttaactata

SEQ ID NO: 32733 - DNA, 20 bp, Artificial Sequence
  Description of Artificial Sequence: Synthetic oligonucleotide
  Target: SCN9A; (-) strand; PAM type: NRG; PAM sequence: AAG
ggaacataggctttaactat

SEQ ID NO: 32734 - DNA, 20 bp, Artificial Sequence
  Description of Artificial Sequence: Synthetic oligonucleotide
  Target: SCN9A; (-) strand; PAM type: NRG; PAM sequence: AGG
ttacattgtagggggaacat

SEQ ID NO: 32735 - DNA, 20 bp, Artificial Sequence
  Description of Artificial Sequence: Synthetic oligonucleotide
  Target: SCN9A; (-) strand; PAM type: NRG; PAM sequence: TAG
gttacattgtagggggaaca

SEQ ID NO: 32736 - DNA, 20 bp, Artificial Sequence
  Description of Artificial Sequence: Synthetic oligonucleotide
  Target: SCN9A; (-) strand; PAM type: NRG; PAM sequence: GGG
aagacatgttacattgtagg

SEQ ID NO: 32737 - DNA, 20 bp, Artificial Sequence
  Description of Artificial Sequence: Synthetic oligonucleotide
  Target: SCN9A; (-) strand; PAM type: NRG; PAM sequence: GGG
gaagacatgttacattgtag

SEQ ID NO: 32738 - DNA, 20 bp, Artificial Sequence
  Description of Artificial Sequence: Synthetic oligonucleotide
  Target: SCN9A; (-) strand; PAM type: NRG; PAM sequence: GGG
ggaagacatgttacattgta

SEQ ID NO: 32739 - DNA, 20 bp, Artificial Sequence
  Description of Artificial Sequence: Synthetic oligonucleotide
  Target: SCN9A; (-) strand; PAM type: NRG; PAM sequence: AGG
tggaagacatgttacattgt

SEQ ID NO: 32740 - DNA, 20 bp, Artificial Sequence
  Description of Artificial Sequence: Synthetic oligonucleotide
  Target: SCN9A; (-) strand; PAM type: NRG; PAM sequence: TAG
atggaagacatgttacattg

SEQ ID NO: 32741 - DNA, 20 bp, Artificial Sequence
  Description of Artificial Sequence: Synthetic oligonucleotide
  Target: SCN9A; (-) strand; PAM type: NRG; PAM sequence: AAG
tttggatgtgaccactatgg

SEQ ID NO: 32742 - DNA, 20 bp, Artificial Sequence
  Description of Artificial Sequence: Synthetic oligonucleotide
  Target: SCN9A; (-) strand; PAM type: NRG; PAM sequence: TGG
aaatttggatgtgaccacta

SEQ ID NO: 32743 - DNA, 20 bp, Artificial Sequence
  Description of Artificial Sequence: Synthetic oligonucleotide
  Target: SCN9A; (-) strand; PAM type: NRG; PAM sequence: TGG
aatggagaaaagagaaaatt

SEQ ID NO: 32744 - DNA, 20 bp, Artificial Sequence
  Description of Artificial Sequence: Synthetic oligonucleotide
  Target: SCN9A; (-) strand; PAM type: NRG; PAM sequence: GAG
tgaatgttgaatggagaaaa

SEQ ID NO: 32745 - DNA, 20 bp, Artificial Sequence
  Description of Artificial Sequence: Synthetic oligonucleotide
  Target: SCN9A; (-) strand; PAM type: NRG; PAM sequence: AAG
aatgaatgttgaatggagaa

SEQ ID NO: 32746 - DNA, 20 bp, Artificial Sequence
  Description of Artificial Sequence: Synthetic oligonucleotide
  Target: SCN9A; (-) strand; PAM type: NRG; PAM sequence: GAG
tcattaatgaatgttgaatg

SEQ ID NO: 32747 - DNA, 20 bp, Artificial Sequence
  Description of Artificial Sequence: Synthetic oligonucleotide
  Target: SCN9A; (-) strand; PAM type: NRG; PAM sequence: TGG
tctcattaatgaatgttgaa

SEQ ID NO: 32748 - DNA, 20 bp, Artificial Sequence
  Description of Artificial Sequence: Synthetic oligonucleotide
  Target: SCN9A; (-) strand; PAM type: NRG; PAM sequence: TGG
aataagctggacttataagc

SEQ ID NO: 32749 - DNA, 20 bp, Artificial Sequence
  Description of Artificial Sequence: Synthetic oligonucleotide
  Target: SCN9A; (-) strand; PAM type: NRG; PAM sequence: AAG
gttcaataagctggacttat

SEQ ID NO: 32750 - DNA, 20 bp, Artificial Sequence
  Description of Artificial Sequence: Synthetic oligonucleotide
  Target: SCN9A; (-) strand; PAM type: NRG; PAM sequence: TGG
actgaacatgttcaataagc

SEQ ID NO: 32751 - DNA, 20 bp, Artificial Sequence
  Description of Artificial Sequence: Synthetic oligonucleotide
  Target: SCN9A; (-) strand; PAM type: NRG; PAM sequence: AAG
taacactgaacatgttcaat

SEQ ID NO: 32752 - DNA, 20 bp, Artificial Sequence
  Description of Artificial Sequence: Synthetic oligonucleotide
  Target: SCN9A; (-) strand; PAM type: NRG; PAM sequence: AGG
gttcagaagtccagcttata

SEQ ID NO: 32753 - DNA, 20 bp, Artificial Sequence
  Description of Artificial Sequence: Synthetic oligonucleotide
  Target: SCN9A; (-) strand; PAM type: NRG; PAM sequence: AAG
tgttcagaagtccagcttat

SEQ ID NO: 32754 - DNA, 20 bp, Artificial Sequence
  Description of Artificial Sequence: Synthetic oligonucleotide
  Target: SCN9A; (-) strand; PAM type: NRG; PAM sequence: CAG
tcaatacatgttcagaagtc

SEQ ID NO: 32755 - DNA, 20 bp, Artificial Sequence
  Description of Artificial Sequence: Synthetic oligonucleotide
  Target: SCN9A; (-) strand; PAM type: NRG; PAM sequence: AAG
ttaagtcaatacatgttcag

SEQ ID NO: 32756 - DNA, 20 bp, Artificial Sequence
  Description of Artificial Sequence: Synthetic oligonucleotide
  Target: SCN9A; (-) strand; PAM type: NRG; PAM sequence: CAG
actttaagtcaatacatgtt

SEQ ID NO: 32757 - DNA, 20 bp, Artificial Sequence
  Description of Artificial Sequence: Synthetic oligonucleotide
  Target: SCN9A; (-) strand; PAM type: NRG; PAM sequence: AAG
taagtcccagagttaacttt

SEQ ID NO: 32758 - DNA, 20 bp, Artificial Sequence
  Description of Artificial Sequence: Synthetic oligonucleotide
  Target: SCN9A; (-) strand; PAM type: NRG; PAM sequence: GAG
tagcaaaagagtaagtccca

SEQ ID NO: 32759 - DNA, 20 bp, Artificial Sequence
  Description of Artificial Sequence: Synthetic oligonucleotide
  Target: SCN9A; (-) strand; PAM type: NRG; PAM sequence: CAG
tttagcaaaagagtaagtcc

SEQ ID NO: 32760 - DNA, 20 bp, Artificial Sequence
  Description of Artificial Sequence: Synthetic oligonucleotide
  Target: SCN9A; (-) strand; PAM type: NRG; PAM sequence: AAG
gtgttctttagcaaaagagt

SEQ ID NO: 32761 - DNA, 20 bp, Artificial Sequence
  Description of Artificial Sequence: Synthetic oligonucleotide
  Target: SCN9A; (-) strand; PAM type: NRG; PAM sequence: GAG
tattgtgttctttagcaaaa

SEQ ID NO: 32762 - DNA, 20 bp, Artificial Sequence
  Description of Artificial Sequence: Synthetic oligonucleotide
  Target: SCN9A; (-) strand; PAM type: NRG; PAM sequence: AAG
ggtattgtgttctttagcaa

SEQ ID NO: 32763 - DNA, 20 bp, Artificial Sequence
  Description of Artificial Sequence: Synthetic oligonucleotide
  Target: SCN9A; (-) strand; PAM type: NRG; PAM sequence: TAG
aaatatggtattgtgttctt

SEQ ID NO: 32764 - DNA, 20 bp, Artificial Sequence
  Description of Artificial Sequence: Synthetic oligonucleotide
  Target: SCN9A; (-) strand; PAM type: NRG; PAM sequence: TGG
acaagttatgtcatgaaata

SEQ ID NO: 32765 - DNA, 20 bp, Artificial Sequence
  Description of Artificial Sequence: Synthetic oligonucleotide
  Target: SCN9A; (-) strand; PAM type: NRG; PAM sequence: AAG
cctgaaaaataaaaaaaaac

SEQ ID NO: 32766 - DNA, 20 bp, Artificial Sequence
  Description of Artificial Sequence: Synthetic oligonucleotide
  Target: SCN9A; (-) strand; PAM type: NRG; PAM sequence: TAG
gaaaatatttttaaaagttg

SEQ ID NO: 32767 - DNA, 20 bp, Artificial Sequence
  Description of Artificial Sequence: Synthetic oligonucleotide
  Target: SCN9A; (-) strand; PAM type: NRG; PAM sequence: AAG
tcagtggaaaatatttttaa

SEQ ID NO: 32768 - DNA, 20 bp, Artificial Sequence
  Description of Artificial Sequence: Synthetic oligonucleotide
  Target: SCN9A; (-) strand; PAM type: NRG; PAM sequence: TGG
acaatgttctgttttgtcag

SEQ ID NO: 32769 - DNA, 20 bp, Artificial Sequence
  Description of Artificial Sequence: Synthetic oligonucleotide
  Target: SCN9A; (-) strand; PAM type: NRG; PAM sequence: CAG
atgacaatgttctgttttgt

SEQ ID NO: 32770 - DNA, 20 bp, Artificial Sequence
  Description of Artificial Sequence: Synthetic oligonucleotide
  Target: SCN9A; (-) strand; PAM type: NRG; PAM sequence: GGG
aattatatgcactcaaagaa

SEQ ID NO: 32771 - DNA, 20 bp, Artificial Sequence
  Description of Artificial Sequence: Synthetic oligonucleotide
  Target: SCN9A; (-) strand; PAM type: NRG; PAM sequence: AGG
aaattatatgcactcaaaga

SEQ ID NO: 32772 - DNA, 20 bp, Artificial Sequence
  Description of Artificial Sequence: Synthetic oligonucleotide
  Target: SCN9A; (-) strand; PAM type: NRG; PAM sequence: AAG
gaaattatatgcactcaaag

SEQ ID NO: 32773 - DNA, 20 bp, Artificial Sequence
  Description of Artificial Sequence: Synthetic oligonucleotide
  Target: SCN9A; (-) strand; PAM type: NRG; PAM sequence: AAG
ggagaaattatatgcactca

SEQ ID NO: 32774 - DNA, 20 bp, Artificial Sequence
  Description of Artificial Sequence: Synthetic oligonucleotide
  Target: SCN9A; (-) strand; PAM type: NRG; PAM sequence: GAG
ttgatcctttaatggaacag

SEQ ID NO: 32775 - DNA, 20 bp, Artificial Sequence
  Description of Artificial Sequence: Synthetic oligonucleotide
  Target: SCN9A; (-) strand; PAM type: NRG; PAM sequence: AGG
atttgatcctttaatggaac

SEQ ID NO: 32776 - DNA, 20 bp, Artificial Sequence
  Description of Artificial Sequence: Synthetic oligonucleotide
  Target: SCN9A; (-) strand; PAM type: NRG; PAM sequence: CAG
aatttgatcctttaatggaa

SEQ ID NO: 32777 - DNA, 20 bp, Artificial Sequence
  Description of Artificial Sequence: Synthetic oligonucleotide
  Target: SCN9A; (-) strand; PAM type: NRG; PAM sequence: TGG
tgaagaatttgatcctttaa

SEQ ID NO: 32778 - DNA, 20 bp, Artificial Sequence
  Description of Artificial Sequence: Synthetic oligonucleotide
  Target: SCN9A; (-) strand; PAM type: NRG; PAM sequence: AAG
gaaatgtattttatcccttg

SEQ ID NO: 32779 - DNA, 20 bp, Artificial Sequence
  Description of Artificial Sequence: Synthetic oligonucleotide
  Target: SCN9A; (-) strand; PAM type: NRG; PAM sequence: GAG
attatttttacatttgtcat

SEQ ID NO: 32780 - DNA, 20 bp, Artificial Sequence
  Description of Artificial Sequence: Synthetic oligonucleotide
  Target: SCN9A; (-) strand; PAM type: NRG; PAM sequence: TGG
ggaaaaagtccgtattgaag

SEQ ID NO: 32781 - DNA, 20 bp, Artificial Sequence
  Description of Artificial Sequence: Synthetic oligonucleotide
  Target: SCN9A; (-) strand; PAM type: NRG; PAM sequence: AAG
cagggaaaaagtccgtattg

SEQ ID NO: 32782 - DNA, 20 bp, Artificial Sequence
  Description of Artificial Sequence: Synthetic oligonucleotide
  Target: SCN9A; (-) strand; PAM type: NRG; PAM sequence: AAG
acaacttagggacagggaaa

SEQ ID NO: 32783 - DNA, 20 bp, Artificial Sequence
  Description of Artificial Sequence: Synthetic oligonucleotide
  Target: SCN9A; (-) strand; PAM type: NRG; PAM sequence: GGG
aacaacacaacttagggaca

SEQ ID NO: 32784 - DNA, 20 bp, Artificial Sequence
  Description of Artificial Sequence: Synthetic oligonucleotide
  Target: SCN9A; (-) strand; PAM type: NRG; PAM sequence: AGG
gaacaacacaacttagggac

SEQ ID NO: 32785 - DNA, 20 bp, Artificial Sequence
  Description of Artificial Sequence: Synthetic oligonucleotide
  Target: SCN9A; (-) strand; PAM type: NRG; PAM sequence: CAG
ggaacaacacaacttaggga

SEQ ID NO: 32786 - DNA, 20 bp, Artificial Sequence
  Description of Artificial Sequence: Synthetic oligonucleotide
  Target: SCN9A; (-) strand; PAM type: NRG; PAM sequence: GGG
aagaggaacaacacaactta

SEQ ID NO: 32787 - DNA, 20 bp, Artificial Sequence
  Description of Artificial Sequence: Synthetic oligonucleotide
  Target: SCN9A; (-) strand; PAM type: NRG; PAM sequence: AGG
taagaggaacaacacaactt

SEQ ID NO: 32788 - DNA, 20 bp, Artificial Sequence
  Description of Artificial Sequence: Synthetic oligonucleotide
  Target: SCN9A; (-) strand; PAM type: NRG; PAM sequence: TAG
ttaagaggaacaacacaact

SEQ ID NO: 32789 - DNA, 20 bp, Artificial Sequence
  Description of Artificial Sequence: Synthetic oligonucleotide
  Target: SCN9A; (-) strand; PAM type: NRG; PAM sequence: AGG
tatgccaaggctgttttaag

SEQ ID NO: 32790 - DNA, 20 bp, Artificial Sequence
  Description of Artificial Sequence: Synthetic oligonucleotide
  Target: SCN9A; (-) strand; PAM type: NRG; PAM sequence: GAG
gtatgccaaggctgttttaa

SEQ ID NO: 32791 - DNA, 20 bp, Artificial Sequence
  Description of Artificial Sequence: Synthetic oligonucleotide
  Target: SCN9A; (-) strand; PAM type: NRG; PAM sequence: AAG
ttgtatgccaaggctgtttt

SEQ ID NO: 32792 - DNA, 20 bp, Artificial Sequence
  Description of Artificial Sequence: Synthetic oligonucleotide
  Target: SCN9A; (-) strand; PAM type: NRG; PAM sequence: AGG
agtttatcccttgtatgcca

SEQ ID NO: 32793 - DNA, 20 bp, Artificial Sequence
  Description of Artificial Sequence: Synthetic oligonucleotide
  Target: SCN9A; (-) strand; PAM type: NRG; PAM sequence: AAG
aagtttatcccttgtatgcc

SEQ ID NO: 32794 - DNA, 20 bp, Artificial Sequence
  Description of Artificial Sequence: Synthetic oligonucleotide
  Target: SCN9A; (-) strand; PAM type: NRG; PAM sequence: AAG
ttaaagataaaatggatgaa

SEQ ID NO: 32795 - DNA, 20 bp, Artificial Sequence
  Description of Artificial Sequence: Synthetic oligonucleotide
  Target: SCN9A; (-) strand; PAM type: NRG; PAM sequence: TGG
tgaatgtattaaagataaaa

SEQ ID NO: 32796 - DNA, 20 bp, Artificial Sequence
  Description of Artificial Sequence: Synthetic oligonucleotide
  Target: SCN9A; (-) strand; PAM type: NRG; PAM sequence: AAG
aagagttgttgaatgtatta

SEQ ID NO: 32797 - DNA, 20 bp, Artificial Sequence
  Description of Artificial Sequence: Synthetic oligonucleotide
  Target: SCN9A; (-) strand; PAM type: NRG; PAM sequence: GAG
tgccctccattgcttacaaa

SEQ ID NO: 32798 - DNA, 20 bp, Artificial Sequence
  Description of Artificial Sequence: Synthetic oligonucleotide
  Target: SCN9A; (-) strand; PAM type: NRG; PAM sequence: AAG
gatgccctccattgcttaca

SEQ ID NO: 32799 - DNA, 20 bp, Artificial Sequence
  Description of Artificial Sequence: Synthetic oligonucleotide
  Target: SCN9A; (-) strand; PAM type: NRG; PAM sequence: GAG
gattatgcaatttgaaagaa

SEQ ID NO: 32800 - DNA, 20 bp, Artificial Sequence
  Description of Artificial Sequence: Synthetic oligonucleotide
  Target: SCN9A; (-) strand; PAM type: NRG; PAM sequence: AAG
aggattatgcaatttgaaag

SEQ ID NO: 32801 - DNA, 20 bp, Artificial Sequence
  Description of Artificial Sequence: Synthetic oligonucleotide
  Target: SCN9A; (-) strand; PAM type: NRG; PAM sequence: AAG
aataggattatgcaatttga

SEQ ID NO: 32802 - DNA, 20 bp, Artificial Sequence
  Description of Artificial Sequence: Synthetic oligonucleotide
  Target: SCN9A; (-) strand; PAM type: NRG; PAM sequence: AGG
attccatatcttttagcaat

SEQ ID NO: 32803 - DNA, 20 bp, Artificial Sequence
  Description of Artificial Sequence: Synthetic oligonucleotide
  Target: SCN9A; (-) strand; PAM type: NRG; PAM sequence: TAG
cattccatatcttttagcaa

SEQ ID NO: 32804 - DNA, 20 bp, Artificial Sequence
  Description of Artificial Sequence: Synthetic oligonucleotide
  Target: SCN9A; (-) strand; PAM type: NRG; PAM sequence: TAG
tcatagcattccatatcttt

SEQ ID NO: 32805 - DNA, 20 bp, Artificial Sequence
  Description of Artificial Sequence: Synthetic oligonucleotide
  Target: SCN9A; (-) strand; PAM type: NRG; PAM sequence: TAG
gactacttatttcttgctca

SEQ ID NO: 32806 - DNA, 20 bp, Artificial Sequence
  Description of Artificial Sequence: Synthetic oligonucleotide
  Target: SCN9A; (-) strand; PAM type: NRG; PAM sequence: AAG
ttaaaataacccattgagta

SEQ ID NO: 32807 - DNA, 20 bp, Artificial Sequence
  Description of Artificial Sequence: Synthetic oligonucleotide
  Target: SCN9A; (-) strand; PAM type: NRG; PAM sequence: GAG
gacttttaaaataacccatt

SEQ ID NO: 32808 - DNA, 20 bp, Artificial Sequence
  Description of Artificial Sequence: Synthetic oligonucleotide
  Target: SCN9A; (-) strand; PAM type: NRG; PAM sequence: AGG
atactttaattctgaagaaa

SEQ ID NO: 32809 - DNA, 20 bp, Artificial Sequence
  Description of Artificial Sequence: Synthetic oligonucleotide
  Target: SCN9A; (-) strand; PAM type: NRG; PAM sequence: AAG
catactttaattctgaagaa

SEQ ID NO: 32810 - DNA, 20 bp, Artificial Sequence
  Description of Artificial Sequence: Synthetic oligonucleotide
  Target: SCN9A; (-) strand; PAM type: NRG; PAM sequence: AAG
gaaatcatactttaattctg

SEQ ID NO: 32811 - DNA, 20 bp, Artificial Sequence
  Description of Artificial Sequence: Synthetic oligonucleotide
  Target: SCN9A; (-) strand; PAM type: NRG; PAM sequence: AAG
gagaattcttagtttattta

SEQ ID NO: 32812 - DNA, 20 bp, Artificial Sequence
  Description of Artificial Sequence: Synthetic oligonucleotide
  Target: SCN9A; (-) strand; PAM type: NRG; PAM sequence: TAG
gatgcagttgagagaattct

SEQ ID NO: 32813 - DNA, 20 bp, Artificial Sequence
  Description of Artificial Sequence: Synthetic oligonucleotide
  Target: SCN9A; (-) strand; PAM type: NRG; PAM sequence: GAG
tctttaatagatgcagttga

SEQ ID NO: 32814 - DNA, 20 bp, Artificial Sequence
  Description of Artificial Sequence: Synthetic oligonucleotide
  Target: SCN9A; (-) strand; PAM type: NRG; PAM sequence: GAG
tctctttaatagatgcagtt

SEQ ID NO: 32815 - DNA, 20 bp, Artificial Sequence
  Description of Artificial Sequence: Synthetic oligonucleotide
  Target: SCN9A; (-) strand; PAM type: NRG; PAM sequence: CAG
ctggctctctttaatagatg

SEQ ID NO: 32816 - DNA, 20 bp, Artificial Sequence
  Description of Artificial Sequence: Synthetic oligonucleotide
  Target: SCN9A; (-) strand; PAM type: NRG; PAM sequence: TAG
aattcactggctctctttaa

SEQ ID NO: 32817 - DNA, 20 bp, Artificial Sequence
  Description of Artificial Sequence: Synthetic oligonucleotide
  Target: SCN9A; (-) strand; PAM type: NRG; PAM sequence: TGG
tttcacattttaaaattcac

SEQ ID NO: 32818 - DNA, 20 bp, Artificial Sequence
  Description of Artificial Sequence: Synthetic oligonucleotide
  Target: SCN9A; (-) strand; PAM type: NRG; PAM sequence: CAG
ttgttggcattcgttatttt

SEQ ID NO: 32819 - DNA, 20 bp, Artificial Sequence
  Description of Artificial Sequence: Synthetic oligonucleotide
  Target: SCN9A; (-) strand; PAM type: NRG; PAM sequence: TGG
aagaatttttgtaattttgt

SEQ ID NO: 32820 - DNA, 20 bp, Artificial Sequence
  Description of Artificial Sequence: Synthetic oligonucleotide
  Target: SCN9A; (-) strand; PAM type: NRG; PAM sequence: AAG
ctgttcagactctactaatg

SEQ ID NO: 32821 - DNA, 20 bp, Artificial Sequence
  Description of Artificial Sequence: Synthetic oligonucleotide
  Target: SCN9A; (-) strand; PAM type: NRG; PAM sequence: CAG
atttcagcatttattctgtt

SEQ ID NO: 32822 - DNA, 20 bp, Artificial Sequence
  Description of Artificial Sequence: Synthetic oligonucleotide
  Target: SCN9A; (-) strand; PAM type: NRG; PAM sequence: CAG
gtcaagaaattattctattt

SEQ ID NO: 32823 - DNA, 20 bp, Artificial Sequence
  Description of Artificial Sequence: Synthetic oligonucleotide
  Target: SCN9A; (-) strand; PAM type: NRG; PAM sequence: AAG
ttgccagtaaagaaattgtc

SEQ ID NO: 32824 - DNA, 20 bp, Artificial Sequence
  Description of Artificial Sequence: Synthetic oligonucleotide
  Target: SCN9A; (-) strand; PAM type: NRG; PAM sequence: AAG
cagtaaagtaattgccagta

SEQ ID NO: 32825 - DNA, 20 bp, Artificial Sequence
  Description of Artificial Sequence: Synthetic oligonucleotide
  Target: SCN9A; (-) strand; PAM type: NRG; PAM sequence: CAG
gatatcagtaaagtaattgc

SEQ ID NO: 32826 - DNA, 20 bp, Artificial Sequence
  Description of Artificial Sequence: Synthetic oligonucleotide
  Target: SCN9A; (-) strand; PAM type: NRG; PAM sequence: AAG
aacagcatctgatatcagta

SEQ ID NO: 32827 - DNA, 20 bp, Artificial Sequence
  Description of Artificial Sequence: Synthetic oligonucleotide
  Target: SCN9A; (-) strand; PAM type: NRG; PAM sequence: CAG
gctcaaacagcatctgatat

SEQ ID NO: 32828 - DNA, 20 bp, Artificial Sequence
  Description of Artificial Sequence: Synthetic oligonucleotide
  Target: SCN9A; (-) strand; PAM type: NRG; PAM sequence: CAG
tctacatgacgctgctcaaa

SEQ ID NO: 32829 - DNA, 20 bp, Artificial Sequence
  Description of Artificial Sequence: Synthetic oligonucleotide
  Target: SCN9A; (-) strand; PAM type: NRG; PAM sequence: CAG
agtataaatgggactatgaa

SEQ ID NO: 32830 - DNA, 20 bp, Artificial Sequence
  Description of Artificial Sequence: Synthetic oligonucleotide
  Target: SCN9A; (-) strand; PAM type: NRG; PAM sequence: GGG
agttaaagcaaagtataaat

SEQ ID NO: 32831 - DNA, 20 bp, Artificial Sequence
  Description of Artificial Sequence: Synthetic oligonucleotide
  Target: SCN9A; (-) strand; PAM type: NRG; PAM sequence: TGG
aagttaaagcaaagtataaa

SEQ ID NO: 32832 - DNA, 20 bp, Artificial Sequence
  Description of Artificial Sequence: Synthetic oligonucleotide
  Target: SCN9A; (-) strand; PAM type: NRG; PAM sequence: AAG
atttattgaaagttaaagca

SEQ ID NO: 32833 - DNA, 20 bp, Artificial Sequence
  Description of Artificial Sequence: Synthetic oligonucleotide
  Target: SCN9A; (-) strand; PAM type: NRG; PAM sequence: AAG
gtgatatttattgaaagtta

SEQ ID NO: 32834 - DNA, 20 bp, Artificial Sequence
  Description of Artificial Sequence: Synthetic oligonucleotide
  Target: SCN9A; (-) strand; PAM type: NRG; PAM sequence: AAG
aaaggtgtgatatttattga

SEQ ID NO: 32835 - DNA, 20 bp, Artificial Sequence
  Description of Artificial Sequence: Synthetic oligonucleotide
  Target: SCN9A; (-) strand; PAM type: NRG; PAM sequence: AGG
attggtggatatttgcataa

SEQ ID NO: 32836 - DNA, 20 bp, Artificial Sequence
  Description of Artificial Sequence: Synthetic oligonucleotide
  Target: SCN9A; (-) strand; PAM type: NRG; PAM sequence: AAG
aattggtggatatttgcata

SEQ ID NO: 32837 - DNA, 20 bp, Artificial Sequence
  Description of Artificial Sequence: Synthetic oligonucleotide
  Target: SCN9A; (-) strand; PAM type: NRG; PAM sequence: TGG
gtaatacaaatataaattgg

SEQ ID NO: 32838 - DNA, 20 bp, Artificial Sequence
  Description of Artificial Sequence: Synthetic oligonucleotide
  Target: SCN9A; (-) strand; PAM type: NRG; PAM sequence: TGG
gaggtaatacaaatataaat

SEQ ID NO: 32839 - DNA, 20 bp, Artificial Sequence
  Description of Artificial Sequence: Synthetic oligonucleotide
  Target: SCN9A; (-) strand; PAM type: NRG; PAM sequence: AGG
aaattatacttattttgtgg

SEQ ID NO: 32840 - DNA, 20 bp, Artificial Sequence
  Description of Artificial Sequence: Synthetic oligonucleotide
  Target: SCN9A; (-) strand; PAM type: NRG; PAM sequence: GAG
aaaattatacttattttgtg

SEQ ID NO: 32841 - DNA, 20 bp, Artificial Sequence
  Description of Artificial Sequence: Synthetic oligonucleotide
  Target: SCN9A; (-) strand; PAM type: NRG; PAM sequence: TGG
taaaaattatacttattttg

SEQ ID NO: 32842 - DNA, 20 bp, Artificial Sequence
  Description of Artificial Sequence: Synthetic oligonucleotide
  Target: SCN9A; (-) strand; PAM type: NRG; PAM sequence: TAG
agaccctatgattgagttag

SEQ ID NO: 32843 - DNA, 20 bp, Artificial Sequence
  Description of Artificial Sequence: Synthetic oligonucleotide
  Target: SCN9A; (-) strand; PAM type: NRG; PAM sequence: TAG
cagagaccctatgattgagt

SEQ ID NO: 32844 - DNA, 20 bp, Artificial Sequence
  Description of Artificial Sequence: Synthetic oligonucleotide
  Target: SCN9A; (-) strand; PAM type: NRG; PAM sequence: GAG
gttgcagagaccctatgatt

SEQ ID NO: 32845 - DNA, 20 bp, Artificial Sequence
  Description of Artificial Sequence: Synthetic oligonucleotide
  Target: SCN9A; (-) strand; PAM type: NRG; PAM sequence: GAG
aacaacaagaaattgttgca

SEQ ID NO: 32846 - DNA, 20 bp, Artificial Sequence
  Description of Artificial Sequence: Synthetic oligonucleotide
  Target: SCN9A; (-) strand; PAM type: NRG; PAM sequence: CAG
gaaacaacaagaaattgttg

SEQ ID NO: 32847 - DNA, 20 bp, Artificial Sequence
  Description of Artificial Sequence: Synthetic oligonucleotide
  Target: SCN9A; (-) strand; PAM type: NRG; PAM sequence: AAG
gatgagtcttcagaaacaac

SEQ ID NO: 32848 - DNA, 20 bp, Artificial Sequence
  Description of Artificial Sequence: Synthetic oligonucleotide
  Target: SCN9A; (-) strand; PAM type: NRG; PAM sequence: CAG
acgccttccagatgagtctt

SEQ ID NO: 32849 - DNA, 20 bp, Artificial Sequence
  Description of Artificial Sequence: Synthetic oligonucleotide
  Target: SCN9A; (-) strand; PAM type: NRG; PAM sequence: GAG
ttgtaacacgccttccagat

SEQ ID NO: 32850 - DNA, 20 bp, Artificial Sequence
  Description of Artificial Sequence: Synthetic oligonucleotide
  Target: SCN9A; (-) strand; PAM type: NRG; PAM sequence: CAG
ggctattgtaacacgccttc

SEQ ID NO: 32851 - DNA, 20 bp, Artificial Sequence
  Description of Artificial Sequence: Synthetic oligonucleotide
  Target: SCN9A; (-) strand; PAM type: NRG; PAM sequence: AGG
cataaaaagacttgcttaca

SEQ ID NO: 32852 - DNA, 20 bp, Artificial Sequence
  Description of Artificial Sequence: Synthetic oligonucleotide
  Target: SCN9A; (-) strand; PAM type: NRG; PAM sequence: AAG
tcataaaaagacttgcttac

SEQ ID NO: 32853 - DNA, 20 bp, Artificial Sequence
  Description of Artificial Sequence: Synthetic oligonucleotide
  Target: SCN9A; (-) strand; PAM type: NRG; PAM sequence: AAG
tataataattttctcataaa

SEQ ID NO: 32854 - DNA, 20 bp, Artificial Sequence
  Description of Artificial Sequence: Synthetic oligonucleotide
  Target: SCN9A; (-) strand; PAM type: NRG; PAM sequence: GGG
tgcaagtaatcacaatttgg

SEQ ID NO: 32855 - DNA, 20 bp, Artificial Sequence
  Description of Artificial Sequence: Synthetic oligonucleotide
  Target: SCN9A; (-) strand; PAM type: NRG; PAM sequence: GGG
atgcaagtaatcacaatttg

SEQ ID NO: 32856 - DNA, 20 bp, Artificial Sequence
  Description of Artificial Sequence: Synthetic oligonucleotide
  Target: SCN9A; (-) strand; PAM type: NRG; PAM sequence: GGG
aatgcaagtaatcacaattt

SEQ ID NO: 32857 - DNA, 20 bp, Artificial Sequence
  Description of Artificial Sequence: Synthetic oligonucleotide
  Target: SCN9A; (-) strand; PAM type: NRG; PAM sequence: TGG
gaatgcaagtaatcacaatt

SEQ ID NO: 32858 - DNA, 20 bp, Artificial Sequence
  Description of Artificial Sequence: Synthetic oligonucleotide
  Target: SCN9A; (-) strand; PAM type: NRG; PAM sequence: AAG
tatggcatagccatgaatgc

SEQ ID NO: 32859 - DNA, 20 bp, Artificial Sequence
  Description of Artificial Sequence: Synthetic oligonucleotide
  Target: SCN9A; (-) strand; PAM type: NRG; PAM sequence: TAG
tgttttacttttttatggca

SEQ ID NO: 32860 - DNA, 20 bp, Artificial Sequence
  Description of Artificial Sequence: Synthetic oligonucleotide
  Target: SCN9A; (-) strand; PAM type: NRG; PAM sequence: TGG
tcaaatgttttactttttta

SEQ ID NO: 32861 - DNA, 20 bp, Artificial Sequence
  Description of Artificial Sequence: Synthetic oligonucleotide
  Target: SCN9A; (-) strand; PAM type: NRG; PAM sequence: CAG
tactgttacagagattacca

SEQ ID NO: 32862 - DNA, 20 bp, Artificial Sequence
  Description of Artificial Sequence: Synthetic oligonucleotide
  Target: SCN9A; (-) strand; PAM type: NRG; PAM sequence: GAG
taactccatttactgttaca

SEQ ID NO: 32863 - DNA, 20 bp, Artificial Sequence
  Description of Artificial Sequence: Synthetic oligonucleotide
  Target: SCN9A; (-) strand; PAM type: NRG; PAM sequence: CAG
aataactccatttactgtta

SEQ ID NO: 32864 - DNA, 20 bp, Artificial Sequence
  Description of Artificial Sequence: Synthetic oligonucleotide
  Target: SCN9A; (-) strand; PAM type: NRG; PAM sequence: TAG
tctactgccgtaataaaaat

SEQ ID NO: 32865 - DNA, 20 bp, Artificial Sequence
  Description of Artificial Sequence: Synthetic oligonucleotide
  Target: SCN9A; (-) strand; PAM type: NRG; PAM sequence: AGG
agtaaattttctagtgctat

SEQ ID NO: 32866 - DNA, 20 bp, Artificial Sequence
  Description of Artificial Sequence: Synthetic oligonucleotide
  Target: SCN9A; (-) strand; PAM type: NRG; PAM sequence: TAG
aagtaaattttctagtgcta

SEQ ID NO: 32867 - DNA, 20 bp, Artificial Sequence
  Description of Artificial Sequence: Synthetic oligonucleotide
  Target: SCN9A; (-) strand; PAM type: NRG; PAM sequence: TAG
aaaattgtaagtaaattttc

SEQ ID NO: 32868 - DNA, 20 bp, Artificial Sequence
  Description of Artificial Sequence: Synthetic oligonucleotide
  Target: SCN9A; (-) strand; PAM type: NRG; PAM sequence: AAG
attttttaatgcaaaattgt

SEQ ID NO: 32869 - DNA, 20 bp, Artificial Sequence
  Description of Artificial Sequence: Synthetic oligonucleotide
  Target: SCN9A; (-) strand; PAM type: NRG; PAM sequence: AAG
cttaatttgaattgtgctac

SEQ ID NO: 32870 - DNA, 20 bp, Artificial Sequence
  Description of Artificial Sequence: Synthetic oligonucleotide
  Target: SCN9A; (-) strand; PAM type: NRG; PAM sequence: AAG
tgtatatcatacaaggtttt

SEQ ID NO: 32871 - DNA, 20 bp, Artificial Sequence
  Description of Artificial Sequence: Synthetic oligonucleotide
  Target: SCN9A; (-) strand; PAM type: NRG; PAM sequence: AGG
tccactttgtatatcataca

SEQ ID NO: 32872 - DNA, 20 bp, Artificial Sequence
  Description of Artificial Sequence: Synthetic oligonucleotide
  Target: SCN9A; (-) strand; PAM type: NRG; PAM sequence: AAG
ttccactttgtatatcatac

SEQ ID NO: 32873 - DNA, 20 bp, Artificial Sequence
  Description of Artificial Sequence: Synthetic oligonucleotide
  Target: SCN9A; (-) strand; PAM type: NRG; PAM sequence: AAG
agataaaataattgcagcac

SEQ ID NO: 32874 - DNA, 20 bp, Artificial Sequence
  Description of Artificial Sequence: Synthetic oligonucleotide
  Target: SCN9A; (-) strand; PAM type: NRG; PAM sequence: CAG
tgaagaagataaaataattg

SEQ ID NO: 32875 - DNA, 20 bp, Artificial Sequence
  Description of Artificial Sequence: Synthetic oligonucleotide
  Target: SCN9A; (-) strand; PAM type: NRG; PAM sequence: AAG
tgaaagaaattcagatgaag

SEQ ID NO: 32876 - DNA, 20 bp, Artificial Sequence
  Description of Artificial Sequence: Synthetic oligonucleotide
  Target: SCN9A; (-) strand; PAM type: NRG; PAM sequence: AAG
tattgaaagaaattcagatg

SEQ ID NO: 32877 - DNA, 20 bp, Artificial Sequence
  Description of Artificial Sequence: Synthetic oligonucleotide
  Target: SCN9A; (-) strand; PAM type: NRG; PAM sequence: CAG
acatcttattgaaagaaatt

SEQ ID NO: 32878 - DNA, 20 bp, Artificial Sequence
  Description of Artificial Sequence: Synthetic oligonucleotide
  Target: SCN9A; (-) strand; PAM type: NRG; PAM sequence: AAG
ataaaatcacatcttattga

SEQ ID NO: 32879 - DNA, 20 bp, Artificial Sequence
  Description of Artificial Sequence: Synthetic oligonucleotide
  Target: SCN9A; (-) strand; PAM type: NRG; PAM sequence: AAG
tcctcaacttgtaccaaaga

SEQ ID NO: 32880 - DNA, 20 bp, Artificial Sequence
  Description of Artificial Sequence: Synthetic oligonucleotide
  Target: SCN9A; (-) strand; PAM type: NRG; PAM sequence: AAG
gatttcctcaacttgtacca

SEQ ID NO: 32881 - DNA, 20 bp, Artificial Sequence
  Description of Artificial Sequence: Synthetic oligonucleotide
  Target: SCN9A; (-) strand; PAM type: NRG; PAM sequence: TAG
aatactaacagctaagcaaa

SEQ ID NO: 32882 - DNA, 20 bp, Artificial Sequence
  Description of Artificial Sequence: Synthetic oligonucleotide
  Target: SCN9A; (-) strand; PAM type: NRG; PAM sequence: AAG
gccagcaaatactaacagct

SEQ ID NO: 32883 - DNA, 20 bp, Artificial Sequence
  Description of Artificial Sequence: Synthetic oligonucleotide
  Target: SCN9A; (-) strand; PAM type: NRG; PAM sequence: CAG
tgtaagccagcaaatactaa

SEQ ID NO: 32884 - DNA, 20 bp, Artificial Sequence
  Description of Artificial Sequence: Synthetic oligonucleotide
  Target: SCN9A; (-) strand; PAM type: NRG; PAM sequence: CAG
gtgaaaacttggatgtaagc

SEQ ID NO: 32885 - DNA, 20 bp, Artificial Sequence
  Description of Artificial Sequence: Synthetic oligonucleotide
  Target: SCN9A; (-) strand; PAM type: NRG; PAM sequence: AAG
aatggtgaaaacttggatgt

SEQ ID NO: 32886 - DNA, 20 bp, Artificial Sequence
  Description of Artificial Sequence: Synthetic oligonucleotide
  Target: SCN9A; (-) strand; PAM type: NRG; PAM sequence: TGG
tattgaaaatggtgaaaact

SEQ ID NO: 32887 - DNA, 20 bp, Artificial Sequence
  Description of Artificial Sequence: Synthetic oligonucleotide
  Target: SCN9A; (-) strand; PAM type: NRG; PAM sequence: TGG
tgtttagctaatattgaaaa

SEQ ID NO: 32888 - DNA, 20 bp, Artificial Sequence
  Description of Artificial Sequence: Synthetic oligonucleotide
  Target: SCN9A; (-) strand; PAM type: NRG; PAM sequence: TAG
ttgtgcagcatacaattgtt

SEQ ID NO: 32889 - DNA, 20 bp, Artificial Sequence
  Description of Artificial Sequence: Synthetic oligonucleotide
  Target: SCN9A; (-) strand; PAM type: NRG; PAM sequence: CAG
tccttttgaagctctttgtg

SEQ ID NO: 32890 - DNA, 20 bp, Artificial Sequence
  Description of Artificial Sequence: Synthetic oligonucleotide
  Target: SCN9A; (-) strand; PAM type: NRG; PAM sequence: AAG
acaaagaaaaactccttttg

SEQ ID NO: 32891 - DNA, 20 bp, Artificial Sequence
  Description of Artificial Sequence: Synthetic oligonucleotide
  Target: SCN9A; (-) strand; PAM type: NRG; PAM sequence: AAG
caatggatgtgcattaaaca

SEQ ID NO: 32892 - DNA, 20 bp, Artificial Sequence
  Description of Artificial Sequence: Synthetic oligonucleotide
  Target: SCN9A; (-) strand; PAM type: NRG; PAM sequence: TGG
gtgataaattttatgaacaa

SEQ ID NO: 32893 - DNA, 20 bp, Artificial Sequence
  Description of Artificial Sequence: Synthetic oligonucleotide
  Target: SCN9A; (-) strand; PAM type: NRG; PAM sequence: AAG
aaaaatgtcaaaatgcaagt

SEQ ID NO: 32894 - DNA, 20 bp, Artificial Sequence
  Description of Artificial Sequence: Synthetic oligonucleotide
  Target: SCN9A; (-) strand; PAM type: NRG; PAM sequence: AAG
actcaaaaatgtcaaaatgc

SEQ ID NO: 32895 - DNA, 20 bp, Artificial Sequence
  Description of Artificial Sequence: Synthetic oligonucleotide
  Target: SCN9A; (-) strand; PAM type: NRG; PAM sequence: AAG
tccattttttatttgtgtag

SEQ ID NO: 32896 - DNA, 20 bp, Artificial Sequence
  Description of Artificial Sequence: Synthetic oligonucleotide
  Target: SCN9A; (-) strand; PAM type: NRG; PAM sequence: TAG
atatccattttttatttgtg

SEQ ID NO: 32897 - DNA, 20 bp, Artificial Sequence
  Description of Artificial Sequence: Synthetic oligonucleotide
  Target: SCN9A; (-) strand; PAM type: NRG; PAM sequence: GGG
attcaatcttttcaattcct

SEQ ID NO: 32898 - DNA, 20 bp, Artificial Sequence
  Description of Artificial Sequence: Synthetic oligonucleotide
  Target: SCN9A; (-) strand; PAM type: NRG; PAM sequence: TGG
aattcaatcttttcaattcc

SEQ ID NO: 32899 - DNA, 20 bp, Artificial Sequence
  Description of Artificial Sequence: Synthetic oligonucleotide
  Target: SCN9A; (-) strand; PAM type: NRG; PAM sequence: GAG
actgacagtgacaaagctgt

SEQ ID NO: 32900 - DNA, 20 bp, Artificial Sequence
  Description of Artificial Sequence: Synthetic oligonucleotide
  Target: SCN9A; (-) strand; PAM type: NRG; PAM sequence: AAG
gtgagtgactgacagtgaca

SEQ ID NO: 32901 - DNA, 20 bp, Artificial Sequence
  Description of Artificial Sequence: Synthetic oligonucleotide
  Target: SCN9A; (-) strand; PAM type: NRG; PAM sequence: CAG
ttgtacctgtgagtgactga

SEQ ID NO: 32902 - DNA, 20 bp, Artificial Sequence
  Description of Artificial Sequence: Synthetic oligonucleotide
  Target: SCN9A; (-) strand; PAM type: NRG; PAM sequence: GAG
agttatgagtttgtacctgt

SEQ ID NO: 32903 - DNA, 20 bp, Artificial Sequence
  Description of Artificial Sequence: Synthetic oligonucleotide
  Target: SCN9A; (-) strand; PAM type: NRG; PAM sequence: GAG
tcttgtttatgtttagttat

SEQ ID NO: 32904 - DNA, 20 bp, Artificial Sequence
  Description of Artificial Sequence: Synthetic oligonucleotide
  Target: SCN9A; (-) strand; PAM type: NRG; PAM sequence: TAG
gctcaactcttgtttatgtt

SEQ ID NO: 32905 - DNA, 20 bp, Artificial Sequence
  Description of Artificial Sequence: Synthetic oligonucleotide
  Target: SCN9A; (-) strand; PAM type: NRG; PAM sequence: TGG
caagtttgcaatcctttcat

SEQ ID NO: 32906 - DNA, 20 bp, Artificial Sequence
  Description of Artificial Sequence: Synthetic oligonucleotide
  Target: SCN9A; (-) strand; PAM type: NRG; PAM sequence: AAG
tcaatttactgtaagttcac

SEQ ID NO: 32907 - DNA, 20 bp, Artificial Sequence
  Description of Artificial Sequence: Synthetic oligonucleotide
  Target: SCN9A; (-) strand; PAM type: NRG; PAM sequence: AAG
tatttagttcaatttactgt

SEQ ID NO: 32908 - DNA, 20 bp, Artificial Sequence
  Description of Artificial Sequence: Synthetic oligonucleotide
  Target: SCN9A; (-) strand; PAM type: NRG; PAM sequence: TAG
gatttttggcatccaatatt

SEQ ID NO: 32909 - DNA, 20 bp, Artificial Sequence
  Description of Artificial Sequence: Synthetic oligonucleotide
  Target: SCN9A; (-) strand; PAM type: NRG; PAM sequence: TGG
aaacagaacgtttagatttt

SEQ ID NO: 32910 - DNA, 20 bp, Artificial Sequence
  Description of Artificial Sequence: Synthetic oligonucleotide
  Target: SCN9A; (-) strand; PAM type: NRG; PAM sequence: TAG
ttgctggcaaacagaacgtt

SEQ ID NO: 32911 - DNA, 20 bp, Artificial Sequence
  Description of Artificial Sequence: Synthetic oligonucleotide
  Target: SCN9A; (-) strand; PAM type: NRG; PAM sequence: CAG
agttctctcttgctggcaaa

SEQ ID NO: 32912 - DNA, 20 bp, Artificial Sequence
  Description of Artificial Sequence: Synthetic oligonucleotide
  Target: SCN9A; (-) strand; PAM type: NRG; PAM sequence: TGG
caaatacagttctctcttgc

SEQ ID NO: 32913 - DNA, 20 bp, Artificial Sequence
  Description of Artificial Sequence: Synthetic oligonucleotide
  Target: SCN9A; (-) strand; PAM type: NRG; PAM sequence: CAG
gaacttatctctcacaaata

SEQ ID NO: 32914 - DNA, 20 bp, Artificial Sequence
  Description of Artificial Sequence: Synthetic oligonucleotide
  Target: SCN9A; (-) strand; PAM type: NRG; PAM sequence: AGG
gtcagctgtggctttgttcc

SEQ ID NO: 32915 - DNA, 20 bp, Artificial Sequence
  Description of Artificial Sequence: Synthetic oligonucleotide
  Target: SCN9A; (-) strand; PAM type: NRG; PAM sequence: CAG
tgtcagctgtggctttgttc

SEQ ID NO: 32916 - DNA, 20 bp, Artificial Sequence
  Description of Artificial Sequence: Synthetic oligonucleotide
  Target: SCN9A; (-) strand; PAM type: NRG; PAM sequence: TGG
accttatataatgtcagctg

SEQ ID NO: 32917 - DNA, 20 bp, Artificial Sequence
  Description of Artificial Sequence: Synthetic oligonucleotide
  Target: SCN9A; (-) strand; PAM type: NRG; PAM sequence: CAG
ccccaaaccttatataatgt

SEQ ID NO: 32918 - DNA, 20 bp, Artificial Sequence
  Description of Artificial Sequence: Synthetic oligonucleotide
  Target: SCN9A; (-) strand; PAM type: NRG; PAM sequence: GAG
taacacagctggaagtcctt

SEQ ID NO: 32919 - DNA, 20 bp, Artificial Sequence
  Description of Artificial Sequence: Synthetic oligonucleotide
  Target: SCN9A; (-) strand; PAM type: NRG; PAM sequence: AAG
gtccacactaacacagctgg

SEQ ID NO: 32920 - DNA, 20 bp, Artificial Sequence
  Description of Artificial Sequence: Synthetic oligonucleotide
  Target: SCN9A; (-) strand; PAM type: NRG; PAM sequence: TGG
agtgtccacactaacacagc

SEQ ID NO: 32921 - DNA, 20 bp, Artificial Sequence
  Description of Artificial Sequence: Synthetic oligonucleotide
  Target: SCN9A; (-) strand; PAM type: NRG; PAM sequence: CAG
ctccagtgtccacactaaca

SEQ ID NO: 32922 - DNA, 20 bp, Artificial Sequence
  Description of Artificial Sequence: Synthetic oligonucleotide
  Target: SCN9A; (-) strand; PAM type: NRG; PAM sequence: CAG
ggtcaacggcagtcttactc

SEQ ID NO: 32923 - DNA, 20 bp, Artificial Sequence
  Description of Artificial Sequence: Synthetic oligonucleotide
  Target: SCN9A; (-) strand; PAM type: NRG; PAM sequence: CAG
aaaatttagaaggtcaacgg

SEQ ID NO: 32924 - DNA, 20 bp, Artificial Sequence
  Description of Artificial Sequence: Synthetic oligonucleotide
  Target: SCN9A; (-) strand; PAM type: NRG; PAM sequence: CGG
tccaaaatttagaaggtcaa

SEQ ID NO: 32925 - DNA, 20 bp, Artificial Sequence
  Description of Artificial Sequence: Synthetic oligonucleotide
  Target: SCN9A; (-) strand; PAM type: NRG; PAM sequence: AGG
ccatgtttccaaaatttaga

SEQ ID NO: 32926 - DNA, 20 bp, Artificial Sequence
  Description of Artificial Sequence: Synthetic oligonucleotide
  Target: SCN9A; (-) strand; PAM type: NRG; PAM sequence: AAG
accatgtttccaaaatttag

SEQ ID NO: 32927 - DNA, 20 bp, Artificial Sequence
  Description of Artificial Sequence: Synthetic oligonucleotide
  Target: SCN9A; (-) strand; PAM type: NRG; PAM sequence: TAG
gtgaccatgtttccaaaatt

SEQ ID NO: 32928 - DNA, 20 bp, Artificial Sequence
  Description of Artificial Sequence: Synthetic oligonucleotide
  Target: SCN9A; (-) strand; PAM type: NRG; PAM sequence: TAG
aatcagtaagtgtcccactc

SEQ ID NO: 32929 - DNA, 20 bp, Artificial Sequence
  Description of Artificial Sequence: Synthetic oligonucleotide
  Target: SCN9A; (-) strand; PAM type: NRG; PAM sequence: AAG
ctagagaacagccaatcagt

SEQ ID NO: 32930 - DNA, 20 bp, Artificial Sequence
  Description of Artificial Sequence: Synthetic oligonucleotide
  Target: SCN9A; (-) strand; PAM type: NRG; PAM sequence: CAG
ggtgctagagaacagccaat

SEQ ID NO: 32931 - DNA, 20 bp, Artificial Sequence
  Description of Artificial Sequence: Synthetic oligonucleotide
  Target: SCN9A; (-) strand; PAM type: NRG; PAM sequence: CAG
gcccctatggtgctagagaa

SEQ ID NO: 32932 - DNA, 20 bp, Artificial Sequence
  Description of Artificial Sequence: Synthetic oligonucleotide
  Target: SCN9A; (-) strand; PAM type: NRG; PAM sequence: GAG
tgcctgcccctatggtgcta

SEQ ID NO: 32933 - DNA, 20 bp, Artificial Sequence
  Description of Artificial Sequence: Synthetic oligonucleotide
  Target: SCN9A; (-) strand; PAM type: NRG; PAM sequence: TAG
agtgcctgcccctatggtgc

SEQ ID NO: 32934 - DNA, 20 bp, Artificial Sequence
  Description of Artificial Sequence: Synthetic oligonucleotide
  Target: SCN9A; (-) strand; PAM type: NRG; PAM sequence: TGG
cctgtcagtgcctgccccta

SEQ ID NO: 32935 - DNA, 20 bp, Artificial Sequence
  Description of Artificial Sequence: Synthetic oligonucleotide
  Target: SCN9A; (-) strand; PAM type: NRG; PAM sequence: CAG
agtcccgaacatcaccctgt

SEQ ID NO: 32936 - DNA, 20 bp, Artificial Sequence
  Description of Artificial Sequence: Synthetic oligonucleotide
  Target: SCN9A; (-) strand; PAM type: NRG; PAM sequence: CAG
gtctgctaatgataaactcc

SEQ ID NO: 32937 - DNA, 20 bp, Artificial Sequence
  Description of Artificial Sequence: Synthetic oligonucleotide
  Target: SCN9A; (-) strand; PAM type: NRG; PAM sequence: AAG
aggccagtccaagcttttga

SEQ ID NO: 32938 - DNA, 20 bp, Artificial Sequence
  Description of Artificial Sequence: Synthetic oligonucleotide
  Target: SCN9A; (-) strand; PAM type: NRG; PAM sequence: AAG
tagcaagtgaaggccagtcc

SEQ ID NO: 32939 - DNA, 20 bp, Artificial Sequence
  Description of Artificial Sequence: Synthetic oligonucleotide
  Target: SCN9A; (-) strand; PAM type: NRG; PAM sequence: CAG
gaaagttagcaagtgaaggc

SEQ ID NO: 32940 - DNA, 20 bp, Artificial Sequence
  Description of Artificial Sequence: Synthetic oligonucleotide
  Target: SCN9A; (-) strand; PAM type: NRG; PAM sequence: AGG
ttctgaaagttagcaagtga

SEQ ID NO: 32941 - DNA, 20 bp, Artificial Sequence
  Description of Artificial Sequence: Synthetic oligonucleotide
  Target: SCN9A; (-) strand; PAM type: NRG; PAM sequence: AAG
cttctgaaagttagcaagtg

SEQ ID NO: 32942 - DNA, 20 bp, Artificial Sequence
  Description of Artificial Sequence: Synthetic oligonucleotide
  Target: SCN9A; (-) strand; PAM type: NRG; PAM sequence: AAG
ctatgcttctgaaagttagc

SEQ ID NO: 32943 - DNA, 20 bp, Artificial Sequence
  Description of Artificial Sequence: Synthetic oligonucleotide
  Target: SCN9A; (-) strand; PAM type: NRG; PAM sequence: TAG
gtaactatgcttctgaaagt

SEQ ID NO: 32944 - DNA, 20 bp, Artificial Sequence
  Description of Artificial Sequence: Synthetic oligonucleotide
  Target: SCN9A; (-) strand; PAM type: NRG; PAM sequence: AAG
tccagtaactatgcttctga

SEQ ID NO: 32945 - DNA, 20 bp, Artificial Sequence
  Description of Artificial Sequence: Synthetic oligonucleotide
  Target: SCN9A; (-) strand; PAM type: NRG; PAM sequence: CAG
agtcaataactgcctcactc

SEQ ID NO: 32946 - DNA, 20 bp, Artificial Sequence
  Description of Artificial Sequence: Synthetic oligonucleotide
  Target: SCN9A; (-) strand; PAM type: NRG; PAM sequence: CAG
ccatgtttctgaaaataaac

SEQ ID NO: 32947 - DNA, 20 bp, Artificial Sequence
  Description of Artificial Sequence: Synthetic oligonucleotide
  Target: SCN9A; (-) strand; PAM type: NRG; PAM sequence: TGG
ctgtgaaattctcattccag

SEQ ID NO: 32948 - DNA, 20 bp, Artificial Sequence
  Description of Artificial Sequence: Synthetic oligonucleotide
  Target: SCN9A; (-) strand; PAM type: NRG; PAM sequence: CAG
aatctgtgaaattctcattc

SEQ ID NO: 32949 - DNA, 20 bp, Artificial Sequence
  Description of Artificial Sequence: Synthetic oligonucleotide
  Target: SCN9A; (-) strand; PAM type: NRG; PAM sequence: CAG
agtacacaggctctgaaaat

SEQ ID NO: 32950 - DNA, 20 bp, Artificial Sequence
  Description of Artificial Sequence: Synthetic oligonucleotide
  Target: SCN9A; (-) strand; PAM type: NRG; PAM sequence: AGG
ttaactcagaatcagtacac

SEQ ID NO: 32951 - DNA, 20 bp, Artificial Sequence
  Description of Artificial Sequence: Synthetic oligonucleotide
  Target: SCN9A; (-) strand; PAM type: NRG; PAM sequence: CAG
attaactcagaatcagtaca

SEQ ID NO: 32952 - DNA, 20 bp, Artificial Sequence
  Description of Artificial Sequence: Synthetic oligonucleotide
  Target: SCN9A; (-) strand; PAM type: NRG; PAM sequence: CAG
atttatcattaactcagaat

SEQ ID NO: 32953 - DNA, 20 bp, Artificial Sequence
  Description of Artificial Sequence: Synthetic oligonucleotide
  Target: SCN9A; (-) strand; PAM type: NRG; PAM sequence: CAG
atcattatttatcattaact

SEQ ID NO: 32954 - DNA, 20 bp, Artificial Sequence
  Description of Artificial Sequence: Synthetic oligonucleotide
  Target: SCN9A; (-) strand; PAM type: NRG; PAM sequence: AGG
ccaagtttcaagttgtgaac

SEQ ID NO: 32955 - DNA, 20 bp, Artificial Sequence
  Description of Artificial Sequence: Synthetic oligonucleotide
  Target: SCN9A; (-) strand; PAM type: NRG; PAM sequence: CAG
cccaagtttcaagttgtgaa

SEQ ID NO: 32956 - DNA, 20 bp, Artificial Sequence
  Description of Artificial Sequence: Synthetic oligonucleotide
  Target: SCN9A; (-) strand; PAM type: NRG; PAM sequence: AAG
ggtctttaagcccaagtttc

SEQ ID NO: 32957 - DNA, 20 bp, Artificial Sequence
  Description of Artificial Sequence: Synthetic oligonucleotide
  Target: SCN9A; (-) strand; PAM type: NRG; PAM sequence: AAG
aaagaatggtctttaagccc

SEQ ID NO: 32958 - DNA, 20 bp, Artificial Sequence
  Description of Artificial Sequence: Synthetic oligonucleotide
  Target: SCN9A; (-) strand; PAM type: NRG; PAM sequence: AAG
aaaggaaaagaatggtcttt

SEQ ID NO: 32959 - DNA, 20 bp, Artificial Sequence
  Description of Artificial Sequence: Synthetic oligonucleotide
  Target: SCN9A; (-) strand; PAM type: NRG; PAM sequence: TGG
tattcaagaaaggaaaagaa

SEQ ID NO: 32960 - DNA, 20 bp, Artificial Sequence
  Description of Artificial Sequence: Synthetic oligonucleotide
  Target: SCN9A; (-) strand; PAM type: NRG; PAM sequence: AAG
tttcatattcaagaaaggaa

SEQ ID NO: 32961 - DNA, 20 bp, Artificial Sequence
  Description of Artificial Sequence: Synthetic oligonucleotide
  Target: SCN9A; (-) strand; PAM type: NRG; PAM sequence: AGG
ttatttttcatattcaagaa

SEQ ID NO: 32962 - DNA, 20 bp, Artificial Sequence
  Description of Artificial Sequence: Synthetic oligonucleotide
  Target: SCN9A; (-) strand; PAM type: NRG; PAM sequence: AAG
cttatttttcatattcaaga

SEQ ID NO: 32963 - DNA, 20 bp, Artificial Sequence
  Description of Artificial Sequence: Synthetic oligonucleotide
  Target: SCN9A; (-) strand; PAM type: NRG; PAM sequence: AAG
tgtgcttatttttcatattc

SEQ ID NO: 32964 - DNA, 20 bp, Artificial Sequence
  Description of Artificial Sequence: Synthetic oligonucleotide
  Target: SCN9A; (-) strand; PAM type: NRG; PAM sequence: CAG
aaaaaaactctgtacatgct

SEQ ID NO: 32965 - DNA, 20 bp, Artificial Sequence
  Description of Artificial Sequence: Synthetic oligonucleotide
  Target: SCN9A; (-) strand; PAM type: NRG; PAM sequence: AAG
attcattaggaaataatgac

SEQ ID NO: 32966 - DNA, 20 bp, Artificial Sequence
  Description of Artificial Sequence: Synthetic oligonucleotide
  Target: SCN9A; (-) strand; PAM type: NRG; PAM sequence: AGG
gttgttattctgcattcatt

SEQ ID NO: 32967 - DNA, 20 bp, Artificial Sequence
  Description of Artificial Sequence: Synthetic oligonucleotide
  Target: SCN9A; (-) strand; PAM type: NRG; PAM sequence: TAG
tgttgttattctgcattcat

SEQ ID NO: 32968 - DNA, 20 bp, Artificial Sequence
  Description of Artificial Sequence: Synthetic oligonucleotide
  Target: SCN9A; (-) strand; PAM type: NRG; PAM sequence: TAG
cgtatactttaaatcatctc

SEQ ID NO: 32969 - DNA, 20 bp, Artificial Sequence
  Description of Artificial Sequence: Synthetic oligonucleotide
  Target: SCN9A; (-) strand; PAM type: NRG; PAM sequence: TGG
ctcaagttctttacataaaa

SEQ ID NO: 32970 - DNA, 20 bp, Artificial Sequence
  Description of Artificial Sequence: Synthetic oligonucleotide
  Target: SCN9A; (-) strand; PAM type: NRG; PAM sequence: AAG
actgaaatctggagatgctc

SEQ ID NO: 32971 - DNA, 20 bp, Artificial Sequence
  Description of Artificial Sequence: Synthetic oligonucleotide
  Target: SCN9A; (-) strand; PAM type: NRG; PAM sequence: GAG
tcatgagatactgaaatctg

SEQ ID NO: 32972 - DNA, 20 bp, Artificial Sequence
  Description of Artificial Sequence: Synthetic oligonucleotide
  Target: SCN9A; (-) strand; PAM type: NRG; PAM sequence: TGG
cctcatgagatactgaaatc

SEQ ID NO: 32973 - DNA, 20 bp, Artificial Sequence
  Description of Artificial Sequence: Synthetic oligonucleotide
  Target: SCN9A; (-) strand; PAM type: NRG; PAM sequence: GAG
gattggttctaggacctcat

SEQ ID NO: 32974 - DNA, 20 bp, Artificial Sequence
  Description of Artificial Sequence: Synthetic oligonucleotide
  Target: SCN9A; (-) strand; PAM type: NRG; PAM sequence: AGG
atcagtgagggattggttct

SEQ ID NO: 32975 - DNA, 20 bp, Artificial Sequence
  Description of Artificial Sequence: Synthetic oligonucleotide
  Target: SCN9A; (-) strand; PAM type: NRG; PAM sequence: TAG
tatcagtgagggattggttc

SEQ ID NO: 32976 - DNA, 20 bp, Artificial Sequence
  Description of Artificial Sequence: Synthetic oligonucleotide
  Target: SCN9A; (-) strand; PAM type: NRG; PAM sequence: TGG
cctcagtatcagtgagggat

SEQ ID NO: 32977 - DNA, 20 bp, Artificial Sequence
  Description of Artificial Sequence: Synthetic oligonucleotide
  Target: SCN9A; (-) strand; PAM type: NRG; PAM sequence: GGG
ttgtccctcagtatcagtga

SEQ ID NO: 32978 - DNA, 20 bp, Artificial Sequence
  Description of Artificial Sequence: Synthetic oligonucleotide
  Target: SCN9A; (-) strand; PAM type: NRG; PAM sequence: AGG
attgtccctcagtatcagtg

SEQ ID NO: 32979 - DNA, 20 bp, Artificial Sequence
  Description of Artificial Sequence: Synthetic oligonucleotide
  Target: SCN9A; (-) strand; PAM type: NRG; PAM sequence: GAG
aattgtccctcagtatcagt

SEQ ID NO: 32980 - DNA, 20 bp, Artificial Sequence
  Description of Artificial Sequence: Synthetic oligonucleotide
  Target: SCN9A; (-) strand; PAM type: NRG; PAM sequence: CAG
ttacaattgtccctcagtat

SEQ ID NO: 32981 - DNA, 20 bp, Artificial Sequence
  Description of Artificial Sequence: Synthetic oligonucleotide
  Target: SCN9A; (-) strand; PAM type: NRG; PAM sequence: CAG
ttacaattacaattgtccct

SEQ ID NO: 32982 - DNA, 20 bp, Artificial Sequence
  Description of Artificial Sequence: Synthetic oligonucleotide
  Target: SCN9A; (-) strand; PAM type: NRG; PAM sequence: CAG
gggaacaccaaaagcacagg

SEQ ID NO: 32983 - DNA, 20 bp, Artificial Sequence
  Description of Artificial Sequence: Synthetic oligonucleotide
  Target: SCN9A; (-) strand; PAM type: NRG; PAM sequence: AGG
taagggaacaccaaaagcac

SEQ ID NO: 32984 - DNA, 20 bp, Artificial Sequence
  Description of Artificial Sequence: Synthetic oligonucleotide
  Target: SCN9A; (-) strand; PAM type: NRG; PAM sequence: CAG
ctaagggaacaccaaaagca

SEQ ID NO: 32985 - DNA, 20 bp, Artificial Sequence
  Description of Artificial Sequence: Synthetic oligonucleotide
  Target: SCN9A; (-) strand; PAM type: NRG; PAM sequence: AAG
tttggctaagggaacaccaa

SEQ ID NO: 32986 - DNA, 20 bp, Artificial Sequence
  Description of Artificial Sequence: Synthetic oligonucleotide
  Target: SCN9A; (-) strand; PAM type: NRG; PAM sequence: GGG
tttctagcaggtttggctaa

SEQ ID NO: 32987 - DNA, 20 bp, Artificial Sequence
  Description of Artificial Sequence: Synthetic oligonucleotide
  Target: SCN9A; (-) strand; PAM type: NRG; PAM sequence: AGG
ctttctagcaggtttggcta

SEQ ID NO: 32988 - DNA, 20 bp, Artificial Sequence
  Description of Artificial Sequence: Synthetic oligonucleotide
  Target: SCN9A; (-) strand; PAM type: NRG; PAM sequence: AAG
tctttctagcaggtttggct

SEQ ID NO: 32989 - DNA, 20 bp, Artificial Sequence
  Description of Artificial Sequence: Synthetic oligonucleotide
  Target: SCN9A; (-) strand; PAM type: NRG; PAM sequence: TGG
tatcctctttctagcaggtt

SEQ ID NO: 32990 - DNA, 20 bp, Artificial Sequence
  Description of Artificial Sequence: Synthetic oligonucleotide
  Target: SCN9A; (-) strand; PAM type: NRG; PAM sequence: AGG
atccctatcctctttctagc

SEQ ID NO: 32991 - DNA, 20 bp, Artificial Sequence
  Description of Artificial Sequence: Synthetic oligonucleotide
  Target: SCN9A; (-) strand; PAM type: NRG; PAM sequence: CAG
aatccctatcctctttctag

SEQ ID NO: 32992 - DNA, 20 bp, Artificial Sequence
  Description of Artificial Sequence: Synthetic oligonucleotide
  Target: SCN9A; (-) strand; PAM type: NRG; PAM sequence: TAG
tacaatccctatcctctttc

SEQ ID NO: 32993 - DNA, 20 bp, Artificial Sequence
  Description of Artificial Sequence: Synthetic oligonucleotide
  Target: SCN9A; (-) strand; PAM type: NRG; PAM sequence: GAG
aaatgtttacctctacaaat

SEQ ID NO: 32994 - DNA, 20 bp, Artificial Sequence
  Description of Artificial Sequence: Synthetic oligonucleotide
  Target: SCN9A; (-) strand; PAM type: NRG; PAM sequence: TAG
aatcgcttaaatgccaacat

SEQ ID NO: 32995 - DNA, 20 bp, Artificial Sequence
  Description of Artificial Sequence: Synthetic oligonucleotide
  Target: SCN9A; (-) strand; PAM type: NRG; PAM sequence: TGG
catttttctgcgacagtaat

SEQ ID NO: 32996 - DNA, 20 bp, Artificial Sequence
  Description of Artificial Sequence: Synthetic oligonucleotide
  Target: SCN9A; (-) strand; PAM type: NRG; PAM sequence: CAG
ttggagccatttttctgcga

SEQ ID NO: 32997 - DNA, 20 bp, Artificial Sequence
  Description of Artificial Sequence: Synthetic oligonucleotide
  Target: SCN9A; (-) strand; PAM type: NRG; PAM sequence: GAG
ttacaaaaatttgacagttg

SEQ ID NO: 32998 - DNA, 20 bp, Artificial Sequence
  Description of Artificial Sequence: Synthetic oligonucleotide
  Target: SCN9A; (-) strand; PAM type: NRG; PAM sequence: TGG
aattacaaaaatttgacagt

SEQ ID NO: 32999 - DNA, 20 bp, Artificial Sequence
  Description of Artificial Sequence: Synthetic oligonucleotide
  Target: SCN9A; (-) strand; PAM type: NRG; PAM sequence: CAG
aataaattacaaaaatttga

SEQ ID NO: 33000 - DNA, 20 bp, Artificial Sequence
  Description of Artificial Sequence: Synthetic oligonucleotide
  Target: SCN9A; (-) strand; PAM type: NRG; PAM sequence: TAG
agcctaaatttcctgtatct

SEQ ID NO: 33001 - DNA, 20 bp, Artificial Sequence
  Description of Artificial Sequence: Synthetic oligonucleotide
  Target: SCN9A; (-) strand; PAM type: NRG; PAM sequence: CAG
ctttattggctttgtcaaga

SEQ ID NO: 33002 - DNA, 20 bp, Artificial Sequence
  Description of Artificial Sequence: Synthetic oligonucleotide
  Target: SCN9A; (-) strand; PAM type: NRG; PAM sequence: AAG
caccctttattggctttgtc

SEQ ID NO: 33003 - DNA, 20 bp, Artificial Sequence
  Description of Artificial Sequence: Synthetic oligonucleotide
  Target: SCN9A; (-) strand; PAM type: NRG; PAM sequence: TGG
ttttgtcctgcaccctttat

SEQ ID NO: 33004 - DNA, 20 bp, Artificial Sequence
  Description of Artificial Sequence: Synthetic oligonucleotide
  Target: SCN9A; (-) strand; PAM type: NRG; PAM sequence: AGG
tctatacagtatatgaaact

SEQ ID NO: 33005 - DNA, 20 bp, Artificial Sequence
  Description of Artificial Sequence: Synthetic oligonucleotide
  Target: SCN9A; (-) strand; PAM type: NRG; PAM sequence: TAG
atctatacagtatatgaaac

SEQ ID NO: 33006 - DNA, 20 bp, Artificial Sequence
  Description of Artificial Sequence: Synthetic oligonucleotide
  Target: SCN9A; (-) strand; PAM type: NRG; PAM sequence: CAG
aggagagtccgatatctata

SEQ ID NO: 33007 - DNA, 20 bp, Artificial Sequence
  Description of Artificial Sequence: Synthetic oligonucleotide
  Target: SCN9A; (-) strand; PAM type: NRG; PAM sequence: GAG
catgttcccatgagggagga

SEQ ID NO: 33008 - DNA, 20 bp, Artificial Sequence
  Description of Artificial Sequence: Synthetic oligonucleotide
  Target: SCN9A; (-) strand; PAM type: NRG; PAM sequence: GAG
tccatgttcccatgagggag

SEQ ID NO: 33009 - DNA, 20 bp, Artificial Sequence
  Description of Artificial Sequence: Synthetic oligonucleotide
  Target: SCN9A; (-) strand; PAM type: NRG; PAM sequence: AGG
cctccatgttcccatgaggg

SEQ ID NO: 33010 - DNA, 20 bp, Artificial Sequence
  Description of Artificial Sequence: Synthetic oligonucleotide
  Target: SCN9A; (-) strand; PAM type: NRG; PAM sequence: GAG
tcctccatgttcccatgagg

SEQ ID NO: 33011 - DNA, 20 bp, Artificial Sequence
  Description of Artificial Sequence: Synthetic oligonucleotide
  Target: SCN9A; (-) strand; PAM type: NRG; PAM sequence: GGG
cttcctccatgttcccatga

SEQ ID NO: 33012 - DNA, 20 bp, Artificial Sequence
  Description of Artificial Sequence: Synthetic oligonucleotide
  Target: SCN9A; (-) strand; PAM type: NRG; PAM sequence: AGG
tcttcctccatgttcccatg

SEQ ID NO: 33013 - DNA, 20 bp, Artificial Sequence
  Description of Artificial Sequence: Synthetic oligonucleotide
  Target: SCN9A; (-) strand; PAM type: NRG; PAM sequence: GAG
ttcttcctccatgttcccat

SEQ ID NO: 33014 - DNA, 20 bp, Artificial Sequence
  Description of Artificial Sequence: Synthetic oligonucleotide
  Target: SCN9A; (-) strand; PAM type: NRG; PAM sequence: AAG
acccaccaggtgtccatagc

SEQ ID NO: 33015 - DNA, 20 bp, Artificial Sequence
  Description of Artificial Sequence: Synthetic oligonucleotide
  Target: SCN9A; (-) strand; PAM type: NRG; PAM sequence: TAG
ctctacccaccaggtgtcca

SEQ ID NO: 33016 - DNA, 20 bp, Artificial Sequence
  Description of Artificial Sequence: Synthetic oligonucleotide
  Target: SCN9A; (-) strand; PAM type: NRG; PAM sequence: AGG
ctctctgtcctctacccacc

SEQ ID NO: 33017 - DNA, 20 bp, Artificial Sequence
  Description of Artificial Sequence: Synthetic oligonucleotide
  Target: SCN9A; (-) strand; PAM type: NRG; PAM sequence: CAG
cctctctgtcctctacccac

SEQ ID NO: 33018 - DNA, 20 bp, Artificial Sequence
  Description of Artificial Sequence: Synthetic oligonucleotide
  Target: SCN9A; (-) strand; PAM type: NRG; PAM sequence: CAG
cattcctataggaactttag

SEQ ID NO: 33019 - DNA, 20 bp, Artificial Sequence
  Description of Artificial Sequence: Synthetic oligonucleotide
  Target: SCN9A; (-) strand; PAM type: NRG; PAM sequence: TAG
gggcattcctataggaactt

SEQ ID NO: 33020 - DNA, 20 bp, Artificial Sequence
  Description of Artificial Sequence: Synthetic oligonucleotide
  Target: SCN9A; (-) strand; PAM type: NRG; PAM sequence: AGG
gattttgggggcattcctat

SEQ ID NO: 33021 - DNA, 20 bp, Artificial Sequence
  Description of Artificial Sequence: Synthetic oligonucleotide
  Target: SCN9A; (-) strand; PAM type: NRG; PAM sequence: TAG
cgattttgggggcattccta

SEQ ID NO: 33022 - DNA, 20 bp, Artificial Sequence
  Description of Artificial Sequence: Synthetic oligonucleotide
  Target: SCN9A; (-) strand; PAM type: NRG; PAM sequence: GGG
ctcagcttaatcgattttgg

SEQ ID NO: 33023 - DNA, 20 bp, Artificial Sequence
  Description of Artificial Sequence: Synthetic oligonucleotide
  Target: SCN9A; (-) strand; PAM type: NRG; PAM sequence: GGG
cctcagcttaatcgattttg

SEQ ID NO: 33024 - DNA, 20 bp, Artificial Sequence
  Description of Artificial Sequence: Synthetic oligonucleotide
  Target: SCN9A; (-) strand; PAM type: NRG; PAM sequence: GGG
acctcagcttaatcgatttt

SEQ ID NO: 33025 - DNA, 20 bp, Artificial Sequence
  Description of Artificial Sequence: Synthetic oligonucleotide
  Target: SCN9A; (-) strand; PAM type: NRG; PAM sequence: TGG
aacctcagcttaatcgattt

SEQ ID NO: 33026 - DNA, 20 bp, Artificial Sequence
  Description of Artificial Sequence: Synthetic oligonucleotide
  Target: SCN9A; (-) strand; PAM type: NRG; PAM sequence: CAG
aagcataggtttctcaacct

SEQ ID NO: 33027 - DNA, 20 bp, Artificial Sequence
  Description of Artificial Sequence: Synthetic oligonucleotide
  Target: SCN9A; (-) strand; PAM type: NRG; PAM sequence: AGG
tgaaattgtggtctaagcat

SEQ ID NO: 33028 - DNA, 20 bp, Artificial Sequence
  Description of Artificial Sequence: Synthetic oligonucleotide
  Target: SCN9A; (-) strand; PAM type: NRG; PAM sequence: TAG
gtgaaattgtggtctaagca

SEQ ID NO: 33029 - DNA, 20 bp, Artificial Sequence
  Description of Artificial Sequence: Synthetic oligonucleotide
  Target: SCN9A; (-) strand; PAM type: NRG; PAM sequence: AAG
tccaggtgaaattgtggtct

SEQ ID NO: 33030 - DNA, 20 bp, Artificial Sequence
  Description of Artificial Sequence: Synthetic oligonucleotide
  Target: SCN9A; (-) strand; PAM type: NRG; PAM sequence: TGG
aaagcctccaggtgaaattg

SEQ ID NO: 33031 - DNA, 20 bp, Artificial Sequence
  Description of Artificial Sequence: Synthetic oligonucleotide
  Target: SCN9A; (-) strand; PAM type: NRG; PAM sequence: AGG
gttaaatggaaaaagcctcc

SEQ ID NO: 33032 - DNA, 20 bp, Artificial Sequence
  Description of Artificial Sequence: Synthetic oligonucleotide
  Target: SCN9A; (-) strand; PAM type: NRG; PAM sequence: CAG
tgttaaatggaaaaagcctc

SEQ ID NO: 33033 - DNA, 20 bp, Artificial Sequence
  Description of Artificial Sequence: Synthetic oligonucleotide
  Target: SCN9A; (-) strand; PAM type: NRG; PAM sequence: AAG
ctggcattgttaaatggaaa

SEQ ID NO: 33034 - DNA, 20 bp, Artificial Sequence
  Description of Artificial Sequence: Synthetic oligonucleotide
  Target: SCN9A; (-) strand; PAM type: NRG; PAM sequence: TGG
aggaccctggcattgttaaa

SEQ ID NO: 33035 - DNA, 20 bp, Artificial Sequence
  Description of Artificial Sequence: Synthetic oligonucleotide
  Target: SCN9A; (-) strand; PAM type: NRG; PAM sequence: TGG
caagtaagttctaaggaccc

SEQ ID NO: 33036 - DNA, 20 bp, Artificial Sequence
  Description of Artificial Sequence: Synthetic oligonucleotide
  Target: SCN9A; (-) strand; PAM type: NRG; PAM sequence: AGG
aaaggagcaagtaagttcta

SEQ ID NO: 33037 - DNA, 20 bp, Artificial Sequence
  Description of Artificial Sequence: Synthetic oligonucleotide
  Target: SCN9A; (-) strand; PAM type: NRG; PAM sequence: AAG
caaaggagcaagtaagttct

SEQ ID NO: 33038 - DNA, 20 bp, Artificial Sequence
  Description of Artificial Sequence: Synthetic oligonucleotide
  Target: SCN9A; (-) strand; PAM type: NRG; PAM sequence: AAG
ttagagccaaaggagcaagt

SEQ ID NO: 33039 - DNA, 20 bp, Artificial Sequence
  Description of Artificial Sequence: Synthetic oligonucleotide
  Target: SCN9A; (-) strand; PAM type: NRG; PAM sequence: AAG
gcaattagagccaaaggagc

SEQ ID NO: 33040 - DNA, 20 bp, Artificial Sequence
  Description of Artificial Sequence: Synthetic oligonucleotide
  Target: SCN9A; (-) strand; PAM type: NRG; PAM sequence: GAG
caaagcaattagagccaaag

SEQ ID NO: 33041 - DNA, 20 bp, Artificial Sequence
  Description of Artificial Sequence: Synthetic oligonucleotide
  Target: SCN9A; (-) strand; PAM type: NRG; PAM sequence: AGG
aacaaagcaattagagccaa

SEQ ID NO: 33042 - DNA, 20 bp, Artificial Sequence
  Description of Artificial Sequence: Synthetic oligonucleotide
  Target: SCN9A; (-) strand; PAM type: NRG; PAM sequence: AAG
aaacaaagcaattagagcca

SEQ ID NO: 33043 - DNA, 20 bp, Artificial Sequence
  Description of Artificial Sequence: Synthetic oligonucleotide
  Target: SCN9A; (-) strand; PAM type: NRG; PAM sequence: GAG
cagtgtaaacaaagcaatta

SEQ ID NO: 33044 - DNA, 20 bp, Artificial Sequence
  Description of Artificial Sequence: Synthetic oligonucleotide
  Target: SCN9A; (-) strand; PAM type: NRG; PAM sequence: TAG
tacagtgtaaacaaagcaat

SEQ ID NO: 33045 - DNA, 20 bp, Artificial Sequence
  Description of Artificial Sequence: Synthetic oligonucleotide
  Target: SCN9A; (-) strand; PAM type: NRG; PAM sequence: AAG
ggccgtttacagtgtaaaca

SEQ ID NO: 33046 - DNA, 20 bp, Artificial Sequence
  Description of Artificial Sequence: Synthetic oligonucleotide
  Target: SCN9A; (-) strand; PAM type: NRG; PAM sequence: CAG
ccagcctctcaggccgttta

SEQ ID NO: 33047 - DNA, 20 bp, Artificial Sequence
  Description of Artificial Sequence: Synthetic oligonucleotide
  Target: SCN9A; (-) strand; PAM type: NRG; PAM sequence: AGG
aaaaacccagccagcctctc

SEQ ID NO: 33048 - DNA, 20 bp, Artificial Sequence
  Description of Artificial Sequence: Synthetic oligonucleotide
  Target: SCN9A; (-) strand; PAM type: NRG; PAM sequence: CAG
taaaaacccagccagcctct

SEQ ID NO: 33049 - DNA, 20 bp, Artificial Sequence
  Description of Artificial Sequence: Synthetic oligonucleotide
  Target: SCN9A; (-) strand; PAM type: NRG; PAM sequence: CAG
tatagaactaaaaacccagc

SEQ ID NO: 33050 - DNA, 20 bp, Artificial Sequence
  Description of Artificial Sequence: Synthetic oligonucleotide
  Target: SCN9A; (-) strand; PAM type: NRG; PAM sequence: CAG
aagatatagaactaaaaacc

SEQ ID NO: 33051 - DNA, 20 bp, Artificial Sequence
  Description of Artificial Sequence: Synthetic oligonucleotide
  Target: SCN9A; (-) strand; PAM type: NRG; PAM sequence: TAG
agaatacctctcagaagata

SEQ ID NO: 33052 - DNA, 20 bp, Artificial Sequence
  Description of Artificial Sequence: Synthetic oligonucleotide
  Target: SCN9A; (-) strand; PAM type: NRG; PAM sequence: AAG
aagcctagaatacctctcag

SEQ ID NO: 33053 - DNA, 20 bp, Artificial Sequence
  Description of Artificial Sequence: Synthetic oligonucleotide
  Target: SCN9A; (-) strand; PAM type: NRG; PAM sequence: CAG
tggaagcctagaatacctct

SEQ ID NO: 33054 - DNA, 20 bp, Artificial Sequence
  Description of Artificial Sequence: Synthetic oligonucleotide
  Target: SCN9A; (-) strand; PAM type: NRG; PAM sequence: TAG
tggtggatatattggaagcc

SEQ ID NO: 33055 - DNA, 20 bp, Artificial Sequence
  Description of Artificial Sequence: Synthetic oligonucleotide
  Target: SCN9A; (-) strand; PAM type: NRG; PAM sequence: AAG
agccttggtggatatattgg

SEQ ID NO: 33056 - DNA, 20 bp, Artificial Sequence
  Description of Artificial Sequence: Synthetic oligonucleotide
  Target: SCN9A; (-) strand; PAM type: NRG; PAM sequence: TGG
attagccttggtggatatat

SEQ ID NO: 33057 - DNA, 20 bp, Artificial Sequence
  Description of Artificial Sequence: Synthetic oligonucleotide
  Target: SCN9A; (-) strand; PAM type: NRG; PAM sequence: TGG
cagttagtgattagccttgg

SEQ ID NO: 33058 - DNA, 20 bp, Artificial Sequence
  Description of Artificial Sequence: Synthetic oligonucleotide
  Target: SCN9A; (-) strand; PAM type: NRG; PAM sequence: TGG
aaacagttagtgattagcct

SEQ ID NO: 33059 - DNA, 20 bp, Artificial Sequence
  Description of Artificial Sequence: Synthetic oligonucleotide
  Target: SCN9A; (-) strand; PAM type: NRG; PAM sequence: TAG
aactgaaaacagttagtgat

SEQ ID NO: 33060 - DNA, 20 bp, Artificial Sequence
  Description of Artificial Sequence: Synthetic oligonucleotide
  Target: SCN9A; (-) strand; PAM type: NRG; PAM sequence: TAG
tgattacaactgaaaacagt

SEQ ID NO: 33061 - DNA, 20 bp, Artificial Sequence
  Description of Artificial Sequence: Synthetic oligonucleotide
  Target: SCN9A; (-) strand; PAM type: NRG; PAM sequence: CAG
ggaatgattacaactgaaaa

SEQ ID NO: 33062 - DNA, 20 bp, Artificial Sequence
  Description of Artificial Sequence: Synthetic oligonucleotide
  Target: SCN9A; (-) strand; PAM type: NRG; PAM sequence: TGG
gcttaatcactggatgacac

SEQ ID NO: 33063 - DNA, 20 bp, Artificial Sequence
  Description of Artificial Sequence: Synthetic oligonucleotide
  Target: SCN9A; (-) strand; PAM type: NRG; PAM sequence: TGG
aaagcttagagcttaatcac

SEQ ID NO: 33064 - DNA, 20 bp, Artificial Sequence
  Description of Artificial Sequence: Synthetic oligonucleotide
  Target: SCN9A; (-) strand; PAM type: NRG; PAM sequence: GAG
aaaaggagtaccaaagctta

SEQ ID NO: 33065 - DNA, 20 bp, Artificial Sequence
  Description of Artificial Sequence: Synthetic oligonucleotide
  Target: SCN9A; (-) strand; PAM type: NRG; PAM sequence: TAG
ataaaaggagtaccaaagct

SEQ ID NO: 33066 - DNA, 20 bp, Artificial Sequence
  Description of Artificial Sequence: Synthetic oligonucleotide
  Target: SCN9A; (-) strand; PAM type: NRG; PAM sequence: AAG
gtactataaaaggagtacca

SEQ ID NO: 33067 - DNA, 20 bp, Artificial Sequence
  Description of Artificial Sequence: Synthetic oligonucleotide
  Target: SCN9A; (-) strand; PAM type: NRG; PAM sequence: GAG
tattaagtgtactataaaag

SEQ ID NO: 33068 - DNA, 20 bp, Artificial Sequence
  Description of Artificial Sequence: Synthetic oligonucleotide
  Target: SCN9A; (-) strand; PAM type: NRG; PAM sequence: AGG
tttattaagtgtactataaa

SEQ ID NO: 33069 - DNA, 20 bp, Artificial Sequence
  Description of Artificial Sequence: Synthetic oligonucleotide
  Target: SCN9A; (-) strand; PAM type: NRG; PAM sequence: AAG
ctttattaagtgtactataa

SEQ ID NO: 33070 - DNA, 20 bp, Artificial Sequence
  Description of Artificial Sequence: Synthetic oligonucleotide
  Target: SCN9A; (-) strand; PAM type: NRG; PAM sequence: AAG
cagcacaggtatcctttatt

SEQ ID NO: 33071 - DNA, 20 bp, Artificial Sequence
  Description of Artificial Sequence: Synthetic oligonucleotide
  Target: SCN9A; (-) strand; PAM type: NRG; PAM sequence: AGG
cagggtctacaactcagcac

SEQ ID NO: 33072 - DNA, 20 bp, Artificial Sequence
  Description of Artificial Sequence: Synthetic oligonucleotide
  Target: SCN9A; (-) strand; PAM type: NRG; PAM sequence: CAG
ccagggtctacaactcagca

SEQ ID NO: 33073 - DNA, 20 bp, Artificial Sequence
  Description of Artificial Sequence: Synthetic oligonucleotide
  Target: SCN9A; (-) strand; PAM type: NRG; PAM sequence: CAG
aatgcccagggtctacaact

SEQ ID NO: 33074 - DNA, 20 bp, Artificial Sequence
  Description of Artificial Sequence: Synthetic oligonucleotide
  Target: SCN9A; (-) strand; PAM type: NRG; PAM sequence: GGG
tgagttagtgtcaatgccca

SEQ ID NO: 33075 - DNA, 20 bp, Artificial Sequence
  Description of Artificial Sequence: Synthetic oligonucleotide
  Target: SCN9A; (-) strand; PAM type: NRG; PAM sequence: AGG
atgagttagtgtcaatgccc

SEQ ID NO: 33076 - DNA, 20 bp, Artificial Sequence
  Description of Artificial Sequence: Synthetic oligonucleotide
  Target: SCN9A; (-) strand; PAM type: NRG; PAM sequence: CAG
aatgagttagtgtcaatgcc

SEQ ID NO: 33077 - DNA, 20 bp, Artificial Sequence
  Description of Artificial Sequence: Synthetic oligonucleotide
  Target: SCN9A; (-) strand; PAM type: NRG; PAM sequence: TAG
gtcaatattttccaatgagt

SEQ ID NO: 33078 - DNA, 20 bp, Artificial Sequence
  Description of Artificial Sequence: Synthetic oligonucleotide
  Target: SCN9A; (-) strand; PAM type: NRG; PAM sequence: GAG
atcagtcaatattttccaat

SEQ ID NO: 33079 - DNA, 20 bp, Artificial Sequence
  Description of Artificial Sequence: Synthetic oligonucleotide
  Target: SCN9A; (-) strand; PAM type: NRG; PAM sequence: CAG
ttaaaaataatgaaaataat

SEQ ID NO: 33080 - DNA, 20 bp, Artificial Sequence
  Description of Artificial Sequence: Synthetic oligonucleotide
  Target: SCN9A; (-) strand; PAM type: NRG; PAM sequence: TAG
cactttctttgttaaggaaa

SEQ ID NO: 33081 - DNA, 20 bp, Artificial Sequence
  Description of Artificial Sequence: Synthetic oligonucleotide
  Target: SCN9A; (-) strand; PAM type: NRG; PAM sequence: AGG
tctctccactttctttgtta

SEQ ID NO: 33082 - DNA, 20 bp, Artificial Sequence
  Description of Artificial Sequence: Synthetic oligonucleotide
  Target: SCN9A; (-) strand; PAM type: NRG; PAM sequence: AAG
ttctctccactttctttgtt

SEQ ID NO: 33083 - DNA, 20 bp, Artificial Sequence
  Description of Artificial Sequence: Synthetic oligonucleotide
  Target: SCN9A; (-) strand; PAM type: NRG; PAM sequence: TGG
atcatacatctaccttcctc

SEQ ID NO: 33084 - DNA, 20 bp, Artificial Sequence
  Description of Artificial Sequence: Synthetic oligonucleotide
  Target: SCN9A; (-) strand; PAM type: NRG; PAM sequence: TGG
aaagtgagttttacaaaata

SEQ ID NO: 33085 - DNA, 20 bp, Artificial Sequence
  Description of Artificial Sequence: Synthetic oligonucleotide
  Target: SCN9A; (-) strand; PAM type: NRG; PAM sequence: GAG
ctctagactatgtgaaaagt

SEQ ID NO: 33086 - DNA, 20 bp, Artificial Sequence
  Description of Artificial Sequence: Synthetic oligonucleotide
  Target: SCN9A; (-) strand; PAM type: NRG; PAM sequence: AAG
taccctctagactatgtgaa

SEQ ID NO: 33087 - DNA, 20 bp, Artificial Sequence
  Description of Artificial Sequence: Synthetic oligonucleotide
  Target: SCN9A; (-) strand; PAM type: NRG; PAM sequence: TAG
tctgctgtaaatttaccctc

SEQ ID NO: 33088 - DNA, 20 bp, Artificial Sequence
  Description of Artificial Sequence: Synthetic oligonucleotide
  Target: SCN9A; (-) strand; PAM type: NRG; PAM sequence: TGG
tcatatcagttttattcact

SEQ ID NO: 33089 - DNA, 20 bp, Artificial Sequence
  Description of Artificial Sequence: Synthetic oligonucleotide
  Target: SCN9A; (-) strand; PAM type: NRG; PAM sequence: CAG
catacccccaccaatcatat

SEQ ID NO: 33090 - DNA, 20 bp, Artificial Sequence
  Description of Artificial Sequence: Synthetic oligonucleotide
  Target: SCN9A; (-) strand; PAM type: NRG; PAM sequence: CAG
ccgagttcaactgccatttc

SEQ ID NO: 33091 - DNA, 20 bp, Artificial Sequence
  Description of Artificial Sequence: Synthetic oligonucleotide
  Target: SCN9A; (-) strand; PAM type: NRG; PAM sequence: GAG
catctcacttctggaatccc

SEQ ID NO: 33092 - DNA, 20 bp, Artificial Sequence
  Description of Artificial Sequence: Synthetic oligonucleotide
  Target: SCN9A; (-) strand; PAM type: NRG; PAM sequence: TGG
ttggatgctcatctcacttc

SEQ ID NO: 33093 - DNA, 20 bp, Artificial Sequence
  Description of Artificial Sequence: Synthetic oligonucleotide
  Target: SCN9A; (-) strand; PAM type: NRG; PAM sequence: TGG
cagatacctgaaagtaatct

SEQ ID NO: 33094 - DNA, 20 bp, Artificial Sequence
  Description of Artificial Sequence: Synthetic oligonucleotide
  Target: SCN9A; (-) strand; PAM type: NRG; PAM sequence: AAG
aggccaagtcagatacctga

SEQ ID NO: 33095 - DNA, 20 bp, Artificial Sequence
  Description of Artificial Sequence: Synthetic oligonucleotide
  Target: SCN9A; (-) strand; PAM type: NRG; PAM sequence: CAG
attaacttggcaggccaagt

SEQ ID NO: 33096 - DNA, 20 bp, Artificial Sequence
  Description of Artificial Sequence: Synthetic oligonucleotide
  Target: SCN9A; (-) strand; PAM type: NRG; PAM sequence: AAG
gagtattaacttggcaggcc

SEQ ID NO: 33097 - DNA, 20 bp, Artificial Sequence
  Description of Artificial Sequence: Synthetic oligonucleotide
  Target: SCN9A; (-) strand; PAM type: NRG; PAM sequence: AGG
cactggagtattaacttggc

SEQ ID NO: 33098 - DNA, 20 bp, Artificial Sequence
  Description of Artificial Sequence: Synthetic oligonucleotide
  Target: SCN9A; (-) strand; PAM type: NRG; PAM sequence: CAG
tcactggagtattaacttgg

SEQ ID NO: 33099 - DNA, 20 bp, Artificial Sequence
  Description of Artificial Sequence: Synthetic oligonucleotide
  Target: SCN9A; (-) strand; PAM type: NRG; PAM sequence: TGG
aaatcactggagtattaact

SEQ ID NO: 33100 - DNA, 20 bp, Artificial Sequence
  Description of Artificial Sequence: Synthetic oligonucleotide
  Target: SCN9A; (-) strand; PAM type: NRG; PAM sequence: GAG
cctctcataagaaatcactg

SEQ ID NO: 33101 - DNA, 20 bp, Artificial Sequence
  Description of Artificial Sequence: Synthetic oligonucleotide
  Target: SCN9A; (-) strand; PAM type: NRG; PAM sequence: TGG
ttcctctcataagaaatcac

SEQ ID NO: 33102 - DNA, 20 bp, Artificial Sequence
  Description of Artificial Sequence: Synthetic oligonucleotide
  Target: SCN9A; (-) strand; PAM type: NRG; PAM sequence: AAG
tcctcctagtttcctctcat

SEQ ID NO: 33103 - DNA, 20 bp, Artificial Sequence
  Description of Artificial Sequence: Synthetic oligonucleotide
  Target: SCN9A; (-) strand; PAM type: NRG; PAM sequence: TAG
ttctttaagcctcatcctcc

SEQ ID NO: 33104 - DNA, 20 bp, Artificial Sequence
  Description of Artificial Sequence: Synthetic oligonucleotide
  Target: SCN9A; (-) strand; PAM type: NRG; PAM sequence: AAG
atttttcttccctgttcttt

SEQ ID NO: 33105 - DNA, 20 bp, Artificial Sequence
  Description of Artificial Sequence: Synthetic oligonucleotide
  Target: SCN9A; (-) strand; PAM type: NRG; PAM sequence: TGG
aaacacaggatgtccaaaat

SEQ ID NO: 33106 - DNA, 20 bp, Artificial Sequence
  Description of Artificial Sequence: Synthetic oligonucleotide
  Target: SCN9A; (-) strand; PAM type: NRG; PAM sequence: AGG
ctcccaggcatctcaaacac

SEQ ID NO: 33107 - DNA, 20 bp, Artificial Sequence
  Description of Artificial Sequence: Synthetic oligonucleotide
  Target: SCN9A; (-) strand; PAM type: NRG; PAM sequence: CAG
tctcccaggcatctcaaaca

SEQ ID NO: 33108 - DNA, 20 bp, Artificial Sequence
  Description of Artificial Sequence: Synthetic oligonucleotide
  Target: SCN9A; (-) strand; PAM type: NRG; PAM sequence: AGG
ctgtctactttgtgtctccc

SEQ ID NO: 33109 - DNA, 20 bp, Artificial Sequence
  Description of Artificial Sequence: Synthetic oligonucleotide
  Target: SCN9A; (-) strand; PAM type: NRG; PAM sequence: CAG
cctgtctactttgtgtctcc

SEQ ID NO: 33110 - DNA, 20 bp, Artificial Sequence
  Description of Artificial Sequence: Synthetic oligonucleotide
  Target: SCN9A; (-) strand; PAM type: NRG; PAM sequence: TGG
taacatggttagctacttat

SEQ ID NO: 33111 - DNA, 20 bp, Artificial Sequence
  Description of Artificial Sequence: Synthetic oligonucleotide
  Target: SCN9A; (-) strand; PAM type: NRG; PAM sequence: TAG
aagttccagagtaacatggt

SEQ ID NO: 33112 - DNA, 20 bp, Artificial Sequence
  Description of Artificial Sequence: Synthetic oligonucleotide
  Target: SCN9A; (-) strand; PAM type: NRG; PAM sequence: TGG
ttttaagttccagagtaaca

SEQ ID NO: 33113 - DNA, 20 bp, Artificial Sequence
  Description of Artificial Sequence: Synthetic oligonucleotide
  Target: SCN9A; (-) strand; PAM type: NRG; PAM sequence: GAG
gcctcccattttaagttcca

SEQ ID NO: 33114 - DNA, 20 bp, Artificial Sequence
  Description of Artificial Sequence: Synthetic oligonucleotide
  Target: SCN9A; (-) strand; PAM type: NRG; PAM sequence: CAG
cagcctcccattttaagttc

SEQ ID NO: 33115 - DNA, 20 bp, Artificial Sequence
  Description of Artificial Sequence: Synthetic oligonucleotide
  Target: SCN9A; (-) strand; PAM type: NRG; PAM sequence: AAG
ccaacccagcctcccatttt

SEQ ID NO: 33116 - DNA, 20 bp, Artificial Sequence
  Description of Artificial Sequence: Synthetic oligonucleotide
  Target: SCN9A; (-) strand; PAM type: NRG; PAM sequence: CAG
caaagttactatttccaacc

SEQ ID NO: 33117 - DNA, 20 bp, Artificial Sequence
  Description of Artificial Sequence: Synthetic oligonucleotide
  Target: SCN9A; (-) strand; PAM type: NRG; PAM sequence: AAG
tttatatgctggtgtctcca

SEQ ID NO: 33118 - DNA, 20 bp, Artificial Sequence
  Description of Artificial Sequence: Synthetic oligonucleotide
  Target: SCN9A; (-) strand; PAM type: NRG; PAM sequence: TGG
tcaaaatactctttatatgc

SEQ ID NO: 33119 - DNA, 20 bp, Artificial Sequence
  Description of Artificial Sequence: Synthetic oligonucleotide
  Target: SCN9A; (-) strand; PAM type: NRG; PAM sequence: GGG
ttgggactaggaatattcct

SEQ ID NO: 33120 - DNA, 20 bp, Artificial Sequence
  Description of Artificial Sequence: Synthetic oligonucleotide
  Target: SCN9A; (-) strand; PAM type: NRG; PAM sequence: TGG
cttgggactaggaatattcc

SEQ ID NO: 33121 - DNA, 20 bp, Artificial Sequence
  Description of Artificial Sequence: Synthetic oligonucleotide
  Target: SCN9A; (-) strand; PAM type: NRG; PAM sequence: AGG
accattagcctcttgggact

SEQ ID NO: 33122 - DNA, 20 bp, Artificial Sequence
  Description of Artificial Sequence: Synthetic oligonucleotide
  Target: SCN9A; (-) strand; PAM type: NRG; PAM sequence: TAG
aaccattagcctcttgggac

SEQ ID NO: 33123 - DNA, 20 bp, Artificial Sequence
  Description of Artificial Sequence: Synthetic oligonucleotide
  Target: SCN9A; (-) strand; PAM type: NRG; PAM sequence: GGG
ttaaaaaccattagcctctt

SEQ ID NO: 33124 - DNA, 20 bp, Artificial Sequence
  Description of Artificial Sequence: Synthetic oligonucleotide
  Target: SCN9A; (-) strand; PAM type: NRG; PAM sequence: TGG
cttaaaaaccattagcctct

SEQ ID NO: 33125 - DNA, 20 bp, Artificial Sequence
  Description of Artificial Sequence: Synthetic oligonucleotide
  Target: SCN9A; (-) strand; PAM type: NRG; PAM sequence: TAG
acgtctttcttaaaaaccat

SEQ ID NO: 33126 - DNA, 20 bp, Artificial Sequence
  Description of Artificial Sequence: Synthetic oligonucleotide
  Target: SCN9A; (-) strand; PAM type: NRG; PAM sequence: AAG
cttttaaaatacttccattc

SEQ ID NO: 33127 - DNA, 20 bp, Artificial Sequence
  Description of Artificial Sequence: Synthetic oligonucleotide
  Target: SCN9A; (-) strand; PAM type: NRG; PAM sequence: AGG
tctaaccccttgtgtttcca

SEQ ID NO: 33128 - DNA, 20 bp, Artificial Sequence
  Description of Artificial Sequence: Synthetic oligonucleotide
  Target: SCN9A; (-) strand; PAM type: NRG; PAM sequence: AAG
ttctaaccccttgtgtttcc

SEQ ID NO: 33129 - DNA, 20 bp, Artificial Sequence
  Description of Artificial Sequence: Synthetic oligonucleotide
  Target: SCN9A; (-) strand; PAM type: NRG; PAM sequence: CAG
actttccttctttcctatac

SEQ ID NO: 33130 - DNA, 20 bp, Artificial Sequence
  Description of Artificial Sequence: Synthetic oligonucleotide
  Target: SCN9A; (-) strand; PAM type: NRG; PAM sequence: TAG
ggcttgcacttttcagcctt

SEQ ID NO: 33131 - DNA, 20 bp, Artificial Sequence
  Description of Artificial Sequence: Synthetic oligonucleotide
  Target: SCN9A; (-) strand; PAM type: NRG; PAM sequence: CAG
gtagcctggcttgcactttt

SEQ ID NO: 33132 - DNA, 20 bp, Artificial Sequence
  Description of Artificial Sequence: Synthetic oligonucleotide
  Target: SCN9A; (-) strand; PAM type: NRG; PAM sequence: TGG
ggattaaaaagaaggtagcc

SEQ ID NO: 33133 - DNA, 20 bp, Artificial Sequence
  Description of Artificial Sequence: Synthetic oligonucleotide
  Target: SCN9A; (-) strand; PAM type: NRG; PAM sequence: TAG
agtctggattaaaaagaagg

SEQ ID NO: 33134 - DNA, 20 bp, Artificial Sequence
  Description of Artificial Sequence: Synthetic oligonucleotide
  Target: SCN9A; (-) strand; PAM type: NRG; PAM sequence: AGG
tggagtctggattaaaaaga

SEQ ID NO: 33135 - DNA, 20 bp, Artificial Sequence
  Description of Artificial Sequence: Synthetic oligonucleotide
  Target: SCN9A; (-) strand; PAM type: NRG; PAM sequence: AAG
ttggagtctggattaaaaag

SEQ ID NO: 33136 - DNA, 20 bp, Artificial Sequence
  Description of Artificial Sequence: Synthetic oligonucleotide
  Target: SCN9A; (-) strand; PAM type: NRG; PAM sequence: AAG
gtgttggagtctggattaaa

SEQ ID NO: 33137 - DNA, 20 bp, Artificial Sequence
  Description of Artificial Sequence: Synthetic oligonucleotide
  Target: SCN9A; (-) strand; PAM type: NRG; PAM sequence: TGG
agcttttcagtgttggagtc

SEQ ID NO: 33138 - DNA, 20 bp, Artificial Sequence
  Description of Artificial Sequence: Synthetic oligonucleotide
  Target: SCN9A; (-) strand; PAM type: NRG; PAM sequence: GAG
gacctagcttttcagtgttg

SEQ ID NO: 33139 - DNA, 20 bp, Artificial Sequence
  Description of Artificial Sequence: Synthetic oligonucleotide
  Target: SCN9A; (-) strand; PAM type: NRG; PAM sequence: TGG
gtgacctagcttttcagtgt

SEQ ID NO: 33140 - DNA, 20 bp, Artificial Sequence
  Description of Artificial Sequence: Synthetic oligonucleotide
  Target: SCN9A; (-) strand; PAM type: NRG; PAM sequence: CAG
actaaggtgacctagctttt

SEQ ID NO: 33141 - DNA, 20 bp, Artificial Sequence
  Description of Artificial Sequence: Synthetic oligonucleotide
  Target: SCN9A; (-) strand; PAM type: NRG; PAM sequence: TAG
gtaacttaactaaggtgacc

SEQ ID NO: 33142 - DNA, 20 bp, Artificial Sequence
  Description of Artificial Sequence: Synthetic oligonucleotide
  Target: SCN9A; (-) strand; PAM type: NRG; PAM sequence: AGG
acagttaagtaacttaacta

SEQ ID NO: 33143 - DNA, 20 bp, Artificial Sequence
  Description of Artificial Sequence: Synthetic oligonucleotide
  Target: SCN9A; (-) strand; PAM type: NRG; PAM sequence: AAG
cacagttaagtaacttaact

SEQ ID NO: 33144 - DNA, 20 bp, Artificial Sequence
  Description of Artificial Sequence: Synthetic oligonucleotide
  Target: SCN9A; (-) strand; PAM type: NRG; PAM sequence: AAG
gtaaactgagatacacagtt

SEQ ID NO: 33145 - DNA, 20 bp, Artificial Sequence
  Description of Artificial Sequence: Synthetic oligonucleotide
  Target: SCN9A; (-) strand; PAM type: NRG; PAM sequence: CAG
gatgagtaaactgagataca

SEQ ID NO: 33146 - DNA, 20 bp, Artificial Sequence
  Description of Artificial Sequence: Synthetic oligonucleotide
  Target: SCN9A; (-) strand; PAM type: NRG; PAM sequence: GAG
attttaccgatgagtaaact

SEQ ID NO: 33147 - DNA, 20 bp, Artificial Sequence
  Description of Artificial Sequence: Synthetic oligonucleotide
  Target: SCN9A; (-) strand; PAM type: NRG; PAM sequence: GAG
ttcatactcattttaccgat

SEQ ID NO: 33148 - DNA, 20 bp, Artificial Sequence
  Description of Artificial Sequence: Synthetic oligonucleotide
  Target: SCN9A; (-) strand; PAM type: NRG; PAM sequence: GAG
ttggttcaagtatgattcta

SEQ ID NO: 33149 - DNA, 20 bp, Artificial Sequence
  Description of Artificial Sequence: Synthetic oligonucleotide
  Target: SCN9A; (-) strand; PAM type: NRG; PAM sequence: TAG
tattggttcaagtatgattc

SEQ ID NO: 33150 - DNA, 20 bp, Artificial Sequence
  Description of Artificial Sequence: Synthetic oligonucleotide
  Target: SCN9A; (-) strand; PAM type: NRG; PAM sequence: AAG
tattgagttcttattggttc

SEQ ID NO: 33151 - DNA, 20 bp, Artificial Sequence
  Description of Artificial Sequence: Synthetic oligonucleotide
  Target: SCN9A; (-) strand; PAM type: NRG; PAM sequence: TGG
ggtatgtattgagttcttat

SEQ ID NO: 33152 - DNA, 20 bp, Artificial Sequence
  Description of Artificial Sequence: Synthetic oligonucleotide
  Target: SCN9A; (-) strand; PAM type: NRG; PAM sequence: GAG
caataatagaggtatgtatt

SEQ ID NO: 33153 - DNA, 20 bp, Artificial Sequence
  Description of Artificial Sequence: Synthetic oligonucleotide
  Target: SCN9A; (-) strand; PAM type: NRG; PAM sequence: AGG
aatgataataacaataatag

SEQ ID NO: 33154 - DNA, 20 bp, Artificial Sequence
  Description of Artificial Sequence: Synthetic oligonucleotide
  Target: SCN9A; (-) strand; PAM type: NRG; PAM sequence: GAG
taatgataataacaataata

SEQ ID NO: 33155 - DNA, 20 bp, Artificial Sequence
  Description of Artificial Sequence: Synthetic oligonucleotide
  Target: SCN9A; (-) strand; PAM type: NRG; PAM sequence: TAG
aataatgataataacaataa

SEQ ID NO: 33156 - DNA, 20 bp, Artificial Sequence
  Description of Artificial Sequence: Synthetic oligonucleotide
  Target: SCN9A; (-) strand; PAM type: NRG; PAM sequence: CAG
attttgaagcatttatgtgt

SEQ ID NO: 33157 - DNA, 20 bp, Artificial Sequence
  Description of Artificial Sequence: Synthetic oligonucleotide
  Target: SCN9A; (-) strand; PAM type: NRG; PAM sequence: AAG
aacttgctgtgtacattttg

SEQ ID NO: 33158 - DNA, 20 bp, Artificial Sequence
  Description of Artificial Sequence: Synthetic oligonucleotide
  Target: SCN9A; (-) strand; PAM type: NRG; PAM sequence: TAG
gagtgctgccaagtagtcca

SEQ ID NO: 33159 - DNA, 20 bp, Artificial Sequence
  Description of Artificial Sequence: Synthetic oligonucleotide
  Target: SCN9A; (-) strand; PAM type: NRG; PAM sequence: TAG
ctgggaagagtgctgccaag

SEQ ID NO: 33160 - DNA, 20 bp, Artificial Sequence
  Description of Artificial Sequence: Synthetic oligonucleotide
  Target: SCN9A; (-) strand; PAM type: NRG; PAM sequence: AAG
atcctgggaagagtgctgcc

SEQ ID NO: 33161 - DNA, 20 bp, Artificial Sequence
  Description of Artificial Sequence: Synthetic oligonucleotide
  Target: SCN9A; (-) strand; PAM type: NRG; PAM sequence: GAG
tctctcttgtatcctgggaa

SEQ ID NO: 33162 - DNA, 20 bp, Artificial Sequence
  Description of Artificial Sequence: Synthetic oligonucleotide
  Target: SCN9A; (-) strand; PAM type: NRG; PAM sequence: AAG
tttctctcttgtatcctggg

SEQ ID NO: 33163 - DNA, 20 bp, Artificial Sequence
  Description of Artificial Sequence: Synthetic oligonucleotide
  Target: SCN9A; (-) strand; PAM type: NRG; PAM sequence: GGG
tggtttctctcttgtatcct

SEQ ID NO: 33164 - DNA, 20 bp, Artificial Sequence
  Description of Artificial Sequence: Synthetic oligonucleotide
  Target: SCN9A; (-) strand; PAM type: NRG; PAM sequence: TGG
ctggtttctctcttgtatcc

SEQ ID NO: 33165 - DNA, 20 bp, Artificial Sequence
  Description of Artificial Sequence: Synthetic oligonucleotide
  Target: SCN9A; (-) strand; PAM type: NRG; PAM sequence: TGG
actcctccgtttgaaagctc

SEQ ID NO: 33166 - DNA, 20 bp, Artificial Sequence
  Description of Artificial Sequence: Synthetic oligonucleotide
  Target: SCN9A; (-) strand; PAM type: NRG; PAM sequence: AAG
ggcactactcctccgtttga

SEQ ID NO: 33167 - DNA, 20 bp, Artificial Sequence
  Description of Artificial Sequence: Synthetic oligonucleotide
  Target: SCN9A; (-) strand; PAM type: NRG; PAM sequence: TGG
tcccatacaaggagaatgcc

SEQ ID NO: 33168 - DNA, 20 bp, Artificial Sequence
  Description of Artificial Sequence: Synthetic oligonucleotide
  Target: SCN9A; (-) strand; PAM type: NRG; PAM sequence: GAG
tgaaaagactcccatacaag

SEQ ID NO: 33169 - DNA, 20 bp, Artificial Sequence
  Description of Artificial Sequence: Synthetic oligonucleotide
  Target: SCN9A; (-) strand; PAM type: NRG; PAM sequence: AGG
gctgaaaagactcccataca

SEQ ID NO: 33170 - DNA, 20 bp, Artificial Sequence
  Description of Artificial Sequence: Synthetic oligonucleotide
  Target: SCN9A; (-) strand; PAM type: NRG; PAM sequence: AAG
tgctgaaaagactcccatac

SEQ ID NO: 33171 - DNA, 20 bp, Artificial Sequence
  Description of Artificial Sequence: Synthetic oligonucleotide
  Target: SCN9A; (-) strand; PAM type: NRG; PAM sequence: AAG
attgctgcaaaattgctgaa

SEQ ID NO: 33172 - DNA, 20 bp, Artificial Sequence
  Description of Artificial Sequence: Synthetic oligonucleotide
  Target: SCN9A; (-) strand; PAM type: NRG; PAM sequence: TGG
catagatatgctttgctgca

SEQ ID NO: 33173 - DNA, 20 bp, Artificial Sequence
  Description of Artificial Sequence: Synthetic oligonucleotide
  Target: SCN9A; (-) strand; PAM type: NRG; PAM sequence: TAG
ctcatctccttgtatttgca

SEQ ID NO: 33174 - DNA, 20 bp, Artificial Sequence
  Description of Artificial Sequence: Synthetic oligonucleotide
  Target: SCN9A; (-) strand; PAM type: NRG; PAM sequence: TGG
actcccacaactgctcaatg

SEQ ID NO: 33175 - DNA, 20 bp, Artificial Sequence
  Description of Artificial Sequence: Synthetic oligonucleotide
  Target: SCN9A; (-) strand; PAM type: NRG; PAM sequence: GGG
agacaagcaattttgaagca

SEQ ID NO: 33176 - DNA, 20 bp, Artificial Sequence
  Description of Artificial Sequence: Synthetic oligonucleotide
  Target: SCN9A; (-) strand; PAM type: NRG; PAM sequence: AGG
gagacaagcaattttgaagc

SEQ ID NO: 33177 - DNA, 20 bp, Artificial Sequence
  Description of Artificial Sequence: Synthetic oligonucleotide
  Target: SCN9A; (-) strand; PAM type: NRG; PAM sequence: CAG
tgagacaagcaattttgaag

SEQ ID NO: 33178 - DNA, 20 bp, Artificial Sequence
  Description of Artificial Sequence: Synthetic oligonucleotide
  Target: SCN9A; (-) strand; PAM type: NRG; PAM sequence: AAG
atgtgagacaagcaattttg

SEQ ID NO: 33179 - DNA, 20 bp, Artificial Sequence
  Description of Artificial Sequence: Synthetic oligonucleotide
  Target: SCN9A; (-) strand; PAM type: NRG; PAM sequence: AAG
gataagggttcatgtgagac

SEQ ID NO: 33180 - DNA, 20 bp, Artificial Sequence
  Description of Artificial Sequence: Synthetic oligonucleotide
  Target: SCN9A; (-) strand; PAM type: NRG; PAM sequence: GAG
caattgataagggttcatgt

SEQ ID NO: 33181 - DNA, 20 bp, Artificial Sequence
  Description of Artificial Sequence: Synthetic oligonucleotide
  Target: SCN9A; (-) strand; PAM type: NRG; PAM sequence: GGG
gcagttgttacaattgataa

SEQ ID NO: 33182 - DNA, 20 bp, Artificial Sequence
  Description of Artificial Sequence: Synthetic oligonucleotide
  Target: SCN9A; (-) strand; PAM type: NRG; PAM sequence: AGG
tgcagttgttacaattgata

SEQ ID NO: 33183 - DNA, 20 bp, Artificial Sequence
  Description of Artificial Sequence: Synthetic oligonucleotide
  Target: SCN9A; (-) strand; PAM type: NRG; PAM sequence: AAG
ttgcagttgttacaattgat

SEQ ID NO: 33184 - DNA, 20 bp, Artificial Sequence
  Description of Artificial Sequence: Synthetic oligonucleotide
  Target: SCN9A; (-) strand; PAM type: NRG; PAM sequence: CAG
gtccctttcatacagagttg

SEQ ID NO: 33185 - DNA, 20 bp, Artificial Sequence
  Description of Artificial Sequence: Synthetic oligonucleotide
  Target: SCN9A; (-) strand; PAM type: NRG; PAM sequence: GAG
gggcatgtccctttcataca

SEQ ID NO: 33186 - DNA, 20 bp, Artificial Sequence
  Description of Artificial Sequence: Synthetic oligonucleotide
  Target: SCN9A; (-) strand; PAM type: NRG; PAM sequence: CAG
gtgggcatgtccctttcata

SEQ ID NO: 33187 - DNA, 20 bp, Artificial Sequence
  Description of Artificial Sequence: Synthetic oligonucleotide
  Target: SCN9A; (-) strand; PAM type: NRG; PAM sequence: GGG
atgcagtgactcctgtaagt

SEQ ID NO: 33188 - DNA, 20 bp, Artificial Sequence
  Description of Artificial Sequence: Synthetic oligonucleotide
  Target: SCN9A; (-) strand; PAM type: NRG; PAM sequence: TGG
aatgcagtgactcctgtaag

SEQ ID NO: 33189 - DNA, 20 bp, Artificial Sequence
  Description of Artificial Sequence: Synthetic oligonucleotide
  Target: SCN9A; (-) strand; PAM type: NRG; PAM sequence: AAG
cttaatgcagtgactcctgt

SEQ ID NO: 33190 - DNA, 20 bp, Artificial Sequence
  Description of Artificial Sequence: Synthetic oligonucleotide
  Target: SCN9A; (-) strand; PAM type: NRG; PAM sequence: CAG
tctttggaacccccttaatg

SEQ ID NO: 33191 - DNA, 20 bp, Artificial Sequence
  Description of Artificial Sequence: Synthetic oligonucleotide
  Target: SCN9A; (-) strand; PAM type: NRG; PAM sequence: TGG
ccgagggtgtcatctttctt

SEQ ID NO: 33192 - DNA, 20 bp, Artificial Sequence
  Description of Artificial Sequence: Synthetic oligonucleotide
  Target: SCN9A; (-) strand; PAM type: NRG; PAM sequence: GGG
aagccctaaatcaatgccga

SEQ ID NO: 33193 - DNA, 20 bp, Artificial Sequence
  Description of Artificial Sequence: Synthetic oligonucleotide
  Target: SCN9A; (-) strand; PAM type: NRG; PAM sequence: AGG
taagccctaaatcaatgccg

SEQ ID NO: 33194 - DNA, 20 bp, Artificial Sequence
  Description of Artificial Sequence: Synthetic oligonucleotide
  Target: SCN9A; (-) strand; PAM type: NRG; PAM sequence: GAG
ataagccctaaatcaatgcc

SEQ ID NO: 33195 - DNA, 20 bp, Artificial Sequence
  Description of Artificial Sequence: Synthetic oligonucleotide
  Target: SCN9A; (-) strand; PAM type: NRG; PAM sequence: AAG
accgaaagagaaaaaaaaat

SEQ ID NO: 33196 - DNA, 20 bp, Artificial Sequence
  Description of Artificial Sequence: Synthetic oligonucleotide
  Target: SCN9A; (-) strand; PAM type: NRG; PAM sequence: GAG
taatataaagagcaccgaaa

SEQ ID NO: 33197 - DNA, 20 bp, Artificial Sequence
  Description of Artificial Sequence: Synthetic oligonucleotide
  Target: SCN9A; (-) strand; PAM type: NRG; PAM sequence: AAG
tttaatataaagagcaccga

SEQ ID NO: 33198 - DNA, 20 bp, Artificial Sequence
  Description of Artificial Sequence: Synthetic oligonucleotide
  Target: SCN9A; (-) strand; PAM type: NRG; PAM sequence: GAG
ttgtataattttaatataaa

SEQ ID NO: 33199 - DNA, 20 bp, Artificial Sequence
  Description of Artificial Sequence: Synthetic oligonucleotide
  Target: SCN9A; (-) strand; PAM type: NRG; PAM sequence: AAG
tcttgtataattttaatata

SEQ ID NO: 33200 - DNA, 20 bp, Artificial Sequence
  Description of Artificial Sequence: Synthetic oligonucleotide
  Target: SCN9A; (-) strand; PAM type: NRG; PAM sequence: TAG
gggcgttagacagatagtaa

SEQ ID NO: 33201 - DNA, 20 bp, Artificial Sequence
  Description of Artificial Sequence: Synthetic oligonucleotide
  Target: SCN9A; (-) strand; PAM type: NRG; PAM sequence: TAG
acacatgggcgttagacaga

SEQ ID NO: 33202 - DNA, 20 bp, Artificial Sequence
  Description of Artificial Sequence: Synthetic oligonucleotide
  Target: SCN9A; (-) strand; PAM type: NRG; PAM sequence: CAG
ttgtacacatgggcgttaga

SEQ ID NO: 33203 - DNA, 20 bp, Artificial Sequence
  Description of Artificial Sequence: Synthetic oligonucleotide
  Target: SCN9A; (-) strand; PAM type: NRG; PAM sequence: TAG
gtttttgtacacatgggcgt

SEQ ID NO: 33204 - DNA, 20 bp, Artificial Sequence
  Description of Artificial Sequence: Synthetic oligonucleotide
  Target: SCN9A; (-) strand; PAM type: NRG; PAM sequence: GGG
agaactgtttttgtacacat

SEQ ID NO: 33205 - DNA, 20 bp, Artificial Sequence
  Description of Artificial Sequence: Synthetic oligonucleotide
  Target: SCN9A; (-) strand; PAM type: NRG; PAM sequence: TGG
tagaactgtttttgtacaca

SEQ ID NO: 33206 - DNA, 20 bp, Artificial Sequence
  Description of Artificial Sequence: Synthetic oligonucleotide
  Target: SCN9A; (-) strand; PAM type: NRG; PAM sequence: TAG
gccaacaaatagcataagta

SEQ ID NO: 33207 - DNA, 20 bp, Artificial Sequence
  Description of Artificial Sequence: Synthetic oligonucleotide
  Target: SCN9A; (-) strand; PAM type: NRG; PAM sequence: AAG
gagaagccaacaaatagcat

SEQ ID NO: 33208 - DNA, 20 bp, Artificial Sequence
  Description of Artificial Sequence: Synthetic oligonucleotide
  Target: SCN9A; (-) strand; PAM type: NRG; PAM sequence: TAG
agagaggagaagccaacaaa

SEQ ID NO: 33209 - DNA, 20 bp, Artificial Sequence
  Description of Artificial Sequence: Synthetic oligonucleotide
  Target: SCN9A; (-) strand; PAM type: NRG; PAM sequence: AAG
aaaagttatggagagaggag

SEQ ID NO: 33210 - DNA, 20 bp, Artificial Sequence
  Description of Artificial Sequence: Synthetic oligonucleotide
  Target: SCN9A; (-) strand; PAM type: NRG; PAM sequence: GAG
aataaaagttatggagagag

SEQ ID NO: 33211 - DNA, 20 bp, Artificial Sequence
  Description of Artificial Sequence: Synthetic oligonucleotide
  Target: SCN9A; (-) strand; PAM type: NRG; PAM sequence: AGG
caaataaaagttatggagag

SEQ ID NO: 33212 - DNA, 20 bp, Artificial Sequence
  Description of Artificial Sequence: Synthetic oligonucleotide
  Target: SCN9A; (-) strand; PAM type: NRG; PAM sequence: GAG
acaaataaaagttatggaga

SEQ ID NO: 33213 - DNA, 20 bp, Artificial Sequence
  Description of Artificial Sequence: Synthetic oligonucleotide
  Target: SCN9A; (-) strand; PAM type: NRG; PAM sequence: GAG
aaacaaataaaagttatgga

SEQ ID NO: 33214 - DNA, 20 bp, Artificial Sequence
  Description of Artificial Sequence: Synthetic oligonucleotide
  Target: SCN9A; (-) strand; PAM type: NRG; PAM sequence: GAG
aaaaacaaataaaagttatg

SEQ ID NO: 33215 - DNA, 20 bp, Artificial Sequence
  Description of Artificial Sequence: Synthetic oligonucleotide
  Target: SCN9A; (-) strand; PAM type: NRG; PAM sequence: TGG
taaaaaacaaataaaagtta

SEQ ID NO: 33216 - DNA, 20 bp, Artificial Sequence
  Description of Artificial Sequence: Synthetic oligonucleotide
  Target: SCN9A; (-) strand; PAM type: NRG; PAM sequence: AAG
aaaatttaaaaaacaaataa

SEQ ID NO: 33217 - DNA, 20 bp, Artificial Sequence
  Description of Artificial Sequence: Synthetic oligonucleotide
  Target: SCN9A; (-) strand; PAM type: NRG; PAM sequence: TAG
ttttgctcctttcctataat

SEQ ID NO: 33218 - DNA, 20 bp, Artificial Sequence
  Description of Artificial Sequence: Synthetic oligonucleotide
  Target: SCN9A; (-) strand; PAM type: NRG; PAM sequence: TAG
agggggtacaagggaatatt

SEQ ID NO: 33219 - DNA, 20 bp, Artificial Sequence
  Description of Artificial Sequence: Synthetic oligonucleotide
  Target: SCN9A; (-) strand; PAM type: NRG; PAM sequence: GGG
aagtggggcagggggtacaa

SEQ ID NO: 33220 - DNA, 20 bp, Artificial Sequence
  Description of Artificial Sequence: Synthetic oligonucleotide
  Target: SCN9A; (-) strand; PAM type: NRG; PAM sequence: AGG
gaagtggggcagggggtaca

SEQ ID NO: 33221 - DNA, 20 bp, Artificial Sequence
  Description of Artificial Sequence: Synthetic oligonucleotide
  Target: SCN9A; (-) strand; PAM type: NRG; PAM sequence: AAG
ggaagtggggcagggggtac

SEQ ID NO: 33222 - DNA, 20 bp, Artificial Sequence
  Description of Artificial Sequence: Synthetic oligonucleotide
  Target: SCN9A; (-) strand; PAM type: NRG; PAM sequence: GGG
attataggaagtggggcagg

SEQ ID NO: 33223 - DNA, 20 bp, Artificial Sequence
  Description of Artificial Sequence: Synthetic oligonucleotide
  Target: SCN9A; (-) strand; PAM type: NRG; PAM sequence: GGG
cattataggaagtggggcag

SEQ ID NO: 33224 - DNA, 20 bp, Artificial Sequence
  Description of Artificial Sequence: Synthetic oligonucleotide
  Target: SCN9A; (-) strand; PAM type: NRG; PAM sequence: GGG
acattataggaagtggggca

SEQ ID NO: 33225 - DNA, 20 bp, Artificial Sequence
  Description of Artificial Sequence: Synthetic oligonucleotide
  Target: SCN9A; (-) strand; PAM type: NRG; PAM sequence: AGG
aacattataggaagtggggc

SEQ ID NO: 33226 - DNA, 20 bp, Artificial Sequence
  Description of Artificial Sequence: Synthetic oligonucleotide
  Target: SCN9A; (-) strand; PAM type: NRG; PAM sequence: CAG
taacattataggaagtgggg

SEQ ID NO: 33227 - DNA, 20 bp, Artificial Sequence
  Description of Artificial Sequence: Synthetic oligonucleotide
  Target: SCN9A; (-) strand; PAM type: NRG; PAM sequence: GGG
tgttaacattataggaagtg

SEQ ID NO: 33228 - DNA, 20 bp, Artificial Sequence
  Description of Artificial Sequence: Synthetic oligonucleotide
  Target: SCN9A; (-) strand; PAM type: NRG; PAM sequence: GGG
ttgttaacattataggaagt

SEQ ID NO: 33229 - DNA, 20 bp, Artificial Sequence
  Description of Artificial Sequence: Synthetic oligonucleotide
  Target: SCN9A; (-) strand; PAM type: NRG; PAM sequence: TGG
attgttaacattataggaag

SEQ ID NO: 33230 - DNA, 20 bp, Artificial Sequence
  Description of Artificial Sequence: Synthetic oligonucleotide
  Target: SCN9A; (-) strand; PAM type: NRG; PAM sequence: AAG
ataattgttaacattatagg

SEQ ID NO: 33231 - DNA, 20 bp, Artificial Sequence
  Description of Artificial Sequence: Synthetic oligonucleotide
  Target: SCN9A; (-) strand; PAM type: NRG; PAM sequence: AGG
tatataattgttaacattat

SEQ ID NO: 33232 - DNA, 20 bp, Artificial Sequence
  Description of Artificial Sequence: Synthetic oligonucleotide
  Target: SCN9A; (-) strand; PAM type: NRG; PAM sequence: TAG
ttatataattgttaacatta

SEQ ID NO: 33233 - DNA, 20 bp, Artificial Sequence
  Description of Artificial Sequence: Synthetic oligonucleotide
  Target: SCN9A; (-) strand; PAM type: NRG; PAM sequence: TGG
gttaattttcttgattacta

SEQ ID NO: 33234 - DNA, 20 bp, Artificial Sequence
  Description of Artificial Sequence: Synthetic oligonucleotide
  Target: SCN9A; (-) strand; PAM type: NRG; PAM sequence: TGG
ttcagatagtaatatcatac

SEQ ID NO: 33235 - DNA, 20 bp, Artificial Sequence
  Description of Artificial Sequence: Synthetic oligonucleotide
  Target: SCN9A; (-) strand; PAM type: NRG; PAM sequence: TAG
agtaagatttgcaattcaga

SEQ ID NO: 33236 - DNA, 20 bp, Artificial Sequence
  Description of Artificial Sequence: Synthetic oligonucleotide
  Target: SCN9A; (-) strand; PAM type: NRG; PAM sequence: CAG
tttaagtaagatttgcaatt

SEQ ID NO: 33237 - DNA, 20 bp, Artificial Sequence
  Description of Artificial Sequence: Synthetic oligonucleotide
  Target: SCN9A; (-) strand; PAM type: NRG; PAM sequence: AAG
aaaaatgatgtaatttaagt

SEQ ID NO: 33238 - DNA, 20 bp, Artificial Sequence
  Description of Artificial Sequence: Synthetic oligonucleotide
  Target: SCN9A; (-) strand; PAM type: NRG; PAM sequence: AAG
aataaaaaatgatgtaattt

SEQ ID NO: 33239 - DNA, 20 bp, Artificial Sequence
  Description of Artificial Sequence: Synthetic oligonucleotide
  Target: SCN9A; (-) strand; PAM type: NRG; PAM sequence: AGG
cagataaaaagagactaatg

SEQ ID NO: 33240 - DNA, 20 bp, Artificial Sequence
  Description of Artificial Sequence: Synthetic oligonucleotide
  Target: SCN9A; (-) strand; PAM type: NRG; PAM sequence: GAG
gcagataaaaagagactaat

SEQ ID NO: 33241 - DNA, 20 bp, Artificial Sequence
  Description of Artificial Sequence: Synthetic oligonucleotide
  Target: SCN9A; (-) strand; PAM type: NRG; PAM sequence: GAG
agttctgttgcagataaaaa

SEQ ID NO: 33242 - DNA, 20 bp, Artificial Sequence
  Description of Artificial Sequence: Synthetic oligonucleotide
  Target: SCN9A; (-) strand; PAM type: NRG; PAM sequence: AAG
gaagttctgttgcagataaa

SEQ ID NO: 33243 - DNA, 20 bp, Artificial Sequence
  Description of Artificial Sequence: Synthetic oligonucleotide
  Target: SCN9A; (-) strand; PAM type: NRG; PAM sequence: CAG
aaacaattgaagttctgttg

SEQ ID NO: 33244 - DNA, 20 bp, Artificial Sequence
  Description of Artificial Sequence: Synthetic oligonucleotide
  Target: SCN9A; (-) strand; PAM type: NRG; PAM sequence: AAG
gaaagaaaagaaaacaattg

SEQ ID NO: 33245 - DNA, 20 bp, Artificial Sequence
  Description of Artificial Sequence: Synthetic oligonucleotide
  Target: SCN9A; (-) strand; PAM type: NRG; PAM sequence: AAG
attgtcaggtcacgaaagaa

SEQ ID NO: 33246 - DNA, 20 bp, Artificial Sequence
  Description of Artificial Sequence: Synthetic oligonucleotide
  Target: SCN9A; (-) strand; PAM type: NRG; PAM sequence: AAG
gcccaattgtcaggtcacga

SEQ ID NO: 33247 - DNA, 20 bp, Artificial Sequence
  Description of Artificial Sequence: Synthetic oligonucleotide
  Target: SCN9A; (-) strand; PAM type: NRG; PAM sequence: AGG
ttgtattctgcccaattgtc

SEQ ID NO: 33248 - DNA, 20 bp, Artificial Sequence
  Description of Artificial Sequence: Synthetic oligonucleotide
  Target: SCN9A; (-) strand; PAM type: NRG; PAM sequence: CAG
tttgtattctgcccaattgt

SEQ ID NO: 33249 - DNA, 20 bp, Artificial Sequence
  Description of Artificial Sequence: Synthetic oligonucleotide
  Target: SCN9A; (-) strand; PAM type: NRG; PAM sequence: GAG
aaattcagtgaacccaagtt

SEQ ID NO: 33250 - DNA, 20 bp, Artificial Sequence
  Description of Artificial Sequence: Synthetic oligonucleotide
  Target: SCN9A; (-) strand; PAM type: NRG; PAM sequence: AAG
ttgaaaaattcagtgaaccc

SEQ ID NO: 33251 - DNA, 20 bp, Artificial Sequence
  Description of Artificial Sequence: Synthetic oligonucleotide
  Target: SCN9A; (-) strand; PAM type: NRG; PAM sequence: CAG
tagttgtgaattgaaaaatt

SEQ ID NO: 33252 - DNA, 20 bp, Artificial Sequence
  Description of Artificial Sequence: Synthetic oligonucleotide
  Target: SCN9A; (-) strand; PAM type: NRG; PAM sequence: TAG
agataacgctttagtttcct

SEQ ID NO: 33253 - DNA, 20 bp, Artificial Sequence
  Description of Artificial Sequence: Synthetic oligonucleotide
  Target: SCN9A; (-) strand; PAM type: NRG; PAM sequence: TAG
taattccatagataacgctt

SEQ ID NO: 33254 - DNA, 20 bp, Artificial Sequence
  Description of Artificial Sequence: Synthetic oligonucleotide
  Target: SCN9A; (-) strand; PAM type: NRG; PAM sequence: TAG
gagcaaagtatctaattcca

SEQ ID NO: 33255 - DNA, 20 bp, Artificial Sequence
  Description of Artificial Sequence: Synthetic oligonucleotide
  Target: SCN9A; (-) strand; PAM type: NRG; PAM sequence: AAG
cagctgtgttaccttgagca

SEQ ID NO: 33256 - DNA, 20 bp, Artificial Sequence
  Description of Artificial Sequence: Synthetic oligonucleotide
  Target: SCN9A; (-) strand; PAM type: NRG; PAM sequence: GAG
acacacagctgtgttacctt

SEQ ID NO: 33257 - DNA, 20 bp, Artificial Sequence
  Description of Artificial Sequence: Synthetic oligonucleotide
  Target: SCN9A; (-) strand; PAM type: NRG; PAM sequence: CAG
aatcctggctctgctacaca

SEQ ID NO: 33258 - DNA, 20 bp, Artificial Sequence
  Description of Artificial Sequence: Synthetic oligonucleotide
  Target: SCN9A; (-) strand; PAM type: NRG; PAM sequence: TGG
acagatcttagttcaaatcc

SEQ ID NO: 33259 - DNA, 20 bp, Artificial Sequence
  Description of Artificial Sequence: Synthetic oligonucleotide
  Target: SCN9A; (-) strand; PAM type: NRG; PAM sequence: TAG
gcctggggagtaacagatct

SEQ ID NO: 33260 - DNA, 20 bp, Artificial Sequence
  Description of Artificial Sequence: Synthetic oligonucleotide
  Target: SCN9A; (-) strand; PAM type: NRG; PAM sequence: CAG
tatactggcctggggagtaa

SEQ ID NO: 33261 - DNA, 20 bp, Artificial Sequence
  Description of Artificial Sequence: Synthetic oligonucleotide
  Target: SCN9A; (-) strand; PAM type: NRG; PAM sequence: GAG
tttttctatactggcctggg

SEQ ID NO: 33262 - DNA, 20 bp, Artificial Sequence
  Description of Artificial Sequence: Synthetic oligonucleotide
  Target: SCN9A; (-) strand; PAM type: NRG; PAM sequence: GGG
tttttttctatactggcctg

SEQ ID NO: 33263 - DNA, 20 bp, Artificial Sequence
  Description of Artificial Sequence: Synthetic oligonucleotide
  Target: SCN9A; (-) strand; PAM type: NRG; PAM sequence: GGG
ttttttttctatactggcct

SEQ ID NO: 33264 - DNA, 20 bp, Artificial Sequence
  Description of Artificial Sequence: Synthetic oligonucleotide
  Target: SCN9A; (-) strand; PAM type: NRG; PAM sequence: TGG
cttttttttctatactggcc

SEQ ID NO: 33265 - DNA, 20 bp, Artificial Sequence
  Description of Artificial Sequence: Synthetic oligonucleotide
  Target: SCN9A; (-) strand; PAM type: NRG; PAM sequence: TGG
gttatcttttttttctatac

SEQ ID NO: 33266 - DNA, 20 bp, Artificial Sequence
  Description of Artificial Sequence: Synthetic oligonucleotide
  Target: SCN9A; (-) strand; PAM type: NRG; PAM sequence: AAG
ccatgtatttctgcatttta

SEQ ID NO: 33267 - DNA, 20 bp, Artificial Sequence
  Description of Artificial Sequence: Synthetic oligonucleotide
  Target: SCN9A; (-) strand; PAM type: NRG; PAM sequence: AAG
ttgcaacaggtacatactct

SEQ ID NO: 33268 - DNA, 20 bp, Artificial Sequence
  Description of Artificial Sequence: Synthetic oligonucleotide
  Target: SCN9A; (-) strand; PAM type: NRG; PAM sequence: AGG
gatgccaagacctttgcaac

SEQ ID NO: 33269 - DNA, 20 bp, Artificial Sequence
  Description of Artificial Sequence: Synthetic oligonucleotide
  Target: SCN9A; (-) strand; PAM type: NRG; PAM sequence: CAG
agatgccaagacctttgcaa

SEQ ID NO: 33270 - DNA, 20 bp, Artificial Sequence
  Description of Artificial Sequence: Synthetic oligonucleotide
  Target: SCN9A; (-) strand; PAM type: NRG; PAM sequence: AAG
tcgataaaaattcagatgcc

SEQ ID NO: 33271 - DNA, 20 bp, Artificial Sequence
  Description of Artificial Sequence: Synthetic oligonucleotide
  Target: SCN9A; (-) strand; PAM type: NRG; PAM sequence: CAG
atgagtcatcgataaaaatt

SEQ ID NO: 33272 - DNA, 20 bp, Artificial Sequence
  Description of Artificial Sequence: Synthetic oligonucleotide
  Target: SCN9A; (-) strand; PAM type: NRG; PAM sequence: GAG
tctgctgaataaagccaaat

SEQ ID NO: 33273 - DNA, 20 bp, Artificial Sequence
  Description of Artificial Sequence: Synthetic oligonucleotide
  Target: SCN9A; (-) strand; PAM type: NRG; PAM sequence: AAG
aaactcaagtctgctgaata

SEQ ID NO: 33274 - DNA, 20 bp, Artificial Sequence
  Description of Artificial Sequence: Synthetic oligonucleotide
  Target: SCN9A; (-) strand; PAM type: NRG; PAM sequence: AAG
ctgattgaatttctaaactc

SEQ ID NO: 33275 - DNA, 20 bp, Artificial Sequence
  Description of Artificial Sequence: Synthetic oligonucleotide
  Target: SCN9A; (-) strand; PAM type: NRG; PAM sequence: CAG
taattacaaggacagtttac

SEQ ID NO: 33276 - DNA, 20 bp, Artificial Sequence
  Description of Artificial Sequence: Synthetic oligonucleotide
  Target: SCN9A; (-) strand; PAM type: NRG; PAM sequence: CAG
gttttatttaattacaagga

SEQ ID NO: 33277 - DNA, 20 bp, Artificial Sequence
  Description of Artificial Sequence: Synthetic oligonucleotide
  Target: SCN9A; (-) strand; PAM type: NRG; PAM sequence: AGG
gattgttttatttaattaca

SEQ ID NO: 33278 - DNA, 20 bp, Artificial Sequence
  Description of Artificial Sequence: Synthetic oligonucleotide
  Target: SCN9A; (-) strand; PAM type: NRG; PAM sequence: AAG
ggattgttttatttaattac

SEQ ID NO: 33279 - DNA, 20 bp, Artificial Sequence
  Description of Artificial Sequence: Synthetic oligonucleotide
  Target: SCN9A; (-) strand; PAM type: NRG; PAM sequence: GGG
ttttttcaattaacttcctg

SEQ ID NO: 33280 - DNA, 20 bp, Artificial Sequence
  Description of Artificial Sequence: Synthetic oligonucleotide
  Target: SCN9A; (-) strand; PAM type: NRG; PAM sequence: GGG
cttttttcaattaacttcct

SEQ ID NO: 33281 - DNA, 20 bp, Artificial Sequence
  Description of Artificial Sequence: Synthetic oligonucleotide
  Target: SCN9A; (-) strand; PAM type: NRG; PAM sequence: TGG
gcttttttcaattaacttcc

SEQ ID NO: 33282 - DNA, 20 bp, Artificial Sequence
  Description of Artificial Sequence: Synthetic oligonucleotide
  Target: SCN9A; (-) strand; PAM type: NRG; PAM sequence: AGG
tctaggtgttcctgatgggc

SEQ ID NO: 33283 - DNA, 20 bp, Artificial Sequence
  Description of Artificial Sequence: Synthetic oligonucleotide
  Target: SCN9A; (-) strand; PAM type: NRG; PAM sequence: CAG
ttctaggtgttcctgatggg

SEQ ID NO: 33284 - DNA, 20 bp, Artificial Sequence
  Description of Artificial Sequence: Synthetic oligonucleotide
  Target: SCN9A; (-) strand; PAM type: NRG; PAM sequence: GGG
ggcttctaggtgttcctgat

SEQ ID NO: 33285 - DNA, 20 bp, Artificial Sequence
  Description of Artificial Sequence: Synthetic oligonucleotide
  Target: SCN9A; (-) strand; PAM type: NRG; PAM sequence: TGG
tggcttctaggtgttcctga

SEQ ID NO: 33286 - DNA, 20 bp, Artificial Sequence
  Description of Artificial Sequence: Synthetic oligonucleotide
  Target: SCN9A; (-) strand; PAM type: NRG; PAM sequence: AGG
accaacaaagcgtggcttct

SEQ ID NO: 33287 - DNA, 20 bp, Artificial Sequence
  Description of Artificial Sequence: Synthetic oligonucleotide
  Target: SCN9A; (-) strand; PAM type: NRG; PAM sequence: TAG
gaccaacaaagcgtggcttc

SEQ ID NO: 33288 - DNA, 20 bp, Artificial Sequence
  Description of Artificial Sequence: Synthetic oligonucleotide
  Target: SCN9A; (-) strand; PAM type: NRG; PAM sequence: TGG
ttaaacagaccaacaaagcg

SEQ ID NO: 33289 - DNA, 20 bp, Artificial Sequence
  Description of Artificial Sequence: Synthetic oligonucleotide
  Target: SCN9A; (-) strand; PAM type: NRG; PAM sequence: AAG
ttggcttaaacagaccaaca

SEQ ID NO: 33290 - DNA, 20 bp, Artificial Sequence
  Description of Artificial Sequence: Synthetic oligonucleotide
  Target: SCN9A; (-) strand; PAM type: NRG; PAM sequence: CAG
tgccagaaatttggcttaaa

SEQ ID NO: 33291 - DNA, 20 bp, Artificial Sequence
  Description of Artificial Sequence: Synthetic oligonucleotide
  Target: SCN9A; (-) strand; PAM type: NRG; PAM sequence: TGG
agagcagtgtgccagaaatt

SEQ ID NO: 33292 - DNA, 20 bp, Artificial Sequence
  Description of Artificial Sequence: Synthetic oligonucleotide
  Target: SCN9A; (-) strand; PAM type: NRG; PAM sequence: CAG
atttccgaagagcagtgtgc

SEQ ID NO: 33293 - DNA, 20 bp, Artificial Sequence
  Description of Artificial Sequence: Synthetic oligonucleotide
  Target: SCN9A; (-) strand; PAM type: NRG; PAM sequence: CAG
taaatttgatttccgaagag

SEQ ID NO: 33294 - DNA, 20 bp, Artificial Sequence
  Description of Artificial Sequence: Synthetic oligonucleotide
  Target: SCN9A; (-) strand; PAM type: NRG; PAM sequence: GAG
ttttaaatttgatttccgaa

SEQ ID NO: 33295 - DNA, 20 bp, Artificial Sequence
  Description of Artificial Sequence: Synthetic oligonucleotide
  Target: SCN9A; (-) strand; PAM type: NRG; PAM sequence: AAG
cattttaaatttgatttccg

SEQ ID NO: 33296 - DNA, 20 bp, Artificial Sequence
  Description of Artificial Sequence: Synthetic oligonucleotide
  Target: SCN9A; (-) strand; PAM type: NRG; PAM sequence: AAG
tttgtgcctttaagaaagtt

SEQ ID NO: 33297 - DNA, 20 bp, Artificial Sequence
  Description of Artificial Sequence: Synthetic oligonucleotide
  Target: SCN9A; (-) strand; PAM type: NRG; PAM sequence: AAG
acttgtttgtgcctttaaga

SEQ ID NO: 33298 - DNA, 20 bp, Artificial Sequence
  Description of Artificial Sequence: Synthetic oligonucleotide
  Target: SCN9A; (-) strand; PAM type: NRG; PAM sequence: AAG
tattacttgtttgtgccttt

SEQ ID NO: 33299 - DNA, 20 bp, Artificial Sequence
  Description of Artificial Sequence: Synthetic oligonucleotide
  Target: SCN9A; (-) strand; PAM type: NRG; PAM sequence: CAG
tacattatatatcagagagt

SEQ ID NO: 33300 - DNA, 20 bp, Artificial Sequence
  Description of Artificial Sequence: Synthetic oligonucleotide
  Target: SCN9A; (-) strand; PAM type: NRG; PAM sequence: GAG
gtgatacattatatatcaga

SEQ ID NO: 33301 - DNA, 20 bp, Artificial Sequence
  Description of Artificial Sequence: Synthetic oligonucleotide
  Target: SCN9A; (-) strand; PAM type: NRG; PAM sequence: GAG
ctgtgatacattatatatca

SEQ ID NO: 33302 - DNA, 20 bp, Artificial Sequence
  Description of Artificial Sequence: Synthetic oligonucleotide
  Target: SCN9A; (-) strand; PAM type: NRG; PAM sequence: CAG
ttctgtgatacattatatat

SEQ ID NO: 33303 - DNA, 20 bp, Artificial Sequence
  Description of Artificial Sequence: Synthetic oligonucleotide
  Target: SCN9A; (-) strand; PAM type: NRG; PAM sequence: CAG
aaggccactacatgtgaaat

SEQ ID NO: 33304 - DNA, 20 bp, Artificial Sequence
  Description of Artificial Sequence: Synthetic oligonucleotide
  Target: SCN9A; (-) strand; PAM type: NRG; PAM sequence: AGG
attatgttgctgttgataaa

SEQ ID NO: 33305 - DNA, 20 bp, Artificial Sequence
  Description of Artificial Sequence: Synthetic oligonucleotide
  Target: SCN9A; (-) strand; PAM type: NRG; PAM sequence: AAG
aattatgttgctgttgataa

SEQ ID NO: 33306 - DNA, 20 bp, Artificial Sequence
  Description of Artificial Sequence: Synthetic oligonucleotide
  Target: SCN9A; (-) strand; PAM type: NRG; PAM sequence: TAG
taagatctaaattaaaaatt

SEQ ID NO: 33307 - DNA, 20 bp, Artificial Sequence
  Description of Artificial Sequence: Synthetic oligonucleotide
  Target: SCN9A; (-) strand; PAM type: NRG; PAM sequence: AAG
attttttcatatcttaaagt

SEQ ID NO: 33308 - DNA, 20 bp, Artificial Sequence
  Description of Artificial Sequence: Synthetic oligonucleotide
  Target: SCN9A; (-) strand; PAM type: NRG; PAM sequence: AAG
tcctattttttcatatctta

SEQ ID NO: 33309 - DNA, 20 bp, Artificial Sequence
  Description of Artificial Sequence: Synthetic oligonucleotide
  Target: SCN9A; (-) strand; PAM type: NRG; PAM sequence: TAG
catgtctttccccaggcatt

SEQ ID NO: 33310 - DNA, 20 bp, Artificial Sequence
  Description of Artificial Sequence: Synthetic oligonucleotide
  Target: SCN9A; (-) strand; PAM type: NRG; PAM sequence: AGG
gaacatgcatgtctttcccc

SEQ ID NO: 33311 - DNA, 20 bp, Artificial Sequence
  Description of Artificial Sequence: Synthetic oligonucleotide
  Target: SCN9A; (-) strand; PAM type: NRG; PAM sequence: CAG
agaacatgcatgtctttccc

SEQ ID NO: 33312 - DNA, 20 bp, Artificial Sequence
  Description of Artificial Sequence: Synthetic oligonucleotide
  Target: SCN9A; (-) strand; PAM type: NRG; PAM sequence: AAG
ttacattctaacaaaattct

SEQ ID NO: 33313 - DNA, 20 bp, Artificial Sequence
  Description of Artificial Sequence: Synthetic oligonucleotide
  Target: SCN9A; (-) strand; PAM type: NRG; PAM sequence: GGG
tataaaaatactaggacata

SEQ ID NO: 33314 - DNA, 20 bp, Artificial Sequence
  Description of Artificial Sequence: Synthetic oligonucleotide
  Target: SCN9A; (-) strand; PAM type: NRG; PAM sequence: AGG
ctataaaaatactaggacat

SEQ ID NO: 33315 - DNA, 20 bp, Artificial Sequence
  Description of Artificial Sequence: Synthetic oligonucleotide
  Target: SCN9A; (-) strand; PAM type: NRG; PAM sequence: TAG
tctataaaaatactaggaca

SEQ ID NO: 33316 - DNA, 20 bp, Artificial Sequence
  Description of Artificial Sequence: Synthetic oligonucleotide
  Target: SCN9A; (-) strand; PAM type: NRG; PAM sequence: AGG
agggagtctataaaaatact

SEQ ID NO: 33317 - DNA, 20 bp, Artificial Sequence
  Description of Artificial Sequence: Synthetic oligonucleotide
  Target: SCN9A; (-) strand; PAM type: NRG; PAM sequence: TAG
gagggagtctataaaaatac

SEQ ID NO: 33318 - DNA, 20 bp, Artificial Sequence
  Description of Artificial Sequence: Synthetic oligonucleotide
  Target: SCN9A; (-) strand; PAM type: NRG; PAM sequence: GAG
ttcattatagttaacagagg

SEQ ID NO: 33319 - DNA, 20 bp, Artificial Sequence
  Description of Artificial Sequence: Synthetic oligonucleotide
  Target: SCN9A; (-) strand; PAM type: NRG; PAM sequence: GGG
aattcattatagttaacaga

SEQ ID NO: 33320 - DNA, 20 bp, Artificial Sequence
  Description of Artificial Sequence: Synthetic oligonucleotide
  Target: SCN9A; (-) strand; PAM type: NRG; PAM sequence: AGG
aaattcattatagttaacag

SEQ ID NO: 33321 - DNA, 20 bp, Artificial Sequence
  Description of Artificial Sequence: Synthetic oligonucleotide
  Target: SCN9A; (-) strand; PAM type: NRG; PAM sequence: GAG
taaattcattatagttaaca

SEQ ID NO: 33322 - DNA, 20 bp, Artificial Sequence
  Description of Artificial Sequence: Synthetic oligonucleotide
  Target: SCN9A; (-) strand; PAM type: NRG; PAM sequence: CAG
cctaaattcattatagttaa

SEQ ID NO: 33323 - DNA, 20 bp, Artificial Sequence
  Description of Artificial Sequence: Synthetic oligonucleotide
  Target: SCN9A; (-) strand; PAM type: NRG; PAM sequence: TAG
ccaccttcctaaattcatta

SEQ ID NO: 33324 - DNA, 20 bp, Artificial Sequence
  Description of Artificial Sequence: Synthetic oligonucleotide
  Target: SCN9A; (-) strand; PAM type: NRG; PAM sequence: GAG
tatcatttattggggtgaaa

SEQ ID NO: 33325 - DNA, 20 bp, Artificial Sequence
  Description of Artificial Sequence: Synthetic oligonucleotide
  Target: SCN9A; (-) strand; PAM type: NRG; PAM sequence: AAG
gatatcatttattggggtga

SEQ ID NO: 33326 - DNA, 20 bp, Artificial Sequence
  Description of Artificial Sequence: Synthetic oligonucleotide
  Target: SCN9A; (-) strand; PAM type: NRG; PAM sequence: GGG
atgcttgatatcatttattg

SEQ ID NO: 33327 - DNA, 20 bp, Artificial Sequence
  Description of Artificial Sequence: Synthetic oligonucleotide
  Target: SCN9A; (-) strand; PAM type: NRG; PAM sequence: GGG
gatgcttgatatcatttatt

SEQ ID NO: 33328 - DNA, 20 bp, Artificial Sequence
  Description of Artificial Sequence: Synthetic oligonucleotide
  Target: SCN9A; (-) strand; PAM type: NRG; PAM sequence: TGG
agatgcttgatatcatttat

SEQ ID NO: 33329 - DNA, 20 bp, Artificial Sequence
  Description of Artificial Sequence: Synthetic oligonucleotide
  Target: SCN9A; (-) strand; PAM type: NRG; PAM sequence: TAG
agtttttgttaatttaaata

SEQ ID NO: 33330 - DNA, 20 bp, Artificial Sequence
  Description of Artificial Sequence: Synthetic oligonucleotide
  Target: SCN9A; (-) strand; PAM type: NRG; PAM sequence: CAG
tgttcaggtgccagggactc

SEQ ID NO: 33331 - DNA, 20 bp, Artificial Sequence
  Description of Artificial Sequence: Synthetic oligonucleotide
  Target: SCN9A; (-) strand; PAM type: NRG; PAM sequence: GGG
aagcacttgttcaggtgcca

SEQ ID NO: 33332 - DNA, 20 bp, Artificial Sequence
  Description of Artificial Sequence: Synthetic oligonucleotide
  Target: SCN9A; (-) strand; PAM type: NRG; PAM sequence: AGG
caagcacttgttcaggtgcc

SEQ ID NO: 33333 - DNA, 20 bp, Artificial Sequence
  Description of Artificial Sequence: Synthetic oligonucleotide
  Target: SCN9A; (-) strand; PAM type: NRG; PAM sequence: CAG
gcaagcacttgttcaggtgc

SEQ ID NO: 33334 - DNA, 20 bp, Artificial Sequence
  Description of Artificial Sequence: Synthetic oligonucleotide
  Target: SCN9A; (-) strand; PAM type: NRG; PAM sequence: AGG
gtttgagcaagcacttgttc

SEQ ID NO: 33335 - DNA, 20 bp, Artificial Sequence
  Description of Artificial Sequence: Synthetic oligonucleotide
  Target: SCN9A; (-) strand; PAM type: NRG; PAM sequence: CAG
tgtttgagcaagcacttgtt

SEQ ID NO: 33336 - DNA, 20 bp, Artificial Sequence
  Description of Artificial Sequence: Synthetic oligonucleotide
  Target: SCN9A; (-) strand; PAM type: NRG; PAM sequence: AAG
ttaacaaatactgtttgagc

SEQ ID NO: 33337 - DNA, 20 bp, Artificial Sequence
  Description of Artificial Sequence: Synthetic oligonucleotide
  Target: SCN9A; (-) strand; PAM type: NRG; PAM sequence: GAG
gtaattaacaaatactgttt

SEQ ID NO: 33338 - DNA, 20 bp, Artificial Sequence
  Description of Artificial Sequence: Synthetic oligonucleotide
  Target: SCN9A; (-) strand; PAM type: NRG; PAM sequence: AAG
ccttgaagtgctacatttac

SEQ ID NO: 33339 - DNA, 20 bp, Artificial Sequence
  Description of Artificial Sequence: Synthetic oligonucleotide
  Target: SCN9A; (-) strand; PAM type: NRG; PAM sequence: AAG
actattaactctcctccttg

SEQ ID NO: 33340 - DNA, 20 bp, Artificial Sequence
  Description of Artificial Sequence: Synthetic oligonucleotide
  Target: SCN9A; (-) strand; PAM type: NRG; PAM sequence: AGG
aatttaaaagtctgatttta

SEQ ID NO: 33341 - DNA, 20 bp, Artificial Sequence
  Description of Artificial Sequence: Synthetic oligonucleotide
  Target: SCN9A; (-) strand; PAM type: NRG; PAM sequence: AAG
taatttaaaagtctgatttt

SEQ ID NO: 33342 - DNA, 20 bp, Artificial Sequence
  Description of Artificial Sequence: Synthetic oligonucleotide
  Target: SCN9A; (-) strand; PAM type: NRG; PAM sequence: AAG
atagaagttatttaatttaa

SEQ ID NO: 33343 - DNA, 20 bp, Artificial Sequence
  Description of Artificial Sequence: Synthetic oligonucleotide
  Target: SCN9A; (-) strand; PAM type: NRG; PAM sequence: AAG
tccaccatattattacatag

SEQ ID NO: 33344 - DNA, 20 bp, Artificial Sequence
  Description of Artificial Sequence: Synthetic oligonucleotide
  Target: SCN9A; (-) strand; PAM type: NRG; PAM sequence: TAG
ttttccaccatattattaca

SEQ ID NO: 33345 - DNA, 20 bp, Artificial Sequence
  Description of Artificial Sequence: Synthetic oligonucleotide
  Target: SCN9A; (-) strand; PAM type: NRG; PAM sequence: AGG
aaattccatattctacacta

SEQ ID NO: 33346 - DNA, 20 bp, Artificial Sequence
  Description of Artificial Sequence: Synthetic oligonucleotide
  Target: SCN9A; (-) strand; PAM type: NRG; PAM sequence: AAG
gaaattccatattctacact

SEQ ID NO: 33347 - DNA, 20 bp, Artificial Sequence
  Description of Artificial Sequence: Synthetic oligonucleotide
  Target: SCN9A; (-) strand; PAM type: NRG; PAM sequence: GAG
atttcaaagagaaatgtcag

SEQ ID NO: 33348 - DNA, 20 bp, Artificial Sequence
  Description of Artificial Sequence: Synthetic oligonucleotide
  Target: SCN9A; (-) strand; PAM type: NRG; PAM sequence: AGG
aaatttcaaagagaaatgtc

SEQ ID NO: 33349 - DNA, 20 bp, Artificial Sequence
  Description of Artificial Sequence: Synthetic oligonucleotide
  Target: SCN9A; (-) strand; PAM type: NRG; PAM sequence: CAG
taaatttcaaagagaaatgt

SEQ ID NO: 33350 - DNA, 20 bp, Artificial Sequence
  Description of Artificial Sequence: Synthetic oligonucleotide
  Target: SCN9A; (-) strand; PAM type: NRG; PAM sequence: GAG
tagtagaattaaatttcaaa

SEQ ID NO: 33351 - DNA, 20 bp, Artificial Sequence
  Description of Artificial Sequence: Synthetic oligonucleotide
  Target: SCN9A; (-) strand; PAM type: NRG; PAM sequence: AAG
gatagtagaattaaatttca

SEQ ID NO: 33352 - DNA, 20 bp, Artificial Sequence
  Description of Artificial Sequence: Synthetic oligonucleotide
  Target: SCN9A; (-) strand; PAM type: NRG; PAM sequence: TAG
tatgctacctctctagatag

SEQ ID NO: 33353 - DNA, 20 bp, Artificial Sequence
  Description of Artificial Sequence: Synthetic oligonucleotide
  Target: SCN9A; (-) strand; PAM type: NRG; PAM sequence: TAG
caatatgctacctctctaga

SEQ ID NO: 33354 - DNA, 20 bp, Artificial Sequence
  Description of Artificial Sequence: Synthetic oligonucleotide
  Target: SCN9A; (-) strand; PAM type: NRG; PAM sequence: TAG
cctacaatatgctacctctc

SEQ ID NO: 33355 - DNA, 20 bp, Artificial Sequence
  Description of Artificial Sequence: Synthetic oligonucleotide
  Target: SCN9A; (-) strand; PAM type: NRG; PAM sequence: TGG
agagtggtaaagccaacatt

SEQ ID NO: 33356 - DNA, 20 bp, Artificial Sequence
  Description of Artificial Sequence: Synthetic oligonucleotide
  Target: SCN9A; (-) strand; PAM type: NRG; PAM sequence: AAG
aggttcatacaagagtggta

SEQ ID NO: 33357 - DNA, 20 bp, Artificial Sequence
  Description of Artificial Sequence: Synthetic oligonucleotide
  Target: SCN9A; (-) strand; PAM type: NRG; PAM sequence: TGG
tactcaggttcatacaagag

SEQ ID NO: 33358 - DNA, 20 bp, Artificial Sequence
  Description of Artificial Sequence: Synthetic oligonucleotide
  Target: SCN9A; (-) strand; PAM type: NRG; PAM sequence: GAG
atttactcaggttcatacaa

SEQ ID NO: 33359 - DNA, 20 bp, Artificial Sequence
  Description of Artificial Sequence: Synthetic oligonucleotide
  Target: SCN9A; (-) strand; PAM type: NRG; PAM sequence: AAG
tcatttactcaggttcatac

SEQ ID NO: 33360 - DNA, 20 bp, Artificial Sequence
  Description of Artificial Sequence: Synthetic oligonucleotide
  Target: SCN9A; (-) strand; PAM type: NRG; PAM sequence: AGG
tgaggttaaatcatttactc

SEQ ID NO: 33361 - DNA, 20 bp, Artificial Sequence
  Description of Artificial Sequence: Synthetic oligonucleotide
  Target: SCN9A; (-) strand; PAM type: NRG; PAM sequence: CAG
ctgaggttaaatcatttact

SEQ ID NO: 33362 - DNA, 20 bp, Artificial Sequence
  Description of Artificial Sequence: Synthetic oligonucleotide
  Target: SCN9A; (-) strand; PAM type: NRG; PAM sequence: AGG
aataggagacatagttcctg

SEQ ID NO: 33363 - DNA, 20 bp, Artificial Sequence
  Description of Artificial Sequence: Synthetic oligonucleotide
  Target: SCN9A; (-) strand; PAM type: NRG; PAM sequence: GAG
aaataggagacatagttcct

SEQ ID NO: 33364 - DNA, 20 bp, Artificial Sequence
  Description of Artificial Sequence: Synthetic oligonucleotide
  Target: SCN9A; (-) strand; PAM type: NRG; PAM sequence: TAG
caccagtgaaataggagaca

SEQ ID NO: 33365 - DNA, 20 bp, Artificial Sequence
  Description of Artificial Sequence: Synthetic oligonucleotide
  Target: SCN9A; (-) strand; PAM type: NRG; PAM sequence: GAG
cttcctcaccagtgaaatag

SEQ ID NO: 33366 - DNA, 20 bp, Artificial Sequence
  Description of Artificial Sequence: Synthetic oligonucleotide
  Target: SCN9A; (-) strand; PAM type: NRG; PAM sequence: AGG
aacttcctcaccagtgaaat

SEQ ID NO: 33367 - DNA, 20 bp, Artificial Sequence
  Description of Artificial Sequence: Synthetic oligonucleotide
  Target: SCN9A; (-) strand; PAM type: NRG; PAM sequence: TAG
taacttcctcaccagtgaaa

SEQ ID NO: 33368 - DNA, 20 bp, Artificial Sequence
  Description of Artificial Sequence: Synthetic oligonucleotide
  Target: SCN9A; (-) strand; PAM type: NRG; PAM sequence: CAG
tacccgtgtaacttcctcac

SEQ ID NO: 33369 - DNA, 20 bp, Artificial Sequence
  Description of Artificial Sequence: Synthetic oligonucleotide
  Target: SCN9A; (-) strand; PAM type: NRG; PAM sequence: CAG
acttcatcccctctttctaa

SEQ ID NO: 33370 - DNA, 20 bp, Artificial Sequence
  Description of Artificial Sequence: Synthetic oligonucleotide
  Target: SCN9A; (-) strand; PAM type: NRG; PAM sequence: AGG
ctgtagagtaaaccctagcc

SEQ ID NO: 33371 - DNA, 20 bp, Artificial Sequence
  Description of Artificial Sequence: Synthetic oligonucleotide
  Target: SCN9A; (-) strand; PAM type: NRG; PAM sequence: CAG
actgtagagtaaaccctagc

SEQ ID NO: 33372 - DNA, 20 bp, Artificial Sequence
  Description of Artificial Sequence: Synthetic oligonucleotide
  Target: SCN9A; (-) strand; PAM type: NRG; PAM sequence: TAG
taatactgtagagtaaaccc

SEQ ID NO: 33373 - DNA, 20 bp, Artificial Sequence
  Description of Artificial Sequence: Synthetic oligonucleotide
  Target: SCN9A; (-) strand; PAM type: NRG; PAM sequence: GAG
tttcaagctgtaatactgta

SEQ ID NO: 33374 - DNA, 20 bp, Artificial Sequence
  Description of Artificial Sequence: Synthetic oligonucleotide
  Target: SCN9A; (-) strand; PAM type: NRG; PAM sequence: TAG
gttttcaagctgtaatactg

SEQ ID NO: 33375 - DNA, 20 bp, Artificial Sequence
  Description of Artificial Sequence: Synthetic oligonucleotide
  Target: SCN9A; (-) strand; PAM type: NRG; PAM sequence: AAG
tttctcttttctttgttttc

SEQ ID NO: 33376 - DNA, 20 bp, Artificial Sequence
  Description of Artificial Sequence: Synthetic oligonucleotide
  Target: SCN9A; (-) strand; PAM type: NRG; PAM sequence: TGG
ctcattttcattaaggagac

SEQ ID NO: 33377 - DNA, 20 bp, Artificial Sequence
  Description of Artificial Sequence: Synthetic oligonucleotide
  Target: SCN9A; (-) strand; PAM type: NRG; PAM sequence: GAG
cttcactcattttcattaag

SEQ ID NO: 33378 - DNA, 20 bp, Artificial Sequence
  Description of Artificial Sequence: Synthetic oligonucleotide
  Target: SCN9A; (-) strand; PAM type: NRG; PAM sequence: AGG
gtcttcactcattttcatta

SEQ ID NO: 33379 - DNA, 20 bp, Artificial Sequence
  Description of Artificial Sequence: Synthetic oligonucleotide
  Target: SCN9A; (-) strand; PAM type: NRG; PAM sequence: AAG
tgtcttcactcattttcatt

SEQ ID NO: 33380 - DNA, 20 bp, Artificial Sequence
  Description of Artificial Sequence: Synthetic oligonucleotide
  Target: SCN9A; (-) strand; PAM type: NRG; PAM sequence: AGG
ttcccaagatgtgttatttg

SEQ ID NO: 33381 - DNA, 20 bp, Artificial Sequence
  Description of Artificial Sequence: Synthetic oligonucleotide
  Target: SCN9A; (-) strand; PAM type: NRG; PAM sequence: GAG
cttcccaagatgtgttattt

SEQ ID NO: 33382 - DNA, 20 bp, Artificial Sequence
  Description of Artificial Sequence: Synthetic oligonucleotide
  Target: SCN9A; (-) strand; PAM type: NRG; PAM sequence: AAG
tttctgagtacattcttccc

SEQ ID NO: 33383 - DNA, 20 bp, Artificial Sequence
  Description of Artificial Sequence: Synthetic oligonucleotide
  Target: SCN9A; (-) strand; PAM type: NRG; PAM sequence: GAG
ttataaattataaaatttct

SEQ ID NO: 33384 - DNA, 20 bp, Artificial Sequence
  Description of Artificial Sequence: Synthetic oligonucleotide
  Target: SCN9A; (-) strand; PAM type: NRG; PAM sequence: CAG
aaattatagattatatttct

SEQ ID NO: 33385 - DNA, 20 bp, Artificial Sequence
  Description of Artificial Sequence: Synthetic oligonucleotide
  Target: SCN9A; (-) strand; PAM type: NRG; PAM sequence: TAG
caaatagtcgatataaatta

SEQ ID NO: 33386 - DNA, 20 bp, Artificial Sequence
  Description of Artificial Sequence: Synthetic oligonucleotide
  Target: SCN9A; (-) strand; PAM type: NRG; PAM sequence: TAG
gaaagaaaacccatgtcaaa

SEQ ID NO: 33387 - DNA, 20 bp, Artificial Sequence
  Description of Artificial Sequence: Synthetic oligonucleotide
  Target: SCN9A; (-) strand; PAM type: NRG; PAM sequence: AAG
gttaaaatggcatgttttga

SEQ ID NO: 33388 - DNA, 20 bp, Artificial Sequence
  Description of Artificial Sequence: Synthetic oligonucleotide
  Target: SCN9A; (-) strand; PAM type: NRG; PAM sequence: TGG
tagatatgtcaatgttaaaa

SEQ ID NO: 33389 - DNA, 20 bp, Artificial Sequence
  Description of Artificial Sequence: Synthetic oligonucleotide
  Target: SCN9A; (-) strand; PAM type: NRG; PAM sequence: TAG
tgtacttgaccttcaagtaa

SEQ ID NO: 33390 - DNA, 20 bp, Artificial Sequence
  Description of Artificial Sequence: Synthetic oligonucleotide
  Target: SCN9A; (-) strand; PAM type: NRG; PAM sequence: AAG
tgcacttgtacttgaccttc

SEQ ID NO: 33391 - DNA, 20 bp, Artificial Sequence
  Description of Artificial Sequence: Synthetic oligonucleotide
  Target: SCN9A; (-) strand; PAM type: NRG; PAM sequence: TGG
atcaatgtggaaacactatt

SEQ ID NO: 33392 - DNA, 20 bp, Artificial Sequence
  Description of Artificial Sequence: Synthetic oligonucleotide
  Target: SCN9A; (-) strand; PAM type: NRG; PAM sequence: TGG
aagtagttttgcaatcaatg

SEQ ID NO: 33393 - DNA, 20 bp, Artificial Sequence
  Description of Artificial Sequence: Synthetic oligonucleotide
  Target: SCN9A; (-) strand; PAM type: NRG; PAM sequence: TAG
aagtaaaactgagtgaaaag

SEQ ID NO: 33394 - DNA, 20 bp, Artificial Sequence
  Description of Artificial Sequence: Synthetic oligonucleotide
  Target: SCN9A; (-) strand; PAM type: NRG; PAM sequence: AAG
agaaagtaaaactgagtgaa

SEQ ID NO: 33395 - DNA, 20 bp, Artificial Sequence
  Description of Artificial Sequence: Synthetic oligonucleotide
  Target: SCN9A; (-) strand; PAM type: NRG; PAM sequence: GAG
gtagttgagaaagtaaaact

SEQ ID NO: 33396 - DNA, 20 bp, Artificial Sequence
  Description of Artificial Sequence: Synthetic oligonucleotide
  Target: SCN9A; (-) strand; PAM type: NRG; PAM sequence: AAG
atcagtagtagtagttgaga

SEQ ID NO: 33397 - DNA, 20 bp, Artificial Sequence
  Description of Artificial Sequence: Synthetic oligonucleotide
  Target: SCN9A; (-) strand; PAM type: NRG; PAM sequence: GAG
aagaatcagtagtagtagtt

SEQ ID NO: 33398 - DNA, 20 bp, Artificial Sequence
  Description of Artificial Sequence: Synthetic oligonucleotide
  Target: SCN9A; (-) strand; PAM type: NRG; PAM sequence: TAG
aaaccaagaatcagtagtag

SEQ ID NO: 33399 - DNA, 20 bp, Artificial Sequence
  Description of Artificial Sequence: Synthetic oligonucleotide
  Target: SCN9A; (-) strand; PAM type: NRG; PAM sequence: TAG
caaaaaccaagaatcagtag

SEQ ID NO: 33400 - DNA, 20 bp, Artificial Sequence
  Description of Artificial Sequence: Synthetic oligonucleotide
  Target: SCN9A; (-) strand; PAM type: NRG; PAM sequence: TAG
attcaaaaaccaagaatcag

SEQ ID NO: 33401 - DNA, 20 bp, Artificial Sequence
  Description of Artificial Sequence: Synthetic oligonucleotide
  Target: SCN9A; (-) strand; PAM type: NRG; PAM sequence: CAG
aaaattcaaaaaccaagaat

SEQ ID NO: 33402 - DNA, 20 bp, Artificial Sequence
  Description of Artificial Sequence: Synthetic oligonucleotide
  Target: SCN9A; (-) strand; PAM type: NRG; PAM sequence: AAG
ttttaaaaaattcaaaaacc

SEQ ID NO: 33403 - DNA, 20 bp, Artificial Sequence
  Description of Artificial Sequence: Synthetic oligonucleotide
  Target: SCN9A; (-) strand; PAM type: NRG; PAM sequence: AAG
gactaagtcttaacgattag

SEQ ID NO: 33404 - DNA, 20 bp, Artificial Sequence
  Description of Artificial Sequence: Synthetic oligonucleotide
  Target: SCN9A; (-) strand; PAM type: NRG; PAM sequence: TAG
gaggactaagtcttaacgat

SEQ ID NO: 33405 - DNA, 20 bp, Artificial Sequence
  Description of Artificial Sequence: Synthetic oligonucleotide
  Target: SCN9A; (-) strand; PAM type: NRG; PAM sequence: AAG
tgtgatatgattagaggact

SEQ ID NO: 33406 - DNA, 20 bp, Artificial Sequence
  Description of Artificial Sequence: Synthetic oligonucleotide
  Target: SCN9A; (-) strand; PAM type: NRG; PAM sequence: AGG
aaacgttgtgatatgattag

SEQ ID NO: 33407 - DNA, 20 bp, Artificial Sequence
  Description of Artificial Sequence: Synthetic oligonucleotide
  Target: SCN9A; (-) strand; PAM type: NRG; PAM sequence: GAG
aaaacgttgtgatatgatta

SEQ ID NO: 33408 - DNA, 20 bp, Artificial Sequence
  Description of Artificial Sequence: Synthetic oligonucleotide
  Target: SCN9A; (-) strand; PAM type: NRG; PAM sequence: TAG
agaaaacgttgtgatatgat

SEQ ID NO: 33409 - DNA, 20 bp, Artificial Sequence
  Description of Artificial Sequence: Synthetic oligonucleotide
  Target: SCN9A; (-) strand; PAM type: NRG; PAM sequence: AAG
gaaaaaaagaaagagaaaga

SEQ ID NO: 33410 - DNA, 20 bp, Artificial Sequence
  Description of Artificial Sequence: Synthetic oligonucleotide
  Target: SCN9A; (-) strand; PAM type: NRG; PAM sequence: AAG
gaaagaaaaaaagaaagaga

SEQ ID NO: 33411 - DNA, 20 bp, Artificial Sequence
  Description of Artificial Sequence: Synthetic oligonucleotide
  Target: SCN9A; (-) strand; PAM type: NRG; PAM sequence: GAG
gaaagaaagaaaaaaagaaa

SEQ ID NO: 33412 - DNA, 20 bp, Artificial Sequence
  Description of Artificial Sequence: Synthetic oligonucleotide
  Target: SCN9A; (-) strand; PAM type: NRG; PAM sequence: AAG
aagaaagaaagaaaaaaaga

SEQ ID NO: 33413 - DNA, 20 bp, Artificial Sequence
  Description of Artificial Sequence: Synthetic oligonucleotide
  Target: SCN9A; (-) strand; PAM type: NRG; PAM sequence: AAG
aagaaagaaagaaagaaaaa

SEQ ID NO: 33414 - DNA, 20 bp, Artificial Sequence
  Description of Artificial Sequence: Synthetic oligonucleotide
  Target: SCN9A; (-) strand; PAM type: NRG; PAM sequence: AAG
ggaaggaaaagaaagaaaga

SEQ ID NO: 33415 - DNA, 20 bp, Artificial Sequence
  Description of Artificial Sequence: Synthetic oligonucleotide
  Target: SCN9A; (-) strand; PAM type: NRG; PAM sequence: AAG
ggaaggaaggaaaagaaaga

SEQ ID NO: 33416 - DNA, 20 bp, Artificial Sequence
  Description of Artificial Sequence: Synthetic oligonucleotide
  Target: SCN9A; (-) strand; PAM type: NRG; PAM sequence: AAG
agagggaaggaaggaaaaga

SEQ ID NO: 33417 - DNA, 20 bp, Artificial Sequence
  Description of Artificial Sequence: Synthetic oligonucleotide
  Target: SCN9A; (-) strand; PAM type: NRG; PAM sequence: AAG
ggagagagggaaggaaggaa

SEQ ID NO: 33418 - DNA, 20 bp, Artificial Sequence
  Description of Artificial Sequence: Synthetic oligonucleotide
  Target: SCN9A; (-) strand; PAM type: NRG; PAM sequence: AGG
agaaaggagagagggaagga

SEQ ID NO: 33419 - DNA, 20 bp, Artificial Sequence
  Description of Artificial Sequence: Synthetic oligonucleotide
  Target: SCN9A; (-) strand; PAM type: NRG; PAM sequence: AAG
aagaaaggagagagggaagg

SEQ ID NO: 33420 - DNA, 20 bp, Artificial Sequence
  Description of Artificial Sequence: Synthetic oligonucleotide
  Target: SCN9A; (-) strand; PAM type: NRG; PAM sequence: AGG
gaaaagaaaggagagaggga

SEQ ID NO: 33421 - DNA, 20 bp, Artificial Sequence
  Description of Artificial Sequence: Synthetic oligonucleotide
  Target: SCN9A; (-) strand; PAM type: NRG; PAM sequence: AAG
agaaaagaaaggagagaggg

SEQ ID NO: 33422 - DNA, 20 bp, Artificial Sequence
  Description of Artificial Sequence: Synthetic oligonucleotide
  Target: SCN9A; (-) strand; PAM type: NRG; PAM sequence: GGG
gaaagaaaagaaaggagaga

SEQ ID NO: 33423 - DNA, 20 bp, Artificial Sequence
  Description of Artificial Sequence: Synthetic oligonucleotide
  Target: SCN9A; (-) strand; PAM type: NRG; PAM sequence: AGG
ggaaagaaaagaaaggagag

SEQ ID NO: 33424 - DNA, 20 bp, Artificial Sequence
  Description of Artificial Sequence: Synthetic oligonucleotide
  Target: SCN9A; (-) strand; PAM type: NRG; PAM sequence: GAG
gggaaagaaaagaaaggaga

SEQ ID NO: 33425 - DNA, 20 bp, Artificial Sequence
  Description of Artificial Sequence: Synthetic oligonucleotide
  Target: SCN9A; (-) strand; PAM type: NRG; PAM sequence: GAG
aagggaaagaaaagaaagga

SEQ ID NO: 33426 - DNA, 20 bp, Artificial Sequence
  Description of Artificial Sequence: Synthetic oligonucleotide
  Target: SCN9A; (-) strand; PAM type: NRG; PAM sequence: GAG
gaaagggaaagaaaagaaag

SEQ ID NO: 33427 - DNA, 20 bp, Artificial Sequence
  Description of Artificial Sequence: Synthetic oligonucleotide
  Target: SCN9A; (-) strand; PAM type: NRG; PAM sequence: AGG
aagaaagggaaagaaaagaa

SEQ ID NO: 33428 - DNA, 20 bp, Artificial Sequence
  Description of Artificial Sequence: Synthetic oligonucleotide
  Target: SCN9A; (-) strand; PAM type: NRG; PAM sequence: AAG
aaagaaagggaaagaaaaga

SEQ ID NO: 33429 - DNA, 20 bp, Artificial Sequence
  Description of Artificial Sequence: Synthetic oligonucleotide
  Target: SCN9A; (-) strand; PAM type: NRG; PAM sequence: AAG
aaagaaagaaagggaaagaa

SEQ ID NO: 33430 - DNA, 20 bp, Artificial Sequence
  Description of Artificial Sequence: Synthetic oligonucleotide
  Target: SCN9A; (-) strand; PAM type: NRG; PAM sequence: AAG
gaaagaaagaaagaaaggga

SEQ ID NO: 33431 - DNA, 20 bp, Artificial Sequence
  Description of Artificial Sequence: Synthetic oligonucleotide
  Target: SCN9A; (-) strand; PAM type: NRG; PAM sequence: GGG
gaaagaaagaaagaaagaaa

SEQ ID NO: 33432 - DNA, 20 bp, Artificial Sequence
  Description of Artificial Sequence: Synthetic oligonucleotide
  Target: SCN9A; (-) strand; PAM type: NRG; PAM sequence: AGG
agaaagaaagaaagaaagaa

SEQ ID NO: 33433 - DNA, 20 bp, Artificial Sequence
  Description of Artificial Sequence: Synthetic oligonucleotide
  Target: SCN9A; (-) strand; PAM type: NRG; PAM sequence: AAG
aagaaagaaagaaagaaaga

SEQ ID NO: 33434 - DNA, 20 bp, Artificial Sequence
  Description of Artificial Sequence: Synthetic oligonucleotide
  Target: SCN9A; (-) strand; PAM type: NRG; PAM sequence: AAG
aagaaagaaagaaagaaaga

SEQ ID NO: 33435 - DNA, 20 bp, Artificial Sequence
  Description of Artificial Sequence: Synthetic oligonucleotide
  Target: SCN9A; (-) strand; PAM type: NRG; PAM sequence: AAG
aagaaagaaagaaagaaaga

SEQ ID NO: 33436 - DNA, 20 bp, Artificial Sequence
  Description of Artificial Sequence: Synthetic oligonucleotide
  Target: SCN9A; (-) strand; PAM type: NRG; PAM sequence: AAG
aagaaagaaagaaagaaaga

SEQ ID NO: 33437 - DNA, 20 bp, Artificial Sequence
  Description of Artificial Sequence: Synthetic oligonucleotide
  Target: SCN9A; (-) strand; PAM type: NRG; PAM sequence: AAG
aagaaagaaagaaagaaaga

SEQ ID NO: 33438 - DNA, 20 bp, Artificial Sequence
  Description of Artificial Sequence: Synthetic oligonucleotide
  Target: SCN9A; (-) strand; PAM type: NRG; PAM sequence: AAG
aagaaagaaagaaagaaaga

SEQ ID NO: 33439 - DNA, 20 bp, Artificial Sequence
  Description of Artificial Sequence: Synthetic oligonucleotide
  Target: SCN9A; (-) strand; PAM type: NRG; PAM sequence: AAG
aagaaagaaagaaagaaaga

SEQ ID NO: 33440 - DNA, 20 bp, Artificial Sequence
  Description of Artificial Sequence: Synthetic oligonucleotide
  Target: SCN9A; (-) strand; PAM type: NRG; PAM sequence: AAG
aagaaagaaagaaagaaaga

SEQ ID NO: 33441 - DNA, 20 bp, Artificial Sequence
  Description of Artificial Sequence: Synthetic oligonucleotide
  Target: SCN9A; (-) strand; PAM type: NRG; PAM sequence: AAG
aagaaagaaagaaagaaaga

SEQ ID NO: 33442 - DNA, 20 bp, Artificial Sequence
  Description of Artificial Sequence: Synthetic oligonucleotide
  Target: SCN9A; (-) strand; PAM type: NRG; PAM sequence: AAG
aagaaagaaagaaagaaaga

SEQ ID NO: 33443 - DNA, 20 bp, Artificial Sequence
  Description of Artificial Sequence: Synthetic oligonucleotide
  Target: SCN9A; (-) strand; PAM type: NRG; PAM sequence: AAG
aagaaagaaagaaagaaaga

SEQ ID NO: 33444 - DNA, 20 bp, Artificial Sequence
  Description of Artificial Sequence: Synthetic oligonucleotide
  Target: SCN9A; (-) strand; PAM type: NRG; PAM sequence: AAG
gaaaaagaaagaaagaaaga

SEQ ID NO: 33445 - DNA, 20 bp, Artificial Sequence
  Description of Artificial Sequence: Synthetic oligonucleotide
  Target: SCN9A; (-) strand; PAM type: NRG; PAM sequence: AAG
gaaagaaaaagaaagaaaga

SEQ ID NO: 33446 - DNA, 20 bp, Artificial Sequence
  Description of Artificial Sequence: Synthetic oligonucleotide
  Target: SCN9A; (-) strand; PAM type: NRG; PAM sequence: AAG
gaaagaaagaaaaagaaaga

SEQ ID NO: 33447 - DNA, 20 bp, Artificial Sequence
  Description of Artificial Sequence: Synthetic oligonucleotide
  Target: SCN9A; (-) strand; PAM type: NRG; PAM sequence: AAG
gaaagaaagaaagaaaaaga

SEQ ID NO: 33448 - DNA, 20 bp, Artificial Sequence
  Description of Artificial Sequence: Synthetic oligonucleotide
  Target: SCN9A; (-) strand; PAM type: NRG; PAM sequence: AAG
aaaggaaagaaagaaagaaa

SEQ ID NO: 33449 - DNA, 20 bp, Artificial Sequence
  Description of Artificial Sequence: Synthetic oligonucleotide
  Target: SCN9A; (-) strand; PAM type: NRG; PAM sequence: AAG
gaagagaaaggaaagaaaga

SEQ ID NO: 33450 - DNA, 20 bp, Artificial Sequence
  Description of Artificial Sequence: Synthetic oligonucleotide
  Target: SCN9A; (-) strand; PAM type: NRG; PAM sequence: AAG
gaaagaagagaaaggaaaga

SEQ ID NO: 33451 - DNA, 20 bp, Artificial Sequence
  Description of Artificial Sequence: Synthetic oligonucleotide
  Target: SCN9A; (-) strand; PAM type: NRG; PAM sequence: AAG
aaaagaaagaagagaaagga

SEQ ID NO: 33452 - DNA, 20 bp, Artificial Sequence
  Description of Artificial Sequence: Synthetic oligonucleotide
  Target: SCN9A; (-) strand; PAM type: NRG; PAM sequence: AGG
tcaaaaaagaaagaagagaa

SEQ ID NO: 33453 - DNA, 20 bp, Artificial Sequence
  Description of Artificial Sequence: Synthetic oligonucleotide
  Target: SCN9A; (-) strand; PAM type: NRG; PAM sequence: AAG
atcaaaaaagaaagaagaga

SEQ ID NO: 33454 - DNA, 20 bp, Artificial Sequence
  Description of Artificial Sequence: Synthetic oligonucleotide
  Target: SCN9A; (-) strand; PAM type: NRG; PAM sequence: GAG
cactatcaaaaaagaaagaa

SEQ ID NO: 33455 - DNA, 20 bp, Artificial Sequence
  Description of Artificial Sequence: Synthetic oligonucleotide
  Target: SCN9A; (-) strand; PAM type: NRG; PAM sequence: AAG
tacactatcaaaaaagaaag

SEQ ID NO: 33456 - DNA, 20 bp, Artificial Sequence
  Description of Artificial Sequence: Synthetic oligonucleotide
  Target: SCN9A; (-) strand; PAM type: NRG; PAM sequence: AAG
aaatacactatcaaaaaaga

SEQ ID NO: 33457 - DNA, 20 bp, Artificial Sequence
  Description of Artificial Sequence: Synthetic oligonucleotide
  Target: SCN9A; (-) strand; PAM type: NRG; PAM sequence: AAG
acagaaatacactatcaaaa

SEQ ID NO: 33458 - DNA, 20 bp, Artificial Sequence
  Description of Artificial Sequence: Synthetic oligonucleotide
  Target: SCN9A; (-) strand; PAM type: NRG; PAM sequence: CAG
gcactacagcctgggtgaca

SEQ ID NO: 33459 - DNA, 20 bp, Artificial Sequence
  Description of Artificial Sequence: Synthetic oligonucleotide
  Target: SCN9A; (-) strand; PAM type: NRG; PAM sequence: GGG
gcactactgcactacagcct

SEQ ID NO: 33460 - DNA, 20 bp, Artificial Sequence
  Description of Artificial Sequence: Synthetic oligonucleotide
  Target: SCN9A; (-) strand; PAM type: NRG; PAM sequence: TGG
tgcactactgcactacagcc

SEQ ID NO: 33461 - DNA, 20 bp, Artificial Sequence
  Description of Artificial Sequence: Synthetic oligonucleotide
  Target: SCN9A; (-) strand; PAM type: NRG; PAM sequence: CAG
gtcaatgcactactgcacta

SEQ ID NO: 33462 - DNA, 20 bp, Artificial Sequence
  Description of Artificial Sequence: Synthetic oligonucleotide
  Target: SCN9A; (-) strand; PAM type: NRG; PAM sequence: GAG
ccagaggtggaggctgcagt

SEQ ID NO: 33463 - DNA, 20 bp, Artificial Sequence
  Description of Artificial Sequence: Synthetic oligonucleotide
  Target: SCN9A; (-) strand; PAM type: NRG; PAM sequence: CAG
aatcccagaggtggaggctg

SEQ ID NO: 33464 - DNA, 20 bp, Artificial Sequence
  Description of Artificial Sequence: Synthetic oligonucleotide
  Target: SCN9A; (-) strand; PAM type: NRG; PAM sequence: AGG
cacttgaatcccagaggtgg

SEQ ID NO: 33465 - DNA, 20 bp, Artificial Sequence
  Description of Artificial Sequence: Synthetic oligonucleotide
  Target: SCN9A; (-) strand; PAM type: NRG; PAM sequence: GAG
tcacttgaatcccagaggtg

SEQ ID NO: 33466 - DNA, 20 bp, Artificial Sequence
  Description of Artificial Sequence: Synthetic oligonucleotide
  Target: SCN9A; (-) strand; PAM type: NRG; PAM sequence: TGG
ggtcacttgaatcccagagg

SEQ ID NO: 33467 - DNA, 20 bp, Artificial Sequence
  Description of Artificial Sequence: Synthetic oligonucleotide
  Target: SCN9A; (-) strand; PAM type: NRG; PAM sequence: AGG
gagggtcacttgaatcccag

SEQ ID NO: 33468 - DNA, 20 bp, Artificial Sequence
  Description of Artificial Sequence: Synthetic oligonucleotide
  Target: SCN9A; (-) strand; PAM type: NRG; PAM sequence: GAG
ggagggtcacttgaatccca

SEQ ID NO: 33469 - DNA, 20 bp, Artificial Sequence
  Description of Artificial Sequence: Synthetic oligonucleotide
  Target: SCN9A; (-) strand; PAM type: NRG; PAM sequence: CAG
tgggagggtcacttgaatcc

SEQ ID NO: 33470 - DNA, 20 bp, Artificial Sequence
  Description of Artificial Sequence: Synthetic oligonucleotide
  Target: SCN9A; (-) strand; PAM type: NRG; PAM sequence: GGG
cttgagaggctgaggtggga

SEQ ID NO: 33471 - DNA, 20 bp, Artificial Sequence
  Description of Artificial Sequence: Synthetic oligonucleotide
  Target: SCN9A; (-) strand; PAM type: NRG; PAM sequence: AGG
acttgagaggctgaggtggg

SEQ ID NO: 33472 - DNA, 20 bp, Artificial Sequence
  Description of Artificial Sequence: Synthetic oligonucleotide
  Target: SCN9A; (-) strand; PAM type: NRG; PAM sequence: GAG
tacttgagaggctgaggtgg

SEQ ID NO: 33473 - DNA, 20 bp, Artificial Sequence
  Description of Artificial Sequence: Synthetic oligonucleotide
  Target: SCN9A; (-) strand; PAM type: NRG; PAM sequence: GGG
gctacttgagaggctgaggt

SEQ ID NO: 33474 - DNA, 20 bp, Artificial Sequence
  Description of Artificial Sequence: Synthetic oligonucleotide
  Target: SCN9A; (-) strand; PAM type: NRG; PAM sequence: TGG
agctacttgagaggctgagg

SEQ ID NO: 33475 - DNA, 20 bp, Artificial Sequence
  Description of Artificial Sequence: Synthetic oligonucleotide
  Target: SCN9A; (-) strand; PAM type: NRG; PAM sequence: AGG
cctagctacttgagaggctg

SEQ ID NO: 33476 - DNA, 20 bp, Artificial Sequence
  Description of Artificial Sequence: Synthetic oligonucleotide
  Target: SCN9A; (-) strand; PAM type: NRG; PAM sequence: GAG
tcctagctacttgagaggct

SEQ ID NO: 33477 - DNA, 20 bp, Artificial Sequence
  Description of Artificial Sequence: Synthetic oligonucleotide
  Target: SCN9A; (-) strand; PAM type: NRG; PAM sequence: AGG
tgcagtcctagctacttgag

SEQ ID NO: 33478 - DNA, 20 bp, Artificial Sequence
  Description of Artificial Sequence: Synthetic oligonucleotide
  Target: SCN9A; (-) strand; PAM type: NRG; PAM sequence: GAG
ctgcagtcctagctacttga

SEQ ID NO: 33479 - DNA, 20 bp, Artificial Sequence
  Description of Artificial Sequence: Synthetic oligonucleotide
  Target: SCN9A; (-) strand; PAM type: NRG; PAM sequence: GAG
gcctgcagtcctagctactt

SEQ ID NO: 33480 - DNA, 20 bp, Artificial Sequence
  Description of Artificial Sequence: Synthetic oligonucleotide
  Target: SCN9A; (-) strand; PAM type: NRG; PAM sequence: TAG
gtggcgcctgcctgcagtcc

SEQ ID NO: 33481 - DNA, 20 bp, Artificial Sequence
  Description of Artificial Sequence: Synthetic oligonucleotide
  Target: SCN9A; (-) strand; PAM type: NRG; PAM sequence: CAG
ggtgttgtggcgcctgcctg

SEQ ID NO: 33482 - DNA, 20 bp, Artificial Sequence
  Description of Artificial Sequence: Synthetic oligonucleotide
  Target: SCN9A; (-) strand; PAM type: NRG; PAM sequence: TGG
caaaacttagccgggtgttg

SEQ ID NO: 33483 - DNA, 20 bp, Artificial Sequence
  Description of Artificial Sequence: Synthetic oligonucleotide
  Target: SCN9A; (-) strand; PAM type: NRG; PAM sequence: GGG
aaaatagacaaaacttagcc

SEQ ID NO: 33484 - DNA, 20 bp, Artificial Sequence
  Description of Artificial Sequence: Synthetic oligonucleotide
  Target: SCN9A; (-) strand; PAM type: NRG; PAM sequence: CGG
aaaaatagacaaaacttagc

SEQ ID NO: 33485 - DNA, 20 bp, Artificial Sequence
  Description of Artificial Sequence: Synthetic oligonucleotide
  Target: SCN9A; (-) strand; PAM type: NRG; PAM sequence: TAG
tataaaaaatagacaaaact

SEQ ID NO: 33486 - DNA, 20 bp, Artificial Sequence
  Description of Artificial Sequence: Synthetic oligonucleotide
  Target: SCN9A; (-) strand; PAM type: NRG; PAM sequence: TAG
gaccccatttctataaaaaa

SEQ ID NO: 33487 - DNA, 20 bp, Artificial Sequence
  Description of Artificial Sequence: Synthetic oligonucleotide
  Target: SCN9A; (-) strand; PAM type: NRG; PAM sequence: AAG
accagccggggcaacatagt

SEQ ID NO: 33488 - DNA, 20 bp, Artificial Sequence
  Description of Artificial Sequence: Synthetic oligonucleotide
  Target: SCN9A; (-) strand; PAM type: NRG; PAM sequence: TAG
caagaccagccggggcaaca

SEQ ID NO: 33489 - DNA, 20 bp, Artificial Sequence
  Description of Artificial Sequence: Synthetic oligonucleotide
  Target: SCN9A; (-) strand; PAM type: NRG; PAM sequence: GGG
caggagttcaagaccagccg

SEQ ID NO: 33490 - DNA, 20 bp, Artificial Sequence
  Description of Artificial Sequence: Synthetic oligonucleotide
  Target: SCN9A; (-) strand; PAM type: NRG; PAM sequence: GGG
ccaggagttcaagaccagcc

SEQ ID NO: 33491 - DNA, 20 bp, Artificial Sequence
  Description of Artificial Sequence: Synthetic oligonucleotide
  Target: SCN9A; (-) strand; PAM type: NRG; PAM sequence: CGG
cccaggagttcaagaccagc

SEQ ID NO: 33492 - DNA, 20 bp, Artificial Sequence
  Description of Artificial Sequence: Synthetic oligonucleotide
  Target: SCN9A; (-) strand; PAM type: NRG; PAM sequence: CAG
tgagcccaggagttcaagac

SEQ ID NO: 33493 - DNA, 20 bp, Artificial Sequence
  Description of Artificial Sequence: Synthetic oligonucleotide
  Target: SCN9A; (-) strand; PAM type: NRG; PAM sequence: AAG
tcacttgagcccaggagttc

SEQ ID NO: 33494 - DNA, 20 bp, Artificial Sequence
  Description of Artificial Sequence: Synthetic oligonucleotide
  Target: SCN9A; (-) strand; PAM type: NRG; PAM sequence: GAG
ggtggatcacttgagcccag

SEQ ID NO: 33495 - DNA, 20 bp, Artificial Sequence
  Description of Artificial Sequence: Synthetic oligonucleotide
  Target: SCN9A; (-) strand; PAM type: NRG; PAM sequence: AGG
tgggtggatcacttgagccc

SEQ ID NO: 33496 - DNA, 20 bp, Artificial Sequence
  Description of Artificial Sequence: Synthetic oligonucleotide
  Target: SCN9A; (-) strand; PAM type: NRG; PAM sequence: CAG
gtgggtggatcacttgagcc

SEQ ID NO: 33497 - DNA, 20 bp, Artificial Sequence
  Description of Artificial Sequence: Synthetic oligonucleotide
  Target: SCN9A; (-) strand; PAM type: NRG; PAM sequence: GAG
ctgaggtgggtggatcactt

SEQ ID NO: 33498 - DNA, 20 bp, Artificial Sequence
  Description of Artificial Sequence: Synthetic oligonucleotide
  Target: SCN9A; (-) strand; PAM type: NRG; PAM sequence: TGG
ctttgggaggctgaggtggg

SEQ ID NO: 33499 - DNA, 20 bp, Artificial Sequence
  Description of Artificial Sequence: Synthetic oligonucleotide
  Target: SCN9A; (-) strand; PAM type: NRG; PAM sequence: GGG
gcactttgggaggctgaggt

SEQ ID NO: 33500 - DNA, 20 bp, Artificial Sequence
  Description of Artificial Sequence: Synthetic oligonucleotide
  Target: SCN9A; (-) strand; PAM type: NRG; PAM sequence: TGG
agcactttgggaggctgagg

SEQ ID NO: 33501 - DNA, 20 bp, Artificial Sequence
  Description of Artificial Sequence: Synthetic oligonucleotide
  Target: SCN9A; (-) strand; PAM type: NRG; PAM sequence: AGG
cccagcactttgggaggctg

SEQ ID NO: 33502 - DNA, 20 bp, Artificial Sequence
  Description of Artificial Sequence: Synthetic oligonucleotide
  Target: SCN9A; (-) strand; PAM type: NRG; PAM sequence: GAG
tcccagcactttgggaggct

SEQ ID NO: 33503 - DNA, 20 bp, Artificial Sequence
  Description of Artificial Sequence: Synthetic oligonucleotide
  Target: SCN9A; (-) strand; PAM type: NRG; PAM sequence: AGG
tgcaatcccagcactttggg

SEQ ID NO: 33504 - DNA, 20 bp, Artificial Sequence
  Description of Artificial Sequence: Synthetic oligonucleotide
  Target: SCN9A; (-) strand; PAM type: NRG; PAM sequence: GAG
ctgcaatcccagcactttgg

SEQ ID NO: 33505 - DNA, 20 bp, Artificial Sequence
  Description of Artificial Sequence: Synthetic oligonucleotide
  Target: SCN9A; (-) strand; PAM type: NRG; PAM sequence: GGG
gcctgcaatcccagcacttt

SEQ ID NO: 33506 - DNA, 20 bp, Artificial Sequence
  Description of Artificial Sequence: Synthetic oligonucleotide
  Target: SCN9A; (-) strand; PAM type: NRG; PAM sequence: TGG
tgcctgcaatcccagcactt

SEQ ID NO: 33507 - DNA, 20 bp, Artificial Sequence
  Description of Artificial Sequence: Synthetic oligonucleotide
  Target: SCN9A; (-) strand; PAM type: NRG; PAM sequence: CAG
acggctcatgcctgcaatcc

SEQ ID NO: 33508 - DNA, 20 bp, Artificial Sequence
  Description of Artificial Sequence: Synthetic oligonucleotide
  Target: SCN9A; (-) strand; PAM type: NRG; PAM sequence: CGG
aacttcaaagccaggcagga

SEQ ID NO: 33509 - DNA, 20 bp, Artificial Sequence
  Description of Artificial Sequence: Synthetic oligonucleotide
  Target: SCN9A; (-) strand; PAM type: NRG; PAM sequence: AGG
aataaacttcaaagccaggc

SEQ ID NO: 33510 - DNA, 20 bp, Artificial Sequence
  Description of Artificial Sequence: Synthetic oligonucleotide
  Target: SCN9A; (-) strand; PAM type: NRG; PAM sequence: CAG
aaataaacttcaaagccagg

SEQ ID NO: 33511 - DNA, 20 bp, Artificial Sequence
  Description of Artificial Sequence: Synthetic oligonucleotide
  Target: SCN9A; (-) strand; PAM type: NRG; PAM sequence: AGG
aagaaataaacttcaaagcc

SEQ ID NO: 33512 - DNA, 20 bp, Artificial Sequence
  Description of Artificial Sequence: Synthetic oligonucleotide
  Target: SCN9A; (-) strand; PAM type: NRG; PAM sequence: CAG
gaagaaataaacttcaaagc

SEQ ID NO: 33513 - DNA, 20 bp, Artificial Sequence
  Description of Artificial Sequence: Synthetic oligonucleotide
  Target: SCN9A; (-) strand; PAM type: NRG; PAM sequence: AAG
acatgaagaaataaacttca

SEQ ID NO: 33514 - DNA, 20 bp, Artificial Sequence
  Description of Artificial Sequence: Synthetic oligonucleotide
  Target: SCN9A; (-) strand; PAM type: NRG; PAM sequence: AAG
ttggcatatatttgtacatg

SEQ ID NO: 33515 - DNA, 20 bp, Artificial Sequence
  Description of Artificial Sequence: Synthetic oligonucleotide
  Target: SCN9A; (-) strand; PAM type: NRG; PAM sequence: TGG
atacacagctaccatattct

SEQ ID NO: 33516 - DNA, 20 bp, Artificial Sequence
  Description of Artificial Sequence: Synthetic oligonucleotide
  Target: SCN9A; (-) strand; PAM type: NRG; PAM sequence: CAG
taaaatatagaataaataca

SEQ ID NO: 33517 - DNA, 20 bp, Artificial Sequence
  Description of Artificial Sequence: Synthetic oligonucleotide
  Target: SCN9A; (-) strand; PAM type: NRG; PAM sequence: TAG
gcagttataaaaataaaata

SEQ ID NO: 33518 - DNA, 20 bp, Artificial Sequence
  Description of Artificial Sequence: Synthetic oligonucleotide
  Target: SCN9A; (-) strand; PAM type: NRG; PAM sequence: CAG
cataataatacaaagaaatg

SEQ ID NO: 33519 - DNA, 20 bp, Artificial Sequence
  Description of Artificial Sequence: Synthetic oligonucleotide
  Target: SCN9A; (-) strand; PAM type: NRG; PAM sequence: AAG
tcaatgcacataataataca

SEQ ID NO: 33520 - DNA, 20 bp, Artificial Sequence
  Description of Artificial Sequence: Synthetic oligonucleotide
  Target: SCN9A; (-) strand; PAM type: NRG; PAM sequence: TAG
tagttctttagaaaatactt

SEQ ID NO: 33521 - DNA, 20 bp, Artificial Sequence
  Description of Artificial Sequence: Synthetic oligonucleotide
  Target: SCN9A; (-) strand; PAM type: NRG; PAM sequence: TAG
ttccaaaggaaatagttctt

SEQ ID NO: 33522 - DNA, 20 bp, Artificial Sequence
  Description of Artificial Sequence: Synthetic oligonucleotide
  Target: SCN9A; (-) strand; PAM type: NRG; PAM sequence: TAG
agagatatttccaaaggaaa

SEQ ID NO: 33523 - DNA, 20 bp, Artificial Sequence
  Description of Artificial Sequence: Synthetic oligonucleotide
  Target: SCN9A; (-) strand; PAM type: NRG; PAM sequence: AGG
caattaagagatatttccaa

SEQ ID NO: 33524 - DNA, 20 bp, Artificial Sequence
  Description of Artificial Sequence: Synthetic oligonucleotide
  Target: SCN9A; (-) strand; PAM type: NRG; PAM sequence: AAG
tcaattaagagatatttcca

SEQ ID NO: 33525 - DNA, 20 bp, Artificial Sequence
  Description of Artificial Sequence: Synthetic oligonucleotide
  Target: SCN9A; (-) strand; PAM type: NRG; PAM sequence: GAG
aaaaaggtaaggtcaattaa

SEQ ID NO: 33526 - DNA, 20 bp, Artificial Sequence
  Description of Artificial Sequence: Synthetic oligonucleotide
  Target: SCN9A; (-) strand; PAM type: NRG; PAM sequence: AAG
ctaaaaaggtaaggtcaatt

SEQ ID NO: 33527 - DNA, 20 bp, Artificial Sequence
  Description of Artificial Sequence: Synthetic oligonucleotide
  Target: SCN9A; (-) strand; PAM type: NRG; PAM sequence: AGG
acttttcttctaaaaaggta

SEQ ID NO: 33528 - DNA, 20 bp, Artificial Sequence
  Description of Artificial Sequence: Synthetic oligonucleotide
  Target: SCN9A; (-) strand; PAM type: NRG; PAM sequence: AAG
aacttttcttctaaaaaggt

SEQ ID NO: 33529 - DNA, 20 bp, Artificial Sequence
  Description of Artificial Sequence: Synthetic oligonucleotide
  Target: SCN9A; (-) strand; PAM type: NRG; PAM sequence: AGG
tttcaacttttcttctaaaa

SEQ ID NO: 33530 - DNA, 20 bp, Artificial Sequence
  Description of Artificial Sequence: Synthetic oligonucleotide
  Target: SCN9A; (-) strand; PAM type: NRG; PAM sequence: AAG
ttttcaacttttcttctaaa

SEQ ID NO: 33531 - DNA, 20 bp, Artificial Sequence
  Description of Artificial Sequence: Synthetic oligonucleotide
  Target: SCN9A; (-) strand; PAM type: NRG; PAM sequence: CAG
tttccatttgttccccagcc

SEQ ID NO: 33532 - DNA, 20 bp, Artificial Sequence
  Description of Artificial Sequence: Synthetic oligonucleotide
  Target: SCN9A; (-) strand; PAM type: NRG; PAM sequence: CAG
cttattttccatttgttccc

SEQ ID NO: 33533 - DNA, 20 bp, Artificial Sequence
  Description of Artificial Sequence: Synthetic oligonucleotide
  Target: SCN9A; (-) strand; PAM type: NRG; PAM sequence: AAG
attacatacatgatagttaa

SEQ ID NO: 33534 - DNA, 20 bp, Artificial Sequence
  Description of Artificial Sequence: Synthetic oligonucleotide
  Target: SCN9A; (-) strand; PAM type: NRG; PAM sequence: TAG
tcactctattacatacatga

SEQ ID NO: 33535 - DNA, 20 bp, Artificial Sequence
  Description of Artificial Sequence: Synthetic oligonucleotide
  Target: SCN9A; (-) strand; PAM type: NRG; PAM sequence: AAG
gtcattatatagatatgtct

SEQ ID NO: 33536 - DNA, 20 bp, Artificial Sequence
  Description of Artificial Sequence: Synthetic oligonucleotide
  Target: SCN9A; (-) strand; PAM type: NRG; PAM sequence: TAG
taactcaccatgtcattata

SEQ ID NO: 33537 - DNA, 20 bp, Artificial Sequence
  Description of Artificial Sequence: Synthetic oligonucleotide
  Target: SCN9A; (-) strand; PAM type: NRG; PAM sequence: CAG
gagctgtgaaaattataaac

SEQ ID NO: 33538 - DNA, 20 bp, Artificial Sequence
  Description of Artificial Sequence: Synthetic oligonucleotide
  Target: SCN9A; (-) strand; PAM type: NRG; PAM sequence: GAG
gagcattgctatatgtgaaa

SEQ ID NO: 33539 - DNA, 20 bp, Artificial Sequence
  Description of Artificial Sequence: Synthetic oligonucleotide
  Target: SCN9A; (-) strand; PAM type: NRG; PAM sequence: AAG
tagagcattgctatatgtga

SEQ ID NO: 33540 - DNA, 20 bp, Artificial Sequence
  Description of Artificial Sequence: Synthetic oligonucleotide
  Target: SCN9A; (-) strand; PAM type: NRG; PAM sequence: GAG
tctttgcagtttatatttta

SEQ ID NO: 33541 - DNA, 20 bp, Artificial Sequence
  Description of Artificial Sequence: Synthetic oligonucleotide
  Target: SCN9A; (-) strand; PAM type: NRG; PAM sequence: TAG
aatctttgcagtttatattt

SEQ ID NO: 33542 - DNA, 20 bp, Artificial Sequence
  Description of Artificial Sequence: Synthetic oligonucleotide
  Target: SCN9A; (-) strand; PAM type: NRG; PAM sequence: CAG
aaaaatgaaaggaatctttg

SEQ ID NO: 33543 - DNA, 20 bp, Artificial Sequence
  Description of Artificial Sequence: Synthetic oligonucleotide
  Target: SCN9A; (-) strand; PAM type: NRG; PAM sequence: AGG
cctttggtaagaaaaatgaa

SEQ ID NO: 33544 - DNA, 20 bp, Artificial Sequence
  Description of Artificial Sequence: Synthetic oligonucleotide
  Target: SCN9A; (-) strand; PAM type: NRG; PAM sequence: AAG
acctttggtaagaaaaatga

SEQ ID NO: 33545 - DNA, 20 bp, Artificial Sequence
  Description of Artificial Sequence: Synthetic oligonucleotide
  Target: SCN9A; (-) strand; PAM type: NRG; PAM sequence: AAG
atctcaatgtcacctttggt

SEQ ID NO: 33546 - DNA, 20 bp, Artificial Sequence
  Description of Artificial Sequence: Synthetic oligonucleotide
  Target: SCN9A; (-) strand; PAM type: NRG; PAM sequence: TGG
gtaaatctcaatgtcacctt

SEQ ID NO: 33547 - DNA, 20 bp, Artificial Sequence
  Description of Artificial Sequence: Synthetic oligonucleotide
  Target: SCN9A; (-) strand; PAM type: NRG; PAM sequence: AAG
cttaaacatgacttggtaac

SEQ ID NO: 33548 - DNA, 20 bp, Artificial Sequence
  Description of Artificial Sequence: Synthetic oligonucleotide
  Target: SCN9A; (-) strand; PAM type: NRG; PAM sequence: TGG
atgtttccttaaacatgact

SEQ ID NO: 33549 - DNA, 20 bp, Artificial Sequence
  Description of Artificial Sequence: Synthetic oligonucleotide
  Target: SCN9A; (-) strand; PAM type: NRG; PAM sequence: TAG
caaagcctgacttctggtca

SEQ ID NO: 33550 - DNA, 20 bp, Artificial Sequence
  Description of Artificial Sequence: Synthetic oligonucleotide
  Target: SCN9A; (-) strand; PAM type: NRG; PAM sequence: TGG
aaagctcaaagcctgacttc

SEQ ID NO: 33551 - DNA, 20 bp, Artificial Sequence
  Description of Artificial Sequence: Synthetic oligonucleotide
  Target: SCN9A; (-) strand; PAM type: NRG; PAM sequence: AAG
gccactgaactcaaagctca

SEQ ID NO: 33552 - DNA, 20 bp, Artificial Sequence
  Description of Artificial Sequence: Synthetic oligonucleotide
  Target: SCN9A; (-) strand; PAM type: NRG; PAM sequence: AAG
gggagaagccactgaactca

SEQ ID NO: 33553 - DNA, 20 bp, Artificial Sequence
  Description of Artificial Sequence: Synthetic oligonucleotide
  Target: SCN9A; (-) strand; PAM type: NRG; PAM sequence: AAG
tagacggtataaagtgggag

SEQ ID NO: 33554 - DNA, 20 bp, Artificial Sequence
  Description of Artificial Sequence: Synthetic oligonucleotide
  Target: SCN9A; (-) strand; PAM type: NRG; PAM sequence: GAG
tcttagacggtataaagtgg

SEQ ID NO: 33555 - DNA, 20 bp, Artificial Sequence
  Description of Artificial Sequence: Synthetic oligonucleotide
  Target: SCN9A; (-) strand; PAM type: NRG; PAM sequence: GGG
tttcttagacggtataaagt

SEQ ID NO: 33556 - DNA, 20 bp, Artificial Sequence
  Description of Artificial Sequence: Synthetic oligonucleotide
  Target: SCN9A; (-) strand; PAM type: NRG; PAM sequence: TGG
ttttcttagacggtataaag

SEQ ID NO: 33557 - DNA, 20 bp, Artificial Sequence
  Description of Artificial Sequence: Synthetic oligonucleotide
  Target: SCN9A; (-) strand; PAM type: NRG; PAM sequence: AAG
aacttttcttagacggtata

SEQ ID NO: 33558 - DNA, 20 bp, Artificial Sequence
  Description of Artificial Sequence: Synthetic oligonucleotide
  Target: SCN9A; (-) strand; PAM type: NRG; PAM sequence: CGG
tcaaattaacttttcttaga

SEQ ID NO: 33559 - DNA, 20 bp, Artificial Sequence
  Description of Artificial Sequence: Synthetic oligonucleotide
  Target: SCN9A; (-) strand; PAM type: NRG; PAM sequence: TAG
tctatcaaattaacttttct

SEQ ID NO: 33560 - DNA, 20 bp, Artificial Sequence
  Description of Artificial Sequence: Synthetic oligonucleotide
  Target: SCN9A; (-) strand; PAM type: NRG; PAM sequence: AGG
gtgccttttaaaacatctgc

SEQ ID NO: 33561 - DNA, 20 bp, Artificial Sequence
  Description of Artificial Sequence: Synthetic oligonucleotide
  Target: SCN9A; (-) strand; PAM type: NRG; PAM sequence: CAG
agtgccttttaaaacatctg

SEQ ID NO: 33562 - DNA, 20 bp, Artificial Sequence
  Description of Artificial Sequence: Synthetic oligonucleotide
  Target: SCN9A; (-) strand; PAM type: NRG; PAM sequence: TAG
tttaggcatattggctaaac

SEQ ID NO: 33563 - DNA, 20 bp, Artificial Sequence
  Description of Artificial Sequence: Synthetic oligonucleotide
  Target: SCN9A; (-) strand; PAM type: NRG; PAM sequence: TGG
atgtacatatttaggcatat

SEQ ID NO: 33564 - DNA, 20 bp, Artificial Sequence
  Description of Artificial Sequence: Synthetic oligonucleotide
  Target: SCN9A; (-) strand; PAM type: NRG; PAM sequence: AGG
agagacccatgtacatattt

SEQ ID NO: 33565 - DNA, 20 bp, Artificial Sequence
  Description of Artificial Sequence: Synthetic oligonucleotide
  Target: SCN9A; (-) strand; PAM type: NRG; PAM sequence: TAG
aagagacccatgtacatatt

SEQ ID NO: 33566 - DNA, 20 bp, Artificial Sequence
  Description of Artificial Sequence: Synthetic oligonucleotide
  Target: SCN9A; (-) strand; PAM type: NRG; PAM sequence: GAG
tctctttgtggagtcttaaa

SEQ ID NO: 33567 - DNA, 20 bp, Artificial Sequence
  Description of Artificial Sequence: Synthetic oligonucleotide
  Target: SCN9A; (-) strand; PAM type: NRG; PAM sequence: AAG
tgtctctttgtggagtctta

SEQ ID NO: 33568 - DNA, 20 bp, Artificial Sequence
  Description of Artificial Sequence: Synthetic oligonucleotide
  Target: SCN9A; (-) strand; PAM type: NRG; PAM sequence: GAG
cttagcagtgtctctttgtg

SEQ ID NO: 33569 - DNA, 20 bp, Artificial Sequence
  Description of Artificial Sequence: Synthetic oligonucleotide
  Target: SCN9A; (-) strand; PAM type: NRG; PAM sequence: TGG
ctcttagcagtgtctctttg

SEQ ID NO: 33570 - DNA, 20 bp, Artificial Sequence
  Description of Artificial Sequence: Synthetic oligonucleotide
  Target: SCN9A; (-) strand; PAM type: NRG; PAM sequence: CAG
ttgtttccagtaactcttag

SEQ ID NO: 33571 - DNA, 20 bp, Artificial Sequence
  Description of Artificial Sequence: Synthetic oligonucleotide
  Target: SCN9A; (-) strand; PAM type: NRG; PAM sequence: TAG
agtttgtttccagtaactct

SEQ ID NO: 33572 - DNA, 20 bp, Artificial Sequence
  Description of Artificial Sequence: Synthetic oligonucleotide
  Target: SCN9A; (-) strand; PAM type: NRG; PAM sequence: CAG
gagcagctgtagtttgtttc

SEQ ID NO: 33573 - DNA, 20 bp, Artificial Sequence
  Description of Artificial Sequence: Synthetic oligonucleotide
  Target: SCN9A; (-) strand; PAM type: NRG; PAM sequence: TAG
atttattcacagagcagctg

SEQ ID NO: 33574 - DNA, 20 bp, Artificial Sequence
  Description of Artificial Sequence: Synthetic oligonucleotide
  Target: SCN9A; (-) strand; PAM type: NRG; PAM sequence: CAG
ctaagaatttattcacagag

SEQ ID NO: 33575 - DNA, 20 bp, Artificial Sequence
  Description of Artificial Sequence: Synthetic oligonucleotide
  Target: SCN9A; (-) strand; PAM type: NRG; PAM sequence: GAG
gaactaagaatttattcaca

SEQ ID NO: 33576 - DNA, 20 bp, Artificial Sequence
  Description of Artificial Sequence: Synthetic oligonucleotide
  Target: SCN9A; (-) strand; PAM type: NRG; PAM sequence: CAG
gtgaactaagaatttattca

SEQ ID NO: 33577 - DNA, 20 bp, Artificial Sequence
  Description of Artificial Sequence: Synthetic oligonucleotide
  Target: SCN9A; (-) strand; PAM type: NRG; PAM sequence: AAG
tcccacagcaactgtgaact

SEQ ID NO: 33578 - DNA, 20 bp, Artificial Sequence
  Description of Artificial Sequence: Synthetic oligonucleotide
  Target: SCN9A; (-) strand; PAM type: NRG; PAM sequence: CAG
ggatctttcattttttccca

SEQ ID NO: 33579 - DNA, 20 bp, Artificial Sequence
  Description of Artificial Sequence: Synthetic oligonucleotide
  Target: SCN9A; (-) strand; PAM type: NRG; PAM sequence: TGG
aatctcccagactttgtaat

SEQ ID NO: 33580 - DNA, 20 bp, Artificial Sequence
  Description of Artificial Sequence: Synthetic oligonucleotide
  Target: SCN9A; (-) strand; PAM type: NRG; PAM sequence: CAG
actaattataggaaatctcc

SEQ ID NO: 33581 - DNA, 20 bp, Artificial Sequence
  Description of Artificial Sequence: Synthetic oligonucleotide
  Target: SCN9A; (-) strand; PAM type: NRG; PAM sequence: AGG
atataatagcaactaattat

SEQ ID NO: 33582 - DNA, 20 bp, Artificial Sequence
  Description of Artificial Sequence: Synthetic oligonucleotide
  Target: SCN9A; (-) strand; PAM type: NRG; PAM sequence: TAG
aatataatagcaactaatta

SEQ ID NO: 33583 - DNA, 20 bp, Artificial Sequence
  Description of Artificial Sequence: Synthetic oligonucleotide
  Target: SCN9A; (-) strand; PAM type: NRG; PAM sequence: TAG
tcatagcaaaagtaatataa

SEQ ID NO: 33584 - DNA, 20 bp, Artificial Sequence
  Description of Artificial Sequence: Synthetic oligonucleotide
  Target: SCN9A; (-) strand; PAM type: NRG; PAM sequence: AAG
tctgtactgtgtcatagcaa

SEQ ID NO: 33585 - DNA, 20 bp, Artificial Sequence
  Description of Artificial Sequence: Synthetic oligonucleotide
  Target: SCN9A; (-) strand; PAM type: NRG; PAM sequence: TAG
ctttcttctgtactgtgtca

SEQ ID NO: 33586 - DNA, 20 bp, Artificial Sequence
  Description of Artificial Sequence: Synthetic oligonucleotide
  Target: SCN9A; (-) strand; PAM type: NRG; PAM sequence: CAG
aaaataataaagaaatgaaa

SEQ ID NO: 33587 - DNA, 20 bp, Artificial Sequence
  Description of Artificial Sequence: Synthetic oligonucleotide
  Target: SCN9A; (-) strand; PAM type: NRG; PAM sequence: AAG
aagcaattaagaaaataata

SEQ ID NO: 33588 - DNA, 20 bp, Artificial Sequence
  Description of Artificial Sequence: Synthetic oligonucleotide
  Target: SCN9A; (-) strand; PAM type: NRG; PAM sequence: AAG
ctgttagtaaaaaagcaatt

SEQ ID NO: 33589 - DNA, 20 bp, Artificial Sequence
  Description of Artificial Sequence: Synthetic oligonucleotide
  Target: SCN9A; (-) strand; PAM type: NRG; PAM sequence: AAG
gacacaggctgttagtaaaa

SEQ ID NO: 33590 - DNA, 20 bp, Artificial Sequence
  Description of Artificial Sequence: Synthetic oligonucleotide
  Target: SCN9A; (-) strand; PAM type: NRG; PAM sequence: TAG
ttccttgagacacaggctgt

SEQ ID NO: 33591 - DNA, 20 bp, Artificial Sequence
  Description of Artificial Sequence: Synthetic oligonucleotide
  Target: SCN9A; (-) strand; PAM type: NRG; PAM sequence: AGG
gcttggcttccttgagacac

SEQ ID NO: 33592 - DNA, 20 bp, Artificial Sequence
  Description of Artificial Sequence: Synthetic oligonucleotide
  Target: SCN9A; (-) strand; PAM type: NRG; PAM sequence: CAG
ggcttggcttccttgagaca

SEQ ID NO: 33593 - DNA, 20 bp, Artificial Sequence
  Description of Artificial Sequence: Synthetic oligonucleotide
  Target: SCN9A; (-) strand; PAM type: NRG; PAM sequence: GAG
gaatatggcttggcttcctt

SEQ ID NO: 33594 - DNA, 20 bp, Artificial Sequence
  Description of Artificial Sequence: Synthetic oligonucleotide
  Target: SCN9A; (-) strand; PAM type: NRG; PAM sequence: TGG
ttgatgaaatgaatatggct

SEQ ID NO: 33595 - DNA, 20 bp, Artificial Sequence
  Description of Artificial Sequence: Synthetic oligonucleotide
  Target: SCN9A; (-) strand; PAM type: NRG; PAM sequence: TGG
tgttattgatgaaatgaata

SEQ ID NO: 33596 - DNA, 20 bp, Artificial Sequence
  Description of Artificial Sequence: Synthetic oligonucleotide
  Target: SCN9A; (-) strand; PAM type: NRG; PAM sequence: CAG
gtatttcctgaatgaaatga

SEQ ID NO: 33597 - DNA, 20 bp, Artificial Sequence
  Description of Artificial Sequence: Synthetic oligonucleotide
  Target: SCN9A; (-) strand; PAM type: NRG; PAM sequence: AGG
agaatatcctagtattctta

SEQ ID NO: 33598 - DNA, 20 bp, Artificial Sequence
  Description of Artificial Sequence: Synthetic oligonucleotide
  Target: SCN9A; (-) strand; PAM type: NRG; PAM sequence: AAG
cagaatatcctagtattctt

SEQ ID NO: 33599 - DNA, 20 bp, Artificial Sequence
  Description of Artificial Sequence: Synthetic oligonucleotide
  Target: SCN9A; (-) strand; PAM type: NRG; PAM sequence: TAG
taagagagatcagaatatcc

SEQ ID NO: 33600 - DNA, 20 bp, Artificial Sequence
  Description of Artificial Sequence: Synthetic oligonucleotide
  Target: SCN9A; (-) strand; PAM type: NRG; PAM sequence: CAG
caaaacaatataagagagat

SEQ ID NO: 33601 - DNA, 20 bp, Artificial Sequence
  Description of Artificial Sequence: Synthetic oligonucleotide
  Target: SCN9A; (-) strand; PAM type: NRG; PAM sequence: GAG
gcttacaaaacaatataaga

SEQ ID NO: 33602 - DNA, 20 bp, Artificial Sequence
  Description of Artificial Sequence: Synthetic oligonucleotide
  Target: SCN9A; (-) strand; PAM type: NRG; PAM sequence: GAG
atgcttacaaaacaatataa

SEQ ID NO: 33603 - DNA, 20 bp, Artificial Sequence
  Description of Artificial Sequence: Synthetic oligonucleotide
  Target: SCN9A; (-) strand; PAM type: NRG; PAM sequence: AAG
gtatgcttacaaaacaatat

SEQ ID NO: 33604 - DNA, 20 bp, Artificial Sequence
  Description of Artificial Sequence: Synthetic oligonucleotide
  Target: SCN9A; (-) strand; PAM type: NRG; PAM sequence: AAG
atgtattgacattattctgc

SEQ ID NO: 33605 - DNA, 20 bp, Artificial Sequence
  Description of Artificial Sequence: Synthetic oligonucleotide
  Target: SCN9A; (-) strand; PAM type: NRG; PAM sequence: AAG
tgccacacatgcagaaacac

SEQ ID NO: 33606 - DNA, 20 bp, Artificial Sequence
  Description of Artificial Sequence: Synthetic oligonucleotide
  Target: SCN9A; (-) strand; PAM type: NRG; PAM sequence: CAG
aaacatttatgccacacatg

SEQ ID NO: 33607 - DNA, 20 bp, Artificial Sequence
  Description of Artificial Sequence: Synthetic oligonucleotide
  Target: SCN9A; (-) strand; PAM type: NRG; PAM sequence: TAG
tagtatacataataatcaca

SEQ ID NO: 33608 - DNA, 20 bp, Artificial Sequence
  Description of Artificial Sequence: Synthetic oligonucleotide
  Target: SCN9A; (-) strand; PAM type: NRG; PAM sequence: TAG
gacaagacttgggaacaaca

SEQ ID NO: 33609 - DNA, 20 bp, Artificial Sequence
  Description of Artificial Sequence: Synthetic oligonucleotide
  Target: SCN9A; (-) strand; PAM type: NRG; PAM sequence: GGG
atataatcaggacaagactt

SEQ ID NO: 33610 - DNA, 20 bp, Artificial Sequence
  Description of Artificial Sequence: Synthetic oligonucleotide
  Target: SCN9A; (-) strand; PAM type: NRG; PAM sequence: TGG
aatataatcaggacaagact

SEQ ID NO: 33611 - DNA, 20 bp, Artificial Sequence
  Description of Artificial Sequence: Synthetic oligonucleotide
  Target: SCN9A; (-) strand; PAM type: NRG; PAM sequence: AAG
aggtataatataatcaggac

SEQ ID NO: 33612 - DNA, 20 bp, Artificial Sequence
  Description of Artificial Sequence: Synthetic oligonucleotide
  Target: SCN9A; (-) strand; PAM type: NRG; PAM sequence: AGG
atataaggtataatataatc

SEQ ID NO: 33613 - DNA, 20 bp, Artificial Sequence
  Description of Artificial Sequence: Synthetic oligonucleotide
  Target: SCN9A; (-) strand; PAM type: NRG; PAM sequence: CAG
aatataaggtataatataat

SEQ ID NO: 33614 - DNA, 20 bp, Artificial Sequence
  Description of Artificial Sequence: Synthetic oligonucleotide
  Target: SCN9A; (-) strand; PAM type: NRG; PAM sequence: AGG
atcataatttctcaaatata

SEQ ID NO: 33615 - DNA, 20 bp, Artificial Sequence
  Description of Artificial Sequence: Synthetic oligonucleotide
  Target: SCN9A; (-) strand; PAM type: NRG; PAM sequence: AAG
catcataatttctcaaatat

SEQ ID NO: 33616 - DNA, 20 bp, Artificial Sequence
  Description of Artificial Sequence: Synthetic oligonucleotide
  Target: SCN9A; (-) strand; PAM type: NRG; PAM sequence: GGG
tgcgcttttctctatttata

SEQ ID NO: 33617 - DNA, 20 bp, Artificial Sequence
  Description of Artificial Sequence: Synthetic oligonucleotide
  Target: SCN9A; (-) strand; PAM type: NRG; PAM sequence: AGG
gtgcgcttttctctatttat

SEQ ID NO: 33618 - DNA, 20 bp, Artificial Sequence
  Description of Artificial Sequence: Synthetic oligonucleotide
  Target: SCN9A; (-) strand; PAM type: NRG; PAM sequence: TAG
tgtgcgcttttctctattta

SEQ ID NO: 33619 - DNA, 20 bp, Artificial Sequence
  Description of Artificial Sequence: Synthetic oligonucleotide
  Target: SCN9A; (-) strand; PAM type: NRG; PAM sequence: TAG
aatatattattagtattata

SEQ ID NO: 33620 - DNA, 20 bp, Artificial Sequence
  Description of Artificial Sequence: Synthetic oligonucleotide
  Target: SCN9A; (-) strand; PAM type: NRG; PAM sequence: TAG
aagtaaatgcaatatattat

SEQ ID NO: 33621 - DNA, 20 bp, Artificial Sequence
  Description of Artificial Sequence: Synthetic oligonucleotide
  Target: SCN9A; (-) strand; PAM type: NRG; PAM sequence: AAG
aaagattctaaacgatttta

SEQ ID NO: 33622 - DNA, 20 bp, Artificial Sequence
  Description of Artificial Sequence: Synthetic oligonucleotide
  Target: SCN9A; (-) strand; PAM type: NRG; PAM sequence: AAG
tacaaactttaaatagccca

SEQ ID NO: 33623 - DNA, 20 bp, Artificial Sequence
  Description of Artificial Sequence: Synthetic oligonucleotide
  Target: SCN9A; (-) strand; PAM type: NRG; PAM sequence: TAG
ttttttgtacaaactttaaa

SEQ ID NO: 33624 - DNA, 20 bp, Artificial Sequence
  Description of Artificial Sequence: Synthetic oligonucleotide
  Target: SCN9A; (-) strand; PAM type: NRG; PAM sequence: AAG
attggttctattactgattg

SEQ ID NO: 33625 - DNA, 20 bp, Artificial Sequence
  Description of Artificial Sequence: Synthetic oligonucleotide
  Target: SCN9A; (-) strand; PAM type: NRG; PAM sequence: TGG
atggcattcattgactagat

SEQ ID NO: 33626 - DNA, 20 bp, Artificial Sequence
  Description of Artificial Sequence: Synthetic oligonucleotide
  Target: SCN9A; (-) strand; PAM type: NRG; PAM sequence: TAG
tccatatggcattcattgac

SEQ ID NO: 33627 - DNA, 20 bp, Artificial Sequence
  Description of Artificial Sequence: Synthetic oligonucleotide
  Target: SCN9A; (-) strand; PAM type: NRG; PAM sequence: TGG
caaacagggacatctccata

SEQ ID NO: 33628 - DNA, 20 bp, Artificial Sequence
  Description of Artificial Sequence: Synthetic oligonucleotide
  Target: SCN9A; (-) strand; PAM type: NRG; PAM sequence: GGG
tgtcaaaaagtgaccaaaca

SEQ ID NO: 33629 - DNA, 20 bp, Artificial Sequence
  Description of Artificial Sequence: Synthetic oligonucleotide
  Target: SCN9A; (-) strand; PAM type: NRG; PAM sequence: AGG
gtgtcaaaaagtgaccaaac

SEQ ID NO: 33630 - DNA, 20 bp, Artificial Sequence
  Description of Artificial Sequence: Synthetic oligonucleotide
  Target: SCN9A; (-) strand; PAM type: NRG; PAM sequence: CAG
agtgtcaaaaagtgaccaaa

SEQ ID NO: 33631 - DNA, 20 bp, Artificial Sequence
  Description of Artificial Sequence: Synthetic oligonucleotide
  Target: SCN9A; (-) strand; PAM type: NRG; PAM sequence: AAG
gactggcctgcagtgtcaaa

SEQ ID NO: 33632 - DNA, 20 bp, Artificial Sequence
  Description of Artificial Sequence: Synthetic oligonucleotide
  Target: SCN9A; (-) strand; PAM type: NRG; PAM sequence: CAG
aaggggtcatgactggcctg

SEQ ID NO: 33633 - DNA, 20 bp, Artificial Sequence
  Description of Artificial Sequence: Synthetic oligonucleotide
  Target: SCN9A; (-) strand; PAM type: NRG; PAM sequence: TGG
cacattgaaggggtcatgac

SEQ ID NO: 33634 - DNA, 20 bp, Artificial Sequence
  Description of Artificial Sequence: Synthetic oligonucleotide
  Target: SCN9A; (-) strand; PAM type: NRG; PAM sequence: GGG
tgaccattggcacattgaag

SEQ ID NO: 33635 - DNA, 20 bp, Artificial Sequence
  Description of Artificial Sequence: Synthetic oligonucleotide
  Target: SCN9A; (-) strand; PAM type: NRG; PAM sequence: GGG
ttgaccattggcacattgaa

SEQ ID NO: 33636 - DNA, 20 bp, Artificial Sequence
  Description of Artificial Sequence: Synthetic oligonucleotide
  Target: SCN9A; (-) strand; PAM type: NRG; PAM sequence: AGG
gttgaccattggcacattga

SEQ ID NO: 33637 - DNA, 20 bp, Artificial Sequence
  Description of Artificial Sequence: Synthetic oligonucleotide
  Target: SCN9A; (-) strand; PAM type: NRG; PAM sequence: AAG
agttgaccattggcacattg

SEQ ID NO: 33638 - DNA, 20 bp, Artificial Sequence
  Description of Artificial Sequence: Synthetic oligonucleotide
  Target: SCN9A; (-) strand; PAM type: NRG; PAM sequence: TGG
taactgcagtagttgaccat

SEQ ID NO: 33639 - DNA, 20 bp, Artificial Sequence
  Description of Artificial Sequence: Synthetic oligonucleotide
  Target: SCN9A; (-) strand; PAM type: NRG; PAM sequence: TAG
ggcaggaaagctaactgcag

SEQ ID NO: 33640 - DNA, 20 bp, Artificial Sequence
  Description of Artificial Sequence: Synthetic oligonucleotide
  Target: SCN9A; (-) strand; PAM type: NRG; PAM sequence: CAG
aaaggcaggaaagctaactg

SEQ ID NO: 33641 - DNA, 20 bp, Artificial Sequence
  Description of Artificial Sequence: Synthetic oligonucleotide
  Target: SCN9A; (-) strand; PAM type: NRG; PAM sequence: AAG
caccttaaggaaaggcagga

SEQ ID NO: 33642 - DNA, 20 bp, Artificial Sequence
  Description of Artificial Sequence: Synthetic oligonucleotide
  Target: SCN9A; (-) strand; PAM type: NRG; PAM sequence: AGG
ttatcaccttaaggaaaggc

SEQ ID NO: 33643 - DNA, 20 bp, Artificial Sequence
  Description of Artificial Sequence: Synthetic oligonucleotide
  Target: SCN9A; (-) strand; PAM type: NRG; PAM sequence: CAG
attatcaccttaaggaaagg

SEQ ID NO: 33644 - DNA, 20 bp, Artificial Sequence
  Description of Artificial Sequence: Synthetic oligonucleotide
  Target: SCN9A; (-) strand; PAM type: NRG; PAM sequence: AGG
gatattatcaccttaaggaa

SEQ ID NO: 33645 - DNA, 20 bp, Artificial Sequence
  Description of Artificial Sequence: Synthetic oligonucleotide
  Target: SCN9A; (-) strand; PAM type: NRG; PAM sequence: AAG
agatattatcaccttaagga

SEQ ID NO: 33646 - DNA, 20 bp, Artificial Sequence
  Description of Artificial Sequence: Synthetic oligonucleotide
  Target: SCN9A; (-) strand; PAM type: NRG; PAM sequence: AGG
ctatagatattatcacctta

SEQ ID NO: 33647 - DNA, 20 bp, Artificial Sequence
  Description of Artificial Sequence: Synthetic oligonucleotide
  Target: SCN9A; (-) strand; PAM type: NRG; PAM sequence: AAG
cctatagatattatcacctt

SEQ ID NO: 33648 - DNA, 20 bp, Artificial Sequence
  Description of Artificial Sequence: Synthetic oligonucleotide
  Target: SCN9A; (-) strand; PAM type: NRG; PAM sequence: TAG
ggatggaaaacttggtccta

SEQ ID NO: 33649 - DNA, 20 bp, Artificial Sequence
  Description of Artificial Sequence: Synthetic oligonucleotide
  Target: SCN9A; (-) strand; PAM type: NRG; PAM sequence: TGG
aattataaggatggaaaact

SEQ ID NO: 33650 - DNA, 20 bp, Artificial Sequence
  Description of Artificial Sequence: Synthetic oligonucleotide
  Target: SCN9A; (-) strand; PAM type: NRG; PAM sequence: TGG
gtaacacttaattataagga

SEQ ID NO: 33651 - DNA, 20 bp, Artificial Sequence
  Description of Artificial Sequence: Synthetic oligonucleotide
  Target: SCN9A; (-) strand; PAM type: NRG; PAM sequence: AGG
gtttgtaacacttaattata

SEQ ID NO: 33652 - DNA, 20 bp, Artificial Sequence
  Description of Artificial Sequence: Synthetic oligonucleotide
  Target: SCN9A; (-) strand; PAM type: NRG; PAM sequence: AAG
tgtttgtaacacttaattat

SEQ ID NO: 33653 - DNA, 20 bp, Artificial Sequence
  Description of Artificial Sequence: Synthetic oligonucleotide
  Target: SCN9A; (-) strand; PAM type: NRG; PAM sequence: AAG
tttaagccacactataatta

SEQ ID NO: 33654 - DNA, 20 bp, Artificial Sequence
  Description of Artificial Sequence: Synthetic oligonucleotide
  Target: SCN9A; (-) strand; PAM type: NRG; PAM sequence: AAG
taatctttaaaaaacagttt

SEQ ID NO: 33655 - DNA, 20 bp, Artificial Sequence
  Description of Artificial Sequence: Synthetic oligonucleotide
  Target: SCN9A; (-) strand; PAM type: NRG; PAM sequence: CAG
atggtttaatctttaaaaaa

SEQ ID NO: 33656 - DNA, 20 bp, Artificial Sequence
  Description of Artificial Sequence: Synthetic oligonucleotide
  Target: SCN9A; (-) strand; PAM type: NRG; PAM sequence: TGG
aaaattttctctgactctaa

SEQ ID NO: 33657 - DNA, 20 bp, Artificial Sequence
  Description of Artificial Sequence: Synthetic oligonucleotide
  Target: SCN9A; (-) strand; PAM type: NRG; PAM sequence: TAG
actctattctaaacgtgagg

SEQ ID NO: 33658 - DNA, 20 bp, Artificial Sequence
  Description of Artificial Sequence: Synthetic oligonucleotide
  Target: SCN9A; (-) strand; PAM type: NRG; PAM sequence: AGG
gagactctattctaaacgtg

SEQ ID NO: 33659 - DNA, 20 bp, Artificial Sequence
  Description of Artificial Sequence: Synthetic oligonucleotide
  Target: SCN9A; (-) strand; PAM type: NRG; PAM sequence: GAG
ggagactctattctaaacgt

SEQ ID NO: 33660 - DNA, 20 bp, Artificial Sequence
  Description of Artificial Sequence: Synthetic oligonucleotide
  Target: SCN9A; (-) strand; PAM type: NRG; PAM sequence: GAG
gtgatgatcaaaaataattg

SEQ ID NO: 33661 - DNA, 20 bp, Artificial Sequence
  Description of Artificial Sequence: Synthetic oligonucleotide
  Target: SCN9A; (-) strand; PAM type: NRG; PAM sequence: TGG
gggtgatgatcaaaaataat

SEQ ID NO: 33662 - DNA, 20 bp, Artificial Sequence
  Description of Artificial Sequence: Synthetic oligonucleotide
  Target: SCN9A; (-) strand; PAM type: NRG; PAM sequence: GGG
tgctattattgagctggtaa

SEQ ID NO: 33663 - DNA, 20 bp, Artificial Sequence
  Description of Artificial Sequence: Synthetic oligonucleotide
  Target: SCN9A; (-) strand; PAM type: NRG; PAM sequence: AGG
ttgctattattgagctggta

SEQ ID NO: 33664 - DNA, 20 bp, Artificial Sequence
  Description of Artificial Sequence: Synthetic oligonucleotide
  Target: SCN9A; (-) strand; PAM type: NRG; PAM sequence: AAG
attgctattattgagctggt

SEQ ID NO: 33665 - DNA, 20 bp, Artificial Sequence
  Description of Artificial Sequence: Synthetic oligonucleotide
  Target: SCN9A; (-) strand; PAM type: NRG; PAM sequence: TGG
tggtattgctattattgagc

SEQ ID NO: 33666 - DNA, 20 bp, Artificial Sequence
  Description of Artificial Sequence: Synthetic oligonucleotide
  Target: SCN9A; (-) strand; PAM type: NRG; PAM sequence: GAG
ttattggtattgctattatt

SEQ ID NO: 33667 - DNA, 20 bp, Artificial Sequence
  Description of Artificial Sequence: Synthetic oligonucleotide
  Target: SCN9A; (-) strand; PAM type: NRG; PAM sequence: TGG
gggagatcttttattattat

SEQ ID NO: 33668 - DNA, 20 bp, Artificial Sequence
  Description of Artificial Sequence: Synthetic oligonucleotide
  Target: SCN9A; (-) strand; PAM type: NRG; PAM sequence: GAG
catataaattcatttattgg

SEQ ID NO: 33669 - DNA, 20 bp, Artificial Sequence
  Description of Artificial Sequence: Synthetic oligonucleotide
  Target: SCN9A; (-) strand; PAM type: NRG; PAM sequence: GGG
agcatataaattcatttatt

SEQ ID NO: 33670 - DNA, 20 bp, Artificial Sequence
  Description of Artificial Sequence: Synthetic oligonucleotide
  Target: SCN9A; (-) strand; PAM type: NRG; PAM sequence: TGG
aagcatataaattcatttat

SEQ ID NO: 33671 - DNA, 20 bp, Artificial Sequence
  Description of Artificial Sequence: Synthetic oligonucleotide
  Target: SCN9A; (-) strand; PAM type: NRG; PAM sequence: AAG
tagattgtttataatttagc

SEQ ID NO: 33672 - DNA, 20 bp, Artificial Sequence
  Description of Artificial Sequence: Synthetic oligonucleotide
  Target: SCN9A; (-) strand; PAM type: NRG; PAM sequence: TAG
tgtgtagattgtttataatt

SEQ ID NO: 33673 - DNA, 20 bp, Artificial Sequence
  Description of Artificial Sequence: Synthetic oligonucleotide
  Target: SCN9A; (-) strand; PAM type: NRG; PAM sequence: TAG
tatgttttacactgcatgtg

SEQ ID NO: 33674 - DNA, 20 bp, Artificial Sequence
  Description of Artificial Sequence: Synthetic oligonucleotide
  Target: SCN9A; (-) strand; PAM type: NRG; PAM sequence: TAG
aataatgataaaataaaaaa

SEQ ID NO: 33675 - DNA, 20 bp, Artificial Sequence
  Description of Artificial Sequence: Synthetic oligonucleotide
  Target: SCN9A; (-) strand; PAM type: NRG; PAM sequence: TAG
attcaagatcaaggtaatga

SEQ ID NO: 33676 - DNA, 20 bp, Artificial Sequence
  Description of Artificial Sequence: Synthetic oligonucleotide
  Target: SCN9A; (-) strand; PAM type: NRG; PAM sequence: AGG
ttcaattttattcaagatca

SEQ ID NO: 33677 - DNA, 20 bp, Artificial Sequence
  Description of Artificial Sequence: Synthetic oligonucleotide
  Target: SCN9A; (-) strand; PAM type: NRG; PAM sequence: AAG
tttcaattttattcaagatc

SEQ ID NO: 33678 - DNA, 20 bp, Artificial Sequence
  Description of Artificial Sequence: Synthetic oligonucleotide
  Target: SCN9A; (-) strand; PAM type: NRG; PAM sequence: AAG
taaaagtttcaattttattc

SEQ ID NO: 33679 - DNA, 20 bp, Artificial Sequence
  Description of Artificial Sequence: Synthetic oligonucleotide
  Target: SCN9A; (-) strand; PAM type: NRG; PAM sequence: AAG
gtcttcattcttatctttaa

SEQ ID NO: 33680 - DNA, 20 bp, Artificial Sequence
  Description of Artificial Sequence: Synthetic oligonucleotide
  Target: SCN9A; (-) strand; PAM type: NRG; PAM sequence: GAG
acctaagaacaatgctggaa

SEQ ID NO: 33681 - DNA, 20 bp, Artificial Sequence
  Description of Artificial Sequence: Synthetic oligonucleotide
  Target: SCN9A; (-) strand; PAM type: NRG; PAM sequence: AAG
acacctaagaacaatgctgg

SEQ ID NO: 33682 - DNA, 20 bp, Artificial Sequence
  Description of Artificial Sequence: Synthetic oligonucleotide
  Target: SCN9A; (-) strand; PAM type: NRG; PAM sequence: TGG
tgcacacctaagaacaatgc

SEQ ID NO: 33683 - DNA, 20 bp, Artificial Sequence
  Description of Artificial Sequence: Synthetic oligonucleotide
  Target: SCN9A; (-) strand; PAM type: NRG; PAM sequence: AAG
aaagttgaatatgcacacct

SEQ ID NO: 33684 - DNA, 20 bp, Artificial Sequence
  Description of Artificial Sequence: Synthetic oligonucleotide
  Target: SCN9A; (-) strand; PAM type: NRG; PAM sequence: AAG
ggcataatctgtggtttcca

SEQ ID NO: 33685 - DNA, 20 bp, Artificial Sequence
  Description of Artificial Sequence: Synthetic oligonucleotide
  Target: SCN9A; (-) strand; PAM type: NRG; PAM sequence: TGG
tatgcaaagggcataatctg

SEQ ID NO: 33686 - DNA, 20 bp, Artificial Sequence
  Description of Artificial Sequence: Synthetic oligonucleotide
  Target: SCN9A; (-) strand; PAM type: NRG; PAM sequence: GGG
tggtggtggatgtatgcaaa

SEQ ID NO: 33687 - DNA, 20 bp, Artificial Sequence
  Description of Artificial Sequence: Synthetic oligonucleotide
  Target: SCN9A; (-) strand; PAM type: NRG; PAM sequence: AGG
ttggtggtggatgtatgcaa

SEQ ID NO: 33688 - DNA, 20 bp, Artificial Sequence
  Description of Artificial Sequence: Synthetic oligonucleotide
  Target: SCN9A; (-) strand; PAM type: NRG; PAM sequence: AAG
tttggtggtggatgtatgca

SEQ ID NO: 33689 - DNA, 20 bp, Artificial Sequence
  Description of Artificial Sequence: Synthetic oligonucleotide
  Target: SCN9A; (-) strand; PAM type: NRG; PAM sequence: TGG
ctccagggaagctttggtgg

SEQ ID NO: 33690 - DNA, 20 bp, Artificial Sequence
  Description of Artificial Sequence: Synthetic oligonucleotide
  Target: SCN9A; (-) strand; PAM type: NRG; PAM sequence: TGG
gttctccagggaagctttgg

SEQ ID NO: 33691 - DNA, 20 bp, Artificial Sequence
  Description of Artificial Sequence: Synthetic oligonucleotide
  Target: SCN9A; (-) strand; PAM type: NRG; PAM sequence: TGG
tgagttctccagggaagctt

SEQ ID NO: 33692 - DNA, 20 bp, Artificial Sequence
  Description of Artificial Sequence: Synthetic oligonucleotide
  Target: SCN9A; (-) strand; PAM type: NRG; PAM sequence: AAG
tttgcctgagttctccaggg

SEQ ID NO: 33693 - DNA, 20 bp, Artificial Sequence
  Description of Artificial Sequence: Synthetic oligonucleotide
  Target: SCN9A; (-) strand; PAM type: NRG; PAM sequence: GGG
atgtttgcctgagttctcca

SEQ ID NO: 33694 - DNA, 20 bp, Artificial Sequence
  Description of Artificial Sequence: Synthetic oligonucleotide
  Target: SCN9A; (-) strand; PAM type: NRG; PAM sequence: AGG
catgtttgcctgagttctcc

SEQ ID NO: 33695 - DNA, 20 bp, Artificial Sequence
  Description of Artificial Sequence: Synthetic oligonucleotide
  Target: SCN9A; (-) strand; PAM type: NRG; PAM sequence: CAG
acatgtttgcctgagttctc

SEQ ID NO: 33696 - DNA, 20 bp, Artificial Sequence
  Description of Artificial Sequence: Synthetic oligonucleotide
  Target: SCN9A; (-) strand; PAM type: NRG; PAM sequence: GAG
ggacagggacatgtttgcct

SEQ ID NO: 33697 - DNA, 20 bp, Artificial Sequence
  Description of Artificial Sequence: Synthetic oligonucleotide
  Target: SCN9A; (-) strand; PAM type: NRG; PAM sequence: GGG
catgaaggtagggatggaca

SEQ ID NO: 33698 - DNA, 20 bp, Artificial Sequence
  Description of Artificial Sequence: Synthetic oligonucleotide
  Target: SCN9A; (-) strand; PAM type: NRG; PAM sequence: AGG
gcatgaaggtagggatggac

SEQ ID NO: 33699 - DNA, 20 bp, Artificial Sequence
  Description of Artificial Sequence: Synthetic oligonucleotide
  Target: SCN9A; (-) strand; PAM type: NRG; PAM sequence: CAG
agcatgaaggtagggatgga

SEQ ID NO: 33700 - DNA, 20 bp, Artificial Sequence
  Description of Artificial Sequence: Synthetic oligonucleotide
  Target: SCN9A; (-) strand; PAM type: NRG; PAM sequence: TGG
ttgcagcatgaaggtaggga

SEQ ID NO: 33701 - DNA, 20 bp, Artificial Sequence
  Description of Artificial Sequence: Synthetic oligonucleotide
  Target: SCN9A; (-) strand; PAM type: NRG; PAM sequence: GGG
gtttttgcagcatgaaggta

SEQ ID NO: 33702 - DNA, 20 bp, Artificial Sequence
  Description of Artificial Sequence: Synthetic oligonucleotide
  Target: SCN9A; (-) strand; PAM type: NRG; PAM sequence: AGG
cgtttttgcagcatgaaggt

SEQ ID NO: 33703 - DNA, 20 bp, Artificial Sequence
  Description of Artificial Sequence: Synthetic oligonucleotide
  Target: SCN9A; (-) strand; PAM type: NRG; PAM sequence: TAG
acgtttttgcagcatgaagg

SEQ ID NO: 33704 - DNA, 20 bp, Artificial Sequence
  Description of Artificial Sequence: Synthetic oligonucleotide
  Target: SCN9A; (-) strand; PAM type: NRG; PAM sequence: AGG
aaaacgtttttgcagcatga

SEQ ID NO: 33705 - DNA, 20 bp, Artificial Sequence
  Description of Artificial Sequence: Synthetic oligonucleotide
  Target: SCN9A; (-) strand; PAM type: NRG; PAM sequence: AAG
aaaaacgtttttgcagcatg

SEQ ID NO: 33706 - DNA, 20 bp, Artificial Sequence
  Description of Artificial Sequence: Synthetic oligonucleotide
  Target: SCN9A; (-) strand; PAM type: NRG; PAM sequence: CAG
atgtgctaaaaacgtttttg

SEQ ID NO: 33707 - DNA, 20 bp, Artificial Sequence
  Description of Artificial Sequence: Synthetic oligonucleotide
  Target: SCN9A; (-) strand; PAM type: NRG; PAM sequence: TAG
atctgatgttgaaagaatgc

SEQ ID NO: 33708 - DNA, 20 bp, Artificial Sequence
  Description of Artificial Sequence: Synthetic oligonucleotide
  Target: SCN9A; (-) strand; PAM type: NRG; PAM sequence: AAG
ttcaattaatctgatgttga

SEQ ID NO: 33709 - DNA, 20 bp, Artificial Sequence
  Description of Artificial Sequence: Synthetic oligonucleotide
  Target: SCN9A; (-) strand; PAM type: NRG; PAM sequence: AAG
agaaagatgttatgcaagag

SEQ ID NO: 33710 - DNA, 20 bp, Artificial Sequence
  Description of Artificial Sequence: Synthetic oligonucleotide
  Target: SCN9A; (-) strand; PAM type: NRG; PAM sequence: GAG
tctagaaagatgttatgcaa

SEQ ID NO: 33711 - DNA, 20 bp, Artificial Sequence
  Description of Artificial Sequence: Synthetic oligonucleotide
  Target: SCN9A; (-) strand; PAM type: NRG; PAM sequence: AAG
gctctagaaagatgttatgc

SEQ ID NO: 33712 - DNA, 20 bp, Artificial Sequence
  Description of Artificial Sequence: Synthetic oligonucleotide
  Target: SCN9A; (-) strand; PAM type: NRG; PAM sequence: AAG
ttaattttacaggctctaga

SEQ ID NO: 33713 - DNA, 20 bp, Artificial Sequence
  Description of Artificial Sequence: Synthetic oligonucleotide
  Target: SCN9A; (-) strand; PAM type: NRG; PAM sequence: TAG
ttagttaattttacaggctc

SEQ ID NO: 33714 - DNA, 20 bp, Artificial Sequence
  Description of Artificial Sequence: Synthetic oligonucleotide
  Target: SCN9A; (-) strand; PAM type: NRG; PAM sequence: AGG
cattatttagttaattttac

SEQ ID NO: 33715 - DNA, 20 bp, Artificial Sequence
  Description of Artificial Sequence: Synthetic oligonucleotide
  Target: SCN9A; (-) strand; PAM type: NRG; PAM sequence: CAG
acattatttagttaatttta

SEQ ID NO: 33716 - DNA, 20 bp, Artificial Sequence
  Description of Artificial Sequence: Synthetic oligonucleotide
  Target: SCN9A; (-) strand; PAM type: NRG; PAM sequence: TAG
tttacctgcactacattatt

SEQ ID NO: 33717 - DNA, 20 bp, Artificial Sequence
  Description of Artificial Sequence: Synthetic oligonucleotide
  Target: SCN9A; (-) strand; PAM type: NRG; PAM sequence: AAG
tgtaattatttcatatgaat

SEQ ID NO: 33718 - DNA, 20 bp, Artificial Sequence
  Description of Artificial Sequence: Synthetic oligonucleotide
  Target: SCN9A; (-) strand; PAM type: NRG; PAM sequence: TAG
tttcacctcaccaagaaaat

SEQ ID NO: 33719 - DNA, 20 bp, Artificial Sequence
  Description of Artificial Sequence: Synthetic oligonucleotide
  Target: SCN9A; (-) strand; PAM type: NRG; PAM sequence: AAG
tgctcttttttcacctcacc

SEQ ID NO: 33720 - DNA, 20 bp, Artificial Sequence
  Description of Artificial Sequence: Synthetic oligonucleotide
  Target: SCN9A; (-) strand; PAM type: NRG; PAM sequence: CGG
aaagtatatgacaaaaaaat

SEQ ID NO: 33721 - DNA, 20 bp, Artificial Sequence
  Description of Artificial Sequence: Synthetic oligonucleotide
  Target: SCN9A; (-) strand; PAM type: NRG; PAM sequence: AAG
tttttcctataaaacaagca

SEQ ID NO: 33722 - DNA, 20 bp, Artificial Sequence
  Description of Artificial Sequence: Synthetic oligonucleotide
  Target: SCN9A; (-) strand; PAM type: NRG; PAM sequence: AAG
taatttttttcctataaaac

SEQ ID NO: 33723 - DNA, 20 bp, Artificial Sequence
  Description of Artificial Sequence: Synthetic oligonucleotide
  Target: SCN9A; (-) strand; PAM type: NRG; PAM sequence: AGG
cattgattagaattctaaat

SEQ ID NO: 33724 - DNA, 20 bp, Artificial Sequence
  Description of Artificial Sequence: Synthetic oligonucleotide
  Target: SCN9A; (-) strand; PAM type: NRG; PAM sequence: TAG
acattgattagaattctaaa

SEQ ID NO: 33725 - DNA, 20 bp, Artificial Sequence
  Description of Artificial Sequence: Synthetic oligonucleotide
  Target: SCN9A; (-) strand; PAM type: NRG; PAM sequence: TAG
ttttgaaataaaacattgat

SEQ ID NO: 33726 - DNA, 20 bp, Artificial Sequence
  Description of Artificial Sequence: Synthetic oligonucleotide
  Target: SCN9A; (-) strand; PAM type: NRG; PAM sequence: AAG
gctttgggtttttatatgtg

SEQ ID NO: 33727 - DNA, 20 bp, Artificial Sequence
  Description of Artificial Sequence: Synthetic oligonucleotide
  Target: SCN9A; (-) strand; PAM type: NRG; PAM sequence: GGG
taaagtctcctaaaagcttt

SEQ ID NO: 33728 - DNA, 20 bp, Artificial Sequence
  Description of Artificial Sequence: Synthetic oligonucleotide
  Target: SCN9A; (-) strand; PAM type: NRG; PAM sequence: TGG
gtaaagtctcctaaaagctt

SEQ ID NO: 33729 - DNA, 20 bp, Artificial Sequence
  Description of Artificial Sequence: Synthetic oligonucleotide
  Target: SCN9A; (-) strand; PAM type: NRG; PAM sequence: AAG
acatatgtaaagtctcctaa

SEQ ID NO: 33730 - DNA, 20 bp, Artificial Sequence
  Description of Artificial Sequence: Synthetic oligonucleotide
  Target: SCN9A; (-) strand; PAM type: NRG; PAM sequence: AAG
ataaaatatcaacatatgta

SEQ ID NO: 33731 - DNA, 20 bp, Artificial Sequence
  Description of Artificial Sequence: Synthetic oligonucleotide
  Target: SCN9A; (-) strand; PAM type: NRG; PAM sequence: TAG
tttgaaaatacaagcattcc

SEQ ID NO: 33732 - DNA, 20 bp, Artificial Sequence
  Description of Artificial Sequence: Synthetic oligonucleotide
  Target: SCN9A; (-) strand; PAM type: NRG; PAM sequence: AAG
aacttctattttgaaaatac

SEQ ID NO: 33733 - DNA, 20 bp, Artificial Sequence
  Description of Artificial Sequence: Synthetic oligonucleotide
  Target: SCN9A; (-) strand; PAM type: NRG; PAM sequence: TAG
tttttcccagaaaagtaatc

SEQ ID NO: 33734 - DNA, 20 bp, Artificial Sequence
  Description of Artificial Sequence: Synthetic oligonucleotide
  Target: SCN9A; (-) strand; PAM type: NRG; PAM sequence: AAG
tttttttctttttcccagaa

SEQ ID NO: 33735 - DNA, 20 bp, Artificial Sequence
  Description of Artificial Sequence: Synthetic oligonucleotide
  Target: SCN9A; (-) strand; PAM type: NRG; PAM sequence: CAG
tttaatttttttctttttcc

SEQ ID NO: 33736 - DNA, 20 bp, Artificial Sequence
  Description of Artificial Sequence: Synthetic oligonucleotide
  Target: SCN9A; (-) strand; PAM type: NRG; PAM sequence: TAG
cttgactttgagatgatgta

SEQ ID NO: 33737 - DNA, 20 bp, Artificial Sequence
  Description of Artificial Sequence: Synthetic oligonucleotide
  Target: SCN9A; (-) strand; PAM type: NRG; PAM sequence: GAG
gttccctcttgcttgacttt

SEQ ID NO: 33738 - DNA, 20 bp, Artificial Sequence
  Description of Artificial Sequence: Synthetic oligonucleotide
  Target: SCN9A; (-) strand; PAM type: NRG; PAM sequence: AGG
tcctatagtcctcaaaccaa

SEQ ID NO: 33739 - DNA, 20 bp, Artificial Sequence
  Description of Artificial Sequence: Synthetic oligonucleotide
  Target: SCN9A; (-) strand; PAM type: NRG; PAM sequence: AAG
atcctatagtcctcaaacca

SEQ ID NO: 33740 - DNA, 20 bp, Artificial Sequence
  Description of Artificial Sequence: Synthetic oligonucleotide
  Target: SCN9A; (-) strand; PAM type: NRG; PAM sequence: TAG
tagttcttaataccatccta

SEQ ID NO: 33741 - DNA, 20 bp, Artificial Sequence
  Description of Artificial Sequence: Synthetic oligonucleotide
  Target: SCN9A; (-) strand; PAM type: NRG; PAM sequence: TAG
tcaaatcaggttctttctca

SEQ ID NO: 33742 - DNA, 20 bp, Artificial Sequence
  Description of Artificial Sequence: Synthetic oligonucleotide
  Target: SCN9A; (-) strand; PAM type: NRG; PAM sequence: AGG
acagaactgcaattcaaatc

SEQ ID NO: 33743 - DNA, 20 bp, Artificial Sequence
  Description of Artificial Sequence: Synthetic oligonucleotide
  Target: SCN9A; (-) strand; PAM type: NRG; PAM sequence: CAG
aacagaactgcaattcaaat

SEQ ID NO: 33744 - DNA, 20 bp, Artificial Sequence
  Description of Artificial Sequence: Synthetic oligonucleotide
  Target: SCN9A; (-) strand; PAM type: NRG; PAM sequence: CAG
cacatgcaacaagaaaaaaa

SEQ ID NO: 33745 - DNA, 20 bp, Artificial Sequence
  Description of Artificial Sequence: Synthetic oligonucleotide
  Target: SCN9A; (-) strand; PAM type: NRG; PAM sequence: AAG
gacatgttatcacatgcaac

SEQ ID NO: 33746 - DNA, 20 bp, Artificial Sequence
  Description of Artificial Sequence: Synthetic oligonucleotide
  Target: SCN9A; (-) strand; PAM type: NRG; PAM sequence: AAG
aaccgtggtttagagaagta

SEQ ID NO: 33747 - DNA, 20 bp, Artificial Sequence
  Description of Artificial Sequence: Synthetic oligonucleotide
  Target: SCN9A; (-) strand; PAM type: NRG; PAM sequence: AAG
gaggaaaccgtggtttagag

SEQ ID NO: 33748 - DNA, 20 bp, Artificial Sequence
  Description of Artificial Sequence: Synthetic oligonucleotide
  Target: SCN9A; (-) strand; PAM type: NRG; PAM sequence: GAG
aatgaggaaaccgtggttta

SEQ ID NO: 33749 - DNA, 20 bp, Artificial Sequence
  Description of Artificial Sequence: Synthetic oligonucleotide
  Target: SCN9A; (-) strand; PAM type: NRG; PAM sequence: TAG
tcaatgaggaaaccgtggtt

SEQ ID NO: 33750 - DNA, 20 bp, Artificial Sequence
  Description of Artificial Sequence: Synthetic oligonucleotide
  Target: SCN9A; (-) strand; PAM type: NRG; PAM sequence: TGG
ctttttcaatgaggaaaccg

SEQ ID NO: 33751 - DNA, 20 bp, Artificial Sequence
  Description of Artificial Sequence: Synthetic oligonucleotide
  Target: SCN9A; (-) strand; PAM type: NRG; PAM sequence: AGG
ggccttccactttttcaatg

SEQ ID NO: 33752 - DNA, 20 bp, Artificial Sequence
  Description of Artificial Sequence: Synthetic oligonucleotide
  Target: SCN9A; (-) strand; PAM type: NRG; PAM sequence: GAG
tggccttccactttttcaat

SEQ ID NO: 33753 - DNA, 20 bp, Artificial Sequence
  Description of Artificial Sequence: Synthetic oligonucleotide
  Target: SCN9A; (-) strand; PAM type: NRG; PAM sequence: TGG
taggcatgagccatcacacc

SEQ ID NO: 33754 - DNA, 20 bp, Artificial Sequence
  Description of Artificial Sequence: Synthetic oligonucleotide
  Target: SCN9A; (-) strand; PAM type: NRG; PAM sequence: GAG
agtgctgggattataggcat

SEQ ID NO: 33755 - DNA, 20 bp, Artificial Sequence
  Description of Artificial Sequence: Synthetic oligonucleotide
  Target: SCN9A; (-) strand; PAM type: NRG; PAM sequence: AGG
tcccaaagtgctgggattat

SEQ ID NO: 33756 - DNA, 20 bp, Artificial Sequence
  Description of Artificial Sequence: Synthetic oligonucleotide
  Target: SCN9A; (-) strand; PAM type: NRG; PAM sequence: TAG
ctcccaaagtgctgggatta

SEQ ID NO: 33757 - DNA, 20 bp, Artificial Sequence
  Description of Artificial Sequence: Synthetic oligonucleotide
  Target: SCN9A; (-) strand; PAM type: NRG; PAM sequence: GGG
cctcggcctcccaaagtgct

SEQ ID NO: 33758 - DNA, 20 bp, Artificial Sequence
  Description of Artificial Sequence: Synthetic oligonucleotide
  Target: SCN9A; (-) strand; PAM type: NRG; PAM sequence: TGG
ccctcggcctcccaaagtgc

SEQ ID NO: 33759 - DNA, 20 bp, Artificial Sequence
  Description of Artificial Sequence: Synthetic oligonucleotide
  Target: SCN9A; (-) strand; PAM type: NRG; PAM sequence: AAG
ccactcccctcggcctccca

SEQ ID NO: 33760 - DNA, 20 bp, Artificial Sequence
  Description of Artificial Sequence: Synthetic oligonucleotide
  Target: SCN9A; (-) strand; PAM type: NRG; PAM sequence: CGG
tagctgagatccactcccct

SEQ ID NO: 33761 - DNA, 20 bp, Artificial Sequence
  Description of Artificial Sequence: Synthetic oligonucleotide
  Target: SCN9A; (-) strand; PAM type: NRG; PAM sequence: GAG
tctcagcctcttgagtagct

SEQ ID NO: 33762 - DNA, 20 bp, Artificial Sequence
  Description of Artificial Sequence: Synthetic oligonucleotide
  Target: SCN9A; (-) strand; PAM type: NRG; PAM sequence: TAG
tcctgtctcagcctcttgag

SEQ ID NO: 33763 - DNA, 20 bp, Artificial Sequence
  Description of Artificial Sequence: Synthetic oligonucleotide
  Target: SCN9A; (-) strand; PAM type: NRG; PAM sequence: GAG
acatcctgtctcagcctctt

SEQ ID NO: 33764 - DNA, 20 bp, Artificial Sequence
  Description of Artificial Sequence: Synthetic oligonucleotide
  Target: SCN9A; (-) strand; PAM type: NRG; PAM sequence: CAG
ctcaagcaaacatcctgtct

SEQ ID NO: 33765 - DNA, 20 bp, Artificial Sequence
  Description of Artificial Sequence: Synthetic oligonucleotide
  Target: SCN9A; (-) strand; PAM type: NRG; PAM sequence: AAG
acctccatccccaggggctc

SEQ ID NO: 33766 - DNA, 20 bp, Artificial Sequence
  Description of Artificial Sequence: Synthetic oligonucleotide
  Target: SCN9A; (-) strand; PAM type: NRG; PAM sequence: GGG
actgcaacctccatccccag

SEQ ID NO: 33767 - DNA, 20 bp, Artificial Sequence
  Description of Artificial Sequence: Synthetic oligonucleotide
  Target: SCN9A; (-) strand; PAM type: NRG; PAM sequence: GGG
cactgcaacctccatcccca

SEQ ID NO: 33768 - DNA, 20 bp, Artificial Sequence
  Description of Artificial Sequence: Synthetic oligonucleotide
  Target: SCN9A; (-) strand; PAM type: NRG; PAM sequence: AGG
tcactgcaacctccatcccc

SEQ ID NO: 33769 - DNA, 20 bp, Artificial Sequence
  Description of Artificial Sequence: Synthetic oligonucleotide
  Target: SCN9A; (-) strand; PAM type: NRG; PAM sequence: CAG
ttcactgcaacctccatccc

SEQ ID NO: 33770 - DNA, 20 bp, Artificial Sequence
  Description of Artificial Sequence: Synthetic oligonucleotide
  Target: SCN9A; (-) strand; PAM type: NRG; PAM sequence: CAG
tgagtgcagtggcacagtca

SEQ ID NO: 33771 - DNA, 20 bp, Artificial Sequence
  Description of Artificial Sequence: Synthetic oligonucleotide
  Target: SCN9A; (-) strand; PAM type: NRG; PAM sequence: CAG
ccaggctgagtgcagtggca

SEQ ID NO: 33772 - DNA, 20 bp, Artificial Sequence
  Description of Artificial Sequence: Synthetic oligonucleotide
  Target: SCN9A; (-) strand; PAM type: NRG; PAM sequence: TGG
gtctcccaggctgagtgcag

SEQ ID NO: 33773 - DNA, 20 bp, Artificial Sequence
  Description of Artificial Sequence: Synthetic oligonucleotide
  Target: SCN9A; (-) strand; PAM type: NRG; PAM sequence: CAG
tctgtctcccaggctgagtg

SEQ ID NO: 33774 - DNA, 20 bp, Artificial Sequence
  Description of Artificial Sequence: Synthetic oligonucleotide
  Target: SCN9A; (-) strand; PAM type: NRG; PAM sequence: GAG
ctcactctgtctcccaggct

SEQ ID NO: 33775 - DNA, 20 bp, Artificial Sequence
  Description of Artificial Sequence: Synthetic oligonucleotide
  Target: SCN9A; (-) strand; PAM type: NRG; PAM sequence: AGG
acaatctcactctgtctccc

SEQ ID NO: 33776 - DNA, 20 bp, Artificial Sequence
  Description of Artificial Sequence: Synthetic oligonucleotide
  Target: SCN9A; (-) strand; PAM type: NRG; PAM sequence: CAG
cacaatctcactctgtctcc

SEQ ID NO: 33777 - DNA, 20 bp, Artificial Sequence
  Description of Artificial Sequence: Synthetic oligonucleotide
  Target: SCN9A; (-) strand; PAM type: NRG; PAM sequence: GGG
acaataatataatgaagatg

SEQ ID NO: 33778 - DNA, 20 bp, Artificial Sequence
  Description of Artificial Sequence: Synthetic oligonucleotide
  Target: SCN9A; (-) strand; PAM type: NRG; PAM sequence: GGG
cacaataatataatgaagat

SEQ ID NO: 33779 - DNA, 20 bp, Artificial Sequence
  Description of Artificial Sequence: Synthetic oligonucleotide
  Target: SCN9A; (-) strand; PAM type: NRG; PAM sequence: TGG
acacaataatataatgaaga

SEQ ID NO: 33780 - DNA, 20 bp, Artificial Sequence
  Description of Artificial Sequence: Synthetic oligonucleotide
  Target: SCN9A; (-) strand; PAM type: NRG; PAM sequence: AAG
atgcacacaataatataatg

SEQ ID NO: 33781 - DNA, 20 bp, Artificial Sequence
  Description of Artificial Sequence: Synthetic oligonucleotide
  Target: SCN9A; (-) strand; PAM type: NRG; PAM sequence: AAG
tctactcactttacattata

SEQ ID NO: 33782 - DNA, 20 bp, Artificial Sequence
  Description of Artificial Sequence: Synthetic oligonucleotide
  Target: SCN9A; (-) strand; PAM type: NRG; PAM sequence: TGG
gagatttaatatgtattgag

SEQ ID NO: 33783 - DNA, 20 bp, Artificial Sequence
  Description of Artificial Sequence: Synthetic oligonucleotide
  Target: SCN9A; (-) strand; PAM type: NRG; PAM sequence: GAG
tttgagatttaatatgtatt

SEQ ID NO: 33784 - DNA, 20 bp, Artificial Sequence
  Description of Artificial Sequence: Synthetic oligonucleotide
  Target: SCN9A; (-) strand; PAM type: NRG; PAM sequence: GAG
gaattgacacttagcatttt

SEQ ID NO: 33785 - DNA, 20 bp, Artificial Sequence
  Description of Artificial Sequence: Synthetic oligonucleotide
  Target: SCN9A; (-) strand; PAM type: NRG; PAM sequence: TAG
acaagtaaagaattgacact

SEQ ID NO: 33786 - DNA, 20 bp, Artificial Sequence
  Description of Artificial Sequence: Synthetic oligonucleotide
  Target: SCN9A; (-) strand; PAM type: NRG; PAM sequence: AAG
aatctgttatctcacaagta

SEQ ID NO: 33787 - DNA, 20 bp, Artificial Sequence
  Description of Artificial Sequence: Synthetic oligonucleotide
  Target: SCN9A; (-) strand; PAM type: NRG; PAM sequence: AAG
atcctaatctgttatctcac

SEQ ID NO: 33788 - DNA, 20 bp, Artificial Sequence
  Description of Artificial Sequence: Synthetic oligonucleotide
  Target: SCN9A; (-) strand; PAM type: NRG; PAM sequence: TAG
tagaaaggcatatgtacttt

SEQ ID NO: 33789 - DNA, 20 bp, Artificial Sequence
  Description of Artificial Sequence: Synthetic oligonucleotide
  Target: SCN9A; (-) strand; PAM type: NRG; PAM sequence: AGG
cttagcatttctccatagaa

SEQ ID NO: 33790 - DNA, 20 bp, Artificial Sequence
  Description of Artificial Sequence: Synthetic oligonucleotide
  Target: SCN9A; (-) strand; PAM type: NRG; PAM sequence: AAG
acttagcatttctccataga

SEQ ID NO: 33791 - DNA, 20 bp, Artificial Sequence
  Description of Artificial Sequence: Synthetic oligonucleotide
  Target: SCN9A; (-) strand; PAM type: NRG; PAM sequence: TAG
aaagacttagcatttctcca

SEQ ID NO: 33792 - DNA, 20 bp, Artificial Sequence
  Description of Artificial Sequence: Synthetic oligonucleotide
  Target: SCN9A; (-) strand; PAM type: NRG; PAM sequence: TAG
tggattcctgtaaaaagact

SEQ ID NO: 33793 - DNA, 20 bp, Artificial Sequence
  Description of Artificial Sequence: Synthetic oligonucleotide
  Target: SCN9A; (-) strand; PAM type: NRG; PAM sequence: AAG
aaagtttggattcctgtaaa

SEQ ID NO: 33794 - DNA, 20 bp, Artificial Sequence
  Description of Artificial Sequence: Synthetic oligonucleotide
  Target: SCN9A; (-) strand; PAM type: NRG; PAM sequence: TGG
actgtaactaaagcaaagtt

SEQ ID NO: 33795 - DNA, 20 bp, Artificial Sequence
  Description of Artificial Sequence: Synthetic oligonucleotide
  Target: SCN9A; (-) strand; PAM type: NRG; PAM sequence: AAG
atgttactgtaactaaagca

SEQ ID NO: 33796 - DNA, 20 bp, Artificial Sequence
  Description of Artificial Sequence: Synthetic oligonucleotide
  Target: SCN9A; (-) strand; PAM type: NRG; PAM sequence: AAG
atatgatgttactgtaacta

SEQ ID NO: 33797 - DNA, 20 bp, Artificial Sequence
  Description of Artificial Sequence: Synthetic oligonucleotide
  Target: SCN9A; (-) strand; PAM type: NRG; PAM sequence: TGG
gctagtttagtttagttgat

SEQ ID NO: 33798 - DNA, 20 bp, Artificial Sequence
  Description of Artificial Sequence: Synthetic oligonucleotide
  Target: SCN9A; (-) strand; PAM type: NRG; PAM sequence: TAG
ttgtctgtgctagtttagtt

SEQ ID NO: 33799 - DNA, 20 bp, Artificial Sequence
  Description of Artificial Sequence: Synthetic oligonucleotide
  Target: SCN9A; (-) strand; PAM type: NRG; PAM sequence: TAG
tctttttgtctgtgctagtt

SEQ ID NO: 33800 - DNA, 20 bp, Artificial Sequence
  Description of Artificial Sequence: Synthetic oligonucleotide
  Target: SCN9A; (-) strand; PAM type: NRG; PAM sequence: TAG
acttttctttttgtctgtgc

SEQ ID NO: 33801 - DNA, 20 bp, Artificial Sequence
  Description of Artificial Sequence: Synthetic oligonucleotide
  Target: SCN9A; (-) strand; PAM type: NRG; PAM sequence: AAG
tgatcaataatttttcaatt

SEQ ID NO: 33802 - DNA, 20 bp, Artificial Sequence
  Description of Artificial Sequence: Synthetic oligonucleotide
  Target: SCN9A; (-) strand; PAM type: NRG; PAM sequence: AAG
ccttatacttcatttattct

SEQ ID NO: 33803 - DNA, 20 bp, Artificial Sequence
  Description of Artificial Sequence: Synthetic oligonucleotide
  Target: SCN9A; (-) strand; PAM type: NRG; PAM sequence: TAG
tttaactttataaggctttt

SEQ ID NO: 33804 - DNA, 20 bp, Artificial Sequence
  Description of Artificial Sequence: Synthetic oligonucleotide
  Target: SCN9A; (-) strand; PAM type: NRG; PAM sequence: AGG
gatatatttttaactttata

SEQ ID NO: 33805 - DNA, 20 bp, Artificial Sequence
  Description of Artificial Sequence: Synthetic oligonucleotide
  Target: SCN9A; (-) strand; PAM type: NRG; PAM sequence: AAG
tgatatatttttaactttat

SEQ ID NO: 33806 - DNA, 20 bp, Artificial Sequence
  Description of Artificial Sequence: Synthetic oligonucleotide
  Target: SCN9A; (-) strand; PAM type: NRG; PAM sequence: AAG
atgaaataatagataataaa

SEQ ID NO: 33807 - DNA, 20 bp, Artificial Sequence
  Description of Artificial Sequence: Synthetic oligonucleotide
  Target: SCN9A; (-) strand; PAM type: NRG; PAM sequence: TAG
atcagcttcaaatgaaataa

SEQ ID NO: 33808 - DNA, 20 bp, Artificial Sequence
  Description of Artificial Sequence: Synthetic oligonucleotide
  Target: SCN9A; (-) strand; PAM type: NRG; PAM sequence: CAG
ttttttagtagtgctattat

SEQ ID NO: 33809 - DNA, 20 bp, Artificial Sequence
  Description of Artificial Sequence: Synthetic oligonucleotide
  Target: SCN9A; (-) strand; PAM type: NRG; PAM sequence: TAG
gttaatggtatcttttttag

SEQ ID NO: 33810 - DNA, 20 bp, Artificial Sequence
  Description of Artificial Sequence: Synthetic oligonucleotide
  Target: SCN9A; (-) strand; PAM type: NRG; PAM sequence: TAG
atagttaatggtatcttttt

SEQ ID NO: 33811 - DNA, 20 bp, Artificial Sequence
  Description of Artificial Sequence: Synthetic oligonucleotide
  Target: SCN9A; (-) strand; PAM type: NRG; PAM sequence: TGG
gactcccaggtgatagttaa

SEQ ID NO: 33812 - DNA, 20 bp, Artificial Sequence
  Description of Artificial Sequence: Synthetic oligonucleotide
  Target: SCN9A; (-) strand; PAM type: NRG; PAM sequence: TAG
tcatgttgactcccaggtga

SEQ ID NO: 33813 - DNA, 20 bp, Artificial Sequence
  Description of Artificial Sequence: Synthetic oligonucleotide
  Target: SCN9A; (-) strand; PAM type: NRG; PAM sequence: AGG
tcatattcatgttgactccc

SEQ ID NO: 33814 - DNA, 20 bp, Artificial Sequence
  Description of Artificial Sequence: Synthetic oligonucleotide
  Target: SCN9A; (-) strand; PAM type: NRG; PAM sequence: CAG
ttcatattcatgttgactcc

SEQ ID NO: 33815 - DNA, 20 bp, Artificial Sequence
  Description of Artificial Sequence: Synthetic oligonucleotide
  Target: SCN9A; (-) strand; PAM type: NRG; PAM sequence: TGG
tcatcaaaggcttttctttg

SEQ ID NO: 33816 - DNA, 20 bp, Artificial Sequence
  Description of Artificial Sequence: Synthetic oligonucleotide
  Target: SCN9A; (-) strand; PAM type: NRG; PAM sequence: AGG
gtaagatgctgtttcatcaa

SEQ ID NO: 33817 - DNA, 20 bp, Artificial Sequence
  Description of Artificial Sequence: Synthetic oligonucleotide
  Target: SCN9A; (-) strand; PAM type: NRG; PAM sequence: AAG
cgtaagatgctgtttcatca

SEQ ID NO: 33818 - DNA, 20 bp, Artificial Sequence
  Description of Artificial Sequence: Synthetic oligonucleotide
  Target: SCN9A; (-) strand; PAM type: NRG; PAM sequence: AAG
ttacaagtccttagtttcgt

SEQ ID NO: 33819 - DNA, 20 bp, Artificial Sequence
  Description of Artificial Sequence: Synthetic oligonucleotide
  Target: SCN9A; (-) strand; PAM type: NRG; PAM sequence: TAG
atgtacaaattacaagtcct

SEQ ID NO: 33820 - DNA, 20 bp, Artificial Sequence
  Description of Artificial Sequence: Synthetic oligonucleotide
  Target: SCN9A; (-) strand; PAM type: NRG; PAM sequence: AAG
taagcgaatgtacaaattac

SEQ ID NO: 33821 - DNA, 20 bp, Artificial Sequence
  Description of Artificial Sequence: Synthetic oligonucleotide
  Target: SCN9A; (-) strand; PAM type: NRG; PAM sequence: AAG
gacttgaaggactattttct

SEQ ID NO: 33822 - DNA, 20 bp, Artificial Sequence
  Description of Artificial Sequence: Synthetic oligonucleotide
  Target: SCN9A; (-) strand; PAM type: NRG; PAM sequence: AGG
tctaatggcggatgacttga

SEQ ID NO: 33823 - DNA, 20 bp, Artificial Sequence
  Description of Artificial Sequence: Synthetic oligonucleotide
  Target: SCN9A; (-) strand; PAM type: NRG; PAM sequence: AAG
ttctaatggcggatgacttg

SEQ ID NO: 33824 - DNA, 20 bp, Artificial Sequence
  Description of Artificial Sequence: Synthetic oligonucleotide
  Target: SCN9A; (-) strand; PAM type: NRG; PAM sequence: CGG
aggttaaacaattctaatgg

SEQ ID NO: 33825 - DNA, 20 bp, Artificial Sequence
  Description of Artificial Sequence: Synthetic oligonucleotide
  Target: SCN9A; (-) strand; PAM type: NRG; PAM sequence: TGG
gcaaggttaaacaattctaa

SEQ ID NO: 33826 - DNA, 20 bp, Artificial Sequence
  Description of Artificial Sequence: Synthetic oligonucleotide
  Target: SCN9A; (-) strand; PAM type: NRG; PAM sequence: AGG
ccaagcccagtactcttgca

SEQ ID NO: 33827 - DNA, 20 bp, Artificial Sequence
  Description of Artificial Sequence: Synthetic oligonucleotide
  Target: SCN9A; (-) strand; PAM type: NRG; PAM sequence: AAG
accaagcccagtactcttgc

SEQ ID NO: 33828 - DNA, 20 bp, Artificial Sequence
  Description of Artificial Sequence: Synthetic oligonucleotide
  Target: SCN9A; (-) strand; PAM type: NRG; PAM sequence: CAG
gagtttcttttgaccaagcc

SEQ ID NO: 33829 - DNA, 20 bp, Artificial Sequence
  Description of Artificial Sequence: Synthetic oligonucleotide
  Target: SCN9A; (-) strand; PAM type: NRG; PAM sequence: AAG
gagctgagtttcttttgacc

SEQ ID NO: 33830 - DNA, 20 bp, Artificial Sequence
  Description of Artificial Sequence: Synthetic oligonucleotide
  Target: SCN9A; (-) strand; PAM type: NRG; PAM sequence: GAG
taatgatgatttatagagct

SEQ ID NO: 33831 - DNA, 20 bp, Artificial Sequence
  Description of Artificial Sequence: Synthetic oligonucleotide
  Target: SCN9A; (-) strand; PAM type: NRG; PAM sequence: GAG
tagtataatgatgatttata

SEQ ID NO: 33832 - DNA, 20 bp, Artificial Sequence
  Description of Artificial Sequence: Synthetic oligonucleotide
  Target: SCN9A; (-) strand; PAM type: NRG; PAM sequence: TAG
gctagtataatgatgattta

SEQ ID NO: 33833 - DNA, 20 bp, Artificial Sequence
  Description of Artificial Sequence: Synthetic oligonucleotide
  Target: SCN9A; (-) strand; PAM type: NRG; PAM sequence: TAG
ctaacatgctgatgaattgc

SEQ ID NO: 33834 - DNA, 20 bp, Artificial Sequence
  Description of Artificial Sequence: Synthetic oligonucleotide
  Target: SCN9A; (-) strand; PAM type: NRG; PAM sequence: AAG
tttcattgtgccttttacac

SEQ ID NO: 33835 - DNA, 20 bp, Artificial Sequence
  Description of Artificial Sequence: Synthetic oligonucleotide
  Target: SCN9A; (-) strand; PAM type: NRG; PAM sequence: AGG
gggagaaaaatcatagcagc

SEQ ID NO: 33836 - DNA, 20 bp, Artificial Sequence
  Description of Artificial Sequence: Synthetic oligonucleotide
  Target: SCN9A; (-) strand; PAM type: NRG; PAM sequence: CAG
ggggagaaaaatcatagcag

SEQ ID NO: 33837 - DNA, 20 bp, Artificial Sequence
  Description of Artificial Sequence: Synthetic oligonucleotide
  Target: SCN9A; (-) strand; PAM type: NRG; PAM sequence: CAG
tgtggggagaaaaatcatag

SEQ ID NO: 33838 - DNA, 20 bp, Artificial Sequence
  Description of Artificial Sequence: Synthetic oligonucleotide
  Target: SCN9A; (-) strand; PAM type: NRG; PAM sequence: TAG
tgttgtggggagaaaaatca

SEQ ID NO: 33839 - DNA, 20 bp, Artificial Sequence
  Description of Artificial Sequence: Synthetic oligonucleotide
  Target: SCN9A; (-) strand; PAM type: NRG; PAM sequence: GAG
attagattatttgttgtggg

SEQ ID NO: 33840 - DNA, 20 bp, Artificial Sequence
  Description of Artificial Sequence: Synthetic oligonucleotide
  Target: SCN9A; (-) strand; PAM type: NRG; PAM sequence: GGG
aaattagattatttgttgtg

SEQ ID NO: 33841 - DNA, 20 bp, Artificial Sequence
  Description of Artificial Sequence: Synthetic oligonucleotide
  Target: SCN9A; (-) strand; PAM type: NRG; PAM sequence: GGG
caaattagattatttgttgt

SEQ ID NO: 33842 - DNA, 20 bp, Artificial Sequence
  Description of Artificial Sequence: Synthetic oligonucleotide
  Target: SCN9A; (-) strand; PAM type: NRG; PAM sequence: TGG
acaaattagattatttgttg

SEQ ID NO: 33843 - DNA, 20 bp, Artificial Sequence
  Description of Artificial Sequence: Synthetic oligonucleotide
  Target: SCN9A; (-) strand; PAM type: NRG; PAM sequence: TAG
aaaggagcttcaaaacaaat

SEQ ID NO: 33844 - DNA, 20 bp, Artificial Sequence
  Description of Artificial Sequence: Synthetic oligonucleotide
  Target: SCN9A; (-) strand; PAM type: NRG; PAM sequence: GAG
atgaaaaggatcactaaaag

SEQ ID NO: 33845 - DNA, 20 bp, Artificial Sequence
  Description of Artificial Sequence: Synthetic oligonucleotide
  Target: SCN9A; (-) strand; PAM type: NRG; PAM sequence: AGG
acatgaaaaggatcactaaa

SEQ ID NO: 33846 - DNA, 20 bp, Artificial Sequence
  Description of Artificial Sequence: Synthetic oligonucleotide
  Target: SCN9A; (-) strand; PAM type: NRG; PAM sequence: AAG
gacatgaaaaggatcactaa

SEQ ID NO: 33847 - DNA, 20 bp, Artificial Sequence
  Description of Artificial Sequence: Synthetic oligonucleotide
  Target: SCN9A; (-) strand; PAM type: NRG; PAM sequence: AGG
tccagaaaagagacatgaaa

SEQ ID NO: 33848 - DNA, 20 bp, Artificial Sequence
  Description of Artificial Sequence: Synthetic oligonucleotide
  Target: SCN9A; (-) strand; PAM type: NRG; PAM sequence: AAG
ttccagaaaagagacatgaa

SEQ ID NO: 33849 - DNA, 20 bp, Artificial Sequence
  Description of Artificial Sequence: Synthetic oligonucleotide
  Target: SCN9A; (-) strand; PAM type: NRG; PAM sequence: GAG
gtaggtggctttccagaaaa

SEQ ID NO: 33850 - DNA, 20 bp, Artificial Sequence
  Description of Artificial Sequence: Synthetic oligonucleotide
  Target: SCN9A; (-) strand; PAM type: NRG; PAM sequence: AAG
ttgtaggtggctttccagaa

SEQ ID NO: 33851 - DNA, 20 bp, Artificial Sequence
  Description of Artificial Sequence: Synthetic oligonucleotide
  Target: SCN9A; (-) strand; PAM type: NRG; PAM sequence: CAG
aaggattgtaggtggctttc

SEQ ID NO: 33852 - DNA, 20 bp, Artificial Sequence
  Description of Artificial Sequence: Synthetic oligonucleotide
  Target: SCN9A; (-) strand; PAM type: NRG; PAM sequence: TGG
tttgcacaaaggattgtagg

SEQ ID NO: 33853 - DNA, 20 bp, Artificial Sequence
  Description of Artificial Sequence: Synthetic oligonucleotide
  Target: SCN9A; (-) strand; PAM type: NRG; PAM sequence: AGG
ctgtttgcacaaaggattgt

SEQ ID NO: 33854 - DNA, 20 bp, Artificial Sequence
  Description of Artificial Sequence: Synthetic oligonucleotide
  Target: SCN9A; (-) strand; PAM type: NRG; PAM sequence: TAG
cctgtttgcacaaaggattg

SEQ ID NO: 33855 - DNA, 20 bp, Artificial Sequence
  Description of Artificial Sequence: Synthetic oligonucleotide
  Target: SCN9A; (-) strand; PAM type: NRG; PAM sequence: AGG
ttctttccctgtttgcacaa

SEQ ID NO: 33856 - DNA, 20 bp, Artificial Sequence
  Description of Artificial Sequence: Synthetic oligonucleotide
  Target: SCN9A; (-) strand; PAM type: NRG; PAM sequence: AAG
tttctttccctgtttgcaca

SEQ ID NO: 33857 - DNA, 20 bp, Artificial Sequence
  Description of Artificial Sequence: Synthetic oligonucleotide
  Target: SCN9A; (-) strand; PAM type: NRG; PAM sequence: TGG
gaaatttccacctcttagtt

SEQ ID NO: 33858 - DNA, 20 bp, Artificial Sequence
  Description of Artificial Sequence: Synthetic oligonucleotide
  Target: SCN9A; (-) strand; PAM type: NRG; PAM sequence: TAG
tgatggaaatttccacctct

SEQ ID NO: 33859 - DNA, 20 bp, Artificial Sequence
  Description of Artificial Sequence: Synthetic oligonucleotide
  Target: SCN9A; (-) strand; PAM type: NRG; PAM sequence: TGG
tacagctatgatgtcagtga

SEQ ID NO: 33860 - DNA, 20 bp, Artificial Sequence
  Description of Artificial Sequence: Synthetic oligonucleotide
  Target: SCN9A; (-) strand; PAM type: NRG; PAM sequence: CAG
taatcatacagctatgatgt

SEQ ID NO: 33861 - DNA, 20 bp, Artificial Sequence
  Description of Artificial Sequence: Synthetic oligonucleotide
  Target: SCN9A; (-) strand; PAM type: NRG; PAM sequence: CAG
ggttttctcatctaatcata

SEQ ID NO: 33862 - DNA, 20 bp, Artificial Sequence
  Description of Artificial Sequence: Synthetic oligonucleotide
  Target: SCN9A; (-) strand; PAM type: NRG; PAM sequence: GGG
cttctcctcccacatatttt

SEQ ID NO: 33863 - DNA, 20 bp, Artificial Sequence
  Description of Artificial Sequence: Synthetic oligonucleotide
  Target: SCN9A; (-) strand; PAM type: NRG; PAM sequence: TGG
ccttctcctcccacatattt

SEQ ID NO: 33864 - DNA, 20 bp, Artificial Sequence
  Description of Artificial Sequence: Synthetic oligonucleotide
  Target: SCN9A; (-) strand; PAM type: NRG; PAM sequence: TGG
gcagaggattttatgtttca

SEQ ID NO: 33865 - DNA, 20 bp, Artificial Sequence
  Description of Artificial Sequence: Synthetic oligonucleotide
  Target: SCN9A; (-) strand; PAM type: NRG; PAM sequence: AGG
ctgcttcacatcaggggcag

SEQ ID NO: 33866 - DNA, 20 bp, Artificial Sequence
  Description of Artificial Sequence: Synthetic oligonucleotide
  Target: SCN9A; (-) strand; PAM type: NRG; PAM sequence: GAG
gctgcttcacatcaggggca

SEQ ID NO: 33867 - DNA, 20 bp, Artificial Sequence
  Description of Artificial Sequence: Synthetic oligonucleotide
  Target: SCN9A; (-) strand; PAM type: NRG; PAM sequence: CAG
ctgctgcttcacatcagggg

SEQ ID NO: 33868 - DNA, 20 bp, Artificial Sequence
  Description of Artificial Sequence: Synthetic oligonucleotide
  Target: SCN9A; (-) strand; PAM type: NRG; PAM sequence: GGG
acactgctgcttcacatcag

SEQ ID NO: 33869 - DNA, 20 bp, Artificial Sequence
  Description of Artificial Sequence: Synthetic oligonucleotide
  Target: SCN9A; (-) strand; PAM type: NRG; PAM sequence: GGG
tacactgctgcttcacatca

SEQ ID NO: 33870 - DNA, 20 bp, Artificial Sequence
  Description of Artificial Sequence: Synthetic oligonucleotide
  Target: SCN9A; (-) strand; PAM type: NRG; PAM sequence: AGG
ttacactgctgcttcacatc

SEQ ID NO: 33871 - DNA, 20 bp, Artificial Sequence
  Description of Artificial Sequence: Synthetic oligonucleotide
  Target: SCN9A; (-) strand; PAM type: NRG; PAM sequence: CAG
cttacactgctgcttcacat

SEQ ID NO: 33872 - DNA, 20 bp, Artificial Sequence
  Description of Artificial Sequence: Synthetic oligonucleotide
  Target: SCN9A; (-) strand; PAM type: NRG; PAM sequence: AGG
gcttctggcaaagataacaa

SEQ ID NO: 33873 - DNA, 20 bp, Artificial Sequence
  Description of Artificial Sequence: Synthetic oligonucleotide
  Target: SCN9A; (-) strand; PAM type: NRG; PAM sequence: AAG
agcttctggcaaagataaca

SEQ ID NO: 33874 - DNA, 20 bp, Artificial Sequence
  Description of Artificial Sequence: Synthetic oligonucleotide
  Target: SCN9A; (-) strand; PAM type: NRG; PAM sequence: AAG
tcgagaaaaagcttctggca

SEQ ID NO: 33875 - DNA, 20 bp, Artificial Sequence
  Description of Artificial Sequence: Synthetic oligonucleotide
  Target: SCN9A; (-) strand; PAM type: NRG; PAM sequence: TGG
gttcctcgagaaaaagcttc

SEQ ID NO: 33876 - DNA, 20 bp, Artificial Sequence
  Description of Artificial Sequence: Synthetic oligonucleotide
  Target: SCN9A; (-) strand; PAM type: NRG; PAM sequence: AAG
ccatttagttcctcgagaaa

SEQ ID NO: 33877 - DNA, 20 bp, Artificial Sequence
  Description of Artificial Sequence: Synthetic oligonucleotide
  Target: SCN9A; (-) strand; PAM type: NRG; PAM sequence: GAG
aagcttccatttagttcctc

SEQ ID NO: 33878 - DNA, 20 bp, Artificial Sequence
  Description of Artificial Sequence: Synthetic oligonucleotide
  Target: SCN9A; (-) strand; PAM type: NRG; PAM sequence: TAG
atgtagtcaaagcttccatt

SEQ ID NO: 33879 - DNA, 20 bp, Artificial Sequence
  Description of Artificial Sequence: Synthetic oligonucleotide
  Target: SCN9A; (-) strand; PAM type: NRG; PAM sequence: AAG
tgaggtctgaaatgtagtca

SEQ ID NO: 33880 - DNA, 20 bp, Artificial Sequence
  Description of Artificial Sequence: Synthetic oligonucleotide
  Target: SCN9A; (-) strand; PAM type: NRG; PAM sequence: TAG
ctttcatgaggtctgaaatg

SEQ ID NO: 33881 - DNA, 20 bp, Artificial Sequence
  Description of Artificial Sequence: Synthetic oligonucleotide
  Target: SCN9A; (-) strand; PAM type: NRG; PAM sequence: AGG
tctaatttatttctttcatg

SEQ ID NO: 33882 - DNA, 20 bp, Artificial Sequence
  Description of Artificial Sequence: Synthetic oligonucleotide
  Target: SCN9A; (-) strand; PAM type: NRG; PAM sequence: GAG
atctaatttatttctttcat

SEQ ID NO: 33883 - DNA, 20 bp, Artificial Sequence
  Description of Artificial Sequence: Synthetic oligonucleotide
  Target: SCN9A; (-) strand; PAM type: NRG; PAM sequence: CAG
gggtatattcacaataaaat

SEQ ID NO: 33884 - DNA, 20 bp, Artificial Sequence
  Description of Artificial Sequence: Synthetic oligonucleotide
  Target: SCN9A; (-) strand; PAM type: NRG; PAM sequence: GGG
tttaactcctggagtaattg

SEQ ID NO: 33885 - DNA, 20 bp, Artificial Sequence
  Description of Artificial Sequence: Synthetic oligonucleotide
  Target: SCN9A; (-) strand; PAM type: NRG; PAM sequence: GGG
ttttaactcctggagtaatt

SEQ ID NO: 33886 - DNA, 20 bp, Artificial Sequence
  Description of Artificial Sequence: Synthetic oligonucleotide
  Target: SCN9A; (-) strand; PAM type: NRG; PAM sequence: TGG
attttaactcctggagtaat

SEQ ID NO: 33887 - DNA, 20 bp, Artificial Sequence
  Description of Artificial Sequence: Synthetic oligonucleotide
  Target: SCN9A; (-) strand; PAM type: NRG; PAM sequence: GAG
ctgtaatattttaactcctg

SEQ ID NO: 33888 - DNA, 20 bp, Artificial Sequence
  Description of Artificial Sequence: Synthetic oligonucleotide
  Target: SCN9A; (-) strand; PAM type: NRG; PAM sequence: TGG
ggctgtaatattttaactcc

SEQ ID NO: 33889 - DNA, 20 bp, Artificial Sequence
  Description of Artificial Sequence: Synthetic oligonucleotide
  Target: SCN9A; (-) strand; PAM type: NRG; PAM sequence: AGG
tagatacccatcttatacac

SEQ ID NO: 33890 - DNA, 20 bp, Artificial Sequence
  Description of Artificial Sequence: Synthetic oligonucleotide
  Target: SCN9A; (-) strand; PAM type: NRG; PAM sequence: CAG
ctagatacccatcttataca

SEQ ID NO: 33891 - DNA, 20 bp, Artificial Sequence
  Description of Artificial Sequence: Synthetic oligonucleotide
  Target: SCN9A; (-) strand; PAM type: NRG; PAM sequence: TAG
aaagactctactgaagccac

SEQ ID NO: 33892 - DNA, 20 bp, Artificial Sequence
  Description of Artificial Sequence: Synthetic oligonucleotide
  Target: SCN9A; (-) strand; PAM type: NRG; PAM sequence: AAG
gatagttaaagactctactg

SEQ ID NO: 33893 - DNA, 20 bp, Artificial Sequence
  Description of Artificial Sequence: Synthetic oligonucleotide
  Target: SCN9A; (-) strand; PAM type: NRG; PAM sequence: AAG
ttccacatggatgatagtta

SEQ ID NO: 33894 - DNA, 20 bp, Artificial Sequence
  Description of Artificial Sequence: Synthetic oligonucleotide
  Target: SCN9A; (-) strand; PAM type: NRG; PAM sequence: TAG
ctacccttccacatggatga

SEQ ID NO: 33895 - DNA, 20 bp, Artificial Sequence
  Description of Artificial Sequence: Synthetic oligonucleotide
  Target: SCN9A; (-) strand; PAM type: NRG; PAM sequence: TGG
ttttttgctacccttccaca

SEQ ID NO: 33896 - DNA, 20 bp, Artificial Sequence
  Description of Artificial Sequence: Synthetic oligonucleotide
  Target: SCN9A; (-) strand; PAM type: NRG; PAM sequence: CAG
tcattcagggcattatatag

SEQ ID NO: 33897 - DNA, 20 bp, Artificial Sequence
  Description of Artificial Sequence: Synthetic oligonucleotide
  Target: SCN9A; (-) strand; PAM type: NRG; PAM sequence: TAG
cattcattcagggcattata

SEQ ID NO: 33898 - DNA, 20 bp, Artificial Sequence
  Description of Artificial Sequence: Synthetic oligonucleotide
  Target: SCN9A; (-) strand; PAM type: NRG; PAM sequence: GGG
ttgattgattcattcattca

SEQ ID NO: 33899 - DNA, 20 bp, Artificial Sequence
  Description of Artificial Sequence: Synthetic oligonucleotide
  Target: SCN9A; (-) strand; PAM type: NRG; PAM sequence: AGG
attgattgattcattcattc

SEQ ID NO: 33900 - DNA, 20 bp, Artificial Sequence
  Description of Artificial Sequence: Synthetic oligonucleotide
  Target: SCN9A; (-) strand; PAM type: NRG; PAM sequence: CAG
cattgattgattcattcatt

SEQ ID NO: 33901 - DNA, 20 bp, Artificial Sequence
  Description of Artificial Sequence: Synthetic oligonucleotide
  Target: SCN9A; (-) strand; PAM type: NRG; PAM sequence: AAG
acattgagtaccacataatc

SEQ ID NO: 33902 - DNA, 20 bp, Artificial Sequence
  Description of Artificial Sequence: Synthetic oligonucleotide
  Target: SCN9A; (-) strand; PAM type: NRG; PAM sequence: GAG
agattctgtgaaagaacatt

SEQ ID NO: 33903 - DNA, 20 bp, Artificial Sequence
  Description of Artificial Sequence: Synthetic oligonucleotide
  Target: SCN9A; (-) strand; PAM type: NRG; PAM sequence: AAG
taaaaatagagattctgtga

SEQ ID NO: 33904 - DNA, 20 bp, Artificial Sequence
  Description of Artificial Sequence: Synthetic oligonucleotide
  Target: SCN9A; (-) strand; PAM type: NRG; PAM sequence: GAG
ctgaagaaatcctaaaaata

SEQ ID NO: 33905 - DNA, 20 bp, Artificial Sequence
  Description of Artificial Sequence: Synthetic oligonucleotide
  Target: SCN9A; (-) strand; PAM type: NRG; PAM sequence: TAG
tcctgaagaaatcctaaaaa

SEQ ID NO: 33906 - DNA, 20 bp, Artificial Sequence
  Description of Artificial Sequence: Synthetic oligonucleotide
  Target: SCN9A; (-) strand; PAM type: NRG; PAM sequence: AAG
aattttgtcatgatgtcctg

SEQ ID NO: 33907 - DNA, 20 bp, Artificial Sequence
  Description of Artificial Sequence: Synthetic oligonucleotide
  Target: SCN9A; (-) strand; PAM type: NRG; PAM sequence: CAG
aagttatgcacaccacaatt

SEQ ID NO: 33908 - DNA, 20 bp, Artificial Sequence
  Description of Artificial Sequence: Synthetic oligonucleotide
  Target: SCN9A; (-) strand; PAM type: NRG; PAM sequence: AAG
ctttatgcatatttttttct

SEQ ID NO: 33909 - DNA, 20 bp, Artificial Sequence
  Description of Artificial Sequence: Synthetic oligonucleotide
  Target: SCN9A; (-) strand; PAM type: NRG; PAM sequence: TAG
attacatttgtagcacaggg

SEQ ID NO: 33910 - DNA, 20 bp, Artificial Sequence
  Description of Artificial Sequence: Synthetic oligonucleotide
  Target: SCN9A; (-) strand; PAM type: NRG; PAM sequence: GGG
aaaattacatttgtagcaca

SEQ ID NO: 33911 - DNA, 20 bp, Artificial Sequence
  Description of Artificial Sequence: Synthetic oligonucleotide
  Target: SCN9A; (-) strand; PAM type: NRG; PAM sequence: AGG
aaaaattacatttgtagcac

SEQ ID NO: 33912 - DNA, 20 bp, Artificial Sequence
  Description of Artificial Sequence: Synthetic oligonucleotide
  Target: SCN9A; (-) strand; PAM type: NRG; PAM sequence: CAG
aaaaaattacatttgtagca

SEQ ID NO: 33913 - DNA, 20 bp, Artificial Sequence
  Description of Artificial Sequence: Synthetic oligonucleotide
  Target: SCN9A; (-) strand; PAM type: NRG; PAM sequence: TAG
tatagaaaaaattacatttg

SEQ ID NO: 33914 - DNA, 20 bp, Artificial Sequence
  Description of Artificial Sequence: Synthetic oligonucleotide
  Target: SCN9A; (-) strand; PAM type: NRG; PAM sequence: TAG
ataacatgttctaattgtta

SEQ ID NO: 33915 - DNA, 20 bp, Artificial Sequence
  Description of Artificial Sequence: Synthetic oligonucleotide
  Target: SCN9A; (-) strand; PAM type: NRG; PAM sequence: AGG
actctccatgaattaaaatg

SEQ ID NO: 33916 - DNA, 20 bp, Artificial Sequence
  Description of Artificial Sequence: Synthetic oligonucleotide
  Target: SCN9A; (-) strand; PAM type: NRG; PAM sequence: GAG
aactctccatgaattaaaat

SEQ ID NO: 33917 - DNA, 20 bp, Artificial Sequence
  Description of Artificial Sequence: Synthetic oligonucleotide
  Target: SCN9A; (-) strand; PAM type: NRG; PAM sequence: AAG
ttttcaaaagaggcggatat

SEQ ID NO: 33918 - DNA, 20 bp, Artificial Sequence
  Description of Artificial Sequence: Synthetic oligonucleotide
  Target: SCN9A; (-) strand; PAM type: NRG; PAM sequence: CGG
gtgaaagttttcaaaagagg

SEQ ID NO: 33919 - DNA, 20 bp, Artificial Sequence
  Description of Artificial Sequence: Synthetic oligonucleotide
  Target: SCN9A; (-) strand; PAM type: NRG; PAM sequence: AGG
gtggtgaaagttttcaaaag

SEQ ID NO: 33920 - DNA, 20 bp, Artificial Sequence
  Description of Artificial Sequence: Synthetic oligonucleotide
  Target: SCN9A; (-) strand; PAM type: NRG; PAM sequence: GAG
cgtggtgaaagttttcaaaa

SEQ ID NO: 33921 - DNA, 20 bp, Artificial Sequence
  Description of Artificial Sequence: Synthetic oligonucleotide
  Target: SCN9A; (-) strand; PAM type: NRG; PAM sequence: AAG
aacgtggtgaaagttttcaa

SEQ ID NO: 33922 - DNA, 20 bp, Artificial Sequence
  Description of Artificial Sequence: Synthetic oligonucleotide
  Target: SCN9A; (-) strand; PAM type: NRG; PAM sequence: AAG
tactgacctcaacgtggtga

SEQ ID NO: 33923 - DNA, 20 bp, Artificial Sequence
  Description of Artificial Sequence: Synthetic oligonucleotide
  Target: SCN9A; (-) strand; PAM type: NRG; PAM sequence: TGG
agagcatactgacctcaacg

SEQ ID NO: 33924 - DNA, 20 bp, Artificial Sequence
  Description of Artificial Sequence: Synthetic oligonucleotide
  Target: SCN9A; (-) strand; PAM type: NRG; PAM sequence: GAG
tttttgttactttttttcaa

SEQ ID NO: 33925 - DNA, 20 bp, Artificial Sequence
  Description of Artificial Sequence: Synthetic oligonucleotide
  Target: SCN9A; (-) strand; PAM type: NRG; PAM sequence: AAG
tttttttgttactttttttc

SEQ ID NO: 33926 - DNA, 20 bp, Artificial Sequence
  Description of Artificial Sequence: Synthetic oligonucleotide
  Target: SCN9A; (-) strand; PAM type: NRG; PAM sequence: TAG
tagattgtttttctggaact

SEQ ID NO: 33927 - DNA, 20 bp, Artificial Sequence
  Description of Artificial Sequence: Synthetic oligonucleotide
  Target: SCN9A; (-) strand; PAM type: NRG; PAM sequence: TGG
aaatgcctagattgtttttc

SEQ ID NO: 33928 - DNA, 20 bp, Artificial Sequence
  Description of Artificial Sequence: Synthetic oligonucleotide
  Target: SCN9A; (-) strand; PAM type: NRG; PAM sequence: TAG
ctctattaatttgaaatgcc

SEQ ID NO: 33929 - DNA, 20 bp, Artificial Sequence
  Description of Artificial Sequence: Synthetic oligonucleotide
  Target: SCN9A; (-) strand; PAM type: NRG; PAM sequence: TGG
tcatcttcaacaggattttc

SEQ ID NO: 33930 - DNA, 20 bp, Artificial Sequence
  Description of Artificial Sequence: Synthetic oligonucleotide
  Target: SCN9A; (-) strand; PAM type: NRG; PAM sequence: AGG
taaataccttcatcttcaac

SEQ ID NO: 33931 - DNA, 20 bp, Artificial Sequence
  Description of Artificial Sequence: Synthetic oligonucleotide
  Target: SCN9A; (-) strand; PAM type: NRG; PAM sequence: CAG
ataaataccttcatcttcaa

SEQ ID NO: 33932 - DNA, 20 bp, Artificial Sequence
  Description of Artificial Sequence: Synthetic oligonucleotide
  Target: SCN9A; (-) strand; PAM type: NRG; PAM sequence: AAG
caggagctcaggaagaagga

SEQ ID NO: 33933 - DNA, 20 bp, Artificial Sequence
  Description of Artificial Sequence: Synthetic oligonucleotide
  Target: SCN9A; (-) strand; PAM type: NRG; PAM sequence: AGG
acatcaggagctcaggaaga

SEQ ID NO: 33934 - DNA, 20 bp, Artificial Sequence
  Description of Artificial Sequence: Synthetic oligonucleotide
  Target: SCN9A; (-) strand; PAM type: NRG; PAM sequence: AAG
aacatcaggagctcaggaag

SEQ ID NO: 33935 - DNA, 20 bp, Artificial Sequence
  Description of Artificial Sequence: Synthetic oligonucleotide
  Target: SCN9A; (-) strand; PAM type: NRG; PAM sequence: AAG
tacaacatcaggagctcagg

SEQ ID NO: 33936 - DNA, 20 bp, Artificial Sequence
  Description of Artificial Sequence: Synthetic oligonucleotide
  Target: SCN9A; (-) strand; PAM type: NRG; PAM sequence: AGG
acttacaacatcaggagctc

SEQ ID NO: 33937 - DNA, 20 bp, Artificial Sequence
  Description of Artificial Sequence: Synthetic oligonucleotide
  Target: SCN9A; (-) strand; PAM type: NRG; PAM sequence: CAG
aacttacaacatcaggagct

SEQ ID NO: 33938 - DNA, 20 bp, Artificial Sequence
  Description of Artificial Sequence: Synthetic oligonucleotide
  Target: SCN9A; (-) strand; PAM type: NRG; PAM sequence: GAG
atgacaacttacaacatcag

SEQ ID NO: 33939 - DNA, 20 bp, Artificial Sequence
  Description of Artificial Sequence: Synthetic oligonucleotide
  Target: SCN9A; (-) strand; PAM type: NRG; PAM sequence: AGG
tgatgacaacttacaacatc

SEQ ID NO: 33940 - DNA, 20 bp, Artificial Sequence
  Description of Artificial Sequence: Synthetic oligonucleotide
  Target: SCN9A; (-) strand; PAM type: NRG; PAM sequence: CAG
atgatgacaacttacaacat

SEQ ID NO: 33941 - DNA, 20 bp, Artificial Sequence
  Description of Artificial Sequence: Synthetic oligonucleotide
  Target: SCN9A; (-) strand; PAM type: NRG; PAM sequence: CAG
gtagtagcggaaaatataac

SEQ ID NO: 33942 - DNA, 20 bp, Artificial Sequence
  Description of Artificial Sequence: Synthetic oligonucleotide
  Target: SCN9A; (-) strand; PAM type: NRG; PAM sequence: CGG
tggggaggaggtagtagtag

SEQ ID NO: 33943 - DNA, 20 bp, Artificial Sequence
  Description of Artificial Sequence: Synthetic oligonucleotide
  Target: SCN9A; (-) strand; PAM type: NRG; PAM sequence: TAG
atttggggaggaggtagtag

SEQ ID NO: 33944 - DNA, 20 bp, Artificial Sequence
  Description of Artificial Sequence: Synthetic oligonucleotide
  Target: SCN9A; (-) strand; PAM type: NRG; PAM sequence: TAG
tttatttggggaggaggtag

SEQ ID NO: 33945 - DNA, 20 bp, Artificial Sequence
  Description of Artificial Sequence: Synthetic oligonucleotide
  Target: SCN9A; (-) strand; PAM type: NRG; PAM sequence: TAG
tattttatttggggaggagg

SEQ ID NO: 33946 - DNA, 20 bp, Artificial Sequence
  Description of Artificial Sequence: Synthetic oligonucleotide
  Target: SCN9A; (-) strand; PAM type: NRG; PAM sequence: AGG
gtttattttatttggggagg

SEQ ID NO: 33947 - DNA, 20 bp, Artificial Sequence
  Description of Artificial Sequence: Synthetic oligonucleotide
  Target: SCN9A; (-) strand; PAM type: NRG; PAM sequence: GAG
cgtttattttatttggggag

SEQ ID NO: 33948 - DNA, 20 bp, Artificial Sequence
  Description of Artificial Sequence: Synthetic oligonucleotide
  Target: SCN9A; (-) strand; PAM type: NRG; PAM sequence: AGG
cccgtttattttatttgggg

SEQ ID NO: 33949 - DNA, 20 bp, Artificial Sequence
  Description of Artificial Sequence: Synthetic oligonucleotide
  Target: SCN9A; (-) strand; PAM type: NRG; PAM sequence: GAG
ccccgtttattttatttggg

SEQ ID NO: 33950 - DNA, 20 bp, Artificial Sequence
  Description of Artificial Sequence: Synthetic oligonucleotide
  Target: SCN9A; (-) strand; PAM type: NRG; PAM sequence: GGG
ggccccgtttattttatttg

SEQ ID NO: 33951 - DNA, 20 bp, Artificial Sequence
  Description of Artificial Sequence: Synthetic oligonucleotide
  Target: SCN9A; (-) strand; PAM type: NRG; PAM sequence: GGG
aggccccgtttattttattt

SEQ ID NO: 33952 - DNA, 20 bp, Artificial Sequence
  Description of Artificial Sequence: Synthetic oligonucleotide
  Target: SCN9A; (-) strand; PAM type: NRG; PAM sequence: TGG
taggccccgtttattttatt

SEQ ID NO: 33953 - DNA, 20 bp, Artificial Sequence
  Description of Artificial Sequence: Synthetic oligonucleotide
  Target: SCN9A; (-) strand; PAM type: NRG; PAM sequence: AGG
aaaataaaaagatatagcat

SEQ ID NO: 33954 - DNA, 20 bp, Artificial Sequence
  Description of Artificial Sequence: Synthetic oligonucleotide
  Target: SCN9A; (-) strand; PAM type: NRG; PAM sequence: TAG
gaaaataaaaagatatagca

SEQ ID NO: 33955 - DNA, 20 bp, Artificial Sequence
  Description of Artificial Sequence: Synthetic oligonucleotide
  Target: SCN9A; (-) strand; PAM type: NRG; PAM sequence: TAG
gggatgaaaataaaaagata

SEQ ID NO: 33956 - DNA, 20 bp, Artificial Sequence
  Description of Artificial Sequence: Synthetic oligonucleotide
  Target: SCN9A; (-) strand; PAM type: NRG; PAM sequence: AAG
tctcttgggatgaaaataaa

SEQ ID NO: 33957 - DNA, 20 bp, Artificial Sequence
  Description of Artificial Sequence: Synthetic oligonucleotide
  Target: SCN9A; (-) strand; PAM type: NRG; PAM sequence: GGG
tcgttagaagatattctctt

SEQ ID NO: 33958 - DNA, 20 bp, Artificial Sequence
  Description of Artificial Sequence: Synthetic oligonucleotide
  Target: SCN9A; (-) strand; PAM type: NRG; PAM sequence: TGG
atcgttagaagatattctct

SEQ ID NO: 33959 - DNA, 20 bp, Artificial Sequence
  Description of Artificial Sequence: Synthetic oligonucleotide
  Target: SCN9A; (-) strand; PAM type: NRG; PAM sequence: AAG
tgataaacttctatcgttag

SEQ ID NO: 33960 - DNA, 20 bp, Artificial Sequence
  Description of Artificial Sequence: Synthetic oligonucleotide
  Target: SCN9A; (-) strand; PAM type: NRG; PAM sequence: TAG
acatgataaacttctatcgt

SEQ ID NO: 33961 - DNA, 20 bp, Artificial Sequence
  Description of Artificial Sequence: Synthetic oligonucleotide
  Target: SCN9A; (-) strand; PAM type: NRG; PAM sequence: CAG
gtgtaatgcccatgtttaaa

SEQ ID NO: 33962 - DNA, 20 bp, Artificial Sequence
  Description of Artificial Sequence: Synthetic oligonucleotide
  Target: SCN9A; (-) strand; PAM type: NRG; PAM sequence: AAG
tgtttttcagtaatattgga

SEQ ID NO: 33963 - DNA, 20 bp, Artificial Sequence
  Description of Artificial Sequence: Synthetic oligonucleotide
  Target: SCN9A; (-) strand; PAM type: NRG; PAM sequence: TGG
cagttgtttttcagtaatat

SEQ ID NO: 33964 - DNA, 20 bp, Artificial Sequence
  Description of Artificial Sequence: Synthetic oligonucleotide
  Target: SCN9A; (-) strand; PAM type: NRG; PAM sequence: CAG
agctagattcagttgttttt

SEQ ID NO: 33965 - DNA, 20 bp, Artificial Sequence
  Description of Artificial Sequence: Synthetic oligonucleotide
  Target: SCN9A; (-) strand; PAM type: NRG; PAM sequence: CAG
ttcagggaggaagctagatt

SEQ ID NO: 33966 - DNA, 20 bp, Artificial Sequence
  Description of Artificial Sequence: Synthetic oligonucleotide
  Target: SCN9A; (-) strand; PAM type: NRG; PAM sequence: TAG
cccaaattcagggaggaagc

SEQ ID NO: 33967 - DNA, 20 bp, Artificial Sequence
  Description of Artificial Sequence: Synthetic oligonucleotide
  Target: SCN9A; (-) strand; PAM type: NRG; PAM sequence: AAG
tactcccaaattcagggagg

SEQ ID NO: 33968 - DNA, 20 bp, Artificial Sequence
  Description of Artificial Sequence: Synthetic oligonucleotide
  Target: SCN9A; (-) strand; PAM type: NRG; PAM sequence: AGG
gaatactcccaaattcaggg

SEQ ID NO: 33969 - DNA, 20 bp, Artificial Sequence
  Description of Artificial Sequence: Synthetic oligonucleotide
  Target: SCN9A; (-) strand; PAM type: NRG; PAM sequence: GAG
agaatactcccaaattcagg

SEQ ID NO: 33970 - DNA, 20 bp, Artificial Sequence
  Description of Artificial Sequence: Synthetic oligonucleotide
  Target: SCN9A; (-) strand; PAM type: NRG; PAM sequence: GGG
gcagaatactcccaaattca

SEQ ID NO: 33971 - DNA, 20 bp, Artificial Sequence
  Description of Artificial Sequence: Synthetic oligonucleotide
  Target: SCN9A; (-) strand; PAM type: NRG; PAM sequence: AGG
tgcagaatactcccaaattc

SEQ ID NO: 33972 - DNA, 20 bp, Artificial Sequence
  Description of Artificial Sequence: Synthetic oligonucleotide
  Target: SCN9A; (-) strand; PAM type: NRG; PAM sequence: CAG
gtgcagaatactcccaaatt

SEQ ID NO: 33973 - DNA, 20 bp, Artificial Sequence
  Description of Artificial Sequence: Synthetic oligonucleotide
  Target: SCN9A; (-) strand; PAM type: NRG; PAM sequence: CAG
atttagtagccattttagtg

SEQ ID NO: 33974 - DNA, 20 bp, Artificial Sequence
  Description of Artificial Sequence: Synthetic oligonucleotide
  Target: SCN9A; (-) strand; PAM type: NRG; PAM sequence: TAG
acaaaatttagtagccattt

SEQ ID NO: 33975 - DNA, 20 bp, Artificial Sequence
  Description of Artificial Sequence: Synthetic oligonucleotide
  Target: SCN9A; (-) strand; PAM type: NRG; PAM sequence: TAG
aggcagatgacaaaatttag

SEQ ID NO: 33976 - DNA, 20 bp, Artificial Sequence
  Description of Artificial Sequence: Synthetic oligonucleotide
  Target: SCN9A; (-) strand; PAM type: NRG; PAM sequence: TAG
tcaaggcagatgacaaaatt

SEQ ID NO: 33977 - DNA, 20 bp, Artificial Sequence
  Description of Artificial Sequence: Synthetic oligonucleotide
  Target: SCN9A; (-) strand; PAM type: NRG; PAM sequence: CAG
ccatctttgttgtttcaagg

SEQ ID NO: 33978 - DNA, 20 bp, Artificial Sequence
  Description of Artificial Sequence: Synthetic oligonucleotide
  Target: SCN9A; (-) strand; PAM type: NRG; PAM sequence: AGG
tctccatctttgttgtttca

SEQ ID NO: 33979 - DNA, 20 bp, Artificial Sequence
  Description of Artificial Sequence: Synthetic oligonucleotide
  Target: SCN9A; (-) strand; PAM type: NRG; PAM sequence: AAG
ttctccatctttgttgtttc

SEQ ID NO: 33980 - DNA, 20 bp, Artificial Sequence
  Description of Artificial Sequence: Synthetic oligonucleotide
  Target: SCN9A; (-) strand; PAM type: NRG; PAM sequence: AGG
tccttattcatatttcagta

SEQ ID NO: 33981 - DNA, 20 bp, Artificial Sequence
  Description of Artificial Sequence: Synthetic oligonucleotide
  Target: SCN9A; (-) strand; PAM type: NRG; PAM sequence: AAG
ttccttattcatatttcagt

SEQ ID NO: 33982 - DNA, 20 bp, Artificial Sequence
  Description of Artificial Sequence: Synthetic oligonucleotide
  Target: SCN9A; (-) strand; PAM type: NRG; PAM sequence: CAG
gacattccttattcatattt

SEQ ID NO: 33983 - DNA, 20 bp, Artificial Sequence
  Description of Artificial Sequence: Synthetic oligonucleotide
  Target: SCN9A; (-) strand; PAM type: NRG; PAM sequence: GAG
gcccagaggagcaggagaat

SEQ ID NO: 33984 - DNA, 20 bp, Artificial Sequence
  Description of Artificial Sequence: Synthetic oligonucleotide
  Target: SCN9A; (-) strand; PAM type: NRG; PAM sequence: GAG
tcaaaagcccagaggagcag

SEQ ID NO: 33985 - DNA, 20 bp, Artificial Sequence
  Description of Artificial Sequence: Synthetic oligonucleotide
  Target: SCN9A; (-) strand; PAM type: NRG; PAM sequence: AGG
actcaaaagcccagaggagc

SEQ ID NO: 33986 - DNA, 20 bp, Artificial Sequence
  Description of Artificial Sequence: Synthetic oligonucleotide
  Target: SCN9A; (-) strand; PAM type: NRG; PAM sequence: CAG
tactcaaaagcccagaggag

SEQ ID NO: 33987 - DNA, 20 bp, Artificial Sequence
  Description of Artificial Sequence: Synthetic oligonucleotide
  Target: SCN9A; (-) strand; PAM type: NRG; PAM sequence: GAG
ggttactcaaaagcccagag

SEQ ID NO: 33988 - DNA, 20 bp, Artificial Sequence
  Description of Artificial Sequence: Synthetic oligonucleotide
  Target: SCN9A; (-) strand; PAM type: NRG; PAM sequence: AGG
caggttactcaaaagcccag

SEQ ID NO: 33989 - DNA, 20 bp, Artificial Sequence
  Description of Artificial Sequence: Synthetic oligonucleotide
  Target: SCN9A; (-) strand; PAM type: NRG; PAM sequence: GAG
acaggttactcaaaagccca

SEQ ID NO: 33990 - DNA, 20 bp, Artificial Sequence
  Description of Artificial Sequence: Synthetic oligonucleotide
  Target: SCN9A; (-) strand; PAM type: NRG; PAM sequence: CAG
gcacaggttactcaaaagcc

SEQ ID NO: 33991 - DNA, 20 bp, Artificial Sequence
  Description of Artificial Sequence: Synthetic oligonucleotide
  Target: SCN9A; (-) strand; PAM type: NRG; PAM sequence: AAG
cagcagcacaggttactcaa

SEQ ID NO: 33992 - DNA, 20 bp, Artificial Sequence
  Description of Artificial Sequence: Synthetic oligonucleotide
  Target: SCN9A; (-) strand; PAM type: NRG; PAM sequence: AGG
attacctcccacagcagcac

SEQ ID NO: 33993 - DNA, 20 bp, Artificial Sequence
  Description of Artificial Sequence: Synthetic oligonucleotide
  Target: SCN9A; (-) strand; PAM type: NRG; PAM sequence: CAG
aattacctcccacagcagca

SEQ ID NO: 33994 - DNA, 20 bp, Artificial Sequence
  Description of Artificial Sequence: Synthetic oligonucleotide
  Target: SCN9A; (-) strand; PAM type: NRG; PAM sequence: CAG
atacaaattacctcccacag

SEQ ID NO: 33995 - DNA, 20 bp, Artificial Sequence
  Description of Artificial Sequence: Synthetic oligonucleotide
  Target: SCN9A; (-) strand; PAM type: NRG; PAM sequence: CAG
gtaatacaaattacctccca

SEQ ID NO: 33996 - DNA, 20 bp, Artificial Sequence
  Description of Artificial Sequence: Synthetic oligonucleotide
  Target: SCN9A; (-) strand; PAM type: NRG; PAM sequence: TGG
tgtttactcttttcacgaag

SEQ ID NO: 33997 - DNA, 20 bp, Artificial Sequence
  Description of Artificial Sequence: Synthetic oligonucleotide
  Target: SCN9A; (-) strand; PAM type: NRG; PAM sequence: AAG
gcttgtttactcttttcacg

SEQ ID NO: 33998 - DNA, 20 bp, Artificial Sequence
  Description of Artificial Sequence: Synthetic oligonucleotide
  Target: SCN9A; (-) strand; PAM type: NRG; PAM sequence: GGG
ggggaaaggggatagtggta

SEQ ID NO: 33999 - DNA, 20 bp, Artificial Sequence
  Description of Artificial Sequence: Synthetic oligonucleotide
  Target: SCN9A; (-) strand; PAM type: NRG; PAM sequence: AGG
aggggaaaggggatagtggt

SEQ ID NO: 34000 - DNA, 20 bp, Artificial Sequence
  Description of Artificial Sequence: Synthetic oligonucleotide
  Target: SCN9A; (-) strand; PAM type: NRG; PAM sequence: TAG
caggggaaaggggatagtgg

SEQ ID NO: 34001 - DNA, 20 bp, Artificial Sequence
  Description of Artificial Sequence: Synthetic oligonucleotide
  Target: SCN9A; (-) strand; PAM type: NRG; PAM sequence: TGG
aggcaggggaaaggggatag

SEQ ID NO: 34002 - DNA, 20 bp, Artificial Sequence
  Description of Artificial Sequence: Synthetic oligonucleotide
  Target: SCN9A; (-) strand; PAM type: NRG; PAM sequence: TAG
ttaaggcaggggaaagggga

SEQ ID NO: 34003 - DNA, 20 bp, Artificial Sequence
  Description of Artificial Sequence: Synthetic oligonucleotide
  Target: SCN9A; (-) strand; PAM type: NRG; PAM sequence: GGG
ttgattaaggcaggggaaag

SEQ ID NO: 34004 - DNA, 20 bp, Artificial Sequence
  Description of Artificial Sequence: Synthetic oligonucleotide
  Target: SCN9A; (-) strand; PAM type: NRG; PAM sequence: GGG
attgattaaggcaggggaaa

SEQ ID NO: 34005 - DNA, 20 bp, Artificial Sequence
  Description of Artificial Sequence: Synthetic oligonucleotide
  Target: SCN9A; (-) strand; PAM type: NRG; PAM sequence: AGG
aattgattaaggcaggggaa

SEQ ID NO: 34006 - DNA, 20 bp, Artificial Sequence
  Description of Artificial Sequence: Synthetic oligonucleotide
  Target: SCN9A; (-) strand; PAM type: NRG; PAM sequence: AAG
aaattgattaaggcagggga

SEQ ID NO: 34007 - DNA, 20 bp, Artificial Sequence
  Description of Artificial Sequence: Synthetic oligonucleotide
  Target: SCN9A; (-) strand; PAM type: NRG; PAM sequence: GGG
tgagaaattgattaaggcag

SEQ ID NO: 34008 - DNA, 20 bp, Artificial Sequence
  Description of Artificial Sequence: Synthetic oligonucleotide
  Target: SCN9A; (-) strand; PAM type: NRG; PAM sequence: GGG
ttgagaaattgattaaggca

SEQ ID NO: 34009 - DNA, 20 bp, Artificial Sequence
  Description of Artificial Sequence: Synthetic oligonucleotide
  Target: SCN9A; (-) strand; PAM type: NRG; PAM sequence: AGG
tttgagaaattgattaaggc

SEQ ID NO: 34010 - DNA, 20 bp, Artificial Sequence
  Description of Artificial Sequence: Synthetic oligonucleotide
  Target: SCN9A; (-) strand; PAM type: NRG; PAM sequence: CAG
ttttgagaaattgattaagg

SEQ ID NO: 34011 - DNA, 20 bp, Artificial Sequence
  Description of Artificial Sequence: Synthetic oligonucleotide
  Target: SCN9A; (-) strand; PAM type: NRG; PAM sequence: AGG
tctttttgagaaattgatta

SEQ ID NO: 34012 - DNA, 20 bp, Artificial Sequence
  Description of Artificial Sequence: Synthetic oligonucleotide
  Target: SCN9A; (-) strand; PAM type: NRG; PAM sequence: AAG
gtctttttgagaaattgatt

SEQ ID NO: 34013 - DNA, 20 bp, Artificial Sequence
  Description of Artificial Sequence: Synthetic oligonucleotide
  Target: SCN9A; (-) strand; PAM type: NRG; PAM sequence: GAG
ttatggcctatggtcttttt

SEQ ID NO: 34014 - DNA, 20 bp, Artificial Sequence
  Description of Artificial Sequence: Synthetic oligonucleotide
  Target: SCN9A; (-) strand; PAM type: NRG; PAM sequence: TGG
tattcaatttttatggccta

SEQ ID NO: 34015 - DNA, 20 bp, Artificial Sequence
  Description of Artificial Sequence: Synthetic oligonucleotide
  Target: SCN9A; (-) strand; PAM type: NRG; PAM sequence: TGG
gatgatctattcaattttta

SEQ ID NO: 34016 - DNA, 20 bp, Artificial Sequence
  Description of Artificial Sequence: Synthetic oligonucleotide
  Target: SCN9A; (-) strand; PAM type: NRG; PAM sequence: AAG
agttagacctaaataatgag

SEQ ID NO: 34017 - DNA, 20 bp, Artificial Sequence
  Description of Artificial Sequence: Synthetic oligonucleotide
  Target: SCN9A; (-) strand; PAM type: NRG; PAM sequence: GAG
tttagttagacctaaataat

SEQ ID NO: 34018 - DNA, 20 bp, Artificial Sequence
  Description of Artificial Sequence: Synthetic oligonucleotide
  Target: SCN9A; (-) strand; PAM type: NRG; PAM sequence: TAG
tattgcatttggaatttagt

SEQ ID NO: 34019 - DNA, 20 bp, Artificial Sequence
  Description of Artificial Sequence: Synthetic oligonucleotide
  Target: SCN9A; (-) strand; PAM type: NRG; PAM sequence: TAG
ttgctattgcatttggaatt

SEQ ID NO: 34020 - DNA, 20 bp, Artificial Sequence
  Description of Artificial Sequence: Synthetic oligonucleotide
  Target: SCN9A; (-) strand; PAM type: NRG; PAM sequence: TGG
atgatctttgctattgcatt

SEQ ID NO: 34021 - DNA, 20 bp, Artificial Sequence
  Description of Artificial Sequence: Synthetic oligonucleotide
  Target: SCN9A; (-) strand; PAM type: NRG; PAM sequence: AAG
tcactaatgagggagaagaa

SEQ ID NO: 34022 - DNA, 20 bp, Artificial Sequence
  Description of Artificial Sequence: Synthetic oligonucleotide
  Target: SCN9A; (-) strand; PAM type: NRG; PAM sequence: AAG
caggttcactaatgagggag

SEQ ID NO: 34023 - DNA, 20 bp, Artificial Sequence
  Description of Artificial Sequence: Synthetic oligonucleotide
  Target: SCN9A; (-) strand; PAM type: NRG; PAM sequence: GAG
caacaggttcactaatgagg

SEQ ID NO: 34024 - DNA, 20 bp, Artificial Sequence
  Description of Artificial Sequence: Synthetic oligonucleotide
  Target: SCN9A; (-) strand; PAM type: NRG; PAM sequence: GGG
tacaacaggttcactaatga

SEQ ID NO: 34025 - DNA, 20 bp, Artificial Sequence
  Description of Artificial Sequence: Synthetic oligonucleotide
  Target: SCN9A; (-) strand; PAM type: NRG; PAM sequence: AGG
ttacaacaggttcactaatg

SEQ ID NO: 34026 - DNA, 20 bp, Artificial Sequence
  Description of Artificial Sequence: Synthetic oligonucleotide
  Target: SCN9A; (-) strand; PAM type: NRG; PAM sequence: GAG
gttacaacaggttcactaat

SEQ ID NO: 34027 - DNA, 20 bp, Artificial Sequence
  Description of Artificial Sequence: Synthetic oligonucleotide
  Target: SCN9A; (-) strand; PAM type: NRG; PAM sequence: AGG
gagaaatgccaagttacaac

SEQ ID NO: 34028 - DNA, 20 bp, Artificial Sequence
  Description of Artificial Sequence: Synthetic oligonucleotide
  Target: SCN9A; (-) strand; PAM type: NRG; PAM sequence: CAG
tgagaaatgccaagttacaa

SEQ ID NO: 34029 - DNA, 20 bp, Artificial Sequence
  Description of Artificial Sequence: Synthetic oligonucleotide
  Target: SCN9A; (-) strand; PAM type: NRG; PAM sequence: AAG
agacaagtatgagaaatgcc

SEQ ID NO: 34030 - DNA, 20 bp, Artificial Sequence
  Description of Artificial Sequence: Synthetic oligonucleotide
  Target: SCN9A; (-) strand; PAM type: NRG; PAM sequence: GAG
ggcttttccaagacaagtat

SEQ ID NO: 34031 - DNA, 20 bp, Artificial Sequence
  Description of Artificial Sequence: Synthetic oligonucleotide
  Target: SCN9A; (-) strand; PAM type: NRG; PAM sequence: AAG
tattcaggcttttccaagac

SEQ ID NO: 34032 - DNA, 20 bp, Artificial Sequence
  Description of Artificial Sequence: Synthetic oligonucleotide
  Target: SCN9A; (-) strand; PAM type: NRG; PAM sequence: AAG
aaaggtattcaggcttttcc

SEQ ID NO: 34033 - DNA, 20 bp, Artificial Sequence
  Description of Artificial Sequence: Synthetic oligonucleotide
  Target: SCN9A; (-) strand; PAM type: NRG; PAM sequence: AGG
gagataaataaaaggtattc

SEQ ID NO: 34034 - DNA, 20 bp, Artificial Sequence
  Description of Artificial Sequence: Synthetic oligonucleotide
  Target: SCN9A; (-) strand; PAM type: NRG; PAM sequence: CAG
tgagataaataaaaggtatt

SEQ ID NO: 34035 - DNA, 20 bp, Artificial Sequence
  Description of Artificial Sequence: Synthetic oligonucleotide
  Target: SCN9A; (-) strand; PAM type: NRG; PAM sequence: AGG
actttgctgagataaataaa

SEQ ID NO: 34036 - DNA, 20 bp, Artificial Sequence
  Description of Artificial Sequence: Synthetic oligonucleotide
  Target: SCN9A; (-) strand; PAM type: NRG; PAM sequence: AAG
tactttgctgagataaataa

SEQ ID NO: 34037 - DNA, 20 bp, Artificial Sequence
  Description of Artificial Sequence: Synthetic oligonucleotide
  Target: SCN9A; (-) strand; PAM type: NRG; PAM sequence: GAG
tattaaaatcttactttgct

SEQ ID NO: 34038 - DNA, 20 bp, Artificial Sequence
  Description of Artificial Sequence: Synthetic oligonucleotide
  Target: SCN9A; (-) strand; PAM type: NRG; PAM sequence: GAG
attttctactggacagtatt

SEQ ID NO: 34039 - DNA, 20 bp, Artificial Sequence
  Description of Artificial Sequence: Synthetic oligonucleotide
  Target: SCN9A; (-) strand; PAM type: NRG; PAM sequence: CAG
ttaatacattttctactgga

SEQ ID NO: 34040 - DNA, 20 bp, Artificial Sequence
  Description of Artificial Sequence: Synthetic oligonucleotide
  Target: SCN9A; (-) strand; PAM type: NRG; PAM sequence: TGG
aagtttaatacattttctac

SEQ ID NO: 34041 - DNA, 20 bp, Artificial Sequence
  Description of Artificial Sequence: Synthetic oligonucleotide
  Target: SCN9A; (-) strand; PAM type: NRG; PAM sequence: AAG
caagtattatgtactttaag

SEQ ID NO: 34042 - DNA, 20 bp, Artificial Sequence
  Description of Artificial Sequence: Synthetic oligonucleotide
  Target: SCN9A; (-) strand; PAM type: NRG; PAM sequence: AAG
gctcaagtattatgtacttt

SEQ ID NO: 34043 - DNA, 20 bp, Artificial Sequence
  Description of Artificial Sequence: Synthetic oligonucleotide
  Target: SCN9A; (-) strand; PAM type: NRG; PAM sequence: AAG
ctgtgtgtctttgacggctc

SEQ ID NO: 34044 - DNA, 20 bp, Artificial Sequence
  Description of Artificial Sequence: Synthetic oligonucleotide
  Target: SCN9A; (-) strand; PAM type: NRG; PAM sequence: CGG
gcccatctgtgtgtctttga

SEQ ID NO: 34045 - DNA, 20 bp, Artificial Sequence
  Description of Artificial Sequence: Synthetic oligonucleotide
  Target: SCN9A; (-) strand; PAM type: NRG; PAM sequence: AGG
attaggagaaatgcccctag

SEQ ID NO: 34046 - DNA, 20 bp, Artificial Sequence
  Description of Artificial Sequence: Synthetic oligonucleotide
  Target: SCN9A; (-) strand; PAM type: NRG; PAM sequence: GAG
tattaggagaaatgccccta

SEQ ID NO: 34047 - DNA, 20 bp, Artificial Sequence
  Description of Artificial Sequence: Synthetic oligonucleotide
  Target: SCN9A; (-) strand; PAM type: NRG; PAM sequence: TAG
tttattaggagaaatgcccc

SEQ ID NO: 34048 - DNA, 20 bp, Artificial Sequence
  Description of Artificial Sequence: Synthetic oligonucleotide
  Target: SCN9A; (-) strand; PAM type: NRG; PAM sequence: GAG
gagcatctcacatttattag

SEQ ID NO: 34049 - DNA, 20 bp, Artificial Sequence
  Description of Artificial Sequence: Synthetic oligonucleotide
  Target: SCN9A; (-) strand; PAM type: NRG; PAM sequence: AGG
cagagcatctcacatttatt

SEQ ID NO: 34050 - DNA, 20 bp, Artificial Sequence
  Description of Artificial Sequence: Synthetic oligonucleotide
  Target: SCN9A; (-) strand; PAM type: NRG; PAM sequence: TAG
gcagagcatctcacatttat

SEQ ID NO: 34051 - DNA, 20 bp, Artificial Sequence
  Description of Artificial Sequence: Synthetic oligonucleotide
  Target: SCN9A; (-) strand; PAM type: NRG; PAM sequence: GAG
attttttcccagcttgagca

SEQ ID NO: 34052 - DNA, 20 bp, Artificial Sequence
  Description of Artificial Sequence: Synthetic oligonucleotide
  Target: SCN9A; (-) strand; PAM type: NRG; PAM sequence: CAG
atattttttcccagcttgag

SEQ ID NO: 34053 - DNA, 20 bp, Artificial Sequence
  Description of Artificial Sequence: Synthetic oligonucleotide
  Target: SCN9A; (-) strand; PAM type: NRG; PAM sequence: GAG
tacatattttttcccagctt

SEQ ID NO: 34054 - DNA, 20 bp, Artificial Sequence
  Description of Artificial Sequence: Synthetic oligonucleotide
  Target: SCN9A; (-) strand; PAM type: NRG; PAM sequence: CAG
aggagatacatattttttcc

SEQ ID NO: 34055 - DNA, 20 bp, Artificial Sequence
  Description of Artificial Sequence: Synthetic oligonucleotide
  Target: SCN9A; (-) strand; PAM type: NRG; PAM sequence: GAG
accatatctttcacaaacag

SEQ ID NO: 34056 - DNA, 20 bp, Artificial Sequence
  Description of Artificial Sequence: Synthetic oligonucleotide
  Target: SCN9A; (-) strand; PAM type: NRG; PAM sequence: AGG
gaaccatatctttcacaaac

SEQ ID NO: 34057 - DNA, 20 bp, Artificial Sequence
  Description of Artificial Sequence: Synthetic oligonucleotide
  Target: SCN9A; (-) strand; PAM type: NRG; PAM sequence: CAG
tgaaccatatctttcacaaa

SEQ ID NO: 34058 - DNA, 20 bp, Artificial Sequence
  Description of Artificial Sequence: Synthetic oligonucleotide
  Target: SCN9A; (-) strand; PAM type: NRG; PAM sequence: CAG
tggttttgttgtcagggtag

SEQ ID NO: 34059 - DNA, 20 bp, Artificial Sequence
  Description of Artificial Sequence: Synthetic oligonucleotide
  Target: SCN9A; (-) strand; PAM type: NRG; PAM sequence: TAG
gcttggttttgttgtcaggg

SEQ ID NO: 34060 - DNA, 20 bp, Artificial Sequence
  Description of Artificial Sequence: Synthetic oligonucleotide
  Target: SCN9A; (-) strand; PAM type: NRG; PAM sequence: GGG
tgtgcttggttttgttgtca

SEQ ID NO: 34061 - DNA, 20 bp, Artificial Sequence
  Description of Artificial Sequence: Synthetic oligonucleotide
  Target: SCN9A; (-) strand; PAM type: NRG; PAM sequence: AGG
atgtgcttggttttgttgtc

SEQ ID NO: 34062 - DNA, 20 bp, Artificial Sequence
  Description of Artificial Sequence: Synthetic oligonucleotide
  Target: SCN9A; (-) strand; PAM type: NRG; PAM sequence: CAG
aatgtgcttggttttgttgt

SEQ ID NO: 34063 - DNA, 20 bp, Artificial Sequence
  Description of Artificial Sequence: Synthetic oligonucleotide
  Target: SCN9A; (-) strand; PAM type: NRG; PAM sequence: TGG
ccttaggtcactaatgtgct

SEQ ID NO: 34064 - DNA, 20 bp, Artificial Sequence
  Description of Artificial Sequence: Synthetic oligonucleotide
  Target: SCN9A; (-) strand; PAM type: NRG; PAM sequence: AGG
aggtatctctgcagtccctt

SEQ ID NO: 34065 - DNA, 20 bp, Artificial Sequence
  Description of Artificial Sequence: Synthetic oligonucleotide
  Target: SCN9A; (-) strand; PAM type: NRG; PAM sequence: TAG
caggtatctctgcagtccct

SEQ ID NO: 34066 - DNA, 20 bp, Artificial Sequence
  Description of Artificial Sequence: Synthetic oligonucleotide
  Target: SCN9A; (-) strand; PAM type: NRG; PAM sequence: CAG
aacaatagcaggtatctctg

SEQ ID NO: 34067 - DNA, 20 bp, Artificial Sequence
  Description of Artificial Sequence: Synthetic oligonucleotide
  Target: SCN9A; (-) strand; PAM type: NRG; PAM sequence: AGG
ttttggtgtcaaacaatagc

SEQ ID NO: 34068 - DNA, 20 bp, Artificial Sequence
  Description of Artificial Sequence: Synthetic oligonucleotide
  Target: SCN9A; (-) strand; PAM type: NRG; PAM sequence: CAG
cttttggtgtcaaacaatag

SEQ ID NO: 34069 - DNA, 20 bp, Artificial Sequence
  Description of Artificial Sequence: Synthetic oligonucleotide
  Target: SCN9A; (-) strand; PAM type: NRG; PAM sequence: TAG
ttccttttggtgtcaaacaa

SEQ ID NO: 34070 - DNA, 20 bp, Artificial Sequence
  Description of Artificial Sequence: Synthetic oligonucleotide
  Target: SCN9A; (-) strand; PAM type: NRG; PAM sequence: TGG
agtaagtttccaattccttt

SEQ ID NO: 34071 - DNA, 20 bp, Artificial Sequence
  Description of Artificial Sequence: Synthetic oligonucleotide
  Target: SCN9A; (-) strand; PAM type: NRG; PAM sequence: AAG
gcacctgctccatatttagt

SEQ ID NO: 34072 - DNA, 20 bp, Artificial Sequence
  Description of Artificial Sequence: Synthetic oligonucleotide
  Target: SCN9A; (-) strand; PAM type: NRG; PAM sequence: TAG
ctctgcacctgctccatatt

SEQ ID NO: 34073 - DNA, 20 bp, Artificial Sequence
  Description of Artificial Sequence: Synthetic oligonucleotide
  Target: SCN9A; (-) strand; PAM type: NRG; PAM sequence: AGG
gctttagagagaacaatgat

SEQ ID NO: 34074 - DNA, 20 bp, Artificial Sequence
  Description of Artificial Sequence: Synthetic oligonucleotide
  Target: SCN9A; (-) strand; PAM type: NRG; PAM sequence: TAG
cgctttagagagaacaatga

SEQ ID NO: 34075 - DNA, 20 bp, Artificial Sequence
  Description of Artificial Sequence: Synthetic oligonucleotide
  Target: SCN9A; (-) strand; PAM type: NRG; PAM sequence: GAG
acctgaacccacgctttaga

SEQ ID NO: 34076 - DNA, 20 bp, Artificial Sequence
  Description of Artificial Sequence: Synthetic oligonucleotide
  Target: SCN9A; (-) strand; PAM type: NRG; PAM sequence: GAG
ccacctgaacccacgcttta

SEQ ID NO: 34077 - DNA, 20 bp, Artificial Sequence
  Description of Artificial Sequence: Synthetic oligonucleotide
  Target: SCN9A; (-) strand; PAM type: NRG; PAM sequence: TAG
tcccacctgaacccacgctt

SEQ ID NO: 34078 - DNA, 20 bp, Artificial Sequence
  Description of Artificial Sequence: Synthetic oligonucleotide
  Target: SCN9A; (-) strand; PAM type: NRG; PAM sequence: GAG
tatatcatatacttttcaat

SEQ ID NO: 34079 - DNA, 20 bp, Artificial Sequence
  Description of Artificial Sequence: Synthetic oligonucleotide
  Target: SCN9A; (-) strand; PAM type: NRG; PAM sequence: TGG
tctttctgatgttcctctcc

SEQ ID NO: 34080 - DNA, 20 bp, Artificial Sequence
  Description of Artificial Sequence: Synthetic oligonucleotide
  Target: SCN9A; (-) strand; PAM type: NRG; PAM sequence: AGG
tcagagttctgtctagtgtg

SEQ ID NO: 34081 - DNA, 20 bp, Artificial Sequence
  Description of Artificial Sequence: Synthetic oligonucleotide
  Target: SCN9A; (-) strand; PAM type: NRG; PAM sequence: GAG
ttcagagttctgtctagtgt

SEQ ID NO: 34082 - DNA, 20 bp, Artificial Sequence
  Description of Artificial Sequence: Synthetic oligonucleotide
  Target: SCN9A; (-) strand; PAM type: NRG; PAM sequence: TAG
catctcttcagagttctgtc

SEQ ID NO: 34083 - DNA, 20 bp, Artificial Sequence
  Description of Artificial Sequence: Synthetic oligonucleotide
  Target: SCN9A; (-) strand; PAM type: NRG; PAM sequence: GAG
ttgaaatatccatctcttca

SEQ ID NO: 34084 - DNA, 20 bp, Artificial Sequence
  Description of Artificial Sequence: Synthetic oligonucleotide
  Target: SCN9A; (-) strand; PAM type: NRG; PAM sequence: CAG
atttgaaatatccatctctt

SEQ ID NO: 34085 - DNA, 20 bp, Artificial Sequence
  Description of Artificial Sequence: Synthetic oligonucleotide
  Target: SCN9A; (-) strand; PAM type: NRG; PAM sequence: CAG
acacatggatgactcactcc

SEQ ID NO: 34086 - DNA, 20 bp, Artificial Sequence
  Description of Artificial Sequence: Synthetic oligonucleotide
  Target: SCN9A; (-) strand; PAM type: NRG; PAM sequence: TGG
ggagaaatgggacagacaca

SEQ ID NO: 34087 - DNA, 20 bp, Artificial Sequence
  Description of Artificial Sequence: Synthetic oligonucleotide
  Target: SCN9A; (-) strand; PAM type: NRG; PAM sequence: CAG
attgatgtggagaaatggga

SEQ ID NO: 34088 - DNA, 20 bp, Artificial Sequence
  Description of Artificial Sequence: Synthetic oligonucleotide
  Target: SCN9A; (-) strand; PAM type: NRG; PAM sequence: GGG
gcaaattgatgtggagaaat

SEQ ID NO: 34089 - DNA, 20 bp, Artificial Sequence
  Description of Artificial Sequence: Synthetic oligonucleotide
  Target: SCN9A; (-) strand; PAM type: NRG; PAM sequence: TGG
agcaaattgatgtggagaaa

SEQ ID NO: 34090 - DNA, 20 bp, Artificial Sequence
  Description of Artificial Sequence: Synthetic oligonucleotide
  Target: SCN9A; (-) strand; PAM type: NRG; PAM sequence: GAG
gatgtcagcaaattgatgtg

SEQ ID NO: 34091 - DNA, 20 bp, Artificial Sequence
  Description of Artificial Sequence: Synthetic oligonucleotide
  Target: SCN9A; (-) strand; PAM type: NRG; PAM sequence: TGG
cagatgtcagcaaattgatg

SEQ ID NO: 34092 - DNA, 20 bp, Artificial Sequence
  Description of Artificial Sequence: Synthetic oligonucleotide
  Target: SCN9A; (-) strand; PAM type: NRG; PAM sequence: CAG
aaagtggacaaggcagatgt

SEQ ID NO: 34093 - DNA, 20 bp, Artificial Sequence
  Description of Artificial Sequence: Synthetic oligonucleotide
  Target: SCN9A; (-) strand; PAM type: NRG; PAM sequence: CAG
attttaaaaagtggacaagg

SEQ ID NO: 34094 - DNA, 20 bp, Artificial Sequence
  Description of Artificial Sequence: Synthetic oligonucleotide
  Target: SCN9A; (-) strand; PAM type: NRG; PAM sequence: AGG
aatattttaaaaagtggaca

SEQ ID NO: 34095 - DNA, 20 bp, Artificial Sequence
  Description of Artificial Sequence: Synthetic oligonucleotide
  Target: SCN9A; (-) strand; PAM type: NRG; PAM sequence: AAG
aaatattttaaaaagtggac

SEQ ID NO: 34096 - DNA, 20 bp, Artificial Sequence
  Description of Artificial Sequence: Synthetic oligonucleotide
  Target: SCN9A; (-) strand; PAM type: NRG; PAM sequence: TGG
actaaaaatattttaaaaag

SEQ ID NO: 34097 - DNA, 20 bp, Artificial Sequence
  Description of Artificial Sequence: Synthetic oligonucleotide
  Target: SCN9A; (-) strand; PAM type: NRG; PAM sequence: AAG
ataactaaaaatattttaaa

SEQ ID NO: 34098 - DNA, 20 bp, Artificial Sequence
  Description of Artificial Sequence: Synthetic oligonucleotide
  Target: SCN9A; (-) strand; PAM type: NRG; PAM sequence: CAG
aaacaccattcttattagtt

SEQ ID NO: 34099 - DNA, 20 bp, Artificial Sequence
  Description of Artificial Sequence: Synthetic oligonucleotide
  Target: SCN9A; (-) strand; PAM type: NRG; PAM sequence: TAG
tctctaaacaccattcttat

SEQ ID NO: 34100 - DNA, 20 bp, Artificial Sequence
  Description of Artificial Sequence: Synthetic oligonucleotide
  Target: SCN9A; (-) strand; PAM type: NRG; PAM sequence: CAG
cagtgcctaaagattttaga

SEQ ID NO: 34101 - DNA, 20 bp, Artificial Sequence
  Description of Artificial Sequence: Synthetic oligonucleotide
  Target: SCN9A; (-) strand; PAM type: NRG; PAM sequence: TAG
ggaccagtgcctaaagattt

SEQ ID NO: 34102 - DNA, 20 bp, Artificial Sequence
  Description of Artificial Sequence: Synthetic oligonucleotide
  Target: SCN9A; (-) strand; PAM type: NRG; PAM sequence: AAG
gagtgatggaccagtgccta

SEQ ID NO: 34103 - DNA, 20 bp, Artificial Sequence
  Description of Artificial Sequence: Synthetic oligonucleotide
  Target: SCN9A; (-) strand; PAM type: NRG; PAM sequence: CAG
agacggcaagagtgatggac

SEQ ID NO: 34104 - DNA, 20 bp, Artificial Sequence
  Description of Artificial Sequence: Synthetic oligonucleotide
  Target: SCN9A; (-) strand; PAM type: NRG; PAM sequence: TGG
tataaagacggcaagagtga

SEQ ID NO: 34105 - DNA, 20 bp, Artificial Sequence
  Description of Artificial Sequence: Synthetic oligonucleotide
  Target: SCN9A; (-) strand; PAM type: NRG; PAM sequence: GAG
atgggctataaagacggcaa

SEQ ID NO: 34106 - DNA, 20 bp, Artificial Sequence
  Description of Artificial Sequence: Synthetic oligonucleotide
  Target: SCN9A; (-) strand; PAM type: NRG; PAM sequence: AAG
gaatgggctataaagacggc

SEQ ID NO: 34107 - DNA, 20 bp, Artificial Sequence
  Description of Artificial Sequence: Synthetic oligonucleotide
  Target: SCN9A; (-) strand; PAM type: NRG; PAM sequence: CGG
agaggaatgggctataaaga

SEQ ID NO: 34108 - DNA, 20 bp, Artificial Sequence
  Description of Artificial Sequence: Synthetic oligonucleotide
  Target: SCN9A; (-) strand; PAM type: NRG; PAM sequence: AAG
agagagaggaatgggctata

SEQ ID NO: 34109 - DNA, 20 bp, Artificial Sequence
  Description of Artificial Sequence: Synthetic oligonucleotide
  Target: SCN9A; (-) strand; PAM type: NRG; PAM sequence: GGG
gaagaaagagagagaggaat

SEQ ID NO: 34110 - DNA, 20 bp, Artificial Sequence
  Description of Artificial Sequence: Synthetic oligonucleotide
  Target: SCN9A; (-) strand; PAM type: NRG; PAM sequence: TGG
agaagaaagagagagaggaa

SEQ ID NO: 34111 - DNA, 20 bp, Artificial Sequence
  Description of Artificial Sequence: Synthetic oligonucleotide
  Target: SCN9A; (-) strand; PAM type: NRG; PAM sequence: AGG
gaataagaagaaagagagag

SEQ ID NO: 34112 - DNA, 20 bp, Artificial Sequence
  Description of Artificial Sequence: Synthetic oligonucleotide
  Target: SCN9A; (-) strand; PAM type: NRG; PAM sequence: GAG
agaataagaagaaagagaga

SEQ ID NO: 34113 - DNA, 20 bp, Artificial Sequence
  Description of Artificial Sequence: Synthetic oligonucleotide
  Target: SCN9A; (-) strand; PAM type: NRG; PAM sequence: GAG
ggagaataagaagaaagaga

SEQ ID NO: 34114 - DNA, 20 bp, Artificial Sequence
  Description of Artificial Sequence: Synthetic oligonucleotide
  Target: SCN9A; (-) strand; PAM type: NRG; PAM sequence: GAG
aaggagaataagaagaaaga

SEQ ID NO: 34115 - DNA, 20 bp, Artificial Sequence
  Description of Artificial Sequence: Synthetic oligonucleotide
  Target: SCN9A; (-) strand; PAM type: NRG; PAM sequence: GAG
caaaggagaataagaagaaa

SEQ ID NO: 34116 - DNA, 20 bp, Artificial Sequence
  Description of Artificial Sequence: Synthetic oligonucleotide
  Target: SCN9A; (-) strand; PAM type: NRG; PAM sequence: AAG
cccaaaggagaataagaaga

SEQ ID NO: 34117 - DNA, 20 bp, Artificial Sequence
  Description of Artificial Sequence: Synthetic oligonucleotide
  Target: SCN9A; (-) strand; PAM type: NRG; PAM sequence: AAG
agatcccaaaggagaataag

SEQ ID NO: 34118 - DNA, 20 bp, Artificial Sequence
  Description of Artificial Sequence: Synthetic oligonucleotide
  Target: SCN9A; (-) strand; PAM type: NRG; PAM sequence: AAG
aaaagatcccaaaggagaat

SEQ ID NO: 34119 - DNA, 20 bp, Artificial Sequence
  Description of Artificial Sequence: Synthetic oligonucleotide
  Target: SCN9A; (-) strand; PAM type: NRG; PAM sequence: GAG
aaaaataaaagatcccaaag

SEQ ID NO: 34120 - DNA, 20 bp, Artificial Sequence
  Description of Artificial Sequence: Synthetic oligonucleotide
  Target: SCN9A; (-) strand; PAM type: NRG; PAM sequence: AGG
aaaaaaataaaagatcccaa

SEQ ID NO: 34121 - DNA, 20 bp, Artificial Sequence
  Description of Artificial Sequence: Synthetic oligonucleotide
  Target: SCN9A; (-) strand; PAM type: NRG; PAM sequence: AAG
caaaaaaataaaagatccca

SEQ ID NO: 34122 - DNA, 20 bp, Artificial Sequence
  Description of Artificial Sequence: Synthetic oligonucleotide
  Target: SCN9A; (-) strand; PAM type: NRG; PAM sequence: AAG
cagaatactcaaaaaaataa

SEQ ID NO: 34123 - DNA, 20 bp, Artificial Sequence
  Description of Artificial Sequence: Synthetic oligonucleotide
  Target: SCN9A; (-) strand; PAM type: NRG; PAM sequence: CAG
gtaggtgtaattggaaacaa

SEQ ID NO: 34124 - DNA, 20 bp, Artificial Sequence
  Description of Artificial Sequence: Synthetic oligonucleotide
  Target: SCN9A; (-) strand; PAM type: NRG; PAM sequence: TGG
ccagaagttgtaggtgtaat

SEQ ID NO: 34125 - DNA, 20 bp, Artificial Sequence
  Description of Artificial Sequence: Synthetic oligonucleotide
  Target: SCN9A; (-) strand; PAM type: NRG; PAM sequence: AGG
tattttttgccagaagttgt

SEQ ID NO: 34126 - DNA, 20 bp, Artificial Sequence
  Description of Artificial Sequence: Synthetic oligonucleotide
  Target: SCN9A; (-) strand; PAM type: NRG; PAM sequence: TAG
atattttttgccagaagttg

SEQ ID NO: 34127 - DNA, 20 bp, Artificial Sequence
  Description of Artificial Sequence: Synthetic oligonucleotide
  Target: SCN9A; (-) strand; PAM type: NRG; PAM sequence: AAG
tattttatattttttgccag

SEQ ID NO: 34128 - DNA, 20 bp, Artificial Sequence
  Description of Artificial Sequence: Synthetic oligonucleotide
  Target: SCN9A; (-) strand; PAM type: NRG; PAM sequence: CAG
aagtattttatattttttgc

SEQ ID NO: 34129 - DNA, 20 bp, Artificial Sequence
  Description of Artificial Sequence: Synthetic oligonucleotide
  Target: SCN9A; (-) strand; PAM type: NRG; PAM sequence: AAG
aattacttgatgtcctatta

SEQ ID NO: 34130 - DNA, 20 bp, Artificial Sequence
  Description of Artificial Sequence: Synthetic oligonucleotide
  Target: SCN9A; (-) strand; PAM type: NRG; PAM sequence: AGG
ttcatgaaccctctggattt

SEQ ID NO: 34131 - DNA, 20 bp, Artificial Sequence
  Description of Artificial Sequence: Synthetic oligonucleotide
  Target: SCN9A; (-) strand; PAM type: NRG; PAM sequence: TAG
attcatgaaccctctggatt

SEQ ID NO: 34132 - DNA, 20 bp, Artificial Sequence
  Description of Artificial Sequence: Synthetic oligonucleotide
  Target: SCN9A; (-) strand; PAM type: NRG; PAM sequence: TGG
gcaatgattcatgaaccctc

SEQ ID NO: 34133 - DNA, 20 bp, Artificial Sequence
  Description of Artificial Sequence: Synthetic oligonucleotide
  Target: SCN9A; (-) strand; PAM type: NRG; PAM sequence: GAG
gggtgtcaagagctttctaa

SEQ ID NO: 34134 - DNA, 20 bp, Artificial Sequence
  Description of Artificial Sequence: Synthetic oligonucleotide
  Target: SCN9A; (-) strand; PAM type: NRG; PAM sequence: AAG
ctgggtgtcaagagctttct

SEQ ID NO: 34135 - DNA, 20 bp, Artificial Sequence
  Description of Artificial Sequence: Synthetic oligonucleotide
  Target: SCN9A; (-) strand; PAM type: NRG; PAM sequence: GAG
acctatcccctgggtgtcaa

SEQ ID NO: 34136 - DNA, 20 bp, Artificial Sequence
  Description of Artificial Sequence: Synthetic oligonucleotide
  Target: SCN9A; (-) strand; PAM type: NRG; PAM sequence: AAG
aaacctatcccctgggtgtc

SEQ ID NO: 34137 - DNA, 20 bp, Artificial Sequence
  Description of Artificial Sequence: Synthetic oligonucleotide
  Target: SCN9A; (-) strand; PAM type: NRG; PAM sequence: GGG
tgcatgaaaacctatcccct

SEQ ID NO: 34138 - DNA, 20 bp, Artificial Sequence
  Description of Artificial Sequence: Synthetic oligonucleotide
  Target: SCN9A; (-) strand; PAM type: NRG; PAM sequence: TGG
ctgcatgaaaacctatcccc

SEQ ID NO: 34139 - DNA, 20 bp, Artificial Sequence
  Description of Artificial Sequence: Synthetic oligonucleotide
  Target: SCN9A; (-) strand; PAM type: NRG; PAM sequence: GGG
ctaggcatgttgatctccca

SEQ ID NO: 34140 - DNA, 20 bp, Artificial Sequence
  Description of Artificial Sequence: Synthetic oligonucleotide
  Target: SCN9A; (-) strand; PAM type: NRG; PAM sequence: AGG
actaggcatgttgatctccc

SEQ ID NO: 34141 - DNA, 20 bp, Artificial Sequence
  Description of Artificial Sequence: Synthetic oligonucleotide
  Target: SCN9A; (-) strand; PAM type: NRG; PAM sequence: CAG
cactaggcatgttgatctcc

SEQ ID NO: 34142 - DNA, 20 bp, Artificial Sequence
  Description of Artificial Sequence: Synthetic oligonucleotide
  Target: SCN9A; (-) strand; PAM type: NRG; PAM sequence: AGG
catgaggtacatcaaccact

SEQ ID NO: 34143 - DNA, 20 bp, Artificial Sequence
  Description of Artificial Sequence: Synthetic oligonucleotide
  Target: SCN9A; (-) strand; PAM type: NRG; PAM sequence: TAG
acatgaggtacatcaaccac

SEQ ID NO: 34144 - DNA, 20 bp, Artificial Sequence
  Description of Artificial Sequence: Synthetic oligonucleotide
  Target: SCN9A; (-) strand; PAM type: NRG; PAM sequence: AGG
acaaacacatcttgtacatg

SEQ ID NO: 34145 - DNA, 20 bp, Artificial Sequence
  Description of Artificial Sequence: Synthetic oligonucleotide
  Target: SCN9A; (-) strand; PAM type: NRG; PAM sequence: GAG
aacaaacacatcttgtacat

SEQ ID NO: 34146 - DNA, 20 bp, Artificial Sequence
  Description of Artificial Sequence: Synthetic oligonucleotide
  Target: SCN9A; (-) strand; PAM type: NRG; PAM sequence: GAG
atagctctttactaagtcag

SEQ ID NO: 34147 - DNA, 20 bp, Artificial Sequence
  Description of Artificial Sequence: Synthetic oligonucleotide
  Target: SCN9A; (-) strand; PAM type: NRG; PAM sequence: AGG
aaatagctctttactaagtc

SEQ ID NO: 34148 - DNA, 20 bp, Artificial Sequence
  Description of Artificial Sequence: Synthetic oligonucleotide
  Target: SCN9A; (-) strand; PAM type: NRG; PAM sequence: CAG
taaatagctctttactaagt

SEQ ID NO: 34149 - DNA, 20 bp, Artificial Sequence
  Description of Artificial Sequence: Synthetic oligonucleotide
  Target: SCN9A; (-) strand; PAM type: NRG; PAM sequence: AAG
cacttaaatagctctttact

SEQ ID NO: 34150 - DNA, 20 bp, Artificial Sequence
  Description of Artificial Sequence: Synthetic oligonucleotide
  Target: SCN9A; (-) strand; PAM type: NRG; PAM sequence: TAG
caaccaggggtccacttaaa

SEQ ID NO: 34151 - DNA, 20 bp, Artificial Sequence
  Description of Artificial Sequence: Synthetic oligonucleotide
  Target: SCN9A; (-) strand; PAM type: NRG; PAM sequence: GGG
aggctttcctccccaaccag

SEQ ID NO: 34152 - DNA, 20 bp, Artificial Sequence
  Description of Artificial Sequence: Synthetic oligonucleotide
  Target: SCN9A; (-) strand; PAM type: NRG; PAM sequence: GGG
aaggctttcctccccaacca

SEQ ID NO: 34153 - DNA, 20 bp, Artificial Sequence
  Description of Artificial Sequence: Synthetic oligonucleotide
  Target: SCN9A; (-) strand; PAM type: NRG; PAM sequence: AGG
caaggctttcctccccaacc

SEQ ID NO: 34154 - DNA, 20 bp, Artificial Sequence
  Description of Artificial Sequence: Synthetic oligonucleotide
  Target: SCN9A; (-) strand; PAM type: NRG; PAM sequence: CAG
tcaaggctttcctccccaac

SEQ ID NO: 34155 - DNA, 20 bp, Artificial Sequence
  Description of Artificial Sequence: Synthetic oligonucleotide
  Target: SCN9A; (-) strand; PAM type: NRG; PAM sequence: AGG
tctaaatagcacagaactca

SEQ ID NO: 34156 - DNA, 20 bp, Artificial Sequence
  Description of Artificial Sequence: Synthetic oligonucleotide
  Target: SCN9A; (-) strand; PAM type: NRG; PAM sequence: AAG
ttctaaatagcacagaactc

SEQ ID NO: 34157 - DNA, 20 bp, Artificial Sequence
  Description of Artificial Sequence: Synthetic oligonucleotide
  Target: SCN9A; (-) strand; PAM type: NRG; PAM sequence: CAG
gagaggcattctaaatagca

SEQ ID NO: 34158 - DNA, 20 bp, Artificial Sequence
  Description of Artificial Sequence: Synthetic oligonucleotide
  Target: SCN9A; (-) strand; PAM type: NRG; PAM sequence: TAG
tagttgagaggcattctaaa

SEQ ID NO: 34159 - DNA, 20 bp, Artificial Sequence
  Description of Artificial Sequence: Synthetic oligonucleotide
  Target: SCN9A; (-) strand; PAM type: NRG; PAM sequence: AGG
ttacaaagcatttagttgag

SEQ ID NO: 34160 - DNA, 20 bp, Artificial Sequence
  Description of Artificial Sequence: Synthetic oligonucleotide
  Target: SCN9A; (-) strand; PAM type: NRG; PAM sequence: GAG
attacaaagcatttagttga

SEQ ID NO: 34161 - DNA, 20 bp, Artificial Sequence
  Description of Artificial Sequence: Synthetic oligonucleotide
  Target: SCN9A; (-) strand; PAM type: NRG; PAM sequence: GAG
taattacaaagcatttagtt

SEQ ID NO: 34162 - DNA, 20 bp, Artificial Sequence
  Description of Artificial Sequence: Synthetic oligonucleotide
  Target: SCN9A; (-) strand; PAM type: NRG; PAM sequence: TAG
ttagttaattacaaagcatt

SEQ ID NO: 34163 - DNA, 20 bp, Artificial Sequence
  Description of Artificial Sequence: Synthetic oligonucleotide
  Target: SCN9A; (-) strand; PAM type: NRG; PAM sequence: AAG
acattaattagttaattaca

SEQ ID NO: 34164 - DNA, 20 bp, Artificial Sequence
  Description of Artificial Sequence: Synthetic oligonucleotide
  Target: SCN9A; (-) strand; PAM type: NRG; PAM sequence: TAG
ggtgtgttgtgaacattaat

SEQ ID NO: 34165 - DNA, 20 bp, Artificial Sequence
  Description of Artificial Sequence: Synthetic oligonucleotide
  Target: SCN9A; (-) strand; PAM type: NRG; PAM sequence: AGG
aatagtagcagcaatgccac

SEQ ID NO: 34166 - DNA, 20 bp, Artificial Sequence
  Description of Artificial Sequence: Synthetic oligonucleotide
  Target: SCN9A; (-) strand; PAM type: NRG; PAM sequence: CAG
gaatagtagcagcaatgcca

SEQ ID NO: 34167 - DNA, 20 bp, Artificial Sequence
  Description of Artificial Sequence: Synthetic oligonucleotide
  Target: SCN9A; (-) strand; PAM type: NRG; PAM sequence: CAG
gaaaaatgatggaatagtag

SEQ ID NO: 34168 - DNA, 20 bp, Artificial Sequence
  Description of Artificial Sequence: Synthetic oligonucleotide
  Target: SCN9A; (-) strand; PAM type: NRG; PAM sequence: TAG
caggaaaaatgatggaatag

SEQ ID NO: 34169 - DNA, 20 bp, Artificial Sequence
  Description of Artificial Sequence: Synthetic oligonucleotide
  Target: SCN9A; (-) strand; PAM type: NRG; PAM sequence: TAG
actcaggaaaaatgatggaa

SEQ ID NO: 34170 - DNA, 20 bp, Artificial Sequence
  Description of Artificial Sequence: Synthetic oligonucleotide
  Target: SCN9A; (-) strand; PAM type: NRG; PAM sequence: TGG
ttattactcaggaaaaatga

SEQ ID NO: 34171 - DNA, 20 bp, Artificial Sequence
  Description of Artificial Sequence: Synthetic oligonucleotide
  Target: SCN9A; (-) strand; PAM type: NRG; PAM sequence: AGG
tcttaatgtgtttattactc

SEQ ID NO: 34172 - DNA, 20 bp, Artificial Sequence
  Description of Artificial Sequence: Synthetic oligonucleotide
  Target: SCN9A; (-) strand; PAM type: NRG; PAM sequence: CAG
gtcttaatgtgtttattact

SEQ ID NO: 34173 - DNA, 20 bp, Artificial Sequence
  Description of Artificial Sequence: Synthetic oligonucleotide
  Target: SCN9A; (-) strand; PAM type: NRG; PAM sequence: AAG
tttattgattacttcatata

SEQ ID NO: 34174 - DNA, 20 bp, Artificial Sequence
  Description of Artificial Sequence: Synthetic oligonucleotide
  Target: SCN9A; (-) strand; PAM type: NRG; PAM sequence: TGG
caggtaatttagacacttcc

SEQ ID NO: 34175 - DNA, 20 bp, Artificial Sequence
  Description of Artificial Sequence: Synthetic oligonucleotide
  Target: SCN9A; (-) strand; PAM type: NRG; PAM sequence: TAG
ccagtgaattccaggtaatt

SEQ ID NO: 34176 - DNA, 20 bp, Artificial Sequence
  Description of Artificial Sequence: Synthetic oligonucleotide
  Target: SCN9A; (-) strand; PAM type: NRG; PAM sequence: AGG
attggctaccagtgaattcc

SEQ ID NO: 34177 - DNA, 20 bp, Artificial Sequence
  Description of Artificial Sequence: Synthetic oligonucleotide
  Target: SCN9A; (-) strand; PAM type: NRG; PAM sequence: CAG
gattggctaccagtgaattc

SEQ ID NO: 34178 - DNA, 20 bp, Artificial Sequence
  Description of Artificial Sequence: Synthetic oligonucleotide
  Target: SCN9A; (-) strand; PAM type: NRG; PAM sequence: CAG
gctgggttacgattggctac

SEQ ID NO: 34179 - DNA, 20 bp, Artificial Sequence
  Description of Artificial Sequence: Synthetic oligonucleotide
  Target: SCN9A; (-) strand; PAM type: NRG; PAM sequence: TGG
gaatggggctgggttacgat

SEQ ID NO: 34180 - DNA, 20 bp, Artificial Sequence
  Description of Artificial Sequence: Synthetic oligonucleotide
  Target: SCN9A; (-) strand; PAM type: NRG; PAM sequence: GGG
tgcctgtgaagaatggggct

SEQ ID NO: 34181 - DNA, 20 bp, Artificial Sequence
  Description of Artificial Sequence: Synthetic oligonucleotide
  Target: SCN9A; (-) strand; PAM type: NRG; PAM sequence: TGG
atgcctgtgaagaatggggc

SEQ ID NO: 34182 - DNA, 20 bp, Artificial Sequence
  Description of Artificial Sequence: Synthetic oligonucleotide
  Target: SCN9A; (-) strand; PAM type: NRG; PAM sequence: GGG
ttaaatgcctgtgaagaatg

SEQ ID NO: 34183 - DNA, 20 bp, Artificial Sequence
  Description of Artificial Sequence: Synthetic oligonucleotide
  Target: SCN9A; (-) strand; PAM type: NRG; PAM sequence: GGG
tttaaatgcctgtgaagaat

SEQ ID NO: 34184 - DNA, 20 bp, Artificial Sequence
  Description of Artificial Sequence: Synthetic oligonucleotide
  Target: SCN9A; (-) strand; PAM type: NRG; PAM sequence: TGG
ctttaaatgcctgtgaagaa

SEQ ID NO: 34185 - DNA, 20 bp, Artificial Sequence
  Description of Artificial Sequence: Synthetic oligonucleotide
  Target: SCN9A; (-) strand; PAM type: NRG; PAM sequence: AAG
atgaactttaaatgcctgtg

SEQ ID NO: 34186 - DNA, 20 bp, Artificial Sequence
  Description of Artificial Sequence: Synthetic oligonucleotide
  Target: SCN9A; (-) strand; PAM type: NRG; PAM sequence: TGG
aacagcctctttaaattctg

SEQ ID NO: 34187 - DNA, 20 bp, Artificial Sequence
  Description of Artificial Sequence: Synthetic oligonucleotide
  Target: SCN9A; (-) strand; PAM type: NRG; PAM sequence: CAG
agttctagatcagagtgtaa

SEQ ID NO: 34188 - DNA, 20 bp, Artificial Sequence
  Description of Artificial Sequence: Synthetic oligonucleotide
  Target: SCN9A; (-) strand; PAM type: NRG; PAM sequence: GAG
attatacaagttctagatca

SEQ ID NO: 34189 - DNA, 20 bp, Artificial Sequence
  Description of Artificial Sequence: Synthetic oligonucleotide
  Target: SCN9A; (-) strand; PAM type: NRG; PAM sequence: CAG
ttattatacaagttctagat

SEQ ID NO: 34190 - DNA, 20 bp, Artificial Sequence
  Description of Artificial Sequence: Synthetic oligonucleotide
  Target: SCN9A; (-) strand; PAM type: NRG; PAM sequence: TAG
tgaccttattatacaagttc

SEQ ID NO: 34191 - DNA, 20 bp, Artificial Sequence
  Description of Artificial Sequence: Synthetic oligonucleotide
  Target: SCN9A; (-) strand; PAM type: NRG; PAM sequence: AAG
tcttcatgaccttattatac

SEQ ID NO: 34192 - DNA, 20 bp, Artificial Sequence
  Description of Artificial Sequence: Synthetic oligonucleotide
  Target: SCN9A; (-) strand; PAM type: NRG; PAM sequence: TGG
tagacaccatgtattttatc

SEQ ID NO: 34193 - DNA, 20 bp, Artificial Sequence
  Description of Artificial Sequence: Synthetic oligonucleotide
  Target: SCN9A; (-) strand; PAM type: NRG; PAM sequence: TAG
atctggaattcaaatatgac

SEQ ID NO: 34194 - DNA, 20 bp, Artificial Sequence
  Description of Artificial Sequence: Synthetic oligonucleotide
  Target: SCN9A; (-) strand; PAM type: NRG; PAM sequence: TGG
atgtaggtcctggacttatc

SEQ ID NO: 34195 - DNA, 20 bp, Artificial Sequence
  Description of Artificial Sequence: Synthetic oligonucleotide
  Target: SCN9A; (-) strand; PAM type: NRG; PAM sequence: TGG
ccaatttcctatgtaggtcc

SEQ ID NO: 34196 - DNA, 20 bp, Artificial Sequence
  Description of Artificial Sequence: Synthetic oligonucleotide
  Target: SCN9A; (-) strand; PAM type: NRG; PAM sequence: AGG
aagttgccaatttcctatgt

SEQ ID NO: 34197 - DNA, 20 bp, Artificial Sequence
  Description of Artificial Sequence: Synthetic oligonucleotide
  Target: SCN9A; (-) strand; PAM type: NRG; PAM sequence: TAG
aaagttgccaatttcctatg

SEQ ID NO: 34198 - DNA, 20 bp, Artificial Sequence
  Description of Artificial Sequence: Synthetic oligonucleotide
  Target: SCN9A; (-) strand; PAM type: NRG; PAM sequence: AAG
ttctggaacatgcctgtgaa

SEQ ID NO: 34199 - DNA, 20 bp, Artificial Sequence
  Description of Artificial Sequence: Synthetic oligonucleotide
  Target: SCN9A; (-) strand; PAM type: NRG; PAM sequence: TGG
ggaaaaaggtttggtccttc

SEQ ID NO: 34200 - DNA, 20 bp, Artificial Sequence
  Description of Artificial Sequence: Synthetic oligonucleotide
  Target: SCN9A; (-) strand; PAM type: NRG; PAM sequence: TGG
cttgccataggaaaaaggtt

SEQ ID NO: 34201 - DNA, 20 bp, Artificial Sequence
  Description of Artificial Sequence: Synthetic oligonucleotide
  Target: SCN9A; (-) strand; PAM type: NRG; PAM sequence: AGG
accatcttgccataggaaaa

SEQ ID NO: 34202 - DNA, 20 bp, Artificial Sequence
  Description of Artificial Sequence: Synthetic oligonucleotide
  Target: SCN9A; (-) strand; PAM type: NRG; PAM sequence: AAG
taccatcttgccataggaaa

SEQ ID NO: 34203 - DNA, 20 bp, Artificial Sequence
  Description of Artificial Sequence: Synthetic oligonucleotide
  Target: SCN9A; (-) strand; PAM type: NRG; PAM sequence: AGG
agaacctaccatcttgccat

SEQ ID NO: 34204 - DNA, 20 bp, Artificial Sequence
  Description of Artificial Sequence: Synthetic oligonucleotide
  Target: SCN9A; (-) strand; PAM type: NRG; PAM sequence: TAG
aagaacctaccatcttgcca

SEQ ID NO: 34205 - DNA, 20 bp, Artificial Sequence
  Description of Artificial Sequence: Synthetic oligonucleotide
  Target: SCN9A; (-) strand; PAM type: NRG; PAM sequence: AAG
attgttagcagagaagctgg

SEQ ID NO: 34206 - DNA, 20 bp, Artificial Sequence
  Description of Artificial Sequence: Synthetic oligonucleotide
  Target: SCN9A; (-) strand; PAM type: NRG; PAM sequence: TGG
cagattgttagcagagaagc

SEQ ID NO: 34207 - DNA, 20 bp, Artificial Sequence
  Description of Artificial Sequence: Synthetic oligonucleotide
  Target: SCN9A; (-) strand; PAM type: NRG; PAM sequence: AAG
gccacagattgttagcagag

SEQ ID NO: 34208 - DNA, 20 bp, Artificial Sequence
  Description of Artificial Sequence: Synthetic oligonucleotide
  Target: SCN9A; (-) strand; PAM type: NRG; PAM sequence: GAG
ggagccacagattgttagca

SEQ ID NO: 34209 - DNA, 20 bp, Artificial Sequence
  Description of Artificial Sequence: Synthetic oligonucleotide
  Target: SCN9A; (-) strand; PAM type: NRG; PAM sequence: CAG
ctggagccacagattgttag

SEQ ID NO: 34210 - DNA, 20 bp, Artificial Sequence
  Description of Artificial Sequence: Synthetic oligonucleotide
  Target: SCN9A; (-) strand; PAM type: NRG; PAM sequence: TAG
tctctggagccacagattgt

SEQ ID NO: 34211 - DNA, 20 bp, Artificial Sequence
  Description of Artificial Sequence: Synthetic oligonucleotide
  Target: SCN9A; (-) strand; PAM type: NRG; PAM sequence: CAG
cctcttcctctctggagcca

SEQ ID NO: 34212 - DNA, 20 bp, Artificial Sequence
  Description of Artificial Sequence: Synthetic oligonucleotide
  Target: SCN9A; (-) strand; PAM type: NRG; PAM sequence: GAG
ctcttgcctcttcctctctg

SEQ ID NO: 34213 - DNA, 20 bp, Artificial Sequence
  Description of Artificial Sequence: Synthetic oligonucleotide
  Target: SCN9A; (-) strand; PAM type: NRG; PAM sequence: TGG
tcctcttgcctcttcctctc

SEQ ID NO: 34214 - DNA, 20 bp, Artificial Sequence
  Description of Artificial Sequence: Synthetic oligonucleotide
  Target: SCN9A; (-) strand; PAM type: NRG; PAM sequence: TGG
ctcatgagttacatgctacc

SEQ ID NO: 34215 - DNA, 20 bp, Artificial Sequence
  Description of Artificial Sequence: Synthetic oligonucleotide
  Target: SCN9A; (-) strand; PAM type: NRG; PAM sequence: GAG
actaattttcattggctcat

SEQ ID NO: 34216 - DNA, 20 bp, Artificial Sequence
  Description of Artificial Sequence: Synthetic oligonucleotide
  Target: SCN9A; (-) strand; PAM type: NRG; PAM sequence: TGG
gtatattaactaattttcat

SEQ ID NO: 34217 - DNA, 20 bp, Artificial Sequence
  Description of Artificial Sequence: Synthetic oligonucleotide
  Target: SCN9A; (-) strand; PAM type: NRG; PAM sequence: TGG
ccgttacacatgtgctaagg

SEQ ID NO: 34218 - DNA, 20 bp, Artificial Sequence
  Description of Artificial Sequence: Synthetic oligonucleotide
  Target: SCN9A; (-) strand; PAM type: NRG; PAM sequence: AGG
aaaccgttacacatgtgcta

SEQ ID NO: 34219 - DNA, 20 bp, Artificial Sequence
  Description of Artificial Sequence: Synthetic oligonucleotide
  Target: SCN9A; (-) strand; PAM type: NRG; PAM sequence: AAG
caaaccgttacacatgtgct

SEQ ID NO: 34220 - DNA, 20 bp, Artificial Sequence
  Description of Artificial Sequence: Synthetic oligonucleotide
  Target: SCN9A; (-) strand; PAM type: NRG; PAM sequence: AGG
actttctattcttagtttgt

SEQ ID NO: 34221 - DNA, 20 bp, Artificial Sequence
  Description of Artificial Sequence: Synthetic oligonucleotide
  Target: SCN9A; (-) strand; PAM type: NRG; PAM sequence: TAG
gactttctattcttagtttg

SEQ ID NO: 34222 - DNA, 20 bp, Artificial Sequence
  Description of Artificial Sequence: Synthetic oligonucleotide
  Target: SCN9A; (-) strand; PAM type: NRG; PAM sequence: TAG
gttggaagactttctattct

SEQ ID NO: 34223 - DNA, 20 bp, Artificial Sequence
  Description of Artificial Sequence: Synthetic oligonucleotide
  Target: SCN9A; (-) strand; PAM type: NRG; PAM sequence: AAG
ttttttttttttaatgttgg

SEQ ID NO: 34224 - DNA, 20 bp, Artificial Sequence
  Description of Artificial Sequence: Synthetic oligonucleotide
  Target: SCN9A; (-) strand; PAM type: NRG; PAM sequence: TGG
tcattttttttttttaatgt

SEQ ID NO: 34225 - DNA, 20 bp, Artificial Sequence
  Description of Artificial Sequence: Synthetic oligonucleotide
  Target: SCN9A; (-) strand; PAM type: NRG; PAM sequence: TAG
ggcatatctaggctggaaaa

SEQ ID NO: 34226 - DNA, 20 bp, Artificial Sequence
  Description of Artificial Sequence: Synthetic oligonucleotide
  Target: SCN9A; (-) strand; PAM type: NRG; PAM sequence: TGG
cttgaggggcatatctaggc

SEQ ID NO: 34227 - DNA, 20 bp, Artificial Sequence
  Description of Artificial Sequence: Synthetic oligonucleotide
  Target: SCN9A; (-) strand; PAM type: NRG; PAM sequence: AGG
ggaacttgaggggcatatct

SEQ ID NO: 34228 - DNA, 20 bp, Artificial Sequence
  Description of Artificial Sequence: Synthetic oligonucleotide
  Target: SCN9A; (-) strand; PAM type: NRG; PAM sequence: TAG
tggaacttgaggggcatatc

SEQ ID NO: 34229 - DNA, 20 bp, Artificial Sequence
  Description of Artificial Sequence: Synthetic oligonucleotide
  Target: SCN9A; (-) strand; PAM type: NRG; PAM sequence: GGG
tagagtttgtggaacttgag

SEQ ID NO: 34230 - DNA, 20 bp, Artificial Sequence
  Description of Artificial Sequence: Synthetic oligonucleotide
  Target: SCN9A; (-) strand; PAM type: NRG; PAM sequence: GGG
ttagagtttgtggaacttga

SEQ ID NO: 34231 - DNA, 20 bp, Artificial Sequence
  Description of Artificial Sequence: Synthetic oligonucleotide
  Target: SCN9A; (-) strand; PAM type: NRG; PAM sequence: AGG
attagagtttgtggaacttg

SEQ ID NO: 34232 - DNA, 20 bp, Artificial Sequence
  Description of Artificial Sequence: Synthetic oligonucleotide
  Target: SCN9A; (-) strand; PAM type: NRG; PAM sequence: GAG
aattagagtttgtggaactt

SEQ ID NO: 34233 - DNA, 20 bp, Artificial Sequence
  Description of Artificial Sequence: Synthetic oligonucleotide
  Target: SCN9A; (-) strand; PAM type: NRG; PAM sequence: TGG
atatgaaaaattagagtttg

SEQ ID NO: 34234 - DNA, 20 bp, Artificial Sequence
  Description of Artificial Sequence: Synthetic oligonucleotide
  Target: SCN9A; (-) strand; PAM type: NRG; PAM sequence: GAG
taagagtatatgaaaaatta

SEQ ID NO: 34235 - DNA, 20 bp, Artificial Sequence
  Description of Artificial Sequence: Synthetic oligonucleotide
  Target: SCN9A; (-) strand; PAM type: NRG; PAM sequence: TAG
aataagagtatatgaaaaat

SEQ ID NO: 34236 - DNA, 20 bp, Artificial Sequence
  Description of Artificial Sequence: Synthetic oligonucleotide
  Target: SCN9A; (-) strand; PAM type: NRG; PAM sequence: GAG
aaatgagcgggttaaaataa

SEQ ID NO: 34237 - DNA, 20 bp, Artificial Sequence
  Description of Artificial Sequence: Synthetic oligonucleotide
  Target: SCN9A; (-) strand; PAM type: NRG; PAM sequence: AAG
ttaaatgagcgggttaaaat

SEQ ID NO: 34238 - DNA, 20 bp, Artificial Sequence
  Description of Artificial Sequence: Synthetic oligonucleotide
  Target: SCN9A; (-) strand; PAM type: NRG; PAM sequence: GGG
tggcaatcatttaaatgagc

SEQ ID NO: 34239 - DNA, 20 bp, Artificial Sequence
  Description of Artificial Sequence: Synthetic oligonucleotide
  Target: SCN9A; (-) strand; PAM type: NRG; PAM sequence: CGG
ctggcaatcatttaaatgag

SEQ ID NO: 34240 - DNA, 20 bp, Artificial Sequence
  Description of Artificial Sequence: Synthetic oligonucleotide
  Target: SCN9A; (-) strand; PAM type: NRG; PAM sequence: GAG
tgactggcaatcatttaaat

SEQ ID NO: 34241 - DNA, 20 bp, Artificial Sequence
  Description of Artificial Sequence: Synthetic oligonucleotide
  Target: SCN9A; (-) strand; PAM type: NRG; PAM sequence: TGG
tactagcactggctactgac

SEQ ID NO: 34242 - DNA, 20 bp, Artificial Sequence
  Description of Artificial Sequence: Synthetic oligonucleotide
  Target: SCN9A; (-) strand; PAM type: NRG; PAM sequence: TGG
gtactttttattactagcac

SEQ ID NO: 34243 - DNA, 20 bp, Artificial Sequence
  Description of Artificial Sequence: Synthetic oligonucleotide
  Target: SCN9A; (-) strand; PAM type: NRG; PAM sequence: TAG
taaatggtactttttattac

SEQ ID NO: 34244 - DNA, 20 bp, Artificial Sequence
  Description of Artificial Sequence: Synthetic oligonucleotide
  Target: SCN9A; (-) strand; PAM type: NRG; PAM sequence: TGG
ctgagttcccagggagtaaa

SEQ ID NO: 34245 - DNA, 20 bp, Artificial Sequence
  Description of Artificial Sequence: Synthetic oligonucleotide
  Target: SCN9A; (-) strand; PAM type: NRG; PAM sequence: GAG
ctctattctgagttcccagg

SEQ ID NO: 34246 - DNA, 20 bp, Artificial Sequence
  Description of Artificial Sequence: Synthetic oligonucleotide
  Target: SCN9A; (-) strand; PAM type: NRG; PAM sequence: GGG
tactctattctgagttccca

SEQ ID NO: 34247 - DNA, 20 bp, Artificial Sequence
  Description of Artificial Sequence: Synthetic oligonucleotide
  Target: SCN9A; (-) strand; PAM type: NRG; PAM sequence: AGG
ttactctattctgagttccc

SEQ ID NO: 34248 - DNA, 20 bp, Artificial Sequence
  Description of Artificial Sequence: Synthetic oligonucleotide
  Target: SCN9A; (-) strand; PAM type: NRG; PAM sequence: CAG
gttactctattctgagttcc

SEQ ID NO: 34249 - DNA, 20 bp, Artificial Sequence
  Description of Artificial Sequence: Synthetic oligonucleotide
  Target: SCN9A; (-) strand; PAM type: NRG; PAM sequence: GAG
attagatgttactctattct

SEQ ID NO: 34250 - DNA, 20 bp, Artificial Sequence
  Description of Artificial Sequence: Synthetic oligonucleotide
  Target: SCN9A; (-) strand; PAM type: NRG; PAM sequence: TAG
aatcaatagcccttgttgat

SEQ ID NO: 34251 - DNA, 20 bp, Artificial Sequence
  Description of Artificial Sequence: Synthetic oligonucleotide
  Target: SCN9A; (-) strand; PAM type: NRG; PAM sequence: TAG
gatttagaaagtataatcaa

SEQ ID NO: 34252 - DNA, 20 bp, Artificial Sequence
  Description of Artificial Sequence: Synthetic oligonucleotide
  Target: SCN9A; (-) strand; PAM type: NRG; PAM sequence: AAG
gggtttagggttgatttaga

SEQ ID NO: 34253 - DNA, 20 bp, Artificial Sequence
  Description of Artificial Sequence: Synthetic oligonucleotide
  Target: SCN9A; (-) strand; PAM type: NRG; PAM sequence: TAG
gaaagggtttagggttgatt

SEQ ID NO: 34254 - DNA, 20 bp, Artificial Sequence
  Description of Artificial Sequence: Synthetic oligonucleotide
  Target: SCN9A; (-) strand; PAM type: NRG; PAM sequence: GGG
aagcaaagggaaagggttta

SEQ ID NO: 34255 - DNA, 20 bp, Artificial Sequence
  Description of Artificial Sequence: Synthetic oligonucleotide
  Target: SCN9A; (-) strand; PAM type: NRG; PAM sequence: AGG
aaagcaaagggaaagggttt

SEQ ID NO: 34256 - DNA, 20 bp, Artificial Sequence
  Description of Artificial Sequence: Synthetic oligonucleotide
  Target: SCN9A; (-) strand; PAM type: NRG; PAM sequence: TAG
aaaagcaaagggaaagggtt

SEQ ID NO: 34257 - DNA, 20 bp, Artificial Sequence
  Description of Artificial Sequence: Synthetic oligonucleotide
  Target: SCN9A; (-) strand; PAM type: NRG; PAM sequence: GGG
agagaaaaagcaaagggaaa

SEQ ID NO: 34258 - DNA, 20 bp, Artificial Sequence
  Description of Artificial Sequence: Synthetic oligonucleotide
  Target: SCN9A; (-) strand; PAM type: NRG; PAM sequence: AGG
aagagaaaaagcaaagggaa

SEQ ID NO: 34259 - DNA, 20 bp, Artificial Sequence
  Description of Artificial Sequence: Synthetic oligonucleotide
  Target: SCN9A; (-) strand; PAM type: NRG; PAM sequence: AAG
aaagagaaaaagcaaaggga

SEQ ID NO: 34260 - DNA, 20 bp, Artificial Sequence
  Description of Artificial Sequence: Synthetic oligonucleotide
  Target: SCN9A; (-) strand; PAM type: NRG; PAM sequence: GGG
agataaagagaaaaagcaaa

SEQ ID NO: 34261 - DNA, 20 bp, Artificial Sequence
  Description of Artificial Sequence: Synthetic oligonucleotide
  Target: SCN9A; (-) strand; PAM type: NRG; PAM sequence: AGG
aagataaagagaaaaagcaa

SEQ ID NO: 34262 - DNA, 20 bp, Artificial Sequence
  Description of Artificial Sequence: Synthetic oligonucleotide
  Target: SCN9A; (-) strand; PAM type: NRG; PAM sequence: AAG
aaagataaagagaaaaagca

SEQ ID NO: 34263 - DNA, 20 bp, Artificial Sequence
  Description of Artificial Sequence: Synthetic oligonucleotide
  Target: SCN9A; (-) strand; PAM type: NRG; PAM sequence: AAG
agataaaagataaagagaaa

SEQ ID NO: 34264 - DNA, 20 bp, Artificial Sequence
  Description of Artificial Sequence: Synthetic oligonucleotide
  Target: SCN9A; (-) strand; PAM type: NRG; PAM sequence: GAG
tagtacagataaaagataaa

SEQ ID NO: 34265 - DNA, 20 bp, Artificial Sequence
  Description of Artificial Sequence: Synthetic oligonucleotide
  Target: SCN9A; (-) strand; PAM type: NRG; PAM sequence: AAG
gatagtacagataaaagata

SEQ ID NO: 34266 - DNA, 20 bp, Artificial Sequence
  Description of Artificial Sequence: Synthetic oligonucleotide
  Target: SCN9A; (-) strand; PAM type: NRG; PAM sequence: AAG
cattgtgatagtacagataa

SEQ ID NO: 34267 - DNA, 20 bp, Artificial Sequence
  Description of Artificial Sequence: Synthetic oligonucleotide
  Target: SCN9A; (-) strand; PAM type: NRG; PAM sequence: CAG
tggagaccattgtgatagta

SEQ ID NO: 34268 - DNA, 20 bp, Artificial Sequence
  Description of Artificial Sequence: Synthetic oligonucleotide
  Target: SCN9A; (-) strand; PAM type: NRG; PAM sequence: TAG
agacttggagaccattgtga

SEQ ID NO: 34269 - DNA, 20 bp, Artificial Sequence
  Description of Artificial Sequence: Synthetic oligonucleotide
  Target: SCN9A; (-) strand; PAM type: NRG; PAM sequence: GAG
agtggaaacctagagacttg

SEQ ID NO: 34270 - DNA, 20 bp, Artificial Sequence
  Description of Artificial Sequence: Synthetic oligonucleotide
  Target: SCN9A; (-) strand; PAM type: NRG; PAM sequence: TGG
agagtggaaacctagagact

SEQ ID NO: 34271 - DNA, 20 bp, Artificial Sequence
  Description of Artificial Sequence: Synthetic oligonucleotide
  Target: SCN9A; (-) strand; PAM type: NRG; PAM sequence: GAG
aaaatgagagtggaaaccta

SEQ ID NO: 34272 - DNA, 20 bp, Artificial Sequence
  Description of Artificial Sequence: Synthetic oligonucleotide
  Target: SCN9A; (-) strand; PAM type: NRG; PAM sequence: TAG
acaaaatgagagtggaaacc

SEQ ID NO: 34273 - DNA, 20 bp, Artificial Sequence
  Description of Artificial Sequence: Synthetic oligonucleotide
  Target: SCN9A; (-) strand; PAM type: NRG; PAM sequence: TGG
tggataagacaaaatgagag

SEQ ID NO: 34274 - DNA, 20 bp, Artificial Sequence
  Description of Artificial Sequence: Synthetic oligonucleotide
  Target: SCN9A; (-) strand; PAM type: NRG; PAM sequence: GAG
ctgtggataagacaaaatga

SEQ ID NO: 34275 - DNA, 20 bp, Artificial Sequence
  Description of Artificial Sequence: Synthetic oligonucleotide
  Target: SCN9A; (-) strand; PAM type: NRG; PAM sequence: GAG
ttctgtggataagacaaaat

SEQ ID NO: 34276 - DNA, 20 bp, Artificial Sequence
  Description of Artificial Sequence: Synthetic oligonucleotide
  Target: SCN9A; (-) strand; PAM type: NRG; PAM sequence: AAG
gtactatatattctgtggat

SEQ ID NO: 34277 - DNA, 20 bp, Artificial Sequence
  Description of Artificial Sequence: Synthetic oligonucleotide
  Target: SCN9A; (-) strand; PAM type: NRG; PAM sequence: TGG
tgacagtactatatattctg

SEQ ID NO: 34278 - DNA, 20 bp, Artificial Sequence
  Description of Artificial Sequence: Synthetic oligonucleotide
  Target: SCN9A; (-) strand; PAM type: NRG; PAM sequence: CAG
atttttaattaccactctga

SEQ ID NO: 34279 - DNA, 20 bp, Artificial Sequence
  Description of Artificial Sequence: Synthetic oligonucleotide
  Target: SCN9A; (-) strand; PAM type: NRG; PAM sequence: GAG
gatgattttttaacagaaga

SEQ ID NO: 34280 - DNA, 20 bp, Artificial Sequence
  Description of Artificial Sequence: Synthetic oligonucleotide
  Target: SCN9A; (-) strand; PAM type: NRG; PAM sequence: GAG
ctgatgattttttaacagaa

SEQ ID NO: 34281 - DNA, 20 bp, Artificial Sequence
  Description of Artificial Sequence: Synthetic oligonucleotide
  Target: SCN9A; (-) strand; PAM type: NRG; PAM sequence: AAG
cactgatgattttttaacag

SEQ ID NO: 34282 - DNA, 20 bp, Artificial Sequence
  Description of Artificial Sequence: Synthetic oligonucleotide
  Target: SCN9A; (-) strand; PAM type: NRG; PAM sequence: CAG
agccactgatgattttttaa

SEQ ID NO: 34283 - DNA, 20 bp, Artificial Sequence
  Description of Artificial Sequence: Synthetic oligonucleotide
  Target: SCN9A; (-) strand; PAM type: NRG; PAM sequence: AAG
taatcccataagctattgag

SEQ ID NO: 34284 - DNA, 20 bp, Artificial Sequence
  Description of Artificial Sequence: Synthetic oligonucleotide
  Target: SCN9A; (-) strand; PAM type: NRG; PAM sequence: GAG
ggttaatcccataagctatt

SEQ ID NO: 34285 - DNA, 20 bp, Artificial Sequence
  Description of Artificial Sequence: Synthetic oligonucleotide
  Target: SCN9A; (-) strand; PAM type: NRG; PAM sequence: AAG
cccttgtgggttaatcccat

SEQ ID NO: 34286 - DNA, 20 bp, Artificial Sequence
  Description of Artificial Sequence: Synthetic oligonucleotide
  Target: SCN9A; (-) strand; PAM type: NRG; PAM sequence: GGG
cacttaggacaggcccttgt

SEQ ID NO: 34287 - DNA, 20 bp, Artificial Sequence
  Description of Artificial Sequence: Synthetic oligonucleotide
  Target: SCN9A; (-) strand; PAM type: NRG; PAM sequence: TGG
ccacttaggacaggcccttg

SEQ ID NO: 34288 - DNA, 20 bp, Artificial Sequence
  Description of Artificial Sequence: Synthetic oligonucleotide
  Target: SCN9A; (-) strand; PAM type: NRG; PAM sequence: AGG
gggctgggaccacttaggac

SEQ ID NO: 34289 - DNA, 20 bp, Artificial Sequence
  Description of Artificial Sequence: Synthetic oligonucleotide
  Target: SCN9A; (-) strand; PAM type: NRG; PAM sequence: CAG
tgggctgggaccacttagga

SEQ ID NO: 34290 - DNA, 20 bp, Artificial Sequence
  Description of Artificial Sequence: Synthetic oligonucleotide
  Target: SCN9A; (-) strand; PAM type: NRG; PAM sequence: AGG
aaattgggctgggaccactt

SEQ ID NO: 34291 - DNA, 20 bp, Artificial Sequence
  Description of Artificial Sequence: Synthetic oligonucleotide
  Target: SCN9A; (-) strand; PAM type: NRG; PAM sequence: TAG
gaaattgggctgggaccact

SEQ ID NO: 34292 - DNA, 20 bp, Artificial Sequence
  Description of Artificial Sequence: Synthetic oligonucleotide
  Target: SCN9A; (-) strand; PAM type: NRG; PAM sequence: GGG
gagtatcaggaaattgggct

SEQ ID NO: 34293 - DNA, 20 bp, Artificial Sequence
  Description of Artificial Sequence: Synthetic oligonucleotide
  Target: SCN9A; (-) strand; PAM type: NRG; PAM sequence: TGG
tgagtatcaggaaattgggc

SEQ ID NO: 34294 - DNA, 20 bp, Artificial Sequence
  Description of Artificial Sequence: Synthetic oligonucleotide
  Target: SCN9A; (-) strand; PAM type: NRG; PAM sequence: GGG
ggaatgagtatcaggaaatt

SEQ ID NO: 34295 - DNA, 20 bp, Artificial Sequence
  Description of Artificial Sequence: Synthetic oligonucleotide
  Target: SCN9A; (-) strand; PAM type: NRG; PAM sequence: TGG
gggaatgagtatcaggaaat

SEQ ID NO: 34296 - DNA, 20 bp, Artificial Sequence
  Description of Artificial Sequence: Synthetic oligonucleotide
  Target: SCN9A; (-) strand; PAM type: NRG; PAM sequence: AGG
ggtgggtgggaatgagtatc

SEQ ID NO: 34297 - DNA, 20 bp, Artificial Sequence
  Description of Artificial Sequence: Synthetic oligonucleotide
  Target: SCN9A; (-) strand; PAM type: NRG; PAM sequence: CAG
aggtgggtgggaatgagtat

SEQ ID NO: 34298 - DNA, 20 bp, Artificial Sequence
  Description of Artificial Sequence: Synthetic oligonucleotide
  Target: SCN9A; (-) strand; PAM type: NRG; PAM sequence: GAG
ctagataggtgggtgggaat

SEQ ID NO: 34299 - DNA, 20 bp, Artificial Sequence
  Description of Artificial Sequence: Synthetic oligonucleotide
  Target: SCN9A; (-) strand; PAM type: NRG; PAM sequence: GGG
tgagtcctagataggtgggt

SEQ ID NO: 34300 - DNA, 20 bp, Artificial Sequence
  Description of Artificial Sequence: Synthetic oligonucleotide
  Target: SCN9A; (-) strand; PAM type: NRG; PAM sequence: TGG
ttgagtcctagataggtggg

SEQ ID NO: 34301 - DNA, 20 bp, Artificial Sequence
  Description of Artificial Sequence: Synthetic oligonucleotide
  Target: SCN9A; (-) strand; PAM type: NRG; PAM sequence: GGG
atcttgagtcctagataggt

SEQ ID NO: 34302 - DNA, 20 bp, Artificial Sequence
  Description of Artificial Sequence: Synthetic oligonucleotide
  Target: SCN9A; (-) strand; PAM type: NRG; PAM sequence: TGG
gatcttgagtcctagatagg

SEQ ID NO: 34303 - DNA, 20 bp, Artificial Sequence
  Description of Artificial Sequence: Synthetic oligonucleotide
  Target: SCN9A; (-) strand; PAM type: NRG; PAM sequence: AGG
taggatcttgagtcctagat

SEQ ID NO: 34304 - DNA, 20 bp, Artificial Sequence
  Description of Artificial Sequence: Synthetic oligonucleotide
  Target: SCN9A; (-) strand; PAM type: NRG; PAM sequence: TAG
ctaggatcttgagtcctaga

SEQ ID NO: 34305 - DNA, 20 bp, Artificial Sequence
  Description of Artificial Sequence: Synthetic oligonucleotide
  Target: SCN9A; (-) strand; PAM type: NRG; PAM sequence: TAG
ctatctaggatcttgagtcc

SEQ ID NO: 34306 - DNA, 20 bp, Artificial Sequence
  Description of Artificial Sequence: Synthetic oligonucleotide
  Target: SCN9A; (-) strand; PAM type: NRG; PAM sequence: GAG
agccacctatctaggatctt

SEQ ID NO: 34307 - DNA, 20 bp, Artificial Sequence
  Description of Artificial Sequence: Synthetic oligonucleotide
  Target: SCN9A; (-) strand; PAM type: NRG; PAM sequence: AGG
tggagcatagccacctatct

SEQ ID NO: 34308 - DNA, 20 bp, Artificial Sequence
  Description of Artificial Sequence: Synthetic oligonucleotide
  Target: SCN9A; (-) strand; PAM type: NRG; PAM sequence: TAG
ttggagcatagccacctatc

SEQ ID NO: 34309 - DNA, 20 bp, Artificial Sequence
  Description of Artificial Sequence: Synthetic oligonucleotide
  Target: SCN9A; (-) strand; PAM type: NRG; PAM sequence: TAG
taaaatgccctattggagca

SEQ ID NO: 34310 - DNA, 20 bp, Artificial Sequence
  Description of Artificial Sequence: Synthetic oligonucleotide
  Target: SCN9A; (-) strand; PAM type: NRG; PAM sequence: GAG
agaattaaaatgccctattg

SEQ ID NO: 34311 - DNA, 20 bp, Artificial Sequence
  Description of Artificial Sequence: Synthetic oligonucleotide
  Target: SCN9A; (-) strand; PAM type: NRG; PAM sequence: TGG
gaagaattaaaatgccctat

SEQ ID NO: 34312 - DNA, 20 bp, Artificial Sequence
  Description of Artificial Sequence: Synthetic oligonucleotide
  Target: SCN9A; (-) strand; PAM type: NRG; PAM sequence: AAG
cttggactggctcctgaggg

SEQ ID NO: 34313 - DNA, 20 bp, Artificial Sequence
  Description of Artificial Sequence: Synthetic oligonucleotide
  Target: SCN9A; (-) strand; PAM type: NRG; PAM sequence: GGG
actcttggactggctcctga

SEQ ID NO: 34314 - DNA, 20 bp, Artificial Sequence
  Description of Artificial Sequence: Synthetic oligonucleotide
  Target: SCN9A; (-) strand; PAM type: NRG; PAM sequence: AGG
aactcttggactggctcctg

SEQ ID NO: 34315 - DNA, 20 bp, Artificial Sequence
  Description of Artificial Sequence: Synthetic oligonucleotide
  Target: SCN9A; (-) strand; PAM type: NRG; PAM sequence: GAG
aaactcttggactggctcct

SEQ ID NO: 34316 - DNA, 20 bp, Artificial Sequence
  Description of Artificial Sequence: Synthetic oligonucleotide
  Target: SCN9A; (-) strand; PAM type: NRG; PAM sequence: TGG
taggtttaaaactcttggac

SEQ ID NO: 34317 - DNA, 20 bp, Artificial Sequence
  Description of Artificial Sequence: Synthetic oligonucleotide
  Target: SCN9A; (-) strand; PAM type: NRG; PAM sequence: TGG
agttgtaggtttaaaactct

SEQ ID NO: 34318 - DNA, 20 bp, Artificial Sequence
  Description of Artificial Sequence: Synthetic oligonucleotide
  Target: SCN9A; (-) strand; PAM type: NRG; PAM sequence: AGG
ggtttaagaaaagtagttgt

SEQ ID NO: 34319 - DNA, 20 bp, Artificial Sequence
  Description of Artificial Sequence: Synthetic oligonucleotide
  Target: SCN9A; (-) strand; PAM type: NRG; PAM sequence: TAG
aggtttaagaaaagtagttg

SEQ ID NO: 34320 - DNA, 20 bp, Artificial Sequence
  Description of Artificial Sequence: Synthetic oligonucleotide
  Target: SCN9A; (-) strand; PAM type: NRG; PAM sequence: TAG
ctttggaggtttaagaaaag

SEQ ID NO: 34321 - DNA, 20 bp, Artificial Sequence
  Description of Artificial Sequence: Synthetic oligonucleotide
  Target: SCN9A; (-) strand; PAM type: NRG; PAM sequence: AAG
ctactttggaggtttaagaa

SEQ ID NO: 34322 - DNA, 20 bp, Artificial Sequence
  Description of Artificial Sequence: Synthetic oligonucleotide
  Target: SCN9A; (-) strand; PAM type: NRG; PAM sequence: AAG
ggccactactttggaggttt

SEQ ID NO: 34323 - DNA, 20 bp, Artificial Sequence
  Description of Artificial Sequence: Synthetic oligonucleotide
  Target: SCN9A; (-) strand; PAM type: NRG; PAM sequence: AGG
gcacccggccactactttgg

SEQ ID NO: 34324 - DNA, 20 bp, Artificial Sequence
  Description of Artificial Sequence: Synthetic oligonucleotide
  Target: SCN9A; (-) strand; PAM type: NRG; PAM sequence: GAG
tgcacccggccactactttg

SEQ ID NO: 34325 - DNA, 20 bp, Artificial Sequence
  Description of Artificial Sequence: Synthetic oligonucleotide
  Target: SCN9A; (-) strand; PAM type: NRG; PAM sequence: TGG
actgcacccggccactactt

SEQ ID NO: 34326 - DNA, 20 bp, Artificial Sequence
  Description of Artificial Sequence: Synthetic oligonucleotide
  Target: SCN9A; (-) strand; PAM type: NRG; PAM sequence: CGG
cagacgtgagccactgcacc

SEQ ID NO: 34327 - DNA, 20 bp, Artificial Sequence
  Description of Artificial Sequence: Synthetic oligonucleotide
  Target: SCN9A; (-) strand; PAM type: NRG; PAM sequence: GAG
agtgttgggattacagacgt

SEQ ID NO: 34328 - DNA, 20 bp, Artificial Sequence
  Description of Artificial Sequence: Synthetic oligonucleotide
  Target: SCN9A; (-) strand; PAM type: NRG; PAM sequence: CAG
ctcccaaagtgttgggatta

SEQ ID NO: 34329 - DNA, 20 bp, Artificial Sequence
  Description of Artificial Sequence: Synthetic oligonucleotide
  Target: SCN9A; (-) strand; PAM type: NRG; PAM sequence: GGG
cctctgcctcccaaagtgtt

SEQ ID NO: 34330 - DNA, 20 bp, Artificial Sequence
  Description of Artificial Sequence: Synthetic oligonucleotide
  Target: SCN9A; (-) strand; PAM type: NRG; PAM sequence: TGG
acctctgcctcccaaagtgt

SEQ ID NO: 34331 - DNA, 20 bp, Artificial Sequence
  Description of Artificial Sequence: Synthetic oligonucleotide
  Target: SCN9A; (-) strand; PAM type: NRG; PAM sequence: AAG
ctgcccacctctgcctccca

SEQ ID NO: 34332 - DNA, 20 bp, Artificial Sequence
  Description of Artificial Sequence: Synthetic oligonucleotide
  Target: SCN9A; (-) strand; PAM type: NRG; PAM sequence: AAG
ggtcttgaacttccgacctc

SEQ ID NO: 34333 - DNA, 20 bp, Artificial Sequence
  Description of Artificial Sequence: Synthetic oligonucleotide
  Target: SCN9A; (-) strand; PAM type: NRG; PAM sequence: TGG
tttctccatgttggtcaggc

SEQ ID NO: 34334 - DNA, 20 bp, Artificial Sequence
  Description of Artificial Sequence: Synthetic oligonucleotide
  Target: SCN9A; (-) strand; PAM type: NRG; PAM sequence: AGG
ggagtttctccatgttggtc

SEQ ID NO: 34335 - DNA, 20 bp, Artificial Sequence
  Description of Artificial Sequence: Synthetic oligonucleotide
  Target: SCN9A; (-) strand; PAM type: NRG; PAM sequence: CAG
tggagtttctccatgttggt

SEQ ID NO: 34336 - DNA, 20 bp, Artificial Sequence
  Description of Artificial Sequence: Synthetic oligonucleotide
  Target: SCN9A; (-) strand; PAM type: NRG; PAM sequence: TGG
gagatggagtttctccatgt

SEQ ID NO: 34337 - DNA, 20 bp, Artificial Sequence
  Description of Artificial Sequence: Synthetic oligonucleotide
  Target: SCN9A; (-) strand; PAM type: NRG; PAM sequence: GAG
tattttttttagtagagatg

SEQ ID NO: 34338 - DNA, 20 bp, Artificial Sequence
  Description of Artificial Sequence: Synthetic oligonucleotide
  Target: SCN9A; (-) strand; PAM type: NRG; PAM sequence: TGG
tgtattttttttagtagaga

SEQ ID NO: 34339 - DNA, 20 bp, Artificial Sequence
  Description of Artificial Sequence: Synthetic oligonucleotide
  Target: SCN9A; (-) strand; PAM type: NRG; PAM sequence: GAG
attttgtattttttttagta

SEQ ID NO: 34340 - DNA, 20 bp, Artificial Sequence
  Description of Artificial Sequence: Synthetic oligonucleotide
  Target: SCN9A; (-) strand; PAM type: NRG; PAM sequence: TAG
taattttgtattttttttag

SEQ ID NO: 34341 - DNA, 20 bp, Artificial Sequence
  Description of Artificial Sequence: Synthetic oligonucleotide
  Target: SCN9A; (-) strand; PAM type: NRG; PAM sequence: TAG
ggctaattttgtattttttt

SEQ ID NO: 34342 - DNA, 20 bp, Artificial Sequence
  Description of Artificial Sequence: Synthetic oligonucleotide
  Target: SCN9A; (-) strand; PAM type: NRG; PAM sequence: CGG
taagcacgcgccaccacgcc

SEQ ID NO: 34343 - DNA, 20 bp, Artificial Sequence
  Description of Artificial Sequence: Synthetic oligonucleotide
  Target: SCN9A; (-) strand; PAM type: NRG; PAM sequence: AAG
ttccgaggagccgggattat

SEQ ID NO: 34344 - DNA, 20 bp, Artificial Sequence
  Description of Artificial Sequence: Synthetic oligonucleotide
  Target: SCN9A; (-) strand; PAM type: NRG; PAM sequence: GGG
cctcagccttccgaggagcc

SEQ ID NO: 34345 - DNA, 20 bp, Artificial Sequence
  Description of Artificial Sequence: Synthetic oligonucleotide
  Target: SCN9A; (-) strand; PAM type: NRG; PAM sequence: CGG
gcctcagccttccgaggagc

SEQ ID NO: 34346 - DNA, 20 bp, Artificial Sequence
  Description of Artificial Sequence: Synthetic oligonucleotide
  Target: SCN9A; (-) strand; PAM type: NRG; PAM sequence: GAG
tcctgcctcagccttccgag

SEQ ID NO: 34347 - DNA, 20 bp, Artificial Sequence
  Description of Artificial Sequence: Synthetic oligonucleotide
  Target: SCN9A; (-) strand; PAM type: NRG; PAM sequence: AGG
tctcctgcctcagccttccg

SEQ ID NO: 34348 - DNA, 20 bp, Artificial Sequence
  Description of Artificial Sequence: Synthetic oligonucleotide
  Target: SCN9A; (-) strand; PAM type: NRG; PAM sequence: GAG
ttctcctgcctcagccttcc

SEQ ID NO: 34349 - DNA, 20 bp, Artificial Sequence
  Description of Artificial Sequence: Synthetic oligonucleotide
  Target: SCN9A; (-) strand; PAM type: NRG; PAM sequence: CAG
ttcaagcgattctcctgcct

SEQ ID NO: 34350 - DNA, 20 bp, Artificial Sequence
  Description of Artificial Sequence: Synthetic oligonucleotide
  Target: SCN9A; (-) strand; PAM type: NRG; PAM sequence: AAG
caatctccgctcctgggttc

SEQ ID NO: 34351 - DNA, 20 bp, Artificial Sequence
  Description of Artificial Sequence: Synthetic oligonucleotide
  Target: SCN9A; (-) strand; PAM type: NRG; PAM sequence: GGG
tcaccgcaatctccgctcct

SEQ ID NO: 34352 - DNA, 20 bp, Artificial Sequence
  Description of Artificial Sequence: Synthetic oligonucleotide
  Target: SCN9A; (-) strand; PAM type: NRG; PAM sequence: TGG
ctcaccgcaatctccgctcc

SEQ ID NO: 34353 - DNA, 20 bp, Artificial Sequence
  Description of Artificial Sequence: Synthetic oligonucleotide
  Target: SCN9A; (-) strand; PAM type: NRG; PAM sequence: CGG
gaagtgcaatggcgtgatct

SEQ ID NO: 34354 - DNA, 20 bp, Artificial Sequence
  Description of Artificial Sequence: Synthetic oligonucleotide
  Target: SCN9A; (-) strand; PAM type: NRG; PAM sequence: TGG
ttgcccatcctgaagtgcaa

SEQ ID NO: 34355 - DNA, 20 bp, Artificial Sequence
  Description of Artificial Sequence: Synthetic oligonucleotide
  Target: SCN9A; (-) strand; PAM type: NRG; PAM sequence: AAG
tgctcttgttgcccatcctg

SEQ ID NO: 34356 - DNA, 20 bp, Artificial Sequence
  Description of Artificial Sequence: Synthetic oligonucleotide
  Target: SCN9A; (-) strand; PAM type: NRG; PAM sequence: GAG
tttgtttgtttgttttgacg

SEQ ID NO: 34357 - DNA, 20 bp, Artificial Sequence
  Description of Artificial Sequence: Synthetic oligonucleotide
  Target: SCN9A; (-) strand; PAM type: NRG; PAM sequence: CGG
tgtttgtttgtttgttttga

SEQ ID NO: 34358 - DNA, 20 bp, Artificial Sequence
  Description of Artificial Sequence: Synthetic oligonucleotide
  Target: SCN9A; (-) strand; PAM type: NRG; PAM sequence: GAG
atgtcaaatcatgatgagag

SEQ ID NO: 34359 - DNA, 20 bp, Artificial Sequence
  Description of Artificial Sequence: Synthetic oligonucleotide
  Target: SCN9A; (-) strand; PAM type: NRG; PAM sequence: AGG
ttatgtcaaatcatgatgag

SEQ ID NO: 34360 - DNA, 20 bp, Artificial Sequence
  Description of Artificial Sequence: Synthetic oligonucleotide
  Target: SCN9A; (-) strand; PAM type: NRG; PAM sequence: GAG
attatgtcaaatcatgatga

SEQ ID NO: 34361 - DNA, 20 bp, Artificial Sequence
  Description of Artificial Sequence: Synthetic oligonucleotide
  Target: SCN9A; (-) strand; PAM type: NRG; PAM sequence: GAG
tgattatgtcaaatcatgat

SEQ ID NO: 34362 - DNA, 20 bp, Artificial Sequence
  Description of Artificial Sequence: Synthetic oligonucleotide
  Target: SCN9A; (-) strand; PAM type: NRG; PAM sequence: GGG
gatggtcacagcttggggga

SEQ ID NO: 34363 - DNA, 20 bp, Artificial Sequence
  Description of Artificial Sequence: Synthetic oligonucleotide
  Target: SCN9A; (-) strand; PAM type: NRG; PAM sequence: AGG
agatggtcacagcttggggg

SEQ ID NO: 34364 - DNA, 20 bp, Artificial Sequence
  Description of Artificial Sequence: Synthetic oligonucleotide
  Target: SCN9A; (-) strand; PAM type: NRG; PAM sequence: GAG
aagatggtcacagcttgggg

SEQ ID NO: 34365 - DNA, 20 bp, Artificial Sequence
  Description of Artificial Sequence: Synthetic oligonucleotide
  Target: SCN9A; (-) strand; PAM type: NRG; PAM sequence: GGG
ataagatggtcacagcttgg

SEQ ID NO: 34366 - DNA, 20 bp, Artificial Sequence
  Description of Artificial Sequence: Synthetic oligonucleotide
  Target: SCN9A; (-) strand; PAM type: NRG; PAM sequence: GGG
aataagatggtcacagcttg

SEQ ID NO: 34367 - DNA, 20 bp, Artificial Sequence
  Description of Artificial Sequence: Synthetic oligonucleotide
  Target: SCN9A; (-) strand; PAM type: NRG; PAM sequence: GGG
gaataagatggtcacagctt

SEQ ID NO: 34368 - DNA, 20 bp, Artificial Sequence
  Description of Artificial Sequence: Synthetic oligonucleotide
  Target: SCN9A; (-) strand; PAM type: NRG; PAM sequence: TGG
tgaataagatggtcacagct

SEQ ID NO: 34369 - DNA, 20 bp, Artificial Sequence
  Description of Artificial Sequence: Synthetic oligonucleotide
  Target: SCN9A; (-) strand; PAM type: NRG; PAM sequence: CAG
aaagatgaataagatggtca

SEQ ID NO: 34370 - DNA, 20 bp, Artificial Sequence
  Description of Artificial Sequence: Synthetic oligonucleotide
  Target: SCN9A; (-) strand; PAM type: NRG; PAM sequence: TGG
gagtagaaagatgaataaga

SEQ ID NO: 34371 - DNA, 20 bp, Artificial Sequence
  Description of Artificial Sequence: Synthetic oligonucleotide
  Target: SCN9A; (-) strand; PAM type: NRG; PAM sequence: AAG
atgggagtagaaagatgaat

SEQ ID NO: 34372 - DNA, 20 bp, Artificial Sequence
  Description of Artificial Sequence: Synthetic oligonucleotide
  Target: SCN9A; (-) strand; PAM type: NRG; PAM sequence: AAG
gggctaaatatgggagtaga

SEQ ID NO: 34373 - DNA, 20 bp, Artificial Sequence
  Description of Artificial Sequence: Synthetic oligonucleotide
  Target: SCN9A; (-) strand; PAM type: NRG; PAM sequence: TAG
cattgggctaaatatgggag

SEQ ID NO: 34374 - DNA, 20 bp, Artificial Sequence
  Description of Artificial Sequence: Synthetic oligonucleotide
  Target: SCN9A; (-) strand; PAM type: NRG; PAM sequence: GAG
ccccattgggctaaatatgg

SEQ ID NO: 34375 - DNA, 20 bp, Artificial Sequence
  Description of Artificial Sequence: Synthetic oligonucleotide
  Target: SCN9A; (-) strand; PAM type: NRG; PAM sequence: GGG
taccccattgggctaaatat

SEQ ID NO: 34376 - DNA, 20 bp, Artificial Sequence
  Description of Artificial Sequence: Synthetic oligonucleotide
  Target: SCN9A; (-) strand; PAM type: NRG; PAM sequence: TGG
gtaccccattgggctaaata

SEQ ID NO: 34377 - DNA, 20 bp, Artificial Sequence
  Description of Artificial Sequence: Synthetic oligonucleotide
  Target: SCN9A; (-) strand; PAM type: NRG; PAM sequence: GGG
taccttctatgtaccccatt

SEQ ID NO: 34378 - DNA, 20 bp, Artificial Sequence
  Description of Artificial Sequence: Synthetic oligonucleotide
  Target: SCN9A; (-) strand; PAM type: NRG; PAM sequence: TGG
ttaccttctatgtaccccat

SEQ ID NO: 34379 - DNA, 20 bp, Artificial Sequence
  Description of Artificial Sequence: Synthetic oligonucleotide
  Target: SCN9A; (-) strand; PAM type: NRG; PAM sequence: AAG
aagagtgtatacaactgaat

SEQ ID NO: 34380 - DNA, 20 bp, Artificial Sequence
  Description of Artificial Sequence: Synthetic oligonucleotide
  Target: SCN9A; (-) strand; PAM type: NRG; PAM sequence: GAG
taaagtaaggaatagagaaa

SEQ ID NO: 34381 - DNA, 20 bp, Artificial Sequence
  Description of Artificial Sequence: Synthetic oligonucleotide
  Target: SCN9A; (-) strand; PAM type: NRG; PAM sequence: AAG
tttaaagtaaggaatagaga

SEQ ID NO: 34382 - DNA, 20 bp, Artificial Sequence
  Description of Artificial Sequence: Synthetic oligonucleotide
  Target: SCN9A; (-) strand; PAM type: NRG; PAM sequence: GAG
tctttttaaagtaaggaata

SEQ ID NO: 34383 - DNA, 20 bp, Artificial Sequence
  Description of Artificial Sequence: Synthetic oligonucleotide
  Target: SCN9A; (-) strand; PAM type: NRG; PAM sequence: TAG
cttctttttaaagtaaggaa

SEQ ID NO: 34384 - DNA, 20 bp, Artificial Sequence
  Description of Artificial Sequence: Synthetic oligonucleotide
  Target: SCN9A; (-) strand; PAM type: NRG; PAM sequence: AGG
gtttccttctttttaaagta

SEQ ID NO: 34385 - DNA, 20 bp, Artificial Sequence
  Description of Artificial Sequence: Synthetic oligonucleotide
  Target: SCN9A; (-) strand; PAM type: NRG; PAM sequence: AAG
tgtttccttctttttaaagt

SEQ ID NO: 34386 - DNA, 20 bp, Artificial Sequence
  Description of Artificial Sequence: Synthetic oligonucleotide
  Target: SCN9A; (-) strand; PAM type: NRG; PAM sequence: AAG
tttctgtttccttcttttta

SEQ ID NO: 34387 - DNA, 20 bp, Artificial Sequence
  Description of Artificial Sequence: Synthetic oligonucleotide
  Target: SCN9A; (-) strand; PAM type: NRG; PAM sequence: TGG
cttttttctttttctttcat

SEQ ID NO: 34388 - DNA, 20 bp, Artificial Sequence
  Description of Artificial Sequence: Synthetic oligonucleotide
  Target: SCN9A; (-) strand; PAM type: NRG; PAM sequence: AAG
ataacaaatacaacagtaaa

SEQ ID NO: 34389 - DNA, 20 bp, Artificial Sequence
  Description of Artificial Sequence: Synthetic oligonucleotide
  Target: SCN9A; (-) strand; PAM type: NRG; PAM sequence: CAG
gaaaatgataacaaatacaa

SEQ ID NO: 34390 - DNA, 20 bp, Artificial Sequence
  Description of Artificial Sequence: Synthetic oligonucleotide
  Target: SCN9A; (-) strand; PAM type: NRG; PAM sequence: TAG
ataaataaaatgagactatt

SEQ ID NO: 34391 - DNA, 20 bp, Artificial Sequence
  Description of Artificial Sequence: Synthetic oligonucleotide
  Target: SCN9A; (-) strand; PAM type: NRG; PAM sequence: GAG
taaattgaaataaataaaat

SEQ ID NO: 34392 - DNA, 20 bp, Artificial Sequence
  Description of Artificial Sequence: Synthetic oligonucleotide
  Target: SCN9A; (-) strand; PAM type: NRG; PAM sequence: TGG
cagtagattagtaaaacata

SEQ ID NO: 34393 - DNA, 20 bp, Artificial Sequence
  Description of Artificial Sequence: Synthetic oligonucleotide
  Target: SCN9A; (-) strand; PAM type: NRG; PAM sequence: TAG
agtggaagtacacagtagat

SEQ ID NO: 34394 - DNA, 20 bp, Artificial Sequence
  Description of Artificial Sequence: Synthetic oligonucleotide
  Target: SCN9A; (-) strand; PAM type: NRG; PAM sequence: TAG
aatgaagtggaagtacacag

SEQ ID NO: 34395 - DNA, 20 bp, Artificial Sequence
  Description of Artificial Sequence: Synthetic oligonucleotide
  Target: SCN9A; (-) strand; PAM type: NRG; PAM sequence: CAG
caaaatgaagtggaagtaca

SEQ ID NO: 34396 - DNA, 20 bp, Artificial Sequence
  Description of Artificial Sequence: Synthetic oligonucleotide
  Target: SCN9A; (-) strand; PAM type: NRG; PAM sequence: AAG
taaattgcaaaatgaagtgg

SEQ ID NO: 34397 - DNA, 20 bp, Artificial Sequence
  Description of Artificial Sequence: Synthetic oligonucleotide
  Target: SCN9A; (-) strand; PAM type: NRG; PAM sequence: TGG
tcctaaattgcaaaatgaag

SEQ ID NO: 34398 - DNA, 20 bp, Artificial Sequence
  Description of Artificial Sequence: Synthetic oligonucleotide
  Target: SCN9A; (-) strand; PAM type: NRG; PAM sequence: AAG
tactcctaaattgcaaaatg

SEQ ID NO: 34399 - DNA, 20 bp, Artificial Sequence
  Description of Artificial Sequence: Synthetic oligonucleotide
  Target: SCN9A; (-) strand; PAM type: NRG; PAM sequence: CAG
attctaattttcagaattaa

SEQ ID NO: 34400 - DNA, 20 bp, Artificial Sequence
  Description of Artificial Sequence: Synthetic oligonucleotide
  Target: SCN9A; (-) strand; PAM type: NRG; PAM sequence: CAG
tgtagagagattctaatttt

SEQ ID NO: 34401 - DNA, 20 bp, Artificial Sequence
  Description of Artificial Sequence: Synthetic oligonucleotide
  Target: SCN9A; (-) strand; PAM type: NRG; PAM sequence: GAG
ctaatttaaaagtttgtaga

SEQ ID NO: 34402 - DNA, 20 bp, Artificial Sequence
  Description of Artificial Sequence: Synthetic oligonucleotide
  Target: SCN9A; (-) strand; PAM type: NRG; PAM sequence: GAG
acctaatttaaaagtttgta

SEQ ID NO: 34403 - DNA, 20 bp, Artificial Sequence
  Description of Artificial Sequence: Synthetic oligonucleotide
  Target: SCN9A; (-) strand; PAM type: NRG; PAM sequence: TAG
tgacctaatttaaaagtttg

SEQ ID NO: 34404 - DNA, 20 bp, Artificial Sequence
  Description of Artificial Sequence: Synthetic oligonucleotide
  Target: SCN9A; (-) strand; PAM type: NRG; PAM sequence: AAG
aatattgtgacctaatttaa

SEQ ID NO: 34405 - DNA, 20 bp, Artificial Sequence
  Description of Artificial Sequence: Synthetic oligonucleotide
  Target: SCN9A; (-) strand; PAM type: NRG; PAM sequence: AGG
atagtctacttagggttttt

SEQ ID NO: 34406 - DNA, 20 bp, Artificial Sequence
  Description of Artificial Sequence: Synthetic oligonucleotide
  Target: SCN9A; (-) strand; PAM type: NRG; PAM sequence: TAG
tatagtctacttagggtttt

SEQ ID NO: 34407 - DNA, 20 bp, Artificial Sequence
  Description of Artificial Sequence: Synthetic oligonucleotide
  Target: SCN9A; (-) strand; PAM type: NRG; PAM sequence: GGG
ttgcccttatagtctactta

SEQ ID NO: 34408 - DNA, 20 bp, Artificial Sequence
  Description of Artificial Sequence: Synthetic oligonucleotide
  Target: SCN9A; (-) strand; PAM type: NRG; PAM sequence: AGG
attgcccttatagtctactt

SEQ ID NO: 34409 - DNA, 20 bp, Artificial Sequence
  Description of Artificial Sequence: Synthetic oligonucleotide
  Target: SCN9A; (-) strand; PAM type: NRG; PAM sequence: TAG
cattgcccttatagtctact

SEQ ID NO: 34410 - DNA, 20 bp, Artificial Sequence
  Description of Artificial Sequence: Synthetic oligonucleotide
  Target: SCN9A; (-) strand; PAM type: NRG; PAM sequence: TAG
cttataatgcattgccctta

SEQ ID NO: 34411 - DNA, 20 bp, Artificial Sequence
  Description of Artificial Sequence: Synthetic oligonucleotide
  Target: SCN9A; (-) strand; PAM type: NRG; PAM sequence: TAG
tgttatatacacggcaactc

SEQ ID NO: 34412 - DNA, 20 bp, Artificial Sequence
  Description of Artificial Sequence: Synthetic oligonucleotide
  Target: SCN9A; (-) strand; PAM type: NRG; PAM sequence: CGG
ctgaggtattgttatataca

SEQ ID NO: 34413 - DNA, 20 bp, Artificial Sequence
  Description of Artificial Sequence: Synthetic oligonucleotide
  Target: SCN9A; (-) strand; PAM type: NRG; PAM sequence: AGG
gagccaccatgcccggtctg

SEQ ID NO: 34414 - DNA, 20 bp, Artificial Sequence
  Description of Artificial Sequence: Synthetic oligonucleotide
  Target: SCN9A; (-) strand; PAM type: NRG; PAM sequence: GAG
tgagccaccatgcccggtct

SEQ ID NO: 34415 - DNA, 20 bp, Artificial Sequence
  Description of Artificial Sequence: Synthetic oligonucleotide
  Target: SCN9A; (-) strand; PAM type: NRG; PAM sequence: CGG
caggcgtgagccaccatgcc

SEQ ID NO: 34416 - DNA, 20 bp, Artificial Sequence
  Description of Artificial Sequence: Synthetic oligonucleotide
  Target: SCN9A; (-) strand; PAM type: NRG; PAM sequence: GAG
agtgctgggattacaggcgt

SEQ ID NO: 34417 - DNA, 20 bp, Artificial Sequence
  Description of Artificial Sequence: Synthetic oligonucleotide
  Target: SCN9A; (-) strand; PAM type: NRG; PAM sequence: AGG
ttccaaagtgctgggattac

SEQ ID NO: 34418 - DNA, 20 bp, Artificial Sequence
  Description of Artificial Sequence: Synthetic oligonucleotide
  Target: SCN9A; (-) strand; PAM type: NRG; PAM sequence: CAG
cttccaaagtgctgggatta

SEQ ID NO: 34419 - DNA, 20 bp, Artificial Sequence
  Description of Artificial Sequence: Synthetic oligonucleotide
  Target: SCN9A; (-) strand; PAM type: NRG; PAM sequence: GGG
cctcggccttccaaagtgct

SEQ ID NO: 34420 - DNA, 20 bp, Artificial Sequence
  Description of Artificial Sequence: Synthetic oligonucleotide
  Target: SCN9A; (-) strand; PAM type: NRG; PAM sequence: TGG
gcctcggccttccaaagtgc

SEQ ID NO: 34421 - DNA, 20 bp, Artificial Sequence
  Description of Artificial Sequence: Synthetic oligonucleotide
  Target: SCN9A; (-) strand; PAM type: NRG; PAM sequence: AAG
ccacctgcctcggccttcca

SEQ ID NO: 34422 - DNA, 20 bp, Artificial Sequence
  Description of Artificial Sequence: Synthetic oligonucleotide
  Target: SCN9A; (-) strand; PAM type: NRG; PAM sequence: CGG
ttcaggtgatccacctgcct

SEQ ID NO: 34423 - DNA, 20 bp, Artificial Sequence
  Description of Artificial Sequence: Synthetic oligonucleotide
  Target: SCN9A; (-) strand; PAM type: NRG; PAM sequence: AGG
ggtctcgaactcccgacttc

SEQ ID NO: 34424 - DNA, 20 bp, Artificial Sequence
  Description of Artificial Sequence: Synthetic oligonucleotide
  Target: SCN9A; (-) strand; PAM type: NRG; PAM sequence: CAG
tggtctcgaactcccgactt

SEQ ID NO: 34425 - DNA, 20 bp, Artificial Sequence
  Description of Artificial Sequence: Synthetic oligonucleotide
  Target: SCN9A; (-) strand; PAM type: NRG; PAM sequence: TGG
tttctccatgttggtcagac

SEQ ID NO: 34426 - DNA, 20 bp, Artificial Sequence
  Description of Artificial Sequence: Synthetic oligonucleotide
  Target: SCN9A; (-) strand; PAM type: NRG; PAM sequence: CAG
cagggtttctccatgttggt

SEQ ID NO: 34427 - DNA, 20 bp, Artificial Sequence
  Description of Artificial Sequence: Synthetic oligonucleotide
  Target: SCN9A; (-) strand; PAM type: NRG; PAM sequence: TGG
gagacagggtttctccatgt

SEQ ID NO: 34428 - DNA, 20 bp, Artificial Sequence
  Description of Artificial Sequence: Synthetic oligonucleotide
  Target: SCN9A; (-) strand; PAM type: NRG; PAM sequence: GGG
ttgtatttttagtagagaca

SEQ ID NO: 34429 - DNA, 20 bp, Artificial Sequence
  Description of Artificial Sequence: Synthetic oligonucleotide
  Target: SCN9A; (-) strand; PAM type: NRG; PAM sequence: AGG
tttgtatttttagtagagac

SEQ ID NO: 34430 - DNA, 20 bp, Artificial Sequence
  Description of Artificial Sequence: Synthetic oligonucleotide
  Target: SCN9A; (-) strand; PAM type: NRG; PAM sequence: CAG
ttttgtatttttagtagaga

SEQ ID NO: 34431 - DNA, 20 bp, Artificial Sequence
  Description of Artificial Sequence: Synthetic oligonucleotide
  Target: SCN9A; (-) strand; PAM type: NRG; PAM sequence: GAG
ctaattttgtatttttagta

SEQ ID NO: 34432 - DNA, 20 bp, Artificial Sequence
  Description of Artificial Sequence: Synthetic oligonucleotide
  Target: SCN9A; (-) strand; PAM type: NRG; PAM sequence: TAG
ggctaattttgtatttttag

SEQ ID NO: 34433 - DNA, 20 bp, Artificial Sequence
  Description of Artificial Sequence: Synthetic oligonucleotide
  Target: SCN9A; (-) strand; PAM type: NRG; PAM sequence: TAG
cctggctaattttgtatttt

SEQ ID NO: 34434 - DNA, 20 bp, Artificial Sequence
  Description of Artificial Sequence: Synthetic oligonucleotide
  Target: SCN9A; (-) strand; PAM type: NRG; PAM sequence: TGG
caggcatgccccaccacgcc

SEQ ID NO: 34435 - DNA, 20 bp, Artificial Sequence
  Description of Artificial Sequence: Synthetic oligonucleotide
  Target: SCN9A; (-) strand; PAM type: NRG; PAM sequence: AGG
tcctgagtagctgggattac

SEQ ID NO: 34436 - DNA, 20 bp, Artificial Sequence
  Description of Artificial Sequence: Synthetic oligonucleotide
  Target: SCN9A; (-) strand; PAM type: NRG; PAM sequence: CAG
ctcctgagtagctgggatta

SEQ ID NO: 34437 - DNA, 20 bp, Artificial Sequence
  Description of Artificial Sequence: Synthetic oligonucleotide
  Target: SCN9A; (-) strand; PAM type: NRG; PAM sequence: GGG
cctcagcctcctgagtagct

SEQ ID NO: 34438 - DNA, 20 bp, Artificial Sequence
  Description of Artificial Sequence: Synthetic oligonucleotide
  Target: SCN9A; (-) strand; PAM type: NRG; PAM sequence: TGG
gcctcagcctcctgagtagc

SEQ ID NO: 34439 - DNA, 20 bp, Artificial Sequence
  Description of Artificial Sequence: Synthetic oligonucleotide
  Target: SCN9A; (-) strand; PAM type: NRG; PAM sequence: TAG
ttctgcctcagcctcctgag

SEQ ID NO: 34440 - DNA, 20 bp, Artificial Sequence
  Description of Artificial Sequence: Synthetic oligonucleotide
  Target: SCN9A; (-) strand; PAM type: NRG; PAM sequence: GAG
ttcttctgcctcagcctcct

SEQ ID NO: 34441 - DNA, 20 bp, Artificial Sequence
  Description of Artificial Sequence: Synthetic oligonucleotide
  Target: SCN9A; (-) strand; PAM type: NRG; PAM sequence: CAG
ttcaagcaattcttctgcct

SEQ ID NO: 34442 - DNA, 20 bp, Artificial Sequence
  Description of Artificial Sequence: Synthetic oligonucleotide
  Target: SCN9A; (-) strand; PAM type: NRG; PAM sequence: AAG
aacctccgcctcccaggttc

SEQ ID NO: 34443 - DNA, 20 bp, Artificial Sequence
  Description of Artificial Sequence: Synthetic oligonucleotide
  Target: SCN9A; (-) strand; PAM type: NRG; PAM sequence: AGG
cgccacaacctccgcctccc

SEQ ID NO: 34444 - DNA, 20 bp, Artificial Sequence
  Description of Artificial Sequence: Synthetic oligonucleotide
  Target: SCN9A; (-) strand; PAM type: NRG; PAM sequence: CAG
tcgccacaacctccgcctcc

SEQ ID NO: 34445 - DNA, 20 bp, Artificial Sequence
  Description of Artificial Sequence: Synthetic oligonucleotide
  Target: SCN9A; (-) strand; PAM type: NRG; PAM sequence: TGG
ggagtgcaatggcgcaatct

SEQ ID NO: 34446 - DNA, 20 bp, Artificial Sequence
  Description of Artificial Sequence: Synthetic oligonucleotide
  Target: SCN9A; (-) strand; PAM type: NRG; PAM sequence: TGG
ttgcccaggctggagtgcaa

SEQ ID NO: 34447 - DNA, 20 bp, Artificial Sequence
  Description of Artificial Sequence: Synthetic oligonucleotide
  Target: SCN9A; (-) strand; PAM type: NRG; PAM sequence: GAG
cactcttgttgcccaggctg

SEQ ID NO: 34448 - DNA, 20 bp, Artificial Sequence
  Description of Artificial Sequence: Synthetic oligonucleotide
  Target: SCN9A; (-) strand; PAM type: NRG; PAM sequence: TGG
ttcactcttgttgcccaggc

SEQ ID NO: 34449 - DNA, 20 bp, Artificial Sequence
  Description of Artificial Sequence: Synthetic oligonucleotide
  Target: SCN9A; (-) strand; PAM type: NRG; PAM sequence: AGG
gagtttcactcttgttgccc

SEQ ID NO: 34450 - DNA, 20 bp, Artificial Sequence
  Description of Artificial Sequence: Synthetic oligonucleotide
  Target: SCN9A; (-) strand; PAM type: NRG; PAM sequence: CAG
ggagtttcactcttgttgcc

SEQ ID NO: 34451 - DNA, 20 bp, Artificial Sequence
  Description of Artificial Sequence: Synthetic oligonucleotide
  Target: SCN9A; (-) strand; PAM type: NRG; PAM sequence: GAG
tttattttttttgtgagagg

SEQ ID NO: 34452 - DNA, 20 bp, Artificial Sequence
  Description of Artificial Sequence: Synthetic oligonucleotide
  Target: SCN9A; (-) strand; PAM type: NRG; PAM sequence: GGG
tttttattttttttgtgaga

SEQ ID NO: 34453 - DNA, 20 bp, Artificial Sequence
  Description of Artificial Sequence: Synthetic oligonucleotide
  Target: SCN9A; (-) strand; PAM type: NRG; PAM sequence: AGG
ttttttattttttttgtgag

SEQ ID NO: 34454 - DNA, 20 bp, Artificial Sequence
  Description of Artificial Sequence: Synthetic oligonucleotide
  Target: SCN9A; (-) strand; PAM type: NRG; PAM sequence: GAG
attttttattttttttgtga

SEQ ID NO: 34455 - DNA, 20 bp, Artificial Sequence
  Description of Artificial Sequence: Synthetic oligonucleotide
  Target: SCN9A; (-) strand; PAM type: NRG; PAM sequence: GAG
ttattttttattttttttgt

SEQ ID NO: 34456 - DNA, 20 bp, Artificial Sequence
  Description of Artificial Sequence: Synthetic oligonucleotide
  Target: SCN9A; (-) strand; PAM type: NRG; PAM sequence: AAG
aatgagaaatattgcagacc

SEQ ID NO: 34457 - DNA, 20 bp, Artificial Sequence
  Description of Artificial Sequence: Synthetic oligonucleotide
  Target: SCN9A; (-) strand; PAM type: NRG; PAM sequence: CAG
ttttcaaatgagaaatattg

SEQ ID NO: 34458 - DNA, 20 bp, Artificial Sequence
  Description of Artificial Sequence: Synthetic oligonucleotide
  Target: SCN9A; (-) strand; PAM type: NRG; PAM sequence: GAG
gagtagaaaagttttcaaat

SEQ ID NO: 34459 - DNA, 20 bp, Artificial Sequence
  Description of Artificial Sequence: Synthetic oligonucleotide
  Target: SCN9A; (-) strand; PAM type: NRG; PAM sequence: AAG
tccacgaaccaggagtagaa

SEQ ID NO: 34460 - DNA, 20 bp, Artificial Sequence
  Description of Artificial Sequence: Synthetic oligonucleotide
  Target: SCN9A; (-) strand; PAM type: NRG; PAM sequence: TAG
acaagtccacgaaccaggag

SEQ ID NO: 34461 - DNA, 20 bp, Artificial Sequence
  Description of Artificial Sequence: Synthetic oligonucleotide
  Target: SCN9A; (-) strand; PAM type: NRG; PAM sequence: GAG
tagacaagtccacgaaccag

SEQ ID NO: 34462 - DNA, 20 bp, Artificial Sequence
  Description of Artificial Sequence: Synthetic oligonucleotide
  Target: SCN9A; (-) strand; PAM type: NRG; PAM sequence: AGG
tatagacaagtccacgaacc

SEQ ID NO: 34463 - DNA, 20 bp, Artificial Sequence
  Description of Artificial Sequence: Synthetic oligonucleotide
  Target: SCN9A; (-) strand; PAM type: NRG; PAM sequence: CAG
ttatagacaagtccacgaac

SEQ ID NO: 34464 - DNA, 20 bp, Artificial Sequence
  Description of Artificial Sequence: Synthetic oligonucleotide
  Target: SCN9A; (-) strand; PAM type: NRG; PAM sequence: AAG
tggcagaggaagttatagac

SEQ ID NO: 34465 - DNA, 20 bp, Artificial Sequence
  Description of Artificial Sequence: Synthetic oligonucleotide
  Target: SCN9A; (-) strand; PAM type: NRG; PAM sequence: TAG
aattatggcagaggaagtta

SEQ ID NO: 34466 - DNA, 20 bp, Artificial Sequence
  Description of Artificial Sequence: Synthetic oligonucleotide
  Target: SCN9A; (-) strand; PAM type: NRG; PAM sequence: AAG
tactttaattatggcagagg

SEQ ID NO: 34467 - DNA, 20 bp, Artificial Sequence
  Description of Artificial Sequence: Synthetic oligonucleotide
  Target: SCN9A; (-) strand; PAM type: NRG; PAM sequence: AGG
agatactttaattatggcag

SEQ ID NO: 34468 - DNA, 20 bp, Artificial Sequence
  Description of Artificial Sequence: Synthetic oligonucleotide
  Target: SCN9A; (-) strand; PAM type: NRG; PAM sequence: GAG
gagatactttaattatggca

SEQ ID NO: 34469 - DNA, 20 bp, Artificial Sequence
  Description of Artificial Sequence: Synthetic oligonucleotide
  Target: SCN9A; (-) strand; PAM type: NRG; PAM sequence: CAG
cagagatactttaattatgg

SEQ ID NO: 34470 - DNA, 20 bp, Artificial Sequence
  Description of Artificial Sequence: Synthetic oligonucleotide
  Target: SCN9A; (-) strand; PAM type: NRG; PAM sequence: TGG
gcccagagatactttaatta

SEQ ID NO: 34471 - DNA, 20 bp, Artificial Sequence
  Description of Artificial Sequence: Synthetic oligonucleotide
  Target: SCN9A; (-) strand; PAM type: NRG; PAM sequence: GAG
gtaaatgtttttggtgccca

SEQ ID NO: 34472 - DNA, 20 bp, Artificial Sequence
  Description of Artificial Sequence: Synthetic oligonucleotide
  Target: SCN9A; (-) strand; PAM type: NRG; PAM sequence: CAG
ttgtaaatgtttttggtgcc

SEQ ID NO: 34473 - DNA, 20 bp, Artificial Sequence
  Description of Artificial Sequence: Synthetic oligonucleotide
  Target: SCN9A; (-) strand; PAM type: NRG; PAM sequence: TGG
agtcattttgtaaatgtttt

SEQ ID NO: 34474 - DNA, 20 bp, Artificial Sequence
  Description of Artificial Sequence: Synthetic oligonucleotide
  Target: SCN9A; (-) strand; PAM type: NRG; PAM sequence: CAG
attgacatcatagttgaaag

SEQ ID NO: 34475 - DNA, 20 bp, Artificial Sequence
  Description of Artificial Sequence: Synthetic oligonucleotide
  Target: SCN9A; (-) strand; PAM type: NRG; PAM sequence: AAG
tttattgacatcatagttga

SEQ ID NO: 34476 - DNA, 20 bp, Artificial Sequence
  Description of Artificial Sequence: Synthetic oligonucleotide
  Target: SCN9A; (-) strand; PAM type: NRG; PAM sequence: TAG
aaggaattttattgacatca

SEQ ID NO: 34477 - DNA, 20 bp, Artificial Sequence
  Description of Artificial Sequence: Synthetic oligonucleotide
  Target: SCN9A; (-) strand; PAM type: NRG; PAM sequence: AGG
catagaatttttgtagtata

SEQ ID NO: 34478 - DNA, 20 bp, Artificial Sequence
  Description of Artificial Sequence: Synthetic oligonucleotide
  Target: SCN9A; (-) strand; PAM type: NRG; PAM sequence: AAG
tcatagaatttttgtagtat

SEQ ID NO: 34479 - DNA, 20 bp, Artificial Sequence
  Description of Artificial Sequence: Synthetic oligonucleotide
  Target: SCN9A; (-) strand; PAM type: NRG; PAM sequence: TAG
atagaatcatagaatttttg

SEQ ID NO: 34480 - DNA, 20 bp, Artificial Sequence
  Description of Artificial Sequence: Synthetic oligonucleotide
  Target: SCN9A; (-) strand; PAM type: NRG; PAM sequence: TAG
atgcaggaataatagaatca

SEQ ID NO: 34481 - DNA, 20 bp, Artificial Sequence
  Description of Artificial Sequence: Synthetic oligonucleotide
  Target: SCN9A; (-) strand; PAM type: NRG; PAM sequence: TAG
aattatccatgcaggaataa

SEQ ID NO: 34482 - DNA, 20 bp, Artificial Sequence
  Description of Artificial Sequence: Synthetic oligonucleotide
  Target: SCN9A; (-) strand; PAM type: NRG; PAM sequence: AGG
tactggtaaattatccatgc

SEQ ID NO: 34483 - DNA, 20 bp, Artificial Sequence
  Description of Artificial Sequence: Synthetic oligonucleotide
  Target: SCN9A; (-) strand; PAM type: NRG; PAM sequence: CAG
ttactggtaaattatccatg

SEQ ID NO: 34484 - DNA, 20 bp, Artificial Sequence
  Description of Artificial Sequence: Synthetic oligonucleotide
  Target: SCN9A; (-) strand; PAM type: NRG; PAM sequence: TGG
acataaaaagcttgaattac

SEQ ID NO: 34485 - DNA, 20 bp, Artificial Sequence
  Description of Artificial Sequence: Synthetic oligonucleotide
  Target: SCN9A; (-) strand; PAM type: NRG; PAM sequence: AAG
aatctctctccttacataaa

SEQ ID NO: 34486 - DNA, 20 bp, Artificial Sequence
  Description of Artificial Sequence: Synthetic oligonucleotide
  Target: SCN9A; (-) strand; PAM type: NRG; PAM sequence: TAG
ttcctggaggggcatcccca

SEQ ID NO: 34487 - DNA, 20 bp, Artificial Sequence
  Description of Artificial Sequence: Synthetic oligonucleotide
  Target: SCN9A; (-) strand; PAM type: NRG; PAM sequence: GGG
tgaaaatgaaattcctggag

SEQ ID NO: 34488 - DNA, 20 bp, Artificial Sequence
  Description of Artificial Sequence: Synthetic oligonucleotide
  Target: SCN9A; (-) strand; PAM type: NRG; PAM sequence: GGG
atgaaaatgaaattcctgga

SEQ ID NO: 34489 - DNA, 20 bp, Artificial Sequence
  Description of Artificial Sequence: Synthetic oligonucleotide
  Target: SCN9A; (-) strand; PAM type: NRG; PAM sequence: AGG
aatgaaaatgaaattcctgg

SEQ ID NO: 34490 - DNA, 20 bp, Artificial Sequence
  Description of Artificial Sequence: Synthetic oligonucleotide
  Target: SCN9A; (-) strand; PAM type: NRG; PAM sequence: GAG
gaatgaaaatgaaattcctg

SEQ ID NO: 34491 - DNA, 20 bp, Artificial Sequence
  Description of Artificial Sequence: Synthetic oligonucleotide
  Target: SCN9A; (-) strand; PAM type: NRG; PAM sequence: TGG
aagaatgaaaatgaaattcc

SEQ ID NO: 34492 - DNA, 20 bp, Artificial Sequence
  Description of Artificial Sequence: Synthetic oligonucleotide
  Target: SCN9A; (-) strand; PAM type: NRG; PAM sequence: AAG
taaaggcagaatgcccagac

SEQ ID NO: 34493 - DNA, 20 bp, Artificial Sequence
  Description of Artificial Sequence: Synthetic oligonucleotide
  Target: SCN9A; (-) strand; PAM type: NRG; PAM sequence: CAG
gctgttaaaggcagaatgcc

SEQ ID NO: 34494 - DNA, 20 bp, Artificial Sequence
  Description of Artificial Sequence: Synthetic oligonucleotide
  Target: SCN9A; (-) strand; PAM type: NRG; PAM sequence: CAG
aaagagaaagctgttaaagg

SEQ ID NO: 34495 - DNA, 20 bp, Artificial Sequence
  Description of Artificial Sequence: Synthetic oligonucleotide
  Target: SCN9A; (-) strand; PAM type: NRG; PAM sequence: AGG
cacaaagagaaagctgttaa

SEQ ID NO: 34496 - DNA, 20 bp, Artificial Sequence
  Description of Artificial Sequence: Synthetic oligonucleotide
  Target: SCN9A; (-) strand; PAM type: NRG; PAM sequence: AAG
acacaaagagaaagctgtta

SEQ ID NO: 34497 - DNA, 20 bp, Artificial Sequence
  Description of Artificial Sequence: Synthetic oligonucleotide
  Target: SCN9A; (-) strand; PAM type: NRG; PAM sequence: AAG
ggacattacacacaaagaga

SEQ ID NO: 34498 - DNA, 20 bp, Artificial Sequence
  Description of Artificial Sequence: Synthetic oligonucleotide
  Target: SCN9A; (-) strand; PAM type: NRG; PAM sequence: GAG
gtggggacattacacacaaa

SEQ ID NO: 34499 - DNA, 20 bp, Artificial Sequence
  Description of Artificial Sequence: Synthetic oligonucleotide
  Target: SCN9A; (-) strand; PAM type: NRG; PAM sequence: AAG
tggtggggacattacacaca

SEQ ID NO: 34500 - DNA, 20 bp, Artificial Sequence
  Description of Artificial Sequence: Synthetic oligonucleotide
  Target: SCN9A; (-) strand; PAM type: NRG; PAM sequence: GGG
tttcatgaaaccaagtggtg

SEQ ID NO: 34501 - DNA, 20 bp, Artificial Sequence
  Description of Artificial Sequence: Synthetic oligonucleotide
  Target: SCN9A; (-) strand; PAM type: NRG; PAM sequence: GGG
gtttcatgaaaccaagtggt

SEQ ID NO: 34502 - DNA, 20 bp, Artificial Sequence
  Description of Artificial Sequence: Synthetic oligonucleotide
  Target: SCN9A; (-) strand; PAM type: NRG; PAM sequence: TGG
agtttcatgaaaccaagtgg

SEQ ID NO: 34503 - DNA, 20 bp, Artificial Sequence
  Description of Artificial Sequence: Synthetic oligonucleotide
  Target: SCN9A; (-) strand; PAM type: NRG; PAM sequence: TGG
cctagtttcatgaaaccaag

SEQ ID NO: 34504 - DNA, 20 bp, Artificial Sequence
  Description of Artificial Sequence: Synthetic oligonucleotide
  Target: SCN9A; (-) strand; PAM type: NRG; PAM sequence: AAG
atacctagtttcatgaaacc

SEQ ID NO: 34505 - DNA, 20 bp, Artificial Sequence
  Description of Artificial Sequence: Synthetic oligonucleotide
  Target: SCN9A; (-) strand; PAM type: NRG; PAM sequence: TAG
gaggcacatatagggatacc

SEQ ID NO: 34506 - DNA, 20 bp, Artificial Sequence
  Description of Artificial Sequence: Synthetic oligonucleotide
  Target: SCN9A; (-) strand; PAM type: NRG; PAM sequence: GGG
gtgtttctgaggcacatata

SEQ ID NO: 34507 - DNA, 20 bp, Artificial Sequence
  Description of Artificial Sequence: Synthetic oligonucleotide
  Target: SCN9A; (-) strand; PAM type: NRG; PAM sequence: AGG
tgtgtttctgaggcacatat

SEQ ID NO: 34508 - DNA, 20 bp, Artificial Sequence
  Description of Artificial Sequence: Synthetic oligonucleotide
  Target: SCN9A; (-) strand; PAM type: NRG; PAM sequence: TAG
ttgtgtttctgaggcacata

SEQ ID NO: 34509 - DNA, 20 bp, Artificial Sequence
  Description of Artificial Sequence: Synthetic oligonucleotide
  Target: SCN9A; (-) strand; PAM type: NRG; PAM sequence: AGG
tgttgtgttttgtgtttctg

SEQ ID NO: 34510 - DNA, 20 bp, Artificial Sequence
  Description of Artificial Sequence: Synthetic oligonucleotide
  Target: SCN9A; (-) strand; PAM type: NRG; PAM sequence: GAG
ttgttgtgttttgtgtttct

SEQ ID NO: 34511 - DNA, 20 bp, Artificial Sequence
  Description of Artificial Sequence: Synthetic oligonucleotide
  Target: SCN9A; (-) strand; PAM type: NRG; PAM sequence: CAG
gcagagatgaagggatggac

SEQ ID NO: 34512 - DNA, 20 bp, Artificial Sequence
  Description of Artificial Sequence: Synthetic oligonucleotide
  Target: SCN9A; (-) strand; PAM type: NRG; PAM sequence: TGG
aatcagcagagatgaaggga

SEQ ID NO: 34513 - DNA, 20 bp, Artificial Sequence
  Description of Artificial Sequence: Synthetic oligonucleotide
  Target: SCN9A; (-) strand; PAM type: NRG; PAM sequence: GGG
ctaaaatcagcagagatgaa

SEQ ID NO: 34514 - DNA, 20 bp, Artificial Sequence
  Description of Artificial Sequence: Synthetic oligonucleotide
  Target: SCN9A; (-) strand; PAM type: NRG; PAM sequence: AGG
cctaaaatcagcagagatga

SEQ ID NO: 34515 - DNA, 20 bp, Artificial Sequence
  Description of Artificial Sequence: Synthetic oligonucleotide
  Target: SCN9A; (-) strand; PAM type: NRG; PAM sequence: AAG
tcctaaaatcagcagagatg

SEQ ID NO: 34516 - DNA, 20 bp, Artificial Sequence
  Description of Artificial Sequence: Synthetic oligonucleotide
  Target: SCN9A; (-) strand; PAM type: NRG; PAM sequence: GAG
ctgaattcctaaaatcagca

SEQ ID NO: 34517 - DNA, 20 bp, Artificial Sequence
  Description of Artificial Sequence: Synthetic oligonucleotide
  Target: SCN9A; (-) strand; PAM type: NRG; PAM sequence: CAG
ttctgaattcctaaaatcag

SEQ ID NO: 34518 - DNA, 20 bp, Artificial Sequence
  Description of Artificial Sequence: Synthetic oligonucleotide
  Target: SCN9A; (-) strand; PAM type: NRG; PAM sequence: CAG
aatttctgaattcctaaaat

SEQ ID NO: 34519 - DNA, 20 bp, Artificial Sequence
  Description of Artificial Sequence: Synthetic oligonucleotide
  Target: SCN9A; (-) strand; PAM type: NRG; PAM sequence: AAG
atttcattagtgaattacta

SEQ ID NO: 34520 - DNA, 20 bp, Artificial Sequence
  Description of Artificial Sequence: Synthetic oligonucleotide
  Target: SCN9A; (-) strand; PAM type: NRG; PAM sequence: TAG
tatcatttacaaaatttcat

SEQ ID NO: 34521 - DNA, 20 bp, Artificial Sequence
  Description of Artificial Sequence: Synthetic oligonucleotide
  Target: SCN9A; (-) strand; PAM type: NRG; PAM sequence: AAG
atagttaaataaataatagg

SEQ ID NO: 34522 - DNA, 20 bp, Artificial Sequence
  Description of Artificial Sequence: Synthetic oligonucleotide
  Target: SCN9A; (-) strand; PAM type: NRG; PAM sequence: AGG
ggcatagttaaataaataat

SEQ ID NO: 34523 - DNA, 20 bp, Artificial Sequence
  Description of Artificial Sequence: Synthetic oligonucleotide
  Target: SCN9A; (-) strand; PAM type: NRG; PAM sequence: TAG
gggcatagttaaataaataa

SEQ ID NO: 34524 - DNA, 20 bp, Artificial Sequence
  Description of Artificial Sequence: Synthetic oligonucleotide
  Target: SCN9A; (-) strand; PAM type: NRG; PAM sequence: TAG
gtctaggataatagtgggca

SEQ ID NO: 34525 - DNA, 20 bp, Artificial Sequence
  Description of Artificial Sequence: Synthetic oligonucleotide
  Target: SCN9A; (-) strand; PAM type: NRG; PAM sequence: GGG
aatgtgtctaggataatagt

SEQ ID NO: 34526 - DNA, 20 bp, Artificial Sequence
  Description of Artificial Sequence: Synthetic oligonucleotide
  Target: SCN9A; (-) strand; PAM type: NRG; PAM sequence: TGG
caatgtgtctaggataatag

SEQ ID NO: 34527 - DNA, 20 bp, Artificial Sequence
  Description of Artificial Sequence: Synthetic oligonucleotide
  Target: SCN9A; (-) strand; PAM type: NRG; PAM sequence: TAG
attcaatgtgtctaggataa

SEQ ID NO: 34528 - DNA, 20 bp, Artificial Sequence
  Description of Artificial Sequence: Synthetic oligonucleotide
  Target: SCN9A; (-) strand; PAM type: NRG; PAM sequence: AGG
gagctcaattcaatgtgtct

SEQ ID NO: 34529 - DNA, 20 bp, Artificial Sequence
  Description of Artificial Sequence: Synthetic oligonucleotide
  Target: SCN9A; (-) strand; PAM type: NRG; PAM sequence: TAG
agagctcaattcaatgtgtc

SEQ ID NO: 34530 - DNA, 20 bp, Artificial Sequence
  Description of Artificial Sequence: Synthetic oligonucleotide
  Target: SCN9A; (-) strand; PAM type: NRG; PAM sequence: GAG
atttacagacaaaattctaa

SEQ ID NO: 34531 - DNA, 20 bp, Artificial Sequence
  Description of Artificial Sequence: Synthetic oligonucleotide
  Target: SCN9A; (-) strand; PAM type: NRG; PAM sequence: AAG
ttatttacagacaaaattct

SEQ ID NO: 34532 - DNA, 20 bp, Artificial Sequence
  Description of Artificial Sequence: Synthetic oligonucleotide
  Target: SCN9A; (-) strand; PAM type: NRG; PAM sequence: CAG
atagttctaattcttattta

SEQ ID NO: 34533 - DNA, 20 bp, Artificial Sequence
  Description of Artificial Sequence: Synthetic oligonucleotide
  Target: SCN9A; (-) strand; PAM type: NRG; PAM sequence: TAG
aaaagtgacctcataaaata

SEQ ID NO: 34534 - DNA, 20 bp, Artificial Sequence
  Description of Artificial Sequence: Synthetic oligonucleotide
  Target: SCN9A; (-) strand; PAM type: NRG; PAM sequence: AAG
atcattgatgactaagttaa

SEQ ID NO: 34535 - DNA, 20 bp, Artificial Sequence
  Description of Artificial Sequence: Synthetic oligonucleotide
  Target: SCN9A; (-) strand; PAM type: NRG; PAM sequence: AAG
acatggaatcattgatgact

SEQ ID NO: 34536 - DNA, 20 bp, Artificial Sequence
  Description of Artificial Sequence: Synthetic oligonucleotide
  Target: SCN9A; (-) strand; PAM type: NRG; PAM sequence: TGG
agagaatgtgtttacaaaca

SEQ ID NO: 34537 - DNA, 20 bp, Artificial Sequence
  Description of Artificial Sequence: Synthetic oligonucleotide
  Target: SCN9A; (-) strand; PAM type: NRG; PAM sequence: GAG
agtgggcaagatgattgaca

SEQ ID NO: 34538 - DNA, 20 bp, Artificial Sequence
  Description of Artificial Sequence: Synthetic oligonucleotide
  Target: SCN9A; (-) strand; PAM type: NRG; PAM sequence: CAG
ccagtgggcaagatgattga

SEQ ID NO: 34539 - DNA, 20 bp, Artificial Sequence
  Description of Artificial Sequence: Synthetic oligonucleotide
  Target: SCN9A; (-) strand; PAM type: NRG; PAM sequence: AAG
cctggtgatcaccagtgggc

SEQ ID NO: 34540 - DNA, 20 bp, Artificial Sequence
  Description of Artificial Sequence: Synthetic oligonucleotide
  Target: SCN9A; (-) strand; PAM type: NRG; PAM sequence: GGG
tttccctggtgatcaccagt

SEQ ID NO: 34541 - DNA, 20 bp, Artificial Sequence
  Description of Artificial Sequence: Synthetic oligonucleotide
  Target: SCN9A; (-) strand; PAM type: NRG; PAM sequence: TGG
ttttccctggtgatcaccag

SEQ ID NO: 34542 - DNA, 20 bp, Artificial Sequence
  Description of Artificial Sequence: Synthetic oligonucleotide
  Target: SCN9A; (-) strand; PAM type: NRG; PAM sequence: CAG
gccttttccctggtgatcac

SEQ ID NO: 34543 - DNA, 20 bp, Artificial Sequence
  Description of Artificial Sequence: Synthetic oligonucleotide
  Target: SCN9A; (-) strand; PAM type: NRG; PAM sequence: TGG
ataaccttttgccttttccc

SEQ ID NO: 34544 - DNA, 20 bp, Artificial Sequence
  Description of Artificial Sequence: Synthetic oligonucleotide
  Target: SCN9A; (-) strand; PAM type: NRG; PAM sequence: GAG
atacttaaaatgttcttttt

SEQ ID NO: 34545 - DNA, 20 bp, Artificial Sequence
  Description of Artificial Sequence: Synthetic oligonucleotide
  Target: SCN9A; (-) strand; PAM type: NRG; PAM sequence: AAG
attttaatacacatgcaact

SEQ ID NO: 34546 - DNA, 20 bp, Artificial Sequence
  Description of Artificial Sequence: Synthetic oligonucleotide
  Target: SCN9A; (-) strand; PAM type: NRG; PAM sequence: TAG
taattcctgtttcttactct

SEQ ID NO: 34547 - DNA, 20 bp, Artificial Sequence
  Description of Artificial Sequence: Synthetic oligonucleotide
  Target: SCN9A; (-) strand; PAM type: NRG; PAM sequence: TAG
tagcattcgctttatatttg

SEQ ID NO: 34548 - DNA, 20 bp, Artificial Sequence
  Description of Artificial Sequence: Synthetic oligonucleotide
  Target: SCN9A; (-) strand; PAM type: NRG; PAM sequence: TAG
aaaaaaagtcaccgtcaaaa

SEQ ID NO: 34549 - DNA, 20 bp, Artificial Sequence
  Description of Artificial Sequence: Synthetic oligonucleotide
  Target: SCN9A; (-) strand; PAM type: NRG; PAM sequence: AAG
ttttaaaaatattataaaaa

SEQ ID NO: 34550 - DNA, 20 bp, Artificial Sequence
  Description of Artificial Sequence: Synthetic oligonucleotide
  Target: SCN9A; (-) strand; PAM type: NRG; PAM sequence: AAG
ttactcttagcactctgaaa

SEQ ID NO: 34551 - DNA, 20 bp, Artificial Sequence
  Description of Artificial Sequence: Synthetic oligonucleotide
  Target: SCN9A; (-) strand; PAM type: NRG; PAM sequence: TAG
gagagcaggcaaattactct

SEQ ID NO: 34552 - DNA, 20 bp, Artificial Sequence
  Description of Artificial Sequence: Synthetic oligonucleotide
  Target: SCN9A; (-) strand; PAM type: NRG; PAM sequence: AGG
tgtgcttatatatagagagc

SEQ ID NO: 34553 - DNA, 20 bp, Artificial Sequence
  Description of Artificial Sequence: Synthetic oligonucleotide
  Target: SCN9A; (-) strand; PAM type: NRG; PAM sequence: CAG
ctgtgcttatatatagagag

SEQ ID NO: 34554 - DNA, 20 bp, Artificial Sequence
  Description of Artificial Sequence: Synthetic oligonucleotide
  Target: SCN9A; (-) strand; PAM type: NRG; PAM sequence: GAG
cgtctgtgcttatatataga

SEQ ID NO: 34555 - DNA, 20 bp, Artificial Sequence
  Description of Artificial Sequence: Synthetic oligonucleotide
  Target: SCN9A; (-) strand; PAM type: NRG; PAM sequence: GAG
tgcgtctgtgcttatatata

SEQ ID NO: 34556 - DNA, 20 bp, Artificial Sequence
  Description of Artificial Sequence: Synthetic oligonucleotide
  Target: SCN9A; (-) strand; PAM type: NRG; PAM sequence: TAG
tgtgcgtctgtgcttatata

SEQ ID NO: 34557 - DNA, 20 bp, Artificial Sequence
  Description of Artificial Sequence: Synthetic oligonucleotide
  Target: SCN9A; (-) strand; PAM type: NRG; PAM sequence: AGG
aatgtcttaagtgtctactt

SEQ ID NO: 34558 - DNA, 20 bp, Artificial Sequence
  Description of Artificial Sequence: Synthetic oligonucleotide
  Target: SCN9A; (-) strand; PAM type: NRG; PAM sequence: TAG
gaatgtcttaagtgtctact

SEQ ID NO: 34559 - DNA, 20 bp, Artificial Sequence
  Description of Artificial Sequence: Synthetic oligonucleotide
  Target: SCN9A; (-) strand; PAM type: NRG; PAM sequence: AAG
aacttagatatgaatgtctt

SEQ ID NO: 34560 - DNA, 20 bp, Artificial Sequence
  Description of Artificial Sequence: Synthetic oligonucleotide
  Target: SCN9A; (-) strand; PAM type: NRG; PAM sequence: TAG
aatcagatttttttaaaact

SEQ ID NO: 34561 - DNA, 20 bp, Artificial Sequence
  Description of Artificial Sequence: Synthetic oligonucleotide
  Target: SCN9A; (-) strand; PAM type: NRG; PAM sequence: CAG
aagcctttgtgtcgccaaat

SEQ ID NO: 34562 - DNA, 20 bp, Artificial Sequence
  Description of Artificial Sequence: Synthetic oligonucleotide
  Target: SCN9A; (-) strand; PAM type: NRG; PAM sequence: AAG
ttgttaaattcttcccttgg

SEQ ID NO: 34563 - DNA, 20 bp, Artificial Sequence
  Description of Artificial Sequence: Synthetic oligonucleotide
  Target: SCN9A; (-) strand; PAM type: NRG; PAM sequence: TGG
attttgttaaattcttccct

SEQ ID NO: 34564 - DNA, 20 bp, Artificial Sequence
  Description of Artificial Sequence: Synthetic oligonucleotide
  Target: SCN9A; (-) strand; PAM type: NRG; PAM sequence: AAG
ttttcatgcttcaagacttc

SEQ ID NO: 34565 - DNA, 20 bp, Artificial Sequence
  Description of Artificial Sequence: Synthetic oligonucleotide
  Target: SCN9A; (-) strand; PAM type: NRG; PAM sequence: AAG
ttttaggcttttcatgcttc

SEQ ID NO: 34566 - DNA, 20 bp, Artificial Sequence
  Description of Artificial Sequence: Synthetic oligonucleotide
  Target: SCN9A; (-) strand; PAM type: NRG; PAM sequence: AGG
tttgtattattcttcttttt

SEQ ID NO: 34567 - DNA, 20 bp, Artificial Sequence
  Description of Artificial Sequence: Synthetic oligonucleotide
  Target: SCN9A; (-) strand; PAM type: NRG; PAM sequence: TAG
ttttgtattattcttctttt

SEQ ID NO: 34568 - DNA, 20 bp, Artificial Sequence
  Description of Artificial Sequence: Synthetic oligonucleotide
  Target: SCN9A; (-) strand; PAM type: NRG; PAM sequence: GGG
atttcaccaccctgatgtgt

SEQ ID NO: 34569 - DNA, 20 bp, Artificial Sequence
  Description of Artificial Sequence: Synthetic oligonucleotide
  Target: SCN9A; (-) strand; PAM type: NRG; PAM sequence: TGG
catttcaccaccctgatgtg

SEQ ID NO: 34570 - DNA, 20 bp, Artificial Sequence
  Description of Artificial Sequence: Synthetic oligonucleotide
  Target: SCN9A; (-) strand; PAM type: NRG; PAM sequence: AGG
tgtggttgataaactttata

SEQ ID NO: 34571 - DNA, 20 bp, Artificial Sequence
  Description of Artificial Sequence: Synthetic oligonucleotide
  Target: SCN9A; (-) strand; PAM type: NRG; PAM sequence: AAG
gtgtggttgataaactttat

SEQ ID NO: 34572 - DNA, 20 bp, Artificial Sequence
  Description of Artificial Sequence: Synthetic oligonucleotide
  Target: SCN9A; (-) strand; PAM type: NRG; PAM sequence: TGG
taaaccataaagtaattgtg

SEQ ID NO: 34573 - DNA, 20 bp, Artificial Sequence
  Description of Artificial Sequence: Synthetic oligonucleotide
  Target: SCN9A; (-) strand; PAM type: NRG; PAM sequence: AAG
ataattttatataaaccata

SEQ ID NO: 34574 - DNA, 20 bp, Artificial Sequence
  Description of Artificial Sequence: Synthetic oligonucleotide
  Target: SCN9A; (-) strand; PAM type: NRG; PAM sequence: CAG
ttttcatgataagttgtatg

SEQ ID NO: 34575 - DNA, 20 bp, Artificial Sequence
  Description of Artificial Sequence: Synthetic oligonucleotide
  Target: SCN9A; (-) strand; PAM type: NRG; PAM sequence: AAG
ggaagcaattttttcatgat

SEQ ID NO: 34576 - DNA, 20 bp, Artificial Sequence
  Description of Artificial Sequence: Synthetic oligonucleotide
  Target: SCN9A; (-) strand; PAM type: NRG; PAM sequence: AAG
ttcctcagctcagttgcagg

SEQ ID NO: 34577 - DNA, 20 bp, Artificial Sequence
  Description of Artificial Sequence: Synthetic oligonucleotide
  Target: SCN9A; (-) strand; PAM type: NRG; PAM sequence: AGG
aaattcctcagctcagttgc

SEQ ID NO: 34578 - DNA, 20 bp, Artificial Sequence
  Description of Artificial Sequence: Synthetic oligonucleotide
  Target: SCN9A; (-) strand; PAM type: NRG; PAM sequence: CAG
taaattcctcagctcagttg

SEQ ID NO: 34579 - DNA, 20 bp, Artificial Sequence
  Description of Artificial Sequence: Synthetic oligonucleotide
  Target: SCN9A; (-) strand; PAM type: NRG; PAM sequence: CAG
catccctaaattcctcagct

SEQ ID NO: 34580 - DNA, 20 bp, Artificial Sequence
  Description of Artificial Sequence: Synthetic oligonucleotide
  Target: SCN9A; (-) strand; PAM type: NRG; PAM sequence: CAG
catatcatccctaaattcct

SEQ ID NO: 34581 - DNA, 20 bp, Artificial Sequence
  Description of Artificial Sequence: Synthetic oligonucleotide
  Target: SCN9A; (-) strand; PAM type: NRG; PAM sequence: AAG
cccacatcttttgcttgaaa

SEQ ID NO: 34582 - DNA, 20 bp, Artificial Sequence
  Description of Artificial Sequence: Synthetic oligonucleotide
  Target: SCN9A; (-) strand; PAM type: NRG; PAM sequence: TAG
gagccatgaagatattgcaa

SEQ ID NO: 34583 - DNA, 20 bp, Artificial Sequence
  Description of Artificial Sequence: Synthetic oligonucleotide
  Target: SCN9A; (-) strand; PAM type: NRG; PAM sequence: AAG
cttttggcaagagagccatg

SEQ ID NO: 34584 - DNA, 20 bp, Artificial Sequence
  Description of Artificial Sequence: Synthetic oligonucleotide
  Target: SCN9A; (-) strand; PAM type: NRG; PAM sequence: GAG
acatcagtcttttggcaaga

SEQ ID NO: 34585 - DNA, 20 bp, Artificial Sequence
  Description of Artificial Sequence: Synthetic oligonucleotide
  Target: SCN9A; (-) strand; PAM type: NRG; PAM sequence: GAG
atacatcagtcttttggcaa

SEQ ID NO: 34586 - DNA, 20 bp, Artificial Sequence
  Description of Artificial Sequence: Synthetic oligonucleotide
  Target: SCN9A; (-) strand; PAM type: NRG; PAM sequence: AAG
atatacatcagtcttttggc

SEQ ID NO: 34587 - DNA, 20 bp, Artificial Sequence
  Description of Artificial Sequence: Synthetic oligonucleotide
  Target: SCN9A; (-) strand; PAM type: NRG; PAM sequence: TGG
ttaaatatacatcagtcttt

SEQ ID NO: 34588 - DNA, 20 bp, Artificial Sequence
  Description of Artificial Sequence: Synthetic oligonucleotide
  Target: SCN9A; (-) strand; PAM type: NRG; PAM sequence: CAG
taaagtgattaaatatacat

SEQ ID NO: 34589 - DNA, 20 bp, Artificial Sequence
  Description of Artificial Sequence: Synthetic oligonucleotide
  Target: SCN9A; (-) strand; PAM type: NRG; PAM sequence: AAG
gaaatcacatccattagata

SEQ ID NO: 34590 - DNA, 20 bp, Artificial Sequence
  Description of Artificial Sequence: Synthetic oligonucleotide
  Target: SCN9A; (-) strand; PAM type: NRG; PAM sequence: TAG
actttagaaatcacatccat

SEQ ID NO: 34591 - DNA, 20 bp, Artificial Sequence
  Description of Artificial Sequence: Synthetic oligonucleotide
  Target: SCN9A; (-) strand; PAM type: NRG; PAM sequence: TAG
ctaatggctaactgtgactt

SEQ ID NO: 34592 - DNA, 20 bp, Artificial Sequence
  Description of Artificial Sequence: Synthetic oligonucleotide
  Target: SCN9A; (-) strand; PAM type: NRG; PAM sequence: TGG
cagagcaagagctttcctaa

SEQ ID NO: 34593 - DNA, 20 bp, Artificial Sequence
  Description of Artificial Sequence: Synthetic oligonucleotide
  Target: SCN9A; (-) strand; PAM type: NRG; PAM sequence: GAG
gctcagctgaaccagagcaa

SEQ ID NO: 34594 - DNA, 20 bp, Artificial Sequence
  Description of Artificial Sequence: Synthetic oligonucleotide
  Target: SCN9A; (-) strand; PAM type: NRG; PAM sequence: AAG
gtgctcagctgaaccagagc

SEQ ID NO: 34595 - DNA, 20 bp, Artificial Sequence
  Description of Artificial Sequence: Synthetic oligonucleotide
  Target: SCN9A; (-) strand; PAM type: NRG; PAM sequence: GAG
cagagtgctcagctgaacca

SEQ ID NO: 34596 - DNA, 20 bp, Artificial Sequence
  Description of Artificial Sequence: Synthetic oligonucleotide
  Target: SCN9A; (-) strand; PAM type: NRG; PAM sequence: CAG
atcagagtgctcagctgaac

SEQ ID NO: 34597 - DNA, 20 bp, Artificial Sequence
  Description of Artificial Sequence: Synthetic oligonucleotide
  Target: SCN9A; (-) strand; PAM type: NRG; PAM sequence: CAG
ggaaatgtaatcagagtgct

SEQ ID NO: 34598 - DNA, 20 bp, Artificial Sequence
  Description of Artificial Sequence: Synthetic oligonucleotide
  Target: SCN9A; (-) strand; PAM type: NRG; PAM sequence: GAG
aaagtcaggaaatgtaatca

SEQ ID NO: 34599 - DNA, 20 bp, Artificial Sequence
  Description of Artificial Sequence: Synthetic oligonucleotide
  Target: SCN9A; (-) strand; PAM type: NRG; PAM sequence: CAG
acaaagtcaggaaatgtaat

SEQ ID NO: 34600 - DNA, 20 bp, Artificial Sequence
  Description of Artificial Sequence: Synthetic oligonucleotide
  Target: SCN9A; (-) strand; PAM type: NRG; PAM sequence: AGG
ttctctgaaaccacaaagtc

SEQ ID NO: 34601 - DNA, 20 bp, Artificial Sequence
  Description of Artificial Sequence: Synthetic oligonucleotide
  Target: SCN9A; (-) strand; PAM type: NRG; PAM sequence: CAG
cttctctgaaaccacaaagt

SEQ ID NO: 34602 - DNA, 20 bp, Artificial Sequence
  Description of Artificial Sequence: Synthetic oligonucleotide
  Target: SCN9A; (-) strand; PAM type: NRG; PAM sequence: AAG
tctgcttctctgaaaccaca

SEQ ID NO: 34603 - DNA, 20 bp, Artificial Sequence
  Description of Artificial Sequence: Synthetic oligonucleotide
  Target: SCN9A; (-) strand; PAM type: NRG; PAM sequence: CAG
ccagccagggaattctccac

SEQ ID NO: 34604 - DNA, 20 bp, Artificial Sequence
  Description of Artificial Sequence: Synthetic oligonucleotide
  Target: SCN9A; (-) strand; PAM type: NRG; PAM sequence: GGG
aagactgatgaatccagcca

SEQ ID NO: 34605 - DNA, 20 bp, Artificial Sequence
  Description of Artificial Sequence: Synthetic oligonucleotide
  Target: SCN9A; (-) strand; PAM type: NRG; PAM sequence: AGG
aaagactgatgaatccagcc

SEQ ID NO: 34606 - DNA, 20 bp, Artificial Sequence
  Description of Artificial Sequence: Synthetic oligonucleotide
  Target: SCN9A; (-) strand; PAM type: NRG; PAM sequence: CAG
caaagactgatgaatccagc

SEQ ID NO: 34607 - DNA, 20 bp, Artificial Sequence
  Description of Artificial Sequence: Synthetic oligonucleotide
  Target: SCN9A; (-) strand; PAM type: NRG; PAM sequence: CAG
atagcaaagactgatgaatc

SEQ ID NO: 34608 - DNA, 20 bp, Artificial Sequence
  Description of Artificial Sequence: Synthetic oligonucleotide
  Target: SCN9A; (-) strand; PAM type: NRG; PAM sequence: AAG
gtattctcttgtccatagca

SEQ ID NO: 34609 - DNA, 20 bp, Artificial Sequence
  Description of Artificial Sequence: Synthetic oligonucleotide
  Target: SCN9A; (-) strand; PAM type: NRG; PAM sequence: TAG
ttactgtattctcttgtcca

SEQ ID NO: 34610 - DNA, 20 bp, Artificial Sequence
  Description of Artificial Sequence: Synthetic oligonucleotide
  Target: SCN9A; (-) strand; PAM type: NRG; PAM sequence: TGG
cccaagactaatgacttgga

SEQ ID NO: 34611 - DNA, 20 bp, Artificial Sequence
  Description of Artificial Sequence: Synthetic oligonucleotide
  Target: SCN9A; (-) strand; PAM type: NRG; PAM sequence: TGG
aacccccaagactaatgact

SEQ ID NO: 34612 - DNA, 20 bp, Artificial Sequence
  Description of Artificial Sequence: Synthetic oligonucleotide
  Target: SCN9A; (-) strand; PAM type: NRG; PAM sequence: AAG
agtgaatctacccaaccccc

SEQ ID NO: 34613 - DNA, 20 bp, Artificial Sequence
  Description of Artificial Sequence: Synthetic oligonucleotide
  Target: SCN9A; (-) strand; PAM type: NRG; PAM sequence: TAG
tggctctaaagacttggatg

SEQ ID NO: 34614 - DNA, 20 bp, Artificial Sequence
  Description of Artificial Sequence: Synthetic oligonucleotide
  Target: SCN9A; (-) strand; PAM type: NRG; PAM sequence: TGG
ggcacttggctctaaagact

SEQ ID NO: 34615 - DNA, 20 bp, Artificial Sequence
  Description of Artificial Sequence: Synthetic oligonucleotide
  Target: SCN9A; (-) strand; PAM type: NRG; PAM sequence: AAG
catatgggcacttggctcta

SEQ ID NO: 34616 - DNA, 20 bp, Artificial Sequence
  Description of Artificial Sequence: Synthetic oligonucleotide
  Target: SCN9A; (-) strand; PAM type: NRG; PAM sequence: TGG
aagttagccatatgggcact

SEQ ID NO: 34617 - DNA, 20 bp, Artificial Sequence
  Description of Artificial Sequence: Synthetic oligonucleotide
  Target: SCN9A; (-) strand; PAM type: NRG; PAM sequence: GGG
gtaattaaagttagccatat

SEQ ID NO: 34618 - DNA, 20 bp, Artificial Sequence
  Description of Artificial Sequence: Synthetic oligonucleotide
  Target: SCN9A; (-) strand; PAM type: NRG; PAM sequence: TGG
agtaattaaagttagccata

SEQ ID NO: 34619 - DNA, 20 bp, Artificial Sequence
  Description of Artificial Sequence: Synthetic oligonucleotide
  Target: SCN9A; (-) strand; PAM type: NRG; PAM sequence: TAG
tgttctatagtaattaaagt

SEQ ID NO: 34620 - DNA, 20 bp, Artificial Sequence
  Description of Artificial Sequence: Synthetic oligonucleotide
  Target: SCN9A; (-) strand; PAM type: NRG; PAM sequence: AAG
aatctgttctatagtaatta

SEQ ID NO: 34621 - DNA, 20 bp, Artificial Sequence
  Description of Artificial Sequence: Synthetic oligonucleotide
  Target: SCN9A; (-) strand; PAM type: NRG; PAM sequence: TAG
gggaaaaaaaatctgttcta

SEQ ID NO: 34622 - DNA, 20 bp, Artificial Sequence
  Description of Artificial Sequence: Synthetic oligonucleotide
  Target: SCN9A; (-) strand; PAM type: NRG; PAM sequence: GGG
tcaagaagggtaagaatttg

SEQ ID NO: 34623 - DNA, 20 bp, Artificial Sequence
  Description of Artificial Sequence: Synthetic oligonucleotide
  Target: SCN9A; (-) strand; PAM type: NRG; PAM sequence: GGG
atcaagaagggtaagaattt

SEQ ID NO: 34624 - DNA, 20 bp, Artificial Sequence
  Description of Artificial Sequence: Synthetic oligonucleotide
  Target: SCN9A; (-) strand; PAM type: NRG; PAM sequence: TGG
aatcaagaagggtaagaatt

SEQ ID NO: 34625 - DNA, 20 bp, Artificial Sequence
  Description of Artificial Sequence: Synthetic oligonucleotide
  Target: SCN9A; (-) strand; PAM type: NRG; PAM sequence: AAG
ccaatctaatcaagaagggt

SEQ ID NO: 34626 - DNA, 20 bp, Artificial Sequence
  Description of Artificial Sequence: Synthetic oligonucleotide
  Target: SCN9A; (-) strand; PAM type: NRG; PAM sequence: GGG
gtttccaatctaatcaagaa

SEQ ID NO: 34627 - DNA, 20 bp, Artificial Sequence
  Description of Artificial Sequence: Synthetic oligonucleotide
  Target: SCN9A; (-) strand; PAM type: NRG; PAM sequence: AGG
tgtttccaatctaatcaaga

SEQ ID NO: 34628 - DNA, 20 bp, Artificial Sequence
  Description of Artificial Sequence: Synthetic oligonucleotide
  Target: SCN9A; (-) strand; PAM type: NRG; PAM sequence: AAG
ttgtttccaatctaatcaag

SEQ ID NO: 34629 - DNA, 20 bp, Artificial Sequence
  Description of Artificial Sequence: Synthetic oligonucleotide
  Target: SCN9A; (-) strand; PAM type: NRG; PAM sequence: AAG
gatttgtttccaatctaatc

SEQ ID NO: 34630 - DNA, 20 bp, Artificial Sequence
  Description of Artificial Sequence: Synthetic oligonucleotide
  Target: SCN9A; (-) strand; PAM type: NRG; PAM sequence: GAG
attatttaaaactccataat

SEQ ID NO: 34631 - DNA, 20 bp, Artificial Sequence
  Description of Artificial Sequence: Synthetic oligonucleotide
  Target: SCN9A; (-) strand; PAM type: NRG; PAM sequence: TGG
gttgatgatgatgagcttca

SEQ ID NO: 34632 - DNA, 20 bp, Artificial Sequence
  Description of Artificial Sequence: Synthetic oligonucleotide
  Target: SCN9A; (-) strand; PAM type: NRG; PAM sequence: GAG
ggtatcaggttgatgatgat

SEQ ID NO: 34633 - DNA, 20 bp, Artificial Sequence
  Description of Artificial Sequence: Synthetic oligonucleotide
  Target: SCN9A; (-) strand; PAM type: NRG; PAM sequence: AGG
acatattcttagatggtatc

SEQ ID NO: 34634 - DNA, 20 bp, Artificial Sequence
  Description of Artificial Sequence: Synthetic oligonucleotide
  Target: SCN9A; (-) strand; PAM type: NRG; PAM sequence: CAG
aacatattcttagatggtat

SEQ ID NO: 34635 - DNA, 20 bp, Artificial Sequence
  Description of Artificial Sequence: Synthetic oligonucleotide
  Target: SCN9A; (-) strand; PAM type: NRG; PAM sequence: TGG
cacataaacatattcttaga

SEQ ID NO: 34636 - DNA, 20 bp, Artificial Sequence
  Description of Artificial Sequence: Synthetic oligonucleotide
  Target: SCN9A; (-) strand; PAM type: NRG; PAM sequence: TAG
tttgcacataaacatattct

SEQ ID NO: 34637 - DNA, 20 bp, Artificial Sequence
  Description of Artificial Sequence: Synthetic oligonucleotide
  Target: SCN9A; (-) strand; PAM type: NRG; PAM sequence: AAG
acttgaatttaaattttttc

SEQ ID NO: 34638 - DNA, 20 bp, Artificial Sequence
  Description of Artificial Sequence: Synthetic oligonucleotide
  Target: SCN9A; (-) strand; PAM type: NRG; PAM sequence: CAG
ttttttactgtatcttacaa

SEQ ID NO: 34639 - DNA, 20 bp, Artificial Sequence
  Description of Artificial Sequence: Synthetic oligonucleotide
  Target: SCN9A; (-) strand; PAM type: NRG; PAM sequence: TAG
agtctatttgtgatatattc

SEQ ID NO: 34640 - DNA, 20 bp, Artificial Sequence
  Description of Artificial Sequence: Synthetic oligonucleotide
  Target: SCN9A; (-) strand; PAM type: NRG; PAM sequence: AAG
atagaatgaagacaataggg

SEQ ID NO: 34641 - DNA, 20 bp, Artificial Sequence
  Description of Artificial Sequence: Synthetic oligonucleotide
  Target: SCN9A; (-) strand; PAM type: NRG; PAM sequence: GGG
gccatagaatgaagacaata

SEQ ID NO: 34642 - DNA, 20 bp, Artificial Sequence
  Description of Artificial Sequence: Synthetic oligonucleotide
  Target: SCN9A; (-) strand; PAM type: NRG; PAM sequence: AGG
cgccatagaatgaagacaat

SEQ ID NO: 34643 - DNA, 20 bp, Artificial Sequence
  Description of Artificial Sequence: Synthetic oligonucleotide
  Target: SCN9A; (-) strand; PAM type: NRG; PAM sequence: TAG
acgccatagaatgaagacaa

SEQ ID NO: 34644 - DNA, 20 bp, Artificial Sequence
  Description of Artificial Sequence: Synthetic oligonucleotide
  Target: SCN9A; (-) strand; PAM type: NRG; PAM sequence: AAG
ttaagaaacgccatagaatg

SEQ ID NO: 34645 - DNA, 20 bp, Artificial Sequence
  Description of Artificial Sequence: Synthetic oligonucleotide
  Target: SCN9A; (-) strand; PAM type: NRG; PAM sequence: TAG
gtgtttcttaagaaacgcca

SEQ ID NO: 34646 - DNA, 20 bp, Artificial Sequence
  Description of Artificial Sequence: Synthetic oligonucleotide
  Target: SCN9A; (-) strand; PAM type: NRG; PAM sequence: AAG
taacattgtacgtgtttctt

SEQ ID NO: 34647 - DNA, 20 bp, Artificial Sequence
  Description of Artificial Sequence: Synthetic oligonucleotide
  Target: SCN9A; (-) strand; PAM type: NRG; PAM sequence: AAG
cttattttttttgagatgtc

SEQ ID NO: 34648 - DNA, 20 bp, Artificial Sequence
  Description of Artificial Sequence: Synthetic oligonucleotide
  Target: SCN9A; (-) strand; PAM type: NRG; PAM sequence: GAG
gtttagggcttatttttttt

SEQ ID NO: 34649 - DNA, 20 bp, Artificial Sequence
  Description of Artificial Sequence: Synthetic oligonucleotide
  Target: SCN9A; (-) strand; PAM type: NRG; PAM sequence: GGG
ctccccattttacgggttta

SEQ ID NO: 34650 - DNA, 20 bp, Artificial Sequence
  Description of Artificial Sequence: Synthetic oligonucleotide
  Target: SCN9A; (-) strand; PAM type: NRG; PAM sequence: AGG
tctccccattttacgggttt

SEQ ID NO: 34651 - DNA, 20 bp, Artificial Sequence
  Description of Artificial Sequence: Synthetic oligonucleotide
  Target: SCN9A; (-) strand; PAM type: NRG; PAM sequence: TAG
ttctccccattttacgggtt

SEQ ID NO: 34652 - DNA, 20 bp, Artificial Sequence
  Description of Artificial Sequence: Synthetic oligonucleotide
  Target: SCN9A; (-) strand; PAM type: NRG; PAM sequence: GGG
gttttttctccccattttac

SEQ ID NO: 34653 - DNA, 20 bp, Artificial Sequence
  Description of Artificial Sequence: Synthetic oligonucleotide
  Target: SCN9A; (-) strand; PAM type: NRG; PAM sequence: CGG
agttttttctccccatttta

SEQ ID NO: 34654 - DNA, 20 bp, Artificial Sequence
  Description of Artificial Sequence: Synthetic oligonucleotide
  Target: SCN9A; (-) strand; PAM type: NRG; PAM sequence: TAG
ttaccaatataccaacttta

SEQ ID NO: 34655 - DNA, 20 bp, Artificial Sequence
  Description of Artificial Sequence: Synthetic oligonucleotide
  Target: SCN9A; (-) strand; PAM type: NRG; PAM sequence: AGG
actgtcattcacattataat

SEQ ID NO: 34656 - DNA, 20 bp, Artificial Sequence
  Description of Artificial Sequence: Synthetic oligonucleotide
  Target: SCN9A; (-) strand; PAM type: NRG; PAM sequence: TAG
tactgtcattcacattataa

SEQ ID NO: 34657 - DNA, 20 bp, Artificial Sequence
  Description of Artificial Sequence: Synthetic oligonucleotide
  Target: SCN9A; (-) strand; PAM type: NRG; PAM sequence: GGG
ctgtcaggctgttaaaagta

SEQ ID NO: 34658 - DNA, 20 bp, Artificial Sequence
  Description of Artificial Sequence: Synthetic oligonucleotide
  Target: SCN9A; (-) strand; PAM type: NRG; PAM sequence: AGG
tctgtcaggctgttaaaagt

SEQ ID NO: 34659 - DNA, 20 bp, Artificial Sequence
  Description of Artificial Sequence: Synthetic oligonucleotide
  Target: SCN9A; (-) strand; PAM type: NRG; PAM sequence: TAG
ttctgtcaggctgttaaaag

SEQ ID NO: 34660 - DNA, 20 bp, Artificial Sequence
  Description of Artificial Sequence: Synthetic oligonucleotide
  Target: SCN9A; (-) strand; PAM type: NRG; PAM sequence: AAG
attttctgtcaggctgttaa

SEQ ID NO: 34661 - DNA, 20 bp, Artificial Sequence
  Description of Artificial Sequence: Synthetic oligonucleotide
  Target: SCN9A; (-) strand; PAM type: NRG; PAM sequence: AGG
tctactgtaaattttctgtc

SEQ ID NO: 34662 - DNA, 20 bp, Artificial Sequence
  Description of Artificial Sequence: Synthetic oligonucleotide
  Target: SCN9A; (-) strand; PAM type: NRG; PAM sequence: CAG
atctactgtaaattttctgt

SEQ ID NO: 34663 - DNA, 20 bp, Artificial Sequence
  Description of Artificial Sequence: Synthetic oligonucleotide
  Target: SCN9A; (-) strand; PAM type: NRG; PAM sequence: TAG
agataaatccatgagtagta

SEQ ID NO: 34664 - DNA, 20 bp, Artificial Sequence
  Description of Artificial Sequence: Synthetic oligonucleotide
  Target: SCN9A; (-) strand; PAM type: NRG; PAM sequence: TAG
aagtcagataaatccatgag

SEQ ID NO: 34665 - DNA, 20 bp, Artificial Sequence
  Description of Artificial Sequence: Synthetic oligonucleotide
  Target: SCN9A; (-) strand; PAM type: NRG; PAM sequence: GAG
cataagtcagataaatccat

SEQ ID NO: 34666 - DNA, 20 bp, Artificial Sequence
  Description of Artificial Sequence: Synthetic oligonucleotide
  Target: SCN9A; (-) strand; PAM type: NRG; PAM sequence: CAG
aaggggaatcatccataagt

SEQ ID NO: 34667 - DNA, 20 bp, Artificial Sequence
  Description of Artificial Sequence: Synthetic oligonucleotide
  Target: SCN9A; (-) strand; PAM type: NRG; PAM sequence: AAG
tttaaaggggaatcatccat

SEQ ID NO: 34668 - DNA, 20 bp, Artificial Sequence
  Description of Artificial Sequence: Synthetic oligonucleotide
  Target: SCN9A; (-) strand; PAM type: NRG; PAM sequence: GGG
gaatagaacagtctttaaag

SEQ ID NO: 34669 - DNA, 20 bp, Artificial Sequence
  Description of Artificial Sequence: Synthetic oligonucleotide
  Target: SCN9A; (-) strand; PAM type: NRG; PAM sequence: GGG
tgaatagaacagtctttaaa

SEQ ID NO: 34670 - DNA, 20 bp, Artificial Sequence
  Description of Artificial Sequence: Synthetic oligonucleotide
  Target: SCN9A; (-) strand; PAM type: NRG; PAM sequence: AGG
ttgaatagaacagtctttaa

SEQ ID NO: 34671 - DNA, 20 bp, Artificial Sequence
  Description of Artificial Sequence: Synthetic oligonucleotide
  Target: SCN9A; (-) strand; PAM type: NRG; PAM sequence: AAG
attgaatagaacagtcttta

SEQ ID NO: 34672 - DNA, 20 bp, Artificial Sequence
  Description of Artificial Sequence: Synthetic oligonucleotide
  Target: SCN9A; (-) strand; PAM type: NRG; PAM sequence: CAG
taaaactttattgaatagaa

SEQ ID NO: 34673 - DNA, 20 bp, Artificial Sequence
  Description of Artificial Sequence: Synthetic oligonucleotide
  Target: SCN9A; (-) strand; PAM type: NRG; PAM sequence: TAG
gcatgtaaaactttattgaa

SEQ ID NO: 34674 - DNA, 20 bp, Artificial Sequence
  Description of Artificial Sequence: Synthetic oligonucleotide
  Target: SCN9A; (-) strand; PAM type: NRG; PAM sequence: AAG
agcaaaggaatgcatacaac

SEQ ID NO: 34675 - DNA, 20 bp, Artificial Sequence
  Description of Artificial Sequence: Synthetic oligonucleotide
  Target: SCN9A; (-) strand; PAM type: NRG; PAM sequence: AGG
tatttctggtcttgtagcaa

SEQ ID NO: 34676 - DNA, 20 bp, Artificial Sequence
  Description of Artificial Sequence: Synthetic oligonucleotide
  Target: SCN9A; (-) strand; PAM type: NRG; PAM sequence: AAG
ttatttctggtcttgtagca

SEQ ID NO: 34677 - DNA, 20 bp, Artificial Sequence
  Description of Artificial Sequence: Synthetic oligonucleotide
  Target: SCN9A; (-) strand; PAM type: NRG; PAM sequence: TAG
atgctttatttctggtcttg

SEQ ID NO: 34678 - DNA, 20 bp, Artificial Sequence
  Description of Artificial Sequence: Synthetic oligonucleotide
  Target: SCN9A; (-) strand; PAM type: NRG; PAM sequence: TGG
attgtataatgctttatttc

SEQ ID NO: 34679 - DNA, 20 bp, Artificial Sequence
  Description of Artificial Sequence: Synthetic oligonucleotide
  Target: SCN9A; (-) strand; PAM type: NRG; PAM sequence: TAG
tatctttttaacttgttatt

SEQ ID NO: 34680 - DNA, 20 bp, Artificial Sequence
  Description of Artificial Sequence: Synthetic oligonucleotide
  Target: SCN9A; (-) strand; PAM type: NRG; PAM sequence: TGG
tcaccatcattaatttacca

SEQ ID NO: 34681 - DNA, 20 bp, Artificial Sequence
  Description of Artificial Sequence: Synthetic oligonucleotide
  Target: SCN9A; (-) strand; PAM type: NRG; PAM sequence: AGG
ctgcagtctgcttttattgt

SEQ ID NO: 34682 - DNA, 20 bp, Artificial Sequence
  Description of Artificial Sequence: Synthetic oligonucleotide
  Target: SCN9A; (-) strand; PAM type: NRG; PAM sequence: TAG
actgcagtctgcttttattg

SEQ ID NO: 34683 - DNA, 20 bp, Artificial Sequence
  Description of Artificial Sequence: Synthetic oligonucleotide
  Target: SCN9A; (-) strand; PAM type: NRG; PAM sequence: CAG
tcttagtttcagtcttactg

SEQ ID NO: 34684 - DNA, 20 bp, Artificial Sequence
  Description of Artificial Sequence: Synthetic oligonucleotide
  Target: SCN9A; (-) strand; PAM type: NRG; PAM sequence: CAG
cttatttggtttcttagttt

SEQ ID NO: 34685 - DNA, 20 bp, Artificial Sequence
  Description of Artificial Sequence: Synthetic oligonucleotide
  Target: SCN9A; (-) strand; PAM type: NRG; PAM sequence: TAG
taatgccttatttggtttct

SEQ ID NO: 34686 - DNA, 20 bp, Artificial Sequence
  Description of Artificial Sequence: Synthetic oligonucleotide
  Target: SCN9A; (-) strand; PAM type: NRG; PAM sequence: TGG
gtccttgctaatgccttatt

SEQ ID NO: 34687 - DNA, 20 bp, Artificial Sequence
  Description of Artificial Sequence: Synthetic oligonucleotide
  Target: SCN9A; (-) strand; PAM type: NRG; PAM sequence: AGG
atacttcagtacagaatgta

SEQ ID NO: 34688 - DNA, 20 bp, Artificial Sequence
  Description of Artificial Sequence: Synthetic oligonucleotide
  Target: SCN9A; (-) strand; PAM type: NRG; PAM sequence: AAG
tatacttcagtacagaatgt

SEQ ID NO: 34689 - DNA, 20 bp, Artificial Sequence
  Description of Artificial Sequence: Synthetic oligonucleotide
  Target: SCN9A; (-) strand; PAM type: NRG; PAM sequence: CAG
aatatttctatacttcagta

SEQ ID NO: 34690 - DNA, 20 bp, Artificial Sequence
  Description of Artificial Sequence: Synthetic oligonucleotide
  Target: SCN9A; (-) strand; PAM type: NRG; PAM sequence: CAG
taaataatatttctatactt

SEQ ID NO: 34691 - DNA, 20 bp, Artificial Sequence
  Description of Artificial Sequence: Synthetic oligonucleotide
  Target: SCN9A; (-) strand; PAM type: NRG; PAM sequence: AAG
tgattgatgttttgtgattg

SEQ ID NO: 34692 - DNA, 20 bp, Artificial Sequence
  Description of Artificial Sequence: Synthetic oligonucleotide
  Target: SCN9A; (-) strand; PAM type: NRG; PAM sequence: AAG
aaggtgcatatacgaaaagc

SEQ ID NO: 34693 - DNA, 20 bp, Artificial Sequence
  Description of Artificial Sequence: Synthetic oligonucleotide
  Target: SCN9A; (-) strand; PAM type: NRG; PAM sequence: AAG
aatgaaggtgcatatacgaa

SEQ ID NO: 34694 - DNA, 20 bp, Artificial Sequence
  Description of Artificial Sequence: Synthetic oligonucleotide
  Target: SCN9A; (-) strand; PAM type: NRG; PAM sequence: AGG
gttcattaagagtctaatga

SEQ ID NO: 34695 - DNA, 20 bp, Artificial Sequence
  Description of Artificial Sequence: Synthetic oligonucleotide
  Target: SCN9A; (-) strand; PAM type: NRG; PAM sequence: AAG
agttcattaagagtctaatg

SEQ ID NO: 34696 - DNA, 20 bp, Artificial Sequence
  Description of Artificial Sequence: Synthetic oligonucleotide
  Target: SCN9A; (-) strand; PAM type: NRG; PAM sequence: GAG
atttttaatcagttcattaa

SEQ ID NO: 34697 - DNA, 20 bp, Artificial Sequence
  Description of Artificial Sequence: Synthetic oligonucleotide
  Target: SCN9A; (-) strand; PAM type: NRG; PAM sequence: AAG
acatttttaatcagttcatt

SEQ ID NO: 34698 - DNA, 20 bp, Artificial Sequence
  Description of Artificial Sequence: Synthetic oligonucleotide
  Target: SCN9A; (-) strand; PAM type: NRG; PAM sequence: CAG
ttggagaaaacatttttaat

SEQ ID NO: 34699 - DNA, 20 bp, Artificial Sequence
  Description of Artificial Sequence: Synthetic oligonucleotide
  Target: SCN9A; (-) strand; PAM type: NRG; PAM sequence: GAG
aagaaaaaattaacccattg

SEQ ID NO: 34700 - DNA, 20 bp, Artificial Sequence
  Description of Artificial Sequence: Synthetic oligonucleotide
  Target: SCN9A; (-) strand; PAM type: NRG; PAM sequence: TGG
ctaagaaaaaattaacccat

SEQ ID NO: 34701 - DNA, 20 bp, Artificial Sequence
  Description of Artificial Sequence: Synthetic oligonucleotide
  Target: SCN9A; (-) strand; PAM type: NRG; PAM sequence: AAG
cccacaatgttactgcaact

SEQ ID NO: 34702 - DNA, 20 bp, Artificial Sequence
  Description of Artificial Sequence: Synthetic oligonucleotide
  Target: SCN9A; (-) strand; PAM type: NRG; PAM sequence: AAG
gtatcttgatcagtatatag

SEQ ID NO: 34703 - DNA, 20 bp, Artificial Sequence
  Description of Artificial Sequence: Synthetic oligonucleotide
  Target: SCN9A; (-) strand; PAM type: NRG; PAM sequence: TAG
aaagtatcttgatcagtata

SEQ ID NO: 34704 - DNA, 20 bp, Artificial Sequence
  Description of Artificial Sequence: Synthetic oligonucleotide
  Target: SCN9A; (-) strand; PAM type: NRG; PAM sequence: CAG
tgtaggaaaagtatcttgat

SEQ ID NO: 34705 - DNA, 20 bp, Artificial Sequence
  Description of Artificial Sequence: Synthetic oligonucleotide
  Target: SCN9A; (-) strand; PAM type: NRG; PAM sequence: AAG
tcttatgctgtgtgtaggaa

SEQ ID NO: 34706 - DNA, 20 bp, Artificial Sequence
  Description of Artificial Sequence: Synthetic oligonucleotide
  Target: SCN9A; (-) strand; PAM type: NRG; PAM sequence: AGG
tatcttcttatgctgtgtgt

SEQ ID NO: 34707 - DNA, 20 bp, Artificial Sequence
  Description of Artificial Sequence: Synthetic oligonucleotide
  Target: SCN9A; (-) strand; PAM type: NRG; PAM sequence: TAG
atatcttcttatgctgtgtg

SEQ ID NO: 34708 - DNA, 20 bp, Artificial Sequence
  Description of Artificial Sequence: Synthetic oligonucleotide
  Target: SCN9A; (-) strand; PAM type: NRG; PAM sequence: AAG
tttcagtttgattaacgtgg

SEQ ID NO: 34709 - DNA, 20 bp, Artificial Sequence
  Description of Artificial Sequence: Synthetic oligonucleotide
  Target: SCN9A; (-) strand; PAM type: NRG; PAM sequence: TGG
acttttcagtttgattaacg

SEQ ID NO: 34710 - DNA, 20 bp, Artificial Sequence
  Description of Artificial Sequence: Synthetic oligonucleotide
  Target: SCN9A; (-) strand; PAM type: NRG; PAM sequence: CAG
gaattccttgtcttactttt

SEQ ID NO: 34711 - DNA, 20 bp, Artificial Sequence
  Description of Artificial Sequence: Synthetic oligonucleotide
  Target: SCN9A; (-) strand; PAM type: NRG; PAM sequence: TGG
ttctaaaataggctctgatt

SEQ ID NO: 34712 - DNA, 20 bp, Artificial Sequence
  Description of Artificial Sequence: Synthetic oligonucleotide
  Target: SCN9A; (-) strand; PAM type: NRG; PAM sequence: AGG
aatgctcatagttctaaaat

SEQ ID NO: 34713 - DNA, 20 bp, Artificial Sequence
  Description of Artificial Sequence: Synthetic oligonucleotide
  Target: SCN9A; (-) strand; PAM type: NRG; PAM sequence: TAG
gaatgctcatagttctaaaa

SEQ ID NO: 34714 - DNA, 20 bp, Artificial Sequence
  Description of Artificial Sequence: Synthetic oligonucleotide
  Target: SCN9A; (-) strand; PAM type: NRG; PAM sequence: TAG
cgttttcagttgaatgctca

SEQ ID NO: 34715 - DNA, 20 bp, Artificial Sequence
  Description of Artificial Sequence: Synthetic oligonucleotide
  Target: SCN9A; (-) strand; PAM type: NRG; PAM sequence: CAG
gaaatctggagacccgtttt

SEQ ID NO: 34716 - DNA, 20 bp, Artificial Sequence
  Description of Artificial Sequence: Synthetic oligonucleotide
  Target: SCN9A; (-) strand; PAM type: NRG; PAM sequence: GAG
tggagcagcacagaaatctg

SEQ ID NO: 34717 - DNA, 20 bp, Artificial Sequence
  Description of Artificial Sequence: Synthetic oligonucleotide
  Target: SCN9A; (-) strand; PAM type: NRG; PAM sequence: TGG
aatggagcagcacagaaatc

SEQ ID NO: 34718 - DNA, 20 bp, Artificial Sequence
  Description of Artificial Sequence: Synthetic oligonucleotide
  Target: SCN9A; (-) strand; PAM type: NRG; PAM sequence: CAG
ggcaacagaatggagcagca

SEQ ID NO: 34719 - DNA, 20 bp, Artificial Sequence
  Description of Artificial Sequence: Synthetic oligonucleotide
  Target: SCN9A; (-) strand; PAM type: NRG; PAM sequence: CAG
ttggtggcaacagaatggag

SEQ ID NO: 34720 - DNA, 20 bp, Artificial Sequence
  Description of Artificial Sequence: Synthetic oligonucleotide
  Target: SCN9A; (-) strand; PAM type: NRG; PAM sequence: GAG
ttgttggtggcaacagaatg

SEQ ID NO: 34721 - DNA, 20 bp, Artificial Sequence
  Description of Artificial Sequence: Synthetic oligonucleotide
  Target: SCN9A; (-) strand; PAM type: NRG; PAM sequence: TGG
aattgttggtggcaacagaa

SEQ ID NO: 34722 - DNA, 20 bp, Artificial Sequence
  Description of Artificial Sequence: Synthetic oligonucleotide
  Target: SCN9A; (-) strand; PAM type: NRG; PAM sequence: CAG
ttatcaattgttggtggcaa

SEQ ID NO: 34723 - DNA, 20 bp, Artificial Sequence
  Description of Artificial Sequence: Synthetic oligonucleotide
  Target: SCN9A; (-) strand; PAM type: NRG; PAM sequence: TGG
taccaattatcaattgttgg

SEQ ID NO: 34724 - DNA, 20 bp, Artificial Sequence
  Description of Artificial Sequence: Synthetic oligonucleotide
  Target: SCN9A; (-) strand; PAM type: NRG; PAM sequence: TGG
tgataccaattatcaattgt

SEQ ID NO: 34725 - DNA, 20 bp, Artificial Sequence
  Description of Artificial Sequence: Synthetic oligonucleotide
  Target: SCN9A; (-) strand; PAM type: NRG; PAM sequence: AGG
caagttaaaaagcactaaca

SEQ ID NO: 34726 - DNA, 20 bp, Artificial Sequence
  Description of Artificial Sequence: Synthetic oligonucleotide
  Target: SCN9A; (-) strand; PAM type: NRG; PAM sequence: AAG
tcaagttaaaaagcactaac

SEQ ID NO: 34727 - DNA, 20 bp, Artificial Sequence
  Description of Artificial Sequence: Synthetic oligonucleotide
  Target: SCN9A; (-) strand; PAM type: NRG; PAM sequence: AAG
cttcaaacactcaagttaaa

SEQ ID NO: 34728 - DNA, 20 bp, Artificial Sequence
  Description of Artificial Sequence: Synthetic oligonucleotide
  Target: SCN9A; (-) strand; PAM type: NRG; PAM sequence: AAG
ttgaacaacttcaaacactc

SEQ ID NO: 34729 - DNA, 20 bp, Artificial Sequence
  Description of Artificial Sequence: Synthetic oligonucleotide
  Target: SCN9A; (-) strand; PAM type: NRG; PAM sequence: CAG
aaatcttggtttagagaaaa

SEQ ID NO: 34730 - DNA, 20 bp, Artificial Sequence
  Description of Artificial Sequence: Synthetic oligonucleotide
  Target: SCN9A; (-) strand; PAM type: NRG; PAM sequence: GAG
aacttttaaatcttggttta

SEQ ID NO: 34731 - DNA, 20 bp, Artificial Sequence
  Description of Artificial Sequence: Synthetic oligonucleotide
  Target: SCN9A; (-) strand; PAM type: NRG; PAM sequence: TAG
ggaacttttaaatcttggtt

SEQ ID NO: 34732 - DNA, 20 bp, Artificial Sequence
  Description of Artificial Sequence: Synthetic oligonucleotide
  Target: SCN9A; (-) strand; PAM type: NRG; PAM sequence: TGG
atcctggaacttttaaatct

SEQ ID NO: 34733 - DNA, 20 bp, Artificial Sequence
  Description of Artificial Sequence: Synthetic oligonucleotide
  Target: SCN9A; (-) strand; PAM type: NRG; PAM sequence: TGG
caatggaaagatatcgatcc

SEQ ID NO: 34734 - DNA, 20 bp, Artificial Sequence
  Description of Artificial Sequence: Synthetic oligonucleotide
  Target: SCN9A; (-) strand; PAM type: NRG; PAM sequence: AAG
aaaaaaacagatacaatgga

SEQ ID NO: 34735 - DNA, 20 bp, Artificial Sequence
  Description of Artificial Sequence: Synthetic oligonucleotide
  Target: SCN9A; (-) strand; PAM type: NRG; PAM sequence: TGG
taaaaaaaaaacagatacaa

SEQ ID NO: 34736 - DNA, 20 bp, Artificial Sequence
  Description of Artificial Sequence: Synthetic oligonucleotide
  Target: SCN9A; (-) strand; PAM type: NRG; PAM sequence: CAG
gaaagaaattaaaaaaaaaa

SEQ ID NO: 34737 - DNA, 20 bp, Artificial Sequence
  Description of Artificial Sequence: Synthetic oligonucleotide
  Target: SCN9A; (-) strand; PAM type: NRG; PAM sequence: AAG
tttgtgatgttttaataaga

SEQ ID NO: 34738 - DNA, 20 bp, Artificial Sequence
  Description of Artificial Sequence: Synthetic oligonucleotide
  Target: SCN9A; (-) strand; PAM type: NRG; PAM sequence: AAG
gaaatttgtgatgttttaat

SEQ ID NO: 34739 - DNA, 20 bp, Artificial Sequence
  Description of Artificial Sequence: Synthetic oligonucleotide
  Target: SCN9A; (-) strand; PAM type: NRG; PAM sequence: AAG
aagcacagatcttttttcaa

SEQ ID NO: 34740 - DNA, 20 bp, Artificial Sequence
  Description of Artificial Sequence: Synthetic oligonucleotide
  Target: SCN9A; (-) strand; PAM type: NRG; PAM sequence: CAG
gccaccacgcccagaaagca

SEQ ID NO: 34741 - DNA, 20 bp, Artificial Sequence
  Description of Artificial Sequence: Synthetic oligonucleotide
  Target: SCN9A; (-) strand; PAM type: NRG; PAM sequence: AAG
cattagccaccacgcccaga

SEQ ID NO: 34742 - DNA, 20 bp, Artificial Sequence
  Description of Artificial Sequence: Synthetic oligonucleotide
  Target: SCN9A; (-) strand; PAM type: NRG; PAM sequence: CAG
cagacattagccaccacgcc

SEQ ID NO: 34743 - DNA, 20 bp, Artificial Sequence
  Description of Artificial Sequence: Synthetic oligonucleotide
  Target: SCN9A; (-) strand; PAM type: NRG; PAM sequence: TAG
agtgctgggattacagacat

SEQ ID NO: 34744 - DNA, 20 bp, Artificial Sequence
  Description of Artificial Sequence: Synthetic oligonucleotide
  Target: SCN9A; (-) strand; PAM type: NRG; PAM sequence: CAG
ctcccaaagtgctgggatta

SEQ ID NO: 34745 - DNA, 20 bp, Artificial Sequence
  Description of Artificial Sequence: Synthetic oligonucleotide
  Target: SCN9A; (-) strand; PAM type: NRG; PAM sequence: GGG
cttcggcctcccaaagtgct

SEQ ID NO: 34746 - DNA, 20 bp, Artificial Sequence
  Description of Artificial Sequence: Synthetic oligonucleotide
  Target: SCN9A; (-) strand; PAM type: NRG; PAM sequence: TGG
acttcggcctcccaaagtgc

SEQ ID NO: 34747 - DNA, 20 bp, Artificial Sequence
  Description of Artificial Sequence: Synthetic oligonucleotide
  Target: SCN9A; (-) strand; PAM type: NRG; PAM sequence: AAG
ctgcccacttcggcctccca

SEQ ID NO: 34748 - DNA, 20 bp, Artificial Sequence
  Description of Artificial Sequence: Synthetic oligonucleotide
  Target: SCN9A; (-) strand; PAM type: NRG; PAM sequence: CGG
ctcaagtgatctgcccactt

SEQ ID NO: 34749 - DNA, 20 bp, Artificial Sequence
  Description of Artificial Sequence: Synthetic oligonucleotide
  Target: SCN9A; (-) strand; PAM type: NRG; PAM sequence: AAG
ggacttgaactcctgacctc

SEQ ID NO: 34750 - DNA, 20 bp, Artificial Sequence
  Description of Artificial Sequence: Synthetic oligonucleotide
  Target: SCN9A; (-) strand; PAM type: NRG; PAM sequence: TGG
tttcatcatgttggtcaggc

SEQ ID NO: 34751 - DNA, 20 bp, Artificial Sequence
  Description of Artificial Sequence: Synthetic oligonucleotide
  Target: SCN9A; (-) strand; PAM type: NRG; PAM sequence: AGG
ggggtttcatcatgttggtc

SEQ ID NO: 34752 - DNA, 20 bp, Artificial Sequence
  Description of Artificial Sequence: Synthetic oligonucleotide
  Target: SCN9A; (-) strand; PAM type: NRG; PAM sequence: CAG
aggggtttcatcatgttggt

SEQ ID NO: 34753 - DNA, 20 bp, Artificial Sequence
  Description of Artificial Sequence: Synthetic oligonucleotide
  Target: SCN9A; (-) strand; PAM type: NRG; PAM sequence: TGG
gggaaggggtttcatcatgt

SEQ ID NO: 34754 - DNA, 20 bp, Artificial Sequence
  Description of Artificial Sequence: Synthetic oligonucleotide
  Target: SCN9A; (-) strand; PAM type: NRG; PAM sequence: GGG
tttgtatttttgaagggaag

SEQ ID NO: 34755 - DNA, 20 bp, Artificial Sequence
  Description of Artificial Sequence: Synthetic oligonucleotide
  Target: SCN9A; (-) strand; PAM type: NRG; PAM sequence: GGG
ttttgtatttttgaagggaa

SEQ ID NO: 34756 - DNA, 20 bp, Artificial Sequence
  Description of Artificial Sequence: Synthetic oligonucleotide
  Target: SCN9A; (-) strand; PAM type: NRG; PAM sequence: AGG
tttttgtatttttgaaggga

SEQ ID NO: 34757 - DNA, 20 bp, Artificial Sequence
  Description of Artificial Sequence: Synthetic oligonucleotide
  Target: SCN9A; (-) strand; PAM type: NRG; PAM sequence: AAG
atttttgtatttttgaaggg

SEQ ID NO: 34758 - DNA, 20 bp, Artificial Sequence
  Description of Artificial Sequence: Synthetic oligonucleotide
  Target: SCN9A; (-) strand; PAM type: NRG; PAM sequence: GGG
actatttttgtatttttgaa

SEQ ID NO: 34759 - DNA, 20 bp, Artificial Sequence
  Description of Artificial Sequence: Synthetic oligonucleotide
  Target: SCN9A; (-) strand; PAM type: NRG; PAM sequence: AGG
cactatttttgtatttttga

SEQ ID NO: 34760 - DNA, 20 bp, Artificial Sequence
  Description of Artificial Sequence: Synthetic oligonucleotide
  Target: SCN9A; (-) strand; PAM type: NRG; PAM sequence: AAG
tcactatttttgtatttttg

SEQ ID NO: 34761 - DNA, 20 bp, Artificial Sequence
  Description of Artificial Sequence: Synthetic oligonucleotide
  Target: SCN9A; (-) strand; PAM type: NRG; PAM sequence: GGG
tttttttttttttggaaaca

SEQ ID NO: 34762 - DNA, 20 bp, Artificial Sequence
  Description of Artificial Sequence: Synthetic oligonucleotide
  Target: SCN9A; (-) strand; PAM type: NRG; PAM sequence: AGG
ttttttttttttttggaaac

SEQ ID NO: 34763 - DNA, 20 bp, Artificial Sequence
  Description of Artificial Sequence: Synthetic oligonucleotide
  Target: SCN9A; (-) strand; PAM type: NRG; PAM sequence: CAG
cttttttttttttttggaaa

SEQ ID NO: 34764 - DNA, 20 bp, Artificial Sequence
  Description of Artificial Sequence: Synthetic oligonucleotide
  Target: SCN9A; (-) strand; PAM type: NRG; PAM sequence: TGG
ttttctcttttttttttttt

SEQ ID NO: 34765 - DNA, 20 bp, Artificial Sequence
  Description of Artificial Sequence: Synthetic oligonucleotide
  Target: SCN9A; (-) strand; PAM type: NRG; PAM sequence: CAG
taaggcatttttttgtagca

SEQ ID NO: 34766 - DNA, 20 bp, Artificial Sequence
  Description of Artificial Sequence: Synthetic oligonucleotide
  Target: SCN9A; (-) strand; PAM type: NRG; PAM sequence: TAG
tgttttaaggcatttttttg

SEQ ID NO: 34767 - DNA, 20 bp, Artificial Sequence
  Description of Artificial Sequence: Synthetic oligonucleotide
  Target: SCN9A; (-) strand; PAM type: NRG; PAM sequence: AGG
ttaggcaactaaatgtttta

SEQ ID NO: 34768 - DNA, 20 bp, Artificial Sequence
  Description of Artificial Sequence: Synthetic oligonucleotide
  Target: SCN9A; (-) strand; PAM type: NRG; PAM sequence: AAG
gttaggcaactaaatgtttt

SEQ ID NO: 34769 - DNA, 20 bp, Artificial Sequence
  Description of Artificial Sequence: Synthetic oligonucleotide
  Target: SCN9A; (-) strand; PAM type: NRG; PAM sequence: AGG
attcaaacttgcttggtgtt

SEQ ID NO: 34770 - DNA, 20 bp, Artificial Sequence
  Description of Artificial Sequence: Synthetic oligonucleotide
  Target: SCN9A; (-) strand; PAM type: NRG; PAM sequence: TAG
tattcaaacttgcttggtgt

SEQ ID NO: 34771 - DNA, 20 bp, Artificial Sequence
  Description of Artificial Sequence: Synthetic oligonucleotide
  Target: SCN9A; (-) strand; PAM type: NRG; PAM sequence: TGG
ataatttattcaaacttgct

SEQ ID NO: 34772 - DNA, 20 bp, Artificial Sequence
  Description of Artificial Sequence: Synthetic oligonucleotide
  Target: SCN9A; (-) strand; PAM type: NRG; PAM sequence: GGG
aatttcctattgcagacaaa

SEQ ID NO: 34773 - DNA, 20 bp, Artificial Sequence
  Description of Artificial Sequence: Synthetic oligonucleotide
  Target: SCN9A; (-) strand; PAM type: NRG; PAM sequence: AGG
aaatttcctattgcagacaa

SEQ ID NO: 34774 - DNA, 20 bp, Artificial Sequence
  Description of Artificial Sequence: Synthetic oligonucleotide
  Target: SCN9A; (-) strand; PAM type: NRG; PAM sequence: AAG
caaatttcctattgcagaca

SEQ ID NO: 34775 - DNA, 20 bp, Artificial Sequence
  Description of Artificial Sequence: Synthetic oligonucleotide
  Target: SCN9A; (-) strand; PAM type: NRG; PAM sequence: CAG
gattatcaaatttcctattg

SEQ ID NO: 34776 - DNA, 20 bp, Artificial Sequence
  Description of Artificial Sequence: Synthetic oligonucleotide
  Target: SCN9A; (-) strand; PAM type: NRG; PAM sequence: AAG
aatttttttttagtcatggg

SEQ ID NO: 34777 - DNA, 20 bp, Artificial Sequence
  Description of Artificial Sequence: Synthetic oligonucleotide
  Target: SCN9A; (-) strand; PAM type: NRG; PAM sequence: GGG
tataatttttttttagtcat

SEQ ID NO: 34778 - DNA, 20 bp, Artificial Sequence
  Description of Artificial Sequence: Synthetic oligonucleotide
  Target: SCN9A; (-) strand; PAM type: NRG; PAM sequence: TGG
ttataatttttttttagtca

SEQ ID NO: 34779 - DNA, 20 bp, Artificial Sequence
  Description of Artificial Sequence: Synthetic oligonucleotide
  Target: SCN9A; (-) strand; PAM type: NRG; PAM sequence: TAG
tgtagattataatttttttt

SEQ ID NO: 34780 - DNA, 20 bp, Artificial Sequence
  Description of Artificial Sequence: Synthetic oligonucleotide
  Target: SCN9A; (-) strand; PAM type: NRG; PAM sequence: TAG
ctgtacatagtggggagctg

SEQ ID NO: 34781 - DNA, 20 bp, Artificial Sequence
  Description of Artificial Sequence: Synthetic oligonucleotide
  Target: SCN9A; (-) strand; PAM type: NRG; PAM sequence: GAG
gttattctgtacatagtggg

SEQ ID NO: 34782 - DNA, 20 bp, Artificial Sequence
  Description of Artificial Sequence: Synthetic oligonucleotide
  Target: SCN9A; (-) strand; PAM type: NRG; PAM sequence: GGG
aggttattctgtacatagtg

SEQ ID NO: 34783 - DNA, 20 bp, Artificial Sequence
  Description of Artificial Sequence: Synthetic oligonucleotide
  Target: SCN9A; (-) strand; PAM type: NRG; PAM sequence: GGG
caggttattctgtacatagt

SEQ ID NO: 34784 - DNA, 20 bp, Artificial Sequence
  Description of Artificial Sequence: Synthetic oligonucleotide
  Target: SCN9A; (-) strand; PAM type: NRG; PAM sequence: TGG
acaggttattctgtacatag

SEQ ID NO: 34785 - DNA, 20 bp, Artificial Sequence
  Description of Artificial Sequence: Synthetic oligonucleotide
  Target: SCN9A; (-) strand; PAM type: NRG; PAM sequence: TAG
atgacaggttattctgtaca

SEQ ID NO: 34786 - DNA, 20 bp, Artificial Sequence
  Description of Artificial Sequence: Synthetic oligonucleotide
  Target: SCN9A; (-) strand; PAM type: NRG; PAM sequence: AGG
tgacagaccaaagacatgac

SEQ ID NO: 34787 - DNA, 20 bp, Artificial Sequence
  Description of Artificial Sequence: Synthetic oligonucleotide
  Target: SCN9A; (-) strand; PAM type: NRG; PAM sequence: CAG
atgacagaccaaagacatga

SEQ ID NO: 34788 - DNA, 20 bp, Artificial Sequence
  Description of Artificial Sequence: Synthetic oligonucleotide
  Target: SCN9A; (-) strand; PAM type: NRG; PAM sequence: AAG
aaaccttctatgacagacca

SEQ ID NO: 34789 - DNA, 20 bp, Artificial Sequence
  Description of Artificial Sequence: Synthetic oligonucleotide
  Target: SCN9A; (-) strand; PAM type: NRG; PAM sequence: CAG
gttagtaaaaccttctatga

SEQ ID NO: 34790 - DNA, 20 bp, Artificial Sequence
  Description of Artificial Sequence: Synthetic oligonucleotide
  Target: SCN9A; (-) strand; PAM type: NRG; PAM sequence: TAG
agaggctgtcagcatcaggt

SEQ ID NO: 34791 - DNA, 20 bp, Artificial Sequence
  Description of Artificial Sequence: Synthetic oligonucleotide
  Target: SCN9A; (-) strand; PAM type: NRG; PAM sequence: AGG
cagaagaggctgtcagcatc

SEQ ID NO: 34792 - DNA, 20 bp, Artificial Sequence
  Description of Artificial Sequence: Synthetic oligonucleotide
  Target: SCN9A; (-) strand; PAM type: NRG; PAM sequence: CAG
acagaagaggctgtcagcat

SEQ ID NO: 34793 - DNA, 20 bp, Artificial Sequence
  Description of Artificial Sequence: Synthetic oligonucleotide
  Target: SCN9A; (-) strand; PAM type: NRG; PAM sequence: CAG
agggaaacagaagaggctgt

SEQ ID NO: 34794 - DNA, 20 bp, Artificial Sequence
  Description of Artificial Sequence: Synthetic oligonucleotide
  Target: SCN9A; (-) strand; PAM type: NRG; PAM sequence: AGG
tgcaaatagggaaacagaag

SEQ ID NO: 34795 - DNA, 20 bp, Artificial Sequence
  Description of Artificial Sequence: Synthetic oligonucleotide
  Target: SCN9A; (-) strand; PAM type: NRG; PAM sequence: GAG
ctgcaaatagggaaacagaa

SEQ ID NO: 34796 - DNA, 20 bp, Artificial Sequence
  Description of Artificial Sequence: Synthetic oligonucleotide
  Target: SCN9A; (-) strand; PAM type: NRG; PAM sequence: AAG
gactgcaaatagggaaacag

SEQ ID NO: 34797 - DNA, 20 bp, Artificial Sequence
  Description of Artificial Sequence: Synthetic oligonucleotide
  Target: SCN9A; (-) strand; PAM type: NRG; PAM sequence: CAG
gtagactgcaaatagggaaa

SEQ ID NO: 34798 - DNA, 20 bp, Artificial Sequence
  Description of Artificial Sequence: Synthetic oligonucleotide
  Target: SCN9A; (-) strand; PAM type: NRG; PAM sequence: GGG
tggaatgtagactgcaaata

SEQ ID NO: 34799 - DNA, 20 bp, Artificial Sequence
  Description of Artificial Sequence: Synthetic oligonucleotide
  Target: SCN9A; (-) strand; PAM type: NRG; PAM sequence: AGG
ctggaatgtagactgcaaat

SEQ ID NO: 34800 - DNA, 20 bp, Artificial Sequence
  Description of Artificial Sequence: Synthetic oligonucleotide
  Target: SCN9A; (-) strand; PAM type: NRG; PAM sequence: TAG
gctggaatgtagactgcaaa

SEQ ID NO: 34801 - DNA, 20 bp, Artificial Sequence
  Description of Artificial Sequence: Synthetic oligonucleotide
  Target: SCN9A; (-) strand; PAM type: NRG; PAM sequence: TAG
agaataatgtagctggaatg

SEQ ID NO: 34802 - DNA, 20 bp, Artificial Sequence
  Description of Artificial Sequence: Synthetic oligonucleotide
  Target: SCN9A; (-) strand; PAM type: NRG; PAM sequence: TGG
taaacgtagaataatgtagc

SEQ ID NO: 34803 - DNA, 20 bp, Artificial Sequence
  Description of Artificial Sequence: Synthetic oligonucleotide
  Target: SCN9A; (-) strand; PAM type: NRG; PAM sequence: TAG
aaattaaacgtagaataatg

SEQ ID NO: 34804 - DNA, 20 bp, Artificial Sequence
  Description of Artificial Sequence: Synthetic oligonucleotide
  Target: SCN9A; (-) strand; PAM type: NRG; PAM sequence: TAG
acctttggggaaattaaacg

SEQ ID NO: 34805 - DNA, 20 bp, Artificial Sequence
  Description of Artificial Sequence: Synthetic oligonucleotide
  Target: SCN9A; (-) strand; PAM type: NRG; PAM sequence: GGG
aattatctagctgacctttg

SEQ ID NO: 34806 - DNA, 20 bp, Artificial Sequence
  Description of Artificial Sequence: Synthetic oligonucleotide
  Target: SCN9A; (-) strand; PAM type: NRG; PAM sequence: GGG
aaattatctagctgaccttt

SEQ ID NO: 34807 - DNA, 20 bp, Artificial Sequence
  Description of Artificial Sequence: Synthetic oligonucleotide
  Target: SCN9A; (-) strand; PAM type: NRG; PAM sequence: TGG
gaaattatctagctgacctt

SEQ ID NO: 34808 - DNA, 20 bp, Artificial Sequence
  Description of Artificial Sequence: Synthetic oligonucleotide
  Target: SCN9A; (-) strand; PAM type: NRG; PAM sequence: TAG
atgaggatgcagaaattatc

SEQ ID NO: 34809 - DNA, 20 bp, Artificial Sequence
  Description of Artificial Sequence: Synthetic oligonucleotide
  Target: SCN9A; (-) strand; PAM type: NRG; PAM sequence: CAG
aagggaacattatgaggatg

SEQ ID NO: 34810 - DNA, 20 bp, Artificial Sequence
  Description of Artificial Sequence: Synthetic oligonucleotide
  Target: SCN9A; (-) strand; PAM type: NRG; PAM sequence: AGG
cagataaagggaacattatg

SEQ ID NO: 34811 - DNA, 20 bp, Artificial Sequence
  Description of Artificial Sequence: Synthetic oligonucleotide
  Target: SCN9A; (-) strand; PAM type: NRG; PAM sequence: GAG
tcagataaagggaacattat

SEQ ID NO: 34812 - DNA, 20 bp, Artificial Sequence
  Description of Artificial Sequence: Synthetic oligonucleotide
  Target: SCN9A; (-) strand; PAM type: NRG; PAM sequence: GGG
gttgaaactgttcagataaa

SEQ ID NO: 34813 - DNA, 20 bp, Artificial Sequence
  Description of Artificial Sequence: Synthetic oligonucleotide
  Target: SCN9A; (-) strand; PAM type: NRG; PAM sequence: AGG
agttgaaactgttcagataa

SEQ ID NO: 34814 - DNA, 20 bp, Artificial Sequence
  Description of Artificial Sequence: Synthetic oligonucleotide
  Target: SCN9A; (-) strand; PAM type: NRG; PAM sequence: AAG
tagttgaaactgttcagata

SEQ ID NO: 34815 - DNA, 20 bp, Artificial Sequence
  Description of Artificial Sequence: Synthetic oligonucleotide
  Target: SCN9A; (-) strand; PAM type: NRG; PAM sequence: CAG
tcaggatagttgaaactgtt

SEQ ID NO: 34816 - DNA, 20 bp, Artificial Sequence
  Description of Artificial Sequence: Synthetic oligonucleotide
  Target: SCN9A; (-) strand; PAM type: NRG; PAM sequence: TAG
aagtaatcaggtgatcagga

SEQ ID NO: 34817 - DNA, 20 bp, Artificial Sequence
  Description of Artificial Sequence: Synthetic oligonucleotide
  Target: SCN9A; (-) strand; PAM type: NRG; PAM sequence: AGG
aagcaagtaatcaggtgatc

SEQ ID NO: 34818 - DNA, 20 bp, Artificial Sequence
  Description of Artificial Sequence: Synthetic oligonucleotide
  Target: SCN9A; (-) strand; PAM type: NRG; PAM sequence: CAG
aaagcaagtaatcaggtgat

SEQ ID NO: 34819 - DNA, 20 bp, Artificial Sequence
  Description of Artificial Sequence: Synthetic oligonucleotide
  Target: SCN9A; (-) strand; PAM type: NRG; PAM sequence: AGG
atattacaaagcaagtaatc

SEQ ID NO: 34820 - DNA, 20 bp, Artificial Sequence
  Description of Artificial Sequence: Synthetic oligonucleotide
  Target: SCN9A; (-) strand; PAM type: NRG; PAM sequence: CAG
aatattacaaagcaagtaat

SEQ ID NO: 34821 - DNA, 20 bp, Artificial Sequence
  Description of Artificial Sequence: Synthetic oligonucleotide
  Target: SCN9A; (-) strand; PAM type: NRG; PAM sequence: AAG
tgagccaaatattacaaagc

SEQ ID NO: 34822 - DNA, 20 bp, Artificial Sequence
  Description of Artificial Sequence: Synthetic oligonucleotide
  Target: SCN9A; (-) strand; PAM type: NRG; PAM sequence: AAG
gtattgagccaaatattaca

SEQ ID NO: 34823 - DNA, 20 bp, Artificial Sequence
  Description of Artificial Sequence: Synthetic oligonucleotide
  Target: SCN9A; (-) strand; PAM type: NRG; PAM sequence: GAG
cttttcatacaagaggtatt

SEQ ID NO: 34824 - DNA, 20 bp, Artificial Sequence
  Description of Artificial Sequence: Synthetic oligonucleotide
  Target: SCN9A; (-) strand; PAM type: NRG; PAM sequence: AGG
gtcagatcttttcatacaag

SEQ ID NO: 34825 - DNA, 20 bp, Artificial Sequence
  Description of Artificial Sequence: Synthetic oligonucleotide
  Target: SCN9A; (-) strand; PAM type: NRG; PAM sequence: GAG
agtcagatcttttcatacaa

SEQ ID NO: 34826 - DNA, 20 bp, Artificial Sequence
  Description of Artificial Sequence: Synthetic oligonucleotide
  Target: SCN9A; (-) strand; PAM type: NRG; PAM sequence: AAG
gaagtcagatcttttcatac

SEQ ID NO: 34827 - DNA, 20 bp, Artificial Sequence
  Description of Artificial Sequence: Synthetic oligonucleotide
  Target: SCN9A; (-) strand; PAM type: NRG; PAM sequence: CAG
gggaaggaaggaggcgaagt

SEQ ID NO: 34828 - DNA, 20 bp, Artificial Sequence
  Description of Artificial Sequence: Synthetic oligonucleotide
  Target: SCN9A; (-) strand; PAM type: NRG; PAM sequence: AAG
ttgagggaaggaaggaggcg

SEQ ID NO: 34829 - DNA, 20 bp, Artificial Sequence
  Description of Artificial Sequence: Synthetic oligonucleotide
  Target: SCN9A; (-) strand; PAM type: NRG; PAM sequence: AGG
tatatttgagggaaggaagg

SEQ ID NO: 34830 - DNA, 20 bp, Artificial Sequence
  Description of Artificial Sequence: Synthetic oligonucleotide
  Target: SCN9A; (-) strand; PAM type: NRG; PAM sequence: GAG
ttatatttgagggaaggaag

SEQ ID NO: 34831 - DNA, 20 bp, Artificial Sequence
  Description of Artificial Sequence: Synthetic oligonucleotide
  Target: SCN9A; (-) strand; PAM type: NRG; PAM sequence: AGG
atttatatttgagggaagga

SEQ ID NO: 34832 - DNA, 20 bp, Artificial Sequence
  Description of Artificial Sequence: Synthetic oligonucleotide
  Target: SCN9A; (-) strand; PAM type: NRG; PAM sequence: AAG
aatttatatttgagggaagg

SEQ ID NO: 34833 - DNA, 20 bp, Artificial Sequence
  Description of Artificial Sequence: Synthetic oligonucleotide
  Target: SCN9A; (-) strand; PAM type: NRG; PAM sequence: AGG
ttgaatttatatttgaggga

SEQ ID NO: 34834 - DNA, 20 bp, Artificial Sequence
  Description of Artificial Sequence: Synthetic oligonucleotide
  Target: SCN9A; (-) strand; PAM type: NRG; PAM sequence: AAG
gttgaatttatatttgaggg

SEQ ID NO: 34835 - DNA, 20 bp, Artificial Sequence
  Description of Artificial Sequence: Synthetic oligonucleotide
  Target: SCN9A; (-) strand; PAM type: NRG; PAM sequence: GGG
agggttgaatttatatttga

SEQ ID NO: 34836 - DNA, 20 bp, Artificial Sequence
  Description of Artificial Sequence: Synthetic oligonucleotide
  Target: SCN9A; (-) strand; PAM type: NRG; PAM sequence: AGG
aagggttgaatttatatttg

SEQ ID NO: 34837 - DNA, 20 bp, Artificial Sequence
  Description of Artificial Sequence: Synthetic oligonucleotide
  Target: SCN9A; (-) strand; PAM type: NRG; PAM sequence: GAG
gaagggttgaatttatattt

SEQ ID NO: 34838 - DNA, 20 bp, Artificial Sequence
  Description of Artificial Sequence: Synthetic oligonucleotide
  Target: SCN9A; (-) strand; PAM type: NRG; PAM sequence: GGG
gagaaagagaagctgatgaa

SEQ ID NO: 34839 - DNA, 20 bp, Artificial Sequence
  Description of Artificial Sequence: Synthetic oligonucleotide
  Target: SCN9A; (-) strand; PAM type: NRG; PAM sequence: AGG
ggagaaagagaagctgatga

SEQ ID NO: 34840 - DNA, 20 bp, Artificial Sequence
  Description of Artificial Sequence: Synthetic oligonucleotide
  Target: SCN9A; (-) strand; PAM type: NRG; PAM sequence: AAG
gggagaaagagaagctgatg

SEQ ID NO: 34841 - DNA, 20 bp, Artificial Sequence
  Description of Artificial Sequence: Synthetic oligonucleotide
  Target: SCN9A; (-) strand; PAM type: NRG; PAM sequence: AAG
tggagatatgggagaaagag

SEQ ID NO: 34842 - DNA, 20 bp, Artificial Sequence
  Description of Artificial Sequence: Synthetic oligonucleotide
  Target: SCN9A; (-) strand; PAM type: NRG; PAM sequence: GAG
gactggagatatgggagaaa

SEQ ID NO: 34843 - DNA, 20 bp, Artificial Sequence
  Description of Artificial Sequence: Synthetic oligonucleotide
  Target: SCN9A; (-) strand; PAM type: NRG; PAM sequence: AAG
cagactggagatatgggaga

SEQ ID NO: 34844 - DNA, 20 bp, Artificial Sequence
  Description of Artificial Sequence: Synthetic oligonucleotide
  Target: SCN9A; (-) strand; PAM type: NRG; PAM sequence: GAG
aaagcagactggagatatgg

SEQ ID NO: 34845 - DNA, 20 bp, Artificial Sequence
  Description of Artificial Sequence: Synthetic oligonucleotide
  Target: SCN9A; (-) strand; PAM type: NRG; PAM sequence: GGG
tcaaagcagactggagatat

SEQ ID NO: 34846 - DNA, 20 bp, Artificial Sequence
  Description of Artificial Sequence: Synthetic oligonucleotide
  Target: SCN9A; (-) strand; PAM type: NRG; PAM sequence: TGG
ctcaaagcagactggagata

SEQ ID NO: 34847 - DNA, 20 bp, Artificial Sequence
  Description of Artificial Sequence: Synthetic oligonucleotide
  Target: SCN9A; (-) strand; PAM type: NRG; PAM sequence: GAG
tggcagctcaaagcagactg

SEQ ID NO: 34848 - DNA, 20 bp, Artificial Sequence
  Description of Artificial Sequence: Synthetic oligonucleotide
  Target: SCN9A; (-) strand; PAM type: NRG; PAM sequence: TGG
gctggcagctcaaagcagac

SEQ ID NO: 34849 - DNA, 20 bp, Artificial Sequence
  Description of Artificial Sequence: Synthetic oligonucleotide
  Target: SCN9A; (-) strand; PAM type: NRG; PAM sequence: CAG
ggactgctggcagctcaaag

SEQ ID NO: 34850 - DNA, 20 bp, Artificial Sequence
  Description of Artificial Sequence: Synthetic oligonucleotide
  Target: SCN9A; (-) strand; PAM type: NRG; PAM sequence: AAG
aggggactgctggcagctca

SEQ ID NO: 34851 - DNA, 20 bp, Artificial Sequence
  Description of Artificial Sequence: Synthetic oligonucleotide
  Target: SCN9A; (-) strand; PAM type: NRG; PAM sequence: CAG
cgcatttaggggactgctgg

SEQ ID NO: 34852 - DNA, 20 bp, Artificial Sequence
  Description of Artificial Sequence: Synthetic oligonucleotide
  Target: SCN9A; (-) strand; PAM type: NRG; PAM sequence: TGG
atccgcatttaggggactgc

SEQ ID NO: 34853 - DNA, 20 bp, Artificial Sequence
  Description of Artificial Sequence: Synthetic oligonucleotide
  Target: SCN9A; (-) strand; PAM type: NRG; PAM sequence: GGG
ggataaaaatccgcatttag

SEQ ID NO: 34854 - DNA, 20 bp, Artificial Sequence
  Description of Artificial Sequence: Synthetic oligonucleotide
  Target: SCN9A; (-) strand; PAM type: NRG; PAM sequence: GGG
aggataaaaatccgcattta

SEQ ID NO: 34855 - DNA, 20 bp, Artificial Sequence
  Description of Artificial Sequence: Synthetic oligonucleotide
  Target: SCN9A; (-) strand; PAM type: NRG; PAM sequence: AGG
taggataaaaatccgcattt

SEQ ID NO: 34856 - DNA, 20 bp, Artificial Sequence
  Description of Artificial Sequence: Synthetic oligonucleotide
  Target: SCN9A; (-) strand; PAM type: NRG; PAM sequence: TAG
gtaggataaaaatccgcatt

SEQ ID NO: 34857 - DNA, 20 bp, Artificial Sequence
  Description of Artificial Sequence: Synthetic oligonucleotide
  Target: SCN9A; (-) strand; PAM type: NRG; PAM sequence: AGG
aaataaagcactgtagaagt

SEQ ID NO: 34858 - DNA, 20 bp, Artificial Sequence
  Description of Artificial Sequence: Synthetic oligonucleotide
  Target: SCN9A; (-) strand; PAM type: NRG; PAM sequence: TAG
gaaataaagcactgtagaag

SEQ ID NO: 34859 - DNA, 20 bp, Artificial Sequence
  Description of Artificial Sequence: Synthetic oligonucleotide
  Target: SCN9A; (-) strand; PAM type: NRG; PAM sequence: AAG
aaagaaataaagcactgtag

SEQ ID NO: 34860 - DNA, 20 bp, Artificial Sequence
  Description of Artificial Sequence: Synthetic oligonucleotide
  Target: SCN9A; (-) strand; PAM type: NRG; PAM sequence: TAG
atgaaagaaataaagcactg

SEQ ID NO: 34861 - DNA, 20 bp, Artificial Sequence
  Description of Artificial Sequence: Synthetic oligonucleotide
  Target: SCN9A; (-) strand; PAM type: NRG; PAM sequence: AAG
caggcgtgatgaaagaaata

SEQ ID NO: 34862 - DNA, 20 bp, Artificial Sequence
  Description of Artificial Sequence: Synthetic oligonucleotide
  Target: SCN9A; (-) strand; PAM type: NRG; PAM sequence: AAG
gaaggagacaggcgtgatga

SEQ ID NO: 34863 - DNA, 20 bp, Artificial Sequence
  Description of Artificial Sequence: Synthetic oligonucleotide
  Target: SCN9A; (-) strand; PAM type: NRG; PAM sequence: AGG
ggaatctagttgaaggagac

SEQ ID NO: 34864 - DNA, 20 bp, Artificial Sequence
  Description of Artificial Sequence: Synthetic oligonucleotide
  Target: SCN9A; (-) strand; PAM type: NRG; PAM sequence: CAG
tggaatctagttgaaggaga

SEQ ID NO: 34865 - DNA, 20 bp, Artificial Sequence
  Description of Artificial Sequence: Synthetic oligonucleotide
  Target: SCN9A; (-) strand; PAM type: NRG; PAM sequence: GAG
agtttggaatctagttgaag

SEQ ID NO: 34866 - DNA, 20 bp, Artificial Sequence
  Description of Artificial Sequence: Synthetic oligonucleotide
  Target: SCN9A; (-) strand; PAM type: NRG; PAM sequence: AGG
gaagtttggaatctagttga

SEQ ID NO: 34867 - DNA, 20 bp, Artificial Sequence
  Description of Artificial Sequence: Synthetic oligonucleotide
  Target: SCN9A; (-) strand; PAM type: NRG; PAM sequence: AAG
tgaagtttggaatctagttg

SEQ ID NO: 34868 - DNA, 20 bp, Artificial Sequence
  Description of Artificial Sequence: Synthetic oligonucleotide
  Target: SCN9A; (-) strand; PAM type: NRG; PAM sequence: TAG
tgtctatgaagtttggaatc

SEQ ID NO: 34869 - DNA, 20 bp, Artificial Sequence
  Description of Artificial Sequence: Synthetic oligonucleotide
  Target: SCN9A; (-) strand; PAM type: NRG; PAM sequence: TGG
aatttcctgtctatgaagtt

SEQ ID NO: 34870 - DNA, 20 bp, Artificial Sequence
  Description of Artificial Sequence: Synthetic oligonucleotide
  Target: SCN9A; (-) strand; PAM type: NRG; PAM sequence: AAG
agacaaatttcctgtctatg

SEQ ID NO: 34871 - DNA, 20 bp, Artificial Sequence
  Description of Artificial Sequence: Synthetic oligonucleotide
  Target: SCN9A; (-) strand; PAM type: NRG; PAM sequence: AAG
cttggtgataatacatgcct

SEQ ID NO: 34872 - DNA, 20 bp, Artificial Sequence
  Description of Artificial Sequence: Synthetic oligonucleotide
  Target: SCN9A; (-) strand; PAM type: NRG; PAM sequence: TGG
ccagatatcatgttatacct

SEQ ID NO: 34873 - DNA, 20 bp, Artificial Sequence
  Description of Artificial Sequence: Synthetic oligonucleotide
  Target: SCN9A; (-) strand; PAM type: NRG; PAM sequence: CAG
aacaattttatatgatgtgc

SEQ ID NO: 34874 - DNA, 20 bp, Artificial Sequence
  Description of Artificial Sequence: Synthetic oligonucleotide
  Target: SCN9A; (-) strand; PAM type: NRG; PAM sequence: AAG
tttcaccatcttcattcatc

SEQ ID NO: 34875 - DNA, 20 bp, Artificial Sequence
  Description of Artificial Sequence: Synthetic oligonucleotide
  Target: SCN9A; (-) strand; PAM type: NRG; PAM sequence: AAG
tcaagtgcttgggttaggag

SEQ ID NO: 34876 - DNA, 20 bp, Artificial Sequence
  Description of Artificial Sequence: Synthetic oligonucleotide
  Target: SCN9A; (-) strand; PAM type: NRG; PAM sequence: GAG
tcttcaagtgcttgggttag

SEQ ID NO: 34877 - DNA, 20 bp, Artificial Sequence
  Description of Artificial Sequence: Synthetic oligonucleotide
  Target: SCN9A; (-) strand; PAM type: NRG; PAM sequence: AGG
cttcttcaagtgcttgggtt

SEQ ID NO: 34878 - DNA, 20 bp, Artificial Sequence
  Description of Artificial Sequence: Synthetic oligonucleotide
  Target: SCN9A; (-) strand; PAM type: NRG; PAM sequence: TAG
gcttcttcaagtgcttgggt

SEQ ID NO: 34879 - DNA, 20 bp, Artificial Sequence
  Description of Artificial Sequence: Synthetic oligonucleotide
  Target: SCN9A; (-) strand; PAM type: NRG; PAM sequence: GGG
gcgtgcttcttcaagtgctt

SEQ ID NO: 34880 - DNA, 20 bp, Artificial Sequence
  Description of Artificial Sequence: Synthetic oligonucleotide
  Target: SCN9A; (-) strand; PAM type: NRG; PAM sequence: TGG
agcgtgcttcttcaagtgct

SEQ ID NO: 34881 - DNA, 20 bp, Artificial Sequence
  Description of Artificial Sequence: Synthetic oligonucleotide
  Target: SCN9A; (-) strand; PAM type: NRG; PAM sequence: AAG
attagatagcgtgcttcttc

SEQ ID NO: 34882 - DNA, 20 bp, Artificial Sequence
  Description of Artificial Sequence: Synthetic oligonucleotide
  Target: SCN9A; (-) strand; PAM type: NRG; PAM sequence: TAG
ttaaaggcaatataattaga

SEQ ID NO: 34883 - DNA, 20 bp, Artificial Sequence
  Description of Artificial Sequence: Synthetic oligonucleotide
  Target: SCN9A; (-) strand; PAM type: NRG; PAM sequence: TAG
tatgttaaaggcaatataat

SEQ ID NO: 34884 - DNA, 20 bp, Artificial Sequence
  Description of Artificial Sequence: Synthetic oligonucleotide
  Target: SCN9A; (-) strand; PAM type: NRG; PAM sequence: AGG
tagtgtgacatctatgttaa

SEQ ID NO: 34885 - DNA, 20 bp, Artificial Sequence
  Description of Artificial Sequence: Synthetic oligonucleotide
  Target: SCN9A; (-) strand; PAM type: NRG; PAM sequence: AAG
ttagtgtgacatctatgtta

SEQ ID NO: 34886 - DNA, 20 bp, Artificial Sequence
  Description of Artificial Sequence: Synthetic oligonucleotide
  Target: SCN9A; (-) strand; PAM type: NRG; PAM sequence: TAG
taattaaaattgtcttaaat

SEQ ID NO: 34887 - DNA, 20 bp, Artificial Sequence
  Description of Artificial Sequence: Synthetic oligonucleotide
  Target: SCN9A; (-) strand; PAM type: NRG; PAM sequence: TAG
cttggaacactgaaaaatct

SEQ ID NO: 34888 - DNA, 20 bp, Artificial Sequence
  Description of Artificial Sequence: Synthetic oligonucleotide
  Target: SCN9A; (-) strand; PAM type: NRG; PAM sequence: TGG
taaatgtttgaagatgctct

SEQ ID NO: 34889 - DNA, 20 bp, Artificial Sequence
  Description of Artificial Sequence: Synthetic oligonucleotide
  Target: SCN9A; (-) strand; PAM type: NRG; PAM sequence: AAG
tggattattgtaaatgtttg

SEQ ID NO: 34890 - DNA, 20 bp, Artificial Sequence
  Description of Artificial Sequence: Synthetic oligonucleotide
  Target: SCN9A; (-) strand; PAM type: NRG; PAM sequence: TGG
tgtaaaatcaatgatagtta

SEQ ID NO: 34891 - DNA, 20 bp, Artificial Sequence
  Description of Artificial Sequence: Synthetic oligonucleotide
  Target: SCN9A; (-) strand; PAM type: NRG; PAM sequence: TAG
ttctgatgtaaaatcaatga

SEQ ID NO: 34892 - DNA, 20 bp, Artificial Sequence
  Description of Artificial Sequence: Synthetic oligonucleotide
  Target: SCN9A; (-) strand; PAM type: NRG; PAM sequence: TAG
agagtgccataaattaaaga

SEQ ID NO: 34893 - DNA, 20 bp, Artificial Sequence
  Description of Artificial Sequence: Synthetic oligonucleotide
  Target: SCN9A; (-) strand; PAM type: NRG; PAM sequence: AAG
attgagagtgccataaatta

SEQ ID NO: 34894 - DNA, 20 bp, Artificial Sequence
  Description of Artificial Sequence: Synthetic oligonucleotide
  Target: SCN9A; (-) strand; PAM type: NRG; PAM sequence: GAG
aggagaaaaagagcaattga

SEQ ID NO: 34895 - DNA, 20 bp, Artificial Sequence
  Description of Artificial Sequence: Synthetic oligonucleotide
  Target: SCN9A; (-) strand; PAM type: NRG; PAM sequence: GAG
tgaggagaaaaagagcaatt

SEQ ID NO: 34896 - DNA, 20 bp, Artificial Sequence
  Description of Artificial Sequence: Synthetic oligonucleotide
  Target: SCN9A; (-) strand; PAM type: NRG; PAM sequence: GAG
ttttttaatgaggagaaaaa

SEQ ID NO: 34897 - DNA, 20 bp, Artificial Sequence
  Description of Artificial Sequence: Synthetic oligonucleotide
  Target: SCN9A; (-) strand; PAM type: NRG; PAM sequence: AAG
atttttttaatgaggagaaa

SEQ ID NO: 34898 - DNA, 20 bp, Artificial Sequence
  Description of Artificial Sequence: Synthetic oligonucleotide
  Target: SCN9A; (-) strand; PAM type: NRG; PAM sequence: GAG
gttttaatttttttaatgag

SEQ ID NO: 34899 - DNA, 20 bp, Artificial Sequence
  Description of Artificial Sequence: Synthetic oligonucleotide
  Target: SCN9A; (-) strand; PAM type: NRG; PAM sequence: AGG
atgttttaatttttttaatg

SEQ ID NO: 34900 - DNA, 20 bp, Artificial Sequence
  Description of Artificial Sequence: Synthetic oligonucleotide
  Target: SCN9A; (-) strand; PAM type: NRG; PAM sequence: GAG
aatgttttaatttttttaat

SEQ ID NO: 34901 - DNA, 20 bp, Artificial Sequence
  Description of Artificial Sequence: Synthetic oligonucleotide
  Target: SCN9A; (-) strand; PAM type: NRG; PAM sequence: TGG
tatcagcctccataaaagga

SEQ ID NO: 34902 - DNA, 20 bp, Artificial Sequence
  Description of Artificial Sequence: Synthetic oligonucleotide
  Target: SCN9A; (-) strand; PAM type: NRG; PAM sequence: AGG
cacatatcagcctccataaa

SEQ ID NO: 34903 - DNA, 20 bp, Artificial Sequence
  Description of Artificial Sequence: Synthetic oligonucleotide
  Target: SCN9A; (-) strand; PAM type: NRG; PAM sequence: AAG
gcacatatcagcctccataa

SEQ ID NO: 34904 - DNA, 20 bp, Artificial Sequence
  Description of Artificial Sequence: Synthetic oligonucleotide
  Target: SCN9A; (-) strand; PAM type: NRG; PAM sequence: CAG
cttatattttttgcacatat

SEQ ID NO: 34905 - DNA, 20 bp, Artificial Sequence
  Description of Artificial Sequence: Synthetic oligonucleotide
  Target: SCN9A; (-) strand; PAM type: NRG; PAM sequence: CAG
ggggaaacaggttgtaatag

SEQ ID NO: 34906 - DNA, 20 bp, Artificial Sequence
  Description of Artificial Sequence: Synthetic oligonucleotide
  Target: SCN9A; (-) strand; PAM type: NRG; PAM sequence: TAG
aatggggaaacaggttgtaa

SEQ ID NO: 34907 - DNA, 20 bp, Artificial Sequence
  Description of Artificial Sequence: Synthetic oligonucleotide
  Target: SCN9A; (-) strand; PAM type: NRG; PAM sequence: AGG
tgtcactaaaatggggaaac

SEQ ID NO: 34908 - DNA, 20 bp, Artificial Sequence
  Description of Artificial Sequence: Synthetic oligonucleotide
  Target: SCN9A; (-) strand; PAM type: NRG; PAM sequence: CAG
atgtcactaaaatggggaaa

SEQ ID NO: 34909 - DNA, 20 bp, Artificial Sequence
  Description of Artificial Sequence: Synthetic oligonucleotide
  Target: SCN9A; (-) strand; PAM type: NRG; PAM sequence: GGG
atttcgatgtcactaaaatg

SEQ ID NO: 34910 - DNA, 20 bp, Artificial Sequence
  Description of Artificial Sequence: Synthetic oligonucleotide
  Target: SCN9A; (-) strand; PAM type: NRG; PAM sequence: GGG
tatttcgatgtcactaaaat

SEQ ID NO: 34911 - DNA, 20 bp, Artificial Sequence
  Description of Artificial Sequence: Synthetic oligonucleotide
  Target: SCN9A; (-) strand; PAM type: NRG; PAM sequence: TGG
gtatttcgatgtcactaaaa

SEQ ID NO: 34912 - DNA, 20 bp, Artificial Sequence
  Description of Artificial Sequence: Synthetic oligonucleotide
  Target: SCN9A; (-) strand; PAM type: NRG; PAM sequence: TAG
tttaattaaacctaagcaga

SEQ ID NO: 34913 - DNA, 20 bp, Artificial Sequence
  Description of Artificial Sequence: Synthetic oligonucleotide
  Target: SCN9A; (-) strand; PAM type: NRG; PAM sequence: CAG
ctactttaattaaacctaag

SEQ ID NO: 34914 - DNA, 20 bp, Artificial Sequence
  Description of Artificial Sequence: Synthetic oligonucleotide
  Target: SCN9A; (-) strand; PAM type: NRG; PAM sequence: AAG
aagctactttaattaaacct

SEQ ID NO: 34915 - DNA, 20 bp, Artificial Sequence
  Description of Artificial Sequence: Synthetic oligonucleotide
  Target: SCN9A; (-) strand; PAM type: NRG; PAM sequence: AAG
tttatggctggggaaaaaaa

SEQ ID NO: 34916 - DNA, 20 bp, Artificial Sequence
  Description of Artificial Sequence: Synthetic oligonucleotide
  Target: SCN9A; (-) strand; PAM type: NRG; PAM sequence: GGG
aaccttcctgtttatggctg

SEQ ID NO: 34917 - DNA, 20 bp, Artificial Sequence
  Description of Artificial Sequence: Synthetic oligonucleotide
  Target: SCN9A; (-) strand; PAM type: NRG; PAM sequence: GGG
taaccttcctgtttatggct

SEQ ID NO: 34918 - DNA, 20 bp, Artificial Sequence
  Description of Artificial Sequence: Synthetic oligonucleotide
  Target: SCN9A; (-) strand; PAM type: NRG; PAM sequence: TGG
ttaaccttcctgtttatggc

SEQ ID NO: 34919 - DNA, 20 bp, Artificial Sequence
  Description of Artificial Sequence: Synthetic oligonucleotide
  Target: SCN9A; (-) strand; PAM type: NRG; PAM sequence: TGG
acttttaaccttcctgttta

SEQ ID NO: 34920 - DNA, 20 bp, Artificial Sequence
  Description of Artificial Sequence: Synthetic oligonucleotide
  Target: SCN9A; (-) strand; PAM type: NRG; PAM sequence: TGG
agagaattttaaactttagt

SEQ ID NO: 34921 - DNA, 20 bp, Artificial Sequence
  Description of Artificial Sequence: Synthetic oligonucleotide
  Target: SCN9A; (-) strand; PAM type: NRG; PAM sequence: TAG
aattagagaattttaaactt

SEQ ID NO: 34922 - DNA, 20 bp, Artificial Sequence
  Description of Artificial Sequence: Synthetic oligonucleotide
  Target: SCN9A; (-) strand; PAM type: NRG; PAM sequence: GAG
atttgtgtaatcccaaatta

SEQ ID NO: 34923 - DNA, 20 bp, Artificial Sequence
  Description of Artificial Sequence: Synthetic oligonucleotide
  Target: SCN9A; (-) strand; PAM type: NRG; PAM sequence: TAG
ggatttgtgtaatcccaaat

SEQ ID NO: 34924 - DNA, 20 bp, Artificial Sequence
  Description of Artificial Sequence: Synthetic oligonucleotide
  Target: SCN9A; (-) strand; PAM type: NRG; PAM sequence: GGG
gctgtgaacttaaaaacttt

SEQ ID NO: 34925 - DNA, 20 bp, Artificial Sequence
  Description of Artificial Sequence: Synthetic oligonucleotide
  Target: SCN9A; (-) strand; PAM type: NRG; PAM sequence: TGG
tgctgtgaacttaaaaactt

SEQ ID NO: 34926 - DNA, 20 bp, Artificial Sequence
  Description of Artificial Sequence: Synthetic oligonucleotide
  Target: SCN9A; (-) strand; PAM type: NRG; PAM sequence: AAG
aatgtgcctaatgtattttt

SEQ ID NO: 34927 - DNA, 20 bp, Artificial Sequence
  Description of Artificial Sequence: Synthetic oligonucleotide
  Target: SCN9A; (-) strand; PAM type: NRG; PAM sequence: TGG
attttaaggtgcttaagtac

SEQ ID NO: 34928 - DNA, 20 bp, Artificial Sequence
  Description of Artificial Sequence: Synthetic oligonucleotide
  Target: SCN9A; (-) strand; PAM type: NRG; PAM sequence: AAG
tctacaattttaaggtgctt

SEQ ID NO: 34929 - DNA, 20 bp, Artificial Sequence
  Description of Artificial Sequence: Synthetic oligonucleotide
  Target: SCN9A; (-) strand; PAM type: NRG; PAM sequence: AGG
ataaaatatctacaatttta

SEQ ID NO: 34930 - DNA, 20 bp, Artificial Sequence
  Description of Artificial Sequence: Synthetic oligonucleotide
  Target: SCN9A; (-) strand; PAM type: NRG; PAM sequence: AAG
aataaaatatctacaatttt

SEQ ID NO: 34931 - DNA, 20 bp, Artificial Sequence
  Description of Artificial Sequence: Synthetic oligonucleotide
  Target: SCN9A; (-) strand; PAM type: NRG; PAM sequence: TGG
ttgttggatgttcaaagatt

SEQ ID NO: 34932 - DNA, 20 bp, Artificial Sequence
  Description of Artificial Sequence: Synthetic oligonucleotide
  Target: SCN9A; (-) strand; PAM type: NRG; PAM sequence: AAG
atcgctttgttggatgttca

SEQ ID NO: 34933 - DNA, 20 bp, Artificial Sequence
  Description of Artificial Sequence: Synthetic oligonucleotide
  Target: SCN9A; (-) strand; PAM type: NRG; PAM sequence: TGG
taaatacttgatcgctttgt

SEQ ID NO: 34934 - DNA, 20 bp, Artificial Sequence
  Description of Artificial Sequence: Synthetic oligonucleotide
  Target: SCN9A; (-) strand; PAM type: NRG; PAM sequence: AGG
ctaggattgtatctgtgcct

SEQ ID NO: 34935 - DNA, 20 bp, Artificial Sequence
  Description of Artificial Sequence: Synthetic oligonucleotide
  Target: SCN9A; (-) strand; PAM type: NRG; PAM sequence: TAG
tctaggattgtatctgtgcc

SEQ ID NO: 34936 - DNA, 20 bp, Artificial Sequence
  Description of Artificial Sequence: Synthetic oligonucleotide
  Target: SCN9A; (-) strand; PAM type: NRG; PAM sequence: AGG
ttagggttaatcaaccatct

SEQ ID NO: 34937 - DNA, 20 bp, Artificial Sequence
  Description of Artificial Sequence: Synthetic oligonucleotide
  Target: SCN9A; (-) strand; PAM type: NRG; PAM sequence: TAG
gttagggttaatcaaccatc

SEQ ID NO: 34938 - DNA, 20 bp, Artificial Sequence
  Description of Artificial Sequence: Synthetic oligonucleotide
  Target: SCN9A; (-) strand; PAM type: NRG; PAM sequence: GGG
taatggcaaaaattaagtta

SEQ ID NO: 34939 - DNA, 20 bp, Artificial Sequence
  Description of Artificial Sequence: Synthetic oligonucleotide
  Target: SCN9A; (-) strand; PAM type: NRG; PAM sequence: AGG
ttaatggcaaaaattaagtt

SEQ ID NO: 34940 - DNA, 20 bp, Artificial Sequence
  Description of Artificial Sequence: Synthetic oligonucleotide
  Target: SCN9A; (-) strand; PAM type: NRG; PAM sequence: TAG
tttaatggcaaaaattaagt

SEQ ID NO: 34941 - DNA, 20 bp, Artificial Sequence
  Description of Artificial Sequence: Synthetic oligonucleotide
  Target: SCN9A; (-) strand; PAM type: NRG; PAM sequence: AAG
ctattttaatggcaaaaatt

SEQ ID NO: 34942 - DNA, 20 bp, Artificial Sequence
  Description of Artificial Sequence: Synthetic oligonucleotide
  Target: SCN9A; (-) strand; PAM type: NRG; PAM sequence: TGG
aactgcataaactattttaa

SEQ ID NO: 34943 - DNA, 20 bp, Artificial Sequence
  Description of Artificial Sequence: Synthetic oligonucleotide
  Target: SCN9A; (-) strand; PAM type: NRG; PAM sequence: AAG
tctccctgttatttgcgtac

SEQ ID NO: 34944 - DNA, 20 bp, Artificial Sequence
  Description of Artificial Sequence: Synthetic oligonucleotide
  Target: SCN9A; (-) strand; PAM type: NRG; PAM sequence: TAG
gaaatgaaatcttttcagta

SEQ ID NO: 34945 - DNA, 20 bp, Artificial Sequence
  Description of Artificial Sequence: Synthetic oligonucleotide
  Target: SCN9A; (-) strand; PAM type: NRG; PAM sequence: CAG
taatggaaatgaaatctttt

SEQ ID NO: 34946 - DNA, 20 bp, Artificial Sequence
  Description of Artificial Sequence: Synthetic oligonucleotide
  Target: SCN9A; (-) strand; PAM type: NRG; PAM sequence: TGG
taaatgtgtcttggatttaa

SEQ ID NO: 34947 - DNA, 20 bp, Artificial Sequence
  Description of Artificial Sequence: Synthetic oligonucleotide
  Target: SCN9A; (-) strand; PAM type: NRG; PAM sequence: TGG
ttctgcaaataaatgtgtct

SEQ ID NO: 34948 - DNA, 20 bp, Artificial Sequence
  Description of Artificial Sequence: Synthetic oligonucleotide
  Target: SCN9A; (-) strand; PAM type: NRG; PAM sequence: TAG
ccatattaataaccccaaat

SEQ ID NO: 34949 - DNA, 20 bp, Artificial Sequence
  Description of Artificial Sequence: Synthetic oligonucleotide
  Target: SCN9A; (-) strand; PAM type: NRG; PAM sequence: CAG
ttatttttttctatgctttt

SEQ ID NO: 34950 - DNA, 20 bp, Artificial Sequence
  Description of Artificial Sequence: Synthetic oligonucleotide
  Target: SCN9A; (-) strand; PAM type: NRG; PAM sequence: AGG
atcagtaattttcttggaat

SEQ ID NO: 34951 - DNA, 20 bp, Artificial Sequence
  Description of Artificial Sequence: Synthetic oligonucleotide
  Target: SCN9A; (-) strand; PAM type: NRG; PAM sequence: TAG
aatcagtaattttcttggaa

SEQ ID NO: 34952 - DNA, 20 bp, Artificial Sequence
  Description of Artificial Sequence: Synthetic oligonucleotide
  Target: SCN9A; (-) strand; PAM type: NRG; PAM sequence: TGG
aaaaaaatcagtaattttct

SEQ ID NO: 34953 - DNA, 20 bp, Artificial Sequence
  Description of Artificial Sequence: Synthetic oligonucleotide
  Target: SCN9A; (-) strand; PAM type: NRG; PAM sequence: CAG
gtctctttaaaaaaaaaaat

SEQ ID NO: 34954 - DNA, 20 bp, Artificial Sequence
  Description of Artificial Sequence: Synthetic oligonucleotide
  Target: SCN9A; (-) strand; PAM type: NRG; PAM sequence: GAG
cacagcctgggtaacagtag

SEQ ID NO: 34955 - DNA, 20 bp, Artificial Sequence
  Description of Artificial Sequence: Synthetic oligonucleotide
  Target: SCN9A; (-) strand; PAM type: NRG; PAM sequence: AGG
accacagcctgggtaacagt

SEQ ID NO: 34956 - DNA, 20 bp, Artificial Sequence
  Description of Artificial Sequence: Synthetic oligonucleotide
  Target: SCN9A; (-) strand; PAM type: NRG; PAM sequence: TAG
caccacagcctgggtaacag

SEQ ID NO: 34957 - DNA, 20 bp, Artificial Sequence
  Description of Artificial Sequence: Synthetic oligonucleotide
  Target: SCN9A; (-) strand; PAM type: NRG; PAM sequence: CAG
ttgcaccacagcctgggtaa

SEQ ID NO: 34958 - DNA, 20 bp, Artificial Sequence
  Description of Artificial Sequence: Synthetic oligonucleotide
  Target: SCN9A; (-) strand; PAM type: NRG; PAM sequence: GGG
ctatgattgcaccacagcct

SEQ ID NO: 34959 - DNA, 20 bp, Artificial Sequence
  Description of Artificial Sequence: Synthetic oligonucleotide
  Target: SCN9A; (-) strand; PAM type: NRG; PAM sequence: TGG
gctatgattgcaccacagcc

SEQ ID NO: 34960 - DNA, 20 bp, Artificial Sequence
  Description of Artificial Sequence: Synthetic oligonucleotide
  Target: SCN9A; (-) strand; PAM type: NRG; PAM sequence: CAG
agtcagctatgattgcacca

SEQ ID NO: 34961 - DNA, 20 bp, Artificial Sequence
  Description of Artificial Sequence: Synthetic oligonucleotide
  Target: SCN9A; (-) strand; PAM type: NRG; PAM sequence: CAG
tgaggtttggaggttgcagt

SEQ ID NO: 34962 - DNA, 20 bp, Artificial Sequence
  Description of Artificial Sequence: Synthetic oligonucleotide
  Target: SCN9A; (-) strand; PAM type: NRG; PAM sequence: CAG
cccatgaggtttggaggttg

SEQ ID NO: 34963 - DNA, 20 bp, Artificial Sequence
  Description of Artificial Sequence: Synthetic oligonucleotide
  Target: SCN9A; (-) strand; PAM type: NRG; PAM sequence: AGG
cttgagcccatgaggtttgg

SEQ ID NO: 34964 - DNA, 20 bp, Artificial Sequence
  Description of Artificial Sequence: Synthetic oligonucleotide
  Target: SCN9A; (-) strand; PAM type: NRG; PAM sequence: GAG
acttgagcccatgaggtttg

SEQ ID NO: 34965 - DNA, 20 bp, Artificial Sequence
  Description of Artificial Sequence: Synthetic oligonucleotide
  Target: SCN9A; (-) strand; PAM type: NRG; PAM sequence: TGG
acacttgagcccatgaggtt

SEQ ID NO: 34966 - DNA, 20 bp, Artificial Sequence
  Description of Artificial Sequence: Synthetic oligonucleotide
  Target: SCN9A; (-) strand; PAM type: NRG; PAM sequence: AGG
gaagaacacttgagcccatg

SEQ ID NO: 34967 - DNA, 20 bp, Artificial Sequence
  Description of Artificial Sequence: Synthetic oligonucleotide
  Target: SCN9A; (-) strand; PAM type: NRG; PAM sequence: GAG
ggaagaacacttgagcccat

SEQ ID NO: 34968 - DNA, 20 bp, Artificial Sequence
  Description of Artificial Sequence: Synthetic oligonucleotide
  Target: SCN9A; (-) strand; PAM type: NRG; PAM sequence: GAG
ctgaggtgggaagaacactt

SEQ ID NO: 34969 - DNA, 20 bp, Artificial Sequence
  Description of Artificial Sequence: Synthetic oligonucleotide
  Target: SCN9A; (-) strand; PAM type: NRG; PAM sequence: AAG
acttgggaggctgaggtggg

SEQ ID NO: 34970 - DNA, 20 bp, Artificial Sequence
  Description of Artificial Sequence: Synthetic oligonucleotide
  Target: SCN9A; (-) strand; PAM type: NRG; PAM sequence: GGG
gctacttgggaggctgaggt

SEQ ID NO: 34971 - DNA, 20 bp, Artificial Sequence
  Description of Artificial Sequence: Synthetic oligonucleotide
  Target: SCN9A; (-) strand; PAM type: NRG; PAM sequence: TGG
agctacttgggaggctgagg

SEQ ID NO: 34972 - DNA, 20 bp, Artificial Sequence
  Description of Artificial Sequence: Synthetic oligonucleotide
  Target: SCN9A; (-) strand; PAM type: NRG; PAM sequence: AGG
cctagctacttgggaggctg

SEQ ID NO: 34973 - DNA, 20 bp, Artificial Sequence
  Description of Artificial Sequence: Synthetic oligonucleotide
  Target: SCN9A; (-) strand; PAM type: NRG; PAM sequence: GAG
tcctagctacttgggaggct

SEQ ID NO: 34974 - DNA, 20 bp, Artificial Sequence
  Description of Artificial Sequence: Synthetic oligonucleotide
  Target: SCN9A; (-) strand; PAM type: NRG; PAM sequence: AGG
tgtagtcctagctacttggg

SEQ ID NO: 34975 - DNA, 20 bp, Artificial Sequence
  Description of Artificial Sequence: Synthetic oligonucleotide
  Target: SCN9A; (-) strand; PAM type: NRG; PAM sequence: GAG
ctgtagtcctagctacttgg

SEQ ID NO: 34976 - DNA, 20 bp, Artificial Sequence
  Description of Artificial Sequence: Synthetic oligonucleotide
  Target: SCN9A; (-) strand; PAM type: NRG; PAM sequence: GGG
acctgtagtcctagctactt

SEQ ID NO: 34977 - DNA, 20 bp, Artificial Sequence
  Description of Artificial Sequence: Synthetic oligonucleotide
  Target: SCN9A; (-) strand; PAM type: NRG; PAM sequence: TGG
cacctgtagtcctagctact

SEQ ID NO: 34978 - DNA, 20 bp, Artificial Sequence
  Description of Artificial Sequence: Synthetic oligonucleotide
  Target: SCN9A; (-) strand; PAM type: NRG; PAM sequence: TAG
gtggtgcacacctgtagtcc

SEQ ID NO: 34979 - DNA, 20 bp, Artificial Sequence
  Description of Artificial Sequence: Synthetic oligonucleotide
  Target: SCN9A; (-) strand; PAM type: NRG; PAM sequence: TAG
gacatagtggtgcacacctg

SEQ ID NO: 34980 - DNA, 20 bp, Artificial Sequence
  Description of Artificial Sequence: Synthetic oligonucleotide
  Target: SCN9A; (-) strand; PAM type: NRG; PAM sequence: TGG
aaaaaattagccagacatag

SEQ ID NO: 34981 - DNA, 20 bp, Artificial Sequence
  Description of Artificial Sequence: Synthetic oligonucleotide
  Target: SCN9A; (-) strand; PAM type: NRG; PAM sequence: TAG
aaaaaaaaattagccagaca

SEQ ID NO: 34982 - DNA, 20 bp, Artificial Sequence
  Description of Artificial Sequence: Synthetic oligonucleotide
  Target: SCN9A; (-) strand; PAM type: NRG; PAM sequence: CAG
cattaaaaaaaaaaattagc

SEQ ID NO: 34983 - DNA, 20 bp, Artificial Sequence
  Description of Artificial Sequence: Synthetic oligonucleotide
  Target: SCN9A; (-) strand; PAM type: NRG; PAM sequence: TAG
actccattaaaaaaaaaaat

SEQ ID NO: 34984 - DNA, 20 bp, Artificial Sequence
  Description of Artificial Sequence: Synthetic oligonucleotide
  Target: SCN9A; (-) strand; PAM type: NRG; PAM sequence: GAG
tccagcctgggtgacagaga

SEQ ID NO: 34985 - DNA, 20 bp, Artificial Sequence
  Description of Artificial Sequence: Synthetic oligonucleotide
  Target: SCN9A; (-) strand; PAM type: NRG; PAM sequence: GAG
actccagcctgggtgacaga

SEQ ID NO: 34986 - DNA, 20 bp, Artificial Sequence
  Description of Artificial Sequence: Synthetic oligonucleotide
  Target: SCN9A; (-) strand; PAM type: NRG; PAM sequence: GAG
gcactccagcctgggtgaca

SEQ ID NO: 34987 - DNA, 20 bp, Artificial Sequence
  Description of Artificial Sequence: Synthetic oligonucleotide
  Target: SCN9A; (-) strand; PAM type: NRG; PAM sequence: CAG
ctgcactccagcctgggtga

SEQ ID NO: 34988 - DNA, 20 bp, Artificial Sequence
  Description of Artificial Sequence: Synthetic oligonucleotide
  Target: SCN9A; (-) strand; PAM type: NRG; PAM sequence: GGG
atatcactgcactccagcct

SEQ ID NO: 34989 - DNA, 20 bp, Artificial Sequence
  Description of Artificial Sequence: Synthetic oligonucleotide
  Target: SCN9A; (-) strand; PAM type: NRG; PAM sequence: TGG
catatcactgcactccagcc

SEQ ID NO: 34990 - DNA, 20 bp, Artificial Sequence
  Description of Artificial Sequence: Synthetic oligonucleotide
  Target: SCN9A; (-) strand; PAM type: NRG; PAM sequence: CAG
gagatcatatcactgcactc

SEQ ID NO: 34991 - DNA, 20 bp, Artificial Sequence
  Description of Artificial Sequence: Synthetic oligonucleotide
  Target: SCN9A; (-) strand; PAM type: NRG; PAM sequence: GAG
ttgcagtgatggagtgagcc

SEQ ID NO: 34992 - DNA, 20 bp, Artificial Sequence
  Description of Artificial Sequence: Synthetic oligonucleotide
  Target: SCN9A; (-) strand; PAM type: NRG; PAM sequence: GAG
agaggttgcagtgatggagt

SEQ ID NO: 34993 - DNA, 20 bp, Artificial Sequence
  Description of Artificial Sequence: Synthetic oligonucleotide
  Target: SCN9A; (-) strand; PAM type: NRG; PAM sequence: GAG
aggcagaggttgcagtgatg

SEQ ID NO: 34994 - DNA, 20 bp, Artificial Sequence
  Description of Artificial Sequence: Synthetic oligonucleotide
  Target: SCN9A; (-) strand; PAM type: NRG; PAM sequence: TGG
agaggcagaggttgcagtga

SEQ ID NO: 34995 - DNA, 20 bp, Artificial Sequence
  Description of Artificial Sequence: Synthetic oligonucleotide
  Target: SCN9A; (-) strand; PAM type: NRG; PAM sequence: CAG
ctgccaagaggcagaggttg

SEQ ID NO: 34996 - DNA, 20 bp, Artificial Sequence
  Description of Artificial Sequence: Synthetic oligonucleotide
  Target: SCN9A; (-) strand; PAM type: NRG; PAM sequence: AGG
ccagtgctgccaagaggcag

SEQ ID NO: 34997 - DNA, 20 bp, Artificial Sequence
  Description of Artificial Sequence: Synthetic oligonucleotide
  Target: SCN9A; (-) strand; PAM type: NRG; PAM sequence: GAG
cccagtgctgccaagaggca

SEQ ID NO: 34998 - DNA, 20 bp, Artificial Sequence
  Description of Artificial Sequence: Synthetic oligonucleotide
  Target: SCN9A; (-) strand; PAM type: NRG; PAM sequence: CAG
atcccagtgctgccaagagg

SEQ ID NO: 34999 - DNA, 20 bp, Artificial Sequence
  Description of Artificial Sequence: Synthetic oligonucleotide
  Target: SCN9A; (-) strand; PAM type: NRG; PAM sequence: AGG
gttatcccagtgctgccaag

SEQ ID NO: 35000 - DNA, 20 bp, Artificial Sequence
  Description of Artificial Sequence: Synthetic oligonucleotide
  Target: SCN9A; (-) strand; PAM type: NRG; PAM sequence: GAG
tgttatcccagtgctgccaa

SEQ ID NO: 35001 - DNA, 20 bp, Artificial Sequence
  Description of Artificial Sequence: Synthetic oligonucleotide
  Target: SCN9A; (-) strand; PAM type: NRG; PAM sequence: AAG
cctgttatcccagtgctgcc

SEQ ID NO: 35002 - DNA, 20 bp, Artificial Sequence
  Description of Artificial Sequence: Synthetic oligonucleotide
  Target: SCN9A; (-) strand; PAM type: NRG; PAM sequence: CAG
gtggctcatgcctgttatcc

SEQ ID NO: 35003 - DNA, 20 bp, Artificial Sequence
  Description of Artificial Sequence: Synthetic oligonucleotide
  Target: SCN9A; (-) strand; PAM type: NRG; PAM sequence: TGG
agaagacaggttgggtgtgg

SEQ ID NO: 35004 - DNA, 20 bp, Artificial Sequence
  Description of Artificial Sequence: Synthetic oligonucleotide
  Target: SCN9A; (-) strand; PAM type: NRG; PAM sequence: TGG
aaaagaagacaggttgggtg

SEQ ID NO: 35005 - DNA, 20 bp, Artificial Sequence
  Description of Artificial Sequence: Synthetic oligonucleotide
  Target: SCN9A; (-) strand; PAM type: NRG; PAM sequence: GGG
tatataaaagaagacaggtt

SEQ ID NO: 35006 - DNA, 20 bp, Artificial Sequence
  Description of Artificial Sequence: Synthetic oligonucleotide
  Target: SCN9A; (-) strand; PAM type: NRG; PAM sequence: TGG
atatataaaagaagacaggt

SEQ ID NO: 35007 - DNA, 20 bp, Artificial Sequence
  Description of Artificial Sequence: Synthetic oligonucleotide
  Target: SCN9A; (-) strand; PAM type: NRG; PAM sequence: AGG
atatatatataaaagaagac

SEQ ID NO: 35008 - DNA, 20 bp, Artificial Sequence
  Description of Artificial Sequence: Synthetic oligonucleotide
  Target: SCN9A; (-) strand; PAM type: NRG; PAM sequence: CAG
tatatatatataaaagaaga

SEQ ID NO: 35009 - DNA, 20 bp, Artificial Sequence
  Description of Artificial Sequence: Synthetic oligonucleotide
  Target: SCN9A; (-) strand; PAM type: NRG; PAM sequence: AAG
tatgtatatatatataaaag

SEQ ID NO: 35010 - DNA, 20 bp, Artificial Sequence
  Description of Artificial Sequence: Synthetic oligonucleotide
  Target: SCN9A; (-) strand; PAM type: NRG; PAM sequence: AAG
cagtatgtatatatatataa

SEQ ID NO: 35011 - DNA, 20 bp, Artificial Sequence
  Description of Artificial Sequence: Synthetic oligonucleotide
  Target: SCN9A; (-) strand; PAM type: NRG; PAM sequence: CAG
cctttctggaaacattttgt

SEQ ID NO: 35012 - DNA, 20 bp, Artificial Sequence
  Description of Artificial Sequence: Synthetic oligonucleotide
  Target: SCN9A; (-) strand; PAM type: NRG; PAM sequence: TGG
atacatttttatagcctttc

SEQ ID NO: 35013 - DNA, 20 bp, Artificial Sequence
  Description of Artificial Sequence: Synthetic oligonucleotide
  Target: SCN9A; (-) strand; PAM type: NRG; PAM sequence: TAG
aaaaatgatatacattttta

SEQ ID NO: 35014 - DNA, 20 bp, Artificial Sequence
  Description of Artificial Sequence: Synthetic oligonucleotide
  Target: SCN9A; (-) strand; PAM type: NRG; PAM sequence: GGG
atgactatacttaacattgt

SEQ ID NO: 35015 - DNA, 20 bp, Artificial Sequence
  Description of Artificial Sequence: Synthetic oligonucleotide
  Target: SCN9A; (-) strand; PAM type: NRG; PAM sequence: TGG
aatgactatacttaacattg

SEQ ID NO: 35016 - DNA, 20 bp, Artificial Sequence
  Description of Artificial Sequence: Synthetic oligonucleotide
  Target: SCN9A; (-) strand; PAM type: NRG; PAM sequence: AAG
gttttaaatatcaaattatg

SEQ ID NO: 35017 - DNA, 20 bp, Artificial Sequence
  Description of Artificial Sequence: Synthetic oligonucleotide
  Target: SCN9A; (-) strand; PAM type: NRG; PAM sequence: TAG
gtttcacgaaattcacattt

SEQ ID NO: 35018 - DNA, 20 bp, Artificial Sequence
  Description of Artificial Sequence: Synthetic oligonucleotide
  Target: SCN9A; (-) strand; PAM type: NRG; PAM sequence: TAG
gacactgaccaaagaagaac

SEQ ID NO: 35019 - DNA, 20 bp, Artificial Sequence
  Description of Artificial Sequence: Synthetic oligonucleotide
  Target: SCN9A; (-) strand; PAM type: NRG; PAM sequence: AAG
actaaagacactgaccaaag

SEQ ID NO: 35020 - DNA, 20 bp, Artificial Sequence
  Description of Artificial Sequence: Synthetic oligonucleotide
  Target: SCN9A; (-) strand; PAM type: NRG; PAM sequence: AAG
gagactaaagacactgacca

SEQ ID NO: 35021 - DNA, 20 bp, Artificial Sequence
  Description of Artificial Sequence: Synthetic oligonucleotide
  Target: SCN9A; (-) strand; PAM type: NRG; PAM sequence: AAG
gaaaaaagatcaagagacta

SEQ ID NO: 35022 - DNA, 20 bp, Artificial Sequence
  Description of Artificial Sequence: Synthetic oligonucleotide
  Target: SCN9A; (-) strand; PAM type: NRG; PAM sequence: GAG
ttcaatagaaaaaagatcaa

SEQ ID NO: 35023 - DNA, 20 bp, Artificial Sequence
  Description of Artificial Sequence: Synthetic oligonucleotide
  Target: SCN9A; (-) strand; PAM type: NRG; PAM sequence: AAG
atttcaatagaaaaaagatc

SEQ ID NO: 35024 - DNA, 20 bp, Artificial Sequence
  Description of Artificial Sequence: Synthetic oligonucleotide
  Target: SCN9A; (-) strand; PAM type: NRG; PAM sequence: AAG
atgaatatttcaatagaaaa

SEQ ID NO: 35025 - DNA, 20 bp, Artificial Sequence
  Description of Artificial Sequence: Synthetic oligonucleotide
  Target: SCN9A; (-) strand; PAM type: NRG; PAM sequence: TAG
gaaaataatgaatatttcaa

SEQ ID NO: 35026 - DNA, 20 bp, Artificial Sequence
  Description of Artificial Sequence: Synthetic oligonucleotide
  Target: SCN9A; (-) strand; PAM type: NRG; PAM sequence: AAG
cacacaatcccttggcaaac

SEQ ID NO: 35027 - DNA, 20 bp, Artificial Sequence
  Description of Artificial Sequence: Synthetic oligonucleotide
  Target: SCN9A; (-) strand; PAM type: NRG; PAM sequence: TGG
cacacacacacacaatccct

SEQ ID NO: 35028 - DNA, 20 bp, Artificial Sequence
  Description of Artificial Sequence: Synthetic oligonucleotide
  Target: SCN9A; (-) strand; PAM type: NRG; PAM sequence: TAG
tgaaaaggtatcaatatcct

SEQ ID NO: 35029 - DNA, 20 bp, Artificial Sequence
  Description of Artificial Sequence: Synthetic oligonucleotide
  Target: SCN9A; (-) strand; PAM type: NRG; PAM sequence: AGG
aaaaagaaatttttgtgaaa

SEQ ID NO: 35030 - DNA, 20 bp, Artificial Sequence
  Description of Artificial Sequence: Synthetic oligonucleotide
  Target: SCN9A; (-) strand; PAM type: NRG; PAM sequence: AAG
aaaaaagaaatttttgtgaa

SEQ ID NO: 35031 - DNA, 20 bp, Artificial Sequence
  Description of Artificial Sequence: Synthetic oligonucleotide
  Target: SCN9A; (-) strand; PAM type: NRG; PAM sequence: AAG
aactggcaaaagaaaaaaaa

SEQ ID NO: 35032 - DNA, 20 bp, Artificial Sequence
  Description of Artificial Sequence: Synthetic oligonucleotide
  Target: SCN9A; (-) strand; PAM type: NRG; PAM sequence: AAG
aaaagatgacaaactggcaa

SEQ ID NO: 35033 - DNA, 20 bp, Artificial Sequence
  Description of Artificial Sequence: Synthetic oligonucleotide
  Target: SCN9A; (-) strand; PAM type: NRG; PAM sequence: TGG
aaagttaaaagatgacaaac

SEQ ID NO: 35034 - DNA, 20 bp, Artificial Sequence
  Description of Artificial Sequence: Synthetic oligonucleotide
  Target: SCN9A; (-) strand; PAM type: NRG; PAM sequence: AAG
tttagtaaagacaaagttaa

SEQ ID NO: 35035 - DNA, 20 bp, Artificial Sequence
  Description of Artificial Sequence: Synthetic oligonucleotide
  Target: SCN9A; (-) strand; PAM type: NRG; PAM sequence: AAG
aaccagttttagtaaagaca

SEQ ID NO: 35036 - DNA, 20 bp, Artificial Sequence
  Description of Artificial Sequence: Synthetic oligonucleotide
  Target: SCN9A; (-) strand; PAM type: NRG; PAM sequence: AAG
tttgaaaaccagttttagta

SEQ ID NO: 35037 - DNA, 20 bp, Artificial Sequence
  Description of Artificial Sequence: Synthetic oligonucleotide
  Target: SCN9A; (-) strand; PAM type: NRG; PAM sequence: TAG
tcatttttgaaaaccagttt

SEQ ID NO: 35038 - DNA, 20 bp, Artificial Sequence
  Description of Artificial Sequence: Synthetic oligonucleotide
  Target: SCN9A; (-) strand; PAM type: NRG; PAM sequence: CAG
ttctattcatttttgaaaac

SEQ ID NO: 35039 - DNA, 20 bp, Artificial Sequence
  Description of Artificial Sequence: Synthetic oligonucleotide
  Target: SCN9A; (-) strand; PAM type: NRG; PAM sequence: GAG
tactgcataattcctttaaa

SEQ ID NO: 35040 - DNA, 20 bp, Artificial Sequence
  Description of Artificial Sequence: Synthetic oligonucleotide
  Target: SCN9A; (-) strand; PAM type: NRG; PAM sequence: AAG
gttactgcataattccttta

SEQ ID NO: 35041 - DNA, 20 bp, Artificial Sequence
  Description of Artificial Sequence: Synthetic oligonucleotide
  Target: SCN9A; (-) strand; PAM type: NRG; PAM sequence: AAG
ggtaaatatttttaatgtta

SEQ ID NO: 35042 - DNA, 20 bp, Artificial Sequence
  Description of Artificial Sequence: Synthetic oligonucleotide
  Target: SCN9A; (-) strand; PAM type: NRG; PAM sequence: AGG
aaacatatatatgcacaaaa

SEQ ID NO: 35043 - DNA, 20 bp, Artificial Sequence
  Description of Artificial Sequence: Synthetic oligonucleotide
  Target: SCN9A; (-) strand; PAM type: NRG; PAM sequence: AAG
aaaacatatatatgcacaaa

SEQ ID NO: 35044 - DNA, 20 bp, Artificial Sequence
  Description of Artificial Sequence: Synthetic oligonucleotide
  Target: SCN9A; (-) strand; PAM type: NRG; PAM sequence: GGG
aataaaactgccctcccaat

SEQ ID NO: 35045 - DNA, 20 bp, Artificial Sequence
  Description of Artificial Sequence: Synthetic oligonucleotide
  Target: SCN9A; (-) strand; PAM type: NRG; PAM sequence: TGG
aaataaaactgccctcccaa

SEQ ID NO: 35046 - DNA, 20 bp, Artificial Sequence
  Description of Artificial Sequence: Synthetic oligonucleotide
  Target: SCN9A; (-) strand; PAM type: NRG; PAM sequence: CAG
atttctaggcctatgtttcc

SEQ ID NO: 35047 - DNA, 20 bp, Artificial Sequence
  Description of Artificial Sequence: Synthetic oligonucleotide
  Target: SCN9A; (-) strand; PAM type: NRG; PAM sequence: AGG
aaaaaaaaaatctcatttct

SEQ ID NO: 35048 - DNA, 20 bp, Artificial Sequence
  Description of Artificial Sequence: Synthetic oligonucleotide
  Target: SCN9A; (-) strand; PAM type: NRG; PAM sequence: TAG
aaaaaaaaaaatctcatttc

SEQ ID NO: 35049 - DNA, 20 bp, Artificial Sequence
  Description of Artificial Sequence: Synthetic oligonucleotide
  Target: SCN9A; (-) strand; PAM type: NRG; PAM sequence: GAG
atgccactgcactccagact

SEQ ID NO: 35050 - DNA, 20 bp, Artificial Sequence
  Description of Artificial Sequence: Synthetic oligonucleotide
  Target: SCN9A; (-) strand; PAM type: NRG; PAM sequence: CAG
gagatcatgccactgcactc

SEQ ID NO: 35051 - DNA, 20 bp, Artificial Sequence
  Description of Artificial Sequence: Synthetic oligonucleotide
  Target: SCN9A; (-) strand; PAM type: NRG; PAM sequence: GAG
ggcagaggttatagtgagct

SEQ ID NO: 35052 - DNA, 20 bp, Artificial Sequence
  Description of Artificial Sequence: Synthetic oligonucleotide
  Target: SCN9A; (-) strand; PAM type: NRG; PAM sequence: GAG
caggaggcagaggttatagt

SEQ ID NO: 35053 - DNA, 20 bp, Artificial Sequence
  Description of Artificial Sequence: Synthetic oligonucleotide
  Target: SCN9A; (-) strand; PAM type: NRG; PAM sequence: TAG
aatccaggaggcagaggtta

SEQ ID NO: 35054 - DNA, 20 bp, Artificial Sequence
  Description of Artificial Sequence: Synthetic oligonucleotide
  Target: SCN9A; (-) strand; PAM type: NRG; PAM sequence: AGG
cacttgaatccaggaggcag

SEQ ID NO: 35055 - DNA, 20 bp, Artificial Sequence
  Description of Artificial Sequence: Synthetic oligonucleotide
  Target: SCN9A; (-) strand; PAM type: NRG; PAM sequence: GAG
tcacttgaatccaggaggca

SEQ ID NO: 35056 - DNA, 20 bp, Artificial Sequence
  Description of Artificial Sequence: Synthetic oligonucleotide
  Target: SCN9A; (-) strand; PAM type: NRG; PAM sequence: CAG
aatcacttgaatccaggagg

SEQ ID NO: 35057 - DNA, 20 bp, Artificial Sequence
  Description of Artificial Sequence: Synthetic oligonucleotide
  Target: SCN9A; (-) strand; PAM type: NRG; PAM sequence: AGG
gagaatcacttgaatccagg

SEQ ID NO: 35058 - DNA, 20 bp, Artificial Sequence
  Description of Artificial Sequence: Synthetic oligonucleotide
  Target: SCN9A; (-) strand; PAM type: NRG; PAM sequence: GAG
ggagaatcacttgaatccag

SEQ ID NO: 35059 - DNA, 20 bp, Artificial Sequence
  Description of Artificial Sequence: Synthetic oligonucleotide
  Target: SCN9A; (-) strand; PAM type: NRG; PAM sequence: AGG
caggagaatcacttgaatcc

SEQ ID NO: 35060 - DNA, 20 bp, Artificial Sequence
  Description of Artificial Sequence: Synthetic oligonucleotide
  Target: SCN9A; (-) strand; PAM type: NRG; PAM sequence: CAG
gcaggagaatcacttgaatc

SEQ ID NO: 35061 - DNA, 20 bp, Artificial Sequence
  Description of Artificial Sequence: Synthetic oligonucleotide
  Target: SCN9A; (-) strand; PAM type: NRG; PAM sequence: GAG
tactcaggaggctgaggcag

SEQ ID NO: 35062 - DNA, 20 bp, Artificial Sequence
  Description of Artificial Sequence: Synthetic oligonucleotide
  Target: SCN9A; (-) strand; PAM type: NRG; PAM sequence: AGG
gctactcaggaggctgaggc

SEQ ID NO: 35063 - DNA, 20 bp, Artificial Sequence
  Description of Artificial Sequence: Synthetic oligonucleotide
  Target: SCN9A; (-) strand; PAM type: NRG; PAM sequence: CAG
agctactcaggaggctgagg

SEQ ID NO: 35064 - DNA, 20 bp, Artificial Sequence
  Description of Artificial Sequence: Synthetic oligonucleotide
  Target: SCN9A; (-) strand; PAM type: NRG; PAM sequence: AGG
cccagctactcaggaggctg

SEQ ID NO: 35065 - DNA, 20 bp, Artificial Sequence
  Description of Artificial Sequence: Synthetic oligonucleotide
  Target: SCN9A; (-) strand; PAM type: NRG; PAM sequence: GAG
tcccagctactcaggaggct

SEQ ID NO: 35066 - DNA, 20 bp, Artificial Sequence
  Description of Artificial Sequence: Synthetic oligonucleotide
  Target: SCN9A; (-) strand; PAM type: NRG; PAM sequence: AGG
tatagtcccagctactcagg

SEQ ID NO: 35067 - DNA, 20 bp, Artificial Sequence
  Description of Artificial Sequence: Synthetic oligonucleotide
  Target: SCN9A; (-) strand; PAM type: NRG; PAM sequence: GAG
ctatagtcccagctactcag

SEQ ID NO: 35068 - DNA, 20 bp, Artificial Sequence
  Description of Artificial Sequence: Synthetic oligonucleotide
  Target: SCN9A; (-) strand; PAM type: NRG; PAM sequence: AGG
acctatagtcccagctactc

SEQ ID NO: 35069 - DNA, 20 bp, Artificial Sequence
  Description of Artificial Sequence: Synthetic oligonucleotide
  Target: SCN9A; (-) strand; PAM type: NRG; PAM sequence: CAG
cacctatagtcccagctact

SEQ ID NO: 35070 - DNA, 20 bp, Artificial Sequence
  Description of Artificial Sequence: Synthetic oligonucleotide
  Target: SCN9A; (-) strand; PAM type: NRG; PAM sequence: CAG
gtggcaggcacctatagtcc

SEQ ID NO: 35071 - DNA, 20 bp, Artificial Sequence
  Description of Artificial Sequence: Synthetic oligonucleotide
  Target: SCN9A; (-) strand; PAM type: NRG; PAM sequence: TAG
ggcgtggtggcaggcaccta

SEQ ID NO: 35072 - DNA, 20 bp, Artificial Sequence
  Description of Artificial Sequence: Synthetic oligonucleotide
  Target: SCN9A; (-) strand; PAM type: NRG; PAM sequence: AGG
aattagctgggcgtggtggc

SEQ ID NO: 35073 - DNA, 20 bp, Artificial Sequence
  Description of Artificial Sequence: Synthetic oligonucleotide
  Target: SCN9A; (-) strand; PAM type: NRG; PAM sequence: CAG
aaattagctgggcgtggtgg

SEQ ID NO: 35074 - DNA, 20 bp, Artificial Sequence
  Description of Artificial Sequence: Synthetic oligonucleotide
  Target: SCN9A; (-) strand; PAM type: NRG; PAM sequence: TGG
caaaaattagctgggcgtgg

SEQ ID NO: 35075 - DNA, 20 bp, Artificial Sequence
  Description of Artificial Sequence: Synthetic oligonucleotide
  Target: SCN9A; (-) strand; PAM type: NRG; PAM sequence: TGG
atacaaaaattagctgggcg

SEQ ID NO: 35076 - DNA, 20 bp, Artificial Sequence
  Description of Artificial Sequence: Synthetic oligonucleotide
  Target: SCN9A; (-) strand; PAM type: NRG; PAM sequence: GGG
taaaaatacaaaaattagct

SEQ ID NO: 35077 - DNA, 20 bp, Artificial Sequence
  Description of Artificial Sequence: Synthetic oligonucleotide
  Target: SCN9A; (-) strand; PAM type: NRG; PAM sequence: TGG
ctaaaaatacaaaaattagc

SEQ ID NO: 35078 - DNA, 20 bp, Artificial Sequence
  Description of Artificial Sequence: Synthetic oligonucleotide
  Target: SCN9A; (-) strand; PAM type: NRG; PAM sequence: TAG
gctactaaaaatacaaaaat

SEQ ID NO: 35079 - DNA, 20 bp, Artificial Sequence
  Description of Artificial Sequence: Synthetic oligonucleotide
  Target: SCN9A; (-) strand; PAM type: NRG; PAM sequence: TGG
caagaccatcctggccaaca

SEQ ID NO: 35080 - DNA, 20 bp, Artificial Sequence
  Description of Artificial Sequence: Synthetic oligonucleotide
  Target: SCN9A; (-) strand; PAM type: NRG; PAM sequence: TGG
tcaagagatcaagaccatcc

SEQ ID NO: 35081 - DNA, 20 bp, Artificial Sequence
  Description of Artificial Sequence: Synthetic oligonucleotide
  Target: SCN9A; (-) strand; PAM type: NRG; PAM sequence: AAG
gatcacaaggtcaagagatc

SEQ ID NO: 35082 - DNA, 20 bp, Artificial Sequence
  Description of Artificial Sequence: Synthetic oligonucleotide
  Target: SCN9A; (-) strand; PAM type: NRG; PAM sequence: GAG
cgggcagatcacaaggtcaa

SEQ ID NO: 35083 - DNA, 20 bp, Artificial Sequence
  Description of Artificial Sequence: Synthetic oligonucleotide
  Target: SCN9A; (-) strand; PAM type: NRG; PAM sequence: AAG
ggcgggcagatcacaaggtc

SEQ ID NO: 35084 - DNA, 20 bp, Artificial Sequence
  Description of Artificial Sequence: Synthetic oligonucleotide
  Target: SCN9A; (-) strand; PAM type: NRG; PAM sequence: AGG
gccaaggcgggcagatcaca

SEQ ID NO: 35085 - DNA, 20 bp, Artificial Sequence
  Description of Artificial Sequence: Synthetic oligonucleotide
  Target: SCN9A; (-) strand; PAM type: NRG; PAM sequence: AAG
ggccaaggcgggcagatcac

SEQ ID NO: 35086 - DNA, 20 bp, Artificial Sequence
  Description of Artificial Sequence: Synthetic oligonucleotide
  Target: SCN9A; (-) strand; PAM type: NRG; PAM sequence: CAG
ttttgggaggccaaggcggg

SEQ ID NO: 35087 - DNA, 20 bp, Artificial Sequence
  Description of Artificial Sequence: Synthetic oligonucleotide
  Target: SCN9A; (-) strand; PAM type: NRG; PAM sequence: GGG
gcattttgggaggccaaggc

SEQ ID NO: 35088 - DNA, 20 bp, Artificial Sequence
  Description of Artificial Sequence: Synthetic oligonucleotide
  Target: SCN9A; (-) strand; PAM type: NRG; PAM sequence: CGG
agcattttgggaggccaagg

SEQ ID NO: 35089 - DNA, 20 bp, Artificial Sequence
  Description of Artificial Sequence: Synthetic oligonucleotide
  Target: SCN9A; (-) strand; PAM type: NRG; PAM sequence: AGG
cccagcattttgggaggcca

SEQ ID NO: 35090 - DNA, 20 bp, Artificial Sequence
  Description of Artificial Sequence: Synthetic oligonucleotide
  Target: SCN9A; (-) strand; PAM type: NRG; PAM sequence: AAG
tcccagcattttgggaggcc

SEQ ID NO: 35091 - DNA, 20 bp, Artificial Sequence
  Description of Artificial Sequence: Synthetic oligonucleotide
  Target: SCN9A; (-) strand; PAM type: NRG; PAM sequence: AGG
tgtaatcccagcattttggg

SEQ ID NO: 35092 - DNA, 20 bp, Artificial Sequence
  Description of Artificial Sequence: Synthetic oligonucleotide
  Target: SCN9A; (-) strand; PAM type: NRG; PAM sequence: GAG
ctgtaatcccagcattttgg

SEQ ID NO: 35093 - DNA, 20 bp, Artificial Sequence
  Description of Artificial Sequence: Synthetic oligonucleotide
  Target: SCN9A; (-) strand; PAM type: NRG; PAM sequence: GGG
gcctgtaatcccagcatttt

SEQ ID NO: 35094 - DNA, 20 bp, Artificial Sequence
  Description of Artificial Sequence: Synthetic oligonucleotide
  Target: SCN9A; (-) strand; PAM type: NRG; PAM sequence: TGG
cgcctgtaatcccagcattt

SEQ ID NO: 35095 - DNA, 20 bp, Artificial Sequence
  Description of Artificial Sequence: Synthetic oligonucleotide
  Target: SCN9A; (-) strand; PAM type: NRG; PAM sequence: CAG
gtggctcacgcctgtaatcc

SEQ ID NO: 35096 - DNA, 20 bp, Artificial Sequence
  Description of Artificial Sequence: Synthetic oligonucleotide
  Target: SCN9A; (-) strand; PAM type: NRG; PAM sequence: TGG
ctcattttggccaggcgcag

SEQ ID NO: 35097 - DNA, 20 bp, Artificial Sequence
  Description of Artificial Sequence: Synthetic oligonucleotide
  Target: SCN9A; (-) strand; PAM type: NRG; PAM sequence: CAG
aacctcattttggccaggcg

SEQ ID NO: 35098 - DNA, 20 bp, Artificial Sequence
  Description of Artificial Sequence: Synthetic oligonucleotide
  Target: SCN9A; (-) strand; PAM type: NRG; PAM sequence: AGG
tgaaaaacctcattttggcc

SEQ ID NO: 35099 - DNA, 20 bp, Artificial Sequence
  Description of Artificial Sequence: Synthetic oligonucleotide
  Target: SCN9A; (-) strand; PAM type: NRG; PAM sequence: CAG
gtgaaaaacctcattttggc

SEQ ID NO: 35100 - DNA, 20 bp, Artificial Sequence
  Description of Artificial Sequence: Synthetic oligonucleotide
  Target: SCN9A; (-) strand; PAM type: NRG; PAM sequence: TGG
ctgtgtgaaaaacctcattt

SEQ ID NO: 35101 - DNA, 20 bp, Artificial Sequence
  Description of Artificial Sequence: Synthetic oligonucleotide
  Target: SCN9A; (-) strand; PAM type: NRG; PAM sequence: GGG
cagcctcagacaagactcca

SEQ ID NO: 35102 - DNA, 20 bp, Artificial Sequence
  Description of Artificial Sequence: Synthetic oligonucleotide
  Target: SCN9A; (-) strand; PAM type: NRG; PAM sequence: AGG
ccagcctcagacaagactcc

SEQ ID NO: 35103 - DNA, 20 bp, Artificial Sequence
  Description of Artificial Sequence: Synthetic oligonucleotide
  Target: SCN9A; (-) strand; PAM type: NRG; PAM sequence: CAG
cccagcctcagacaagactc

SEQ ID NO: 35104 - DNA, 20 bp, Artificial Sequence
  Description of Artificial Sequence: Synthetic oligonucleotide
  Target: SCN9A; (-) strand; PAM type: NRG; PAM sequence: AAG
agcctcacccagcctcagac

SEQ ID NO: 35105 - DNA, 20 bp, Artificial Sequence
  Description of Artificial Sequence: Synthetic oligonucleotide
  Target: SCN9A; (-) strand; PAM type: NRG; PAM sequence: CAG
gaagcagcctcacccagcct

SEQ ID NO: 35106 - DNA, 20 bp, Artificial Sequence
  Description of Artificial Sequence: Synthetic oligonucleotide
  Target: SCN9A; (-) strand; PAM type: NRG; PAM sequence: CAG
ggtaaagaagcagcctcacc

SEQ ID NO: 35107 - DNA, 20 bp, Artificial Sequence
  Description of Artificial Sequence: Synthetic oligonucleotide
  Target: SCN9A; (-) strand; PAM type: NRG; PAM sequence: CAG
ttcagtttgaggtaaagaag

SEQ ID NO: 35108 - DNA, 20 bp, Artificial Sequence
  Description of Artificial Sequence: Synthetic oligonucleotide
  Target: SCN9A; (-) strand; PAM type: NRG; PAM sequence: AAG
tagttcagtttgaggtaaag

SEQ ID NO: 35109 - DNA, 20 bp, Artificial Sequence
  Description of Artificial Sequence: Synthetic oligonucleotide
  Target: SCN9A; (-) strand; PAM type: NRG; PAM sequence: AAG
ggatagttcagtttgaggta

SEQ ID NO: 35110 - DNA, 20 bp, Artificial Sequence
  Description of Artificial Sequence: Synthetic oligonucleotide
  Target: SCN9A; (-) strand; PAM type: NRG; PAM sequence: AGG
gagcaggatagttcagtttg

SEQ ID NO: 35111 - DNA, 20 bp, Artificial Sequence
  Description of Artificial Sequence: Synthetic oligonucleotide
  Target: SCN9A; (-) strand; PAM type: NRG; PAM sequence: GAG
tgagcaggatagttcagttt

SEQ ID NO: 35112 - DNA, 20 bp, Artificial Sequence
  Description of Artificial Sequence: Synthetic oligonucleotide
  Target: SCN9A; (-) strand; PAM type: NRG; PAM sequence: CAG
agaggctgagcaggatagtt

SEQ ID NO: 35113 - DNA, 20 bp, Artificial Sequence
  Description of Artificial Sequence: Synthetic oligonucleotide
  Target: SCN9A; (-) strand; PAM type: NRG; PAM sequence: TAG
gaggcagaggctgagcagga

SEQ ID NO: 35114 - DNA, 20 bp, Artificial Sequence
  Description of Artificial Sequence: Synthetic oligonucleotide
  Target: SCN9A; (-) strand; PAM type: NRG; PAM sequence: AGG
aaaagaggcagaggctgagc

SEQ ID NO: 35115 - DNA, 20 bp, Artificial Sequence
  Description of Artificial Sequence: Synthetic oligonucleotide
  Target: SCN9A; (-) strand; PAM type: NRG; PAM sequence: CAG
gaaaagaggcagaggctgag

SEQ ID NO: 35116 - DNA, 20 bp, Artificial Sequence
  Description of Artificial Sequence: Synthetic oligonucleotide
  Target: SCN9A; (-) strand; PAM type: NRG; PAM sequence: GAG
aaagaaaagaggcagaggct

SEQ ID NO: 35117 - DNA, 20 bp, Artificial Sequence
  Description of Artificial Sequence: Synthetic oligonucleotide
  Target: SCN9A; (-) strand; PAM type: NRG; PAM sequence: AGG
tgagaaaagaaaagaggcag

SEQ ID NO: 35118 - DNA, 20 bp, Artificial Sequence
  Description of Artificial Sequence: Synthetic oligonucleotide
  Target: SCN9A; (-) strand; PAM type: NRG; PAM sequence: GAG
ctgagaaaagaaaagaggca

SEQ ID NO: 35119 - DNA, 20 bp, Artificial Sequence
  Description of Artificial Sequence: Synthetic oligonucleotide
  Target: SCN9A; (-) strand; PAM type: NRG; PAM sequence: CAG
cactgagaaaagaaaagagg

SEQ ID NO: 35120 - DNA, 20 bp, Artificial Sequence
  Description of Artificial Sequence: Synthetic oligonucleotide
  Target: SCN9A; (-) strand; PAM type: NRG; PAM sequence: AGG
aaacactgagaaaagaaaag

SEQ ID NO: 35121 - DNA, 20 bp, Artificial Sequence
  Description of Artificial Sequence: Synthetic oligonucleotide
  Target: SCN9A; (-) strand; PAM type: NRG; PAM sequence: GAG
caaacactgagaaaagaaaa

SEQ ID NO: 35122 - DNA, 20 bp, Artificial Sequence
  Description of Artificial Sequence: Synthetic oligonucleotide
  Target: SCN9A; (-) strand; PAM type: NRG; PAM sequence: AAG
cccaaacactgagaaaagaa

SEQ ID NO: 35123 - DNA, 20 bp, Artificial Sequence
  Description of Artificial Sequence: Synthetic oligonucleotide
  Target: SCN9A; (-) strand; PAM type: NRG; PAM sequence: AAG
gatgacccaaacactgagaa

SEQ ID NO: 35124 - DNA, 20 bp, Artificial Sequence
  Description of Artificial Sequence: Synthetic oligonucleotide
  Target: SCN9A; (-) strand; PAM type: NRG; PAM sequence: GAG
aggtggatgacccaaacact

SEQ ID NO: 35125 - DNA, 20 bp, Artificial Sequence
  Description of Artificial Sequence: Synthetic oligonucleotide
  Target: SCN9A; (-) strand; PAM type: NRG; PAM sequence: TGG
gtacagtagctctgaggagg

SEQ ID NO: 35126 - DNA, 20 bp, Artificial Sequence
  Description of Artificial Sequence: Synthetic oligonucleotide
  Target: SCN9A; (-) strand; PAM type: NRG; PAM sequence: AGG
gttgtacagtagctctgagg

SEQ ID NO: 35127 - DNA, 20 bp, Artificial Sequence
  Description of Artificial Sequence: Synthetic oligonucleotide
  Target: SCN9A; (-) strand; PAM type: NRG; PAM sequence: GAG
tgttgtacagtagctctgag

SEQ ID NO: 35128 - DNA, 20 bp, Artificial Sequence
  Description of Artificial Sequence: Synthetic oligonucleotide
  Target: SCN9A; (-) strand; PAM type: NRG; PAM sequence: AGG
aatgttgtacagtagctctg

SEQ ID NO: 35129 - DNA, 20 bp, Artificial Sequence
  Description of Artificial Sequence: Synthetic oligonucleotide
  Target: SCN9A; (-) strand; PAM type: NRG; PAM sequence: GAG
aaatgttgtacagtagctct

SEQ ID NO: 35130 - DNA, 20 bp, Artificial Sequence
  Description of Artificial Sequence: Synthetic oligonucleotide
  Target: SCN9A; (-) strand; PAM type: NRG; PAM sequence: TAG
aataaaaaaatgttgtacag

SEQ ID NO: 35131 - DNA, 20 bp, Artificial Sequence
  Description of Artificial Sequence: Synthetic oligonucleotide
  Target: SCN9A; (-) strand; PAM type: NRG; PAM sequence: CAG
ctaaataaaaaaatgttgta

SEQ ID NO: 35132 - DNA, 20 bp, Artificial Sequence
  Description of Artificial Sequence: Synthetic oligonucleotide
  Target: SCN9A; (-) strand; PAM type: NRG; PAM sequence: AAG
gaatagagtcatctgcatta

SEQ ID NO: 35133 - DNA, 20 bp, Artificial Sequence
  Description of Artificial Sequence: Synthetic oligonucleotide
  Target: SCN9A; (-) strand; PAM type: NRG; PAM sequence: GAG
tataaggtttatttagaata

SEQ ID NO: 35134 - DNA, 20 bp, Artificial Sequence
  Description of Artificial Sequence: Synthetic oligonucleotide
  Target: SCN9A; (-) strand; PAM type: NRG; PAM sequence: TAG
aatataaggtttatttagaa

SEQ ID NO: 35135 - DNA, 20 bp, Artificial Sequence
  Description of Artificial Sequence: Synthetic oligonucleotide
  Target: SCN9A; (-) strand; PAM type: NRG; PAM sequence: TAG
gtattaatataaggtttatt

SEQ ID NO: 35136 - DNA, 20 bp, Artificial Sequence
  Description of Artificial Sequence: Synthetic oligonucleotide
  Target: SCN9A; (-) strand; PAM type: NRG; PAM sequence: AGG
aaatgtagagtattaatata

SEQ ID NO: 35137 - DNA, 20 bp, Artificial Sequence
  Description of Artificial Sequence: Synthetic oligonucleotide
  Target: SCN9A; (-) strand; PAM type: NRG; PAM sequence: AAG
aaaatgtagagtattaatat

SEQ ID NO: 35138 - DNA, 20 bp, Artificial Sequence
  Description of Artificial Sequence: Synthetic oligonucleotide
  Target: SCN9A; (-) strand; PAM type: NRG; PAM sequence: GAG
attatgtgtgtaaaaatgta

SEQ ID NO: 35139 - DNA, 20 bp, Artificial Sequence
  Description of Artificial Sequence: Synthetic oligonucleotide
  Target: SCN9A; (-) strand; PAM type: NRG; PAM sequence: TAG
ccattatgtgtgtaaaaatg

SEQ ID NO: 35140 - DNA, 20 bp, Artificial Sequence
  Description of Artificial Sequence: Synthetic oligonucleotide
  Target: SCN9A; (-) strand; PAM type: NRG; PAM sequence: TGG
tagttcctctaaaatatgtc

SEQ ID NO: 35141 - DNA, 20 bp, Artificial Sequence
  Description of Artificial Sequence: Synthetic oligonucleotide
  Target: SCN9A; (-) strand; PAM type: NRG; PAM sequence: TAG
ttaggatgataatcaaataa

SEQ ID NO: 35142 - DNA, 20 bp, Artificial Sequence
  Description of Artificial Sequence: Synthetic oligonucleotide
  Target: SCN9A; (-) strand; PAM type: NRG; PAM sequence: AGG
tactaactgctctgatgctt

SEQ ID NO: 35143 - DNA, 20 bp, Artificial Sequence
  Description of Artificial Sequence: Synthetic oligonucleotide
  Target: SCN9A; (-) strand; PAM type: NRG; PAM sequence: TAG
ttactaactgctctgatgct

SEQ ID NO: 35144 - DNA, 20 bp, Artificial Sequence
  Description of Artificial Sequence: Synthetic oligonucleotide
  Target: SCN9A; (-) strand; PAM type: NRG; PAM sequence: GAG
ttaaaaatgttctgttcttg

SEQ ID NO: 35145 - DNA, 20 bp, Artificial Sequence
  Description of Artificial Sequence: Synthetic oligonucleotide
  Target: SCN9A; (-) strand; PAM type: NRG; PAM sequence: TGG
acttaaaaatgttctgttct

SEQ ID NO: 35146 - DNA, 20 bp, Artificial Sequence
  Description of Artificial Sequence: Synthetic oligonucleotide
  Target: SCN9A; (-) strand; PAM type: NRG; PAM sequence: TGG
ggagtcataaacctgcaatt

SEQ ID NO: 35147 - DNA, 20 bp, Artificial Sequence
  Description of Artificial Sequence: Synthetic oligonucleotide
  Target: SCN9A; (-) strand; PAM type: NRG; PAM sequence: GAG
tatttatggggaaaaaatgg

SEQ ID NO: 35148 - DNA, 20 bp, Artificial Sequence
  Description of Artificial Sequence: Synthetic oligonucleotide
  Target: SCN9A; (-) strand; PAM type: NRG; PAM sequence: GGG
gctatttatggggaaaaaat

SEQ ID NO: 35149 - DNA, 20 bp, Artificial Sequence
  Description of Artificial Sequence: Synthetic oligonucleotide
  Target: SCN9A; (-) strand; PAM type: NRG; PAM sequence: TGG
tgctatttatggggaaaaaa

SEQ ID NO: 35150 - DNA, 20 bp, Artificial Sequence
  Description of Artificial Sequence: Synthetic oligonucleotide
  Target: SCN9A; (-) strand; PAM type: NRG; PAM sequence: GGG
atataagaatgctatttatg

SEQ ID NO: 35151 - DNA, 20 bp, Artificial Sequence
  Description of Artificial Sequence: Synthetic oligonucleotide
  Target: SCN9A; (-) strand; PAM type: NRG; PAM sequence: GGG
aatataagaatgctatttat

SEQ ID NO: 35152 - DNA, 20 bp, Artificial Sequence
  Description of Artificial Sequence: Synthetic oligonucleotide
  Target: SCN9A; (-) strand; PAM type: NRG; PAM sequence: TGG
aaatataagaatgctattta

SEQ ID NO: 35153 - DNA, 20 bp, Artificial Sequence
  Description of Artificial Sequence: Synthetic oligonucleotide
  Target: SCN9A; (-) strand; PAM type: NRG; PAM sequence: AAG
tattcttcaaaaataaatat

SEQ ID NO: 35154 - DNA, 20 bp, Artificial Sequence
  Description of Artificial Sequence: Synthetic oligonucleotide
  Target: SCN9A; (-) strand; PAM type: NRG; PAM sequence: TGG
atacatacttttgagttttg

SEQ ID NO: 35155 - DNA, 20 bp, Artificial Sequence
  Description of Artificial Sequence: Synthetic oligonucleotide
  Target: SCN9A; (-) strand; PAM type: NRG; PAM sequence: GAG
ttttcgttatacatactttt

SEQ ID NO: 35156 - DNA, 20 bp, Artificial Sequence
  Description of Artificial Sequence: Synthetic oligonucleotide
  Target: SCN9A; (-) strand; PAM type: NRG; PAM sequence: GAG
tgggaaacattgaagagtga

SEQ ID NO: 35157 - DNA, 20 bp, Artificial Sequence
  Description of Artificial Sequence: Synthetic oligonucleotide
  Target: SCN9A; (-) strand; PAM type: NRG; PAM sequence: GAG
gctgggaaacattgaagagt

SEQ ID NO: 35158 - DNA, 20 bp, Artificial Sequence
  Description of Artificial Sequence: Synthetic oligonucleotide
  Target: SCN9A; (-) strand; PAM type: NRG; PAM sequence: GAG
gatggctgggaaacattgaa

SEQ ID NO: 35159 - DNA, 20 bp, Artificial Sequence
  Description of Artificial Sequence: Synthetic oligonucleotide
  Target: SCN9A; (-) strand; PAM type: NRG; PAM sequence: AAG
tggatggctgggaaacattg

SEQ ID NO: 35160 - DNA, 20 bp, Artificial Sequence
  Description of Artificial Sequence: Synthetic oligonucleotide
  Target: SCN9A; (-) strand; PAM type: NRG; PAM sequence: GGG
ggggaggaatttggatggct

SEQ ID NO: 35161 - DNA, 20 bp, Artificial Sequence
  Description of Artificial Sequence: Synthetic oligonucleotide
  Target: SCN9A; (-) strand; PAM type: NRG; PAM sequence: TGG
aggggaggaatttggatggc

SEQ ID NO: 35162 - DNA, 20 bp, Artificial Sequence
  Description of Artificial Sequence: Synthetic oligonucleotide
  Target: SCN9A; (-) strand; PAM type: NRG; PAM sequence: TGG
ccacaggggaggaatttgga

SEQ ID NO: 35163 - DNA, 20 bp, Artificial Sequence
  Description of Artificial Sequence: Synthetic oligonucleotide
  Target: SCN9A; (-) strand; PAM type: NRG; PAM sequence: TGG
ttgtccacaggggaggaatt

SEQ ID NO: 35164 - DNA, 20 bp, Artificial Sequence
  Description of Artificial Sequence: Synthetic oligonucleotide
  Target: SCN9A; (-) strand; PAM type: NRG; PAM sequence: AGG
actgtggttgtccacagggg

SEQ ID NO: 35165 - DNA, 20 bp, Artificial Sequence
  Description of Artificial Sequence: Synthetic oligonucleotide
  Target: SCN9A; (-) strand; PAM type: NRG; PAM sequence: GAG
tactgtggttgtccacaggg

SEQ ID NO: 35166 - DNA, 20 bp, Artificial Sequence
  Description of Artificial Sequence: Synthetic oligonucleotide
  Target: SCN9A; (-) strand; PAM type: NRG; PAM sequence: GGG
ggtactgtggttgtccacag

SEQ ID NO: 35167 - DNA, 20 bp, Artificial Sequence
  Description of Artificial Sequence: Synthetic oligonucleotide
  Target: SCN9A; (-) strand; PAM type: NRG; PAM sequence: GGG
tggtactgtggttgtccaca

SEQ ID NO: 35168 - DNA, 20 bp, Artificial Sequence
  Description of Artificial Sequence: Synthetic oligonucleotide
  Target: SCN9A; (-) strand; PAM type: NRG; PAM sequence: AGG
ttggtactgtggttgtccac

SEQ ID NO: 35169 - DNA, 20 bp, Artificial Sequence
  Description of Artificial Sequence: Synthetic oligonucleotide
  Target: SCN9A; (-) strand; PAM type: NRG; PAM sequence: CAG
gttggtactgtggttgtcca

SEQ ID NO: 35170 - DNA, 20 bp, Artificial Sequence
  Description of Artificial Sequence: Synthetic oligonucleotide
  Target: SCN9A; (-) strand; PAM type: NRG; PAM sequence: TGG
tacacaaggggttggtactg

SEQ ID NO: 35171 - DNA, 20 bp, Artificial Sequence
  Description of Artificial Sequence: Synthetic oligonucleotide
  Target: SCN9A; (-) strand; PAM type: NRG; PAM sequence: TGG
tggatggatacacaaggggt

SEQ ID NO: 35172 - DNA, 20 bp, Artificial Sequence
  Description of Artificial Sequence: Synthetic oligonucleotide
  Target: SCN9A; (-) strand; PAM type: NRG; PAM sequence: GGG
cacatggatggatacacaag

SEQ ID NO: 35173 - DNA, 20 bp, Artificial Sequence
  Description of Artificial Sequence: Synthetic oligonucleotide
  Target: SCN9A; (-) strand; PAM type: NRG; PAM sequence: GGG
ccacatggatggatacacaa

SEQ ID NO: 35174 - DNA, 20 bp, Artificial Sequence
  Description of Artificial Sequence: Synthetic oligonucleotide
  Target: SCN9A; (-) strand; PAM type: NRG; PAM sequence: AGG
accacatggatggatacaca

SEQ ID NO: 35175 - DNA, 20 bp, Artificial Sequence
  Description of Artificial Sequence: Synthetic oligonucleotide
  Target: SCN9A; (-) strand; PAM type: NRG; PAM sequence: AAG
aaccacatggatggatacac

SEQ ID NO: 35176 - DNA, 20 bp, Artificial Sequence
  Description of Artificial Sequence: Synthetic oligonucleotide
  Target: SCN9A; (-) strand; PAM type: NRG; PAM sequence: TGG
tgctgataaaaccacatgga

SEQ ID NO: 35177 - DNA, 20 bp, Artificial Sequence
  Description of Artificial Sequence: Synthetic oligonucleotide
  Target: SCN9A; (-) strand; PAM type: NRG; PAM sequence: TGG
tacatgctgataaaaccaca

SEQ ID NO: 35178 - DNA, 20 bp, Artificial Sequence
  Description of Artificial Sequence: Synthetic oligonucleotide
  Target: SCN9A; (-) strand; PAM type: NRG; PAM sequence: TAG
tgcatgaaaagaaaaatgaa

SEQ ID NO: 35179 - DNA, 20 bp, Artificial Sequence
  Description of Artificial Sequence: Synthetic oligonucleotide
  Target: SCN9A; (-) strand; PAM type: NRG; PAM sequence: AAG
tagggtattatttgcatgaa

SEQ ID NO: 35180 - DNA, 20 bp, Artificial Sequence
  Description of Artificial Sequence: Synthetic oligonucleotide
  Target: SCN9A; (-) strand; PAM type: NRG; PAM sequence: GGG
tatgaaacaatgtttatata

SEQ ID NO: 35181 - DNA, 20 bp, Artificial Sequence
  Description of Artificial Sequence: Synthetic oligonucleotide
  Target: SCN9A; (-) strand; PAM type: NRG; PAM sequence: AGG
gtatgaaacaatgtttatat

SEQ ID NO: 35182 - DNA, 20 bp, Artificial Sequence
  Description of Artificial Sequence: Synthetic oligonucleotide
  Target: SCN9A; (-) strand; PAM type: NRG; PAM sequence: TAG
ggtatgaaacaatgtttata

SEQ ID NO: 35183 - DNA, 20 bp, Artificial Sequence
  Description of Artificial Sequence: Synthetic oligonucleotide
  Target: SCN9A; (-) strand; PAM type: NRG; PAM sequence: AGG
gatttttaagtgacgaagga

SEQ ID NO: 35184 - DNA, 20 bp, Artificial Sequence
  Description of Artificial Sequence: Synthetic oligonucleotide
  Target: SCN9A; (-) strand; PAM type: NRG; PAM sequence: AAG
tgatttttaagtgacgaagg

SEQ ID NO: 35185 - DNA, 20 bp, Artificial Sequence
  Description of Artificial Sequence: Synthetic oligonucleotide
  Target: SCN9A; (-) strand; PAM type: NRG; PAM sequence: AGG
gtctgatttttaagtgacga

SEQ ID NO: 35186 - DNA, 20 bp, Artificial Sequence
  Description of Artificial Sequence: Synthetic oligonucleotide
  Target: SCN9A; (-) strand; PAM type: NRG; PAM sequence: AAG
agtctgatttttaagtgacg

SEQ ID NO: 35187 - DNA, 20 bp, Artificial Sequence
  Description of Artificial Sequence: Synthetic oligonucleotide
  Target: SCN9A; (-) strand; PAM type: NRG; PAM sequence: AAG
gatttccaagtctgattttt

SEQ ID NO: 35188 - DNA, 20 bp, Artificial Sequence
  Description of Artificial Sequence: Synthetic oligonucleotide
  Target: SCN9A; (-) strand; PAM type: NRG; PAM sequence: AAG
gctgatacagaaagatttcc

SEQ ID NO: 35189 - DNA, 20 bp, Artificial Sequence
  Description of Artificial Sequence: Synthetic oligonucleotide
  Target: SCN9A; (-) strand; PAM type: NRG; PAM sequence: AAG
tttatacatgctgatacaga

SEQ ID NO: 35190 - DNA, 20 bp, Artificial Sequence
  Description of Artificial Sequence: Synthetic oligonucleotide
  Target: SCN9A; (-) strand; PAM type: NRG; PAM sequence: CAG
tagctttatacatgctgata

SEQ ID NO: 35191 - DNA, 20 bp, Artificial Sequence
  Description of Artificial Sequence: Synthetic oligonucleotide
  Target: SCN9A; (-) strand; PAM type: NRG; PAM sequence: TAG
gaagctgctataaaaagaag

SEQ ID NO: 35192 - DNA, 20 bp, Artificial Sequence
  Description of Artificial Sequence: Synthetic oligonucleotide
  Target: SCN9A; (-) strand; PAM type: NRG; PAM sequence: AAG
tatgaagctgctataaaaag

SEQ ID NO: 35193 - DNA, 20 bp, Artificial Sequence
  Description of Artificial Sequence: Synthetic oligonucleotide
  Target: SCN9A; (-) strand; PAM type: NRG; PAM sequence: AAG
ctttatgaagctgctataaa

SEQ ID NO: 35194 - DNA, 20 bp, Artificial Sequence
  Description of Artificial Sequence: Synthetic oligonucleotide
  Target: SCN9A; (-) strand; PAM type: NRG; PAM sequence: AAG
ctgtacaataggactttatg

SEQ ID NO: 35195 - DNA, 20 bp, Artificial Sequence
  Description of Artificial Sequence: Synthetic oligonucleotide
  Target: SCN9A; (-) strand; PAM type: NRG; PAM sequence: AGG
tttgggtacagctgtacaat

SEQ ID NO: 35196 - DNA, 20 bp, Artificial Sequence
  Description of Artificial Sequence: Synthetic oligonucleotide
  Target: SCN9A; (-) strand; PAM type: NRG; PAM sequence: TAG
atttgggtacagctgtacaa

SEQ ID NO: 35197 - DNA, 20 bp, Artificial Sequence
  Description of Artificial Sequence: Synthetic oligonucleotide
  Target: SCN9A; (-) strand; PAM type: NRG; PAM sequence: CAG
atgactaaataatttgggta

SEQ ID NO: 35198 - DNA, 20 bp, Artificial Sequence
  Description of Artificial Sequence: Synthetic oligonucleotide
  Target: SCN9A; (-) strand; PAM type: NRG; PAM sequence: GGG
tgggaatgactaaataattt

SEQ ID NO: 35199 - DNA, 20 bp, Artificial Sequence
  Description of Artificial Sequence: Synthetic oligonucleotide
  Target: SCN9A; (-) strand; PAM type: NRG; PAM sequence: TGG
gtgggaatgactaaataatt

SEQ ID NO: 35200 - DNA, 20 bp, Artificial Sequence
  Description of Artificial Sequence: Synthetic oligonucleotide
  Target: SCN9A; (-) strand; PAM type: NRG; PAM sequence: GGG
acctaaatgttctacagtgt

SEQ ID NO: 35201 - DNA, 20 bp, Artificial Sequence
  Description of Artificial Sequence: Synthetic oligonucleotide
  Target: SCN9A; (-) strand; PAM type: NRG; PAM sequence: TGG
aacctaaatgttctacagtg

SEQ ID NO: 35202 - DNA, 20 bp, Artificial Sequence
  Description of Artificial Sequence: Synthetic oligonucleotide
  Target: SCN9A; (-) strand; PAM type: NRG; PAM sequence: CAG
gaaacaacctaaatgttcta

SEQ ID NO: 35203 - DNA, 20 bp, Artificial Sequence
  Description of Artificial Sequence: Synthetic oligonucleotide
  Target: SCN9A; (-) strand; PAM type: NRG; PAM sequence: GGG
aagataattattgtagcttt

SEQ ID NO: 35204 - DNA, 20 bp, Artificial Sequence
  Description of Artificial Sequence: Synthetic oligonucleotide
  Target: SCN9A; (-) strand; PAM type: NRG; PAM sequence: TGG
gaagataattattgtagctt

SEQ ID NO: 35205 - DNA, 20 bp, Artificial Sequence
  Description of Artificial Sequence: Synthetic oligonucleotide
  Target: SCN9A; (-) strand; PAM type: NRG; PAM sequence: TAG
taatgagaagataattattg

SEQ ID NO: 35206 - DNA, 20 bp, Artificial Sequence
  Description of Artificial Sequence: Synthetic oligonucleotide
  Target: SCN9A; (-) strand; PAM type: NRG; PAM sequence: AAG
aaaagaaaaaaactaatgag

SEQ ID NO: 35207 - DNA, 20 bp, Artificial Sequence
  Description of Artificial Sequence: Synthetic oligonucleotide
  Target: SCN9A; (-) strand; PAM type: NRG; PAM sequence: GAG
aaaaaaagaaaaaaactaat

SEQ ID NO: 35208 - DNA, 20 bp, Artificial Sequence
  Description of Artificial Sequence: Synthetic oligonucleotide
  Target: SCN9A; (-) strand; PAM type: NRG; PAM sequence: AAG
acaaaagagtaggttaaaaa

SEQ ID NO: 35209 - DNA, 20 bp, Artificial Sequence
  Description of Artificial Sequence: Synthetic oligonucleotide
  Target: SCN9A; (-) strand; PAM type: NRG; PAM sequence: AGG
aaaagagcccacaaaagagt

SEQ ID NO: 35210 - DNA, 20 bp, Artificial Sequence
  Description of Artificial Sequence: Synthetic oligonucleotide
  Target: SCN9A; (-) strand; PAM type: NRG; PAM sequence: TAG
aaaaagagcccacaaaagag

SEQ ID NO: 35211 - DNA, 20 bp, Artificial Sequence
  Description of Artificial Sequence: Synthetic oligonucleotide
  Target: SCN9A; (-) strand; PAM type: NRG; PAM sequence: GAG
tacaaaaagagcccacaaaa

SEQ ID NO: 35212 - DNA, 20 bp, Artificial Sequence
  Description of Artificial Sequence: Synthetic oligonucleotide
  Target: SCN9A; (-) strand; PAM type: NRG; PAM sequence: AAG
gttacaaaaagagcccacaa

SEQ ID NO: 35213 - DNA, 20 bp, Artificial Sequence
  Description of Artificial Sequence: Synthetic oligonucleotide
  Target: SCN9A; (-) strand; PAM type: NRG; PAM sequence: GAG
taaaataaaagttacaaaaa

SEQ ID NO: 35214 - DNA, 20 bp, Artificial Sequence
  Description of Artificial Sequence: Synthetic oligonucleotide
  Target: SCN9A; (-) strand; PAM type: NRG; PAM sequence: AAG
cttaaaataaaagttacaaa

SEQ ID NO: 35215 - DNA, 20 bp, Artificial Sequence
  Description of Artificial Sequence: Synthetic oligonucleotide
  Target: SCN9A; (-) strand; PAM type: NRG; PAM sequence: AAG
tacccctgaacttaaaataa

SEQ ID NO: 35216 - DNA, 20 bp, Artificial Sequence
  Description of Artificial Sequence: Synthetic oligonucleotide
  Target: SCN9A; (-) strand; PAM type: NRG; PAM sequence: AAG
agaacaaaaccctgtaacac

SEQ ID NO: 35217 - DNA, 20 bp, Artificial Sequence
  Description of Artificial Sequence: Synthetic oligonucleotide
  Target: SCN9A; (-) strand; PAM type: NRG; PAM sequence: TAG
cttggtgatgaaataagatg

SEQ ID NO: 35218 - DNA, 20 bp, Artificial Sequence
  Description of Artificial Sequence: Synthetic oligonucleotide
  Target: SCN9A; (-) strand; PAM type: NRG; PAM sequence: AAG
taagaccttggtgatgaaat

SEQ ID NO: 35219 - DNA, 20 bp, Artificial Sequence
  Description of Artificial Sequence: Synthetic oligonucleotide
  Target: SCN9A; (-) strand; PAM type: NRG; PAM sequence: TGG
aagtacttggcttaagacct

SEQ ID NO: 35220 - DNA, 20 bp, Artificial Sequence
  Description of Artificial Sequence: Synthetic oligonucleotide
  Target: SCN9A; (-) strand; PAM type: NRG; PAM sequence: AAG
aactaataagtacttggctt

SEQ ID NO: 35221 - DNA, 20 bp, Artificial Sequence
  Description of Artificial Sequence: Synthetic oligonucleotide
  Target: SCN9A; (-) strand; PAM type: NRG; PAM sequence: TGG
aaaaataactaataagtact

SEQ ID NO: 35222 - DNA, 20 bp, Artificial Sequence
  Description of Artificial Sequence: Synthetic oligonucleotide
  Target: SCN9A; (-) strand; PAM type: NRG; PAM sequence: AAG
gatcaggaaaaataactaat

SEQ ID NO: 35223 - DNA, 20 bp, Artificial Sequence
  Description of Artificial Sequence: Synthetic oligonucleotide
  Target: SCN9A; (-) strand; PAM type: NRG; PAM sequence: AGG
gtggcaggagggaggggatc

SEQ ID NO: 35224 - DNA, 20 bp, Artificial Sequence
  Description of Artificial Sequence: Synthetic oligonucleotide
  Target: SCN9A; (-) strand; PAM type: NRG; PAM sequence: CAG
ggtggcaggagggaggggat

SEQ ID NO: 35225 - DNA, 20 bp, Artificial Sequence
  Description of Artificial Sequence: Synthetic oligonucleotide
  Target: SCN9A; (-) strand; PAM type: NRG; PAM sequence: GGG
tggagggtggcaggagggag

SEQ ID NO: 35226 - DNA, 20 bp, Artificial Sequence
  Description of Artificial Sequence: Synthetic oligonucleotide
  Target: SCN9A; (-) strand; PAM type: NRG; PAM sequence: GGG
gtggagggtggcaggaggga

SEQ ID NO: 35227 - DNA, 20 bp, Artificial Sequence
  Description of Artificial Sequence: Synthetic oligonucleotide
  Target: SCN9A; (-) strand; PAM type: NRG; PAM sequence: AGG
ggtggagggtggcaggaggg

SEQ ID NO: 35228 - DNA, 20 bp, Artificial Sequence
  Description of Artificial Sequence: Synthetic oligonucleotide
  Target: SCN9A; (-) strand; PAM type: NRG; PAM sequence: GAG
gggtggagggtggcaggagg

SEQ ID NO: 35229 - DNA, 20 bp, Artificial Sequence
  Description of Artificial Sequence: Synthetic oligonucleotide
  Target: SCN9A; (-) strand; PAM type: NRG; PAM sequence: GGG
gagggtggagggtggcagga

SEQ ID NO: 35230 - DNA, 20 bp, Artificial Sequence
  Description of Artificial Sequence: Synthetic oligonucleotide
  Target: SCN9A; (-) strand; PAM type: NRG; PAM sequence: AGG
ggagggtggagggtggcagg

SEQ ID NO: 35231 - DNA, 20 bp, Artificial Sequence
  Description of Artificial Sequence: Synthetic oligonucleotide
  Target: SCN9A; (-) strand; PAM type: NRG; PAM sequence: GAG
tggagggtggagggtggcag

SEQ ID NO: 35232 - DNA, 20 bp, Artificial Sequence
  Description of Artificial Sequence: Synthetic oligonucleotide
  Target: SCN9A; (-) strand; PAM type: NRG; PAM sequence: AGG
attggagggtggagggtggc

SEQ ID NO: 35233 - DNA, 20 bp, Artificial Sequence
  Description of Artificial Sequence: Synthetic oligonucleotide
  Target: SCN9A; (-) strand; PAM type: NRG; PAM sequence: CAG
cattggagggtggagggtgg

SEQ ID NO: 35234 - DNA, 20 bp, Artificial Sequence
  Description of Artificial Sequence: Synthetic oligonucleotide
  Target: SCN9A; (-) strand; PAM type: NRG; PAM sequence: TGG
gcccattggagggtggaggg

SEQ ID NO: 35235 - DNA, 20 bp, Artificial Sequence
  Description of Artificial Sequence: Synthetic oligonucleotide
  Target: SCN9A; (-) strand; PAM type: NRG; PAM sequence: GGG
ggggcccattggagggtgga

SEQ ID NO: 35236 - DNA, 20 bp, Artificial Sequence
  Description of Artificial Sequence: Synthetic oligonucleotide
  Target: SCN9A; (-) strand; PAM type: NRG; PAM sequence: AGG
tggggcccattggagggtgg

SEQ ID NO: 35237 - DNA, 20 bp, Artificial Sequence
  Description of Artificial Sequence: Synthetic oligonucleotide
  Target: SCN9A; (-) strand; PAM type: NRG; PAM sequence: GAG
ctggggcccattggagggtg

SEQ ID NO: 35238 - DNA, 20 bp, Artificial Sequence
  Description of Artificial Sequence: Synthetic oligonucleotide
  Target: SCN9A; (-) strand; PAM type: NRG; PAM sequence: TGG
cactggggcccattggaggg

SEQ ID NO: 35239 - DNA, 20 bp, Artificial Sequence
  Description of Artificial Sequence: Synthetic oligonucleotide
  Target: SCN9A; (-) strand; PAM type: NRG; PAM sequence: GGG
acacactggggcccattgga

SEQ ID NO: 35240 - DNA, 20 bp, Artificial Sequence
  Description of Artificial Sequence: Synthetic oligonucleotide
  Target: SCN9A; (-) strand; PAM type: NRG; PAM sequence: AGG
cacacactggggcccattgg

SEQ ID NO: 35241 - DNA, 20 bp, Artificial Sequence
  Description of Artificial Sequence: Synthetic oligonucleotide
  Target: SCN9A; (-) strand; PAM type: NRG; PAM sequence: GAG
acacacactggggcccattg

SEQ ID NO: 35242 - DNA, 20 bp, Artificial Sequence
  Description of Artificial Sequence: Synthetic oligonucleotide
  Target: SCN9A; (-) strand; PAM type: NRG; PAM sequence: TGG
caacacacactggggcccat

SEQ ID NO: 35243 - DNA, 20 bp, Artificial Sequence
  Description of Artificial Sequence: Synthetic oligonucleotide
  Target: SCN9A; (-) strand; PAM type: NRG; PAM sequence: GGG
ggtgggaacaacacacactg

SEQ ID NO: 35244 - DNA, 20 bp, Artificial Sequence
  Description of Artificial Sequence: Synthetic oligonucleotide
  Target: SCN9A; (-) strand; PAM type: NRG; PAM sequence: GGG
aggtgggaacaacacacact

SEQ ID NO: 35245 - DNA, 20 bp, Artificial Sequence
  Description of Artificial Sequence: Synthetic oligonucleotide
  Target: SCN9A; (-) strand; PAM type: NRG; PAM sequence: TGG
taggtgggaacaacacacac

SEQ ID NO: 35246 - DNA, 20 bp, Artificial Sequence
  Description of Artificial Sequence: Synthetic oligonucleotide
  Target: SCN9A; (-) strand; PAM type: NRG; PAM sequence: GGG
gaacacatggacacataggt

SEQ ID NO: 35247 - DNA, 20 bp, Artificial Sequence
  Description of Artificial Sequence: Synthetic oligonucleotide
  Target: SCN9A; (-) strand; PAM type: NRG; PAM sequence: TGG
agaacacatggacacatagg

SEQ ID NO: 35248 - DNA, 20 bp, Artificial Sequence
  Description of Artificial Sequence: Synthetic oligonucleotide
  Target: SCN9A; (-) strand; PAM type: NRG; PAM sequence: AGG
atgagaacacatggacacat

SEQ ID NO: 35249 - DNA, 20 bp, Artificial Sequence
  Description of Artificial Sequence: Synthetic oligonucleotide
  Target: SCN9A; (-) strand; PAM type: NRG; PAM sequence: TAG
gatgagaacacatggacaca

SEQ ID NO: 35250 - DNA, 20 bp, Artificial Sequence
  Description of Artificial Sequence: Synthetic oligonucleotide
  Target: SCN9A; (-) strand; PAM type: NRG; PAM sequence: TGG
agctaaatgatgagaacaca

SEQ ID NO: 35251 - DNA, 20 bp, Artificial Sequence
  Description of Artificial Sequence: Synthetic oligonucleotide
  Target: SCN9A; (-) strand; PAM type: NRG; PAM sequence: GAG
ataagtgagagctaaatgat

SEQ ID NO: 35252 - DNA, 20 bp, Artificial Sequence
  Description of Artificial Sequence: Synthetic oligonucleotide
  Target: SCN9A; (-) strand; PAM type: NRG; PAM sequence: GAG
atgtcctcacttataagtga

SEQ ID NO: 35253 - DNA, 20 bp, Artificial Sequence
  Description of Artificial Sequence: Synthetic oligonucleotide
  Target: SCN9A; (-) strand; PAM type: NRG; PAM sequence: GAG
gaatgtcctcacttataagt

SEQ ID NO: 35254 - DNA, 20 bp, Artificial Sequence
  Description of Artificial Sequence: Synthetic oligonucleotide
  Target: SCN9A; (-) strand; PAM type: NRG; PAM sequence: AAG
aagagaatgtcctcacttat

SEQ ID NO: 35255 - DNA, 20 bp, Artificial Sequence
  Description of Artificial Sequence: Synthetic oligonucleotide
  Target: SCN9A; (-) strand; PAM type: NRG; PAM sequence: GAG
cgtactgtgaaactattcaa

SEQ ID NO: 35256 - DNA, 20 bp, Artificial Sequence
  Description of Artificial Sequence: Synthetic oligonucleotide
  Target: SCN9A; (-) strand; PAM type: NRG; PAM sequence: AAG
accgtactgtgaaactattc

SEQ ID NO: 35257 - DNA, 20 bp, Artificial Sequence
  Description of Artificial Sequence: Synthetic oligonucleotide
  Target: SCN9A; (-) strand; PAM type: NRG; PAM sequence: AAG
gactcagcaatttcactctg

SEQ ID NO: 35258 - DNA, 20 bp, Artificial Sequence
  Description of Artificial Sequence: Synthetic oligonucleotide
  Target: SCN9A; (-) strand; PAM type: NRG; PAM sequence: CAG
acgcacatacaattatgact

SEQ ID NO: 35259 - DNA, 20 bp, Artificial Sequence
  Description of Artificial Sequence: Synthetic oligonucleotide
  Target: SCN9A; (-) strand; PAM type: NRG; PAM sequence: TGG
aattcggcaatattttatta

SEQ ID NO: 35260 - DNA, 20 bp, Artificial Sequence
  Description of Artificial Sequence: Synthetic oligonucleotide
  Target: SCN9A; (-) strand; PAM type: NRG; PAM sequence: CGG
ctaggtaacaaaagagaatt

SEQ ID NO: 35261 - DNA, 20 bp, Artificial Sequence
  Description of Artificial Sequence: Synthetic oligonucleotide
  Target: SCN9A; (-) strand; PAM type: NRG; PAM sequence: GAG
cgttacactaggtaacaaaa

SEQ ID NO: 35262 - DNA, 20 bp, Artificial Sequence
  Description of Artificial Sequence: Synthetic oligonucleotide
  Target: SCN9A; (-) strand; PAM type: NRG; PAM sequence: AAG
ggcgttacactaggtaacaa

SEQ ID NO: 35263 - DNA, 20 bp, Artificial Sequence
  Description of Artificial Sequence: Synthetic oligonucleotide
  Target: SCN9A; (-) strand; PAM type: NRG; PAM sequence: AGG
ggccctgtaggcgttacact

SEQ ID NO: 35264 - DNA, 20 bp, Artificial Sequence
  Description of Artificial Sequence: Synthetic oligonucleotide
  Target: SCN9A; (-) strand; PAM type: NRG; PAM sequence: TAG
tggccctgtaggcgttacac

SEQ ID NO: 35265 - DNA, 20 bp, Artificial Sequence
  Description of Artificial Sequence: Synthetic oligonucleotide
  Target: SCN9A; (-) strand; PAM type: NRG; PAM sequence: AGG
aaattcagctatggccctgt

SEQ ID NO: 35266 - DNA, 20 bp, Artificial Sequence
  Description of Artificial Sequence: Synthetic oligonucleotide
  Target: SCN9A; (-) strand; PAM type: NRG; PAM sequence: TAG
gaaattcagctatggccctg

SEQ ID NO: 35267 - DNA, 20 bp, Artificial Sequence
  Description of Artificial Sequence: Synthetic oligonucleotide
  Target: SCN9A; (-) strand; PAM type: NRG; PAM sequence: TGG
gtaggatagaaattcagcta

SEQ ID NO: 35268 - DNA, 20 bp, Artificial Sequence
  Description of Artificial Sequence: Synthetic oligonucleotide
  Target: SCN9A; (-) strand; PAM type: NRG; PAM sequence: CAG
gttagggtaggatagaaatt

SEQ ID NO: 35269 - DNA, 20 bp, Artificial Sequence
  Description of Artificial Sequence: Synthetic oligonucleotide
  Target: SCN9A; (-) strand; PAM type: NRG; PAM sequence: TAG
tcagcagagttagggtagga

SEQ ID NO: 35270 - DNA, 20 bp, Artificial Sequence
  Description of Artificial Sequence: Synthetic oligonucleotide
  Target: SCN9A; (-) strand; PAM type: NRG; PAM sequence: AGG
aagatcagcagagttagggt

SEQ ID NO: 35271 - DNA, 20 bp, Artificial Sequence
  Description of Artificial Sequence: Synthetic oligonucleotide
  Target: SCN9A; (-) strand; PAM type: NRG; PAM sequence: TAG
aaagatcagcagagttaggg

SEQ ID NO: 35272 - DNA, 20 bp, Artificial Sequence
  Description of Artificial Sequence: Synthetic oligonucleotide
  Target: SCN9A; (-) strand; PAM type: NRG; PAM sequence: GGG
cttaaagatcagcagagtta

SEQ ID NO: 35273 - DNA, 20 bp, Artificial Sequence
  Description of Artificial Sequence: Synthetic oligonucleotide
  Target: SCN9A; (-) strand; PAM type: NRG; PAM sequence: AGG
tcttaaagatcagcagagtt

SEQ ID NO: 35274 - DNA, 20 bp, Artificial Sequence
  Description of Artificial Sequence: Synthetic oligonucleotide
  Target: SCN9A; (-) strand; PAM type: NRG; PAM sequence: TAG
ttcttaaagatcagcagagt

SEQ ID NO: 35275 - DNA, 20 bp, Artificial Sequence
  Description of Artificial Sequence: Synthetic oligonucleotide
  Target: SCN9A; (-) strand; PAM type: NRG; PAM sequence: GAG
ctgtttcttaaagatcagca

SEQ ID NO: 35276 - DNA, 20 bp, Artificial Sequence
  Description of Artificial Sequence: Synthetic oligonucleotide
  Target: SCN9A; (-) strand; PAM type: NRG; PAM sequence: CAG
acctgtttcttaaagatcag

SEQ ID NO: 35277 - DNA, 20 bp, Artificial Sequence
  Description of Artificial Sequence: Synthetic oligonucleotide
  Target: SCN9A; (-) strand; PAM type: NRG; PAM sequence: CAG
tttacctgtttcttaaagat

SEQ ID NO: 35278 - DNA, 20 bp, Artificial Sequence
  Description of Artificial Sequence: Synthetic oligonucleotide
  Target: SCN9A; (-) strand; PAM type: NRG; PAM sequence: AAG
aacattttacctgtttctta

SEQ ID NO: 35279 - DNA, 20 bp, Artificial Sequence
  Description of Artificial Sequence: Synthetic oligonucleotide
  Target: SCN9A; (-) strand; PAM type: NRG; PAM sequence: TGG
tcagctgctctggttacaaa

SEQ ID NO: 35280 - DNA, 20 bp, Artificial Sequence
  Description of Artificial Sequence: Synthetic oligonucleotide
  Target: SCN9A; (-) strand; PAM type: NRG; PAM sequence: TGG
ctaagcaatctcagctgctc

SEQ ID NO: 35281 - DNA, 20 bp, Artificial Sequence
  Description of Artificial Sequence: Synthetic oligonucleotide
  Target: SCN9A; (-) strand; PAM type: NRG; PAM sequence: CAG
atcttggttctaagcaatct

SEQ ID NO: 35282 - DNA, 20 bp, Artificial Sequence
  Description of Artificial Sequence: Synthetic oligonucleotide
  Target: SCN9A; (-) strand; PAM type: NRG; PAM sequence: AAG
tagtcaactatcttggttct

SEQ ID NO: 35283 - DNA, 20 bp, Artificial Sequence
  Description of Artificial Sequence: Synthetic oligonucleotide
  Target: SCN9A; (-) strand; PAM type: NRG; PAM sequence: TGG
agtcctttagtcaactatct

SEQ ID NO: 35284 - DNA, 20 bp, Artificial Sequence
  Description of Artificial Sequence: Synthetic oligonucleotide
  Target: SCN9A; (-) strand; PAM type: NRG; PAM sequence: TAG
gaggtcttcttgaagtcctt

SEQ ID NO: 35285 - DNA, 20 bp, Artificial Sequence
  Description of Artificial Sequence: Synthetic oligonucleotide
  Target: SCN9A; (-) strand; PAM type: NRG; PAM sequence: AAG
tgatgcctgaggtcttcttg

SEQ ID NO: 35286 - DNA, 20 bp, Artificial Sequence
  Description of Artificial Sequence: Synthetic oligonucleotide
  Target: SCN9A; (-) strand; PAM type: NRG; PAM sequence: AGG
tgagattataatgatgcctg

SEQ ID NO: 35287 - DNA, 20 bp, Artificial Sequence
  Description of Artificial Sequence: Synthetic oligonucleotide
  Target: SCN9A; (-) strand; PAM type: NRG; PAM sequence: GAG
atgagattataatgatgcct

SEQ ID NO: 35288 - DNA, 20 bp, Artificial Sequence
  Description of Artificial Sequence: Synthetic oligonucleotide
  Target: SCN9A; (-) strand; PAM type: NRG; PAM sequence: GAG
gtgtcatttagcatgaaaat

SEQ ID NO: 35289 - DNA, 20 bp, Artificial Sequence
  Description of Artificial Sequence: Synthetic oligonucleotide
  Target: SCN9A; (-) strand; PAM type: NRG; PAM sequence: TAG
gcactggtgggggtgtcatt

SEQ ID NO: 35290 - DNA, 20 bp, Artificial Sequence
  Description of Artificial Sequence: Synthetic oligonucleotide
  Target: SCN9A; (-) strand; PAM type: NRG; PAM sequence: GGG
aactgtcatggcactggtgg

SEQ ID NO: 35291 - DNA, 20 bp, Artificial Sequence
  Description of Artificial Sequence: Synthetic oligonucleotide
  Target: SCN9A; (-) strand; PAM type: NRG; PAM sequence: GGG
caactgtcatggcactggtg

SEQ ID NO: 35292 - DNA, 20 bp, Artificial Sequence
  Description of Artificial Sequence: Synthetic oligonucleotide
  Target: SCN9A; (-) strand; PAM type: NRG; PAM sequence: GGG
tcaactgtcatggcactggt

SEQ ID NO: 35293 - DNA, 20 bp, Artificial Sequence
  Description of Artificial Sequence: Synthetic oligonucleotide
  Target: SCN9A; (-) strand; PAM type: NRG; PAM sequence: TGG
atcaactgtcatggcactgg

SEQ ID NO: 35294 - DNA, 20 bp, Artificial Sequence
  Description of Artificial Sequence: Synthetic oligonucleotide
  Target: SCN9A; (-) strand; PAM type: NRG; PAM sequence: TGG
attatcaactgtcatggcac

SEQ ID NO: 35295 - DNA, 20 bp, Artificial Sequence
  Description of Artificial Sequence: Synthetic oligonucleotide
  Target: SCN9A; (-) strand; PAM type: NRG; PAM sequence: TGG
atggggattatcaactgtca

SEQ ID NO: 35296 - DNA, 20 bp, Artificial Sequence
  Description of Artificial Sequence: Synthetic oligonucleotide
  Target: SCN9A; (-) strand; PAM type: NRG; PAM sequence: GGG
ttcttctggtcattgtcatg

SEQ ID NO: 35297 - DNA, 20 bp, Artificial Sequence
  Description of Artificial Sequence: Synthetic oligonucleotide
  Target: SCN9A; (-) strand; PAM type: NRG; PAM sequence: GGG
cttcttctggtcattgtcat

SEQ ID NO: 35298 - DNA, 20 bp, Artificial Sequence
  Description of Artificial Sequence: Synthetic oligonucleotide
  Target: SCN9A; (-) strand; PAM type: NRG; PAM sequence: TGG
gcttcttctggtcattgtca

SEQ ID NO: 35299 - DNA, 20 bp, Artificial Sequence
  Description of Artificial Sequence: Synthetic oligonucleotide
  Target: SCN9A; (-) strand; PAM type: NRG; PAM sequence: TGG
tgtccttttatggcttcttc

SEQ ID NO: 35300 - DNA, 20 bp, Artificial Sequence
  Description of Artificial Sequence: Synthetic oligonucleotide
  Target: SCN9A; (-) strand; PAM type: NRG; PAM sequence: TGG
ccttcctttttgtcctttta

SEQ ID NO: 35301 - DNA, 20 bp, Artificial Sequence
  Description of Artificial Sequence: Synthetic oligonucleotide
  Target: SCN9A; (-) strand; PAM type: NRG; PAM sequence: GAG
tggtgaacttcttggaacca

SEQ ID NO: 35302 - DNA, 20 bp, Artificial Sequence
  Description of Artificial Sequence: Synthetic oligonucleotide
  Target: SCN9A; (-) strand; PAM type: NRG; PAM sequence: CAG
ggtggtgaacttcttggaac

SEQ ID NO: 35303 - DNA, 20 bp, Artificial Sequence
  Description of Artificial Sequence: Synthetic oligonucleotide
  Target: SCN9A; (-) strand; PAM type: NRG; PAM sequence: TGG
gaaataggtggtgaacttct

SEQ ID NO: 35304 - DNA, 20 bp, Artificial Sequence
  Description of Artificial Sequence: Synthetic oligonucleotide
  Target: SCN9A; (-) strand; PAM type: NRG; PAM sequence: TGG
atgtcttttccagaaatagg

SEQ ID NO: 35305 - DNA, 20 bp, Artificial Sequence
  Description of Artificial Sequence: Synthetic oligonucleotide
  Target: SCN9A; (-) strand; PAM type: NRG; PAM sequence: AGG
ttcatgtcttttccagaaat

SEQ ID NO: 35306 - DNA, 20 bp, Artificial Sequence
  Description of Artificial Sequence: Synthetic oligonucleotide
  Target: SCN9A; (-) strand; PAM type: NRG; PAM sequence: TAG
gttcatgtcttttccagaaa

SEQ ID NO: 35307 - DNA, 20 bp, Artificial Sequence
  Description of Artificial Sequence: Synthetic oligonucleotide
  Target: SCN9A; (-) strand; PAM type: NRG; PAM sequence: CAG
aggaatgttcatgtcttttc

SEQ ID NO: 35308 - DNA, 20 bp, Artificial Sequence
  Description of Artificial Sequence: Synthetic oligonucleotide
  Target: SCN9A; (-) strand; PAM type: NRG; PAM sequence: AGG
tggtcattaagagtgagggg

SEQ ID NO: 35309 - DNA, 20 bp, Artificial Sequence
  Description of Artificial Sequence: Synthetic oligonucleotide
  Target: SCN9A; (-) strand; PAM type: NRG; PAM sequence: GAG
ttggtcattaagagtgaggg

SEQ ID NO: 35310 - DNA, 20 bp, Artificial Sequence
  Description of Artificial Sequence: Synthetic oligonucleotide
  Target: SCN9A; (-) strand; PAM type: NRG; PAM sequence: GGG
agttggtcattaagagtgag

SEQ ID NO: 35311 - DNA, 20 bp, Artificial Sequence
  Description of Artificial Sequence: Synthetic oligonucleotide
  Target: SCN9A; (-) strand; PAM type: NRG; PAM sequence: GGG
aagttggtcattaagagtga

SEQ ID NO: 35312 - DNA, 20 bp, Artificial Sequence
  Description of Artificial Sequence: Synthetic oligonucleotide
  Target: SCN9A; (-) strand; PAM type: NRG; PAM sequence: AGG
gaagttggtcattaagagtg

SEQ ID NO: 35313 - DNA, 20 bp, Artificial Sequence
  Description of Artificial Sequence: Synthetic oligonucleotide
  Target: SCN9A; (-) strand; PAM type: NRG; PAM sequence: GAG
agaagttggtcattaagagt

SEQ ID NO: 35314 - DNA, 20 bp, Artificial Sequence
  Description of Artificial Sequence: Synthetic oligonucleotide
  Target: SCN9A; (-) strand; PAM type: NRG; PAM sequence: GAG
atgaagaagttggtcattaa

SEQ ID NO: 35315 - DNA, 20 bp, Artificial Sequence
  Description of Artificial Sequence: Synthetic oligonucleotide
  Target: SCN9A; (-) strand; PAM type: NRG; PAM sequence: AAG
taatgaagaagttggtcatt

SEQ ID NO: 35316 - DNA, 20 bp, Artificial Sequence
  Description of Artificial Sequence: Synthetic oligonucleotide
  Target: SCN9A; (-) strand; PAM type: NRG; PAM sequence: TGG
agtatatctaatgaagaagt

SEQ ID NO: 35317 - DNA, 20 bp, Artificial Sequence
  Description of Artificial Sequence: Synthetic oligonucleotide
  Target: SCN9A; (-) strand; PAM type: NRG; PAM sequence: AAG
agaaagtatatctaatgaag

SEQ ID NO: 35318 - DNA, 20 bp, Artificial Sequence
  Description of Artificial Sequence: Synthetic oligonucleotide
  Target: SCN9A; (-) strand; PAM type: NRG; PAM sequence: AAG
aatagaaagtatatctaatg

SEQ ID NO: 35319 - DNA, 20 bp, Artificial Sequence
  Description of Artificial Sequence: Synthetic oligonucleotide
  Target: SCN9A; (-) strand; PAM type: NRG; PAM sequence: AAG
agtgaggaaattgaaataga

SEQ ID NO: 35320 - DNA, 20 bp, Artificial Sequence
  Description of Artificial Sequence: Synthetic oligonucleotide
  Target: SCN9A; (-) strand; PAM type: NRG; PAM sequence: TAG
gaggagtgaggaaattgaaa

SEQ ID NO: 35321 - DNA, 20 bp, Artificial Sequence
  Description of Artificial Sequence: Synthetic oligonucleotide
  Target: SCN9A; (-) strand; PAM type: NRG; PAM sequence: AGG
ttcttgactagtgaggagtg

SEQ ID NO: 35322 - DNA, 20 bp, Artificial Sequence
  Description of Artificial Sequence: Synthetic oligonucleotide
  Target: SCN9A; (-) strand; PAM type: NRG; PAM sequence: GAG
cttcttgactagtgaggagt

SEQ ID NO: 35323 - DNA, 20 bp, Artificial Sequence
  Description of Artificial Sequence: Synthetic oligonucleotide
  Target: SCN9A; (-) strand; PAM type: NRG; PAM sequence: GAG
ctaacttcttgactagtgag

SEQ ID NO: 35324 - DNA, 20 bp, Artificial Sequence
  Description of Artificial Sequence: Synthetic oligonucleotide
  Target: SCN9A; (-) strand; PAM type: NRG; PAM sequence: AGG
agctaacttcttgactagtg

SEQ ID NO: 35325 - DNA, 20 bp, Artificial Sequence
  Description of Artificial Sequence: Synthetic oligonucleotide
  Target: SCN9A; (-) strand; PAM type: NRG; PAM sequence: GAG
aagctaacttcttgactagt

SEQ ID NO: 35326 - DNA, 20 bp, Artificial Sequence
  Description of Artificial Sequence: Synthetic oligonucleotide
  Target: SCN9A; (-) strand; PAM type: NRG; PAM sequence: TAG
gcacaagctaacttcttgac

SEQ ID NO: 35327 - DNA, 20 bp, Artificial Sequence
  Description of Artificial Sequence: Synthetic oligonucleotide
  Target: SCN9A; (-) strand; PAM type: NRG; PAM sequence: AAG
gaagtgcaagtatggcgcac

SEQ ID NO: 35328 - DNA, 20 bp, Artificial Sequence
  Description of Artificial Sequence: Synthetic oligonucleotide
  Target: SCN9A; (-) strand; PAM type: NRG; PAM sequence: TGG
agaatggagaagtgcaagta

SEQ ID NO: 35329 - DNA, 20 bp, Artificial Sequence
  Description of Artificial Sequence: Synthetic oligonucleotide
  Target: SCN9A; (-) strand; PAM type: NRG; PAM sequence: AAG
gccaaagaatggagaagtgc

SEQ ID NO: 35330 - DNA, 20 bp, Artificial Sequence
  Description of Artificial Sequence: Synthetic oligonucleotide
  Target: SCN9A; (-) strand; PAM type: NRG; PAM sequence: AAG
tcgatggccaaagaatggag

SEQ ID NO: 35331 - DNA, 20 bp, Artificial Sequence
  Description of Artificial Sequence: Synthetic oligonucleotide
  Target: SCN9A; (-) strand; PAM type: NRG; PAM sequence: GAG
tattcgatggccaaagaatg

SEQ ID NO: 35332 - DNA, 20 bp, Artificial Sequence
  Description of Artificial Sequence: Synthetic oligonucleotide
  Target: SCN9A; (-) strand; PAM type: NRG; PAM sequence: TGG
tttattcgatggccaaagaa

SEQ ID NO: 35333 - DNA, 20 bp, Artificial Sequence
  Description of Artificial Sequence: Synthetic oligonucleotide
  Target: SCN9A; (-) strand; PAM type: NRG; PAM sequence: AAG
caagctttattcgatggcca

SEQ ID NO: 35334 - DNA, 20 bp, Artificial Sequence
  Description of Artificial Sequence: Synthetic oligonucleotide
  Target: SCN9A; (-) strand; PAM type: NRG; PAM sequence: TGG
gcaatgcaagctttattcga

SEQ ID NO: 35335 - DNA, 20 bp, Artificial Sequence
  Description of Artificial Sequence: Synthetic oligonucleotide
  Target: SCN9A; (-) strand; PAM type: NRG; PAM sequence: AAG
aagtgagcatcaagcaatgc

SEQ ID NO: 35336 - DNA, 20 bp, Artificial Sequence
  Description of Artificial Sequence: Synthetic oligonucleotide
  Target: SCN9A; (-) strand; PAM type: NRG; PAM sequence: AAG
gaaatgggaaagtgagcatc

SEQ ID NO: 35337 - DNA, 20 bp, Artificial Sequence
  Description of Artificial Sequence: Synthetic oligonucleotide
  Target: SCN9A; (-) strand; PAM type: NRG; PAM sequence: GAG
aatacaagaaatgggaaagt

SEQ ID NO: 35338 - DNA, 20 bp, Artificial Sequence
  Description of Artificial Sequence: Synthetic oligonucleotide
  Target: SCN9A; (-) strand; PAM type: NRG; PAM sequence: AAG
acccaatacaagaaatggga

SEQ ID NO: 35339 - DNA, 20 bp, Artificial Sequence
  Description of Artificial Sequence: Synthetic oligonucleotide
  Target: SCN9A; (-) strand; PAM type: NRG; PAM sequence: GGG
ggagacccaatacaagaaat

SEQ ID NO: 35340 - DNA, 20 bp, Artificial Sequence
  Description of Artificial Sequence: Synthetic oligonucleotide
  Target: SCN9A; (-) strand; PAM type: NRG; PAM sequence: TGG
tggagacccaatacaagaaa

SEQ ID NO: 35341 - DNA, 20 bp, Artificial Sequence
  Description of Artificial Sequence: Synthetic oligonucleotide
  Target: SCN9A; (-) strand; PAM type: NRG; PAM sequence: AAG
tggtattggagacccaatac

SEQ ID NO: 35342 - DNA, 20 bp, Artificial Sequence
  Description of Artificial Sequence: Synthetic oligonucleotide
  Target: SCN9A; (-) strand; PAM type: NRG; PAM sequence: GAG
tctttccctgtttggtattg

SEQ ID NO: 35343 - DNA, 20 bp, Artificial Sequence
  Description of Artificial Sequence: Synthetic oligonucleotide
  Target: SCN9A; (-) strand; PAM type: NRG; PAM sequence: TGG
catctttccctgtttggtat

SEQ ID NO: 35344 - DNA, 20 bp, Artificial Sequence
  Description of Artificial Sequence: Synthetic oligonucleotide
  Target: SCN9A; (-) strand; PAM type: NRG; PAM sequence: TGG
aggtggcatctttccctgtt

SEQ ID NO: 35345 - DNA, 20 bp, Artificial Sequence
  Description of Artificial Sequence: Synthetic oligonucleotide
  Target: SCN9A; (-) strand; PAM type: NRG; PAM sequence: TGG
tccttggtagtttcaaaagg

SEQ ID NO: 35346 - DNA, 20 bp, Artificial Sequence
  Description of Artificial Sequence: Synthetic oligonucleotide
  Target: SCN9A; (-) strand; PAM type: NRG; PAM sequence: AGG
acctccttggtagtttcaaa

SEQ ID NO: 35347 - DNA, 20 bp, Artificial Sequence
  Description of Artificial Sequence: Synthetic oligonucleotide
  Target: SCN9A; (-) strand; PAM type: NRG; PAM sequence: AAG
aacctccttggtagtttcaa

SEQ ID NO: 35348 - DNA, 20 bp, Artificial Sequence
  Description of Artificial Sequence: Synthetic oligonucleotide
  Target: SCN9A; (-) strand; PAM type: NRG; PAM sequence: TAG
tataccaataacctccttgg

SEQ ID NO: 35349 - DNA, 20 bp, Artificial Sequence
  Description of Artificial Sequence: Synthetic oligonucleotide
  Target: SCN9A; (-) strand; PAM type: NRG; PAM sequence: TGG
caatataccaataacctcct

SEQ ID NO: 35350 - DNA, 20 bp, Artificial Sequence
  Description of Artificial Sequence: Synthetic oligonucleotide
  Target: SCN9A; (-) strand; PAM type: NRG; PAM sequence: GAG
attgataggcctttatgaag

SEQ ID NO: 35351 - DNA, 20 bp, Artificial Sequence
  Description of Artificial Sequence: Synthetic oligonucleotide
  Target: SCN9A; (-) strand; PAM type: NRG; PAM sequence: AGG
ggattgataggcctttatga

SEQ ID NO: 35352 - DNA, 20 bp, Artificial Sequence
  Description of Artificial Sequence: Synthetic oligonucleotide
  Target: SCN9A; (-) strand; PAM type: NRG; PAM sequence: AAG
tggattgataggcctttatg

SEQ ID NO: 35353 - DNA, 20 bp, Artificial Sequence
  Description of Artificial Sequence: Synthetic oligonucleotide
  Target: SCN9A; (-) strand; PAM type: NRG; PAM sequence: AGG
tggggagagcatggattgat

SEQ ID NO: 35354 - DNA, 20 bp, Artificial Sequence
  Description of Artificial Sequence: Synthetic oligonucleotide
  Target: SCN9A; (-) strand; PAM type: NRG; PAM sequence: TAG
ttggggagagcatggattga

SEQ ID NO: 35355 - DNA, 20 bp, Artificial Sequence
  Description of Artificial Sequence: Synthetic oligonucleotide
  Target: SCN9A; (-) strand; PAM type: NRG; PAM sequence: TGG
cacattgtttggggagagca

SEQ ID NO: 35356 - DNA, 20 bp, Artificial Sequence
  Description of Artificial Sequence: Synthetic oligonucleotide
  Target: SCN9A; (-) strand; PAM type: NRG; PAM sequence: GAG
cctgacacattgtttgggga

SEQ ID NO: 35357 - DNA, 20 bp, Artificial Sequence
  Description of Artificial Sequence: Synthetic oligonucleotide
  Target: SCN9A; (-) strand; PAM type: NRG; PAM sequence: GAG
tccctgacacattgtttggg

SEQ ID NO: 35358 - DNA, 20 bp, Artificial Sequence
  Description of Artificial Sequence: Synthetic oligonucleotide
  Target: SCN9A; (-) strand; PAM type: NRG; PAM sequence: GGG
aatccctgacacattgtttg

SEQ ID NO: 35359 - DNA, 20 bp, Artificial Sequence
  Description of Artificial Sequence: Synthetic oligonucleotide
  Target: SCN9A; (-) strand; PAM type: NRG; PAM sequence: GGG
caatccctgacacattgttt

SEQ ID NO: 35360 - DNA, 20 bp, Artificial Sequence
  Description of Artificial Sequence: Synthetic oligonucleotide
  Target: SCN9A; (-) strand; PAM type: NRG; PAM sequence: TGG
acaatccctgacacattgtt

SEQ ID NO: 35361 - DNA, 20 bp, Artificial Sequence
  Description of Artificial Sequence: Synthetic oligonucleotide
  Target: SCN9A; (-) strand; PAM type: NRG; PAM sequence: AGG
tttatgaaatactttattga

SEQ ID NO: 35362 - DNA, 20 bp, Artificial Sequence
  Description of Artificial Sequence: Synthetic oligonucleotide
  Target: SCN9A; (-) strand; PAM type: NRG; PAM sequence: AAG
atttatgaaatactttattg

SEQ ID NO: 35363 - DNA, 20 bp, Artificial Sequence
  Description of Artificial Sequence: Synthetic oligonucleotide
  Target: SCN9A; (-) strand; PAM type: NRG; PAM sequence: AAG
ccccacttattaggctcaca

SEQ ID NO: 35364 - DNA, 20 bp, Artificial Sequence
  Description of Artificial Sequence: Synthetic oligonucleotide
  Target: SCN9A; (-) strand; PAM type: NRG; PAM sequence: AGG
agttttattccccacttatt

SEQ ID NO: 35365 - DNA, 20 bp, Artificial Sequence
  Description of Artificial Sequence: Synthetic oligonucleotide
  Target: SCN9A; (-) strand; PAM type: NRG; PAM sequence: TAG
aagttttattccccacttat

SEQ ID NO: 35366 - DNA, 20 bp, Artificial Sequence
  Description of Artificial Sequence: Synthetic oligonucleotide
  Target: SCN9A; (-) strand; PAM type: NRG; PAM sequence: AAG
ataaataaataaataaataa

SEQ ID NO: 35367 - DNA, 20 bp, Artificial Sequence
  Description of Artificial Sequence: Synthetic oligonucleotide
  Target: SCN9A; (-) strand; PAM type: NRG; PAM sequence: GAG
ctccagcctgggcaatgaga

SEQ ID NO: 35368 - DNA, 20 bp, Artificial Sequence
  Description of Artificial Sequence: Synthetic oligonucleotide
  Target: SCN9A; (-) strand; PAM type: NRG; PAM sequence: GAG
cactccagcctgggcaatga

SEQ ID NO: 35369 - DNA, 20 bp, Artificial Sequence
  Description of Artificial Sequence: Synthetic oligonucleotide
  Target: SCN9A; (-) strand; PAM type: NRG; PAM sequence: GAG
ggcactccagcctgggcaat

SEQ ID NO: 35370 - DNA, 20 bp, Artificial Sequence
  Description of Artificial Sequence: Synthetic oligonucleotide
  Target: SCN9A; (-) strand; PAM type: NRG; PAM sequence: GGG
gcaccaaggcactccagcct

SEQ ID NO: 35371 - DNA, 20 bp, Artificial Sequence
  Description of Artificial Sequence: Synthetic oligonucleotide
  Target: SCN9A; (-) strand; PAM type: NRG; PAM sequence: TGG
cgcaccaaggcactccagcc

SEQ ID NO: 35372 - DNA, 20 bp, Artificial Sequence
  Description of Artificial Sequence: Synthetic oligonucleotide
  Target: SCN9A; (-) strand; PAM type: NRG; PAM sequence: CAG
gagatcgcaccaaggcactc

SEQ ID NO: 35373 - DNA, 20 bp, Artificial Sequence
  Description of Artificial Sequence: Synthetic oligonucleotide
  Target: SCN9A; (-) strand; PAM type: NRG; PAM sequence: AGG
agtgagctgagatcgcacca

SEQ ID NO: 35374 - DNA, 20 bp, Artificial Sequence
  Description of Artificial Sequence: Synthetic oligonucleotide
  Target: SCN9A; (-) strand; PAM type: NRG; PAM sequence: AAG
cagtgagctgagatcgcacc

SEQ ID NO: 35375 - DNA, 20 bp, Artificial Sequence
  Description of Artificial Sequence: Synthetic oligonucleotide
  Target: SCN9A; (-) strand; PAM type: NRG; PAM sequence: GAG
ggcagatgttgcagtgagct

SEQ ID NO: 35376 - DNA, 20 bp, Artificial Sequence
  Description of Artificial Sequence: Synthetic oligonucleotide
  Target: SCN9A; (-) strand; PAM type: NRG; PAM sequence: GAG
caggaggcagatgttgcagt

SEQ ID NO: 35377 - DNA, 20 bp, Artificial Sequence
  Description of Artificial Sequence: Synthetic oligonucleotide
  Target: SCN9A; (-) strand; PAM type: NRG; PAM sequence: CAG
aacccaggaggcagatgttg

SEQ ID NO: 35378 - DNA, 20 bp, Artificial Sequence
  Description of Artificial Sequence: Synthetic oligonucleotide
  Target: SCN9A; (-) strand; PAM type: NRG; PAM sequence: CAG
aactgcttgaacccaggagg

SEQ ID NO: 35379 - DNA, 20 bp, Artificial Sequence
  Description of Artificial Sequence: Synthetic oligonucleotide
  Target: SCN9A; (-) strand; PAM type: NRG; PAM sequence: AGG
gagaactgcttgaacccagg

SEQ ID NO: 35380 - DNA, 20 bp, Artificial Sequence
  Description of Artificial Sequence: Synthetic oligonucleotide
  Target: SCN9A; (-) strand; PAM type: NRG; PAM sequence: GAG
ggagaactgcttgaacccag

SEQ ID NO: 35381 - DNA, 20 bp, Artificial Sequence
  Description of Artificial Sequence: Synthetic oligonucleotide
  Target: SCN9A; (-) strand; PAM type: NRG; PAM sequence: AGG
caggagaactgcttgaaccc

SEQ ID NO: 35382 - DNA, 20 bp, Artificial Sequence
  Description of Artificial Sequence: Synthetic oligonucleotide
  Target: SCN9A; (-) strand; PAM type: NRG; PAM sequence: CAG
gcaggagaactgcttgaacc

SEQ ID NO: 35383 - DNA, 20 bp, Artificial Sequence
  Description of Artificial Sequence: Synthetic oligonucleotide
  Target: SCN9A; (-) strand; PAM type: NRG; PAM sequence: GAG
tactcaggaggctgaggcag

SEQ ID NO: 35384 - DNA, 20 bp, Artificial Sequence
  Description of Artificial Sequence: Synthetic oligonucleotide
  Target: SCN9A; (-) strand; PAM type: NRG; PAM sequence: AGG
gctactcaggaggctgaggc

SEQ ID NO: 35385 - DNA, 20 bp, Artificial Sequence
  Description of Artificial Sequence: Synthetic oligonucleotide
  Target: SCN9A; (-) strand; PAM type: NRG; PAM sequence: CAG
agctactcaggaggctgagg

SEQ ID NO: 35386 - DNA, 20 bp, Artificial Sequence
  Description of Artificial Sequence: Synthetic oligonucleotide
  Target: SCN9A; (-) strand; PAM type: NRG; PAM sequence: AGG
ccgagctactcaggaggctg

SEQ ID NO: 35387 - DNA, 20 bp, Artificial Sequence
  Description of Artificial Sequence: Synthetic oligonucleotide
  Target: SCN9A; (-) strand; PAM type: NRG; PAM sequence: GAG
tccgagctactcaggaggct

SEQ ID NO: 35388 - DNA, 20 bp, Artificial Sequence
  Description of Artificial Sequence: Synthetic oligonucleotide
  Target: SCN9A; (-) strand; PAM type: NRG; PAM sequence: AGG
tctaatccgagctactcagg

SEQ ID NO: 35389 - DNA, 20 bp, Artificial Sequence
  Description of Artificial Sequence: Synthetic oligonucleotide
  Target: SCN9A; (-) strand; PAM type: NRG; PAM sequence: GAG
ctctaatccgagctactcag

SEQ ID NO: 35390 - DNA, 20 bp, Artificial Sequence
  Description of Artificial Sequence: Synthetic oligonucleotide
  Target: SCN9A; (-) strand; PAM type: NRG; PAM sequence: AGG
acctctaatccgagctactc

SEQ ID NO: 35391 - DNA, 20 bp, Artificial Sequence
  Description of Artificial Sequence: Synthetic oligonucleotide
  Target: SCN9A; (-) strand; PAM type: NRG; PAM sequence: CAG
tacctctaatccgagctact

SEQ ID NO: 35392 - DNA, 20 bp, Artificial Sequence
  Description of Artificial Sequence: Synthetic oligonucleotide
  Target: SCN9A; (-) strand; PAM type: NRG; PAM sequence: GAG
gtggtgggtacctctaatcc

SEQ ID NO: 35393 - DNA, 20 bp, Artificial Sequence
  Description of Artificial Sequence: Synthetic oligonucleotide
  Target: SCN9A; (-) strand; PAM type: NRG; PAM sequence: GGG
aattagccgggtgtggtggt

SEQ ID NO: 35394 - DNA, 20 bp, Artificial Sequence
  Description of Artificial Sequence: Synthetic oligonucleotide
  Target: SCN9A; (-) strand; PAM type: NRG; PAM sequence: TGG
aaattagccgggtgtggtgg

SEQ ID NO: 35395 - DNA, 20 bp, Artificial Sequence
  Description of Artificial Sequence: Synthetic oligonucleotide
  Target: SCN9A; (-) strand; PAM type: NRG; PAM sequence: TGG
caaaaattagccgggtgtgg

SEQ ID NO: 35396 - DNA, 20 bp, Artificial Sequence
  Description of Artificial Sequence: Synthetic oligonucleotide
  Target: SCN9A; (-) strand; PAM type: NRG; PAM sequence: TGG
gtacaaaaattagccgggtg

SEQ ID NO: 35397 - DNA, 20 bp, Artificial Sequence
  Description of Artificial Sequence: Synthetic oligonucleotide
  Target: SCN9A; (-) strand; PAM type: NRG; PAM sequence: GGG
taaaggtacaaaaattagcc

SEQ ID NO: 35398 - DNA, 20 bp, Artificial Sequence
  Description of Artificial Sequence: Synthetic oligonucleotide
  Target: SCN9A; (-) strand; PAM type: NRG; PAM sequence: CGG
ctaaaggtacaaaaattagc

SEQ ID NO: 35399 - DNA, 20 bp, Artificial Sequence
  Description of Artificial Sequence: Synthetic oligonucleotide
  Target: SCN9A; (-) strand; PAM type: NRG; PAM sequence: TAG
tctactaaaggtacaaaaat

SEQ ID NO: 35400 - DNA, 20 bp, Artificial Sequence
  Description of Artificial Sequence: Synthetic oligonucleotide
  Target: SCN9A; (-) strand; PAM type: NRG; PAM sequence: AGG
tgaaaacctgtctctactaa

SEQ ID NO: 35401 - DNA, 20 bp, Artificial Sequence
  Description of Artificial Sequence: Synthetic oligonucleotide
  Target: SCN9A; (-) strand; PAM type: NRG; PAM sequence: AAG
gtgaaaacctgtctctacta

SEQ ID NO: 35402 - DNA, 20 bp, Artificial Sequence
  Description of Artificial Sequence: Synthetic oligonucleotide
  Target: SCN9A; (-) strand; PAM type: NRG; PAM sequence: TGG
ggagaccagcctggccaaca

SEQ ID NO: 35403 - DNA, 20 bp, Artificial Sequence
  Description of Artificial Sequence: Synthetic oligonucleotide
  Target: SCN9A; (-) strand; PAM type: NRG; PAM sequence: TGG
tcaggagttggagaccagcc

SEQ ID NO: 35404 - DNA, 20 bp, Artificial Sequence
  Description of Artificial Sequence: Synthetic oligonucleotide
  Target: SCN9A; (-) strand; PAM type: NRG; PAM sequence: CAG
tgaggtcaggagttggagac

SEQ ID NO: 35405 - DNA, 20 bp, Artificial Sequence
  Description of Artificial Sequence: Synthetic oligonucleotide
  Target: SCN9A; (-) strand; PAM type: NRG; PAM sequence: GAG
tcacatgaggtcaggagttg

SEQ ID NO: 35406 - DNA, 20 bp, Artificial Sequence
  Description of Artificial Sequence: Synthetic oligonucleotide
  Target: SCN9A; (-) strand; PAM type: NRG; PAM sequence: TGG
gatcacatgaggtcaggagt

SEQ ID NO: 35407 - DNA, 20 bp, Artificial Sequence
  Description of Artificial Sequence: Synthetic oligonucleotide
  Target: SCN9A; (-) strand; PAM type: NRG; PAM sequence: GAG
ggtggatcacatgaggtcag

SEQ ID NO: 35408 - DNA, 20 bp, Artificial Sequence
  Description of Artificial Sequence: Synthetic oligonucleotide
  Target: SCN9A; (-) strand; PAM type: NRG; PAM sequence: AGG
tgggtggatcacatgaggtc

SEQ ID NO: 35409 - DNA, 20 bp, Artificial Sequence
  Description of Artificial Sequence: Synthetic oligonucleotide
  Target: SCN9A; (-) strand; PAM type: NRG; PAM sequence: CAG
atgggtggatcacatgaggt

SEQ ID NO: 35410 - DNA, 20 bp, Artificial Sequence
  Description of Artificial Sequence: Synthetic oligonucleotide
  Target: SCN9A; (-) strand; PAM type: NRG; PAM sequence: AGG
tgagatgggtggatcacatg

SEQ ID NO: 35411 - DNA, 20 bp, Artificial Sequence
  Description of Artificial Sequence: Synthetic oligonucleotide
  Target: SCN9A; (-) strand; PAM type: NRG; PAM sequence: GAG
ctgagatgggtggatcacat

SEQ ID NO: 35412 - DNA, 20 bp, Artificial Sequence
  Description of Artificial Sequence: Synthetic oligonucleotide
  Target: SCN9A; (-) strand; PAM type: NRG; PAM sequence: TGG
ctttgggaagctgagatggg

SEQ ID NO: 35413 - DNA, 20 bp, Artificial Sequence
  Description of Artificial Sequence: Synthetic oligonucleotide
  Target: SCN9A; (-) strand; PAM type: NRG; PAM sequence: GGG
gcactttgggaagctgagat

SEQ ID NO: 35414 - DNA, 20 bp, Artificial Sequence
  Description of Artificial Sequence: Synthetic oligonucleotide
  Target: SCN9A; (-) strand; PAM type: NRG; PAM sequence: TGG
agcactttgggaagctgaga

SEQ ID NO: 35415 - DNA, 20 bp, Artificial Sequence
  Description of Artificial Sequence: Synthetic oligonucleotide
  Target: SCN9A; (-) strand; PAM type: NRG; PAM sequence: GAG
tcccagcactttgggaagct

SEQ ID NO: 35416 - DNA, 20 bp, Artificial Sequence
  Description of Artificial Sequence: Synthetic oligonucleotide
  Target: SCN9A; (-) strand; PAM type: NRG; PAM sequence: AAG
tgtgatcccagcactttggg

SEQ ID NO: 35417 - DNA, 20 bp, Artificial Sequence
  Description of Artificial Sequence: Synthetic oligonucleotide
  Target: SCN9A; (-) strand; PAM type: NRG; PAM sequence: GGG
gtttgtgatcccagcacttt

SEQ ID NO: 35418 - DNA, 20 bp, Artificial Sequence
  Description of Artificial Sequence: Synthetic oligonucleotide
  Target: SCN9A; (-) strand; PAM type: NRG; PAM sequence: TGG
tgtttgtgatcccagcactt

SEQ ID NO: 35419 - DNA, 20 bp, Artificial Sequence
  Description of Artificial Sequence: Synthetic oligonucleotide
  Target: SCN9A; (-) strand; PAM type: NRG; PAM sequence: CAG
gtggctcatgtttgtgatcc

SEQ ID NO: 35420 - DNA, 20 bp, Artificial Sequence
  Description of Artificial Sequence: Synthetic oligonucleotide
  Target: SCN9A; (-) strand; PAM type: NRG; PAM sequence: TGG
aagttttcggccgggtgtgg

SEQ ID NO: 35421 - DNA, 20 bp, Artificial Sequence
  Description of Artificial Sequence: Synthetic oligonucleotide
  Target: SCN9A; (-) strand; PAM type: NRG; PAM sequence: TGG
aagaagttttcggccgggtg

SEQ ID NO: 35422 - DNA, 20 bp, Artificial Sequence
  Description of Artificial Sequence: Synthetic oligonucleotide
  Target: SCN9A; (-) strand; PAM type: NRG; PAM sequence: GGG
gaattaagaagttttcggcc

SEQ ID NO: 35423 - DNA, 20 bp, Artificial Sequence
  Description of Artificial Sequence: Synthetic oligonucleotide
  Target: SCN9A; (-) strand; PAM type: NRG; PAM sequence: CGG
agaattaagaagttttcggc

SEQ ID NO: 35424 - DNA, 20 bp, Artificial Sequence
  Description of Artificial Sequence: Synthetic oligonucleotide
  Target: SCN9A; (-) strand; PAM type: NRG; PAM sequence: CGG
gataagaattaagaagtttt

SEQ ID NO: 35425 - DNA, 20 bp, Artificial Sequence
  Description of Artificial Sequence: Synthetic oligonucleotide
  Target: SCN9A; (-) strand; PAM type: NRG; PAM sequence: AAG
ctaaaatgataagaattaag

SEQ ID NO: 35426 - DNA, 20 bp, Artificial Sequence
  Description of Artificial Sequence: Synthetic oligonucleotide
  Target: SCN9A; (-) strand; PAM type: NRG; PAM sequence: AAG
aaactaaaatgataagaatt

SEQ ID NO: 35427 - DNA, 20 bp, Artificial Sequence
  Description of Artificial Sequence: Synthetic oligonucleotide
  Target: SCN9A; (-) strand; PAM type: NRG; PAM sequence: AAG
aaaatgcaaactaaaatgat

SEQ ID NO: 35428 - DNA, 20 bp, Artificial Sequence
  Description of Artificial Sequence: Synthetic oligonucleotide
  Target: SCN9A; (-) strand; PAM type: NRG; PAM sequence: AAG
atccctgacctcactcacaa

SEQ ID NO: 35429 - DNA, 20 bp, Artificial Sequence
  Description of Artificial Sequence: Synthetic oligonucleotide
  Target: SCN9A; (-) strand; PAM type: NRG; PAM sequence: AAG
atggcatctgaggatatgaa

SEQ ID NO: 35430 - DNA, 20 bp, Artificial Sequence
  Description of Artificial Sequence: Synthetic oligonucleotide
  Target: SCN9A; (-) strand; PAM type: NRG; PAM sequence: AGG
aaaagcacaaatggcatctg

SEQ ID NO: 35431 - DNA, 20 bp, Artificial Sequence
  Description of Artificial Sequence: Synthetic oligonucleotide
  Target: SCN9A; (-) strand; PAM type: NRG; PAM sequence: GAG
aaaaagcacaaatggcatct

SEQ ID NO: 35432 - DNA, 20 bp, Artificial Sequence
  Description of Artificial Sequence: Synthetic oligonucleotide
  Target: SCN9A; (-) strand; PAM type: NRG; PAM sequence: TGG
cacagaaaaaaaagcacaaa

SEQ ID NO: 35433 - DNA, 20 bp, Artificial Sequence
  Description of Artificial Sequence: Synthetic oligonucleotide
  Target: SCN9A; (-) strand; PAM type: NRG; PAM sequence: AAG
cagacagagcacagaaaaaa

SEQ ID NO: 35434 - DNA, 20 bp, Artificial Sequence
  Description of Artificial Sequence: Synthetic oligonucleotide
  Target: SCN9A; (-) strand; PAM type: NRG; PAM sequence: CAG
gactacatacagacagagca

SEQ ID NO: 35435 - DNA, 20 bp, Artificial Sequence
  Description of Artificial Sequence: Synthetic oligonucleotide
  Target: SCN9A; (-) strand; PAM type: NRG; PAM sequence: GAG
gacaagactacatacagaca

SEQ ID NO: 35436 - DNA, 20 bp, Artificial Sequence
  Description of Artificial Sequence: Synthetic oligonucleotide
  Target: SCN9A; (-) strand; PAM type: NRG; PAM sequence: CAG
tggacaagactacatacaga

SEQ ID NO: 35437 - DNA, 20 bp, Artificial Sequence
  Description of Artificial Sequence: Synthetic oligonucleotide
  Target: SCN9A; (-) strand; PAM type: NRG; PAM sequence: CAG
aaagtggacaagactacata

SEQ ID NO: 35438 - DNA, 20 bp, Artificial Sequence
  Description of Artificial Sequence: Synthetic oligonucleotide
  Target: SCN9A; (-) strand; PAM type: NRG; PAM sequence: AAG
agtctattaaaaaagtggac

SEQ ID NO: 35439 - DNA, 20 bp, Artificial Sequence
  Description of Artificial Sequence: Synthetic oligonucleotide
  Target: SCN9A; (-) strand; PAM type: NRG; PAM sequence: TGG
ctgatagtctattaaaaaag

SEQ ID NO: 35440 - DNA, 20 bp, Artificial Sequence
  Description of Artificial Sequence: Synthetic oligonucleotide
  Target: SCN9A; (-) strand; PAM type: NRG; PAM sequence: AAG
acactgatagtctattaaaa

SEQ ID NO: 35441 - DNA, 20 bp, Artificial Sequence
  Description of Artificial Sequence: Synthetic oligonucleotide
  Target: SCN9A; (-) strand; PAM type: NRG; PAM sequence: TAG
ctaaattaataaaacactga

SEQ ID NO: 35442 - DNA, 20 bp, Artificial Sequence
  Description of Artificial Sequence: Synthetic oligonucleotide
  Target: SCN9A; (-) strand; PAM type: NRG; PAM sequence: GAG
taattttattattttgttaa

SEQ ID NO: 35443 - DNA, 20 bp, Artificial Sequence
  Description of Artificial Sequence: Synthetic oligonucleotide
  Target: SCN9A; (-) strand; PAM type: NRG; PAM sequence: AAG
gctaattttattattttgtt

SEQ ID NO: 35444 - DNA, 20 bp, Artificial Sequence
  Description of Artificial Sequence: Synthetic oligonucleotide
  Target: SCN9A; (-) strand; PAM type: NRG; PAM sequence: AAG
tattgtataccacagaaaaa

SEQ ID NO: 35445 - DNA, 20 bp, Artificial Sequence
  Description of Artificial Sequence: Synthetic oligonucleotide
  Target: SCN9A; (-) strand; PAM type: NRG; PAM sequence: CAG
aatatttgtattgtatacca

SEQ ID NO: 35446 - DNA, 20 bp, Artificial Sequence
  Description of Artificial Sequence: Synthetic oligonucleotide
  Target: SCN9A; (-) strand; PAM type: NRG; PAM sequence: CAG
taaaccaaaagaaacaaaaa

SEQ ID NO: 35447 - DNA, 20 bp, Artificial Sequence
  Description of Artificial Sequence: Synthetic oligonucleotide
  Target: SCN9A; (-) strand; PAM type: NRG; PAM sequence: AAG
gataaactaccataaaccaa

SEQ ID NO: 35448 - DNA, 20 bp, Artificial Sequence
  Description of Artificial Sequence: Synthetic oligonucleotide
  Target: SCN9A; (-) strand; PAM type: NRG; PAM sequence: AAG
taaaatgtagatgcttttaa

SEQ ID NO: 35449 - DNA, 20 bp, Artificial Sequence
  Description of Artificial Sequence: Synthetic oligonucleotide
  Target: SCN9A; (-) strand; PAM type: NRG; PAM sequence: TAG
aattcaatttaattaaaatg

SEQ ID NO: 35450 - DNA, 20 bp, Artificial Sequence
  Description of Artificial Sequence: Synthetic oligonucleotide
  Target: SCN9A; (-) strand; PAM type: NRG; PAM sequence: TGG
ggagccactggagaaaggat

SEQ ID NO: 35451 - DNA, 20 bp, Artificial Sequence
  Description of Artificial Sequence: Synthetic oligonucleotide
  Target: SCN9A; (-) strand; PAM type: NRG; PAM sequence: AGG
acacaggagccactggagaa

SEQ ID NO: 35452 - DNA, 20 bp, Artificial Sequence
  Description of Artificial Sequence: Synthetic oligonucleotide
  Target: SCN9A; (-) strand; PAM type: NRG; PAM sequence: AAG
aacacaggagccactggaga

SEQ ID NO: 35453 - DNA, 20 bp, Artificial Sequence
  Description of Artificial Sequence: Synthetic oligonucleotide
  Target: SCN9A; (-) strand; PAM type: NRG; PAM sequence: GAG
ataaaacacaggagccactg

SEQ ID NO: 35454 - DNA, 20 bp, Artificial Sequence
  Description of Artificial Sequence: Synthetic oligonucleotide
  Target: SCN9A; (-) strand; PAM type: NRG; PAM sequence: TGG
atataaaacacaggagccac

SEQ ID NO: 35455 - DNA, 20 bp, Artificial Sequence
  Description of Artificial Sequence: Synthetic oligonucleotide
  Target: SCN9A; (-) strand; PAM type: NRG; PAM sequence: GAG
taagataatataaaacacag

SEQ ID NO: 35456 - DNA, 20 bp, Artificial Sequence
  Description of Artificial Sequence: Synthetic oligonucleotide
  Target: SCN9A; (-) strand; PAM type: NRG; PAM sequence: AGG
tctaagataatataaaacac

SEQ ID NO: 35457 - DNA, 20 bp, Artificial Sequence
  Description of Artificial Sequence: Synthetic oligonucleotide
  Target: SCN9A; (-) strand; PAM type: NRG; PAM sequence: CAG
ttctaagataatataaaaca

SEQ ID NO: 35458 - DNA, 20 bp, Artificial Sequence
  Description of Artificial Sequence: Synthetic oligonucleotide
  Target: SCN9A; (-) strand; PAM type: NRG; PAM sequence: AAG
tgaagtagaaattattttct

SEQ ID NO: 35459 - DNA, 20 bp, Artificial Sequence
  Description of Artificial Sequence: Synthetic oligonucleotide
  Target: SCN9A; (-) strand; PAM type: NRG; PAM sequence: TAG
cacttatgaagtacttgaag

SEQ ID NO: 35460 - DNA, 20 bp, Artificial Sequence
  Description of Artificial Sequence: Synthetic oligonucleotide
  Target: SCN9A; (-) strand; PAM type: NRG; PAM sequence: AAG
tcacacttatgaagtacttg

SEQ ID NO: 35461 - DNA, 20 bp, Artificial Sequence
  Description of Artificial Sequence: Synthetic oligonucleotide
  Target: SCN9A; (-) strand; PAM type: NRG; PAM sequence: AAG
acccagtcatcacacttatg

SEQ ID NO: 35462 - DNA, 20 bp, Artificial Sequence
  Description of Artificial Sequence: Synthetic oligonucleotide
  Target: SCN9A; (-) strand; PAM type: NRG; PAM sequence: CAG
cacatatgcatgtgaaaacc

SEQ ID NO: 35463 - DNA, 20 bp, Artificial Sequence
  Description of Artificial Sequence: Synthetic oligonucleotide
  Target: SCN9A; (-) strand; PAM type: NRG; PAM sequence: AGG
gtcattacaaggtttgaggg

SEQ ID NO: 35464 - DNA, 20 bp, Artificial Sequence
  Description of Artificial Sequence: Synthetic oligonucleotide
  Target: SCN9A; (-) strand; PAM type: NRG; PAM sequence: GAG
tgtcattacaaggtttgagg

SEQ ID NO: 35465 - DNA, 20 bp, Artificial Sequence
  Description of Artificial Sequence: Synthetic oligonucleotide
  Target: SCN9A; (-) strand; PAM type: NRG; PAM sequence: GGG
aatgtcattacaaggtttga

SEQ ID NO: 35466 - DNA, 20 bp, Artificial Sequence
  Description of Artificial Sequence: Synthetic oligonucleotide
  Target: SCN9A; (-) strand; PAM type: NRG; PAM sequence: AGG
caatgtcattacaaggtttg

SEQ ID NO: 35467 - DNA, 20 bp, Artificial Sequence
  Description of Artificial Sequence: Synthetic oligonucleotide
  Target: SCN9A; (-) strand; PAM type: NRG; PAM sequence: GAG
tcaatgtcattacaaggttt

SEQ ID NO: 35468 - DNA, 20 bp, Artificial Sequence
  Description of Artificial Sequence: Synthetic oligonucleotide
  Target: SCN9A; (-) strand; PAM type: NRG; PAM sequence: AGG
aatatatcaatgtcattaca

SEQ ID NO: 35469 - DNA, 20 bp, Artificial Sequence
  Description of Artificial Sequence: Synthetic oligonucleotide
  Target: SCN9A; (-) strand; PAM type: NRG; PAM sequence: AAG
taatatatcaatgtcattac

SEQ ID NO: 35470 - DNA, 20 bp, Artificial Sequence
  Description of Artificial Sequence: Synthetic oligonucleotide
  Target: SCN9A; (-) strand; PAM type: NRG; PAM sequence: TGG
ttttttcttttcacctgaga

SEQ ID NO: 35471 - DNA, 20 bp, Artificial Sequence
  Description of Artificial Sequence: Synthetic oligonucleotide
  Target: SCN9A; (-) strand; PAM type: NRG; PAM sequence: GAG
tttcttttttcttttcacct

SEQ ID NO: 35472 - DNA, 20 bp, Artificial Sequence
  Description of Artificial Sequence: Synthetic oligonucleotide
  Target: SCN9A; (-) strand; PAM type: NRG; PAM sequence: AGG
tgctagaagaaaacatgtga

SEQ ID NO: 35473 - DNA, 20 bp, Artificial Sequence
  Description of Artificial Sequence: Synthetic oligonucleotide
  Target: SCN9A; (-) strand; PAM type: NRG; PAM sequence: AAG
ctgctagaagaaaacatgtg

SEQ ID NO: 35474 - DNA, 20 bp, Artificial Sequence
  Description of Artificial Sequence: Synthetic oligonucleotide
  Target: SCN9A; (-) strand; PAM type: NRG; PAM sequence: AAG
acaaaccacaaaactgctag

SEQ ID NO: 35475 - DNA, 20 bp, Artificial Sequence
  Description of Artificial Sequence: Synthetic oligonucleotide
  Target: SCN9A; (-) strand; PAM type: NRG; PAM sequence: TAG
catacaaaccacaaaactgc

SEQ ID NO: 35476 - DNA, 20 bp, Artificial Sequence
  Description of Artificial Sequence: Synthetic oligonucleotide
  Target: SCN9A; (-) strand; PAM type: NRG; PAM sequence: TGG
taacccaagatacattttag

SEQ ID NO: 35477 - DNA, 20 bp, Artificial Sequence
  Description of Artificial Sequence: Synthetic oligonucleotide
  Target: SCN9A; (-) strand; PAM type: NRG; PAM sequence: TAG
acctaacccaagatacattt

SEQ ID NO: 35478 - DNA, 20 bp, Artificial Sequence
  Description of Artificial Sequence: Synthetic oligonucleotide
  Target: SCN9A; (-) strand; PAM type: NRG; PAM sequence: AAG
actgctttgccacctaaccc

SEQ ID NO: 35479 - DNA, 20 bp, Artificial Sequence
  Description of Artificial Sequence: Synthetic oligonucleotide
  Target: SCN9A; (-) strand; PAM type: NRG; PAM sequence: CAG
catgtggataaaaataaatt

SEQ ID NO: 35480 - DNA, 20 bp, Artificial Sequence
  Description of Artificial Sequence: Synthetic oligonucleotide
  Target: SCN9A; (-) strand; PAM type: NRG; PAM sequence: TGG
gggacacctgggtagtcatg

SEQ ID NO: 35481 - DNA, 20 bp, Artificial Sequence
  Description of Artificial Sequence: Synthetic oligonucleotide
  Target: SCN9A; (-) strand; PAM type: NRG; PAM sequence: TAG
ttatcattgggacacctggg

SEQ ID NO: 35482 - DNA, 20 bp, Artificial Sequence
  Description of Artificial Sequence: Synthetic oligonucleotide
  Target: SCN9A; (-) strand; PAM type: NRG; PAM sequence: GGG
tagttatcattgggacacct

SEQ ID NO: 35483 - DNA, 20 bp, Artificial Sequence
  Description of Artificial Sequence: Synthetic oligonucleotide
  Target: SCN9A; (-) strand; PAM type: NRG; PAM sequence: TGG
atagttatcattgggacacc

SEQ ID NO: 35484 - DNA, 20 bp, Artificial Sequence
  Description of Artificial Sequence: Synthetic oligonucleotide
  Target: SCN9A; (-) strand; PAM type: NRG; PAM sequence: GGG
attatttaatagttatcatt

SEQ ID NO: 35485 - DNA, 20 bp, Artificial Sequence
  Description of Artificial Sequence: Synthetic oligonucleotide
  Target: SCN9A; (-) strand; PAM type: NRG; PAM sequence: TGG
tattatttaatagttatcat

SEQ ID NO: 35486 - DNA, 20 bp, Artificial Sequence
  Description of Artificial Sequence: Synthetic oligonucleotide
  Target: SCN9A; (-) strand; PAM type: NRG; PAM sequence: TAG
ttgaaagaaatattatttaa

SEQ ID NO: 35487 - DNA, 20 bp, Artificial Sequence
  Description of Artificial Sequence: Synthetic oligonucleotide
  Target: SCN9A; (-) strand; PAM type: NRG; PAM sequence: AAG
tagcatcttaaataggttga

SEQ ID NO: 35488 - DNA, 20 bp, Artificial Sequence
  Description of Artificial Sequence: Synthetic oligonucleotide
  Target: SCN9A; (-) strand; PAM type: NRG; PAM sequence: AGG
ataaaggtagcatcttaaat

SEQ ID NO: 35489 - DNA, 20 bp, Artificial Sequence
  Description of Artificial Sequence: Synthetic oligonucleotide
  Target: SCN9A; (-) strand; PAM type: NRG; PAM sequence: TAG
tataaaggtagcatcttaaa

SEQ ID NO: 35490 - DNA, 20 bp, Artificial Sequence
  Description of Artificial Sequence: Synthetic oligonucleotide
  Target: SCN9A; (-) strand; PAM type: NRG; PAM sequence: TAG
acatatgagaattataaagg

SEQ ID NO: 35491 - DNA, 20 bp, Artificial Sequence
  Description of Artificial Sequence: Synthetic oligonucleotide
  Target: SCN9A; (-) strand; PAM type: NRG; PAM sequence: AGG
gttacatatgagaattataa

SEQ ID NO: 35492 - DNA, 20 bp, Artificial Sequence
  Description of Artificial Sequence: Synthetic oligonucleotide
  Target: SCN9A; (-) strand; PAM type: NRG; PAM sequence: AAG
agttacatatgagaattata

SEQ ID NO: 35493 - DNA, 20 bp, Artificial Sequence
  Description of Artificial Sequence: Synthetic oligonucleotide
  Target: SCN9A; (-) strand; PAM type: NRG; PAM sequence: GAG
aaatagacatagttacatat

SEQ ID NO: 35494 - DNA, 20 bp, Artificial Sequence
  Description of Artificial Sequence: Synthetic oligonucleotide
  Target: SCN9A; (-) strand; PAM type: NRG; PAM sequence: TAG
acgatatccagaaatagaca

SEQ ID NO: 35495 - DNA, 20 bp, Artificial Sequence
  Description of Artificial Sequence: Synthetic oligonucleotide
  Target: SCN9A; (-) strand; PAM type: NRG; PAM sequence: TAG
gaaaatacgatatccagaaa

SEQ ID NO: 35496 - DNA, 20 bp, Artificial Sequence
  Description of Artificial Sequence: Synthetic oligonucleotide
  Target: SCN9A; (-) strand; PAM type: NRG; PAM sequence: CAG
ttggaagaaaatacgatatc

SEQ ID NO: 35497 - DNA, 20 bp, Artificial Sequence
  Description of Artificial Sequence: Synthetic oligonucleotide
  Target: SCN9A; (-) strand; PAM type: NRG; PAM sequence: AAG
ctacatagatagttcattgg

SEQ ID NO: 35498 - DNA, 20 bp, Artificial Sequence
  Description of Artificial Sequence: Synthetic oligonucleotide
  Target: SCN9A; (-) strand; PAM type: NRG; PAM sequence: TGG
gacctacatagatagttcat

SEQ ID NO: 35499 - DNA, 20 bp, Artificial Sequence
  Description of Artificial Sequence: Synthetic oligonucleotide
  Target: SCN9A; (-) strand; PAM type: NRG; PAM sequence: TAG
agtatggtgacctacataga

SEQ ID NO: 35500 - DNA, 20 bp, Artificial Sequence
  Description of Artificial Sequence: Synthetic oligonucleotide
  Target: SCN9A; (-) strand; PAM type: NRG; PAM sequence: TAG
aaatagtatggtgacctaca

SEQ ID NO: 35501 - DNA, 20 bp, Artificial Sequence
  Description of Artificial Sequence: Synthetic oligonucleotide
  Target: SCN9A; (-) strand; PAM type: NRG; PAM sequence: TGG
atagggtaattaaaatagta

SEQ ID NO: 35502 - DNA, 20 bp, Artificial Sequence
  Description of Artificial Sequence: Synthetic oligonucleotide
  Target: SCN9A; (-) strand; PAM type: NRG; PAM sequence: TAG
tgcaaatagggtaattaaaa

SEQ ID NO: 35503 - DNA, 20 bp, Artificial Sequence
  Description of Artificial Sequence: Synthetic oligonucleotide
  Target: SCN9A; (-) strand; PAM type: NRG; PAM sequence: GGG
aatgttattttatgcaaata

SEQ ID NO: 35504 - DNA, 20 bp, Artificial Sequence
  Description of Artificial Sequence: Synthetic oligonucleotide
  Target: SCN9A; (-) strand; PAM type: NRG; PAM sequence: AGG
taatgttattttatgcaaat

SEQ ID NO: 35505 - DNA, 20 bp, Artificial Sequence
  Description of Artificial Sequence: Synthetic oligonucleotide
  Target: SCN9A; (-) strand; PAM type: NRG; PAM sequence: TAG
ataatgttattttatgcaaa

SEQ ID NO: 35506 - DNA, 20 bp, Artificial Sequence
  Description of Artificial Sequence: Synthetic oligonucleotide
  Target: SCN9A; (-) strand; PAM type: NRG; PAM sequence: TAG
cataaaagagtaatatctaa

SEQ ID NO: 35507 - DNA, 20 bp, Artificial Sequence
  Description of Artificial Sequence: Synthetic oligonucleotide
  Target: SCN9A; (-) strand; PAM type: NRG; PAM sequence: GAG
gaaattgtacacacataaaa

SEQ ID NO: 35508 - DNA, 20 bp, Artificial Sequence
  Description of Artificial Sequence: Synthetic oligonucleotide
  Target: SCN9A; (-) strand; PAM type: NRG; PAM sequence: AAG
gggaaattgtacacacataa

SEQ ID NO: 35509 - DNA, 20 bp, Artificial Sequence
  Description of Artificial Sequence: Synthetic oligonucleotide
  Target: SCN9A; (-) strand; PAM type: NRG; PAM sequence: GGG
tagataatctggatctagtt

SEQ ID NO: 35510 - DNA, 20 bp, Artificial Sequence
  Description of Artificial Sequence: Synthetic oligonucleotide
  Target: SCN9A; (-) strand; PAM type: NRG; PAM sequence: TGG
ttagataatctggatctagt

SEQ ID NO: 35511 - DNA, 20 bp, Artificial Sequence
  Description of Artificial Sequence: Synthetic oligonucleotide
  Target: SCN9A; (-) strand; PAM type: NRG; PAM sequence: TAG
ggaattagataatctggatc

SEQ ID NO: 35512 - DNA, 20 bp, Artificial Sequence
  Description of Artificial Sequence: Synthetic oligonucleotide
  Target: SCN9A; (-) strand; PAM type: NRG; PAM sequence: TGG
ccatttggaattagataatc

SEQ ID NO: 35513 - DNA, 20 bp, Artificial Sequence
  Description of Artificial Sequence: Synthetic oligonucleotide
  Target: SCN9A; (-) strand; PAM type: NRG; PAM sequence: TAG
gaaattttcccatttggaat

SEQ ID NO: 35514 - DNA, 20 bp, Artificial Sequence
  Description of Artificial Sequence: Synthetic oligonucleotide
  Target: SCN9A; (-) strand; PAM type: NRG; PAM sequence: TGG
aaaatagaaattttcccatt

SEQ ID NO: 35515 - DNA, 20 bp, Artificial Sequence
  Description of Artificial Sequence: Synthetic oligonucleotide
  Target: SCN9A; (-) strand; PAM type: NRG; PAM sequence: TAG
aatcccaatgaaaataaaaa

SEQ ID NO: 35516 - DNA, 20 bp, Artificial Sequence
  Description of Artificial Sequence: Synthetic oligonucleotide
  Target: SCN9A; (-) strand; PAM type: NRG; PAM sequence: AAG
ttttaaccttttaatttata

SEQ ID NO: 35517 - DNA, 20 bp, Artificial Sequence
  Description of Artificial Sequence: Synthetic oligonucleotide
  Target: SCN9A; (-) strand; PAM type: NRG; PAM sequence: CAG
gtcagagtgcttaccattgg

SEQ ID NO: 35518 - DNA, 20 bp, Artificial Sequence
  Description of Artificial Sequence: Synthetic oligonucleotide
  Target: SCN9A; (-) strand; PAM type: NRG; PAM sequence: TGG
agagtcagagtgcttaccat

SEQ ID NO: 35519 - DNA, 20 bp, Artificial Sequence
  Description of Artificial Sequence: Synthetic oligonucleotide
  Target: SCN9A; (-) strand; PAM type: NRG; PAM sequence: GAG
aggtattaaaaaaagagtca

SEQ ID NO: 35520 - DNA, 20 bp, Artificial Sequence
  Description of Artificial Sequence: Synthetic oligonucleotide
  Target: SCN9A; (-) strand; PAM type: NRG; PAM sequence: CAG
agaggtattaaaaaaagagt

SEQ ID NO: 35521 - DNA, 20 bp, Artificial Sequence
  Description of Artificial Sequence: Synthetic oligonucleotide
  Target: SCN9A; (-) strand; PAM type: NRG; PAM sequence: GAG
aagaagaggtattaaaaaaa

SEQ ID NO: 35522 - DNA, 20 bp, Artificial Sequence
  Description of Artificial Sequence: Synthetic oligonucleotide
  Target: SCN9A; (-) strand; PAM type: NRG; PAM sequence: AAG
taaagaagaggtattaaaaa

SEQ ID NO: 35523 - DNA, 20 bp, Artificial Sequence
  Description of Artificial Sequence: Synthetic oligonucleotide
  Target: SCN9A; (-) strand; PAM type: NRG; PAM sequence: AGG
gtttttataatctaaagaag

SEQ ID NO: 35524 - DNA, 20 bp, Artificial Sequence
  Description of Artificial Sequence: Synthetic oligonucleotide
  Target: SCN9A; (-) strand; PAM type: NRG; PAM sequence: GAG
tgtttttataatctaaagaa

SEQ ID NO: 35525 - DNA, 20 bp, Artificial Sequence
  Description of Artificial Sequence: Synthetic oligonucleotide
  Target: SCN9A; (-) strand; PAM type: NRG; PAM sequence: AAG
tttgtttttataatctaaag

SEQ ID NO: 35526 - DNA, 20 bp, Artificial Sequence
  Description of Artificial Sequence: Synthetic oligonucleotide
  Target: SCN9A; (-) strand; PAM type: NRG; PAM sequence: AAG
tactttgtttttataatcta

SEQ ID NO: 35527 - DNA, 20 bp, Artificial Sequence
  Description of Artificial Sequence: Synthetic oligonucleotide
  Target: SCN9A; (-) strand; PAM type: NRG; PAM sequence: TGG
ttttcttgtgatattatact

SEQ ID NO: 35528 - DNA, 20 bp, Artificial Sequence
  Description of Artificial Sequence: Synthetic oligonucleotide
  Target: SCN9A; (-) strand; PAM type: NRG; PAM sequence: CAG
gaggttctaaaatgagtagc

SEQ ID NO: 35529 - DNA, 20 bp, Artificial Sequence
  Description of Artificial Sequence: Synthetic oligonucleotide
  Target: SCN9A; (-) strand; PAM type: NRG; PAM sequence: TAG
attagaggttctaaaatgag

SEQ ID NO: 35530 - DNA, 20 bp, Artificial Sequence
  Description of Artificial Sequence: Synthetic oligonucleotide
  Target: SCN9A; (-) strand; PAM type: NRG; PAM sequence: GAG
aacattagaggttctaaaat

SEQ ID NO: 35531 - DNA, 20 bp, Artificial Sequence
  Description of Artificial Sequence: Synthetic oligonucleotide
  Target: SCN9A; (-) strand; PAM type: NRG; PAM sequence: AGG
attgatacacttaacattag

SEQ ID NO: 35532 - DNA, 20 bp, Artificial Sequence
  Description of Artificial Sequence: Synthetic oligonucleotide
  Target: SCN9A; (-) strand; PAM type: NRG; PAM sequence: GAG
tattgatacacttaacatta

SEQ ID NO: 35533 - DNA, 20 bp, Artificial Sequence
  Description of Artificial Sequence: Synthetic oligonucleotide
  Target: SCN9A; (-) strand; PAM type: NRG; PAM sequence: TAG
tatattgatacacttaacat

SEQ ID NO: 35534 - DNA, 20 bp, Artificial Sequence
  Description of Artificial Sequence: Synthetic oligonucleotide
  Target: SCN9A; (-) strand; PAM type: NRG; PAM sequence: TGG
agtatttaatgaaaagtatt

SEQ ID NO: 35535 - DNA, 20 bp, Artificial Sequence
  Description of Artificial Sequence: Synthetic oligonucleotide
  Target: SCN9A; (-) strand; PAM type: NRG; PAM sequence: AAG
tcaggcaagtatttaatgaa

SEQ ID NO: 35536 - DNA, 20 bp, Artificial Sequence
  Description of Artificial Sequence: Synthetic oligonucleotide
  Target: SCN9A; (-) strand; PAM type: NRG; PAM sequence: AAG
taagatttcagcaatcaggc

SEQ ID NO: 35537 - DNA, 20 bp, Artificial Sequence
  Description of Artificial Sequence: Synthetic oligonucleotide
  Target: SCN9A; (-) strand; PAM type: NRG; PAM sequence: AGG
atggtaagatttcagcaatc

SEQ ID NO: 35538 - DNA, 20 bp, Artificial Sequence
  Description of Artificial Sequence: Synthetic oligonucleotide
  Target: SCN9A; (-) strand; PAM type: NRG; PAM sequence: CAG
aatggtaagatttcagcaat

SEQ ID NO: 35539 - DNA, 20 bp, Artificial Sequence
  Description of Artificial Sequence: Synthetic oligonucleotide
  Target: SCN9A; (-) strand; PAM type: NRG; PAM sequence: CAG
aggatgcaatggtaagattt

SEQ ID NO: 35540 - DNA, 20 bp, Artificial Sequence
  Description of Artificial Sequence: Synthetic oligonucleotide
  Target: SCN9A; (-) strand; PAM type: NRG; PAM sequence: AAG
cttatgaaggatgcaatggt

SEQ ID NO: 35541 - DNA, 20 bp, Artificial Sequence
  Description of Artificial Sequence: Synthetic oligonucleotide
  Target: SCN9A; (-) strand; PAM type: NRG; PAM sequence: TGG
gttacttatgaaggatgcaa

SEQ ID NO: 35542 - DNA, 20 bp, Artificial Sequence
  Description of Artificial Sequence: Synthetic oligonucleotide
  Target: SCN9A; (-) strand; PAM type: NRG; PAM sequence: AGG
taacataatgttacttatga

SEQ ID NO: 35543 - DNA, 20 bp, Artificial Sequence
  Description of Artificial Sequence: Synthetic oligonucleotide
  Target: SCN9A; (-) strand; PAM type: NRG; PAM sequence: AAG
ttaacataatgttacttatg

SEQ ID NO: 35544 - DNA, 20 bp, Artificial Sequence
  Description of Artificial Sequence: Synthetic oligonucleotide
  Target: SCN9A; (-) strand; PAM type: NRG; PAM sequence: AAG
taagaaataataattatttt

SEQ ID NO: 35545 - DNA, 20 bp, Artificial Sequence
  Description of Artificial Sequence: Synthetic oligonucleotide
  Target: SCN9A; (-) strand; PAM type: NRG; PAM sequence: AAG
ctaccaaattaagcatttct

SEQ ID NO: 35546 - DNA, 20 bp, Artificial Sequence
  Description of Artificial Sequence: Synthetic oligonucleotide
  Target: SCN9A; (-) strand; PAM type: NRG; PAM sequence: AAG
gatttgccatctaccaaatt

SEQ ID NO: 35547 - DNA, 20 bp, Artificial Sequence
  Description of Artificial Sequence: Synthetic oligonucleotide
  Target: SCN9A; (-) strand; PAM type: NRG; PAM sequence: AAG
atattgaactactcttgttg

SEQ ID NO: 35548 - DNA, 20 bp, Artificial Sequence
  Description of Artificial Sequence: Synthetic oligonucleotide
  Target: SCN9A; (-) strand; PAM type: NRG; PAM sequence: AGG
ccataaaattgaatgatttt

SEQ ID NO: 35549 - DNA, 20 bp, Artificial Sequence
  Description of Artificial Sequence: Synthetic oligonucleotide
  Target: SCN9A; (-) strand; PAM type: NRG; PAM sequence: TAG
gccataaaattgaatgattt

SEQ ID NO: 35550 - DNA, 20 bp, Artificial Sequence
  Description of Artificial Sequence: Synthetic oligonucleotide
  Target: SCN9A; (-) strand; PAM type: NRG; PAM sequence: CAG
gcttaatttgttttgcatac

SEQ ID NO: 35551 - DNA, 20 bp, Artificial Sequence
  Description of Artificial Sequence: Synthetic oligonucleotide
  Target: SCN9A; (-) strand; PAM type: NRG; PAM sequence: CAG
atataaaattatcgcatata

SEQ ID NO: 35552 - DNA, 20 bp, Artificial Sequence
  Description of Artificial Sequence: Synthetic oligonucleotide
  Target: SCN9A; (-) strand; PAM type: NRG; PAM sequence: CAG
aatttagaaatagtccctat

SEQ ID NO: 35553 - DNA, 20 bp, Artificial Sequence
  Description of Artificial Sequence: Synthetic oligonucleotide
  Target: SCN9A; (-) strand; PAM type: NRG; PAM sequence: TAG
ataatcatagaatttagaaa

SEQ ID NO: 35554 - DNA, 20 bp, Artificial Sequence
  Description of Artificial Sequence: Synthetic oligonucleotide
  Target: SCN9A; (-) strand; PAM type: NRG; PAM sequence: TAG
attttaataatcatagaatt

SEQ ID NO: 35555 - DNA, 20 bp, Artificial Sequence
  Description of Artificial Sequence: Synthetic oligonucleotide
  Target: SCN9A; (-) strand; PAM type: NRG; PAM sequence: TAG
tcacaatattttaataatca

SEQ ID NO: 35556 - DNA, 20 bp, Artificial Sequence
  Description of Artificial Sequence: Synthetic oligonucleotide
  Target: SCN9A; (-) strand; PAM type: NRG; PAM sequence: GGG
taatataaatgattattaca

SEQ ID NO: 35557 - DNA, 20 bp, Artificial Sequence
  Description of Artificial Sequence: Synthetic oligonucleotide
  Target: SCN9A; (-) strand; PAM type: NRG; PAM sequence: AGG
ataatataaatgattattac

SEQ ID NO: 35558 - DNA, 20 bp, Artificial Sequence
  Description of Artificial Sequence: Synthetic oligonucleotide
  Target: SCN9A; (-) strand; PAM type: NRG; PAM sequence: CAG
tataatataaatgattatta

SEQ ID NO: 35559 - DNA, 20 bp, Artificial Sequence
  Description of Artificial Sequence: Synthetic oligonucleotide
  Target: SCN9A; (-) strand; PAM type: NRG; PAM sequence: AAG
tattttaaaaggctatacat

SEQ ID NO: 35560 - DNA, 20 bp, Artificial Sequence
  Description of Artificial Sequence: Synthetic oligonucleotide
  Target: SCN9A; (-) strand; PAM type: NRG; PAM sequence: AGG
gaggaatactatattttaaa

SEQ ID NO: 35561 - DNA, 20 bp, Artificial Sequence
  Description of Artificial Sequence: Synthetic oligonucleotide
  Target: SCN9A; (-) strand; PAM type: NRG; PAM sequence: AAG
tgaggaatactatattttaa

SEQ ID NO: 35562 - DNA, 20 bp, Artificial Sequence
  Description of Artificial Sequence: Synthetic oligonucleotide
  Target: SCN9A; (-) strand; PAM type: NRG; PAM sequence: AGG
tttcatttcttataaacttg

SEQ ID NO: 35563 - DNA, 20 bp, Artificial Sequence
  Description of Artificial Sequence: Synthetic oligonucleotide
  Target: SCN9A; (-) strand; PAM type: NRG; PAM sequence: GAG
ctttcatttcttataaactt

SEQ ID NO: 35564 - DNA, 20 bp, Artificial Sequence
  Description of Artificial Sequence: Synthetic oligonucleotide
  Target: SCN9A; (-) strand; PAM type: NRG; PAM sequence: CGG
taggcgtgagccaccacgcc

SEQ ID NO: 35565 - DNA, 20 bp, Artificial Sequence
  Description of Artificial Sequence: Synthetic oligonucleotide
  Target: SCN9A; (-) strand; PAM type: NRG; PAM sequence: GAG
agtgctgggattataggcgt

SEQ ID NO: 35566 - DNA, 20 bp, Artificial Sequence
  Description of Artificial Sequence: Synthetic oligonucleotide
  Target: SCN9A; (-) strand; PAM type: NRG; PAM sequence: AGG
tcccaaagtgctgggattat

SEQ ID NO: 35567 - DNA, 20 bp, Artificial Sequence
  Description of Artificial Sequence: Synthetic oligonucleotide
  Target: SCN9A; (-) strand; PAM type: NRG; PAM sequence: TAG
ttcccaaagtgctgggatta

SEQ ID NO: 35568 - DNA, 20 bp, Artificial Sequence
  Description of Artificial Sequence: Synthetic oligonucleotide
  Target: SCN9A; (-) strand; PAM type: NRG; PAM sequence: GGG
cctcggcttcccaaagtgct

SEQ ID NO: 35569 - DNA, 20 bp, Artificial Sequence
  Description of Artificial Sequence: Synthetic oligonucleotide
  Target: SCN9A; (-) strand; PAM type: NRG; PAM sequence: TGG
gcctcggcttcccaaagtgc

SEQ ID NO: 35570 - DNA, 20 bp, Artificial Sequence
  Description of Artificial Sequence: Synthetic oligonucleotide
  Target: SCN9A; (-) strand; PAM type: NRG; PAM sequence: AAG
ccgcctgcctcggcttccca

SEQ ID NO: 35571 - DNA, 20 bp, Artificial Sequence
  Description of Artificial Sequence: Synthetic oligonucleotide
  Target: SCN9A; (-) strand; PAM type: NRG; PAM sequence: CGG
ctcaggtgatccgcctgcct

SEQ ID NO: 35572 - DNA, 20 bp, Artificial Sequence
  Description of Artificial Sequence: Synthetic oligonucleotide
  Target: SCN9A; (-) strand; PAM type: NRG; PAM sequence: AGG
ggtcttgaattcctgacctc

SEQ ID NO: 35573 - DNA, 20 bp, Artificial Sequence
  Description of Artificial Sequence: Synthetic oligonucleotide
  Target: SCN9A; (-) strand; PAM type: NRG; PAM sequence: CAG
tggtcttgaattcctgacct

SEQ ID NO: 35574 - DNA, 20 bp, Artificial Sequence
  Description of Artificial Sequence: Synthetic oligonucleotide
  Target: SCN9A; (-) strand; PAM type: NRG; PAM sequence: TGG
tttctccatgttggtcaggc

SEQ ID NO: 35575 - DNA, 20 bp, Artificial Sequence
  Description of Artificial Sequence: Synthetic oligonucleotide
  Target: SCN9A; (-) strand; PAM type: NRG; PAM sequence: AGG
ggggtttctccatgttggtc

SEQ ID NO: 35576 - DNA, 20 bp, Artificial Sequence
  Description of Artificial Sequence: Synthetic oligonucleotide
  Target: SCN9A; (-) strand; PAM type: NRG; PAM sequence: CAG
cggggtttctccatgttggt

SEQ ID NO: 35577 - DNA, 20 bp, Artificial Sequence
  Description of Artificial Sequence: Synthetic oligonucleotide
  Target: SCN9A; (-) strand; PAM type: NRG; PAM sequence: TGG
gagacggggtttctccatgt

SEQ ID NO: 35578 - DNA, 20 bp, Artificial Sequence
  Description of Artificial Sequence: Synthetic oligonucleotide
  Target: SCN9A; (-) strand; PAM type: NRG; PAM sequence: GGG
ttgtatttttagtagagacg

SEQ ID NO: 35579 - DNA, 20 bp, Artificial Sequence
  Description of Artificial Sequence: Synthetic oligonucleotide
  Target: SCN9A; (-) strand; PAM type: NRG; PAM sequence: GGG
tttgtatttttagtagagac

SEQ ID NO: 35580 - DNA, 20 bp, Artificial Sequence
  Description of Artificial Sequence: Synthetic oligonucleotide
  Target: SCN9A; (-) strand; PAM type: NRG; PAM sequence: CGG
ttttgtatttttagtagaga

SEQ ID NO: 35581 - DNA, 20 bp, Artificial Sequence
  Description of Artificial Sequence: Synthetic oligonucleotide
  Target: SCN9A; (-) strand; PAM type: NRG; PAM sequence: GAG
ctaattttgtatttttagta

SEQ ID NO: 35582 - DNA, 20 bp, Artificial Sequence
  Description of Artificial Sequence: Synthetic oligonucleotide
  Target: SCN9A; (-) strand; PAM type: NRG; PAM sequence: TAG
agctaattttgtatttttag

SEQ ID NO: 35583 - DNA, 20 bp, Artificial Sequence
  Description of Artificial Sequence: Synthetic oligonucleotide
  Target: SCN9A; (-) strand; PAM type: NRG; PAM sequence: TAG
accagctaattttgtatttt

SEQ ID NO: 35584 - DNA, 20 bp, Artificial Sequence
  Description of Artificial Sequence: Synthetic oligonucleotide
  Target: SCN9A; (-) strand; PAM type: NRG; PAM sequence: CAG
caggcatgcgccaccatgac

SEQ ID NO: 35585 - DNA, 20 bp, Artificial Sequence
  Description of Artificial Sequence: Synthetic oligonucleotide
  Target: SCN9A; (-) strand; PAM type: NRG; PAM sequence: AGG
tcctgagtagctgggattac

SEQ ID NO: 35586 - DNA, 20 bp, Artificial Sequence
  Description of Artificial Sequence: Synthetic oligonucleotide
  Target: SCN9A; (-) strand; PAM type: NRG; PAM sequence: CAG
ctcctgagtagctgggatta

SEQ ID NO: 35587 - DNA, 20 bp, Artificial Sequence
  Description of Artificial Sequence: Synthetic oligonucleotide
  Target: SCN9A; (-) strand; PAM type: NRG; PAM sequence: GGG
cctcagcctcctgagtagct

SEQ ID NO: 35588 - DNA, 20 bp, Artificial Sequence
  Description of Artificial Sequence: Synthetic oligonucleotide
  Target: SCN9A; (-) strand; PAM type: NRG; PAM sequence: TGG
gcctcagcctcctgagtagc

SEQ ID NO: 35589 - DNA, 20 bp, Artificial Sequence
  Description of Artificial Sequence: Synthetic oligonucleotide
  Target: SCN9A; (-) strand; PAM type: NRG; PAM sequence: TAG
tcctgcctcagcctcctgag

SEQ ID NO: 35590 - DNA, 20 bp, Artificial Sequence
  Description of Artificial Sequence: Synthetic oligonucleotide
  Target: SCN9A; (-) strand; PAM type: NRG; PAM sequence: GAG
ttctcctgcctcagcctcct

SEQ ID NO: 35591 - DNA, 20 bp, Artificial Sequence
  Description of Artificial Sequence: Synthetic oligonucleotide
  Target: SCN9A; (-) strand; PAM type: NRG; PAM sequence: CAG
ttcaagcagttctcctgcct

SEQ ID NO: 35592 - DNA, 20 bp, Artificial Sequence
  Description of Artificial Sequence: Synthetic oligonucleotide
  Target: SCN9A; (-) strand; PAM type: NRG; PAM sequence: CAG
atccacctcccgggttcaag

SEQ ID NO: 35593 - DNA, 20 bp, Artificial Sequence
  Description of Artificial Sequence: Synthetic oligonucleotide
  Target: SCN9A; (-) strand; PAM type: NRG; PAM sequence: AAG
acaatccacctcccgggttc

SEQ ID NO: 35594 - DNA, 20 bp, Artificial Sequence
  Description of Artificial Sequence: Synthetic oligonucleotide
  Target: SCN9A; (-) strand; PAM type: NRG; PAM sequence: GGG
ctcactacaatccacctccc

SEQ ID NO: 35595 - DNA, 20 bp, Artificial Sequence
  Description of Artificial Sequence: Synthetic oligonucleotide
  Target: SCN9A; (-) strand; PAM type: NRG; PAM sequence: CGG
gctcactacaatccacctcc

SEQ ID NO: 35596 - DNA, 20 bp, Artificial Sequence
  Description of Artificial Sequence: Synthetic oligonucleotide
  Target: SCN9A; (-) strand; PAM type: NRG; PAM sequence: CAG
ggagtgcaatggcccgatct

SEQ ID NO: 35597 - DNA, 20 bp, Artificial Sequence
  Description of Artificial Sequence: Synthetic oligonucleotide
  Target: SCN9A; (-) strand; PAM type: NRG; PAM sequence: TGG
ttgcccaggctggagtgcaa

SEQ ID NO: 35598 - DNA, 20 bp, Artificial Sequence
  Description of Artificial Sequence: Synthetic oligonucleotide
  Target: SCN9A; (-) strand; PAM type: NRG; PAM sequence: GAG
cgctcttgttgcccaggctg

SEQ ID NO: 35599 - DNA, 20 bp, Artificial Sequence
  Description of Artificial Sequence: Synthetic oligonucleotide
  Target: SCN9A; (-) strand; PAM type: NRG; PAM sequence: TGG
ttcgctcttgttgcccaggc

SEQ ID NO: 35600 - DNA, 20 bp, Artificial Sequence
  Description of Artificial Sequence: Synthetic oligonucleotide
  Target: SCN9A; (-) strand; PAM type: NRG; PAM sequence: AGG
gagtttcgctcttgttgccc

SEQ ID NO: 35601 - DNA, 20 bp, Artificial Sequence
  Description of Artificial Sequence: Synthetic oligonucleotide
  Target: SCN9A; (-) strand; PAM type: NRG; PAM sequence: CAG
agagtttcgctcttgttgcc

SEQ ID NO: 35602 - DNA, 20 bp, Artificial Sequence
  Description of Artificial Sequence: Synthetic oligonucleotide
  Target: SCN9A; (-) strand; PAM type: NRG; PAM sequence: GAG
ttttttttttttttgagaca

SEQ ID NO: 35603 - DNA, 20 bp, Artificial Sequence
  Description of Artificial Sequence: Synthetic oligonucleotide
  Target: SCN9A; (-) strand; PAM type: NRG; PAM sequence: CAG
ttttttttttttttttgaga

SEQ ID NO: 35604 - DNA, 20 bp, Artificial Sequence
  Description of Artificial Sequence: Synthetic oligonucleotide
  Target: SCN9A; (-) strand; PAM type: NRG; PAM sequence: GAG
tttctttttttttttttttt

SEQ ID NO: 35605 - DNA, 20 bp, Artificial Sequence
  Description of Artificial Sequence: Synthetic oligonucleotide
  Target: SCN9A; (-) strand; PAM type: NRG; PAM sequence: AAG
cccagggtaatacacttctt

SEQ ID NO: 35606 - DNA, 20 bp, Artificial Sequence
  Description of Artificial Sequence: Synthetic oligonucleotide
  Target: SCN9A; (-) strand; PAM type: NRG; PAM sequence: GGG
actaatcttaagttttccca

SEQ ID NO: 35607 - DNA, 20 bp, Artificial Sequence
  Description of Artificial Sequence: Synthetic oligonucleotide
  Target: SCN9A; (-) strand; PAM type: NRG; PAM sequence: AGG
cactaatcttaagttttccc

SEQ ID NO: 35608 - DNA, 20 bp, Artificial Sequence
  Description of Artificial Sequence: Synthetic oligonucleotide
  Target: SCN9A; (-) strand; PAM type: NRG; PAM sequence: CAG
acactaatcttaagttttcc

SEQ ID NO: 35609 - DNA, 20 bp, Artificial Sequence
  Description of Artificial Sequence: Synthetic oligonucleotide
  Target: SCN9A; (-) strand; PAM type: NRG; PAM sequence: AAG
caaatgttgacactaatctt

SEQ ID NO: 35610 - DNA, 20 bp, Artificial Sequence
  Description of Artificial Sequence: Synthetic oligonucleotide
  Target: SCN9A; (-) strand; PAM type: NRG; PAM sequence: CAG
attaaaacgttcagatatgc

SEQ ID NO: 35611 - DNA, 20 bp, Artificial Sequence
  Description of Artificial Sequence: Synthetic oligonucleotide
  Target: SCN9A; (-) strand; PAM type: NRG; PAM sequence: CAG
gaattttttattaaaacgtt

SEQ ID NO: 35612 - DNA, 20 bp, Artificial Sequence
  Description of Artificial Sequence: Synthetic oligonucleotide
  Target: SCN9A; (-) strand; PAM type: NRG; PAM sequence: AAG
tttatacatgctgtacagat

SEQ ID NO: 35613 - DNA, 20 bp, Artificial Sequence
  Description of Artificial Sequence: Synthetic oligonucleotide
  Target: SCN9A; (-) strand; PAM type: NRG; PAM sequence: CAG
cttcctttatacatgctgta

SEQ ID NO: 35614 - DNA, 20 bp, Artificial Sequence
  Description of Artificial Sequence: Synthetic oligonucleotide
  Target: SCN9A; (-) strand; PAM type: NRG; PAM sequence: AAG
gggatttaacgtgaactaag

SEQ ID NO: 35615 - DNA, 20 bp, Artificial Sequence
  Description of Artificial Sequence: Synthetic oligonucleotide
  Target: SCN9A; (-) strand; PAM type: NRG; PAM sequence: AAG
gatgggatttaacgtgaact

SEQ ID NO: 35616 - DNA, 20 bp, Artificial Sequence
  Description of Artificial Sequence: Synthetic oligonucleotide
  Target: SCN9A; (-) strand; PAM type: NRG; PAM sequence: GGG
gtcttaactaacagagagat

SEQ ID NO: 35617 - DNA, 20 bp, Artificial Sequence
  Description of Artificial Sequence: Synthetic oligonucleotide
  Target: SCN9A; (-) strand; PAM type: NRG; PAM sequence: TGG
agtcttaactaacagagaga

SEQ ID NO: 35618 - DNA, 20 bp, Artificial Sequence
  Description of Artificial Sequence: Synthetic oligonucleotide
  Target: SCN9A; (-) strand; PAM type: NRG; PAM sequence: GAG
ataaagtcttaactaacaga

SEQ ID NO: 35619 - DNA, 20 bp, Artificial Sequence
  Description of Artificial Sequence: Synthetic oligonucleotide
  Target: SCN9A; (-) strand; PAM type: NRG; PAM sequence: GAG
caataaagtcttaactaaca

SEQ ID NO: 35620 - DNA, 20 bp, Artificial Sequence
  Description of Artificial Sequence: Synthetic oligonucleotide
  Target: SCN9A; (-) strand; PAM type: NRG; PAM sequence: CAG
ctcaataaagtcttaactaa

SEQ ID NO: 35621 - DNA, 20 bp, Artificial Sequence
  Description of Artificial Sequence: Synthetic oligonucleotide
  Target: SCN9A; (-) strand; PAM type: NRG; PAM sequence: AAG
ataattttgtgctctcaata

SEQ ID NO: 35622 - DNA, 20 bp, Artificial Sequence
  Description of Artificial Sequence: Synthetic oligonucleotide
  Target: SCN9A; (-) strand; PAM type: NRG; PAM sequence: AAG
agaacctgttctgcagccat

SEQ ID NO: 35623 - DNA, 20 bp, Artificial Sequence
  Description of Artificial Sequence: Synthetic oligonucleotide
  Target: SCN9A; (-) strand; PAM type: NRG; PAM sequence: CAG
agggtatagaacctgttctg

SEQ ID NO: 35624 - DNA, 20 bp, Artificial Sequence
  Description of Artificial Sequence: Synthetic oligonucleotide
  Target: SCN9A; (-) strand; PAM type: NRG; PAM sequence: TAG
taattatttaaataagggta

SEQ ID NO: 35625 - DNA, 20 bp, Artificial Sequence
  Description of Artificial Sequence: Synthetic oligonucleotide
  Target: SCN9A; (-) strand; PAM type: NRG; PAM sequence: GGG
ctctctaattatttaaataa

SEQ ID NO: 35626 - DNA, 20 bp, Artificial Sequence
  Description of Artificial Sequence: Synthetic oligonucleotide
  Target: SCN9A; (-) strand; PAM type: NRG; PAM sequence: AGG
tctctctaattatttaaata

SEQ ID NO: 35627 - DNA, 20 bp, Artificial Sequence
  Description of Artificial Sequence: Synthetic oligonucleotide
  Target: SCN9A; (-) strand; PAM type: NRG; PAM sequence: AAG
ttctctctaattatttaaat

SEQ ID NO: 35628 - DNA, 20 bp, Artificial Sequence
  Description of Artificial Sequence: Synthetic oligonucleotide
  Target: SCN9A; (-) strand; PAM type: NRG; PAM sequence: TGG
ggatacatgtataataatat

SEQ ID NO: 35629 - DNA, 20 bp, Artificial Sequence
  Description of Artificial Sequence: Synthetic oligonucleotide
  Target: SCN9A; (-) strand; PAM type: NRG; PAM sequence: TGG
tgttgatgttttgagggaag

SEQ ID NO: 35630 - DNA, 20 bp, Artificial Sequence
  Description of Artificial Sequence: Synthetic oligonucleotide
  Target: SCN9A; (-) strand; PAM type: NRG; PAM sequence: AAG
tcatgttgatgttttgaggg

SEQ ID NO: 35631 - DNA, 20 bp, Artificial Sequence
  Description of Artificial Sequence: Synthetic oligonucleotide
  Target: SCN9A; (-) strand; PAM type: NRG; PAM sequence: GGG
aaatcatgttgatgttttga

SEQ ID NO: 35632 - DNA, 20 bp, Artificial Sequence
  Description of Artificial Sequence: Synthetic oligonucleotide
  Target: SCN9A; (-) strand; PAM type: NRG; PAM sequence: AGG
taaatcatgttgatgttttg

SEQ ID NO: 35633 - DNA, 20 bp, Artificial Sequence
  Description of Artificial Sequence: Synthetic oligonucleotide
  Target: SCN9A; (-) strand; PAM type: NRG; PAM sequence: GAG
ctaaatcatgttgatgtttt

SEQ ID NO: 35634 - DNA, 20 bp, Artificial Sequence
  Description of Artificial Sequence: Synthetic oligonucleotide
  Target: SCN9A; (-) strand; PAM type: NRG; PAM sequence: AAG
cctaagtctgcctggtgcca

SEQ ID NO: 35635 - DNA, 20 bp, Artificial Sequence
  Description of Artificial Sequence: Synthetic oligonucleotide
  Target: SCN9A; (-) strand; PAM type: NRG; PAM sequence: TGG
aattcaaacctaagtctgcc

SEQ ID NO: 35636 - DNA, 20 bp, Artificial Sequence
  Description of Artificial Sequence: Synthetic oligonucleotide
  Target: SCN9A; (-) strand; PAM type: NRG; PAM sequence: AAG
taaacaggaaattcaaacct

SEQ ID NO: 35637 - DNA, 20 bp, Artificial Sequence
  Description of Artificial Sequence: Synthetic oligonucleotide
  Target: SCN9A; (-) strand; PAM type: NRG; PAM sequence: AGG
gctaattatatggaataaac

SEQ ID NO: 35638 - DNA, 20 bp, Artificial Sequence
  Description of Artificial Sequence: Synthetic oligonucleotide
  Target: SCN9A; (-) strand; PAM type: NRG; PAM sequence: CAG
agctaattatatggaataaa

SEQ ID NO: 35639 - DNA, 20 bp, Artificial Sequence
  Description of Artificial Sequence: Synthetic oligonucleotide
  Target: SCN9A; (-) strand; PAM type: NRG; PAM sequence: TGG
atgctgcagagctaattata

SEQ ID NO: 35640 - DNA, 20 bp, Artificial Sequence
  Description of Artificial Sequence: Synthetic oligonucleotide
  Target: SCN9A; (-) strand; PAM type: NRG; PAM sequence: GAG
ggaatttgcataatgctgca

SEQ ID NO: 35641 - DNA, 20 bp, Artificial Sequence
  Description of Artificial Sequence: Synthetic oligonucleotide
  Target: SCN9A; (-) strand; PAM type: NRG; PAM sequence: CAG
ggggaatttgcataatgctg

SEQ ID NO: 35642 - DNA, 20 bp, Artificial Sequence
  Description of Artificial Sequence: Synthetic oligonucleotide
  Target: SCN9A; (-) strand; PAM type: NRG; PAM sequence: GGG
atttctctctttcatttatg

SEQ ID NO: 35643 - DNA, 20 bp, Artificial Sequence
  Description of Artificial Sequence: Synthetic oligonucleotide
  Target: SCN9A; (-) strand; PAM type: NRG; PAM sequence: GGG
tatttctctctttcatttat

SEQ ID NO: 35644 - DNA, 20 bp, Artificial Sequence
  Description of Artificial Sequence: Synthetic oligonucleotide
  Target: SCN9A; (-) strand; PAM type: NRG; PAM sequence: TGG
atatttctctctttcattta

SEQ ID NO: 35645 - DNA, 20 bp, Artificial Sequence
  Description of Artificial Sequence: Synthetic oligonucleotide
  Target: SCN9A; (-) strand; PAM type: NRG; PAM sequence: CAG
tacatgataactttataaga

SEQ ID NO: 35646 - DNA, 20 bp, Artificial Sequence
  Description of Artificial Sequence: Synthetic oligonucleotide
  Target: SCN9A; (-) strand; PAM type: NRG; PAM sequence: AAG
attctacatgataactttat

SEQ ID NO: 35647 - DNA, 20 bp, Artificial Sequence
  Description of Artificial Sequence: Synthetic oligonucleotide
  Target: SCN9A; (-) strand; PAM type: NRG; PAM sequence: AGG
tttagcctaggcactgtggt

SEQ ID NO: 35648 - DNA, 20 bp, Artificial Sequence
  Description of Artificial Sequence: Synthetic oligonucleotide
  Target: SCN9A; (-) strand; PAM type: NRG; PAM sequence: TAG
atttagcctaggcactgtgg

SEQ ID NO: 35649 - DNA, 20 bp, Artificial Sequence
  Description of Artificial Sequence: Synthetic oligonucleotide
  Target: SCN9A; (-) strand; PAM type: NRG; PAM sequence: TGG
tttatttagcctaggcactg

SEQ ID NO: 35650 - DNA, 20 bp, Artificial Sequence
  Description of Artificial Sequence: Synthetic oligonucleotide
  Target: SCN9A; (-) strand; PAM type: NRG; PAM sequence: AGG
tgctgttatttatttagcct

SEQ ID NO: 35651 - DNA, 20 bp, Artificial Sequence
  Description of Artificial Sequence: Synthetic oligonucleotide
  Target: SCN9A; (-) strand; PAM type: NRG; PAM sequence: TAG
ttgctgttatttatttagcc

SEQ ID NO: 35652 - DNA, 20 bp, Artificial Sequence
  Description of Artificial Sequence: Synthetic oligonucleotide
  Target: SCN9A; (-) strand; PAM type: NRG; PAM sequence: TAG
taatcttgctgttatttatt

SEQ ID NO: 35653 - DNA, 20 bp, Artificial Sequence
  Description of Artificial Sequence: Synthetic oligonucleotide
  Target: SCN9A; (-) strand; PAM type: NRG; PAM sequence: AGG
ttcagtctgtatagggaaga

SEQ ID NO: 35654 - DNA, 20 bp, Artificial Sequence
  Description of Artificial Sequence: Synthetic oligonucleotide
  Target: SCN9A; (-) strand; PAM type: NRG; PAM sequence: AAG
tttcagtctgtatagggaag

SEQ ID NO: 35655 - DNA, 20 bp, Artificial Sequence
  Description of Artificial Sequence: Synthetic oligonucleotide
  Target: SCN9A; (-) strand; PAM type: NRG; PAM sequence: AAG
aaatttcagtctgtataggg

SEQ ID NO: 35656 - DNA, 20 bp, Artificial Sequence
  Description of Artificial Sequence: Synthetic oligonucleotide
  Target: SCN9A; (-) strand; PAM type: NRG; PAM sequence: GGG
taaaaatttcagtctgtata

SEQ ID NO: 35657 - DNA, 20 bp, Artificial Sequence
  Description of Artificial Sequence: Synthetic oligonucleotide
  Target: SCN9A; (-) strand; PAM type: NRG; PAM sequence: AGG
ttaaaaatttcagtctgtat

SEQ ID NO: 35658 - DNA, 20 bp, Artificial Sequence
  Description of Artificial Sequence: Synthetic oligonucleotide
  Target: SCN9A; (-) strand; PAM type: NRG; PAM sequence: TAG
tttaaaaatttcagtctgta

SEQ ID NO: 35659 - DNA, 20 bp, Artificial Sequence
  Description of Artificial Sequence: Synthetic oligonucleotide
  Target: SCN9A; (-) strand; PAM type: NRG; PAM sequence: CAG
ggcttattatttaaaaattt

SEQ ID NO: 35660 - DNA, 20 bp, Artificial Sequence
  Description of Artificial Sequence: Synthetic oligonucleotide
  Target: SCN9A; (-) strand; PAM type: NRG; PAM sequence: TGG
tgtgtttattggccaactca

SEQ ID NO: 35661 - DNA, 20 bp, Artificial Sequence
  Description of Artificial Sequence: Synthetic oligonucleotide
  Target: SCN9A; (-) strand; PAM type: NRG; PAM sequence: TGG
tcgtaaggttttgtgtttat

SEQ ID NO: 35662 - DNA, 20 bp, Artificial Sequence
  Description of Artificial Sequence: Synthetic oligonucleotide
  Target: SCN9A; (-) strand; PAM type: NRG; PAM sequence: AGG
ctccacataagattttcgta

SEQ ID NO: 35663 - DNA, 20 bp, Artificial Sequence
  Description of Artificial Sequence: Synthetic oligonucleotide
  Target: SCN9A; (-) strand; PAM type: NRG; PAM sequence: AAG
actccacataagattttcgt

SEQ ID NO: 35664 - DNA, 20 bp, Artificial Sequence
  Description of Artificial Sequence: Synthetic oligonucleotide
  Target: SCN9A; (-) strand; PAM type: NRG; PAM sequence: AAG
gtaacaaatatactccacat

SEQ ID NO: 35665 - DNA, 20 bp, Artificial Sequence
  Description of Artificial Sequence: Synthetic oligonucleotide
  Target: SCN9A; (-) strand; PAM type: NRG; PAM sequence: AGG
tgtttggcaagataaaacat

SEQ ID NO: 35666 - DNA, 20 bp, Artificial Sequence
  Description of Artificial Sequence: Synthetic oligonucleotide
  Target: SCN9A; (-) strand; PAM type: NRG; PAM sequence: TAG
atgtttggcaagataaaaca

SEQ ID NO: 35667 - DNA, 20 bp, Artificial Sequence
  Description of Artificial Sequence: Synthetic oligonucleotide
  Target: SCN9A; (-) strand; PAM type: NRG; PAM sequence: AAG
aagccataaacatgtttggc

SEQ ID NO: 35668 - DNA, 20 bp, Artificial Sequence
  Description of Artificial Sequence: Synthetic oligonucleotide
  Target: SCN9A; (-) strand; PAM type: NRG; PAM sequence: TGG
attaaagccataaacatgtt

SEQ ID NO: 35669 - DNA, 20 bp, Artificial Sequence
  Description of Artificial Sequence: Synthetic oligonucleotide
  Target: SCN9A; (-) strand; PAM type: NRG; PAM sequence: AAG
cagatctatattttaaatta

SEQ ID NO: 35670 - DNA, 20 bp, Artificial Sequence
  Description of Artificial Sequence: Synthetic oligonucleotide
  Target: SCN9A; (-) strand; PAM type: NRG; PAM sequence: CAG
gctgtcttactattttactg

SEQ ID NO: 35671 - DNA, 20 bp, Artificial Sequence
  Description of Artificial Sequence: Synthetic oligonucleotide
  Target: SCN9A; (-) strand; PAM type: NRG; PAM sequence: GGG
gagccatgaatttaacaact

SEQ ID NO: 35672 - DNA, 20 bp, Artificial Sequence
  Description of Artificial Sequence: Synthetic oligonucleotide
  Target: SCN9A; (-) strand; PAM type: NRG; PAM sequence: TGG
ggagccatgaatttaacaac

SEQ ID NO: 35673 - DNA, 20 bp, Artificial Sequence
  Description of Artificial Sequence: Synthetic oligonucleotide
  Target: SCN9A; (-) strand; PAM type: NRG; PAM sequence: GAG
cccatgcctctctcactctg

SEQ ID NO: 35674 - DNA, 20 bp, Artificial Sequence
  Description of Artificial Sequence: Synthetic oligonucleotide
  Target: SCN9A; (-) strand; PAM type: NRG; PAM sequence: TGG
aacccatgcctctctcactc

SEQ ID NO: 35675 - DNA, 20 bp, Artificial Sequence
  Description of Artificial Sequence: Synthetic oligonucleotide
  Target: SCN9A; (-) strand; PAM type: NRG; PAM sequence: GGG
agctagtaagcagtagagat

SEQ ID NO: 35676 - DNA, 20 bp, Artificial Sequence
  Description of Artificial Sequence: Synthetic oligonucleotide
  Target: SCN9A; (-) strand; PAM type: NRG; PAM sequence: TGG
aagctagtaagcagtagaga

SEQ ID NO: 35677 - DNA, 20 bp, Artificial Sequence
  Description of Artificial Sequence: Synthetic oligonucleotide
  Target: SCN9A; (-) strand; PAM type: NRG; PAM sequence: GAG
acataagctagtaagcagta

SEQ ID NO: 35678 - DNA, 20 bp, Artificial Sequence
  Description of Artificial Sequence: Synthetic oligonucleotide
  Target: SCN9A; (-) strand; PAM type: NRG; PAM sequence: TAG
ggacataagctagtaagcag

SEQ ID NO: 35679 - DNA, 20 bp, Artificial Sequence
  Description of Artificial Sequence: Synthetic oligonucleotide
  Target: SCN9A; (-) strand; PAM type: NRG; PAM sequence: CAG
caaggacataagctagtaag

SEQ ID NO: 35680 - DNA, 20 bp, Artificial Sequence
  Description of Artificial Sequence: Synthetic oligonucleotide
  Target: SCN9A; (-) strand; PAM type: NRG; PAM sequence: AAG
ccccaaggacataagctagt

SEQ ID NO: 35681 - DNA, 20 bp, Artificial Sequence
  Description of Artificial Sequence: Synthetic oligonucleotide
  Target: SCN9A; (-) strand; PAM type: NRG; PAM sequence: TAG
aattccccaaggacataagc

SEQ ID NO: 35682 - DNA, 20 bp, Artificial Sequence
  Description of Artificial Sequence: Synthetic oligonucleotide
  Target: SCN9A; (-) strand; PAM type: NRG; PAM sequence: AAG
attaaattccccaaggacat

SEQ ID NO: 35683 - DNA, 20 bp, Artificial Sequence
  Description of Artificial Sequence: Synthetic oligonucleotide
  Target: SCN9A; (-) strand; PAM type: NRG; PAM sequence: AGG
gaagttaattaaattcccca

SEQ ID NO: 35684 - DNA, 20 bp, Artificial Sequence
  Description of Artificial Sequence: Synthetic oligonucleotide
  Target: SCN9A; (-) strand; PAM type: NRG; PAM sequence: AAG
agaagttaattaaattcccc

SEQ ID NO: 35685 - DNA, 20 bp, Artificial Sequence
  Description of Artificial Sequence: Synthetic oligonucleotide
  Target: SCN9A; (-) strand; PAM type: NRG; PAM sequence: AAG
ataagaactgagctttagag

SEQ ID NO: 35686 - DNA, 20 bp, Artificial Sequence
  Description of Artificial Sequence: Synthetic oligonucleotide
  Target: SCN9A; (-) strand; PAM type: NRG; PAM sequence: GAG
tatataagaactgagcttta

SEQ ID NO: 35687 - DNA, 20 bp, Artificial Sequence
  Description of Artificial Sequence: Synthetic oligonucleotide
  Target: SCN9A; (-) strand; PAM type: NRG; PAM sequence: TAG
gctatataagaactgagctt

SEQ ID NO: 35688 - DNA, 20 bp, Artificial Sequence
  Description of Artificial Sequence: Synthetic oligonucleotide
  Target: SCN9A; (-) strand; PAM type: NRG; PAM sequence: GAG
cggtttgctatataagaact

SEQ ID NO: 35689 - DNA, 20 bp, Artificial Sequence
  Description of Artificial Sequence: Synthetic oligonucleotide
  Target: SCN9A; (-) strand; PAM type: NRG; PAM sequence: AAG
tcagctccggtttgctatat

SEQ ID NO: 35690 - DNA, 20 bp, Artificial Sequence
  Description of Artificial Sequence: Synthetic oligonucleotide
  Target: SCN9A; (-) strand; PAM type: NRG; PAM sequence: CGG
aggattatcattttcagctc

SEQ ID NO: 35691 - DNA, 20 bp, Artificial Sequence
  Description of Artificial Sequence: Synthetic oligonucleotide
  Target: SCN9A; (-) strand; PAM type: NRG; PAM sequence: CAG
ccttaaaggattatcatttt

SEQ ID NO: 35692 - DNA, 20 bp, Artificial Sequence
  Description of Artificial Sequence: Synthetic oligonucleotide
  Target: SCN9A; (-) strand; PAM type: NRG; PAM sequence: AGG
ttccactaaaataaccttaa

SEQ ID NO: 35693 - DNA, 20 bp, Artificial Sequence
  Description of Artificial Sequence: Synthetic oligonucleotide
  Target: SCN9A; (-) strand; PAM type: NRG; PAM sequence: AAG
tttccactaaaataacctta

SEQ ID NO: 35694 - DNA, 20 bp, Artificial Sequence
  Description of Artificial Sequence: Synthetic oligonucleotide
  Target: SCN9A; (-) strand; PAM type: NRG; PAM sequence: CAG
tgtgctaagttattaaaatt

SEQ ID NO: 35695 - DNA, 20 bp, Artificial Sequence
  Description of Artificial Sequence: Synthetic oligonucleotide
  Target: SCN9A; (-) strand; PAM type: NRG; PAM sequence: AAG
agtgtaacaggaaatgtgct

SEQ ID NO: 35696 - DNA, 20 bp, Artificial Sequence
  Description of Artificial Sequence: Synthetic oligonucleotide
  Target: SCN9A; (-) strand; PAM type: NRG; PAM sequence: AGG
ttgtgcactgaaagtgtaac

SEQ ID NO: 35697 - DNA, 20 bp, Artificial Sequence
  Description of Artificial Sequence: Synthetic oligonucleotide
  Target: SCN9A; (-) strand; PAM type: NRG; PAM sequence: CAG
attgtgcactgaaagtgtaa

SEQ ID NO: 35698 - DNA, 20 bp, Artificial Sequence
  Description of Artificial Sequence: Synthetic oligonucleotide
  Target: SCN9A; (-) strand; PAM type: NRG; PAM sequence: AAG
tacaatgtattgtgcactga

SEQ ID NO: 35699 - DNA, 20 bp, Artificial Sequence
  Description of Artificial Sequence: Synthetic oligonucleotide
  Target: SCN9A; (-) strand; PAM type: NRG; PAM sequence: CAG
gctaaaatcactaataataa

SEQ ID NO: 35700 - DNA, 20 bp, Artificial Sequence
  Description of Artificial Sequence: Synthetic oligonucleotide
  Target: SCN9A; (-) strand; PAM type: NRG; PAM sequence: AAG
tacaaaatcaacttagaaga

SEQ ID NO: 35701 - DNA, 20 bp, Artificial Sequence
  Description of Artificial Sequence: Synthetic oligonucleotide
  Target: SCN9A; (-) strand; PAM type: NRG; PAM sequence: AAG
ggtatacaaaatcaacttag

SEQ ID NO: 35702 - DNA, 20 bp, Artificial Sequence
  Description of Artificial Sequence: Synthetic oligonucleotide
  Target: SCN9A; (-) strand; PAM type: NRG; PAM sequence: TAG
ttaggtatacaaaatcaact

SEQ ID NO: 35703 - DNA, 20 bp, Artificial Sequence
  Description of Artificial Sequence: Synthetic oligonucleotide
  Target: SCN9A; (-) strand; PAM type: NRG; PAM sequence: AGG
ttcctaagaacattagcttt

SEQ ID NO: 35704 - DNA, 20 bp, Artificial Sequence
  Description of Artificial Sequence: Synthetic oligonucleotide
  Target: SCN9A; (-) strand; PAM type: NRG; PAM sequence: TAG
gttcctaagaacattagctt

SEQ ID NO: 35705 - DNA, 20 bp, Artificial Sequence
  Description of Artificial Sequence: Synthetic oligonucleotide
  Target: SCN9A; (-) strand; PAM type: NRG; PAM sequence: TAG
attctcgttcctaagaacat

SEQ ID NO: 35706 - DNA, 20 bp, Artificial Sequence
  Description of Artificial Sequence: Synthetic oligonucleotide
  Target: SCN9A; (-) strand; PAM type: NRG; PAM sequence: AAG
gcaaatatattctcgttcct

SEQ ID NO: 35707 - DNA, 20 bp, Artificial Sequence
  Description of Artificial Sequence: Synthetic oligonucleotide
  Target: SCN9A; (-) strand; PAM type: NRG; PAM sequence: AAG
aagcttttctattataaagt

SEQ ID NO: 35708 - DNA, 20 bp, Artificial Sequence
  Description of Artificial Sequence: Synthetic oligonucleotide
  Target: SCN9A; (-) strand; PAM type: NRG; PAM sequence: AAG
acaaaagcttttctattata

SEQ ID NO: 35709 - DNA, 20 bp, Artificial Sequence
  Description of Artificial Sequence: Synthetic oligonucleotide
  Target: SCN9A; (-) strand; PAM type: NRG; PAM sequence: AAG
gttttgtatatgcaatacaa

SEQ ID NO: 35710 - DNA, 20 bp, Artificial Sequence
  Description of Artificial Sequence: Synthetic oligonucleotide
  Target: SCN9A; (-) strand; PAM type: NRG; PAM sequence: AGG
gaaagctccctaagaagaaa

SEQ ID NO: 35711 - DNA, 20 bp, Artificial Sequence
  Description of Artificial Sequence: Synthetic oligonucleotide
  Target: SCN9A; (-) strand; PAM type: NRG; PAM sequence: AAG
tgaaagctccctaagaagaa

SEQ ID NO: 35712 - DNA, 20 bp, Artificial Sequence
  Description of Artificial Sequence: Synthetic oligonucleotide
  Target: SCN9A; (-) strand; PAM type: NRG; PAM sequence: AAG
tgagttgaaagctccctaag

SEQ ID NO: 35713 - DNA, 20 bp, Artificial Sequence
  Description of Artificial Sequence: Synthetic oligonucleotide
  Target: SCN9A; (-) strand; PAM type: NRG; PAM sequence: AAG
ttctgagttgaaagctccct

SEQ ID NO: 35714 - DNA, 20 bp, Artificial Sequence
  Description of Artificial Sequence: Synthetic oligonucleotide
  Target: SCN9A; (-) strand; PAM type: NRG; PAM sequence: AAG
tttaaaatattctgagttga

SEQ ID NO: 35715 - DNA, 20 bp, Artificial Sequence
  Description of Artificial Sequence: Synthetic oligonucleotide
  Target: SCN9A; (-) strand; PAM type: NRG; PAM sequence: GAG
tttagtctttaaaatattct

SEQ ID NO: 35716 - DNA, 20 bp, Artificial Sequence
  Description of Artificial Sequence: Synthetic oligonucleotide
  Target: SCN9A; (-) strand; PAM type: NRG; PAM sequence: TAG
tttgctataagcatacattt

SEQ ID NO: 35717 - DNA, 20 bp, Artificial Sequence
  Description of Artificial Sequence: Synthetic oligonucleotide
  Target: SCN9A; (-) strand; PAM type: NRG; PAM sequence: AAG
tgtagtcttggttttgctat

SEQ ID NO: 35718 - DNA, 20 bp, Artificial Sequence
  Description of Artificial Sequence: Synthetic oligonucleotide
  Target: SCN9A; (-) strand; PAM type: NRG; PAM sequence: TGG
ggtagaaggcaatgtagtct

SEQ ID NO: 35719 - DNA, 20 bp, Artificial Sequence
  Description of Artificial Sequence: Synthetic oligonucleotide
  Target: SCN9A; (-) strand; PAM type: NRG; PAM sequence: TAG
cctgttggtagaaggcaatg

SEQ ID NO: 35720 - DNA, 20 bp, Artificial Sequence
  Description of Artificial Sequence: Synthetic oligonucleotide
  Target: SCN9A; (-) strand; PAM type: NRG; PAM sequence: AGG
tattgccacctgttggtaga

SEQ ID NO: 35721 - DNA, 20 bp, Artificial Sequence
  Description of Artificial Sequence: Synthetic oligonucleotide
  Target: SCN9A; (-) strand; PAM type: NRG; PAM sequence: AAG
atattgccacctgttggtag

SEQ ID NO: 35722 - DNA, 20 bp, Artificial Sequence
  Description of Artificial Sequence: Synthetic oligonucleotide
  Target: SCN9A; (-) strand; PAM type: NRG; PAM sequence: TAG
catatattgccacctgttgg

SEQ ID NO: 35723 - DNA, 20 bp, Artificial Sequence
  Description of Artificial Sequence: Synthetic oligonucleotide
  Target: SCN9A; (-) strand; PAM type: NRG; PAM sequence: TGG
tggcatatattgccacctgt

SEQ ID NO: 35724 - DNA, 20 bp, Artificial Sequence
  Description of Artificial Sequence: Synthetic oligonucleotide
  Target: SCN9A; (-) strand; PAM type: NRG; PAM sequence: TGG
aggactaaaatggctgtgtg

SEQ ID NO: 35725 - DNA, 20 bp, Artificial Sequence
  Description of Artificial Sequence: Synthetic oligonucleotide
  Target: SCN9A; (-) strand; PAM type: NRG; PAM sequence: TGG
ttgtattggcaggactaaaa

SEQ ID NO: 35726 - DNA, 20 bp, Artificial Sequence
  Description of Artificial Sequence: Synthetic oligonucleotide
  Target: SCN9A; (-) strand; PAM type: NRG; PAM sequence: AGG
ctaatgaactttgtattggc

SEQ ID NO: 35727 - DNA, 20 bp, Artificial Sequence
  Description of Artificial Sequence: Synthetic oligonucleotide
  Target: SCN9A; (-) strand; PAM type: NRG; PAM sequence: CAG
actaatgaactttgtattgg

SEQ ID NO: 35728 - DNA, 20 bp, Artificial Sequence
  Description of Artificial Sequence: Synthetic oligonucleotide
  Target: SCN9A; (-) strand; PAM type: NRG; PAM sequence: TGG
taaactaatgaactttgtat

SEQ ID NO: 35729 - DNA, 20 bp, Artificial Sequence
  Description of Artificial Sequence: Synthetic oligonucleotide
  Target: SCN9A; (-) strand; PAM type: NRG; PAM sequence: TAG
aaagcaaggcccacatcctg

SEQ ID NO: 35730 - DNA, 20 bp, Artificial Sequence
  Description of Artificial Sequence: Synthetic oligonucleotide
  Target: SCN9A; (-) strand; PAM type: NRG; PAM sequence: AGG
tttatataaccttgaaagca

SEQ ID NO: 35731 - DNA, 20 bp, Artificial Sequence
  Description of Artificial Sequence: Synthetic oligonucleotide
  Target: SCN9A; (-) strand; PAM type: NRG; PAM sequence: AAG
atttatataaccttgaaagc

SEQ ID NO: 35732 - DNA, 20 bp, Artificial Sequence
  Description of Artificial Sequence: Synthetic oligonucleotide
  Target: SCN9A; (-) strand; PAM type: NRG; PAM sequence: AAG
aagaatttatataaccttga

SEQ ID NO: 35733 - DNA, 20 bp, Artificial Sequence
  Description of Artificial Sequence: Synthetic oligonucleotide
  Target: SCN9A; (-) strand; PAM type: NRG; PAM sequence: AAG
ttatcaaacctgatggattt

SEQ ID NO: 35734 - DNA, 20 bp, Artificial Sequence
  Description of Artificial Sequence: Synthetic oligonucleotide
  Target: SCN9A; (-) strand; PAM type: NRG; PAM sequence: TGG
tccacatttatcaaacctga

SEQ ID NO: 35735 - DNA, 20 bp, Artificial Sequence
  Description of Artificial Sequence: Synthetic oligonucleotide
  Target: SCN9A; (-) strand; PAM type: NRG; PAM sequence: CAG
ttcaacatcctcggtgtgtt

SEQ ID NO: 35736 - DNA, 20 bp, Artificial Sequence
  Description of Artificial Sequence: Synthetic oligonucleotide
  Target: SCN9A; (-) strand; PAM type: NRG; PAM sequence: CGG
attaaatctttcaacatcct

SEQ ID NO: 35737 - DNA, 20 bp, Artificial Sequence
  Description of Artificial Sequence: Synthetic oligonucleotide
  Target: SCN9A; (-) strand; PAM type: NRG; PAM sequence: TGG
atcattttattatttttctt

SEQ ID NO: 35738 - DNA, 20 bp, Artificial Sequence
  Description of Artificial Sequence: Synthetic oligonucleotide
  Target: SCN9A; (-) strand; PAM type: NRG; PAM sequence: GGG
taattctgctcagtcctaga

SEQ ID NO: 35739 - DNA, 20 bp, Artificial Sequence
  Description of Artificial Sequence: Synthetic oligonucleotide
  Target: SCN9A; (-) strand; PAM type: NRG; PAM sequence: AGG
ataattctgctcagtcctag

SEQ ID NO: 35740 - DNA, 20 bp, Artificial Sequence
  Description of Artificial Sequence: Synthetic oligonucleotide
  Target: SCN9A; (-) strand; PAM type: NRG; PAM sequence: GAG
cataattctgctcagtccta

SEQ ID NO: 35741 - DNA, 20 bp, Artificial Sequence
  Description of Artificial Sequence: Synthetic oligonucleotide
  Target: SCN9A; (-) strand; PAM type: NRG; PAM sequence: TAG
tgcataattctgctcagtcc

SEQ ID NO: 35742 - DNA, 20 bp, Artificial Sequence
  Description of Artificial Sequence: Synthetic oligonucleotide
  Target: SCN9A; (-) strand; PAM type: NRG; PAM sequence: CAG
aacttttgcataattctgct

SEQ ID NO: 35743 - DNA, 20 bp, Artificial Sequence
  Description of Artificial Sequence: Synthetic oligonucleotide
  Target: SCN9A; (-) strand; PAM type: NRG; PAM sequence: AAG
tatcttgctggctattgcct

SEQ ID NO: 35744 - DNA, 20 bp, Artificial Sequence
  Description of Artificial Sequence: Synthetic oligonucleotide
  Target: SCN9A; (-) strand; PAM type: NRG; PAM sequence: TGG
caatgttccttgtatcttgc

SEQ ID NO: 35745 - DNA, 20 bp, Artificial Sequence
  Description of Artificial Sequence: Synthetic oligonucleotide
  Target: SCN9A; (-) strand; PAM type: NRG; PAM sequence: GAG
aaatcctctgactcatgcta

SEQ ID NO: 35746 - DNA, 20 bp, Artificial Sequence
  Description of Artificial Sequence: Synthetic oligonucleotide
  Target: SCN9A; (-) strand; PAM type: NRG; PAM sequence: TAG
aaaaatcctctgactcatgc

SEQ ID NO: 35747 - DNA, 20 bp, Artificial Sequence
  Description of Artificial Sequence: Synthetic oligonucleotide
  Target: SCN9A; (-) strand; PAM type: NRG; PAM sequence: GAG
cactttagcattaagttctg

SEQ ID NO: 35748 - DNA, 20 bp, Artificial Sequence
  Description of Artificial Sequence: Synthetic oligonucleotide
  Target: SCN9A; (-) strand; PAM type: NRG; PAM sequence: TGG
ctcactttagcattaagttc

SEQ ID NO: 35749 - DNA, 20 bp, Artificial Sequence
  Description of Artificial Sequence: Synthetic oligonucleotide
  Target: SCN9A; (-) strand; PAM type: NRG; PAM sequence: AAG
tcttttctcactttagcatt

SEQ ID NO: 35750 - DNA, 20 bp, Artificial Sequence
  Description of Artificial Sequence: Synthetic oligonucleotide
  Target: SCN9A; (-) strand; PAM type: NRG; PAM sequence: TAG
tacctagtcttttctcactt

SEQ ID NO: 35751 - DNA, 20 bp, Artificial Sequence
  Description of Artificial Sequence: Synthetic oligonucleotide
  Target: SCN9A; (-) strand; PAM type: NRG; PAM sequence: TAG
tgccttcttgaatgaatacc

SEQ ID NO: 35752 - DNA, 20 bp, Artificial Sequence
  Description of Artificial Sequence: Synthetic oligonucleotide
  Target: SCN9A; (-) strand; PAM type: NRG; PAM sequence: TGG
tcagcagctgttactgtgct

SEQ ID NO: 35753 - DNA, 20 bp, Artificial Sequence
  Description of Artificial Sequence: Synthetic oligonucleotide
  Target: SCN9A; (-) strand; PAM type: NRG; PAM sequence: CAG
catcaggaatatttcatcag

SEQ ID NO: 35754 - DNA, 20 bp, Artificial Sequence
  Description of Artificial Sequence: Synthetic oligonucleotide
  Target: SCN9A; (-) strand; PAM type: NRG; PAM sequence: CAG
ccccatcaggaatatttcat

SEQ ID NO: 35755 - DNA, 20 bp, Artificial Sequence
  Description of Artificial Sequence: Synthetic oligonucleotide
  Target: SCN9A; (-) strand; PAM type: NRG; PAM sequence: AGG
ttaacaattcctgccccatc

SEQ ID NO: 35756 - DNA, 20 bp, Artificial Sequence
  Description of Artificial Sequence: Synthetic oligonucleotide
  Target: SCN9A; (-) strand; PAM type: NRG; PAM sequence: CAG
tttaacaattcctgccccat

SEQ ID NO: 35757 - DNA, 20 bp, Artificial Sequence
  Description of Artificial Sequence: Synthetic oligonucleotide
  Target: SCN9A; (-) strand; PAM type: NRG; PAM sequence: GGG
tattttgatattgaattaaa

SEQ ID NO: 35758 - DNA, 20 bp, Artificial Sequence
  Description of Artificial Sequence: Synthetic oligonucleotide
  Target: SCN9A; (-) strand; PAM type: NRG; PAM sequence: AGG
ttattttgatattgaattaa

SEQ ID NO: 35759 - DNA, 20 bp, Artificial Sequence
  Description of Artificial Sequence: Synthetic oligonucleotide
  Target: SCN9A; (-) strand; PAM type: NRG; PAM sequence: AAG
cttattttgatattgaatta

SEQ ID NO: 35760 - DNA, 20 bp, Artificial Sequence
  Description of Artificial Sequence: Synthetic oligonucleotide
  Target: SCN9A; (-) strand; PAM type: NRG; PAM sequence: TGG
aaatgttccaaagaatactt

SEQ ID NO: 35761 - DNA, 20 bp, Artificial Sequence
  Description of Artificial Sequence: Synthetic oligonucleotide
  Target: SCN9A; (-) strand; PAM type: NRG; PAM sequence: AAG
caatgtccacaaatgttcca

SEQ ID NO: 35762 - DNA, 20 bp, Artificial Sequence
  Description of Artificial Sequence: Synthetic oligonucleotide
  Target: SCN9A; (-) strand; PAM type: NRG; PAM sequence: TAG
atcttatgagtagatgtcac

SEQ ID NO: 35763 - DNA, 20 bp, Artificial Sequence
  Description of Artificial Sequence: Synthetic oligonucleotide
  Target: SCN9A; (-) strand; PAM type: NRG; PAM sequence: TAG
ttcatcaaaaatcttatgag

SEQ ID NO: 35764 - DNA, 20 bp, Artificial Sequence
  Description of Artificial Sequence: Synthetic oligonucleotide
  Target: SCN9A; (-) strand; PAM type: NRG; PAM sequence: GAG
gtcttcatcaaaaatcttat

SEQ ID NO: 35765 - DNA, 20 bp, Artificial Sequence
  Description of Artificial Sequence: Synthetic oligonucleotide
  Target: SCN9A; (-) strand; PAM type: NRG; PAM sequence: TAG
acccccttcctttgctaata

SEQ ID NO: 35766 - DNA, 20 bp, Artificial Sequence
  Description of Artificial Sequence: Synthetic oligonucleotide
  Target: SCN9A; (-) strand; PAM type: NRG; PAM sequence: CAG
ttcctttagactcctcaaac

SEQ ID NO: 35767 - DNA, 20 bp, Artificial Sequence
  Description of Artificial Sequence: Synthetic oligonucleotide
  Target: SCN9A; (-) strand; PAM type: NRG; PAM sequence: TAG
cactaaataaactgttcctt

SEQ ID NO: 35768 - DNA, 20 bp, Artificial Sequence
  Description of Artificial Sequence: Synthetic oligonucleotide
  Target: SCN9A; (-) strand; PAM type: NRG; PAM sequence: CAG
ccatagtactttaccatctc

SEQ ID NO: 35769 - DNA, 20 bp, Artificial Sequence
  Description of Artificial Sequence: Synthetic oligonucleotide
  Target: SCN9A; (-) strand; PAM type: NRG; PAM sequence: TAG
aactcatgttatttatacca

SEQ ID NO: 35770 - DNA, 20 bp, Artificial Sequence
  Description of Artificial Sequence: Synthetic oligonucleotide
  Target: SCN9A; (-) strand; PAM type: NRG; PAM sequence: TAG
ttagtttgcaaaaggtttgt

SEQ ID NO: 35771 - DNA, 20 bp, Artificial Sequence
  Description of Artificial Sequence: Synthetic oligonucleotide
  Target: SCN9A; (-) strand; PAM type: NRG; PAM sequence: AGG
tgaacatgttagtttgcaaa

SEQ ID NO: 35772 - DNA, 20 bp, Artificial Sequence
  Description of Artificial Sequence: Synthetic oligonucleotide
  Target: SCN9A; (-) strand; PAM type: NRG; PAM sequence: AAG
atgaacatgttagtttgcaa

SEQ ID NO: 35773 - DNA, 20 bp, Artificial Sequence
  Description of Artificial Sequence: Synthetic oligonucleotide
  Target: SCN9A; (-) strand; PAM type: NRG; PAM sequence: TAG
agtcatatctatgaacatgt

SEQ ID NO: 35774 - DNA, 20 bp, Artificial Sequence
  Description of Artificial Sequence: Synthetic oligonucleotide
  Target: SCN9A; (-) strand; PAM type: NRG; PAM sequence: AAG
agagaaataagaaacacagg

SEQ ID NO: 35775 - DNA, 20 bp, Artificial Sequence
  Description of Artificial Sequence: Synthetic oligonucleotide
  Target: SCN9A; (-) strand; PAM type: NRG; PAM sequence: AGG
agcagagaaataagaaacac

SEQ ID NO: 35776 - DNA, 20 bp, Artificial Sequence
  Description of Artificial Sequence: Synthetic oligonucleotide
  Target: SCN9A; (-) strand; PAM type: NRG; PAM sequence: CAG
gagcagagaaataagaaaca

SEQ ID NO: 35777 - DNA, 20 bp, Artificial Sequence
  Description of Artificial Sequence: Synthetic oligonucleotide
  Target: SCN9A; (-) strand; PAM type: NRG; PAM sequence: AAG
ccaagagagagcagagaaat

SEQ ID NO: 35778 - DNA, 20 bp, Artificial Sequence
  Description of Artificial Sequence: Synthetic oligonucleotide
  Target: SCN9A; (-) strand; PAM type: NRG; PAM sequence: GAG
tttagttccaagagagagca

SEQ ID NO: 35779 - DNA, 20 bp, Artificial Sequence
  Description of Artificial Sequence: Synthetic oligonucleotide
  Target: SCN9A; (-) strand; PAM type: NRG; PAM sequence: CAG
cctttagttccaagagagag

SEQ ID NO: 35780 - DNA, 20 bp, Artificial Sequence
  Description of Artificial Sequence: Synthetic oligonucleotide
  Target: SCN9A; (-) strand; PAM type: NRG; PAM sequence: GAG
cagcctttagttccaagaga

SEQ ID NO: 35781 - DNA, 20 bp, Artificial Sequence
  Description of Artificial Sequence: Synthetic oligonucleotide
  Target: SCN9A; (-) strand; PAM type: NRG; PAM sequence: GAG
cacagcctttagttccaaga

SEQ ID NO: 35782 - DNA, 20 bp, Artificial Sequence
  Description of Artificial Sequence: Synthetic oligonucleotide
  Target: SCN9A; (-) strand; PAM type: NRG; PAM sequence: GAG
atcacagcctttagttccaa

SEQ ID NO: 35783 - DNA, 20 bp, Artificial Sequence
  Description of Artificial Sequence: Synthetic oligonucleotide
  Target: SCN9A; (-) strand; PAM type: NRG; PAM sequence: AAG
taatcacagcctttagttcc

SEQ ID NO: 35784 - DNA, 20 bp, Artificial Sequence
  Description of Artificial Sequence: Synthetic oligonucleotide
  Target: SCN9A; (-) strand; PAM type: NRG; PAM sequence: TAG
cttgccataatcacagcctt

SEQ ID NO: 35785 - DNA, 20 bp, Artificial Sequence
  Description of Artificial Sequence: Synthetic oligonucleotide
  Target: SCN9A; (-) strand; PAM type: NRG; PAM sequence: CAG
tagataccttgccataatca

SEQ ID NO: 35786 - DNA, 20 bp, Artificial Sequence
  Description of Artificial Sequence: Synthetic oligonucleotide
  Target: SCN9A; (-) strand; PAM type: NRG; PAM sequence: TAG
cagattatggtgagggttcc

SEQ ID NO: 35787 - DNA, 20 bp, Artificial Sequence
  Description of Artificial Sequence: Synthetic oligonucleotide
  Target: SCN9A; (-) strand; PAM type: NRG; PAM sequence: GGG
atattcccagattatggtga

SEQ ID NO: 35788 - DNA, 20 bp, Artificial Sequence
  Description of Artificial Sequence: Synthetic oligonucleotide
  Target: SCN9A; (-) strand; PAM type: NRG; PAM sequence: AGG
catattcccagattatggtg

SEQ ID NO: 35789 - DNA, 20 bp, Artificial Sequence
  Description of Artificial Sequence: Synthetic oligonucleotide
  Target: SCN9A; (-) strand; PAM type: NRG; PAM sequence: GAG
tcatattcccagattatggt

SEQ ID NO: 35790 - DNA, 20 bp, Artificial Sequence
  Description of Artificial Sequence: Synthetic oligonucleotide
  Target: SCN9A; (-) strand; PAM type: NRG; PAM sequence: TGG
ttcatcatattcccagatta

SEQ ID NO: 35791 - DNA, 20 bp, Artificial Sequence
  Description of Artificial Sequence: Synthetic oligonucleotide
  Target: SCN9A; (-) strand; PAM type: NRG; PAM sequence: CAG
catgagtttcatcatattcc

SEQ ID NO: 35792 - DNA, 20 bp, Artificial Sequence
  Description of Artificial Sequence: Synthetic oligonucleotide
  Target: SCN9A; (-) strand; PAM type: NRG; PAM sequence: GAG
cattttaaacaatatcacat

SEQ ID NO: 35793 - DNA, 20 bp, Artificial Sequence
  Description of Artificial Sequence: Synthetic oligonucleotide
  Target: SCN9A; (-) strand; PAM type: NRG; PAM sequence: GAG
tttaacaacaacaacagaaa

SEQ ID NO: 35794 - DNA, 20 bp, Artificial Sequence
  Description of Artificial Sequence: Synthetic oligonucleotide
  Target: SCN9A; (-) strand; PAM type: NRG; PAM sequence: AAG
tttttaacaacaacaacaga

SEQ ID NO: 35795 - DNA, 20 bp, Artificial Sequence
  Description of Artificial Sequence: Synthetic oligonucleotide
  Target: SCN9A; (-) strand; PAM type: NRG; PAM sequence: CAG
tatatttttaacaacaacaa

SEQ ID NO: 35796 - DNA, 20 bp, Artificial Sequence
  Description of Artificial Sequence: Synthetic oligonucleotide
  Target: SCN9A; (-) strand; PAM type: NRG; PAM sequence: TAG
ttaattcacccttaaaaaaa

SEQ ID NO: 35797 - DNA, 20 bp, Artificial Sequence
  Description of Artificial Sequence: Synthetic oligonucleotide
  Target: SCN9A; (-) strand; PAM type: NRG; PAM sequence: AAG
gccccaaaatggcagaaagt

SEQ ID NO: 35798 - DNA, 20 bp, Artificial Sequence
  Description of Artificial Sequence: Synthetic oligonucleotide
  Target: SCN9A; (-) strand; PAM type: NRG; PAM sequence: AAG
ttctgccccaaaatggcaga

SEQ ID NO: 35799 - DNA, 20 bp, Artificial Sequence
  Description of Artificial Sequence: Synthetic oligonucleotide
  Target: SCN9A; (-) strand; PAM type: NRG; PAM sequence: CAG
aaaattctgccccaaaatgg

SEQ ID NO: 35800 - DNA, 20 bp, Artificial Sequence
  Description of Artificial Sequence: Synthetic oligonucleotide
  Target: SCN9A; (-) strand; PAM type: NRG; PAM sequence: TGG
ctgaaaattctgccccaaaa

SEQ ID NO: 35801 - DNA, 20 bp, Artificial Sequence
  Description of Artificial Sequence: Synthetic oligonucleotide
  Target: SCN9A; (-) strand; PAM type: NRG; PAM sequence: AGG
caatcctatttatatctgtg

SEQ ID NO: 35802 - DNA, 20 bp, Artificial Sequence
  Description of Artificial Sequence: Synthetic oligonucleotide
  Target: SCN9A; (-) strand; PAM type: NRG; PAM sequence: GAG
ccaatcctatttatatctgt

SEQ ID NO: 35803 - DNA, 20 bp, Artificial Sequence
  Description of Artificial Sequence: Synthetic oligonucleotide
  Target: SCN9A; (-) strand; PAM type: NRG; PAM sequence: TGG
cctgtgattgttatctaatt

SEQ ID NO: 35804 - DNA, 20 bp, Artificial Sequence
  Description of Artificial Sequence: Synthetic oligonucleotide
  Target: SCN9A; (-) strand; PAM type: NRG; PAM sequence: AGG
atataaatttgaggaaggat

SEQ ID NO: 35805 - DNA, 20 bp, Artificial Sequence
  Description of Artificial Sequence: Synthetic oligonucleotide
  Target: SCN9A; (-) strand; PAM type: NRG; PAM sequence: TAG
aatataaatttgaggaagga

SEQ ID NO: 35806 - DNA, 20 bp, Artificial Sequence
  Description of Artificial Sequence: Synthetic oligonucleotide
  Target: SCN9A; (-) strand; PAM type: NRG; PAM sequence: AGG
ctggaatataaatttgagga

SEQ ID NO: 35807 - DNA, 20 bp, Artificial Sequence
  Description of Artificial Sequence: Synthetic oligonucleotide
  Target: SCN9A; (-) strand; PAM type: NRG; PAM sequence: AAG
tctggaatataaatttgagg

SEQ ID NO: 35808 - DNA, 20 bp, Artificial Sequence
  Description of Artificial Sequence: Synthetic oligonucleotide
  Target: SCN9A; (-) strand; PAM type: NRG; PAM sequence: AGG
ccttctggaatataaatttg

SEQ ID NO: 35809 - DNA, 20 bp, Artificial Sequence
  Description of Artificial Sequence: Synthetic oligonucleotide
  Target: SCN9A; (-) strand; PAM type: NRG; PAM sequence: GAG
tccttctggaatataaattt

SEQ ID NO: 35810 - DNA, 20 bp, Artificial Sequence
  Description of Artificial Sequence: Synthetic oligonucleotide
  Target: SCN9A; (-) strand; PAM type: NRG; PAM sequence: TGG
ttaggcaaaacacttccttc

SEQ ID NO: 35811 - DNA, 20 bp, Artificial Sequence
  Description of Artificial Sequence: Synthetic oligonucleotide
  Target: SCN9A; (-) strand; PAM type: NRG; PAM sequence: AGG
ctgagataaagcaaatgttt

SEQ ID NO: 35812 - DNA, 20 bp, Artificial Sequence
  Description of Artificial Sequence: Synthetic oligonucleotide
  Target: SCN9A; (-) strand; PAM type: NRG; PAM sequence: TAG
tctgagataaagcaaatgtt

SEQ ID NO: 35813 - DNA, 20 bp, Artificial Sequence
  Description of Artificial Sequence: Synthetic oligonucleotide
  Target: SCN9A; (-) strand; PAM type: NRG; PAM sequence: AAG
gagtcttggattctgagata

SEQ ID NO: 35814 - DNA, 20 bp, Artificial Sequence
  Description of Artificial Sequence: Synthetic oligonucleotide
  Target: SCN9A; (-) strand; PAM type: NRG; PAM sequence: GAG
gatcaggagtcttggattct

SEQ ID NO: 35815 - DNA, 20 bp, Artificial Sequence
  Description of Artificial Sequence: Synthetic oligonucleotide
  Target: SCN9A; (-) strand; PAM type: NRG; PAM sequence: TGG
ataaatttgatcaggagtct

SEQ ID NO: 35816 - DNA, 20 bp, Artificial Sequence
  Description of Artificial Sequence: Synthetic oligonucleotide
  Target: SCN9A; (-) strand; PAM type: NRG; PAM sequence: GAG
tggaatataaatttgatcag

SEQ ID NO: 35817 - DNA, 20 bp, Artificial Sequence
  Description of Artificial Sequence: Synthetic oligonucleotide
  Target: SCN9A; (-) strand; PAM type: NRG; PAM sequence: AGG
tctggaatataaatttgatc

SEQ ID NO: 35818 - DNA, 20 bp, Artificial Sequence
  Description of Artificial Sequence: Synthetic oligonucleotide
  Target: SCN9A; (-) strand; PAM type: NRG; PAM sequence: CAG
ttctggaatataaatttgat

SEQ ID NO: 35819 - DNA, 20 bp, Artificial Sequence
  Description of Artificial Sequence: Synthetic oligonucleotide
  Target: SCN9A; (-) strand; PAM type: NRG; PAM sequence: TGG
ttaataattttaattccttc

SEQ ID NO: 35820 - DNA, 20 bp, Artificial Sequence
  Description of Artificial Sequence: Synthetic oligonucleotide
  Target: SCN9A; (-) strand; PAM type: NRG; PAM sequence: AAG
gaatccaagcctcctggtca

SEQ ID NO: 35821 - DNA, 20 bp, Artificial Sequence
  Description of Artificial Sequence: Synthetic oligonucleotide
  Target: SCN9A; (-) strand; PAM type: NRG; PAM sequence: TGG
atctcagaatccaagcctcc

SEQ ID NO: 35822 - DNA, 20 bp, Artificial Sequence
  Description of Artificial Sequence: Synthetic oligonucleotide
  Target: SCN9A; (-) strand; PAM type: NRG; PAM sequence: AAG
cttgctttatctcagaatcc

SEQ ID NO: 35823 - DNA, 20 bp, Artificial Sequence
  Description of Artificial Sequence: Synthetic oligonucleotide
  Target: SCN9A; (-) strand; PAM type: NRG; PAM sequence: CAG
cctatgcacttgctttatct

SEQ ID NO: 35824 - DNA, 20 bp, Artificial Sequence
  Description of Artificial Sequence: Synthetic oligonucleotide
  Target: SCN9A; (-) strand; PAM type: NRG; PAM sequence: AAG
gaagtctgtaaataaaagtt

SEQ ID NO: 35825 - DNA, 20 bp, Artificial Sequence
  Description of Artificial Sequence: Synthetic oligonucleotide
  Target: SCN9A; (-) strand; PAM type: NRG; PAM sequence: AAG
aaaaagaagtctgtaaataa

SEQ ID NO: 35826 - DNA, 20 bp, Artificial Sequence
  Description of Artificial Sequence: Synthetic oligonucleotide
  Target: SCN9A; (-) strand; PAM type: NRG; PAM sequence: AAG
tcagttagaataataaaaag

SEQ ID NO: 35827 - DNA, 20 bp, Artificial Sequence
  Description of Artificial Sequence: Synthetic oligonucleotide
  Target: SCN9A; (-) strand; PAM type: NRG; PAM sequence: AAG
tcatcagttagaataataaa

SEQ ID NO: 35828 - DNA, 20 bp, Artificial Sequence
  Description of Artificial Sequence: Synthetic oligonucleotide
  Target: SCN9A; (-) strand; PAM type: NRG; PAM sequence: TAG
gaacaggtcaattcatcagt

SEQ ID NO: 35829 - DNA, 20 bp, Artificial Sequence
  Description of Artificial Sequence: Synthetic oligonucleotide
  Target: SCN9A; (-) strand; PAM type: NRG; PAM sequence: CAG
aaatgaacaggtcaattcat

SEQ ID NO: 35830 - DNA, 20 bp, Artificial Sequence
  Description of Artificial Sequence: Synthetic oligonucleotide
  Target: SCN9A; (-) strand; PAM type: NRG; PAM sequence: AGG
ggacatttaaaaaaatgaac

SEQ ID NO: 35831 - DNA, 20 bp, Artificial Sequence
  Description of Artificial Sequence: Synthetic oligonucleotide
  Target: SCN9A; (-) strand; PAM type: NRG; PAM sequence: CAG
tggacatttaaaaaaatgaa

SEQ ID NO: 35832 - DNA, 20 bp, Artificial Sequence
  Description of Artificial Sequence: Synthetic oligonucleotide
  Target: SCN9A; (-) strand; PAM type: NRG; PAM sequence: TGG
tttcatgaaaatatgacata

SEQ ID NO: 35833 - DNA, 20 bp, Artificial Sequence
  Description of Artificial Sequence: Synthetic oligonucleotide
  Target: SCN9A; (-) strand; PAM type: NRG; PAM sequence: AAG
tatggaaactccaggtcact

SEQ ID NO: 35834 - DNA, 20 bp, Artificial Sequence
  Description of Artificial Sequence: Synthetic oligonucleotide
  Target: SCN9A; (-) strand; PAM type: NRG; PAM sequence: AGG
tgactatttatggaaactcc

SEQ ID NO: 35835 - DNA, 20 bp, Artificial Sequence
  Description of Artificial Sequence: Synthetic oligonucleotide
  Target: SCN9A; (-) strand; PAM type: NRG; PAM sequence: CAG
gtgactatttatggaaactc

SEQ ID NO: 35836 - DNA, 20 bp, Artificial Sequence
  Description of Artificial Sequence: Synthetic oligonucleotide
  Target: SCN9A; (-) strand; PAM type: NRG; PAM sequence: TGG
tgaaaaatggtgactattta

SEQ ID NO: 35837 - DNA, 20 bp, Artificial Sequence
  Description of Artificial Sequence: Synthetic oligonucleotide
  Target: SCN9A; (-) strand; PAM type: NRG; PAM sequence: TGG
agttacaagcaaatgaaaaa

SEQ ID NO: 35838 - DNA, 20 bp, Artificial Sequence
  Description of Artificial Sequence: Synthetic oligonucleotide
  Target: SCN9A; (-) strand; PAM type: NRG; PAM sequence: AAG
ttttcccactggggagttac

SEQ ID NO: 35839 - DNA, 20 bp, Artificial Sequence
  Description of Artificial Sequence: Synthetic oligonucleotide
  Target: SCN9A; (-) strand; PAM type: NRG; PAM sequence: GAG
caataccttttcccactggg

SEQ ID NO: 35840 - DNA, 20 bp, Artificial Sequence
  Description of Artificial Sequence: Synthetic oligonucleotide
  Target: SCN9A; (-) strand; PAM type: NRG; PAM sequence: GGG
ggcaataccttttcccactg

SEQ ID NO: 35841 - DNA, 20 bp, Artificial Sequence
  Description of Artificial Sequence: Synthetic oligonucleotide
  Target: SCN9A; (-) strand; PAM type: NRG; PAM sequence: GGG
aggcaataccttttcccact

SEQ ID NO: 35842 - DNA, 20 bp, Artificial Sequence
  Description of Artificial Sequence: Synthetic oligonucleotide
  Target: SCN9A; (-) strand; PAM type: NRG; PAM sequence: TGG
taggcaataccttttcccac

SEQ ID NO: 35843 - DNA, 20 bp, Artificial Sequence
  Description of Artificial Sequence: Synthetic oligonucleotide
  Target: SCN9A; (-) strand; PAM type: NRG; PAM sequence: AGG
ttgtggaggttaagtcccct

SEQ ID NO: 35844 - DNA, 20 bp, Artificial Sequence
  Description of Artificial Sequence: Synthetic oligonucleotide
  Target: SCN9A; (-) strand; PAM type: NRG; PAM sequence: TAG
cttgtggaggttaagtcccc

SEQ ID NO: 35845 - DNA, 20 bp, Artificial Sequence
  Description of Artificial Sequence: Synthetic oligonucleotide
  Target: SCN9A; (-) strand; PAM type: NRG; PAM sequence: AAG
agacaatccttgtggaggtt

SEQ ID NO: 35846 - DNA, 20 bp, Artificial Sequence
  Description of Artificial Sequence: Synthetic oligonucleotide
  Target: SCN9A; (-) strand; PAM type: NRG; PAM sequence: AGG
tttttagacaatccttgtgg

SEQ ID NO: 35847 - DNA, 20 bp, Artificial Sequence
  Description of Artificial Sequence: Synthetic oligonucleotide
  Target: SCN9A; (-) strand; PAM type: NRG; PAM sequence: GAG
gtttttagacaatccttgtg

SEQ ID NO: 35848 - DNA, 20 bp, Artificial Sequence
  Description of Artificial Sequence: Synthetic oligonucleotide
  Target: SCN9A; (-) strand; PAM type: NRG; PAM sequence: TGG
ttgtttttagacaatccttg

SEQ ID NO: 35849 - DNA, 20 bp, Artificial Sequence
  Description of Artificial Sequence: Synthetic oligonucleotide
  Target: SCN9A; (-) strand; PAM type: NRG; PAM sequence: TAG
ccacagatatttcttgtttt

SEQ ID NO: 35850 - DNA, 20 bp, Artificial Sequence
  Description of Artificial Sequence: Synthetic oligonucleotide
  Target: SCN9A; (-) strand; PAM type: NRG; PAM sequence: CAG
taaggttagtgtttatacca

SEQ ID NO: 35851 - DNA, 20 bp, Artificial Sequence
  Description of Artificial Sequence: Synthetic oligonucleotide
  Target: SCN9A; (-) strand; PAM type: NRG; PAM sequence: TAG
gaaaactgaagttttaaggt

SEQ ID NO: 35852 - DNA, 20 bp, Artificial Sequence
  Description of Artificial Sequence: Synthetic oligonucleotide
  Target: SCN9A; (-) strand; PAM type: NRG; PAM sequence: AGG
taccgaaaactgaagtttta

SEQ ID NO: 35853 - DNA, 20 bp, Artificial Sequence
  Description of Artificial Sequence: Synthetic oligonucleotide
  Target: SCN9A; (-) strand; PAM type: NRG; PAM sequence: AAG
ttaccgaaaactgaagtttt

SEQ ID NO: 35854 - DNA, 20 bp, Artificial Sequence
  Description of Artificial Sequence: Synthetic oligonucleotide
  Target: SCN9A; (-) strand; PAM type: NRG; PAM sequence: AAG
gagtttgttaccgaaaactg

SEQ ID NO: 35855 - DNA, 20 bp, Artificial Sequence
  Description of Artificial Sequence: Synthetic oligonucleotide
  Target: SCN9A; (-) strand; PAM type: NRG; PAM sequence: GAG
ttgttaaagtgttttcagaa

SEQ ID NO: 35856 - DNA, 20 bp, Artificial Sequence
  Description of Artificial Sequence: Synthetic oligonucleotide
  Target: SCN9A; (-) strand; PAM type: NRG; PAM sequence: AAG
ttttgttaaagtgttttcag

SEQ ID NO: 35857 - DNA, 20 bp, Artificial Sequence
  Description of Artificial Sequence: Synthetic oligonucleotide
  Target: SCN9A; (-) strand; PAM type: NRG; PAM sequence: CAG
cagttttgttaaagtgtttt

SEQ ID NO: 35858 - DNA, 20 bp, Artificial Sequence
  Description of Artificial Sequence: Synthetic oligonucleotide
  Target: SCN9A; (-) strand; PAM type: NRG; PAM sequence: AAG
tttttcactcagttttgtta

SEQ ID NO: 35859 - DNA, 20 bp, Artificial Sequence
  Description of Artificial Sequence: Synthetic oligonucleotide
  Target: SCN9A; (-) strand; PAM type: NRG; PAM sequence: CAG
aaagtcacttatttttcact

SEQ ID NO: 35860 - DNA, 20 bp, Artificial Sequence
  Description of Artificial Sequence: Synthetic oligonucleotide
  Target: SCN9A; (-) strand; PAM type: NRG; PAM sequence: AAG
ctctctgttaatttttagta

SEQ ID NO: 35861 - DNA, 20 bp, Artificial Sequence
  Description of Artificial Sequence: Synthetic oligonucleotide
  Target: SCN9A; (-) strand; PAM type: NRG; PAM sequence: TAG
ctcctctctctgttaatttt

SEQ ID NO: 35862 - DNA, 20 bp, Artificial Sequence
  Description of Artificial Sequence: Synthetic oligonucleotide
  Target: SCN9A; (-) strand; PAM type: NRG; PAM sequence: AAG
tagatttattttaataaagc

SEQ ID NO: 35863 - DNA, 20 bp, Artificial Sequence
  Description of Artificial Sequence: Synthetic oligonucleotide
  Target: SCN9A; (-) strand; PAM type: NRG; PAM sequence: AAG
atcttagatttattttaata

SEQ ID NO: 35864 - DNA, 20 bp, Artificial Sequence
  Description of Artificial Sequence: Synthetic oligonucleotide
  Target: SCN9A; (-) strand; PAM type: NRG; PAM sequence: TAG
atttctactatttagaatct

SEQ ID NO: 35865 - DNA, 20 bp, Artificial Sequence
  Description of Artificial Sequence: Synthetic oligonucleotide
  Target: SCN9A; (-) strand; PAM type: NRG; PAM sequence: TAG
gatcaatgatttctactatt

SEQ ID NO: 35866 - DNA, 20 bp, Artificial Sequence
  Description of Artificial Sequence: Synthetic oligonucleotide
  Target: SCN9A; (-) strand; PAM type: NRG; PAM sequence: TAG
ttgttttctcaacggtcaag

SEQ ID NO: 35867 - DNA, 20 bp, Artificial Sequence
  Description of Artificial Sequence: Synthetic oligonucleotide
  Target: SCN9A; (-) strand; PAM type: NRG; PAM sequence: AAG
atcttgttttctcaacggtc

SEQ ID NO: 35868 - DNA, 20 bp, Artificial Sequence
  Description of Artificial Sequence: Synthetic oligonucleotide
  Target: SCN9A; (-) strand; PAM type: NRG; PAM sequence: CGG
aagctatcttgttttctcaa

SEQ ID NO: 35869 - DNA, 20 bp, Artificial Sequence
  Description of Artificial Sequence: Synthetic oligonucleotide
  Target: SCN9A; (-) strand; PAM type: NRG; PAM sequence: AAG
aattaatgagtaagaaagaa

SEQ ID NO: 35870 - DNA, 20 bp, Artificial Sequence
  Description of Artificial Sequence: Synthetic oligonucleotide
  Target: SCN9A; (-) strand; PAM type: NRG; PAM sequence: AAG
aattgaattaatgagtaaga

SEQ ID NO: 35871 - DNA, 20 bp, Artificial Sequence
  Description of Artificial Sequence: Synthetic oligonucleotide
  Target: SCN9A; (-) strand; PAM type: NRG; PAM sequence: AAG
aacaaattgaattaatgagt

SEQ ID NO: 35872 - DNA, 20 bp, Artificial Sequence
  Description of Artificial Sequence: Synthetic oligonucleotide
  Target: SCN9A; (-) strand; PAM type: NRG; PAM sequence: GAG
agtaaacaaattgaattaat

SEQ ID NO: 35873 - DNA, 20 bp, Artificial Sequence
  Description of Artificial Sequence: Synthetic oligonucleotide
  Target: SCN9A; (-) strand; PAM type: NRG; PAM sequence: GAG
agagaaggtgcttaatactt

SEQ ID NO: 35874 - DNA, 20 bp, Artificial Sequence
  Description of Artificial Sequence: Synthetic oligonucleotide
  Target: SCN9A; (-) strand; PAM type: NRG; PAM sequence: AGG
tacaaggctttgcacagaga

SEQ ID NO: 35875 - DNA, 20 bp, Artificial Sequence
  Description of Artificial Sequence: Synthetic oligonucleotide
  Target: SCN9A; (-) strand; PAM type: NRG; PAM sequence: AAG
ttacaaggctttgcacagag

SEQ ID NO: 35876 - DNA, 20 bp, Artificial Sequence
  Description of Artificial Sequence: Synthetic oligonucleotide
  Target: SCN9A; (-) strand; PAM type: NRG; PAM sequence: GAG
attttacaaggctttgcaca

SEQ ID NO: 35877 - DNA, 20 bp, Artificial Sequence
  Description of Artificial Sequence: Synthetic oligonucleotide
  Target: SCN9A; (-) strand; PAM type: NRG; PAM sequence: CAG
ccattttacaaggctttgca

SEQ ID NO: 35878 - DNA, 20 bp, Artificial Sequence
  Description of Artificial Sequence: Synthetic oligonucleotide
  Target: SCN9A; (-) strand; PAM type: NRG; PAM sequence: AGG
tccacacagaccattttaca

SEQ ID NO: 35879 - DNA, 20 bp, Artificial Sequence
  Description of Artificial Sequence: Synthetic oligonucleotide
  Target: SCN9A; (-) strand; PAM type: NRG; PAM sequence: AAG
atccacacagaccattttac

SEQ ID NO: 35880 - DNA, 20 bp, Artificial Sequence
  Description of Artificial Sequence: Synthetic oligonucleotide
  Target: SCN9A; (-) strand; PAM type: NRG; PAM sequence: CAG
tgctgtagttgtaatccaca

SEQ ID NO: 35881 - DNA, 20 bp, Artificial Sequence
  Description of Artificial Sequence: Synthetic oligonucleotide
  Target: SCN9A; (-) strand; PAM type: NRG; PAM sequence: TAG
aacaaggattcattgtgctg

SEQ ID NO: 35882 - DNA, 20 bp, Artificial Sequence
  Description of Artificial Sequence: Synthetic oligonucleotide
  Target: SCN9A; (-) strand; PAM type: NRG; PAM sequence: AGG
agatatgattaaatcaaaca

SEQ ID NO: 35883 - DNA, 20 bp, Artificial Sequence
  Description of Artificial Sequence: Synthetic oligonucleotide
  Target: SCN9A; (-) strand; PAM type: NRG; PAM sequence: AAG
tagatatgattaaatcaaac

SEQ ID NO: 35884 - DNA, 20 bp, Artificial Sequence
  Description of Artificial Sequence: Synthetic oligonucleotide
  Target: SCN9A; (-) strand; PAM type: NRG; PAM sequence: TAG
gacccttcattttctaatcc

SEQ ID NO: 35885 - DNA, 20 bp, Artificial Sequence
  Description of Artificial Sequence: Synthetic oligonucleotide
  Target: SCN9A; (-) strand; PAM type: NRG; PAM sequence: GGG
ctagctagttaatgaattta

SEQ ID NO: 35886 - DNA, 20 bp, Artificial Sequence
  Description of Artificial Sequence: Synthetic oligonucleotide
  Target: SCN9A; (-) strand; PAM type: NRG; PAM sequence: AGG
cctagctagttaatgaattt

SEQ ID NO: 35887 - DNA, 20 bp, Artificial Sequence
  Description of Artificial Sequence: Synthetic oligonucleotide
  Target: SCN9A; (-) strand; PAM type: NRG; PAM sequence: TAG
gcctagctagttaatgaatt

SEQ ID NO: 35888 - DNA, 20 bp, Artificial Sequence
  Description of Artificial Sequence: Synthetic oligonucleotide
  Target: SCN9A; (-) strand; PAM type: NRG; PAM sequence: TAG
aaagaatatccttgcctagc

SEQ ID NO: 35889 - DNA, 20 bp, Artificial Sequence
  Description of Artificial Sequence: Synthetic oligonucleotide
  Target: SCN9A; (-) strand; PAM type: NRG; PAM sequence: TAG
tgggaaagaatatccttgcc

SEQ ID NO: 35890 - DNA, 20 bp, Artificial Sequence
  Description of Artificial Sequence: Synthetic oligonucleotide
  Target: SCN9A; (-) strand; PAM type: NRG; PAM sequence: AAG
taggagaattcctgatggga

SEQ ID NO: 35891 - DNA, 20 bp, Artificial Sequence
  Description of Artificial Sequence: Synthetic oligonucleotide
  Target: SCN9A; (-) strand; PAM type: NRG; PAM sequence: GGG
aatttaggagaattcctgat

SEQ ID NO: 35892 - DNA, 20 bp, Artificial Sequence
  Description of Artificial Sequence: Synthetic oligonucleotide
  Target: SCN9A; (-) strand; PAM type: NRG; PAM sequence: TGG
caatttaggagaattcctga

SEQ ID NO: 35893 - DNA, 20 bp, Artificial Sequence
  Description of Artificial Sequence: Synthetic oligonucleotide
  Target: SCN9A; (-) strand; PAM type: NRG; PAM sequence: GAG
taaatatactagcaatttag

SEQ ID NO: 35894 - DNA, 20 bp, Artificial Sequence
  Description of Artificial Sequence: Synthetic oligonucleotide
  Target: SCN9A; (-) strand; PAM type: NRG; PAM sequence: AGG
tataaatatactagcaattt

SEQ ID NO: 35895 - DNA, 20 bp, Artificial Sequence
  Description of Artificial Sequence: Synthetic oligonucleotide
  Target: SCN9A; (-) strand; PAM type: NRG; PAM sequence: TAG
gtataaatatactagcaatt

SEQ ID NO: 35896 - DNA, 20 bp, Artificial Sequence
  Description of Artificial Sequence: Synthetic oligonucleotide
  Target: SCN9A; (-) strand; PAM type: NRG; PAM sequence: TAG
gagttgttgtataaatatac

SEQ ID NO: 35897 - DNA, 20 bp, Artificial Sequence
  Description of Artificial Sequence: Synthetic oligonucleotide
  Target: SCN9A; (-) strand; PAM type: NRG; PAM sequence: GAG
ataccagtattaaaactttt

SEQ ID NO: 35898 - DNA, 20 bp, Artificial Sequence
  Description of Artificial Sequence: Synthetic oligonucleotide
  Target: SCN9A; (-) strand; PAM type: NRG; PAM sequence: CAG
ttctgttttttcttttatac

SEQ ID NO: 35899 - DNA, 20 bp, Artificial Sequence
  Description of Artificial Sequence: Synthetic oligonucleotide
  Target: SCN9A; (-) strand; PAM type: NRG; PAM sequence: AAG
gaacatgtgccttccatttc

SEQ ID NO: 35900 - DNA, 20 bp, Artificial Sequence
  Description of Artificial Sequence: Synthetic oligonucleotide
  Target: SCN9A; (-) strand; PAM type: NRG; PAM sequence: TAG
gtccccagagatctggtttt

SEQ ID NO: 35901 - DNA, 20 bp, Artificial Sequence
  Description of Artificial Sequence: Synthetic oligonucleotide
  Target: SCN9A; (-) strand; PAM type: NRG; PAM sequence: TGG
acccattgtccccagagatc

SEQ ID NO: 35902 - DNA, 20 bp, Artificial Sequence
  Description of Artificial Sequence: Synthetic oligonucleotide
  Target: SCN9A; (-) strand; PAM type: NRG; PAM sequence: GAG
tcccatacccattgtcccca

SEQ ID NO: 35903 - DNA, 20 bp, Artificial Sequence
  Description of Artificial Sequence: Synthetic oligonucleotide
  Target: SCN9A; (-) strand; PAM type: NRG; PAM sequence: CAG
tttcccatacccattgtccc

SEQ ID NO: 35904 - DNA, 20 bp, Artificial Sequence
  Description of Artificial Sequence: Synthetic oligonucleotide
  Target: SCN9A; (-) strand; PAM type: NRG; PAM sequence: CAG
gtagactctaagagagtttc

SEQ ID NO: 35905 - DNA, 20 bp, Artificial Sequence
  Description of Artificial Sequence: Synthetic oligonucleotide
  Target: SCN9A; (-) strand; PAM type: NRG; PAM sequence: GAG
ataattcgtagactctaaga

SEQ ID NO: 35906 - DNA, 20 bp, Artificial Sequence
  Description of Artificial Sequence: Synthetic oligonucleotide
  Target: SCN9A; (-) strand; PAM type: NRG; PAM sequence: GAG
atataattcgtagactctaa

SEQ ID NO: 35907 - DNA, 20 bp, Artificial Sequence
  Description of Artificial Sequence: Synthetic oligonucleotide
  Target: SCN9A; (-) strand; PAM type: NRG; PAM sequence: AAG
ctatataattcgtagactct

SEQ ID NO: 35908 - DNA, 20 bp, Artificial Sequence
  Description of Artificial Sequence: Synthetic oligonucleotide
  Target: SCN9A; (-) strand; PAM type: NRG; PAM sequence: TAG
aaaaattcctatataattcg

SEQ ID NO: 35909 - DNA, 20 bp, Artificial Sequence
  Description of Artificial Sequence: Synthetic oligonucleotide
  Target: SCN9A; (-) strand; PAM type: NRG; PAM sequence: TGG
cgtttaggtctgtgattcat

SEQ ID NO: 35910 - DNA, 20 bp, Artificial Sequence
  Description of Artificial Sequence: Synthetic oligonucleotide
  Target: SCN9A; (-) strand; PAM type: NRG; PAM sequence: AGG
cagttctaactctgacgttt

SEQ ID NO: 35911 - DNA, 20 bp, Artificial Sequence
  Description of Artificial Sequence: Synthetic oligonucleotide
  Target: SCN9A; (-) strand; PAM type: NRG; PAM sequence: TAG
acagttctaactctgacgtt

SEQ ID NO: 35912 - DNA, 20 bp, Artificial Sequence
  Description of Artificial Sequence: Synthetic oligonucleotide
  Target: SCN9A; (-) strand; PAM type: NRG; PAM sequence: CAG
gatattttcttagaaattta

SEQ ID NO: 35913 - DNA, 20 bp, Artificial Sequence
  Description of Artificial Sequence: Synthetic oligonucleotide
  Target: SCN9A; (-) strand; PAM type: NRG; PAM sequence: TAG
ttttccctatgatattttct

SEQ ID NO: 35914 - DNA, 20 bp, Artificial Sequence
  Description of Artificial Sequence: Synthetic oligonucleotide
  Target: SCN9A; (-) strand; PAM type: NRG; PAM sequence: AAG
gtgccaaatctaatgtctcg

SEQ ID NO: 35915 - DNA, 20 bp, Artificial Sequence
  Description of Artificial Sequence: Synthetic oligonucleotide
  Target: SCN9A; (-) strand; PAM type: NRG; PAM sequence: TGG
tcttttgttgaccgtgcttt

SEQ ID NO: 35916 - DNA, 20 bp, Artificial Sequence
  Description of Artificial Sequence: Synthetic oligonucleotide
  Target: SCN9A; (-) strand; PAM type: NRG; PAM sequence: CAG
aattttgacaaaatccaatt

SEQ ID NO: 35917 - DNA, 20 bp, Artificial Sequence
  Description of Artificial Sequence: Synthetic oligonucleotide
  Target: SCN9A; (-) strand; PAM type: NRG; PAM sequence: CAG
tagtgttctttgatgcacaa

SEQ ID NO: 35918 - DNA, 20 bp, Artificial Sequence
  Description of Artificial Sequence: Synthetic oligonucleotide
  Target: SCN9A; (-) strand; PAM type: NRG; PAM sequence: TAG
attgccttttcactttctag

SEQ ID NO: 35919 - DNA, 20 bp, Artificial Sequence
  Description of Artificial Sequence: Synthetic oligonucleotide
  Target: SCN9A; (-) strand; PAM type: NRG; PAM sequence: TAG
tggattgccttttcactttc

SEQ ID NO: 35920 - DNA, 20 bp, Artificial Sequence
  Description of Artificial Sequence: Synthetic oligonucleotide
  Target: SCN9A; (-) strand; PAM type: NRG; PAM sequence: TGG
aattattttctcccatcata

SEQ ID NO: 35921 - DNA, 20 bp, Artificial Sequence
  Description of Artificial Sequence: Synthetic oligonucleotide
  Target: SCN9A; (-) strand; PAM type: NRG; PAM sequence: CAG
tgccaatgttaatcccttat

SEQ ID NO: 35922 - DNA, 20 bp, Artificial Sequence
  Description of Artificial Sequence: Synthetic oligonucleotide
  Target: SCN9A; (-) strand; PAM type: NRG; PAM sequence: AGG
tttattttttgttgaggagt

SEQ ID NO: 35923 - DNA, 20 bp, Artificial Sequence
  Description of Artificial Sequence: Synthetic oligonucleotide
  Target: SCN9A; (-) strand; PAM type: NRG; PAM sequence: TAG
gtttattttttgttgaggag

SEQ ID NO: 35924 - DNA, 20 bp, Artificial Sequence
  Description of Artificial Sequence: Synthetic oligonucleotide
  Target: SCN9A; (-) strand; PAM type: NRG; PAM sequence: GAG
cttgtttattttttgttgag

SEQ ID NO: 35925 - DNA, 20 bp, Artificial Sequence
  Description of Artificial Sequence: Synthetic oligonucleotide
  Target: SCN9A; (-) strand; PAM type: NRG; PAM sequence: AGG
tgcttgtttattttttgttg

SEQ ID NO: 35926 - DNA, 20 bp, Artificial Sequence
  Description of Artificial Sequence: Synthetic oligonucleotide
  Target: SCN9A; (-) strand; PAM type: NRG; PAM sequence: GAG
ctgcttgtttattttttgtt

SEQ ID NO: 35927 - DNA, 20 bp, Artificial Sequence
  Description of Artificial Sequence: Synthetic oligonucleotide
  Target: SCN9A; (-) strand; PAM type: NRG; PAM sequence: TGG
atgtactgattgactttctt

SEQ ID NO: 35928 - DNA, 20 bp, Artificial Sequence
  Description of Artificial Sequence: Synthetic oligonucleotide
  Target: SCN9A; (-) strand; PAM type: NRG; PAM sequence: GAG
cccaaatgatcggtgatgtt

SEQ ID NO: 35929 - DNA, 20 bp, Artificial Sequence
  Description of Artificial Sequence: Synthetic oligonucleotide
  Target: SCN9A; (-) strand; PAM type: NRG; PAM sequence: CGG
atttgcatttcccaaatgat

SEQ ID NO: 35930 - DNA, 20 bp, Artificial Sequence
  Description of Artificial Sequence: Synthetic oligonucleotide
  Target: SCN9A; (-) strand; PAM type: NRG; PAM sequence: TGG
tgtgaagtgatattttattg

SEQ ID NO: 35931 - DNA, 20 bp, Artificial Sequence
  Description of Artificial Sequence: Synthetic oligonucleotide
  Target: SCN9A; (-) strand; PAM type: NRG; PAM sequence: AAG
taaccatccgaccaagtgtg

SEQ ID NO: 35932 - DNA, 20 bp, Artificial Sequence
  Description of Artificial Sequence: Synthetic oligonucleotide
  Target: SCN9A; (-) strand; PAM type: NRG; PAM sequence: AAG
taaacaataaccatccgacc

SEQ ID NO: 35933 - DNA, 20 bp, Artificial Sequence
  Description of Artificial Sequence: Synthetic oligonucleotide
  Target: SCN9A; (-) strand; PAM type: NRG; PAM sequence: GGG
ttcctatcagcaatgcacaa

SEQ ID NO: 35934 - DNA, 20 bp, Artificial Sequence
  Description of Artificial Sequence: Synthetic oligonucleotide
  Target: SCN9A; (-) strand; PAM type: NRG; PAM sequence: AGG
attcctatcagcaatgcaca

SEQ ID NO: 35935 - DNA, 20 bp, Artificial Sequence
  Description of Artificial Sequence: Synthetic oligonucleotide
  Target: SCN9A; (-) strand; PAM type: NRG; PAM sequence: AAG
tattcctatcagcaatgcac

SEQ ID NO: 35936 - DNA, 20 bp, Artificial Sequence
  Description of Artificial Sequence: Synthetic oligonucleotide
  Target: SCN9A; (-) strand; PAM type: NRG; PAM sequence: CAG
gcactattttatattcctat

SEQ ID NO: 35937 - DNA, 20 bp, Artificial Sequence
  Description of Artificial Sequence: Synthetic oligonucleotide
  Target: SCN9A; (-) strand; PAM type: NRG; PAM sequence: CAG
caccacagtgttttccacag

SEQ ID NO: 35938 - DNA, 20 bp, Artificial Sequence
  Description of Artificial Sequence: Synthetic oligonucleotide
  Target: SCN9A; (-) strand; PAM type: NRG; PAM sequence: CAG
aaccaccacagtgttttcca

SEQ ID NO: 35939 - DNA, 20 bp, Artificial Sequence
  Description of Artificial Sequence: Synthetic oligonucleotide
  Target: SCN9A; (-) strand; PAM type: NRG; PAM sequence: CAG
aattttttgaggaaccacca

SEQ ID NO: 35940 - DNA, 20 bp, Artificial Sequence
  Description of Artificial Sequence: Synthetic oligonucleotide
  Target: SCN9A; (-) strand; PAM type: NRG; PAM sequence: AGG
tatttctgtttaattttttg

SEQ ID NO: 35941 - DNA, 20 bp, Artificial Sequence
  Description of Artificial Sequence: Synthetic oligonucleotide
  Target: SCN9A; (-) strand; PAM type: NRG; PAM sequence: GAG
atatttctgtttaatttttt

SEQ ID NO: 35942 - DNA, 20 bp, Artificial Sequence
  Description of Artificial Sequence: Synthetic oligonucleotide
  Target: SCN9A; (-) strand; PAM type: NRG; PAM sequence: TGG
ataccctaaagtagaattgc

SEQ ID NO: 35943 - DNA, 20 bp, Artificial Sequence
  Description of Artificial Sequence: Synthetic oligonucleotide
  Target: SCN9A; (-) strand; PAM type: NRG; PAM sequence: TAG
ttaggatgtataccctaaag

SEQ ID NO: 35944 - DNA, 20 bp, Artificial Sequence
  Description of Artificial Sequence: Synthetic oligonucleotide
  Target: SCN9A; (-) strand; PAM type: NRG; PAM sequence: AAG
tgtttaggatgtatacccta

SEQ ID NO: 35945 - DNA, 20 bp, Artificial Sequence
  Description of Artificial Sequence: Synthetic oligonucleotide
  Target: SCN9A; (-) strand; PAM type: NRG; PAM sequence: AGG
gtcccttctattaattgttt

SEQ ID NO: 35946 - DNA, 20 bp, Artificial Sequence
  Description of Artificial Sequence: Synthetic oligonucleotide
  Target: SCN9A; (-) strand; PAM type: NRG; PAM sequence: TAG
cgtcccttctattaattgtt

SEQ ID NO: 35947 - DNA, 20 bp, Artificial Sequence
  Description of Artificial Sequence: Synthetic oligonucleotide
  Target: SCN9A; (-) strand; PAM type: NRG; PAM sequence: CAG
ctgctatgaacattggtgta

SEQ ID NO: 35948 - DNA, 20 bp, Artificial Sequence
  Description of Artificial Sequence: Synthetic oligonucleotide
  Target: SCN9A; (-) strand; PAM type: NRG; PAM sequence: TGG
attagtgctgctatgaacat

SEQ ID NO: 35949 - DNA, 20 bp, Artificial Sequence
  Description of Artificial Sequence: Synthetic oligonucleotide
  Target: SCN9A; (-) strand; PAM type: NRG; PAM sequence: TAG
cactttttggctactgtgat

SEQ ID NO: 35950 - DNA, 20 bp, Artificial Sequence
  Description of Artificial Sequence: Synthetic oligonucleotide
  Target: SCN9A; (-) strand; PAM type: NRG; PAM sequence: TGG
tttgggttgttttcactttt

SEQ ID NO: 35951 - DNA, 20 bp, Artificial Sequence
  Description of Artificial Sequence: Synthetic oligonucleotide
  Target: SCN9A; (-) strand; PAM type: NRG; PAM sequence: GGG
tcatctgttgatagacattt

SEQ ID NO: 35952 - DNA, 20 bp, Artificial Sequence
  Description of Artificial Sequence: Synthetic oligonucleotide
  Target: SCN9A; (-) strand; PAM type: NRG; PAM sequence: TGG
ttcatctgttgatagacatt

SEQ ID NO: 35953 - DNA, 20 bp, Artificial Sequence
  Description of Artificial Sequence: Synthetic oligonucleotide
  Target: SCN9A; (-) strand; PAM type: NRG; PAM sequence: TAG
tttatctgttcatctgttga

SEQ ID NO: 35954 - DNA, 20 bp, Artificial Sequence
  Description of Artificial Sequence: Synthetic oligonucleotide
  Target: SCN9A; (-) strand; PAM type: NRG; PAM sequence: TAG
tattcatttttaaggctgtg

SEQ ID NO: 35955 - DNA, 20 bp, Artificial Sequence
  Description of Artificial Sequence: Synthetic oligonucleotide
  Target: SCN9A; (-) strand; PAM type: NRG; PAM sequence: AGG
cagaattttattcattttta

SEQ ID NO: 35956 - DNA, 20 bp, Artificial Sequence
  Description of Artificial Sequence: Synthetic oligonucleotide
  Target: SCN9A; (-) strand; PAM type: NRG; PAM sequence: AAG
tcagaattttattcattttt

SEQ ID NO: 35957 - DNA, 20 bp, Artificial Sequence
  Description of Artificial Sequence: Synthetic oligonucleotide
  Target: SCN9A; (-) strand; PAM type: NRG; PAM sequence: CAG
atccgggtcgtagcatatat

SEQ ID NO: 35958 - DNA, 20 bp, Artificial Sequence
  Description of Artificial Sequence: Synthetic oligonucleotide
  Target: SCN9A; (-) strand; PAM type: NRG; PAM sequence: TAG
caaggtgttcatccgggtcg

SEQ ID NO: 35959 - DNA, 20 bp, Artificial Sequence
  Description of Artificial Sequence: Synthetic oligonucleotide
  Target: SCN9A; (-) strand; PAM type: NRG; PAM sequence: GGG
tgttttcaaggtgttcatcc

SEQ ID NO: 35960 - DNA, 20 bp, Artificial Sequence
  Description of Artificial Sequence: Synthetic oligonucleotide
  Target: SCN9A; (-) strand; PAM type: NRG; PAM sequence: CGG
atgttttcaaggtgttcatc

SEQ ID NO: 35961 - DNA, 20 bp, Artificial Sequence
  Description of Artificial Sequence: Synthetic oligonucleotide
  Target: SCN9A; (-) strand; PAM type: NRG; PAM sequence: AGG
cacttagcataatgttttca

SEQ ID NO: 35962 - DNA, 20 bp, Artificial Sequence
  Description of Artificial Sequence: Synthetic oligonucleotide
  Target: SCN9A; (-) strand; PAM type: NRG; PAM sequence: AAG
tcacttagcataatgttttc

SEQ ID NO: 35963 - DNA, 20 bp, Artificial Sequence
  Description of Artificial Sequence: Synthetic oligonucleotide
  Target: SCN9A; (-) strand; PAM type: NRG; PAM sequence: TAG
catgtctggcttatttcact

SEQ ID NO: 35964 - DNA, 20 bp, Artificial Sequence
  Description of Artificial Sequence: Synthetic oligonucleotide
  Target: SCN9A; (-) strand; PAM type: NRG; PAM sequence: TGG
agcatttgtcttttcatgtc

SEQ ID NO: 35965 - DNA, 20 bp, Artificial Sequence
  Description of Artificial Sequence: Synthetic oligonucleotide
  Target: SCN9A; (-) strand; PAM type: NRG; PAM sequence: TAG
ctcatgtaagtggaacccta

SEQ ID NO: 35966 - DNA, 20 bp, Artificial Sequence
  Description of Artificial Sequence: Synthetic oligonucleotide
  Target: SCN9A; (-) strand; PAM type: NRG; PAM sequence: TGG
ttctaggtacctcatgtaag

SEQ ID NO: 35967 - DNA, 20 bp, Artificial Sequence
  Description of Artificial Sequence: Synthetic oligonucleotide
  Target: SCN9A; (-) strand; PAM type: NRG; PAM sequence: AAG
ctattctaggtacctcatgt

SEQ ID NO: 35968 - DNA, 20 bp, Artificial Sequence
  Description of Artificial Sequence: Synthetic oligonucleotide
  Target: SCN9A; (-) strand; PAM type: NRG; PAM sequence: AGG
tctatgaatgtgactattct

SEQ ID NO: 35969 - DNA, 20 bp, Artificial Sequence
  Description of Artificial Sequence: Synthetic oligonucleotide
  Target: SCN9A; (-) strand; PAM type: NRG; PAM sequence: TAG
ctctatgaatgtgactattc

SEQ ID NO: 35970 - DNA, 20 bp, Artificial Sequence
  Description of Artificial Sequence: Synthetic oligonucleotide
  Target: SCN9A; (-) strand; PAM type: NRG; PAM sequence: CAG
tcctctcttcccctatcacc

SEQ ID NO: 35971 - DNA, 20 bp, Artificial Sequence
  Description of Artificial Sequence: Synthetic oligonucleotide
  Target: SCN9A; (-) strand; PAM type: NRG; PAM sequence: CGG
catcattccaaacaaaaact

SEQ ID NO: 35972 - DNA, 20 bp, Artificial Sequence
  Description of Artificial Sequence: Synthetic oligonucleotide
  Target: SCN9A; (-) strand; PAM type: NRG; PAM sequence: CAG
cgatcaccaccatccatctt

SEQ ID NO: 35973 - DNA, 20 bp, Artificial Sequence
  Description of Artificial Sequence: Synthetic oligonucleotide
  Target: SCN9A; (-) strand; PAM type: NRG; PAM sequence: AAG
atgtacagtttagaggtatt

SEQ ID NO: 35974 - DNA, 20 bp, Artificial Sequence
  Description of Artificial Sequence: Synthetic oligonucleotide
  Target: SCN9A; (-) strand; PAM type: NRG; PAM sequence: AGG
atttcaaatgtacagtttag

SEQ ID NO: 35975 - DNA, 20 bp, Artificial Sequence
  Description of Artificial Sequence: Synthetic oligonucleotide
  Target: SCN9A; (-) strand; PAM type: NRG; PAM sequence: GAG
catttcaaatgtacagttta

SEQ ID NO: 35976 - DNA, 20 bp, Artificial Sequence
  Description of Artificial Sequence: Synthetic oligonucleotide
  Target: SCN9A; (-) strand; PAM type: NRG; PAM sequence: TAG
accatttcaaatgtacagtt

SEQ ID NO: 35977 - DNA, 20 bp, Artificial Sequence
  Description of Artificial Sequence: Synthetic oligonucleotide
  Target: SCN9A; (-) strand; PAM type: NRG; PAM sequence: CAG
ttttaaccatttcaaatgta

SEQ ID NO: 35978 - DNA, 20 bp, Artificial Sequence
  Description of Artificial Sequence: Synthetic oligonucleotide
  Target: SCN9A; (-) strand; PAM type: NRG; PAM sequence: TGG
gaatttaaaaatttatattt

SEQ ID NO: 35979 - DNA, 20 bp, Artificial Sequence
  Description of Artificial Sequence: Synthetic oligonucleotide
  Target: SCN9A; (-) strand; PAM type: NRG; PAM sequence: TAG
ttacggatctcaaaacacgc

SEQ ID NO: 35980 - DNA, 20 bp, Artificial Sequence
  Description of Artificial Sequence: Synthetic oligonucleotide
  Target: SCN9A; (-) strand; PAM type: NRG; PAM sequence: CGG
tactgactctttctgcctta

SEQ ID NO: 35981 - DNA, 20 bp, Artificial Sequence
  Description of Artificial Sequence: Synthetic oligonucleotide
  Target: SCN9A; (-) strand; PAM type: NRG; PAM sequence: CGG
cgcatgttgtcagggttgac

SEQ ID NO: 35982 - DNA, 20 bp, Artificial Sequence
  Description of Artificial Sequence: Synthetic oligonucleotide
  Target: SCN9A; (-) strand; PAM type: NRG; PAM sequence: GGG
ggagacaccgcatgttgtca

SEQ ID NO: 35983 - DNA, 20 bp, Artificial Sequence
  Description of Artificial Sequence: Synthetic oligonucleotide
  Target: SCN9A; (-) strand; PAM type: NRG; PAM sequence: AGG
aggagacaccgcatgttgtc

SEQ ID NO: 35984 - DNA, 20 bp, Artificial Sequence
  Description of Artificial Sequence: Synthetic oligonucleotide
  Target: SCN9A; (-) strand; PAM type: NRG; PAM sequence: CAG
aaggagacaccgcatgttgt

SEQ ID NO: 35985 - DNA, 20 bp, Artificial Sequence
  Description of Artificial Sequence: Synthetic oligonucleotide
  Target: SCN9A; (-) strand; PAM type: NRG; PAM sequence: GAG
ctagcaaaacagataccaag

SEQ ID NO: 35986 - DNA, 20 bp, Artificial Sequence
  Description of Artificial Sequence: Synthetic oligonucleotide
  Target: SCN9A; (-) strand; PAM type: NRG; PAM sequence: AGG
gcctagcaaaacagatacca

SEQ ID NO: 35987 - DNA, 20 bp, Artificial Sequence
  Description of Artificial Sequence: Synthetic oligonucleotide
  Target: SCN9A; (-) strand; PAM type: NRG; PAM sequence: AAG
tgcctagcaaaacagatacc

SEQ ID NO: 35988 - DNA, 20 bp, Artificial Sequence
  Description of Artificial Sequence: Synthetic oligonucleotide
  Target: SCN9A; (-) strand; PAM type: NRG; PAM sequence: CAG
atgactactgcctagcaaaa

SEQ ID NO: 35989 - DNA, 20 bp, Artificial Sequence
  Description of Artificial Sequence: Synthetic oligonucleotide
  Target: SCN9A; (-) strand; PAM type: NRG; PAM sequence: TAG
agatataaatgactactgcc

SEQ ID NO: 35990 - DNA, 20 bp, Artificial Sequence
  Description of Artificial Sequence: Synthetic oligonucleotide
  Target: SCN9A; (-) strand; PAM type: NRG; PAM sequence: TAG
catgaaatagtggtactgca

SEQ ID NO: 35991 - DNA, 20 bp, Artificial Sequence
  Description of Artificial Sequence: Synthetic oligonucleotide
  Target: SCN9A; (-) strand; PAM type: NRG; PAM sequence: TGG
gattatttctcatgaaatag

SEQ ID NO: 35992 - DNA, 20 bp, Artificial Sequence
  Description of Artificial Sequence: Synthetic oligonucleotide
  Target: SCN9A; (-) strand; PAM type: NRG; PAM sequence: TAG
tatgattatttctcatgaaa

SEQ ID NO: 35993 - DNA, 20 bp, Artificial Sequence
  Description of Artificial Sequence: Synthetic oligonucleotide
  Target: SCN9A; (-) strand; PAM type: NRG; PAM sequence: CAG
gaaacttaatggtgggagta

SEQ ID NO: 35994 - DNA, 20 bp, Artificial Sequence
  Description of Artificial Sequence: Synthetic oligonucleotide
  Target: SCN9A; (-) strand; PAM type: NRG; PAM sequence: GAG
ttttggaaacttaatggtgg

SEQ ID NO: 35995 - DNA, 20 bp, Artificial Sequence
  Description of Artificial Sequence: Synthetic oligonucleotide
  Target: SCN9A; (-) strand; PAM type: NRG; PAM sequence: GGG
cattttggaaacttaatggt

SEQ ID NO: 35996 - DNA, 20 bp, Artificial Sequence
  Description of Artificial Sequence: Synthetic oligonucleotide
  Target: SCN9A; (-) strand; PAM type: NRG; PAM sequence: TGG
gcattttggaaacttaatgg

SEQ ID NO: 35997 - DNA, 20 bp, Artificial Sequence
  Description of Artificial Sequence: Synthetic oligonucleotide
  Target: SCN9A; (-) strand; PAM type: NRG; PAM sequence: TGG
tttgcattttggaaacttaa

SEQ ID NO: 35998 - DNA, 20 bp, Artificial Sequence
  Description of Artificial Sequence: Synthetic oligonucleotide
  Target: SCN9A; (-) strand; PAM type: NRG; PAM sequence: TGG
aactttaaatgtttgcattt

SEQ ID NO: 35999 - DNA, 20 bp, Artificial Sequence
  Description of Artificial Sequence: Synthetic oligonucleotide
  Target: SCN9A; (-) strand; PAM type: NRG; PAM sequence: GAG
aagacaaagattacaattga

SEQ ID NO: 36000 - DNA, 20 bp, Artificial Sequence
  Description of Artificial Sequence: Synthetic oligonucleotide
  Target: SCN9A; (-) strand; PAM type: NRG; PAM sequence: GAG
ataagacaaagattacaatt

SEQ ID NO: 36001 - DNA, 20 bp, Artificial Sequence
  Description of Artificial Sequence: Synthetic oligonucleotide
  Target: SCN9A; (-) strand; PAM type: NRG; PAM sequence: AAG
ggggcagggctaataagaca

SEQ ID NO: 36002 - DNA, 20 bp, Artificial Sequence
  Description of Artificial Sequence: Synthetic oligonucleotide
  Target: SCN9A; (-) strand; PAM type: NRG; PAM sequence: AAG
gggcagggggcagggctaat

SEQ ID NO: 36003 - DNA, 20 bp, Artificial Sequence
  Description of Artificial Sequence: Synthetic oligonucleotide
  Target: SCN9A; (-) strand; PAM type: NRG; PAM sequence: GGG
actatttggggcagggggca

SEQ ID NO: 36004 - DNA, 20 bp, Artificial Sequence
  Description of Artificial Sequence: Synthetic oligonucleotide
  Target: SCN9A; (-) strand; PAM type: NRG; PAM sequence: AGG
tactatttggggcagggggc

SEQ ID NO: 36005 - DNA, 20 bp, Artificial Sequence
  Description of Artificial Sequence: Synthetic oligonucleotide
  Target: SCN9A; (-) strand; PAM type: NRG; PAM sequence: CAG
ttactatttggggcaggggg

SEQ ID NO: 36006 - DNA, 20 bp, Artificial Sequence
  Description of Artificial Sequence: Synthetic oligonucleotide
  Target: SCN9A; (-) strand; PAM type: NRG; PAM sequence: GGG
ctcttactatttggggcagg

SEQ ID NO: 36007 - DNA, 20 bp, Artificial Sequence
  Description of Artificial Sequence: Synthetic oligonucleotide
  Target: SCN9A; (-) strand; PAM type: NRG; PAM sequence: GGG
cctcttactatttggggcag

SEQ ID NO: 36008 - DNA, 20 bp, Artificial Sequence
  Description of Artificial Sequence: Synthetic oligonucleotide
  Target: SCN9A; (-) strand; PAM type: NRG; PAM sequence: GGG
acctcttactatttggggca

SEQ ID NO: 36009 - DNA, 20 bp, Artificial Sequence
  Description of Artificial Sequence: Synthetic oligonucleotide
  Target: SCN9A; (-) strand; PAM type: NRG; PAM sequence: AGG
aacctcttactatttggggc

SEQ ID NO: 36010 - DNA, 20 bp, Artificial Sequence
  Description of Artificial Sequence: Synthetic oligonucleotide
  Target: SCN9A; (-) strand; PAM type: NRG; PAM sequence: CAG
gaacctcttactatttgggg

SEQ ID NO: 36011 - DNA, 20 bp, Artificial Sequence
  Description of Artificial Sequence: Synthetic oligonucleotide
  Target: SCN9A; (-) strand; PAM type: NRG; PAM sequence: GGG
ttggaacctcttactatttg

SEQ ID NO: 36012 - DNA, 20 bp, Artificial Sequence
  Description of Artificial Sequence: Synthetic oligonucleotide
  Target: SCN9A; (-) strand; PAM type: NRG; PAM sequence: GGG
cttggaacctcttactattt

SEQ ID NO: 36013 - DNA, 20 bp, Artificial Sequence
  Description of Artificial Sequence: Synthetic oligonucleotide
  Target: SCN9A; (-) strand; PAM type: NRG; PAM sequence: TGG
tcttggaacctcttactatt

SEQ ID NO: 36014 - DNA, 20 bp, Artificial Sequence
  Description of Artificial Sequence: Synthetic oligonucleotide
  Target: SCN9A; (-) strand; PAM type: NRG; PAM sequence: TGG
tctgtaatggattggattct

SEQ ID NO: 36015 - DNA, 20 bp, Artificial Sequence
  Description of Artificial Sequence: Synthetic oligonucleotide
  Target: SCN9A; (-) strand; PAM type: NRG; PAM sequence: TGG
tcttcctgtctgtaatggat

SEQ ID NO: 36016 - DNA, 20 bp, Artificial Sequence
  Description of Artificial Sequence: Synthetic oligonucleotide
  Target: SCN9A; (-) strand; PAM type: NRG; PAM sequence: TGG
tattctcttcctgtctgtaa

SEQ ID NO: 36017 - DNA, 20 bp, Artificial Sequence
  Description of Artificial Sequence: Synthetic oligonucleotide
  Target: SCN9A; (-) strand; PAM type: NRG; PAM sequence: TAG
ttttgtctttttttgtgatt

SEQ ID NO: 36018 - DNA, 20 bp, Artificial Sequence
  Description of Artificial Sequence: Synthetic oligonucleotide
  Target: SCN9A; (-) strand; PAM type: NRG; PAM sequence: AAG
accagaaaaaaatgtttgag

SEQ ID NO: 36019 - DNA, 20 bp, Artificial Sequence
  Description of Artificial Sequence: Synthetic oligonucleotide
  Target: SCN9A; (-) strand; PAM type: NRG; PAM sequence: GAG
aaaaccagaaaaaaatgttt

SEQ ID NO: 36020 - DNA, 20 bp, Artificial Sequence
  Description of Artificial Sequence: Synthetic oligonucleotide
  Target: SCN9A; (-) strand; PAM type: NRG; PAM sequence: CAG
ggacatgggtaacataaaac

SEQ ID NO: 36021 - DNA, 20 bp, Artificial Sequence
  Description of Artificial Sequence: Synthetic oligonucleotide
  Target: SCN9A; (-) strand; PAM type: NRG; PAM sequence: GGG
ctggatctctttctggacat

SEQ ID NO: 36022 - DNA, 20 bp, Artificial Sequence
  Description of Artificial Sequence: Synthetic oligonucleotide
  Target: SCN9A; (-) strand; PAM type: NRG; PAM sequence: TGG
actggatctctttctggaca

SEQ ID NO: 36023 - DNA, 20 bp, Artificial Sequence
  Description of Artificial Sequence: Synthetic oligonucleotide
  Target: SCN9A; (-) strand; PAM type: NRG; PAM sequence: TGG
tttttaactggatctctttc

SEQ ID NO: 36024 - DNA, 20 bp, Artificial Sequence
  Description of Artificial Sequence: Synthetic oligonucleotide
  Target: SCN9A; (-) strand; PAM type: NRG; PAM sequence: TGG
tgagtgtgctcttttttaac

SEQ ID NO: 36025 - DNA, 20 bp, Artificial Sequence
  Description of Artificial Sequence: Synthetic oligonucleotide
  Target: SCN9A; (-) strand; PAM type: NRG; PAM sequence: GAG
gtacaactttggaaagggat

SEQ ID NO: 36026 - DNA, 20 bp, Artificial Sequence
  Description of Artificial Sequence: Synthetic oligonucleotide
  Target: SCN9A; (-) strand; PAM type: NRG; PAM sequence: GGG
catgggtacaactttggaaa

SEQ ID NO: 36027 - DNA, 20 bp, Artificial Sequence
  Description of Artificial Sequence: Synthetic oligonucleotide
  Target: SCN9A; (-) strand; PAM type: NRG; PAM sequence: AGG
gcatgggtacaactttggaa

SEQ ID NO: 36028 - DNA, 20 bp, Artificial Sequence
  Description of Artificial Sequence: Synthetic oligonucleotide
  Target: SCN9A; (-) strand; PAM type: NRG; PAM sequence: AAG
agcatgggtacaactttgga

SEQ ID NO: 36029 - DNA, 20 bp, Artificial Sequence
  Description of Artificial Sequence: Synthetic oligonucleotide
  Target: SCN9A; (-) strand; PAM type: NRG; PAM sequence: TGG
taccagcatgggtacaactt

SEQ ID NO: 36030 - DNA, 20 bp, Artificial Sequence
  Description of Artificial Sequence: Synthetic oligonucleotide
  Target: SCN9A; (-) strand; PAM type: NRG; PAM sequence: GGG
aatgctaaaattaccagcat

SEQ ID NO: 36031 - DNA, 20 bp, Artificial Sequence
  Description of Artificial Sequence: Synthetic oligonucleotide
  Target: SCN9A; (-) strand; PAM type: NRG; PAM sequence: TGG
caatgctaaaattaccagca

SEQ ID NO: 36032 - DNA, 20 bp, Artificial Sequence
  Description of Artificial Sequence: Synthetic oligonucleotide
  Target: SCN9A; (-) strand; PAM type: NRG; PAM sequence: CAG
taaaccaatgctaaaattac

SEQ ID NO: 36033 - DNA, 20 bp, Artificial Sequence
  Description of Artificial Sequence: Synthetic oligonucleotide
  Target: SCN9A; (-) strand; PAM type: NRG; PAM sequence: GGG
ggattactaacctgcgtcga

SEQ ID NO: 36034 - DNA, 20 bp, Artificial Sequence
  Description of Artificial Sequence: Synthetic oligonucleotide
  Target: SCN9A; (-) strand; PAM type: NRG; PAM sequence: AGG
gggattactaacctgcgtcg

SEQ ID NO: 36035 - DNA, 20 bp, Artificial Sequence
  Description of Artificial Sequence: Synthetic oligonucleotide
  Target: SCN9A; (-) strand; PAM type: NRG; PAM sequence: GAG
agggattactaacctgcgtc

SEQ ID NO: 36036 - DNA, 20 bp, Artificial Sequence
  Description of Artificial Sequence: Synthetic oligonucleotide
  Target: SCN9A; (-) strand; PAM type: NRG; PAM sequence: GGG
gggtttttcttgattttgta

SEQ ID NO: 36037 - DNA, 20 bp, Artificial Sequence
  Description of Artificial Sequence: Synthetic oligonucleotide
  Target: SCN9A; (-) strand; PAM type: NRG; PAM sequence: AGG
agggtttttcttgattttgt

SEQ ID NO: 36038 - DNA, 20 bp, Artificial Sequence
  Description of Artificial Sequence: Synthetic oligonucleotide
  Target: SCN9A; (-) strand; PAM type: NRG; PAM sequence: TAG
gagggtttttcttgattttg

SEQ ID NO: 36039 - DNA, 20 bp, Artificial Sequence
  Description of Artificial Sequence: Synthetic oligonucleotide
  Target: SCN9A; (-) strand; PAM type: NRG; PAM sequence: GGG
agattgaaagcagaagatga

SEQ ID NO: 36040 - DNA, 20 bp, Artificial Sequence
  Description of Artificial Sequence: Synthetic oligonucleotide
  Target: SCN9A; (-) strand; PAM type: NRG; PAM sequence: AGG
aagattgaaagcagaagatg

SEQ ID NO: 36041 - DNA, 20 bp, Artificial Sequence
  Description of Artificial Sequence: Synthetic oligonucleotide
  Target: SCN9A; (-) strand; PAM type: NRG; PAM sequence: GAG
caagattgaaagcagaagat

SEQ ID NO: 36042 - DNA, 20 bp, Artificial Sequence
  Description of Artificial Sequence: Synthetic oligonucleotide
  Target: SCN9A; (-) strand; PAM type: NRG; PAM sequence: AAG
gacagcaagattgaaagcag

SEQ ID NO: 36043 - DNA, 20 bp, Artificial Sequence
  Description of Artificial Sequence: Synthetic oligonucleotide
  Target: SCN9A; (-) strand; PAM type: NRG; PAM sequence: CAG
acagacagcaagattgaaag

SEQ ID NO: 36044 - DNA, 20 bp, Artificial Sequence
  Description of Artificial Sequence: Synthetic oligonucleotide
  Target: SCN9A; (-) strand; PAM type: NRG; PAM sequence: AAG
aatacagacagcaagattga

SEQ ID NO: 36045 - DNA, 20 bp, Artificial Sequence
  Description of Artificial Sequence: Synthetic oligonucleotide
  Target: SCN9A; (-) strand; PAM type: NRG; PAM sequence: AAG
atggttgaaatacagacagc

SEQ ID NO: 36046 - DNA, 20 bp, Artificial Sequence
  Description of Artificial Sequence: Synthetic oligonucleotide
  Target: SCN9A; (-) strand; PAM type: NRG; PAM sequence: CAG
cagcatggttgaaatacaga

SEQ ID NO: 36047 - DNA, 20 bp, Artificial Sequence
  Description of Artificial Sequence: Synthetic oligonucleotide
  Target: SCN9A; (-) strand; PAM type: NRG; PAM sequence: CAG
aaaccagcatggttgaaata

SEQ ID NO: 36048 - DNA, 20 bp, Artificial Sequence
  Description of Artificial Sequence: Synthetic oligonucleotide
  Target: SCN9A; (-) strand; PAM type: NRG; PAM sequence: TGG
gagaagcaagaaaaccagca

SEQ ID NO: 36049 - DNA, 20 bp, Artificial Sequence
  Description of Artificial Sequence: Synthetic oligonucleotide
  Target: SCN9A; (-) strand; PAM type: NRG; PAM sequence: CAG
ttaaggagaagcaagaaaac

SEQ ID NO: 36050 - DNA, 20 bp, Artificial Sequence
  Description of Artificial Sequence: Synthetic oligonucleotide
  Target: SCN9A; (-) strand; PAM type: NRG; PAM sequence: AAG
tgatgtatttaaggagaagc

SEQ ID NO: 36051 - DNA, 20 bp, Artificial Sequence
  Description of Artificial Sequence: Synthetic oligonucleotide
  Target: SCN9A; (-) strand; PAM type: NRG; PAM sequence: AAG
tatttgatgtatttaaggag

SEQ ID NO: 36052 - DNA, 20 bp, Artificial Sequence
  Description of Artificial Sequence: Synthetic oligonucleotide
  Target: SCN9A; (-) strand; PAM type: NRG; PAM sequence: GAG
gcatatttgatgtatttaag

SEQ ID NO: 36053 - DNA, 20 bp, Artificial Sequence
  Description of Artificial Sequence: Synthetic oligonucleotide
  Target: SCN9A; (-) strand; PAM type: NRG; PAM sequence: AGG
aggcatatttgatgtattta

SEQ ID NO: 36054 - DNA, 20 bp, Artificial Sequence
  Description of Artificial Sequence: Synthetic oligonucleotide
  Target: SCN9A; (-) strand; PAM type: NRG; PAM sequence: AAG
aaggcatatttgatgtattt

SEQ ID NO: 36055 - DNA, 20 bp, Artificial Sequence
  Description of Artificial Sequence: Synthetic oligonucleotide
  Target: SCN9A; (-) strand; PAM type: NRG; PAM sequence: AGG
cagcaattgcaaaagcccta

SEQ ID NO: 36056 - DNA, 20 bp, Artificial Sequence
  Description of Artificial Sequence: Synthetic oligonucleotide
  Target: SCN9A; (-) strand; PAM type: NRG; PAM sequence: AAG
acagcaattgcaaaagccct

SEQ ID NO: 36057 - DNA, 20 bp, Artificial Sequence
  Description of Artificial Sequence: Synthetic oligonucleotide
  Target: SCN9A; (-) strand; PAM type: NRG; PAM sequence: AAG
acaaaaaacagcaattgcaa

SEQ ID NO: 36058 - DNA, 20 bp, Artificial Sequence
  Description of Artificial Sequence: Synthetic oligonucleotide
  Target: SCN9A; (-) strand; PAM type: NRG; PAM sequence: CAG
atcattctagtcacaaaaaa

SEQ ID NO: 36059 - DNA, 20 bp, Artificial Sequence
  Description of Artificial Sequence: Synthetic oligonucleotide
  Target: SCN9A; (-) strand; PAM type: NRG; PAM sequence: TAG
aaacaactgaagaatcattc

SEQ ID NO: 36060 - DNA, 20 bp, Artificial Sequence
  Description of Artificial Sequence: Synthetic oligonucleotide
  Target: SCN9A; (-) strand; PAM type: NRG; PAM sequence: AAG
gggagctagctaaacaactg

SEQ ID NO: 36061 - DNA, 20 bp, Artificial Sequence
  Description of Artificial Sequence: Synthetic oligonucleotide
  Target: SCN9A; (-) strand; PAM type: NRG; PAM sequence: TAG
aaatgaaaaactaagggagc

SEQ ID NO: 36062 - DNA, 20 bp, Artificial Sequence
  Description of Artificial Sequence: Synthetic oligonucleotide
  Target: SCN9A; (-) strand; PAM type: NRG; PAM sequence: GAG
aagtaaatgaaaaactaagg

SEQ ID NO: 36063 - DNA, 20 bp, Artificial Sequence
  Description of Artificial Sequence: Synthetic oligonucleotide
  Target: SCN9A; (-) strand; PAM type: NRG; PAM sequence: GGG
tgaagtaaatgaaaaactaa

SEQ ID NO: 36064 - DNA, 20 bp, Artificial Sequence
  Description of Artificial Sequence: Synthetic oligonucleotide
  Target: SCN9A; (-) strand; PAM type: NRG; PAM sequence: AGG
atgaagtaaatgaaaaacta

SEQ ID NO: 36065 - DNA, 20 bp, Artificial Sequence
  Description of Artificial Sequence: Synthetic oligonucleotide
  Target: SCN9A; (-) strand; PAM type: NRG; PAM sequence: AAG
catgaagtaaatgaaaaact

SEQ ID NO: 36066 - DNA, 20 bp, Artificial Sequence
  Description of Artificial Sequence: Synthetic oligonucleotide
  Target: SCN9A; (-) strand; PAM type: NRG; PAM sequence: AAG
ggtatttgagtagagacatg

SEQ ID NO: 36067 - DNA, 20 bp, Artificial Sequence
  Description of Artificial Sequence: Synthetic oligonucleotide
  Target: SCN9A; (-) strand; PAM type: NRG; PAM sequence: GAG
ttatacagggtatttgagta

SEQ ID NO: 36068 - DNA, 20 bp, Artificial Sequence
  Description of Artificial Sequence: Synthetic oligonucleotide
  Target: SCN9A; (-) strand; PAM type: NRG; PAM sequence: TAG
ttttatacagggtatttgag

SEQ ID NO: 36069 - DNA, 20 bp, Artificial Sequence
  Description of Artificial Sequence: Synthetic oligonucleotide
  Target: SCN9A; (-) strand; PAM type: NRG; PAM sequence: GAG
aaattttatacagggtattt

SEQ ID NO: 36070 - DNA, 20 bp, Artificial Sequence
  Description of Artificial Sequence: Synthetic oligonucleotide
  Target: SCN9A; (-) strand; PAM type: NRG; PAM sequence: GGG
ggtctgaaaaattttataca

SEQ ID NO: 36071 - DNA, 20 bp, Artificial Sequence
  Description of Artificial Sequence: Synthetic oligonucleotide
  Target: SCN9A; (-) strand; PAM type: NRG; PAM sequence: AGG
tggtctgaaaaattttatac

SEQ ID NO: 36072 - DNA, 20 bp, Artificial Sequence
  Description of Artificial Sequence: Synthetic oligonucleotide
  Target: SCN9A; (-) strand; PAM type: NRG; PAM sequence: CAG
gtggtctgaaaaattttata

SEQ ID NO: 36073 - DNA, 20 bp, Artificial Sequence
  Description of Artificial Sequence: Synthetic oligonucleotide
  Target: SCN9A; (-) strand; PAM type: NRG; PAM sequence: TGG
gaaggaggtattatttaaag

SEQ ID NO: 36074 - DNA, 20 bp, Artificial Sequence
  Description of Artificial Sequence: Synthetic oligonucleotide
  Target: SCN9A; (-) strand; PAM type: NRG; PAM sequence: AAG
agagaaggaggtattattta

SEQ ID NO: 36075 - DNA, 20 bp, Artificial Sequence
  Description of Artificial Sequence: Synthetic oligonucleotide
  Target: SCN9A; (-) strand; PAM type: NRG; PAM sequence: AGG
gacagagaattgagagaagg

SEQ ID NO: 36076 - DNA, 20 bp, Artificial Sequence
  Description of Artificial Sequence: Synthetic oligonucleotide
  Target: SCN9A; (-) strand; PAM type: NRG; PAM sequence: GAG
ggacagagaattgagagaag

SEQ ID NO: 36077 - DNA, 20 bp, Artificial Sequence
  Description of Artificial Sequence: Synthetic oligonucleotide
  Target: SCN9A; (-) strand; PAM type: NRG; PAM sequence: AGG
caggacagagaattgagaga

SEQ ID NO: 36078 - DNA, 20 bp, Artificial Sequence
  Description of Artificial Sequence: Synthetic oligonucleotide
  Target: SCN9A; (-) strand; PAM type: NRG; PAM sequence: AAG
acaggacagagaattgagag

SEQ ID NO: 36079 - DNA, 20 bp, Artificial Sequence
  Description of Artificial Sequence: Synthetic oligonucleotide
  Target: SCN9A; (-) strand; PAM type: NRG; PAM sequence: GAG
aaaacaggacagagaattga

SEQ ID NO: 36080 - DNA, 20 bp, Artificial Sequence
  Description of Artificial Sequence: Synthetic oligonucleotide
  Target: SCN9A; (-) strand; PAM type: NRG; PAM sequence: GAG
ataaaacaggacagagaatt

SEQ ID NO: 36081 - DNA, 20 bp, Artificial Sequence
  Description of Artificial Sequence: Synthetic oligonucleotide
  Target: SCN9A; (-) strand; PAM type: NRG; PAM sequence: GAG
aaaaacaataaaacaggaca

SEQ ID NO: 36082 - DNA, 20 bp, Artificial Sequence
  Description of Artificial Sequence: Synthetic oligonucleotide
  Target: SCN9A; (-) strand; PAM type: NRG; PAM sequence: CAG
tgaaaaacaataaaacagga

SEQ ID NO: 36083 - DNA, 20 bp, Artificial Sequence
  Description of Artificial Sequence: Synthetic oligonucleotide
  Target: SCN9A; (-) strand; PAM type: NRG; PAM sequence: AGG
gctgtgaaaaacaataaaac

SEQ ID NO: 36084 - DNA, 20 bp, Artificial Sequence
  Description of Artificial Sequence: Synthetic oligonucleotide
  Target: SCN9A; (-) strand; PAM type: NRG; PAM sequence: CAG
tgctgtgaaaaacaataaaa

SEQ ID NO: 36085 - DNA, 20 bp, Artificial Sequence
  Description of Artificial Sequence: Synthetic oligonucleotide
  Target: SCN9A; (-) strand; PAM type: NRG; PAM sequence: AAG
actatccatcattgtaccat

SEQ ID NO: 36086 - DNA, 20 bp, Artificial Sequence
  Description of Artificial Sequence: Synthetic oligonucleotide
  Target: SCN9A; (-) strand; PAM type: NRG; PAM sequence: GAG
cgattttaagagataatgaa

SEQ ID NO: 36087 - DNA, 20 bp, Artificial Sequence
  Description of Artificial Sequence: Synthetic oligonucleotide
  Target: SCN9A; (-) strand; PAM type: NRG; PAM sequence: AAG
gccgattttaagagataatg

SEQ ID NO: 36088 - DNA, 20 bp, Artificial Sequence
  Description of Artificial Sequence: Synthetic oligonucleotide
  Target: SCN9A; (-) strand; PAM type: NRG; PAM sequence: GAG
agatgtgacgccgattttaa

SEQ ID NO: 36089 - DNA, 20 bp, Artificial Sequence
  Description of Artificial Sequence: Synthetic oligonucleotide
  Target: SCN9A; (-) strand; PAM type: NRG; PAM sequence: AAG
ggagatgtgacgccgatttt

SEQ ID NO: 36090 - DNA, 20 bp, Artificial Sequence
  Description of Artificial Sequence: Synthetic oligonucleotide
  Target: SCN9A; (-) strand; PAM type: NRG; PAM sequence: GAG
atagcaatgaacaacacatg

SEQ ID NO: 36091 - DNA, 20 bp, Artificial Sequence
  Description of Artificial Sequence: Synthetic oligonucleotide
  Target: SCN9A; (-) strand; PAM type: NRG; PAM sequence: TGG
atatagcaatgaacaacaca

SEQ ID NO: 36092 - DNA, 20 bp, Artificial Sequence
  Description of Artificial Sequence: Synthetic oligonucleotide
  Target: SCN9A; (-) strand; PAM type: NRG; PAM sequence: TAG
tttattgtagacatcagata

SEQ ID NO: 36093 - DNA, 20 bp, Artificial Sequence
  Description of Artificial Sequence: Synthetic oligonucleotide
  Target: SCN9A; (-) strand; PAM type: NRG; PAM sequence: CAG
taaagttttattgtagacat

SEQ ID NO: 36094 - DNA, 20 bp, Artificial Sequence
  Description of Artificial Sequence: Synthetic oligonucleotide
  Target: SCN9A; (-) strand; PAM type: NRG; PAM sequence: TAG
ttcttcataaagttttattg

SEQ ID NO: 36095 - DNA, 20 bp, Artificial Sequence
  Description of Artificial Sequence: Synthetic oligonucleotide
  Target: SCN9A; (-) strand; PAM type: NRG; PAM sequence: AAG
ccctctcttccttcttcata

SEQ ID NO: 36096 - DNA, 20 bp, Artificial Sequence
  Description of Artificial Sequence: Synthetic oligonucleotide
  Target: SCN9A; (-) strand; PAM type: NRG; PAM sequence: AAG
atactcttcctggaatttaa

SEQ ID NO: 36097 - DNA, 20 bp, Artificial Sequence
  Description of Artificial Sequence: Synthetic oligonucleotide
  Target: SCN9A; (-) strand; PAM type: NRG; PAM sequence: TGG
ctcagcatttatactcttcc

SEQ ID NO: 36098 - DNA, 20 bp, Artificial Sequence
  Description of Artificial Sequence: Synthetic oligonucleotide
  Target: SCN9A; (-) strand; PAM type: NRG; PAM sequence: CAG
actcacaacctcactcctct

SEQ ID NO: 36099 - DNA, 20 bp, Artificial Sequence
  Description of Artificial Sequence: Synthetic oligonucleotide
  Target: SCN9A; (-) strand; PAM type: NRG; PAM sequence: AAG
agtccctccaggccagttcc

SEQ ID NO: 36100 - DNA, 20 bp, Artificial Sequence
  Description of Artificial Sequence: Synthetic oligonucleotide
  Target: SCN9A; (-) strand; PAM type: NRG; PAM sequence: CAG
gctgctgagtccctccaggc

SEQ ID NO: 36101 - DNA, 20 bp, Artificial Sequence
  Description of Artificial Sequence: Synthetic oligonucleotide
  Target: SCN9A; (-) strand; PAM type: NRG; PAM sequence: AGG
agcggctgctgagtccctcc

SEQ ID NO: 36102 - DNA, 20 bp, Artificial Sequence
  Description of Artificial Sequence: Synthetic oligonucleotide
  Target: SCN9A; (-) strand; PAM type: NRG; PAM sequence: CAG
aagcggctgctgagtccctc

SEQ ID NO: 36103 - DNA, 20 bp, Artificial Sequence
  Description of Artificial Sequence: Synthetic oligonucleotide
  Target: SCN9A; (-) strand; PAM type: NRG; PAM sequence: GAG
ggcagtggtaagcggctgct

SEQ ID NO: 36104 - DNA, 20 bp, Artificial Sequence
  Description of Artificial Sequence: Synthetic oligonucleotide
  Target: SCN9A; (-) strand; PAM type: NRG; PAM sequence: CGG
atcccaagggcagtggtaag

SEQ ID NO: 36105 - DNA, 20 bp, Artificial Sequence
  Description of Artificial Sequence: Synthetic oligonucleotide
  Target: SCN9A; (-) strand; PAM type: NRG; PAM sequence: AAG
gagatcccaagggcagtggt

SEQ ID NO: 36106 - DNA, 20 bp, Artificial Sequence
  Description of Artificial Sequence: Synthetic oligonucleotide
  Target: SCN9A; (-) strand; PAM type: NRG; PAM sequence: TGG
ggcagagatcccaagggcag

SEQ ID NO: 36107 - DNA, 20 bp, Artificial Sequence
  Description of Artificial Sequence: Synthetic oligonucleotide
  Target: SCN9A; (-) strand; PAM type: NRG; PAM sequence: CAG
cctggcagagatcccaaggg

SEQ ID NO: 36108 - DNA, 20 bp, Artificial Sequence
  Description of Artificial Sequence: Synthetic oligonucleotide
  Target: SCN9A; (-) strand; PAM type: NRG; PAM sequence: GGG
agacctggcagagatcccaa

SEQ ID NO: 36109 - DNA, 20 bp, Artificial Sequence
  Description of Artificial Sequence: Synthetic oligonucleotide
  Target: SCN9A; (-) strand; PAM type: NRG; PAM sequence: AGG
aagacctggcagagatccca

SEQ ID NO: 36110 - DNA, 20 bp, Artificial Sequence
  Description of Artificial Sequence: Synthetic oligonucleotide
  Target: SCN9A; (-) strand; PAM type: NRG; PAM sequence: AAG
gaagacctggcagagatccc

SEQ ID NO: 36111 - DNA, 20 bp, Artificial Sequence
  Description of Artificial Sequence: Synthetic oligonucleotide
  Target: SCN9A; (-) strand; PAM type: NRG; PAM sequence: GAG
tagggagggaagacctggca

SEQ ID NO: 36112 - DNA, 20 bp, Artificial Sequence
  Description of Artificial Sequence: Synthetic oligonucleotide
  Target: SCN9A; (-) strand; PAM type: NRG; PAM sequence: CAG
tgtagggagggaagacctgg

SEQ ID NO: 36113 - DNA, 20 bp, Artificial Sequence
  Description of Artificial Sequence: Synthetic oligonucleotide
  Target: SCN9A; (-) strand; PAM type: NRG; PAM sequence: TGG
gtttgtagggagggaagacc

SEQ ID NO: 36114 - DNA, 20 bp, Artificial Sequence
  Description of Artificial Sequence: Synthetic oligonucleotide
  Target: SCN9A; (-) strand; PAM type: NRG; PAM sequence: AAG
attgaggtttgtagggaggg

SEQ ID NO: 36115 - DNA, 20 bp, Artificial Sequence
  Description of Artificial Sequence: Synthetic oligonucleotide
  Target: SCN9A; (-) strand; PAM type: NRG; PAM sequence: GGG
gccattgaggtttgtaggga

SEQ ID NO: 36116 - DNA, 20 bp, Artificial Sequence
  Description of Artificial Sequence: Synthetic oligonucleotide
  Target: SCN9A; (-) strand; PAM type: NRG; PAM sequence: AGG
tgccattgaggtttgtaggg

SEQ ID NO: 36117 - DNA, 20 bp, Artificial Sequence
  Description of Artificial Sequence: Synthetic oligonucleotide
  Target: SCN9A; (-) strand; PAM type: NRG; PAM sequence: GAG
gtgccattgaggtttgtagg

SEQ ID NO: 36118 - DNA, 20 bp, Artificial Sequence
  Description of Artificial Sequence: Synthetic oligonucleotide
  Target: SCN9A; (-) strand; PAM type: NRG; PAM sequence: GGG
tggtgccattgaggtttgta

SEQ ID NO: 36119 - DNA, 20 bp, Artificial Sequence
  Description of Artificial Sequence: Synthetic oligonucleotide
  Target: SCN9A; (-) strand; PAM type: NRG; PAM sequence: AGG
ttggtgccattgaggtttgt

SEQ ID NO: 36120 - DNA, 20 bp, Artificial Sequence
  Description of Artificial Sequence: Synthetic oligonucleotide
  Target: SCN9A; (-) strand; PAM type: NRG; PAM sequence: TAG
attggtgccattgaggtttg

SEQ ID NO: 36121 - DNA, 20 bp, Artificial Sequence
  Description of Artificial Sequence: Synthetic oligonucleotide
  Target: SCN9A; (-) strand; PAM type: NRG; PAM sequence: AGG
agttggtattggtgccattg

SEQ ID NO: 36122 - DNA, 20 bp, Artificial Sequence
  Description of Artificial Sequence: Synthetic oligonucleotide
  Target: SCN9A; (-) strand; PAM type: NRG; PAM sequence: GAG
aagttggtattggtgccatt

SEQ ID NO: 36123 - DNA, 20 bp, Artificial Sequence
  Description of Artificial Sequence: Synthetic oligonucleotide
  Target: SCN9A; (-) strand; PAM type: NRG; PAM sequence: TGG
gttggcatccaagttggtat

SEQ ID NO: 36124 - DNA, 20 bp, Artificial Sequence
  Description of Artificial Sequence: Synthetic oligonucleotide
  Target: SCN9A; (-) strand; PAM type: NRG; PAM sequence: TGG
tcaggagttggcatccaagt

SEQ ID NO: 36125 - DNA, 20 bp, Artificial Sequence
  Description of Artificial Sequence: Synthetic oligonucleotide
  Target: SCN9A; (-) strand; PAM type: NRG; PAM sequence: AAG
taggtcaggagttggcatcc

SEQ ID NO: 36126 - DNA, 20 bp, Artificial Sequence
  Description of Artificial Sequence: Synthetic oligonucleotide
  Target: SCN9A; (-) strand; PAM type: NRG; PAM sequence: TGG
aaaatgtgtaggtcaggagt

SEQ ID NO: 36127 - DNA, 20 bp, Artificial Sequence
  Description of Artificial Sequence: Synthetic oligonucleotide
  Target: SCN9A; (-) strand; PAM type: NRG; PAM sequence: GAG
ctccaaaatgtgtaggtcag

SEQ ID NO: 36128 - DNA, 20 bp, Artificial Sequence
  Description of Artificial Sequence: Synthetic oligonucleotide
  Target: SCN9A; (-) strand; PAM type: NRG; PAM sequence: AGG
gcctccaaaatgtgtaggtc

SEQ ID NO: 36129 - DNA, 20 bp, Artificial Sequence
  Description of Artificial Sequence: Synthetic oligonucleotide
  Target: SCN9A; (-) strand; PAM type: NRG; PAM sequence: CAG
ggcctccaaaatgtgtaggt

SEQ ID NO: 36130 - DNA, 20 bp, Artificial Sequence
  Description of Artificial Sequence: Synthetic oligonucleotide
  Target: SCN9A; (-) strand; PAM type: NRG; PAM sequence: AGG
agttggcctccaaaatgtgt

SEQ ID NO: 36131 - DNA, 20 bp, Artificial Sequence
  Description of Artificial Sequence: Synthetic oligonucleotide
  Target: SCN9A; (-) strand; PAM type: NRG; PAM sequence: TAG
tagttggcctccaaaatgtg

SEQ ID NO: 36132 - DNA, 20 bp, Artificial Sequence
  Description of Artificial Sequence: Synthetic oligonucleotide
  Target: SCN9A; (-) strand; PAM type: NRG; PAM sequence: TGG
atcattagatccggtctagt

SEQ ID NO: 36133 - DNA, 20 bp, Artificial Sequence
  Description of Artificial Sequence: Synthetic oligonucleotide
  Target: SCN9A; (-) strand; PAM type: NRG; PAM sequence: TAG
attaatcattagatccggtc

SEQ ID NO: 36134 - DNA, 20 bp, Artificial Sequence
  Description of Artificial Sequence: Synthetic oligonucleotide
  Target: SCN9A; (-) strand; PAM type: NRG; PAM sequence: CGG
tagggattaatcattagatc

SEQ ID NO: 36135 - DNA, 20 bp, Artificial Sequence
  Description of Artificial Sequence: Synthetic oligonucleotide
  Target: SCN9A; (-) strand; PAM type: NRG; PAM sequence: TAG
ttagcctagggattaatcat

SEQ ID NO: 36136 - DNA, 20 bp, Artificial Sequence
  Description of Artificial Sequence: Synthetic oligonucleotide
  Target: SCN9A; (-) strand; PAM type: NRG; PAM sequence: GGG
aactgatttatcttagccta

SEQ ID NO: 36137 - DNA, 20 bp, Artificial Sequence
  Description of Artificial Sequence: Synthetic oligonucleotide
  Target: SCN9A; (-) strand; PAM type: NRG; PAM sequence: AGG
caactgatttatcttagcct

SEQ ID NO: 36138 - DNA, 20 bp, Artificial Sequence
  Description of Artificial Sequence: Synthetic oligonucleotide
  Target: SCN9A; (-) strand; PAM type: NRG; PAM sequence: TAG
ccaactgatttatcttagcc

SEQ ID NO: 36139 - DNA, 20 bp, Artificial Sequence
  Description of Artificial Sequence: Synthetic oligonucleotide
  Target: SCN9A; (-) strand; PAM type: NRG; PAM sequence: TAG
aatttccaactgatttatct

SEQ ID NO: 36140 - DNA, 20 bp, Artificial Sequence
  Description of Artificial Sequence: Synthetic oligonucleotide
  Target: SCN9A; (-) strand; PAM type: NRG; PAM sequence: AAG
gataagaaaaaacaaagtta

SEQ ID NO: 36141 - DNA, 20 bp, Artificial Sequence
  Description of Artificial Sequence: Synthetic oligonucleotide
  Target: SCN9A; (-) strand; PAM type: NRG; PAM sequence: AAG
ctggcagataagaaaaaaca

SEQ ID NO: 36142 - DNA, 20 bp, Artificial Sequence
  Description of Artificial Sequence: Synthetic oligonucleotide
  Target: SCN9A; (-) strand; PAM type: NRG; PAM sequence: AAG
taacaggtagactggcagat

SEQ ID NO: 36143 - DNA, 20 bp, Artificial Sequence
  Description of Artificial Sequence: Synthetic oligonucleotide
  Target: SCN9A; (-) strand; PAM type: NRG; PAM sequence: CAG
atgcttaacaggtagactgg

SEQ ID NO: 36144 - DNA, 20 bp, Artificial Sequence
  Description of Artificial Sequence: Synthetic oligonucleotide
  Target: SCN9A; (-) strand; PAM type: NRG; PAM sequence: TGG
gatatgcttaacaggtagac

SEQ ID NO: 36145 - DNA, 20 bp, Artificial Sequence
  Description of Artificial Sequence: Synthetic oligonucleotide
  Target: SCN9A; (-) strand; PAM type: NRG; PAM sequence: TAG
tgacagatatgcttaacagg

SEQ ID NO: 36146 - DNA, 20 bp, Artificial Sequence
  Description of Artificial Sequence: Synthetic oligonucleotide
  Target: SCN9A; (-) strand; PAM type: NRG; PAM sequence: AGG
cagtgacagatatgcttaac

SEQ ID NO: 36147 - DNA, 20 bp, Artificial Sequence
  Description of Artificial Sequence: Synthetic oligonucleotide
  Target: SCN9A; (-) strand; PAM type: NRG; PAM sequence: CAG
acagtgacagatatgcttaa

SEQ ID NO: 36148 - DNA, 20 bp, Artificial Sequence
  Description of Artificial Sequence: Synthetic oligonucleotide
  Target: SCN9A; (-) strand; PAM type: NRG; PAM sequence: CAG
acgaaaacttttgacagtga

SEQ ID NO: 36149 - DNA, 20 bp, Artificial Sequence
  Description of Artificial Sequence: Synthetic oligonucleotide
  Target: SCN9A; (-) strand; PAM type: NRG; PAM sequence: CAG
agggacacgaaaacttttga

SEQ ID NO: 36150 - DNA, 20 bp, Artificial Sequence
  Description of Artificial Sequence: Synthetic oligonucleotide
  Target: SCN9A; (-) strand; PAM type: NRG; PAM sequence: GGG
tgctaagtgaaataagtaaa

SEQ ID NO: 36151 - DNA, 20 bp, Artificial Sequence
  Description of Artificial Sequence: Synthetic oligonucleotide
  Target: SCN9A; (-) strand; PAM type: NRG; PAM sequence: AGG
atgctaagtgaaataagtaa

SEQ ID NO: 36152 - DNA, 20 bp, Artificial Sequence
  Description of Artificial Sequence: Synthetic oligonucleotide
  Target: SCN9A; (-) strand; PAM type: NRG; PAM sequence: AAG
catgctaagtgaaataagta

SEQ ID NO: 36153 - DNA, 20 bp, Artificial Sequence
  Description of Artificial Sequence: Synthetic oligonucleotide
  Target: SCN9A; (-) strand; PAM type: NRG; PAM sequence: AAG
agagacatgctaagtgaaat

SEQ ID NO: 36154 - DNA, 20 bp, Artificial Sequence
  Description of Artificial Sequence: Synthetic oligonucleotide
  Target: SCN9A; (-) strand; PAM type: NRG; PAM sequence: AAG
ggacctagaagagacatgct

SEQ ID NO: 36155 - DNA, 20 bp, Artificial Sequence
  Description of Artificial Sequence: Synthetic oligonucleotide
  Target: SCN9A; (-) strand; PAM type: NRG; PAM sequence: GAG
cagcatgcatggacctagaa

SEQ ID NO: 36156 - DNA, 20 bp, Artificial Sequence
  Description of Artificial Sequence: Synthetic oligonucleotide
  Target: SCN9A; (-) strand; PAM type: NRG; PAM sequence: AAG
gacagcatgcatggacctag

SEQ ID NO: 36157 - DNA, 20 bp, Artificial Sequence
  Description of Artificial Sequence: Synthetic oligonucleotide
  Target: SCN9A; (-) strand; PAM type: NRG; PAM sequence: TAG
tgtgacagcatgcatggacc

SEQ ID NO: 36158 - DNA, 20 bp, Artificial Sequence
  Description of Artificial Sequence: Synthetic oligonucleotide
  Target: SCN9A; (-) strand; PAM type: NRG; PAM sequence: TGG
actatttgtgacagcatgca

SEQ ID NO: 36159 - DNA, 20 bp, Artificial Sequence
  Description of Artificial Sequence: Synthetic oligonucleotide
  Target: SCN9A; (-) strand; PAM type: NRG; PAM sequence: CAG
ggaaatcttactatttgtga

SEQ ID NO: 36160 - DNA, 20 bp, Artificial Sequence
  Description of Artificial Sequence: Synthetic oligonucleotide
  Target: SCN9A; (-) strand; PAM type: NRG; PAM sequence: AGG
tatctagccttaaaaaaaga

SEQ ID NO: 36161 - DNA, 20 bp, Artificial Sequence
  Description of Artificial Sequence: Synthetic oligonucleotide
  Target: SCN9A; (-) strand; PAM type: NRG; PAM sequence: AAG
ttatctagccttaaaaaaag

SEQ ID NO: 36162 - DNA, 20 bp, Artificial Sequence
  Description of Artificial Sequence: Synthetic oligonucleotide
  Target: SCN9A; (-) strand; PAM type: NRG; PAM sequence: AAG
atattatctagccttaaaaa

SEQ ID NO: 36163 - DNA, 20 bp, Artificial Sequence
  Description of Artificial Sequence: Synthetic oligonucleotide
  Target: SCN9A; (-) strand; PAM type: NRG; PAM sequence: TAG
atataaaatagaatattatc

SEQ ID NO: 36164 - DNA, 20 bp, Artificial Sequence
  Description of Artificial Sequence: Synthetic oligonucleotide
  Target: SCN9A; (-) strand; PAM type: NRG; PAM sequence: TAG
aatgtggtctgtatataaaa

SEQ ID NO: 36165 - DNA, 20 bp, Artificial Sequence
  Description of Artificial Sequence: Synthetic oligonucleotide
  Target: SCN9A; (-) strand; PAM type: NRG; PAM sequence: TGG
ataaaagagtaaagaaaatg

SEQ ID NO: 36166 - DNA, 20 bp, Artificial Sequence
  Description of Artificial Sequence: Synthetic oligonucleotide
  Target: SCN9A; (-) strand; PAM type: NRG; PAM sequence: AAG
catcaacagataaaagagta

SEQ ID NO: 36167 - DNA, 20 bp, Artificial Sequence
  Description of Artificial Sequence: Synthetic oligonucleotide
  Target: SCN9A; (-) strand; PAM type: NRG; PAM sequence: GAG
atgatcatcaacagataaaa

SEQ ID NO: 36168 - DNA, 20 bp, Artificial Sequence
  Description of Artificial Sequence: Synthetic oligonucleotide
  Target: SCN9A; (-) strand; PAM type: NRG; PAM sequence: AAG
aaatgatcatcaacagataa

SEQ ID NO: 36169 - DNA, 20 bp, Artificial Sequence
  Description of Artificial Sequence: Synthetic oligonucleotide
  Target: SCN9A; (-) strand; PAM type: NRG; PAM sequence: CAG
acaacccaaatgatcatcaa

SEQ ID NO: 36170 - DNA, 20 bp, Artificial Sequence
  Description of Artificial Sequence: Synthetic oligonucleotide
  Target: SCN9A; (-) strand; PAM type: NRG; PAM sequence: TAG
tactgcagcattattcacaa

SEQ ID NO: 36171 - DNA, 20 bp, Artificial Sequence
  Description of Artificial Sequence: Synthetic oligonucleotide
  Target: SCN9A; (-) strand; PAM type: NRG; PAM sequence: CAG
atgcacttctgtgtttactg

SEQ ID NO: 36172 - DNA, 20 bp, Artificial Sequence
  Description of Artificial Sequence: Synthetic oligonucleotide
  Target: SCN9A; (-) strand; PAM type: NRG; PAM sequence: GAG
attgaaatcagaatctcaaa

SEQ ID NO: 36173 - DNA, 20 bp, Artificial Sequence
  Description of Artificial Sequence: Synthetic oligonucleotide
  Target: SCN9A; (-) strand; PAM type: NRG; PAM sequence: AAG
caattgaaatcagaatctca

SEQ ID NO: 36174 - DNA, 20 bp, Artificial Sequence
  Description of Artificial Sequence: Synthetic oligonucleotide
  Target: SCN9A; (-) strand; PAM type: NRG; PAM sequence: CAG
tatgatccagcaattgaaat

SEQ ID NO: 36175 - DNA, 20 bp, Artificial Sequence
  Description of Artificial Sequence: Synthetic oligonucleotide
  Target: SCN9A; (-) strand; PAM type: NRG; PAM sequence: CAG
aatagaactaccatatgatc

SEQ ID NO: 36176 - DNA, 20 bp, Artificial Sequence
  Description of Artificial Sequence: Synthetic oligonucleotide
  Target: SCN9A; (-) strand; PAM type: NRG; PAM sequence: TAG
gttcctcaaaaaattaaaaa

SEQ ID NO: 36177 - DNA, 20 bp, Artificial Sequence
  Description of Artificial Sequence: Synthetic oligonucleotide
  Target: SCN9A; (-) strand; PAM type: NRG; PAM sequence: AAG
tgctatggaaaataatatgg

SEQ ID NO: 36178 - DNA, 20 bp, Artificial Sequence
  Description of Artificial Sequence: Synthetic oligonucleotide
  Target: SCN9A; (-) strand; PAM type: NRG; PAM sequence: TGG
agctgctatggaaaataata

SEQ ID NO: 36179 - DNA, 20 bp, Artificial Sequence
  Description of Artificial Sequence: Synthetic oligonucleotide
  Target: SCN9A; (-) strand; PAM type: NRG; PAM sequence: TGG
gtataatagtgtagctgcta

SEQ ID NO: 36180 - DNA, 20 bp, Artificial Sequence
  Description of Artificial Sequence: Synthetic oligonucleotide
  Target: SCN9A; (-) strand; PAM type: NRG; PAM sequence: TAG
ggtgggaatgtataatagtg

SEQ ID NO: 36181 - DNA, 20 bp, Artificial Sequence
  Description of Artificial Sequence: Synthetic oligonucleotide
  Target: SCN9A; (-) strand; PAM type: NRG; PAM sequence: TAG
ctgttggtgggaatgtataa

SEQ ID NO: 36182 - DNA, 20 bp, Artificial Sequence
  Description of Artificial Sequence: Synthetic oligonucleotide
  Target: SCN9A; (-) strand; PAM type: NRG; PAM sequence: GGG
aagcattgtccactgttggt

SEQ ID NO: 36183 - DNA, 20 bp, Artificial Sequence
  Description of Artificial Sequence: Synthetic oligonucleotide
  Target: SCN9A; (-) strand; PAM type: NRG; PAM sequence: TGG
aaagcattgtccactgttgg

SEQ ID NO: 36184 - DNA, 20 bp, Artificial Sequence
  Description of Artificial Sequence: Synthetic oligonucleotide
  Target: SCN9A; (-) strand; PAM type: NRG; PAM sequence: TGG
atgaaagcattgtccactgt

SEQ ID NO: 36185 - DNA, 20 bp, Artificial Sequence
  Description of Artificial Sequence: Synthetic oligonucleotide
  Target: SCN9A; (-) strand; PAM type: NRG; PAM sequence: AAG
tgagaatgtgaagaaaatga

SEQ ID NO: 36186 - DNA, 20 bp, Artificial Sequence
  Description of Artificial Sequence: Synthetic oligonucleotide
  Target: SCN9A; (-) strand; PAM type: NRG; PAM sequence: AAG
aaggtgttgttgagaatgtg

SEQ ID NO: 36187 - DNA, 20 bp, Artificial Sequence
  Description of Artificial Sequence: Synthetic oligonucleotide
  Target: SCN9A; (-) strand; PAM type: NRG; PAM sequence: GAG
aaaaagtgaaaggtgttgtt

SEQ ID NO: 36188 - DNA, 20 bp, Artificial Sequence
  Description of Artificial Sequence: Synthetic oligonucleotide
  Target: SCN9A; (-) strand; PAM type: NRG; PAM sequence: AGG
ggctgttataaaaaagtgaa

SEQ ID NO: 36189 - DNA, 20 bp, Artificial Sequence
  Description of Artificial Sequence: Synthetic oligonucleotide
  Target: SCN9A; (-) strand; PAM type: NRG; PAM sequence: AAG
tggctgttataaaaaagtga

SEQ ID NO: 36190 - DNA, 20 bp, Artificial Sequence
  Description of Artificial Sequence: Synthetic oligonucleotide
  Target: SCN9A; (-) strand; PAM type: NRG; PAM sequence: AAG
ttaagatggctgttataaaa

SEQ ID NO: 36191 - DNA, 20 bp, Artificial Sequence
  Description of Artificial Sequence: Synthetic oligonucleotide
  Target: SCN9A; (-) strand; PAM type: NRG; PAM sequence: TGG
tcatctcacacctgttaaga

SEQ ID NO: 36192 - DNA, 20 bp, Artificial Sequence
  Description of Artificial Sequence: Synthetic oligonucleotide
  Target: SCN9A; (-) strand; PAM type: NRG; PAM sequence: AAG
ataatcatctcacacctgtt

SEQ ID NO: 36193 - DNA, 20 bp, Artificial Sequence
  Description of Artificial Sequence: Synthetic oligonucleotide
  Target: SCN9A; (-) strand; PAM type: NRG; PAM sequence: GAG
ggttttatcagcactgcaat

SEQ ID NO: 36194 - DNA, 20 bp, Artificial Sequence
  Description of Artificial Sequence: Synthetic oligonucleotide
  Target: SCN9A; (-) strand; PAM type: NRG; PAM sequence: CAG
ctaagtggttaaggttttat

SEQ ID NO: 36195 - DNA, 20 bp, Artificial Sequence
  Description of Artificial Sequence: Synthetic oligonucleotide
  Target: SCN9A; (-) strand; PAM type: NRG; PAM sequence: AGG
tcctctagactaagtggtta

SEQ ID NO: 36196 - DNA, 20 bp, Artificial Sequence
  Description of Artificial Sequence: Synthetic oligonucleotide
  Target: SCN9A; (-) strand; PAM type: NRG; PAM sequence: AAG
atcctctagactaagtggtt

SEQ ID NO: 36197 - DNA, 20 bp, Artificial Sequence
  Description of Artificial Sequence: Synthetic oligonucleotide
  Target: SCN9A; (-) strand; PAM type: NRG; PAM sequence: TGG
agcttatcctctagactaag

SEQ ID NO: 36198 - DNA, 20 bp, Artificial Sequence
  Description of Artificial Sequence: Synthetic oligonucleotide
  Target: SCN9A; (-) strand; PAM type: NRG; PAM sequence: AAG
ggtagcttatcctctagact

SEQ ID NO: 36199 - DNA, 20 bp, Artificial Sequence
  Description of Artificial Sequence: Synthetic oligonucleotide
  Target: SCN9A; (-) strand; PAM type: NRG; PAM sequence: TAG
tggattggtagcttatcctc

SEQ ID NO: 36200 - DNA, 20 bp, Artificial Sequence
  Description of Artificial Sequence: Synthetic oligonucleotide
  Target: SCN9A; (-) strand; PAM type: NRG; PAM sequence: TAG
tttagtgatttgtggattgg

SEQ ID NO: 36201 - DNA, 20 bp, Artificial Sequence
  Description of Artificial Sequence: Synthetic oligonucleotide
  Target: SCN9A; (-) strand; PAM type: NRG; PAM sequence: TGG
tattttagtgatttgtggat

SEQ ID NO: 36202 - DNA, 20 bp, Artificial Sequence
  Description of Artificial Sequence: Synthetic oligonucleotide
  Target: SCN9A; (-) strand; PAM type: NRG; PAM sequence: TGG
caatctattttagtgatttg

SEQ ID NO: 36203 - DNA, 20 bp, Artificial Sequence
  Description of Artificial Sequence: Synthetic oligonucleotide
  Target: SCN9A; (-) strand; PAM type: NRG; PAM sequence: TAG
tgatacgtctcaatctattt

SEQ ID NO: 36204 - DNA, 20 bp, Artificial Sequence
  Description of Artificial Sequence: Synthetic oligonucleotide
  Target: SCN9A; (-) strand; PAM type: NRG; PAM sequence: GAG
ccatgggaaatttggccctt

SEQ ID NO: 36205 - DNA, 20 bp, Artificial Sequence
  Description of Artificial Sequence: Synthetic oligonucleotide
  Target: SCN9A; (-) strand; PAM type: NRG; PAM sequence: TGG
tataaaaaccatgggaaatt

SEQ ID NO: 36206 - DNA, 20 bp, Artificial Sequence
  Description of Artificial Sequence: Synthetic oligonucleotide
  Target: SCN9A; (-) strand; PAM type: NRG; PAM sequence: GGG
ctttgggatataaaaaccat

SEQ ID NO: 36207 - DNA, 20 bp, Artificial Sequence
  Description of Artificial Sequence: Synthetic oligonucleotide
  Target: SCN9A; (-) strand; PAM type: NRG; PAM sequence: TGG
actttgggatataaaaacca

SEQ ID NO: 36208 - DNA, 20 bp, Artificial Sequence
  Description of Artificial Sequence: Synthetic oligonucleotide
  Target: SCN9A; (-) strand; PAM type: NRG; PAM sequence: GGG
ccacttagatactgtacttt

SEQ ID NO: 36209 - DNA, 20 bp, Artificial Sequence
  Description of Artificial Sequence: Synthetic oligonucleotide
  Target: SCN9A; (-) strand; PAM type: NRG; PAM sequence: TGG
tccacttagatactgtactt

SEQ ID NO: 36210 - DNA, 20 bp, Artificial Sequence
  Description of Artificial Sequence: Synthetic oligonucleotide
  Target: SCN9A; (-) strand; PAM type: NRG; PAM sequence: TAG
ttaaatatctattatccact

SEQ ID NO: 36211 - DNA, 20 bp, Artificial Sequence
  Description of Artificial Sequence: Synthetic oligonucleotide
  Target: SCN9A; (-) strand; PAM type: NRG; PAM sequence: TGG
taagggttttaaaacagttt

SEQ ID NO: 36212 - DNA, 20 bp, Artificial Sequence
  Description of Artificial Sequence: Synthetic oligonucleotide
  Target: SCN9A; (-) strand; PAM type: NRG; PAM sequence: CAG
gacttttaagggttttaaaa

SEQ ID NO: 36213 - DNA, 20 bp, Artificial Sequence
  Description of Artificial Sequence: Synthetic oligonucleotide
  Target: SCN9A; (-) strand; PAM type: NRG; PAM sequence: GGG
tgcaagaagttgacttttaa

SEQ ID NO: 36214 - DNA, 20 bp, Artificial Sequence
  Description of Artificial Sequence: Synthetic oligonucleotide
  Target: SCN9A; (-) strand; PAM type: NRG; PAM sequence: AGG
atgcaagaagttgactttta

SEQ ID NO: 36215 - DNA, 20 bp, Artificial Sequence
  Description of Artificial Sequence: Synthetic oligonucleotide
  Target: SCN9A; (-) strand; PAM type: NRG; PAM sequence: AAG
aatgcaagaagttgactttt

SEQ ID NO: 36216 - DNA, 20 bp, Artificial Sequence
  Description of Artificial Sequence: Synthetic oligonucleotide
  Target: SCN9A; (-) strand; PAM type: NRG; PAM sequence: AAG
tctaacatcagtaatgcaag

SEQ ID NO: 36217 - DNA, 20 bp, Artificial Sequence
  Description of Artificial Sequence: Synthetic oligonucleotide
  Target: SCN9A; (-) strand; PAM type: NRG; PAM sequence: AAG
ttgtctaacatcagtaatgc

SEQ ID NO: 36218 - DNA, 20 bp, Artificial Sequence
  Description of Artificial Sequence: Synthetic oligonucleotide
  Target: SCN9A; (-) strand; PAM type: NRG; PAM sequence: CAG
tcagttaaattgtctaacat

SEQ ID NO: 36219 - DNA, 20 bp, Artificial Sequence
  Description of Artificial Sequence: Synthetic oligonucleotide
  Target: SCN9A; (-) strand; PAM type: NRG; PAM sequence: CAG
gaagactcaattatctaagt

SEQ ID NO: 36220 - DNA, 20 bp, Artificial Sequence
  Description of Artificial Sequence: Synthetic oligonucleotide
  Target: SCN9A; (-) strand; PAM type: NRG; PAM sequence: AAG
tcatgaagactcaattatct

SEQ ID NO: 36221 - DNA, 20 bp, Artificial Sequence
  Description of Artificial Sequence: Synthetic oligonucleotide
  Target: SCN9A; (-) strand; PAM type: NRG; PAM sequence: AAG
tcacagtacttattgtcatg

SEQ ID NO: 36222 - DNA, 20 bp, Artificial Sequence
  Description of Artificial Sequence: Synthetic oligonucleotide
  Target: SCN9A; (-) strand; PAM type: NRG; PAM sequence: CAG
cacaaatgaaacctaaatca

SEQ ID NO: 36223 - DNA, 20 bp, Artificial Sequence
  Description of Artificial Sequence: Synthetic oligonucleotide
  Target: SCN9A; (-) strand; PAM type: NRG; PAM sequence: GAG
tggaggagtacaaatattta

SEQ ID NO: 36224 - DNA, 20 bp, Artificial Sequence
  Description of Artificial Sequence: Synthetic oligonucleotide
  Target: SCN9A; (-) strand; PAM type: NRG; PAM sequence: TAG
attggaggagtacaaatatt

SEQ ID NO: 36225 - DNA, 20 bp, Artificial Sequence
  Description of Artificial Sequence: Synthetic oligonucleotide
  Target: SCN9A; (-) strand; PAM type: NRG; PAM sequence: GAG
ttagatattctatattggag

SEQ ID NO: 36226 - DNA, 20 bp, Artificial Sequence
  Description of Artificial Sequence: Synthetic oligonucleotide
  Target: SCN9A; (-) strand; PAM type: NRG; PAM sequence: AGG
atttagatattctatattgg

SEQ ID NO: 36227 - DNA, 20 bp, Artificial Sequence
  Description of Artificial Sequence: Synthetic oligonucleotide
  Target: SCN9A; (-) strand; PAM type: NRG; PAM sequence: GAG
aatttagatattctatattg

SEQ ID NO: 36228 - DNA, 20 bp, Artificial Sequence
  Description of Artificial Sequence: Synthetic oligonucleotide
  Target: SCN9A; (-) strand; PAM type: NRG; PAM sequence: TGG
aaaatttagatattctatat

SEQ ID NO: 36229 - DNA, 20 bp, Artificial Sequence
  Description of Artificial Sequence: Synthetic oligonucleotide
  Target: SCN9A; (-) strand; PAM type: NRG; PAM sequence: TAG
tatcttggaaaataaaaatt

SEQ ID NO: 36230 - DNA, 20 bp, Artificial Sequence
  Description of Artificial Sequence: Synthetic oligonucleotide
  Target: SCN9A; (-) strand; PAM type: NRG; PAM sequence: TGG
ttggaagtatttatatatct

SEQ ID NO: 36231 - DNA, 20 bp, Artificial Sequence
  Description of Artificial Sequence: Synthetic oligonucleotide
  Target: SCN9A; (-) strand; PAM type: NRG; PAM sequence: AAG
aagatgatggtgttcattgg

SEQ ID NO: 36232 - DNA, 20 bp, Artificial Sequence
  Description of Artificial Sequence: Synthetic oligonucleotide
  Target: SCN9A; (-) strand; PAM type: NRG; PAM sequence: TGG
gataagatgatggtgttcat

SEQ ID NO: 36233 - DNA, 20 bp, Artificial Sequence
  Description of Artificial Sequence: Synthetic oligonucleotide
  Target: SCN9A; (-) strand; PAM type: NRG; PAM sequence: TGG
tcttgtgcaggataagatga

SEQ ID NO: 36234 - DNA, 20 bp, Artificial Sequence
  Description of Artificial Sequence: Synthetic oligonucleotide
  Target: SCN9A; (-) strand; PAM type: NRG; PAM sequence: AAG
aaagtgatcttgtgcaggat

SEQ ID NO: 36235 - DNA, 20 bp, Artificial Sequence
  Description of Artificial Sequence: Synthetic oligonucleotide
  Target: SCN9A; (-) strand; PAM type: NRG; PAM sequence: AGG
aaagcaaagtgatcttgtgc

SEQ ID NO: 36236 - DNA, 20 bp, Artificial Sequence
  Description of Artificial Sequence: Synthetic oligonucleotide
  Target: SCN9A; (-) strand; PAM type: NRG; PAM sequence: CAG
aaaagcaaagtgatcttgtg

SEQ ID NO: 36237 - DNA, 20 bp, Artificial Sequence
  Description of Artificial Sequence: Synthetic oligonucleotide
  Target: SCN9A; (-) strand; PAM type: NRG; PAM sequence: AAG
atggagaagtatgaaaagca

SEQ ID NO: 36238 - DNA, 20 bp, Artificial Sequence
  Description of Artificial Sequence: Synthetic oligonucleotide
  Target: SCN9A; (-) strand; PAM type: NRG; PAM sequence: AAG
agcagatggagaagtatgaa

SEQ ID NO: 36239 - DNA, 20 bp, Artificial Sequence
  Description of Artificial Sequence: Synthetic oligonucleotide
  Target: SCN9A; (-) strand; PAM type: NRG; PAM sequence: AAG
cctggagctagcagatggag

SEQ ID NO: 36240 - DNA, 20 bp, Artificial Sequence
  Description of Artificial Sequence: Synthetic oligonucleotide
  Target: SCN9A; (-) strand; PAM type: NRG; PAM sequence: GAG
gatcctggagctagcagatg

SEQ ID NO: 36241 - DNA, 20 bp, Artificial Sequence
  Description of Artificial Sequence: Synthetic oligonucleotide
  Target: SCN9A; (-) strand; PAM type: NRG; PAM sequence: TGG
gagatcctggagctagcaga

SEQ ID NO: 36242 - DNA, 20 bp, Artificial Sequence
  Description of Artificial Sequence: Synthetic oligonucleotide
  Target: SCN9A; (-) strand; PAM type: NRG; PAM sequence: CAG
cgttgagatcctggagctag

SEQ ID NO: 36243 - DNA, 20 bp, Artificial Sequence
  Description of Artificial Sequence: Synthetic oligonucleotide
  Target: SCN9A; (-) strand; PAM type: NRG; PAM sequence: TAG
acacgttgagatcctggagc

SEQ ID NO: 36244 - DNA, 20 bp, Artificial Sequence
  Description of Artificial Sequence: Synthetic oligonucleotide
  Target: SCN9A; (-) strand; PAM type: NRG; PAM sequence: GAG
ttacacacgttgagatcctg

SEQ ID NO: 36245 - DNA, 20 bp, Artificial Sequence
  Description of Artificial Sequence: Synthetic oligonucleotide
  Target: SCN9A; (-) strand; PAM type: NRG; PAM sequence: TGG
agttacacacgttgagatcc

SEQ ID NO: 36246 - DNA, 20 bp, Artificial Sequence
  Description of Artificial Sequence: Synthetic oligonucleotide
  Target: SCN9A; (-) strand; PAM type: NRG; PAM sequence: GAG
ggaatgaagttacacacgtt

SEQ ID NO: 36247 - DNA, 20 bp, Artificial Sequence
  Description of Artificial Sequence: Synthetic oligonucleotide
  Target: SCN9A; (-) strand; PAM type: NRG; PAM sequence: AAG
tggagaagaaacagggaatg

SEQ ID NO: 36248 - DNA, 20 bp, Artificial Sequence
  Description of Artificial Sequence: Synthetic oligonucleotide
  Target: SCN9A; (-) strand; PAM type: NRG; PAM sequence: GGG
tctgaaatggagaagaaaca

SEQ ID NO: 36249 - DNA, 20 bp, Artificial Sequence
  Description of Artificial Sequence: Synthetic oligonucleotide
  Target: SCN9A; (-) strand; PAM type: NRG; PAM sequence: AGG
ttctgaaatggagaagaaac

SEQ ID NO: 36250 - DNA, 20 bp, Artificial Sequence
  Description of Artificial Sequence: Synthetic oligonucleotide
  Target: SCN9A; (-) strand; PAM type: NRG; PAM sequence: CAG
attctgaaatggagaagaaa

SEQ ID NO: 36251 - DNA, 20 bp, Artificial Sequence
  Description of Artificial Sequence: Synthetic oligonucleotide
  Target: SCN9A; (-) strand; PAM type: NRG; PAM sequence: AAG
aagtttattctgaaatggag

SEQ ID NO: 36252 - DNA, 20 bp, Artificial Sequence
  Description of Artificial Sequence: Synthetic oligonucleotide
  Target: SCN9A; (-) strand; PAM type: NRG; PAM sequence: GAG
atgaagtttattctgaaatg

SEQ ID NO: 36253 - DNA, 20 bp, Artificial Sequence
  Description of Artificial Sequence: Synthetic oligonucleotide
  Target: SCN9A; (-) strand; PAM type: NRG; PAM sequence: TGG
ggatgaagtttattctgaaa

SEQ ID NO: 36254 - DNA, 20 bp, Artificial Sequence
  Description of Artificial Sequence: Synthetic oligonucleotide
  Target: SCN9A; (-) strand; PAM type: NRG; PAM sequence: AAG
ttaaaaaaatgtctaggatg

SEQ ID NO: 36255 - DNA, 20 bp, Artificial Sequence
  Description of Artificial Sequence: Synthetic oligonucleotide
  Target: SCN9A; (-) strand; PAM type: NRG; PAM sequence: AGG
aaaaaattaaaaaaatgtct

SEQ ID NO: 36256 - DNA, 20 bp, Artificial Sequence
  Description of Artificial Sequence: Synthetic oligonucleotide
  Target: SCN9A; (-) strand; PAM type: NRG; PAM sequence: TAG
aaaaaaattaaaaaaatgtc

SEQ ID NO: 36257 - DNA, 20 bp, Artificial Sequence
  Description of Artificial Sequence: Synthetic oligonucleotide
  Target: SCN9A; (-) strand; PAM type: NRG; PAM sequence: AAG
acagagcgagactcagtctc

SEQ ID NO: 36258 - DNA, 20 bp, Artificial Sequence
  Description of Artificial Sequence: Synthetic oligonucleotide
  Target: SCN9A; (-) strand; PAM type: NRG; PAM sequence: CAG
ctgggcaacagagcgagact

SEQ ID NO: 36259 - DNA, 20 bp, Artificial Sequence
  Description of Artificial Sequence: Synthetic oligonucleotide
  Target: SCN9A; (-) strand; PAM type: NRG; PAM sequence: GAG
tcctgcctgggcaacagagc

SEQ ID NO: 36260 - DNA, 20 bp, Artificial Sequence
  Description of Artificial Sequence: Synthetic oligonucleotide
  Target: SCN9A; (-) strand; PAM type: NRG; PAM sequence: GAG
gcactcctgcctgggcaaca

SEQ ID NO: 36261 - DNA, 20 bp, Artificial Sequence
  Description of Artificial Sequence: Synthetic oligonucleotide
  Target: SCN9A; (-) strand; PAM type: NRG; PAM sequence: CAG
ctgcactcctgcctgggcaa

SEQ ID NO: 36262 - DNA, 20 bp, Artificial Sequence
  Description of Artificial Sequence: Synthetic oligonucleotide
  Target: SCN9A; (-) strand; PAM type: NRG; PAM sequence: GGG
gagccactgcactcctgcct

SEQ ID NO: 36263 - DNA, 20 bp, Artificial Sequence
  Description of Artificial Sequence: Synthetic oligonucleotide
  Target: SCN9A; (-) strand; PAM type: NRG; PAM sequence: TGG
cgagccactgcactcctgcc

SEQ ID NO: 36264 - DNA, 20 bp, Artificial Sequence
  Description of Artificial Sequence: Synthetic oligonucleotide
  Target: SCN9A; (-) strand; PAM type: NRG; PAM sequence: GAG
ggttgcagtgagctgagatc

SEQ ID NO: 36265 - DNA, 20 bp, Artificial Sequence
  Description of Artificial Sequence: Synthetic oligonucleotide
  Target: SCN9A; (-) strand; PAM type: NRG; PAM sequence: GAG
gatggaggttgcagtgagct

SEQ ID NO: 36266 - DNA, 20 bp, Artificial Sequence
  Description of Artificial Sequence: Synthetic oligonucleotide
  Target: SCN9A; (-) strand; PAM type: NRG; PAM sequence: GAG
tgggagatggaggttgcagt

SEQ ID NO: 36267 - DNA, 20 bp, Artificial Sequence
  Description of Artificial Sequence: Synthetic oligonucleotide
  Target: SCN9A; (-) strand; PAM type: NRG; PAM sequence: CAG
aacctgggagatggaggttg

SEQ ID NO: 36268 - DNA, 20 bp, Artificial Sequence
  Description of Artificial Sequence: Synthetic oligonucleotide
  Target: SCN9A; (-) strand; PAM type: NRG; PAM sequence: AGG
tgcctgaacctgggagatgg

SEQ ID NO: 36269 - DNA, 20 bp, Artificial Sequence
  Description of Artificial Sequence: Synthetic oligonucleotide
  Target: SCN9A; (-) strand; PAM type: NRG; PAM sequence: GAG
ttgcctgaacctgggagatg

SEQ ID NO: 36270 - DNA, 20 bp, Artificial Sequence
  Description of Artificial Sequence: Synthetic oligonucleotide
  Target: SCN9A; (-) strand; PAM type: NRG; PAM sequence: TGG
aattgcctgaacctgggaga

SEQ ID NO: 36271 - DNA, 20 bp, Artificial Sequence
  Description of Artificial Sequence: Synthetic oligonucleotide
  Target: SCN9A; (-) strand; PAM type: NRG; PAM sequence: GAG
ggagaattgcctgaacctgg

SEQ ID NO: 36272 - DNA, 20 bp, Artificial Sequence
  Description of Artificial Sequence: Synthetic oligonucleotide
  Target: SCN9A; (-) strand; PAM type: NRG; PAM sequence: GGG
caggagaattgcctgaacct

SEQ ID NO: 36273 - DNA, 20 bp, Artificial Sequence
  Description of Artificial Sequence: Synthetic oligonucleotide
  Target: SCN9A; (-) strand; PAM type: NRG; PAM sequence: TGG
gcaggagaattgcctgaacc

SEQ ID NO: 36274 - DNA, 20 bp, Artificial Sequence
  Description of Artificial Sequence: Synthetic oligonucleotide
  Target: SCN9A; (-) strand; PAM type: NRG; PAM sequence: GAG
ttctcgggaggctgaggcag

SEQ ID NO: 36275 - DNA, 20 bp, Artificial Sequence
  Description of Artificial Sequence: Synthetic oligonucleotide
  Target: SCN9A; (-) strand; PAM type: NRG; PAM sequence: AGG
gcttctcgggaggctgaggc

SEQ ID NO: 36276 - DNA, 20 bp, Artificial Sequence
  Description of Artificial Sequence: Synthetic oligonucleotide
  Target: SCN9A; (-) strand; PAM type: NRG; PAM sequence: CAG
agcttctcgggaggctgagg

SEQ ID NO: 36277 - DNA, 20 bp, Artificial Sequence
  Description of Artificial Sequence: Synthetic oligonucleotide
  Target: SCN9A; (-) strand; PAM type: NRG; PAM sequence: AGG
cccagcttctcgggaggctg

SEQ ID NO: 36278 - DNA, 20 bp, Artificial Sequence
  Description of Artificial Sequence: Synthetic oligonucleotide
  Target: SCN9A; (-) strand; PAM type: NRG; PAM sequence: GAG
tcccagcttctcgggaggct

SEQ ID NO: 36279 - DNA, 20 bp, Artificial Sequence
  Description of Artificial Sequence: Synthetic oligonucleotide
  Target: SCN9A; (-) strand; PAM type: NRG; PAM sequence: AGG
tgtagtcccagcttctcggg

SEQ ID NO: 36280 - DNA, 20 bp, Artificial Sequence
  Description of Artificial Sequence: Synthetic oligonucleotide
  Target: SCN9A; (-) strand; PAM type: NRG; PAM sequence: GAG
ctgtagtcccagcttctcgg

SEQ ID NO: 36281 - DNA, 20 bp, Artificial Sequence
  Description of Artificial Sequence: Synthetic oligonucleotide
  Target: SCN9A; (-) strand; PAM type: NRG; PAM sequence: GGG
acctgtagtcccagcttctc

SEQ ID NO: 36282 - DNA, 20 bp, Artificial Sequence
  Description of Artificial Sequence: Synthetic oligonucleotide
  Target: SCN9A; (-) strand; PAM type: NRG; PAM sequence: CGG
cacctgtagtcccagcttct

SEQ ID NO: 36283 - DNA, 20 bp, Artificial Sequence
  Description of Artificial Sequence: Synthetic oligonucleotide
  Target: SCN9A; (-) strand; PAM type: NRG; PAM sequence: CAG
gtggccagcacctgtagtcc

SEQ ID NO: 36284 - DNA, 20 bp, Artificial Sequence
  Description of Artificial Sequence: Synthetic oligonucleotide
  Target: SCN9A; (-) strand; PAM type: NRG; PAM sequence: TAG
ggcatggtggccagcacctg

SEQ ID NO: 36285 - DNA, 20 bp, Artificial Sequence
  Description of Artificial Sequence: Synthetic oligonucleotide
  Target: SCN9A; (-) strand; PAM type: NRG; PAM sequence: CAG
aactatccaggcatggtggc

SEQ ID NO: 36286 - DNA, 20 bp, Artificial Sequence
  Description of Artificial Sequence: Synthetic oligonucleotide
  Target: SCN9A; (-) strand; PAM type: NRG; PAM sequence: TGG
caaaaactatccaggcatgg

SEQ ID NO: 36287 - DNA, 20 bp, Artificial Sequence
  Description of Artificial Sequence: Synthetic oligonucleotide
  Target: SCN9A; (-) strand; PAM type: NRG; PAM sequence: TGG
atacaaaaactatccaggca

SEQ ID NO: 36288 - DNA, 20 bp, Artificial Sequence
  Description of Artificial Sequence: Synthetic oligonucleotide
  Target: SCN9A; (-) strand; PAM type: NRG; PAM sequence: AGG
aaaaaatacaaaaactatcc

SEQ ID NO: 36289 - DNA, 20 bp, Artificial Sequence
  Description of Artificial Sequence: Synthetic oligonucleotide
  Target: SCN9A; (-) strand; PAM type: NRG; PAM sequence: CAG
aaaaaaatacaaaaactatc

SEQ ID NO: 36290 - DNA, 20 bp, Artificial Sequence
  Description of Artificial Sequence: Synthetic oligonucleotide
  Target: SCN9A; (-) strand; PAM type: NRG; PAM sequence: TAG
ggagaccagcctggtcaaca

SEQ ID NO: 36291 - DNA, 20 bp, Artificial Sequence
  Description of Artificial Sequence: Synthetic oligonucleotide
  Target: SCN9A; (-) strand; PAM type: NRG; PAM sequence: TGG
tcaggagttggagaccagcc

SEQ ID NO: 36292 - DNA, 20 bp, Artificial Sequence
  Description of Artificial Sequence: Synthetic oligonucleotide
  Target: SCN9A; (-) strand; PAM type: NRG; PAM sequence: CAG
tgaggtcaggagttggagac

SEQ ID NO: 36293 - DNA, 20 bp, Artificial Sequence
  Description of Artificial Sequence: Synthetic oligonucleotide
  Target: SCN9A; (-) strand; PAM type: NRG; PAM sequence: GAG
tcacttgaggtcaggagttg

SEQ ID NO: 36294 - DNA, 20 bp, Artificial Sequence
  Description of Artificial Sequence: Synthetic oligonucleotide
  Target: SCN9A; (-) strand; PAM type: NRG; PAM sequence: TGG
gatcacttgaggtcaggagt

SEQ ID NO: 36295 - DNA, 20 bp, Artificial Sequence
  Description of Artificial Sequence: Synthetic oligonucleotide
  Target: SCN9A; (-) strand; PAM type: NRG; PAM sequence: GAG
ggctgatcacttgaggtcag

SEQ ID NO: 36296 - DNA, 20 bp, Artificial Sequence
  Description of Artificial Sequence: Synthetic oligonucleotide
  Target: SCN9A; (-) strand; PAM type: NRG; PAM sequence: AGG
caggctgatcacttgaggtc

SEQ ID NO: 36297 - DNA, 20 bp, Artificial Sequence
  Description of Artificial Sequence: Synthetic oligonucleotide
  Target: SCN9A; (-) strand; PAM type: NRG; PAM sequence: CAG
gcaggctgatcacttgaggt

SEQ ID NO: 36298 - DNA, 20 bp, Artificial Sequence
  Description of Artificial Sequence: Synthetic oligonucleotide
  Target: SCN9A; (-) strand; PAM type: NRG; PAM sequence: AGG
tgaggcaggctgatcacttg

SEQ ID NO: 36299 - DNA, 20 bp, Artificial Sequence
  Description of Artificial Sequence: Synthetic oligonucleotide
  Target: SCN9A; (-) strand; PAM type: NRG; PAM sequence: GAG
ctgaggcaggctgatcactt

SEQ ID NO: 36300 - DNA, 20 bp, Artificial Sequence
  Description of Artificial Sequence: Synthetic oligonucleotide
  Target: SCN9A; (-) strand; PAM type: NRG; PAM sequence: AGG
gcactttggaaggctgaggc

SEQ ID NO: 36301 - DNA, 20 bp, Artificial Sequence
  Description of Artificial Sequence: Synthetic oligonucleotide
  Target: SCN9A; (-) strand; PAM type: NRG; PAM sequence: CAG
agcactttggaaggctgagg

SEQ ID NO: 36302 - DNA, 20 bp, Artificial Sequence
  Description of Artificial Sequence: Synthetic oligonucleotide
  Target: SCN9A; (-) strand; PAM type: NRG; PAM sequence: AGG
tccagcactttggaaggctg

SEQ ID NO: 36303 - DNA, 20 bp, Artificial Sequence
  Description of Artificial Sequence: Synthetic oligonucleotide
  Target: SCN9A; (-) strand; PAM type: NRG; PAM sequence: GAG
atccagcactttggaaggct

SEQ ID NO: 36304 - DNA, 20 bp, Artificial Sequence
  Description of Artificial Sequence: Synthetic oligonucleotide
  Target: SCN9A; (-) strand; PAM type: NRG; PAM sequence: AGG
ccgtaatccagcactttgga

SEQ ID NO: 36305 - DNA, 20 bp, Artificial Sequence
  Description of Artificial Sequence: Synthetic oligonucleotide
  Target: SCN9A; (-) strand; PAM type: NRG; PAM sequence: AAG
cccgtaatccagcactttgg

SEQ ID NO: 36306 - DNA, 20 bp, Artificial Sequence
  Description of Artificial Sequence: Synthetic oligonucleotide
  Target: SCN9A; (-) strand; PAM type: NRG; PAM sequence: TGG
acgcccgtaatccagcactt

SEQ ID NO: 36307 - DNA, 20 bp, Artificial Sequence
  Description of Artificial Sequence: Synthetic oligonucleotide
  Target: SCN9A; (-) strand; PAM type: NRG; PAM sequence: CAG
ggtggcttacgcccgtaatc

SEQ ID NO: 36308 - DNA, 20 bp, Artificial Sequence
  Description of Artificial Sequence: Synthetic oligonucleotide
  Target: SCN9A; (-) strand; PAM type: NRG; PAM sequence: TGG
ctagggtgggccaggcgcgg

SEQ ID NO: 36309 - DNA, 20 bp, Artificial Sequence
  Description of Artificial Sequence: Synthetic oligonucleotide
  Target: SCN9A; (-) strand; PAM type: NRG; PAM sequence: CGG
tgtctagggtgggccaggcg

SEQ ID NO: 36310 - DNA, 20 bp, Artificial Sequence
  Description of Artificial Sequence: Synthetic oligonucleotide
  Target: SCN9A; (-) strand; PAM type: NRG; PAM sequence: AGG
taaaatgtctagggtgggcc

SEQ ID NO: 36311 - DNA, 20 bp, Artificial Sequence
  Description of Artificial Sequence: Synthetic oligonucleotide
  Target: SCN9A; (-) strand; PAM type: NRG; PAM sequence: CAG
ataaaatgtctagggtgggc

SEQ ID NO: 36312 - DNA, 20 bp, Artificial Sequence
  Description of Artificial Sequence: Synthetic oligonucleotide
  Target: SCN9A; (-) strand; PAM type: NRG; PAM sequence: GGG
atgtataaaatgtctagggt

SEQ ID NO: 36313 - DNA, 20 bp, Artificial Sequence
  Description of Artificial Sequence: Synthetic oligonucleotide
  Target: SCN9A; (-) strand; PAM type: NRG; PAM sequence: TGG
tatgtataaaatgtctaggg

SEQ ID NO: 36314 - DNA, 20 bp, Artificial Sequence
  Description of Artificial Sequence: Synthetic oligonucleotide
  Target: SCN9A; (-) strand; PAM type: NRG; PAM sequence: GGG
aaatatgtataaaatgtcta

SEQ ID NO: 36315 - DNA, 20 bp, Artificial Sequence
  Description of Artificial Sequence: Synthetic oligonucleotide
  Target: SCN9A; (-) strand; PAM type: NRG; PAM sequence: AGG
gaaatatgtataaaatgtct

SEQ ID NO: 36316 - DNA, 20 bp, Artificial Sequence
  Description of Artificial Sequence: Synthetic oligonucleotide
  Target: SCN9A; (-) strand; PAM type: NRG; PAM sequence: TAG
ggaaatatgtataaaatgtc

SEQ ID NO: 36317 - DNA, 20 bp, Artificial Sequence
  Description of Artificial Sequence: Synthetic oligonucleotide
  Target: SCN9A; (-) strand; PAM type: NRG; PAM sequence: GGG
gaggaatggtgtaattaaaa

SEQ ID NO: 36318 - DNA, 20 bp, Artificial Sequence
  Description of Artificial Sequence: Synthetic oligonucleotide
  Target: SCN9A; (-) strand; PAM type: NRG; PAM sequence: AGG
agaggaatggtgtaattaaa

SEQ ID NO: 36319 - DNA, 20 bp, Artificial Sequence
  Description of Artificial Sequence: Synthetic oligonucleotide
  Target: SCN9A; (-) strand; PAM type: NRG; PAM sequence: AAG
aagaggaatggtgtaattaa

SEQ ID NO: 36320 - DNA, 20 bp, Artificial Sequence
  Description of Artificial Sequence: Synthetic oligonucleotide
  Target: SCN9A; (-) strand; PAM type: NRG; PAM sequence: TGG
aagatttgaaaaaagaggaa

SEQ ID NO: 36321 - DNA, 20 bp, Artificial Sequence
  Description of Artificial Sequence: Synthetic oligonucleotide
  Target: SCN9A; (-) strand; PAM type: NRG; PAM sequence: AGG
tagaaaagatttgaaaaaag

SEQ ID NO: 36322 - DNA, 20 bp, Artificial Sequence
  Description of Artificial Sequence: Synthetic oligonucleotide
  Target: SCN9A; (-) strand; PAM type: NRG; PAM sequence: GAG
gtagaaaagatttgaaaaaa

SEQ ID NO: 36323 - DNA, 20 bp, Artificial Sequence
  Description of Artificial Sequence: Synthetic oligonucleotide
  Target: SCN9A; (-) strand; PAM type: NRG; PAM sequence: AAG
aggtagaaaagatttgaaaa

SEQ ID NO: 36324 - DNA, 20 bp, Artificial Sequence
  Description of Artificial Sequence: Synthetic oligonucleotide
  Target: SCN9A; (-) strand; PAM type: NRG; PAM sequence: AAG
aggccttccccaaggtagaa

SEQ ID NO: 36325 - DNA, 20 bp, Artificial Sequence
  Description of Artificial Sequence: Synthetic oligonucleotide
  Target: SCN9A; (-) strand; PAM type: NRG; PAM sequence: TAG
gaaaaaggccttccccaagg

SEQ ID NO: 36326 - DNA, 20 bp, Artificial Sequence
  Description of Artificial Sequence: Synthetic oligonucleotide
  Target: SCN9A; (-) strand; PAM type: NRG; PAM sequence: AGG
tgggaaaaaggccttcccca

SEQ ID NO: 36327 - DNA, 20 bp, Artificial Sequence
  Description of Artificial Sequence: Synthetic oligonucleotide
  Target: SCN9A; (-) strand; PAM type: NRG; PAM sequence: AAG
atgggaaaaaggccttcccc

SEQ ID NO: 36328 - DNA, 20 bp, Artificial Sequence
  Description of Artificial Sequence: Synthetic oligonucleotide
  Target: SCN9A; (-) strand; PAM type: NRG; PAM sequence: AGG
aaaaaactgaaatgggaaaa

SEQ ID NO: 36329 - DNA, 20 bp, Artificial Sequence
  Description of Artificial Sequence: Synthetic oligonucleotide
  Target: SCN9A; (-) strand; PAM type: NRG; PAM sequence: AAG
taaaaaactgaaatgggaaa

SEQ ID NO: 36330 - DNA, 20 bp, Artificial Sequence
  Description of Artificial Sequence: Synthetic oligonucleotide
  Target: SCN9A; (-) strand; PAM type: NRG; PAM sequence: GGG
taacattaaaaaactgaaat

SEQ ID NO: 36331 - DNA, 20 bp, Artificial Sequence
  Description of Artificial Sequence: Synthetic oligonucleotide
  Target: SCN9A; (-) strand; PAM type: NRG; PAM sequence: TGG
ttaacattaaaaaactgaaa

SEQ ID NO: 36332 - DNA, 20 bp, Artificial Sequence
  Description of Artificial Sequence: Synthetic oligonucleotide
  Target: SCN9A; (-) strand; PAM type: NRG; PAM sequence: GAG
acttcactttcctggtctag

SEQ ID NO: 36333 - DNA, 20 bp, Artificial Sequence
  Description of Artificial Sequence: Synthetic oligonucleotide
  Target: SCN9A; (-) strand; PAM type: NRG; PAM sequence: AGG
tgacttcactttcctggtct

SEQ ID NO: 36334 - DNA, 20 bp, Artificial Sequence
  Description of Artificial Sequence: Synthetic oligonucleotide
  Target: SCN9A; (-) strand; PAM type: NRG; PAM sequence: TAG
atgacttcactttcctggtc

SEQ ID NO: 36335 - DNA, 20 bp, Artificial Sequence
  Description of Artificial Sequence: Synthetic oligonucleotide
  Target: SCN9A; (-) strand; PAM type: NRG; PAM sequence: TGG
gttgaatgacttcactttcc

SEQ ID NO: 36336 - DNA, 20 bp, Artificial Sequence
  Description of Artificial Sequence: Synthetic oligonucleotide
  Target: SCN9A; (-) strand; PAM type: NRG; PAM sequence: AGG
tgtttttgaagttgttttat

SEQ ID NO: 36337 - DNA, 20 bp, Artificial Sequence
  Description of Artificial Sequence: Synthetic oligonucleotide
  Target: SCN9A; (-) strand; PAM type: NRG; PAM sequence: TAG
gtgtttttgaagttgtttta

SEQ ID NO: 36338 - DNA, 20 bp, Artificial Sequence
  Description of Artificial Sequence: Synthetic oligonucleotide
  Target: SCN9A; (-) strand; PAM type: NRG; PAM sequence: AAG
atgcatttaaagtgtttttg

SEQ ID NO: 36339 - DNA, 20 bp, Artificial Sequence
  Description of Artificial Sequence: Synthetic oligonucleotide
  Target: SCN9A; (-) strand; PAM type: NRG; PAM sequence: AAG
aaagagtacctatgcattta

SEQ ID NO: 36340 - DNA, 20 bp, Artificial Sequence
  Description of Artificial Sequence: Synthetic oligonucleotide
  Target: SCN9A; (-) strand; PAM type: NRG; PAM sequence: GAG
gtttgaagacattatgaaaa

SEQ ID NO: 36341 - DNA, 20 bp, Artificial Sequence
  Description of Artificial Sequence: Synthetic oligonucleotide
  Target: SCN9A; (-) strand; PAM type: NRG; PAM sequence: AAG
aagtttgaagacattatgaa

SEQ ID NO: 36342 - DNA, 20 bp, Artificial Sequence
  Description of Artificial Sequence: Synthetic oligonucleotide
  Target: SCN9A; (-) strand; PAM type: NRG; PAM sequence: AAG
gagattttggtggaagtttg

SEQ ID NO: 36343 - DNA, 20 bp, Artificial Sequence
  Description of Artificial Sequence: Synthetic oligonucleotide
  Target: SCN9A; (-) strand; PAM type: NRG; PAM sequence: AAG
caaaatagagattttggtgg

SEQ ID NO: 36344 - DNA, 20 bp, Artificial Sequence
  Description of Artificial Sequence: Synthetic oligonucleotide
  Target: SCN9A; (-) strand; PAM type: NRG; PAM sequence: TGG
agtcaaaatagagattttgg

SEQ ID NO: 36345 - DNA, 20 bp, Artificial Sequence
  Description of Artificial Sequence: Synthetic oligonucleotide
  Target: SCN9A; (-) strand; PAM type: NRG; PAM sequence: TGG
ttaagtcaaaatagagattt

SEQ ID NO: 36346 - DNA, 20 bp, Artificial Sequence
  Description of Artificial Sequence: Synthetic oligonucleotide
  Target: SCN9A; (-) strand; PAM type: NRG; PAM sequence: GAG
tattgtgttaagtcaaaata

SEQ ID NO: 36347 - DNA, 20 bp, Artificial Sequence
  Description of Artificial Sequence: Synthetic oligonucleotide
  Target: SCN9A; (-) strand; PAM type: NRG; PAM sequence: TAG
tatattgtgttaagtcaaaa

SEQ ID NO: 36348 - DNA, 20 bp, Artificial Sequence
  Description of Artificial Sequence: Synthetic oligonucleotide
  Target: SCN9A; (-) strand; PAM type: NRG; PAM sequence: AAG
cctgaggggtatattgtgtt

SEQ ID NO: 36349 - DNA, 20 bp, Artificial Sequence
  Description of Artificial Sequence: Synthetic oligonucleotide
  Target: SCN9A; (-) strand; PAM type: NRG; PAM sequence: GGG
cttggacaccaattcctgag

SEQ ID NO: 36350 - DNA, 20 bp, Artificial Sequence
  Description of Artificial Sequence: Synthetic oligonucleotide
  Target: SCN9A; (-) strand; PAM type: NRG; PAM sequence: GGG
tcttggacaccaattcctga

SEQ ID NO: 36351 - DNA, 20 bp, Artificial Sequence
  Description of Artificial Sequence: Synthetic oligonucleotide
  Target: SCN9A; (-) strand; PAM type: NRG; PAM sequence: AGG
ttcttggacaccaattcctg

SEQ ID NO: 36352 - DNA, 20 bp, Artificial Sequence
  Description of Artificial Sequence: Synthetic oligonucleotide
  Target: SCN9A; (-) strand; PAM type: NRG; PAM sequence: GAG
cttcttggacaccaattcct

SEQ ID NO: 36353 - DNA, 20 bp, Artificial Sequence
  Description of Artificial Sequence: Synthetic oligonucleotide
  Target: SCN9A; (-) strand; PAM type: NRG; PAM sequence: TGG
gactgtttcaattttcttct

SEQ ID NO: 36354 - DNA, 20 bp, Artificial Sequence
  Description of Artificial Sequence: Synthetic oligonucleotide
  Target: SCN9A; (-) strand; PAM type: NRG; PAM sequence: TGG
aaacaacaaaaaaagaaaga

SEQ ID NO: 36355 - DNA, 20 bp, Artificial Sequence
  Description of Artificial Sequence: Synthetic oligonucleotide
  Target: SCN9A; (-) strand; PAM type: NRG; PAM sequence: AAG
tagaaaacaacaaaaaaaga

SEQ ID NO: 36356 - DNA, 20 bp, Artificial Sequence
  Description of Artificial Sequence: Synthetic oligonucleotide
  Target: SCN9A; (-) strand; PAM type: NRG; PAM sequence: AAG
ctaatagaaaacaacaaaaa

SEQ ID NO: 36357 - DNA, 20 bp, Artificial Sequence
  Description of Artificial Sequence: Synthetic oligonucleotide
  Target: SCN9A; (-) strand; PAM type: NRG; PAM sequence: TAG
aatcatgtaattacagctaa

SEQ ID NO: 36358 - DNA, 20 bp, Artificial Sequence
  Description of Artificial Sequence: Synthetic oligonucleotide
  Target: SCN9A; (-) strand; PAM type: NRG; PAM sequence: CAG
catactaaatcatgtaatta

SEQ ID NO: 36359 - DNA, 20 bp, Artificial Sequence
  Description of Artificial Sequence: Synthetic oligonucleotide
  Target: SCN9A; (-) strand; PAM type: NRG; PAM sequence: GAG
aatatgtttaacccttaatg

SEQ ID NO: 36360 - DNA, 20 bp, Artificial Sequence
  Description of Artificial Sequence: Synthetic oligonucleotide
  Target: SCN9A; (-) strand; PAM type: NRG; PAM sequence: TGG
caaatatgtttaacccttaa

SEQ ID NO: 36361 - DNA, 20 bp, Artificial Sequence
  Description of Artificial Sequence: Synthetic oligonucleotide
  Target: SCN9A; (-) strand; PAM type: NRG; PAM sequence: AAG
tacctggtggttacgctacc

SEQ ID NO: 36362 - DNA, 20 bp, Artificial Sequence
  Description of Artificial Sequence: Synthetic oligonucleotide
  Target: SCN9A; (-) strand; PAM type: NRG; PAM sequence: TGG
ccccacacagatatacctgg

SEQ ID NO: 36363 - DNA, 20 bp, Artificial Sequence
  Description of Artificial Sequence: Synthetic oligonucleotide
  Target: SCN9A; (-) strand; PAM type: NRG; PAM sequence: TGG
ataccccacacagatatacc

SEQ ID NO: 36364 - DNA, 20 bp, Artificial Sequence
  Description of Artificial Sequence: Synthetic oligonucleotide
  Target: SCN9A; (-) strand; PAM type: NRG; PAM sequence: CAG
acgtttgcacataccccaca

SEQ ID NO: 36365 - DNA, 20 bp, Artificial Sequence
  Description of Artificial Sequence: Synthetic oligonucleotide
  Target: SCN9A; (-) strand; PAM type: NRG; PAM sequence: AAG
aaagaaatcttatatattcc

SEQ ID NO: 36366 - DNA, 20 bp, Artificial Sequence
  Description of Artificial Sequence: Synthetic oligonucleotide
  Target: SCN9A; (-) strand; PAM type: NRG; PAM sequence: AAG
tacacatttcttttatagga

SEQ ID NO: 36367 - DNA, 20 bp, Artificial Sequence
  Description of Artificial Sequence: Synthetic oligonucleotide
  Target: SCN9A; (-) strand; PAM type: NRG; PAM sequence: AGG
aacatacacatttcttttat

SEQ ID NO: 36368 - DNA, 20 bp, Artificial Sequence
  Description of Artificial Sequence: Synthetic oligonucleotide
  Target: SCN9A; (-) strand; PAM type: NRG; PAM sequence: TAG
taacatacacatttctttta

SEQ ID NO: 36369 - DNA, 20 bp, Artificial Sequence
  Description of Artificial Sequence: Synthetic oligonucleotide
  Target: SCN9A; (-) strand; PAM type: NRG; PAM sequence: TGG
acctttccaaagactcacaa

SEQ ID NO: 36370 - DNA, 20 bp, Artificial Sequence
  Description of Artificial Sequence: Synthetic oligonucleotide
  Target: SCN9A; (-) strand; PAM type: NRG; PAM sequence: AAG
gaaattacctaacctttcca

SEQ ID NO: 36371 - DNA, 20 bp, Artificial Sequence
  Description of Artificial Sequence: Synthetic oligonucleotide
  Target: SCN9A; (-) strand; PAM type: NRG; PAM sequence: CAG
gaggtgagaacactaaggct

SEQ ID NO: 36372 - DNA, 20 bp, Artificial Sequence
  Description of Artificial Sequence: Synthetic oligonucleotide
  Target: SCN9A; (-) strand; PAM type: NRG; PAM sequence: AGG
catttgaggtgagaacacta

SEQ ID NO: 36373 - DNA, 20 bp, Artificial Sequence
  Description of Artificial Sequence: Synthetic oligonucleotide
  Target: SCN9A; (-) strand; PAM type: NRG; PAM sequence: AAG
ccatttgaggtgagaacact

SEQ ID NO: 36374 - DNA, 20 bp, Artificial Sequence
  Description of Artificial Sequence: Synthetic oligonucleotide
  Target: SCN9A; (-) strand; PAM type: NRG; PAM sequence: GAG
tcatgaccaccatttgaggt

SEQ ID NO: 36375 - DNA, 20 bp, Artificial Sequence
  Description of Artificial Sequence: Synthetic oligonucleotide
  Target: SCN9A; (-) strand; PAM type: NRG; PAM sequence: AGG
atcctcatgaccaccatttg

SEQ ID NO: 36376 - DNA, 20 bp, Artificial Sequence
  Description of Artificial Sequence: Synthetic oligonucleotide
  Target: SCN9A; (-) strand; PAM type: NRG; PAM sequence: GAG
aatcctcatgaccaccattt

SEQ ID NO: 36377 - DNA, 20 bp, Artificial Sequence
  Description of Artificial Sequence: Synthetic oligonucleotide
  Target: SCN9A; (-) strand; PAM type: NRG; PAM sequence: GGG
ctaactgagcagtttgttaa

SEQ ID NO: 36378 - DNA, 20 bp, Artificial Sequence
  Description of Artificial Sequence: Synthetic oligonucleotide
  Target: SCN9A; (-) strand; PAM type: NRG; PAM sequence: AGG
gctaactgagcagtttgtta

SEQ ID NO: 36379 - DNA, 20 bp, Artificial Sequence
  Description of Artificial Sequence: Synthetic oligonucleotide
  Target: SCN9A; (-) strand; PAM type: NRG; PAM sequence: AAG
tgctaactgagcagtttgtt

SEQ ID NO: 36380 - DNA, 20 bp, Artificial Sequence
  Description of Artificial Sequence: Synthetic oligonucleotide
  Target: SCN9A; (-) strand; PAM type: NRG; PAM sequence: CAG
tctccttaatgctaactgag

SEQ ID NO: 36381 - DNA, 20 bp, Artificial Sequence
  Description of Artificial Sequence: Synthetic oligonucleotide
  Target: SCN9A; (-) strand; PAM type: NRG; PAM sequence: GAG
acgtctccttaatgctaact

SEQ ID NO: 36382 - DNA, 20 bp, Artificial Sequence
  Description of Artificial Sequence: Synthetic oligonucleotide
  Target: SCN9A; (-) strand; PAM type: NRG; PAM sequence: TGG
taatgtaacagtcttatgta

SEQ ID NO: 36383 - DNA, 20 bp, Artificial Sequence
  Description of Artificial Sequence: Synthetic oligonucleotide
  Target: SCN9A; (-) strand; PAM type: NRG; PAM sequence: CAG
tactgataatattaatgtaa

SEQ ID NO: 36384 - DNA, 20 bp, Artificial Sequence
  Description of Artificial Sequence: Synthetic oligonucleotide
  Target: SCN9A; (-) strand; PAM type: NRG; PAM sequence: AAG
aaggaaaaatacatacggaa

SEQ ID NO: 36385 - DNA, 20 bp, Artificial Sequence
  Description of Artificial Sequence: Synthetic oligonucleotide
  Target: SCN9A; (-) strand; PAM type: NRG; PAM sequence: CGG
gttacaaggaaaaatacata

SEQ ID NO: 36386 - DNA, 20 bp, Artificial Sequence
  Description of Artificial Sequence: Synthetic oligonucleotide
  Target: SCN9A; (-) strand; PAM type: NRG; PAM sequence: AGG
ccagcaattatgctgttaca

SEQ ID NO: 36387 - DNA, 20 bp, Artificial Sequence
  Description of Artificial Sequence: Synthetic oligonucleotide
  Target: SCN9A; (-) strand; PAM type: NRG; PAM sequence: AAG
gccagcaattatgctgttac

SEQ ID NO: 36388 - DNA, 20 bp, Artificial Sequence
  Description of Artificial Sequence: Synthetic oligonucleotide
  Target: SCN9A; (-) strand; PAM type: NRG; PAM sequence: CAG
tgtaagccactgtgcaaggc

SEQ ID NO: 36389 - DNA, 20 bp, Artificial Sequence
  Description of Artificial Sequence: Synthetic oligonucleotide
  Target: SCN9A; (-) strand; PAM type: NRG; PAM sequence: AGG
caggtgtaagccactgtgca

SEQ ID NO: 36390 - DNA, 20 bp, Artificial Sequence
  Description of Artificial Sequence: Synthetic oligonucleotide
  Target: SCN9A; (-) strand; PAM type: NRG; PAM sequence: AAG
acaggtgtaagccactgtgc

SEQ ID NO: 36391 - DNA, 20 bp, Artificial Sequence
  Description of Artificial Sequence: Synthetic oligonucleotide
  Target: SCN9A; (-) strand; PAM type: NRG; PAM sequence: AAG
agtgttgggattacaggtgt

SEQ ID NO: 36392 - DNA, 20 bp, Artificial Sequence
  Description of Artificial Sequence: Synthetic oligonucleotide
  Target: SCN9A; (-) strand; PAM type: NRG; PAM sequence: AGG
ttctaaagtgttgggattac

SEQ ID NO: 36393 - DNA, 20 bp, Artificial Sequence
  Description of Artificial Sequence: Synthetic oligonucleotide
  Target: SCN9A; (-) strand; PAM type: NRG; PAM sequence: CAG
cttctaaagtgttgggatta

SEQ ID NO: 36394 - DNA, 20 bp, Artificial Sequence
  Description of Artificial Sequence: Synthetic oligonucleotide
  Target: SCN9A; (-) strand; PAM type: NRG; PAM sequence: GGG
cctcggccttctaaagtgtt

SEQ ID NO: 36395 - DNA, 20 bp, Artificial Sequence
  Description of Artificial Sequence: Synthetic oligonucleotide
  Target: SCN9A; (-) strand; PAM type: NRG; PAM sequence: TGG
acctcggccttctaaagtgt

SEQ ID NO: 36396 - DNA, 20 bp, Artificial Sequence
  Description of Artificial Sequence: Synthetic oligonucleotide
  Target: SCN9A; (-) strand; PAM type: NRG; PAM sequence: AAG
ctgcccacctcggccttcta

SEQ ID NO: 36397 - DNA, 20 bp, Artificial Sequence
  Description of Artificial Sequence: Synthetic oligonucleotide
  Target: SCN9A; (-) strand; PAM type: NRG; PAM sequence: CGG
ctcaggtgatctgcccacct

SEQ ID NO: 36398 - DNA, 20 bp, Artificial Sequence
  Description of Artificial Sequence: Synthetic oligonucleotide
  Target: SCN9A; (-) strand; PAM type: NRG; PAM sequence: AGG
agtctcgaattcctgacctc

SEQ ID NO: 36399 - DNA, 20 bp, Artificial Sequence
  Description of Artificial Sequence: Synthetic oligonucleotide
  Target: SCN9A; (-) strand; PAM type: NRG; PAM sequence: CAG
tagtctcgaattcctgacct

SEQ ID NO: 36400 - DNA, 20 bp, Artificial Sequence
  Description of Artificial Sequence: Synthetic oligonucleotide
  Target: SCN9A; (-) strand; PAM type: NRG; PAM sequence: TAG
tttcaccatgttggccagac

SEQ ID NO: 36401 - DNA, 20 bp, Artificial Sequence
  Description of Artificial Sequence: Synthetic oligonucleotide
  Target: SCN9A; (-) strand; PAM type: NRG; PAM sequence: CAG
tggggtttcaccatgttggc

SEQ ID NO: 36402 - DNA, 20 bp, Artificial Sequence
  Description of Artificial Sequence: Synthetic oligonucleotide
  Target: SCN9A; (-) strand; PAM type: NRG; PAM sequence: TGG
gagatggggtttcaccatgt

SEQ ID NO: 36403 - DNA, 20 bp, Artificial Sequence
  Description of Artificial Sequence: Synthetic oligonucleotide
  Target: SCN9A; (-) strand; PAM type: NRG; PAM sequence: GGG
ttgcagttttagtagagatg

SEQ ID NO: 36404 - DNA, 20 bp, Artificial Sequence
  Description of Artificial Sequence: Synthetic oligonucleotide
  Target: SCN9A; (-) strand; PAM type: NRG; PAM sequence: GGG
tttgcagttttagtagagat

SEQ ID NO: 36405 - DNA, 20 bp, Artificial Sequence
  Description of Artificial Sequence: Synthetic oligonucleotide
  Target: SCN9A; (-) strand; PAM type: NRG; PAM sequence: TGG
ttttgcagttttagtagaga

SEQ ID NO: 36406 - DNA, 20 bp, Artificial Sequence
  Description of Artificial Sequence: Synthetic oligonucleotide
  Target: SCN9A; (-) strand; PAM type: NRG; PAM sequence: GAG
ctaattttgcagttttagta

SEQ ID NO: 36407 - DNA, 20 bp, Artificial Sequence
  Description of Artificial Sequence: Synthetic oligonucleotide
  Target: SCN9A; (-) strand; PAM type: NRG; PAM sequence: TAG
ggctaattttgcagttttag

SEQ ID NO: 36408 - DNA, 20 bp, Artificial Sequence
  Description of Artificial Sequence: Synthetic oligonucleotide
  Target: SCN9A; (-) strand; PAM type: NRG; PAM sequence: TAG
cccggctaattttgcagttt

SEQ ID NO: 36409 - DNA, 20 bp, Artificial Sequence
  Description of Artificial Sequence: Synthetic oligonucleotide
  Target: SCN9A; (-) strand; PAM type: NRG; PAM sequence: CAG
accatgcccggctaattttg

SEQ ID NO: 36410 - DNA, 20 bp, Artificial Sequence
  Description of Artificial Sequence: Synthetic oligonucleotide
  Target: SCN9A; (-) strand; PAM type: NRG; PAM sequence: CGG
caggcatgtaccaccatgcc

SEQ ID NO: 36411 - DNA, 20 bp, Artificial Sequence
  Description of Artificial Sequence: Synthetic oligonucleotide
  Target: SCN9A; (-) strand; PAM type: NRG; PAM sequence: AGG
tcccaagtagctgggattac

SEQ ID NO: 36412 - DNA, 20 bp, Artificial Sequence
  Description of Artificial Sequence: Synthetic oligonucleotide
  Target: SCN9A; (-) strand; PAM type: NRG; PAM sequence: CAG
ctcccaagtagctgggatta

SEQ ID NO: 36413 - DNA, 20 bp, Artificial Sequence
  Description of Artificial Sequence: Synthetic oligonucleotide
  Target: SCN9A; (-) strand; PAM type: NRG; PAM sequence: GGG
cctcagcctcccaagtagct

SEQ ID NO: 36414 - DNA, 20 bp, Artificial Sequence
  Description of Artificial Sequence: Synthetic oligonucleotide
  Target: SCN9A; (-) strand; PAM type: NRG; PAM sequence: TGG
gcctcagcctcccaagtagc

SEQ ID NO: 36415 - DNA, 20 bp, Artificial Sequence
  Description of Artificial Sequence: Synthetic oligonucleotide
  Target: SCN9A; (-) strand; PAM type: NRG; PAM sequence: TAG
tcctgcctcagcctcccaag

SEQ ID NO: 36416 - DNA, 20 bp, Artificial Sequence
  Description of Artificial Sequence: Synthetic oligonucleotide
  Target: SCN9A; (-) strand; PAM type: NRG; PAM sequence: AAG
ttctcctgcctcagcctccc

SEQ ID NO: 36417 - DNA, 20 bp, Artificial Sequence
  Description of Artificial Sequence: Synthetic oligonucleotide
  Target: SCN9A; (-) strand; PAM type: NRG; PAM sequence: CAG
ttcaagtgattctcctgcct

SEQ ID NO: 36418 - DNA, 20 bp, Artificial Sequence
  Description of Artificial Sequence: Synthetic oligonucleotide
  Target: SCN9A; (-) strand; PAM type: NRG; PAM sequence: AAG
aacctctgcctcccagattc

SEQ ID NO: 36419 - DNA, 20 bp, Artificial Sequence
  Description of Artificial Sequence: Synthetic oligonucleotide
  Target: SCN9A; (-) strand; PAM type: NRG; PAM sequence: CAG
tcgctgcaacctctgcctcc

SEQ ID NO: 36420 - DNA, 20 bp, Artificial Sequence
  Description of Artificial Sequence: Synthetic oligonucleotide
  Target: SCN9A; (-) strand; PAM type: NRG; PAM sequence: TGG
ggagtgcagtggtacgatgt

SEQ ID NO: 36421 - DNA, 20 bp, Artificial Sequence
  Description of Artificial Sequence: Synthetic oligonucleotide
  Target: SCN9A; (-) strand; PAM type: NRG; PAM sequence: TGG
ttgcccaggctggagtgcag

SEQ ID NO: 36422 - DNA, 20 bp, Artificial Sequence
  Description of Artificial Sequence: Synthetic oligonucleotide
  Target: SCN9A; (-) strand; PAM type: NRG; PAM sequence: CAG
ctgttgcccaggctggagtg

SEQ ID NO: 36423 - DNA, 20 bp, Artificial Sequence
  Description of Artificial Sequence: Synthetic oligonucleotide
  Target: SCN9A; (-) strand; PAM type: NRG; PAM sequence: GAG
tcactctgttgcccaggctg

SEQ ID NO: 36424 - DNA, 20 bp, Artificial Sequence
  Description of Artificial Sequence: Synthetic oligonucleotide
  Target: SCN9A; (-) strand; PAM type: NRG; PAM sequence: TGG
tttcactctgttgcccaggc

SEQ ID NO: 36425 - DNA, 20 bp, Artificial Sequence
  Description of Artificial Sequence: Synthetic oligonucleotide
  Target: SCN9A; (-) strand; PAM type: NRG; PAM sequence: AGG
ccggtttcactctgttgccc

SEQ ID NO: 36426 - DNA, 20 bp, Artificial Sequence
  Description of Artificial Sequence: Synthetic oligonucleotide
  Target: SCN9A; (-) strand; PAM type: NRG; PAM sequence: CAG
gccggtttcactctgttgcc

SEQ ID NO: 36427 - DNA, 20 bp, Artificial Sequence
  Description of Artificial Sequence: Synthetic oligonucleotide
  Target: SCN9A; (-) strand; PAM type: NRG; PAM sequence: CGG
ttacataggtaaaggtgtgc

SEQ ID NO: 36428 - DNA, 20 bp, Artificial Sequence
  Description of Artificial Sequence: Synthetic oligonucleotide
  Target: SCN9A; (-) strand; PAM type: NRG; PAM sequence: AGG
caggttttttacataggtaa

SEQ ID NO: 36429 - DNA, 20 bp, Artificial Sequence
  Description of Artificial Sequence: Synthetic oligonucleotide
  Target: SCN9A; (-) strand; PAM type: NRG; PAM sequence: AAG
gcaggttttttacataggta

SEQ ID NO: 36430 - DNA, 20 bp, Artificial Sequence
  Description of Artificial Sequence: Synthetic oligonucleotide
  Target: SCN9A; (-) strand; PAM type: NRG; PAM sequence: AGG
gatgtgcaggttttttacat

SEQ ID NO: 36431 - DNA, 20 bp, Artificial Sequence
  Description of Artificial Sequence: Synthetic oligonucleotide
  Target: SCN9A; (-) strand; PAM type: NRG; PAM sequence: TAG
ggatgtgcaggttttttaca

SEQ ID NO: 36432 - DNA, 20 bp, Artificial Sequence
  Description of Artificial Sequence: Synthetic oligonucleotide
  Target: SCN9A; (-) strand; PAM type: NRG; PAM sequence: AGG
ggtacatttgcaggatgtgc

SEQ ID NO: 36433 - DNA, 20 bp, Artificial Sequence
  Description of Artificial Sequence: Synthetic oligonucleotide
  Target: SCN9A; (-) strand; PAM type: NRG; PAM sequence: CAG
aggtacatttgcaggatgtg

SEQ ID NO: 36434 - DNA, 20 bp, Artificial Sequence
  Description of Artificial Sequence: Synthetic oligonucleotide
  Target: SCN9A; (-) strand; PAM type: NRG; PAM sequence: AGG
aagtttcaaggtacatttgc

SEQ ID NO: 36435 - DNA, 20 bp, Artificial Sequence
  Description of Artificial Sequence: Synthetic oligonucleotide
  Target: SCN9A; (-) strand; PAM type: NRG; PAM sequence: CAG
taagtttcaaggtacatttg

SEQ ID NO: 36436 - DNA, 20 bp, Artificial Sequence
  Description of Artificial Sequence: Synthetic oligonucleotide
  Target: SCN9A; (-) strand; PAM type: NRG; PAM sequence: AGG
ttttttttaattaagtttca

SEQ ID NO: 36437 - DNA, 20 bp, Artificial Sequence
  Description of Artificial Sequence: Synthetic oligonucleotide
  Target: SCN9A; (-) strand; PAM type: NRG; PAM sequence: AAG
tttttttttaattaagtttc

SEQ ID NO: 36438 - DNA, 20 bp, Artificial Sequence
  Description of Artificial Sequence: Synthetic oligonucleotide
  Target: SCN9A; (-) strand; PAM type: NRG; PAM sequence: AAG
ttttttttttttttttaatt

SEQ ID NO: 36439 - DNA, 20 bp, Artificial Sequence
  Description of Artificial Sequence: Synthetic oligonucleotide
  Target: SCN9A; (-) strand; PAM type: NRG; PAM sequence: CAG
taggcgtgagccaccatgcc

SEQ ID NO: 36440 - DNA, 20 bp, Artificial Sequence
  Description of Artificial Sequence: Synthetic oligonucleotide
  Target: SCN9A; (-) strand; PAM type: NRG; PAM sequence: GAG
agtgctgggattataggcgt

SEQ ID NO: 36441 - DNA, 20 bp, Artificial Sequence
  Description of Artificial Sequence: Synthetic oligonucleotide
  Target: SCN9A; (-) strand; PAM type: NRG; PAM sequence: AGG
ccccaaagtgctgggattat

SEQ ID NO: 36442 - DNA, 20 bp, Artificial Sequence
  Description of Artificial Sequence: Synthetic oligonucleotide
  Target: SCN9A; (-) strand; PAM type: NRG; PAM sequence: TAG
cccccaaagtgctgggatta

SEQ ID NO: 36443 - DNA, 20 bp, Artificial Sequence
  Description of Artificial Sequence: Synthetic oligonucleotide
  Target: SCN9A; (-) strand; PAM type: NRG; PAM sequence: GGG
cctaggccccccaaagtgct

SEQ ID NO: 36444 - DNA, 20 bp, Artificial Sequence
  Description of Artificial Sequence: Synthetic oligonucleotide
  Target: SCN9A; (-) strand; PAM type: NRG; PAM sequence: TGG
gcctaggccccccaaagtgc

SEQ ID NO: 36445 - DNA, 20 bp, Artificial Sequence
  Description of Artificial Sequence: Synthetic oligonucleotide
  Target: SCN9A; (-) strand; PAM type: NRG; PAM sequence: AAG
ctgcccgcctaggcccccca

SEQ ID NO: 36446 - DNA, 20 bp, Artificial Sequence
  Description of Artificial Sequence: Synthetic oligonucleotide
  Target: SCN9A; (-) strand; PAM type: NRG; PAM sequence: AGG
ttcaggtgatctgcccgcct

SEQ ID NO: 36447 - DNA, 20 bp, Artificial Sequence
  Description of Artificial Sequence: Synthetic oligonucleotide
  Target: SCN9A; (-) strand; PAM type: NRG; PAM sequence: TAG
gttcaggtgatctgcccgcc

SEQ ID NO: 36448 - DNA, 20 bp, Artificial Sequence
  Description of Artificial Sequence: Synthetic oligonucleotide
  Target: SCN9A; (-) strand; PAM type: NRG; PAM sequence: AGG
ggtcttgaactcctgagttc

SEQ ID NO: 36449 - DNA, 20 bp, Artificial Sequence
  Description of Artificial Sequence: Synthetic oligonucleotide
  Target: SCN9A; (-) strand; PAM type: NRG; PAM sequence: CAG
tggtcttgaactcctgagtt

SEQ ID NO: 36450 - DNA, 20 bp, Artificial Sequence
  Description of Artificial Sequence: Synthetic oligonucleotide
  Target: SCN9A; (-) strand; PAM type: NRG; PAM sequence: GAG
caggctggtcttgaactcct

SEQ ID NO: 36451 - DNA, 20 bp, Artificial Sequence
  Description of Artificial Sequence: Synthetic oligonucleotide
  Target: SCN9A; (-) strand; PAM type: NRG; PAM sequence: TGG
tttcaccaggttgggcaggc

SEQ ID NO: 36452 - DNA, 20 bp, Artificial Sequence
  Description of Artificial Sequence: Synthetic oligonucleotide
  Target: SCN9A; (-) strand; PAM type: NRG; PAM sequence: AGG
aggatttcaccaggttgggc

SEQ ID NO: 36453 - DNA, 20 bp, Artificial Sequence
  Description of Artificial Sequence: Synthetic oligonucleotide
  Target: SCN9A; (-) strand; PAM type: NRG; PAM sequence: CAG
taggatttcaccaggttggg

SEQ ID NO: 36454 - DNA, 20 bp, Artificial Sequence
  Description of Artificial Sequence: Synthetic oligonucleotide
  Target: SCN9A; (-) strand; PAM type: NRG; PAM sequence: GGG
agataggatttcaccaggtt

SEQ ID NO: 36455 - DNA, 20 bp, Artificial Sequence
  Description of Artificial Sequence: Synthetic oligonucleotide
  Target: SCN9A; (-) strand; PAM type: NRG; PAM sequence: TGG
gagataggatttcaccaggt

SEQ ID NO: 36456 - DNA, 20 bp, Artificial Sequence
  Description of Artificial Sequence: Synthetic oligonucleotide
  Target: SCN9A; (-) strand; PAM type: NRG; PAM sequence: AGG
agtagagataggatttcacc

SEQ ID NO: 36457 - DNA, 20 bp, Artificial Sequence
  Description of Artificial Sequence: Synthetic oligonucleotide
  Target: SCN9A; (-) strand; PAM type: NRG; PAM sequence: CAG
tagtagagataggatttcac

SEQ ID NO: 36458 - DNA, 20 bp, Artificial Sequence
  Description of Artificial Sequence: Synthetic oligonucleotide
  Target: SCN9A; (-) strand; PAM type: NRG; PAM sequence: AGG
tttgtatttttagtagagat

SEQ ID NO: 36459 - DNA, 20 bp, Artificial Sequence
  Description of Artificial Sequence: Synthetic oligonucleotide
  Target: SCN9A; (-) strand; PAM type: NRG; PAM sequence: TAG
ttttgtatttttagtagaga

SEQ ID NO: 36460 - DNA, 20 bp, Artificial Sequence
  Description of Artificial Sequence: Synthetic oligonucleotide
  Target: SCN9A; (-) strand; PAM type: NRG; PAM sequence: GAG
ctaattttgtatttttagta

SEQ ID NO: 36461 - DNA, 20 bp, Artificial Sequence
  Description of Artificial Sequence: Synthetic oligonucleotide
  Target: SCN9A; (-) strand; PAM type: NRG; PAM sequence: TAG
ggctaattttgtatttttag

SEQ ID NO: 36462 - DNA, 20 bp, Artificial Sequence
  Description of Artificial Sequence: Synthetic oligonucleotide
  Target: SCN9A; (-) strand; PAM type: NRG; PAM sequence: TAG
cctggctaattttgtatttt

SEQ ID NO: 36463 - DNA, 20 bp, Artificial Sequence
  Description of Artificial Sequence: Synthetic oligonucleotide
  Target: SCN9A; (-) strand; PAM type: NRG; PAM sequence: TGG
caggcatgagccacctcgcc

SEQ ID NO: 36464 - DNA, 20 bp, Artificial Sequence
  Description of Artificial Sequence: Synthetic oligonucleotide
  Target: SCN9A; (-) strand; PAM type: NRG; PAM sequence: GAG
gtagccgggattacaggcat

SEQ ID NO: 36465 - DNA, 20 bp, Artificial Sequence
  Description of Artificial Sequence: Synthetic oligonucleotide
  Target: SCN9A; (-) strand; PAM type: NRG; PAM sequence: AGG
tcccgagtagccgggattac

SEQ ID NO: 36466 - DNA, 20 bp, Artificial Sequence
  Description of Artificial Sequence: Synthetic oligonucleotide
  Target: SCN9A; (-) strand; PAM type: NRG; PAM sequence: CAG
ctcccgagtagccgggatta

SEQ ID NO: 36467 - DNA, 20 bp, Artificial Sequence
  Description of Artificial Sequence: Synthetic oligonucleotide
  Target: SCN9A; (-) strand; PAM type: NRG; PAM sequence: GGG
cctcagcctcccgagtagcc

SEQ ID NO: 36468 - DNA, 20 bp, Artificial Sequence
  Description of Artificial Sequence: Synthetic oligonucleotide
  Target: SCN9A; (-) strand; PAM type: NRG; PAM sequence: CGG
gcctcagcctcccgagtagc

SEQ ID NO: 36469 - DNA, 20 bp, Artificial Sequence
  Description of Artificial Sequence: Synthetic oligonucleotide
  Target: SCN9A; (-) strand; PAM type: NRG; PAM sequence: TAG
tcctgcctcagcctcccgag

SEQ ID NO: 36470 - DNA, 20 bp, Artificial Sequence
  Description of Artificial Sequence: Synthetic oligonucleotide
  Target: SCN9A; (-) strand; PAM type: NRG; PAM sequence: GAG
ttctcctgcctcagcctccc

SEQ ID NO: 36471 - DNA, 20 bp, Artificial Sequence
  Description of Artificial Sequence: Synthetic oligonucleotide
  Target: SCN9A; (-) strand; PAM type: NRG; PAM sequence: CAG
ttcaagcaattctcctgcct

SEQ ID NO: 36472 - DNA, 20 bp, Artificial Sequence
  Description of Artificial Sequence: Synthetic oligonucleotide
  Target: SCN9A; (-) strand; PAM type: NRG; PAM sequence: AAG
aacttccgcctcccaggttc

SEQ ID NO: 36473 - DNA, 20 bp, Artificial Sequence
  Description of Artificial Sequence: Synthetic oligonucleotide
  Target: SCN9A; (-) strand; PAM type: NRG; PAM sequence: AGG
cactgcaacttccgcctccc

SEQ ID NO: 36474 - DNA, 20 bp, Artificial Sequence
  Description of Artificial Sequence: Synthetic oligonucleotide
  Target: SCN9A; (-) strand; PAM type: NRG; PAM sequence: CAG
tcactgcaacttccgcctcc

SEQ ID NO: 36475 - DNA, 20 bp, Artificial Sequence
  Description of Artificial Sequence: Synthetic oligonucleotide
  Target: SCN9A; (-) strand; PAM type: NRG; PAM sequence: TGG
ggagtgcaatggtacgatct

SEQ ID NO: 36476 - DNA, 20 bp, Artificial Sequence
  Description of Artificial Sequence: Synthetic oligonucleotide
  Target: SCN9A; (-) strand; PAM type: NRG; PAM sequence: TGG
ttgcccaggctggagtgcaa

SEQ ID NO: 36477 - DNA, 20 bp, Artificial Sequence
  Description of Artificial Sequence: Synthetic oligonucleotide
  Target: SCN9A; (-) strand; PAM type: NRG; PAM sequence: GAG
cactcttgttgcccaggctg

SEQ ID NO: 36478 - DNA, 20 bp, Artificial Sequence
  Description of Artificial Sequence: Synthetic oligonucleotide
  Target: SCN9A; (-) strand; PAM type: NRG; PAM sequence: TGG
ttcactcttgttgcccaggc

SEQ ID NO: 36479 - DNA, 20 bp, Artificial Sequence
  Description of Artificial Sequence: Synthetic oligonucleotide
  Target: SCN9A; (-) strand; PAM type: NRG; PAM sequence: AGG
gagtttcactcttgttgccc

SEQ ID NO: 36480 - DNA, 20 bp, Artificial Sequence
  Description of Artificial Sequence: Synthetic oligonucleotide
  Target: SCN9A; (-) strand; PAM type: NRG; PAM sequence: CAG
cgagtttcactcttgttgcc

SEQ ID NO: 36481 - DNA, 20 bp, Artificial Sequence
  Description of Artificial Sequence: Synthetic oligonucleotide
  Target: SCN9A; (-) strand; PAM type: NRG; PAM sequence: GAG
ttttttttttttttgagacc

SEQ ID NO: 36482 - DNA, 20 bp, Artificial Sequence
  Description of Artificial Sequence: Synthetic oligonucleotide
  Target: SCN9A; (-) strand; PAM type: NRG; PAM sequence: GAG
gcattctttttttttttttt

SEQ ID NO: 36483 - DNA, 20 bp, Artificial Sequence
  Description of Artificial Sequence: Synthetic oligonucleotide
  Target: SCN9A; (-) strand; PAM type: NRG; PAM sequence: TAG
tatctaggcatttaataact

SEQ ID NO: 36484 - DNA, 20 bp, Artificial Sequence
  Description of Artificial Sequence: Synthetic oligonucleotide
  Target: SCN9A; (-) strand; PAM type: NRG; PAM sequence: AGG
gatgttcaataatggtatct

SEQ ID NO: 36485 - DNA, 20 bp, Artificial Sequence
  Description of Artificial Sequence: Synthetic oligonucleotide
  Target: SCN9A; (-) strand; PAM type: NRG; PAM sequence: TAG
agatgttcaataatggtatc

SEQ ID NO: 36486 - DNA, 20 bp, Artificial Sequence
  Description of Artificial Sequence: Synthetic oligonucleotide
  Target: SCN9A; (-) strand; PAM type: NRG; PAM sequence: TGG
tatgagtagatgttcaataa

SEQ ID NO: 36487 - DNA, 20 bp, Artificial Sequence
  Description of Artificial Sequence: Synthetic oligonucleotide
  Target: SCN9A; (-) strand; PAM type: NRG; PAM sequence: TAG
acatgataagtagatatgag

SEQ ID NO: 36488 - DNA, 20 bp, Artificial Sequence
  Description of Artificial Sequence: Synthetic oligonucleotide
  Target: SCN9A; (-) strand; PAM type: NRG; PAM sequence: GAG
tacacatgataagtagatat

SEQ ID NO: 36489 - DNA, 20 bp, Artificial Sequence
  Description of Artificial Sequence: Synthetic oligonucleotide
  Target: SCN9A; (-) strand; PAM type: NRG; PAM sequence: TAG
agtgtcttacacatgataag

SEQ ID NO: 36490 - DNA, 20 bp, Artificial Sequence
  Description of Artificial Sequence: Synthetic oligonucleotide
  Target: SCN9A; (-) strand; PAM type: NRG; PAM sequence: AAG
tttagtgtcttacacatgat

SEQ ID NO: 36491 - DNA, 20 bp, Artificial Sequence
  Description of Artificial Sequence: Synthetic oligonucleotide
  Target: SCN9A; (-) strand; PAM type: NRG; PAM sequence: TAG
tttttccaaaacagccactt

SEQ ID NO: 36492 - DNA, 20 bp, Artificial Sequence
  Description of Artificial Sequence: Synthetic oligonucleotide
  Target: SCN9A; (-) strand; PAM type: NRG; PAM sequence: CAG
gtaatttgttttttccaaaa

SEQ ID NO: 36493 - DNA, 20 bp, Artificial Sequence
  Description of Artificial Sequence: Synthetic oligonucleotide
  Target: SCN9A; (-) strand; PAM type: NRG; PAM sequence: GAG
tagagtatattatatattag

SEQ ID NO: 36494 - DNA, 20 bp, Artificial Sequence
  Description of Artificial Sequence: Synthetic oligonucleotide
  Target: SCN9A; (-) strand; PAM type: NRG; PAM sequence: AGG
tatagagtatattatatatt

SEQ ID NO: 36495 - DNA, 20 bp, Artificial Sequence
  Description of Artificial Sequence: Synthetic oligonucleotide
  Target: SCN9A; (-) strand; PAM type: NRG; PAM sequence: TAG
atatagagtatattatatat

SEQ ID NO: 36496 - DNA, 20 bp, Artificial Sequence
  Description of Artificial Sequence: Synthetic oligonucleotide
  Target: SCN9A; (-) strand; PAM type: NRG; PAM sequence: GAG
tatattatatgttatatata

SEQ ID NO: 36497 - DNA, 20 bp, Artificial Sequence
  Description of Artificial Sequence: Synthetic oligonucleotide
  Target: SCN9A; (-) strand; PAM type: NRG; PAM sequence: TAG
actatattatatgttatata

SEQ ID NO: 36498 - DNA, 20 bp, Artificial Sequence
  Description of Artificial Sequence: Synthetic oligonucleotide
  Target: SCN9A; (-) strand; PAM type: NRG; PAM sequence: AGG
attagtagtatttacttcta

SEQ ID NO: 36499 - DNA, 20 bp, Artificial Sequence
  Description of Artificial Sequence: Synthetic oligonucleotide
  Target: SCN9A; (-) strand; PAM type: NRG; PAM sequence: AAG
aattagtagtatttacttct

SEQ ID NO: 36500 - DNA, 20 bp, Artificial Sequence
  Description of Artificial Sequence: Synthetic oligonucleotide
  Target: SCN9A; (-) strand; PAM type: NRG; PAM sequence: TAG
attgctttcctgtaaattag

SEQ ID NO: 36501 - DNA, 20 bp, Artificial Sequence
  Description of Artificial Sequence: Synthetic oligonucleotide
  Target: SCN9A; (-) strand; PAM type: NRG; PAM sequence: TAG
aatattgctttcctgtaaat

SEQ ID NO: 36502 - DNA, 20 bp, Artificial Sequence
  Description of Artificial Sequence: Synthetic oligonucleotide
  Target: SCN9A; (-) strand; PAM type: NRG; PAM sequence: TAG
ctttactcagtatgtggtct

SEQ ID NO: 36503 - DNA, 20 bp, Artificial Sequence
  Description of Artificial Sequence: Synthetic oligonucleotide
  Target: SCN9A; (-) strand; PAM type: NRG; PAM sequence: TGG
tatttcctttactcagtatg

SEQ ID NO: 36504 - DNA, 20 bp, Artificial Sequence
  Description of Artificial Sequence: Synthetic oligonucleotide
  Target: SCN9A; (-) strand; PAM type: NRG; PAM sequence: CAG
tcccaaatatttcctttact

SEQ ID NO: 36505 - DNA, 20 bp, Artificial Sequence
  Description of Artificial Sequence: Synthetic oligonucleotide
  Target: SCN9A; (-) strand; PAM type: NRG; PAM sequence: AAG
caaattagtatagtgaaagg

SEQ ID NO: 36506 - DNA, 20 bp, Artificial Sequence
  Description of Artificial Sequence: Synthetic oligonucleotide
  Target: SCN9A; (-) strand; PAM type: NRG; PAM sequence: AGG
gttcaaattagtatagtgaa

SEQ ID NO: 36507 - DNA, 20 bp, Artificial Sequence
  Description of Artificial Sequence: Synthetic oligonucleotide
  Target: SCN9A; (-) strand; PAM type: NRG; PAM sequence: AAG
agttcaaattagtatagtga

SEQ ID NO: 36508 - DNA, 20 bp, Artificial Sequence
  Description of Artificial Sequence: Synthetic oligonucleotide
  Target: SCN9A; (-) strand; PAM type: NRG; PAM sequence: TAG
aatttgagttcaaattagta

SEQ ID NO: 36509 - DNA, 20 bp, Artificial Sequence
  Description of Artificial Sequence: Synthetic oligonucleotide
  Target: SCN9A; (-) strand; PAM type: NRG; PAM sequence: TAG
aaataaatttgagttcaaat

SEQ ID NO: 36510 - DNA, 20 bp, Artificial Sequence
  Description of Artificial Sequence: Synthetic oligonucleotide
  Target: SCN9A; (-) strand; PAM type: NRG; PAM sequence: GAG
aagcacagataaataaattt

SEQ ID NO: 36511 - DNA, 20 bp, Artificial Sequence
  Description of Artificial Sequence: Synthetic oligonucleotide
  Target: SCN9A; (-) strand; PAM type: NRG; PAM sequence: CAG
tttataaagtgttaaaagca

SEQ ID NO: 36512 - DNA, 20 bp, Artificial Sequence
  Description of Artificial Sequence: Synthetic oligonucleotide
  Target: SCN9A; (-) strand; PAM type: NRG; PAM sequence: AAG
atatttttataaagtgttaa

SEQ ID NO: 36513 - DNA, 20 bp, Artificial Sequence
  Description of Artificial Sequence: Synthetic oligonucleotide
  Target: SCN9A; (-) strand; PAM type: NRG; PAM sequence: AAG
gactgtaaaatatttttata

SEQ ID NO: 36514 - DNA, 20 bp, Artificial Sequence
  Description of Artificial Sequence: Synthetic oligonucleotide
  Target: SCN9A; (-) strand; PAM type: NRG; PAM sequence: CAG
attacatctctactatattt

SEQ ID NO: 36515 - DNA, 20 bp, Artificial Sequence
  Description of Artificial Sequence: Synthetic oligonucleotide
  Target: SCN9A; (-) strand; PAM type: NRG; PAM sequence: AAG
tgtagaacagctaggcagag

SEQ ID NO: 36516 - DNA, 20 bp, Artificial Sequence
  Description of Artificial Sequence: Synthetic oligonucleotide
  Target: SCN9A; (-) strand; PAM type: NRG; PAM sequence: GAG
acttgtagaacagctaggca

SEQ ID NO: 36517 - DNA, 20 bp, Artificial Sequence
  Description of Artificial Sequence: Synthetic oligonucleotide
  Target: SCN9A; (-) strand; PAM type: NRG; PAM sequence: CAG
acacttgtagaacagctagg

SEQ ID NO: 36518 - DNA, 20 bp, Artificial Sequence
  Description of Artificial Sequence: Synthetic oligonucleotide
  Target: SCN9A; (-) strand; PAM type: NRG; PAM sequence: AGG
tgaacacttgtagaacagct

SEQ ID NO: 36519 - DNA, 20 bp, Artificial Sequence
  Description of Artificial Sequence: Synthetic oligonucleotide
  Target: SCN9A; (-) strand; PAM type: NRG; PAM sequence: TAG
atgaacacttgtagaacagc

SEQ ID NO: 36520 - DNA, 20 bp, Artificial Sequence
  Description of Artificial Sequence: Synthetic oligonucleotide
  Target: SCN9A; (-) strand; PAM type: NRG; PAM sequence: CAG
aggaatgaacacttgtagaa

SEQ ID NO: 36521 - DNA, 20 bp, Artificial Sequence
  Description of Artificial Sequence: Synthetic oligonucleotide
  Target: SCN9A; (-) strand; PAM type: NRG; PAM sequence: TAG
cttttaggaatgaacacttg

SEQ ID NO: 36522 - DNA, 20 bp, Artificial Sequence
  Description of Artificial Sequence: Synthetic oligonucleotide
  Target: SCN9A; (-) strand; PAM type: NRG; PAM sequence: AGG
agatcagctgacagactttt

SEQ ID NO: 36523 - DNA, 20 bp, Artificial Sequence
  Description of Artificial Sequence: Synthetic oligonucleotide
  Target: SCN9A; (-) strand; PAM type: NRG; PAM sequence: TAG
gagatcagctgacagacttt

SEQ ID NO: 36524 - DNA, 20 bp, Artificial Sequence
  Description of Artificial Sequence: Synthetic oligonucleotide
  Target: SCN9A; (-) strand; PAM type: NRG; PAM sequence: CAG
aatcccatgagatcagctga

SEQ ID NO: 36525 - DNA, 20 bp, Artificial Sequence
  Description of Artificial Sequence: Synthetic oligonucleotide
  Target: SCN9A; (-) strand; PAM type: NRG; PAM sequence: CAG
ttcttataatcccatgagat

SEQ ID NO: 36526 - DNA, 20 bp, Artificial Sequence
  Description of Artificial Sequence: Synthetic oligonucleotide
  Target: SCN9A; (-) strand; PAM type: NRG; PAM sequence: GAG
taaggttcttataatcccat

SEQ ID NO: 36527 - DNA, 20 bp, Artificial Sequence
  Description of Artificial Sequence: Synthetic oligonucleotide
  Target: SCN9A; (-) strand; PAM type: NRG; PAM sequence: AGG
tcagggatcaactgggaata

SEQ ID NO: 36528 - DNA, 20 bp, Artificial Sequence
  Description of Artificial Sequence: Synthetic oligonucleotide
  Target: SCN9A; (-) strand; PAM type: NRG; PAM sequence: AAG
ctcagggatcaactgggaat

SEQ ID NO: 36529 - DNA, 20 bp, Artificial Sequence
  Description of Artificial Sequence: Synthetic oligonucleotide
  Target: SCN9A; (-) strand; PAM type: NRG; PAM sequence: GGG
ggcctactcagggatcaact

SEQ ID NO: 36530 - DNA, 20 bp, Artificial Sequence
  Description of Artificial Sequence: Synthetic oligonucleotide
  Target: SCN9A; (-) strand; PAM type: NRG; PAM sequence: TGG
tggcctactcagggatcaac

SEQ ID NO: 36531 - DNA, 20 bp, Artificial Sequence
  Description of Artificial Sequence: Synthetic oligonucleotide
  Target: SCN9A; (-) strand; PAM type: NRG; PAM sequence: GGG
aaagggaagtggcctactca

SEQ ID NO: 36532 - DNA, 20 bp, Artificial Sequence
  Description of Artificial Sequence: Synthetic oligonucleotide
  Target: SCN9A; (-) strand; PAM type: NRG; PAM sequence: AGG
aaaagggaagtggcctactc

SEQ ID NO: 36533 - DNA, 20 bp, Artificial Sequence
  Description of Artificial Sequence: Synthetic oligonucleotide
  Target: SCN9A; (-) strand; PAM type: NRG; PAM sequence: CAG
aaaaagggaagtggcctact

SEQ ID NO: 36534 - DNA, 20 bp, Artificial Sequence
  Description of Artificial Sequence: Synthetic oligonucleotide
  Target: SCN9A; (-) strand; PAM type: NRG; PAM sequence: TGG
tcaggtaggaaaaagggaag

SEQ ID NO: 36535 - DNA, 20 bp, Artificial Sequence
  Description of Artificial Sequence: Synthetic oligonucleotide
  Target: SCN9A; (-) strand; PAM type: NRG; PAM sequence: AAG
aattcaggtaggaaaaaggg

SEQ ID NO: 36536 - DNA, 20 bp, Artificial Sequence
  Description of Artificial Sequence: Synthetic oligonucleotide
  Target: SCN9A; (-) strand; PAM type: NRG; PAM sequence: GGG
ggtaattcaggtaggaaaaa

SEQ ID NO: 36537 - DNA, 20 bp, Artificial Sequence
  Description of Artificial Sequence: Synthetic oligonucleotide
  Target: SCN9A; (-) strand; PAM type: NRG; PAM sequence: AGG
tggtaattcaggtaggaaaa

SEQ ID NO: 36538 - DNA, 20 bp, Artificial Sequence
  Description of Artificial Sequence: Synthetic oligonucleotide
  Target: SCN9A; (-) strand; PAM type: NRG; PAM sequence: AAG
atggtaattcaggtaggaaa

SEQ ID NO: 36539 - DNA, 20 bp, Artificial Sequence
  Description of Artificial Sequence: Synthetic oligonucleotide
  Target: SCN9A; (-) strand; PAM type: NRG; PAM sequence: AGG
tggctcatggtaattcaggt

SEQ ID NO: 36540 - DNA, 20 bp, Artificial Sequence
  Description of Artificial Sequence: Synthetic oligonucleotide
  Target: SCN9A; (-) strand; PAM type: NRG; PAM sequence: TAG
ttggctcatggtaattcagg

SEQ ID NO: 36541 - DNA, 20 bp, Artificial Sequence
  Description of Artificial Sequence: Synthetic oligonucleotide
  Target: SCN9A; (-) strand; PAM type: NRG; PAM sequence: AGG
aacttggctcatggtaattc

SEQ ID NO: 36542 - DNA, 20 bp, Artificial Sequence
  Description of Artificial Sequence: Synthetic oligonucleotide
  Target: SCN9A; (-) strand; PAM type: NRG; PAM sequence: CAG
aaacttggctcatggtaatt

SEQ ID NO: 36543 - DNA, 20 bp, Artificial Sequence
  Description of Artificial Sequence: Synthetic oligonucleotide
  Target: SCN9A; (-) strand; PAM type: NRG; PAM sequence: TGG
ccatttacaaacttggctca

SEQ ID NO: 36544 - DNA, 20 bp, Artificial Sequence
  Description of Artificial Sequence: Synthetic oligonucleotide
  Target: SCN9A; (-) strand; PAM type: NRG; PAM sequence: TGG
tgttaccccatttacaaact

SEQ ID NO: 36545 - DNA, 20 bp, Artificial Sequence
  Description of Artificial Sequence: Synthetic oligonucleotide
  Target: SCN9A; (-) strand; PAM type: NRG; PAM sequence: AAG
aacaaaatattataaagttg

SEQ ID NO: 36546 - DNA, 20 bp, Artificial Sequence
  Description of Artificial Sequence: Synthetic oligonucleotide
  Target: SCN9A; (-) strand; PAM type: NRG; PAM sequence: AAG
gcatggaacaaaatattata

SEQ ID NO: 36547 - DNA, 20 bp, Artificial Sequence
  Description of Artificial Sequence: Synthetic oligonucleotide
  Target: SCN9A; (-) strand; PAM type: NRG; PAM sequence: TGG
ctttgtaaatgatctttgca

SEQ ID NO: 36548 - DNA, 20 bp, Artificial Sequence
  Description of Artificial Sequence: Synthetic oligonucleotide
  Target: SCN9A; (-) strand; PAM type: NRG; PAM sequence: GGG
tccttctaggtaaatattat

SEQ ID NO: 36549 - DNA, 20 bp, Artificial Sequence
  Description of Artificial Sequence: Synthetic oligonucleotide
  Target: SCN9A; (-) strand; PAM type: NRG; PAM sequence: TGG
ttccttctaggtaaatatta

SEQ ID NO: 36550 - DNA, 20 bp, Artificial Sequence
  Description of Artificial Sequence: Synthetic oligonucleotide
  Target: SCN9A; (-) strand; PAM type: NRG; PAM sequence: AGG
ttatctgagtgattccttct

SEQ ID NO: 36551 - DNA, 20 bp, Artificial Sequence
  Description of Artificial Sequence: Synthetic oligonucleotide
  Target: SCN9A; (-) strand; PAM type: NRG; PAM sequence: TAG
tttatctgagtgattccttc

SEQ ID NO: 36552 - DNA, 20 bp, Artificial Sequence
  Description of Artificial Sequence: Synthetic oligonucleotide
  Target: SCN9A; (-) strand; PAM type: NRG; PAM sequence: GAG
ggtaagtgatgcctttatct

SEQ ID NO: 36553 - DNA, 20 bp, Artificial Sequence
  Description of Artificial Sequence: Synthetic oligonucleotide
  Target: SCN9A; (-) strand; PAM type: NRG; PAM sequence: AAG
gaattaaatgctttattggt

SEQ ID NO: 36554 - DNA, 20 bp, Artificial Sequence
  Description of Artificial Sequence: Synthetic oligonucleotide
  Target: SCN9A; (-) strand; PAM type: NRG; PAM sequence: TGG
ggatgaattaaatgctttat

SEQ ID NO: 36555 - DNA, 20 bp, Artificial Sequence
  Description of Artificial Sequence: Synthetic oligonucleotide
  Target: SCN9A; (-) strand; PAM type: NRG; PAM sequence: AGG
ttattgaggacattttgaat

SEQ ID NO: 36556 - DNA, 20 bp, Artificial Sequence
  Description of Artificial Sequence: Synthetic oligonucleotide
  Target: SCN9A; (-) strand; PAM type: NRG; PAM sequence: TAG
tttattgaggacattttgaa

SEQ ID NO: 36557 - DNA, 20 bp, Artificial Sequence
  Description of Artificial Sequence: Synthetic oligonucleotide
  Target: SCN9A; (-) strand; PAM type: NRG; PAM sequence: AGG
agagtaaagataatttattg

SEQ ID NO: 36558 - DNA, 20 bp, Artificial Sequence
  Description of Artificial Sequence: Synthetic oligonucleotide
  Target: SCN9A; (-) strand; PAM type: NRG; PAM sequence: GAG
cagagtaaagataatttatt

SEQ ID NO: 36559 - DNA, 20 bp, Artificial Sequence
  Description of Artificial Sequence: Synthetic oligonucleotide
  Target: SCN9A; (-) strand; PAM type: NRG; PAM sequence: AAG
atcttttagggctcagagta

SEQ ID NO: 36560 - DNA, 20 bp, Artificial Sequence
  Description of Artificial Sequence: Synthetic oligonucleotide
  Target: SCN9A; (-) strand; PAM type: NRG; PAM sequence: GAG
agtgtatcttttagggctca

SEQ ID NO: 36561 - DNA, 20 bp, Artificial Sequence
  Description of Artificial Sequence: Synthetic oligonucleotide
  Target: SCN9A; (-) strand; PAM type: NRG; PAM sequence: CAG
acagtgtatcttttagggct

SEQ ID NO: 36562 - DNA, 20 bp, Artificial Sequence
  Description of Artificial Sequence: Synthetic oligonucleotide
  Target: SCN9A; (-) strand; PAM type: NRG; PAM sequence: GGG
aatagacagtgtatctttta

SEQ ID NO: 36563 - DNA, 20 bp, Artificial Sequence
  Description of Artificial Sequence: Synthetic oligonucleotide
  Target: SCN9A; (-) strand; PAM type: NRG; PAM sequence: AGG
taatagacagtgtatctttt

SEQ ID NO: 36564 - DNA, 20 bp, Artificial Sequence
  Description of Artificial Sequence: Synthetic oligonucleotide
  Target: SCN9A; (-) strand; PAM type: NRG; PAM sequence: TAG
ctaatagacagtgtatcttt

SEQ ID NO: 36565 - DNA, 20 bp, Artificial Sequence
  Description of Artificial Sequence: Synthetic oligonucleotide
  Target: SCN9A; (-) strand; PAM type: NRG; PAM sequence: CAG
attctttcaagtctaataga

SEQ ID NO: 36566 - DNA, 20 bp, Artificial Sequence
  Description of Artificial Sequence: Synthetic oligonucleotide
  Target: SCN9A; (-) strand; PAM type: NRG; PAM sequence: TAG
gactattctttcaagtctaa

SEQ ID NO: 36567 - DNA, 20 bp, Artificial Sequence
  Description of Artificial Sequence: Synthetic oligonucleotide
  Target: SCN9A; (-) strand; PAM type: NRG; PAM sequence: AAG
tactaaatgactattctttc

SEQ ID NO: 36568 - DNA, 20 bp, Artificial Sequence
  Description of Artificial Sequence: Synthetic oligonucleotide
  Target: SCN9A; (-) strand; PAM type: NRG; PAM sequence: AAG
tatatttcatatattgattt

SEQ ID NO: 36569 - DNA, 20 bp, Artificial Sequence
  Description of Artificial Sequence: Synthetic oligonucleotide
  Target: SCN9A; (-) strand; PAM type: NRG; PAM sequence: AGG
agatcagcctgggcaataaa

SEQ ID NO: 36570 - DNA, 20 bp, Artificial Sequence
  Description of Artificial Sequence: Synthetic oligonucleotide
  Target: SCN9A; (-) strand; PAM type: NRG; PAM sequence: AAG
tagatcagcctgggcaataa

SEQ ID NO: 36571 - DNA, 20 bp, Artificial Sequence
  Description of Artificial Sequence: Synthetic oligonucleotide
  Target: SCN9A; (-) strand; PAM type: NRG; PAM sequence: GGG
caggagttctagatcagcct

SEQ ID NO: 36572 - DNA, 20 bp, Artificial Sequence
  Description of Artificial Sequence: Synthetic oligonucleotide
  Target: SCN9A; (-) strand; PAM type: NRG; PAM sequence: TGG
ccaggagttctagatcagcc

SEQ ID NO: 36573 - DNA, 20 bp, Artificial Sequence
  Description of Artificial Sequence: Synthetic oligonucleotide
  Target: SCN9A; (-) strand; PAM type: NRG; PAM sequence: CAG
ttgatccaggagttctagat

SEQ ID NO: 36574 - DNA, 20 bp, Artificial Sequence
  Description of Artificial Sequence: Synthetic oligonucleotide
  Target: SCN9A; (-) strand; PAM type: NRG; PAM sequence: TAG
attgcttgatccaggagttc

SEQ ID NO: 36575 - DNA, 20 bp, Artificial Sequence
  Description of Artificial Sequence: Synthetic oligonucleotide
  Target: SCN9A; (-) strand; PAM type: NRG; PAM sequence: GAG
tggaggattgcttgatccag

SEQ ID NO: 36576 - DNA, 20 bp, Artificial Sequence
  Description of Artificial Sequence: Synthetic oligonucleotide
  Target: SCN9A; (-) strand; PAM type: NRG; PAM sequence: AGG
gctggaggattgcttgatcc

SEQ ID NO: 36577 - DNA, 20 bp, Artificial Sequence
  Description of Artificial Sequence: Synthetic oligonucleotide
  Target: SCN9A; (-) strand; PAM type: NRG; PAM sequence: CAG
ggctggaggattgcttgatc

SEQ ID NO: 36578 - DNA, 20 bp, Artificial Sequence
  Description of Artificial Sequence: Synthetic oligonucleotide
  Target: SCN9A; (-) strand; PAM type: NRG; PAM sequence: AGG
ctttgggaggccgaggctgg

SEQ ID NO: 36579 - DNA, 20 bp, Artificial Sequence
  Description of Artificial Sequence: Synthetic oligonucleotide
  Target: SCN9A; (-) strand; PAM type: NRG; PAM sequence: GAG
actttgggaggccgaggctg

SEQ ID NO: 36580 - DNA, 20 bp, Artificial Sequence
  Description of Artificial Sequence: Synthetic oligonucleotide
  Target: SCN9A; (-) strand; PAM type: NRG; PAM sequence: TGG
tcactttgggaggccgaggc

SEQ ID NO: 36581 - DNA, 20 bp, Artificial Sequence
  Description of Artificial Sequence: Synthetic oligonucleotide
  Target: SCN9A; (-) strand; PAM type: NRG; PAM sequence: AGG
cccatcactttgggaggccg

SEQ ID NO: 36582 - DNA, 20 bp, Artificial Sequence
  Description of Artificial Sequence: Synthetic oligonucleotide
  Target: SCN9A; (-) strand; PAM type: NRG; PAM sequence: GAG
tcccatcactttgggaggcc

SEQ ID NO: 36583 - DNA, 20 bp, Artificial Sequence
  Description of Artificial Sequence: Synthetic oligonucleotide
  Target: SCN9A; (-) strand; PAM type: NRG; PAM sequence: AGG
tgcaatcccatcactttggg

SEQ ID NO: 36584 - DNA, 20 bp, Artificial Sequence
  Description of Artificial Sequence: Synthetic oligonucleotide
  Target: SCN9A; (-) strand; PAM type: NRG; PAM sequence: GAG
ctgcaatcccatcactttgg

SEQ ID NO: 36585 - DNA, 20 bp, Artificial Sequence
  Description of Artificial Sequence: Synthetic oligonucleotide
  Target: SCN9A; (-) strand; PAM type: NRG; PAM sequence: GGG
ccctgcaatcccatcacttt

SEQ ID NO: 36586 - DNA, 20 bp, Artificial Sequence
  Description of Artificial Sequence: Synthetic oligonucleotide
  Target: SCN9A; (-) strand; PAM type: NRG; PAM sequence: TGG
cccctgcaatcccatcactt

SEQ ID NO: 36587 - DNA, 20 bp, Artificial Sequence
  Description of Artificial Sequence: Synthetic oligonucleotide
  Target: SCN9A; (-) strand; PAM type: NRG; PAM sequence: TGG
aatattatgtcaggcacagc

SEQ ID NO: 36588 - DNA, 20 bp, Artificial Sequence
  Description of Artificial Sequence: Synthetic oligonucleotide
  Target: SCN9A; (-) strand; PAM type: NRG; PAM sequence: CAG
ataaaatattatgtcaggca

SEQ ID NO: 36589 - DNA, 20 bp, Artificial Sequence
  Description of Artificial Sequence: Synthetic oligonucleotide
  Target: SCN9A; (-) strand; PAM type: NRG; PAM sequence: AGG
tgataataaaatattatgtc

SEQ ID NO: 36590 - DNA, 20 bp, Artificial Sequence
  Description of Artificial Sequence: Synthetic oligonucleotide
  Target: SCN9A; (-) strand; PAM type: NRG; PAM sequence: CAG
atgataataaaatattatgt

SEQ ID NO: 36591 - DNA, 20 bp, Artificial Sequence
  Description of Artificial Sequence: Synthetic oligonucleotide
  Target: SCN9A; (-) strand; PAM type: NRG; PAM sequence: GAG
tgagtaaaacagggaaaaat

SEQ ID NO: 36592 - DNA, 20 bp, Artificial Sequence
  Description of Artificial Sequence: Synthetic oligonucleotide
  Target: SCN9A; (-) strand; PAM type: NRG; PAM sequence: GGG
ccatgcagatgagtaaaaca

SEQ ID NO: 36593 - DNA, 20 bp, Artificial Sequence
  Description of Artificial Sequence: Synthetic oligonucleotide
  Target: SCN9A; (-) strand; PAM type: NRG; PAM sequence: AGG
tccatgcagatgagtaaaac

SEQ ID NO: 36594 - DNA, 20 bp, Artificial Sequence
  Description of Artificial Sequence: Synthetic oligonucleotide
  Target: SCN9A; (-) strand; PAM type: NRG; PAM sequence: CAG
atccatgcagatgagtaaaa

SEQ ID NO: 36595 - DNA, 20 bp, Artificial Sequence
  Description of Artificial Sequence: Synthetic oligonucleotide
  Target: SCN9A; (-) strand; PAM type: NRG; PAM sequence: GAG
atattcaaatccatgcagat

SEQ ID NO: 36596 - DNA, 20 bp, Artificial Sequence
  Description of Artificial Sequence: Synthetic oligonucleotide
  Target: SCN9A; (-) strand; PAM type: NRG; PAM sequence: CAG
tgtagatattcaaatccatg

SEQ ID NO: 36597 - DNA, 20 bp, Artificial Sequence
  Description of Artificial Sequence: Synthetic oligonucleotide
  Target: SCN9A; (-) strand; PAM type: NRG; PAM sequence: TAG
tttgaaaaaagaagtaaatg

SEQ ID NO: 36598 - DNA, 20 bp, Artificial Sequence
  Description of Artificial Sequence: Synthetic oligonucleotide
  Target: SCN9A; (-) strand; PAM type: NRG; PAM sequence: AAG
actttagaatttgaaaaaag

SEQ ID NO: 36599 - DNA, 20 bp, Artificial Sequence
  Description of Artificial Sequence: Synthetic oligonucleotide
  Target: SCN9A; (-) strand; PAM type: NRG; PAM sequence: AAG
tatactttagaatttgaaaa

SEQ ID NO: 36600 - DNA, 20 bp, Artificial Sequence
  Description of Artificial Sequence: Synthetic oligonucleotide
  Target: SCN9A; (-) strand; PAM type: NRG; PAM sequence: TAG
cttcttgagagtctatactt

SEQ ID NO: 36601 - DNA, 20 bp, Artificial Sequence
  Description of Artificial Sequence: Synthetic oligonucleotide
  Target: SCN9A; (-) strand; PAM type: NRG; PAM sequence: GAG
aaaatatgtcatcttcttga

SEQ ID NO: 36602 - DNA, 20 bp, Artificial Sequence
  Description of Artificial Sequence: Synthetic oligonucleotide
  Target: SCN9A; (-) strand; PAM type: NRG; PAM sequence: GAG
taaaaatatgtcatcttctt

SEQ ID NO: 36603 - DNA, 20 bp, Artificial Sequence
  Description of Artificial Sequence: Synthetic oligonucleotide
  Target: SCN9A; (-) strand; PAM type: NRG; PAM sequence: TAG
tggtatctgtcaacttttac

SEQ ID NO: 36604 - DNA, 20 bp, Artificial Sequence
  Description of Artificial Sequence: Synthetic oligonucleotide
  Target: SCN9A; (-) strand; PAM type: NRG; PAM sequence: TGG
gggggtaatttcactggatg

SEQ ID NO: 36605 - DNA, 20 bp, Artificial Sequence
  Description of Artificial Sequence: Synthetic oligonucleotide
  Target: SCN9A; (-) strand; PAM type: NRG; PAM sequence: TGG
ttaactgggggtaatttcac

SEQ ID NO: 36606 - DNA, 20 bp, Artificial Sequence
  Description of Artificial Sequence: Synthetic oligonucleotide
  Target: SCN9A; (-) strand; PAM type: NRG; PAM sequence: GGG
attattattattttaactgg

SEQ ID NO: 36607 - DNA, 20 bp, Artificial Sequence
  Description of Artificial Sequence: Synthetic oligonucleotide
  Target: SCN9A; (-) strand; PAM type: NRG; PAM sequence: GGG
tattattattattttaactg

SEQ ID NO: 36608 - DNA, 20 bp, Artificial Sequence
  Description of Artificial Sequence: Synthetic oligonucleotide
  Target: SCN9A; (-) strand; PAM type: NRG; PAM sequence: GGG
ttattattattattttaact

SEQ ID NO: 36609 - DNA, 20 bp, Artificial Sequence
  Description of Artificial Sequence: Synthetic oligonucleotide
  Target: SCN9A; (-) strand; PAM type: NRG; PAM sequence: TGG
attattattattattttaac

SEQ ID NO: 36610 - DNA, 20 bp, Artificial Sequence
  Description of Artificial Sequence: Synthetic oligonucleotide
  Target: SCN9A; (-) strand; PAM type: NRG; PAM sequence: CAG
caagcatgagccaccgcgct

SEQ ID NO: 36611 - DNA, 20 bp, Artificial Sequence
  Description of Artificial Sequence: Synthetic oligonucleotide
  Target: SCN9A; (-) strand; PAM type: NRG; PAM sequence: GAG
agtgctgggattacaagcat

SEQ ID NO: 36612 - DNA, 20 bp, Artificial Sequence
  Description of Artificial Sequence: Synthetic oligonucleotide
  Target: SCN9A; (-) strand; PAM type: NRG; PAM sequence: AAG
tcccaaagtgctgggattac

SEQ ID NO: 36613 - DNA, 20 bp, Artificial Sequence
  Description of Artificial Sequence: Synthetic oligonucleotide
  Target: SCN9A; (-) strand; PAM type: NRG; PAM sequence: GGG
cctcgacctcccaaagtgct

SEQ ID NO: 36614 - DNA, 20 bp, Artificial Sequence
  Description of Artificial Sequence: Synthetic oligonucleotide
  Target: SCN9A; (-) strand; PAM type: NRG; PAM sequence: TGG
gcctcgacctcccaaagtgc

SEQ ID NO: 36615 - DNA, 20 bp, Artificial Sequence
  Description of Artificial Sequence: Synthetic oligonucleotide
  Target: SCN9A; (-) strand; PAM type: NRG; PAM sequence: AAG
ccgcccgcctcgacctccca

SEQ ID NO: 36616 - DNA, 20 bp, Artificial Sequence
  Description of Artificial Sequence: Synthetic oligonucleotide
  Target: SCN9A; (-) strand; PAM type: NRG; PAM sequence: TAG
atggtctcaatctcctgacc

SEQ ID NO: 36617 - DNA, 20 bp, Artificial Sequence
  Description of Artificial Sequence: Synthetic oligonucleotide
  Target: SCN9A; (-) strand; PAM type: NRG; PAM sequence: TGG
tttcaccatgttagccagga

SEQ ID NO: 36618 - DNA, 20 bp, Artificial Sequence
  Description of Artificial Sequence: Synthetic oligonucleotide
  Target: SCN9A; (-) strand; PAM type: NRG; PAM sequence: AGG
ggagtttcaccatgttagcc

SEQ ID NO: 36619 - DNA, 20 bp, Artificial Sequence
  Description of Artificial Sequence: Synthetic oligonucleotide
  Target: SCN9A; (-) strand; PAM type: NRG; PAM sequence: CAG
cggagtttcaccatgttagc

SEQ ID NO: 36620 - DNA, 20 bp, Artificial Sequence
  Description of Artificial Sequence: Synthetic oligonucleotide
  Target: SCN9A; (-) strand; PAM type: NRG; PAM sequence: TAG
gagacggagtttcaccatgt

SEQ ID NO: 36621 - DNA, 20 bp, Artificial Sequence
  Description of Artificial Sequence: Synthetic oligonucleotide
  Target: SCN9A; (-) strand; PAM type: NRG; PAM sequence: GAG
ttgtatttttagtagagacg

SEQ ID NO: 36622 - DNA, 20 bp, Artificial Sequence
  Description of Artificial Sequence: Synthetic oligonucleotide
  Target: SCN9A; (-) strand; PAM type: NRG; PAM sequence: CGG
ttttgtatttttagtagaga

SEQ ID NO: 36623 - DNA, 20 bp, Artificial Sequence
  Description of Artificial Sequence: Synthetic oligonucleotide
  Target: SCN9A; (-) strand; PAM type: NRG; PAM sequence: GAG
atgtttttgtatttttagta

SEQ ID NO: 36624 - DNA, 20 bp, Artificial Sequence
  Description of Artificial Sequence: Synthetic oligonucleotide
  Target: SCN9A; (-) strand; PAM type: NRG; PAM sequence: TAG
taatgtttttgtatttttag

SEQ ID NO: 36625 - DNA, 20 bp, Artificial Sequence
  Description of Artificial Sequence: Synthetic oligonucleotide
  Target: SCN9A; (-) strand; PAM type: NRG; PAM sequence: TAG
ggctaatgtttttgtatttt

SEQ ID NO: 36626 - DNA, 20 bp, Artificial Sequence
  Description of Artificial Sequence: Synthetic oligonucleotide
  Target: SCN9A; (-) strand; PAM type: NRG; PAM sequence: CGG
caggcgcctaccaccgtgcc

SEQ ID NO: 36627 - DNA, 20 bp, Artificial Sequence
  Description of Artificial Sequence: Synthetic oligonucleotide
  Target: SCN9A; (-) strand; PAM type: NRG; PAM sequence: AGG
ctccgagtagctgggactac

SEQ ID NO: 36628 - DNA, 20 bp, Artificial Sequence
  Description of Artificial Sequence: Synthetic oligonucleotide
  Target: SCN9A; (-) strand; PAM type: NRG; PAM sequence: CAG
cctccgagtagctgggacta

SEQ ID NO: 36629 - DNA, 20 bp, Artificial Sequence
  Description of Artificial Sequence: Synthetic oligonucleotide
  Target: SCN9A; (-) strand; PAM type: NRG; PAM sequence: GGG
gcctcagcctccgagtagct

SEQ ID NO: 36630 - DNA, 20 bp, Artificial Sequence
  Description of Artificial Sequence: Synthetic oligonucleotide
  Target: SCN9A; (-) strand; PAM type: NRG; PAM sequence: TGG
tgcctcagcctccgagtagc

SEQ ID NO: 36631 - DNA, 20 bp, Artificial Sequence
  Description of Artificial Sequence: Synthetic oligonucleotide
  Target: SCN9A; (-) strand; PAM type: NRG; PAM sequence: TAG
ctcctgcctcagcctccgag

SEQ ID NO: 36632 - DNA, 20 bp, Artificial Sequence
  Description of Artificial Sequence: Synthetic oligonucleotide
  Target: SCN9A; (-) strand; PAM type: NRG; PAM sequence: GAG
attctcctgcctcagcctcc

SEQ ID NO: 36633 - DNA, 20 bp, Artificial Sequence
  Description of Artificial Sequence: Synthetic oligonucleotide
  Target: SCN9A; (-) strand; PAM type: NRG; PAM sequence: CAG
ttcacaccattctcctgcct

SEQ ID NO: 36634 - DNA, 20 bp, Artificial Sequence
  Description of Artificial Sequence: Synthetic oligonucleotide
  Target: SCN9A; (-) strand; PAM type: NRG; PAM sequence: GGG
cactgcaagctccgcgtcct

SEQ ID NO: 36635 - DNA, 20 bp, Artificial Sequence
  Description of Artificial Sequence: Synthetic oligonucleotide
  Target: SCN9A; (-) strand; PAM type: NRG; PAM sequence: TGG
tcactgcaagctccgcgtcc

SEQ ID NO: 36636 - DNA, 20 bp, Artificial Sequence
  Description of Artificial Sequence: Synthetic oligonucleotide
  Target: SCN9A; (-) strand; PAM type: NRG; PAM sequence: AAG
gcgcgatcttggctcactgc

SEQ ID NO: 36637 - DNA, 20 bp, Artificial Sequence
  Description of Artificial Sequence: Synthetic oligonucleotide
  Target: SCN9A; (-) strand; PAM type: NRG; PAM sequence: TGG
ggagtgcagtggcgcgatct

SEQ ID NO: 36638 - DNA, 20 bp, Artificial Sequence
  Description of Artificial Sequence: Synthetic oligonucleotide
  Target: SCN9A; (-) strand; PAM type: NRG; PAM sequence: TGG
tcgcccaggctggagtgcag

SEQ ID NO: 36639 - DNA, 20 bp, Artificial Sequence
  Description of Artificial Sequence: Synthetic oligonucleotide
  Target: SCN9A; (-) strand; PAM type: NRG; PAM sequence: CAG
ctgtcgcccaggctggagtg

SEQ ID NO: 36640 - DNA, 20 bp, Artificial Sequence
  Description of Artificial Sequence: Synthetic oligonucleotide
  Target: SCN9A; (-) strand; PAM type: NRG; PAM sequence: GAG
tcgctctgtcgcccaggctg

SEQ ID NO: 36641 - DNA, 20 bp, Artificial Sequence
  Description of Artificial Sequence: Synthetic oligonucleotide
  Target: SCN9A; (-) strand; PAM type: NRG; PAM sequence: TGG
tctcgctctgtcgcccaggc

SEQ ID NO: 36642 - DNA, 20 bp, Artificial Sequence
  Description of Artificial Sequence: Synthetic oligonucleotide
  Target: SCN9A; (-) strand; PAM type: NRG; PAM sequence: AGG
ggagtctcgctctgtcgccc

SEQ ID NO: 36643 - DNA, 20 bp, Artificial Sequence
  Description of Artificial Sequence: Synthetic oligonucleotide
  Target: SCN9A; (-) strand; PAM type: NRG; PAM sequence: CAG
cggagtctcgctctgtcgcc

SEQ ID NO: 36644 - DNA, 20 bp, Artificial Sequence
  Description of Artificial Sequence: Synthetic oligonucleotide
  Target: SCN9A; (-) strand; PAM type: NRG; PAM sequence: GAG
ttttttatttttttgagacg

SEQ ID NO: 36645 - DNA, 20 bp, Artificial Sequence
  Description of Artificial Sequence: Synthetic oligonucleotide
  Target: SCN9A; (-) strand; PAM type: NRG; PAM sequence: CGG
tattttttatttttttgaga

SEQ ID NO: 36646 - DNA, 20 bp, Artificial Sequence
  Description of Artificial Sequence: Synthetic oligonucleotide
  Target: SCN9A; (-) strand; PAM type: NRG; PAM sequence: GAG
tttttattttttattttttt

SEQ ID NO: 36647 - DNA, 20 bp, Artificial Sequence
  Description of Artificial Sequence: Synthetic oligonucleotide
  Target: SCN9A; (-) strand; PAM type: NRG; PAM sequence: AAG
cctgtattatctgattttta

SEQ ID NO: 36648 - DNA, 20 bp, Artificial Sequence
  Description of Artificial Sequence: Synthetic oligonucleotide
  Target: SCN9A; (-) strand; PAM type: NRG; PAM sequence: TAG
ttatgtgctatatgcacacc

SEQ ID NO: 36649 - DNA, 20 bp, Artificial Sequence
  Description of Artificial Sequence: Synthetic oligonucleotide
  Target: SCN9A; (-) strand; PAM type: NRG; PAM sequence: AAG
agtattaaaaacattcccat

SEQ ID NO: 36650 - DNA, 20 bp, Artificial Sequence
  Description of Artificial Sequence: Synthetic oligonucleotide
  Target: SCN9A; (-) strand; PAM type: NRG; PAM sequence: AAG
agaagcatgcattaaaatat

SEQ ID NO: 36651 - DNA, 20 bp, Artificial Sequence
  Description of Artificial Sequence: Synthetic oligonucleotide
  Target: SCN9A; (-) strand; PAM type: NRG; PAM sequence: AAG
agaaagataaataagattag

SEQ ID NO: 36652 - DNA, 20 bp, Artificial Sequence
  Description of Artificial Sequence: Synthetic oligonucleotide
  Target: SCN9A; (-) strand; PAM type: NRG; PAM sequence: TAG
taaagaaagataaataagat

SEQ ID NO: 36653 - DNA, 20 bp, Artificial Sequence
  Description of Artificial Sequence: Synthetic oligonucleotide
  Target: SCN9A; (-) strand; PAM type: NRG; PAM sequence: AAG
gcctctaaagaaagataaat

SEQ ID NO: 36654 - DNA, 20 bp, Artificial Sequence
  Description of Artificial Sequence: Synthetic oligonucleotide
  Target: SCN9A; (-) strand; PAM type: NRG; PAM sequence: AAG
gaaaattgagcctctaaaga

SEQ ID NO: 36655 - DNA, 20 bp, Artificial Sequence
  Description of Artificial Sequence: Synthetic oligonucleotide
  Target: SCN9A; (-) strand; PAM type: NRG; PAM sequence: AAG
attggaaaattgagcctcta

SEQ ID NO: 36656 - DNA, 20 bp, Artificial Sequence
  Description of Artificial Sequence: Synthetic oligonucleotide
  Target: SCN9A; (-) strand; PAM type: NRG; PAM sequence: GAG
gtacaaataattggaaaatt

SEQ ID NO: 36657 - DNA, 20 bp, Artificial Sequence
  Description of Artificial Sequence: Synthetic oligonucleotide
  Target: SCN9A; (-) strand; PAM type: NRG; PAM sequence: TGG
aaactattagtacaaataat

SEQ ID NO: 36658 - DNA, 20 bp, Artificial Sequence
  Description of Artificial Sequence: Synthetic oligonucleotide
  Target: SCN9A; (-) strand; PAM type: NRG; PAM sequence: TAG
ccacttttaggtcaaactat

SEQ ID NO: 36659 - DNA, 20 bp, Artificial Sequence
  Description of Artificial Sequence: Synthetic oligonucleotide
  Target: SCN9A; (-) strand; PAM type: NRG; PAM sequence: AGG
gcaaattttactccactttt

SEQ ID NO: 36660 - DNA, 20 bp, Artificial Sequence
  Description of Artificial Sequence: Synthetic oligonucleotide
  Target: SCN9A; (-) strand; PAM type: NRG; PAM sequence: TAG
ggcaaattttactccacttt

SEQ ID NO: 36661 - DNA, 20 bp, Artificial Sequence
  Description of Artificial Sequence: Synthetic oligonucleotide
  Target: SCN9A; (-) strand; PAM type: NRG; PAM sequence: AGG
gtttgatatgtacgccagta

SEQ ID NO: 36662 - DNA, 20 bp, Artificial Sequence
  Description of Artificial Sequence: Synthetic oligonucleotide
  Target: SCN9A; (-) strand; PAM type: NRG; PAM sequence: AAG
tgtttgatatgtacgccagt

SEQ ID NO: 36663 - DNA, 20 bp, Artificial Sequence
  Description of Artificial Sequence: Synthetic oligonucleotide
  Target: SCN9A; (-) strand; PAM type: NRG; PAM sequence: CAG
caaatgtttgatatgtacgc

SEQ ID NO: 36664 - DNA, 20 bp, Artificial Sequence
  Description of Artificial Sequence: Synthetic oligonucleotide
  Target: SCN9A; (-) strand; PAM type: NRG; PAM sequence: TAG
gtgtacatttacaattaagt

SEQ ID NO: 36665 - DNA, 20 bp, Artificial Sequence
  Description of Artificial Sequence: Synthetic oligonucleotide
  Target: SCN9A; (-) strand; PAM type: NRG; PAM sequence: AAG
gagtgtgtacatttacaatt

SEQ ID NO: 36666 - DNA, 20 bp, Artificial Sequence
  Description of Artificial Sequence: Synthetic oligonucleotide
  Target: SCN9A; (-) strand; PAM type: NRG; PAM sequence: GAG
ttcacttggaaatttagaaa

SEQ ID NO: 36667 - DNA, 20 bp, Artificial Sequence
  Description of Artificial Sequence: Synthetic oligonucleotide
  Target: SCN9A; (-) strand; PAM type: NRG; PAM sequence: AAG
tgttcacttggaaatttaga

SEQ ID NO: 36668 - DNA, 20 bp, Artificial Sequence
  Description of Artificial Sequence: Synthetic oligonucleotide
  Target: SCN9A; (-) strand; PAM type: NRG; PAM sequence: TAG
ggattgttcacttggaaatt

SEQ ID NO: 36669 - DNA, 20 bp, Artificial Sequence
  Description of Artificial Sequence: Synthetic oligonucleotide
  Target: SCN9A; (-) strand; PAM type: NRG; PAM sequence: TGG
tgcacctaggattgttcact

SEQ ID NO: 36670 - DNA, 20 bp, Artificial Sequence
  Description of Artificial Sequence: Synthetic oligonucleotide
  Target: SCN9A; (-) strand; PAM type: NRG; PAM sequence: AGG
ataaagctctaattgcacct

SEQ ID NO: 36671 - DNA, 20 bp, Artificial Sequence
  Description of Artificial Sequence: Synthetic oligonucleotide
  Target: SCN9A; (-) strand; PAM type: NRG; PAM sequence: TAG
aataaagctctaattgcacc

SEQ ID NO: 36672 - DNA, 20 bp, Artificial Sequence
  Description of Artificial Sequence: Synthetic oligonucleotide
  Target: SCN9A; (-) strand; PAM type: NRG; PAM sequence: AAG
tcatttatcaaaatacaata

SEQ ID NO: 36673 - DNA, 20 bp, Artificial Sequence
  Description of Artificial Sequence: Synthetic oligonucleotide
  Target: SCN9A; (-) strand; PAM type: NRG; PAM sequence: AAG
gtctccttggattttttaca

SEQ ID NO: 36674 - DNA, 20 bp, Artificial Sequence
  Description of Artificial Sequence: Synthetic oligonucleotide
  Target: SCN9A; (-) strand; PAM type: NRG; PAM sequence: TGG
atttctttaaaatgtctcct

SEQ ID NO: 36675 - DNA, 20 bp, Artificial Sequence
  Description of Artificial Sequence: Synthetic oligonucleotide
  Target: SCN9A; (-) strand; PAM type: NRG; PAM sequence: GAG
ttgttatgtcaagtgttaga

SEQ ID NO: 36676 - DNA, 20 bp, Artificial Sequence
  Description of Artificial Sequence: Synthetic oligonucleotide
  Target: SCN9A; (-) strand; PAM type: NRG; PAM sequence: GAG
tcttgttatgtcaagtgtta

SEQ ID NO: 36677 - DNA, 20 bp, Artificial Sequence
  Description of Artificial Sequence: Synthetic oligonucleotide
  Target: SCN9A; (-) strand; PAM type: NRG; PAM sequence: TAG
cctcttgttatgtcaagtgt

SEQ ID NO: 36678 - DNA, 20 bp, Artificial Sequence
  Description of Artificial Sequence: Synthetic oligonucleotide
  Target: SCN9A; (-) strand; PAM type: NRG; PAM sequence: AAG
tgatttcctcttgttatgtc

SEQ ID NO: 36679 - DNA, 20 bp, Artificial Sequence
  Description of Artificial Sequence: Synthetic oligonucleotide
  Target: SCN9A; (-) strand; PAM type: NRG; PAM sequence: GAG
ttttaaagtgatataacatg

SEQ ID NO: 36680 - DNA, 20 bp, Artificial Sequence
  Description of Artificial Sequence: Synthetic oligonucleotide
  Target: SCN9A; (-) strand; PAM type: NRG; PAM sequence: TGG
ttttttaaagtgatataaca

SEQ ID NO: 36681 - DNA, 20 bp, Artificial Sequence
  Description of Artificial Sequence: Synthetic oligonucleotide
  Target: SCN9A; (-) strand; PAM type: NRG; PAM sequence: AAG
aactatctttagatttttta

SEQ ID NO: 36682 - DNA, 20 bp, Artificial Sequence
  Description of Artificial Sequence: Synthetic oligonucleotide
  Target: SCN9A; (-) strand; PAM type: NRG; PAM sequence: TAG
cacaggagatgaactatctt

SEQ ID NO: 36683 - DNA, 20 bp, Artificial Sequence
  Description of Artificial Sequence: Synthetic oligonucleotide
  Target: SCN9A; (-) strand; PAM type: NRG; PAM sequence: GAG
ttgttgtttctttaacacag

SEQ ID NO: 36684 - DNA, 20 bp, Artificial Sequence
  Description of Artificial Sequence: Synthetic oligonucleotide
  Target: SCN9A; (-) strand; PAM type: NRG; PAM sequence: AGG
tgttgttgtttctttaacac

SEQ ID NO: 36685 - DNA, 20 bp, Artificial Sequence
  Description of Artificial Sequence: Synthetic oligonucleotide
  Target: SCN9A; (-) strand; PAM type: NRG; PAM sequence: CAG
ttgttgttgtttctttaaca

SEQ ID NO: 36686 - DNA, 20 bp, Artificial Sequence
  Description of Artificial Sequence: Synthetic oligonucleotide
  Target: SCN9A; (-) strand; PAM type: NRG; PAM sequence: AAG
ttaaaataacaacttactgt

SEQ ID NO: 36687 - DNA, 20 bp, Artificial Sequence
  Description of Artificial Sequence: Synthetic oligonucleotide
  Target: SCN9A; (-) strand; PAM type: NRG; PAM sequence: GAG
tatatctttttagttctata

SEQ ID NO: 36688 - DNA, 20 bp, Artificial Sequence
  Description of Artificial Sequence: Synthetic oligonucleotide
  Target: SCN9A; (-) strand; PAM type: NRG; PAM sequence: TAG
tctatatctttttagttcta

SEQ ID NO: 36689 - DNA, 20 bp, Artificial Sequence
  Description of Artificial Sequence: Synthetic oligonucleotide
  Target: SCN9A; (-) strand; PAM type: NRG; PAM sequence: TAG
tgaattattctatatctttt

SEQ ID NO: 36690 - DNA, 20 bp, Artificial Sequence
  Description of Artificial Sequence: Synthetic oligonucleotide
  Target: SCN9A; (-) strand; PAM type: NRG; PAM sequence: TAG
caagtttgaattgacatatg

SEQ ID NO: 36691 - DNA, 20 bp, Artificial Sequence
  Description of Artificial Sequence: Synthetic oligonucleotide
  Target: SCN9A; (-) strand; PAM type: NRG; PAM sequence: AAG
aagcataatctgccacagac

SEQ ID NO: 36692 - DNA, 20 bp, Artificial Sequence
  Description of Artificial Sequence: Synthetic oligonucleotide
  Target: SCN9A; (-) strand; PAM type: NRG; PAM sequence: CAG
ccagtaagcataatctgcca

SEQ ID NO: 36693 - DNA, 20 bp, Artificial Sequence
  Description of Artificial Sequence: Synthetic oligonucleotide
  Target: SCN9A; (-) strand; PAM type: NRG; PAM sequence: AAG
atgccttgaacagtgccagt

SEQ ID NO: 36694 - DNA, 20 bp, Artificial Sequence
  Description of Artificial Sequence: Synthetic oligonucleotide
  Target: SCN9A; (-) strand; PAM type: NRG; PAM sequence: CAG
gggaatgccttgaacagtgc

SEQ ID NO: 36695 - DNA, 20 bp, Artificial Sequence
  Description of Artificial Sequence: Synthetic oligonucleotide
  Target: SCN9A; (-) strand; PAM type: NRG; PAM sequence: CAG
gaagaggggaatgccttgaa

SEQ ID NO: 36696 - DNA, 20 bp, Artificial Sequence
  Description of Artificial Sequence: Synthetic oligonucleotide
  Target: SCN9A; (-) strand; PAM type: NRG; PAM sequence: GGG
ataaagtggggaaggaagag

SEQ ID NO: 36697 - DNA, 20 bp, Artificial Sequence
  Description of Artificial Sequence: Synthetic oligonucleotide
  Target: SCN9A; (-) strand; PAM type: NRG; PAM sequence: GGG
gataaagtggggaaggaaga

SEQ ID NO: 36698 - DNA, 20 bp, Artificial Sequence
  Description of Artificial Sequence: Synthetic oligonucleotide
  Target: SCN9A; (-) strand; PAM type: NRG; PAM sequence: AGG
tgataaagtggggaaggaag

SEQ ID NO: 36699 - DNA, 20 bp, Artificial Sequence
  Description of Artificial Sequence: Synthetic oligonucleotide
  Target: SCN9A; (-) strand; PAM type: NRG; PAM sequence: GAG
atgataaagtggggaaggaa

SEQ ID NO: 36700 - DNA, 20 bp, Artificial Sequence
  Description of Artificial Sequence: Synthetic oligonucleotide
  Target: SCN9A; (-) strand; PAM type: NRG; PAM sequence: AAG
ccatgataaagtggggaagg

SEQ ID NO: 36701 - DNA, 20 bp, Artificial Sequence
  Description of Artificial Sequence: Synthetic oligonucleotide
  Target: SCN9A; (-) strand; PAM type: NRG; PAM sequence: AGG
aggccatgataaagtgggga

SEQ ID NO: 36702 - DNA, 20 bp, Artificial Sequence
  Description of Artificial Sequence: Synthetic oligonucleotide
  Target: SCN9A; (-) strand; PAM type: NRG; PAM sequence: AAG
caggccatgataaagtgggg

SEQ ID NO: 36703 - DNA, 20 bp, Artificial Sequence
  Description of Artificial Sequence: Synthetic oligonucleotide
  Target: SCN9A; (-) strand; PAM type: NRG; PAM sequence: GGG
tgccaggccatgataaagtg

SEQ ID NO: 36704 - DNA, 20 bp, Artificial Sequence
  Description of Artificial Sequence: Synthetic oligonucleotide
  Target: SCN9A; (-) strand; PAM type: NRG; PAM sequence: GGG
atgccaggccatgataaagt

SEQ ID NO: 36705 - DNA, 20 bp, Artificial Sequence
  Description of Artificial Sequence: Synthetic oligonucleotide
  Target: SCN9A; (-) strand; PAM type: NRG; PAM sequence: TGG
aatgccaggccatgataaag

SEQ ID NO: 36706 - DNA, 20 bp, Artificial Sequence
  Description of Artificial Sequence: Synthetic oligonucleotide
  Target: SCN9A; (-) strand; PAM type: NRG; PAM sequence: AAG
aaaaatgccaggccatgata

SEQ ID NO: 36707 - DNA, 20 bp, Artificial Sequence
  Description of Artificial Sequence: Synthetic oligonucleotide
  Target: SCN9A; (-) strand; PAM type: NRG; PAM sequence: AGG
gggtggtgaggaaaaatgcc

SEQ ID NO: 36708 - DNA, 20 bp, Artificial Sequence
  Description of Artificial Sequence: Synthetic oligonucleotide
  Target: SCN9A; (-) strand; PAM type: NRG; PAM sequence: CAG
tgggtggtgaggaaaaatgc

SEQ ID NO: 36709 - DNA, 20 bp, Artificial Sequence
  Description of Artificial Sequence: Synthetic oligonucleotide
  Target: SCN9A; (-) strand; PAM type: NRG; PAM sequence: AGG
tgaaacccttctgggtggtg

SEQ ID NO: 36710 - DNA, 20 bp, Artificial Sequence
  Description of Artificial Sequence: Synthetic oligonucleotide
  Target: SCN9A; (-) strand; PAM type: NRG; PAM sequence: GAG
atgaaacccttctgggtggt

SEQ ID NO: 36711 - DNA, 20 bp, Artificial Sequence
  Description of Artificial Sequence: Synthetic oligonucleotide
  Target: SCN9A; (-) strand; PAM type: NRG; PAM sequence: TGG
aggaatgaaacccttctggg

SEQ ID NO: 36712 - DNA, 20 bp, Artificial Sequence
  Description of Artificial Sequence: Synthetic oligonucleotide
  Target: SCN9A; (-) strand; PAM type: NRG; PAM sequence: GGG
tggaggaatgaaacccttct

SEQ ID NO: 36713 - DNA, 20 bp, Artificial Sequence
  Description of Artificial Sequence: Synthetic oligonucleotide
  Target: SCN9A; (-) strand; PAM type: NRG; PAM sequence: TGG
ttggaggaatgaaacccttc

SEQ ID NO: 36714 - DNA, 20 bp, Artificial Sequence
  Description of Artificial Sequence: Synthetic oligonucleotide
  Target: SCN9A; (-) strand; PAM type: NRG; PAM sequence: AGG
aaaggtggaatgaagtttgg

SEQ ID NO: 36715 - DNA, 20 bp, Artificial Sequence
  Description of Artificial Sequence: Synthetic oligonucleotide
  Target: SCN9A; (-) strand; PAM type: NRG; PAM sequence: GAG
taaaggtggaatgaagtttg

SEQ ID NO: 36716 - DNA, 20 bp, Artificial Sequence
  Description of Artificial Sequence: Synthetic oligonucleotide
  Target: SCN9A; (-) strand; PAM type: NRG; PAM sequence: TGG
gctaaaggtggaatgaagtt

SEQ ID NO: 36717 - DNA, 20 bp, Artificial Sequence
  Description of Artificial Sequence: Synthetic oligonucleotide
  Target: SCN9A; (-) strand; PAM type: NRG; PAM sequence: AAG
tggcagctaaaggtggaatg

SEQ ID NO: 36718 - DNA, 20 bp, Artificial Sequence
  Description of Artificial Sequence: Synthetic oligonucleotide
  Target: SCN9A; (-) strand; PAM type: NRG; PAM sequence: TGG
cagctcttggcagctaaagg

SEQ ID NO: 36719 - DNA, 20 bp, Artificial Sequence
  Description of Artificial Sequence: Synthetic oligonucleotide
  Target: SCN9A; (-) strand; PAM type: NRG; PAM sequence: AGG
catcagctcttggcagctaa

SEQ ID NO: 36720 - DNA, 20 bp, Artificial Sequence
  Description of Artificial Sequence: Synthetic oligonucleotide
  Target: SCN9A; (-) strand; PAM type: NRG; PAM sequence: AAG
ccatcagctcttggcagcta

SEQ ID NO: 36721 - DNA, 20 bp, Artificial Sequence
  Description of Artificial Sequence: Synthetic oligonucleotide
  Target: SCN9A; (-) strand; PAM type: NRG; PAM sequence: CAG
aaaaagccatcagctcttgg

SEQ ID NO: 36722 - DNA, 20 bp, Artificial Sequence
  Description of Artificial Sequence: Synthetic oligonucleotide
  Target: SCN9A; (-) strand; PAM type: NRG; PAM sequence: TGG
aagaaaaagccatcagctct

SEQ ID NO: 36723 - DNA, 20 bp, Artificial Sequence
  Description of Artificial Sequence: Synthetic oligonucleotide
  Target: SCN9A; (-) strand; PAM type: NRG; PAM sequence: CAG
taggcaaaagaaaaagccat

SEQ ID NO: 36724 - DNA, 20 bp, Artificial Sequence
  Description of Artificial Sequence: Synthetic oligonucleotide
  Target: SCN9A; (-) strand; PAM type: NRG; PAM sequence: AAG
atggctttaggcaaaagaaa

SEQ ID NO: 36725 - DNA, 20 bp, Artificial Sequence
  Description of Artificial Sequence: Synthetic oligonucleotide
  Target: SCN9A; (-) strand; PAM type: NRG; PAM sequence: AAG
aaggaaatggctttaggcaa

SEQ ID NO: 36726 - DNA, 20 bp, Artificial Sequence
  Description of Artificial Sequence: Synthetic oligonucleotide
  Target: SCN9A; (-) strand; PAM type: NRG; PAM sequence: AGG
tgctggaaggaaatggcttt

SEQ ID NO: 36727 - DNA, 20 bp, Artificial Sequence
  Description of Artificial Sequence: Synthetic oligonucleotide
  Target: SCN9A; (-) strand; PAM type: NRG; PAM sequence: TAG
ttgctggaaggaaatggctt

SEQ ID NO: 36728 - DNA, 20 bp, Artificial Sequence
  Description of Artificial Sequence: Synthetic oligonucleotide
  Target: SCN9A; (-) strand; PAM type: NRG; PAM sequence: TGG
tctgccttgctggaaggaaa

SEQ ID NO: 36729 - DNA, 20 bp, Artificial Sequence
  Description of Artificial Sequence: Synthetic oligonucleotide
  Target: SCN9A; (-) strand; PAM type: NRG; PAM sequence: AGG
ctttcctctgccttgctgga

SEQ ID NO: 36730 - DNA, 20 bp, Artificial Sequence
  Description of Artificial Sequence: Synthetic oligonucleotide
  Target: SCN9A; (-) strand; PAM type: NRG; PAM sequence: AAG
cctttcctctgccttgctgg

SEQ ID NO: 36731 - DNA, 20 bp, Artificial Sequence
  Description of Artificial Sequence: Synthetic oligonucleotide
  Target: SCN9A; (-) strand; PAM type: NRG; PAM sequence: TGG
taccctttcctctgccttgc

SEQ ID NO: 36732 - DNA, 20 bp, Artificial Sequence
  Description of Artificial Sequence: Synthetic oligonucleotide
  Target: SCN9A; (-) strand; PAM type: NRG; PAM sequence: AGG
aaatgaaatttcttcattga

SEQ ID NO: 36733 - DNA, 20 bp, Artificial Sequence
  Description of Artificial Sequence: Synthetic oligonucleotide
  Target: SCN9A; (-) strand; PAM type: NRG; PAM sequence: AAG
aaaatgaaatttcttcattg

SEQ ID NO: 36734 - DNA, 20 bp, Artificial Sequence
  Description of Artificial Sequence: Synthetic oligonucleotide
  Target: SCN9A; (-) strand; PAM type: NRG; PAM sequence: TGG
ggaatatgagataacaattt

SEQ ID NO: 36735 - DNA, 20 bp, Artificial Sequence
  Description of Artificial Sequence: Synthetic oligonucleotide
  Target: SCN9A; (-) strand; PAM type: NRG; PAM sequence: GAG
agaatacttttgtggaatat

SEQ ID NO: 36736 - DNA, 20 bp, Artificial Sequence
  Description of Artificial Sequence: Synthetic oligonucleotide
  Target: SCN9A; (-) strand; PAM type: NRG; PAM sequence: TGG
atgtgggtagaatacttttg

SEQ ID NO: 36737 - DNA, 20 bp, Artificial Sequence
  Description of Artificial Sequence: Synthetic oligonucleotide
  Target: SCN9A; (-) strand; PAM type: NRG; PAM sequence: TAG
gagcatccagagaatgtggg

SEQ ID NO: 36738 - DNA, 20 bp, Artificial Sequence
  Description of Artificial Sequence: Synthetic oligonucleotide
  Target: SCN9A; (-) strand; PAM type: NRG; PAM sequence: GGG
tgagagcatccagagaatgt

SEQ ID NO: 36739 - DNA, 20 bp, Artificial Sequence
  Description of Artificial Sequence: Synthetic oligonucleotide
  Target: SCN9A; (-) strand; PAM type: NRG; PAM sequence: TGG
atgagagcatccagagaatg

SEQ ID NO: 36740 - DNA, 20 bp, Artificial Sequence
  Description of Artificial Sequence: Synthetic oligonucleotide
  Target: SCN9A; (-) strand; PAM type: NRG; PAM sequence: GAG
aggatttatgagagcatcca

SEQ ID NO: 36741 - DNA, 20 bp, Artificial Sequence
  Description of Artificial Sequence: Synthetic oligonucleotide
  Target: SCN9A; (-) strand; PAM type: NRG; PAM sequence: CAG
tgaggatttatgagagcatc

SEQ ID NO: 36742 - DNA, 20 bp, Artificial Sequence
  Description of Artificial Sequence: Synthetic oligonucleotide
  Target: SCN9A; (-) strand; PAM type: NRG; PAM sequence: GAG
ttttatatgaggatttatga

SEQ ID NO: 36743 - DNA, 20 bp, Artificial Sequence
  Description of Artificial Sequence: Synthetic oligonucleotide
  Target: SCN9A; (-) strand; PAM type: NRG; PAM sequence: GAG
tattttatatgaggatttat

SEQ ID NO: 36744 - DNA, 20 bp, Artificial Sequence
  Description of Artificial Sequence: Synthetic oligonucleotide
  Target: SCN9A; (-) strand; PAM type: NRG; PAM sequence: AGG
gtataaaaatattttatatg

SEQ ID NO: 36745 - DNA, 20 bp, Artificial Sequence
  Description of Artificial Sequence: Synthetic oligonucleotide
  Target: SCN9A; (-) strand; PAM type: NRG; PAM sequence: GAG
tgtataaaaatattttatat

SEQ ID NO: 36746 - DNA, 20 bp, Artificial Sequence
  Description of Artificial Sequence: Synthetic oligonucleotide
  Target: SCN9A; (-) strand; PAM type: NRG; PAM sequence: TAG
gaggcaaggtcatattaaaa

SEQ ID NO: 36747 - DNA, 20 bp, Artificial Sequence
  Description of Artificial Sequence: Synthetic oligonucleotide
  Target: SCN9A; (-) strand; PAM type: NRG; PAM sequence: AGG
agattaccacttgagaggca

SEQ ID NO: 36748 - DNA, 20 bp, Artificial Sequence
  Description of Artificial Sequence: Synthetic oligonucleotide
  Target: SCN9A; (-) strand; PAM type: NRG; PAM sequence: AAG
tagattaccacttgagaggc

SEQ ID NO: 36749 - DNA, 20 bp, Artificial Sequence
  Description of Artificial Sequence: Synthetic oligonucleotide
  Target: SCN9A; (-) strand; PAM type: NRG; PAM sequence: AGG
gagttagattaccacttgag

SEQ ID NO: 36750 - DNA, 20 bp, Artificial Sequence
  Description of Artificial Sequence: Synthetic oligonucleotide
  Target: SCN9A; (-) strand; PAM type: NRG; PAM sequence: GAG
agagttagattaccacttga

SEQ ID NO: 36751 - DNA, 20 bp, Artificial Sequence
  Description of Artificial Sequence: Synthetic oligonucleotide
  Target: SCN9A; (-) strand; PAM type: NRG; PAM sequence: GAG
gtagagttagattaccactt

SEQ ID NO: 36752 - DNA, 20 bp, Artificial Sequence
  Description of Artificial Sequence: Synthetic oligonucleotide
  Target: SCN9A; (-) strand; PAM type: NRG; PAM sequence: TAG
cctttagaactgtgtagagt

SEQ ID NO: 36753 - DNA, 20 bp, Artificial Sequence
  Description of Artificial Sequence: Synthetic oligonucleotide
  Target: SCN9A; (-) strand; PAM type: NRG; PAM sequence: GAG
tcttcctttagaactgtgta

SEQ ID NO: 36754 - DNA, 20 bp, Artificial Sequence
  Description of Artificial Sequence: Synthetic oligonucleotide
  Target: SCN9A; (-) strand; PAM type: NRG; PAM sequence: TAG
catcttcctttagaactgtg

SEQ ID NO: 36755 - DNA, 20 bp, Artificial Sequence
  Description of Artificial Sequence: Synthetic oligonucleotide
  Target: SCN9A; (-) strand; PAM type: NRG; PAM sequence: TAG
agtattatgacatcttcctt

SEQ ID NO: 36756 - DNA, 20 bp, Artificial Sequence
  Description of Artificial Sequence: Synthetic oligonucleotide
  Target: SCN9A; (-) strand; PAM type: NRG; PAM sequence: AAG
agctaatttattctttacag

SEQ ID NO: 36757 - DNA, 20 bp, Artificial Sequence
  Description of Artificial Sequence: Synthetic oligonucleotide
  Target: SCN9A; (-) strand; PAM type: NRG; PAM sequence: CAG
attagctaatttattcttta

SEQ ID NO: 36758 - DNA, 20 bp, Artificial Sequence
  Description of Artificial Sequence: Synthetic oligonucleotide
  Target: SCN9A; (-) strand; PAM type: NRG; PAM sequence: TAG
tcatattacacatcacaaat

SEQ ID NO: 36759 - DNA, 20 bp, Artificial Sequence
  Description of Artificial Sequence: Synthetic oligonucleotide
  Target: SCN9A; (-) strand; PAM type: NRG; PAM sequence: TGG
atctgtgtactaattgaaga

SEQ ID NO: 36760 - DNA, 20 bp, Artificial Sequence
  Description of Artificial Sequence: Synthetic oligonucleotide
  Target: SCN9A; (-) strand; PAM type: NRG; PAM sequence: AAG
gggcatctgtgtactaattg

SEQ ID NO: 36761 - DNA, 20 bp, Artificial Sequence
  Description of Artificial Sequence: Synthetic oligonucleotide
  Target: SCN9A; (-) strand; PAM type: NRG; PAM sequence: GGG
attgtggatgttgtattgga

SEQ ID NO: 36762 - DNA, 20 bp, Artificial Sequence
  Description of Artificial Sequence: Synthetic oligonucleotide
  Target: SCN9A; (-) strand; PAM type: NRG; PAM sequence: AGG
tattgtggatgttgtattgg

SEQ ID NO: 36763 - DNA, 20 bp, Artificial Sequence
  Description of Artificial Sequence: Synthetic oligonucleotide
  Target: SCN9A; (-) strand; PAM type: NRG; PAM sequence: GAG
atattgtggatgttgtattg

SEQ ID NO: 36764 - DNA, 20 bp, Artificial Sequence
  Description of Artificial Sequence: Synthetic oligonucleotide
  Target: SCN9A; (-) strand; PAM type: NRG; PAM sequence: TGG
acatattgtggatgttgtat

SEQ ID NO: 36765 - DNA, 20 bp, Artificial Sequence
  Description of Artificial Sequence: Synthetic oligonucleotide
  Target: SCN9A; (-) strand; PAM type: NRG; PAM sequence: TGG
gctctgaagaggacatattg

SEQ ID NO: 36766 - DNA, 20 bp, Artificial Sequence
  Description of Artificial Sequence: Synthetic oligonucleotide
  Target: SCN9A; (-) strand; PAM type: NRG; PAM sequence: AGG
tttaaaaatttgctctgaag

SEQ ID NO: 36767 - DNA, 20 bp, Artificial Sequence
  Description of Artificial Sequence: Synthetic oligonucleotide
  Target: SCN9A; (-) strand; PAM type: NRG; PAM sequence: GAG
ttttaaaaatttgctctgaa

SEQ ID NO: 36768 - DNA, 20 bp, Artificial Sequence
  Description of Artificial Sequence: Synthetic oligonucleotide
  Target: SCN9A; (-) strand; PAM type: NRG; PAM sequence: AAG
atttttaaaaatttgctctg

SEQ ID NO: 36769 - DNA, 20 bp, Artificial Sequence
  Description of Artificial Sequence: Synthetic oligonucleotide
  Target: SCN9A; (-) strand; PAM type: NRG; PAM sequence: GGG
tatttcactaattgtgagca

SEQ ID NO: 36770 - DNA, 20 bp, Artificial Sequence
  Description of Artificial Sequence: Synthetic oligonucleotide
  Target: SCN9A; (-) strand; PAM type: NRG; PAM sequence: AGG
ttatttcactaattgtgagc

SEQ ID NO: 36771 - DNA, 20 bp, Artificial Sequence
  Description of Artificial Sequence: Synthetic oligonucleotide
  Target: SCN9A; (-) strand; PAM type: NRG; PAM sequence: CAG
attatttcactaattgtgag

SEQ ID NO: 36772 - DNA, 20 bp, Artificial Sequence
  Description of Artificial Sequence: Synthetic oligonucleotide
  Target: SCN9A; (-) strand; PAM type: NRG; PAM sequence: GAG
taaattatttcactaattgt

SEQ ID NO: 36773 - DNA, 20 bp, Artificial Sequence
  Description of Artificial Sequence: Synthetic oligonucleotide
  Target: SCN9A; (-) strand; PAM type: NRG; PAM sequence: AGG
gttaccacattacatcttga

SEQ ID NO: 36774 - DNA, 20 bp, Artificial Sequence
  Description of Artificial Sequence: Synthetic oligonucleotide
  Target: SCN9A; (-) strand; PAM type: NRG; PAM sequence: AAG
ggttaccacattacatcttg

SEQ ID NO: 36775 - DNA, 20 bp, Artificial Sequence
  Description of Artificial Sequence: Synthetic oligonucleotide
  Target: SCN9A; (-) strand; PAM type: NRG; PAM sequence: TGG
cagatttttggtaaataatt

SEQ ID NO: 36776 - DNA, 20 bp, Artificial Sequence
  Description of Artificial Sequence: Synthetic oligonucleotide
  Target: SCN9A; (-) strand; PAM type: NRG; PAM sequence: TGG
aatggccagccacagatttt

SEQ ID NO: 36777 - DNA, 20 bp, Artificial Sequence
  Description of Artificial Sequence: Synthetic oligonucleotide
  Target: SCN9A; (-) strand; PAM type: NRG; PAM sequence: CAG
atgtagcaaatggccagcca

SEQ ID NO: 36778 - DNA, 20 bp, Artificial Sequence
  Description of Artificial Sequence: Synthetic oligonucleotide
  Target: SCN9A; (-) strand; PAM type: NRG; PAM sequence: CAG
ttttttatgtagcaaatggc

SEQ ID NO: 36779 - DNA, 20 bp, Artificial Sequence
  Description of Artificial Sequence: Synthetic oligonucleotide
  Target: SCN9A; (-) strand; PAM type: NRG; PAM sequence: TGG
tgatttttttatgtagcaaa

SEQ ID NO: 36780 - DNA, 20 bp, Artificial Sequence
  Description of Artificial Sequence: Synthetic oligonucleotide
  Target: SCN9A; (-) strand; PAM type: NRG; PAM sequence: TAG
tgattaatgatttttttatg

SEQ ID NO: 36781 - DNA, 20 bp, Artificial Sequence
  Description of Artificial Sequence: Synthetic oligonucleotide
  Target: SCN9A; (-) strand; PAM type: NRG; PAM sequence: AGG
tgaaaatttagctttcaatt

SEQ ID NO: 36782 - DNA, 20 bp, Artificial Sequence
  Description of Artificial Sequence: Synthetic oligonucleotide
  Target: SCN9A; (-) strand; PAM type: NRG; PAM sequence: TAG
ttgaaaatttagctttcaat

SEQ ID NO: 36783 - DNA, 20 bp, Artificial Sequence
  Description of Artificial Sequence: Synthetic oligonucleotide
  Target: SCN9A; (-) strand; PAM type: NRG; PAM sequence: TAG
ttaacatttggttgaaaatt

SEQ ID NO: 36784 - DNA, 20 bp, Artificial Sequence
  Description of Artificial Sequence: Synthetic oligonucleotide
  Target: SCN9A; (-) strand; PAM type: NRG; PAM sequence: TGG
ctagttttgctattaacatt

SEQ ID NO: 36785 - DNA, 20 bp, Artificial Sequence
  Description of Artificial Sequence: Synthetic oligonucleotide
  Target: SCN9A; (-) strand; PAM type: NRG; PAM sequence: TAG
aaagatattaaacaaacaac

SEQ ID NO: 36786 - DNA, 20 bp, Artificial Sequence
  Description of Artificial Sequence: Synthetic oligonucleotide
  Target: SCN9A; (-) strand; PAM type: NRG; PAM sequence: AAG
atttttgcagactatgctta

SEQ ID NO: 36787 - DNA, 20 bp, Artificial Sequence
  Description of Artificial Sequence: Synthetic oligonucleotide
  Target: SCN9A; (-) strand; PAM type: NRG; PAM sequence: CAG
gcctcccccctttatttttg

SEQ ID NO: 36788 - DNA, 20 bp, Artificial Sequence
  Description of Artificial Sequence: Synthetic oligonucleotide
  Target: SCN9A; (-) strand; PAM type: NRG; PAM sequence: TGG
acacacacacacactttgta

SEQ ID NO: 36789 - DNA, 20 bp, Artificial Sequence
  Description of Artificial Sequence: Synthetic oligonucleotide
  Target: SCN9A; (-) strand; PAM type: NRG; PAM sequence: TAG
tgattgtgtcattttcatac

SEQ ID NO: 36790 - DNA, 20 bp, Artificial Sequence
  Description of Artificial Sequence: Synthetic oligonucleotide
  Target: SCN9A; (-) strand; PAM type: NRG; PAM sequence: AGG
ctgttattagagtggaagta

SEQ ID NO: 36791 - DNA, 20 bp, Artificial Sequence
  Description of Artificial Sequence: Synthetic oligonucleotide
  Target: SCN9A; (-) strand; PAM type: NRG; PAM sequence: AAG
actgttattagagtggaagt

SEQ ID NO: 36792 - DNA, 20 bp, Artificial Sequence
  Description of Artificial Sequence: Synthetic oligonucleotide
  Target: SCN9A; (-) strand; PAM type: NRG; PAM sequence: AAG
catcactgttattagagtgg

SEQ ID NO: 36793 - DNA, 20 bp, Artificial Sequence
  Description of Artificial Sequence: Synthetic oligonucleotide
  Target: SCN9A; (-) strand; PAM type: NRG; PAM sequence: TGG
acccatcactgttattagag

SEQ ID NO: 36794 - DNA, 20 bp, Artificial Sequence
  Description of Artificial Sequence: Synthetic oligonucleotide
  Target: SCN9A; (-) strand; PAM type: NRG; PAM sequence: GAG
aagacccatcactgttatta

SEQ ID NO: 36795 - DNA, 20 bp, Artificial Sequence
  Description of Artificial Sequence: Synthetic oligonucleotide
  Target: SCN9A; (-) strand; PAM type: NRG; PAM sequence: TAG
tgaagacccatcactgttat

SEQ ID NO: 36796 - DNA, 20 bp, Artificial Sequence
  Description of Artificial Sequence: Synthetic oligonucleotide
  Target: SCN9A; (-) strand; PAM type: NRG; PAM sequence: AAG
gcaatgtgggcttatccatg

SEQ ID NO: 36797 - DNA, 20 bp, Artificial Sequence
  Description of Artificial Sequence: Synthetic oligonucleotide
  Target: SCN9A; (-) strand; PAM type: NRG; PAM sequence: GGG
aaggttcagagaggcaatgt

SEQ ID NO: 36798 - DNA, 20 bp, Artificial Sequence
  Description of Artificial Sequence: Synthetic oligonucleotide
  Target: SCN9A; (-) strand; PAM type: NRG; PAM sequence: TGG
gaaggttcagagaggcaatg

SEQ ID NO: 36799 - DNA, 20 bp, Artificial Sequence
  Description of Artificial Sequence: Synthetic oligonucleotide
  Target: SCN9A; (-) strand; PAM type: NRG; PAM sequence: AGG
tctctaaggaaggttcagag

SEQ ID NO: 36800 - DNA, 20 bp, Artificial Sequence
  Description of Artificial Sequence: Synthetic oligonucleotide
  Target: SCN9A; (-) strand; PAM type: NRG; PAM sequence: GAG
ttctctaaggaaggttcaga

SEQ ID NO: 36801 - DNA, 20 bp, Artificial Sequence
  Description of Artificial Sequence: Synthetic oligonucleotide
  Target: SCN9A; (-) strand; PAM type: NRG; PAM sequence: GAG
cattctctaaggaaggttca

SEQ ID NO: 36802 - DNA, 20 bp, Artificial Sequence
  Description of Artificial Sequence: Synthetic oligonucleotide
  Target: SCN9A; (-) strand; PAM type: NRG; PAM sequence: CAG
agcattctctaaggaaggtt

SEQ ID NO: 36803 - DNA, 20 bp, Artificial Sequence
  Description of Artificial Sequence: Synthetic oligonucleotide
  Target: SCN9A; (-) strand; PAM type: NRG; PAM sequence: AGG
tttgaagcattctctaagga

SEQ ID NO: 36804 - DNA, 20 bp, Artificial Sequence
  Description of Artificial Sequence: Synthetic oligonucleotide
  Target: SCN9A; (-) strand; PAM type: NRG; PAM sequence: AAG
atttgaagcattctctaagg

SEQ ID NO: 36805 - DNA, 20 bp, Artificial Sequence
  Description of Artificial Sequence: Synthetic oligonucleotide
  Target: SCN9A; (-) strand; PAM type: NRG; PAM sequence: AGG
aatatttgaagcattctcta

SEQ ID NO: 36806 - DNA, 20 bp, Artificial Sequence
  Description of Artificial Sequence: Synthetic oligonucleotide
  Target: SCN9A; (-) strand; PAM type: NRG; PAM sequence: AAG
aaatatttgaagcattctct

SEQ ID NO: 36807 - DNA, 20 bp, Artificial Sequence
  Description of Artificial Sequence: Synthetic oligonucleotide
  Target: SCN9A; (-) strand; PAM type: NRG; PAM sequence: AAG
gcacattatccaaatatttg

SEQ ID NO: 36808 - DNA, 20 bp, Artificial Sequence
  Description of Artificial Sequence: Synthetic oligonucleotide
  Target: SCN9A; (-) strand; PAM type: NRG; PAM sequence: GGG
atgtttgccccaggtacaaa

SEQ ID NO: 36809 - DNA, 20 bp, Artificial Sequence
  Description of Artificial Sequence: Synthetic oligonucleotide
  Target: SCN9A; (-) strand; PAM type: NRG; PAM sequence: AGG
gatgtttgccccaggtacaa

SEQ ID NO: 36810 - DNA, 20 bp, Artificial Sequence
  Description of Artificial Sequence: Synthetic oligonucleotide
  Target: SCN9A; (-) strand; PAM type: NRG; PAM sequence: AAG
tgatgtttgccccaggtaca

SEQ ID NO: 36811 - DNA, 20 bp, Artificial Sequence
  Description of Artificial Sequence: Synthetic oligonucleotide
  Target: SCN9A; (-) strand; PAM type: NRG; PAM sequence: AGG
tctaaattgatgtttgcccc

SEQ ID NO: 36812 - DNA, 20 bp, Artificial Sequence
  Description of Artificial Sequence: Synthetic oligonucleotide
  Target: SCN9A; (-) strand; PAM type: NRG; PAM sequence: CAG
gtctaaattgatgtttgccc

SEQ ID NO: 36813 - DNA, 20 bp, Artificial Sequence
  Description of Artificial Sequence: Synthetic oligonucleotide
  Target: SCN9A; (-) strand; PAM type: NRG; PAM sequence: CGG
ccataagttaggtttccaca

SEQ ID NO: 36814 - DNA, 20 bp, Artificial Sequence
  Description of Artificial Sequence: Synthetic oligonucleotide
  Target: SCN9A; (-) strand; PAM type: NRG; PAM sequence: AGG
tgaggcggaggccataagtt

SEQ ID NO: 36815 - DNA, 20 bp, Artificial Sequence
  Description of Artificial Sequence: Synthetic oligonucleotide
  Target: SCN9A; (-) strand; PAM type: NRG; PAM sequence: TAG
atgaggcggaggccataagt

SEQ ID NO: 36816 - DNA, 20 bp, Artificial Sequence
  Description of Artificial Sequence: Synthetic oligonucleotide
  Target: SCN9A; (-) strand; PAM type: NRG; PAM sequence: AAG
tcagatgaggcggaggccat

SEQ ID NO: 36817 - DNA, 20 bp, Artificial Sequence
  Description of Artificial Sequence: Synthetic oligonucleotide
  Target: SCN9A; (-) strand; PAM type: NRG; PAM sequence: AGG
aatgtagtcagatgaggcgg

SEQ ID NO: 36818 - DNA, 20 bp, Artificial Sequence
  Description of Artificial Sequence: Synthetic oligonucleotide
  Target: SCN9A; (-) strand; PAM type: NRG; PAM sequence: GAG
aaatgtagtcagatgaggcg

SEQ ID NO: 36819 - DNA, 20 bp, Artificial Sequence
  Description of Artificial Sequence: Synthetic oligonucleotide
  Target: SCN9A; (-) strand; PAM type: NRG; PAM sequence: CGG
agaaatgtagtcagatgagg

SEQ ID NO: 36820 - DNA, 20 bp, Artificial Sequence
  Description of Artificial Sequence: Synthetic oligonucleotide
  Target: SCN9A; (-) strand; PAM type: NRG; PAM sequence: AGG
gatagaaatgtagtcagatg

SEQ ID NO: 36821 - DNA, 20 bp, Artificial Sequence
  Description of Artificial Sequence: Synthetic oligonucleotide
  Target: SCN9A; (-) strand; PAM type: NRG; PAM sequence: GAG
tgatagaaatgtagtcagat

SEQ ID NO: 36822 - DNA, 20 bp, Artificial Sequence
  Description of Artificial Sequence: Synthetic oligonucleotide
  Target: SCN9A; (-) strand; PAM type: NRG; PAM sequence: CAG
tcagttgatagaaatgtagt

SEQ ID NO: 36823 - DNA, 20 bp, Artificial Sequence
  Description of Artificial Sequence: Synthetic oligonucleotide
  Target: SCN9A; (-) strand; PAM type: NRG; PAM sequence: TAG
gagctcagttgatagaaatg

SEQ ID NO: 36824 - DNA, 20 bp, Artificial Sequence
  Description of Artificial Sequence: Synthetic oligonucleotide
  Target: SCN9A; (-) strand; PAM type: NRG; PAM sequence: TAG
gcttatgtgagctcagttga

SEQ ID NO: 36825 - DNA, 20 bp, Artificial Sequence
  Description of Artificial Sequence: Synthetic oligonucleotide
  Target: SCN9A; (-) strand; PAM type: NRG; PAM sequence: CAG
catagatgcttatgtgagct

SEQ ID NO: 36826 - DNA, 20 bp, Artificial Sequence
  Description of Artificial Sequence: Synthetic oligonucleotide
  Target: SCN9A; (-) strand; PAM type: NRG; PAM sequence: GAG
ataaacatagatgcttatgt

SEQ ID NO: 36827 - DNA, 20 bp, Artificial Sequence
  Description of Artificial Sequence: Synthetic oligonucleotide
  Target: SCN9A; (-) strand; PAM type: NRG; PAM sequence: TAG
atattcttttaaaataaaca

SEQ ID NO: 36828 - DNA, 20 bp, Artificial Sequence
  Description of Artificial Sequence: Synthetic oligonucleotide
  Target: SCN9A; (-) strand; PAM type: NRG; PAM sequence: TAG
gaaatttgagggccagtcaa

SEQ ID NO: 36829 - DNA, 20 bp, Artificial Sequence
  Description of Artificial Sequence: Synthetic oligonucleotide
  Target: SCN9A; (-) strand; PAM type: NRG; PAM sequence: CAG
tctaacagaaatttgagggc

SEQ ID NO: 36830 - DNA, 20 bp, Artificial Sequence
  Description of Artificial Sequence: Synthetic oligonucleotide
  Target: SCN9A; (-) strand; PAM type: NRG; PAM sequence: GGG
atcatctaacagaaatttga

SEQ ID NO: 36831 - DNA, 20 bp, Artificial Sequence
  Description of Artificial Sequence: Synthetic oligonucleotide
  Target: SCN9A; (-) strand; PAM type: NRG; PAM sequence: AGG
tatcatctaacagaaatttg

SEQ ID NO: 36832 - DNA, 20 bp, Artificial Sequence
  Description of Artificial Sequence: Synthetic oligonucleotide
  Target: SCN9A; (-) strand; PAM type: NRG; PAM sequence: GAG
gtatcatctaacagaaattt

SEQ ID NO: 36833 - DNA, 20 bp, Artificial Sequence
  Description of Artificial Sequence: Synthetic oligonucleotide
  Target: SCN9A; (-) strand; PAM type: NRG; PAM sequence: CAG
tttaaatctgtatcatctaa

SEQ ID NO: 36834 - DNA, 20 bp, Artificial Sequence
  Description of Artificial Sequence: Synthetic oligonucleotide
  Target: SCN9A; (-) strand; PAM type: NRG; PAM sequence: AGG
tctaaaatgataaccttgtt

SEQ ID NO: 36835 - DNA, 20 bp, Artificial Sequence
  Description of Artificial Sequence: Synthetic oligonucleotide
  Target: SCN9A; (-) strand; PAM type: NRG; PAM sequence: TAG
atctaaaatgataaccttgt

SEQ ID NO: 36836 - DNA, 20 bp, Artificial Sequence
  Description of Artificial Sequence: Synthetic oligonucleotide
  Target: SCN9A; (-) strand; PAM type: NRG; PAM sequence: AAG
gcataaactaatatggttat

SEQ ID NO: 36837 - DNA, 20 bp, Artificial Sequence
  Description of Artificial Sequence: Synthetic oligonucleotide
  Target: SCN9A; (-) strand; PAM type: NRG; PAM sequence: TGG
ttggattgcataaactaata

SEQ ID NO: 36838 - DNA, 20 bp, Artificial Sequence
  Description of Artificial Sequence: Synthetic oligonucleotide
  Target: SCN9A; (-) strand; PAM type: NRG; PAM sequence: TGG
aatatattttaagaaaaaat

SEQ ID NO: 36839 - DNA, 20 bp, Artificial Sequence
  Description of Artificial Sequence: Synthetic oligonucleotide
  Target: SCN9A; (-) strand; PAM type: NRG; PAM sequence: AAG
aatgtattaaaatatatttt

SEQ ID NO: 36840 - DNA, 20 bp, Artificial Sequence
  Description of Artificial Sequence: Synthetic oligonucleotide
  Target: SCN9A; (-) strand; PAM type: NRG; PAM sequence: CAG
gtaatgcattcttagaaagg

SEQ ID NO: 36841 - DNA, 20 bp, Artificial Sequence
  Description of Artificial Sequence: Synthetic oligonucleotide
  Target: SCN9A; (-) strand; PAM type: NRG; PAM sequence: AGG
tttgtaatgcattcttagaa

SEQ ID NO: 36842 - DNA, 20 bp, Artificial Sequence
  Description of Artificial Sequence: Synthetic oligonucleotide
  Target: SCN9A; (-) strand; PAM type: NRG; PAM sequence: AAG
atttgtaatgcattcttaga

SEQ ID NO: 36843 - DNA, 20 bp, Artificial Sequence
  Description of Artificial Sequence: Synthetic oligonucleotide
  Target: SCN9A; (-) strand; PAM type: NRG; PAM sequence: TAG
agtaatttgtaatgcattct

SEQ ID NO: 36844 - DNA, 20 bp, Artificial Sequence
  Description of Artificial Sequence: Synthetic oligonucleotide
  Target: SCN9A; (-) strand; PAM type: NRG; PAM sequence: AAG
gtgataatgtacttaaaggt

SEQ ID NO: 36845 - DNA, 20 bp, Artificial Sequence
  Description of Artificial Sequence: Synthetic oligonucleotide
  Target: SCN9A; (-) strand; PAM type: NRG; PAM sequence: AGG
gtaggtgataatgtacttaa

SEQ ID NO: 36846 - DNA, 20 bp, Artificial Sequence
  Description of Artificial Sequence: Synthetic oligonucleotide
  Target: SCN9A; (-) strand; PAM type: NRG; PAM sequence: AAG
tgtaggtgataatgtactta

SEQ ID NO: 36847 - DNA, 20 bp, Artificial Sequence
  Description of Artificial Sequence: Synthetic oligonucleotide
  Target: SCN9A; (-) strand; PAM type: NRG; PAM sequence: AGG
attctctcttttatcagtgt

SEQ ID NO: 36848 - DNA, 20 bp, Artificial Sequence
  Description of Artificial Sequence: Synthetic oligonucleotide
  Target: SCN9A; (-) strand; PAM type: NRG; PAM sequence: TAG
tattctctcttttatcagtg

SEQ ID NO: 36849 - DNA, 20 bp, Artificial Sequence
  Description of Artificial Sequence: Synthetic oligonucleotide
  Target: SCN9A; (-) strand; PAM type: NRG; PAM sequence: CAG
agatgtattctctcttttat

SEQ ID NO: 36850 - DNA, 20 bp, Artificial Sequence
  Description of Artificial Sequence: Synthetic oligonucleotide
  Target: SCN9A; (-) strand; PAM type: NRG; PAM sequence: GAG
aggtaaaattaaaatatcct

SEQ ID NO: 36851 - DNA, 20 bp, Artificial Sequence
  Description of Artificial Sequence: Synthetic oligonucleotide
  Target: SCN9A; (-) strand; PAM type: NRG; PAM sequence: AGG
atcatggtatgatattgagg

SEQ ID NO: 36852 - DNA, 20 bp, Artificial Sequence
  Description of Artificial Sequence: Synthetic oligonucleotide
  Target: SCN9A; (-) strand; PAM type: NRG; PAM sequence: GAG
tatcatggtatgatattgag

SEQ ID NO: 36853 - DNA, 20 bp, Artificial Sequence
  Description of Artificial Sequence: Synthetic oligonucleotide
  Target: SCN9A; (-) strand; PAM type: NRG; PAM sequence: AGG
aatatcatggtatgatattg

SEQ ID NO: 36854 - DNA, 20 bp, Artificial Sequence
  Description of Artificial Sequence: Synthetic oligonucleotide
  Target: SCN9A; (-) strand; PAM type: NRG; PAM sequence: GAG
caatatcatggtatgatatt

SEQ ID NO: 36855 - DNA, 20 bp, Artificial Sequence
  Description of Artificial Sequence: Synthetic oligonucleotide
  Target: SCN9A; (-) strand; PAM type: NRG; PAM sequence: TGG
ttagtatttttacaatatca

SEQ ID NO: 36856 - DNA, 20 bp, Artificial Sequence
  Description of Artificial Sequence: Synthetic oligonucleotide
  Target: SCN9A; (-) strand; PAM type: NRG; PAM sequence: TAG
ttttttatttgtcaagcatt

SEQ ID NO: 36857 - DNA, 20 bp, Artificial Sequence
  Description of Artificial Sequence: Synthetic oligonucleotide
  Target: SCN9A; (-) strand; PAM type: NRG; PAM sequence: AAG
gattctattttttatttgtc

SEQ ID NO: 36858 - DNA, 20 bp, Artificial Sequence
  Description of Artificial Sequence: Synthetic oligonucleotide
  Target: SCN9A; (-) strand; PAM type: NRG; PAM sequence: TGG
agaataaagcatattaaccc

SEQ ID NO: 36859 - DNA, 20 bp, Artificial Sequence
  Description of Artificial Sequence: Synthetic oligonucleotide
  Target: SCN9A; (-) strand; PAM type: NRG; PAM sequence: AAG
atatggattcttccagaata

SEQ ID NO: 36860 - DNA, 20 bp, Artificial Sequence
  Description of Artificial Sequence: Synthetic oligonucleotide
  Target: SCN9A; (-) strand; PAM type: NRG; PAM sequence: CAG
tacaaaaatatggattcttc

SEQ ID NO: 36861 - DNA, 20 bp, Artificial Sequence
  Description of Artificial Sequence: Synthetic oligonucleotide
  Target: SCN9A; (-) strand; PAM type: NRG; PAM sequence: TGG
aataataaaatacaaaaata

SEQ ID NO: 36862 - DNA, 20 bp, Artificial Sequence
  Description of Artificial Sequence: Synthetic oligonucleotide
  Target: SCN9A; (-) strand; PAM type: NRG; PAM sequence: TAG
atcaagtagtagggggttcg

SEQ ID NO: 36863 - DNA, 20 bp, Artificial Sequence
  Description of Artificial Sequence: Synthetic oligonucleotide
  Target: SCN9A; (-) strand; PAM type: NRG; PAM sequence: GGG
gcctggcatcaagtagtagg

SEQ ID NO: 36864 - DNA, 20 bp, Artificial Sequence
  Description of Artificial Sequence: Synthetic oligonucleotide
  Target: SCN9A; (-) strand; PAM type: NRG; PAM sequence: GGG
tgcctggcatcaagtagtag

SEQ ID NO: 36865 - DNA, 20 bp, Artificial Sequence
  Description of Artificial Sequence: Synthetic oligonucleotide
  Target: SCN9A; (-) strand; PAM type: NRG; PAM sequence: GGG
gtgcctggcatcaagtagta

SEQ ID NO: 36866 - DNA, 20 bp, Artificial Sequence
  Description of Artificial Sequence: Synthetic oligonucleotide
  Target: SCN9A; (-) strand; PAM type: NRG; PAM sequence: AGG
agtgcctggcatcaagtagt

SEQ ID NO: 36867 - DNA, 20 bp, Artificial Sequence
  Description of Artificial Sequence: Synthetic oligonucleotide
  Target: SCN9A; (-) strand; PAM type: NRG; PAM sequence: TAG
tagtgcctggcatcaagtag

SEQ ID NO: 36868 - DNA, 20 bp, Artificial Sequence
  Description of Artificial Sequence: Synthetic oligonucleotide
  Target: SCN9A; (-) strand; PAM type: NRG; PAM sequence: TAG
gaatagtgcctggcatcaag

SEQ ID NO: 36869 - DNA, 20 bp, Artificial Sequence
  Description of Artificial Sequence: Synthetic oligonucleotide
  Target: SCN9A; (-) strand; PAM type: NRG; PAM sequence: AAG
ccagaatagtgcctggcatc

SEQ ID NO: 36870 - DNA, 20 bp, Artificial Sequence
  Description of Artificial Sequence: Synthetic oligonucleotide
  Target: SCN9A; (-) strand; PAM type: NRG; PAM sequence: TGG
ttagcttccagaatagtgcc

SEQ ID NO: 36871 - DNA, 20 bp, Artificial Sequence
  Description of Artificial Sequence: Synthetic oligonucleotide
  Target: SCN9A; (-) strand; PAM type: NRG; PAM sequence: TAG
tgttgacttagcttccagaa

SEQ ID NO: 36872 - DNA, 20 bp, Artificial Sequence
  Description of Artificial Sequence: Synthetic oligonucleotide
  Target: SCN9A; (-) strand; PAM type: NRG; PAM sequence: CAG
ttcattgttgacttagcttc

SEQ ID NO: 36873 - DNA, 20 bp, Artificial Sequence
  Description of Artificial Sequence: Synthetic oligonucleotide
  Target: SCN9A; (-) strand; PAM type: NRG; PAM sequence: TAG
ctatgtcttcattgttgact

SEQ ID NO: 36874 - DNA, 20 bp, Artificial Sequence
  Description of Artificial Sequence: Synthetic oligonucleotide
  Target: SCN9A; (-) strand; PAM type: NRG; PAM sequence: CAG
ccaaatactccaagggaacc

SEQ ID NO: 36875 - DNA, 20 bp, Artificial Sequence
  Description of Artificial Sequence: Synthetic oligonucleotide
  Target: SCN9A; (-) strand; PAM type: NRG; PAM sequence: GGG
ttgcataccaaatactccaa

SEQ ID NO: 36876 - DNA, 20 bp, Artificial Sequence
  Description of Artificial Sequence: Synthetic oligonucleotide
  Target: SCN9A; (-) strand; PAM type: NRG; PAM sequence: AGG
tttgcataccaaatactcca

SEQ ID NO: 36877 - DNA, 20 bp, Artificial Sequence
  Description of Artificial Sequence: Synthetic oligonucleotide
  Target: SCN9A; (-) strand; PAM type: NRG; PAM sequence: AAG
atttgcataccaaatactcc

SEQ ID NO: 36878 - DNA, 20 bp, Artificial Sequence
  Description of Artificial Sequence: Synthetic oligonucleotide
  Target: SCN9A; (-) strand; PAM type: NRG; PAM sequence: AGG
tactgcttgttacagcatgc

SEQ ID NO: 36879 - DNA, 20 bp, Artificial Sequence
  Description of Artificial Sequence: Synthetic oligonucleotide
  Target: SCN9A; (-) strand; PAM type: NRG; PAM sequence: CAG
atactgcttgttacagcatg

SEQ ID NO: 36880 - DNA, 20 bp, Artificial Sequence
  Description of Artificial Sequence: Synthetic oligonucleotide
  Target: SCN9A; (-) strand; PAM type: NRG; PAM sequence: CAG
ttctttcatactgcttgtta

SEQ ID NO: 36881 - DNA, 20 bp, Artificial Sequence
  Description of Artificial Sequence: Synthetic oligonucleotide
  Target: SCN9A; (-) strand; PAM type: NRG; PAM sequence: TGG
tcccgtgttggtcttgatgt

SEQ ID NO: 36882 - DNA, 20 bp, Artificial Sequence
  Description of Artificial Sequence: Synthetic oligonucleotide
  Target: SCN9A; (-) strand; PAM type: NRG; PAM sequence: TGG
aaaagtaggttgtcccgtgt

SEQ ID NO: 36883 - DNA, 20 bp, Artificial Sequence
  Description of Artificial Sequence: Synthetic oligonucleotide
  Target: SCN9A; (-) strand; PAM type: NRG; PAM sequence: AGG
ttgatcatcttgttaaaagt

SEQ ID NO: 36884 - DNA, 20 bp, Artificial Sequence
  Description of Artificial Sequence: Synthetic oligonucleotide
  Target: SCN9A; (-) strand; PAM type: NRG; PAM sequence: TAG
tttgatcatcttgttaaaag

SEQ ID NO: 36885 - DNA, 20 bp, Artificial Sequence
  Description of Artificial Sequence: Synthetic oligonucleotide
  Target: SCN9A; (-) strand; PAM type: NRG; PAM sequence: AAG
atttttgatcatcttgttaa

SEQ ID NO: 36886 - DNA, 20 bp, Artificial Sequence
  Description of Artificial Sequence: Synthetic oligonucleotide
  Target: SCN9A; (-) strand; PAM type: NRG; PAM sequence: AAG
cgaggtttttttgttttgga

SEQ ID NO: 36887 - DNA, 20 bp, Artificial Sequence
  Description of Artificial Sequence: Synthetic oligonucleotide
  Target: SCN9A; (-) strand; PAM type: NRG; PAM sequence: TGG
aactcgaggtttttttgttt

SEQ ID NO: 36888 - DNA, 20 bp, Artificial Sequence
  Description of Artificial Sequence: Synthetic oligonucleotide
  Target: SCN9A; (-) strand; PAM type: NRG; PAM sequence: AGG
aaactttaaatctcaactcg

SEQ ID NO: 36889 - DNA, 20 bp, Artificial Sequence
  Description of Artificial Sequence: Synthetic oligonucleotide
  Target: SCN9A; (-) strand; PAM type: NRG; PAM sequence: GAG
taaactttaaatctcaactc

SEQ ID NO: 36890 - DNA, 20 bp, Artificial Sequence
  Description of Artificial Sequence: Synthetic oligonucleotide
  Target: SCN9A; (-) strand; PAM type: NRG; PAM sequence: AGG
tgaaacaatagcactcttta

SEQ ID NO: 36891 - DNA, 20 bp, Artificial Sequence
  Description of Artificial Sequence: Synthetic oligonucleotide
  Target: SCN9A; (-) strand; PAM type: NRG; PAM sequence: AAG
atgaaacaatagcactcttt

SEQ ID NO: 36892 - DNA, 20 bp, Artificial Sequence
  Description of Artificial Sequence: Synthetic oligonucleotide
  Target: SCN9A; (-) strand; PAM type: NRG; PAM sequence: TAG
ggctaaaacacatgaaacaa

SEQ ID NO: 36893 - DNA, 20 bp, Artificial Sequence
  Description of Artificial Sequence: Synthetic oligonucleotide
  Target: SCN9A; (-) strand; PAM type: NRG; PAM sequence: TGG
aggtgctcctgcccaggtcg

SEQ ID NO: 36894 - DNA, 20 bp, Artificial Sequence
  Description of Artificial Sequence: Synthetic oligonucleotide
  Target: SCN9A; (-) strand; PAM type: NRG; PAM sequence: AGG
tcattaaggtgctcctgccc

SEQ ID NO: 36895 - DNA, 20 bp, Artificial Sequence
  Description of Artificial Sequence: Synthetic oligonucleotide
  Target: SCN9A; (-) strand; PAM type: NRG; PAM sequence: CAG
ctcattaaggtgctcctgcc

SEQ ID NO: 36896 - DNA, 20 bp, Artificial Sequence
  Description of Artificial Sequence: Synthetic oligonucleotide
  Target: SCN9A; (-) strand; PAM type: NRG; PAM sequence: AGG
aacctattctcttctcatta

SEQ ID NO: 36897 - DNA, 20 bp, Artificial Sequence
  Description of Artificial Sequence: Synthetic oligonucleotide
  Target: SCN9A; (-) strand; PAM type: NRG; PAM sequence: AAG
gaacctattctcttctcatt

SEQ ID NO: 36898 - DNA, 20 bp, Artificial Sequence
  Description of Artificial Sequence: Synthetic oligonucleotide
  Target: SCN9A; (-) strand; PAM type: NRG; PAM sequence: CAG
tcccttctctccaacctcac

SEQ ID NO: 36899 - DNA, 20 bp, Artificial Sequence
  Description of Artificial Sequence: Synthetic oligonucleotide
  Target: SCN9A; (-) strand; PAM type: NRG; PAM sequence: TGG
aaatgcctttcctcagcata

SEQ ID NO: 36900 - DNA, 20 bp, Artificial Sequence
  Description of Artificial Sequence: Synthetic oligonucleotide
  Target: SCN9A; (-) strand; PAM type: NRG; PAM sequence: CAG
caacagtaaatgcctttcct

SEQ ID NO: 36901 - DNA, 20 bp, Artificial Sequence
  Description of Artificial Sequence: Synthetic oligonucleotide
  Target: SCN9A; (-) strand; PAM type: NRG; PAM sequence: CAG
cagagaccaattagcaacaa

SEQ ID NO: 36902 - DNA, 20 bp, Artificial Sequence
  Description of Artificial Sequence: Synthetic oligonucleotide
  Target: SCN9A; (-) strand; PAM type: NRG; PAM sequence: TAG
atggcaacacagagaccaat

SEQ ID NO: 36903 - DNA, 20 bp, Artificial Sequence
  Description of Artificial Sequence: Synthetic oligonucleotide
  Target: SCN9A; (-) strand; PAM type: NRG; PAM sequence: GAG
gaaataaacatggcaacaca

SEQ ID NO: 36904 - DNA, 20 bp, Artificial Sequence
  Description of Artificial Sequence: Synthetic oligonucleotide
  Target: SCN9A; (-) strand; PAM type: NRG; PAM sequence: CAG
aagaaataaacatggcaaca

SEQ ID NO: 36905 - DNA, 20 bp, Artificial Sequence
  Description of Artificial Sequence: Synthetic oligonucleotide
  Target: SCN9A; (-) strand; PAM type: NRG; PAM sequence: TGG
aggagaagaagaaataaaca

SEQ ID NO: 36906 - DNA, 20 bp, Artificial Sequence
  Description of Artificial Sequence: Synthetic oligonucleotide
  Target: SCN9A; (-) strand; PAM type: NRG; PAM sequence: AAG
aggaagaagaagaggagaag

SEQ ID NO: 36907 - DNA, 20 bp, Artificial Sequence
  Description of Artificial Sequence: Synthetic oligonucleotide
  Target: SCN9A; (-) strand; PAM type: NRG; PAM sequence: AAG
aagaggaagaagaagaggag

SEQ ID NO: 36908 - DNA, 20 bp, Artificial Sequence
  Description of Artificial Sequence: Synthetic oligonucleotide
  Target: SCN9A; (-) strand; PAM type: NRG; PAM sequence: GAG
aaaaagaggaagaagaagag

SEQ ID NO: 36909 - DNA, 20 bp, Artificial Sequence
  Description of Artificial Sequence: Synthetic oligonucleotide
  Target: SCN9A; (-) strand; PAM type: NRG; PAM sequence: AGG
aaaaaaagaggaagaagaag

SEQ ID NO: 36910 - DNA, 20 bp, Artificial Sequence
  Description of Artificial Sequence: Synthetic oligonucleotide
  Target: SCN9A; (-) strand; PAM type: NRG; PAM sequence: GAG
aaaaaaaagaggaagaagaa

SEQ ID NO: 36911 - DNA, 20 bp, Artificial Sequence
  Description of Artificial Sequence: Synthetic oligonucleotide
  Target: SCN9A; (-) strand; PAM type: NRG; PAM sequence: AAG
aaaaaaaaaagaggaagaag

SEQ ID NO: 36912 - DNA, 20 bp, Artificial Sequence
  Description of Artificial Sequence: Synthetic oligonucleotide
  Target: SCN9A; (-) strand; PAM type: NRG; PAM sequence: AAG
aaaaaaaaaaaaagaggaag

SEQ ID NO: 36913 - DNA, 20 bp, Artificial Sequence
  Description of Artificial Sequence: Synthetic oligonucleotide
  Target: SCN9A; (-) strand; PAM type: NRG; PAM sequence: AAG
taaaaaaaaaaaaaaagagg

SEQ ID NO: 36914 - DNA, 20 bp, Artificial Sequence
  Description of Artificial Sequence: Synthetic oligonucleotide
  Target: SCN9A; (-) strand; PAM type: NRG; PAM sequence: AGG
atttaaaaaaaaaaaaaaag

SEQ ID NO: 36915 - DNA, 20 bp, Artificial Sequence
  Description of Artificial Sequence: Synthetic oligonucleotide
  Target: SCN9A; (-) strand; PAM type: NRG; PAM sequence: GAG
catttaaaaaaaaaaaaaaa

SEQ ID NO: 36916 - DNA, 20 bp, Artificial Sequence
  Description of Artificial Sequence: Synthetic oligonucleotide
  Target: SCN9A; (-) strand; PAM type: NRG; PAM sequence: AAG
tgcatttaaaaaaaaaaaaa

SEQ ID NO: 36917 - DNA, 20 bp, Artificial Sequence
  Description of Artificial Sequence: Synthetic oligonucleotide
  Target: SCN9A; (-) strand; PAM type: NRG; PAM sequence: TGG
ctgtctcccctaacaaacat

SEQ ID NO: 36918 - DNA, 20 bp, Artificial Sequence
  Description of Artificial Sequence: Synthetic oligonucleotide
  Target: SCN9A; (-) strand; PAM type: NRG; PAM sequence: AAG
tgcaattcattctctataca

SEQ ID NO: 36919 - DNA, 20 bp, Artificial Sequence
  Description of Artificial Sequence: Synthetic oligonucleotide
  Target: SCN9A; (-) strand; PAM type: NRG; PAM sequence: CAG
atttacttggaatcctgcca

SEQ ID NO: 36920 - DNA, 20 bp, Artificial Sequence
  Description of Artificial Sequence: Synthetic oligonucleotide
  Target: SCN9A; (-) strand; PAM type: NRG; PAM sequence: TGG
ggtcatcatcataatttact

SEQ ID NO: 36921 - DNA, 20 bp, Artificial Sequence
  Description of Artificial Sequence: Synthetic oligonucleotide
  Target: SCN9A; (-) strand; PAM type: NRG; PAM sequence: AGG
cacggccaccaaattagttc

SEQ ID NO: 36922 - DNA, 20 bp, Artificial Sequence
  Description of Artificial Sequence: Synthetic oligonucleotide
  Target: SCN9A; (-) strand; PAM type: NRG; PAM sequence: CAG
acacggccaccaaattagtt

SEQ ID NO: 36923 - DNA, 20 bp, Artificial Sequence
  Description of Artificial Sequence: Synthetic oligonucleotide
  Target: SCN9A; (-) strand; PAM type: NRG; PAM sequence: TAG
tatctacacggccaccaaat

SEQ ID NO: 36924 - DNA, 20 bp, Artificial Sequence
  Description of Artificial Sequence: Synthetic oligonucleotide
  Target: SCN9A; (-) strand; PAM type: NRG; PAM sequence: CGG
ccctcttttctgtatctaca

SEQ ID NO: 36925 - DNA, 20 bp, Artificial Sequence
  Description of Artificial Sequence: Synthetic oligonucleotide
  Target: SCN9A; (-) strand; PAM type: NRG; PAM sequence: CAG
ttctatttcatcatacgtct

SEQ ID NO: 36926 - DNA, 20 bp, Artificial Sequence
  Description of Artificial Sequence: Synthetic oligonucleotide
  Target: SCN9A; (-) strand; PAM type: NRG; PAM sequence: TAG
agccctttccagcctgtaag

SEQ ID NO: 36927 - DNA, 20 bp, Artificial Sequence
  Description of Artificial Sequence: Synthetic oligonucleotide
  Target: SCN9A; (-) strand; PAM type: NRG; PAM sequence: AAG
ttcagccctttccagcctgt

SEQ ID NO: 36928 - DNA, 20 bp, Artificial Sequence
  Description of Artificial Sequence: Synthetic oligonucleotide
  Target: SCN9A; (-) strand; PAM type: NRG; PAM sequence: CAG
tactccatttcagccctttc

SEQ ID NO: 36929 - DNA, 20 bp, Artificial Sequence
  Description of Artificial Sequence: Synthetic oligonucleotide
  Target: SCN9A; (-) strand; PAM type: NRG; PAM sequence: CAG
tcttccttattactccattt

SEQ ID NO: 36930 - DNA, 20 bp, Artificial Sequence
  Description of Artificial Sequence: Synthetic oligonucleotide
  Target: SCN9A; (-) strand; PAM type: NRG; PAM sequence: AAG
aataaatgccttcaccatcc

SEQ ID NO: 36931 - DNA, 20 bp, Artificial Sequence
  Description of Artificial Sequence: Synthetic oligonucleotide
  Target: SCN9A; (-) strand; PAM type: NRG; PAM sequence: CAG
ctttccctaaaactctgtct

SEQ ID NO: 36932 - DNA, 20 bp, Artificial Sequence
  Description of Artificial Sequence: Synthetic oligonucleotide
  Target: SCN9A; (-) strand; PAM type: NRG; PAM sequence: TAG
ttgatgtaaatggaacattc

SEQ ID NO: 36933 - DNA, 20 bp, Artificial Sequence
  Description of Artificial Sequence: Synthetic oligonucleotide
  Target: SCN9A; (-) strand; PAM type: NRG; PAM sequence: TGG
ttaaagtttattgatgtaaa

SEQ ID NO: 36934 - DNA, 20 bp, Artificial Sequence
  Description of Artificial Sequence: Synthetic oligonucleotide
  Target: SCN9A; (-) strand; PAM type: NRG; PAM sequence: AAG
tgatcttgtaaaagagctta

SEQ ID NO: 36935 - DNA, 20 bp, Artificial Sequence
  Description of Artificial Sequence: Synthetic oligonucleotide
  Target: SCN9A; (-) strand; PAM type: NRG; PAM sequence: GAG
caagtcatgatcttgtaaaa

SEQ ID NO: 36936 - DNA, 20 bp, Artificial Sequence
  Description of Artificial Sequence: Synthetic oligonucleotide
  Target: SCN9A; (-) strand; PAM type: NRG; PAM sequence: AAG
gacaagtcatgatcttgtaa

SEQ ID NO: 36937 - DNA, 20 bp, Artificial Sequence
  Description of Artificial Sequence: Synthetic oligonucleotide
  Target: SCN9A; (-) strand; PAM type: NRG; PAM sequence: AAG
atatggtacttttctaagac

SEQ ID NO: 36938 - DNA, 20 bp, Artificial Sequence
  Description of Artificial Sequence: Synthetic oligonucleotide
  Target: SCN9A; (-) strand; PAM type: NRG; PAM sequence: AAG
gatttatatggtacttttct

SEQ ID NO: 36939 - DNA, 20 bp, Artificial Sequence
  Description of Artificial Sequence: Synthetic oligonucleotide
  Target: SCN9A; (-) strand; PAM type: NRG; PAM sequence: TGG
aagtgctagaaggatttata

SEQ ID NO: 36940 - DNA, 20 bp, Artificial Sequence
  Description of Artificial Sequence: Synthetic oligonucleotide
  Target: SCN9A; (-) strand; PAM type: NRG; PAM sequence: AGG
aaagagtgtgaagtgctaga

SEQ ID NO: 36941 - DNA, 20 bp, Artificial Sequence
  Description of Artificial Sequence: Synthetic oligonucleotide
  Target: SCN9A; (-) strand; PAM type: NRG; PAM sequence: AAG
aaaagagtgtgaagtgctag

SEQ ID NO: 36942 - DNA, 20 bp, Artificial Sequence
  Description of Artificial Sequence: Synthetic oligonucleotide
  Target: SCN9A; (-) strand; PAM type: NRG; PAM sequence: TAG
tgcaaaagagtgtgaagtgc

SEQ ID NO: 36943 - DNA, 20 bp, Artificial Sequence
  Description of Artificial Sequence: Synthetic oligonucleotide
  Target: SCN9A; (-) strand; PAM type: NRG; PAM sequence: AAG
tagttatgcaaaagagtgtg

SEQ ID NO: 36944 - DNA, 20 bp, Artificial Sequence
  Description of Artificial Sequence: Synthetic oligonucleotide
  Target: SCN9A; (-) strand; PAM type: NRG; PAM sequence: GAG
ttcctattagttatgcaaaa

SEQ ID NO: 36945 - DNA, 20 bp, Artificial Sequence
  Description of Artificial Sequence: Synthetic oligonucleotide
  Target: SCN9A; (-) strand; PAM type: NRG; PAM sequence: AAG
tattcctattagttatgcaa

SEQ ID NO: 36946 - DNA, 20 bp, Artificial Sequence
  Description of Artificial Sequence: Synthetic oligonucleotide
  Target: SCN9A; (-) strand; PAM type: NRG; PAM sequence: TAG
tatccaatttctattcctat

SEQ ID NO: 36947 - DNA, 20 bp, Artificial Sequence
  Description of Artificial Sequence: Synthetic oligonucleotide
  Target: SCN9A; (-) strand; PAM type: NRG; PAM sequence: TAG
ctctgtggcaaggaaaaaag

SEQ ID NO: 36948 - DNA, 20 bp, Artificial Sequence
  Description of Artificial Sequence: Synthetic oligonucleotide
  Target: SCN9A; (-) strand; PAM type: NRG; PAM sequence: AAG
tttctctgtggcaaggaaaa

SEQ ID NO: 36949 - DNA, 20 bp, Artificial Sequence
  Description of Artificial Sequence: Synthetic oligonucleotide
  Target: SCN9A; (-) strand; PAM type: NRG; PAM sequence: AGG
aacccactttctctgtggca

SEQ ID NO: 36950 - DNA, 20 bp, Artificial Sequence
  Description of Artificial Sequence: Synthetic oligonucleotide
  Target: SCN9A; (-) strand; PAM type: NRG; PAM sequence: AAG
caacccactttctctgtggc

SEQ ID NO: 36951 - DNA, 20 bp, Artificial Sequence
  Description of Artificial Sequence: Synthetic oligonucleotide
  Target: SCN9A; (-) strand; PAM type: NRG; PAM sequence: TGG
taatcaacccactttctctg

SEQ ID NO: 36952 - DNA, 20 bp, Artificial Sequence
  Description of Artificial Sequence: Synthetic oligonucleotide
  Target: SCN9A; (-) strand; PAM type: NRG; PAM sequence: GGG
attcagaagagcaatcagta

SEQ ID NO: 36953 - DNA, 20 bp, Artificial Sequence
  Description of Artificial Sequence: Synthetic oligonucleotide
  Target: SCN9A; (-) strand; PAM type: NRG; PAM sequence: AGG
aattcagaagagcaatcagt

SEQ ID NO: 36954 - DNA, 20 bp, Artificial Sequence
  Description of Artificial Sequence: Synthetic oligonucleotide
  Target: SCN9A; (-) strand; PAM type: NRG; PAM sequence: TAG
aaattcagaagagcaatcag

SEQ ID NO: 36955 - DNA, 20 bp, Artificial Sequence
  Description of Artificial Sequence: Synthetic oligonucleotide
  Target: SCN9A; (-) strand; PAM type: NRG; PAM sequence: CAG
aataaattcagaagagcaat

SEQ ID NO: 36956 - DNA, 20 bp, Artificial Sequence
  Description of Artificial Sequence: Synthetic oligonucleotide
  Target: SCN9A; (-) strand; PAM type: NRG; PAM sequence: GAG
acaaataaataaattcagaa

SEQ ID NO: 36957 - DNA, 20 bp, Artificial Sequence
  Description of Artificial Sequence: Synthetic oligonucleotide
  Target: SCN9A; (-) strand; PAM type: NRG; PAM sequence: AAG
aaacaaataaataaattcag

SEQ ID NO: 36958 - DNA, 20 bp, Artificial Sequence
  Description of Artificial Sequence: Synthetic oligonucleotide
  Target: SCN9A; (-) strand; PAM type: NRG; PAM sequence: CAG
gataaacaaataaataaatt

SEQ ID NO: 36959 - DNA, 20 bp, Artificial Sequence
  Description of Artificial Sequence: Synthetic oligonucleotide
  Target: SCN9A; (-) strand; PAM type: NRG; PAM sequence: TAG
gctgagtttcagaagcaaaa

SEQ ID NO: 36960 - DNA, 20 bp, Artificial Sequence
  Description of Artificial Sequence: Synthetic oligonucleotide
  Target: SCN9A; (-) strand; PAM type: NRG; PAM sequence: AAG
gttgctgtgctgagtttcag

SEQ ID NO: 36961 - DNA, 20 bp, Artificial Sequence
  Description of Artificial Sequence: Synthetic oligonucleotide
  Target: SCN9A; (-) strand; PAM type: NRG; PAM sequence: CAG
cctgttgctgtgctgagttt

SEQ ID NO: 36962 - DNA, 20 bp, Artificial Sequence
  Description of Artificial Sequence: Synthetic oligonucleotide
  Target: SCN9A; (-) strand; PAM type: NRG; PAM sequence: GAG
ttactacctgttgctgtgct

SEQ ID NO: 36963 - DNA, 20 bp, Artificial Sequence
  Description of Artificial Sequence: Synthetic oligonucleotide
  Target: SCN9A; (-) strand; PAM type: NRG; PAM sequence: TGG
taatcatgggagcccttctg

SEQ ID NO: 36964 - DNA, 20 bp, Artificial Sequence
  Description of Artificial Sequence: Synthetic oligonucleotide
  Target: SCN9A; (-) strand; PAM type: NRG; PAM sequence: GAG
gggcctgcatataatcatgg

SEQ ID NO: 36965 - DNA, 20 bp, Artificial Sequence
  Description of Artificial Sequence: Synthetic oligonucleotide
  Target: SCN9A; (-) strand; PAM type: NRG; PAM sequence: GGG
tagggcctgcatataatcat

SEQ ID NO: 36966 - DNA, 20 bp, Artificial Sequence
  Description of Artificial Sequence: Synthetic oligonucleotide
  Target: SCN9A; (-) strand; PAM type: NRG; PAM sequence: TGG
ctagggcctgcatataatca

SEQ ID NO: 36967 - DNA, 20 bp, Artificial Sequence
  Description of Artificial Sequence: Synthetic oligonucleotide
  Target: SCN9A; (-) strand; PAM type: NRG; PAM sequence: GGG
cttgggcctcctttccccta

SEQ ID NO: 36968 - DNA, 20 bp, Artificial Sequence
  Description of Artificial Sequence: Synthetic oligonucleotide
  Target: SCN9A; (-) strand; PAM type: NRG; PAM sequence: AGG
tcttgggcctcctttcccct

SEQ ID NO: 36969 - DNA, 20 bp, Artificial Sequence
  Description of Artificial Sequence: Synthetic oligonucleotide
  Target: SCN9A; (-) strand; PAM type: NRG; PAM sequence: TAG
atcttgggcctcctttcccc

SEQ ID NO: 36970 - DNA, 20 bp, Artificial Sequence
  Description of Artificial Sequence: Synthetic oligonucleotide
  Target: SCN9A; (-) strand; PAM type: NRG; PAM sequence: GGG
ctctctgccaaaagcatctt

SEQ ID NO: 36971 - DNA, 20 bp, Artificial Sequence
  Description of Artificial Sequence: Synthetic oligonucleotide
  Target: SCN9A; (-) strand; PAM type: NRG; PAM sequence: TGG
gctctctgccaaaagcatct

SEQ ID NO: 36972 - DNA, 20 bp, Artificial Sequence
  Description of Artificial Sequence: Synthetic oligonucleotide
  Target: SCN9A; (-) strand; PAM type: NRG; PAM sequence: AAG
caggtctggctctctgccaa

SEQ ID NO: 36973 - DNA, 20 bp, Artificial Sequence
  Description of Artificial Sequence: Synthetic oligonucleotide
  Target: SCN9A; (-) strand; PAM type: NRG; PAM sequence: TGG
gaagaaagatgagtcaggtc

SEQ ID NO: 36974 - DNA, 20 bp, Artificial Sequence
  Description of Artificial Sequence: Synthetic oligonucleotide
  Target: SCN9A; (-) strand; PAM type: NRG; PAM sequence: AGG
ctacagaagaaagatgagtc

SEQ ID NO: 36975 - DNA, 20 bp, Artificial Sequence
  Description of Artificial Sequence: Synthetic oligonucleotide
  Target: SCN9A; (-) strand; PAM type: NRG; PAM sequence: CAG
tctacagaagaaagatgagt

SEQ ID NO: 36976 - DNA, 20 bp, Artificial Sequence
  Description of Artificial Sequence: Synthetic oligonucleotide
  Target: SCN9A; (-) strand; PAM type: NRG; PAM sequence: GAG
tgcttctacagaagaaagat

SEQ ID NO: 36977 - DNA, 20 bp, Artificial Sequence
  Description of Artificial Sequence: Synthetic oligonucleotide
  Target: SCN9A; (-) strand; PAM type: NRG; PAM sequence: AAG
cctgatgcttctacagaaga

SEQ ID NO: 36978 - DNA, 20 bp, Artificial Sequence
  Description of Artificial Sequence: Synthetic oligonucleotide
  Target: SCN9A; (-) strand; PAM type: NRG; PAM sequence: AAG
agtacctgatgcttctacag

SEQ ID NO: 36979 - DNA, 20 bp, Artificial Sequence
  Description of Artificial Sequence: Synthetic oligonucleotide
  Target: SCN9A; (-) strand; PAM type: NRG; PAM sequence: CAG
cagagtacctgatgcttcta

SEQ ID NO: 36980 - DNA, 20 bp, Artificial Sequence
  Description of Artificial Sequence: Synthetic oligonucleotide
  Target: SCN9A; (-) strand; PAM type: NRG; PAM sequence: GAG
ggtgcagggctaggctcaca

SEQ ID NO: 36981 - DNA, 20 bp, Artificial Sequence
  Description of Artificial Sequence: Synthetic oligonucleotide
  Target: SCN9A; (-) strand; PAM type: NRG; PAM sequence: CAG
atggtgcagggctaggctca

SEQ ID NO: 36982 - DNA, 20 bp, Artificial Sequence
  Description of Artificial Sequence: Synthetic oligonucleotide
  Target: SCN9A; (-) strand; PAM type: NRG; PAM sequence: AGG
gattcctatggtgcagggct

SEQ ID NO: 36983 - DNA, 20 bp, Artificial Sequence
  Description of Artificial Sequence: Synthetic oligonucleotide
  Target: SCN9A; (-) strand; PAM type: NRG; PAM sequence: TAG
tgattcctatggtgcagggc

SEQ ID NO: 36984 - DNA, 20 bp, Artificial Sequence
  Description of Artificial Sequence: Synthetic oligonucleotide
  Target: SCN9A; (-) strand; PAM type: NRG; PAM sequence: GGG
gccttgattcctatggtgca

SEQ ID NO: 36985 - DNA, 20 bp, Artificial Sequence
  Description of Artificial Sequence: Synthetic oligonucleotide
  Target: SCN9A; (-) strand; PAM type: NRG; PAM sequence: AGG
tgccttgattcctatggtgc

SEQ ID NO: 36986 - DNA, 20 bp, Artificial Sequence
  Description of Artificial Sequence: Synthetic oligonucleotide
  Target: SCN9A; (-) strand; PAM type: NRG; PAM sequence: CAG
atgccttgattcctatggtg

SEQ ID NO: 36987 - DNA, 20 bp, Artificial Sequence
  Description of Artificial Sequence: Synthetic oligonucleotide
  Target: SCN9A; (-) strand; PAM type: NRG; PAM sequence: TGG
atgatatgccttgattccta

SEQ ID NO: 36988 - DNA, 20 bp, Artificial Sequence
  Description of Artificial Sequence: Synthetic oligonucleotide
  Target: SCN9A; (-) strand; PAM type: NRG; PAM sequence: TGG
tgatgtgtttttacagtgac

SEQ ID NO: 36989 - DNA, 20 bp, Artificial Sequence
  Description of Artificial Sequence: Synthetic oligonucleotide
  Target: SCN9A; (-) strand; PAM type: NRG; PAM sequence: CAG
gactcagtgatgtgttttta

SEQ ID NO: 36990 - DNA, 20 bp, Artificial Sequence
  Description of Artificial Sequence: Synthetic oligonucleotide
  Target: SCN9A; (-) strand; PAM type: NRG; PAM sequence: CAG
cactgtgcagttgtgggact

SEQ ID NO: 36991 - DNA, 20 bp, Artificial Sequence
  Description of Artificial Sequence: Synthetic oligonucleotide
  Target: SCN9A; (-) strand; PAM type: NRG; PAM sequence: GGG
gtaagccactgtgcagttgt

SEQ ID NO: 36992 - DNA, 20 bp, Artificial Sequence
  Description of Artificial Sequence: Synthetic oligonucleotide
  Target: SCN9A; (-) strand; PAM type: NRG; PAM sequence: TGG
agtaagccactgtgcagttg

SEQ ID NO: 36993 - DNA, 20 bp, Artificial Sequence
  Description of Artificial Sequence: Synthetic oligonucleotide
  Target: SCN9A; (-) strand; PAM type: NRG; PAM sequence: CAG
tccttaagtaagccactgtg

SEQ ID NO: 36994 - DNA, 20 bp, Artificial Sequence
  Description of Artificial Sequence: Synthetic oligonucleotide
  Target: SCN9A; (-) strand; PAM type: NRG; PAM sequence: AAG
aaaaggaggtttccttaagt

SEQ ID NO: 36995 - DNA, 20 bp, Artificial Sequence
  Description of Artificial Sequence: Synthetic oligonucleotide
  Target: SCN9A; (-) strand; PAM type: NRG; PAM sequence: AAG
gtttaaaaggaggtttcctt

SEQ ID NO: 36996 - DNA, 20 bp, Artificial Sequence
  Description of Artificial Sequence: Synthetic oligonucleotide
  Target: SCN9A; (-) strand; PAM type: NRG; PAM sequence: AGG
ttttgtagaggtttaaaagg

SEQ ID NO: 36997 - DNA, 20 bp, Artificial Sequence
  Description of Artificial Sequence: Synthetic oligonucleotide
  Target: SCN9A; (-) strand; PAM type: NRG; PAM sequence: GAG
attttgtagaggtttaaaag

SEQ ID NO: 36998 - DNA, 20 bp, Artificial Sequence
  Description of Artificial Sequence: Synthetic oligonucleotide
  Target: SCN9A; (-) strand; PAM type: NRG; PAM sequence: AGG
aaattttgtagaggtttaaa

SEQ ID NO: 36999 - DNA, 20 bp, Artificial Sequence
  Description of Artificial Sequence: Synthetic oligonucleotide
  Target: SCN9A; (-) strand; PAM type: NRG; PAM sequence: AAG
aaaattttgtagaggtttaa

SEQ ID NO: 37000 - DNA, 20 bp, Artificial Sequence
  Description of Artificial Sequence: Synthetic oligonucleotide
  Target: SCN9A; (-) strand; PAM type: NRG; PAM sequence: AGG
agttttttaaaattttgtag

SEQ ID NO: 37001 - DNA, 20 bp, Artificial Sequence
  Description of Artificial Sequence: Synthetic oligonucleotide
  Target: SCN9A; (-) strand; PAM type: NRG; PAM sequence: GAG
aagttttttaaaattttgta

SEQ ID NO: 37002 - DNA, 20 bp, Artificial Sequence
  Description of Artificial Sequence: Synthetic oligonucleotide
  Target: SCN9A; (-) strand; PAM type: NRG; PAM sequence: TAG
acaagttttttaaaattttg

SEQ ID NO: 37003 - DNA, 20 bp, Artificial Sequence
  Description of Artificial Sequence: Synthetic oligonucleotide
  Target: SCN9A; (-) strand; PAM type: NRG; PAM sequence: AAG
ctgatagtttggcttaagac

SEQ ID NO: 37004 - DNA, 20 bp, Artificial Sequence
  Description of Artificial Sequence: Synthetic oligonucleotide
  Target: SCN9A; (-) strand; PAM type: NRG; PAM sequence: AAG
ggcaactgatagtttggctt

SEQ ID NO: 37005 - DNA, 20 bp, Artificial Sequence
  Description of Artificial Sequence: Synthetic oligonucleotide
  Target: SCN9A; (-) strand; PAM type: NRG; PAM sequence: TGG
tatttaggcaactgatagtt

SEQ ID NO: 37006 - DNA, 20 bp, Artificial Sequence
  Description of Artificial Sequence: Synthetic oligonucleotide
  Target: SCN9A; (-) strand; PAM type: NRG; PAM sequence: TAG
ccctctatttaggcaactga

SEQ ID NO: 37007 - DNA, 20 bp, Artificial Sequence
  Description of Artificial Sequence: Synthetic oligonucleotide
  Target: SCN9A; (-) strand; PAM type: NRG; PAM sequence: AGG
gaagaatgtgccctctattt

SEQ ID NO: 37008 - DNA, 20 bp, Artificial Sequence
  Description of Artificial Sequence: Synthetic oligonucleotide
  Target: SCN9A; (-) strand; PAM type: NRG; PAM sequence: TAG
agaagaatgtgccctctatt

SEQ ID NO: 37009 - DNA, 20 bp, Artificial Sequence
  Description of Artificial Sequence: Synthetic oligonucleotide
  Target: SCN9A; (-) strand; PAM type: NRG; PAM sequence: AAG
atatggtatttgatgtaaag

SEQ ID NO: 37010 - DNA, 20 bp, Artificial Sequence
  Description of Artificial Sequence: Synthetic oligonucleotide
  Target: SCN9A; (-) strand; PAM type: NRG; PAM sequence: AAG
agaatatggtatttgatgta

SEQ ID NO: 37011 - DNA, 20 bp, Artificial Sequence
  Description of Artificial Sequence: Synthetic oligonucleotide
  Target: SCN9A; (-) strand; PAM type: NRG; PAM sequence: TGG
acaaaactctagacagaata

SEQ ID NO: 37012 - DNA, 20 bp, Artificial Sequence
  Description of Artificial Sequence: Synthetic oligonucleotide
  Target: SCN9A; (-) strand; PAM type: NRG; PAM sequence: CAG
atcaacaacaaaactctaga

SEQ ID NO: 37013 - DNA, 20 bp, Artificial Sequence
  Description of Artificial Sequence: Synthetic oligonucleotide
  Target: SCN9A; (-) strand; PAM type: NRG; PAM sequence: TAG
gcttatcaacaacaaaactc

SEQ ID NO: 37014 - DNA, 20 bp, Artificial Sequence
  Description of Artificial Sequence: Synthetic oligonucleotide
  Target: SCN9A; (-) strand; PAM type: NRG; PAM sequence: TAG
aattttcatgattgttagac

SEQ ID NO: 37015 - DNA, 20 bp, Artificial Sequence
  Description of Artificial Sequence: Synthetic oligonucleotide
  Target: SCN9A; (-) strand; PAM type: NRG; PAM sequence: TAG
tcgcaaattttcatgattgt

SEQ ID NO: 37016 - DNA, 20 bp, Artificial Sequence
  Description of Artificial Sequence: Synthetic oligonucleotide
  Target: SCN9A; (-) strand; PAM type: NRG; PAM sequence: TAG
ttattgattagtttgaaagc

SEQ ID NO: 37017 - DNA, 20 bp, Artificial Sequence
  Description of Artificial Sequence: Synthetic oligonucleotide
  Target: SCN9A; (-) strand; PAM type: NRG; PAM sequence: AAG
aaaattattgattagtttga

SEQ ID NO: 37018 - DNA, 20 bp, Artificial Sequence
  Description of Artificial Sequence: Synthetic oligonucleotide
  Target: SCN9A; (-) strand; PAM type: NRG; PAM sequence: TAG
attttttaaaaattattgat

SEQ ID NO: 37019 - DNA, 20 bp, Artificial Sequence
  Description of Artificial Sequence: Synthetic oligonucleotide
  Target: SCN9A; (-) strand; PAM type: NRG; PAM sequence: GAG
ttttttcttataattatggt

SEQ ID NO: 37020 - DNA, 20 bp, Artificial Sequence
  Description of Artificial Sequence: Synthetic oligonucleotide
  Target: SCN9A; (-) strand; PAM type: NRG; PAM sequence: TGG
ataattttttcttataatta

SEQ ID NO: 37021 - DNA, 20 bp, Artificial Sequence
  Description of Artificial Sequence: Synthetic oligonucleotide
  Target: SCN9A; (-) strand; PAM type: NRG; PAM sequence: AAG
attttttccactatttaaaa

SEQ ID NO: 37022 - DNA, 20 bp, Artificial Sequence
  Description of Artificial Sequence: Synthetic oligonucleotide
  Target: SCN9A; (-) strand; PAM type: NRG; PAM sequence: CAG
tcattttattgcaaattctt

SEQ ID NO: 37023 - DNA, 20 bp, Artificial Sequence
  Description of Artificial Sequence: Synthetic oligonucleotide
  Target: SCN9A; (-) strand; PAM type: NRG; PAM sequence: AAG
tcttccctgtagacaagata

SEQ ID NO: 37024 - DNA, 20 bp, Artificial Sequence
  Description of Artificial Sequence: Synthetic oligonucleotide
  Target: SCN9A; (-) strand; PAM type: NRG; PAM sequence: AAG
atttcttcttccctgtagac

SEQ ID NO: 37025 - DNA, 20 bp, Artificial Sequence
  Description of Artificial Sequence: Synthetic oligonucleotide
  Target: SCN9A; (-) strand; PAM type: NRG; PAM sequence: TAG
tttctatttcttcttccctg

SEQ ID NO: 37026 - DNA, 20 bp, Artificial Sequence
  Description of Artificial Sequence: Synthetic oligonucleotide
  Target: SCN9A; (-) strand; PAM type: NRG; PAM sequence: CAG
ttgggaagttcagttctttt

SEQ ID NO: 37027 - DNA, 20 bp, Artificial Sequence
  Description of Artificial Sequence: Synthetic oligonucleotide
  Target: SCN9A; (-) strand; PAM type: NRG; PAM sequence: CAG
gaagtcagtgttgggaagtt

SEQ ID NO: 37028 - DNA, 20 bp, Artificial Sequence
  Description of Artificial Sequence: Synthetic oligonucleotide
  Target: SCN9A; (-) strand; PAM type: NRG; PAM sequence: AAG
aataggaagtcagtgttggg

SEQ ID NO: 37029 - DNA, 20 bp, Artificial Sequence
  Description of Artificial Sequence: Synthetic oligonucleotide
  Target: SCN9A; (-) strand; PAM type: NRG; PAM sequence: GGG
ctgaataggaagtcagtgtt

SEQ ID NO: 37030 - DNA, 20 bp, Artificial Sequence
  Description of Artificial Sequence: Synthetic oligonucleotide
  Target: SCN9A; (-) strand; PAM type: NRG; PAM sequence: TGG
actgaataggaagtcagtgt

SEQ ID NO: 37031 - DNA, 20 bp, Artificial Sequence
  Description of Artificial Sequence: Synthetic oligonucleotide
  Target: SCN9A; (-) strand; PAM type: NRG; PAM sequence: CAG
tcagttactgaataggaagt

SEQ ID NO: 37032 - DNA, 20 bp, Artificial Sequence
  Description of Artificial Sequence: Synthetic oligonucleotide
  Target: SCN9A; (-) strand; PAM type: NRG; PAM sequence: AAG
cttgtcagttactgaatagg

SEQ ID NO: 37033 - DNA, 20 bp, Artificial Sequence
  Description of Artificial Sequence: Synthetic oligonucleotide
  Target: SCN9A; (-) strand; PAM type: NRG; PAM sequence: AGG
tagcttgtcagttactgaat

SEQ ID NO: 37034 - DNA, 20 bp, Artificial Sequence
  Description of Artificial Sequence: Synthetic oligonucleotide
  Target: SCN9A; (-) strand; PAM type: NRG; PAM sequence: TAG
atagcttgtcagttactgaa

SEQ ID NO: 37035 - DNA, 20 bp, Artificial Sequence
  Description of Artificial Sequence: Synthetic oligonucleotide
  Target: SCN9A; (-) strand; PAM type: NRG; PAM sequence: CAG
tcaaggaagtgatagcttgt

SEQ ID NO: 37036 - DNA, 20 bp, Artificial Sequence
  Description of Artificial Sequence: Synthetic oligonucleotide
  Target: SCN9A; (-) strand; PAM type: NRG; PAM sequence: TAG
gtaagctttcaaggaagtga

SEQ ID NO: 37037 - DNA, 20 bp, Artificial Sequence
  Description of Artificial Sequence: Synthetic oligonucleotide
  Target: SCN9A; (-) strand; PAM type: NRG; PAM sequence: AAG
atcaaagtaagctttcaagg

SEQ ID NO: 37038 - DNA, 20 bp, Artificial Sequence
  Description of Artificial Sequence: Synthetic oligonucleotide
  Target: SCN9A; (-) strand; PAM type: NRG; PAM sequence: AGG
caaatcaaagtaagctttca

SEQ ID NO: 37039 - DNA, 20 bp, Artificial Sequence
  Description of Artificial Sequence: Synthetic oligonucleotide
  Target: SCN9A; (-) strand; PAM type: NRG; PAM sequence: AAG
ccaaatcaaagtaagctttc

SEQ ID NO: 37040 - DNA, 20 bp, Artificial Sequence
  Description of Artificial Sequence: Synthetic oligonucleotide
  Target: SCN9A; (-) strand; PAM type: NRG; PAM sequence: AAG
gataaaagccaaatcaaagt

SEQ ID NO: 37041 - DNA, 20 bp, Artificial Sequence
  Description of Artificial Sequence: Synthetic oligonucleotide
  Target: SCN9A; (-) strand; PAM type: NRG; PAM sequence: AAG
gtaagataaaagccaaatca

SEQ ID NO: 37042 - DNA, 20 bp, Artificial Sequence
  Description of Artificial Sequence: Synthetic oligonucleotide
  Target: SCN9A; (-) strand; PAM type: NRG; PAM sequence: AAG
agctagtgtcagtaagataa

SEQ ID NO: 37043 - DNA, 20 bp, Artificial Sequence
  Description of Artificial Sequence: Synthetic oligonucleotide
  Target: SCN9A; (-) strand; PAM type: NRG; PAM sequence: AAG
tttaagaagctagtgtcagt

SEQ ID NO: 37044 - DNA, 20 bp, Artificial Sequence
  Description of Artificial Sequence: Synthetic oligonucleotide
  Target: SCN9A; (-) strand; PAM type: NRG; PAM sequence: CAG
ggtttttaagaagctagtgt

SEQ ID NO: 37045 - DNA, 20 bp, Artificial Sequence
  Description of Artificial Sequence: Synthetic oligonucleotide
  Target: SCN9A; (-) strand; PAM type: NRG; PAM sequence: TAG
taggggggtttttaagaagc

SEQ ID NO: 37046 - DNA, 20 bp, Artificial Sequence
  Description of Artificial Sequence: Synthetic oligonucleotide
  Target: SCN9A; (-) strand; PAM type: NRG; PAM sequence: AAG
aacttaggggggtttttaag

SEQ ID NO: 37047 - DNA, 20 bp, Artificial Sequence
  Description of Artificial Sequence: Synthetic oligonucleotide
  Target: SCN9A; (-) strand; PAM type: NRG; PAM sequence: AAG
agaaacttaggggggttttt

SEQ ID NO: 37048 - DNA, 20 bp, Artificial Sequence
  Description of Artificial Sequence: Synthetic oligonucleotide
  Target: SCN9A; (-) strand; PAM type: NRG; PAM sequence: GGG
tttacatgagaaacttaggg

SEQ ID NO: 37049 - DNA, 20 bp, Artificial Sequence
  Description of Artificial Sequence: Synthetic oligonucleotide
  Target: SCN9A; (-) strand; PAM type: NRG; PAM sequence: GGG
atttacatgagaaacttagg

SEQ ID NO: 37050 - DNA, 20 bp, Artificial Sequence
  Description of Artificial Sequence: Synthetic oligonucleotide
  Target: SCN9A; (-) strand; PAM type: NRG; PAM sequence: GGG
aatttacatgagaaacttag

SEQ ID NO: 37051 - DNA, 20 bp, Artificial Sequence
  Description of Artificial Sequence: Synthetic oligonucleotide
  Target: SCN9A; (-) strand; PAM type: NRG; PAM sequence: GGG
caatttacatgagaaactta

SEQ ID NO: 37052 - DNA, 20 bp, Artificial Sequence
  Description of Artificial Sequence: Synthetic oligonucleotide
  Target: SCN9A; (-) strand; PAM type: NRG; PAM sequence: AGG
gcaatttacatgagaaactt

SEQ ID NO: 37053 - DNA, 20 bp, Artificial Sequence
  Description of Artificial Sequence: Synthetic oligonucleotide
  Target: SCN9A; (-) strand; PAM type: NRG; PAM sequence: TAG
agcaatttacatgagaaact

SEQ ID NO: 37054 - DNA, 20 bp, Artificial Sequence
  Description of Artificial Sequence: Synthetic oligonucleotide
  Target: SCN9A; (-) strand; PAM type: NRG; PAM sequence: GAG
atgttaagagcaatttacat

SEQ ID NO: 37055 - DNA, 20 bp, Artificial Sequence
  Description of Artificial Sequence: Synthetic oligonucleotide
  Target: SCN9A; (-) strand; PAM type: NRG; PAM sequence: GAG
tatatctactctgatgttaa

SEQ ID NO: 37056 - DNA, 20 bp, Artificial Sequence
  Description of Artificial Sequence: Synthetic oligonucleotide
  Target: SCN9A; (-) strand; PAM type: NRG; PAM sequence: AAG
attatatctactctgatgtt

SEQ ID NO: 37057 - DNA, 20 bp, Artificial Sequence
  Description of Artificial Sequence: Synthetic oligonucleotide
  Target: SCN9A; (-) strand; PAM type: NRG; PAM sequence: TAG
tttttaagttggagcgttca

SEQ ID NO: 37058 - DNA, 20 bp, Artificial Sequence
  Description of Artificial Sequence: Synthetic oligonucleotide
  Target: SCN9A; (-) strand; PAM type: NRG; PAM sequence: GAG
agttttttttttttaagttg

SEQ ID NO: 37059 - DNA, 20 bp, Artificial Sequence
  Description of Artificial Sequence: Synthetic oligonucleotide
  Target: SCN9A; (-) strand; PAM type: NRG; PAM sequence: TGG
ttagttttttttttttaagt

SEQ ID NO: 37060 - DNA, 20 bp, Artificial Sequence
  Description of Artificial Sequence: Synthetic oligonucleotide
  Target: SCN9A; (-) strand; PAM type: NRG; PAM sequence: AAG
tattttagtttttttttttt

SEQ ID NO: 37061 - DNA, 20 bp, Artificial Sequence
  Description of Artificial Sequence: Synthetic oligonucleotide
  Target: SCN9A; (-) strand; PAM type: NRG; PAM sequence: TAG
aaacatttcactcattattt

SEQ ID NO: 37062 - DNA, 20 bp, Artificial Sequence
  Description of Artificial Sequence: Synthetic oligonucleotide
  Target: SCN9A; (-) strand; PAM type: NRG; PAM sequence: TAG
aatgccagtttttgtgatta

SEQ ID NO: 37063 - DNA, 20 bp, Artificial Sequence
  Description of Artificial Sequence: Synthetic oligonucleotide
  Target: SCN9A; (-) strand; PAM type: NRG; PAM sequence: CAG
gaaactagaaacattaatgc

SEQ ID NO: 37064 - DNA, 20 bp, Artificial Sequence
  Description of Artificial Sequence: Synthetic oligonucleotide
  Target: SCN9A; (-) strand; PAM type: NRG; PAM sequence: TAG
caaaaatcagaacaagaaac

SEQ ID NO: 37065 - DNA, 20 bp, Artificial Sequence
  Description of Artificial Sequence: Synthetic oligonucleotide
  Target: SCN9A; (-) strand; PAM type: NRG; PAM sequence: AAG
ttcaagacaaaaatcagaac

SEQ ID NO: 37066 - DNA, 20 bp, Artificial Sequence
  Description of Artificial Sequence: Synthetic oligonucleotide
  Target: SCN9A; (-) strand; PAM type: NRG; PAM sequence: CAG
cttatattcaagacaaaaat

SEQ ID NO: 37067 - DNA, 20 bp, Artificial Sequence
  Description of Artificial Sequence: Synthetic oligonucleotide
  Target: SCN9A; (-) strand; PAM type: NRG; PAM sequence: AAG
tattttcgtgccttatattc

SEQ ID NO: 37068 - DNA, 20 bp, Artificial Sequence
  Description of Artificial Sequence: Synthetic oligonucleotide
  Target: SCN9A; (-) strand; PAM type: NRG; PAM sequence: TGG
catttacttttaggaaaaaa

SEQ ID NO: 37069 - DNA, 20 bp, Artificial Sequence
  Description of Artificial Sequence: Synthetic oligonucleotide
  Target: SCN9A; (-) strand; PAM type: NRG; PAM sequence: AGG
tgggaaactcatttactttt

SEQ ID NO: 37070 - DNA, 20 bp, Artificial Sequence
  Description of Artificial Sequence: Synthetic oligonucleotide
  Target: SCN9A; (-) strand; PAM type: NRG; PAM sequence: TAG
ttgggaaactcatttacttt

SEQ ID NO: 37071 - DNA, 20 bp, Artificial Sequence
  Description of Artificial Sequence: Synthetic oligonucleotide
  Target: SCN9A; (-) strand; PAM type: NRG; PAM sequence: GGG
ctttttatcgaattcaactt

SEQ ID NO: 37072 - DNA, 20 bp, Artificial Sequence
  Description of Artificial Sequence: Synthetic oligonucleotide
  Target: SCN9A; (-) strand; PAM type: NRG; PAM sequence: TGG
actttttatcgaattcaact

SEQ ID NO: 37073 - DNA, 20 bp, Artificial Sequence
  Description of Artificial Sequence: Synthetic oligonucleotide
  Target: SCN9A; (-) strand; PAM type: NRG; PAM sequence: CAG
agtgaaattcagaaaagatg

SEQ ID NO: 37074 - DNA, 20 bp, Artificial Sequence
  Description of Artificial Sequence: Synthetic oligonucleotide
  Target: SCN9A; (-) strand; PAM type: NRG; PAM sequence: AAG
ctttatagtgaaattcagaa

SEQ ID NO: 37075 - DNA, 20 bp, Artificial Sequence
  Description of Artificial Sequence: Synthetic oligonucleotide
  Target: SCN9A; (-) strand; PAM type: NRG; PAM sequence: CAG
aagcactttatagtgaaatt

SEQ ID NO: 37076 - DNA, 20 bp, Artificial Sequence
  Description of Artificial Sequence: Synthetic oligonucleotide
  Target: SCN9A; (-) strand; PAM type: NRG; PAM sequence: TAG
tttttcgaataagcacttta

SEQ ID NO: 37077 - DNA, 20 bp, Artificial Sequence
  Description of Artificial Sequence: Synthetic oligonucleotide
  Target: SCN9A; (-) strand; PAM type: NRG; PAM sequence: AAG
atttatttattttttcgaat

SEQ ID NO: 37078 - DNA, 20 bp, Artificial Sequence
  Description of Artificial Sequence: Synthetic oligonucleotide
  Target: SCN9A; (-) strand; PAM type: NRG; PAM sequence: CAG
tctgcccctatttctcagcg

SEQ ID NO: 37079 - DNA, 20 bp, Artificial Sequence
  Description of Artificial Sequence: Synthetic oligonucleotide
  Target: SCN9A; (-) strand; PAM type: NRG; PAM sequence: CAG
acagctctgcccctatttct

SEQ ID NO: 37080 - DNA, 20 bp, Artificial Sequence
  Description of Artificial Sequence: Synthetic oligonucleotide
  Target: SCN9A; (-) strand; PAM type: NRG; PAM sequence: CAG
aacacaaataattgacagga

SEQ ID NO: 37081 - DNA, 20 bp, Artificial Sequence
  Description of Artificial Sequence: Synthetic oligonucleotide
  Target: SCN9A; (-) strand; PAM type: NRG; PAM sequence: AGG
cacaaacacaaataattgac

SEQ ID NO: 37082 - DNA, 20 bp, Artificial Sequence
  Description of Artificial Sequence: Synthetic oligonucleotide
  Target: SCN9A; (-) strand; PAM type: NRG; PAM sequence: CAG
acacaaacacaaataattga

SEQ ID NO: 37083 - DNA, 20 bp, Artificial Sequence
  Description of Artificial Sequence: Synthetic oligonucleotide
  Target: SCN9A; (-) strand; PAM type: NRG; PAM sequence: GAG
aagaaccccgcaccccttaa

SEQ ID NO: 37084 - DNA, 20 bp, Artificial Sequence
  Description of Artificial Sequence: Synthetic oligonucleotide
  Target: SCN9A; (-) strand; PAM type: NRG; PAM sequence: AAG
aaaagaaccccgcacccctt

SEQ ID NO: 37085 - DNA, 20 bp, Artificial Sequence
  Description of Artificial Sequence: Synthetic oligonucleotide
  Target: SCN9A; (-) strand; PAM type: NRG; PAM sequence: AAG
tacaacctgtggggacagaa

SEQ ID NO: 37086 - DNA, 20 bp, Artificial Sequence
  Description of Artificial Sequence: Synthetic oligonucleotide
  Target: SCN9A; (-) strand; PAM type: NRG; PAM sequence: CAG
gcagatacaacctgtgggga

SEQ ID NO: 37087 - DNA, 20 bp, Artificial Sequence
  Description of Artificial Sequence: Synthetic oligonucleotide
  Target: SCN9A; (-) strand; PAM type: NRG; PAM sequence: GGG
cttagcagatacaacctgtg

SEQ ID NO: 37088 - DNA, 20 bp, Artificial Sequence
  Description of Artificial Sequence: Synthetic oligonucleotide
  Target: SCN9A; (-) strand; PAM type: NRG; PAM sequence: GGG
gcttagcagatacaacctgt

SEQ ID NO: 37089 - DNA, 20 bp, Artificial Sequence
  Description of Artificial Sequence: Synthetic oligonucleotide
  Target: SCN9A; (-) strand; PAM type: NRG; PAM sequence: TGG
agcttagcagatacaacctg

SEQ ID NO: 37090 - DNA, 20 bp, Artificial Sequence
  Description of Artificial Sequence: Synthetic oligonucleotide
  Target: SCN9A; (-) strand; PAM type: NRG; PAM sequence: CAG
agcgtgcagaaccagcttag

SEQ ID NO: 37091 - DNA, 20 bp, Artificial Sequence
  Description of Artificial Sequence: Synthetic oligonucleotide
  Target: SCN9A; (-) strand; PAM type: NRG; PAM sequence: TAG
ctgagcgtgcagaaccagct

SEQ ID NO: 37092 - DNA, 20 bp, Artificial Sequence
  Description of Artificial Sequence: Synthetic oligonucleotide
  Target: SCN9A; (-) strand; PAM type: NRG; PAM sequence: CAG
caaagctgagcgtgcagaac

SEQ ID NO: 37093 - DNA, 20 bp, Artificial Sequence
  Description of Artificial Sequence: Synthetic oligonucleotide
  Target: SCN9A; (-) strand; PAM type: NRG; PAM sequence: CAG
catctgcaaagctgagcgtg

SEQ ID NO: 37094 - DNA, 20 bp, Artificial Sequence
  Description of Artificial Sequence: Synthetic oligonucleotide
  Target: SCN9A; (-) strand; PAM type: NRG; PAM sequence: GAG
tatttcccatctgcaaagct

SEQ ID NO: 37095 - DNA, 20 bp, Artificial Sequence
  Description of Artificial Sequence: Synthetic oligonucleotide
  Target: SCN9A; (-) strand; PAM type: NRG; PAM sequence: AAG
tgctgtatttcccatctgca

SEQ ID NO: 37096 - DNA, 20 bp, Artificial Sequence
  Description of Artificial Sequence: Synthetic oligonucleotide
  Target: SCN9A; (-) strand; PAM type: NRG; PAM sequence: AAG
tcacattttttacgagcaaa

SEQ ID NO: 37097 - DNA, 20 bp, Artificial Sequence
  Description of Artificial Sequence: Synthetic oligonucleotide
  Target: SCN9A; (-) strand; PAM type: NRG; PAM sequence: GAG
gggcagctcacattttttac

SEQ ID NO: 37098 - DNA, 20 bp, Artificial Sequence
  Description of Artificial Sequence: Synthetic oligonucleotide
  Target: SCN9A; (-) strand; PAM type: NRG; PAM sequence: CAG
atggacttcaattcaagggg

SEQ ID NO: 37099 - DNA, 20 bp, Artificial Sequence
  Description of Artificial Sequence: Synthetic oligonucleotide
  Target: SCN9A; (-) strand; PAM type: NRG; PAM sequence: GGG
tagatggacttcaattcaag

SEQ ID NO: 37100 - DNA, 20 bp, Artificial Sequence
  Description of Artificial Sequence: Synthetic oligonucleotide
  Target: SCN9A; (-) strand; PAM type: NRG; PAM sequence: GGG
ttagatggacttcaattcaa

SEQ ID NO: 37101 - DNA, 20 bp, Artificial Sequence
  Description of Artificial Sequence: Synthetic oligonucleotide
  Target: SCN9A; (-) strand; PAM type: NRG; PAM sequence: AGG
gttagatggacttcaattca

SEQ ID NO: 37102 - DNA, 20 bp, Artificial Sequence
  Description of Artificial Sequence: Synthetic oligonucleotide
  Target: SCN9A; (-) strand; PAM type: NRG; PAM sequence: AAG
tgttagatggacttcaattc

SEQ ID NO: 37103 - DNA, 20 bp, Artificial Sequence
  Description of Artificial Sequence: Synthetic oligonucleotide
  Target: SCN9A; (-) strand; PAM type: NRG; PAM sequence: TGG
acgctagcagagttgttaga

SEQ ID NO: 37104 - DNA, 20 bp, Artificial Sequence
  Description of Artificial Sequence: Synthetic oligonucleotide
  Target: SCN9A; (-) strand; PAM type: NRG; PAM sequence: TAG
gtttacgctagcagagttgt

SEQ ID NO: 37105 - DNA, 20 bp, Artificial Sequence
  Description of Artificial Sequence: Synthetic oligonucleotide
  Target: SCN9A; (-) strand; PAM type: NRG; PAM sequence: GAG
tatttctgtttacgctagca

SEQ ID NO: 37106 - DNA, 20 bp, Artificial Sequence
  Description of Artificial Sequence: Synthetic oligonucleotide
  Target: SCN9A; (-) strand; PAM type: NRG; PAM sequence: CAG
tttatttctgtttacgctag

SEQ ID NO: 37107 - DNA, 20 bp, Artificial Sequence
  Description of Artificial Sequence: Synthetic oligonucleotide
  Target: SCN9A; (-) strand; PAM type: NRG; PAM sequence: TAG
tcttttatttctgtttacgc

SEQ ID NO: 37108 - DNA, 20 bp, Artificial Sequence
  Description of Artificial Sequence: Synthetic oligonucleotide
  Target: SCN9A; (-) strand; PAM type: NRG; PAM sequence: TGG
ggaagggtagcaatgcctgg

SEQ ID NO: 37109 - DNA, 20 bp, Artificial Sequence
  Description of Artificial Sequence: Synthetic oligonucleotide
  Target: SCN9A; (-) strand; PAM type: NRG; PAM sequence: TGG
aaaggaagggtagcaatgcc

SEQ ID NO: 37110 - DNA, 20 bp, Artificial Sequence
  Description of Artificial Sequence: Synthetic oligonucleotide
  Target: SCN9A; (-) strand; PAM type: NRG; PAM sequence: TAG
gaaactgtggaaaggaaggg

SEQ ID NO: 37111 - DNA, 20 bp, Artificial Sequence
  Description of Artificial Sequence: Synthetic oligonucleotide
  Target: SCN9A; (-) strand; PAM type: NRG; PAM sequence: GGG
tctgaaactgtggaaaggaa

SEQ ID NO: 37112 - DNA, 20 bp, Artificial Sequence
  Description of Artificial Sequence: Synthetic oligonucleotide
  Target: SCN9A; (-) strand; PAM type: NRG; PAM sequence: AGG
ttctgaaactgtggaaagga

SEQ ID NO: 37113 - DNA, 20 bp, Artificial Sequence
  Description of Artificial Sequence: Synthetic oligonucleotide
  Target: SCN9A; (-) strand; PAM type: NRG; PAM sequence: AAG
gttctgaaactgtggaaagg

SEQ ID NO: 37114 - DNA, 20 bp, Artificial Sequence
  Description of Artificial Sequence: Synthetic oligonucleotide
  Target: SCN9A; (-) strand; PAM type: NRG; PAM sequence: AGG
caggttctgaaactgtggaa

SEQ ID NO: 37115 - DNA, 20 bp, Artificial Sequence
  Description of Artificial Sequence: Synthetic oligonucleotide
  Target: SCN9A; (-) strand; PAM type: NRG; PAM sequence: AAG
ccaggttctgaaactgtgga

SEQ ID NO: 37116 - DNA, 20 bp, Artificial Sequence
  Description of Artificial Sequence: Synthetic oligonucleotide
  Target: SCN9A; (-) strand; PAM type: NRG; PAM sequence: TGG
gctgccaggttctgaaactg

SEQ ID NO: 37117 - DNA, 20 bp, Artificial Sequence
  Description of Artificial Sequence: Synthetic oligonucleotide
  Target: SCN9A; (-) strand; PAM type: NRG; PAM sequence: AGG
gactctgtgggtttgctgcc

SEQ ID NO: 37118 - DNA, 20 bp, Artificial Sequence
  Description of Artificial Sequence: Synthetic oligonucleotide
  Target: SCN9A; (-) strand; PAM type: NRG; PAM sequence: CAG
tgactctgtgggtttgctgc

SEQ ID NO: 37119 - DNA, 20 bp, Artificial Sequence
  Description of Artificial Sequence: Synthetic oligonucleotide
  Target: SCN9A; (-) strand; PAM type: NRG; PAM sequence: GGG
ctgtgcggttttgactctgt

SEQ ID NO: 37120 - DNA, 20 bp, Artificial Sequence
  Description of Artificial Sequence: Synthetic oligonucleotide
  Target: SCN9A; (-) strand; PAM type: NRG; PAM sequence: TGG
cctgtgcggttttgactctg

SEQ ID NO: 37121 - DNA, 20 bp, Artificial Sequence
  Description of Artificial Sequence: Synthetic oligonucleotide
  Target: SCN9A; (-) strand; PAM type: NRG; PAM sequence: CGG
atagctgggcagctcctgtg

SEQ ID NO: 37122 - DNA, 20 bp, Artificial Sequence
  Description of Artificial Sequence: Synthetic oligonucleotide
  Target: SCN9A; (-) strand; PAM type: NRG; PAM sequence: CAG
tagttatttcgatagctggg

SEQ ID NO: 37123 - DNA, 20 bp, Artificial Sequence
  Description of Artificial Sequence: Synthetic oligonucleotide
  Target: SCN9A; (-) strand; PAM type: NRG; PAM sequence: GGG
gcgtagttatttcgatagct

SEQ ID NO: 37124 - DNA, 20 bp, Artificial Sequence
  Description of Artificial Sequence: Synthetic oligonucleotide
  Target: SCN9A; (-) strand; PAM type: NRG; PAM sequence: TGG
agcgtagttatttcgatagc

SEQ ID NO: 37125 - DNA, 20 bp, Artificial Sequence
  Description of Artificial Sequence: Synthetic oligonucleotide
  Target: SCN9A; (-) strand; PAM type: NRG; PAM sequence: TAG
tggaagcgtagttatttcga

SEQ ID NO: 37126 - DNA, 20 bp, Artificial Sequence
  Description of Artificial Sequence: Synthetic oligonucleotide
  Target: SCN9A; (-) strand; PAM type: NRG; PAM sequence: TAG
aggaagaagggctggaagcg

SEQ ID NO: 37127 - DNA, 20 bp, Artificial Sequence
  Description of Artificial Sequence: Synthetic oligonucleotide
  Target: SCN9A; (-) strand; PAM type: NRG; PAM sequence: AAG
atgggaggaagaagggctgg

SEQ ID NO: 37128 - DNA, 20 bp, Artificial Sequence
  Description of Artificial Sequence: Synthetic oligonucleotide
  Target: SCN9A; (-) strand; PAM type: NRG; PAM sequence: TGG
gcaatgggaggaagaagggc

SEQ ID NO: 37129 - DNA, 20 bp, Artificial Sequence
  Description of Artificial Sequence: Synthetic oligonucleotide
  Target: SCN9A; (-) strand; PAM type: NRG; PAM sequence: GGG
tccagcaatgggaggaagaa

SEQ ID NO: 37130 - DNA, 20 bp, Artificial Sequence
  Description of Artificial Sequence: Synthetic oligonucleotide
  Target: SCN9A; (-) strand; PAM type: NRG; PAM sequence: AGG
ttccagcaatgggaggaaga

SEQ ID NO: 37131 - DNA, 20 bp, Artificial Sequence
  Description of Artificial Sequence: Synthetic oligonucleotide
  Target: SCN9A; (-) strand; PAM type: NRG; PAM sequence: AAG
gttccagcaatgggaggaag

SEQ ID NO: 37132 - DNA, 20 bp, Artificial Sequence
  Description of Artificial Sequence: Synthetic oligonucleotide
  Target: SCN9A; (-) strand; PAM type: NRG; PAM sequence: AAG
gtggttccagcaatgggagg

SEQ ID NO: 37133 - DNA, 20 bp, Artificial Sequence
  Description of Artificial Sequence: Synthetic oligonucleotide
  Target: SCN9A; (-) strand; PAM type: NRG; PAM sequence: AGG
cgggtggttccagcaatggg

SEQ ID NO: 37134 - DNA, 20 bp, Artificial Sequence
  Description of Artificial Sequence: Synthetic oligonucleotide
  Target: SCN9A; (-) strand; PAM type: NRG; PAM sequence: GAG
ccgggtggttccagcaatgg

SEQ ID NO: 37135 - DNA, 20 bp, Artificial Sequence
  Description of Artificial Sequence: Synthetic oligonucleotide
  Target: SCN9A; (-) strand; PAM type: NRG; PAM sequence: GGG
gaccgggtggttccagcaat

SEQ ID NO: 37136 - DNA, 20 bp, Artificial Sequence
  Description of Artificial Sequence: Synthetic oligonucleotide
  Target: SCN9A; (-) strand; PAM type: NRG; PAM sequence: TGG
tgaccgggtggttccagcaa

SEQ ID NO: 37137 - DNA, 20 bp, Artificial Sequence
  Description of Artificial Sequence: Synthetic oligonucleotide
  Target: SCN9A; (-) strand; PAM type: NRG; PAM sequence: CAG
gaagcttgaccgggtggttc

SEQ ID NO: 37138 - DNA, 20 bp, Artificial Sequence
  Description of Artificial Sequence: Synthetic oligonucleotide
  Target: SCN9A; (-) strand; PAM type: NRG; PAM sequence: TGG
aggggagaagcttgaccggg

SEQ ID NO: 37139 - DNA, 20 bp, Artificial Sequence
  Description of Artificial Sequence: Synthetic oligonucleotide
  Target: SCN9A; (-) strand; PAM type: NRG; PAM sequence: GGG
gagaggggagaagcttgacc

SEQ ID NO: 37140 - DNA, 20 bp, Artificial Sequence
  Description of Artificial Sequence: Synthetic oligonucleotide
  Target: SCN9A; (-) strand; PAM type: NRG; PAM sequence: CGG
agagaggggagaagcttgac

SEQ ID NO: 37141 - DNA, 20 bp, Artificial Sequence
  Description of Artificial Sequence: Synthetic oligonucleotide
  Target: SCN9A; (-) strand; PAM type: NRG; PAM sequence: AAG
ctggaaagaagagaggggag

SEQ ID NO: 37142 - DNA, 20 bp, Artificial Sequence
  Description of Artificial Sequence: Synthetic oligonucleotide
  Target: SCN9A; (-) strand; PAM type: NRG; PAM sequence: GAG
cacctggaaagaagagaggg

SEQ ID NO: 37143 - DNA, 20 bp, Artificial Sequence
  Description of Artificial Sequence: Synthetic oligonucleotide
  Target: SCN9A; (-) strand; PAM type: NRG; PAM sequence: GGG
gccacctggaaagaagagag

SEQ ID NO: 37144 - DNA, 20 bp, Artificial Sequence
  Description of Artificial Sequence: Synthetic oligonucleotide
  Target: SCN9A; (-) strand; PAM type: NRG; PAM sequence: GGG
cgccacctggaaagaagaga

SEQ ID NO: 37145 - DNA, 20 bp, Artificial Sequence
  Description of Artificial Sequence: Synthetic oligonucleotide
  Target: SCN9A; (-) strand; PAM type: NRG; PAM sequence: AGG
acgccacctggaaagaagag

SEQ ID NO: 37146 - DNA, 20 bp, Artificial Sequence
  Description of Artificial Sequence: Synthetic oligonucleotide
  Target: SCN9A; (-) strand; PAM type: NRG; PAM sequence: GAG
tacgccacctggaaagaaga

SEQ ID NO: 37147 - DNA, 20 bp, Artificial Sequence
  Description of Artificial Sequence: Synthetic oligonucleotide
  Target: SCN9A; (-) strand; PAM type: NRG; PAM sequence: GAG
attacgccacctggaaagaa

SEQ ID NO: 37148 - DNA, 20 bp, Artificial Sequence
  Description of Artificial Sequence: Synthetic oligonucleotide
  Target: SCN9A; (-) strand; PAM type: NRG; PAM sequence: AAG
gtattacgccacctggaaag

SEQ ID NO: 37149 - DNA, 20 bp, Artificial Sequence
  Description of Artificial Sequence: Synthetic oligonucleotide
  Target: SCN9A; (-) strand; PAM type: NRG; PAM sequence: AAG
cctgtattacgccacctgga

SEQ ID NO: 37150 - DNA, 20 bp, Artificial Sequence
  Description of Artificial Sequence: Synthetic oligonucleotide
  Target: SCN9A; (-) strand; PAM type: NRG; PAM sequence: TGG
gaaccctgtattacgccacc

SEQ ID NO: 37151 - DNA, 20 bp, Artificial Sequence
  Description of Artificial Sequence: Synthetic oligonucleotide
  Target: SCN9A; (-) strand; PAM type: NRG; PAM sequence: TGG
ctattttcacatctcggttc

SEQ ID NO: 37152 - DNA, 20 bp, Artificial Sequence
  Description of Artificial Sequence: Synthetic oligonucleotide
  Target: SCN9A; (-) strand; PAM type: NRG; PAM sequence: CGG
ctgtgtctattttcacatct

SEQ ID NO: 37153 - DNA, 20 bp, Artificial Sequence
  Description of Artificial Sequence: Synthetic oligonucleotide
  Target: SCN9A; (-) strand; PAM type: NRG; PAM sequence: CGG
gggaggggaggagaagccct

SEQ ID NO: 37154 - DNA, 20 bp, Artificial Sequence
  Description of Artificial Sequence: Synthetic oligonucleotide
  Target: SCN9A; (-) strand; PAM type: NRG; PAM sequence: AAG
ttctgtggggaggggaggag

SEQ ID NO: 37155 - DNA, 20 bp, Artificial Sequence
  Description of Artificial Sequence: Synthetic oligonucleotide
  Target: SCN9A; (-) strand; PAM type: NRG; PAM sequence: GAG
tgcttctgtggggaggggag

SEQ ID NO: 37156 - DNA, 20 bp, Artificial Sequence
  Description of Artificial Sequence: Synthetic oligonucleotide
  Target: SCN9A; (-) strand; PAM type: NRG; PAM sequence: AGG
gctgcttctgtggggagggg

SEQ ID NO: 37157 - DNA, 20 bp, Artificial Sequence
  Description of Artificial Sequence: Synthetic oligonucleotide
  Target: SCN9A; (-) strand; PAM type: NRG; PAM sequence: GAG
tgctgcttctgtggggaggg

SEQ ID NO: 37158 - DNA, 20 bp, Artificial Sequence
  Description of Artificial Sequence: Synthetic oligonucleotide
  Target: SCN9A; (-) strand; PAM type: NRG; PAM sequence: GGG
tttgctgcttctgtggggag

SEQ ID NO: 37159 - DNA, 20 bp, Artificial Sequence
  Description of Artificial Sequence: Synthetic oligonucleotide
  Target: SCN9A; (-) strand; PAM type: NRG; PAM sequence: GGG
ttttgctgcttctgtgggga

SEQ ID NO: 37160 - DNA, 20 bp, Artificial Sequence
  Description of Artificial Sequence: Synthetic oligonucleotide
  Target: SCN9A; (-) strand; PAM type: NRG; PAM sequence: AGG
cttttgctgcttctgtgggg

SEQ ID NO: 37161 - DNA, 20 bp, Artificial Sequence
  Description of Artificial Sequence: Synthetic oligonucleotide
  Target: SCN9A; (-) strand; PAM type: NRG; PAM sequence: GAG
tcttttgctgcttctgtggg

SEQ ID NO: 37162 - DNA, 20 bp, Artificial Sequence
  Description of Artificial Sequence: Synthetic oligonucleotide
  Target: SCN9A; (-) strand; PAM type: NRG; PAM sequence: GGG
tttcttttgctgcttctgtg

SEQ ID NO: 37163 - DNA, 20 bp, Artificial Sequence
  Description of Artificial Sequence: Synthetic oligonucleotide
  Target: SCN9A; (-) strand; PAM type: NRG; PAM sequence: GGG
ttttcttttgctgcttctgt

SEQ ID NO: 37164 - DNA, 20 bp, Artificial Sequence
  Description of Artificial Sequence: Synthetic oligonucleotide
  Target: SCN9A; (-) strand; PAM type: NRG; PAM sequence: TGG
cttttcttttgctgcttctg

SEQ ID NO: 37165 - DNA, 20 bp, Artificial Sequence
  Description of Artificial Sequence: Synthetic oligonucleotide
  Target: SCN9A; (-) strand; PAM type: NRG; PAM sequence: AAG
cggcgggctaggttgcaagt

SEQ ID NO: 37166 - DNA, 20 bp, Artificial Sequence
  Description of Artificial Sequence: Synthetic oligonucleotide
  Target: SCN9A; (-) strand; PAM type: NRG; PAM sequence: AAG
tgatcggcgggctaggttgc

SEQ ID NO: 37167 - DNA, 20 bp, Artificial Sequence
  Description of Artificial Sequence: Synthetic oligonucleotide
  Target: SCN9A; (-) strand; PAM type: NRG; PAM sequence: AGG
gtggggatgatcggcgggct

SEQ ID NO: 37168 - DNA, 20 bp, Artificial Sequence
  Description of Artificial Sequence: Synthetic oligonucleotide
  Target: SCN9A; (-) strand; PAM type: NRG; PAM sequence: TAG
ggtggggatgatcggcgggc

SEQ ID NO: 37169 - DNA, 20 bp, Artificial Sequence
  Description of Artificial Sequence: Synthetic oligonucleotide
  Target: SCN9A; (-) strand; PAM type: NRG; PAM sequence: GGG
actgggtggggatgatcggc

SEQ ID NO: 37170 - DNA, 20 bp, Artificial Sequence
  Description of Artificial Sequence: Synthetic oligonucleotide
  Target: SCN9A; (-) strand; PAM type: NRG; PAM sequence: CGG
cactgggtggggatgatcgg

SEQ ID NO: 37171 - DNA, 20 bp, Artificial Sequence
  Description of Artificial Sequence: Synthetic oligonucleotide
  Target: SCN9A; (-) strand; PAM type: NRG; PAM sequence: CGG
gtgcactgggtggggatgat

SEQ ID NO: 37172 - DNA, 20 bp, Artificial Sequence
  Description of Artificial Sequence: Synthetic oligonucleotide
  Target: SCN9A; (-) strand; PAM type: NRG; PAM sequence: GGG
ttctgcaggtgcactgggtg

SEQ ID NO: 37173 - DNA, 20 bp, Artificial Sequence
  Description of Artificial Sequence: Synthetic oligonucleotide
  Target: SCN9A; (-) strand; PAM type: NRG; PAM sequence: GGG
attctgcaggtgcactgggt

SEQ ID NO: 37174 - DNA, 20 bp, Artificial Sequence
  Description of Artificial Sequence: Synthetic oligonucleotide
  Target: SCN9A; (-) strand; PAM type: NRG; PAM sequence: TGG
gattctgcaggtgcactggg

SEQ ID NO: 37175 - DNA, 20 bp, Artificial Sequence
  Description of Artificial Sequence: Synthetic oligonucleotide
  Target: SCN9A; (-) strand; PAM type: NRG; PAM sequence: GGG
ccagattctgcaggtgcact

SEQ ID NO: 37176 - DNA, 20 bp, Artificial Sequence
  Description of Artificial Sequence: Synthetic oligonucleotide
  Target: SCN9A; (-) strand; PAM type: NRG; PAM sequence: TGG
gccagattctgcaggtgcac

SEQ ID NO: 37177 - DNA, 20 bp, Artificial Sequence
  Description of Artificial Sequence: Synthetic oligonucleotide
  Target: SCN9A; (-) strand; PAM type: NRG; PAM sequence: AGG
ctcctggagccagattctgc

SEQ ID NO: 37178 - DNA, 20 bp, Artificial Sequence
  Description of Artificial Sequence: Synthetic oligonucleotide
  Target: SCN9A; (-) strand; PAM type: NRG; PAM sequence: CAG
tctcctggagccagattctg

SEQ ID NO: 37179 - DNA, 20 bp, Artificial Sequence
  Description of Artificial Sequence: Synthetic oligonucleotide
  Target: SCN9A; (-) strand; PAM type: NRG; PAM sequence: CAG
cccgcgccctctcctggagc

SEQ ID NO: 37180 - DNA, 20 bp, Artificial Sequence
  Description of Artificial Sequence: Synthetic oligonucleotide
  Target: SCN9A; (-) strand; PAM type: NRG; PAM sequence: GAG
gaggcccgcgccctctcctg

SEQ ID NO: 37181 - DNA, 20 bp, Artificial Sequence
  Description of Artificial Sequence: Synthetic oligonucleotide
  Target: SCN9A; (-) strand; PAM type: NRG; PAM sequence: TGG
gagaggcccgcgccctctcc

SEQ ID NO: 37182 - DNA, 20 bp, Artificial Sequence
  Description of Artificial Sequence: Synthetic oligonucleotide
  Target: SCN9A; (-) strand; PAM type: NRG; PAM sequence: AGG
agagagcgccggggaaggag

SEQ ID NO: 37183 - DNA, 20 bp, Artificial Sequence
  Description of Artificial Sequence: Synthetic oligonucleotide
  Target: SCN9A; (-) strand; PAM type: NRG; PAM sequence: GAG
gagagagcgccggggaagga

SEQ ID NO: 37184 - DNA, 20 bp, Artificial Sequence
  Description of Artificial Sequence: Synthetic oligonucleotide
  Target: SCN9A; (-) strand; PAM type: NRG; PAM sequence: GAG
ctgagagagcgccggggaag

SEQ ID NO: 37185 - DNA, 20 bp, Artificial Sequence
  Description of Artificial Sequence: Synthetic oligonucleotide
  Target: SCN9A; (-) strand; PAM type: NRG; PAM sequence: AGG
ccctgagagagcgccgggga

SEQ ID NO: 37186 - DNA, 20 bp, Artificial Sequence
  Description of Artificial Sequence: Synthetic oligonucleotide
  Target: SCN9A; (-) strand; PAM type: NRG; PAM sequence: AAG
gccctgagagagcgccgggg

SEQ ID NO: 37187 - DNA, 20 bp, Artificial Sequence
  Description of Artificial Sequence: Synthetic oligonucleotide
  Target: SCN9A; (-) strand; PAM type: NRG; PAM sequence: GGG
gcagccctgagagagcgccg

SEQ ID NO: 37188 - DNA, 20 bp, Artificial Sequence
  Description of Artificial Sequence: Synthetic oligonucleotide
  Target: SCN9A; (-) strand; PAM type: NRG; PAM sequence: GGG
agcagccctgagagagcgcc

SEQ ID NO: 37189 - DNA, 20 bp, Artificial Sequence
  Description of Artificial Sequence: Synthetic oligonucleotide
  Target: SCN9A; (-) strand; PAM type: NRG; PAM sequence: CGG
aagcagccctgagagagcgc

SEQ ID NO: 37190 - DNA, 20 bp, Artificial Sequence
  Description of Artificial Sequence: Synthetic oligonucleotide
  Target: SCN9A; (-) strand; PAM type: NRG; PAM sequence: GAG
aaaaagaagcagccctgaga

SEQ ID NO: 37191 - DNA, 20 bp, Artificial Sequence
  Description of Artificial Sequence: Synthetic oligonucleotide
  Target: SCN9A; (-) strand; PAM type: NRG; PAM sequence: GAG
agaaaaagaagcagccctga

SEQ ID NO: 37192 - DNA, 20 bp, Artificial Sequence
  Description of Artificial Sequence: Synthetic oligonucleotide
  Target: SCN9A; (-) strand; PAM type: NRG; PAM sequence: GAG
agagaaaaagaagcagccct

SEQ ID NO: 37193 - DNA, 20 bp, Artificial Sequence
  Description of Artificial Sequence: Synthetic oligonucleotide
  Target: SCN9A; (-) strand; PAM type: NRG; PAM sequence: CAG
ggagcccagagaaaaagaag

SEQ ID NO: 37194 - DNA, 20 bp, Artificial Sequence
  Description of Artificial Sequence: Synthetic oligonucleotide
  Target: SCN9A; (-) strand; PAM type: NRG; PAM sequence: AAG
acaggagcccagagaaaaag

SEQ ID NO: 37195 - DNA, 20 bp, Artificial Sequence
  Description of Artificial Sequence: Synthetic oligonucleotide
  Target: SCN9A; (-) strand; PAM type: NRG; PAM sequence: AAG
gcaacaggagcccagagaaa

SEQ ID NO: 37196 - DNA, 20 bp, Artificial Sequence
  Description of Artificial Sequence: Synthetic oligonucleotide
  Target: SCN9A; (-) strand; PAM type: NRG; PAM sequence: GAG
ccctgagcaacaggagccca

SEQ ID NO: 37197 - DNA, 20 bp, Artificial Sequence
  Description of Artificial Sequence: Synthetic oligonucleotide
  Target: SCN9A; (-) strand; PAM type: NRG; PAM sequence: CAG
tcccctgagcaacaggagcc

SEQ ID NO: 37198 - DNA, 20 bp, Artificial Sequence
  Description of Artificial Sequence: Synthetic oligonucleotide
  Target: SCN9A; (-) strand; PAM type: NRG; PAM sequence: GAG
aggcgtcccctgagcaacag

SEQ ID NO: 37199 - DNA, 20 bp, Artificial Sequence
  Description of Artificial Sequence: Synthetic oligonucleotide
  Target: SCN9A; (-) strand; PAM type: NRG; PAM sequence: AGG
gcaggcgtcccctgagcaac

SEQ ID NO: 37200 - DNA, 20 bp, Artificial Sequence
  Description of Artificial Sequence: Synthetic oligonucleotide
  Target: SCN9A; (-) strand; PAM type: NRG; PAM sequence: CAG
ggcaggcgtcccctgagcaa

SEQ ID NO: 37201 - DNA, 20 bp, Artificial Sequence
  Description of Artificial Sequence: Synthetic oligonucleotide
  Target: SCN9A; (-) strand; PAM type: NRG; PAM sequence: GAG
gctagcggcaggcgtcccct

SEQ ID NO: 37202 - DNA, 20 bp, Artificial Sequence
  Description of Artificial Sequence: Synthetic oligonucleotide
  Target: SCN9A; (-) strand; PAM type: NRG; PAM sequence: AGG
tgccagtggctgctagcggc

SEQ ID NO: 37203 - DNA, 20 bp, Artificial Sequence
  Description of Artificial Sequence: Synthetic oligonucleotide
  Target: SCN9A; (-) strand; PAM type: NRG; PAM sequence: CAG
gtgccagtggctgctagcgg

SEQ ID NO: 37204 - DNA, 20 bp, Artificial Sequence
  Description of Artificial Sequence: Synthetic oligonucleotide
  Target: SCN9A; (-) strand; PAM type: NRG; PAM sequence: CGG
tgggtgccagtggctgctag

SEQ ID NO: 37205 - DNA, 20 bp, Artificial Sequence
  Description of Artificial Sequence: Synthetic oligonucleotide
  Target: SCN9A; (-) strand; PAM type: NRG; PAM sequence: TAG
gcctgggtgccagtggctgc

SEQ ID NO: 37206 - DNA, 20 bp, Artificial Sequence
  Description of Artificial Sequence: Synthetic oligonucleotide
  Target: SCN9A; (-) strand; PAM type: NRG; PAM sequence: TGG
tgggctagcctgggtgccag

SEQ ID NO: 37207 - DNA, 20 bp, Artificial Sequence
  Description of Artificial Sequence: Synthetic oligonucleotide
  Target: SCN9A; (-) strand; PAM type: NRG; PAM sequence: CAG
ggctgggctagcctgggtgc

SEQ ID NO: 37208 - DNA, 20 bp, Artificial Sequence
  Description of Artificial Sequence: Synthetic oligonucleotide
  Target: SCN9A; (-) strand; PAM type: NRG; PAM sequence: GGG
ggctgaggctgggctagcct

SEQ ID NO: 37209 - DNA, 20 bp, Artificial Sequence
  Description of Artificial Sequence: Synthetic oligonucleotide
  Target: SCN9A; (-) strand; PAM type: NRG; PAM sequence: TGG
cggctgaggctgggctagcc

SEQ ID NO: 37210 - DNA, 20 bp, Artificial Sequence
  Description of Artificial Sequence: Synthetic oligonucleotide
  Target: SCN9A; (-) strand; PAM type: NRG; PAM sequence: TAG
cagctcggctgaggctgggc

SEQ ID NO: 37211 - DNA, 20 bp, Artificial Sequence
  Description of Artificial Sequence: Synthetic oligonucleotide
  Target: SCN9A; (-) strand; PAM type: NRG; PAM sequence: GGG
ccgccagctcggctgaggct

SEQ ID NO: 37212 - DNA, 20 bp, Artificial Sequence
  Description of Artificial Sequence: Synthetic oligonucleotide
  Target: SCN9A; (-) strand; PAM type: NRG; PAM sequence: TGG
tccgccagctcggctgaggc

SEQ ID NO: 37213 - DNA, 20 bp, Artificial Sequence
  Description of Artificial Sequence: Synthetic oligonucleotide
  Target: SCN9A; (-) strand; PAM type: NRG; PAM sequence: AGG
caattccgccagctcggctg

SEQ ID NO: 37214 - DNA, 20 bp, Artificial Sequence
  Description of Artificial Sequence: Synthetic oligonucleotide
  Target: SCN9A; (-) strand; PAM type: NRG; PAM sequence: GAG
ccaattccgccagctcggct

SEQ ID NO: 37215 - DNA, 20 bp, Artificial Sequence
  Description of Artificial Sequence: Synthetic oligonucleotide
  Target: SCN9A; (-) strand; PAM type: NRG; PAM sequence: CGG
gctttccaattccgccagct

SEQ ID NO: 37216 - DNA, 20 bp, Artificial Sequence
  Description of Artificial Sequence: Synthetic oligonucleotide
  Target: SCN9A; (-) strand; PAM type: NRG; PAM sequence: CAG
tgtcggctttccaattccgc

SEQ ID NO: 37217 - DNA, 20 bp, Artificial Sequence
  Description of Artificial Sequence: Synthetic oligonucleotide
  Target: SCN9A; (-) strand; PAM type: NRG; PAM sequence: CGG
agcgctccagcggcggctgt

SEQ ID NO: 37218 - DNA, 20 bp, Artificial Sequence
  Description of Artificial Sequence: Synthetic oligonucleotide
  Target: SCN9A; (-) strand; PAM type: NRG; PAM sequence: CGG
ggtcgccagcgctccagcgg

SEQ ID NO: 37219 - DNA, 20 bp, Artificial Sequence
  Description of Artificial Sequence: Synthetic oligonucleotide
  Target: SCN9A; (-) strand; PAM type: NRG; PAM sequence: CGG
ggcggtcgccagcgctccag

SEQ ID NO: 37220 - DNA, 20 bp, Artificial Sequence
  Description of Artificial Sequence: Synthetic oligonucleotide
  Target: SCN9A; (-) strand; PAM type: NRG; PAM sequence: CAG
gcaggcggtcgccagcgctc

SEQ ID NO: 37221 - DNA, 20 bp, Artificial Sequence
  Description of Artificial Sequence: Synthetic oligonucleotide
  Target: SCN9A; (-) strand; PAM type: NRG; PAM sequence: CAG
gtctgcttgcaggcggtcgc

SEQ ID NO: 37222 - DNA, 20 bp, Artificial Sequence
  Description of Artificial Sequence: Synthetic oligonucleotide
  Target: SCN9A; (-) strand; PAM type: NRG; PAM sequence: CGG
gggcgcagtctgcttgcagg

SEQ ID NO: 37223 - DNA, 20 bp, Artificial Sequence
  Description of Artificial Sequence: Synthetic oligonucleotide
  Target: SCN9A; (-) strand; PAM type: NRG; PAM sequence: AGG
gaggggcgcagtctgcttgc

SEQ ID NO: 37224 - DNA, 20 bp, Artificial Sequence
  Description of Artificial Sequence: Synthetic oligonucleotide
  Target: SCN9A; (-) strand; PAM type: NRG; PAM sequence: CAG
ggaggggcgcagtctgcttg

SEQ ID NO: 37225 - DNA, 20 bp, Artificial Sequence
  Description of Artificial Sequence: Synthetic oligonucleotide
  Target: SCN9A; (-) strand; PAM type: NRG; PAM sequence: CAG
gcgccctggcaggaggggcg

SEQ ID NO: 37226 - DNA, 20 bp, Artificial Sequence
  Description of Artificial Sequence: Synthetic oligonucleotide
  Target: SCN9A; (-) strand; PAM type: NRG; PAM sequence: GGG
cgggcgcgccctggcaggag

SEQ ID NO: 37227 - DNA, 20 bp, Artificial Sequence
  Description of Artificial Sequence: Synthetic oligonucleotide
  Target: SCN9A; (-) strand; PAM type: NRG; PAM sequence: GGG
acgggcgcgccctggcagga

SEQ ID NO: 37228 - DNA, 20 bp, Artificial Sequence
  Description of Artificial Sequence: Synthetic oligonucleotide
  Target: SCN9A; (-) strand; PAM type: NRG; PAM sequence: AGG
cacgggcgcgccctggcagg

SEQ ID NO: 37229 - DNA, 20 bp, Artificial Sequence
  Description of Artificial Sequence: Synthetic oligonucleotide
  Target: SCN9A; (-) strand; PAM type: NRG; PAM sequence: GAG
ccacgggcgcgccctggcag

SEQ ID NO: 37230 - DNA, 20 bp, Artificial Sequence
  Description of Artificial Sequence: Synthetic oligonucleotide
  Target: SCN9A; (-) strand; PAM type: NRG; PAM sequence: AGG
ctccacgggcgcgccctggc

SEQ ID NO: 37231 - DNA, 20 bp, Artificial Sequence
  Description of Artificial Sequence: Synthetic oligonucleotide
  Target: SCN9A; (-) strand; PAM type: NRG; PAM sequence: CAG
cctccacgggcgcgccctgg

SEQ ID NO: 37232 - DNA, 20 bp, Artificial Sequence
  Description of Artificial Sequence: Synthetic oligonucleotide
  Target: SCN9A; (-) strand; PAM type: NRG; PAM sequence: TGG
ctacctccacgggcgcgccc

SEQ ID NO: 37233 - DNA, 20 bp, Artificial Sequence
  Description of Artificial Sequence: Synthetic oligonucleotide
  Target: SCN9A; (-) strand; PAM type: NRG; PAM sequence: GGG
ggcggggctgctacctccac

SEQ ID NO: 37234 - DNA, 20 bp, Artificial Sequence
  Description of Artificial Sequence: Synthetic oligonucleotide
  Target: SCN9A; (-) strand; PAM type: NRG; PAM sequence: CGG
aggcggggctgctacctcca

SEQ ID NO: 37235 - DNA, 20 bp, Artificial Sequence
  Description of Artificial Sequence: Synthetic oligonucleotide
  Target: SCN9A; (-) strand; PAM type: NRG; PAM sequence: GGG
cagctgccctcggggaggcg

SEQ ID NO: 37236 - DNA, 20 bp, Artificial Sequence
  Description of Artificial Sequence: Synthetic oligonucleotide
  Target: SCN9A; (-) strand; PAM type: NRG; PAM sequence: GGG
gcagctgccctcggggaggc

SEQ ID NO: 37237 - DNA, 20 bp, Artificial Sequence
  Description of Artificial Sequence: Synthetic oligonucleotide
  Target: SCN9A; (-) strand; PAM type: NRG; PAM sequence: CGG
cgcagctgccctcggggagg

SEQ ID NO: 37238 - DNA, 20 bp, Artificial Sequence
  Description of Artificial Sequence: Synthetic oligonucleotide
  Target: SCN9A; (-) strand; PAM type: NRG; PAM sequence: AGG
cggcgcagctgccctcgggg

SEQ ID NO: 37239 - DNA, 20 bp, Artificial Sequence
  Description of Artificial Sequence: Synthetic oligonucleotide
  Target: SCN9A; (-) strand; PAM type: NRG; PAM sequence: GAG
gcggcgcagctgccctcggg

SEQ ID NO: 37240 - DNA, 20 bp, Artificial Sequence
  Description of Artificial Sequence: Synthetic oligonucleotide
  Target: SCN9A; (-) strand; PAM type: NRG; PAM sequence: GGG
aagcggcgcagctgccctcg

SEQ ID NO: 37241 - DNA, 20 bp, Artificial Sequence
  Description of Artificial Sequence: Synthetic oligonucleotide
  Target: SCN9A; (-) strand; PAM type: NRG; PAM sequence: GGG
aaagcggcgcagctgccctc

SEQ ID NO: 37242 - DNA, 20 bp, Artificial Sequence
  Description of Artificial Sequence: Synthetic oligonucleotide
  Target: SCN9A; (-) strand; PAM type: NRG; PAM sequence: CGG
caaagcggcgcagctgccct

SEQ ID NO: 37243 - DNA, 20 bp, Artificial Sequence
  Description of Artificial Sequence: Synthetic oligonucleotide
  Target: SCN9A; (-) strand; PAM type: NRG; PAM sequence: CAG
gtggaggaggcaaagcggcg

SEQ ID NO: 37244 - DNA, 20 bp, Artificial Sequence
  Description of Artificial Sequence: Synthetic oligonucleotide
  Target: SCN9A; (-) strand; PAM type: NRG; PAM sequence: CGG
gaggagtggaggaggcaaag

SEQ ID NO: 37245 - DNA, 20 bp, Artificial Sequence
  Description of Artificial Sequence: Synthetic oligonucleotide
  Target: SCN9A; (-) strand; PAM type: NRG; PAM sequence: AAG
tgggaggagtggaggaggca

SEQ ID NO: 37246 - DNA, 20 bp, Artificial Sequence
  Description of Artificial Sequence: Synthetic oligonucleotide
  Target: SCN9A; (-) strand; PAM type: NRG; PAM sequence: AGG
cgcgctgggaggagtggagg

SEQ ID NO: 37247 - DNA, 20 bp, Artificial Sequence
  Description of Artificial Sequence: Synthetic oligonucleotide
  Target: SCN9A; (-) strand; PAM type: NRG; PAM sequence: GAG
gcgcgctgggaggagtggag

SEQ ID NO: 37248 - DNA, 20 bp, Artificial Sequence
  Description of Artificial Sequence: Synthetic oligonucleotide
  Target: SCN9A; (-) strand; PAM type: NRG; PAM sequence: AGG
gggcgcgctgggaggagtgg

SEQ ID NO: 37249 - DNA, 20 bp, Artificial Sequence
  Description of Artificial Sequence: Synthetic oligonucleotide
  Target: SCN9A; (-) strand; PAM type: NRG; PAM sequence: GAG
cgggcgcgctgggaggagtg

SEQ ID NO: 37250 - DNA, 20 bp, Artificial Sequence
  Description of Artificial Sequence: Synthetic oligonucleotide
  Target: SCN9A; (-) strand; PAM type: NRG; PAM sequence: TGG
cccgggcgcgctgggaggag

SEQ ID NO: 37251 - DNA, 20 bp, Artificial Sequence
  Description of Artificial Sequence: Synthetic oligonucleotide
  Target: SCN9A; (-) strand; PAM type: NRG; PAM sequence: GAG
ggacccgggcgcgctgggag

SEQ ID NO: 37252 - DNA, 20 bp, Artificial Sequence
  Description of Artificial Sequence: Synthetic oligonucleotide
  Target: SCN9A; (-) strand; PAM type: NRG; PAM sequence: AGG
ggggacccgggcgcgctggg

SEQ ID NO: 37253 - DNA, 20 bp, Artificial Sequence
  Description of Artificial Sequence: Synthetic oligonucleotide
  Target: SCN9A; (-) strand; PAM type: NRG; PAM sequence: GAG
tggggacccgggcgcgctgg

SEQ ID NO: 37254 - DNA, 20 bp, Artificial Sequence
  Description of Artificial Sequence: Synthetic oligonucleotide
  Target: SCN9A; (-) strand; PAM type: NRG; PAM sequence: GGG
ggtggggacccgggcgcgct

SEQ ID NO: 37255 - DNA, 20 bp, Artificial Sequence
  Description of Artificial Sequence: Synthetic oligonucleotide
  Target: SCN9A; (-) strand; PAM type: NRG; PAM sequence: TGG
gggtggggacccgggcgcgc

SEQ ID NO: 37256 - DNA, 20 bp, Artificial Sequence
  Description of Artificial Sequence: Synthetic oligonucleotide
  Target: SCN9A; (-) strand; PAM type: NRG; PAM sequence: GGG
ggagcaaggggtggggaccc

SEQ ID NO: 37257 - DNA, 20 bp, Artificial Sequence
  Description of Artificial Sequence: Synthetic oligonucleotide
  Target: SCN9A; (-) strand; PAM type: NRG; PAM sequence: CGG
gggagcaaggggtggggacc

SEQ ID NO: 37258 - DNA, 20 bp, Artificial Sequence
  Description of Artificial Sequence: Synthetic oligonucleotide
  Target: SCN9A; (-) strand; PAM type: NRG; PAM sequence: GGG
gagggagggagcaaggggtg

SEQ ID NO: 37259 - DNA, 20 bp, Artificial Sequence
  Description of Artificial Sequence: Synthetic oligonucleotide
  Target: SCN9A; (-) strand; PAM type: NRG; PAM sequence: GGG
ggagggagggagcaaggggt

SEQ ID NO: 37260 - DNA, 20 bp, Artificial Sequence
  Description of Artificial Sequence: Synthetic oligonucleotide
  Target: SCN9A; (-) strand; PAM type: NRG; PAM sequence: TGG
gggagggagggagcaagggg

SEQ ID NO: 37261 - DNA, 20 bp, Artificial Sequence
  Description of Artificial Sequence: Synthetic oligonucleotide
  Target: SCN9A; (-) strand; PAM type: NRG; PAM sequence: GGG
ggagggagggagggagcaag

SEQ ID NO: 37262 - DNA, 20 bp, Artificial Sequence
  Description of Artificial Sequence: Synthetic oligonucleotide
  Target: SCN9A; (-) strand; PAM type: NRG; PAM sequence: GGG
gggagggagggagggagcaa

SEQ ID NO: 37263 - DNA, 20 bp, Artificial Sequence
  Description of Artificial Sequence: Synthetic oligonucleotide
  Target: SCN9A; (-) strand; PAM type: NRG; PAM sequence: AGG
agggagggagggagggagca

SEQ ID NO: 37264 - DNA, 20 bp, Artificial Sequence
  Description of Artificial Sequence: Synthetic oligonucleotide
  Target: SCN9A; (-) strand; PAM type: NRG; PAM sequence: AAG
gagggagggagggagggagc

SEQ ID NO: 37265 - DNA, 20 bp, Artificial Sequence
  Description of Artificial Sequence: Synthetic oligonucleotide
  Target: SCN9A; (-) strand; PAM type: NRG; PAM sequence: GAG
gagagagggagggagggagg

SEQ ID NO: 37266 - DNA, 20 bp, Artificial Sequence
  Description of Artificial Sequence: Synthetic oligonucleotide
  Target: SCN9A; (-) strand; PAM type: NRG; PAM sequence: GGG
tggagagagggagggaggga

SEQ ID NO: 37267 - DNA, 20 bp, Artificial Sequence
  Description of Artificial Sequence: Synthetic oligonucleotide
  Target: SCN9A; (-) strand; PAM type: NRG; PAM sequence: AGG
gtggagagagggagggaggg

SEQ ID NO: 37268 - DNA, 20 bp, Artificial Sequence
  Description of Artificial Sequence: Synthetic oligonucleotide
  Target: SCN9A; (-) strand; PAM type: NRG; PAM sequence: GAG
agtggagagagggagggagg

SEQ ID NO: 37269 - DNA, 20 bp, Artificial Sequence
  Description of Artificial Sequence: Synthetic oligonucleotide
  Target: SCN9A; (-) strand; PAM type: NRG; PAM sequence: GGG
ggagtggagagagggaggga

SEQ ID NO: 37270 - DNA, 20 bp, Artificial Sequence
  Description of Artificial Sequence: Synthetic oligonucleotide
  Target: SCN9A; (-) strand; PAM type: NRG; PAM sequence: AGG
aggagtggagagagggaggg

SEQ ID NO: 37271 - DNA, 20 bp, Artificial Sequence
  Description of Artificial Sequence: Synthetic oligonucleotide
  Target: SCN9A; (-) strand; PAM type: NRG; PAM sequence: GAG
caggagtggagagagggagg

SEQ ID NO: 37272 - DNA, 20 bp, Artificial Sequence
  Description of Artificial Sequence: Synthetic oligonucleotide
  Target: SCN9A; (-) strand; PAM type: NRG; PAM sequence: GGG
cgcaggagtggagagaggga

SEQ ID NO: 37273 - DNA, 20 bp, Artificial Sequence
  Description of Artificial Sequence: Synthetic oligonucleotide
  Target: SCN9A; (-) strand; PAM type: NRG; PAM sequence: AGG
ccgcaggagtggagagaggg

SEQ ID NO: 37274 - DNA, 20 bp, Artificial Sequence
  Description of Artificial Sequence: Synthetic oligonucleotide
  Target: SCN9A; (-) strand; PAM type: NRG; PAM sequence: GAG
cccgcaggagtggagagagg

SEQ ID NO: 37275 - DNA, 20 bp, Artificial Sequence
  Description of Artificial Sequence: Synthetic oligonucleotide
  Target: SCN9A; (-) strand; PAM type: NRG; PAM sequence: GGG
cgcccgcaggagtggagaga

SEQ ID NO: 37276 - DNA, 20 bp, Artificial Sequence
  Description of Artificial Sequence: Synthetic oligonucleotide
  Target: SCN9A; (-) strand; PAM type: NRG; PAM sequence: AGG
ccgcccgcaggagtggagag

SEQ ID NO: 37277 - DNA, 20 bp, Artificial Sequence
  Description of Artificial Sequence: Synthetic oligonucleotide
  Target: SCN9A; (-) strand; PAM type: NRG; PAM sequence: GAG
gccgcccgcaggagtggaga

SEQ ID NO: 37278 - DNA, 20 bp, Artificial Sequence
  Description of Artificial Sequence: Synthetic oligonucleotide
  Target: SCN9A; (-) strand; PAM type: NRG; PAM sequence: GAG
gcgccgcccgcaggagtgga

SEQ ID NO: 37279 - DNA, 20 bp, Artificial Sequence
  Description of Artificial Sequence: Synthetic oligonucleotide
  Target: SCN9A; (-) strand; PAM type: NRG; PAM sequence: GAG
ctgcgccgcccgcaggagtg

SEQ ID NO: 37280 - DNA, 20 bp, Artificial Sequence
  Description of Artificial Sequence: Synthetic oligonucleotide
  Target: SCN9A; (-) strand; PAM type: NRG; PAM sequence: TGG
ccctgcgccgcccgcaggag

SEQ ID NO: 37281 - DNA, 20 bp, Artificial Sequence
  Description of Artificial Sequence: Synthetic oligonucleotide
  Target: SCN9A; (-) strand; PAM type: NRG; PAM sequence: GAG
ccgccctgcgccgcccgcag

SEQ ID NO: 37282 - DNA, 20 bp, Artificial Sequence
  Description of Artificial Sequence: Synthetic oligonucleotide
  Target: SCN9A; (-) strand; PAM type: NRG; PAM sequence: AGG
ccccgccctgcgccgcccgc

SEQ ID NO: 37283 - DNA, 20 bp, Artificial Sequence
  Description of Artificial Sequence: Synthetic oligonucleotide
  Target: SCN9A; (-) strand; PAM type: NRG; PAM sequence: CAG
tccccgccctgcgccgcccg

SEQ ID NO: 37284 - DNA, 20 bp, Artificial Sequence
  Description of Artificial Sequence: Synthetic oligonucleotide
  Target: SCN9A; (-) strand; PAM type: NRG; PAM sequence: GGG
ccaccaccgcgcccctagct

SEQ ID NO: 37285 - DNA, 20 bp, Artificial Sequence
  Description of Artificial Sequence: Synthetic oligonucleotide
  Target: SCN9A; (-) strand; PAM type: NRG; PAM sequence: TGG
gccaccaccgcgcccctagc

SEQ ID NO: 37286 - DNA, 20 bp, Artificial Sequence
  Description of Artificial Sequence: Synthetic oligonucleotide
  Target: SCN9A; (-) strand; PAM type: NRG; PAM sequence: TAG
cgtcgccaccaccgcgcccc

SEQ ID NO: 37287 - DNA, 20 bp, Artificial Sequence
  Description of Artificial Sequence: Synthetic oligonucleotide
  Target: SCN9A; (-) strand; PAM type: NRG; PAM sequence: CAG
agcgcatggtgcagaggcta

SEQ ID NO: 37288 - DNA, 20 bp, Artificial Sequence
  Description of Artificial Sequence: Synthetic oligonucleotide
  Target: SCN9A; (-) strand; PAM type: NRG; PAM sequence: AGG
tctattagcgcatggtgcag

SEQ ID NO: 37289 - DNA, 20 bp, Artificial Sequence
  Description of Artificial Sequence: Synthetic oligonucleotide
  Target: SCN9A; (-) strand; PAM type: NRG; PAM sequence: GAG
ttctattagcgcatggtgca

SEQ ID NO: 37290 - DNA, 20 bp, Artificial Sequence
  Description of Artificial Sequence: Synthetic oligonucleotide
  Target: SCN9A; (-) strand; PAM type: NRG; PAM sequence: CAG
ccttctattagcgcatggtg

SEQ ID NO: 37291 - DNA, 20 bp, Artificial Sequence
  Description of Artificial Sequence: Synthetic oligonucleotide
  Target: SCN9A; (-) strand; PAM type: NRG; PAM sequence: TGG
ctccgccttctattagcgca

SEQ ID NO: 37292 - DNA, 20 bp, Artificial Sequence
  Description of Artificial Sequence: Synthetic oligonucleotide
  Target: SCN9A; (-) strand; PAM type: NRG; PAM sequence: TAG
ccccctcctccgccttctat

SEQ ID NO: 37293 - DNA, 20 bp, Artificial Sequence
  Description of Artificial Sequence: Synthetic oligonucleotide
  Target: SCN9A; (-) strand; PAM type: NRG; PAM sequence: AGG
aatgggtggccgtggatggc

SEQ ID NO: 37294 - DNA, 20 bp, Artificial Sequence
  Description of Artificial Sequence: Synthetic oligonucleotide
  Target: SCN9A; (-) strand; PAM type: NRG; PAM sequence: CAG
caatgggtggccgtggatgg

SEQ ID NO: 37295 - DNA, 20 bp, Artificial Sequence
  Description of Artificial Sequence: Synthetic oligonucleotide
  Target: SCN9A; (-) strand; PAM type: NRG; PAM sequence: TGG
acccaatgggtggccgtgga

SEQ ID NO: 37296 - DNA, 20 bp, Artificial Sequence
  Description of Artificial Sequence: Synthetic oligonucleotide
  Target: SCN9A; (-) strand; PAM type: NRG; PAM sequence: TGG
ccccacccaatgggtggccg

SEQ ID NO: 37297 - DNA, 20 bp, Artificial Sequence
  Description of Artificial Sequence: Synthetic oligonucleotide
  Target: SCN9A; (-) strand; PAM type: NRG; PAM sequence: TGG
cacacgccccacccaatggg

SEQ ID NO: 37298 - DNA, 20 bp, Artificial Sequence
  Description of Artificial Sequence: Synthetic oligonucleotide
  Target: SCN9A; (-) strand; PAM type: NRG; PAM sequence: GGG
acacacacgccccacccaat

SEQ ID NO: 37299 - DNA, 20 bp, Artificial Sequence
  Description of Artificial Sequence: Synthetic oligonucleotide
  Target: SCN9A; (-) strand; PAM type: NRG; PAM sequence: TGG
cacacacacgccccacccaa

SEQ ID NO: 37300 - DNA, 20 bp, Artificial Sequence
  Description of Artificial Sequence: Synthetic oligonucleotide
  Target: SCN9A; (-) strand; PAM type: NRG; PAM sequence: TGG
ggaagggctcttctggctgc

SEQ ID NO: 37301 - DNA, 20 bp, Artificial Sequence
  Description of Artificial Sequence: Synthetic oligonucleotide
  Target: SCN9A; (-) strand; PAM type: NRG; PAM sequence: TGG
agataagggaagggctcttc

SEQ ID NO: 37302 - DNA, 20 bp, Artificial Sequence
  Description of Artificial Sequence: Synthetic oligonucleotide
  Target: SCN9A; (-) strand; PAM type: NRG; PAM sequence: GGG
gcgggggtgagataagggaa

SEQ ID NO: 37303 - DNA, 20 bp, Artificial Sequence
  Description of Artificial Sequence: Synthetic oligonucleotide
  Target: SCN9A; (-) strand; PAM type: NRG; PAM sequence: AGG
ggcgggggtgagataaggga

SEQ ID NO: 37304 - DNA, 20 bp, Artificial Sequence
  Description of Artificial Sequence: Synthetic oligonucleotide
  Target: SCN9A; (-) strand; PAM type: NRG; PAM sequence: AAG
gggcgggggtgagataaggg

SEQ ID NO: 37305 - DNA, 20 bp, Artificial Sequence
  Description of Artificial Sequence: Synthetic oligonucleotide
  Target: SCN9A; (-) strand; PAM type: NRG; PAM sequence: GGG
tgggggcgggggtgagataa

SEQ ID NO: 37306 - DNA, 20 bp, Artificial Sequence
  Description of Artificial Sequence: Synthetic oligonucleotide
  Target: SCN9A; (-) strand; PAM type: NRG; PAM sequence: AGG
atgggggcgggggtgagata

SEQ ID NO: 37307 - DNA, 20 bp, Artificial Sequence
  Description of Artificial Sequence: Synthetic oligonucleotide
  Target: SCN9A; (-) strand; PAM type: NRG; PAM sequence: AAG
gatgggggcgggggtgagat

SEQ ID NO: 37308 - DNA, 20 bp, Artificial Sequence
  Description of Artificial Sequence: Synthetic oligonucleotide
  Target: SCN9A; (-) strand; PAM type: NRG; PAM sequence: GAG
gggatgatgggggcgggggt

SEQ ID NO: 37309 - DNA, 20 bp, Artificial Sequence
  Description of Artificial Sequence: Synthetic oligonucleotide
  Target: SCN9A; (-) strand; PAM type: NRG; PAM sequence: GGG
gaaagggatgatgggggcgg

SEQ ID NO: 37310 - DNA, 20 bp, Artificial Sequence
  Description of Artificial Sequence: Synthetic oligonucleotide
  Target: SCN9A; (-) strand; PAM type: NRG; PAM sequence: GGG
ggaaagggatgatgggggcg

SEQ ID NO: 37311 - DNA, 20 bp, Artificial Sequence
  Description of Artificial Sequence: Synthetic oligonucleotide
  Target: SCN9A; (-) strand; PAM type: NRG; PAM sequence: GGG
aggaaagggatgatgggggc

SEQ ID NO: 37312 - DNA, 20 bp, Artificial Sequence
  Description of Artificial Sequence: Synthetic oligonucleotide
  Target: SCN9A; (-) strand; PAM type: NRG; PAM sequence: CGG
gaggaaagggatgatggggg

SEQ ID NO: 37313 - DNA, 20 bp, Artificial Sequence
  Description of Artificial Sequence: Synthetic oligonucleotide
  Target: SCN9A; (-) strand; PAM type: NRG; PAM sequence: GGG
agggaggaaagggatgatgg

SEQ ID NO: 37314 - DNA, 20 bp, Artificial Sequence
  Description of Artificial Sequence: Synthetic oligonucleotide
  Target: SCN9A; (-) strand; PAM type: NRG; PAM sequence: GGG
aagggaggaaagggatgatg

SEQ ID NO: 37315 - DNA, 20 bp, Artificial Sequence
  Description of Artificial Sequence: Synthetic oligonucleotide
  Target: SCN9A; (-) strand; PAM type: NRG; PAM sequence: GGG
gaagggaggaaagggatgat

SEQ ID NO: 37316 - DNA, 20 bp, Artificial Sequence
  Description of Artificial Sequence: Synthetic oligonucleotide
  Target: SCN9A; (-) strand; PAM type: NRG; PAM sequence: TGG
ggaagggaggaaagggatga

SEQ ID NO: 37317 - DNA, 20 bp, Artificial Sequence
  Description of Artificial Sequence: Synthetic oligonucleotide
  Target: SCN9A; (-) strand; PAM type: NRG; PAM sequence: GGG
ctgagcaggaagggaggaaa

SEQ ID NO: 37318 - DNA, 20 bp, Artificial Sequence
  Description of Artificial Sequence: Synthetic oligonucleotide
  Target: SCN9A; (-) strand; PAM type: NRG; PAM sequence: AGG
gctgagcaggaagggaggaa

SEQ ID NO: 37319 - DNA, 20 bp, Artificial Sequence
  Description of Artificial Sequence: Synthetic oligonucleotide
  Target: SCN9A; (-) strand; PAM type: NRG; PAM sequence: AAG
tgctgagcaggaagggagga

SEQ ID NO: 37320 - DNA, 20 bp, Artificial Sequence
  Description of Artificial Sequence: Synthetic oligonucleotide
  Target: SCN9A; (-) strand; PAM type: NRG; PAM sequence: AGG
attctgctgagcaggaaggg

SEQ ID NO: 37321 - DNA, 20 bp, Artificial Sequence
  Description of Artificial Sequence: Synthetic oligonucleotide
  Target: SCN9A; (-) strand; PAM type: NRG; PAM sequence: GAG
gattctgctgagcaggaagg

SEQ ID NO: 37322 - DNA, 20 bp, Artificial Sequence
  Description of Artificial Sequence: Synthetic oligonucleotide
  Target: SCN9A; (-) strand; PAM type: NRG; PAM sequence: GGG
ccgattctgctgagcaggaa

SEQ ID NO: 37323 - DNA, 20 bp, Artificial Sequence
  Description of Artificial Sequence: Synthetic oligonucleotide
  Target: SCN9A; (-) strand; PAM type: NRG; PAM sequence: AGG
gccgattctgctgagcagga

SEQ ID NO: 37324 - DNA, 20 bp, Artificial Sequence
  Description of Artificial Sequence: Synthetic oligonucleotide
  Target: SCN9A; (-) strand; PAM type: NRG; PAM sequence: AAG
agccgattctgctgagcagg

SEQ ID NO: 37325 - DNA, 20 bp, Artificial Sequence
  Description of Artificial Sequence: Synthetic oligonucleotide
  Target: SCN9A; (-) strand; PAM type: NRG; PAM sequence: AGG
attagccgattctgctgagc

SEQ ID NO: 37326 - DNA, 20 bp, Artificial Sequence
  Description of Artificial Sequence: Synthetic oligonucleotide
  Target: SCN9A; (-) strand; PAM type: NRG; PAM sequence: CAG
cattagccgattctgctgag

SEQ ID NO: 37327 - DNA, 20 bp, Artificial Sequence
  Description of Artificial Sequence: Synthetic oligonucleotide
  Target: SCN9A; (-) strand; PAM type: NRG; PAM sequence: GAG
aaacattagccgattctgct

SEQ ID NO: 37328 - DNA, 20 bp, Artificial Sequence
  Description of Artificial Sequence: Synthetic oligonucleotide
  Target: SCN9A; (-) strand; PAM type: NRG; PAM sequence: TAG
aagtgacttctcggaaacat

SEQ ID NO: 37329 - DNA, 20 bp, Artificial Sequence
  Description of Artificial Sequence: Synthetic oligonucleotide
  Target: SCN9A; (-) strand; PAM type: NRG; PAM sequence: CGG
agccacacaaagtgacttct

SEQ ID NO: 37330 - DNA, 20 bp, Artificial Sequence
  Description of Artificial Sequence: Synthetic oligonucleotide
  Target: SCN9A; (-) strand; PAM type: NRG; PAM sequence: AAG
gctccccaccaagccacaca

SEQ ID NO: 37331 - DNA, 20 bp, Artificial Sequence
  Description of Artificial Sequence: Synthetic oligonucleotide
  Target: SCN9A; (-) strand; PAM type: NRG; PAM sequence: AAG
tttttctccagctccccacc

SEQ ID NO: 37332 - DNA, 20 bp, Artificial Sequence
  Description of Artificial Sequence: Synthetic oligonucleotide
  Target: SCN9A; (-) strand; PAM type: NRG; PAM sequence: CAG
tctgctccggagtttttctc

SEQ ID NO: 37333 - DNA, 20 bp, Artificial Sequence
  Description of Artificial Sequence: Synthetic oligonucleotide
  Target: SCN9A; (-) strand; PAM type: NRG; PAM sequence: GAG
tccccacctcctctgctccg

SEQ ID NO: 37334 - DNA, 20 bp, Artificial Sequence
  Description of Artificial Sequence: Synthetic oligonucleotide
  Target: SCN9A; (-) strand; PAM type: NRG; PAM sequence: CGG
ggtccccacctcctctgctc

SEQ ID NO: 37335 - DNA, 20 bp, Artificial Sequence
  Description of Artificial Sequence: Synthetic oligonucleotide
  Target: SCN9A; (-) strand; PAM type: NRG; PAM sequence: TGG
cagactcagggctttgccat

SEQ ID NO: 37336 - DNA, 20 bp, Artificial Sequence
  Description of Artificial Sequence: Synthetic oligonucleotide
  Target: SCN9A; (-) strand; PAM type: NRG; PAM sequence: GGG
cagccactgccccagactca

SEQ ID NO: 37337 - DNA, 20 bp, Artificial Sequence
  Description of Artificial Sequence: Synthetic oligonucleotide
  Target: SCN9A; (-) strand; PAM type: NRG; PAM sequence: AGG
ccagccactgccccagactc

SEQ ID NO: 37338 - DNA, 20 bp, Artificial Sequence
  Description of Artificial Sequence: Synthetic oligonucleotide
  Target: SCN9A; (-) strand; PAM type: NRG; PAM sequence: CAG
cccagccactgccccagact

SEQ ID NO: 37339 - DNA, 20 bp, Artificial Sequence
  Description of Artificial Sequence: Synthetic oligonucleotide
  Target: SCN9A; (-) strand; PAM type: NRG; PAM sequence: CAG
tggctccccagccactgccc

SEQ ID NO: 37340 - DNA, 20 bp, Artificial Sequence
  Description of Artificial Sequence: Synthetic oligonucleotide
  Target: SCN9A; (-) strand; PAM type: NRG; PAM sequence: CAG
ggcggtgttgtctggctccc

SEQ ID NO: 37341 - DNA, 20 bp, Artificial Sequence
  Description of Artificial Sequence: Synthetic oligonucleotide
  Target: SCN9A; (-) strand; PAM type: NRG; PAM sequence: TGG
gctggcctggcggtgttgtc

SEQ ID NO: 37342 - DNA, 20 bp, Artificial Sequence
  Description of Artificial Sequence: Synthetic oligonucleotide
  Target: SCN9A; (-) strand; PAM type: NRG; PAM sequence: CGG
tcggggaggcgctggcctgg

SEQ ID NO: 37343 - DNA, 20 bp, Artificial Sequence
  Description of Artificial Sequence: Synthetic oligonucleotide
  Target: SCN9A; (-) strand; PAM type: NRG; PAM sequence: TGG
aggtcggggaggcgctggcc

SEQ ID NO: 37344 - DNA, 20 bp, Artificial Sequence
  Description of Artificial Sequence: Synthetic oligonucleotide
  Target: SCN9A; (-) strand; PAM type: NRG; PAM sequence: TGG
gcccaaggtcggggaggcgc

SEQ ID NO: 37345 - DNA, 20 bp, Artificial Sequence
  Description of Artificial Sequence: Synthetic oligonucleotide
  Target: SCN9A; (-) strand; PAM type: NRG; PAM sequence: AGG
ttcagagcccaaggtcgggg

SEQ ID NO: 37346 - DNA, 20 bp, Artificial Sequence
  Description of Artificial Sequence: Synthetic oligonucleotide
  Target: SCN9A; (-) strand; PAM type: NRG; PAM sequence: GAG
cttcagagcccaaggtcggg

SEQ ID NO: 37347 - DNA, 20 bp, Artificial Sequence
  Description of Artificial Sequence: Synthetic oligonucleotide
  Target: SCN9A; (-) strand; PAM type: NRG; PAM sequence: GGG
ctcttcagagcccaaggtcg

SEQ ID NO: 37348 - DNA, 20 bp, Artificial Sequence
  Description of Artificial Sequence: Synthetic oligonucleotide
  Target: SCN9A; (-) strand; PAM type: NRG; PAM sequence: GGG
actcttcagagcccaaggtc

SEQ ID NO: 37349 - DNA, 20 bp, Artificial Sequence
  Description of Artificial Sequence: Synthetic oligonucleotide
  Target: SCN9A; (-) strand; PAM type: NRG; PAM sequence: CGG
gactcttcagagcccaaggt

SEQ ID NO: 37350 - DNA, 20 bp, Artificial Sequence
  Description of Artificial Sequence: Synthetic oligonucleotide
  Target: SCN9A; (-) strand; PAM type: NRG; PAM sequence: AGG
cctagactcttcagagccca

SEQ ID NO: 37351 - DNA, 20 bp, Artificial Sequence
  Description of Artificial Sequence: Synthetic oligonucleotide
  Target: SCN9A; (-) strand; PAM type: NRG; PAM sequence: AAG
gcctagactcttcagagccc

SEQ ID NO: 37352 - DNA, 20 bp, Artificial Sequence
  Description of Artificial Sequence: Synthetic oligonucleotide
  Target: SCN9A; (-) strand; PAM type: NRG; PAM sequence: GAG
ttcccagcctagactcttca

SEQ ID NO: 37353 - DNA, 20 bp, Artificial Sequence
  Description of Artificial Sequence: Synthetic oligonucleotide
  Target: SCN9A; (-) strand; PAM type: NRG; PAM sequence: CAG
aattcccagcctagactctt

SEQ ID NO: 37354 - DNA, 20 bp, Artificial Sequence
  Description of Artificial Sequence: Synthetic oligonucleotide
  Target: SCN9A; (-) strand; PAM type: NRG; PAM sequence: TAG
gaagaaaccaattcccagcc

SEQ ID NO: 37355 - DNA, 20 bp, Artificial Sequence
  Description of Artificial Sequence: Synthetic oligonucleotide
  Target: SCN9A; (-) strand; PAM type: NRG; PAM sequence: CAG
ctacggaagaaaccaattcc

SEQ ID NO: 37356 - DNA, 20 bp, Artificial Sequence
  Description of Artificial Sequence: Synthetic oligonucleotide
  Target: SCN9A; (-) strand; PAM type: NRG; PAM sequence: AAG
ttgtgagcaaagccctacgg

SEQ ID NO: 37357 - DNA, 20 bp, Artificial Sequence
  Description of Artificial Sequence: Synthetic oligonucleotide
  Target: SCN9A; (-) strand; PAM type: NRG; PAM sequence: CGG
cggttgtgagcaaagcccta

SEQ ID NO: 37358 - DNA, 20 bp, Artificial Sequence
  Description of Artificial Sequence: Synthetic oligonucleotide
  Target: SCN9A; (-) strand; PAM type: NRG; PAM sequence: AAG
cccactcgcggttgtgagca

SEQ ID NO: 37359 - DNA, 20 bp, Artificial Sequence
  Description of Artificial Sequence: Synthetic oligonucleotide
  Target: SCN9A; (-) strand; PAM type: NRG; PAM sequence: GAG
accgccccactcgcggttgt

SEQ ID NO: 37360 - DNA, 20 bp, Artificial Sequence
  Description of Artificial Sequence: Synthetic oligonucleotide
  Target: SCN9A; (-) strand; PAM type: NRG; PAM sequence: CGG
gagcgtcaccgccccactcg

SEQ ID NO: 37361 - DNA, 20 bp, Artificial Sequence
  Description of Artificial Sequence: Synthetic oligonucleotide
  Target: SCN9A; (-) strand; PAM type: NRG; PAM sequence: GAG
atagcctagataccggtctt

SEQ ID NO: 37362 - DNA, 20 bp, Artificial Sequence
  Description of Artificial Sequence: Synthetic oligonucleotide
  Target: SCN9A; (-) strand; PAM type: NRG; PAM sequence: CGG
agaaaacatagcctagatac

SEQ ID NO: 37363 - DNA, 20 bp, Artificial Sequence
  Description of Artificial Sequence: Synthetic oligonucleotide
  Target: SCN9A; (-) strand; PAM type: NRG; PAM sequence: TAG
agaaaacagaaaacatagcc

SEQ ID NO: 37364 - DNA, 20 bp, Artificial Sequence
  Description of Artificial Sequence: Synthetic oligonucleotide
  Target: SCN9A; (-) strand; PAM type: NRG; PAM sequence: TAG
tataaagaaaacagaaaaca

SEQ ID NO: 37365 - DNA, 20 bp, Artificial Sequence
  Description of Artificial Sequence: Synthetic oligonucleotide
  Target: SCN9A; (-) strand; PAM type: NRG; PAM sequence: CAG
atacatatatataaagaaaa

SEQ ID NO: 37366 - DNA, 20 bp, Artificial Sequence
  Description of Artificial Sequence: Synthetic oligonucleotide
  Target: SCN9A; (-) strand; PAM type: NRG; PAM sequence: AAG
tttatatatacatatatata

SEQ ID NO: 37367 - DNA, 20 bp, Artificial Sequence
  Description of Artificial Sequence: Synthetic oligonucleotide
  Target: SCN9A; (-) strand; PAM type: NRG; PAM sequence: AAG
tgtattatttgcttgcctgg

SEQ ID NO: 37368 - DNA, 20 bp, Artificial Sequence
  Description of Artificial Sequence: Synthetic oligonucleotide
  Target: SCN9A; (-) strand; PAM type: NRG; PAM sequence: TGG
aaatgtattatttgcttgcc

SEQ ID NO: 37369 - DNA, 20 bp, Artificial Sequence
  Description of Artificial Sequence: Synthetic oligonucleotide
  Target: SCN9A; (-) strand; PAM type: NRG; PAM sequence: AAG
attcttcactgcatcttcga

SEQ ID NO: 37370 - DNA, 20 bp, Artificial Sequence
  Description of Artificial Sequence: Synthetic oligonucleotide
  Target: SCN9A; (-) strand; PAM type: NRG; PAM sequence: AGG
ccacgtttctttccccacct

SEQ ID NO: 37371 - DNA, 20 bp, Artificial Sequence
  Description of Artificial Sequence: Synthetic oligonucleotide
  Target: SCN9A; (-) strand; PAM type: NRG; PAM sequence: TAG
cccacgtttctttccccacc

SEQ ID NO: 37372 - DNA, 20 bp, Artificial Sequence
  Description of Artificial Sequence: Synthetic oligonucleotide
  Target: SCN9A; (-) strand; PAM type: NRG; PAM sequence: CAG
gggtcccaggtctggaaaag

SEQ ID NO: 37373 - DNA, 20 bp, Artificial Sequence
  Description of Artificial Sequence: Synthetic oligonucleotide
  Target: SCN9A; (-) strand; PAM type: NRG; PAM sequence: AAG
atcgggtcccaggtctggaa

SEQ ID NO: 37374 - DNA, 20 bp, Artificial Sequence
  Description of Artificial Sequence: Synthetic oligonucleotide
  Target: SCN9A; (-) strand; PAM type: NRG; PAM sequence: TGG
agataatcgggtcccaggtc

SEQ ID NO: 37375 - DNA, 20 bp, Artificial Sequence
  Description of Artificial Sequence: Synthetic oligonucleotide
  Target: SCN9A; (-) strand; PAM type: NRG; PAM sequence: AGG
tattcagataatcgggtccc

SEQ ID NO: 37376 - DNA, 20 bp, Artificial Sequence
  Description of Artificial Sequence: Synthetic oligonucleotide
  Target: SCN9A; (-) strand; PAM type: NRG; PAM sequence: CAG
atattcagataatcgggtcc

SEQ ID NO: 37377 - DNA, 20 bp, Artificial Sequence
  Description of Artificial Sequence: Synthetic oligonucleotide
  Target: SCN9A; (-) strand; PAM type: NRG; PAM sequence: GGG
gatggcatattcagataatc

SEQ ID NO: 37378 - DNA, 20 bp, Artificial Sequence
  Description of Artificial Sequence: Synthetic oligonucleotide
  Target: SCN9A; (-) strand; PAM type: NRG; PAM sequence: CGG
tgatggcatattcagataat

SEQ ID NO: 37379 - DNA, 20 bp, Artificial Sequence
  Description of Artificial Sequence: Synthetic oligonucleotide
  Target: SCN9A; (-) strand; PAM type: NRG; PAM sequence: CAG
catatgactgatggcatatt

SEQ ID NO: 37380 - DNA, 20 bp, Artificial Sequence
  Description of Artificial Sequence: Synthetic oligonucleotide
  Target: SCN9A; (-) strand; PAM type: NRG; PAM sequence: TGG
ttcagaacccatatgactga

SEQ ID NO: 37381 - DNA, 20 bp, Artificial Sequence
  Description of Artificial Sequence: Synthetic oligonucleotide
  Target: SCN9A; (-) strand; PAM type: NRG; PAM sequence: CAG
ctcctaccagctctgaaatt

SEQ ID NO: 37382 - DNA, 20 bp, Artificial Sequence
  Description of Artificial Sequence: Synthetic oligonucleotide
  Target: SCN9A; (-) strand; PAM type: NRG; PAM sequence: CAG
attttcacagtcgctcctac

SEQ ID NO: 37383 - DNA, 20 bp, Artificial Sequence
  Description of Artificial Sequence: Synthetic oligonucleotide
  Target: SCN9A; (-) strand; PAM type: NRG; PAM sequence: CAG
ttttaaaaaatttattttca

SEQ ID NO: 37384 - DNA, 20 bp, Artificial Sequence
  Description of Artificial Sequence: Synthetic oligonucleotide
  Target: SCN9A; (-) strand; PAM type: NRG; PAM sequence: AAG
cctcccaggctgctgtagga

SEQ ID NO: 37385 - DNA, 20 bp, Artificial Sequence
  Description of Artificial Sequence: Synthetic oligonucleotide
  Target: SCN9A; (-) strand; PAM type: NRG; PAM sequence: AGG
tcttcctcccaggctgctgt

SEQ ID NO: 37386 - DNA, 20 bp, Artificial Sequence
  Description of Artificial Sequence: Synthetic oligonucleotide
  Target: SCN9A; (-) strand; PAM type: NRG; PAM sequence: TAG
ttcttcctcccaggctgctg

SEQ ID NO: 37387 - DNA, 20 bp, Artificial Sequence
  Description of Artificial Sequence: Synthetic oligonucleotide
  Target: SCN9A; (-) strand; PAM type: NRG; PAM sequence: AGG
tttccattgttcttcctccc

SEQ ID NO: 37388 - DNA, 20 bp, Artificial Sequence
  Description of Artificial Sequence: Synthetic oligonucleotide
  Target: SCN9A; (-) strand; PAM type: NRG; PAM sequence: CAG
gtttccattgttcttcctcc

SEQ ID NO: 37389 - DNA, 20 bp, Artificial Sequence
  Description of Artificial Sequence: Synthetic oligonucleotide
  Target: SCN9A; (-) strand; PAM type: NRG; PAM sequence: AAG
tttcctgtttctctttgaga

SEQ ID NO: 37390 - DNA, 20 bp, Artificial Sequence
  Description of Artificial Sequence: Synthetic oligonucleotide
  Target: SCN9A; (-) strand; PAM type: NRG; PAM sequence: GAG
gaaatttcctgtttctcttt

SEQ ID NO: 37391 - DNA, 20 bp, Artificial Sequence
  Description of Artificial Sequence: Synthetic oligonucleotide
  Target: SCN9A; (-) strand; PAM type: NRG; PAM sequence: TGG
cctttgatttcttcccttgg

SEQ ID NO: 37392 - DNA, 20 bp, Artificial Sequence
  Description of Artificial Sequence: Synthetic oligonucleotide
  Target: SCN9A; (-) strand; PAM type: NRG; PAM sequence: TGG
catcctttgatttcttccct

SEQ ID NO: 37393 - DNA, 20 bp, Artificial Sequence
  Description of Artificial Sequence: Synthetic oligonucleotide
  Target: SCN9A; (-) strand; PAM type: NRG; PAM sequence: TGG
ttgagaggcaccctgcccta

SEQ ID NO: 37394 - DNA, 20 bp, Artificial Sequence
  Description of Artificial Sequence: Synthetic oligonucleotide
  Target: SCN9A; (-) strand; PAM type: NRG; PAM sequence: AGG
aagtggtctgcccttttgag

SEQ ID NO: 37395 - DNA, 20 bp, Artificial Sequence
  Description of Artificial Sequence: Synthetic oligonucleotide
  Target: SCN9A; (-) strand; PAM type: NRG; PAM sequence: GAG
aaagtggtctgcccttttga

SEQ ID NO: 37396 - DNA, 20 bp, Artificial Sequence
  Description of Artificial Sequence: Synthetic oligonucleotide
  Target: SCN9A; (-) strand; PAM type: NRG; PAM sequence: GAG
gcaaagtggtctgccctttt

SEQ ID NO: 37397 - DNA, 20 bp, Artificial Sequence
  Description of Artificial Sequence: Synthetic oligonucleotide
  Target: SCN9A; (-) strand; PAM type: NRG; PAM sequence: TGG
ctagtgtttatcctgcaaag

SEQ ID NO: 37398 - DNA, 20 bp, Artificial Sequence
  Description of Artificial Sequence: Synthetic oligonucleotide
  Target: SCN9A; (-) strand; PAM type: NRG; PAM sequence: AAG
tcactagtgtttatcctgca

SEQ ID NO: 37399 - DNA, 20 bp, Artificial Sequence
  Description of Artificial Sequence: Synthetic oligonucleotide
  Target: SCN9A; (-) strand; PAM type: NRG; PAM sequence: TAG
ataataaaagtgcccgtcac

SEQ ID NO: 37400 - DNA, 20 bp, Artificial Sequence
  Description of Artificial Sequence: Synthetic oligonucleotide
  Target: SCN9A; (-) strand; PAM type: NRG; PAM sequence: AAG
ggtgtggaagcaaataataa

SEQ ID NO: 37401 - DNA, 20 bp, Artificial Sequence
  Description of Artificial Sequence: Synthetic oligonucleotide
  Target: SCN9A; (-) strand; PAM type: NRG; PAM sequence: AAG
ttccatgatagaaggtgtgg

SEQ ID NO: 37402 - DNA, 20 bp, Artificial Sequence
  Description of Artificial Sequence: Synthetic oligonucleotide
  Target: SCN9A; (-) strand; PAM type: NRG; PAM sequence: TGG
catttccatgatagaaggtg

SEQ ID NO: 37403 - DNA, 20 bp, Artificial Sequence
  Description of Artificial Sequence: Synthetic oligonucleotide
  Target: SCN9A; (-) strand; PAM type: NRG; PAM sequence: AGG
agcatcatttccatgataga

SEQ ID NO: 37404 - DNA, 20 bp, Artificial Sequence
  Description of Artificial Sequence: Synthetic oligonucleotide
  Target: SCN9A; (-) strand; PAM type: NRG; PAM sequence: AAG
aagcatcatttccatgatag

SEQ ID NO: 37405 - DNA, 20 bp, Artificial Sequence
  Description of Artificial Sequence: Synthetic oligonucleotide
  Target: SCN9A; (-) strand; PAM type: NRG; PAM sequence: TAG
tctaagcatcatttccatga

SEQ ID NO: 37406 - DNA, 20 bp, Artificial Sequence
  Description of Artificial Sequence: Synthetic oligonucleotide
  Target: SCN9A; (-) strand; PAM type: NRG; PAM sequence: AAG
atttccttccggttatctct

SEQ ID NO: 37407 - DNA, 20 bp, Artificial Sequence
  Description of Artificial Sequence: Synthetic oligonucleotide
  Target: SCN9A; (-) strand; PAM type: NRG; PAM sequence: CGG
cctgggatttgatttccttc

SEQ ID NO: 37408 - DNA, 20 bp, Artificial Sequence
  Description of Artificial Sequence: Synthetic oligonucleotide
  Target: SCN9A; (-) strand; PAM type: NRG; PAM sequence: GGG
agcagggaaaagtagaccct

SEQ ID NO: 37409 - DNA, 20 bp, Artificial Sequence
  Description of Artificial Sequence: Synthetic oligonucleotide
  Target: SCN9A; (-) strand; PAM type: NRG; PAM sequence: TGG
cagcagggaaaagtagaccc

SEQ ID NO: 37410 - DNA, 20 bp, Artificial Sequence
  Description of Artificial Sequence: Synthetic oligonucleotide
  Target: SCN9A; (-) strand; PAM type: NRG; PAM sequence: TAG
aagaaagcagcagggaaaag

SEQ ID NO: 37411 - DNA, 20 bp, Artificial Sequence
  Description of Artificial Sequence: Synthetic oligonucleotide
  Target: SCN9A; (-) strand; PAM type: NRG; PAM sequence: AAG
gcaaagaaagcagcagggaa

SEQ ID NO: 37412 - DNA, 20 bp, Artificial Sequence
  Description of Artificial Sequence: Synthetic oligonucleotide
  Target: SCN9A; (-) strand; PAM type: NRG; PAM sequence: GGG
cagaagcaaagaaagcagca

SEQ ID NO: 37413 - DNA, 20 bp, Artificial Sequence
  Description of Artificial Sequence: Synthetic oligonucleotide
  Target: SCN9A; (-) strand; PAM type: NRG; PAM sequence: AGG
tcagaagcaaagaaagcagc

SEQ ID NO: 37414 - DNA, 20 bp, Artificial Sequence
  Description of Artificial Sequence: Synthetic oligonucleotide
  Target: SCN9A; (-) strand; PAM type: NRG; PAM sequence: CAG
ctcagaagcaaagaaagcag

SEQ ID NO: 37415 - DNA, 20 bp, Artificial Sequence
  Description of Artificial Sequence: Synthetic oligonucleotide
  Target: SCN9A; (-) strand; PAM type: NRG; PAM sequence: CAG
aatctcagaagcaaagaaag

SEQ ID NO: 37416 - DNA, 20 bp, Artificial Sequence
  Description of Artificial Sequence: Synthetic oligonucleotide
  Target: SCN9A; (-) strand; PAM type: NRG; PAM sequence: AAG
acaaatctcagaagcaaaga

SEQ ID NO: 37417 - DNA, 20 bp, Artificial Sequence
  Description of Artificial Sequence: Synthetic oligonucleotide
  Target: SCN9A; (-) strand; PAM type: NRG; PAM sequence: AAG
caggacaaatctcagaagca

SEQ ID NO: 37418 - DNA, 20 bp, Artificial Sequence
  Description of Artificial Sequence: Synthetic oligonucleotide
  Target: SCN9A; (-) strand; PAM type: NRG; PAM sequence: AAG
agccccaggacaaatctcag

SEQ ID NO: 37419 - DNA, 20 bp, Artificial Sequence
  Description of Artificial Sequence: Synthetic oligonucleotide
  Target: SCN9A; (-) strand; PAM type: NRG; PAM sequence: CAG
caaagccccaggacaaatct

SEQ ID NO: 37420 - DNA, 20 bp, Artificial Sequence
  Description of Artificial Sequence: Synthetic oligonucleotide
  Target: SCN9A; (-) strand; PAM type: NRG; PAM sequence: AGG
aatgtaaggtccaaagcccc

SEQ ID NO: 37421 - DNA, 20 bp, Artificial Sequence
  Description of Artificial Sequence: Synthetic oligonucleotide
  Target: SCN9A; (-) strand; PAM type: NRG; PAM sequence: CAG
gaatgtaaggtccaaagccc

SEQ ID NO: 37422 - DNA, 20 bp, Artificial Sequence
  Description of Artificial Sequence: Synthetic oligonucleotide
  Target: SCN9A; (-) strand; PAM type: NRG; PAM sequence: AAG
agtcaagaatgtaaggtcca

SEQ ID NO: 37423 - DNA, 20 bp, Artificial Sequence
  Description of Artificial Sequence: Synthetic oligonucleotide
  Target: SCN9A; (-) strand; PAM type: NRG; PAM sequence: AGG
tcttacaagtcaagaatgta

SEQ ID NO: 37424 - DNA, 20 bp, Artificial Sequence
  Description of Artificial Sequence: Synthetic oligonucleotide
  Target: SCN9A; (-) strand; PAM type: NRG; PAM sequence: AAG
atcttacaagtcaagaatgt

SEQ ID NO: 37425 - DNA, 20 bp, Artificial Sequence
  Description of Artificial Sequence: Synthetic oligonucleotide
  Target: SCN9A; (-) strand; PAM type: NRG; PAM sequence: AAG
aatagcacatcttacaagtc

SEQ ID NO: 37426 - DNA, 20 bp, Artificial Sequence
  Description of Artificial Sequence: Synthetic oligonucleotide
  Target: SCN9A; (-) strand; PAM type: NRG; PAM sequence: AAG
ccttcaatagcacatcttac

SEQ ID NO: 37427 - DNA, 20 bp, Artificial Sequence
  Description of Artificial Sequence: Synthetic oligonucleotide
  Target: SCN9A; (-) strand; PAM type: NRG; PAM sequence: TAG
ctgaagtttccttccttcaa

SEQ ID NO: 37428 - DNA, 20 bp, Artificial Sequence
  Description of Artificial Sequence: Synthetic oligonucleotide
  Target: SCN9A; (-) strand; PAM type: NRG; PAM sequence: AAG
ttgcacagtctcagtcactg

SEQ ID NO: 37429 - DNA, 20 bp, Artificial Sequence
  Description of Artificial Sequence: Synthetic oligonucleotide
  Target: SCN9A; (-) strand; PAM type: NRG; PAM sequence: CAG
tcaccttcattgcacagtct

SEQ ID NO: 37430 - DNA, 20 bp, Artificial Sequence
  Description of Artificial Sequence: Synthetic oligonucleotide
  Target: SCN9A; (-) strand; PAM type: NRG; PAM sequence: CAG
gctagttcaccttcattgca

SEQ ID NO: 37431 - DNA, 20 bp, Artificial Sequence
  Description of Artificial Sequence: Synthetic oligonucleotide
  Target: SCN9A; (-) strand; PAM type: NRG; PAM sequence: TAG
gagaattatcacaagtgagc

SEQ ID NO: 37432 - DNA, 20 bp, Artificial Sequence
  Description of Artificial Sequence: Synthetic oligonucleotide
  Target: SCN9A; (-) strand; PAM type: NRG; PAM sequence: GAG
cactgagaattatcacaagt

SEQ ID NO: 37433 - DNA, 20 bp, Artificial Sequence
  Description of Artificial Sequence: Synthetic oligonucleotide
  Target: SCN9A; (-) strand; PAM type: NRG; PAM sequence: AAG
atggcactgagaattatcac

SEQ ID NO: 37434 - DNA, 20 bp, Artificial Sequence
  Description of Artificial Sequence: Synthetic oligonucleotide
  Target: SCN9A; (-) strand; PAM type: NRG; PAM sequence: GAG
tttgtccaggatatggcact

SEQ ID NO: 37435 - DNA, 20 bp, Artificial Sequence
  Description of Artificial Sequence: Synthetic oligonucleotide
  Target: SCN9A; (-) strand; PAM type: NRG; PAM sequence: TGG
aaggcgatttgtccaggata

SEQ ID NO: 37436 - DNA, 20 bp, Artificial Sequence
  Description of Artificial Sequence: Synthetic oligonucleotide
  Target: SCN9A; (-) strand; PAM type: NRG; PAM sequence: AGG
gaagagaaggcgatttgtcc

SEQ ID NO: 37437 - DNA, 20 bp, Artificial Sequence
  Description of Artificial Sequence: Synthetic oligonucleotide
  Target: SCN9A; (-) strand; PAM type: NRG; PAM sequence: CAG
ggaagagaaggcgatttgtc

SEQ ID NO: 37438 - DNA, 20 bp, Artificial Sequence
  Description of Artificial Sequence: Synthetic oligonucleotide
  Target: SCN9A; (-) strand; PAM type: NRG; PAM sequence: AGG
accaccaatcagggaagaga

SEQ ID NO: 37439 - DNA, 20 bp, Artificial Sequence
  Description of Artificial Sequence: Synthetic oligonucleotide
  Target: SCN9A; (-) strand; PAM type: NRG; PAM sequence: AAG
taccaccaatcagggaagag

SEQ ID NO: 37440 - DNA, 20 bp, Artificial Sequence
  Description of Artificial Sequence: Synthetic oligonucleotide
  Target: SCN9A; (-) strand; PAM type: NRG; PAM sequence: GAG
atctaccaccaatcagggaa

SEQ ID NO: 37441 - DNA, 20 bp, Artificial Sequence
  Description of Artificial Sequence: Synthetic oligonucleotide
  Target: SCN9A; (-) strand; PAM type: NRG; PAM sequence: AAG
atatctaccaccaatcaggg

SEQ ID NO: 37442 - DNA, 20 bp, Artificial Sequence
  Description of Artificial Sequence: Synthetic oligonucleotide
  Target: SCN9A; (-) strand; PAM type: NRG; PAM sequence: GGG
cctatatctaccaccaatca

SEQ ID NO: 37443 - DNA, 20 bp, Artificial Sequence
  Description of Artificial Sequence: Synthetic oligonucleotide
  Target: SCN9A; (-) strand; PAM type: NRG; PAM sequence: AGG
tcctatatctaccaccaatc

SEQ ID NO: 37444 - DNA, 20 bp, Artificial Sequence
  Description of Artificial Sequence: Synthetic oligonucleotide
  Target: SCN9A; (-) strand; PAM type: NRG; PAM sequence: CAG
ttcctatatctaccaccaat

SEQ ID NO: 37445 - DNA, 20 bp, Artificial Sequence
  Description of Artificial Sequence: Synthetic oligonucleotide
  Target: SCN9A; (-) strand; PAM type: NRG; PAM sequence: CAG
aaagaccattattcctattg

SEQ ID NO: 37446 - DNA, 20 bp, Artificial Sequence
  Description of Artificial Sequence: Synthetic oligonucleotide
  Target: SCN9A; (-) strand; PAM type: NRG; PAM sequence: AAG
attgcttgcatctaataaaa

SEQ ID NO: 37447 - DNA, 20 bp, Artificial Sequence
  Description of Artificial Sequence: Synthetic oligonucleotide
  Target: SCN9A; (-) strand; PAM type: NRG; PAM sequence: TGG
attttaaaaataaaagaatg

SEQ ID NO: 37448 - DNA, 20 bp, Artificial Sequence
  Description of Artificial Sequence: Synthetic oligonucleotide
  Target: SCN9A; (-) strand; PAM type: NRG; PAM sequence: AAG
aaataaaattttaaaaataa

SEQ ID NO: 37449 - DNA, 20 bp, Artificial Sequence
  Description of Artificial Sequence: Synthetic oligonucleotide
  Target: SCN9A; (-) strand; PAM type: NRG; PAM sequence: CAG
aaatctctgtaccctccctt

SEQ ID NO: 37450 - DNA, 20 bp, Artificial Sequence
  Description of Artificial Sequence: Synthetic oligonucleotide
  Target: SCN9A; (-) strand; PAM type: NRG; PAM sequence: GGG
tgtgggagtagcggttatgt

SEQ ID NO: 37451 - DNA, 20 bp, Artificial Sequence
  Description of Artificial Sequence: Synthetic oligonucleotide
  Target: SCN9A; (-) strand; PAM type: NRG; PAM sequence: TGG
gtgtgggagtagcggttatg

SEQ ID NO: 37452 - DNA, 20 bp, Artificial Sequence
  Description of Artificial Sequence: Synthetic oligonucleotide
  Target: SCN9A; (-) strand; PAM type: NRG; PAM sequence: CGG
ctattcttgtgtgggagtag

SEQ ID NO: 37453 - DNA, 20 bp, Artificial Sequence
  Description of Artificial Sequence: Synthetic oligonucleotide
  Target: SCN9A; (-) strand; PAM type: NRG; PAM sequence: TAG
aggctattcttgtgtgggag

SEQ ID NO: 37454 - DNA, 20 bp, Artificial Sequence
  Description of Artificial Sequence: Synthetic oligonucleotide
  Target: SCN9A; (-) strand; PAM type: NRG; PAM sequence: GAG
gggaggctattcttgtgtgg

SEQ ID NO: 37455 - DNA, 20 bp, Artificial Sequence
  Description of Artificial Sequence: Synthetic oligonucleotide
  Target: SCN9A; (-) strand; PAM type: NRG; PAM sequence: GGG
gggggaggctattcttgtgt

SEQ ID NO: 37456 - DNA, 20 bp, Artificial Sequence
  Description of Artificial Sequence: Synthetic oligonucleotide
  Target: SCN9A; (-) strand; PAM type: NRG; PAM sequence: TGG
tgggggaggctattcttgtg

SEQ ID NO: 37457 - DNA, 20 bp, Artificial Sequence
  Description of Artificial Sequence: Synthetic oligonucleotide
  Target: SCN9A; (-) strand; PAM type: NRG; PAM sequence: AGG
gggaatgttgataatggggg

SEQ ID NO: 37458 - DNA, 20 bp, Artificial Sequence
  Description of Artificial Sequence: Synthetic oligonucleotide
  Target: SCN9A; (-) strand; PAM type: NRG; PAM sequence: GAG
ggggaatgttgataatgggg

SEQ ID NO: 37459 - DNA, 20 bp, Artificial Sequence
  Description of Artificial Sequence: Synthetic oligonucleotide
  Target: SCN9A; (-) strand; PAM type: NRG; PAM sequence: GGG
gtggggaatgttgataatgg

SEQ ID NO: 37460 - DNA, 20 bp, Artificial Sequence
  Description of Artificial Sequence: Synthetic oligonucleotide
  Target: SCN9A; (-) strand; PAM type: NRG; PAM sequence: GGG
ggtggggaatgttgataatg

SEQ ID NO: 37461 - DNA, 20 bp, Artificial Sequence
  Description of Artificial Sequence: Synthetic oligonucleotide
  Target: SCN9A; (-) strand; PAM type: NRG; PAM sequence: GGG
tggtggggaatgttgataat

SEQ ID NO: 37462 - DNA, 20 bp, Artificial Sequence
  Description of Artificial Sequence: Synthetic oligonucleotide
  Target: SCN9A; (-) strand; PAM type: NRG; PAM sequence: TGG
ctggtggggaatgttgataa

SEQ ID NO: 37463 - DNA, 20 bp, Artificial Sequence
  Description of Artificial Sequence: Synthetic oligonucleotide
  Target: SCN9A; (-) strand; PAM type: NRG; PAM sequence: GGG
acaaatgtttcattctggtg

SEQ ID NO: 37464 - DNA, 20 bp, Artificial Sequence
  Description of Artificial Sequence: Synthetic oligonucleotide
  Target: SCN9A; (-) strand; PAM type: NRG; PAM sequence: GGG
aacaaatgtttcattctggt

SEQ ID NO: 37465 - DNA, 20 bp, Artificial Sequence
  Description of Artificial Sequence: Synthetic oligonucleotide
  Target: SCN9A; (-) strand; PAM type: NRG; PAM sequence: TGG
taacaaatgtttcattctgg

SEQ ID NO: 37466 - DNA, 20 bp, Artificial Sequence
  Description of Artificial Sequence: Synthetic oligonucleotide
  Target: SCN9A; (-) strand; PAM type: NRG; PAM sequence: TGG
ttttaacaaatgtttcattc

SEQ ID NO: 37467 - DNA, 20 bp, Artificial Sequence
  Description of Artificial Sequence: Synthetic oligonucleotide
  Target: SCN9A; (-) strand; PAM type: NRG; PAM sequence: AAG
agataatgaaacctcaaagt

SEQ ID NO: 37468 - DNA, 20 bp, Artificial Sequence
  Description of Artificial Sequence: Synthetic oligonucleotide
  Target: SCN9A; (-) strand; PAM type: NRG; PAM sequence: AAG
tgggagataatgaaacctca

SEQ ID NO: 37469 - DNA, 20 bp, Artificial Sequence
  Description of Artificial Sequence: Synthetic oligonucleotide
  Target: SCN9A; (-) strand; PAM type: NRG; PAM sequence: GAG
atgtgaactacagaccttgg

SEQ ID NO: 37470 - DNA, 20 bp, Artificial Sequence
  Description of Artificial Sequence: Synthetic oligonucleotide
  Target: SCN9A; (-) strand; PAM type: NRG; PAM sequence: GGG
aaatgtgaactacagacctt

SEQ ID NO: 37471 - DNA, 20 bp, Artificial Sequence
  Description of Artificial Sequence: Synthetic oligonucleotide
  Target: SCN9A; (-) strand; PAM type: NRG; PAM sequence: TGG
taaatgtgaactacagacct

SEQ ID NO: 37472 - DNA, 20 bp, Artificial Sequence
  Description of Artificial Sequence: Synthetic oligonucleotide
  Target: SCN9A; (-) strand; PAM type: NRG; PAM sequence: CAG
ctaaccctaaatgtgaacta

SEQ ID NO: 37473 - DNA, 20 bp, Artificial Sequence
  Description of Artificial Sequence: Synthetic oligonucleotide
  Target: SCN9A; (-) strand; PAM type: NRG; PAM sequence: GAG
catagaatggacaacaccat

SEQ ID NO: 37474 - DNA, 20 bp, Artificial Sequence
  Description of Artificial Sequence: Synthetic oligonucleotide
  Target: SCN9A; (-) strand; PAM type: NRG; PAM sequence: TGG
atttgcctaaccccatagaa

SEQ ID NO: 37475 - DNA, 20 bp, Artificial Sequence
  Description of Artificial Sequence: Synthetic oligonucleotide
  Target: SCN9A; (-) strand; PAM type: NRG; PAM sequence: TAG
tatatatttgcctaacccca

SEQ ID NO: 37476 - DNA, 20 bp, Artificial Sequence
  Description of Artificial Sequence: Synthetic oligonucleotide
  Target: SCN9A; (-) strand; PAM type: NRG; PAM sequence: TGG
tctgtaagatactgtaatgg

SEQ ID NO: 37477 - DNA, 20 bp, Artificial Sequence
  Description of Artificial Sequence: Synthetic oligonucleotide
  Target: SCN9A; (-) strand; PAM type: NRG; PAM sequence: TGG
tactctgtaagatactgtaa

SEQ ID NO: 37478 - DNA, 20 bp, Artificial Sequence
  Description of Artificial Sequence: Synthetic oligonucleotide
  Target: SCN9A; (-) strand; PAM type: NRG; PAM sequence: AAG
gagaactgaaattactctgt

SEQ ID NO: 37479 - DNA, 20 bp, Artificial Sequence
  Description of Artificial Sequence: Synthetic oligonucleotide
  Target: SCN9A; (-) strand; PAM type: NRG; PAM sequence: GAG
ggaacacagagaattcagga

SEQ ID NO: 37480 - DNA, 20 bp, Artificial Sequence
  Description of Artificial Sequence: Synthetic oligonucleotide
  Target: SCN9A; (-) strand; PAM type: NRG; PAM sequence: GAG
gtggaacacagagaattcag

SEQ ID NO: 37481 - DNA, 20 bp, Artificial Sequence
  Description of Artificial Sequence: Synthetic oligonucleotide
  Target: SCN9A; (-) strand; PAM type: NRG; PAM sequence: AGG
aagtggaacacagagaattc

SEQ ID NO: 37482 - DNA, 20 bp, Artificial Sequence
  Description of Artificial Sequence: Synthetic oligonucleotide
  Target: SCN9A; (-) strand; PAM type: NRG; PAM sequence: CAG
taagtggaacacagagaatt

SEQ ID NO: 37483 - DNA, 20 bp, Artificial Sequence
  Description of Artificial Sequence: Synthetic oligonucleotide
  Target: SCN9A; (-) strand; PAM type: NRG; PAM sequence: GAG
agatgaataagtggaacaca

SEQ ID NO: 37484 - DNA, 20 bp, Artificial Sequence
  Description of Artificial Sequence: Synthetic oligonucleotide
  Target: SCN9A; (-) strand; PAM type: NRG; PAM sequence: CAG
ggagatgaataagtggaaca

SEQ ID NO: 37485 - DNA, 20 bp, Artificial Sequence
  Description of Artificial Sequence: Synthetic oligonucleotide
  Target: SCN9A; (-) strand; PAM type: NRG; PAM sequence: TGG
tgaaatgggagatgaataag

SEQ ID NO: 37486 - DNA, 20 bp, Artificial Sequence
  Description of Artificial Sequence: Synthetic oligonucleotide
  Target: SCN9A; (-) strand; PAM type: NRG; PAM sequence: AAG
ggttgaaatgggagatgaat

SEQ ID NO: 37487 - DNA, 20 bp, Artificial Sequence
  Description of Artificial Sequence: Synthetic oligonucleotide
  Target: SCN9A; (-) strand; PAM type: NRG; PAM sequence: GAG
cttgccaggggttgaaatgg

SEQ ID NO: 37488 - DNA, 20 bp, Artificial Sequence
  Description of Artificial Sequence: Synthetic oligonucleotide
  Target: SCN9A; (-) strand; PAM type: NRG; PAM sequence: GGG
tacttgccaggggttgaaat

SEQ ID NO: 37489 - DNA, 20 bp, Artificial Sequence
  Description of Artificial Sequence: Synthetic oligonucleotide
  Target: SCN9A; (-) strand; PAM type: NRG; PAM sequence: TGG
gtacttgccaggggttgaaa

SEQ ID NO: 37490 - DNA, 20 bp, Artificial Sequence
  Description of Artificial Sequence: Synthetic oligonucleotide
  Target: SCN9A; (-) strand; PAM type: NRG; PAM sequence: GGG
aaatgatcagtacttgccag

SEQ ID NO: 37491 - DNA, 20 bp, Artificial Sequence
  Description of Artificial Sequence: Synthetic oligonucleotide
  Target: SCN9A; (-) strand; PAM type: NRG; PAM sequence: GGG
aaaatgatcagtacttgcca

SEQ ID NO: 37492 - DNA, 20 bp, Artificial Sequence
  Description of Artificial Sequence: Synthetic oligonucleotide
  Target: SCN9A; (-) strand; PAM type: NRG; PAM sequence: AGG
taaaatgatcagtacttgcc

SEQ ID NO: 37493 - DNA, 20 bp, Artificial Sequence
  Description of Artificial Sequence: Synthetic oligonucleotide
  Target: SCN9A; (-) strand; PAM type: NRG; PAM sequence: CAG
gtaaaatgatcagtacttgc

SEQ ID NO: 37494 - DNA, 20 bp, Artificial Sequence
  Description of Artificial Sequence: Synthetic oligonucleotide
  Target: SCN9A; (-) strand; PAM type: NRG; PAM sequence: CAG
tataaagacagtaaaatgat

SEQ ID NO: 37495 - DNA, 20 bp, Artificial Sequence
  Description of Artificial Sequence: Synthetic oligonucleotide
  Target: SCN9A; (-) strand; PAM type: NRG; PAM sequence: CAG
agaaggcaaaactataaaga

SEQ ID NO: 37496 - DNA, 20 bp, Artificial Sequence
  Description of Artificial Sequence: Synthetic oligonucleotide
  Target: SCN9A; (-) strand; PAM type: NRG; PAM sequence: AAG
ctggagaaggcaaaactata

SEQ ID NO: 37497 - DNA, 20 bp, Artificial Sequence
  Description of Artificial Sequence: Synthetic oligonucleotide
  Target: SCN9A; (-) strand; PAM type: NRG; PAM sequence: AGG
actataggatatcctggaga

SEQ ID NO: 37498 - DNA, 20 bp, Artificial Sequence
  Description of Artificial Sequence: Synthetic oligonucleotide
  Target: SCN9A; (-) strand; PAM type: NRG; PAM sequence: AAG
aactataggatatcctggag

SEQ ID NO: 37499 - DNA, 20 bp, Artificial Sequence
  Description of Artificial Sequence: Synthetic oligonucleotide
  Target: SCN9A; (-) strand; PAM type: NRG; PAM sequence: GAG
tgcaactataggatatcctg

SEQ ID NO: 37500 - DNA, 20 bp, Artificial Sequence
  Description of Artificial Sequence: Synthetic oligonucleotide
  Target: SCN9A; (-) strand; PAM type: NRG; PAM sequence: TGG
attgcaactataggatatcc

SEQ ID NO: 37501 - DNA, 20 bp, Artificial Sequence
  Description of Artificial Sequence: Synthetic oligonucleotide
  Target: SCN9A; (-) strand; PAM type: NRG; PAM sequence: AGG
ttctgtattattgcaactat

SEQ ID NO: 37502 - DNA, 20 bp, Artificial Sequence
  Description of Artificial Sequence: Synthetic oligonucleotide
  Target: SCN9A; (-) strand; PAM type: NRG; PAM sequence: TAG
attctgtattattgcaacta

SEQ ID NO: 37503 - DNA, 20 bp, Artificial Sequence
  Description of Artificial Sequence: Synthetic oligonucleotide
  Target: SCN9A; (-) strand; PAM type: NRG; PAM sequence: GGG
tgaaaggagtcaatctgaaa

SEQ ID NO: 37504 - DNA, 20 bp, Artificial Sequence
  Description of Artificial Sequence: Synthetic oligonucleotide
  Target: SCN9A; (-) strand; PAM type: NRG; PAM sequence: AGG
gtgaaaggagtcaatctgaa

SEQ ID NO: 37505 - DNA, 20 bp, Artificial Sequence
  Description of Artificial Sequence: Synthetic oligonucleotide
  Target: SCN9A; (-) strand; PAM type: NRG; PAM sequence: AAG
agtgaaaggagtcaatctga

SEQ ID NO: 37506 - DNA, 20 bp, Artificial Sequence
  Description of Artificial Sequence: Synthetic oligonucleotide
  Target: SCN9A; (-) strand; PAM type: NRG; PAM sequence: GAG
agcatattgctaagtgaaag

SEQ ID NO: 37507 - DNA, 20 bp, Artificial Sequence
  Description of Artificial Sequence: Synthetic oligonucleotide
  Target: SCN9A; (-) strand; PAM type: NRG; PAM sequence: AGG
aaagcatattgctaagtgaa

SEQ ID NO: 37508 - DNA, 20 bp, Artificial Sequence
  Description of Artificial Sequence: Synthetic oligonucleotide
  Target: SCN9A; (-) strand; PAM type: NRG; PAM sequence: AAG
aaaagcatattgctaagtga

SEQ ID NO: 37509 - DNA, 20 bp, Artificial Sequence
  Description of Artificial Sequence: Synthetic oligonucleotide
  Target: SCN9A; (-) strand; PAM type: NRG; PAM sequence: AAG
aaaactaaaagcatattgct

SEQ ID NO: 37510 - DNA, 20 bp, Artificial Sequence
  Description of Artificial Sequence: Synthetic oligonucleotide
  Target: SCN9A; (-) strand; PAM type: NRG; PAM sequence: AAG
aagccatggaggaaaactaa

SEQ ID NO: 37511 - DNA, 20 bp, Artificial Sequence
  Description of Artificial Sequence: Synthetic oligonucleotide
  Target: SCN9A; (-) strand; PAM type: NRG; PAM sequence: AGG
caagctatgaaaagccatgg

SEQ ID NO: 37512 - DNA, 20 bp, Artificial Sequence
  Description of Artificial Sequence: Synthetic oligonucleotide
  Target: SCN9A; (-) strand; PAM type: NRG; PAM sequence: GAG
tcaagctatgaaaagccatg

SEQ ID NO: 37513 - DNA, 20 bp, Artificial Sequence
  Description of Artificial Sequence: Synthetic oligonucleotide
  Target: SCN9A; (-) strand; PAM type: NRG; PAM sequence: TGG
tatcaagctatgaaaagcca

SEQ ID NO: 37514 - DNA, 20 bp, Artificial Sequence
  Description of Artificial Sequence: Synthetic oligonucleotide
  Target: SCN9A; (-) strand; PAM type: NRG; PAM sequence: AAG
atgagctatcaagctatgaa

SEQ ID NO: 37515 - DNA, 20 bp, Artificial Sequence
  Description of Artificial Sequence: Synthetic oligonucleotide
  Target: SCN9A; (-) strand; PAM type: NRG; PAM sequence: AAG
ctgtaaagaaatgagctatc

SEQ ID NO: 37516 - DNA, 20 bp, Artificial Sequence
  Description of Artificial Sequence: Synthetic oligonucleotide
  Target: SCN9A; (-) strand; PAM type: NRG; PAM sequence: GAG
attcagcactgtaaagaaat

SEQ ID NO: 37517 - DNA, 20 bp, Artificial Sequence
  Description of Artificial Sequence: Synthetic oligonucleotide
  Target: SCN9A; (-) strand; PAM type: NRG; PAM sequence: AAG
gaatattattcagcactgta

SEQ ID NO: 37518 - DNA, 20 bp, Artificial Sequence
  Description of Artificial Sequence: Synthetic oligonucleotide
  Target: SCN9A; (-) strand; PAM type: NRG; PAM sequence: CAG
ccagtcaatggaatattatt

SEQ ID NO: 37519 - DNA, 20 bp, Artificial Sequence
  Description of Artificial Sequence: Synthetic oligonucleotide
  Target: SCN9A; (-) strand; PAM type: NRG; PAM sequence: TGG
actatggtaccaccagtcaa

SEQ ID NO: 37520 - DNA, 20 bp, Artificial Sequence
  Description of Artificial Sequence: Synthetic oligonucleotide
  Target: SCN9A; (-) strand; PAM type: NRG; PAM sequence: CAG
tgaataaactatggtaccac

SEQ ID NO: 37521 - DNA, 20 bp, Artificial Sequence
  Description of Artificial Sequence: Synthetic oligonucleotide
  Target: SCN9A; (-) strand; PAM type: NRG; PAM sequence: TGG
gtaggtgaatgaataaacta

SEQ ID NO: 37522 - DNA, 20 bp, Artificial Sequence
  Description of Artificial Sequence: Synthetic oligonucleotide
  Target: SCN9A; (-) strand; PAM type: NRG; PAM sequence: AGG
caaacaagatgtccttcagt

SEQ ID NO: 37523 - DNA, 20 bp, Artificial Sequence
  Description of Artificial Sequence: Synthetic oligonucleotide
  Target: SCN9A; (-) strand; PAM type: NRG; PAM sequence: TAG
gcaaacaagatgtccttcag

SEQ ID NO: 37524 - DNA, 20 bp, Artificial Sequence
  Description of Artificial Sequence: Synthetic oligonucleotide
  Target: SCN9A; (-) strand; PAM type: NRG; PAM sequence: CAG
gaagcaaacaagatgtcctt

SEQ ID NO: 37525 - DNA, 20 bp, Artificial Sequence
  Description of Artificial Sequence: Synthetic oligonucleotide
  Target: SCN9A; (-) strand; PAM type: NRG; PAM sequence: AAG
gctaaaacttggaagcaaac

SEQ ID NO: 37526 - DNA, 20 bp, Artificial Sequence
  Description of Artificial Sequence: Synthetic oligonucleotide
  Target: SCN9A; (-) strand; PAM type: NRG; PAM sequence: AAG
gcataattgctaaaacttgg

SEQ ID NO: 37527 - DNA, 20 bp, Artificial Sequence
  Description of Artificial Sequence: Synthetic oligonucleotide
  Target: SCN9A; (-) strand; PAM type: NRG; PAM sequence: TGG
tacgcataattgctaaaact

SEQ ID NO: 37528 - DNA, 20 bp, Artificial Sequence
  Description of Artificial Sequence: Synthetic oligonucleotide
  Target: SCN9A; (-) strand; PAM type: NRG; PAM sequence: AGG
cttcacaaagatgtttatag

SEQ ID NO: 37529 - DNA, 20 bp, Artificial Sequence
  Description of Artificial Sequence: Synthetic oligonucleotide
  Target: SCN9A; (-) strand; PAM type: NRG; PAM sequence: GAG
ccttcacaaagatgtttata

SEQ ID NO: 37530 - DNA, 20 bp, Artificial Sequence
  Description of Artificial Sequence: Synthetic oligonucleotide
  Target: SCN9A; (-) strand; PAM type: NRG; PAM sequence: TAG
aaccttcacaaagatgttta

SEQ ID NO: 37531 - DNA, 20 bp, Artificial Sequence
  Description of Artificial Sequence: Synthetic oligonucleotide
  Target: SCN9A; (-) strand; PAM type: NRG; PAM sequence: AAG
tccacacagtaaccttcaca

SEQ ID NO: 37532 - DNA, 20 bp, Artificial Sequence
  Description of Artificial Sequence: Synthetic oligonucleotide
  Target: SCN9A; (-) strand; PAM type: NRG; PAM sequence: CAG
gacttgaaaacatgtccaca

SEQ ID NO: 37533 - DNA, 20 bp, Artificial Sequence
  Description of Artificial Sequence: Synthetic oligonucleotide
  Target: SCN9A; (-) strand; PAM type: NRG; PAM sequence: AGG
gctccttgatgttcacccaa

SEQ ID NO: 37534 - DNA, 20 bp, Artificial Sequence
  Description of Artificial Sequence: Synthetic oligonucleotide
  Target: SCN9A; (-) strand; PAM type: NRG; PAM sequence: AAG
tgctccttgatgttcaccca

SEQ ID NO: 37535 - DNA, 20 bp, Artificial Sequence
  Description of Artificial Sequence: Synthetic oligonucleotide
  Target: SCN9A; (-) strand; PAM type: NRG; PAM sequence: CAG
catactctcaccatatgatc

SEQ ID NO: 37536 - DNA, 20 bp, Artificial Sequence
  Description of Artificial Sequence: Synthetic oligonucleotide
  Target: SCN9A; (-) strand; PAM type: NRG; PAM sequence: CAG
ccactttgaggacagtgtag

SEQ ID NO: 37537 - DNA, 20 bp, Artificial Sequence
  Description of Artificial Sequence: Synthetic oligonucleotide
  Target: SCN9A; (-) strand; PAM type: NRG; PAM sequence: TAG
cagccactttgaggacagtg

SEQ ID NO: 37538 - DNA, 20 bp, Artificial Sequence
  Description of Artificial Sequence: Synthetic oligonucleotide
  Target: SCN9A; (-) strand; PAM type: NRG; PAM sequence: CAG
tgctccagccactttgagga

SEQ ID NO: 37539 - DNA, 20 bp, Artificial Sequence
  Description of Artificial Sequence: Synthetic oligonucleotide
  Target: SCN9A; (-) strand; PAM type: NRG; PAM sequence: AGG
aaaatgctccagccactttg

SEQ ID NO: 37540 - DNA, 20 bp, Artificial Sequence
  Description of Artificial Sequence: Synthetic oligonucleotide
  Target: SCN9A; (-) strand; PAM type: NRG; PAM sequence: GAG
caaaatgctccagccacttt

SEQ ID NO: 37541 - DNA, 20 bp, Artificial Sequence
  Description of Artificial Sequence: Synthetic oligonucleotide
  Target: SCN9A; (-) strand; PAM type: NRG; PAM sequence: CAG
ggtgggaatgcaaaatgctc

SEQ ID NO: 37542 - DNA, 20 bp, Artificial Sequence
  Description of Artificial Sequence: Synthetic oligonucleotide
  Target: SCN9A; (-) strand; PAM type: NRG; PAM sequence: GGG
aactctcatgtattgctggt

SEQ ID NO: 37543 - DNA, 20 bp, Artificial Sequence
  Description of Artificial Sequence: Synthetic oligonucleotide
  Target: SCN9A; (-) strand; PAM type: NRG; PAM sequence: TGG
gaactctcatgtattgctgg

SEQ ID NO: 37544 - DNA, 20 bp, Artificial Sequence
  Description of Artificial Sequence: Synthetic oligonucleotide
  Target: SCN9A; (-) strand; PAM type: NRG; PAM sequence: TGG
caggaactctcatgtattgc

SEQ ID NO: 37545 - DNA, 20 bp, Artificial Sequence
  Description of Artificial Sequence: Synthetic oligonucleotide
  Target: SCN9A; (-) strand; PAM type: NRG; PAM sequence: AGG
ggccaaggatgtgaggcaac

SEQ ID NO: 37546 - DNA, 20 bp, Artificial Sequence
  Description of Artificial Sequence: Synthetic oligonucleotide
  Target: SCN9A; (-) strand; PAM type: NRG; PAM sequence: CAG
tggccaaggatgtgaggcaa

SEQ ID NO: 37547 - DNA, 20 bp, Artificial Sequence
  Description of Artificial Sequence: Synthetic oligonucleotide
  Target: SCN9A; (-) strand; PAM type: NRG; PAM sequence: AGG
aagttctggccaaggatgtg

SEQ ID NO: 37548 - DNA, 20 bp, Artificial Sequence
  Description of Artificial Sequence: Synthetic oligonucleotide
  Target: SCN9A; (-) strand; PAM type: NRG; PAM sequence: GAG
caagttctggccaaggatgt

SEQ ID NO: 37549 - DNA, 20 bp, Artificial Sequence
  Description of Artificial Sequence: Synthetic oligonucleotide
  Target: SCN9A; (-) strand; PAM type: NRG; PAM sequence: AGG
atgatatcaagttctggcca

SEQ ID NO: 37550 - DNA, 20 bp, Artificial Sequence
  Description of Artificial Sequence: Synthetic oligonucleotide
  Target: SCN9A; (-) strand; PAM type: NRG; PAM sequence: AAG
gatgatatcaagttctggcc

SEQ ID NO: 37551 - DNA, 20 bp, Artificial Sequence
  Description of Artificial Sequence: Synthetic oligonucleotide
  Target: SCN9A; (-) strand; PAM type: NRG; PAM sequence: TGG
acactgatgatatcaagttc

SEQ ID NO: 37552 - DNA, 20 bp, Artificial Sequence
  Description of Artificial Sequence: Synthetic oligonucleotide
  Target: SCN9A; (-) strand; PAM type: NRG; PAM sequence: AAG
tccagaacactgatgatatc

SEQ ID NO: 37553 - DNA, 20 bp, Artificial Sequence
  Description of Artificial Sequence: Synthetic oligonucleotide
  Target: SCN9A; (-) strand; PAM type: NRG; PAM sequence: CAG
gtattggaataaccaaaatc

SEQ ID NO: 37554 - DNA, 20 bp, Artificial Sequence
  Description of Artificial Sequence: Synthetic oligonucleotide
  Target: SCN9A; (-) strand; PAM type: NRG; PAM sequence: TGG
agataccaccacatatgtat

SEQ ID NO: 37555 - DNA, 20 bp, Artificial Sequence
  Description of Artificial Sequence: Synthetic oligonucleotide
  Target: SCN9A; (-) strand; PAM type: NRG; PAM sequence: GAG
atggtatcaacaatgggcat

SEQ ID NO: 37556 - DNA, 20 bp, Artificial Sequence
  Description of Artificial Sequence: Synthetic oligonucleotide
  Target: SCN9A; (-) strand; PAM type: NRG; PAM sequence: GGG
acacttatggtatcaacaat

SEQ ID NO: 37557 - DNA, 20 bp, Artificial Sequence
  Description of Artificial Sequence: Synthetic oligonucleotide
  Target: SCN9A; (-) strand; PAM type: NRG; PAM sequence: TGG
aacacttatggtatcaacaa

SEQ ID NO: 37558 - DNA, 20 bp, Artificial Sequence
  Description of Artificial Sequence: Synthetic oligonucleotide
  Target: SCN9A; (-) strand; PAM type: NRG; PAM sequence: TGG
tgcaaatcaaataacactta

SEQ ID NO: 37559 - DNA, 20 bp, Artificial Sequence
  Description of Artificial Sequence: Synthetic oligonucleotide
  Target: SCN9A; (-) strand; PAM type: NRG; PAM sequence: GGG
atccacatcatatatcacag

SEQ ID NO: 37560 - DNA, 20 bp, Artificial Sequence
  Description of Artificial Sequence: Synthetic oligonucleotide
  Target: SCN9A; (-) strand; PAM type: NRG; PAM sequence: GGG
gatccacatcatatatcaca

SEQ ID NO: 37561 - DNA, 20 bp, Artificial Sequence
  Description of Artificial Sequence: Synthetic oligonucleotide
  Target: SCN9A; (-) strand; PAM type: NRG; PAM sequence: AGG
tgatccacatcatatatcac

SEQ ID NO: 37562 - DNA, 20 bp, Artificial Sequence
  Description of Artificial Sequence: Synthetic oligonucleotide
  Target: SCN9A; (-) strand; PAM type: NRG; PAM sequence: CAG
gtgatccacatcatatatca

SEQ ID NO: 37563 - DNA, 20 bp, Artificial Sequence
  Description of Artificial Sequence: Synthetic oligonucleotide
  Target: SCN9A; (-) strand; PAM type: NRG; PAM sequence: AGG
ttgcaaataagcatataaaa

SEQ ID NO: 37564 - DNA, 20 bp, Artificial Sequence
  Description of Artificial Sequence: Synthetic oligonucleotide
  Target: SCN9A; (-) strand; PAM type: NRG; PAM sequence: AAG
attgcaaataagcatataaa

SEQ ID NO: 37565 - DNA, 20 bp, Artificial Sequence
  Description of Artificial Sequence: Synthetic oligonucleotide
  Target: SCN9A; (-) strand; PAM type: NRG; PAM sequence: AAG
aagatgcacatattgcaaat

SEQ ID NO: 37566 - DNA, 20 bp, Artificial Sequence
  Description of Artificial Sequence: Synthetic oligonucleotide
  Target: SCN9A; (-) strand; PAM type: NRG; PAM sequence: AAG
tataccttaacagaccaaag

SEQ ID NO: 37567 - DNA, 20 bp, Artificial Sequence
  Description of Artificial Sequence: Synthetic oligonucleotide
  Target: SCN9A; (-) strand; PAM type: NRG; PAM sequence: AAG
ccatataccttaacagacca

SEQ ID NO: 37568 - DNA, 20 bp, Artificial Sequence
  Description of Artificial Sequence: Synthetic oligonucleotide
  Target: SCN9A; (-) strand; PAM type: NRG; PAM sequence: CAG
aaatgggccatataccttaa

SEQ ID NO: 37569 - DNA, 20 bp, Artificial Sequence
  Description of Artificial Sequence: Synthetic oligonucleotide
  Target: SCN9A; (-) strand; PAM type: NRG; PAM sequence: GGG
aataacccaatgaaaaaaat

SEQ ID NO: 37570 - DNA, 20 bp, Artificial Sequence
  Description of Artificial Sequence: Synthetic oligonucleotide
  Target: SCN9A; (-) strand; PAM type: NRG; PAM sequence: TGG
aaataacccaatgaaaaaaa

SEQ ID NO: 37571 - DNA, 20 bp, Artificial Sequence
  Description of Artificial Sequence: Synthetic oligonucleotide
  Target: SCN9A; (-) strand; PAM type: NRG; PAM sequence: AAG
ttaaaactcaacaacaagaa

SEQ ID NO: 37572 - DNA, 20 bp, Artificial Sequence
  Description of Artificial Sequence: Synthetic oligonucleotide
  Target: SCN9A; (-) strand; PAM type: NRG; PAM sequence: AAG
aaagcttaaaactcaacaac

SEQ ID NO: 37573 - DNA, 20 bp, Artificial Sequence
  Description of Artificial Sequence: Synthetic oligonucleotide
  Target: SCN9A; (-) strand; PAM type: NRG; PAM sequence: AAG
ttaaccaaaatatacaaata

SEQ ID NO: 37574 - DNA, 20 bp, Artificial Sequence
  Description of Artificial Sequence: Synthetic oligonucleotide
  Target: SCN9A; (-) strand; PAM type: NRG; PAM sequence: AAG
tgttagataaatatttgcaa

SEQ ID NO: 37575 - DNA, 20 bp, Artificial Sequence
  Description of Artificial Sequence: Synthetic oligonucleotide
  Target: SCN9A; (-) strand; PAM type: NRG; PAM sequence: TAG
aacggacaacaagccagtgt

SEQ ID NO: 37576 - DNA, 20 bp, Artificial Sequence
  Description of Artificial Sequence: Synthetic oligonucleotide
  Target: SCN9A; (-) strand; PAM type: NRG; PAM sequence: CAG
tgcaaaaacggacaacaagc

SEQ ID NO: 37577 - DNA, 20 bp, Artificial Sequence
  Description of Artificial Sequence: Synthetic oligonucleotide
  Target: SCN9A; (-) strand; PAM type: NRG; PAM sequence: AAG
gctctgcaaaaacggacaac

SEQ ID NO: 37578 - DNA, 20 bp, Artificial Sequence
  Description of Artificial Sequence: Synthetic oligonucleotide
  Target: SCN9A; (-) strand; PAM type: NRG; PAM sequence: CGG
aaacttctgctctgcaaaaa

SEQ ID NO: 37579 - DNA, 20 bp, Artificial Sequence
  Description of Artificial Sequence: Synthetic oligonucleotide
  Target: SCN9A; (-) strand; PAM type: NRG; PAM sequence: AGG
tataagagacataattgcta

SEQ ID NO: 37580 - DNA, 20 bp, Artificial Sequence
  Description of Artificial Sequence: Synthetic oligonucleotide
  Target: SCN9A; (-) strand; PAM type: NRG; PAM sequence: AAG
ctataagagacataattgct

SEQ ID NO: 37581 - DNA, 20 bp, Artificial Sequence
  Description of Artificial Sequence: Synthetic oligonucleotide
  Target: SCN9A; (-) strand; PAM type: NRG; PAM sequence: GAG
agcaaaggcataatctataa

SEQ ID NO: 37582 - DNA, 20 bp, Artificial Sequence
  Description of Artificial Sequence: Synthetic oligonucleotide
  Target: SCN9A; (-) strand; PAM type: NRG; PAM sequence: AAG
acagcaaaggcataatctat

SEQ ID NO: 37583 - DNA, 20 bp, Artificial Sequence
  Description of Artificial Sequence: Synthetic oligonucleotide
  Target: SCN9A; (-) strand; PAM type: NRG; PAM sequence: AGG
tattctagatataacagcaa

SEQ ID NO: 37584 - DNA, 20 bp, Artificial Sequence
  Description of Artificial Sequence: Synthetic oligonucleotide
  Target: SCN9A; (-) strand; PAM type: NRG; PAM sequence: AAG
ttattctagatataacagca

SEQ ID NO: 37585 - DNA, 20 bp, Artificial Sequence
  Description of Artificial Sequence: Synthetic oligonucleotide
  Target: SCN9A; (-) strand; PAM type: NRG; PAM sequence: CAG
atgtgttattctagatataa

SEQ ID NO: 37586 - DNA, 20 bp, Artificial Sequence
  Description of Artificial Sequence: Synthetic oligonucleotide
  Target: SCN9A; (-) strand; PAM type: NRG; PAM sequence: TAG
atctaacatatgtgttattc

SEQ ID NO: 37587 - DNA, 20 bp, Artificial Sequence
  Description of Artificial Sequence: Synthetic oligonucleotide
  Target: SCN9A; (-) strand; PAM type: NRG; PAM sequence: AAG
tgcattatatattccactct

SEQ ID NO: 37588 - DNA, 20 bp, Artificial Sequence
  Description of Artificial Sequence: Synthetic oligonucleotide
  Target: SCN9A; (-) strand; PAM type: NRG; PAM sequence: AGG
tataacatgttataatatat

SEQ ID NO: 37589 - DNA, 20 bp, Artificial Sequence
  Description of Artificial Sequence: Synthetic oligonucleotide
  Target: SCN9A; (-) strand; PAM type: NRG; PAM sequence: TAG
atataacatgttataatata

SEQ ID NO: 37590 - DNA, 20 bp, Artificial Sequence
  Description of Artificial Sequence: Synthetic oligonucleotide
  Target: SCN9A; (-) strand; PAM type: NRG; PAM sequence: TAG
acatatattataacataata

SEQ ID NO: 37591 - DNA, 20 bp, Artificial Sequence
  Description of Artificial Sequence: Synthetic oligonucleotide
  Target: SCN9A; (-) strand; PAM type: NRG; PAM sequence: TGG
ttgttaatggatgcttaaag

SEQ ID NO: 37592 - DNA, 20 bp, Artificial Sequence
  Description of Artificial Sequence: Synthetic oligonucleotide
  Target: SCN9A; (-) strand; PAM type: NRG; PAM sequence: AAG
ttcttgttaatggatgctta

SEQ ID NO: 37593 - DNA, 20 bp, Artificial Sequence
  Description of Artificial Sequence: Synthetic oligonucleotide
  Target: SCN9A; (-) strand; PAM type: NRG; PAM sequence: TGG
gaatagtaagttcttgttaa

SEQ ID NO: 37594 - DNA, 20 bp, Artificial Sequence
  Description of Artificial Sequence: Synthetic oligonucleotide
  Target: SCN9A; (-) strand; PAM type: NRG; PAM sequence: AAG
ctagatatattgagaatagt

SEQ ID NO: 37595 - DNA, 20 bp, Artificial Sequence
  Description of Artificial Sequence: Synthetic oligonucleotide
  Target: SCN9A; (-) strand; PAM type: NRG; PAM sequence: TAG
gaacctagatatattgagaa

SEQ ID NO: 37596 - DNA, 20 bp, Artificial Sequence
  Description of Artificial Sequence: Synthetic oligonucleotide
  Target: SCN9A; (-) strand; PAM type: NRG; PAM sequence: GAG
aacaagaacctagatatatt

SEQ ID NO: 37597 - DNA, 20 bp, Artificial Sequence
  Description of Artificial Sequence: Synthetic oligonucleotide
  Target: SCN9A; (-) strand; PAM type: NRG; PAM sequence: TAG
gaagatctctaacaagaacc

SEQ ID NO: 37598 - DNA, 20 bp, Artificial Sequence
  Description of Artificial Sequence: Synthetic oligonucleotide
  Target: SCN9A; (-) strand; PAM type: NRG; PAM sequence: AAG
tatgtttgaagatctctaac

SEQ ID NO: 37599 - DNA, 20 bp, Artificial Sequence
  Description of Artificial Sequence: Synthetic oligonucleotide
  Target: SCN9A; (-) strand; PAM type: NRG; PAM sequence: AAG
tttccaggattttatgtttg

SEQ ID NO: 37600 - DNA, 20 bp, Artificial Sequence
  Description of Artificial Sequence: Synthetic oligonucleotide
  Target: SCN9A; (-) strand; PAM type: NRG; PAM sequence: AGG
ttttggttttatcattttcc

SEQ ID NO: 37601 - DNA, 20 bp, Artificial Sequence
  Description of Artificial Sequence: Synthetic oligonucleotide
  Target: SCN9A; (-) strand; PAM type: NRG; PAM sequence: CAG
tttttggttttatcattttc

SEQ ID NO: 37602 - DNA, 20 bp, Artificial Sequence
  Description of Artificial Sequence: Synthetic oligonucleotide
  Target: SCN9A; (-) strand; PAM type: NRG; PAM sequence: TGG
gaccaagaggattttatttt

SEQ ID NO: 37603 - DNA, 20 bp, Artificial Sequence
  Description of Artificial Sequence: Synthetic oligonucleotide
  Target: SCN9A; (-) strand; PAM type: NRG; PAM sequence: AGG
gatccctcagtcagaccaag

SEQ ID NO: 37604 - DNA, 20 bp, Artificial Sequence
  Description of Artificial Sequence: Synthetic oligonucleotide
  Target: SCN9A; (-) strand; PAM type: NRG; PAM sequence: GAG
ggatccctcagtcagaccaa

SEQ ID NO: 37605 - DNA, 20 bp, Artificial Sequence
  Description of Artificial Sequence: Synthetic oligonucleotide
  Target: SCN9A; (-) strand; PAM type: NRG; PAM sequence: AAG
agggatccctcagtcagacc

SEQ ID NO: 37606 - DNA, 20 bp, Artificial Sequence
  Description of Artificial Sequence: Synthetic oligonucleotide
  Target: SCN9A; (-) strand; PAM type: NRG; PAM sequence: CAG
cctgcaagggatccctcagt

SEQ ID NO: 37607 - DNA, 20 bp, Artificial Sequence
  Description of Artificial Sequence: Synthetic oligonucleotide
  Target: SCN9A; (-) strand; PAM type: NRG; PAM sequence: CAG
aaatcctgcaagggatccct

SEQ ID NO: 37608 - DNA, 20 bp, Artificial Sequence
  Description of Artificial Sequence: Synthetic oligonucleotide
  Target: SCN9A; (-) strand; PAM type: NRG; PAM sequence: GGG
tcacagggaaaatcctgcaa

SEQ ID NO: 37609 - DNA, 20 bp, Artificial Sequence
  Description of Artificial Sequence: Synthetic oligonucleotide
  Target: SCN9A; (-) strand; PAM type: NRG; PAM sequence: AGG
ctcacagggaaaatcctgca

SEQ ID NO: 37610 - DNA, 20 bp, Artificial Sequence
  Description of Artificial Sequence: Synthetic oligonucleotide
  Target: SCN9A; (-) strand; PAM type: NRG; PAM sequence: AAG
gctcacagggaaaatcctgc

SEQ ID NO: 37611 - DNA, 20 bp, Artificial Sequence
  Description of Artificial Sequence: Synthetic oligonucleotide
  Target: SCN9A; (-) strand; PAM type: NRG; PAM sequence: GGG
gctttgcctatgagctcaca

SEQ ID NO: 37612 - DNA, 20 bp, Artificial Sequence
  Description of Artificial Sequence: Synthetic oligonucleotide
  Target: SCN9A; (-) strand; PAM type: NRG; PAM sequence: AGG
tgctttgcctatgagctcac

SEQ ID NO: 37613 - DNA, 20 bp, Artificial Sequence
  Description of Artificial Sequence: Synthetic oligonucleotide
  Target: SCN9A; (-) strand; PAM type: NRG; PAM sequence: CAG
atgctttgcctatgagctca

SEQ ID NO: 37614 - DNA, 20 bp, Artificial Sequence
  Description of Artificial Sequence: Synthetic oligonucleotide
  Target: SCN9A; (-) strand; PAM type: NRG; PAM sequence: GAG
atacctaatgctttgcctat

SEQ ID NO: 37615 - DNA, 20 bp, Artificial Sequence
  Description of Artificial Sequence: Synthetic oligonucleotide
  Target: SCN9A; (-) strand; PAM type: NRG; PAM sequence: GGG
ttggaacatgaaagaaaatt

SEQ ID NO: 37616 - DNA, 20 bp, Artificial Sequence
  Description of Artificial Sequence: Synthetic oligonucleotide
  Target: SCN9A; (-) strand; PAM type: NRG; PAM sequence: TGG
gttggaacatgaaagaaaat

SEQ ID NO: 37617 - DNA, 20 bp, Artificial Sequence
  Description of Artificial Sequence: Synthetic oligonucleotide
  Target: SCN9A; (-) strand; PAM type: NRG; PAM sequence: AAG
aataaatagttggaacatga

SEQ ID NO: 37618 - DNA, 20 bp, Artificial Sequence
  Description of Artificial Sequence: Synthetic oligonucleotide
  Target: SCN9A; (-) strand; PAM type: NRG; PAM sequence: TGG
atggaaaggaaataaatagt

SEQ ID NO: 37619 - DNA, 20 bp, Artificial Sequence
  Description of Artificial Sequence: Synthetic oligonucleotide
  Target: SCN9A; (-) strand; PAM type: NRG; PAM sequence: TAG
agaaatggaaaggaaataaa

SEQ ID NO: 37620 - DNA, 20 bp, Artificial Sequence
  Description of Artificial Sequence: Synthetic oligonucleotide
  Target: SCN9A; (-) strand; PAM type: NRG; PAM sequence: AGG
ggcacataaaagaaatggaa

SEQ ID NO: 37621 - DNA, 20 bp, Artificial Sequence
  Description of Artificial Sequence: Synthetic oligonucleotide
  Target: SCN9A; (-) strand; PAM type: NRG; PAM sequence: AAG
tggcacataaaagaaatgga

SEQ ID NO: 37622 - DNA, 20 bp, Artificial Sequence
  Description of Artificial Sequence: Synthetic oligonucleotide
  Target: SCN9A; (-) strand; PAM type: NRG; PAM sequence: TGG
ggaatggcacataaaagaaa

SEQ ID NO: 37623 - DNA, 20 bp, Artificial Sequence
  Description of Artificial Sequence: Synthetic oligonucleotide
  Target: SCN9A; (-) strand; PAM type: NRG; PAM sequence: AAG
agactaggaatggcacataa

SEQ ID NO: 37624 - DNA, 20 bp, Artificial Sequence
  Description of Artificial Sequence: Synthetic oligonucleotide
  Target: SCN9A; (-) strand; PAM type: NRG; PAM sequence: TGG
aatgttctgtagactaggaa

SEQ ID NO: 37625 - DNA, 20 bp, Artificial Sequence
  Description of Artificial Sequence: Synthetic oligonucleotide
  Target: SCN9A; (-) strand; PAM type: NRG; PAM sequence: AGG
cagctaatgttctgtagact

SEQ ID NO: 37626 - DNA, 20 bp, Artificial Sequence
  Description of Artificial Sequence: Synthetic oligonucleotide
  Target: SCN9A; (-) strand; PAM type: NRG; PAM sequence: TAG
acagctaatgttctgtagac

SEQ ID NO: 37627 - DNA, 20 bp, Artificial Sequence
  Description of Artificial Sequence: Synthetic oligonucleotide
  Target: SCN9A; (-) strand; PAM type: NRG; PAM sequence: TAG
cacaaacagctaatgttctg

SEQ ID NO: 37628 - DNA, 20 bp, Artificial Sequence
  Description of Artificial Sequence: Synthetic oligonucleotide
  Target: SCN9A; (-) strand; PAM type: NRG; PAM sequence: CAG
aagagcaagaaaaacacaaa

SEQ ID NO: 37629 - DNA, 20 bp, Artificial Sequence
  Description of Artificial Sequence: Synthetic oligonucleotide
  Target: SCN9A; (-) strand; PAM type: NRG; PAM sequence: AAG
tctagggctgccaaaagagc

SEQ ID NO: 37630 - DNA, 20 bp, Artificial Sequence
  Description of Artificial Sequence: Synthetic oligonucleotide
  Target: SCN9A; (-) strand; PAM type: NRG; PAM sequence: GAG
aatttctagggctgccaaaa

SEQ ID NO: 37631 - DNA, 20 bp, Artificial Sequence
  Description of Artificial Sequence: Synthetic oligonucleotide
  Target: SCN9A; (-) strand; PAM type: NRG; PAM sequence: AAG
aaaatttctagggctgccaa

SEQ ID NO: 37632 - DNA, 20 bp, Artificial Sequence
  Description of Artificial Sequence: Synthetic oligonucleotide
  Target: SCN9A; (-) strand; PAM type: NRG; PAM sequence: GGG
aaaccaagataaaatttcta

SEQ ID NO: 37633 - DNA, 20 bp, Artificial Sequence
  Description of Artificial Sequence: Synthetic oligonucleotide
  Target: SCN9A; (-) strand; PAM type: NRG; PAM sequence: AGG
taaaccaagataaaatttct

SEQ ID NO: 37634 - DNA, 20 bp, Artificial Sequence
  Description of Artificial Sequence: Synthetic oligonucleotide
  Target: SCN9A; (-) strand; PAM type: NRG; PAM sequence: TAG
ttaaaccaagataaaatttc

SEQ ID NO: 37635 - DNA, 20 bp, Artificial Sequence
  Description of Artificial Sequence: Synthetic oligonucleotide
  Target: SCN9A; (-) strand; PAM type: NRG; PAM sequence: AAG
actttttctgggtttaaacc

SEQ ID NO: 37636 - DNA, 20 bp, Artificial Sequence
  Description of Artificial Sequence: Synthetic oligonucleotide
  Target: SCN9A; (-) strand; PAM type: NRG; PAM sequence: GGG
tttggaaagatactttttct

SEQ ID NO: 37637 - DNA, 20 bp, Artificial Sequence
  Description of Artificial Sequence: Synthetic oligonucleotide
  Target: SCN9A; (-) strand; PAM type: NRG; PAM sequence: TGG
atttggaaagatactttttc

SEQ ID NO: 37638 - DNA, 20 bp, Artificial Sequence
  Description of Artificial Sequence: Synthetic oligonucleotide
  Target: SCN9A; (-) strand; PAM type: NRG; PAM sequence: AAG
tatttaataagaaatttgga

SEQ ID NO: 37639 - DNA, 20 bp, Artificial Sequence
  Description of Artificial Sequence: Synthetic oligonucleotide
  Target: SCN9A; (-) strand; PAM type: NRG; PAM sequence: TGG
gtagtatttaataagaaatt

SEQ ID NO: 37640 - DNA, 20 bp, Artificial Sequence
  Description of Artificial Sequence: Synthetic oligonucleotide
  Target: SCN9A; (-) strand; PAM type: NRG; PAM sequence: AAG
tgtgcagtgtagtatttaat

SEQ ID NO: 37641 - DNA, 20 bp, Artificial Sequence
  Description of Artificial Sequence: Synthetic oligonucleotide
  Target: SCN9A; (-) strand; PAM type: NRG; PAM sequence: TAG
actctcaaggctgtgcagtg

SEQ ID NO: 37642 - DNA, 20 bp, Artificial Sequence
  Description of Artificial Sequence: Synthetic oligonucleotide
  Target: SCN9A; (-) strand; PAM type: NRG; PAM sequence: CAG
aatgaactctcaaggctgtg

SEQ ID NO: 37643 - DNA, 20 bp, Artificial Sequence
  Description of Artificial Sequence: Synthetic oligonucleotide
  Target: SCN9A; (-) strand; PAM type: NRG; PAM sequence: AGG
tagtgtttaatgaactctca

SEQ ID NO: 37644 - DNA, 20 bp, Artificial Sequence
  Description of Artificial Sequence: Synthetic oligonucleotide
  Target: SCN9A; (-) strand; PAM type: NRG; PAM sequence: AAG
ttagtgtttaatgaactctc

SEQ ID NO: 37645 - DNA, 20 bp, Artificial Sequence
  Description of Artificial Sequence: Synthetic oligonucleotide
  Target: SCN9A; (-) strand; PAM type: NRG; PAM sequence: TAG
ctacatctgacgctgtcatt

SEQ ID NO: 37646 - DNA, 20 bp, Artificial Sequence
  Description of Artificial Sequence: Synthetic oligonucleotide
  Target: SCN9A; (-) strand; PAM type: NRG; PAM sequence: AAG
ttgtctggttcccttaattc

SEQ ID NO: 37647 - DNA, 20 bp, Artificial Sequence
  Description of Artificial Sequence: Synthetic oligonucleotide
  Target: SCN9A; (-) strand; PAM type: NRG; PAM sequence: TGG
tcaaccagacaggctttgtc

SEQ ID NO: 37648 - DNA, 20 bp, Artificial Sequence
  Description of Artificial Sequence: Synthetic oligonucleotide
  Target: SCN9A; (-) strand; PAM type: NRG; PAM sequence: AGG
attggctttttcaaccagac

SEQ ID NO: 37649 - DNA, 20 bp, Artificial Sequence
  Description of Artificial Sequence: Synthetic oligonucleotide
  Target: SCN9A; (-) strand; PAM type: NRG; PAM sequence: CAG
tattggctttttcaaccaga

SEQ ID NO: 37650 - DNA, 20 bp, Artificial Sequence
  Description of Artificial Sequence: Synthetic oligonucleotide
  Target: SCN9A; (-) strand; PAM type: NRG; PAM sequence: CAG
tggttattggctttttcaac

SEQ ID NO: 37651 - DNA, 20 bp, Artificial Sequence
  Description of Artificial Sequence: Synthetic oligonucleotide
  Target: SCN9A; (-) strand; PAM type: NRG; PAM sequence: TGG
attaggaacttattggttat

SEQ ID NO: 37652 - DNA, 20 bp, Artificial Sequence
  Description of Artificial Sequence: Synthetic oligonucleotide
  Target: SCN9A; (-) strand; PAM type: NRG; PAM sequence: TGG
aaatatgattaggaacttat

SEQ ID NO: 37653 - DNA, 20 bp, Artificial Sequence
  Description of Artificial Sequence: Synthetic oligonucleotide
  Target: SCN9A; (-) strand; PAM type: NRG; PAM sequence: AGG
ggtcagttgtaaatatgatt

SEQ ID NO: 37654 - DNA, 20 bp, Artificial Sequence
  Description of Artificial Sequence: Synthetic oligonucleotide
  Target: SCN9A; (-) strand; PAM type: NRG; PAM sequence: TAG
aggtcagttgtaaatatgat

SEQ ID NO: 37655 - DNA, 20 bp, Artificial Sequence
  Description of Artificial Sequence: Synthetic oligonucleotide
  Target: SCN9A; (-) strand; PAM type: NRG; PAM sequence: CAG
ctatctaagttacggaaggt

SEQ ID NO: 37656 - DNA, 20 bp, Artificial Sequence
  Description of Artificial Sequence: Synthetic oligonucleotide
  Target: SCN9A; (-) strand; PAM type: NRG; PAM sequence: AGG
ttttctatctaagttacgga

SEQ ID NO: 37657 - DNA, 20 bp, Artificial Sequence
  Description of Artificial Sequence: Synthetic oligonucleotide
  Target: SCN9A; (-) strand; PAM type: NRG; PAM sequence: AAG
tttttctatctaagttacgg

SEQ ID NO: 37658 - DNA, 20 bp, Artificial Sequence
  Description of Artificial Sequence: Synthetic oligonucleotide
  Target: SCN9A; (-) strand; PAM type: NRG; PAM sequence: CGG
acatttttctatctaagtta

SEQ ID NO: 37659 - DNA, 20 bp, Artificial Sequence
  Description of Artificial Sequence: Synthetic oligonucleotide
  Target: SCN9A; (-) strand; PAM type: NRG; PAM sequence: AAG
atttccacatttttctatct

SEQ ID NO: 37660 - DNA, 20 bp, Artificial Sequence
  Description of Artificial Sequence: Synthetic oligonucleotide
  Target: SCN9A; (-) strand; PAM type: NRG; PAM sequence: TAG
tggtatggattgtatgatgt

SEQ ID NO: 37661 - DNA, 20 bp, Artificial Sequence
  Description of Artificial Sequence: Synthetic oligonucleotide
  Target: SCN9A; (-) strand; PAM type: NRG; PAM sequence: TGG
ttcttattcctattctggta

SEQ ID NO: 37662 - DNA, 20 bp, Artificial Sequence
  Description of Artificial Sequence: Synthetic oligonucleotide
  Target: SCN9A; (-) strand; PAM type: NRG; PAM sequence: TGG
taaaattcttattcctattc

SEQ ID NO: 37663 - DNA, 20 bp, Artificial Sequence
  Description of Artificial Sequence: Synthetic oligonucleotide
  Target: SCN9A; (-) strand; PAM type: NRG; PAM sequence: GGG
atccatttatttctcactaa

SEQ ID NO: 37664 - DNA, 20 bp, Artificial Sequence
  Description of Artificial Sequence: Synthetic oligonucleotide
  Target: SCN9A; (-) strand; PAM type: NRG; PAM sequence: AGG
tatccatttatttctcacta

SEQ ID NO: 37665 - DNA, 20 bp, Artificial Sequence
  Description of Artificial Sequence: Synthetic oligonucleotide
  Target: SCN9A; (-) strand; PAM type: NRG; PAM sequence: AAG
atatccatttatttctcact

SEQ ID NO: 37666 - DNA, 20 bp, Artificial Sequence
  Description of Artificial Sequence: Synthetic oligonucleotide
  Target: SCN9A; (-) strand; PAM type: NRG; PAM sequence: TGG
ttgtggaaaatacagaagtg

SEQ ID NO: 37667 - DNA, 20 bp, Artificial Sequence
  Description of Artificial Sequence: Synthetic oligonucleotide
  Target: SCN9A; (-) strand; PAM type: NRG; PAM sequence: AAG
ggcaattgtggaaaatacag

SEQ ID NO: 37668 - DNA, 20 bp, Artificial Sequence
  Description of Artificial Sequence: Synthetic oligonucleotide
  Target: SCN9A; (-) strand; PAM type: NRG; PAM sequence: CAG
agtggcaattgtggaaaata

SEQ ID NO: 37669 - DNA, 20 bp, Artificial Sequence
  Description of Artificial Sequence: Synthetic oligonucleotide
  Target: SCN9A; (-) strand; PAM type: NRG; PAM sequence: TGG
gaaaattgcagtggcaattg

SEQ ID NO: 37670 - DNA, 20 bp, Artificial Sequence
  Description of Artificial Sequence: Synthetic oligonucleotide
  Target: SCN9A; (-) strand; PAM type: NRG; PAM sequence: TGG
tacagttttgaaaattgcag

SEQ ID NO: 37671 - DNA, 20 bp, Artificial Sequence
  Description of Artificial Sequence: Synthetic oligonucleotide
  Target: SCN9A; (-) strand; PAM type: NRG; PAM sequence: CAG
ttctacagttttgaaaattg

SEQ ID NO: 37672 - DNA, 20 bp, Artificial Sequence
  Description of Artificial Sequence: Synthetic oligonucleotide
  Target: SCN9A; (-) strand; PAM type: NRG; PAM sequence: CAG
tgttcttccagaaacttcta

SEQ ID NO: 37673 - DNA, 20 bp, Artificial Sequence
  Description of Artificial Sequence: Synthetic oligonucleotide
  Target: SCN9A; (-) strand; PAM type: NRG; PAM sequence: CAG
ctgtctattttttgttcttc

SEQ ID NO: 37674 - DNA, 20 bp, Artificial Sequence
  Description of Artificial Sequence: Synthetic oligonucleotide
  Target: SCN9A; (-) strand; PAM type: NRG; PAM sequence: CAG
tagagaaaaacaaactcttt

SEQ ID NO: 37675 - DNA, 20 bp, Artificial Sequence
  Description of Artificial Sequence: Synthetic oligonucleotide
  Target: SCN9A; (-) strand; PAM type: NRG; PAM sequence: GAG
tttctaatcctatttaatta

SEQ ID NO: 37676 - DNA, 20 bp, Artificial Sequence
  Description of Artificial Sequence: Synthetic oligonucleotide
  Target: SCN9A; (-) strand; PAM type: NRG; PAM sequence: TAG
tttttctaatcctatttaat

SEQ ID NO: 37677 - DNA, 20 bp, Artificial Sequence
  Description of Artificial Sequence: Synthetic oligonucleotide
  Target: SCN9A; (-) strand; PAM type: NRG; PAM sequence: AAG
cagccaatattagaaggtaa

SEQ ID NO: 37678 - DNA, 20 bp, Artificial Sequence
  Description of Artificial Sequence: Synthetic oligonucleotide
  Target: SCN9A; (-) strand; PAM type: NRG; PAM sequence: AGG
gccgtgcagccaatattaga

SEQ ID NO: 37679 - DNA, 20 bp, Artificial Sequence
  Description of Artificial Sequence: Synthetic oligonucleotide
  Target: SCN9A; (-) strand; PAM type: NRG; PAM sequence: AAG
tgccgtgcagccaatattag

SEQ ID NO: 37680 - DNA, 20 bp, Artificial Sequence
  Description of Artificial Sequence: Synthetic oligonucleotide
  Target: SCN9A; (-) strand; PAM type: NRG; PAM sequence: TAG
tattgccgtgcagccaatat

SEQ ID NO: 37681 - DNA, 20 bp, Artificial Sequence
  Description of Artificial Sequence: Synthetic oligonucleotide
  Target: SCN9A; (-) strand; PAM type: NRG; PAM sequence: CAG
tactttgtaatattgccgtg

SEQ ID NO: 37682 - DNA, 20 bp, Artificial Sequence
  Description of Artificial Sequence: Synthetic oligonucleotide
  Target: SCN9A; (-) strand; PAM type: NRG; PAM sequence: CAG
ttattcttctattttcacaa

SEQ ID NO: 37683 - DNA, 20 bp, Artificial Sequence
  Description of Artificial Sequence: Synthetic oligonucleotide
  Target: SCN9A; (-) strand; PAM type: NRG; PAM sequence: TAG
tacttttgaatcctactttt

SEQ ID NO: 37684 - DNA, 20 bp, Artificial Sequence
  Description of Artificial Sequence: Synthetic oligonucleotide
  Target: SCN9A; (-) strand; PAM type: NRG; PAM sequence: AAG
ttctttttagttataatttg

SEQ ID NO: 37685 - DNA, 20 bp, Artificial Sequence
  Description of Artificial Sequence: Synthetic oligonucleotide
  Target: SCN9A; (-) strand; PAM type: NRG; PAM sequence: TAG
ttgtatattctatttctttt

SEQ ID NO: 37686 - DNA, 20 bp, Artificial Sequence
  Description of Artificial Sequence: Synthetic oligonucleotide
  Target: SCN9A; (-) strand; PAM type: NRG; PAM sequence: AAG
ttttcttcagttgtttcatt

SEQ ID NO: 37687 - DNA, 20 bp, Artificial Sequence
  Description of Artificial Sequence: Synthetic oligonucleotide
  Target: SCN9A; (-) strand; PAM type: NRG; PAM sequence: CAG
tttaggaaacctcttttctt

SEQ ID NO: 37688 - DNA, 20 bp, Artificial Sequence
  Description of Artificial Sequence: Synthetic oligonucleotide
  Target: SCN9A; (-) strand; PAM type: NRG; PAM sequence: AGG
actcagatgccaatacattt

SEQ ID NO: 37689 - DNA, 20 bp, Artificial Sequence
  Description of Artificial Sequence: Synthetic oligonucleotide
  Target: SCN9A; (-) strand; PAM type: NRG; PAM sequence: TAG
cactcagatgccaatacatt

SEQ ID NO: 37690 - DNA, 20 bp, Artificial Sequence
  Description of Artificial Sequence: Synthetic oligonucleotide
  Target: SCN9A; (-) strand; PAM type: NRG; PAM sequence: CAG
aaattagacgagcaaacact

SEQ ID NO: 37691 - DNA, 20 bp, Artificial Sequence
  Description of Artificial Sequence: Synthetic oligonucleotide
  Target: SCN9A; (-) strand; PAM type: NRG; PAM sequence: GAG
cagaccacgtcaaattagac

SEQ ID NO: 37692 - DNA, 20 bp, Artificial Sequence
  Description of Artificial Sequence: Synthetic oligonucleotide
  Target: SCN9A; (-) strand; PAM type: NRG; PAM sequence: TAG
aaatccagaccacgtcaaat

SEQ ID NO: 37693 - DNA, 20 bp, Artificial Sequence
  Description of Artificial Sequence: Synthetic oligonucleotide
  Target: SCN9A; (-) strand; PAM type: NRG; PAM sequence: CAG
gttttctggccaaaaaaatc

SEQ ID NO: 37694 - DNA, 20 bp, Artificial Sequence
  Description of Artificial Sequence: Synthetic oligonucleotide
  Target: SCN9A; (-) strand; PAM type: NRG; PAM sequence: TGG
ttttcttcacatcagttttc

SEQ ID NO: 37695 - DNA, 20 bp, Artificial Sequence
  Description of Artificial Sequence: Synthetic oligonucleotide
  Target: SCN9A; (-) strand; PAM type: NRG; PAM sequence: CAG
acatttatttttcttcacat

SEQ ID NO: 37696 - DNA, 20 bp, Artificial Sequence
  Description of Artificial Sequence: Synthetic oligonucleotide
  Target: SCN9A; (-) strand; PAM type: NRG; PAM sequence: AAG
actaagcatctactacatgc

SEQ ID NO: 37697 - DNA, 20 bp, Artificial Sequence
  Description of Artificial Sequence: Synthetic oligonucleotide
  Target: SCN9A; (-) strand; PAM type: NRG; PAM sequence: AAG
aatcaattaatatacttact

SEQ ID NO: 37698 - DNA, 20 bp, Artificial Sequence
  Description of Artificial Sequence: Synthetic oligonucleotide
  Target: SCN9A; (-) strand; PAM type: NRG; PAM sequence: AAG
ggggaaaattcttcaggaat

SEQ ID NO: 37699 - DNA, 20 bp, Artificial Sequence
  Description of Artificial Sequence: Synthetic oligonucleotide
  Target: SCN9A; (-) strand; PAM type: NRG; PAM sequence: AGG
gacactggggaaaattcttc

SEQ ID NO: 37700 - DNA, 20 bp, Artificial Sequence
  Description of Artificial Sequence: Synthetic oligonucleotide
  Target: SCN9A; (-) strand; PAM type: NRG; PAM sequence: CAG
tgacactggggaaaattctt

SEQ ID NO: 37701 - DNA, 20 bp, Artificial Sequence
  Description of Artificial Sequence: Synthetic oligonucleotide
  Target: SCN9A; (-) strand; PAM type: NRG; PAM sequence: GGG
atcagtggactatgacactg

SEQ ID NO: 37702 - DNA, 20 bp, Artificial Sequence
  Description of Artificial Sequence: Synthetic oligonucleotide
  Target: SCN9A; (-) strand; PAM type: NRG; PAM sequence: GGG
catcagtggactatgacact

SEQ ID NO: 37703 - DNA, 20 bp, Artificial Sequence
  Description of Artificial Sequence: Synthetic oligonucleotide
  Target: SCN9A; (-) strand; PAM type: NRG; PAM sequence: TGG
ccatcagtggactatgacac

SEQ ID NO: 37704 - DNA, 20 bp, Artificial Sequence
  Description of Artificial Sequence: Synthetic oligonucleotide
  Target: SCN9A; (-) strand; PAM type: NRG; PAM sequence: TGG
tagggtaagggacccatcag

SEQ ID NO: 37705 - DNA, 20 bp, Artificial Sequence
  Description of Artificial Sequence: Synthetic oligonucleotide
  Target: SCN9A; (-) strand; PAM type: NRG; PAM sequence: CAG
tgttagggtaagggacccat

SEQ ID NO: 37706 - DNA, 20 bp, Artificial Sequence
  Description of Artificial Sequence: Synthetic oligonucleotide
  Target: SCN9A; (-) strand; PAM type: NRG; PAM sequence: GGG
caaaaccattgttagggtaa

SEQ ID NO: 37707 - DNA, 20 bp, Artificial Sequence
  Description of Artificial Sequence: Synthetic oligonucleotide
  Target: SCN9A; (-) strand; PAM type: NRG; PAM sequence: AGG
gcaaaaccattgttagggta

SEQ ID NO: 37708 - DNA, 20 bp, Artificial Sequence
  Description of Artificial Sequence: Synthetic oligonucleotide
  Target: SCN9A; (-) strand; PAM type: NRG; PAM sequence: AAG
agcaaaaccattgttagggt

SEQ ID NO: 37709 - DNA, 20 bp, Artificial Sequence
  Description of Artificial Sequence: Synthetic oligonucleotide
  Target: SCN9A; (-) strand; PAM type: NRG; PAM sequence: GGG
tatcagcaaaaccattgtta

SEQ ID NO: 37710 - DNA, 20 bp, Artificial Sequence
  Description of Artificial Sequence: Synthetic oligonucleotide
  Target: SCN9A; (-) strand; PAM type: NRG; PAM sequence: AGG
ttatcagcaaaaccattgtt

SEQ ID NO: 37711 - DNA, 20 bp, Artificial Sequence
  Description of Artificial Sequence: Synthetic oligonucleotide
  Target: SCN9A; (-) strand; PAM type: NRG; PAM sequence: TAG
attatcagcaaaaccattgt

SEQ ID NO: 37712 - DNA, 20 bp, Artificial Sequence
  Description of Artificial Sequence: Synthetic oligonucleotide
  Target: SCN9A; (-) strand; PAM type: NRG; PAM sequence: CAG
ctccacagaaagcacattat

SEQ ID NO: 37713 - DNA, 20 bp, Artificial Sequence
  Description of Artificial Sequence: Synthetic oligonucleotide
  Target: SCN9A; (-) strand; PAM type: NRG; PAM sequence: AAG
atcaaaaataactccacaga

SEQ ID NO: 37714 - DNA, 20 bp, Artificial Sequence
  Description of Artificial Sequence: Synthetic oligonucleotide
  Target: SCN9A; (-) strand; PAM type: NRG; PAM sequence: CAG
tttgatcaaaaataactcca

SEQ ID NO: 37715 - DNA, 20 bp, Artificial Sequence
  Description of Artificial Sequence: Synthetic oligonucleotide
  Target: SCN9A; (-) strand; PAM type: NRG; PAM sequence: TAG
caagggaatgtcgataacaa

SEQ ID NO: 37716 - DNA, 20 bp, Artificial Sequence
  Description of Artificial Sequence: Synthetic oligonucleotide
  Target: SCN9A; (-) strand; PAM type: NRG; PAM sequence: GGG
ctaatggaagacttctacaa

SEQ ID NO: 37717 - DNA, 20 bp, Artificial Sequence
  Description of Artificial Sequence: Synthetic oligonucleotide
  Target: SCN9A; (-) strand; PAM type: NRG; PAM sequence: AGG
tctaatggaagacttctaca

SEQ ID NO: 37718 - DNA, 20 bp, Artificial Sequence
  Description of Artificial Sequence: Synthetic oligonucleotide
  Target: SCN9A; (-) strand; PAM type: NRG; PAM sequence: AAG
atctaatggaagacttctac

SEQ ID NO: 37719 - DNA, 20 bp, Artificial Sequence
  Description of Artificial Sequence: Synthetic oligonucleotide
  Target: SCN9A; (-) strand; PAM type: NRG; PAM sequence: AAG
tttgtccccttatctaatgg

SEQ ID NO: 37720 - DNA, 20 bp, Artificial Sequence
  Description of Artificial Sequence: Synthetic oligonucleotide
  Target: SCN9A; (-) strand; PAM type: NRG; PAM sequence: TGG
tattttgtccccttatctaa

SEQ ID NO: 37721 - DNA, 20 bp, Artificial Sequence
  Description of Artificial Sequence: Synthetic oligonucleotide
  Target: SCN9A; (-) strand; PAM type: NRG; PAM sequence: TAG
gttgcccaatgactgaaaac

SEQ ID NO: 37722 - DNA, 20 bp, Artificial Sequence
  Description of Artificial Sequence: Synthetic oligonucleotide
  Target: SCN9A; (-) strand; PAM type: NRG; PAM sequence: TAG
ctctagggatcactgtctta

SEQ ID NO: 37723 - DNA, 20 bp, Artificial Sequence
  Description of Artificial Sequence: Synthetic oligonucleotide
  Target: SCN9A; (-) strand; PAM type: NRG; PAM sequence: GGG
cactttctttctcttctcta

SEQ ID NO: 37724 - DNA, 20 bp, Artificial Sequence
  Description of Artificial Sequence: Synthetic oligonucleotide
  Target: SCN9A; (-) strand; PAM type: NRG; PAM sequence: AGG
tcactttctttctcttctct

SEQ ID NO: 37725 - DNA, 20 bp, Artificial Sequence
  Description of Artificial Sequence: Synthetic oligonucleotide
  Target: SCN9A; (-) strand; PAM type: NRG; PAM sequence: TAG
ctcactttctttctcttctc

SEQ ID NO: 37726 - DNA, 20 bp, Artificial Sequence
  Description of Artificial Sequence: Synthetic oligonucleotide
  Target: SCN9A; (-) strand; PAM type: NRG; PAM sequence: CAG
gtagtatgcagagacaatca

SEQ ID NO: 37727 - DNA, 20 bp, Artificial Sequence
  Description of Artificial Sequence: Synthetic oligonucleotide
  Target: SCN9A; (-) strand; PAM type: NRG; PAM sequence: GAG
gaaactttgtgtagtatgca

SEQ ID NO: 37728 - DNA, 20 bp, Artificial Sequence
  Description of Artificial Sequence: Synthetic oligonucleotide
  Target: SCN9A; (-) strand; PAM type: NRG; PAM sequence: CAG
tagaaactttgtgtagtatg

SEQ ID NO: 37729 - DNA, 20 bp, Artificial Sequence
  Description of Artificial Sequence: Synthetic oligonucleotide
  Target: SCN9A; (-) strand; PAM type: NRG; PAM sequence: TAG
tgtggtttagaaactttgtg

SEQ ID NO: 37730 - DNA, 20 bp, Artificial Sequence
  Description of Artificial Sequence: Synthetic oligonucleotide
  Target: SCN9A; (-) strand; PAM type: NRG; PAM sequence: TAG
catcttcctgagctgtggtt

SEQ ID NO: 37731 - DNA, 20 bp, Artificial Sequence
  Description of Artificial Sequence: Synthetic oligonucleotide
  Target: SCN9A; (-) strand; PAM type: NRG; PAM sequence: TGG
gtttccatcttcctgagctg

SEQ ID NO: 37732 - DNA, 20 bp, Artificial Sequence
  Description of Artificial Sequence: Synthetic oligonucleotide
  Target: SCN9A; (-) strand; PAM type: NRG; PAM sequence: GAG
cttcatgtttccatcttcct

SEQ ID NO: 37733 - DNA, 20 bp, Artificial Sequence
  Description of Artificial Sequence: Synthetic oligonucleotide
  Target: SCN9A; (-) strand; PAM type: NRG; PAM sequence: TGG
cctatcaaactcttattttc

SEQ ID NO: 37734 - DNA, 20 bp, Artificial Sequence
  Description of Artificial Sequence: Synthetic oligonucleotide
  Target: SCN9A; (-) strand; PAM type: NRG; PAM sequence: CAG
taaacaaattctagctccct

SEQ ID NO: 37735 - DNA, 20 bp, Artificial Sequence
  Description of Artificial Sequence: Synthetic oligonucleotide
  Target: SCN9A; (-) strand; PAM type: NRG; PAM sequence: TAG
tgtcccaaataaacaaattc

SEQ ID NO: 37736 - DNA, 20 bp, Artificial Sequence
  Description of Artificial Sequence: Synthetic oligonucleotide
  Target: SCN9A; (-) strand; PAM type: NRG; PAM sequence: AGG
ctgttcagctcccttgtctt

SEQ ID NO: 37737 - DNA, 20 bp, Artificial Sequence
  Description of Artificial Sequence: Synthetic oligonucleotide
  Target: SCN9A; (-) strand; PAM type: NRG; PAM sequence: TAG
tctgttcagctcccttgtct

SEQ ID NO: 37738 - DNA, 20 bp, Artificial Sequence
  Description of Artificial Sequence: Synthetic oligonucleotide
  Target: SCN9A; (-) strand; PAM type: NRG; PAM sequence: CAG
tctctggtatactctctgtt

SEQ ID NO: 37739 - DNA, 20 bp, Artificial Sequence
  Description of Artificial Sequence: Synthetic oligonucleotide
  Target: SCN9A; (-) strand; PAM type: NRG; PAM sequence: TGG
ggtctctttctacagatctc

SEQ ID NO: 37740 - DNA, 20 bp, Artificial Sequence
  Description of Artificial Sequence: Synthetic oligonucleotide
  Target: SCN9A; (-) strand; PAM type: NRG; PAM sequence: CAG
aaacttgaggtctctttcta

SEQ ID NO: 37741 - DNA, 20 bp, Artificial Sequence
  Description of Artificial Sequence: Synthetic oligonucleotide
  Target: SCN9A; (-) strand; PAM type: NRG; PAM sequence: AGG
tgctgtcaagcaaaaacttg

SEQ ID NO: 37742 - DNA, 20 bp, Artificial Sequence
  Description of Artificial Sequence: Synthetic oligonucleotide
  Target: SCN9A; (-) strand; PAM type: NRG; PAM sequence: GAG
atgctgtcaagcaaaaactt

SEQ ID NO: 37743 - DNA, 20 bp, Artificial Sequence
  Description of Artificial Sequence: Synthetic oligonucleotide
  Target: SCN9A; (-) strand; PAM type: NRG; PAM sequence: AAG
cacaattgcagaatgctgtc

SEQ ID NO: 37744 - DNA, 20 bp, Artificial Sequence
  Description of Artificial Sequence: Synthetic oligonucleotide
  Target: SCN9A; (-) strand; PAM type: NRG; PAM sequence: CAG
tttttgttttcacacaattg

SEQ ID NO: 37745 - DNA, 20 bp, Artificial Sequence
  Description of Artificial Sequence: Synthetic oligonucleotide
  Target: SCN9A; (-) strand; PAM type: NRG; PAM sequence: GGG
gtagttctttctctggctta

SEQ ID NO: 37746 - DNA, 20 bp, Artificial Sequence
  Description of Artificial Sequence: Synthetic oligonucleotide
  Target: SCN9A; (-) strand; PAM type: NRG; PAM sequence: AGG
tgtagttctttctctggctt

SEQ ID NO: 37747 - DNA, 20 bp, Artificial Sequence
  Description of Artificial Sequence: Synthetic oligonucleotide
  Target: SCN9A; (-) strand; PAM type: NRG; PAM sequence: TAG
ctgtagttctttctctggct

SEQ ID NO: 37748 - DNA, 20 bp, Artificial Sequence
  Description of Artificial Sequence: Synthetic oligonucleotide
  Target: SCN9A; (-) strand; PAM type: NRG; PAM sequence: TGG
catgactgtagttctttctc

SEQ ID NO: 37749 - DNA, 20 bp, Artificial Sequence
  Description of Artificial Sequence: Synthetic oligonucleotide
  Target: SCN9A; (-) strand; PAM type: NRG; PAM sequence: TAG
tgttaggcaatgcatgactg

SEQ ID NO: 37750 - DNA, 20 bp, Artificial Sequence
  Description of Artificial Sequence: Synthetic oligonucleotide
  Target: SCN9A; (-) strand; PAM type: NRG; PAM sequence: AGG
cggtacatatctccattgtt

SEQ ID NO: 37751 - DNA, 20 bp, Artificial Sequence
  Description of Artificial Sequence: Synthetic oligonucleotide
  Target: SCN9A; (-) strand; PAM type: NRG; PAM sequence: TAG
tcggtacatatctccattgt

SEQ ID NO: 37752 - DNA, 20 bp, Artificial Sequence
  Description of Artificial Sequence: Synthetic oligonucleotide
  Target: SCN9A; (-) strand; PAM type: NRG; PAM sequence: CGG
ttgcctagtgacacatttct

SEQ ID NO: 37753 - DNA, 20 bp, Artificial Sequence
  Description of Artificial Sequence: Synthetic oligonucleotide
  Target: SCN9A; (-) strand; PAM type: NRG; PAM sequence: TAG
tctatgatgttaaaattgcc

SEQ ID NO: 37754 - DNA, 20 bp, Artificial Sequence
  Description of Artificial Sequence: Synthetic oligonucleotide
  Target: SCN9A; (-) strand; PAM type: NRG; PAM sequence: AAG
tataccatctaggtttgtgt

SEQ ID NO: 37755 - DNA, 20 bp, Artificial Sequence
  Description of Artificial Sequence: Synthetic oligonucleotide
  Target: SCN9A; (-) strand; PAM type: NRG; PAM sequence: AGG
tgtagtagactataccatct

SEQ ID NO: 37756 - DNA, 20 bp, Artificial Sequence
  Description of Artificial Sequence: Synthetic oligonucleotide
  Target: SCN9A; (-) strand; PAM type: NRG; PAM sequence: TAG
atgtagtagactataccatc

SEQ ID NO: 37757 - DNA, 20 bp, Artificial Sequence
  Description of Artificial Sequence: Synthetic oligonucleotide
  Target: SCN9A; (-) strand; PAM type: NRG; PAM sequence: TAG
cataaagactaagtatgtag

SEQ ID NO: 37758 - DNA, 20 bp, Artificial Sequence
  Description of Artificial Sequence: Synthetic oligonucleotide
  Target: SCN9A; (-) strand; PAM type: NRG; PAM sequence: TAG
taccataaagactaagtatg

SEQ ID NO: 37759 - DNA, 20 bp, Artificial Sequence
  Description of Artificial Sequence: Synthetic oligonucleotide
  Target: SCN9A; (-) strand; PAM type: NRG; PAM sequence: AAG
taggctataccataaagact

SEQ ID NO: 37760 - DNA, 20 bp, Artificial Sequence
  Description of Artificial Sequence: Synthetic oligonucleotide
  Target: SCN9A; (-) strand; PAM type: NRG; PAM sequence: AAG
aagcaataggctataccata

SEQ ID NO: 37761 - DNA, 20 bp, Artificial Sequence
  Description of Artificial Sequence: Synthetic oligonucleotide
  Target: SCN9A; (-) strand; PAM type: NRG; PAM sequence: AGG
gtttatagcctagaagcaat

SEQ ID NO: 37762 - DNA, 20 bp, Artificial Sequence
  Description of Artificial Sequence: Synthetic oligonucleotide
  Target: SCN9A; (-) strand; PAM type: NRG; PAM sequence: TAG
ggtttatagcctagaagcaa

SEQ ID NO: 37763 - DNA, 20 bp, Artificial Sequence
  Description of Artificial Sequence: Synthetic oligonucleotide
  Target: SCN9A; (-) strand; PAM type: NRG; PAM sequence: AAG
tgtacaggtttatagcctag

SEQ ID NO: 37764 - DNA, 20 bp, Artificial Sequence
  Description of Artificial Sequence: Synthetic oligonucleotide
  Target: SCN9A; (-) strand; PAM type: NRG; PAM sequence: TAG
tgttgtacaggtttatagcc

SEQ ID NO: 37765 - DNA, 20 bp, Artificial Sequence
  Description of Artificial Sequence: Synthetic oligonucleotide
  Target: SCN9A; (-) strand; PAM type: NRG; PAM sequence: TAG
taacatgttgtacaggttta

SEQ ID NO: 37766 - DNA, 20 bp, Artificial Sequence
  Description of Artificial Sequence: Synthetic oligonucleotide
  Target: SCN9A; (-) strand; PAM type: NRG; PAM sequence: AGG
agtacagtaacatgttgtac

SEQ ID NO: 37767 - DNA, 20 bp, Artificial Sequence
  Description of Artificial Sequence: Synthetic oligonucleotide
  Target: SCN9A; (-) strand; PAM type: NRG; PAM sequence: CAG
cagtacagtaacatgttgta

SEQ ID NO: 37768 - DNA, 20 bp, Artificial Sequence
  Description of Artificial Sequence: Synthetic oligonucleotide
  Target: SCN9A; (-) strand; PAM type: NRG; PAM sequence: CAG
gtgttacaattgtctcagta

SEQ ID NO: 37769 - DNA, 20 bp, Artificial Sequence
  Description of Artificial Sequence: Synthetic oligonucleotide
  Target: SCN9A; (-) strand; PAM type: NRG; PAM sequence: CAG
ccactgtgttacaattgtct

SEQ ID NO: 37770 - DNA, 20 bp, Artificial Sequence
  Description of Artificial Sequence: Synthetic oligonucleotide
  Target: SCN9A; (-) strand; PAM type: NRG; PAM sequence: TAG
tttctatgtttaggtatgat

SEQ ID NO: 37771 - DNA, 20 bp, Artificial Sequence
  Description of Artificial Sequence: Synthetic oligonucleotide
  Target: SCN9A; (-) strand; PAM type: NRG; PAM sequence: AGG
actgtaacttttctatgttt

SEQ ID NO: 37772 - DNA, 20 bp, Artificial Sequence
  Description of Artificial Sequence: Synthetic oligonucleotide
  Target: SCN9A; (-) strand; PAM type: NRG; PAM sequence: TAG
tactgtaacttttctatgtt

SEQ ID NO: 37773 - DNA, 20 bp, Artificial Sequence
  Description of Artificial Sequence: Synthetic oligonucleotide
  Target: SCN9A; (-) strand; PAM type: NRG; PAM sequence: CAG
catatatgatggtggtccca

SEQ ID NO: 37774 - DNA, 20 bp, Artificial Sequence
  Description of Artificial Sequence: Synthetic oligonucleotide
  Target: SCN9A; (-) strand; PAM type: NRG; PAM sequence: TGG
acagactgcatatatgatgg

SEQ ID NO: 37775 - DNA, 20 bp, Artificial Sequence
  Description of Artificial Sequence: Synthetic oligonucleotide
  Target: SCN9A; (-) strand; PAM type: NRG; PAM sequence: TGG
aggacagactgcatatatga

SEQ ID NO: 37776 - DNA, 20 bp, Artificial Sequence
  Description of Artificial Sequence: Synthetic oligonucleotide
  Target: SCN9A; (-) strand; PAM type: NRG; PAM sequence: CAG
gataacacttcagtcaagga

SEQ ID NO: 37777 - DNA, 20 bp, Artificial Sequence
  Description of Artificial Sequence: Synthetic oligonucleotide
  Target: SCN9A; (-) strand; PAM type: NRG; PAM sequence: AGG
gccagataacacttcagtca

SEQ ID NO: 37778 - DNA, 20 bp, Artificial Sequence
  Description of Artificial Sequence: Synthetic oligonucleotide
  Target: SCN9A; (-) strand; PAM type: NRG; PAM sequence: AAG
tgccagataacacttcagtc

SEQ ID NO: 37779 - DNA, 20 bp, Artificial Sequence
  Description of Artificial Sequence: Synthetic oligonucleotide
  Target: SCN9A; (-) strand; PAM type: NRG; PAM sequence: CAG
tcatgtgccagataacactt

SEQ ID NO: 37780 - DNA, 20 bp, Artificial Sequence
  Description of Artificial Sequence: Synthetic oligonucleotide
  Target: SCN9A; (-) strand; PAM type: NRG; PAM sequence: CAG
cagtcatgtcagtcatgtgc

SEQ ID NO: 37781 - DNA, 20 bp, Artificial Sequence
  Description of Artificial Sequence: Synthetic oligonucleotide
  Target: SCN9A; (-) strand; PAM type: NRG; PAM sequence: CAG
acttaagattacagtcatgt

SEQ ID NO: 37782 - DNA, 20 bp, Artificial Sequence
  Description of Artificial Sequence: Synthetic oligonucleotide
  Target: SCN9A; (-) strand; PAM type: NRG; PAM sequence: CAG
taacctgctacttaagatta

SEQ ID NO: 37783 - DNA, 20 bp, Artificial Sequence
  Description of Artificial Sequence: Synthetic oligonucleotide
  Target: SCN9A; (-) strand; PAM type: NRG; PAM sequence: AAG
gaatttttaacctgctactt

SEQ ID NO: 37784 - DNA, 20 bp, Artificial Sequence
  Description of Artificial Sequence: Synthetic oligonucleotide
  Target: SCN9A; (-) strand; PAM type: NRG; PAM sequence: AAG
actatccctgtgtgaggtcc

SEQ ID NO: 37785 - DNA, 20 bp, Artificial Sequence
  Description of Artificial Sequence: Synthetic oligonucleotide
  Target: SCN9A; (-) strand; PAM type: NRG; PAM sequence: AGG
aatattactatccctgtgtg

SEQ ID NO: 37786 - DNA, 20 bp, Artificial Sequence
  Description of Artificial Sequence: Synthetic oligonucleotide
  Target: SCN9A; (-) strand; PAM type: NRG; PAM sequence: GAG
aaatattactatccctgtgt

SEQ ID NO: 37787 - DNA, 20 bp, Artificial Sequence
  Description of Artificial Sequence: Synthetic oligonucleotide
  Target: SCN9A; (-) strand; PAM type: NRG; PAM sequence: AGG
tcttttcactttgactgggg

SEQ ID NO: 37788 - DNA, 20 bp, Artificial Sequence
  Description of Artificial Sequence: Synthetic oligonucleotide
  Target: SCN9A; (-) strand; PAM type: NRG; PAM sequence: GAG
gtcttttcactttgactggg

SEQ ID NO: 37789 - DNA, 20 bp, Artificial Sequence
  Description of Artificial Sequence: Synthetic oligonucleotide
  Target: SCN9A; (-) strand; PAM type: NRG; PAM sequence: GGG
aggtcttttcactttgactg

SEQ ID NO: 37790 - DNA, 20 bp, Artificial Sequence
  Description of Artificial Sequence: Synthetic oligonucleotide
  Target: SCN9A; (-) strand; PAM type: NRG; PAM sequence: GGG
gaggtcttttcactttgact

SEQ ID NO: 37791 - DNA, 20 bp, Artificial Sequence
  Description of Artificial Sequence: Synthetic oligonucleotide
  Target: SCN9A; (-) strand; PAM type: NRG; PAM sequence: TGG
tgaggtcttttcactttgac

SEQ ID NO: 37792 - DNA, 20 bp, Artificial Sequence
  Description of Artificial Sequence: Synthetic oligonucleotide
  Target: SCN9A; (-) strand; PAM type: NRG; PAM sequence: AGG
ccaatatctcctgtgttttg

SEQ ID NO: 37793 - DNA, 20 bp, Artificial Sequence
  Description of Artificial Sequence: Synthetic oligonucleotide
  Target: SCN9A; (-) strand; PAM type: NRG; PAM sequence: GAG
cccaatatctcctgtgtttt

SEQ ID NO: 37794 - DNA, 20 bp, Artificial Sequence
  Description of Artificial Sequence: Synthetic oligonucleotide
  Target: SCN9A; (-) strand; PAM type: NRG; PAM sequence: GAG
taagataagacccttctgca

SEQ ID NO: 37795 - DNA, 20 bp, Artificial Sequence
  Description of Artificial Sequence: Synthetic oligonucleotide
  Target: SCN9A; (-) strand; PAM type: NRG; PAM sequence: CAG
gctaagataagacccttctg

SEQ ID NO: 37796 - DNA, 20 bp, Artificial Sequence
  Description of Artificial Sequence: Synthetic oligonucleotide
  Target: SCN9A; (-) strand; PAM type: NRG; PAM sequence: AAG
ttcagccccactgctaagat

SEQ ID NO: 37797 - DNA, 20 bp, Artificial Sequence
  Description of Artificial Sequence: Synthetic oligonucleotide
  Target: SCN9A; (-) strand; PAM type: NRG; PAM sequence: AAG
gttaattcagccccactgct

SEQ ID NO: 37798 - DNA, 20 bp, Artificial Sequence
  Description of Artificial Sequence: Synthetic oligonucleotide
  Target: SCN9A; (-) strand; PAM type: NRG; PAM sequence: CAG
aacgttagttaaagttaatt

SEQ ID NO: 37799 - DNA, 20 bp, Artificial Sequence
  Description of Artificial Sequence: Synthetic oligonucleotide
  Target: SCN9A; (-) strand; PAM type: NRG; PAM sequence: AAG
atccagagcaacgttagtta

SEQ ID NO: 37800 - DNA, 20 bp, Artificial Sequence
  Description of Artificial Sequence: Synthetic oligonucleotide
  Target: SCN9A; (-) strand; PAM type: NRG; PAM sequence: TAG
ggataaatccagagcaacgt

SEQ ID NO: 37801 - DNA, 20 bp, Artificial Sequence
  Description of Artificial Sequence: Synthetic oligonucleotide
  Target: SCN9A; (+) strand; PAM type: NRG; PAM sequence: CGG
actaatagctaaggtaatgt

SEQ ID NO: 37802 - DNA, 20 bp, Artificial Sequence
  Description of Artificial Sequence: Synthetic oligonucleotide
  Target: SCN9A; (+) strand; PAM type: NRG; PAM sequence: TAG
atccatgattcatactttta

SEQ ID NO: 37803 - DNA, 20 bp, Artificial Sequence
  Description of Artificial Sequence: Synthetic oligonucleotide
  Target: SCN9A; (+) strand; PAM type: NRG; PAM sequence: CAG
catacttttatagacattgt

SEQ ID NO: 37804 - DNA, 20 bp, Artificial Sequence
  Description of Artificial Sequence: Synthetic oligonucleotide
  Target: SCN9A; (+) strand; PAM type: NRG; PAM sequence: GAG
tacttttatagacattgtca

SEQ ID NO: 37805 - DNA, 20 bp, Artificial Sequence
  Description of Artificial Sequence: Synthetic oligonucleotide
  Target: SCN9A; (+) strand; PAM type: NRG; PAM sequence: CAG
ttatagacattgtcagagat

SEQ ID NO: 37806 - DNA, 20 bp, Artificial Sequence
  Description of Artificial Sequence: Synthetic oligonucleotide
  Target: SCN9A; (+) strand; PAM type: NRG; PAM sequence: TGG
agagatcagtcgttgtcaac

SEQ ID NO: 37807 - DNA, 20 bp, Artificial Sequence
  Description of Artificial Sequence: Synthetic oligonucleotide
  Target: SCN9A; (+) strand; PAM type: NRG; PAM sequence: GGG
gagatcagtcgttgtcaact

SEQ ID NO: 37808 - DNA, 20 bp, Artificial Sequence
  Description of Artificial Sequence: Synthetic oligonucleotide
  Target: SCN9A; (+) strand; PAM type: NRG; PAM sequence: GGG
agatcagtcgttgtcaactg

SEQ ID NO: 37809 - DNA, 20 bp, Artificial Sequence
  Description of Artificial Sequence: Synthetic oligonucleotide
  Target: SCN9A; (+) strand; PAM type: NRG; PAM sequence: AAG
tcagtcgttgtcaactgggg

SEQ ID NO: 37810 - DNA, 20 bp, Artificial Sequence
  Description of Artificial Sequence: Synthetic oligonucleotide
  Target: SCN9A; (+) strand; PAM type: NRG; PAM sequence: GAG
ggggaagattttgtccccct

SEQ ID NO: 37811 - DNA, 20 bp, Artificial Sequence
  Description of Artificial Sequence: Synthetic oligonucleotide
  Target: SCN9A; (+) strand; PAM type: NRG; PAM sequence: TAG
tttgtccccctgagaacatt

SEQ ID NO: 37812 - DNA, 20 bp, Artificial Sequence
  Description of Artificial Sequence: Synthetic oligonucleotide
  Target: SCN9A; (+) strand; PAM type: NRG; PAM sequence: AAG
ccccctgagaacatttagca

SEQ ID NO: 37813 - DNA, 20 bp, Artificial Sequence
  Description of Artificial Sequence: Synthetic oligonucleotide
  Target: SCN9A; (+) strand; PAM type: NRG; PAM sequence: TGG
ctgagaacatttagcaaaga

SEQ ID NO: 37814 - DNA, 20 bp, Artificial Sequence
  Description of Artificial Sequence: Synthetic oligonucleotide
  Target: SCN9A; (+) strand; PAM type: NRG; PAM sequence: GGG
tgagaacatttagcaaagat

SEQ ID NO: 37815 - DNA, 20 bp, Artificial Sequence
  Description of Artificial Sequence: Synthetic oligonucleotide
  Target: SCN9A; (+) strand; PAM type: NRG; PAM sequence: GGG
gagaacatttagcaaagatg

SEQ ID NO: 37816 - DNA, 20 bp, Artificial Sequence
  Description of Artificial Sequence: Synthetic oligonucleotide
  Target: SCN9A; (+) strand; PAM type: NRG; PAM sequence: TGG
atttttatttgtcataactg

SEQ ID NO: 37817 - DNA, 20 bp, Artificial Sequence
  Description of Artificial Sequence: Synthetic oligonucleotide
  Target: SCN9A; (+) strand; PAM type: NRG; PAM sequence: TAG
atttgtcataactgtggaat

SEQ ID NO: 37818 - DNA, 20 bp, Artificial Sequence
  Description of Artificial Sequence: Synthetic oligonucleotide
  Target: SCN9A; (+) strand; PAM type: NRG; PAM sequence: AGG
tttgtcataactgtggaatt

SEQ ID NO: 37819 - DNA, 20 bp, Artificial Sequence
  Description of Artificial Sequence: Synthetic oligonucleotide
  Target: SCN9A; (+) strand; PAM type: NRG; PAM sequence: TAG
taggaatgtttattgatatc

SEQ ID NO: 37820 - DNA, 20 bp, Artificial Sequence
  Description of Artificial Sequence: Synthetic oligonucleotide
  Target: SCN9A; (+) strand; PAM type: NRG; PAM sequence: GAG
ggaatgtttattgatatcta

SEQ ID NO: 37821 - DNA, 20 bp, Artificial Sequence
  Description of Artificial Sequence: Synthetic oligonucleotide
  Target: SCN9A; (+) strand; PAM type: NRG; PAM sequence: AGG
gaatgtttattgatatctag

SEQ ID NO: 37822 - DNA, 20 bp, Artificial Sequence
  Description of Artificial Sequence: Synthetic oligonucleotide
  Target: SCN9A; (+) strand; PAM type: NRG; PAM sequence: TAG
gtttattgatatctagaggt

SEQ ID NO: 37823 - DNA, 20 bp, Artificial Sequence
  Description of Artificial Sequence: Synthetic oligonucleotide
  Target: SCN9A; (+) strand; PAM type: NRG; PAM sequence: GAG
ttattgatatctagaggtta

SEQ ID NO: 37824 - DNA, 20 bp, Artificial Sequence
  Description of Artificial Sequence: Synthetic oligonucleotide
  Target: SCN9A; (+) strand; PAM type: NRG; PAM sequence: CAG
gatatctagaggttagagac

SEQ ID NO: 37825 - DNA, 20 bp, Artificial Sequence
  Description of Artificial Sequence: Synthetic oligonucleotide
  Target: SCN9A; (+) strand; PAM type: NRG; PAM sequence: CAG
gctaaacatcccaccatgca

SEQ ID NO: 37826 - DNA, 20 bp, Artificial Sequence
  Description of Artificial Sequence: Synthetic oligonucleotide
  Target: SCN9A; (+) strand; PAM type: NRG; PAM sequence: AGG
ctaaacatcccaccatgcac

SEQ ID NO: 37827 - DNA, 20 bp, Artificial Sequence
  Description of Artificial Sequence: Synthetic oligonucleotide
  Target: SCN9A; (+) strand; PAM type: NRG; PAM sequence: CAG
acatcccaccatgcacagga

SEQ ID NO: 37828 - DNA, 20 bp, Artificial Sequence
  Description of Artificial Sequence: Synthetic oligonucleotide
  Target: SCN9A; (+) strand; PAM type: NRG; PAM sequence: AAG
caggacagccactcacaaca

SEQ ID NO: 37829 - DNA, 20 bp, Artificial Sequence
  Description of Artificial Sequence: Synthetic oligonucleotide
  Target: SCN9A; (+) strand; PAM type: NRG; PAM sequence: CAG
actcacaacaaagaattatc

SEQ ID NO: 37830 - DNA, 20 bp, Artificial Sequence
  Description of Artificial Sequence: Synthetic oligonucleotide
  Target: SCN9A; (+) strand; PAM type: NRG; PAM sequence: AAG
aattatccagctcaaatatc

SEQ ID NO: 37831 - DNA, 20 bp, Artificial Sequence
  Description of Artificial Sequence: Synthetic oligonucleotide
  Target: SCN9A; (+) strand; PAM type: NRG; PAM sequence: GAG
atatcaagattgccaatatt

SEQ ID NO: 37832 - DNA, 20 bp, Artificial Sequence
  Description of Artificial Sequence: Synthetic oligonucleotide
  Target: SCN9A; (+) strand; PAM type: NRG; PAM sequence: CAG
attgccaatattgagaaact

SEQ ID NO: 37833 - DNA, 20 bp, Artificial Sequence
  Description of Artificial Sequence: Synthetic oligonucleotide
  Target: SCN9A; (+) strand; PAM type: NRG; PAM sequence: AGG
ttgccaatattgagaaactc

SEQ ID NO: 37834 - DNA, 20 bp, Artificial Sequence
  Description of Artificial Sequence: Synthetic oligonucleotide
  Target: SCN9A; (+) strand; PAM type: NRG; PAM sequence: TAG
atattgagaaactcaggcct

SEQ ID NO: 37835 - DNA, 20 bp, Artificial Sequence
  Description of Artificial Sequence: Synthetic oligonucleotide
  Target: SCN9A; (+) strand; PAM type: NRG; PAM sequence: GAG
attgagaaactcaggcctta

SEQ ID NO: 37836 - DNA, 20 bp, Artificial Sequence
  Description of Artificial Sequence: Synthetic oligonucleotide
  Target: SCN9A; (+) strand; PAM type: NRG; PAM sequence: TAG
ataaatgtctgattttaatg

SEQ ID NO: 37837 - DNA, 20 bp, Artificial Sequence
  Description of Artificial Sequence: Synthetic oligonucleotide
  Target: SCN9A; (+) strand; PAM type: NRG; PAM sequence: AAG
ttaatgtagaatgtatatga

SEQ ID NO: 37838 - DNA, 20 bp, Artificial Sequence
  Description of Artificial Sequence: Synthetic oligonucleotide
  Target: SCN9A; (+) strand; PAM type: NRG; PAM sequence: CAG
atatgaaagttttcattttt

SEQ ID NO: 37839 - DNA, 20 bp, Artificial Sequence
  Description of Artificial Sequence: Synthetic oligonucleotide
  Target: SCN9A; (+) strand; PAM type: NRG; PAM sequence: AAG
gttttttttctactttgtta

SEQ ID NO: 37840 - DNA, 20 bp, Artificial Sequence
  Description of Artificial Sequence: Synthetic oligonucleotide
  Target: SCN9A; (+) strand; PAM type: NRG; PAM sequence: TAG
tttctactttgttaaagcta

SEQ ID NO: 37841 - DNA, 20 bp, Artificial Sequence
  Description of Artificial Sequence: Synthetic oligonucleotide
  Target: SCN9A; (+) strand; PAM type: NRG; PAM sequence: GAG
tctactttgttaaagctata

SEQ ID NO: 37842 - DNA, 20 bp, Artificial Sequence
  Description of Artificial Sequence: Synthetic oligonucleotide
  Target: SCN9A; (+) strand; PAM type: NRG; PAM sequence: AGG
ctactttgttaaagctatag

SEQ ID NO: 37843 - DNA, 20 bp, Artificial Sequence
  Description of Artificial Sequence: Synthetic oligonucleotide
  Target: SCN9A; (+) strand; PAM type: NRG; PAM sequence: TAG
gaggaaaaacacttttaact

SEQ ID NO: 37844 - DNA, 20 bp, Artificial Sequence
  Description of Artificial Sequence: Synthetic oligonucleotide
  Target: SCN9A; (+) strand; PAM type: NRG; PAM sequence: CAG
acttagtccttcaaaaatgc

SEQ ID NO: 37845 - DNA, 20 bp, Artificial Sequence
  Description of Artificial Sequence: Synthetic oligonucleotide
  Target: SCN9A; (+) strand; PAM type: NRG; PAM sequence: GAG
ctatactaattttattttgt

SEQ ID NO: 37846 - DNA, 20 bp, Artificial Sequence
  Description of Artificial Sequence: Synthetic oligonucleotide
  Target: SCN9A; (+) strand; PAM type: NRG; PAM sequence: CAG
tactaattttattttgtgag

SEQ ID NO: 37847 - DNA, 20 bp, Artificial Sequence
  Description of Artificial Sequence: Synthetic oligonucleotide
  Target: SCN9A; (+) strand; PAM type: NRG; PAM sequence: TGG
taattttattttgtgagcag

SEQ ID NO: 37848 - DNA, 20 bp, Artificial Sequence
  Description of Artificial Sequence: Synthetic oligonucleotide
  Target: SCN9A; (+) strand; PAM type: NRG; PAM sequence: GGG
aattttattttgtgagcagt

SEQ ID NO: 37849 - DNA, 20 bp, Artificial Sequence
  Description of Artificial Sequence: Synthetic oligonucleotide
  Target: SCN9A; (+) strand; PAM type: NRG; PAM sequence: CAG
ttattttgtgagcagtggga

SEQ ID NO: 37850 - DNA, 20 bp, Artificial Sequence
  Description of Artificial Sequence: Synthetic oligonucleotide
  Target: SCN9A; (+) strand; PAM type: NRG; PAM sequence: AAG
ccactcaacttaccatgtga

SEQ ID NO: 37851 - DNA, 20 bp, Artificial Sequence
  Description of Artificial Sequence: Synthetic oligonucleotide
  Target: SCN9A; (+) strand; PAM type: NRG; PAM sequence: TAG
taccatgtgaaagacatgta

SEQ ID NO: 37852 - DNA, 20 bp, Artificial Sequence
  Description of Artificial Sequence: Synthetic oligonucleotide
  Target: SCN9A; (+) strand; PAM type: NRG; PAM sequence: CAG
aagacatgtatagtctctct

SEQ ID NO: 37853 - DNA, 20 bp, Artificial Sequence
  Description of Artificial Sequence: Synthetic oligonucleotide
  Target: SCN9A; (+) strand; PAM type: NRG; PAM sequence: AGG
agacatgtatagtctctctc

SEQ ID NO: 37854 - DNA, 20 bp, Artificial Sequence
  Description of Artificial Sequence: Synthetic oligonucleotide
  Target: SCN9A; (+) strand; PAM type: NRG; PAM sequence: CAG
atgtatagtctctctcaggc

SEQ ID NO: 37855 - DNA, 20 bp, Artificial Sequence
  Description of Artificial Sequence: Synthetic oligonucleotide
  Target: SCN9A; (+) strand; PAM type: NRG; PAM sequence: AAG
atagtctctctcaggccaga

SEQ ID NO: 37856 - DNA, 20 bp, Artificial Sequence
  Description of Artificial Sequence: Synthetic oligonucleotide
  Target: SCN9A; (+) strand; PAM type: NRG; PAM sequence: TGG
tctctcaggccagaaagcac

SEQ ID NO: 37857 - DNA, 20 bp, Artificial Sequence
  Description of Artificial Sequence: Synthetic oligonucleotide
  Target: SCN9A; (+) strand; PAM type: NRG; PAM sequence: AAG
agaaagcactggcactgtat

SEQ ID NO: 37858 - DNA, 20 bp, Artificial Sequence
  Description of Artificial Sequence: Synthetic oligonucleotide
  Target: SCN9A; (+) strand; PAM type: NRG; PAM sequence: AAG
ctggcactgtataagaatgt

SEQ ID NO: 37859 - DNA, 20 bp, Artificial Sequence
  Description of Artificial Sequence: Synthetic oligonucleotide
  Target: SCN9A; (+) strand; PAM type: NRG; PAM sequence: GAG
gaatacactatacttttgtt

SEQ ID NO: 37860 - DNA, 20 bp, Artificial Sequence
  Description of Artificial Sequence: Synthetic oligonucleotide
  Target: SCN9A; (+) strand; PAM type: NRG; PAM sequence: AAG
tacactatacttttgttgag

SEQ ID NO: 37861 - DNA, 20 bp, Artificial Sequence
  Description of Artificial Sequence: Synthetic oligonucleotide
  Target: SCN9A; (+) strand; PAM type: NRG; PAM sequence: CAG
tgttgagaagatcctgcaaa

SEQ ID NO: 37862 - DNA, 20 bp, Artificial Sequence
  Description of Artificial Sequence: Synthetic oligonucleotide
  Target: SCN9A; (+) strand; PAM type: NRG; PAM sequence: AAG
gagaagatcctgcaaacaga

SEQ ID NO: 37863 - DNA, 20 bp, Artificial Sequence
  Description of Artificial Sequence: Synthetic oligonucleotide
  Target: SCN9A; (+) strand; PAM type: NRG; PAM sequence: GAG
caaacagaaagaaaactatt

SEQ ID NO: 37864 - DNA, 20 bp, Artificial Sequence
  Description of Artificial Sequence: Synthetic oligonucleotide
  Target: SCN9A; (+) strand; PAM type: NRG; PAM sequence: AGG
aaacagaaagaaaactattg

SEQ ID NO: 37865 - DNA, 20 bp, Artificial Sequence
  Description of Artificial Sequence: Synthetic oligonucleotide
  Target: SCN9A; (+) strand; PAM type: NRG; PAM sequence: AAG
aaagaaaactattgaggctg

SEQ ID NO: 37866 - DNA, 20 bp, Artificial Sequence
  Description of Artificial Sequence: Synthetic oligonucleotide
  Target: SCN9A; (+) strand; PAM type: NRG; PAM sequence: CAG
actattgaggctgaagcaca

SEQ ID NO: 37867 - DNA, 20 bp, Artificial Sequence
  Description of Artificial Sequence: Synthetic oligonucleotide
  Target: SCN9A; (+) strand; PAM type: NRG; PAM sequence: AAG
gaggctgaagcacacagatt

SEQ ID NO: 37868 - DNA, 20 bp, Artificial Sequence
  Description of Artificial Sequence: Synthetic oligonucleotide
  Target: SCN9A; (+) strand; PAM type: NRG; PAM sequence: TAG
ctgaagcacacagattaaga

SEQ ID NO: 37869 - DNA, 20 bp, Artificial Sequence
  Description of Artificial Sequence: Synthetic oligonucleotide
  Target: SCN9A; (+) strand; PAM type: NRG; PAM sequence: AGG
tgaagcacacagattaagat

SEQ ID NO: 37870 - DNA, 20 bp, Artificial Sequence
  Description of Artificial Sequence: Synthetic oligonucleotide
  Target: SCN9A; (+) strand; PAM type: NRG; PAM sequence: GGG
gaagcacacagattaagata

SEQ ID NO: 37871 - DNA, 20 bp, Artificial Sequence
  Description of Artificial Sequence: Synthetic oligonucleotide
  Target: SCN9A; (+) strand; PAM type: NRG; PAM sequence: AAG
cacacagattaagataggga

SEQ ID NO: 37872 - DNA, 20 bp, Artificial Sequence
  Description of Artificial Sequence: Synthetic oligonucleotide
  Target: SCN9A; (+) strand; PAM type: NRG; PAM sequence: GAG
cacagattaagatagggaaa

SEQ ID NO: 37873 - DNA, 20 bp, Artificial Sequence
  Description of Artificial Sequence: Synthetic oligonucleotide
  Target: SCN9A; (+) strand; PAM type: NRG; PAM sequence: AGG
acagattaagatagggaaag

SEQ ID NO: 37874 - DNA, 20 bp, Artificial Sequence
  Description of Artificial Sequence: Synthetic oligonucleotide
  Target: SCN9A; (+) strand; PAM type: NRG; PAM sequence: GGG
cagattaagatagggaaaga

SEQ ID NO: 37875 - DNA, 20 bp, Artificial Sequence
  Description of Artificial Sequence: Synthetic oligonucleotide
  Target: SCN9A; (+) strand; PAM type: NRG; PAM sequence: AAG
attaagatagggaaagaggg

SEQ ID NO: 37876 - DNA, 20 bp, Artificial Sequence
  Description of Artificial Sequence: Synthetic oligonucleotide
  Target: SCN9A; (+) strand; PAM type: NRG; PAM sequence: AAG
gatagggaaagagggaagat

SEQ ID NO: 37877 - DNA, 20 bp, Artificial Sequence
  Description of Artificial Sequence: Synthetic oligonucleotide
  Target: SCN9A; (+) strand; PAM type: NRG; PAM sequence: GAG
tagggaaagagggaagataa

SEQ ID NO: 37878 - DNA, 20 bp, Artificial Sequence
  Description of Artificial Sequence: Synthetic oligonucleotide
  Target: SCN9A; (+) strand; PAM type: NRG; PAM sequence: CAG
ggaaagagggaagataagag

SEQ ID NO: 37879 - DNA, 20 bp, Artificial Sequence
  Description of Artificial Sequence: Synthetic oligonucleotide
  Target: SCN9A; (+) strand; PAM type: NRG; PAM sequence: GAG
agagggaagataagagcagt

SEQ ID NO: 37880 - DNA, 20 bp, Artificial Sequence
  Description of Artificial Sequence: Synthetic oligonucleotide
  Target: SCN9A; (+) strand; PAM type: NRG; PAM sequence: AGG
gagggaagataagagcagtg

SEQ ID NO: 37881 - DNA, 20 bp, Artificial Sequence
  Description of Artificial Sequence: Synthetic oligonucleotide
  Target: SCN9A; (+) strand; PAM type: NRG; PAM sequence: TGG
taagagcagtgaggctgaca

SEQ ID NO: 37882 - DNA, 20 bp, Artificial Sequence
  Description of Artificial Sequence: Synthetic oligonucleotide
  Target: SCN9A; (+) strand; PAM type: NRG; PAM sequence: TAG
gcagtgaggctgacatggtg

SEQ ID NO: 37883 - DNA, 20 bp, Artificial Sequence
  Description of Artificial Sequence: Synthetic oligonucleotide
  Target: SCN9A; (+) strand; PAM type: NRG; PAM sequence: AGG
cagtgaggctgacatggtgt

SEQ ID NO: 37884 - DNA, 20 bp, Artificial Sequence
  Description of Artificial Sequence: Synthetic oligonucleotide
  Target: SCN9A; (+) strand; PAM type: NRG; PAM sequence: GGG
agtgaggctgacatggtgta

SEQ ID NO: 37885 - DNA, 20 bp, Artificial Sequence
  Description of Artificial Sequence: Synthetic oligonucleotide
  Target: SCN9A; (+) strand; PAM type: NRG; PAM sequence: TGG
aggctgacatggtgtagggc

SEQ ID NO: 37886 - DNA, 20 bp, Artificial Sequence
  Description of Artificial Sequence: Synthetic oligonucleotide
  Target: SCN9A; (+) strand; PAM type: NRG; PAM sequence: AAG
tgacatggtgtagggctgga

SEQ ID NO: 37887 - DNA, 20 bp, Artificial Sequence
  Description of Artificial Sequence: Synthetic oligonucleotide
  Target: SCN9A; (+) strand; PAM type: NRG; PAM sequence: TAG
gtgtagggctggaaagcttg

SEQ ID NO: 37888 - DNA, 20 bp, Artificial Sequence
  Description of Artificial Sequence: Synthetic oligonucleotide
  Target: SCN9A; (+) strand; PAM type: NRG; PAM sequence: TAG
tggaaagcttgtagaacttg

SEQ ID NO: 37889 - DNA, 20 bp, Artificial Sequence
  Description of Artificial Sequence: Synthetic oligonucleotide
  Target: SCN9A; (+) strand; PAM type: NRG; PAM sequence: CAG
aagcttgtagaacttgtaga

SEQ ID NO: 37890 - DNA, 20 bp, Artificial Sequence
  Description of Artificial Sequence: Synthetic oligonucleotide
  Target: SCN9A; (+) strand; PAM type: NRG; PAM sequence: TAG
gtagaacttgtagacagtaa

SEQ ID NO: 37891 - DNA, 20 bp, Artificial Sequence
  Description of Artificial Sequence: Synthetic oligonucleotide
  Target: SCN9A; (+) strand; PAM type: NRG; PAM sequence: TAG
acttgtagacagtaatagta

SEQ ID NO: 37892 - DNA, 20 bp, Artificial Sequence
  Description of Artificial Sequence: Synthetic oligonucleotide
  Target: SCN9A; (+) strand; PAM type: NRG; PAM sequence: GAG
ttgtagacagtaatagtata

SEQ ID NO: 37893 - DNA, 20 bp, Artificial Sequence
  Description of Artificial Sequence: Synthetic oligonucleotide
  Target: SCN9A; (+) strand; PAM type: NRG; PAM sequence: GAG
gagtttgtaaaatctttgct

SEQ ID NO: 37894 - DNA, 20 bp, Artificial Sequence
  Description of Artificial Sequence: Synthetic oligonucleotide
  Target: SCN9A; (+) strand; PAM type: NRG; PAM sequence: AGG
agtttgtaaaatctttgctg

SEQ ID NO: 37895 - DNA, 20 bp, Artificial Sequence
  Description of Artificial Sequence: Synthetic oligonucleotide
  Target: SCN9A; (+) strand; PAM type: NRG; PAM sequence: TAG
aaaatctttgctgaggattt

SEQ ID NO: 37896 - DNA, 20 bp, Artificial Sequence
  Description of Artificial Sequence: Synthetic oligonucleotide
  Target: SCN9A; (+) strand; PAM type: NRG; PAM sequence: TGG
agaatttatcatcataataa

SEQ ID NO: 37897 - DNA, 20 bp, Artificial Sequence
  Description of Artificial Sequence: Synthetic oligonucleotide
  Target: SCN9A; (+) strand; PAM type: NRG; PAM sequence: GAG
aatttatcatcataataatg

SEQ ID NO: 37898 - DNA, 20 bp, Artificial Sequence
  Description of Artificial Sequence: Synthetic oligonucleotide
  Target: SCN9A; (+) strand; PAM type: NRG; PAM sequence: CAG
ataataatggagaaatatta

SEQ ID NO: 37899 - DNA, 20 bp, Artificial Sequence
  Description of Artificial Sequence: Synthetic oligonucleotide
  Target: SCN9A; (+) strand; PAM type: NRG; PAM sequence: CGG
aatattacagaattttatgc

SEQ ID NO: 37900 - DNA, 20 bp, Artificial Sequence
  Description of Artificial Sequence: Synthetic oligonucleotide
  Target: SCN9A; (+) strand; PAM type: NRG; PAM sequence: AAG
ggaaaatgacccaaaatttt

SEQ ID NO: 37901 - DNA, 20 bp, Artificial Sequence
  Description of Artificial Sequence: Synthetic oligonucleotide
  Target: SCN9A; (+) strand; PAM type: NRG; PAM sequence: CAG
aaatgacccaaaattttaag

SEQ ID NO: 37902 - DNA, 20 bp, Artificial Sequence
  Description of Artificial Sequence: Synthetic oligonucleotide
  Target: SCN9A; (+) strand; PAM type: NRG; PAM sequence: AGG
aatgacccaaaattttaagc

SEQ ID NO: 37903 - DNA, 20 bp, Artificial Sequence
  Description of Artificial Sequence: Synthetic oligonucleotide
  Target: SCN9A; (+) strand; PAM type: NRG; PAM sequence: GGG
atgacccaaaattttaagca

SEQ ID NO: 37904 - DNA, 20 bp, Artificial Sequence
  Description of Artificial Sequence: Synthetic oligonucleotide
  Target: SCN9A; (+) strand; PAM type: NRG; PAM sequence: TGG
caacctcataaaatccactc

SEQ ID NO: 37905 - DNA, 20 bp, Artificial Sequence
  Description of Artificial Sequence: Synthetic oligonucleotide
  Target: SCN9A; (+) strand; PAM type: NRG; PAM sequence: GAG
tccactctggctactgtact

SEQ ID NO: 37906 - DNA, 20 bp, Artificial Sequence
  Description of Artificial Sequence: Synthetic oligonucleotide
  Target: SCN9A; (+) strand; PAM type: NRG; PAM sequence: TAG
tctggctactgtactgagaa

SEQ ID NO: 37907 - DNA, 20 bp, Artificial Sequence
  Description of Artificial Sequence: Synthetic oligonucleotide
  Target: SCN9A; (+) strand; PAM type: NRG; PAM sequence: TGG
tactgtactgagaatagatt

SEQ ID NO: 37908 - DNA, 20 bp, Artificial Sequence
  Description of Artificial Sequence: Synthetic oligonucleotide
  Target: SCN9A; (+) strand; PAM type: NRG; PAM sequence: AAG
tgtactgagaatagatttgg

SEQ ID NO: 37909 - DNA, 20 bp, Artificial Sequence
  Description of Artificial Sequence: Synthetic oligonucleotide
  Target: SCN9A; (+) strand; PAM type: NRG; PAM sequence: GAG
ctgagaatagatttggaagt

SEQ ID NO: 37910 - DNA, 20 bp, Artificial Sequence
  Description of Artificial Sequence: Synthetic oligonucleotide
  Target: SCN9A; (+) strand; PAM type: NRG; PAM sequence: AGG
tgagaatagatttggaagtg

SEQ ID NO: 37911 - DNA, 20 bp, Artificial Sequence
  Description of Artificial Sequence: Synthetic oligonucleotide
  Target: SCN9A; (+) strand; PAM type: NRG; PAM sequence: AAG
aatagatttggaagtgaggc

SEQ ID NO: 37912 - DNA, 20 bp, Artificial Sequence
  Description of Artificial Sequence: Synthetic oligonucleotide
  Target: SCN9A; (+) strand; PAM type: NRG; PAM sequence: TGG
atttggaagtgaggcaagaa

SEQ ID NO: 37913 - DNA, 20 bp, Artificial Sequence
  Description of Artificial Sequence: Synthetic oligonucleotide
  Target: SCN9A; (+) strand; PAM type: NRG; PAM sequence: TAG
aagtgaggcaagaatggatt

SEQ ID NO: 37914 - DNA, 20 bp, Artificial Sequence
  Description of Artificial Sequence: Synthetic oligonucleotide
  Target: SCN9A; (+) strand; PAM type: NRG; PAM sequence: AAG
gaggcaagaatggatttagt

SEQ ID NO: 37915 - DNA, 20 bp, Artificial Sequence
  Description of Artificial Sequence: Synthetic oligonucleotide
  Target: SCN9A; (+) strand; PAM type: NRG; PAM sequence: AAG
tggatttagtaagataaaac

SEQ ID NO: 37916 - DNA, 20 bp, Artificial Sequence
  Description of Artificial Sequence: Synthetic oligonucleotide
  Target: SCN9A; (+) strand; PAM type: NRG; PAM sequence: TAG
atttagtaagataaaacaag

SEQ ID NO: 37917 - DNA, 20 bp, Artificial Sequence
  Description of Artificial Sequence: Synthetic oligonucleotide
  Target: SCN9A; (+) strand; PAM type: NRG; PAM sequence: AGG
tttagtaagataaaacaagt

SEQ ID NO: 37918 - DNA, 20 bp, Artificial Sequence
  Description of Artificial Sequence: Synthetic oligonucleotide
  Target: SCN9A; (+) strand; PAM type: NRG; PAM sequence: AAG
ggttattacattgtcttata

SEQ ID NO: 37919 - DNA, 20 bp, Artificial Sequence
  Description of Artificial Sequence: Synthetic oligonucleotide
  Target: SCN9A; (+) strand; PAM type: NRG; PAM sequence: GAG
ttattacattgtcttataaa

SEQ ID NO: 37920 - DNA, 20 bp, Artificial Sequence
  Description of Artificial Sequence: Synthetic oligonucleotide
  Target: SCN9A; (+) strand; PAM type: NRG; PAM sequence: AGG
tattacattgtcttataaag

SEQ ID NO: 37921 - DNA, 20 bp, Artificial Sequence
  Description of Artificial Sequence: Synthetic oligonucleotide
  Target: SCN9A; (+) strand; PAM type: NRG; PAM sequence: AAG
attgtcttataaagaggtta

SEQ ID NO: 37922 - DNA, 20 bp, Artificial Sequence
  Description of Artificial Sequence: Synthetic oligonucleotide
  Target: SCN9A; (+) strand; PAM type: NRG; PAM sequence: AGG
ttgtcttataaagaggttaa

SEQ ID NO: 37923 - DNA, 20 bp, Artificial Sequence
  Description of Artificial Sequence: Synthetic oligonucleotide
  Target: SCN9A; (+) strand; PAM type: NRG; PAM sequence: TGG
tcttataaagaggttaaagg

SEQ ID NO: 37924 - DNA, 20 bp, Artificial Sequence
  Description of Artificial Sequence: Synthetic oligonucleotide
  Target: SCN9A; (+) strand; PAM type: NRG; PAM sequence: TGG
aaagaggttaaaggtggtaa

SEQ ID NO: 37925 - DNA, 20 bp, Artificial Sequence
  Description of Artificial Sequence: Synthetic oligonucleotide
  Target: SCN9A; (+) strand; PAM type: NRG; PAM sequence: TGG
ggttaaaggtggtaatggat

SEQ ID NO: 37926 - DNA, 20 bp, Artificial Sequence
  Description of Artificial Sequence: Synthetic oligonucleotide
  Target: SCN9A; (+) strand; PAM type: NRG; PAM sequence: TAG
aaggtggtaatggattggat

SEQ ID NO: 37927 - DNA, 20 bp, Artificial Sequence
  Description of Artificial Sequence: Synthetic oligonucleotide
  Target: SCN9A; (+) strand; PAM type: NRG; PAM sequence: AGG
aggtggtaatggattggatt

SEQ ID NO: 37928 - DNA, 20 bp, Artificial Sequence
  Description of Artificial Sequence: Synthetic oligonucleotide
  Target: SCN9A; (+) strand; PAM type: NRG; PAM sequence: CAG
tggattggattaggtgttga

SEQ ID NO: 37929 - DNA, 20 bp, Artificial Sequence
  Description of Artificial Sequence: Synthetic oligonucleotide
  Target: SCN9A; (+) strand; PAM type: NRG; PAM sequence: TGG
attggattaggtgttgacag

SEQ ID NO: 37930 - DNA, 20 bp, Artificial Sequence
  Description of Artificial Sequence: Synthetic oligonucleotide
  Target: SCN9A; (+) strand; PAM type: NRG; PAM sequence: AAG
aggtgttgacagtggaaatt

SEQ ID NO: 37931 - DNA, 20 bp, Artificial Sequence
  Description of Artificial Sequence: Synthetic oligonucleotide
  Target: SCN9A; (+) strand; PAM type: NRG; PAM sequence: GAG
gtgttgacagtggaaattaa

SEQ ID NO: 37932 - DNA, 20 bp, Artificial Sequence
  Description of Artificial Sequence: Synthetic oligonucleotide
  Target: SCN9A; (+) strand; PAM type: NRG; PAM sequence: AAG
ttgacagtggaaattaagag

SEQ ID NO: 37933 - DNA, 20 bp, Artificial Sequence
  Description of Artificial Sequence: Synthetic oligonucleotide
  Target: SCN9A; (+) strand; PAM type: NRG; PAM sequence: TAG
ttgatgtatttacattacat

SEQ ID NO: 37934 - DNA, 20 bp, Artificial Sequence
  Description of Artificial Sequence: Synthetic oligonucleotide
  Target: SCN9A; (+) strand; PAM type: NRG; PAM sequence: AGG
tgatgtatttacattacatt

SEQ ID NO: 37935 - DNA, 20 bp, Artificial Sequence
  Description of Artificial Sequence: Synthetic oligonucleotide
  Target: SCN9A; (+) strand; PAM type: NRG; PAM sequence: TGG
tgtatttacattacattagg

SEQ ID NO: 37936 - DNA, 20 bp, Artificial Sequence
  Description of Artificial Sequence: Synthetic oligonucleotide
  Target: SCN9A; (+) strand; PAM type: NRG; PAM sequence: TAG
atttacattacattaggtgg

SEQ ID NO: 37937 - DNA, 20 bp, Artificial Sequence
  Description of Artificial Sequence: Synthetic oligonucleotide
  Target: SCN9A; (+) strand; PAM type: NRG; PAM sequence: TGG
cattaggtggtagaatgaac

SEQ ID NO: 37938 - DNA, 20 bp, Artificial Sequence
  Description of Artificial Sequence: Synthetic oligonucleotide
  Target: SCN9A; (+) strand; PAM type: NRG; PAM sequence: TGG
gtggtagaatgaactggtct

SEQ ID NO: 37939 - DNA, 20 bp, Artificial Sequence
  Description of Artificial Sequence: Synthetic oligonucleotide
  Target: SCN9A; (+) strand; PAM type: NRG; PAM sequence: CGG
ctggtcttggtgaataaatg

SEQ ID NO: 37940 - DNA, 20 bp, Artificial Sequence
  Description of Artificial Sequence: Synthetic oligonucleotide
  Target: SCN9A; (+) strand; PAM type: NRG; PAM sequence: GAG
ggtcttggtgaataaatgcg

SEQ ID NO: 37941 - DNA, 20 bp, Artificial Sequence
  Description of Artificial Sequence: Synthetic oligonucleotide
  Target: SCN9A; (+) strand; PAM type: NRG; PAM sequence: AGG
gtcttggtgaataaatgcgg

SEQ ID NO: 37942 - DNA, 20 bp, Artificial Sequence
  Description of Artificial Sequence: Synthetic oligonucleotide
  Target: SCN9A; (+) strand; PAM type: NRG; PAM sequence: GGG
tcttggtgaataaatgcgga

SEQ ID NO: 37943 - DNA, 20 bp, Artificial Sequence
  Description of Artificial Sequence: Synthetic oligonucleotide
  Target: SCN9A; (+) strand; PAM type: NRG; PAM sequence: AAG
ataaatgcggagggttaatg

SEQ ID NO: 37944 - DNA, 20 bp, Artificial Sequence
  Description of Artificial Sequence: Synthetic oligonucleotide
  Target: SCN9A; (+) strand; PAM type: NRG; PAM sequence: GAG
aaatgcggagggttaatgaa

SEQ ID NO: 37945 - DNA, 20 bp, Artificial Sequence
  Description of Artificial Sequence: Synthetic oligonucleotide
  Target: SCN9A; (+) strand; PAM type: NRG; PAM sequence: AGG
aatgcggagggttaatgaag

SEQ ID NO: 37946 - DNA, 20 bp, Artificial Sequence
  Description of Artificial Sequence: Synthetic oligonucleotide
  Target: SCN9A; (+) strand; PAM type: NRG; PAM sequence: TAG
ggagggttaatgaagaggat

SEQ ID NO: 37947 - DNA, 20 bp, Artificial Sequence
  Description of Artificial Sequence: Synthetic oligonucleotide
  Target: SCN9A; (+) strand; PAM type: NRG; PAM sequence: TGG
gttaatgaagaggattagtt

SEQ ID NO: 37948 - DNA, 20 bp, Artificial Sequence
  Description of Artificial Sequence: Synthetic oligonucleotide
  Target: SCN9A; (+) strand; PAM type: NRG; PAM sequence: TGG
agaggattagtttggaaaac

SEQ ID NO: 37949 - DNA, 20 bp, Artificial Sequence
  Description of Artificial Sequence: Synthetic oligonucleotide
  Target: SCN9A; (+) strand; PAM type: NRG; PAM sequence: TGG
agtttggaaaactggatgaa

SEQ ID NO: 37950 - DNA, 20 bp, Artificial Sequence
  Description of Artificial Sequence: Synthetic oligonucleotide
  Target: SCN9A; (+) strand; PAM type: NRG; PAM sequence: TGG
ttggaaaactggatgaatgg

SEQ ID NO: 37951 - DNA, 20 bp, Artificial Sequence
  Description of Artificial Sequence: Synthetic oligonucleotide
  Target: SCN9A; (+) strand; PAM type: NRG; PAM sequence: GAG
gaatggtggtactaatcaat

SEQ ID NO: 37952 - DNA, 20 bp, Artificial Sequence
  Description of Artificial Sequence: Synthetic oligonucleotide
  Target: SCN9A; (+) strand; PAM type: NRG; PAM sequence: AAG
tggtggtactaatcaatgag

SEQ ID NO: 37953 - DNA, 20 bp, Artificial Sequence
  Description of Artificial Sequence: Synthetic oligonucleotide
  Target: SCN9A; (+) strand; PAM type: NRG; PAM sequence: AGG
ggtggtactaatcaatgaga

SEQ ID NO: 37954 - DNA, 20 bp, Artificial Sequence
  Description of Artificial Sequence: Synthetic oligonucleotide
  Target: SCN9A; (+) strand; PAM type: NRG; PAM sequence: AAG
ggtactaatcaatgagaagg

SEQ ID NO: 37955 - DNA, 20 bp, Artificial Sequence
  Description of Artificial Sequence: Synthetic oligonucleotide
  Target: SCN9A; (+) strand; PAM type: NRG; PAM sequence: CAG
aatttatttaccatgatata

SEQ ID NO: 37956 - DNA, 20 bp, Artificial Sequence
  Description of Artificial Sequence: Synthetic oligonucleotide
  Target: SCN9A; (+) strand; PAM type: NRG; PAM sequence: TAG
catgatatacagttgtccct

SEQ ID NO: 37957 - DNA, 20 bp, Artificial Sequence
  Description of Artificial Sequence: Synthetic oligonucleotide
  Target: SCN9A; (+) strand; PAM type: NRG; PAM sequence: TGG
agttgtcccttagtatctgc

SEQ ID NO: 37958 - DNA, 20 bp, Artificial Sequence
  Description of Artificial Sequence: Synthetic oligonucleotide
  Target: SCN9A; (+) strand; PAM type: NRG; PAM sequence: GGG
gttgtcccttagtatctgct

SEQ ID NO: 37959 - DNA, 20 bp, Artificial Sequence
  Description of Artificial Sequence: Synthetic oligonucleotide
  Target: SCN9A; (+) strand; PAM type: NRG; PAM sequence: GGG
ttgtcccttagtatctgctg

SEQ ID NO: 37960 - DNA, 20 bp, Artificial Sequence
  Description of Artificial Sequence: Synthetic oligonucleotide
  Target: SCN9A; (+) strand; PAM type: NRG; PAM sequence: TGG
ccttagtatctgctggggat

SEQ ID NO: 37961 - DNA, 20 bp, Artificial Sequence
  Description of Artificial Sequence: Synthetic oligonucleotide
  Target: SCN9A; (+) strand; PAM type: NRG; PAM sequence: TGG
atctgctggggattggcttc

SEQ ID NO: 37962 - DNA, 20 bp, Artificial Sequence
  Description of Artificial Sequence: Synthetic oligonucleotide
  Target: SCN9A; (+) strand; PAM type: NRG; PAM sequence: GAG
gattggcttctggactccct

SEQ ID NO: 37963 - DNA, 20 bp, Artificial Sequence
  Description of Artificial Sequence: Synthetic oligonucleotide
  Target: SCN9A; (+) strand; PAM type: NRG; PAM sequence: CAG
cctgagaataccaaaatcca

SEQ ID NO: 37964 - DNA, 20 bp, Artificial Sequence
  Description of Artificial Sequence: Synthetic oligonucleotide
  Target: SCN9A; (+) strand; PAM type: NRG; PAM sequence: TGG
gctcaaatctcttatacaaa

SEQ ID NO: 37965 - DNA, 20 bp, Artificial Sequence
  Description of Artificial Sequence: Synthetic oligonucleotide
  Target: SCN9A; (+) strand; PAM type: NRG; PAM sequence: TAG
aatctcttatacaaatggca

SEQ ID NO: 37966 - DNA, 20 bp, Artificial Sequence
  Description of Artificial Sequence: Synthetic oligonucleotide
  Target: SCN9A; (+) strand; PAM type: NRG; PAM sequence: TAG
cctacacacatcctcctata

SEQ ID NO: 37967 - DNA, 20 bp, Artificial Sequence
  Description of Artificial Sequence: Synthetic oligonucleotide
  Target: SCN9A; (+) strand; PAM type: NRG; PAM sequence: TGG
tacacatcacttcatttgta

SEQ ID NO: 37968 - DNA, 20 bp, Artificial Sequence
  Description of Artificial Sequence: Synthetic oligonucleotide
  Target: SCN9A; (+) strand; PAM type: NRG; PAM sequence: TAG
tcatttgtatggattcaatg

SEQ ID NO: 37969 - DNA, 20 bp, Artificial Sequence
  Description of Artificial Sequence: Synthetic oligonucleotide
  Target: SCN9A; (+) strand; PAM type: NRG; PAM sequence: CAG
tatggattcaatgtagtact

SEQ ID NO: 37970 - DNA, 20 bp, Artificial Sequence
  Description of Artificial Sequence: Synthetic oligonucleotide
  Target: SCN9A; (+) strand; PAM type: NRG; PAM sequence: TGG
tcaatgtagtactcagcata

SEQ ID NO: 37971 - DNA, 20 bp, Artificial Sequence
  Description of Artificial Sequence: Synthetic oligonucleotide
  Target: SCN9A; (+) strand; PAM type: NRG; PAM sequence: AAG
actcagcatatggaaaattc

SEQ ID NO: 37972 - DNA, 20 bp, Artificial Sequence
  Description of Artificial Sequence: Synthetic oligonucleotide
  Target: SCN9A; (+) strand; PAM type: NRG; PAM sequence: TGG
aaaattcaagttttgccttt

SEQ ID NO: 37973 - DNA, 20 bp, Artificial Sequence
  Description of Artificial Sequence: Synthetic oligonucleotide
  Target: SCN9A; (+) strand; PAM type: NRG; PAM sequence: GGG
aaattcaagttttgcctttt

SEQ ID NO: 37974 - DNA, 20 bp, Artificial Sequence
  Description of Artificial Sequence: Synthetic oligonucleotide
  Target: SCN9A; (+) strand; PAM type: NRG; PAM sequence: GGG
aattcaagttttgccttttg

SEQ ID NO: 37975 - DNA, 20 bp, Artificial Sequence
  Description of Artificial Sequence: Synthetic oligonucleotide
  Target: SCN9A; (+) strand; PAM type: NRG; PAM sequence: TGG
ttttgccttttggggctttg

SEQ ID NO: 37976 - DNA, 20 bp, Artificial Sequence
  Description of Artificial Sequence: Synthetic oligonucleotide
  Target: SCN9A; (+) strand; PAM type: NRG; PAM sequence: CAG
ttccccaactatttctgatc

SEQ ID NO: 37977 - DNA, 20 bp, Artificial Sequence
  Description of Artificial Sequence: Synthetic oligonucleotide
  Target: SCN9A; (+) strand; PAM type: NRG; PAM sequence: TGG
aactatttctgatccagaat

SEQ ID NO: 37978 - DNA, 20 bp, Artificial Sequence
  Description of Artificial Sequence: Synthetic oligonucleotide
  Target: SCN9A; (+) strand; PAM type: NRG; PAM sequence: CAG
tccagaattggttgaatcca

SEQ ID NO: 37979 - DNA, 20 bp, Artificial Sequence
  Description of Artificial Sequence: Synthetic oligonucleotide
  Target: SCN9A; (+) strand; PAM type: NRG; PAM sequence: CAG
aattggttgaatccacagat

SEQ ID NO: 37980 - DNA, 20 bp, Artificial Sequence
  Description of Artificial Sequence: Synthetic oligonucleotide
  Target: SCN9A; (+) strand; PAM type: NRG; PAM sequence: TGG
aatccacagatcagaaacca

SEQ ID NO: 37981 - DNA, 20 bp, Artificial Sequence
  Description of Artificial Sequence: Synthetic oligonucleotide
  Target: SCN9A; (+) strand; PAM type: NRG; PAM sequence: TGG
cagatcagaaaccatggata

SEQ ID NO: 37982 - DNA, 20 bp, Artificial Sequence
  Description of Artificial Sequence: Synthetic oligonucleotide
  Target: SCN9A; (+) strand; PAM type: NRG; PAM sequence: GAG
gatcagaaaccatggatatg

SEQ ID NO: 37983 - DNA, 20 bp, Artificial Sequence
  Description of Artificial Sequence: Synthetic oligonucleotide
  Target: SCN9A; (+) strand; PAM type: NRG; PAM sequence: AGG
atcagaaaccatggatatgg

SEQ ID NO: 37984 - DNA, 20 bp, Artificial Sequence
  Description of Artificial Sequence: Synthetic oligonucleotide
  Target: SCN9A; (+) strand; PAM type: NRG; PAM sequence: GAG
atatatatatcttccaccat

SEQ ID NO: 37985 - DNA, 20 bp, Artificial Sequence
  Description of Artificial Sequence: Synthetic oligonucleotide
  Target: SCN9A; (+) strand; PAM type: NRG; PAM sequence: TAG
tatatcttccaccatgagat

SEQ ID NO: 37986 - DNA, 20 bp, Artificial Sequence
  Description of Artificial Sequence: Synthetic oligonucleotide
  Target: SCN9A; (+) strand; PAM type: NRG; PAM sequence: TAG
ccatgagattagtattccta

SEQ ID NO: 37987 - DNA, 20 bp, Artificial Sequence
  Description of Artificial Sequence: Synthetic oligonucleotide
  Target: SCN9A; (+) strand; PAM type: NRG; PAM sequence: AAG
attagtattcctatagaaaa

SEQ ID NO: 37988 - DNA, 20 bp, Artificial Sequence
  Description of Artificial Sequence: Synthetic oligonucleotide
  Target: SCN9A; (+) strand; PAM type: NRG; PAM sequence: AAG
agtattcctatagaaaaaag

SEQ ID NO: 37989 - DNA, 20 bp, Artificial Sequence
  Description of Artificial Sequence: Synthetic oligonucleotide
  Target: SCN9A; (+) strand; PAM type: NRG; PAM sequence: GAG
tattcctatagaaaaaagaa

SEQ ID NO: 37990 - DNA, 20 bp, Artificial Sequence
  Description of Artificial Sequence: Synthetic oligonucleotide
  Target: SCN9A; (+) strand; PAM type: NRG; PAM sequence: GAG
ttcctatagaaaaaagaaga

SEQ ID NO: 37991 - DNA, 20 bp, Artificial Sequence
  Description of Artificial Sequence: Synthetic oligonucleotide
  Target: SCN9A; (+) strand; PAM type: NRG; PAM sequence: CAG
atagaaaaaagaagagagac

SEQ ID NO: 37992 - DNA, 20 bp, Artificial Sequence
  Description of Artificial Sequence: Synthetic oligonucleotide
  Target: SCN9A; (+) strand; PAM type: NRG; PAM sequence: GAG
agaaaaaagaagagagacca

SEQ ID NO: 37993 - DNA, 20 bp, Artificial Sequence
  Description of Artificial Sequence: Synthetic oligonucleotide
  Target: SCN9A; (+) strand; PAM type: NRG; PAM sequence: AAG
ctcactgcctcctccatttg

SEQ ID NO: 37994 - DNA, 20 bp, Artificial Sequence
  Description of Artificial Sequence: Synthetic oligonucleotide
  Target: SCN9A; (+) strand; PAM type: NRG; PAM sequence: CAG
gcctcctccatttgaagaca

SEQ ID NO: 37995 - DNA, 20 bp, Artificial Sequence
  Description of Artificial Sequence: Synthetic oligonucleotide
  Target: SCN9A; (+) strand; PAM type: NRG; PAM sequence: GAG
cctccatttgaagacacagt

SEQ ID NO: 37996 - DNA, 20 bp, Artificial Sequence
  Description of Artificial Sequence: Synthetic oligonucleotide
  Target: SCN9A; (+) strand; PAM type: NRG; PAM sequence: CAG
gtgagaatgctgccctctgc

SEQ ID NO: 37997 - DNA, 20 bp, Artificial Sequence
  Description of Artificial Sequence: Synthetic oligonucleotide
  Target: SCN9A; (+) strand; PAM type: NRG; PAM sequence: CAG
gaatgctgccctctgccagc

SEQ ID NO: 37998 - DNA, 20 bp, Artificial Sequence
  Description of Artificial Sequence: Synthetic oligonucleotide
  Target: SCN9A; (+) strand; PAM type: NRG; PAM sequence: AGG
aatgctgccctctgccagcc

SEQ ID NO: 37999 - DNA, 20 bp, Artificial Sequence
  Description of Artificial Sequence: Synthetic oligonucleotide
  Target: SCN9A; (+) strand; PAM type: NRG; PAM sequence: GAG
ccctctgccagccaggaaat

SEQ ID NO: 38000 - DNA, 20 bp, Artificial Sequence
  Description of Artificial Sequence: Synthetic oligonucleotide
  Target: SCN9A; (+) strand; PAM type: NRG; PAM sequence: TGG
gccaggaaatgagccctcac

SEQ ID NO: 38001 - DNA, 20 bp, Artificial Sequence
  Description of Artificial Sequence: Synthetic oligonucleotide
  Target: SCN9A; (+) strand; PAM type: NRG; PAM sequence: GGG
ccaggaaatgagccctcact

SEQ ID NO: 38002 - DNA, 20 bp, Artificial Sequence
  Description of Artificial Sequence: Synthetic oligonucleotide
  Target: SCN9A; (+) strand; PAM type: NRG; PAM sequence: GGG
caggaaatgagccctcactg

SEQ ID NO: 38003 - DNA, 20 bp, Artificial Sequence
  Description of Artificial Sequence: Synthetic oligonucleotide
  Target: SCN9A; (+) strand; PAM type: NRG; PAM sequence: TGG
ccctcactggggaacgaaat

SEQ ID NO: 38004 - DNA, 20 bp, Artificial Sequence
  Description of Artificial Sequence: Synthetic oligonucleotide
  Target: SCN9A; (+) strand; PAM type: NRG; PAM sequence: TGG
cactggggaacgaaattggc

SEQ ID NO: 38005 - DNA, 20 bp, Artificial Sequence
  Description of Artificial Sequence: Synthetic oligonucleotide
  Target: SCN9A; (+) strand; PAM type: NRG; PAM sequence: TGG
attggctggcgccttaatct

SEQ ID NO: 38006 - DNA, 20 bp, Artificial Sequence
  Description of Artificial Sequence: Synthetic oligonucleotide
  Target: SCN9A; (+) strand; PAM type: NRG; PAM sequence: CAG
cgccttaatcttggactcct

SEQ ID NO: 38007 - DNA, 20 bp, Artificial Sequence
  Description of Artificial Sequence: Synthetic oligonucleotide
  Target: SCN9A; (+) strand; PAM type: NRG; PAM sequence: CGG
aatcttggactcctcagcct

SEQ ID NO: 38008 - DNA, 20 bp, Artificial Sequence
  Description of Artificial Sequence: Synthetic oligonucleotide
  Target: SCN9A; (+) strand; PAM type: NRG; PAM sequence: GGG
atcttggactcctcagcctc

SEQ ID NO: 38009 - DNA, 20 bp, Artificial Sequence
  Description of Artificial Sequence: Synthetic oligonucleotide
  Target: SCN9A; (+) strand; PAM type: NRG; PAM sequence: TAG
tcctcagcctcgggaactgt

SEQ ID NO: 38010 - DNA, 20 bp, Artificial Sequence
  Description of Artificial Sequence: Synthetic oligonucleotide
  Target: SCN9A; (+) strand; PAM type: NRG; PAM sequence: TAG
gaaataaatttctgttgttc

SEQ ID NO: 38011 - DNA, 20 bp, Artificial Sequence
  Description of Artificial Sequence: Synthetic oligonucleotide
  Target: SCN9A; (+) strand; PAM type: NRG; PAM sequence: CAG
tttctgttgttctagccacc

SEQ ID NO: 38012 - DNA, 20 bp, Artificial Sequence
  Description of Artificial Sequence: Synthetic oligonucleotide
  Target: SCN9A; (+) strand; PAM type: NRG; PAM sequence: TGG
tgttctagccacccagtcta

SEQ ID NO: 38013 - DNA, 20 bp, Artificial Sequence
  Description of Artificial Sequence: Synthetic oligonucleotide
  Target: SCN9A; (+) strand; PAM type: NRG; PAM sequence: CAG
tctatggtatattattatga

SEQ ID NO: 38014 - DNA, 20 bp, Artificial Sequence
  Description of Artificial Sequence: Synthetic oligonucleotide
  Target: SCN9A; (+) strand; PAM type: NRG; PAM sequence: CAG
gtatattattatgacagccc

SEQ ID NO: 38015 - DNA, 20 bp, Artificial Sequence
  Description of Artificial Sequence: Synthetic oligonucleotide
  Target: SCN9A; (+) strand; PAM type: NRG; PAM sequence: AAG
tatgacagccccagctttct

SEQ ID NO: 38016 - DNA, 20 bp, Artificial Sequence
  Description of Artificial Sequence: Synthetic oligonucleotide
  Target: SCN9A; (+) strand; PAM type: NRG; PAM sequence: TGG
acacaaaaatgataatactc

SEQ ID NO: 38017 - DNA, 20 bp, Artificial Sequence
  Description of Artificial Sequence: Synthetic oligonucleotide
  Target: SCN9A; (+) strand; PAM type: NRG; PAM sequence: AAG
ctggctcctgctattgcttt

SEQ ID NO: 38018 - DNA, 20 bp, Artificial Sequence
  Description of Artificial Sequence: Synthetic oligonucleotide
  Target: SCN9A; (+) strand; PAM type: NRG; PAM sequence: GAG
tattattatctctgactcct

SEQ ID NO: 38019 - DNA, 20 bp, Artificial Sequence
  Description of Artificial Sequence: Synthetic oligonucleotide
  Target: SCN9A; (+) strand; PAM type: NRG; PAM sequence: AAG
ctgagtctcatgtcttctgc

SEQ ID NO: 38020 - DNA, 20 bp, Artificial Sequence
  Description of Artificial Sequence: Synthetic oligonucleotide
  Target: SCN9A; (+) strand; PAM type: NRG; PAM sequence: AAG
tgcaagcatgtaacatgcta

SEQ ID NO: 38021 - DNA, 20 bp, Artificial Sequence
  Description of Artificial Sequence: Synthetic oligonucleotide
  Target: SCN9A; (+) strand; PAM type: NRG; PAM sequence: AAG
aaagtgaattatgttactct

SEQ ID NO: 38022 - DNA, 20 bp, Artificial Sequence
  Description of Artificial Sequence: Synthetic oligonucleotide
  Target: SCN9A; (+) strand; PAM type: NRG; PAM sequence: GAG
agtgaattatgttactctaa

SEQ ID NO: 38023 - DNA, 20 bp, Artificial Sequence
  Description of Artificial Sequence: Synthetic oligonucleotide
  Target: SCN9A; (+) strand; PAM type: NRG; PAM sequence: TAG
cttccttaaatgtattgaca

SEQ ID NO: 38024 - DNA, 20 bp, Artificial Sequence
  Description of Artificial Sequence: Synthetic oligonucleotide
  Target: SCN9A; (+) strand; PAM type: NRG; PAM sequence: TAG
atgttccaaatgaaacgttt

SEQ ID NO: 38025 - DNA, 20 bp, Artificial Sequence
  Description of Artificial Sequence: Synthetic oligonucleotide
  Target: SCN9A; (+) strand; PAM type: NRG; PAM sequence: AAG
ttccaaatgaaacgttttag

SEQ ID NO: 38026 - DNA, 20 bp, Artificial Sequence
  Description of Artificial Sequence: Synthetic oligonucleotide
  Target: SCN9A; (+) strand; PAM type: NRG; PAM sequence: TAG
gttttagaagacatttgctg

SEQ ID NO: 38027 - DNA, 20 bp, Artificial Sequence
  Description of Artificial Sequence: Synthetic oligonucleotide
  Target: SCN9A; (+) strand; PAM type: NRG; PAM sequence: TGG
acatttgctgtagattctct

SEQ ID NO: 38028 - DNA, 20 bp, Artificial Sequence
  Description of Artificial Sequence: Synthetic oligonucleotide
  Target: SCN9A; (+) strand; PAM type: NRG; PAM sequence: AAG
ttctcttggcctacatttta

SEQ ID NO: 38029 - DNA, 20 bp, Artificial Sequence
  Description of Artificial Sequence: Synthetic oligonucleotide
  Target: SCN9A; (+) strand; PAM type: NRG; PAM sequence: AGG
tctcttggcctacattttaa

SEQ ID NO: 38030 - DNA, 20 bp, Artificial Sequence
  Description of Artificial Sequence: Synthetic oligonucleotide
  Target: SCN9A; (+) strand; PAM type: NRG; PAM sequence: GAG
ggcctacattttaaaggcat

SEQ ID NO: 38031 - DNA, 20 bp, Artificial Sequence
  Description of Artificial Sequence: Synthetic oligonucleotide
  Target: SCN9A; (+) strand; PAM type: NRG; PAM sequence: TGG
ctacattttaaaggcatgag

SEQ ID NO: 38032 - DNA, 20 bp, Artificial Sequence
  Description of Artificial Sequence: Synthetic oligonucleotide
  Target: SCN9A; (+) strand; PAM type: NRG; PAM sequence: GGG
tacattttaaaggcatgagt

SEQ ID NO: 38033 - DNA, 20 bp, Artificial Sequence
  Description of Artificial Sequence: Synthetic oligonucleotide
  Target: SCN9A; (+) strand; PAM type: NRG; PAM sequence: AAG
tttaaaggcatgagtgggac

SEQ ID NO: 38034 - DNA, 20 bp, Artificial Sequence
  Description of Artificial Sequence: Synthetic oligonucleotide
  Target: SCN9A; (+) strand; PAM type: NRG; PAM sequence: CAG
tgagtgggacaagtatactt

SEQ ID NO: 38035 - DNA, 20 bp, Artificial Sequence
  Description of Artificial Sequence: Synthetic oligonucleotide
  Target: SCN9A; (+) strand; PAM type: NRG; PAM sequence: GAG
ttcagattctctttgacttt

SEQ ID NO: 38036 - DNA, 20 bp, Artificial Sequence
  Description of Artificial Sequence: Synthetic oligonucleotide
  Target: SCN9A; (+) strand; PAM type: NRG; PAM sequence: AAG
tgactttgagaaaattactt

SEQ ID NO: 38037 - DNA, 20 bp, Artificial Sequence
  Description of Artificial Sequence: Synthetic oligonucleotide
  Target: SCN9A; (+) strand; PAM type: NRG; PAM sequence: TGG
ttaagattgcccattttctt

SEQ ID NO: 38038 - DNA, 20 bp, Artificial Sequence
  Description of Artificial Sequence: Synthetic oligonucleotide
  Target: SCN9A; (+) strand; PAM type: NRG; PAM sequence: TGG
tgcccattttctttggcttc

SEQ ID NO: 38039 - DNA, 20 bp, Artificial Sequence
  Description of Artificial Sequence: Synthetic oligonucleotide
  Target: SCN9A; (+) strand; PAM type: NRG; PAM sequence: GGG
gcccattttctttggcttct

SEQ ID NO: 38040 - DNA, 20 bp, Artificial Sequence
  Description of Artificial Sequence: Synthetic oligonucleotide
  Target: SCN9A; (+) strand; PAM type: NRG; PAM sequence: AAG
gcttctgggtaaaaatttgt

SEQ ID NO: 38041 - DNA, 20 bp, Artificial Sequence
  Description of Artificial Sequence: Synthetic oligonucleotide
  Target: SCN9A; (+) strand; PAM type: NRG; PAM sequence: AGG
cttctgggtaaaaatttgta

SEQ ID NO: 38042 - DNA, 20 bp, Artificial Sequence
  Description of Artificial Sequence: Synthetic oligonucleotide
  Target: SCN9A; (+) strand; PAM type: NRG; PAM sequence: AAG
aatttgtaaggtgctttgcc

SEQ ID NO: 38043 - DNA, 20 bp, Artificial Sequence
  Description of Artificial Sequence: Synthetic oligonucleotide
  Target: SCN9A; (+) strand; PAM type: NRG; PAM sequence: AAG
taaggtgctttgccaagaat

SEQ ID NO: 38044 - DNA, 20 bp, Artificial Sequence
  Description of Artificial Sequence: Synthetic oligonucleotide
  Target: SCN9A; (+) strand; PAM type: NRG; PAM sequence: AGG
aaggtgctttgccaagaata

SEQ ID NO: 38045 - DNA, 20 bp, Artificial Sequence
  Description of Artificial Sequence: Synthetic oligonucleotide
  Target: SCN9A; (+) strand; PAM type: NRG; PAM sequence: TGG
caagaataaggtgcactgaa

SEQ ID NO: 38046 - DNA, 20 bp, Artificial Sequence
  Description of Artificial Sequence: Synthetic oligonucleotide
  Target: SCN9A; (+) strand; PAM type: NRG; PAM sequence: TAG
cactgaatggtaaacacgat

SEQ ID NO: 38047 - DNA, 20 bp, Artificial Sequence
  Description of Artificial Sequence: Synthetic oligonucleotide
  Target: SCN9A; (+) strand; PAM type: NRG; PAM sequence: AGG
actgaatggtaaacacgatt

SEQ ID NO: 38048 - DNA, 20 bp, Artificial Sequence
  Description of Artificial Sequence: Synthetic oligonucleotide
  Target: SCN9A; (+) strand; PAM type: NRG; PAM sequence: TAG
aatggtaaacacgattagga

SEQ ID NO: 38049 - DNA, 20 bp, Artificial Sequence
  Description of Artificial Sequence: Synthetic oligonucleotide
  Target: SCN9A; (+) strand; PAM type: NRG; PAM sequence: CAG
aacacgattaggatagtcaa

SEQ ID NO: 38050 - DNA, 20 bp, Artificial Sequence
  Description of Artificial Sequence: Synthetic oligonucleotide
  Target: SCN9A; (+) strand; PAM type: NRG; PAM sequence: AGG
acacgattaggatagtcaac

SEQ ID NO: 38051 - DNA, 20 bp, Artificial Sequence
  Description of Artificial Sequence: Synthetic oligonucleotide
  Target: SCN9A; (+) strand; PAM type: NRG; PAM sequence: GGG
cacgattaggatagtcaaca

SEQ ID NO: 38052 - DNA, 20 bp, Artificial Sequence
  Description of Artificial Sequence: Synthetic oligonucleotide
  Target: SCN9A; (+) strand; PAM type: NRG; PAM sequence: GAG
cgattaggatagtcaacagg

SEQ ID NO: 38053 - DNA, 20 bp, Artificial Sequence
  Description of Artificial Sequence: Synthetic oligonucleotide
  Target: SCN9A; (+) strand; PAM type: NRG; PAM sequence: AGG
gattaggatagtcaacaggg

SEQ ID NO: 38054 - DNA, 20 bp, Artificial Sequence
  Description of Artificial Sequence: Synthetic oligonucleotide
  Target: SCN9A; (+) strand; PAM type: NRG; PAM sequence: AAG
tcctcctttaaatttttgat

SEQ ID NO: 38055 - DNA, 20 bp, Artificial Sequence
  Description of Artificial Sequence: Synthetic oligonucleotide
  Target: SCN9A; (+) strand; PAM type: NRG; PAM sequence: CAG
ttaacatttgctttctacat

SEQ ID NO: 38056 - DNA, 20 bp, Artificial Sequence
  Description of Artificial Sequence: Synthetic oligonucleotide
  Target: SCN9A; (+) strand; PAM type: NRG; PAM sequence: CGG
ctttctacatcagtcttttg

SEQ ID NO: 38057 - DNA, 20 bp, Artificial Sequence
  Description of Artificial Sequence: Synthetic oligonucleotide
  Target: SCN9A; (+) strand; PAM type: NRG; PAM sequence: GGG
tttctacatcagtcttttgc

SEQ ID NO: 38058 - DNA, 20 bp, Artificial Sequence
  Description of Artificial Sequence: Synthetic oligonucleotide
  Target: SCN9A; (+) strand; PAM type: NRG; PAM sequence: GAG
tacatcagtcttttgcgggc

SEQ ID NO: 38059 - DNA, 20 bp, Artificial Sequence
  Description of Artificial Sequence: Synthetic oligonucleotide
  Target: SCN9A; (+) strand; PAM type: NRG; PAM sequence: CAG
cagtcttttgcgggcgagat

SEQ ID NO: 38060 - DNA, 20 bp, Artificial Sequence
  Description of Artificial Sequence: Synthetic oligonucleotide
  Target: SCN9A; (+) strand; PAM type: NRG; PAM sequence: CAG
agtgtgccaaactgtctcac

SEQ ID NO: 38061 - DNA, 20 bp, Artificial Sequence
  Description of Artificial Sequence: Synthetic oligonucleotide
  Target: SCN9A; (+) strand; PAM type: NRG; PAM sequence: CAG
tccctctctttttacctcca

SEQ ID NO: 38062 - DNA, 20 bp, Artificial Sequence
  Description of Artificial Sequence: Synthetic oligonucleotide
  Target: SCN9A; (+) strand; PAM type: NRG; PAM sequence: GAG
tttacctccacagtctgtat

SEQ ID NO: 38063 - DNA, 20 bp, Artificial Sequence
  Description of Artificial Sequence: Synthetic oligonucleotide
  Target: SCN9A; (+) strand; PAM type: NRG; PAM sequence: TGG
acagtctgtatgagccattg

SEQ ID NO: 38064 - DNA, 20 bp, Artificial Sequence
  Description of Artificial Sequence: Synthetic oligonucleotide
  Target: SCN9A; (+) strand; PAM type: NRG; PAM sequence: TAG
gtttgataaaataacctttc

SEQ ID NO: 38065 - DNA, 20 bp, Artificial Sequence
  Description of Artificial Sequence: Synthetic oligonucleotide
  Target: SCN9A; (+) strand; PAM type: NRG; PAM sequence: TAG
tgataaaataacctttctag

SEQ ID NO: 38066 - DNA, 20 bp, Artificial Sequence
  Description of Artificial Sequence: Synthetic oligonucleotide
  Target: SCN9A; (+) strand; PAM type: NRG; PAM sequence: TGG
tctgtatttctaccttaaca

SEQ ID NO: 38067 - DNA, 20 bp, Artificial Sequence
  Description of Artificial Sequence: Synthetic oligonucleotide
  Target: SCN9A; (+) strand; PAM type: NRG; PAM sequence: TGG
tctaccttaacatggtacat

SEQ ID NO: 38068 - DNA, 20 bp, Artificial Sequence
  Description of Artificial Sequence: Synthetic oligonucleotide
  Target: SCN9A; (+) strand; PAM type: NRG; PAM sequence: CAG
taacatggtacattggaaaa

SEQ ID NO: 38069 - DNA, 20 bp, Artificial Sequence
  Description of Artificial Sequence: Synthetic oligonucleotide
  Target: SCN9A; (+) strand; PAM type: NRG; PAM sequence: AGG
aacatggtacattggaaaac

SEQ ID NO: 38070 - DNA, 20 bp, Artificial Sequence
  Description of Artificial Sequence: Synthetic oligonucleotide
  Target: SCN9A; (+) strand; PAM type: NRG; PAM sequence: GAG
catggtacattggaaaacag

SEQ ID NO: 38071 - DNA, 20 bp, Artificial Sequence
  Description of Artificial Sequence: Synthetic oligonucleotide
  Target: SCN9A; (+) strand; PAM type: NRG; PAM sequence: TAG
gtaacaaatgatcacaaatt

SEQ ID NO: 38072 - DNA, 20 bp, Artificial Sequence
  Description of Artificial Sequence: Synthetic oligonucleotide
  Target: SCN9A; (+) strand; PAM type: NRG; PAM sequence: CAG
acaaatgatcacaaatttag

SEQ ID NO: 38073 - DNA, 20 bp, Artificial Sequence
  Description of Artificial Sequence: Synthetic oligonucleotide
  Target: SCN9A; (+) strand; PAM type: NRG; PAM sequence: GAG
tattatctcacaatttttgt

SEQ ID NO: 38074 - DNA, 20 bp, Artificial Sequence
  Description of Artificial Sequence: Synthetic oligonucleotide
  Target: SCN9A; (+) strand; PAM type: NRG; PAM sequence: AGG
attatctcacaatttttgtg

SEQ ID NO: 38075 - DNA, 20 bp, Artificial Sequence
  Description of Artificial Sequence: Synthetic oligonucleotide
  Target: SCN9A; (+) strand; PAM type: NRG; PAM sequence: CAG
atctcacaatttttgtgagg

SEQ ID NO: 38076 - DNA, 20 bp, Artificial Sequence
  Description of Artificial Sequence: Synthetic oligonucleotide
  Target: SCN9A; (+) strand; PAM type: NRG; PAM sequence: AGG
tctcacaatttttgtgaggc

SEQ ID NO: 38077 - DNA, 20 bp, Artificial Sequence
  Description of Artificial Sequence: Synthetic oligonucleotide
  Target: SCN9A; (+) strand; PAM type: NRG; PAM sequence: GAG
tcacaatttttgtgaggcag

SEQ ID NO: 38078 - DNA, 20 bp, Artificial Sequence
  Description of Artificial Sequence: Synthetic oligonucleotide
  Target: SCN9A; (+) strand; PAM type: NRG; PAM sequence: TGG
atttttgtgaggcaggagcc

SEQ ID NO: 38079 - DNA, 20 bp, Artificial Sequence
  Description of Artificial Sequence: Synthetic oligonucleotide
  Target: SCN9A; (+) strand; PAM type: NRG; PAM sequence: GGG
tttttgtgaggcaggagcct

SEQ ID NO: 38080 - DNA, 20 bp, Artificial Sequence
  Description of Artificial Sequence: Synthetic oligonucleotide
  Target: SCN9A; (+) strand; PAM type: NRG; PAM sequence: TAG
gtgaggcaggagcctgggta

SEQ ID NO: 38081 - DNA, 20 bp, Artificial Sequence
  Description of Artificial Sequence: Synthetic oligonucleotide
  Target: SCN9A; (+) strand; PAM type: NRG; PAM sequence: AAG
agttatctgtgttttgtata

SEQ ID NO: 38082 - DNA, 20 bp, Artificial Sequence
  Description of Artificial Sequence: Synthetic oligonucleotide
  Target: SCN9A; (+) strand; PAM type: NRG; PAM sequence: TAG
acttattttttctgttctgt

SEQ ID NO: 38083 - DNA, 20 bp, Artificial Sequence
  Description of Artificial Sequence: Synthetic oligonucleotide
  Target: SCN9A; (+) strand; PAM type: NRG; PAM sequence: AAG
tattttttctgttctgttag

SEQ ID NO: 38084 - DNA, 20 bp, Artificial Sequence
  Description of Artificial Sequence: Synthetic oligonucleotide
  Target: SCN9A; (+) strand; PAM type: NRG; PAM sequence: AGG
attttttctgttctgttaga

SEQ ID NO: 38085 - DNA, 20 bp, Artificial Sequence
  Description of Artificial Sequence: Synthetic oligonucleotide
  Target: SCN9A; (+) strand; PAM type: NRG; PAM sequence: TAG
tctgttctgttagaaggaat

SEQ ID NO: 38086 - DNA, 20 bp, Artificial Sequence
  Description of Artificial Sequence: Synthetic oligonucleotide
  Target: SCN9A; (+) strand; PAM type: NRG; PAM sequence: CAG
tagaaggaattagtgtatca

SEQ ID NO: 38087 - DNA, 20 bp, Artificial Sequence
  Description of Artificial Sequence: Synthetic oligonucleotide
  Target: SCN9A; (+) strand; PAM type: NRG; PAM sequence: TGG
aggaattagtgtatcacagt

SEQ ID NO: 38088 - DNA, 20 bp, Artificial Sequence
  Description of Artificial Sequence: Synthetic oligonucleotide
  Target: SCN9A; (+) strand; PAM type: NRG; PAM sequence: GAG
tttatatccttttcttatat

SEQ ID NO: 38089 - DNA, 20 bp, Artificial Sequence
  Description of Artificial Sequence: Synthetic oligonucleotide
  Target: SCN9A; (+) strand; PAM type: NRG; PAM sequence: AAG
tatccttttcttatatgagc

SEQ ID NO: 38090 - DNA, 20 bp, Artificial Sequence
  Description of Artificial Sequence: Synthetic oligonucleotide
  Target: SCN9A; (+) strand; PAM type: NRG; PAM sequence: GAG
attctttctcatataaaaat

SEQ ID NO: 38091 - DNA, 20 bp, Artificial Sequence
  Description of Artificial Sequence: Synthetic oligonucleotide
  Target: SCN9A; (+) strand; PAM type: NRG; PAM sequence: CAG
ctttctcatataaaaatgag

SEQ ID NO: 38092 - DNA, 20 bp, Artificial Sequence
  Description of Artificial Sequence: Synthetic oligonucleotide
  Target: SCN9A; (+) strand; PAM type: NRG; PAM sequence: AAG
tataaaaatgagcagttctc

SEQ ID NO: 38093 - DNA, 20 bp, Artificial Sequence
  Description of Artificial Sequence: Synthetic oligonucleotide
  Target: SCN9A; (+) strand; PAM type: NRG; PAM sequence: GAG
taaaaatgagcagttctcaa

SEQ ID NO: 38094 - DNA, 20 bp, Artificial Sequence
  Description of Artificial Sequence: Synthetic oligonucleotide
  Target: SCN9A; (+) strand; PAM type: NRG; PAM sequence: TAG
aaatgagcagttctcaagag

SEQ ID NO: 38095 - DNA, 20 bp, Artificial Sequence
  Description of Artificial Sequence: Synthetic oligonucleotide
  Target: SCN9A; (+) strand; PAM type: NRG; PAM sequence: AAG
gcagttctcaagagtagcct

SEQ ID NO: 38096 - DNA, 20 bp, Artificial Sequence
  Description of Artificial Sequence: Synthetic oligonucleotide
  Target: SCN9A; (+) strand; PAM type: NRG; PAM sequence: CAG
tctcaagagtagcctaagaa

SEQ ID NO: 38097 - DNA, 20 bp, Artificial Sequence
  Description of Artificial Sequence: Synthetic oligonucleotide
  Target: SCN9A; (+) strand; PAM type: NRG; PAM sequence: AGG
ctcaagagtagcctaagaac

SEQ ID NO: 38098 - DNA, 20 bp, Artificial Sequence
  Description of Artificial Sequence: Synthetic oligonucleotide
  Target: SCN9A; (+) strand; PAM type: NRG; PAM sequence: GAG
caagagtagcctaagaacag

SEQ ID NO: 38099 - DNA, 20 bp, Artificial Sequence
  Description of Artificial Sequence: Synthetic oligonucleotide
  Target: SCN9A; (+) strand; PAM type: NRG; PAM sequence: AAG
agtagcctaagaacaggaga

SEQ ID NO: 38100 - DNA, 20 bp, Artificial Sequence
  Description of Artificial Sequence: Synthetic oligonucleotide
  Target: SCN9A; (+) strand; PAM type: NRG; PAM sequence: CAG
tttaacatattgtcaatgta

SEQ ID NO: 38101 - DNA, 20 bp, Artificial Sequence
  Description of Artificial Sequence: Synthetic oligonucleotide
  Target: SCN9A; (+) strand; PAM type: NRG; PAM sequence: GAG
taacatattgtcaatgtaca

SEQ ID NO: 38102 - DNA, 20 bp, Artificial Sequence
  Description of Artificial Sequence: Synthetic oligonucleotide
  Target: SCN9A; (+) strand; PAM type: NRG; PAM sequence: TAG
catattgtcaatgtacagag

SEQ ID NO: 38103 - DNA, 20 bp, Artificial Sequence
  Description of Artificial Sequence: Synthetic oligonucleotide
  Target: SCN9A; (+) strand; PAM type: NRG; PAM sequence: AAG
attgtcaatgtacagagtag

SEQ ID NO: 38104 - DNA, 20 bp, Artificial Sequence
  Description of Artificial Sequence: Synthetic oligonucleotide
  Target: SCN9A; (+) strand; PAM type: NRG; PAM sequence: AAG
atgtacagagtagaagacac

SEQ ID NO: 38105 - DNA, 20 bp, Artificial Sequence
  Description of Artificial Sequence: Synthetic oligonucleotide
  Target: SCN9A; (+) strand; PAM type: NRG; PAM sequence: AAG
tagaagacacaagatattta

SEQ ID NO: 38106 - DNA, 20 bp, Artificial Sequence
  Description of Artificial Sequence: Synthetic oligonucleotide
  Target: SCN9A; (+) strand; PAM type: NRG; PAM sequence: GAG
gaagacacaagatatttaaa

SEQ ID NO: 38107 - DNA, 20 bp, Artificial Sequence
  Description of Artificial Sequence: Synthetic oligonucleotide
  Target: SCN9A; (+) strand; PAM type: NRG; PAM sequence: GAG
agacacaagatatttaaaga

SEQ ID NO: 38108 - DNA, 20 bp, Artificial Sequence
  Description of Artificial Sequence: Synthetic oligonucleotide
  Target: SCN9A; (+) strand; PAM type: NRG; PAM sequence: TGG
atatttaaagagagtaaatc

SEQ ID NO: 38109 - DNA, 20 bp, Artificial Sequence
  Description of Artificial Sequence: Synthetic oligonucleotide
  Target: SCN9A; (+) strand; PAM type: NRG; PAM sequence: GAG
atttaaagagagtaaatctg

SEQ ID NO: 38110 - DNA, 20 bp, Artificial Sequence
  Description of Artificial Sequence: Synthetic oligonucleotide
  Target: SCN9A; (+) strand; PAM type: NRG; PAM sequence: AGG
tttaaagagagtaaatctgg

SEQ ID NO: 38111 - DNA, 20 bp, Artificial Sequence
  Description of Artificial Sequence: Synthetic oligonucleotide
  Target: SCN9A; (+) strand; PAM type: NRG; PAM sequence: CAG
gagtaaatctggaggctcct

SEQ ID NO: 38112 - DNA, 20 bp, Artificial Sequence
  Description of Artificial Sequence: Synthetic oligonucleotide
  Target: SCN9A; (+) strand; PAM type: NRG; PAM sequence: AAG
atctggaggctcctcagatg

SEQ ID NO: 38113 - DNA, 20 bp, Artificial Sequence
  Description of Artificial Sequence: Synthetic oligonucleotide
  Target: SCN9A; (+) strand; PAM type: NRG; PAM sequence: AGG
tctggaggctcctcagatga

SEQ ID NO: 38114 - DNA, 20 bp, Artificial Sequence
  Description of Artificial Sequence: Synthetic oligonucleotide
  Target: SCN9A; (+) strand; PAM type: NRG; PAM sequence: GGG
ctggaggctcctcagatgaa

SEQ ID NO: 38115 - DNA, 20 bp, Artificial Sequence
  Description of Artificial Sequence: Synthetic oligonucleotide
  Target: SCN9A; (+) strand; PAM type: NRG; PAM sequence: CAG
aggctcctcagatgaagggc

SEQ ID NO: 38116 - DNA, 20 bp, Artificial Sequence
  Description of Artificial Sequence: Synthetic oligonucleotide
  Target: SCN9A; (+) strand; PAM type: NRG; PAM sequence: AAG
tcagatgaagggccagccat

SEQ ID NO: 38117 - DNA, 20 bp, Artificial Sequence
  Description of Artificial Sequence: Synthetic oligonucleotide
  Target: SCN9A; (+) strand; PAM type: NRG; PAM sequence: AAG
gaagggccagccataagtaa

SEQ ID NO: 38118 - DNA, 20 bp, Artificial Sequence
  Description of Artificial Sequence: Synthetic oligonucleotide
  Target: SCN9A; (+) strand; PAM type: NRG; PAM sequence: AAG
taaaagaatgtatttgttta

SEQ ID NO: 38119 - DNA, 20 bp, Artificial Sequence
  Description of Artificial Sequence: Synthetic oligonucleotide
  Target: SCN9A; (+) strand; PAM type: NRG; PAM sequence: CAG
aagaatgtatttgtttaaag

SEQ ID NO: 38120 - DNA, 20 bp, Artificial Sequence
  Description of Artificial Sequence: Synthetic oligonucleotide
  Target: SCN9A; (+) strand; PAM type: NRG; PAM sequence: CAG
taaagcagcacatgcaaatc

SEQ ID NO: 38121 - DNA, 20 bp, Artificial Sequence
  Description of Artificial Sequence: Synthetic oligonucleotide
  Target: SCN9A; (+) strand; PAM type: NRG; PAM sequence: TAG
agattatgttctcacatatt

SEQ ID NO: 38122 - DNA, 20 bp, Artificial Sequence
  Description of Artificial Sequence: Synthetic oligonucleotide
  Target: SCN9A; (+) strand; PAM type: NRG; PAM sequence: TAG
tgttctcacatatttagaaa

SEQ ID NO: 38123 - DNA, 20 bp, Artificial Sequence
  Description of Artificial Sequence: Synthetic oligonucleotide
  Target: SCN9A; (+) strand; PAM type: NRG; PAM sequence: TGG
atttagaaatagtaatttaa

SEQ ID NO: 38124 - DNA, 20 bp, Artificial Sequence
  Description of Artificial Sequence: Synthetic oligonucleotide
  Target: SCN9A; (+) strand; PAM type: NRG; PAM sequence: GGG
tttagaaatagtaatttaat

SEQ ID NO: 38125 - DNA, 20 bp, Artificial Sequence
  Description of Artificial Sequence: Synthetic oligonucleotide
  Target: SCN9A; (+) strand; PAM type: NRG; PAM sequence: GAG
tagaaatagtaatttaatgg

SEQ ID NO: 38126 - DNA, 20 bp, Artificial Sequence
  Description of Artificial Sequence: Synthetic oligonucleotide
  Target: SCN9A; (+) strand; PAM type: NRG; PAM sequence: TGG
agtgtattcttaatattcac

SEQ ID NO: 38127 - DNA, 20 bp, Artificial Sequence
  Description of Artificial Sequence: Synthetic oligonucleotide
  Target: SCN9A; (+) strand; PAM type: NRG; PAM sequence: TGG
aaaataaaaatgaattatga

SEQ ID NO: 38128 - DNA, 20 bp, Artificial Sequence
  Description of Artificial Sequence: Synthetic oligonucleotide
  Target: SCN9A; (+) strand; PAM type: NRG; PAM sequence: TAG
aatgaattatgatggtatat

SEQ ID NO: 38129 - DNA, 20 bp, Artificial Sequence
  Description of Artificial Sequence: Synthetic oligonucleotide
  Target: SCN9A; (+) strand; PAM type: NRG; PAM sequence: GAG
tgaattatgatggtatatta

SEQ ID NO: 38130 - DNA, 20 bp, Artificial Sequence
  Description of Artificial Sequence: Synthetic oligonucleotide
  Target: SCN9A; (+) strand; PAM type: NRG; PAM sequence: AAG
attatgatggtatattagag

SEQ ID NO: 38131 - DNA, 20 bp, Artificial Sequence
  Description of Artificial Sequence: Synthetic oligonucleotide
  Target: SCN9A; (+) strand; PAM type: NRG; PAM sequence: TAG
agagaagaattatattttta

SEQ ID NO: 38132 - DNA, 20 bp, Artificial Sequence
  Description of Artificial Sequence: Synthetic oligonucleotide
  Target: SCN9A; (+) strand; PAM type: NRG; PAM sequence: AAG
aagaattatatttttataga

SEQ ID NO: 38133 - DNA, 20 bp, Artificial Sequence
  Description of Artificial Sequence: Synthetic oligonucleotide
  Target: SCN9A; (+) strand; PAM type: NRG; PAM sequence: AAG
aatatgactgaactaacttg

SEQ ID NO: 38134 - DNA, 20 bp, Artificial Sequence
  Description of Artificial Sequence: Synthetic oligonucleotide
  Target: SCN9A; (+) strand; PAM type: NRG; PAM sequence: TAG
cttgaagacatattgttttg

SEQ ID NO: 38135 - DNA, 20 bp, Artificial Sequence
  Description of Artificial Sequence: Synthetic oligonucleotide
  Target: SCN9A; (+) strand; PAM type: NRG; PAM sequence: AGG
ttgaagacatattgttttgt

SEQ ID NO: 38136 - DNA, 20 bp, Artificial Sequence
  Description of Artificial Sequence: Synthetic oligonucleotide
  Target: SCN9A; (+) strand; PAM type: NRG; PAM sequence: TAG
gtaggaaataaaataaaaac

SEQ ID NO: 38137 - DNA, 20 bp, Artificial Sequence
  Description of Artificial Sequence: Synthetic oligonucleotide
  Target: SCN9A; (+) strand; PAM type: NRG; PAM sequence: AGG
taggaaataaaataaaaact

SEQ ID NO: 38138 - DNA, 20 bp, Artificial Sequence
  Description of Artificial Sequence: Synthetic oligonucleotide
  Target: SCN9A; (+) strand; PAM type: NRG; PAM sequence: CAG
aaataaaaactaggtcatgc

SEQ ID NO: 38139 - DNA, 20 bp, Artificial Sequence
  Description of Artificial Sequence: Synthetic oligonucleotide
  Target: SCN9A; (+) strand; PAM type: NRG; PAM sequence: CAG
acttacgaataacttttgct

SEQ ID NO: 38140 - DNA, 20 bp, Artificial Sequence
  Description of Artificial Sequence: Synthetic oligonucleotide
  Target: SCN9A; (+) strand; PAM type: NRG; PAM sequence: TAG
taacttttgctcagttctac

SEQ ID NO: 38141 - DNA, 20 bp, Artificial Sequence
  Description of Artificial Sequence: Synthetic oligonucleotide
  Target: SCN9A; (+) strand; PAM type: NRG; PAM sequence: AAG
agatttgcaaaatttttaac

SEQ ID NO: 38142 - DNA, 20 bp, Artificial Sequence
  Description of Artificial Sequence: Synthetic oligonucleotide
  Target: SCN9A; (+) strand; PAM type: NRG; PAM sequence: AAG
gcttttatcttttgtttcta

SEQ ID NO: 38143 - DNA, 20 bp, Artificial Sequence
  Description of Artificial Sequence: Synthetic oligonucleotide
  Target: SCN9A; (+) strand; PAM type: NRG; PAM sequence: AAG
tttctaaagatatatttaaa

SEQ ID NO: 38144 - DNA, 20 bp, Artificial Sequence
  Description of Artificial Sequence: Synthetic oligonucleotide
  Target: SCN9A; (+) strand; PAM type: NRG; PAM sequence: AAG
agatatatttaaaaagattc

SEQ ID NO: 38145 - DNA, 20 bp, Artificial Sequence
  Description of Artificial Sequence: Synthetic oligonucleotide
  Target: SCN9A; (+) strand; PAM type: NRG; PAM sequence: AAG
atttaaaaagattcaagcta

SEQ ID NO: 38146 - DNA, 20 bp, Artificial Sequence
  Description of Artificial Sequence: Synthetic oligonucleotide
  Target: SCN9A; (+) strand; PAM type: NRG; PAM sequence: CAG
caagctaaagtgcaatgatg

SEQ ID NO: 38147 - DNA, 20 bp, Artificial Sequence
  Description of Artificial Sequence: Synthetic oligonucleotide
  Target: SCN9A; (+) strand; PAM type: NRG; PAM sequence: CAG
ctcttcaaattaccttttcg

SEQ ID NO: 38148 - DNA, 20 bp, Artificial Sequence
  Description of Artificial Sequence: Synthetic oligonucleotide
  Target: SCN9A; (+) strand; PAM type: NRG; PAM sequence: CAG
tcaaattaccttttcgcaga

SEQ ID NO: 38149 - DNA, 20 bp, Artificial Sequence
  Description of Artificial Sequence: Synthetic oligonucleotide
  Target: SCN9A; (+) strand; PAM type: NRG; PAM sequence: TAG
agacagatcaattattaatg

SEQ ID NO: 38150 - DNA, 20 bp, Artificial Sequence
  Description of Artificial Sequence: Synthetic oligonucleotide
  Target: SCN9A; (+) strand; PAM type: NRG; PAM sequence: AGG
gacagatcaattattaatgt

SEQ ID NO: 38151 - DNA, 20 bp, Artificial Sequence
  Description of Artificial Sequence: Synthetic oligonucleotide
  Target: SCN9A; (+) strand; PAM type: NRG; PAM sequence: TGG
atcaattattaatgtaggta

SEQ ID NO: 38152 - DNA, 20 bp, Artificial Sequence
  Description of Artificial Sequence: Synthetic oligonucleotide
  Target: SCN9A; (+) strand; PAM type: NRG; PAM sequence: CAG
attaatgtaggtatggctcg

SEQ ID NO: 38153 - DNA, 20 bp, Artificial Sequence
  Description of Artificial Sequence: Synthetic oligonucleotide
  Target: SCN9A; (+) strand; PAM type: NRG; PAM sequence: GAG
taatgtaggtatggctcgca

SEQ ID NO: 38154 - DNA, 20 bp, Artificial Sequence
  Description of Artificial Sequence: Synthetic oligonucleotide
  Target: SCN9A; (+) strand; PAM type: NRG; PAM sequence: TAG
aggtatggctcgcagagtaa

SEQ ID NO: 38155 - DNA, 20 bp, Artificial Sequence
  Description of Artificial Sequence: Synthetic oligonucleotide
  Target: SCN9A; (+) strand; PAM type: NRG; PAM sequence: AGG
ggtatggctcgcagagtaat

SEQ ID NO: 38156 - DNA, 20 bp, Artificial Sequence
  Description of Artificial Sequence: Synthetic oligonucleotide
  Target: SCN9A; (+) strand; PAM type: NRG; PAM sequence: GGG
gtatggctcgcagagtaata

SEQ ID NO: 38157 - DNA, 20 bp, Artificial Sequence
  Description of Artificial Sequence: Synthetic oligonucleotide
  Target: SCN9A; (+) strand; PAM type: NRG; PAM sequence: GAG
atggctcgcagagtaatagg

SEQ ID NO: 38158 - DNA, 20 bp, Artificial Sequence
  Description of Artificial Sequence: Synthetic oligonucleotide
  Target: SCN9A; (+) strand; PAM type: NRG; PAM sequence: AAG
tcgcagagtaatagggagtc

SEQ ID NO: 38159 - DNA, 20 bp, Artificial Sequence
  Description of Artificial Sequence: Synthetic oligonucleotide
  Target: SCN9A; (+) strand; PAM type: NRG; PAM sequence: AAG
gagtaatagggagtcaagct

SEQ ID NO: 38160 - DNA, 20 bp, Artificial Sequence
  Description of Artificial Sequence: Synthetic oligonucleotide
  Target: SCN9A; (+) strand; PAM type: NRG; PAM sequence: TAG
atagggagtcaagctaagtg

SEQ ID NO: 38161 - DNA, 20 bp, Artificial Sequence
  Description of Artificial Sequence: Synthetic oligonucleotide
  Target: SCN9A; (+) strand; PAM type: NRG; PAM sequence: GAG
tcaagctaagtgtagcatgt

SEQ ID NO: 38162 - DNA, 20 bp, Artificial Sequence
  Description of Artificial Sequence: Synthetic oligonucleotide
  Target: SCN9A; (+) strand; PAM type: NRG; PAM sequence: CAG
gtgtgcatcaaatactattg

SEQ ID NO: 38163 - DNA, 20 bp, Artificial Sequence
  Description of Artificial Sequence: Synthetic oligonucleotide
  Target: SCN9A; (+) strand; PAM type: NRG; PAM sequence: TAG
cagcaaaatcccctctgctc

SEQ ID NO: 38164 - DNA, 20 bp, Artificial Sequence
  Description of Artificial Sequence: Synthetic oligonucleotide
  Target: SCN9A; (+) strand; PAM type: NRG; PAM sequence: TAG
aaaatcccctctgctctagc

SEQ ID NO: 38165 - DNA, 20 bp, Artificial Sequence
  Description of Artificial Sequence: Synthetic oligonucleotide
  Target: SCN9A; (+) strand; PAM type: NRG; PAM sequence: GAG
atgtaatttctccctccctt

SEQ ID NO: 38166 - DNA, 20 bp, Artificial Sequence
  Description of Artificial Sequence: Synthetic oligonucleotide
  Target: SCN9A; (+) strand; PAM type: NRG; PAM sequence: GAG
gtaatttctccctcccttga

SEQ ID NO: 38167 - DNA, 20 bp, Artificial Sequence
  Description of Artificial Sequence: Synthetic oligonucleotide
  Target: SCN9A; (+) strand; PAM type: NRG; PAM sequence: GAG
aatttctccctcccttgaga

SEQ ID NO: 38168 - DNA, 20 bp, Artificial Sequence
  Description of Artificial Sequence: Synthetic oligonucleotide
  Target: SCN9A; (+) strand; PAM type: NRG; PAM sequence: CAG
agagattaccatgtatcctg

SEQ ID NO: 38169 - DNA, 20 bp, Artificial Sequence
  Description of Artificial Sequence: Synthetic oligonucleotide
  Target: SCN9A; (+) strand; PAM type: NRG; PAM sequence: TGG
atcctgcagctcattttgct

SEQ ID NO: 38170 - DNA, 20 bp, Artificial Sequence
  Description of Artificial Sequence: Synthetic oligonucleotide
  Target: SCN9A; (+) strand; PAM type: NRG; PAM sequence: GGG
tcctgcagctcattttgctt

SEQ ID NO: 38171 - DNA, 20 bp, Artificial Sequence
  Description of Artificial Sequence: Synthetic oligonucleotide
  Target: SCN9A; (+) strand; PAM type: NRG; PAM sequence: TGG
agctcattttgcttgggtta

SEQ ID NO: 38172 - DNA, 20 bp, Artificial Sequence
  Description of Artificial Sequence: Synthetic oligonucleotide
  Target: SCN9A; (+) strand; PAM type: NRG; PAM sequence: TAG
attttgcttgggttatggca

SEQ ID NO: 38173 - DNA, 20 bp, Artificial Sequence
  Description of Artificial Sequence: Synthetic oligonucleotide
  Target: SCN9A; (+) strand; PAM type: NRG; PAM sequence: AAG
tagcattatctacaatgtga

SEQ ID NO: 38174 - DNA, 20 bp, Artificial Sequence
  Description of Artificial Sequence: Synthetic oligonucleotide
  Target: SCN9A; (+) strand; PAM type: NRG; PAM sequence: TAG
atctacaatgtgaaagaatt

SEQ ID NO: 38175 - DNA, 20 bp, Artificial Sequence
  Description of Artificial Sequence: Synthetic oligonucleotide
  Target: SCN9A; (+) strand; PAM type: NRG; PAM sequence: TGG
cacaatcacttatgttgaaa

SEQ ID NO: 38176 - DNA, 20 bp, Artificial Sequence
  Description of Artificial Sequence: Synthetic oligonucleotide
  Target: SCN9A; (+) strand; PAM type: NRG; PAM sequence: CAG
acttatgttgaaatggatta

SEQ ID NO: 38177 - DNA, 20 bp, Artificial Sequence
  Description of Artificial Sequence: Synthetic oligonucleotide
  Target: SCN9A; (+) strand; PAM type: NRG; PAM sequence: CAG
aaatggattacagtattatt

SEQ ID NO: 38178 - DNA, 20 bp, Artificial Sequence
  Description of Artificial Sequence: Synthetic oligonucleotide
  Target: SCN9A; (+) strand; PAM type: NRG; PAM sequence: CAG
gtgattataattctattttg

SEQ ID NO: 38179 - DNA, 20 bp, Artificial Sequence
  Description of Artificial Sequence: Synthetic oligonucleotide
  Target: SCN9A; (+) strand; PAM type: NRG; PAM sequence: GAG
gattataattctattttgca

SEQ ID NO: 38180 - DNA, 20 bp, Artificial Sequence
  Description of Artificial Sequence: Synthetic oligonucleotide
  Target: SCN9A; (+) strand; PAM type: NRG; PAM sequence: TGG
tataattctattttgcagag

SEQ ID NO: 38181 - DNA, 20 bp, Artificial Sequence
  Description of Artificial Sequence: Synthetic oligonucleotide
  Target: SCN9A; (+) strand; PAM type: NRG; PAM sequence: CAG
agagtggctattgcaactat

SEQ ID NO: 38182 - DNA, 20 bp, Artificial Sequence
  Description of Artificial Sequence: Synthetic oligonucleotide
  Target: SCN9A; (+) strand; PAM type: NRG; PAM sequence: AAG
tattgcaactatcagtacaa

SEQ ID NO: 38183 - DNA, 20 bp, Artificial Sequence
  Description of Artificial Sequence: Synthetic oligonucleotide
  Target: SCN9A; (+) strand; PAM type: NRG; PAM sequence: AAG
actatcagtacaaaagtccc

SEQ ID NO: 38184 - DNA, 20 bp, Artificial Sequence
  Description of Artificial Sequence: Synthetic oligonucleotide
  Target: SCN9A; (+) strand; PAM type: NRG; PAM sequence: AGG
ctatcagtacaaaagtccca

SEQ ID NO: 38185 - DNA, 20 bp, Artificial Sequence
  Description of Artificial Sequence: Synthetic oligonucleotide
  Target: SCN9A; (+) strand; PAM type: NRG; PAM sequence: AAG
tacaccttttacatgctatt

SEQ ID NO: 38186 - DNA, 20 bp, Artificial Sequence
  Description of Artificial Sequence: Synthetic oligonucleotide
  Target: SCN9A; (+) strand; PAM type: NRG; PAM sequence: AAG
atgctattaagataacataa

SEQ ID NO: 38187 - DNA, 20 bp, Artificial Sequence
  Description of Artificial Sequence: Synthetic oligonucleotide
  Target: SCN9A; (+) strand; PAM type: NRG; PAM sequence: TGG
taacataaaagttgaaataa

SEQ ID NO: 38188 - DNA, 20 bp, Artificial Sequence
  Description of Artificial Sequence: Synthetic oligonucleotide
  Target: SCN9A; (+) strand; PAM type: NRG; PAM sequence: TAG
taaaagttgaaataatggcc

SEQ ID NO: 38189 - DNA, 20 bp, Artificial Sequence
  Description of Artificial Sequence: Synthetic oligonucleotide
  Target: SCN9A; (+) strand; PAM type: NRG; PAM sequence: TGG
gttgaaataatggcctagta

SEQ ID NO: 38190 - DNA, 20 bp, Artificial Sequence
  Description of Artificial Sequence: Synthetic oligonucleotide
  Target: SCN9A; (+) strand; PAM type: NRG; PAM sequence: TAG
cctagtatggcaattatttt

SEQ ID NO: 38191 - DNA, 20 bp, Artificial Sequence
  Description of Artificial Sequence: Synthetic oligonucleotide
  Target: SCN9A; (+) strand; PAM type: NRG; PAM sequence: CAG
tcttacctaatgaccatcaa

SEQ ID NO: 38192 - DNA, 20 bp, Artificial Sequence
  Description of Artificial Sequence: Synthetic oligonucleotide
  Target: SCN9A; (+) strand; PAM type: NRG; PAM sequence: AGG
cttacctaatgaccatcaac

SEQ ID NO: 38193 - DNA, 20 bp, Artificial Sequence
  Description of Artificial Sequence: Synthetic oligonucleotide
  Target: SCN9A; (+) strand; PAM type: NRG; PAM sequence: TAG
tcaacaggacttgatgctta

SEQ ID NO: 38194 - DNA, 20 bp, Artificial Sequence
  Description of Artificial Sequence: Synthetic oligonucleotide
  Target: SCN9A; (+) strand; PAM type: NRG; PAM sequence: AAG
ggacttgatgcttatagcta

SEQ ID NO: 38195 - DNA, 20 bp, Artificial Sequence
  Description of Artificial Sequence: Synthetic oligonucleotide
  Target: SCN9A; (+) strand; PAM type: NRG; PAM sequence: TAG
cttgatgcttatagctaaag

SEQ ID NO: 38196 - DNA, 20 bp, Artificial Sequence
  Description of Artificial Sequence: Synthetic oligonucleotide
  Target: SCN9A; (+) strand; PAM type: NRG; PAM sequence: GAG
tgatgcttatagctaaagta

SEQ ID NO: 38197 - DNA, 20 bp, Artificial Sequence
  Description of Artificial Sequence: Synthetic oligonucleotide
  Target: SCN9A; (+) strand; PAM type: NRG; PAM sequence: AGG
gatgcttatagctaaagtag

SEQ ID NO: 38198 - DNA, 20 bp, Artificial Sequence
  Description of Artificial Sequence: Synthetic oligonucleotide
  Target: SCN9A; (+) strand; PAM type: NRG; PAM sequence: GGG
atgcttatagctaaagtaga

SEQ ID NO: 38199 - DNA, 20 bp, Artificial Sequence
  Description of Artificial Sequence: Synthetic oligonucleotide
  Target: SCN9A; (+) strand; PAM type: NRG; PAM sequence: CAG
agagggttgtattaattact

SEQ ID NO: 38200 - DNA, 20 bp, Artificial Sequence
  Description of Artificial Sequence: Synthetic oligonucleotide
  Target: SCN9A; (+) strand; PAM type: NRG; PAM sequence: TGG
attaattactcagctaaaaa

SEQ ID NO: 38201 - DNA, 20 bp, Artificial Sequence
  Description of Artificial Sequence: Synthetic oligonucleotide
  Target: SCN9A; (+) strand; PAM type: NRG; PAM sequence: AAG
attactcagctaaaaatggt

SEQ ID NO: 38202 - DNA, 20 bp, Artificial Sequence
  Description of Artificial Sequence: Synthetic oligonucleotide
  Target: SCN9A; (+) strand; PAM type: NRG; PAM sequence: TGG
taagaaccacctccactttt

SEQ ID NO: 38203 - DNA, 20 bp, Artificial Sequence
  Description of Artificial Sequence: Synthetic oligonucleotide
  Target: SCN9A; (+) strand; PAM type: NRG; PAM sequence: AAG
cacctccactttttggaaat

SEQ ID NO: 38204 - DNA, 20 bp, Artificial Sequence
  Description of Artificial Sequence: Synthetic oligonucleotide
  Target: SCN9A; (+) strand; PAM type: NRG; PAM sequence: TAG
tccactttttggaaataagc

SEQ ID NO: 38205 - DNA, 20 bp, Artificial Sequence
  Description of Artificial Sequence: Synthetic oligonucleotide
  Target: SCN9A; (+) strand; PAM type: NRG; PAM sequence: AAG
tttgaattcataaatctcaa

SEQ ID NO: 38206 - DNA, 20 bp, Artificial Sequence
  Description of Artificial Sequence: Synthetic oligonucleotide
  Target: SCN9A; (+) strand; PAM type: NRG; PAM sequence: TAG
gaattcataaatctcaaaag

SEQ ID NO: 38207 - DNA, 20 bp, Artificial Sequence
  Description of Artificial Sequence: Synthetic oligonucleotide
  Target: SCN9A; (+) strand; PAM type: NRG; PAM sequence: TGG
tagctaaattttgaaatatt

SEQ ID NO: 38208 - DNA, 20 bp, Artificial Sequence
  Description of Artificial Sequence: Synthetic oligonucleotide
  Target: SCN9A; (+) strand; PAM type: NRG; PAM sequence: TGG
aaatatttactacctaccaa

SEQ ID NO: 38209 - DNA, 20 bp, Artificial Sequence
  Description of Artificial Sequence: Synthetic oligonucleotide
  Target: SCN9A; (+) strand; PAM type: NRG; PAM sequence: GGG
aatatttactacctaccaat

SEQ ID NO: 38210 - DNA, 20 bp, Artificial Sequence
  Description of Artificial Sequence: Synthetic oligonucleotide
  Target: SCN9A; (+) strand; PAM type: NRG; PAM sequence: TGG
atgggtgcataaaactcttt

SEQ ID NO: 38211 - DNA, 20 bp, Artificial Sequence
  Description of Artificial Sequence: Synthetic oligonucleotide
  Target: SCN9A; (+) strand; PAM type: NRG; PAM sequence: GGG
tgggtgcataaaactctttt

SEQ ID NO: 38212 - DNA, 20 bp, Artificial Sequence
  Description of Artificial Sequence: Synthetic oligonucleotide
  Target: SCN9A; (+) strand; PAM type: NRG; PAM sequence: TAG
taaaactcttttgggcacta

SEQ ID NO: 38213 - DNA, 20 bp, Artificial Sequence
  Description of Artificial Sequence: Synthetic oligonucleotide
  Target: SCN9A; (+) strand; PAM type: NRG; PAM sequence: TAG
ttatacttacccatataaaa

SEQ ID NO: 38214 - DNA, 20 bp, Artificial Sequence
  Description of Artificial Sequence: Synthetic oligonucleotide
  Target: SCN9A; (+) strand; PAM type: NRG; PAM sequence: GAG
atacttacccatataaaata

SEQ ID NO: 38215 - DNA, 20 bp, Artificial Sequence
  Description of Artificial Sequence: Synthetic oligonucleotide
  Target: SCN9A; (+) strand; PAM type: NRG; PAM sequence: AAG
gtcattatttaacattcatg

SEQ ID NO: 38216 - DNA, 20 bp, Artificial Sequence
  Description of Artificial Sequence: Synthetic oligonucleotide
  Target: SCN9A; (+) strand; PAM type: NRG; PAM sequence: GAG
cattatttaacattcatgaa

SEQ ID NO: 38217 - DNA, 20 bp, Artificial Sequence
  Description of Artificial Sequence: Synthetic oligonucleotide
  Target: SCN9A; (+) strand; PAM type: NRG; PAM sequence: CAG
tgcattgttcctgtatgata

SEQ ID NO: 38218 - DNA, 20 bp, Artificial Sequence
  Description of Artificial Sequence: Synthetic oligonucleotide
  Target: SCN9A; (+) strand; PAM type: NRG; PAM sequence: GAG
cattgttcctgtatgataca

SEQ ID NO: 38219 - DNA, 20 bp, Artificial Sequence
  Description of Artificial Sequence: Synthetic oligonucleotide
  Target: SCN9A; (+) strand; PAM type: NRG; PAM sequence: AGG
attgttcctgtatgatacag

SEQ ID NO: 38220 - DNA, 20 bp, Artificial Sequence
  Description of Artificial Sequence: Synthetic oligonucleotide
  Target: SCN9A; (+) strand; PAM type: NRG; PAM sequence: TAG
gttcctgtatgatacagagg

SEQ ID NO: 38221 - DNA, 20 bp, Artificial Sequence
  Description of Artificial Sequence: Synthetic oligonucleotide
  Target: SCN9A; (+) strand; PAM type: NRG; PAM sequence: TGG
tgtatgatacagaggtagcc

SEQ ID NO: 38222 - DNA, 20 bp, Artificial Sequence
  Description of Artificial Sequence: Synthetic oligonucleotide
  Target: SCN9A; (+) strand; PAM type: NRG; PAM sequence: GGG
gtatgatacagaggtagcct

SEQ ID NO: 38223 - DNA, 20 bp, Artificial Sequence
  Description of Artificial Sequence: Synthetic oligonucleotide
  Target: SCN9A; (+) strand; PAM type: NRG; PAM sequence: TAG
agcctgggttcttacatttt

SEQ ID NO: 38224 - DNA, 20 bp, Artificial Sequence
  Description of Artificial Sequence: Synthetic oligonucleotide
  Target: SCN9A; (+) strand; PAM type: NRG; PAM sequence: TAG
ctgggttcttacatttttag

SEQ ID NO: 38225 - DNA, 20 bp, Artificial Sequence
  Description of Artificial Sequence: Synthetic oligonucleotide
  Target: SCN9A; (+) strand; PAM type: NRG; PAM sequence: CAG
ataaattttcaatgtgtttt

SEQ ID NO: 38226 - DNA, 20 bp, Artificial Sequence
  Description of Artificial Sequence: Synthetic oligonucleotide
  Target: SCN9A; (+) strand; PAM type: NRG; PAM sequence: AAG
attgttttaatttcttcatg

SEQ ID NO: 38227 - DNA, 20 bp, Artificial Sequence
  Description of Artificial Sequence: Synthetic oligonucleotide
  Target: SCN9A; (+) strand; PAM type: NRG; PAM sequence: AAG
atcattacaaccacataatg

SEQ ID NO: 38228 - DNA, 20 bp, Artificial Sequence
  Description of Artificial Sequence: Synthetic oligonucleotide
  Target: SCN9A; (+) strand; PAM type: NRG; PAM sequence: TAG
attacaaccacataatgaag

SEQ ID NO: 38229 - DNA, 20 bp, Artificial Sequence
  Description of Artificial Sequence: Synthetic oligonucleotide
  Target: SCN9A; (+) strand; PAM type: NRG; PAM sequence: TAG
gtactcttctcctcatttta

SEQ ID NO: 38230 - DNA, 20 bp, Artificial Sequence
  Description of Artificial Sequence: Synthetic oligonucleotide
  Target: SCN9A; (+) strand; PAM type: NRG; PAM sequence: AAG
cttctcctcattttatagat

SEQ ID NO: 38231 - DNA, 20 bp, Artificial Sequence
  Description of Artificial Sequence: Synthetic oligonucleotide
  Target: SCN9A; (+) strand; PAM type: NRG; PAM sequence: AAG
tcctcattttatagataaga

SEQ ID NO: 38232 - DNA, 20 bp, Artificial Sequence
  Description of Artificial Sequence: Synthetic oligonucleotide
  Target: SCN9A; (+) strand; PAM type: NRG; PAM sequence: GAG
attttatagataagaaagtt

SEQ ID NO: 38233 - DNA, 20 bp, Artificial Sequence
  Description of Artificial Sequence: Synthetic oligonucleotide
  Target: SCN9A; (+) strand; PAM type: NRG; PAM sequence: AGG
ttttatagataagaaagttg

SEQ ID NO: 38234 - DNA, 20 bp, Artificial Sequence
  Description of Artificial Sequence: Synthetic oligonucleotide
  Target: SCN9A; (+) strand; PAM type: NRG; PAM sequence: TAG
taagaaagttgaggcccata

SEQ ID NO: 38235 - DNA, 20 bp, Artificial Sequence
  Description of Artificial Sequence: Synthetic oligonucleotide
  Target: SCN9A; (+) strand; PAM type: NRG; PAM sequence: AGG
aagaaagttgaggcccatat

SEQ ID NO: 38236 - DNA, 20 bp, Artificial Sequence
  Description of Artificial Sequence: Synthetic oligonucleotide
  Target: SCN9A; (+) strand; PAM type: NRG; PAM sequence: AAG
gttgaggcccatataggtta

SEQ ID NO: 38237 - DNA, 20 bp, Artificial Sequence
  Description of Artificial Sequence: Synthetic oligonucleotide
  Target: SCN9A; (+) strand; PAM type: NRG; PAM sequence: CAG
tataggttaaagaatgtatt

SEQ ID NO: 38238 - DNA, 20 bp, Artificial Sequence
  Description of Artificial Sequence: Synthetic oligonucleotide
  Target: SCN9A; (+) strand; PAM type: NRG; PAM sequence: TAG
gaatgtattcagcaaactca

SEQ ID NO: 38239 - DNA, 20 bp, Artificial Sequence
  Description of Artificial Sequence: Synthetic oligonucleotide
  Target: SCN9A; (+) strand; PAM type: NRG; PAM sequence: AGG
aatgtattcagcaaactcat

SEQ ID NO: 38240 - DNA, 20 bp, Artificial Sequence
  Description of Artificial Sequence: Synthetic oligonucleotide
  Target: SCN9A; (+) strand; PAM type: NRG; PAM sequence: GGG
atgtattcagcaaactcata

SEQ ID NO: 38241 - DNA, 20 bp, Artificial Sequence
  Description of Artificial Sequence: Synthetic oligonucleotide
  Target: SCN9A; (+) strand; PAM type: NRG; PAM sequence: TGG
tcagcaaactcatagggtca

SEQ ID NO: 38242 - DNA, 20 bp, Artificial Sequence
  Description of Artificial Sequence: Synthetic oligonucleotide
  Target: SCN9A; (+) strand; PAM type: NRG; PAM sequence: TGG
tcatagggtcatggcttaac

SEQ ID NO: 38243 - DNA, 20 bp, Artificial Sequence
  Description of Artificial Sequence: Synthetic oligonucleotide
  Target: SCN9A; (+) strand; PAM type: NRG; PAM sequence: GGG
catagggtcatggcttaact

SEQ ID NO: 38244 - DNA, 20 bp, Artificial Sequence
  Description of Artificial Sequence: Synthetic oligonucleotide
  Target: SCN9A; (+) strand; PAM type: NRG; PAM sequence: TAG
gcttaactgggatacaaata

SEQ ID NO: 38245 - DNA, 20 bp, Artificial Sequence
  Description of Artificial Sequence: Synthetic oligonucleotide
  Target: SCN9A; (+) strand; PAM type: NRG; PAM sequence: TAG
ctgggatacaaatatagttc

SEQ ID NO: 38246 - DNA, 20 bp, Artificial Sequence
  Description of Artificial Sequence: Synthetic oligonucleotide
  Target: SCN9A; (+) strand; PAM type: NRG; PAM sequence: TAG
tacaaatatagttctagtct

SEQ ID NO: 38247 - DNA, 20 bp, Artificial Sequence
  Description of Artificial Sequence: Synthetic oligonucleotide
  Target: SCN9A; (+) strand; PAM type: NRG; PAM sequence: TAG
agtcttagaacccatgctct

SEQ ID NO: 38248 - DNA, 20 bp, Artificial Sequence
  Description of Artificial Sequence: Synthetic oligonucleotide
  Target: SCN9A; (+) strand; PAM type: NRG; PAM sequence: AAG
tgtatgctatatcacctctt

SEQ ID NO: 38249 - DNA, 20 bp, Artificial Sequence
  Description of Artificial Sequence: Synthetic oligonucleotide
  Target: SCN9A; (+) strand; PAM type: NRG; PAM sequence: GAG
tatgctatatcacctcttaa

SEQ ID NO: 38250 - DNA, 20 bp, Artificial Sequence
  Description of Artificial Sequence: Synthetic oligonucleotide
  Target: SCN9A; (+) strand; PAM type: NRG; PAM sequence: TGG
ctatatcacctcttaagagc

SEQ ID NO: 38251 - DNA, 20 bp, Artificial Sequence
  Description of Artificial Sequence: Synthetic oligonucleotide
  Target: SCN9A; (+) strand; PAM type: NRG; PAM sequence: CAG
tcacctcttaagagctggta

SEQ ID NO: 38252 - DNA, 20 bp, Artificial Sequence
  Description of Artificial Sequence: Synthetic oligonucleotide
  Target: SCN9A; (+) strand; PAM type: NRG; PAM sequence: GAG
agctttcccatctgtaaaat

SEQ ID NO: 38253 - DNA, 20 bp, Artificial Sequence
  Description of Artificial Sequence: Synthetic oligonucleotide
  Target: SCN9A; (+) strand; PAM type: NRG; PAM sequence: AAG
cccatctgtaaaatgagaaa

SEQ ID NO: 38254 - DNA, 20 bp, Artificial Sequence
  Description of Artificial Sequence: Synthetic oligonucleotide
  Target: SCN9A; (+) strand; PAM type: NRG; PAM sequence: GAG
catctgtaaaatgagaaaaa

SEQ ID NO: 38255 - DNA, 20 bp, Artificial Sequence
  Description of Artificial Sequence: Synthetic oligonucleotide
  Target: SCN9A; (+) strand; PAM type: NRG; PAM sequence: TGG
aaaaagagtaatactccatg

SEQ ID NO: 38256 - DNA, 20 bp, Artificial Sequence
  Description of Artificial Sequence: Synthetic oligonucleotide
  Target: SCN9A; (+) strand; PAM type: NRG; PAM sequence: AAG
gtaatactccatgtggttgt

SEQ ID NO: 38257 - DNA, 20 bp, Artificial Sequence
  Description of Artificial Sequence: Synthetic oligonucleotide
  Target: SCN9A; (+) strand; PAM type: NRG; PAM sequence: AGG
taatactccatgtggttgta

SEQ ID NO: 38258 - DNA, 20 bp, Artificial Sequence
  Description of Artificial Sequence: Synthetic oligonucleotide
  Target: SCN9A; (+) strand; PAM type: NRG; PAM sequence: GGG
aatactccatgtggttgtaa

SEQ ID NO: 38259 - DNA, 20 bp, Artificial Sequence
  Description of Artificial Sequence: Synthetic oligonucleotide
  Target: SCN9A; (+) strand; PAM type: NRG; PAM sequence: TAG
actccatgtggttgtaaggg

SEQ ID NO: 38260 - DNA, 20 bp, Artificial Sequence
  Description of Artificial Sequence: Synthetic oligonucleotide
  Target: SCN9A; (+) strand; PAM type: NRG; PAM sequence: GAG
tgtggttgtaagggtagaat

SEQ ID NO: 38261 - DNA, 20 bp, Artificial Sequence
  Description of Artificial Sequence: Synthetic oligonucleotide
  Target: SCN9A; (+) strand; PAM type: NRG; PAM sequence: AAG
ttgtaagggtagaatgagac

SEQ ID NO: 38262 - DNA, 20 bp, Artificial Sequence
  Description of Artificial Sequence: Synthetic oligonucleotide
  Target: SCN9A; (+) strand; PAM type: NRG; PAM sequence: AAG
agaatgagacaagctacaca

SEQ ID NO: 38263 - DNA, 20 bp, Artificial Sequence
  Description of Artificial Sequence: Synthetic oligonucleotide
  Target: SCN9A; (+) strand; PAM type: NRG; PAM sequence: TAG
gacaagctacacaaagaaat

SEQ ID NO: 38264 - DNA, 20 bp, Artificial Sequence
  Description of Artificial Sequence: Synthetic oligonucleotide
  Target: SCN9A; (+) strand; PAM type: NRG; PAM sequence: CAG
aaattagaacaatgacaata

SEQ ID NO: 38265 - DNA, 20 bp, Artificial Sequence
  Description of Artificial Sequence: Synthetic oligonucleotide
  Target: SCN9A; (+) strand; PAM type: NRG; PAM sequence: AAG
aacaatgacaatacagaatc

SEQ ID NO: 38266 - DNA, 20 bp, Artificial Sequence
  Description of Artificial Sequence: Synthetic oligonucleotide
  Target: SCN9A; (+) strand; PAM type: NRG; PAM sequence: TAG
acagaatcaagaatttatat

SEQ ID NO: 38267 - DNA, 20 bp, Artificial Sequence
  Description of Artificial Sequence: Synthetic oligonucleotide
  Target: SCN9A; (+) strand; PAM type: NRG; PAM sequence: TAG
gaatcaagaatttatattag

SEQ ID NO: 38268 - DNA, 20 bp, Artificial Sequence
  Description of Artificial Sequence: Synthetic oligonucleotide
  Target: SCN9A; (+) strand; PAM type: NRG; PAM sequence: TAG
agaatttatattagtagtaa

SEQ ID NO: 38269 - DNA, 20 bp, Artificial Sequence
  Description of Artificial Sequence: Synthetic oligonucleotide
  Target: SCN9A; (+) strand; PAM type: NRG; PAM sequence: TAG
atttatattagtagtaatag

SEQ ID NO: 38270 - DNA, 20 bp, Artificial Sequence
  Description of Artificial Sequence: Synthetic oligonucleotide
  Target: SCN9A; (+) strand; PAM type: NRG; PAM sequence: TAG
atattagtagtaatagtagt

SEQ ID NO: 38271 - DNA, 20 bp, Artificial Sequence
  Description of Artificial Sequence: Synthetic oligonucleotide
  Target: SCN9A; (+) strand; PAM type: NRG; PAM sequence: AAG
caatttgctactaaaaatgt

SEQ ID NO: 38272 - DNA, 20 bp, Artificial Sequence
  Description of Artificial Sequence: Synthetic oligonucleotide
  Target: SCN9A; (+) strand; PAM type: NRG; PAM sequence: CAG
ctactaaaaatgtaagaatc

SEQ ID NO: 38273 - DNA, 20 bp, Artificial Sequence
  Description of Artificial Sequence: Synthetic oligonucleotide
  Target: SCN9A; (+) strand; PAM type: NRG; PAM sequence: AGG
tactaaaaatgtaagaatcc

SEQ ID NO: 38274 - DNA, 20 bp, Artificial Sequence
  Description of Artificial Sequence: Synthetic oligonucleotide
  Target: SCN9A; (+) strand; PAM type: NRG; PAM sequence: CAG
caggctacttctgtgtcata

SEQ ID NO: 38275 - DNA, 20 bp, Artificial Sequence
  Description of Artificial Sequence: Synthetic oligonucleotide
  Target: SCN9A; (+) strand; PAM type: NRG; PAM sequence: AGG
aggctacttctgtgtcatac

SEQ ID NO: 38276 - DNA, 20 bp, Artificial Sequence
  Description of Artificial Sequence: Synthetic oligonucleotide
  Target: SCN9A; (+) strand; PAM type: NRG; PAM sequence: CAG
tgtgtcatacaggaacaatg

SEQ ID NO: 38277 - DNA, 20 bp, Artificial Sequence
  Description of Artificial Sequence: Synthetic oligonucleotide
  Target: SCN9A; (+) strand; PAM type: NRG; PAM sequence: AAG
aatgcagtctccatgaacca

SEQ ID NO: 38278 - DNA, 20 bp, Artificial Sequence
  Description of Artificial Sequence: Synthetic oligonucleotide
  Target: SCN9A; (+) strand; PAM type: NRG; PAM sequence: TAG
tctccatgaaccaaagctct

SEQ ID NO: 38279 - DNA, 20 bp, Artificial Sequence
  Description of Artificial Sequence: Synthetic oligonucleotide
  Target: SCN9A; (+) strand; PAM type: NRG; PAM sequence: TAG
aatgctattacacaaaaatg

SEQ ID NO: 38280 - DNA, 20 bp, Artificial Sequence
  Description of Artificial Sequence: Synthetic oligonucleotide
  Target: SCN9A; (+) strand; PAM type: NRG; PAM sequence: TGG
aaaatgtagacatcgctgtg

SEQ ID NO: 38281 - DNA, 20 bp, Artificial Sequence
  Description of Artificial Sequence: Synthetic oligonucleotide
  Target: SCN9A; (+) strand; PAM type: NRG; PAM sequence: TAG
tgtagacatcgctgtgtggc

SEQ ID NO: 38282 - DNA, 20 bp, Artificial Sequence
  Description of Artificial Sequence: Synthetic oligonucleotide
  Target: SCN9A; (+) strand; PAM type: NRG; PAM sequence: TGG
cctttgcacaaaccttgatg

SEQ ID NO: 38283 - DNA, 20 bp, Artificial Sequence
  Description of Artificial Sequence: Synthetic oligonucleotide
  Target: SCN9A; (+) strand; PAM type: NRG; PAM sequence: AAG
caaaccttgatgtggatttc

SEQ ID NO: 38284 - DNA, 20 bp, Artificial Sequence
  Description of Artificial Sequence: Synthetic oligonucleotide
  Target: SCN9A; (+) strand; PAM type: NRG; PAM sequence: TGG
tggatttcaagaaattactt

SEQ ID NO: 38285 - DNA, 20 bp, Artificial Sequence
  Description of Artificial Sequence: Synthetic oligonucleotide
  Target: SCN9A; (+) strand; PAM type: NRG; PAM sequence: TAG
aagaaattactttggaactc

SEQ ID NO: 38286 - DNA, 20 bp, Artificial Sequence
  Description of Artificial Sequence: Synthetic oligonucleotide
  Target: SCN9A; (+) strand; PAM type: NRG; PAM sequence: CGG
ttgtccttgtctttgtttcc

SEQ ID NO: 38287 - DNA, 20 bp, Artificial Sequence
  Description of Artificial Sequence: Synthetic oligonucleotide
  Target: SCN9A; (+) strand; PAM type: NRG; PAM sequence: GGG
tgtccttgtctttgtttccc

SEQ ID NO: 38288 - DNA, 20 bp, Artificial Sequence
  Description of Artificial Sequence: Synthetic oligonucleotide
  Target: SCN9A; (+) strand; PAM type: NRG; PAM sequence: TGG
tttcccgggaacacttctta

SEQ ID NO: 38289 - DNA, 20 bp, Artificial Sequence
  Description of Artificial Sequence: Synthetic oligonucleotide
  Target: SCN9A; (+) strand; PAM type: NRG; PAM sequence: GAG
tcccgggaacacttcttatg

SEQ ID NO: 38290 - DNA, 20 bp, Artificial Sequence
  Description of Artificial Sequence: Synthetic oligonucleotide
  Target: SCN9A; (+) strand; PAM type: NRG; PAM sequence: AGG
cccgggaacacttcttatgg

SEQ ID NO: 38291 - DNA, 20 bp, Artificial Sequence
  Description of Artificial Sequence: Synthetic oligonucleotide
  Target: SCN9A; (+) strand; PAM type: NRG; PAM sequence: AAG
cttcttatggaggacatttg

SEQ ID NO: 38292 - DNA, 20 bp, Artificial Sequence
  Description of Artificial Sequence: Synthetic oligonucleotide
  Target: SCN9A; (+) strand; PAM type: NRG; PAM sequence: AAG
gaagctgtcctttcaatgaa

SEQ ID NO: 38293 - DNA, 20 bp, Artificial Sequence
  Description of Artificial Sequence: Synthetic oligonucleotide
  Target: SCN9A; (+) strand; PAM type: NRG; PAM sequence: AGG
aagctgtcctttcaatgaaa

SEQ ID NO: 38294 - DNA, 20 bp, Artificial Sequence
  Description of Artificial Sequence: Synthetic oligonucleotide
  Target: SCN9A; (+) strand; PAM type: NRG; PAM sequence: AAG
tcctttcaatgaaaaggaaa

SEQ ID NO: 38295 - DNA, 20 bp, Artificial Sequence
  Description of Artificial Sequence: Synthetic oligonucleotide
  Target: SCN9A; (+) strand; PAM type: NRG; PAM sequence: CAG
aatgaaaaggaaaaagctat

SEQ ID NO: 38296 - DNA, 20 bp, Artificial Sequence
  Description of Artificial Sequence: Synthetic oligonucleotide
  Target: SCN9A; (+) strand; PAM type: NRG; PAM sequence: TAG
atcagttgttgcaacttatt

SEQ ID NO: 38297 - DNA, 20 bp, Artificial Sequence
  Description of Artificial Sequence: Synthetic oligonucleotide
  Target: SCN9A; (+) strand; PAM type: NRG; PAM sequence: TGG
ccactgactttacccaccta

SEQ ID NO: 38298 - DNA, 20 bp, Artificial Sequence
  Description of Artificial Sequence: Synthetic oligonucleotide
  Target: SCN9A; (+) strand; PAM type: NRG; PAM sequence: CAG
tatggttattctaactgaaa

SEQ ID NO: 38299 - DNA, 20 bp, Artificial Sequence
  Description of Artificial Sequence: Synthetic oligonucleotide
  Target: SCN9A; (+) strand; PAM type: NRG; PAM sequence: TAG
ttttgtataacttttattct

SEQ ID NO: 38300 - DNA, 20 bp, Artificial Sequence
  Description of Artificial Sequence: Synthetic oligonucleotide
  Target: SCN9A; (+) strand; PAM type: NRG; PAM sequence: CAG
tagattatattacaatgtgt

SEQ ID NO: 38301 - DNA, 20 bp, Artificial Sequence
  Description of Artificial Sequence: Synthetic oligonucleotide
  Target: SCN9A; (+) strand; PAM type: NRG; PAM sequence: AAG
tattacaatgtgtcagtctc

SEQ ID NO: 38302 - DNA, 20 bp, Artificial Sequence
  Description of Artificial Sequence: Synthetic oligonucleotide
  Target: SCN9A; (+) strand; PAM type: NRG; PAM sequence: TGG
tataactacaatataattta

SEQ ID NO: 38303 - DNA, 20 bp, Artificial Sequence
  Description of Artificial Sequence: Synthetic oligonucleotide
  Target: SCN9A; (+) strand; PAM type: NRG; PAM sequence: GAG
atggcaaactcaaacatttt

SEQ ID NO: 38304 - DNA, 20 bp, Artificial Sequence
  Description of Artificial Sequence: Synthetic oligonucleotide
  Target: SCN9A; (+) strand; PAM type: NRG; PAM sequence: TAG
tcaaacattttgagcattca

SEQ ID NO: 38305 - DNA, 20 bp, Artificial Sequence
  Description of Artificial Sequence: Synthetic oligonucleotide
  Target: SCN9A; (+) strand; PAM type: NRG; PAM sequence: AAG
atagatctatgaaatttgta

SEQ ID NO: 38306 - DNA, 20 bp, Artificial Sequence
  Description of Artificial Sequence: Synthetic oligonucleotide
  Target: SCN9A; (+) strand; PAM type: NRG; PAM sequence: CAG
tgtaaagaatcctatgtaaa

SEQ ID NO: 38307 - DNA, 20 bp, Artificial Sequence
  Description of Artificial Sequence: Synthetic oligonucleotide
  Target: SCN9A; (+) strand; PAM type: NRG; PAM sequence: TGG
aaacagctttatgatattca

SEQ ID NO: 38308 - DNA, 20 bp, Artificial Sequence
  Description of Artificial Sequence: Synthetic oligonucleotide
  Target: SCN9A; (+) strand; PAM type: NRG; PAM sequence: AAG
gctatttatttattttcatg

SEQ ID NO: 38309 - DNA, 20 bp, Artificial Sequence
  Description of Artificial Sequence: Synthetic oligonucleotide
  Target: SCN9A; (+) strand; PAM type: NRG; PAM sequence: AAG
aattcttgattgttttcctc

SEQ ID NO: 38310 - DNA, 20 bp, Artificial Sequence
  Description of Artificial Sequence: Synthetic oligonucleotide
  Target: SCN9A; (+) strand; PAM type: NRG; PAM sequence: AAG
tcttgattgttttcctcaag

SEQ ID NO: 38311 - DNA, 20 bp, Artificial Sequence
  Description of Artificial Sequence: Synthetic oligonucleotide
  Target: SCN9A; (+) strand; PAM type: NRG; PAM sequence: CAG
gataataacataataaacca

SEQ ID NO: 38312 - DNA, 20 bp, Artificial Sequence
  Description of Artificial Sequence: Synthetic oligonucleotide
  Target: SCN9A; (+) strand; PAM type: NRG; PAM sequence: TGG
cacagatatttttaaaaaat

SEQ ID NO: 38313 - DNA, 20 bp, Artificial Sequence
  Description of Artificial Sequence: Synthetic oligonucleotide
  Target: SCN9A; (+) strand; PAM type: NRG; PAM sequence: TGG
agatatttttaaaaaattgg

SEQ ID NO: 38314 - DNA, 20 bp, Artificial Sequence
  Description of Artificial Sequence: Synthetic oligonucleotide
  Target: SCN9A; (+) strand; PAM type: NRG; PAM sequence: TAG
aaattggtggccttcataca

SEQ ID NO: 38315 - DNA, 20 bp, Artificial Sequence
  Description of Artificial Sequence: Synthetic oligonucleotide
  Target: SCN9A; (+) strand; PAM type: NRG; PAM sequence: AGG
aattggtggccttcatacat

SEQ ID NO: 38316 - DNA, 20 bp, Artificial Sequence
  Description of Artificial Sequence: Synthetic oligonucleotide
  Target: SCN9A; (+) strand; PAM type: NRG; PAM sequence: CAG
tcatacataggtcctaaacc

SEQ ID NO: 38317 - DNA, 20 bp, Artificial Sequence
  Description of Artificial Sequence: Synthetic oligonucleotide
  Target: SCN9A; (+) strand; PAM type: NRG; PAM sequence: AGG
catacataggtcctaaaccc

SEQ ID NO: 38318 - DNA, 20 bp, Artificial Sequence
  Description of Artificial Sequence: Synthetic oligonucleotide
  Target: SCN9A; (+) strand; PAM type: NRG; PAM sequence: TGG
ctaaacccaggccaattccc

SEQ ID NO: 38319 - DNA, 20 bp, Artificial Sequence
  Description of Artificial Sequence: Synthetic oligonucleotide
  Target: SCN9A; (+) strand; PAM type: NRG; PAM sequence: TAG
attccctggccatcctaatt

SEQ ID NO: 38320 - DNA, 20 bp, Artificial Sequence
  Description of Artificial Sequence: Synthetic oligonucleotide
  Target: SCN9A; (+) strand; PAM type: NRG; PAM sequence: TGG
cctggccatcctaatttagt

SEQ ID NO: 38321 - DNA, 20 bp, Artificial Sequence
  Description of Artificial Sequence: Synthetic oligonucleotide
  Target: SCN9A; (+) strand; PAM type: NRG; PAM sequence: CAG
aatttagttggcccttcttt

SEQ ID NO: 38322 - DNA, 20 bp, Artificial Sequence
  Description of Artificial Sequence: Synthetic oligonucleotide
  Target: SCN9A; (+) strand; PAM type: NRG; PAM sequence: TAG
ctattaacatttctctgaaa

SEQ ID NO: 38323 - DNA, 20 bp, Artificial Sequence
  Description of Artificial Sequence: Synthetic oligonucleotide
  Target: SCN9A; (+) strand; PAM type: NRG; PAM sequence: TAG
atttctctgaaatagctatt

SEQ ID NO: 38324 - DNA, 20 bp, Artificial Sequence
  Description of Artificial Sequence: Synthetic oligonucleotide
  Target: SCN9A; (+) strand; PAM type: NRG; PAM sequence: AAG
tattttcactctttttaata

SEQ ID NO: 38325 - DNA, 20 bp, Artificial Sequence
  Description of Artificial Sequence: Synthetic oligonucleotide
  Target: SCN9A; (+) strand; PAM type: NRG; PAM sequence: AAG
aaactctataaaatcatgct

SEQ ID NO: 38326 - DNA, 20 bp, Artificial Sequence
  Description of Artificial Sequence: Synthetic oligonucleotide
  Target: SCN9A; (+) strand; PAM type: NRG; PAM sequence: TGG
taaaatcatgctaagtattt

SEQ ID NO: 38327 - DNA, 20 bp, Artificial Sequence
  Description of Artificial Sequence: Synthetic oligonucleotide
  Target: SCN9A; (+) strand; PAM type: NRG; PAM sequence: GGG
aaaatcatgctaagtatttt

SEQ ID NO: 38328 - DNA, 20 bp, Artificial Sequence
  Description of Artificial Sequence: Synthetic oligonucleotide
  Target: SCN9A; (+) strand; PAM type: NRG; PAM sequence: CAG
gggttgtgatgttcaacaat

SEQ ID NO: 38329 - DNA, 20 bp, Artificial Sequence
  Description of Artificial Sequence: Synthetic oligonucleotide
  Target: SCN9A; (+) strand; PAM type: NRG; PAM sequence: CAG
caacaatcagcatttaaaaa

SEQ ID NO: 38330 - DNA, 20 bp, Artificial Sequence
  Description of Artificial Sequence: Synthetic oligonucleotide
  Target: SCN9A; (+) strand; PAM type: NRG; PAM sequence: AAG
agcatttaaaaacagctcac

SEQ ID NO: 38331 - DNA, 20 bp, Artificial Sequence
  Description of Artificial Sequence: Synthetic oligonucleotide
  Target: SCN9A; (+) strand; PAM type: NRG; PAM sequence: TAG
cacccaaatcttttgcaaac

SEQ ID NO: 38332 - DNA, 20 bp, Artificial Sequence
  Description of Artificial Sequence: Synthetic oligonucleotide
  Target: SCN9A; (+) strand; PAM type: NRG; PAM sequence: AGG
acccaaatcttttgcaaact

SEQ ID NO: 38333 - DNA, 20 bp, Artificial Sequence
  Description of Artificial Sequence: Synthetic oligonucleotide
  Target: SCN9A; (+) strand; PAM type: NRG; PAM sequence: AAG
caaactaggtaactatcaaa

SEQ ID NO: 38334 - DNA, 20 bp, Artificial Sequence
  Description of Artificial Sequence: Synthetic oligonucleotide
  Target: SCN9A; (+) strand; PAM type: NRG; PAM sequence: TAG
aactatcaaaaagctaaaat

SEQ ID NO: 38335 - DNA, 20 bp, Artificial Sequence
  Description of Artificial Sequence: Synthetic oligonucleotide
  Target: SCN9A; (+) strand; PAM type: NRG; PAM sequence: AGG
actatcaaaaagctaaaatt

SEQ ID NO: 38336 - DNA, 20 bp, Artificial Sequence
  Description of Artificial Sequence: Synthetic oligonucleotide
  Target: SCN9A; (+) strand; PAM type: NRG; PAM sequence: AAG
gttctctaattttcatccga

SEQ ID NO: 38337 - DNA, 20 bp, Artificial Sequence
  Description of Artificial Sequence: Synthetic oligonucleotide
  Target: SCN9A; (+) strand; PAM type: NRG; PAM sequence: TGG
gatttgtgttcaaacctgtt

SEQ ID NO: 38338 - DNA, 20 bp, Artificial Sequence
  Description of Artificial Sequence: Synthetic oligonucleotide
  Target: SCN9A; (+) strand; PAM type: NRG; PAM sequence: GGG
atttgtgttcaaacctgttt

SEQ ID NO: 38339 - DNA, 20 bp, Artificial Sequence
  Description of Artificial Sequence: Synthetic oligonucleotide
  Target: SCN9A; (+) strand; PAM type: NRG; PAM sequence: GGG
tttgtgttcaaacctgtttg

SEQ ID NO: 38340 - DNA, 20 bp, Artificial Sequence
  Description of Artificial Sequence: Synthetic oligonucleotide
  Target: SCN9A; (+) strand; PAM type: NRG; PAM sequence: TGG
gttcaaacctgtttggggca

SEQ ID NO: 38341 - DNA, 20 bp, Artificial Sequence
  Description of Artificial Sequence: Synthetic oligonucleotide
  Target: SCN9A; (+) strand; PAM type: NRG; PAM sequence: TGG
caaacctgtttggggcatgg

SEQ ID NO: 38342 - DNA, 20 bp, Artificial Sequence
  Description of Artificial Sequence: Synthetic oligonucleotide
  Target: SCN9A; (+) strand; PAM type: NRG; PAM sequence: CAG
gtggctcatgcctgtaaccc

SEQ ID NO: 38343 - DNA, 20 bp, Artificial Sequence
  Description of Artificial Sequence: Synthetic oligonucleotide
  Target: SCN9A; (+) strand; PAM type: NRG; PAM sequence: TGG
tgcctgtaaccccagcatgt

SEQ ID NO: 38344 - DNA, 20 bp, Artificial Sequence
  Description of Artificial Sequence: Synthetic oligonucleotide
  Target: SCN9A; (+) strand; PAM type: NRG; PAM sequence: CAG
ctgtaaccccagcatgttgg

SEQ ID NO: 38345 - DNA, 20 bp, Artificial Sequence
  Description of Artificial Sequence: Synthetic oligonucleotide
  Target: SCN9A; (+) strand; PAM type: NRG; PAM sequence: AGG
tgtaaccccagcatgttggc

SEQ ID NO: 38346 - DNA, 20 bp, Artificial Sequence
  Description of Artificial Sequence: Synthetic oligonucleotide
  Target: SCN9A; (+) strand; PAM type: NRG; PAM sequence: CAG
agcatgttggcaggtcatga

SEQ ID NO: 38347 - DNA, 20 bp, Artificial Sequence
  Description of Artificial Sequence: Synthetic oligonucleotide
  Target: SCN9A; (+) strand; PAM type: NRG; PAM sequence: TAG
atgttggcaggtcatgacag

SEQ ID NO: 38348 - DNA, 20 bp, Artificial Sequence
  Description of Artificial Sequence: Synthetic oligonucleotide
  Target: SCN9A; (+) strand; PAM type: NRG; PAM sequence: AGG
tgttggcaggtcatgacagt

SEQ ID NO: 38349 - DNA, 20 bp, Artificial Sequence
  Description of Artificial Sequence: Synthetic oligonucleotide
  Target: SCN9A; (+) strand; PAM type: NRG; PAM sequence: AAG
catgacagtaggaacacttg

SEQ ID NO: 38350 - DNA, 20 bp, Artificial Sequence
  Description of Artificial Sequence: Synthetic oligonucleotide
  Target: SCN9A; (+) strand; PAM type: NRG; PAM sequence: CAG
acagtaggaacacttgaagc

SEQ ID NO: 38351 - DNA, 20 bp, Artificial Sequence
  Description of Artificial Sequence: Synthetic oligonucleotide
  Target: SCN9A; (+) strand; PAM type: NRG; PAM sequence: AGG
cagtaggaacacttgaagcc

SEQ ID NO: 38352 - DNA, 20 bp, Artificial Sequence
  Description of Artificial Sequence: Synthetic oligonucleotide
  Target: SCN9A; (+) strand; PAM type: NRG; PAM sequence: GAG
gtaggaacacttgaagccag

SEQ ID NO: 38353 - DNA, 20 bp, Artificial Sequence
  Description of Artificial Sequence: Synthetic oligonucleotide
  Target: SCN9A; (+) strand; PAM type: NRG; PAM sequence: GAG
acacttgaagccaggagttt

SEQ ID NO: 38354 - DNA, 20 bp, Artificial Sequence
  Description of Artificial Sequence: Synthetic oligonucleotide
  Target: SCN9A; (+) strand; PAM type: NRG; PAM sequence: TAG
tgaagccaggagtttgagac

SEQ ID NO: 38355 - DNA, 20 bp, Artificial Sequence
  Description of Artificial Sequence: Synthetic oligonucleotide
  Target: SCN9A; (+) strand; PAM type: NRG; PAM sequence: TGG
ccaggagtttgagactagcc

SEQ ID NO: 38356 - DNA, 20 bp, Artificial Sequence
  Description of Artificial Sequence: Synthetic oligonucleotide
  Target: SCN9A; (+) strand; PAM type: NRG; PAM sequence: GGG
caggagtttgagactagcct

SEQ ID NO: 38357 - DNA, 20 bp, Artificial Sequence
  Description of Artificial Sequence: Synthetic oligonucleotide
  Target: SCN9A; (+) strand; PAM type: NRG; PAM sequence: TAG
tgagactagcctgggcaaca

SEQ ID NO: 38358 - DNA, 20 bp, Artificial Sequence
  Description of Artificial Sequence: Synthetic oligonucleotide
  Target: SCN9A; (+) strand; PAM type: NRG; PAM sequence: AAG
actagcctgggcaacatagc

SEQ ID NO: 38359 - DNA, 20 bp, Artificial Sequence
  Description of Artificial Sequence: Synthetic oligonucleotide
  Target: SCN9A; (+) strand; PAM type: NRG; PAM sequence: TAG
atctacaaaaatttaaatat

SEQ ID NO: 38360 - DNA, 20 bp, Artificial Sequence
  Description of Artificial Sequence: Synthetic oligonucleotide
  Target: SCN9A; (+) strand; PAM type: NRG; PAM sequence: CAG
acaaaaatttaaatattagc

SEQ ID NO: 38361 - DNA, 20 bp, Artificial Sequence
  Description of Artificial Sequence: Synthetic oligonucleotide
  Target: SCN9A; (+) strand; PAM type: NRG; PAM sequence: AGG
caaaaatttaaatattagcc

SEQ ID NO: 38362 - DNA, 20 bp, Artificial Sequence
  Description of Artificial Sequence: Synthetic oligonucleotide
  Target: SCN9A; (+) strand; PAM type: NRG; PAM sequence: TGG
atttaaatattagccaggca

SEQ ID NO: 38363 - DNA, 20 bp, Artificial Sequence
  Description of Artificial Sequence: Synthetic oligonucleotide
  Target: SCN9A; (+) strand; PAM type: NRG; PAM sequence: TGG
taaatattagccaggcatgg

SEQ ID NO: 38364 - DNA, 20 bp, Artificial Sequence
  Description of Artificial Sequence: Synthetic oligonucleotide
  Target: SCN9A; (+) strand; PAM type: NRG; PAM sequence: TAG
ggcatggtggcatgtacctg

SEQ ID NO: 38365 - DNA, 20 bp, Artificial Sequence
  Description of Artificial Sequence: Synthetic oligonucleotide
  Target: SCN9A; (+) strand; PAM type: NRG; PAM sequence: TAG
gtggcatgtacctgtagtct

SEQ ID NO: 38366 - DNA, 20 bp, Artificial Sequence
  Description of Artificial Sequence: Synthetic oligonucleotide
  Target: SCN9A; (+) strand; PAM type: NRG; PAM sequence: TGG
tacctgtagtcttagctact

SEQ ID NO: 38367 - DNA, 20 bp, Artificial Sequence
  Description of Artificial Sequence: Synthetic oligonucleotide
  Target: SCN9A; (+) strand; PAM type: NRG; PAM sequence: GGG
acctgtagtcttagctactt

SEQ ID NO: 38368 - DNA, 20 bp, Artificial Sequence
  Description of Artificial Sequence: Synthetic oligonucleotide
  Target: SCN9A; (+) strand; PAM type: NRG; PAM sequence: GAG
ctgtagtcttagctacttgg

SEQ ID NO: 38369 - DNA, 20 bp, Artificial Sequence
  Description of Artificial Sequence: Synthetic oligonucleotide
  Target: SCN9A; (+) strand; PAM type: NRG; PAM sequence: AGG
tgtagtcttagctacttggg

SEQ ID NO: 38370 - DNA, 20 bp, Artificial Sequence
  Description of Artificial Sequence: Synthetic oligonucleotide
  Target: SCN9A; (+) strand; PAM type: NRG; PAM sequence: GAG
tcttagctacttgggaggct

SEQ ID NO: 38371 - DNA, 20 bp, Artificial Sequence
  Description of Artificial Sequence: Synthetic oligonucleotide
  Target: SCN9A; (+) strand; PAM type: NRG; PAM sequence: AGG
cttagctacttgggaggctg

SEQ ID NO: 38372 - DNA, 20 bp, Artificial Sequence
  Description of Artificial Sequence: Synthetic oligonucleotide
  Target: SCN9A; (+) strand; PAM type: NRG; PAM sequence: CAG
agctacttgggaggctgagg

SEQ ID NO: 38373 - DNA, 20 bp, Artificial Sequence
  Description of Artificial Sequence: Synthetic oligonucleotide
  Target: SCN9A; (+) strand; PAM type: NRG; PAM sequence: AGG
gctacttgggaggctgaggc

SEQ ID NO: 38374 - DNA, 20 bp, Artificial Sequence
  Description of Artificial Sequence: Synthetic oligonucleotide
  Target: SCN9A; (+) strand; PAM type: NRG; PAM sequence: GAG
tacttgggaggctgaggcag

SEQ ID NO: 38375 - DNA, 20 bp, Artificial Sequence
  Description of Artificial Sequence: Synthetic oligonucleotide
  Target: SCN9A; (+) strand; PAM type: NRG; PAM sequence: AGG
acttgggaggctgaggcagg

SEQ ID NO: 38376 - DNA, 20 bp, Artificial Sequence
  Description of Artificial Sequence: Synthetic oligonucleotide
  Target: SCN9A; (+) strand; PAM type: NRG; PAM sequence: GGG
cttgggaggctgaggcagga

SEQ ID NO: 38377 - DNA, 20 bp, Artificial Sequence
  Description of Artificial Sequence: Synthetic oligonucleotide
  Target: SCN9A; (+) strand; PAM type: NRG; PAM sequence: GAG
ctgaggcaggagggttgctt

SEQ ID NO: 38378 - DNA, 20 bp, Artificial Sequence
  Description of Artificial Sequence: Synthetic oligonucleotide
  Target: SCN9A; (+) strand; PAM type: NRG; PAM sequence: CAG
gcaggagggttgcttgagcc

SEQ ID NO: 38379 - DNA, 20 bp, Artificial Sequence
  Description of Artificial Sequence: Synthetic oligonucleotide
  Target: SCN9A; (+) strand; PAM type: NRG; PAM sequence: GAG
aggagggttgcttgagccca

SEQ ID NO: 38380 - DNA, 20 bp, Artificial Sequence
  Description of Artificial Sequence: Synthetic oligonucleotide
  Target: SCN9A; (+) strand; PAM type: NRG; PAM sequence: GAG
ggttgcttgagcccagagtt

SEQ ID NO: 38381 - DNA, 20 bp, Artificial Sequence
  Description of Artificial Sequence: Synthetic oligonucleotide
  Target: SCN9A; (+) strand; PAM type: NRG; PAM sequence: AGG
gttgcttgagcccagagttg

SEQ ID NO: 38382 - DNA, 20 bp, Artificial Sequence
  Description of Artificial Sequence: Synthetic oligonucleotide
  Target: SCN9A; (+) strand; PAM type: NRG; PAM sequence: CAG
tgagcccagagttgaggctg

SEQ ID NO: 38383 - DNA, 20 bp, Artificial Sequence
  Description of Artificial Sequence: Synthetic oligonucleotide
  Target: SCN9A; (+) strand; PAM type: NRG; PAM sequence: GAG
agcccagagttgaggctgca

SEQ ID NO: 38384 - DNA, 20 bp, Artificial Sequence
  Description of Artificial Sequence: Synthetic oligonucleotide
  Target: SCN9A; (+) strand; PAM type: NRG; PAM sequence: GAG
cccagagttgaggctgcaga

SEQ ID NO: 38385 - DNA, 20 bp, Artificial Sequence
  Description of Artificial Sequence: Synthetic oligonucleotide
  Target: SCN9A; (+) strand; PAM type: NRG; PAM sequence: TAG
atgatcatgccattgcactc

SEQ ID NO: 38386 - DNA, 20 bp, Artificial Sequence
  Description of Artificial Sequence: Synthetic oligonucleotide
  Target: SCN9A; (+) strand; PAM type: NRG; PAM sequence: TGG
catgccattgcactctagcc

SEQ ID NO: 38387 - DNA, 20 bp, Artificial Sequence
  Description of Artificial Sequence: Synthetic oligonucleotide
  Target: SCN9A; (+) strand; PAM type: NRG; PAM sequence: GGG
atgccattgcactctagcct

SEQ ID NO: 38388 - DNA, 20 bp, Artificial Sequence
  Description of Artificial Sequence: Synthetic oligonucleotide
  Target: SCN9A; (+) strand; PAM type: NRG; PAM sequence: CAG
ttgcactctagcctgggtga

SEQ ID NO: 38389 - DNA, 20 bp, Artificial Sequence
  Description of Artificial Sequence: Synthetic oligonucleotide
  Target: SCN9A; (+) strand; PAM type: NRG; PAM sequence: GAG
gcactctagcctgggtgaca

SEQ ID NO: 38390 - DNA, 20 bp, Artificial Sequence
  Description of Artificial Sequence: Synthetic oligonucleotide
  Target: SCN9A; (+) strand; PAM type: NRG; PAM sequence: GAG
tctagcctgggtgacagagc

SEQ ID NO: 38391 - DNA, 20 bp, Artificial Sequence
  Description of Artificial Sequence: Synthetic oligonucleotide
  Target: SCN9A; (+) strand; PAM type: NRG; PAM sequence: TGG
ctgggtgacagagcgagacc

SEQ ID NO: 38392 - DNA, 20 bp, Artificial Sequence
  Description of Artificial Sequence: Synthetic oligonucleotide
  Target: SCN9A; (+) strand; PAM type: NRG; PAM sequence: AAG
cgagacctggtcacttaaaa

SEQ ID NO: 38393 - DNA, 20 bp, Artificial Sequence
  Description of Artificial Sequence: Synthetic oligonucleotide
  Target: SCN9A; (+) strand; PAM type: NRG; PAM sequence: TAG
tggtcacttaaaaaagtttt

SEQ ID NO: 38394 - DNA, 20 bp, Artificial Sequence
  Description of Artificial Sequence: Synthetic oligonucleotide
  Target: SCN9A; (+) strand; PAM type: NRG; PAM sequence: AAG
gtttgcttccattttattct

SEQ ID NO: 38395 - DNA, 20 bp, Artificial Sequence
  Description of Artificial Sequence: Synthetic oligonucleotide
  Target: SCN9A; (+) strand; PAM type: NRG; PAM sequence: AAG
cttccattttattctaagtt

SEQ ID NO: 38396 - DNA, 20 bp, Artificial Sequence
  Description of Artificial Sequence: Synthetic oligonucleotide
  Target: SCN9A; (+) strand; PAM type: NRG; PAM sequence: CAG
ttattctaagttaagttctt

SEQ ID NO: 38397 - DNA, 20 bp, Artificial Sequence
  Description of Artificial Sequence: Synthetic oligonucleotide
  Target: SCN9A; (+) strand; PAM type: NRG; PAM sequence: TGG
taactgcctttctgtattgt

SEQ ID NO: 38398 - DNA, 20 bp, Artificial Sequence
  Description of Artificial Sequence: Synthetic oligonucleotide
  Target: SCN9A; (+) strand; PAM type: NRG; PAM sequence: GGG
aactgcctttctgtattgtt

SEQ ID NO: 38399 - DNA, 20 bp, Artificial Sequence
  Description of Artificial Sequence: Synthetic oligonucleotide
  Target: SCN9A; (+) strand; PAM type: NRG; PAM sequence: AAG
tctgtattgttgggtgtaat

SEQ ID NO: 38400 - DNA, 20 bp, Artificial Sequence
  Description of Artificial Sequence: Synthetic oligonucleotide
  Target: SCN9A; (+) strand; PAM type: NRG; PAM sequence: CAG
attgttgggtgtaataagtt

SEQ ID NO: 38401 - DNA, 20 bp, Artificial Sequence
  Description of Artificial Sequence: Synthetic oligonucleotide
  Target: SCN9A; (+) strand; PAM type: NRG; PAM sequence: CAG
aaatttaaatattaatatga

SEQ ID NO: 38402 - DNA, 20 bp, Artificial Sequence
  Description of Artificial Sequence: Synthetic oligonucleotide
  Target: SCN9A; (+) strand; PAM type: NRG; PAM sequence: AAG
taatatgacagtgccttctg

SEQ ID NO: 38403 - DNA, 20 bp, Artificial Sequence
  Description of Artificial Sequence: Synthetic oligonucleotide
  Target: SCN9A; (+) strand; PAM type: NRG; PAM sequence: AGG
aatatgacagtgccttctga

SEQ ID NO: 38404 - DNA, 20 bp, Artificial Sequence
  Description of Artificial Sequence: Synthetic oligonucleotide
  Target: SCN9A; (+) strand; PAM type: NRG; PAM sequence: GGG
atatgacagtgccttctgaa

SEQ ID NO: 38405 - DNA, 20 bp, Artificial Sequence
  Description of Artificial Sequence: Synthetic oligonucleotide
  Target: SCN9A; (+) strand; PAM type: NRG; PAM sequence: CAG
cttctgaagggtgaaaccat

SEQ ID NO: 38406 - DNA, 20 bp, Artificial Sequence
  Description of Artificial Sequence: Synthetic oligonucleotide
  Target: SCN9A; (+) strand; PAM type: NRG; PAM sequence: CAG
ggtgaaaccatcagtacaaa

SEQ ID NO: 38407 - DNA, 20 bp, Artificial Sequence
  Description of Artificial Sequence: Synthetic oligonucleotide
  Target: SCN9A; (+) strand; PAM type: NRG; PAM sequence: TGG
agtacaaacagtaatctaca

SEQ ID NO: 38408 - DNA, 20 bp, Artificial Sequence
  Description of Artificial Sequence: Synthetic oligonucleotide
  Target: SCN9A; (+) strand; PAM type: NRG; PAM sequence: AAG
caaacagtaatctacatgga

SEQ ID NO: 38409 - DNA, 20 bp, Artificial Sequence
  Description of Artificial Sequence: Synthetic oligonucleotide
  Target: SCN9A; (+) strand; PAM type: NRG; PAM sequence: GAG
aacagtaatctacatggaaa

SEQ ID NO: 38410 - DNA, 20 bp, Artificial Sequence
  Description of Artificial Sequence: Synthetic oligonucleotide
  Target: SCN9A; (+) strand; PAM type: NRG; PAM sequence: GAG
cagtaatctacatggaaaga

SEQ ID NO: 38411 - DNA, 20 bp, Artificial Sequence
  Description of Artificial Sequence: Synthetic oligonucleotide
  Target: SCN9A; (+) strand; PAM type: NRG; PAM sequence: AGG
agtaatctacatggaaagag

SEQ ID NO: 38412 - DNA, 20 bp, Artificial Sequence
  Description of Artificial Sequence: Synthetic oligonucleotide
  Target: SCN9A; (+) strand; PAM type: NRG; PAM sequence: AAG
gagaggtctaattttacttc

SEQ ID NO: 38413 - DNA, 20 bp, Artificial Sequence
  Description of Artificial Sequence: Synthetic oligonucleotide
  Target: SCN9A; (+) strand; PAM type: NRG; PAM sequence: AAG
acttcaagcttatacttaat

SEQ ID NO: 38414 - DNA, 20 bp, Artificial Sequence
  Description of Artificial Sequence: Synthetic oligonucleotide
  Target: SCN9A; (+) strand; PAM type: NRG; PAM sequence: AAG
tattatttttaattgataaa

SEQ ID NO: 38415 - DNA, 20 bp, Artificial Sequence
  Description of Artificial Sequence: Synthetic oligonucleotide
  Target: SCN9A; (+) strand; PAM type: NRG; PAM sequence: AAG
tttaattgataaaaagtcac

SEQ ID NO: 38416 - DNA, 20 bp, Artificial Sequence
  Description of Artificial Sequence: Synthetic oligonucleotide
  Target: SCN9A; (+) strand; PAM type: NRG; PAM sequence: TAG
aattgataaaaagtcacaag

SEQ ID NO: 38417 - DNA, 20 bp, Artificial Sequence
  Description of Artificial Sequence: Synthetic oligonucleotide
  Target: SCN9A; (+) strand; PAM type: NRG; PAM sequence: TAG
tgttattttaaaaaaaaaca

SEQ ID NO: 38418 - DNA, 20 bp, Artificial Sequence
  Description of Artificial Sequence: Synthetic oligonucleotide
  Target: SCN9A; (+) strand; PAM type: NRG; PAM sequence: TAG
aaaaaacatagttcatgaaa

SEQ ID NO: 38419 - DNA, 20 bp, Artificial Sequence
  Description of Artificial Sequence: Synthetic oligonucleotide
  Target: SCN9A; (+) strand; PAM type: NRG; PAM sequence: AGG
aaaaacatagttcatgaaat

SEQ ID NO: 38420 - DNA, 20 bp, Artificial Sequence
  Description of Artificial Sequence: Synthetic oligonucleotide
  Target: SCN9A; (+) strand; PAM type: NRG; PAM sequence: AAG
atagttcatgaaataggaaa

SEQ ID NO: 38421 - DNA, 20 bp, Artificial Sequence
  Description of Artificial Sequence: Synthetic oligonucleotide
  Target: SCN9A; (+) strand; PAM type: NRG; PAM sequence: AAG
atatatatttttgaaatgct

SEQ ID NO: 38422 - DNA, 20 bp, Artificial Sequence
  Description of Artificial Sequence: Synthetic oligonucleotide
  Target: SCN9A; (+) strand; PAM type: NRG; PAM sequence: AAG
tatatttttgaaatgctaag

SEQ ID NO: 38423 - DNA, 20 bp, Artificial Sequence
  Description of Artificial Sequence: Synthetic oligonucleotide
  Target: SCN9A; (+) strand; PAM type: NRG; PAM sequence: CAG
aaattgtgttgttaacaaac

SEQ ID NO: 38424 - DNA, 20 bp, Artificial Sequence
  Description of Artificial Sequence: Synthetic oligonucleotide
  Target: SCN9A; (+) strand; PAM type: NRG; PAM sequence: AAG
tttttattttacataaaaac

SEQ ID NO: 38425 - DNA, 20 bp, Artificial Sequence
  Description of Artificial Sequence: Synthetic oligonucleotide
  Target: SCN9A; (+) strand; PAM type: NRG; PAM sequence: AGG
ttttattttacataaaaaca

SEQ ID NO: 38426 - DNA, 20 bp, Artificial Sequence
  Description of Artificial Sequence: Synthetic oligonucleotide
  Target: SCN9A; (+) strand; PAM type: NRG; PAM sequence: TAG
aggcaatgtaaaaacattaa

SEQ ID NO: 38427 - DNA, 20 bp, Artificial Sequence
  Description of Artificial Sequence: Synthetic oligonucleotide
  Target: SCN9A; (+) strand; PAM type: NRG; PAM sequence: AAG
cttgtcttactacattatgt

SEQ ID NO: 38428 - DNA, 20 bp, Artificial Sequence
  Description of Artificial Sequence: Synthetic oligonucleotide
  Target: SCN9A; (+) strand; PAM type: NRG; PAM sequence: CAG
ttatgtaagtattcataatg

SEQ ID NO: 38429 - DNA, 20 bp, Artificial Sequence
  Description of Artificial Sequence: Synthetic oligonucleotide
  Target: SCN9A; (+) strand; PAM type: NRG; PAM sequence: GAG
cataatgcagttatatttgt

SEQ ID NO: 38430 - DNA, 20 bp, Artificial Sequence
  Description of Artificial Sequence: Synthetic oligonucleotide
  Target: SCN9A; (+) strand; PAM type: NRG; PAM sequence: CGG
tatttgtgagtttgaaataa

SEQ ID NO: 38431 - DNA, 20 bp, Artificial Sequence
  Description of Artificial Sequence: Synthetic oligonucleotide
  Target: SCN9A; (+) strand; PAM type: NRG; PAM sequence: TAG
ttgtgagtttgaaataacgg

SEQ ID NO: 38432 - DNA, 20 bp, Artificial Sequence
  Description of Artificial Sequence: Synthetic oligonucleotide
  Target: SCN9A; (+) strand; PAM type: NRG; PAM sequence: AAG
ggtagattgaattcaaattt

SEQ ID NO: 38433 - DNA, 20 bp, Artificial Sequence
  Description of Artificial Sequence: Synthetic oligonucleotide
  Target: SCN9A; (+) strand; PAM type: NRG; PAM sequence: AGG
gtagattgaattcaaattta

SEQ ID NO: 38434 - DNA, 20 bp, Artificial Sequence
  Description of Artificial Sequence: Synthetic oligonucleotide
  Target: SCN9A; (+) strand; PAM type: NRG; PAM sequence: TAG
taaatgtaatatattttgta

SEQ ID NO: 38435 - DNA, 20 bp, Artificial Sequence
  Description of Artificial Sequence: Synthetic oligonucleotide
  Target: SCN9A; (+) strand; PAM type: NRG; PAM sequence: AGG
aaatgtaatatattttgtat

SEQ ID NO: 38436 - DNA, 20 bp, Artificial Sequence
  Description of Artificial Sequence: Synthetic oligonucleotide
  Target: SCN9A; (+) strand; PAM type: NRG; PAM sequence: CAG
ttatcaaaacctatttccaa

SEQ ID NO: 38437 - DNA, 20 bp, Artificial Sequence
  Description of Artificial Sequence: Synthetic oligonucleotide
  Target: SCN9A; (+) strand; PAM type: NRG; PAM sequence: AGG
tatcaaaacctatttccaac

SEQ ID NO: 38438 - DNA, 20 bp, Artificial Sequence
  Description of Artificial Sequence: Synthetic oligonucleotide
  Target: SCN9A; (+) strand; PAM type: NRG; PAM sequence: TGG
aaacctatttccaacaggct

SEQ ID NO: 38439 - DNA, 20 bp, Artificial Sequence
  Description of Artificial Sequence: Synthetic oligonucleotide
  Target: SCN9A; (+) strand; PAM type: NRG; PAM sequence: TAG
cctatttccaacaggcttgg

SEQ ID NO: 38440 - DNA, 20 bp, Artificial Sequence
  Description of Artificial Sequence: Synthetic oligonucleotide
  Target: SCN9A; (+) strand; PAM type: NRG; PAM sequence: AGG
ctatttccaacaggcttggt

SEQ ID NO: 38441 - DNA, 20 bp, Artificial Sequence
  Description of Artificial Sequence: Synthetic oligonucleotide
  Target: SCN9A; (+) strand; PAM type: NRG; PAM sequence: TAG
atgtgataaaatgatctatg

SEQ ID NO: 38442 - DNA, 20 bp, Artificial Sequence
  Description of Artificial Sequence: Synthetic oligonucleotide
  Target: SCN9A; (+) strand; PAM type: NRG; PAM sequence: CGG
taaaatgatctatgtagtct

SEQ ID NO: 38443 - DNA, 20 bp, Artificial Sequence
  Description of Artificial Sequence: Synthetic oligonucleotide
  Target: SCN9A; (+) strand; PAM type: NRG; PAM sequence: TGG
tagtctcggaaaacactgca

SEQ ID NO: 38444 - DNA, 20 bp, Artificial Sequence
  Description of Artificial Sequence: Synthetic oligonucleotide
  Target: SCN9A; (+) strand; PAM type: NRG; PAM sequence: AAG
gtctttcatattaaattaaa

SEQ ID NO: 38445 - DNA, 20 bp, Artificial Sequence
  Description of Artificial Sequence: Synthetic oligonucleotide
  Target: SCN9A; (+) strand; PAM type: NRG; PAM sequence: TGG
tttcatattaaattaaaaag

SEQ ID NO: 38446 - DNA, 20 bp, Artificial Sequence
  Description of Artificial Sequence: Synthetic oligonucleotide
  Target: SCN9A; (+) strand; PAM type: NRG; PAM sequence: TAG
aaattaaaaagtggttcaaa

SEQ ID NO: 38447 - DNA, 20 bp, Artificial Sequence
  Description of Artificial Sequence: Synthetic oligonucleotide
  Target: SCN9A; (+) strand; PAM type: NRG; PAM sequence: AAG
aaaagtggttcaaatagcct

SEQ ID NO: 38448 - DNA, 20 bp, Artificial Sequence
  Description of Artificial Sequence: Synthetic oligonucleotide
  Target: SCN9A; (+) strand; PAM type: NRG; PAM sequence: AAG
agcctaagatgaatgaacct

SEQ ID NO: 38449 - DNA, 20 bp, Artificial Sequence
  Description of Artificial Sequence: Synthetic oligonucleotide
  Target: SCN9A; (+) strand; PAM type: NRG; PAM sequence: TGG
taagatgaatgaacctaaga

SEQ ID NO: 38450 - DNA, 20 bp, Artificial Sequence
  Description of Artificial Sequence: Synthetic oligonucleotide
  Target: SCN9A; (+) strand; PAM type: NRG; PAM sequence: AAG
aatgaacctaagatggtata

SEQ ID NO: 38451 - DNA, 20 bp, Artificial Sequence
  Description of Artificial Sequence: Synthetic oligonucleotide
  Target: SCN9A; (+) strand; PAM type: NRG; PAM sequence: TAG
aagatggtataaagaatctt

SEQ ID NO: 38452 - DNA, 20 bp, Artificial Sequence
  Description of Artificial Sequence: Synthetic oligonucleotide
  Target: SCN9A; (+) strand; PAM type: NRG; PAM sequence: TAG
gtataaagaatctttagccc

SEQ ID NO: 38453 - DNA, 20 bp, Artificial Sequence
  Description of Artificial Sequence: Synthetic oligonucleotide
  Target: SCN9A; (+) strand; PAM type: NRG; PAM sequence: GAG
agaatctttagccctagatt

SEQ ID NO: 38454 - DNA, 20 bp, Artificial Sequence
  Description of Artificial Sequence: Synthetic oligonucleotide
  Target: SCN9A; (+) strand; PAM type: NRG; PAM sequence: TAG
cctagattgagttttatacg

SEQ ID NO: 38455 - DNA, 20 bp, Artificial Sequence
  Description of Artificial Sequence: Synthetic oligonucleotide
  Target: SCN9A; (+) strand; PAM type: NRG; PAM sequence: TAG
attgagttttatacgtagat

SEQ ID NO: 38456 - DNA, 20 bp, Artificial Sequence
  Description of Artificial Sequence: Synthetic oligonucleotide
  Target: SCN9A; (+) strand; PAM type: NRG; PAM sequence: AGG
ttgagttttatacgtagatt

SEQ ID NO: 38457 - DNA, 20 bp, Artificial Sequence
  Description of Artificial Sequence: Synthetic oligonucleotide
  Target: SCN9A; (+) strand; PAM type: NRG; PAM sequence: AAG
agattaggacaaatgtctca

SEQ ID NO: 38458 - DNA, 20 bp, Artificial Sequence
  Description of Artificial Sequence: Synthetic oligonucleotide
  Target: SCN9A; (+) strand; PAM type: NRG; PAM sequence: CGG
caaatgtctcaaagtaataa

SEQ ID NO: 38459 - DNA, 20 bp, Artificial Sequence
  Description of Artificial Sequence: Synthetic oligonucleotide
  Target: SCN9A; (+) strand; PAM type: NRG; PAM sequence: TAG
atcacaatttaaaaacattc

SEQ ID NO: 38460 - DNA, 20 bp, Artificial Sequence
  Description of Artificial Sequence: Synthetic oligonucleotide
  Target: SCN9A; (+) strand; PAM type: NRG; PAM sequence: TAG
accataaatctttgtttcta

SEQ ID NO: 38461 - DNA, 20 bp, Artificial Sequence
  Description of Artificial Sequence: Synthetic oligonucleotide
  Target: SCN9A; (+) strand; PAM type: NRG; PAM sequence: AGG
ccataaatctttgtttctat

SEQ ID NO: 38462 - DNA, 20 bp, Artificial Sequence
  Description of Artificial Sequence: Synthetic oligonucleotide
  Target: SCN9A; (+) strand; PAM type: NRG; PAM sequence: CAG
cctctttctttttaaattgc

SEQ ID NO: 38463 - DNA, 20 bp, Artificial Sequence
  Description of Artificial Sequence: Synthetic oligonucleotide
  Target: SCN9A; (+) strand; PAM type: NRG; PAM sequence: TGG
aatttattattttttaaata

SEQ ID NO: 38464 - DNA, 20 bp, Artificial Sequence
  Description of Artificial Sequence: Synthetic oligonucleotide
  Target: SCN9A; (+) strand; PAM type: NRG; PAM sequence: AAG
tattattttttaaatatgga

SEQ ID NO: 38465 - DNA, 20 bp, Artificial Sequence
  Description of Artificial Sequence: Synthetic oligonucleotide
  Target: SCN9A; (+) strand; PAM type: NRG; PAM sequence: TAG
tttaaatatggaaagcaaat

SEQ ID NO: 38466 - DNA, 20 bp, Artificial Sequence
  Description of Artificial Sequence: Synthetic oligonucleotide
  Target: SCN9A; (+) strand; PAM type: NRG; PAM sequence: AAG
tatggaaagcaaattagtga

SEQ ID NO: 38467 - DNA, 20 bp, Artificial Sequence
  Description of Artificial Sequence: Synthetic oligonucleotide
  Target: SCN9A; (+) strand; PAM type: NRG; PAM sequence: AAG
acctcccacaaaaatcttct

SEQ ID NO: 38468 - DNA, 20 bp, Artificial Sequence
  Description of Artificial Sequence: Synthetic oligonucleotide
  Target: SCN9A; (+) strand; PAM type: NRG; PAM sequence: TAG
aaaactacattctacctgtg

SEQ ID NO: 38469 - DNA, 20 bp, Artificial Sequence
  Description of Artificial Sequence: Synthetic oligonucleotide
  Target: SCN9A; (+) strand; PAM type: NRG; PAM sequence: TAG
cctgtgcatgaataacttta

SEQ ID NO: 38470 - DNA, 20 bp, Artificial Sequence
  Description of Artificial Sequence: Synthetic oligonucleotide
  Target: SCN9A; (+) strand; PAM type: NRG; PAM sequence: AAG
gtgcatgaataactttatag

SEQ ID NO: 38471 - DNA, 20 bp, Artificial Sequence
  Description of Artificial Sequence: Synthetic oligonucleotide
  Target: SCN9A; (+) strand; PAM type: NRG; PAM sequence: AAG
atgaataactttatagaaga

SEQ ID NO: 38472 - DNA, 20 bp, Artificial Sequence
  Description of Artificial Sequence: Synthetic oligonucleotide
  Target: SCN9A; (+) strand; PAM type: NRG; PAM sequence: AAG
tgaaataaactcacgaaaaa

SEQ ID NO: 38473 - DNA, 20 bp, Artificial Sequence
  Description of Artificial Sequence: Synthetic oligonucleotide
  Target: SCN9A; (+) strand; PAM type: NRG; PAM sequence: TGG
actcacgaaaaaaagcatta

SEQ ID NO: 38474 - DNA, 20 bp, Artificial Sequence
  Description of Artificial Sequence: Synthetic oligonucleotide
  Target: SCN9A; (+) strand; PAM type: NRG; PAM sequence: TAG
tcttttcaaattactattaa

SEQ ID NO: 38475 - DNA, 20 bp, Artificial Sequence
  Description of Artificial Sequence: Synthetic oligonucleotide
  Target: SCN9A; (+) strand; PAM type: NRG; PAM sequence: AGG
cttttcaaattactattaat

SEQ ID NO: 38476 - DNA, 20 bp, Artificial Sequence
  Description of Artificial Sequence: Synthetic oligonucleotide
  Target: SCN9A; (+) strand; PAM type: NRG; PAM sequence: TAG
aataggtgttttcaaaaaac

SEQ ID NO: 38477 - DNA, 20 bp, Artificial Sequence
  Description of Artificial Sequence: Synthetic oligonucleotide
  Target: SCN9A; (+) strand; PAM type: NRG; PAM sequence: CAG
ttcaaaaaactagatgtcta

SEQ ID NO: 38478 - DNA, 20 bp, Artificial Sequence
  Description of Artificial Sequence: Synthetic oligonucleotide
  Target: SCN9A; (+) strand; PAM type: NRG; PAM sequence: TAG
tgaatatgtgcttgataaat

SEQ ID NO: 38479 - DNA, 20 bp, Artificial Sequence
  Description of Artificial Sequence: Synthetic oligonucleotide
  Target: SCN9A; (+) strand; PAM type: NRG; PAM sequence: AAG
atatgtgcttgataaattag

SEQ ID NO: 38480 - DNA, 20 bp, Artificial Sequence
  Description of Artificial Sequence: Synthetic oligonucleotide
  Target: SCN9A; (+) strand; PAM type: NRG; PAM sequence: TGG
cttgataaattagaagccca

SEQ ID NO: 38481 - DNA, 20 bp, Artificial Sequence
  Description of Artificial Sequence: Synthetic oligonucleotide
  Target: SCN9A; (+) strand; PAM type: NRG; PAM sequence: GAG
cccatggtactgtgttgatt

SEQ ID NO: 38482 - DNA, 20 bp, Artificial Sequence
  Description of Artificial Sequence: Synthetic oligonucleotide
  Target: SCN9A; (+) strand; PAM type: NRG; PAM sequence: AGG
ccatggtactgtgttgattg

SEQ ID NO: 38483 - DNA, 20 bp, Artificial Sequence
  Description of Artificial Sequence: Synthetic oligonucleotide
  Target: SCN9A; (+) strand; PAM type: NRG; PAM sequence: TAG
gcaaaatatatttcacatca

SEQ ID NO: 38484 - DNA, 20 bp, Artificial Sequence
  Description of Artificial Sequence: Synthetic oligonucleotide
  Target: SCN9A; (+) strand; PAM type: NRG; PAM sequence: AAG
atttcacatcatagaatttt

SEQ ID NO: 38485 - DNA, 20 bp, Artificial Sequence
  Description of Artificial Sequence: Synthetic oligonucleotide
  Target: SCN9A; (+) strand; PAM type: NRG; PAM sequence: AGG
tttcacatcatagaatttta

SEQ ID NO: 38486 - DNA, 20 bp, Artificial Sequence
  Description of Artificial Sequence: Synthetic oligonucleotide
  Target: SCN9A; (+) strand; PAM type: NRG; PAM sequence: GAG
tcacatcatagaattttaag

SEQ ID NO: 38487 - DNA, 20 bp, Artificial Sequence
  Description of Artificial Sequence: Synthetic oligonucleotide
  Target: SCN9A; (+) strand; PAM type: NRG; PAM sequence: AAG
catcatagaattttaaggag

SEQ ID NO: 38488 - DNA, 20 bp, Artificial Sequence
  Description of Artificial Sequence: Synthetic oligonucleotide
  Target: SCN9A; (+) strand; PAM type: NRG; PAM sequence: AGG
atcatagaattttaaggaga

SEQ ID NO: 38489 - DNA, 20 bp, Artificial Sequence
  Description of Artificial Sequence: Synthetic oligonucleotide
  Target: SCN9A; (+) strand; PAM type: NRG; PAM sequence: AAG
cttcctcattgtatacattg

SEQ ID NO: 38490 - DNA, 20 bp, Artificial Sequence
  Description of Artificial Sequence: Synthetic oligonucleotide
  Target: SCN9A; (+) strand; PAM type: NRG; PAM sequence: AAG
acattgaagtatatccaaaa

SEQ ID NO: 38491 - DNA, 20 bp, Artificial Sequence
  Description of Artificial Sequence: Synthetic oligonucleotide
  Target: SCN9A; (+) strand; PAM type: NRG; PAM sequence: TAG
aaaagattacttccataatt

SEQ ID NO: 38492 - DNA, 20 bp, Artificial Sequence
  Description of Artificial Sequence: Synthetic oligonucleotide
  Target: SCN9A; (+) strand; PAM type: NRG; PAM sequence: AGG
aaagattacttccataattt

SEQ ID NO: 38493 - DNA, 20 bp, Artificial Sequence
  Description of Artificial Sequence: Synthetic oligonucleotide
  Target: SCN9A; (+) strand; PAM type: NRG; PAM sequence: AAG
attacttccataatttagga

SEQ ID NO: 38494 - DNA, 20 bp, Artificial Sequence
  Description of Artificial Sequence: Synthetic oligonucleotide
  Target: SCN9A; (+) strand; PAM type: NRG; PAM sequence: AAG
cttccataatttaggaaagt

SEQ ID NO: 38495 - DNA, 20 bp, Artificial Sequence
  Description of Artificial Sequence: Synthetic oligonucleotide
  Target: SCN9A; (+) strand; PAM type: NRG; PAM sequence: TGG
cataatttaggaaagtaagt

SEQ ID NO: 38496 - DNA, 20 bp, Artificial Sequence
  Description of Artificial Sequence: Synthetic oligonucleotide
  Target: SCN9A; (+) strand; PAM type: NRG; PAM sequence: TGG
aatttaggaaagtaagttgg

SEQ ID NO: 38497 - DNA, 20 bp, Artificial Sequence
  Description of Artificial Sequence: Synthetic oligonucleotide
  Target: SCN9A; (+) strand; PAM type: NRG; PAM sequence: AAG
taggaaagtaagttggtggc

SEQ ID NO: 38498 - DNA, 20 bp, Artificial Sequence
  Description of Artificial Sequence: Synthetic oligonucleotide
  Target: SCN9A; (+) strand; PAM type: NRG; PAM sequence: GAG
ggaaagtaagttggtggcaa

SEQ ID NO: 38499 - DNA, 20 bp, Artificial Sequence
  Description of Artificial Sequence: Synthetic oligonucleotide
  Target: SCN9A; (+) strand; PAM type: NRG; PAM sequence: GAG
aaagtaagttggtggcaaga

SEQ ID NO: 38500 - DNA, 20 bp, Artificial Sequence
  Description of Artificial Sequence: Synthetic oligonucleotide
  Target: SCN9A; (+) strand; PAM type: NRG; PAM sequence: AAG
taagttggtggcaagagagc

SEQ ID NO: 38501 - DNA, 20 bp, Artificial Sequence
  Description of Artificial Sequence: Synthetic oligonucleotide
  Target: SCN9A; (+) strand; PAM type: NRG; PAM sequence: TGG
ttggtggcaagagagcaagt

SEQ ID NO: 38502 - DNA, 20 bp, Artificial Sequence
  Description of Artificial Sequence: Synthetic oligonucleotide
  Target: SCN9A; (+) strand; PAM type: NRG; PAM sequence: AAG
tggcaagagagcaagttggc

SEQ ID NO: 38503 - DNA, 20 bp, Artificial Sequence
  Description of Artificial Sequence: Synthetic oligonucleotide
  Target: SCN9A; (+) strand; PAM type: NRG; PAM sequence: AAG
actaaacacatatctgtgta

SEQ ID NO: 38504 - DNA, 20 bp, Artificial Sequence
  Description of Artificial Sequence: Synthetic oligonucleotide
  Target: SCN9A; (+) strand; PAM type: NRG; PAM sequence: AAG
tgtcatattacatgatttga

SEQ ID NO: 38505 - DNA, 20 bp, Artificial Sequence
  Description of Artificial Sequence: Synthetic oligonucleotide
  Target: SCN9A; (+) strand; PAM type: NRG; PAM sequence: CGG
atttgaaagcttgccaaaca

SEQ ID NO: 38506 - DNA, 20 bp, Artificial Sequence
  Description of Artificial Sequence: Synthetic oligonucleotide
  Target: SCN9A; (+) strand; PAM type: NRG; PAM sequence: GGG
tttgaaagcttgccaaacac

SEQ ID NO: 38507 - DNA, 20 bp, Artificial Sequence
  Description of Artificial Sequence: Synthetic oligonucleotide
  Target: SCN9A; (+) strand; PAM type: NRG; PAM sequence: AAG
ccaaacacgggattgtatac

SEQ ID NO: 38508 - DNA, 20 bp, Artificial Sequence
  Description of Artificial Sequence: Synthetic oligonucleotide
  Target: SCN9A; (+) strand; PAM type: NRG; PAM sequence: AAG
atgcaataaatactgtgccc

SEQ ID NO: 38509 - DNA, 20 bp, Artificial Sequence
  Description of Artificial Sequence: Synthetic oligonucleotide
  Target: SCN9A; (+) strand; PAM type: NRG; PAM sequence: AAG
gcccaagttattatctgctc

SEQ ID NO: 38510 - DNA, 20 bp, Artificial Sequence
  Description of Artificial Sequence: Synthetic oligonucleotide
  Target: SCN9A; (+) strand; PAM type: NRG; PAM sequence: TGG
atctgctcaagtatgtaccg

SEQ ID NO: 38511 - DNA, 20 bp, Artificial Sequence
  Description of Artificial Sequence: Synthetic oligonucleotide
  Target: SCN9A; (+) strand; PAM type: NRG; PAM sequence: CAG
tcaaacaactaactgcatat

SEQ ID NO: 38512 - DNA, 20 bp, Artificial Sequence
  Description of Artificial Sequence: Synthetic oligonucleotide
  Target: SCN9A; (+) strand; PAM type: NRG; PAM sequence: AGG
caaacaactaactgcatatc

SEQ ID NO: 38513 - DNA, 20 bp, Artificial Sequence
  Description of Artificial Sequence: Synthetic oligonucleotide
  Target: SCN9A; (+) strand; PAM type: NRG; PAM sequence: AAG
acaactaactgcatatcagg

SEQ ID NO: 38514 - DNA, 20 bp, Artificial Sequence
  Description of Artificial Sequence: Synthetic oligonucleotide
  Target: SCN9A; (+) strand; PAM type: NRG; PAM sequence: AGG
caactaactgcatatcagga

SEQ ID NO: 38515 - DNA, 20 bp, Artificial Sequence
  Description of Artificial Sequence: Synthetic oligonucleotide
  Target: SCN9A; (+) strand; PAM type: NRG; PAM sequence: CAG
gatttcatcaactttgctta

SEQ ID NO: 38516 - DNA, 20 bp, Artificial Sequence
  Description of Artificial Sequence: Synthetic oligonucleotide
  Target: SCN9A; (+) strand; PAM type: NRG; PAM sequence: AAG
atcaactttgcttacagcga

SEQ ID NO: 38517 - DNA, 20 bp, Artificial Sequence
  Description of Artificial Sequence: Synthetic oligonucleotide
  Target: SCN9A; (+) strand; PAM type: NRG; PAM sequence: AGG
tcaactttgcttacagcgaa

SEQ ID NO: 38518 - DNA, 20 bp, Artificial Sequence
  Description of Artificial Sequence: Synthetic oligonucleotide
  Target: SCN9A; (+) strand; PAM type: NRG; PAM sequence: AAG
atgactaaacaatactgcat

SEQ ID NO: 38519 - DNA, 20 bp, Artificial Sequence
  Description of Artificial Sequence: Synthetic oligonucleotide
  Target: SCN9A; (+) strand; PAM type: NRG; PAM sequence: AAG
ctaaacaatactgcataaga

SEQ ID NO: 38520 - DNA, 20 bp, Artificial Sequence
  Description of Artificial Sequence: Synthetic oligonucleotide
  Target: SCN9A; (+) strand; PAM type: NRG; PAM sequence: CAG
aacaatactgcataagaaag

SEQ ID NO: 38521 - DNA, 20 bp, Artificial Sequence
  Description of Artificial Sequence: Synthetic oligonucleotide
  Target: SCN9A; (+) strand; PAM type: NRG; PAM sequence: AGG
acaatactgcataagaaagc

SEQ ID NO: 38522 - DNA, 20 bp, Artificial Sequence
  Description of Artificial Sequence: Synthetic oligonucleotide
  Target: SCN9A; (+) strand; PAM type: NRG; PAM sequence: AAG
aaagcaggaaaatttgacaa

SEQ ID NO: 38523 - DNA, 20 bp, Artificial Sequence
  Description of Artificial Sequence: Synthetic oligonucleotide
  Target: SCN9A; (+) strand; PAM type: NRG; PAM sequence: GAG
agcaggaaaatttgacaaaa

SEQ ID NO: 38524 - DNA, 20 bp, Artificial Sequence
  Description of Artificial Sequence: Synthetic oligonucleotide
  Target: SCN9A; (+) strand; PAM type: NRG; PAM sequence: AAG
aaaatttgacaaaagagttt

SEQ ID NO: 38525 - DNA, 20 bp, Artificial Sequence
  Description of Artificial Sequence: Synthetic oligonucleotide
  Target: SCN9A; (+) strand; PAM type: NRG; PAM sequence: GAG
aatttgacaaaagagtttaa

SEQ ID NO: 38526 - DNA, 20 bp, Artificial Sequence
  Description of Artificial Sequence: Synthetic oligonucleotide
  Target: SCN9A; (+) strand; PAM type: NRG; PAM sequence: CAG
agagtttaagagactattat

SEQ ID NO: 38527 - DNA, 20 bp, Artificial Sequence
  Description of Artificial Sequence: Synthetic oligonucleotide
  Target: SCN9A; (+) strand; PAM type: NRG; PAM sequence: TGG
agagactattatcagtattt

SEQ ID NO: 38528 - DNA, 20 bp, Artificial Sequence
  Description of Artificial Sequence: Synthetic oligonucleotide
  Target: SCN9A; (+) strand; PAM type: NRG; PAM sequence: GGG
gagactattatcagtatttt

SEQ ID NO: 38529 - DNA, 20 bp, Artificial Sequence
  Description of Artificial Sequence: Synthetic oligonucleotide
  Target: SCN9A; (+) strand; PAM type: NRG; PAM sequence: CAG
actattatcagtattttggg

SEQ ID NO: 38530 - DNA, 20 bp, Artificial Sequence
  Description of Artificial Sequence: Synthetic oligonucleotide
  Target: SCN9A; (+) strand; PAM type: NRG; PAM sequence: CAG
tatcagtattttgggcagca

SEQ ID NO: 38531 - DNA, 20 bp, Artificial Sequence
  Description of Artificial Sequence: Synthetic oligonucleotide
  Target: SCN9A; (+) strand; PAM type: NRG; PAM sequence: TAG
tgggcagcacagtcaaatgt

SEQ ID NO: 38532 - DNA, 20 bp, Artificial Sequence
  Description of Artificial Sequence: Synthetic oligonucleotide
  Target: SCN9A; (+) strand; PAM type: NRG; PAM sequence: AGG
gggcagcacagtcaaatgtt

SEQ ID NO: 38533 - DNA, 20 bp, Artificial Sequence
  Description of Artificial Sequence: Synthetic oligonucleotide
  Target: SCN9A; (+) strand; PAM type: NRG; PAM sequence: TAG
atgttaggctatgtaaataa

SEQ ID NO: 38534 - DNA, 20 bp, Artificial Sequence
  Description of Artificial Sequence: Synthetic oligonucleotide
  Target: SCN9A; (+) strand; PAM type: NRG; PAM sequence: TAG
gctatgtaaataatagcaaa

SEQ ID NO: 38535 - DNA, 20 bp, Artificial Sequence
  Description of Artificial Sequence: Synthetic oligonucleotide
  Target: SCN9A; (+) strand; PAM type: NRG; PAM sequence: CAG
tctgtcaataacttttttct

SEQ ID NO: 38536 - DNA, 20 bp, Artificial Sequence
  Description of Artificial Sequence: Synthetic oligonucleotide
  Target: SCN9A; (+) strand; PAM type: NRG; PAM sequence: GAG
cagttatctttgtttttttt

SEQ ID NO: 38537 - DNA, 20 bp, Artificial Sequence
  Description of Artificial Sequence: Synthetic oligonucleotide
  Target: SCN9A; (+) strand; PAM type: NRG; PAM sequence: AGG
agttatctttgttttttttg

SEQ ID NO: 38538 - DNA, 20 bp, Artificial Sequence
  Description of Artificial Sequence: Synthetic oligonucleotide
  Target: SCN9A; (+) strand; PAM type: NRG; PAM sequence: GAG
ttatctttgttttttttgag

SEQ ID NO: 38539 - DNA, 20 bp, Artificial Sequence
  Description of Artificial Sequence: Synthetic oligonucleotide
  Target: SCN9A; (+) strand; PAM type: NRG; PAM sequence: TAG
tgaggagtgtaatatgtact

SEQ ID NO: 38540 - DNA, 20 bp, Artificial Sequence
  Description of Artificial Sequence: Synthetic oligonucleotide
  Target: SCN9A; (+) strand; PAM type: NRG; PAM sequence: AAG
tgtacttagaataatttttc

SEQ ID NO: 38541 - DNA, 20 bp, Artificial Sequence
  Description of Artificial Sequence: Synthetic oligonucleotide
  Target: SCN9A; (+) strand; PAM type: NRG; PAM sequence: TGG
gaataatttttcaagttctg

SEQ ID NO: 38542 - DNA, 20 bp, Artificial Sequence
  Description of Artificial Sequence: Synthetic oligonucleotide
  Target: SCN9A; (+) strand; PAM type: NRG; PAM sequence: AAG
gtggttattctatgaacaaa

SEQ ID NO: 38543 - DNA, 20 bp, Artificial Sequence
  Description of Artificial Sequence: Synthetic oligonucleotide
  Target: SCN9A; (+) strand; PAM type: NRG; PAM sequence: AGG
tggttattctatgaacaaaa

SEQ ID NO: 38544 - DNA, 20 bp, Artificial Sequence
  Description of Artificial Sequence: Synthetic oligonucleotide
  Target: SCN9A; (+) strand; PAM type: NRG; PAM sequence: GGG
ggttattctatgaacaaaaa

SEQ ID NO: 38545 - DNA, 20 bp, Artificial Sequence
  Description of Artificial Sequence: Synthetic oligonucleotide
  Target: SCN9A; (+) strand; PAM type: NRG; PAM sequence: AAG
atgaacaaaaagggatatga

SEQ ID NO: 38546 - DNA, 20 bp, Artificial Sequence
  Description of Artificial Sequence: Synthetic oligonucleotide
  Target: SCN9A; (+) strand; PAM type: NRG; PAM sequence: AAG
aacaaaaagggatatgaaag

SEQ ID NO: 38547 - DNA, 20 bp, Artificial Sequence
  Description of Artificial Sequence: Synthetic oligonucleotide
  Target: SCN9A; (+) strand; PAM type: NRG; PAM sequence: AAG
aaaagggatatgaaagaaga

SEQ ID NO: 38548 - DNA, 20 bp, Artificial Sequence
  Description of Artificial Sequence: Synthetic oligonucleotide
  Target: SCN9A; (+) strand; PAM type: NRG; PAM sequence: AGG
aaagggatatgaaagaagaa

SEQ ID NO: 38549 - DNA, 20 bp, Artificial Sequence
  Description of Artificial Sequence: Synthetic oligonucleotide
  Target: SCN9A; (+) strand; PAM type: NRG; PAM sequence: AAG
ctatgaaacacaatactcta

SEQ ID NO: 38550 - DNA, 20 bp, Artificial Sequence
  Description of Artificial Sequence: Synthetic oligonucleotide
  Target: SCN9A; (+) strand; PAM type: NRG; PAM sequence: AGG
tatgaaacacaatactctaa

SEQ ID NO: 38551 - DNA, 20 bp, Artificial Sequence
  Description of Artificial Sequence: Synthetic oligonucleotide
  Target: SCN9A; (+) strand; PAM type: NRG; PAM sequence: AAG
aaacacaatactctaaaggt

SEQ ID NO: 38552 - DNA, 20 bp, Artificial Sequence
  Description of Artificial Sequence: Synthetic oligonucleotide
  Target: SCN9A; (+) strand; PAM type: NRG; PAM sequence: TGG
aaggtaagtcttatccttgt

SEQ ID NO: 38553 - DNA, 20 bp, Artificial Sequence
  Description of Artificial Sequence: Synthetic oligonucleotide
  Target: SCN9A; (+) strand; PAM type: NRG; PAM sequence: GAG
tcttatccttgttggcatgt

SEQ ID NO: 38554 - DNA, 20 bp, Artificial Sequence
  Description of Artificial Sequence: Synthetic oligonucleotide
  Target: SCN9A; (+) strand; PAM type: NRG; PAM sequence: AAG
tccttgttggcatgtgagtc

SEQ ID NO: 38555 - DNA, 20 bp, Artificial Sequence
  Description of Artificial Sequence: Synthetic oligonucleotide
  Target: SCN9A; (+) strand; PAM type: NRG; PAM sequence: TAG
agatgaatgaaaaacatttg

SEQ ID NO: 38556 - DNA, 20 bp, Artificial Sequence
  Description of Artificial Sequence: Synthetic oligonucleotide
  Target: SCN9A; (+) strand; PAM type: NRG; PAM sequence: TAG
aaaacatttgtagaaatgaa

SEQ ID NO: 38557 - DNA, 20 bp, Artificial Sequence
  Description of Artificial Sequence: Synthetic oligonucleotide
  Target: SCN9A; (+) strand; PAM type: NRG; PAM sequence: TGG
tacatatatttttaatccca

SEQ ID NO: 38558 - DNA, 20 bp, Artificial Sequence
  Description of Artificial Sequence: Synthetic oligonucleotide
  Target: SCN9A; (+) strand; PAM type: NRG; PAM sequence: TAG
tttaatcccatggcatttta

SEQ ID NO: 38559 - DNA, 20 bp, Artificial Sequence
  Description of Artificial Sequence: Synthetic oligonucleotide
  Target: SCN9A; (+) strand; PAM type: NRG; PAM sequence: AGG
ttaatcccatggcattttat

SEQ ID NO: 38560 - DNA, 20 bp, Artificial Sequence
  Description of Artificial Sequence: Synthetic oligonucleotide
  Target: SCN9A; (+) strand; PAM type: NRG; PAM sequence: TGG
ttttataggcacatataaat

SEQ ID NO: 38561 - DNA, 20 bp, Artificial Sequence
  Description of Artificial Sequence: Synthetic oligonucleotide
  Target: SCN9A; (+) strand; PAM type: NRG; PAM sequence: TAG
aaattggttctgatgcaatg

SEQ ID NO: 38562 - DNA, 20 bp, Artificial Sequence
  Description of Artificial Sequence: Synthetic oligonucleotide
  Target: SCN9A; (+) strand; PAM type: NRG; PAM sequence: AAG
atgcaatgtagaataaattt

SEQ ID NO: 38563 - DNA, 20 bp, Artificial Sequence
  Description of Artificial Sequence: Synthetic oligonucleotide
  Target: SCN9A; (+) strand; PAM type: NRG; PAM sequence: TAG
aatttaagcacctcaaaata

SEQ ID NO: 38564 - DNA, 20 bp, Artificial Sequence
  Description of Artificial Sequence: Synthetic oligonucleotide
  Target: SCN9A; (+) strand; PAM type: NRG; PAM sequence: AAG
aacctctgtacattgataaa

SEQ ID NO: 38565 - DNA, 20 bp, Artificial Sequence
  Description of Artificial Sequence: Synthetic oligonucleotide
  Target: SCN9A; (+) strand; PAM type: NRG; PAM sequence: AAG
ctgtacattgataaaaagtc

SEQ ID NO: 38566 - DNA, 20 bp, Artificial Sequence
  Description of Artificial Sequence: Synthetic oligonucleotide
  Target: SCN9A; (+) strand; PAM type: NRG; PAM sequence: AAG
taatgtccattacttctatc

SEQ ID NO: 38567 - DNA, 20 bp, Artificial Sequence
  Description of Artificial Sequence: Synthetic oligonucleotide
  Target: SCN9A; (+) strand; PAM type: NRG; PAM sequence: AAG
ctatcaagcatttcattgca

SEQ ID NO: 38568 - DNA, 20 bp, Artificial Sequence
  Description of Artificial Sequence: Synthetic oligonucleotide
  Target: SCN9A; (+) strand; PAM type: NRG; PAM sequence: AAG
aagcatttcattgcaaagcc

SEQ ID NO: 38569 - DNA, 20 bp, Artificial Sequence
  Description of Artificial Sequence: Synthetic oligonucleotide
  Target: SCN9A; (+) strand; PAM type: NRG; PAM sequence: AGG
agcatttcattgcaaagcca

SEQ ID NO: 38570 - DNA, 20 bp, Artificial Sequence
  Description of Artificial Sequence: Synthetic oligonucleotide
  Target: SCN9A; (+) strand; PAM type: NRG; PAM sequence: TAG
ttttgttgatttccaaataa

SEQ ID NO: 38571 - DNA, 20 bp, Artificial Sequence
  Description of Artificial Sequence: Synthetic oligonucleotide
  Target: SCN9A; (+) strand; PAM type: NRG; PAM sequence: TAG
tccaaataatagataaataa

SEQ ID NO: 38572 - DNA, 20 bp, Artificial Sequence
  Description of Artificial Sequence: Synthetic oligonucleotide
  Target: SCN9A; (+) strand; PAM type: NRG; PAM sequence: TGG
gcgtgtgttgtttatttaca

SEQ ID NO: 38573 - DNA, 20 bp, Artificial Sequence
  Description of Artificial Sequence: Synthetic oligonucleotide
  Target: SCN9A; (+) strand; PAM type: NRG; PAM sequence: GGG
cgtgtgttgtttatttacat

SEQ ID NO: 38574 - DNA, 20 bp, Artificial Sequence
  Description of Artificial Sequence: Synthetic oligonucleotide
  Target: SCN9A; (+) strand; PAM type: NRG; PAM sequence: AAG
tgtttatttacatgggaaac

SEQ ID NO: 38575 - DNA, 20 bp, Artificial Sequence
  Description of Artificial Sequence: Synthetic oligonucleotide
  Target: SCN9A; (+) strand; PAM type: NRG; PAM sequence: AAG
actaattacaatcctgtgaa

SEQ ID NO: 38576 - DNA, 20 bp, Artificial Sequence
  Description of Artificial Sequence: Synthetic oligonucleotide
  Target: SCN9A; (+) strand; PAM type: NRG; PAM sequence: AAG
caatcctgtgaaaagatgac

SEQ ID NO: 38577 - DNA, 20 bp, Artificial Sequence
  Description of Artificial Sequence: Synthetic oligonucleotide
  Target: SCN9A; (+) strand; PAM type: NRG; PAM sequence: AGG
aatcctgtgaaaagatgaca

SEQ ID NO: 38578 - DNA, 20 bp, Artificial Sequence
  Description of Artificial Sequence: Synthetic oligonucleotide
  Target: SCN9A; (+) strand; PAM type: NRG; PAM sequence: CAG
cctgtgaaaagatgacaagg

SEQ ID NO: 38579 - DNA, 20 bp, Artificial Sequence
  Description of Artificial Sequence: Synthetic oligonucleotide
  Target: SCN9A; (+) strand; PAM type: NRG; PAM sequence: AAG
agatgacaaggcagatgtaa

SEQ ID NO: 38580 - DNA, 20 bp, Artificial Sequence
  Description of Artificial Sequence: Synthetic oligonucleotide
  Target: SCN9A; (+) strand; PAM type: NRG; PAM sequence: TGG
agatgtaaaagttttctaca

SEQ ID NO: 38581 - DNA, 20 bp, Artificial Sequence
  Description of Artificial Sequence: Synthetic oligonucleotide
  Target: SCN9A; (+) strand; PAM type: NRG; PAM sequence: CAG
gctataatcaataattccta

SEQ ID NO: 38582 - DNA, 20 bp, Artificial Sequence
  Description of Artificial Sequence: Synthetic oligonucleotide
  Target: SCN9A; (+) strand; PAM type: NRG; PAM sequence: GAG
tataatcaataattcctaca

SEQ ID NO: 38583 - DNA, 20 bp, Artificial Sequence
  Description of Artificial Sequence: Synthetic oligonucleotide
  Target: SCN9A; (+) strand; PAM type: NRG; PAM sequence: AAG
gagttctcttacgattctta

SEQ ID NO: 38584 - DNA, 20 bp, Artificial Sequence
  Description of Artificial Sequence: Synthetic oligonucleotide
  Target: SCN9A; (+) strand; PAM type: NRG; PAM sequence: CAG
tacgattcttaaagaatcat

SEQ ID NO: 38585 - DNA, 20 bp, Artificial Sequence
  Description of Artificial Sequence: Synthetic oligonucleotide
  Target: SCN9A; (+) strand; PAM type: NRG; PAM sequence: TAG
ctaatgctgcccacctttct

SEQ ID NO: 38586 - DNA, 20 bp, Artificial Sequence
  Description of Artificial Sequence: Synthetic oligonucleotide
  Target: SCN9A; (+) strand; PAM type: NRG; PAM sequence: AGG
taatgctgcccacctttctt

SEQ ID NO: 38587 - DNA, 20 bp, Artificial Sequence
  Description of Artificial Sequence: Synthetic oligonucleotide
  Target: SCN9A; (+) strand; PAM type: NRG; PAM sequence: CAG
gcccacctttcttaggaaat

SEQ ID NO: 38588 - DNA, 20 bp, Artificial Sequence
  Description of Artificial Sequence: Synthetic oligonucleotide
  Target: SCN9A; (+) strand; PAM type: NRG; PAM sequence: GAG
ccacctttcttaggaaatca

SEQ ID NO: 38589 - DNA, 20 bp, Artificial Sequence
  Description of Artificial Sequence: Synthetic oligonucleotide
  Target: SCN9A; (+) strand; PAM type: NRG; PAM sequence: TAG
ctttcttaggaaatcagagt

SEQ ID NO: 38590 - DNA, 20 bp, Artificial Sequence
  Description of Artificial Sequence: Synthetic oligonucleotide
  Target: SCN9A; (+) strand; PAM type: NRG; PAM sequence: GAG
ttagtgactgcactgccttc

SEQ ID NO: 38591 - DNA, 20 bp, Artificial Sequence
  Description of Artificial Sequence: Synthetic oligonucleotide
  Target: SCN9A; (+) strand; PAM type: NRG; PAM sequence: AAG
ttcgagaatattttgataaa

SEQ ID NO: 38592 - DNA, 20 bp, Artificial Sequence
  Description of Artificial Sequence: Synthetic oligonucleotide
  Target: SCN9A; (+) strand; PAM type: NRG; PAM sequence: AGG
tcgagaatattttgataaaa

SEQ ID NO: 38593 - DNA, 20 bp, Artificial Sequence
  Description of Artificial Sequence: Synthetic oligonucleotide
  Target: SCN9A; (+) strand; PAM type: NRG; PAM sequence: TGG
tattttgataaaaaggattt

SEQ ID NO: 38594 - DNA, 20 bp, Artificial Sequence
  Description of Artificial Sequence: Synthetic oligonucleotide
  Target: SCN9A; (+) strand; PAM type: NRG; PAM sequence: TAG
tgataaaaaggattttggca

SEQ ID NO: 38595 - DNA, 20 bp, Artificial Sequence
  Description of Artificial Sequence: Synthetic oligonucleotide
  Target: SCN9A; (+) strand; PAM type: NRG; PAM sequence: AAG
tttggcatagacttcctcaa

SEQ ID NO: 38596 - DNA, 20 bp, Artificial Sequence
  Description of Artificial Sequence: Synthetic oligonucleotide
  Target: SCN9A; (+) strand; PAM type: NRG; PAM sequence: GAG
tggcatagacttcctcaaaa

SEQ ID NO: 38597 - DNA, 20 bp, Artificial Sequence
  Description of Artificial Sequence: Synthetic oligonucleotide
  Target: SCN9A; (+) strand; PAM type: NRG; PAM sequence: CAG
acacaaataaatcactttca

SEQ ID NO: 38598 - DNA, 20 bp, Artificial Sequence
  Description of Artificial Sequence: Synthetic oligonucleotide
  Target: SCN9A; (+) strand; PAM type: NRG; PAM sequence: AGG
cacaaataaatcactttcac

SEQ ID NO: 38599 - DNA, 20 bp, Artificial Sequence
  Description of Artificial Sequence: Synthetic oligonucleotide
  Target: SCN9A; (+) strand; PAM type: NRG; PAM sequence: AAG
taaacaatatatcaaaaatg

SEQ ID NO: 38600 - DNA, 20 bp, Artificial Sequence
  Description of Artificial Sequence: Synthetic oligonucleotide
  Target: SCN9A; (+) strand; PAM type: NRG; PAM sequence: TGG
tgttcatatttctctttgtc

SEQ ID NO: 38601 - DNA, 20 bp, Artificial Sequence
  Description of Artificial Sequence: Synthetic oligonucleotide
  Target: SCN9A; (+) strand; PAM type: NRG; PAM sequence: AAG
ctttgttacactatcatatg

SEQ ID NO: 38602 - DNA, 20 bp, Artificial Sequence
  Description of Artificial Sequence: Synthetic oligonucleotide
  Target: SCN9A; (+) strand; PAM type: NRG; PAM sequence: AGG
tttgttacactatcatatga

SEQ ID NO: 38603 - DNA, 20 bp, Artificial Sequence
  Description of Artificial Sequence: Synthetic oligonucleotide
  Target: SCN9A; (+) strand; PAM type: NRG; PAM sequence: TGG
gttacactatcatatgaagg

SEQ ID NO: 38604 - DNA, 20 bp, Artificial Sequence
  Description of Artificial Sequence: Synthetic oligonucleotide
  Target: SCN9A; (+) strand; PAM type: NRG; PAM sequence: GAG
tacactatcatatgaaggtg

SEQ ID NO: 38605 - DNA, 20 bp, Artificial Sequence
  Description of Artificial Sequence: Synthetic oligonucleotide
  Target: SCN9A; (+) strand; PAM type: NRG; PAM sequence: GAG
cactatcatatgaaggtgga

SEQ ID NO: 38606 - DNA, 20 bp, Artificial Sequence
  Description of Artificial Sequence: Synthetic oligonucleotide
  Target: SCN9A; (+) strand; PAM type: NRG; PAM sequence: AGG
actatcatatgaaggtggag

SEQ ID NO: 38607 - DNA, 20 bp, Artificial Sequence
  Description of Artificial Sequence: Synthetic oligonucleotide
  Target: SCN9A; (+) strand; PAM type: NRG; PAM sequence: TGG
atcatatgaaggtggagagg

SEQ ID NO: 38608 - DNA, 20 bp, Artificial Sequence
  Description of Artificial Sequence: Synthetic oligonucleotide
  Target: SCN9A; (+) strand; PAM type: NRG; PAM sequence: TGG
atatgaaggtggagaggtgg

SEQ ID NO: 38609 - DNA, 20 bp, Artificial Sequence
  Description of Artificial Sequence: Synthetic oligonucleotide
  Target: SCN9A; (+) strand; PAM type: NRG; PAM sequence: AAG
aggtggagaggtggtggatg

SEQ ID NO: 38610 - DNA, 20 bp, Artificial Sequence
  Description of Artificial Sequence: Synthetic oligonucleotide
  Target: SCN9A; (+) strand; PAM type: NRG; PAM sequence: TGG
tggagaggtggtggatgaag

SEQ ID NO: 38611 - DNA, 20 bp, Artificial Sequence
  Description of Artificial Sequence: Synthetic oligonucleotide
  Target: SCN9A; (+) strand; PAM type: NRG; PAM sequence: TGG
gaagtggcatctgttttttc

SEQ ID NO: 38612 - DNA, 20 bp, Artificial Sequence
  Description of Artificial Sequence: Synthetic oligonucleotide
  Target: SCN9A; (+) strand; PAM type: NRG; PAM sequence: GAG
catctgttttttctggactt

SEQ ID NO: 38613 - DNA, 20 bp, Artificial Sequence
  Description of Artificial Sequence: Synthetic oligonucleotide
  Target: SCN9A; (+) strand; PAM type: NRG; PAM sequence: AAG
gttctcattaacattatcaa

SEQ ID NO: 38614 - DNA, 20 bp, Artificial Sequence
  Description of Artificial Sequence: Synthetic oligonucleotide
  Target: SCN9A; (+) strand; PAM type: NRG; PAM sequence: GAG
aaagccatatcttttttatt

SEQ ID NO: 38615 - DNA, 20 bp, Artificial Sequence
  Description of Artificial Sequence: Synthetic oligonucleotide
  Target: SCN9A; (+) strand; PAM type: NRG; PAM sequence: AAG
tatttttgacattttgcctt

SEQ ID NO: 38616 - DNA, 20 bp, Artificial Sequence
  Description of Artificial Sequence: Synthetic oligonucleotide
  Target: SCN9A; (+) strand; PAM type: NRG; PAM sequence: CGG
ttttgacattttgccttaag

SEQ ID NO: 38617 - DNA, 20 bp, Artificial Sequence
  Description of Artificial Sequence: Synthetic oligonucleotide
  Target: SCN9A; (+) strand; PAM type: NRG; PAM sequence: AAG
ccttaagcggtaacgtctat

SEQ ID NO: 38618 - DNA, 20 bp, Artificial Sequence
  Description of Artificial Sequence: Synthetic oligonucleotide
  Target: SCN9A; (+) strand; PAM type: NRG; PAM sequence: CAG
tctataagcacgctgaatga

SEQ ID NO: 38619 - DNA, 20 bp, Artificial Sequence
  Description of Artificial Sequence: Synthetic oligonucleotide
  Target: SCN9A; (+) strand; PAM type: NRG; PAM sequence: TAG
ataagcacgctgaatgacag

SEQ ID NO: 38620 - DNA, 20 bp, Artificial Sequence
  Description of Artificial Sequence: Synthetic oligonucleotide
  Target: SCN9A; (+) strand; PAM type: NRG; PAM sequence: CAG
agcacgctgaatgacagtag

SEQ ID NO: 38621 - DNA, 20 bp, Artificial Sequence
  Description of Artificial Sequence: Synthetic oligonucleotide
  Target: SCN9A; (+) strand; PAM type: NRG; PAM sequence: TAG
acatcctcttgtttccgttt

SEQ ID NO: 38622 - DNA, 20 bp, Artificial Sequence
  Description of Artificial Sequence: Synthetic oligonucleotide
  Target: SCN9A; (+) strand; PAM type: NRG; PAM sequence: TGG
ctcttgtttccgttttagtg

SEQ ID NO: 38623 - DNA, 20 bp, Artificial Sequence
  Description of Artificial Sequence: Synthetic oligonucleotide
  Target: SCN9A; (+) strand; PAM type: NRG; PAM sequence: TGG
ccgttttagtgtggttgtga

SEQ ID NO: 38624 - DNA, 20 bp, Artificial Sequence
  Description of Artificial Sequence: Synthetic oligonucleotide
  Target: SCN9A; (+) strand; PAM type: NRG; PAM sequence: GGG
cgttttagtgtggttgtgat

SEQ ID NO: 38625 - DNA, 20 bp, Artificial Sequence
  Description of Artificial Sequence: Synthetic oligonucleotide
  Target: SCN9A; (+) strand; PAM type: NRG; PAM sequence: TAG
gtgtggttgtgatgggttca

SEQ ID NO: 38626 - DNA, 20 bp, Artificial Sequence
  Description of Artificial Sequence: Synthetic oligonucleotide
  Target: SCN9A; (+) strand; PAM type: NRG; PAM sequence: AGG
tgtggttgtgatgggttcat

SEQ ID NO: 38627 - DNA, 20 bp, Artificial Sequence
  Description of Artificial Sequence: Synthetic oligonucleotide
  Target: SCN9A; (+) strand; PAM type: NRG; PAM sequence: TGG
gatgggttcataggacactt

SEQ ID NO: 38628 - DNA, 20 bp, Artificial Sequence
  Description of Artificial Sequence: Synthetic oligonucleotide
  Target: SCN9A; (+) strand; PAM type: NRG; PAM sequence: AAG
gggttcataggacactttgg

SEQ ID NO: 38629 - DNA, 20 bp, Artificial Sequence
  Description of Artificial Sequence: Synthetic oligonucleotide
  Target: SCN9A; (+) strand; PAM type: NRG; PAM sequence: AGG
ggttcataggacactttgga

SEQ ID NO: 38630 - DNA, 20 bp, Artificial Sequence
  Description of Artificial Sequence: Synthetic oligonucleotide
  Target: SCN9A; (+) strand; PAM type: NRG; PAM sequence: CAG
ggacactttggaaggatttg

SEQ ID NO: 38631 - DNA, 20 bp, Artificial Sequence
  Description of Artificial Sequence: Synthetic oligonucleotide
  Target: SCN9A; (+) strand; PAM type: NRG; PAM sequence: AAG
ctttcttccatctgtgaacg

SEQ ID NO: 38632 - DNA, 20 bp, Artificial Sequence
  Description of Artificial Sequence: Synthetic oligonucleotide
  Target: SCN9A; (+) strand; PAM type: NRG; PAM sequence: GAG
ttcttccatctgtgaacgaa

SEQ ID NO: 38633 - DNA, 20 bp, Artificial Sequence
  Description of Artificial Sequence: Synthetic oligonucleotide
  Target: SCN9A; (+) strand; PAM type: NRG; PAM sequence: AAG
acccaaaacacgctttgtaa

SEQ ID NO: 38634 - DNA, 20 bp, Artificial Sequence
  Description of Artificial Sequence: Synthetic oligonucleotide
  Target: SCN9A; (+) strand; PAM type: NRG; PAM sequence: AAG
cacgctttgtaaaagcaaat

SEQ ID NO: 38635 - DNA, 20 bp, Artificial Sequence
  Description of Artificial Sequence: Synthetic oligonucleotide
  Target: SCN9A; (+) strand; PAM type: NRG; PAM sequence: AAG
gtaaaagcaaataagatgtc

SEQ ID NO: 38636 - DNA, 20 bp, Artificial Sequence
  Description of Artificial Sequence: Synthetic oligonucleotide
  Target: SCN9A; (+) strand; PAM type: NRG; PAM sequence: TGG
caaataagatgtcaagacaa

SEQ ID NO: 38637 - DNA, 20 bp, Artificial Sequence
  Description of Artificial Sequence: Synthetic oligonucleotide
  Target: SCN9A; (+) strand; PAM type: NRG; PAM sequence: CGG
agatgtcaagacaatggatc

SEQ ID NO: 38638 - DNA, 20 bp, Artificial Sequence
  Description of Artificial Sequence: Synthetic oligonucleotide
  Target: SCN9A; (+) strand; PAM type: NRG; PAM sequence: TGG
gatccggtcaccactaacca

SEQ ID NO: 38639 - DNA, 20 bp, Artificial Sequence
  Description of Artificial Sequence: Synthetic oligonucleotide
  Target: SCN9A; (+) strand; PAM type: NRG; PAM sequence: GGG
atccggtcaccactaaccat

SEQ ID NO: 38640 - DNA, 20 bp, Artificial Sequence
  Description of Artificial Sequence: Synthetic oligonucleotide
  Target: SCN9A; (+) strand; PAM type: NRG; PAM sequence: CAG
cggtcaccactaaccatggg

SEQ ID NO: 38641 - DNA, 20 bp, Artificial Sequence
  Description of Artificial Sequence: Synthetic oligonucleotide
  Target: SCN9A; (+) strand; PAM type: NRG; PAM sequence: TGG
actaaccatgggcagatcca

SEQ ID NO: 38642 - DNA, 20 bp, Artificial Sequence
  Description of Artificial Sequence: Synthetic oligonucleotide
  Target: SCN9A; (+) strand; PAM type: NRG; PAM sequence: GAG
atgggcagatccatggcaat

SEQ ID NO: 38643 - DNA, 20 bp, Artificial Sequence
  Description of Artificial Sequence: Synthetic oligonucleotide
  Target: SCN9A; (+) strand; PAM type: NRG; PAM sequence: TGG
gcagatccatggcaatgagc

SEQ ID NO: 38644 - DNA, 20 bp, Artificial Sequence
  Description of Artificial Sequence: Synthetic oligonucleotide
  Target: SCN9A; (+) strand; PAM type: NRG; PAM sequence: TGG
ggcaatgagctggactttgt

SEQ ID NO: 38645 - DNA, 20 bp, Artificial Sequence
  Description of Artificial Sequence: Synthetic oligonucleotide
  Target: SCN9A; (+) strand; PAM type: NRG; PAM sequence: GGG
gcaatgagctggactttgtt

SEQ ID NO: 38646 - DNA, 20 bp, Artificial Sequence
  Description of Artificial Sequence: Synthetic oligonucleotide
  Target: SCN9A; (+) strand; PAM type: NRG; PAM sequence: GAG
actttgttgggttttgctat

SEQ ID NO: 38647 - DNA, 20 bp, Artificial Sequence
  Description of Artificial Sequence: Synthetic oligonucleotide
  Target: SCN9A; (+) strand; PAM type: NRG; PAM sequence: AAG
ttgttgggttttgctatgag

SEQ ID NO: 38648 - DNA, 20 bp, Artificial Sequence
  Description of Artificial Sequence: Synthetic oligonucleotide
  Target: SCN9A; (+) strand; PAM type: NRG; PAM sequence: GAG
gttgggttttgctatgagaa

SEQ ID NO: 38649 - DNA, 20 bp, Artificial Sequence
  Description of Artificial Sequence: Synthetic oligonucleotide
  Target: SCN9A; (+) strand; PAM type: NRG; PAM sequence: AGG
ttgggttttgctatgagaag

SEQ ID NO: 38650 - DNA, 20 bp, Artificial Sequence
  Description of Artificial Sequence: Synthetic oligonucleotide
  Target: SCN9A; (+) strand; PAM type: NRG; PAM sequence: GAG
gggttttgctatgagaagag

SEQ ID NO: 38651 - DNA, 20 bp, Artificial Sequence
  Description of Artificial Sequence: Synthetic oligonucleotide
  Target: SCN9A; (+) strand; PAM type: NRG; PAM sequence: AGG
ggttttgctatgagaagagg

SEQ ID NO: 38652 - DNA, 20 bp, Artificial Sequence
  Description of Artificial Sequence: Synthetic oligonucleotide
  Target: SCN9A; (+) strand; PAM type: NRG; PAM sequence: CAG
gctatgagaagaggaggatc

SEQ ID NO: 38653 - DNA, 20 bp, Artificial Sequence
  Description of Artificial Sequence: Synthetic oligonucleotide
  Target: SCN9A; (+) strand; PAM type: NRG; PAM sequence: AGG
ctatgagaagaggaggatcc

SEQ ID NO: 38654 - DNA, 20 bp, Artificial Sequence
  Description of Artificial Sequence: Synthetic oligonucleotide
  Target: SCN9A; (+) strand; PAM type: NRG; PAM sequence: GGG
tatgagaagaggaggatcca

SEQ ID NO: 38655 - DNA, 20 bp, Artificial Sequence
  Description of Artificial Sequence: Synthetic oligonucleotide
  Target: SCN9A; (+) strand; PAM type: NRG; PAM sequence: CAG
gagaagaggaggatccaggg

SEQ ID NO: 38656 - DNA, 20 bp, Artificial Sequence
  Description of Artificial Sequence: Synthetic oligonucleotide
  Target: SCN9A; (+) strand; PAM type: NRG; PAM sequence: CAG
atccagggcagctgcaaaat

SEQ ID NO: 38657 - DNA, 20 bp, Artificial Sequence
  Description of Artificial Sequence: Synthetic oligonucleotide
  Target: SCN9A; (+) strand; PAM type: NRG; PAM sequence: GAG
ccagggcagctgcaaaatca

SEQ ID NO: 38658 - DNA, 20 bp, Artificial Sequence
  Description of Artificial Sequence: Synthetic oligonucleotide
  Target: SCN9A; (+) strand; PAM type: NRG; PAM sequence: GAG
agggcagctgcaaaatcaga

SEQ ID NO: 38659 - DNA, 20 bp, Artificial Sequence
  Description of Artificial Sequence: Synthetic oligonucleotide
  Target: SCN9A; (+) strand; PAM type: NRG; PAM sequence: TAG
agctgcaaaatcagagagtt

SEQ ID NO: 38660 - DNA, 20 bp, Artificial Sequence
  Description of Artificial Sequence: Synthetic oligonucleotide
  Target: SCN9A; (+) strand; PAM type: NRG; PAM sequence: GAG
ctgcaaaatcagagagttta

SEQ ID NO: 38661 - DNA, 20 bp, Artificial Sequence
  Description of Artificial Sequence: Synthetic oligonucleotide
  Target: SCN9A; (+) strand; PAM type: NRG; PAM sequence: TGG
gtttagagaactctataaac

SEQ ID NO: 38662 - DNA, 20 bp, Artificial Sequence
  Description of Artificial Sequence: Synthetic oligonucleotide
  Target: SCN9A; (+) strand; PAM type: NRG; PAM sequence: GGG
tttagagaactctataaact

SEQ ID NO: 38663 - DNA, 20 bp, Artificial Sequence
  Description of Artificial Sequence: Synthetic oligonucleotide
  Target: SCN9A; (+) strand; PAM type: NRG; PAM sequence: CGG
ctctataaactgggtcgcat

SEQ ID NO: 38664 - DNA, 20 bp, Artificial Sequence
  Description of Artificial Sequence: Synthetic oligonucleotide
  Target: SCN9A; (+) strand; PAM type: NRG; PAM sequence: GGG
tctataaactgggtcgcatc

SEQ ID NO: 38665 - DNA, 20 bp, Artificial Sequence
  Description of Artificial Sequence: Synthetic oligonucleotide
  Target: SCN9A; (+) strand; PAM type: NRG; PAM sequence: TAG
caaacttctcccaaacctca

SEQ ID NO: 38666 - DNA, 20 bp, Artificial Sequence
  Description of Artificial Sequence: Synthetic oligonucleotide
  Target: SCN9A; (+) strand; PAM type: NRG; PAM sequence: AAG
aaacctcatagaacatctca

SEQ ID NO: 38667 - DNA, 20 bp, Artificial Sequence
  Description of Artificial Sequence: Synthetic oligonucleotide
  Target: SCN9A; (+) strand; PAM type: NRG; PAM sequence: CAG
atctcaaagtcatcctcact

SEQ ID NO: 38668 - DNA, 20 bp, Artificial Sequence
  Description of Artificial Sequence: Synthetic oligonucleotide
  Target: SCN9A; (+) strand; PAM type: NRG; PAM sequence: GAG
ctcaaagtcatcctcactca

SEQ ID NO: 38669 - DNA, 20 bp, Artificial Sequence
  Description of Artificial Sequence: Synthetic oligonucleotide
  Target: SCN9A; (+) strand; PAM type: NRG; PAM sequence: AGG
tcaaagtcatcctcactcag

SEQ ID NO: 38670 - DNA, 20 bp, Artificial Sequence
  Description of Artificial Sequence: Synthetic oligonucleotide
  Target: SCN9A; (+) strand; PAM type: NRG; PAM sequence: CAG
gtcatcctcactcagaggtt

SEQ ID NO: 38671 - DNA, 20 bp, Artificial Sequence
  Description of Artificial Sequence: Synthetic oligonucleotide
  Target: SCN9A; (+) strand; PAM type: NRG; PAM sequence: CAG
cagaggttcagtactttctt

SEQ ID NO: 38672 - DNA, 20 bp, Artificial Sequence
  Description of Artificial Sequence: Synthetic oligonucleotide
  Target: SCN9A; (+) strand; PAM type: NRG; PAM sequence: TGG
aggttcagtactttcttcag

SEQ ID NO: 38673 - DNA, 20 bp, Artificial Sequence
  Description of Artificial Sequence: Synthetic oligonucleotide
  Target: SCN9A; (+) strand; PAM type: NRG; PAM sequence: CAG
gtggcaacactaaaattctc

SEQ ID NO: 38674 - DNA, 20 bp, Artificial Sequence
  Description of Artificial Sequence: Synthetic oligonucleotide
  Target: SCN9A; (+) strand; PAM type: NRG; PAM sequence: CAG
atgtacatgttcaccacaac

SEQ ID NO: 38675 - DNA, 20 bp, Artificial Sequence
  Description of Artificial Sequence: Synthetic oligonucleotide
  Target: SCN9A; (+) strand; PAM type: NRG; PAM sequence: AGG
tgtacatgttcaccacaacc

SEQ ID NO: 38676 - DNA, 20 bp, Artificial Sequence
  Description of Artificial Sequence: Synthetic oligonucleotide
  Target: SCN9A; (+) strand; PAM type: NRG; PAM sequence: AAG
acatgttcaccacaaccagg

SEQ ID NO: 38677 - DNA, 20 bp, Artificial Sequence
  Description of Artificial Sequence: Synthetic oligonucleotide
  Target: SCN9A; (+) strand; PAM type: NRG; PAM sequence: AGG
catgttcaccacaaccagga

SEQ ID NO: 38678 - DNA, 20 bp, Artificial Sequence
  Description of Artificial Sequence: Synthetic oligonucleotide
  Target: SCN9A; (+) strand; PAM type: NRG; PAM sequence: AAG
atatgatgatataactaaca

SEQ ID NO: 38679 - DNA, 20 bp, Artificial Sequence
  Description of Artificial Sequence: Synthetic oligonucleotide
  Target: SCN9A; (+) strand; PAM type: NRG; PAM sequence: TAG
tgatgatataactaacaaag

SEQ ID NO: 38680 - DNA, 20 bp, Artificial Sequence
  Description of Artificial Sequence: Synthetic oligonucleotide
  Target: SCN9A; (+) strand; PAM type: NRG; PAM sequence: CAG
aacaaagtagaatattccaa

SEQ ID NO: 38681 - DNA, 20 bp, Artificial Sequence
  Description of Artificial Sequence: Synthetic oligonucleotide
  Target: SCN9A; (+) strand; PAM type: NRG; PAM sequence: TGG
aagtagaatattccaacaga

SEQ ID NO: 38682 - DNA, 20 bp, Artificial Sequence
  Description of Artificial Sequence: Synthetic oligonucleotide
  Target: SCN9A; (+) strand; PAM type: NRG; PAM sequence: GGG
agtagaatattccaacagat

SEQ ID NO: 38683 - DNA, 20 bp, Artificial Sequence
  Description of Artificial Sequence: Synthetic oligonucleotide
  Target: SCN9A; (+) strand; PAM type: NRG; PAM sequence: CAG
ttccaacagatgggttacca

SEQ ID NO: 38684 - DNA, 20 bp, Artificial Sequence
  Description of Artificial Sequence: Synthetic oligonucleotide
  Target: SCN9A; (+) strand; PAM type: NRG; PAM sequence: CAG
gtctccttcaactgaacttc

SEQ ID NO: 38685 - DNA, 20 bp, Artificial Sequence
  Description of Artificial Sequence: Synthetic oligonucleotide
  Target: SCN9A; (+) strand; PAM type: NRG; PAM sequence: AGG
tctccttcaactgaacttcc

SEQ ID NO: 38686 - DNA, 20 bp, Artificial Sequence
  Description of Artificial Sequence: Synthetic oligonucleotide
  Target: SCN9A; (+) strand; PAM type: NRG; PAM sequence: TGG
cttccaggatgaactttttt

SEQ ID NO: 38687 - DNA, 20 bp, Artificial Sequence
  Description of Artificial Sequence: Synthetic oligonucleotide
  Target: SCN9A; (+) strand; PAM type: NRG; PAM sequence: GGG
ttccaggatgaacttttttt

SEQ ID NO: 38688 - DNA, 20 bp, Artificial Sequence
  Description of Artificial Sequence: Synthetic oligonucleotide
  Target: SCN9A; (+) strand; PAM type: NRG; PAM sequence: CAG
gatgaactttttttgggtca

SEQ ID NO: 38689 - DNA, 20 bp, Artificial Sequence
  Description of Artificial Sequence: Synthetic oligonucleotide
  Target: SCN9A; (+) strand; PAM type: NRG; PAM sequence: CGG
aactttttttgggtcacagt

SEQ ID NO: 38690 - DNA, 20 bp, Artificial Sequence
  Description of Artificial Sequence: Synthetic oligonucleotide
  Target: SCN9A; (+) strand; PAM type: NRG; PAM sequence: GGG
actttttttgggtcacagtc

SEQ ID NO: 38691 - DNA, 20 bp, Artificial Sequence
  Description of Artificial Sequence: Synthetic oligonucleotide
  Target: SCN9A; (+) strand; PAM type: NRG; PAM sequence: TGG
ttttttgggtcacagtcggg

SEQ ID NO: 38692 - DNA, 20 bp, Artificial Sequence
  Description of Artificial Sequence: Synthetic oligonucleotide
  Target: SCN9A; (+) strand; PAM type: NRG; PAM sequence: AAG
cagtcgggtggcttactgtt

SEQ ID NO: 38693 - DNA, 20 bp, Artificial Sequence
  Description of Artificial Sequence: Synthetic oligonucleotide
  Target: SCN9A; (+) strand; PAM type: NRG; PAM sequence: TAG
gggtggcttactgttaagaa

SEQ ID NO: 38694 - DNA, 20 bp, Artificial Sequence
  Description of Artificial Sequence: Synthetic oligonucleotide
  Target: SCN9A; (+) strand; PAM type: NRG; PAM sequence: AGG
ggtggcttactgttaagaat

SEQ ID NO: 38695 - DNA, 20 bp, Artificial Sequence
  Description of Artificial Sequence: Synthetic oligonucleotide
  Target: SCN9A; (+) strand; PAM type: NRG; PAM sequence: TAG
ttactgttaagaataggtgc

SEQ ID NO: 38696 - DNA, 20 bp, Artificial Sequence
  Description of Artificial Sequence: Synthetic oligonucleotide
  Target: SCN9A; (+) strand; PAM type: NRG; PAM sequence: CAG
taggtgctagcaatccatcc

SEQ ID NO: 38697 - DNA, 20 bp, Artificial Sequence
  Description of Artificial Sequence: Synthetic oligonucleotide
  Target: SCN9A; (+) strand; PAM type: NRG; PAM sequence: CAG
tgctagcaatccatcccagc

SEQ ID NO: 38698 - DNA, 20 bp, Artificial Sequence
  Description of Artificial Sequence: Synthetic oligonucleotide
  Target: SCN9A; (+) strand; PAM type: NRG; PAM sequence: CAG
tagcaatccatcccagccag

SEQ ID NO: 38699 - DNA, 20 bp, Artificial Sequence
  Description of Artificial Sequence: Synthetic oligonucleotide
  Target: SCN9A; (+) strand; PAM type: NRG; PAM sequence: GAG
gcaatccatcccagccagca

SEQ ID NO: 38700 - DNA, 20 bp, Artificial Sequence
  Description of Artificial Sequence: Synthetic oligonucleotide
  Target: SCN9A; (+) strand; PAM type: NRG; PAM sequence: AGG
caatccatcccagccagcag

SEQ ID NO: 38701 - DNA, 20 bp, Artificial Sequence
  Description of Artificial Sequence: Synthetic oligonucleotide
  Target: SCN9A; (+) strand; PAM type: NRG; PAM sequence: TGG
agccagcagaggttgtaatt

SEQ ID NO: 38702 - DNA, 20 bp, Artificial Sequence
  Description of Artificial Sequence: Synthetic oligonucleotide
  Target: SCN9A; (+) strand; PAM type: NRG; PAM sequence: CAG
gcagaggttgtaatttggaa

SEQ ID NO: 38703 - DNA, 20 bp, Artificial Sequence
  Description of Artificial Sequence: Synthetic oligonucleotide
  Target: SCN9A; (+) strand; PAM type: NRG; PAM sequence: AGG
cagaggttgtaatttggaac

SEQ ID NO: 38704 - DNA, 20 bp, Artificial Sequence
  Description of Artificial Sequence: Synthetic oligonucleotide
  Target: SCN9A; (+) strand; PAM type: NRG; PAM sequence: AAG
ggcaaatcatactgttgcca

SEQ ID NO: 38705 - DNA, 20 bp, Artificial Sequence
  Description of Artificial Sequence: Synthetic oligonucleotide
  Target: SCN9A; (+) strand; PAM type: NRG; PAM sequence: AGG
gcaaatcatactgttgccaa

SEQ ID NO: 38706 - DNA, 20 bp, Artificial Sequence
  Description of Artificial Sequence: Synthetic oligonucleotide
  Target: SCN9A; (+) strand; PAM type: NRG; PAM sequence: TAG
ttccatcttcctttttaaca

SEQ ID NO: 38707 - DNA, 20 bp, Artificial Sequence
  Description of Artificial Sequence: Synthetic oligonucleotide
  Target: SCN9A; (+) strand; PAM type: NRG; PAM sequence: AGG
tccatcttcctttttaacat

SEQ ID NO: 38708 - DNA, 20 bp, Artificial Sequence
  Description of Artificial Sequence: Synthetic oligonucleotide
  Target: SCN9A; (+) strand; PAM type: NRG; PAM sequence: AAG
cttcctttttaacataggca

SEQ ID NO: 38709 - DNA, 20 bp, Artificial Sequence
  Description of Artificial Sequence: Synthetic oligonucleotide
  Target: SCN9A; (+) strand; PAM type: NRG; PAM sequence: TGG
ctttttaacataggcaaagt

SEQ ID NO: 38710 - DNA, 20 bp, Artificial Sequence
  Description of Artificial Sequence: Synthetic oligonucleotide
  Target: SCN9A; (+) strand; PAM type: NRG; PAM sequence: AAG
aggcaaagttggacattcca

SEQ ID NO: 38711 - DNA, 20 bp, Artificial Sequence
  Description of Artificial Sequence: Synthetic oligonucleotide
  Target: SCN9A; (+) strand; PAM type: NRG; PAM sequence: TGG
aaagttggacattccaaaga

SEQ ID NO: 38712 - DNA, 20 bp, Artificial Sequence
  Description of Artificial Sequence: Synthetic oligonucleotide
  Target: SCN9A; (+) strand; PAM type: NRG; PAM sequence: TAG
tggacattccaaagatggcg

SEQ ID NO: 38713 - DNA, 20 bp, Artificial Sequence
  Description of Artificial Sequence: Synthetic oligonucleotide
  Target: SCN9A; (+) strand; PAM type: NRG; PAM sequence: CAG
atggcgtagatgaacatgac

SEQ ID NO: 38714 - DNA, 20 bp, Artificial Sequence
  Description of Artificial Sequence: Synthetic oligonucleotide
  Target: SCN9A; (+) strand; PAM type: NRG; PAM sequence: AGG
tggcgtagatgaacatgacc

SEQ ID NO: 38715 - DNA, 20 bp, Artificial Sequence
  Description of Artificial Sequence: Synthetic oligonucleotide
  Target: SCN9A; (+) strand; PAM type: NRG; PAM sequence: AAG
cgtagatgaacatgaccagg

SEQ ID NO: 38716 - DNA, 20 bp, Artificial Sequence
  Description of Artificial Sequence: Synthetic oligonucleotide
  Target: SCN9A; (+) strand; PAM type: NRG; PAM sequence: GAG
tagatgaacatgaccaggaa

SEQ ID NO: 38717 - DNA, 20 bp, Artificial Sequence
  Description of Artificial Sequence: Synthetic oligonucleotide
  Target: SCN9A; (+) strand; PAM type: NRG; PAM sequence: CAG
atgaacatgaccaggaagag

SEQ ID NO: 38718 - DNA, 20 bp, Artificial Sequence
  Description of Artificial Sequence: Synthetic oligonucleotide
  Target: SCN9A; (+) strand; PAM type: NRG; PAM sequence: AGG
tgaacatgaccaggaagagc

SEQ ID NO: 38719 - DNA, 20 bp, Artificial Sequence
  Description of Artificial Sequence: Synthetic oligonucleotide
  Target: SCN9A; (+) strand; PAM type: NRG; PAM sequence: GAG
aacatgaccaggaagagcag

SEQ ID NO: 38720 - DNA, 20 bp, Artificial Sequence
  Description of Artificial Sequence: Synthetic oligonucleotide
  Target: SCN9A; (+) strand; PAM type: NRG; PAM sequence: AGG
acatgaccaggaagagcagg

SEQ ID NO: 38721 - DNA, 20 bp, Artificial Sequence
  Description of Artificial Sequence: Synthetic oligonucleotide
  Target: SCN9A; (+) strand; PAM type: NRG; PAM sequence: CAG
gaggccgatgttaaacaacg

SEQ ID NO: 38722 - DNA, 20 bp, Artificial Sequence
  Description of Artificial Sequence: Synthetic oligonucleotide
  Target: SCN9A; (+) strand; PAM type: NRG; PAM sequence: AGG
aggccgatgttaaacaacgc

SEQ ID NO: 38723 - DNA, 20 bp, Artificial Sequence
  Description of Artificial Sequence: Synthetic oligonucleotide
  Target: SCN9A; (+) strand; PAM type: NRG; PAM sequence: AAG
ccgatgttaaacaacgcagg

SEQ ID NO: 38724 - DNA, 20 bp, Artificial Sequence
  Description of Artificial Sequence: Synthetic oligonucleotide
  Target: SCN9A; (+) strand; PAM type: NRG; PAM sequence: AGG
cgatgttaaacaacgcagga

SEQ ID NO: 38725 - DNA, 20 bp, Artificial Sequence
  Description of Artificial Sequence: Synthetic oligonucleotide
  Target: SCN9A; (+) strand; PAM type: NRG; PAM sequence: GGG
gatgttaaacaacgcaggaa

SEQ ID NO: 38726 - DNA, 20 bp, Artificial Sequence
  Description of Artificial Sequence: Synthetic oligonucleotide
  Target: SCN9A; (+) strand; PAM type: NRG; PAM sequence: AAG
cgcaggaagggacatcatca

SEQ ID NO: 38727 - DNA, 20 bp, Artificial Sequence
  Description of Artificial Sequence: Synthetic oligonucleotide
  Target: SCN9A; (+) strand; PAM type: NRG; PAM sequence: AAG
gaagggacatcatcaaagca

SEQ ID NO: 38728 - DNA, 20 bp, Artificial Sequence
  Description of Artificial Sequence: Synthetic oligonucleotide
  Target: SCN9A; (+) strand; PAM type: NRG; PAM sequence: GAG
agggacatcatcaaagcaaa

SEQ ID NO: 38729 - DNA, 20 bp, Artificial Sequence
  Description of Artificial Sequence: Synthetic oligonucleotide
  Target: SCN9A; (+) strand; PAM type: NRG; PAM sequence: CAG
gacatcatcaaagcaaagag

SEQ ID NO: 38730 - DNA, 20 bp, Artificial Sequence
  Description of Artificial Sequence: Synthetic oligonucleotide
  Target: SCN9A; (+) strand; PAM type: NRG; PAM sequence: CGG
tcaaagcaaagagcagcgtg

SEQ ID NO: 38731 - DNA, 20 bp, Artificial Sequence
  Description of Artificial Sequence: Synthetic oligonucleotide
  Target: SCN9A; (+) strand; PAM type: NRG; PAM sequence: TAG
atcccctttgctcctttgac

SEQ ID NO: 38732 - DNA, 20 bp, Artificial Sequence
  Description of Artificial Sequence: Synthetic oligonucleotide
  Target: SCN9A; (+) strand; PAM type: NRG; PAM sequence: TAG
tttgctcctttgactagacg

SEQ ID NO: 38733 - DNA, 20 bp, Artificial Sequence
  Description of Artificial Sequence: Synthetic oligonucleotide
  Target: SCN9A; (+) strand; PAM type: NRG; PAM sequence: AGG
ttgctcctttgactagacgt

SEQ ID NO: 38734 - DNA, 20 bp, Artificial Sequence
  Description of Artificial Sequence: Synthetic oligonucleotide
  Target: SCN9A; (+) strand; PAM type: NRG; PAM sequence: CGG
ctttgactagacgtaggatt

SEQ ID NO: 38735 - DNA, 20 bp, Artificial Sequence
  Description of Artificial Sequence: Synthetic oligonucleotide
  Target: SCN9A; (+) strand; PAM type: NRG; PAM sequence: TGG
acgtaggattcggccaatcc

SEQ ID NO: 38736 - DNA, 20 bp, Artificial Sequence
  Description of Artificial Sequence: Synthetic oligonucleotide
  Target: SCN9A; (+) strand; PAM type: NRG; PAM sequence: AAG
aggattcggccaatcctggc

SEQ ID NO: 38737 - DNA, 20 bp, Artificial Sequence
  Description of Artificial Sequence: Synthetic oligonucleotide
  Target: SCN9A; (+) strand; PAM type: NRG; PAM sequence: CGG
ttcggccaatcctggcaaga

SEQ ID NO: 38738 - DNA, 20 bp, Artificial Sequence
  Description of Artificial Sequence: Synthetic oligonucleotide
  Target: SCN9A; (+) strand; PAM type: NRG; PAM sequence: CGG
tcctggcaagacggatcact

SEQ ID NO: 38739 - DNA, 20 bp, Artificial Sequence
  Description of Artificial Sequence: Synthetic oligonucleotide
  Target: SCN9A; (+) strand; PAM type: NRG; PAM sequence: CAG
gcaagacggatcactcggaa

SEQ ID NO: 38740 - DNA, 20 bp, Artificial Sequence
  Description of Artificial Sequence: Synthetic oligonucleotide
  Target: SCN9A; (+) strand; PAM type: NRG; PAM sequence: AGG
caagacggatcactcggaac

SEQ ID NO: 38741 - DNA, 20 bp, Artificial Sequence
  Description of Artificial Sequence: Synthetic oligonucleotide
  Target: SCN9A; (+) strand; PAM type: NRG; PAM sequence: GGG
aagacggatcactcggaaca

SEQ ID NO: 38742 - DNA, 20 bp, Artificial Sequence
  Description of Artificial Sequence: Synthetic oligonucleotide
  Target: SCN9A; (+) strand; PAM type: NRG; PAM sequence: TAG
acggatcactcggaacaggg

SEQ ID NO: 38743 - DNA, 20 bp, Artificial Sequence
  Description of Artificial Sequence: Synthetic oligonucleotide
  Target: SCN9A; (+) strand; PAM type: NRG; PAM sequence: AGG
cggatcactcggaacagggt

SEQ ID NO: 38744 - DNA, 20 bp, Artificial Sequence
  Description of Artificial Sequence: Synthetic oligonucleotide
  Target: SCN9A; (+) strand; PAM type: NRG; PAM sequence: GGG
ggatcactcggaacagggta

SEQ ID NO: 38745 - DNA, 20 bp, Artificial Sequence
  Description of Artificial Sequence: Synthetic oligonucleotide
  Target: SCN9A; (+) strand; PAM type: NRG; PAM sequence: GGG
gatcactcggaacagggtag

SEQ ID NO: 38746 - DNA, 20 bp, Artificial Sequence
  Description of Artificial Sequence: Synthetic oligonucleotide
  Target: SCN9A; (+) strand; PAM type: NRG; PAM sequence: CAG
aaaatacgtttcaatcaaat

SEQ ID NO: 38747 - DNA, 20 bp, Artificial Sequence
  Description of Artificial Sequence: Synthetic oligonucleotide
  Target: SCN9A; (+) strand; PAM type: NRG; PAM sequence: TAG
tacgtttcaatcaaatcagc

SEQ ID NO: 38748 - DNA, 20 bp, Artificial Sequence
  Description of Artificial Sequence: Synthetic oligonucleotide
  Target: SCN9A; (+) strand; PAM type: NRG; PAM sequence: TGG
gctagaaacatacctgtatg

SEQ ID NO: 38749 - DNA, 20 bp, Artificial Sequence
  Description of Artificial Sequence: Synthetic oligonucleotide
  Target: SCN9A; (+) strand; PAM type: NRG; PAM sequence: GAG
tagaaacatacctgtatgtg

SEQ ID NO: 38750 - DNA, 20 bp, Artificial Sequence
  Description of Artificial Sequence: Synthetic oligonucleotide
  Target: SCN9A; (+) strand; PAM type: NRG; PAM sequence: AGG
agaaacatacctgtatgtgg

SEQ ID NO: 38751 - DNA, 20 bp, Artificial Sequence
  Description of Artificial Sequence: Synthetic oligonucleotide
  Target: SCN9A; (+) strand; PAM type: NRG; PAM sequence: TAG
ctgtatgtggaggaaaataa

SEQ ID NO: 38752 - DNA, 20 bp, Artificial Sequence
  Description of Artificial Sequence: Synthetic oligonucleotide
  Target: SCN9A; (+) strand; PAM type: NRG; PAM sequence: AAG
taatagaaataaaatattta

SEQ ID NO: 38753 - DNA, 20 bp, Artificial Sequence
  Description of Artificial Sequence: Synthetic oligonucleotide
  Target: SCN9A; (+) strand; PAM type: NRG; PAM sequence: CAG
cctgaaatgatgactctaaa

SEQ ID NO: 38754 - DNA, 20 bp, Artificial Sequence
  Description of Artificial Sequence: Synthetic oligonucleotide
  Target: SCN9A; (+) strand; PAM type: NRG; PAM sequence: AAG
aactcatttcttatgaattc

SEQ ID NO: 38755 - DNA, 20 bp, Artificial Sequence
  Description of Artificial Sequence: Synthetic oligonucleotide
  Target: SCN9A; (+) strand; PAM type: NRG; PAM sequence: CAG
catttcttatgaattcaaga

SEQ ID NO: 38756 - DNA, 20 bp, Artificial Sequence
  Description of Artificial Sequence: Synthetic oligonucleotide
  Target: SCN9A; (+) strand; PAM type: NRG; PAM sequence: GAG
tttttttttttttttttttt

SEQ ID NO: 38757 - DNA, 20 bp, Artificial Sequence
  Description of Artificial Sequence: Synthetic oligonucleotide
  Target: SCN9A; (+) strand; PAM type: NRG; PAM sequence: CGG
ttttttttttttttttgaga

SEQ ID NO: 38758 - DNA, 20 bp, Artificial Sequence
  Description of Artificial Sequence: Synthetic oligonucleotide
  Target: SCN9A; (+) strand; PAM type: NRG; PAM sequence: GAG
ttttttttttttttgagacg

SEQ ID NO: 38759 - DNA, 20 bp, Artificial Sequence
  Description of Artificial Sequence: Synthetic oligonucleotide
  Target: SCN9A; (+) strand; PAM type: NRG; PAM sequence: CAG
cggagtctcgctctgtcgcc

SEQ ID NO: 38760 - DNA, 20 bp, Artificial Sequence
  Description of Artificial Sequence: Synthetic oligonucleotide
  Target: SCN9A; (+) strand; PAM type: NRG; PAM sequence: AGG
ggagtctcgctctgtcgccc

SEQ ID NO: 38761 - DNA, 20 bp, Artificial Sequence
  Description of Artificial Sequence: Synthetic oligonucleotide
  Target: SCN9A; (+) strand; PAM type: NRG; PAM sequence: TGG
tctcgctctgtcgcccaggc

SEQ ID NO: 38762 - DNA, 20 bp, Artificial Sequence
  Description of Artificial Sequence: Synthetic oligonucleotide
  Target: SCN9A; (+) strand; PAM type: NRG; PAM sequence: GAG
tcgctctgtcgcccaggctg

SEQ ID NO: 38763 - DNA, 20 bp, Artificial Sequence
  Description of Artificial Sequence: Synthetic oligonucleotide
  Target: SCN9A; (+) strand; PAM type: NRG; PAM sequence: CAG
ctgtcgcccaggctggagtg

SEQ ID NO: 38764 - DNA, 20 bp, Artificial Sequence
  Description of Artificial Sequence: Synthetic oligonucleotide
  Target: SCN9A; (+) strand; PAM type: NRG; PAM sequence: TGG
tcgcccaggctggagtgcag

SEQ ID NO: 38765 - DNA, 20 bp, Artificial Sequence
  Description of Artificial Sequence: Synthetic oligonucleotide
  Target: SCN9A; (+) strand; PAM type: NRG; PAM sequence: CGG
ggagtgcagtggcgcgatct

SEQ ID NO: 38766 - DNA, 20 bp, Artificial Sequence
  Description of Artificial Sequence: Synthetic oligonucleotide
  Target: SCN9A; (+) strand; PAM type: NRG; PAM sequence: AAG
gcgcgatctcggctcactgc

SEQ ID NO: 38767 - DNA, 20 bp, Artificial Sequence
  Description of Artificial Sequence: Synthetic oligonucleotide
  Target: SCN9A; (+) strand; PAM type: NRG; PAM sequence: CGG
tcactgcaagctccgcctcc

SEQ ID NO: 38768 - DNA, 20 bp, Artificial Sequence
  Description of Artificial Sequence: Synthetic oligonucleotide
  Target: SCN9A; (+) strand; PAM type: NRG; PAM sequence: GGG
cactgcaagctccgcctccc

SEQ ID NO: 38769 - DNA, 20 bp, Artificial Sequence
  Description of Artificial Sequence: Synthetic oligonucleotide
  Target: SCN9A; (+) strand; PAM type: NRG; PAM sequence: CAG
ttcacgccattctcctgcct

SEQ ID NO: 38770 - DNA, 20 bp, Artificial Sequence
  Description of Artificial Sequence: Synthetic oligonucleotide
  Target: SCN9A; (+) strand; PAM type: NRG; PAM sequence: GAG
ttctcctgcctcagcctccc

SEQ ID NO: 38771 - DNA, 20 bp, Artificial Sequence
  Description of Artificial Sequence: Synthetic oligonucleotide
  Target: SCN9A; (+) strand; PAM type: NRG; PAM sequence: TAG
tcctgcctcagcctcccgag

SEQ ID NO: 38772 - DNA, 20 bp, Artificial Sequence
  Description of Artificial Sequence: Synthetic oligonucleotide
  Target: SCN9A; (+) strand; PAM type: NRG; PAM sequence: TGG
gcctcagcctcccgagtagc

SEQ ID NO: 38773 - DNA, 20 bp, Artificial Sequence
  Description of Artificial Sequence: Synthetic oligonucleotide
  Target: SCN9A; (+) strand; PAM type: NRG; PAM sequence: GGG
cctcagcctcccgagtagct

SEQ ID NO: 38774 - DNA, 20 bp, Artificial Sequence
  Description of Artificial Sequence: Synthetic oligonucleotide
  Target: SCN9A; (+) strand; PAM type: NRG; PAM sequence: CAG
ctcccgagtagctgggacta

SEQ ID NO: 38775 - DNA, 20 bp, Artificial Sequence
  Description of Artificial Sequence: Synthetic oligonucleotide
  Target: SCN9A; (+) strand; PAM type: NRG; PAM sequence: AGG
tcccgagtagctgggactac

SEQ ID NO: 38776 - DNA, 20 bp, Artificial Sequence
  Description of Artificial Sequence: Synthetic oligonucleotide
  Target: SCN9A; (+) strand; PAM type: NRG; PAM sequence: CGG
caggcgcccgctaccacgcc

SEQ ID NO: 38777 - DNA, 20 bp, Artificial Sequence
  Description of Artificial Sequence: Synthetic oligonucleotide
  Target: SCN9A; (+) strand; PAM type: NRG; PAM sequence: TAG
cggctaattttttgtatttt

SEQ ID NO: 38778 - DNA, 20 bp, Artificial Sequence
  Description of Artificial Sequence: Synthetic oligonucleotide
  Target: SCN9A; (+) strand; PAM type: NRG; PAM sequence: TAG
ctaattttttgtatttttag

SEQ ID NO: 38779 - DNA, 20 bp, Artificial Sequence
  Description of Artificial Sequence: Synthetic oligonucleotide
  Target: SCN9A; (+) strand; PAM type: NRG; PAM sequence: GAG
aattttttgtatttttagta

SEQ ID NO: 38780 - DNA, 20 bp, Artificial Sequence
  Description of Artificial Sequence: Synthetic oligonucleotide
  Target: SCN9A; (+) strand; PAM type: NRG; PAM sequence: CGG
ttttgtatttttagtagaga

SEQ ID NO: 38781 - DNA, 20 bp, Artificial Sequence
  Description of Artificial Sequence: Synthetic oligonucleotide
  Target: SCN9A; (+) strand; PAM type: NRG; PAM sequence: GGG
tttgtatttttagtagagac

SEQ ID NO: 38782 - DNA, 20 bp, Artificial Sequence
  Description of Artificial Sequence: Synthetic oligonucleotide
  Target: SCN9A; (+) strand; PAM type: NRG; PAM sequence: GGG
ttgtatttttagtagagacg

SEQ ID NO: 38783 - DNA, 20 bp, Artificial Sequence
  Description of Artificial Sequence: Synthetic oligonucleotide
  Target: SCN9A; (+) strand; PAM type: NRG; PAM sequence: TAG
gagacggggtttcaccttgt

SEQ ID NO: 38784 - DNA, 20 bp, Artificial Sequence
  Description of Artificial Sequence: Synthetic oligonucleotide
  Target: SCN9A; (+) strand; PAM type: NRG; PAM sequence: CAG
cggggtttcaccttgttagc

SEQ ID NO: 38785 - DNA, 20 bp, Artificial Sequence
  Description of Artificial Sequence: Synthetic oligonucleotide
  Target: SCN9A; (+) strand; PAM type: NRG; PAM sequence: AGG
ggggtttcaccttgttagcc

SEQ ID NO: 38786 - DNA, 20 bp, Artificial Sequence
  Description of Artificial Sequence: Synthetic oligonucleotide
  Target: SCN9A; (+) strand; PAM type: NRG; PAM sequence: TGG
tttcaccttgttagccagga

SEQ ID NO: 38787 - DNA, 20 bp, Artificial Sequence
  Description of Artificial Sequence: Synthetic oligonucleotide
  Target: SCN9A; (+) strand; PAM type: NRG; PAM sequence: CGG
acctcgtgatccgcccgcct

SEQ ID NO: 38788 - DNA, 20 bp, Artificial Sequence
  Description of Artificial Sequence: Synthetic oligonucleotide
  Target: SCN9A; (+) strand; PAM type: NRG; PAM sequence: AAG
ccgcccgcctcggcctccca

SEQ ID NO: 38789 - DNA, 20 bp, Artificial Sequence
  Description of Artificial Sequence: Synthetic oligonucleotide
  Target: SCN9A; (+) strand; PAM type: NRG; PAM sequence: TGG
gcctcggcctcccaaagtgc

SEQ ID NO: 38790 - DNA, 20 bp, Artificial Sequence
  Description of Artificial Sequence: Synthetic oligonucleotide
  Target: SCN9A; (+) strand; PAM type: NRG; PAM sequence: GGG
cctcggcctcccaaagtgct

SEQ ID NO: 38791 - DNA, 20 bp, Artificial Sequence
  Description of Artificial Sequence: Synthetic oligonucleotide
  Target: SCN9A; (+) strand; PAM type: NRG; PAM sequence: CAG
ctcccaaagtgctgggatta

SEQ ID NO: 38792 - DNA, 20 bp, Artificial Sequence
  Description of Artificial Sequence: Synthetic oligonucleotide
  Target: SCN9A; (+) strand; PAM type: NRG; PAM sequence: AGG
tcccaaagtgctgggattac

SEQ ID NO: 38793 - DNA, 20 bp, Artificial Sequence
  Description of Artificial Sequence: Synthetic oligonucleotide
  Target: SCN9A; (+) strand; PAM type: NRG; PAM sequence: GAG
agtgctgggattacaggcgt

SEQ ID NO: 38794 - DNA, 20 bp, Artificial Sequence
  Description of Artificial Sequence: Synthetic oligonucleotide
  Target: SCN9A; (+) strand; PAM type: NRG; PAM sequence: CGG
caggcgtgagccaccgtgcc

SEQ ID NO: 38795 - DNA, 20 bp, Artificial Sequence
  Description of Artificial Sequence: Synthetic oligonucleotide
  Target: SCN9A; (+) strand; PAM type: NRG; PAM sequence: AAG
gtgagccaccgtgcccggcc

SEQ ID NO: 38796 - DNA, 20 bp, Artificial Sequence
  Description of Artificial Sequence: Synthetic oligonucleotide
  Target: SCN9A; (+) strand; PAM type: NRG; PAM sequence: CAG
gccaccgtgcccggccaaga

SEQ ID NO: 38797 - DNA, 20 bp, Artificial Sequence
  Description of Artificial Sequence: Synthetic oligonucleotide
  Target: SCN9A; (+) strand; PAM type: NRG; PAM sequence: AAG
ctgaatgcaattacttaaaa

SEQ ID NO: 38798 - DNA, 20 bp, Artificial Sequence
  Description of Artificial Sequence: Synthetic oligonucleotide
  Target: SCN9A; (+) strand; PAM type: NRG; PAM sequence: AGG
tgaatgcaattacttaaaaa

SEQ ID NO: 38799 - DNA, 20 bp, Artificial Sequence
  Description of Artificial Sequence: Synthetic oligonucleotide
  Target: SCN9A; (+) strand; PAM type: NRG; PAM sequence: AAG
caattacttaaaaaaggatt

SEQ ID NO: 38800 - DNA, 20 bp, Artificial Sequence
  Description of Artificial Sequence: Synthetic oligonucleotide
  Target: SCN9A; (+) strand; PAM type: NRG; PAM sequence: AAG
aaaaggattaagaaattcca

SEQ ID NO: 38801 - DNA, 20 bp, Artificial Sequence
  Description of Artificial Sequence: Synthetic oligonucleotide
  Target: SCN9A; (+) strand; PAM type: NRG; PAM sequence: GAG
aaggattaagaaattccaaa

SEQ ID NO: 38802 - DNA, 20 bp, Artificial Sequence
  Description of Artificial Sequence: Synthetic oligonucleotide
  Target: SCN9A; (+) strand; PAM type: NRG; PAM sequence: AAG
gacattttctcctttttact

SEQ ID NO: 38803 - DNA, 20 bp, Artificial Sequence
  Description of Artificial Sequence: Synthetic oligonucleotide
  Target: SCN9A; (+) strand; PAM type: NRG; PAM sequence: TGG
tctcctttttactaagttca

SEQ ID NO: 38804 - DNA, 20 bp, Artificial Sequence
  Description of Artificial Sequence: Synthetic oligonucleotide
  Target: SCN9A; (+) strand; PAM type: NRG; PAM sequence: GGG
ctcctttttactaagttcat

SEQ ID NO: 38805 - DNA, 20 bp, Artificial Sequence
  Description of Artificial Sequence: Synthetic oligonucleotide
  Target: SCN9A; (+) strand; PAM type: NRG; PAM sequence: TAG
gccattttttccctccataa

SEQ ID NO: 38806 - DNA, 20 bp, Artificial Sequence
  Description of Artificial Sequence: Synthetic oligonucleotide
  Target: SCN9A; (+) strand; PAM type: NRG; PAM sequence: AAG
ataatagtgttttacatttt

SEQ ID NO: 38807 - DNA, 20 bp, Artificial Sequence
  Description of Artificial Sequence: Synthetic oligonucleotide
  Target: SCN9A; (+) strand; PAM type: NRG; PAM sequence: TAG
aagaatgatacctactcaca

SEQ ID NO: 38808 - DNA, 20 bp, Artificial Sequence
  Description of Artificial Sequence: Synthetic oligonucleotide
  Target: SCN9A; (+) strand; PAM type: NRG; PAM sequence: AAG
cctactcacatagaaaattc

SEQ ID NO: 38809 - DNA, 20 bp, Artificial Sequence
  Description of Artificial Sequence: Synthetic oligonucleotide
  Target: SCN9A; (+) strand; PAM type: NRG; PAM sequence: AAG
caataccgttaaatgctaaa

SEQ ID NO: 38810 - DNA, 20 bp, Artificial Sequence
  Description of Artificial Sequence: Synthetic oligonucleotide
  Target: SCN9A; (+) strand; PAM type: NRG; PAM sequence: GAG
actattatcaatattttttt

SEQ ID NO: 38811 - DNA, 20 bp, Artificial Sequence
  Description of Artificial Sequence: Synthetic oligonucleotide
  Target: SCN9A; (+) strand; PAM type: NRG; PAM sequence: CAG
tatttttttgagtatcactt

SEQ ID NO: 38812 - DNA, 20 bp, Artificial Sequence
  Description of Artificial Sequence: Synthetic oligonucleotide
  Target: SCN9A; (+) strand; PAM type: NRG; PAM sequence: AAG
cttcagacatttttctgtgc

SEQ ID NO: 38813 - DNA, 20 bp, Artificial Sequence
  Description of Artificial Sequence: Synthetic oligonucleotide
  Target: SCN9A; (+) strand; PAM type: NRG; PAM sequence: AAG
caaatgtattcatgttatat

SEQ ID NO: 38814 - DNA, 20 bp, Artificial Sequence
  Description of Artificial Sequence: Synthetic oligonucleotide
  Target: SCN9A; (+) strand; PAM type: NRG; PAM sequence: AAG
aacctatttatttatttttc

SEQ ID NO: 38815 - DNA, 20 bp, Artificial Sequence
  Description of Artificial Sequence: Synthetic oligonucleotide
  Target: SCN9A; (+) strand; PAM type: NRG; PAM sequence: CAG
tatttatttatttttcaaga

SEQ ID NO: 38816 - DNA, 20 bp, Artificial Sequence
  Description of Artificial Sequence: Synthetic oligonucleotide
  Target: SCN9A; (+) strand; PAM type: NRG; PAM sequence: GAG
tttatttatttttcaagaca

SEQ ID NO: 38817 - DNA, 20 bp, Artificial Sequence
  Description of Artificial Sequence: Synthetic oligonucleotide
  Target: SCN9A; (+) strand; PAM type: NRG; PAM sequence: AAG
agagtcttgctctgtcgcca

SEQ ID NO: 38818 - DNA, 20 bp, Artificial Sequence
  Description of Artificial Sequence: Synthetic oligonucleotide
  Target: SCN9A; (+) strand; PAM type: NRG; PAM sequence: TGG
tcttgctctgtcgccaaagc

SEQ ID NO: 38819 - DNA, 20 bp, Artificial Sequence
  Description of Artificial Sequence: Synthetic oligonucleotide
  Target: SCN9A; (+) strand; PAM type: NRG; PAM sequence: GAG
ttgctctgtcgccaaagctg

SEQ ID NO: 38820 - DNA, 20 bp, Artificial Sequence
  Description of Artificial Sequence: Synthetic oligonucleotide
  Target: SCN9A; (+) strand; PAM type: NRG; PAM sequence: CGG
ctgtcgccaaagctggagtg

SEQ ID NO: 38821 - DNA, 20 bp, Artificial Sequence
  Description of Artificial Sequence: Synthetic oligonucleotide
  Target: SCN9A; (+) strand; PAM type: NRG; PAM sequence: TGG
tcgccaaagctggagtgcgg

SEQ ID NO: 38822 - DNA, 20 bp, Artificial Sequence
  Description of Artificial Sequence: Synthetic oligonucleotide
  Target: SCN9A; (+) strand; PAM type: NRG; PAM sequence: TGG
ggagtgcggtggtgtgatct

SEQ ID NO: 38823 - DNA, 20 bp, Artificial Sequence
  Description of Artificial Sequence: Synthetic oligonucleotide
  Target: SCN9A; (+) strand; PAM type: NRG; PAM sequence: CGG
ctactgcaatctctgcatcc

SEQ ID NO: 38824 - DNA, 20 bp, Artificial Sequence
  Description of Artificial Sequence: Synthetic oligonucleotide
  Target: SCN9A; (+) strand; PAM type: NRG; PAM sequence: GGG
tactgcaatctctgcatccc

SEQ ID NO: 38825 - DNA, 20 bp, Artificial Sequence
  Description of Artificial Sequence: Synthetic oligonucleotide
  Target: SCN9A; (+) strand; PAM type: NRG; PAM sequence: CAG
cccgggatcaaatgattctc

SEQ ID NO: 38826 - DNA, 20 bp, Artificial Sequence
  Description of Artificial Sequence: Synthetic oligonucleotide
  Target: SCN9A; (+) strand; PAM type: NRG; PAM sequence: CAG
atcaaatgattctccagcct

SEQ ID NO: 38827 - DNA, 20 bp, Artificial Sequence
  Description of Artificial Sequence: Synthetic oligonucleotide
  Target: SCN9A; (+) strand; PAM type: NRG; PAM sequence: CAG
gattctccagcctcagcctc

SEQ ID NO: 38828 - DNA, 20 bp, Artificial Sequence
  Description of Artificial Sequence: Synthetic oligonucleotide
  Target: SCN9A; (+) strand; PAM type: NRG; PAM sequence: GAG
ttctccagcctcagcctcca

SEQ ID NO: 38829 - DNA, 20 bp, Artificial Sequence
  Description of Artificial Sequence: Synthetic oligonucleotide
  Target: SCN9A; (+) strand; PAM type: NRG; PAM sequence: TAG
tccagcctcagcctccagag

SEQ ID NO: 38830 - DNA, 20 bp, Artificial Sequence
  Description of Artificial Sequence: Synthetic oligonucleotide
  Target: SCN9A; (+) strand; PAM type: NRG; PAM sequence: TGG
gcctcagcctccagagtagc

SEQ ID NO: 38831 - DNA, 20 bp, Artificial Sequence
  Description of Artificial Sequence: Synthetic oligonucleotide
  Target: SCN9A; (+) strand; PAM type: NRG; PAM sequence: GGG
cctcagcctccagagtagct

SEQ ID NO: 38832 - DNA, 20 bp, Artificial Sequence
  Description of Artificial Sequence: Synthetic oligonucleotide
  Target: SCN9A; (+) strand; PAM type: NRG; PAM sequence: CAG
ctccagagtagctgggacta

SEQ ID NO: 38833 - DNA, 20 bp, Artificial Sequence
  Description of Artificial Sequence: Synthetic oligonucleotide
  Target: SCN9A; (+) strand; PAM type: NRG; PAM sequence: AGG
tccagagtagctgggactac

SEQ ID NO: 38834 - DNA, 20 bp, Artificial Sequence
  Description of Artificial Sequence: Synthetic oligonucleotide
  Target: SCN9A; (+) strand; PAM type: NRG; PAM sequence: TGG
caggcatgcgccaccacacc

SEQ ID NO: 38835 - DNA, 20 bp, Artificial Sequence
  Description of Artificial Sequence: Synthetic oligonucleotide
  Target: SCN9A; (+) strand; PAM type: NRG; PAM sequence: TGG
ctggttaatttttgtgtttt

SEQ ID NO: 38836 - DNA, 20 bp, Artificial Sequence
  Description of Artificial Sequence: Synthetic oligonucleotide
  Target: SCN9A; (+) strand; PAM type: NRG; PAM sequence: TAG
gttaatttttgtgtttttgg

SEQ ID NO: 38837 - DNA, 20 bp, Artificial Sequence
  Description of Artificial Sequence: Synthetic oligonucleotide
  Target: SCN9A; (+) strand; PAM type: NRG; PAM sequence: AGG
ttaatttttgtgtttttggt

SEQ ID NO: 38838 - DNA, 20 bp, Artificial Sequence
  Description of Artificial Sequence: Synthetic oligonucleotide
  Target: SCN9A; (+) strand; PAM type: NRG; PAM sequence: GGG
taatttttgtgtttttggta

SEQ ID NO: 38839 - DNA, 20 bp, Artificial Sequence
  Description of Artificial Sequence: Synthetic oligonucleotide
  Target: SCN9A; (+) strand; PAM type: NRG; PAM sequence: CGG
ttttgtgtttttggtaggga

SEQ ID NO: 38840 - DNA, 20 bp, Artificial Sequence
  Description of Artificial Sequence: Synthetic oligonucleotide
  Target: SCN9A; (+) strand; PAM type: NRG; PAM sequence: TGG
agggacggttttcaccttgt

SEQ ID NO: 38841 - DNA, 20 bp, Artificial Sequence
  Description of Artificial Sequence: Synthetic oligonucleotide
  Target: SCN9A; (+) strand; PAM type: NRG; PAM sequence: CAG
acggttttcaccttgttggc

SEQ ID NO: 38842 - DNA, 20 bp, Artificial Sequence
  Description of Artificial Sequence: Synthetic oligonucleotide
  Target: SCN9A; (+) strand; PAM type: NRG; PAM sequence: AGG
cggttttcaccttgttggcc

SEQ ID NO: 38843 - DNA, 20 bp, Artificial Sequence
  Description of Artificial Sequence: Synthetic oligonucleotide
  Target: SCN9A; (+) strand; PAM type: NRG; PAM sequence: TGG
tttcaccttgttggccaggc

SEQ ID NO: 38844 - DNA, 20 bp, Artificial Sequence
  Description of Artificial Sequence: Synthetic oligonucleotide
  Target: SCN9A; (+) strand; PAM type: NRG; PAM sequence: AAG
ggtctcaaacttctgacttc

SEQ ID NO: 38845 - DNA, 20 bp, Artificial Sequence
  Description of Artificial Sequence: Synthetic oligonucleotide
  Target: SCN9A; (+) strand; PAM type: NRG; PAM sequence: CGG
tcaagtgatttcgcccacct

SEQ ID NO: 38846 - DNA, 20 bp, Artificial Sequence
  Description of Artificial Sequence: Synthetic oligonucleotide
  Target: SCN9A; (+) strand; PAM type: NRG; PAM sequence: TGG
acctcggcctcccaatgtgc

SEQ ID NO: 38847 - DNA, 20 bp, Artificial Sequence
  Description of Artificial Sequence: Synthetic oligonucleotide
  Target: SCN9A; (+) strand; PAM type: NRG; PAM sequence: GGG
cctcggcctcccaatgtgct

SEQ ID NO: 38848 - DNA, 20 bp, Artificial Sequence
  Description of Artificial Sequence: Synthetic oligonucleotide
  Target: SCN9A; (+) strand; PAM type: NRG; PAM sequence: TAG
ctcccaatgtgctgggatta

SEQ ID NO: 38849 - DNA, 20 bp, Artificial Sequence
  Description of Artificial Sequence: Synthetic oligonucleotide
  Target: SCN9A; (+) strand; PAM type: NRG; PAM sequence: AGG
tcccaatgtgctgggattat

SEQ ID NO: 38850 - DNA, 20 bp, Artificial Sequence
  Description of Artificial Sequence: Synthetic oligonucleotide
  Target: SCN9A; (+) strand; PAM type: NRG; PAM sequence: GAG
tgtgctgggattataggcgt

SEQ ID NO: 38851 - DNA, 20 bp, Artificial Sequence
  Description of Artificial Sequence: Synthetic oligonucleotide
  Target: SCN9A; (+) strand; PAM type: NRG; PAM sequence: CAG
gggattataggcgtgagcca

SEQ ID NO: 38852 - DNA, 20 bp, Artificial Sequence
  Description of Artificial Sequence: Synthetic oligonucleotide
  Target: SCN9A; (+) strand; PAM type: NRG; PAM sequence: CAG
taggcgtgagccacagtgcc

SEQ ID NO: 38853 - DNA, 20 bp, Artificial Sequence
  Description of Artificial Sequence: Synthetic oligonucleotide
  Target: SCN9A; (+) strand; PAM type: NRG; PAM sequence: TGG
tttatttactttatatgtca

SEQ ID NO: 38854 - DNA, 20 bp, Artificial Sequence
  Description of Artificial Sequence: Synthetic oligonucleotide
  Target: SCN9A; (+) strand; PAM type: NRG; PAM sequence: GAG
tatttactttatatgtcatg

SEQ ID NO: 38855 - DNA, 20 bp, Artificial Sequence
  Description of Artificial Sequence: Synthetic oligonucleotide
  Target: SCN9A; (+) strand; PAM type: NRG; PAM sequence: TAG
tactttatatgtcatggaga

SEQ ID NO: 38856 - DNA, 20 bp, Artificial Sequence
  Description of Artificial Sequence: Synthetic oligonucleotide
  Target: SCN9A; (+) strand; PAM type: NRG; PAM sequence: TAG
gacaacgaaataatttatta

SEQ ID NO: 38857 - DNA, 20 bp, Artificial Sequence
  Description of Artificial Sequence: Synthetic oligonucleotide
  Target: SCN9A; (+) strand; PAM type: NRG; PAM sequence: TGG
aacgaaataatttattatag

SEQ ID NO: 38858 - DNA, 20 bp, Artificial Sequence
  Description of Artificial Sequence: Synthetic oligonucleotide
  Target: SCN9A; (+) strand; PAM type: NRG; PAM sequence: AAG
ctcaaaataaccacaaattg

SEQ ID NO: 38859 - DNA, 20 bp, Artificial Sequence
  Description of Artificial Sequence: Synthetic oligonucleotide
  Target: SCN9A; (+) strand; PAM type: NRG; PAM sequence: TAG
aataaccacaaattgaagac

SEQ ID NO: 38860 - DNA, 20 bp, Artificial Sequence
  Description of Artificial Sequence: Synthetic oligonucleotide
  Target: SCN9A; (+) strand; PAM type: NRG; PAM sequence: TAG
tactgaaatgaatatctaaa

SEQ ID NO: 38861 - DNA, 20 bp, Artificial Sequence
  Description of Artificial Sequence: Synthetic oligonucleotide
  Target: SCN9A; (+) strand; PAM type: NRG; PAM sequence: GAG
ctatgttctcctaattgcat

SEQ ID NO: 38862 - DNA, 20 bp, Artificial Sequence
  Description of Artificial Sequence: Synthetic oligonucleotide
  Target: SCN9A; (+) strand; PAM type: NRG; PAM sequence: TAG
actttttaataatatgttaa

SEQ ID NO: 38863 - DNA, 20 bp, Artificial Sequence
  Description of Artificial Sequence: Synthetic oligonucleotide
  Target: SCN9A; (+) strand; PAM type: NRG; PAM sequence: TGG
aataatatgttaatagaact

SEQ ID NO: 38864 - DNA, 20 bp, Artificial Sequence
  Description of Artificial Sequence: Synthetic oligonucleotide
  Target: SCN9A; (+) strand; PAM type: NRG; PAM sequence: GGG
ataatatgttaatagaactt

SEQ ID NO: 38865 - DNA, 20 bp, Artificial Sequence
  Description of Artificial Sequence: Synthetic oligonucleotide
  Target: SCN9A; (+) strand; PAM type: NRG; PAM sequence: CAG
gttaatagaacttgggtcaa

SEQ ID NO: 38866 - DNA, 20 bp, Artificial Sequence
  Description of Artificial Sequence: Synthetic oligonucleotide
  Target: SCN9A; (+) strand; PAM type: NRG; PAM sequence: CAG
catactatatatactatata

SEQ ID NO: 38867 - DNA, 20 bp, Artificial Sequence
  Description of Artificial Sequence: Synthetic oligonucleotide
  Target: SCN9A; (+) strand; PAM type: NRG; PAM sequence: TAG
tatatactatatacagtata

SEQ ID NO: 38868 - DNA, 20 bp, Artificial Sequence
  Description of Artificial Sequence: Synthetic oligonucleotide
  Target: SCN9A; (+) strand; PAM type: NRG; PAM sequence: AAG
catatacatatacatatact

SEQ ID NO: 38869 - DNA, 20 bp, Artificial Sequence
  Description of Artificial Sequence: Synthetic oligonucleotide
  Target: SCN9A; (+) strand; PAM type: NRG; PAM sequence: CAG
atactaagtatacgtatata

SEQ ID NO: 38870 - DNA, 20 bp, Artificial Sequence
  Description of Artificial Sequence: Synthetic oligonucleotide
  Target: SCN9A; (+) strand; PAM type: NRG; PAM sequence: TAG
gtatacgtatatacagtaca

SEQ ID NO: 38871 - DNA, 20 bp, Artificial Sequence
  Description of Artificial Sequence: Synthetic oligonucleotide
  Target: SCN9A; (+) strand; PAM type: NRG; PAM sequence: TAG
catagtatatgtatactata

SEQ ID NO: 38872 - DNA, 20 bp, Artificial Sequence
  Description of Artificial Sequence: Synthetic oligonucleotide
  Target: SCN9A; (+) strand; PAM type: NRG; PAM sequence: TAG
tactatatagtatgtatata

SEQ ID NO: 38873 - DNA, 20 bp, Artificial Sequence
  Description of Artificial Sequence: Synthetic oligonucleotide
  Target: SCN9A; (+) strand; PAM type: NRG; PAM sequence: TAG
tagtatgtatatatagcata

SEQ ID NO: 38874 - DNA, 20 bp, Artificial Sequence
  Description of Artificial Sequence: Synthetic oligonucleotide
  Target: SCN9A; (+) strand; PAM type: NRG; PAM sequence: TAG
tagtatgcgtatactctata

SEQ ID NO: 38875 - DNA, 20 bp, Artificial Sequence
  Description of Artificial Sequence: Synthetic oligonucleotide
  Target: SCN9A; (+) strand; PAM type: NRG; PAM sequence: TAG
cgtatactctatatagcata

SEQ ID NO: 38876 - DNA, 20 bp, Artificial Sequence
  Description of Artificial Sequence: Synthetic oligonucleotide
  Target: SCN9A; (+) strand; PAM type: NRG; PAM sequence: TAG
tagtatgcatatacgctata

SEQ ID NO: 38877 - DNA, 20 bp, Artificial Sequence
  Description of Artificial Sequence: Synthetic oligonucleotide
  Target: SCN9A; (+) strand; PAM type: NRG; PAM sequence: TAG
catatacgctatatagcata

SEQ ID NO: 38878 - DNA, 20 bp, Artificial Sequence
  Description of Artificial Sequence: Synthetic oligonucleotide
  Target: SCN9A; (+) strand; PAM type: NRG; PAM sequence: TAG
tagtatgcatatactatata

SEQ ID NO: 38879 - DNA, 20 bp, Artificial Sequence
  Description of Artificial Sequence: Synthetic oligonucleotide
  Target: SCN9A; (+) strand; PAM type: NRG; PAM sequence: TAG
tgcatatactatatatagta

SEQ ID NO: 38880 - DNA, 20 bp, Artificial Sequence
  Description of Artificial Sequence: Synthetic oligonucleotide
  Target: SCN9A; (+) strand; PAM type: NRG; PAM sequence: GAG
catatactatatatagtata

SEQ ID NO: 38881 - DNA, 20 bp, Artificial Sequence
  Description of Artificial Sequence: Synthetic oligonucleotide
  Target: SCN9A; (+) strand; PAM type: NRG; PAM sequence: TAG
gtatgcgtatactatatata

SEQ ID NO: 38882 - DNA, 20 bp, Artificial Sequence
  Description of Artificial Sequence: Synthetic oligonucleotide
  Target: SCN9A; (+) strand; PAM type: NRG; PAM sequence: TAG
cgtatactatatatatagta

SEQ ID NO: 38883 - DNA, 20 bp, Artificial Sequence
  Description of Artificial Sequence: Synthetic oligonucleotide
  Target: SCN9A; (+) strand; PAM type: NRG; PAM sequence: GAG
tatactatatatatagtata

SEQ ID NO: 38884 - DNA, 20 bp, Artificial Sequence
  Description of Artificial Sequence: Synthetic oligonucleotide
  Target: SCN9A; (+) strand; PAM type: NRG; PAM sequence: TAG
gtatgcgtatactatatata

SEQ ID NO: 38885 - DNA, 20 bp, Artificial Sequence
  Description of Artificial Sequence: Synthetic oligonucleotide
  Target: SCN9A; (+) strand; PAM type: NRG; PAM sequence: TAG
cgtatactatatatatagta

SEQ ID NO: 38886 - DNA, 20 bp, Artificial Sequence
  Description of Artificial Sequence: Synthetic oligonucleotide
  Target: SCN9A; (+) strand; PAM type: NRG; PAM sequence: GAG
tatactatatatatagtata

SEQ ID NO: 38887 - DNA, 20 bp, Artificial Sequence
  Description of Artificial Sequence: Synthetic oligonucleotide
  Target: SCN9A; (+) strand; PAM type: NRG; PAM sequence: TAG
gtatgcgtatactatatata

SEQ ID NO: 38888 - DNA, 20 bp, Artificial Sequence
  Description of Artificial Sequence: Synthetic oligonucleotide
  Target: SCN9A; (+) strand; PAM type: NRG; PAM sequence: TAG
cgtatactatatatatagta

SEQ ID NO: 38889 - DNA, 20 bp, Artificial Sequence
  Description of Artificial Sequence: Synthetic oligonucleotide
  Target: SCN9A; (+) strand; PAM type: NRG; PAM sequence: GAG
tatactatatatatagtata

SEQ ID NO: 38890 - DNA, 20 bp, Artificial Sequence
  Description of Artificial Sequence: Synthetic oligonucleotide
  Target: SCN9A; (+) strand; PAM type: NRG; PAM sequence: TAG
gtatgcgtatactatatata

SEQ ID NO: 38891 - DNA, 20 bp, Artificial Sequence
  Description of Artificial Sequence: Synthetic oligonucleotide
  Target: SCN9A; (+) strand; PAM type: NRG; PAM sequence: TAG
cgtatactatatatatagta

SEQ ID NO: 38892 - DNA, 20 bp, Artificial Sequence
  Description of Artificial Sequence: Synthetic oligonucleotide
  Target: SCN9A; (+) strand; PAM type: NRG; PAM sequence: GAG
tatactatatatatagtata

SEQ ID NO: 38893 - DNA, 20 bp, Artificial Sequence
  Description of Artificial Sequence: Synthetic oligonucleotide
  Target: SCN9A; (+) strand; PAM type: NRG; PAM sequence: TAG
gtatgcgtatactatatata

SEQ ID NO: 38894 - DNA, 20 bp, Artificial Sequence
  Description of Artificial Sequence: Synthetic oligonucleotide
  Target: SCN9A; (+) strand; PAM type: NRG; PAM sequence: TAG
cgtatactatatatatagta

SEQ ID NO: 38895 - DNA, 20 bp, Artificial Sequence
  Description of Artificial Sequence: Synthetic oligonucleotide
  Target: SCN9A; (+) strand; PAM type: NRG; PAM sequence: GAG
tatactatatatatagtata

SEQ ID NO: 38896 - DNA, 20 bp, Artificial Sequence
  Description of Artificial Sequence: Synthetic oligonucleotide
  Target: SCN9A; (+) strand; PAM type: NRG; PAM sequence: TAG
gtatgcgtatactatatata

SEQ ID NO: 38897 - DNA, 20 bp, Artificial Sequence
  Description of Artificial Sequence: Synthetic oligonucleotide
  Target: SCN9A; (+) strand; PAM type: NRG; PAM sequence: TAG
cgtatactatatatatagta

SEQ ID NO: 38898 - DNA, 20 bp, Artificial Sequence
  Description of Artificial Sequence: Synthetic oligonucleotide
  Target: SCN9A; (+) strand; PAM type: NRG; PAM sequence: GAG
tatactatatatatagtata

SEQ ID NO: 38899 - DNA, 20 bp, Artificial Sequence
  Description of Artificial Sequence: Synthetic oligonucleotide
  Target: SCN9A; (+) strand; PAM type: NRG; PAM sequence: TAG
gtatgcgtatactatatata

SEQ ID NO: 38900 - DNA, 20 bp, Artificial Sequence
  Description of Artificial Sequence: Synthetic oligonucleotide
  Target: SCN9A; (+) strand; PAM type: NRG; PAM sequence: TAG
cgtatactatatatatagta

SEQ ID NO: 38901 - DNA, 20 bp, Artificial Sequence
  Description of Artificial Sequence: Synthetic oligonucleotide
  Target: SCN9A; (+) strand; PAM type: NRG; PAM sequence: GAG
tatactatatatatagtata

SEQ ID NO: 38902 - DNA, 20 bp, Artificial Sequence
  Description of Artificial Sequence: Synthetic oligonucleotide
  Target: SCN9A; (+) strand; PAM type: NRG; PAM sequence: TAG
gtatagagtatgtatatata

SEQ ID NO: 38903 - DNA, 20 bp, Artificial Sequence
  Description of Artificial Sequence: Synthetic oligonucleotide
  Target: SCN9A; (+) strand; PAM type: NRG; PAM sequence: TAG
catactctatactatataca

SEQ ID NO: 38904 - DNA, 20 bp, Artificial Sequence
  Description of Artificial Sequence: Synthetic oligonucleotide
  Target: SCN9A; (+) strand; PAM type: NRG; PAM sequence: TAG
atatatatacacacaatata

SEQ ID NO: 38905 - DNA, 20 bp, Artificial Sequence
  Description of Artificial Sequence: Synthetic oligonucleotide
  Target: SCN9A; (+) strand; PAM type: NRG; PAM sequence: CAG
tatatagctgaacctatctc

SEQ ID NO: 38906 - DNA, 20 bp, Artificial Sequence
  Description of Artificial Sequence: Synthetic oligonucleotide
  Target: SCN9A; (+) strand; PAM type: NRG; PAM sequence: AAG
tagctgaacctatctccaga

SEQ ID NO: 38907 - DNA, 20 bp, Artificial Sequence
  Description of Artificial Sequence: Synthetic oligonucleotide
  Target: SCN9A; (+) strand; PAM type: NRG; PAM sequence: TGG
gtactaattaacatttctaa

SEQ ID NO: 38908 - DNA, 20 bp, Artificial Sequence
  Description of Artificial Sequence: Synthetic oligonucleotide
  Target: SCN9A; (+) strand; PAM type: NRG; PAM sequence: CAG
ctaattaacatttctaatgg

SEQ ID NO: 38909 - DNA, 20 bp, Artificial Sequence
  Description of Artificial Sequence: Synthetic oligonucleotide
  Target: SCN9A; (+) strand; PAM type: NRG; PAM sequence: TAG
tttctaatggcagtatatga

SEQ ID NO: 38910 - DNA, 20 bp, Artificial Sequence
  Description of Artificial Sequence: Synthetic oligonucleotide
  Target: SCN9A; (+) strand; PAM type: NRG; PAM sequence: CAG
ctcatactttacacattcaa

SEQ ID NO: 38911 - DNA, 20 bp, Artificial Sequence
  Description of Artificial Sequence: Synthetic oligonucleotide
  Target: SCN9A; (+) strand; PAM type: NRG; PAM sequence: GAG
tttacacattcaacagtatt

SEQ ID NO: 38912 - DNA, 20 bp, Artificial Sequence
  Description of Artificial Sequence: Synthetic oligonucleotide
  Target: SCN9A; (+) strand; PAM type: NRG; PAM sequence: TAG
agtgctaccattcttcttta

SEQ ID NO: 38913 - DNA, 20 bp, Artificial Sequence
  Description of Artificial Sequence: Synthetic oligonucleotide
  Target: SCN9A; (+) strand; PAM type: NRG; PAM sequence: TGG
ttgttattttgtatccttat

SEQ ID NO: 38914 - DNA, 20 bp, Artificial Sequence
  Description of Artificial Sequence: Synthetic oligonucleotide
  Target: SCN9A; (+) strand; PAM type: NRG; PAM sequence: TGG
ttgtttttaacttctgtttt

SEQ ID NO: 38915 - DNA, 20 bp, Artificial Sequence
  Description of Artificial Sequence: Synthetic oligonucleotide
  Target: SCN9A; (+) strand; PAM type: NRG; PAM sequence: TAG
tttaacttctgtttttggct

SEQ ID NO: 38916 - DNA, 20 bp, Artificial Sequence
  Description of Artificial Sequence: Synthetic oligonucleotide
  Target: SCN9A; (+) strand; PAM type: NRG; PAM sequence: TGG
cttctgtttttggcttagtt

SEQ ID NO: 38917 - DNA, 20 bp, Artificial Sequence
  Description of Artificial Sequence: Synthetic oligonucleotide
  Target: SCN9A; (+) strand; PAM type: NRG; PAM sequence: TGG
gtatttgcccatgtgtctat

SEQ ID NO: 38918 - DNA, 20 bp, Artificial Sequence
  Description of Artificial Sequence: Synthetic oligonucleotide
  Target: SCN9A; (+) strand; PAM type: NRG; PAM sequence: GGG
tatttgcccatgtgtctatt

SEQ ID NO: 38919 - DNA, 20 bp, Artificial Sequence
  Description of Artificial Sequence: Synthetic oligonucleotide
  Target: SCN9A; (+) strand; PAM type: NRG; PAM sequence: AAG
ctatattcttattaatttat

SEQ ID NO: 38920 - DNA, 20 bp, Artificial Sequence
  Description of Artificial Sequence: Synthetic oligonucleotide
  Target: SCN9A; (+) strand; PAM type: NRG; PAM sequence: AAG
taagaacaattttctattta

SEQ ID NO: 38921 - DNA, 20 bp, Artificial Sequence
  Description of Artificial Sequence: Synthetic oligonucleotide
  Target: SCN9A; (+) strand; PAM type: NRG; PAM sequence: CGG
ttaaagtattgatcctttct

SEQ ID NO: 38922 - DNA, 20 bp, Artificial Sequence
  Description of Artificial Sequence: Synthetic oligonucleotide
  Target: SCN9A; (+) strand; PAM type: NRG; PAM sequence: AAG
ttatgatgattttttcccca

SEQ ID NO: 38923 - DNA, 20 bp, Artificial Sequence
  Description of Artificial Sequence: Synthetic oligonucleotide
  Target: SCN9A; (+) strand; PAM type: NRG; PAM sequence: CAG
gaatattttgtttttttgtg

SEQ ID NO: 38924 - DNA, 20 bp, Artificial Sequence
  Description of Artificial Sequence: Synthetic oligonucleotide
  Target: SCN9A; (+) strand; PAM type: NRG; PAM sequence: TGG
ttcttcttcatttttttttt

SEQ ID NO: 38925 - DNA, 20 bp, Artificial Sequence
  Description of Artificial Sequence: Synthetic oligonucleotide
  Target: SCN9A; (+) strand; PAM type: NRG; PAM sequence: TAG
ttacaaatttgtgttttgca

SEQ ID NO: 38926 - DNA, 20 bp, Artificial Sequence
  Description of Artificial Sequence: Synthetic oligonucleotide
  Target: SCN9A; (+) strand; PAM type: NRG; PAM sequence: AAG
aaatttgtgttttgcataga

SEQ ID NO: 38927 - DNA, 20 bp, Artificial Sequence
  Description of Artificial Sequence: Synthetic oligonucleotide
  Target: SCN9A; (+) strand; PAM type: NRG; PAM sequence: AGG
aatttgtgttttgcatagaa

SEQ ID NO: 38928 - DNA, 20 bp, Artificial Sequence
  Description of Artificial Sequence: Synthetic oligonucleotide
  Target: SCN9A; (+) strand; PAM type: NRG; PAM sequence: AAG
ttttgcatagaaaggactat

SEQ ID NO: 38929 - DNA, 20 bp, Artificial Sequence
  Description of Artificial Sequence: Synthetic oligonucleotide
  Target: SCN9A; (+) strand; PAM type: NRG; PAM sequence: GAG
ttgcatagaaaggactataa

SEQ ID NO: 38930 - DNA, 20 bp, Artificial Sequence
  Description of Artificial Sequence: Synthetic oligonucleotide
  Target: SCN9A; (+) strand; PAM type: NRG; PAM sequence: TGG
gaaaggactataagagtata

SEQ ID NO: 38931 - DNA, 20 bp, Artificial Sequence
  Description of Artificial Sequence: Synthetic oligonucleotide
  Target: SCN9A; (+) strand; PAM type: NRG; PAM sequence: TAG
tatttccacatatttcctac

SEQ ID NO: 38932 - DNA, 20 bp, Artificial Sequence
  Description of Artificial Sequence: Synthetic oligonucleotide
  Target: SCN9A; (+) strand; PAM type: NRG; PAM sequence: TAG
agaatctttttttttaactt

SEQ ID NO: 38933 - DNA, 20 bp, Artificial Sequence
  Description of Artificial Sequence: Synthetic oligonucleotide
  Target: SCN9A; (+) strand; PAM type: NRG; PAM sequence: CAG
attcatgtgatcttttcaca

SEQ ID NO: 38934 - DNA, 20 bp, Artificial Sequence
  Description of Artificial Sequence: Synthetic oligonucleotide
  Target: SCN9A; (+) strand; PAM type: NRG; PAM sequence: TGG
gatcttttcacacagtaaat

SEQ ID NO: 38935 - DNA, 20 bp, Artificial Sequence
  Description of Artificial Sequence: Synthetic oligonucleotide
  Target: SCN9A; (+) strand; PAM type: NRG; PAM sequence: AAG
aaattggtaattatacatta

SEQ ID NO: 38936 - DNA, 20 bp, Artificial Sequence
  Description of Artificial Sequence: Synthetic oligonucleotide
  Target: SCN9A; (+) strand; PAM type: NRG; PAM sequence: TGG
ttatacattaaagtttaatt

SEQ ID NO: 38937 - DNA, 20 bp, Artificial Sequence
  Description of Artificial Sequence: Synthetic oligonucleotide
  Target: SCN9A; (+) strand; PAM type: NRG; PAM sequence: GAG
ggactctcttcaaacccact

SEQ ID NO: 38938 - DNA, 20 bp, Artificial Sequence
  Description of Artificial Sequence: Synthetic oligonucleotide
  Target: SCN9A; (+) strand; PAM type: NRG; PAM sequence: CAG
actgagcttttatatttgaa

SEQ ID NO: 38939 - DNA, 20 bp, Artificial Sequence
  Description of Artificial Sequence: Synthetic oligonucleotide
  Target: SCN9A; (+) strand; PAM type: NRG; PAM sequence: CAG
ctatatgtcttaatattttg

SEQ ID NO: 38940 - DNA, 20 bp, Artificial Sequence
  Description of Artificial Sequence: Synthetic oligonucleotide
  Target: SCN9A; (+) strand; PAM type: NRG; PAM sequence: AAG
gtcttaatattttgcagaat

SEQ ID NO: 38941 - DNA, 20 bp, Artificial Sequence
  Description of Artificial Sequence: Synthetic oligonucleotide
  Target: SCN9A; (+) strand; PAM type: NRG; PAM sequence: CAG
ttgtcaccctaattttcttc

SEQ ID NO: 38942 - DNA, 20 bp, Artificial Sequence
  Description of Artificial Sequence: Synthetic oligonucleotide
  Target: SCN9A; (+) strand; PAM type: NRG; PAM sequence: TAG
aattttcttccagatgaatt

SEQ ID NO: 38943 - DNA, 20 bp, Artificial Sequence
  Description of Artificial Sequence: Synthetic oligonucleotide
  Target: SCN9A; (+) strand; PAM type: NRG; PAM sequence: TAG
cagatgaatttagaatcatt

SEQ ID NO: 38944 - DNA, 20 bp, Artificial Sequence
  Description of Artificial Sequence: Synthetic oligonucleotide
  Target: SCN9A; (+) strand; PAM type: NRG; PAM sequence: AAG
tattacccacactacataaa

SEQ ID NO: 38945 - DNA, 20 bp, Artificial Sequence
  Description of Artificial Sequence: Synthetic oligonucleotide
  Target: SCN9A; (+) strand; PAM type: NRG; PAM sequence: TAG
tgatattttccttgaattta

SEQ ID NO: 38946 - DNA, 20 bp, Artificial Sequence
  Description of Artificial Sequence: Synthetic oligonucleotide
  Target: SCN9A; (+) strand; PAM type: NRG; PAM sequence: AAG
ttatagattaataaatttga

SEQ ID NO: 38947 - DNA, 20 bp, Artificial Sequence
  Description of Artificial Sequence: Synthetic oligonucleotide
  Target: SCN9A; (+) strand; PAM type: NRG; PAM sequence: GAG
ttgaaagtcttaattacaat

SEQ ID NO: 38948 - DNA, 20 bp, Artificial Sequence
  Description of Artificial Sequence: Synthetic oligonucleotide
  Target: SCN9A; (+) strand; PAM type: NRG; PAM sequence: GAG
gaaagtcttaattacaatga

SEQ ID NO: 38949 - DNA, 20 bp, Artificial Sequence
  Description of Artificial Sequence: Synthetic oligonucleotide
  Target: SCN9A; (+) strand; PAM type: NRG; PAM sequence: AAG
agtcttaattacaatgagag

SEQ ID NO: 38950 - DNA, 20 bp, Artificial Sequence
  Description of Artificial Sequence: Synthetic oligonucleotide
  Target: SCN9A; (+) strand; PAM type: NRG; PAM sequence: AAG
acaatgagagaagcttatct

SEQ ID NO: 38951 - DNA, 20 bp, Artificial Sequence
  Description of Artificial Sequence: Synthetic oligonucleotide
  Target: SCN9A; (+) strand; PAM type: NRG; PAM sequence: TAG
gacaatcctttcaattattt

SEQ ID NO: 38952 - DNA, 20 bp, Artificial Sequence
  Description of Artificial Sequence: Synthetic oligonucleotide
  Target: SCN9A; (+) strand; PAM type: NRG; PAM sequence: AAG
tagctttcttttatatccta

SEQ ID NO: 38953 - DNA, 20 bp, Artificial Sequence
  Description of Artificial Sequence: Synthetic oligonucleotide
  Target: SCN9A; (+) strand; PAM type: NRG; PAM sequence: CAG
ttatatcctaaagttttctt

SEQ ID NO: 38954 - DNA, 20 bp, Artificial Sequence
  Description of Artificial Sequence: Synthetic oligonucleotide
  Target: SCN9A; (+) strand; PAM type: NRG; PAM sequence: AAG
tatcctaaagttttcttcag

SEQ ID NO: 38955 - DNA, 20 bp, Artificial Sequence
  Description of Artificial Sequence: Synthetic oligonucleotide
  Target: SCN9A; (+) strand; PAM type: NRG; PAM sequence: AAG
ttcagaagtctcatatgata

SEQ ID NO: 38956 - DNA, 20 bp, Artificial Sequence
  Description of Artificial Sequence: Synthetic oligonucleotide
  Target: SCN9A; (+) strand; PAM type: NRG; PAM sequence: TAG
tcatatgataaagttattat

SEQ ID NO: 38957 - DNA, 20 bp, Artificial Sequence
  Description of Artificial Sequence: Synthetic oligonucleotide
  Target: SCN9A; (+) strand; PAM type: NRG; PAM sequence: CAG
tttttattgcaattgtgaat

SEQ ID NO: 38958 - DNA, 20 bp, Artificial Sequence
  Description of Artificial Sequence: Synthetic oligonucleotide
  Target: SCN9A; (+) strand; PAM type: NRG; PAM sequence: AAG
ttctaatttttttcatgtat

SEQ ID NO: 38959 - DNA, 20 bp, Artificial Sequence
  Description of Artificial Sequence: Synthetic oligonucleotide
  Target: SCN9A; (+) strand; PAM type: NRG; PAM sequence: TAG
ttcatgtataagataattat

SEQ ID NO: 38960 - DNA, 20 bp, Artificial Sequence
  Description of Artificial Sequence: Synthetic oligonucleotide
  Target: SCN9A; (+) strand; PAM type: NRG; PAM sequence: TGG
tataagataattattagtgt

SEQ ID NO: 38961 - DNA, 20 bp, Artificial Sequence
  Description of Artificial Sequence: Synthetic oligonucleotide
  Target: SCN9A; (+) strand; PAM type: NRG; PAM sequence: TAG
actctaattgaatttatttt

SEQ ID NO: 38962 - DNA, 20 bp, Artificial Sequence
  Description of Artificial Sequence: Synthetic oligonucleotide
  Target: SCN9A; (+) strand; PAM type: NRG; PAM sequence: AAG
ttctctttcaatatatgaac

SEQ ID NO: 38963 - DNA, 20 bp, Artificial Sequence
  Description of Artificial Sequence: Synthetic oligonucleotide
  Target: SCN9A; (+) strand; PAM type: NRG; PAM sequence: AAG
acaagttctttcattatatg

SEQ ID NO: 38964 - DNA, 20 bp, Artificial Sequence
  Description of Artificial Sequence: Synthetic oligonucleotide
  Target: SCN9A; (+) strand; PAM type: NRG; PAM sequence: AAG
agttctttcattatatgaag

SEQ ID NO: 38965 - DNA, 20 bp, Artificial Sequence
  Description of Artificial Sequence: Synthetic oligonucleotide
  Target: SCN9A; (+) strand; PAM type: NRG; PAM sequence: AGG
gttctttcattatatgaaga

SEQ ID NO: 38966 - DNA, 20 bp, Artificial Sequence
  Description of Artificial Sequence: Synthetic oligonucleotide
  Target: SCN9A; (+) strand; PAM type: NRG; PAM sequence: AAG
atgaagaaggtcattatatt

SEQ ID NO: 38967 - DNA, 20 bp, Artificial Sequence
  Description of Artificial Sequence: Synthetic oligonucleotide
  Target: SCN9A; (+) strand; PAM type: NRG; PAM sequence: AGG
tgaagaaggtcattatatta

SEQ ID NO: 38968 - DNA, 20 bp, Artificial Sequence
  Description of Artificial Sequence: Synthetic oligonucleotide
  Target: SCN9A; (+) strand; PAM type: NRG; PAM sequence: TGG
gttttcttatctaattgcat

SEQ ID NO: 38969 - DNA, 20 bp, Artificial Sequence
  Description of Artificial Sequence: Synthetic oligonucleotide
  Target: SCN9A; (+) strand; PAM type: NRG; PAM sequence: CAG
ttggccaacaacactaaaaa

SEQ ID NO: 38970 - DNA, 20 bp, Artificial Sequence
  Description of Artificial Sequence: Synthetic oligonucleotide
  Target: SCN9A; (+) strand; PAM type: NRG; PAM sequence: AGG
tggccaacaacactaaaaac

SEQ ID NO: 38971 - DNA, 20 bp, Artificial Sequence
  Description of Artificial Sequence: Synthetic oligonucleotide
  Target: SCN9A; (+) strand; PAM type: NRG; PAM sequence: GGG
ggccaacaacactaaaaaca

SEQ ID NO: 38972 - DNA, 20 bp, Artificial Sequence
  Description of Artificial Sequence: Synthetic oligonucleotide
  Target: SCN9A; (+) strand; PAM type: NRG; PAM sequence: CAG
cactaaaaacagggatgata

SEQ ID NO: 38973 - DNA, 20 bp, Artificial Sequence
  Description of Artificial Sequence: Synthetic oligonucleotide
  Target: SCN9A; (+) strand; PAM type: NRG; PAM sequence: AGG
actaaaaacagggatgatac

SEQ ID NO: 38974 - DNA, 20 bp, Artificial Sequence
  Description of Artificial Sequence: Synthetic oligonucleotide
  Target: SCN9A; (+) strand; PAM type: NRG; PAM sequence: TAG
ttttttttttcctgacttaa

SEQ ID NO: 38975 - DNA, 20 bp, Artificial Sequence
  Description of Artificial Sequence: Synthetic oligonucleotide
  Target: SCN9A; (+) strand; PAM type: NRG; PAM sequence: AGG
tttttttttcctgacttaat

SEQ ID NO: 38976 - DNA, 20 bp, Artificial Sequence
  Description of Artificial Sequence: Synthetic oligonucleotide
  Target: SCN9A; (+) strand; PAM type: NRG; PAM sequence: CAG
tgacttaataggaatgcttt

SEQ ID NO: 38977 - DNA, 20 bp, Artificial Sequence
  Description of Artificial Sequence: Synthetic oligonucleotide
  Target: SCN9A; (+) strand; PAM type: NRG; PAM sequence: TAG
gctttcagaatcatttttgt

SEQ ID NO: 38978 - DNA, 20 bp, Artificial Sequence
  Description of Artificial Sequence: Synthetic oligonucleotide
  Target: SCN9A; (+) strand; PAM type: NRG; PAM sequence: TGG
acattttcttatatcaattt

SEQ ID NO: 38979 - DNA, 20 bp, Artificial Sequence
  Description of Artificial Sequence: Synthetic oligonucleotide
  Target: SCN9A; (+) strand; PAM type: NRG; PAM sequence: TGG
atcaattttggtatgacttc

SEQ ID NO: 38980 - DNA, 20 bp, Artificial Sequence
  Description of Artificial Sequence: Synthetic oligonucleotide
  Target: SCN9A; (+) strand; PAM type: NRG; PAM sequence: TGG
taaatgcttactctgttatg

SEQ ID NO: 38981 - DNA, 20 bp, Artificial Sequence
  Description of Artificial Sequence: Synthetic oligonucleotide
  Target: SCN9A; (+) strand; PAM type: NRG; PAM sequence: AAG
gcactcaattttatgattct

SEQ ID NO: 38982 - DNA, 20 bp, Artificial Sequence
  Description of Artificial Sequence: Synthetic oligonucleotide
  Target: SCN9A; (+) strand; PAM type: NRG; PAM sequence: CAG
catgcaaccttgaacctttt

SEQ ID NO: 38983 - DNA, 20 bp, Artificial Sequence
  Description of Artificial Sequence: Synthetic oligonucleotide
  Target: SCN9A; (+) strand; PAM type: NRG; PAM sequence: TAG
taacctgttgattaaacttg

SEQ ID NO: 38984 - DNA, 20 bp, Artificial Sequence
  Description of Artificial Sequence: Synthetic oligonucleotide
  Target: SCN9A; (+) strand; PAM type: NRG; PAM sequence: AAG
ctataatctctctctcttaa

SEQ ID NO: 38985 - DNA, 20 bp, Artificial Sequence
  Description of Artificial Sequence: Synthetic oligonucleotide
  Target: SCN9A; (+) strand; PAM type: NRG; PAM sequence: AAG
taaaagtttataattctaaa

SEQ ID NO: 38986 - DNA, 20 bp, Artificial Sequence
  Description of Artificial Sequence: Synthetic oligonucleotide
  Target: SCN9A; (+) strand; PAM type: NRG; PAM sequence: AAG
acaatcctaaaatactttgc

SEQ ID NO: 38987 - DNA, 20 bp, Artificial Sequence
  Description of Artificial Sequence: Synthetic oligonucleotide
  Target: SCN9A; (+) strand; PAM type: NRG; PAM sequence: AAG
ataacaacaacaacaaaaac

SEQ ID NO: 38988 - DNA, 20 bp, Artificial Sequence
  Description of Artificial Sequence: Synthetic oligonucleotide
  Target: SCN9A; (+) strand; PAM type: NRG; PAM sequence: AAG
acaacaacaacaaaaacaag

SEQ ID NO: 38989 - DNA, 20 bp, Artificial Sequence
  Description of Artificial Sequence: Synthetic oligonucleotide
  Target: SCN9A; (+) strand; PAM type: NRG; PAM sequence: TAG
caacaacaaaaacaagaaga

SEQ ID NO: 38990 - DNA, 20 bp, Artificial Sequence
  Description of Artificial Sequence: Synthetic oligonucleotide
  Target: SCN9A; (+) strand; PAM type: NRG; PAM sequence: TGG
agaagatagaaaaacaacca

SEQ ID NO: 38991 - DNA, 20 bp, Artificial Sequence
  Description of Artificial Sequence: Synthetic oligonucleotide
  Target: SCN9A; (+) strand; PAM type: NRG; PAM sequence: TAG
caaccatggcaatgaatgta

SEQ ID NO: 38992 - DNA, 20 bp, Artificial Sequence
  Description of Artificial Sequence: Synthetic oligonucleotide
  Target: SCN9A; (+) strand; PAM type: NRG; PAM sequence: AGG
aaccatggcaatgaatgtat

SEQ ID NO: 38993 - DNA, 20 bp, Artificial Sequence
  Description of Artificial Sequence: Synthetic oligonucleotide
  Target: SCN9A; (+) strand; PAM type: NRG; PAM sequence: AAG
catggcaatgaatgtatagg

SEQ ID NO: 38994 - DNA, 20 bp, Artificial Sequence
  Description of Artificial Sequence: Synthetic oligonucleotide
  Target: SCN9A; (+) strand; PAM type: NRG; PAM sequence: CAG
aaatcatgtgctgttattca

SEQ ID NO: 38995 - DNA, 20 bp, Artificial Sequence
  Description of Artificial Sequence: Synthetic oligonucleotide
  Target: SCN9A; (+) strand; PAM type: NRG; PAM sequence: TGG
attcacagacatgaacacca

SEQ ID NO: 38996 - DNA, 20 bp, Artificial Sequence
  Description of Artificial Sequence: Synthetic oligonucleotide
  Target: SCN9A; (+) strand; PAM type: NRG; PAM sequence: TGG
acagacatgaacaccatggc

SEQ ID NO: 38997 - DNA, 20 bp, Artificial Sequence
  Description of Artificial Sequence: Synthetic oligonucleotide
  Target: SCN9A; (+) strand; PAM type: NRG; PAM sequence: GAG
catgaacaccatggctggtt

SEQ ID NO: 38998 - DNA, 20 bp, Artificial Sequence
  Description of Artificial Sequence: Synthetic oligonucleotide
  Target: SCN9A; (+) strand; PAM type: NRG; PAM sequence: AGG
atgaacaccatggctggttg

SEQ ID NO: 38999 - DNA, 20 bp, Artificial Sequence
  Description of Artificial Sequence: Synthetic oligonucleotide
  Target: SCN9A; (+) strand; PAM type: NRG; PAM sequence: TGG
atggctggttgaggaatgat

SEQ ID NO: 39000 - DNA, 20 bp, Artificial Sequence
  Description of Artificial Sequence: Synthetic oligonucleotide
  Target: SCN9A; (+) strand; PAM type: NRG; PAM sequence: AAG
tggcattttatacacttgtg

SEQ ID NO: 39001 - DNA, 20 bp, Artificial Sequence
  Description of Artificial Sequence: Synthetic oligonucleotide
  Target: SCN9A; (+) strand; PAM type: NRG; PAM sequence: AAG
ttatacacttgtgaagtatt

SEQ ID NO: 39002 - DNA, 20 bp, Artificial Sequence
  Description of Artificial Sequence: Synthetic oligonucleotide
  Target: SCN9A; (+) strand; PAM type: NRG; PAM sequence: TGG
taagctgtaaaaaataaaac

SEQ ID NO: 39003 - DNA, 20 bp, Artificial Sequence
  Description of Artificial Sequence: Synthetic oligonucleotide
  Target: SCN9A; (+) strand; PAM type: NRG; PAM sequence: TAG
aaaaataaaactggcatttc

SEQ ID NO: 39004 - DNA, 20 bp, Artificial Sequence
  Description of Artificial Sequence: Synthetic oligonucleotide
  Target: SCN9A; (+) strand; PAM type: NRG; PAM sequence: GAG
aaataaaactggcatttcta

SEQ ID NO: 39005 - DNA, 20 bp, Artificial Sequence
  Description of Artificial Sequence: Synthetic oligonucleotide
  Target: SCN9A; (+) strand; PAM type: NRG; PAM sequence: TGG
cttaacttcactttaaattc

SEQ ID NO: 39006 - DNA, 20 bp, Artificial Sequence
  Description of Artificial Sequence: Synthetic oligonucleotide
  Target: SCN9A; (+) strand; PAM type: NRG; PAM sequence: AAG
aacttcactttaaattctgg

SEQ ID NO: 39007 - DNA, 20 bp, Artificial Sequence
  Description of Artificial Sequence: Synthetic oligonucleotide
  Target: SCN9A; (+) strand; PAM type: NRG; PAM sequence: CAG
gaagaattttcacaaattca

SEQ ID NO: 39008 - DNA, 20 bp, Artificial Sequence
  Description of Artificial Sequence: Synthetic oligonucleotide
  Target: SCN9A; (+) strand; PAM type: NRG; PAM sequence: TGG
tcacaaattcacagatattc

SEQ ID NO: 39009 - DNA, 20 bp, Artificial Sequence
  Description of Artificial Sequence: Synthetic oligonucleotide
  Target: SCN9A; (+) strand; PAM type: NRG; PAM sequence: AAG
attatcattaatcaaatgac

SEQ ID NO: 39010 - DNA, 20 bp, Artificial Sequence
  Description of Artificial Sequence: Synthetic oligonucleotide
  Target: SCN9A; (+) strand; PAM type: NRG; PAM sequence: CAG
agtctcacatgtgctaaaac

SEQ ID NO: 39011 - DNA, 20 bp, Artificial Sequence
  Description of Artificial Sequence: Synthetic oligonucleotide
  Target: SCN9A; (+) strand; PAM type: NRG; PAM sequence: AAG
ctcacatgtgctaaaaccag

SEQ ID NO: 39012 - DNA, 20 bp, Artificial Sequence
  Description of Artificial Sequence: Synthetic oligonucleotide
  Target: SCN9A; (+) strand; PAM type: NRG; PAM sequence: CAG
gctaaaaccagaagttattt

SEQ ID NO: 39013 - DNA, 20 bp, Artificial Sequence
  Description of Artificial Sequence: Synthetic oligonucleotide
  Target: SCN9A; (+) strand; PAM type: NRG; PAM sequence: TGG
agttatttcagattcaacat

SEQ ID NO: 39014 - DNA, 20 bp, Artificial Sequence
  Description of Artificial Sequence: Synthetic oligonucleotide
  Target: SCN9A; (+) strand; PAM type: NRG; PAM sequence: AAG
agattcaacattggttttcc

SEQ ID NO: 39015 - DNA, 20 bp, Artificial Sequence
  Description of Artificial Sequence: Synthetic oligonucleotide
  Target: SCN9A; (+) strand; PAM type: NRG; PAM sequence: CAG
aacattggttttccaagaca

SEQ ID NO: 39016 - DNA, 20 bp, Artificial Sequence
  Description of Artificial Sequence: Synthetic oligonucleotide
  Target: SCN9A; (+) strand; PAM type: NRG; PAM sequence: TGG
gacacagctatatataaaca

SEQ ID NO: 39017 - DNA, 20 bp, Artificial Sequence
  Description of Artificial Sequence: Synthetic oligonucleotide
  Target: SCN9A; (+) strand; PAM type: NRG; PAM sequence: TAG
ctatatataaacatggtaac

SEQ ID NO: 39018 - DNA, 20 bp, Artificial Sequence
  Description of Artificial Sequence: Synthetic oligonucleotide
  Target: SCN9A; (+) strand; PAM type: NRG; PAM sequence: AAG
acatggtaactagttttgca

SEQ ID NO: 39019 - DNA, 20 bp, Artificial Sequence
  Description of Artificial Sequence: Synthetic oligonucleotide
  Target: SCN9A; (+) strand; PAM type: NRG; PAM sequence: AGG
catggtaactagttttgcaa

SEQ ID NO: 39020 - DNA, 20 bp, Artificial Sequence
  Description of Artificial Sequence: Synthetic oligonucleotide
  Target: SCN9A; (+) strand; PAM type: NRG; PAM sequence: TGG
tagttttgcaaaggtaatat

SEQ ID NO: 39021 - DNA, 20 bp, Artificial Sequence
  Description of Artificial Sequence: Synthetic oligonucleotide
  Target: SCN9A; (+) strand; PAM type: NRG; PAM sequence: AAG
attggaaactaaatatcaac

SEQ ID NO: 39022 - DNA, 20 bp, Artificial Sequence
  Description of Artificial Sequence: Synthetic oligonucleotide
  Target: SCN9A; (+) strand; PAM type: NRG; PAM sequence: TAG
caagtataatttccttctaa

SEQ ID NO: 39023 - DNA, 20 bp, Artificial Sequence
  Description of Artificial Sequence: Synthetic oligonucleotide
  Target: SCN9A; (+) strand; PAM type: NRG; PAM sequence: TAG
tataatttccttctaataga

SEQ ID NO: 39024 - DNA, 20 bp, Artificial Sequence
  Description of Artificial Sequence: Synthetic oligonucleotide
  Target: SCN9A; (+) strand; PAM type: NRG; PAM sequence: TGG
ttctaatagatagaaatatt

SEQ ID NO: 39025 - DNA, 20 bp, Artificial Sequence
  Description of Artificial Sequence: Synthetic oligonucleotide
  Target: SCN9A; (+) strand; PAM type: NRG; PAM sequence: TGG
tagatagaaatatttggctt

SEQ ID NO: 39026 - DNA, 20 bp, Artificial Sequence
  Description of Artificial Sequence: Synthetic oligonucleotide
  Target: SCN9A; (+) strand; PAM type: NRG; PAM sequence: GGG
agatagaaatatttggcttt

SEQ ID NO: 39027 - DNA, 20 bp, Artificial Sequence
  Description of Artificial Sequence: Synthetic oligonucleotide
  Target: SCN9A; (+) strand; PAM type: NRG; PAM sequence: GGG
gatagaaatatttggctttg

SEQ ID NO: 39028 - DNA, 20 bp, Artificial Sequence
  Description of Artificial Sequence: Synthetic oligonucleotide
  Target: SCN9A; (+) strand; PAM type: NRG; PAM sequence: TAG
atatttggctttggggcctg

SEQ ID NO: 39029 - DNA, 20 bp, Artificial Sequence
  Description of Artificial Sequence: Synthetic oligonucleotide
  Target: SCN9A; (+) strand; PAM type: NRG; PAM sequence: CAG
tggggcctgtagtgtaaacc

SEQ ID NO: 39030 - DNA, 20 bp, Artificial Sequence
  Description of Artificial Sequence: Synthetic oligonucleotide
  Target: SCN9A; (+) strand; PAM type: NRG; PAM sequence: TAG
gtgtaaacccagaaacactg

SEQ ID NO: 39031 - DNA, 20 bp, Artificial Sequence
  Description of Artificial Sequence: Synthetic oligonucleotide
  Target: SCN9A; (+) strand; PAM type: NRG; PAM sequence: GAG
acccagaaacactgtagtat

SEQ ID NO: 39032 - DNA, 20 bp, Artificial Sequence
  Description of Artificial Sequence: Synthetic oligonucleotide
  Target: SCN9A; (+) strand; PAM type: NRG; PAM sequence: GAG
ccagaaacactgtagtatga

SEQ ID NO: 39033 - DNA, 20 bp, Artificial Sequence
  Description of Artificial Sequence: Synthetic oligonucleotide
  Target: SCN9A; (+) strand; PAM type: NRG; PAM sequence: CAG
aaacactgtagtatgagaga

SEQ ID NO: 39034 - DNA, 20 bp, Artificial Sequence
  Description of Artificial Sequence: Synthetic oligonucleotide
  Target: SCN9A; (+) strand; PAM type: NRG; PAM sequence: TAG
cagatatttgttttgctttt

SEQ ID NO: 39035 - DNA, 20 bp, Artificial Sequence
  Description of Artificial Sequence: Synthetic oligonucleotide
  Target: SCN9A; (+) strand; PAM type: NRG; PAM sequence: AGG
agatatttgttttgcttttt

SEQ ID NO: 39036 - DNA, 20 bp, Artificial Sequence
  Description of Artificial Sequence: Synthetic oligonucleotide
  Target: SCN9A; (+) strand; PAM type: NRG; PAM sequence: AAG
ttcattgtactgacttactc

SEQ ID NO: 39037 - DNA, 20 bp, Artificial Sequence
  Description of Artificial Sequence: Synthetic oligonucleotide
  Target: SCN9A; (+) strand; PAM type: NRG; PAM sequence: GAG
cattgtactgacttactcaa

SEQ ID NO: 39038 - DNA, 20 bp, Artificial Sequence
  Description of Artificial Sequence: Synthetic oligonucleotide
  Target: SCN9A; (+) strand; PAM type: NRG; PAM sequence: AAG
tcaagagtaaatttgtgttc

SEQ ID NO: 39039 - DNA, 20 bp, Artificial Sequence
  Description of Artificial Sequence: Synthetic oligonucleotide
  Target: SCN9A; (+) strand; PAM type: NRG; PAM sequence: CAG
taaatttgtgttcaagaatt

SEQ ID NO: 39040 - DNA, 20 bp, Artificial Sequence
  Description of Artificial Sequence: Synthetic oligonucleotide
  Target: SCN9A; (+) strand; PAM type: NRG; PAM sequence: GAG
aattcagcatatacttcctt

SEQ ID NO: 39041 - DNA, 20 bp, Artificial Sequence
  Description of Artificial Sequence: Synthetic oligonucleotide
  Target: SCN9A; (+) strand; PAM type: NRG; PAM sequence: AAG
gcatatacttccttgagcat

SEQ ID NO: 39042 - DNA, 20 bp, Artificial Sequence
  Description of Artificial Sequence: Synthetic oligonucleotide
  Target: SCN9A; (+) strand; PAM type: NRG; PAM sequence: AAG
tacttccttgagcataagtg

SEQ ID NO: 39043 - DNA, 20 bp, Artificial Sequence
  Description of Artificial Sequence: Synthetic oligonucleotide
  Target: SCN9A; (+) strand; PAM type: NRG; PAM sequence: TAG
ccttgagcataagtgaagtt

SEQ ID NO: 39044 - DNA, 20 bp, Artificial Sequence
  Description of Artificial Sequence: Synthetic oligonucleotide
  Target: SCN9A; (+) strand; PAM type: NRG; PAM sequence: TGG
ataaatattcttacctacaa

SEQ ID NO: 39045 - DNA, 20 bp, Artificial Sequence
  Description of Artificial Sequence: Synthetic oligonucleotide
  Target: SCN9A; (+) strand; PAM type: NRG; PAM sequence: GAG
aaatattcttacctacaatg

SEQ ID NO: 39046 - DNA, 20 bp, Artificial Sequence
  Description of Artificial Sequence: Synthetic oligonucleotide
  Target: SCN9A; (+) strand; PAM type: NRG; PAM sequence: CAG
atcaaaaatattccatccta

SEQ ID NO: 39047 - DNA, 20 bp, Artificial Sequence
  Description of Artificial Sequence: Synthetic oligonucleotide
  Target: SCN9A; (+) strand; PAM type: NRG; PAM sequence: AAG
aaatattccatcctacagtg

SEQ ID NO: 39048 - DNA, 20 bp, Artificial Sequence
  Description of Artificial Sequence: Synthetic oligonucleotide
  Target: SCN9A; (+) strand; PAM type: NRG; PAM sequence: TAG
tattccatcctacagtgaag

SEQ ID NO: 39049 - DNA, 20 bp, Artificial Sequence
  Description of Artificial Sequence: Synthetic oligonucleotide
  Target: SCN9A; (+) strand; PAM type: NRG; PAM sequence: TAG
tccatcctacagtgaagtag

SEQ ID NO: 39050 - DNA, 20 bp, Artificial Sequence
  Description of Artificial Sequence: Synthetic oligonucleotide
  Target: SCN9A; (+) strand; PAM type: NRG; PAM sequence: GAG
acagtgaagtagtagtgtct

SEQ ID NO: 39051 - DNA, 20 bp, Artificial Sequence
  Description of Artificial Sequence: Synthetic oligonucleotide
  Target: SCN9A; (+) strand; PAM type: NRG; PAM sequence: AGG
cagtgaagtagtagtgtctg

SEQ ID NO: 39052 - DNA, 20 bp, Artificial Sequence
  Description of Artificial Sequence: Synthetic oligonucleotide
  Target: SCN9A; (+) strand; PAM type: NRG; PAM sequence: GGG
agtgaagtagtagtgtctga

SEQ ID NO: 39053 - DNA, 20 bp, Artificial Sequence
  Description of Artificial Sequence: Synthetic oligonucleotide
  Target: SCN9A; (+) strand; PAM type: NRG; PAM sequence: GAG
tgaagtagtagtgtctgagg

SEQ ID NO: 39054 - DNA, 20 bp, Artificial Sequence
  Description of Artificial Sequence: Synthetic oligonucleotide
  Target: SCN9A; (+) strand; PAM type: NRG; PAM sequence: CAG
tagtagtgtctgagggagat

SEQ ID NO: 39055 - DNA, 20 bp, Artificial Sequence
  Description of Artificial Sequence: Synthetic oligonucleotide
  Target: SCN9A; (+) strand; PAM type: NRG; PAM sequence: TAG
tgtctgagggagatcagttt

SEQ ID NO: 39056 - DNA, 20 bp, Artificial Sequence
  Description of Artificial Sequence: Synthetic oligonucleotide
  Target: SCN9A; (+) strand; PAM type: NRG; PAM sequence: CAG
cagttttagcacacattctc

SEQ ID NO: 39057 - DNA, 20 bp, Artificial Sequence
  Description of Artificial Sequence: Synthetic oligonucleotide
  Target: SCN9A; (+) strand; PAM type: NRG; PAM sequence: AAG
agcacacattctccagtgaa

SEQ ID NO: 39058 - DNA, 20 bp, Artificial Sequence
  Description of Artificial Sequence: Synthetic oligonucleotide
  Target: SCN9A; (+) strand; PAM type: NRG; PAM sequence: AGG
gcacacattctccagtgaaa

SEQ ID NO: 39059 - DNA, 20 bp, Artificial Sequence
  Description of Artificial Sequence: Synthetic oligonucleotide
  Target: SCN9A; (+) strand; PAM type: NRG; PAM sequence: CAG
atttatccaatataaaactt

SEQ ID NO: 39060 - DNA, 20 bp, Artificial Sequence
  Description of Artificial Sequence: Synthetic oligonucleotide
  Target: SCN9A; (+) strand; PAM type: NRG; PAM sequence: TGG
accctccttttctaccatca

SEQ ID NO: 39061 - DNA, 20 bp, Artificial Sequence
  Description of Artificial Sequence: Synthetic oligonucleotide
  Target: SCN9A; (+) strand; PAM type: NRG; PAM sequence: GAG
accatcatggttaccatgtt

SEQ ID NO: 39062 - DNA, 20 bp, Artificial Sequence
  Description of Artificial Sequence: Synthetic oligonucleotide
  Target: SCN9A; (+) strand; PAM type: NRG; PAM sequence: CAG
tcatggttaccatgttgaga

SEQ ID NO: 39063 - DNA, 20 bp, Artificial Sequence
  Description of Artificial Sequence: Synthetic oligonucleotide
  Target: SCN9A; (+) strand; PAM type: NRG; PAM sequence: AAG
gttaccatgttgagacagat

SEQ ID NO: 39064 - DNA, 20 bp, Artificial Sequence
  Description of Artificial Sequence: Synthetic oligonucleotide
  Target: SCN9A; (+) strand; PAM type: NRG; PAM sequence: AAG
gaaccatgatactaatatca

SEQ ID NO: 39065 - DNA, 20 bp, Artificial Sequence
  Description of Artificial Sequence: Synthetic oligonucleotide
  Target: SCN9A; (+) strand; PAM type: NRG; PAM sequence: AGG
aaccatgatactaatatcaa

SEQ ID NO: 39066 - DNA, 20 bp, Artificial Sequence
  Description of Artificial Sequence: Synthetic oligonucleotide
  Target: SCN9A; (+) strand; PAM type: NRG; PAM sequence: TAG
tcaaaggcttgatttgtcac

SEQ ID NO: 39067 - DNA, 20 bp, Artificial Sequence
  Description of Artificial Sequence: Synthetic oligonucleotide
  Target: SCN9A; (+) strand; PAM type: NRG; PAM sequence: AGG
caaaggcttgatttgtcact

SEQ ID NO: 39068 - DNA, 20 bp, Artificial Sequence
  Description of Artificial Sequence: Synthetic oligonucleotide
  Target: SCN9A; (+) strand; PAM type: NRG; PAM sequence: TGG
ctaggtcaaatatacatcct

SEQ ID NO: 39069 - DNA, 20 bp, Artificial Sequence
  Description of Artificial Sequence: Synthetic oligonucleotide
  Target: SCN9A; (+) strand; PAM type: NRG; PAM sequence: AAG
tccttggattttgttctgca

SEQ ID NO: 39070 - DNA, 20 bp, Artificial Sequence
  Description of Artificial Sequence: Synthetic oligonucleotide
  Target: SCN9A; (+) strand; PAM type: NRG; PAM sequence: AAG
attttgttctgcaaagaaat

SEQ ID NO: 39071 - DNA, 20 bp, Artificial Sequence
  Description of Artificial Sequence: Synthetic oligonucleotide
  Target: SCN9A; (+) strand; PAM type: NRG; PAM sequence: CAG
aataagaataatatcgaatg

SEQ ID NO: 39072 - DNA, 20 bp, Artificial Sequence
  Description of Artificial Sequence: Synthetic oligonucleotide
  Target: SCN9A; (+) strand; PAM type: NRG; PAM sequence: GAG
taagaataatatcgaatgca

SEQ ID NO: 39073 - DNA, 20 bp, Artificial Sequence
  Description of Artificial Sequence: Synthetic oligonucleotide
  Target: SCN9A; (+) strand; PAM type: NRG; PAM sequence: AAG
gaatgcagagtaaacttttc

SEQ ID NO: 39074 - DNA, 20 bp, Artificial Sequence
  Description of Artificial Sequence: Synthetic oligonucleotide
  Target: SCN9A; (+) strand; PAM type: NRG; PAM sequence: CAG
taaacttttcaagtattatc

SEQ ID NO: 39075 - DNA, 20 bp, Artificial Sequence
  Description of Artificial Sequence: Synthetic oligonucleotide
  Target: SCN9A; (+) strand; PAM type: NRG; PAM sequence: AAG
caagtattatccagaaatta

SEQ ID NO: 39076 - DNA, 20 bp, Artificial Sequence
  Description of Artificial Sequence: Synthetic oligonucleotide
  Target: SCN9A; (+) strand; PAM type: NRG; PAM sequence: TAG
gatgtgcattaaaaatgaat

SEQ ID NO: 39077 - DNA, 20 bp, Artificial Sequence
  Description of Artificial Sequence: Synthetic oligonucleotide
  Target: SCN9A; (+) strand; PAM type: NRG; PAM sequence: AAG
atttgaaaatctatatgcta

SEQ ID NO: 39078 - DNA, 20 bp, Artificial Sequence
  Description of Artificial Sequence: Synthetic oligonucleotide
  Target: SCN9A; (+) strand; PAM type: NRG; PAM sequence: TGG
tatatatatttttttacccc

SEQ ID NO: 39079 - DNA, 20 bp, Artificial Sequence
  Description of Artificial Sequence: Synthetic oligonucleotide
  Target: SCN9A; (+) strand; PAM type: NRG; PAM sequence: GAG
atatttttttacccctggtc

SEQ ID NO: 39080 - DNA, 20 bp, Artificial Sequence
  Description of Artificial Sequence: Synthetic oligonucleotide
  Target: SCN9A; (+) strand; PAM type: NRG; PAM sequence: AGG
tatttttttacccctggtcg

SEQ ID NO: 39081 - DNA, 20 bp, Artificial Sequence
  Description of Artificial Sequence: Synthetic oligonucleotide
  Target: SCN9A; (+) strand; PAM type: NRG; PAM sequence: TGG
tttacccctggtcgaggaat

SEQ ID NO: 39082 - DNA, 20 bp, Artificial Sequence
  Description of Artificial Sequence: Synthetic oligonucleotide
  Target: SCN9A; (+) strand; PAM type: NRG; PAM sequence: TGG
ggtcgaggaattggcttttg

SEQ ID NO: 39083 - DNA, 20 bp, Artificial Sequence
  Description of Artificial Sequence: Synthetic oligonucleotide
  Target: SCN9A; (+) strand; PAM type: NRG; PAM sequence: TGG
aattggcttttgtggcttct

SEQ ID NO: 39084 - DNA, 20 bp, Artificial Sequence
  Description of Artificial Sequence: Synthetic oligonucleotide
  Target: SCN9A; (+) strand; PAM type: NRG; PAM sequence: CAG
ttttgtggcttcttggaccc

SEQ ID NO: 39085 - DNA, 20 bp, Artificial Sequence
  Description of Artificial Sequence: Synthetic oligonucleotide
  Target: SCN9A; (+) strand; PAM type: NRG; PAM sequence: TAG
ccagctttttcattgcatta

SEQ ID NO: 39086 - DNA, 20 bp, Artificial Sequence
  Description of Artificial Sequence: Synthetic oligonucleotide
  Target: SCN9A; (+) strand; PAM type: NRG; PAM sequence: AAG
tcttctgttcttctgtcata

SEQ ID NO: 39087 - DNA, 20 bp, Artificial Sequence
  Description of Artificial Sequence: Synthetic oligonucleotide
  Target: SCN9A; (+) strand; PAM type: NRG; PAM sequence: AAG
ataaagatgtcttgacctcc

SEQ ID NO: 39088 - DNA, 20 bp, Artificial Sequence
  Description of Artificial Sequence: Synthetic oligonucleotide
  Target: SCN9A; (+) strand; PAM type: NRG; PAM sequence: AGG
taaagatgtcttgacctcca

SEQ ID NO: 39089 - DNA, 20 bp, Artificial Sequence
  Description of Artificial Sequence: Synthetic oligonucleotide
  Target: SCN9A; (+) strand; PAM type: NRG; PAM sequence: AAG
atgtcttgacctccaaggta

SEQ ID NO: 39090 - DNA, 20 bp, Artificial Sequence
  Description of Artificial Sequence: Synthetic oligonucleotide
  Target: SCN9A; (+) strand; PAM type: NRG; PAM sequence: TAG
aaacaaacaaaaaataaatg

SEQ ID NO: 39091 - DNA, 20 bp, Artificial Sequence
  Description of Artificial Sequence: Synthetic oligonucleotide
  Target: SCN9A; (+) strand; PAM type: NRG; PAM sequence: CAG
aaaataaatgtagttaaaac

SEQ ID NO: 39092 - DNA, 20 bp, Artificial Sequence
  Description of Artificial Sequence: Synthetic oligonucleotide
  Target: SCN9A; (+) strand; PAM type: NRG; PAM sequence: TAG
tcattgtctacatctttcta

SEQ ID NO: 39093 - DNA, 20 bp, Artificial Sequence
  Description of Artificial Sequence: Synthetic oligonucleotide
  Target: SCN9A; (+) strand; PAM type: NRG; PAM sequence: TAG
ctttctatagattactaaaa

SEQ ID NO: 39094 - DNA, 20 bp, Artificial Sequence
  Description of Artificial Sequence: Synthetic oligonucleotide
  Target: SCN9A; (+) strand; PAM type: NRG; PAM sequence: AGG
tttctatagattactaaaat

SEQ ID NO: 39095 - DNA, 20 bp, Artificial Sequence
  Description of Artificial Sequence: Synthetic oligonucleotide
  Target: SCN9A; (+) strand; PAM type: NRG; PAM sequence: TAG
taggttaaaatgtgttaata

SEQ ID NO: 39096 - DNA, 20 bp, Artificial Sequence
  Description of Artificial Sequence: Synthetic oligonucleotide
  Target: SCN9A; (+) strand; PAM type: NRG; PAM sequence: TAG
gtattttattatgttcatga

SEQ ID NO: 39097 - DNA, 20 bp, Artificial Sequence
  Description of Artificial Sequence: Synthetic oligonucleotide
  Target: SCN9A; (+) strand; PAM type: NRG; PAM sequence: TAG
cttaaataattacatatgtg

SEQ ID NO: 39098 - DNA, 20 bp, Artificial Sequence
  Description of Artificial Sequence: Synthetic oligonucleotide
  Target: SCN9A; (+) strand; PAM type: NRG; PAM sequence: TGG
attacatatgtgtagaaaca

SEQ ID NO: 39099 - DNA, 20 bp, Artificial Sequence
  Description of Artificial Sequence: Synthetic oligonucleotide
  Target: SCN9A; (+) strand; PAM type: NRG; PAM sequence: GGG
ttacatatgtgtagaaacat

SEQ ID NO: 39100 - DNA, 20 bp, Artificial Sequence
  Description of Artificial Sequence: Synthetic oligonucleotide
  Target: SCN9A; (+) strand; PAM type: NRG; PAM sequence: CAG
gaaacatgggtctccaaaca

SEQ ID NO: 39101 - DNA, 20 bp, Artificial Sequence
  Description of Artificial Sequence: Synthetic oligonucleotide
  Target: SCN9A; (+) strand; PAM type: NRG; PAM sequence: AAG
atatttgtattacatataat

SEQ ID NO: 39102 - DNA, 20 bp, Artificial Sequence
  Description of Artificial Sequence: Synthetic oligonucleotide
  Target: SCN9A; (+) strand; PAM type: NRG; PAM sequence: AGG
tatttgtattacatataata

SEQ ID NO: 39103 - DNA, 20 bp, Artificial Sequence
  Description of Artificial Sequence: Synthetic oligonucleotide
  Target: SCN9A; (+) strand; PAM type: NRG; PAM sequence: TGG
gtattacatataataaggat

SEQ ID NO: 39104 - DNA, 20 bp, Artificial Sequence
  Description of Artificial Sequence: Synthetic oligonucleotide
  Target: SCN9A; (+) strand; PAM type: NRG; PAM sequence: TGG
ggattggctcaatattcttt

SEQ ID NO: 39105 - DNA, 20 bp, Artificial Sequence
  Description of Artificial Sequence: Synthetic oligonucleotide
  Target: SCN9A; (+) strand; PAM type: NRG; PAM sequence: CAG
tattcttttggtgtgctaat

SEQ ID NO: 39106 - DNA, 20 bp, Artificial Sequence
  Description of Artificial Sequence: Synthetic oligonucleotide
  Target: SCN9A; (+) strand; PAM type: NRG; PAM sequence: TAG
cttttatcttttttatctgc

SEQ ID NO: 39107 - DNA, 20 bp, Artificial Sequence
  Description of Artificial Sequence: Synthetic oligonucleotide
  Target: SCN9A; (+) strand; PAM type: NRG; PAM sequence: AAG
ttactgtgacttttattgct

SEQ ID NO: 39108 - DNA, 20 bp, Artificial Sequence
  Description of Artificial Sequence: Synthetic oligonucleotide
  Target: SCN9A; (+) strand; PAM type: NRG; PAM sequence: AAG
ttattgctaagaaaatttgt

SEQ ID NO: 39109 - DNA, 20 bp, Artificial Sequence
  Description of Artificial Sequence: Synthetic oligonucleotide
  Target: SCN9A; (+) strand; PAM type: NRG; PAM sequence: AAG
agaaaatttgtaagaattaa

SEQ ID NO: 39110 - DNA, 20 bp, Artificial Sequence
  Description of Artificial Sequence: Synthetic oligonucleotide
  Target: SCN9A; (+) strand; PAM type: NRG; PAM sequence: TGG
gaatatcttctttgatgatt

SEQ ID NO: 39111 - DNA, 20 bp, Artificial Sequence
  Description of Artificial Sequence: Synthetic oligonucleotide
  Target: SCN9A; (+) strand; PAM type: NRG; PAM sequence: TAG
ttgatgatttggcaaatatt

SEQ ID NO: 39112 - DNA, 20 bp, Artificial Sequence
  Description of Artificial Sequence: Synthetic oligonucleotide
  Target: SCN9A; (+) strand; PAM type: NRG; PAM sequence: AAG
aaatatttagaacttttata

SEQ ID NO: 39113 - DNA, 20 bp, Artificial Sequence
  Description of Artificial Sequence: Synthetic oligonucleotide
  Target: SCN9A; (+) strand; PAM type: NRG; PAM sequence: TAG
tttagaacttttataaagaa

SEQ ID NO: 39114 - DNA, 20 bp, Artificial Sequence
  Description of Artificial Sequence: Synthetic oligonucleotide
  Target: SCN9A; (+) strand; PAM type: NRG; PAM sequence: AGG
ttagaacttttataaagaat

SEQ ID NO: 39115 - DNA, 20 bp, Artificial Sequence
  Description of Artificial Sequence: Synthetic oligonucleotide
  Target: SCN9A; (+) strand; PAM type: NRG; PAM sequence: GGG
tagaacttttataaagaata

SEQ ID NO: 39116 - DNA, 20 bp, Artificial Sequence
  Description of Artificial Sequence: Synthetic oligonucleotide
  Target: SCN9A; (+) strand; PAM type: NRG; PAM sequence: GAG
gaacttttataaagaatagg

SEQ ID NO: 39117 - DNA, 20 bp, Artificial Sequence
  Description of Artificial Sequence: Synthetic oligonucleotide
  Target: SCN9A; (+) strand; PAM type: NRG; PAM sequence: GAG
agaatagggagccaaatcat

SEQ ID NO: 39118 - DNA, 20 bp, Artificial Sequence
  Description of Artificial Sequence: Synthetic oligonucleotide
  Target: SCN9A; (+) strand; PAM type: NRG; PAM sequence: AAG
tcccattcacaattactaca

SEQ ID NO: 39119 - DNA, 20 bp, Artificial Sequence
  Description of Artificial Sequence: Synthetic oligonucleotide
  Target: SCN9A; (+) strand; PAM type: NRG; PAM sequence: GAG
ccattcacaattactacaaa

SEQ ID NO: 39120 - DNA, 20 bp, Artificial Sequence
  Description of Artificial Sequence: Synthetic oligonucleotide
  Target: SCN9A; (+) strand; PAM type: NRG; PAM sequence: TAG
tacaaagagaataaaatacc

SEQ ID NO: 39121 - DNA, 20 bp, Artificial Sequence
  Description of Artificial Sequence: Synthetic oligonucleotide
  Target: SCN9A; (+) strand; PAM type: NRG; PAM sequence: AGG
acaaagagaataaaatacct

SEQ ID NO: 39122 - DNA, 20 bp, Artificial Sequence
  Description of Artificial Sequence: Synthetic oligonucleotide
  Target: SCN9A; (+) strand; PAM type: NRG; PAM sequence: AAG
tacctaggaatccaacttac

SEQ ID NO: 39123 - DNA, 20 bp, Artificial Sequence
  Description of Artificial Sequence: Synthetic oligonucleotide
  Target: SCN9A; (+) strand; PAM type: NRG; PAM sequence: AGG
acctaggaatccaacttaca

SEQ ID NO: 39124 - DNA, 20 bp, Artificial Sequence
  Description of Artificial Sequence: Synthetic oligonucleotide
  Target: SCN9A; (+) strand; PAM type: NRG; PAM sequence: GGG
cctaggaatccaacttacaa

SEQ ID NO: 39125 - DNA, 20 bp, Artificial Sequence
  Description of Artificial Sequence: Synthetic oligonucleotide
  Target: SCN9A; (+) strand; PAM type: NRG; PAM sequence: AAG
tccaacttacaagggatgtg

SEQ ID NO: 39126 - DNA, 20 bp, Artificial Sequence
  Description of Artificial Sequence: Synthetic oligonucleotide
  Target: SCN9A; (+) strand; PAM type: NRG; PAM sequence: AGG
ccaacttacaagggatgtga

SEQ ID NO: 39127 - DNA, 20 bp, Artificial Sequence
  Description of Artificial Sequence: Synthetic oligonucleotide
  Target: SCN9A; (+) strand; PAM type: NRG; PAM sequence: AAG
gggatgtgaaggacctcttc

SEQ ID NO: 39128 - DNA, 20 bp, Artificial Sequence
  Description of Artificial Sequence: Synthetic oligonucleotide
  Target: SCN9A; (+) strand; PAM type: NRG; PAM sequence: AGG
ggatgtgaaggacctcttca

SEQ ID NO: 39129 - DNA, 20 bp, Artificial Sequence
  Description of Artificial Sequence: Synthetic oligonucleotide
  Target: SCN9A; (+) strand; PAM type: NRG; PAM sequence: GAG
atgtgaaggacctcttcaag

SEQ ID NO: 39130 - DNA, 20 bp, Artificial Sequence
  Description of Artificial Sequence: Synthetic oligonucleotide
  Target: SCN9A; (+) strand; PAM type: NRG; PAM sequence: CAG
gagaactacaaaccactgct

SEQ ID NO: 39131 - DNA, 20 bp, Artificial Sequence
  Description of Artificial Sequence: Synthetic oligonucleotide
  Target: SCN9A; (+) strand; PAM type: NRG; PAM sequence: AAG
accactgctcagcgaaataa

SEQ ID NO: 39132 - DNA, 20 bp, Artificial Sequence
  Description of Artificial Sequence: Synthetic oligonucleotide
  Target: SCN9A; (+) strand; PAM type: NRG; PAM sequence: GAG
cactgctcagcgaaataaaa

SEQ ID NO: 39133 - DNA, 20 bp, Artificial Sequence
  Description of Artificial Sequence: Synthetic oligonucleotide
  Target: SCN9A; (+) strand; PAM type: NRG; PAM sequence: AGG
actgctcagcgaaataaaag

SEQ ID NO: 39134 - DNA, 20 bp, Artificial Sequence
  Description of Artificial Sequence: Synthetic oligonucleotide
  Target: SCN9A; (+) strand; PAM type: NRG; PAM sequence: TGG
taaaagaggacacaaacaaa

SEQ ID NO: 39135 - DNA, 20 bp, Artificial Sequence
  Description of Artificial Sequence: Synthetic oligonucleotide
  Target: SCN9A; (+) strand; PAM type: NRG; PAM sequence: AAG
aagaggacacaaacaaatgg

SEQ ID NO: 39136 - DNA, 20 bp, Artificial Sequence
  Description of Artificial Sequence: Synthetic oligonucleotide
  Target: SCN9A; (+) strand; PAM type: NRG; PAM sequence: TGG
ggaagaatattccatgctca

SEQ ID NO: 39137 - DNA, 20 bp, Artificial Sequence
  Description of Artificial Sequence: Synthetic oligonucleotide
  Target: SCN9A; (+) strand; PAM type: NRG; PAM sequence: TAG
gaatattccatgctcatgga

SEQ ID NO: 39138 - DNA, 20 bp, Artificial Sequence
  Description of Artificial Sequence: Synthetic oligonucleotide
  Target: SCN9A; (+) strand; PAM type: NRG; PAM sequence: AGG
aatattccatgctcatggat

SEQ ID NO: 39139 - DNA, 20 bp, Artificial Sequence
  Description of Artificial Sequence: Synthetic oligonucleotide
  Target: SCN9A; (+) strand; PAM type: NRG; PAM sequence: AAG
attccatgctcatggatagg

SEQ ID NO: 39140 - DNA, 20 bp, Artificial Sequence
  Description of Artificial Sequence: Synthetic oligonucleotide
  Target: SCN9A; (+) strand; PAM type: NRG; PAM sequence: TGG
aagactcaatatcatgaaaa

SEQ ID NO: 39141 - DNA, 20 bp, Artificial Sequence
  Description of Artificial Sequence: Synthetic oligonucleotide
  Target: SCN9A; (+) strand; PAM type: NRG; PAM sequence: AAG
tgaaaatggcattactgccc

SEQ ID NO: 39142 - DNA, 20 bp, Artificial Sequence
  Description of Artificial Sequence: Synthetic oligonucleotide
  Target: SCN9A; (+) strand; PAM type: NRG; PAM sequence: AGG
gaaaatggcattactgccca

SEQ ID NO: 39143 - DNA, 20 bp, Artificial Sequence
  Description of Artificial Sequence: Synthetic oligonucleotide
  Target: SCN9A; (+) strand; PAM type: NRG; PAM sequence: AAG
aattcaatgctatccccatc

SEQ ID NO: 39144 - DNA, 20 bp, Artificial Sequence
  Description of Artificial Sequence: Synthetic oligonucleotide
  Target: SCN9A; (+) strand; PAM type: NRG; PAM sequence: TGG
actgactttcttcacaaaat

SEQ ID NO: 39145 - DNA, 20 bp, Artificial Sequence
  Description of Artificial Sequence: Synthetic oligonucleotide
  Target: SCN9A; (+) strand; PAM type: NRG; PAM sequence: AAG
attggaaaaaaactacttta

SEQ ID NO: 39146 - DNA, 20 bp, Artificial Sequence
  Description of Artificial Sequence: Synthetic oligonucleotide
  Target: SCN9A; (+) strand; PAM type: NRG; PAM sequence: TGG
aaactactttaaagttcata

SEQ ID NO: 39147 - DNA, 20 bp, Artificial Sequence
  Description of Artificial Sequence: Synthetic oligonucleotide
  Target: SCN9A; (+) strand; PAM type: NRG; PAM sequence: AAG
aagttcatatggaaccaaaa

SEQ ID NO: 39148 - DNA, 20 bp, Artificial Sequence
  Description of Artificial Sequence: Synthetic oligonucleotide
  Target: SCN9A; (+) strand; PAM type: NRG; PAM sequence: GAG
gttcatatggaaccaaaaaa

SEQ ID NO: 39149 - DNA, 20 bp, Artificial Sequence
  Description of Artificial Sequence: Synthetic oligonucleotide
  Target: SCN9A; (+) strand; PAM type: NRG; PAM sequence: TAG
gaaccaaaaaagagcctgca

SEQ ID NO: 39150 - DNA, 20 bp, Artificial Sequence
  Description of Artificial Sequence: Synthetic oligonucleotide
  Target: SCN9A; (+) strand; PAM type: NRG; PAM sequence: AAG
aaaaaagagcctgcatagcc

SEQ ID NO: 39151 - DNA, 20 bp, Artificial Sequence
  Description of Artificial Sequence: Synthetic oligonucleotide
  Target: SCN9A; (+) strand; PAM type: NRG; PAM sequence: AAG
tgcatagccaagataatcct

SEQ ID NO: 39152 - DNA, 20 bp, Artificial Sequence
  Description of Artificial Sequence: Synthetic oligonucleotide
  Target: SCN9A; (+) strand; PAM type: NRG; PAM sequence: AAG
ccaagataatcctaagcaaa

SEQ ID NO: 39153 - DNA, 20 bp, Artificial Sequence
  Description of Artificial Sequence: Synthetic oligonucleotide
  Target: SCN9A; (+) strand; PAM type: NRG; PAM sequence: AAG
aatcctaagcaaaaagaaca

SEQ ID NO: 39154 - DNA, 20 bp, Artificial Sequence
  Description of Artificial Sequence: Synthetic oligonucleotide
  Target: SCN9A; (+) strand; PAM type: NRG; PAM sequence: TGG
ctaagcaaaaagaacaaagc

SEQ ID NO: 39155 - DNA, 20 bp, Artificial Sequence
  Description of Artificial Sequence: Synthetic oligonucleotide
  Target: SCN9A; (+) strand; PAM type: NRG; PAM sequence: GAG
aagcaaaaagaacaaagctg

SEQ ID NO: 39156 - DNA, 20 bp, Artificial Sequence
  Description of Artificial Sequence: Synthetic oligonucleotide
  Target: SCN9A; (+) strand; PAM type: NRG; PAM sequence: AGG
agcaaaaagaacaaagctgg

SEQ ID NO: 39157 - DNA, 20 bp, Artificial Sequence
  Description of Artificial Sequence: Synthetic oligonucleotide
  Target: SCN9A; (+) strand; PAM type: NRG; PAM sequence: AAG
ctgacttcaaactatactac

SEQ ID NO: 39158 - DNA, 20 bp, Artificial Sequence
  Description of Artificial Sequence: Synthetic oligonucleotide
  Target: SCN9A; (+) strand; PAM type: NRG; PAM sequence: AGG
tgacttcaaactatactaca

SEQ ID NO: 39159 - DNA, 20 bp, Artificial Sequence
  Description of Artificial Sequence: Synthetic oligonucleotide
  Target: SCN9A; (+) strand; PAM type: NRG; PAM sequence: CAG
caaactatactacaaggcta

SEQ ID NO: 39160 - DNA, 20 bp, Artificial Sequence
  Description of Artificial Sequence: Synthetic oligonucleotide
  Target: SCN9A; (+) strand; PAM type: NRG; PAM sequence: CAG
caaggctacagtaaccaaaa

SEQ ID NO: 39161 - DNA, 20 bp, Artificial Sequence
  Description of Artificial Sequence: Synthetic oligonucleotide
  Target: SCN9A; (+) strand; PAM type: NRG; PAM sequence: TGG
ctacagtaaccaaaacagca

SEQ ID NO: 39162 - DNA, 20 bp, Artificial Sequence
  Description of Artificial Sequence: Synthetic oligonucleotide
  Target: SCN9A; (+) strand; PAM type: NRG; PAM sequence: TGG
taaccaaaacagcatggtac

SEQ ID NO: 39163 - DNA, 20 bp, Artificial Sequence
  Description of Artificial Sequence: Synthetic oligonucleotide
  Target: SCN9A; (+) strand; PAM type: NRG; PAM sequence: CAG
gcatggtactggtaccaaaa

SEQ ID NO: 39164 - DNA, 20 bp, Artificial Sequence
  Description of Artificial Sequence: Synthetic oligonucleotide
  Target: SCN9A; (+) strand; PAM type: NRG; PAM sequence: CAG
aaaacagatacatacaccaa

SEQ ID NO: 39165 - DNA, 20 bp, Artificial Sequence
  Description of Artificial Sequence: Synthetic oligonucleotide
  Target: SCN9A; (+) strand; PAM type: NRG; PAM sequence: CAG
agatacatacaccaacagaa

SEQ ID NO: 39166 - DNA, 20 bp, Artificial Sequence
  Description of Artificial Sequence: Synthetic oligonucleotide
  Target: SCN9A; (+) strand; PAM type: NRG; PAM sequence: CAG
catacaccaacagaacagaa

SEQ ID NO: 39167 - DNA, 20 bp, Artificial Sequence
  Description of Artificial Sequence: Synthetic oligonucleotide
  Target: SCN9A; (+) strand; PAM type: NRG; PAM sequence: GAG
tacaccaacagaacagaaca

SEQ ID NO: 39168 - DNA, 20 bp, Artificial Sequence
  Description of Artificial Sequence: Synthetic oligonucleotide
  Target: SCN9A; (+) strand; PAM type: NRG; PAM sequence: AGG
acaccaacagaacagaacag

SEQ ID NO: 39169 - DNA, 20 bp, Artificial Sequence
  Description of Artificial Sequence: Synthetic oligonucleotide
  Target: SCN9A; (+) strand; PAM type: NRG; PAM sequence: CAG
acagaacagaacagaggcct

SEQ ID NO: 39170 - DNA, 20 bp, Artificial Sequence
  Description of Artificial Sequence: Synthetic oligonucleotide
  Target: SCN9A; (+) strand; PAM type: NRG; PAM sequence: AAG
ttgacaaacctcacaaaaac

SEQ ID NO: 39171 - DNA, 20 bp, Artificial Sequence
  Description of Artificial Sequence: Synthetic oligonucleotide
  Target: SCN9A; (+) strand; PAM type: NRG; PAM sequence: CGG
aacctcacaaaaacaagcaa

SEQ ID NO: 39172 - DNA, 20 bp, Artificial Sequence
  Description of Artificial Sequence: Synthetic oligonucleotide
  Target: SCN9A; (+) strand; PAM type: NRG; PAM sequence: GGG
acctcacaaaaacaagcaac

SEQ ID NO: 39173 - DNA, 20 bp, Artificial Sequence
  Description of Artificial Sequence: Synthetic oligonucleotide
  Target: SCN9A; (+) strand; PAM type: NRG; PAM sequence: GGG
cctcacaaaaacaagcaacg

SEQ ID NO: 39174 - DNA, 20 bp, Artificial Sequence
  Description of Artificial Sequence: Synthetic oligonucleotide
  Target: SCN9A; (+) strand; PAM type: NRG; PAM sequence: AAG
acaaaaacaagcaacgggga

SEQ ID NO: 39175 - DNA, 20 bp, Artificial Sequence
  Description of Artificial Sequence: Synthetic oligonucleotide
  Target: SCN9A; (+) strand; PAM type: NRG; PAM sequence: AGG
caaaaacaagcaacggggaa

SEQ ID NO: 39176 - DNA, 20 bp, Artificial Sequence
  Description of Artificial Sequence: Synthetic oligonucleotide
  Target: SCN9A; (+) strand; PAM type: NRG; PAM sequence: TGG
ccctatttaataaatgatgc

SEQ ID NO: 39177 - DNA, 20 bp, Artificial Sequence
  Description of Artificial Sequence: Synthetic oligonucleotide
  Target: SCN9A; (+) strand; PAM type: NRG; PAM sequence: GGG
cctatttaataaatgatgct

SEQ ID NO: 39178 - DNA, 20 bp, Artificial Sequence
  Description of Artificial Sequence: Synthetic oligonucleotide
  Target: SCN9A; (+) strand; PAM type: NRG; PAM sequence: TGG
ataaatgatgctgggaaaac

SEQ ID NO: 39179 - DNA, 20 bp, Artificial Sequence
  Description of Artificial Sequence: Synthetic oligonucleotide
  Target: SCN9A; (+) strand; PAM type: NRG; PAM sequence: TAG
atgatgctgggaaaactggc

SEQ ID NO: 39180 - DNA, 20 bp, Artificial Sequence
  Description of Artificial Sequence: Synthetic oligonucleotide
  Target: SCN9A; (+) strand; PAM type: NRG; PAM sequence: TAG
gaaaactggctagccatatg

SEQ ID NO: 39181 - DNA, 20 bp, Artificial Sequence
  Description of Artificial Sequence: Synthetic oligonucleotide
  Target: SCN9A; (+) strand; PAM type: NRG; PAM sequence: AAG
actggctagccatatgtaga

SEQ ID NO: 39182 - DNA, 20 bp, Artificial Sequence
  Description of Artificial Sequence: Synthetic oligonucleotide
  Target: SCN9A; (+) strand; PAM type: NRG; PAM sequence: TGG
catatgtagaaagttgaaac

SEQ ID NO: 39183 - DNA, 20 bp, Artificial Sequence
  Description of Artificial Sequence: Synthetic oligonucleotide
  Target: SCN9A; (+) strand; PAM type: NRG; PAM sequence: AAG
ccttgtacaaaaattaactc

SEQ ID NO: 39184 - DNA, 20 bp, Artificial Sequence
  Description of Artificial Sequence: Synthetic oligonucleotide
  Target: SCN9A; (+) strand; PAM type: NRG; PAM sequence: TGG
gtacaaaaattaactcaaga

SEQ ID NO: 39185 - DNA, 20 bp, Artificial Sequence
  Description of Artificial Sequence: Synthetic oligonucleotide
  Target: SCN9A; (+) strand; PAM type: NRG; PAM sequence: AAG
aattaactcaagatggatta

SEQ ID NO: 39186 - DNA, 20 bp, Artificial Sequence
  Description of Artificial Sequence: Synthetic oligonucleotide
  Target: SCN9A; (+) strand; PAM type: NRG; PAM sequence: AAG
tggattaaagacttaaatgt

SEQ ID NO: 39187 - DNA, 20 bp, Artificial Sequence
  Description of Artificial Sequence: Synthetic oligonucleotide
  Target: SCN9A; (+) strand; PAM type: NRG; PAM sequence: TAG
acctaaaaccataaaaaccc

SEQ ID NO: 39188 - DNA, 20 bp, Artificial Sequence
  Description of Artificial Sequence: Synthetic oligonucleotide
  Target: SCN9A; (+) strand; PAM type: NRG; PAM sequence: AAG
taaaaccataaaaaccctag

SEQ ID NO: 39189 - DNA, 20 bp, Artificial Sequence
  Description of Artificial Sequence: Synthetic oligonucleotide
  Target: SCN9A; (+) strand; PAM type: NRG; PAM sequence: TAG
aaaaaccctagaagaaactc

SEQ ID NO: 39190 - DNA, 20 bp, Artificial Sequence
  Description of Artificial Sequence: Synthetic oligonucleotide
  Target: SCN9A; (+) strand; PAM type: NRG; PAM sequence: AGG
aaaaccctagaagaaactct

SEQ ID NO: 39191 - DNA, 20 bp, Artificial Sequence
  Description of Artificial Sequence: Synthetic oligonucleotide
  Target: SCN9A; (+) strand; PAM type: NRG; PAM sequence: CAG
aaactctaggcaatatcatt

SEQ ID NO: 39192 - DNA, 20 bp, Artificial Sequence
  Description of Artificial Sequence: Synthetic oligonucleotide
  Target: SCN9A; (+) strand; PAM type: NRG; PAM sequence: AGG
aactctaggcaatatcattc

SEQ ID NO: 39193 - DNA, 20 bp, Artificial Sequence
  Description of Artificial Sequence: Synthetic oligonucleotide
  Target: SCN9A; (+) strand; PAM type: NRG; PAM sequence: TAG
aggcaatatcattcaggaca

SEQ ID NO: 39194 - DNA, 20 bp, Artificial Sequence
  Description of Artificial Sequence: Synthetic oligonucleotide
  Target: SCN9A; (+) strand; PAM type: NRG; PAM sequence: AGG
ggcaatatcattcaggacat

SEQ ID NO: 39195 - DNA, 20 bp, Artificial Sequence
  Description of Artificial Sequence: Synthetic oligonucleotide
  Target: SCN9A; (+) strand; PAM type: NRG; PAM sequence: TGG
tatcattcaggacataggca

SEQ ID NO: 39196 - DNA, 20 bp, Artificial Sequence
  Description of Artificial Sequence: Synthetic oligonucleotide
  Target: SCN9A; (+) strand; PAM type: NRG; PAM sequence: GGG
atcattcaggacataggcat

SEQ ID NO: 39197 - DNA, 20 bp, Artificial Sequence
  Description of Artificial Sequence: Synthetic oligonucleotide
  Target: SCN9A; (+) strand; PAM type: NRG; PAM sequence: AAG
tcaggacataggcatgggca

SEQ ID NO: 39198 - DNA, 20 bp, Artificial Sequence
  Description of Artificial Sequence: Synthetic oligonucleotide
  Target: SCN9A; (+) strand; PAM type: NRG; PAM sequence: AAG
cttcatgactaaaacaccaa

SEQ ID NO: 39199 - DNA, 20 bp, Artificial Sequence
  Description of Artificial Sequence: Synthetic oligonucleotide
  Target: SCN9A; (+) strand; PAM type: NRG; PAM sequence: TGG
gactaaaacaccaaaagcaa

SEQ ID NO: 39200 - DNA, 20 bp, Artificial Sequence
  Description of Artificial Sequence: Synthetic oligonucleotide
  Target: SCN9A; (+) strand; PAM type: NRG; PAM sequence: AAG
accaaaagcaatggcaacaa

SEQ ID NO: 39201 - DNA, 20 bp, Artificial Sequence
  Description of Artificial Sequence: Synthetic oligonucleotide
  Target: SCN9A; (+) strand; PAM type: NRG; PAM sequence: CAG
aatggcaacaaaagccaaaa

SEQ ID NO: 39202 - DNA, 20 bp, Artificial Sequence
  Description of Artificial Sequence: Synthetic oligonucleotide
  Target: SCN9A; (+) strand; PAM type: NRG; PAM sequence: TGG
caaaagccaaaacagacaaa

SEQ ID NO: 39203 - DNA, 20 bp, Artificial Sequence
  Description of Artificial Sequence: Synthetic oligonucleotide
  Target: SCN9A; (+) strand; PAM type: NRG; PAM sequence: GGG
aaaagccaaaacagacaaat

SEQ ID NO: 39204 - DNA, 20 bp, Artificial Sequence
  Description of Artificial Sequence: Synthetic oligonucleotide
  Target: SCN9A; (+) strand; PAM type: NRG; PAM sequence: AAG
aatgggatctaattaaacta

SEQ ID NO: 39205 - DNA, 20 bp, Artificial Sequence
  Description of Artificial Sequence: Synthetic oligonucleotide
  Target: SCN9A; (+) strand; PAM type: NRG; PAM sequence: GAG
tgggatctaattaaactaaa

SEQ ID NO: 39206 - DNA, 20 bp, Artificial Sequence
  Description of Artificial Sequence: Synthetic oligonucleotide
  Target: SCN9A; (+) strand; PAM type: NRG; PAM sequence: AAG
taaactaaagagcttctgca

SEQ ID NO: 39207 - DNA, 20 bp, Artificial Sequence
  Description of Artificial Sequence: Synthetic oligonucleotide
  Target: SCN9A; (+) strand; PAM type: NRG; PAM sequence: AAG
aaagagcttctgcaaagcaa

SEQ ID NO: 39208 - DNA, 20 bp, Artificial Sequence
  Description of Artificial Sequence: Synthetic oligonucleotide
  Target: SCN9A; (+) strand; PAM type: NRG; PAM sequence: CAG
aaagcaaaagaaactatcat

SEQ ID NO: 39209 - DNA, 20 bp, Artificial Sequence
  Description of Artificial Sequence: Synthetic oligonucleotide
  Target: SCN9A; (+) strand; PAM type: NRG; PAM sequence: GAG
agcaaaagaaactatcatca

SEQ ID NO: 39210 - DNA, 20 bp, Artificial Sequence
  Description of Artificial Sequence: Synthetic oligonucleotide
  Target: SCN9A; (+) strand; PAM type: NRG; PAM sequence: CAG
gaaactatcatcagagtgaa

SEQ ID NO: 39211 - DNA, 20 bp, Artificial Sequence
  Description of Artificial Sequence: Synthetic oligonucleotide
  Target: SCN9A; (+) strand; PAM type: NRG; PAM sequence: AGG
aaactatcatcagagtgaac

SEQ ID NO: 39212 - DNA, 20 bp, Artificial Sequence
  Description of Artificial Sequence: Synthetic oligonucleotide
  Target: SCN9A; (+) strand; PAM type: NRG; PAM sequence: CAG
cagagtgaacaggcaaccta

SEQ ID NO: 39213 - DNA, 20 bp, Artificial Sequence
  Description of Artificial Sequence: Synthetic oligonucleotide
  Target: SCN9A; (+) strand; PAM type: NRG; PAM sequence: TGG
tgaacaggcaacctacagaa

SEQ ID NO: 39214 - DNA, 20 bp, Artificial Sequence
  Description of Artificial Sequence: Synthetic oligonucleotide
  Target: SCN9A; (+) strand; PAM type: NRG; PAM sequence: GGG
gaacaggcaacctacagaat

SEQ ID NO: 39215 - DNA, 20 bp, Artificial Sequence
  Description of Artificial Sequence: Synthetic oligonucleotide
  Target: SCN9A; (+) strand; PAM type: NRG; PAM sequence: GAG
acaggcaacctacagaatgg

SEQ ID NO: 39216 - DNA, 20 bp, Artificial Sequence
  Description of Artificial Sequence: Synthetic oligonucleotide
  Target: SCN9A; (+) strand; PAM type: NRG; PAM sequence: AAG
gcaatttatccatctgacaa

SEQ ID NO: 39217 - DNA, 20 bp, Artificial Sequence
  Description of Artificial Sequence: Synthetic oligonucleotide
  Target: SCN9A; (+) strand; PAM type: NRG; PAM sequence: AGG
caatttatccatctgacaaa

SEQ ID NO: 39218 - DNA, 20 bp, Artificial Sequence
  Description of Artificial Sequence: Synthetic oligonucleotide
  Target: SCN9A; (+) strand; PAM type: NRG; PAM sequence: GGG
aatttatccatctgacaaaa

SEQ ID NO: 39219 - DNA, 20 bp, Artificial Sequence
  Description of Artificial Sequence: Synthetic oligonucleotide
  Target: SCN9A; (+) strand; PAM type: NRG; PAM sequence: CAG
ctgacaaaagggctaatatc

SEQ ID NO: 39220 - DNA, 20 bp, Artificial Sequence
  Description of Artificial Sequence: Synthetic oligonucleotide
  Target: SCN9A; (+) strand; PAM type: NRG; PAM sequence: AAG
gctaatatccagaatctaca

SEQ ID NO: 39221 - DNA, 20 bp, Artificial Sequence
  Description of Artificial Sequence: Synthetic oligonucleotide
  Target: SCN9A; (+) strand; PAM type: NRG; PAM sequence: AAG
aagaacttaaacaaatttac

SEQ ID NO: 39222 - DNA, 20 bp, Artificial Sequence
  Description of Artificial Sequence: Synthetic oligonucleotide
  Target: SCN9A; (+) strand; PAM type: NRG; PAM sequence: AAG
aaacaaacaactccatcaaa

SEQ ID NO: 39223 - DNA, 20 bp, Artificial Sequence
  Description of Artificial Sequence: Synthetic oligonucleotide
  Target: SCN9A; (+) strand; PAM type: NRG; PAM sequence: TGG
caaacaactccatcaaaaag

SEQ ID NO: 39224 - DNA, 20 bp, Artificial Sequence
  Description of Artificial Sequence: Synthetic oligonucleotide
  Target: SCN9A; (+) strand; PAM type: NRG; PAM sequence: GGG
aaacaactccatcaaaaagt

SEQ ID NO: 39225 - DNA, 20 bp, Artificial Sequence
  Description of Artificial Sequence: Synthetic oligonucleotide
  Target: SCN9A; (+) strand; PAM type: NRG; PAM sequence: AAG
actccatcaaaaagtgggca

SEQ ID NO: 39226 - DNA, 20 bp, Artificial Sequence
  Description of Artificial Sequence: Synthetic oligonucleotide
  Target: SCN9A; (+) strand; PAM type: NRG; PAM sequence: AGG
ctccatcaaaaagtgggcaa

SEQ ID NO: 39227 - DNA, 20 bp, Artificial Sequence
  Description of Artificial Sequence: Synthetic oligonucleotide
  Target: SCN9A; (+) strand; PAM type: NRG; PAM sequence: CAG
aagtgggcaaaggatatgaa

SEQ ID NO: 39228 - DNA, 20 bp, Artificial Sequence
  Description of Artificial Sequence: Synthetic oligonucleotide
  Target: SCN9A; (+) strand; PAM type: NRG; PAM sequence: AGG
agtgggcaaaggatatgaac

SEQ ID NO: 39229 - DNA, 20 bp, Artificial Sequence
  Description of Artificial Sequence: Synthetic oligonucleotide
  Target: SCN9A; (+) strand; PAM type: NRG; PAM sequence: AAG
tatgaacaggtacttctcaa

SEQ ID NO: 39230 - DNA, 20 bp, Artificial Sequence
  Description of Artificial Sequence: Synthetic oligonucleotide
  Target: SCN9A; (+) strand; PAM type: NRG; PAM sequence: AAG
gaacaggtacttctcaaaag

SEQ ID NO: 39231 - DNA, 20 bp, Artificial Sequence
  Description of Artificial Sequence: Synthetic oligonucleotide
  Target: SCN9A; (+) strand; PAM type: NRG; PAM sequence: CAG
ctcaaaagaagacatttatg

SEQ ID NO: 39232 - DNA, 20 bp, Artificial Sequence
  Description of Artificial Sequence: Synthetic oligonucleotide
  Target: SCN9A; (+) strand; PAM type: NRG; PAM sequence: CAG
gaagacatttatgcagccaa

SEQ ID NO: 39233 - DNA, 20 bp, Artificial Sequence
  Description of Artificial Sequence: Synthetic oligonucleotide
  Target: SCN9A; (+) strand; PAM type: NRG; PAM sequence: TGG
gaaaaaatgctcatcatcac

SEQ ID NO: 39234 - DNA, 20 bp, Artificial Sequence
  Description of Artificial Sequence: Synthetic oligonucleotide
  Target: SCN9A; (+) strand; PAM type: NRG; PAM sequence: CAG
tgctcatcatcactggtcat

SEQ ID NO: 39235 - DNA, 20 bp, Artificial Sequence
  Description of Artificial Sequence: Synthetic oligonucleotide
  Target: SCN9A; (+) strand; PAM type: NRG; PAM sequence: GAG
ctcatcatcactggtcatca

SEQ ID NO: 39236 - DNA, 20 bp, Artificial Sequence
  Description of Artificial Sequence: Synthetic oligonucleotide
  Target: SCN9A; (+) strand; PAM type: NRG; PAM sequence: GAG
acacaaatcaaaaccacaat

SEQ ID NO: 39237 - DNA, 20 bp, Artificial Sequence
  Description of Artificial Sequence: Synthetic oligonucleotide
  Target: SCN9A; (+) strand; PAM type: NRG; PAM sequence: TAG
agataccacctcatgccaat

SEQ ID NO: 39238 - DNA, 20 bp, Artificial Sequence
  Description of Artificial Sequence: Synthetic oligonucleotide
  Target: SCN9A; (+) strand; PAM type: NRG; PAM sequence: TGG
ccacctcatgccaattagaa

SEQ ID NO: 39239 - DNA, 20 bp, Artificial Sequence
  Description of Artificial Sequence: Synthetic oligonucleotide
  Target: SCN9A; (+) strand; PAM type: NRG; PAM sequence: AAG
ttagaatggcaatcactaaa

SEQ ID NO: 39240 - DNA, 20 bp, Artificial Sequence
  Description of Artificial Sequence: Synthetic oligonucleotide
  Target: SCN9A; (+) strand; PAM type: NRG; PAM sequence: CAG
aatggcaatcactaaaaagt

SEQ ID NO: 39241 - DNA, 20 bp, Artificial Sequence
  Description of Artificial Sequence: Synthetic oligonucleotide
  Target: SCN9A; (+) strand; PAM type: NRG; PAM sequence: AGG
atggcaatcactaaaaagtc

SEQ ID NO: 39242 - DNA, 20 bp, Artificial Sequence
  Description of Artificial Sequence: Synthetic oligonucleotide
  Target: SCN9A; (+) strand; PAM type: NRG; PAM sequence: CAG
actaaaaagtcaggaaacaa

SEQ ID NO: 39243 - DNA, 20 bp, Artificial Sequence
  Description of Artificial Sequence: Synthetic oligonucleotide
  Target: SCN9A; (+) strand; PAM type: NRG; PAM sequence: TGG
agtcaggaaacaacagatgt

SEQ ID NO: 39244 - DNA, 20 bp, Artificial Sequence
  Description of Artificial Sequence: Synthetic oligonucleotide
  Target: SCN9A; (+) strand; PAM type: NRG; PAM sequence: GAG
tcaggaaacaacagatgttg

SEQ ID NO: 39245 - DNA, 20 bp, Artificial Sequence
  Description of Artificial Sequence: Synthetic oligonucleotide
  Target: SCN9A; (+) strand; PAM type: NRG; PAM sequence: GAG
aggaaacaacagatgttgga

SEQ ID NO: 39246 - DNA, 20 bp, Artificial Sequence
  Description of Artificial Sequence: Synthetic oligonucleotide
  Target: SCN9A; (+) strand; PAM type: NRG; PAM sequence: AGG
ggaaacaacagatgttggag

SEQ ID NO: 39247 - DNA, 20 bp, Artificial Sequence
  Description of Artificial Sequence: Synthetic oligonucleotide
  Target: SCN9A; (+) strand; PAM type: NRG; PAM sequence: TGG
aacagatgttggagaggatg

SEQ ID NO: 39248 - DNA, 20 bp, Artificial Sequence
  Description of Artificial Sequence: Synthetic oligonucleotide
  Target: SCN9A; (+) strand; PAM type: NRG; PAM sequence: GAG
cagatgttggagaggatgtg

SEQ ID NO: 39249 - DNA, 20 bp, Artificial Sequence
  Description of Artificial Sequence: Synthetic oligonucleotide
  Target: SCN9A; (+) strand; PAM type: NRG; PAM sequence: TAG
ttggagaggatgtggagaaa

SEQ ID NO: 39250 - DNA, 20 bp, Artificial Sequence
  Description of Artificial Sequence: Synthetic oligonucleotide
  Target: SCN9A; (+) strand; PAM type: NRG; PAM sequence: TGG
tagcaacgcttttacactgt

SEQ ID NO: 39251 - DNA, 20 bp, Artificial Sequence
  Description of Artificial Sequence: Synthetic oligonucleotide
  Target: SCN9A; (+) strand; PAM type: NRG; PAM sequence: GAG
aacgcttttacactgttggt

SEQ ID NO: 39252 - DNA, 20 bp, Artificial Sequence
  Description of Artificial Sequence: Synthetic oligonucleotide
  Target: SCN9A; (+) strand; PAM type: NRG; PAM sequence: GAG
cgcttttacactgttggtga

SEQ ID NO: 39253 - DNA, 20 bp, Artificial Sequence
  Description of Artificial Sequence: Synthetic oligonucleotide
  Target: SCN9A; (+) strand; PAM type: NRG; PAM sequence: TAG
ctgttggtgagagtgtaaaa

SEQ ID NO: 39254 - DNA, 20 bp, Artificial Sequence
  Description of Artificial Sequence: Synthetic oligonucleotide
  Target: SCN9A; (+) strand; PAM type: NRG; PAM sequence: TGG
gtaaaatagttcaaccattg

SEQ ID NO: 39255 - DNA, 20 bp, Artificial Sequence
  Description of Artificial Sequence: Synthetic oligonucleotide
  Target: SCN9A; (+) strand; PAM type: NRG; PAM sequence: AAG
aaatagttcaaccattgtgg

SEQ ID NO: 39256 - DNA, 20 bp, Artificial Sequence
  Description of Artificial Sequence: Synthetic oligonucleotide
  Target: SCN9A; (+) strand; PAM type: NRG; PAM sequence: CAG
agttcaaccattgtggaaga

SEQ ID NO: 39257 - DNA, 20 bp, Artificial Sequence
  Description of Artificial Sequence: Synthetic oligonucleotide
  Target: SCN9A; (+) strand; PAM type: NRG; PAM sequence: AAG
agacagtgtgatgattcctc

SEQ ID NO: 39258 - DNA, 20 bp, Artificial Sequence
  Description of Artificial Sequence: Synthetic oligonucleotide
  Target: SCN9A; (+) strand; PAM type: NRG; PAM sequence: TAG
attcctcaagaatctaaaac

SEQ ID NO: 39259 - DNA, 20 bp, Artificial Sequence
  Description of Artificial Sequence: Synthetic oligonucleotide
  Target: SCN9A; (+) strand; PAM type: NRG; PAM sequence: CAG
actagaaataccatttgacc

SEQ ID NO: 39260 - DNA, 20 bp, Artificial Sequence
  Description of Artificial Sequence: Synthetic oligonucleotide
  Target: SCN9A; (+) strand; PAM type: NRG; PAM sequence: TGG
tgacccagcaatctcattac

SEQ ID NO: 39261 - DNA, 20 bp, Artificial Sequence
  Description of Artificial Sequence: Synthetic oligonucleotide
  Target: SCN9A; (+) strand; PAM type: NRG; PAM sequence: GGG
gacccagcaatctcattact

SEQ ID NO: 39262 - DNA, 20 bp, Artificial Sequence
  Description of Artificial Sequence: Synthetic oligonucleotide
  Target: SCN9A; (+) strand; PAM type: NRG; PAM sequence: AAG
tcattactgggtatatactc

SEQ ID NO: 39263 - DNA, 20 bp, Artificial Sequence
  Description of Artificial Sequence: Synthetic oligonucleotide
  Target: SCN9A; (+) strand; PAM type: NRG; PAM sequence: AGG
cattactgggtatatactca

SEQ ID NO: 39264 - DNA, 20 bp, Artificial Sequence
  Description of Artificial Sequence: Synthetic oligonucleotide
  Target: SCN9A; (+) strand; PAM type: NRG; PAM sequence: GGG
attactgggtatatactcaa

SEQ ID NO: 39265 - DNA, 20 bp, Artificial Sequence
  Description of Artificial Sequence: Synthetic oligonucleotide
  Target: SCN9A; (+) strand; PAM type: NRG; PAM sequence: AAG
ttgtaaatcatgctactata

SEQ ID NO: 39266 - DNA, 20 bp, Artificial Sequence
  Description of Artificial Sequence: Synthetic oligonucleotide
  Target: SCN9A; (+) strand; PAM type: NRG; PAM sequence: CAG
atgcatatgtatatttattg

SEQ ID NO: 39267 - DNA, 20 bp, Artificial Sequence
  Description of Artificial Sequence: Synthetic oligonucleotide
  Target: SCN9A; (+) strand; PAM type: NRG; PAM sequence: TAG
tattgcagcactattcacaa

SEQ ID NO: 39268 - DNA, 20 bp, Artificial Sequence
  Description of Artificial Sequence: Synthetic oligonucleotide
  Target: SCN9A; (+) strand; PAM type: NRG; PAM sequence: AAG
cagcactattcacaatagca

SEQ ID NO: 39269 - DNA, 20 bp, Artificial Sequence
  Description of Artificial Sequence: Synthetic oligonucleotide
  Target: SCN9A; (+) strand; PAM type: NRG; PAM sequence: TGG
tattcacaatagcaaagact

SEQ ID NO: 39270 - DNA, 20 bp, Artificial Sequence
  Description of Artificial Sequence: Synthetic oligonucleotide
  Target: SCN9A; (+) strand; PAM type: NRG; PAM sequence: TAG
acccaaatgtccatcaataa

SEQ ID NO: 39271 - DNA, 20 bp, Artificial Sequence
  Description of Artificial Sequence: Synthetic oligonucleotide
  Target: SCN9A; (+) strand; PAM type: NRG; PAM sequence: TGG
aatgtccatcaataatagac

SEQ ID NO: 39272 - DNA, 20 bp, Artificial Sequence
  Description of Artificial Sequence: Synthetic oligonucleotide
  Target: SCN9A; (+) strand; PAM type: NRG; PAM sequence: AAG
catcaataatagactggata

SEQ ID NO: 39273 - DNA, 20 bp, Artificial Sequence
  Description of Artificial Sequence: Synthetic oligonucleotide
  Target: SCN9A; (+) strand; PAM type: NRG; PAM sequence: TGG
tagactggataaagaaaatg

SEQ ID NO: 39274 - DNA, 20 bp, Artificial Sequence
  Description of Artificial Sequence: Synthetic oligonucleotide
  Target: SCN9A; (+) strand; PAM type: NRG; PAM sequence: TGG
aatgtggcatatatacacca

SEQ ID NO: 39275 - DNA, 20 bp, Artificial Sequence
  Description of Artificial Sequence: Synthetic oligonucleotide
  Target: SCN9A; (+) strand; PAM type: NRG; PAM sequence: CAG
atacaccatggaatactatg

SEQ ID NO: 39276 - DNA, 20 bp, Artificial Sequence
  Description of Artificial Sequence: Synthetic oligonucleotide
  Target: SCN9A; (+) strand; PAM type: NRG; PAM sequence: AAG
aatactatgcagccataaaa

SEQ ID NO: 39277 - DNA, 20 bp, Artificial Sequence
  Description of Artificial Sequence: Synthetic oligonucleotide
  Target: SCN9A; (+) strand; PAM type: NRG; PAM sequence: AGG
atactatgcagccataaaaa

SEQ ID NO: 39278 - DNA, 20 bp, Artificial Sequence
  Description of Artificial Sequence: Synthetic oligonucleotide
  Target: SCN9A; (+) strand; PAM type: NRG; PAM sequence: GAG
atgcagccataaaaaaggat

SEQ ID NO: 39279 - DNA, 20 bp, Artificial Sequence
  Description of Artificial Sequence: Synthetic oligonucleotide
  Target: SCN9A; (+) strand; PAM type: NRG; PAM sequence: TAG
ggatgagttcatgtcctttg

SEQ ID NO: 39280 - DNA, 20 bp, Artificial Sequence
  Description of Artificial Sequence: Synthetic oligonucleotide
  Target: SCN9A; (+) strand; PAM type: NRG; PAM sequence: AGG
gatgagttcatgtcctttgt

SEQ ID NO: 39281 - DNA, 20 bp, Artificial Sequence
  Description of Artificial Sequence: Synthetic oligonucleotide
  Target: SCN9A; (+) strand; PAM type: NRG; PAM sequence: GGG
atgagttcatgtcctttgta

SEQ ID NO: 39282 - DNA, 20 bp, Artificial Sequence
  Description of Artificial Sequence: Synthetic oligonucleotide
  Target: SCN9A; (+) strand; PAM type: NRG; PAM sequence: AAG
cctttgtagggacatgcatg

SEQ ID NO: 39283 - DNA, 20 bp, Artificial Sequence
  Description of Artificial Sequence: Synthetic oligonucleotide
  Target: SCN9A; (+) strand; PAM type: NRG; PAM sequence: TGG
tgtagggacatgcatgaagc

SEQ ID NO: 39284 - DNA, 20 bp, Artificial Sequence
  Description of Artificial Sequence: Synthetic oligonucleotide
  Target: SCN9A; (+) strand; PAM type: NRG; PAM sequence: CAG
aagctggaaaccatcattct

SEQ ID NO: 39285 - DNA, 20 bp, Artificial Sequence
  Description of Artificial Sequence: Synthetic oligonucleotide
  Target: SCN9A; (+) strand; PAM type: NRG; PAM sequence: AAG
cattctcagcaaaatatcac

SEQ ID NO: 39286 - DNA, 20 bp, Artificial Sequence
  Description of Artificial Sequence: Synthetic oligonucleotide
  Target: SCN9A; (+) strand; PAM type: NRG; PAM sequence: AGG
attctcagcaaaatatcaca

SEQ ID NO: 39287 - DNA, 20 bp, Artificial Sequence
  Description of Artificial Sequence: Synthetic oligonucleotide
  Target: SCN9A; (+) strand; PAM type: NRG; PAM sequence: CGG
tcagcaaaatatcacaagga

SEQ ID NO: 39288 - DNA, 20 bp, Artificial Sequence
  Description of Artificial Sequence: Synthetic oligonucleotide
  Target: SCN9A; (+) strand; PAM type: NRG; PAM sequence: AAG
ctctgcatgttctcactcat

SEQ ID NO: 39289 - DNA, 20 bp, Artificial Sequence
  Description of Artificial Sequence: Synthetic oligonucleotide
  Target: SCN9A; (+) strand; PAM type: NRG; PAM sequence: TGG
tgcatgttctcactcataag

SEQ ID NO: 39290 - DNA, 20 bp, Artificial Sequence
  Description of Artificial Sequence: Synthetic oligonucleotide
  Target: SCN9A; (+) strand; PAM type: NRG; PAM sequence: GGG
gcatgttctcactcataagt

SEQ ID NO: 39291 - DNA, 20 bp, Artificial Sequence
  Description of Artificial Sequence: Synthetic oligonucleotide
  Target: SCN9A; (+) strand; PAM type: NRG; PAM sequence: GAG
atgttctcactcataagtgg

SEQ ID NO: 39292 - DNA, 20 bp, Artificial Sequence
  Description of Artificial Sequence: Synthetic oligonucleotide
  Target: SCN9A; (+) strand; PAM type: NRG; PAM sequence: GAG
ataagtgggagttgaacaat

SEQ ID NO: 39293 - DNA, 20 bp, Artificial Sequence
  Description of Artificial Sequence: Synthetic oligonucleotide
  Target: SCN9A; (+) strand; PAM type: NRG; PAM sequence: TGG
agttgaacaatgagaacaca

SEQ ID NO: 39294 - DNA, 20 bp, Artificial Sequence
  Description of Artificial Sequence: Synthetic oligonucleotide
  Target: SCN9A; (+) strand; PAM type: NRG; PAM sequence: CAG
acaatgagaacacatggaca

SEQ ID NO: 39295 - DNA, 20 bp, Artificial Sequence
  Description of Artificial Sequence: Synthetic oligonucleotide
  Target: SCN9A; (+) strand; PAM type: NRG; PAM sequence: AGG
caatgagaacacatggacac

SEQ ID NO: 39296 - DNA, 20 bp, Artificial Sequence
  Description of Artificial Sequence: Synthetic oligonucleotide
  Target: SCN9A; (+) strand; PAM type: NRG; PAM sequence: GGG
aatgagaacacatggacaca

SEQ ID NO: 39297 - DNA, 20 bp, Artificial Sequence
  Description of Artificial Sequence: Synthetic oligonucleotide
  Target: SCN9A; (+) strand; PAM type: NRG; PAM sequence: GAG
tgagaacacatggacacagg

SEQ ID NO: 39298 - DNA, 20 bp, Artificial Sequence
  Description of Artificial Sequence: Synthetic oligonucleotide
  Target: SCN9A; (+) strand; PAM type: NRG; PAM sequence: AGG
gagaacacatggacacaggg

SEQ ID NO: 39299 - DNA, 20 bp, Artificial Sequence
  Description of Artificial Sequence: Synthetic oligonucleotide
  Target: SCN9A; (+) strand; PAM type: NRG; PAM sequence: GGG
agaacacatggacacaggga

SEQ ID NO: 39300 - DNA, 20 bp, Artificial Sequence
  Description of Artificial Sequence: Synthetic oligonucleotide
  Target: SCN9A; (+) strand; PAM type: NRG; PAM sequence: GGG
gaacacatggacacagggag

SEQ ID NO: 39301 - DNA, 20 bp, Artificial Sequence
  Description of Artificial Sequence: Synthetic oligonucleotide
  Target: SCN9A; (+) strand; PAM type: NRG; PAM sequence: CAG
gggaggggaacatcacacac

SEQ ID NO: 39302 - DNA, 20 bp, Artificial Sequence
  Description of Artificial Sequence: Synthetic oligonucleotide
  Target: SCN9A; (+) strand; PAM type: NRG; PAM sequence: AGG
ggaggggaacatcacacacc

SEQ ID NO: 39303 - DNA, 20 bp, Artificial Sequence
  Description of Artificial Sequence: Synthetic oligonucleotide
  Target: SCN9A; (+) strand; PAM type: NRG; PAM sequence: GGG
gaggggaacatcacacacca

SEQ ID NO: 39304 - DNA, 20 bp, Artificial Sequence
  Description of Artificial Sequence: Synthetic oligonucleotide
  Target: SCN9A; (+) strand; PAM type: NRG; PAM sequence: GGG
aggggaacatcacacaccag

SEQ ID NO: 39305 - DNA, 20 bp, Artificial Sequence
  Description of Artificial Sequence: Synthetic oligonucleotide
  Target: SCN9A; (+) strand; PAM type: NRG; PAM sequence: CAG
ggaacatcacacaccagggg

SEQ ID NO: 39306 - DNA, 20 bp, Artificial Sequence
  Description of Artificial Sequence: Synthetic oligonucleotide
  Target: SCN9A; (+) strand; PAM type: NRG; PAM sequence: TAG
catcacacaccaggggcagt

SEQ ID NO: 39307 - DNA, 20 bp, Artificial Sequence
  Description of Artificial Sequence: Synthetic oligonucleotide
  Target: SCN9A; (+) strand; PAM type: NRG; PAM sequence: AGG
atcacacaccaggggcagtt

SEQ ID NO: 39308 - DNA, 20 bp, Artificial Sequence
  Description of Artificial Sequence: Synthetic oligonucleotide
  Target: SCN9A; (+) strand; PAM type: NRG; PAM sequence: GGG
tcacacaccaggggcagtta

SEQ ID NO: 39309 - DNA, 20 bp, Artificial Sequence
  Description of Artificial Sequence: Synthetic oligonucleotide
  Target: SCN9A; (+) strand; PAM type: NRG; PAM sequence: GGG
cacacaccaggggcagttag

SEQ ID NO: 39310 - DNA, 20 bp, Artificial Sequence
  Description of Artificial Sequence: Synthetic oligonucleotide
  Target: SCN9A; (+) strand; PAM type: NRG; PAM sequence: GGG
acacaccaggggcagttagg

SEQ ID NO: 39311 - DNA, 20 bp, Artificial Sequence
  Description of Artificial Sequence: Synthetic oligonucleotide
  Target: SCN9A; (+) strand; PAM type: NRG; PAM sequence: TGG
accaggggcagttagggggt

SEQ ID NO: 39312 - DNA, 20 bp, Artificial Sequence
  Description of Artificial Sequence: Synthetic oligonucleotide
  Target: SCN9A; (+) strand; PAM type: NRG; PAM sequence: GGG
ccaggggcagttagggggtt

SEQ ID NO: 39313 - DNA, 20 bp, Artificial Sequence
  Description of Artificial Sequence: Synthetic oligonucleotide
  Target: SCN9A; (+) strand; PAM type: NRG; PAM sequence: GAG
aggggcagttagggggttgg

SEQ ID NO: 39314 - DNA, 20 bp, Artificial Sequence
  Description of Artificial Sequence: Synthetic oligonucleotide
  Target: SCN9A; (+) strand; PAM type: NRG; PAM sequence: TGG
agttagggggttgggagctt

SEQ ID NO: 39315 - DNA, 20 bp, Artificial Sequence
  Description of Artificial Sequence: Synthetic oligonucleotide
  Target: SCN9A; (+) strand; PAM type: NRG; PAM sequence: GGG
gttagggggttgggagcttt

SEQ ID NO: 39316 - DNA, 20 bp, Artificial Sequence
  Description of Artificial Sequence: Synthetic oligonucleotide
  Target: SCN9A; (+) strand; PAM type: NRG; PAM sequence: GAG
tagggggttgggagctttgg

SEQ ID NO: 39317 - DNA, 20 bp, Artificial Sequence
  Description of Artificial Sequence: Synthetic oligonucleotide
  Target: SCN9A; (+) strand; PAM type: NRG; PAM sequence: AGG
agggggttgggagctttggg

SEQ ID NO: 39318 - DNA, 20 bp, Artificial Sequence
  Description of Artificial Sequence: Synthetic oligonucleotide
  Target: SCN9A; (+) strand; PAM type: NRG; PAM sequence: GGG
gggggttgggagctttggga

SEQ ID NO: 39319 - DNA, 20 bp, Artificial Sequence
  Description of Artificial Sequence: Synthetic oligonucleotide
  Target: SCN9A; (+) strand; PAM type: NRG; PAM sequence: TAG
gagctttgggagggattact

SEQ ID NO: 39320 - DNA, 20 bp, Artificial Sequence
  Description of Artificial Sequence: Synthetic oligonucleotide
  Target: SCN9A; (+) strand; PAM type: NRG; PAM sequence: AGG
agctttgggagggattactt

SEQ ID NO: 39321 - DNA, 20 bp, Artificial Sequence
  Description of Artificial Sequence: Synthetic oligonucleotide
  Target: SCN9A; (+) strand; PAM type: NRG; PAM sequence: GAG
ctttgggagggattacttag

SEQ ID NO: 39322 - DNA, 20 bp, Artificial Sequence
  Description of Artificial Sequence: Synthetic oligonucleotide
  Target: SCN9A; (+) strand; PAM type: NRG; PAM sequence: GAG
aaatacctaatgtaaatgat

SEQ ID NO: 39323 - DNA, 20 bp, Artificial Sequence
  Description of Artificial Sequence: Synthetic oligonucleotide
  Target: SCN9A; (+) strand; PAM type: NRG; PAM sequence: TGG
aatgtaaatgatgagttgat

SEQ ID NO: 39324 - DNA, 20 bp, Artificial Sequence
  Description of Artificial Sequence: Synthetic oligonucleotide
  Target: SCN9A; (+) strand; PAM type: NRG; PAM sequence: CAG
aaatgatgagttgattggtg

SEQ ID NO: 39325 - DNA, 20 bp, Artificial Sequence
  Description of Artificial Sequence: Synthetic oligonucleotide
  Target: SCN9A; (+) strand; PAM type: NRG; PAM sequence: TGG
attggtgcagcaaaccaaca

SEQ ID NO: 39326 - DNA, 20 bp, Artificial Sequence
  Description of Artificial Sequence: Synthetic oligonucleotide
  Target: SCN9A; (+) strand; PAM type: NRG; PAM sequence: TAG
catgttttgcacatgtaccc

SEQ ID NO: 39327 - DNA, 20 bp, Artificial Sequence
  Description of Artificial Sequence: Synthetic oligonucleotide
  Target: SCN9A; (+) strand; PAM type: NRG; PAM sequence: AAG
cacatgtaccctagaactta

SEQ ID NO: 39328 - DNA, 20 bp, Artificial Sequence
  Description of Artificial Sequence: Synthetic oligonucleotide
  Target: SCN9A; (+) strand; PAM type: NRG; PAM sequence: AAG
ttaaagtataataataaaaa

SEQ ID NO: 39329 - DNA, 20 bp, Artificial Sequence
  Description of Artificial Sequence: Synthetic oligonucleotide
  Target: SCN9A; (+) strand; PAM type: NRG; PAM sequence: TAG
gtataataataaaaaaagaa

SEQ ID NO: 39330 - DNA, 20 bp, Artificial Sequence
  Description of Artificial Sequence: Synthetic oligonucleotide
  Target: SCN9A; (+) strand; PAM type: NRG; PAM sequence: AGG
tataataataaaaaaagaat

SEQ ID NO: 39331 - DNA, 20 bp, Artificial Sequence
  Description of Artificial Sequence: Synthetic oligonucleotide
  Target: SCN9A; (+) strand; PAM type: NRG; PAM sequence: GGG
ataataataaaaaaagaata

SEQ ID NO: 39332 - DNA, 20 bp, Artificial Sequence
  Description of Artificial Sequence: Synthetic oligonucleotide
  Target: SCN9A; (+) strand; PAM type: NRG; PAM sequence: GGG
taataataaaaaaagaatag

SEQ ID NO: 39333 - DNA, 20 bp, Artificial Sequence
  Description of Artificial Sequence: Synthetic oligonucleotide
  Target: SCN9A; (+) strand; PAM type: NRG; PAM sequence: AAG
catttctatatctctatttc

SEQ ID NO: 39334 - DNA, 20 bp, Artificial Sequence
  Description of Artificial Sequence: Synthetic oligonucleotide
  Target: SCN9A; (+) strand; PAM type: NRG; PAM sequence: AAG
tacctttttaattctaaata

SEQ ID NO: 39335 - DNA, 20 bp, Artificial Sequence
  Description of Artificial Sequence: Synthetic oligonucleotide
  Target: SCN9A; (+) strand; PAM type: NRG; PAM sequence: AGG
acctttttaattctaaataa

SEQ ID NO: 39336 - DNA, 20 bp, Artificial Sequence
  Description of Artificial Sequence: Synthetic oligonucleotide
  Target: SCN9A; (+) strand; PAM type: NRG; PAM sequence: TGG
tttcaacataaacactttat

SEQ ID NO: 39337 - DNA, 20 bp, Artificial Sequence
  Description of Artificial Sequence: Synthetic oligonucleotide
  Target: SCN9A; (+) strand; PAM type: NRG; PAM sequence: TAG
gatgtcaacattatccttga

SEQ ID NO: 39338 - DNA, 20 bp, Artificial Sequence
  Description of Artificial Sequence: Synthetic oligonucleotide
  Target: SCN9A; (+) strand; PAM type: NRG; PAM sequence: TAG
cattatccttgatagatttc

SEQ ID NO: 39339 - DNA, 20 bp, Artificial Sequence
  Description of Artificial Sequence: Synthetic oligonucleotide
  Target: SCN9A; (+) strand; PAM type: NRG; PAM sequence: AGG
attatccttgatagatttct

SEQ ID NO: 39340 - DNA, 20 bp, Artificial Sequence
  Description of Artificial Sequence: Synthetic oligonucleotide
  Target: SCN9A; (+) strand; PAM type: NRG; PAM sequence: GAG
ttgatagatttctaggtact

SEQ ID NO: 39341 - DNA, 20 bp, Artificial Sequence
  Description of Artificial Sequence: Synthetic oligonucleotide
  Target: SCN9A; (+) strand; PAM type: NRG; PAM sequence: AGG
tgatagatttctaggtactg

SEQ ID NO: 39342 - DNA, 20 bp, Artificial Sequence
  Description of Artificial Sequence: Synthetic oligonucleotide
  Target: SCN9A; (+) strand; PAM type: NRG; PAM sequence: AAG
tagatttctaggtactgagg

SEQ ID NO: 39343 - DNA, 20 bp, Artificial Sequence
  Description of Artificial Sequence: Synthetic oligonucleotide
  Target: SCN9A; (+) strand; PAM type: NRG; PAM sequence: AAG
caattatcatacccaaactg

SEQ ID NO: 39344 - DNA, 20 bp, Artificial Sequence
  Description of Artificial Sequence: Synthetic oligonucleotide
  Target: SCN9A; (+) strand; PAM type: NRG; PAM sequence: AGG
aattatcatacccaaactga

SEQ ID NO: 39345 - DNA, 20 bp, Artificial Sequence
  Description of Artificial Sequence: Synthetic oligonucleotide
  Target: SCN9A; (+) strand; PAM type: NRG; PAM sequence: AAG
ctttccaattgattacataa

SEQ ID NO: 39346 - DNA, 20 bp, Artificial Sequence
  Description of Artificial Sequence: Synthetic oligonucleotide
  Target: SCN9A; (+) strand; PAM type: NRG; PAM sequence: CAG
atataacttttaaaattcaa

SEQ ID NO: 39347 - DNA, 20 bp, Artificial Sequence
  Description of Artificial Sequence: Synthetic oligonucleotide
  Target: SCN9A; (+) strand; PAM type: NRG; PAM sequence: GAG
aaataacataacatctaaat

SEQ ID NO: 39348 - DNA, 20 bp, Artificial Sequence
  Description of Artificial Sequence: Synthetic oligonucleotide
  Target: SCN9A; (+) strand; PAM type: NRG; PAM sequence: AGG
aataacataacatctaaatg

SEQ ID NO: 39349 - DNA, 20 bp, Artificial Sequence
  Description of Artificial Sequence: Synthetic oligonucleotide
  Target: SCN9A; (+) strand; PAM type: NRG; PAM sequence: TGG
atctaaatgaggtttttgac

SEQ ID NO: 39350 - DNA, 20 bp, Artificial Sequence
  Description of Artificial Sequence: Synthetic oligonucleotide
  Target: SCN9A; (+) strand; PAM type: NRG; PAM sequence: AAG
aatgaggtttttgactggaa

SEQ ID NO: 39351 - DNA, 20 bp, Artificial Sequence
  Description of Artificial Sequence: Synthetic oligonucleotide
  Target: SCN9A; (+) strand; PAM type: NRG; PAM sequence: AAG
ggaaaagcctaaatcttaca

SEQ ID NO: 39352 - DNA, 20 bp, Artificial Sequence
  Description of Artificial Sequence: Synthetic oligonucleotide
  Target: SCN9A; (+) strand; PAM type: NRG; PAM sequence: AGG
gaaaagcctaaatcttacaa

SEQ ID NO: 39353 - DNA, 20 bp, Artificial Sequence
  Description of Artificial Sequence: Synthetic oligonucleotide
  Target: SCN9A; (+) strand; PAM type: NRG; PAM sequence: GGG
aaaagcctaaatcttacaaa

SEQ ID NO: 39354 - DNA, 20 bp, Artificial Sequence
  Description of Artificial Sequence: Synthetic oligonucleotide
  Target: SCN9A; (+) strand; PAM type: NRG; PAM sequence: GGG
aaagcctaaatcttacaaag

SEQ ID NO: 39355 - DNA, 20 bp, Artificial Sequence
  Description of Artificial Sequence: Synthetic oligonucleotide
  Target: SCN9A; (+) strand; PAM type: NRG; PAM sequence: GGG
aagcctaaatcttacaaagg

SEQ ID NO: 39356 - DNA, 20 bp, Artificial Sequence
  Description of Artificial Sequence: Synthetic oligonucleotide
  Target: SCN9A; (+) strand; PAM type: NRG; PAM sequence: GGG
agcctaaatcttacaaaggg

SEQ ID NO: 39357 - DNA, 20 bp, Artificial Sequence
  Description of Artificial Sequence: Synthetic oligonucleotide
  Target: SCN9A; (+) strand; PAM type: NRG; PAM sequence: TAG
taaatcttacaaaggggggc

SEQ ID NO: 39358 - DNA, 20 bp, Artificial Sequence
  Description of Artificial Sequence: Synthetic oligonucleotide
  Target: SCN9A; (+) strand; PAM type: NRG; PAM sequence: AAG
atcttacaaaggggggctag

SEQ ID NO: 39359 - DNA, 20 bp, Artificial Sequence
  Description of Artificial Sequence: Synthetic oligonucleotide
  Target: SCN9A; (+) strand; PAM type: NRG; PAM sequence: CAG
caaaggggggctagaagctt

SEQ ID NO: 39360 - DNA, 20 bp, Artificial Sequence
  Description of Artificial Sequence: Synthetic oligonucleotide
  Target: SCN9A; (+) strand; PAM type: NRG; PAM sequence: AAG
ttgttctctgctaatttctt

SEQ ID NO: 39361 - DNA, 20 bp, Artificial Sequence
  Description of Artificial Sequence: Synthetic oligonucleotide
  Target: SCN9A; (+) strand; PAM type: NRG; PAM sequence: TAG
tctctgctaatttcttaagt

SEQ ID NO: 39362 - DNA, 20 bp, Artificial Sequence
  Description of Artificial Sequence: Synthetic oligonucleotide
  Target: SCN9A; (+) strand; PAM type: NRG; PAM sequence: AAG
taatttcttaagttagctgt

SEQ ID NO: 39363 - DNA, 20 bp, Artificial Sequence
  Description of Artificial Sequence: Synthetic oligonucleotide
  Target: SCN9A; (+) strand; PAM type: NRG; PAM sequence: CAG
taagttagctgtaagtttta

SEQ ID NO: 39364 - DNA, 20 bp, Artificial Sequence
  Description of Artificial Sequence: Synthetic oligonucleotide
  Target: SCN9A; (+) strand; PAM type: NRG; PAM sequence: TAG
gatttatgtatattctacat

SEQ ID NO: 39365 - DNA, 20 bp, Artificial Sequence
  Description of Artificial Sequence: Synthetic oligonucleotide
  Target: SCN9A; (+) strand; PAM type: NRG; PAM sequence: AAG
gtctataatttcaccttttt

SEQ ID NO: 39366 - DNA, 20 bp, Artificial Sequence
  Description of Artificial Sequence: Synthetic oligonucleotide
  Target: SCN9A; (+) strand; PAM type: NRG; PAM sequence: CAG
aatttcacctttttaagtca

SEQ ID NO: 39367 - DNA, 20 bp, Artificial Sequence
  Description of Artificial Sequence: Synthetic oligonucleotide
  Target: SCN9A; (+) strand; PAM type: NRG; PAM sequence: TAG
ttttaagtcacagcataaat

SEQ ID NO: 39368 - DNA, 20 bp, Artificial Sequence
  Description of Artificial Sequence: Synthetic oligonucleotide
  Target: SCN9A; (+) strand; PAM type: NRG; PAM sequence: AAG
ttagtataatccatataatt

SEQ ID NO: 39369 - DNA, 20 bp, Artificial Sequence
  Description of Artificial Sequence: Synthetic oligonucleotide
  Target: SCN9A; (+) strand; PAM type: NRG; PAM sequence: AAG
ataattaagaatttattttc

SEQ ID NO: 39370 - DNA, 20 bp, Artificial Sequence
  Description of Artificial Sequence: Synthetic oligonucleotide
  Target: SCN9A; (+) strand; PAM type: NRG; PAM sequence: AGG
taattaagaatttattttca

SEQ ID NO: 39371 - DNA, 20 bp, Artificial Sequence
  Description of Artificial Sequence: Synthetic oligonucleotide
  Target: SCN9A; (+) strand; PAM type: NRG; PAM sequence: TAG
aatttattttcaaggattta

SEQ ID NO: 39372 - DNA, 20 bp, Artificial Sequence
  Description of Artificial Sequence: Synthetic oligonucleotide
  Target: SCN9A; (+) strand; PAM type: NRG; PAM sequence: GAG
tttcaaggatttatagttct

SEQ ID NO: 39373 - DNA, 20 bp, Artificial Sequence
  Description of Artificial Sequence: Synthetic oligonucleotide
  Target: SCN9A; (+) strand; PAM type: NRG; PAM sequence: TAG
tgagatcattacttaacttg

SEQ ID NO: 39374 - DNA, 20 bp, Artificial Sequence
  Description of Artificial Sequence: Synthetic oligonucleotide
  Target: SCN9A; (+) strand; PAM type: NRG; PAM sequence: AGG
gagatcattacttaacttgt

SEQ ID NO: 39375 - DNA, 20 bp, Artificial Sequence
  Description of Artificial Sequence: Synthetic oligonucleotide
  Target: SCN9A; (+) strand; PAM type: NRG; PAM sequence: GGG
agatcattacttaacttgta

SEQ ID NO: 39376 - DNA, 20 bp, Artificial Sequence
  Description of Artificial Sequence: Synthetic oligonucleotide
  Target: SCN9A; (+) strand; PAM type: NRG; PAM sequence: TGG
ttacttaacttgtagggtgc

SEQ ID NO: 39377 - DNA, 20 bp, Artificial Sequence
  Description of Artificial Sequence: Synthetic oligonucleotide
  Target: SCN9A; (+) strand; PAM type: NRG; PAM sequence: AAG
cttgtagggtgctggaatta

SEQ ID NO: 39378 - DNA, 20 bp, Artificial Sequence
  Description of Artificial Sequence: Synthetic oligonucleotide
  Target: SCN9A; (+) strand; PAM type: NRG; PAM sequence: TGG
tgctggaattaaagatgacc

SEQ ID NO: 39379 - DNA, 20 bp, Artificial Sequence
  Description of Artificial Sequence: Synthetic oligonucleotide
  Target: SCN9A; (+) strand; PAM type: NRG; PAM sequence: TGG
aattaaagatgacctggtta

SEQ ID NO: 39380 - DNA, 20 bp, Artificial Sequence
  Description of Artificial Sequence: Synthetic oligonucleotide
  Target: SCN9A; (+) strand; PAM type: NRG; PAM sequence: TGG
atggtttccctttattctct

SEQ ID NO: 39381 - DNA, 20 bp, Artificial Sequence
  Description of Artificial Sequence: Synthetic oligonucleotide
  Target: SCN9A; (+) strand; PAM type: NRG; PAM sequence: TGG
tccctttattctcttggatt

SEQ ID NO: 39382 - DNA, 20 bp, Artificial Sequence
  Description of Artificial Sequence: Synthetic oligonucleotide
  Target: SCN9A; (+) strand; PAM type: NRG; PAM sequence: CAG
ctcttggatttggtaatatt

SEQ ID NO: 39383 - DNA, 20 bp, Artificial Sequence
  Description of Artificial Sequence: Synthetic oligonucleotide
  Target: SCN9A; (+) strand; PAM type: NRG; PAM sequence: TGG
tttaattgtttgctattgaa

SEQ ID NO: 39384 - DNA, 20 bp, Artificial Sequence
  Description of Artificial Sequence: Synthetic oligonucleotide
  Target: SCN9A; (+) strand; PAM type: NRG; PAM sequence: GGG
ttaattgtttgctattgaat

SEQ ID NO: 39385 - DNA, 20 bp, Artificial Sequence
  Description of Artificial Sequence: Synthetic oligonucleotide
  Target: SCN9A; (+) strand; PAM type: NRG; PAM sequence: AAG
attgtttgctattgaatggg

SEQ ID NO: 39386 - DNA, 20 bp, Artificial Sequence
  Description of Artificial Sequence: Synthetic oligonucleotide
  Target: SCN9A; (+) strand; PAM type: NRG; PAM sequence: TGG
cttattcatcaaacacctaa

SEQ ID NO: 39387 - DNA, 20 bp, Artificial Sequence
  Description of Artificial Sequence: Synthetic oligonucleotide
  Target: SCN9A; (+) strand; PAM type: NRG; PAM sequence: CAG
atcaaacacctaatggtaac

SEQ ID NO: 39388 - DNA, 20 bp, Artificial Sequence
  Description of Artificial Sequence: Synthetic oligonucleotide
  Target: SCN9A; (+) strand; PAM type: NRG; PAM sequence: TAG
ccagacttccctttctgcct

SEQ ID NO: 39389 - DNA, 20 bp, Artificial Sequence
  Description of Artificial Sequence: Synthetic oligonucleotide
  Target: SCN9A; (+) strand; PAM type: NRG; PAM sequence: GAG
agacttccctttctgcctta

SEQ ID NO: 39390 - DNA, 20 bp, Artificial Sequence
  Description of Artificial Sequence: Synthetic oligonucleotide
  Target: SCN9A; (+) strand; PAM type: NRG; PAM sequence: TGG
gttgttgttgttgtttttga

SEQ ID NO: 39391 - DNA, 20 bp, Artificial Sequence
  Description of Artificial Sequence: Synthetic oligonucleotide
  Target: SCN9A; (+) strand; PAM type: NRG; PAM sequence: GAG
tgttgttgttgtttttgatg

SEQ ID NO: 39392 - DNA, 20 bp, Artificial Sequence
  Description of Artificial Sequence: Synthetic oligonucleotide
  Target: SCN9A; (+) strand; PAM type: NRG; PAM sequence: GAG
ttttgatggagtcttgctct

SEQ ID NO: 39393 - DNA, 20 bp, Artificial Sequence
  Description of Artificial Sequence: Synthetic oligonucleotide
  Target: SCN9A; (+) strand; PAM type: NRG; PAM sequence: AGG
tttgatggagtcttgctctg

SEQ ID NO: 39394 - DNA, 20 bp, Artificial Sequence
  Description of Artificial Sequence: Synthetic oligonucleotide
  Target: SCN9A; (+) strand; PAM type: NRG; PAM sequence: CAG
tggagtcttgctctgaggca

SEQ ID NO: 39395 - DNA, 20 bp, Artificial Sequence
  Description of Artificial Sequence: Synthetic oligonucleotide
  Target: SCN9A; (+) strand; PAM type: NRG; PAM sequence: AGG
ggagtcttgctctgaggcac

SEQ ID NO: 39396 - DNA, 20 bp, Artificial Sequence
  Description of Artificial Sequence: Synthetic oligonucleotide
  Target: SCN9A; (+) strand; PAM type: NRG; PAM sequence: TGG
tcttgctctgaggcacaggc

SEQ ID NO: 39397 - DNA, 20 bp, Artificial Sequence
  Description of Artificial Sequence: Synthetic oligonucleotide
  Target: SCN9A; (+) strand; PAM type: NRG; PAM sequence: GAG
ttgctctgaggcacaggctg

SEQ ID NO: 39398 - DNA, 20 bp, Artificial Sequence
  Description of Artificial Sequence: Synthetic oligonucleotide
  Target: SCN9A; (+) strand; PAM type: NRG; PAM sequence: CAG
ctgaggcacaggctggagtg

SEQ ID NO: 39399 - DNA, 20 bp, Artificial Sequence
  Description of Artificial Sequence: Synthetic oligonucleotide
  Target: SCN9A; (+) strand; PAM type: NRG; PAM sequence: TGG
ggagtgcagtgccaccatct

SEQ ID NO: 39400 - DNA, 20 bp, Artificial Sequence
  Description of Artificial Sequence: Synthetic oligonucleotide
  Target: SCN9A; (+) strand; PAM type: NRG; PAM sequence: TGG
tcactgcaacctccacctcc

SEQ ID NO: 39401 - DNA, 20 bp, Artificial Sequence
  Description of Artificial Sequence: Synthetic oligonucleotide
  Target: SCN9A; (+) strand; PAM type: NRG; PAM sequence: GGG
cactgcaacctccacctcct

SEQ ID NO: 39402 - DNA, 20 bp, Artificial Sequence
  Description of Artificial Sequence: Synthetic oligonucleotide
  Target: SCN9A; (+) strand; PAM type: NRG; PAM sequence: AAG
aacctccacctcctgggttc

SEQ ID NO: 39403 - DNA, 20 bp, Artificial Sequence
  Description of Artificial Sequence: Synthetic oligonucleotide
  Target: SCN9A; (+) strand; PAM type: NRG; PAM sequence: CAG
ttcaagtaattctcatgtct

SEQ ID NO: 39404 - DNA, 20 bp, Artificial Sequence
  Description of Artificial Sequence: Synthetic oligonucleotide
  Target: SCN9A; (+) strand; PAM type: NRG; PAM sequence: AAG
ttctcatgtctcagcctccc

SEQ ID NO: 39405 - DNA, 20 bp, Artificial Sequence
  Description of Artificial Sequence: Synthetic oligonucleotide
  Target: SCN9A; (+) strand; PAM type: NRG; PAM sequence: TAG
tcatgtctcagcctcccaag

SEQ ID NO: 39406 - DNA, 20 bp, Artificial Sequence
  Description of Artificial Sequence: Synthetic oligonucleotide
  Target: SCN9A; (+) strand; PAM type: NRG; PAM sequence: TGG
gtctcagcctcccaagtagc

SEQ ID NO: 39407 - DNA, 20 bp, Artificial Sequence
  Description of Artificial Sequence: Synthetic oligonucleotide
  Target: SCN9A; (+) strand; PAM type: NRG; PAM sequence: GGG
tctcagcctcccaagtagct

SEQ ID NO: 39408 - DNA, 20 bp, Artificial Sequence
  Description of Artificial Sequence: Synthetic oligonucleotide
  Target: SCN9A; (+) strand; PAM type: NRG; PAM sequence: CAG
ctcccaagtagctgggatta

SEQ ID NO: 39409 - DNA, 20 bp, Artificial Sequence
  Description of Artificial Sequence: Synthetic oligonucleotide
  Target: SCN9A; (+) strand; PAM type: NRG; PAM sequence: AGG
tcccaagtagctgggattac

SEQ ID NO: 39410 - DNA, 20 bp, Artificial Sequence
  Description of Artificial Sequence: Synthetic oligonucleotide
  Target: SCN9A; (+) strand; PAM type: NRG; PAM sequence: CAG
acaggtgcatgccaccacat

SEQ ID NO: 39411 - DNA, 20 bp, Artificial Sequence
  Description of Artificial Sequence: Synthetic oligonucleotide
  Target: SCN9A; (+) strand; PAM type: NRG; PAM sequence: AGG
caggtgcatgccaccacatc

SEQ ID NO: 39412 - DNA, 20 bp, Artificial Sequence
  Description of Artificial Sequence: Synthetic oligonucleotide
  Target: SCN9A; (+) strand; PAM type: NRG; PAM sequence: TAG
caggctaatttttgtatttt

SEQ ID NO: 39413 - DNA, 20 bp, Artificial Sequence
  Description of Artificial Sequence: Synthetic oligonucleotide
  Target: SCN9A; (+) strand; PAM type: NRG; PAM sequence: TAG
gctaatttttgtatttttag

SEQ ID NO: 39414 - DNA, 20 bp, Artificial Sequence
  Description of Artificial Sequence: Synthetic oligonucleotide
  Target: SCN9A; (+) strand; PAM type: NRG; PAM sequence: GAG
taatttttgtatttttagta

SEQ ID NO: 39415 - DNA, 20 bp, Artificial Sequence
  Description of Artificial Sequence: Synthetic oligonucleotide
  Target: SCN9A; (+) strand; PAM type: NRG; PAM sequence: CAG
ttttgtatttttagtagaga

SEQ ID NO: 39416 - DNA, 20 bp, Artificial Sequence
  Description of Artificial Sequence: Synthetic oligonucleotide
  Target: SCN9A; (+) strand; PAM type: NRG; PAM sequence: AGG
tttgtatttttagtagagac

SEQ ID NO: 39417 - DNA, 20 bp, Artificial Sequence
  Description of Artificial Sequence: Synthetic oligonucleotide
  Target: SCN9A; (+) strand; PAM type: NRG; PAM sequence: GGG
ttgtatttttagtagagaca

SEQ ID NO: 39418 - DNA, 20 bp, Artificial Sequence
  Description of Artificial Sequence: Synthetic oligonucleotide
  Target: SCN9A; (+) strand; PAM type: NRG; PAM sequence: TGG
gagacagggtttcaccatgt

SEQ ID NO: 39419 - DNA, 20 bp, Artificial Sequence
  Description of Artificial Sequence: Synthetic oligonucleotide
  Target: SCN9A; (+) strand; PAM type: NRG; PAM sequence: TGG
cagggtttcaccatgttggc

SEQ ID NO: 39420 - DNA, 20 bp, Artificial Sequence
  Description of Artificial Sequence: Synthetic oligonucleotide
  Target: SCN9A; (+) strand; PAM type: NRG; PAM sequence: TGG
tttcaccatgttggctggtc

SEQ ID NO: 39421 - DNA, 20 bp, Artificial Sequence
  Description of Artificial Sequence: Synthetic oligonucleotide
  Target: SCN9A; (+) strand; PAM type: NRG; PAM sequence: TGG
ctggtctggttttgaactcc

SEQ ID NO: 39422 - DNA, 20 bp, Artificial Sequence
  Description of Artificial Sequence: Synthetic oligonucleotide
  Target: SCN9A; (+) strand; PAM type: NRG; PAM sequence: AAG
ggttttgaactcctggcctc

SEQ ID NO: 39423 - DNA, 20 bp, Artificial Sequence
  Description of Artificial Sequence: Synthetic oligonucleotide
  Target: SCN9A; (+) strand; PAM type: NRG; PAM sequence: CAG
cctggcctcaagtgatctgc

SEQ ID NO: 39424 - DNA, 20 bp, Artificial Sequence
  Description of Artificial Sequence: Synthetic oligonucleotide
  Target: SCN9A; (+) strand; PAM type: NRG; PAM sequence: TGG
ctcaagtgatctgccagcct

SEQ ID NO: 39425 - DNA, 20 bp, Artificial Sequence
  Description of Artificial Sequence: Synthetic oligonucleotide
  Target: SCN9A; (+) strand; PAM type: NRG; PAM sequence: AAG
ctgccagccttggcctccca

SEQ ID NO: 39426 - DNA, 20 bp, Artificial Sequence
  Description of Artificial Sequence: Synthetic oligonucleotide
  Target: SCN9A; (+) strand; PAM type: NRG; PAM sequence: TGG
gccttggcctcccaaagtgc

SEQ ID NO: 39427 - DNA, 20 bp, Artificial Sequence
  Description of Artificial Sequence: Synthetic oligonucleotide
  Target: SCN9A; (+) strand; PAM type: NRG; PAM sequence: GGG
ccttggcctcccaaagtgct

SEQ ID NO: 39428 - DNA, 20 bp, Artificial Sequence
  Description of Artificial Sequence: Synthetic oligonucleotide
  Target: SCN9A; (+) strand; PAM type: NRG; PAM sequence: CAG
ctcccaaagtgctgggatta

SEQ ID NO: 39429 - DNA, 20 bp, Artificial Sequence
  Description of Artificial Sequence: Synthetic oligonucleotide
  Target: SCN9A; (+) strand; PAM type: NRG; PAM sequence: AGG
tcccaaagtgctgggattac

SEQ ID NO: 39430 - DNA, 20 bp, Artificial Sequence
  Description of Artificial Sequence: Synthetic oligonucleotide
  Target: SCN9A; (+) strand; PAM type: NRG; PAM sequence: GAG
agtgctgggattacaggcgt

SEQ ID NO: 39431 - DNA, 20 bp, Artificial Sequence
  Description of Artificial Sequence: Synthetic oligonucleotide
  Target: SCN9A; (+) strand; PAM type: NRG; PAM sequence: CGG
caggcgtgagccaccatatc

SEQ ID NO: 39432 - DNA, 20 bp, Artificial Sequence
  Description of Artificial Sequence: Synthetic oligonucleotide
  Target: SCN9A; (+) strand; PAM type: NRG; PAM sequence: TAG
gccaccatatccggccacct

SEQ ID NO: 39433 - DNA, 20 bp, Artificial Sequence
  Description of Artificial Sequence: Synthetic oligonucleotide
  Target: SCN9A; (+) strand; PAM type: NRG; PAM sequence: GAG
caccatatccggccacctta

SEQ ID NO: 39434 - DNA, 20 bp, Artificial Sequence
  Description of Artificial Sequence: Synthetic oligonucleotide
  Target: SCN9A; (+) strand; PAM type: NRG; PAM sequence: CAG
caccttagagtgttttaatt

SEQ ID NO: 39435 - DNA, 20 bp, Artificial Sequence
  Description of Artificial Sequence: Synthetic oligonucleotide
  Target: SCN9A; (+) strand; PAM type: NRG; PAM sequence: CAG
gctttcctctatttaatatg

SEQ ID NO: 39436 - DNA, 20 bp, Artificial Sequence
  Description of Artificial Sequence: Synthetic oligonucleotide
  Target: SCN9A; (+) strand; PAM type: NRG; PAM sequence: TGG
ttcatattcatctcacctac

SEQ ID NO: 39437 - DNA, 20 bp, Artificial Sequence
  Description of Artificial Sequence: Synthetic oligonucleotide
  Target: SCN9A; (+) strand; PAM type: NRG; PAM sequence: AAG
tattcatctcacctactggc

SEQ ID NO: 39438 - DNA, 20 bp, Artificial Sequence
  Description of Artificial Sequence: Synthetic oligonucleotide
  Target: SCN9A; (+) strand; PAM type: NRG; PAM sequence: AGG
attcatctcacctactggca

SEQ ID NO: 39439 - DNA, 20 bp, Artificial Sequence
  Description of Artificial Sequence: Synthetic oligonucleotide
  Target: SCN9A; (+) strand; PAM type: NRG; PAM sequence: GAG
ctcacctactggcaaggcat

SEQ ID NO: 39440 - DNA, 20 bp, Artificial Sequence
  Description of Artificial Sequence: Synthetic oligonucleotide
  Target: SCN9A; (+) strand; PAM type: NRG; PAM sequence: GAG
cacctactggcaaggcatga

SEQ ID NO: 39441 - DNA, 20 bp, Artificial Sequence
  Description of Artificial Sequence: Synthetic oligonucleotide
  Target: SCN9A; (+) strand; PAM type: NRG; PAM sequence: GAG
cctactggcaaggcatgaga

SEQ ID NO: 39442 - DNA, 20 bp, Artificial Sequence
  Description of Artificial Sequence: Synthetic oligonucleotide
  Target: SCN9A; (+) strand; PAM type: NRG; PAM sequence: CAG
ctggcaaggcatgagagaga

SEQ ID NO: 39443 - DNA, 20 bp, Artificial Sequence
  Description of Artificial Sequence: Synthetic oligonucleotide
  Target: SCN9A; (+) strand; PAM type: NRG; PAM sequence: AAG
acagacttcatgtcaatgtc

SEQ ID NO: 39444 - DNA, 20 bp, Artificial Sequence
  Description of Artificial Sequence: Synthetic oligonucleotide
  Target: SCN9A; (+) strand; PAM type: NRG; PAM sequence: GAG
agacttcatgtcaatgtcaa

SEQ ID NO: 39445 - DNA, 20 bp, Artificial Sequence
  Description of Artificial Sequence: Synthetic oligonucleotide
  Target: SCN9A; (+) strand; PAM type: NRG; PAM sequence: CAG
tgtcaatgtcaagagaaacc

SEQ ID NO: 39446 - DNA, 20 bp, Artificial Sequence
  Description of Artificial Sequence: Synthetic oligonucleotide
  Target: SCN9A; (+) strand; PAM type: NRG; PAM sequence: TGG
gatcctttactgttcattaa

SEQ ID NO: 39447 - DNA, 20 bp, Artificial Sequence
  Description of Artificial Sequence: Synthetic oligonucleotide
  Target: SCN9A; (+) strand; PAM type: NRG; PAM sequence: GGG
atcctttactgttcattaat

SEQ ID NO: 39448 - DNA, 20 bp, Artificial Sequence
  Description of Artificial Sequence: Synthetic oligonucleotide
  Target: SCN9A; (+) strand; PAM type: NRG; PAM sequence: GGG
tcctttactgttcattaatg

SEQ ID NO: 39449 - DNA, 20 bp, Artificial Sequence
  Description of Artificial Sequence: Synthetic oligonucleotide
  Target: SCN9A; (+) strand; PAM type: NRG; PAM sequence: CAG
ttaatggggactgaaaatta

SEQ ID NO: 39450 - DNA, 20 bp, Artificial Sequence
  Description of Artificial Sequence: Synthetic oligonucleotide
  Target: SCN9A; (+) strand; PAM type: NRG; PAM sequence: AAG
actgaaaattacagcatgcc

SEQ ID NO: 39451 - DNA, 20 bp, Artificial Sequence
  Description of Artificial Sequence: Synthetic oligonucleotide
  Target: SCN9A; (+) strand; PAM type: NRG; PAM sequence: CAG
acagcatgccaagaacttga

SEQ ID NO: 39452 - DNA, 20 bp, Artificial Sequence
  Description of Artificial Sequence: Synthetic oligonucleotide
  Target: SCN9A; (+) strand; PAM type: NRG; PAM sequence: AAG
gcatgccaagaacttgacag

SEQ ID NO: 39453 - DNA, 20 bp, Artificial Sequence
  Description of Artificial Sequence: Synthetic oligonucleotide
  Target: SCN9A; (+) strand; PAM type: NRG; PAM sequence: AAG
tgccaagaacttgacagaag

SEQ ID NO: 39454 - DNA, 20 bp, Artificial Sequence
  Description of Artificial Sequence: Synthetic oligonucleotide
  Target: SCN9A; (+) strand; PAM type: NRG; PAM sequence: TGG
aagaacttgacagaagaagc

SEQ ID NO: 39455 - DNA, 20 bp, Artificial Sequence
  Description of Artificial Sequence: Synthetic oligonucleotide
  Target: SCN9A; (+) strand; PAM type: NRG; PAM sequence: GAG
gaacttgacagaagaagctg

SEQ ID NO: 39456 - DNA, 20 bp, Artificial Sequence
  Description of Artificial Sequence: Synthetic oligonucleotide
  Target: SCN9A; (+) strand; PAM type: NRG; PAM sequence: GAG
gaagaagctggagaaaaact

SEQ ID NO: 39457 - DNA, 20 bp, Artificial Sequence
  Description of Artificial Sequence: Synthetic oligonucleotide
  Target: SCN9A; (+) strand; PAM type: NRG; PAM sequence: AGG
aagaagctggagaaaaactg

SEQ ID NO: 39458 - DNA, 20 bp, Artificial Sequence
  Description of Artificial Sequence: Synthetic oligonucleotide
  Target: SCN9A; (+) strand; PAM type: NRG; PAM sequence: GAG
gaagctggagaaaaactgag

SEQ ID NO: 39459 - DNA, 20 bp, Artificial Sequence
  Description of Artificial Sequence: Synthetic oligonucleotide
  Target: SCN9A; (+) strand; PAM type: NRG; PAM sequence: AAG
aggagaaaactccaactttg

SEQ ID NO: 39460 - DNA, 20 bp, Artificial Sequence
  Description of Artificial Sequence: Synthetic oligonucleotide
  Target: SCN9A; (+) strand; PAM type: NRG; PAM sequence: GAG
gagaaaactccaactttgaa

SEQ ID NO: 39461 - DNA, 20 bp, Artificial Sequence
  Description of Artificial Sequence: Synthetic oligonucleotide
  Target: SCN9A; (+) strand; PAM type: NRG; PAM sequence: AAG
caactttgaagagaaaatca

SEQ ID NO: 39462 - DNA, 20 bp, Artificial Sequence
  Description of Artificial Sequence: Synthetic oligonucleotide
  Target: SCN9A; (+) strand; PAM type: NRG; PAM sequence: TAG
tgaagagaaaatcaaagtaa

SEQ ID NO: 39463 - DNA, 20 bp, Artificial Sequence
  Description of Artificial Sequence: Synthetic oligonucleotide
  Target: SCN9A; (+) strand; PAM type: NRG; PAM sequence: TGG
gttttcccctaatgatatcc

SEQ ID NO: 39464 - DNA, 20 bp, Artificial Sequence
  Description of Artificial Sequence: Synthetic oligonucleotide
  Target: SCN9A; (+) strand; PAM type: NRG; PAM sequence: AAG
tcctggttgtcaatatgatg

SEQ ID NO: 39465 - DNA, 20 bp, Artificial Sequence
  Description of Artificial Sequence: Synthetic oligonucleotide
  Target: SCN9A; (+) strand; PAM type: NRG; PAM sequence: TGG
gttgtcaatatgatgaagaa

SEQ ID NO: 39466 - DNA, 20 bp, Artificial Sequence
  Description of Artificial Sequence: Synthetic oligonucleotide
  Target: SCN9A; (+) strand; PAM type: NRG; PAM sequence: GGG
ttgtcaatatgatgaagaat

SEQ ID NO: 39467 - DNA, 20 bp, Artificial Sequence
  Description of Artificial Sequence: Synthetic oligonucleotide
  Target: SCN9A; (+) strand; PAM type: NRG; PAM sequence: TAG
gaagaatgggataaaactaa

SEQ ID NO: 39468 - DNA, 20 bp, Artificial Sequence
  Description of Artificial Sequence: Synthetic oligonucleotide
  Target: SCN9A; (+) strand; PAM type: NRG; PAM sequence: AGG
aagaatgggataaaactaat

SEQ ID NO: 39469 - DNA, 20 bp, Artificial Sequence
  Description of Artificial Sequence: Synthetic oligonucleotide
  Target: SCN9A; (+) strand; PAM type: NRG; PAM sequence: GAG
gaatgggataaaactaatag

SEQ ID NO: 39470 - DNA, 20 bp, Artificial Sequence
  Description of Artificial Sequence: Synthetic oligonucleotide
  Target: SCN9A; (+) strand; PAM type: NRG; PAM sequence: TAG
gagattatgaattaattcaa

SEQ ID NO: 39471 - DNA, 20 bp, Artificial Sequence
  Description of Artificial Sequence: Synthetic oligonucleotide
  Target: SCN9A; (+) strand; PAM type: NRG; PAM sequence: GAG
gattatgaattaattcaata

SEQ ID NO: 39472 - DNA, 20 bp, Artificial Sequence
  Description of Artificial Sequence: Synthetic oligonucleotide
  Target: SCN9A; (+) strand; PAM type: NRG; PAM sequence: TGG
attcaatagagaaacttgcg

SEQ ID NO: 39473 - DNA, 20 bp, Artificial Sequence
  Description of Artificial Sequence: Synthetic oligonucleotide
  Target: SCN9A; (+) strand; PAM type: NRG; PAM sequence: GGG
ttcaatagagaaacttgcgt

SEQ ID NO: 39474 - DNA, 20 bp, Artificial Sequence
  Description of Artificial Sequence: Synthetic oligonucleotide
  Target: SCN9A; (+) strand; PAM type: NRG; PAM sequence: TAG
gtgggtgttttgttttccta

SEQ ID NO: 39475 - DNA, 20 bp, Artificial Sequence
  Description of Artificial Sequence: Synthetic oligonucleotide
  Target: SCN9A; (+) strand; PAM type: NRG; PAM sequence: TAG
ttgttttcctatagcttatt

SEQ ID NO: 39476 - DNA, 20 bp, Artificial Sequence
  Description of Artificial Sequence: Synthetic oligonucleotide
  Target: SCN9A; (+) strand; PAM type: NRG; PAM sequence: AGG
tgttttcctatagcttattt

SEQ ID NO: 39477 - DNA, 20 bp, Artificial Sequence
  Description of Artificial Sequence: Synthetic oligonucleotide
  Target: SCN9A; (+) strand; PAM type: NRG; PAM sequence: TAG
aaatgtatccctttaaaacc

SEQ ID NO: 39478 - DNA, 20 bp, Artificial Sequence
  Description of Artificial Sequence: Synthetic oligonucleotide
  Target: SCN9A; (+) strand; PAM type: NRG; PAM sequence: AGG
aatgtatccctttaaaacct

SEQ ID NO: 39479 - DNA, 20 bp, Artificial Sequence
  Description of Artificial Sequence: Synthetic oligonucleotide
  Target: SCN9A; (+) strand; PAM type: NRG; PAM sequence: TGG
gtatccctttaaaacctagg

SEQ ID NO: 39480 - DNA, 20 bp, Artificial Sequence
  Description of Artificial Sequence: Synthetic oligonucleotide
  Target: SCN9A; (+) strand; PAM type: NRG; PAM sequence: AAG
tccctttaaaacctaggtgg

SEQ ID NO: 39481 - DNA, 20 bp, Artificial Sequence
  Description of Artificial Sequence: Synthetic oligonucleotide
  Target: SCN9A; (+) strand; PAM type: NRG; PAM sequence: AGG
ccctttaaaacctaggtgga

SEQ ID NO: 39482 - DNA, 20 bp, Artificial Sequence
  Description of Artificial Sequence: Synthetic oligonucleotide
  Target: SCN9A; (+) strand; PAM type: NRG; PAM sequence: AAG
ctaggtggaaggaattctgt

SEQ ID NO: 39483 - DNA, 20 bp, Artificial Sequence
  Description of Artificial Sequence: Synthetic oligonucleotide
  Target: SCN9A; (+) strand; PAM type: NRG; PAM sequence: CAG
gtggaaggaattctgtaagt

SEQ ID NO: 39484 - DNA, 20 bp, Artificial Sequence
  Description of Artificial Sequence: Synthetic oligonucleotide
  Target: SCN9A; (+) strand; PAM type: NRG; PAM sequence: AGG
tggaaggaattctgtaagtc

SEQ ID NO: 39485 - DNA, 20 bp, Artificial Sequence
  Description of Artificial Sequence: Synthetic oligonucleotide
  Target: SCN9A; (+) strand; PAM type: NRG; PAM sequence: TAG
aggaattctgtaagtcaggc

SEQ ID NO: 39486 - DNA, 20 bp, Artificial Sequence
  Description of Artificial Sequence: Synthetic oligonucleotide
  Target: SCN9A; (+) strand; PAM type: NRG; PAM sequence: GAG
tctgtgttacaatctacatt

SEQ ID NO: 39487 - DNA, 20 bp, Artificial Sequence
  Description of Artificial Sequence: Synthetic oligonucleotide
  Target: SCN9A; (+) strand; PAM type: NRG; PAM sequence: AGG
ctgtgttacaatctacattg

SEQ ID NO: 39488 - DNA, 20 bp, Artificial Sequence
  Description of Artificial Sequence: Synthetic oligonucleotide
  Target: SCN9A; (+) strand; PAM type: NRG; PAM sequence: TAG
tacattgaggctgtattaca

SEQ ID NO: 39489 - DNA, 20 bp, Artificial Sequence
  Description of Artificial Sequence: Synthetic oligonucleotide
  Target: SCN9A; (+) strand; PAM type: NRG; PAM sequence: AAG
ggctgtattacatagtaata

SEQ ID NO: 39490 - DNA, 20 bp, Artificial Sequence
  Description of Artificial Sequence: Synthetic oligonucleotide
  Target: SCN9A; (+) strand; PAM type: NRG; PAM sequence: TGG
aataaagacttcttcacttc

SEQ ID NO: 39491 - DNA, 20 bp, Artificial Sequence
  Description of Artificial Sequence: Synthetic oligonucleotide
  Target: SCN9A; (+) strand; PAM type: NRG; PAM sequence: CAG
gacttcttcacttctggtgt

SEQ ID NO: 39492 - DNA, 20 bp, Artificial Sequence
  Description of Artificial Sequence: Synthetic oligonucleotide
  Target: SCN9A; (+) strand; PAM type: NRG; PAM sequence: AAG
gtgtcagatcatctttgttc

SEQ ID NO: 39493 - DNA, 20 bp, Artificial Sequence
  Description of Artificial Sequence: Synthetic oligonucleotide
  Target: SCN9A; (+) strand; PAM type: NRG; PAM sequence: TGG
caagtcctttcttttgtcct

SEQ ID NO: 39494 - DNA, 20 bp, Artificial Sequence
  Description of Artificial Sequence: Synthetic oligonucleotide
  Target: SCN9A; (+) strand; PAM type: NRG; PAM sequence: GGG
aagtcctttcttttgtcctt

SEQ ID NO: 39495 - DNA, 20 bp, Artificial Sequence
  Description of Artificial Sequence: Synthetic oligonucleotide
  Target: SCN9A; (+) strand; PAM type: NRG; PAM sequence: AAG
cctttcttttgtccttgggt

SEQ ID NO: 39496 - DNA, 20 bp, Artificial Sequence
  Description of Artificial Sequence: Synthetic oligonucleotide
  Target: SCN9A; (+) strand; PAM type: NRG; PAM sequence: AAG
ggtaagtttcttaattcttt

SEQ ID NO: 39497 - DNA, 20 bp, Artificial Sequence
  Description of Artificial Sequence: Synthetic oligonucleotide
  Target: SCN9A; (+) strand; PAM type: NRG; PAM sequence: AAG
taaaaccacctcatcattat

SEQ ID NO: 39498 - DNA, 20 bp, Artificial Sequence
  Description of Artificial Sequence: Synthetic oligonucleotide
  Target: SCN9A; (+) strand; PAM type: NRG; PAM sequence: GAG
aaaccacctcatcattataa

SEQ ID NO: 39499 - DNA, 20 bp, Artificial Sequence
  Description of Artificial Sequence: Synthetic oligonucleotide
  Target: SCN9A; (+) strand; PAM type: NRG; PAM sequence: TAG
ccacctcatcattataagag

SEQ ID NO: 39500 - DNA, 20 bp, Artificial Sequence
  Description of Artificial Sequence: Synthetic oligonucleotide
  Target: SCN9A; (+) strand; PAM type: NRG; PAM sequence: GAG
tcactgcatttgtgtttgct

SEQ ID NO: 39501 - DNA, 20 bp, Artificial Sequence
  Description of Artificial Sequence: Synthetic oligonucleotide
  Target: SCN9A; (+) strand; PAM type: NRG; PAM sequence: AAG
ctgcatttgtgtttgctgag

SEQ ID NO: 39502 - DNA, 20 bp, Artificial Sequence
  Description of Artificial Sequence: Synthetic oligonucleotide
  Target: SCN9A; (+) strand; PAM type: NRG; PAM sequence: GAG
gtttgctgagaagataaatt

SEQ ID NO: 39503 - DNA, 20 bp, Artificial Sequence
  Description of Artificial Sequence: Synthetic oligonucleotide
  Target: SCN9A; (+) strand; PAM type: NRG; PAM sequence: AGG
tttgctgagaagataaattg

SEQ ID NO: 39504 - DNA, 20 bp, Artificial Sequence
  Description of Artificial Sequence: Synthetic oligonucleotide
  Target: SCN9A; (+) strand; PAM type: NRG; PAM sequence: AAG
ataaattgaggtaatgcatg

SEQ ID NO: 39505 - DNA, 20 bp, Artificial Sequence
  Description of Artificial Sequence: Synthetic oligonucleotide
  Target: SCN9A; (+) strand; PAM type: NRG; PAM sequence: TAG
ggtaatgcatgaagaatact

SEQ ID NO: 39506 - DNA, 20 bp, Artificial Sequence
  Description of Artificial Sequence: Synthetic oligonucleotide
  Target: SCN9A; (+) strand; PAM type: NRG; PAM sequence: TGG
agaatacttagcataatatc

SEQ ID NO: 39507 - DNA, 20 bp, Artificial Sequence
  Description of Artificial Sequence: Synthetic oligonucleotide
  Target: SCN9A; (+) strand; PAM type: NRG; PAM sequence: TGG
ttagcataatatctggcaca

SEQ ID NO: 39508 - DNA, 20 bp, Artificial Sequence
  Description of Artificial Sequence: Synthetic oligonucleotide
  Target: SCN9A; (+) strand; PAM type: NRG; PAM sequence: AAG
cataatatctggcacatggt

SEQ ID NO: 39509 - DNA, 20 bp, Artificial Sequence
  Description of Artificial Sequence: Synthetic oligonucleotide
  Target: SCN9A; (+) strand; PAM type: NRG; PAM sequence: TAG
ggtaagtcttcattaaattt

SEQ ID NO: 39510 - DNA, 20 bp, Artificial Sequence
  Description of Artificial Sequence: Synthetic oligonucleotide
  Target: SCN9A; (+) strand; PAM type: NRG; PAM sequence: TGG
attttagttactattactgt

SEQ ID NO: 39511 - DNA, 20 bp, Artificial Sequence
  Description of Artificial Sequence: Synthetic oligonucleotide
  Target: SCN9A; (+) strand; PAM type: NRG; PAM sequence: AAG
gtgctattaaacttcctgat

SEQ ID NO: 39512 - DNA, 20 bp, Artificial Sequence
  Description of Artificial Sequence: Synthetic oligonucleotide
  Target: SCN9A; (+) strand; PAM type: NRG; PAM sequence: GAG
attaaacttcctgataagat

SEQ ID NO: 39513 - DNA, 20 bp, Artificial Sequence
  Description of Artificial Sequence: Synthetic oligonucleotide
  Target: SCN9A; (+) strand; PAM type: NRG; PAM sequence: GAG
taaacttcctgataagatga

SEQ ID NO: 39514 - DNA, 20 bp, Artificial Sequence
  Description of Artificial Sequence: Synthetic oligonucleotide
  Target: SCN9A; (+) strand; PAM type: NRG; PAM sequence: GAG
aagatgagagttaatgaaat

SEQ ID NO: 39515 - DNA, 20 bp, Artificial Sequence
  Description of Artificial Sequence: Synthetic oligonucleotide
  Target: SCN9A; (+) strand; PAM type: NRG; PAM sequence: AGG
agatgagagttaatgaaatg

SEQ ID NO: 39516 - DNA, 20 bp, Artificial Sequence
  Description of Artificial Sequence: Synthetic oligonucleotide
  Target: SCN9A; (+) strand; PAM type: NRG; PAM sequence: TAG
tattgttaacatttactcca

SEQ ID NO: 39517 - DNA, 20 bp, Artificial Sequence
  Description of Artificial Sequence: Synthetic oligonucleotide
  Target: SCN9A; (+) strand; PAM type: NRG; PAM sequence: TAG
attaatgacttttgttctaa

SEQ ID NO: 39518 - DNA, 20 bp, Artificial Sequence
  Description of Artificial Sequence: Synthetic oligonucleotide
  Target: SCN9A; (+) strand; PAM type: NRG; PAM sequence: TAG
aatgacttttgttctaatag

SEQ ID NO: 39519 - DNA, 20 bp, Artificial Sequence
  Description of Artificial Sequence: Synthetic oligonucleotide
  Target: SCN9A; (+) strand; PAM type: NRG; PAM sequence: TAG
ctaatttcacatgaaatcat

SEQ ID NO: 39520 - DNA, 20 bp, Artificial Sequence
  Description of Artificial Sequence: Synthetic oligonucleotide
  Target: SCN9A; (+) strand; PAM type: NRG; PAM sequence: GAG
aatttcacatgaaatcatta

SEQ ID NO: 39521 - DNA, 20 bp, Artificial Sequence
  Description of Artificial Sequence: Synthetic oligonucleotide
  Target: SCN9A; (+) strand; PAM type: NRG; PAM sequence: AGG
atttcacatgaaatcattag

SEQ ID NO: 39522 - DNA, 20 bp, Artificial Sequence
  Description of Artificial Sequence: Synthetic oligonucleotide
  Target: SCN9A; (+) strand; PAM type: NRG; PAM sequence: AAG
gaaatcattagaggtgaaaa

SEQ ID NO: 39523 - DNA, 20 bp, Artificial Sequence
  Description of Artificial Sequence: Synthetic oligonucleotide
  Target: SCN9A; (+) strand; PAM type: NRG; PAM sequence: GAG
gaggtgaaaaaagtacttat

SEQ ID NO: 39524 - DNA, 20 bp, Artificial Sequence
  Description of Artificial Sequence: Synthetic oligonucleotide
  Target: SCN9A; (+) strand; PAM type: NRG; PAM sequence: AGG
aggtgaaaaaagtacttatg

SEQ ID NO: 39525 - DNA, 20 bp, Artificial Sequence
  Description of Artificial Sequence: Synthetic oligonucleotide
  Target: SCN9A; (+) strand; PAM type: NRG; PAM sequence: TAG
gtacttatgaggatgatgaa

SEQ ID NO: 39526 - DNA, 20 bp, Artificial Sequence
  Description of Artificial Sequence: Synthetic oligonucleotide
  Target: SCN9A; (+) strand; PAM type: NRG; PAM sequence: TGG
ttatgaggatgatgaatagt

SEQ ID NO: 39527 - DNA, 20 bp, Artificial Sequence
  Description of Artificial Sequence: Synthetic oligonucleotide
  Target: SCN9A; (+) strand; PAM type: NRG; PAM sequence: TAG
tgatgaatagttggaaaaac

SEQ ID NO: 39528 - DNA, 20 bp, Artificial Sequence
  Description of Artificial Sequence: Synthetic oligonucleotide
  Target: SCN9A; (+) strand; PAM type: NRG; PAM sequence: TAG
agttggaaaaactagtaaaa

SEQ ID NO: 39529 - DNA, 20 bp, Artificial Sequence
  Description of Artificial Sequence: Synthetic oligonucleotide
  Target: SCN9A; (+) strand; PAM type: NRG; PAM sequence: AGG
gttggaaaaactagtaaaat

SEQ ID NO: 39530 - DNA, 20 bp, Artificial Sequence
  Description of Artificial Sequence: Synthetic oligonucleotide
  Target: SCN9A; (+) strand; PAM type: NRG; PAM sequence: GGG
ttggaaaaactagtaaaata

SEQ ID NO: 39531 - DNA, 20 bp, Artificial Sequence
  Description of Artificial Sequence: Synthetic oligonucleotide
  Target: SCN9A; (+) strand; PAM type: NRG; PAM sequence: TGG
aaaaactagtaaaatagggt

SEQ ID NO: 39532 - DNA, 20 bp, Artificial Sequence
  Description of Artificial Sequence: Synthetic oligonucleotide
  Target: SCN9A; (+) strand; PAM type: NRG; PAM sequence: TAG
agtaaaatagggttggttat

SEQ ID NO: 39533 - DNA, 20 bp, Artificial Sequence
  Description of Artificial Sequence: Synthetic oligonucleotide
  Target: SCN9A; (+) strand; PAM type: NRG; PAM sequence: AAG
aaatagggttggttattaga

SEQ ID NO: 39534 - DNA, 20 bp, Artificial Sequence
  Description of Artificial Sequence: Synthetic oligonucleotide
  Target: SCN9A; (+) strand; PAM type: NRG; PAM sequence: GAG
atagggttggttattagaaa

SEQ ID NO: 39535 - DNA, 20 bp, Artificial Sequence
  Description of Artificial Sequence: Synthetic oligonucleotide
  Target: SCN9A; (+) strand; PAM type: NRG; PAM sequence: AGG
tagggttggttattagaaag

SEQ ID NO: 39536 - DNA, 20 bp, Artificial Sequence
  Description of Artificial Sequence: Synthetic oligonucleotide
  Target: SCN9A; (+) strand; PAM type: NRG; PAM sequence: TGG
ttggttattagaaagaggca

SEQ ID NO: 39537 - DNA, 20 bp, Artificial Sequence
  Description of Artificial Sequence: Synthetic oligonucleotide
  Target: SCN9A; (+) strand; PAM type: NRG; PAM sequence: GGG
tggttattagaaagaggcat

SEQ ID NO: 39538 - DNA, 20 bp, Artificial Sequence
  Description of Artificial Sequence: Synthetic oligonucleotide
  Target: SCN9A; (+) strand; PAM type: NRG; PAM sequence: TAG
ttattagaaagaggcatggg

SEQ ID NO: 39539 - DNA, 20 bp, Artificial Sequence
  Description of Artificial Sequence: Synthetic oligonucleotide
  Target: SCN9A; (+) strand; PAM type: NRG; PAM sequence: TAG
aaagaggcatgggtagttga

SEQ ID NO: 39540 - DNA, 20 bp, Artificial Sequence
  Description of Artificial Sequence: Synthetic oligonucleotide
  Target: SCN9A; (+) strand; PAM type: NRG; PAM sequence: GAG
agaggcatgggtagttgata

SEQ ID NO: 39541 - DNA, 20 bp, Artificial Sequence
  Description of Artificial Sequence: Synthetic oligonucleotide
  Target: SCN9A; (+) strand; PAM type: NRG; PAM sequence: AAG
tgggtagttgatagagccat

SEQ ID NO: 39542 - DNA, 20 bp, Artificial Sequence
  Description of Artificial Sequence: Synthetic oligonucleotide
  Target: SCN9A; (+) strand; PAM type: NRG; PAM sequence: AAG
aagctttgatcaaattattg

SEQ ID NO: 39543 - DNA, 20 bp, Artificial Sequence
  Description of Artificial Sequence: Synthetic oligonucleotide
  Target: SCN9A; (+) strand; PAM type: NRG; PAM sequence: AAG
atcaaattattgaagttaaa

SEQ ID NO: 39544 - DNA, 20 bp, Artificial Sequence
  Description of Artificial Sequence: Synthetic oligonucleotide
  Target: SCN9A; (+) strand; PAM type: NRG; PAM sequence: CAG
aaattattgaagttaaaaag

SEQ ID NO: 39545 - DNA, 20 bp, Artificial Sequence
  Description of Artificial Sequence: Synthetic oligonucleotide
  Target: SCN9A; (+) strand; PAM type: NRG; PAM sequence: AAG
tattgaagttaaaaagcagt

SEQ ID NO: 39546 - DNA, 20 bp, Artificial Sequence
  Description of Artificial Sequence: Synthetic oligonucleotide
  Target: SCN9A; (+) strand; PAM type: NRG; PAM sequence: TGG
tgaagttaaaaagcagtaag

SEQ ID NO: 39547 - DNA, 20 bp, Artificial Sequence
  Description of Artificial Sequence: Synthetic oligonucleotide
  Target: SCN9A; (+) strand; PAM type: NRG; PAM sequence: TGG
taagtggcaacattgcattg

SEQ ID NO: 39548 - DNA, 20 bp, Artificial Sequence
  Description of Artificial Sequence: Synthetic oligonucleotide
  Target: SCN9A; (+) strand; PAM type: NRG; PAM sequence: AAG
ggcaacattgcattgtggaa

SEQ ID NO: 39549 - DNA, 20 bp, Artificial Sequence
  Description of Artificial Sequence: Synthetic oligonucleotide
  Target: SCN9A; (+) strand; PAM type: NRG; PAM sequence: TGG
attgcattgtggaaaagata

SEQ ID NO: 39550 - DNA, 20 bp, Artificial Sequence
  Description of Artificial Sequence: Synthetic oligonucleotide
  Target: SCN9A; (+) strand; PAM type: NRG; PAM sequence: GGG
ttgcattgtggaaaagatat

SEQ ID NO: 39551 - DNA, 20 bp, Artificial Sequence
  Description of Artificial Sequence: Synthetic oligonucleotide
  Target: SCN9A; (+) strand; PAM type: NRG; PAM sequence: CAG
atatgggttttcaaatcaaa

SEQ ID NO: 39552 - DNA, 20 bp, Artificial Sequence
  Description of Artificial Sequence: Synthetic oligonucleotide
  Target: SCN9A; (+) strand; PAM type: NRG; PAM sequence: AGG
tatgggttttcaaatcaaac

SEQ ID NO: 39553 - DNA, 20 bp, Artificial Sequence
  Description of Artificial Sequence: Synthetic oligonucleotide
  Target: SCN9A; (+) strand; PAM type: NRG; PAM sequence: TGG
catttcaatcataactgtgc

SEQ ID NO: 39554 - DNA, 20 bp, Artificial Sequence
  Description of Artificial Sequence: Synthetic oligonucleotide
  Target: SCN9A; (+) strand; PAM type: NRG; PAM sequence: TGG
tgtgctggtatcctgttact

SEQ ID NO: 39555 - DNA, 20 bp, Artificial Sequence
  Description of Artificial Sequence: Synthetic oligonucleotide
  Target: SCN9A; (+) strand; PAM type: NRG; PAM sequence: TAG
aacaatttatccatcctttc

SEQ ID NO: 39556 - DNA, 20 bp, Artificial Sequence
  Description of Artificial Sequence: Synthetic oligonucleotide
  Target: SCN9A; (+) strand; PAM type: NRG; PAM sequence: AGG
acaatttatccatcctttct

SEQ ID NO: 39557 - DNA, 20 bp, Artificial Sequence
  Description of Artificial Sequence: Synthetic oligonucleotide
  Target: SCN9A; (+) strand; PAM type: NRG; PAM sequence: GGG
caatttatccatcctttcta

SEQ ID NO: 39558 - DNA, 20 bp, Artificial Sequence
  Description of Artificial Sequence: Synthetic oligonucleotide
  Target: SCN9A; (+) strand; PAM type: NRG; PAM sequence: GGG
aatttatccatcctttctag

SEQ ID NO: 39559 - DNA, 20 bp, Artificial Sequence
  Description of Artificial Sequence: Synthetic oligonucleotide
  Target: SCN9A; (+) strand; PAM type: NRG; PAM sequence: AAG
ctaatttattcattttcatc

SEQ ID NO: 39560 - DNA, 20 bp, Artificial Sequence
  Description of Artificial Sequence: Synthetic oligonucleotide
  Target: SCN9A; (+) strand; PAM type: NRG; PAM sequence: AAG
ttcatcaagataccactttc

SEQ ID NO: 39561 - DNA, 20 bp, Artificial Sequence
  Description of Artificial Sequence: Synthetic oligonucleotide
  Target: SCN9A; (+) strand; PAM type: NRG; PAM sequence: AGG
tcatcaagataccactttca

SEQ ID NO: 39562 - DNA, 20 bp, Artificial Sequence
  Description of Artificial Sequence: Synthetic oligonucleotide
  Target: SCN9A; (+) strand; PAM type: NRG; PAM sequence: GGG
catcaagataccactttcaa

SEQ ID NO: 39563 - DNA, 20 bp, Artificial Sequence
  Description of Artificial Sequence: Synthetic oligonucleotide
  Target: SCN9A; (+) strand; PAM type: NRG; PAM sequence: GAG
tcaagataccactttcaagg

SEQ ID NO: 39564 - DNA, 20 bp, Artificial Sequence
  Description of Artificial Sequence: Synthetic oligonucleotide
  Target: SCN9A; (+) strand; PAM type: NRG; PAM sequence: AGG
caagataccactttcaaggg

SEQ ID NO: 39565 - DNA, 20 bp, Artificial Sequence
  Description of Artificial Sequence: Synthetic oligonucleotide
  Target: SCN9A; (+) strand; PAM type: NRG; PAM sequence: GGG
aagataccactttcaaggga

SEQ ID NO: 39566 - DNA, 20 bp, Artificial Sequence
  Description of Artificial Sequence: Synthetic oligonucleotide
  Target: SCN9A; (+) strand; PAM type: NRG; PAM sequence: GAG
gataccactttcaagggagg

SEQ ID NO: 39567 - DNA, 20 bp, Artificial Sequence
  Description of Artificial Sequence: Synthetic oligonucleotide
  Target: SCN9A; (+) strand; PAM type: NRG; PAM sequence: GAG
taccactttcaagggaggga

SEQ ID NO: 39568 - DNA, 20 bp, Artificial Sequence
  Description of Artificial Sequence: Synthetic oligonucleotide
  Target: SCN9A; (+) strand; PAM type: NRG; PAM sequence: AGG
accactttcaagggagggag

SEQ ID NO: 39569 - DNA, 20 bp, Artificial Sequence
  Description of Artificial Sequence: Synthetic oligonucleotide
  Target: SCN9A; (+) strand; PAM type: NRG; PAM sequence: GAG
cactttcaagggagggagag

SEQ ID NO: 39570 - DNA, 20 bp, Artificial Sequence
  Description of Artificial Sequence: Synthetic oligonucleotide
  Target: SCN9A; (+) strand; PAM type: NRG; PAM sequence: TGG
tttcaagggagggagaggag

SEQ ID NO: 39571 - DNA, 20 bp, Artificial Sequence
  Description of Artificial Sequence: Synthetic oligonucleotide
  Target: SCN9A; (+) strand; PAM type: NRG; PAM sequence: GAG
tcaagggagggagaggagtg

SEQ ID NO: 39572 - DNA, 20 bp, Artificial Sequence
  Description of Artificial Sequence: Synthetic oligonucleotide
  Target: SCN9A; (+) strand; PAM type: NRG; PAM sequence: CAG
catcaaatgtccttgccatt

SEQ ID NO: 39573 - DNA, 20 bp, Artificial Sequence
  Description of Artificial Sequence: Synthetic oligonucleotide
  Target: SCN9A; (+) strand; PAM type: NRG; PAM sequence: TAG
tgccattcagtgtgctgcac

SEQ ID NO: 39574 - DNA, 20 bp, Artificial Sequence
  Description of Artificial Sequence: Synthetic oligonucleotide
  Target: SCN9A; (+) strand; PAM type: NRG; PAM sequence: AGG
gccattcagtgtgctgcact

SEQ ID NO: 39575 - DNA, 20 bp, Artificial Sequence
  Description of Artificial Sequence: Synthetic oligonucleotide
  Target: SCN9A; (+) strand; PAM type: NRG; PAM sequence: GGG
ccattcagtgtgctgcacta

SEQ ID NO: 39576 - DNA, 20 bp, Artificial Sequence
  Description of Artificial Sequence: Synthetic oligonucleotide
  Target: SCN9A; (+) strand; PAM type: NRG; PAM sequence: CAG
cagtgtgctgcactagggtc

SEQ ID NO: 39577 - DNA, 20 bp, Artificial Sequence
  Description of Artificial Sequence: Synthetic oligonucleotide
  Target: SCN9A; (+) strand; PAM type: NRG; PAM sequence: TGG
agtttcactcttgcctcata

SEQ ID NO: 39578 - DNA, 20 bp, Artificial Sequence
  Description of Artificial Sequence: Synthetic oligonucleotide
  Target: SCN9A; (+) strand; PAM type: NRG; PAM sequence: GAG
tttcactcttgcctcatatg

SEQ ID NO: 39579 - DNA, 20 bp, Artificial Sequence
  Description of Artificial Sequence: Synthetic oligonucleotide
  Target: SCN9A; (+) strand; PAM type: NRG; PAM sequence: AAG
tgcctcatatggagcactga

SEQ ID NO: 39580 - DNA, 20 bp, Artificial Sequence
  Description of Artificial Sequence: Synthetic oligonucleotide
  Target: SCN9A; (+) strand; PAM type: NRG; PAM sequence: CAG
atatggagcactgaaagaac

SEQ ID NO: 39581 - DNA, 20 bp, Artificial Sequence
  Description of Artificial Sequence: Synthetic oligonucleotide
  Target: SCN9A; (+) strand; PAM type: NRG; PAM sequence: TAG
actgaaagaaccagtatgat

SEQ ID NO: 39582 - DNA, 20 bp, Artificial Sequence
  Description of Artificial Sequence: Synthetic oligonucleotide
  Target: SCN9A; (+) strand; PAM type: NRG; PAM sequence: CAG
tatgattagaacaattgata

SEQ ID NO: 39583 - DNA, 20 bp, Artificial Sequence
  Description of Artificial Sequence: Synthetic oligonucleotide
  Target: SCN9A; (+) strand; PAM type: NRG; PAM sequence: TAG
aattgatacagctacaaaca

SEQ ID NO: 39584 - DNA, 20 bp, Artificial Sequence
  Description of Artificial Sequence: Synthetic oligonucleotide
  Target: SCN9A; (+) strand; PAM type: NRG; PAM sequence: AGG
attgatacagctacaaacat

SEQ ID NO: 39585 - DNA, 20 bp, Artificial Sequence
  Description of Artificial Sequence: Synthetic oligonucleotide
  Target: SCN9A; (+) strand; PAM type: NRG; PAM sequence: AAG
tacagctacaaacataggaa

SEQ ID NO: 39586 - DNA, 20 bp, Artificial Sequence
  Description of Artificial Sequence: Synthetic oligonucleotide
  Target: SCN9A; (+) strand; PAM type: NRG; PAM sequence: AGG
acagctacaaacataggaaa

SEQ ID NO: 39587 - DNA, 20 bp, Artificial Sequence
  Description of Artificial Sequence: Synthetic oligonucleotide
  Target: SCN9A; (+) strand; PAM type: NRG; PAM sequence: GGG
cagctacaaacataggaaaa

SEQ ID NO: 39588 - DNA, 20 bp, Artificial Sequence
  Description of Artificial Sequence: Synthetic oligonucleotide
  Target: SCN9A; (+) strand; PAM type: NRG; PAM sequence: GGG
agctacaaacataggaaaag

SEQ ID NO: 39589 - DNA, 20 bp, Artificial Sequence
  Description of Artificial Sequence: Synthetic oligonucleotide
  Target: SCN9A; (+) strand; PAM type: NRG; PAM sequence: CGG
acaaacataggaaaagggga

SEQ ID NO: 39590 - DNA, 20 bp, Artificial Sequence
  Description of Artificial Sequence: Synthetic oligonucleotide
  Target: SCN9A; (+) strand; PAM type: NRG; PAM sequence: TAG
aacataggaaaaggggacgg

SEQ ID NO: 39591 - DNA, 20 bp, Artificial Sequence
  Description of Artificial Sequence: Synthetic oligonucleotide
  Target: SCN9A; (+) strand; PAM type: NRG; PAM sequence: TAG
aggaaaaggggacggtagat

SEQ ID NO: 39592 - DNA, 20 bp, Artificial Sequence
  Description of Artificial Sequence: Synthetic oligonucleotide
  Target: SCN9A; (+) strand; PAM type: NRG; PAM sequence: GAG
ggacggtagattagctgttt

SEQ ID NO: 39593 - DNA, 20 bp, Artificial Sequence
  Description of Artificial Sequence: Synthetic oligonucleotide
  Target: SCN9A; (+) strand; PAM type: NRG; PAM sequence: GAG
acggtagattagctgtttga

SEQ ID NO: 39594 - DNA, 20 bp, Artificial Sequence
  Description of Artificial Sequence: Synthetic oligonucleotide
  Target: SCN9A; (+) strand; PAM type: NRG; PAM sequence: CAG
ttagctgtttgagagactct

SEQ ID NO: 39595 - DNA, 20 bp, Artificial Sequence
  Description of Artificial Sequence: Synthetic oligonucleotide
  Target: SCN9A; (+) strand; PAM type: NRG; PAM sequence: TAG
tgagagactctcagtatctc

SEQ ID NO: 39596 - DNA, 20 bp, Artificial Sequence
  Description of Artificial Sequence: Synthetic oligonucleotide
  Target: SCN9A; (+) strand; PAM type: NRG; PAM sequence: CAG
agactctcagtatctctagc

SEQ ID NO: 39597 - DNA, 20 bp, Artificial Sequence
  Description of Artificial Sequence: Synthetic oligonucleotide
  Target: SCN9A; (+) strand; PAM type: NRG; PAM sequence: AGG
gactctcagtatctctagcc

SEQ ID NO: 39598 - DNA, 20 bp, Artificial Sequence
  Description of Artificial Sequence: Synthetic oligonucleotide
  Target: SCN9A; (+) strand; PAM type: NRG; PAM sequence: TGG
gtatctctagccaggctgac

SEQ ID NO: 39599 - DNA, 20 bp, Artificial Sequence
  Description of Artificial Sequence: Synthetic oligonucleotide
  Target: SCN9A; (+) strand; PAM type: NRG; PAM sequence: AAG
tctagccaggctgactggca

SEQ ID NO: 39600 - DNA, 20 bp, Artificial Sequence
  Description of Artificial Sequence: Synthetic oligonucleotide
  Target: SCN9A; (+) strand; PAM type: NRG; PAM sequence: AGG
ctagccaggctgactggcaa

SEQ ID NO: 39601 - DNA, 20 bp, Artificial Sequence
  Description of Artificial Sequence: Synthetic oligonucleotide
  Target: SCN9A; (+) strand; PAM type: NRG; PAM sequence: AAG
gcaaaggtcttgccctgtca

SEQ ID NO: 39602 - DNA, 20 bp, Artificial Sequence
  Description of Artificial Sequence: Synthetic oligonucleotide
  Target: SCN9A; (+) strand; PAM type: NRG; PAM sequence: CAG
aggtcttgccctgtcaaagt

SEQ ID NO: 39603 - DNA, 20 bp, Artificial Sequence
  Description of Artificial Sequence: Synthetic oligonucleotide
  Target: SCN9A; (+) strand; PAM type: NRG; PAM sequence: TGG
caaagtcagtccataaatct

SEQ ID NO: 39604 - DNA, 20 bp, Artificial Sequence
  Description of Artificial Sequence: Synthetic oligonucleotide
  Target: SCN9A; (+) strand; PAM type: NRG; PAM sequence: TGG
agtcagtccataaatcttgg

SEQ ID NO: 39605 - DNA, 20 bp, Artificial Sequence
  Description of Artificial Sequence: Synthetic oligonucleotide
  Target: SCN9A; (+) strand; PAM type: NRG; PAM sequence: CGG
tgtcctttgtgacattgtgt

SEQ ID NO: 39606 - DNA, 20 bp, Artificial Sequence
  Description of Artificial Sequence: Synthetic oligonucleotide
  Target: SCN9A; (+) strand; PAM type: NRG; PAM sequence: TGG
ctttgtgacattgtgtcgga

SEQ ID NO: 39607 - DNA, 20 bp, Artificial Sequence
  Description of Artificial Sequence: Synthetic oligonucleotide
  Target: SCN9A; (+) strand; PAM type: NRG; PAM sequence: CAG
acattgtgtcggatggctga

SEQ ID NO: 39608 - DNA, 20 bp, Artificial Sequence
  Description of Artificial Sequence: Synthetic oligonucleotide
  Target: SCN9A; (+) strand; PAM type: NRG; PAM sequence: AGG
cattgtgtcggatggctgac

SEQ ID NO: 39609 - DNA, 20 bp, Artificial Sequence
  Description of Artificial Sequence: Synthetic oligonucleotide
  Target: SCN9A; (+) strand; PAM type: NRG; PAM sequence: TGG
tgtgtcggatggctgacagg

SEQ ID NO: 39610 - DNA, 20 bp, Artificial Sequence
  Description of Artificial Sequence: Synthetic oligonucleotide
  Target: SCN9A; (+) strand; PAM type: NRG; PAM sequence: CAG
gtggctattcttccaatgca

SEQ ID NO: 39611 - DNA, 20 bp, Artificial Sequence
  Description of Artificial Sequence: Synthetic oligonucleotide
  Target: SCN9A; (+) strand; PAM type: NRG; PAM sequence: AAG
aatgcacagacaccaatgca

SEQ ID NO: 39612 - DNA, 20 bp, Artificial Sequence
  Description of Artificial Sequence: Synthetic oligonucleotide
  Target: SCN9A; (+) strand; PAM type: NRG; PAM sequence: AAG
cagacaccaatgcaaagcac

SEQ ID NO: 39613 - DNA, 20 bp, Artificial Sequence
  Description of Artificial Sequence: Synthetic oligonucleotide
  Target: SCN9A; (+) strand; PAM type: NRG; PAM sequence: AGG
agacaccaatgcaaagcaca

SEQ ID NO: 39614 - DNA, 20 bp, Artificial Sequence
  Description of Artificial Sequence: Synthetic oligonucleotide
  Target: SCN9A; (+) strand; PAM type: NRG; PAM sequence: AAG
tgcaaagcacaaggaacaca

SEQ ID NO: 39615 - DNA, 20 bp, Artificial Sequence
  Description of Artificial Sequence: Synthetic oligonucleotide
  Target: SCN9A; (+) strand; PAM type: NRG; PAM sequence: TAG
gcacaaggaacacaaagaat

SEQ ID NO: 39616 - DNA, 20 bp, Artificial Sequence
  Description of Artificial Sequence: Synthetic oligonucleotide
  Target: SCN9A; (+) strand; PAM type: NRG; PAM sequence: AGG
cacaaggaacacaaagaatt

SEQ ID NO: 39617 - DNA, 20 bp, Artificial Sequence
  Description of Artificial Sequence: Synthetic oligonucleotide
  Target: SCN9A; (+) strand; PAM type: NRG; PAM sequence: GGG
acaaggaacacaaagaatta

SEQ ID NO: 39618 - DNA, 20 bp, Artificial Sequence
  Description of Artificial Sequence: Synthetic oligonucleotide
  Target: SCN9A; (+) strand; PAM type: NRG; PAM sequence: AAG
agaattagggaaacaacaaa

SEQ ID NO: 39619 - DNA, 20 bp, Artificial Sequence
  Description of Artificial Sequence: Synthetic oligonucleotide
  Target: SCN9A; (+) strand; PAM type: NRG; PAM sequence: AGG
gaattagggaaacaacaaaa

SEQ ID NO: 39620 - DNA, 20 bp, Artificial Sequence
  Description of Artificial Sequence: Synthetic oligonucleotide
  Target: SCN9A; (+) strand; PAM type: NRG; PAM sequence: GGG
aattagggaaacaacaaaaa

SEQ ID NO: 39621 - DNA, 20 bp, Artificial Sequence
  Description of Artificial Sequence: Synthetic oligonucleotide
  Target: SCN9A; (+) strand; PAM type: NRG; PAM sequence: AAG
gaaacaacaaaaagggataa

SEQ ID NO: 39622 - DNA, 20 bp, Artificial Sequence
  Description of Artificial Sequence: Synthetic oligonucleotide
  Target: SCN9A; (+) strand; PAM type: NRG; PAM sequence: CAG
aaagggataaaagaaatccg

SEQ ID NO: 39623 - DNA, 20 bp, Artificial Sequence
  Description of Artificial Sequence: Synthetic oligonucleotide
  Target: SCN9A; (+) strand; PAM type: NRG; PAM sequence: AAG
atccgcagttactgacccta

SEQ ID NO: 39624 - DNA, 20 bp, Artificial Sequence
  Description of Artificial Sequence: Synthetic oligonucleotide
  Target: SCN9A; (+) strand; PAM type: NRG; PAM sequence: TAG
agttactgaccctaaagaaa

SEQ ID NO: 39625 - DNA, 20 bp, Artificial Sequence
  Description of Artificial Sequence: Synthetic oligonucleotide
  Target: SCN9A; (+) strand; PAM type: NRG; PAM sequence: GAG
ttactgaccctaaagaaata

SEQ ID NO: 39626 - DNA, 20 bp, Artificial Sequence
  Description of Artificial Sequence: Synthetic oligonucleotide
  Target: SCN9A; (+) strand; PAM type: NRG; PAM sequence: AAG
gatttataaattgcctaaaa

SEQ ID NO: 39627 - DNA, 20 bp, Artificial Sequence
  Description of Artificial Sequence: Synthetic oligonucleotide
  Target: SCN9A; (+) strand; PAM type: NRG; PAM sequence: AAG
tcaaaataattatcctaatg

SEQ ID NO: 39628 - DNA, 20 bp, Artificial Sequence
  Description of Artificial Sequence: Synthetic oligonucleotide
  Target: SCN9A; (+) strand; PAM type: NRG; PAM sequence: TAG
ataattatcctaatgaagtt

SEQ ID NO: 39629 - DNA, 20 bp, Artificial Sequence
  Description of Artificial Sequence: Synthetic oligonucleotide
  Target: SCN9A; (+) strand; PAM type: NRG; PAM sequence: AAG
tatcctaatgaagtttagca

SEQ ID NO: 39630 - DNA, 20 bp, Artificial Sequence
  Description of Artificial Sequence: Synthetic oligonucleotide
  Target: SCN9A; (+) strand; PAM type: NRG; PAM sequence: CAG
aatgaagtttagcaaagtac

SEQ ID NO: 39631 - DNA, 20 bp, Artificial Sequence
  Description of Artificial Sequence: Synthetic oligonucleotide
  Target: SCN9A; (+) strand; PAM type: NRG; PAM sequence: GAG
tgaagtttagcaaagtacca

SEQ ID NO: 39632 - DNA, 20 bp, Artificial Sequence
  Description of Artificial Sequence: Synthetic oligonucleotide
  Target: SCN9A; (+) strand; PAM type: NRG; PAM sequence: CAG
tttagcaaagtaccagagaa

SEQ ID NO: 39633 - DNA, 20 bp, Artificial Sequence
  Description of Artificial Sequence: Synthetic oligonucleotide
  Target: SCN9A; (+) strand; PAM type: NRG; PAM sequence: GAG
tagcaaagtaccagagaaca

SEQ ID NO: 39634 - DNA, 20 bp, Artificial Sequence
  Description of Artificial Sequence: Synthetic oligonucleotide
  Target: SCN9A; (+) strand; PAM type: NRG; PAM sequence: TAG
aaagtaccagagaacagaga

SEQ ID NO: 39635 - DNA, 20 bp, Artificial Sequence
  Description of Artificial Sequence: Synthetic oligonucleotide
  Target: SCN9A; (+) strand; PAM type: NRG; PAM sequence: CAG
gatagacaactaaacaaaat

SEQ ID NO: 39636 - DNA, 20 bp, Artificial Sequence
  Description of Artificial Sequence: Synthetic oligonucleotide
  Target: SCN9A; (+) strand; PAM type: NRG; PAM sequence: AGG
atagacaactaaacaaaatc

SEQ ID NO: 39637 - DNA, 20 bp, Artificial Sequence
  Description of Artificial Sequence: Synthetic oligonucleotide
  Target: SCN9A; (+) strand; PAM type: NRG; PAM sequence: AAG
gacaactaaacaaaatcagg

SEQ ID NO: 39638 - DNA, 20 bp, Artificial Sequence
  Description of Artificial Sequence: Synthetic oligonucleotide
  Target: SCN9A; (+) strand; PAM type: NRG; PAM sequence: GAG
agatgatacatgaacacaat

SEQ ID NO: 39639 - DNA, 20 bp, Artificial Sequence
  Description of Artificial Sequence: Synthetic oligonucleotide
  Target: SCN9A; (+) strand; PAM type: NRG; PAM sequence: AGG
gatgatacatgaacacaatg

SEQ ID NO: 39640 - DNA, 20 bp, Artificial Sequence
  Description of Artificial Sequence: Synthetic oligonucleotide
  Target: SCN9A; (+) strand; PAM type: NRG; PAM sequence: AAG
acacaatgaggatatcaatg

SEQ ID NO: 39641 - DNA, 20 bp, Artificial Sequence
  Description of Artificial Sequence: Synthetic oligonucleotide
  Target: SCN9A; (+) strand; PAM type: NRG; PAM sequence: AGG
cacaatgaggatatcaatga

SEQ ID NO: 39642 - DNA, 20 bp, Artificial Sequence
  Description of Artificial Sequence: Synthetic oligonucleotide
  Target: SCN9A; (+) strand; PAM type: NRG; PAM sequence: GGG
acaatgaggatatcaatgaa

SEQ ID NO: 39643 - DNA, 20 bp, Artificial Sequence
  Description of Artificial Sequence: Synthetic oligonucleotide
  Target: SCN9A; (+) strand; PAM type: NRG; PAM sequence: AAG
tgaggatatcaatgaaggga

SEQ ID NO: 39644 - DNA, 20 bp, Artificial Sequence
  Description of Artificial Sequence: Synthetic oligonucleotide
  Target: SCN9A; (+) strand; PAM type: NRG; PAM sequence: AAG
actatacacacacacacaaa

SEQ ID NO: 39645 - DNA, 20 bp, Artificial Sequence
  Description of Artificial Sequence: Synthetic oligonucleotide
  Target: SCN9A; (+) strand; PAM type: NRG; PAM sequence: CAG
acacacaaaaagtcaaatat

SEQ ID NO: 39646 - DNA, 20 bp, Artificial Sequence
  Description of Artificial Sequence: Synthetic oligonucleotide
  Target: SCN9A; (+) strand; PAM type: NRG; PAM sequence: TGG
tcaaatatcagtaaaaactc

SEQ ID NO: 39647 - DNA, 20 bp, Artificial Sequence
  Description of Artificial Sequence: Synthetic oligonucleotide
  Target: SCN9A; (+) strand; PAM type: NRG; PAM sequence: AAG
cagtaaaaactctggaattg

SEQ ID NO: 39648 - DNA, 20 bp, Artificial Sequence
  Description of Artificial Sequence: Synthetic oligonucleotide
  Target: SCN9A; (+) strand; PAM type: NRG; PAM sequence: TAG
aattgaactaaaaaactccc

SEQ ID NO: 39649 - DNA, 20 bp, Artificial Sequence
  Description of Artificial Sequence: Synthetic oligonucleotide
  Target: SCN9A; (+) strand; PAM type: NRG; PAM sequence: GAG
ttgaactaaaaaactcccta

SEQ ID NO: 39650 - DNA, 20 bp, Artificial Sequence
  Description of Artificial Sequence: Synthetic oligonucleotide
  Target: SCN9A; (+) strand; PAM type: NRG; PAM sequence: AGG
tgaactaaaaaactccctag

SEQ ID NO: 39651 - DNA, 20 bp, Artificial Sequence
  Description of Artificial Sequence: Synthetic oligonucleotide
  Target: SCN9A; (+) strand; PAM type: NRG; PAM sequence: TAG
aaactccctagaggattcaa

SEQ ID NO: 39652 - DNA, 20 bp, Artificial Sequence
  Description of Artificial Sequence: Synthetic oligonucleotide
  Target: SCN9A; (+) strand; PAM type: NRG; PAM sequence: CAG
ctccctagaggattcaatag

SEQ ID NO: 39653 - DNA, 20 bp, Artificial Sequence
  Description of Artificial Sequence: Synthetic oligonucleotide
  Target: SCN9A; (+) strand; PAM type: NRG; PAM sequence: TGG
aatagcagacttgatcaaac

SEQ ID NO: 39654 - DNA, 20 bp, Artificial Sequence
  Description of Artificial Sequence: Synthetic oligonucleotide
  Target: SCN9A; (+) strand; PAM type: NRG; PAM sequence: GAG
tagcagacttgatcaaactg

SEQ ID NO: 39655 - DNA, 20 bp, Artificial Sequence
  Description of Artificial Sequence: Synthetic oligonucleotide
  Target: SCN9A; (+) strand; PAM type: NRG; PAM sequence: AAG
agacttgatcaaactggaga

SEQ ID NO: 39656 - DNA, 20 bp, Artificial Sequence
  Description of Artificial Sequence: Synthetic oligonucleotide
  Target: SCN9A; (+) strand; PAM type: NRG; PAM sequence: AAG
ggagaaagaatcaacaaacc

SEQ ID NO: 39657 - DNA, 20 bp, Artificial Sequence
  Description of Artificial Sequence: Synthetic oligonucleotide
  Target: SCN9A; (+) strand; PAM type: NRG; PAM sequence: TGG
aaaacaaccccatcaaaaac

SEQ ID NO: 39658 - DNA, 20 bp, Artificial Sequence
  Description of Artificial Sequence: Synthetic oligonucleotide
  Target: SCN9A; (+) strand; PAM type: NRG; PAM sequence: GGG
aaacaaccccatcaaaaact

SEQ ID NO: 39659 - DNA, 20 bp, Artificial Sequence
  Description of Artificial Sequence: Synthetic oligonucleotide
  Target: SCN9A; (+) strand; PAM type: NRG; PAM sequence: AAG
accccatcaaaaactgggta

SEQ ID NO: 39660 - DNA, 20 bp, Artificial Sequence
  Description of Artificial Sequence: Synthetic oligonucleotide
  Target: SCN9A; (+) strand; PAM type: NRG; PAM sequence: AGG
ccccatcaaaaactgggtaa

SEQ ID NO: 39661 - DNA, 20 bp, Artificial Sequence
  Description of Artificial Sequence: Synthetic oligonucleotide
  Target: SCN9A; (+) strand; PAM type: NRG; PAM sequence: CAG
aactgggtaaaggatatgaa

SEQ ID NO: 39662 - DNA, 20 bp, Artificial Sequence
  Description of Artificial Sequence: Synthetic oligonucleotide
  Target: SCN9A; (+) strand; PAM type: NRG; PAM sequence: AAG
tatgaacagacacttctcaa

SEQ ID NO: 39663 - DNA, 20 bp, Artificial Sequence
  Description of Artificial Sequence: Synthetic oligonucleotide
  Target: SCN9A; (+) strand; PAM type: NRG; PAM sequence: AAG
gaacagacacttctcaaaag

SEQ ID NO: 39664 - DNA, 20 bp, Artificial Sequence
  Description of Artificial Sequence: Synthetic oligonucleotide
  Target: SCN9A; (+) strand; PAM type: NRG; PAM sequence: CAG
ctcaaaagaagacatttatg

SEQ ID NO: 39665 - DNA, 20 bp, Artificial Sequence
  Description of Artificial Sequence: Synthetic oligonucleotide
  Target: SCN9A; (+) strand; PAM type: NRG; PAM sequence: TGG
gaaaaaatgctcatcatcac

SEQ ID NO: 39666 - DNA, 20 bp, Artificial Sequence
  Description of Artificial Sequence: Synthetic oligonucleotide
  Target: SCN9A; (+) strand; PAM type: NRG; PAM sequence: CAG
tgctcatcatcactggccat

SEQ ID NO: 39667 - DNA, 20 bp, Artificial Sequence
  Description of Artificial Sequence: Synthetic oligonucleotide
  Target: SCN9A; (+) strand; PAM type: NRG; PAM sequence: GAG
ctcatcatcactggccatca

SEQ ID NO: 39668 - DNA, 20 bp, Artificial Sequence
  Description of Artificial Sequence: Synthetic oligonucleotide
  Target: SCN9A; (+) strand; PAM type: NRG; PAM sequence: GAG
atgcaaatcaaaaccgcaat

SEQ ID NO: 39669 - DNA, 20 bp, Artificial Sequence
  Description of Artificial Sequence: Synthetic oligonucleotide
  Target: SCN9A; (+) strand; PAM type: NRG; PAM sequence: CAG
aatgagataccatctcatac

SEQ ID NO: 39670 - DNA, 20 bp, Artificial Sequence
  Description of Artificial Sequence: Synthetic oligonucleotide
  Target: SCN9A; (+) strand; PAM type: NRG; PAM sequence: TAG
agataccatctcataccagt

SEQ ID NO: 39671 - DNA, 20 bp, Artificial Sequence
  Description of Artificial Sequence: Synthetic oligonucleotide
  Target: SCN9A; (+) strand; PAM type: NRG; PAM sequence: TGG
ccatctcataccagttagaa

SEQ ID NO: 39672 - DNA, 20 bp, Artificial Sequence
  Description of Artificial Sequence: Synthetic oligonucleotide
  Target: SCN9A; (+) strand; PAM type: NRG; PAM sequence: AAG
ttagaatggtgatcattaaa

SEQ ID NO: 39673 - DNA, 20 bp, Artificial Sequence
  Description of Artificial Sequence: Synthetic oligonucleotide
  Target: SCN9A; (+) strand; PAM type: NRG; PAM sequence: CAG
aatggtgatcattaaaaagt

SEQ ID NO: 39674 - DNA, 20 bp, Artificial Sequence
  Description of Artificial Sequence: Synthetic oligonucleotide
  Target: SCN9A; (+) strand; PAM type: NRG; PAM sequence: AGG
atggtgatcattaaaaagtc

SEQ ID NO: 39675 - DNA, 20 bp, Artificial Sequence
  Description of Artificial Sequence: Synthetic oligonucleotide
  Target: SCN9A; (+) strand; PAM type: NRG; PAM sequence: CAG
attaaaaagtcaggaaacaa

SEQ ID NO: 39676 - DNA, 20 bp, Artificial Sequence
  Description of Artificial Sequence: Synthetic oligonucleotide
  Target: SCN9A; (+) strand; PAM type: NRG; PAM sequence: AGG
ttaaaaagtcaggaaacaac

SEQ ID NO: 39677 - DNA, 20 bp, Artificial Sequence
  Description of Artificial Sequence: Synthetic oligonucleotide
  Target: SCN9A; (+) strand; PAM type: NRG; PAM sequence: TGG
agtcaggaaacaacaggtgc

SEQ ID NO: 39678 - DNA, 20 bp, Artificial Sequence
  Description of Artificial Sequence: Synthetic oligonucleotide
  Target: SCN9A; (+) strand; PAM type: NRG; PAM sequence: GAG
tcaggaaacaacaggtgctg

SEQ ID NO: 39679 - DNA, 20 bp, Artificial Sequence
  Description of Artificial Sequence: Synthetic oligonucleotide
  Target: SCN9A; (+) strand; PAM type: NRG; PAM sequence: GAG
aggaaacaacaggtgctgga

SEQ ID NO: 39680 - DNA, 20 bp, Artificial Sequence
  Description of Artificial Sequence: Synthetic oligonucleotide
  Target: SCN9A; (+) strand; PAM type: NRG; PAM sequence: AGG
ggaaacaacaggtgctggag

SEQ ID NO: 39681 - DNA, 20 bp, Artificial Sequence
  Description of Artificial Sequence: Synthetic oligonucleotide
  Target: SCN9A; (+) strand; PAM type: NRG; PAM sequence: TGG
aacaggtgctggagaggatg

SEQ ID NO: 39682 - DNA, 20 bp, Artificial Sequence
  Description of Artificial Sequence: Synthetic oligonucleotide
  Target: SCN9A; (+) strand; PAM type: NRG; PAM sequence: GAG
caggtgctggagaggatgtg

SEQ ID NO: 39683 - DNA, 20 bp, Artificial Sequence
  Description of Artificial Sequence: Synthetic oligonucleotide
  Target: SCN9A; (+) strand; PAM type: NRG; PAM sequence: TAG
ctggagaggatgtggagaaa

SEQ ID NO: 39684 - DNA, 20 bp, Artificial Sequence
  Description of Artificial Sequence: Synthetic oligonucleotide
  Target: SCN9A; (+) strand; PAM type: NRG; PAM sequence: AGG
tggagaggatgtggagaaat

SEQ ID NO: 39685 - DNA, 20 bp, Artificial Sequence
  Description of Artificial Sequence: Synthetic oligonucleotide
  Target: SCN9A; (+) strand; PAM type: NRG; PAM sequence: TGG
taggaacacttttacactgt

SEQ ID NO: 39686 - DNA, 20 bp, Artificial Sequence
  Description of Artificial Sequence: Synthetic oligonucleotide
  Target: SCN9A; (+) strand; PAM type: NRG; PAM sequence: TGG
gaacacttttacactgttgg

SEQ ID NO: 39687 - DNA, 20 bp, Artificial Sequence
  Description of Artificial Sequence: Synthetic oligonucleotide
  Target: SCN9A; (+) strand; PAM type: NRG; PAM sequence: GGG
aacacttttacactgttggt

SEQ ID NO: 39688 - DNA, 20 bp, Artificial Sequence
  Description of Artificial Sequence: Synthetic oligonucleotide
  Target: SCN9A; (+) strand; PAM type: NRG; PAM sequence: TAG
ctgttggtgggactgtaaac

SEQ ID NO: 39689 - DNA, 20 bp, Artificial Sequence
  Description of Artificial Sequence: Synthetic oligonucleotide
  Target: SCN9A; (+) strand; PAM type: NRG; PAM sequence: TGG
gtaaactagttcaaccactg

SEQ ID NO: 39690 - DNA, 20 bp, Artificial Sequence
  Description of Artificial Sequence: Synthetic oligonucleotide
  Target: SCN9A; (+) strand; PAM type: NRG; PAM sequence: AAG
aactagttcaaccactgtgg

SEQ ID NO: 39691 - DNA, 20 bp, Artificial Sequence
  Description of Artificial Sequence: Synthetic oligonucleotide
  Target: SCN9A; (+) strand; PAM type: NRG; PAM sequence: TGG
aaccactgtggaagtccgtg

SEQ ID NO: 39692 - DNA, 20 bp, Artificial Sequence
  Description of Artificial Sequence: Synthetic oligonucleotide
  Target: SCN9A; (+) strand; PAM type: NRG; PAM sequence: AAG
agtccgtgtggcgattcctc

SEQ ID NO: 39693 - DNA, 20 bp, Artificial Sequence
  Description of Artificial Sequence: Synthetic oligonucleotide
  Target: SCN9A; (+) strand; PAM type: NRG; PAM sequence: AGG
gtccgtgtggcgattcctca

SEQ ID NO: 39694 - DNA, 20 bp, Artificial Sequence
  Description of Artificial Sequence: Synthetic oligonucleotide
  Target: SCN9A; (+) strand; PAM type: NRG; PAM sequence: TAG
gtggcgattcctcaaggatc

SEQ ID NO: 39695 - DNA, 20 bp, Artificial Sequence
  Description of Artificial Sequence: Synthetic oligonucleotide
  Target: SCN9A; (+) strand; PAM type: NRG; PAM sequence: TAG
attcctcaaggatctagaac

SEQ ID NO: 39696 - DNA, 20 bp, Artificial Sequence
  Description of Artificial Sequence: Synthetic oligonucleotide
  Target: SCN9A; (+) strand; PAM type: NRG; PAM sequence: CAG
actagaaataccatttgacc

SEQ ID NO: 39697 - DNA, 20 bp, Artificial Sequence
  Description of Artificial Sequence: Synthetic oligonucleotide
  Target: SCN9A; (+) strand; PAM type: NRG; PAM sequence: TGG
tgacccagccatcccatgac

SEQ ID NO: 39698 - DNA, 20 bp, Artificial Sequence
  Description of Artificial Sequence: Synthetic oligonucleotide
  Target: SCN9A; (+) strand; PAM type: NRG; PAM sequence: GGG
gacccagccatcccatgact

SEQ ID NO: 39699 - DNA, 20 bp, Artificial Sequence
  Description of Artificial Sequence: Synthetic oligonucleotide
  Target: SCN9A; (+) strand; PAM type: NRG; PAM sequence: AAG
catgactgggtatataccca

SEQ ID NO: 39700 - DNA, 20 bp, Artificial Sequence
  Description of Artificial Sequence: Synthetic oligonucleotide
  Target: SCN9A; (+) strand; PAM type: NRG; PAM sequence: AGG
atgactgggtatatacccaa

SEQ ID NO: 39701 - DNA, 20 bp, Artificial Sequence
  Description of Artificial Sequence: Synthetic oligonucleotide
  Target: SCN9A; (+) strand; PAM type: NRG; PAM sequence: AAG
ttataaatcatgctgctata

SEQ ID NO: 39702 - DNA, 20 bp, Artificial Sequence
  Description of Artificial Sequence: Synthetic oligonucleotide
  Target: SCN9A; (+) strand; PAM type: NRG; PAM sequence: CGG
atgcacacgtatgtttattg

SEQ ID NO: 39703 - DNA, 20 bp, Artificial Sequence
  Description of Artificial Sequence: Synthetic oligonucleotide
  Target: SCN9A; (+) strand; PAM type: NRG; PAM sequence: TAG
tattgcggcactattcacaa

SEQ ID NO: 39704 - DNA, 20 bp, Artificial Sequence
  Description of Artificial Sequence: Synthetic oligonucleotide
  Target: SCN9A; (+) strand; PAM type: NRG; PAM sequence: AAG
cggcactattcacaatagca

SEQ ID NO: 39705 - DNA, 20 bp, Artificial Sequence
  Description of Artificial Sequence: Synthetic oligonucleotide
  Target: SCN9A; (+) strand; PAM type: NRG; PAM sequence: TGG
tattcacaatagcaaagact

SEQ ID NO: 39706 - DNA, 20 bp, Artificial Sequence
  Description of Artificial Sequence: Synthetic oligonucleotide
  Target: SCN9A; (+) strand; PAM type: NRG; PAM sequence: AAG
aatagcaaagacttggaacc

SEQ ID NO: 39707 - DNA, 20 bp, Artificial Sequence
  Description of Artificial Sequence: Synthetic oligonucleotide
  Target: SCN9A; (+) strand; PAM type: NRG; PAM sequence: TAG
agccaaatgtccaacaatga

SEQ ID NO: 39708 - DNA, 20 bp, Artificial Sequence
  Description of Artificial Sequence: Synthetic oligonucleotide
  Target: SCN9A; (+) strand; PAM type: NRG; PAM sequence: TGG
aatgtccaacaatgatagac

SEQ ID NO: 39709 - DNA, 20 bp, Artificial Sequence
  Description of Artificial Sequence: Synthetic oligonucleotide
  Target: SCN9A; (+) strand; PAM type: NRG; PAM sequence: AAG
caacaatgatagactggatt

SEQ ID NO: 39710 - DNA, 20 bp, Artificial Sequence
  Description of Artificial Sequence: Synthetic oligonucleotide
  Target: SCN9A; (+) strand; PAM type: NRG; PAM sequence: TGG
tagactggattaagaaaata

SEQ ID NO: 39711 - DNA, 20 bp, Artificial Sequence
  Description of Artificial Sequence: Synthetic oligonucleotide
  Target: SCN9A; (+) strand; PAM type: NRG; PAM sequence: TGG
aatatggcacatatacacca

SEQ ID NO: 39712 - DNA, 20 bp, Artificial Sequence
  Description of Artificial Sequence: Synthetic oligonucleotide
  Target: SCN9A; (+) strand; PAM type: NRG; PAM sequence: CAG
atacaccatggaatactatg

SEQ ID NO: 39713 - DNA, 20 bp, Artificial Sequence
  Description of Artificial Sequence: Synthetic oligonucleotide
  Target: SCN9A; (+) strand; PAM type: NRG; PAM sequence: AAG
aatactatgcagccataaaa

SEQ ID NO: 39714 - DNA, 20 bp, Artificial Sequence
  Description of Artificial Sequence: Synthetic oligonucleotide
  Target: SCN9A; (+) strand; PAM type: NRG; PAM sequence: AGG
atactatgcagccataaaaa

SEQ ID NO: 39715 - DNA, 20 bp, Artificial Sequence
  Description of Artificial Sequence: Synthetic oligonucleotide
  Target: SCN9A; (+) strand; PAM type: NRG; PAM sequence: GAG
atgcagccataaaaaaggat

SEQ ID NO: 39716 - DNA, 20 bp, Artificial Sequence
  Description of Artificial Sequence: Synthetic oligonucleotide
  Target: SCN9A; (+) strand; PAM type: NRG; PAM sequence: AAG
ccataaaaaaggatgagctc

SEQ ID NO: 39717 - DNA, 20 bp, Artificial Sequence
  Description of Artificial Sequence: Synthetic oligonucleotide
  Target: SCN9A; (+) strand; PAM type: NRG; PAM sequence: CAG
ggatgagctcaagtcctttg

SEQ ID NO: 39718 - DNA, 20 bp, Artificial Sequence
  Description of Artificial Sequence: Synthetic oligonucleotide
  Target: SCN9A; (+) strand; PAM type: NRG; PAM sequence: AGG
gatgagctcaagtcctttgc

SEQ ID NO: 39719 - DNA, 20 bp, Artificial Sequence
  Description of Artificial Sequence: Synthetic oligonucleotide
  Target: SCN9A; (+) strand; PAM type: NRG; PAM sequence: GGG
atgagctcaagtcctttgca

SEQ ID NO: 39720 - DNA, 20 bp, Artificial Sequence
  Description of Artificial Sequence: Synthetic oligonucleotide
  Target: SCN9A; (+) strand; PAM type: NRG; PAM sequence: AAG
cctttgcagggacatgcatg

SEQ ID NO: 39721 - DNA, 20 bp, Artificial Sequence
  Description of Artificial Sequence: Synthetic oligonucleotide
  Target: SCN9A; (+) strand; PAM type: NRG; PAM sequence: TGG
tgcagggacatgcatgaagc

SEQ ID NO: 39722 - DNA, 20 bp, Artificial Sequence
  Description of Artificial Sequence: Synthetic oligonucleotide
  Target: SCN9A; (+) strand; PAM type: NRG; PAM sequence: CAG
aagctggaaaccatcattct

SEQ ID NO: 39723 - DNA, 20 bp, Artificial Sequence
  Description of Artificial Sequence: Synthetic oligonucleotide
  Target: SCN9A; (+) strand; PAM type: NRG; PAM sequence: AAG
cattctcagcaaactatcgc

SEQ ID NO: 39724 - DNA, 20 bp, Artificial Sequence
  Description of Artificial Sequence: Synthetic oligonucleotide
  Target: SCN9A; (+) strand; PAM type: NRG; PAM sequence: AGG
attctcagcaaactatcgca

SEQ ID NO: 39725 - DNA, 20 bp, Artificial Sequence
  Description of Artificial Sequence: Synthetic oligonucleotide
  Target: SCN9A; (+) strand; PAM type: NRG; PAM sequence: TAG
acactgcactttctcactca

SEQ ID NO: 39726 - DNA, 20 bp, Artificial Sequence
  Description of Artificial Sequence: Synthetic oligonucleotide
  Target: SCN9A; (+) strand; PAM type: NRG; PAM sequence: AGG
cactgcactttctcactcat

SEQ ID NO: 39727 - DNA, 20 bp, Artificial Sequence
  Description of Artificial Sequence: Synthetic oligonucleotide
  Target: SCN9A; (+) strand; PAM type: NRG; PAM sequence: TGG
tgcactttctcactcatagg

SEQ ID NO: 39728 - DNA, 20 bp, Artificial Sequence
  Description of Artificial Sequence: Synthetic oligonucleotide
  Target: SCN9A; (+) strand; PAM type: NRG; PAM sequence: GGG
gcactttctcactcataggt

SEQ ID NO: 39729 - DNA, 20 bp, Artificial Sequence
  Description of Artificial Sequence: Synthetic oligonucleotide
  Target: SCN9A; (+) strand; PAM type: NRG; PAM sequence: GAG
ataggtgggaattgaacaat

SEQ ID NO: 39730 - DNA, 20 bp, Artificial Sequence
  Description of Artificial Sequence: Synthetic oligonucleotide
  Target: SCN9A; (+) strand; PAM type: NRG; PAM sequence: TGG
aattgaacaatgagaacaca

SEQ ID NO: 39731 - DNA, 20 bp, Artificial Sequence
  Description of Artificial Sequence: Synthetic oligonucleotide
  Target: SCN9A; (+) strand; PAM type: NRG; PAM sequence: CAG
acaatgagaacacatggaca

SEQ ID NO: 39732 - DNA, 20 bp, Artificial Sequence
  Description of Artificial Sequence: Synthetic oligonucleotide
  Target: SCN9A; (+) strand; PAM type: NRG; PAM sequence: AGG
caatgagaacacatggacac

SEQ ID NO: 39733 - DNA, 20 bp, Artificial Sequence
  Description of Artificial Sequence: Synthetic oligonucleotide
  Target: SCN9A; (+) strand; PAM type: NRG; PAM sequence: AAG
tgagaacacatggacacagg

SEQ ID NO: 39734 - DNA, 20 bp, Artificial Sequence
  Description of Artificial Sequence: Synthetic oligonucleotide
  Target: SCN9A; (+) strand; PAM type: NRG; PAM sequence: AGG
gagaacacatggacacagga

SEQ ID NO: 39735 - DNA, 20 bp, Artificial Sequence
  Description of Artificial Sequence: Synthetic oligonucleotide
  Target: SCN9A; (+) strand; PAM type: NRG; PAM sequence: GGG
agaacacatggacacaggaa

SEQ ID NO: 39736 - DNA, 20 bp, Artificial Sequence
  Description of Artificial Sequence: Synthetic oligonucleotide
  Target: SCN9A; (+) strand; PAM type: NRG; PAM sequence: GGG
gaacacatggacacaggaag

SEQ ID NO: 39737 - DNA, 20 bp, Artificial Sequence
  Description of Artificial Sequence: Synthetic oligonucleotide
  Target: SCN9A; (+) strand; PAM type: NRG; PAM sequence: CAG
ggaaggggaccatcacacac

SEQ ID NO: 39738 - DNA, 20 bp, Artificial Sequence
  Description of Artificial Sequence: Synthetic oligonucleotide
  Target: SCN9A; (+) strand; PAM type: NRG; PAM sequence: AGG
gaaggggaccatcacacacc

SEQ ID NO: 39739 - DNA, 20 bp, Artificial Sequence
  Description of Artificial Sequence: Synthetic oligonucleotide
  Target: SCN9A; (+) strand; PAM type: NRG; PAM sequence: GGG
aaggggaccatcacacacca

SEQ ID NO: 39740 - DNA, 20 bp, Artificial Sequence
  Description of Artificial Sequence: Synthetic oligonucleotide
  Target: SCN9A; (+) strand; PAM type: NRG; PAM sequence: TGG
tcacacaccagggcctgttg

SEQ ID NO: 39741 - DNA, 20 bp, Artificial Sequence
  Description of Artificial Sequence: Synthetic oligonucleotide
  Target: SCN9A; (+) strand; PAM type: NRG; PAM sequence: GGG
cacacaccagggcctgttgt

SEQ ID NO: 39742 - DNA, 20 bp, Artificial Sequence
  Description of Artificial Sequence: Synthetic oligonucleotide
  Target: SCN9A; (+) strand; PAM type: NRG; PAM sequence: GGG
acacaccagggcctgttgtg

SEQ ID NO: 39743 - DNA, 20 bp, Artificial Sequence
  Description of Artificial Sequence: Synthetic oligonucleotide
  Target: SCN9A; (+) strand; PAM type: NRG; PAM sequence: TGG
caccagggcctgttgtgggg

SEQ ID NO: 39744 - DNA, 20 bp, Artificial Sequence
  Description of Artificial Sequence: Synthetic oligonucleotide
  Target: SCN9A; (+) strand; PAM type: NRG; PAM sequence: GGG
accagggcctgttgtggggt

SEQ ID NO: 39745 - DNA, 20 bp, Artificial Sequence
  Description of Artificial Sequence: Synthetic oligonucleotide
  Target: SCN9A; (+) strand; PAM type: NRG; PAM sequence: GGG
ccagggcctgttgtggggtg

SEQ ID NO: 39746 - DNA, 20 bp, Artificial Sequence
  Description of Artificial Sequence: Synthetic oligonucleotide
  Target: SCN9A; (+) strand; PAM type: NRG; PAM sequence: GGG
cagggcctgttgtggggtgg

SEQ ID NO: 39747 - DNA, 20 bp, Artificial Sequence
  Description of Artificial Sequence: Synthetic oligonucleotide
  Target: SCN9A; (+) strand; PAM type: NRG; PAM sequence: GGG
agggcctgttgtggggtggg

SEQ ID NO: 39748 - DNA, 20 bp, Artificial Sequence
  Description of Artificial Sequence: Synthetic oligonucleotide
  Target: SCN9A; (+) strand; PAM type: NRG; PAM sequence: GAG
ggcctgttgtggggtggggg

SEQ ID NO: 39749 - DNA, 20 bp, Artificial Sequence
  Description of Artificial Sequence: Synthetic oligonucleotide
  Target: SCN9A; (+) strand; PAM type: NRG; PAM sequence: AGG
gcctgttgtggggtgggggg

SEQ ID NO: 39750 - DNA, 20 bp, Artificial Sequence
  Description of Artificial Sequence: Synthetic oligonucleotide
  Target: SCN9A; (+) strand; PAM type: NRG; PAM sequence: GAG
ctgttgtggggtggggggag

SEQ ID NO: 39751 - DNA, 20 bp, Artificial Sequence
  Description of Artificial Sequence: Synthetic oligonucleotide
  Target: SCN9A; (+) strand; PAM type: NRG; PAM sequence: AGG
tgttgtggggtggggggagg

SEQ ID NO: 39752 - DNA, 20 bp, Artificial Sequence
  Description of Artificial Sequence: Synthetic oligonucleotide
  Target: SCN9A; (+) strand; PAM type: NRG; PAM sequence: GGG
gttgtggggtggggggagga

SEQ ID NO: 39753 - DNA, 20 bp, Artificial Sequence
  Description of Artificial Sequence: Synthetic oligonucleotide
  Target: SCN9A; (+) strand; PAM type: NRG; PAM sequence: GGG
ttgtggggtggggggaggag

SEQ ID NO: 39754 - DNA, 20 bp, Artificial Sequence
  Description of Artificial Sequence: Synthetic oligonucleotide
  Target: SCN9A; (+) strand; PAM type: NRG; PAM sequence: GGG
tgtggggtggggggaggagg

SEQ ID NO: 39755 - DNA, 20 bp, Artificial Sequence
  Description of Artificial Sequence: Synthetic oligonucleotide
  Target: SCN9A; (+) strand; PAM type: NRG; PAM sequence: TAG
gagggggatatacctaacat

SEQ ID NO: 39756 - DNA, 20 bp, Artificial Sequence
  Description of Artificial Sequence: Synthetic oligonucleotide
  Target: SCN9A; (+) strand; PAM type: NRG; PAM sequence: AGG
agggggatatacctaacatt

SEQ ID NO: 39757 - DNA, 20 bp, Artificial Sequence
  Description of Artificial Sequence: Synthetic oligonucleotide
  Target: SCN9A; (+) strand; PAM type: NRG; PAM sequence: GAG
ggggatatacctaacattag

SEQ ID NO: 39758 - DNA, 20 bp, Artificial Sequence
  Description of Artificial Sequence: Synthetic oligonucleotide
  Target: SCN9A; (+) strand; PAM type: NRG; PAM sequence: GAG
tatacctaatgttaaatgat

SEQ ID NO: 39759 - DNA, 20 bp, Artificial Sequence
  Description of Artificial Sequence: Synthetic oligonucleotide
  Target: SCN9A; (+) strand; PAM type: NRG; PAM sequence: TGG
aatgttaaatgatgagttaa

SEQ ID NO: 39760 - DNA, 20 bp, Artificial Sequence
  Description of Artificial Sequence: Synthetic oligonucleotide
  Target: SCN9A; (+) strand; PAM type: NRG; PAM sequence: GGG
atgttaaatgatgagttaat

SEQ ID NO: 39761 - DNA, 20 bp, Artificial Sequence
  Description of Artificial Sequence: Synthetic oligonucleotide
  Target: SCN9A; (+) strand; PAM type: NRG; PAM sequence: TAG
aaatgatgagttaatgggtg

SEQ ID NO: 39762 - DNA, 20 bp, Artificial Sequence
  Description of Artificial Sequence: Synthetic oligonucleotide
  Target: SCN9A; (+) strand; PAM type: NRG; PAM sequence: TGG
atgggtgtagcacaccaaca

SEQ ID NO: 39763 - DNA, 20 bp, Artificial Sequence
  Description of Artificial Sequence: Synthetic oligonucleotide
  Target: SCN9A; (+) strand; PAM type: NRG; PAM sequence: AAG
cacatgtaccctaaaactta

SEQ ID NO: 39764 - DNA, 20 bp, Artificial Sequence
  Description of Artificial Sequence: Synthetic oligonucleotide
  Target: SCN9A; (+) strand; PAM type: NRG; PAM sequence: AAG
taaaattaaaaaaccctcaa

SEQ ID NO: 39765 - DNA, 20 bp, Artificial Sequence
  Description of Artificial Sequence: Synthetic oligonucleotide
  Target: SCN9A; (+) strand; PAM type: NRG; PAM sequence: TGG
attaaaaaaccctcaaaaga

SEQ ID NO: 39766 - DNA, 20 bp, Artificial Sequence
  Description of Artificial Sequence: Synthetic oligonucleotide
  Target: SCN9A; (+) strand; PAM type: NRG; PAM sequence: AAG
ggacaccaaaaaaaaaaaaa

SEQ ID NO: 39767 - DNA, 20 bp, Artificial Sequence
  Description of Artificial Sequence: Synthetic oligonucleotide
  Target: SCN9A; (+) strand; PAM type: NRG; PAM sequence: AGG
gacaccaaaaaaaaaaaaaa

SEQ ID NO: 39768 - DNA, 20 bp, Artificial Sequence
  Description of Artificial Sequence: Synthetic oligonucleotide
  Target: SCN9A; (+) strand; PAM type: NRG; PAM sequence: TAG
accaaaaaaaaaaaaaaagg

SEQ ID NO: 39769 - DNA, 20 bp, Artificial Sequence
  Description of Artificial Sequence: Synthetic oligonucleotide
  Target: SCN9A; (+) strand; PAM type: NRG; PAM sequence: CAG
gtagatcatttaaaattatc

SEQ ID NO: 39770 - DNA, 20 bp, Artificial Sequence
  Description of Artificial Sequence: Synthetic oligonucleotide
  Target: SCN9A; (+) strand; PAM type: NRG; PAM sequence: CAG
atcatttaaaattatccagt

SEQ ID NO: 39771 - DNA, 20 bp, Artificial Sequence
  Description of Artificial Sequence: Synthetic oligonucleotide
  Target: SCN9A; (+) strand; PAM type: NRG; PAM sequence: TGG
atttaaaattatccagtcag

SEQ ID NO: 39772 - DNA, 20 bp, Artificial Sequence
  Description of Artificial Sequence: Synthetic oligonucleotide
  Target: SCN9A; (+) strand; PAM type: NRG; PAM sequence: GAG
ttaaaattatccagtcagtg

SEQ ID NO: 39773 - DNA, 20 bp, Artificial Sequence
  Description of Artificial Sequence: Synthetic oligonucleotide
  Target: SCN9A; (+) strand; PAM type: NRG; PAM sequence: AAG
aattatccagtcagtggagc

SEQ ID NO: 39774 - DNA, 20 bp, Artificial Sequence
  Description of Artificial Sequence: Synthetic oligonucleotide
  Target: SCN9A; (+) strand; PAM type: NRG; PAM sequence: AAG
tatccagtcagtggagcaag

SEQ ID NO: 39775 - DNA, 20 bp, Artificial Sequence
  Description of Artificial Sequence: Synthetic oligonucleotide
  Target: SCN9A; (+) strand; PAM type: NRG; PAM sequence: GAG
gaagaaataaaaaaaaaaat

SEQ ID NO: 39776 - DNA, 20 bp, Artificial Sequence
  Description of Artificial Sequence: Synthetic oligonucleotide
  Target: SCN9A; (+) strand; PAM type: NRG; PAM sequence: AAG
aataaaaaaaaaaatgagtg

SEQ ID NO: 39777 - DNA, 20 bp, Artificial Sequence
  Description of Artificial Sequence: Synthetic oligonucleotide
  Target: SCN9A; (+) strand; PAM type: NRG; PAM sequence: AGG
ataaaaaaaaaaatgagtga

SEQ ID NO: 39778 - DNA, 20 bp, Artificial Sequence
  Description of Artificial Sequence: Synthetic oligonucleotide
  Target: SCN9A; (+) strand; PAM type: NRG; PAM sequence: TGG
aaaaaatgagtgaaggttca

SEQ ID NO: 39779 - DNA, 20 bp, Artificial Sequence
  Description of Artificial Sequence: Synthetic oligonucleotide
  Target: SCN9A; (+) strand; PAM type: NRG; PAM sequence: GGG
aaaaatgagtgaaggttcat

SEQ ID NO: 39780 - DNA, 20 bp, Artificial Sequence
  Description of Artificial Sequence: Synthetic oligonucleotide
  Target: SCN9A; (+) strand; PAM type: NRG; PAM sequence: AAG
aaggttcatgggacatcatt

SEQ ID NO: 39781 - DNA, 20 bp, Artificial Sequence
  Description of Artificial Sequence: Synthetic oligonucleotide
  Target: SCN9A; (+) strand; PAM type: NRG; PAM sequence: TGG
gttcatgggacatcattaag

SEQ ID NO: 39782 - DNA, 20 bp, Artificial Sequence
  Description of Artificial Sequence: Synthetic oligonucleotide
  Target: SCN9A; (+) strand; PAM type: NRG; PAM sequence: CAG
atatatgcattatgaaatca

SEQ ID NO: 39783 - DNA, 20 bp, Artificial Sequence
  Description of Artificial Sequence: Synthetic oligonucleotide
  Target: SCN9A; (+) strand; PAM type: NRG; PAM sequence: GAG
atatgcattatgaaatcaca

SEQ ID NO: 39784 - DNA, 20 bp, Artificial Sequence
  Description of Artificial Sequence: Synthetic oligonucleotide
  Target: SCN9A; (+) strand; PAM type: NRG; PAM sequence: AAG
tgcattatgaaatcacagag

SEQ ID NO: 39785 - DNA, 20 bp, Artificial Sequence
  Description of Artificial Sequence: Synthetic oligonucleotide
  Target: SCN9A; (+) strand; PAM type: NRG; PAM sequence: CAG
ttatgaaatcacagagaaga

SEQ ID NO: 39786 - DNA, 20 bp, Artificial Sequence
  Description of Artificial Sequence: Synthetic oligonucleotide
  Target: SCN9A; (+) strand; PAM type: NRG; PAM sequence: AAG
gaaatcacagagaagacaga

SEQ ID NO: 39787 - DNA, 20 bp, Artificial Sequence
  Description of Artificial Sequence: Synthetic oligonucleotide
  Target: SCN9A; (+) strand; PAM type: NRG; PAM sequence: AGG
aaatcacagagaagacagaa

SEQ ID NO: 39788 - DNA, 20 bp, Artificial Sequence
  Description of Artificial Sequence: Synthetic oligonucleotide
  Target: SCN9A; (+) strand; PAM type: NRG; PAM sequence: GGG
aatcacagagaagacagaaa

SEQ ID NO: 39789 - DNA, 20 bp, Artificial Sequence
  Description of Artificial Sequence: Synthetic oligonucleotide
  Target: SCN9A; (+) strand; PAM type: NRG; PAM sequence: GGG
atcacagagaagacagaaag

SEQ ID NO: 39790 - DNA, 20 bp, Artificial Sequence
  Description of Artificial Sequence: Synthetic oligonucleotide
  Target: SCN9A; (+) strand; PAM type: NRG; PAM sequence: TGG
gactaaaatatgttcaaatt

SEQ ID NO: 39791 - DNA, 20 bp, Artificial Sequence
  Description of Artificial Sequence: Synthetic oligonucleotide
  Target: SCN9A; (+) strand; PAM type: NRG; PAM sequence: GGG
actaaaatatgttcaaattt

SEQ ID NO: 39792 - DNA, 20 bp, Artificial Sequence
  Description of Artificial Sequence: Synthetic oligonucleotide
  Target: SCN9A; (+) strand; PAM type: NRG; PAM sequence: GGG
ctaaaatatgttcaaatttg

SEQ ID NO: 39793 - DNA, 20 bp, Artificial Sequence
  Description of Artificial Sequence: Synthetic oligonucleotide
  Target: SCN9A; (+) strand; PAM type: NRG; PAM sequence: GAG
aaaatatgttcaaatttggg

SEQ ID NO: 39794 - DNA, 20 bp, Artificial Sequence
  Description of Artificial Sequence: Synthetic oligonucleotide
  Target: SCN9A; (+) strand; PAM type: NRG; PAM sequence: GAG
aatatgttcaaatttgggga

SEQ ID NO: 39795 - DNA, 20 bp, Artificial Sequence
  Description of Artificial Sequence: Synthetic oligonucleotide
  Target: SCN9A; (+) strand; PAM type: NRG; PAM sequence: CAG
gagatatgaacatctaaatt

SEQ ID NO: 39796 - DNA, 20 bp, Artificial Sequence
  Description of Artificial Sequence: Synthetic oligonucleotide
  Target: SCN9A; (+) strand; PAM type: NRG; PAM sequence: AGG
agatatgaacatctaaattc

SEQ ID NO: 39797 - DNA, 20 bp, Artificial Sequence
  Description of Artificial Sequence: Synthetic oligonucleotide
  Target: SCN9A; (+) strand; PAM type: NRG; PAM sequence: AAG
atctaaattcaggaaactca

SEQ ID NO: 39798 - DNA, 20 bp, Artificial Sequence
  Description of Artificial Sequence: Synthetic oligonucleotide
  Target: SCN9A; (+) strand; PAM type: NRG; PAM sequence: TAG
gaaactcaaagaatcccaaa

SEQ ID NO: 39799 - DNA, 20 bp, Artificial Sequence
  Description of Artificial Sequence: Synthetic oligonucleotide
  Target: SCN9A; (+) strand; PAM type: NRG; PAM sequence: AGG
aaactcaaagaatcccaaat

SEQ ID NO: 39800 - DNA, 20 bp, Artificial Sequence
  Description of Artificial Sequence: Synthetic oligonucleotide
  Target: SCN9A; (+) strand; PAM type: NRG; PAM sequence: AAG
tcccaaataggacaaatcta

SEQ ID NO: 39801 - DNA, 20 bp, Artificial Sequence
  Description of Artificial Sequence: Synthetic oligonucleotide
  Target: SCN9A; (+) strand; PAM type: NRG; PAM sequence: AAG
caaataggacaaatctaaag

SEQ ID NO: 39802 - DNA, 20 bp, Artificial Sequence
  Description of Artificial Sequence: Synthetic oligonucleotide
  Target: SCN9A; (+) strand; PAM type: NRG; PAM sequence: CGG
ggacaaatctaaagaagtct

SEQ ID NO: 39803 - DNA, 20 bp, Artificial Sequence
  Description of Artificial Sequence: Synthetic oligonucleotide
  Target: SCN9A; (+) strand; PAM type: NRG; PAM sequence: TGG
aaatctaaagaagtctcggc

SEQ ID NO: 39804 - DNA, 20 bp, Artificial Sequence
  Description of Artificial Sequence: Synthetic oligonucleotide
  Target: SCN9A; (+) strand; PAM type: NRG; PAM sequence: GGG
aatctaaagaagtctcggct

SEQ ID NO: 39805 - DNA, 20 bp, Artificial Sequence
  Description of Artificial Sequence: Synthetic oligonucleotide
  Target: SCN9A; (+) strand; PAM type: NRG; PAM sequence: TGG
aaagaagtctcggctgggca

SEQ ID NO: 39806 - DNA, 20 bp, Artificial Sequence
  Description of Artificial Sequence: Synthetic oligonucleotide
  Target: SCN9A; (+) strand; PAM type: NRG; PAM sequence: TGG
gaagtctcggctgggcatgg

SEQ ID NO: 39807 - DNA, 20 bp, Artificial Sequence
  Description of Artificial Sequence: Synthetic oligonucleotide
  Target: SCN9A; (+) strand; PAM type: NRG; PAM sequence: CAG
gtggctcacacctgtaatcc

SEQ ID NO: 39808 - DNA, 20 bp, Artificial Sequence
  Description of Artificial Sequence: Synthetic oligonucleotide
  Target: SCN9A; (+) strand; PAM type: NRG; PAM sequence: GAG
acctgtaatcccagcacttt

SEQ ID NO: 39809 - DNA, 20 bp, Artificial Sequence
  Description of Artificial Sequence: Synthetic oligonucleotide
  Target: SCN9A; (+) strand; PAM type: NRG; PAM sequence: AGG
cctgtaatcccagcactttg

SEQ ID NO: 39810 - DNA, 20 bp, Artificial Sequence
  Description of Artificial Sequence: Synthetic oligonucleotide
  Target: SCN9A; (+) strand; PAM type: NRG; PAM sequence: GGG
ctgtaatcccagcactttga

SEQ ID NO: 39811 - DNA, 20 bp, Artificial Sequence
  Description of Artificial Sequence: Synthetic oligonucleotide
  Target: SCN9A; (+) strand; PAM type: NRG; PAM sequence: GGG
tgtaatcccagcactttgag

SEQ ID NO: 39812 - DNA, 20 bp, Artificial Sequence
  Description of Artificial Sequence: Synthetic oligonucleotide
  Target: SCN9A; (+) strand; PAM type: NRG; PAM sequence: GAG
tcccagcactttgaggggct

SEQ ID NO: 39813 - DNA, 20 bp, Artificial Sequence
  Description of Artificial Sequence: Synthetic oligonucleotide
  Target: SCN9A; (+) strand; PAM type: NRG; PAM sequence: CGG
cagcactttgaggggctgag

SEQ ID NO: 39814 - DNA, 20 bp, Artificial Sequence
  Description of Artificial Sequence: Synthetic oligonucleotide
  Target: SCN9A; (+) strand; PAM type: NRG; PAM sequence: GGG
agcactttgaggggctgagc

SEQ ID NO: 39815 - DNA, 20 bp, Artificial Sequence
  Description of Artificial Sequence: Synthetic oligonucleotide
  Target: SCN9A; (+) strand; PAM type: NRG; PAM sequence: GAG
cactttgaggggctgagcgg

SEQ ID NO: 39816 - DNA, 20 bp, Artificial Sequence
  Description of Artificial Sequence: Synthetic oligonucleotide
  Target: SCN9A; (+) strand; PAM type: NRG; PAM sequence: TGG
tttgaggggctgagcgggag

SEQ ID NO: 39817 - DNA, 20 bp, Artificial Sequence
  Description of Artificial Sequence: Synthetic oligonucleotide
  Target: SCN9A; (+) strand; PAM type: NRG; PAM sequence: GAG
tgagcgggagtggatcacct

SEQ ID NO: 39818 - DNA, 20 bp, Artificial Sequence
  Description of Artificial Sequence: Synthetic oligonucleotide
  Target: SCN9A; (+) strand; PAM type: NRG; PAM sequence: AGG
gagcgggagtggatcacctg

SEQ ID NO: 39819 - DNA, 20 bp, Artificial Sequence
  Description of Artificial Sequence: Synthetic oligonucleotide
  Target: SCN9A; (+) strand; PAM type: NRG; PAM sequence: CAG
gggagtggatcacctgaggt

SEQ ID NO: 39820 - DNA, 20 bp, Artificial Sequence
  Description of Artificial Sequence: Synthetic oligonucleotide
  Target: SCN9A; (+) strand; PAM type: NRG; PAM sequence: AGG
ggagtggatcacctgaggtc

SEQ ID NO: 39821 - DNA, 20 bp, Artificial Sequence
  Description of Artificial Sequence: Synthetic oligonucleotide
  Target: SCN9A; (+) strand; PAM type: NRG; PAM sequence: GAG
agtggatcacctgaggtcag

SEQ ID NO: 39822 - DNA, 20 bp, Artificial Sequence
  Description of Artificial Sequence: Synthetic oligonucleotide
  Target: SCN9A; (+) strand; PAM type: NRG; PAM sequence: AAG
tcacctgaggtcaggagttc

SEQ ID NO: 39823 - DNA, 20 bp, Artificial Sequence
  Description of Artificial Sequence: Synthetic oligonucleotide
  Target: SCN9A; (+) strand; PAM type: NRG; PAM sequence: CAG
tgaggtcaggagttcaagac

SEQ ID NO: 39824 - DNA, 20 bp, Artificial Sequence
  Description of Artificial Sequence: Synthetic oligonucleotide
  Target: SCN9A; (+) strand; PAM type: NRG; PAM sequence: TGG
tcaggagttcaagaccagcc

SEQ ID NO: 39825 - DNA, 20 bp, Artificial Sequence
  Description of Artificial Sequence: Synthetic oligonucleotide
  Target: SCN9A; (+) strand; PAM type: NRG; PAM sequence: TGG
caagaccagcctggccaaca

SEQ ID NO: 39826 - DNA, 20 bp, Artificial Sequence
  Description of Artificial Sequence: Synthetic oligonucleotide
  Target: SCN9A; (+) strand; PAM type: NRG; PAM sequence: CAG
ctaccaaaaattacaaaaat

SEQ ID NO: 39827 - DNA, 20 bp, Artificial Sequence
  Description of Artificial Sequence: Synthetic oligonucleotide
  Target: SCN9A; (+) strand; PAM type: NRG; PAM sequence: TGG
caaaaattacaaaaatcagc

SEQ ID NO: 39828 - DNA, 20 bp, Artificial Sequence
  Description of Artificial Sequence: Synthetic oligonucleotide
  Target: SCN9A; (+) strand; PAM type: NRG; PAM sequence: GGG
aaaaattacaaaaatcagct

SEQ ID NO: 39829 - DNA, 20 bp, Artificial Sequence
  Description of Artificial Sequence: Synthetic oligonucleotide
  Target: SCN9A; (+) strand; PAM type: NRG; PAM sequence: TGG
ttacaaaaatcagctgggtg

SEQ ID NO: 39830 - DNA, 20 bp, Artificial Sequence
  Description of Artificial Sequence: Synthetic oligonucleotide
  Target: SCN9A; (+) strand; PAM type: NRG; PAM sequence: TGG
caaaaatcagctgggtgtgg

SEQ ID NO: 39831 - DNA, 20 bp, Artificial Sequence
  Description of Artificial Sequence: Synthetic oligonucleotide
  Target: SCN9A; (+) strand; PAM type: NRG; PAM sequence: TGG
aaatcagctgggtgtggtgg

SEQ ID NO: 39832 - DNA, 20 bp, Artificial Sequence
  Description of Artificial Sequence: Synthetic oligonucleotide
  Target: SCN9A; (+) strand; PAM type: NRG; PAM sequence: GGG
aatcagctgggtgtggtggt

SEQ ID NO: 39833 - DNA, 20 bp, Artificial Sequence
  Description of Artificial Sequence: Synthetic oligonucleotide
  Target: SCN9A; (+) strand; PAM type: NRG; PAM sequence: CAG
gtggtgggtgcctataatcc

SEQ ID NO: 39834 - DNA, 20 bp, Artificial Sequence
  Description of Artificial Sequence: Synthetic oligonucleotide
  Target: SCN9A; (+) strand; PAM type: NRG; PAM sequence: CGG
tgcctataatcccagctact

SEQ ID NO: 39835 - DNA, 20 bp, Artificial Sequence
  Description of Artificial Sequence: Synthetic oligonucleotide
  Target: SCN9A; (+) strand; PAM type: NRG; PAM sequence: GGG
gcctataatcccagctactc

SEQ ID NO: 39836 - DNA, 20 bp, Artificial Sequence
  Description of Artificial Sequence: Synthetic oligonucleotide
  Target: SCN9A; (+) strand; PAM type: NRG; PAM sequence: GAG
ctataatcccagctactcgg

SEQ ID NO: 39837 - DNA, 20 bp, Artificial Sequence
  Description of Artificial Sequence: Synthetic oligonucleotide
  Target: SCN9A; (+) strand; PAM type: NRG; PAM sequence: AGG
tataatcccagctactcggg

SEQ ID NO: 39838 - DNA, 20 bp, Artificial Sequence
  Description of Artificial Sequence: Synthetic oligonucleotide
  Target: SCN9A; (+) strand; PAM type: NRG; PAM sequence: GAG
tcccagctactcgggaggct

SEQ ID NO: 39839 - DNA, 20 bp, Artificial Sequence
  Description of Artificial Sequence: Synthetic oligonucleotide
  Target: SCN9A; (+) strand; PAM type: NRG; PAM sequence: AGG
cccagctactcgggaggctg

SEQ ID NO: 39840 - DNA, 20 bp, Artificial Sequence
  Description of Artificial Sequence: Synthetic oligonucleotide
  Target: SCN9A; (+) strand; PAM type: NRG; PAM sequence: CAG
agctactcgggaggctgagg

SEQ ID NO: 39841 - DNA, 20 bp, Artificial Sequence
  Description of Artificial Sequence: Synthetic oligonucleotide
  Target: SCN9A; (+) strand; PAM type: NRG; PAM sequence: GAG
ctactcgggaggctgaggca

SEQ ID NO: 39842 - DNA, 20 bp, Artificial Sequence
  Description of Artificial Sequence: Synthetic oligonucleotide
  Target: SCN9A; (+) strand; PAM type: NRG; PAM sequence: GAG
actcgggaggctgaggcaga

SEQ ID NO: 39843 - DNA, 20 bp, Artificial Sequence
  Description of Artificial Sequence: Synthetic oligonucleotide
  Target: SCN9A; (+) strand; PAM type: NRG; PAM sequence: GAG
agagaattgcttgaacccac

SEQ ID NO: 39844 - DNA, 20 bp, Artificial Sequence
  Description of Artificial Sequence: Synthetic oligonucleotide
  Target: SCN9A; (+) strand; PAM type: NRG; PAM sequence: AGG
gagaattgcttgaacccacg

SEQ ID NO: 39845 - DNA, 20 bp, Artificial Sequence
  Description of Artificial Sequence: Synthetic oligonucleotide
  Target: SCN9A; (+) strand; PAM type: NRG; PAM sequence: TGG
aattgcttgaacccacgagg

SEQ ID NO: 39846 - DNA, 20 bp, Artificial Sequence
  Description of Artificial Sequence: Synthetic oligonucleotide
  Target: SCN9A; (+) strand; PAM type: NRG; PAM sequence: AAG
tgcttgaacccacgaggtgg

SEQ ID NO: 39847 - DNA, 20 bp, Artificial Sequence
  Description of Artificial Sequence: Synthetic oligonucleotide
  Target: SCN9A; (+) strand; PAM type: NRG; PAM sequence: CAG
aacccacgaggtggaagttg

SEQ ID NO: 39848 - DNA, 20 bp, Artificial Sequence
  Description of Artificial Sequence: Synthetic oligonucleotide
  Target: SCN9A; (+) strand; PAM type: NRG; PAM sequence: GAG
cacgaggtggaagttgcagt

SEQ ID NO: 39849 - DNA, 20 bp, Artificial Sequence
  Description of Artificial Sequence: Synthetic oligonucleotide
  Target: SCN9A; (+) strand; PAM type: NRG; PAM sequence: AAG
ggtggaagttgcagtgagcc

SEQ ID NO: 39850 - DNA, 20 bp, Artificial Sequence
  Description of Artificial Sequence: Synthetic oligonucleotide
  Target: SCN9A; (+) strand; PAM type: NRG; PAM sequence: CAG
aagatcatgctactgcactc

SEQ ID NO: 39851 - DNA, 20 bp, Artificial Sequence
  Description of Artificial Sequence: Synthetic oligonucleotide
  Target: SCN9A; (+) strand; PAM type: NRG; PAM sequence: TGG
catgctactgcactccagcc

SEQ ID NO: 39852 - DNA, 20 bp, Artificial Sequence
  Description of Artificial Sequence: Synthetic oligonucleotide
  Target: SCN9A; (+) strand; PAM type: NRG; PAM sequence: GGG
atgctactgcactccagcct

SEQ ID NO: 39853 - DNA, 20 bp, Artificial Sequence
  Description of Artificial Sequence: Synthetic oligonucleotide
  Target: SCN9A; (+) strand; PAM type: NRG; PAM sequence: CGG
gcactccagcctgggcaaca

SEQ ID NO: 39854 - DNA, 20 bp, Artificial Sequence
  Description of Artificial Sequence: Synthetic oligonucleotide
  Target: SCN9A; (+) strand; PAM type: NRG; PAM sequence: CGG
aacacggtgaaactctatct

SEQ ID NO: 39855 - DNA, 20 bp, Artificial Sequence
  Description of Artificial Sequence: Synthetic oligonucleotide
  Target: SCN9A; (+) strand; PAM type: NRG; PAM sequence: AAG
aaactctatctcggaaaaaa

SEQ ID NO: 39856 - DNA, 20 bp, Artificial Sequence
  Description of Artificial Sequence: Synthetic oligonucleotide
  Target: SCN9A; (+) strand; PAM type: NRG; PAM sequence: AAG
tctatctcggaaaaaaaaga

SEQ ID NO: 39857 - DNA, 20 bp, Artificial Sequence
  Description of Artificial Sequence: Synthetic oligonucleotide
  Target: SCN9A; (+) strand; PAM type: NRG; PAM sequence: AAG
tctcggaaaaaaaagaaaga

SEQ ID NO: 39858 - DNA, 20 bp, Artificial Sequence
  Description of Artificial Sequence: Synthetic oligonucleotide
  Target: SCN9A; (+) strand; PAM type: NRG; PAM sequence: TAG
aaaagaaagaaagtctccac

SEQ ID NO: 39859 - DNA, 20 bp, Artificial Sequence
  Description of Artificial Sequence: Synthetic oligonucleotide
  Target: SCN9A; (+) strand; PAM type: NRG; PAM sequence: GAG
aagaaagaaagtctccacta

SEQ ID NO: 39860 - DNA, 20 bp, Artificial Sequence
  Description of Artificial Sequence: Synthetic oligonucleotide
  Target: SCN9A; (+) strand; PAM type: NRG; PAM sequence: AAG
taatatcatcaaattgccaa

SEQ ID NO: 39861 - DNA, 20 bp, Artificial Sequence
  Description of Artificial Sequence: Synthetic oligonucleotide
  Target: SCN9A; (+) strand; PAM type: NRG; PAM sequence: AAG
catcaaattgccaaaagtga

SEQ ID NO: 39862 - DNA, 20 bp, Artificial Sequence
  Description of Artificial Sequence: Synthetic oligonucleotide
  Target: SCN9A; (+) strand; PAM type: NRG; PAM sequence: AGG
atcaaattgccaaaagtgaa

SEQ ID NO: 39863 - DNA, 20 bp, Artificial Sequence
  Description of Artificial Sequence: Synthetic oligonucleotide
  Target: SCN9A; (+) strand; PAM type: NRG; PAM sequence: GGG
tcaaattgccaaaagtgaaa

SEQ ID NO: 39864 - DNA, 20 bp, Artificial Sequence
  Description of Artificial Sequence: Synthetic oligonucleotide
  Target: SCN9A; (+) strand; PAM type: NRG; PAM sequence: AAG
aattgccaaaagtgaaaggg

SEQ ID NO: 39865 - DNA, 20 bp, Artificial Sequence
  Description of Artificial Sequence: Synthetic oligonucleotide
  Target: SCN9A; (+) strand; PAM type: NRG; PAM sequence: AAG
aaagtgaaagggaagtttga

SEQ ID NO: 39866 - DNA, 20 bp, Artificial Sequence
  Description of Artificial Sequence: Synthetic oligonucleotide
  Target: SCN9A; (+) strand; PAM type: NRG; PAM sequence: CAG
gtgaaagggaagtttgaaag

SEQ ID NO: 39867 - DNA, 20 bp, Artificial Sequence
  Description of Artificial Sequence: Synthetic oligonucleotide
  Target: SCN9A; (+) strand; PAM type: NRG; PAM sequence: AAG
aagggaagtttgaaagcagc

SEQ ID NO: 39868 - DNA, 20 bp, Artificial Sequence
  Description of Artificial Sequence: Synthetic oligonucleotide
  Target: SCN9A; (+) strand; PAM type: NRG; PAM sequence: AAG
aactgaattgtcatgtccaa

SEQ ID NO: 39869 - DNA, 20 bp, Artificial Sequence
  Description of Artificial Sequence: Synthetic oligonucleotide
  Target: SCN9A; (+) strand; PAM type: NRG; PAM sequence: GAG
ctgaattgtcatgtccaaaa

SEQ ID NO: 39870 - DNA, 20 bp, Artificial Sequence
  Description of Artificial Sequence: Synthetic oligonucleotide
  Target: SCN9A; (+) strand; PAM type: NRG; PAM sequence: AAG
atgtccaaaagagctctctt

SEQ ID NO: 39871 - DNA, 20 bp, Artificial Sequence
  Description of Artificial Sequence: Synthetic oligonucleotide
  Target: SCN9A; (+) strand; PAM type: NRG; PAM sequence: CAG
aagagctctcttaagatgaa

SEQ ID NO: 39872 - DNA, 20 bp, Artificial Sequence
  Description of Artificial Sequence: Synthetic oligonucleotide
  Target: SCN9A; (+) strand; PAM type: NRG; PAM sequence: CAG
agctctcttaagatgaacag

SEQ ID NO: 39873 - DNA, 20 bp, Artificial Sequence
  Description of Artificial Sequence: Synthetic oligonucleotide
  Target: SCN9A; (+) strand; PAM type: NRG; PAM sequence: CAG
aagatgaacagcagatttct

SEQ ID NO: 39874 - DNA, 20 bp, Artificial Sequence
  Description of Artificial Sequence: Synthetic oligonucleotide
  Target: SCN9A; (+) strand; PAM type: NRG; PAM sequence: TGG
atgaacagcagatttctcag

SEQ ID NO: 39875 - DNA, 20 bp, Artificial Sequence
  Description of Artificial Sequence: Synthetic oligonucleotide
  Target: SCN9A; (+) strand; PAM type: NRG; PAM sequence: AAG
tttctcagtggaaactttaa

SEQ ID NO: 39876 - DNA, 20 bp, Artificial Sequence
  Description of Artificial Sequence: Synthetic oligonucleotide
  Target: SCN9A; (+) strand; PAM type: NRG; PAM sequence: GAG
tctcagtggaaactttaaaa

SEQ ID NO: 39877 - DNA, 20 bp, Artificial Sequence
  Description of Artificial Sequence: Synthetic oligonucleotide
  Target: SCN9A; (+) strand; PAM type: NRG; PAM sequence: AAG
aaactttaaaagagcaaata

SEQ ID NO: 39878 - DNA, 20 bp, Artificial Sequence
  Description of Artificial Sequence: Synthetic oligonucleotide
  Target: SCN9A; (+) strand; PAM type: NRG; PAM sequence: AAG
taaaagagcaaataaagtga

SEQ ID NO: 39879 - DNA, 20 bp, Artificial Sequence
  Description of Artificial Sequence: Synthetic oligonucleotide
  Target: SCN9A; (+) strand; PAM type: NRG; PAM sequence: AAG
gtatatattcaaaatactta

SEQ ID NO: 39880 - DNA, 20 bp, Artificial Sequence
  Description of Artificial Sequence: Synthetic oligonucleotide
  Target: SCN9A; (+) strand; PAM type: NRG; PAM sequence: AAG
aaagaaaaaaactgctgacc

SEQ ID NO: 39881 - DNA, 20 bp, Artificial Sequence
  Description of Artificial Sequence: Synthetic oligonucleotide
  Target: SCN9A; (+) strand; PAM type: NRG; PAM sequence: TGG
ctgaccaagaataatatacc

SEQ ID NO: 39882 - DNA, 20 bp, Artificial Sequence
  Description of Artificial Sequence: Synthetic oligonucleotide
  Target: SCN9A; (+) strand; PAM type: NRG; PAM sequence: AAG
aaaaactgtcctttaaaatt

SEQ ID NO: 39883 - DNA, 20 bp, Artificial Sequence
  Description of Artificial Sequence: Synthetic oligonucleotide
  Target: SCN9A; (+) strand; PAM type: NRG; PAM sequence: AGG
aaaactgtcctttaaaatta

SEQ ID NO: 39884 - DNA, 20 bp, Artificial Sequence
  Description of Artificial Sequence: Synthetic oligonucleotide
  Target: SCN9A; (+) strand; PAM type: NRG; PAM sequence: AAG
actgtcctttaaaattaagg

SEQ ID NO: 39885 - DNA, 20 bp, Artificial Sequence
  Description of Artificial Sequence: Synthetic oligonucleotide
  Target: SCN9A; (+) strand; PAM type: NRG; PAM sequence: AGG
ctgtcctttaaaattaagga

SEQ ID NO: 39886 - DNA, 20 bp, Artificial Sequence
  Description of Artificial Sequence: Synthetic oligonucleotide
  Target: SCN9A; (+) strand; PAM type: NRG; PAM sequence: AAG
ggataaaaactttctcatac

SEQ ID NO: 39887 - DNA, 20 bp, Artificial Sequence
  Description of Artificial Sequence: Synthetic oligonucleotide
  Target: SCN9A; (+) strand; PAM type: NRG; PAM sequence: GAG
ttctcatacaagcaaatgct

SEQ ID NO: 39888 - DNA, 20 bp, Artificial Sequence
  Description of Artificial Sequence: Synthetic oligonucleotide
  Target: SCN9A; (+) strand; PAM type: NRG; PAM sequence: AGG
tctcatacaagcaaatgctg

SEQ ID NO: 39889 - DNA, 20 bp, Artificial Sequence
  Description of Artificial Sequence: Synthetic oligonucleotide
  Target: SCN9A; (+) strand; PAM type: NRG; PAM sequence: GGG
ctcatacaagcaaatgctga

SEQ ID NO: 39890 - DNA, 20 bp, Artificial Sequence
  Description of Artificial Sequence: Synthetic oligonucleotide
  Target: SCN9A; (+) strand; PAM type: NRG; PAM sequence: GAG
catacaagcaaatgctgagg

SEQ ID NO: 39891 - DNA, 20 bp, Artificial Sequence
  Description of Artificial Sequence: Synthetic oligonucleotide
  Target: SCN9A; (+) strand; PAM type: NRG; PAM sequence: TAG
ctgagggagttcatcaccac

SEQ ID NO: 39892 - DNA, 20 bp, Artificial Sequence
  Description of Artificial Sequence: Synthetic oligonucleotide
  Target: SCN9A; (+) strand; PAM type: NRG; PAM sequence: TAG
tcaccactagatttatctta

SEQ ID NO: 39893 - DNA, 20 bp, Artificial Sequence
  Description of Artificial Sequence: Synthetic oligonucleotide
  Target: SCN9A; (+) strand; PAM type: NRG; PAM sequence: AGG
caccactagatttatcttat

SEQ ID NO: 39894 - DNA, 20 bp, Artificial Sequence
  Description of Artificial Sequence: Synthetic oligonucleotide
  Target: SCN9A; (+) strand; PAM type: NRG; PAM sequence: AAG
ttatcttataggaaatgcta

SEQ ID NO: 39895 - DNA, 20 bp, Artificial Sequence
  Description of Artificial Sequence: Synthetic oligonucleotide
  Target: SCN9A; (+) strand; PAM type: NRG; PAM sequence: GAG
cttataggaaatgctaaagt

SEQ ID NO: 39896 - DNA, 20 bp, Artificial Sequence
  Description of Artificial Sequence: Synthetic oligonucleotide
  Target: SCN9A; (+) strand; PAM type: NRG; PAM sequence: AAG
aatgctaaagtgagttcttc

SEQ ID NO: 39897 - DNA, 20 bp, Artificial Sequence
  Description of Artificial Sequence: Synthetic oligonucleotide
  Target: SCN9A; (+) strand; PAM type: NRG; PAM sequence: AAG
agttcttcaagttgaaacga

SEQ ID NO: 39898 - DNA, 20 bp, Artificial Sequence
  Description of Artificial Sequence: Synthetic oligonucleotide
  Target: SCN9A; (+) strand; PAM type: NRG; PAM sequence: TGG
ttcaagttgaaacgaaagca

SEQ ID NO: 39899 - DNA, 20 bp, Artificial Sequence
  Description of Artificial Sequence: Synthetic oligonucleotide
  Target: SCN9A; (+) strand; PAM type: NRG; PAM sequence: AAG
gttgaaacgaaagcatggta

SEQ ID NO: 39900 - DNA, 20 bp, Artificial Sequence
  Description of Artificial Sequence: Synthetic oligonucleotide
  Target: SCN9A; (+) strand; PAM type: NRG; PAM sequence: GAG
tgaaacgaaagcatggtaaa

SEQ ID NO: 39901 - DNA, 20 bp, Artificial Sequence
  Description of Artificial Sequence: Synthetic oligonucleotide
  Target: SCN9A; (+) strand; PAM type: NRG; PAM sequence: AAG
agcatggtaaagagcaacac

SEQ ID NO: 39902 - DNA, 20 bp, Artificial Sequence
  Description of Artificial Sequence: Synthetic oligonucleotide
  Target: SCN9A; (+) strand; PAM type: NRG; PAM sequence: GAG
catggtaaagagcaacacaa

SEQ ID NO: 39903 - DNA, 20 bp, Artificial Sequence
  Description of Artificial Sequence: Synthetic oligonucleotide
  Target: SCN9A; (+) strand; PAM type: NRG; PAM sequence: AAG
agcaacacaagagcatatga

SEQ ID NO: 39904 - DNA, 20 bp, Artificial Sequence
  Description of Artificial Sequence: Synthetic oligonucleotide
  Target: SCN9A; (+) strand; PAM type: NRG; PAM sequence: TAG
tatgaaagcacaaatctcac

SEQ ID NO: 39905 - DNA, 20 bp, Artificial Sequence
  Description of Artificial Sequence: Synthetic oligonucleotide
  Target: SCN9A; (+) strand; PAM type: NRG; PAM sequence: AAG
aagcacaaatctcactagta

SEQ ID NO: 39906 - DNA, 20 bp, Artificial Sequence
  Description of Artificial Sequence: Synthetic oligonucleotide
  Target: SCN9A; (+) strand; PAM type: NRG; PAM sequence: AGG
agcacaaatctcactagtaa

SEQ ID NO: 39907 - DNA, 20 bp, Artificial Sequence
  Description of Artificial Sequence: Synthetic oligonucleotide
  Target: SCN9A; (+) strand; PAM type: NRG; PAM sequence: TGG
cactagtaaaggtaaataca

SEQ ID NO: 39908 - DNA, 20 bp, Artificial Sequence
  Description of Artificial Sequence: Synthetic oligonucleotide
  Target: SCN9A; (+) strand; PAM type: NRG; PAM sequence: TAG
aaggtaaatacatggacaaa

SEQ ID NO: 39909 - DNA, 20 bp, Artificial Sequence
  Description of Artificial Sequence: Synthetic oligonucleotide
  Target: SCN9A; (+) strand; PAM type: NRG; PAM sequence: GAG
ggtaaatacatggacaaata

SEQ ID NO: 39910 - DNA, 20 bp, Artificial Sequence
  Description of Artificial Sequence: Synthetic oligonucleotide
  Target: SCN9A; (+) strand; PAM type: NRG; PAM sequence: TAG
agaatactgtaatactctaa

SEQ ID NO: 39911 - DNA, 20 bp, Artificial Sequence
  Description of Artificial Sequence: Synthetic oligonucleotide
  Target: SCN9A; (+) strand; PAM type: NRG; PAM sequence: AAG
catttataattctaatataa

SEQ ID NO: 39912 - DNA, 20 bp, Artificial Sequence
  Description of Artificial Sequence: Synthetic oligonucleotide
  Target: SCN9A; (+) strand; PAM type: NRG; PAM sequence: AAG
agttaaatgtcaaaataatt

SEQ ID NO: 39913 - DNA, 20 bp, Artificial Sequence
  Description of Artificial Sequence: Synthetic oligonucleotide
  Target: SCN9A; (+) strand; PAM type: NRG; PAM sequence: TAG
aaattacaaaaatgtgtttg

SEQ ID NO: 39914 - DNA, 20 bp, Artificial Sequence
  Description of Artificial Sequence: Synthetic oligonucleotide
  Target: SCN9A; (+) strand; PAM type: NRG; PAM sequence: AAG
ttgtagaaacacattataaa

SEQ ID NO: 39915 - DNA, 20 bp, Artificial Sequence
  Description of Artificial Sequence: Synthetic oligonucleotide
  Target: SCN9A; (+) strand; PAM type: NRG; PAM sequence: AAG
gtaaattgtgacataacaaa

SEQ ID NO: 39916 - DNA, 20 bp, Artificial Sequence
  Description of Artificial Sequence: Synthetic oligonucleotide
  Target: SCN9A; (+) strand; PAM type: NRG; PAM sequence: GAG
tgtgacataacaaaaagtgt

SEQ ID NO: 39917 - DNA, 20 bp, Artificial Sequence
  Description of Artificial Sequence: Synthetic oligonucleotide
  Target: SCN9A; (+) strand; PAM type: NRG; PAM sequence: AGG
gtgacataacaaaaagtgtg

SEQ ID NO: 39918 - DNA, 20 bp, Artificial Sequence
  Description of Artificial Sequence: Synthetic oligonucleotide
  Target: SCN9A; (+) strand; PAM type: NRG; PAM sequence: GGG
tgacataacaaaaagtgtga

SEQ ID NO: 39919 - DNA, 20 bp, Artificial Sequence
  Description of Artificial Sequence: Synthetic oligonucleotide
  Target: SCN9A; (+) strand; PAM type: NRG; PAM sequence: GAG
acataacaaaaagtgtgagg

SEQ ID NO: 39920 - DNA, 20 bp, Artificial Sequence
  Description of Artificial Sequence: Synthetic oligonucleotide
  Target: SCN9A; (+) strand; PAM type: NRG; PAM sequence: AGG
cataacaaaaagtgtgaggg

SEQ ID NO: 39921 - DNA, 20 bp, Artificial Sequence
  Description of Artificial Sequence: Synthetic oligonucleotide
  Target: SCN9A; (+) strand; PAM type: NRG; PAM sequence: AAG
aagtgtgagggaggtattaa

SEQ ID NO: 39922 - DNA, 20 bp, Artificial Sequence
  Description of Artificial Sequence: Synthetic oligonucleotide
  Target: SCN9A; (+) strand; PAM type: NRG; PAM sequence: AAG
tgagggaggtattaaaagtg

SEQ ID NO: 39923 - DNA, 20 bp, Artificial Sequence
  Description of Artificial Sequence: Synthetic oligonucleotide
  Target: SCN9A; (+) strand; PAM type: NRG; PAM sequence: AAG
agatttttgatatatgattg

SEQ ID NO: 39924 - DNA, 20 bp, Artificial Sequence
  Description of Artificial Sequence: Synthetic oligonucleotide
  Target: SCN9A; (+) strand; PAM type: NRG; PAM sequence: AAG
tttgatatatgattgaagtt

SEQ ID NO: 39925 - DNA, 20 bp, Artificial Sequence
  Description of Artificial Sequence: Synthetic oligonucleotide
  Target: SCN9A; (+) strand; PAM type: NRG; PAM sequence: CAG
gattgaagttaagttgttat

SEQ ID NO: 39926 - DNA, 20 bp, Artificial Sequence
  Description of Artificial Sequence: Synthetic oligonucleotide
  Target: SCN9A; (+) strand; PAM type: NRG; PAM sequence: AAG
gttaagttgttatcagctta

SEQ ID NO: 39927 - DNA, 20 bp, Artificial Sequence
  Description of Artificial Sequence: Synthetic oligonucleotide
  Target: SCN9A; (+) strand; PAM type: NRG; PAM sequence: TAG
aagttgttatcagcttaaag

SEQ ID NO: 39928 - DNA, 20 bp, Artificial Sequence
  Description of Artificial Sequence: Synthetic oligonucleotide
  Target: SCN9A; (+) strand; PAM type: NRG; PAM sequence: AAG
agcttaaagtagactattat

SEQ ID NO: 39929 - DNA, 20 bp, Artificial Sequence
  Description of Artificial Sequence: Synthetic oligonucleotide
  Target: SCN9A; (+) strand; PAM type: NRG; PAM sequence: AAG
gattgcctcatgataaccac

SEQ ID NO: 39930 - DNA, 20 bp, Artificial Sequence
  Description of Artificial Sequence: Synthetic oligonucleotide
  Target: SCN9A; (+) strand; PAM type: NRG; PAM sequence: AGG
attgcctcatgataaccaca

SEQ ID NO: 39931 - DNA, 20 bp, Artificial Sequence
  Description of Artificial Sequence: Synthetic oligonucleotide
  Target: SCN9A; (+) strand; PAM type: NRG; PAM sequence: CAG
ggaaaatccacgtaaaaata

SEQ ID NO: 39932 - DNA, 20 bp, Artificial Sequence
  Description of Artificial Sequence: Synthetic oligonucleotide
  Target: SCN9A; (+) strand; PAM type: NRG; PAM sequence: AAG
gtaaaaatacagaaataaaa

SEQ ID NO: 39933 - DNA, 20 bp, Artificial Sequence
  Description of Artificial Sequence: Synthetic oligonucleotide
  Target: SCN9A; (+) strand; PAM type: NRG; PAM sequence: GAG
aaaaatacagaaataaaaaa

SEQ ID NO: 39934 - DNA, 20 bp, Artificial Sequence
  Description of Artificial Sequence: Synthetic oligonucleotide
  Target: SCN9A; (+) strand; PAM type: NRG; PAM sequence: TAG
gaaataaaaaagagaaatca

SEQ ID NO: 39935 - DNA, 20 bp, Artificial Sequence
  Description of Artificial Sequence: Synthetic oligonucleotide
  Target: SCN9A; (+) strand; PAM type: NRG; PAM sequence: AAG
aaaatatcatccaatcacaa

SEQ ID NO: 39936 - DNA, 20 bp, Artificial Sequence
  Description of Artificial Sequence: Synthetic oligonucleotide
  Target: SCN9A; (+) strand; PAM type: NRG; PAM sequence: AAG
atatcatccaatcacaaaag

SEQ ID NO: 39937 - DNA, 20 bp, Artificial Sequence
  Description of Artificial Sequence: Synthetic oligonucleotide
  Target: SCN9A; (+) strand; PAM type: NRG; PAM sequence: CAG
catccaatcacaaaagaaga

SEQ ID NO: 39938 - DNA, 20 bp, Artificial Sequence
  Description of Artificial Sequence: Synthetic oligonucleotide
  Target: SCN9A; (+) strand; PAM type: NRG; PAM sequence: AAG
aatcacaaaagaagacagtt

SEQ ID NO: 39939 - DNA, 20 bp, Artificial Sequence
  Description of Artificial Sequence: Synthetic oligonucleotide
  Target: SCN9A; (+) strand; PAM type: NRG; PAM sequence: GAG
tcacaaaagaagacagttaa

SEQ ID NO: 39940 - DNA, 20 bp, Artificial Sequence
  Description of Artificial Sequence: Synthetic oligonucleotide
  Target: SCN9A; (+) strand; PAM type: NRG; PAM sequence: GAG
acaaaagaagacagttaaga

SEQ ID NO: 39941 - DNA, 20 bp, Artificial Sequence
  Description of Artificial Sequence: Synthetic oligonucleotide
  Target: SCN9A; (+) strand; PAM type: NRG; PAM sequence: AAG
gaagacagttaagagagaaa

SEQ ID NO: 39942 - DNA, 20 bp, Artificial Sequence
  Description of Artificial Sequence: Synthetic oligonucleotide
  Target: SCN9A; (+) strand; PAM type: NRG; PAM sequence: CAG
acagttaagagagaaaaaga

SEQ ID NO: 39943 - DNA, 20 bp, Artificial Sequence
  Description of Artificial Sequence: Synthetic oligonucleotide
  Target: SCN9A; (+) strand; PAM type: NRG; PAM sequence: AAG
gagagaaaaagacagaaaaa

SEQ ID NO: 39944 - DNA, 20 bp, Artificial Sequence
  Description of Artificial Sequence: Synthetic oligonucleotide
  Target: SCN9A; (+) strand; PAM type: NRG; PAM sequence: CAG
agaaaaaaagaattacaaaa

SEQ ID NO: 39945 - DNA, 20 bp, Artificial Sequence
  Description of Artificial Sequence: Synthetic oligonucleotide
  Target: SCN9A; (+) strand; PAM type: NRG; PAM sequence: AAG
aaacagaaaaatttaacaaa

SEQ ID NO: 39946 - DNA, 20 bp, Artificial Sequence
  Description of Artificial Sequence: Synthetic oligonucleotide
  Target: SCN9A; (+) strand; PAM type: NRG; PAM sequence: AGG
aacagaaaaatttaacaaaa

SEQ ID NO: 39947 - DNA, 20 bp, Artificial Sequence
  Description of Artificial Sequence: Synthetic oligonucleotide
  Target: SCN9A; (+) strand; PAM type: NRG; PAM sequence: TAG
aaaatttaacaaaaaggcaa

SEQ ID NO: 39948 - DNA, 20 bp, Artificial Sequence
  Description of Artificial Sequence: Synthetic oligonucleotide
  Target: SCN9A; (+) strand; PAM type: NRG; PAM sequence: AAG
tttaacaaaaaggcaatagt

SEQ ID NO: 39949 - DNA, 20 bp, Artificial Sequence
  Description of Artificial Sequence: Synthetic oligonucleotide
  Target: SCN9A; (+) strand; PAM type: NRG; PAM sequence: TGG
atgattatttcaaatacaaa

SEQ ID NO: 39950 - DNA, 20 bp, Artificial Sequence
  Description of Artificial Sequence: Synthetic oligonucleotide
  Target: SCN9A; (+) strand; PAM type: NRG; PAM sequence: AAG
ggattaaacttcccaatcaa

SEQ ID NO: 39951 - DNA, 20 bp, Artificial Sequence
  Description of Artificial Sequence: Synthetic oligonucleotide
  Target: SCN9A; (+) strand; PAM type: NRG; PAM sequence: TGG
cccaatcaaaagacctacaa

SEQ ID NO: 39952 - DNA, 20 bp, Artificial Sequence
  Description of Artificial Sequence: Synthetic oligonucleotide
  Target: SCN9A; (+) strand; PAM type: NRG; PAM sequence: TAG
aaagacctacaatggctgca

SEQ ID NO: 39953 - DNA, 20 bp, Artificial Sequence
  Description of Artificial Sequence: Synthetic oligonucleotide
  Target: SCN9A; (+) strand; PAM type: NRG; PAM sequence: AAG
ctgcatagatttatgaaaac

SEQ ID NO: 39954 - DNA, 20 bp, Artificial Sequence
  Description of Artificial Sequence: Synthetic oligonucleotide
  Target: SCN9A; (+) strand; PAM type: NRG; PAM sequence: CAG
agatttatgaaaacaagatc

SEQ ID NO: 39955 - DNA, 20 bp, Artificial Sequence
  Description of Artificial Sequence: Synthetic oligonucleotide
  Target: SCN9A; (+) strand; PAM type: NRG; PAM sequence: CAG
atccagttatatgctgtctc

SEQ ID NO: 39956 - DNA, 20 bp, Artificial Sequence
  Description of Artificial Sequence: Synthetic oligonucleotide
  Target: SCN9A; (+) strand; PAM type: NRG; PAM sequence: CAG
ctgtctccagatactcgttt

SEQ ID NO: 39957 - DNA, 20 bp, Artificial Sequence
  Description of Artificial Sequence: Synthetic oligonucleotide
  Target: SCN9A; (+) strand; PAM type: NRG; PAM sequence: AAG
cagatactcgtttcagattt

SEQ ID NO: 39958 - DNA, 20 bp, Artificial Sequence
  Description of Artificial Sequence: Synthetic oligonucleotide
  Target: SCN9A; (+) strand; PAM type: NRG; PAM sequence: TAG
gtttcagatttaagaaaaca

SEQ ID NO: 39959 - DNA, 20 bp, Artificial Sequence
  Description of Artificial Sequence: Synthetic oligonucleotide
  Target: SCN9A; (+) strand; PAM type: NRG; PAM sequence: AAG
tttaagaaaacatagtttga

SEQ ID NO: 39960 - DNA, 20 bp, Artificial Sequence
  Description of Artificial Sequence: Synthetic oligonucleotide
  Target: SCN9A; (+) strand; PAM type: NRG; PAM sequence: AAG
ttgaaagttaattgataaaa

SEQ ID NO: 39961 - DNA, 20 bp, Artificial Sequence
  Description of Artificial Sequence: Synthetic oligonucleotide
  Target: SCN9A; (+) strand; PAM type: NRG; PAM sequence: TAG
gataaaaaagatacattttg

SEQ ID NO: 39962 - DNA, 20 bp, Artificial Sequence
  Description of Artificial Sequence: Synthetic oligonucleotide
  Target: SCN9A; (+) strand; PAM type: NRG; PAM sequence: TGG
aaagatacattttgtagaaa

SEQ ID NO: 39963 - DNA, 20 bp, Artificial Sequence
  Description of Artificial Sequence: Synthetic oligonucleotide
  Target: SCN9A; (+) strand; PAM type: NRG; PAM sequence: AAG
tttgtagaaatggtaaccaa

SEQ ID NO: 39964 - DNA, 20 bp, Artificial Sequence
  Description of Artificial Sequence: Synthetic oligonucleotide
  Target: SCN9A; (+) strand; PAM type: NRG; PAM sequence: GAG
tgtagaaatggtaaccaaaa

SEQ ID NO: 39965 - DNA, 20 bp, Artificial Sequence
  Description of Artificial Sequence: Synthetic oligonucleotide
  Target: SCN9A; (+) strand; PAM type: NRG; PAM sequence: GAG
tagaaatggtaaccaaaaga

SEQ ID NO: 39966 - DNA, 20 bp, Artificial Sequence
  Description of Artificial Sequence: Synthetic oligonucleotide
  Target: SCN9A; (+) strand; PAM type: NRG; PAM sequence: TGG
tggtaaccaaaagagagcaa

SEQ ID NO: 39967 - DNA, 20 bp, Artificial Sequence
  Description of Artificial Sequence: Synthetic oligonucleotide
  Target: SCN9A; (+) strand; PAM type: NRG; PAM sequence: GGG
ggtaaccaaaagagagcaat
